United States Patent 11,421,016 (CANCER NEOEPITOPES) - sequence listing, part 4

SEQ ID NO: 138312 - protein, 9 aa, Homo Sapiens
KTGIVSSFG

SEQ ID NO: 138313 - protein, 9 aa, Homo Sapiens
ETAAIITDT

SEQ ID NO: 138314 - protein, 9 aa, Homo Sapiens
LPAVVVLHG

SEQ ID NO: 138315 - protein, 9 aa, Homo Sapiens
NQRQEAVNE

SEQ ID NO: 138316 - protein, 9 aa, Homo Sapiens
LFHNKLGLF

SEQ ID NO: 138317 - protein, 9 aa, Homo Sapiens
DQEPLQEEI

SEQ ID NO: 138318 - protein, 9 aa, Homo Sapiens
SAWMVVRHG

SEQ ID NO: 138319 - protein, 9 aa, Homo Sapiens
YGIFPGNFT

SEQ ID NO: 138320 - protein, 9 aa, Homo Sapiens
HVTDASSES

SEQ ID NO: 138321 - protein, 9 aa, Homo Sapiens
DLKMGEFIR

SEQ ID NO: 138322 - protein, 9 aa, Homo Sapiens
FFYHFLGFT

SEQ ID NO: 138323 - protein, 9 aa, Homo Sapiens
IGMGAMTWS

SEQ ID NO: 138324 - protein, 9 aa, Homo Sapiens
TKGADIDVL

SEQ ID NO: 138325 - protein, 9 aa, Homo Sapiens
HQAEVKHLH

SEQ ID NO: 138326 - protein, 9 aa, Homo Sapiens
EFLASVFQD

SEQ ID NO: 138327 - protein, 9 aa, Homo Sapiens
DPACRELGY

SEQ ID NO: 138328 - protein, 9 aa, Homo Sapiens
GHTSHPLKQ

SEQ ID NO: 138329 - protein, 9 aa, Homo Sapiens
GNQRQEAVN

SEQ ID NO: 138330 - protein, 9 aa, Homo Sapiens
CLYRPCPPS

SEQ ID NO: 138331 - protein, 9 aa, Homo Sapiens
LGENEYFKV

SEQ ID NO: 138332 - protein, 9 aa, Homo Sapiens
RGQVDDRDE

SEQ ID NO: 138333 - protein, 9 aa, Homo Sapiens
FIPPLPSYN

SEQ ID NO: 138334 - protein, 9 aa, Homo Sapiens
ALPAVVVLH

SEQ ID NO: 138335 - protein, 9 aa, Homo Sapiens
WSTMPNRHQ

SEQ ID NO: 138336 - protein, 9 aa, Homo Sapiens
HPPQAPLPM

SEQ ID NO: 138337 - protein, 9 aa, Homo Sapiens
TLTIGITDI

SEQ ID NO: 138338 - protein, 9 aa, Homo Sapiens
ERGGVSAVP

SEQ ID NO: 138339 - protein, 9 aa, Homo Sapiens
WVRGQAGLA

SEQ ID NO: 138340 - protein, 9 aa, Homo Sapiens
ERALILDRL

SEQ ID NO: 138341 - protein, 9 aa, Homo Sapiens
ALPQFSSGA

SEQ ID NO: 138342 - protein, 9 aa, Homo Sapiens
HSGTTLISV

SEQ ID NO: 138343 - protein, 9 aa, Homo Sapiens
FLLYQMWTF

SEQ ID NO: 138344 - protein, 9 aa, Homo Sapiens
MGEFIRNLV

SEQ ID NO: 138345 - protein, 9 aa, Homo Sapiens
VLHGLFGSK

SEQ ID NO: 138346 - protein, 9 aa, Homo Sapiens
VLGILQLRR

SEQ ID NO: 138347 - protein, 9 aa, Homo Sapiens
KHLHHLLKQ

SEQ ID NO: 138348 - protein, 9 aa, Homo Sapiens
DAVLGILQL

SEQ ID NO: 138349 - protein, 9 aa, Homo Sapiens
TVWGFRIYG

SEQ ID NO: 138350 - protein, 9 aa, Homo Sapiens
DCVSIVVQK

SEQ ID NO: 138351 - protein, 9 aa, Homo Sapiens
QLEGYLSLA

SEQ ID NO: 138352 - protein, 9 aa, Homo Sapiens
LGIIMGYVD

SEQ ID NO: 138353 - protein, 9 aa, Homo Sapiens
KGLNLFHNK

SEQ ID NO: 138354 - protein, 9 aa, Homo Sapiens
LQQYARCIP

SEQ ID NO: 138355 - protein, 9 aa, Homo Sapiens
VLKPFFLRR

SEQ ID NO: 138356 - protein, 9 aa, Homo Sapiens
RKNRCNNMG

SEQ ID NO: 138357 - protein, 9 aa, Homo Sapiens
VTPEIPARL

SEQ ID NO: 138358 - protein, 9 aa, Homo Sapiens
LAIIVFISA

SEQ ID NO: 138359 - protein, 9 aa, Homo Sapiens
LKRERVDLS

SEQ ID NO: 138360 - protein, 9 aa, Homo Sapiens
LDPCNAELI

SEQ ID NO: 138361 - protein, 9 aa, Homo Sapiens
YCIEAELKA

SEQ ID NO: 138362 - protein, 9 aa, Homo Sapiens
VFRQQVHAM

SEQ ID NO: 138363 - protein, 9 aa, Homo Sapiens
RWFQLYRSM

SEQ ID NO: 138364 - protein, 9 aa, Homo Sapiens
RQREDQEPL

SEQ ID NO: 138365 - protein, 9 aa, Homo Sapiens
HHLLKQLKP

SEQ ID NO: 138366 - protein, 9 aa, Homo Sapiens
MYRNMLINC

SEQ ID NO: 138367 - protein, 9 aa, Homo Sapiens
HREKGDLAL

SEQ ID NO: 138368 - protein, 9 aa, Homo Sapiens
EDTEDGISF

SEQ ID NO: 138369 - protein, 9 aa, Homo Sapiens
SSLRRVPRR

SEQ ID NO: 138370 - protein, 9 aa, Homo Sapiens
VHTVEKPYD

SEQ ID NO: 138371 - protein, 9 aa, Homo Sapiens
NQTYSFSPF

SEQ ID NO: 138372 - protein, 9 aa, Homo Sapiens
LSVVFALEL

SEQ ID NO: 138373 - protein, 9 aa, Homo Sapiens
QWAGEMTDV

SEQ ID NO: 138374 - protein, 9 aa, Homo Sapiens
RKQVSGPEH

SEQ ID NO: 138375 - protein, 9 aa, Homo Sapiens
KECGKSFSH

SEQ ID NO: 138376 - protein, 9 aa, Homo Sapiens
APWMVNREL

SEQ ID NO: 138377 - protein, 9 aa, Homo Sapiens
GPLWPPGQK

SEQ ID NO: 138378 - protein, 9 aa, Homo Sapiens
PPEERSFSF

SEQ ID NO: 138379 - protein, 9 aa, Homo Sapiens
DGCIQLALN

SEQ ID NO: 138380 - protein, 9 aa, Homo Sapiens
ISREDGYID

SEQ ID NO: 138381 - protein, 9 aa, Homo Sapiens
LLPLTSRSS

SEQ ID NO: 138382 - protein, 9 aa, Homo Sapiens
HTIPITREE

SEQ ID NO: 138383 - protein, 9 aa, Homo Sapiens
LKMHSTNGR

SEQ ID NO: 138384 - protein, 9 aa, Homo Sapiens
MAEIQMRLA

SEQ ID NO: 138385 - protein, 9 aa, Homo Sapiens
CSPLPFLNN

SEQ ID NO: 138386 - protein, 9 aa, Homo Sapiens
MRPPPWSDT

SEQ ID NO: 138387 - protein, 9 aa, Homo Sapiens
DVVPDTRHL

SEQ ID NO: 138388 - protein, 9 aa, Homo Sapiens
HSPPEERSF

SEQ ID NO: 138389 - protein, 9 aa, Homo Sapiens
AEIQMRLAY

SEQ ID NO: 138390 - protein, 9 aa, Homo Sapiens
SAQLEGYLS

SEQ ID NO: 138391 - protein, 9 aa, Homo Sapiens
DLKVFLLRH

SEQ ID NO: 138392 - protein, 9 aa, Homo Sapiens
RQWAGEMTD

SEQ ID NO: 138393 - protein, 9 aa, Homo Sapiens
LNGGKDPIG

SEQ ID NO: 138394 - protein, 9 aa, Homo Sapiens
GNFTFNLLM

SEQ ID NO: 138395 - protein, 9 aa, Homo Sapiens
GVFYISRED

SEQ ID NO: 138396 - protein, 9 aa, Homo Sapiens
ISFQPYIEP

SEQ ID NO: 138397 - protein, 9 aa, Homo Sapiens
SEFLVEESL

SEQ ID NO: 138398 - protein, 9 aa, Homo Sapiens
DSAVKPERA

SEQ ID NO: 138399 - protein, 9 aa, Homo Sapiens
PAFREALTK

SEQ ID NO: 138400 - protein, 9 aa, Homo Sapiens
RVHTVEKPY

SEQ ID NO: 138401 - protein, 9 aa, Homo Sapiens
VRDWQLEKE

SEQ ID NO: 138402 - protein, 9 aa, Homo Sapiens
GDQFHPTPP

SEQ ID NO: 138403 - protein, 9 aa, Homo Sapiens
LFRVPREKE

SEQ ID NO: 138404 - protein, 9 aa, Homo Sapiens
MKEFLASVF

SEQ ID NO: 138405 - protein, 9 aa, Homo Sapiens
MTADSAWMV

SEQ ID NO: 138406 - protein, 9 aa, Homo Sapiens
LEKDPVPLF

SEQ ID NO: 138407 - protein, 9 aa, Homo Sapiens
ALEALPQFS

SEQ ID NO: 138408 - protein, 9 aa, Homo Sapiens
PSAFDVGYI

SEQ ID NO: 138409 - protein, 9 aa, Homo Sapiens
HPSNRSARA

SEQ ID NO: 138410 - protein, 9 aa, Homo Sapiens
DLAHRVNLT

SEQ ID NO: 138411 - protein, 9 aa, Homo Sapiens
LHRGCPLLC

SEQ ID NO: 138412 - protein, 9 aa, Homo Sapiens
RRAMITPAF

SEQ ID NO: 138413 - protein, 9 aa, Homo Sapiens
FLGFTECFL

SEQ ID NO: 138414 - protein, 9 aa, Homo Sapiens
SLEVDVFLG

SEQ ID NO: 138415 - protein, 9 aa, Homo Sapiens
VGYILVHLA

SEQ ID NO: 138416 - protein, 9 aa, Homo Sapiens
QREDQEPLQ

SEQ ID NO: 138417 - protein, 9 aa, Homo Sapiens
FHNKLGLFP

SEQ ID NO: 138418 - protein, 9 aa, Homo Sapiens
ILVHLAIRF

SEQ ID NO: 138419 - protein, 9 aa, Homo Sapiens
IYPCPNTVD

SEQ ID NO: 138420 - protein, 9 aa, Homo Sapiens
LQLRRKFER

SEQ ID NO: 138421 - protein, 9 aa, Homo Sapiens
PEQDRPLFR

SEQ ID NO: 138422 - protein, 9 aa, Homo Sapiens
EALPLERED

SEQ ID NO: 138423 - protein, 9 aa, Homo Sapiens
ELIILGRNT

SEQ ID NO: 138424 - protein, 9 aa, Homo Sapiens
KEKEPETQK

SEQ ID NO: 138425 - protein, 9 aa, Homo Sapiens
LILDRLASN

SEQ ID NO: 138426 - protein, 9 aa, Homo Sapiens
GAQGDWSAS

SEQ ID NO: 138427 - protein, 9 aa, Homo Sapiens
EEPTSYYSS

SEQ ID NO: 138428 - protein, 9 aa, Homo Sapiens
SLMASEDEY

SEQ ID NO: 138429 - protein, 9 aa, Homo Sapiens
YPDCVSIVV

SEQ ID NO: 138430 - protein, 9 aa, Homo Sapiens
NVRLLPLTS

SEQ ID NO: 138431 - protein, 9 aa, Homo Sapiens
GILQLRRKF

SEQ ID NO: 138432 - protein, 9 aa, Homo Sapiens
TPAFREALT

SEQ ID NO: 138433 - protein, 9 aa, Homo Sapiens
HNARGGGNQ

SEQ ID NO: 138434 - protein, 9 aa, Homo Sapiens
PEIPARLPS

SEQ ID NO: 138435 - protein, 9 aa, Homo Sapiens
SAFDVGYIL

SEQ ID NO: 138436 - protein, 9 aa, Homo Sapiens
WGFRIYGSP

SEQ ID NO: 138437 - protein, 9 aa, Homo Sapiens
FDVGYILVH

SEQ ID NO: 138438 - protein, 9 aa, Homo Sapiens
VPSGLPRHV

SEQ ID NO: 138439 - protein, 9 aa, Homo Sapiens
LMGPLWPPG

SEQ ID NO: 138440 - protein, 9 aa, Homo Sapiens
TSYYSSPGS

SEQ ID NO: 138441 - protein, 9 aa, Homo Sapiens
LCLYRPCPP

SEQ ID NO: 138442 - protein, 9 aa, Homo Sapiens
LHQRVHTVE

SEQ ID NO: 138443 - protein, 9 aa, Homo Sapiens
KVFLLRHPP

SEQ ID NO: 138444 - protein, 9 aa, Homo Sapiens
ATLTIGITD

SEQ ID NO: 138445 - protein, 9 aa, Homo Sapiens
VRLLPLTSR

SEQ ID NO: 138446 - protein, 9 aa, Homo Sapiens
GMQQPPLPP

SEQ ID NO: 138447 - protein, 9 aa, Homo Sapiens
GPQERGGVS

SEQ ID NO: 138448 - protein, 9 aa, Homo Sapiens
REDLAHRVN

SEQ ID NO: 138449 - protein, 9 aa, Homo Sapiens
LMNPGDQFH

SEQ ID NO: 138450 - protein, 9 aa, Homo Sapiens
GASPPDPAC

SEQ ID NO: 138451 - protein, 9 aa, Homo Sapiens
LLEKDPVPL

SEQ ID NO: 138452 - protein, 9 aa, Homo Sapiens
VPAAPPAGL

SEQ ID NO: 138453 - protein, 9 aa, Homo Sapiens
EDDKFFLPK

SEQ ID NO: 138454 - protein, 9 aa, Homo Sapiens
CRMSGKYPN

SEQ ID NO: 138455 - protein, 9 aa, Homo Sapiens
IPARLPSPR

SEQ ID NO: 138456 - protein, 9 aa, Homo Sapiens
FSPFKSYSR

SEQ ID NO: 138457 - protein, 9 aa, Homo Sapiens
TNVAQIHMA

SEQ ID NO: 138458 - protein, 9 aa, Homo Sapiens
CNAELIILG

SEQ ID NO: 138459 - protein, 9 aa, Homo Sapiens
RDWQLEKEY

SEQ ID NO: 138460 - protein, 9 aa, Homo Sapiens
ACRELGYRA

SEQ ID NO: 138461 - protein, 9 aa, Homo Sapiens
TLILSSFFV

SEQ ID NO: 138462 - protein, 9 aa, Homo Sapiens
RPPVTPRLV

SEQ ID NO: 138463 - protein, 9 aa, Homo Sapiens
QLKGLNLFH

SEQ ID NO: 138464 - protein, 9 aa, Homo Sapiens
GSERALILD

SEQ ID NO: 138465 - protein, 9 aa, Homo Sapiens
QPPLPPQPP

SEQ ID NO: 138466 - protein, 9 aa, Homo Sapiens
FISAVVGMQ

SEQ ID NO: 138467 - protein, 9 aa, Homo Sapiens
VLLNFSSPW

SEQ ID NO: 138468 - protein, 9 aa, Homo Sapiens
EHTIPITRE

SEQ ID NO: 138469 - protein, 9 aa, Homo Sapiens
RGEVNRHSA

SEQ ID NO: 138470 - protein, 9 aa, Homo Sapiens
HKIGMGAMT

SEQ ID NO: 138471 - protein, 9 aa, Homo Sapiens
AIITDTSFL

SEQ ID NO: 138472 - protein, 9 aa, Homo Sapiens
EDGISFQPY

SEQ ID NO: 138473 - protein, 9 aa, Homo Sapiens
PSIPTMAAS

SEQ ID NO: 138474 - protein, 9 aa, Homo Sapiens
VKPERAATP

SEQ ID NO: 138475 - protein, 9 aa, Homo Sapiens
DKPEDGHTS

SEQ ID NO: 138476 - protein, 9 aa, Homo Sapiens
TSPLKEEER

SEQ ID NO: 138477 - protein, 9 aa, Homo Sapiens
CRELGYRAG

SEQ ID NO: 138478 - protein, 9 aa, Homo Sapiens
VTDASSEST

SEQ ID NO: 138479 - protein, 9 aa, Homo Sapiens
FSSPWVGIS

SEQ ID NO: 138480 - protein, 9 aa, Homo Sapiens
DFLNPSDSI

SEQ ID NO: 138481 - protein, 9 aa, Homo Sapiens
GEVNRHSAN

SEQ ID NO: 138482 - protein, 9 aa, Homo Sapiens
RLDNIFLTP

SEQ ID NO: 138483 - protein, 9 aa, Homo Sapiens
VFQDFDVSL

SEQ ID NO: 138484 - protein, 9 aa, Homo Sapiens
IDRFCLNGG

SEQ ID NO: 138485 - protein, 9 aa, Homo Sapiens
VTPRLVVPA

SEQ ID NO: 138486 - protein, 9 aa, Homo Sapiens
VELGDVQGA

SEQ ID NO: 138487 - protein, 9 aa, Homo Sapiens
SSATPVHDS

SEQ ID NO: 138488 - protein, 9 aa, Homo Sapiens
SATPVHDSV

SEQ ID NO: 138489 - protein, 9 aa, Homo Sapiens
NPFIYSLSN

SEQ ID NO: 138490 - protein, 9 aa, Homo Sapiens
FTECFLYTV

SEQ ID NO: 138491 - protein, 9 aa, Homo Sapiens
ASSESTGHA

SEQ ID NO: 138492 - protein, 9 aa, Homo Sapiens
ACGVGKSAL

SEQ ID NO: 138493 - protein, 9 aa, Homo Sapiens
HRLTLHKED

SEQ ID NO: 138494 - protein, 9 aa, Homo Sapiens
FEAHNARGG

SEQ ID NO: 138495 - protein, 9 aa, Homo Sapiens
DRPLFRVPR

SEQ ID NO: 138496 - protein, 9 aa, Homo Sapiens
FSECMIQIF

SEQ ID NO: 138497 - protein, 9 aa, Homo Sapiens
PAHSGTTLI

SEQ ID NO: 138498 - protein, 9 aa, Homo Sapiens
RPLFRVPRE

SEQ ID NO: 138499 - protein, 9 aa, Homo Sapiens
LRKKIGGLY

SEQ ID NO: 138500 - protein, 9 aa, Homo Sapiens
GARDTLWVR

SEQ ID NO: 138501 - protein, 9 aa, Homo Sapiens
VNRHSANNF

SEQ ID NO: 138502 - protein, 9 aa, Homo Sapiens
ERQKKDNQN

SEQ ID NO: 138503 - protein, 9 aa, Homo Sapiens
SLSNKDMKQ

SEQ ID NO: 138504 - protein, 9 aa, Homo Sapiens
PTEKSTIPP

SEQ ID NO: 138505 - protein, 9 aa, Homo Sapiens
TSKNAIRKR

SEQ ID NO: 138506 - protein, 9 aa, Homo Sapiens
YQVVTISSS

SEQ ID NO: 138507 - protein, 9 aa, Homo Sapiens
DYQVVTISS

SEQ ID NO: 138508 - protein, 9 aa, Homo Sapiens
IVPSIPTMA

SEQ ID NO: 138509 - protein, 9 aa, Homo Sapiens
VEEPTSYYS

SEQ ID NO: 138510 - protein, 9 aa, Homo Sapiens
HSANNFYSM

SEQ ID NO: 138511 - protein, 9 aa, Homo Sapiens
SSDTVFLLD

SEQ ID NO: 138512 - protein, 9 aa, Homo Sapiens
RLTLHKEDS

SEQ ID NO: 138513 - protein, 9 aa, Homo Sapiens
CKDFNCTPG

SEQ ID NO: 138514 - protein, 9 aa, Homo Sapiens
FTVSYSSAT

SEQ ID NO: 138515 - protein, 9 aa, Homo Sapiens
KYPNSVSIS

SEQ ID NO: 138516 - protein, 9 aa, Homo Sapiens
TPAHSGTTL

SEQ ID NO: 138517 - protein, 9 aa, Homo Sapiens
LFFYHFLGF

SEQ ID NO: 138518 - protein, 9 aa, Homo Sapiens
LTSRSSAQS

SEQ ID NO: 138519 - protein, 9 aa, Homo Sapiens
AELIILGRN

SEQ ID NO: 138520 - protein, 9 aa, Homo Sapiens
LLYQMWTFS

SEQ ID NO: 138521 - protein, 9 aa, Homo Sapiens
HEQVRDWQL

SEQ ID NO: 138522 - protein, 9 aa, Homo Sapiens
PLLCRWLCR

SEQ ID NO: 138523 - protein, 9 aa, Homo Sapiens
LWVRGQAGL

SEQ ID NO: 138524 - protein, 9 aa, Homo Sapiens
MGERQWAGE

SEQ ID NO: 138525 - protein, 9 aa, Homo Sapiens
LCNLMVADL

SEQ ID NO: 138526 - protein, 9 aa, Homo Sapiens
FSSDPQKAS

SEQ ID NO: 138527 - protein, 9 aa, Homo Sapiens
WFKEDDKFF

SEQ ID NO: 138528 - protein, 9 aa, Homo Sapiens
AALPAVVVL

SEQ ID NO: 138529 - protein, 9 aa, Homo Sapiens
PVTPRLVVP

SEQ ID NO: 138530 - protein, 9 aa, Homo Sapiens
SLGIIMGYV

SEQ ID NO: 138531 - protein, 9 aa, Homo Sapiens
LFHKIGMGA

SEQ ID NO: 138532 - protein, 9 aa, Homo Sapiens
AFVREDLAH

SEQ ID NO: 138533 - protein, 9 aa, Homo Sapiens
KRVSILSKP

SEQ ID NO: 138534 - protein, 9 aa, Homo Sapiens
PPAGLQVPQ

SEQ ID NO: 138535 - protein, 9 aa, Homo Sapiens
DVGYILVHL

SEQ ID NO: 138536 - protein, 9 aa, Homo Sapiens
KPEDGHTSH

SEQ ID NO: 138537 - protein, 9 aa, Homo Sapiens
SVVFALELN

SEQ ID NO: 138538 - protein, 9 aa, Homo Sapiens
KRERVDLSK

SEQ ID NO: 138539 - protein, 9 aa, Homo Sapiens
ALMKDGCIQ

SEQ ID NO: 138540 - protein, 9 aa, Homo Sapiens
SDPQKASCR

SEQ ID NO: 138541 - protein, 9 aa, Homo Sapiens
AAPPAGLQV

SEQ ID NO: 138542 - protein, 9 aa, Homo Sapiens
MVADLFYIC

SEQ ID NO: 138543 - protein, 9 aa, Homo Sapiens
PPLPSYNPN

SEQ ID NO: 138544 - protein, 9 aa, Homo Sapiens
YVYMRPPPW

SEQ ID NO: 138545 - protein, 9 aa, Homo Sapiens
IPPLPSYNP

SEQ ID NO: 138546 - protein, 9 aa, Homo Sapiens
IGITDINDN

SEQ ID NO: 138547 - protein, 9 aa, Homo Sapiens
PAVVVLHGL

SEQ ID NO: 138548 - protein, 9 aa, Homo Sapiens
VVLHGLFGS

SEQ ID NO: 138549 - protein, 9 aa, Homo Sapiens
DKQWSTMPN

SEQ ID NO: 138550 - protein, 9 aa, Homo Sapiens
QRQEAVNES

SEQ ID NO: 138551 - protein, 9 aa, Homo Sapiens
LVEEPTSYY

SEQ ID NO: 138552 - protein, 9 aa, Homo Sapiens
YRPCPPSRG

SEQ ID NO: 138553 - protein, 9 aa, Homo Sapiens
KRWFQLYRS

SEQ ID NO: 138554 - protein, 9 aa, Homo Sapiens
LGVYLCNLM

SEQ ID NO: 138555 - protein, 9 aa, Homo Sapiens
LVKCDIYPC

SEQ ID NO: 138556 - protein, 9 aa, Homo Sapiens
SERALILDR

SEQ ID NO: 138557 - protein, 9 aa, Homo Sapiens
AELKANILP

SEQ ID NO: 138558 - protein, 9 aa, Homo Sapiens
PEERSFSFT

SEQ ID NO: 138559 - protein, 9 aa, Homo Sapiens
HMAYRYETW

SEQ ID NO: 138560 - protein, 9 aa, Homo Sapiens
ELFHKIGMG

SEQ ID NO: 138561 - protein, 9 aa, Homo Sapiens
EVTVWGFRI

SEQ ID NO: 138562 - protein, 9 aa, Homo Sapiens
KVVFRQQVH

SEQ ID NO: 138563 - protein, 9 aa, Homo Sapiens
IHYEILIHD

SEQ ID NO: 138564 - protein, 9 aa, Homo Sapiens
KLWDLKMGE

SEQ ID NO: 138565 - protein, 9 aa, Homo Sapiens
IVFISAVVG

SEQ ID NO: 138566 - protein, 9 aa, Homo Sapiens
AWTLFSTWP

SEQ ID NO: 138567 - protein, 9 aa, Homo Sapiens
RLLEKDPVP

SEQ ID NO: 138568 - protein, 9 aa, Homo Sapiens
ADCKDFNCT

SEQ ID NO: 138569 - protein, 9 aa, Homo Sapiens
GKAGPQERG

SEQ ID NO: 138570 - protein, 9 aa, Homo Sapiens
IRAMRGQVN

SEQ ID NO: 138571 - protein, 9 aa, Homo Sapiens
RQDYIQMIL

SEQ ID NO: 138572 - protein, 9 aa, Homo Sapiens
PGDQFHPTP

SEQ ID NO: 138573 - protein, 9 aa, Homo Sapiens
IGGVRGMWC

SEQ ID NO: 138574 - protein, 9 aa, Homo Sapiens
FLASVFQDF

SEQ ID NO: 138575 - protein, 9 aa, Homo Sapiens
LLCRWLCRR

SEQ ID NO: 138576 - protein, 9 aa, Homo Sapiens
AASRPPVTP

SEQ ID NO: 138577 - protein, 9 aa, Homo Sapiens
RVSILSKPR

SEQ ID NO: 138578 - protein, 9 aa, Homo Sapiens
QHLPAATRA

SEQ ID NO: 138579 - protein, 9 aa, Homo Sapiens
VYMRPPPWS

SEQ ID NO: 138580 - protein, 9 aa, Homo Sapiens
VAQIHMAYR

SEQ ID NO: 138581 - protein, 9 aa, Homo Sapiens
FFVYLVEKD

SEQ ID NO: 138582 - protein, 9 aa, Homo Sapiens
ELKANILPA

SEQ ID NO: 138583 - protein, 9 aa, Homo Sapiens
TPVHDSVGV

SEQ ID NO: 138584 - protein, 9 aa, Homo Sapiens
HLHHLLKQL

SEQ ID NO: 138585 - protein, 9 aa, Homo Sapiens
NMTADSAWM

SEQ ID NO: 138586 - protein, 9 aa, Homo Sapiens
KVMCILVHG

SEQ ID NO: 138587 - protein, 9 aa, Homo Sapiens
AAWTLFSTW

SEQ ID NO: 138588 - protein, 9 aa, Homo Sapiens
VMCILVHGD

SEQ ID NO: 138589 - protein, 9 aa, Homo Sapiens
NCTPGSRQA

SEQ ID NO: 138590 - protein, 9 aa, Homo Sapiens
WKKRLRHRV

SEQ ID NO: 138591 - protein, 9 aa, Homo Sapiens
APPAGLQVP

SEQ ID NO: 138592 - protein, 9 aa, Homo Sapiens
MRGQVNYSK

SEQ ID NO: 138593 - protein, 9 aa, Homo Sapiens
PMHWSNVGG

SEQ ID NO: 138594 - protein, 9 aa, Homo Sapiens
RGQVNYSKI

SEQ ID NO: 138595 - protein, 9 aa, Homo Sapiens
RTEYVYMRP

SEQ ID NO: 138596 - protein, 9 aa, Homo Sapiens
PQERGGVSA

SEQ ID NO: 138597 - protein, 9 aa, Homo Sapiens
HAVLKPFFL

SEQ ID NO: 138598 - protein, 9 aa, Homo Sapiens
WIIFNVSSD

SEQ ID NO: 138599 - protein, 9 aa, Homo Sapiens
SSFGRTHEK

SEQ ID NO: 138600 - protein, 9 aa, Homo Sapiens
LFSTWPNGS

SEQ ID NO: 138601 - protein, 9 aa, Homo Sapiens
LWPPGQKGS

SEQ ID NO: 138602 - protein, 9 aa, Homo Sapiens
IIFNVSSDT

SEQ ID NO: 138603 - protein, 9 aa, Homo Sapiens
CFYSYLTGS

SEQ ID NO: 138604 - protein, 9 aa, Homo Sapiens
GISSLRRVP

SEQ ID NO: 138605 - protein, 9 aa, Homo Sapiens
RFCLNGGKD

SEQ ID NO: 138606 - protein, 9 aa, Homo Sapiens
QSRHRAEAL

SEQ ID NO: 138607 - protein, 9 aa, Homo Sapiens
LLKRERVDL

SEQ ID NO: 138608 - protein, 9 aa, Homo Sapiens
SEDEYSTKE

SEQ ID NO: 138609 - protein, 9 aa, Homo Sapiens
HLLLKRERV

SEQ ID NO: 138610 - protein, 9 aa, Homo Sapiens
VDGGTPAHS

SEQ ID NO: 138611 - protein, 9 aa, Homo Sapiens
SRSSAQSPL

SEQ ID NO: 138612 - protein, 9 aa, Homo Sapiens
ILKMHSTNG

SEQ ID NO: 138613 - protein, 9 aa, Homo Sapiens
EAPKRVSIL

SEQ ID NO: 138614 - protein, 9 aa, Homo Sapiens
QQPPLPPQP

SEQ ID NO: 138615 - protein, 9 aa, Homo Sapiens
SPLKEEERE

SEQ ID NO: 138616 - protein, 9 aa, Homo Sapiens
TADSAWMVV

SEQ ID NO: 138617 - protein, 9 aa, Homo Sapiens
AMRGQVNYS

SEQ ID NO: 138618 - protein, 9 aa, Homo Sapiens
EGTHREKGD

SEQ ID NO: 138619 - protein, 9 aa, Homo Sapiens
NIRHSPPEE

SEQ ID NO: 138620 - protein, 9 aa, Homo Sapiens
ASRPPVTPR

SEQ ID NO: 138621 - protein, 9 aa, Homo Sapiens
CLDLLVGNQ

SEQ ID NO: 138622 - protein, 9 aa, Homo Sapiens
QWNQRWGRH

SEQ ID NO: 138623 - protein, 9 aa, Homo Sapiens
ILQLRRKFE

SEQ ID NO: 138624 - protein, 9 aa, Homo Sapiens
NRHSANNFY

SEQ ID NO: 138625 - protein, 9 aa, Homo Sapiens
KMGEFIRNL

SEQ ID NO: 138626 - protein, 9 aa, Homo Sapiens
WQLEKEYVC

SEQ ID NO: 138627 - protein, 9 aa, Homo Sapiens
AVVVLHGLF

SEQ ID NO: 138628 - protein, 9 aa, Homo Sapiens
RHSANNFYS

SEQ ID NO: 138629 - protein, 9 aa, Homo Sapiens
INCENQCVI

SEQ ID NO: 138630 - protein, 9 aa, Homo Sapiens
KDSAVKPER

SEQ ID NO: 138631 - protein, 9 aa, Homo Sapiens
NCENQCVII

SEQ ID NO: 138632 - protein, 9 aa, Homo Sapiens
ERGEVNRHS

SEQ ID NO: 138633 - protein, 9 aa, Homo Sapiens
QRWKKRLRH

SEQ ID NO: 138634 - protein, 9 aa, Homo Sapiens
FHALMKDGC

SEQ ID NO: 138635 - protein, 9 aa, Homo Sapiens
SDKQWSTMP

SEQ ID NO: 138636 - protein, 9 aa, Homo Sapiens
SNVRLLPLT

SEQ ID NO: 138637 - protein, 9 aa, Homo Sapiens
IFNVSSDTV

SEQ ID NO: 138638 - protein, 9 aa, Homo Sapiens
LLERGQVDD

SEQ ID NO: 138639 - protein, 9 aa, Homo Sapiens
EYVYMRPPP

SEQ ID NO: 138640 - protein, 9 aa, Homo Sapiens
TAAIITDTS

SEQ ID NO: 138641 - protein, 9 aa, Homo Sapiens
VSILSKPRA

SEQ ID NO: 138642 - protein, 9 aa, Homo Sapiens
STIPPEKPT

SEQ ID NO: 138643 - protein, 9 aa, Homo Sapiens
TEDGISFQP

SEQ ID NO: 138644 - protein, 9 aa, Homo Sapiens
DSAWMVVRH

SEQ ID NO: 138645 - protein, 9 aa, Homo Sapiens
TQKDEKMSK

SEQ ID NO: 138646 - protein, 9 aa, Homo Sapiens
GGVRGMWCF

SEQ ID NO: 138647 - protein, 9 aa, Homo Sapiens
VYLCNLMVA

SEQ ID NO: 138648 - protein, 9 aa, Homo Sapiens
FLNPSDSIS

SEQ ID NO: 138649 - protein, 9 aa, Homo Sapiens
HRVNLTEAR

SEQ ID NO: 138650 - protein, 9 aa, Homo Sapiens
KDNQNLIER

SEQ ID NO: 138651 - protein, 9 aa, Homo Sapiens
QKTGIVSSF

SEQ ID NO: 138652 - protein, 9 aa, Homo Sapiens
GYILVHLAI

SEQ ID NO: 138653 - protein, 9 aa, Homo Sapiens
KPERAATPH

SEQ ID NO: 138654 - protein, 9 aa, Homo Sapiens
HALMKDGCI

SEQ ID NO: 138655 - protein, 9 aa, Homo Sapiens
MRLAYVCCV

SEQ ID NO: 138656 - protein, 9 aa, Homo Sapiens
TKMGERQWA

SEQ ID NO: 138657 - protein, 9 aa, Homo Sapiens
DGQRLLERG

SEQ ID NO: 138658 - protein, 9 aa, Homo Sapiens
LELFDQLHG

SEQ ID NO: 138659 - protein, 9 aa, Homo Sapiens
ISAVVGMQL

SEQ ID NO: 138660 - protein, 9 aa, Homo Sapiens
QVHAMAVSE

SEQ ID NO: 138661 - protein, 9 aa, Homo Sapiens
QTCHQAEVK

SEQ ID NO: 138662 - protein, 9 aa, Homo Sapiens
HGLVLVDLK

SEQ ID NO: 138663 - protein, 9 aa, Homo Sapiens
EALPQFSSG

SEQ ID NO: 138664 - protein, 9 aa, Homo Sapiens
EMKTTSPLK

SEQ ID NO: 138665 - protein, 9 aa, Homo Sapiens
RAMITPAFR

SEQ ID NO: 138666 - protein, 9 aa, Homo Sapiens
TWPNGSCIF

SEQ ID NO: 138667 - protein, 9 aa, Homo Sapiens
PPDPACREL

SEQ ID NO: 138668 - protein, 9 aa, Homo Sapiens
KSTIPPEKP

SEQ ID NO: 138669 - protein, 9 aa, Homo Sapiens
TLHQRVHTV

SEQ ID NO: 138670 - protein, 9 aa, Homo Sapiens
EGYLSLADK

SEQ ID NO: 138671 - protein, 9 aa, Homo Sapiens
FQDFDVSLN

SEQ ID NO: 138672 - protein, 9 aa, Homo Sapiens
KCDIYPCPN

SEQ ID NO: 138673 - protein, 9 aa, Homo Sapiens
KYCIEAELK

SEQ ID NO: 138674 - protein, 9 aa, Homo Sapiens
LSVVESVVK

SEQ ID NO: 138675 - protein, 9 aa, Homo Sapiens
PDTRHLDKF

SEQ ID NO: 138676 - protein, 9 aa, Homo Sapiens
ASEDEYSTK

SEQ ID NO: 138677 - protein, 9 aa, Homo Sapiens
AQGDWSASL

SEQ ID NO: 138678 - protein, 9 aa, Homo Sapiens
KLWFKEDDK

SEQ ID NO: 138679 - protein, 9 aa, Homo Sapiens
GVRGMWCFY

SEQ ID NO: 138680 - protein, 9 aa, Homo Sapiens
KKVMCILVH

SEQ ID NO: 138681 - protein, 9 aa, Homo Sapiens
DWQLEKEYV

SEQ ID NO: 138682 - protein, 9 aa, Homo Sapiens
FIYSLSNKD

SEQ ID NO: 138683 - protein, 9 aa, Homo Sapiens
YSFSPFKSY

SEQ ID NO: 138684 - protein, 9 aa, Homo Sapiens
TTSPLKEEE

SEQ ID NO: 138685 - protein, 9 aa, Homo Sapiens
RVPSGLPRH

SEQ ID NO: 138686 - protein, 9 aa, Homo Sapiens
GKKVMCILV

SEQ ID NO: 138687 - protein, 9 aa, Homo Sapiens
DSAQLEGYL

SEQ ID NO: 138688 - protein, 9 aa, Homo Sapiens
SKNAIRKRG

SEQ ID NO: 138689 - protein, 9 aa, Homo Sapiens
SYSSATPVH

SEQ ID NO: 138690 - protein, 9 aa, Homo Sapiens
HTVEKPYDC

SEQ ID NO: 138691 - protein, 9 aa, Homo Sapiens
QQYARCIPS

SEQ ID NO: 138692 - protein, 9 aa, Homo Sapiens
LLKQLKPSE

SEQ ID NO: 138693 - protein, 9 aa, Homo Sapiens
GLPRHVRTL

SEQ ID NO: 138694 - protein, 9 aa, Homo Sapiens
FLTPMHWSN

SEQ ID NO: 138695 - protein, 9 aa, Homo Sapiens
LVVVGACGV

SEQ ID NO: 138696 - protein, 9 aa, Homo Sapiens
VPLMNPGDQ

SEQ ID NO: 138697 - protein, 9 aa, Homo Sapiens
GMGAMTWSP

SEQ ID NO: 138698 - protein, 9 aa, Homo Sapiens
RHSPPEERS

SEQ ID NO: 138699 - protein, 9 aa, Homo Sapiens
LAHRVNLTE

SEQ ID NO: 138700 - protein, 9 aa, Homo Sapiens
SEAPKRVSI

SEQ ID NO: 138701 - protein, 9 aa, Homo Sapiens
EKYCIEAEL

SEQ ID NO: 138702 - protein, 9 aa, Homo Sapiens
CNNMGYEIN

SEQ ID NO: 138703 - protein, 9 aa, Homo Sapiens
FCLNGGKDP

SEQ ID NO: 138704 - protein, 9 aa, Homo Sapiens
GLVLVDLKS

SEQ ID NO: 138705 - protein, 9 aa, Homo Sapiens
PWVGISAVA

SEQ ID NO: 138706 - protein, 9 aa, Homo Sapiens
HRAEALPLE

SEQ ID NO: 138707 - protein, 9 aa, Homo Sapiens
VSSFGRTHE

SEQ ID NO: 138708 - protein, 9 aa, Homo Sapiens
YQMWTFSTF

SEQ ID NO: 138709 - protein, 9 aa, Homo Sapiens
MWTFSTFLE

SEQ ID NO: 138710 - protein, 9 aa, Homo Sapiens
TITVMCEEC

SEQ ID NO: 138711 - protein, 9 aa, Homo Sapiens
RILLRAANN

SEQ ID NO: 138712 - protein, 9 aa, Homo Sapiens
DAPCPQEMK

SEQ ID NO: 138713 - protein, 9 aa, Homo Sapiens
INIDVGTRD

SEQ ID NO: 138714 - protein, 9 aa, Homo Sapiens
VGCQTLATP

SEQ ID NO: 138715 - protein, 9 aa, Homo Sapiens
MVMWGDPEL

SEQ ID NO: 138716 - protein, 9 aa, Homo Sapiens
YTHWNWDQP

SEQ ID NO: 138717 - protein, 9 aa, Homo Sapiens
GFLGTQISV

SEQ ID NO: 138718 - protein, 9 aa, Homo Sapiens
ADDNVKIVC

SEQ ID NO: 138719 - protein, 9 aa, Homo Sapiens
STNLTDSCI

SEQ ID NO: 138720 - protein, 9 aa, Homo Sapiens
LAQQQLHLE

SEQ ID NO: 138721 - protein, 9 aa, Homo Sapiens
RFWETLGRY

SEQ ID NO: 138722 - protein, 9 aa, Homo Sapiens
RDTERRWVF

SEQ ID NO: 138723 - protein, 9 aa, Homo Sapiens
RTPRVGGST

SEQ ID NO: 138724 - protein, 9 aa, Homo Sapiens
HIFMLILLS

SEQ ID NO: 138725 - protein, 9 aa, Homo Sapiens
MFAFFAQHI

SEQ ID NO: 138726 - protein, 9 aa, Homo Sapiens
AAEKQGLQR

SEQ ID NO: 138727 - protein, 9 aa, Homo Sapiens
VIVYPMKFL

SEQ ID NO: 138728 - protein, 9 aa, Homo Sapiens
VTLQPLTAV

SEQ ID NO: 138729 - protein, 9 aa, Homo Sapiens
QAPGDRGLP

SEQ ID NO: 138730 - protein, 9 aa, Homo Sapiens
KKIKWFAVL

SEQ ID NO: 138731 - protein, 9 aa, Homo Sapiens
VVWGVFCNE

SEQ ID NO: 138732 - protein, 9 aa, Homo Sapiens
LVGCQTLAT

SEQ ID NO: 138733 - protein, 9 aa, Homo Sapiens
VIVVSMFIA

SEQ ID NO: 138734 - protein, 9 aa, Homo Sapiens
PKEINIDVG

SEQ ID NO: 138735 - protein, 9 aa, Homo Sapiens
PGCPQEAHT

SEQ ID NO: 138736 - protein, 9 aa, Homo Sapiens
LTMLLALAV

SEQ ID NO: 138737 - protein, 9 aa, Homo Sapiens
RIDLAVGNV

SEQ ID NO: 138738 - protein, 9 aa, Homo Sapiens
ERAATRRCS

SEQ ID NO: 138739 - protein, 9 aa, Homo Sapiens
ENKTVEEMK

SEQ ID NO: 138740 - protein, 9 aa, Homo Sapiens
DHYNDCGDT

SEQ ID NO: 138741 - protein, 9 aa, Homo Sapiens
RDPLSKITE

SEQ ID NO: 138742 - protein, 9 aa, Homo Sapiens
LAKWIQSEW

SEQ ID NO: 138743 - protein, 9 aa, Homo Sapiens
DITVNINEL

SEQ ID NO: 138744 - protein, 9 aa, Homo Sapiens
PEDNKITEL

SEQ ID NO: 138745 - protein, 9 aa, Homo Sapiens
FPEEVPPQA

SEQ ID NO: 138746 - protein, 9 aa, Homo Sapiens
AGVGPSSGI

SEQ ID NO: 138747 - protein, 9 aa, Homo Sapiens
LDYSGPSQE

SEQ ID NO: 138748 - protein, 9 aa, Homo Sapiens
LVLAWKLDP

SEQ ID NO: 138749 - protein, 9 aa, Homo Sapiens
LFLILRHRH

SEQ ID NO: 138750 - protein, 9 aa, Homo Sapiens
KDVLQLNEF

SEQ ID NO: 138751 - protein, 9 aa, Homo Sapiens
ETLAQQQLH

SEQ ID NO: 138752 - protein, 9 aa, Homo Sapiens
FSMGDAKTR

SEQ ID NO: 138753 - protein, 9 aa, Homo Sapiens
IDLAVGNVV

SEQ ID NO: 138754 - protein, 9 aa, Homo Sapiens
FLMYMAFKD

SEQ ID NO: 138755 - protein, 9 aa, Homo Sapiens
QQEVRKIFF

SEQ ID NO: 138756 - protein, 9 aa, Homo Sapiens
AFFAQHITH

SEQ ID NO: 138757 - protein, 9 aa, Homo Sapiens
RVIRAAFPG

SEQ ID NO: 138758 - protein, 9 aa, Homo Sapiens
CSGPASQTL

SEQ ID NO: 138759 - protein, 9 aa, Homo Sapiens
EDNKITELT

SEQ ID NO: 138760 - protein, 9 aa, Homo Sapiens
VEKSQSASG

SEQ ID NO: 138761 - protein, 9 aa, Homo Sapiens
QSRHRQILV

SEQ ID NO: 138762 - protein, 9 aa, Homo Sapiens
NSRFHCRGV

SEQ ID NO: 138763 - protein, 9 aa, Homo Sapiens
FMLRNEQQF

SEQ ID NO: 138764 - protein, 9 aa, Homo Sapiens
PSKNMKLEA

SEQ ID NO: 138765 - protein, 9 aa, Homo Sapiens
DLGSRPPVS

SEQ ID NO: 138766 - protein, 9 aa, Homo Sapiens
YHLFWKSKD

SEQ ID NO: 138767 - protein, 9 aa, Homo Sapiens
SRCCRRAGC

SEQ ID NO: 138768 - protein, 9 aa, Homo Sapiens
ALGVDLKDV

SEQ ID NO: 138769 - protein, 9 aa, Homo Sapiens
FIQPECSEP

SEQ ID NO: 138770 - protein, 9 aa, Homo Sapiens
QQLHLEQIQ

SEQ ID NO: 138771 - protein, 9 aa, Homo Sapiens
EAAAEKQGL

SEQ ID NO: 138772 - protein, 9 aa, Homo Sapiens
QLKAVLDPK

SEQ ID NO: 138773 - protein, 9 aa, Homo Sapiens
QEMKSKQVP

SEQ ID NO: 138774 - protein, 9 aa, Homo Sapiens
GQKLLCGQQ

SEQ ID NO: 138775 - protein, 9 aa, Homo Sapiens
ALLTPWMRG

SEQ ID NO: 138776 - protein, 9 aa, Homo Sapiens
TISCHGLSV

SEQ ID NO: 138777 - protein, 9 aa, Homo Sapiens
GGKDIFMME

SEQ ID NO: 138778 - protein, 9 aa, Homo Sapiens
GPAQLVGCQ

SEQ ID NO: 138779 - protein, 9 aa, Homo Sapiens
IRDKKKPQM

SEQ ID NO: 138780 - protein, 9 aa, Homo Sapiens
SHKDPEVKF

SEQ ID NO: 138781 - protein, 9 aa, Homo Sapiens
EVPPQAEEI

SEQ ID NO: 138782 - protein, 9 aa, Homo Sapiens
LVDKYYQEN

SEQ ID NO: 138783 - protein, 9 aa, Homo Sapiens
ASYGFKDGD

SEQ ID NO: 138784 - protein, 9 aa, Homo Sapiens
QKVLTITHV

SEQ ID NO: 138785 - protein, 9 aa, Homo Sapiens
LTITVMCEE

SEQ ID NO: 138786 - protein, 9 aa, Homo Sapiens
TRSRNSRFH

SEQ ID NO: 138787 - protein, 9 aa, Homo Sapiens
PPPLHYLLP

SEQ ID NO: 138788 - protein, 9 aa, Homo Sapiens
QKLLCGQQK

SEQ ID NO: 138789 - protein, 9 aa, Homo Sapiens
QMTIPSACG

SEQ ID NO: 138790 - protein, 9 aa, Homo Sapiens
GSRPPVSLD

SEQ ID NO: 138791 - protein, 9 aa, Homo Sapiens
ALRRSCLRK

SEQ ID NO: 138792 - protein, 9 aa, Homo Sapiens
VPPPMERAA

SEQ ID NO: 138793 - protein, 9 aa, Homo Sapiens
ERRWVFQAL

SEQ ID NO: 138794 - protein, 9 aa, Homo Sapiens
GNPHSRSWI

SEQ ID NO: 138795 - protein, 9 aa, Homo Sapiens
RAPRYIHKG

SEQ ID NO: 138796 - protein, 9 aa, Homo Sapiens
VQQKKDGPI

SEQ ID NO: 138797 - protein, 9 aa, Homo Sapiens
PCKKCSHWK

SEQ ID NO: 138798 - protein, 9 aa, Homo Sapiens
CFQLPAFPW

SEQ ID NO: 138799 - protein, 9 aa, Homo Sapiens
LSADMVTVL

SEQ ID NO: 138800 - protein, 9 aa, Homo Sapiens
TELTLEIER

SEQ ID NO: 138801 - protein, 9 aa, Homo Sapiens
SYGFKDGDV

SEQ ID NO: 138802 - protein, 9 aa, Homo Sapiens
FLGTQISVG

SEQ ID NO: 138803 - protein, 9 aa, Homo Sapiens
LHRELPPDQ

SEQ ID NO: 138804 - protein, 9 aa, Homo Sapiens
APGDRGLPP

SEQ ID NO: 138805 - protein, 9 aa, Homo Sapiens
CSICSHTAT

SEQ ID NO: 138806 - protein, 9 aa, Homo Sapiens
HQGKHWTST

SEQ ID NO: 138807 - protein, 9 aa, Homo Sapiens
DTERRWVFQ

SEQ ID NO: 138808 - protein, 9 aa, Homo Sapiens
PQEAHTDGS

SEQ ID NO: 138809 - protein, 9 aa, Homo Sapiens
QGGVVCGDL

SEQ ID NO: 138810 - protein, 9 aa, Homo Sapiens
KIVEVKNFF

SEQ ID NO: 138811 - protein, 9 aa, Homo Sapiens
LQWQLQIPS

SEQ ID NO: 138812 - protein, 9 aa, Homo Sapiens
CQRTGTATC

SEQ ID NO: 138813 - protein, 9 aa, Homo Sapiens
MWGDPELSC

SEQ ID NO: 138814 - protein, 9 aa, Homo Sapiens
DAGVSPLGS

SEQ ID NO: 138815 - protein, 9 aa, Homo Sapiens
LASTEKDVL

SEQ ID NO: 138816 - protein, 9 aa, Homo Sapiens
TATCASSCA

SEQ ID NO: 138817 - protein, 9 aa, Homo Sapiens
QLQIPSGTV

SEQ ID NO: 138818 - protein, 9 aa, Homo Sapiens
PWLLLDLTP

SEQ ID NO: 138819 - protein, 9 aa, Homo Sapiens
VAIYSEQDM

SEQ ID NO: 138820 - protein, 9 aa, Homo Sapiens
RAANNHSSA

SEQ ID NO: 138821 - protein, 9 aa, Homo Sapiens
KDAPCPQEM

SEQ ID NO: 138822 - protein, 9 aa, Homo Sapiens
KEINIDVGT

SEQ ID NO: 138823 - protein, 9 aa, Homo Sapiens
LVFNSWAQA

SEQ ID NO: 138824 - protein, 9 aa, Homo Sapiens
LNWQLHIFM

SEQ ID NO: 138825 - protein, 9 aa, Homo Sapiens
VNSFLMYMA

SEQ ID NO: 138826 - protein, 9 aa, Homo Sapiens
LLSGSKEVQ

SEQ ID NO: 138827 - protein, 9 aa, Homo Sapiens
LTLAKWIQS

SEQ ID NO: 138828 - protein, 9 aa, Homo Sapiens
TNLTDSCID

SEQ ID NO: 138829 - protein, 9 aa, Homo Sapiens
EVQSSFSMR

SEQ ID NO: 138830 - protein, 9 aa, Homo Sapiens
PLSKITEQE

SEQ ID NO: 138831 - protein, 9 aa, Homo Sapiens
FPGTTEAQK

SEQ ID NO: 138832 - protein, 9 aa, Homo Sapiens
RLRGHQKKA

SEQ ID NO: 138833 - protein, 9 aa, Homo Sapiens
RDLMANRTL

SEQ ID NO: 138834 - protein, 9 aa, Homo Sapiens
KVQKVGQQA

SEQ ID NO: 138835 - protein, 9 aa, Homo Sapiens
HRSLASYGF

SEQ ID NO: 138836 - protein, 9 aa, Homo Sapiens
DGPYMCSVQ

SEQ ID NO: 138837 - protein, 9 aa, Homo Sapiens
EMKSKQVPG

SEQ ID NO: 138838 - protein, 9 aa, Homo Sapiens
VRHCPHHER

SEQ ID NO: 138839 - protein, 9 aa, Homo Sapiens
EAWPVGGSF

SEQ ID NO: 138840 - protein, 9 aa, Homo Sapiens
EIALSRHKL

SEQ ID NO: 138841 - protein, 9 aa, Homo Sapiens
LQIPSGTVV

SEQ ID NO: 138842 - protein, 9 aa, Homo Sapiens
SQFIQPYLN

SEQ ID NO: 138843 - protein, 9 aa, Homo Sapiens
VKNSLEELL

SEQ ID NO: 138844 - protein, 9 aa, Homo Sapiens
KNFPVTCLV

SEQ ID NO: 138845 - protein, 9 aa, Homo Sapiens
MKSKQVPGD

SEQ ID NO: 138846 - protein, 9 aa, Homo Sapiens
FNDYWNLQD

SEQ ID NO: 138847 - protein, 9 aa, Homo Sapiens
TWNSISSES

SEQ ID NO: 138848 - protein, 9 aa, Homo Sapiens
PTEFSRSHS

SEQ ID NO: 138849 - protein, 9 aa, Homo Sapiens
CVGLSHISG

SEQ ID NO: 138850 - protein, 9 aa, Homo Sapiens
MAYQLYTLY

SEQ ID NO: 138851 - protein, 9 aa, Homo Sapiens
ICSHTATCQ

SEQ ID NO: 138852 - protein, 9 aa, Homo Sapiens
YWNLQDYYP

SEQ ID NO: 138853 - protein, 9 aa, Homo Sapiens
PNLQLFVGG

SEQ ID NO: 138854 - protein, 9 aa, Homo Sapiens
LTPWMRGTD

SEQ ID NO: 138855 - protein, 9 aa, Homo Sapiens
PLYAVARTA

SEQ ID NO: 138856 - protein, 9 aa, Homo Sapiens
STFPTIQGA

SEQ ID NO: 138857 - protein, 9 aa, Homo Sapiens
TVLRCSALP

SEQ ID NO: 138858 - protein, 9 aa, Homo Sapiens
QHLLSDNGI

SEQ ID NO: 138859 - protein, 9 aa, Homo Sapiens
MVLAEVIVV

SEQ ID NO: 138860 - protein, 9 aa, Homo Sapiens
HAYANDKFT

SEQ ID NO: 138861 - protein, 9 aa, Homo Sapiens
KDITVNINE

SEQ ID NO: 138862 - protein, 9 aa, Homo Sapiens
LEELLSGSK

SEQ ID NO: 138863 - protein, 9 aa, Homo Sapiens
QQQESALRE

SEQ ID NO: 138864 - protein, 9 aa, Homo Sapiens
FFCVAAILQ

SEQ ID NO: 138865 - protein, 9 aa, Homo Sapiens
HLLSDNGIN

SEQ ID NO: 138866 - protein, 9 aa, Homo Sapiens
QMPPVSPAP

SEQ ID NO: 138867 - protein, 9 aa, Homo Sapiens
EEAAAEKQG

SEQ ID NO: 138868 - protein, 9 aa, Homo Sapiens
VVKGQPSAS

SEQ ID NO: 138869 - protein, 9 aa, Homo Sapiens
WAPPPSPAP

SEQ ID NO: 138870 - protein, 9 aa, Homo Sapiens
DKKKPQMDL

SEQ ID NO: 138871 - protein, 9 aa, Homo Sapiens
DPQNMGYFT

SEQ ID NO: 138872 - protein, 9 aa, Homo Sapiens
SSHSLCEDP

SEQ ID NO: 138873 - protein, 9 aa, Homo Sapiens
LSHISGKYA

SEQ ID NO: 138874 - protein, 9 aa, Homo Sapiens
IDKISRIIF

SEQ ID NO: 138875 - protein, 9 aa, Homo Sapiens
LYAVARTAS

SEQ ID NO: 138876 - protein, 9 aa, Homo Sapiens
ACFQLPAFP

SEQ ID NO: 138877 - protein, 9 aa, Homo Sapiens
VQEVACSAF

SEQ ID NO: 138878 - protein, 9 aa, Homo Sapiens
CLRKVQTFP

SEQ ID NO: 138879 - protein, 9 aa, Homo Sapiens
HMTEVVRHC

SEQ ID NO: 138880 - protein, 9 aa, Homo Sapiens
QESALRENI

SEQ ID NO: 138881 - protein, 9 aa, Homo Sapiens
LVAEIILTM

SEQ ID NO: 138882 - protein, 9 aa, Homo Sapiens
PSPETLSSD

SEQ ID NO: 138883 - protein, 9 aa, Homo Sapiens
TILLILTAV

SEQ ID NO: 138884 - protein, 9 aa, Homo Sapiens
ILLRAANNH

SEQ ID NO: 138885 - protein, 9 aa, Homo Sapiens
TFDQQEVRK

SEQ ID NO: 138886 - protein, 9 aa, Homo Sapiens
KGHPESPEP

SEQ ID NO: 138887 - protein, 9 aa, Homo Sapiens
SAGLVTILL

SEQ ID NO: 138888 - protein, 9 aa, Homo Sapiens
QQHHAASTG

SEQ ID NO: 138889 - protein, 9 aa, Homo Sapiens
SQGGVVCGD

SEQ ID NO: 138890 - protein, 9 aa, Homo Sapiens
DQQEVRKIF

SEQ ID NO: 138891 - protein, 9 aa, Homo Sapiens
WLSPWLLLD

SEQ ID NO: 138892 - protein, 9 aa, Homo Sapiens
QPSASAQVQ

SEQ ID NO: 138893 - protein, 9 aa, Homo Sapiens
GMTTAKQRL

SEQ ID NO: 138894 - protein, 9 aa, Homo Sapiens
GRVIRAAFP

SEQ ID NO: 138895 - protein, 9 aa, Homo Sapiens
RAAFPGTTE

SEQ ID NO: 138896 - protein, 9 aa, Homo Sapiens
VTWNSISSE

SEQ ID NO: 138897 - protein, 9 aa, Homo Sapiens
LLTPWMRGT

SEQ ID NO: 138898 - protein, 9 aa, Homo Sapiens
IGELTITVM

SEQ ID NO: 138899 - protein, 9 aa, Homo Sapiens
RNEQQFKEE

SEQ ID NO: 138900 - protein, 9 aa, Homo Sapiens
NSFSEIQIH

SEQ ID NO: 138901 - protein, 9 aa, Homo Sapiens
KVLTITHVL

SEQ ID NO: 138902 - protein, 9 aa, Homo Sapiens
EELLSGSKE

SEQ ID NO: 138903 - protein, 9 aa, Homo Sapiens
RDALRRSCL

SEQ ID NO: 138904 - protein, 9 aa, Homo Sapiens
EYVGASNSA

SEQ ID NO: 138905 - protein, 9 aa, Homo Sapiens
EAHTDGSWP

SEQ ID NO: 138906 - protein, 9 aa, Homo Sapiens
GEVLMTISC

SEQ ID NO: 138907 - protein, 9 aa, Homo Sapiens
RVQEVACSA

SEQ ID NO: 138908 - protein, 9 aa, Homo Sapiens
PGTTEAQKI

SEQ ID NO: 138909 - protein, 9 aa, Homo Sapiens
ATCQRTGTA

SEQ ID NO: 138910 - protein, 9 aa, Homo Sapiens
AVGNVVKTW

SEQ ID NO: 138911 - protein, 9 aa, Homo Sapiens
LFVGGTYFP

SEQ ID NO: 138912 - protein, 9 aa, Homo Sapiens
APCPQEMKS

SEQ ID NO: 138913 - protein, 9 aa, Homo Sapiens
GDRGLPPDM

SEQ ID NO: 138914 - protein, 9 aa, Homo Sapiens
RRHEGFERY

SEQ ID NO: 138915 - protein, 9 aa, Homo Sapiens
KLLCGQQKC

SEQ ID NO: 138916 - protein, 9 aa, Homo Sapiens
STQLFYSVR

SEQ ID NO: 138917 - protein, 9 aa, Homo Sapiens
LGTQISVGT

SEQ ID NO: 138918 - protein, 9 aa, Homo Sapiens
GKRPKKGMT

SEQ ID NO: 138919 - protein, 9 aa, Homo Sapiens
NVVKTWRFS

SEQ ID NO: 138920 - protein, 9 aa, Homo Sapiens
ISVGTYLVL

SEQ ID NO: 138921 - protein, 9 aa, Homo Sapiens
CIDLARCCL

SEQ ID NO: 138922 - protein, 9 aa, Homo Sapiens
GVGPSSGIS

SEQ ID NO: 138923 - protein, 9 aa, Homo Sapiens
YSVRASPKP

SEQ ID NO: 138924 - protein, 9 aa, Homo Sapiens
AEKQGLQRR

SEQ ID NO: 138925 - protein, 9 aa, Homo Sapiens
AANNHSSAK

SEQ ID NO: 138926 - protein, 9 aa, Homo Sapiens
CHGKYSRWI

SEQ ID NO: 138927 - protein, 9 aa, Homo Sapiens
RRCFPTIHA

SEQ ID NO: 138928 - protein, 9 aa, Homo Sapiens
LKDVDPIRH

SEQ ID NO: 138929 - protein, 9 aa, Homo Sapiens
DVTRGKGPL

SEQ ID NO: 138930 - protein, 9 aa, Homo Sapiens
RHQGKHWTS

SEQ ID NO: 138931 - protein, 9 aa, Homo Sapiens
SQEFFFLLS

SEQ ID NO: 138932 - protein, 9 aa, Homo Sapiens
AILIHTPAK

SEQ ID NO: 138933 - protein, 9 aa, Homo Sapiens
VGPSSGISR

SEQ ID NO: 138934 - protein, 9 aa, Homo Sapiens
HVLMEDDDL

SEQ ID NO: 138935 - protein, 9 aa, Homo Sapiens
INPAILIHT

SEQ ID NO: 138936 - protein, 9 aa, Homo Sapiens
YHIVWLNCK

SEQ ID NO: 138937 - protein, 9 aa, Homo Sapiens
HWKSLKHQE

SEQ ID NO: 138938 - protein, 9 aa, Homo Sapiens
YAVARTASE

SEQ ID NO: 138939 - protein, 9 aa, Homo Sapiens
ILHLVAADL

SEQ ID NO: 138940 - protein, 9 aa, Homo Sapiens
ASTGLASAA

SEQ ID NO: 138941 - protein, 9 aa, Homo Sapiens
VASDLGSRP

SEQ ID NO: 138942 - protein, 9 aa, Homo Sapiens
LALGVDLKD

SEQ ID NO: 138943 - protein, 9 aa, Homo Sapiens
PPPHEFMAY

SEQ ID NO: 138944 - protein, 9 aa, Homo Sapiens
CLPGFSDQF

SEQ ID NO: 138945 - protein, 9 aa, Homo Sapiens
MQASVPSPS

SEQ ID NO: 138946 - protein, 9 aa, Homo Sapiens
LHLVAADLI

SEQ ID NO: 138947 - protein, 9 aa, Homo Sapiens
SGPSPEYTV

SEQ ID NO: 138948 - protein, 9 aa, Homo Sapiens
SLYHIVWLN

SEQ ID NO: 138949 - protein, 9 aa, Homo Sapiens
SPWLLLDLT

SEQ ID NO: 138950 - protein, 9 aa, Homo Sapiens
KKKPQMDLE

SEQ ID NO: 138951 - protein, 9 aa, Homo Sapiens
GTSVPFQRR

SEQ ID NO: 138952 - protein, 9 aa, Homo Sapiens
MQEGTAPTE

SEQ ID NO: 138953 - protein, 9 aa, Homo Sapiens
ALQQEDFAK

SEQ ID NO: 138954 - protein, 9 aa, Homo Sapiens
VGGSFNVNT

SEQ ID NO: 138955 - protein, 9 aa, Homo Sapiens
MTIPSACGT

SEQ ID NO: 138956 - protein, 9 aa, Homo Sapiens
PYILAEELH

SEQ ID NO: 138957 - protein, 9 aa, Homo Sapiens
IMMEMTDVT

SEQ ID NO: 138958 - protein, 9 aa, Homo Sapiens
EINIDVGTR

SEQ ID NO: 138959 - protein, 9 aa, Homo Sapiens
QEATFDQQE

SEQ ID NO: 138960 - protein, 9 aa, Homo Sapiens
ADTLLQIFC

SEQ ID NO: 138961 - protein, 9 aa, Homo Sapiens
SCGLCCHSR

SEQ ID NO: 138962 - protein, 9 aa, Homo Sapiens
QKKDGPIPP

SEQ ID NO: 138963 - protein, 9 aa, Homo Sapiens
EKQGLQRRA

SEQ ID NO: 138964 - protein, 9 aa, Homo Sapiens
PHCLLLPAH

SEQ ID NO: 138965 - protein, 9 aa, Homo Sapiens
KLASTEKDV

SEQ ID NO: 138966 - protein, 9 aa, Homo Sapiens
DMVTVLQLL

SEQ ID NO: 138967 - protein, 9 aa, Homo Sapiens
RDKKKPQMD

SEQ ID NO: 138968 - protein, 9 aa, Homo Sapiens
TMVMWGDPE

SEQ ID NO: 138969 - protein, 9 aa, Homo Sapiens
LQEATFDQQ

SEQ ID NO: 138970 - protein, 9 aa, Homo Sapiens
TKNFPVTCL

SEQ ID NO: 138971 - protein, 9 aa, Homo Sapiens
DALIYLDQV

SEQ ID NO: 138972 - protein, 9 aa, Homo Sapiens
PGFSDQFCE

SEQ ID NO: 138973 - protein, 9 aa, Homo Sapiens
SIDRYHVIV

SEQ ID NO: 138974 - protein, 9 aa, Homo Sapiens
GSHFGSWMT

SEQ ID NO: 138975 - protein, 9 aa, Homo Sapiens
VGQQALRQI

SEQ ID NO: 138976 - protein, 9 aa, Homo Sapiens
SSSQGGVVC

SEQ ID NO: 138977 - protein, 9 aa, Homo Sapiens
ESALRENIL

SEQ ID NO: 138978 - protein, 9 aa, Homo Sapiens
QFIQPYLNS

SEQ ID NO: 138979 - protein, 9 aa, Homo Sapiens
LWAPPPSPA

SEQ ID NO: 138980 - protein, 9 aa, Homo Sapiens
VTILLILTA

SEQ ID NO: 138981 - protein, 9 aa, Homo Sapiens
STHLLERGV

SEQ ID NO: 138982 - protein, 9 aa, Homo Sapiens
QILVDKYYQ

SEQ ID NO: 138983 - protein, 9 aa, Homo Sapiens
IPCRSTKGW

SEQ ID NO: 138984 - protein, 9 aa, Homo Sapiens
SEQDMGQMH

SEQ ID NO: 138985 - protein, 9 aa, Homo Sapiens
SKNMKLEAS

SEQ ID NO: 138986 - protein, 9 aa, Homo Sapiens
VIFFMDGSR

SEQ ID NO: 138987 - protein, 9 aa, Homo Sapiens
ILFINPAIL

SEQ ID NO: 138988 - protein, 9 aa, Homo Sapiens
HRHQGKHWT

SEQ ID NO: 138989 - protein, 9 aa, Homo Sapiens
YNDCGDTSD

SEQ ID NO: 138990 - protein, 9 aa, Homo Sapiens
ALSRHKLQD

SEQ ID NO: 138991 - protein, 9 aa, Homo Sapiens
DNKITELTL

SEQ ID NO: 138992 - protein, 9 aa, Homo Sapiens
HCRGVDANR

SEQ ID NO: 138993 - protein, 9 aa, Homo Sapiens
VHAYANDKF

SEQ ID NO: 138994 - protein, 9 aa, Homo Sapiens
SGPSQEFFF

SEQ ID NO: 138995 - protein, 9 aa, Homo Sapiens
SHSVLKPFT

SEQ ID NO: 138996 - protein, 9 aa, Homo Sapiens
DLIYLCCSA

SEQ ID NO: 138997 - protein, 9 aa, Homo Sapiens
LPEAAQTQA

SEQ ID NO: 138998 - protein, 9 aa, Homo Sapiens
PHEFMAYQL

SEQ ID NO: 138999 - protein, 9 aa, Homo Sapiens
RRSCLRKVQ

SEQ ID NO: 139000 - protein, 9 aa, Homo Sapiens
PRRFMVLAE

SEQ ID NO: 139001 - protein, 9 aa, Homo Sapiens
YEHLRDLAA

SEQ ID NO: 139002 - protein, 9 aa, Homo Sapiens
ETRLSADMV

SEQ ID NO: 139003 - protein, 9 aa, Homo Sapiens
VSPLGSNVT

SEQ ID NO: 139004 - protein, 9 aa, Homo Sapiens
LVLQMTIPS

SEQ ID NO: 139005 - protein, 9 aa, Homo Sapiens
ARDAGVSPL

SEQ ID NO: 139006 - protein, 9 aa, Homo Sapiens
WKLDPQNMG

SEQ ID NO: 139007 - protein, 9 aa, Homo Sapiens
VHVEDALIY

SEQ ID NO: 139008 - protein, 9 aa, Homo Sapiens
TRDPLSKIT

SEQ ID NO: 139009 - protein, 9 aa, Homo Sapiens
QTQAQADLL

SEQ ID NO: 139010 - protein, 9 aa, Homo Sapiens
IKAVQGCMR

SEQ ID NO: 139011 - protein, 9 aa, Homo Sapiens
GCQTLATPA

SEQ ID NO: 139012 - protein, 9 aa, Homo Sapiens
DPLSKITEQ

SEQ ID NO: 139013 - protein, 9 aa, Homo Sapiens
VVVGAVGVG

SEQ ID NO: 139014 - protein, 9 aa, Homo Sapiens
PASLWAPPP

SEQ ID NO: 139015 - protein, 9 aa, Homo Sapiens
VCLGDSAVG

SEQ ID NO: 139016 - protein, 9 aa, Homo Sapiens
FFAQHITHQ

SEQ ID NO: 139017 - protein, 9 aa, Homo Sapiens
SMDSRCHID

SEQ ID NO: 139018 - protein, 9 aa, Homo Sapiens
KKGMTTAKQ

SEQ ID NO: 139019 - protein, 9 aa, Homo Sapiens
TMLLALAVC

SEQ ID NO: 139020 - protein, 9 aa, Homo Sapiens
VDVSHKDPE

SEQ ID NO: 139021 - protein, 9 aa, Homo Sapiens
AMGSHFGSW

SEQ ID NO: 139022 - protein, 9 aa, Homo Sapiens
MPPVSPAPQ

SEQ ID NO: 139023 - protein, 9 aa, Homo Sapiens
QNTGNMKNF

SEQ ID NO: 139024 - protein, 9 aa, Homo Sapiens
WQLQIPSGT

SEQ ID NO: 139025 - protein, 9 aa, Homo Sapiens
RATLGRPLV

SEQ ID NO: 139026 - protein, 9 aa, Homo Sapiens
SFLMYMAFK

SEQ ID NO: 139027 - protein, 9 aa, Homo Sapiens
IPSAGLVTI

SEQ ID NO: 139028 - protein, 9 aa, Homo Sapiens
EGTAPTEFS

SEQ ID NO: 139029 - protein, 9 aa, Homo Sapiens
DVQAKKEEK

SEQ ID NO: 139030 - protein, 9 aa, Homo Sapiens
GTYLVLQMT

SEQ ID NO: 139031 - protein, 9 aa, Homo Sapiens
GLMQASVPS

SEQ ID NO: 139032 - protein, 9 aa, Homo Sapiens
LRIKMGKWC

SEQ ID NO: 139033 - protein, 9 aa, Homo Sapiens
LCCHSRKKG

SEQ ID NO: 139034 - protein, 9 aa, Homo Sapiens
CRCLPGFSD

SEQ ID NO: 139035 - protein, 9 aa, Homo Sapiens
TITHVLMED

SEQ ID NO: 139036 - protein, 9 aa, Homo Sapiens
SVPFQRREK

SEQ ID NO: 139037 - protein, 9 aa, Homo Sapiens
FNVNTILQL

SEQ ID NO: 139038 - protein, 9 aa, Homo Sapiens
HRELPPDQA

SEQ ID NO: 139039 - protein, 9 aa, Homo Sapiens
SRNAARSRH

SEQ ID NO: 139040 - protein, 9 aa, Homo Sapiens
LEGVPPSKN

SEQ ID NO: 139041 - protein, 9 aa, Homo Sapiens
AFLKAMEAQ

SEQ ID NO: 139042 - protein, 9 aa, Homo Sapiens
GPASQTLDC

SEQ ID NO: 139043 - protein, 9 aa, Homo Sapiens
FSFFCVAAI

SEQ ID NO: 139044 - protein, 9 aa, Homo Sapiens
NFFQITCEN

SEQ ID NO: 139045 - protein, 9 aa, Homo Sapiens
KKPFGLRIK

SEQ ID NO: 139046 - protein, 9 aa, Homo Sapiens
KTVEEMKVE

SEQ ID NO: 139047 - protein, 9 aa, Homo Sapiens
ASQIKVTLQ

SEQ ID NO: 139048 - protein, 9 aa, Homo Sapiens
ERYLVPLGD

SEQ ID NO: 139049 - protein, 9 aa, Homo Sapiens
VEVKNFFQI

SEQ ID NO: 139050 - protein, 9 aa, Homo Sapiens
KDVSVTVSM

SEQ ID NO: 139051 - protein, 9 aa, Homo Sapiens
VDLKDVDPI

SEQ ID NO: 139052 - protein, 9 aa, Homo Sapiens
DCGDTSDER

SEQ ID NO: 139053 - protein, 9 aa, Homo Sapiens
EPCKKCSHW

SEQ ID NO: 139054 - protein, 9 aa, Homo Sapiens
ANRTLPPGG

SEQ ID NO: 139055 - protein, 9 aa, Homo Sapiens
TDSCIDLAR

SEQ ID NO: 139056 - protein, 9 aa, Homo Sapiens
VQGCMRLIF

SEQ ID NO: 139057 - protein, 9 aa, Homo Sapiens
VVRHCPHHE

SEQ ID NO: 139058 - protein, 9 aa, Homo Sapiens
LQMTIPSAC

SEQ ID NO: 139059 - protein, 9 aa, Homo Sapiens
YVGPGVSQF

SEQ ID NO: 139060 - protein, 9 aa, Homo Sapiens
DGPIPPDAQ

SEQ ID NO: 139061 - protein, 9 aa, Homo Sapiens
GFSDQFCEI

SEQ ID NO: 139062 - protein, 9 aa, Homo Sapiens
VTRVPEARL

SEQ ID NO: 139063 - protein, 9 aa, Homo Sapiens
PGDRGLPPD

SEQ ID NO: 139064 - protein, 9 aa, Homo Sapiens
ITVMCEECA

SEQ ID NO: 139065 - protein, 9 aa, Homo Sapiens
RQILVDKYY

SEQ ID NO: 139066 - protein, 9 aa, Homo Sapiens
RWIFLFIQP

SEQ ID NO: 139067 - protein, 9 aa, Homo Sapiens
RLSADMVTV

SEQ ID NO: 139068 - protein, 9 aa, Homo Sapiens
LAWKLDPQN

SEQ ID NO: 139069 - protein, 9 aa, Homo Sapiens
MTTAKQRLG

SEQ ID NO: 139070 - protein, 9 aa, Homo Sapiens
CRRAGCCYT

SEQ ID NO: 139071 - protein, 9 aa, Homo Sapiens
LHLEQIQQL

SEQ ID NO: 139072 - protein, 9 aa, Homo Sapiens
SVTVSMDSR

SEQ ID NO: 139073 - protein, 9 aa, Homo Sapiens
QKLASTEKD

SEQ ID NO: 139074 - protein, 9 aa, Homo Sapiens
FSEIQIHPL

SEQ ID NO: 139075 - protein, 9 aa, Homo Sapiens
DLKDVDPIR

SEQ ID NO: 139076 - protein, 9 aa, Homo Sapiens
GRAPRYIHK

SEQ ID NO: 139077 - protein, 9 aa, Homo Sapiens
CCHSRKKGP

SEQ ID NO: 139078 - protein, 9 aa, Homo Sapiens
RTVVIVVSM

SEQ ID NO: 139079 - protein, 9 aa, Homo Sapiens
HAPDEQRLE

SEQ ID NO: 139080 - protein, 9 aa, Homo Sapiens
LASYGFKDG

SEQ ID NO: 139081 - protein, 9 aa, Homo Sapiens
RPKKGMTTA

SEQ ID NO: 139082 - protein, 9 aa, Homo Sapiens
KDSPLYAVA

SEQ ID NO: 139083 - protein, 9 aa, Homo Sapiens
TQISVGTYL

SEQ ID NO: 139084 - protein, 9 aa, Homo Sapiens
EHLRDLAAC

SEQ ID NO: 139085 - protein, 9 aa, Homo Sapiens
FIYHLFWKS

SEQ ID NO: 139086 - protein, 9 aa, Homo Sapiens
EDVQAKKEE

SEQ ID NO: 139087 - protein, 9 aa, Homo Sapiens
PQNMGYFTL

SEQ ID NO: 139088 - protein, 9 aa, Homo Sapiens
MNCVWLIIP

SEQ ID NO: 139089 - protein, 9 aa, Homo Sapiens
HITHQFFKT

SEQ ID NO: 139090 - protein, 9 aa, Homo Sapiens
LVAADLIYL

SEQ ID NO: 139091 - protein, 9 aa, Homo Sapiens
GPPPLHYLL

SEQ ID NO: 139092 - protein, 9 aa, Homo Sapiens
SEYVGASNS

SEQ ID NO: 139093 - protein, 9 aa, Homo Sapiens
TFPTIQGAS

SEQ ID NO: 139094 - protein, 9 aa, Homo Sapiens
LRDLAACCG

SEQ ID NO: 139095 - protein, 9 aa, Homo Sapiens
TLQPLTAVI

SEQ ID NO: 139096 - protein, 9 aa, Homo Sapiens
VKTCRGATV

SEQ ID NO: 139097 - protein, 9 aa, Homo Sapiens
AEADENKTV

SEQ ID NO: 139098 - protein, 9 aa, Homo Sapiens
AFPGTTEAQ

SEQ ID NO: 139099 - protein, 9 aa, Homo Sapiens
HEGFERYLV

SEQ ID NO: 139100 - protein, 9 aa, Homo Sapiens
SDGQGVSLS

SEQ ID NO: 139101 - protein, 9 aa, Homo Sapiens
NPIKAVQGC

SEQ ID NO: 139102 - protein, 9 aa, Homo Sapiens
LQLFVGGTY

SEQ ID NO: 139103 - protein, 9 aa, Homo Sapiens
PQMDLEEQH

SEQ ID NO: 139104 - protein, 9 aa, Homo Sapiens
DKFSMGDAK

SEQ ID NO: 139105 - protein, 9 aa, Homo Sapiens
GELTITVMC

SEQ ID NO: 139106 - protein, 9 aa, Homo Sapiens
KITELTLEI

SEQ ID NO: 139107 - protein, 9 aa, Homo Sapiens
APKEINIDV

SEQ ID NO: 139108 - protein, 9 aa, Homo Sapiens
QSEWKEISG

SEQ ID NO: 139109 - protein, 9 aa, Homo Sapiens
SVVIWICLV

SEQ ID NO: 139110 - protein, 9 aa, Homo Sapiens
KKDGPIPPD

SEQ ID NO: 139111 - protein, 9 aa, Homo Sapiens
KHLDFLKKI

SEQ ID NO: 139112 - protein, 9 aa, Homo Sapiens
QEVACSAFA

SEQ ID NO: 139113 - protein, 9 aa, Homo Sapiens
CNEDQWAWV

SEQ ID NO: 139114 - protein, 9 aa, Homo Sapiens
SLSPVSKTM

SEQ ID NO: 139115 - protein, 9 aa, Homo Sapiens
MMEMTDVTR

SEQ ID NO: 139116 - protein, 9 aa, Homo Sapiens
EVACSAFAT

SEQ ID NO: 139117 - protein, 9 aa, Homo Sapiens
LGVDLKDVD

SEQ ID NO: 139118 - protein, 9 aa, Homo Sapiens
TEFSRSHSL

SEQ ID NO: 139119 - protein, 9 aa, Homo Sapiens
LPLPEAAQT

SEQ ID NO: 139120 - protein, 9 aa, Homo Sapiens
NTMKVIFFM

SEQ ID NO: 139121 - protein, 9 aa, Homo Sapiens
QLHIFMLIL

SEQ ID NO: 139122 - protein, 9 aa, Homo Sapiens
VFCNEDQWA

SEQ ID NO: 139123 - protein, 9 aa, Homo Sapiens
TVSMDSRCH

SEQ ID NO: 139124 - protein, 9 aa, Homo Sapiens
DGNKRVQEV

SEQ ID NO: 139125 - protein, 9 aa, Homo Sapiens
TYNSVSKID

SEQ ID NO: 139126 - protein, 9 aa, Homo Sapiens
VSTSSSSSG

SEQ ID NO: 139127 - protein, 9 aa, Homo Sapiens
STEKDVLQL

SEQ ID NO: 139128 - protein, 9 aa, Homo Sapiens
PTIQGASLP

SEQ ID NO: 139129 - protein, 9 aa, Homo Sapiens
CPQEMKSKQ

SEQ ID NO: 139130 - protein, 9 aa, Homo Sapiens
EPLQHLLSD

SEQ ID NO: 139131 - protein, 9 aa, Homo Sapiens
IFCHGKYSR

SEQ ID NO: 139132 - protein, 9 aa, Homo Sapiens
ARRCFPTIH

SEQ ID NO: 139133 - protein, 9 aa, Homo Sapiens
ASLWAPPPS

SEQ ID NO: 139134 - protein, 9 aa, Homo Sapiens
AKWIQSEWK

SEQ ID NO: 139135 - protein, 9 aa, Homo Sapiens
NDCGDTSDE

SEQ ID NO: 139136 - protein, 9 aa, Homo Sapiens
SFFCVAAIL

SEQ ID NO: 139137 - protein, 9 aa, Homo Sapiens
SEIQIHPLS

SEQ ID NO: 139138 - protein, 9 aa, Homo Sapiens
KWPSIRNSL

SEQ ID NO: 139139 - protein, 9 aa, Homo Sapiens
SKIDKISRI

SEQ ID NO: 139140 - protein, 9 aa, Homo Sapiens
WIPGKGHPE

SEQ ID NO: 139141 - protein, 9 aa, Homo Sapiens
QEDFAKAHR

SEQ ID NO: 139142 - protein, 9 aa, Homo Sapiens
AKTQMPPVS

SEQ ID NO: 139143 - protein, 9 aa, Homo Sapiens
PFGLRIKMG

SEQ ID NO: 139144 - protein, 9 aa, Homo Sapiens
DSHVKVQKV

SEQ ID NO: 139145 - protein, 9 aa, Homo Sapiens
NPHSRSWIK

SEQ ID NO: 139146 - protein, 9 aa, Homo Sapiens
RCCRRAGCC

SEQ ID NO: 139147 - protein, 9 aa, Homo Sapiens
TQMPPVSPA

SEQ ID NO: 139148 - protein, 9 aa, Homo Sapiens
ARSRHGKEN

SEQ ID NO: 139149 - protein, 9 aa, Homo Sapiens
MTEVVRHCP

SEQ ID NO: 139150 - protein, 9 aa, Homo Sapiens
CGDTSDERD

SEQ ID NO: 139151 - protein, 9 aa, Homo Sapiens
APDVTRVPE

SEQ ID NO: 139152 - protein, 9 aa, Homo Sapiens
NKTVEEMKV

SEQ ID NO: 139153 - protein, 9 aa, Homo Sapiens
TRVPEARLL

SEQ ID NO: 139154 - protein, 9 aa, Homo Sapiens
EYHIEFLGN

SEQ ID NO: 139155 - protein, 9 aa, Homo Sapiens
EAAQTQAQA

SEQ ID NO: 139156 - protein, 9 aa, Homo Sapiens
SRFHCRGVD

SEQ ID NO: 139157 - protein, 9 aa, Homo Sapiens
VSMDSRCHI

SEQ ID NO: 139158 - protein, 9 aa, Homo Sapiens
EYTVAVKNI

SEQ ID NO: 139159 - protein, 9 aa, Homo Sapiens
FERYLVPLG

SEQ ID NO: 139160 - protein, 9 aa, Homo Sapiens
LILRHRHQG

SEQ ID NO: 139161 - protein, 9 aa, Homo Sapiens
GTSCRCWQL

SEQ ID NO: 139162 - protein, 9 aa, Homo Sapiens
KAVQGCMRL

SEQ ID NO: 139163 - protein, 9 aa, Homo Sapiens
ATRRCSICS

SEQ ID NO: 139164 - protein, 9 aa, Homo Sapiens
QNLWNPTYH

SEQ ID NO: 139165 - protein, 9 aa, Homo Sapiens
CVAAILQGV

SEQ ID NO: 139166 - protein, 9 aa, Homo Sapiens
LGYCSSACP

SEQ ID NO: 139167 - protein, 9 aa, Homo Sapiens
TCQRTGTAT

SEQ ID NO: 139168 - protein, 9 aa, Homo Sapiens
SPLGSNVTL

SEQ ID NO: 139169 - protein, 9 aa, Homo Sapiens
HWSCGLCCH

SEQ ID NO: 139170 - protein, 9 aa, Homo Sapiens
IGAEADENK

SEQ ID NO: 139171 - protein, 9 aa, Homo Sapiens
MGSHFGSWM

SEQ ID NO: 139172 - protein, 9 aa, Homo Sapiens
LQIFCHGKY

SEQ ID NO: 139173 - protein, 9 aa, Homo Sapiens
PPPMERAAT

SEQ ID NO: 139174 - protein, 9 aa, Homo Sapiens
TIHAYKGVL

SEQ ID NO: 139175 - protein, 9 aa, Homo Sapiens
KVGQQALRQ

SEQ ID NO: 139176 - protein, 9 aa, Homo Sapiens
GTATCASSC

SEQ ID NO: 139177 - protein, 9 aa, Homo Sapiens
DYSGPSQEF

SEQ ID NO: 139178 - protein, 9 aa, Homo Sapiens
VPSPSEEPV

SEQ ID NO: 139179 - protein, 9 aa, Homo Sapiens
MEEQKKYYN

SEQ ID NO: 139180 - protein, 9 aa, Homo Sapiens
DVTDDGPYM

SEQ ID NO: 139181 - protein, 9 aa, Homo Sapiens
EMTVWVHKL

SEQ ID NO: 139182 - protein, 9 aa, Homo Sapiens
DMGQMHRQK

SEQ ID NO: 139183 - protein, 9 aa, Homo Sapiens
SADMVTVLQ

SEQ ID NO: 139184 - protein, 9 aa, Homo Sapiens
MITKKWPSI

SEQ ID NO: 139185 - protein, 9 aa, Homo Sapiens
EEMITKKWP

SEQ ID NO: 139186 - protein, 9 aa, Homo Sapiens
YILAEELHR

SEQ ID NO: 139187 - protein, 9 aa, Homo Sapiens
QEYEHLRDL

SEQ ID NO: 139188 - protein, 9 aa, Homo Sapiens
CPEDNKITE

SEQ ID NO: 139189 - protein, 9 aa, Homo Sapiens
VGVGKSALT

SEQ ID NO: 139190 - protein, 9 aa, Homo Sapiens
PEYTVAVKN

SEQ ID NO: 139191 - protein, 9 aa, Homo Sapiens
TLGRYMVKH

SEQ ID NO: 139192 - protein, 9 aa, Homo Sapiens
DGQGVSLSP

SEQ ID NO: 139193 - protein, 9 aa, Homo Sapiens
VSQFIQPYL

SEQ ID NO: 139194 - protein, 9 aa, Homo Sapiens
WVMVTWNSI

SEQ ID NO: 139195 - protein, 9 aa, Homo Sapiens
VFNSWAQAI

SEQ ID NO: 139196 - protein, 9 aa, Homo Sapiens
FLEWVMVTW

SEQ ID NO: 139197 - protein, 9 aa, Homo Sapiens
RYLVPLGDK

SEQ ID NO: 139198 - protein, 9 aa, Homo Sapiens
FMDGSRPYG

SEQ ID NO: 139199 - protein, 9 aa, Homo Sapiens
KRVQEVACS

SEQ ID NO: 139200 - protein, 9 aa, Homo Sapiens
YHVIVYPMK

SEQ ID NO: 139201 - protein, 9 aa, Homo Sapiens
GYSTQLFYS

SEQ ID NO: 139202 - protein, 9 aa, Homo Sapiens
WLLLDLTPL

SEQ ID NO: 139203 - protein, 9 aa, Homo Sapiens
FCNEDQWAW

SEQ ID NO: 139204 - protein, 9 aa, Homo Sapiens
PLARRCFPT

SEQ ID NO: 139205 - protein, 9 aa, Homo Sapiens
TTAKQRLGK

SEQ ID NO: 139206 - protein, 9 aa, Homo Sapiens
KAVLDPKGL

SEQ ID NO: 139207 - protein, 9 aa, Homo Sapiens
MAFLKAMEA

SEQ ID NO: 139208 - protein, 9 aa, Homo Sapiens
DSCIDLARC

SEQ ID NO: 139209 - protein, 9 aa, Homo Sapiens
EVWIPGKGH

SEQ ID NO: 139210 - protein, 9 aa, Homo Sapiens
AEEAAAEKQ

SEQ ID NO: 139211 - protein, 9 aa, Homo Sapiens
GNEPLQHLL

SEQ ID NO: 139212 - protein, 9 aa, Homo Sapiens
LRNEQQFKE

SEQ ID NO: 139213 - protein, 9 aa, Homo Sapiens
VQSSFSMRD

SEQ ID NO: 139214 - protein, 9 aa, Homo Sapiens
IFFMDGSRP

SEQ ID NO: 139215 - protein, 9 aa, Homo Sapiens
SHWKSLKHQ

SEQ ID NO: 139216 - protein, 9 aa, Homo Sapiens
WLTPNLQLF

SEQ ID NO: 139217 - protein, 9 aa, Homo Sapiens
DQKVLTITH

SEQ ID NO: 139218 - protein, 9 aa, Homo Sapiens
VEDALIYLD

SEQ ID NO: 139219 - protein, 9 aa, Homo Sapiens
FINPAILIH

SEQ ID NO: 139220 - protein, 9 aa, Homo Sapiens
IHKGVKKCV

SEQ ID NO: 139221 - protein, 9 aa, Homo Sapiens
LIYLDQVKI

SEQ ID NO: 139222 - protein, 9 aa, Homo Sapiens
FRRGSSHSL

SEQ ID NO: 139223 - protein, 9 aa, Homo Sapiens
QIKVTLQPL

SEQ ID NO: 139224 - protein, 9 aa, Homo Sapiens
ELHRELPPD

SEQ ID NO: 139225 - protein, 9 aa, Homo Sapiens
PEEVPPQAE

SEQ ID NO: 139226 - protein, 9 aa, Homo Sapiens
DVSVTVSMD

SEQ ID NO: 139227 - protein, 9 aa, Homo Sapiens
DEYLQNTGN

SEQ ID NO: 139228 - protein, 9 aa, Homo Sapiens
KGLMNPGKV

SEQ ID NO: 139229 - protein, 9 aa, Homo Sapiens
ISTRDPLSK

SEQ ID NO: 139230 - protein, 9 aa, Homo Sapiens
HKDPEVKFN

SEQ ID NO: 139231 - protein, 9 aa, Homo Sapiens
TLGRPLVLN

SEQ ID NO: 139232 - protein, 9 aa, Homo Sapiens
RHEGFERYL

SEQ ID NO: 139233 - protein, 9 aa, Homo Sapiens
SHRVSHSVL

SEQ ID NO: 139234 - protein, 9 aa, Homo Sapiens
HLVAADLIY

SEQ ID NO: 139235 - protein, 9 aa, Homo Sapiens
STRDPLSKI

SEQ ID NO: 139236 - protein, 9 aa, Homo Sapiens
TVWVHKLPL

SEQ ID NO: 139237 - protein, 9 aa, Homo Sapiens
APPPSPAPS

SEQ ID NO: 139238 - protein, 9 aa, Homo Sapiens
PIFRYFFGW

SEQ ID NO: 139239 - protein, 9 aa, Homo Sapiens
STKGWWPLT

SEQ ID NO: 139240 - protein, 9 aa, Homo Sapiens
AEIILTMLL

SEQ ID NO: 139241 - protein, 9 aa, Homo Sapiens
GQGVSLSPV

SEQ ID NO: 139242 - protein, 9 aa, Homo Sapiens
LFINPAILI

SEQ ID NO: 139243 - protein, 9 aa, Homo Sapiens
CKKCSHWKS

SEQ ID NO: 139244 - protein, 9 aa, Homo Sapiens
SDQFCEINI

SEQ ID NO: 139245 - protein, 9 aa, Homo Sapiens
DSPLYAVAR

SEQ ID NO: 139246 - protein, 9 aa, Homo Sapiens
VKIVCLGDS

SEQ ID NO: 139247 - protein, 9 aa, Homo Sapiens
ASVPSPSEE

SEQ ID NO: 139248 - protein, 9 aa, Homo Sapiens
DNVKIVCLG

SEQ ID NO: 139249 - protein, 9 aa, Homo Sapiens
KSLALQQED

SEQ ID NO: 139250 - protein, 9 aa, Homo Sapiens
LRAANNHSS

SEQ ID NO: 139251 - protein, 9 aa, Homo Sapiens
ARAKTQMPP

SEQ ID NO: 139252 - protein, 9 aa, Homo Sapiens
NEPLQHLLS

SEQ ID NO: 139253 - protein, 9 aa, Homo Sapiens
HHAASTGLA

SEQ ID NO: 139254 - protein, 9 aa, Homo Sapiens
RCFVKVHAY

SEQ ID NO: 139255 - protein, 9 aa, Homo Sapiens
KFMLRNEQQ

SEQ ID NO: 139256 - protein, 9 aa, Homo Sapiens
DDNVKIVCL

SEQ ID NO: 139257 - protein, 9 aa, Homo Sapiens
SSGISRLIK

SEQ ID NO: 139258 - protein, 9 aa, Homo Sapiens
FIGELTITV

SEQ ID NO: 139259 - protein, 9 aa, Homo Sapiens
VWLIIPEPG

SEQ ID NO: 139260 - protein, 9 aa, Homo Sapiens
LRHRHQGKH

SEQ ID NO: 139261 - protein, 9 aa, Homo Sapiens
RTRPRRFMV

SEQ ID NO: 139262 - protein, 9 aa, Homo Sapiens
VPSPASLWA

SEQ ID NO: 139263 - protein, 9 aa, Homo Sapiens
FLWPHLGPP

SEQ ID NO: 139264 - protein, 9 aa, Homo Sapiens
SCLRKVQTF

SEQ ID NO: 139265 - protein, 9 aa, Homo Sapiens
GPYMCSVQT

SEQ ID NO: 139266 - protein, 9 aa, Homo Sapiens
IQSEWKEIS

SEQ ID NO: 139267 - protein, 9 aa, Homo Sapiens
TLLQIFCHG

SEQ ID NO: 139268 - protein, 9 aa, Homo Sapiens
VLTITHVLM

SEQ ID NO: 139269 - protein, 9 aa, Homo Sapiens
FMFRRGSSH

SEQ ID NO: 139270 - protein, 9 aa, Homo Sapiens
VKDVSVTVS

SEQ ID NO: 139271 - protein, 9 aa, Homo Sapiens
EMITKKWPS

SEQ ID NO: 139272 - protein, 9 aa, Homo Sapiens
HVIVYPMKF

SEQ ID NO: 139273 - protein, 9 aa, Homo Sapiens
ALQEATFDQ

SEQ ID NO: 139274 - protein, 9 aa, Homo Sapiens
KSQSASGVH

SEQ ID NO: 139275 - protein, 9 aa, Homo Sapiens
FLKKIKWFA

SEQ ID NO: 139276 - protein, 9 aa, Homo Sapiens
QASQIKVTL

SEQ ID NO: 139277 - protein, 9 aa, Homo Sapiens
DFLQVFIYH

SEQ ID NO: 139278 - protein, 9 aa, Homo Sapiens
LVVVGAVGV

SEQ ID NO: 139279 - protein, 9 aa, Homo Sapiens
GHQKKAMGF

SEQ ID NO: 139280 - protein, 9 aa, Homo Sapiens
VTDDGPYMC

SEQ ID NO: 139281 - protein, 9 aa, Homo Sapiens
LTKNFPVTC

SEQ ID NO: 139282 - protein, 9 aa, Homo Sapiens
VRAMGSHFG

SEQ ID NO: 139283 - protein, 9 aa, Homo Sapiens
LHIFMLILL

SEQ ID NO: 139284 - protein, 9 aa, Homo Sapiens
FVRQFSWLE

SEQ ID NO: 139285 - protein, 9 aa, Homo Sapiens
SLWAPPPSP

SEQ ID NO: 139286 - protein, 9 aa, Homo Sapiens
DFRVKTCRG

SEQ ID NO: 139287 - protein, 9 aa, Homo Sapiens
NEQQFKEEK

SEQ ID NO: 139288 - protein, 9 aa, Homo Sapiens
ARATLGRPL

SEQ ID NO: 139289 - protein, 9 aa, Homo Sapiens
GKGHPESPE

SEQ ID NO: 139290 - protein, 9 aa, Homo Sapiens
QFSWLEICN

SEQ ID NO: 139291 - protein, 9 aa, Homo Sapiens
NVCVSSSQG

SEQ ID NO: 139292 - protein, 9 aa, Homo Sapiens
LYHIVWLNC

SEQ ID NO: 139293 - protein, 9 aa, Homo Sapiens
IQIHPLSQA

SEQ ID NO: 139294 - protein, 9 aa, Homo Sapiens
YNFRVTMVM

SEQ ID NO: 139295 - protein, 9 aa, Homo Sapiens
RRRCFVKVH

SEQ ID NO: 139296 - protein, 9 aa, Homo Sapiens
QQQLHLEQI

SEQ ID NO: 139297 - protein, 9 aa, Homo Sapiens
LSGSKEVQE

SEQ ID NO: 139298 - protein, 9 aa, Homo Sapiens
WVHKLPLHI

SEQ ID NO: 139299 - protein, 9 aa, Homo Sapiens
KKAMGFLGT

SEQ ID NO: 139300 - protein, 9 aa, Homo Sapiens
QSHRVSHSV

SEQ ID NO: 139301 - protein, 9 aa, Homo Sapiens
NLQLFVGGT

SEQ ID NO: 139302 - protein, 9 aa, Homo Sapiens
LALQQEDFA

SEQ ID NO: 139303 - protein, 9 aa, Homo Sapiens
PSIRNSLMI

SEQ ID NO: 139304 - protein, 9 aa, Homo Sapiens
FLGNPHSRS

SEQ ID NO: 139305 - protein, 9 aa, Homo Sapiens
FFMDGSRPY

SEQ ID NO: 139306 - protein, 9 aa, Homo Sapiens
DRYHVIVYP

SEQ ID NO: 139307 - protein, 9 aa, Homo Sapiens
LLIMNIDME

SEQ ID NO: 139308 - protein, 9 aa, Homo Sapiens
KWIQSEWKE

SEQ ID NO: 139309 - protein, 9 aa, Homo Sapiens
YSRWIFLFI

SEQ ID NO: 139310 - protein, 9 aa, Homo Sapiens
LEMTVWVHK

SEQ ID NO: 139311 - protein, 9 aa, Homo Sapiens
PCSGPASQT

SEQ ID NO: 139312 - protein, 9 aa, Homo Sapiens
RRFMVLAEV

SEQ ID NO: 139313 - protein, 9 aa, Homo Sapiens
RGSSHSLCE

SEQ ID NO: 139314 - protein, 9 aa, Homo Sapiens
MFIACWSPL

SEQ ID NO: 139315 - protein, 9 aa, Homo Sapiens
GNKRVQEVA

SEQ ID NO: 139316 - protein, 9 aa, Homo Sapiens
VGPGVSQFI

SEQ ID NO: 139317 - protein, 9 aa, Homo Sapiens
SLALQQEDF

SEQ ID NO: 139318 - protein, 9 aa, Homo Sapiens
TKLGYCSSA

SEQ ID NO: 139319 - protein, 9 aa, Homo Sapiens
RSCLRKVQT

SEQ ID NO: 139320 - protein, 9 aa, Homo Sapiens
FLILRHRHQ

SEQ ID NO: 139321 - protein, 9 aa, Homo Sapiens
LSKITEQEK

SEQ ID NO: 139322 - protein, 9 aa, Homo Sapiens
EFLGNPHSR

SEQ ID NO: 139323 - protein, 9 aa, Homo Sapiens
IVVSMFIAC

SEQ ID NO: 139324 - protein, 9 aa, Homo Sapiens
GGSFNVNTI

SEQ ID NO: 139325 - protein, 9 aa, Homo Sapiens
MANRTLPPG

SEQ ID NO: 139326 - protein, 9 aa, Homo Sapiens
LSIDRYHVI

SEQ ID NO: 139327 - protein, 9 aa, Homo Sapiens
PYMCSVQTQ

SEQ ID NO: 139328 - protein, 9 aa, Homo Sapiens
NWQLHIFML

SEQ ID NO: 139329 - protein, 9 aa, Homo Sapiens
QDGKTLLIM

SEQ ID NO: 139330 - protein, 9 aa, Homo Sapiens
EIQIHPLSQ

SEQ ID NO: 139331 - protein, 9 aa, Homo Sapiens
ANQEYEHLR

SEQ ID NO: 139332 - protein, 9 aa, Homo Sapiens
QQQQESALR

SEQ ID NO: 139333 - protein, 9 aa, Homo Sapiens
KVHAYANDK

SEQ ID NO: 139334 - protein, 9 aa, Homo Sapiens
YNSVSKIDK

SEQ ID NO: 139335 - protein, 9 aa, Homo Sapiens
VCVSSSQGG

SEQ ID NO: 139336 - protein, 9 aa, Homo Sapiens
DADDNVKIV

SEQ ID NO: 139337 - protein, 9 aa, Homo Sapiens
SLASYGFKD

SEQ ID NO: 139338 - protein, 9 aa, Homo Sapiens
YGFKDGDVV

SEQ ID NO: 139339 - protein, 9 aa, Homo Sapiens
MVQQKKDGP

SEQ ID NO: 139340 - protein, 9 aa, Homo Sapiens
ITVRAMGSH

SEQ ID NO: 139341 - protein, 9 aa, Homo Sapiens
QEAHTDGSW

SEQ ID NO: 139342 - protein, 9 aa, Homo Sapiens
IQPECSEPR

SEQ ID NO: 139343 - protein, 9 aa, Homo Sapiens
DLMANRTLP

SEQ ID NO: 139344 - protein, 9 aa, Homo Sapiens
WPHLGPPPL

SEQ ID NO: 139345 - protein, 9 aa, Homo Sapiens
VIRAAFPGT

SEQ ID NO: 139346 - protein, 9 aa, Homo Sapiens
TGNMKNFAD

SEQ ID NO: 139347 - protein, 9 aa, Homo Sapiens
NRTLPPGGR

SEQ ID NO: 139348 - protein, 9 aa, Homo Sapiens
AMGFLGTQI

SEQ ID NO: 139349 - protein, 9 aa, Homo Sapiens
HVKVQKVGQ

SEQ ID NO: 139350 - protein, 9 aa, Homo Sapiens
ATLGRPLVL

SEQ ID NO: 139351 - protein, 9 aa, Homo Sapiens
QEGTAPTEF

SEQ ID NO: 139352 - protein, 9 aa, Homo Sapiens
HCHAPDEQR

SEQ ID NO: 139353 - protein, 9 aa, Homo Sapiens
LIYLCCSAV

SEQ ID NO: 139354 - protein, 9 aa, Homo Sapiens
ATCASSCAT

SEQ ID NO: 139355 - protein, 9 aa, Homo Sapiens
PVHVEDALI

SEQ ID NO: 139356 - protein, 9 aa, Homo Sapiens
RHCPHHERC

SEQ ID NO: 139357 - protein, 9 aa, Homo Sapiens
GVSPLGSNV

SEQ ID NO: 139358 - protein, 9 aa, Homo Sapiens
VLAWKLDPQ

SEQ ID NO: 139359 - protein, 9 aa, Homo Sapiens
YIHKGVKKC

SEQ ID NO: 139360 - protein, 9 aa, Homo Sapiens
FRVTMVMWG

SEQ ID NO: 139361 - protein, 9 aa, Homo Sapiens
VSVTVSMDS

SEQ ID NO: 139362 - protein, 9 aa, Homo Sapiens
KQGLQRRAT

SEQ ID NO: 139363 - protein, 9 aa, Homo Sapiens
TCASSCATS

SEQ ID NO: 139364 - protein, 9 aa, Homo Sapiens
PGVSQFIQP

SEQ ID NO: 139365 - protein, 9 aa, Homo Sapiens
PPQAEEITI

SEQ ID NO: 139366 - protein, 9 aa, Homo Sapiens
IDLARCCLQ

SEQ ID NO: 139367 - protein, 9 aa, Homo Sapiens
TQSLYHIVW

SEQ ID NO: 139368 - protein, 9 aa, Homo Sapiens
TCPEDNKIT

SEQ ID NO: 139369 - protein, 9 aa, Homo Sapiens
LRLRGHQKK

SEQ ID NO: 139370 - protein, 9 aa, Homo Sapiens
TLLIMNIDM

SEQ ID NO: 139371 - protein, 9 aa, Homo Sapiens
RAKTQMPPV

SEQ ID NO: 139372 - protein, 9 aa, Homo Sapiens
EFMAYQLYT

SEQ ID NO: 139373 - protein, 9 aa, Homo Sapiens
PSPSEEPVV

SEQ ID NO: 139374 - protein, 9 aa, Homo Sapiens
LDPKGLMNP

SEQ ID NO: 139375 - protein, 9 aa, Homo Sapiens
PPVASDLGS

SEQ ID NO: 139376 - protein, 9 aa, Homo Sapiens
KPFGLRIKM

SEQ ID NO: 139377 - protein, 9 aa, Homo Sapiens
AMEAQLYVD

SEQ ID NO: 139378 - protein, 9 aa, Homo Sapiens
HRQILVDKY

SEQ ID NO: 139379 - protein, 9 aa, Homo Sapiens
NEEMITKKW

SEQ ID NO: 139380 - protein, 9 aa, Homo Sapiens
AQQQLHLEQ

SEQ ID NO: 139381 - protein, 9 aa, Homo Sapiens
GLVTILLIL

SEQ ID NO: 139382 - protein, 9 aa, Homo Sapiens
DPKGLMNPG

SEQ ID NO: 139383 - protein, 9 aa, Homo Sapiens
GVVKGQPSA

SEQ ID NO: 139384 - protein, 9 aa, Homo Sapiens
PHLGPPPLH

SEQ ID NO: 139385 - protein, 9 aa, Homo Sapiens
PDADTLLQI

SEQ ID NO: 139386 - protein, 9 aa, Homo Sapiens
QLFYSVRAS

SEQ ID NO: 139387 - protein, 9 aa, Homo Sapiens
KIKWFAVLE

SEQ ID NO: 139388 - protein, 9 aa, Homo Sapiens
SRNSRFHCR

SEQ ID NO: 139389 - protein, 9 aa, Homo Sapiens
NQEYEHLRD

SEQ ID NO: 139390 - protein, 9 aa, Homo Sapiens
TDGSWPPSK

SEQ ID NO: 139391 - protein, 9 aa, Homo Sapiens
NFNYFYYRE

SEQ ID NO: 139392 - protein, 9 aa, Homo Sapiens
AAGVGPSSG

SEQ ID NO: 139393 - protein, 9 aa, Homo Sapiens
RNSRFHCRG

SEQ ID NO: 139394 - protein, 9 aa, Homo Sapiens
RRGSSHSLC

SEQ ID NO: 139395 - protein, 9 aa, Homo Sapiens
ELTITVMCE

SEQ ID NO: 139396 - protein, 9 aa, Homo Sapiens
FYMAFSFFC

SEQ ID NO: 139397 - protein, 9 aa, Homo Sapiens
FYYRETEGE

SEQ ID NO: 139398 - protein, 9 aa, Homo Sapiens
YSEQDMGQM

SEQ ID NO: 139399 - protein, 9 aa, Homo Sapiens
FLRLVFNSW

SEQ ID NO: 139400 - protein, 9 aa, Homo Sapiens
LLRLFSVVI

SEQ ID NO: 139401 - protein, 9 aa, Homo Sapiens
EQARAKTQM

SEQ ID NO: 139402 - protein, 9 aa, Homo Sapiens
VKDITVNIN

SEQ ID NO: 139403 - protein, 9 aa, Homo Sapiens
AQTQAQADL

SEQ ID NO: 139404 - protein, 9 aa, Homo Sapiens
VAADLIYLC

SEQ ID NO: 139405 - protein, 9 aa, Homo Sapiens
WWPLTASAA

SEQ ID NO: 139406 - protein, 9 aa, Homo Sapiens
NVKIVCLGD

SEQ ID NO: 139407 - protein, 9 aa, Homo Sapiens
ALMKDSPLY

SEQ ID NO: 139408 - protein, 9 aa, Homo Sapiens
SRHGKENLE

SEQ ID NO: 139409 - protein, 9 aa, Homo Sapiens
QAEEITIPA

SEQ ID NO: 139410 - protein, 9 aa, Homo Sapiens
VVDVSHKDP

SEQ ID NO: 139411 - protein, 9 aa, Homo Sapiens
GSSHSLCED

SEQ ID NO: 139412 - protein, 9 aa, Homo Sapiens
VAVKNIKLY

SEQ ID NO: 139413 - protein, 9 aa, Homo Sapiens
ITVNINELK

SEQ ID NO: 139414 - protein, 9 aa, Homo Sapiens
VLQMTIPSA

SEQ ID NO: 139415 - protein, 9 aa, Homo Sapiens
WPSIRNSLM

SEQ ID NO: 139416 - protein, 9 aa, Homo Sapiens
IKFMLRNEQ

SEQ ID NO: 139417 - protein, 9 aa, Homo Sapiens
QIHPLSQAS

SEQ ID NO: 139418 - protein, 9 aa, Homo Sapiens
TFIHTLEVQ

SEQ ID NO: 139419 - protein, 9 aa, Homo Sapiens
LTKLGYCSS

SEQ ID NO: 139420 - protein, 9 aa, Homo Sapiens
SKIVEVKNF

SEQ ID NO: 139421 - protein, 9 aa, Homo Sapiens
LSRHKLQDE

SEQ ID NO: 139422 - protein, 9 aa, Homo Sapiens
VPFQRREKW

SEQ ID NO: 139423 - protein, 9 aa, Homo Sapiens
THWNWDQPG

SEQ ID NO: 139424 - protein, 9 aa, Homo Sapiens
QEFFFLLSQ

SEQ ID NO: 139425 - protein, 9 aa, Homo Sapiens
PGYSTQLFY

SEQ ID NO: 139426 - protein, 9 aa, Homo Sapiens
FNSWAQAIH

SEQ ID NO: 139427 - protein, 9 aa, Homo Sapiens
EEDVQAKKE

SEQ ID NO: 139428 - protein, 9 aa, Homo Sapiens
VYGRAPRYI

SEQ ID NO: 139429 - protein, 9 aa, Homo Sapiens
EGVPPSKNM

SEQ ID NO: 139430 - protein, 9 aa, Homo Sapiens
VGTRDLISK

SEQ ID NO: 139431 - protein, 9 aa, Homo Sapiens
AQAPGDRGL

SEQ ID NO: 139432 - protein, 9 aa, Homo Sapiens
SALRENILV

SEQ ID NO: 139433 - protein, 9 aa, Homo Sapiens
QRTGTATCA

SEQ ID NO: 139434 - protein, 9 aa, Homo Sapiens
VKKPFGLRI

SEQ ID NO: 139435 - protein, 9 aa, Homo Sapiens
VSKIDKISR

SEQ ID NO: 139436 - protein, 9 aa, Homo Sapiens
KAMGFLGTQ

SEQ ID NO: 139437 - protein, 9 aa, Homo Sapiens
EANQEYEHL

SEQ ID NO: 139438 - protein, 9 aa, Homo Sapiens
ETLSSDKKG

SEQ ID NO: 139439 - protein, 9 aa, Homo Sapiens
DENKTVEEM

SEQ ID NO: 139440 - protein, 9 aa, Homo Sapiens
AVQGCMRLI

SEQ ID NO: 139441 - protein, 9 aa, Homo Sapiens
TVRAMGSHF

SEQ ID NO: 139442 - protein, 9 aa, Homo Sapiens
EDALIYLDQ

SEQ ID NO: 139443 - protein, 9 aa, Homo Sapiens
TGTATCASS

SEQ ID NO: 139444 - protein, 9 aa, Homo Sapiens
VKGQPSASA

SEQ ID NO: 139445 - protein, 9 aa, Homo Sapiens
IRAAFPGTT

SEQ ID NO: 139446 - protein, 9 aa, Homo Sapiens
HTATCQRTG

SEQ ID NO: 139447 - protein, 9 aa, Homo Sapiens
AASTGLASA

SEQ ID NO: 139448 - protein, 9 aa, Homo Sapiens
GKTLLIMNI

SEQ ID NO: 139449 - protein, 9 aa, Homo Sapiens
SNFNYFYYR

SEQ ID NO: 139450 - protein, 9 aa, Homo Sapiens
QIPSGTVVL

SEQ ID NO: 139451 - protein, 9 aa, Homo Sapiens
TERRWVFQA

SEQ ID NO: 139452 - protein, 9 aa, Homo Sapiens
GKYSRWIFL

SEQ ID NO: 139453 - protein, 9 aa, Homo Sapiens
VTVSMDSRC

SEQ ID NO: 139454 - protein, 9 aa, Homo Sapiens
LLPAHTLQG

SEQ ID NO: 139455 - protein, 9 aa, Homo Sapiens
SHISGKYAS

SEQ ID NO: 139456 - protein, 9 aa, Homo Sapiens
FVKVHAYAN

SEQ ID NO: 139457 - protein, 9 aa, Homo Sapiens
VAEIILTML

SEQ ID NO: 139458 - protein, 9 aa, Homo Sapiens
CRGATVTIV

SEQ ID NO: 139459 - protein, 9 aa, Homo Sapiens
CHSRKKGPI

SEQ ID NO: 139460 - protein, 9 aa, Homo Sapiens
DEQRLEARR

SEQ ID NO: 139461 - protein, 9 aa, Homo Sapiens
RVGGSTHLL

SEQ ID NO: 139462 - protein, 9 aa, Homo Sapiens
SPEYTVAVK

SEQ ID NO: 139463 - protein, 9 aa, Homo Sapiens
VVVDVSHKD

SEQ ID NO: 139464 - protein, 9 aa, Homo Sapiens
VVGAVGVGK

SEQ ID NO: 139465 - protein, 9 aa, Homo Sapiens
TPNLQLFVG

SEQ ID NO: 139466 - protein, 9 aa, Homo Sapiens
IYSEQDMGQ

SEQ ID NO: 139467 - protein, 9 aa, Homo Sapiens
CWQLSPGHG

SEQ ID NO: 139468 - protein, 9 aa, Homo Sapiens
TRLSADMVT

SEQ ID NO: 139469 - protein, 9 aa, Homo Sapiens
GDTSDERDC

SEQ ID NO: 139470 - protein, 9 aa, Homo Sapiens
GNVVKTWRF

SEQ ID NO: 139471 - protein, 9 aa, Homo Sapiens
KVTLQPLTA

SEQ ID NO: 139472 - protein, 9 aa, Homo Sapiens
AHTDGSWPP

SEQ ID NO: 139473 - protein, 9 aa, Homo Sapiens
TIPSACGTS

SEQ ID NO: 139474 - protein, 9 aa, Homo Sapiens
YCSSACPSD

SEQ ID NO: 139475 - protein, 9 aa, Homo Sapiens
LIIPEPGSR

SEQ ID NO: 139476 - protein, 9 aa, Homo Sapiens
EVVRHCPHH

SEQ ID NO: 139477 - protein, 9 aa, Homo Sapiens
GVDLKDVDP

SEQ ID NO: 139478 - protein, 9 aa, Homo Sapiens
YDKFSMGDA

SEQ ID NO: 139479 - protein, 9 aa, Homo Sapiens
NFRVTMVMW

SEQ ID NO: 139480 - protein, 9 aa, Homo Sapiens
VLAEVIVVI

SEQ ID NO: 139481 - protein, 9 aa, Homo Sapiens
IPSGTVVLE

SEQ ID NO: 139482 - protein, 9 aa, Homo Sapiens
QKVGQQALR

SEQ ID NO: 139483 - protein, 9 aa, Homo Sapiens
ANNHSSAKP

SEQ ID NO: 139484 - protein, 9 aa, Homo Sapiens
NYFYYRETE

SEQ ID NO: 139485 - protein, 9 aa, Homo Sapiens
DDGPYMCSV

SEQ ID NO: 139486 - protein, 9 aa, Homo Sapiens
RYIHKGVKK

SEQ ID NO: 139487 - protein, 9 aa, Homo Sapiens
LLRAANNHS

SEQ ID NO: 139488 - protein, 9 aa, Homo Sapiens
IPGKGHPES

SEQ ID NO: 139489 - protein, 9 aa, Homo Sapiens
PRVGGSTHL

SEQ ID NO: 139490 - protein, 9 aa, Homo Sapiens
AGLVTILLI

SEQ ID NO: 139491 - protein, 9 aa, Homo Sapiens
IALSRHKLQ

SEQ ID NO: 139492 - protein, 9 aa, Homo Sapiens
SCRCWQLSP

SEQ ID NO: 139493 - protein, 9 aa, Homo Sapiens
ENAAGVGPS

SEQ ID NO: 139494 - protein, 9 aa, Homo Sapiens
PDEQRLEAR

SEQ ID NO: 139495 - protein, 9 aa, Homo Sapiens
YFFGWMVPP

SEQ ID NO: 139496 - protein, 9 aa, Homo Sapiens
SCHGLSVNV

SEQ ID NO: 139497 - protein, 9 aa, Homo Sapiens
FLFIQPECS

SEQ ID NO: 139498 - protein, 9 aa, Homo Sapiens
QLGNEPLQH

SEQ ID NO: 139499 - protein, 9 aa, Homo Sapiens
LRDTERRWV

SEQ ID NO: 139500 - protein, 9 aa, Homo Sapiens
KSEYVGASN

SEQ ID NO: 139501 - protein, 9 aa, Homo Sapiens
GFKDGDVVI

SEQ ID NO: 139502 - protein, 9 aa, Homo Sapiens
WGVFCNEDQ

SEQ ID NO: 139503 - protein, 9 aa, Homo Sapiens
MTISCHGLS

SEQ ID NO: 139504 - protein, 9 aa, Homo Sapiens
QHITHQFFK

SEQ ID NO: 139505 - protein, 9 aa, Homo Sapiens
PPMERAATR

SEQ ID NO: 139506 - protein, 9 aa, Homo Sapiens
GKDIFMMEE

SEQ ID NO: 139507 - protein, 9 aa, Homo Sapiens
CLLLPAHTL

SEQ ID NO: 139508 - protein, 9 aa, Homo Sapiens
TSVPFQRRE

SEQ ID NO: 139509 - protein, 9 aa, Homo Sapiens
NPIFRYFFG

SEQ ID NO: 139510 - protein, 9 aa, Homo Sapiens
EKDVLQLNE

SEQ ID NO: 139511 - protein, 9 aa, Homo Sapiens
PEPGSRIHL

SEQ ID NO: 139512 - protein, 9 aa, Homo Sapiens
QASVPSPSE

SEQ ID NO: 139513 - protein, 9 aa, Homo Sapiens
PPHEFMAYQ

SEQ ID NO: 139514 - protein, 9 aa, Homo Sapiens
TSCRCWQLS

SEQ ID NO: 139515 - protein, 9 aa, Homo Sapiens
DVDPIRHYY

SEQ ID NO: 139516 - protein, 9 aa, Homo Sapiens
IILTMLLAL

SEQ ID NO: 139517 - protein, 9 aa, Homo Sapiens
LMKDSPLYA

SEQ ID NO: 139518 - protein, 9 aa, Homo Sapiens
LKAMEAQLY

SEQ ID NO: 139519 - protein, 9 aa, Homo Sapiens
NNPIFRYFF

SEQ ID NO: 139520 - protein, 9 aa, Homo Sapiens
AVYDKFSMG

SEQ ID NO: 139521 - protein, 9 aa, Homo Sapiens
ADMVTVLQL

SEQ ID NO: 139522 - protein, 9 aa, Homo Sapiens
LSSDKKGSK

SEQ ID NO: 139523 - protein, 9 aa, Homo Sapiens
AQHITHQFF

SEQ ID NO: 139524 - protein, 9 aa, Homo Sapiens
VSVVWGVFC

SEQ ID NO: 139525 - protein, 9 aa, Homo Sapiens
VGAVGVGKS

SEQ ID NO: 139526 - protein, 9 aa, Homo Sapiens
RCSICSHTA

SEQ ID NO: 139527 - protein, 9 aa, Homo Sapiens
SHTATCQRT

SEQ ID NO: 139528 - protein, 9 aa, Homo Sapiens
FLRDTERRW

SEQ ID NO: 139529 - protein, 9 aa, Homo Sapiens
RRCFVKVHA

SEQ ID NO: 139530 - protein, 9 aa, Homo Sapiens
HQKKAMGFL

SEQ ID NO: 139531 - protein, 9 aa, Homo Sapiens
MNIDMEPCT

SEQ ID NO: 139532 - protein, 9 aa, Homo Sapiens
KLDPQNMGY

SEQ ID NO: 139533 - protein, 9 aa, Homo Sapiens
MGQMHRQKA

SEQ ID NO: 139534 - protein, 9 aa, Homo Sapiens
EATFDQQEV

SEQ ID NO: 139535 - protein, 9 aa, Homo Sapiens
SVGTYLVLQ

SEQ ID NO: 139536 - protein, 9 aa, Homo Sapiens
NIDVGTRDL

SEQ ID NO: 139537 - protein, 9 aa, Homo Sapiens
QVFIYHLFW

SEQ ID NO: 139538 - protein, 9 aa, Homo Sapiens
VWIPGKGHP

SEQ ID NO: 139539 - protein, 9 aa, Homo Sapiens
EWVMVTWNS

SEQ ID NO: 139540 - protein, 9 aa, Homo Sapiens
SSLVDACFQ

SEQ ID NO: 139541 - protein, 9 aa, Homo Sapiens
ILIHTPAKV

SEQ ID NO: 139542 - protein, 9 aa, Homo Sapiens
FLQVFIYHL

SEQ ID NO: 139543 - protein, 9 aa, Homo Sapiens
ASNSAFEAD

SEQ ID NO: 139544 - protein, 9 aa, Homo Sapiens
MKVIFFMDG

SEQ ID NO: 139545 - protein, 9 aa, Homo Sapiens
TGLASAAGP

SEQ ID NO: 139546 - protein, 9 aa, Homo Sapiens
TDVTRGKGP

SEQ ID NO: 139547 - protein, 9 aa, Homo Sapiens
YLVLQMTIP

SEQ ID NO: 139548 - protein, 9 aa, Homo Sapiens
VVIWICLVA

SEQ ID NO: 139549 - protein, 9 aa, Homo Sapiens
ELLSGSKEV

SEQ ID NO: 139550 - protein, 9 aa, Homo Sapiens
TRRCSICSH

SEQ ID NO: 139551 - protein, 9 aa, Homo Sapiens
SFSEIQIHP

SEQ ID NO: 139552 - protein, 9 aa, Homo Sapiens
ALIYLDQVK

SEQ ID NO: 139553 - protein, 9 aa, Homo Sapiens
IFLFIQPEC

SEQ ID NO: 139554 - protein, 9 aa, Homo Sapiens
TEVVRHCPH

SEQ ID NO: 139555 - protein, 9 aa, Homo Sapiens
EQEAQAPGD

SEQ ID NO: 139556 - protein, 9 aa, Homo Sapiens
SICSHTATC

SEQ ID NO: 139557 - protein, 9 aa, Homo Sapiens
GSTHLLERG

SEQ ID NO: 139558 - protein, 9 aa, Homo Sapiens
RHRHQGKHW

SEQ ID NO: 139559 - protein, 9 aa, Homo Sapiens
KNMKLEASQ

SEQ ID NO: 139560 - protein, 9 aa, Homo Sapiens
LWPHLGPPP

SEQ ID NO: 139561 - protein, 9 aa, Homo Sapiens
RVSHSVLKP

SEQ ID NO: 139562 - protein, 9 aa, Homo Sapiens
ATFDQQEVR

SEQ ID NO: 139563 - protein, 9 aa, Homo Sapiens
IFMLILLSM

SEQ ID NO: 139564 - protein, 9 aa, Homo Sapiens
RLEARRQRE

SEQ ID NO: 139565 - protein, 9 aa, Homo Sapiens
VMVTWNSIS

SEQ ID NO: 139566 - protein, 9 aa, Homo Sapiens
FRYFFGWMV

SEQ ID NO: 139567 - protein, 9 aa, Homo Sapiens
RYFFGWMVP

SEQ ID NO: 139568 - protein, 9 aa, Homo Sapiens
NCVWLIIPE

SEQ ID NO: 139569 - protein, 9 aa, Homo Sapiens
AAVKDITVN

SEQ ID NO: 139570 - protein, 9 aa, Homo Sapiens
GLRIKMGKW

SEQ ID NO: 139571 - protein, 9 aa, Homo Sapiens
QLVGCQTLA

SEQ ID NO: 139572 - protein, 9 aa, Homo Sapiens
VQKVGQQAL

SEQ ID NO: 139573 - protein, 9 aa, Homo Sapiens
LVDACFQLP

SEQ ID NO: 139574 - protein, 9 aa, Homo Sapiens
YGRAPRYIH

SEQ ID NO: 139575 - protein, 9 aa, Homo Sapiens
MEMTDVTRG

SEQ ID NO: 139576 - protein, 9 aa, Homo Sapiens
WQLSPGHGP

SEQ ID NO: 139577 - protein, 9 aa, Homo Sapiens
GAEADENKT

SEQ ID NO: 139578 - protein, 9 aa, Homo Sapiens
PASQTLDCS

SEQ ID NO: 139579 - protein, 9 aa, Homo Sapiens
PALLTPWMR

SEQ ID NO: 139580 - protein, 9 aa, Homo Sapiens
LPAHTLQGE

SEQ ID NO: 139581 - protein, 9 aa, Homo Sapiens
TATCQRTGT

SEQ ID NO: 139582 - protein, 9 aa, Homo Sapiens
NEIALSRHK

SEQ ID NO: 139583 - protein, 9 aa, Homo Sapiens
AARSRHGKE

SEQ ID NO: 139584 - protein, 9 aa, Homo Sapiens
PCRSTKGWW

SEQ ID NO: 139585 - protein, 9 aa, Homo Sapiens
HKLQDENQK

SEQ ID NO: 139586 - protein, 9 aa, Homo Sapiens
GASNSAFEA

SEQ ID NO: 139587 - protein, 9 aa, Homo Sapiens
SRHKLQDEN

SEQ ID NO: 139588 - protein, 9 aa, Homo Sapiens
PQEMKSKQV

SEQ ID NO: 139589 - protein, 9 aa, Homo Sapiens
TKNSFSEIQ

SEQ ID NO: 139590 - protein, 9 aa, Homo Sapiens
KDGPIPPDA

SEQ ID NO: 139591 - protein, 9 aa, Homo Sapiens
IFIGELTIT

SEQ ID NO: 139592 - protein, 9 aa, Homo Sapiens
LGRYMVKHK

SEQ ID NO: 139593 - protein, 9 aa, Homo Sapiens
ITHQFFKTS

SEQ ID NO: 139594 - protein, 9 aa, Homo Sapiens
RIFIGELTI

SEQ ID NO: 139595 - protein, 9 aa, Homo Sapiens
FIHTLEVQS

SEQ ID NO: 139596 - protein, 9 aa, Homo Sapiens
VPGCVGLSH

SEQ ID NO: 139597 - protein, 9 aa, Homo Sapiens
NNHSSAKPC

SEQ ID NO: 139598 - protein, 9 aa, Homo Sapiens
IPEPGSRIH

SEQ ID NO: 139599 - protein, 9 aa, Homo Sapiens
RTLPPGGRP

SEQ ID NO: 139600 - protein, 9 aa, Homo Sapiens
TKKWPSIRN

SEQ ID NO: 139601 - protein, 9 aa, Homo Sapiens
KRPKKGMTT

SEQ ID NO: 139602 - protein, 9 aa, Homo Sapiens
SVSKIDKIS

SEQ ID NO: 139603 - protein, 9 aa, Homo Sapiens
KQQQQESAL

SEQ ID NO: 139604 - protein, 9 aa, Homo Sapiens
WQLHIFMLI

SEQ ID NO: 139605 - protein, 9 aa, Homo Sapiens
NKRVQEVAC

SEQ ID NO: 139606 - protein, 9 aa, Homo Sapiens
QGLQRRATP

SEQ ID NO: 139607 - protein, 9 aa, Homo Sapiens
QISVGTYLV

SEQ ID NO: 139608 - protein, 9 aa, Homo Sapiens
MFLRLVFNS

SEQ ID NO: 139609 - protein, 9 aa, Homo Sapiens
SLVDACFQL

SEQ ID NO: 139610 - protein, 9 aa, Homo Sapiens
KPQMDLEEQ

SEQ ID NO: 139611 - protein, 9 aa, Homo Sapiens
TYLVLQMTI

SEQ ID NO: 139612 - protein, 9 aa, Homo Sapiens
VNVCVSSSQ

SEQ ID NO: 139613 - protein, 9 aa, Homo Sapiens
MAFSFFCVA

SEQ ID NO: 139614 - protein, 9 aa, Homo Sapiens
KYSRWIFLF

SEQ ID NO: 139615 - protein, 9 aa, Homo Sapiens
AAQTQAQAD

SEQ ID NO: 139616 - protein, 9 aa, Homo Sapiens
IKMGKWCRH

SEQ ID NO: 139617 - protein, 9 aa, Homo Sapiens
FFGWMVPPK

SEQ ID NO: 139618 - protein, 9 aa, Homo Sapiens
PGKGHPESP

SEQ ID NO: 139619 - protein, 9 aa, Homo Sapiens
PAQLVGCQT

SEQ ID NO: 139620 - protein, 9 aa, Homo Sapiens
IYLDQVKIR

SEQ ID NO: 139621 - protein, 9 aa, Homo Sapiens
PSQEFFFLL

SEQ ID NO: 139622 - protein, 9 aa, Homo Sapiens
GWWPLTASA

SEQ ID NO: 139623 - protein, 9 aa, Homo Sapiens
EYEHLRDLA

SEQ ID NO: 139624 - protein, 9 aa, Homo Sapiens
PDVTRVPEA

SEQ ID NO: 139625 - protein, 9 aa, Homo Sapiens
SSQGGVVCG

SEQ ID NO: 139626 - protein, 9 aa, Homo Sapiens
PRYIHKGVK

SEQ ID NO: 139627 - protein, 9 aa, Homo Sapiens
HTLEVQSSF

SEQ ID NO: 139628 - protein, 9 aa, Homo Sapiens
EMTDVTRGK

SEQ ID NO: 139629 - protein, 9 aa, Homo Sapiens
AVKDITVNI

SEQ ID NO: 139630 - protein, 9 aa, Homo Sapiens
HLEQIQQLQ

SEQ ID NO: 139631 - protein, 9 aa, Homo Sapiens
IMNIDMEPC

SEQ ID NO: 139632 - protein, 9 aa, Homo Sapiens
DLAVGNVVK

SEQ ID NO: 139633 - protein, 9 aa, Homo Sapiens
LRENILVMR

SEQ ID NO: 139634 - protein, 9 aa, Homo Sapiens
GCVGLSHIS

SEQ ID NO: 139635 - protein, 9 aa, Homo Sapiens
RCLPGFSDQ

SEQ ID NO: 139636 - protein, 9 aa, Homo Sapiens
EADENKTVE

SEQ ID NO: 139637 - protein, 9 aa, Homo Sapiens
WLIIPEPGS

SEQ ID NO: 139638 - protein, 9 aa, Homo Sapiens
VYDKFSMGD

SEQ ID NO: 139639 - protein, 9 aa, Homo Sapiens
HSLCEDPVC

SEQ ID NO: 139640 - protein, 9 aa, Homo Sapiens
LGSRPPVSL

SEQ ID NO: 139641 - protein, 9 aa, Homo Sapiens
KGWWPLTAS

SEQ ID NO: 139642 - protein, 9 aa, Homo Sapiens
PVGGSFNVN

SEQ ID NO: 139643 - protein, 9 aa, Homo Sapiens
CQTLATPAM

SEQ ID NO: 139644 - protein, 9 aa, Homo Sapiens
PCPQEMKSK

SEQ ID NO: 139645 - protein, 9 aa, Homo Sapiens
NAARSRHGK

SEQ ID NO: 139646 - protein, 9 aa, Homo Sapiens
PMERAATRR

SEQ ID NO: 139647 - protein, 9 aa, Homo Sapiens
YSGPSQEFF

SEQ ID NO: 139648 - protein, 9 aa, Homo Sapiens
MLRNEQQFK

SEQ ID NO: 139649 - protein, 9 aa, Homo Sapiens
MYMAFKDRF

SEQ ID NO: 139650 - protein, 9 aa, Homo Sapiens
VSARDAGVS

SEQ ID NO: 139651 - protein, 9 aa, Homo Sapiens
GPSSGISRL

SEQ ID NO: 139652 - protein, 9 aa, Homo Sapiens
RCWQLSPGH

SEQ ID NO: 139653 - protein, 9 aa, Homo Sapiens
WIFLFIQPE

SEQ ID NO: 139654 - protein, 9 aa, Homo Sapiens
FMLILLSMH

SEQ ID NO: 139655 - protein, 9 aa, Homo Sapiens
EYLQNTGNM

SEQ ID NO: 139656 - protein, 9 aa, Homo Sapiens
NAAGVGPSS

SEQ ID NO: 139657 - protein, 9 aa, Homo Sapiens
SQIKVTLQP

SEQ ID NO: 139658 - protein, 9 aa, Homo Sapiens
RSTKGWWPL

SEQ ID NO: 139659 - protein, 9 aa, Homo Sapiens
KTCRGATVT

SEQ ID NO: 139660 - protein, 9 aa, Homo Sapiens
MMEEQKKYY

SEQ ID NO: 139661 - protein, 9 aa, Homo Sapiens
PSSGISRLI

SEQ ID NO: 139662 - protein, 9 aa, Homo Sapiens
GRPLVLNDL

SEQ ID NO: 139663 - protein, 9 aa, Homo Sapiens
IVEVKNFFQ

SEQ ID NO: 139664 - protein, 9 aa, Homo Sapiens
QQESALREN

SEQ ID NO: 139665 - protein, 9 aa, Homo Sapiens
LPGFSDQFC

SEQ ID NO: 139666 - protein, 9 aa, Homo Sapiens
GPSPEYTVA

SEQ ID NO: 139667 - protein, 9 aa, Homo Sapiens
PQAEEITIP

SEQ ID NO: 139668 - protein, 9 aa, Homo Sapiens
QDYYPINES

SEQ ID NO: 139669 - protein, 9 aa, Homo Sapiens
EVMYTHWNW

SEQ ID NO: 139670 - protein, 9 aa, Homo Sapiens
SKITEQEKD

SEQ ID NO: 139671 - protein, 9 aa, Homo Sapiens
FCHGKYSRW

SEQ ID NO: 139672 - protein, 9 aa, Homo Sapiens
CVVVDVSHK

SEQ ID NO: 139673 - protein, 9 aa, Homo Sapiens
NAIRDKKKP

SEQ ID NO: 139674 - protein, 9 aa, Homo Sapiens
GLSHISGKY

SEQ ID NO: 139675 - protein, 9 aa, Homo Sapiens
CVSSSQGGV

SEQ ID NO: 139676 - protein, 9 aa, Homo Sapiens
GTQISVGTY

SEQ ID NO: 139677 - protein, 9 aa, Homo Sapiens
SHSLCEDPV

SEQ ID NO: 139678 - protein, 9 aa, Homo Sapiens
IKVTLQPLT

SEQ ID NO: 139679 - protein, 9 aa, Homo Sapiens
FLTLTKNFP

SEQ ID NO: 139680 - protein, 9 aa, Homo Sapiens
ILAEELHRE

SEQ ID NO: 139681 - protein, 9 aa, Homo Sapiens
GAPDVTRVP

SEQ ID NO: 139682 - protein, 9 aa, Homo Sapiens
FLKAMEAQL

SEQ ID NO: 139683 - protein, 9 aa, Homo Sapiens
AAFPGTTEA

SEQ ID NO: 139684 - protein, 9 aa, Homo Sapiens
RWVFQALAR

SEQ ID NO: 139685 - protein, 9 aa, Homo Sapiens
WKSLKHQER

SEQ ID NO: 139686 - protein, 9 aa, Homo Sapiens
THLLERGVA

SEQ ID NO: 139687 - protein, 9 aa, Homo Sapiens
HLFWKSKDR

SEQ ID NO: 139688 - protein, 9 aa, Homo Sapiens
RSRHGKENL

SEQ ID NO: 139689 - protein, 9 aa, Homo Sapiens
PWMRGTDGA

SEQ ID NO: 139690 - protein, 9 aa, Homo Sapiens
GTAPTEFSR

SEQ ID NO: 139691 - protein, 9 aa, Homo Sapiens
TLAQQQLHL

SEQ ID NO: 139692 - protein, 9 aa, Homo Sapiens
KGQPSASAQ

SEQ ID NO: 139693 - protein, 9 aa, Homo Sapiens
LLDLTPLLS

SEQ ID NO: 139694 - protein, 9 aa, Homo Sapiens
RNAARSRHG

SEQ ID NO: 139695 - protein, 9 aa, Homo Sapiens
WDQPGYSRG

SEQ ID NO: 139696 - protein, 9 aa, Homo Sapiens
VWGVFCNED

SEQ ID NO: 139697 - protein, 9 aa, Homo Sapiens
GCCYTHSCC

SEQ ID NO: 139698 - protein, 9 aa, Homo Sapiens
HRVSHSVLK

SEQ ID NO: 139699 - protein, 9 aa, Homo Sapiens
LIMNIDMEP

SEQ ID NO: 139700 - protein, 9 aa, Homo Sapiens
WVFQALARI

SEQ ID NO: 139701 - protein, 9 aa, Homo Sapiens
RRCSICSHT

SEQ ID NO: 139702 - protein, 9 aa, Homo Sapiens
DALRRSCLR

SEQ ID NO: 139703 - protein, 9 aa, Homo Sapiens
ALRENILVM

SEQ ID NO: 139704 - protein, 9 aa, Homo Sapiens
QQKCENPCH

SEQ ID NO: 139705 - protein, 9 aa, Homo Sapiens
LKAVLDPKG

SEQ ID NO: 139706 - protein, 9 aa, Homo Sapiens
CGTSVPFQR

SEQ ID NO: 139707 - protein, 9 aa, Homo Sapiens
APRYIHKGV

SEQ ID NO: 139708 - protein, 9 aa, Homo Sapiens
VRQFSWLEI

SEQ ID NO: 139709 - protein, 9 aa, Homo Sapiens
VNEIALSRH

SEQ ID NO: 139710 - protein, 9 aa, Homo Sapiens
VWLTPNLQL

SEQ ID NO: 139711 - protein, 9 aa, Homo Sapiens
GVSLSPVSK

SEQ ID NO: 139712 - protein, 9 aa, Homo Sapiens
IYHLFWKSK

SEQ ID NO: 139713 - protein, 9 aa, Homo Sapiens
GPSQEFFFL

SEQ ID NO: 139714 - protein, 9 aa, Homo Sapiens
SDFVRQFSW

SEQ ID NO: 139715 - protein, 9 aa, Homo Sapiens
KKCSHWKSL

SEQ ID NO: 139716 - protein, 9 aa, Homo Sapiens
MYTHWNWDQ

SEQ ID NO: 139717 - protein, 9 aa, Homo Sapiens
TRFLTKLGY

SEQ ID NO: 139718 - protein, 9 aa, Homo Sapiens
LGRPLVLND

SEQ ID NO: 139719 - protein, 9 aa, Homo Sapiens
QPSPETLSS

SEQ ID NO: 139720 - protein, 9 aa, Homo Sapiens
RAGCCYTHS

SEQ ID NO: 139721 - protein, 9 aa, Homo Sapiens
FAVYDKFSM

SEQ ID NO: 139722 - protein, 9 aa, Homo Sapiens
VMQEGTAPT

SEQ ID NO: 139723 - protein, 9 aa, Homo Sapiens
HPASTFPTI

SEQ ID NO: 139724 - protein, 9 aa, Homo Sapiens
VSHKDPEVK

SEQ ID NO: 139725 - protein, 9 aa, Homo Sapiens
SPETLSSDK

SEQ ID NO: 139726 - protein, 9 aa, Homo Sapiens
YHIEFLGNP

SEQ ID NO: 139727 - protein, 9 aa, Homo Sapiens
SVPSPSEEP

SEQ ID NO: 139728 - protein, 9 aa, Homo Sapiens
LGNPHSRSW

SEQ ID NO: 139729 - protein, 9 aa, Homo Sapiens
FMAYQLYTL

SEQ ID NO: 139730 - protein, 9 aa, Homo Sapiens
FSVVIWICL

SEQ ID NO: 139731 - protein, 9 aa, Homo Sapiens
CLNPIKAVQ

SEQ ID NO: 139732 - protein, 9 aa, Homo Sapiens
PKKGMTTAK

SEQ ID NO: 139733 - protein, 9 aa, Homo Sapiens
VTRGKGPLK

SEQ ID NO: 139734 - protein, 9 aa, Homo Sapiens
RDAGVSPLG

SEQ ID NO: 139735 - protein, 9 aa, Homo Sapiens
TEKDVLQLN

SEQ ID NO: 139736 - protein, 9 aa, Homo Sapiens
NLQDYYPIN

SEQ ID NO: 139737 - protein, 9 aa, Homo Sapiens
VGASNSAFE

SEQ ID NO: 139738 - protein, 9 aa, Homo Sapiens
LTFIHTLEV

SEQ ID NO: 139739 - protein, 9 aa, Homo Sapiens
HFGSWMTDT

SEQ ID NO: 139740 - protein, 9 aa, Homo Sapiens
MLILLSMHT

SEQ ID NO: 139741 - protein, 9 aa, Homo Sapiens
GNMKNFADL

SEQ ID NO: 139742 - protein, 9 aa, Homo Sapiens
WSCGLCCHS

SEQ ID NO: 139743 - protein, 9 aa, Homo Sapiens
AEELHRELP

SEQ ID NO: 139744 - protein, 9 aa, Homo Sapiens
GSFNVNTIL

SEQ ID NO: 139745 - protein, 9 aa, Homo Sapiens
RGHQKKAMG

SEQ ID NO: 139746 - protein, 9 aa, Homo Sapiens
HIEFLGNPH

SEQ ID NO: 139747 - protein, 9 aa, Homo Sapiens
AWPVGGSFN

SEQ ID NO: 139748 - protein, 9 aa, Homo Sapiens
THVLMEDDD

SEQ ID NO: 139749 - protein, 9 aa, Homo Sapiens
AADLIYLCC

SEQ ID NO: 139750 - protein, 9 aa, Homo Sapiens
TQSRHRQIL

SEQ ID NO: 139751 - protein, 9 aa, Homo Sapiens
YSTQLFYSV

SEQ ID NO: 139752 - protein, 9 aa, Homo Sapiens
KKLLRLFSV

SEQ ID NO: 139753 - protein, 9 aa, Homo Sapiens
CVWLIIPEP

SEQ ID NO: 139754 - protein, 9 aa, Homo Sapiens
IDRYHVIVY

SEQ ID NO: 139755 - protein, 9 aa, Homo Sapiens
GFERYLVPL

SEQ ID NO: 139756 - protein, 9 aa, Homo Sapiens
STSSSSSGG

SEQ ID NO: 139757 - protein, 9 aa, Homo Sapiens
DVGTRDLIS

SEQ ID NO: 139758 - protein, 9 aa, Homo Sapiens
SRPPVSLDP

SEQ ID NO: 139759 - protein, 9 aa, Homo Sapiens
RAATRRCSI

SEQ ID NO: 139760 - protein, 9 aa, Homo Sapiens
IRIDLAVGN

SEQ ID NO: 139761 - protein, 9 aa, Homo Sapiens
LFYSVRASP

SEQ ID NO: 139762 - protein, 9 aa, Homo Sapiens
AAAEKQGLQ

SEQ ID NO: 139763 - protein, 9 aa, Homo Sapiens
VPPQAEEIT

SEQ ID NO: 139764 - protein, 9 aa, Homo Sapiens
LFLEWVMVT

SEQ ID NO: 139765 - protein, 9 aa, Homo Sapiens
VMWGDPELS

SEQ ID NO: 139766 - protein, 9 aa, Homo Sapiens
TKHLDFLKK

SEQ ID NO: 139767 - protein, 9 aa, Homo Sapiens
NSLEELLSG

SEQ ID NO: 139768 - protein, 9 aa, Homo Sapiens
QLFVGGTYF

SEQ ID NO: 139769 - protein, 9 aa, Homo Sapiens
SPPPPHEFM

SEQ ID NO: 139770 - protein, 9 aa, Homo Sapiens
HGKENLEFF

SEQ ID NO: 139771 - protein, 9 aa, Homo Sapiens
HIVWLNCKA

SEQ ID NO: 139772 - protein, 9 aa, Homo Sapiens
SSDGQGVSL

SEQ ID NO: 139773 - protein, 9 aa, Homo Sapiens
CGLCCHSRK

SEQ ID NO: 139774 - protein, 9 aa, Homo Sapiens
MEMVQQKKD

SEQ ID NO: 139775 - protein, 9 aa, Homo Sapiens
NLTDSCIDL

SEQ ID NO: 139776 - protein, 9 aa, Homo Sapiens
GPGVSQFIQ

SEQ ID NO: 139777 - protein, 9 aa, Homo Sapiens
NLWNPTYHS

SEQ ID NO: 139778 - protein, 9 aa, Homo Sapiens
AIRDKKKPQ

SEQ ID NO: 139779 - protein, 9 aa, Homo Sapiens
DVSHKDPEV

SEQ ID NO: 139780 - protein, 9 aa, Homo Sapiens
YTVLRCSAL

SEQ ID NO: 139781 - protein, 9 aa, Homo Sapiens
SGTVVLEPP

SEQ ID NO: 139782 - protein, 9 aa, Homo Sapiens
VSSLVDACF

SEQ ID NO: 139783 - protein, 9 aa, Homo Sapiens
ITELTLEIE

SEQ ID NO: 139784 - protein, 9 aa, Homo Sapiens
LRLFSVVIW

SEQ ID NO: 139785 - protein, 9 aa, Homo Sapiens
KNSLEELLS

SEQ ID NO: 139786 - protein, 9 aa, Homo Sapiens
TSDERDCEM

SEQ ID NO: 139787 - protein, 9 aa, Homo Sapiens
KGMTTAKQR

SEQ ID NO: 139788 - protein, 9 aa, Homo Sapiens
PSACGTSVP

SEQ ID NO: 139789 - protein, 9 aa, Homo Sapiens
HGVNSFLMY

SEQ ID NO: 139790 - protein, 9 aa, Homo Sapiens
HLRDLAACC

SEQ ID NO: 139791 - protein, 9 aa, Homo Sapiens
SLSIDRYHV

SEQ ID NO: 139792 - protein, 9 aa, Homo Sapiens
NTGNMKNFA

SEQ ID NO: 139793 - protein, 9 aa, Homo Sapiens
NFPVTCLVD

SEQ ID NO: 139794 - protein, 9 aa, Homo Sapiens
VLDPKGLMN

SEQ ID NO: 139795 - protein, 9 aa, Homo Sapiens
VSMFIACWS

SEQ ID NO: 139796 - protein, 9 aa, Homo Sapiens
MERAATRRC

SEQ ID NO: 139797 - protein, 9 aa, Homo Sapiens
QEAQAPGDR

SEQ ID NO: 139798 - protein, 9 aa, Homo Sapiens
FKDGDVVIL

SEQ ID NO: 139799 - protein, 9 aa, Homo Sapiens
NMKNFADLE

SEQ ID NO: 139800 - protein, 9 aa, Homo Sapiens
LRFWETLGR

SEQ ID NO: 139801 - protein, 9 aa, Homo Sapiens
FSDQFCEIN

SEQ ID NO: 139802 - protein, 9 aa, Homo Sapiens
PLEMTVWVH

SEQ ID NO: 139803 - protein, 9 aa, Homo Sapiens
LAVGNVVKT

SEQ ID NO: 139804 - protein, 9 aa, Homo Sapiens
KFSMGDAKT

SEQ ID NO: 139805 - protein, 9 aa, Homo Sapiens
TVVIVVSMF

SEQ ID NO: 139806 - protein, 9 aa, Homo Sapiens
DGKTLLIMN

SEQ ID NO: 139807 - protein, 9 aa, Homo Sapiens
GGSTHLLER

SEQ ID NO: 139808 - protein, 9 aa, Homo Sapiens
KAMEAQLYV

SEQ ID NO: 139809 - protein, 9 aa, Homo Sapiens
PARATLGRP

SEQ ID NO: 139810 - protein, 9 aa, Homo Sapiens
TLTKNFPVT

SEQ ID NO: 139811 - protein, 9 aa, Homo Sapiens
WNLQDYYPI

SEQ ID NO: 139812 - protein, 9 aa, Homo Sapiens
PVASDLGSR

SEQ ID NO: 139813 - protein, 9 aa, Homo Sapiens
EQQFKEEKL

SEQ ID NO: 139814 - protein, 9 aa, Homo Sapiens
PSPASLWAP

SEQ ID NO: 139815 - protein, 9 aa, Homo Sapiens
SRWIFLFIQ

SEQ ID NO: 139816 - protein, 9 aa, Homo Sapiens
LQPSPETLS

SEQ ID NO: 139817 - protein, 9 aa, Homo Sapiens
KIVCLGDSA

SEQ ID NO: 139818 - protein, 9 aa, Homo Sapiens
SCIDLARCC

SEQ ID NO: 139819 - protein, 9 aa, Homo Sapiens
RCFPTIHAY

SEQ ID NO: 139820 - protein, 9 aa, Homo Sapiens
HCPHHERCS

SEQ ID NO: 139821 - protein, 9 aa, Homo Sapiens
PEAAQTQAQ

SEQ ID NO: 139822 - protein, 9 aa, Homo Sapiens
WNWDQPGYS

SEQ ID NO: 139823 - protein, 9 aa, Homo Sapiens
LGAPDVTRV

SEQ ID NO: 139824 - protein, 9 aa, Homo Sapiens
LFIQPECSE

SEQ ID NO: 139825 - protein, 9 aa, Homo Sapiens
QQKKDGPIP

SEQ ID NO: 139826 - protein, 9 aa, Homo Sapiens
YMAFSFFCV

SEQ ID NO: 139827 - protein, 9 aa, Homo Sapiens
FPTIHAYKG

SEQ ID NO: 139828 - protein, 9 aa, Homo Sapiens
VLGAPDVTR

SEQ ID NO: 139829 - protein, 9 aa, Homo Sapiens
LPDADTLLQ

SEQ ID NO: 139830 - protein, 9 aa, Homo Sapiens
ITKKWPSIR

SEQ ID NO: 139831 - protein, 9 aa, Homo Sapiens
SPLYAVART

SEQ ID NO: 139832 - protein, 9 aa, Homo Sapiens
CGQQKCENP

SEQ ID NO: 139833 - protein, 9 aa, Homo Sapiens
IHTLEVQSS

SEQ ID NO: 139834 - protein, 9 aa, Homo Sapiens
DLTPLLSSE

SEQ ID NO: 139835 - protein, 9 aa, Homo Sapiens
FLTKLGYCS

SEQ ID NO: 139836 - protein, 9 aa, Homo Sapiens
SPARATLGR

SEQ ID NO: 139837 - protein, 9 aa, Homo Sapiens
VLRCSALPT

SEQ ID NO: 139838 - protein, 9 aa, Homo Sapiens
NPAILIHTP

SEQ ID NO: 139839 - protein, 9 aa, Homo Sapiens
LLCGQQKCE

SEQ ID NO: 139840 - protein, 9 aa, Homo Sapiens
EDFRVKTCR

SEQ ID NO: 139841 - protein, 9 aa, Homo Sapiens
PLQHLLSDN

SEQ ID NO: 139842 - protein, 9 aa, Homo Sapiens
SARDAGVSP

SEQ ID NO: 139843 - protein, 9 aa, Homo Sapiens
EKSQSASGV

SEQ ID NO: 139844 - protein, 9 aa, Homo Sapiens
VTMVMWGDP

SEQ ID NO: 139845 - protein, 9 aa, Homo Sapiens
HLGPPPLHY

SEQ ID NO: 139846 - protein, 9 aa, Homo Sapiens
LTLTKNFPV

SEQ ID NO: 139847 - protein, 9 aa, Homo Sapiens
ISCHGLSVN

SEQ ID NO: 139848 - protein, 9 aa, Homo Sapiens
ETLGRYMVK

SEQ ID NO: 139849 - protein, 9 aa, Homo Sapiens
SSSSSGGSS

SEQ ID NO: 139850 - protein, 9 aa, Homo Sapiens
MLLALAVCM

SEQ ID NO: 139851 - protein, 9 aa, Homo Sapiens
SSDKKGSKV

SEQ ID NO: 139852 - protein, 9 aa, Homo Sapiens
KTLLIMNID

SEQ ID NO: 139853 - protein, 9 aa, Homo Sapiens
APTEFSRSH

SEQ ID NO: 139854 - protein, 9 aa, Homo Sapiens
SPASLWAPP

SEQ ID NO: 139855 - protein, 9 aa, Homo Sapiens
IIPEPGSRI

SEQ ID NO: 139856 - protein, 9 aa, Homo Sapiens
CFPTIHAYK

SEQ ID NO: 139857 - protein, 9 aa, Homo Sapiens
FHCRGVDAN

SEQ ID NO: 139858 - protein, 9 aa, Homo Sapiens
GCPQEAHTD

SEQ ID NO: 139859 - protein, 9 aa, Homo Sapiens
GYCSSACPS

SEQ ID NO: 139860 - protein, 9 aa, Homo Sapiens
VSHSVLKPF

SEQ ID NO: 139861 - protein, 9 aa, Homo Sapiens
LKKIKWFAV

SEQ ID NO: 139862 - protein, 9 aa, Homo Sapiens
KDIFMMEEQ

SEQ ID NO: 139863 - protein, 9 aa, Homo Sapiens
MTVWVHKLP

SEQ ID NO: 139864 - protein, 9 aa, Homo Sapiens
VMYTHWNWD

SEQ ID NO: 139865 - protein, 9 aa, Homo Sapiens
YTVAVKNIK

SEQ ID NO: 139866 - protein, 9 aa, Homo Sapiens
RRAGCCYTH

SEQ ID NO: 139867 - protein, 9 aa, Homo Sapiens
YYRETEGEE

SEQ ID NO: 139868 - protein, 9 aa, Homo Sapiens
FMVLAEVIV

SEQ ID NO: 139869 - protein, 9 aa, Homo Sapiens
CASSCATSR

SEQ ID NO: 139870 - protein, 9 aa, Homo Sapiens
HYNDCGDTS

SEQ ID NO: 139871 - protein, 9 aa, Homo Sapiens
HAASTGLAS

SEQ ID NO: 139872 - protein, 9 aa, Homo Sapiens
RPLVLNDLF

SEQ ID NO: 139873 - protein, 9 aa, Homo Sapiens
ILLILTAVG

SEQ ID NO: 139874 - protein, 9 aa, Homo Sapiens
TVAVKNIKL

SEQ ID NO: 139875 - protein, 9 aa, Homo Sapiens
MIMMEMTDV

SEQ ID NO: 139876 - protein, 9 aa, Homo Sapiens
ADENKTVEE

SEQ ID NO: 139877 - protein, 9 aa, Homo Sapiens
VKVQKVGQQ

SEQ ID NO: 139878 - protein, 9 aa, Homo Sapiens
EVLMTISCH

SEQ ID NO: 139879 - protein, 9 aa, Homo Sapiens
AGCCYTHSC

SEQ ID NO: 139880 - protein, 9 aa, Homo Sapiens
PETLSSDKK

SEQ ID NO: 139881 - protein, 9 aa, Homo Sapiens
NWDQPGYSR

SEQ ID NO: 139882 - protein, 9 aa, Homo Sapiens
VSNFNYFYY

SEQ ID NO: 139883 - protein, 9 aa, Homo Sapiens
VTVLQLLQR

SEQ ID NO: 139884 - protein, 9 aa, Homo Sapiens
ILTMLLALA

SEQ ID NO: 139885 - protein, 9 aa, Homo Sapiens
KKWPSIRNS

SEQ ID NO: 139886 - protein, 9 aa, Homo Sapiens
YRETEGEEQ

SEQ ID NO: 139887 - protein, 9 aa, Homo Sapiens
PAILIHTPA

SEQ ID NO: 139888 - protein, 9 aa, Homo Sapiens
KKPQMDLEE

SEQ ID NO: 139889 - protein, 9 aa, Homo Sapiens
CSHWKSLKH

SEQ ID NO: 139890 - protein, 9 aa, Homo Sapiens
PPLHYLLPP

SEQ ID NO: 139891 - protein, 9 aa, Homo Sapiens
FGLRIKMGK

SEQ ID NO: 139892 - protein, 9 aa, Homo Sapiens
QWQLQIPSG

SEQ ID NO: 139893 - protein, 9 aa, Homo Sapiens
WIQSEWKEI

SEQ ID NO: 139894 - protein, 9 aa, Homo Sapiens
SMGDAKTRY

SEQ ID NO: 139895 - protein, 9 aa, Homo Sapiens
LDFLKKIKW

SEQ ID NO: 139896 - protein, 9 aa, Homo Sapiens
YLPLPEAAQ

SEQ ID NO: 139897 - protein, 9 aa, Homo Sapiens
EQRLEARRQ

SEQ ID NO: 139898 - protein, 9 aa, Homo Sapiens
VRDLMANRT

SEQ ID NO: 139899 - protein, 9 aa, Homo Sapiens
VWVHKLPLH

SEQ ID NO: 139900 - protein, 9 aa, Homo Sapiens
YVGASNSAF

SEQ ID NO: 139901 - protein, 9 aa, Homo Sapiens
FNYFYYRET

SEQ ID NO: 139902 - protein, 9 aa, Homo Sapiens
TVSSLVDAC

SEQ ID NO: 139903 - protein, 9 aa, Homo Sapiens
RPRRFMVLA

SEQ ID NO: 139904 - protein, 9 aa, Homo Sapiens
TQLFYSVRA

SEQ ID NO: 139905 - protein, 9 aa, Homo Sapiens
RLFSVVIWI

SEQ ID NO: 139906 - protein, 9 aa, Homo Sapiens
TPWMRGTDG

SEQ ID NO: 139907 - protein, 9 aa, Homo Sapiens
LQVFIYHLF

SEQ ID NO: 139908 - protein, 9 aa, Homo Sapiens
DFVRQFSWL

SEQ ID NO: 139909 - protein, 9 aa, Homo Sapiens
FCVAAILQG

SEQ ID NO: 139910 - protein, 9 aa, Homo Sapiens
EEVPPQAEE

SEQ ID NO: 139911 - protein, 9 aa, Homo Sapiens
ILRHRHQGK

SEQ ID NO: 139912 - protein, 9 aa, Homo Sapiens
HEFMAYQLY

SEQ ID NO: 139913 - protein, 9 aa, Homo Sapiens
GVFCNEDQW

SEQ ID NO: 139914 - protein, 9 aa, Homo Sapiens
VGLSHISGK

SEQ ID NO: 139915 - protein, 9 aa, Homo Sapiens
SSSDGQGVS

SEQ ID NO: 139916 - protein, 9 aa, Homo Sapiens
VGGSTHLLE

SEQ ID NO: 139917 - protein, 9 aa, Homo Sapiens
TLAKWIQSE

SEQ ID NO: 139918 - protein, 9 aa, Homo Sapiens
TCRGATVTI

SEQ ID NO: 139919 - protein, 9 aa, Homo Sapiens
LAEELHREL

SEQ ID NO: 139920 - protein, 9 aa, Homo Sapiens
APDEQRLEA

SEQ ID NO: 139921 - protein, 9 aa, Homo Sapiens
DVTRVPEAR

SEQ ID NO: 139922 - protein, 9 aa, Homo Sapiens
EQDMGQMHR

SEQ ID NO: 139923 - protein, 9 aa, Homo Sapiens
SWLEICNLS

SEQ ID NO: 139924 - protein, 9 aa, Homo Sapiens
SHVKVQKVG

SEQ ID NO: 139925 - protein, 9 aa, Homo Sapiens
RHGKENLEF

SEQ ID NO: 139926 - protein, 9 aa, Homo Sapiens
LGGKDIFMM

SEQ ID NO: 139927 - protein, 9 aa, Homo Sapiens
GVSQFIQPY

SEQ ID NO: 139928 - protein, 9 aa, Homo Sapiens
TSSSSSGGS

SEQ ID NO: 139929 - protein, 9 aa, Homo Sapiens
VGNVVKTWR

SEQ ID NO: 139930 - protein, 9 aa, Homo Sapiens
LEVQSSFSM

SEQ ID NO: 139931 - protein, 9 aa, Homo Sapiens
PASTFPTIQ

SEQ ID NO: 139932 - protein, 9 aa, Homo Sapiens
HGKYSRWIF

SEQ ID NO: 139933 - protein, 9 aa, Homo Sapiens
YFYYRETEG

SEQ ID NO: 139934 - protein, 9 aa, Homo Sapiens
TKGWWPLTA

SEQ ID NO: 139935 - protein, 9 aa, Homo Sapiens
RRWVFQALA

SEQ ID NO: 139936 - protein, 9 aa, Homo Sapiens
KLLRLFSVV

SEQ ID NO: 139937 - protein, 9 aa, Homo Sapiens
RVTMVMWGD

SEQ ID NO: 139938 - protein, 9 aa, Homo Sapiens
ASTFPTIQG

SEQ ID NO: 139939 - protein, 9 aa, Homo Sapiens
EEVWIPGKG

SEQ ID NO: 139940 - protein, 9 aa, Homo Sapiens
TMKVIFFMD

SEQ ID NO: 139941 - protein, 9 aa, Homo Sapiens
GKGTSCRCW

SEQ ID NO: 139942 - protein, 9 aa, Homo Sapiens
LEWVMVTWN

SEQ ID NO: 139943 - protein, 9 aa, Homo Sapiens
FRVKTCRGA

SEQ ID NO: 139944 - protein, 9 aa, Homo Sapiens
RHRQILVDK

SEQ ID NO: 139945 - protein, 9 aa, Homo Sapiens
SLEELLSGS

SEQ ID NO: 139946 - protein, 9 aa, Homo Sapiens
AQLVGCQTL

SEQ ID NO: 139947 - protein, 9 aa, Homo Sapiens
NMKLEASQQ

SEQ ID NO: 139948 - protein, 9 aa, Homo Sapiens
PTIHAYKGV

SEQ ID NO: 139949 - protein, 9 aa, Homo Sapiens
HSRKKGPIS

SEQ ID NO: 139950 - protein, 9 aa, Homo Sapiens
RVKTCRGAT

SEQ ID NO: 139951 - protein, 9 aa, Homo Sapiens
AFAAVKDIT

SEQ ID NO: 139952 - protein, 9 aa, Homo Sapiens
VFIYHLFWK

SEQ ID NO: 139953 - protein, 9 aa, Homo Sapiens
HSVLKPFTC

SEQ ID NO: 139954 - protein, 9 aa, Homo Sapiens
RTGTATCAS

SEQ ID NO: 139955 - protein, 9 aa, Homo Sapiens
SVVWGVFCN

SEQ ID NO: 139956 - protein, 9 aa, Homo Sapiens
SMFIACWSP

SEQ ID NO: 139957 - protein, 9 aa, Homo Sapiens
LYVGPGVSQ

SEQ ID NO: 139958 - protein, 9 aa, Homo Sapiens
DACFQLPAF

SEQ ID NO: 139959 - protein, 9 aa, Homo Sapiens
KTQMPPVSP

SEQ ID NO: 139960 - protein, 9 aa, Homo Sapiens
QQEDFAKAH

SEQ ID NO: 139961 - protein, 9 aa, Homo Sapiens
LRGHQKKAM

SEQ ID NO: 139962 - protein, 9 aa, Homo Sapiens
MTDVTRGKG

SEQ ID NO: 139963 - protein, 9 aa, Homo Sapiens
SQSASGVHP

SEQ ID NO: 139964 - protein, 9 aa, Homo Sapiens
AVLDPKGLM

SEQ ID NO: 139965 - protein, 9 aa, Homo Sapiens
QIFCHGKYS

SEQ ID NO: 139966 - protein, 9 aa, Homo Sapiens
VVSMFIACW

SEQ ID NO: 139967 - protein, 9 aa, Homo Sapiens
YLVPLGDKV

SEQ ID NO: 139968 - protein, 9 aa, Homo Sapiens
LDPQNMGYF

SEQ ID NO: 139969 - protein, 9 aa, Homo Sapiens
RSRNSRFHC

SEQ ID NO: 139970 - protein, 9 aa, Homo Sapiens
MCSVQTQHT

SEQ ID NO: 139971 - protein, 9 aa, Homo Sapiens
TVNINELKR

SEQ ID NO: 139972 - protein, 9 aa, Homo Sapiens
GVNSFLMYM

SEQ ID NO: 139973 - protein, 9 aa, Homo Sapiens
DIFMMEEQK

SEQ ID NO: 139974 - protein, 9 aa, Homo Sapiens
TLEVQSSFS

SEQ ID NO: 139975 - protein, 9 aa, Homo Sapiens
LLLDLTPLL

SEQ ID NO: 139976 - protein, 9 aa, Homo Sapiens
GAVGVGKSA

SEQ ID NO: 139977 - protein, 9 aa, Homo Sapiens
RAMGSHFGS

SEQ ID NO: 139978 - protein, 9 aa, Homo Sapiens
VPPSKNMKL

SEQ ID NO: 139979 - protein, 9 aa, Homo Sapiens
LTDSCIDLA

SEQ ID NO: 139980 - protein, 9 aa, Homo Sapiens
KCSHWKSLK

SEQ ID NO: 139981 - protein, 9 aa, Homo Sapiens
SDLGSRPPV

SEQ ID NO: 139982 - protein, 9 aa, Homo Sapiens
EFPEEVPPQ

SEQ ID NO: 139983 - protein, 9 aa, Homo Sapiens
LRRSCLRKV

SEQ ID NO: 139984 - protein, 9 aa, Homo Sapiens
IEFLGNPHS

SEQ ID NO: 139985 - protein, 9 aa, Homo Sapiens
LGNEPLQHL

SEQ ID NO: 139986 - protein, 9 aa, Homo Sapiens
LFSVVIWIC

SEQ ID NO: 139987 - protein, 9 aa, Homo Sapiens
QDMGQMHRQ

SEQ ID NO: 139988 - protein, 9 aa, Homo Sapiens
NSFLMYMAF

SEQ ID NO: 139989 - protein, 9 aa, Homo Sapiens
RFHCRGVDA

SEQ ID NO: 139990 - protein, 9 aa, Homo Sapiens
RIKMGKWCR

SEQ ID NO: 139991 - protein, 9 aa, Homo Sapiens
QHMTEVVRH

SEQ ID NO: 139992 - protein, 9 aa, Homo Sapiens
LLFLTLTKN

SEQ ID NO: 139993 - protein, 9 aa, Homo Sapiens
SPSEEPVVY

SEQ ID NO: 139994 - protein, 9 aa, Homo Sapiens
PSGTVVLEP

SEQ ID NO: 139995 - protein, 9 aa, Homo Sapiens
LRLVFNSWA

SEQ ID NO: 139996 - protein, 9 aa, Homo Sapiens
KKSEYVGAS

SEQ ID NO: 139997 - protein, 9 aa, Homo Sapiens
FMMEEQKKY

SEQ ID NO: 139998 - protein, 9 aa, Homo Sapiens
VHPASTFPT

SEQ ID NO: 139999 - protein, 9 aa, Homo Sapiens
FAAVKDITV

SEQ ID NO: 140000 - protein, 9 aa, Homo Sapiens
LCGQQKCEN

SEQ ID NO: 140001 - protein, 9 aa, Homo Sapiens
GLDYSGPSQ

SEQ ID NO: 140002 - protein, 9 aa, Homo Sapiens
LLLPAHTLQ

SEQ ID NO: 140003 - protein, 9 aa, Homo Sapiens
LQDYYPINE

SEQ ID NO: 140004 - protein, 9 aa, Homo Sapiens
NKITELTLE

SEQ ID NO: 140005 - protein, 9 aa, Homo Sapiens
NSVSKIDKI

SEQ ID NO: 140006 - protein, 9 aa, Homo Sapiens
DRGLPPDML

SEQ ID NO: 140007 - protein, 9 aa, Homo Sapiens
KNSFSEIQI

SEQ ID NO: 140008 - protein, 9 aa, Homo Sapiens
DTLLQIFCH

SEQ ID NO: 140009 - protein, 9 aa, Homo Sapiens
SEWKEISGQ

SEQ ID NO: 140010 - protein, 9 aa, Homo Sapiens
RSLASYGFK

SEQ ID NO: 140011 - protein, 9 aa, Homo Sapiens
LMQASVPSP

SEQ ID NO: 140012 - protein, 9 aa, Homo Sapiens
RYHVIVYPM

SEQ ID NO: 140013 - protein, 9 aa, Homo Sapiens
DRDALRRSC

SEQ ID NO: 140014 - protein, 9 aa, Homo Sapiens
VKVHAYAND

SEQ ID NO: 140015 - protein, 9 aa, Homo Sapiens
VACSAFATL

SEQ ID NO: 140016 - protein, 9 aa, Homo Sapiens
RGATVTIVS

SEQ ID NO: 140017 - protein, 9 aa, Homo Sapiens
PLPEAAQTQ

SEQ ID NO: 140018 - protein, 9 aa, Homo Sapiens
LLQIFCHGK

SEQ ID NO: 140019 - protein, 9 aa, Homo Sapiens
LTPNLQLFV

SEQ ID NO: 140020 - protein, 9 aa, Homo Sapiens
QKCENPCHA

SEQ ID NO: 140021 - protein, 9 aa, Homo Sapiens
IFRYFFGWM

SEQ ID NO: 140022 - protein, 9 aa, Homo Sapiens
HKLPLHIEL

SEQ ID NO: 140023 - protein, 9 aa, Homo Sapiens
LQHLLSDNG

SEQ ID NO: 140024 - protein, 9 aa, Homo Sapiens
IVCLGDSAV

SEQ ID NO: 140025 - protein, 9 aa, Homo Sapiens
AIYSEQDMG

SEQ ID NO: 140026 - protein, 9 aa, Homo Sapiens
FAFFAQHIT

SEQ ID NO: 140027 - protein, 9 aa, Homo Sapiens
SVLKPFTCG

SEQ ID NO: 140028 - protein, 9 aa, Homo Sapiens
SHFGSWMTD

SEQ ID NO: 140029 - protein, 9 aa, Homo Sapiens
AQQHHAAST

SEQ ID NO: 140030 - protein, 9 aa, Homo Sapiens
VLMTISCHG

SEQ ID NO: 140031 - protein, 9 aa, Homo Sapiens
KDPEVKFNW

SEQ ID NO: 140032 - protein, 9 aa, Homo Sapiens
CPQEAHTDG

SEQ ID NO: 140033 - protein, 9 aa, Homo Sapiens
KLGYCSSAC

SEQ ID NO: 140034 - protein, 9 aa, Homo Sapiens
CCRRAGCCY

SEQ ID NO: 140035 - protein, 9 aa, Homo Sapiens
AVGVGKSAL

SEQ ID NO: 140036 - protein, 9 aa, Homo Sapiens
SPCSGPASQ

SEQ ID NO: 140037 - protein, 9 aa, Homo Sapiens
CRCWQLSPG

SEQ ID NO: 140038 - protein, 9 aa, Homo Sapiens
CHGLSVNVV

SEQ ID NO: 140039 - protein, 9 aa, Homo Sapiens
AFSFFCVAA

SEQ ID NO: 140040 - protein, 9 aa, Homo Sapiens
QLHLEQIQQ

SEQ ID NO: 140041 - protein, 9 aa, Homo Sapiens
LTITHVLME

SEQ ID NO: 140042 - protein, 9 aa, Homo Sapiens
PGCVGLSHI

SEQ ID NO: 140043 - protein, 9 aa, Homo Sapiens
QSLYHIVWL

SEQ ID NO: 140044 - protein, 9 aa, Homo Sapiens
TIQGASLPA

SEQ ID NO: 140045 - protein, 9 aa, Homo Sapiens
VSLSPVSKT

SEQ ID NO: 140046 - protein, 9 aa, Homo Sapiens
ASDLGSRPP

SEQ ID NO: 140047 - protein, 9 aa, Homo Sapiens
LVTILLILT

SEQ ID NO: 140048 - protein, 9 aa, Homo Sapiens
KDVDPIRHY

SEQ ID NO: 140049 - protein, 9 aa, Homo Sapiens
ADLIYLCCS

SEQ ID NO: 140050 - protein, 9 aa, Homo Sapiens
VQAKKEEKV

SEQ ID NO: 140051 - protein, 9 aa, Homo Sapiens
DADTLLQIF

SEQ ID NO: 140052 - protein, 9 aa, Homo Sapiens
MEAQLYVDQ

SEQ ID NO: 140053 - protein, 9 aa, Homo Sapiens
SACGTSVPF

SEQ ID NO: 140054 - protein, 9 aa, Homo Sapiens
ITHVLMEDD

SEQ ID NO: 140055 - protein, 9 aa, Homo Sapiens
FAQHITHQF

SEQ ID NO: 140056 - protein, 9 aa, Homo Sapiens
NAPALLTPW

SEQ ID NO: 140057 - protein, 9 aa, Homo Sapiens
YLQNTGNMK

SEQ ID NO: 140058 - protein, 9 aa, Homo Sapiens
PSAGLVTIL

SEQ ID NO: 140059 - protein, 9 aa, Homo Sapiens
EAQAPGDRG

SEQ ID NO: 140060 - protein, 9 aa, Homo Sapiens
MDGSRPYGG

SEQ ID NO: 140061 - protein, 9 aa, Homo Sapiens
IFMMEEQKK

SEQ ID NO: 140062 - protein, 9 aa, Homo Sapiens
HLDFLKKIK

SEQ ID NO: 140063 - protein, 9 aa, Homo Sapiens
IDVGTRDLI

SEQ ID NO: 140064 - protein, 9 aa, Homo Sapiens
NDYWNLQDY

SEQ ID NO: 140065 - protein, 9 aa, Homo Sapiens
QQFKEEKLA

SEQ ID NO: 140066 - protein, 9 aa, Homo Sapiens
AVRDLMANR

SEQ ID NO: 140067 - protein, 9 aa, Homo Sapiens
PSPEYTVAV

SEQ ID NO: 140068 - protein, 9 aa, Homo Sapiens
DHGVNSFLM

SEQ ID NO: 140069 - protein, 9 aa, Homo Sapiens
VGTYLVLQM

SEQ ID NO: 140070 - protein, 9 aa, Homo Sapiens
VSSSQGGVV

SEQ ID NO: 140071 - protein, 9 aa, Homo Sapiens
HTDGSWPPS

SEQ ID NO: 140072 - protein, 9 aa, Homo Sapiens
AGVSPLGSN

SEQ ID NO: 140073 - protein, 9 aa, Homo Sapiens
DFLKKIKWF

SEQ ID NO: 140074 - protein, 9 aa, Homo Sapiens
WMRGTDGAV

SEQ ID NO: 140075 - protein, 9 aa, Homo Sapiens
PPPPHEFMA

SEQ ID NO: 140076 - protein, 9 aa, Homo Sapiens
MGFLGTQIS

SEQ ID NO: 140077 - protein, 9 aa, Homo Sapiens
EELHRELPP

SEQ ID NO: 140078 - protein, 9 aa, Homo Sapiens
EMVQQKKDG

SEQ ID NO: 140079 - protein, 9 aa, Homo Sapiens
GQPSASAQV

SEQ ID NO: 140080 - protein, 9 aa, Homo Sapiens
HCLLLPAHT

SEQ ID NO: 140081 - protein, 9 aa, Homo Sapiens
SGPASQTLD

SEQ ID NO: 140082 - protein, 9 aa, Homo Sapiens
VHKLPLHIE

SEQ ID NO: 140083 - protein, 9 aa, Homo Sapiens
LARRCFPTI

SEQ ID NO: 140084 - protein, 9 aa, Homo Sapiens
KTYNSVSKI

SEQ ID NO: 140085 - protein, 9 aa, Homo Sapiens
DQFCEININ

SEQ ID NO: 140086 - protein, 9 aa, Homo Sapiens
PSASAQVQQ

SEQ ID NO: 140087 - protein, 9 aa, Homo Sapiens
ITQSLYHIV

SEQ ID NO: 140088 - protein, 9 aa, Homo Sapiens
MVTVLQLLQ

SEQ ID NO: 140089 - protein, 9 aa, Homo Sapiens
FWETLGRYM

SEQ ID NO: 140090 - protein, 9 aa, Homo Sapiens
TDDGPYMCS

SEQ ID NO: 140091 - protein, 9 aa, Homo Sapiens
KIDKISRII

SEQ ID NO: 140092 - protein, 9 aa, Homo Sapiens
QHHAASTGL

SEQ ID NO: 140093 - protein, 9 aa, Homo Sapiens
QARAKTQMP

SEQ ID NO: 140094 - protein, 9 aa, Homo Sapiens
FYSVRASPK

SEQ ID NO: 140095 - protein, 9 aa, Homo Sapiens
VKNFFQITC

SEQ ID NO: 140096 - protein, 9 aa, Homo Sapiens
MVTWNSISS

SEQ ID NO: 140097 - protein, 9 aa, Homo Sapiens
KGTSCRCWQ

SEQ ID NO: 140098 - protein, 9 aa, Homo Sapiens
TSKIVEVKN

SEQ ID NO: 140099 - protein, 9 aa, Homo Sapiens
DVLQLNEFL

SEQ ID NO: 140100 - protein, 9 aa, Homo Sapiens
FSWLEICNL

SEQ ID NO: 140101 - protein, 9 aa, Homo Sapiens
KLVVVGAVG

SEQ ID NO: 140102 - protein, 9 aa, Homo Sapiens
LNPIKAVQG

SEQ ID NO: 140103 - protein, 9 aa, Homo Sapiens
LIHTPAKVQ

SEQ ID NO: 140104 - protein, 9 aa, Homo Sapiens
ASTEKDVLQ

SEQ ID NO: 140105 - protein, 9 aa, Homo Sapiens
ILVDKYYQE

SEQ ID NO: 140106 - protein, 9 aa, Homo Sapiens
KVIFFMDGS

SEQ ID NO: 140107 - protein, 9 aa, Homo Sapiens
RQFSWLEIC

SEQ ID NO: 140108 - protein, 9 aa, Homo Sapiens
AVLGAPDVT

SEQ ID NO: 140109 - protein, 9 aa, Homo Sapiens
QRLEARRQR

SEQ ID NO: 140110 - protein, 9 aa, Homo Sapiens
VDACFQLPA

SEQ ID NO: 140111 - protein, 9 aa, Homo Sapiens
CRSTKGWWP

SEQ ID NO: 140112 - protein, 9 aa, Homo Sapiens
LGPAQLVGC

SEQ ID NO: 140113 - protein, 9 aa, Homo Sapiens
FPTIQGASL

SEQ ID NO: 140114 - protein, 9 aa, Homo Sapiens
PVPGCVGLS

SEQ ID NO: 140115 - protein, 9 aa, Homo Sapiens
LSPWLLLDL

SEQ ID NO: 140116 - protein, 9 aa, Homo Sapiens
QGVSLSPVS

SEQ ID NO: 140117 - protein, 9 aa, Homo Sapiens
GNNPIFRYF

SEQ ID NO: 140118 - protein, 9 aa, Homo Sapiens
FDQQEVRKI

SEQ ID NO: 140119 - protein, 9 aa, Homo Sapiens
TRPRRFMVL

SEQ ID NO: 140120 - protein, 9 aa, Homo Sapiens
LQNTGNMKN

SEQ ID NO: 140121 - protein, 9 aa, Homo Sapiens
GLCCHSRKK

SEQ ID NO: 140122 - protein, 9 aa, Homo Sapiens
HVEDALIYL

SEQ ID NO: 140123 - protein, 9 aa, Homo Sapiens
VVIVVSMFI

SEQ ID NO: 140124 - protein, 9 aa, Homo Sapiens
DYWNLQDYY

SEQ ID NO: 140125 - protein, 9 aa, Homo Sapiens
LQPLTAVIY

SEQ ID NO: 140126 - protein, 9 aa, Homo Sapiens
EGFERYLVP

SEQ ID NO: 140127 - protein, 9 aa, Homo Sapiens
PPSKNMKLE

SEQ ID NO: 140128 - protein, 9 aa, Homo Sapiens
LFLTLTKNF

SEQ ID NO: 140129 - protein, 9 aa, Homo Sapiens
GQQKCENPC

SEQ ID NO: 140130 - protein, 9 aa, Homo Sapiens
RFLTKLGYC

SEQ ID NO: 140131 - protein, 9 aa, Homo Sapiens
TLSSDKKGS

SEQ ID NO: 140132 - protein, 9 aa, Homo Sapiens
WPVGGSFNV

SEQ ID NO: 140133 - protein, 9 aa, Homo Sapiens
PKGLMNPGK

SEQ ID NO: 140134 - protein, 9 aa, Homo Sapiens
CHAPDEQRL

SEQ ID NO: 140135 - protein, 9 aa, Homo Sapiens
LQQEDFAKA

SEQ ID NO: 140136 - protein, 9 aa, Homo Sapiens
FMAFLKAME

SEQ ID NO: 140137 - protein, 9 aa, Homo Sapiens
KNFFQITCE

SEQ ID NO: 140138 - protein, 9 aa, Homo Sapiens
APALLTPWM

SEQ ID NO: 140139 - protein, 9 aa, Homo Sapiens
AWKLDPQNM

SEQ ID NO: 140140 - protein, 9 aa, Homo Sapiens
RFMAFLKAM

SEQ ID NO: 140141 - protein, 9 aa, Homo Sapiens
VLKPFTCGA

SEQ ID NO: 140142 - protein, 9 aa, Homo Sapiens
LMANRTLPP

SEQ ID NO: 140143 - protein, 9 aa, Homo Sapiens
DTSDERDCE

SEQ ID NO: 140144 - protein, 9 aa, Homo Sapiens
LMYMAFKDR

SEQ ID NO: 140145 - protein, 9 aa, Homo Sapiens
SFNVNTILQ

SEQ ID NO: 140146 - protein, 9 aa, Homo Sapiens
LDLTPLLSS

SEQ ID NO: 140147 - protein, 9 aa, Homo Sapiens
MKDSPLYAV

SEQ ID NO: 140148 - protein, 9 aa, Homo Sapiens
YMCSVQTQH

SEQ ID NO: 140149 - protein, 9 aa, Homo Sapiens
TPRVGGSTH

SEQ ID NO: 140150 - protein, 9 aa, Homo Sapiens
WLEICNLSP

SEQ ID NO: 140151 - protein, 9 aa, Homo Sapiens
MGDAKTRYK

SEQ ID NO: 140152 - protein, 9 aa, Homo Sapiens
TEEVWIPGK

SEQ ID NO: 140153 - protein, 9 aa, Homo Sapiens
IPSACGTSV

SEQ ID NO: 140154 - protein, 9 aa, Homo Sapiens
SRHRQILVD

SEQ ID NO: 140155 - protein, 9 aa, Homo Sapiens
WITQSLYHI

SEQ ID NO: 140156 - protein, 9 aa, Homo Sapiens
FLRFWETLG

SEQ ID NO: 140157 - protein, 9 aa, Homo Sapiens
LGPPPLHYL

SEQ ID NO: 140158 - protein, 9 aa, Homo Sapiens
HWNWDQPGY

SEQ ID NO: 140159 - protein, 9 aa, Homo Sapiens
WETLGRYMV

SEQ ID NO: 140160 - protein, 9 aa, Homo Sapiens
LMTISCHGL

SEQ ID NO: 140161 - protein, 9 aa, Homo Sapiens
QCLNPIKAV

SEQ ID NO: 140162 - protein, 9 aa, Homo Sapiens
GVPPSKNMK

SEQ ID NO: 140163 - protein, 9 aa, Homo Sapiens
AATRRCSIC

SEQ ID NO: 140164 - protein, 9 aa, Homo Sapiens
EVKNFFQIT

SEQ ID NO: 140165 - protein, 9 aa, Homo Sapiens
QKKAMGFLG

SEQ ID NO: 140166 - protein, 9 aa, Homo Sapiens
RLVFNSWAQ

SEQ ID NO: 140167 - protein, 9 aa, Homo Sapiens
IVWLNCKAA

SEQ ID NO: 140168 - protein, 9 aa, Homo Sapiens
PIKAVQGCM

SEQ ID NO: 140169 - protein, 9 aa, Homo Sapiens
CSHTATCQR

SEQ ID NO: 140170 - protein, 9 aa, Homo Sapiens
GRYMVKHKS

SEQ ID NO: 140171 - protein, 9 aa, Homo Sapiens
ACGTSVPFQ

SEQ ID NO: 140172 - protein, 9 aa, Homo Sapiens
STGLASAAG

SEQ ID NO: 140173 - protein, 9 aa, Homo Sapiens
KITEQEKDF

SEQ ID NO: 140174 - protein, 9 aa, Homo Sapiens
RHKLQDENQ

SEQ ID NO: 140175 - protein, 9 aa, Homo Sapiens
CFVKVHAYA

SEQ ID NO: 140176 - protein, 9 aa, Homo Sapiens
TAPTEFSRS

SEQ ID NO: 140177 - protein, 9 aa, Homo Sapiens
NHSSAKPCG

SEQ ID NO: 140178 - protein, 9 aa, Homo Sapiens
EIILTMLLA

SEQ ID NO: 140179 - protein, 9 aa, Homo Sapiens
YKLVVVGAV

SEQ ID NO: 140180 - protein, 9 aa, Homo Sapiens
DPHCLLLPA

SEQ ID NO: 140181 - protein, 9 aa, Homo Sapiens
MFRRGSSHS

SEQ ID NO: 140182 - protein, 9 aa, Homo Sapiens
RFMVLAEVI

SEQ ID NO: 140183 - protein, 9 aa, Homo Sapiens
TATECDVCM

SEQ ID NO: 140184 - protein, 9 aa, Homo Sapiens
SPQCTVQAL

SEQ ID NO: 140185 - protein, 9 aa, Homo Sapiens
QARPFMPQR

SEQ ID NO: 140186 - protein, 9 aa, Homo Sapiens
TCLQYGIPH

SEQ ID NO: 140187 - protein, 9 aa, Homo Sapiens
LPTILVFIL

SEQ ID NO: 140188 - protein, 9 aa, Homo Sapiens
AGAHSSSGH

SEQ ID NO: 140189 - protein, 9 aa, Homo Sapiens
ECDVCMSKS

SEQ ID NO: 140190 - protein, 9 aa, Homo Sapiens
DFIMDTRDA

SEQ ID NO: 140191 - protein, 9 aa, Homo Sapiens
EDDSKGVRG

SEQ ID NO: 140192 - protein, 9 aa, Homo Sapiens
SVGSQPLCL

SEQ ID NO: 140193 - protein, 9 aa, Homo Sapiens
VPKVEVTSP

SEQ ID NO: 140194 - protein, 9 aa, Homo Sapiens
FLRYRRVNS

SEQ ID NO: 140195 - protein, 9 aa, Homo Sapiens
RTSSALRPE

SEQ ID NO: 140196 - protein, 9 aa, Homo Sapiens
TTPVRFLRY

SEQ ID NO: 140197 - protein, 9 aa, Homo Sapiens
DQDEYAVYG

SEQ ID NO: 140198 - protein, 9 aa, Homo Sapiens
TAGSWASTL

SEQ ID NO: 140199 - protein, 9 aa, Homo Sapiens
HLHFDARTV

SEQ ID NO: 140200 - protein, 9 aa, Homo Sapiens
ASPQCTVQA

SEQ ID NO: 140201 - protein, 9 aa, Homo Sapiens
AIPLVPLTE

SEQ ID NO: 140202 - protein, 9 aa, Homo Sapiens
VQNLLSLAQ

SEQ ID NO: 140203 - protein, 9 aa, Homo Sapiens
TVRAEDSGG

SEQ ID NO: 140204 - protein, 9 aa, Homo Sapiens
AVLNGLLYD

SEQ ID NO: 140205 - protein, 9 aa, Homo Sapiens
MEQARRCEV

SEQ ID NO: 140206 - protein, 9 aa, Homo Sapiens
HFCETFTLK

SEQ ID NO: 140207 - protein, 9 aa, Homo Sapiens
GGKTFGYNP

SEQ ID NO: 140208 - protein, 9 aa, Homo Sapiens
DNHNTATKR

SEQ ID NO: 140209 - protein, 9 aa, Homo Sapiens
ATDADSNWN

SEQ ID NO: 140210 - protein, 9 aa, Homo Sapiens
KHAHLTQHN

SEQ ID NO: 140211 - protein, 9 aa, Homo Sapiens
TVDPAFRTW

SEQ ID NO: 140212 - protein, 9 aa, Homo Sapiens
YSLIQALVR

SEQ ID NO: 140213 - protein, 9 aa, Homo Sapiens
SGGQFTTIR

SEQ ID NO: 140214 - protein, 9 aa, Homo Sapiens
SKNIEKAQA

SEQ ID NO: 140215 - protein, 9 aa, Homo Sapiens
WEIFTPLWA

SEQ ID NO: 140216 - protein, 9 aa, Homo Sapiens
SSVIVQVRL

SEQ ID NO: 140217 - protein, 9 aa, Homo Sapiens
ETFTLKTDS

SEQ ID NO: 140218 - protein, 9 aa, Homo Sapiens
HTGEWPYGC

SEQ ID NO: 140219 - protein, 9 aa, Homo Sapiens
RSRRHEQSS

SEQ ID NO: 140220 - protein, 9 aa, Homo Sapiens
ALRAVPTAL

SEQ ID NO: 140221 - protein, 9 aa, Homo Sapiens
CDVCMSKSK

SEQ ID NO: 140222 - protein, 9 aa, Homo Sapiens
LPSVNYTAC

SEQ ID NO: 140223 - protein, 9 aa, Homo Sapiens
RTATECDVC

SEQ ID NO: 140224 - protein, 9 aa, Homo Sapiens
TAHNNMTNC

SEQ ID NO: 140225 - protein, 9 aa, Homo Sapiens
SALRPETNS

SEQ ID NO: 140226 - protein, 9 aa, Homo Sapiens
MDTRDAGYG

SEQ ID NO: 140227 - protein, 9 aa, Homo Sapiens
CTVQALLNH

SEQ ID NO: 140228 - protein, 9 aa, Homo Sapiens
NIEKAQAIQ

SEQ ID NO: 140229 - protein, 9 aa, Homo Sapiens
EEDGCSQAI

SEQ ID NO: 140230 - protein, 9 aa, Homo Sapiens
AHTGEWPYG

SEQ ID NO: 140231 - protein, 9 aa, Homo Sapiens
VTAHHRNDL

SEQ ID NO: 140232 - protein, 9 aa, Homo Sapiens
NLCGAITIA

SEQ ID NO: 140233 - protein, 9 aa, Homo Sapiens
RPFMPQRAL

SEQ ID NO: 140234 - protein, 9 aa, Homo Sapiens
GTADVSKDC

SEQ ID NO: 140235 - protein, 9 aa, Homo Sapiens
QYGIPHHLH

SEQ ID NO: 140236 - protein, 9 aa, Homo Sapiens
GVRGGHSTT

SEQ ID NO: 140237 - protein, 9 aa, Homo Sapiens
PETNSPSWA

SEQ ID NO: 140238 - protein, 9 aa, Homo Sapiens
AGSTREAGR

SEQ ID NO: 140239 - protein, 9 aa, Homo Sapiens
NYWGRQYLL

SEQ ID NO: 140240 - protein, 9 aa, Homo Sapiens
WASTLPTTW

SEQ ID NO: 140241 - protein, 9 aa, Homo Sapiens
RNRNLLNKM

SEQ ID NO: 140242 - protein, 9 aa, Homo Sapiens
VCMSKSKSD

SEQ ID NO: 140243 - protein, 9 aa, Homo Sapiens
SGTADVSKD

SEQ ID NO: 140244 - protein, 9 aa, Homo Sapiens
LHLGCGVLL

SEQ ID NO: 140245 - protein, 9 aa, Homo Sapiens
TAQHYGIAD

SEQ ID NO: 140246 - protein, 9 aa, Homo Sapiens
NDSARLLNT

SEQ ID NO: 140247 - protein, 9 aa, Homo Sapiens
HGRSRRHEQ

SEQ ID NO: 140248 - protein, 9 aa, Homo Sapiens
CALQASPQC

SEQ ID NO: 140249 - protein, 9 aa, Homo Sapiens
CGKSISYIS

SEQ ID NO: 140250 - protein, 9 aa, Homo Sapiens
RRMSRAGAV

SEQ ID NO: 140251 - protein, 9 aa, Homo Sapiens
IFTPLWAEL

SEQ ID NO: 140252 - protein, 9 aa, Homo Sapiens
LRTPNWRPC

SEQ ID NO: 140253 - protein, 9 aa, Homo Sapiens
RTWGNANTV

SEQ ID NO: 140254 - protein, 9 aa, Homo Sapiens
IADCGTLLI

SEQ ID NO: 140255 - protein, 9 aa, Homo Sapiens
LDLKVPKVE

SEQ ID NO: 140256 - protein, 9 aa, Homo Sapiens
WARRMSRAG

SEQ ID NO: 140257 - protein, 9 aa, Homo Sapiens
VAGNKINCG

SEQ ID NO: 140258 - protein, 9 aa, Homo Sapiens
SKVRSRYSL

SEQ ID NO: 140259 - protein, 9 aa, Homo Sapiens
IPHHLHFDA

SEQ ID NO: 140260 - protein, 9 aa, Homo Sapiens
QEREQRMRN

SEQ ID NO: 140261 - protein, 9 aa, Homo Sapiens
NNKSKANTV

SEQ ID NO: 140262 - protein, 9 aa, Homo Sapiens
TWGNANTVW

SEQ ID NO: 140263 - protein, 9 aa, Homo Sapiens
GIQDGDIII

SEQ ID NO: 140264 - protein, 9 aa, Homo Sapiens
AFRTWGNAN

SEQ ID NO: 140265 - protein, 9 aa, Homo Sapiens
TATSLDIMT

SEQ ID NO: 140266 - protein, 9 aa, Homo Sapiens
VCSRERGRG

SEQ ID NO: 140267 - protein, 9 aa, Homo Sapiens
AKHSAEFHG

SEQ ID NO: 140268 - protein, 9 aa, Homo Sapiens
SVIVQVRLS

SEQ ID NO: 140269 - protein, 9 aa, Homo Sapiens
LNDPQPSRN

SEQ ID NO: 140270 - protein, 9 aa, Homo Sapiens
SAVAGNKIN

SEQ ID NO: 140271 - protein, 9 aa, Homo Sapiens
VGGMRHQTY

SEQ ID NO: 140272 - protein, 9 aa, Homo Sapiens
VIGLEKVNN

SEQ ID NO: 140273 - protein, 9 aa, Homo Sapiens
NLLSLAQKI

SEQ ID NO: 140274 - protein, 9 aa, Homo Sapiens
EVALFQAVL

SEQ ID NO: 140275 - protein, 9 aa, Homo Sapiens
IIKVNGRPL

SEQ ID NO: 140276 - protein, 9 aa, Homo Sapiens
TAFSFEDNT

SEQ ID NO: 140277 - protein, 9 aa, Homo Sapiens
GCSQAIPLV

SEQ ID NO: 140278 - protein, 9 aa, Homo Sapiens
TEKIVHRYY

SEQ ID NO: 140279 - protein, 9 aa, Homo Sapiens
SKGVRGGHS

SEQ ID NO: 140280 - protein, 9 aa, Homo Sapiens
PCQARPFMP

SEQ ID NO: 140281 - protein, 9 aa, Homo Sapiens
TNCATVWAS

SEQ ID NO: 140282 - protein, 9 aa, Homo Sapiens
EDGCSQAIP

SEQ ID NO: 140283 - protein, 9 aa, Homo Sapiens
GCGVLLSLL

SEQ ID NO: 140284 - protein, 9 aa, Homo Sapiens
EPVEVLPSV

SEQ ID NO: 140285 - protein, 9 aa, Homo Sapiens
RAGAVGGWT

SEQ ID NO: 140286 - protein, 9 aa, Homo Sapiens
LVSSEANTL

SEQ ID NO: 140287 - protein, 9 aa, Homo Sapiens
HNTATKRQS

SEQ ID NO: 140288 - protein, 9 aa, Homo Sapiens
QPLCLRAYP

SEQ ID NO: 140289 - protein, 9 aa, Homo Sapiens
GIPHHLHFD

SEQ ID NO: 140290 - protein, 9 aa, Homo Sapiens
SRAGAVGGW

SEQ ID NO: 140291 - protein, 9 aa, Homo Sapiens
IHQGGKTFG

SEQ ID NO: 140292 - protein, 9 aa, Homo Sapiens
DGDIIIKVN

SEQ ID NO: 140293 - protein, 9 aa, Homo Sapiens
AQHYGIADC

SEQ ID NO: 140294 - protein, 9 aa, Homo Sapiens
FQIITVTKD

SEQ ID NO: 140295 - protein, 9 aa, Homo Sapiens
LYELPNYWG

SEQ ID NO: 140296 - protein, 9 aa, Homo Sapiens
HPRTATSLD

SEQ ID NO: 140297 - protein, 9 aa, Homo Sapiens
SPLVVPPPN

SEQ ID NO: 140298 - protein, 9 aa, Homo Sapiens
STSWGPEDD

SEQ ID NO: 140299 - protein, 9 aa, Homo Sapiens
RTATSLDIM

SEQ ID NO: 140300 - protein, 9 aa, Homo Sapiens
MPVSTTLLV

SEQ ID NO: 140301 - protein, 9 aa, Homo Sapiens
PAFRTWGNA

SEQ ID NO: 140302 - protein, 9 aa, Homo Sapiens
QTFQSADVR

SEQ ID NO: 140303 - protein, 9 aa, Homo Sapiens
QTTPPVPTE

SEQ ID NO: 140304 - protein, 9 aa, Homo Sapiens
TPNWRPCFR

SEQ ID NO: 140305 - protein, 9 aa, Homo Sapiens
ATSLDIMTC

SEQ ID NO: 140306 - protein, 9 aa, Homo Sapiens
YAVILCHIR

SEQ ID NO: 140307 - protein, 9 aa, Homo Sapiens
ALRPETNSP

SEQ ID NO: 140308 - protein, 9 aa, Homo Sapiens
DNTVPLSPL

SEQ ID NO: 140309 - protein, 9 aa, Homo Sapiens
IQEVLIFDN

SEQ ID NO: 140310 - protein, 9 aa, Homo Sapiens
RGGHSTTMT

SEQ ID NO: 140311 - protein, 9 aa, Homo Sapiens
LPNYWGRQY

SEQ ID NO: 140312 - protein, 9 aa, Homo Sapiens
MSRAGAVGG

SEQ ID NO: 140313 - protein, 9 aa, Homo Sapiens
ATMTHPRTA

SEQ ID NO: 140314 - protein, 9 aa, Homo Sapiens
VTTEKIVHR

SEQ ID NO: 140315 - protein, 9 aa, Homo Sapiens
RRGQTAQCS

SEQ ID NO: 140316 - protein, 9 aa, Homo Sapiens
QKICERVHR

SEQ ID NO: 140317 - protein, 9 aa, Homo Sapiens
PCFRYYHWT

SEQ ID NO: 140318 - protein, 9 aa, Homo Sapiens
WTAGSWAST

SEQ ID NO: 140319 - protein, 9 aa, Homo Sapiens
IVINVGGMR

SEQ ID NO: 140320 - protein, 9 aa, Homo Sapiens
DSKGVRGGH

SEQ ID NO: 140321 - protein, 9 aa, Homo Sapiens
GRGIRSVSF

SEQ ID NO: 140322 - protein, 9 aa, Homo Sapiens
NWNALLVYQ

SEQ ID NO: 140323 - protein, 9 aa, Homo Sapiens
PTILVFILI

SEQ ID NO: 140324 - protein, 9 aa, Homo Sapiens
PASHRNPAG

SEQ ID NO: 140325 - protein, 9 aa, Homo Sapiens
AQCSIDHVY

SEQ ID NO: 140326 - protein, 9 aa, Homo Sapiens
KRNGSIISM

SEQ ID NO: 140327 - protein, 9 aa, Homo Sapiens
QSADVRACE

SEQ ID NO: 140328 - protein, 9 aa, Homo Sapiens
KAQAIQKKM

SEQ ID NO: 140329 - protein, 9 aa, Homo Sapiens
LLVSSEANT

SEQ ID NO: 140330 - protein, 9 aa, Homo Sapiens
DMEQARRCE

SEQ ID NO: 140331 - protein, 9 aa, Homo Sapiens
QPHGRSRRH

SEQ ID NO: 140332 - protein, 9 aa, Homo Sapiens
GKSISYISA

SEQ ID NO: 140333 - protein, 9 aa, Homo Sapiens
TFGYNPQFA

SEQ ID NO: 140334 - protein, 9 aa, Homo Sapiens
MTHPRTATS

SEQ ID NO: 140335 - protein, 9 aa, Homo Sapiens
DSGGQFTTI

SEQ ID NO: 140336 - protein, 9 aa, Homo Sapiens
RVPSPTKSQ

SEQ ID NO: 140337 - protein, 9 aa, Homo Sapiens
SRLSAVAGN

SEQ ID NO: 140338 - protein, 9 aa, Homo Sapiens
PPVPTEAQT

SEQ ID NO: 140339 - protein, 9 aa, Homo Sapiens
ALGIPLTPK

SEQ ID NO: 140340 - protein, 9 aa, Homo Sapiens
SLNDPQPSR

SEQ ID NO: 140341 - protein, 9 aa, Homo Sapiens
RVAGCPNPR

SEQ ID NO: 140342 - protein, 9 aa, Homo Sapiens
KGVRGGHST

SEQ ID NO: 140343 - protein, 9 aa, Homo Sapiens
DVCMSKSKS

SEQ ID NO: 140344 - protein, 9 aa, Homo Sapiens
LHFCETFTL

SEQ ID NO: 140345 - protein, 9 aa, Homo Sapiens
PQHIHIYST

SEQ ID NO: 140346 - protein, 9 aa, Homo Sapiens
RVVVVTTEK

SEQ ID NO: 140347 - protein, 9 aa, Homo Sapiens
PSVNYTACA

SEQ ID NO: 140348 - protein, 9 aa, Homo Sapiens
WNALLVYQI

SEQ ID NO: 140349 - protein, 9 aa, Homo Sapiens
ERGRGIRSV

SEQ ID NO: 140350 - protein, 9 aa, Homo Sapiens
GPCQARPFM

SEQ ID NO: 140351 - protein, 9 aa, Homo Sapiens
MREIMWYRV

SEQ ID NO: 140352 - protein, 9 aa, Homo Sapiens
CHIREHSSE

SEQ ID NO: 140353 - protein, 9 aa, Homo Sapiens
ASLLPTILV

SEQ ID NO: 140354 - protein, 9 aa, Homo Sapiens
SLIQALVRR

SEQ ID NO: 140355 - protein, 9 aa, Homo Sapiens
CQARPFMPQ

SEQ ID NO: 140356 - protein, 9 aa, Homo Sapiens
LERMSNVFL

SEQ ID NO: 140357 - protein, 9 aa, Homo Sapiens
FRYCTGSCP

SEQ ID NO: 140358 - protein, 9 aa, Homo Sapiens
NSKRYVTRH

SEQ ID NO: 140359 - protein, 9 aa, Homo Sapiens
AGSWASTLP

SEQ ID NO: 140360 - protein, 9 aa, Homo Sapiens
KASPQVKPL

SEQ ID NO: 140361 - protein, 9 aa, Homo Sapiens
GRGAQDLST

SEQ ID NO: 140362 - protein, 9 aa, Homo Sapiens
LCGAITIAQ

SEQ ID NO: 140363 - protein, 9 aa, Homo Sapiens
LLSLAQKIC

SEQ ID NO: 140364 - protein, 9 aa, Homo Sapiens
SVNYTACAT

SEQ ID NO: 140365 - protein, 9 aa, Homo Sapiens
TAMRQEITQ

SEQ ID NO: 140366 - protein, 9 aa, Homo Sapiens
YGIADCGTL

SEQ ID NO: 140367 - protein, 9 aa, Homo Sapiens
TREAGRGAQ

SEQ ID NO: 140368 - protein, 9 aa, Homo Sapiens
KEPVEVLPS

SEQ ID NO: 140369 - protein, 9 aa, Homo Sapiens
LQASPQCTV

SEQ ID NO: 140370 - protein, 9 aa, Homo Sapiens
IIIKVNGRP

SEQ ID NO: 140371 - protein, 9 aa, Homo Sapiens
ARPFMPQRA

SEQ ID NO: 140372 - protein, 9 aa, Homo Sapiens
GKHTTCIEF

SEQ ID NO: 140373 - protein, 9 aa, Homo Sapiens
FMPQRALPP

SEQ ID NO: 140374 - protein, 9 aa, Homo Sapiens
YWGRQYLLR

SEQ ID NO: 140375 - protein, 9 aa, Homo Sapiens
CFRYYHWTL

SEQ ID NO: 140376 - protein, 9 aa, Homo Sapiens
DIIIKVNGR

SEQ ID NO: 140377 - protein, 9 aa, Homo Sapiens
CIEFTNTSL

SEQ ID NO: 140378 - protein, 9 aa, Homo Sapiens
HEQSSSRNS

SEQ ID NO: 140379 - protein, 9 aa, Homo Sapiens
SDFIMDTRD

SEQ ID NO: 140380 - protein, 9 aa, Homo Sapiens
DIMTCLQYG

SEQ ID NO: 140381 - protein, 9 aa, Homo Sapiens
RERGRGIRS

SEQ ID NO: 140382 - protein, 9 aa, Homo Sapiens
DTEVALFQA

SEQ ID NO: 140383 - protein, 9 aa, Homo Sapiens
VGGWTAGSW

SEQ ID NO: 140384 - protein, 9 aa, Homo Sapiens
GLLYDVGGF

SEQ ID NO: 140385 - protein, 9 aa, Homo Sapiens
GSWASTLPT

SEQ ID NO: 140386 - protein, 9 aa, Homo Sapiens
KDKPRAYTI

SEQ ID NO: 140387 - protein, 9 aa, Homo Sapiens
DGRMREIMW

SEQ ID NO: 140388 - protein, 9 aa, Homo Sapiens
VEVLPSVNY

SEQ ID NO: 140389 - protein, 9 aa, Homo Sapiens
PPATMTHPR

SEQ ID NO: 140390 - protein, 9 aa, Homo Sapiens
KLDLKVPKV

SEQ ID NO: 140391 - protein, 9 aa, Homo Sapiens
CPAKHSAEF

SEQ ID NO: 140392 - protein, 9 aa, Homo Sapiens
LKVPKVEVT

SEQ ID NO: 140393 - protein, 9 aa, Homo Sapiens
TRQLQEREQ

SEQ ID NO: 140394 - protein, 9 aa, Homo Sapiens
ADVSKDCPE

SEQ ID NO: 140395 - protein, 9 aa, Homo Sapiens
AMRQEITQA

SEQ ID NO: 140396 - protein, 9 aa, Homo Sapiens
TECDVCMSK

SEQ ID NO: 140397 - protein, 9 aa, Homo Sapiens
QHYGIADCG

SEQ ID NO: 140398 - protein, 9 aa, Homo Sapiens
TPVRFLRYR

SEQ ID NO: 140399 - protein, 9 aa, Homo Sapiens
MTRQLQERE

SEQ ID NO: 140400 - protein, 9 aa, Homo Sapiens
HIYSTSWGP

SEQ ID NO: 140401 - protein, 9 aa, Homo Sapiens
QIASFILLC

SEQ ID NO: 140402 - protein, 9 aa, Homo Sapiens
RQLQEREQR

SEQ ID NO: 140403 - protein, 9 aa, Homo Sapiens
LCNLCGAIT

SEQ ID NO: 140404 - protein, 9 aa, Homo Sapiens
RLSAVAGNK

SEQ ID NO: 140405 - protein, 9 aa, Homo Sapiens
YSTSWGPED

SEQ ID NO: 140406 - protein, 9 aa, Homo Sapiens
AQTTPPVPT

SEQ ID NO: 140407 - protein, 9 aa, Homo Sapiens
CACSALRAV

SEQ ID NO: 140408 - protein, 9 aa, Homo Sapiens
LLHLGCGVL

SEQ ID NO: 140409 - protein, 9 aa, Homo Sapiens
DDSKGVRGG

SEQ ID NO: 140410 - protein, 9 aa, Homo Sapiens
GYNPQFADW

SEQ ID NO: 140411 - protein, 9 aa, Homo Sapiens
AQTFQSADV

SEQ ID NO: 140412 - protein, 9 aa, Homo Sapiens
SFILLCLFA

SEQ ID NO: 140413 - protein, 9 aa, Homo Sapiens
PLNPQQAQA

SEQ ID NO: 140414 - protein, 9 aa, Homo Sapiens
ADCGTLLIL

SEQ ID NO: 140415 - protein, 9 aa, Homo Sapiens
LCHIREHSS

SEQ ID NO: 140416 - protein, 9 aa, Homo Sapiens
PNPRGKGSA

SEQ ID NO: 140417 - protein, 9 aa, Homo Sapiens
SADVRACEA

SEQ ID NO: 140418 - protein, 9 aa, Homo Sapiens
VIFRYCTGS

SEQ ID NO: 140419 - protein, 9 aa, Homo Sapiens
VTKDKPRAY

SEQ ID NO: 140420 - protein, 9 aa, Homo Sapiens
DDHYRVAGC

SEQ ID NO: 140421 - protein, 9 aa, Homo Sapiens
MSDFIMDTR

SEQ ID NO: 140422 - protein, 9 aa, Homo Sapiens
QARRCEVSV

SEQ ID NO: 140423 - protein, 9 aa, Homo Sapiens
PVSTTLLVS

SEQ ID NO: 140424 - protein, 9 aa, Homo Sapiens
SLDIMTCLQ

SEQ ID NO: 140425 - protein, 9 aa, Homo Sapiens
TTPPVPTEA

SEQ ID NO: 140426 - protein, 9 aa, Homo Sapiens
SMPTTLGAL

SEQ ID NO: 140427 - protein, 9 aa, Homo Sapiens
IQDGDIIIK

SEQ ID NO: 140428 - protein, 9 aa, Homo Sapiens
TLLVSSEAN

SEQ ID NO: 140429 - protein, 9 aa, Homo Sapiens
LRPETNSPS

SEQ ID NO: 140430 - protein, 9 aa, Homo Sapiens
SRVPSPTKS

SEQ ID NO: 140431 - protein, 9 aa, Homo Sapiens
QAIPLVPLT

SEQ ID NO: 140432 - protein, 9 aa, Homo Sapiens
TTMTARSRT

SEQ ID NO: 140433 - protein, 9 aa, Homo Sapiens
KNIEKAQAI

SEQ ID NO: 140434 - protein, 9 aa, Homo Sapiens
VKPLRASEP

SEQ ID NO: 140435 - protein, 9 aa, Homo Sapiens
TSLDIMTCL

SEQ ID NO: 140436 - protein, 9 aa, Homo Sapiens
LNPQQAQAL

SEQ ID NO: 140437 - protein, 9 aa, Homo Sapiens
RNLRPPQEE

SEQ ID NO: 140438 - protein, 9 aa, Homo Sapiens
RFLRYRRVN

SEQ ID NO: 140439 - protein, 9 aa, Homo Sapiens
CQPCPAKHS

SEQ ID NO: 140440 - protein, 9 aa, Homo Sapiens
DPAFRTWGN

SEQ ID NO: 140441 - protein, 9 aa, Homo Sapiens
IGLEKVNNK

SEQ ID NO: 140442 - protein, 9 aa, Homo Sapiens
DIQKLERMS

SEQ ID NO: 140443 - protein, 9 aa, Homo Sapiens
TTLLVSSEA

SEQ ID NO: 140444 - protein, 9 aa, Homo Sapiens
LTSLLHLGC

SEQ ID NO: 140445 - protein, 9 aa, Homo Sapiens
TTCIEFTNT

SEQ ID NO: 140446 - protein, 9 aa, Homo Sapiens
RMSRAGAVG

SEQ ID NO: 140447 - protein, 9 aa, Homo Sapiens
ISYISALHV

SEQ ID NO: 140448 - protein, 9 aa, Homo Sapiens
VRFLRYRRV

SEQ ID NO: 140449 - protein, 9 aa, Homo Sapiens
SWARRMSRA

SEQ ID NO: 140450 - protein, 9 aa, Homo Sapiens
CSQAIPLVP

SEQ ID NO: 140451 - protein, 9 aa, Homo Sapiens
STLPTTWRL

SEQ ID NO: 140452 - protein, 9 aa, Homo Sapiens
HHRNDLGQL

SEQ ID NO: 140453 - protein, 9 aa, Homo Sapiens
VSLCMAGGI

SEQ ID NO: 140454 - protein, 9 aa, Homo Sapiens
ASPQVKPLR

SEQ ID NO: 140455 - protein, 9 aa, Homo Sapiens
QNLLSLAQK

SEQ ID NO: 140456 - protein, 9 aa, Homo Sapiens
QVKPLRASE

SEQ ID NO: 140457 - protein, 9 aa, Homo Sapiens
SALRAVPTA

SEQ ID NO: 140458 - protein, 9 aa, Homo Sapiens
REAGRGAQD

SEQ ID NO: 140459 - protein, 9 aa, Homo Sapiens
LGKHTTCIE

SEQ ID NO: 140460 - protein, 9 aa, Homo Sapiens
VLIFDNKHT

SEQ ID NO: 140461 - protein, 9 aa, Homo Sapiens
PQPSRNLRP

SEQ ID NO: 140462 - protein, 9 aa, Homo Sapiens
GKTFGYNPQ

SEQ ID NO: 140463 - protein, 9 aa, Homo Sapiens
RAKRNGSII

SEQ ID NO: 140464 - protein, 9 aa, Homo Sapiens
RSRSGVSPW

SEQ ID NO: 140465 - protein, 9 aa, Homo Sapiens
LGCGVLLSL

SEQ ID NO: 140466 - protein, 9 aa, Homo Sapiens
MPTTLGALK

SEQ ID NO: 140467 - protein, 9 aa, Homo Sapiens
ACSALRAVP

SEQ ID NO: 140468 - protein, 9 aa, Homo Sapiens
NKMLTSSYE

SEQ ID NO: 140469 - protein, 9 aa, Homo Sapiens
KDMEQARRC

SEQ ID NO: 140470 - protein, 9 aa, Homo Sapiens
PGEKKSQAS

SEQ ID NO: 140471 - protein, 9 aa, Homo Sapiens
TLPTTWRLS

SEQ ID NO: 140472 - protein, 9 aa, Homo Sapiens
IYSTSWGPE

SEQ ID NO: 140473 - protein, 9 aa, Homo Sapiens
FQALCNLCG

SEQ ID NO: 140474 - protein, 9 aa, Homo Sapiens
LNHLDSMPT

SEQ ID NO: 140475 - protein, 9 aa, Homo Sapiens
KVRSRYSLI

SEQ ID NO: 140476 - protein, 9 aa, Homo Sapiens
QPSRNLRPP

SEQ ID NO: 140477 - protein, 9 aa, Homo Sapiens
KVIFRYCTG

SEQ ID NO: 140478 - protein, 9 aa, Homo Sapiens
ITVTKDKPR

SEQ ID NO: 140479 - protein, 9 aa, Homo Sapiens
SPASHRNPA

SEQ ID NO: 140480 - protein, 9 aa, Homo Sapiens
DCGTLLILD

SEQ ID NO: 140481 - protein, 9 aa, Homo Sapiens
KMLTSSYET

SEQ ID NO: 140482 - protein, 9 aa, Homo Sapiens
NPQQAQALG

SEQ ID NO: 140483 - protein, 9 aa, Homo Sapiens
HIREHSSEG

SEQ ID NO: 140484 - protein, 9 aa, Homo Sapiens
NHNTATKRQ

SEQ ID NO: 140485 - protein, 9 aa, Homo Sapiens
SPQVKPLRA

SEQ ID NO: 140486 - protein, 9 aa, Homo Sapiens
IHIYSTSWG

SEQ ID NO: 140487 - protein, 9 aa, Homo Sapiens
TQANKGWAL

SEQ ID NO: 140488 - protein, 9 aa, Homo Sapiens
FEMSDFIMD

SEQ ID NO: 140489 - protein, 9 aa, Homo Sapiens
PCQPCPAKH

SEQ ID NO: 140490 - protein, 9 aa, Homo Sapiens
CLQYGIPHH

SEQ ID NO: 140491 - protein, 9 aa, Homo Sapiens
EWPYGCSEC

SEQ ID NO: 140492 - protein, 9 aa, Homo Sapiens
PNYWGRQYL

SEQ ID NO: 140493 - protein, 9 aa, Homo Sapiens
YGIPHHLHF

SEQ ID NO: 140494 - protein, 9 aa, Homo Sapiens
WRPCFRYYH

SEQ ID NO: 140495 - protein, 9 aa, Homo Sapiens
TFEMSDFIM

SEQ ID NO: 140496 - protein, 9 aa, Homo Sapiens
PVTAHHRND

SEQ ID NO: 140497 - protein, 9 aa, Homo Sapiens
PFMPQRALP

SEQ ID NO: 140498 - protein, 9 aa, Homo Sapiens
NVGGMRHQT

SEQ ID NO: 140499 - protein, 9 aa, Homo Sapiens
WGSLGPLCV

SEQ ID NO: 140500 - protein, 9 aa, Homo Sapiens
LFQAVLLMS

SEQ ID NO: 140501 - protein, 9 aa, Homo Sapiens
DADSNWNAL

SEQ ID NO: 140502 - protein, 9 aa, Homo Sapiens
PLVVPPPND

SEQ ID NO: 140503 - protein, 9 aa, Homo Sapiens
CNLCGAITI

SEQ ID NO: 140504 - protein, 9 aa, Homo Sapiens
ECETGVHHC

SEQ ID NO: 140505 - protein, 9 aa, Homo Sapiens
TNSPSWARR

SEQ ID NO: 140506 - protein, 9 aa, Homo Sapiens
EDSGGQFTT

SEQ ID NO: 140507 - protein, 9 aa, Homo Sapiens
QAIQKKMWD

SEQ ID NO: 140508 - protein, 9 aa, Homo Sapiens
NFCPVTAHH

SEQ ID NO: 140509 - protein, 9 aa, Homo Sapiens
QALCNLCGA

SEQ ID NO: 140510 - protein, 9 aa, Homo Sapiens
RAYPPATMT

SEQ ID NO: 140511 - protein, 9 aa, Homo Sapiens
CLNVRIACS

SEQ ID NO: 140512 - protein, 9 aa, Homo Sapiens
ERMSNVFLT

SEQ ID NO: 140513 - protein, 9 aa, Homo Sapiens
STREAGRGA

SEQ ID NO: 140514 - protein, 9 aa, Homo Sapiens
IEFTNTSLH

SEQ ID NO: 140515 - protein, 9 aa, Homo Sapiens
CGKPFRKHA

SEQ ID NO: 140516 - protein, 9 aa, Homo Sapiens
GLNHLDSMP

SEQ ID NO: 140517 - protein, 9 aa, Homo Sapiens
GGWTAGSWA

SEQ ID NO: 140518 - protein, 9 aa, Homo Sapiens
YPPATMTHP

SEQ ID NO: 140519 - protein, 9 aa, Homo Sapiens
RKHAHLTQH

SEQ ID NO: 140520 - protein, 9 aa, Homo Sapiens
YRVAGCPNP

SEQ ID NO: 140521 - protein, 9 aa, Homo Sapiens
GMRHQTYRS

SEQ ID NO: 140522 - protein, 9 aa, Homo Sapiens
ADVRACEAE

SEQ ID NO: 140523 - protein, 9 aa, Homo Sapiens
HRNPAGAHS

SEQ ID NO: 140524 - protein, 9 aa, Homo Sapiens
TNSSVIVQV

SEQ ID NO: 140525 - protein, 9 aa, Homo Sapiens
CKDQDEYAV

SEQ ID NO: 140526 - protein, 9 aa, Homo Sapiens
EMSDFIMDT

SEQ ID NO: 140527 - protein, 9 aa, Homo Sapiens
IKVNGRPLV

SEQ ID NO: 140528 - protein, 9 aa, Homo Sapiens
LYDVGGFDG

SEQ ID NO: 140529 - protein, 9 aa, Homo Sapiens
AFSFEDNTV

SEQ ID NO: 140530 - protein, 9 aa, Homo Sapiens
RSCKDQDEY

SEQ ID NO: 140531 - protein, 9 aa, Homo Sapiens
YTFSRVPSP

SEQ ID NO: 140532 - protein, 9 aa, Homo Sapiens
LDSMPTTLG

SEQ ID NO: 140533 - protein, 9 aa, Homo Sapiens
NHLDSMPTT

SEQ ID NO: 140534 - protein, 9 aa, Homo Sapiens
CMSKSKSDN

SEQ ID NO: 140535 - protein, 9 aa, Homo Sapiens
VPKLDLKVP

SEQ ID NO: 140536 - protein, 9 aa, Homo Sapiens
QEITQANKG

SEQ ID NO: 140537 - protein, 9 aa, Homo Sapiens
RPCFRYYHW

SEQ ID NO: 140538 - protein, 9 aa, Homo Sapiens
SSALRPETN

SEQ ID NO: 140539 - protein, 9 aa, Homo Sapiens
AHHRNDLGQ

SEQ ID NO: 140540 - protein, 9 aa, Homo Sapiens
VPPPNDSAR

SEQ ID NO: 140541 - protein, 9 aa, Homo Sapiens
CLRAYPPAT

SEQ ID NO: 140542 - protein, 9 aa, Homo Sapiens
PGRSRSGVS

SEQ ID NO: 140543 - protein, 9 aa, Homo Sapiens
SRTSSALRP

SEQ ID NO: 140544 - protein, 9 aa, Homo Sapiens
ISMNLKDAF

SEQ ID NO: 140545 - protein, 9 aa, Homo Sapiens
MVASLLPTI

SEQ ID NO: 140546 - protein, 9 aa, Homo Sapiens
NSPSWARRM

SEQ ID NO: 140547 - protein, 9 aa, Homo Sapiens
FTPLWAELM

SEQ ID NO: 140548 - protein, 9 aa, Homo Sapiens
GSIISMNLK

SEQ ID NO: 140549 - protein, 9 aa, Homo Sapiens
HQGGKTFGY

SEQ ID NO: 140550 - protein, 9 aa, Homo Sapiens
ITQANKGWA

SEQ ID NO: 140551 - protein, 9 aa, Homo Sapiens
RSRYSLIQA

SEQ ID NO: 140552 - protein, 9 aa, Homo Sapiens
RMSNVFLTD

SEQ ID NO: 140553 - protein, 9 aa, Homo Sapiens
IISMNLKDA

SEQ ID NO: 140554 - protein, 9 aa, Homo Sapiens
RSRTSSALR

SEQ ID NO: 140555 - protein, 9 aa, Homo Sapiens
RATDADSNW

SEQ ID NO: 140556 - protein, 9 aa, Homo Sapiens
WPYGCSECG

SEQ ID NO: 140557 - protein, 9 aa, Homo Sapiens
TDGRMREIM

SEQ ID NO: 140558 - protein, 9 aa, Homo Sapiens
TYTFSRVPS

SEQ ID NO: 140559 - protein, 9 aa, Homo Sapiens
SFEDNTVPL

SEQ ID NO: 140560 - protein, 9 aa, Homo Sapiens
GCPNPRGKG

SEQ ID NO: 140561 - protein, 9 aa, Homo Sapiens
RTPNWRPCF

SEQ ID NO: 140562 - protein, 9 aa, Homo Sapiens
CTGSCPRGA

SEQ ID NO: 140563 - protein, 9 aa, Homo Sapiens
FILLCLFAE

SEQ ID NO: 140564 - protein, 9 aa, Homo Sapiens
CPVTAHHRN

SEQ ID NO: 140565 - protein, 9 aa, Homo Sapiens
LGLNHLDSM

SEQ ID NO: 140566 - protein, 9 aa, Homo Sapiens
VFNSKRYVT

SEQ ID NO: 140567 - protein, 9 aa, Homo Sapiens
IASFILLCL

SEQ ID NO: 140568 - protein, 9 aa, Homo Sapiens
LDNHNTATK

SEQ ID NO: 140569 - protein, 9 aa, Homo Sapiens
HLGCGVLLS

SEQ ID NO: 140570 - protein, 9 aa, Homo Sapiens
SVCSRERGR

SEQ ID NO: 140571 - protein, 9 aa, Homo Sapiens
PTTPVRFLR

SEQ ID NO: 140572 - protein, 9 aa, Homo Sapiens
TSLLHLGCG

SEQ ID NO: 140573 - protein, 9 aa, Homo Sapiens
ASNVALSVA

SEQ ID NO: 140574 - protein, 9 aa, Homo Sapiens
VTAFSFEDN

SEQ ID NO: 140575 - protein, 9 aa, Homo Sapiens
LLPTILVFI

SEQ ID NO: 140576 - protein, 9 aa, Homo Sapiens
TCQCLNVRI

SEQ ID NO: 140577 - protein, 9 aa, Homo Sapiens
TPPVPTEAQ

SEQ ID NO: 140578 - protein, 9 aa, Homo Sapiens
NWEIFTPLW

SEQ ID NO: 140579 - protein, 9 aa, Homo Sapiens
EKVNNKSKA

SEQ ID NO: 140580 - protein, 9 aa, Homo Sapiens
HAHLTQHNR

SEQ ID NO: 140581 - protein, 9 aa, Homo Sapiens
LAQKICERV

SEQ ID NO: 140582 - protein, 9 aa, Homo Sapiens
VNNKSKANT

SEQ ID NO: 140583 - protein, 9 aa, Homo Sapiens
NGLLYDVGG

SEQ ID NO: 140584 - protein, 9 aa, Homo Sapiens
QASPQCTVQ

SEQ ID NO: 140585 - protein, 9 aa, Homo Sapiens
EIFTPLWAE

SEQ ID NO: 140586 - protein, 9 aa, Homo Sapiens
WGRQYLLRP

SEQ ID NO: 140587 - protein, 9 aa, Homo Sapiens
YDVGGFDGS

SEQ ID NO: 140588 - protein, 9 aa, Homo Sapiens
VDIQKLERM

SEQ ID NO: 140589 - protein, 9 aa, Homo Sapiens
ALQPGEKKS

SEQ ID NO: 140590 - protein, 9 aa, Homo Sapiens
ALCNLCGAI

SEQ ID NO: 140591 - protein, 9 aa, Homo Sapiens
GQTAQCSID

SEQ ID NO: 140592 - protein, 9 aa, Homo Sapiens
VPSPTKSQD

SEQ ID NO: 140593 - protein, 9 aa, Homo Sapiens
PATMTHPRT

SEQ ID NO: 140594 - protein, 9 aa, Homo Sapiens
ILTVRAEDS

SEQ ID NO: 140595 - protein, 9 aa, Homo Sapiens
AVILCHIRE

SEQ ID NO: 140596 - protein, 9 aa, Homo Sapiens
SRRGQTAQC

SEQ ID NO: 140597 - protein, 9 aa, Homo Sapiens
RYCTGSCPR

SEQ ID NO: 140598 - protein, 9 aa, Homo Sapiens
TTYTFSRVP

SEQ ID NO: 140599 - protein, 9 aa, Homo Sapiens
SLGKHTTCI

SEQ ID NO: 140600 - protein, 9 aa, Homo Sapiens
HIHIYSTSW

SEQ ID NO: 140601 - protein, 9 aa, Homo Sapiens
RGRGIRSVS

SEQ ID NO: 140602 - protein, 9 aa, Homo Sapiens
RNPAGAHSS

SEQ ID NO: 140603 - protein, 9 aa, Homo Sapiens
QPGEKKSQA

SEQ ID NO: 140604 - protein, 9 aa, Homo Sapiens
GGHSTTMTA

SEQ ID NO: 140605 - protein, 9 aa, Homo Sapiens
MRHQTYRST

SEQ ID NO: 140606 - protein, 9 aa, Homo Sapiens
VFDWGSLGP

SEQ ID NO: 140607 - protein, 9 aa, Homo Sapiens
QEEEEEEEQ

SEQ ID NO: 140608 - protein, 9 aa, Homo Sapiens
RNLLNKMLT

SEQ ID NO: 140609 - protein, 9 aa, Homo Sapiens
IMDTRDAGY

SEQ ID NO: 140610 - protein, 9 aa, Homo Sapiens
IITVTKDKP

SEQ ID NO: 140611 - protein, 9 aa, Homo Sapiens
HYRVAGCPN

SEQ ID NO: 140612 - protein, 9 aa, Homo Sapiens
VDPAFRTWG

SEQ ID NO: 140613 - protein, 9 aa, Homo Sapiens
HHLHFDART

SEQ ID NO: 140614 - protein, 9 aa, Homo Sapiens
TSWGPEDDG

SEQ ID NO: 140615 - protein, 9 aa, Homo Sapiens
NSSVIVQVR

SEQ ID NO: 140616 - protein, 9 aa, Homo Sapiens
RGAQDLSTL

SEQ ID NO: 140617 - protein, 9 aa, Homo Sapiens
CATVWASKT

SEQ ID NO: 140618 - protein, 9 aa, Homo Sapiens
LWQHFQWPL

SEQ ID NO: 140619 - protein, 9 aa, Homo Sapiens
GRMREIMWY

SEQ ID NO: 140620 - protein, 9 aa, Homo Sapiens
MTCLQYGIP

SEQ ID NO: 140621 - protein, 9 aa, Homo Sapiens
LSLAQKICE

SEQ ID NO: 140622 - protein, 9 aa, Homo Sapiens
RPETNSPSW

SEQ ID NO: 140623 - protein, 9 aa, Homo Sapiens
LDLDNHNTA

SEQ ID NO: 140624 - protein, 9 aa, Homo Sapiens
YAVYGTCSQ

SEQ ID NO: 140625 - protein, 9 aa, Homo Sapiens
DDTEVALFQ

SEQ ID NO: 140626 - protein, 9 aa, Homo Sapiens
GLEKVNNKS

SEQ ID NO: 140627 - protein, 9 aa, Homo Sapiens
YVTRHRRCH

SEQ ID NO: 140628 - protein, 9 aa, Homo Sapiens
GRSRSGVSP

SEQ ID NO: 140629 - protein, 9 aa, Homo Sapiens
HTTCIEFTN

SEQ ID NO: 140630 - protein, 9 aa, Homo Sapiens
VAGCPNPRG

SEQ ID NO: 140631 - protein, 9 aa, Homo Sapiens
YLSRLSAVA

SEQ ID NO: 140632 - protein, 9 aa, Homo Sapiens
IEKAQAIQK

SEQ ID NO: 140633 - protein, 9 aa, Homo Sapiens
TTEKIVHRY

SEQ ID NO: 140634 - protein, 9 aa, Homo Sapiens
QWPLQDLQL

SEQ ID NO: 140635 - protein, 9 aa, Homo Sapiens
EMTRQLQER

SEQ ID NO: 140636 - protein, 9 aa, Homo Sapiens
PFRKHAHLT

SEQ ID NO: 140637 - protein, 9 aa, Homo Sapiens
ETNSPSWAR

SEQ ID NO: 140638 - protein, 9 aa, Homo Sapiens
KVPKVEVTS

SEQ ID NO: 140639 - protein, 9 aa, Homo Sapiens
LTVRAEDSG

SEQ ID NO: 140640 - protein, 9 aa, Homo Sapiens
CSIDHVYTG

SEQ ID NO: 140641 - protein, 9 aa, Homo Sapiens
HCGEGQVCH

SEQ ID NO: 140642 - protein, 9 aa, Homo Sapiens
ETGVHHCGE

SEQ ID NO: 140643 - protein, 9 aa, Homo Sapiens
ASFILLCLF

SEQ ID NO: 140644 - protein, 9 aa, Homo Sapiens
FRTWGNANT

SEQ ID NO: 140645 - protein, 9 aa, Homo Sapiens
ELSSGTADV

SEQ ID NO: 140646 - protein, 9 aa, Homo Sapiens
STTLLVSSE

SEQ ID NO: 140647 - protein, 9 aa, Homo Sapiens
VVPPPNDSA

SEQ ID NO: 140648 - protein, 9 aa, Homo Sapiens
GSQPLCLRA

SEQ ID NO: 140649 - protein, 9 aa, Homo Sapiens
VLPSVNYTA

SEQ ID NO: 140650 - protein, 9 aa, Homo Sapiens
NVALSVAAL

SEQ ID NO: 140651 - protein, 9 aa, Homo Sapiens
MTNCATVWA

SEQ ID NO: 140652 - protein, 9 aa, Homo Sapiens
LWAELMCTL

SEQ ID NO: 140653 - protein, 9 aa, Homo Sapiens
GWTAGSWAS

SEQ ID NO: 140654 - protein, 9 aa, Homo Sapiens
LQEREQRMR

SEQ ID NO: 140655 - protein, 9 aa, Homo Sapiens
THPRTATSL

SEQ ID NO: 140656 - protein, 9 aa, Homo Sapiens
AGRGAQDLS

SEQ ID NO: 140657 - protein, 9 aa, Homo Sapiens
LQPGEKKSQ

SEQ ID NO: 140658 - protein, 9 aa, Homo Sapiens
VVTTEKIVH

SEQ ID NO: 140659 - protein, 9 aa, Homo Sapiens
HQRAHTGEW

SEQ ID NO: 140660 - protein, 9 aa, Homo Sapiens
LSAVAGNKI

SEQ ID NO: 140661 - protein, 9 aa, Homo Sapiens
KRYVTRHRR

SEQ ID NO: 140662 - protein, 9 aa, Homo Sapiens
VILCHIREH

SEQ ID NO: 140663 - protein, 9 aa, Homo Sapiens
DSNWNALLV

SEQ ID NO: 140664 - protein, 9 aa, Homo Sapiens
AGAVGGWTA

SEQ ID NO: 140665 - protein, 9 aa, Homo Sapiens
TFSRVPSPT

SEQ ID NO: 140666 - protein, 9 aa, Homo Sapiens
VVVTTEKIV

SEQ ID NO: 140667 - protein, 9 aa, Homo Sapiens
PHGRSRRHE

SEQ ID NO: 140668 - protein, 9 aa, Homo Sapiens
LVVPPPNDS

SEQ ID NO: 140669 - protein, 9 aa, Homo Sapiens
SHRNPAGAH

SEQ ID NO: 140670 - protein, 9 aa, Homo Sapiens
DVRACEAER

SEQ ID NO: 140671 - protein, 9 aa, Homo Sapiens
EETDPMEDA

SEQ ID NO: 140672 - protein, 9 aa, Homo Sapiens
TRHRRCHTG

SEQ ID NO: 140673 - protein, 9 aa, Homo Sapiens
CSALRAVPT

SEQ ID NO: 140674 - protein, 9 aa, Homo Sapiens
SLCMAGGIG

SEQ ID NO: 140675 - protein, 9 aa, Homo Sapiens
TDADSNWNA

SEQ ID NO: 140676 - protein, 9 aa, Homo Sapiens
TARSRTSSA

SEQ ID NO: 140677 - protein, 9 aa, Homo Sapiens
TMTHPRTAT

SEQ ID NO: 140678 - protein, 9 aa, Homo Sapiens
GAVGGWTAG

SEQ ID NO: 140679 - protein, 9 aa, Homo Sapiens
EVLPSVNYT

SEQ ID NO: 140680 - protein, 9 aa, Homo Sapiens
SYISALHVH

SEQ ID NO: 140681 - protein, 9 aa, Homo Sapiens
LSSGTADVS

SEQ ID NO: 140682 - protein, 9 aa, Homo Sapiens
DWGSLGPLC

SEQ ID NO: 140683 - protein, 9 aa, Homo Sapiens
NTATKRQSS

SEQ ID NO: 140684 - protein, 9 aa, Homo Sapiens
TFTLKTDSS

SEQ ID NO: 140685 - protein, 9 aa, Homo Sapiens
NCATVWASK

SEQ ID NO: 140686 - protein, 9 aa, Homo Sapiens
MLTSSYETF

SEQ ID NO: 140687 - protein, 9 aa, Homo Sapiens
KLERMSNVF

SEQ ID NO: 140688 - protein, 9 aa, Homo Sapiens
DVGGFDGST

SEQ ID NO: 140689 - protein, 9 aa, Homo Sapiens
SKASPQVKP

SEQ ID NO: 140690 - protein, 9 aa, Homo Sapiens
FTLKTDSSP

SEQ ID NO: 140691 - protein, 9 aa, Homo Sapiens
QGGKTFGYN

SEQ ID NO: 140692 - protein, 9 aa, Homo Sapiens
YFQIITVTK

SEQ ID NO: 140693 - protein, 9 aa, Homo Sapiens
ASTLPTTWR

SEQ ID NO: 140694 - protein, 9 aa, Homo Sapiens
QANKGWALD

SEQ ID NO: 140695 - protein, 9 aa, Homo Sapiens
NTCQCLNVR

SEQ ID NO: 140696 - protein, 9 aa, Homo Sapiens
TADVSKDCP

SEQ ID NO: 140697 - protein, 9 aa, Homo Sapiens
SMPVSTTLL

SEQ ID NO: 140698 - protein, 9 aa, Homo Sapiens
AVAGNKINC

SEQ ID NO: 140699 - protein, 9 aa, Homo Sapiens
ICGKPFRKH

SEQ ID NO: 140700 - protein, 9 aa, Homo Sapiens
TGVHHCGEG

SEQ ID NO: 140701 - protein, 9 aa, Homo Sapiens
WGNANTVWV

SEQ ID NO: 140702 - protein, 9 aa, Homo Sapiens
PQCTVQALL

SEQ ID NO: 140703 - protein, 9 aa, Homo Sapiens
LEKVNNKSK

SEQ ID NO: 140704 - protein, 9 aa, Homo Sapiens
NLLNKMLTS

SEQ ID NO: 140705 - protein, 9 aa, Homo Sapiens
FGYNPQFAD

SEQ ID NO: 140706 - protein, 9 aa, Homo Sapiens
RCEVSVLEG

SEQ ID NO: 140707 - protein, 9 aa, Homo Sapiens
QLQEREQRM

SEQ ID NO: 140708 - protein, 9 aa, Homo Sapiens
TPLWAELMC

SEQ ID NO: 140709 - protein, 9 aa, Homo Sapiens
QHQLIQEVL

SEQ ID NO: 140710 - protein, 9 aa, Homo Sapiens
IQKLERMSN

SEQ ID NO: 140711 - protein, 9 aa, Homo Sapiens
LNGLLYDVG

SEQ ID NO: 140712 - protein, 9 aa, Homo Sapiens
LASNVALSV

SEQ ID NO: 140713 - protein, 9 aa, Homo Sapiens
TATKRQSSL

SEQ ID NO: 140714 - protein, 9 aa, Homo Sapiens
LNKMLTSSY

SEQ ID NO: 140715 - protein, 9 aa, Homo Sapiens
CEVSVLEGQ

SEQ ID NO: 140716 - protein, 9 aa, Homo Sapiens
HNNMTNCAT

SEQ ID NO: 140717 - protein, 9 aa, Homo Sapiens
PLCLRAYPP

SEQ ID NO: 140718 - protein, 9 aa, Homo Sapiens
GVHHCGEGQ

SEQ ID NO: 140719 - protein, 9 aa, Homo Sapiens
HSAEFHGLC

SEQ ID NO: 140720 - protein, 9 aa, Homo Sapiens
GEWPYGCSE

SEQ ID NO: 140721 - protein, 9 aa, Homo Sapiens
EITQANKGW

SEQ ID NO: 140722 - protein, 9 aa, Homo Sapiens
SLGPLCVSP

SEQ ID NO: 140723 - protein, 9 aa, Homo Sapiens
VRSRYSLIQ

SEQ ID NO: 140724 - protein, 9 aa, Homo Sapiens
ASHRNPAGA

SEQ ID NO: 140725 - protein, 9 aa, Homo Sapiens
NKSKANTVG

SEQ ID NO: 140726 - protein, 9 aa, Homo Sapiens
PSKASPQVK

SEQ ID NO: 140727 - protein, 9 aa, Homo Sapiens
INVGGMRHQ

SEQ ID NO: 140728 - protein, 9 aa, Homo Sapiens
ILLCLFAED

SEQ ID NO: 140729 - protein, 9 aa, Homo Sapiens
RHEQSSSRN

SEQ ID NO: 140730 - protein, 9 aa, Homo Sapiens
GGMRHQTYR

SEQ ID NO: 140731 - protein, 9 aa, Homo Sapiens
TKDKPRAYT

SEQ ID NO: 140732 - protein, 9 aa, Homo Sapiens
FCETFTLKT

SEQ ID NO: 140733 - protein, 9 aa, Homo Sapiens
PPPNDSARL

SEQ ID NO: 140734 - protein, 9 aa, Homo Sapiens
LSRLSAVAG

SEQ ID NO: 140735 - protein, 9 aa, Homo Sapiens
DNELSSGTA

SEQ ID NO: 140736 - protein, 9 aa, Homo Sapiens
RAEDSGGQF

SEQ ID NO: 140737 - protein, 9 aa, Homo Sapiens
EAQTTPPVP

SEQ ID NO: 140738 - protein, 9 aa, Homo Sapiens
EQARRCEVS

SEQ ID NO: 140739 - protein, 9 aa, Homo Sapiens
FQAVLLMSS

SEQ ID NO: 140740 - protein, 9 aa, Homo Sapiens
CQCLNVRIA

SEQ ID NO: 140741 - protein, 9 aa, Homo Sapiens
MWYRVTDGG

SEQ ID NO: 140742 - protein, 9 aa, Homo Sapiens
LIQALVRRI

SEQ ID NO: 140743 - protein, 9 aa, Homo Sapiens
AYLSRLSAV

SEQ ID NO: 140744 - protein, 9 aa, Homo Sapiens
VALSVAALS

SEQ ID NO: 140745 - protein, 9 aa, Homo Sapiens
RGIRSVSFY

SEQ ID NO: 140746 - protein, 9 aa, Homo Sapiens
KPFRKHAHL

SEQ ID NO: 140747 - protein, 9 aa, Homo Sapiens
FRKHAHLTQ

SEQ ID NO: 140748 - protein, 9 aa, Homo Sapiens
STTMTARSR

SEQ ID NO: 140749 - protein, 9 aa, Homo Sapiens
YEVSLCMAG

SEQ ID NO: 140750 - protein, 9 aa, Homo Sapiens
NTVPLSPLK

SEQ ID NO: 140751 - protein, 9 aa, Homo Sapiens
EIMWYRVTD

SEQ ID NO: 140752 - protein, 9 aa, Homo Sapiens
NMTNCATVW

SEQ ID NO: 140753 - protein, 9 aa, Homo Sapiens
PMEDASRVG

SEQ ID NO: 140754 - protein, 9 aa, Homo Sapiens
TAHHRNDLG

SEQ ID NO: 140755 - protein, 9 aa, Homo Sapiens
PDVFDWGSL

SEQ ID NO: 140756 - protein, 9 aa, Homo Sapiens
VRGGHSTTM

SEQ ID NO: 140757 - protein, 9 aa, Homo Sapiens
GFEETDPME

SEQ ID NO: 140758 - protein, 9 aa, Homo Sapiens
GLRVVVVTT

SEQ ID NO: 140759 - protein, 9 aa, Homo Sapiens
HHCGEGQVC

SEQ ID NO: 140760 - protein, 9 aa, Homo Sapiens
LLYDVGGFD

SEQ ID NO: 140761 - protein, 9 aa, Homo Sapiens
RMREIMWYR

SEQ ID NO: 140762 - protein, 9 aa, Homo Sapiens
QDGDIIIKV

SEQ ID NO: 140763 - protein, 9 aa, Homo Sapiens
RYVTRHRRC

SEQ ID NO: 140764 - protein, 9 aa, Homo Sapiens
ETDPMEDAS

SEQ ID NO: 140765 - protein, 9 aa, Homo Sapiens
VLNGLLYDV

SEQ ID NO: 140766 - protein, 9 aa, Homo Sapiens
GKPFRKHAH

SEQ ID NO: 140767 - protein, 9 aa, Homo Sapiens
SCKDQDEYA

SEQ ID NO: 140768 - protein, 9 aa, Homo Sapiens
SIISMNLKD

SEQ ID NO: 140769 - protein, 9 aa, Homo Sapiens
PAKHSAEFH

SEQ ID NO: 140770 - protein, 9 aa, Homo Sapiens
PQVKPLRAS

SEQ ID NO: 140771 - protein, 9 aa, Homo Sapiens
AGCPNPRGK

SEQ ID NO: 140772 - protein, 9 aa, Homo Sapiens
EKAQAIQKK

SEQ ID NO: 140773 - protein, 9 aa, Homo Sapiens
FSRVPSPTK

SEQ ID NO: 140774 - protein, 9 aa, Homo Sapiens
RRCEVSVLE

SEQ ID NO: 140775 - protein, 9 aa, Homo Sapiens
RRHEQSSSR

SEQ ID NO: 140776 - protein, 9 aa, Homo Sapiens
LNVRIACSK

SEQ ID NO: 140777 - protein, 9 aa, Homo Sapiens
DEYAVYGTC

SEQ ID NO: 140778 - protein, 9 aa, Homo Sapiens
NNMTNCATV

SEQ ID NO: 140779 - protein, 9 aa, Homo Sapiens
EVSLCMAGG

SEQ ID NO: 140780 - protein, 9 aa, Homo Sapiens
NRNLLNKML

SEQ ID NO: 140781 - protein, 9 aa, Homo Sapiens
QDEYAVYGT

SEQ ID NO: 140782 - protein, 9 aa, Homo Sapiens
HFQWPLQDL

SEQ ID NO: 140783 - protein, 9 aa, Homo Sapiens
CMAGGIGVT

SEQ ID NO: 140784 - protein, 9 aa, Homo Sapiens
LQYGIPHHL

SEQ ID NO: 140785 - protein, 9 aa, Homo Sapiens
FCPVTAHHR

SEQ ID NO: 140786 - protein, 9 aa, Homo Sapiens
MSNVFLTDT

SEQ ID NO: 140787 - protein, 9 aa, Homo Sapiens
CNTCQCLNV

SEQ ID NO: 140788 - protein, 9 aa, Homo Sapiens
KSISYISAL

SEQ ID NO: 140789 - protein, 9 aa, Homo Sapiens
TEVALFQAV

SEQ ID NO: 140790 - protein, 9 aa, Homo Sapiens
FIMDTRDAG

SEQ ID NO: 140791 - protein, 9 aa, Homo Sapiens
GDIIIKVNG

SEQ ID NO: 140792 - protein, 9 aa, Homo Sapiens
FEDNTVPLS

SEQ ID NO: 140793 - protein, 9 aa, Homo Sapiens
SQPLCLRAY

SEQ ID NO: 140794 - protein, 9 aa, Homo Sapiens
CGAITIAQA

SEQ ID NO: 140795 - protein, 9 aa, Homo Sapiens
RNGSIISMN

SEQ ID NO: 140796 - protein, 9 aa, Homo Sapiens
KHSAEFHGL

SEQ ID NO: 140797 - protein, 9 aa, Homo Sapiens
MMVASLLPT

SEQ ID NO: 140798 - protein, 9 aa, Homo Sapiens
SLLPTILVF

SEQ ID NO: 140799 - protein, 9 aa, Homo Sapiens
VHHCGEGQV

SEQ ID NO: 140800 - protein, 9 aa, Homo Sapiens
LRAYPPATM

SEQ ID NO: 140801 - protein, 9 aa, Homo Sapiens
DPMEDASRV

SEQ ID NO: 140802 - protein, 9 aa, Homo Sapiens
TSSALRPET

SEQ ID NO: 140803 - protein, 9 aa, Homo Sapiens
DECGKSISY

SEQ ID NO: 140804 - protein, 9 aa, Homo Sapiens
QLIQEVLIF

SEQ ID NO: 140805 - protein, 9 aa, Homo Sapiens
DGCSQAIPL

SEQ ID NO: 140806 - protein, 9 aa, Homo Sapiens
RYSLIQALV

SEQ ID NO: 140807 - protein, 9 aa, Homo Sapiens
TFQSADVRA

SEQ ID NO: 140808 - protein, 9 aa, Homo Sapiens
SRYSLIQAL

SEQ ID NO: 140809 - protein, 9 aa, Homo Sapiens
EDNTVPLSP

SEQ ID NO: 140810 - protein, 9 aa, Homo Sapiens
VRIACSKVW

SEQ ID NO: 140811 - protein, 9 aa, Homo Sapiens
FSFEDNTVP

SEQ ID NO: 140812 - protein, 9 aa, Homo Sapiens
PSWARRMSR

SEQ ID NO: 140813 - protein, 9 aa, Homo Sapiens
KHTTCIEFT

SEQ ID NO: 140814 - protein, 9 aa, Homo Sapiens
LRVVVVTTE

SEQ ID NO: 140815 - protein, 9 aa, Homo Sapiens
CSRERGRGI

SEQ ID NO: 140816 - protein, 9 aa, Homo Sapiens
LCMAGGIGV

SEQ ID NO: 140817 - protein, 9 aa, Homo Sapiens
VVVVTTEKI

SEQ ID NO: 140818 - protein, 9 aa, Homo Sapiens
ECGKSISYI

SEQ ID NO: 140819 - protein, 9 aa, Homo Sapiens
PRTATSLDI

SEQ ID NO: 140820 - protein, 9 aa, Homo Sapiens
LLNKMLTSS

SEQ ID NO: 140821 - protein, 9 aa, Homo Sapiens
EAGRGAQDL

SEQ ID NO: 140822 - protein, 9 aa, Homo Sapiens
LDIMTCLQY

SEQ ID NO: 140823 - protein, 9 aa, Homo Sapiens
FQWPLQDLQ

SEQ ID NO: 140824 - protein, 9 aa, Homo Sapiens
QKLERMSNV

SEQ ID NO: 140825 - protein, 9 aa, Homo Sapiens
QTAQCSIDH

SEQ ID NO: 140826 - protein, 9 aa, Homo Sapiens
ARSRTSSAL

SEQ ID NO: 140827 - protein, 9 aa, Homo Sapiens
MAGGIGVTP

SEQ ID NO: 140828 - protein, 9 aa, Homo Sapiens
RSPSERSHC

SEQ ID NO: 140829 - protein, 9 aa, Homo Sapiens
IPLVPLTEE

SEQ ID NO: 140830 - protein, 9 aa, Homo Sapiens
ARRMSRAGA

SEQ ID NO: 140831 - protein, 9 aa, Homo Sapiens
GIADCGTLL

SEQ ID NO: 140832 - protein, 9 aa, Homo Sapiens
NECETGVHH

SEQ ID NO: 140833 - protein, 9 aa, Homo Sapiens
NELSSGTAD

SEQ ID NO: 140834 - protein, 9 aa, Homo Sapiens
PPNDSARLL

SEQ ID NO: 140835 - protein, 9 aa, Homo Sapiens
GRSRRHEQS

SEQ ID NO: 140836 - protein, 9 aa, Homo Sapiens
FDWGSLGPL

SEQ ID NO: 140837 - protein, 9 aa, Homo Sapiens
TAQCSIDHV

SEQ ID NO: 140838 - protein, 9 aa, Homo Sapiens
PSRNLRPPQ

SEQ ID NO: 140839 - protein, 9 aa, Homo Sapiens
AVGGWTAGS

SEQ ID NO: 140840 - protein, 9 aa, Homo Sapiens
TGSCPRGAR

SEQ ID NO: 140841 - protein, 9 aa, Homo Sapiens
MEDASRVGA

SEQ ID NO: 140842 - protein, 9 aa, Homo Sapiens
TMTARSRTS

SEQ ID NO: 140843 - protein, 9 aa, Homo Sapiens
PHHLHFDAR

SEQ ID NO: 140844 - protein, 9 aa, Homo Sapiens
GSLGPLCVS

SEQ ID NO: 140845 - protein, 9 aa, Homo Sapiens
LIQEVLIFD

SEQ ID NO: 140846 - protein, 9 aa, Homo Sapiens
QQHQLIQEV

SEQ ID NO: 140847 - protein, 9 aa, Homo Sapiens
ALFQAVLLM

SEQ ID NO: 140848 - protein, 9 aa, Homo Sapiens
LGPLCVSPK

SEQ ID NO: 140849 - protein, 9 aa, Homo Sapiens
CETGVHHCG

SEQ ID NO: 140850 - protein, 9 aa, Homo Sapiens
VRAEDSGGQ

SEQ ID NO: 140851 - protein, 9 aa, Homo Sapiens
SLLHLGCGV

SEQ ID NO: 140852 - protein, 9 aa, Homo Sapiens
SRNLRPPQE

SEQ ID NO: 140853 - protein, 9 aa, Homo Sapiens
QCTVQALLN

SEQ ID NO: 140854 - protein, 9 aa, Homo Sapiens
NVPKLDLKV

SEQ ID NO: 140855 - protein, 9 aa, Homo Sapiens
NAEMTRQLQ

SEQ ID NO: 140856 - protein, 9 aa, Homo Sapiens
SISYISALH

SEQ ID NO: 140857 - protein, 9 aa, Homo Sapiens
NWRPCFRYY

SEQ ID NO: 140858 - protein, 9 aa, Homo Sapiens
CPNPRGKGS

SEQ ID NO: 140859 - protein, 9 aa, Homo Sapiens
FLDLDNHNT

SEQ ID NO: 140860 - protein, 9 aa, Homo Sapiens
DSMPTTLGA

SEQ ID NO: 140861 - protein, 9 aa, Homo Sapiens
VTRHRRCHT

SEQ ID NO: 140862 - protein, 9 aa, Homo Sapiens
RQEITQANK

SEQ ID NO: 140863 - protein, 9 aa, Homo Sapiens
PVEVLPSVN

SEQ ID NO: 140864 - protein, 9 aa, Homo Sapiens
SKRYVTRHR

SEQ ID NO: 140865 - protein, 9 aa, Homo Sapiens
DLDNHNTAT

SEQ ID NO: 140866 - protein, 9 aa, Homo Sapiens
CETFTLKTD

SEQ ID NO: 140867 - protein, 9 aa, Homo Sapiens
QIITVTKDK

SEQ ID NO: 140868 - protein, 9 aa, Homo Sapiens
ELWQHFQWP

SEQ ID NO: 140869 - protein, 9 aa, Homo Sapiens
PLWAELMCT

SEQ ID NO: 140870 - protein, 9 aa, Homo Sapiens
NPAGAHSSS

SEQ ID NO: 140871 - protein, 9 aa, Homo Sapiens
AHNNMTNCA

SEQ ID NO: 140872 - protein, 9 aa, Homo Sapiens
SLAQKICER

SEQ ID NO: 140873 - protein, 9 aa, Homo Sapiens
VLYELPNYW

SEQ ID NO: 140874 - protein, 9 aa, Homo Sapiens
NVRIACSKV

SEQ ID NO: 140875 - protein, 9 aa, Homo Sapiens
TGEWPYGCS

SEQ ID NO: 140876 - protein, 9 aa, Homo Sapiens
VELWQHFQW

SEQ ID NO: 140877 - protein, 9 aa, Homo Sapiens
SSGTADVSK

SEQ ID NO: 140878 - protein, 9 aa, Homo Sapiens
PVRFLRYRR

SEQ ID NO: 140879 - protein, 9 aa, Homo Sapiens
YELPNYWGR

SEQ ID NO: 140880 - protein, 9 aa, Homo Sapiens
SPSWARRMS

SEQ ID NO: 140881 - protein, 9 aa, Homo Sapiens
AEDSGGQFT

SEQ ID NO: 140882 - protein, 9 aa, Homo Sapiens
DSVGSQPLC

SEQ ID NO: 140883 - protein, 9 aa, Homo Sapiens
IMTCLQYGI

SEQ ID NO: 140884 - protein, 9 aa, Homo Sapiens
ADSNWNALL

SEQ ID NO: 140885 - protein, 9 aa, Homo Sapiens
NGSIISMNL

SEQ ID NO: 140886 - protein, 9 aa, Homo Sapiens
RAHTGEWPY

SEQ ID NO: 140887 - protein, 9 aa, Homo Sapiens
MTARSRTSS

SEQ ID NO: 140888 - protein, 9 aa, Homo Sapiens
DPQPSRNLR

SEQ ID NO: 140889 - protein, 9 aa, Homo Sapiens
KDQDEYAVY

SEQ ID NO: 140890 - protein, 9 aa, Homo Sapiens
EVLIFDNKH

SEQ ID NO: 140891 - protein, 9 aa, Homo Sapiens
SRERGRGIR

SEQ ID NO: 140892 - protein, 9 aa, Homo Sapiens
QHFQWPLQD

SEQ ID NO: 140893 - protein, 9 aa, Homo Sapiens
ATECDVCMS

SEQ ID NO: 140894 - protein, 9 aa, Homo Sapiens
FQSADVRAC

SEQ ID NO: 140895 - protein, 9 aa, Homo Sapiens
APGRSRSGV

SEQ ID NO: 140896 - protein, 9 aa, Homo Sapiens
ATTYTFSRV

SEQ ID NO: 140897 - protein, 9 aa, Homo Sapiens
QRAHTGEWP

SEQ ID NO: 140898 - protein, 9 aa, Homo Sapiens
EKVIFRYCT

SEQ ID NO: 140899 - protein, 9 aa, Homo Sapiens
VINVGGMRH

SEQ ID NO: 140900 - protein, 9 aa, Homo Sapiens
IFRYCTGSC

SEQ ID NO: 140901 - protein, 9 aa, Homo Sapiens
YCTGSCPRG

SEQ ID NO: 140902 - protein, 9 aa, Homo Sapiens
VALFQAVLL

SEQ ID NO: 140903 - protein, 9 aa, Homo Sapiens
DHYRVAGCP

SEQ ID NO: 140904 - protein, 9 aa, Homo Sapiens
HQLIQEVLI

SEQ ID NO: 140905 - protein, 9 aa, Homo Sapiens
AIQKKMWDE

SEQ ID NO: 140906 - protein, 9 aa, Homo Sapiens
GHSTTMTAR

SEQ ID NO: 140907 - protein, 9 aa, Homo Sapiens
PNWRPCFRY

SEQ ID NO: 140908 - protein, 9 aa, Homo Sapiens
CGVLLSLLA

SEQ ID NO: 140909 - protein, 9 aa, Homo Sapiens
QEVLIFDNK

SEQ ID NO: 140910 - protein, 9 aa, Homo Sapiens
FNSKRYVTR

SEQ ID NO: 140911 - protein, 9 aa, Homo Sapiens
VASLLPTIL

SEQ ID NO: 140912 - protein, 9 aa, Homo Sapiens
SRRHEQSSS

SEQ ID NO: 140913 - protein, 9 aa, Homo Sapiens
RDSVGSQPL

SEQ ID NO: 140914 - protein, 9 aa, Homo Sapiens
TVTKDKPRA

SEQ ID NO: 140915 - protein, 9 aa, Homo Sapiens
VTNSSVIVQ

SEQ ID NO: 140916 - protein, 9 aa, Homo Sapiens
RIVINVGGM

SEQ ID NO: 140917 - protein, 9 aa, Homo Sapiens
SNVALSVAA

SEQ ID NO: 140918 - protein, 9 aa, Homo Sapiens
TCIEFTNTS

SEQ ID NO: 140919 - protein, 9 aa, Homo Sapiens
REIMWYRVT

SEQ ID NO: 140920 - protein, 9 aa, Homo Sapiens
DSPTTPVRF

SEQ ID NO: 140921 - protein, 9 aa, Homo Sapiens
PRGKGSAGF

SEQ ID NO: 140922 - protein, 9 aa, Homo Sapiens
GSTREAGRG

SEQ ID NO: 140923 - protein, 9 aa, Homo Sapiens
ILCHIREHS

SEQ ID NO: 140924 - protein, 9 aa, Homo Sapiens
LCLRAYPPA

SEQ ID NO: 140925 - protein, 9 aa, Homo Sapiens
QCLNVRIAC

SEQ ID NO: 140926 - protein, 9 aa, Homo Sapiens
DTFLASNVA

SEQ ID NO: 140927 - protein, 9 aa, Homo Sapiens
DVFDWGSLG

SEQ ID NO: 140928 - protein, 9 aa, Homo Sapiens
SQAIPLVPL

SEQ ID NO: 140929 - protein, 9 aa, Homo Sapiens
WQHFQWPLQ

SEQ ID NO: 140930 - protein, 9 aa, Homo Sapiens
LDDTEVALF

SEQ ID NO: 140931 - protein, 9 aa, Homo Sapiens
AKRNGSIIS

SEQ ID NO: 140932 - protein, 9 aa, Homo Sapiens
AQAIQKKMW

SEQ ID NO: 140933 - protein, 9 aa, Homo Sapiens
TLKTDSSPS

SEQ ID NO: 140934 - protein, 9 aa, Homo Sapiens
WPLQDLQLW

SEQ ID NO: 140935 - protein, 9 aa, Homo Sapiens
NPRGKGSAG

SEQ ID NO: 140936 - protein, 9 aa, Homo Sapiens
LNYEVSLCM

SEQ ID NO: 140937 - protein, 9 aa, Homo Sapiens
FLASNVALS

SEQ ID NO: 140938 - protein, 9 aa, Homo Sapiens
WAELMCTLR

SEQ ID NO: 140939 - protein, 9 aa, Homo Sapiens
FGFEETDPM

SEQ ID NO: 140940 - protein, 9 aa, Homo Sapiens
SYAVILCHI

SEQ ID NO: 140941 - protein, 9 aa, Homo Sapiens
QCSIDHVYT

SEQ ID NO: 140942 - protein, 9 aa, Homo Sapiens
HSTTMTARS

SEQ ID NO: 140943 - protein, 9 aa, Homo Sapiens
QPCPAKHSA

SEQ ID NO: 140944 - protein, 9 aa, Homo Sapiens
VSTTLLVSS

SEQ ID NO: 140945 - protein, 9 aa, Homo Sapiens
AQKICERVH

SEQ ID NO: 140946 - protein, 9 aa, Homo Sapiens
NDPQPSRNL

SEQ ID NO: 140947 - protein, 9 aa, Homo Sapiens
PNDSARLLN

SEQ ID NO: 140948 - protein, 9 aa, Homo Sapiens
KVNNKSKAN

SEQ ID NO: 140949 - protein, 9 aa, Homo Sapiens
DLKVPKVEV

SEQ ID NO: 140950 - protein, 9 aa, Homo Sapiens
LKTDSSPSP

SEQ ID NO: 140951 - protein, 9 aa, Homo Sapiens
TFLASNVAL

SEQ ID NO: 140952 - protein, 9 aa, Homo Sapiens
ALQASPQCT

SEQ ID NO: 140953 - protein, 9 aa, Homo Sapiens
FEETDPMED

SEQ ID NO: 140954 - protein, 9 aa, Homo Sapiens
VRACEAERP

SEQ ID NO: 140955 - protein, 9 aa, Homo Sapiens
ELPNYWGRQ

SEQ ID NO: 140956 - protein, 9 aa, Homo Sapiens
AEMTRQLQE

SEQ ID NO: 140957 - protein, 9 aa, Homo Sapiens
TEAQTTPPV

SEQ ID NO: 140958 - protein, 9 aa, Homo Sapiens
CDECGKSIS

SEQ ID NO: 140959 - protein, 9 aa, Homo Sapiens
SPTTPVRFL

SEQ ID NO: 140960 - protein, 9 aa, Homo Sapiens
HRNDLGQLD

SEQ ID NO: 140961 - protein, 9 aa, Homo Sapiens
PCPAKHSAE

SEQ ID NO: 140962 - protein, 9 aa, Homo Sapiens
MPQRALPPV

SEQ ID NO: 140963 - protein, 9 aa, Homo Sapiens
NYEVSLCMA

SEQ ID NO: 140964 - protein, 9 aa, Homo Sapiens
AYPPATMTH

SEQ ID NO: 140965 - protein, 9 aa, Homo Sapiens
PAGAHSSSG

SEQ ID NO: 140966 - protein, 9 aa, Homo Sapiens
HYGIADCGT

SEQ ID NO: 140967 - protein, 9 aa, Homo Sapiens
LDTFLASNV

SEQ ID NO: 140968 - protein, 9 aa, Homo Sapiens
VGSQPLCLR

SEQ ID NO: 140969 - protein, 9 aa, Homo Sapiens
TDPMEDASR

SEQ ID NO: 140970 - protein, 9 aa, Homo Sapiens
EYAVYGTCS

SEQ ID NO: 140971 - protein, 9 aa, Homo Sapiens
KFQALCNLC

SEQ ID NO: 140972 - protein, 9 aa, Homo Sapiens
MRQEITQAN

SEQ ID NO: 140973 - protein, 9 aa, Homo Sapiens
SWASTLPTT

SEQ ID NO: 140974 - protein, 9 aa, Homo Sapiens
RGQTAQCSI

SEQ ID NO: 140975 - protein, 9 aa, Homo Sapiens
LPSKASPQV

SEQ ID NO: 140976 - protein, 9 aa, Homo Sapiens
KTFGYNPQF

SEQ ID NO: 140977 - protein, 9 aa, Homo Sapiens
TILVFILIF

SEQ ID NO: 140978 - protein, 9 aa, Homo Sapiens
HLDSMPTTL

SEQ ID NO: 140979 - protein, 9 aa, Homo Sapiens
LRAVPTALP

SEQ ID NO: 140980 - protein, 9 aa, Homo Sapiens
SNWNALLVY

SEQ ID NO: 140981 - protein, 9 aa, Homo Sapiens
QHIHIYSTS

SEQ ID NO: 140982 - protein, 9 aa, Homo Sapiens
IMWYRVTDG

SEQ ID NO: 140983 - protein, 9 aa, Homo Sapiens
ARRCEVSVL

SEQ ID NO: 140984 - protein, 9 aa, Homo Sapiens
LDPDTLCKK

SEQ ID NO: 140985 - protein, 9 aa, Homo Sapiens
SSQTHTRPT

SEQ ID NO: 140986 - protein, 9 aa, Homo Sapiens
LKFIIILYV

SEQ ID NO: 140987 - protein, 9 aa, Homo Sapiens
TRSTSQEVP

SEQ ID NO: 140988 - protein, 9 aa, Homo Sapiens
TSDSEEGDD

SEQ ID NO: 140989 - protein, 9 aa, Homo Sapiens
PLRLPSEQE

SEQ ID NO: 140990 - protein, 9 aa, Homo Sapiens
PRSPTPTRR

SEQ ID NO: 140991 - protein, 9 aa, Homo Sapiens
ALGLAPPPP

SEQ ID NO: 140992 - protein, 9 aa, Homo Sapiens
TDGKDKGNV

SEQ ID NO: 140993 - protein, 9 aa, Homo Sapiens
LGAGAGAVP

SEQ ID NO: 140994 - protein, 9 aa, Homo Sapiens
ILYTSDTTG

SEQ ID NO: 140995 - protein, 9 aa, Homo Sapiens
SASAAAMHT

SEQ ID NO: 140996 - protein, 9 aa, Homo Sapiens
VGGDLDVQG

SEQ ID NO: 140997 - protein, 9 aa, Homo Sapiens
EWCTWRAAA

SEQ ID NO: 140998 - protein, 9 aa, Homo Sapiens
DEEFIGFRD

SEQ ID NO: 140999 - protein, 9 aa, Homo Sapiens
AAARQQQPP

SEQ ID NO: 141000 - protein, 9 aa, Homo Sapiens
TIMNRHLCC

SEQ ID NO: 141001 - protein, 9 aa, Homo Sapiens
TVRIGVFSV

SEQ ID NO: 141002 - protein, 9 aa, Homo Sapiens
RAHSQLINH

SEQ ID NO: 141003 - protein, 9 aa, Homo Sapiens
LMFAVWEEV

SEQ ID NO: 141004 - protein, 9 aa, Homo Sapiens
ISHQWIRLH

SEQ ID NO: 141005 - protein, 9 aa, Homo Sapiens
PKFSRLHRG

SEQ ID NO: 141006 - protein, 9 aa, Homo Sapiens
CRPAVASRS

SEQ ID NO: 141007 - protein, 9 aa, Homo Sapiens
YATIMNRHL

SEQ ID NO: 141008 - protein, 9 aa, Homo Sapiens
HRGALSPTC

SEQ ID NO: 141009 - protein, 9 aa, Homo Sapiens
GGAGTALLC

SEQ ID NO: 141010 - protein, 9 aa, Homo Sapiens
RDSSFRLDP

SEQ ID NO: 141011 - protein, 9 aa, Homo Sapiens
APPTRIALN

SEQ ID NO: 141012 - protein, 9 aa, Homo Sapiens
VWKEVRGEW

SEQ ID NO: 141013 - protein, 9 aa, Homo Sapiens
TVLVVVAAR

SEQ ID NO: 141014 - protein, 9 aa, Homo Sapiens
GYFIDTTTI

SEQ ID NO: 141015 - protein, 9 aa, Homo Sapiens
LCMLRLGQM

SEQ ID NO: 141016 - protein, 9 aa, Homo Sapiens
LSPNVVAFT

SEQ ID NO: 141017 - protein, 9 aa, Homo Sapiens
RARRAPRAP

SEQ ID NO: 141018 - protein, 9 aa, Homo Sapiens
EATLEVSGS

SEQ ID NO: 141019 - protein, 9 aa, Homo Sapiens
LAVLGKTSL

SEQ ID NO: 141020 - protein, 9 aa, Homo Sapiens
FMCSDPFVP

SEQ ID NO: 141021 - protein, 9 aa, Homo Sapiens
HQECHQQPP

SEQ ID NO: 141022 - protein, 9 aa, Homo Sapiens
PVRVPDQEP

SEQ ID NO: 141023 - protein, 9 aa, Homo Sapiens
FAVQTGKYK

SEQ ID NO: 141024 - protein, 9 aa, Homo Sapiens
QIVPDLYAC

SEQ ID NO: 141025 - protein, 9 aa, Homo Sapiens
VGRCFLEKM

SEQ ID NO: 141026 - protein, 9 aa, Homo Sapiens
DLYACGEAA

SEQ ID NO: 141027 - protein, 9 aa, Homo Sapiens
EVWWCATSD

SEQ ID NO: 141028 - protein, 9 aa, Homo Sapiens
VALGASCTA

SEQ ID NO: 141029 - protein, 9 aa, Homo Sapiens
LLEEIEEKT

SEQ ID NO: 141030 - protein, 9 aa, Homo Sapiens
PLLLLLFLL

SEQ ID NO: 141031 - protein, 9 aa, Homo Sapiens
QANQGSVFI

SEQ ID NO: 141032 - protein, 9 aa, Homo Sapiens
YFYEFLSLH

SEQ ID NO: 141033 - protein, 9 aa, Homo Sapiens
CHLGTAGTD

SEQ ID NO: 141034 - protein, 9 aa, Homo Sapiens
APLRLWSWC

SEQ ID NO: 141035 - protein, 9 aa, Homo Sapiens
TSRRTRPNR

SEQ ID NO: 141036 - protein, 9 aa, Homo Sapiens
LIRHAYSFH

SEQ ID NO: 141037 - protein, 9 aa, Homo Sapiens
LLSCHIPVV

SEQ ID NO: 141038 - protein, 9 aa, Homo Sapiens
RMICNVELP

SEQ ID NO: 141039 - protein, 9 aa, Homo Sapiens
QFLTWILNR

SEQ ID NO: 141040 - protein, 9 aa, Homo Sapiens
ECHQQPPVI

SEQ ID NO: 141041 - protein, 9 aa, Homo Sapiens
NNTTGTSIG

SEQ ID NO: 141042 - protein, 9 aa, Homo Sapiens
GAAPSPLCL

SEQ ID NO: 141043 - protein, 9 aa, Homo Sapiens
IDTTTIVEC

SEQ ID NO: 141044 - protein, 9 aa, Homo Sapiens
WDFCLLSLP

SEQ ID NO: 141045 - protein, 9 aa, Homo Sapiens
RMERSANAA

SEQ ID NO: 141046 - protein, 9 aa, Homo Sapiens
PEFSFNIPH

SEQ ID NO: 141047 - protein, 9 aa, Homo Sapiens
RCWKRTSHP

SEQ ID NO: 141048 - protein, 9 aa, Homo Sapiens
VPARTRGAP

SEQ ID NO: 141049 - protein, 9 aa, Homo Sapiens
TPAAAAPGE

SEQ ID NO: 141050 - protein, 9 aa, Homo Sapiens
THVLLITVT

SEQ ID NO: 141051 - protein, 9 aa, Homo Sapiens
GVERPLIPE

SEQ ID NO: 141052 - protein, 9 aa, Homo Sapiens
NFLTTKSED

SEQ ID NO: 141053 - protein, 9 aa, Homo Sapiens
CPNLLPAPS

SEQ ID NO: 141054 - protein, 9 aa, Homo Sapiens
VCAPATPHV

SEQ ID NO: 141055 - protein, 9 aa, Homo Sapiens
HTVIHTDTH

SEQ ID NO: 141056 - protein, 9 aa, Homo Sapiens
GGGVQKRSH

SEQ ID NO: 141057 - protein, 9 aa, Homo Sapiens
LYNGHFFQN

SEQ ID NO: 141058 - protein, 9 aa, Homo Sapiens
LCLGMPRAW

SEQ ID NO: 141059 - protein, 9 aa, Homo Sapiens
RWHQECHQQ

SEQ ID NO: 141060 - protein, 9 aa, Homo Sapiens
VHIFQDCEA

SEQ ID NO: 141061 - protein, 9 aa, Homo Sapiens
STEPERISE

SEQ ID NO: 141062 - protein, 9 aa, Homo Sapiens
YEASGQFIH

SEQ ID NO: 141063 - protein, 9 aa, Homo Sapiens
RSCMCTADY

SEQ ID NO: 141064 - protein, 9 aa, Homo Sapiens
HRSVLVHAD

SEQ ID NO: 141065 - protein, 9 aa, Homo Sapiens
NKKLTGHFG

SEQ ID NO: 141066 - protein, 9 aa, Homo Sapiens
GALSPTCVE

SEQ ID NO: 141067 - protein, 9 aa, Homo Sapiens
VDNKAAAEW

SEQ ID NO: 141068 - protein, 9 aa, Homo Sapiens
LEYITHSLL

SEQ ID NO: 141069 - protein, 9 aa, Homo Sapiens
LMALLSFLH

SEQ ID NO: 141070 - protein, 9 aa, Homo Sapiens
NKSVCDRFN

SEQ ID NO: 141071 - protein, 9 aa, Homo Sapiens
SSTPCTVLT

SEQ ID NO: 141072 - protein, 9 aa, Homo Sapiens
LSCRTRRRW

SEQ ID NO: 141073 - protein, 9 aa, Homo Sapiens
SADRFADQR

SEQ ID NO: 141074 - protein, 9 aa, Homo Sapiens
AAAHALARF

SEQ ID NO: 141075 - protein, 9 aa, Homo Sapiens
LADDVTLTK

SEQ ID NO: 141076 - protein, 9 aa, Homo Sapiens
DQSRRKMQT

SEQ ID NO: 141077 - protein, 9 aa, Homo Sapiens
MHKTFGTQN

SEQ ID NO: 141078 - protein, 9 aa, Homo Sapiens
VRCRSLTGR

SEQ ID NO: 141079 - protein, 9 aa, Homo Sapiens
KTVWRLVPG

SEQ ID NO: 141080 - protein, 9 aa, Homo Sapiens
FDIKYNREI

SEQ ID NO: 141081 - protein, 9 aa, Homo Sapiens
HFGSASLDS

SEQ ID NO: 141082 - protein, 9 aa, Homo Sapiens
DEVLHLIHE

SEQ ID NO: 141083 - protein, 9 aa, Homo Sapiens
SIRGEVWSF

SEQ ID NO: 141084 - protein, 9 aa, Homo Sapiens
AVCGYNAAC

SEQ ID NO: 141085 - protein, 9 aa, Homo Sapiens
APAPRPLPS

SEQ ID NO: 141086 - protein, 9 aa, Homo Sapiens
GSGRRATLT

SEQ ID NO: 141087 - protein, 9 aa, Homo Sapiens
PSSMPAAMR

SEQ ID NO: 141088 - protein, 9 aa, Homo Sapiens
DVLKKEIYI

SEQ ID NO: 141089 - protein, 9 aa, Homo Sapiens
VSEAFISIV

SEQ ID NO: 141090 - protein, 9 aa, Homo Sapiens
MDSAWSLTS

SEQ ID NO: 141091 - protein, 9 aa, Homo Sapiens
VWSCVNVAG

SEQ ID NO: 141092 - protein, 9 aa, Homo Sapiens
SLVGTWYSK

SEQ ID NO: 141093 - protein, 9 aa, Homo Sapiens
LRAGAGCGQ

SEQ ID NO: 141094 - protein, 9 aa, Homo Sapiens
KCRYALGIQ

SEQ ID NO: 141095 - protein, 9 aa, Homo Sapiens
QRFQDTDEK

SEQ ID NO: 141096 - protein, 9 aa, Homo Sapiens
ARCLDPSEA

SEQ ID NO: 141097 - protein, 9 aa, Homo Sapiens
VIMDRPLQV

SEQ ID NO: 141098 - protein, 9 aa, Homo Sapiens
DLGDCILKL

SEQ ID NO: 141099 - protein, 9 aa, Homo Sapiens
LMITRARKG

SEQ ID NO: 141100 - protein, 9 aa, Homo Sapiens
FLGDLLAVP

SEQ ID NO: 141101 - protein, 9 aa, Homo Sapiens
LLSFLHHHL

SEQ ID NO: 141102 - protein, 9 aa, Homo Sapiens
ISQPTASWH

SEQ ID NO: 141103 - protein, 9 aa, Homo Sapiens
GSGRRPRLR

SEQ ID NO: 141104 - protein, 9 aa, Homo Sapiens
YTHALDGLY

SEQ ID NO: 141105 - protein, 9 aa, Homo Sapiens
EKMKHLNIV

SEQ ID NO: 141106 - protein, 9 aa, Homo Sapiens
KGRCIPPRT

SEQ ID NO: 141107 - protein, 9 aa, Homo Sapiens
GSGAFGMVY

SEQ ID NO: 141108 - protein, 9 aa, Homo Sapiens
TCTVWTTSW

SEQ ID NO: 141109 - protein, 9 aa, Homo Sapiens
REEEQKQVE

SEQ ID NO: 141110 - protein, 9 aa, Homo Sapiens
WDFHDSFNL

SEQ ID NO: 141111 - protein, 9 aa, Homo Sapiens
EDFLWNDYI

SEQ ID NO: 141112 - protein, 9 aa, Homo Sapiens
RTTYCHPSC

SEQ ID NO: 141113 - protein, 9 aa, Homo Sapiens
LKGGNGWRN

SEQ ID NO: 141114 - protein, 9 aa, Homo Sapiens
CLLSLPWIP

SEQ ID NO: 141115 - protein, 9 aa, Homo Sapiens
QRREHVLKQ

SEQ ID NO: 141116 - protein, 9 aa, Homo Sapiens
QFLVLCPEC

SEQ ID NO: 141117 - protein, 9 aa, Homo Sapiens
TRVDDIHPR

SEQ ID NO: 141118 - protein, 9 aa, Homo Sapiens
PQDSRQVLA

SEQ ID NO: 141119 - protein, 9 aa, Homo Sapiens
GTGPVGWQL

SEQ ID NO: 141120 - protein, 9 aa, Homo Sapiens
GPCGYGPQD

SEQ ID NO: 141121 - protein, 9 aa, Homo Sapiens
WSWRPHPPS

SEQ ID NO: 141122 - protein, 9 aa, Homo Sapiens
PPLTPAATR

SEQ ID NO: 141123 - protein, 9 aa, Homo Sapiens
EDTPVGIII

SEQ ID NO: 141124 - protein, 9 aa, Homo Sapiens
DLEGVNMRH

SEQ ID NO: 141125 - protein, 9 aa, Homo Sapiens
VVPLLLVVV

SEQ ID NO: 141126 - protein, 9 aa, Homo Sapiens
QGRGGEGAW

SEQ ID NO: 141127 - protein, 9 aa, Homo Sapiens
GLGPDPPTG

SEQ ID NO: 141128 - protein, 9 aa, Homo Sapiens
TKFWEYKAI

SEQ ID NO: 141129 - protein, 9 aa, Homo Sapiens
PIHAAAEAD

SEQ ID NO: 141130 - protein, 9 aa, Homo Sapiens
ELALCKRGR

SEQ ID NO: 141131 - protein, 9 aa, Homo Sapiens
AAVLNPRGV

SEQ ID NO: 141132 - protein, 9 aa, Homo Sapiens
PIQPRTLSM

SEQ ID NO: 141133 - protein, 9 aa, Homo Sapiens
DFQLVLPGE

SEQ ID NO: 141134 - protein, 9 aa, Homo Sapiens
KPLGMVSNI

SEQ ID NO: 141135 - protein, 9 aa, Homo Sapiens
VKRQRKCLV

SEQ ID NO: 141136 - protein, 9 aa, Homo Sapiens
GLEITASAP

SEQ ID NO: 141137 - protein, 9 aa, Homo Sapiens
PAVPAAACP

SEQ ID NO: 141138 - protein, 9 aa, Homo Sapiens
AEAVEAANM

SEQ ID NO: 141139 - protein, 9 aa, Homo Sapiens
RSWRTWSAG

SEQ ID NO: 141140 - protein, 9 aa, Homo Sapiens
CEHVKLLLN

SEQ ID NO: 141141 - protein, 9 aa, Homo Sapiens
STKCGTWRS

SEQ ID NO: 141142 - protein, 9 aa, Homo Sapiens
SVTLRLRKV

SEQ ID NO: 141143 - protein, 9 aa, Homo Sapiens
AKLGVNFGR

SEQ ID NO: 141144 - protein, 9 aa, Homo Sapiens
STGGIFEPS

SEQ ID NO: 141145 - protein, 9 aa, Homo Sapiens
WTGACPAVA

SEQ ID NO: 141146 - protein, 9 aa, Homo Sapiens
IPKDEHILQ

SEQ ID NO: 141147 - protein, 9 aa, Homo Sapiens
LVVFYINVS

SEQ ID NO: 141148 - protein, 9 aa, Homo Sapiens
AGVLLLVDD

SEQ ID NO: 141149 - protein, 9 aa, Homo Sapiens
EFENKLEVE

SEQ ID NO: 141150 - protein, 9 aa, Homo Sapiens
VTCSSHMMV

SEQ ID NO: 141151 - protein, 9 aa, Homo Sapiens
IPHVPVWLP

SEQ ID NO: 141152 - protein, 9 aa, Homo Sapiens
LQETISRFW

SEQ ID NO: 141153 - protein, 9 aa, Homo Sapiens
KGNFMELGA

SEQ ID NO: 141154 - protein, 9 aa, Homo Sapiens
AKCRYALGI

SEQ ID NO: 141155 - protein, 9 aa, Homo Sapiens
LRVSPVRNS

SEQ ID NO: 141156 - protein, 9 aa, Homo Sapiens
PPARSWSAP

SEQ ID NO: 141157 - protein, 9 aa, Homo Sapiens
DIQLPNGIT

SEQ ID NO: 141158 - protein, 9 aa, Homo Sapiens
SLPGPCASL

SEQ ID NO: 141159 - protein, 9 aa, Homo Sapiens
QGLTFDYSH

SEQ ID NO: 141160 - protein, 9 aa, Homo Sapiens
KGGNVTKAP

SEQ ID NO: 141161 - protein, 9 aa, Homo Sapiens
SLQAQEDAH

SEQ ID NO: 141162 - protein, 9 aa, Homo Sapiens
PSPAACWMA

SEQ ID NO: 141163 - protein, 9 aa, Homo Sapiens
SVVPQFLPR

SEQ ID NO: 141164 - protein, 9 aa, Homo Sapiens
VMNVRNTIH

SEQ ID NO: 141165 - protein, 9 aa, Homo Sapiens
TAKHHSTPL

SEQ ID NO: 141166 - protein, 9 aa, Homo Sapiens
LSWSSRIVA

SEQ ID NO: 141167 - protein, 9 aa, Homo Sapiens
SLRCLPDQP

SEQ ID NO: 141168 - protein, 9 aa, Homo Sapiens
PDTQAMSDW

SEQ ID NO: 141169 - protein, 9 aa, Homo Sapiens
PCTQGRCWK

SEQ ID NO: 141170 - protein, 9 aa, Homo Sapiens
TGLRGGVRV

SEQ ID NO: 141171 - protein, 9 aa, Homo Sapiens
RPHPPSSTP

SEQ ID NO: 141172 - protein, 9 aa, Homo Sapiens
PTLPLSPSR

SEQ ID NO: 141173 - protein, 9 aa, Homo Sapiens
EGKGHTNTG

SEQ ID NO: 141174 - protein, 9 aa, Homo Sapiens
ATRTWLWRG

SEQ ID NO: 141175 - protein, 9 aa, Homo Sapiens
AQLFLRRKM

SEQ ID NO: 141176 - protein, 9 aa, Homo Sapiens
FLVPAAMMG

SEQ ID NO: 141177 - protein, 9 aa, Homo Sapiens
KRVGPKSWA

SEQ ID NO: 141178 - protein, 9 aa, Homo Sapiens
ERMTGHGRA

SEQ ID NO: 141179 - protein, 9 aa, Homo Sapiens
RLWDSHICG

SEQ ID NO: 141180 - protein, 9 aa, Homo Sapiens
HYRLDDPDE

SEQ ID NO: 141181 - protein, 9 aa, Homo Sapiens
PQGPAQAPL

SEQ ID NO: 141182 - protein, 9 aa, Homo Sapiens
DAHNHNRQT

SEQ ID NO: 141183 - protein, 9 aa, Homo Sapiens
SEDECTLDL

SEQ ID NO: 141184 - protein, 9 aa, Homo Sapiens
VAELARKAS

SEQ ID NO: 141185 - protein, 9 aa, Homo Sapiens
AHKKKARMT

SEQ ID NO: 141186 - protein, 9 aa, Homo Sapiens
KEVRGEWRQ

SEQ ID NO: 141187 - protein, 9 aa, Homo Sapiens
SAAAALGPA

SEQ ID NO: 141188 - protein, 9 aa, Homo Sapiens
SRIYGFIGL

SEQ ID NO: 141189 - protein, 9 aa, Homo Sapiens
RPSFRGSCR

SEQ ID NO: 141190 - protein, 9 aa, Homo Sapiens
PRTSAGLLH

SEQ ID NO: 141191 - protein, 9 aa, Homo Sapiens
TLLDFMNAV

SEQ ID NO: 141192 - protein, 9 aa, Homo Sapiens
ARAEPMAEE

SEQ ID NO: 141193 - protein, 9 aa, Homo Sapiens
TLHKPATLS

SEQ ID NO: 141194 - protein, 9 aa, Homo Sapiens
RARGRGFGC

SEQ ID NO: 141195 - protein, 9 aa, Homo Sapiens
PPPRRSWWR

SEQ ID NO: 141196 - protein, 9 aa, Homo Sapiens
KMLLRMHTV

SEQ ID NO: 141197 - protein, 9 aa, Homo Sapiens
KAYPSEKSN

SEQ ID NO: 141198 - protein, 9 aa, Homo Sapiens
PALLRNMAM

SEQ ID NO: 141199 - protein, 9 aa, Homo Sapiens
SYHPGIFRG

SEQ ID NO: 141200 - protein, 9 aa, Homo Sapiens
EAGVEEGPA

SEQ ID NO: 141201 - protein, 9 aa, Homo Sapiens
LSISGSPAL

SEQ ID NO: 141202 - protein, 9 aa, Homo Sapiens
LLQRNLLRL

SEQ ID NO: 141203 - protein, 9 aa, Homo Sapiens
FSRLHRGLK

SEQ ID NO: 141204 - protein, 9 aa, Homo Sapiens
VHKSMKDHS

SEQ ID NO: 141205 - protein, 9 aa, Homo Sapiens
DLIWNWAQS

SEQ ID NO: 141206 - protein, 9 aa, Homo Sapiens
RMTRTRSDF

SEQ ID NO: 141207 - protein, 9 aa, Homo Sapiens
PRPCPLALA

SEQ ID NO: 141208 - protein, 9 aa, Homo Sapiens
YNNSVDVYA

SEQ ID NO: 141209 - protein, 9 aa, Homo Sapiens
DLIAVRQVD

SEQ ID NO: 141210 - protein, 9 aa, Homo Sapiens
KGKIKVVRS

SEQ ID NO: 141211 - protein, 9 aa, Homo Sapiens
QQRVLINLY

SEQ ID NO: 141212 - protein, 9 aa, Homo Sapiens
EVQMKRVGP

SEQ ID NO: 141213 - protein, 9 aa, Homo Sapiens
QLKGGNGWR

SEQ ID NO: 141214 - protein, 9 aa, Homo Sapiens
YSKKAKERQ

SEQ ID NO: 141215 - protein, 9 aa, Homo Sapiens
FQICYGMHG

SEQ ID NO: 141216 - protein, 9 aa, Homo Sapiens
FPICCFQAI

SEQ ID NO: 141217 - protein, 9 aa, Homo Sapiens
IQCPALRKT

SEQ ID NO: 141218 - protein, 9 aa, Homo Sapiens
SCEVQPDSL

SEQ ID NO: 141219 - protein, 9 aa, Homo Sapiens
RIGNGFEEG

SEQ ID NO: 141220 - protein, 9 aa, Homo Sapiens
GGRPGQCAG

SEQ ID NO: 141221 - protein, 8 aa, Homo Sapiens
RLGSPGLL

SEQ ID NO: 141222 - protein, 9 aa, Homo Sapiens
DVFICQYFT

SEQ ID NO: 141223 - protein, 9 aa, Homo Sapiens
KSNELLQAN

SEQ ID NO: 141224 - protein, 9 aa, Homo Sapiens
ANAPPLTPA

SEQ ID NO: 141225 - protein, 9 aa, Homo Sapiens
TPGTRERVW

SEQ ID NO: 141226 - protein, 9 aa, Homo Sapiens
SWDGAWFLE

SEQ ID NO: 141227 - protein, 9 aa, Homo Sapiens
WATSSSTWA

SEQ ID NO: 141228 - protein, 9 aa, Homo Sapiens
QASDTAAPA

SEQ ID NO: 141229 - protein, 9 aa, Homo Sapiens
KLYDIMGVP

SEQ ID NO: 141230 - protein, 9 aa, Homo Sapiens
EYRRAEKEW

SEQ ID NO: 141231 - protein, 9 aa, Homo Sapiens
LTVMAVANV

SEQ ID NO: 141232 - protein, 9 aa, Homo Sapiens
STSCGTYSS

SEQ ID NO: 141233 - protein, 9 aa, Homo Sapiens
PARASPAPG

SEQ ID NO: 141234 - protein, 9 aa, Homo Sapiens
LDGPQIGVN

SEQ ID NO: 141235 - protein, 9 aa, Homo Sapiens
RAQTTCIAA

SEQ ID NO: 141236 - protein, 9 aa, Homo Sapiens
FYEFLSLHS

SEQ ID NO: 141237 - protein, 9 aa, Homo Sapiens
KAPKKTLLK

SEQ ID NO: 141238 - protein, 9 aa, Homo Sapiens
PKWKDYLPT

SEQ ID NO: 141239 - protein, 9 aa, Homo Sapiens
TTTTTSQPS

SEQ ID NO: 141240 - protein, 9 aa, Homo Sapiens
RGGGRQRGR

SEQ ID NO: 141241 - protein, 9 aa, Homo Sapiens
PIETPDLKL

SEQ ID NO: 141242 - protein, 9 aa, Homo Sapiens
GDHQPGDPS

SEQ ID NO: 141243 - protein, 9 aa, Homo Sapiens
NPPNHPSQQ

SEQ ID NO: 141244 - protein, 9 aa, Homo Sapiens
SNIKKGKKI

SEQ ID NO: 141245 - protein, 9 aa, Homo Sapiens
LREWCTWRA

SEQ ID NO: 141246 - protein, 9 aa, Homo Sapiens
GRDQGLTFD

SEQ ID NO: 141247 - protein, 9 aa, Homo Sapiens
LNYECCPGY

SEQ ID NO: 141248 - protein, 9 aa, Homo Sapiens
WPRTPSPCT

SEQ ID NO: 141249 - protein, 9 aa, Homo Sapiens
DCVFRSCFH

SEQ ID NO: 141250 - protein, 9 aa, Homo Sapiens
KGIDGPPGK

SEQ ID NO: 141251 - protein, 9 aa, Homo Sapiens
WPPYRAFLR

SEQ ID NO: 141252 - protein, 9 aa, Homo Sapiens
SFKEWFHAS

SEQ ID NO: 141253 - protein, 9 aa, Homo Sapiens
QILERKRKG

SEQ ID NO: 141254 - protein, 9 aa, Homo Sapiens
FLCGMHYLY

SEQ ID NO: 141255 - protein, 9 aa, Homo Sapiens
LLKSTHLLL

SEQ ID NO: 141256 - protein, 9 aa, Homo Sapiens
PRTPTPVPP

SEQ ID NO: 141257 - protein, 9 aa, Homo Sapiens
SGSCAWMRT

SEQ ID NO: 141258 - protein, 9 aa, Homo Sapiens
LVSSDARNI

SEQ ID NO: 141259 - protein, 9 aa, Homo Sapiens
NTMAIGVAV

SEQ ID NO: 141260 - protein, 9 aa, Homo Sapiens
FIRVASMVS

SEQ ID NO: 141261 - protein, 9 aa, Homo Sapiens
KLSIADRPS

SEQ ID NO: 141262 - protein, 9 aa, Homo Sapiens
PAGAAPRRW

SEQ ID NO: 141263 - protein, 9 aa, Homo Sapiens
NVTKPLNNF

SEQ ID NO: 141264 - protein, 9 aa, Homo Sapiens
VCVSCPEDP

SEQ ID NO: 141265 - protein, 9 aa, Homo Sapiens
NDPQLPFPR

SEQ ID NO: 141266 - protein, 9 aa, Homo Sapiens
HHRCVRDLG

SEQ ID NO: 141267 - protein, 9 aa, Homo Sapiens
LLLIDSFNS

SEQ ID NO: 141268 - protein, 9 aa, Homo Sapiens
SIPQAGARP

SEQ ID NO: 141269 - protein, 9 aa, Homo Sapiens
FGDLNPSSA

SEQ ID NO: 141270 - protein, 9 aa, Homo Sapiens
RQVGMLFLL

SEQ ID NO: 141271 - protein, 9 aa, Homo Sapiens
NAFHQSRLW

SEQ ID NO: 141272 - protein, 9 aa, Homo Sapiens
SEELDERGY

SEQ ID NO: 141273 - protein, 9 aa, Homo Sapiens
EGLGPDPPT

SEQ ID NO: 141274 - protein, 9 aa, Homo Sapiens
HPEQVNLKW

SEQ ID NO: 141275 - protein, 9 aa, Homo Sapiens
PAAAPWRPF

SEQ ID NO: 141276 - protein, 9 aa, Homo Sapiens
GSGWSGRSA

SEQ ID NO: 141277 - protein, 9 aa, Homo Sapiens
KASMTKKSL

SEQ ID NO: 141278 - protein, 9 aa, Homo Sapiens
GYSGPSLPA

SEQ ID NO: 141279 - protein, 9 aa, Homo Sapiens
TAGAVWHEV

SEQ ID NO: 141280 - protein, 9 aa, Homo Sapiens
LLWLLRGRL

SEQ ID NO: 141281 - protein, 9 aa, Homo Sapiens
ALRCIQTLC

SEQ ID NO: 141282 - protein, 9 aa, Homo Sapiens
SSQLLVQAY

SEQ ID NO: 141283 - protein, 9 aa, Homo Sapiens
RWASRAQTH

SEQ ID NO: 141284 - protein, 9 aa, Homo Sapiens
LEKYYEASG

SEQ ID NO: 141285 - protein, 9 aa, Homo Sapiens
YNAACQHYG

SEQ ID NO: 141286 - protein, 9 aa, Homo Sapiens
HTGIHRHTQ

SEQ ID NO: 141287 - protein, 9 aa, Homo Sapiens
YSYHYRLDD

SEQ ID NO: 141288 - protein, 9 aa, Homo Sapiens
HTAGTQNCE

SEQ ID NO: 141289 - protein, 9 aa, Homo Sapiens
FPQCTFFFL

SEQ ID NO: 141290 - protein, 9 aa, Homo Sapiens
LLGSRMAHP

SEQ ID NO: 141291 - protein, 9 aa, Homo Sapiens
LGCVLRRAR

SEQ ID NO: 141292 - protein, 9 aa, Homo Sapiens
DYAIDLYPS

SEQ ID NO: 141293 - protein, 9 aa, Homo Sapiens
SSEVTRLWS

SEQ ID NO: 141294 - protein, 9 aa, Homo Sapiens
VGGQSWNCA

SEQ ID NO: 141295 - protein, 9 aa, Homo Sapiens
VKNAEELFV

SEQ ID NO: 141296 - protein, 9 aa, Homo Sapiens
WEYKAIETL

SEQ ID NO: 141297 - protein, 9 aa, Homo Sapiens
DLGLKVKAL

SEQ ID NO: 141298 - protein, 9 aa, Homo Sapiens
WHQECHQQP

SEQ ID NO: 141299 - protein, 9 aa, Homo Sapiens
MLSPDHHPQ

SEQ ID NO: 141300 - protein, 9 aa, Homo Sapiens
QLPPQTLEM

SEQ ID NO: 141301 - protein, 9 aa, Homo Sapiens
SRYQFQNLA

SEQ ID NO: 141302 - protein, 9 aa, Homo Sapiens
SRYNQNRLS

SEQ ID NO: 141303 - protein, 9 aa, Homo Sapiens
QDEKACIEA

SEQ ID NO: 141304 - protein, 9 aa, Homo Sapiens
STFPTINIE

SEQ ID NO: 141305 - protein, 9 aa, Homo Sapiens
IYTVWVCIK

SEQ ID NO: 141306 - protein, 9 aa, Homo Sapiens
DPLVQGGQG

SEQ ID NO: 141307 - protein, 9 aa, Homo Sapiens
PFFMTLGWE

SEQ ID NO: 141308 - protein, 9 aa, Homo Sapiens
DVQQKIEPH

SEQ ID NO: 141309 - protein, 9 aa, Homo Sapiens
MKMLERSNH

SEQ ID NO: 141310 - protein, 9 aa, Homo Sapiens
SSTSILSAL

SEQ ID NO: 141311 - protein, 9 aa, Homo Sapiens
MRGHFHEEA

SEQ ID NO: 141312 - protein, 9 aa, Homo Sapiens
AGLLAGLPH

SEQ ID NO: 141313 - protein, 9 aa, Homo Sapiens
ITNIELTDA

SEQ ID NO: 141314 - protein, 9 aa, Homo Sapiens
VKYGDEVPG

SEQ ID NO: 141315 - protein, 9 aa, Homo Sapiens
LGLQLPDLL

SEQ ID NO: 141316 - protein, 9 aa, Homo Sapiens
FKRPPINVV

SEQ ID NO: 141317 - protein, 9 aa, Homo Sapiens
WLGGPSARR

SEQ ID NO: 141318 - protein, 9 aa, Homo Sapiens
SHRLHLLLH

SEQ ID NO: 141319 - protein, 9 aa, Homo Sapiens
SCGTRLWTS

SEQ ID NO: 141320 - protein, 9 aa, Homo Sapiens
SKSPSTSGI

SEQ ID NO: 141321 - protein, 9 aa, Homo Sapiens
TGPQQSRPL

SEQ ID NO: 141322 - protein, 9 aa, Homo Sapiens
FHLRCTHHL

SEQ ID NO: 141323 - protein, 9 aa, Homo Sapiens
VSLPELPVT

SEQ ID NO: 141324 - protein, 9 aa, Homo Sapiens
NFQFPPQVN

SEQ ID NO: 141325 - protein, 9 aa, Homo Sapiens
WLRGSLEWL

SEQ ID NO: 141326 - protein, 9 aa, Homo Sapiens
AHQGPGHGG

SEQ ID NO: 141327 - protein, 9 aa, Homo Sapiens
GHNGGPPWG

SEQ ID NO: 141328 - protein, 9 aa, Homo Sapiens
AIHRGKDQE

SEQ ID NO: 141329 - protein, 9 aa, Homo Sapiens
GEADLADGA

SEQ ID NO: 141330 - protein, 9 aa, Homo Sapiens
RNMAMATSL

SEQ ID NO: 141331 - protein, 9 aa, Homo Sapiens
IWNWAQSCP

SEQ ID NO: 141332 - protein, 9 aa, Homo Sapiens
SRYEWNLES

SEQ ID NO: 141333 - protein, 9 aa, Homo Sapiens
VVDMDLTPA

SEQ ID NO: 141334 - protein, 9 aa, Homo Sapiens
FNIPHAKRE

SEQ ID NO: 141335 - protein, 9 aa, Homo Sapiens
DPMSILFKM

SEQ ID NO: 141336 - protein, 9 aa, Homo Sapiens
SSPGHPLGP

SEQ ID NO: 141337 - protein, 9 aa, Homo Sapiens
AKDIYGGDY

SEQ ID NO: 141338 - protein, 9 aa, Homo Sapiens
MKWSGDILT

SEQ ID NO: 141339 - protein, 9 aa, Homo Sapiens
APQCRRAGR

SEQ ID NO: 141340 - protein, 9 aa, Homo Sapiens
LLRSSSAPP

SEQ ID NO: 141341 - protein, 9 aa, Homo Sapiens
LPPIVPVKK

SEQ ID NO: 141342 - protein, 9 aa, Homo Sapiens
RPVCCPRAP

SEQ ID NO: 141343 - protein, 9 aa, Homo Sapiens
HPLPVKPKT

SEQ ID NO: 141344 - protein, 9 aa, Homo Sapiens
NNLKNCIYP

SEQ ID NO: 141345 - protein, 9 aa, Homo Sapiens
LTADVTKKN

SEQ ID NO: 141346 - protein, 9 aa, Homo Sapiens
GSQRPPRQV

SEQ ID NO: 141347 - protein, 9 aa, Homo Sapiens
ATTFPTQRP

SEQ ID NO: 141348 - protein, 9 aa, Homo Sapiens
PIHLSKFMS

SEQ ID NO: 141349 - protein, 9 aa, Homo Sapiens
SCTAPCSCS

SEQ ID NO: 141350 - protein, 9 aa, Homo Sapiens
PALSPVACP

SEQ ID NO: 141351 - protein, 9 aa, Homo Sapiens
APTPWDATI

SEQ ID NO: 141352 - protein, 9 aa, Homo Sapiens
KLTRKPKGS

SEQ ID NO: 141353 - protein, 9 aa, Homo Sapiens
TSNNNMEKV

SEQ ID NO: 141354 - protein, 9 aa, Homo Sapiens
DISEKEQRC

SEQ ID NO: 141355 - protein, 9 aa, Homo Sapiens
QRIQRGMEV

SEQ ID NO: 141356 - protein, 9 aa, Homo Sapiens
VWEKENSDR

SEQ ID NO: 141357 - protein, 9 aa, Homo Sapiens
VTSNSSTLR

SEQ ID NO: 141358 - protein, 9 aa, Homo Sapiens
GATGIGTPT

SEQ ID NO: 141359 - protein, 9 aa, Homo Sapiens
GEPFRRYSS

SEQ ID NO: 141360 - protein, 9 aa, Homo Sapiens
YWCRRTDPT

SEQ ID NO: 141361 - protein, 9 aa, Homo Sapiens
LRLDASHIS

SEQ ID NO: 141362 - protein, 9 aa, Homo Sapiens
APPAPQAEA

SEQ ID NO: 141363 - protein, 9 aa, Homo Sapiens
TARATSGTA

SEQ ID NO: 141364 - protein, 9 aa, Homo Sapiens
CLGMPRAWC

SEQ ID NO: 141365 - protein, 9 aa, Homo Sapiens
GCDSPDPDV

SEQ ID NO: 141366 - protein, 9 aa, Homo Sapiens
RGQSAKSGS

SEQ ID NO: 141367 - protein, 9 aa, Homo Sapiens
ASTEPERIS

SEQ ID NO: 141368 - protein, 9 aa, Homo Sapiens
SSAPPAATD

SEQ ID NO: 141369 - protein, 9 aa, Homo Sapiens
NFRGPHPRA

SEQ ID NO: 141370 - protein, 9 aa, Homo Sapiens
AACPMTACS

SEQ ID NO: 141371 - protein, 9 aa, Homo Sapiens
PGSSVLWLS

SEQ ID NO: 141372 - protein, 9 aa, Homo Sapiens
ASLGREWDL

SEQ ID NO: 141373 - protein, 9 aa, Homo Sapiens
GGTDTMSAS

SEQ ID NO: 141374 - protein, 9 aa, Homo Sapiens
HQQPPVIPL

SEQ ID NO: 141375 - protein, 9 aa, Homo Sapiens
FTTQAHPIH

SEQ ID NO: 141376 - protein, 9 aa, Homo Sapiens
RPSTKCGTW

SEQ ID NO: 141377 - protein, 9 aa, Homo Sapiens
AIVLQILVE

SEQ ID NO: 141378 - protein, 9 aa, Homo Sapiens
LAQRGRDDD

SEQ ID NO: 141379 - protein, 9 aa, Homo Sapiens
LTSGLPHGL

SEQ ID NO: 141380 - protein, 9 aa, Homo Sapiens
VPERTMAGL

SEQ ID NO: 141381 - protein, 9 aa, Homo Sapiens
PAPAPPLFL

SEQ ID NO: 141382 - protein, 9 aa, Homo Sapiens
PLLLGLAQL

SEQ ID NO: 141383 - protein, 9 aa, Homo Sapiens
SYRVLPSPS

SEQ ID NO: 141384 - protein, 9 aa, Homo Sapiens
SQDTCLRTN

SEQ ID NO: 141385 - protein, 9 aa, Homo Sapiens
TLQISQKGR

SEQ ID NO: 141386 - protein, 9 aa, Homo Sapiens
SPSMWRTSC

SEQ ID NO: 141387 - protein, 9 aa, Homo Sapiens
SEFTPQSPP

SEQ ID NO: 141388 - protein, 9 aa, Homo Sapiens
KSGSGSGLN

SEQ ID NO: 141389 - protein, 9 aa, Homo Sapiens
RCEGEKQQE

SEQ ID NO: 141390 - protein, 9 aa, Homo Sapiens
AALLTDGTT

SEQ ID NO: 141391 - protein, 9 aa, Homo Sapiens
VPHPPPPVT

SEQ ID NO: 141392 - protein, 9 aa, Homo Sapiens
PLPPPQVTS

SEQ ID NO: 141393 - protein, 9 aa, Homo Sapiens
GVATGHIIS

SEQ ID NO: 141394 - protein, 9 aa, Homo Sapiens
PSNFWKGAL

SEQ ID NO: 141395 - protein, 9 aa, Homo Sapiens
YVETPMSPT

SEQ ID NO: 141396 - protein, 9 aa, Homo Sapiens
YNANWERER

SEQ ID NO: 141397 - protein, 9 aa, Homo Sapiens
LGLAPPPPA

SEQ ID NO: 141398 - protein, 9 aa, Homo Sapiens
LRPQASRAP

SEQ ID NO: 141399 - protein, 9 aa, Homo Sapiens
MGSWRSFIC

SEQ ID NO: 141400 - protein, 9 aa, Homo Sapiens
RHLCCILVA

SEQ ID NO: 141401 - protein, 9 aa, Homo Sapiens
SCVSPWATS

SEQ ID NO: 141402 - protein, 9 aa, Homo Sapiens
TPPSILLPA

SEQ ID NO: 141403 - protein, 9 aa, Homo Sapiens
RTQQRTAAL

SEQ ID NO: 141404 - protein, 9 aa, Homo Sapiens
GLDNSAKSG

SEQ ID NO: 141405 - protein, 9 aa, Homo Sapiens
SRLPPHHRR

SEQ ID NO: 141406 - protein, 9 aa, Homo Sapiens
PMGRPSNFA

SEQ ID NO: 141407 - protein, 9 aa, Homo Sapiens
SCFGPSKIS

SEQ ID NO: 141408 - protein, 9 aa, Homo Sapiens
GPWRMQTVP

SEQ ID NO: 141409 - protein, 9 aa, Homo Sapiens
GRVRHSLCE

SEQ ID NO: 141410 - protein, 9 aa, Homo Sapiens
ALIPGGPPG

SEQ ID NO: 141411 - protein, 9 aa, Homo Sapiens
VWTTSWCGW

SEQ ID NO: 141412 - protein, 9 aa, Homo Sapiens
PSMWRTSCR

SEQ ID NO: 141413 - protein, 9 aa, Homo Sapiens
SSGREMGSL

SEQ ID NO: 141414 - protein, 9 aa, Homo Sapiens
SRWCCCRAR

SEQ ID NO: 141415 - protein, 9 aa, Homo Sapiens
PAQAVMLRM

SEQ ID NO: 141416 - protein, 9 aa, Homo Sapiens
LWSWCGTSQ

SEQ ID NO: 141417 - protein, 9 aa, Homo Sapiens
LPSPRSRWR

SEQ ID NO: 141418 - protein, 9 aa, Homo Sapiens
MLKEDSVSS

SEQ ID NO: 141419 - protein, 9 aa, Homo Sapiens
HHRNTDQRS

SEQ ID NO: 141420 - protein, 9 aa, Homo Sapiens
GLWSLRTAR

SEQ ID NO: 141421 - protein, 9 aa, Homo Sapiens
LPLGCIWTG

SEQ ID NO: 141422 - protein, 9 aa, Homo Sapiens
VVRSAPGQA

SEQ ID NO: 141423 - protein, 9 aa, Homo Sapiens
VAVEQAGGS

SEQ ID NO: 141424 - protein, 9 aa, Homo Sapiens
SPAGPLAPP

SEQ ID NO: 141425 - protein, 9 aa, Homo Sapiens
QILVENIRV

SEQ ID NO: 141426 - protein, 9 aa, Homo Sapiens
PTPATTLRL

SEQ ID NO: 141427 - protein, 9 aa, Homo Sapiens
QTGKYKAHF

SEQ ID NO: 141428 - protein, 9 aa, Homo Sapiens
PLDASPAGP

SEQ ID NO: 141429 - protein, 9 aa, Homo Sapiens
WRWQLGTAP

SEQ ID NO: 141430 - protein, 9 aa, Homo Sapiens
EAGAGAGGR

SEQ ID NO: 141431 - protein, 9 aa, Homo Sapiens
TERSPLPPG

SEQ ID NO: 141432 - protein, 9 aa, Homo Sapiens
FCHHGGVFH

SEQ ID NO: 141433 - protein, 9 aa, Homo Sapiens
WQLGTAPWP

SEQ ID NO: 141434 - protein, 9 aa, Homo Sapiens
VPICSGAST

SEQ ID NO: 141435 - protein, 9 aa, Homo Sapiens
GRHTAGAVW

SEQ ID NO: 141436 - protein, 9 aa, Homo Sapiens
LGGADPGPW

SEQ ID NO: 141437 - protein, 9 aa, Homo Sapiens
MRMCMGSWR

SEQ ID NO: 141438 - protein, 9 aa, Homo Sapiens
NSINVDREQ

SEQ ID NO: 141439 - protein, 9 aa, Homo Sapiens
LGQECPESI

SEQ ID NO: 141440 - protein, 9 aa, Homo Sapiens
KKTTSQSQL

SEQ ID NO: 141441 - protein, 9 aa, Homo Sapiens
HFFQLKTSL

SEQ ID NO: 141442 - protein, 9 aa, Homo Sapiens
FHYQVTERG

SEQ ID NO: 141443 - protein, 9 aa, Homo Sapiens
EKFRISASL

SEQ ID NO: 141444 - protein, 9 aa, Homo Sapiens
LFGRDQGLT

SEQ ID NO: 141445 - protein, 9 aa, Homo Sapiens
GPYPAASAP

SEQ ID NO: 141446 - protein, 9 aa, Homo Sapiens
CSRPVCCPR

SEQ ID NO: 141447 - protein, 9 aa, Homo Sapiens
LSAQSEGLQ

SEQ ID NO: 141448 - protein, 9 aa, Homo Sapiens
DENYEHINV

SEQ ID NO: 141449 - protein, 9 aa, Homo Sapiens
ARRATLCMC

SEQ ID NO: 141450 - protein, 9 aa, Homo Sapiens
SMAVVIPDA

SEQ ID NO: 141451 - protein, 9 aa, Homo Sapiens
ELPVTPGLG

SEQ ID NO: 141452 - protein, 9 aa, Homo Sapiens
RQTLGVTLK

SEQ ID NO: 141453 - protein, 9 aa, Homo Sapiens
PVPERTMAG

SEQ ID NO: 141454 - protein, 9 aa, Homo Sapiens
QSPKVQVSP

SEQ ID NO: 141455 - protein, 9 aa, Homo Sapiens
GYSVRAKVL

SEQ ID NO: 141456 - protein, 9 aa, Homo Sapiens
AGAVVWDPV

SEQ ID NO: 141457 - protein, 9 aa, Homo Sapiens
RPPSSPTRA

SEQ ID NO: 141458 - protein, 9 aa, Homo Sapiens
MIGHPWHQS

SEQ ID NO: 141459 - protein, 9 aa, Homo Sapiens
LPGPREVPA

SEQ ID NO: 141460 - protein, 9 aa, Homo Sapiens
PHLLKEKVL

SEQ ID NO: 141461 - protein, 9 aa, Homo Sapiens
SWVGPCFPE

SEQ ID NO: 141462 - protein, 9 aa, Homo Sapiens
WWLQVPGEL

SEQ ID NO: 141463 - protein, 9 aa, Homo Sapiens
TDLGLAPTP

SEQ ID NO: 141464 - protein, 9 aa, Homo Sapiens
CPRAPEVPR

SEQ ID NO: 141465 - protein, 9 aa, Homo Sapiens
DKTRMQRIK

SEQ ID NO: 141466 - protein, 9 aa, Homo Sapiens
ACGSHLAVV

SEQ ID NO: 141467 - protein, 9 aa, Homo Sapiens
LGVVPGPPL

SEQ ID NO: 141468 - protein, 9 aa, Homo Sapiens
RARAGIEAS

SEQ ID NO: 141469 - protein, 9 aa, Homo Sapiens
SSDIVALGA

SEQ ID NO: 141470 - protein, 9 aa, Homo Sapiens
PAQLFLRRK

SEQ ID NO: 141471 - protein, 9 aa, Homo Sapiens
SQRWPPPRW

SEQ ID NO: 141472 - protein, 9 aa, Homo Sapiens
SSSREGPVP

SEQ ID NO: 141473 - protein, 9 aa, Homo Sapiens
HHTPELRSS

SEQ ID NO: 141474 - protein, 9 aa, Homo Sapiens
GAKHKGIKS

SEQ ID NO: 141475 - protein, 9 aa, Homo Sapiens
ATSSSTGVA

SEQ ID NO: 141476 - protein, 9 aa, Homo Sapiens
PQILERKRK

SEQ ID NO: 141477 - protein, 9 aa, Homo Sapiens
CAMGVAYGS

SEQ ID NO: 141478 - protein, 9 aa, Homo Sapiens
NTKLSSWRS

SEQ ID NO: 141479 - protein, 9 aa, Homo Sapiens
EPKLGEEFM

SEQ ID NO: 141480 - protein, 9 aa, Homo Sapiens
MSGMAALTA

SEQ ID NO: 141481 - protein, 9 aa, Homo Sapiens
LDDQIQWPT

SEQ ID NO: 141482 - protein, 9 aa, Homo Sapiens
VSMVTLLST

SEQ ID NO: 141483 - protein, 9 aa, Homo Sapiens
PCLAQAPIP

SEQ ID NO: 141484 - protein, 9 aa, Homo Sapiens
RVWFSDKVL

SEQ ID NO: 141485 - protein, 9 aa, Homo Sapiens
VFLPEPGCL

SEQ ID NO: 141486 - protein, 9 aa, Homo Sapiens
SAGLCSLPW

SEQ ID NO: 141487 - protein, 9 aa, Homo Sapiens
LFGSLRRQN

SEQ ID NO: 141488 - protein, 9 aa, Homo Sapiens
VVPILLSIL

SEQ ID NO: 141489 - protein, 9 aa, Homo Sapiens
HLFSMEISS

SEQ ID NO: 141490 - protein, 9 aa, Homo Sapiens
GPDSTPRGR

SEQ ID NO: 141491 - protein, 9 aa, Homo Sapiens
MVSNIIEQL

SEQ ID NO: 141492 - protein, 9 aa, Homo Sapiens
IEVGEKMLL

SEQ ID NO: 141493 - protein, 9 aa, Homo Sapiens
AGARPGASG

SEQ ID NO: 141494 - protein, 9 aa, Homo Sapiens
GGSMLMPRW

SEQ ID NO: 141495 - protein, 9 aa, Homo Sapiens
SPNGPLGPS

SEQ ID NO: 141496 - protein, 9 aa, Homo Sapiens
NWAQSCPTF

SEQ ID NO: 141497 - protein, 9 aa, Homo Sapiens
IIMGRWTAA

SEQ ID NO: 141498 - protein, 9 aa, Homo Sapiens
LLLEHCIEF

SEQ ID NO: 141499 - protein, 9 aa, Homo Sapiens
QTELAAIDL

SEQ ID NO: 141500 - protein, 9 aa, Homo Sapiens
RKGFKYFES

SEQ ID NO: 141501 - protein, 9 aa, Homo Sapiens
CTRRPVTSS

SEQ ID NO: 141502 - protein, 9 aa, Homo Sapiens
SCLYSVCEQ

SEQ ID NO: 141503 - protein, 9 aa, Homo Sapiens
LRRSSPSLC

SEQ ID NO: 141504 - protein, 9 aa, Homo Sapiens
FHYQYGVLG

SEQ ID NO: 141505 - protein, 9 aa, Homo Sapiens
FLCAWDFNI

SEQ ID NO: 141506 - protein, 9 aa, Homo Sapiens
FAVWEEVEV

SEQ ID NO: 141507 - protein, 9 aa, Homo Sapiens
SWWAQRRRW

SEQ ID NO: 141508 - protein, 9 aa, Homo Sapiens
AGPWGGRWP

SEQ ID NO: 141509 - protein, 9 aa, Homo Sapiens
AQQPHQEAD

SEQ ID NO: 141510 - protein, 9 aa, Homo Sapiens
CLIRQQQEM

SEQ ID NO: 141511 - protein, 9 aa, Homo Sapiens
RCAIVGNSG

SEQ ID NO: 141512 - protein, 9 aa, Homo Sapiens
PQPLPVAPG

SEQ ID NO: 141513 - protein, 9 aa, Homo Sapiens
AKRMSYHAV

SEQ ID NO: 141514 - protein, 9 aa, Homo Sapiens
LMQRLLEHP

SEQ ID NO: 141515 - protein, 9 aa, Homo Sapiens
SMATDPSYP

SEQ ID NO: 141516 - protein, 9 aa, Homo Sapiens
DRWKGLEPQ

SEQ ID NO: 141517 - protein, 9 aa, Homo Sapiens
RRCTGPPAR

SEQ ID NO: 141518 - protein, 9 aa, Homo Sapiens
MWDFCLLSL

SEQ ID NO: 141519 - protein, 9 aa, Homo Sapiens
SLMAPWSLA

SEQ ID NO: 141520 - protein, 9 aa, Homo Sapiens
TSELRKDDF

SEQ ID NO: 141521 - protein, 9 aa, Homo Sapiens
RLPARLQRL

SEQ ID NO: 141522 - protein, 9 aa, Homo Sapiens
LPLPRGIRC

SEQ ID NO: 141523 - protein, 9 aa, Homo Sapiens
LMYMTVKYG

SEQ ID NO: 141524 - protein, 9 aa, Homo Sapiens
QPMGPPPEC

SEQ ID NO: 141525 - protein, 9 aa, Homo Sapiens
YDETTQKFT

SEQ ID NO: 141526 - protein, 9 aa, Homo Sapiens
RLNPLRLPS

SEQ ID NO: 141527 - protein, 9 aa, Homo Sapiens
FLNIRAKML

SEQ ID NO: 141528 - protein, 9 aa, Homo Sapiens
PWEFGDIIP

SEQ ID NO: 141529 - protein, 9 aa, Homo Sapiens
EDVVLKKLE

SEQ ID NO: 141530 - protein, 9 aa, Homo Sapiens
GQHHRCVRD

SEQ ID NO: 141531 - protein, 9 aa, Homo Sapiens
RLRAGAGCG

SEQ ID NO: 141532 - protein, 9 aa, Homo Sapiens
FKNYERQKM

SEQ ID NO: 141533 - protein, 9 aa, Homo Sapiens
ARICALPDD

SEQ ID NO: 141534 - protein, 9 aa, Homo Sapiens
ICQYFTVFD

SEQ ID NO: 141535 - protein, 9 aa, Homo Sapiens
SVLVHADSQ

SEQ ID NO: 141536 - protein, 9 aa, Homo Sapiens
RVRTVKCQD

SEQ ID NO: 141537 - protein, 9 aa, Homo Sapiens
MAEERMTGH

SEQ ID NO: 141538 - protein, 9 aa, Homo Sapiens
WRPFSWEDV

SEQ ID NO: 141539 - protein, 9 aa, Homo Sapiens
FKMVDVGGR

SEQ ID NO: 141540 - protein, 9 aa, Homo Sapiens
GFFTGIEAV

SEQ ID NO: 141541 - protein, 9 aa, Homo Sapiens
LHHWNYLSF

SEQ ID NO: 141542 - protein, 9 aa, Homo Sapiens
QPPLPALAP

SEQ ID NO: 141543 - protein, 9 aa, Homo Sapiens
FPLRLDMTS

SEQ ID NO: 141544 - protein, 9 aa, Homo Sapiens
VFLGLKPTI

SEQ ID NO: 141545 - protein, 9 aa, Homo Sapiens
HRRVNDALN

SEQ ID NO: 141546 - protein, 9 aa, Homo Sapiens
MYREVLESG

SEQ ID NO: 141547 - protein, 9 aa, Homo Sapiens
EKTKEAYAQ

SEQ ID NO: 141548 - protein, 9 aa, Homo Sapiens
LEEFKMEKR

SEQ ID NO: 141549 - protein, 9 aa, Homo Sapiens
NTLMVALNS

SEQ ID NO: 141550 - protein, 9 aa, Homo Sapiens
YQPRRNFGQ

SEQ ID NO: 141551 - protein, 9 aa, Homo Sapiens
GLPHFSSLS

SEQ ID NO: 141552 - protein, 9 aa, Homo Sapiens
TPPPGPRYC

SEQ ID NO: 141553 - protein, 9 aa, Homo Sapiens
NLNCSSPGC

SEQ ID NO: 141554 - protein, 9 aa, Homo Sapiens
PDGNGASTA

SEQ ID NO: 141555 - protein, 9 aa, Homo Sapiens
DDTNEFVSS

SEQ ID NO: 141556 - protein, 9 aa, Homo Sapiens
APGLHPGCS

SEQ ID NO: 141557 - protein, 9 aa, Homo Sapiens
ILVENIRVA

SEQ ID NO: 141558 - protein, 9 aa, Homo Sapiens
GSFVRSCTR

SEQ ID NO: 141559 - protein, 9 aa, Homo Sapiens
TLTSSYNFK

SEQ ID NO: 141560 - protein, 9 aa, Homo Sapiens
STCACLLGL

SEQ ID NO: 141561 - protein, 9 aa, Homo Sapiens
TYPEKIDGF

SEQ ID NO: 141562 - protein, 9 aa, Homo Sapiens
SPCISQPTA

SEQ ID NO: 141563 - protein, 9 aa, Homo Sapiens
LPSSEPLSM

SEQ ID NO: 141564 - protein, 9 aa, Homo Sapiens
TLHMAVHDL

SEQ ID NO: 141565 - protein, 9 aa, Homo Sapiens
AVASRSTAP

SEQ ID NO: 141566 - protein, 9 aa, Homo Sapiens
AISMETLKV

SEQ ID NO: 141567 - protein, 9 aa, Homo Sapiens
QQQQQQEEA

SEQ ID NO: 141568 - protein, 9 aa, Homo Sapiens
PVGESPWQV

SEQ ID NO: 141569 - protein, 9 aa, Homo Sapiens
QRPVPEPPT

SEQ ID NO: 141570 - protein, 9 aa, Homo Sapiens
RILLQRNLL

SEQ ID NO: 141571 - protein, 9 aa, Homo Sapiens
QVLVTDPGV

SEQ ID NO: 141572 - protein, 9 aa, Homo Sapiens
YLAEMGCGP

SEQ ID NO: 141573 - protein, 9 aa, Homo Sapiens
ADIIQRTTS

SEQ ID NO: 141574 - protein, 9 aa, Homo Sapiens
DELPSVQPE

SEQ ID NO: 141575 - protein, 9 aa, Homo Sapiens
VILDDVDIS

SEQ ID NO: 141576 - protein, 9 aa, Homo Sapiens
SEFGLSKME

SEQ ID NO: 141577 - protein, 9 aa, Homo Sapiens
GSSQGCREG

SEQ ID NO: 141578 - protein, 9 aa, Homo Sapiens
GTSQTYFGS

SEQ ID NO: 141579 - protein, 9 aa, Homo Sapiens
MRWARRCTG

SEQ ID NO: 141580 - protein, 9 aa, Homo Sapiens
HNNFFFDGM

SEQ ID NO: 141581 - protein, 9 aa, Homo Sapiens
CRRISATTN

SEQ ID NO: 141582 - protein, 9 aa, Homo Sapiens
VKSAVTHST

SEQ ID NO: 141583 - protein, 9 aa, Homo Sapiens
AADWLLQTP

SEQ ID NO: 141584 - protein, 9 aa, Homo Sapiens
LSADIIQRT

SEQ ID NO: 141585 - protein, 9 aa, Homo Sapiens
GAWSFQPAS

SEQ ID NO: 141586 - protein, 9 aa, Homo Sapiens
KLASGTQEW

SEQ ID NO: 141587 - protein, 9 aa, Homo Sapiens
PLGMVSNII

SEQ ID NO: 141588 - protein, 9 aa, Homo Sapiens
HLAAGLGQL

SEQ ID NO: 141589 - protein, 9 aa, Homo Sapiens
CFLTIHSYG

SEQ ID NO: 141590 - protein, 9 aa, Homo Sapiens
LLALQQLPV

SEQ ID NO: 141591 - protein, 9 aa, Homo Sapiens
VWAQWGPNL

SEQ ID NO: 141592 - protein, 9 aa, Homo Sapiens
MRRVNQEEI

SEQ ID NO: 141593 - protein, 9 aa, Homo Sapiens
ADAVAATTW

SEQ ID NO: 141594 - protein, 9 aa, Homo Sapiens
RLGSCTAPC

SEQ ID NO: 141595 - protein, 9 aa, Homo Sapiens
TKPISPVNQ

SEQ ID NO: 141596 - protein, 9 aa, Homo Sapiens
GSLLRNNGQ

SEQ ID NO: 141597 - protein, 9 aa, Homo Sapiens
ACSRPVCCP

SEQ ID NO: 141598 - protein, 9 aa, Homo Sapiens
ISVPCPNLL

SEQ ID NO: 141599 - protein, 9 aa, Homo Sapiens
SSDEGIMSR

SEQ ID NO: 141600 - protein, 9 aa, Homo Sapiens
APGGGGSPR

SEQ ID NO: 141601 - protein, 9 aa, Homo Sapiens
LLFVVMAWN

SEQ ID NO: 141602 - protein, 9 aa, Homo Sapiens
PKLGEEFME

SEQ ID NO: 141603 - protein, 9 aa, Homo Sapiens
VGGSMLMPR

SEQ ID NO: 141604 - protein, 9 aa, Homo Sapiens
LTGSSPRCG

SEQ ID NO: 141605 - protein, 9 aa, Homo Sapiens
DTKLYDIMG

SEQ ID NO: 141606 - protein, 9 aa, Homo Sapiens
APAVRKFSL

SEQ ID NO: 141607 - protein, 9 aa, Homo Sapiens
PMHGGTLLD

SEQ ID NO: 141608 - protein, 9 aa, Homo Sapiens
PDQVRTLHR

SEQ ID NO: 141609 - protein, 9 aa, Homo Sapiens
IGGGGWPGW

SEQ ID NO: 141610 - protein, 9 aa, Homo Sapiens
VPVLIKKIA

SEQ ID NO: 141611 - protein, 9 aa, Homo Sapiens
MTGHGRARP

SEQ ID NO: 141612 - protein, 9 aa, Homo Sapiens
QIVMNVRNT

SEQ ID NO: 141613 - protein, 9 aa, Homo Sapiens
STSWSASAA

SEQ ID NO: 141614 - protein, 9 aa, Homo Sapiens
EPLSTTSAA

SEQ ID NO: 141615 - protein, 9 aa, Homo Sapiens
GGVNQLGGG

SEQ ID NO: 141616 - protein, 9 aa, Homo Sapiens
FQPFWQLEA

SEQ ID NO: 141617 - protein, 9 aa, Homo Sapiens
PYTCRALAT

SEQ ID NO: 141618 - protein, 9 aa, Homo Sapiens
PLKTVVKKS

SEQ ID NO: 141619 - protein, 9 aa, Homo Sapiens
WPSWVGPCF

SEQ ID NO: 141620 - protein, 9 aa, Homo Sapiens
WQRFGRHTA

SEQ ID NO: 141621 - protein, 9 aa, Homo Sapiens
VPPALSPVA

SEQ ID NO: 141622 - protein, 9 aa, Homo Sapiens
CQDYLSKTG

SEQ ID NO: 141623 - protein, 9 aa, Homo Sapiens
TCLSLLSLW

SEQ ID NO: 141624 - protein, 9 aa, Homo Sapiens
VSEGGPEAP

SEQ ID NO: 141625 - protein, 9 aa, Homo Sapiens
DEEVFFSAK

SEQ ID NO: 141626 - protein, 9 aa, Homo Sapiens
LESLNGQNG

SEQ ID NO: 141627 - protein, 9 aa, Homo Sapiens
SQVNEGVWE

SEQ ID NO: 141628 - protein, 9 aa, Homo Sapiens
KAFSACGSH

SEQ ID NO: 141629 - protein, 9 aa, Homo Sapiens
SIRPSLNGR

SEQ ID NO: 141630 - protein, 9 aa, Homo Sapiens
PRSWPRKLR

SEQ ID NO: 141631 - protein, 9 aa, Homo Sapiens
EALVLGLDG

SEQ ID NO: 141632 - protein, 9 aa, Homo Sapiens
TPAKMEPLS

SEQ ID NO: 141633 - protein, 9 aa, Homo Sapiens
PGEWFLCGG

SEQ ID NO: 141634 - protein, 9 aa, Homo Sapiens
LPRPFDLGL

SEQ ID NO: 141635 - protein, 9 aa, Homo Sapiens
CLLGLTRRS

SEQ ID NO: 141636 - protein, 9 aa, Homo Sapiens
RISASLAAG

SEQ ID NO: 141637 - protein, 9 aa, Homo Sapiens
SQIVMNVRN

SEQ ID NO: 141638 - protein, 9 aa, Homo Sapiens
GKRATPDLD

SEQ ID NO: 141639 - protein, 9 aa, Homo Sapiens
LMKGHSARI

SEQ ID NO: 141640 - protein, 9 aa, Homo Sapiens
LSSSSILLC

SEQ ID NO: 141641 - protein, 9 aa, Homo Sapiens
PRLGRSCFH

SEQ ID NO: 141642 - protein, 9 aa, Homo Sapiens
EKLDYIAYL

SEQ ID NO: 141643 - protein, 9 aa, Homo Sapiens
DATNVNNWR

SEQ ID NO: 141644 - protein, 9 aa, Homo Sapiens
METLKVINK

SEQ ID NO: 141645 - protein, 9 aa, Homo Sapiens
VLTEIAPIR

SEQ ID NO: 141646 - protein, 9 aa, Homo Sapiens
IHELVLLQE

SEQ ID NO: 141647 - protein, 9 aa, Homo Sapiens
PGLHGPPGP

SEQ ID NO: 141648 - protein, 9 aa, Homo Sapiens
RCGCTARPL

SEQ ID NO: 141649 - protein, 9 aa, Homo Sapiens
ANAAARRAT

SEQ ID NO: 141650 - protein, 9 aa, Homo Sapiens
AFEALNLSL

SEQ ID NO: 141651 - protein, 9 aa, Homo Sapiens
SRPPTTPTP

SEQ ID NO: 141652 - protein, 9 aa, Homo Sapiens
AALGLAPPP

SEQ ID NO: 141653 - protein, 9 aa, Homo Sapiens
CRPLSKTVC

SEQ ID NO: 141654 - protein, 9 aa, Homo Sapiens
LKLSPETGL

SEQ ID NO: 141655 - protein, 9 aa, Homo Sapiens
KTEKRLLYK

SEQ ID NO: 141656 - protein, 9 aa, Homo Sapiens
IEKNSPFGS

SEQ ID NO: 141657 - protein, 9 aa, Homo Sapiens
VRAASTEPE

SEQ ID NO: 141658 - protein, 9 aa, Homo Sapiens
PAKSQGSGD

SEQ ID NO: 141659 - protein, 9 aa, Homo Sapiens
PKVTAAHSV

SEQ ID NO: 141660 - protein, 9 aa, Homo Sapiens
LLVSRPPSL

SEQ ID NO: 141661 - protein, 9 aa, Homo Sapiens
KERGPLEGG

SEQ ID NO: 141662 - protein, 9 aa, Homo Sapiens
LHPSKTEVH

SEQ ID NO: 141663 - protein, 9 aa, Homo Sapiens
APRWWKRHT

SEQ ID NO: 141664 - protein, 9 aa, Homo Sapiens
LWWCGGGQT

SEQ ID NO: 141665 - protein, 9 aa, Homo Sapiens
MYVLWLLFV

SEQ ID NO: 141666 - protein, 9 aa, Homo Sapiens
AELVPRLFW

SEQ ID NO: 141667 - protein, 9 aa, Homo Sapiens
ALVQCHLGT

SEQ ID NO: 141668 - protein, 9 aa, Homo Sapiens
PLTRLRRRM

SEQ ID NO: 141669 - protein, 9 aa, Homo Sapiens
SRNKRPTFP

SEQ ID NO: 141670 - protein, 9 aa, Homo Sapiens
EKCRRISAT

SEQ ID NO: 141671 - protein, 9 aa, Homo Sapiens
TLPPPPRLG

SEQ ID NO: 141672 - protein, 9 aa, Homo Sapiens
EVELIVREK

SEQ ID NO: 141673 - protein, 9 aa, Homo Sapiens
PPPQQQHYV

SEQ ID NO: 141674 - protein, 9 aa, Homo Sapiens
SQPCLECPS

SEQ ID NO: 141675 - protein, 9 aa, Homo Sapiens
INSAAKVVV

SEQ ID NO: 141676 - protein, 9 aa, Homo Sapiens
PCLDIPGLP

SEQ ID NO: 141677 - protein, 9 aa, Homo Sapiens
ITKEKCRRI

SEQ ID NO: 141678 - protein, 9 aa, Homo Sapiens
ALPGGRLGA

SEQ ID NO: 141679 - protein, 9 aa, Homo Sapiens
TVVGPVLHK

SEQ ID NO: 141680 - protein, 9 aa, Homo Sapiens
VGMDWTGAR

SEQ ID NO: 141681 - protein, 9 aa, Homo Sapiens
CCTCPPAPG

SEQ ID NO: 141682 - protein, 9 aa, Homo Sapiens
KTKEAYAQN

SEQ ID NO: 141683 - protein, 9 aa, Homo Sapiens
NAGNTVRSA

SEQ ID NO: 141684 - protein, 9 aa, Homo Sapiens
VSTPSSRPS

SEQ ID NO: 141685 - protein, 9 aa, Homo Sapiens
LELSPLLLL

SEQ ID NO: 141686 - protein, 9 aa, Homo Sapiens
ISSWTCLAD

SEQ ID NO: 141687 - protein, 9 aa, Homo Sapiens
LSTTTMRLE

SEQ ID NO: 141688 - protein, 9 aa, Homo Sapiens
MVHTLAWNN

SEQ ID NO: 141689 - protein, 9 aa, Homo Sapiens
AELHNLYRA

SEQ ID NO: 141690 - protein, 9 aa, Homo Sapiens
RGIKPSPVP

SEQ ID NO: 141691 - protein, 9 aa, Homo Sapiens
PTKKNSCEV

SEQ ID NO: 141692 - protein, 9 aa, Homo Sapiens
HLKLTRKPK

SEQ ID NO: 141693 - protein, 9 aa, Homo Sapiens
PEGASWSVS

SEQ ID NO: 141694 - protein, 9 aa, Homo Sapiens
AQDCQAEQD

SEQ ID NO: 141695 - protein, 9 aa, Homo Sapiens
MAVVIPDAV

SEQ ID NO: 141696 - protein, 9 aa, Homo Sapiens
NIAIPQCWV

SEQ ID NO: 141697 - protein, 9 aa, Homo Sapiens
QDVKQQQVT

SEQ ID NO: 141698 - protein, 9 aa, Homo Sapiens
QTLRTLSLR

SEQ ID NO: 141699 - protein, 9 aa, Homo Sapiens
PVSGVGQQE

SEQ ID NO: 141700 - protein, 9 aa, Homo Sapiens
AQLREDNTT

SEQ ID NO: 141701 - protein, 9 aa, Homo Sapiens
AYPSSQLLV

SEQ ID NO: 141702 - protein, 9 aa, Homo Sapiens
CGYNAACQH

SEQ ID NO: 141703 - protein, 9 aa, Homo Sapiens
CIFYNPQWA

SEQ ID NO: 141704 - protein, 9 aa, Homo Sapiens
LPAPPSAAQ

SEQ ID NO: 141705 - protein, 9 aa, Homo Sapiens
RAPPGWACG

SEQ ID NO: 141706 - protein, 9 aa, Homo Sapiens
KGTEVPWPE

SEQ ID NO: 141707 - protein, 9 aa, Homo Sapiens
SGHTHTVAT

SEQ ID NO: 141708 - protein, 9 aa, Homo Sapiens
PHPERKTAT

SEQ ID NO: 141709 - protein, 9 aa, Homo Sapiens
HSARIISAT

SEQ ID NO: 141710 - protein, 9 aa, Homo Sapiens
KALFALCSL

SEQ ID NO: 141711 - protein, 9 aa, Homo Sapiens
AATPAAAAP

SEQ ID NO: 141712 - protein, 9 aa, Homo Sapiens
ASTDLGLAP

SEQ ID NO: 141713 - protein, 9 aa, Homo Sapiens
TEVNINNSD

SEQ ID NO: 141714 - protein, 9 aa, Homo Sapiens
EANLRRLKM

SEQ ID NO: 141715 - protein, 9 aa, Homo Sapiens
WHPGSWPVA

SEQ ID NO: 141716 - protein, 9 aa, Homo Sapiens
QHRNINTGV

SEQ ID NO: 141717 - protein, 9 aa, Homo Sapiens
SLKAPTPWD

SEQ ID NO: 141718 - protein, 9 aa, Homo Sapiens
PATPPFGLI

SEQ ID NO: 141719 - protein, 9 aa, Homo Sapiens
YRRAEKEWG

SEQ ID NO: 141720 - protein, 9 aa, Homo Sapiens
RRTTTTSTR

SEQ ID NO: 141721 - protein, 9 aa, Homo Sapiens
HVAGEGPRQ

SEQ ID NO: 141722 - protein, 9 aa, Homo Sapiens
RYALGIQDR

SEQ ID NO: 141723 - protein, 9 aa, Homo Sapiens
SFIRGPNPI

SEQ ID NO: 141724 - protein, 9 aa, Homo Sapiens
ANARRSPRS

SEQ ID NO: 141725 - protein, 9 aa, Homo Sapiens
SKLDFFRSE

SEQ ID NO: 141726 - protein, 9 aa, Homo Sapiens
QGPLASTDL

SEQ ID NO: 141727 - protein, 9 aa, Homo Sapiens
MVIINTFCA

SEQ ID NO: 141728 - protein, 9 aa, Homo Sapiens
GRGGGEGWG

SEQ ID NO: 141729 - protein, 9 aa, Homo Sapiens
GHLSPRLGR

SEQ ID NO: 141730 - protein, 9 aa, Homo Sapiens
SFPDLFALL

SEQ ID NO: 141731 - protein, 9 aa, Homo Sapiens
CARLWMANA

SEQ ID NO: 141732 - protein, 9 aa, Homo Sapiens
PGWACGRGA

SEQ ID NO: 141733 - protein, 9 aa, Homo Sapiens
KEEKTKEAY

SEQ ID NO: 141734 - protein, 9 aa, Homo Sapiens
NSRPPEYEI

SEQ ID NO: 141735 - protein, 9 aa, Homo Sapiens
LQGATERSC

SEQ ID NO: 141736 - protein, 9 aa, Homo Sapiens
FLRQEGPMQ

SEQ ID NO: 141737 - protein, 9 aa, Homo Sapiens
PRGSQSALG

SEQ ID NO: 141738 - protein, 9 aa, Homo Sapiens
AAPWRPFSW

SEQ ID NO: 141739 - protein, 9 aa, Homo Sapiens
GQEGLRVRR

SEQ ID NO: 141740 - protein, 9 aa, Homo Sapiens
FGKKHRIEE

SEQ ID NO: 141741 - protein, 9 aa, Homo Sapiens
PLGHPSRNH

SEQ ID NO: 141742 - protein, 9 aa, Homo Sapiens
IREGWRWGW

SEQ ID NO: 141743 - protein, 9 aa, Homo Sapiens
RPPSLHPSQ

SEQ ID NO: 141744 - protein, 9 aa, Homo Sapiens
NPGTFMCSD

SEQ ID NO: 141745 - protein, 9 aa, Homo Sapiens
EGNGMKDVP

SEQ ID NO: 141746 - protein, 9 aa, Homo Sapiens
FTKNSRGAV

SEQ ID NO: 141747 - protein, 9 aa, Homo Sapiens
TEKSRWSGS

SEQ ID NO: 141748 - protein, 9 aa, Homo Sapiens
RLEGWPSWV

SEQ ID NO: 141749 - protein, 9 aa, Homo Sapiens
EGGPEAPST

SEQ ID NO: 141750 - protein, 9 aa, Homo Sapiens
PETLQSAFY

SEQ ID NO: 141751 - protein, 9 aa, Homo Sapiens
TTNPHSPGP

SEQ ID NO: 141752 - protein, 9 aa, Homo Sapiens
GSCAWMRTQ

SEQ ID NO: 141753 - protein, 9 aa, Homo Sapiens
TGMHRHTHT

SEQ ID NO: 141754 - protein, 9 aa, Homo Sapiens
SILFKMSNS

SEQ ID NO: 141755 - protein, 9 aa, Homo Sapiens
IMCQCWRKE

SEQ ID NO: 141756 - protein, 9 aa, Homo Sapiens
CGHPKDANS

SEQ ID NO: 141757 - protein, 9 aa, Homo Sapiens
RMSYHAVAS

SEQ ID NO: 141758 - protein, 9 aa, Homo Sapiens
YQTNSRLYE

SEQ ID NO: 141759 - protein, 9 aa, Homo Sapiens
CQVSSDPPT

SEQ ID NO: 141760 - protein, 9 aa, Homo Sapiens
DYMLYKAVS

SEQ ID NO: 141761 - protein, 9 aa, Homo Sapiens
VTVFKFIGG

SEQ ID NO: 141762 - protein, 9 aa, Homo Sapiens
GGRLGAGAG

SEQ ID NO: 141763 - protein, 9 aa, Homo Sapiens
CVQQVALKQ

SEQ ID NO: 141764 - protein, 9 aa, Homo Sapiens
LYEEKQKQH

SEQ ID NO: 141765 - protein, 9 aa, Homo Sapiens
LGPLQGGLQ

SEQ ID NO: 141766 - protein, 9 aa, Homo Sapiens
ACSFAVGSR

SEQ ID NO: 141767 - protein, 9 aa, Homo Sapiens
KKKCRSKTL

SEQ ID NO: 141768 - protein, 9 aa, Homo Sapiens
AHMSASTGT

SEQ ID NO: 141769 - protein, 9 aa, Homo Sapiens
APPSAAQGS

SEQ ID NO: 141770 - protein, 9 aa, Homo Sapiens
RVHPPLDIG

SEQ ID NO: 141771 - protein, 9 aa, Homo Sapiens
RGPHPRAHR

SEQ ID NO: 141772 - protein, 9 aa, Homo Sapiens
SHHGSRGAA

SEQ ID NO: 141773 - protein, 9 aa, Homo Sapiens
TVERDFEME

SEQ ID NO: 141774 - protein, 9 aa, Homo Sapiens
VEKKRCARI

SEQ ID NO: 141775 - protein, 9 aa, Homo Sapiens
GAKGDRGQP

SEQ ID NO: 141776 - protein, 9 aa, Homo Sapiens
GRIGGNFRG

SEQ ID NO: 141777 - protein, 9 aa, Homo Sapiens
EHVLEEVIR

SEQ ID NO: 141778 - protein, 9 aa, Homo Sapiens
AKLHQMLRP

SEQ ID NO: 141779 - protein, 9 aa, Homo Sapiens
HTGIHTHTG

SEQ ID NO: 141780 - protein, 9 aa, Homo Sapiens
DSRKWRKRR

SEQ ID NO: 141781 - protein, 9 aa, Homo Sapiens
ATAPSSAPR

SEQ ID NO: 141782 - protein, 9 aa, Homo Sapiens
SCSSCSTSC

SEQ ID NO: 141783 - protein, 9 aa, Homo Sapiens
EIFFLTFYI

SEQ ID NO: 141784 - protein, 9 aa, Homo Sapiens
VNSIWRRFP

SEQ ID NO: 141785 - protein, 9 aa, Homo Sapiens
VQMGFCDWS

SEQ ID NO: 141786 - protein, 9 aa, Homo Sapiens
LRWEKIDLE

SEQ ID NO: 141787 - protein, 9 aa, Homo Sapiens
IPKRNARLM

SEQ ID NO: 141788 - protein, 9 aa, Homo Sapiens
GQGGLDLDP

SEQ ID NO: 141789 - protein, 9 aa, Homo Sapiens
PADGLIQEN

SEQ ID NO: 141790 - protein, 9 aa, Homo Sapiens
WGLMKGHSA

SEQ ID NO: 141791 - protein, 9 aa, Homo Sapiens
DTQAMSDWM

SEQ ID NO: 141792 - protein, 9 aa, Homo Sapiens
LYLVMEYTS

SEQ ID NO: 141793 - protein, 9 aa, Homo Sapiens
YQAQTTVQP

SEQ ID NO: 141794 - protein, 9 aa, Homo Sapiens
GMLFLLIKA

SEQ ID NO: 141795 - protein, 9 aa, Homo Sapiens
GLDDRSPQA

SEQ ID NO: 141796 - protein, 9 aa, Homo Sapiens
YIEYRRAEK

SEQ ID NO: 141797 - protein, 9 aa, Homo Sapiens
KTVPSNFWK

SEQ ID NO: 141798 - protein, 9 aa, Homo Sapiens
NPLRCGCTA

SEQ ID NO: 141799 - protein, 9 aa, Homo Sapiens
HVRWFPETC

SEQ ID NO: 141800 - protein, 9 aa, Homo Sapiens
VNGGKVARK

SEQ ID NO: 141801 - protein, 9 aa, Homo Sapiens
GASTARWRT

SEQ ID NO: 141802 - protein, 9 aa, Homo Sapiens
SCNAEAYIR

SEQ ID NO: 141803 - protein, 9 aa, Homo Sapiens
AVRCVEKMQ

SEQ ID NO: 141804 - protein, 9 aa, Homo Sapiens
GPNPIKLIQ

SEQ ID NO: 141805 - protein, 9 aa, Homo Sapiens
SLLSTLSQP

SEQ ID NO: 141806 - protein, 9 aa, Homo Sapiens
KFTKLAKKQ

SEQ ID NO: 141807 - protein, 9 aa, Homo Sapiens
KRKGRPLGL

SEQ ID NO: 141808 - protein, 9 aa, Homo Sapiens
SQQAETRPE

SEQ ID NO: 141809 - protein, 9 aa, Homo Sapiens
TQSFIHSLV

SEQ ID NO: 141810 - protein, 9 aa, Homo Sapiens
TLAVKHKAD

SEQ ID NO: 141811 - protein, 9 aa, Homo Sapiens
PPLSAPPTR

SEQ ID NO: 141812 - protein, 9 aa, Homo Sapiens
LAARATALE

SEQ ID NO: 141813 - protein, 9 aa, Homo Sapiens
ARLMKVTEN

SEQ ID NO: 141814 - protein, 9 aa, Homo Sapiens
TTTARPRPQ

SEQ ID NO: 141815 - protein, 9 aa, Homo Sapiens
SAPGAPSYM

SEQ ID NO: 141816 - protein, 9 aa, Homo Sapiens
PLLRRPCLP

SEQ ID NO: 141817 - protein, 9 aa, Homo Sapiens
LPALLLPAT

SEQ ID NO: 141818 - protein, 9 aa, Homo Sapiens
ERLLAPLIQ

SEQ ID NO: 141819 - protein, 9 aa, Homo Sapiens
ILERKRKGR

SEQ ID NO: 141820 - protein, 9 aa, Homo Sapiens
QNDPQLPFP

SEQ ID NO: 141821 - protein, 9 aa, Homo Sapiens
GTTREPLTK

SEQ ID NO: 141822 - protein, 9 aa, Homo Sapiens
RLAAPSLAL

SEQ ID NO: 141823 - protein, 9 aa, Homo Sapiens
HAEERQKFL

SEQ ID NO: 141824 - protein, 9 aa, Homo Sapiens
LLNYRTSNI

SEQ ID NO: 141825 - protein, 9 aa, Homo Sapiens
KECVLLDYS

SEQ ID NO: 141826 - protein, 9 aa, Homo Sapiens
NARLMKVTE

SEQ ID NO: 141827 - protein, 9 aa, Homo Sapiens
VRNRRLGSC

SEQ ID NO: 141828 - protein, 9 aa, Homo Sapiens
EEEELEREH

SEQ ID NO: 141829 - protein, 9 aa, Homo Sapiens
QVGPLPCVL

SEQ ID NO: 141830 - protein, 9 aa, Homo Sapiens
GQNGKLAKP

SEQ ID NO: 141831 - protein, 9 aa, Homo Sapiens
QSERAGSSR

SEQ ID NO: 141832 - protein, 9 aa, Homo Sapiens
KKVRRAPSL

SEQ ID NO: 141833 - protein, 9 aa, Homo Sapiens
TAATTAAGA

SEQ ID NO: 141834 - protein, 9 aa, Homo Sapiens
GMTGLPRKS

SEQ ID NO: 141835 - protein, 9 aa, Homo Sapiens
AEGRKKAFV

SEQ ID NO: 141836 - protein, 9 aa, Homo Sapiens
ECCSSWLRR

SEQ ID NO: 141837 - protein, 9 aa, Homo Sapiens
RLFCWLVHR

SEQ ID NO: 141838 - protein, 9 aa, Homo Sapiens
VTHRKAQHL

SEQ ID NO: 141839 - protein, 9 aa, Homo Sapiens
CSILARLVA

SEQ ID NO: 141840 - protein, 9 aa, Homo Sapiens
KNVFPPSSQ

SEQ ID NO: 141841 - protein, 9 aa, Homo Sapiens
IAAAADIAT

SEQ ID NO: 141842 - protein, 9 aa, Homo Sapiens
QSIEFNANH

SEQ ID NO: 141843 - protein, 9 aa, Homo Sapiens
DTVMIHPLP

SEQ ID NO: 141844 - protein, 9 aa, Homo Sapiens
IFAKLEEIQ

SEQ ID NO: 141845 - protein, 9 aa, Homo Sapiens
LRTQRPLEM

SEQ ID NO: 141846 - protein, 9 aa, Homo Sapiens
QTPLGLVPP

SEQ ID NO: 141847 - protein, 9 aa, Homo Sapiens
EADQLLILK

SEQ ID NO: 141848 - protein, 9 aa, Homo Sapiens
LADGAHVWL

SEQ ID NO: 141849 - protein, 9 aa, Homo Sapiens
GPRTPRSSH

SEQ ID NO: 141850 - protein, 9 aa, Homo Sapiens
CLDPGVPVN

SEQ ID NO: 141851 - protein, 9 aa, Homo Sapiens
DDSDPEPDY

SEQ ID NO: 141852 - protein, 9 aa, Homo Sapiens
QRVMSQEHL

SEQ ID NO: 141853 - protein, 9 aa, Homo Sapiens
TYTWLGAPP

SEQ ID NO: 141854 - protein, 9 aa, Homo Sapiens
LRTSCGAAR

SEQ ID NO: 141855 - protein, 9 aa, Homo Sapiens
SLDTSLCVV

SEQ ID NO: 141856 - protein, 9 aa, Homo Sapiens
DFGLAKAYI

SEQ ID NO: 141857 - protein, 9 aa, Homo Sapiens
VGRVRHSLC

SEQ ID NO: 141858 - protein, 9 aa, Homo Sapiens
ACTPASGPS

SEQ ID NO: 141859 - protein, 9 aa, Homo Sapiens
ATQASMTLP

SEQ ID NO: 141860 - protein, 9 aa, Homo Sapiens
PNDDIRYDR

SEQ ID NO: 141861 - protein, 9 aa, Homo Sapiens
NQAYVMMLS

SEQ ID NO: 141862 - protein, 9 aa, Homo Sapiens
KACLEEERE

SEQ ID NO: 141863 - protein, 9 aa, Homo Sapiens
NTTTTTSQP

SEQ ID NO: 141864 - protein, 9 aa, Homo Sapiens
AQVGPLPCV

SEQ ID NO: 141865 - protein, 9 aa, Homo Sapiens
QVQPPPAQS

SEQ ID NO: 141866 - protein, 9 aa, Homo Sapiens
GAAERGVPL

SEQ ID NO: 141867 - protein, 9 aa, Homo Sapiens
RAKDIYGHF

SEQ ID NO: 141868 - protein, 9 aa, Homo Sapiens
MHYLYFAIV

SEQ ID NO: 141869 - protein, 9 aa, Homo Sapiens
DYIPDSIQI

SEQ ID NO: 141870 - protein, 9 aa, Homo Sapiens
ERRRVVRLP

SEQ ID NO: 141871 - protein, 9 aa, Homo Sapiens
KLPCYEALR

SEQ ID NO: 141872 - protein, 9 aa, Homo Sapiens
IIQPSSCHL

SEQ ID NO: 141873 - protein, 9 aa, Homo Sapiens
VTVVGPVLH

SEQ ID NO: 141874 - protein, 9 aa, Homo Sapiens
GPEEGRCGR

SEQ ID NO: 141875 - protein, 9 aa, Homo Sapiens
SPQSPGMRR

SEQ ID NO: 141876 - protein, 9 aa, Homo Sapiens
GEGGRGGGE

SEQ ID NO: 141877 - protein, 9 aa, Homo Sapiens
LDIMTCLQY

SEQ ID NO: 141878 - protein, 9 aa, Homo Sapiens
AALAGVLLL

SEQ ID NO: 141879 - protein, 9 aa, Homo Sapiens
GACEAPIGR

SEQ ID NO: 141880 - protein, 9 aa, Homo Sapiens
CADRNYVNV

SEQ ID NO: 141881 - protein, 9 aa, Homo Sapiens
RVNNKSLAR

SEQ ID NO: 141882 - protein, 9 aa, Homo Sapiens
GKAKKPHSF

SEQ ID NO: 141883 - protein, 9 aa, Homo Sapiens
TWGGPRDPT

SEQ ID NO: 141884 - protein, 9 aa, Homo Sapiens
LSQGAEVLA

SEQ ID NO: 141885 - protein, 9 aa, Homo Sapiens
SAPRSCGTR

SEQ ID NO: 141886 - protein, 9 aa, Homo Sapiens
STILGPQDL

SEQ ID NO: 141887 - protein, 9 aa, Homo Sapiens
DGRVAVPYP

SEQ ID NO: 141888 - protein, 9 aa, Homo Sapiens
NLLLKDMQP

SEQ ID NO: 141889 - protein, 9 aa, Homo Sapiens
ERLFCWLVH

SEQ ID NO: 141890 - protein, 9 aa, Homo Sapiens
EVGEKMLLL

SEQ ID NO: 141891 - protein, 9 aa, Homo Sapiens
LLHPCLDIP

SEQ ID NO: 141892 - protein, 9 aa, Homo Sapiens
SQYRQLLND

SEQ ID NO: 141893 - protein, 9 aa, Homo Sapiens
DNSLDDSDV

SEQ ID NO: 141894 - protein, 9 aa, Homo Sapiens
GHHIGPRAV

SEQ ID NO: 141895 - protein, 9 aa, Homo Sapiens
FKCLRTHSL

SEQ ID NO: 141896 - protein, 9 aa, Homo Sapiens
ATLHMAVHD

SEQ ID NO: 141897 - protein, 9 aa, Homo Sapiens
PHHLHFDAR

SEQ ID NO: 141898 - protein, 9 aa, Homo Sapiens
GPLSNHLES

SEQ ID NO: 141899 - protein, 9 aa, Homo Sapiens
WLLHTAGTQ

SEQ ID NO: 141900 - protein, 9 aa, Homo Sapiens
TELSAGCDP

SEQ ID NO: 141901 - protein, 9 aa, Homo Sapiens
AGLCSLPWA

SEQ ID NO: 141902 - protein, 9 aa, Homo Sapiens
TSAAHHQSS

SEQ ID NO: 141903 - protein, 9 aa, Homo Sapiens
LQELNEYLA

SEQ ID NO: 141904 - protein, 9 aa, Homo Sapiens
RGAGPPGCA

SEQ ID NO: 141905 - protein, 9 aa, Homo Sapiens
LYLRRKEPD

SEQ ID NO: 141906 - protein, 9 aa, Homo Sapiens
EPGMDYEVT

SEQ ID NO: 141907 - protein, 9 aa, Homo Sapiens
AHPGEGWVE

SEQ ID NO: 141908 - protein, 9 aa, Homo Sapiens
PGSPGHLSP

SEQ ID NO: 141909 - protein, 9 aa, Homo Sapiens
MNAFTGRGH

SEQ ID NO: 141910 - protein, 9 aa, Homo Sapiens
LPGDGQTRA

SEQ ID NO: 141911 - protein, 9 aa, Homo Sapiens
WEKIDLENT

SEQ ID NO: 141912 - protein, 9 aa, Homo Sapiens
QRSLAKYVE

SEQ ID NO: 141913 - protein, 9 aa, Homo Sapiens
RSGKHSFKT

SEQ ID NO: 141914 - protein, 9 aa, Homo Sapiens
TPDKKSIEN

SEQ ID NO: 141915 - protein, 9 aa, Homo Sapiens
KKLTGHFGS

SEQ ID NO: 141916 - protein, 9 aa, Homo Sapiens
LAGGTSSLL

SEQ ID NO: 141917 - protein, 9 aa, Homo Sapiens
PGIYTVWVC

SEQ ID NO: 141918 - protein, 9 aa, Homo Sapiens
QAGGSCRLQ

SEQ ID NO: 141919 - protein, 9 aa, Homo Sapiens
LTLRPALAA

SEQ ID NO: 141920 - protein, 9 aa, Homo Sapiens
AFCERPALL

SEQ ID NO: 141921 - protein, 9 aa, Homo Sapiens
IIKQVYQAQ

SEQ ID NO: 141922 - protein, 9 aa, Homo Sapiens
ASAASCASG

SEQ ID NO: 141923 - protein, 9 aa, Homo Sapiens
LATWNFQFP

SEQ ID NO: 141924 - protein, 9 aa, Homo Sapiens
KSWAPAPRR

SEQ ID NO: 141925 - protein, 9 aa, Homo Sapiens
GAGGRRLPA

SEQ ID NO: 141926 - protein, 9 aa, Homo Sapiens
IIGMINMFH

SEQ ID NO: 141927 - protein, 9 aa, Homo Sapiens
THTRPTRRS

SEQ ID NO: 141928 - protein, 9 aa, Homo Sapiens
VDLCGREVE

SEQ ID NO: 141929 - protein, 9 aa, Homo Sapiens
QVNEGVWEK

SEQ ID NO: 141930 - protein, 9 aa, Homo Sapiens
EGPIEAYRT

SEQ ID NO: 141931 - protein, 9 aa, Homo Sapiens
ASSLGSSRL

SEQ ID NO: 141932 - protein, 9 aa, Homo Sapiens
DTNGLVRAL

SEQ ID NO: 141933 - protein, 9 aa, Homo Sapiens
TTIIKQVYQ

SEQ ID NO: 141934 - protein, 9 aa, Homo Sapiens
ELVLLQEPA

SEQ ID NO: 141935 - protein, 9 aa, Homo Sapiens
HRVQLLGAD

SEQ ID NO: 141936 - protein, 9 aa, Homo Sapiens
PSMETHHLQ

SEQ ID NO: 141937 - protein, 9 aa, Homo Sapiens
VGDVAVKIF

SEQ ID NO: 141938 - protein, 9 aa, Homo Sapiens
KKKRTEFSS

SEQ ID NO: 141939 - protein, 9 aa, Homo Sapiens
AKKEWNEDC

SEQ ID NO: 141940 - protein, 9 aa, Homo Sapiens
KTRMQRIKV

SEQ ID NO: 141941 - protein, 9 aa, Homo Sapiens
RHLWNLMEK

SEQ ID NO: 141942 - protein, 9 aa, Homo Sapiens
SEGGPEAPS

SEQ ID NO: 141943 - protein, 9 aa, Homo Sapiens
EIPKDEHIL

SEQ ID NO: 141944 - protein, 9 aa, Homo Sapiens
YTLDPDTLC

SEQ ID NO: 141945 - protein, 9 aa, Homo Sapiens
KPALPGTGG

SEQ ID NO: 141946 - protein, 9 aa, Homo Sapiens
MVYKGIWVP

SEQ ID NO: 141947 - protein, 9 aa, Homo Sapiens
PQDSGVVSS

SEQ ID NO: 141948 - protein, 9 aa, Homo Sapiens
LAALGPPKP

SEQ ID NO: 141949 - protein, 9 aa, Homo Sapiens
KRRRTICGS

SEQ ID NO: 141950 - protein, 9 aa, Homo Sapiens
EAEAAAHAL

SEQ ID NO: 141951 - protein, 9 aa, Homo Sapiens
ARARTCSPC

SEQ ID NO: 141952 - protein, 9 aa, Homo Sapiens
LGVAVDAQV

SEQ ID NO: 141953 - protein, 9 aa, Homo Sapiens
KEAVAAEEE

SEQ ID NO: 141954 - protein, 9 aa, Homo Sapiens
VSNIIEQLV

SEQ ID NO: 141955 - protein, 9 aa, Homo Sapiens
SEMAEPPQM

SEQ ID NO: 141956 - protein, 9 aa, Homo Sapiens
RLPSEQESI

SEQ ID NO: 141957 - protein, 9 aa, Homo Sapiens
KVGQNEERL

SEQ ID NO: 141958 - protein, 9 aa, Homo Sapiens
FFHYQVTER

SEQ ID NO: 141959 - protein, 9 aa, Homo Sapiens
GSGAPPPAA

SEQ ID NO: 141960 - protein, 9 aa, Homo Sapiens
PVPPPYTPP

SEQ ID NO: 141961 - protein, 9 aa, Homo Sapiens
QLWEGRRPL

SEQ ID NO: 141962 - protein, 9 aa, Homo Sapiens
ACDKELIKP

SEQ ID NO: 141963 - protein, 9 aa, Homo Sapiens
DWRRACVQS

SEQ ID NO: 141964 - protein, 9 aa, Homo Sapiens
EVSCSWWAQ

SEQ ID NO: 141965 - protein, 9 aa, Homo Sapiens
LQLQRLGVV

SEQ ID NO: 141966 - protein, 9 aa, Homo Sapiens
ETGLLPECF

SEQ ID NO: 141967 - protein, 9 aa, Homo Sapiens
NLQTMLRDL

SEQ ID NO: 141968 - protein, 9 aa, Homo Sapiens
FRGSCRRGA

SEQ ID NO: 141969 - protein, 9 aa, Homo Sapiens
HCQERLALH

SEQ ID NO: 141970 - protein, 9 aa, Homo Sapiens
VQCHLGTAG

SEQ ID NO: 141971 - protein, 9 aa, Homo Sapiens
LCDGDDEEM

SEQ ID NO: 141972 - protein, 9 aa, Homo Sapiens
TIDLPWGDC

SEQ ID NO: 141973 - protein, 9 aa, Homo Sapiens
GEMKWSGDI

SEQ ID NO: 141974 - protein, 9 aa, Homo Sapiens
KKDSIMYRE

SEQ ID NO: 141975 - protein, 9 aa, Homo Sapiens
PKRNARLMK

SEQ ID NO: 141976 - protein, 9 aa, Homo Sapiens
GGTMAEERM

SEQ ID NO: 141977 - protein, 9 aa, Homo Sapiens
SVVLLGWQA

SEQ ID NO: 141978 - protein, 9 aa, Homo Sapiens
GIPDNKLDA

SEQ ID NO: 141979 - protein, 9 aa, Homo Sapiens
PAHVHVESN

SEQ ID NO: 141980 - protein, 9 aa, Homo Sapiens
PPPPVTLEL

SEQ ID NO: 141981 - protein, 9 aa, Homo Sapiens
PPPSTAATT

SEQ ID NO: 141982 - protein, 9 aa, Homo Sapiens
TWREEKNVH

SEQ ID NO: 141983 - protein, 9 aa, Homo Sapiens
PPKPCPDVW

SEQ ID NO: 141984 - protein, 9 aa, Homo Sapiens
DGTVLFWDA

SEQ ID NO: 141985 - protein, 9 aa, Homo Sapiens
GAVHDAQCK

SEQ ID NO: 141986 - protein, 9 aa, Homo Sapiens
LDPGVPVNG

SEQ ID NO: 141987 - protein, 9 aa, Homo Sapiens
GEPCDLPVP

SEQ ID NO: 141988 - protein, 9 aa, Homo Sapiens
SSQTVQQKV

SEQ ID NO: 141989 - protein, 9 aa, Homo Sapiens
RPPQRPSTV

SEQ ID NO: 141990 - protein, 9 aa, Homo Sapiens
TEFDNVSLS

SEQ ID NO: 141991 - protein, 9 aa, Homo Sapiens
CRVSRYNQN

SEQ ID NO: 141992 - protein, 9 aa, Homo Sapiens
ENLKEPEPL

SEQ ID NO: 141993 - protein, 9 aa, Homo Sapiens
GPPARRHSH

SEQ ID NO: 141994 - protein, 9 aa, Homo Sapiens
VVWDPVHRP

SEQ ID NO: 141995 - protein, 9 aa, Homo Sapiens
LFALLSWGR

SEQ ID NO: 141996 - protein, 9 aa, Homo Sapiens
SMETHHLQP

SEQ ID NO: 141997 - protein, 9 aa, Homo Sapiens
REELCLSKE

SEQ ID NO: 141998 - protein, 9 aa, Homo Sapiens
TLYLVMEYT

SEQ ID NO: 141999 - protein, 9 aa, Homo Sapiens
LGDPGRAPQ

SEQ ID NO: 142000 - protein, 9 aa, Homo Sapiens
SSGGQPRLT

SEQ ID NO: 142001 - protein, 9 aa, Homo Sapiens
VGWLSTTTM

SEQ ID NO: 142002 - protein, 9 aa, Homo Sapiens
RRGGPGTTR

SEQ ID NO: 142003 - protein, 9 aa, Homo Sapiens
EDVNTEFDN

SEQ ID NO: 142004 - protein, 9 aa, Homo Sapiens
PVQVTVPVD

SEQ ID NO: 142005 - protein, 9 aa, Homo Sapiens
LCLYCDKLY

SEQ ID NO: 142006 - protein, 9 aa, Homo Sapiens
NFVLQYQLA

SEQ ID NO: 142007 - protein, 9 aa, Homo Sapiens
EGVPSGPRE

SEQ ID NO: 142008 - protein, 9 aa, Homo Sapiens
TSGRSLSCC

SEQ ID NO: 142009 - protein, 9 aa, Homo Sapiens
WRMQTVPEG

SEQ ID NO: 142010 - protein, 9 aa, Homo Sapiens
QCSLTRATS

SEQ ID NO: 142011 - protein, 9 aa, Homo Sapiens
PGAPRSPPR

SEQ ID NO: 142012 - protein, 9 aa, Homo Sapiens
LHMAVHDLM

SEQ ID NO: 142013 - protein, 9 aa, Homo Sapiens
LTYYEGEVN

SEQ ID NO: 142014 - protein, 9 aa, Homo Sapiens
GPGGEGGRG

SEQ ID NO: 142015 - protein, 9 aa, Homo Sapiens
YKCAMCDSL

SEQ ID NO: 142016 - protein, 9 aa, Homo Sapiens
GDPGVIKQK

SEQ ID NO: 142017 - protein, 9 aa, Homo Sapiens
DIGMTKADL

SEQ ID NO: 142018 - protein, 9 aa, Homo Sapiens
LTPAATRAA

SEQ ID NO: 142019 - protein, 9 aa, Homo Sapiens
EAYCLQFLV

SEQ ID NO: 142020 - protein, 9 aa, Homo Sapiens
ENYKVPESW

SEQ ID NO: 142021 - protein, 9 aa, Homo Sapiens
RPTPPQDRP

SEQ ID NO: 142022 - protein, 9 aa, Homo Sapiens
CDKLYSRKY

SEQ ID NO: 142023 - protein, 9 aa, Homo Sapiens
SISGSPALE

SEQ ID NO: 142024 - protein, 9 aa, Homo Sapiens
RAGGPFQPL

SEQ ID NO: 142025 - protein, 9 aa, Homo Sapiens
ENQQPDGRS

SEQ ID NO: 142026 - protein, 9 aa, Homo Sapiens
ATTAAGASG

SEQ ID NO: 142027 - protein, 9 aa, Homo Sapiens
PQIGVNIRK

SEQ ID NO: 142028 - protein, 9 aa, Homo Sapiens
VGSQPCLEC

SEQ ID NO: 142029 - protein, 9 aa, Homo Sapiens
TDDDEEMNN

SEQ ID NO: 142030 - protein, 9 aa, Homo Sapiens
VWLQCGNFL

SEQ ID NO: 142031 - protein, 9 aa, Homo Sapiens
HPDSRGPRT

SEQ ID NO: 142032 - protein, 9 aa, Homo Sapiens
PPPPHPPLP

SEQ ID NO: 142033 - protein, 9 aa, Homo Sapiens
LRTPWTLNP

SEQ ID NO: 142034 - protein, 9 aa, Homo Sapiens
RCTGPPARR

SEQ ID NO: 142035 - protein, 9 aa, Homo Sapiens
SAAAASPRA

SEQ ID NO: 142036 - protein, 9 aa, Homo Sapiens
AKSQGSGDE

SEQ ID NO: 142037 - protein, 9 aa, Homo Sapiens
IKKKPRLLV

SEQ ID NO: 142038 - protein, 9 aa, Homo Sapiens
RRVVRLPHG

SEQ ID NO: 142039 - protein, 9 aa, Homo Sapiens
RRPVTSSRS

SEQ ID NO: 142040 - protein, 9 aa, Homo Sapiens
WREEKNVHR

SEQ ID NO: 142041 - protein, 9 aa, Homo Sapiens
IQDRTIPDS

SEQ ID NO: 142042 - protein, 9 aa, Homo Sapiens
VMQFGQVAE

SEQ ID NO: 142043 - protein, 9 aa, Homo Sapiens
LKITPKEDP

SEQ ID NO: 142044 - protein, 9 aa, Homo Sapiens
PARLQRLGD

SEQ ID NO: 142045 - protein, 9 aa, Homo Sapiens
RLRLQLQLR

SEQ ID NO: 142046 - protein, 9 aa, Homo Sapiens
SCLIRLHGW

SEQ ID NO: 142047 - protein, 9 aa, Homo Sapiens
LKSQGPRLD

SEQ ID NO: 142048 - protein, 9 aa, Homo Sapiens
AALVAAFFV

SEQ ID NO: 142049 - protein, 9 aa, Homo Sapiens
PAFQVHPDS

SEQ ID NO: 142050 - protein, 9 aa, Homo Sapiens
TFLLILLIF

SEQ ID NO: 142051 - protein, 9 aa, Homo Sapiens
RSKTLLRNH

SEQ ID NO: 142052 - protein, 9 aa, Homo Sapiens
QGRLFISRA

SEQ ID NO: 142053 - protein, 9 aa, Homo Sapiens
SPVGDVGLG

SEQ ID NO: 142054 - protein, 9 aa, Homo Sapiens
HPTCILGQR

SEQ ID NO: 142055 - protein, 9 aa, Homo Sapiens
RSAPSLRPP

SEQ ID NO: 142056 - protein, 9 aa, Homo Sapiens
HLLNYRTSN

SEQ ID NO: 142057 - protein, 9 aa, Homo Sapiens
LRHVAGEGP

SEQ ID NO: 142058 - protein, 9 aa, Homo Sapiens
QRRHISNTD

SEQ ID NO: 142059 - protein, 9 aa, Homo Sapiens
VNAVTRQGI

SEQ ID NO: 142060 - protein, 9 aa, Homo Sapiens
KSPSTSGIC

SEQ ID NO: 142061 - protein, 9 aa, Homo Sapiens
GAVVWDPVH

SEQ ID NO: 142062 - protein, 9 aa, Homo Sapiens
NRGAWKASR

SEQ ID NO: 142063 - protein, 9 aa, Homo Sapiens
CTQGRCWKR

SEQ ID NO: 142064 - protein, 9 aa, Homo Sapiens
AMGVAYGSR

SEQ ID NO: 142065 - protein, 9 aa, Homo Sapiens
TFYIISSEK

SEQ ID NO: 142066 - protein, 9 aa, Homo Sapiens
LWTCLGLAW

SEQ ID NO: 142067 - protein, 9 aa, Homo Sapiens
VLDHVPRID

SEQ ID NO: 142068 - protein, 9 aa, Homo Sapiens
SWLSVSAAG

SEQ ID NO: 142069 - protein, 9 aa, Homo Sapiens
VVVLIVCCC

SEQ ID NO: 142070 - protein, 9 aa, Homo Sapiens
QIFFDVDTS

SEQ ID NO: 142071 - protein, 9 aa, Homo Sapiens
GTRLWTSVR

SEQ ID NO: 142072 - protein, 9 aa, Homo Sapiens
DLPPPRRGS

SEQ ID NO: 142073 - protein, 9 aa, Homo Sapiens
ATMTHPRTA

SEQ ID NO: 142074 - protein, 9 aa, Homo Sapiens
NSEKRKLKA

SEQ ID NO: 142075 - protein, 9 aa, Homo Sapiens
NMEKVTLKK

SEQ ID NO: 142076 - protein, 9 aa, Homo Sapiens
QMDLGDCIL

SEQ ID NO: 142077 - protein, 9 aa, Homo Sapiens
RKSGILAIA

SEQ ID NO: 142078 - protein, 9 aa, Homo Sapiens
KVPRLHSVP

SEQ ID NO: 142079 - protein, 9 aa, Homo Sapiens
DVLTPDDVQ

SEQ ID NO: 142080 - protein, 9 aa, Homo Sapiens
RWRTTRSWR

SEQ ID NO: 142081 - protein, 9 aa, Homo Sapiens
LLPATTCKV

SEQ ID NO: 142082 - protein, 9 aa, Homo Sapiens
TPRSPWAWC

SEQ ID NO: 142083 - protein, 9 aa, Homo Sapiens
PPCPSRPLP

SEQ ID NO: 142084 - protein, 9 aa, Homo Sapiens
EATSLFIKP

SEQ ID NO: 142085 - protein, 9 aa, Homo Sapiens
LSYDKIFSH

SEQ ID NO: 142086 - protein, 9 aa, Homo Sapiens
LEHCLFTSI

SEQ ID NO: 142087 - protein, 9 aa, Homo Sapiens
SHNSEKRKL

SEQ ID NO: 142088 - protein, 9 aa, Homo Sapiens
LGPTQPRPA

SEQ ID NO: 142089 - protein, 9 aa, Homo Sapiens
IGPRSCLSS

SEQ ID NO: 142090 - protein, 9 aa, Homo Sapiens
LRRKMEANI

SEQ ID NO: 142091 - protein, 9 aa, Homo Sapiens
LRLWDSHIC

SEQ ID NO: 142092 - protein, 9 aa, Homo Sapiens
VCEHVKLLL

SEQ ID NO: 142093 - protein, 9 aa, Homo Sapiens
PERAGRTAL

SEQ ID NO: 142094 - protein, 9 aa, Homo Sapiens
CRHCGSTSA

SEQ ID NO: 142095 - protein, 9 aa, Homo Sapiens
PSHFTQQWT

SEQ ID NO: 142096 - protein, 9 aa, Homo Sapiens
SSRDREPEA

SEQ ID NO: 142097 - protein, 9 aa, Homo Sapiens
REALVAELA

SEQ ID NO: 142098 - protein, 9 aa, Homo Sapiens
GVCWPLLRG

SEQ ID NO: 142099 - protein, 9 aa, Homo Sapiens
CRPAAFPPP

SEQ ID NO: 142100 - protein, 9 aa, Homo Sapiens
VVKLEKTID

SEQ ID NO: 142101 - protein, 9 aa, Homo Sapiens
NTGVKPYSC

SEQ ID NO: 142102 - protein, 9 aa, Homo Sapiens
LGVPSMETH

SEQ ID NO: 142103 - protein, 9 aa, Homo Sapiens
PVPEPPTPP

SEQ ID NO: 142104 - protein, 9 aa, Homo Sapiens
EEVIRFLTV

SEQ ID NO: 142105 - protein, 9 aa, Homo Sapiens
PIIVNIDTL

SEQ ID NO: 142106 - protein, 9 aa, Homo Sapiens
VRTRSTSQE

SEQ ID NO: 142107 - protein, 9 aa, Homo Sapiens
RGCHKSIIS

SEQ ID NO: 142108 - protein, 9 aa, Homo Sapiens
ENYRNLFSM

SEQ ID NO: 142109 - protein, 9 aa, Homo Sapiens
TGPLLCLGP

SEQ ID NO: 142110 - protein, 9 aa, Homo Sapiens
SPVNQGIRG

SEQ ID NO: 142111 - protein, 9 aa, Homo Sapiens
RRRGGPGTT

SEQ ID NO: 142112 - protein, 9 aa, Homo Sapiens
RATLCMCTR

SEQ ID NO: 142113 - protein, 9 aa, Homo Sapiens
TKDVEEAVR

SEQ ID NO: 142114 - protein, 9 aa, Homo Sapiens
GMGPHVPRQ

SEQ ID NO: 142115 - protein, 9 aa, Homo Sapiens
PDVDDSALN

SEQ ID NO: 142116 - protein, 9 aa, Homo Sapiens
HVLHPRLQP

SEQ ID NO: 142117 - protein, 9 aa, Homo Sapiens
TPPAPHRRA

SEQ ID NO: 142118 - protein, 9 aa, Homo Sapiens
RMCMGSWRS

SEQ ID NO: 142119 - protein, 9 aa, Homo Sapiens
KDIYGHFGP

SEQ ID NO: 142120 - protein, 9 aa, Homo Sapiens
IARPTPPQD

SEQ ID NO: 142121 - protein, 9 aa, Homo Sapiens
NSSWFIFSE

SEQ ID NO: 142122 - protein, 9 aa, Homo Sapiens
FIRGPNPIK

SEQ ID NO: 142123 - protein, 9 aa, Homo Sapiens
HLEVIMDRP

SEQ ID NO: 142124 - protein, 9 aa, Homo Sapiens
PLGCIWTGQ

SEQ ID NO: 142125 - protein, 9 aa, Homo Sapiens
EEGRPPDVL

SEQ ID NO: 142126 - protein, 9 aa, Homo Sapiens
PAIQPGPRA

SEQ ID NO: 142127 - protein, 9 aa, Homo Sapiens
TRLQKMLQD

SEQ ID NO: 142128 - protein, 9 aa, Homo Sapiens
QSWNCAWEP

SEQ ID NO: 142129 - protein, 9 aa, Homo Sapiens
LKGQIIREM

SEQ ID NO: 142130 - protein, 9 aa, Homo Sapiens
PPPQILERK

SEQ ID NO: 142131 - protein, 9 aa, Homo Sapiens
RLMLKEDSV

SEQ ID NO: 142132 - protein, 9 aa, Homo Sapiens
SSLLSPVQW

SEQ ID NO: 142133 - protein, 9 aa, Homo Sapiens
SLAHSDNFP

SEQ ID NO: 142134 - protein, 9 aa, Homo Sapiens
QCKQDHQKD

SEQ ID NO: 142135 - protein, 9 aa, Homo Sapiens
HWHMVLLTR

SEQ ID NO: 142136 - protein, 9 aa, Homo Sapiens
TALMLTVSH

SEQ ID NO: 142137 - protein, 9 aa, Homo Sapiens
VDMDLTPAA

SEQ ID NO: 142138 - protein, 9 aa, Homo Sapiens
CQRQAREQT

SEQ ID NO: 142139 - protein, 9 aa, Homo Sapiens
LGDHDTGSL

SEQ ID NO: 142140 - protein, 9 aa, Homo Sapiens
EDNSYTFID

SEQ ID NO: 142141 - protein, 9 aa, Homo Sapiens
AIKSVKTPD

SEQ ID NO: 142142 - protein, 9 aa, Homo Sapiens
ASTPTAELT

SEQ ID NO: 142143 - protein, 9 aa, Homo Sapiens
ALPGTGGTS

SEQ ID NO: 142144 - protein, 9 aa, Homo Sapiens
DGAWCTTSC

SEQ ID NO: 142145 - protein, 9 aa, Homo Sapiens
LPKTLEQRI

SEQ ID NO: 142146 - protein, 9 aa, Homo Sapiens
KKRRTMRRV

SEQ ID NO: 142147 - protein, 9 aa, Homo Sapiens
AEGVVGPKV

SEQ ID NO: 142148 - protein, 9 aa, Homo Sapiens
MVPGETGLL

SEQ ID NO: 142149 - protein, 9 aa, Homo Sapiens
KATYERLFC

SEQ ID NO: 142150 - protein, 9 aa, Homo Sapiens
HLEGGITFV

SEQ ID NO: 142151 - protein, 9 aa, Homo Sapiens
QRPLEMLEE

SEQ ID NO: 142152 - protein, 9 aa, Homo Sapiens
CEVTLSRPW

SEQ ID NO: 142153 - protein, 9 aa, Homo Sapiens
WAGPWGGRW

SEQ ID NO: 142154 - protein, 9 aa, Homo Sapiens
GGACGQSCG

SEQ ID NO: 142155 - protein, 9 aa, Homo Sapiens
LIGLFSLVP

SEQ ID NO: 142156 - protein, 9 aa, Homo Sapiens
CLVHGFLLP

SEQ ID NO: 142157 - protein, 9 aa, Homo Sapiens
LPAGNRGAW

SEQ ID NO: 142158 - protein, 9 aa, Homo Sapiens
DAYNPETDT

SEQ ID NO: 142159 - protein, 9 aa, Homo Sapiens
APGTLLHTP

SEQ ID NO: 142160 - protein, 9 aa, Homo Sapiens
GGTPHVSVL

SEQ ID NO: 142161 - protein, 9 aa, Homo Sapiens
VGLEVIKKP

SEQ ID NO: 142162 - protein, 9 aa, Homo Sapiens
LQILELEHC

SEQ ID NO: 142163 - protein, 9 aa, Homo Sapiens
CGTGTSGTR

SEQ ID NO: 142164 - protein, 9 aa, Homo Sapiens
PRDLDWEPA

SEQ ID NO: 142165 - protein, 9 aa, Homo Sapiens
AYPSEKSNK

SEQ ID NO: 142166 - protein, 9 aa, Homo Sapiens
AAKMLLRMH

SEQ ID NO: 142167 - protein, 9 aa, Homo Sapiens
REKFVFRMA

SEQ ID NO: 142168 - protein, 9 aa, Homo Sapiens
GMINMFHKY

SEQ ID NO: 142169 - protein, 9 aa, Homo Sapiens
PERKTATVR

SEQ ID NO: 142170 - protein, 9 aa, Homo Sapiens
GRGHLVGVK

SEQ ID NO: 142171 - protein, 9 aa, Homo Sapiens
LIIESSSDE

SEQ ID NO: 142172 - protein, 9 aa, Homo Sapiens
PLPPPAARP

SEQ ID NO: 142173 - protein, 9 aa, Homo Sapiens
SLMTKNPTM

SEQ ID NO: 142174 - protein, 9 aa, Homo Sapiens
QEVPLHRGW

SEQ ID NO: 142175 - protein, 9 aa, Homo Sapiens
KRNTNTPGS

SEQ ID NO: 142176 - protein, 9 aa, Homo Sapiens
VATMIAIVW

SEQ ID NO: 142177 - protein, 9 aa, Homo Sapiens
SPELAQRGR

SEQ ID NO: 142178 - protein, 9 aa, Homo Sapiens
RFPVMSDAY

SEQ ID NO: 142179 - protein, 9 aa, Homo Sapiens
LLRLLGFIH

SEQ ID NO: 142180 - protein, 9 aa, Homo Sapiens
FSRRVLSDC

SEQ ID NO: 142181 - protein, 9 aa, Homo Sapiens
DLLAVPQVN

SEQ ID NO: 142182 - protein, 9 aa, Homo Sapiens
WQPLHPGIT

SEQ ID NO: 142183 - protein, 9 aa, Homo Sapiens
DIYELIKRE

SEQ ID NO: 142184 - protein, 9 aa, Homo Sapiens
KDKGNVLQP

SEQ ID NO: 142185 - protein, 9 aa, Homo Sapiens
FGDYHVTFY

SEQ ID NO: 142186 - protein, 9 aa, Homo Sapiens
FLFPDVFIC

SEQ ID NO: 142187 - protein, 9 aa, Homo Sapiens
KHRLESGVC

SEQ ID NO: 142188 - protein, 9 aa, Homo Sapiens
IGPRAVHDD

SEQ ID NO: 142189 - protein, 9 aa, Homo Sapiens
DRLIHVLNM

SEQ ID NO: 142190 - protein, 9 aa, Homo Sapiens
KHLVFLGLK

SEQ ID NO: 142191 - protein, 9 aa, Homo Sapiens
VKAKKSTDK

SEQ ID NO: 142192 - protein, 9 aa, Homo Sapiens
LQRSDGQVS

SEQ ID NO: 142193 - protein, 9 aa, Homo Sapiens
TAQLPPQTL

SEQ ID NO: 142194 - protein, 9 aa, Homo Sapiens
VTSSLGIRA

SEQ ID NO: 142195 - protein, 9 aa, Homo Sapiens
IAFTKQVLK

SEQ ID NO: 142196 - protein, 9 aa, Homo Sapiens
PPAVSSRRL

SEQ ID NO: 142197 - protein, 9 aa, Homo Sapiens
VGPQWECEL

SEQ ID NO: 142198 - protein, 9 aa, Homo Sapiens
CAVCGYNAA

SEQ ID NO: 142199 - protein, 9 aa, Homo Sapiens
NKLEVEQQN

SEQ ID NO: 142200 - protein, 9 aa, Homo Sapiens
VREVFPGDS

SEQ ID NO: 142201 - protein, 9 aa, Homo Sapiens
TRAAARPTP

SEQ ID NO: 142202 - protein, 9 aa, Homo Sapiens
TFMCSDPFV

SEQ ID NO: 142203 - protein, 9 aa, Homo Sapiens
CTWPLLRPE

SEQ ID NO: 142204 - protein, 9 aa, Homo Sapiens
CLQFLVLCP

SEQ ID NO: 142205 - protein, 9 aa, Homo Sapiens
KNQAYVMML

SEQ ID NO: 142206 - protein, 9 aa, Homo Sapiens
MLVCPQGQP

SEQ ID NO: 142207 - protein, 9 aa, Homo Sapiens
KDQTMSECE

SEQ ID NO: 142208 - protein, 9 aa, Homo Sapiens
CPSLTGSSP

SEQ ID NO: 142209 - protein, 9 aa, Homo Sapiens
RGSRLPPHH

SEQ ID NO: 142210 - protein, 9 aa, Homo Sapiens
FPVAGPPCP

SEQ ID NO: 142211 - protein, 9 aa, Homo Sapiens
KANPKHLEE

SEQ ID NO: 142212 - protein, 9 aa, Homo Sapiens
RGKWARSSQ

SEQ ID NO: 142213 - protein, 9 aa, Homo Sapiens
RNPNGDDDQ

SEQ ID NO: 142214 - protein, 9 aa, Homo Sapiens
VSGQCVLIK

SEQ ID NO: 142215 - protein, 9 aa, Homo Sapiens
DPYVETPMS

SEQ ID NO: 142216 - protein, 9 aa, Homo Sapiens
HFHEEATLC

SEQ ID NO: 142217 - protein, 9 aa, Homo Sapiens
TRDSFQMNN

SEQ ID NO: 142218 - protein, 9 aa, Homo Sapiens
TALPSQLVP

SEQ ID NO: 142219 - protein, 9 aa, Homo Sapiens
QVVNAKKKC

SEQ ID NO: 142220 - protein, 9 aa, Homo Sapiens
RRARRAPRA

SEQ ID NO: 142221 - protein, 9 aa, Homo Sapiens
VARPSTTRR

SEQ ID NO: 142222 - protein, 9 aa, Homo Sapiens
AQTTCIAAG

SEQ ID NO: 142223 - protein, 9 aa, Homo Sapiens
DEVHLDEQC

SEQ ID NO: 142224 - protein, 9 aa, Homo Sapiens
PLSGPSSPQ

SEQ ID NO: 142225 - protein, 9 aa, Homo Sapiens
QVHDDRSIQ

SEQ ID NO: 142226 - protein, 9 aa, Homo Sapiens
TFSKSPSTS

SEQ ID NO: 142227 - protein, 9 aa, Homo Sapiens
RAQKTRSLV

SEQ ID NO: 142228 - protein, 9 aa, Homo Sapiens
PQPSSGREM

SEQ ID NO: 142229 - protein, 9 aa, Homo Sapiens
CEYCDSVYR

SEQ ID NO: 142230 - protein, 9 aa, Homo Sapiens
RRVAGLLAD

SEQ ID NO: 142231 - protein, 9 aa, Homo Sapiens
KSEGSKMAH

SEQ ID NO: 142232 - protein, 9 aa, Homo Sapiens
LGPQDLSMK

SEQ ID NO: 142233 - protein, 9 aa, Homo Sapiens
VVPLRQDVK

SEQ ID NO: 142234 - protein, 9 aa, Homo Sapiens
RGLCKSRQP

SEQ ID NO: 142235 - protein, 9 aa, Homo Sapiens
NKGYTLASD

SEQ ID NO: 142236 - protein, 9 aa, Homo Sapiens
RSRDVASRC

SEQ ID NO: 142237 - protein, 9 aa, Homo Sapiens
AAGLPMAVI

SEQ ID NO: 142238 - protein, 9 aa, Homo Sapiens
YAQLSLHIL

SEQ ID NO: 142239 - protein, 9 aa, Homo Sapiens
VFFLLLLLL

SEQ ID NO: 142240 - protein, 9 aa, Homo Sapiens
PLLKFSKAI

SEQ ID NO: 142241 - protein, 9 aa, Homo Sapiens
QTDLTGQKR

SEQ ID NO: 142242 - protein, 9 aa, Homo Sapiens
SIHLEVIMD

SEQ ID NO: 142243 - protein, 9 aa, Homo Sapiens
MPKKLISHL

SEQ ID NO: 142244 - protein, 9 aa, Homo Sapiens
LSSGAPPAD

SEQ ID NO: 142245 - protein, 9 aa, Homo Sapiens
NMLSPDHHP

SEQ ID NO: 142246 - protein, 9 aa, Homo Sapiens
LPVGGDLDV

SEQ ID NO: 142247 - protein, 9 aa, Homo Sapiens
EKLFGASSS

SEQ ID NO: 142248 - protein, 9 aa, Homo Sapiens
ACGAASPPA

SEQ ID NO: 142249 - protein, 9 aa, Homo Sapiens
EASQVGGTQ

SEQ ID NO: 142250 - protein, 9 aa, Homo Sapiens
KRSRLEKVH

SEQ ID NO: 142251 - protein, 9 aa, Homo Sapiens
LFPTSYILA

SEQ ID NO: 142252 - protein, 9 aa, Homo Sapiens
PGQPMAAFA

SEQ ID NO: 142253 - protein, 9 aa, Homo Sapiens
EAIPHVPVW

SEQ ID NO: 142254 - protein, 9 aa, Homo Sapiens
ASRRRACVV

SEQ ID NO: 142255 - protein, 9 aa, Homo Sapiens
FLLLPPFTY

SEQ ID NO: 142256 - protein, 9 aa, Homo Sapiens
RTICGSLPL

SEQ ID NO: 142257 - protein, 9 aa, Homo Sapiens
GSLPLMTLT

SEQ ID NO: 142258 - protein, 9 aa, Homo Sapiens
PAKGKIKVV

SEQ ID NO: 142259 - protein, 9 aa, Homo Sapiens
GGGSVPART

SEQ ID NO: 142260 - protein, 9 aa, Homo Sapiens
MVADHEVKL

SEQ ID NO: 142261 - protein, 9 aa, Homo Sapiens
CPMTACSIL

SEQ ID NO: 142262 - protein, 9 aa, Homo Sapiens
CEEFLKTAM

SEQ ID NO: 142263 - protein, 9 aa, Homo Sapiens
RRLISAKSR

SEQ ID NO: 142264 - protein, 9 aa, Homo Sapiens
AYRERYVAS

SEQ ID NO: 142265 - protein, 9 aa, Homo Sapiens
YILAVQNVD

SEQ ID NO: 142266 - protein, 9 aa, Homo Sapiens
LASEFLPQG

SEQ ID NO: 142267 - protein, 9 aa, Homo Sapiens
VTNQHRRTT

SEQ ID NO: 142268 - protein, 9 aa, Homo Sapiens
FHLHLARSH

SEQ ID NO: 142269 - protein, 9 aa, Homo Sapiens
KRRLISAKS

SEQ ID NO: 142270 - protein, 9 aa, Homo Sapiens
TTKESHPTS

SEQ ID NO: 142271 - protein, 9 aa, Homo Sapiens
PPAPEDEDG

SEQ ID NO: 142272 - protein, 9 aa, Homo Sapiens
QEFENKLEV

SEQ ID NO: 142273 - protein, 9 aa, Homo Sapiens
QCQAPSVFS

SEQ ID NO: 142274 - protein, 9 aa, Homo Sapiens
YTGTHRHTH

SEQ ID NO: 142275 - protein, 9 aa, Homo Sapiens
CWGWHGSLY

SEQ ID NO: 142276 - protein, 9 aa, Homo Sapiens
KRRTAGHVA

SEQ ID NO: 142277 - protein, 9 aa, Homo Sapiens
ACCPVCTRP

SEQ ID NO: 142278 - protein, 9 aa, Homo Sapiens
PLHRTTNPH

SEQ ID NO: 142279 - protein, 9 aa, Homo Sapiens
KALRCIQTL

SEQ ID NO: 142280 - protein, 9 aa, Homo Sapiens
KDYQWEDKK

SEQ ID NO: 142281 - protein, 9 aa, Homo Sapiens
FWVASKTHR

SEQ ID NO: 142282 - protein, 9 aa, Homo Sapiens
DGEVEEEIK

SEQ ID NO: 142283 - protein, 9 aa, Homo Sapiens
VIMILVMVV

SEQ ID NO: 142284 - protein, 9 aa, Homo Sapiens
PAKGRCIPP

SEQ ID NO: 142285 - protein, 9 aa, Homo Sapiens
TVLPHGHGK

SEQ ID NO: 142286 - protein, 9 aa, Homo Sapiens
PSQLVPAGR

SEQ ID NO: 142287 - protein, 9 aa, Homo Sapiens
NSEMDHVTP

SEQ ID NO: 142288 - protein, 9 aa, Homo Sapiens
GVVPGPPLP

SEQ ID NO: 142289 - protein, 9 aa, Homo Sapiens
LGGGVCERP

SEQ ID NO: 142290 - protein, 9 aa, Homo Sapiens
KKEWNEDCN

SEQ ID NO: 142291 - protein, 9 aa, Homo Sapiens
LKDQSRRKM

SEQ ID NO: 142292 - protein, 9 aa, Homo Sapiens
ASGSCAWMR

SEQ ID NO: 142293 - protein, 9 aa, Homo Sapiens
QALLHLGIH

SEQ ID NO: 142294 - protein, 9 aa, Homo Sapiens
NQTQIPDYA

SEQ ID NO: 142295 - protein, 9 aa, Homo Sapiens
LGRAVGTAL

SEQ ID NO: 142296 - protein, 9 aa, Homo Sapiens
NVLGFSVAL

SEQ ID NO: 142297 - protein, 9 aa, Homo Sapiens
AEGLRCVKP

SEQ ID NO: 142298 - protein, 9 aa, Homo Sapiens
GKSQGGRIL

SEQ ID NO: 142299 - protein, 9 aa, Homo Sapiens
LGAHCSPLP

SEQ ID NO: 142300 - protein, 9 aa, Homo Sapiens
LLAVVWAQW

SEQ ID NO: 142301 - protein, 9 aa, Homo Sapiens
MCRMEMISD

SEQ ID NO: 142302 - protein, 9 aa, Homo Sapiens
FPSPELWVT

SEQ ID NO: 142303 - protein, 9 aa, Homo Sapiens
QERLALHGF

SEQ ID NO: 142304 - protein, 9 aa, Homo Sapiens
CTFFFLHKE

SEQ ID NO: 142305 - protein, 9 aa, Homo Sapiens
VEAVAIHRG

SEQ ID NO: 142306 - protein, 9 aa, Homo Sapiens
RCVRRRRRH

SEQ ID NO: 142307 - protein, 9 aa, Homo Sapiens
QRVLINLYC

SEQ ID NO: 142308 - protein, 9 aa, Homo Sapiens
FARPGRGGA

SEQ ID NO: 142309 - protein, 9 aa, Homo Sapiens
QVIPVLPSQ

SEQ ID NO: 142310 - protein, 9 aa, Homo Sapiens
DYEEMASQL

SEQ ID NO: 142311 - protein, 9 aa, Homo Sapiens
VRTLHRKLT

SEQ ID NO: 142312 - protein, 9 aa, Homo Sapiens
TRASGPTPV

SEQ ID NO: 142313 - protein, 9 aa, Homo Sapiens
GSCARSISG

SEQ ID NO: 142314 - protein, 9 aa, Homo Sapiens
GIHTDTHTG

SEQ ID NO: 142315 - protein, 9 aa, Homo Sapiens
VFRMAGKGL

SEQ ID NO: 142316 - protein, 9 aa, Homo Sapiens
LKVINKLGP

SEQ ID NO: 142317 - protein, 9 aa, Homo Sapiens
WHGLANSIS

SEQ ID NO: 142318 - protein, 9 aa, Homo Sapiens
YTTGAETTT

SEQ ID NO: 142319 - protein, 9 aa, Homo Sapiens
QKKRNTNTP

SEQ ID NO: 142320 - protein, 9 aa, Homo Sapiens
LHGPPGPKG

SEQ ID NO: 142321 - protein, 9 aa, Homo Sapiens
DASHISYVP

SEQ ID NO: 142322 - protein, 9 aa, Homo Sapiens
SPPSKNPPQ

SEQ ID NO: 142323 - protein, 9 aa, Homo Sapiens
PSVARPSTT

SEQ ID NO: 142324 - protein, 9 aa, Homo Sapiens
TECFLYIVM

SEQ ID NO: 142325 - protein, 9 aa, Homo Sapiens
QRNVKHMHQ

SEQ ID NO: 142326 - protein, 9 aa, Homo Sapiens
ATSLCLKTP

SEQ ID NO: 142327 - protein, 9 aa, Homo Sapiens
QLLVLTQLP

SEQ ID NO: 142328 - protein, 9 aa, Homo Sapiens
GLYGEGGAG

SEQ ID NO: 142329 - protein, 9 aa, Homo Sapiens
LTLPFHQTI

SEQ ID NO: 142330 - protein, 9 aa, Homo Sapiens
LSRRLCGII

SEQ ID NO: 142331 - protein, 9 aa, Homo Sapiens
LVTADIQLP

SEQ ID NO: 142332 - protein, 9 aa, Homo Sapiens
APRTPTPVP

SEQ ID NO: 142333 - protein, 9 aa, Homo Sapiens
LSPRAPVHN

SEQ ID NO: 142334 - protein, 9 aa, Homo Sapiens
QGELEPLKC

SEQ ID NO: 142335 - protein, 9 aa, Homo Sapiens
MEVAMAEAL

SEQ ID NO: 142336 - protein, 9 aa, Homo Sapiens
HNLPCPFST

SEQ ID NO: 142337 - protein, 9 aa, Homo Sapiens
LPPAGRHVA

SEQ ID NO: 142338 - protein, 9 aa, Homo Sapiens
YSSQTVQQK

SEQ ID NO: 142339 - protein, 9 aa, Homo Sapiens
LWLCRIGRA

SEQ ID NO: 142340 - protein, 9 aa, Homo Sapiens
RDRWKGLEP

SEQ ID NO: 142341 - protein, 9 aa, Homo Sapiens
VIVESGILL

SEQ ID NO: 142342 - protein, 9 aa, Homo Sapiens
SFWKTLIDL

SEQ ID NO: 142343 - protein, 9 aa, Homo Sapiens
VPHVTTAQW

SEQ ID NO: 142344 - protein, 9 aa, Homo Sapiens
DKLGPNSEM

SEQ ID NO: 142345 - protein, 9 aa, Homo Sapiens
IKTSKQNRR

SEQ ID NO: 142346 - protein, 9 aa, Homo Sapiens
PTPQNPPNH

SEQ ID NO: 142347 - protein, 9 aa, Homo Sapiens
PREVPAAAA

SEQ ID NO: 142348 - protein, 9 aa, Homo Sapiens
ILGPQDLSM

SEQ ID NO: 142349 - protein, 9 aa, Homo Sapiens
PVVQHFWSI

SEQ ID NO: 142350 - protein, 9 aa, Homo Sapiens
SSVTLVFPS

SEQ ID NO: 142351 - protein, 9 aa, Homo Sapiens
FIMYMTMRN

SEQ ID NO: 142352 - protein, 9 aa, Homo Sapiens
GGAGSCEVT

SEQ ID NO: 142353 - protein, 9 aa, Homo Sapiens
CLPSPRSRW

SEQ ID NO: 142354 - protein, 9 aa, Homo Sapiens
WGPPRAREK

SEQ ID NO: 142355 - protein, 9 aa, Homo Sapiens
TVCFNVLKV

SEQ ID NO: 142356 - protein, 9 aa, Homo Sapiens
GAHVWLLPG

SEQ ID NO: 142357 - protein, 9 aa, Homo Sapiens
GHTLPMPRL

SEQ ID NO: 142358 - protein, 9 aa, Homo Sapiens
PRPPCSSTS

SEQ ID NO: 142359 - protein, 9 aa, Homo Sapiens
HDDRSIQQI

SEQ ID NO: 142360 - protein, 9 aa, Homo Sapiens
SEFLPQGPV

SEQ ID NO: 142361 - protein, 9 aa, Homo Sapiens
HRLEGWPSW

SEQ ID NO: 142362 - protein, 9 aa, Homo Sapiens
LCCGCPHPP

SEQ ID NO: 142363 - protein, 9 aa, Homo Sapiens
RNLMWDFCL

SEQ ID NO: 142364 - protein, 9 aa, Homo Sapiens
REFGKKQST

SEQ ID NO: 142365 - protein, 9 aa, Homo Sapiens
EFTPQSPPQ

SEQ ID NO: 142366 - protein, 9 aa, Homo Sapiens
QCRICMHNF

SEQ ID NO: 142367 - protein, 9 aa, Homo Sapiens
KPKGSLMAL

SEQ ID NO: 142368 - protein, 9 aa, Homo Sapiens
AHRSPSAPD

SEQ ID NO: 142369 - protein, 9 aa, Homo Sapiens
VPVHLRDLS

SEQ ID NO: 142370 - protein, 9 aa, Homo Sapiens
LSGDHRRSW

SEQ ID NO: 142371 - protein, 9 aa, Homo Sapiens
STSRSTCAR

SEQ ID NO: 142372 - protein, 9 aa, Homo Sapiens
YLGRWGRGG

SEQ ID NO: 142373 - protein, 9 aa, Homo Sapiens
APKKTLLKC

SEQ ID NO: 142374 - protein, 9 aa, Homo Sapiens
AASKEKCVY

SEQ ID NO: 142375 - protein, 9 aa, Homo Sapiens
RTTRSWRTW

SEQ ID NO: 142376 - protein, 9 aa, Homo Sapiens
PRPWPPPSV

SEQ ID NO: 142377 - protein, 9 aa, Homo Sapiens
CMAEKCYRV

SEQ ID NO: 142378 - protein, 9 aa, Homo Sapiens
RKALDLASE

SEQ ID NO: 142379 - protein, 9 aa, Homo Sapiens
FVPHWTPPS

SEQ ID NO: 142380 - protein, 9 aa, Homo Sapiens
GERLRHHFY

SEQ ID NO: 142381 - protein, 9 aa, Homo Sapiens
QQVTENCGH

SEQ ID NO: 142382 - protein, 9 aa, Homo Sapiens
PSSTPCTVL

SEQ ID NO: 142383 - protein, 9 aa, Homo Sapiens
PGLAVHQDV

SEQ ID NO: 142384 - protein, 9 aa, Homo Sapiens
PSEGQLFQS

SEQ ID NO: 142385 - protein, 9 aa, Homo Sapiens
KPDPIPDSF

SEQ ID NO: 142386 - protein, 9 aa, Homo Sapiens
TERSMPHLQ

SEQ ID NO: 142387 - protein, 9 aa, Homo Sapiens
LNVWAIGGL

SEQ ID NO: 142388 - protein, 9 aa, Homo Sapiens
LRSHHTPEL

SEQ ID NO: 142389 - protein, 9 aa, Homo Sapiens
RQTRFSSVT

SEQ ID NO: 142390 - protein, 9 aa, Homo Sapiens
YLSFLKGQI

SEQ ID NO: 142391 - protein, 9 aa, Homo Sapiens
QWGPNLSPL

SEQ ID NO: 142392 - protein, 9 aa, Homo Sapiens
SLFWSVQGN

SEQ ID NO: 142393 - protein, 9 aa, Homo Sapiens
VGQVLGPLS

SEQ ID NO: 142394 - protein, 9 aa, Homo Sapiens
GHEGIIPAN

SEQ ID NO: 142395 - protein, 9 aa, Homo Sapiens
SDPPTTIIW

SEQ ID NO: 142396 - protein, 9 aa, Homo Sapiens
CRPPLQLQR

SEQ ID NO: 142397 - protein, 9 aa, Homo Sapiens
MEKNYNLEQ

SEQ ID NO: 142398 - protein, 9 aa, Homo Sapiens
MKEGCSFLT

SEQ ID NO: 142399 - protein, 9 aa, Homo Sapiens
MEKRLCKMF

SEQ ID NO: 142400 - protein, 9 aa, Homo Sapiens
KSAFIRVAS

SEQ ID NO: 142401 - protein, 9 aa, Homo Sapiens
TFFDEIQQW

SEQ ID NO: 142402 - protein, 9 aa, Homo Sapiens
PLPLGCIWT

SEQ ID NO: 142403 - protein, 9 aa, Homo Sapiens
KFIGGLRRS

SEQ ID NO: 142404 - protein, 9 aa, Homo Sapiens
CGPSPGPGH

SEQ ID NO: 142405 - protein, 9 aa, Homo Sapiens
PWGDCYHEW

SEQ ID NO: 142406 - protein, 9 aa, Homo Sapiens
FENKLEVEQ

SEQ ID NO: 142407 - protein, 9 aa, Homo Sapiens
PFLRPCHLL

SEQ ID NO: 142408 - protein, 9 aa, Homo Sapiens
WGQWHLGAA

SEQ ID NO: 142409 - protein, 9 aa, Homo Sapiens
SGAFGMVYK

SEQ ID NO: 142410 - protein, 9 aa, Homo Sapiens
PGSPRLCAT

SEQ ID NO: 142411 - protein, 9 aa, Homo Sapiens
RGPLEGGLN

SEQ ID NO: 142412 - protein, 9 aa, Homo Sapiens
YTGGWHHHD

SEQ ID NO: 142413 - protein, 9 aa, Homo Sapiens
SILWTCVLT

SEQ ID NO: 142414 - protein, 9 aa, Homo Sapiens
EEADALLAH

SEQ ID NO: 142415 - protein, 9 aa, Homo Sapiens
GRTRANGDP

SEQ ID NO: 142416 - protein, 9 aa, Homo Sapiens
LKLGVPSME

SEQ ID NO: 142417 - protein, 9 aa, Homo Sapiens
WNNTCNILC

SEQ ID NO: 142418 - protein, 9 aa, Homo Sapiens
KEHRRVNDA

SEQ ID NO: 142419 - protein, 9 aa, Homo Sapiens
QPAPAGAWS

SEQ ID NO: 142420 - protein, 9 aa, Homo Sapiens
QEWRWQLGT

SEQ ID NO: 142421 - protein, 9 aa, Homo Sapiens
CPRCRPRGP

SEQ ID NO: 142422 - protein, 9 aa, Homo Sapiens
IAHITPSAP

SEQ ID NO: 142423 - protein, 9 aa, Homo Sapiens
GGDVREPRK

SEQ ID NO: 142424 - protein, 9 aa, Homo Sapiens
RHSLGFCDT

SEQ ID NO: 142425 - protein, 9 aa, Homo Sapiens
KWVHSLPVK

SEQ ID NO: 142426 - protein, 9 aa, Homo Sapiens
SFKTKDTHM

SEQ ID NO: 142427 - protein, 9 aa, Homo Sapiens
PILFGSLRR

SEQ ID NO: 142428 - protein, 9 aa, Homo Sapiens
IIQERRRTL

SEQ ID NO: 142429 - protein, 9 aa, Homo Sapiens
LLVLGEVAR

SEQ ID NO: 142430 - protein, 9 aa, Homo Sapiens
LWLGTLCPG

SEQ ID NO: 142431 - protein, 9 aa, Homo Sapiens
CKRGRRTPP

SEQ ID NO: 142432 - protein, 9 aa, Homo Sapiens
RLAQHRNIN

SEQ ID NO: 142433 - protein, 9 aa, Homo Sapiens
SAMAYPAVF

SEQ ID NO: 142434 - protein, 9 aa, Homo Sapiens
GAHQGPGHG

SEQ ID NO: 142435 - protein, 9 aa, Homo Sapiens
SCWRPSQSA

SEQ ID NO: 142436 - protein, 9 aa, Homo Sapiens
MAPETTLWL

SEQ ID NO: 142437 - protein, 9 aa, Homo Sapiens
LPLPCSPPL

SEQ ID NO: 142438 - protein, 9 aa, Homo Sapiens
KTNENKQSL

SEQ ID NO: 142439 - protein, 9 aa, Homo Sapiens
PRGVVHRRA

SEQ ID NO: 142440 - protein, 9 aa, Homo Sapiens
FKLHNRNAP

SEQ ID NO: 142441 - protein, 9 aa, Homo Sapiens
RQEGPMQAA

SEQ ID NO: 142442 - protein, 9 aa, Homo Sapiens
DQVHDDRSI

SEQ ID NO: 142443 - protein, 9 aa, Homo Sapiens
TVFKFIGGL

SEQ ID NO: 142444 - protein, 9 aa, Homo Sapiens
ALNLSLEPA

SEQ ID NO: 142445 - protein, 9 aa, Homo Sapiens
DNSVVCFLP

SEQ ID NO: 142446 - protein, 9 aa, Homo Sapiens
LPLLSCHIP

SEQ ID NO: 142447 - protein, 9 aa, Homo Sapiens
RVGTSDRGS

SEQ ID NO: 142448 - protein, 9 aa, Homo Sapiens
QWECELELV

SEQ ID NO: 142449 - protein, 9 aa, Homo Sapiens
NTCNILCGL

SEQ ID NO: 142450 - protein, 9 aa, Homo Sapiens
KFSLTLSCL

SEQ ID NO: 142451 - protein, 9 aa, Homo Sapiens
SSLWSTPAP

SEQ ID NO: 142452 - protein, 9 aa, Homo Sapiens
WRVPTPPSS

SEQ ID NO: 142453 - protein, 9 aa, Homo Sapiens
SVALSTNIM

SEQ ID NO: 142454 - protein, 9 aa, Homo Sapiens
GGNGWRNSR

SEQ ID NO: 142455 - protein, 9 aa, Homo Sapiens
SSRMVSFWL

SEQ ID NO: 142456 - protein, 9 aa, Homo Sapiens
TASYGMSLN

SEQ ID NO: 142457 - protein, 9 aa, Homo Sapiens
HNPFNIHPQ

SEQ ID NO: 142458 - protein, 9 aa, Homo Sapiens
IMEIQCPAL

SEQ ID NO: 142459 - protein, 9 aa, Homo Sapiens
GVPAPAYRS

SEQ ID NO: 142460 - protein, 9 aa, Homo Sapiens
SRVPSPRSW

SEQ ID NO: 142461 - protein, 9 aa, Homo Sapiens
EHKKFILER

SEQ ID NO: 142462 - protein, 9 aa, Homo Sapiens
GLGLEQFLT

SEQ ID NO: 142463 - protein, 9 aa, Homo Sapiens
PTVFTFQDP

SEQ ID NO: 142464 - protein, 9 aa, Homo Sapiens
QRLERAVSD

SEQ ID NO: 142465 - protein, 9 aa, Homo Sapiens
SRPLPPPPA

SEQ ID NO: 142466 - protein, 9 aa, Homo Sapiens
AKSQIVMNV

SEQ ID NO: 142467 - protein, 9 aa, Homo Sapiens
NNWRWTERD

SEQ ID NO: 142468 - protein, 9 aa, Homo Sapiens
GVSRRPLSL

SEQ ID NO: 142469 - protein, 9 aa, Homo Sapiens
DALLDTECS

SEQ ID NO: 142470 - protein, 9 aa, Homo Sapiens
SSCLQTSNN

SEQ ID NO: 142471 - protein, 9 aa, Homo Sapiens
LERHSTPPG

SEQ ID NO: 142472 - protein, 9 aa, Homo Sapiens
PGGRSPTTT

SEQ ID NO: 142473 - protein, 9 aa, Homo Sapiens
PQQPPPRLP

SEQ ID NO: 142474 - protein, 9 aa, Homo Sapiens
KQKREELCL

SEQ ID NO: 142475 - protein, 9 aa, Homo Sapiens
GRCRGTASA

SEQ ID NO: 142476 - protein, 9 aa, Homo Sapiens
ASMAVVIPD

SEQ ID NO: 142477 - protein, 9 aa, Homo Sapiens
HRLESGVCF

SEQ ID NO: 142478 - protein, 9 aa, Homo Sapiens
QRTAALLTD

SEQ ID NO: 142479 - protein, 9 aa, Homo Sapiens
RTAGHVATM

SEQ ID NO: 142480 - protein, 9 aa, Homo Sapiens
FSGHTHTVA

SEQ ID NO: 142481 - protein, 9 aa, Homo Sapiens
TQKAPCGRQ

SEQ ID NO: 142482 - protein, 9 aa, Homo Sapiens
ASSQRWPPP

SEQ ID NO: 142483 - protein, 9 aa, Homo Sapiens
REFRNALKS

SEQ ID NO: 142484 - protein, 9 aa, Homo Sapiens
EECLIRQQQ

SEQ ID NO: 142485 - protein, 9 aa, Homo Sapiens
FSSSRQHCF

SEQ ID NO: 142486 - protein, 9 aa, Homo Sapiens
TGSLTSTSH

SEQ ID NO: 142487 - protein, 9 aa, Homo Sapiens
TQAADWLLQ

SEQ ID NO: 142488 - protein, 9 aa, Homo Sapiens
LSKNLNSRD

SEQ ID NO: 142489 - protein, 9 aa, Homo Sapiens
ELLLLLLQP

SEQ ID NO: 142490 - protein, 9 aa, Homo Sapiens
AQKTRSLVG

SEQ ID NO: 142491 - protein, 9 aa, Homo Sapiens
RTEKKCYLH

SEQ ID NO: 142492 - protein, 9 aa, Homo Sapiens
PPSLHPSQQ

SEQ ID NO: 142493 - protein, 9 aa, Homo Sapiens
WQLLQGLRH

SEQ ID NO: 142494 - protein, 9 aa, Homo Sapiens
AFLGDLLAV

SEQ ID NO: 142495 - protein, 9 aa, Homo Sapiens
MAHPSLLLT

SEQ ID NO: 142496 - protein, 9 aa, Homo Sapiens
DALQEVPEE

SEQ ID NO: 142497 - protein, 9 aa, Homo Sapiens
LSLPWIPKR

SEQ ID NO: 142498 - protein, 9 aa, Homo Sapiens
WSGFSARQR

SEQ ID NO: 142499 - protein, 9 aa, Homo Sapiens
RPSKLDFFR

SEQ ID NO: 142500 - protein, 9 aa, Homo Sapiens
GGGGGSGSA

SEQ ID NO: 142501 - protein, 9 aa, Homo Sapiens
QGPPAPSRP

SEQ ID NO: 142502 - protein, 9 aa, Homo Sapiens
EAEQRPEVL

SEQ ID NO: 142503 - protein, 9 aa, Homo Sapiens
YMTMRNATQ

SEQ ID NO: 142504 - protein, 9 aa, Homo Sapiens
RLYCSRFSR

SEQ ID NO: 142505 - protein, 9 aa, Homo Sapiens
SRWRHPLPP

SEQ ID NO: 142506 - protein, 9 aa, Homo Sapiens
AYGGAYFHT

SEQ ID NO: 142507 - protein, 9 aa, Homo Sapiens
VSSRMVSFW

SEQ ID NO: 142508 - protein, 9 aa, Homo Sapiens
APEVGSPSY

SEQ ID NO: 142509 - protein, 9 aa, Homo Sapiens
STAFEEGQA

SEQ ID NO: 142510 - protein, 9 aa, Homo Sapiens
NTRPGSEQP

SEQ ID NO: 142511 - protein, 9 aa, Homo Sapiens
LFSMGMTVS

SEQ ID NO: 142512 - protein, 9 aa, Homo Sapiens
DRGRVRGRD

SEQ ID NO: 142513 - protein, 9 aa, Homo Sapiens
GGPPWGVGQ

SEQ ID NO: 142514 - protein, 9 aa, Homo Sapiens
SLGQTFGVA

SEQ ID NO: 142515 - protein, 9 aa, Homo Sapiens
EELEQREAL

SEQ ID NO: 142516 - protein, 9 aa, Homo Sapiens
MPGAYFFSF

SEQ ID NO: 142517 - protein, 9 aa, Homo Sapiens
VVERRRWPR

SEQ ID NO: 142518 - protein, 9 aa, Homo Sapiens
FQSCKNSYI

SEQ ID NO: 142519 - protein, 9 aa, Homo Sapiens
EDQRRGLPG

SEQ ID NO: 142520 - protein, 9 aa, Homo Sapiens
SERQAKTGT

SEQ ID NO: 142521 - protein, 9 aa, Homo Sapiens
FRMASSPPG

SEQ ID NO: 142522 - protein, 9 aa, Homo Sapiens
SSDARNIWY

SEQ ID NO: 142523 - protein, 9 aa, Homo Sapiens
GQPPPPPPH

SEQ ID NO: 142524 - protein, 9 aa, Homo Sapiens
TLCLAGPPA

SEQ ID NO: 142525 - protein, 9 aa, Homo Sapiens
DYTNDDLNV

SEQ ID NO: 142526 - protein, 9 aa, Homo Sapiens
AEELFVEKI

SEQ ID NO: 142527 - protein, 9 aa, Homo Sapiens
TVLACVPSP

SEQ ID NO: 142528 - protein, 9 aa, Homo Sapiens
SSSKAPPPA

SEQ ID NO: 142529 - protein, 9 aa, Homo Sapiens
AAAPWRPFS

SEQ ID NO: 142530 - protein, 9 aa, Homo Sapiens
PRTLSMDAP

SEQ ID NO: 142531 - protein, 9 aa, Homo Sapiens
RDGIESGHI

SEQ ID NO: 142532 - protein, 9 aa, Homo Sapiens
WGPNLSPLF

SEQ ID NO: 142533 - protein, 9 aa, Homo Sapiens
EKLKQGCLK

SEQ ID NO: 142534 - protein, 9 aa, Homo Sapiens
CEHTFIAIK

SEQ ID NO: 142535 - protein, 9 aa, Homo Sapiens
DVTLNMMAV

SEQ ID NO: 142536 - protein, 9 aa, Homo Sapiens
VMSDAYDRT

SEQ ID NO: 142537 - protein, 9 aa, Homo Sapiens
ATSRTPSGC

SEQ ID NO: 142538 - protein, 9 aa, Homo Sapiens
EIQCPALRK

SEQ ID NO: 142539 - protein, 9 aa, Homo Sapiens
TGSVQPVCA

SEQ ID NO: 142540 - protein, 9 aa, Homo Sapiens
APMPKKLIS

SEQ ID NO: 142541 - protein, 9 aa, Homo Sapiens
FLTLPFHQT

SEQ ID NO: 142542 - protein, 9 aa, Homo Sapiens
GTAPWPPYR

SEQ ID NO: 142543 - protein, 9 aa, Homo Sapiens
YGIPHHLHF

SEQ ID NO: 142544 - protein, 9 aa, Homo Sapiens
RLDMTSYTE

SEQ ID NO: 142545 - protein, 9 aa, Homo Sapiens
KPLVEKKRC

SEQ ID NO: 142546 - protein, 9 aa, Homo Sapiens
LPPPCPSRP

SEQ ID NO: 142547 - protein, 9 aa, Homo Sapiens
FWLLHTAGT

SEQ ID NO: 142548 - protein, 9 aa, Homo Sapiens
GGGGSPRST

SEQ ID NO: 142549 - protein, 9 aa, Homo Sapiens
SMRMCMGSW

SEQ ID NO: 142550 - protein, 9 aa, Homo Sapiens
CGLDKSCLD

SEQ ID NO: 142551 - protein, 9 aa, Homo Sapiens
TLDPDTLCK

SEQ ID NO: 142552 - protein, 9 aa, Homo Sapiens
GFKYFESLD

SEQ ID NO: 142553 - protein, 9 aa, Homo Sapiens
QWPTLCLGM

SEQ ID NO: 142554 - protein, 9 aa, Homo Sapiens
CLCLEEPRK

SEQ ID NO: 142555 - protein, 9 aa, Homo Sapiens
YYNANWERE

SEQ ID NO: 142556 - protein, 9 aa, Homo Sapiens
IHIVGPQWE

SEQ ID NO: 142557 - protein, 9 aa, Homo Sapiens
DRVRKFFRL

SEQ ID NO: 142558 - protein, 9 aa, Homo Sapiens
STHTTVFPA

SEQ ID NO: 142559 - protein, 9 aa, Homo Sapiens
ALREAEQEL

SEQ ID NO: 142560 - protein, 9 aa, Homo Sapiens
NAEELFVEK

SEQ ID NO: 142561 - protein, 9 aa, Homo Sapiens
AAVDPPWSS

SEQ ID NO: 142562 - protein, 9 aa, Homo Sapiens
TSNIKKGKK

SEQ ID NO: 142563 - protein, 9 aa, Homo Sapiens
CDGDDEEMV

SEQ ID NO: 142564 - protein, 9 aa, Homo Sapiens
TFPKIKKPL

SEQ ID NO: 142565 - protein, 9 aa, Homo Sapiens
FEFRVGTSD

SEQ ID NO: 142566 - protein, 9 aa, Homo Sapiens
RPGRGGACG

SEQ ID NO: 142567 - protein, 9 aa, Homo Sapiens
SAAGVRDRS

SEQ ID NO: 142568 - protein, 9 aa, Homo Sapiens
RFGILQSVV

SEQ ID NO: 142569 - protein, 9 aa, Homo Sapiens
HPRLQPALL

SEQ ID NO: 142570 - protein, 9 aa, Homo Sapiens
QGCWGCCGS

SEQ ID NO: 142571 - protein, 9 aa, Homo Sapiens
LGPVFLLGL

SEQ ID NO: 142572 - protein, 9 aa, Homo Sapiens
ECELELVSR

SEQ ID NO: 142573 - protein, 9 aa, Homo Sapiens
GYDWNESIC

SEQ ID NO: 142574 - protein, 9 aa, Homo Sapiens
EMKKTTSQS

SEQ ID NO: 142575 - protein, 9 aa, Homo Sapiens
WHWPKMLVC

SEQ ID NO: 142576 - protein, 9 aa, Homo Sapiens
PHSHNKVLN

SEQ ID NO: 142577 - protein, 9 aa, Homo Sapiens
RPSTARVIL

SEQ ID NO: 142578 - protein, 9 aa, Homo Sapiens
REMGSLSLL

SEQ ID NO: 142579 - protein, 9 aa, Homo Sapiens
TELTKVWCS

SEQ ID NO: 142580 - protein, 9 aa, Homo Sapiens
TGPVGWQLV

SEQ ID NO: 142581 - protein, 9 aa, Homo Sapiens
TPKRPFSQC

SEQ ID NO: 142582 - protein, 9 aa, Homo Sapiens
SSSQCTQGR

SEQ ID NO: 142583 - protein, 9 aa, Homo Sapiens
WLGAPPVLH

SEQ ID NO: 142584 - protein, 9 aa, Homo Sapiens
THTGIHTHT

SEQ ID NO: 142585 - protein, 9 aa, Homo Sapiens
RCPSLTGSS

SEQ ID NO: 142586 - protein, 9 aa, Homo Sapiens
RMHPSLEIP

SEQ ID NO: 142587 - protein, 9 aa, Homo Sapiens
ETTCQRQAR

SEQ ID NO: 142588 - protein, 9 aa, Homo Sapiens
LMRWGLHLQ

SEQ ID NO: 142589 - protein, 9 aa, Homo Sapiens
RGLPPPPGA

SEQ ID NO: 142590 - protein, 9 aa, Homo Sapiens
ALKQVSPAS

SEQ ID NO: 142591 - protein, 9 aa, Homo Sapiens
ARKIGARIC

SEQ ID NO: 142592 - protein, 9 aa, Homo Sapiens
LQEAKFLQQ

SEQ ID NO: 142593 - protein, 9 aa, Homo Sapiens
QIFVIDNGA

SEQ ID NO: 142594 - protein, 9 aa, Homo Sapiens
THADTPTST

SEQ ID NO: 142595 - protein, 9 aa, Homo Sapiens
DHRRSWLLG

SEQ ID NO: 142596 - protein, 9 aa, Homo Sapiens
GWDYAHCMP

SEQ ID NO: 142597 - protein, 9 aa, Homo Sapiens
AVRKFSLTL

SEQ ID NO: 142598 - protein, 9 aa, Homo Sapiens
FRCSLVDFQ

SEQ ID NO: 142599 - protein, 9 aa, Homo Sapiens
KHRSSTPKS

SEQ ID NO: 142600 - protein, 9 aa, Homo Sapiens
VPPGEQQCP

SEQ ID NO: 142601 - protein, 9 aa, Homo Sapiens
SHLILLWLL

SEQ ID NO: 142602 - protein, 9 aa, Homo Sapiens
PLGKDGRVA

SEQ ID NO: 142603 - protein, 9 aa, Homo Sapiens
IDFGLAKAY

SEQ ID NO: 142604 - protein, 9 aa, Homo Sapiens
PSVPGAFSS

SEQ ID NO: 142605 - protein, 9 aa, Homo Sapiens
SPCSGPSKT

SEQ ID NO: 142606 - protein, 9 aa, Homo Sapiens
MMGAFLSLL

SEQ ID NO: 142607 - protein, 9 aa, Homo Sapiens
ANERKSGIL

SEQ ID NO: 142608 - protein, 9 aa, Homo Sapiens
EAKFLQQQQ

SEQ ID NO: 142609 - protein, 9 aa, Homo Sapiens
RTSNISHQW

SEQ ID NO: 142610 - protein, 9 aa, Homo Sapiens
LLLRKCCLI

SEQ ID NO: 142611 - protein, 9 aa, Homo Sapiens
SQEQDVLER

SEQ ID NO: 142612 - protein, 9 aa, Homo Sapiens
QRASSAQVR

SEQ ID NO: 142613 - protein, 9 aa, Homo Sapiens
GTRDWLRGP

SEQ ID NO: 142614 - protein, 9 aa, Homo Sapiens
CCPVCTRPV

SEQ ID NO: 142615 - protein, 9 aa, Homo Sapiens
IFVIDNGAD

SEQ ID NO: 142616 - protein, 9 aa, Homo Sapiens
PPPVTLELS

SEQ ID NO: 142617 - protein, 9 aa, Homo Sapiens
IGNGFEEGT

SEQ ID NO: 142618 - protein, 9 aa, Homo Sapiens
EPHPMSSPT

SEQ ID NO: 142619 - protein, 9 aa, Homo Sapiens
VTEECGKSG

SEQ ID NO: 142620 - protein, 9 aa, Homo Sapiens
LDHVPRIDR

SEQ ID NO: 142621 - protein, 9 aa, Homo Sapiens
RPRPHPLYF

SEQ ID NO: 142622 - protein, 9 aa, Homo Sapiens
ARVDAHVVL

SEQ ID NO: 142623 - protein, 9 aa, Homo Sapiens
PAAQAVASQ

SEQ ID NO: 142624 - protein, 9 aa, Homo Sapiens
CNKGYTLAS

SEQ ID NO: 142625 - protein, 9 aa, Homo Sapiens
HGLFSLPPD

SEQ ID NO: 142626 - protein, 9 aa, Homo Sapiens
PPPRWMSSE

SEQ ID NO: 142627 - protein, 9 aa, Homo Sapiens
PFARPGRGG

SEQ ID NO: 142628 - protein, 9 aa, Homo Sapiens
TSCSLMAPW

SEQ ID NO: 142629 - protein, 9 aa, Homo Sapiens
QPAPQCRRA

SEQ ID NO: 142630 - protein, 9 aa, Homo Sapiens
QELELEARV

SEQ ID NO: 142631 - protein, 9 aa, Homo Sapiens
VHLWQALLH

SEQ ID NO: 142632 - protein, 9 aa, Homo Sapiens
MTSYTEDFL

SEQ ID NO: 142633 - protein, 9 aa, Homo Sapiens
PTCVEAASS

SEQ ID NO: 142634 - protein, 9 aa, Homo Sapiens
EDDTATAKE

SEQ ID NO: 142635 - protein, 9 aa, Homo Sapiens
KQVYQAQTT

SEQ ID NO: 142636 - protein, 9 aa, Homo Sapiens
TCWCYLTSG

SEQ ID NO: 142637 - protein, 9 aa, Homo Sapiens
HQAVDNKAA

SEQ ID NO: 142638 - protein, 9 aa, Homo Sapiens
LRRGPSPSP

SEQ ID NO: 142639 - protein, 9 aa, Homo Sapiens
GVLSTPAVS

SEQ ID NO: 142640 - protein, 9 aa, Homo Sapiens
TVGILPSTC

SEQ ID NO: 142641 - protein, 9 aa, Homo Sapiens
RAVVFLTFL

SEQ ID NO: 142642 - protein, 9 aa, Homo Sapiens
QDQIVPDLY

SEQ ID NO: 142643 - protein, 9 aa, Homo Sapiens
IIPDYVLGQ

SEQ ID NO: 142644 - protein, 9 aa, Homo Sapiens
PTSGSTPGS

SEQ ID NO: 142645 - protein, 9 aa, Homo Sapiens
GPPRSRLAA

SEQ ID NO: 142646 - protein, 9 aa, Homo Sapiens
TQSRWCCCR

SEQ ID NO: 142647 - protein, 9 aa, Homo Sapiens
CHPEQVNLK

SEQ ID NO: 142648 - protein, 9 aa, Homo Sapiens
FMTLGWEAL

SEQ ID NO: 142649 - protein, 9 aa, Homo Sapiens
AGSRRCCLR

SEQ ID NO: 142650 - protein, 9 aa, Homo Sapiens
VQDALHWKN

SEQ ID NO: 142651 - protein, 9 aa, Homo Sapiens
QGRVTEADS

SEQ ID NO: 142652 - protein, 9 aa, Homo Sapiens
TLLGICNGG

SEQ ID NO: 142653 - protein, 9 aa, Homo Sapiens
SLSLESWRR

SEQ ID NO: 142654 - protein, 9 aa, Homo Sapiens
QTHTVIHTD

SEQ ID NO: 142655 - protein, 9 aa, Homo Sapiens
GDGQTRAGD

SEQ ID NO: 142656 - protein, 9 aa, Homo Sapiens
PLKITPKED

SEQ ID NO: 142657 - protein, 9 aa, Homo Sapiens
RQDEKACIE

SEQ ID NO: 142658 - protein, 9 aa, Homo Sapiens
AAVGNILVL

SEQ ID NO: 142659 - protein, 9 aa, Homo Sapiens
EAKLHQMLR

SEQ ID NO: 142660 - protein, 9 aa, Homo Sapiens
SCVPTAARP

SEQ ID NO: 142661 - protein, 9 aa, Homo Sapiens
RPKQRTRTM

SEQ ID NO: 142662 - protein, 9 aa, Homo Sapiens
NVDTERALL

SEQ ID NO: 142663 - protein, 9 aa, Homo Sapiens
EEAEAAAHA

SEQ ID NO: 142664 - protein, 9 aa, Homo Sapiens
EHINVPVPQ

SEQ ID NO: 142665 - protein, 9 aa, Homo Sapiens
CEIKGREAV

SEQ ID NO: 142666 - protein, 9 aa, Homo Sapiens
EAMKKNLRI

SEQ ID NO: 142667 - protein, 9 aa, Homo Sapiens
LSLPGAKAG

SEQ ID NO: 142668 - protein, 9 aa, Homo Sapiens
PLQGGLQLG

SEQ ID NO: 142669 - protein, 9 aa, Homo Sapiens
YQYGVLGEL

SEQ ID NO: 142670 - protein, 9 aa, Homo Sapiens
GRFALADQR

SEQ ID NO: 142671 - protein, 9 aa, Homo Sapiens
LLPTLPLSP

SEQ ID NO: 142672 - protein, 9 aa, Homo Sapiens
GSTGGGSSG

SEQ ID NO: 142673 - protein, 9 aa, Homo Sapiens
AARQQQPPP

SEQ ID NO: 142674 - protein, 9 aa, Homo Sapiens
GPCLAQAPI

SEQ ID NO: 142675 - protein, 9 aa, Homo Sapiens
WPGWRWRRG

SEQ ID NO: 142676 - protein, 9 aa, Homo Sapiens
ELLLLVVVP

SEQ ID NO: 142677 - protein, 9 aa, Homo Sapiens
PSSAPRTPT

SEQ ID NO: 142678 - protein, 9 aa, Homo Sapiens
GPHVPRQLP

SEQ ID NO: 142679 - protein, 9 aa, Homo Sapiens
EVISFIDEA

SEQ ID NO: 142680 - protein, 9 aa, Homo Sapiens
NIELTDAFE

SEQ ID NO: 142681 - protein, 9 aa, Homo Sapiens
PGPITCLEQ

SEQ ID NO: 142682 - protein, 9 aa, Homo Sapiens
PNAAVGSQP

SEQ ID NO: 142683 - protein, 9 aa, Homo Sapiens
RRLYCSRFS

SEQ ID NO: 142684 - protein, 9 aa, Homo Sapiens
KFRDVAVEF

SEQ ID NO: 142685 - protein, 9 aa, Homo Sapiens
PSEKSNKKI

SEQ ID NO: 142686 - protein, 9 aa, Homo Sapiens
THAEPYTCR

SEQ ID NO: 142687 - protein, 9 aa, Homo Sapiens
ISFSVKNKE

SEQ ID NO: 142688 - protein, 9 aa, Homo Sapiens
PRAPEVPRC

SEQ ID NO: 142689 - protein, 9 aa, Homo Sapiens
TSSLPGGTD

SEQ ID NO: 142690 - protein, 9 aa, Homo Sapiens
APVHNPRVE

SEQ ID NO: 142691 - protein, 9 aa, Homo Sapiens
PGRAPHPER

SEQ ID NO: 142692 - protein, 9 aa, Homo Sapiens
PSASLAHSD

SEQ ID NO: 142693 - protein, 9 aa, Homo Sapiens
QLPRKGQSL

SEQ ID NO: 142694 - protein, 9 aa, Homo Sapiens
SMPHLQKVF

SEQ ID NO: 142695 - protein, 9 aa, Homo Sapiens
GEATDTVGC

SEQ ID NO: 142696 - protein, 9 aa, Homo Sapiens
GWLQETHKG

SEQ ID NO: 142697 - protein, 9 aa, Homo Sapiens
AVAANSATS

SEQ ID NO: 142698 - protein, 9 aa, Homo Sapiens
RSCSPAHWL

SEQ ID NO: 142699 - protein, 9 aa, Homo Sapiens
SAYKVPVTL

SEQ ID NO: 142700 - protein, 9 aa, Homo Sapiens
STSWCSVKS

SEQ ID NO: 142701 - protein, 9 aa, Homo Sapiens
LTNIPEEVC

SEQ ID NO: 142702 - protein, 9 aa, Homo Sapiens
TRRPRPPCS

SEQ ID NO: 142703 - protein, 9 aa, Homo Sapiens
NVHSLLTST

SEQ ID NO: 142704 - protein, 9 aa, Homo Sapiens
SLHILYLEA

SEQ ID NO: 142705 - protein, 9 aa, Homo Sapiens
RVLSCLYSV

SEQ ID NO: 142706 - protein, 9 aa, Homo Sapiens
WIPKRNARL

SEQ ID NO: 142707 - protein, 9 aa, Homo Sapiens
PSALVLLAP

SEQ ID NO: 142708 - protein, 9 aa, Homo Sapiens
EEITNIELT

SEQ ID NO: 142709 - protein, 9 aa, Homo Sapiens
KSDHTKPRP

SEQ ID NO: 142710 - protein, 9 aa, Homo Sapiens
AARPTPRVR

SEQ ID NO: 142711 - protein, 9 aa, Homo Sapiens
TGTHTDTHT

SEQ ID NO: 142712 - protein, 9 aa, Homo Sapiens
SPVQWVGDD

SEQ ID NO: 142713 - protein, 9 aa, Homo Sapiens
VPDHGRDQG

SEQ ID NO: 142714 - protein, 9 aa, Homo Sapiens
QLGGGVCER

SEQ ID NO: 142715 - protein, 9 aa, Homo Sapiens
QRRNYTHAL

SEQ ID NO: 142716 - protein, 9 aa, Homo Sapiens
LHTAGGGGG

SEQ ID NO: 142717 - protein, 9 aa, Homo Sapiens
AIQPGPRAN

SEQ ID NO: 142718 - protein, 9 aa, Homo Sapiens
AALGPANAP

SEQ ID NO: 142719 - protein, 9 aa, Homo Sapiens
INPSAPAKG

SEQ ID NO: 142720 - protein, 9 aa, Homo Sapiens
KLTGHFGSA

SEQ ID NO: 142721 - protein, 9 aa, Homo Sapiens
LSCHIPVVR

SEQ ID NO: 142722 - protein, 9 aa, Homo Sapiens
DYIVMQFGQ

SEQ ID NO: 142723 - protein, 9 aa, Homo Sapiens
SPRRSPALR

SEQ ID NO: 142724 - protein, 9 aa, Homo Sapiens
TLLSQGAEV

SEQ ID NO: 142725 - protein, 9 aa, Homo Sapiens
PNPSSERHS

SEQ ID NO: 142726 - protein, 9 aa, Homo Sapiens
SCSWWAQRR

SEQ ID NO: 142727 - protein, 9 aa, Homo Sapiens
GTEVPWPEV

SEQ ID NO: 142728 - protein, 9 aa, Homo Sapiens
GSLRRQNMS

SEQ ID NO: 142729 - protein, 9 aa, Homo Sapiens
CLADLEGVN

SEQ ID NO: 142730 - protein, 9 aa, Homo Sapiens
HKSIISHTA

SEQ ID NO: 142731 - protein, 9 aa, Homo Sapiens
KISAEKAEV

SEQ ID NO: 142732 - protein, 9 aa, Homo Sapiens
AMFYHAYGS

SEQ ID NO: 142733 - protein, 9 aa, Homo Sapiens
VFLRQEGPM

SEQ ID NO: 142734 - protein, 9 aa, Homo Sapiens
LLFPTSYIL

SEQ ID NO: 142735 - protein, 9 aa, Homo Sapiens
EGWRWGWGQ

SEQ ID NO: 142736 - protein, 9 aa, Homo Sapiens
KRKLKALLS

SEQ ID NO: 142737 - protein, 9 aa, Homo Sapiens
PTPVPPALS

SEQ ID NO: 142738 - protein, 9 aa, Homo Sapiens
GPWAARPRP

SEQ ID NO: 142739 - protein, 9 aa, Homo Sapiens
HGQHHRCVR

SEQ ID NO: 142740 - protein, 9 aa, Homo Sapiens
NCEHTFIAI

SEQ ID NO: 142741 - protein, 9 aa, Homo Sapiens
HLWRPDVKV

SEQ ID NO: 142742 - protein, 9 aa, Homo Sapiens
WRTPEDHSD

SEQ ID NO: 142743 - protein, 9 aa, Homo Sapiens
NFTPQNVTF

SEQ ID NO: 142744 - protein, 9 aa, Homo Sapiens
ESFFHYQVT

SEQ ID NO: 142745 - protein, 9 aa, Homo Sapiens
ACYLLYHKT

SEQ ID NO: 142746 - protein, 9 aa, Homo Sapiens
NNNMEKVTL

SEQ ID NO: 142747 - protein, 9 aa, Homo Sapiens
RNHISALGL

SEQ ID NO: 142748 - protein, 9 aa, Homo Sapiens
RQKFLKYSV

SEQ ID NO: 142749 - protein, 9 aa, Homo Sapiens
RLPGLPQLP

SEQ ID NO: 142750 - protein, 9 aa, Homo Sapiens
WTCVLTAFL

SEQ ID NO: 142751 - protein, 9 aa, Homo Sapiens
IAVDKGDLV

SEQ ID NO: 142752 - protein, 9 aa, Homo Sapiens
NHYCEAAFG

SEQ ID NO: 142753 - protein, 9 aa, Homo Sapiens
TAKRMSYHA

SEQ ID NO: 142754 - protein, 9 aa, Homo Sapiens
YCDSVYRMT

SEQ ID NO: 142755 - protein, 9 aa, Homo Sapiens
PGDAPSHSP

SEQ ID NO: 142756 - protein, 9 aa, Homo Sapiens
IFGGKALTR

SEQ ID NO: 142757 - protein, 9 aa, Homo Sapiens
PGSHLCVET

SEQ ID NO: 142758 - protein, 9 aa, Homo Sapiens
PERQDEKAC

SEQ ID NO: 142759 - protein, 9 aa, Homo Sapiens
MSFHLLNYR

SEQ ID NO: 142760 - protein, 9 aa, Homo Sapiens
LYTSDTTGL

SEQ ID NO: 142761 - protein, 9 aa, Homo Sapiens
TADVTKKNK

SEQ ID NO: 142762 - protein, 9 aa, Homo Sapiens
SSRRLRPRW

SEQ ID NO: 142763 - protein, 9 aa, Homo Sapiens
EEEKKEEED

SEQ ID NO: 142764 - protein, 9 aa, Homo Sapiens
PAQPPLPAL

SEQ ID NO: 142765 - protein, 9 aa, Homo Sapiens
EEVVVSALL

SEQ ID NO: 142766 - protein, 9 aa, Homo Sapiens
LIKKIARLF

SEQ ID NO: 142767 - protein, 9 aa, Homo Sapiens
AGGTPHVSV

SEQ ID NO: 142768 - protein, 9 aa, Homo Sapiens
LSLRQADAL

SEQ ID NO: 142769 - protein, 9 aa, Homo Sapiens
VKQESRDHT

SEQ ID NO: 142770 - protein, 9 aa, Homo Sapiens
YMVTQGRKL

SEQ ID NO: 142771 - protein, 9 aa, Homo Sapiens
GSHLCVETS

SEQ ID NO: 142772 - protein, 9 aa, Homo Sapiens
AIIWQMGIG

SEQ ID NO: 142773 - protein, 9 aa, Homo Sapiens
IVLQILVEN

SEQ ID NO: 142774 - protein, 9 aa, Homo Sapiens
EQRCGAKTI

SEQ ID NO: 142775 - protein, 9 aa, Homo Sapiens
EEQGGRGRL

SEQ ID NO: 142776 - protein, 9 aa, Homo Sapiens
QKALEIKHI

SEQ ID NO: 142777 - protein, 9 aa, Homo Sapiens
PLVHTLISV

SEQ ID NO: 142778 - protein, 9 aa, Homo Sapiens
KEVCHPEQV

SEQ ID NO: 142779 - protein, 9 aa, Homo Sapiens
QFPPQVNGH

SEQ ID NO: 142780 - protein, 9 aa, Homo Sapiens
RVEVDTVRV

SEQ ID NO: 142781 - protein, 9 aa, Homo Sapiens
RAPSLKAPT

SEQ ID NO: 142782 - protein, 9 aa, Homo Sapiens
ELEPLKCNF

SEQ ID NO: 142783 - protein, 9 aa, Homo Sapiens
NPTQAFLLV

SEQ ID NO: 142784 - protein, 9 aa, Homo Sapiens
KKHRIEESI

SEQ ID NO: 142785 - protein, 9 aa, Homo Sapiens
VYIGPDDVQ

SEQ ID NO: 142786 - protein, 9 aa, Homo Sapiens
RKGREERRE

SEQ ID NO: 142787 - protein, 9 aa, Homo Sapiens
ICSGASTSC

SEQ ID NO: 142788 - protein, 9 aa, Homo Sapiens
LWVVFHKFK

SEQ ID NO: 142789 - protein, 9 aa, Homo Sapiens
CACCVPAKD

SEQ ID NO: 142790 - protein, 9 aa, Homo Sapiens
DELAARATA

SEQ ID NO: 142791 - protein, 9 aa, Homo Sapiens
LPPMGSLTP

SEQ ID NO: 142792 - protein, 9 aa, Homo Sapiens
ESYWYSVTT

SEQ ID NO: 142793 - protein, 9 aa, Homo Sapiens
ARSVHAAMK

SEQ ID NO: 142794 - protein, 9 aa, Homo Sapiens
RKCLVQMQT

SEQ ID NO: 142795 - protein, 9 aa, Homo Sapiens
QKVTSSLGI

SEQ ID NO: 142796 - protein, 9 aa, Homo Sapiens
MERPRSAVE

SEQ ID NO: 142797 - protein, 9 aa, Homo Sapiens
RPVLKKTPN

SEQ ID NO: 142798 - protein, 9 aa, Homo Sapiens
VWLAAASEP

SEQ ID NO: 142799 - protein, 9 aa, Homo Sapiens
LPGPCASLL

SEQ ID NO: 142800 - protein, 9 aa, Homo Sapiens
LGFSVALST

SEQ ID NO: 142801 - protein, 9 aa, Homo Sapiens
VTKPLNNFR

SEQ ID NO: 142802 - protein, 9 aa, Homo Sapiens
CIECGKLFT

SEQ ID NO: 142803 - protein, 9 aa, Homo Sapiens
GGKKDSIMY

SEQ ID NO: 142804 - protein, 9 aa, Homo Sapiens
TGHLWLGTL

SEQ ID NO: 142805 - protein, 9 aa, Homo Sapiens
CLMDSAWSL

SEQ ID NO: 142806 - protein, 9 aa, Homo Sapiens
KTRSLVGTW

SEQ ID NO: 142807 - protein, 9 aa, Homo Sapiens
DVEEAVRKL

SEQ ID NO: 142808 - protein, 9 aa, Homo Sapiens
GKSETCGSC

SEQ ID NO: 142809 - protein, 9 aa, Homo Sapiens
PNGPLGPSE

SEQ ID NO: 142810 - protein, 9 aa, Homo Sapiens
VLLLVDDRQ

SEQ ID NO: 142811 - protein, 9 aa, Homo Sapiens
GMSLNVWAI

SEQ ID NO: 142812 - protein, 9 aa, Homo Sapiens
VRVEVDTVR

SEQ ID NO: 142813 - protein, 9 aa, Homo Sapiens
CERPALLHH

SEQ ID NO: 142814 - protein, 9 aa, Homo Sapiens
PDLFALLFL

SEQ ID NO: 142815 - protein, 9 aa, Homo Sapiens
SLSCQAQGA

SEQ ID NO: 142816 - protein, 9 aa, Homo Sapiens
PRRALPRAT

SEQ ID NO: 142817 - protein, 9 aa, Homo Sapiens
VPTGVPVCS

SEQ ID NO: 142818 - protein, 9 aa, Homo Sapiens
AKYTELIAV

SEQ ID NO: 142819 - protein, 9 aa, Homo Sapiens
VHVQGAAVV

SEQ ID NO: 142820 - protein, 9 aa, Homo Sapiens
PLRLDMTSY

SEQ ID NO: 142821 - protein, 9 aa, Homo Sapiens
SREKRRRTI

SEQ ID NO: 142822 - protein, 9 aa, Homo Sapiens
GYRDKTRMQ

SEQ ID NO: 142823 - protein, 9 aa, Homo Sapiens
HQQQQQQKA

SEQ ID NO: 142824 - protein, 9 aa, Homo Sapiens
SSGPGSTRA

SEQ ID NO: 142825 - protein, 9 aa, Homo Sapiens
GGSLPKKIN

SEQ ID NO: 142826 - protein, 9 aa, Homo Sapiens
MSPTLQDIP

SEQ ID NO: 142827 - protein, 9 aa, Homo Sapiens
VQQKVTQWA

SEQ ID NO: 142828 - protein, 9 aa, Homo Sapiens
EEIAVDKGD

SEQ ID NO: 142829 - protein, 9 aa, Homo Sapiens
TVDITQVTS

SEQ ID NO: 142830 - protein, 9 aa, Homo Sapiens
APRPAPRSW

SEQ ID NO: 142831 - protein, 9 aa, Homo Sapiens
AETLHKLQA

SEQ ID NO: 142832 - protein, 9 aa, Homo Sapiens
EFVGWRYRR

SEQ ID NO: 142833 - protein, 9 aa, Homo Sapiens
LQIFIQVFE

SEQ ID NO: 142834 - protein, 9 aa, Homo Sapiens
TVLSITSSR

SEQ ID NO: 142835 - protein, 9 aa, Homo Sapiens
LPAAGGTPH

SEQ ID NO: 142836 - protein, 9 aa, Homo Sapiens
QPPQRPPLQ

SEQ ID NO: 142837 - protein, 9 aa, Homo Sapiens
VSSDPPTTI

SEQ ID NO: 142838 - protein, 9 aa, Homo Sapiens
RFGDRFPVM

SEQ ID NO: 142839 - protein, 9 aa, Homo Sapiens
CRYALGIQD

SEQ ID NO: 142840 - protein, 9 aa, Homo Sapiens
PPSAPPAPQ

SEQ ID NO: 142841 - protein, 9 aa, Homo Sapiens
ALTFSASIA

SEQ ID NO: 142842 - protein, 9 aa, Homo Sapiens
TTSTLGSSP

SEQ ID NO: 142843 - protein, 9 aa, Homo Sapiens
MNIQHNPFN

SEQ ID NO: 142844 - protein, 9 aa, Homo Sapiens
EYCDSVYRM

SEQ ID NO: 142845 - protein, 9 aa, Homo Sapiens
GSTPGSGPS

SEQ ID NO: 142846 - protein, 9 aa, Homo Sapiens
TAGHVATMI

SEQ ID NO: 142847 - protein, 9 aa, Homo Sapiens
RSGGSGWSG

SEQ ID NO: 142848 - protein, 9 aa, Homo Sapiens
PVADDHWHM

SEQ ID NO: 142849 - protein, 9 aa, Homo Sapiens
LLNSINVDR

SEQ ID NO: 142850 - protein, 9 aa, Homo Sapiens
KNMLSPDHH

SEQ ID NO: 142851 - protein, 9 aa, Homo Sapiens
AAMRWARRC

SEQ ID NO: 142852 - protein, 9 aa, Homo Sapiens
IHQPQYSIF

SEQ ID NO: 142853 - protein, 9 aa, Homo Sapiens
GCRRCAIVG

SEQ ID NO: 142854 - protein, 9 aa, Homo Sapiens
PDTSCSLMA

SEQ ID NO: 142855 - protein, 9 aa, Homo Sapiens
TEKAFPAHL

SEQ ID NO: 142856 - protein, 9 aa, Homo Sapiens
ELKQARKAF

SEQ ID NO: 142857 - protein, 9 aa, Homo Sapiens
FCKAQNFPE

SEQ ID NO: 142858 - protein, 9 aa, Homo Sapiens
LRPPGTGPQ

SEQ ID NO: 142859 - protein, 9 aa, Homo Sapiens
GWPGWRWRR

SEQ ID NO: 142860 - protein, 9 aa, Homo Sapiens
DAPYCVAEL

SEQ ID NO: 142861 - protein, 9 aa, Homo Sapiens
ILVMVVILQ

SEQ ID NO: 142862 - protein, 9 aa, Homo Sapiens
IYSRAAKDY

SEQ ID NO: 142863 - protein, 9 aa, Homo Sapiens
ERLTSAYRN

SEQ ID NO: 142864 - protein, 9 aa, Homo Sapiens
QPEKQLPPI

SEQ ID NO: 142865 - protein, 9 aa, Homo Sapiens
NNMEKVTLK

SEQ ID NO: 142866 - protein, 9 aa, Homo Sapiens
TDRNTQTHT

SEQ ID NO: 142867 - protein, 9 aa, Homo Sapiens
QGYVPDHGR

SEQ ID NO: 142868 - protein, 9 aa, Homo Sapiens
LETFRKSLH

SEQ ID NO: 142869 - protein, 9 aa, Homo Sapiens
KVGSLGQQH

SEQ ID NO: 142870 - protein, 9 aa, Homo Sapiens
VKASYPKRL

SEQ ID NO: 142871 - protein, 9 aa, Homo Sapiens
RTISQYLSG

SEQ ID NO: 142872 - protein, 9 aa, Homo Sapiens
RQASSGYDW

SEQ ID NO: 142873 - protein, 9 aa, Homo Sapiens
LPHSSGLAL

SEQ ID NO: 142874 - protein, 9 aa, Homo Sapiens
QSTQKKMFM

SEQ ID NO: 142875 - protein, 9 aa, Homo Sapiens
GDQGGGQTL

SEQ ID NO: 142876 - protein, 9 aa, Homo Sapiens
GPTSGSTPG

SEQ ID NO: 142877 - protein, 9 aa, Homo Sapiens
VEEGPALRE

SEQ ID NO: 142878 - protein, 9 aa, Homo Sapiens
PPQILERKR

SEQ ID NO: 142879 - protein, 9 aa, Homo Sapiens
LRALSGGDS

SEQ ID NO: 142880 - protein, 9 aa, Homo Sapiens
LHPVHLPTL

SEQ ID NO: 142881 - protein, 9 aa, Homo Sapiens
PEPGCLRPP

SEQ ID NO: 142882 - protein, 9 aa, Homo Sapiens
LMYVLWLLF

SEQ ID NO: 142883 - protein, 9 aa, Homo Sapiens
KKCYLHHWN

SEQ ID NO: 142884 - protein, 9 aa, Homo Sapiens
SIFVSIVVK

SEQ ID NO: 142885 - protein, 9 aa, Homo Sapiens
PEINKDCDG

SEQ ID NO: 142886 - protein, 9 aa, Homo Sapiens
TPQNPPNHP

SEQ ID NO: 142887 - protein, 9 aa, Homo Sapiens
VRHSLGFCD

SEQ ID NO: 142888 - protein, 9 aa, Homo Sapiens
QPGASPRCP

SEQ ID NO: 142889 - protein, 9 aa, Homo Sapiens
QVLGESGEM

SEQ ID NO: 142890 - protein, 9 aa, Homo Sapiens
HVTATPRIV

SEQ ID NO: 142891 - protein, 9 aa, Homo Sapiens
NQLGGGVCE

SEQ ID NO: 142892 - protein, 9 aa, Homo Sapiens
SPWATSSST

SEQ ID NO: 142893 - protein, 9 aa, Homo Sapiens
IRTEMASLT

SEQ ID NO: 142894 - protein, 9 aa, Homo Sapiens
PCGRQCLMS

SEQ ID NO: 142895 - protein, 9 aa, Homo Sapiens
AAPVITSSQ

SEQ ID NO: 142896 - protein, 9 aa, Homo Sapiens
TFGVAEKGA

SEQ ID NO: 142897 - protein, 9 aa, Homo Sapiens
PSPASGSTS

SEQ ID NO: 142898 - protein, 9 aa, Homo Sapiens
EPGLWSLRT

SEQ ID NO: 142899 - protein, 9 aa, Homo Sapiens
PPPTKKRGK

SEQ ID NO: 142900 - protein, 9 aa, Homo Sapiens
CLSVLGGAG

SEQ ID NO: 142901 - protein, 9 aa, Homo Sapiens
PHSSGLALC

SEQ ID NO: 142902 - protein, 9 aa, Homo Sapiens
RDREPEARP

SEQ ID NO: 142903 - protein, 9 aa, Homo Sapiens
CMCTADYSL

SEQ ID NO: 142904 - protein, 9 aa, Homo Sapiens
RHLGYELLT

SEQ ID NO: 142905 - protein, 9 aa, Homo Sapiens
SLMALLSFL

SEQ ID NO: 142906 - protein, 9 aa, Homo Sapiens
KRHTPRSPW

SEQ ID NO: 142907 - protein, 9 aa, Homo Sapiens
PTFLPLHLK

SEQ ID NO: 142908 - protein, 9 aa, Homo Sapiens
ATQGPWLVV

SEQ ID NO: 142909 - protein, 9 aa, Homo Sapiens
PAPRSWPRK

SEQ ID NO: 142910 - protein, 9 aa, Homo Sapiens
GGTSSLLSP

SEQ ID NO: 142911 - protein, 9 aa, Homo Sapiens
ELHKIPLPL

SEQ ID NO: 142912 - protein, 9 aa, Homo Sapiens
KLGVPSMET

SEQ ID NO: 142913 - protein, 9 aa, Homo Sapiens
SWSVSLMPP

SEQ ID NO: 142914 - protein, 9 aa, Homo Sapiens
RLGPHGGQL

SEQ ID NO: 142915 - protein, 9 aa, Homo Sapiens
LSTTSAASG

SEQ ID NO: 142916 - protein, 9 aa, Homo Sapiens
LKPTMKMLE

SEQ ID NO: 142917 - protein, 9 aa, Homo Sapiens
SSGDLPCDW

SEQ ID NO: 142918 - protein, 9 aa, Homo Sapiens
CPSITTPGA

SEQ ID NO: 142919 - protein, 9 aa, Homo Sapiens
TALIVFGAE

SEQ ID NO: 142920 - protein, 9 aa, Homo Sapiens
ALQYAGDDS

SEQ ID NO: 142921 - protein, 9 aa, Homo Sapiens
LKKASSPGH

SEQ ID NO: 142922 - protein, 9 aa, Homo Sapiens
LDPRPLTVM

SEQ ID NO: 142923 - protein, 9 aa, Homo Sapiens
SLRLLVWLE

SEQ ID NO: 142924 - protein, 9 aa, Homo Sapiens
VCDRFNARQ

SEQ ID NO: 142925 - protein, 9 aa, Homo Sapiens
RATPDLDVR

SEQ ID NO: 142926 - protein, 9 aa, Homo Sapiens
SEHTLMGKE

SEQ ID NO: 142927 - protein, 9 aa, Homo Sapiens
HFGPFCDPQ

SEQ ID NO: 142928 - protein, 9 aa, Homo Sapiens
MLFLLIKAN

SEQ ID NO: 142929 - protein, 9 aa, Homo Sapiens
KVELATRLQ

SEQ ID NO: 142930 - protein, 9 aa, Homo Sapiens
QTPPLLTLR

SEQ ID NO: 142931 - protein, 9 aa, Homo Sapiens
QARDMLGGD

SEQ ID NO: 142932 - protein, 9 aa, Homo Sapiens
KLYAKKEWN

SEQ ID NO: 142933 - protein, 9 aa, Homo Sapiens
AFPAHLASA

SEQ ID NO: 142934 - protein, 9 aa, Homo Sapiens
RGQPPPPPP

SEQ ID NO: 142935 - protein, 9 aa, Homo Sapiens
SAIGPRSCL

SEQ ID NO: 142936 - protein, 9 aa, Homo Sapiens
AGAGAVPRS

SEQ ID NO: 142937 - protein, 9 aa, Homo Sapiens
SYVSVPLNC

SEQ ID NO: 142938 - protein, 9 aa, Homo Sapiens
RAEPMAEEE

SEQ ID NO: 142939 - protein, 9 aa, Homo Sapiens
PVLIKKIAR

SEQ ID NO: 142940 - protein, 9 aa, Homo Sapiens
ALRVRHGFL

SEQ ID NO: 142941 - protein, 9 aa, Homo Sapiens
KPYVYRECG

SEQ ID NO: 142942 - protein, 9 aa, Homo Sapiens
SYTEDFLMG

SEQ ID NO: 142943 - protein, 9 aa, Homo Sapiens
DFCLLSLPW

SEQ ID NO: 142944 - protein, 9 aa, Homo Sapiens
LSTLLGICN

SEQ ID NO: 142945 - protein, 9 aa, Homo Sapiens
LGRGGGRGW

SEQ ID NO: 142946 - protein, 9 aa, Homo Sapiens
GIHTHTGTH

SEQ ID NO: 142947 - protein, 9 aa, Homo Sapiens
KSSTSLALS

SEQ ID NO: 142948 - protein, 9 aa, Homo Sapiens
TMKTVPSNF

SEQ ID NO: 142949 - protein, 9 aa, Homo Sapiens
GERWPGGFE

SEQ ID NO: 142950 - protein, 9 aa, Homo Sapiens
DNTKDKNTA

SEQ ID NO: 142951 - protein, 9 aa, Homo Sapiens
RANGDPLLR

SEQ ID NO: 142952 - protein, 9 aa, Homo Sapiens
KQLALKHQL

SEQ ID NO: 142953 - protein, 9 aa, Homo Sapiens
HRIAQCLNV

SEQ ID NO: 142954 - protein, 9 aa, Homo Sapiens
LENIMENST

SEQ ID NO: 142955 - protein, 9 aa, Homo Sapiens
AAAPSRPAT

SEQ ID NO: 142956 - protein, 9 aa, Homo Sapiens
TMAIGVAVD

SEQ ID NO: 142957 - protein, 9 aa, Homo Sapiens
GLIQENDRV

SEQ ID NO: 142958 - protein, 9 aa, Homo Sapiens
MWFLGIVFR

SEQ ID NO: 142959 - protein, 9 aa, Homo Sapiens
VVGKAKKPH

SEQ ID NO: 142960 - protein, 9 aa, Homo Sapiens
RAPGTLLHT

SEQ ID NO: 142961 - protein, 9 aa, Homo Sapiens
KENVTKFWE

SEQ ID NO: 142962 - protein, 9 aa, Homo Sapiens
PCDWRRACV

SEQ ID NO: 142963 - protein, 9 aa, Homo Sapiens
TRDWLRGPS

SEQ ID NO: 142964 - protein, 9 aa, Homo Sapiens
WCGWRTLSS

SEQ ID NO: 142965 - protein, 9 aa, Homo Sapiens
IDIRIRVQS

SEQ ID NO: 142966 - protein, 9 aa, Homo Sapiens
SMCLLIGLF

SEQ ID NO: 142967 - protein, 9 aa, Homo Sapiens
DEWEIPGSL

SEQ ID NO: 142968 - protein, 9 aa, Homo Sapiens
LVQFNCIGC

SEQ ID NO: 142969 - protein, 9 aa, Homo Sapiens
ILGKGNLIG

SEQ ID NO: 142970 - protein, 9 aa, Homo Sapiens
THPTCILGQ

SEQ ID NO: 142971 - protein, 9 aa, Homo Sapiens
AFVLSSMLY

SEQ ID NO: 142972 - protein, 9 aa, Homo Sapiens
EMLAYSNSS

SEQ ID NO: 142973 - protein, 9 aa, Homo Sapiens
VLSDCKVCP

SEQ ID NO: 142974 - protein, 9 aa, Homo Sapiens
PEEQAGGPP

SEQ ID NO: 142975 - protein, 9 aa, Homo Sapiens
RGPRPLHRW

SEQ ID NO: 142976 - protein, 9 aa, Homo Sapiens
AFPNGPFSR

SEQ ID NO: 142977 - protein, 9 aa, Homo Sapiens
WHLPCGGVR

SEQ ID NO: 142978 - protein, 9 aa, Homo Sapiens
TVPPPPLLK

SEQ ID NO: 142979 - protein, 9 aa, Homo Sapiens
LLCQCPLLL

SEQ ID NO: 142980 - protein, 9 aa, Homo Sapiens
APAYRSVSE

SEQ ID NO: 142981 - protein, 9 aa, Homo Sapiens
YCHPSCCVS

SEQ ID NO: 142982 - protein, 9 aa, Homo Sapiens
WCGGGQTPA

SEQ ID NO: 142983 - protein, 9 aa, Homo Sapiens
SSPRRSPAL

SEQ ID NO: 142984 - protein, 9 aa, Homo Sapiens
SGPGGEGGR

SEQ ID NO: 142985 - protein, 9 aa, Homo Sapiens
CTVWTTSWC

SEQ ID NO: 142986 - protein, 9 aa, Homo Sapiens
MCMGSWRSF

SEQ ID NO: 142987 - protein, 9 aa, Homo Sapiens
SWGPTAGAA

SEQ ID NO: 142988 - protein, 9 aa, Homo Sapiens
GAVPRSGSE

SEQ ID NO: 142989 - protein, 9 aa, Homo Sapiens
REPHSPPPS

SEQ ID NO: 142990 - protein, 9 aa, Homo Sapiens
AWLSSSQWG

SEQ ID NO: 142991 - protein, 9 aa, Homo Sapiens
LSRPINNMT

SEQ ID NO: 142992 - protein, 9 aa, Homo Sapiens
HTDTHTGTD

SEQ ID NO: 142993 - protein, 9 aa, Homo Sapiens
TARPLLAWL

SEQ ID NO: 142994 - protein, 9 aa, Homo Sapiens
LPATSLCLK

SEQ ID NO: 142995 - protein, 9 aa, Homo Sapiens
QCHPRYPPH

SEQ ID NO: 142996 - protein, 9 aa, Homo Sapiens
FFCLRGHPS

SEQ ID NO: 142997 - protein, 9 aa, Homo Sapiens
YVKAKKSTD

SEQ ID NO: 142998 - protein, 9 aa, Homo Sapiens
EQLAQLRED

SEQ ID NO: 142999 - protein, 9 aa, Homo Sapiens
DQGRHPVRV

SEQ ID NO: 143000 - protein, 9 aa, Homo Sapiens
KIVLHPGHF

SEQ ID NO: 143001 - protein, 9 aa, Homo Sapiens
WAQPVLDPT

SEQ ID NO: 143002 - protein, 9 aa, Homo Sapiens
NISYGLPIV

SEQ ID NO: 143003 - protein, 9 aa, Homo Sapiens
MHGFMDLVC

SEQ ID NO: 143004 - protein, 9 aa, Homo Sapiens
PPRWMSSEV

SEQ ID NO: 143005 - protein, 9 aa, Homo Sapiens
VTAAHSVTV

SEQ ID NO: 143006 - protein, 9 aa, Homo Sapiens
EEMNNLQIS

SEQ ID NO: 143007 - protein, 9 aa, Homo Sapiens
SEPKLGEEF

SEQ ID NO: 143008 - protein, 9 aa, Homo Sapiens
TPVIDQGGK

SEQ ID NO: 143009 - protein, 9 aa, Homo Sapiens
AKDIDPENE

SEQ ID NO: 143010 - protein, 9 aa, Homo Sapiens
KIAFYVGIK

SEQ ID NO: 143011 - protein, 9 aa, Homo Sapiens
LCGGYFIDT

SEQ ID NO: 143012 - protein, 9 aa, Homo Sapiens
SSTIHIKTF

SEQ ID NO: 143013 - protein, 9 aa, Homo Sapiens
VKCQDYLSK

SEQ ID NO: 143014 - protein, 9 aa, Homo Sapiens
IVPDLYACG

SEQ ID NO: 143015 - protein, 9 aa, Homo Sapiens
ILGKHLVFL

SEQ ID NO: 143016 - protein, 9 aa, Homo Sapiens
NNSVDVYAF

SEQ ID NO: 143017 - protein, 9 aa, Homo Sapiens
KVHHHCFHS

SEQ ID NO: 143018 - protein, 9 aa, Homo Sapiens
YCSRFSRRV

SEQ ID NO: 143019 - protein, 9 aa, Homo Sapiens
VHGGHAPSP

SEQ ID NO: 143020 - protein, 9 aa, Homo Sapiens
EELKQARKA

SEQ ID NO: 143021 - protein, 9 aa, Homo Sapiens
EKPYVYREC

SEQ ID NO: 143022 - protein, 9 aa, Homo Sapiens
RKMQRRHIS

SEQ ID NO: 143023 - protein, 9 aa, Homo Sapiens
EVGSPSYAP

SEQ ID NO: 143024 - protein, 9 aa, Homo Sapiens
PAPSALVLL

SEQ ID NO: 143025 - protein, 9 aa, Homo Sapiens
PPEEAADEK

SEQ ID NO: 143026 - protein, 9 aa, Homo Sapiens
PLPSPPVPL

SEQ ID NO: 143027 - protein, 9 aa, Homo Sapiens
RWPRDSPTL

SEQ ID NO: 143028 - protein, 9 aa, Homo Sapiens
WLCRIGRAG

SEQ ID NO: 143029 - protein, 9 aa, Homo Sapiens
GRIYSRAAK

SEQ ID NO: 143030 - protein, 9 aa, Homo Sapiens
LGRALPLPR

SEQ ID NO: 143031 - protein, 9 aa, Homo Sapiens
RCRDVTLNM

SEQ ID NO: 143032 - protein, 9 aa, Homo Sapiens
VTTGLLVHF

SEQ ID NO: 143033 - protein, 9 aa, Homo Sapiens
HAAALALDV

SEQ ID NO: 143034 - protein, 9 aa, Homo Sapiens
SGSPALELL

SEQ ID NO: 143035 - protein, 9 aa, Homo Sapiens
SSGTSTVTN

SEQ ID NO: 143036 - protein, 9 aa, Homo Sapiens
DLHQIFMLT

SEQ ID NO: 143037 - protein, 9 aa, Homo Sapiens
RWIIEVVKA

SEQ ID NO: 143038 - protein, 9 aa, Homo Sapiens
PHRRAPPGW

SEQ ID NO: 143039 - protein, 9 aa, Homo Sapiens
AKDIYGHFG

SEQ ID NO: 143040 - protein, 9 aa, Homo Sapiens
EKLEKKRIM

SEQ ID NO: 143041 - protein, 9 aa, Homo Sapiens
PPLPALAPQ

SEQ ID NO: 143042 - protein, 9 aa, Homo Sapiens
PKKINSRCG

SEQ ID NO: 143043 - protein, 9 aa, Homo Sapiens
EQANTVKAS

SEQ ID NO: 143044 - protein, 9 aa, Homo Sapiens
GAFGMVYKG

SEQ ID NO: 143045 - protein, 9 aa, Homo Sapiens
QLTMNDSKH

SEQ ID NO: 143046 - protein, 9 aa, Homo Sapiens
VRKFSLTLS

SEQ ID NO: 143047 - protein, 9 aa, Homo Sapiens
YVHPHALLH

SEQ ID NO: 143048 - protein, 9 aa, Homo Sapiens
YIVMQFGQV

SEQ ID NO: 143049 - protein, 9 aa, Homo Sapiens
WKASRRSSS

SEQ ID NO: 143050 - protein, 9 aa, Homo Sapiens
SSRTACGAA

SEQ ID NO: 143051 - protein, 9 aa, Homo Sapiens
DFEMEYGKL

SEQ ID NO: 143052 - protein, 9 aa, Homo Sapiens
PKELPPEIL

SEQ ID NO: 143053 - protein, 9 aa, Homo Sapiens
FMSCVSPWA

SEQ ID NO: 143054 - protein, 9 aa, Homo Sapiens
GCWGCCGSW

SEQ ID NO: 143055 - protein, 9 aa, Homo Sapiens
RQENETWWM

SEQ ID NO: 143056 - protein, 9 aa, Homo Sapiens
MDPDEVHLD

SEQ ID NO: 143057 - protein, 9 aa, Homo Sapiens
GEAARECRR

SEQ ID NO: 143058 - protein, 9 aa, Homo Sapiens
RIGQQGYLG

SEQ ID NO: 143059 - protein, 9 aa, Homo Sapiens
KNKGRLWTP

SEQ ID NO: 143060 - protein, 9 aa, Homo Sapiens
LHFQRKLSV

SEQ ID NO: 143061 - protein, 9 aa, Homo Sapiens
AGEWSLCTC

SEQ ID NO: 143062 - protein, 9 aa, Homo Sapiens
GPAGRIGGN

SEQ ID NO: 143063 - protein, 9 aa, Homo Sapiens
GIYTVWVCI

SEQ ID NO: 143064 - protein, 9 aa, Homo Sapiens
FKTFFLLLP

SEQ ID NO: 143065 - protein, 9 aa, Homo Sapiens
TQTHTGIHR

SEQ ID NO: 143066 - protein, 9 aa, Homo Sapiens
TSAMAYPAV

SEQ ID NO: 143067 - protein, 9 aa, Homo Sapiens
CAQSKTVIF

SEQ ID NO: 143068 - protein, 9 aa, Homo Sapiens
GSWRSFICR

SEQ ID NO: 143069 - protein, 9 aa, Homo Sapiens
FMNAVKEKY

SEQ ID NO: 143070 - protein, 9 aa, Homo Sapiens
ECVLTVTWL

SEQ ID NO: 143071 - protein, 9 aa, Homo Sapiens
AVPAALAGV

SEQ ID NO: 143072 - protein, 9 aa, Homo Sapiens
LDTLKKVHI

SEQ ID NO: 143073 - protein, 9 aa, Homo Sapiens
MAVANVMSA

SEQ ID NO: 143074 - protein, 9 aa, Homo Sapiens
RGEVWSFLL

SEQ ID NO: 143075 - protein, 9 aa, Homo Sapiens
QGNSLLGLG

SEQ ID NO: 143076 - protein, 9 aa, Homo Sapiens
HISALGLLD

SEQ ID NO: 143077 - protein, 9 aa, Homo Sapiens
QKTGAPLSA

SEQ ID NO: 143078 - protein, 9 aa, Homo Sapiens
TSPNTAFIP

SEQ ID NO: 143079 - protein, 9 aa, Homo Sapiens
LPKALRCIQ

SEQ ID NO: 143080 - protein, 9 aa, Homo Sapiens
KAHSLLCLL

SEQ ID NO: 143081 - protein, 9 aa, Homo Sapiens
KAGKVKRQR

SEQ ID NO: 143082 - protein, 9 aa, Homo Sapiens
YTTICRVGT

SEQ ID NO: 143083 - protein, 9 aa, Homo Sapiens
DQRAEIAEL

SEQ ID NO: 143084 - protein, 9 aa, Homo Sapiens
PVSLPELPV

SEQ ID NO: 143085 - protein, 9 aa, Homo Sapiens
VHDDRSIQQ

SEQ ID NO: 143086 - protein, 9 aa, Homo Sapiens
LTEMLAYSN

SEQ ID NO: 143087 - protein, 9 aa, Homo Sapiens
TAVLEKYYE

SEQ ID NO: 143088 - protein, 9 aa, Homo Sapiens
AAGSSNLPV

SEQ ID NO: 143089 - protein, 9 aa, Homo Sapiens
RYQFQNLAD

SEQ ID NO: 143090 - protein, 9 aa, Homo Sapiens
CRRGAAFGF

SEQ ID NO: 143091 - protein, 9 aa, Homo Sapiens
YILATWAVP

SEQ ID NO: 143092 - protein, 9 aa, Homo Sapiens
NAAARRATL

SEQ ID NO: 143093 - protein, 9 aa, Homo Sapiens
QTTSIPSIP

SEQ ID NO: 143094 - protein, 9 aa, Homo Sapiens
DLDPLLGVV

SEQ ID NO: 143095 - protein, 9 aa, Homo Sapiens
SGASRNVVW

SEQ ID NO: 143096 - protein, 9 aa, Homo Sapiens
VEEDFQPFW

SEQ ID NO: 143097 - protein, 9 aa, Homo Sapiens
KKIFGDASA

SEQ ID NO: 143098 - protein, 9 aa, Homo Sapiens
PTVHGLLRQ

SEQ ID NO: 143099 - protein, 9 aa, Homo Sapiens
RLSQAGRQQ

SEQ ID NO: 143100 - protein, 9 aa, Homo Sapiens
SRLWERELS

SEQ ID NO: 143101 - protein, 9 aa, Homo Sapiens
NGDPLLRRL

SEQ ID NO: 143102 - protein, 9 aa, Homo Sapiens
SCLPSCNNR

SEQ ID NO: 143103 - protein, 9 aa, Homo Sapiens
TAQKTEEAW

SEQ ID NO: 143104 - protein, 9 aa, Homo Sapiens
GPWGLMKGH

SEQ ID NO: 143105 - protein, 9 aa, Homo Sapiens
LSLWTCLGL

SEQ ID NO: 143106 - protein, 9 aa, Homo Sapiens
SARSPTSSP

SEQ ID NO: 143107 - protein, 9 aa, Homo Sapiens
ERAGSSRPT

SEQ ID NO: 143108 - protein, 9 aa, Homo Sapiens
RGVFAVQTG

SEQ ID NO: 143109 - protein, 9 aa, Homo Sapiens
KLPGLAVHQ

SEQ ID NO: 143110 - protein, 9 aa, Homo Sapiens
MAADRAWGL

SEQ ID NO: 143111 - protein, 9 aa, Homo Sapiens
PRPQSERAG

SEQ ID NO: 143112 - protein, 9 aa, Homo Sapiens
REDPPMSLH

SEQ ID NO: 143113 - protein, 9 aa, Homo Sapiens
SSLKPGALT

SEQ ID NO: 143114 - protein, 9 aa, Homo Sapiens
ERSIIGMIN

SEQ ID NO: 143115 - protein, 9 aa, Homo Sapiens
FDADVRQWK

SEQ ID NO: 143116 - protein, 9 aa, Homo Sapiens
GSASLDSQQ

SEQ ID NO: 143117 - protein, 9 aa, Homo Sapiens
EMPLIIMGR

SEQ ID NO: 143118 - protein, 9 aa, Homo Sapiens
PELLLEHCI

SEQ ID NO: 143119 - protein, 9 aa, Homo Sapiens
PQVIPVLPS

SEQ ID NO: 143120 - protein, 9 aa, Homo Sapiens
PRLPRSSRR

SEQ ID NO: 143121 - protein, 9 aa, Homo Sapiens
AGKQLEDGS

SEQ ID NO: 143122 - protein, 9 aa, Homo Sapiens
LGTTKESHP

SEQ ID NO: 143123 - protein, 9 aa, Homo Sapiens
ALREKKFGL

SEQ ID NO: 143124 - protein, 9 aa, Homo Sapiens
ANMGGSRPE

SEQ ID NO: 143125 - protein, 9 aa, Homo Sapiens
PREYYMQQE

SEQ ID NO: 143126 - protein, 9 aa, Homo Sapiens
RARSSCWPP

SEQ ID NO: 143127 - protein, 9 aa, Homo Sapiens
VVKVPSGVQ

SEQ ID NO: 143128 - protein, 9 aa, Homo Sapiens
ITGEIRPRK

SEQ ID NO: 143129 - protein, 9 aa, Homo Sapiens
PRLFWVASK

SEQ ID NO: 143130 - protein, 9 aa, Homo Sapiens
PGPPLPSSR

SEQ ID NO: 143131 - protein, 9 aa, Homo Sapiens
RSCFSQQEK

SEQ ID NO: 143132 - protein, 9 aa, Homo Sapiens
RHLLRFLRV

SEQ ID NO: 143133 - protein, 9 aa, Homo Sapiens
LQQEFENKL

SEQ ID NO: 143134 - protein, 9 aa, Homo Sapiens
SLRRSPGSL

SEQ ID NO: 143135 - protein, 9 aa, Homo Sapiens
MSCVSPWAT

SEQ ID NO: 143136 - protein, 9 aa, Homo Sapiens
PYKPLDIPD

SEQ ID NO: 143137 - protein, 9 aa, Homo Sapiens
LRLGPHGGQ

SEQ ID NO: 143138 - protein, 9 aa, Homo Sapiens
SACGSHLAV

SEQ ID NO: 143139 - protein, 9 aa, Homo Sapiens
GMVEGGVSG

SEQ ID NO: 143140 - protein, 9 aa, Homo Sapiens
SPLAFEALN

SEQ ID NO: 143141 - protein, 9 aa, Homo Sapiens
LFYQGPGWE

SEQ ID NO: 143142 - protein, 9 aa, Homo Sapiens
RQAQDIEAT

SEQ ID NO: 143143 - protein, 9 aa, Homo Sapiens
GTRKASAAS

SEQ ID NO: 143144 - protein, 9 aa, Homo Sapiens
WHNSEEKKF

SEQ ID NO: 143145 - protein, 9 aa, Homo Sapiens
TLHKLQALT

SEQ ID NO: 143146 - protein, 9 aa, Homo Sapiens
AALSPANPQ

SEQ ID NO: 143147 - protein, 9 aa, Homo Sapiens
GCLKRTGHS

SEQ ID NO: 143148 - protein, 9 aa, Homo Sapiens
GDVREPRKI

SEQ ID NO: 143149 - protein, 9 aa, Homo Sapiens
KYNNSVDVY

SEQ ID NO: 143150 - protein, 9 aa, Homo Sapiens
IPWTGACPA

SEQ ID NO: 143151 - protein, 9 aa, Homo Sapiens
ADDVTLTKH

SEQ ID NO: 143152 - protein, 9 aa, Homo Sapiens
PGCRPAAFP

SEQ ID NO: 143153 - protein, 9 aa, Homo Sapiens
ITSSQYSSG

SEQ ID NO: 143154 - protein, 9 aa, Homo Sapiens
HPLHPPHLV

SEQ ID NO: 143155 - protein, 9 aa, Homo Sapiens
LTRATSPGA

SEQ ID NO: 143156 - protein, 9 aa, Homo Sapiens
PPCSSTSTT

SEQ ID NO: 143157 - protein, 9 aa, Homo Sapiens
QLGHHIGPR

SEQ ID NO: 143158 - protein, 9 aa, Homo Sapiens
NGHTLPMPR

SEQ ID NO: 143159 - protein, 9 aa, Homo Sapiens
IKRYQESLG

SEQ ID NO: 143160 - protein, 9 aa, Homo Sapiens
SGRQSPSPA

SEQ ID NO: 143161 - protein, 9 aa, Homo Sapiens
PGLYGEGGA

SEQ ID NO: 143162 - protein, 9 aa, Homo Sapiens
FSASIAEGA

SEQ ID NO: 143163 - protein, 9 aa, Homo Sapiens
VLSITSSRY

SEQ ID NO: 143164 - protein, 9 aa, Homo Sapiens
CHLLPLSDL

SEQ ID NO: 143165 - protein, 9 aa, Homo Sapiens
HISNTDNIP

SEQ ID NO: 143166 - protein, 9 aa, Homo Sapiens
LLLVVFYIN

SEQ ID NO: 143167 - protein, 9 aa, Homo Sapiens
LFQILCILL

SEQ ID NO: 143168 - protein, 9 aa, Homo Sapiens
QDALHWKNV

SEQ ID NO: 143169 - protein, 9 aa, Homo Sapiens
YLLGLDDHL

SEQ ID NO: 143170 - protein, 9 aa, Homo Sapiens
LPWIPKRNA

SEQ ID NO: 143171 - protein, 9 aa, Homo Sapiens
CCGPRDLDW

SEQ ID NO: 143172 - protein, 9 aa, Homo Sapiens
NEGVWEKEN

SEQ ID NO: 143173 - protein, 9 aa, Homo Sapiens
RIVDKVKEC

SEQ ID NO: 143174 - protein, 9 aa, Homo Sapiens
SLRRQNMSL

SEQ ID NO: 143175 - protein, 9 aa, Homo Sapiens
LRQLGKGTE

SEQ ID NO: 143176 - protein, 9 aa, Homo Sapiens
YVNPQHVES

SEQ ID NO: 143177 - protein, 9 aa, Homo Sapiens
IEYRRAEKE

SEQ ID NO: 143178 - protein, 9 aa, Homo Sapiens
LGAPPVLHC

SEQ ID NO: 143179 - protein, 9 aa, Homo Sapiens
LVRTEIVCW

SEQ ID NO: 143180 - protein, 9 aa, Homo Sapiens
GRAVGTALV

SEQ ID NO: 143181 - protein, 9 aa, Homo Sapiens
KGEKGIDGP

SEQ ID NO: 143182 - protein, 9 aa, Homo Sapiens
ALSPVACPQ

SEQ ID NO: 143183 - protein, 9 aa, Homo Sapiens
PQGCWGCCG

SEQ ID NO: 143184 - protein, 9 aa, Homo Sapiens
ARPGQQRVL

SEQ ID NO: 143185 - protein, 9 aa, Homo Sapiens
RANGATGSV

SEQ ID NO: 143186 - protein, 9 aa, Homo Sapiens
GDSEAPMEE

SEQ ID NO: 143187 - protein, 9 aa, Homo Sapiens
SPHSDGGDP

SEQ ID NO: 143188 - protein, 9 aa, Homo Sapiens
KRSHLCNNP

SEQ ID NO: 143189 - protein, 9 aa, Homo Sapiens
FTKQVLKGS

SEQ ID NO: 143190 - protein, 9 aa, Homo Sapiens
IDHILESLE

SEQ ID NO: 143191 - protein, 9 aa, Homo Sapiens
CRRHQPVVV

SEQ ID NO: 143192 - protein, 9 aa, Homo Sapiens
DFLWNDYIP

SEQ ID NO: 143193 - protein, 9 aa, Homo Sapiens
RTRPNRVLT

SEQ ID NO: 143194 - protein, 9 aa, Homo Sapiens
VNGMSDSSL

SEQ ID NO: 143195 - protein, 9 aa, Homo Sapiens
AAAAPSRPA

SEQ ID NO: 143196 - protein, 9 aa, Homo Sapiens
GRLAAPSLA

SEQ ID NO: 143197 - protein, 9 aa, Homo Sapiens
HTVATFQPS

SEQ ID NO: 143198 - protein, 9 aa, Homo Sapiens
GPALREKKF

SEQ ID NO: 143199 - protein, 9 aa, Homo Sapiens
TDAAHMSAS

SEQ ID NO: 143200 - protein, 9 aa, Homo Sapiens
RKETTARSV

SEQ ID NO: 143201 - protein, 9 aa, Homo Sapiens
SETGSHQQL

SEQ ID NO: 143202 - protein, 9 aa, Homo Sapiens
PTRTPLATN

SEQ ID NO: 143203 - protein, 9 aa, Homo Sapiens
PETCAHNRT

SEQ ID NO: 143204 - protein, 9 aa, Homo Sapiens
QPPHHLVPL

SEQ ID NO: 143205 - protein, 9 aa, Homo Sapiens
RTRRRWSSK

SEQ ID NO: 143206 - protein, 9 aa, Homo Sapiens
AHQRTGRQH

SEQ ID NO: 143207 - protein, 9 aa, Homo Sapiens
EEIMSYVHP

SEQ ID NO: 143208 - protein, 9 aa, Homo Sapiens
NLASAYKVP

SEQ ID NO: 143209 - protein, 9 aa, Homo Sapiens
YHKTKSFLL

SEQ ID NO: 143210 - protein, 9 aa, Homo Sapiens
WQMGIGMKP

SEQ ID NO: 143211 - protein, 9 aa, Homo Sapiens
SPCVDNCGP

SEQ ID NO: 143212 - protein, 9 aa, Homo Sapiens
ELAARATAL

SEQ ID NO: 143213 - protein, 9 aa, Homo Sapiens
GPVFLLGLW

SEQ ID NO: 143214 - protein, 9 aa, Homo Sapiens
DQIQWPTVH

SEQ ID NO: 143215 - protein, 9 aa, Homo Sapiens
PAARPPGVQ

SEQ ID NO: 143216 - protein, 9 aa, Homo Sapiens
IQSDENGIP

SEQ ID NO: 143217 - protein, 9 aa, Homo Sapiens
LQGSKVANV

SEQ ID NO: 143218 - protein, 9 aa, Homo Sapiens
HCSPLPRPF

SEQ ID NO: 143219 - protein, 9 aa, Homo Sapiens
NAGYSVRAK

SEQ ID NO: 143220 - protein, 9 aa, Homo Sapiens
RGTASAGRR

SEQ ID NO: 143221 - protein, 9 aa, Homo Sapiens
LSAGCDPRR

SEQ ID NO: 143222 - protein, 9 aa, Homo Sapiens
RKTLPILFG

SEQ ID NO: 143223 - protein, 9 aa, Homo Sapiens
CGRAFCERP

SEQ ID NO: 143224 - protein, 9 aa, Homo Sapiens
GYPHNILRD

SEQ ID NO: 143225 - protein, 9 aa, Homo Sapiens
VPQFLPRSL

SEQ ID NO: 143226 - protein, 9 aa, Homo Sapiens
CAAQLAREI

SEQ ID NO: 143227 - protein, 9 aa, Homo Sapiens
DVRTAPLLA

SEQ ID NO: 143228 - protein, 9 aa, Homo Sapiens
FRVGTSDRG

SEQ ID NO: 143229 - protein, 9 aa, Homo Sapiens
IGGIYTSAM

SEQ ID NO: 143230 - protein, 9 aa, Homo Sapiens
PMQAALLRI

SEQ ID NO: 143231 - protein, 9 aa, Homo Sapiens
LLVDDRQGV

SEQ ID NO: 143232 - protein, 9 aa, Homo Sapiens
ERRRWPRDS

SEQ ID NO: 143233 - protein, 9 aa, Homo Sapiens
RRRTWWRTR

SEQ ID NO: 143234 - protein, 9 aa, Homo Sapiens
MAAAAPSRP

SEQ ID NO: 143235 - protein, 9 aa, Homo Sapiens
PGVIKQKVL

SEQ ID NO: 143236 - protein, 9 aa, Homo Sapiens
CYLHHWNYL

SEQ ID NO: 143237 - protein, 9 aa, Homo Sapiens
GATGSVQPV

SEQ ID NO: 143238 - protein, 9 aa, Homo Sapiens
LHSVPLCFV

SEQ ID NO: 143239 - protein, 9 aa, Homo Sapiens
LVPPGADQH

SEQ ID NO: 143240 - protein, 9 aa, Homo Sapiens
PPQRPPLQP

SEQ ID NO: 143241 - protein, 9 aa, Homo Sapiens
DDVVGGRQT

SEQ ID NO: 143242 - protein, 9 aa, Homo Sapiens
SSSKSDSDT

SEQ ID NO: 143243 - protein, 9 aa, Homo Sapiens
VRVKLAHLS

SEQ ID NO: 143244 - protein, 9 aa, Homo Sapiens
KLDHQVSEV

SEQ ID NO: 143245 - protein, 9 aa, Homo Sapiens
RLPPPCPSR

SEQ ID NO: 143246 - protein, 9 aa, Homo Sapiens
KSSKKRCDK

SEQ ID NO: 143247 - protein, 9 aa, Homo Sapiens
AQTAVVLVW

SEQ ID NO: 143248 - protein, 9 aa, Homo Sapiens
PGGRLGAGA

SEQ ID NO: 143249 - protein, 9 aa, Homo Sapiens
DPHLLKEKV

SEQ ID NO: 143250 - protein, 9 aa, Homo Sapiens
KILEKLMTR

SEQ ID NO: 143251 - protein, 9 aa, Homo Sapiens
SSNFLTTKS

SEQ ID NO: 143252 - protein, 9 aa, Homo Sapiens
FRRYSSTFP

SEQ ID NO: 143253 - protein, 9 aa, Homo Sapiens
TILINPENM

SEQ ID NO: 143254 - protein, 9 aa, Homo Sapiens
GGGCFAATV

SEQ ID NO: 143255 - protein, 9 aa, Homo Sapiens
LEDGSSLSD

SEQ ID NO: 143256 - protein, 9 aa, Homo Sapiens
RLGPRPHSH

SEQ ID NO: 143257 - protein, 9 aa, Homo Sapiens
DHVPRIDRI

SEQ ID NO: 143258 - protein, 9 aa, Homo Sapiens
HLRDLSLCA

SEQ ID NO: 143259 - protein, 9 aa, Homo Sapiens
PIPWLNWSS

SEQ ID NO: 143260 - protein, 9 aa, Homo Sapiens
FALLSWGRR

SEQ ID NO: 143261 - protein, 9 aa, Homo Sapiens
DTGILYVLR

SEQ ID NO: 143262 - protein, 9 aa, Homo Sapiens
PFQNTGAQG

SEQ ID NO: 143263 - protein, 9 aa, Homo Sapiens
SAKSRFKEQ

SEQ ID NO: 143264 - protein, 9 aa, Homo Sapiens
GGRSPTTTA

SEQ ID NO: 143265 - protein, 9 aa, Homo Sapiens
PPSKNPPQP

SEQ ID NO: 143266 - protein, 9 aa, Homo Sapiens
TLNRYLKVV

SEQ ID NO: 143267 - protein, 9 aa, Homo Sapiens
SAFELASLW

SEQ ID NO: 143268 - protein, 9 aa, Homo Sapiens
LQRRQFLAK

SEQ ID NO: 143269 - protein, 9 aa, Homo Sapiens
PHHRRRLRA

SEQ ID NO: 143270 - protein, 9 aa, Homo Sapiens
RDKRRKPLV

SEQ ID NO: 143271 - protein, 9 aa, Homo Sapiens
PCLECPSWK

SEQ ID NO: 143272 - protein, 9 aa, Homo Sapiens
HSFKTKDTH

SEQ ID NO: 143273 - protein, 9 aa, Homo Sapiens
RVPDQEPTH

SEQ ID NO: 143274 - protein, 9 aa, Homo Sapiens
ALLDTECSL

SEQ ID NO: 143275 - protein, 9 aa, Homo Sapiens
KTIDDHKTN

SEQ ID NO: 143276 - protein, 9 aa, Homo Sapiens
NTFQEEGNG

SEQ ID NO: 143277 - protein, 9 aa, Homo Sapiens
VYMVTQGRK

SEQ ID NO: 143278 - protein, 9 aa, Homo Sapiens
APAPPLFLP

SEQ ID NO: 143279 - protein, 9 aa, Homo Sapiens
SPVSLPELP

SEQ ID NO: 143280 - protein, 9 aa, Homo Sapiens
AARAHQRTG

SEQ ID NO: 143281 - protein, 9 aa, Homo Sapiens
SPLRPAFPV

SEQ ID NO: 143282 - protein, 9 aa, Homo Sapiens
TQTQTHTHT

SEQ ID NO: 143283 - protein, 9 aa, Homo Sapiens
DSVLLIPRT

SEQ ID NO: 143284 - protein, 9 aa, Homo Sapiens
LVRHGTGPV

SEQ ID NO: 143285 - protein, 9 aa, Homo Sapiens
GVEVEVTIV

SEQ ID NO: 143286 - protein, 9 aa, Homo Sapiens
WSAGEWSLC

SEQ ID NO: 143287 - protein, 9 aa, Homo Sapiens
TLQRTPCSR

SEQ ID NO: 143288 - protein, 9 aa, Homo Sapiens
EQELELEAR

SEQ ID NO: 143289 - protein, 9 aa, Homo Sapiens
ALPRATGCW

SEQ ID NO: 143290 - protein, 9 aa, Homo Sapiens
AFLRSCHGD

SEQ ID NO: 143291 - protein, 9 aa, Homo Sapiens
VCDMHPLLE

SEQ ID NO: 143292 - protein, 9 aa, Homo Sapiens
GGCFAATVH

SEQ ID NO: 143293 - protein, 9 aa, Homo Sapiens
CVETSSWTI

SEQ ID NO: 143294 - protein, 9 aa, Homo Sapiens
KEGSYVSVP

SEQ ID NO: 143295 - protein, 9 aa, Homo Sapiens
ESPALKQVS

SEQ ID NO: 143296 - protein, 9 aa, Homo Sapiens
PLFLPPLQP

SEQ ID NO: 143297 - protein, 9 aa, Homo Sapiens
PAVCGDHQP

SEQ ID NO: 143298 - protein, 9 aa, Homo Sapiens
RLHSVPLCF

SEQ ID NO: 143299 - protein, 9 aa, Homo Sapiens
IAKMPMDKP

SEQ ID NO: 143300 - protein, 9 aa, Homo Sapiens
TSSPEASLR

SEQ ID NO: 143301 - protein, 9 aa, Homo Sapiens
AALTAAAAA

SEQ ID NO: 143302 - protein, 9 aa, Homo Sapiens
VNSSHDTFM

SEQ ID NO: 143303 - protein, 9 aa, Homo Sapiens
STARWRTTR

SEQ ID NO: 143304 - protein, 9 aa, Homo Sapiens
PVSVWLQCG

SEQ ID NO: 143305 - protein, 9 aa, Homo Sapiens
AAVAAARCK

SEQ ID NO: 143306 - protein, 9 aa, Homo Sapiens
GPNSEMDHV

SEQ ID NO: 143307 - protein, 9 aa, Homo Sapiens
EWNEDCNFK

SEQ ID NO: 143308 - protein, 9 aa, Homo Sapiens
PTPSTCLGG

SEQ ID NO: 143309 - protein, 9 aa, Homo Sapiens
GSLPKKINS

SEQ ID NO: 143310 - protein, 9 aa, Homo Sapiens
RKGAQLGGG

SEQ ID NO: 143311 - protein, 9 aa, Homo Sapiens
SLLRNNGQS

SEQ ID NO: 143312 - protein, 9 aa, Homo Sapiens
RDSFQMNNG

SEQ ID NO: 143313 - protein, 9 aa, Homo Sapiens
IRKFIVQIN

SEQ ID NO: 143314 - protein, 9 aa, Homo Sapiens
YVELDREDD

SEQ ID NO: 143315 - protein, 9 aa, Homo Sapiens
SPCSPTTPS

SEQ ID NO: 143316 - protein, 9 aa, Homo Sapiens
MENSTQWLM

SEQ ID NO: 143317 - protein, 9 aa, Homo Sapiens
TGGIFEPSI

SEQ ID NO: 143318 - protein, 9 aa, Homo Sapiens
NAKNLSEVA

SEQ ID NO: 143319 - protein, 9 aa, Homo Sapiens
AIMEATVQN

SEQ ID NO: 143320 - protein, 9 aa, Homo Sapiens
EQQDTYEFF

SEQ ID NO: 143321 - protein, 9 aa, Homo Sapiens
HRHLRFPPM

SEQ ID NO: 143322 - protein, 9 aa, Homo Sapiens
YILSREFGK

SEQ ID NO: 143323 - protein, 9 aa, Homo Sapiens
QVRHSLGFC

SEQ ID NO: 143324 - protein, 9 aa, Homo Sapiens
GKEGIYKAH

SEQ ID NO: 143325 - protein, 9 aa, Homo Sapiens
RRCCLRTSC

SEQ ID NO: 143326 - protein, 9 aa, Homo Sapiens
PRSCTWPLL

SEQ ID NO: 143327 - protein, 9 aa, Homo Sapiens
PSLSILSPA

SEQ ID NO: 143328 - protein, 9 aa, Homo Sapiens
KGGEYLKEQ

SEQ ID NO: 143329 - protein, 9 aa, Homo Sapiens
HPGHFPLQV

SEQ ID NO: 143330 - protein, 9 aa, Homo Sapiens
HHAALKEEV

SEQ ID NO: 143331 - protein, 9 aa, Homo Sapiens
LAFEALNLS

SEQ ID NO: 143332 - protein, 9 aa, Homo Sapiens
TPHVPHARG

SEQ ID NO: 143333 - protein, 9 aa, Homo Sapiens
HVPKVTAAH

SEQ ID NO: 143334 - protein, 9 aa, Homo Sapiens
GGARSGFGF

SEQ ID NO: 143335 - protein, 9 aa, Homo Sapiens
WFHASVRRL

SEQ ID NO: 143336 - protein, 9 aa, Homo Sapiens
DPPMSLHTV

SEQ ID NO: 143337 - protein, 9 aa, Homo Sapiens
ERERTNQSG

SEQ ID NO: 143338 - protein, 9 aa, Homo Sapiens
LFWDASGVC

SEQ ID NO: 143339 - protein, 9 aa, Homo Sapiens
HLGIHIVGP

SEQ ID NO: 143340 - protein, 9 aa, Homo Sapiens
ISMETLKVI

SEQ ID NO: 143341 - protein, 9 aa, Homo Sapiens
LRCIQTLCC

SEQ ID NO: 143342 - protein, 9 aa, Homo Sapiens
EDQGVWQGG

SEQ ID NO: 143343 - protein, 9 aa, Homo Sapiens
SCLMDSAWS

SEQ ID NO: 143344 - protein, 9 aa, Homo Sapiens
GRVRGRDAP

SEQ ID NO: 143345 - protein, 9 aa, Homo Sapiens
GVVVVGFPV

SEQ ID NO: 143346 - protein, 9 aa, Homo Sapiens
RSLRPGGDV

SEQ ID NO: 143347 - protein, 9 aa, Homo Sapiens
ELTLPLMSA

SEQ ID NO: 143348 - protein, 9 aa, Homo Sapiens
NPSEDPHLL

SEQ ID NO: 143349 - protein, 9 aa, Homo Sapiens
SKEGSYVSV

SEQ ID NO: 143350 - protein, 9 aa, Homo Sapiens
GREWDLSES

SEQ ID NO: 143351 - protein, 9 aa, Homo Sapiens
LFLRRKMEA

SEQ ID NO: 143352 - protein, 9 aa, Homo Sapiens
LTDGTTKTG

SEQ ID NO: 143353 - protein, 9 aa, Homo Sapiens
PPPPPPHPP

SEQ ID NO: 143354 - protein, 9 aa, Homo Sapiens
SPGPGLRPG

SEQ ID NO: 143355 - protein, 9 aa, Homo Sapiens
DTPQPSLPG

SEQ ID NO: 143356 - protein, 9 aa, Homo Sapiens
EWEIPGSLS

SEQ ID NO: 143357 - protein, 9 aa, Homo Sapiens
KLGREPHSP

SEQ ID NO: 143358 - protein, 9 aa, Homo Sapiens
VMVIINTFC

SEQ ID NO: 143359 - protein, 9 aa, Homo Sapiens
NSHPPTTTT

SEQ ID NO: 143360 - protein, 9 aa, Homo Sapiens
MPHLQKVFD

SEQ ID NO: 143361 - protein, 9 aa, Homo Sapiens
LLLLVVFYI

SEQ ID NO: 143362 - protein, 9 aa, Homo Sapiens
QQWHGLANS

SEQ ID NO: 143363 - protein, 9 aa, Homo Sapiens
RHGPYPAAS

SEQ ID NO: 143364 - protein, 9 aa, Homo Sapiens
PTDTVMIHP

SEQ ID NO: 143365 - protein, 9 aa, Homo Sapiens
LMAPWSLAE

SEQ ID NO: 143366 - protein, 9 aa, Homo Sapiens
PCPNLLPAP

SEQ ID NO: 143367 - protein, 9 aa, Homo Sapiens
KANRMSNSK

SEQ ID NO: 143368 - protein, 9 aa, Homo Sapiens
PNHYCEAAF

SEQ ID NO: 143369 - protein, 9 aa, Homo Sapiens
APGQALDKI

SEQ ID NO: 143370 - protein, 9 aa, Homo Sapiens
KRYIRRRAA

SEQ ID NO: 143371 - protein, 9 aa, Homo Sapiens
LGMVSNIIE

SEQ ID NO: 143372 - protein, 9 aa, Homo Sapiens
PVAGPPCPA

SEQ ID NO: 143373 - protein, 9 aa, Homo Sapiens
RSPGHPRGS

SEQ ID NO: 143374 - protein, 9 aa, Homo Sapiens
GCPHPPVSP

SEQ ID NO: 143375 - protein, 9 aa, Homo Sapiens
AAVGSQPCL

SEQ ID NO: 143376 - protein, 9 aa, Homo Sapiens
LLLHPCLDI

SEQ ID NO: 143377 - protein, 9 aa, Homo Sapiens
NGEAARECR

SEQ ID NO: 143378 - protein, 9 aa, Homo Sapiens
KPSARSPTW

SEQ ID NO: 143379 - protein, 9 aa, Homo Sapiens
GGRGQSAKS

SEQ ID NO: 143380 - protein, 9 aa, Homo Sapiens
SSASLGREW

SEQ ID NO: 143381 - protein, 9 aa, Homo Sapiens
LTRKPKGSL

SEQ ID NO: 143382 - protein, 9 aa, Homo Sapiens
SRSNSPRRP

SEQ ID NO: 143383 - protein, 9 aa, Homo Sapiens
RGPSPSPPA

SEQ ID NO: 143384 - protein, 9 aa, Homo Sapiens
CKAGGPWRM

SEQ ID NO: 143385 - protein, 9 aa, Homo Sapiens
ILLCSRSLR

SEQ ID NO: 143386 - protein, 9 aa, Homo Sapiens
GDPGRAPQG

SEQ ID NO: 143387 - protein, 9 aa, Homo Sapiens
RLMGPWHLC

SEQ ID NO: 143388 - protein, 9 aa, Homo Sapiens
APPPPAVSS

SEQ ID NO: 143389 - protein, 9 aa, Homo Sapiens
RRLGSCTAP

SEQ ID NO: 143390 - protein, 9 aa, Homo Sapiens
SPAPSAGRT

SEQ ID NO: 143391 - protein, 9 aa, Homo Sapiens
FSWLPQRCN

SEQ ID NO: 143392 - protein, 9 aa, Homo Sapiens
AGRIGGNFR

SEQ ID NO: 143393 - protein, 9 aa, Homo Sapiens
SALLADAPC

SEQ ID NO: 143394 - protein, 9 aa, Homo Sapiens
KTGGSTAPG

SEQ ID NO: 143395 - protein, 9 aa, Homo Sapiens
KVCVLPTVS

SEQ ID NO: 143396 - protein, 9 aa, Homo Sapiens
AFSSSSSAS

SEQ ID NO: 143397 - protein, 9 aa, Homo Sapiens
IVPAHGPTN

SEQ ID NO: 143398 - protein, 9 aa, Homo Sapiens
RTQGSRPCH

SEQ ID NO: 143399 - protein, 9 aa, Homo Sapiens
EEFDCLIND

SEQ ID NO: 143400 - protein, 9 aa, Homo Sapiens
FRHAPPPRM

SEQ ID NO: 143401 - protein, 9 aa, Homo Sapiens
CIAIKWMPP

SEQ ID NO: 143402 - protein, 9 aa, Homo Sapiens
HVPHARGRP

SEQ ID NO: 143403 - protein, 9 aa, Homo Sapiens
PCPFSTVKG

SEQ ID NO: 143404 - protein, 9 aa, Homo Sapiens
KVHFSQACY

SEQ ID NO: 143405 - protein, 9 aa, Homo Sapiens
DVLRHVAGE

SEQ ID NO: 143406 - protein, 9 aa, Homo Sapiens
GLEPQAGGP

SEQ ID NO: 143407 - protein, 9 aa, Homo Sapiens
GGGGSWSSA

SEQ ID NO: 143408 - protein, 9 aa, Homo Sapiens
GQRREHVLK

SEQ ID NO: 143409 - protein, 9 aa, Homo Sapiens
AQWGPNLSP

SEQ ID NO: 143410 - protein, 9 aa, Homo Sapiens
EDEEKMKVG

SEQ ID NO: 143411 - protein, 9 aa, Homo Sapiens
TTKTGAAWS

SEQ ID NO: 143412 - protein, 9 aa, Homo Sapiens
PLTKQLWEG

SEQ ID NO: 143413 - protein, 9 aa, Homo Sapiens
DIKYNREIS

SEQ ID NO: 143414 - protein, 9 aa, Homo Sapiens
CVVSFCLSA

SEQ ID NO: 143415 - protein, 9 aa, Homo Sapiens
VVWSSSISG

SEQ ID NO: 143416 - protein, 9 aa, Homo Sapiens
MAALTAAAA

SEQ ID NO: 143417 - protein, 9 aa, Homo Sapiens
TVASITTAA

SEQ ID NO: 143418 - protein, 9 aa, Homo Sapiens
HKLESPALK

SEQ ID NO: 143419 - protein, 9 aa, Homo Sapiens
VQIQSQSST

SEQ ID NO: 143420 - protein, 9 aa, Homo Sapiens
GTGGTSPAK

SEQ ID NO: 143421 - protein, 9 aa, Homo Sapiens
WLSVSAAGV

SEQ ID NO: 143422 - protein, 9 aa, Homo Sapiens
TENIKEMSL

SEQ ID NO: 143423 - protein, 9 aa, Homo Sapiens
ASAYKVPVT

SEQ ID NO: 143424 - protein, 9 aa, Homo Sapiens
VHPVSPMRL

SEQ ID NO: 143425 - protein, 9 aa, Homo Sapiens
GCSFLTLPF

SEQ ID NO: 143426 - protein, 9 aa, Homo Sapiens
FLKGQIIRE

SEQ ID NO: 143427 - protein, 9 aa, Homo Sapiens
SMKDHSSGN

SEQ ID NO: 143428 - protein, 9 aa, Homo Sapiens
ISLAEVCQS

SEQ ID NO: 143429 - protein, 9 aa, Homo Sapiens
NVKHMHQLL

SEQ ID NO: 143430 - protein, 9 aa, Homo Sapiens
SGAGKSETC

SEQ ID NO: 143431 - protein, 9 aa, Homo Sapiens
PPQESTRVD

SEQ ID NO: 143432 - protein, 9 aa, Homo Sapiens
VDTVRVMEV

SEQ ID NO: 143433 - protein, 9 aa, Homo Sapiens
CQLTAHLQD

SEQ ID NO: 143434 - protein, 9 aa, Homo Sapiens
LQNDPQLPF

SEQ ID NO: 143435 - protein, 9 aa, Homo Sapiens
RQQPSASLA

SEQ ID NO: 143436 - protein, 9 aa, Homo Sapiens
VGDVGLGVQ

SEQ ID NO: 143437 - protein, 9 aa, Homo Sapiens
SQNEISPSK

SEQ ID NO: 143438 - protein, 9 aa, Homo Sapiens
AQEDAHHRN

SEQ ID NO: 143439 - protein, 9 aa, Homo Sapiens
SKRLAIPCK

SEQ ID NO: 143440 - protein, 9 aa, Homo Sapiens
LWSLRTARH

SEQ ID NO: 143441 - protein, 9 aa, Homo Sapiens
GIGTPTAGP

SEQ ID NO: 143442 - protein, 9 aa, Homo Sapiens
MTHPRTATS

SEQ ID NO: 143443 - protein, 9 aa, Homo Sapiens
YSSGLRPCL

SEQ ID NO: 143444 - protein, 9 aa, Homo Sapiens
QVVRAREAL

SEQ ID NO: 143445 - protein, 9 aa, Homo Sapiens
DPEINPSAP

SEQ ID NO: 143446 - protein, 9 aa, Homo Sapiens
ETISRFWAL

SEQ ID NO: 143447 - protein, 9 aa, Homo Sapiens
YAKKEWNED

SEQ ID NO: 143448 - protein, 9 aa, Homo Sapiens
QNTGAQGRG

SEQ ID NO: 143449 - protein, 9 aa, Homo Sapiens
RMNTHVLHP

SEQ ID NO: 143450 - protein, 9 aa, Homo Sapiens
HMFETDDGS

SEQ ID NO: 143451 - protein, 9 aa, Homo Sapiens
RRPGGRSPT

SEQ ID NO: 143452 - protein, 9 aa, Homo Sapiens
CVQKVTSSL

SEQ ID NO: 143453 - protein, 9 aa, Homo Sapiens
PMVPGETGL

SEQ ID NO: 143454 - protein, 9 aa, Homo Sapiens
GVFAVQTGK

SEQ ID NO: 143455 - protein, 9 aa, Homo Sapiens
CPGRNAWWL

SEQ ID NO: 143456 - protein, 9 aa, Homo Sapiens
WILGDVFIC

SEQ ID NO: 143457 - protein, 9 aa, Homo Sapiens
GQVVYRSLG

SEQ ID NO: 143458 - protein, 9 aa, Homo Sapiens
PCASRAPRL

SEQ ID NO: 143459 - protein, 9 aa, Homo Sapiens
QSLMQAHLL

SEQ ID NO: 143460 - protein, 9 aa, Homo Sapiens
VAGVWRARQ

SEQ ID NO: 143461 - protein, 9 aa, Homo Sapiens
IAGSLLRNN

SEQ ID NO: 143462 - protein, 9 aa, Homo Sapiens
PPSAIGPRS

SEQ ID NO: 143463 - protein, 9 aa, Homo Sapiens
HGFMDLVCI

SEQ ID NO: 143464 - protein, 9 aa, Homo Sapiens
STSDSEEGD

SEQ ID NO: 143465 - protein, 9 aa, Homo Sapiens
SCKKQAASM

SEQ ID NO: 143466 - protein, 9 aa, Homo Sapiens
GQGPLHLGT

SEQ ID NO: 143467 - protein, 9 aa, Homo Sapiens
RRSSPSLCS

SEQ ID NO: 143468 - protein, 9 aa, Homo Sapiens
ISHLMKWAH

SEQ ID NO: 143469 - protein, 9 aa, Homo Sapiens
AHVVLEVVV

SEQ ID NO: 143470 - protein, 9 aa, Homo Sapiens
QMNDARHGG

SEQ ID NO: 143471 - protein, 9 aa, Homo Sapiens
HALARFAQE

SEQ ID NO: 143472 - protein, 9 aa, Homo Sapiens
SSGAGKSET

SEQ ID NO: 143473 - protein, 9 aa, Homo Sapiens
VANVAGVWR

SEQ ID NO: 143474 - protein, 9 aa, Homo Sapiens
DQAHRPDYA

SEQ ID NO: 143475 - protein, 9 aa, Homo Sapiens
STPEPHPNE

SEQ ID NO: 143476 - protein, 9 aa, Homo Sapiens
RCSLVDFQI

SEQ ID NO: 143477 - protein, 9 aa, Homo Sapiens
ETIYIVGGV

SEQ ID NO: 143478 - protein, 9 aa, Homo Sapiens
VNVASWSAD

SEQ ID NO: 143479 - protein, 9 aa, Homo Sapiens
GAASRGHRG

SEQ ID NO: 143480 - protein, 9 aa, Homo Sapiens
TGSGRRPRL

SEQ ID NO: 143481 - protein, 9 aa, Homo Sapiens
GASTPARSP

SEQ ID NO: 143482 - protein, 9 aa, Homo Sapiens
GGSTAPGVG

SEQ ID NO: 143483 - protein, 9 aa, Homo Sapiens
HSSGDLPCD

SEQ ID NO: 143484 - protein, 9 aa, Homo Sapiens
STLLSQGAE

SEQ ID NO: 143485 - protein, 9 aa, Homo Sapiens
ARLQRLGDP

SEQ ID NO: 143486 - protein, 9 aa, Homo Sapiens
SGGDSVASP

SEQ ID NO: 143487 - protein, 9 aa, Homo Sapiens
QILTAFSSL

SEQ ID NO: 143488 - protein, 9 aa, Homo Sapiens
RALPRATGC

SEQ ID NO: 143489 - protein, 9 aa, Homo Sapiens
GNTVLSITS

SEQ ID NO: 143490 - protein, 9 aa, Homo Sapiens
DNKLDADYI

SEQ ID NO: 143491 - protein, 9 aa, Homo Sapiens
QHVESRWDS

SEQ ID NO: 143492 - protein, 9 aa, Homo Sapiens
RLCGIIPGL

SEQ ID NO: 143493 - protein, 9 aa, Homo Sapiens
KWKKFWAIL

SEQ ID NO: 143494 - protein, 9 aa, Homo Sapiens
AAGASPTVC

SEQ ID NO: 143495 - protein, 9 aa, Homo Sapiens
PGDGQTRAG

SEQ ID NO: 143496 - protein, 9 aa, Homo Sapiens
KKVHHHCFH

SEQ ID NO: 143497 - protein, 9 aa, Homo Sapiens
PWPPYRAFL

SEQ ID NO: 143498 - protein, 9 aa, Homo Sapiens
DIMCQCWRK

SEQ ID NO: 143499 - protein, 9 aa, Homo Sapiens
LETKAELIQ

SEQ ID NO: 143500 - protein, 9 aa, Homo Sapiens
TSCLPLSRP

SEQ ID NO: 143501 - protein, 9 aa, Homo Sapiens
QTQKNMLSP

SEQ ID NO: 143502 - protein, 9 aa, Homo Sapiens
GEVEEEIKK

SEQ ID NO: 143503 - protein, 9 aa, Homo Sapiens
EAAAHALAR

SEQ ID NO: 143504 - protein, 9 aa, Homo Sapiens
LSRASRALC

SEQ ID NO: 143505 - protein, 9 aa, Homo Sapiens
VLSVFELLL

SEQ ID NO: 143506 - protein, 9 aa, Homo Sapiens
SLGARLSRA

SEQ ID NO: 143507 - protein, 9 aa, Homo Sapiens
AVNEAIKKG

SEQ ID NO: 143508 - protein, 9 aa, Homo Sapiens
FVTQCNTQL

SEQ ID NO: 143509 - protein, 9 aa, Homo Sapiens
YSVRAKVLI

SEQ ID NO: 143510 - protein, 9 aa, Homo Sapiens
ITPSAPSPA

SEQ ID NO: 143511 - protein, 9 aa, Homo Sapiens
RNYTHALDG

SEQ ID NO: 143512 - protein, 9 aa, Homo Sapiens
SDHKRETEC

SEQ ID NO: 143513 - protein, 9 aa, Homo Sapiens
ATAACPMTA

SEQ ID NO: 143514 - protein, 9 aa, Homo Sapiens
TKLYDIMGV

SEQ ID NO: 143515 - protein, 9 aa, Homo Sapiens
SLYSPAEED

SEQ ID NO: 143516 - protein, 9 aa, Homo Sapiens
HKHTHKHTD

SEQ ID NO: 143517 - protein, 9 aa, Homo Sapiens
DGWADRTDH

SEQ ID NO: 143518 - protein, 9 aa, Homo Sapiens
RRHRVCPQA

SEQ ID NO: 143519 - protein, 9 aa, Homo Sapiens
KQESRDHTT

SEQ ID NO: 143520 - protein, 9 aa, Homo Sapiens
STGSPIQPR

SEQ ID NO: 143521 - protein, 9 aa, Homo Sapiens
HPGIFRGDK

SEQ ID NO: 143522 - protein, 9 aa, Homo Sapiens
ANPGPAEGV

SEQ ID NO: 143523 - protein, 9 aa, Homo Sapiens
ESLHDIMCQ

SEQ ID NO: 143524 - protein, 9 aa, Homo Sapiens
LPCRSTDFT

SEQ ID NO: 143525 - protein, 9 aa, Homo Sapiens
PNPQRVMSQ

SEQ ID NO: 143526 - protein, 9 aa, Homo Sapiens
PQCRRAGRA

SEQ ID NO: 143527 - protein, 9 aa, Homo Sapiens
EDSVSSITR

SEQ ID NO: 143528 - protein, 9 aa, Homo Sapiens
PQDRPSHPG

SEQ ID NO: 143529 - protein, 9 aa, Homo Sapiens
WLMQMREFK

SEQ ID NO: 143530 - protein, 9 aa, Homo Sapiens
TLTLVDTDI

SEQ ID NO: 143531 - protein, 9 aa, Homo Sapiens
QILELEHCL

SEQ ID NO: 143532 - protein, 9 aa, Homo Sapiens
LGPRPHSHN

SEQ ID NO: 143533 - protein, 9 aa, Homo Sapiens
AGLLADTLL

SEQ ID NO: 143534 - protein, 9 aa, Homo Sapiens
VRQTAVVKK

SEQ ID NO: 143535 - protein, 9 aa, Homo Sapiens
TEEKEIEEN

SEQ ID NO: 143536 - protein, 9 aa, Homo Sapiens
SSPSLCSVT

SEQ ID NO: 143537 - protein, 9 aa, Homo Sapiens
RQLGKGTEV

SEQ ID NO: 143538 - protein, 9 aa, Homo Sapiens
RSISGRQSP

SEQ ID NO: 143539 - protein, 9 aa, Homo Sapiens
LRGPSAGLC

SEQ ID NO: 143540 - protein, 9 aa, Homo Sapiens
RAARAHQRT

SEQ ID NO: 143541 - protein, 9 aa, Homo Sapiens
IMTTKKSNI

SEQ ID NO: 143542 - protein, 9 aa, Homo Sapiens
PVHNPRVEH

SEQ ID NO: 143543 - protein, 9 aa, Homo Sapiens
FLGWTVCPF

SEQ ID NO: 143544 - protein, 9 aa, Homo Sapiens
FVALHSPFL

SEQ ID NO: 143545 - protein, 9 aa, Homo Sapiens
SAKIISNNG

SEQ ID NO: 143546 - protein, 9 aa, Homo Sapiens
ARCPRCRPR

SEQ ID NO: 143547 - protein, 9 aa, Homo Sapiens
ESCVVSFCL

SEQ ID NO: 143548 - protein, 9 aa, Homo Sapiens
PLEGAQAFV

SEQ ID NO: 143549 - protein, 9 aa, Homo Sapiens
PRDSRKWRK

SEQ ID NO: 143550 - protein, 9 aa, Homo Sapiens
LKVVLFQIL

SEQ ID NO: 143551 - protein, 9 aa, Homo Sapiens
VRHSLCELY

SEQ ID NO: 143552 - protein, 9 aa, Homo Sapiens
PPPPPPRRC

SEQ ID NO: 143553 - protein, 9 aa, Homo Sapiens
PHPDQVRTL

SEQ ID NO: 143554 - protein, 9 aa, Homo Sapiens
RWGRGGWRV

SEQ ID NO: 143555 - protein, 9 aa, Homo Sapiens
HKHTHRHTG

SEQ ID NO: 143556 - protein, 9 aa, Homo Sapiens
PPQPMGPPP

SEQ ID NO: 143557 - protein, 9 aa, Homo Sapiens
FLRPCHLLP

SEQ ID NO: 143558 - protein, 9 aa, Homo Sapiens
LRGMVPRTL

SEQ ID NO: 143559 - protein, 9 aa, Homo Sapiens
SFLLRYYSH

SEQ ID NO: 143560 - protein, 9 aa, Homo Sapiens
TSSYNFKQK

SEQ ID NO: 143561 - protein, 9 aa, Homo Sapiens
KQTRHEEIF

SEQ ID NO: 143562 - protein, 9 aa, Homo Sapiens
LWFAEGRRY

SEQ ID NO: 143563 - protein, 9 aa, Homo Sapiens
GPRDLDWEP

SEQ ID NO: 143564 - protein, 9 aa, Homo Sapiens
FYRPMGREE

SEQ ID NO: 143565 - protein, 9 aa, Homo Sapiens
GGIYTSAMA

SEQ ID NO: 143566 - protein, 9 aa, Homo Sapiens
GSQPCLECP

SEQ ID NO: 143567 - protein, 9 aa, Homo Sapiens
PLRPPGTGP

SEQ ID NO: 143568 - protein, 9 aa, Homo Sapiens
NTKDKNTAV

SEQ ID NO: 143569 - protein, 9 aa, Homo Sapiens
ASPRCPPCP

SEQ ID NO: 143570 - protein, 9 aa, Homo Sapiens
ALVTKRCAQ

SEQ ID NO: 143571 - protein, 9 aa, Homo Sapiens
GLAPAPNPQ

SEQ ID NO: 143572 - protein, 9 aa, Homo Sapiens
QLLLATLCL

SEQ ID NO: 143573 - protein, 9 aa, Homo Sapiens
FDCLINDEH

SEQ ID NO: 143574 - protein, 9 aa, Homo Sapiens
IKKGKKIIE

SEQ ID NO: 143575 - protein, 9 aa, Homo Sapiens
DKAVDDILG

SEQ ID NO: 143576 - protein, 9 aa, Homo Sapiens
ALTAAAAAT

SEQ ID NO: 143577 - protein, 9 aa, Homo Sapiens
SEGSKMAHW

SEQ ID NO: 143578 - protein, 9 aa, Homo Sapiens
GTPPQVSMV

SEQ ID NO: 143579 - protein, 9 aa, Homo Sapiens
NTYPEKIDG

SEQ ID NO: 143580 - protein, 9 aa, Homo Sapiens
IIYEMLQNI

SEQ ID NO: 143581 - protein, 9 aa, Homo Sapiens
WCTWRAAAR

SEQ ID NO: 143582 - protein, 9 aa, Homo Sapiens
LAAFMKKIF

SEQ ID NO: 143583 - protein, 9 aa, Homo Sapiens
KKSSKKRCD

SEQ ID NO: 143584 - protein, 9 aa, Homo Sapiens
ASPPTRSSS

SEQ ID NO: 143585 - protein, 9 aa, Homo Sapiens
ARSISGRQS

SEQ ID NO: 143586 - protein, 9 aa, Homo Sapiens
IHLSKFMSC

SEQ ID NO: 143587 - protein, 9 aa, Homo Sapiens
SAASGSCAW

SEQ ID NO: 143588 - protein, 9 aa, Homo Sapiens
RFWALAVDP

SEQ ID NO: 143589 - protein, 9 aa, Homo Sapiens
LGGVIMILV

SEQ ID NO: 143590 - protein, 9 aa, Homo Sapiens
ENGEIGGSQ

SEQ ID NO: 143591 - protein, 9 aa, Homo Sapiens
ALGTTKESH

SEQ ID NO: 143592 - protein, 9 aa, Homo Sapiens
GKHSFKTKD

SEQ ID NO: 143593 - protein, 9 aa, Homo Sapiens
PPQVNGHPD

SEQ ID NO: 143594 - protein, 9 aa, Homo Sapiens
FWTFSYYQI

SEQ ID NO: 143595 - protein, 9 aa, Homo Sapiens
PECFRHAPP

SEQ ID NO: 143596 - protein, 9 aa, Homo Sapiens
NCGPYGQCK

SEQ ID NO: 143597 - protein, 9 aa, Homo Sapiens
SLADTTRTS

SEQ ID NO: 143598 - protein, 9 aa, Homo Sapiens
VPTPPSSTL

SEQ ID NO: 143599 - protein, 9 aa, Homo Sapiens
ALLWRNPNG

SEQ ID NO: 143600 - protein, 9 aa, Homo Sapiens
LGTQAKELW

SEQ ID NO: 143601 - protein, 9 aa, Homo Sapiens
TGTDRNTQT

SEQ ID NO: 143602 - protein, 9 aa, Homo Sapiens
WFPETCAHN

SEQ ID NO: 143603 - protein, 9 aa, Homo Sapiens
KEGCSFLTL

SEQ ID NO: 143604 - protein, 9 aa, Homo Sapiens
CGYGPQDSY

SEQ ID NO: 143605 - protein, 9 aa, Homo Sapiens
QLGTAPWPP

SEQ ID NO: 143606 - protein, 9 aa, Homo Sapiens
LLPTGCRAL

SEQ ID NO: 143607 - protein, 9 aa, Homo Sapiens
LGGAPGGGG

SEQ ID NO: 143608 - protein, 9 aa, Homo Sapiens
TPEPHPNEW

SEQ ID NO: 143609 - protein, 9 aa, Homo Sapiens
TAKTGASSC

SEQ ID NO: 143610 - protein, 9 aa, Homo Sapiens
ARHTHPSSM

SEQ ID NO: 143611 - protein, 9 aa, Homo Sapiens
KRRSQSICL

SEQ ID NO: 143612 - protein, 9 aa, Homo Sapiens
EEQKQVESL

SEQ ID NO: 143613 - protein, 9 aa, Homo Sapiens
SSHDTFMVS

SEQ ID NO: 143614 - protein, 9 aa, Homo Sapiens
HPLYFRGRL

SEQ ID NO: 143615 - protein, 9 aa, Homo Sapiens
LCSVTLRLR

SEQ ID NO: 143616 - protein, 9 aa, Homo Sapiens
PSACLHPNS

SEQ ID NO: 143617 - protein, 9 aa, Homo Sapiens
RPCLPLQPR

SEQ ID NO: 143618 - protein, 9 aa, Homo Sapiens
SDARNIWYL

SEQ ID NO: 143619 - protein, 9 aa, Homo Sapiens
HYQYGVLGE

SEQ ID NO: 143620 - protein, 9 aa, Homo Sapiens
RRLCGIIPG

SEQ ID NO: 143621 - protein, 9 aa, Homo Sapiens
CLAQAPIPW

SEQ ID NO: 143622 - protein, 9 aa, Homo Sapiens
MSCSKAYRE

SEQ ID NO: 143623 - protein, 9 aa, Homo Sapiens
VIPVLPSQA

SEQ ID NO: 143624 - protein, 9 aa, Homo Sapiens
PPVSPRLVN

SEQ ID NO: 143625 - protein, 9 aa, Homo Sapiens
ERLALHGFR

SEQ ID NO: 143626 - protein, 9 aa, Homo Sapiens
ESACDPRGS

SEQ ID NO: 143627 - protein, 9 aa, Homo Sapiens
ASMTKKSLS

SEQ ID NO: 143628 - protein, 9 aa, Homo Sapiens
QGKNTYPEK

SEQ ID NO: 143629 - protein, 9 aa, Homo Sapiens
EAKQNVEKE

SEQ ID NO: 143630 - protein, 9 aa, Homo Sapiens
IQSQSSTSI

SEQ ID NO: 143631 - protein, 9 aa, Homo Sapiens
QTAVVLVWV

SEQ ID NO: 143632 - protein, 9 aa, Homo Sapiens
AVVNAYPSS

SEQ ID NO: 143633 - protein, 9 aa, Homo Sapiens
RWTVSPRWW

SEQ ID NO: 143634 - protein, 9 aa, Homo Sapiens
PGPAEGVVG

SEQ ID NO: 143635 - protein, 9 aa, Homo Sapiens
PPMSLHTVA

SEQ ID NO: 143636 - protein, 9 aa, Homo Sapiens
LPCRRHCPR

SEQ ID NO: 143637 - protein, 9 aa, Homo Sapiens
DWVASPPTR

SEQ ID NO: 143638 - protein, 9 aa, Homo Sapiens
TSLAALFMS

SEQ ID NO: 143639 - protein, 9 aa, Homo Sapiens
VHDAQCKQD

SEQ ID NO: 143640 - protein, 9 aa, Homo Sapiens
RGPWSPTHS

SEQ ID NO: 143641 - protein, 9 aa, Homo Sapiens
PGGRPGQCA

SEQ ID NO: 143642 - protein, 9 aa, Homo Sapiens
TTAQWPTLC

SEQ ID NO: 143643 - protein, 9 aa, Homo Sapiens
VAGLLADTL

SEQ ID NO: 143644 - protein, 9 aa, Homo Sapiens
AWSFQPASS

SEQ ID NO: 143645 - protein, 9 aa, Homo Sapiens
AQGNSLLGL

SEQ ID NO: 143646 - protein, 9 aa, Homo Sapiens
TCAHNRTTG

SEQ ID NO: 143647 - protein, 9 aa, Homo Sapiens
RMWHLSTGT

SEQ ID NO: 143648 - protein, 9 aa, Homo Sapiens
THSGGGGGS

SEQ ID NO: 143649 - protein, 9 aa, Homo Sapiens
RQAREQTRN

SEQ ID NO: 143650 - protein, 9 aa, Homo Sapiens
EGVWEKENS

SEQ ID NO: 143651 - protein, 9 aa, Homo Sapiens
SKSDSDTES

SEQ ID NO: 143652 - protein, 9 aa, Homo Sapiens
GGLRMNTHV

SEQ ID NO: 143653 - protein, 9 aa, Homo Sapiens
LDQETLRVE

SEQ ID NO: 143654 - protein, 9 aa, Homo Sapiens
NLSASSTLE

SEQ ID NO: 143655 - protein, 9 aa, Homo Sapiens
TGGGSSGGG

SEQ ID NO: 143656 - protein, 9 aa, Homo Sapiens
GPREPHPMS

SEQ ID NO: 143657 - protein, 9 aa, Homo Sapiens
PPASSTSRS

SEQ ID NO: 143658 - protein, 9 aa, Homo Sapiens
DRVHEQGYV

SEQ ID NO: 143659 - protein, 9 aa, Homo Sapiens
LYEAYHGVF

SEQ ID NO: 143660 - protein, 9 aa, Homo Sapiens
SSSTWAGAS

SEQ ID NO: 143661 - protein, 9 aa, Homo Sapiens
EPYTCRALA

SEQ ID NO: 143662 - protein, 9 aa, Homo Sapiens
FSNDPEPPV

SEQ ID NO: 143663 - protein, 9 aa, Homo Sapiens
IVMSYDRYL

SEQ ID NO: 143664 - protein, 9 aa, Homo Sapiens
YIRRRAALG

SEQ ID NO: 143665 - protein, 9 aa, Homo Sapiens
EKQLPPIVP

SEQ ID NO: 143666 - protein, 9 aa, Homo Sapiens
LKEQCASNI

SEQ ID NO: 143667 - protein, 9 aa, Homo Sapiens
HGFLLPGQP

SEQ ID NO: 143668 - protein, 9 aa, Homo Sapiens
NALKSLLWR

SEQ ID NO: 143669 - protein, 9 aa, Homo Sapiens
ASDTIKFVL

SEQ ID NO: 143670 - protein, 9 aa, Homo Sapiens
GSFTGNKFT

SEQ ID NO: 143671 - protein, 9 aa, Homo Sapiens
FTVINRCKK

SEQ ID NO: 143672 - protein, 9 aa, Homo Sapiens
CSSPGCRPA

SEQ ID NO: 143673 - protein, 9 aa, Homo Sapiens
PSTARVILG

SEQ ID NO: 143674 - protein, 9 aa, Homo Sapiens
VSPWATSSS

SEQ ID NO: 143675 - protein, 9 aa, Homo Sapiens
SVWLQCGNF

SEQ ID NO: 143676 - protein, 9 aa, Homo Sapiens
FTVKQTRHE

SEQ ID NO: 143677 - protein, 9 aa, Homo Sapiens
GKLYAKKEW

SEQ ID NO: 143678 - protein, 9 aa, Homo Sapiens
TTTSSPRRS

SEQ ID NO: 143679 - protein, 9 aa, Homo Sapiens
KGNLQTMLR

SEQ ID NO: 143680 - protein, 9 aa, Homo Sapiens
ATTLRLRLQ

SEQ ID NO: 143681 - protein, 9 aa, Homo Sapiens
AGISFSVKN

SEQ ID NO: 143682 - protein, 9 aa, Homo Sapiens
TSCGAARPR

SEQ ID NO: 143683 - protein, 9 aa, Homo Sapiens
PGHLSPRLG

SEQ ID NO: 143684 - protein, 9 aa, Homo Sapiens
DETTQKFTF

SEQ ID NO: 143685 - protein, 9 aa, Homo Sapiens
GQTARGYAV

SEQ ID NO: 143686 - protein, 9 aa, Homo Sapiens
DIIQRTTST

SEQ ID NO: 143687 - protein, 9 aa, Homo Sapiens
GLGLQLALF

SEQ ID NO: 143688 - protein, 9 aa, Homo Sapiens
LHGFRPSTA

SEQ ID NO: 143689 - protein, 9 aa, Homo Sapiens
ELFTGKYNN

SEQ ID NO: 143690 - protein, 9 aa, Homo Sapiens
GPGLAFITY

SEQ ID NO: 143691 - protein, 9 aa, Homo Sapiens
PVLHKVPGK

SEQ ID NO: 143692 - protein, 9 aa, Homo Sapiens
AKMLLRMHT

SEQ ID NO: 143693 - protein, 9 aa, Homo Sapiens
GSHRLHLLL

SEQ ID NO: 143694 - protein, 9 aa, Homo Sapiens
CAWMRTQLR

SEQ ID NO: 143695 - protein, 9 aa, Homo Sapiens
HTQQLSLLI

SEQ ID NO: 143696 - protein, 9 aa, Homo Sapiens
PSLAVSSRM

SEQ ID NO: 143697 - protein, 9 aa, Homo Sapiens
FGSSCLQTS

SEQ ID NO: 143698 - protein, 9 aa, Homo Sapiens
LRGKSRPVL

SEQ ID NO: 143699 - protein, 9 aa, Homo Sapiens
KSSKKLKEA

SEQ ID NO: 143700 - protein, 9 aa, Homo Sapiens
MAPEENAGN

SEQ ID NO: 143701 - protein, 9 aa, Homo Sapiens
LPSSRVFTR

SEQ ID NO: 143702 - protein, 9 aa, Homo Sapiens
SLCSVTLRL

SEQ ID NO: 143703 - protein, 9 aa, Homo Sapiens
LAVVWAQWG

SEQ ID NO: 143704 - protein, 9 aa, Homo Sapiens
SMCCVIIPP

SEQ ID NO: 143705 - protein, 9 aa, Homo Sapiens
PPCRPPRSP

SEQ ID NO: 143706 - protein, 9 aa, Homo Sapiens
QDLDEGCDQ

SEQ ID NO: 143707 - protein, 9 aa, Homo Sapiens
RSSCWPPGY

SEQ ID NO: 143708 - protein, 9 aa, Homo Sapiens
VFLTAITLN

SEQ ID NO: 143709 - protein, 9 aa, Homo Sapiens
STHAEPYTC

SEQ ID NO: 143710 - protein, 9 aa, Homo Sapiens
ALMLTVSHG

SEQ ID NO: 143711 - protein, 9 aa, Homo Sapiens
TNENKQSLK

SEQ ID NO: 143712 - protein, 9 aa, Homo Sapiens
GFYTSAMAY

SEQ ID NO: 143713 - protein, 9 aa, Homo Sapiens
GYLFLSWKC

SEQ ID NO: 143714 - protein, 9 aa, Homo Sapiens
ELDRSHELE

SEQ ID NO: 143715 - protein, 9 aa, Homo Sapiens
STLELLREK

SEQ ID NO: 143716 - protein, 9 aa, Homo Sapiens
IFKTFFLLL

SEQ ID NO: 143717 - protein, 9 aa, Homo Sapiens
CGAGADDVL

SEQ ID NO: 143718 - protein, 9 aa, Homo Sapiens
RFALADQRV

SEQ ID NO: 143719 - protein, 9 aa, Homo Sapiens
SWTIPWTGA

SEQ ID NO: 143720 - protein, 9 aa, Homo Sapiens
WRLPPPCPS

SEQ ID NO: 143721 - protein, 9 aa, Homo Sapiens
SRSCSTLLR

SEQ ID NO: 143722 - protein, 9 aa, Homo Sapiens
DVTLTKHAI

SEQ ID NO: 143723 - protein, 9 aa, Homo Sapiens
QALDYDRFS

SEQ ID NO: 143724 - protein, 9 aa, Homo Sapiens
GSNKKLTGH

SEQ ID NO: 143725 - protein, 9 aa, Homo Sapiens
GRRYSHAAG

SEQ ID NO: 143726 - protein, 9 aa, Homo Sapiens
RHCPRCPAP

SEQ ID NO: 143727 - protein, 9 aa, Homo Sapiens
KNVYLKAIL

SEQ ID NO: 143728 - protein, 9 aa, Homo Sapiens
VLLHFQRKL

SEQ ID NO: 143729 - protein, 9 aa, Homo Sapiens
VRAKVLITV

SEQ ID NO: 143730 - protein, 9 aa, Homo Sapiens
VKGGTLNMK

SEQ ID NO: 143731 - protein, 9 aa, Homo Sapiens
HTHTGTQAY

SEQ ID NO: 143732 - protein, 9 aa, Homo Sapiens
SFAVGSRLP

SEQ ID NO: 143733 - protein, 9 aa, Homo Sapiens
AGLLTAASL

SEQ ID NO: 143734 - protein, 9 aa, Homo Sapiens
SRVFTRDST

SEQ ID NO: 143735 - protein, 9 aa, Homo Sapiens
LLSWGRRRR

SEQ ID NO: 143736 - protein, 9 aa, Homo Sapiens
DDVIHHGVK

SEQ ID NO: 143737 - protein, 9 aa, Homo Sapiens
EENTKVFVW

SEQ ID NO: 143738 - protein, 9 aa, Homo Sapiens
SPGEWFLCG

SEQ ID NO: 143739 - protein, 9 aa, Homo Sapiens
SGMAALTAA

SEQ ID NO: 143740 - protein, 9 aa, Homo Sapiens
RPGQQRVLI

SEQ ID NO: 143741 - protein, 9 aa, Homo Sapiens
LFFGQNGLP

SEQ ID NO: 143742 - protein, 9 aa, Homo Sapiens
RCSLPDPCR

SEQ ID NO: 143743 - protein, 9 aa, Homo Sapiens
LEVIMDRPL

SEQ ID NO: 143744 - protein, 9 aa, Homo Sapiens
APAAQAVAS

SEQ ID NO: 143745 - protein, 9 aa, Homo Sapiens
QSLAWRKQH

SEQ ID NO: 143746 - protein, 9 aa, Homo Sapiens
LLLDLPILD

SEQ ID NO: 143747 - protein, 9 aa, Homo Sapiens
GSDSMWSWR

SEQ ID NO: 143748 - protein, 9 aa, Homo Sapiens
QRPGAPGPC

SEQ ID NO: 143749 - protein, 9 aa, Homo Sapiens
QGTFYTRER

SEQ ID NO: 143750 - protein, 9 aa, Homo Sapiens
RTAPLLADD

SEQ ID NO: 143751 - protein, 9 aa, Homo Sapiens
PFQMRNVAL

SEQ ID NO: 143752 - protein, 9 aa, Homo Sapiens
RNKRPTFPK

SEQ ID NO: 143753 - protein, 9 aa, Homo Sapiens
HSVCDMHPL

SEQ ID NO: 143754 - protein, 9 aa, Homo Sapiens
DAHVVLEVV

SEQ ID NO: 143755 - protein, 9 aa, Homo Sapiens
QCGRAFCER

SEQ ID NO: 143756 - protein, 9 aa, Homo Sapiens
HVPRQLPGP

SEQ ID NO: 143757 - protein, 9 aa, Homo Sapiens
FHDKIDHIL

SEQ ID NO: 143758 - protein, 9 aa, Homo Sapiens
TPQVCVSCP

SEQ ID NO: 143759 - protein, 9 aa, Homo Sapiens
HLEEVTVVG

SEQ ID NO: 143760 - protein, 9 aa, Homo Sapiens
TTDNTTTTT

SEQ ID NO: 143761 - protein, 9 aa, Homo Sapiens
ELSKVQSVE

SEQ ID NO: 143762 - protein, 9 aa, Homo Sapiens
IRKSRLVHV

SEQ ID NO: 143763 - protein, 9 aa, Homo Sapiens
KFPSLSILS

SEQ ID NO: 143764 - protein, 9 aa, Homo Sapiens
FWQLEAAAS

SEQ ID NO: 143765 - protein, 9 aa, Homo Sapiens
PWAWCARWT

SEQ ID NO: 143766 - protein, 9 aa, Homo Sapiens
EIVNVASWS

SEQ ID NO: 143767 - protein, 9 aa, Homo Sapiens
VERAVKRMW

SEQ ID NO: 143768 - protein, 9 aa, Homo Sapiens
QIYAGATLR

SEQ ID NO: 143769 - protein, 9 aa, Homo Sapiens
RGRDDDVSS

SEQ ID NO: 143770 - protein, 9 aa, Homo Sapiens
YILYTSDTT

SEQ ID NO: 143771 - protein, 9 aa, Homo Sapiens
RPICRKECV

SEQ ID NO: 143772 - protein, 9 aa, Homo Sapiens
RLHLLLHPC

SEQ ID NO: 143773 - protein, 9 aa, Homo Sapiens
SAFIRVASM

SEQ ID NO: 143774 - protein, 9 aa, Homo Sapiens
PQAPLRLWS

SEQ ID NO: 143775 - protein, 9 aa, Homo Sapiens
QGRRWGAWH

SEQ ID NO: 143776 - protein, 9 aa, Homo Sapiens
RRTTSAGTV

SEQ ID NO: 143777 - protein, 9 aa, Homo Sapiens
PSSPQLQPM

SEQ ID NO: 143778 - protein, 9 aa, Homo Sapiens
LVGPHARVD

SEQ ID NO: 143779 - protein, 9 aa, Homo Sapiens
PAPTRRGEA

SEQ ID NO: 143780 - protein, 9 aa, Homo Sapiens
QRPEVLEGS

SEQ ID NO: 143781 - protein, 9 aa, Homo Sapiens
LKKKCRSKT

SEQ ID NO: 143782 - protein, 9 aa, Homo Sapiens
RPFARPGRG

SEQ ID NO: 143783 - protein, 9 aa, Homo Sapiens
NWRWTERDA

SEQ ID NO: 143784 - protein, 9 aa, Homo Sapiens
HAPLMNIQH

SEQ ID NO: 143785 - protein, 9 aa, Homo Sapiens
SFLKGQIIR

SEQ ID NO: 143786 - protein, 9 aa, Homo Sapiens
LVDTDIGMT

SEQ ID NO: 143787 - protein, 9 aa, Homo Sapiens
SYGMSLNVW

SEQ ID NO: 143788 - protein, 9 aa, Homo Sapiens
ILFHIQHLL

SEQ ID NO: 143789 - protein, 9 aa, Homo Sapiens
PALAAPACQ

SEQ ID NO: 143790 - protein, 9 aa, Homo Sapiens
QRQAREQTR

SEQ ID NO: 143791 - protein, 9 aa, Homo Sapiens
TGGTSPAKA

SEQ ID NO: 143792 - protein, 9 aa, Homo Sapiens
PAHFCHHGG

SEQ ID NO: 143793 - protein, 9 aa, Homo Sapiens
SSTLTSGPT

SEQ ID NO: 143794 - protein, 9 aa, Homo Sapiens
FTKQVLGES

SEQ ID NO: 143795 - protein, 9 aa, Homo Sapiens
YEFLCTNSA

SEQ ID NO: 143796 - protein, 9 aa, Homo Sapiens
PRPSTKCGT

SEQ ID NO: 143797 - protein, 9 aa, Homo Sapiens
KSGAVNRVI

SEQ ID NO: 143798 - protein, 9 aa, Homo Sapiens
RQRELCAAQ

SEQ ID NO: 143799 - protein, 9 aa, Homo Sapiens
ALRVSPVRN

SEQ ID NO: 143800 - protein, 9 aa, Homo Sapiens
FFPEVISFI

SEQ ID NO: 143801 - protein, 9 aa, Homo Sapiens
RIYGFIGLC

SEQ ID NO: 143802 - protein, 9 aa, Homo Sapiens
FPYSYHYRL

SEQ ID NO: 143803 - protein, 9 aa, Homo Sapiens
SQEVPLHRG

SEQ ID NO: 143804 - protein, 9 aa, Homo Sapiens
AILKGSSLY

SEQ ID NO: 143805 - protein, 9 aa, Homo Sapiens
HTKPRPGLG

SEQ ID NO: 143806 - protein, 9 aa, Homo Sapiens
LAWRKQHQV

SEQ ID NO: 143807 - protein, 9 aa, Homo Sapiens
IDYMLYKAV

SEQ ID NO: 143808 - protein, 9 aa, Homo Sapiens
PRGPPLPPP

SEQ ID NO: 143809 - protein, 9 aa, Homo Sapiens
AQASAAVLN

SEQ ID NO: 143810 - protein, 9 aa, Homo Sapiens
LSVSAAGVR

SEQ ID NO: 143811 - protein, 9 aa, Homo Sapiens
VLRSFDYEQ

SEQ ID NO: 143812 - protein, 9 aa, Homo Sapiens
EAEGLATER

SEQ ID NO: 143813 - protein, 9 aa, Homo Sapiens
PLPALAPQP

SEQ ID NO: 143814 - protein, 9 aa, Homo Sapiens
MVEGGVSGV

SEQ ID NO: 143815 - protein, 9 aa, Homo Sapiens
RRRFPLGAH

SEQ ID NO: 143816 - protein, 9 aa, Homo Sapiens
RSRGSPRPS

SEQ ID NO: 143817 - protein, 9 aa, Homo Sapiens
SAPPAPQAE

SEQ ID NO: 143818 - protein, 9 aa, Homo Sapiens
GSSPSTPPT

SEQ ID NO: 143819 - protein, 9 aa, Homo Sapiens
KARSLYSPA

SEQ ID NO: 143820 - protein, 9 aa, Homo Sapiens
RAGRTALAP

SEQ ID NO: 143821 - protein, 9 aa, Homo Sapiens
TSGLGRTQR

SEQ ID NO: 143822 - protein, 9 aa, Homo Sapiens
RAAPRTSAG

SEQ ID NO: 143823 - protein, 9 aa, Homo Sapiens
GHTCMEGSP

SEQ ID NO: 143824 - protein, 9 aa, Homo Sapiens
ILEKLMTRF

SEQ ID NO: 143825 - protein, 9 aa, Homo Sapiens
LDPLLGVVP

SEQ ID NO: 143826 - protein, 9 aa, Homo Sapiens
GLEAEGWAP

SEQ ID NO: 143827 - protein, 9 aa, Homo Sapiens
LLLTVLVVV

SEQ ID NO: 143828 - protein, 9 aa, Homo Sapiens
QRTRTMRLG

SEQ ID NO: 143829 - protein, 9 aa, Homo Sapiens
VTSKLDRRS

SEQ ID NO: 143830 - protein, 9 aa, Homo Sapiens
ECFRHAPPP

SEQ ID NO: 143831 - protein, 9 aa, Homo Sapiens
YFITFIFLC

SEQ ID NO: 143832 - protein, 9 aa, Homo Sapiens
PLDIGEGRK

SEQ ID NO: 143833 - protein, 9 aa, Homo Sapiens
APTPPAPHR

SEQ ID NO: 143834 - protein, 9 aa, Homo Sapiens
ASEKLDYIA

SEQ ID NO: 143835 - protein, 9 aa, Homo Sapiens
GRQQPSASL

SEQ ID NO: 143836 - protein, 9 aa, Homo Sapiens
KPGPITCLE

SEQ ID NO: 143837 - protein, 9 aa, Homo Sapiens
ATLRCPAVP

SEQ ID NO: 143838 - protein, 9 aa, Homo Sapiens
AEKAEVGRP

SEQ ID NO: 143839 - protein, 9 aa, Homo Sapiens
IPVLCGCFL

SEQ ID NO: 143840 - protein, 9 aa, Homo Sapiens
LHLAAGLGQ

SEQ ID NO: 143841 - protein, 9 aa, Homo Sapiens
ATAHAPLHS

SEQ ID NO: 143842 - protein, 9 aa, Homo Sapiens
VDVNATAED

SEQ ID NO: 143843 - protein, 9 aa, Homo Sapiens
AVAAEEEEA

SEQ ID NO: 143844 - protein, 9 aa, Homo Sapiens
TGASPVWAH

SEQ ID NO: 143845 - protein, 9 aa, Homo Sapiens
PAPGRAAPR

SEQ ID NO: 143846 - protein, 9 aa, Homo Sapiens
GMPRAWCCL

SEQ ID NO: 143847 - protein, 9 aa, Homo Sapiens
YGFGGARSG

SEQ ID NO: 143848 - protein, 9 aa, Homo Sapiens
ASSPLSGPS

SEQ ID NO: 143849 - protein, 9 aa, Homo Sapiens
NKMKDTPKR

SEQ ID NO: 143850 - protein, 9 aa, Homo Sapiens
LHQIFMLTV

SEQ ID NO: 143851 - protein, 9 aa, Homo Sapiens
PPAPQAEAE

SEQ ID NO: 143852 - protein, 9 aa, Homo Sapiens
LHPSQQAET

SEQ ID NO: 143853 - protein, 9 aa, Homo Sapiens
HICGVSLLS

SEQ ID NO: 143854 - protein, 9 aa, Homo Sapiens
HNHNRQTLC

SEQ ID NO: 143855 - protein, 9 aa, Homo Sapiens
VHVESNSST

SEQ ID NO: 143856 - protein, 9 aa, Homo Sapiens
TPTSGLGRT

SEQ ID NO: 143857 - protein, 9 aa, Homo Sapiens
ADVNAVTRQ

SEQ ID NO: 143858 - protein, 9 aa, Homo Sapiens
RFVAKKALC

SEQ ID NO: 143859 - protein, 9 aa, Homo Sapiens
ALLSWGRRR

SEQ ID NO: 143860 - protein, 9 aa, Homo Sapiens
TGACPAVAV

SEQ ID NO: 143861 - protein, 9 aa, Homo Sapiens
KFDLIWNWA

SEQ ID NO: 143862 - protein, 9 aa, Homo Sapiens
LPIVPFEMV

SEQ ID NO: 143863 - protein, 9 aa, Homo Sapiens
GAYFHTGAS

SEQ ID NO: 143864 - protein, 9 aa, Homo Sapiens
LKNPLKTVV

SEQ ID NO: 143865 - protein, 9 aa, Homo Sapiens
RALHVYSLG

SEQ ID NO: 143866 - protein, 9 aa, Homo Sapiens
VHPHALLHP

SEQ ID NO: 143867 - protein, 9 aa, Homo Sapiens
HPSQQSTLY

SEQ ID NO: 143868 - protein, 9 aa, Homo Sapiens
AGKGLKVVL

SEQ ID NO: 143869 - protein, 9 aa, Homo Sapiens
TVKQTRHEE

SEQ ID NO: 143870 - protein, 9 aa, Homo Sapiens
EPLRGQPPP

SEQ ID NO: 143871 - protein, 9 aa, Homo Sapiens
SVGCRRCAI

SEQ ID NO: 143872 - protein, 9 aa, Homo Sapiens
QMGIGMKPN

SEQ ID NO: 143873 - protein, 9 aa, Homo Sapiens
IQKTGAPLS

SEQ ID NO: 143874 - protein, 9 aa, Homo Sapiens
YRPTPTWRW

SEQ ID NO: 143875 - protein, 9 aa, Homo Sapiens
TEQTPALLR

SEQ ID NO: 143876 - protein, 9 aa, Homo Sapiens
PLALAALGP

SEQ ID NO: 143877 - protein, 9 aa, Homo Sapiens
DHSVCDMHP

SEQ ID NO: 143878 - protein, 9 aa, Homo Sapiens
ADPILQEAK

SEQ ID NO: 143879 - protein, 9 aa, Homo Sapiens
RPGLGCFMP

SEQ ID NO: 143880 - protein, 9 aa, Homo Sapiens
HQGLTQLSN

SEQ ID NO: 143881 - protein, 9 aa, Homo Sapiens
AKGRCIPPR

SEQ ID NO: 143882 - protein, 9 aa, Homo Sapiens
QMREFKPKL

SEQ ID NO: 143883 - protein, 9 aa, Homo Sapiens
KTSLSADII

SEQ ID NO: 143884 - protein, 9 aa, Homo Sapiens
SLDSQQTVP

SEQ ID NO: 143885 - protein, 9 aa, Homo Sapiens
FSVKNKERQ

SEQ ID NO: 143886 - protein, 9 aa, Homo Sapiens
SPANPQEKW

SEQ ID NO: 143887 - protein, 9 aa, Homo Sapiens
LCCTCPPAP

SEQ ID NO: 143888 - protein, 9 aa, Homo Sapiens
LEKLEKKRI

SEQ ID NO: 143889 - protein, 9 aa, Homo Sapiens
PGEKPDPIP

SEQ ID NO: 143890 - protein, 9 aa, Homo Sapiens
RTMRRVNQE

SEQ ID NO: 143891 - protein, 9 aa, Homo Sapiens
LFLKLASGT

SEQ ID NO: 143892 - protein, 9 aa, Homo Sapiens
LQQLPRKGQ

SEQ ID NO: 143893 - protein, 9 aa, Homo Sapiens
GYGQGPCGY

SEQ ID NO: 143894 - protein, 9 aa, Homo Sapiens
RVGPKSWAP

SEQ ID NO: 143895 - protein, 9 aa, Homo Sapiens
GRILLQRNL

SEQ ID NO: 143896 - protein, 9 aa, Homo Sapiens
YVNVDPTFN

SEQ ID NO: 143897 - protein, 9 aa, Homo Sapiens
WDELAARAT

SEQ ID NO: 143898 - protein, 9 aa, Homo Sapiens
HSWIRTEMA

SEQ ID NO: 143899 - protein, 9 aa, Homo Sapiens
NPPQPMGPP

SEQ ID NO: 143900 - protein, 9 aa, Homo Sapiens
SLHPSQQAE

SEQ ID NO: 143901 - protein, 9 aa, Homo Sapiens
FANFVLQYQ

SEQ ID NO: 143902 - protein, 9 aa, Homo Sapiens
LSSWRSPCS

SEQ ID NO: 143903 - protein, 9 aa, Homo Sapiens
SLTNFLTEM

SEQ ID NO: 143904 - protein, 9 aa, Homo Sapiens
FWKKRRTMR

SEQ ID NO: 143905 - protein, 9 aa, Homo Sapiens
RRHLWNLME

SEQ ID NO: 143906 - protein, 9 aa, Homo Sapiens
KFIIILYVK

SEQ ID NO: 143907 - protein, 9 aa, Homo Sapiens
ALIIYEMLQ

SEQ ID NO: 143908 - protein, 9 aa, Homo Sapiens
GKHLVFLGL

SEQ ID NO: 143909 - protein, 9 aa, Homo Sapiens
VVHELGVAV

SEQ ID NO: 143910 - protein, 9 aa, Homo Sapiens
YCLQFLVLC

SEQ ID NO: 143911 - protein, 9 aa, Homo Sapiens
VLCRVSRYN

SEQ ID NO: 143912 - protein, 9 aa, Homo Sapiens
STSLNDHMG

SEQ ID NO: 143913 - protein, 9 aa, Homo Sapiens
DPALLAVLS

SEQ ID NO: 143914 - protein, 9 aa, Homo Sapiens
LLVFFLLLL

SEQ ID NO: 143915 - protein, 9 aa, Homo Sapiens
QGVLGGLPL

SEQ ID NO: 143916 - protein, 9 aa, Homo Sapiens
LLGSFLLDH

SEQ ID NO: 143917 - protein, 9 aa, Homo Sapiens
LQGFSDAVS

SEQ ID NO: 143918 - protein, 9 aa, Homo Sapiens
VCGYLFLSW

SEQ ID NO: 143919 - protein, 9 aa, Homo Sapiens
IAALILTLF

SEQ ID NO: 143920 - protein, 9 aa, Homo Sapiens
RMASSPPGP

SEQ ID NO: 143921 - protein, 9 aa, Homo Sapiens
EERMTGHGR

SEQ ID NO: 143922 - protein, 9 aa, Homo Sapiens
VITSSQYSS

SEQ ID NO: 143923 - protein, 9 aa, Homo Sapiens
VLSTPAVSC

SEQ ID NO: 143924 - protein, 9 aa, Homo Sapiens
TGGLYIFCQ

SEQ ID NO: 143925 - protein, 9 aa, Homo Sapiens
KAVASSPSA

SEQ ID NO: 143926 - protein, 9 aa, Homo Sapiens
SQFVSKGNL

SEQ ID NO: 143927 - protein, 9 aa, Homo Sapiens
LRGSWRRME

SEQ ID NO: 143928 - protein, 9 aa, Homo Sapiens
VRTVKCQDY

SEQ ID NO: 143929 - protein, 9 aa, Homo Sapiens
NSGGGRELS

SEQ ID NO: 143930 - protein, 9 aa, Homo Sapiens
FLLAGGTSS

SEQ ID NO: 143931 - protein, 9 aa, Homo Sapiens
RGPSAGLCS

SEQ ID NO: 143932 - protein, 9 aa, Homo Sapiens
VNIRKFIVQ

SEQ ID NO: 143933 - protein, 9 aa, Homo Sapiens
LQAQEDAHH

SEQ ID NO: 143934 - protein, 9 aa, Homo Sapiens
SAWTSMHQT

SEQ ID NO: 143935 - protein, 9 aa, Homo Sapiens
RPAPRSWPR

SEQ ID NO: 143936 - protein, 9 aa, Homo Sapiens
LTAITLNRY

SEQ ID NO: 143937 - protein, 9 aa, Homo Sapiens
VSPASPPTQ

SEQ ID NO: 143938 - protein, 9 aa, Homo Sapiens
PISSWTCLA

SEQ ID NO: 143939 - protein, 9 aa, Homo Sapiens
AVAVEQAGG

SEQ ID NO: 143940 - protein, 9 aa, Homo Sapiens
TLASDKESS

SEQ ID NO: 143941 - protein, 9 aa, Homo Sapiens
GRGGEGAWV

SEQ ID NO: 143942 - protein, 9 aa, Homo Sapiens
SRGAADDRV

SEQ ID NO: 143943 - protein, 9 aa, Homo Sapiens
FNGTRLGVV

SEQ ID NO: 143944 - protein, 9 aa, Homo Sapiens
WLESWEVRD

SEQ ID NO: 143945 - protein, 9 aa, Homo Sapiens
PSASQSARI

SEQ ID NO: 143946 - protein, 9 aa, Homo Sapiens
AGSSRPTVP

SEQ ID NO: 143947 - protein, 9 aa, Homo Sapiens
RCPAVPAAA

SEQ ID NO: 143948 - protein, 9 aa, Homo Sapiens
LIFLQPLLL

SEQ ID NO: 143949 - protein, 9 aa, Homo Sapiens
GLLTAASLV

SEQ ID NO: 143950 - protein, 9 aa, Homo Sapiens
WCCCRARSS

SEQ ID NO: 143951 - protein, 9 aa, Homo Sapiens
TCPPAPGRA

SEQ ID NO: 143952 - protein, 9 aa, Homo Sapiens
GLMAADRAW

SEQ ID NO: 143953 - protein, 9 aa, Homo Sapiens
RAGDASLQD

SEQ ID NO: 143954 - protein, 9 aa, Homo Sapiens
EPADVPVHL

SEQ ID NO: 143955 - protein, 9 aa, Homo Sapiens
CGPTSGSTP

SEQ ID NO: 143956 - protein, 9 aa, Homo Sapiens
SPRSWGPRL

SEQ ID NO: 143957 - protein, 9 aa, Homo Sapiens
HTFIAIKPD

SEQ ID NO: 143958 - protein, 9 aa, Homo Sapiens
AQTHRKSWP

SEQ ID NO: 143959 - protein, 9 aa, Homo Sapiens
LPPAHVHVE

SEQ ID NO: 143960 - protein, 9 aa, Homo Sapiens
QLKGIPLNL

SEQ ID NO: 143961 - protein, 9 aa, Homo Sapiens
GDFGLATEK

SEQ ID NO: 143962 - protein, 9 aa, Homo Sapiens
SLLSPVQWV

SEQ ID NO: 143963 - protein, 9 aa, Homo Sapiens
KPSVNEQTK

SEQ ID NO: 143964 - protein, 9 aa, Homo Sapiens
LVTPPQGPA

SEQ ID NO: 143965 - protein, 9 aa, Homo Sapiens
EAWGEIFLF

SEQ ID NO: 143966 - protein, 9 aa, Homo Sapiens
PPDVLWKHW

SEQ ID NO: 143967 - protein, 9 aa, Homo Sapiens
STGVPLVMG

SEQ ID NO: 143968 - protein, 9 aa, Homo Sapiens
RWQLGTAPW

SEQ ID NO: 143969 - protein, 9 aa, Homo Sapiens
EEFKMEKRL

SEQ ID NO: 143970 - protein, 9 aa, Homo Sapiens
LSQKLGRWC

SEQ ID NO: 143971 - protein, 9 aa, Homo Sapiens
ACIAIKWMP

SEQ ID NO: 143972 - protein, 9 aa, Homo Sapiens
PPLQLQRLG

SEQ ID NO: 143973 - protein, 9 aa, Homo Sapiens
VMLRMPESS

SEQ ID NO: 143974 - protein, 9 aa, Homo Sapiens
IIEVGEKML

SEQ ID NO: 143975 - protein, 9 aa, Homo Sapiens
LGPAGRIGG

SEQ ID NO: 143976 - protein, 9 aa, Homo Sapiens
MTTKKSNIY

SEQ ID NO: 143977 - protein, 9 aa, Homo Sapiens
PPPLPPPQV

SEQ ID NO: 143978 - protein, 9 aa, Homo Sapiens
LWENMLSGD

SEQ ID NO: 143979 - protein, 9 aa, Homo Sapiens
LIKREKFVF

SEQ ID NO: 143980 - protein, 9 aa, Homo Sapiens
QEHVKKNYS

SEQ ID NO: 143981 - protein, 9 aa, Homo Sapiens
SICLQVLTD

SEQ ID NO: 143982 - protein, 9 aa, Homo Sapiens
INQLLEVVP

SEQ ID NO: 143983 - protein, 9 aa, Homo Sapiens
RPASQSGQE

SEQ ID NO: 143984 - protein, 9 aa, Homo Sapiens
FSFSWLPQR

SEQ ID NO: 143985 - protein, 9 aa, Homo Sapiens
NAAKSQIVM

SEQ ID NO: 143986 - protein, 9 aa, Homo Sapiens
VTGGTMAEE

SEQ ID NO: 143987 - protein, 9 aa, Homo Sapiens
WPFTTQAHP

SEQ ID NO: 143988 - protein, 9 aa, Homo Sapiens
GASRNVVWS

SEQ ID NO: 143989 - protein, 9 aa, Homo Sapiens
QIQWPTVHG

SEQ ID NO: 143990 - protein, 9 aa, Homo Sapiens
LDEGCDQWI

SEQ ID NO: 143991 - protein, 9 aa, Homo Sapiens
LLLLLDLPI

SEQ ID NO: 143992 - protein, 9 aa, Homo Sapiens
DALHWKNVY

SEQ ID NO: 143993 - protein, 9 aa, Homo Sapiens
ERRLHQAAF

SEQ ID NO: 143994 - protein, 9 aa, Homo Sapiens
SKAPPPAFQ

SEQ ID NO: 143995 - protein, 9 aa, Homo Sapiens
GPPLVLTEI

SEQ ID NO: 143996 - protein, 9 aa, Homo Sapiens
APNPSSERH

SEQ ID NO: 143997 - protein, 9 aa, Homo Sapiens
CMAIAGYFD

SEQ ID NO: 143998 - protein, 9 aa, Homo Sapiens
SRAVVFLTF

SEQ ID NO: 143999 - protein, 9 aa, Homo Sapiens
GGGQTPASL

SEQ ID NO: 144000 - protein, 9 aa, Homo Sapiens
YVREQQDTY

SEQ ID NO: 144001 - protein, 9 aa, Homo Sapiens
ILCILLRKQ

SEQ ID NO: 144002 - protein, 9 aa, Homo Sapiens
LYGSNKKLT

SEQ ID NO: 144003 - protein, 9 aa, Homo Sapiens
QHHRCVRDL

SEQ ID NO: 144004 - protein, 9 aa, Homo Sapiens
EFWKKRRTM

SEQ ID NO: 144005 - protein, 9 aa, Homo Sapiens
EKGNFMELG

SEQ ID NO: 144006 - protein, 9 aa, Homo Sapiens
TSVVTRIVE

SEQ ID NO: 144007 - protein, 9 aa, Homo Sapiens
AEGWAPESA

SEQ ID NO: 144008 - protein, 9 aa, Homo Sapiens
TRLWTSVRG

SEQ ID NO: 144009 - protein, 9 aa, Homo Sapiens
KHRIEESIT

SEQ ID NO: 144010 - protein, 9 aa, Homo Sapiens
CSPPLLRRP

SEQ ID NO: 144011 - protein, 9 aa, Homo Sapiens
GRTPLPATT

SEQ ID NO: 144012 - protein, 9 aa, Homo Sapiens
AIASRSVTD

SEQ ID NO: 144013 - protein, 9 aa, Homo Sapiens
LWLLFVVMA

SEQ ID NO: 144014 - protein, 9 aa, Homo Sapiens
STTVASITT

SEQ ID NO: 144015 - protein, 9 aa, Homo Sapiens
SYSFPDLFA

SEQ ID NO: 144016 - protein, 9 aa, Homo Sapiens
GVILDDVDI

SEQ ID NO: 144017 - protein, 9 aa, Homo Sapiens
LSLSPAAVG

SEQ ID NO: 144018 - protein, 9 aa, Homo Sapiens
TGQRLSQAG

SEQ ID NO: 144019 - protein, 9 aa, Homo Sapiens
ALMRWHRIA

SEQ ID NO: 144020 - protein, 9 aa, Homo Sapiens
QLSPQSRVF

SEQ ID NO: 144021 - protein, 9 aa, Homo Sapiens
LWAHRVPAG

SEQ ID NO: 144022 - protein, 9 aa, Homo Sapiens
GYGLGLEQF

SEQ ID NO: 144023 - protein, 9 aa, Homo Sapiens
GDGISDEYH

SEQ ID NO: 144024 - protein, 9 aa, Homo Sapiens
QNLADCLQK

SEQ ID NO: 144025 - protein, 9 aa, Homo Sapiens
SPGKPTFQK

SEQ ID NO: 144026 - protein, 9 aa, Homo Sapiens
LCCCCYGGG

SEQ ID NO: 144027 - protein, 9 aa, Homo Sapiens
SAAAMHTTR

SEQ ID NO: 144028 - protein, 9 aa, Homo Sapiens
PGMRRMGRL

SEQ ID NO: 144029 - protein, 9 aa, Homo Sapiens
GQRLSQAGR

SEQ ID NO: 144030 - protein, 9 aa, Homo Sapiens
TMRDEERIQ

SEQ ID NO: 144031 - protein, 9 aa, Homo Sapiens
LVLCTALNL

SEQ ID NO: 144032 - protein, 9 aa, Homo Sapiens
REWDLSESS

SEQ ID NO: 144033 - protein, 9 aa, Homo Sapiens
RPPHADDAP

SEQ ID NO: 144034 - protein, 9 aa, Homo Sapiens
GDSPKELPP

SEQ ID NO: 144035 - protein, 9 aa, Homo Sapiens
PQAFPKLVQ

SEQ ID NO: 144036 - protein, 9 aa, Homo Sapiens
LALVGPHAR

SEQ ID NO: 144037 - protein, 9 aa, Homo Sapiens
AGKSETCGS

SEQ ID NO: 144038 - protein, 9 aa, Homo Sapiens
FVLPWTELS

SEQ ID NO: 144039 - protein, 9 aa, Homo Sapiens
LTSSYNFKQ

SEQ ID NO: 144040 - protein, 9 aa, Homo Sapiens
PAPQAEAEV

SEQ ID NO: 144041 - protein, 9 aa, Homo Sapiens
PQVLQNYYT

SEQ ID NO: 144042 - protein, 9 aa, Homo Sapiens
QAFVDDPDI

SEQ ID NO: 144043 - protein, 9 aa, Homo Sapiens
QRFGRHTAG

SEQ ID NO: 144044 - protein, 9 aa, Homo Sapiens
ATGQFRCRM

SEQ ID NO: 144045 - protein, 9 aa, Homo Sapiens
SVTDKILDL

SEQ ID NO: 144046 - protein, 9 aa, Homo Sapiens
LNGQNGKLA

SEQ ID NO: 144047 - protein, 9 aa, Homo Sapiens
SPVACPQRL

SEQ ID NO: 144048 - protein, 9 aa, Homo Sapiens
CMGSWRSFI

SEQ ID NO: 144049 - protein, 9 aa, Homo Sapiens
PPCRPRVTP

SEQ ID NO: 144050 - protein, 9 aa, Homo Sapiens
VKINLFFKS

SEQ ID NO: 144051 - protein, 9 aa, Homo Sapiens
SMTLPAPTA

SEQ ID NO: 144052 - protein, 9 aa, Homo Sapiens
TVRPKQRTR

SEQ ID NO: 144053 - protein, 9 aa, Homo Sapiens
KTEKAFPAH

SEQ ID NO: 144054 - protein, 9 aa, Homo Sapiens
LGGLDRIVD

SEQ ID NO: 144055 - protein, 9 aa, Homo Sapiens
LKQVSPASP

SEQ ID NO: 144056 - protein, 9 aa, Homo Sapiens
GGPGTTREP

SEQ ID NO: 144057 - protein, 9 aa, Homo Sapiens
DMTSYTEDF

SEQ ID NO: 144058 - protein, 9 aa, Homo Sapiens
SPAAVGNIL

SEQ ID NO: 144059 - protein, 9 aa, Homo Sapiens
MQAALLRIG

SEQ ID NO: 144060 - protein, 9 aa, Homo Sapiens
TWLGGPSAR

SEQ ID NO: 144061 - protein, 9 aa, Homo Sapiens
GHLWLGTLC

SEQ ID NO: 144062 - protein, 9 aa, Homo Sapiens
GVPVCSGDA

SEQ ID NO: 144063 - protein, 9 aa, Homo Sapiens
LEGWPSWVG

SEQ ID NO: 144064 - protein, 9 aa, Homo Sapiens
GPWHLCMGL

SEQ ID NO: 144065 - protein, 9 aa, Homo Sapiens
IKRSRLEKV

SEQ ID NO: 144066 - protein, 9 aa, Homo Sapiens
GGDLDVQGQ

SEQ ID NO: 144067 - protein, 9 aa, Homo Sapiens
ATRAAARPT

SEQ ID NO: 144068 - protein, 9 aa, Homo Sapiens
AWPCCAPIA

SEQ ID NO: 144069 - protein, 9 aa, Homo Sapiens
CCAYEVTQA

SEQ ID NO: 144070 - protein, 9 aa, Homo Sapiens
TRPERLLAP

SEQ ID NO: 144071 - protein, 9 aa, Homo Sapiens
AENAMWYIN

SEQ ID NO: 144072 - protein, 9 aa, Homo Sapiens
NARRSPRSC

SEQ ID NO: 144073 - protein, 9 aa, Homo Sapiens
VPKKAPRRP

SEQ ID NO: 144074 - protein, 9 aa, Homo Sapiens
MAAFAAQRV

SEQ ID NO: 144075 - protein, 9 aa, Homo Sapiens
KLDQETLRV

SEQ ID NO: 144076 - protein, 9 aa, Homo Sapiens
ATMPILLYN

SEQ ID NO: 144077 - protein, 9 aa, Homo Sapiens
GGPPRSRLA

SEQ ID NO: 144078 - protein, 9 aa, Homo Sapiens
MKKTTSQSQ

SEQ ID NO: 144079 - protein, 9 aa, Homo Sapiens
TGHIISWKR

SEQ ID NO: 144080 - protein, 9 aa, Homo Sapiens
MPAQLFLRR

SEQ ID NO: 144081 - protein, 9 aa, Homo Sapiens
RTSCGAARP

SEQ ID NO: 144082 - protein, 9 aa, Homo Sapiens
RLPKALRCI

SEQ ID NO: 144083 - protein, 9 aa, Homo Sapiens
LIAVRQVDL

SEQ ID NO: 144084 - protein, 9 aa, Homo Sapiens
EGEVNAGRI

SEQ ID NO: 144085 - protein, 9 aa, Homo Sapiens
KLHQMLRPN

SEQ ID NO: 144086 - protein, 9 aa, Homo Sapiens
PPKPWQSPW

SEQ ID NO: 144087 - protein, 9 aa, Homo Sapiens
PPPSVPGAF

SEQ ID NO: 144088 - protein, 9 aa, Homo Sapiens
AVPTPATTL

SEQ ID NO: 144089 - protein, 9 aa, Homo Sapiens
CTHHLLLVK

SEQ ID NO: 144090 - protein, 9 aa, Homo Sapiens
PFTTQAHPI

SEQ ID NO: 144091 - protein, 9 aa, Homo Sapiens
SPMRLESFS

SEQ ID NO: 144092 - protein, 9 aa, Homo Sapiens
SLALSPDSA

SEQ ID NO: 144093 - protein, 9 aa, Homo Sapiens
VEVMNKRLG

SEQ ID NO: 144094 - protein, 9 aa, Homo Sapiens
VVVPLRQDV

SEQ ID NO: 144095 - protein, 9 aa, Homo Sapiens
IHPATTFPT

SEQ ID NO: 144096 - protein, 9 aa, Homo Sapiens
SLPWIPKRN

SEQ ID NO: 144097 - protein, 9 aa, Homo Sapiens
DDHLFYIYT

SEQ ID NO: 144098 - protein, 9 aa, Homo Sapiens
PPRTLHGGR

SEQ ID NO: 144099 - protein, 9 aa, Homo Sapiens
VASQGLHAL

SEQ ID NO: 144100 - protein, 9 aa, Homo Sapiens
TVCKPGPIT

SEQ ID NO: 144101 - protein, 9 aa, Homo Sapiens
QRLGDPGRA

SEQ ID NO: 144102 - protein, 9 aa, Homo Sapiens
LPIGLSGIP

SEQ ID NO: 144103 - protein, 9 aa, Homo Sapiens
TRMQRIKVC

SEQ ID NO: 144104 - protein, 9 aa, Homo Sapiens
SCRPSVQAQ

SEQ ID NO: 144105 - protein, 9 aa, Homo Sapiens
STTSAASGS

SEQ ID NO: 144106 - protein, 9 aa, Homo Sapiens
EGRPPDVLW

SEQ ID NO: 144107 - protein, 9 aa, Homo Sapiens
ASPGILKFW

SEQ ID NO: 144108 - protein, 9 aa, Homo Sapiens
PSLRTRVQK

SEQ ID NO: 144109 - protein, 9 aa, Homo Sapiens
NLLTGCLSF

SEQ ID NO: 144110 - protein, 9 aa, Homo Sapiens
LLRNMAMAT

SEQ ID NO: 144111 - protein, 9 aa, Homo Sapiens
FSSSSSASF

SEQ ID NO: 144112 - protein, 9 aa, Homo Sapiens
TGHGRARPT

SEQ ID NO: 144113 - protein, 9 aa, Homo Sapiens
PPPLLKLGN

SEQ ID NO: 144114 - protein, 9 aa, Homo Sapiens
TPSTCLGGS

SEQ ID NO: 144115 - protein, 9 aa, Homo Sapiens
YPEKIDGFR

SEQ ID NO: 144116 - protein, 9 aa, Homo Sapiens
SEKSNKKIS

SEQ ID NO: 144117 - protein, 9 aa, Homo Sapiens
SQRPSLAVS

SEQ ID NO: 144118 - protein, 9 aa, Homo Sapiens
RGPAVRTRS

SEQ ID NO: 144119 - protein, 9 aa, Homo Sapiens
PEQVNLKWP

SEQ ID NO: 144120 - protein, 9 aa, Homo Sapiens
VQAAATMPI

SEQ ID NO: 144121 - protein, 9 aa, Homo Sapiens
SPSYAPQVT

SEQ ID NO: 144122 - protein, 9 aa, Homo Sapiens
EPCDLPVPQ

SEQ ID NO: 144123 - protein, 9 aa, Homo Sapiens
LVWLEELRR

SEQ ID NO: 144124 - protein, 9 aa, Homo Sapiens
KTVNSSHDT

SEQ ID NO: 144125 - protein, 9 aa, Homo Sapiens
QINPTNVKN

SEQ ID NO: 144126 - protein, 9 aa, Homo Sapiens
LIDENKLLH

SEQ ID NO: 144127 - protein, 9 aa, Homo Sapiens
KQVLGESGE

SEQ ID NO: 144128 - protein, 9 aa, Homo Sapiens
IYVKINLFF

SEQ ID NO: 144129 - protein, 9 aa, Homo Sapiens
SCHLITQDG

SEQ ID NO: 144130 - protein, 9 aa, Homo Sapiens
RRGGGRQRG

SEQ ID NO: 144131 - protein, 9 aa, Homo Sapiens
PKQDTMTFS

SEQ ID NO: 144132 - protein, 9 aa, Homo Sapiens
PLGDTPQPS

SEQ ID NO: 144133 - protein, 9 aa, Homo Sapiens
TSHPCRWFC

SEQ ID NO: 144134 - protein, 9 aa, Homo Sapiens
YSAVVKVPS

SEQ ID NO: 144135 - protein, 9 aa, Homo Sapiens
GVTTGLLVH

SEQ ID NO: 144136 - protein, 9 aa, Homo Sapiens
LPGGTDTMS

SEQ ID NO: 144137 - protein, 9 aa, Homo Sapiens
KVMHKTFGT

SEQ ID NO: 144138 - protein, 9 aa, Homo Sapiens
SPARSAAAA

SEQ ID NO: 144139 - protein, 9 aa, Homo Sapiens
MRSRSNSPR

SEQ ID NO: 144140 - protein, 9 aa, Homo Sapiens
LSASSTLEL

SEQ ID NO: 144141 - protein, 9 aa, Homo Sapiens
SCSKAYRER

SEQ ID NO: 144142 - protein, 9 aa, Homo Sapiens
ASGPSPARS

SEQ ID NO: 144143 - protein, 9 aa, Homo Sapiens
EIRPRKALD

SEQ ID NO: 144144 - protein, 9 aa, Homo Sapiens
LLPECFRHA

SEQ ID NO: 144145 - protein, 9 aa, Homo Sapiens
VVGQQGRAR

SEQ ID NO: 144146 - protein, 9 aa, Homo Sapiens
AYKVPVTLA

SEQ ID NO: 144147 - protein, 9 aa, Homo Sapiens
IRGEVWSFL

SEQ ID NO: 144148 - protein, 9 aa, Homo Sapiens
GRHKAFSAC

SEQ ID NO: 144149 - protein, 9 aa, Homo Sapiens
LGREWDLSE

SEQ ID NO: 144150 - protein, 9 aa, Homo Sapiens
SPSTAAWIP

SEQ ID NO: 144151 - protein, 9 aa, Homo Sapiens
SQLTFPAVM

SEQ ID NO: 144152 - protein, 9 aa, Homo Sapiens
DARNIWYLA

SEQ ID NO: 144153 - protein, 9 aa, Homo Sapiens
QFQNLADCL

SEQ ID NO: 144154 - protein, 9 aa, Homo Sapiens
KVSKKRLPK

SEQ ID NO: 144155 - protein, 9 aa, Homo Sapiens
WSLTSSLPG

SEQ ID NO: 144156 - protein, 9 aa, Homo Sapiens
TRARKGREE

SEQ ID NO: 144157 - protein, 9 aa, Homo Sapiens
VCAVRAVGQ

SEQ ID NO: 144158 - protein, 9 aa, Homo Sapiens
RVVDHRVFG

SEQ ID NO: 144159 - protein, 9 aa, Homo Sapiens
IMGVPPGAS

SEQ ID NO: 144160 - protein, 9 aa, Homo Sapiens
PDQEPTHTG

SEQ ID NO: 144161 - protein, 9 aa, Homo Sapiens
KKKKRKRNL

SEQ ID NO: 144162 - protein, 9 aa, Homo Sapiens
MCCVIIPPG

SEQ ID NO: 144163 - protein, 9 aa, Homo Sapiens
ATVRPKQRT

SEQ ID NO: 144164 - protein, 9 aa, Homo Sapiens
RTTTTSTRW

SEQ ID NO: 144165 - protein, 9 aa, Homo Sapiens
YGLGLEQFL

SEQ ID NO: 144166 - protein, 9 aa, Homo Sapiens
FWSVQGNLL

SEQ ID NO: 144167 - protein, 9 aa, Homo Sapiens
HRVPAGSGS

SEQ ID NO: 144168 - protein, 9 aa, Homo Sapiens
TKKNKGRLW

SEQ ID NO: 144169 - protein, 9 aa, Homo Sapiens
AHIPLFCTP

SEQ ID NO: 144170 - protein, 9 aa, Homo Sapiens
PVIPLAVLG

SEQ ID NO: 144171 - protein, 9 aa, Homo Sapiens
PGAQIYMCF

SEQ ID NO: 144172 - protein, 9 aa, Homo Sapiens
PLLVFFLLL

SEQ ID NO: 144173 - protein, 9 aa, Homo Sapiens
SGSAGSGSG

SEQ ID NO: 144174 - protein, 9 aa, Homo Sapiens
TTQIAMAAQ

SEQ ID NO: 144175 - protein, 9 aa, Homo Sapiens
VKSPREYYM

SEQ ID NO: 144176 - protein, 9 aa, Homo Sapiens
DPILQEAKF

SEQ ID NO: 144177 - protein, 9 aa, Homo Sapiens
QGGYRDKTR

SEQ ID NO: 144178 - protein, 9 aa, Homo Sapiens
HPPTTTTSS

SEQ ID NO: 144179 - protein, 9 aa, Homo Sapiens
AVAVARLWW

SEQ ID NO: 144180 - protein, 9 aa, Homo Sapiens
QRTENIKEM

SEQ ID NO: 144181 - protein, 9 aa, Homo Sapiens
AAMHTTRPV

SEQ ID NO: 144182 - protein, 9 aa, Homo Sapiens
APMEEEESE

SEQ ID NO: 144183 - protein, 9 aa, Homo Sapiens
FGLPPAQPP

SEQ ID NO: 144184 - protein, 9 aa, Homo Sapiens
NQVRLKVLR

SEQ ID NO: 144185 - protein, 9 aa, Homo Sapiens
CRAQTVAPR

SEQ ID NO: 144186 - protein, 9 aa, Homo Sapiens
ILLEKMKHL

SEQ ID NO: 144187 - protein, 9 aa, Homo Sapiens
PIEAPPPST

SEQ ID NO: 144188 - protein, 9 aa, Homo Sapiens
HIPVVRRES

SEQ ID NO: 144189 - protein, 9 aa, Homo Sapiens
AALALDVAV

SEQ ID NO: 144190 - protein, 9 aa, Homo Sapiens
RATSGTAPS

SEQ ID NO: 144191 - protein, 9 aa, Homo Sapiens
GPLLCLGPT

SEQ ID NO: 144192 - protein, 9 aa, Homo Sapiens
PHARVDAHV

SEQ ID NO: 144193 - protein, 9 aa, Homo Sapiens
PFLQKLQGS

SEQ ID NO: 144194 - protein, 9 aa, Homo Sapiens
RNRRLGSCT

SEQ ID NO: 144195 - protein, 9 aa, Homo Sapiens
HILYLEAGM

SEQ ID NO: 144196 - protein, 9 aa, Homo Sapiens
VFYINVSKA

SEQ ID NO: 144197 - protein, 9 aa, Homo Sapiens
AVATQGPWL

SEQ ID NO: 144198 - protein, 9 aa, Homo Sapiens
AIFYRPMGR

SEQ ID NO: 144199 - protein, 9 aa, Homo Sapiens
PSSERHSPR

SEQ ID NO: 144200 - protein, 9 aa, Homo Sapiens
PTRRGEAAH

SEQ ID NO: 144201 - protein, 9 aa, Homo Sapiens
SEGKLILSQ

SEQ ID NO: 144202 - protein, 9 aa, Homo Sapiens
NLVRLMGPW

SEQ ID NO: 144203 - protein, 9 aa, Homo Sapiens
SSSGAGKSE

SEQ ID NO: 144204 - protein, 9 aa, Homo Sapiens
SEQANQGSV

SEQ ID NO: 144205 - protein, 9 aa, Homo Sapiens
SLHDIMCQC

SEQ ID NO: 144206 - protein, 9 aa, Homo Sapiens
VRGRDAPYC

SEQ ID NO: 144207 - protein, 9 aa, Homo Sapiens
TARSVLRPH

SEQ ID NO: 144208 - protein, 9 aa, Homo Sapiens
LEQREALVL

SEQ ID NO: 144209 - protein, 9 aa, Homo Sapiens
RDEERIQLM

SEQ ID NO: 144210 - protein, 9 aa, Homo Sapiens
DEAEPLGKG

SEQ ID NO: 144211 - protein, 9 aa, Homo Sapiens
WDDSWDLDD

SEQ ID NO: 144212 - protein, 9 aa, Homo Sapiens
SEEVLTAEY

SEQ ID NO: 144213 - protein, 9 aa, Homo Sapiens
ALSCRTRRR

SEQ ID NO: 144214 - protein, 9 aa, Homo Sapiens
LLKEKVLKL

SEQ ID NO: 144215 - protein, 9 aa, Homo Sapiens
AGAAERGVP

SEQ ID NO: 144216 - protein, 9 aa, Homo Sapiens
GQLDVHQLL

SEQ ID NO: 144217 - protein, 9 aa, Homo Sapiens
PALPTQQLA

SEQ ID NO: 144218 - protein, 9 aa, Homo Sapiens
RELCAAQLA

SEQ ID NO: 144219 - protein, 9 aa, Homo Sapiens
HRRSPGEWF

SEQ ID NO: 144220 - protein, 9 aa, Homo Sapiens
ERKRKGRPL

SEQ ID NO: 144221 - protein, 9 aa, Homo Sapiens
PSRPLPPPP

SEQ ID NO: 144222 - protein, 9 aa, Homo Sapiens
ATNPTWRRT

SEQ ID NO: 144223 - protein, 9 aa, Homo Sapiens
KNPLKTVVK

SEQ ID NO: 144224 - protein, 9 aa, Homo Sapiens
IMEATVQNN

SEQ ID NO: 144225 - protein, 9 aa, Homo Sapiens
SFFHYQVTE

SEQ ID NO: 144226 - protein, 9 aa, Homo Sapiens
DENAFNGIC

SEQ ID NO: 144227 - protein, 9 aa, Homo Sapiens
FESFFHYQV

SEQ ID NO: 144228 - protein, 9 aa, Homo Sapiens
DSLEIFAKL

SEQ ID NO: 144229 - protein, 9 aa, Homo Sapiens
KRLLYKLKL

SEQ ID NO: 144230 - protein, 9 aa, Homo Sapiens
GLQLALFYQ

SEQ ID NO: 144231 - protein, 9 aa, Homo Sapiens
KKPGSKIFK

SEQ ID NO: 144232 - protein, 9 aa, Homo Sapiens
SPRWWSTAR

SEQ ID NO: 144233 - protein, 9 aa, Homo Sapiens
GRRLPTACT

SEQ ID NO: 144234 - protein, 9 aa, Homo Sapiens
TELIAVNAT

SEQ ID NO: 144235 - protein, 9 aa, Homo Sapiens
LDNPETTAA

SEQ ID NO: 144236 - protein, 9 aa, Homo Sapiens
SYLLQITEL

SEQ ID NO: 144237 - protein, 9 aa, Homo Sapiens
GDDSVLLIP

SEQ ID NO: 144238 - protein, 9 aa, Homo Sapiens
LFALLFLGN

SEQ ID NO: 144239 - protein, 9 aa, Homo Sapiens
KAYEFLCTN

SEQ ID NO: 144240 - protein, 9 aa, Homo Sapiens
TARVILGKH

SEQ ID NO: 144241 - protein, 9 aa, Homo Sapiens
RAQGNSLLG

SEQ ID NO: 144242 - protein, 9 aa, Homo Sapiens
GLISGWARN

SEQ ID NO: 144243 - protein, 9 aa, Homo Sapiens
EVIMDRPLQ

SEQ ID NO: 144244 - protein, 9 aa, Homo Sapiens
PLVSSDARN

SEQ ID NO: 144245 - protein, 9 aa, Homo Sapiens
RLLGGLDRI

SEQ ID NO: 144246 - protein, 9 aa, Homo Sapiens
WSSRIVAPG

SEQ ID NO: 144247 - protein, 9 aa, Homo Sapiens
KEQCASNIY

SEQ ID NO: 144248 - protein, 9 aa, Homo Sapiens
HELGVAVDA

SEQ ID NO: 144249 - protein, 9 aa, Homo Sapiens
GTGPQQSRP

SEQ ID NO: 144250 - protein, 9 aa, Homo Sapiens
SKVQSVEAV

SEQ ID NO: 144251 - protein, 9 aa, Homo Sapiens
DPPSASQSA

SEQ ID NO: 144252 - protein, 9 aa, Homo Sapiens
ALAYHLTDL

SEQ ID NO: 144253 - protein, 9 aa, Homo Sapiens
PLCFVLPWT

SEQ ID NO: 144254 - protein, 9 aa, Homo Sapiens
IDLDKYEVC

SEQ ID NO: 144255 - protein, 9 aa, Homo Sapiens
VRRRRRHRR

SEQ ID NO: 144256 - protein, 9 aa, Homo Sapiens
HEQGYVPDH

SEQ ID NO: 144257 - protein, 9 aa, Homo Sapiens
WRGERLRHH

SEQ ID NO: 144258 - protein, 9 aa, Homo Sapiens
NAAVGSQPC

SEQ ID NO: 144259 - protein, 9 aa, Homo Sapiens
GRWRVGDVA

SEQ ID NO: 144260 - protein, 9 aa, Homo Sapiens
LPPPQVTSA

SEQ ID NO: 144261 - protein, 9 aa, Homo Sapiens
LVAAFFVLW

SEQ ID NO: 144262 - protein, 9 aa, Homo Sapiens
HPETVDSAL

SEQ ID NO: 144263 - protein, 9 aa, Homo Sapiens
VRGEWRQGG

SEQ ID NO: 144264 - protein, 9 aa, Homo Sapiens
CSYRVLPSP

SEQ ID NO: 144265 - protein, 9 aa, Homo Sapiens
SSSTYVNPQ

SEQ ID NO: 144266 - protein, 9 aa, Homo Sapiens
LPSPSMWRT

SEQ ID NO: 144267 - protein, 9 aa, Homo Sapiens
VPAHGPTNI

SEQ ID NO: 144268 - protein, 9 aa, Homo Sapiens
LQKLGREPH

SEQ ID NO: 144269 - protein, 9 aa, Homo Sapiens
VTKAPDLLI

SEQ ID NO: 144270 - protein, 9 aa, Homo Sapiens
LGTAPWPPY

SEQ ID NO: 144271 - protein, 9 aa, Homo Sapiens
SPAGMGSSP

SEQ ID NO: 144272 - protein, 9 aa, Homo Sapiens
SGSGLNAWN

SEQ ID NO: 144273 - protein, 9 aa, Homo Sapiens
LSLRGMVPR

SEQ ID NO: 144274 - protein, 9 aa, Homo Sapiens
LSKFMSCVS

SEQ ID NO: 144275 - protein, 9 aa, Homo Sapiens
YEAYHGVFV

SEQ ID NO: 144276 - protein, 9 aa, Homo Sapiens
AYIDPETKK

SEQ ID NO: 144277 - protein, 9 aa, Homo Sapiens
WNLESLNGQ

SEQ ID NO: 144278 - protein, 9 aa, Homo Sapiens
VFFSLLFIA

SEQ ID NO: 144279 - protein, 9 aa, Homo Sapiens
GSGSAGSGS

SEQ ID NO: 144280 - protein, 9 aa, Homo Sapiens
NSPVSLPEL

SEQ ID NO: 144281 - protein, 9 aa, Homo Sapiens
KGNVLQPEE

SEQ ID NO: 144282 - protein, 9 aa, Homo Sapiens
SYLFPQDKF

SEQ ID NO: 144283 - protein, 9 aa, Homo Sapiens
CLYSVCEQC

SEQ ID NO: 144284 - protein, 9 aa, Homo Sapiens
QTEQHPREQ

SEQ ID NO: 144285 - protein, 9 aa, Homo Sapiens
EAPLWRVTQ

SEQ ID NO: 144286 - protein, 9 aa, Homo Sapiens
TVPSNFWKG

SEQ ID NO: 144287 - protein, 9 aa, Homo Sapiens
ALTFRKEQC

SEQ ID NO: 144288 - protein, 9 aa, Homo Sapiens
SSSSCKKQA

SEQ ID NO: 144289 - protein, 9 aa, Homo Sapiens
PPLWPPPGS

SEQ ID NO: 144290 - protein, 9 aa, Homo Sapiens
RWARRCTGP

SEQ ID NO: 144291 - protein, 9 aa, Homo Sapiens
LMAELHNLY

SEQ ID NO: 144292 - protein, 9 aa, Homo Sapiens
VCHPEQVNL

SEQ ID NO: 144293 - protein, 9 aa, Homo Sapiens
RSPTWCRTG

SEQ ID NO: 144294 - protein, 9 aa, Homo Sapiens
LPADPILQE

SEQ ID NO: 144295 - protein, 9 aa, Homo Sapiens
AHSLLCLLR

SEQ ID NO: 144296 - protein, 9 aa, Homo Sapiens
FHTGASPVW

SEQ ID NO: 144297 - protein, 9 aa, Homo Sapiens
VMGYTTYDA

SEQ ID NO: 144298 - protein, 9 aa, Homo Sapiens
GRALPLPRG

SEQ ID NO: 144299 - protein, 9 aa, Homo Sapiens
MNVRNTIHG

SEQ ID NO: 144300 - protein, 9 aa, Homo Sapiens
THKHTHRHT

SEQ ID NO: 144301 - protein, 9 aa, Homo Sapiens
GTQAKELWH

SEQ ID NO: 144302 - protein, 9 aa, Homo Sapiens
GLEVIKKPP

SEQ ID NO: 144303 - protein, 9 aa, Homo Sapiens
QKTRSLVGT

SEQ ID NO: 144304 - protein, 9 aa, Homo Sapiens
LWRGCGTGT

SEQ ID NO: 144305 - protein, 9 aa, Homo Sapiens
VHDFTDAII

SEQ ID NO: 144306 - protein, 9 aa, Homo Sapiens
LPPSAIGPR

SEQ ID NO: 144307 - protein, 9 aa, Homo Sapiens
PSGCTAKTG

SEQ ID NO: 144308 - protein, 9 aa, Homo Sapiens
TEMDMWSTQ

SEQ ID NO: 144309 - protein, 9 aa, Homo Sapiens
PGRKGTAGL

SEQ ID NO: 144310 - protein, 9 aa, Homo Sapiens
PVTSSRSFL

SEQ ID NO: 144311 - protein, 9 aa, Homo Sapiens
VMSFDRYMV

SEQ ID NO: 144312 - protein, 9 aa, Homo Sapiens
AGRQQPSAS

SEQ ID NO: 144313 - protein, 9 aa, Homo Sapiens
VVVSALLQC

SEQ ID NO: 144314 - protein, 9 aa, Homo Sapiens
CFGDYHVTF

SEQ ID NO: 144315 - protein, 9 aa, Homo Sapiens
FGILQSVVG

SEQ ID NO: 144316 - protein, 9 aa, Homo Sapiens
LRCGCTARP

SEQ ID NO: 144317 - protein, 9 aa, Homo Sapiens
LPCSPPLLR

SEQ ID NO: 144318 - protein, 9 aa, Homo Sapiens
QNGCLYRLR

SEQ ID NO: 144319 - protein, 9 aa, Homo Sapiens
YETPIKKKR

SEQ ID NO: 144320 - protein, 9 aa, Homo Sapiens
WRSFICRMR

SEQ ID NO: 144321 - protein, 9 aa, Homo Sapiens
VLAMCRRLS

SEQ ID NO: 144322 - protein, 9 aa, Homo Sapiens
PLHPQPAPA

SEQ ID NO: 144323 - protein, 9 aa, Homo Sapiens
SIFLLFPTS

SEQ ID NO: 144324 - protein, 9 aa, Homo Sapiens
LYLQALDYD

SEQ ID NO: 144325 - protein, 9 aa, Homo Sapiens
LKKTEKAFP

SEQ ID NO: 144326 - protein, 9 aa, Homo Sapiens
WLWRGCGTG

SEQ ID NO: 144327 - protein, 9 aa, Homo Sapiens
RLQQKMLLA

SEQ ID NO: 144328 - protein, 9 aa, Homo Sapiens
FRLQGRVTE

SEQ ID NO: 144329 - protein, 9 aa, Homo Sapiens
AVCGDHQPG

SEQ ID NO: 144330 - protein, 9 aa, Homo Sapiens
SQYLSGVGV

SEQ ID NO: 144331 - protein, 9 aa, Homo Sapiens
YMCFMQEHT

SEQ ID NO: 144332 - protein, 9 aa, Homo Sapiens
LRTRSIFVS

SEQ ID NO: 144333 - protein, 9 aa, Homo Sapiens
SNSSTLRLK

SEQ ID NO: 144334 - protein, 9 aa, Homo Sapiens
IGEKTEIQL

SEQ ID NO: 144335 - protein, 9 aa, Homo Sapiens
LRMVSFCCS

SEQ ID NO: 144336 - protein, 9 aa, Homo Sapiens
LLHLGIHIV

SEQ ID NO: 144337 - protein, 9 aa, Homo Sapiens
NQLLEVVPL

SEQ ID NO: 144338 - protein, 9 aa, Homo Sapiens
GKGHTNTGD

SEQ ID NO: 144339 - protein, 9 aa, Homo Sapiens
IGSSCSFVE

SEQ ID NO: 144340 - protein, 9 aa, Homo Sapiens
YKAKNKVGH

SEQ ID NO: 144341 - protein, 9 aa, Homo Sapiens
PARPPQVQP

SEQ ID NO: 144342 - protein, 9 aa, Homo Sapiens
VLTAEYCEN

SEQ ID NO: 144343 - protein, 9 aa, Homo Sapiens
PPPARASPA

SEQ ID NO: 144344 - protein, 9 aa, Homo Sapiens
ASVNSIWRR

SEQ ID NO: 144345 - protein, 9 aa, Homo Sapiens
WATWLDFLK

SEQ ID NO: 144346 - protein, 9 aa, Homo Sapiens
PAPQCRRAG

SEQ ID NO: 144347 - protein, 9 aa, Homo Sapiens
CYGGGGSTC

SEQ ID NO: 144348 - protein, 9 aa, Homo Sapiens
SGDLPCDWR

SEQ ID NO: 144349 - protein, 9 aa, Homo Sapiens
QTHTGIHRH

SEQ ID NO: 144350 - protein, 9 aa, Homo Sapiens
RPLIFLPPV

SEQ ID NO: 144351 - protein, 9 aa, Homo Sapiens
PSGPREPHP

SEQ ID NO: 144352 - protein, 9 aa, Homo Sapiens
RHPLPPRPR

SEQ ID NO: 144353 - protein, 9 aa, Homo Sapiens
PESLHDIMC

SEQ ID NO: 144354 - protein, 9 aa, Homo Sapiens
CANTRPGSE

SEQ ID NO: 144355 - protein, 9 aa, Homo Sapiens
HHLGCVLRR

SEQ ID NO: 144356 - protein, 9 aa, Homo Sapiens
WRRMEVSCS

SEQ ID NO: 144357 - protein, 9 aa, Homo Sapiens
RELRTRSRS

SEQ ID NO: 144358 - protein, 9 aa, Homo Sapiens
VVRAREALV

SEQ ID NO: 144359 - protein, 9 aa, Homo Sapiens
LPSEQESIT

SEQ ID NO: 144360 - protein, 9 aa, Homo Sapiens
KDVLAWVKN

SEQ ID NO: 144361 - protein, 9 aa, Homo Sapiens
FSVALSTNI

SEQ ID NO: 144362 - protein, 9 aa, Homo Sapiens
VSVWLQCGN

SEQ ID NO: 144363 - protein, 9 aa, Homo Sapiens
ESYEDNSYT

SEQ ID NO: 144364 - protein, 9 aa, Homo Sapiens
FPMVPGETG

SEQ ID NO: 144365 - protein, 9 aa, Homo Sapiens
GPASVAPAT

SEQ ID NO: 144366 - protein, 9 aa, Homo Sapiens
LSPQSRVFA

SEQ ID NO: 144367 - protein, 9 aa, Homo Sapiens
GEWSLCTCT

SEQ ID NO: 144368 - protein, 9 aa, Homo Sapiens
PAPGSPRLC

SEQ ID NO: 144369 - protein, 9 aa, Homo Sapiens
IHTDTHTGT

SEQ ID NO: 144370 - protein, 9 aa, Homo Sapiens
CATVHQGLT

SEQ ID NO: 144371 - protein, 9 aa, Homo Sapiens
IFLQPLLLL

SEQ ID NO: 144372 - protein, 9 aa, Homo Sapiens
EKRKLKALL

SEQ ID NO: 144373 - protein, 9 aa, Homo Sapiens
TDTVGCCSL

SEQ ID NO: 144374 - protein, 9 aa, Homo Sapiens
GGLHSSPPT

SEQ ID NO: 144375 - protein, 9 aa, Homo Sapiens
RTQRPLEML

SEQ ID NO: 144376 - protein, 9 aa, Homo Sapiens
ELVRFALRV

SEQ ID NO: 144377 - protein, 9 aa, Homo Sapiens
GKHIAHITP

SEQ ID NO: 144378 - protein, 9 aa, Homo Sapiens
SICCGHGHN

SEQ ID NO: 144379 - protein, 9 aa, Homo Sapiens
LEAARSRDV

SEQ ID NO: 144380 - protein, 9 aa, Homo Sapiens
RMENGLWLK

SEQ ID NO: 144381 - protein, 9 aa, Homo Sapiens
SPVPLRIHF

SEQ ID NO: 144382 - protein, 9 aa, Homo Sapiens
SMEFRQKGS

SEQ ID NO: 144383 - protein, 9 aa, Homo Sapiens
GHTHTVATF

SEQ ID NO: 144384 - protein, 9 aa, Homo Sapiens
FEYHQSTLQ

SEQ ID NO: 144385 - protein, 9 aa, Homo Sapiens
PQSSFVPTQ

SEQ ID NO: 144386 - protein, 9 aa, Homo Sapiens
QVRTLHRKL

SEQ ID NO: 144387 - protein, 9 aa, Homo Sapiens
RGHRGAHRS

SEQ ID NO: 144388 - protein, 9 aa, Homo Sapiens
PQAEAEVRP

SEQ ID NO: 144389 - protein, 9 aa, Homo Sapiens
LVSRPPSLH

SEQ ID NO: 144390 - protein, 9 aa, Homo Sapiens
PPIPLPLPC

SEQ ID NO: 144391 - protein, 9 aa, Homo Sapiens
AVVWDPVHR

SEQ ID NO: 144392 - protein, 9 aa, Homo Sapiens
DGAHVWLLP

SEQ ID NO: 144393 - protein, 9 aa, Homo Sapiens
KALTRLNLR

SEQ ID NO: 144394 - protein, 9 aa, Homo Sapiens
VSSGRRKTS

SEQ ID NO: 144395 - protein, 9 aa, Homo Sapiens
PSLRPPHAD

SEQ ID NO: 144396 - protein, 9 aa, Homo Sapiens
DISVCRDLD

SEQ ID NO: 144397 - protein, 9 aa, Homo Sapiens
PYVETPMSP

SEQ ID NO: 144398 - protein, 9 aa, Homo Sapiens
DASPAGPLA

SEQ ID NO: 144399 - protein, 9 aa, Homo Sapiens
IPRTRGLIS

SEQ ID NO: 144400 - protein, 9 aa, Homo Sapiens
PPSAAQGSV

SEQ ID NO: 144401 - protein, 9 aa, Homo Sapiens
SWKCLVVVS

SEQ ID NO: 144402 - protein, 9 aa, Homo Sapiens
QTMKTVPSN

SEQ ID NO: 144403 - protein, 9 aa, Homo Sapiens
EMVQRWASN

SEQ ID NO: 144404 - protein, 9 aa, Homo Sapiens
RIAYKCCIT

SEQ ID NO: 144405 - protein, 9 aa, Homo Sapiens
ALEIKHISK

SEQ ID NO: 144406 - protein, 9 aa, Homo Sapiens
QAKTGTQGE

SEQ ID NO: 144407 - protein, 9 aa, Homo Sapiens
WSVQGNLLS

SEQ ID NO: 144408 - protein, 9 aa, Homo Sapiens
KPSAKPPLW

SEQ ID NO: 144409 - protein, 9 aa, Homo Sapiens
AVPRSGSEA

SEQ ID NO: 144410 - protein, 9 aa, Homo Sapiens
ALFLKLASG

SEQ ID NO: 144411 - protein, 9 aa, Homo Sapiens
EPRLGPRPH

SEQ ID NO: 144412 - protein, 9 aa, Homo Sapiens
VVVAARPGC

SEQ ID NO: 144413 - protein, 9 aa, Homo Sapiens
KKKEGVPSG

SEQ ID NO: 144414 - protein, 9 aa, Homo Sapiens
VFSGRTPLP

SEQ ID NO: 144415 - protein, 9 aa, Homo Sapiens
GQLTGSFFT

SEQ ID NO: 144416 - protein, 9 aa, Homo Sapiens
LVHADSQGQ

SEQ ID NO: 144417 - protein, 9 aa, Homo Sapiens
RRAQGNSLL

SEQ ID NO: 144418 - protein, 9 aa, Homo Sapiens
AVWSCVNVA

SEQ ID NO: 144419 - protein, 9 aa, Homo Sapiens
HYCPELPAP

SEQ ID NO: 144420 - protein, 9 aa, Homo Sapiens
MEATVQNNW

SEQ ID NO: 144421 - protein, 9 aa, Homo Sapiens
APPSPSNPG

SEQ ID NO: 144422 - protein, 9 aa, Homo Sapiens
RATGCWGLG

SEQ ID NO: 144423 - protein, 9 aa, Homo Sapiens
DADVRQWKE

SEQ ID NO: 144424 - protein, 9 aa, Homo Sapiens
KSNKKISVL

SEQ ID NO: 144425 - protein, 9 aa, Homo Sapiens
DTTRTSCIP

SEQ ID NO: 144426 - protein, 9 aa, Homo Sapiens
AEGVPAPAY

SEQ ID NO: 144427 - protein, 9 aa, Homo Sapiens
LPTRTPLAT

SEQ ID NO: 144428 - protein, 9 aa, Homo Sapiens
QKASMTKKS

SEQ ID NO: 144429 - protein, 9 aa, Homo Sapiens
SHCAQSKTV

SEQ ID NO: 144430 - protein, 9 aa, Homo Sapiens
HRWLQQTTG

SEQ ID NO: 144431 - protein, 9 aa, Homo Sapiens
VIIPPGSSH

SEQ ID NO: 144432 - protein, 9 aa, Homo Sapiens
EKKRCARIN

SEQ ID NO: 144433 - protein, 9 aa, Homo Sapiens
PCTVLTAPG

SEQ ID NO: 144434 - protein, 9 aa, Homo Sapiens
VVFLTAITL

SEQ ID NO: 144435 - protein, 9 aa, Homo Sapiens
PRSGSEAGA

SEQ ID NO: 144436 - protein, 9 aa, Homo Sapiens
VLTAPGVCW

SEQ ID NO: 144437 - protein, 9 aa, Homo Sapiens
AGSLLRNNG

SEQ ID NO: 144438 - protein, 9 aa, Homo Sapiens
LPPPPACSP

SEQ ID NO: 144439 - protein, 9 aa, Homo Sapiens
PCAPMPKKL

SEQ ID NO: 144440 - protein, 9 aa, Homo Sapiens
KYASIILLH

SEQ ID NO: 144441 - protein, 9 aa, Homo Sapiens
EELEREHFW

SEQ ID NO: 144442 - protein, 9 aa, Homo Sapiens
VCCPRAPEV

SEQ ID NO: 144443 - protein, 9 aa, Homo Sapiens
PAEGVVGPK

SEQ ID NO: 144444 - protein, 9 aa, Homo Sapiens
FYNPQWAHL

SEQ ID NO: 144445 - protein, 9 aa, Homo Sapiens
VSCPEDPWT

SEQ ID NO: 144446 - protein, 9 aa, Homo Sapiens
STPGSGPSP

SEQ ID NO: 144447 - protein, 9 aa, Homo Sapiens
ASQLGRLDA

SEQ ID NO: 144448 - protein, 9 aa, Homo Sapiens
LHLARSHQP

SEQ ID NO: 144449 - protein, 9 aa, Homo Sapiens
GPFQSCKNS

SEQ ID NO: 144450 - protein, 9 aa, Homo Sapiens
GGSCRLQLR

SEQ ID NO: 144451 - protein, 9 aa, Homo Sapiens
LSLHILYLE

SEQ ID NO: 144452 - protein, 9 aa, Homo Sapiens
QMKRVGPKS

SEQ ID NO: 144453 - protein, 9 aa, Homo Sapiens
TSAGTVSDA

SEQ ID NO: 144454 - protein, 9 aa, Homo Sapiens
WHGSLYPLI

SEQ ID NO: 144455 - protein, 9 aa, Homo Sapiens
RALLYQGPH

SEQ ID NO: 144456 - protein, 9 aa, Homo Sapiens
MCRRLSFTL

SEQ ID NO: 144457 - protein, 9 aa, Homo Sapiens
PPNHPSQQS

SEQ ID NO: 144458 - protein, 9 aa, Homo Sapiens
NGASTARWR

SEQ ID NO: 144459 - protein, 9 aa, Homo Sapiens
QAFPKLVQI

SEQ ID NO: 144460 - protein, 9 aa, Homo Sapiens
KLLVTPPQG

SEQ ID NO: 144461 - protein, 9 aa, Homo Sapiens
GAAWSRRPS

SEQ ID NO: 144462 - protein, 9 aa, Homo Sapiens
HTHTGTHTD

SEQ ID NO: 144463 - protein, 9 aa, Homo Sapiens
EERRLHQAA

SEQ ID NO: 144464 - protein, 9 aa, Homo Sapiens
GGGGPGPAQ

SEQ ID NO: 144465 - protein, 9 aa, Homo Sapiens
RLSAQSEGL

SEQ ID NO: 144466 - protein, 9 aa, Homo Sapiens
KLILSQDTC

SEQ ID NO: 144467 - protein, 9 aa, Homo Sapiens
AASTPAKME

SEQ ID NO: 144468 - protein, 9 aa, Homo Sapiens
VAPTAPATA

SEQ ID NO: 144469 - protein, 9 aa, Homo Sapiens
TAALLTDGT

SEQ ID NO: 144470 - protein, 9 aa, Homo Sapiens
PQCTFFFLH

SEQ ID NO: 144471 - protein, 9 aa, Homo Sapiens
GGCVQQVAL

SEQ ID NO: 144472 - protein, 9 aa, Homo Sapiens
RLPPHHRRR

SEQ ID NO: 144473 - protein, 9 aa, Homo Sapiens
PSSNFLTTK

SEQ ID NO: 144474 - protein, 9 aa, Homo Sapiens
YLREEEQKQ

SEQ ID NO: 144475 - protein, 9 aa, Homo Sapiens
LRGKQLCVR

SEQ ID NO: 144476 - protein, 9 aa, Homo Sapiens
WGQLLLLLL

SEQ ID NO: 144477 - protein, 9 aa, Homo Sapiens
PVPTATAAS

SEQ ID NO: 144478 - protein, 9 aa, Homo Sapiens
QAYTLTYTG

SEQ ID NO: 144479 - protein, 9 aa, Homo Sapiens
TKRCAQTAV

SEQ ID NO: 144480 - protein, 9 aa, Homo Sapiens
HKADSEEER

SEQ ID NO: 144481 - protein, 9 aa, Homo Sapiens
TRFSSVTLV

SEQ ID NO: 144482 - protein, 9 aa, Homo Sapiens
IPNQKKRNT

SEQ ID NO: 144483 - protein, 9 aa, Homo Sapiens
GTYSSCRKA

SEQ ID NO: 144484 - protein, 9 aa, Homo Sapiens
ECCGRRLPT

SEQ ID NO: 144485 - protein, 9 aa, Homo Sapiens
QCTQGRRWG

SEQ ID NO: 144486 - protein, 9 aa, Homo Sapiens
EKKSRYEWN

SEQ ID NO: 144487 - protein, 9 aa, Homo Sapiens
SSLTHVLQS

SEQ ID NO: 144488 - protein, 9 aa, Homo Sapiens
LFLIMTTKK

SEQ ID NO: 144489 - protein, 9 aa, Homo Sapiens
NQQPDGRSS

SEQ ID NO: 144490 - protein, 9 aa, Homo Sapiens
PRTLHGGRP

SEQ ID NO: 144491 - protein, 9 aa, Homo Sapiens
MLGGDGISD

SEQ ID NO: 144492 - protein, 9 aa, Homo Sapiens
PPTTTTSSP

SEQ ID NO: 144493 - protein, 9 aa, Homo Sapiens
AIMPSSPRW

SEQ ID NO: 144494 - protein, 9 aa, Homo Sapiens
TSSGLEITA

SEQ ID NO: 144495 - protein, 9 aa, Homo Sapiens
DQGPPLVLT

SEQ ID NO: 144496 - protein, 9 aa, Homo Sapiens
PEVPGLYGE

SEQ ID NO: 144497 - protein, 9 aa, Homo Sapiens
EWFHASVRR

SEQ ID NO: 144498 - protein, 9 aa, Homo Sapiens
RKGLWERSP

SEQ ID NO: 144499 - protein, 9 aa, Homo Sapiens
LDAHNHNRQ

SEQ ID NO: 144500 - protein, 9 aa, Homo Sapiens
LTAASLVGI

SEQ ID NO: 144501 - protein, 9 aa, Homo Sapiens
LGPWNGTTM

SEQ ID NO: 144502 - protein, 9 aa, Homo Sapiens
PYNVDTERA

SEQ ID NO: 144503 - protein, 9 aa, Homo Sapiens
SVHLQEAGG

SEQ ID NO: 144504 - protein, 9 aa, Homo Sapiens
VAELALVGP

SEQ ID NO: 144505 - protein, 9 aa, Homo Sapiens
APGRAAPRT

SEQ ID NO: 144506 - protein, 9 aa, Homo Sapiens
RICMHNFSR

SEQ ID NO: 144507 - protein, 9 aa, Homo Sapiens
CRGTASAGR

SEQ ID NO: 144508 - protein, 9 aa, Homo Sapiens
PPKSPPPPP

SEQ ID NO: 144509 - protein, 9 aa, Homo Sapiens
CSMCCVIIP

SEQ ID NO: 144510 - protein, 9 aa, Homo Sapiens
VLWRGCHKS

SEQ ID NO: 144511 - protein, 9 aa, Homo Sapiens
LKKGNFFFQ

SEQ ID NO: 144512 - protein, 9 aa, Homo Sapiens
IHGLFSLPP

SEQ ID NO: 144513 - protein, 9 aa, Homo Sapiens
EQKQNSTHW

SEQ ID NO: 144514 - protein, 9 aa, Homo Sapiens
NYIAEEFDV

SEQ ID NO: 144515 - protein, 9 aa, Homo Sapiens
LGQQHQRHP

SEQ ID NO: 144516 - protein, 9 aa, Homo Sapiens
GSVFIPYRE

SEQ ID NO: 144517 - protein, 9 aa, Homo Sapiens
GEKTEIQLT

SEQ ID NO: 144518 - protein, 9 aa, Homo Sapiens
PCSMCCVII

SEQ ID NO: 144519 - protein, 9 aa, Homo Sapiens
LLHPLPLGC

SEQ ID NO: 144520 - protein, 9 aa, Homo Sapiens
IRASVCAPA

SEQ ID NO: 144521 - protein, 9 aa, Homo Sapiens
AIHIPELLI

SEQ ID NO: 144522 - protein, 9 aa, Homo Sapiens
TRLWSSSGA

SEQ ID NO: 144523 - protein, 9 aa, Homo Sapiens
TGIHRHTQA

SEQ ID NO: 144524 - protein, 9 aa, Homo Sapiens
RARKGREER

SEQ ID NO: 144525 - protein, 9 aa, Homo Sapiens
NFFFQNPRG

SEQ ID NO: 144526 - protein, 9 aa, Homo Sapiens
SSSASVCCR

SEQ ID NO: 144527 - protein, 9 aa, Homo Sapiens
PMVFLPEPG

SEQ ID NO: 144528 - protein, 9 aa, Homo Sapiens
PPPRSPGVP

SEQ ID NO: 144529 - protein, 9 aa, Homo Sapiens
CRVYPAPSY

SEQ ID NO: 144530 - protein, 9 aa, Homo Sapiens
KHIAHITPS

SEQ ID NO: 144531 - protein, 9 aa, Homo Sapiens
RRLRPRWSC

SEQ ID NO: 144532 - protein, 9 aa, Homo Sapiens
EQCRCANTR

SEQ ID NO: 144533 - protein, 9 aa, Homo Sapiens
SITSSRYIL

SEQ ID NO: 144534 - protein, 9 aa, Homo Sapiens
AKSRFKEQK

SEQ ID NO: 144535 - protein, 9 aa, Homo Sapiens
VQHFWSIQF

SEQ ID NO: 144536 - protein, 9 aa, Homo Sapiens
YHAVASGNK

SEQ ID NO: 144537 - protein, 9 aa, Homo Sapiens
NLMYVLWLL

SEQ ID NO: 144538 - protein, 9 aa, Homo Sapiens
VTTKNQNQG

SEQ ID NO: 144539 - protein, 9 aa, Homo Sapiens
HESEDECTL

SEQ ID NO: 144540 - protein, 9 aa, Homo Sapiens
TCKVPRLHS

SEQ ID NO: 144541 - protein, 9 aa, Homo Sapiens
VAIHIPELL

SEQ ID NO: 144542 - protein, 9 aa, Homo Sapiens
MGIGMKPNL

SEQ ID NO: 144543 - protein, 9 aa, Homo Sapiens
TVQMGFCDW

SEQ ID NO: 144544 - protein, 9 aa, Homo Sapiens
QLDVHQLLV

SEQ ID NO: 144545 - protein, 9 aa, Homo Sapiens
HHLPRPFHL

SEQ ID NO: 144546 - protein, 9 aa, Homo Sapiens
LIEMGSFNL

SEQ ID NO: 144547 - protein, 9 aa, Homo Sapiens
AMCRRLSFT

SEQ ID NO: 144548 - protein, 9 aa, Homo Sapiens
SVLGGAGTA

SEQ ID NO: 144549 - protein, 9 aa, Homo Sapiens
CLVQMQTEV

SEQ ID NO: 144550 - protein, 9 aa, Homo Sapiens
DVKVLRWII

SEQ ID NO: 144551 - protein, 9 aa, Homo Sapiens
QLQRLGVVW

SEQ ID NO: 144552 - protein, 9 aa, Homo Sapiens
SLYNGHFFQ

SEQ ID NO: 144553 - protein, 9 aa, Homo Sapiens
KSCLDIQHF

SEQ ID NO: 144554 - protein, 9 aa, Homo Sapiens
SCAPLLHRR

SEQ ID NO: 144555 - protein, 9 aa, Homo Sapiens
AHCSPLPRP

SEQ ID NO: 144556 - protein, 9 aa, Homo Sapiens
AWRTISQYL

SEQ ID NO: 144557 - protein, 9 aa, Homo Sapiens
ARKASCKLT

SEQ ID NO: 144558 - protein, 9 aa, Homo Sapiens
VDYPYLETS

SEQ ID NO: 144559 - protein, 9 aa, Homo Sapiens
VVVHELGVA

SEQ ID NO: 144560 - protein, 9 aa, Homo Sapiens
ATPPFGLIP

SEQ ID NO: 144561 - protein, 9 aa, Homo Sapiens
ATSLDIMTC

SEQ ID NO: 144562 - protein, 9 aa, Homo Sapiens
EVRVGQVVY

SEQ ID NO: 144563 - protein, 9 aa, Homo Sapiens
ESHYCPELP

SEQ ID NO: 144564 - protein, 9 aa, Homo Sapiens
STSQEVPLH

SEQ ID NO: 144565 - protein, 9 aa, Homo Sapiens
SEPPQCHPR

SEQ ID NO: 144566 - protein, 9 aa, Homo Sapiens
RYVQEWSKN

SEQ ID NO: 144567 - protein, 9 aa, Homo Sapiens
CLGGSDSMW

SEQ ID NO: 144568 - protein, 9 aa, Homo Sapiens
GKGLKVVLF

SEQ ID NO: 144569 - protein, 9 aa, Homo Sapiens
HCRHPLQDS

SEQ ID NO: 144570 - protein, 9 aa, Homo Sapiens
QRSDGQVSK

SEQ ID NO: 144571 - protein, 9 aa, Homo Sapiens
VSIVVKMEF

SEQ ID NO: 144572 - protein, 9 aa, Homo Sapiens
LGLLVAPRP

SEQ ID NO: 144573 - protein, 9 aa, Homo Sapiens
VSGSRCLRL

SEQ ID NO: 144574 - protein, 9 aa, Homo Sapiens
SPEDCGRGP

SEQ ID NO: 144575 - protein, 9 aa, Homo Sapiens
VRGVFAVQT

SEQ ID NO: 144576 - protein, 9 aa, Homo Sapiens
VVWDRNHIS

SEQ ID NO: 144577 - protein, 9 aa, Homo Sapiens
EVIREGWRW

SEQ ID NO: 144578 - protein, 9 aa, Homo Sapiens
FICDNKSFA

SEQ ID NO: 144579 - protein, 9 aa, Homo Sapiens
NILASPGIL

SEQ ID NO: 144580 - protein, 9 aa, Homo Sapiens
CYQATFRLP

SEQ ID NO: 144581 - protein, 9 aa, Homo Sapiens
EFGLSKMED

SEQ ID NO: 144582 - protein, 9 aa, Homo Sapiens
FPAHLASAV

SEQ ID NO: 144583 - protein, 9 aa, Homo Sapiens
GTFMCSDPF

SEQ ID NO: 144584 - protein, 9 aa, Homo Sapiens
NKVLYEAYH

SEQ ID NO: 144585 - protein, 9 aa, Homo Sapiens
LPCYEALRG

SEQ ID NO: 144586 - protein, 9 aa, Homo Sapiens
PALLAVLSR

SEQ ID NO: 144587 - protein, 9 aa, Homo Sapiens
GVKRLKSVP

SEQ ID NO: 144588 - protein, 9 aa, Homo Sapiens
SILHVPKVT

SEQ ID NO: 144589 - protein, 9 aa, Homo Sapiens
SASLGREWD

SEQ ID NO: 144590 - protein, 9 aa, Homo Sapiens
AKHKGIKSS

SEQ ID NO: 144591 - protein, 9 aa, Homo Sapiens
PVSPRLVNA

SEQ ID NO: 144592 - protein, 9 aa, Homo Sapiens
LLLPPFTYL

SEQ ID NO: 144593 - protein, 9 aa, Homo Sapiens
FRGPHPRAH

SEQ ID NO: 144594 - protein, 9 aa, Homo Sapiens
PTPPAPHRR

SEQ ID NO: 144595 - protein, 9 aa, Homo Sapiens
PSSRDREPE

SEQ ID NO: 144596 - protein, 9 aa, Homo Sapiens
LKGGNVTKA

SEQ ID NO: 144597 - protein, 9 aa, Homo Sapiens
GRNTSLAAL

SEQ ID NO: 144598 - protein, 9 aa, Homo Sapiens
GRPLGLLVA

SEQ ID NO: 144599 - protein, 9 aa, Homo Sapiens
GVLDGPQKN

SEQ ID NO: 144600 - protein, 9 aa, Homo Sapiens
PADLPHSSG

SEQ ID NO: 144601 - protein, 9 aa, Homo Sapiens
PRGSPACCP

SEQ ID NO: 144602 - protein, 9 aa, Homo Sapiens
LSPAEQANT

SEQ ID NO: 144603 - protein, 9 aa, Homo Sapiens
WLPRAATQS

SEQ ID NO: 144604 - protein, 9 aa, Homo Sapiens
RERPRRARR

SEQ ID NO: 144605 - protein, 9 aa, Homo Sapiens
SKENVTKFW

SEQ ID NO: 144606 - protein, 9 aa, Homo Sapiens
FKKPGSKIF

SEQ ID NO: 144607 - protein, 9 aa, Homo Sapiens
LLRPEFSQS

SEQ ID NO: 144608 - protein, 9 aa, Homo Sapiens
KTEIQLTMN

SEQ ID NO: 144609 - protein, 9 aa, Homo Sapiens
FDNVSLSPL

SEQ ID NO: 144610 - protein, 9 aa, Homo Sapiens
AYFHTGASP

SEQ ID NO: 144611 - protein, 9 aa, Homo Sapiens
LEEQHTQQL

SEQ ID NO: 144612 - protein, 9 aa, Homo Sapiens
RQRGRLNSA

SEQ ID NO: 144613 - protein, 9 aa, Homo Sapiens
REEKNVHRQ

SEQ ID NO: 144614 - protein, 9 aa, Homo Sapiens
MYMTVKYGD

SEQ ID NO: 144615 - protein, 9 aa, Homo Sapiens
MCTADYSLR

SEQ ID NO: 144616 - protein, 9 aa, Homo Sapiens
GGVSLNEMC

SEQ ID NO: 144617 - protein, 9 aa, Homo Sapiens
CLSCPGRNA

SEQ ID NO: 144618 - protein, 9 aa, Homo Sapiens
ATRHGPYPA

SEQ ID NO: 144619 - protein, 9 aa, Homo Sapiens
REAEQELEL

SEQ ID NO: 144620 - protein, 9 aa, Homo Sapiens
EHSVRAASK

SEQ ID NO: 144621 - protein, 9 aa, Homo Sapiens
RADAENAMW

SEQ ID NO: 144622 - protein, 9 aa, Homo Sapiens
VTFYFAGVP

SEQ ID NO: 144623 - protein, 9 aa, Homo Sapiens
FEAMSRGET

SEQ ID NO: 144624 - protein, 9 aa, Homo Sapiens
QCECGLDKS

SEQ ID NO: 144625 - protein, 9 aa, Homo Sapiens
KRCEGEKQQ

SEQ ID NO: 144626 - protein, 9 aa, Homo Sapiens
TTSIPSIPK

SEQ ID NO: 144627 - protein, 9 aa, Homo Sapiens
GQCAGAWGL

SEQ ID NO: 144628 - protein, 9 aa, Homo Sapiens
RQHPPPAKH

SEQ ID NO: 144629 - protein, 9 aa, Homo Sapiens
PKLVQILTA

SEQ ID NO: 144630 - protein, 9 aa, Homo Sapiens
AHWLRASSV

SEQ ID NO: 144631 - protein, 9 aa, Homo Sapiens
PPVPHEIPM

SEQ ID NO: 144632 - protein, 9 aa, Homo Sapiens
AARPRRTRS

SEQ ID NO: 144633 - protein, 9 aa, Homo Sapiens
VPGAGAMEV

SEQ ID NO: 144634 - protein, 9 aa, Homo Sapiens
EFRVGTSDR

SEQ ID NO: 144635 - protein, 9 aa, Homo Sapiens
DMIDLEANL

SEQ ID NO: 144636 - protein, 9 aa, Homo Sapiens
PRRAQKTRS

SEQ ID NO: 144637 - protein, 9 aa, Homo Sapiens
FMRLNEAVL

SEQ ID NO: 144638 - protein, 9 aa, Homo Sapiens
GAGASAPLW

SEQ ID NO: 144639 - protein, 9 aa, Homo Sapiens
MAQHLKSQG

SEQ ID NO: 144640 - protein, 9 aa, Homo Sapiens
NNVLQEKYV

SEQ ID NO: 144641 - protein, 9 aa, Homo Sapiens
SGSEAGAGA

SEQ ID NO: 144642 - protein, 9 aa, Homo Sapiens
SQGLPPMSS

SEQ ID NO: 144643 - protein, 9 aa, Homo Sapiens
WLQETHKGE

SEQ ID NO: 144644 - protein, 9 aa, Homo Sapiens
RPGGRSPTT

SEQ ID NO: 144645 - protein, 9 aa, Homo Sapiens
PDPIPDSFI

SEQ ID NO: 144646 - protein, 9 aa, Homo Sapiens
KVTAAHSVT

SEQ ID NO: 144647 - protein, 9 aa, Homo Sapiens
LTFRKEQCA

SEQ ID NO: 144648 - protein, 9 aa, Homo Sapiens
ALERRRVVR

SEQ ID NO: 144649 - protein, 9 aa, Homo Sapiens
SWRSGGSGW

SEQ ID NO: 144650 - protein, 9 aa, Homo Sapiens
GILPSTCSD

SEQ ID NO: 144651 - protein, 9 aa, Homo Sapiens
QMQDYECRS

SEQ ID NO: 144652 - protein, 9 aa, Homo Sapiens
TGRRRRRTR

SEQ ID NO: 144653 - protein, 9 aa, Homo Sapiens
VIAFTKQVL

SEQ ID NO: 144654 - protein, 9 aa, Homo Sapiens
MGKAVEAEL

SEQ ID NO: 144655 - protein, 9 aa, Homo Sapiens
EDLPFPPAV

SEQ ID NO: 144656 - protein, 9 aa, Homo Sapiens
SKDEKTKIS

SEQ ID NO: 144657 - protein, 9 aa, Homo Sapiens
CERMICNVE

SEQ ID NO: 144658 - protein, 9 aa, Homo Sapiens
LGKDGRVAV

SEQ ID NO: 144659 - protein, 9 aa, Homo Sapiens
TSTHRPASA

SEQ ID NO: 144660 - protein, 9 aa, Homo Sapiens
TGRQHPPPA

SEQ ID NO: 144661 - protein, 9 aa, Homo Sapiens
CTLSAKHVP

SEQ ID NO: 144662 - protein, 9 aa, Homo Sapiens
RREFRNALK

SEQ ID NO: 144663 - protein, 9 aa, Homo Sapiens
HLQEAGGDL

SEQ ID NO: 144664 - protein, 9 aa, Homo Sapiens
KQDTMTFSD

SEQ ID NO: 144665 - protein, 9 aa, Homo Sapiens
RRTGASTPA

SEQ ID NO: 144666 - protein, 9 aa, Homo Sapiens
LLRQLGKGT

SEQ ID NO: 144667 - protein, 9 aa, Homo Sapiens
PPGPAASLC

SEQ ID NO: 144668 - protein, 9 aa, Homo Sapiens
RQSPSPAAC

SEQ ID NO: 144669 - protein, 9 aa, Homo Sapiens
LRHFPYKPL

SEQ ID NO: 144670 - protein, 9 aa, Homo Sapiens
SSAPRTPTP

SEQ ID NO: 144671 - protein, 9 aa, Homo Sapiens
VHMILVLCT

SEQ ID NO: 144672 - protein, 9 aa, Homo Sapiens
KQRMEKAAR

SEQ ID NO: 144673 - protein, 9 aa, Homo Sapiens
SWAVSCVEE

SEQ ID NO: 144674 - protein, 9 aa, Homo Sapiens
TFQKPKLHL

SEQ ID NO: 144675 - protein, 9 aa, Homo Sapiens
PGTGPQQSR

SEQ ID NO: 144676 - protein, 9 aa, Homo Sapiens
LFDIKYNRE

SEQ ID NO: 144677 - protein, 9 aa, Homo Sapiens
SGYPTQQPP

SEQ ID NO: 144678 - protein, 9 aa, Homo Sapiens
PRRPPMRVC

SEQ ID NO: 144679 - protein, 9 aa, Homo Sapiens
LRPEQDTLT

SEQ ID NO: 144680 - protein, 9 aa, Homo Sapiens
HLNIVAFFN

SEQ ID NO: 144681 - protein, 9 aa, Homo Sapiens
QDMREVGAQ

SEQ ID NO: 144682 - protein, 9 aa, Homo Sapiens
PMGVGLNEL

SEQ ID NO: 144683 - protein, 9 aa, Homo Sapiens
LHLVMLHLG

SEQ ID NO: 144684 - protein, 9 aa, Homo Sapiens
RATRHGPYP

SEQ ID NO: 144685 - protein, 9 aa, Homo Sapiens
NSVVCFLPR

SEQ ID NO: 144686 - protein, 9 aa, Homo Sapiens
GPRLDFAFF

SEQ ID NO: 144687 - protein, 9 aa, Homo Sapiens
PDVWLAAAS

SEQ ID NO: 144688 - protein, 9 aa, Homo Sapiens
GRWTAAWPC

SEQ ID NO: 144689 - protein, 9 aa, Homo Sapiens
CRAPPPASS

SEQ ID NO: 144690 - protein, 9 aa, Homo Sapiens
PPARRHSHT

SEQ ID NO: 144691 - protein, 9 aa, Homo Sapiens
PLEDASTPF

SEQ ID NO: 144692 - protein, 9 aa, Homo Sapiens
AVLNPRGVV

SEQ ID NO: 144693 - protein, 9 aa, Homo Sapiens
WLQQLPRKG

SEQ ID NO: 144694 - protein, 9 aa, Homo Sapiens
TPPQDRPSH

SEQ ID NO: 144695 - protein, 9 aa, Homo Sapiens
MQLTATAPS

SEQ ID NO: 144696 - protein, 9 aa, Homo Sapiens
DTHADTPTS

SEQ ID NO: 144697 - protein, 9 aa, Homo Sapiens
YEALHGPPP

SEQ ID NO: 144698 - protein, 9 aa, Homo Sapiens
PAVRKFSLT

SEQ ID NO: 144699 - protein, 9 aa, Homo Sapiens
ERTVVKLEK

SEQ ID NO: 144700 - protein, 9 aa, Homo Sapiens
TATAPSSAP

SEQ ID NO: 144701 - protein, 9 aa, Homo Sapiens
VADGALLRG

SEQ ID NO: 144702 - protein, 9 aa, Homo Sapiens
CDIFQNISA

SEQ ID NO: 144703 - protein, 9 aa, Homo Sapiens
SRPATSRTP

SEQ ID NO: 144704 - protein, 9 aa, Homo Sapiens
LLGPLQGGL

SEQ ID NO: 144705 - protein, 9 aa, Homo Sapiens
GIHRHTQAY

SEQ ID NO: 144706 - protein, 9 aa, Homo Sapiens
NYRNLFSMG

SEQ ID NO: 144707 - protein, 9 aa, Homo Sapiens
DSGVVSSGR

SEQ ID NO: 144708 - protein, 9 aa, Homo Sapiens
LYHPYVPPL

SEQ ID NO: 144709 - protein, 9 aa, Homo Sapiens
DTSLCVVLY

SEQ ID NO: 144710 - protein, 9 aa, Homo Sapiens
KARMTRTRS

SEQ ID NO: 144711 - protein, 9 aa, Homo Sapiens
LGTGQRLSQ

SEQ ID NO: 144712 - protein, 9 aa, Homo Sapiens
IDDDNPPCL

SEQ ID NO: 144713 - protein, 9 aa, Homo Sapiens
RVPVLIKKI

SEQ ID NO: 144714 - protein, 9 aa, Homo Sapiens
EEKNVHRQP

SEQ ID NO: 144715 - protein, 9 aa, Homo Sapiens
ESSASLGRE

SEQ ID NO: 144716 - protein, 9 aa, Homo Sapiens
GTKIVYRHV

SEQ ID NO: 144717 - protein, 9 aa, Homo Sapiens
DFSGHTHTV

SEQ ID NO: 144718 - protein, 9 aa, Homo Sapiens
SSVLWLSQR

SEQ ID NO: 144719 - protein, 9 aa, Homo Sapiens
RASVCAPAT

SEQ ID NO: 144720 - protein, 9 aa, Homo Sapiens
LSPLFPPLL

SEQ ID NO: 144721 - protein, 9 aa, Homo Sapiens
HPCRWFCPT

SEQ ID NO: 144722 - protein, 9 aa, Homo Sapiens
ADRNYVNVD

SEQ ID NO: 144723 - protein, 9 aa, Homo Sapiens
PSQVWTAAT

SEQ ID NO: 144724 - protein, 9 aa, Homo Sapiens
EDEDGAWRQ

SEQ ID NO: 144725 - protein, 9 aa, Homo Sapiens
YPPHPLSLP

SEQ ID NO: 144726 - protein, 9 aa, Homo Sapiens
AQVLVTDPG

SEQ ID NO: 144727 - protein, 9 aa, Homo Sapiens
GMHRHTHTQ

SEQ ID NO: 144728 - protein, 9 aa, Homo Sapiens
FSIHQPQYS

SEQ ID NO: 144729 - protein, 9 aa, Homo Sapiens
VVFHKFKGQ

SEQ ID NO: 144730 - protein, 9 aa, Homo Sapiens
ALHSPPPEA

SEQ ID NO: 144731 - protein, 9 aa, Homo Sapiens
ARPPGVQQP

SEQ ID NO: 144732 - protein, 9 aa, Homo Sapiens
HLVPKLQRR

SEQ ID NO: 144733 - protein, 9 aa, Homo Sapiens
VILDANDAH

SEQ ID NO: 144734 - protein, 9 aa, Homo Sapiens
RSANAAARR

SEQ ID NO: 144735 - protein, 9 aa, Homo Sapiens
YPVCCQTTC

SEQ ID NO: 144736 - protein, 9 aa, Homo Sapiens
SCSPAHWLR

SEQ ID NO: 144737 - protein, 9 aa, Homo Sapiens
GTAPSAVPS

SEQ ID NO: 144738 - protein, 9 aa, Homo Sapiens
LNEYLAEMG

SEQ ID NO: 144739 - protein, 9 aa, Homo Sapiens
ALAAPACQC

SEQ ID NO: 144740 - protein, 9 aa, Homo Sapiens
YVLAVKWGR

SEQ ID NO: 144741 - protein, 9 aa, Homo Sapiens
RMERPRSAV

SEQ ID NO: 144742 - protein, 9 aa, Homo Sapiens
AEADQLLIL

SEQ ID NO: 144743 - protein, 9 aa, Homo Sapiens
ASGTQEWRW

SEQ ID NO: 144744 - protein, 9 aa, Homo Sapiens
SLTLSCLRM

SEQ ID NO: 144745 - protein, 9 aa, Homo Sapiens
PHPNEWEKR

SEQ ID NO: 144746 - protein, 9 aa, Homo Sapiens
KVPCLCLEE

SEQ ID NO: 144747 - protein, 9 aa, Homo Sapiens
RPQRGPRPL

SEQ ID NO: 144748 - protein, 9 aa, Homo Sapiens
GQTPASLMI

SEQ ID NO: 144749 - protein, 9 aa, Homo Sapiens
TMKMLERSN

SEQ ID NO: 144750 - protein, 9 aa, Homo Sapiens
HIGSSCSFV

SEQ ID NO: 144751 - protein, 9 aa, Homo Sapiens
VQFNCIGCA

SEQ ID NO: 144752 - protein, 9 aa, Homo Sapiens
RAPSLRTRV

SEQ ID NO: 144753 - protein, 9 aa, Homo Sapiens
PRRWSCWST

SEQ ID NO: 144754 - protein, 9 aa, Homo Sapiens
GYTLYTSDY

SEQ ID NO: 144755 - protein, 9 aa, Homo Sapiens
PASEAPPRS

SEQ ID NO: 144756 - protein, 9 aa, Homo Sapiens
KLFGASSSP

SEQ ID NO: 144757 - protein, 9 aa, Homo Sapiens
SGWRGARVP

SEQ ID NO: 144758 - protein, 9 aa, Homo Sapiens
DNAGYSVRA

SEQ ID NO: 144759 - protein, 9 aa, Homo Sapiens
SAPAKGKIK

SEQ ID NO: 144760 - protein, 9 aa, Homo Sapiens
PAPPEDDTA

SEQ ID NO: 144761 - protein, 9 aa, Homo Sapiens
LQSVIQMHS

SEQ ID NO: 144762 - protein, 9 aa, Homo Sapiens
GEGPYECIE

SEQ ID NO: 144763 - protein, 9 aa, Homo Sapiens
WKNVYLKAI

SEQ ID NO: 144764 - protein, 9 aa, Homo Sapiens
LQSLLSLYS

SEQ ID NO: 144765 - protein, 9 aa, Homo Sapiens
LQISQKGRI

SEQ ID NO: 144766 - protein, 9 aa, Homo Sapiens
TQGRRWGAW

SEQ ID NO: 144767 - protein, 9 aa, Homo Sapiens
PNLSPLFPP

SEQ ID NO: 144768 - protein, 9 aa, Homo Sapiens
KKALFALCS

SEQ ID NO: 144769 - protein, 9 aa, Homo Sapiens
WRTISQYLS

SEQ ID NO: 144770 - protein, 9 aa, Homo Sapiens
APWPPYRAF

SEQ ID NO: 144771 - protein, 9 aa, Homo Sapiens
DSAGSRGPA

SEQ ID NO: 144772 - protein, 9 aa, Homo Sapiens
LGVRVLLHF

SEQ ID NO: 144773 - protein, 9 aa, Homo Sapiens
CDSLHSQTP

SEQ ID NO: 144774 - protein, 9 aa, Homo Sapiens
VRRRFPLGA

SEQ ID NO: 144775 - protein, 9 aa, Homo Sapiens
FLHIQKTGA

SEQ ID NO: 144776 - protein, 9 aa, Homo Sapiens
DYSLRSGQQ

SEQ ID NO: 144777 - protein, 9 aa, Homo Sapiens
TPHVSVLHP

SEQ ID NO: 144778 - protein, 9 aa, Homo Sapiens
RESTLRRHR

SEQ ID NO: 144779 - protein, 9 aa, Homo Sapiens
RVENKSQCC

SEQ ID NO: 144780 - protein, 9 aa, Homo Sapiens
GPFHYQYGV

SEQ ID NO: 144781 - protein, 9 aa, Homo Sapiens
MSASTGTEV

SEQ ID NO: 144782 - protein, 9 aa, Homo Sapiens
KKYSCNMMV

SEQ ID NO: 144783 - protein, 9 aa, Homo Sapiens
VATGHIISW

SEQ ID NO: 144784 - protein, 9 aa, Homo Sapiens
VHLPTLFAL

SEQ ID NO: 144785 - protein, 9 aa, Homo Sapiens
WWCATSDPE

SEQ ID NO: 144786 - protein, 9 aa, Homo Sapiens
KAYIDPETK

SEQ ID NO: 144787 - protein, 9 aa, Homo Sapiens
AIPHVPVWL

SEQ ID NO: 144788 - protein, 9 aa, Homo Sapiens
PLPPGLPPA

SEQ ID NO: 144789 - protein, 9 aa, Homo Sapiens
LRIGNGFEE

SEQ ID NO: 144790 - protein, 9 aa, Homo Sapiens
PGHTGDPHC

SEQ ID NO: 144791 - protein, 9 aa, Homo Sapiens
AVGSRLPGL

SEQ ID NO: 144792 - protein, 9 aa, Homo Sapiens
LWRNPNGDD

SEQ ID NO: 144793 - protein, 9 aa, Homo Sapiens
KSHPQLAEN

SEQ ID NO: 144794 - protein, 9 aa, Homo Sapiens
VPPIKKKPR

SEQ ID NO: 144795 - protein, 9 aa, Homo Sapiens
PLRLGQGPL

SEQ ID NO: 144796 - protein, 9 aa, Homo Sapiens
IFWGLRSYH

SEQ ID NO: 144797 - protein, 9 aa, Homo Sapiens
QDSGVVSSG

SEQ ID NO: 144798 - protein, 9 aa, Homo Sapiens
MRHLWRPDV

SEQ ID NO: 144799 - protein, 9 aa, Homo Sapiens
PREPHPMSS

SEQ ID NO: 144800 - protein, 9 aa, Homo Sapiens
LFLGWTVCP

SEQ ID NO: 144801 - protein, 9 aa, Homo Sapiens
GVLGTQAKE

SEQ ID NO: 144802 - protein, 9 aa, Homo Sapiens
QSLSHLLPP

SEQ ID NO: 144803 - protein, 9 aa, Homo Sapiens
PLSVGTSKG

SEQ ID NO: 144804 - protein, 9 aa, Homo Sapiens
IGGGGQWRA

SEQ ID NO: 144805 - protein, 9 aa, Homo Sapiens
LMDSAWSLT

SEQ ID NO: 144806 - protein, 9 aa, Homo Sapiens
TGKNPYMCK

SEQ ID NO: 144807 - protein, 9 aa, Homo Sapiens
HPQLAENKQ

SEQ ID NO: 144808 - protein, 9 aa, Homo Sapiens
HLGPVFLLG

SEQ ID NO: 144809 - protein, 9 aa, Homo Sapiens
HKTNENKQS

SEQ ID NO: 144810 - protein, 9 aa, Homo Sapiens
TPPKPWQSP

SEQ ID NO: 144811 - protein, 9 aa, Homo Sapiens
THPSSMPAA

SEQ ID NO: 144812 - protein, 9 aa, Homo Sapiens
GELGTLADR

SEQ ID NO: 144813 - protein, 9 aa, Homo Sapiens
QRVPPGEQQ

SEQ ID NO: 144814 - protein, 9 aa, Homo Sapiens
NDSKHKLES

SEQ ID NO: 144815 - protein, 9 aa, Homo Sapiens
WISVPCPNL

SEQ ID NO: 144816 - protein, 9 aa, Homo Sapiens
WGTVWDDSW

SEQ ID NO: 144817 - protein, 9 aa, Homo Sapiens
SEQESITVI

SEQ ID NO: 144818 - protein, 9 aa, Homo Sapiens
NMLSGDHRR

SEQ ID NO: 144819 - protein, 9 aa, Homo Sapiens
KHQRERESF

SEQ ID NO: 144820 - protein, 9 aa, Homo Sapiens
APLLHRRAA

SEQ ID NO: 144821 - protein, 9 aa, Homo Sapiens
LTFLELADP

SEQ ID NO: 144822 - protein, 9 aa, Homo Sapiens
RRSPGSLSL

SEQ ID NO: 144823 - protein, 9 aa, Homo Sapiens
ALTAKHHST

SEQ ID NO: 144824 - protein, 9 aa, Homo Sapiens
EIQQWHGLA

SEQ ID NO: 144825 - protein, 9 aa, Homo Sapiens
RWTERDASN

SEQ ID NO: 144826 - protein, 9 aa, Homo Sapiens
PWTELSAGC

SEQ ID NO: 144827 - protein, 9 aa, Homo Sapiens
LCLAPFVYL

SEQ ID NO: 144828 - protein, 9 aa, Homo Sapiens
GPNLSPLFP

SEQ ID NO: 144829 - protein, 9 aa, Homo Sapiens
GELEPLKCN

SEQ ID NO: 144830 - protein, 9 aa, Homo Sapiens
PRKGLWERS

SEQ ID NO: 144831 - protein, 9 aa, Homo Sapiens
ASGSTSRRT

SEQ ID NO: 144832 - protein, 9 aa, Homo Sapiens
LGCFMPDNI

SEQ ID NO: 144833 - protein, 9 aa, Homo Sapiens
LHPGCSLGS

SEQ ID NO: 144834 - protein, 9 aa, Homo Sapiens
LYGEGGAGQ

SEQ ID NO: 144835 - protein, 9 aa, Homo Sapiens
FYGPQRRHL

SEQ ID NO: 144836 - protein, 9 aa, Homo Sapiens
QHQVDYILA

SEQ ID NO: 144837 - protein, 9 aa, Homo Sapiens
MECGGGGSG

SEQ ID NO: 144838 - protein, 9 aa, Homo Sapiens
VAAEEEEAA

SEQ ID NO: 144839 - protein, 9 aa, Homo Sapiens
PPTGSWQPR

SEQ ID NO: 144840 - protein, 9 aa, Homo Sapiens
GRRATLTSS

SEQ ID NO: 144841 - protein, 9 aa, Homo Sapiens
GLPLHLIHG

SEQ ID NO: 144842 - protein, 9 aa, Homo Sapiens
HTAAVRLML

SEQ ID NO: 144843 - protein, 9 aa, Homo Sapiens
LCKRGRRTP

SEQ ID NO: 144844 - protein, 9 aa, Homo Sapiens
DRQQTVLPH

SEQ ID NO: 144845 - protein, 9 aa, Homo Sapiens
FCERPALLH

SEQ ID NO: 144846 - protein, 9 aa, Homo Sapiens
FLGEAGITG

SEQ ID NO: 144847 - protein, 9 aa, Homo Sapiens
ASKNRVHPP

SEQ ID NO: 144848 - protein, 9 aa, Homo Sapiens
PQGTAFPEP

SEQ ID NO: 144849 - protein, 9 aa, Homo Sapiens
PRRNFGQQD

SEQ ID NO: 144850 - protein, 9 aa, Homo Sapiens
AFMRLNEAV

SEQ ID NO: 144851 - protein, 9 aa, Homo Sapiens
KDANSRADG

SEQ ID NO: 144852 - protein, 9 aa, Homo Sapiens
LSCCPRPRC

SEQ ID NO: 144853 - protein, 9 aa, Homo Sapiens
RTTGAPGAK

SEQ ID NO: 144854 - protein, 9 aa, Homo Sapiens
SEKFRISAS

SEQ ID NO: 144855 - protein, 9 aa, Homo Sapiens
RVNGMSDSS

SEQ ID NO: 144856 - protein, 9 aa, Homo Sapiens
LCTALNLFF

SEQ ID NO: 144857 - protein, 9 aa, Homo Sapiens
CWVLNFKAL

SEQ ID NO: 144858 - protein, 9 aa, Homo Sapiens
RSRLEKVHF

SEQ ID NO: 144859 - protein, 9 aa, Homo Sapiens
AILGVTTGL

SEQ ID NO: 144860 - protein, 9 aa, Homo Sapiens
SRVLFHSSG

SEQ ID NO: 144861 - protein, 9 aa, Homo Sapiens
PPPPPTKKR

SEQ ID NO: 144862 - protein, 9 aa, Homo Sapiens
TLEQRIQRG

SEQ ID NO: 144863 - protein, 9 aa, Homo Sapiens
QSVSGTATQ

SEQ ID NO: 144864 - protein, 9 aa, Homo Sapiens
RPLPPSAIG

SEQ ID NO: 144865 - protein, 9 aa, Homo Sapiens
WPCCAPIAL

SEQ ID NO: 144866 - protein, 9 aa, Homo Sapiens
KCGEGPSAP

SEQ ID NO: 144867 - protein, 9 aa, Homo Sapiens
QESTRVDDI

SEQ ID NO: 144868 - protein, 9 aa, Homo Sapiens
VWFSDKVLY

SEQ ID NO: 144869 - protein, 9 aa, Homo Sapiens
PSPCLSWSS

SEQ ID NO: 144870 - protein, 9 aa, Homo Sapiens
YNFKQKREE

SEQ ID NO: 144871 - protein, 9 aa, Homo Sapiens
VFTFQDPTQ

SEQ ID NO: 144872 - protein, 9 aa, Homo Sapiens
PSTPPDRSK

SEQ ID NO: 144873 - protein, 9 aa, Homo Sapiens
ELMPHTFSK

SEQ ID NO: 144874 - protein, 9 aa, Homo Sapiens
LLSILWTCV

SEQ ID NO: 144875 - protein, 9 aa, Homo Sapiens
GFPGAKGDR

SEQ ID NO: 144876 - protein, 9 aa, Homo Sapiens
GVRLHVTAT

SEQ ID NO: 144877 - protein, 9 aa, Homo Sapiens
ECTLDLDLV

SEQ ID NO: 144878 - protein, 9 aa, Homo Sapiens
AVWEEVEVL

SEQ ID NO: 144879 - protein, 9 aa, Homo Sapiens
AFELASLWN

SEQ ID NO: 144880 - protein, 9 aa, Homo Sapiens
AQSKTVIFF

SEQ ID NO: 144881 - protein, 9 aa, Homo Sapiens
PDQPPPRSP

SEQ ID NO: 144882 - protein, 9 aa, Homo Sapiens
KTGAAWSRR

SEQ ID NO: 144883 - protein, 9 aa, Homo Sapiens
AQVRAARPA

SEQ ID NO: 144884 - protein, 9 aa, Homo Sapiens
QWAQPVLDP

SEQ ID NO: 144885 - protein, 9 aa, Homo Sapiens
KHLNIVAFF

SEQ ID NO: 144886 - protein, 9 aa, Homo Sapiens
SVCDRFNAR

SEQ ID NO: 144887 - protein, 9 aa, Homo Sapiens
SEGKGHTNT

SEQ ID NO: 144888 - protein, 9 aa, Homo Sapiens
KPPEEAADE

SEQ ID NO: 144889 - protein, 9 aa, Homo Sapiens
EGRRYSHAA

SEQ ID NO: 144890 - protein, 9 aa, Homo Sapiens
GQSAKSGST

SEQ ID NO: 144891 - protein, 9 aa, Homo Sapiens
AGSCEVTLS

SEQ ID NO: 144892 - protein, 9 aa, Homo Sapiens
GQFRCRMPG

SEQ ID NO: 144893 - protein, 9 aa, Homo Sapiens
QAGRQQPSA

SEQ ID NO: 144894 - protein, 9 aa, Homo Sapiens
DSVSSITRN

SEQ ID NO: 144895 - protein, 9 aa, Homo Sapiens
CMHRGLCKS

SEQ ID NO: 144896 - protein, 9 aa, Homo Sapiens
SLPQGCWGC

SEQ ID NO: 144897 - protein, 9 aa, Homo Sapiens
FVSIVVKME

SEQ ID NO: 144898 - protein, 9 aa, Homo Sapiens
NLLPAPSAL

SEQ ID NO: 144899 - protein, 9 aa, Homo Sapiens
SEESYKHKG

SEQ ID NO: 144900 - protein, 9 aa, Homo Sapiens
YLGVRVLLH

SEQ ID NO: 144901 - protein, 9 aa, Homo Sapiens
PQWRTWLGG

SEQ ID NO: 144902 - protein, 9 aa, Homo Sapiens
GRQHPPPAK

SEQ ID NO: 144903 - protein, 9 aa, Homo Sapiens
PPRDRWKGL

SEQ ID NO: 144904 - protein, 9 aa, Homo Sapiens
SGTHLCRVC

SEQ ID NO: 144905 - protein, 9 aa, Homo Sapiens
CGEGPSAPA

SEQ ID NO: 144906 - protein, 9 aa, Homo Sapiens
TAKKKALFA

SEQ ID NO: 144907 - protein, 9 aa, Homo Sapiens
EISSCDYAI

SEQ ID NO: 144908 - protein, 9 aa, Homo Sapiens
LFFVLVNLE

SEQ ID NO: 144909 - protein, 9 aa, Homo Sapiens
VDITQVTSK

SEQ ID NO: 144910 - protein, 9 aa, Homo Sapiens
KRNAGNTVR

SEQ ID NO: 144911 - protein, 9 aa, Homo Sapiens
KIAAALVAA

SEQ ID NO: 144912 - protein, 9 aa, Homo Sapiens
LPPGLPPAT

SEQ ID NO: 144913 - protein, 9 aa, Homo Sapiens
IRVASMVSL

SEQ ID NO: 144914 - protein, 9 aa, Homo Sapiens
RNEIFFLTF

SEQ ID NO: 144915 - protein, 9 aa, Homo Sapiens
QKREELCLS

SEQ ID NO: 144916 - protein, 9 aa, Homo Sapiens
GASTFSLRV

SEQ ID NO: 144917 - protein, 9 aa, Homo Sapiens
AVVIPDAVL

SEQ ID NO: 144918 - protein, 9 aa, Homo Sapiens
RTRSAWGDW

SEQ ID NO: 144919 - protein, 9 aa, Homo Sapiens
VLKFRDVAV

SEQ ID NO: 144920 - protein, 9 aa, Homo Sapiens
GWMWQSQAP

SEQ ID NO: 144921 - protein, 9 aa, Homo Sapiens
SSRYQFQNL

SEQ ID NO: 144922 - protein, 9 aa, Homo Sapiens
NKFTLDSKV

SEQ ID NO: 144923 - protein, 9 aa, Homo Sapiens
RAHQRTGRQ

SEQ ID NO: 144924 - protein, 9 aa, Homo Sapiens
SPPAQAVML

SEQ ID NO: 144925 - protein, 9 aa, Homo Sapiens
ATLTSNNTT

SEQ ID NO: 144926 - protein, 9 aa, Homo Sapiens
PHSPGPGLR

SEQ ID NO: 144927 - protein, 9 aa, Homo Sapiens
ILLHFKILK

SEQ ID NO: 144928 - protein, 9 aa, Homo Sapiens
QLFLRRKME

SEQ ID NO: 144929 - protein, 9 aa, Homo Sapiens
LRLGQMDTN

SEQ ID NO: 144930 - protein, 9 aa, Homo Sapiens
EKYVLWRGC

SEQ ID NO: 144931 - protein, 9 aa, Homo Sapiens
PATALDVGL

SEQ ID NO: 144932 - protein, 9 aa, Homo Sapiens
FLLAVVWAQ

SEQ ID NO: 144933 - protein, 9 aa, Homo Sapiens
GWGQLLLLL

SEQ ID NO: 144934 - protein, 9 aa, Homo Sapiens
EPRKGLWER

SEQ ID NO: 144935 - protein, 9 aa, Homo Sapiens
GVVHRRAAA

SEQ ID NO: 144936 - protein, 9 aa, Homo Sapiens
VPRLHSVPL

SEQ ID NO: 144937 - protein, 9 aa, Homo Sapiens
PGKKEAPLW

SEQ ID NO: 144938 - protein, 9 aa, Homo Sapiens
RRARRLRGR

SEQ ID NO: 144939 - protein, 9 aa, Homo Sapiens
SCLQTSNNN

SEQ ID NO: 144940 - protein, 9 aa, Homo Sapiens
KSIRPSLNG

SEQ ID NO: 144941 - protein, 9 aa, Homo Sapiens
ECGGGGSGT

SEQ ID NO: 144942 - protein, 9 aa, Homo Sapiens
GRSLSCCPR

SEQ ID NO: 144943 - protein, 9 aa, Homo Sapiens
SKCFTLSDL

SEQ ID NO: 144944 - protein, 9 aa, Homo Sapiens
SGIPGEAMV

SEQ ID NO: 144945 - protein, 9 aa, Homo Sapiens
KDQSRRKMQ

SEQ ID NO: 144946 - protein, 9 aa, Homo Sapiens
SLAASSPGG

SEQ ID NO: 144947 - protein, 9 aa, Homo Sapiens
RTRTQQRTA

SEQ ID NO: 144948 - protein, 9 aa, Homo Sapiens
QSWAVSCVE

SEQ ID NO: 144949 - protein, 9 aa, Homo Sapiens
TSCGTYSSC

SEQ ID NO: 144950 - protein, 9 aa, Homo Sapiens
PCLKVMHKT

SEQ ID NO: 144951 - protein, 9 aa, Homo Sapiens
LSGGDSVAS

SEQ ID NO: 144952 - protein, 9 aa, Homo Sapiens
YTSAMAYPA

SEQ ID NO: 144953 - protein, 9 aa, Homo Sapiens
LLVVVPLRQ

SEQ ID NO: 144954 - protein, 9 aa, Homo Sapiens
GAETTTASN

SEQ ID NO: 144955 - protein, 9 aa, Homo Sapiens
TDTVMIHPL

SEQ ID NO: 144956 - protein, 9 aa, Homo Sapiens
LRLDGSQRP

SEQ ID NO: 144957 - protein, 9 aa, Homo Sapiens
STWAGASTF

SEQ ID NO: 144958 - protein, 9 aa, Homo Sapiens
LNIRAKMLH

SEQ ID NO: 144959 - protein, 9 aa, Homo Sapiens
TDTHTGTDR

SEQ ID NO: 144960 - protein, 9 aa, Homo Sapiens
VENIRVASL

SEQ ID NO: 144961 - protein, 9 aa, Homo Sapiens
EHMFETDDG

SEQ ID NO: 144962 - protein, 9 aa, Homo Sapiens
DGTTKTGAA

SEQ ID NO: 144963 - protein, 9 aa, Homo Sapiens
PIKKKPRLL

SEQ ID NO: 144964 - protein, 9 aa, Homo Sapiens
IRRRAALGQ

SEQ ID NO: 144965 - protein, 9 aa, Homo Sapiens
QGFSDAVSH

SEQ ID NO: 144966 - protein, 9 aa, Homo Sapiens
RAFCERPAL

SEQ ID NO: 144967 - protein, 9 aa, Homo Sapiens
CREGRMATL

SEQ ID NO: 144968 - protein, 9 aa, Homo Sapiens
GTVWDDSWD

SEQ ID NO: 144969 - protein, 9 aa, Homo Sapiens
SCHIPVVRR

SEQ ID NO: 144970 - protein, 9 aa, Homo Sapiens
CYGMHGFMD

SEQ ID NO: 144971 - protein, 9 aa, Homo Sapiens
ARKGREERR

SEQ ID NO: 144972 - protein, 9 aa, Homo Sapiens
PSKKKVQGH

SEQ ID NO: 144973 - protein, 9 aa, Homo Sapiens
KETTARSVH

SEQ ID NO: 144974 - protein, 9 aa, Homo Sapiens
CCSSWLRRI

SEQ ID NO: 144975 - protein, 9 aa, Homo Sapiens
CCVWLRCCG

SEQ ID NO: 144976 - protein, 9 aa, Homo Sapiens
TCHCQCVGM

SEQ ID NO: 144977 - protein, 9 aa, Homo Sapiens
PWRKSGSGS

SEQ ID NO: 144978 - protein, 9 aa, Homo Sapiens
CTCPPAPGR

SEQ ID NO: 144979 - protein, 9 aa, Homo Sapiens
SMLYMPLHL

SEQ ID NO: 144980 - protein, 9 aa, Homo Sapiens
TCSPCSPTT

SEQ ID NO: 144981 - protein, 9 aa, Homo Sapiens
VLGVDGHTC

SEQ ID NO: 144982 - protein, 9 aa, Homo Sapiens
FRAHSQLIN

SEQ ID NO: 144983 - protein, 9 aa, Homo Sapiens
GLAHRWAAL

SEQ ID NO: 144984 - protein, 9 aa, Homo Sapiens
PRNEIFFLT

SEQ ID NO: 144985 - protein, 9 aa, Homo Sapiens
APRSCGTRL

SEQ ID NO: 144986 - protein, 9 aa, Homo Sapiens
GGLRRSSPS

SEQ ID NO: 144987 - protein, 9 aa, Homo Sapiens
TAITLNRYL

SEQ ID NO: 144988 - protein, 9 aa, Homo Sapiens
GASCTASTC

SEQ ID NO: 144989 - protein, 9 aa, Homo Sapiens
AAGLLTAAS

SEQ ID NO: 144990 - protein, 9 aa, Homo Sapiens
AKTEKRLLY

SEQ ID NO: 144991 - protein, 9 aa, Homo Sapiens
FCRCEIKGR

SEQ ID NO: 144992 - protein, 9 aa, Homo Sapiens
PAPAGAWSF

SEQ ID NO: 144993 - protein, 9 aa, Homo Sapiens
LDDSDVSEP

SEQ ID NO: 144994 - protein, 9 aa, Homo Sapiens
CCYGGGGST

SEQ ID NO: 144995 - protein, 9 aa, Homo Sapiens
QGSVMISSP

SEQ ID NO: 144996 - protein, 9 aa, Homo Sapiens
DLPSLTSGL

SEQ ID NO: 144997 - protein, 9 aa, Homo Sapiens
VFLTFLELA

SEQ ID NO: 144998 - protein, 9 aa, Homo Sapiens
RNVVWSSSI

SEQ ID NO: 144999 - protein, 9 aa, Homo Sapiens
RWHRIAQCL

SEQ ID NO: 145000 - protein, 9 aa, Homo Sapiens
PVGIIIGAV

SEQ ID NO: 145001 - protein, 9 aa, Homo Sapiens
AADDRVHEQ

SEQ ID NO: 145002 - protein, 9 aa, Homo Sapiens
GLGDHDTGS

SEQ ID NO: 145003 - protein, 9 aa, Homo Sapiens
WPRKLRRPG

SEQ ID NO: 145004 - protein, 9 aa, Homo Sapiens
VPAIFYRPM

SEQ ID NO: 145005 - protein, 9 aa, Homo Sapiens
RAGAGCGQV

SEQ ID NO: 145006 - protein, 9 aa, Homo Sapiens
RPPINVVID

SEQ ID NO: 145007 - protein, 9 aa, Homo Sapiens
HHLHFDART

SEQ ID NO: 145008 - protein, 9 aa, Homo Sapiens
ARRQPGPPC

SEQ ID NO: 145009 - protein, 9 aa, Homo Sapiens
AKAGAQAVA

SEQ ID NO: 145010 - protein, 9 aa, Homo Sapiens
SFAYTLAVS

SEQ ID NO: 145011 - protein, 9 aa, Homo Sapiens
LRNHFSLIL

SEQ ID NO: 145012 - protein, 9 aa, Homo Sapiens
CWKRTSHPC

SEQ ID NO: 145013 - protein, 9 aa, Homo Sapiens
SCSFVEQAL

SEQ ID NO: 145014 - protein, 9 aa, Homo Sapiens
RSIIGMINM

SEQ ID NO: 145015 - protein, 9 aa, Homo Sapiens
TTATVTILG

SEQ ID NO: 145016 - protein, 9 aa, Homo Sapiens
LQQQQQQEE

SEQ ID NO: 145017 - protein, 9 aa, Homo Sapiens
GWNGLAHRW

SEQ ID NO: 145018 - protein, 9 aa, Homo Sapiens
HDIMCQCWR

SEQ ID NO: 145019 - protein, 9 aa, Homo Sapiens
RLLILRSPR

SEQ ID NO: 145020 - protein, 9 aa, Homo Sapiens
RPPDVLWKH

SEQ ID NO: 145021 - protein, 9 aa, Homo Sapiens
SVTTSVVTR

SEQ ID NO: 145022 - protein, 9 aa, Homo Sapiens
PGHPRGSQS

SEQ ID NO: 145023 - protein, 9 aa, Homo Sapiens
TRCPAPSQP

SEQ ID NO: 145024 - protein, 9 aa, Homo Sapiens
NPQEKWLRK

SEQ ID NO: 145025 - protein, 9 aa, Homo Sapiens
PPPGSPGHL

SEQ ID NO: 145026 - protein, 9 aa, Homo Sapiens
IGGSQVKGG

SEQ ID NO: 145027 - protein, 9 aa, Homo Sapiens
IETPDLKLA

SEQ ID NO: 145028 - protein, 9 aa, Homo Sapiens
EDPHLLKEK

SEQ ID NO: 145029 - protein, 9 aa, Homo Sapiens
DTLSKHQAV

SEQ ID NO: 145030 - protein, 9 aa, Homo Sapiens
CVSPWATSS

SEQ ID NO: 145031 - protein, 9 aa, Homo Sapiens
TIPWTGACP

SEQ ID NO: 145032 - protein, 9 aa, Homo Sapiens
GAQSGTPPQ

SEQ ID NO: 145033 - protein, 9 aa, Homo Sapiens
FLFFLLLVQ

SEQ ID NO: 145034 - protein, 9 aa, Homo Sapiens
VLVTDPGVA

SEQ ID NO: 145035 - protein, 9 aa, Homo Sapiens
GLGCFMPDN

SEQ ID NO: 145036 - protein, 9 aa, Homo Sapiens
SCCYPVCCQ

SEQ ID NO: 145037 - protein, 9 aa, Homo Sapiens
EQLVDLTSW

SEQ ID NO: 145038 - protein, 9 aa, Homo Sapiens
RHSHSWIRT

SEQ ID NO: 145039 - protein, 9 aa, Homo Sapiens
HKVPGKPEV

SEQ ID NO: 145040 - protein, 9 aa, Homo Sapiens
GTTKTGAAW

SEQ ID NO: 145041 - protein, 9 aa, Homo Sapiens
RPCLPSPRS

SEQ ID NO: 145042 - protein, 9 aa, Homo Sapiens
LCFLTIHSY

SEQ ID NO: 145043 - protein, 9 aa, Homo Sapiens
CRMEMISDF

SEQ ID NO: 145044 - protein, 9 aa, Homo Sapiens
GSCRLQLRS

SEQ ID NO: 145045 - protein, 9 aa, Homo Sapiens
VRLKVLRAR

SEQ ID NO: 145046 - protein, 9 aa, Homo Sapiens
KHGRRARCL

SEQ ID NO: 145047 - protein, 9 aa, Homo Sapiens
EDPEINPSA

SEQ ID NO: 145048 - protein, 9 aa, Homo Sapiens
FIHSLVIVE

SEQ ID NO: 145049 - protein, 9 aa, Homo Sapiens
SGREMGSLS

SEQ ID NO: 145050 - protein, 9 aa, Homo Sapiens
AFNGICRLK

SEQ ID NO: 145051 - protein, 9 aa, Homo Sapiens
QLINHQETH

SEQ ID NO: 145052 - protein, 9 aa, Homo Sapiens
PQGQRRNYT

SEQ ID NO: 145053 - protein, 9 aa, Homo Sapiens
AHSDNFPRP

SEQ ID NO: 145054 - protein, 9 aa, Homo Sapiens
TSLCVVLYV

SEQ ID NO: 145055 - protein, 9 aa, Homo Sapiens
KTRKRIFFA

SEQ ID NO: 145056 - protein, 9 aa, Homo Sapiens
EGKGERWPG

SEQ ID NO: 145057 - protein, 9 aa, Homo Sapiens
QGQWGPPRA

SEQ ID NO: 145058 - protein, 9 aa, Homo Sapiens
QWRTWLGGP

SEQ ID NO: 145059 - protein, 9 aa, Homo Sapiens
GGAPAAAGR

SEQ ID NO: 145060 - protein, 9 aa, Homo Sapiens
GEKPYVYRE

SEQ ID NO: 145061 - protein, 9 aa, Homo Sapiens
AEAYIRNAG

SEQ ID NO: 145062 - protein, 9 aa, Homo Sapiens
LVHDFTDAI

SEQ ID NO: 145063 - protein, 9 aa, Homo Sapiens
TLRTLSLRG

SEQ ID NO: 145064 - protein, 9 aa, Homo Sapiens
AGRHVAYSV

SEQ ID NO: 145065 - protein, 9 aa, Homo Sapiens
TAEYCENVY

SEQ ID NO: 145066 - protein, 9 aa, Homo Sapiens
LPLLLLPTG

SEQ ID NO: 145067 - protein, 9 aa, Homo Sapiens
RFNGTRLGV

SEQ ID NO: 145068 - protein, 9 aa, Homo Sapiens
KATRRARRA

SEQ ID NO: 145069 - protein, 9 aa, Homo Sapiens
NIVAPPSPS

SEQ ID NO: 145070 - protein, 9 aa, Homo Sapiens
GPTSQQILF

SEQ ID NO: 145071 - protein, 9 aa, Homo Sapiens
GGRCRGTAS

SEQ ID NO: 145072 - protein, 9 aa, Homo Sapiens
QRTPCSRLV

SEQ ID NO: 145073 - protein, 9 aa, Homo Sapiens
APRSWPRKL

SEQ ID NO: 145074 - protein, 9 aa, Homo Sapiens
ELARKASCK

SEQ ID NO: 145075 - protein, 9 aa, Homo Sapiens
CRARSSCWP

SEQ ID NO: 145076 - protein, 9 aa, Homo Sapiens
TKNSRGAVK

SEQ ID NO: 145077 - protein, 9 aa, Homo Sapiens
GSPSYAPQV

SEQ ID NO: 145078 - protein, 9 aa, Homo Sapiens
HTPGLPQFP

SEQ ID NO: 145079 - protein, 9 aa, Homo Sapiens
ILFAFTKQV

SEQ ID NO: 145080 - protein, 9 aa, Homo Sapiens
VYLWLMQMR

SEQ ID NO: 145081 - protein, 9 aa, Homo Sapiens
SRRTRPNRV

SEQ ID NO: 145082 - protein, 9 aa, Homo Sapiens
SLPLMTLTS

SEQ ID NO: 145083 - protein, 9 aa, Homo Sapiens
TLAWNNTCN

SEQ ID NO: 145084 - protein, 9 aa, Homo Sapiens
NVYMVTQGR

SEQ ID NO: 145085 - protein, 9 aa, Homo Sapiens
GTSTVTNSE

SEQ ID NO: 145086 - protein, 9 aa, Homo Sapiens
FCTLSAKHV

SEQ ID NO: 145087 - protein, 9 aa, Homo Sapiens
PGAGAMEVA

SEQ ID NO: 145088 - protein, 9 aa, Homo Sapiens
GGGGGGSTG

SEQ ID NO: 145089 - protein, 9 aa, Homo Sapiens
WFLGIVFRR

SEQ ID NO: 145090 - protein, 9 aa, Homo Sapiens
PAIFYRPMG

SEQ ID NO: 145091 - protein, 9 aa, Homo Sapiens
PPLPSSRVF

SEQ ID NO: 145092 - protein, 9 aa, Homo Sapiens
FQKALEIKH

SEQ ID NO: 145093 - protein, 9 aa, Homo Sapiens
GQTEQCGIN

SEQ ID NO: 145094 - protein, 9 aa, Homo Sapiens
HACVQKVTS

SEQ ID NO: 145095 - protein, 9 aa, Homo Sapiens
MHPLLELLC

SEQ ID NO: 145096 - protein, 9 aa, Homo Sapiens
GGITFVPHW

SEQ ID NO: 145097 - protein, 9 aa, Homo Sapiens
EPSVAASSL

SEQ ID NO: 145098 - protein, 9 aa, Homo Sapiens
SSSAPPAAT

SEQ ID NO: 145099 - protein, 9 aa, Homo Sapiens
RPRWSCWRP

SEQ ID NO: 145100 - protein, 9 aa, Homo Sapiens
PPPKSPPPP

SEQ ID NO: 145101 - protein, 9 aa, Homo Sapiens
CIEALGGFV

SEQ ID NO: 145102 - protein, 9 aa, Homo Sapiens
GSTSAGLRC

SEQ ID NO: 145103 - protein, 9 aa, Homo Sapiens
CGRQCLMSQ

SEQ ID NO: 145104 - protein, 9 aa, Homo Sapiens
MKHTYMRLD

SEQ ID NO: 145105 - protein, 9 aa, Homo Sapiens
RRRLRAGQT

SEQ ID NO: 145106 - protein, 9 aa, Homo Sapiens
YCDKLYSRK

SEQ ID NO: 145107 - protein, 9 aa, Homo Sapiens
APAPRRQRA

SEQ ID NO: 145108 - protein, 9 aa, Homo Sapiens
CWGLGTGQR

SEQ ID NO: 145109 - protein, 9 aa, Homo Sapiens
ALQLLILDL

SEQ ID NO: 145110 - protein, 9 aa, Homo Sapiens
RNLSNMTIQ

SEQ ID NO: 145111 - protein, 9 aa, Homo Sapiens
DVYIGPDDV

SEQ ID NO: 145112 - protein, 9 aa, Homo Sapiens
PASRGAPGS

SEQ ID NO: 145113 - protein, 9 aa, Homo Sapiens
RWGLHLQKD

SEQ ID NO: 145114 - protein, 9 aa, Homo Sapiens
TDEKFMEVM

SEQ ID NO: 145115 - protein, 9 aa, Homo Sapiens
FAVSPNHRP

SEQ ID NO: 145116 - protein, 9 aa, Homo Sapiens
RRPSLCWPS

SEQ ID NO: 145117 - protein, 9 aa, Homo Sapiens
RLGVVALYA

SEQ ID NO: 145118 - protein, 9 aa, Homo Sapiens
QHPPTGPLL

SEQ ID NO: 145119 - protein, 9 aa, Homo Sapiens
NSLLGLGDP

SEQ ID NO: 145120 - protein, 9 aa, Homo Sapiens
FTLELDRSH

SEQ ID NO: 145121 - protein, 9 aa, Homo Sapiens
SDPDGPGRL

SEQ ID NO: 145122 - protein, 9 aa, Homo Sapiens
LAEVCQSGE

SEQ ID NO: 145123 - protein, 9 aa, Homo Sapiens
TALAPRAPA

SEQ ID NO: 145124 - protein, 9 aa, Homo Sapiens
FLYIVMSYD

SEQ ID NO: 145125 - protein, 9 aa, Homo Sapiens
AFLRTPWTL

SEQ ID NO: 145126 - protein, 9 aa, Homo Sapiens
PPLLKLGNG

SEQ ID NO: 145127 - protein, 9 aa, Homo Sapiens
GSRPCHSLP

SEQ ID NO: 145128 - protein, 9 aa, Homo Sapiens
RSVLRPHSY

SEQ ID NO: 145129 - protein, 9 aa, Homo Sapiens
LLGVVPGPP

SEQ ID NO: 145130 - protein, 9 aa, Homo Sapiens
VPPPKSPPP

SEQ ID NO: 145131 - protein, 9 aa, Homo Sapiens
EVLDEGTKA

SEQ ID NO: 145132 - protein, 9 aa, Homo Sapiens
LEELRRLYC

SEQ ID NO: 145133 - protein, 9 aa, Homo Sapiens
KYVLWRGCH

SEQ ID NO: 145134 - protein, 9 aa, Homo Sapiens
RVILGKHLV

SEQ ID NO: 145135 - protein, 9 aa, Homo Sapiens
ARKRYIRRR

SEQ ID NO: 145136 - protein, 9 aa, Homo Sapiens
ENSHPPTTT

SEQ ID NO: 145137 - protein, 9 aa, Homo Sapiens
IWNGMAIIR

SEQ ID NO: 145138 - protein, 9 aa, Homo Sapiens
SHLMFAVWE

SEQ ID NO: 145139 - protein, 9 aa, Homo Sapiens
VVWAQWGPN

SEQ ID NO: 145140 - protein, 9 aa, Homo Sapiens
GLPATSLCL

SEQ ID NO: 145141 - protein, 9 aa, Homo Sapiens
LRVKALKKA

SEQ ID NO: 145142 - protein, 9 aa, Homo Sapiens
IFGKKHRIE

SEQ ID NO: 145143 - protein, 9 aa, Homo Sapiens
STPAPQKIS

SEQ ID NO: 145144 - protein, 9 aa, Homo Sapiens
FPDVFICDN

SEQ ID NO: 145145 - protein, 9 aa, Homo Sapiens
KWSGDILTG

SEQ ID NO: 145146 - protein, 9 aa, Homo Sapiens
DHQKDTRWH

SEQ ID NO: 145147 - protein, 9 aa, Homo Sapiens
GTAGLRKRP

SEQ ID NO: 145148 - protein, 9 aa, Homo Sapiens
RSSRSAPSL

SEQ ID NO: 145149 - protein, 9 aa, Homo Sapiens
EEAADEKLT

SEQ ID NO: 145150 - protein, 9 aa, Homo Sapiens
YYLRHLEGG

SEQ ID NO: 145151 - protein, 9 aa, Homo Sapiens
AAVRLMLKE

SEQ ID NO: 145152 - protein, 9 aa, Homo Sapiens
LGTASEGWS

SEQ ID NO: 145153 - protein, 9 aa, Homo Sapiens
KTGGLYIFC

SEQ ID NO: 145154 - protein, 9 aa, Homo Sapiens
KCSLQAAVI

SEQ ID NO: 145155 - protein, 9 aa, Homo Sapiens
WSASCGPTS

SEQ ID NO: 145156 - protein, 9 aa, Homo Sapiens
LLVVFYINV

SEQ ID NO: 145157 - protein, 9 aa, Homo Sapiens
NRHLCCILV

SEQ ID NO: 145158 - protein, 9 aa, Homo Sapiens
PKHTEAKKA

SEQ ID NO: 145159 - protein, 9 aa, Homo Sapiens
LFLLIKANF

SEQ ID NO: 145160 - protein, 9 aa, Homo Sapiens
CTALNLFFK

SEQ ID NO: 145161 - protein, 9 aa, Homo Sapiens
YSSTFPTIN

SEQ ID NO: 145162 - protein, 9 aa, Homo Sapiens
QTNSRLYES

SEQ ID NO: 145163 - protein, 9 aa, Homo Sapiens
DSESHYCPE

SEQ ID NO: 145164 - protein, 9 aa, Homo Sapiens
WSFLLRYYS

SEQ ID NO: 145165 - protein, 9 aa, Homo Sapiens
QQRPGAPGP

SEQ ID NO: 145166 - protein, 9 aa, Homo Sapiens
AQSEGLQLL

SEQ ID NO: 145167 - protein, 9 aa, Homo Sapiens
PEVPRCAMA

SEQ ID NO: 145168 - protein, 9 aa, Homo Sapiens
SVAVWSCVN

SEQ ID NO: 145169 - protein, 9 aa, Homo Sapiens
EAVAAEEEE

SEQ ID NO: 145170 - protein, 9 aa, Homo Sapiens
KQMSEKKRL

SEQ ID NO: 145171 - protein, 9 aa, Homo Sapiens
ASSAQVRAA

SEQ ID NO: 145172 - protein, 9 aa, Homo Sapiens
LPFHQTIRL

SEQ ID NO: 145173 - protein, 9 aa, Homo Sapiens
GSLTPRTGL

SEQ ID NO: 145174 - protein, 9 aa, Homo Sapiens
EMGSFNLSY

SEQ ID NO: 145175 - protein, 9 aa, Homo Sapiens
CVFRSCFHL

SEQ ID NO: 145176 - protein, 9 aa, Homo Sapiens
KIFGDASAM

SEQ ID NO: 145177 - protein, 9 aa, Homo Sapiens
KEWNEDCNF

SEQ ID NO: 145178 - protein, 9 aa, Homo Sapiens
ELLQANRLP

SEQ ID NO: 145179 - protein, 9 aa, Homo Sapiens
QLAGVLGPE

SEQ ID NO: 145180 - protein, 9 aa, Homo Sapiens
LATRLQKML

SEQ ID NO: 145181 - protein, 9 aa, Homo Sapiens
VATRTWLWR

SEQ ID NO: 145182 - protein, 9 aa, Homo Sapiens
LSAPPTRIA

SEQ ID NO: 145183 - protein, 9 aa, Homo Sapiens
RPPQVQPPP

SEQ ID NO: 145184 - protein, 9 aa, Homo Sapiens
IQRTTSTLG

SEQ ID NO: 145185 - protein, 9 aa, Homo Sapiens
ARSRDVASR

SEQ ID NO: 145186 - protein, 9 aa, Homo Sapiens
TYCHPSCCV

SEQ ID NO: 145187 - protein, 9 aa, Homo Sapiens
AKIEVLDEG

SEQ ID NO: 145188 - protein, 9 aa, Homo Sapiens
HQPVVVLNH

SEQ ID NO: 145189 - protein, 9 aa, Homo Sapiens
PTPWDATIQ

SEQ ID NO: 145190 - protein, 9 aa, Homo Sapiens
KTGTQGERL

SEQ ID NO: 145191 - protein, 9 aa, Homo Sapiens
GCDQWITCK

SEQ ID NO: 145192 - protein, 9 aa, Homo Sapiens
APSLRTRVQ

SEQ ID NO: 145193 - protein, 9 aa, Homo Sapiens
HNKLSVVPQ

SEQ ID NO: 145194 - protein, 9 aa, Homo Sapiens
NEKEDGEAT

SEQ ID NO: 145195 - protein, 9 aa, Homo Sapiens
DRNYVNVDP

SEQ ID NO: 145196 - protein, 9 aa, Homo Sapiens
PPTPKSTYE

SEQ ID NO: 145197 - protein, 9 aa, Homo Sapiens
LICFQLRVP

SEQ ID NO: 145198 - protein, 9 aa, Homo Sapiens
WLLPGMGPH

SEQ ID NO: 145199 - protein, 9 aa, Homo Sapiens
NAVPTVFTF

SEQ ID NO: 145200 - protein, 9 aa, Homo Sapiens
AGGRRTAPE

SEQ ID NO: 145201 - protein, 9 aa, Homo Sapiens
APLWRVTQK

SEQ ID NO: 145202 - protein, 9 aa, Homo Sapiens
ILEKLEKKR

SEQ ID NO: 145203 - protein, 9 aa, Homo Sapiens
FWMIGGIYT

SEQ ID NO: 145204 - protein, 9 aa, Homo Sapiens
KPISRNSRN

SEQ ID NO: 145205 - protein, 9 aa, Homo Sapiens
RVKALKKAS

SEQ ID NO: 145206 - protein, 9 aa, Homo Sapiens
LQELTLPLM

SEQ ID NO: 145207 - protein, 9 aa, Homo Sapiens
IKEMSLQSL

SEQ ID NO: 145208 - protein, 9 aa, Homo Sapiens
CGDPPPYEP

SEQ ID NO: 145209 - protein, 9 aa, Homo Sapiens
PAAFPPPAA

SEQ ID NO: 145210 - protein, 9 aa, Homo Sapiens
EQHTQQLSL

SEQ ID NO: 145211 - protein, 9 aa, Homo Sapiens
MHTTRPVWG

SEQ ID NO: 145212 - protein, 9 aa, Homo Sapiens
EGASWSVSL

SEQ ID NO: 145213 - protein, 9 aa, Homo Sapiens
CCVIIPPGS

SEQ ID NO: 145214 - protein, 9 aa, Homo Sapiens
TPKSTYESN

SEQ ID NO: 145215 - protein, 9 aa, Homo Sapiens
EPPQCHPRY

SEQ ID NO: 145216 - protein, 9 aa, Homo Sapiens
PQEKWLRKR

SEQ ID NO: 145217 - protein, 9 aa, Homo Sapiens
PVTLELSPL

SEQ ID NO: 145218 - protein, 9 aa, Homo Sapiens
TVKCQDYLS

SEQ ID NO: 145219 - protein, 9 aa, Homo Sapiens
GNGVERPLI

SEQ ID NO: 145220 - protein, 9 aa, Homo Sapiens
SQVGGTQEV

SEQ ID NO: 145221 - protein, 9 aa, Homo Sapiens
VQMKRVGPK

SEQ ID NO: 145222 - protein, 9 aa, Homo Sapiens
ERPAAAPWR

SEQ ID NO: 145223 - protein, 9 aa, Homo Sapiens
VLPHGHGKP

SEQ ID NO: 145224 - protein, 9 aa, Homo Sapiens
WAGASTFSL

SEQ ID NO: 145225 - protein, 9 aa, Homo Sapiens
SFPKFSRLH

SEQ ID NO: 145226 - protein, 9 aa, Homo Sapiens
LSKVQSVEA

SEQ ID NO: 145227 - protein, 9 aa, Homo Sapiens
SIWNDPWLL

SEQ ID NO: 145228 - protein, 9 aa, Homo Sapiens
TYYEGEVNA

SEQ ID NO: 145229 - protein, 9 aa, Homo Sapiens
GWVEVLKAS

SEQ ID NO: 145230 - protein, 9 aa, Homo Sapiens
PRLGYSITA

SEQ ID NO: 145231 - protein, 9 aa, Homo Sapiens
NGICMHRGL

SEQ ID NO: 145232 - protein, 9 aa, Homo Sapiens
SSTLELLRE

SEQ ID NO: 145233 - protein, 9 aa, Homo Sapiens
GVSLNEMCC

SEQ ID NO: 145234 - protein, 9 aa, Homo Sapiens
NRFKWGPTS

SEQ ID NO: 145235 - protein, 9 aa, Homo Sapiens
KEEMKKTTS

SEQ ID NO: 145236 - protein, 9 aa, Homo Sapiens
THLCRVCGC

SEQ ID NO: 145237 - protein, 9 aa, Homo Sapiens
TSRIYGFIG

SEQ ID NO: 145238 - protein, 9 aa, Homo Sapiens
VLQWQKKWV

SEQ ID NO: 145239 - protein, 9 aa, Homo Sapiens
QGAAVVHGQ

SEQ ID NO: 145240 - protein, 9 aa, Homo Sapiens
SPRRAPLNS

SEQ ID NO: 145241 - protein, 9 aa, Homo Sapiens
RVKFLLWLL

SEQ ID NO: 145242 - protein, 9 aa, Homo Sapiens
FQARKRYIR

SEQ ID NO: 145243 - protein, 9 aa, Homo Sapiens
RCRSLTGRT

SEQ ID NO: 145244 - protein, 9 aa, Homo Sapiens
PPTTGLPAT

SEQ ID NO: 145245 - protein, 9 aa, Homo Sapiens
RGPAATSSS

SEQ ID NO: 145246 - protein, 9 aa, Homo Sapiens
CFRHAPPPR

SEQ ID NO: 145247 - protein, 9 aa, Homo Sapiens
GPPKPGLVC

SEQ ID NO: 145248 - protein, 9 aa, Homo Sapiens
LDSQQTVPF

SEQ ID NO: 145249 - protein, 9 aa, Homo Sapiens
NVDKLAKDI

SEQ ID NO: 145250 - protein, 9 aa, Homo Sapiens
SKFITKEKC

SEQ ID NO: 145251 - protein, 9 aa, Homo Sapiens
APSQVWTAA

SEQ ID NO: 145252 - protein, 9 aa, Homo Sapiens
GSLSLLPDT

SEQ ID NO: 145253 - protein, 9 aa, Homo Sapiens
SSSILLCSR

SEQ ID NO: 145254 - protein, 9 aa, Homo Sapiens
PSPSMWRTS

SEQ ID NO: 145255 - protein, 9 aa, Homo Sapiens
KKFTKLAKK

SEQ ID NO: 145256 - protein, 9 aa, Homo Sapiens
LSWGRRRRM

SEQ ID NO: 145257 - protein, 9 aa, Homo Sapiens
LFQSIWNDP

SEQ ID NO: 145258 - protein, 9 aa, Homo Sapiens
FSDAVSHLL

SEQ ID NO: 145259 - protein, 9 aa, Homo Sapiens
TIQTMKTVP

SEQ ID NO: 145260 - protein, 9 aa, Homo Sapiens
LLPDTSCSL

SEQ ID NO: 145261 - protein, 9 aa, Homo Sapiens
PRRSPALRA

SEQ ID NO: 145262 - protein, 9 aa, Homo Sapiens
GPYECIECG

SEQ ID NO: 145263 - protein, 9 aa, Homo Sapiens
DVVLKKLEY

SEQ ID NO: 145264 - protein, 9 aa, Homo Sapiens
DHGRDQGRH

SEQ ID NO: 145265 - protein, 9 aa, Homo Sapiens
PAKHSSSQC

SEQ ID NO: 145266 - protein, 9 aa, Homo Sapiens
RAAGQRREH

SEQ ID NO: 145267 - protein, 9 aa, Homo Sapiens
HSLEGPIEA

SEQ ID NO: 145268 - protein, 9 aa, Homo Sapiens
WGRGGWRVV

SEQ ID NO: 145269 - protein, 9 aa, Homo Sapiens
AHVHVESNS

SEQ ID NO: 145270 - protein, 9 aa, Homo Sapiens
LGEAGITGQ

SEQ ID NO: 145271 - protein, 9 aa, Homo Sapiens
ISEKEQRCG

SEQ ID NO: 145272 - protein, 9 aa, Homo Sapiens
RCPAPSQPP

SEQ ID NO: 145273 - protein, 9 aa, Homo Sapiens
AAWIPASRC

SEQ ID NO: 145274 - protein, 9 aa, Homo Sapiens
SRDQVHDDR

SEQ ID NO: 145275 - protein, 9 aa, Homo Sapiens
WSCVNVAGV

SEQ ID NO: 145276 - protein, 9 aa, Homo Sapiens
QLLILDLVH

SEQ ID NO: 145277 - protein, 9 aa, Homo Sapiens
SGLDNSAKS

SEQ ID NO: 145278 - protein, 9 aa, Homo Sapiens
GWRWGWGQL

SEQ ID NO: 145279 - protein, 9 aa, Homo Sapiens
PVGWQLVGL

SEQ ID NO: 145280 - protein, 9 aa, Homo Sapiens
RAAKDYQWE

SEQ ID NO: 145281 - protein, 9 aa, Homo Sapiens
TPFCTLSAK

SEQ ID NO: 145282 - protein, 9 aa, Homo Sapiens
VVGVYGSLH

SEQ ID NO: 145283 - protein, 9 aa, Homo Sapiens
LPKKINSRC

SEQ ID NO: 145284 - protein, 9 aa, Homo Sapiens
GYAVSSHHN

SEQ ID NO: 145285 - protein, 9 aa, Homo Sapiens
QISQKGRIY

SEQ ID NO: 145286 - protein, 9 aa, Homo Sapiens
GDELVRFAL

SEQ ID NO: 145287 - protein, 9 aa, Homo Sapiens
TEDLPPMGR

SEQ ID NO: 145288 - protein, 9 aa, Homo Sapiens
CSTSCGTYS

SEQ ID NO: 145289 - protein, 9 aa, Homo Sapiens
TLCCGCPHP

SEQ ID NO: 145290 - protein, 9 aa, Homo Sapiens
TKKSNIYKM

SEQ ID NO: 145291 - protein, 9 aa, Homo Sapiens
RHVAGEGPR

SEQ ID NO: 145292 - protein, 9 aa, Homo Sapiens
IWQMGIGMK

SEQ ID NO: 145293 - protein, 9 aa, Homo Sapiens
IAEEFDVSE

SEQ ID NO: 145294 - protein, 9 aa, Homo Sapiens
PQRRHLWNL

SEQ ID NO: 145295 - protein, 9 aa, Homo Sapiens
LGLAQLTAQ

SEQ ID NO: 145296 - protein, 9 aa, Homo Sapiens
RVAVPYPPT

SEQ ID NO: 145297 - protein, 9 aa, Homo Sapiens
IAELTVLAL

SEQ ID NO: 145298 - protein, 9 aa, Homo Sapiens
LGKGTEVPW

SEQ ID NO: 145299 - protein, 9 aa, Homo Sapiens
VTLRLRKVL

SEQ ID NO: 145300 - protein, 9 aa, Homo Sapiens
QETHKGEIP

SEQ ID NO: 145301 - protein, 9 aa, Homo Sapiens
QKEEKTKEA

SEQ ID NO: 145302 - protein, 9 aa, Homo Sapiens
PSWVGPCFP

SEQ ID NO: 145303 - protein, 9 aa, Homo Sapiens
KLGVVDVNA

SEQ ID NO: 145304 - protein, 9 aa, Homo Sapiens
VQLRPQASR

SEQ ID NO: 145305 - protein, 9 aa, Homo Sapiens
LPSLQQLLE

SEQ ID NO: 145306 - protein, 9 aa, Homo Sapiens
VNSSWFIFS

SEQ ID NO: 145307 - protein, 9 aa, Homo Sapiens
YVMMLSLSE

SEQ ID NO: 145308 - protein, 9 aa, Homo Sapiens
RRTAPERAG

SEQ ID NO: 145309 - protein, 9 aa, Homo Sapiens
SESSRYQFQ

SEQ ID NO: 145310 - protein, 9 aa, Homo Sapiens
PSTTRRDSW

SEQ ID NO: 145311 - protein, 9 aa, Homo Sapiens
PLSRPINNM

SEQ ID NO: 145312 - protein, 9 aa, Homo Sapiens
SDCKVCPSW

SEQ ID NO: 145313 - protein, 9 aa, Homo Sapiens
CGRRRRPGG

SEQ ID NO: 145314 - protein, 9 aa, Homo Sapiens
EQVNLKWPW

SEQ ID NO: 145315 - protein, 9 aa, Homo Sapiens
EEMVQRWAS

SEQ ID NO: 145316 - protein, 9 aa, Homo Sapiens
QSKRLAIPC

SEQ ID NO: 145317 - protein, 9 aa, Homo Sapiens
TSSRYILSR

SEQ ID NO: 145318 - protein, 9 aa, Homo Sapiens
QSSSLSLES

SEQ ID NO: 145319 - protein, 9 aa, Homo Sapiens
ATAAGGRTR

SEQ ID NO: 145320 - protein, 9 aa, Homo Sapiens
YIRNAGLST

SEQ ID NO: 145321 - protein, 9 aa, Homo Sapiens
GLGGRCRGT

SEQ ID NO: 145322 - protein, 9 aa, Homo Sapiens
DAALIIYEM

SEQ ID NO: 145323 - protein, 9 aa, Homo Sapiens
SAKCGEGPS

SEQ ID NO: 145324 - protein, 9 aa, Homo Sapiens
ALQGPLAST

SEQ ID NO: 145325 - protein, 9 aa, Homo Sapiens
TDPVLFTPA

SEQ ID NO: 145326 - protein, 9 aa, Homo Sapiens
PMTACSILA

SEQ ID NO: 145327 - protein, 9 aa, Homo Sapiens
AVPQVNMTD

SEQ ID NO: 145328 - protein, 9 aa, Homo Sapiens
LDKSCLDIQ

SEQ ID NO: 145329 - protein, 9 aa, Homo Sapiens
HGWLQETHK

SEQ ID NO: 145330 - protein, 9 aa, Homo Sapiens
RRAPRAPSS

SEQ ID NO: 145331 - protein, 9 aa, Homo Sapiens
HQLLMDRGL

SEQ ID NO: 145332 - protein, 9 aa, Homo Sapiens
CWSTAACAE

SEQ ID NO: 145333 - protein, 9 aa, Homo Sapiens
VGTSKGLLE

SEQ ID NO: 145334 - protein, 9 aa, Homo Sapiens
LTASLTVAE

SEQ ID NO: 145335 - protein, 9 aa, Homo Sapiens
EGLRVRRRF

SEQ ID NO: 145336 - protein, 9 aa, Homo Sapiens
TTREPLTKQ

SEQ ID NO: 145337 - protein, 9 aa, Homo Sapiens
EDGAWRQRR

SEQ ID NO: 145338 - protein, 9 aa, Homo Sapiens
SAPGTDRQQ

SEQ ID NO: 145339 - protein, 9 aa, Homo Sapiens
DVWLAAASE

SEQ ID NO: 145340 - protein, 9 aa, Homo Sapiens
AKYHKAHSL

SEQ ID NO: 145341 - protein, 9 aa, Homo Sapiens
VKFCKAQNF

SEQ ID NO: 145342 - protein, 9 aa, Homo Sapiens
ALMAQLTAA

SEQ ID NO: 145343 - protein, 9 aa, Homo Sapiens
VRPYTVRAG

SEQ ID NO: 145344 - protein, 9 aa, Homo Sapiens
LIQSDENGI

SEQ ID NO: 145345 - protein, 9 aa, Homo Sapiens
CGYPSLFLS

SEQ ID NO: 145346 - protein, 9 aa, Homo Sapiens
VFSFFFCLR

SEQ ID NO: 145347 - protein, 9 aa, Homo Sapiens
THKHTHKHT

SEQ ID NO: 145348 - protein, 9 aa, Homo Sapiens
GNFRGPHPR

SEQ ID NO: 145349 - protein, 9 aa, Homo Sapiens
TQAYTLTYT

SEQ ID NO: 145350 - protein, 9 aa, Homo Sapiens
GGSNPHANR

SEQ ID NO: 145351 - protein, 9 aa, Homo Sapiens
QHTQQLSLL

SEQ ID NO: 145352 - protein, 9 aa, Homo Sapiens
IPSGMEDVG

SEQ ID NO: 145353 - protein, 9 aa, Homo Sapiens
CGLVAQQPH

SEQ ID NO: 145354 - protein, 9 aa, Homo Sapiens
HNTMAIGVA

SEQ ID NO: 145355 - protein, 9 aa, Homo Sapiens
ILQAIMEAT

SEQ ID NO: 145356 - protein, 9 aa, Homo Sapiens
VTNITTKFP

SEQ ID NO: 145357 - protein, 9 aa, Homo Sapiens
RSRTQGSRP

SEQ ID NO: 145358 - protein, 9 aa, Homo Sapiens
ECRSCCERM

SEQ ID NO: 145359 - protein, 9 aa, Homo Sapiens
PLYSSHSQN

SEQ ID NO: 145360 - protein, 9 aa, Homo Sapiens
PRANGATGS

SEQ ID NO: 145361 - protein, 9 aa, Homo Sapiens
ADEKLTEEA

SEQ ID NO: 145362 - protein, 9 aa, Homo Sapiens
AKYVELDRE

SEQ ID NO: 145363 - protein, 9 aa, Homo Sapiens
ACSPSRLST

SEQ ID NO: 145364 - protein, 9 aa, Homo Sapiens
YEEMASQLG

SEQ ID NO: 145365 - protein, 9 aa, Homo Sapiens
HGLWFLLKS

SEQ ID NO: 145366 - protein, 9 aa, Homo Sapiens
PVPKKAPRR

SEQ ID NO: 145367 - protein, 9 aa, Homo Sapiens
TLPCRRHCP

SEQ ID NO: 145368 - protein, 9 aa, Homo Sapiens
PVLCGCFLL

SEQ ID NO: 145369 - protein, 9 aa, Homo Sapiens
PEYTWHLPC

SEQ ID NO: 145370 - protein, 9 aa, Homo Sapiens
TRSWRTWSA

SEQ ID NO: 145371 - protein, 9 aa, Homo Sapiens
MKRVGPKSW

SEQ ID NO: 145372 - protein, 9 aa, Homo Sapiens
REALVLGLD

SEQ ID NO: 145373 - protein, 9 aa, Homo Sapiens
LTRLRRRME

SEQ ID NO: 145374 - protein, 9 aa, Homo Sapiens
RPHSHNKVL

SEQ ID NO: 145375 - protein, 9 aa, Homo Sapiens
FQEIINHSS

SEQ ID NO: 145376 - protein, 9 aa, Homo Sapiens
SSSCKKQAA

SEQ ID NO: 145377 - protein, 9 aa, Homo Sapiens
LPLSPSRRS

SEQ ID NO: 145378 - protein, 9 aa, Homo Sapiens
TPARSPTSA

SEQ ID NO: 145379 - protein, 9 aa, Homo Sapiens
QRRRWASRA

SEQ ID NO: 145380 - protein, 9 aa, Homo Sapiens
KNGRFALAD

SEQ ID NO: 145381 - protein, 9 aa, Homo Sapiens
LDHQVSEVF

SEQ ID NO: 145382 - protein, 9 aa, Homo Sapiens
PVLFTPATH

SEQ ID NO: 145383 - protein, 9 aa, Homo Sapiens
GGLPVGESP

SEQ ID NO: 145384 - protein, 9 aa, Homo Sapiens
LTALPSQLV

SEQ ID NO: 145385 - protein, 9 aa, Homo Sapiens
DHLFYIYTS

SEQ ID NO: 145386 - protein, 9 aa, Homo Sapiens
NAWWLQVPG

SEQ ID NO: 145387 - protein, 9 aa, Homo Sapiens
SASDTIKFV

SEQ ID NO: 145388 - protein, 9 aa, Homo Sapiens
RSCTRRPVT

SEQ ID NO: 145389 - protein, 9 aa, Homo Sapiens
MPSSPRWRL

SEQ ID NO: 145390 - protein, 9 aa, Homo Sapiens
TGQKRAGNF

SEQ ID NO: 145391 - protein, 9 aa, Homo Sapiens
ELWVTHRKA

SEQ ID NO: 145392 - protein, 9 aa, Homo Sapiens
RLRSRSSRR

SEQ ID NO: 145393 - protein, 9 aa, Homo Sapiens
LDWITQAKD

SEQ ID NO: 145394 - protein, 9 aa, Homo Sapiens
KYVELDRED

SEQ ID NO: 145395 - protein, 9 aa, Homo Sapiens
KIHTGKNPY

SEQ ID NO: 145396 - protein, 9 aa, Homo Sapiens
RPPPAARPP

SEQ ID NO: 145397 - protein, 9 aa, Homo Sapiens
PGTFMCSDP

SEQ ID NO: 145398 - protein, 9 aa, Homo Sapiens
SGWAMAVVA

SEQ ID NO: 145399 - protein, 9 aa, Homo Sapiens
RHRVCPQAS

SEQ ID NO: 145400 - protein, 9 aa, Homo Sapiens
RMPESSGHT

SEQ ID NO: 145401 - protein, 9 aa, Homo Sapiens
GFLDVRTAP

SEQ ID NO: 145402 - protein, 9 aa, Homo Sapiens
ELIDGSAVP

SEQ ID NO: 145403 - protein, 9 aa, Homo Sapiens
EGAVATQGP

SEQ ID NO: 145404 - protein, 9 aa, Homo Sapiens
NKKISVLSF

SEQ ID NO: 145405 - protein, 9 aa, Homo Sapiens
FRLIMDGVK

SEQ ID NO: 145406 - protein, 9 aa, Homo Sapiens
HLDTLKKVH

SEQ ID NO: 145407 - protein, 9 aa, Homo Sapiens
THYSQDQFL

SEQ ID NO: 145408 - protein, 9 aa, Homo Sapiens
WQALLHLGI

SEQ ID NO: 145409 - protein, 9 aa, Homo Sapiens
KCLVQMQTE

SEQ ID NO: 145410 - protein, 9 aa, Homo Sapiens
VGLGVQVLP

SEQ ID NO: 145411 - protein, 9 aa, Homo Sapiens
PAHWLRASS

SEQ ID NO: 145412 - protein, 9 aa, Homo Sapiens
VLLCFDISH

SEQ ID NO: 145413 - protein, 9 aa, Homo Sapiens
AWLRHRLRA

SEQ ID NO: 145414 - protein, 9 aa, Homo Sapiens
ARTCSPCSP

SEQ ID NO: 145415 - protein, 9 aa, Homo Sapiens
GLLLLGGGC

SEQ ID NO: 145416 - protein, 9 aa, Homo Sapiens
QELWQLLQG

SEQ ID NO: 145417 - protein, 9 aa, Homo Sapiens
ARLSRALHV

SEQ ID NO: 145418 - protein, 9 aa, Homo Sapiens
PAGRHVAYS

SEQ ID NO: 145419 - protein, 9 aa, Homo Sapiens
QISIFHALM

SEQ ID NO: 145420 - protein, 9 aa, Homo Sapiens
TTTMRLESN

SEQ ID NO: 145421 - protein, 9 aa, Homo Sapiens
QPLPVAPGS

SEQ ID NO: 145422 - protein, 9 aa, Homo Sapiens
YMLYKAVSG

SEQ ID NO: 145423 - protein, 9 aa, Homo Sapiens
HELVLLQEP

SEQ ID NO: 145424 - protein, 9 aa, Homo Sapiens
AMAHPSLLL

SEQ ID NO: 145425 - protein, 9 aa, Homo Sapiens
WGWGQLLLL

SEQ ID NO: 145426 - protein, 9 aa, Homo Sapiens
YDPFMHLEN

SEQ ID NO: 145427 - protein, 9 aa, Homo Sapiens
FQNISAKQR

SEQ ID NO: 145428 - protein, 9 aa, Homo Sapiens
SVSAAGVRD

SEQ ID NO: 145429 - protein, 9 aa, Homo Sapiens
HEGPSPLLR

SEQ ID NO: 145430 - protein, 9 aa, Homo Sapiens
IVGQLYLRR

SEQ ID NO: 145431 - protein, 9 aa, Homo Sapiens
VQKEGLSPR

SEQ ID NO: 145432 - protein, 9 aa, Homo Sapiens
EHRRVNDAL

SEQ ID NO: 145433 - protein, 9 aa, Homo Sapiens
TFPEGALGQ

SEQ ID NO: 145434 - protein, 9 aa, Homo Sapiens
PPQSSFVPT

SEQ ID NO: 145435 - protein, 9 aa, Homo Sapiens
PPPHPPLPS

SEQ ID NO: 145436 - protein, 9 aa, Homo Sapiens
GRAAPRTSA

SEQ ID NO: 145437 - protein, 9 aa, Homo Sapiens
LRRQASSGY

SEQ ID NO: 145438 - protein, 9 aa, Homo Sapiens
GLRHFPYKP

SEQ ID NO: 145439 - protein, 9 aa, Homo Sapiens
VGQQGRARA

SEQ ID NO: 145440 - protein, 9 aa, Homo Sapiens
LGLKVKALE

SEQ ID NO: 145441 - protein, 9 aa, Homo Sapiens
MHSSGSKRN

SEQ ID NO: 145442 - protein, 9 aa, Homo Sapiens
SAPVPKKAP

SEQ ID NO: 145443 - protein, 9 aa, Homo Sapiens
VLTAFLLAG

SEQ ID NO: 145444 - protein, 9 aa, Homo Sapiens
HTGTQAYTQ

SEQ ID NO: 145445 - protein, 9 aa, Homo Sapiens
FYTRERLGA

SEQ ID NO: 145446 - protein, 9 aa, Homo Sapiens
KKEIYIYNI

SEQ ID NO: 145447 - protein, 9 aa, Homo Sapiens
PAATSSSTG

SEQ ID NO: 145448 - protein, 9 aa, Homo Sapiens
PGTRERVWF

SEQ ID NO: 145449 - protein, 9 aa, Homo Sapiens
KQRTRTMRL

SEQ ID NO: 145450 - protein, 9 aa, Homo Sapiens
PLRQDVKQQ

SEQ ID NO: 145451 - protein, 9 aa, Homo Sapiens
LVINKPYGL

SEQ ID NO: 145452 - protein, 9 aa, Homo Sapiens
SWPVAQRMG

SEQ ID NO: 145453 - protein, 9 aa, Homo Sapiens
FKKPGRKGT

SEQ ID NO: 145454 - protein, 9 aa, Homo Sapiens
MGDVEAFAK

SEQ ID NO: 145455 - protein, 9 aa, Homo Sapiens
CYLTSGGFF

SEQ ID NO: 145456 - protein, 9 aa, Homo Sapiens
INKDCDGEV

SEQ ID NO: 145457 - protein, 9 aa, Homo Sapiens
LGASCTAST

SEQ ID NO: 145458 - protein, 9 aa, Homo Sapiens
YHLTDLGSR

SEQ ID NO: 145459 - protein, 9 aa, Homo Sapiens
DCILKLNTE

SEQ ID NO: 145460 - protein, 9 aa, Homo Sapiens
GKYNNSVDV

SEQ ID NO: 145461 - protein, 9 aa, Homo Sapiens
QTQTHTHTG

SEQ ID NO: 145462 - protein, 9 aa, Homo Sapiens
TVKYGDEVP

SEQ ID NO: 145463 - protein, 9 aa, Homo Sapiens
LNSINVDRE

SEQ ID NO: 145464 - protein, 9 aa, Homo Sapiens
PVLTSLSEE

SEQ ID NO: 145465 - protein, 9 aa, Homo Sapiens
CPRMAAAAP

SEQ ID NO: 145466 - protein, 9 aa, Homo Sapiens
CNMMVFLAD

SEQ ID NO: 145467 - protein, 9 aa, Homo Sapiens
WFLCGGILI

SEQ ID NO: 145468 - protein, 9 aa, Homo Sapiens
GRKKAFVTC

SEQ ID NO: 145469 - protein, 9 aa, Homo Sapiens
RAGRAAGPG

SEQ ID NO: 145470 - protein, 9 aa, Homo Sapiens
GQLAWLSSS

SEQ ID NO: 145471 - protein, 9 aa, Homo Sapiens
FPRPPPASK

SEQ ID NO: 145472 - protein, 9 aa, Homo Sapiens
KKAVGANYD

SEQ ID NO: 145473 - protein, 9 aa, Homo Sapiens
WSLCTCTVW

SEQ ID NO: 145474 - protein, 9 aa, Homo Sapiens
APIIVNIDT

SEQ ID NO: 145475 - protein, 9 aa, Homo Sapiens
RQLLLATLC

SEQ ID NO: 145476 - protein, 9 aa, Homo Sapiens
LCMQLTATA

SEQ ID NO: 145477 - protein, 9 aa, Homo Sapiens
FPPPAASTP

SEQ ID NO: 145478 - protein, 9 aa, Homo Sapiens
RKSRLVHVY

SEQ ID NO: 145479 - protein, 9 aa, Homo Sapiens
HFQRKLSVL

SEQ ID NO: 145480 - protein, 9 aa, Homo Sapiens
VRAREALVA

SEQ ID NO: 145481 - protein, 9 aa, Homo Sapiens
DTAAPARFL

SEQ ID NO: 145482 - protein, 9 aa, Homo Sapiens
PLIIMGRWT

SEQ ID NO: 145483 - protein, 9 aa, Homo Sapiens
PKYRHIKPI

SEQ ID NO: 145484 - protein, 9 aa, Homo Sapiens
GYNAACQHY

SEQ ID NO: 145485 - protein, 9 aa, Homo Sapiens
ELTDAFEQM

SEQ ID NO: 145486 - protein, 9 aa, Homo Sapiens
PPFGLIPRL

SEQ ID NO: 145487 - protein, 9 aa, Homo Sapiens
PLDGPQIGV

SEQ ID NO: 145488 - protein, 9 aa, Homo Sapiens
ERQDEKACI

SEQ ID NO: 145489 - protein, 9 aa, Homo Sapiens
TSCRGRIKE

SEQ ID NO: 145490 - protein, 9 aa, Homo Sapiens
PRLPLRPQR

SEQ ID NO: 145491 - protein, 9 aa, Homo Sapiens
QPQATGRRR

SEQ ID NO: 145492 - protein, 9 aa, Homo Sapiens
IGVNIRKFI

SEQ ID NO: 145493 - protein, 9 aa, Homo Sapiens
KKNYSTLQI

SEQ ID NO: 145494 - protein, 9 aa, Homo Sapiens
PPPPRLGYS

SEQ ID NO: 145495 - protein, 9 aa, Homo Sapiens
DCYMRIWSL

SEQ ID NO: 145496 - protein, 9 aa, Homo Sapiens
SSRPSTGSR

SEQ ID NO: 145497 - protein, 9 aa, Homo Sapiens
RSPRSCSPA

SEQ ID NO: 145498 - protein, 9 aa, Homo Sapiens
DSKIMISEF

SEQ ID NO: 145499 - protein, 9 aa, Homo Sapiens
TWHLPCGGV

SEQ ID NO: 145500 - protein, 9 aa, Homo Sapiens
QSLRCLPDQ

SEQ ID NO: 145501 - protein, 9 aa, Homo Sapiens
TPATTLRLR

SEQ ID NO: 145502 - protein, 9 aa, Homo Sapiens
THTHTGTQA

SEQ ID NO: 145503 - protein, 9 aa, Homo Sapiens
VGVYGSLHC

SEQ ID NO: 145504 - protein, 9 aa, Homo Sapiens
SSTSSLWST

SEQ ID NO: 145505 - protein, 9 aa, Homo Sapiens
RYIRRRAAL

SEQ ID NO: 145506 - protein, 9 aa, Homo Sapiens
LWVTHRKAQ

SEQ ID NO: 145507 - protein, 9 aa, Homo Sapiens
TSGICSPTW

SEQ ID NO: 145508 - protein, 9 aa, Homo Sapiens
VDGHTCMEG

SEQ ID NO: 145509 - protein, 9 aa, Homo Sapiens
LSKTVCFNV

SEQ ID NO: 145510 - protein, 9 aa, Homo Sapiens
HLTDLGSRL

SEQ ID NO: 145511 - protein, 9 aa, Homo Sapiens
RQRLENLRQ

SEQ ID NO: 145512 - protein, 9 aa, Homo Sapiens
PGVPSPSSL

SEQ ID NO: 145513 - protein, 9 aa, Homo Sapiens
LPATTSTGG

SEQ ID NO: 145514 - protein, 9 aa, Homo Sapiens
CPAPSQPPS

SEQ ID NO: 145515 - protein, 9 aa, Homo Sapiens
LMGPWHLCM

SEQ ID NO: 145516 - protein, 9 aa, Homo Sapiens
TRTQQRTAA

SEQ ID NO: 145517 - protein, 9 aa, Homo Sapiens
FQFPPQVNG

SEQ ID NO: 145518 - protein, 9 aa, Homo Sapiens
TYTGTHRHT

SEQ ID NO: 145519 - protein, 9 aa, Homo Sapiens
GHPRGSQSA

SEQ ID NO: 145520 - protein, 9 aa, Homo Sapiens
STCTGSGRR

SEQ ID NO: 145521 - protein, 9 aa, Homo Sapiens
GLRRSSPSL

SEQ ID NO: 145522 - protein, 9 aa, Homo Sapiens
LGKGNLIGC

SEQ ID NO: 145523 - protein, 9 aa, Homo Sapiens
EGKDYCIFY

SEQ ID NO: 145524 - protein, 9 aa, Homo Sapiens
GPFQMRNVA

SEQ ID NO: 145525 - protein, 9 aa, Homo Sapiens
ARASPAPGS

SEQ ID NO: 145526 - protein, 9 aa, Homo Sapiens
RVAGLLADT

SEQ ID NO: 145527 - protein, 9 aa, Homo Sapiens
MSILFKMSN

SEQ ID NO: 145528 - protein, 9 aa, Homo Sapiens
TNIELTDAF

SEQ ID NO: 145529 - protein, 9 aa, Homo Sapiens
TAAGASGWS

SEQ ID NO: 145530 - protein, 9 aa, Homo Sapiens
LASGTQVTT

SEQ ID NO: 145531 - protein, 9 aa, Homo Sapiens
ASSRQLAGV

SEQ ID NO: 145532 - protein, 9 aa, Homo Sapiens
VSPNHRPMQ

SEQ ID NO: 145533 - protein, 9 aa, Homo Sapiens
PFHLHLARS

SEQ ID NO: 145534 - protein, 9 aa, Homo Sapiens
EGSHHTPSP

SEQ ID NO: 145535 - protein, 9 aa, Homo Sapiens
GTHTDTHTG

SEQ ID NO: 145536 - protein, 9 aa, Homo Sapiens
CNALIAELL

SEQ ID NO: 145537 - protein, 9 aa, Homo Sapiens
PPPACSPSR

SEQ ID NO: 145538 - protein, 9 aa, Homo Sapiens
TLAVSFPHS

SEQ ID NO: 145539 - protein, 9 aa, Homo Sapiens
LPDERGPLK

SEQ ID NO: 145540 - protein, 9 aa, Homo Sapiens
KEGLSPRRA

SEQ ID NO: 145541 - protein, 9 aa, Homo Sapiens
PHHLPRPFH

SEQ ID NO: 145542 - protein, 9 aa, Homo Sapiens
FEFETVLAC

SEQ ID NO: 145543 - protein, 9 aa, Homo Sapiens
QTPASLMIT

SEQ ID NO: 145544 - protein, 9 aa, Homo Sapiens
SCAWMRTQL

SEQ ID NO: 145545 - protein, 9 aa, Homo Sapiens
QTPQDSRQV

SEQ ID NO: 145546 - protein, 9 aa, Homo Sapiens
SIAEGAVAT

SEQ ID NO: 145547 - protein, 9 aa, Homo Sapiens
KPWQSPWGE

SEQ ID NO: 145548 - protein, 9 aa, Homo Sapiens
PASGSTSRR

SEQ ID NO: 145549 - protein, 9 aa, Homo Sapiens
SLRLDASHI

SEQ ID NO: 145550 - protein, 9 aa, Homo Sapiens
RAPMDEDRL

SEQ ID NO: 145551 - protein, 9 aa, Homo Sapiens
DVTAKRMSY

SEQ ID NO: 145552 - protein, 9 aa, Homo Sapiens
NPDSKDEKT

SEQ ID NO: 145553 - protein, 9 aa, Homo Sapiens
HSLVIVESG

SEQ ID NO: 145554 - protein, 9 aa, Homo Sapiens
SSSPPGAVP

SEQ ID NO: 145555 - protein, 9 aa, Homo Sapiens
RKSIFFVGQ

SEQ ID NO: 145556 - protein, 9 aa, Homo Sapiens
NQLDHTNLI

SEQ ID NO: 145557 - protein, 9 aa, Homo Sapiens
IFYNPQWAH

SEQ ID NO: 145558 - protein, 9 aa, Homo Sapiens
IGARICALP

SEQ ID NO: 145559 - protein, 9 aa, Homo Sapiens
VAEAGACEA

SEQ ID NO: 145560 - protein, 9 aa, Homo Sapiens
HMAVHDLMR

SEQ ID NO: 145561 - protein, 9 aa, Homo Sapiens
GAMEVAMAE

SEQ ID NO: 145562 - protein, 9 aa, Homo Sapiens
IVSTSSHLI

SEQ ID NO: 145563 - protein, 9 aa, Homo Sapiens
PVTPIIESR

SEQ ID NO: 145564 - protein, 9 aa, Homo Sapiens
RCPSKKKVQ

SEQ ID NO: 145565 - protein, 9 aa, Homo Sapiens
QEVISIYNS

SEQ ID NO: 145566 - protein, 9 aa, Homo Sapiens
LPLAASASE

SEQ ID NO: 145567 - protein, 9 aa, Homo Sapiens
PPPGPRYCV

SEQ ID NO: 145568 - protein, 9 aa, Homo Sapiens
SCLSVLGGA

SEQ ID NO: 145569 - protein, 9 aa, Homo Sapiens
GTALVAPVP

SEQ ID NO: 145570 - protein, 9 aa, Homo Sapiens
KDYCIFYNP

SEQ ID NO: 145571 - protein, 9 aa, Homo Sapiens
RRLPARLQR

SEQ ID NO: 145572 - protein, 9 aa, Homo Sapiens
RFKWGPTSQ

SEQ ID NO: 145573 - protein, 9 aa, Homo Sapiens
RGPLKHLYS

SEQ ID NO: 145574 - protein, 9 aa, Homo Sapiens
LLCLGPTRP

SEQ ID NO: 145575 - protein, 9 aa, Homo Sapiens
ERGYTLYTS

SEQ ID NO: 145576 - protein, 9 aa, Homo Sapiens
NAPPLTPAA

SEQ ID NO: 145577 - protein, 9 aa, Homo Sapiens
WSCWSTAAC

SEQ ID NO: 145578 - protein, 9 aa, Homo Sapiens
CAFAVSPNH

SEQ ID NO: 145579 - protein, 9 aa, Homo Sapiens
MSQRTQRPQ

SEQ ID NO: 145580 - protein, 9 aa, Homo Sapiens
PTPPSSTLT

SEQ ID NO: 145581 - protein, 9 aa, Homo Sapiens
KKMFMLHLA

SEQ ID NO: 145582 - protein, 9 aa, Homo Sapiens
ANHSTLLSQ

SEQ ID NO: 145583 - protein, 9 aa, Homo Sapiens
IKGREAVSI

SEQ ID NO: 145584 - protein, 9 aa, Homo Sapiens
TSSQYSSGL

SEQ ID NO: 145585 - protein, 9 aa, Homo Sapiens
LPRNEIFFL

SEQ ID NO: 145586 - protein, 9 aa, Homo Sapiens
RHGTGPVGW

SEQ ID NO: 145587 - protein, 9 aa, Homo Sapiens
HPHHLPRPF

SEQ ID NO: 145588 - protein, 9 aa, Homo Sapiens
TQTHTHTGI

SEQ ID NO: 145589 - protein, 9 aa, Homo Sapiens
RKRKGRPLG

SEQ ID NO: 145590 - protein, 9 aa, Homo Sapiens
IKKIARLFL

SEQ ID NO: 145591 - protein, 9 aa, Homo Sapiens
CDKELIKPK

SEQ ID NO: 145592 - protein, 9 aa, Homo Sapiens
LITEFVGWR

SEQ ID NO: 145593 - protein, 9 aa, Homo Sapiens
AWCTTSCDT

SEQ ID NO: 145594 - protein, 9 aa, Homo Sapiens
LGMPRAWCC

SEQ ID NO: 145595 - protein, 9 aa, Homo Sapiens
ANLRRLKMN

SEQ ID NO: 145596 - protein, 9 aa, Homo Sapiens
ASIAEGAVA

SEQ ID NO: 145597 - protein, 9 aa, Homo Sapiens
GEKGYPRIP

SEQ ID NO: 145598 - protein, 9 aa, Homo Sapiens
NVREASFVK

SEQ ID NO: 145599 - protein, 9 aa, Homo Sapiens
SPQSRVFAS

SEQ ID NO: 145600 - protein, 9 aa, Homo Sapiens
THRHTHTHT

SEQ ID NO: 145601 - protein, 9 aa, Homo Sapiens
SLSADIIQR

SEQ ID NO: 145602 - protein, 9 aa, Homo Sapiens
APGLRHFPY

SEQ ID NO: 145603 - protein, 9 aa, Homo Sapiens
PQDLSMKEG

SEQ ID NO: 145604 - protein, 9 aa, Homo Sapiens
AGTVRIFAS

SEQ ID NO: 145605 - protein, 9 aa, Homo Sapiens
SFPYSYHYR

SEQ ID NO: 145606 - protein, 9 aa, Homo Sapiens
LEIPLKGWS

SEQ ID NO: 145607 - protein, 9 aa, Homo Sapiens
PTFPKIKKP

SEQ ID NO: 145608 - protein, 9 aa, Homo Sapiens
ARATSGTAP

SEQ ID NO: 145609 - protein, 9 aa, Homo Sapiens
PWNGTTMMA

SEQ ID NO: 145610 - protein, 9 aa, Homo Sapiens
LPTLPLSPS

SEQ ID NO: 145611 - protein, 9 aa, Homo Sapiens
LPRPFHLHL

SEQ ID NO: 145612 - protein, 9 aa, Homo Sapiens
LRIHFCPVH

SEQ ID NO: 145613 - protein, 9 aa, Homo Sapiens
PPPPRRCCA

SEQ ID NO: 145614 - protein, 9 aa, Homo Sapiens
NDDLNVHSL

SEQ ID NO: 145615 - protein, 9 aa, Homo Sapiens
AQWPTLCLG

SEQ ID NO: 145616 - protein, 9 aa, Homo Sapiens
PPTTIIWTL

SEQ ID NO: 145617 - protein, 9 aa, Homo Sapiens
QKMLLACRA

SEQ ID NO: 145618 - protein, 9 aa, Homo Sapiens
PRSSRRCTV

SEQ ID NO: 145619 - protein, 9 aa, Homo Sapiens
RRWGAWHPG

SEQ ID NO: 145620 - protein, 9 aa, Homo Sapiens
ACCVPAKDS

SEQ ID NO: 145621 - protein, 9 aa, Homo Sapiens
GAPGGGGSP

SEQ ID NO: 145622 - protein, 9 aa, Homo Sapiens
RMAAAAPSR

SEQ ID NO: 145623 - protein, 9 aa, Homo Sapiens
GSPRPSTKC

SEQ ID NO: 145624 - protein, 9 aa, Homo Sapiens
LDAELLGGW

SEQ ID NO: 145625 - protein, 9 aa, Homo Sapiens
CLSKECVLT

SEQ ID NO: 145626 - protein, 9 aa, Homo Sapiens
QNRESTPLP

SEQ ID NO: 145627 - protein, 9 aa, Homo Sapiens
AACWMAWLR

SEQ ID NO: 145628 - protein, 9 aa, Homo Sapiens
RLENLRQKE

SEQ ID NO: 145629 - protein, 9 aa, Homo Sapiens
VETPMSPTL

SEQ ID NO: 145630 - protein, 9 aa, Homo Sapiens
REKRRRTIC

SEQ ID NO: 145631 - protein, 9 aa, Homo Sapiens
QRTEKKCYL

SEQ ID NO: 145632 - protein, 9 aa, Homo Sapiens
NSERVREDA

SEQ ID NO: 145633 - protein, 9 aa, Homo Sapiens
HLMEECLIR

SEQ ID NO: 145634 - protein, 9 aa, Homo Sapiens
EMAEPPQMP

SEQ ID NO: 145635 - protein, 9 aa, Homo Sapiens
VTLTKHAIV

SEQ ID NO: 145636 - protein, 9 aa, Homo Sapiens
CKHRHLRFP

SEQ ID NO: 145637 - protein, 9 aa, Homo Sapiens
KFLKYSVDE

SEQ ID NO: 145638 - protein, 9 aa, Homo Sapiens
KTAMSVETC

SEQ ID NO: 145639 - protein, 9 aa, Homo Sapiens
CKVCPSWLS

SEQ ID NO: 145640 - protein, 9 aa, Homo Sapiens
PPGYSGPSL

SEQ ID NO: 145641 - protein, 9 aa, Homo Sapiens
QKIVLHPGH

SEQ ID NO: 145642 - protein, 9 aa, Homo Sapiens
HTGKNPYMC

SEQ ID NO: 145643 - protein, 9 aa, Homo Sapiens
ATLKFIIIL

SEQ ID NO: 145644 - protein, 9 aa, Homo Sapiens
VEMITALIV

SEQ ID NO: 145645 - protein, 9 aa, Homo Sapiens
AICISHTPI

SEQ ID NO: 145646 - protein, 9 aa, Homo Sapiens
TEEEEELER

SEQ ID NO: 145647 - protein, 9 aa, Homo Sapiens
SAKPPLWPP

SEQ ID NO: 145648 - protein, 9 aa, Homo Sapiens
LRRHRVCPQ

SEQ ID NO: 145649 - protein, 9 aa, Homo Sapiens
ESTPLPADL

SEQ ID NO: 145650 - protein, 9 aa, Homo Sapiens
ARLTGFPPA

SEQ ID NO: 145651 - protein, 9 aa, Homo Sapiens
QQPPVIPLA

SEQ ID NO: 145652 - protein, 9 aa, Homo Sapiens
ALALDVAVQ

SEQ ID NO: 145653 - protein, 9 aa, Homo Sapiens
HSTHSAWRR

SEQ ID NO: 145654 - protein, 9 aa, Homo Sapiens
LPVSVWLQC

SEQ ID NO: 145655 - protein, 9 aa, Homo Sapiens
RMQTVPEGA

SEQ ID NO: 145656 - protein, 9 aa, Homo Sapiens
AGGRRLPAR

SEQ ID NO: 145657 - protein, 9 aa, Homo Sapiens
GEWFLCGGI

SEQ ID NO: 145658 - protein, 9 aa, Homo Sapiens
LLWRNPNGD

SEQ ID NO: 145659 - protein, 9 aa, Homo Sapiens
NLKEPEPLH

SEQ ID NO: 145660 - protein, 9 aa, Homo Sapiens
TSVPGGPRW

SEQ ID NO: 145661 - protein, 9 aa, Homo Sapiens
TLTSWSMAT

SEQ ID NO: 145662 - protein, 9 aa, Homo Sapiens
SQMPSRCSN

SEQ ID NO: 145663 - protein, 9 aa, Homo Sapiens
GHIISWKRT

SEQ ID NO: 145664 - protein, 9 aa, Homo Sapiens
RSPTPTRRP

SEQ ID NO: 145665 - protein, 9 aa, Homo Sapiens
HCMPYFRKA

SEQ ID NO: 145666 - protein, 9 aa, Homo Sapiens
DSKHKLESP

SEQ ID NO: 145667 - protein, 9 aa, Homo Sapiens
KENQQPDGR

SEQ ID NO: 145668 - protein, 9 aa, Homo Sapiens
PRGSRLPPH

SEQ ID NO: 145669 - protein, 9 aa, Homo Sapiens
CYPVCCQTT

SEQ ID NO: 145670 - protein, 9 aa, Homo Sapiens
EKPDPIPDS

SEQ ID NO: 145671 - protein, 9 aa, Homo Sapiens
SKHQAVDNK

SEQ ID NO: 145672 - protein, 9 aa, Homo Sapiens
ATLTSSYNF

SEQ ID NO: 145673 - protein, 9 aa, Homo Sapiens
HLHFDARTV

SEQ ID NO: 145674 - protein, 9 aa, Homo Sapiens
VVWGPLRCS

SEQ ID NO: 145675 - protein, 9 aa, Homo Sapiens
HLLKEKVLK

SEQ ID NO: 145676 - protein, 9 aa, Homo Sapiens
TRKPKGSLM

SEQ ID NO: 145677 - protein, 9 aa, Homo Sapiens
SPPTRSSSR

SEQ ID NO: 145678 - protein, 9 aa, Homo Sapiens
GYLANMGGS

SEQ ID NO: 145679 - protein, 9 aa, Homo Sapiens
KRLQQEFEN

SEQ ID NO: 145680 - protein, 9 aa, Homo Sapiens
GCHKSIISH

SEQ ID NO: 145681 - protein, 9 aa, Homo Sapiens
THRHTGMHR

SEQ ID NO: 145682 - protein, 9 aa, Homo Sapiens
ILPSTCSDI

SEQ ID NO: 145683 - protein, 9 aa, Homo Sapiens
HSLPVKKKR

SEQ ID NO: 145684 - protein, 9 aa, Homo Sapiens
GVAWLESWE

SEQ ID NO: 145685 - protein, 9 aa, Homo Sapiens
RAYRRQVLR

SEQ ID NO: 145686 - protein, 9 aa, Homo Sapiens
PKAPKKTLL

SEQ ID NO: 145687 - protein, 9 aa, Homo Sapiens
SVARPSTTR

SEQ ID NO: 145688 - protein, 9 aa, Homo Sapiens
NMFHKYTRR

SEQ ID NO: 145689 - protein, 9 aa, Homo Sapiens
GILQSVVGY

SEQ ID NO: 145690 - protein, 9 aa, Homo Sapiens
CVSGQCVLI

SEQ ID NO: 145691 - protein, 9 aa, Homo Sapiens
PPTQQPQTP

SEQ ID NO: 145692 - protein, 9 aa, Homo Sapiens
GPAEGVVGP

SEQ ID NO: 145693 - protein, 9 aa, Homo Sapiens
LPPPPRLGY

SEQ ID NO: 145694 - protein, 9 aa, Homo Sapiens
HGFRPSTAR

SEQ ID NO: 145695 - protein, 9 aa, Homo Sapiens
PGTDRQQTV

SEQ ID NO: 145696 - protein, 9 aa, Homo Sapiens
QVCVSCPED

SEQ ID NO: 145697 - protein, 9 aa, Homo Sapiens
VIAKMPMDK

SEQ ID NO: 145698 - protein, 9 aa, Homo Sapiens
YYTGGWHHH

SEQ ID NO: 145699 - protein, 9 aa, Homo Sapiens
LCAAQLARE

SEQ ID NO: 145700 - protein, 9 aa, Homo Sapiens
SVNEQTKFN

SEQ ID NO: 145701 - protein, 9 aa, Homo Sapiens
ARPTPRVRI

SEQ ID NO: 145702 - protein, 9 aa, Homo Sapiens
QAVVDFDPS

SEQ ID NO: 145703 - protein, 9 aa, Homo Sapiens
QETISRFWA

SEQ ID NO: 145704 - protein, 9 aa, Homo Sapiens
PKTAAAEEA

SEQ ID NO: 145705 - protein, 9 aa, Homo Sapiens
KETTCQRQA

SEQ ID NO: 145706 - protein, 9 aa, Homo Sapiens
IMYMTMRNA

SEQ ID NO: 145707 - protein, 9 aa, Homo Sapiens
RAREALVAE

SEQ ID NO: 145708 - protein, 9 aa, Homo Sapiens
TRRSSNKPL

SEQ ID NO: 145709 - protein, 9 aa, Homo Sapiens
CIYPLSMCI

SEQ ID NO: 145710 - protein, 9 aa, Homo Sapiens
PPLLTLRPA

SEQ ID NO: 145711 - protein, 9 aa, Homo Sapiens
PLQPRGPPL

SEQ ID NO: 145712 - protein, 9 aa, Homo Sapiens
VGPLPCVLP

SEQ ID NO: 145713 - protein, 9 aa, Homo Sapiens
TRANGDPLL

SEQ ID NO: 145714 - protein, 9 aa, Homo Sapiens
SQSICLQVL

SEQ ID NO: 145715 - protein, 9 aa, Homo Sapiens
KSQIVMNVR

SEQ ID NO: 145716 - protein, 9 aa, Homo Sapiens
RTWLPRAAT

SEQ ID NO: 145717 - protein, 9 aa, Homo Sapiens
PHSAAHGPP

SEQ ID NO: 145718 - protein, 9 aa, Homo Sapiens
RKRSRTQGS

SEQ ID NO: 145719 - protein, 9 aa, Homo Sapiens
SVLHPVHLP

SEQ ID NO: 145720 - protein, 9 aa, Homo Sapiens
NIQLYLSME

SEQ ID NO: 145721 - protein, 9 aa, Homo Sapiens
NTAVRAYSD

SEQ ID NO: 145722 - protein, 9 aa, Homo Sapiens
TGQRPKTAA

SEQ ID NO: 145723 - protein, 9 aa, Homo Sapiens
VLGGAGTAL

SEQ ID NO: 145724 - protein, 9 aa, Homo Sapiens
CCRPSCCYP

SEQ ID NO: 145725 - protein, 9 aa, Homo Sapiens
MVDVGGRGQ

SEQ ID NO: 145726 - protein, 9 aa, Homo Sapiens
EDGTVLFWD

SEQ ID NO: 145727 - protein, 9 aa, Homo Sapiens
LHHHLMVAD

SEQ ID NO: 145728 - protein, 9 aa, Homo Sapiens
PVACPQRLP

SEQ ID NO: 145729 - protein, 9 aa, Homo Sapiens
GQLGVGILN

SEQ ID NO: 145730 - protein, 9 aa, Homo Sapiens
SQDQFLRAL

SEQ ID NO: 145731 - protein, 9 aa, Homo Sapiens
LRRPCLPLQ

SEQ ID NO: 145732 - protein, 9 aa, Homo Sapiens
KLSVVPQFL

SEQ ID NO: 145733 - protein, 9 aa, Homo Sapiens
SLPDPCRAP

SEQ ID NO: 145734 - protein, 9 aa, Homo Sapiens
CRKGFKYFE

SEQ ID NO: 145735 - protein, 9 aa, Homo Sapiens
MTRCPAPSQ

SEQ ID NO: 145736 - protein, 9 aa, Homo Sapiens
DSTCLSSSS

SEQ ID NO: 145737 - protein, 9 aa, Homo Sapiens
TSKGLLEQF

SEQ ID NO: 145738 - protein, 9 aa, Homo Sapiens
PGQCAGAWG

SEQ ID NO: 145739 - protein, 9 aa, Homo Sapiens
GLDDHLAEA

SEQ ID NO: 145740 - protein, 9 aa, Homo Sapiens
LIHGLFSLP

SEQ ID NO: 145741 - protein, 9 aa, Homo Sapiens
VTDPGVAGD

SEQ ID NO: 145742 - protein, 9 aa, Homo Sapiens
LATNSPGPT

SEQ ID NO: 145743 - protein, 9 aa, Homo Sapiens
QENETWWMC

SEQ ID NO: 145744 - protein, 9 aa, Homo Sapiens
PATTCKVPR

SEQ ID NO: 145745 - protein, 9 aa, Homo Sapiens
IQPSSCHLI

SEQ ID NO: 145746 - protein, 9 aa, Homo Sapiens
LVPMYYRGA

SEQ ID NO: 145747 - protein, 9 aa, Homo Sapiens
RSDSKEGSY

SEQ ID NO: 145748 - protein, 9 aa, Homo Sapiens
WKIIESYED

SEQ ID NO: 145749 - protein, 9 aa, Homo Sapiens
ARLWMANAR

SEQ ID NO: 145750 - protein, 9 aa, Homo Sapiens
GGAYFHTGA

SEQ ID NO: 145751 - protein, 9 aa, Homo Sapiens
TRPVWGPAI

SEQ ID NO: 145752 - protein, 9 aa, Homo Sapiens
RTGASTRAS

SEQ ID NO: 145753 - protein, 9 aa, Homo Sapiens
ASPRAAIWR

SEQ ID NO: 145754 - protein, 9 aa, Homo Sapiens
ECGRAFFIS

SEQ ID NO: 145755 - protein, 9 aa, Homo Sapiens
IPSKGMDDH

SEQ ID NO: 145756 - protein, 9 aa, Homo Sapiens
LLRGLGLQL

SEQ ID NO: 145757 - protein, 9 aa, Homo Sapiens
VLGPLSNHL

SEQ ID NO: 145758 - protein, 9 aa, Homo Sapiens
APPPAFQVH

SEQ ID NO: 145759 - protein, 9 aa, Homo Sapiens
KVGHEGIIP

SEQ ID NO: 145760 - protein, 9 aa, Homo Sapiens
FRQKGSQMS

SEQ ID NO: 145761 - protein, 9 aa, Homo Sapiens
PHPLSLPGA

SEQ ID NO: 145762 - protein, 9 aa, Homo Sapiens
PKLHLAAGL

SEQ ID NO: 145763 - protein, 9 aa, Homo Sapiens
APGGPFHYQ

SEQ ID NO: 145764 - protein, 9 aa, Homo Sapiens
PSSRVFTRD

SEQ ID NO: 145765 - protein, 9 aa, Homo Sapiens
CTAPCSCSS

SEQ ID NO: 145766 - protein, 9 aa, Homo Sapiens
TEVPWPEVW

SEQ ID NO: 145767 - protein, 9 aa, Homo Sapiens
SFPCWGWHG

SEQ ID NO: 145768 - protein, 9 aa, Homo Sapiens
CFLEKMEDF

SEQ ID NO: 145769 - protein, 9 aa, Homo Sapiens
GVSSLEYIT

SEQ ID NO: 145770 - protein, 9 aa, Homo Sapiens
HNPRVEHTL

SEQ ID NO: 145771 - protein, 9 aa, Homo Sapiens
SRSSRRHSH

SEQ ID NO: 145772 - protein, 9 aa, Homo Sapiens
TPMHARHKV

SEQ ID NO: 145773 - protein, 9 aa, Homo Sapiens
FRNSGIMVG

SEQ ID NO: 145774 - protein, 9 aa, Homo Sapiens
LPLGRGGGR

SEQ ID NO: 145775 - protein, 9 aa, Homo Sapiens
SDHTKPRPG

SEQ ID NO: 145776 - protein, 9 aa, Homo Sapiens
TVMSPGEKP

SEQ ID NO: 145777 - protein, 9 aa, Homo Sapiens
KGQIIREMS

SEQ ID NO: 145778 - protein, 9 aa, Homo Sapiens
CCVPAKDST

SEQ ID NO: 145779 - protein, 9 aa, Homo Sapiens
RVFSSSRQH

SEQ ID NO: 145780 - protein, 9 aa, Homo Sapiens
DILCFLTIH

SEQ ID NO: 145781 - protein, 9 aa, Homo Sapiens
NKSECYSNI

SEQ ID NO: 145782 - protein, 9 aa, Homo Sapiens
CDWRRACVQ

SEQ ID NO: 145783 - protein, 9 aa, Homo Sapiens
GADNSVVCF

SEQ ID NO: 145784 - protein, 9 aa, Homo Sapiens
AAERGVPLY

SEQ ID NO: 145785 - protein, 9 aa, Homo Sapiens
LYSPAEEDA

SEQ ID NO: 145786 - protein, 9 aa, Homo Sapiens
PGVCWPLLR

SEQ ID NO: 145787 - protein, 9 aa, Homo Sapiens
GPPGLHGPP

SEQ ID NO: 145788 - protein, 9 aa, Homo Sapiens
ELTKVWCSL

SEQ ID NO: 145789 - protein, 9 aa, Homo Sapiens
TRTPLATNS

SEQ ID NO: 145790 - protein, 9 aa, Homo Sapiens
CECGLDKSC

SEQ ID NO: 145791 - protein, 9 aa, Homo Sapiens
LCLGPTRPL

SEQ ID NO: 145792 - protein, 9 aa, Homo Sapiens
LEDAKKRGT

SEQ ID NO: 145793 - protein, 9 aa, Homo Sapiens
GWRTGLACG

SEQ ID NO: 145794 - protein, 9 aa, Homo Sapiens
NGTRLGVVA

SEQ ID NO: 145795 - protein, 9 aa, Homo Sapiens
DKGNVLQPE

SEQ ID NO: 145796 - protein, 9 aa, Homo Sapiens
PERPAAAPW

SEQ ID NO: 145797 - protein, 9 aa, Homo Sapiens
FAKYTELIA

SEQ ID NO: 145798 - protein, 9 aa, Homo Sapiens
WPKMLVCPQ

SEQ ID NO: 145799 - protein, 9 aa, Homo Sapiens
GGGPGPAQA

SEQ ID NO: 145800 - protein, 9 aa, Homo Sapiens
PAGPLAPPP

SEQ ID NO: 145801 - protein, 9 aa, Homo Sapiens
DYIDRLFQI

SEQ ID NO: 145802 - protein, 9 aa, Homo Sapiens
NIFGGKALT

SEQ ID NO: 145803 - protein, 9 aa, Homo Sapiens
REAVSIYQF

SEQ ID NO: 145804 - protein, 9 aa, Homo Sapiens
DWEPAVERD

SEQ ID NO: 145805 - protein, 9 aa, Homo Sapiens
ICALPDDLV

SEQ ID NO: 145806 - protein, 9 aa, Homo Sapiens
EIPSGMEDV

SEQ ID NO: 145807 - protein, 9 aa, Homo Sapiens
INNSDCITN

SEQ ID NO: 145808 - protein, 9 aa, Homo Sapiens
EGAWVGAHQ

SEQ ID NO: 145809 - protein, 9 aa, Homo Sapiens
DDTATAKEA

SEQ ID NO: 145810 - protein, 9 aa, Homo Sapiens
LHGQKMLPL

SEQ ID NO: 145811 - protein, 9 aa, Homo Sapiens
KNQNQGNPA

SEQ ID NO: 145812 - protein, 9 aa, Homo Sapiens
DLQGHLFSM

SEQ ID NO: 145813 - protein, 9 aa, Homo Sapiens
SPTWCRTGA

SEQ ID NO: 145814 - protein, 9 aa, Homo Sapiens
SEGQLFQSI

SEQ ID NO: 145815 - protein, 9 aa, Homo Sapiens
SHHTPSPGL

SEQ ID NO: 145816 - protein, 9 aa, Homo Sapiens
AGGTSSLLS

SEQ ID NO: 145817 - protein, 9 aa, Homo Sapiens
QKKMFMLHL

SEQ ID NO: 145818 - protein, 9 aa, Homo Sapiens
AWVGAHQGP

SEQ ID NO: 145819 - protein, 9 aa, Homo Sapiens
TRAAPPSLR

SEQ ID NO: 145820 - protein, 9 aa, Homo Sapiens
HHDKDGWPL

SEQ ID NO: 145821 - protein, 9 aa, Homo Sapiens
PQAGARPGA

SEQ ID NO: 145822 - protein, 9 aa, Homo Sapiens
PDSKDEKTK

SEQ ID NO: 145823 - protein, 9 aa, Homo Sapiens
PKKIKANRM

SEQ ID NO: 145824 - protein, 9 aa, Homo Sapiens
FESLDNHMG

SEQ ID NO: 145825 - protein, 9 aa, Homo Sapiens
GARLSRALH

SEQ ID NO: 145826 - protein, 9 aa, Homo Sapiens
PGGDVREPR

SEQ ID NO: 145827 - protein, 9 aa, Homo Sapiens
VERPLIPEG

SEQ ID NO: 145828 - protein, 9 aa, Homo Sapiens
FSLPPDVLR

SEQ ID NO: 145829 - protein, 9 aa, Homo Sapiens
VALLNIRFV

SEQ ID NO: 145830 - protein, 9 aa, Homo Sapiens
VVDVNATAE

SEQ ID NO: 145831 - protein, 9 aa, Homo Sapiens
KAPPPAFQV

SEQ ID NO: 145832 - protein, 9 aa, Homo Sapiens
AAWPCCAPI

SEQ ID NO: 145833 - protein, 9 aa, Homo Sapiens
ELLLEHCIE

SEQ ID NO: 145834 - protein, 9 aa, Homo Sapiens
YCPELPAPR

SEQ ID NO: 145835 - protein, 9 aa, Homo Sapiens
ACCTMQATS

SEQ ID NO: 145836 - protein, 9 aa, Homo Sapiens
FPVMSDAYD

SEQ ID NO: 145837 - protein, 9 aa, Homo Sapiens
PALLKLGVP

SEQ ID NO: 145838 - protein, 9 aa, Homo Sapiens
IIGQNGVLS

SEQ ID NO: 145839 - protein, 9 aa, Homo Sapiens
RGGGGGAPA

SEQ ID NO: 145840 - protein, 9 aa, Homo Sapiens
FERLTSAYR

SEQ ID NO: 145841 - protein, 9 aa, Homo Sapiens
YVQEWSKNK

SEQ ID NO: 145842 - protein, 9 aa, Homo Sapiens
KNLVINKPY

SEQ ID NO: 145843 - protein, 9 aa, Homo Sapiens
AGKVKRQRK

SEQ ID NO: 145844 - protein, 9 aa, Homo Sapiens
LLIFLVPAA

SEQ ID NO: 145845 - protein, 9 aa, Homo Sapiens
RPSQSAAAA

SEQ ID NO: 145846 - protein, 9 aa, Homo Sapiens
CLPNQFRCV

SEQ ID NO: 145847 - protein, 9 aa, Homo Sapiens
GQTLMSPGS

SEQ ID NO: 145848 - protein, 9 aa, Homo Sapiens
GQIIREMSF

SEQ ID NO: 145849 - protein, 9 aa, Homo Sapiens
NTSLAALFM

SEQ ID NO: 145850 - protein, 9 aa, Homo Sapiens
LLPAPSALV

SEQ ID NO: 145851 - protein, 9 aa, Homo Sapiens
QPLLLLLFL

SEQ ID NO: 145852 - protein, 9 aa, Homo Sapiens
ATQSRWCCC

SEQ ID NO: 145853 - protein, 9 aa, Homo Sapiens
AKGYRPTPT

SEQ ID NO: 145854 - protein, 9 aa, Homo Sapiens
GATKTSRIY

SEQ ID NO: 145855 - protein, 9 aa, Homo Sapiens
ERDFEMEYG

SEQ ID NO: 145856 - protein, 9 aa, Homo Sapiens
VQGAAVVHG

SEQ ID NO: 145857 - protein, 9 aa, Homo Sapiens
LRLDMTSYT

SEQ ID NO: 145858 - protein, 9 aa, Homo Sapiens
APSQPPSPG

SEQ ID NO: 145859 - protein, 9 aa, Homo Sapiens
GLQLPDLLF

SEQ ID NO: 145860 - protein, 9 aa, Homo Sapiens
SGPGSTRAA

SEQ ID NO: 145861 - protein, 9 aa, Homo Sapiens
QRATRHGPY

SEQ ID NO: 145862 - protein, 9 aa, Homo Sapiens
EVLTAEYCE

SEQ ID NO: 145863 - protein, 9 aa, Homo Sapiens
RRAGRAAGP

SEQ ID NO: 145864 - protein, 9 aa, Homo Sapiens
TPLQQRPGA

SEQ ID NO: 145865 - protein, 9 aa, Homo Sapiens
CVLPHVDFQ

SEQ ID NO: 145866 - protein, 9 aa, Homo Sapiens
PSTSGICSP

SEQ ID NO: 145867 - protein, 9 aa, Homo Sapiens
TGTEVQMKR

SEQ ID NO: 145868 - protein, 9 aa, Homo Sapiens
VERLQRSDG

SEQ ID NO: 145869 - protein, 9 aa, Homo Sapiens
PTTIIKQVY

SEQ ID NO: 145870 - protein, 9 aa, Homo Sapiens
PLPADLPHS

SEQ ID NO: 145871 - protein, 9 aa, Homo Sapiens
KPQGTAFPE

SEQ ID NO: 145872 - protein, 9 aa, Homo Sapiens
SEITMRDEE

SEQ ID NO: 145873 - protein, 9 aa, Homo Sapiens
TKPVIGKDE

SEQ ID NO: 145874 - protein, 9 aa, Homo Sapiens
LPELPVTPG

SEQ ID NO: 145875 - protein, 9 aa, Homo Sapiens
MPMDKPGLG

SEQ ID NO: 145876 - protein, 9 aa, Homo Sapiens
SKHKLESPA

SEQ ID NO: 145877 - protein, 9 aa, Homo Sapiens
ETLRVENKS

SEQ ID NO: 145878 - protein, 9 aa, Homo Sapiens
HHHDKDGWP

SEQ ID NO: 145879 - protein, 9 aa, Homo Sapiens
TGCLSFPSV

SEQ ID NO: 145880 - protein, 9 aa, Homo Sapiens
HQSTLQPSL

SEQ ID NO: 145881 - protein, 9 aa, Homo Sapiens
ESICCGHGH

SEQ ID NO: 145882 - protein, 9 aa, Homo Sapiens
GGGQWRAQT

SEQ ID NO: 145883 - protein, 9 aa, Homo Sapiens
CARWTVSPR

SEQ ID NO: 145884 - protein, 9 aa, Homo Sapiens
VAKPLDGPQ

SEQ ID NO: 145885 - protein, 9 aa, Homo Sapiens
HLGTLRGDE

SEQ ID NO: 145886 - protein, 9 aa, Homo Sapiens
LLLLVVVPL

SEQ ID NO: 145887 - protein, 9 aa, Homo Sapiens
HHHCFHSHH

SEQ ID NO: 145888 - protein, 9 aa, Homo Sapiens
MKTVPSNFW

SEQ ID NO: 145889 - protein, 9 aa, Homo Sapiens
KKEKHSLSP

SEQ ID NO: 145890 - protein, 9 aa, Homo Sapiens
LTSSLPGGT

SEQ ID NO: 145891 - protein, 9 aa, Homo Sapiens
SGVAWLESW

SEQ ID NO: 145892 - protein, 9 aa, Homo Sapiens
LEVVPLSTP

SEQ ID NO: 145893 - protein, 9 aa, Homo Sapiens
APQVIPVLP

SEQ ID NO: 145894 - protein, 9 aa, Homo Sapiens
CQELQKSGH

SEQ ID NO: 145895 - protein, 9 aa, Homo Sapiens
EFGKKQSTQ

SEQ ID NO: 145896 - protein, 9 aa, Homo Sapiens
PATSRTPSG

SEQ ID NO: 145897 - protein, 9 aa, Homo Sapiens
LGGSDSMWS

SEQ ID NO: 145898 - protein, 9 aa, Homo Sapiens
KKKKKRKRN

SEQ ID NO: 145899 - protein, 9 aa, Homo Sapiens
MDDHLFYIY

SEQ ID NO: 145900 - protein, 9 aa, Homo Sapiens
SRSTCARLW

SEQ ID NO: 145901 - protein, 9 aa, Homo Sapiens
KPICCVPIC

SEQ ID NO: 145902 - protein, 9 aa, Homo Sapiens
LIPEGASWS

SEQ ID NO: 145903 - protein, 9 aa, Homo Sapiens
RTRANGDPL

SEQ ID NO: 145904 - protein, 9 aa, Homo Sapiens
AKTGASSCA

SEQ ID NO: 145905 - protein, 9 aa, Homo Sapiens
RRSWWRVPT

SEQ ID NO: 145906 - protein, 9 aa, Homo Sapiens
QTAVVKKIH

SEQ ID NO: 145907 - protein, 9 aa, Homo Sapiens
GLALCGIVS

SEQ ID NO: 145908 - protein, 9 aa, Homo Sapiens
KEVKMEGAH

SEQ ID NO: 145909 - protein, 9 aa, Homo Sapiens
IFHALMYII

SEQ ID NO: 145910 - protein, 9 aa, Homo Sapiens
IFWIVPAHG

SEQ ID NO: 145911 - protein, 9 aa, Homo Sapiens
RPWPPPSVP

SEQ ID NO: 145912 - protein, 9 aa, Homo Sapiens
STARVILGK

SEQ ID NO: 145913 - protein, 9 aa, Homo Sapiens
QCPALRKTL

SEQ ID NO: 145914 - protein, 9 aa, Homo Sapiens
GGGGGSTGG

SEQ ID NO: 145915 - protein, 9 aa, Homo Sapiens
VSVLHPVHL

SEQ ID NO: 145916 - protein, 9 aa, Homo Sapiens
GACGQSCGL

SEQ ID NO: 145917 - protein, 9 aa, Homo Sapiens
GKKDSIMYR

SEQ ID NO: 145918 - protein, 9 aa, Homo Sapiens
TYSSCRKAT

SEQ ID NO: 145919 - protein, 9 aa, Homo Sapiens
ISYGLPIVP

SEQ ID NO: 145920 - protein, 9 aa, Homo Sapiens
HHFYWQMLF

SEQ ID NO: 145921 - protein, 9 aa, Homo Sapiens
GGKRAAGQR

SEQ ID NO: 145922 - protein, 9 aa, Homo Sapiens
RSPALRARG

SEQ ID NO: 145923 - protein, 9 aa, Homo Sapiens
LKLEQRGRL

SEQ ID NO: 145924 - protein, 9 aa, Homo Sapiens
ATVHQGLTQ

SEQ ID NO: 145925 - protein, 9 aa, Homo Sapiens
GVPSTPHES

SEQ ID NO: 145926 - protein, 9 aa, Homo Sapiens
KRTEFSSDD

SEQ ID NO: 145927 - protein, 9 aa, Homo Sapiens
EGGVATGHI

SEQ ID NO: 145928 - protein, 9 aa, Homo Sapiens
LHLGRTQAA

SEQ ID NO: 145929 - protein, 9 aa, Homo Sapiens
NFWKGALLH

SEQ ID NO: 145930 - protein, 9 aa, Homo Sapiens
CAPATPHVP

SEQ ID NO: 145931 - protein, 9 aa, Homo Sapiens
MHTVGGAAG

SEQ ID NO: 145932 - protein, 9 aa, Homo Sapiens
ALRLQRSME

SEQ ID NO: 145933 - protein, 9 aa, Homo Sapiens
VEEEQQPPP

SEQ ID NO: 145934 - protein, 9 aa, Homo Sapiens
MHNFSRSDH

SEQ ID NO: 145935 - protein, 9 aa, Homo Sapiens
ELNEYLAEM

SEQ ID NO: 145936 - protein, 9 aa, Homo Sapiens
WYINGTRLD

SEQ ID NO: 145937 - protein, 9 aa, Homo Sapiens
AAASGPCHA

SEQ ID NO: 145938 - protein, 9 aa, Homo Sapiens
TRSLVGTWY

SEQ ID NO: 145939 - protein, 9 aa, Homo Sapiens
ILGQEAAGS

SEQ ID NO: 145940 - protein, 9 aa, Homo Sapiens
LIVAIHIPE

SEQ ID NO: 145941 - protein, 9 aa, Homo Sapiens
PECEGSPPS

SEQ ID NO: 145942 - protein, 9 aa, Homo Sapiens
LFIWTPWRK

SEQ ID NO: 145943 - protein, 9 aa, Homo Sapiens
WNDPWLLAT

SEQ ID NO: 145944 - protein, 9 aa, Homo Sapiens
LRKTLPILF

SEQ ID NO: 145945 - protein, 9 aa, Homo Sapiens
LRTLHKPAT

SEQ ID NO: 145946 - protein, 9 aa, Homo Sapiens
KPLRGDPGV

SEQ ID NO: 145947 - protein, 9 aa, Homo Sapiens
SCASGVTTS

SEQ ID NO: 145948 - protein, 9 aa, Homo Sapiens
TSSHLILLW

SEQ ID NO: 145949 - protein, 9 aa, Homo Sapiens
KAFVTCSSH

SEQ ID NO: 145950 - protein, 9 aa, Homo Sapiens
LTSWDGAWF

SEQ ID NO: 145951 - protein, 9 aa, Homo Sapiens
LQRLGDPGR

SEQ ID NO: 145952 - protein, 9 aa, Homo Sapiens
FCTPFCTLS

SEQ ID NO: 145953 - protein, 9 aa, Homo Sapiens
RRSQSICLQ

SEQ ID NO: 145954 - protein, 9 aa, Homo Sapiens
MGLKSWISV

SEQ ID NO: 145955 - protein, 9 aa, Homo Sapiens
ADLEGVNMR

SEQ ID NO: 145956 - protein, 9 aa, Homo Sapiens
DIAELWVVF

SEQ ID NO: 145957 - protein, 9 aa, Homo Sapiens
CGSCARSIS

SEQ ID NO: 145958 - protein, 9 aa, Homo Sapiens
ILKSLMTKN

SEQ ID NO: 145959 - protein, 9 aa, Homo Sapiens
EISGWAMAV

SEQ ID NO: 145960 - protein, 9 aa, Homo Sapiens
NPQRVMSQE

SEQ ID NO: 145961 - protein, 9 aa, Homo Sapiens
CLYCDKLYS

SEQ ID NO: 145962 - protein, 9 aa, Homo Sapiens
RLPTACTIQ

SEQ ID NO: 145963 - protein, 9 aa, Homo Sapiens
QEHSITLQV

SEQ ID NO: 145964 - protein, 9 aa, Homo Sapiens
PMAAFAAQR

SEQ ID NO: 145965 - protein, 9 aa, Homo Sapiens
QADALQEVP

SEQ ID NO: 145966 - protein, 9 aa, Homo Sapiens
VQPVCAVRA

SEQ ID NO: 145967 - protein, 9 aa, Homo Sapiens
DHTNLIQLY

SEQ ID NO: 145968 - protein, 9 aa, Homo Sapiens
RASSVVPRM

SEQ ID NO: 145969 - protein, 9 aa, Homo Sapiens
GMCEGESAS

SEQ ID NO: 145970 - protein, 9 aa, Homo Sapiens
LPTQQLAWP

SEQ ID NO: 145971 - protein, 9 aa, Homo Sapiens
DLGLMTRCP

SEQ ID NO: 145972 - protein, 9 aa, Homo Sapiens
SSVVPRMSS

SEQ ID NO: 145973 - protein, 9 aa, Homo Sapiens
KWKDYLPTV

SEQ ID NO: 145974 - protein, 9 aa, Homo Sapiens
LMSTMRNQV

SEQ ID NO: 145975 - protein, 9 aa, Homo Sapiens
QKEEAEQLR

SEQ ID NO: 145976 - protein, 9 aa, Homo Sapiens
GLAFITYPR

SEQ ID NO: 145977 - protein, 9 aa, Homo Sapiens
RMGRLAAPS

SEQ ID NO: 145978 - protein, 9 aa, Homo Sapiens
GVEAVAIHR

SEQ ID NO: 145979 - protein, 9 aa, Homo Sapiens
LPPGLLVLG

SEQ ID NO: 145980 - protein, 9 aa, Homo Sapiens
FMKQMNDAR

SEQ ID NO: 145981 - protein, 9 aa, Homo Sapiens
VGPHARVDA

SEQ ID NO: 145982 - protein, 9 aa, Homo Sapiens
QVGQVLGPL

SEQ ID NO: 145983 - protein, 9 aa, Homo Sapiens
LGPLSNHLE

SEQ ID NO: 145984 - protein, 9 aa, Homo Sapiens
DEGSHHTPS

SEQ ID NO: 145985 - protein, 9 aa, Homo Sapiens
PLPRGIRCP

SEQ ID NO: 145986 - protein, 9 aa, Homo Sapiens
WINQECQKT

SEQ ID NO: 145987 - protein, 9 aa, Homo Sapiens
EAADEKLTE

SEQ ID NO: 145988 - protein, 9 aa, Homo Sapiens
SGVCFDILG

SEQ ID NO: 145989 - protein, 9 aa, Homo Sapiens
AMAYPAVFG

SEQ ID NO: 145990 - protein, 9 aa, Homo Sapiens
ICFQLRVPV

SEQ ID NO: 145991 - protein, 9 aa, Homo Sapiens
HPCQLDIRL

SEQ ID NO: 145992 - protein, 9 aa, Homo Sapiens
APEDEDGAW

SEQ ID NO: 145993 - protein, 9 aa, Homo Sapiens
WLRHRLRAG

SEQ ID NO: 145994 - protein, 9 aa, Homo Sapiens
SLFIKPNPA

SEQ ID NO: 145995 - protein, 9 aa, Homo Sapiens
GVDFSSLDT

SEQ ID NO: 145996 - protein, 9 aa, Homo Sapiens
VAPRWWKRH

SEQ ID NO: 145997 - protein, 9 aa, Homo Sapiens
TIIKQVYQA

SEQ ID NO: 145998 - protein, 9 aa, Homo Sapiens
STVPLPTTQ

SEQ ID NO: 145999 - protein, 9 aa, Homo Sapiens
TAVDLCGRE

SEQ ID NO: 146000 - protein, 9 aa, Homo Sapiens
TYEFFTSLI

SEQ ID NO: 146001 - protein, 9 aa, Homo Sapiens
VFHFLDTLQ

SEQ ID NO: 146002 - protein, 9 aa, Homo Sapiens
ASPAPGSSV

SEQ ID NO: 146003 - protein, 9 aa, Homo Sapiens
GRTQAADWL

SEQ ID NO: 146004 - protein, 9 aa, Homo Sapiens
LNAWNGFSN

SEQ ID NO: 146005 - protein, 9 aa, Homo Sapiens
ATLTSRSGW

SEQ ID NO: 146006 - protein, 9 aa, Homo Sapiens
RTSARRRTW

SEQ ID NO: 146007 - protein, 9 aa, Homo Sapiens
ALMPAQLFL

SEQ ID NO: 146008 - protein, 9 aa, Homo Sapiens
PAGGRRTAP

SEQ ID NO: 146009 - protein, 9 aa, Homo Sapiens
ISAKSRFKE

SEQ ID NO: 146010 - protein, 9 aa, Homo Sapiens
KFITKEKCR

SEQ ID NO: 146011 - protein, 9 aa, Homo Sapiens
SPALSTCTG

SEQ ID NO: 146012 - protein, 9 aa, Homo Sapiens
EKAQDCQAE

SEQ ID NO: 146013 - protein, 9 aa, Homo Sapiens
KTLEQRIQR

SEQ ID NO: 146014 - protein, 9 aa, Homo Sapiens
ESVYSGCSH

SEQ ID NO: 146015 - protein, 9 aa, Homo Sapiens
LKNCIYPLS

SEQ ID NO: 146016 - protein, 9 aa, Homo Sapiens
PPPPAVSSR

SEQ ID NO: 146017 - protein, 9 aa, Homo Sapiens
GGASLGRAL

SEQ ID NO: 146018 - protein, 9 aa, Homo Sapiens
FELLPTLPL

SEQ ID NO: 146019 - protein, 9 aa, Homo Sapiens
SRTPSGCTA

SEQ ID NO: 146020 - protein, 9 aa, Homo Sapiens
QTWCMENVD

SEQ ID NO: 146021 - protein, 9 aa, Homo Sapiens
TDIAELWVV

SEQ ID NO: 146022 - protein, 9 aa, Homo Sapiens
RPAQKSSKK

SEQ ID NO: 146023 - protein, 9 aa, Homo Sapiens
KKFILERNP

SEQ ID NO: 146024 - protein, 9 aa, Homo Sapiens
GSLMALLSF

SEQ ID NO: 146025 - protein, 9 aa, Homo Sapiens
QKIHTGKNP

SEQ ID NO: 146026 - protein, 9 aa, Homo Sapiens
GVGILNGQL

SEQ ID NO: 146027 - protein, 9 aa, Homo Sapiens
LRCDGWADR

SEQ ID NO: 146028 - protein, 9 aa, Homo Sapiens
ALCLAPFVY

SEQ ID NO: 146029 - protein, 9 aa, Homo Sapiens
KGYVRIMEA

SEQ ID NO: 146030 - protein, 9 aa, Homo Sapiens
CEDHRDRMV

SEQ ID NO: 146031 - protein, 9 aa, Homo Sapiens
IYGHFGPFC

SEQ ID NO: 146032 - protein, 9 aa, Homo Sapiens
LPGEADLAD

SEQ ID NO: 146033 - protein, 9 aa, Homo Sapiens
AHRWAALLH

SEQ ID NO: 146034 - protein, 9 aa, Homo Sapiens
GPAATSSST

SEQ ID NO: 146035 - protein, 9 aa, Homo Sapiens
GEKQQEEDC

SEQ ID NO: 146036 - protein, 9 aa, Homo Sapiens
PRPLHRWLQ

SEQ ID NO: 146037 - protein, 9 aa, Homo Sapiens
LHLQKDVHK

SEQ ID NO: 146038 - protein, 9 aa, Homo Sapiens
AYTTGAETT

SEQ ID NO: 146039 - protein, 9 aa, Homo Sapiens
SDPPSASQS

SEQ ID NO: 146040 - protein, 9 aa, Homo Sapiens
GGRGRLQQK

SEQ ID NO: 146041 - protein, 9 aa, Homo Sapiens
NSSHDTFMV

SEQ ID NO: 146042 - protein, 9 aa, Homo Sapiens
CLKTPPKPW

SEQ ID NO: 146043 - protein, 9 aa, Homo Sapiens
YPEPEEVPQ

SEQ ID NO: 146044 - protein, 9 aa, Homo Sapiens
TGTSGTRDW

SEQ ID NO: 146045 - protein, 9 aa, Homo Sapiens
RRSPALRAR

SEQ ID NO: 146046 - protein, 9 aa, Homo Sapiens
HYCEAAFGG

SEQ ID NO: 146047 - protein, 9 aa, Homo Sapiens
SLEYITHSL

SEQ ID NO: 146048 - protein, 9 aa, Homo Sapiens
AELARKASC

SEQ ID NO: 146049 - protein, 9 aa, Homo Sapiens
LERQTLGVT

SEQ ID NO: 146050 - protein, 9 aa, Homo Sapiens
IDQGGKIRH

SEQ ID NO: 146051 - protein, 9 aa, Homo Sapiens
ATPALPTQQ

SEQ ID NO: 146052 - protein, 9 aa, Homo Sapiens
KAGAAERGV

SEQ ID NO: 146053 - protein, 9 aa, Homo Sapiens
DSLDMCDGD

SEQ ID NO: 146054 - protein, 9 aa, Homo Sapiens
RGHFHEEAT

SEQ ID NO: 146055 - protein, 9 aa, Homo Sapiens
VDDRQGVLG

SEQ ID NO: 146056 - protein, 9 aa, Homo Sapiens
TDPQWHWPK

SEQ ID NO: 146057 - protein, 9 aa, Homo Sapiens
GGLDRIVDK

SEQ ID NO: 146058 - protein, 9 aa, Homo Sapiens
TPPFGLIPR

SEQ ID NO: 146059 - protein, 9 aa, Homo Sapiens
DENKSVCDR

SEQ ID NO: 146060 - protein, 9 aa, Homo Sapiens
SSSRGQVRH

SEQ ID NO: 146061 - protein, 9 aa, Homo Sapiens
ENIMENSTQ

SEQ ID NO: 146062 - protein, 9 aa, Homo Sapiens
NGGSNPHAN

SEQ ID NO: 146063 - protein, 9 aa, Homo Sapiens
ARPGASGVP

SEQ ID NO: 146064 - protein, 9 aa, Homo Sapiens
HSDPDACTI

SEQ ID NO: 146065 - protein, 9 aa, Homo Sapiens
SAGRRSAPR

SEQ ID NO: 146066 - protein, 9 aa, Homo Sapiens
MAVHDLMRS

SEQ ID NO: 146067 - protein, 9 aa, Homo Sapiens
VLTPDDVQI

SEQ ID NO: 146068 - protein, 9 aa, Homo Sapiens
VALHSPFLQ

SEQ ID NO: 146069 - protein, 9 aa, Homo Sapiens
RSSRRHSHS

SEQ ID NO: 146070 - protein, 9 aa, Homo Sapiens
HCLSKASSP

SEQ ID NO: 146071 - protein, 9 aa, Homo Sapiens
VVGPKVALK

SEQ ID NO: 146072 - protein, 9 aa, Homo Sapiens
KKAPRRPLT

SEQ ID NO: 146073 - protein, 9 aa, Homo Sapiens
PLLGVVPGP

SEQ ID NO: 146074 - protein, 9 aa, Homo Sapiens
DGSAVPYVP

SEQ ID NO: 146075 - protein, 9 aa, Homo Sapiens
SFWLRMVSF

SEQ ID NO: 146076 - protein, 9 aa, Homo Sapiens
CVFREQFKE

SEQ ID NO: 146077 - protein, 9 aa, Homo Sapiens
PLSVVLLGW

SEQ ID NO: 146078 - protein, 9 aa, Homo Sapiens
QRLLEHPCP

SEQ ID NO: 146079 - protein, 9 aa, Homo Sapiens
HRLYNGHTL

SEQ ID NO: 146080 - protein, 9 aa, Homo Sapiens
SVKSAVTHS

SEQ ID NO: 146081 - protein, 9 aa, Homo Sapiens
LITKPVIGK

SEQ ID NO: 146082 - protein, 9 aa, Homo Sapiens
SCQISIFHA

SEQ ID NO: 146083 - protein, 9 aa, Homo Sapiens
EGRMATLER

SEQ ID NO: 146084 - protein, 9 aa, Homo Sapiens
VKNVAKPLD

SEQ ID NO: 146085 - protein, 9 aa, Homo Sapiens
LSPCVDNCG

SEQ ID NO: 146086 - protein, 9 aa, Homo Sapiens
ASPAGPLAP

SEQ ID NO: 146087 - protein, 9 aa, Homo Sapiens
LIATGGVPS

SEQ ID NO: 146088 - protein, 9 aa, Homo Sapiens
KASSRQLAG

SEQ ID NO: 146089 - protein, 9 aa, Homo Sapiens
WSSSISGEI

SEQ ID NO: 146090 - protein, 9 aa, Homo Sapiens
CVGMDWTGA

SEQ ID NO: 146091 - protein, 9 aa, Homo Sapiens
HMKIHCKSL

SEQ ID NO: 146092 - protein, 9 aa, Homo Sapiens
EKKFTKLAK

SEQ ID NO: 146093 - protein, 9 aa, Homo Sapiens
PEINPSAPA

SEQ ID NO: 146094 - protein, 9 aa, Homo Sapiens
SSPQLQPMP

SEQ ID NO: 146095 - protein, 9 aa, Homo Sapiens
EGIYKAHIH

SEQ ID NO: 146096 - protein, 9 aa, Homo Sapiens
SSFVPTQYN

SEQ ID NO: 146097 - protein, 9 aa, Homo Sapiens
GPRLGPAGR

SEQ ID NO: 146098 - protein, 9 aa, Homo Sapiens
HRPMQQVAP

SEQ ID NO: 146099 - protein, 9 aa, Homo Sapiens
PKKSNELLQ

SEQ ID NO: 146100 - protein, 9 aa, Homo Sapiens
LLILLIFLV

SEQ ID NO: 146101 - protein, 9 aa, Homo Sapiens
RQKEEAEQL

SEQ ID NO: 146102 - protein, 9 aa, Homo Sapiens
LYHKTKSFL

SEQ ID NO: 146103 - protein, 9 aa, Homo Sapiens
AVGNILVLC

SEQ ID NO: 146104 - protein, 9 aa, Homo Sapiens
PSPQSPGMR

SEQ ID NO: 146105 - protein, 9 aa, Homo Sapiens
LLTVLVVVA

SEQ ID NO: 146106 - protein, 9 aa, Homo Sapiens
KRMSYHAVA

SEQ ID NO: 146107 - protein, 9 aa, Homo Sapiens
ARHGGWTTK

SEQ ID NO: 146108 - protein, 9 aa, Homo Sapiens
FPAVMLCNL

SEQ ID NO: 146109 - protein, 9 aa, Homo Sapiens
AVEQAGGSC

SEQ ID NO: 146110 - protein, 9 aa, Homo Sapiens
RRLHQAAFQ

SEQ ID NO: 146111 - protein, 9 aa, Homo Sapiens
STHRPASAW

SEQ ID NO: 146112 - protein, 9 aa, Homo Sapiens
QEKYVLWRG

SEQ ID NO: 146113 - protein, 9 aa, Homo Sapiens
LRCPSKKKV

SEQ ID NO: 146114 - protein, 9 aa, Homo Sapiens
CAPLLHRRA

SEQ ID NO: 146115 - protein, 9 aa, Homo Sapiens
EKWKDQNIK

SEQ ID NO: 146116 - protein, 9 aa, Homo Sapiens
RSLRLLVWL

SEQ ID NO: 146117 - protein, 9 aa, Homo Sapiens
CPTLEAARS

SEQ ID NO: 146118 - protein, 9 aa, Homo Sapiens
QAKGYRPTP

SEQ ID NO: 146119 - protein, 9 aa, Homo Sapiens
VRDRSPMVF

SEQ ID NO: 146120 - protein, 9 aa, Homo Sapiens
GNSGLDNSA

SEQ ID NO: 146121 - protein, 9 aa, Homo Sapiens
LSSSASVCC

SEQ ID NO: 146122 - protein, 9 aa, Homo Sapiens
QGRLLIRHA

SEQ ID NO: 146123 - protein, 9 aa, Homo Sapiens
PLTPAATRA

SEQ ID NO: 146124 - protein, 9 aa, Homo Sapiens
PMSLHTVAL

SEQ ID NO: 146125 - protein, 9 aa, Homo Sapiens
KNVHRQPVQ

SEQ ID NO: 146126 - protein, 9 aa, Homo Sapiens
QLKSYLLQI

SEQ ID NO: 146127 - protein, 9 aa, Homo Sapiens
PCSPAHHLC

SEQ ID NO: 146128 - protein, 9 aa, Homo Sapiens
SSGLRPCLP

SEQ ID NO: 146129 - protein, 9 aa, Homo Sapiens
VCFLPREEG

SEQ ID NO: 146130 - protein, 9 aa, Homo Sapiens
WPQGGGCVQ

SEQ ID NO: 146131 - protein, 9 aa, Homo Sapiens
RTLHRKLTE

SEQ ID NO: 146132 - protein, 9 aa, Homo Sapiens
GSSHACVQK

SEQ ID NO: 146133 - protein, 9 aa, Homo Sapiens
SLLSLWTCL

SEQ ID NO: 146134 - protein, 9 aa, Homo Sapiens
LRLWSWCGT

SEQ ID NO: 146135 - protein, 9 aa, Homo Sapiens
PSLTSGLPH

SEQ ID NO: 146136 - protein, 9 aa, Homo Sapiens
APLIQKKQL

SEQ ID NO: 146137 - protein, 9 aa, Homo Sapiens
EKQALAACD

SEQ ID NO: 146138 - protein, 9 aa, Homo Sapiens
AERGVPLYR

SEQ ID NO: 146139 - protein, 9 aa, Homo Sapiens
DKDGWPLCM

SEQ ID NO: 146140 - protein, 9 aa, Homo Sapiens
MEEEESEAL

SEQ ID NO: 146141 - protein, 9 aa, Homo Sapiens
LMEECLIRQ

SEQ ID NO: 146142 - protein, 9 aa, Homo Sapiens
LLGWQAGAS

SEQ ID NO: 146143 - protein, 9 aa, Homo Sapiens
LLGVRAAST

SEQ ID NO: 146144 - protein, 9 aa, Homo Sapiens
GVPHPPPPV

SEQ ID NO: 146145 - protein, 9 aa, Homo Sapiens
APGSHLCVE

SEQ ID NO: 146146 - protein, 9 aa, Homo Sapiens
QDQFLRALS

SEQ ID NO: 146147 - protein, 9 aa, Homo Sapiens
PTATAACPM

SEQ ID NO: 146148 - protein, 9 aa, Homo Sapiens
RICTRYTPK

SEQ ID NO: 146149 - protein, 9 aa, Homo Sapiens
PQGVLSPPP

SEQ ID NO: 146150 - protein, 9 aa, Homo Sapiens
SYVPPTGAC

SEQ ID NO: 146151 - protein, 9 aa, Homo Sapiens
EMDLIKRYQ

SEQ ID NO: 146152 - protein, 9 aa, Homo Sapiens
ARSAAAASP

SEQ ID NO: 146153 - protein, 9 aa, Homo Sapiens
KVARKHSGT

SEQ ID NO: 146154 - protein, 9 aa, Homo Sapiens
QAYVMMLSL

SEQ ID NO: 146155 - protein, 9 aa, Homo Sapiens
LVGPMGVGL

SEQ ID NO: 146156 - protein, 9 aa, Homo Sapiens
KTGAPLSAG

SEQ ID NO: 146157 - protein, 9 aa, Homo Sapiens
PSTSWSASA

SEQ ID NO: 146158 - protein, 9 aa, Homo Sapiens
KTSLPQGCW

SEQ ID NO: 146159 - protein, 9 aa, Homo Sapiens
APPEDDTAT

SEQ ID NO: 146160 - protein, 9 aa, Homo Sapiens
SKTVIFFKV

SEQ ID NO: 146161 - protein, 9 aa, Homo Sapiens
TQAFLLVNQ

SEQ ID NO: 146162 - protein, 9 aa, Homo Sapiens
DHKTNENKQ

SEQ ID NO: 146163 - protein, 9 aa, Homo Sapiens
KFLLWLLRG

SEQ ID NO: 146164 - protein, 9 aa, Homo Sapiens
YKCCITCRL

SEQ ID NO: 146165 - protein, 9 aa, Homo Sapiens
GPAVRTRST

SEQ ID NO: 146166 - protein, 9 aa, Homo Sapiens
FLKTAMSVE

SEQ ID NO: 146167 - protein, 9 aa, Homo Sapiens
KVLAGIVMT

SEQ ID NO: 146168 - protein, 9 aa, Homo Sapiens
LPARLQRLG

SEQ ID NO: 146169 - protein, 9 aa, Homo Sapiens
APSFPYSYH

SEQ ID NO: 146170 - protein, 9 aa, Homo Sapiens
WEDEEKMKV

SEQ ID NO: 146171 - protein, 9 aa, Homo Sapiens
ISQKGRIYS

SEQ ID NO: 146172 - protein, 9 aa, Homo Sapiens
CWMAWLRHR

SEQ ID NO: 146173 - protein, 9 aa, Homo Sapiens
QQEEALKQC

SEQ ID NO: 146174 - protein, 9 aa, Homo Sapiens
KQLEDGSSL

SEQ ID NO: 146175 - protein, 9 aa, Homo Sapiens
PYRAFLRTP

SEQ ID NO: 146176 - protein, 9 aa, Homo Sapiens
PPGLHGPPG

SEQ ID NO: 146177 - protein, 9 aa, Homo Sapiens
LLIFWIVPA

SEQ ID NO: 146178 - protein, 9 aa, Homo Sapiens
VTKRCAQTA

SEQ ID NO: 146179 - protein, 9 aa, Homo Sapiens
RSGWPRTPS

SEQ ID NO: 146180 - protein, 9 aa, Homo Sapiens
RFDADVRQW

SEQ ID NO: 146181 - protein, 9 aa, Homo Sapiens
VLRPHSYVP

SEQ ID NO: 146182 - protein, 9 aa, Homo Sapiens
ALQQLPVGG

SEQ ID NO: 146183 - protein, 9 aa, Homo Sapiens
TLDLDLVTD

SEQ ID NO: 146184 - protein, 9 aa, Homo Sapiens
SQKETTCQR

SEQ ID NO: 146185 - protein, 9 aa, Homo Sapiens
IKVGQNEER

SEQ ID NO: 146186 - protein, 9 aa, Homo Sapiens
AIDLDKYEV

SEQ ID NO: 146187 - protein, 9 aa, Homo Sapiens
CRTRRRWSS

SEQ ID NO: 146188 - protein, 9 aa, Homo Sapiens
TSAMAWAII

SEQ ID NO: 146189 - protein, 9 aa, Homo Sapiens
QLFQSIWND

SEQ ID NO: 146190 - protein, 9 aa, Homo Sapiens
EHCLFTSIC

SEQ ID NO: 146191 - protein, 9 aa, Homo Sapiens
GLVCTTTPN

SEQ ID NO: 146192 - protein, 9 aa, Homo Sapiens
CFHSHHPHH

SEQ ID NO: 146193 - protein, 9 aa, Homo Sapiens
LRRKEPDRP

SEQ ID NO: 146194 - protein, 9 aa, Homo Sapiens
RNARLMKVT

SEQ ID NO: 146195 - protein, 9 aa, Homo Sapiens
LCTNSAKIV

SEQ ID NO: 146196 - protein, 9 aa, Homo Sapiens
RTHSLSRNP

SEQ ID NO: 146197 - protein, 9 aa, Homo Sapiens
LAWNNTCNI

SEQ ID NO: 146198 - protein, 9 aa, Homo Sapiens
RIDEPGLWS

SEQ ID NO: 146199 - protein, 9 aa, Homo Sapiens
QALDKISAE

SEQ ID NO: 146200 - protein, 9 aa, Homo Sapiens
PLVEKKRCA

SEQ ID NO: 146201 - protein, 9 aa, Homo Sapiens
PAPGLHPGC

SEQ ID NO: 146202 - protein, 9 aa, Homo Sapiens
IFIQVFETF

SEQ ID NO: 146203 - protein, 9 aa, Homo Sapiens
WQPSVGCAD

SEQ ID NO: 146204 - protein, 9 aa, Homo Sapiens
GGADPGPWQ

SEQ ID NO: 146205 - protein, 9 aa, Homo Sapiens
LPLPPVPFL

SEQ ID NO: 146206 - protein, 9 aa, Homo Sapiens
LRAGQTEGE

SEQ ID NO: 146207 - protein, 9 aa, Homo Sapiens
HKTKSFLLL

SEQ ID NO: 146208 - protein, 9 aa, Homo Sapiens
GEEAEGLAT

SEQ ID NO: 146209 - protein, 9 aa, Homo Sapiens
QVLRYHPDK

SEQ ID NO: 146210 - protein, 9 aa, Homo Sapiens
SDSEEGDDQ

SEQ ID NO: 146211 - protein, 9 aa, Homo Sapiens
SSPPGAVPS

SEQ ID NO: 146212 - protein, 9 aa, Homo Sapiens
ARHGEEVVV

SEQ ID NO: 146213 - protein, 9 aa, Homo Sapiens
IYMCFMQEH

SEQ ID NO: 146214 - protein, 9 aa, Homo Sapiens
DLGGQAVVD

SEQ ID NO: 146215 - protein, 9 aa, Homo Sapiens
TQHRKSIFF

SEQ ID NO: 146216 - protein, 9 aa, Homo Sapiens
KVPESWFSR

SEQ ID NO: 146217 - protein, 9 aa, Homo Sapiens
IGEKFYRKN

SEQ ID NO: 146218 - protein, 9 aa, Homo Sapiens
DCDGEVEEE

SEQ ID NO: 146219 - protein, 9 aa, Homo Sapiens
HTGHLWLGT

SEQ ID NO: 146220 - protein, 9 aa, Homo Sapiens
IRELRTRSR

SEQ ID NO: 146221 - protein, 9 aa, Homo Sapiens
AAKNVFPPS

SEQ ID NO: 146222 - protein, 9 aa, Homo Sapiens
GKGERWPGG

SEQ ID NO: 146223 - protein, 9 aa, Homo Sapiens
ANPKHLEEV

SEQ ID NO: 146224 - protein, 9 aa, Homo Sapiens
QLGVGILNG

SEQ ID NO: 146225 - protein, 9 aa, Homo Sapiens
CVEVNGKDQ

SEQ ID NO: 146226 - protein, 9 aa, Homo Sapiens
DDSVLLIPR

SEQ ID NO: 146227 - protein, 9 aa, Homo Sapiens
EWRQGGSPV

SEQ ID NO: 146228 - protein, 9 aa, Homo Sapiens
GDLDVQGQL

SEQ ID NO: 146229 - protein, 9 aa, Homo Sapiens
PTWRRTGAS

SEQ ID NO: 146230 - protein, 9 aa, Homo Sapiens
SAPEPVVGI

SEQ ID NO: 146231 - protein, 9 aa, Homo Sapiens
QYRPGLGCF

SEQ ID NO: 146232 - protein, 9 aa, Homo Sapiens
FLPEPGCLR

SEQ ID NO: 146233 - protein, 9 aa, Homo Sapiens
FLTAITLNR

SEQ ID NO: 146234 - protein, 9 aa, Homo Sapiens
KFVFRMAGK

SEQ ID NO: 146235 - protein, 9 aa, Homo Sapiens
NRMSNSKKS

SEQ ID NO: 146236 - protein, 9 aa, Homo Sapiens
AGNELLLQS

SEQ ID NO: 146237 - protein, 9 aa, Homo Sapiens
PNNVLQEKY

SEQ ID NO: 146238 - protein, 9 aa, Homo Sapiens
VDFQIEKKI

SEQ ID NO: 146239 - protein, 9 aa, Homo Sapiens
IARLFLGWT

SEQ ID NO: 146240 - protein, 9 aa, Homo Sapiens
LEQRGRLLV

SEQ ID NO: 146241 - protein, 9 aa, Homo Sapiens
LERKRKGRP

SEQ ID NO: 146242 - protein, 9 aa, Homo Sapiens
GTEVQMKRV

SEQ ID NO: 146243 - protein, 9 aa, Homo Sapiens
MPYFRKAQG

SEQ ID NO: 146244 - protein, 9 aa, Homo Sapiens
NAPRDSRLG

SEQ ID NO: 146245 - protein, 9 aa, Homo Sapiens
GRVTEADSR

SEQ ID NO: 146246 - protein, 9 aa, Homo Sapiens
KSPREYYMQ

SEQ ID NO: 146247 - protein, 9 aa, Homo Sapiens
DCYHEWNTE

SEQ ID NO: 146248 - protein, 9 aa, Homo Sapiens
LALKHQLRH

SEQ ID NO: 146249 - protein, 9 aa, Homo Sapiens
LVPTGVPVC

SEQ ID NO: 146250 - protein, 9 aa, Homo Sapiens
GIHIVGPQW

SEQ ID NO: 146251 - protein, 9 aa, Homo Sapiens
FSRPHPALW

SEQ ID NO: 146252 - protein, 9 aa, Homo Sapiens
SLSSFLIFF

SEQ ID NO: 146253 - protein, 9 aa, Homo Sapiens
SRPCHSLPR

SEQ ID NO: 146254 - protein, 9 aa, Homo Sapiens
MMVFLADEY

SEQ ID NO: 146255 - protein, 9 aa, Homo Sapiens
REVRLMKNG

SEQ ID NO: 146256 - protein, 9 aa, Homo Sapiens
VMVLGGASL

SEQ ID NO: 146257 - protein, 9 aa, Homo Sapiens
LQTPLGLVP

SEQ ID NO: 146258 - protein, 9 aa, Homo Sapiens
GGSGSAGSG

SEQ ID NO: 146259 - protein, 9 aa, Homo Sapiens
PPTPSTCLG

SEQ ID NO: 146260 - protein, 9 aa, Homo Sapiens
SKFMSCVSP

SEQ ID NO: 146261 - protein, 9 aa, Homo Sapiens
AASCASGVT

SEQ ID NO: 146262 - protein, 9 aa, Homo Sapiens
SPSTSGICS

SEQ ID NO: 146263 - protein, 9 aa, Homo Sapiens
HPSAFNNLK

SEQ ID NO: 146264 - protein, 9 aa, Homo Sapiens
QNMSLEMWC

SEQ ID NO: 146265 - protein, 9 aa, Homo Sapiens
LRKCCLIDE

SEQ ID NO: 146266 - protein, 9 aa, Homo Sapiens
GFGPFQMRN

SEQ ID NO: 146267 - protein, 9 aa, Homo Sapiens
FLQEVWMIP

SEQ ID NO: 146268 - protein, 9 aa, Homo Sapiens
LDQRFQDTD

SEQ ID NO: 146269 - protein, 9 aa, Homo Sapiens
GSCRRGAAF

SEQ ID NO: 146270 - protein, 9 aa, Homo Sapiens
VRLMLKEDS

SEQ ID NO: 146271 - protein, 9 aa, Homo Sapiens
SGETTHIHT

SEQ ID NO: 146272 - protein, 9 aa, Homo Sapiens
DRSPQAPLR

SEQ ID NO: 146273 - protein, 9 aa, Homo Sapiens
QWHGLANSI

SEQ ID NO: 146274 - protein, 9 aa, Homo Sapiens
ADDHWHMVL

SEQ ID NO: 146275 - protein, 9 aa, Homo Sapiens
RLWPQGGGC

SEQ ID NO: 146276 - protein, 9 aa, Homo Sapiens
GPRPGLSAP

SEQ ID NO: 146277 - protein, 9 aa, Homo Sapiens
SLQQDEDIL

SEQ ID NO: 146278 - protein, 9 aa, Homo Sapiens
TRCPSLTGS

SEQ ID NO: 146279 - protein, 9 aa, Homo Sapiens
ELEHCLFTS

SEQ ID NO: 146280 - protein, 9 aa, Homo Sapiens
STRAAPPSL

SEQ ID NO: 146281 - protein, 9 aa, Homo Sapiens
SKTLLRNHF

SEQ ID NO: 146282 - protein, 9 aa, Homo Sapiens
AGGPSGVAW

SEQ ID NO: 146283 - protein, 9 aa, Homo Sapiens
LSTCTGSGR

SEQ ID NO: 146284 - protein, 9 aa, Homo Sapiens
QFGQVAEDV

SEQ ID NO: 146285 - protein, 9 aa, Homo Sapiens
SADIIQRTT

SEQ ID NO: 146286 - protein, 9 aa, Homo Sapiens
PISRNSRNS

SEQ ID NO: 146287 - protein, 9 aa, Homo Sapiens
VLSCLYSVC

SEQ ID NO: 146288 - protein, 9 aa, Homo Sapiens
YRLSAQSEG

SEQ ID NO: 146289 - protein, 9 aa, Homo Sapiens
ATDIAELWV

SEQ ID NO: 146290 - protein, 9 aa, Homo Sapiens
PPPPPTFLP

SEQ ID NO: 146291 - protein, 9 aa, Homo Sapiens
SPSLCSVTL

SEQ ID NO: 146292 - protein, 9 aa, Homo Sapiens
DMDLTPAAP

SEQ ID NO: 146293 - protein, 9 aa, Homo Sapiens
RRYQKKRQP

SEQ ID NO: 146294 - protein, 9 aa, Homo Sapiens
PITNSKLSA

SEQ ID NO: 146295 - protein, 9 aa, Homo Sapiens
PPWHGLMAA

SEQ ID NO: 146296 - protein, 9 aa, Homo Sapiens
LGFFTGIEA

SEQ ID NO: 146297 - protein, 9 aa, Homo Sapiens
IGVAVDILG

SEQ ID NO: 146298 - protein, 9 aa, Homo Sapiens
NAKKKCHSS

SEQ ID NO: 146299 - protein, 9 aa, Homo Sapiens
HTGASPVWA

SEQ ID NO: 146300 - protein, 9 aa, Homo Sapiens
HLKSQGPRL

SEQ ID NO: 146301 - protein, 9 aa, Homo Sapiens
FLGLKPTIE

SEQ ID NO: 146302 - protein, 9 aa, Homo Sapiens
TLQCGYPSL

SEQ ID NO: 146303 - protein, 9 aa, Homo Sapiens
KRGKSQGGR

SEQ ID NO: 146304 - protein, 9 aa, Homo Sapiens
SITSPNTAF

SEQ ID NO: 146305 - protein, 9 aa, Homo Sapiens
PPRPRPHPL

SEQ ID NO: 146306 - protein, 9 aa, Homo Sapiens
PRPALLKLG

SEQ ID NO: 146307 - protein, 9 aa, Homo Sapiens
WKNYKKVHH

SEQ ID NO: 146308 - protein, 9 aa, Homo Sapiens
PQPWLQQLP

SEQ ID NO: 146309 - protein, 9 aa, Homo Sapiens
SPGRAPHPE

SEQ ID NO: 146310 - protein, 9 aa, Homo Sapiens
EEFLKTAMS

SEQ ID NO: 146311 - protein, 9 aa, Homo Sapiens
RQLSVRALA

SEQ ID NO: 146312 - protein, 9 aa, Homo Sapiens
RRWASRAQT

SEQ ID NO: 146313 - protein, 9 aa, Homo Sapiens
STPSSNFLT

SEQ ID NO: 146314 - protein, 9 aa, Homo Sapiens
VKLYFTKNS

SEQ ID NO: 146315 - protein, 9 aa, Homo Sapiens
FSKSPSTSG

SEQ ID NO: 146316 - protein, 9 aa, Homo Sapiens
QCWVLNFKA

SEQ ID NO: 146317 - protein, 9 aa, Homo Sapiens
RACTPASGP

SEQ ID NO: 146318 - protein, 9 aa, Homo Sapiens
SLRLWDSHI

SEQ ID NO: 146319 - protein, 9 aa, Homo Sapiens
YIRELRTRS

SEQ ID NO: 146320 - protein, 9 aa, Homo Sapiens
LGVTLKSPS

SEQ ID NO: 146321 - protein, 9 aa, Homo Sapiens
SKIMISEFG

SEQ ID NO: 146322 - protein, 9 aa, Homo Sapiens
GDEDQRRGL

SEQ ID NO: 146323 - protein, 9 aa, Homo Sapiens
SHLCNNPTP

SEQ ID NO: 146324 - protein, 9 aa, Homo Sapiens
GFSNLVRLM

SEQ ID NO: 146325 - protein, 9 aa, Homo Sapiens
CAEEARKKD

SEQ ID NO: 146326 - protein, 9 aa, Homo Sapiens
VCFDILGGS

SEQ ID NO: 146327 - protein, 9 aa, Homo Sapiens
LREKVPCLC

SEQ ID NO: 146328 - protein, 9 aa, Homo Sapiens
AGTQNCEVY

SEQ ID NO: 146329 - protein, 9 aa, Homo Sapiens
PLADDVTLT

SEQ ID NO: 146330 - protein, 9 aa, Homo Sapiens
VISFIDEAR

SEQ ID NO: 146331 - protein, 9 aa, Homo Sapiens
DEKACIEAL

SEQ ID NO: 146332 - protein, 9 aa, Homo Sapiens
RFGRHTAGA

SEQ ID NO: 146333 - protein, 9 aa, Homo Sapiens
AKSGSTASR

SEQ ID NO: 146334 - protein, 9 aa, Homo Sapiens
PPPPTFLPL

SEQ ID NO: 146335 - protein, 9 aa, Homo Sapiens
GPGVPSPSS

SEQ ID NO: 146336 - protein, 9 aa, Homo Sapiens
VLGTQAKEL

SEQ ID NO: 146337 - protein, 9 aa, Homo Sapiens
PEKIDGFRA

SEQ ID NO: 146338 - protein, 9 aa, Homo Sapiens
NYLSFLKGQ

SEQ ID NO: 146339 - protein, 9 aa, Homo Sapiens
ITGQFSHHN

SEQ ID NO: 146340 - protein, 9 aa, Homo Sapiens
VPDLYACGE

SEQ ID NO: 146341 - protein, 9 aa, Homo Sapiens
DPGDSEAPM

SEQ ID NO: 146342 - protein, 9 aa, Homo Sapiens
EKLMTRFPQ

SEQ ID NO: 146343 - protein, 9 aa, Homo Sapiens
AQAVMLRMP

SEQ ID NO: 146344 - protein, 9 aa, Homo Sapiens
CCLRTSCGA

SEQ ID NO: 146345 - protein, 9 aa, Homo Sapiens
NSILCRGGH

SEQ ID NO: 146346 - protein, 9 aa, Homo Sapiens
VCWPLLRGQ

SEQ ID NO: 146347 - protein, 9 aa, Homo Sapiens
VRSCTRRPV

SEQ ID NO: 146348 - protein, 9 aa, Homo Sapiens
RWWKRHTPR

SEQ ID NO: 146349 - protein, 9 aa, Homo Sapiens
EAGLIFLQP

SEQ ID NO: 146350 - protein, 9 aa, Homo Sapiens
LAPLIQKKQ

SEQ ID NO: 146351 - protein, 9 aa, Homo Sapiens
RKNVREASF

SEQ ID NO: 146352 - protein, 9 aa, Homo Sapiens
KSRPVLKKT

SEQ ID NO: 146353 - protein, 9 aa, Homo Sapiens
THTGIHTDT

SEQ ID NO: 146354 - protein, 9 aa, Homo Sapiens
SPTHSAQSP

SEQ ID NO: 146355 - protein, 9 aa, Homo Sapiens
QRHTAYISE

SEQ ID NO: 146356 - protein, 9 aa, Homo Sapiens
LKEDSVSSI

SEQ ID NO: 146357 - protein, 9 aa, Homo Sapiens
MLLACRAPS

SEQ ID NO: 146358 - protein, 9 aa, Homo Sapiens
PGTTREPLT

SEQ ID NO: 146359 - protein, 9 aa, Homo Sapiens
RLHGWLQET

SEQ ID NO: 146360 - protein, 9 aa, Homo Sapiens
VRAGDENDN

SEQ ID NO: 146361 - protein, 9 aa, Homo Sapiens
DLPHSSGLA

SEQ ID NO: 146362 - protein, 9 aa, Homo Sapiens
VDAQVGPLP

SEQ ID NO: 146363 - protein, 9 aa, Homo Sapiens
SRMVSFWLR

SEQ ID NO: 146364 - protein, 9 aa, Homo Sapiens
STLGSSPST

SEQ ID NO: 146365 - protein, 9 aa, Homo Sapiens
PDYTSLPVL

SEQ ID NO: 146366 - protein, 9 aa, Homo Sapiens
PSLPAGGRR

SEQ ID NO: 146367 - protein, 9 aa, Homo Sapiens
SLTSSLPGG

SEQ ID NO: 146368 - protein, 9 aa, Homo Sapiens
VKTPDKKSI

SEQ ID NO: 146369 - protein, 9 aa, Homo Sapiens
YGMSLNVWA

SEQ ID NO: 146370 - protein, 9 aa, Homo Sapiens
DVHQLLVLT

SEQ ID NO: 146371 - protein, 9 aa, Homo Sapiens
GPCHAAALA

SEQ ID NO: 146372 - protein, 9 aa, Homo Sapiens
SPSPPARCA

SEQ ID NO: 146373 - protein, 9 aa, Homo Sapiens
FLQSKLSSG

SEQ ID NO: 146374 - protein, 9 aa, Homo Sapiens
LCGCFLLWN

SEQ ID NO: 146375 - protein, 9 aa, Homo Sapiens
LEKQMALFF

SEQ ID NO: 146376 - protein, 9 aa, Homo Sapiens
DLEQCKEAV

SEQ ID NO: 146377 - protein, 9 aa, Homo Sapiens
RPYTVRAGD

SEQ ID NO: 146378 - protein, 9 aa, Homo Sapiens
LLTDGTTKT

SEQ ID NO: 146379 - protein, 9 aa, Homo Sapiens
CSSTSTTSA

SEQ ID NO: 146380 - protein, 9 aa, Homo Sapiens
FGSASLDSQ

SEQ ID NO: 146381 - protein, 9 aa, Homo Sapiens
ENLRQKEEA

SEQ ID NO: 146382 - protein, 9 aa, Homo Sapiens
KKINSRCGS

SEQ ID NO: 146383 - protein, 9 aa, Homo Sapiens
TLNPQGVLS

SEQ ID NO: 146384 - protein, 9 aa, Homo Sapiens
VQGQLDVHQ

SEQ ID NO: 146385 - protein, 9 aa, Homo Sapiens
MRSGCVRSF

SEQ ID NO: 146386 - protein, 9 aa, Homo Sapiens
KKWVHSLPV

SEQ ID NO: 146387 - protein, 9 aa, Homo Sapiens
LTQLPRHVL

SEQ ID NO: 146388 - protein, 9 aa, Homo Sapiens
FPVTPIIES

SEQ ID NO: 146389 - protein, 9 aa, Homo Sapiens
STPRGRTSG

SEQ ID NO: 146390 - protein, 9 aa, Homo Sapiens
RRYSSTFPT

SEQ ID NO: 146391 - protein, 9 aa, Homo Sapiens
EEEIMSYVH

SEQ ID NO: 146392 - protein, 9 aa, Homo Sapiens
GPAQASAAV

SEQ ID NO: 146393 - protein, 9 aa, Homo Sapiens
CAQTAVVLV

SEQ ID NO: 146394 - protein, 9 aa, Homo Sapiens
RKRKPSAKP

SEQ ID NO: 146395 - protein, 9 aa, Homo Sapiens
KDTRWHQEC

SEQ ID NO: 146396 - protein, 9 aa, Homo Sapiens
FETQEDIAV

SEQ ID NO: 146397 - protein, 9 aa, Homo Sapiens
TTVASITTA

SEQ ID NO: 146398 - protein, 9 aa, Homo Sapiens
EAEQELELE

SEQ ID NO: 146399 - protein, 9 aa, Homo Sapiens
AVILDANDA

SEQ ID NO: 146400 - protein, 9 aa, Homo Sapiens
GDANHSTLL

SEQ ID NO: 146401 - protein, 9 aa, Homo Sapiens
PPSTAATTA

SEQ ID NO: 146402 - protein, 9 aa, Homo Sapiens
WTCLGLAWF

SEQ ID NO: 146403 - protein, 9 aa, Homo Sapiens
KKRKHRSST

SEQ ID NO: 146404 - protein, 9 aa, Homo Sapiens
EDECTLDLD

SEQ ID NO: 146405 - protein, 9 aa, Homo Sapiens
AQGSVMISS

SEQ ID NO: 146406 - protein, 9 aa, Homo Sapiens
FGVYVGTAI

SEQ ID NO: 146407 - protein, 9 aa, Homo Sapiens
RRHRGALSP

SEQ ID NO: 146408 - protein, 9 aa, Homo Sapiens
ADVPVHLRD

SEQ ID NO: 146409 - protein, 9 aa, Homo Sapiens
SSVWSSAAT

SEQ ID NO: 146410 - protein, 9 aa, Homo Sapiens
YPDVPPEKL

SEQ ID NO: 146411 - protein, 9 aa, Homo Sapiens
TLLRHCALA

SEQ ID NO: 146412 - protein, 9 aa, Homo Sapiens
LNTDHHPCQ

SEQ ID NO: 146413 - protein, 9 aa, Homo Sapiens
LSKECVLTV

SEQ ID NO: 146414 - protein, 9 aa, Homo Sapiens
IVGGVSTSW

SEQ ID NO: 146415 - protein, 9 aa, Homo Sapiens
GICRLKELI

SEQ ID NO: 146416 - protein, 9 aa, Homo Sapiens
PQGQPAILL

SEQ ID NO: 146417 - protein, 9 aa, Homo Sapiens
SLTGSSPRC

SEQ ID NO: 146418 - protein, 9 aa, Homo Sapiens
AERTVVKLE

SEQ ID NO: 146419 - protein, 9 aa, Homo Sapiens
LMTRFPQCN

SEQ ID NO: 146420 - protein, 9 aa, Homo Sapiens
EQAGGSCRL

SEQ ID NO: 146421 - protein, 9 aa, Homo Sapiens
KKKRRLISA

SEQ ID NO: 146422 - protein, 9 aa, Homo Sapiens
TPPQESTRV

SEQ ID NO: 146423 - protein, 9 aa, Homo Sapiens
WVASPPTRS

SEQ ID NO: 146424 - protein, 9 aa, Homo Sapiens
RTQAADWLL

SEQ ID NO: 146425 - protein, 9 aa, Homo Sapiens
RVGLFPPPL

SEQ ID NO: 146426 - protein, 9 aa, Homo Sapiens
SGTRDWLRG

SEQ ID NO: 146427 - protein, 9 aa, Homo Sapiens
RTTTCKGST

SEQ ID NO: 146428 - protein, 9 aa, Homo Sapiens
FGKKQSTQK

SEQ ID NO: 146429 - protein, 9 aa, Homo Sapiens
CTCTVWTTS

SEQ ID NO: 146430 - protein, 9 aa, Homo Sapiens
QRYRLSAQS

SEQ ID NO: 146431 - protein, 9 aa, Homo Sapiens
SRGGGGGAP

SEQ ID NO: 146432 - protein, 9 aa, Homo Sapiens
QPPSPGKPT

SEQ ID NO: 146433 - protein, 9 aa, Homo Sapiens
PLHTAGGGG

SEQ ID NO: 146434 - protein, 9 aa, Homo Sapiens
TWLPRAATQ

SEQ ID NO: 146435 - protein, 9 aa, Homo Sapiens
RHISNTDNI

SEQ ID NO: 146436 - protein, 9 aa, Homo Sapiens
QGGRPSPCL

SEQ ID NO: 146437 - protein, 9 aa, Homo Sapiens
KQLPPIVPV

SEQ ID NO: 146438 - protein, 9 aa, Homo Sapiens
QDSSPEDCG

SEQ ID NO: 146439 - protein, 9 aa, Homo Sapiens
PHVTTAQWP

SEQ ID NO: 146440 - protein, 9 aa, Homo Sapiens
VGDDGEAGL

SEQ ID NO: 146441 - protein, 9 aa, Homo Sapiens
SNKKLTGHF

SEQ ID NO: 146442 - protein, 9 aa, Homo Sapiens
PRRCCAARC

SEQ ID NO: 146443 - protein, 9 aa, Homo Sapiens
GSGGGGGHG

SEQ ID NO: 146444 - protein, 9 aa, Homo Sapiens
PQASRAPAS

SEQ ID NO: 146445 - protein, 9 aa, Homo Sapiens
PVPHEIPMS

SEQ ID NO: 146446 - protein, 9 aa, Homo Sapiens
PAPAPPLQP

SEQ ID NO: 146447 - protein, 9 aa, Homo Sapiens
RSSPSLCSV

SEQ ID NO: 146448 - protein, 9 aa, Homo Sapiens
EEFMEGDEH

SEQ ID NO: 146449 - protein, 9 aa, Homo Sapiens
DPCRAPPPA

SEQ ID NO: 146450 - protein, 9 aa, Homo Sapiens
SAPPAATDA

SEQ ID NO: 146451 - protein, 9 aa, Homo Sapiens
CELELVSRA

SEQ ID NO: 146452 - protein, 9 aa, Homo Sapiens
LGLMTRCPA

SEQ ID NO: 146453 - protein, 9 aa, Homo Sapiens
EVIRFLTVI

SEQ ID NO: 146454 - protein, 9 aa, Homo Sapiens
QTTGCSQRR

SEQ ID NO: 146455 - protein, 9 aa, Homo Sapiens
PPPAASTPA

SEQ ID NO: 146456 - protein, 9 aa, Homo Sapiens
KRCDKSDHT

SEQ ID NO: 146457 - protein, 9 aa, Homo Sapiens
ALGAGASAP

SEQ ID NO: 146458 - protein, 9 aa, Homo Sapiens
QFKENWYNT

SEQ ID NO: 146459 - protein, 9 aa, Homo Sapiens
GAHLGLPGR

SEQ ID NO: 146460 - protein, 9 aa, Homo Sapiens
PKRLGRLLI

SEQ ID NO: 146461 - protein, 9 aa, Homo Sapiens
LFEYHQSTL

SEQ ID NO: 146462 - protein, 9 aa, Homo Sapiens
SRFKEQKQN

SEQ ID NO: 146463 - protein, 9 aa, Homo Sapiens
LRSSRSAPS

SEQ ID NO: 146464 - protein, 9 aa, Homo Sapiens
RALCLAPFV

SEQ ID NO: 146465 - protein, 9 aa, Homo Sapiens
QSLRLDASH

SEQ ID NO: 146466 - protein, 9 aa, Homo Sapiens
FRGRLPRHP

SEQ ID NO: 146467 - protein, 9 aa, Homo Sapiens
VTPFQTLQL

SEQ ID NO: 146468 - protein, 9 aa, Homo Sapiens
LAPQHLIRV

SEQ ID NO: 146469 - protein, 9 aa, Homo Sapiens
TSAASGSCA

SEQ ID NO: 146470 - protein, 9 aa, Homo Sapiens
ELLVALLNI

SEQ ID NO: 146471 - protein, 9 aa, Homo Sapiens
VPWPEVWKE

SEQ ID NO: 146472 - protein, 9 aa, Homo Sapiens
RYCVGSVLR

SEQ ID NO: 146473 - protein, 9 aa, Homo Sapiens
TRLRRRMER

SEQ ID NO: 146474 - protein, 9 aa, Homo Sapiens
ELRRLYCSR

SEQ ID NO: 146475 - protein, 9 aa, Homo Sapiens
AGSGSFVRS

SEQ ID NO: 146476 - protein, 9 aa, Homo Sapiens
YQESLGLSW

SEQ ID NO: 146477 - protein, 9 aa, Homo Sapiens
SSKENQQPD

SEQ ID NO: 146478 - protein, 9 aa, Homo Sapiens
LGVVALYAC

SEQ ID NO: 146479 - protein, 9 aa, Homo Sapiens
SKKKVQGHP

SEQ ID NO: 146480 - protein, 9 aa, Homo Sapiens
LQASDTAAP

SEQ ID NO: 146481 - protein, 9 aa, Homo Sapiens
ALCKRGRRT

SEQ ID NO: 146482 - protein, 9 aa, Homo Sapiens
GSGDEAEPL

SEQ ID NO: 146483 - protein, 9 aa, Homo Sapiens
EKHQRERES

SEQ ID NO: 146484 - protein, 9 aa, Homo Sapiens
LHCLSKASS

SEQ ID NO: 146485 - protein, 9 aa, Homo Sapiens
PECGRAFFI

SEQ ID NO: 146486 - protein, 9 aa, Homo Sapiens
VAKKALCIR

SEQ ID NO: 146487 - protein, 9 aa, Homo Sapiens
LIIMGRWTA

SEQ ID NO: 146488 - protein, 9 aa, Homo Sapiens
SPTCVEAAS

SEQ ID NO: 146489 - protein, 9 aa, Homo Sapiens
WLRALSGGD

SEQ ID NO: 146490 - protein, 9 aa, Homo Sapiens
IFGSVHPVS

SEQ ID NO: 146491 - protein, 9 aa, Homo Sapiens
HALMYIIAQ

SEQ ID NO: 146492 - protein, 9 aa, Homo Sapiens
LLRPKGFTR

SEQ ID NO: 146493 - protein, 9 aa, Homo Sapiens
KFCFRYVQE

SEQ ID NO: 146494 - protein, 9 aa, Homo Sapiens
SDTAAPARF

SEQ ID NO: 146495 - protein, 9 aa, Homo Sapiens
QLRPQASRA

SEQ ID NO: 146496 - protein, 9 aa, Homo Sapiens
KKSRYEWNL

SEQ ID NO: 146497 - protein, 9 aa, Homo Sapiens
PTAAKPSAR

SEQ ID NO: 146498 - protein, 9 aa, Homo Sapiens
PPAVSCDSF

SEQ ID NO: 146499 - protein, 9 aa, Homo Sapiens
EPIFGKKHR

SEQ ID NO: 146500 - protein, 9 aa, Homo Sapiens
RTQLREWCT

SEQ ID NO: 146501 - protein, 9 aa, Homo Sapiens
MKSKEEEIA

SEQ ID NO: 146502 - protein, 9 aa, Homo Sapiens
GVPSMETHH

SEQ ID NO: 146503 - protein, 9 aa, Homo Sapiens
NEYLAEMGC

SEQ ID NO: 146504 - protein, 9 aa, Homo Sapiens
RQDVKQQQV

SEQ ID NO: 146505 - protein, 9 aa, Homo Sapiens
GPLASTDLG

SEQ ID NO: 146506 - protein, 9 aa, Homo Sapiens
VFREQFKEN

SEQ ID NO: 146507 - protein, 9 aa, Homo Sapiens
RPRPQSERA

SEQ ID NO: 146508 - protein, 9 aa, Homo Sapiens
GPQKNQKGQ

SEQ ID NO: 146509 - protein, 9 aa, Homo Sapiens
DLPVPQGQK

SEQ ID NO: 146510 - protein, 9 aa, Homo Sapiens
AVTGQRPKT

SEQ ID NO: 146511 - protein, 9 aa, Homo Sapiens
MSHCAQSKT

SEQ ID NO: 146512 - protein, 9 aa, Homo Sapiens
SGDHRRSWL

SEQ ID NO: 146513 - protein, 9 aa, Homo Sapiens
SSLSDSIHT

SEQ ID NO: 146514 - protein, 9 aa, Homo Sapiens
ACRAPSLRT

SEQ ID NO: 146515 - protein, 9 aa, Homo Sapiens
VATPALPTQ

SEQ ID NO: 146516 - protein, 9 aa, Homo Sapiens
CEAAFGGGL

SEQ ID NO: 146517 - protein, 9 aa, Homo Sapiens
SPCLSWSSR

SEQ ID NO: 146518 - protein, 9 aa, Homo Sapiens
KKNGIKGRG

SEQ ID NO: 146519 - protein, 9 aa, Homo Sapiens
WAALLHYEN

SEQ ID NO: 146520 - protein, 9 aa, Homo Sapiens
LDRNKMKDT

SEQ ID NO: 146521 - protein, 9 aa, Homo Sapiens
IAAGGLRMN

SEQ ID NO: 146522 - protein, 9 aa, Homo Sapiens
SCTWPLLRP

SEQ ID NO: 146523 - protein, 9 aa, Homo Sapiens
LLGFEFGFV

SEQ ID NO: 146524 - protein, 9 aa, Homo Sapiens
LFKLHNRNA

SEQ ID NO: 146525 - protein, 9 aa, Homo Sapiens
LMVALNSCT

SEQ ID NO: 146526 - protein, 9 aa, Homo Sapiens
VFGQTPGQE

SEQ ID NO: 146527 - protein, 9 aa, Homo Sapiens
STNVDKLAK

SEQ ID NO: 146528 - protein, 9 aa, Homo Sapiens
AAVTGQRPK

SEQ ID NO: 146529 - protein, 9 aa, Homo Sapiens
RCKKVASNV

SEQ ID NO: 146530 - protein, 9 aa, Homo Sapiens
EQGGRGRLQ

SEQ ID NO: 146531 - protein, 9 aa, Homo Sapiens
RTLFPSLYE

SEQ ID NO: 146532 - protein, 9 aa, Homo Sapiens
PPLDIGEGR

SEQ ID NO: 146533 - protein, 9 aa, Homo Sapiens
NLLLNQVKQ

SEQ ID NO: 146534 - protein, 9 aa, Homo Sapiens
ERLQRSDGQ

SEQ ID NO: 146535 - protein, 9 aa, Homo Sapiens
CRTTYCHPS

SEQ ID NO: 146536 - protein, 9 aa, Homo Sapiens
HPRSPTPTR

SEQ ID NO: 146537 - protein, 9 aa, Homo Sapiens
SSAKIISNN

SEQ ID NO: 146538 - protein, 9 aa, Homo Sapiens
PVPQHPPTG

SEQ ID NO: 146539 - protein, 9 aa, Homo Sapiens
PLATNSPGP

SEQ ID NO: 146540 - protein, 9 aa, Homo Sapiens
RTPSPCTQG

SEQ ID NO: 146541 - protein, 9 aa, Homo Sapiens
VVHRRAAAP

SEQ ID NO: 146542 - protein, 9 aa, Homo Sapiens
ILLQRNLLR

SEQ ID NO: 146543 - protein, 9 aa, Homo Sapiens
GTASAGRRS

SEQ ID NO: 146544 - protein, 9 aa, Homo Sapiens
LTVCKPGPI

SEQ ID NO: 146545 - protein, 9 aa, Homo Sapiens
MQSLMQAHL

SEQ ID NO: 146546 - protein, 9 aa, Homo Sapiens
HIISWKRTS

SEQ ID NO: 146547 - protein, 9 aa, Homo Sapiens
SFDRYMVIC

SEQ ID NO: 146548 - protein, 9 aa, Homo Sapiens
AAWSRRPSL

SEQ ID NO: 146549 - protein, 9 aa, Homo Sapiens
NSRGAVKSR

SEQ ID NO: 146550 - protein, 9 aa, Homo Sapiens
GAQAFVDDP

SEQ ID NO: 146551 - protein, 9 aa, Homo Sapiens
MVQLRPQAS

SEQ ID NO: 146552 - protein, 9 aa, Homo Sapiens
PPAKHSSSQ

SEQ ID NO: 146553 - protein, 9 aa, Homo Sapiens
PEEVCEHVK

SEQ ID NO: 146554 - protein, 9 aa, Homo Sapiens
PPPAVSSRR

SEQ ID NO: 146555 - protein, 9 aa, Homo Sapiens
TPTPVPPAL

SEQ ID NO: 146556 - protein, 9 aa, Homo Sapiens
RLGAGAGAV

SEQ ID NO: 146557 - protein, 9 aa, Homo Sapiens
NGNTVLSIT

SEQ ID NO: 146558 - protein, 9 aa, Homo Sapiens
TMRLESNNT

SEQ ID NO: 146559 - protein, 9 aa, Homo Sapiens
LHKPATLSQ

SEQ ID NO: 146560 - protein, 9 aa, Homo Sapiens
RTAVDLCGR

SEQ ID NO: 146561 - protein, 9 aa, Homo Sapiens
SAKSGWVTT

SEQ ID NO: 146562 - protein, 9 aa, Homo Sapiens
GLGVLGTQA

SEQ ID NO: 146563 - protein, 9 aa, Homo Sapiens
SEAPMEEEE

SEQ ID NO: 146564 - protein, 9 aa, Homo Sapiens
GLCSLPWAR

SEQ ID NO: 146565 - protein, 9 aa, Homo Sapiens
IQVFETFSE

SEQ ID NO: 146566 - protein, 9 aa, Homo Sapiens
PRAATQSRW

SEQ ID NO: 146567 - protein, 9 aa, Homo Sapiens
MKHLNIVAF

SEQ ID NO: 146568 - protein, 9 aa, Homo Sapiens
GNILVLCLD

SEQ ID NO: 146569 - protein, 9 aa, Homo Sapiens
LAQAQPNPR

SEQ ID NO: 146570 - protein, 9 aa, Homo Sapiens
GGSGWSGRS

SEQ ID NO: 146571 - protein, 9 aa, Homo Sapiens
TNTYAAGGM

SEQ ID NO: 146572 - protein, 9 aa, Homo Sapiens
RDFEMEYGK

SEQ ID NO: 146573 - protein, 9 aa, Homo Sapiens
SSPSTPPTT

SEQ ID NO: 146574 - protein, 9 aa, Homo Sapiens
YLMFPLLKF

SEQ ID NO: 146575 - protein, 9 aa, Homo Sapiens
PPAHVHVES

SEQ ID NO: 146576 - protein, 9 aa, Homo Sapiens
PSPSLGQTF

SEQ ID NO: 146577 - protein, 9 aa, Homo Sapiens
YMPLHLLGC

SEQ ID NO: 146578 - protein, 9 aa, Homo Sapiens
PSAPDDQGP

SEQ ID NO: 146579 - protein, 9 aa, Homo Sapiens
VPPLPLAAS

SEQ ID NO: 146580 - protein, 9 aa, Homo Sapiens
SLCAPQVIP

SEQ ID NO: 146581 - protein, 9 aa, Homo Sapiens
DPDEVHLDE

SEQ ID NO: 146582 - protein, 9 aa, Homo Sapiens
SGATKTSRI

SEQ ID NO: 146583 - protein, 9 aa, Homo Sapiens
DHILESLER

SEQ ID NO: 146584 - protein, 9 aa, Homo Sapiens
LLIGLFSLV

SEQ ID NO: 146585 - protein, 9 aa, Homo Sapiens
KSPSCLMDS

SEQ ID NO: 146586 - protein, 9 aa, Homo Sapiens
AEPYTCRAL

SEQ ID NO: 146587 - protein, 9 aa, Homo Sapiens
TGGTMAEER

SEQ ID NO: 146588 - protein, 9 aa, Homo Sapiens
TIKFVLRDA

SEQ ID NO: 146589 - protein, 9 aa, Homo Sapiens
GNKVLYEAY

SEQ ID NO: 146590 - protein, 9 aa, Homo Sapiens
GLPPAQPPL

SEQ ID NO: 146591 - protein, 9 aa, Homo Sapiens
AASGSCAWM

SEQ ID NO: 146592 - protein, 9 aa, Homo Sapiens
GSSLSDYNI

SEQ ID NO: 146593 - protein, 9 aa, Homo Sapiens
AATQSRWCC

SEQ ID NO: 146594 - protein, 9 aa, Homo Sapiens
IRLNPLRLP

SEQ ID NO: 146595 - protein, 9 aa, Homo Sapiens
ACLEEERER

SEQ ID NO: 146596 - protein, 9 aa, Homo Sapiens
GATERSCRP

SEQ ID NO: 146597 - protein, 9 aa, Homo Sapiens
TLELSPLLL

SEQ ID NO: 146598 - protein, 9 aa, Homo Sapiens
QVAEDVFTM

SEQ ID NO: 146599 - protein, 9 aa, Homo Sapiens
AFSACGSHL

SEQ ID NO: 146600 - protein, 9 aa, Homo Sapiens
IHIPELLID

SEQ ID NO: 146601 - protein, 9 aa, Homo Sapiens
DGWPLCMLR

SEQ ID NO: 146602 - protein, 9 aa, Homo Sapiens
VRIDYMLYK

SEQ ID NO: 146603 - protein, 9 aa, Homo Sapiens
KCKDISQVL

SEQ ID NO: 146604 - protein, 9 aa, Homo Sapiens
GVIKQKVLR

SEQ ID NO: 146605 - protein, 9 aa, Homo Sapiens
AVATRTWLW

SEQ ID NO: 146606 - protein, 9 aa, Homo Sapiens
RPLHRWLQQ

SEQ ID NO: 146607 - protein, 9 aa, Homo Sapiens
ASSPSATNS

SEQ ID NO: 146608 - protein, 9 aa, Homo Sapiens
VAARPGCEF

SEQ ID NO: 146609 - protein, 9 aa, Homo Sapiens
PWRPFSWED

SEQ ID NO: 146610 - protein, 9 aa, Homo Sapiens
DAAPPSTPP

SEQ ID NO: 146611 - protein, 9 aa, Homo Sapiens
LYPSLYNGH

SEQ ID NO: 146612 - protein, 9 aa, Homo Sapiens
AGAQAVAEA

SEQ ID NO: 146613 - protein, 9 aa, Homo Sapiens
EKACIEALG

SEQ ID NO: 146614 - protein, 9 aa, Homo Sapiens
IPRRQWAQP

SEQ ID NO: 146615 - protein, 9 aa, Homo Sapiens
STVDAYNPE

SEQ ID NO: 146616 - protein, 9 aa, Homo Sapiens
APATLPCRR

SEQ ID NO: 146617 - protein, 9 aa, Homo Sapiens
PMSMEFQEV

SEQ ID NO: 146618 - protein, 9 aa, Homo Sapiens
TSAGLLHPL

SEQ ID NO: 146619 - protein, 9 aa, Homo Sapiens
QFLRALSNY

SEQ ID NO: 146620 - protein, 9 aa, Homo Sapiens
TPTAGPGEE

SEQ ID NO: 146621 - protein, 9 aa, Homo Sapiens
VQVTVPVDG

SEQ ID NO: 146622 - protein, 9 aa, Homo Sapiens
LIQENDRVV

SEQ ID NO: 146623 - protein, 9 aa, Homo Sapiens
CLSLLSLWT

SEQ ID NO: 146624 - protein, 9 aa, Homo Sapiens
FPGAKGDRG

SEQ ID NO: 146625 - protein, 9 aa, Homo Sapiens
FRQRELCAA

SEQ ID NO: 146626 - protein, 9 aa, Homo Sapiens
PGRAAPRTS

SEQ ID NO: 146627 - protein, 9 aa, Homo Sapiens
SLHSQTPPL

SEQ ID NO: 146628 - protein, 9 aa, Homo Sapiens
LELVSRAVV

SEQ ID NO: 146629 - protein, 9 aa, Homo Sapiens
GPRPLHRWL

SEQ ID NO: 146630 - protein, 9 aa, Homo Sapiens
EVGRPAQKS

SEQ ID NO: 146631 - protein, 9 aa, Homo Sapiens
SGPTPVPTA

SEQ ID NO: 146632 - protein, 9 aa, Homo Sapiens
ITKPVIGKD

SEQ ID NO: 146633 - protein, 9 aa, Homo Sapiens
SAKLDHQVS

SEQ ID NO: 146634 - protein, 9 aa, Homo Sapiens
WLGPASVAP

SEQ ID NO: 146635 - protein, 9 aa, Homo Sapiens
GPWLVVPIL

SEQ ID NO: 146636 - protein, 9 aa, Homo Sapiens
PHGGQLRLS

SEQ ID NO: 146637 - protein, 9 aa, Homo Sapiens
MGRLAAPSL

SEQ ID NO: 146638 - protein, 9 aa, Homo Sapiens
VGGFVYRDC

SEQ ID NO: 146639 - protein, 9 aa, Homo Sapiens
QKDTRWHQE

SEQ ID NO: 146640 - protein, 9 aa, Homo Sapiens
GRCFLEKME

SEQ ID NO: 146641 - protein, 9 aa, Homo Sapiens
TIHIKTFSE

SEQ ID NO: 146642 - protein, 9 aa, Homo Sapiens
PIKLIQQFL

SEQ ID NO: 146643 - protein, 9 aa, Homo Sapiens
SQLINHQET

SEQ ID NO: 146644 - protein, 9 aa, Homo Sapiens
VSFWLRMVS

SEQ ID NO: 146645 - protein, 9 aa, Homo Sapiens
VYIVFYSAK

SEQ ID NO: 146646 - protein, 9 aa, Homo Sapiens
SQLGRLDAV

SEQ ID NO: 146647 - protein, 9 aa, Homo Sapiens
PGAPSYMRK

SEQ ID NO: 146648 - protein, 9 aa, Homo Sapiens
VYQAQTTVQ

SEQ ID NO: 146649 - protein, 9 aa, Homo Sapiens
HWTPPSITP

SEQ ID NO: 146650 - protein, 9 aa, Homo Sapiens
MHQLLMDRG

SEQ ID NO: 146651 - protein, 9 aa, Homo Sapiens
AAQRVPPGE

SEQ ID NO: 146652 - protein, 9 aa, Homo Sapiens
NGGLQGSPL

SEQ ID NO: 146653 - protein, 9 aa, Homo Sapiens
SGGGCARTW

SEQ ID NO: 146654 - protein, 9 aa, Homo Sapiens
IAFYVGIKS

SEQ ID NO: 146655 - protein, 9 aa, Homo Sapiens
VCLQLKSGT

SEQ ID NO: 146656 - protein, 9 aa, Homo Sapiens
LGFEFGFVA

SEQ ID NO: 146657 - protein, 9 aa, Homo Sapiens
DTHTGIHTD

SEQ ID NO: 146658 - protein, 9 aa, Homo Sapiens
RDCVFRSCF

SEQ ID NO: 146659 - protein, 9 aa, Homo Sapiens
QLFTTHFLE

SEQ ID NO: 146660 - protein, 9 aa, Homo Sapiens
VRLMKNGEA

SEQ ID NO: 146661 - protein, 9 aa, Homo Sapiens
TQDETRDSF

SEQ ID NO: 146662 - protein, 9 aa, Homo Sapiens
GSPGCVLVL

SEQ ID NO: 146663 - protein, 9 aa, Homo Sapiens
GPSGVAWLE

SEQ ID NO: 146664 - protein, 9 aa, Homo Sapiens
LSPDSAGSR

SEQ ID NO: 146665 - protein, 9 aa, Homo Sapiens
SRFSRRVLS

SEQ ID NO: 146666 - protein, 9 aa, Homo Sapiens
LYDIMGVPP

SEQ ID NO: 146667 - protein, 9 aa, Homo Sapiens
PSLQQLLEL

SEQ ID NO: 146668 - protein, 9 aa, Homo Sapiens
CVRFACHSA

SEQ ID NO: 146669 - protein, 9 aa, Homo Sapiens
KSRFKEQKQ

SEQ ID NO: 146670 - protein, 9 aa, Homo Sapiens
VVVLRLDGS

SEQ ID NO: 146671 - protein, 9 aa, Homo Sapiens
CAESACDPR

SEQ ID NO: 146672 - protein, 9 aa, Homo Sapiens
PVGGDLDVQ

SEQ ID NO: 146673 - protein, 9 aa, Homo Sapiens
LTAQLPPQT

SEQ ID NO: 146674 - protein, 9 aa, Homo Sapiens
SSPGGGEGM

SEQ ID NO: 146675 - protein, 9 aa, Homo Sapiens
GQQRVLINL

SEQ ID NO: 146676 - protein, 9 aa, Homo Sapiens
HISKGVHRV

SEQ ID NO: 146677 - protein, 9 aa, Homo Sapiens
YTLAVSFPH

SEQ ID NO: 146678 - protein, 9 aa, Homo Sapiens
HTEAVRCVE

SEQ ID NO: 146679 - protein, 9 aa, Homo Sapiens
HHPCQLDIR

SEQ ID NO: 146680 - protein, 9 aa, Homo Sapiens
LVDDRQGVL

SEQ ID NO: 146681 - protein, 9 aa, Homo Sapiens
LHPPHLVPK

SEQ ID NO: 146682 - protein, 9 aa, Homo Sapiens
LRTWGGPRD

SEQ ID NO: 146683 - protein, 9 aa, Homo Sapiens
RHGEEVVVS

SEQ ID NO: 146684 - protein, 9 aa, Homo Sapiens
AVLGKTSLP

SEQ ID NO: 146685 - protein, 9 aa, Homo Sapiens
HGGRPLGHP

SEQ ID NO: 146686 - protein, 9 aa, Homo Sapiens
LYSEDSTPA

SEQ ID NO: 146687 - protein, 9 aa, Homo Sapiens
FGSVHPVSP

SEQ ID NO: 146688 - protein, 9 aa, Homo Sapiens
GSQVKGGEE

SEQ ID NO: 146689 - protein, 9 aa, Homo Sapiens
PRIDRIFRQ

SEQ ID NO: 146690 - protein, 9 aa, Homo Sapiens
HTQAYTLTY

SEQ ID NO: 146691 - protein, 9 aa, Homo Sapiens
FLAKQGQWG

SEQ ID NO: 146692 - protein, 9 aa, Homo Sapiens
LKQGCLKRT

SEQ ID NO: 146693 - protein, 9 aa, Homo Sapiens
NKRPTFPKI

SEQ ID NO: 146694 - protein, 9 aa, Homo Sapiens
KQDHQKDTR

SEQ ID NO: 146695 - protein, 9 aa, Homo Sapiens
FSYYQIFFD

SEQ ID NO: 146696 - protein, 9 aa, Homo Sapiens
KDSTSWCSV

SEQ ID NO: 146697 - protein, 9 aa, Homo Sapiens
MTRTRSDFL

SEQ ID NO: 146698 - protein, 9 aa, Homo Sapiens
TIDDHKTNE

SEQ ID NO: 146699 - protein, 9 aa, Homo Sapiens
CRPSVQAQA

SEQ ID NO: 146700 - protein, 9 aa, Homo Sapiens
VLCGCFLLW

SEQ ID NO: 146701 - protein, 9 aa, Homo Sapiens
SDANERKSG

SEQ ID NO: 146702 - protein, 9 aa, Homo Sapiens
DGPGRLRPE

SEQ ID NO: 146703 - protein, 9 aa, Homo Sapiens
LCWPSRTTG

SEQ ID NO: 146704 - protein, 9 aa, Homo Sapiens
ACSILARLV

SEQ ID NO: 146705 - protein, 9 aa, Homo Sapiens
WTKETNCES

SEQ ID NO: 146706 - protein, 9 aa, Homo Sapiens
EVVVSALLQ

SEQ ID NO: 146707 - protein, 9 aa, Homo Sapiens
VCPSWLSVS

SEQ ID NO: 146708 - protein, 9 aa, Homo Sapiens
PLQPRPCPL

SEQ ID NO: 146709 - protein, 9 aa, Homo Sapiens
ADPYVETPM

SEQ ID NO: 146710 - protein, 9 aa, Homo Sapiens
GSTASRASQ

SEQ ID NO: 146711 - protein, 9 aa, Homo Sapiens
RKATRRARR

SEQ ID NO: 146712 - protein, 9 aa, Homo Sapiens
GRTSGRSLS

SEQ ID NO: 146713 - protein, 9 aa, Homo Sapiens
PSATNSEVK

SEQ ID NO: 146714 - protein, 9 aa, Homo Sapiens
LQLRSQDPS

SEQ ID NO: 146715 - protein, 9 aa, Homo Sapiens
WEIPGSLSG

SEQ ID NO: 146716 - protein, 9 aa, Homo Sapiens
LCGREVEVL

SEQ ID NO: 146717 - protein, 9 aa, Homo Sapiens
CSPTKKNSC

SEQ ID NO: 146718 - protein, 9 aa, Homo Sapiens
DNFPRPPPA

SEQ ID NO: 146719 - protein, 9 aa, Homo Sapiens
AATSSSTGV

SEQ ID NO: 146720 - protein, 9 aa, Homo Sapiens
LTPPNAAVG

SEQ ID NO: 146721 - protein, 9 aa, Homo Sapiens
AIPQCWVLN

SEQ ID NO: 146722 - protein, 9 aa, Homo Sapiens
ISMKAGVIH

SEQ ID NO: 146723 - protein, 9 aa, Homo Sapiens
FGFATLTSR

SEQ ID NO: 146724 - protein, 9 aa, Homo Sapiens
EHPCPEQFW

SEQ ID NO: 146725 - protein, 9 aa, Homo Sapiens
VPVCSGDAT

SEQ ID NO: 146726 - protein, 9 aa, Homo Sapiens
LPVGESPWQ

SEQ ID NO: 146727 - protein, 9 aa, Homo Sapiens
GCTAKTGAS

SEQ ID NO: 146728 - protein, 9 aa, Homo Sapiens
LQKLQGSKV

SEQ ID NO: 146729 - protein, 9 aa, Homo Sapiens
PLFALLSWG

SEQ ID NO: 146730 - protein, 9 aa, Homo Sapiens
GLAQLTAQL

SEQ ID NO: 146731 - protein, 9 aa, Homo Sapiens
CISQPTASW

SEQ ID NO: 146732 - protein, 9 aa, Homo Sapiens
HQLRHPLHP

SEQ ID NO: 146733 - protein, 9 aa, Homo Sapiens
RSCLSSRIG

SEQ ID NO: 146734 - protein, 9 aa, Homo Sapiens
SFRGSCRRG

SEQ ID NO: 146735 - protein, 9 aa, Homo Sapiens
LSACQGVYL

SEQ ID NO: 146736 - protein, 9 aa, Homo Sapiens
WRVGDVAVK

SEQ ID NO: 146737 - protein, 9 aa, Homo Sapiens
VLRLDGSQR

SEQ ID NO: 146738 - protein, 9 aa, Homo Sapiens
ICLQVLTDK

SEQ ID NO: 146739 - protein, 9 aa, Homo Sapiens
AGNRGAWKA

SEQ ID NO: 146740 - protein, 9 aa, Homo Sapiens
PSEQESITV

SEQ ID NO: 146741 - protein, 9 aa, Homo Sapiens
MSMEFQEVQ

SEQ ID NO: 146742 - protein, 9 aa, Homo Sapiens
TVHEKYQCQ

SEQ ID NO: 146743 - protein, 9 aa, Homo Sapiens
TDTHADTPT

SEQ ID NO: 146744 - protein, 9 aa, Homo Sapiens
RPQASRAPA

SEQ ID NO: 146745 - protein, 9 aa, Homo Sapiens
MFDVLKKEI

SEQ ID NO: 146746 - protein, 9 aa, Homo Sapiens
SEKLLNSIN

SEQ ID NO: 146747 - protein, 9 aa, Homo Sapiens
TAFLGDLLA

SEQ ID NO: 146748 - protein, 9 aa, Homo Sapiens
NLSQFFPEV

SEQ ID NO: 146749 - protein, 9 aa, Homo Sapiens
RASEMAEPP

SEQ ID NO: 146750 - protein, 9 aa, Homo Sapiens
GGGGGPGPA

SEQ ID NO: 146751 - protein, 9 aa, Homo Sapiens
LTATAPSSA

SEQ ID NO: 146752 - protein, 9 aa, Homo Sapiens
PRQLPGPHD

SEQ ID NO: 146753 - protein, 9 aa, Homo Sapiens
WSGRSARMS

SEQ ID NO: 146754 - protein, 9 aa, Homo Sapiens
MRVCPSPST

SEQ ID NO: 146755 - protein, 9 aa, Homo Sapiens
DLPKTVNSS

SEQ ID NO: 146756 - protein, 9 aa, Homo Sapiens
FGDRFPVMS

SEQ ID NO: 146757 - protein, 9 aa, Homo Sapiens
VALLWRNPN

SEQ ID NO: 146758 - protein, 9 aa, Homo Sapiens
CRRLSFTLE

SEQ ID NO: 146759 - protein, 9 aa, Homo Sapiens
PEEVPQEVI

SEQ ID NO: 146760 - protein, 9 aa, Homo Sapiens
FETFSESAI

SEQ ID NO: 146761 - protein, 9 aa, Homo Sapiens
PLPSSRVFT

SEQ ID NO: 146762 - protein, 9 aa, Homo Sapiens
GPHDDFVAD

SEQ ID NO: 146763 - protein, 9 aa, Homo Sapiens
GIQDRTIPD

SEQ ID NO: 146764 - protein, 9 aa, Homo Sapiens
LDLPILDDQ

SEQ ID NO: 146765 - protein, 9 aa, Homo Sapiens
VLGRAAPLG

SEQ ID NO: 146766 - protein, 9 aa, Homo Sapiens
ATRLQKMLQ

SEQ ID NO: 146767 - protein, 9 aa, Homo Sapiens
EWQRFGRHT

SEQ ID NO: 146768 - protein, 9 aa, Homo Sapiens
RCARINESL

SEQ ID NO: 146769 - protein, 9 aa, Homo Sapiens
GLLVLGEVA

SEQ ID NO: 146770 - protein, 9 aa, Homo Sapiens
RERTNQSGL

SEQ ID NO: 146771 - protein, 9 aa, Homo Sapiens
SMPAAMRWA

SEQ ID NO: 146772 - protein, 9 aa, Homo Sapiens
VLQILVENI

SEQ ID NO: 146773 - protein, 9 aa, Homo Sapiens
SPDQDMREV

SEQ ID NO: 146774 - protein, 9 aa, Homo Sapiens
WGPTAGAAR

SEQ ID NO: 146775 - protein, 9 aa, Homo Sapiens
AWRRPSGPC

SEQ ID NO: 146776 - protein, 9 aa, Homo Sapiens
QKEDAALII

SEQ ID NO: 146777 - protein, 9 aa, Homo Sapiens
TKEAYAQNR

SEQ ID NO: 146778 - protein, 9 aa, Homo Sapiens
FAFTKQVLG

SEQ ID NO: 146779 - protein, 9 aa, Homo Sapiens
CPDVWLAAA

SEQ ID NO: 146780 - protein, 9 aa, Homo Sapiens
CLLIGLFSL

SEQ ID NO: 146781 - protein, 9 aa, Homo Sapiens
GGTRKASAA

SEQ ID NO: 146782 - protein, 9 aa, Homo Sapiens
PSAVPSVAR

SEQ ID NO: 146783 - protein, 9 aa, Homo Sapiens
CWCYLTSGG

SEQ ID NO: 146784 - protein, 9 aa, Homo Sapiens
PGRGGACGQ

SEQ ID NO: 146785 - protein, 9 aa, Homo Sapiens
GNGASTARW

SEQ ID NO: 146786 - protein, 9 aa, Homo Sapiens
ILHVPKVTA

SEQ ID NO: 146787 - protein, 9 aa, Homo Sapiens
HCFHSHHPH

SEQ ID NO: 146788 - protein, 9 aa, Homo Sapiens
PEVWKEVRG

SEQ ID NO: 146789 - protein, 9 aa, Homo Sapiens
QSGERSTRW

SEQ ID NO: 146790 - protein, 9 aa, Homo Sapiens
WQVMASLTG

SEQ ID NO: 146791 - protein, 9 aa, Homo Sapiens
KKMMDLRME

SEQ ID NO: 146792 - protein, 9 aa, Homo Sapiens
RKASAASCA

SEQ ID NO: 146793 - protein, 9 aa, Homo Sapiens
QAQDIEATQ

SEQ ID NO: 146794 - protein, 9 aa, Homo Sapiens
IWRRFPTDY

SEQ ID NO: 146795 - protein, 9 aa, Homo Sapiens
HVATMIAIV

SEQ ID NO: 146796 - protein, 9 aa, Homo Sapiens
KAGVIHANT

SEQ ID NO: 146797 - protein, 9 aa, Homo Sapiens
ATGGVPSTP

SEQ ID NO: 146798 - protein, 9 aa, Homo Sapiens
AGNFAIMEI

SEQ ID NO: 146799 - protein, 9 aa, Homo Sapiens
MEVWWCATS

SEQ ID NO: 146800 - protein, 9 aa, Homo Sapiens
MGVPPGASE

SEQ ID NO: 146801 - protein, 9 aa, Homo Sapiens
TGSWQPRPP

SEQ ID NO: 146802 - protein, 9 aa, Homo Sapiens
SVVFLTAIT

SEQ ID NO: 146803 - protein, 9 aa, Homo Sapiens
TEIPDTQAM

SEQ ID NO: 146804 - protein, 9 aa, Homo Sapiens
NCDIFQNIS

SEQ ID NO: 146805 - protein, 9 aa, Homo Sapiens
RNYVNVDPT

SEQ ID NO: 146806 - protein, 9 aa, Homo Sapiens
LSHLLPPPE

SEQ ID NO: 146807 - protein, 9 aa, Homo Sapiens
QRNLLRLQS

SEQ ID NO: 146808 - protein, 9 aa, Homo Sapiens
DDRSIQQIQ

SEQ ID NO: 146809 - protein, 9 aa, Homo Sapiens
LLGFIHPPL

SEQ ID NO: 146810 - protein, 9 aa, Homo Sapiens
MLRMPESSG

SEQ ID NO: 146811 - protein, 9 aa, Homo Sapiens
PPMGSLTPR

SEQ ID NO: 146812 - protein, 9 aa, Homo Sapiens
SLHSHAFLR

SEQ ID NO: 146813 - protein, 9 aa, Homo Sapiens
VVLVGPMGV

SEQ ID NO: 146814 - protein, 9 aa, Homo Sapiens
SDLPSLTSG

SEQ ID NO: 146815 - protein, 9 aa, Homo Sapiens
RKRRKRSRT

SEQ ID NO: 146816 - protein, 9 aa, Homo Sapiens
WARHTHPSS

SEQ ID NO: 146817 - protein, 9 aa, Homo Sapiens
VRPKQRTRT

SEQ ID NO: 146818 - protein, 9 aa, Homo Sapiens
GFIQAKGYR

SEQ ID NO: 146819 - protein, 9 aa, Homo Sapiens
KPTMKMLER

SEQ ID NO: 146820 - protein, 9 aa, Homo Sapiens
LPRHVLLGP

SEQ ID NO: 146821 - protein, 9 aa, Homo Sapiens
QEFEFRVGT

SEQ ID NO: 146822 - protein, 9 aa, Homo Sapiens
RNTSLAALF

SEQ ID NO: 146823 - protein, 9 aa, Homo Sapiens
CTNSAKIVD

SEQ ID NO: 146824 - protein, 9 aa, Homo Sapiens
QYYYQNGCL

SEQ ID NO: 146825 - protein, 9 aa, Homo Sapiens
WLLRGRLEV

SEQ ID NO: 146826 - protein, 9 aa, Homo Sapiens
GTSSLLSPV

SEQ ID NO: 146827 - protein, 9 aa, Homo Sapiens
RSCRPSVQA

SEQ ID NO: 146828 - protein, 9 aa, Homo Sapiens
ALLRNMAMA

SEQ ID NO: 146829 - protein, 9 aa, Homo Sapiens
GFFQGPPAP

SEQ ID NO: 146830 - protein, 9 aa, Homo Sapiens
AIVGNSGNL

SEQ ID NO: 146831 - protein, 9 aa, Homo Sapiens
FSACGSHLA

SEQ ID NO: 146832 - protein, 9 aa, Homo Sapiens
WMANARRSP

SEQ ID NO: 146833 - protein, 9 aa, Homo Sapiens
LEPQAGGPR

SEQ ID NO: 146834 - protein, 9 aa, Homo Sapiens
PARRAQGNS

SEQ ID NO: 146835 - protein, 9 aa, Homo Sapiens
CTQGRRWGA

SEQ ID NO: 146836 - protein, 9 aa, Homo Sapiens
KHRRSPGEW

SEQ ID NO: 146837 - protein, 9 aa, Homo Sapiens
DDHWHMVLL

SEQ ID NO: 146838 - protein, 9 aa, Homo Sapiens
NGLVRALGE

SEQ ID NO: 146839 - protein, 9 aa, Homo Sapiens
DAELLGGWW

SEQ ID NO: 146840 - protein, 9 aa, Homo Sapiens
RPPWHGLMA

SEQ ID NO: 146841 - protein, 9 aa, Homo Sapiens
GNTVRSAMK

SEQ ID NO: 146842 - protein, 9 aa, Homo Sapiens
REPLTKQLW

SEQ ID NO: 146843 - protein, 9 aa, Homo Sapiens
VLVGPMGVG

SEQ ID NO: 146844 - protein, 9 aa, Homo Sapiens
STECFLYIV

SEQ ID NO: 146845 - protein, 9 aa, Homo Sapiens
HQEADVLHG

SEQ ID NO: 146846 - protein, 9 aa, Homo Sapiens
CWFKENRCL

SEQ ID NO: 146847 - protein, 9 aa, Homo Sapiens
QGPWQPGAS

SEQ ID NO: 146848 - protein, 9 aa, Homo Sapiens
NKVGHEGII

SEQ ID NO: 146849 - protein, 9 aa, Homo Sapiens
LGLDDHLAE

SEQ ID NO: 146850 - protein, 9 aa, Homo Sapiens
LPLHLIHGL

SEQ ID NO: 146851 - protein, 9 aa, Homo Sapiens
TACSILARL

SEQ ID NO: 146852 - protein, 9 aa, Homo Sapiens
SIRRPLIFL

SEQ ID NO: 146853 - protein, 9 aa, Homo Sapiens
TAPGVCWPL

SEQ ID NO: 146854 - protein, 9 aa, Homo Sapiens
IDENKLLHP

SEQ ID NO: 146855 - protein, 9 aa, Homo Sapiens
DVSMCRMEM

SEQ ID NO: 146856 - protein, 9 aa, Homo Sapiens
PYVPVQVTV

SEQ ID NO: 146857 - protein, 9 aa, Homo Sapiens
VDDSALNKK

SEQ ID NO: 146858 - protein, 9 aa, Homo Sapiens
SGPRPGLSA

SEQ ID NO: 146859 - protein, 9 aa, Homo Sapiens
WDRNNVLNR

SEQ ID NO: 146860 - protein, 9 aa, Homo Sapiens
AGLPPGLLV

SEQ ID NO: 146861 - protein, 9 aa, Homo Sapiens
APERAGRTA

SEQ ID NO: 146862 - protein, 9 aa, Homo Sapiens
MVSEGGPEA

SEQ ID NO: 146863 - protein, 9 aa, Homo Sapiens
PCWAPAPGS

SEQ ID NO: 146864 - protein, 9 aa, Homo Sapiens
WPSRTTGAP

SEQ ID NO: 146865 - protein, 9 aa, Homo Sapiens
EVPLHRGWF

SEQ ID NO: 146866 - protein, 9 aa, Homo Sapiens
QLQLRPQPW

SEQ ID NO: 146867 - protein, 9 aa, Homo Sapiens
LVMLHLGRT

SEQ ID NO: 146868 - protein, 9 aa, Homo Sapiens
TRRGEAAHR

SEQ ID NO: 146869 - protein, 9 aa, Homo Sapiens
VKLEKTIDD

SEQ ID NO: 146870 - protein, 9 aa, Homo Sapiens
AANSATSVD

SEQ ID NO: 146871 - protein, 9 aa, Homo Sapiens
FYIISSEKI

SEQ ID NO: 146872 - protein, 9 aa, Homo Sapiens
IEAVICALV

SEQ ID NO: 146873 - protein, 9 aa, Homo Sapiens
PSPRAGSRR

SEQ ID NO: 146874 - protein, 9 aa, Homo Sapiens
LGFIHPPLI

SEQ ID NO: 146875 - protein, 9 aa, Homo Sapiens
RFNLPCRST

SEQ ID NO: 146876 - protein, 9 aa, Homo Sapiens
KIIEYYLRH

SEQ ID NO: 146877 - protein, 9 aa, Homo Sapiens
SPRLGRSCF

SEQ ID NO: 146878 - protein, 9 aa, Homo Sapiens
SARSPTWCR

SEQ ID NO: 146879 - protein, 9 aa, Homo Sapiens
HPPLIFGAG

SEQ ID NO: 146880 - protein, 9 aa, Homo Sapiens
TKAELIQSD

SEQ ID NO: 146881 - protein, 9 aa, Homo Sapiens
KGREERREV

SEQ ID NO: 146882 - protein, 9 aa, Homo Sapiens
GVKFCKAQN

SEQ ID NO: 146883 - protein, 9 aa, Homo Sapiens
LLELSSLKP

SEQ ID NO: 146884 - protein, 9 aa, Homo Sapiens
GLVRTEIVC

SEQ ID NO: 146885 - protein, 9 aa, Homo Sapiens
KLRRPGLGV

SEQ ID NO: 146886 - protein, 9 aa, Homo Sapiens
RPTFPKIKK

SEQ ID NO: 146887 - protein, 9 aa, Homo Sapiens
EEKQKQHIH

SEQ ID NO: 146888 - protein, 9 aa, Homo Sapiens
PQNPPNHPS

SEQ ID NO: 146889 - protein, 9 aa, Homo Sapiens
TEVQMKRVG

SEQ ID NO: 146890 - protein, 9 aa, Homo Sapiens
SIFFVGQLE

SEQ ID NO: 146891 - protein, 9 aa, Homo Sapiens
QRTQRPQPQ

SEQ ID NO: 146892 - protein, 9 aa, Homo Sapiens
TPSSNFLTT

SEQ ID NO: 146893 - protein, 9 aa, Homo Sapiens
EPDYTSLPV

SEQ ID NO: 146894 - protein, 9 aa, Homo Sapiens
DIVALGASC

SEQ ID NO: 146895 - protein, 9 aa, Homo Sapiens
PEAPSTRAA

SEQ ID NO: 146896 - protein, 9 aa, Homo Sapiens
TCHGLLTGQ

SEQ ID NO: 146897 - protein, 9 aa, Homo Sapiens
LWRVTQKAP

SEQ ID NO: 146898 - protein, 9 aa, Homo Sapiens
EEERRLHQA

SEQ ID NO: 146899 - protein, 9 aa, Homo Sapiens
KRNARLMKV

SEQ ID NO: 146900 - protein, 9 aa, Homo Sapiens
QPPGSLSIT

SEQ ID NO: 146901 - protein, 9 aa, Homo Sapiens
MLPIGLSGI

SEQ ID NO: 146902 - protein, 9 aa, Homo Sapiens
GIVSTSSHL

SEQ ID NO: 146903 - protein, 9 aa, Homo Sapiens
SSCAPLLHR

SEQ ID NO: 146904 - protein, 9 aa, Homo Sapiens
RLALHGFRP

SEQ ID NO: 146905 - protein, 9 aa, Homo Sapiens
LSSLKPGAL

SEQ ID NO: 146906 - protein, 9 aa, Homo Sapiens
NAGTVRIFA

SEQ ID NO: 146907 - protein, 9 aa, Homo Sapiens
EIPMSMEFQ

SEQ ID NO: 146908 - protein, 9 aa, Homo Sapiens
CSMKCKDIS

SEQ ID NO: 146909 - protein, 9 aa, Homo Sapiens
NGPTSCLPL

SEQ ID NO: 146910 - protein, 9 aa, Homo Sapiens
RSDGQVSKS

SEQ ID NO: 146911 - protein, 9 aa, Homo Sapiens
PETGLRQGG

SEQ ID NO: 146912 - protein, 9 aa, Homo Sapiens
DNPETTAAS

SEQ ID NO: 146913 - protein, 9 aa, Homo Sapiens
SSPTRALGA

SEQ ID NO: 146914 - protein, 9 aa, Homo Sapiens
GLLTGQSYI

SEQ ID NO: 146915 - protein, 9 aa, Homo Sapiens
ARGIKPSPV

SEQ ID NO: 146916 - protein, 9 aa, Homo Sapiens
FPSLSILSP

SEQ ID NO: 146917 - protein, 9 aa, Homo Sapiens
TAVRAYSDQ

SEQ ID NO: 146918 - protein, 9 aa, Homo Sapiens
VESNSSTSI

SEQ ID NO: 146919 - protein, 9 aa, Homo Sapiens
LEIKHISKG

SEQ ID NO: 146920 - protein, 9 aa, Homo Sapiens
ELSERCNAL

SEQ ID NO: 146921 - protein, 9 aa, Homo Sapiens
SGYDWNESI

SEQ ID NO: 146922 - protein, 9 aa, Homo Sapiens
CLIDENKLL

SEQ ID NO: 146923 - protein, 9 aa, Homo Sapiens
RWRLPPPCP

SEQ ID NO: 146924 - protein, 9 aa, Homo Sapiens
WLRASSVVP

SEQ ID NO: 146925 - protein, 9 aa, Homo Sapiens
VKQTRHEEI

SEQ ID NO: 146926 - protein, 9 aa, Homo Sapiens
QYQLALDLL

SEQ ID NO: 146927 - protein, 9 aa, Homo Sapiens
RGHPSAFNN

SEQ ID NO: 146928 - protein, 9 aa, Homo Sapiens
LRCPAVPAA

SEQ ID NO: 146929 - protein, 9 aa, Homo Sapiens
VFETFSESA

SEQ ID NO: 146930 - protein, 9 aa, Homo Sapiens
WPPGYSGPS

SEQ ID NO: 146931 - protein, 9 aa, Homo Sapiens
VEKMQDHKQ

SEQ ID NO: 146932 - protein, 9 aa, Homo Sapiens
GPLAPPPPL

SEQ ID NO: 146933 - protein, 9 aa, Homo Sapiens
RCSSSEVPC

SEQ ID NO: 146934 - protein, 9 aa, Homo Sapiens
GTAFPEPGT

SEQ ID NO: 146935 - protein, 9 aa, Homo Sapiens
PLLSCHIPV

SEQ ID NO: 146936 - protein, 9 aa, Homo Sapiens
QLRPQPWLQ

SEQ ID NO: 146937 - protein, 9 aa, Homo Sapiens
GFIPLKPTM

SEQ ID NO: 146938 - protein, 9 aa, Homo Sapiens
GLPPMSSPF

SEQ ID NO: 146939 - protein, 9 aa, Homo Sapiens
SEKKRLSEG

SEQ ID NO: 146940 - protein, 9 aa, Homo Sapiens
GSVMISSPA

SEQ ID NO: 146941 - protein, 9 aa, Homo Sapiens
INLFFKSFH

SEQ ID NO: 146942 - protein, 9 aa, Homo Sapiens
AHNHNRQTL

SEQ ID NO: 146943 - protein, 9 aa, Homo Sapiens
QQTVLPHGH

SEQ ID NO: 146944 - protein, 9 aa, Homo Sapiens
LLPGPREVP

SEQ ID NO: 146945 - protein, 9 aa, Homo Sapiens
RQGGSPVGD

SEQ ID NO: 146946 - protein, 9 aa, Homo Sapiens
AMQEKAQDC

SEQ ID NO: 146947 - protein, 9 aa, Homo Sapiens
SSRQLAGVL

SEQ ID NO: 146948 - protein, 9 aa, Homo Sapiens
GCFAATVHP

SEQ ID NO: 146949 - protein, 9 aa, Homo Sapiens
RHRLRAGAG

SEQ ID NO: 146950 - protein, 9 aa, Homo Sapiens
PTHTGHLWL

SEQ ID NO: 146951 - protein, 9 aa, Homo Sapiens
GHLVGVKRL

SEQ ID NO: 146952 - protein, 9 aa, Homo Sapiens
SRRCCLRTS

SEQ ID NO: 146953 - protein, 9 aa, Homo Sapiens
GGQTLMSPG

SEQ ID NO: 146954 - protein, 9 aa, Homo Sapiens
LPPPRRGSS

SEQ ID NO: 146955 - protein, 9 aa, Homo Sapiens
LVPPPKSPP

SEQ ID NO: 146956 - protein, 9 aa, Homo Sapiens
HCNIHLPSS

SEQ ID NO: 146957 - protein, 9 aa, Homo Sapiens
WWHNSEEKK

SEQ ID NO: 146958 - protein, 9 aa, Homo Sapiens
QPFFMTLGW

SEQ ID NO: 146959 - protein, 9 aa, Homo Sapiens
KHLEHWWWK

SEQ ID NO: 146960 - protein, 9 aa, Homo Sapiens
NECYQATFR

SEQ ID NO: 146961 - protein, 9 aa, Homo Sapiens
LRQTRFSSV

SEQ ID NO: 146962 - protein, 9 aa, Homo Sapiens
REKPFTVEI

SEQ ID NO: 146963 - protein, 9 aa, Homo Sapiens
LPPEILSGA

SEQ ID NO: 146964 - protein, 9 aa, Homo Sapiens
WTLNPQGVL

SEQ ID NO: 146965 - protein, 9 aa, Homo Sapiens
QAPLHPQPA

SEQ ID NO: 146966 - protein, 9 aa, Homo Sapiens
RQAKTGTQG

SEQ ID NO: 146967 - protein, 9 aa, Homo Sapiens
QSSTSILSA

SEQ ID NO: 146968 - protein, 9 aa, Homo Sapiens
NPSSAEFFL

SEQ ID NO: 146969 - protein, 9 aa, Homo Sapiens
HHLVPLFIW

SEQ ID NO: 146970 - protein, 9 aa, Homo Sapiens
ALNSCTMVL

SEQ ID NO: 146971 - protein, 9 aa, Homo Sapiens
SPGEKPDPI

SEQ ID NO: 146972 - protein, 9 aa, Homo Sapiens
FLWNDYIPD

SEQ ID NO: 146973 - protein, 9 aa, Homo Sapiens
VACSFAVGS

SEQ ID NO: 146974 - protein, 9 aa, Homo Sapiens
GGGGGHGPW

SEQ ID NO: 146975 - protein, 9 aa, Homo Sapiens
CNTQLTRVL

SEQ ID NO: 146976 - protein, 9 aa, Homo Sapiens
LWRKRKPSA

SEQ ID NO: 146977 - protein, 9 aa, Homo Sapiens
ERSMPHLQK

SEQ ID NO: 146978 - protein, 9 aa, Homo Sapiens
QGCLKRTGH

SEQ ID NO: 146979 - protein, 9 aa, Homo Sapiens
LPRKERGPL

SEQ ID NO: 146980 - protein, 9 aa, Homo Sapiens
ASGVTTSTH

SEQ ID NO: 146981 - protein, 9 aa, Homo Sapiens
KFTLDSKVV

SEQ ID NO: 146982 - protein, 9 aa, Homo Sapiens
EQCASNIYV

SEQ ID NO: 146983 - protein, 9 aa, Homo Sapiens
NGQLSTLLG

SEQ ID NO: 146984 - protein, 9 aa, Homo Sapiens
PDSRGPRTP

SEQ ID NO: 146985 - protein, 9 aa, Homo Sapiens
LFCTPFCTL

SEQ ID NO: 146986 - protein, 9 aa, Homo Sapiens
IDPALLAVL

SEQ ID NO: 146987 - protein, 9 aa, Homo Sapiens
LVATPALPT

SEQ ID NO: 146988 - protein, 9 aa, Homo Sapiens
RSVHLQEAG

SEQ ID NO: 146989 - protein, 9 aa, Homo Sapiens
AATIPRPFT

SEQ ID NO: 146990 - protein, 9 aa, Homo Sapiens
EEDQGVWQG

SEQ ID NO: 146991 - protein, 9 aa, Homo Sapiens
QTRAGDASL

SEQ ID NO: 146992 - protein, 9 aa, Homo Sapiens
ETTARSVHA

SEQ ID NO: 146993 - protein, 9 aa, Homo Sapiens
VGFPVTPII

SEQ ID NO: 146994 - protein, 9 aa, Homo Sapiens
TGILKSLMT

SEQ ID NO: 146995 - protein, 9 aa, Homo Sapiens
VLACVPSPV

SEQ ID NO: 146996 - protein, 9 aa, Homo Sapiens
DDVQILVEM

SEQ ID NO: 146997 - protein, 9 aa, Homo Sapiens
GLGTGQRLS

SEQ ID NO: 146998 - protein, 9 aa, Homo Sapiens
FVTCSSHMM

SEQ ID NO: 146999 - protein, 9 aa, Homo Sapiens
TTGAETTTA

SEQ ID NO: 147000 - protein, 9 aa, Homo Sapiens
RFTCHGLLT

SEQ ID NO: 147001 - protein, 9 aa, Homo Sapiens
VGNILVLCL

SEQ ID NO: 147002 - protein, 9 aa, Homo Sapiens
WGGPRDPTD

SEQ ID NO: 147003 - protein, 9 aa, Homo Sapiens
DLGLQLPDL

SEQ ID NO: 147004 - protein, 9 aa, Homo Sapiens
QKTEEAWRK

SEQ ID NO: 147005 - protein, 9 aa, Homo Sapiens
FPPAVPAAL

SEQ ID NO: 147006 - protein, 9 aa, Homo Sapiens
PRCAMAPET

SEQ ID NO: 147007 - protein, 9 aa, Homo Sapiens
TQQRTAALL

SEQ ID NO: 147008 - protein, 9 aa, Homo Sapiens
LLAPKPQGT

SEQ ID NO: 147009 - protein, 9 aa, Homo Sapiens
GRRLPARLQ

SEQ ID NO: 147010 - protein, 9 aa, Homo Sapiens
HLENLKEPE

SEQ ID NO: 147011 - protein, 9 aa, Homo Sapiens
FPCWGWHGS

SEQ ID NO: 147012 - protein, 9 aa, Homo Sapiens
KDIQPAPQC

SEQ ID NO: 147013 - protein, 9 aa, Homo Sapiens
AIPCKLEKM

SEQ ID NO: 147014 - protein, 9 aa, Homo Sapiens
VPLRQDVKQ

SEQ ID NO: 147015 - protein, 9 aa, Homo Sapiens
PLENQPLPM

SEQ ID NO: 147016 - protein, 9 aa, Homo Sapiens
SSRGGGGGA

SEQ ID NO: 147017 - protein, 9 aa, Homo Sapiens
RLPRSSRRC

SEQ ID NO: 147018 - protein, 9 aa, Homo Sapiens
RERYVASVQ

SEQ ID NO: 147019 - protein, 9 aa, Homo Sapiens
VLFQILCIL

SEQ ID NO: 147020 - protein, 9 aa, Homo Sapiens
PRWMSSEVT

SEQ ID NO: 147021 - protein, 9 aa, Homo Sapiens
GNKFTLDSK

SEQ ID NO: 147022 - protein, 9 aa, Homo Sapiens
VDTDIGMTK

SEQ ID NO: 147023 - protein, 9 aa, Homo Sapiens
EGLRCVKPN

SEQ ID NO: 147024 - protein, 9 aa, Homo Sapiens
RAGSRRCCL

SEQ ID NO: 147025 - protein, 9 aa, Homo Sapiens
CTGSGRRPR

SEQ ID NO: 147026 - protein, 9 aa, Homo Sapiens
LAPAPNPQR

SEQ ID NO: 147027 - protein, 9 aa, Homo Sapiens
LIWNWAQSC

SEQ ID NO: 147028 - protein, 9 aa, Homo Sapiens
HITPSAPSP

SEQ ID NO: 147029 - protein, 9 aa, Homo Sapiens
WPLLRPEFS

SEQ ID NO: 147030 - protein, 9 aa, Homo Sapiens
TAAGGRTRA

SEQ ID NO: 147031 - protein, 9 aa, Homo Sapiens
PSSPTRALG

SEQ ID NO: 147032 - protein, 9 aa, Homo Sapiens
VCTRPVVPA

SEQ ID NO: 147033 - protein, 9 aa, Homo Sapiens
EQQRHTAYI

SEQ ID NO: 147034 - protein, 9 aa, Homo Sapiens
GFPVTPIIE

SEQ ID NO: 147035 - protein, 9 aa, Homo Sapiens
PGHALSCRT

SEQ ID NO: 147036 - protein, 9 aa, Homo Sapiens
SCTRRPVTS

SEQ ID NO: 147037 - protein, 9 aa, Homo Sapiens
ELELEARVA

SEQ ID NO: 147038 - protein, 9 aa, Homo Sapiens
SSQKETTCQ

SEQ ID NO: 147039 - protein, 9 aa, Homo Sapiens
QSSVVRCRS

SEQ ID NO: 147040 - protein, 9 aa, Homo Sapiens
PSHSTPRLL

SEQ ID NO: 147041 - protein, 9 aa, Homo Sapiens
HADTPTSTH

SEQ ID NO: 147042 - protein, 9 aa, Homo Sapiens
IHPLPVKPK

SEQ ID NO: 147043 - protein, 9 aa, Homo Sapiens
RPTRRSSGS

SEQ ID NO: 147044 - protein, 9 aa, Homo Sapiens
FDVLKKEIY

SEQ ID NO: 147045 - protein, 9 aa, Homo Sapiens
VLLQEPALQ

SEQ ID NO: 147046 - protein, 9 aa, Homo Sapiens
CLQLKSGTH

SEQ ID NO: 147047 - protein, 9 aa, Homo Sapiens
LGLQLALFY

SEQ ID NO: 147048 - protein, 9 aa, Homo Sapiens
GYTLASDKE

SEQ ID NO: 147049 - protein, 9 aa, Homo Sapiens
GKTVTMKED

SEQ ID NO: 147050 - protein, 9 aa, Homo Sapiens
YSGPSLPAG

SEQ ID NO: 147051 - protein, 9 aa, Homo Sapiens
RVAPTAPAT

SEQ ID NO: 147052 - protein, 9 aa, Homo Sapiens
RRAPPGWAC

SEQ ID NO: 147053 - protein, 9 aa, Homo Sapiens
PHVPHARGR

SEQ ID NO: 147054 - protein, 9 aa, Homo Sapiens
FKPLYSSHS

SEQ ID NO: 147055 - protein, 9 aa, Homo Sapiens
VDISVCRDL

SEQ ID NO: 147056 - protein, 9 aa, Homo Sapiens
SLNEMCCAY

SEQ ID NO: 147057 - protein, 9 aa, Homo Sapiens
LAILGKGNL

SEQ ID NO: 147058 - protein, 9 aa, Homo Sapiens
FHALMYIIA

SEQ ID NO: 147059 - protein, 9 aa, Homo Sapiens
VAPGHALSC

SEQ ID NO: 147060 - protein, 9 aa, Homo Sapiens
YALGIQDRT

SEQ ID NO: 147061 - protein, 9 aa, Homo Sapiens
PPPPTKKRG

SEQ ID NO: 147062 - protein, 9 aa, Homo Sapiens
INQECQKTL

SEQ ID NO: 147063 - protein, 9 aa, Homo Sapiens
SSLPGGTDT

SEQ ID NO: 147064 - protein, 9 aa, Homo Sapiens
ASEFLPQGP

SEQ ID NO: 147065 - protein, 9 aa, Homo Sapiens
RGKNIQGGR

SEQ ID NO: 147066 - protein, 9 aa, Homo Sapiens
ALLALQQLP

SEQ ID NO: 147067 - protein, 9 aa, Homo Sapiens
CVWCRHCGS

SEQ ID NO: 147068 - protein, 9 aa, Homo Sapiens
IGGNFRGPH

SEQ ID NO: 147069 - protein, 9 aa, Homo Sapiens
GGEGDFALI

SEQ ID NO: 147070 - protein, 9 aa, Homo Sapiens
CCYPVCCQT

SEQ ID NO: 147071 - protein, 9 aa, Homo Sapiens
LSSSQWGPL

SEQ ID NO: 147072 - protein, 9 aa, Homo Sapiens
RPASAWTSM

SEQ ID NO: 147073 - protein, 9 aa, Homo Sapiens
FAERTVVKL

SEQ ID NO: 147074 - protein, 9 aa, Homo Sapiens
QEVEIGTVV

SEQ ID NO: 147075 - protein, 9 aa, Homo Sapiens
QQHQRHPGT

SEQ ID NO: 147076 - protein, 9 aa, Homo Sapiens
HKPATLSQI

SEQ ID NO: 147077 - protein, 9 aa, Homo Sapiens
SGLRPCLPS

SEQ ID NO: 147078 - protein, 9 aa, Homo Sapiens
QAIMEATVQ

SEQ ID NO: 147079 - protein, 9 aa, Homo Sapiens
DREPEARPK

SEQ ID NO: 147080 - protein, 9 aa, Homo Sapiens
ASRGHRGAH

SEQ ID NO: 147081 - protein, 9 aa, Homo Sapiens
VLLITVTAL

SEQ ID NO: 147082 - protein, 9 aa, Homo Sapiens
RLQQEFENK

SEQ ID NO: 147083 - protein, 9 aa, Homo Sapiens
VLEVVVVHE

SEQ ID NO: 147084 - protein, 9 aa, Homo Sapiens
TVQQKVTQW

SEQ ID NO: 147085 - protein, 9 aa, Homo Sapiens
FLGIVFRRV

SEQ ID NO: 147086 - protein, 9 aa, Homo Sapiens
DAPSHSPPA

SEQ ID NO: 147087 - protein, 9 aa, Homo Sapiens
GCSHLVSDL

SEQ ID NO: 147088 - protein, 9 aa, Homo Sapiens
NFLQEVWMI

SEQ ID NO: 147089 - protein, 9 aa, Homo Sapiens
SSCWPPGYS

SEQ ID NO: 147090 - protein, 9 aa, Homo Sapiens
TPAPQKIST

SEQ ID NO: 147091 - protein, 9 aa, Homo Sapiens
VTATPRIVN

SEQ ID NO: 147092 - protein, 9 aa, Homo Sapiens
TCTGSGRRP

SEQ ID NO: 147093 - protein, 9 aa, Homo Sapiens
PGPHDDFVA

SEQ ID NO: 147094 - protein, 9 aa, Homo Sapiens
KDKFLPTSL

SEQ ID NO: 147095 - protein, 9 aa, Homo Sapiens
ERFGDRFPV

SEQ ID NO: 147096 - protein, 9 aa, Homo Sapiens
RTWLWRGCG

SEQ ID NO: 147097 - protein, 9 aa, Homo Sapiens
PLPPPPACS

SEQ ID NO: 147098 - protein, 9 aa, Homo Sapiens
NSETGSHQQ

SEQ ID NO: 147099 - protein, 9 aa, Homo Sapiens
MTPPPGPRY

SEQ ID NO: 147100 - protein, 9 aa, Homo Sapiens
ALVAELALV

SEQ ID NO: 147101 - protein, 9 aa, Homo Sapiens
DSTSWCSVK

SEQ ID NO: 147102 - protein, 9 aa, Homo Sapiens
SQPTASWHP

SEQ ID NO: 147103 - protein, 9 aa, Homo Sapiens
QHQRHPGTC

SEQ ID NO: 147104 - protein, 9 aa, Homo Sapiens
AAGLGQLAW

SEQ ID NO: 147105 - protein, 9 aa, Homo Sapiens
VPCLCLEEP

SEQ ID NO: 147106 - protein, 9 aa, Homo Sapiens
PPTEYPVHE

SEQ ID NO: 147107 - protein, 9 aa, Homo Sapiens
LAGVLLLVD

SEQ ID NO: 147108 - protein, 9 aa, Homo Sapiens
DDDEEMNNL

SEQ ID NO: 147109 - protein, 9 aa, Homo Sapiens
CPELPAPRT

SEQ ID NO: 147110 - protein, 9 aa, Homo Sapiens
SPRAPVHNP

SEQ ID NO: 147111 - protein, 9 aa, Homo Sapiens
AYDETTQKF

SEQ ID NO: 147112 - protein, 9 aa, Homo Sapiens
DGIESGHIP

SEQ ID NO: 147113 - protein, 9 aa, Homo Sapiens
DSSPEDCGR

SEQ ID NO: 147114 - protein, 9 aa, Homo Sapiens
YGSLHCAQI

SEQ ID NO: 147115 - protein, 9 aa, Homo Sapiens
LPWGDCYHE

SEQ ID NO: 147116 - protein, 9 aa, Homo Sapiens
PAPRRQRAS

SEQ ID NO: 147117 - protein, 9 aa, Homo Sapiens
PTSAAHHQS

SEQ ID NO: 147118 - protein, 9 aa, Homo Sapiens
PTVCATVAQ

SEQ ID NO: 147119 - protein, 9 aa, Homo Sapiens
PRMAAAAPS

SEQ ID NO: 147120 - protein, 9 aa, Homo Sapiens
ARAWDRNNV

SEQ ID NO: 147121 - protein, 9 aa, Homo Sapiens
LVPAAMMGA

SEQ ID NO: 147122 - protein, 9 aa, Homo Sapiens
SPSSLRRTT

SEQ ID NO: 147123 - protein, 9 aa, Homo Sapiens
KKEEEDQGV

SEQ ID NO: 147124 - protein, 9 aa, Homo Sapiens
VQKRSHLCN

SEQ ID NO: 147125 - protein, 9 aa, Homo Sapiens
QGQRRNYTH

SEQ ID NO: 147126 - protein, 9 aa, Homo Sapiens
WNFQFPPQV

SEQ ID NO: 147127 - protein, 9 aa, Homo Sapiens
GSPIQPRTL

SEQ ID NO: 147128 - protein, 9 aa, Homo Sapiens
GRPPDVLWK

SEQ ID NO: 147129 - protein, 9 aa, Homo Sapiens
TEYGKTVTM

SEQ ID NO: 147130 - protein, 9 aa, Homo Sapiens
SLLCQCPLL

SEQ ID NO: 147131 - protein, 9 aa, Homo Sapiens
CRMHPKVPV

SEQ ID NO: 147132 - protein, 9 aa, Homo Sapiens
TQQPQTPQD

SEQ ID NO: 147133 - protein, 9 aa, Homo Sapiens
QVPGELGTL

SEQ ID NO: 147134 - protein, 9 aa, Homo Sapiens
LRLSTVDAY

SEQ ID NO: 147135 - protein, 9 aa, Homo Sapiens
PLHLGTLRG

SEQ ID NO: 147136 - protein, 9 aa, Homo Sapiens
MVLGGASLG

SEQ ID NO: 147137 - protein, 9 aa, Homo Sapiens
LGVGILNGQ

SEQ ID NO: 147138 - protein, 9 aa, Homo Sapiens
EKQQEEDCT

SEQ ID NO: 147139 - protein, 9 aa, Homo Sapiens
TRPPTPSTC

SEQ ID NO: 147140 - protein, 9 aa, Homo Sapiens
GLTRRSSAL

SEQ ID NO: 147141 - protein, 9 aa, Homo Sapiens
TNLIQLYDA

SEQ ID NO: 147142 - protein, 9 aa, Homo Sapiens
NETWWMCDC

SEQ ID NO: 147143 - protein, 9 aa, Homo Sapiens
PRLLVSRPP

SEQ ID NO: 147144 - protein, 9 aa, Homo Sapiens
VISGCLGTI

SEQ ID NO: 147145 - protein, 9 aa, Homo Sapiens
DSPNGPLGP

SEQ ID NO: 147146 - protein, 9 aa, Homo Sapiens
AVDNKAAAE

SEQ ID NO: 147147 - protein, 9 aa, Homo Sapiens
FHLETLQRT

SEQ ID NO: 147148 - protein, 9 aa, Homo Sapiens
AGCDPRRAL

SEQ ID NO: 147149 - protein, 9 aa, Homo Sapiens
SKTVCFNVL

SEQ ID NO: 147150 - protein, 9 aa, Homo Sapiens
FDVSEAFIS

SEQ ID NO: 147151 - protein, 9 aa, Homo Sapiens
SVAASSLGS

SEQ ID NO: 147152 - protein, 9 aa, Homo Sapiens
TNFLTEMLA

SEQ ID NO: 147153 - protein, 9 aa, Homo Sapiens
MVTLLSTTR

SEQ ID NO: 147154 - protein, 9 aa, Homo Sapiens
KQLGHHIGP

SEQ ID NO: 147155 - protein, 9 aa, Homo Sapiens
TGFPPAVPA

SEQ ID NO: 147156 - protein, 9 aa, Homo Sapiens
GALLRGLGL

SEQ ID NO: 147157 - protein, 9 aa, Homo Sapiens
GAEIWNGMA

SEQ ID NO: 147158 - protein, 9 aa, Homo Sapiens
PLAVLGKTS

SEQ ID NO: 147159 - protein, 9 aa, Homo Sapiens
GKNPYMCKK

SEQ ID NO: 147160 - protein, 9 aa, Homo Sapiens
DPAVCGDHQ

SEQ ID NO: 147161 - protein, 9 aa, Homo Sapiens
TDTMSASTE

SEQ ID NO: 147162 - protein, 9 aa, Homo Sapiens
SSGHTMPTS

SEQ ID NO: 147163 - protein, 9 aa, Homo Sapiens
RMVCGPHGP

SEQ ID NO: 147164 - protein, 9 aa, Homo Sapiens
ADPLVQGGQ

SEQ ID NO: 147165 - protein, 9 aa, Homo Sapiens
LKVPCLSTI

SEQ ID NO: 147166 - protein, 9 aa, Homo Sapiens
QLTGSFFTF

SEQ ID NO: 147167 - protein, 9 aa, Homo Sapiens
LSLYSVAVW

SEQ ID NO: 147168 - protein, 9 aa, Homo Sapiens
LPLSRPINN

SEQ ID NO: 147169 - protein, 9 aa, Homo Sapiens
GQVRHSLGF

SEQ ID NO: 147170 - protein, 9 aa, Homo Sapiens
VVVGFPVTP

SEQ ID NO: 147171 - protein, 9 aa, Homo Sapiens
KRIAYKCCI

SEQ ID NO: 147172 - protein, 9 aa, Homo Sapiens
DEKLTEEAT

SEQ ID NO: 147173 - protein, 9 aa, Homo Sapiens
AATAAGGRT

SEQ ID NO: 147174 - protein, 9 aa, Homo Sapiens
SHYCPELPA

SEQ ID NO: 147175 - protein, 9 aa, Homo Sapiens
TDLTGQKRA

SEQ ID NO: 147176 - protein, 9 aa, Homo Sapiens
MFLEELMAP

SEQ ID NO: 147177 - protein, 9 aa, Homo Sapiens
ASEMAEPPQ

SEQ ID NO: 147178 - protein, 9 aa, Homo Sapiens
LREEEQKQV

SEQ ID NO: 147179 - protein, 9 aa, Homo Sapiens
PVHLPTLFA

SEQ ID NO: 147180 - protein, 9 aa, Homo Sapiens
RRAAHSRVP

SEQ ID NO: 147181 - protein, 9 aa, Homo Sapiens
RCPRCRPRG

SEQ ID NO: 147182 - protein, 9 aa, Homo Sapiens
RKHHLGCVL

SEQ ID NO: 147183 - protein, 9 aa, Homo Sapiens
LPWTELSAG

SEQ ID NO: 147184 - protein, 9 aa, Homo Sapiens
GMHYLYFAI

SEQ ID NO: 147185 - protein, 9 aa, Homo Sapiens
WGPLRCSLP

SEQ ID NO: 147186 - protein, 9 aa, Homo Sapiens
SPASPPTQQ

SEQ ID NO: 147187 - protein, 9 aa, Homo Sapiens
FADQRAEIA

SEQ ID NO: 147188 - protein, 9 aa, Homo Sapiens
APSHNSEKR

SEQ ID NO: 147189 - protein, 9 aa, Homo Sapiens
REHVLEEVI

SEQ ID NO: 147190 - protein, 9 aa, Homo Sapiens
VIINTFCAP

SEQ ID NO: 147191 - protein, 9 aa, Homo Sapiens
LAVHQDVKA

SEQ ID NO: 147192 - protein, 9 aa, Homo Sapiens
LGAASRGHR

SEQ ID NO: 147193 - protein, 9 aa, Homo Sapiens
LHPGITDTA

SEQ ID NO: 147194 - protein, 9 aa, Homo Sapiens
VLCTALNLF

SEQ ID NO: 147195 - protein, 9 aa, Homo Sapiens
NPSSERHSP

SEQ ID NO: 147196 - protein, 9 aa, Homo Sapiens
TGHEDGTVL

SEQ ID NO: 147197 - protein, 9 aa, Homo Sapiens
HAPLHSVGY

SEQ ID NO: 147198 - protein, 9 aa, Homo Sapiens
DYFEAMSRG

SEQ ID NO: 147199 - protein, 9 aa, Homo Sapiens
LKSVPHLHL

SEQ ID NO: 147200 - protein, 9 aa, Homo Sapiens
GKALTRLNL

SEQ ID NO: 147201 - protein, 9 aa, Homo Sapiens
RLIIGQNGV

SEQ ID NO: 147202 - protein, 9 aa, Homo Sapiens
LKSGTHLCR

SEQ ID NO: 147203 - protein, 9 aa, Homo Sapiens
KIHCKSLPP

SEQ ID NO: 147204 - protein, 9 aa, Homo Sapiens
DLDKYEVCI

SEQ ID NO: 147205 - protein, 9 aa, Homo Sapiens
AAARRATLC

SEQ ID NO: 147206 - protein, 9 aa, Homo Sapiens
RRIGATTPP

SEQ ID NO: 147207 - protein, 9 aa, Homo Sapiens
GQLLLLLLL

SEQ ID NO: 147208 - protein, 9 aa, Homo Sapiens
TIGEKTEIQ

SEQ ID NO: 147209 - protein, 9 aa, Homo Sapiens
RTGLRGSWR

SEQ ID NO: 147210 - protein, 9 aa, Homo Sapiens
GPAQAPLHP

SEQ ID NO: 147211 - protein, 9 aa, Homo Sapiens
PTGLYCFPS

SEQ ID NO: 147212 - protein, 9 aa, Homo Sapiens
FLLFPTSYI

SEQ ID NO: 147213 - protein, 9 aa, Homo Sapiens
PRPGHTGDP

SEQ ID NO: 147214 - protein, 9 aa, Homo Sapiens
GSNPHANRQ

SEQ ID NO: 147215 - protein, 9 aa, Homo Sapiens
QLALFYQGP

SEQ ID NO: 147216 - protein, 9 aa, Homo Sapiens
FHQTIRLNP

SEQ ID NO: 147217 - protein, 9 aa, Homo Sapiens
GRQSPSPAA

SEQ ID NO: 147218 - protein, 9 aa, Homo Sapiens
QLYLRRKEP

SEQ ID NO: 147219 - protein, 9 aa, Homo Sapiens
IEYYLRHLE

SEQ ID NO: 147220 - protein, 9 aa, Homo Sapiens
GIFEPSIRG

SEQ ID NO: 147221 - protein, 9 aa, Homo Sapiens
QGSKVANVA

SEQ ID NO: 147222 - protein, 9 aa, Homo Sapiens
GSRRCCLRT

SEQ ID NO: 147223 - protein, 9 aa, Homo Sapiens
PWLNWSSCW

SEQ ID NO: 147224 - protein, 9 aa, Homo Sapiens
FLSWKCLVV

SEQ ID NO: 147225 - protein, 9 aa, Homo Sapiens
APCGRQCLM

SEQ ID NO: 147226 - protein, 9 aa, Homo Sapiens
GGRGGGEGW

SEQ ID NO: 147227 - protein, 9 aa, Homo Sapiens
NPYMCKKCD

SEQ ID NO: 147228 - protein, 9 aa, Homo Sapiens
FWEYKAIET

SEQ ID NO: 147229 - protein, 9 aa, Homo Sapiens
NAYPSSQLL

SEQ ID NO: 147230 - protein, 9 aa, Homo Sapiens
WERSPGHPR

SEQ ID NO: 147231 - protein, 9 aa, Homo Sapiens
MGSFNLSYD

SEQ ID NO: 147232 - protein, 9 aa, Homo Sapiens
TQRPLEMLE

SEQ ID NO: 147233 - protein, 9 aa, Homo Sapiens
NTYFEFETV

SEQ ID NO: 147234 - protein, 9 aa, Homo Sapiens
AAAKMLLRM

SEQ ID NO: 147235 - protein, 9 aa, Homo Sapiens
GASGWSASC

SEQ ID NO: 147236 - protein, 9 aa, Homo Sapiens
LPPHHRRRL

SEQ ID NO: 147237 - protein, 9 aa, Homo Sapiens
SPRLCATTT

SEQ ID NO: 147238 - protein, 9 aa, Homo Sapiens
IPHAKRELA

SEQ ID NO: 147239 - protein, 9 aa, Homo Sapiens
QDEWEIPGS

SEQ ID NO: 147240 - protein, 9 aa, Homo Sapiens
PSVGVPHPP

SEQ ID NO: 147241 - protein, 9 aa, Homo Sapiens
GVCERPAPT

SEQ ID NO: 147242 - protein, 9 aa, Homo Sapiens
SLAQAQPNP

SEQ ID NO: 147243 - protein, 9 aa, Homo Sapiens
GEIVNVASW

SEQ ID NO: 147244 - protein, 9 aa, Homo Sapiens
NIDKAREII

SEQ ID NO: 147245 - protein, 9 aa, Homo Sapiens
YPTQQPPST

SEQ ID NO: 147246 - protein, 9 aa, Homo Sapiens
RDIYELIKR

SEQ ID NO: 147247 - protein, 9 aa, Homo Sapiens
VHEGPSPLL

SEQ ID NO: 147248 - protein, 9 aa, Homo Sapiens
RLKSVPHLH

SEQ ID NO: 147249 - protein, 9 aa, Homo Sapiens
PRVTPGPPP

SEQ ID NO: 147250 - protein, 9 aa, Homo Sapiens
RAAHSRVPS

SEQ ID NO: 147251 - protein, 9 aa, Homo Sapiens
LLKDMQPED

SEQ ID NO: 147252 - protein, 9 aa, Homo Sapiens
THLLLLIAL

SEQ ID NO: 147253 - protein, 9 aa, Homo Sapiens
TFLELADPL

SEQ ID NO: 147254 - protein, 9 aa, Homo Sapiens
ASPPTQQPQ

SEQ ID NO: 147255 - protein, 9 aa, Homo Sapiens
PKALRCIQT

SEQ ID NO: 147256 - protein, 9 aa, Homo Sapiens
EKKCYLHHW

SEQ ID NO: 147257 - protein, 9 aa, Homo Sapiens
PKEPGIYTV

SEQ ID NO: 147258 - protein, 9 aa, Homo Sapiens
VWLLPGMGP

SEQ ID NO: 147259 - protein, 9 aa, Homo Sapiens
KGLEPQAGG

SEQ ID NO: 147260 - protein, 9 aa, Homo Sapiens
QLGGGQGGQ

SEQ ID NO: 147261 - protein, 9 aa, Homo Sapiens
HPVHLPTLF

SEQ ID NO: 147262 - protein, 9 aa, Homo Sapiens
TEKLEKLTV

SEQ ID NO: 147263 - protein, 9 aa, Homo Sapiens
LVVPILLSI

SEQ ID NO: 147264 - protein, 9 aa, Homo Sapiens
ENAMWYING

SEQ ID NO: 147265 - protein, 9 aa, Homo Sapiens
AKCGEGPSA

SEQ ID NO: 147266 - protein, 9 aa, Homo Sapiens
VVHGQHHRC

SEQ ID NO: 147267 - protein, 9 aa, Homo Sapiens
QILCILLRK

SEQ ID NO: 147268 - protein, 9 aa, Homo Sapiens
GGGCARTWL

SEQ ID NO: 147269 - protein, 9 aa, Homo Sapiens
KSETCGSCA

SEQ ID NO: 147270 - protein, 9 aa, Homo Sapiens
PPPELHPLP

SEQ ID NO: 147271 - protein, 9 aa, Homo Sapiens
LGVVDVNAT

SEQ ID NO: 147272 - protein, 9 aa, Homo Sapiens
GGQGGLDLD

SEQ ID NO: 147273 - protein, 9 aa, Homo Sapiens
ASYGMSLNV

SEQ ID NO: 147274 - protein, 9 aa, Homo Sapiens
SSEPLSMTF

SEQ ID NO: 147275 - protein, 9 aa, Homo Sapiens
LEYGADVNA

SEQ ID NO: 147276 - protein, 9 aa, Homo Sapiens
IQDEVLHLI

SEQ ID NO: 147277 - protein, 9 aa, Homo Sapiens
LLNPIETPD

SEQ ID NO: 147278 - protein, 9 aa, Homo Sapiens
LRRLYCSRF

SEQ ID NO: 147279 - protein, 9 aa, Homo Sapiens
GPPCRPPRS

SEQ ID NO: 147280 - protein, 9 aa, Homo Sapiens
CVVREALEK

SEQ ID NO: 147281 - protein, 9 aa, Homo Sapiens
PPPARPPQV

SEQ ID NO: 147282 - protein, 9 aa, Homo Sapiens
FNGICRLKE

SEQ ID NO: 147283 - protein, 9 aa, Homo Sapiens
MTCLQYGIP

SEQ ID NO: 147284 - protein, 9 aa, Homo Sapiens
PDTLCKKKM

SEQ ID NO: 147285 - protein, 9 aa, Homo Sapiens
MEKQALAAC

SEQ ID NO: 147286 - protein, 9 aa, Homo Sapiens
HSHAFLRSC

SEQ ID NO: 147287 - protein, 9 aa, Homo Sapiens
GGGGQWRAQ

SEQ ID NO: 147288 - protein, 9 aa, Homo Sapiens
LAPQPRRPP

SEQ ID NO: 147289 - protein, 9 aa, Homo Sapiens
TSNSSTLRL

SEQ ID NO: 147290 - protein, 9 aa, Homo Sapiens
REVFPGDSK

SEQ ID NO: 147291 - protein, 9 aa, Homo Sapiens
SRRCTVMVL

SEQ ID NO: 147292 - protein, 9 aa, Homo Sapiens
NLESLNGQN

SEQ ID NO: 147293 - protein, 9 aa, Homo Sapiens
EGDFALIPG

SEQ ID NO: 147294 - protein, 9 aa, Homo Sapiens
SSTSTTSAA

SEQ ID NO: 147295 - protein, 9 aa, Homo Sapiens
EKFGDLNPS

SEQ ID NO: 147296 - protein, 9 aa, Homo Sapiens
SPSPAACWM

SEQ ID NO: 147297 - protein, 9 aa, Homo Sapiens
TWRRTGAST

SEQ ID NO: 147298 - protein, 9 aa, Homo Sapiens
RPPGVQQPQ

SEQ ID NO: 147299 - protein, 9 aa, Homo Sapiens
AWVKNAEEL

SEQ ID NO: 147300 - protein, 9 aa, Homo Sapiens
PVCCPRAPE

SEQ ID NO: 147301 - protein, 9 aa, Homo Sapiens
TSSSTGVAV

SEQ ID NO: 147302 - protein, 9 aa, Homo Sapiens
HPPLDIGEG

SEQ ID NO: 147303 - protein, 9 aa, Homo Sapiens
LGGLPLRLG

SEQ ID NO: 147304 - protein, 9 aa, Homo Sapiens
TFQDPTQVR

SEQ ID NO: 147305 - protein, 9 aa, Homo Sapiens
ERALLYQGP

SEQ ID NO: 147306 - protein, 9 aa, Homo Sapiens
PGKPEVEAW

SEQ ID NO: 147307 - protein, 9 aa, Homo Sapiens
ITYPRAVTL

SEQ ID NO: 147308 - protein, 9 aa, Homo Sapiens
SLDDSDVSE

SEQ ID NO: 147309 - protein, 9 aa, Homo Sapiens
QLSTLLGIC

SEQ ID NO: 147310 - protein, 9 aa, Homo Sapiens
TGTQGERLK

SEQ ID NO: 147311 - protein, 9 aa, Homo Sapiens
HQWIRLHFQ

SEQ ID NO: 147312 - protein, 9 aa, Homo Sapiens
WRVTQKAPC

SEQ ID NO: 147313 - protein, 9 aa, Homo Sapiens
SLHSLDKGI

SEQ ID NO: 147314 - protein, 9 aa, Homo Sapiens
WCTTSCDTK

SEQ ID NO: 147315 - protein, 9 aa, Homo Sapiens
LEPADVPVH

SEQ ID NO: 147316 - protein, 9 aa, Homo Sapiens
TVPVDGDAN

SEQ ID NO: 147317 - protein, 9 aa, Homo Sapiens
GCARTWLPR

SEQ ID NO: 147318 - protein, 9 aa, Homo Sapiens
DIMGVPPGA

SEQ ID NO: 147319 - protein, 9 aa, Homo Sapiens
VAGPPCPAL

SEQ ID NO: 147320 - protein, 9 aa, Homo Sapiens
DFVADGALL

SEQ ID NO: 147321 - protein, 9 aa, Homo Sapiens
EATDTVGCC

SEQ ID NO: 147322 - protein, 9 aa, Homo Sapiens
GPQWECELE

SEQ ID NO: 147323 - protein, 9 aa, Homo Sapiens
NIHVIDFHN

SEQ ID NO: 147324 - protein, 9 aa, Homo Sapiens
QPMAAFAAQ

SEQ ID NO: 147325 - protein, 9 aa, Homo Sapiens
HPGSWPVAQ

SEQ ID NO: 147326 - protein, 9 aa, Homo Sapiens
PLQVWLLTE

SEQ ID NO: 147327 - protein, 9 aa, Homo Sapiens
LILSQDTCL

SEQ ID NO: 147328 - protein, 9 aa, Homo Sapiens
MRLGGADPG

SEQ ID NO: 147329 - protein, 9 aa, Homo Sapiens
HSVRAASKE

SEQ ID NO: 147330 - protein, 9 aa, Homo Sapiens
PSPRSRWRH

SEQ ID NO: 147331 - protein, 9 aa, Homo Sapiens
SRASQPSSS

SEQ ID NO: 147332 - protein, 9 aa, Homo Sapiens
LATERSPLP

SEQ ID NO: 147333 - protein, 9 aa, Homo Sapiens
LEPLKCNFD

SEQ ID NO: 147334 - protein, 9 aa, Homo Sapiens
DLDEGCDQW

SEQ ID NO: 147335 - protein, 9 aa, Homo Sapiens
IFWLLHTAG

SEQ ID NO: 147336 - protein, 9 aa, Homo Sapiens
CCAPIALWA

SEQ ID NO: 147337 - protein, 9 aa, Homo Sapiens
ILCRGGHLW

SEQ ID NO: 147338 - protein, 9 aa, Homo Sapiens
EVDTVRVME

SEQ ID NO: 147339 - protein, 9 aa, Homo Sapiens
KVKLYFTKN

SEQ ID NO: 147340 - protein, 9 aa, Homo Sapiens
LGWQAGASG

SEQ ID NO: 147341 - protein, 9 aa, Homo Sapiens
IYTSAMAWA

SEQ ID NO: 147342 - protein, 9 aa, Homo Sapiens
TRLGVVALY

SEQ ID NO: 147343 - protein, 9 aa, Homo Sapiens
DEEKRLMAE

SEQ ID NO: 147344 - protein, 9 aa, Homo Sapiens
EEVTVVGPV

SEQ ID NO: 147345 - protein, 9 aa, Homo Sapiens
TYERLFCWL

SEQ ID NO: 147346 - protein, 9 aa, Homo Sapiens
PPHADDAPA

SEQ ID NO: 147347 - protein, 9 aa, Homo Sapiens
PSTAAWIPA

SEQ ID NO: 147348 - protein, 9 aa, Homo Sapiens
IKGRGKWAR

SEQ ID NO: 147349 - protein, 9 aa, Homo Sapiens
YSFPDLFAL

SEQ ID NO: 147350 - protein, 9 aa, Homo Sapiens
GQQELLHRV

SEQ ID NO: 147351 - protein, 9 aa, Homo Sapiens
VNNWRWTER

SEQ ID NO: 147352 - protein, 9 aa, Homo Sapiens
DVKANPKHL

SEQ ID NO: 147353 - protein, 9 aa, Homo Sapiens
WMRTQLREW

SEQ ID NO: 147354 - protein, 9 aa, Homo Sapiens
CRLQLRSQD

SEQ ID NO: 147355 - protein, 9 aa, Homo Sapiens
HMATMSSAQ

SEQ ID NO: 147356 - protein, 9 aa, Homo Sapiens
IALWAHRVP

SEQ ID NO: 147357 - protein, 9 aa, Homo Sapiens
LFSMEISSG

SEQ ID NO: 147358 - protein, 9 aa, Homo Sapiens
PPPPACSPS

SEQ ID NO: 147359 - protein, 9 aa, Homo Sapiens
SQGMIGHPW

SEQ ID NO: 147360 - protein, 9 aa, Homo Sapiens
HQPKDRCGL

SEQ ID NO: 147361 - protein, 9 aa, Homo Sapiens
VREQQDTYE

SEQ ID NO: 147362 - protein, 9 aa, Homo Sapiens
SSPASSQRW

SEQ ID NO: 147363 - protein, 9 aa, Homo Sapiens
TTCKVPRLH

SEQ ID NO: 147364 - protein, 9 aa, Homo Sapiens
KKHSHKQVE

SEQ ID NO: 147365 - protein, 9 aa, Homo Sapiens
GPITCLEQR

SEQ ID NO: 147366 - protein, 9 aa, Homo Sapiens
APGTDRQQT

SEQ ID NO: 147367 - protein, 9 aa, Homo Sapiens
GMEVWWCAT

SEQ ID NO: 147368 - protein, 9 aa, Homo Sapiens
PGLGQECPE

SEQ ID NO: 147369 - protein, 9 aa, Homo Sapiens
SHTRGVSRR

SEQ ID NO: 147370 - protein, 9 aa, Homo Sapiens
SFFFCLRGH

SEQ ID NO: 147371 - protein, 9 aa, Homo Sapiens
YPSLFLSIH

SEQ ID NO: 147372 - protein, 9 aa, Homo Sapiens
KALGSACIA

SEQ ID NO: 147373 - protein, 9 aa, Homo Sapiens
GKPEVEAWG

SEQ ID NO: 147374 - protein, 9 aa, Homo Sapiens
GEGAWVGAH

SEQ ID NO: 147375 - protein, 9 aa, Homo Sapiens
TSTLGSSPS

SEQ ID NO: 147376 - protein, 9 aa, Homo Sapiens
EYCDFMRGH

SEQ ID NO: 147377 - protein, 9 aa, Homo Sapiens
LSITSSRYI

SEQ ID NO: 147378 - protein, 9 aa, Homo Sapiens
DFALIPGGP

SEQ ID NO: 147379 - protein, 9 aa, Homo Sapiens
YRHIKPISR

SEQ ID NO: 147380 - protein, 9 aa, Homo Sapiens
NLPVPERTM

SEQ ID NO: 147381 - protein, 9 aa, Homo Sapiens
LPGMTGLPR

SEQ ID NO: 147382 - protein, 9 aa, Homo Sapiens
LTGQSYIFR

SEQ ID NO: 147383 - protein, 9 aa, Homo Sapiens
ARSPTSAPT

SEQ ID NO: 147384 - protein, 9 aa, Homo Sapiens
AIGGGGWPG

SEQ ID NO: 147385 - protein, 9 aa, Homo Sapiens
PAASLCVST

SEQ ID NO: 147386 - protein, 9 aa, Homo Sapiens
SGLPHGLWF

SEQ ID NO: 147387 - protein, 9 aa, Homo Sapiens
TSWGPTAGA

SEQ ID NO: 147388 - protein, 9 aa, Homo Sapiens
LKHTMLSEV

SEQ ID NO: 147389 - protein, 9 aa, Homo Sapiens
SKVCVLPTV

SEQ ID NO: 147390 - protein, 9 aa, Homo Sapiens
KSFHSWTSC

SEQ ID NO: 147391 - protein, 9 aa, Homo Sapiens
NVYLKAILR

SEQ ID NO: 147392 - protein, 9 aa, Homo Sapiens
LQYYYQNGC

SEQ ID NO: 147393 - protein, 9 aa, Homo Sapiens
QLTAQLPPQ

SEQ ID NO: 147394 - protein, 9 aa, Homo Sapiens
PINVVIDRG

SEQ ID NO: 147395 - protein, 9 aa, Homo Sapiens
SGTSTVTNS

SEQ ID NO: 147396 - protein, 9 aa, Homo Sapiens
PGMGPHVPR

SEQ ID NO: 147397 - protein, 9 aa, Homo Sapiens
FTFQDPTQV

SEQ ID NO: 147398 - protein, 9 aa, Homo Sapiens
GVCFDILGG

SEQ ID NO: 147399 - protein, 9 aa, Homo Sapiens
PRRQWAQPV

SEQ ID NO: 147400 - protein, 9 aa, Homo Sapiens
LYSSHSQNE

SEQ ID NO: 147401 - protein, 9 aa, Homo Sapiens
TAAHSVTVK

SEQ ID NO: 147402 - protein, 9 aa, Homo Sapiens
SLTSLKKSP

SEQ ID NO: 147403 - protein, 9 aa, Homo Sapiens
PYNVMVIIN

SEQ ID NO: 147404 - protein, 9 aa, Homo Sapiens
GDSGAPPCR

SEQ ID NO: 147405 - protein, 9 aa, Homo Sapiens
ETLTSWSMA

SEQ ID NO: 147406 - protein, 9 aa, Homo Sapiens
FAEGLRCVK

SEQ ID NO: 147407 - protein, 9 aa, Homo Sapiens
YKVPESWFS

SEQ ID NO: 147408 - protein, 9 aa, Homo Sapiens
LFQICYGMH

SEQ ID NO: 147409 - protein, 9 aa, Homo Sapiens
GNFAIMEIQ

SEQ ID NO: 147410 - protein, 9 aa, Homo Sapiens
FTGKYNNSV

SEQ ID NO: 147411 - protein, 9 aa, Homo Sapiens
KNVTKPLNN

SEQ ID NO: 147412 - protein, 9 aa, Homo Sapiens
IFQNISAKQ

SEQ ID NO: 147413 - protein, 9 aa, Homo Sapiens
LLLLGGGCF

SEQ ID NO: 147414 - protein, 9 aa, Homo Sapiens
CKSLPPSPG

SEQ ID NO: 147415 - protein, 9 aa, Homo Sapiens
APASRGAPG

SEQ ID NO: 147416 - protein, 9 aa, Homo Sapiens
PRATGCWGL

SEQ ID NO: 147417 - protein, 9 aa, Homo Sapiens
IGLSGIPGE

SEQ ID NO: 147418 - protein, 9 aa, Homo Sapiens
MKRMCERKN

SEQ ID NO: 147419 - protein, 9 aa, Homo Sapiens
YEEKQKQHI

SEQ ID NO: 147420 - protein, 9 aa, Homo Sapiens
DLSRRLCGI

SEQ ID NO: 147421 - protein, 9 aa, Homo Sapiens
YHYRLDDPD

SEQ ID NO: 147422 - protein, 9 aa, Homo Sapiens
HKKKLEAQV

SEQ ID NO: 147423 - protein, 9 aa, Homo Sapiens
KSMKDHSSG

SEQ ID NO: 147424 - protein, 9 aa, Homo Sapiens
LRVRHGFLQ

SEQ ID NO: 147425 - protein, 9 aa, Homo Sapiens
SLRPGGDVR

SEQ ID NO: 147426 - protein, 9 aa, Homo Sapiens
PPRLPLRPQ

SEQ ID NO: 147427 - protein, 9 aa, Homo Sapiens
SSITRNLMW

SEQ ID NO: 147428 - protein, 9 aa, Homo Sapiens
VSSITRNLM

SEQ ID NO: 147429 - protein, 9 aa, Homo Sapiens
WVKNAEELF

SEQ ID NO: 147430 - protein, 9 aa, Homo Sapiens
FALRVRHGF

SEQ ID NO: 147431 - protein, 9 aa, Homo Sapiens
VPESWFSRS

SEQ ID NO: 147432 - protein, 9 aa, Homo Sapiens
TPPNAAVGS

SEQ ID NO: 147433 - protein, 9 aa, Homo Sapiens
SNVYMVTQG

SEQ ID NO: 147434 - protein, 9 aa, Homo Sapiens
LLDFMNAVK

SEQ ID NO: 147435 - protein, 9 aa, Homo Sapiens
PEPHPNEWE

SEQ ID NO: 147436 - protein, 9 aa, Homo Sapiens
PRYPPHPLS

SEQ ID NO: 147437 - protein, 9 aa, Homo Sapiens
ENKSECYSN

SEQ ID NO: 147438 - protein, 9 aa, Homo Sapiens
LRPAFPVAG

SEQ ID NO: 147439 - protein, 9 aa, Homo Sapiens
ILRVNNKSL

SEQ ID NO: 147440 - protein, 9 aa, Homo Sapiens
LYIVMSYDR

SEQ ID NO: 147441 - protein, 9 aa, Homo Sapiens
LKLEKKSRY

SEQ ID NO: 147442 - protein, 9 aa, Homo Sapiens
PTSYILAVQ

SEQ ID NO: 147443 - protein, 9 aa, Homo Sapiens
SPAACWMAW

SEQ ID NO: 147444 - protein, 9 aa, Homo Sapiens
PGDSEAPME

SEQ ID NO: 147445 - protein, 9 aa, Homo Sapiens
RGWMWQSQA

SEQ ID NO: 147446 - protein, 9 aa, Homo Sapiens
PENYSKKAK

SEQ ID NO: 147447 - protein, 9 aa, Homo Sapiens
GPREVPAAA

SEQ ID NO: 147448 - protein, 9 aa, Homo Sapiens
GLTVCKPGP

SEQ ID NO: 147449 - protein, 9 aa, Homo Sapiens
NNDTSELRK

SEQ ID NO: 147450 - protein, 9 aa, Homo Sapiens
RAATQSRWC

SEQ ID NO: 147451 - protein, 9 aa, Homo Sapiens
TQRWAAGLG

SEQ ID NO: 147452 - protein, 9 aa, Homo Sapiens
TGLLPECFR

SEQ ID NO: 147453 - protein, 9 aa, Homo Sapiens
LEKPALPGT

SEQ ID NO: 147454 - protein, 9 aa, Homo Sapiens
CIWTGQEGL

SEQ ID NO: 147455 - protein, 9 aa, Homo Sapiens
TTSQSQLSS

SEQ ID NO: 147456 - protein, 9 aa, Homo Sapiens
SRMAHPRLP

SEQ ID NO: 147457 - protein, 9 aa, Homo Sapiens
EIPDTQAMS

SEQ ID NO: 147458 - protein, 9 aa, Homo Sapiens
GAPRSPSGP

SEQ ID NO: 147459 - protein, 9 aa, Homo Sapiens
RHPRSPTPT

SEQ ID NO: 147460 - protein, 9 aa, Homo Sapiens
RATSPGAPR

SEQ ID NO: 147461 - protein, 9 aa, Homo Sapiens
CEGSPPSTA

SEQ ID NO: 147462 - protein, 9 aa, Homo Sapiens
LACGLPPCW

SEQ ID NO: 147463 - protein, 9 aa, Homo Sapiens
PGMDYEVTV

SEQ ID NO: 147464 - protein, 9 aa, Homo Sapiens
FRHTRENLH

SEQ ID NO: 147465 - protein, 9 aa, Homo Sapiens
HHGVKEIGT

SEQ ID NO: 147466 - protein, 9 aa, Homo Sapiens
KKKSSKKRC

SEQ ID NO: 147467 - protein, 9 aa, Homo Sapiens
GGTQEVEIG

SEQ ID NO: 147468 - protein, 9 aa, Homo Sapiens
LDTVPPPPL

SEQ ID NO: 147469 - protein, 9 aa, Homo Sapiens
YTVRAGDEN

SEQ ID NO: 147470 - protein, 9 aa, Homo Sapiens
STGTEVQMK

SEQ ID NO: 147471 - protein, 9 aa, Homo Sapiens
CWPSRTTGA

SEQ ID NO: 147472 - protein, 9 aa, Homo Sapiens
HRGAGPPGC

SEQ ID NO: 147473 - protein, 9 aa, Homo Sapiens
AEEFDVSEA

SEQ ID NO: 147474 - protein, 9 aa, Homo Sapiens
SVGTSKGLL

SEQ ID NO: 147475 - protein, 9 aa, Homo Sapiens
KRTSHPCRW

SEQ ID NO: 147476 - protein, 9 aa, Homo Sapiens
CSLPWARHT

SEQ ID NO: 147477 - protein, 9 aa, Homo Sapiens
SSSSILLCS

SEQ ID NO: 147478 - protein, 9 aa, Homo Sapiens
TVVVLRLDG

SEQ ID NO: 147479 - protein, 9 aa, Homo Sapiens
CSLMAPWSL

SEQ ID NO: 147480 - protein, 9 aa, Homo Sapiens
AKAYIDPET

SEQ ID NO: 147481 - protein, 9 aa, Homo Sapiens
CRSCCERMI

SEQ ID NO: 147482 - protein, 9 aa, Homo Sapiens
SMETLKVIN

SEQ ID NO: 147483 - protein, 9 aa, Homo Sapiens
DPDTLCKKK

SEQ ID NO: 147484 - protein, 9 aa, Homo Sapiens
LHRWLQQTT

SEQ ID NO: 147485 - protein, 9 aa, Homo Sapiens
LSAKHVPLS

SEQ ID NO: 147486 - protein, 9 aa, Homo Sapiens
HPNEWEKRR

SEQ ID NO: 147487 - protein, 9 aa, Homo Sapiens
IRNAGLSTG

SEQ ID NO: 147488 - protein, 9 aa, Homo Sapiens
VAQQPHQEA

SEQ ID NO: 147489 - protein, 9 aa, Homo Sapiens
WITQAKDID

SEQ ID NO: 147490 - protein, 9 aa, Homo Sapiens
LKTSLSADI

SEQ ID NO: 147491 - protein, 9 aa, Homo Sapiens
PACCPVCTR

SEQ ID NO: 147492 - protein, 9 aa, Homo Sapiens
TSSRSFLAC

SEQ ID NO: 147493 - protein, 9 aa, Homo Sapiens
VPRCAMAPE

SEQ ID NO: 147494 - protein, 9 aa, Homo Sapiens
GGGWPGWRW

SEQ ID NO: 147495 - protein, 9 aa, Homo Sapiens
EPEEVPQEV

SEQ ID NO: 147496 - protein, 9 aa, Homo Sapiens
TLTSRSGWP

SEQ ID NO: 147497 - protein, 9 aa, Homo Sapiens
LMTLTSSSS

SEQ ID NO: 147498 - protein, 9 aa, Homo Sapiens
CVPTAARPS

SEQ ID NO: 147499 - protein, 9 aa, Homo Sapiens
PSTGSREKR

SEQ ID NO: 147500 - protein, 9 aa, Homo Sapiens
GVEEGPALR

SEQ ID NO: 147501 - protein, 9 aa, Homo Sapiens
AVKWGRNTS

SEQ ID NO: 147502 - protein, 9 aa, Homo Sapiens
AETRPERLL

SEQ ID NO: 147503 - protein, 9 aa, Homo Sapiens
LQRLGVVWG

SEQ ID NO: 147504 - protein, 9 aa, Homo Sapiens
AKKKALFAL

SEQ ID NO: 147505 - protein, 9 aa, Homo Sapiens
SGSGSGLNA

SEQ ID NO: 147506 - protein, 9 aa, Homo Sapiens
HKAHSLLCL

SEQ ID NO: 147507 - protein, 9 aa, Homo Sapiens
LVVQLQALM

SEQ ID NO: 147508 - protein, 9 aa, Homo Sapiens
ERVREDAER

SEQ ID NO: 147509 - protein, 9 aa, Homo Sapiens
MESTPEPHP

SEQ ID NO: 147510 - protein, 9 aa, Homo Sapiens
MGREEESDQ

SEQ ID NO: 147511 - protein, 9 aa, Homo Sapiens
CSWWAQRRR

SEQ ID NO: 147512 - protein, 9 aa, Homo Sapiens
IVVKMEFLS

SEQ ID NO: 147513 - protein, 9 aa, Homo Sapiens
WGEPCDLPV

SEQ ID NO: 147514 - protein, 9 aa, Homo Sapiens
LPSQALQLL

SEQ ID NO: 147515 - protein, 9 aa, Homo Sapiens
HPLGDTPQP

SEQ ID NO: 147516 - protein, 9 aa, Homo Sapiens
DYIAYLSIF

SEQ ID NO: 147517 - protein, 9 aa, Homo Sapiens
SMASLKKQY

SEQ ID NO: 147518 - protein, 9 aa, Homo Sapiens
RGRVRGRDA

SEQ ID NO: 147519 - protein, 9 aa, Homo Sapiens
GPDPPTGIG

SEQ ID NO: 147520 - protein, 9 aa, Homo Sapiens
WRQGGSPVG

SEQ ID NO: 147521 - protein, 9 aa, Homo Sapiens
PTGACCTMQ

SEQ ID NO: 147522 - protein, 9 aa, Homo Sapiens
NELLKHVRE

SEQ ID NO: 147523 - protein, 9 aa, Homo Sapiens
YRCRDCVFR

SEQ ID NO: 147524 - protein, 9 aa, Homo Sapiens
IESYEDNSY

SEQ ID NO: 147525 - protein, 9 aa, Homo Sapiens
DNVSLSPLN

SEQ ID NO: 147526 - protein, 9 aa, Homo Sapiens
PSLGQTFGV

SEQ ID NO: 147527 - protein, 9 aa, Homo Sapiens
CSSASSWSE

SEQ ID NO: 147528 - protein, 9 aa, Homo Sapiens
KAPTPWDAT

SEQ ID NO: 147529 - protein, 9 aa, Homo Sapiens
SHPPTTTTS

SEQ ID NO: 147530 - protein, 9 aa, Homo Sapiens
HPERKTATV

SEQ ID NO: 147531 - protein, 9 aa, Homo Sapiens
SLPAGGRRT

SEQ ID NO: 147532 - protein, 9 aa, Homo Sapiens
QATFRLPRD

SEQ ID NO: 147533 - protein, 9 aa, Homo Sapiens
ASAEYELEN

SEQ ID NO: 147534 - protein, 9 aa, Homo Sapiens
APPGWACGR

SEQ ID NO: 147535 - protein, 9 aa, Homo Sapiens
LIAKNMAAD

SEQ ID NO: 147536 - protein, 9 aa, Homo Sapiens
PPVPFLDCL

SEQ ID NO: 147537 - protein, 9 aa, Homo Sapiens
SELKDQSRR

SEQ ID NO: 147538 - protein, 9 aa, Homo Sapiens
CFQLRVPVL

SEQ ID NO: 147539 - protein, 9 aa, Homo Sapiens
IRRPLIFLP

SEQ ID NO: 147540 - protein, 9 aa, Homo Sapiens
YFTKNSRGA

SEQ ID NO: 147541 - protein, 9 aa, Homo Sapiens
QPRLTEPDI

SEQ ID NO: 147542 - protein, 9 aa, Homo Sapiens
VTMKEDQVM

SEQ ID NO: 147543 - protein, 9 aa, Homo Sapiens
ALGPANAPP

SEQ ID NO: 147544 - protein, 9 aa, Homo Sapiens
ATWLDFLKV

SEQ ID NO: 147545 - protein, 9 aa, Homo Sapiens
GGLGDHDTG

SEQ ID NO: 147546 - protein, 9 aa, Homo Sapiens
DAKNSRTLF

SEQ ID NO: 147547 - protein, 9 aa, Homo Sapiens
PECCSSWLR

SEQ ID NO: 147548 - protein, 9 aa, Homo Sapiens
LDEGTKASG

SEQ ID NO: 147549 - protein, 9 aa, Homo Sapiens
AETTTASNT

SEQ ID NO: 147550 - protein, 9 aa, Homo Sapiens
EANIQLYLS

SEQ ID NO: 147551 - protein, 9 aa, Homo Sapiens
DHRDRMVKH

SEQ ID NO: 147552 - protein, 9 aa, Homo Sapiens
PATTSTGGI

SEQ ID NO: 147553 - protein, 9 aa, Homo Sapiens
WEKENSDRL

SEQ ID NO: 147554 - protein, 9 aa, Homo Sapiens
AMAPETTLW

SEQ ID NO: 147555 - protein, 9 aa, Homo Sapiens
HPSLEIPLK

SEQ ID NO: 147556 - protein, 9 aa, Homo Sapiens
QITELKALV

SEQ ID NO: 147557 - protein, 9 aa, Homo Sapiens
GRTTTCKGS

SEQ ID NO: 147558 - protein, 9 aa, Homo Sapiens
GRGKWARSS

SEQ ID NO: 147559 - protein, 9 aa, Homo Sapiens
AIGPRSCLS

SEQ ID NO: 147560 - protein, 9 aa, Homo Sapiens
KNLSEVARA

SEQ ID NO: 147561 - protein, 9 aa, Homo Sapiens
LEITASAPG

SEQ ID NO: 147562 - protein, 9 aa, Homo Sapiens
EVQIFVIDN

SEQ ID NO: 147563 - protein, 9 aa, Homo Sapiens
GPPLPSSRV

SEQ ID NO: 147564 - protein, 9 aa, Homo Sapiens
VHRQPVQIQ

SEQ ID NO: 147565 - protein, 9 aa, Homo Sapiens
PGLGVLGTQ

SEQ ID NO: 147566 - protein, 9 aa, Homo Sapiens
ELWVVFHKF

SEQ ID NO: 147567 - protein, 9 aa, Homo Sapiens
TRSIFVSIV

SEQ ID NO: 147568 - protein, 9 aa, Homo Sapiens
IVQINPTNV

SEQ ID NO: 147569 - protein, 9 aa, Homo Sapiens
YLLILNAKN

SEQ ID NO: 147570 - protein, 9 aa, Homo Sapiens
ANSATSVDA

SEQ ID NO: 147571 - protein, 9 aa, Homo Sapiens
RGCSYRVLP

SEQ ID NO: 147572 - protein, 9 aa, Homo Sapiens
RGPPLPPPA

SEQ ID NO: 147573 - protein, 9 aa, Homo Sapiens
EYTSGGEVF

SEQ ID NO: 147574 - protein, 9 aa, Homo Sapiens
HKKKARMTR

SEQ ID NO: 147575 - protein, 9 aa, Homo Sapiens
LTLEQLRWE

SEQ ID NO: 147576 - protein, 9 aa, Homo Sapiens
TRRDSWPTR

SEQ ID NO: 147577 - protein, 9 aa, Homo Sapiens
FQNTGAQGR

SEQ ID NO: 147578 - protein, 9 aa, Homo Sapiens
NLRIGNGFE

SEQ ID NO: 147579 - protein, 9 aa, Homo Sapiens
DDFVADGAL

SEQ ID NO: 147580 - protein, 9 aa, Homo Sapiens
LGVDGHTCM

SEQ ID NO: 147581 - protein, 9 aa, Homo Sapiens
ICCVPICSG

SEQ ID NO: 147582 - protein, 9 aa, Homo Sapiens
NMGGSRPEL

SEQ ID NO: 147583 - protein, 9 aa, Homo Sapiens
SFNLTLKQV

SEQ ID NO: 147584 - protein, 9 aa, Homo Sapiens
DVGGRGQSA

SEQ ID NO: 147585 - protein, 9 aa, Homo Sapiens
TFCSSSTYV

SEQ ID NO: 147586 - protein, 9 aa, Homo Sapiens
GRAQTTCIA

SEQ ID NO: 147587 - protein, 9 aa, Homo Sapiens
PTPPQDRPS

SEQ ID NO: 147588 - protein, 9 aa, Homo Sapiens
GGGSWSSAS

SEQ ID NO: 147589 - protein, 9 aa, Homo Sapiens
YLLPLLSCH

SEQ ID NO: 147590 - protein, 9 aa, Homo Sapiens
CARTWLPRA

SEQ ID NO: 147591 - protein, 9 aa, Homo Sapiens
GPRSCLSSR

SEQ ID NO: 147592 - protein, 9 aa, Homo Sapiens
QQQEEALKQ

SEQ ID NO: 147593 - protein, 9 aa, Homo Sapiens
KITPVIDQG

SEQ ID NO: 147594 - protein, 9 aa, Homo Sapiens
LSLADTTRT

SEQ ID NO: 147595 - protein, 9 aa, Homo Sapiens
EENAGNELL

SEQ ID NO: 147596 - protein, 9 aa, Homo Sapiens
YVLSINEEE

SEQ ID NO: 147597 - protein, 9 aa, Homo Sapiens
RPGLSAPGT

SEQ ID NO: 147598 - protein, 9 aa, Homo Sapiens
FLLPGQPMA

SEQ ID NO: 147599 - protein, 9 aa, Homo Sapiens
GLGGAPGGG

SEQ ID NO: 147600 - protein, 9 aa, Homo Sapiens
PLSTTSAAS

SEQ ID NO: 147601 - protein, 9 aa, Homo Sapiens
CAGAWGLLP

SEQ ID NO: 147602 - protein, 9 aa, Homo Sapiens
RTQRWAAGL

SEQ ID NO: 147603 - protein, 9 aa, Homo Sapiens
LLQTPLGLV

SEQ ID NO: 147604 - protein, 9 aa, Homo Sapiens
HVTFYFAGV

SEQ ID NO: 147605 - protein, 9 aa, Homo Sapiens
PPHSAAHGP

SEQ ID NO: 147606 - protein, 9 aa, Homo Sapiens
PRSPWAWCA

SEQ ID NO: 147607 - protein, 9 aa, Homo Sapiens
LLGICNGGL

SEQ ID NO: 147608 - protein, 9 aa, Homo Sapiens
GGEGGRGGG

SEQ ID NO: 147609 - protein, 9 aa, Homo Sapiens
YMVICDPLH

SEQ ID NO: 147610 - protein, 9 aa, Homo Sapiens
LLPLLLLPT

SEQ ID NO: 147611 - protein, 9 aa, Homo Sapiens
ATYERLFCW

SEQ ID NO: 147612 - protein, 9 aa, Homo Sapiens
EEVCEHVKL

SEQ ID NO: 147613 - protein, 9 aa, Homo Sapiens
GSLHCAQIQ

SEQ ID NO: 147614 - protein, 9 aa, Homo Sapiens
EKFDLIWNW

SEQ ID NO: 147615 - protein, 9 aa, Homo Sapiens
CTRYTPKQD

SEQ ID NO: 147616 - protein, 9 aa, Homo Sapiens
HLPTLFALS

SEQ ID NO: 147617 - protein, 9 aa, Homo Sapiens
GIEGLGTDI

SEQ ID NO: 147618 - protein, 9 aa, Homo Sapiens
RLFLGWTVC

SEQ ID NO: 147619 - protein, 9 aa, Homo Sapiens
RDLSLCAPQ

SEQ ID NO: 147620 - protein, 9 aa, Homo Sapiens
PAHLASAVA

SEQ ID NO: 147621 - protein, 9 aa, Homo Sapiens
QQAETRPER

SEQ ID NO: 147622 - protein, 9 aa, Homo Sapiens
VLGGMEVWW

SEQ ID NO: 147623 - protein, 9 aa, Homo Sapiens
KRLAIPCKL

SEQ ID NO: 147624 - protein, 9 aa, Homo Sapiens
VDLTSWDGA

SEQ ID NO: 147625 - protein, 9 aa, Homo Sapiens
RRFKCLRTH

SEQ ID NO: 147626 - protein, 9 aa, Homo Sapiens
INKDHKLCT

SEQ ID NO: 147627 - protein, 9 aa, Homo Sapiens
ITMRDEERI

SEQ ID NO: 147628 - protein, 9 aa, Homo Sapiens
PLSISGSPA

SEQ ID NO: 147629 - protein, 9 aa, Homo Sapiens
QKETTCQRQ

SEQ ID NO: 147630 - protein, 9 aa, Homo Sapiens
GGRRTAPER

SEQ ID NO: 147631 - protein, 9 aa, Homo Sapiens
SMKEGCSFL

SEQ ID NO: 147632 - protein, 9 aa, Homo Sapiens
STSGICSPT

SEQ ID NO: 147633 - protein, 9 aa, Homo Sapiens
PEEGRCGRR

SEQ ID NO: 147634 - protein, 9 aa, Homo Sapiens
MVYMKHTYM

SEQ ID NO: 147635 - protein, 9 aa, Homo Sapiens
ATTSSPEAS

SEQ ID NO: 147636 - protein, 9 aa, Homo Sapiens
FSSVTLVFP

SEQ ID NO: 147637 - protein, 9 aa, Homo Sapiens
PFWEDEEKM

SEQ ID NO: 147638 - protein, 9 aa, Homo Sapiens
DSDVSEPAK

SEQ ID NO: 147639 - protein, 9 aa, Homo Sapiens
RVLLHFQRK

SEQ ID NO: 147640 - protein, 9 aa, Homo Sapiens
VNLKWPWAS

SEQ ID NO: 147641 - protein, 9 aa, Homo Sapiens
WTFSYYQIF

SEQ ID NO: 147642 - protein, 9 aa, Homo Sapiens
KDEHILQFL

SEQ ID NO: 147643 - protein, 9 aa, Homo Sapiens
GLVPPPKSP

SEQ ID NO: 147644 - protein, 9 aa, Homo Sapiens
HLCCILVAL

SEQ ID NO: 147645 - protein, 9 aa, Homo Sapiens
RRPGLGVLG

SEQ ID NO: 147646 - protein, 9 aa, Homo Sapiens
AWKASRRSS

SEQ ID NO: 147647 - protein, 9 aa, Homo Sapiens
SVRGCSYRV

SEQ ID NO: 147648 - protein, 9 aa, Homo Sapiens
TREPLTKQL

SEQ ID NO: 147649 - protein, 9 aa, Homo Sapiens
SWGTVWDDS

SEQ ID NO: 147650 - protein, 9 aa, Homo Sapiens
ANIAIPQCW

SEQ ID NO: 147651 - protein, 9 aa, Homo Sapiens
ISQGMIGHP

SEQ ID NO: 147652 - protein, 9 aa, Homo Sapiens
ESTPEPHPN

SEQ ID NO: 147653 - protein, 9 aa, Homo Sapiens
SGTQVTTQI

SEQ ID NO: 147654 - protein, 9 aa, Homo Sapiens
TTSVVTRIV

SEQ ID NO: 147655 - protein, 9 aa, Homo Sapiens
IDGPPGKPG

SEQ ID NO: 147656 - protein, 9 aa, Homo Sapiens
RRSPRSCSP

SEQ ID NO: 147657 - protein, 9 aa, Homo Sapiens
QPKDRCGLI

SEQ ID NO: 147658 - protein, 9 aa, Homo Sapiens
NFPRPPPAS

SEQ ID NO: 147659 - protein, 9 aa, Homo Sapiens
PGSTRAAAD

SEQ ID NO: 147660 - protein, 9 aa, Homo Sapiens
TVAPRWWKR

SEQ ID NO: 147661 - protein, 9 aa, Homo Sapiens
PESCTGPPR

SEQ ID NO: 147662 - protein, 9 aa, Homo Sapiens
PPPAAAALD

SEQ ID NO: 147663 - protein, 9 aa, Homo Sapiens
PPLQPQATG

SEQ ID NO: 147664 - protein, 9 aa, Homo Sapiens
DDEEGLKHF

SEQ ID NO: 147665 - protein, 9 aa, Homo Sapiens
RIFASLHVS

SEQ ID NO: 147666 - protein, 9 aa, Homo Sapiens
GEEEKKEEE

SEQ ID NO: 147667 - protein, 9 aa, Homo Sapiens
QGSRPCHSL

SEQ ID NO: 147668 - protein, 9 aa, Homo Sapiens
CRTGASTRA

SEQ ID NO: 147669 - protein, 9 aa, Homo Sapiens
ILCFLTIHS

SEQ ID NO: 147670 - protein, 9 aa, Homo Sapiens
TISRFWALA

SEQ ID NO: 147671 - protein, 9 aa, Homo Sapiens
NVPWEFGDI

SEQ ID NO: 147672 - protein, 9 aa, Homo Sapiens
VLWLLFVVM

SEQ ID NO: 147673 - protein, 9 aa, Homo Sapiens
FILERNPTN

SEQ ID NO: 147674 - protein, 9 aa, Homo Sapiens
LLHTAGTQN

SEQ ID NO: 147675 - protein, 9 aa, Homo Sapiens
DTADAVAAT

SEQ ID NO: 147676 - protein, 9 aa, Homo Sapiens
PASKNRVHP

SEQ ID NO: 147677 - protein, 9 aa, Homo Sapiens
QREALVLGL

SEQ ID NO: 147678 - protein, 9 aa, Homo Sapiens
MLCNLNEFR

SEQ ID NO: 147679 - protein, 9 aa, Homo Sapiens
AAKDYQWED

SEQ ID NO: 147680 - protein, 9 aa, Homo Sapiens
AIRCFGVYV

SEQ ID NO: 147681 - protein, 9 aa, Homo Sapiens
EDSKIMISE

SEQ ID NO: 147682 - protein, 9 aa, Homo Sapiens
STSWGPTAG

SEQ ID NO: 147683 - protein, 9 aa, Homo Sapiens
GRGQSAKSG

SEQ ID NO: 147684 - protein, 9 aa, Homo Sapiens
RGAPGSHLC

SEQ ID NO: 147685 - protein, 9 aa, Homo Sapiens
RIHFCPVHR

SEQ ID NO: 147686 - protein, 9 aa, Homo Sapiens
TWLRGSLEW

SEQ ID NO: 147687 - protein, 9 aa, Homo Sapiens
ANTVKASPP

SEQ ID NO: 147688 - protein, 9 aa, Homo Sapiens
AFPKLVQIL

SEQ ID NO: 147689 - protein, 9 aa, Homo Sapiens
IRGPNPIKL

SEQ ID NO: 147690 - protein, 9 aa, Homo Sapiens
RRPPMRVCP

SEQ ID NO: 147691 - protein, 9 aa, Homo Sapiens
KWGPTSQQI

SEQ ID NO: 147692 - protein, 9 aa, Homo Sapiens
GGVFHFLDT

SEQ ID NO: 147693 - protein, 9 aa, Homo Sapiens
EDHRDRMVK

SEQ ID NO: 147694 - protein, 9 aa, Homo Sapiens
IPLRQTRFS

SEQ ID NO: 147695 - protein, 9 aa, Homo Sapiens
NSCTMVLEG

SEQ ID NO: 147696 - protein, 9 aa, Homo Sapiens
AGGGGSWSS

SEQ ID NO: 147697 - protein, 9 aa, Homo Sapiens
KRSRTQGSR

SEQ ID NO: 147698 - protein, 9 aa, Homo Sapiens
VRTAPLLAD

SEQ ID NO: 147699 - protein, 9 aa, Homo Sapiens
VLAWVKNAE

SEQ ID NO: 147700 - protein, 9 aa, Homo Sapiens
CCPGYSGRP

SEQ ID NO: 147701 - protein, 9 aa, Homo Sapiens
WMWQSQAPA

SEQ ID NO: 147702 - protein, 9 aa, Homo Sapiens
LLGMCEGES

SEQ ID NO: 147703 - protein, 9 aa, Homo Sapiens
QTVPEGAAA

SEQ ID NO: 147704 - protein, 9 aa, Homo Sapiens
HLCLYCDKL

SEQ ID NO: 147705 - protein, 9 aa, Homo Sapiens
SLMQAHLLI

SEQ ID NO: 147706 - protein, 9 aa, Homo Sapiens
CTARPLLAW

SEQ ID NO: 147707 - protein, 9 aa, Homo Sapiens
RCEIKGREA

SEQ ID NO: 147708 - protein, 9 aa, Homo Sapiens
DLSMKEGCS

SEQ ID NO: 147709 - protein, 9 aa, Homo Sapiens
PTTIIWTLN

SEQ ID NO: 147710 - protein, 9 aa, Homo Sapiens
NIRAKMLHR

SEQ ID NO: 147711 - protein, 9 aa, Homo Sapiens
MQRLLEHPC

SEQ ID NO: 147712 - protein, 9 aa, Homo Sapiens
TFPICCFQA

SEQ ID NO: 147713 - protein, 9 aa, Homo Sapiens
RRFVAKKAL

SEQ ID NO: 147714 - protein, 9 aa, Homo Sapiens
ERLKNPLKT

SEQ ID NO: 147715 - protein, 9 aa, Homo Sapiens
TTCKGSTPT

SEQ ID NO: 147716 - protein, 9 aa, Homo Sapiens
CCVPICSGA

SEQ ID NO: 147717 - protein, 9 aa, Homo Sapiens
SMEMIYVKI

SEQ ID NO: 147718 - protein, 9 aa, Homo Sapiens
LGICNGGLQ

SEQ ID NO: 147719 - protein, 9 aa, Homo Sapiens
PKVEVMNKR

SEQ ID NO: 147720 - protein, 9 aa, Homo Sapiens
PTMKMLERS

SEQ ID NO: 147721 - protein, 9 aa, Homo Sapiens
KALDLASEF

SEQ ID NO: 147722 - protein, 9 aa, Homo Sapiens
PLTAKKKAL

SEQ ID NO: 147723 - protein, 9 aa, Homo Sapiens
RTPSGCTAK

SEQ ID NO: 147724 - protein, 9 aa, Homo Sapiens
LYFRGRLPR

SEQ ID NO: 147725 - protein, 9 aa, Homo Sapiens
IAYKCCITC

SEQ ID NO: 147726 - protein, 9 aa, Homo Sapiens
TQPRPALLK

SEQ ID NO: 147727 - protein, 9 aa, Homo Sapiens
ARGYAVSSH

SEQ ID NO: 147728 - protein, 9 aa, Homo Sapiens
TVTALTFSA

SEQ ID NO: 147729 - protein, 9 aa, Homo Sapiens
AVVKVPSGV

SEQ ID NO: 147730 - protein, 9 aa, Homo Sapiens
AASAPCWAP

SEQ ID NO: 147731 - protein, 9 aa, Homo Sapiens
ATPAAAAPG

SEQ ID NO: 147732 - protein, 9 aa, Homo Sapiens
EHGEISSCD

SEQ ID NO: 147733 - protein, 9 aa, Homo Sapiens
VKKNYSTLQ

SEQ ID NO: 147734 - protein, 9 aa, Homo Sapiens
NPRPWPPPS

SEQ ID NO: 147735 - protein, 9 aa, Homo Sapiens
NTTGTSIGD

SEQ ID NO: 147736 - protein, 9 aa, Homo Sapiens
QECHQQPPV

SEQ ID NO: 147737 - protein, 9 aa, Homo Sapiens
CRRHCPRCP

SEQ ID NO: 147738 - protein, 9 aa, Homo Sapiens
LLKHVRETE

SEQ ID NO: 147739 - protein, 9 aa, Homo Sapiens
EAKKAYPSE

SEQ ID NO: 147740 - protein, 9 aa, Homo Sapiens
EPGIYTVWV

SEQ ID NO: 147741 - protein, 9 aa, Homo Sapiens
QKLGRWCAV

SEQ ID NO: 147742 - protein, 9 aa, Homo Sapiens
SPGGGEGML

SEQ ID NO: 147743 - protein, 9 aa, Homo Sapiens
TKTAYTTGA

SEQ ID NO: 147744 - protein, 9 aa, Homo Sapiens
RKRNLSNMT

SEQ ID NO: 147745 - protein, 9 aa, Homo Sapiens
LAFITYPRA

SEQ ID NO: 147746 - protein, 9 aa, Homo Sapiens
TSGSTPGSG

SEQ ID NO: 147747 - protein, 9 aa, Homo Sapiens
YVLWLLFVV

SEQ ID NO: 147748 - protein, 9 aa, Homo Sapiens
RPAVASRST

SEQ ID NO: 147749 - protein, 9 aa, Homo Sapiens
STPAKMEPL

SEQ ID NO: 147750 - protein, 9 aa, Homo Sapiens
RSHQPKDRC

SEQ ID NO: 147751 - protein, 9 aa, Homo Sapiens
LLDAELLGG

SEQ ID NO: 147752 - protein, 9 aa, Homo Sapiens
RNTNTPGSA

SEQ ID NO: 147753 - protein, 9 aa, Homo Sapiens
GTSGWRGAR

SEQ ID NO: 147754 - protein, 9 aa, Homo Sapiens
VLKEGLSGD

SEQ ID NO: 147755 - protein, 9 aa, Homo Sapiens
AGVIHANTH

SEQ ID NO: 147756 - protein, 9 aa, Homo Sapiens
LDLVHALSL

SEQ ID NO: 147757 - protein, 9 aa, Homo Sapiens
HTGMHRHTH

SEQ ID NO: 147758 - protein, 9 aa, Homo Sapiens
PTQQLAWPD

SEQ ID NO: 147759 - protein, 9 aa, Homo Sapiens
ISQYLSGVG

SEQ ID NO: 147760 - protein, 9 aa, Homo Sapiens
IIEYYLRHL

SEQ ID NO: 147761 - protein, 9 aa, Homo Sapiens
PSQQAETRP

SEQ ID NO: 147762 - protein, 9 aa, Homo Sapiens
PGGGEGMLH

SEQ ID NO: 147763 - protein, 9 aa, Homo Sapiens
KNRVHPPLD

SEQ ID NO: 147764 - protein, 9 aa, Homo Sapiens
HLGAASRGH

SEQ ID NO: 147765 - protein, 9 aa, Homo Sapiens
GGRELSELV

SEQ ID NO: 147766 - protein, 9 aa, Homo Sapiens
LQARTGTSS

SEQ ID NO: 147767 - protein, 9 aa, Homo Sapiens
DPRPLTVMA

SEQ ID NO: 147768 - protein, 9 aa, Homo Sapiens
TLEAARSRD

SEQ ID NO: 147769 - protein, 9 aa, Homo Sapiens
LQPQATGRR

SEQ ID NO: 147770 - protein, 9 aa, Homo Sapiens
LRCVKPNSR

SEQ ID NO: 147771 - protein, 9 aa, Homo Sapiens
ASSHHGSRG

SEQ ID NO: 147772 - protein, 9 aa, Homo Sapiens
RYQGKNTYP

SEQ ID NO: 147773 - protein, 9 aa, Homo Sapiens
KLKQGCLKR

SEQ ID NO: 147774 - protein, 9 aa, Homo Sapiens
HGEEVVVSA

SEQ ID NO: 147775 - protein, 9 aa, Homo Sapiens
AYLAACRMH

SEQ ID NO: 147776 - protein, 9 aa, Homo Sapiens
STPSSRPST

SEQ ID NO: 147777 - protein, 9 aa, Homo Sapiens
EDCYFFSIL

SEQ ID NO: 147778 - protein, 9 aa, Homo Sapiens
DVLVVGTTS

SEQ ID NO: 147779 - protein, 9 aa, Homo Sapiens
KFGFATLTS

SEQ ID NO: 147780 - protein, 9 aa, Homo Sapiens
LAQAPIPWL

SEQ ID NO: 147781 - protein, 9 aa, Homo Sapiens
AQTVAPRWW

SEQ ID NO: 147782 - protein, 9 aa, Homo Sapiens
RLPVSVWLQ

SEQ ID NO: 147783 - protein, 9 aa, Homo Sapiens
NMTDVSTAF

SEQ ID NO: 147784 - protein, 9 aa, Homo Sapiens
LTGCLSFPS

SEQ ID NO: 147785 - protein, 9 aa, Homo Sapiens
LRLRLQLQL

SEQ ID NO: 147786 - protein, 9 aa, Homo Sapiens
PRHPRSPTP

SEQ ID NO: 147787 - protein, 9 aa, Homo Sapiens
LRLLGFIHP

SEQ ID NO: 147788 - protein, 9 aa, Homo Sapiens
CFLNIRAKM

SEQ ID NO: 147789 - protein, 9 aa, Homo Sapiens
FLHHHLMVA

SEQ ID NO: 147790 - protein, 9 aa, Homo Sapiens
FQNLADCLQ

SEQ ID NO: 147791 - protein, 9 aa, Homo Sapiens
YYYQNGCLY

SEQ ID NO: 147792 - protein, 9 aa, Homo Sapiens
PKDEHILQF

SEQ ID NO: 147793 - protein, 9 aa, Homo Sapiens
STQKKMFML

SEQ ID NO: 147794 - protein, 9 aa, Homo Sapiens
LTSELALCK

SEQ ID NO: 147795 - protein, 9 aa, Homo Sapiens
LCTCTVWTT

SEQ ID NO: 147796 - protein, 9 aa, Homo Sapiens
QQTTGCSQR

SEQ ID NO: 147797 - protein, 9 aa, Homo Sapiens
LMQMREFKP

SEQ ID NO: 147798 - protein, 9 aa, Homo Sapiens
VPGSGAPPP

SEQ ID NO: 147799 - protein, 9 aa, Homo Sapiens
ATVQNNWQV

SEQ ID NO: 147800 - protein, 9 aa, Homo Sapiens
SSSVWSSAA

SEQ ID NO: 147801 - protein, 9 aa, Homo Sapiens
YTSGGEVFD

SEQ ID NO: 147802 - protein, 9 aa, Homo Sapiens
QFNCIGCAR

SEQ ID NO: 147803 - protein, 9 aa, Homo Sapiens
RNELLKHVR

SEQ ID NO: 147804 - protein, 9 aa, Homo Sapiens
NMRHLWRPD

SEQ ID NO: 147805 - protein, 9 aa, Homo Sapiens
LVIVESGIL

SEQ ID NO: 147806 - protein, 9 aa, Homo Sapiens
PRLGPRPHS

SEQ ID NO: 147807 - protein, 9 aa, Homo Sapiens
IINTFCAPC

SEQ ID NO: 147808 - protein, 9 aa, Homo Sapiens
RKHRSSTPK

SEQ ID NO: 147809 - protein, 9 aa, Homo Sapiens
PGRNAWWLQ

SEQ ID NO: 147810 - protein, 9 aa, Homo Sapiens
VLRWIIEVV

SEQ ID NO: 147811 - protein, 9 aa, Homo Sapiens
IQAKGYRPT

SEQ ID NO: 147812 - protein, 9 aa, Homo Sapiens
TEIVCWFKE

SEQ ID NO: 147813 - protein, 9 aa, Homo Sapiens
QRMEKAARE

SEQ ID NO: 147814 - protein, 9 aa, Homo Sapiens
PSEEQGGRG

SEQ ID NO: 147815 - protein, 9 aa, Homo Sapiens
ADYTNDDLN

SEQ ID NO: 147816 - protein, 9 aa, Homo Sapiens
AARGHGAPR

SEQ ID NO: 147817 - protein, 9 aa, Homo Sapiens
LRTRVQKEG

SEQ ID NO: 147818 - protein, 9 aa, Homo Sapiens
RSLQNLVEA

SEQ ID NO: 147819 - protein, 9 aa, Homo Sapiens
PQRPSTVPL

SEQ ID NO: 147820 - protein, 9 aa, Homo Sapiens
SSGLEITAS

SEQ ID NO: 147821 - protein, 9 aa, Homo Sapiens
TCPGPSWHP

SEQ ID NO: 147822 - protein, 9 aa, Homo Sapiens
TRHEEIFYV

SEQ ID NO: 147823 - protein, 9 aa, Homo Sapiens
MYMTMRNAT

SEQ ID NO: 147824 - protein, 9 aa, Homo Sapiens
LFVQPMELI

SEQ ID NO: 147825 - protein, 9 aa, Homo Sapiens
GKGTEVPWP

SEQ ID NO: 147826 - protein, 9 aa, Homo Sapiens
KIIESYEDN

SEQ ID NO: 147827 - protein, 9 aa, Homo Sapiens
RCFLEKMED

SEQ ID NO: 147828 - protein, 9 aa, Homo Sapiens
SADRDSSPI

SEQ ID NO: 147829 - protein, 9 aa, Homo Sapiens
GIRCPPAAW

SEQ ID NO: 147830 - protein, 9 aa, Homo Sapiens
RIGATTPPI

SEQ ID NO: 147831 - protein, 9 aa, Homo Sapiens
DPAMAHPSL

SEQ ID NO: 147832 - protein, 9 aa, Homo Sapiens
MAQLTAAAA

SEQ ID NO: 147833 - protein, 9 aa, Homo Sapiens
LEEVIREGW

SEQ ID NO: 147834 - protein, 9 aa, Homo Sapiens
SHISYVPPS

SEQ ID NO: 147835 - protein, 9 aa, Homo Sapiens
ALAPRAPAP

SEQ ID NO: 147836 - protein, 9 aa, Homo Sapiens
ETEQNKKRQ

SEQ ID NO: 147837 - protein, 9 aa, Homo Sapiens
DCCLCCCCY

SEQ ID NO: 147838 - protein, 9 aa, Homo Sapiens
TVTILGQEA

SEQ ID NO: 147839 - protein, 9 aa, Homo Sapiens
ILDDVDISV

SEQ ID NO: 147840 - protein, 9 aa, Homo Sapiens
FVADGALLR

SEQ ID NO: 147841 - protein, 9 aa, Homo Sapiens
FFQLKTSLS

SEQ ID NO: 147842 - protein, 9 aa, Homo Sapiens
HARVDAHVV

SEQ ID NO: 147843 - protein, 9 aa, Homo Sapiens
PSAGRTSAR

SEQ ID NO: 147844 - protein, 9 aa, Homo Sapiens
DVKLDPAMA

SEQ ID NO: 147845 - protein, 9 aa, Homo Sapiens
THALDGLYR

SEQ ID NO: 147846 - protein, 9 aa, Homo Sapiens
RGEIVNVAS

SEQ ID NO: 147847 - protein, 9 aa, Homo Sapiens
LLLLIALPS

SEQ ID NO: 147848 - protein, 9 aa, Homo Sapiens
RAAARPTPR

SEQ ID NO: 147849 - protein, 9 aa, Homo Sapiens
KNLNSRDIK

SEQ ID NO: 147850 - protein, 9 aa, Homo Sapiens
TPAQTEQHP

SEQ ID NO: 147851 - protein, 9 aa, Homo Sapiens
PPPASKNRV

SEQ ID NO: 147852 - protein, 9 aa, Homo Sapiens
RGGGRGWMW

SEQ ID NO: 147853 - protein, 9 aa, Homo Sapiens
RALSGGDSV

SEQ ID NO: 147854 - protein, 9 aa, Homo Sapiens
RAVGQLQAR

SEQ ID NO: 147855 - protein, 9 aa, Homo Sapiens
GLRGGVRVK

SEQ ID NO: 147856 - protein, 9 aa, Homo Sapiens
LRPGGDVRE

SEQ ID NO: 147857 - protein, 9 aa, Homo Sapiens
QLTLPPPPR

SEQ ID NO: 147858 - protein, 9 aa, Homo Sapiens
RTTSAGTVS

SEQ ID NO: 147859 - protein, 9 aa, Homo Sapiens
GGPDSTPRG

SEQ ID NO: 147860 - protein, 9 aa, Homo Sapiens
PPRAREKLT

SEQ ID NO: 147861 - protein, 9 aa, Homo Sapiens
TEGEEEKKE

SEQ ID NO: 147862 - protein, 9 aa, Homo Sapiens
HTDTHTGIH

SEQ ID NO: 147863 - protein, 9 aa, Homo Sapiens
PLWRVTQKA

SEQ ID NO: 147864 - protein, 9 aa, Homo Sapiens
MKKNLRIGN

SEQ ID NO: 147865 - protein, 9 aa, Homo Sapiens
GDLPCASRA

SEQ ID NO: 147866 - protein, 9 aa, Homo Sapiens
GYQPRRNFG

SEQ ID NO: 147867 - protein, 9 aa, Homo Sapiens
IPEEVCEHV

SEQ ID NO: 147868 - protein, 9 aa, Homo Sapiens
ARQVFLRQE

SEQ ID NO: 147869 - protein, 9 aa, Homo Sapiens
LVQGGQGGL

SEQ ID NO: 147870 - protein, 9 aa, Homo Sapiens
RLDASHISY

SEQ ID NO: 147871 - protein, 9 aa, Homo Sapiens
DPIEAPPPS

SEQ ID NO: 147872 - protein, 9 aa, Homo Sapiens
VRKHHLGCV

SEQ ID NO: 147873 - protein, 9 aa, Homo Sapiens
RVLPSPSMW

SEQ ID NO: 147874 - protein, 9 aa, Homo Sapiens
ENLEKIHKR

SEQ ID NO: 147875 - protein, 9 aa, Homo Sapiens
VKEEMKKTT

SEQ ID NO: 147876 - protein, 9 aa, Homo Sapiens
HPPSSTPCT

SEQ ID NO: 147877 - protein, 9 aa, Homo Sapiens
GRPSNFAQN

SEQ ID NO: 147878 - protein, 9 aa, Homo Sapiens
SRYILSREF

SEQ ID NO: 147879 - protein, 9 aa, Homo Sapiens
NIQGGRPSP

SEQ ID NO: 147880 - protein, 9 aa, Homo Sapiens
EEAKNILAS

SEQ ID NO: 147881 - protein, 9 aa, Homo Sapiens
RLFWVASKT

SEQ ID NO: 147882 - protein, 9 aa, Homo Sapiens
LSCLSVLGG

SEQ ID NO: 147883 - protein, 9 aa, Homo Sapiens
TPKQDTMTF

SEQ ID NO: 147884 - protein, 9 aa, Homo Sapiens
APSSPRSRG

SEQ ID NO: 147885 - protein, 9 aa, Homo Sapiens
DLTSWDGAW

SEQ ID NO: 147886 - protein, 9 aa, Homo Sapiens
HGPYPAASA

SEQ ID NO: 147887 - protein, 9 aa, Homo Sapiens
DAQCKQDHQ

SEQ ID NO: 147888 - protein, 9 aa, Homo Sapiens
MEKNGNTVL

SEQ ID NO: 147889 - protein, 9 aa, Homo Sapiens
RWMSSEVTR

SEQ ID NO: 147890 - protein, 9 aa, Homo Sapiens
NISAKQRLS

SEQ ID NO: 147891 - protein, 9 aa, Homo Sapiens
EEEDQGVWQ

SEQ ID NO: 147892 - protein, 9 aa, Homo Sapiens
RAQGTRRSS

SEQ ID NO: 147893 - protein, 9 aa, Homo Sapiens
GQRATRHGP

SEQ ID NO: 147894 - protein, 9 aa, Homo Sapiens
QTVPFMKSV

SEQ ID NO: 147895 - protein, 9 aa, Homo Sapiens
HHCFHSHHP

SEQ ID NO: 147896 - protein, 9 aa, Homo Sapiens
LRLPSEQES

SEQ ID NO: 147897 - protein, 9 aa, Homo Sapiens
LIRLHGWLQ

SEQ ID NO: 147898 - protein, 9 aa, Homo Sapiens
ANQGSVFIP

SEQ ID NO: 147899 - protein, 9 aa, Homo Sapiens
KGRPLGLLV

SEQ ID NO: 147900 - protein, 9 aa, Homo Sapiens
KHTMLSEVL

SEQ ID NO: 147901 - protein, 9 aa, Homo Sapiens
EDPPMSLHT

SEQ ID NO: 147902 - protein, 9 aa, Homo Sapiens
RSGSEAGAG

SEQ ID NO: 147903 - protein, 9 aa, Homo Sapiens
QLLELSSLK

SEQ ID NO: 147904 - protein, 9 aa, Homo Sapiens
VFFSAKCGE

SEQ ID NO: 147905 - protein, 9 aa, Homo Sapiens
PAAAFMRLN

SEQ ID NO: 147906 - protein, 9 aa, Homo Sapiens
NKSFAEGLR

SEQ ID NO: 147907 - protein, 9 aa, Homo Sapiens
AVSHEQLAQ

SEQ ID NO: 147908 - protein, 9 aa, Homo Sapiens
ESMDKAVDD

SEQ ID NO: 147909 - protein, 9 aa, Homo Sapiens
GGLDDRSPQ

SEQ ID NO: 147910 - protein, 9 aa, Homo Sapiens
IKSELKKAV

SEQ ID NO: 147911 - protein, 9 aa, Homo Sapiens
RSPTSSPTA

SEQ ID NO: 147912 - protein, 9 aa, Homo Sapiens
KALKKASSP

SEQ ID NO: 147913 - protein, 9 aa, Homo Sapiens
GGSDLSGFL

SEQ ID NO: 147914 - protein, 9 aa, Homo Sapiens
APRAPAPAP

SEQ ID NO: 147915 - protein, 9 aa, Homo Sapiens
PSKGMDDHL

SEQ ID NO: 147916 - protein, 9 aa, Homo Sapiens
YMRKETTAR

SEQ ID NO: 147917 - protein, 9 aa, Homo Sapiens
KVINKLGPR

SEQ ID NO: 147918 - protein, 9 aa, Homo Sapiens
EERQKFLKY

SEQ ID NO: 147919 - protein, 9 aa, Homo Sapiens
GAGASLRPS

SEQ ID NO: 147920 - protein, 9 aa, Homo Sapiens
APAARGHGA

SEQ ID NO: 147921 - protein, 9 aa, Homo Sapiens
MPLRGKQLC

SEQ ID NO: 147922 - protein, 9 aa, Homo Sapiens
SSVCWRALP

SEQ ID NO: 147923 - protein, 9 aa, Homo Sapiens
TPPTTGLPA

SEQ ID NO: 147924 - protein, 9 aa, Homo Sapiens
AGDLPCASR

SEQ ID NO: 147925 - protein, 9 aa, Homo Sapiens
VSLNEMCCA

SEQ ID NO: 147926 - protein, 9 aa, Homo Sapiens
KGHSARIIS

SEQ ID NO: 147927 - protein, 9 aa, Homo Sapiens
TADIQLPNG

SEQ ID NO: 147928 - protein, 9 aa, Homo Sapiens
SNSGGGREL

SEQ ID NO: 147929 - protein, 9 aa, Homo Sapiens
YERLFCWLV

SEQ ID NO: 147930 - protein, 9 aa, Homo Sapiens
QVNGGKVAR

SEQ ID NO: 147931 - protein, 9 aa, Homo Sapiens
GDRFPVMSD

SEQ ID NO: 147932 - protein, 9 aa, Homo Sapiens
SAETLHKLQ

SEQ ID NO: 147933 - protein, 9 aa, Homo Sapiens
RPQQPPPRL

SEQ ID NO: 147934 - protein, 9 aa, Homo Sapiens
QRLSQAGRQ

SEQ ID NO: 147935 - protein, 9 aa, Homo Sapiens
EEQQPPPQQ

SEQ ID NO: 147936 - protein, 9 aa, Homo Sapiens
ADRERGPWS

SEQ ID NO: 147937 - protein, 9 aa, Homo Sapiens
HSPPPEARA

SEQ ID NO: 147938 - protein, 9 aa, Homo Sapiens
GADQRGLVP

SEQ ID NO: 147939 - protein, 9 aa, Homo Sapiens
RLHKTVWRL

SEQ ID NO: 147940 - protein, 9 aa, Homo Sapiens
DFTDAIIQE

SEQ ID NO: 147941 - protein, 9 aa, Homo Sapiens
APHPDQVRT

SEQ ID NO: 147942 - protein, 9 aa, Homo Sapiens
EFIGFRDDV

SEQ ID NO: 147943 - protein, 9 aa, Homo Sapiens
TNITTKFPW

SEQ ID NO: 147944 - protein, 9 aa, Homo Sapiens
NTVLSITSS

SEQ ID NO: 147945 - protein, 9 aa, Homo Sapiens
STSAGLRCE

SEQ ID NO: 147946 - protein, 9 aa, Homo Sapiens
LAVSFPHSE

SEQ ID NO: 147947 - protein, 9 aa, Homo Sapiens
SARMSSWSQ

SEQ ID NO: 147948 - protein, 9 aa, Homo Sapiens
AVVHGQHHR

SEQ ID NO: 147949 - protein, 9 aa, Homo Sapiens
KYRHIKPIS

SEQ ID NO: 147950 - protein, 9 aa, Homo Sapiens
PWQPGASPR

SEQ ID NO: 147951 - protein, 9 aa, Homo Sapiens
TGLYCFPSS

SEQ ID NO: 147952 - protein, 9 aa, Homo Sapiens
RGRTSGRSL

SEQ ID NO: 147953 - protein, 9 aa, Homo Sapiens
VGQLYLRRK

SEQ ID NO: 147954 - protein, 9 aa, Homo Sapiens
QVFETFSES

SEQ ID NO: 147955 - protein, 9 aa, Homo Sapiens
YITHSLLGR

SEQ ID NO: 147956 - protein, 9 aa, Homo Sapiens
VSRSCSTLL

SEQ ID NO: 147957 - protein, 9 aa, Homo Sapiens
VIREGWRWG

SEQ ID NO: 147958 - protein, 9 aa, Homo Sapiens
LSSMLYMPL

SEQ ID NO: 147959 - protein, 9 aa, Homo Sapiens
SPPPQILER

SEQ ID NO: 147960 - protein, 9 aa, Homo Sapiens
GDENKSVCD

SEQ ID NO: 147961 - protein, 9 aa, Homo Sapiens
LVVVAARPG

SEQ ID NO: 147962 - protein, 9 aa, Homo Sapiens
EVLDHVPRI

SEQ ID NO: 147963 - protein, 9 aa, Homo Sapiens
PAMAHPSLL

SEQ ID NO: 147964 - protein, 9 aa, Homo Sapiens
LFISRANEK

SEQ ID NO: 147965 - protein, 9 aa, Homo Sapiens
KTVERDFEM

SEQ ID NO: 147966 - protein, 9 aa, Homo Sapiens
NGGPPWGVG

SEQ ID NO: 147967 - protein, 9 aa, Homo Sapiens
MCMAIAGYF

SEQ ID NO: 147968 - protein, 9 aa, Homo Sapiens
DHLIAKNMA

SEQ ID NO: 147969 - protein, 9 aa, Homo Sapiens
PRDPTDPQW

SEQ ID NO: 147970 - protein, 9 aa, Homo Sapiens
DARHGGWTT

SEQ ID NO: 147971 - protein, 9 aa, Homo Sapiens
ATWNFQFPP

SEQ ID NO: 147972 - protein, 9 aa, Homo Sapiens
STARSVLRP

SEQ ID NO: 147973 - protein, 9 aa, Homo Sapiens
RLESGVCFD

SEQ ID NO: 147974 - protein, 9 aa, Homo Sapiens
GSSRPTVPS

SEQ ID NO: 147975 - protein, 9 aa, Homo Sapiens
PTRKEVHAL

SEQ ID NO: 147976 - protein, 9 aa, Homo Sapiens
APDGNGAST

SEQ ID NO: 147977 - protein, 9 aa, Homo Sapiens
LQSVVGYAI

SEQ ID NO: 147978 - protein, 9 aa, Homo Sapiens
HPPVSPRLV

SEQ ID NO: 147979 - protein, 9 aa, Homo Sapiens
APVITSSQY

SEQ ID NO: 147980 - protein, 9 aa, Homo Sapiens
WLRLLVEQE

SEQ ID NO: 147981 - protein, 9 aa, Homo Sapiens
PRSCSPAHW

SEQ ID NO: 147982 - protein, 9 aa, Homo Sapiens
IQPRTLSMD

SEQ ID NO: 147983 - protein, 9 aa, Homo Sapiens
TLSRPWPHV

SEQ ID NO: 147984 - protein, 9 aa, Homo Sapiens
IMISEFGLS

SEQ ID NO: 147985 - protein, 9 aa, Homo Sapiens
AARRATLCM

SEQ ID NO: 147986 - protein, 9 aa, Homo Sapiens
VGANYDAQT

SEQ ID NO: 147987 - protein, 9 aa, Homo Sapiens
THHLQPPPH

SEQ ID NO: 147988 - protein, 9 aa, Homo Sapiens
PWKTCWCYL

SEQ ID NO: 147989 - protein, 9 aa, Homo Sapiens
NFMELGAEF

SEQ ID NO: 147990 - protein, 9 aa, Homo Sapiens
EMVHKSMKD

SEQ ID NO: 147991 - protein, 9 aa, Homo Sapiens
PATTFPTQR

SEQ ID NO: 147992 - protein, 9 aa, Homo Sapiens
SSKFETQED

SEQ ID NO: 147993 - protein, 9 aa, Homo Sapiens
APGHALSCR

SEQ ID NO: 147994 - protein, 9 aa, Homo Sapiens
DHDTGSLTS

SEQ ID NO: 147995 - protein, 9 aa, Homo Sapiens
MLLRMHTVP

SEQ ID NO: 147996 - protein, 9 aa, Homo Sapiens
RKSGSGSGL

SEQ ID NO: 147997 - protein, 9 aa, Homo Sapiens
VPQGQKRGL

SEQ ID NO: 147998 - protein, 9 aa, Homo Sapiens
GGGAPAAAG

SEQ ID NO: 147999 - protein, 9 aa, Homo Sapiens
RKHRLESGV

SEQ ID NO: 148000 - protein, 9 aa, Homo Sapiens
RDEKGNFME

SEQ ID NO: 148001 - protein, 9 aa, Homo Sapiens
LHLKLTRKP

SEQ ID NO: 148002 - protein, 9 aa, Homo Sapiens
CLRPPPARA

SEQ ID NO: 148003 - protein, 9 aa, Homo Sapiens
SNFWKGALL

SEQ ID NO: 148004 - protein, 9 aa, Homo Sapiens
PALLALQQL

SEQ ID NO: 148005 - protein, 9 aa, Homo Sapiens
YGGGGSTCC

SEQ ID NO: 148006 - protein, 9 aa, Homo Sapiens
LSTILINPE

SEQ ID NO: 148007 - protein, 9 aa, Homo Sapiens
VRLHVTATP

SEQ ID NO: 148008 - protein, 9 aa, Homo Sapiens
YLFPQDKFY

SEQ ID NO: 148009 - protein, 9 aa, Homo Sapiens
SCTGPPRDR

SEQ ID NO: 148010 - protein, 9 aa, Homo Sapiens
KEAKLHQML

SEQ ID NO: 148011 - protein, 9 aa, Homo Sapiens
LWERELSVQ

SEQ ID NO: 148012 - protein, 9 aa, Homo Sapiens
YLFFRFGIL

SEQ ID NO: 148013 - protein, 9 aa, Homo Sapiens
ESLDNHMGI

SEQ ID NO: 148014 - protein, 9 aa, Homo Sapiens
SDEGIMSRK

SEQ ID NO: 148015 - protein, 9 aa, Homo Sapiens
QFHNLPCPF

SEQ ID NO: 148016 - protein, 9 aa, Homo Sapiens
ADNSVVCFL

SEQ ID NO: 148017 - protein, 9 aa, Homo Sapiens
GSTSRRTRP

SEQ ID NO: 148018 - protein, 9 aa, Homo Sapiens
RHRGALSPT

SEQ ID NO: 148019 - protein, 9 aa, Homo Sapiens
LCSLPWARH

SEQ ID NO: 148020 - protein, 9 aa, Homo Sapiens
HQGPGHGGP

SEQ ID NO: 148021 - protein, 9 aa, Homo Sapiens
DEIQQWHGL

SEQ ID NO: 148022 - protein, 9 aa, Homo Sapiens
LCEEFLKTA

SEQ ID NO: 148023 - protein, 9 aa, Homo Sapiens
LPPMSSPFR

SEQ ID NO: 148024 - protein, 9 aa, Homo Sapiens
HVPLSISGS

SEQ ID NO: 148025 - protein, 9 aa, Homo Sapiens
LPQWRTWLG

SEQ ID NO: 148026 - protein, 9 aa, Homo Sapiens
KPGALTPLQ

SEQ ID NO: 148027 - protein, 9 aa, Homo Sapiens
RQCLMSQRT

SEQ ID NO: 148028 - protein, 9 aa, Homo Sapiens
TAATLRCPA

SEQ ID NO: 148029 - protein, 9 aa, Homo Sapiens
ADALLAHHA

SEQ ID NO: 148030 - protein, 9 aa, Homo Sapiens
SLQNLVEAG

SEQ ID NO: 148031 - protein, 9 aa, Homo Sapiens
VYAITSECV

SEQ ID NO: 148032 - protein, 9 aa, Homo Sapiens
PPGSSHACV

SEQ ID NO: 148033 - protein, 9 aa, Homo Sapiens
PNSEMDHVT

SEQ ID NO: 148034 - protein, 9 aa, Homo Sapiens
YRDKTRMQR

SEQ ID NO: 148035 - protein, 9 aa, Homo Sapiens
ILSREFGKK

SEQ ID NO: 148036 - protein, 9 aa, Homo Sapiens
RAPHPERKT

SEQ ID NO: 148037 - protein, 9 aa, Homo Sapiens
TAACPMTAC

SEQ ID NO: 148038 - protein, 9 aa, Homo Sapiens
DTATAKEAA

SEQ ID NO: 148039 - protein, 9 aa, Homo Sapiens
EKVPCLCLE

SEQ ID NO: 148040 - protein, 9 aa, Homo Sapiens
SSRSFLACT

SEQ ID NO: 148041 - protein, 9 aa, Homo Sapiens
FCLRGHPSA

SEQ ID NO: 148042 - protein, 9 aa, Homo Sapiens
PRSCLSSRI

SEQ ID NO: 148043 - protein, 9 aa, Homo Sapiens
HSAWRRPSG

SEQ ID NO: 148044 - protein, 9 aa, Homo Sapiens
LLADAPCRH

SEQ ID NO: 148045 - protein, 9 aa, Homo Sapiens
FSNQTQIPD

SEQ ID NO: 148046 - protein, 9 aa, Homo Sapiens
VVLEVVVVH

SEQ ID NO: 148047 - protein, 9 aa, Homo Sapiens
EVLEGSASG

SEQ ID NO: 148048 - protein, 9 aa, Homo Sapiens
SEAPPRSLQ

SEQ ID NO: 148049 - protein, 9 aa, Homo Sapiens
SDLDCASSG

SEQ ID NO: 148050 - protein, 9 aa, Homo Sapiens
VGRTKDVEE

SEQ ID NO: 148051 - protein, 9 aa, Homo Sapiens
PPSILLPAL

SEQ ID NO: 148052 - protein, 9 aa, Homo Sapiens
GPRDPTDPQ

SEQ ID NO: 148053 - protein, 9 aa, Homo Sapiens
TGSSPRCGD

SEQ ID NO: 148054 - protein, 9 aa, Homo Sapiens
LFLSIHLIW

SEQ ID NO: 148055 - protein, 9 aa, Homo Sapiens
RAASTEPER

SEQ ID NO: 148056 - protein, 9 aa, Homo Sapiens
TTTCPGPSW

SEQ ID NO: 148057 - protein, 9 aa, Homo Sapiens
RSCSTLLRS

SEQ ID NO: 148058 - protein, 9 aa, Homo Sapiens
PTLRTRSIF

SEQ ID NO: 148059 - protein, 9 aa, Homo Sapiens
CRDCVFRSC

SEQ ID NO: 148060 - protein, 9 aa, Homo Sapiens
QPPPQAPSQ

SEQ ID NO: 148061 - protein, 9 aa, Homo Sapiens
ASTCCGAWA

SEQ ID NO: 148062 - protein, 9 aa, Homo Sapiens
RHGLPLHLI

SEQ ID NO: 148063 - protein, 9 aa, Homo Sapiens
HPSQQAETR

SEQ ID NO: 148064 - protein, 9 aa, Homo Sapiens
RKPELILRM

SEQ ID NO: 148065 - protein, 9 aa, Homo Sapiens
SLSCCPRPR

SEQ ID NO: 148066 - protein, 9 aa, Homo Sapiens
RYILSREFG

SEQ ID NO: 148067 - protein, 9 aa, Homo Sapiens
GPRSIRRPL

SEQ ID NO: 148068 - protein, 9 aa, Homo Sapiens
WQKKWVHSL

SEQ ID NO: 148069 - protein, 9 aa, Homo Sapiens
CMLRLGQMD

SEQ ID NO: 148070 - protein, 9 aa, Homo Sapiens
EGQLFQSIW

SEQ ID NO: 148071 - protein, 9 aa, Homo Sapiens
QWITCKSLQ

SEQ ID NO: 148072 - protein, 9 aa, Homo Sapiens
TPAFAIFKF

SEQ ID NO: 148073 - protein, 9 aa, Homo Sapiens
QAKNQAYVM

SEQ ID NO: 148074 - protein, 9 aa, Homo Sapiens
QTSLTPPSI

SEQ ID NO: 148075 - protein, 9 aa, Homo Sapiens
SPGCRPAAF

SEQ ID NO: 148076 - protein, 9 aa, Homo Sapiens
QKKKKKRKR

SEQ ID NO: 148077 - protein, 9 aa, Homo Sapiens
CSIHLEVIM

SEQ ID NO: 148078 - protein, 9 aa, Homo Sapiens
LLAVPQVNM

SEQ ID NO: 148079 - protein, 9 aa, Homo Sapiens
CCPRPRCRP

SEQ ID NO: 148080 - protein, 9 aa, Homo Sapiens
EPAAALALW

SEQ ID NO: 148081 - protein, 9 aa, Homo Sapiens
PIEAYRTNA

SEQ ID NO: 148082 - protein, 9 aa, Homo Sapiens
TPPIGPSCV

SEQ ID NO: 148083 - protein, 9 aa, Homo Sapiens
GRAFCERPA

SEQ ID NO: 148084 - protein, 9 aa, Homo Sapiens
LDPAMAHPS

SEQ ID NO: 148085 - protein, 9 aa, Homo Sapiens
KHVPLSISG

SEQ ID NO: 148086 - protein, 9 aa, Homo Sapiens
APRSPSGPR

SEQ ID NO: 148087 - protein, 9 aa, Homo Sapiens
PANPQEKWL

SEQ ID NO: 148088 - protein, 9 aa, Homo Sapiens
KEKCRRISA

SEQ ID NO: 148089 - protein, 9 aa, Homo Sapiens
VDVGGRGQS

SEQ ID NO: 148090 - protein, 9 aa, Homo Sapiens
PITCLEQRK

SEQ ID NO: 148091 - protein, 9 aa, Homo Sapiens
RPPMRVCPS

SEQ ID NO: 148092 - protein, 9 aa, Homo Sapiens
VDSLDMCDG

SEQ ID NO: 148093 - protein, 9 aa, Homo Sapiens
PSDDEEFIG

SEQ ID NO: 148094 - protein, 9 aa, Homo Sapiens
RAPRLPRSS

SEQ ID NO: 148095 - protein, 9 aa, Homo Sapiens
LRNMAMATS

SEQ ID NO: 148096 - protein, 9 aa, Homo Sapiens
WSVSLMPPL

SEQ ID NO: 148097 - protein, 9 aa, Homo Sapiens
ASAPLWASS

SEQ ID NO: 148098 - protein, 9 aa, Homo Sapiens
SCGAARPRR

SEQ ID NO: 148099 - protein, 9 aa, Homo Sapiens
QTVAPRWWK

SEQ ID NO: 148100 - protein, 9 aa, Homo Sapiens
GVYLWLMQM

SEQ ID NO: 148101 - protein, 9 aa, Homo Sapiens
LASAYKVPV

SEQ ID NO: 148102 - protein, 9 aa, Homo Sapiens
YTNDDLNVH

SEQ ID NO: 148103 - protein, 9 aa, Homo Sapiens
RKWRKRRKR

SEQ ID NO: 148104 - protein, 9 aa, Homo Sapiens
CGELLVALL

SEQ ID NO: 148105 - protein, 9 aa, Homo Sapiens
KMEDFQIYE

SEQ ID NO: 148106 - protein, 9 aa, Homo Sapiens
CPLGGKRAT

SEQ ID NO: 148107 - protein, 9 aa, Homo Sapiens
REQEQQRHT

SEQ ID NO: 148108 - protein, 9 aa, Homo Sapiens
PAPEDEDGA

SEQ ID NO: 148109 - protein, 9 aa, Homo Sapiens
LISDLIAVR

SEQ ID NO: 148110 - protein, 9 aa, Homo Sapiens
TGTHRHTHK

SEQ ID NO: 148111 - protein, 9 aa, Homo Sapiens
IMENSTQWL

SEQ ID NO: 148112 - protein, 9 aa, Homo Sapiens
GEQQCPGSH

SEQ ID NO: 148113 - protein, 9 aa, Homo Sapiens
LPRAATQSR

SEQ ID NO: 148114 - protein, 9 aa, Homo Sapiens
KNGIKGRGK

SEQ ID NO: 148115 - protein, 9 aa, Homo Sapiens
RGEAAHRGA

SEQ ID NO: 148116 - protein, 9 aa, Homo Sapiens
ARLFLGWTV

SEQ ID NO: 148117 - protein, 9 aa, Homo Sapiens
DTRWHQECH

SEQ ID NO: 148118 - protein, 9 aa, Homo Sapiens
KLKLEQRGR

SEQ ID NO: 148119 - protein, 9 aa, Homo Sapiens
HGLLRQLGK

SEQ ID NO: 148120 - protein, 9 aa, Homo Sapiens
EDFQPFWQL

SEQ ID NO: 148121 - protein, 9 aa, Homo Sapiens
NKSLARVTH

SEQ ID NO: 148122 - protein, 9 aa, Homo Sapiens
SSKKLKEAK

SEQ ID NO: 148123 - protein, 9 aa, Homo Sapiens
RMVTVPHVT

SEQ ID NO: 148124 - protein, 9 aa, Homo Sapiens
TVHQGLTQL

SEQ ID NO: 148125 - protein, 9 aa, Homo Sapiens
ARSSQKETT

SEQ ID NO: 148126 - protein, 9 aa, Homo Sapiens
TGTHRHTHT

SEQ ID NO: 148127 - protein, 9 aa, Homo Sapiens
QNGVLSTPA

SEQ ID NO: 148128 - protein, 9 aa, Homo Sapiens
HQLKGGNGW

SEQ ID NO: 148129 - protein, 9 aa, Homo Sapiens
GNGWRNSRV

SEQ ID NO: 148130 - protein, 9 aa, Homo Sapiens
YPGFLDVRT

SEQ ID NO: 148131 - protein, 9 aa, Homo Sapiens
FSMEISSGD

SEQ ID NO: 148132 - protein, 9 aa, Homo Sapiens
GIFRGDKWS

SEQ ID NO: 148133 - protein, 9 aa, Homo Sapiens
RFALRVRHG

SEQ ID NO: 148134 - protein, 9 aa, Homo Sapiens
EIINHSSSE

SEQ ID NO: 148135 - protein, 9 aa, Homo Sapiens
PTPKPRPPQ

SEQ ID NO: 148136 - protein, 9 aa, Homo Sapiens
LRRPGLGVL

SEQ ID NO: 148137 - protein, 9 aa, Homo Sapiens
CGPHGPRGP

SEQ ID NO: 148138 - protein, 9 aa, Homo Sapiens
KHKGIKSSI

SEQ ID NO: 148139 - protein, 9 aa, Homo Sapiens
TNDDLNVHS

SEQ ID NO: 148140 - protein, 9 aa, Homo Sapiens
SKKKSSKKR

SEQ ID NO: 148141 - protein, 9 aa, Homo Sapiens
SKKAKERQN

SEQ ID NO: 148142 - protein, 9 aa, Homo Sapiens
PPIKKKPRL

SEQ ID NO: 148143 - protein, 9 aa, Homo Sapiens
YNVDTERAL

SEQ ID NO: 148144 - protein, 9 aa, Homo Sapiens
TSLDIMTCL

SEQ ID NO: 148145 - protein, 9 aa, Homo Sapiens
LAQLREDNT

SEQ ID NO: 148146 - protein, 9 aa, Homo Sapiens
RGGHLWRKR

SEQ ID NO: 148147 - protein, 9 aa, Homo Sapiens
QGMEALVQC

SEQ ID NO: 148148 - protein, 9 aa, Homo Sapiens
IAVRQVDLG

SEQ ID NO: 148149 - protein, 9 aa, Homo Sapiens
TSSLWSTPA

SEQ ID NO: 148150 - protein, 9 aa, Homo Sapiens
CAENLEKIH

SEQ ID NO: 148151 - protein, 9 aa, Homo Sapiens
VPAALAGVL

SEQ ID NO: 148152 - protein, 9 aa, Homo Sapiens
NPKHLEEVT

SEQ ID NO: 148153 - protein, 9 aa, Homo Sapiens
DWLRGPSAG

SEQ ID NO: 148154 - protein, 9 aa, Homo Sapiens
SERHSPRPI

SEQ ID NO: 148155 - protein, 9 aa, Homo Sapiens
RPRVTPGPP

SEQ ID NO: 148156 - protein, 9 aa, Homo Sapiens
QQPHQEADV

SEQ ID NO: 148157 - protein, 9 aa, Homo Sapiens
ETHKGEIPK

SEQ ID NO: 148158 - protein, 9 aa, Homo Sapiens
GQDCYMRIW

SEQ ID NO: 148159 - protein, 9 aa, Homo Sapiens
QLVLPGEAD

SEQ ID NO: 148160 - protein, 9 aa, Homo Sapiens
KAKIEVLDE

SEQ ID NO: 148161 - protein, 9 aa, Homo Sapiens
KSIISHTAA

SEQ ID NO: 148162 - protein, 9 aa, Homo Sapiens
LVEKKRCAR

SEQ ID NO: 148163 - protein, 9 aa, Homo Sapiens
CLDLSNDAV

SEQ ID NO: 148164 - protein, 9 aa, Homo Sapiens
DMLGGDGIS

SEQ ID NO: 148165 - protein, 9 aa, Homo Sapiens
RPVWGPAIQ

SEQ ID NO: 148166 - protein, 9 aa, Homo Sapiens
KTVHEKYQC

SEQ ID NO: 148167 - protein, 9 aa, Homo Sapiens
AHWPKEQPS

SEQ ID NO: 148168 - protein, 9 aa, Homo Sapiens
CQISIFHAL

SEQ ID NO: 148169 - protein, 9 aa, Homo Sapiens
EAANMGDVE

SEQ ID NO: 148170 - protein, 9 aa, Homo Sapiens
TVATFQPSR

SEQ ID NO: 148171 - protein, 9 aa, Homo Sapiens
RRKEPDRPR

SEQ ID NO: 148172 - protein, 9 aa, Homo Sapiens
CVSCPEDPW

SEQ ID NO: 148173 - protein, 9 aa, Homo Sapiens
IYPLSMCIN

SEQ ID NO: 148174 - protein, 9 aa, Homo Sapiens
LPECFRHAP

SEQ ID NO: 148175 - protein, 9 aa, Homo Sapiens
CPVCTRPVV

SEQ ID NO: 148176 - protein, 9 aa, Homo Sapiens
HSTPRLLAP

SEQ ID NO: 148177 - protein, 9 aa, Homo Sapiens
PPAARPPGV

SEQ ID NO: 148178 - protein, 9 aa, Homo Sapiens
RKTKKKEGV

SEQ ID NO: 148179 - protein, 9 aa, Homo Sapiens
SPTTPSPAS

SEQ ID NO: 148180 - protein, 9 aa, Homo Sapiens
SRLPGLPQL

SEQ ID NO: 148181 - protein, 9 aa, Homo Sapiens
ACLLGLTRR

SEQ ID NO: 148182 - protein, 9 aa, Homo Sapiens
DSDPEPDYT

SEQ ID NO: 148183 - protein, 9 aa, Homo Sapiens
TGAKGEKGI

SEQ ID NO: 148184 - protein, 9 aa, Homo Sapiens
LFWSVQGNL

SEQ ID NO: 148185 - protein, 9 aa, Homo Sapiens
WPTRRSTMS

SEQ ID NO: 148186 - protein, 9 aa, Homo Sapiens
QAYTQTQTH

SEQ ID NO: 148187 - protein, 9 aa, Homo Sapiens
KMRRGPGVL

SEQ ID NO: 148188 - protein, 9 aa, Homo Sapiens
RCIQTLCCG

SEQ ID NO: 148189 - protein, 9 aa, Homo Sapiens
SKPSVNEQT

SEQ ID NO: 148190 - protein, 9 aa, Homo Sapiens
GSSGPGSTR

SEQ ID NO: 148191 - protein, 9 aa, Homo Sapiens
ASYPKRLGR

SEQ ID NO: 148192 - protein, 9 aa, Homo Sapiens
AVVDFDPST

SEQ ID NO: 148193 - protein, 9 aa, Homo Sapiens
ILLWLLGSR

SEQ ID NO: 148194 - protein, 9 aa, Homo Sapiens
RPRAGCCVW

SEQ ID NO: 148195 - protein, 9 aa, Homo Sapiens
QDIEATQSP

SEQ ID NO: 148196 - protein, 9 aa, Homo Sapiens
ATIAAAADI

SEQ ID NO: 148197 - protein, 9 aa, Homo Sapiens
HRPFARPGR

SEQ ID NO: 148198 - protein, 9 aa, Homo Sapiens
QPPPHSAAH

SEQ ID NO: 148199 - protein, 9 aa, Homo Sapiens
SIMYREVLE

SEQ ID NO: 148200 - protein, 9 aa, Homo Sapiens
RRPLIFLPP

SEQ ID NO: 148201 - protein, 9 aa, Homo Sapiens
KAHIHLNGY

SEQ ID NO: 148202 - protein, 9 aa, Homo Sapiens
GKQLCVRFA

SEQ ID NO: 148203 - protein, 9 aa, Homo Sapiens
KNYERQKMF

SEQ ID NO: 148204 - protein, 9 aa, Homo Sapiens
GEGPSAPAG

SEQ ID NO: 148205 - protein, 9 aa, Homo Sapiens
MIYVKINLF

SEQ ID NO: 148206 - protein, 9 aa, Homo Sapiens
QLAWLSSSQ

SEQ ID NO: 148207 - protein, 9 aa, Homo Sapiens
PILQEAKFL

SEQ ID NO: 148208 - protein, 9 aa, Homo Sapiens
FVQPMELID

SEQ ID NO: 148209 - protein, 9 aa, Homo Sapiens
QSVEAVAKK

SEQ ID NO: 148210 - protein, 9 aa, Homo Sapiens
SLGSSRLPL

SEQ ID NO: 148211 - protein, 9 aa, Homo Sapiens
LPVRVEVDT

SEQ ID NO: 148212 - protein, 9 aa, Homo Sapiens
GISFSVKNK

SEQ ID NO: 148213 - protein, 9 aa, Homo Sapiens
QCHLGTAGT

SEQ ID NO: 148214 - protein, 9 aa, Homo Sapiens
RPTVPSCRR

SEQ ID NO: 148215 - protein, 9 aa, Homo Sapiens
RESCVVSFC

SEQ ID NO: 148216 - protein, 9 aa, Homo Sapiens
IKQKVLREK

SEQ ID NO: 148217 - protein, 9 aa, Homo Sapiens
VHFSQACYL

SEQ ID NO: 148218 - protein, 9 aa, Homo Sapiens
RPMGREEES

SEQ ID NO: 148219 - protein, 9 aa, Homo Sapiens
TKKRGKSQG

SEQ ID NO: 148220 - protein, 9 aa, Homo Sapiens
GWRWRRGHR

SEQ ID NO: 148221 - protein, 9 aa, Homo Sapiens
QVNLKWPWA

SEQ ID NO: 148222 - protein, 9 aa, Homo Sapiens
GRTALAPRA

SEQ ID NO: 148223 - protein, 9 aa, Homo Sapiens
EIQLTMNDS

SEQ ID NO: 148224 - protein, 9 aa, Homo Sapiens
SDIVALGAS

SEQ ID NO: 148225 - protein, 9 aa, Homo Sapiens
HPRGSQSAL

SEQ ID NO: 148226 - protein, 9 aa, Homo Sapiens
HSYVPPTGA

SEQ ID NO: 148227 - protein, 9 aa, Homo Sapiens
MAPWSLAEW

SEQ ID NO: 148228 - protein, 9 aa, Homo Sapiens
PVGDVGLGV

SEQ ID NO: 148229 - protein, 9 aa, Homo Sapiens
SEEKKFTKL

SEQ ID NO: 148230 - protein, 9 aa, Homo Sapiens
GCVLRRARA

SEQ ID NO: 148231 - protein, 9 aa, Homo Sapiens
VLCLDLSND

SEQ ID NO: 148232 - protein, 9 aa, Homo Sapiens
ACTGTHRHT

SEQ ID NO: 148233 - protein, 9 aa, Homo Sapiens
TSSLLSPVQ

SEQ ID NO: 148234 - protein, 9 aa, Homo Sapiens
TQQLSLLIA

SEQ ID NO: 148235 - protein, 9 aa, Homo Sapiens
PSGPRPGLS

SEQ ID NO: 148236 - protein, 9 aa, Homo Sapiens
GIIIGAVTA

SEQ ID NO: 148237 - protein, 9 aa, Homo Sapiens
IILYVKEWS

SEQ ID NO: 148238 - protein, 9 aa, Homo Sapiens
LPSQLVPAG

SEQ ID NO: 148239 - protein, 9 aa, Homo Sapiens
RWRGERLRH

SEQ ID NO: 148240 - protein, 9 aa, Homo Sapiens
FRMAGKGLK

SEQ ID NO: 148241 - protein, 9 aa, Homo Sapiens
PGPCASLLS

SEQ ID NO: 148242 - protein, 9 aa, Homo Sapiens
KKVHIFQDC

SEQ ID NO: 148243 - protein, 9 aa, Homo Sapiens
ACDPRGSPA

SEQ ID NO: 148244 - protein, 9 aa, Homo Sapiens
FHPLPFQNT

SEQ ID NO: 148245 - protein, 9 aa, Homo Sapiens
GSPGHLSPR

SEQ ID NO: 148246 - protein, 9 aa, Homo Sapiens
MVQRWASNP

SEQ ID NO: 148247 - protein, 9 aa, Homo Sapiens
AMEVAMAEA

SEQ ID NO: 148248 - protein, 9 aa, Homo Sapiens
LEPGMDYEV

SEQ ID NO: 148249 - protein, 9 aa, Homo Sapiens
DSTPAFAIF

SEQ ID NO: 148250 - protein, 9 aa, Homo Sapiens
ECEGSPPST

SEQ ID NO: 148251 - protein, 9 aa, Homo Sapiens
EYMVYMKHT

SEQ ID NO: 148252 - protein, 9 aa, Homo Sapiens
SIPSIPKRR

SEQ ID NO: 148253 - protein, 9 aa, Homo Sapiens
KKARMTRTR

SEQ ID NO: 148254 - protein, 9 aa, Homo Sapiens
KQQQVTENC

SEQ ID NO: 148255 - protein, 9 aa, Homo Sapiens
LQGSPLAFE

SEQ ID NO: 148256 - protein, 9 aa, Homo Sapiens
DTPKRPFSQ

SEQ ID NO: 148257 - protein, 9 aa, Homo Sapiens
EGCSFLTLP

SEQ ID NO: 148258 - protein, 9 aa, Homo Sapiens
FSKVCVLPT

SEQ ID NO: 148259 - protein, 9 aa, Homo Sapiens
ALFYQGPGW

SEQ ID NO: 148260 - protein, 9 aa, Homo Sapiens
PSLRAARAH

SEQ ID NO: 148261 - protein, 9 aa, Homo Sapiens
VRGCSYRVL

SEQ ID NO: 148262 - protein, 9 aa, Homo Sapiens
SATSVDAKV

SEQ ID NO: 148263 - protein, 9 aa, Homo Sapiens
DAVSHLLQD

SEQ ID NO: 148264 - protein, 9 aa, Homo Sapiens
PRCPPCPRM

SEQ ID NO: 148265 - protein, 9 aa, Homo Sapiens
CKKVASNVA

SEQ ID NO: 148266 - protein, 9 aa, Homo Sapiens
STTSIPSPH

SEQ ID NO: 148267 - protein, 9 aa, Homo Sapiens
THTQAYTLT

SEQ ID NO: 148268 - protein, 9 aa, Homo Sapiens
ILVLCLDLS

SEQ ID NO: 148269 - protein, 9 aa, Homo Sapiens
ETVLACVPS

SEQ ID NO: 148270 - protein, 9 aa, Homo Sapiens
LSALRVSPV

SEQ ID NO: 148271 - protein, 9 aa, Homo Sapiens
GGRGWMWQS

SEQ ID NO: 148272 - protein, 9 aa, Homo Sapiens
SRAAKDYQW

SEQ ID NO: 148273 - protein, 9 aa, Homo Sapiens
PLEKLKQGC

SEQ ID NO: 148274 - protein, 9 aa, Homo Sapiens
KRKKKKKKK

SEQ ID NO: 148275 - protein, 9 aa, Homo Sapiens
APLGCCPAP

SEQ ID NO: 148276 - protein, 9 aa, Homo Sapiens
EMCCAYEVT

SEQ ID NO: 148277 - protein, 9 aa, Homo Sapiens
GNGSFTGNK

SEQ ID NO: 148278 - protein, 9 aa, Homo Sapiens
ECGLDKSCL

SEQ ID NO: 148279 - protein, 9 aa, Homo Sapiens
GEEVVVSAL

SEQ ID NO: 148280 - protein, 9 aa, Homo Sapiens
CLRTHSLSR

SEQ ID NO: 148281 - protein, 9 aa, Homo Sapiens
AEDLGLKVK

SEQ ID NO: 148282 - protein, 9 aa, Homo Sapiens
FTVRYDPYT

SEQ ID NO: 148283 - protein, 9 aa, Homo Sapiens
HTDTHADTP

SEQ ID NO: 148284 - protein, 9 aa, Homo Sapiens
QDETRDSFQ

SEQ ID NO: 148285 - protein, 9 aa, Homo Sapiens
VNGKDQTMS

SEQ ID NO: 148286 - protein, 9 aa, Homo Sapiens
YGEGGAGQG

SEQ ID NO: 148287 - protein, 9 aa, Homo Sapiens
LRPCLPSPR

SEQ ID NO: 148288 - protein, 9 aa, Homo Sapiens
EVTVVGPVL

SEQ ID NO: 148289 - protein, 9 aa, Homo Sapiens
KPGTYPDVP

SEQ ID NO: 148290 - protein, 9 aa, Homo Sapiens
SPITNSKLS

SEQ ID NO: 148291 - protein, 9 aa, Homo Sapiens
CSPTTPSPA

SEQ ID NO: 148292 - protein, 9 aa, Homo Sapiens
LNPQGVLSP

SEQ ID NO: 148293 - protein, 9 aa, Homo Sapiens
SLPPDVLRH

SEQ ID NO: 148294 - protein, 9 aa, Homo Sapiens
SANAAARRA

SEQ ID NO: 148295 - protein, 9 aa, Homo Sapiens
TKCGTWRST

SEQ ID NO: 148296 - protein, 9 aa, Homo Sapiens
YDRFLSCDK

SEQ ID NO: 148297 - protein, 9 aa, Homo Sapiens
VFAVQTGKY

SEQ ID NO: 148298 - protein, 9 aa, Homo Sapiens
TVMVLGGAS

SEQ ID NO: 148299 - protein, 9 aa, Homo Sapiens
TSDRGSPAL

SEQ ID NO: 148300 - protein, 9 aa, Homo Sapiens
ILNAKNLSE

SEQ ID NO: 148301 - protein, 9 aa, Homo Sapiens
KEVELIVRE

SEQ ID NO: 148302 - protein, 9 aa, Homo Sapiens
LHSSPPTGS

SEQ ID NO: 148303 - protein, 9 aa, Homo Sapiens
ALGTASEGW

SEQ ID NO: 148304 - protein, 9 aa, Homo Sapiens
LAATDDDEE

SEQ ID NO: 148305 - protein, 9 aa, Homo Sapiens
GEIGGSQVK

SEQ ID NO: 148306 - protein, 9 aa, Homo Sapiens
NSCEVQPDS

SEQ ID NO: 148307 - protein, 9 aa, Homo Sapiens
LAYSSQTVQ

SEQ ID NO: 148308 - protein, 9 aa, Homo Sapiens
KENNISKCF

SEQ ID NO: 148309 - protein, 9 aa, Homo Sapiens
RASRALCLA

SEQ ID NO: 148310 - protein, 9 aa, Homo Sapiens
LSITSPNTA

SEQ ID NO: 148311 - protein, 9 aa, Homo Sapiens
DYAHCMPYF

SEQ ID NO: 148312 - protein, 9 aa, Homo Sapiens
QVSMVTLLS

SEQ ID NO: 148313 - protein, 9 aa, Homo Sapiens
GHGHNTQSR

SEQ ID NO: 148314 - protein, 9 aa, Homo Sapiens
ADQLLILKA

SEQ ID NO: 148315 - protein, 9 aa, Homo Sapiens
SKLSSGAPP

SEQ ID NO: 148316 - protein, 9 aa, Homo Sapiens
PLPLPPVPF

SEQ ID NO: 148317 - protein, 9 aa, Homo Sapiens
SFLTLPFHQ

SEQ ID NO: 148318 - protein, 9 aa, Homo Sapiens
KEMSLQSLA

SEQ ID NO: 148319 - protein, 9 aa, Homo Sapiens
PATPHVPHA

SEQ ID NO: 148320 - protein, 9 aa, Homo Sapiens
LNGQLSTLL

SEQ ID NO: 148321 - protein, 9 aa, Homo Sapiens
EGYSNSETG

SEQ ID NO: 148322 - protein, 9 aa, Homo Sapiens
ILQSVVGYA

SEQ ID NO: 148323 - protein, 9 aa, Homo Sapiens
KPSPVPPPY

SEQ ID NO: 148324 - protein, 9 aa, Homo Sapiens
VFTRDSTCL

SEQ ID NO: 148325 - protein, 9 aa, Homo Sapiens
PLPPAHVHV

SEQ ID NO: 148326 - protein, 9 aa, Homo Sapiens
SGWSGNSGL

SEQ ID NO: 148327 - protein, 9 aa, Homo Sapiens
GGSWGTVWD

SEQ ID NO: 148328 - protein, 9 aa, Homo Sapiens
VETSSWTIP

SEQ ID NO: 148329 - protein, 9 aa, Homo Sapiens
LNCSSPGCR

SEQ ID NO: 148330 - protein, 9 aa, Homo Sapiens
VTFCSSSTY

SEQ ID NO: 148331 - protein, 9 aa, Homo Sapiens
GMSDSSLSD

SEQ ID NO: 148332 - protein, 9 aa, Homo Sapiens
RMSSWSQTS

SEQ ID NO: 148333 - protein, 9 aa, Homo Sapiens
FHNLPCPFS

SEQ ID NO: 148334 - protein, 9 aa, Homo Sapiens
ALLHLGIHI

SEQ ID NO: 148335 - protein, 9 aa, Homo Sapiens
ILQFLCAWD

SEQ ID NO: 148336 - protein, 9 aa, Homo Sapiens
EALNLSLEP

SEQ ID NO: 148337 - protein, 9 aa, Homo Sapiens
DCYFFSILH

SEQ ID NO: 148338 - protein, 9 aa, Homo Sapiens
GDLGGQAVV

SEQ ID NO: 148339 - protein, 9 aa, Homo Sapiens
GGIFEPSIR

SEQ ID NO: 148340 - protein, 9 aa, Homo Sapiens
STLTSGPTP

SEQ ID NO: 148341 - protein, 9 aa, Homo Sapiens
AQAQPNPRP

SEQ ID NO: 148342 - protein, 9 aa, Homo Sapiens
AFPPLEDAS

SEQ ID NO: 148343 - protein, 9 aa, Homo Sapiens
LSPAAVGNI

SEQ ID NO: 148344 - protein, 9 aa, Homo Sapiens
DAIIQERRR

SEQ ID NO: 148345 - protein, 9 aa, Homo Sapiens
LKKEIYIYN

SEQ ID NO: 148346 - protein, 9 aa, Homo Sapiens
STDLGLAPT

SEQ ID NO: 148347 - protein, 9 aa, Homo Sapiens
KVPSGVQVL

SEQ ID NO: 148348 - protein, 9 aa, Homo Sapiens
GDPPPYEPH

SEQ ID NO: 148349 - protein, 9 aa, Homo Sapiens
FAATVHPAQ

SEQ ID NO: 148350 - protein, 9 aa, Homo Sapiens
GQKRAGNFA

SEQ ID NO: 148351 - protein, 9 aa, Homo Sapiens
HIPELLIDE

SEQ ID NO: 148352 - protein, 9 aa, Homo Sapiens
KISVHAFQQ

SEQ ID NO: 148353 - protein, 9 aa, Homo Sapiens
DRPSHPGGP

SEQ ID NO: 148354 - protein, 9 aa, Homo Sapiens
PYVYRECGR

SEQ ID NO: 148355 - protein, 9 aa, Homo Sapiens
TFKALKCHG

SEQ ID NO: 148356 - protein, 9 aa, Homo Sapiens
KSLPPSPGP

SEQ ID NO: 148357 - protein, 9 aa, Homo Sapiens
VLQEKYVLW

SEQ ID NO: 148358 - protein, 9 aa, Homo Sapiens
EFKMEKRLC

SEQ ID NO: 148359 - protein, 9 aa, Homo Sapiens
QEPAAALAL

SEQ ID NO: 148360 - protein, 9 aa, Homo Sapiens
ITNSKLSAL

SEQ ID NO: 148361 - protein, 9 aa, Homo Sapiens
PVKKKRRLI

SEQ ID NO: 148362 - protein, 9 aa, Homo Sapiens
KRYQESLGL

SEQ ID NO: 148363 - protein, 9 aa, Homo Sapiens
GRWPGPPSY

SEQ ID NO: 148364 - protein, 9 aa, Homo Sapiens
LWLGPASVA

SEQ ID NO: 148365 - protein, 9 aa, Homo Sapiens
EGAQAFVDD

SEQ ID NO: 148366 - protein, 9 aa, Homo Sapiens
RNTFQEEGN

SEQ ID NO: 148367 - protein, 9 aa, Homo Sapiens
FHSHHPHHL

SEQ ID NO: 148368 - protein, 9 aa, Homo Sapiens
SMTKKSLSV

SEQ ID NO: 148369 - protein, 9 aa, Homo Sapiens
DNIFGGKAL

SEQ ID NO: 148370 - protein, 9 aa, Homo Sapiens
HVKKNYSTL

SEQ ID NO: 148371 - protein, 9 aa, Homo Sapiens
LHQMLRPNY

SEQ ID NO: 148372 - protein, 9 aa, Homo Sapiens
PASSQRWPP

SEQ ID NO: 148373 - protein, 9 aa, Homo Sapiens
VDDPDIPKT

SEQ ID NO: 148374 - protein, 9 aa, Homo Sapiens
NGRFALADQ

SEQ ID NO: 148375 - protein, 9 aa, Homo Sapiens
RSRSRSHSK

SEQ ID NO: 148376 - protein, 9 aa, Homo Sapiens
QSQSSTSIL

SEQ ID NO: 148377 - protein, 9 aa, Homo Sapiens
SGGGGGHGP

SEQ ID NO: 148378 - protein, 9 aa, Homo Sapiens
IIREMSFHL

SEQ ID NO: 148379 - protein, 9 aa, Homo Sapiens
PQTLAVKHK

SEQ ID NO: 148380 - protein, 9 aa, Homo Sapiens
RNSGIMVGK

SEQ ID NO: 148381 - protein, 9 aa, Homo Sapiens
SWQPRPPRF

SEQ ID NO: 148382 - protein, 9 aa, Homo Sapiens
PSARSPTWC

SEQ ID NO: 148383 - protein, 9 aa, Homo Sapiens
SPRCPPCPR

SEQ ID NO: 148384 - protein, 9 aa, Homo Sapiens
ILSALRVSP

SEQ ID NO: 148385 - protein, 9 aa, Homo Sapiens
FRSCFHLGH

SEQ ID NO: 148386 - protein, 9 aa, Homo Sapiens
KKQSTQKKM

SEQ ID NO: 148387 - protein, 9 aa, Homo Sapiens
GPTQPRPAL

SEQ ID NO: 148388 - protein, 9 aa, Homo Sapiens
QPRRPPMRV

SEQ ID NO: 148389 - protein, 9 aa, Homo Sapiens
RAKNECYQA

SEQ ID NO: 148390 - protein, 9 aa, Homo Sapiens
RSTEEEEEL

SEQ ID NO: 148391 - protein, 9 aa, Homo Sapiens
HVSVLHPVH

SEQ ID NO: 148392 - protein, 9 aa, Homo Sapiens
PGSLSITSP

SEQ ID NO: 148393 - protein, 9 aa, Homo Sapiens
KEGFAKYTE

SEQ ID NO: 148394 - protein, 9 aa, Homo Sapiens
EFRNALKSL

SEQ ID NO: 148395 - protein, 9 aa, Homo Sapiens
GGHLWRKRK

SEQ ID NO: 148396 - protein, 9 aa, Homo Sapiens
LPGTGGTSP

SEQ ID NO: 148397 - protein, 9 aa, Homo Sapiens
ITRTSMCMA

SEQ ID NO: 148398 - protein, 9 aa, Homo Sapiens
KKASSPGHP

SEQ ID NO: 148399 - protein, 9 aa, Homo Sapiens
VDFSSLDTS

SEQ ID NO: 148400 - protein, 9 aa, Homo Sapiens
PPGTGPQQS

SEQ ID NO: 148401 - protein, 9 aa, Homo Sapiens
ARTGTSSGL

SEQ ID NO: 148402 - protein, 9 aa, Homo Sapiens
ENVDNSLDD

SEQ ID NO: 148403 - protein, 9 aa, Homo Sapiens
PALLLPATT

SEQ ID NO: 148404 - protein, 9 aa, Homo Sapiens
KLHPSFKEW

SEQ ID NO: 148405 - protein, 9 aa, Homo Sapiens
ATTCKVPRL

SEQ ID NO: 148406 - protein, 9 aa, Homo Sapiens
TNTYQTFKA

SEQ ID NO: 148407 - protein, 9 aa, Homo Sapiens
VYMKHTYMR

SEQ ID NO: 148408 - protein, 9 aa, Homo Sapiens
RRQAQDIEA

SEQ ID NO: 148409 - protein, 9 aa, Homo Sapiens
TAGLRKRPA

SEQ ID NO: 148410 - protein, 9 aa, Homo Sapiens
PLSPAEQAN

SEQ ID NO: 148411 - protein, 9 aa, Homo Sapiens
ACELKGGNV

SEQ ID NO: 148412 - protein, 9 aa, Homo Sapiens
TVGGAAGAA

SEQ ID NO: 148413 - protein, 9 aa, Homo Sapiens
WLLGFEFGF

SEQ ID NO: 148414 - protein, 9 aa, Homo Sapiens
SPKVQVSPG

SEQ ID NO: 148415 - protein, 9 aa, Homo Sapiens
RLLGFIHPP

SEQ ID NO: 148416 - protein, 9 aa, Homo Sapiens
YYEASGQFI

SEQ ID NO: 148417 - protein, 9 aa, Homo Sapiens
VGGTQEVEI

SEQ ID NO: 148418 - protein, 9 aa, Homo Sapiens
HTAGGGGGP

SEQ ID NO: 148419 - protein, 9 aa, Homo Sapiens
QPPPARPPQ

SEQ ID NO: 148420 - protein, 9 aa, Homo Sapiens
AGAWGLLPG

SEQ ID NO: 148421 - protein, 9 aa, Homo Sapiens
WVLNFKALH

SEQ ID NO: 148422 - protein, 9 aa, Homo Sapiens
APWSLAEWL

SEQ ID NO: 148423 - protein, 9 aa, Homo Sapiens
CGDHQPGDP

SEQ ID NO: 148424 - protein, 9 aa, Homo Sapiens
DLDVQGQLD

SEQ ID NO: 148425 - protein, 9 aa, Homo Sapiens
RWEKIDLEN

SEQ ID NO: 148426 - protein, 9 aa, Homo Sapiens
FLPLHLKLT

SEQ ID NO: 148427 - protein, 9 aa, Homo Sapiens
EYEIFWGLR

SEQ ID NO: 148428 - protein, 9 aa, Homo Sapiens
LGGKRATPD

SEQ ID NO: 148429 - protein, 9 aa, Homo Sapiens
VSPMRLESF

SEQ ID NO: 148430 - protein, 9 aa, Homo Sapiens
LEKLMTRFP

SEQ ID NO: 148431 - protein, 9 aa, Homo Sapiens
TRTSMCMAI

SEQ ID NO: 148432 - protein, 9 aa, Homo Sapiens
NEKMRRGPG

SEQ ID NO: 148433 - protein, 9 aa, Homo Sapiens
IMVGKRGKT

SEQ ID NO: 148434 - protein, 9 aa, Homo Sapiens
EDSTPAFAI

SEQ ID NO: 148435 - protein, 9 aa, Homo Sapiens
PHSPPPSEH

SEQ ID NO: 148436 - protein, 9 aa, Homo Sapiens
TPTAELTGS

SEQ ID NO: 148437 - protein, 9 aa, Homo Sapiens
TWNFQFPPQ

SEQ ID NO: 148438 - protein, 9 aa, Homo Sapiens
PPSPSNPGQ

SEQ ID NO: 148439 - protein, 9 aa, Homo Sapiens
TVNSSHDTF

SEQ ID NO: 148440 - protein, 9 aa, Homo Sapiens
IWTGQEGLR

SEQ ID NO: 148441 - protein, 9 aa, Homo Sapiens
QDSLPAPGL

SEQ ID NO: 148442 - protein, 9 aa, Homo Sapiens
PRHVLLGPL

SEQ ID NO: 148443 - protein, 9 aa, Homo Sapiens
LGMCEGESA

SEQ ID NO: 148444 - protein, 9 aa, Homo Sapiens
AMHTTRPVW

SEQ ID NO: 148445 - protein, 9 aa, Homo Sapiens
RHTAGAVWH

SEQ ID NO: 148446 - protein, 9 aa, Homo Sapiens
RGGPGTTRE

SEQ ID NO: 148447 - protein, 9 aa, Homo Sapiens
SRKWRKRRK

SEQ ID NO: 148448 - protein, 9 aa, Homo Sapiens
TCCRPSCCY

SEQ ID NO: 148449 - protein, 9 aa, Homo Sapiens
WGLHLQKDV

SEQ ID NO: 148450 - protein, 9 aa, Homo Sapiens
LVDLTSWDG

SEQ ID NO: 148451 - protein, 9 aa, Homo Sapiens
PHEIPMSME

SEQ ID NO: 148452 - protein, 9 aa, Homo Sapiens
GMGSSPCSP

SEQ ID NO: 148453 - protein, 9 aa, Homo Sapiens
WLAAASEPP

SEQ ID NO: 148454 - protein, 9 aa, Homo Sapiens
GLPPATMTH

SEQ ID NO: 148455 - protein, 9 aa, Homo Sapiens
HVAYSVGWE

SEQ ID NO: 148456 - protein, 9 aa, Homo Sapiens
VWDPVHRPF

SEQ ID NO: 148457 - protein, 9 aa, Homo Sapiens
RLQGRVTEA

SEQ ID NO: 148458 - protein, 9 aa, Homo Sapiens
LKHLYSLHI

SEQ ID NO: 148459 - protein, 9 aa, Homo Sapiens
PPPRRCCAA

SEQ ID NO: 148460 - protein, 9 aa, Homo Sapiens
LQQPVGRVR

SEQ ID NO: 148461 - protein, 9 aa, Homo Sapiens
VGSPSYAPQ

SEQ ID NO: 148462 - protein, 9 aa, Homo Sapiens
FWIVPAHGP

SEQ ID NO: 148463 - protein, 9 aa, Homo Sapiens
WAQRRRWAS

SEQ ID NO: 148464 - protein, 9 aa, Homo Sapiens
RAEGVPAPA

SEQ ID NO: 148465 - protein, 9 aa, Homo Sapiens
PELLIDEAA

SEQ ID NO: 148466 - protein, 9 aa, Homo Sapiens
GLMTRCPAP

SEQ ID NO: 148467 - protein, 9 aa, Homo Sapiens
PRPRCRPAV

SEQ ID NO: 148468 - protein, 9 aa, Homo Sapiens
AMDNAGYSV

SEQ ID NO: 148469 - protein, 9 aa, Homo Sapiens
VTSSRSFLA

SEQ ID NO: 148470 - protein, 9 aa, Homo Sapiens
EDAALIIYE

SEQ ID NO: 148471 - protein, 9 aa, Homo Sapiens
TLNMMAVRV

SEQ ID NO: 148472 - protein, 9 aa, Homo Sapiens
ASRNVVWSS

SEQ ID NO: 148473 - protein, 9 aa, Homo Sapiens
RSSGSQCSL

SEQ ID NO: 148474 - protein, 9 aa, Homo Sapiens
SVVCFLPRE

SEQ ID NO: 148475 - protein, 9 aa, Homo Sapiens
KVLREKVPC

SEQ ID NO: 148476 - protein, 9 aa, Homo Sapiens
RMTPPPGPR

SEQ ID NO: 148477 - protein, 9 aa, Homo Sapiens
RSAAAASPR

SEQ ID NO: 148478 - protein, 9 aa, Homo Sapiens
TLFPSLYEL

SEQ ID NO: 148479 - protein, 9 aa, Homo Sapiens
HIFQDCEAG

SEQ ID NO: 148480 - protein, 9 aa, Homo Sapiens
QTLAVKHKA

SEQ ID NO: 148481 - protein, 9 aa, Homo Sapiens
AAFFVLWFP

SEQ ID NO: 148482 - protein, 9 aa, Homo Sapiens
STHSAWRRP

SEQ ID NO: 148483 - protein, 9 aa, Homo Sapiens
LASTDLGLA

SEQ ID NO: 148484 - protein, 9 aa, Homo Sapiens
SVVRCRSLT

SEQ ID NO: 148485 - protein, 9 aa, Homo Sapiens
GVPSGPREP

SEQ ID NO: 148486 - protein, 9 aa, Homo Sapiens
RFAGPFSNQ

SEQ ID NO: 148487 - protein, 9 aa, Homo Sapiens
ALVLGLDGA

SEQ ID NO: 148488 - protein, 9 aa, Homo Sapiens
KGKKIIEYY

SEQ ID NO: 148489 - protein, 9 aa, Homo Sapiens
DKNLVINKP

SEQ ID NO: 148490 - protein, 9 aa, Homo Sapiens
AAVAVARLW

SEQ ID NO: 148491 - protein, 9 aa, Homo Sapiens
TGSGRRATL

SEQ ID NO: 148492 - protein, 9 aa, Homo Sapiens
ASVAPATLP

SEQ ID NO: 148493 - protein, 9 aa, Homo Sapiens
PGGTDTMSA

SEQ ID NO: 148494 - protein, 9 aa, Homo Sapiens
DDHKTNENK

SEQ ID NO: 148495 - protein, 9 aa, Homo Sapiens
RHFQHHTKP

SEQ ID NO: 148496 - protein, 9 aa, Homo Sapiens
QWTKETNCE

SEQ ID NO: 148497 - protein, 9 aa, Homo Sapiens
THHLLLVKG

SEQ ID NO: 148498 - protein, 9 aa, Homo Sapiens
ASSSPPGAV

SEQ ID NO: 148499 - protein, 9 aa, Homo Sapiens
LPHGLWFLL

SEQ ID NO: 148500 - protein, 9 aa, Homo Sapiens
RQTAVVKKI

SEQ ID NO: 148501 - protein, 9 aa, Homo Sapiens
ELELVSRAV

SEQ ID NO: 148502 - protein, 9 aa, Homo Sapiens
AQYRPGLGC

SEQ ID NO: 148503 - protein, 9 aa, Homo Sapiens
VLAVKWGRN

SEQ ID NO: 148504 - protein, 9 aa, Homo Sapiens
KEGIYKAHI

SEQ ID NO: 148505 - protein, 9 aa, Homo Sapiens
LERMRSVHL

SEQ ID NO: 148506 - protein, 9 aa, Homo Sapiens
ILGQRATRH

SEQ ID NO: 148507 - protein, 9 aa, Homo Sapiens
SAPEKDKFL

SEQ ID NO: 148508 - protein, 9 aa, Homo Sapiens
SSVVLRTLH

SEQ ID NO: 148509 - protein, 9 aa, Homo Sapiens
CFMPDNIDP

SEQ ID NO: 148510 - protein, 9 aa, Homo Sapiens
IFLFVQPME

SEQ ID NO: 148511 - protein, 9 aa, Homo Sapiens
TAAWPCCAP

SEQ ID NO: 148512 - protein, 9 aa, Homo Sapiens
ALDKISAEK

SEQ ID NO: 148513 - protein, 9 aa, Homo Sapiens
EKGLSLKLG

SEQ ID NO: 148514 - protein, 9 aa, Homo Sapiens
MCLLIGLFS

SEQ ID NO: 148515 - protein, 9 aa, Homo Sapiens
GHSARIISA

SEQ ID NO: 148516 - protein, 9 aa, Homo Sapiens
ASKEKCVYF

SEQ ID NO: 148517 - protein, 9 aa, Homo Sapiens
ILYVLRSFD

SEQ ID NO: 148518 - protein, 9 aa, Homo Sapiens
ITVTALTFS

SEQ ID NO: 148519 - protein, 9 aa, Homo Sapiens
PPWSSQTHT

SEQ ID NO: 148520 - protein, 9 aa, Homo Sapiens
DGNGASTAR

SEQ ID NO: 148521 - protein, 9 aa, Homo Sapiens
PAPAPRPLP

SEQ ID NO: 148522 - protein, 9 aa, Homo Sapiens
KEDAALIIY

SEQ ID NO: 148523 - protein, 9 aa, Homo Sapiens
GFPPAVPAA

SEQ ID NO: 148524 - protein, 9 aa, Homo Sapiens
LEELEQREA

SEQ ID NO: 148525 - protein, 9 aa, Homo Sapiens
GCSVLHIVA

SEQ ID NO: 148526 - protein, 9 aa, Homo Sapiens
LLHTPGLPQ

SEQ ID NO: 148527 - protein, 9 aa, Homo Sapiens
FVLSSMLYM

SEQ ID NO: 148528 - protein, 9 aa, Homo Sapiens
REWCTWRAA

SEQ ID NO: 148529 - protein, 9 aa, Homo Sapiens
GGQWRAQTE

SEQ ID NO: 148530 - protein, 9 aa, Homo Sapiens
PPPQAPSQV

SEQ ID NO: 148531 - protein, 9 aa, Homo Sapiens
PKTVNSSHD

SEQ ID NO: 148532 - protein, 9 aa, Homo Sapiens
LLWLLGSRM

SEQ ID NO: 148533 - protein, 9 aa, Homo Sapiens
STCLSSSSI

SEQ ID NO: 148534 - protein, 9 aa, Homo Sapiens
SIISHTAAV

SEQ ID NO: 148535 - protein, 9 aa, Homo Sapiens
LLACRAPSL

SEQ ID NO: 148536 - protein, 9 aa, Homo Sapiens
PTDPQWHWP

SEQ ID NO: 148537 - protein, 9 aa, Homo Sapiens
WDGAWFLEE

SEQ ID NO: 148538 - protein, 9 aa, Homo Sapiens
PDVFICDNK

SEQ ID NO: 148539 - protein, 9 aa, Homo Sapiens
YVREVFPGD

SEQ ID NO: 148540 - protein, 9 aa, Homo Sapiens
KTLPILFGS

SEQ ID NO: 148541 - protein, 9 aa, Homo Sapiens
PWRPLHTAG

SEQ ID NO: 148542 - protein, 9 aa, Homo Sapiens
GYPSLFLSI

SEQ ID NO: 148543 - protein, 9 aa, Homo Sapiens
PLPLPCSPP

SEQ ID NO: 148544 - protein, 9 aa, Homo Sapiens
RQQTVLPHG

SEQ ID NO: 148545 - protein, 9 aa, Homo Sapiens
MTLAPHPRP

SEQ ID NO: 148546 - protein, 9 aa, Homo Sapiens
AKGEKGIDG

SEQ ID NO: 148547 - protein, 9 aa, Homo Sapiens
ALDPMSILF

SEQ ID NO: 148548 - protein, 9 aa, Homo Sapiens
GGVRRQLSV

SEQ ID NO: 148549 - protein, 9 aa, Homo Sapiens
TILGQEAAG

SEQ ID NO: 148550 - protein, 9 aa, Homo Sapiens
SQPPSPGKP

SEQ ID NO: 148551 - protein, 9 aa, Homo Sapiens
PALREKKFG

SEQ ID NO: 148552 - protein, 9 aa, Homo Sapiens
PTLSRLRSR

SEQ ID NO: 148553 - protein, 9 aa, Homo Sapiens
GVLLLVDDR

SEQ ID NO: 148554 - protein, 9 aa, Homo Sapiens
LLFIAALIL

SEQ ID NO: 148555 - protein, 9 aa, Homo Sapiens
LWSTPAPQK

SEQ ID NO: 148556 - protein, 9 aa, Homo Sapiens
VLNMEKNYN

SEQ ID NO: 148557 - protein, 9 aa, Homo Sapiens
VDVKLDPAM

SEQ ID NO: 148558 - protein, 9 aa, Homo Sapiens
PAGNRGAWK

SEQ ID NO: 148559 - protein, 9 aa, Homo Sapiens
AGEGPRQEL

SEQ ID NO: 148560 - protein, 9 aa, Homo Sapiens
DRCRLFECG

SEQ ID NO: 148561 - protein, 9 aa, Homo Sapiens
LVAQQPHQE

SEQ ID NO: 148562 - protein, 9 aa, Homo Sapiens
ADGLIQEND

SEQ ID NO: 148563 - protein, 9 aa, Homo Sapiens
VCVLPTVSG

SEQ ID NO: 148564 - protein, 9 aa, Homo Sapiens
VRWFPETCA

SEQ ID NO: 148565 - protein, 9 aa, Homo Sapiens
SSWTCLADL

SEQ ID NO: 148566 - protein, 9 aa, Homo Sapiens
PSQALQLLI

SEQ ID NO: 148567 - protein, 9 aa, Homo Sapiens
AAAFMRLNE

SEQ ID NO: 148568 - protein, 9 aa, Homo Sapiens
HQRTGRQHP

SEQ ID NO: 148569 - protein, 9 aa, Homo Sapiens
HTGIHTDTH

SEQ ID NO: 148570 - protein, 9 aa, Homo Sapiens
REERREVWV

SEQ ID NO: 148571 - protein, 9 aa, Homo Sapiens
PLPKTLEQR

SEQ ID NO: 148572 - protein, 9 aa, Homo Sapiens
LLRDLEPGM

SEQ ID NO: 148573 - protein, 9 aa, Homo Sapiens
MWSGFSARQ

SEQ ID NO: 148574 - protein, 9 aa, Homo Sapiens
TGEKPYVYR

SEQ ID NO: 148575 - protein, 9 aa, Homo Sapiens
PIPSPSACS

SEQ ID NO: 148576 - protein, 9 aa, Homo Sapiens
PFPPAVSCD

SEQ ID NO: 148577 - protein, 9 aa, Homo Sapiens
AVRTRSTSQ

SEQ ID NO: 148578 - protein, 9 aa, Homo Sapiens
QVSPGLLAA

SEQ ID NO: 148579 - protein, 9 aa, Homo Sapiens
PELILRMEN

SEQ ID NO: 148580 - protein, 9 aa, Homo Sapiens
LTHVLQSLT

SEQ ID NO: 148581 - protein, 9 aa, Homo Sapiens
NAAPEVGSP

SEQ ID NO: 148582 - protein, 9 aa, Homo Sapiens
KLAAFMKKI

SEQ ID NO: 148583 - protein, 9 aa, Homo Sapiens
MGGTRKASA

SEQ ID NO: 148584 - protein, 9 aa, Homo Sapiens
VDPSTSWSA

SEQ ID NO: 148585 - protein, 9 aa, Homo Sapiens
LHKFCFRYV

SEQ ID NO: 148586 - protein, 9 aa, Homo Sapiens
NINTGVKPY

SEQ ID NO: 148587 - protein, 9 aa, Homo Sapiens
PVHRPFARP

SEQ ID NO: 148588 - protein, 9 aa, Homo Sapiens
VMVVILQLR

SEQ ID NO: 148589 - protein, 9 aa, Homo Sapiens
RGDELVRFA

SEQ ID NO: 148590 - protein, 9 aa, Homo Sapiens
NQTQKNMLS

SEQ ID NO: 148591 - protein, 9 aa, Homo Sapiens
SIADRPSTC

SEQ ID NO: 148592 - protein, 9 aa, Homo Sapiens
PDSPNGPLG

SEQ ID NO: 148593 - protein, 9 aa, Homo Sapiens
TKDTHMEDF

SEQ ID NO: 148594 - protein, 9 aa, Homo Sapiens
LRLLGGLDR

SEQ ID NO: 148595 - protein, 9 aa, Homo Sapiens
KYQCQAPSV

SEQ ID NO: 148596 - protein, 9 aa, Homo Sapiens
AAVILDAND

SEQ ID NO: 148597 - protein, 9 aa, Homo Sapiens
WDRNHISAL

SEQ ID NO: 148598 - protein, 9 aa, Homo Sapiens
MDRFNLPCR

SEQ ID NO: 148599 - protein, 9 aa, Homo Sapiens
WRTTRSWRT

SEQ ID NO: 148600 - protein, 9 aa, Homo Sapiens
AAHSRVPSP

SEQ ID NO: 148601 - protein, 9 aa, Homo Sapiens
PPIGPSCVP

SEQ ID NO: 148602 - protein, 9 aa, Homo Sapiens
LLLVVVLIV

SEQ ID NO: 148603 - protein, 9 aa, Homo Sapiens
LWLLRGRLE

SEQ ID NO: 148604 - protein, 9 aa, Homo Sapiens
HAFLRSCHG

SEQ ID NO: 148605 - protein, 9 aa, Homo Sapiens
VVGFPVTPI

SEQ ID NO: 148606 - protein, 9 aa, Homo Sapiens
PLGCCPAPG

SEQ ID NO: 148607 - protein, 9 aa, Homo Sapiens
LAKAYIDPE

SEQ ID NO: 148608 - protein, 9 aa, Homo Sapiens
CEALRLQRS

SEQ ID NO: 148609 - protein, 9 aa, Homo Sapiens
CLRGHPSAF

SEQ ID NO: 148610 - protein, 9 aa, Homo Sapiens
TNPHSPGPG

SEQ ID NO: 148611 - protein, 9 aa, Homo Sapiens
AMWYINGTR

SEQ ID NO: 148612 - protein, 9 aa, Homo Sapiens
VYRMTQRGR

SEQ ID NO: 148613 - protein, 9 aa, Homo Sapiens
CLQVLTDKH

SEQ ID NO: 148614 - protein, 9 aa, Homo Sapiens
YSSCRKATR

SEQ ID NO: 148615 - protein, 9 aa, Homo Sapiens
QPQTPQDSR

SEQ ID NO: 148616 - protein, 9 aa, Homo Sapiens
TSQQILFQA

SEQ ID NO: 148617 - protein, 9 aa, Homo Sapiens
ASEPPQCHP

SEQ ID NO: 148618 - protein, 9 aa, Homo Sapiens
NLPCRSTDF

SEQ ID NO: 148619 - protein, 9 aa, Homo Sapiens
SEEQGGRGR

SEQ ID NO: 148620 - protein, 9 aa, Homo Sapiens
AVKHKADSE

SEQ ID NO: 148621 - protein, 9 aa, Homo Sapiens
ILITEFVGW

SEQ ID NO: 148622 - protein, 9 aa, Homo Sapiens
RQIYAGATL

SEQ ID NO: 148623 - protein, 9 aa, Homo Sapiens
RPCPLALAA

SEQ ID NO: 148624 - protein, 9 aa, Homo Sapiens
RGYAVSSHH

SEQ ID NO: 148625 - protein, 9 aa, Homo Sapiens
ITRARKGRE

SEQ ID NO: 148626 - protein, 9 aa, Homo Sapiens
KPNPAKSLT

SEQ ID NO: 148627 - protein, 9 aa, Homo Sapiens
EYLAEMGCG

SEQ ID NO: 148628 - protein, 9 aa, Homo Sapiens
VVPRMSSPR

SEQ ID NO: 148629 - protein, 9 aa, Homo Sapiens
DTVRVMEVF

SEQ ID NO: 148630 - protein, 9 aa, Homo Sapiens
DGDANHSTL

SEQ ID NO: 148631 - protein, 9 aa, Homo Sapiens
GPPPECCSS

SEQ ID NO: 148632 - protein, 9 aa, Homo Sapiens
SQYIRELRT

SEQ ID NO: 148633 - protein, 9 aa, Homo Sapiens
HRRFVAKKA

SEQ ID NO: 148634 - protein, 9 aa, Homo Sapiens
EPTHTGHLW

SEQ ID NO: 148635 - protein, 9 aa, Homo Sapiens
DPHCRHPLQ

SEQ ID NO: 148636 - protein, 9 aa, Homo Sapiens
DTSELRKDD

SEQ ID NO: 148637 - protein, 9 aa, Homo Sapiens
GPRYCVGSV

SEQ ID NO: 148638 - protein, 9 aa, Homo Sapiens
ISHMKMHTV

SEQ ID NO: 148639 - protein, 9 aa, Homo Sapiens
LHQSLPLGR

SEQ ID NO: 148640 - protein, 9 aa, Homo Sapiens
WPLLRGQSE

SEQ ID NO: 148641 - protein, 9 aa, Homo Sapiens
FPAPPEDDT

SEQ ID NO: 148642 - protein, 9 aa, Homo Sapiens
SGDLGGQAV

SEQ ID NO: 148643 - protein, 9 aa, Homo Sapiens
AHLLIALGL

SEQ ID NO: 148644 - protein, 9 aa, Homo Sapiens
VMMLSLSED

SEQ ID NO: 148645 - protein, 9 aa, Homo Sapiens
LRLLVWLEE

SEQ ID NO: 148646 - protein, 9 aa, Homo Sapiens
YPAASAPCW

SEQ ID NO: 148647 - protein, 9 aa, Homo Sapiens
SDSDGLAPQ

SEQ ID NO: 148648 - protein, 9 aa, Homo Sapiens
LLRFLRVQH

SEQ ID NO: 148649 - protein, 9 aa, Homo Sapiens
WATRKPPTP

SEQ ID NO: 148650 - protein, 9 aa, Homo Sapiens
VMHKTFGTQ

SEQ ID NO: 148651 - protein, 9 aa, Homo Sapiens
VPSNFWKGA

SEQ ID NO: 148652 - protein, 9 aa, Homo Sapiens
FVEQALRLG

SEQ ID NO: 148653 - protein, 9 aa, Homo Sapiens
VTPIIESRA

SEQ ID NO: 148654 - protein, 9 aa, Homo Sapiens
TKVFVWPIS

SEQ ID NO: 148655 - protein, 9 aa, Homo Sapiens
FTDAIIQER

SEQ ID NO: 148656 - protein, 9 aa, Homo Sapiens
QGGLQLGQL

SEQ ID NO: 148657 - protein, 9 aa, Homo Sapiens
MRIWSLRHG

SEQ ID NO: 148658 - protein, 9 aa, Homo Sapiens
DGLIQENDR

SEQ ID NO: 148659 - protein, 9 aa, Homo Sapiens
QPRTLSMDA

SEQ ID NO: 148660 - protein, 9 aa, Homo Sapiens
ETKAELIQS

SEQ ID NO: 148661 - protein, 9 aa, Homo Sapiens
SRLVHVYIV

SEQ ID NO: 148662 - protein, 9 aa, Homo Sapiens
GSYGFGGAR

SEQ ID NO: 148663 - protein, 9 aa, Homo Sapiens
LERRRVVRL

SEQ ID NO: 148664 - protein, 9 aa, Homo Sapiens
LILFQKKII

SEQ ID NO: 148665 - protein, 9 aa, Homo Sapiens
ESGVCFDIL

SEQ ID NO: 148666 - protein, 9 aa, Homo Sapiens
HNRNAPRDS

SEQ ID NO: 148667 - protein, 9 aa, Homo Sapiens
LELSSLKPG

SEQ ID NO: 148668 - protein, 9 aa, Homo Sapiens
ARPTPPQDR

SEQ ID NO: 148669 - protein, 9 aa, Homo Sapiens
ATGILKSLM

SEQ ID NO: 148670 - protein, 9 aa, Homo Sapiens
GQSCGLVAQ

SEQ ID NO: 148671 - protein, 9 aa, Homo Sapiens
RLMKVTENP

SEQ ID NO: 148672 - protein, 9 aa, Homo Sapiens
GWDELAARA

SEQ ID NO: 148673 - protein, 9 aa, Homo Sapiens
QRSMEELEN

SEQ ID NO: 148674 - protein, 9 aa, Homo Sapiens
PIEPHFGKM

SEQ ID NO: 148675 - protein, 9 aa, Homo Sapiens
RRHSHSWIR

SEQ ID NO: 148676 - protein, 9 aa, Homo Sapiens
LPRPGHTGD

SEQ ID NO: 148677 - protein, 9 aa, Homo Sapiens
LRARAEPMA

SEQ ID NO: 148678 - protein, 9 aa, Homo Sapiens
AATLHMAVH

SEQ ID NO: 148679 - protein, 9 aa, Homo Sapiens
HCFSSKVCV

SEQ ID NO: 148680 - protein, 9 aa, Homo Sapiens
GAQIYMCFM

SEQ ID NO: 148681 - protein, 9 aa, Homo Sapiens
YGHFGPFCD

SEQ ID NO: 148682 - protein, 9 aa, Homo Sapiens
EDDYWGGLR

SEQ ID NO: 148683 - protein, 9 aa, Homo Sapiens
ISHTAAVRL

SEQ ID NO: 148684 - protein, 9 aa, Homo Sapiens
LEIFAKLEE

SEQ ID NO: 148685 - protein, 9 aa, Homo Sapiens
GSVHPVSPM

SEQ ID NO: 148686 - protein, 9 aa, Homo Sapiens
IIMDPDEVH

SEQ ID NO: 148687 - protein, 9 aa, Homo Sapiens
GIVFRRVEN

SEQ ID NO: 148688 - protein, 9 aa, Homo Sapiens
RLQPALLAL

SEQ ID NO: 148689 - protein, 9 aa, Homo Sapiens
ASLRRSPGS

SEQ ID NO: 148690 - protein, 9 aa, Homo Sapiens
KYVKAKKST

SEQ ID NO: 148691 - protein, 9 aa, Homo Sapiens
LTNFLTEML

SEQ ID NO: 148692 - protein, 9 aa, Homo Sapiens
KPSVGVPHP

SEQ ID NO: 148693 - protein, 9 aa, Homo Sapiens
HQTIRLNPL

SEQ ID NO: 148694 - protein, 9 aa, Homo Sapiens
ALSGGDSVA

SEQ ID NO: 148695 - protein, 9 aa, Homo Sapiens
PMRMVTVPH

SEQ ID NO: 148696 - protein, 9 aa, Homo Sapiens
EPLTKQLWE

SEQ ID NO: 148697 - protein, 9 aa, Homo Sapiens
GNLTALPSQ

SEQ ID NO: 148698 - protein, 9 aa, Homo Sapiens
ALQASDTAA

SEQ ID NO: 148699 - protein, 9 aa, Homo Sapiens
QAVASQGLH

SEQ ID NO: 148700 - protein, 9 aa, Homo Sapiens
EPPQMPNDF

SEQ ID NO: 148701 - protein, 9 aa, Homo Sapiens
RAARAGDLP

SEQ ID NO: 148702 - protein, 9 aa, Homo Sapiens
LCSRSLRLL

SEQ ID NO: 148703 - protein, 9 aa, Homo Sapiens
PGGGGSPRS

SEQ ID NO: 148704 - protein, 9 aa, Homo Sapiens
RKRLEEQHT

SEQ ID NO: 148705 - protein, 9 aa, Homo Sapiens
WNEDCNFKE

SEQ ID NO: 148706 - protein, 9 aa, Homo Sapiens
LEDASTPFA

SEQ ID NO: 148707 - protein, 9 aa, Homo Sapiens
VNAVATRTW

SEQ ID NO: 148708 - protein, 9 aa, Homo Sapiens
PGLSAPGTD

SEQ ID NO: 148709 - protein, 9 aa, Homo Sapiens
VFRSCFHLG

SEQ ID NO: 148710 - protein, 9 aa, Homo Sapiens
LEMLEEKEV

SEQ ID NO: 148711 - protein, 9 aa, Homo Sapiens
HFHFRHTRE

SEQ ID NO: 148712 - protein, 9 aa, Homo Sapiens
KSAPVPKKA

SEQ ID NO: 148713 - protein, 9 aa, Homo Sapiens
GIQSWAVSC

SEQ ID NO: 148714 - protein, 9 aa, Homo Sapiens
WGWHGSLYP

SEQ ID NO: 148715 - protein, 9 aa, Homo Sapiens
GLDKSCLDI

SEQ ID NO: 148716 - protein, 9 aa, Homo Sapiens
PCPRMAAAA

SEQ ID NO: 148717 - protein, 9 aa, Homo Sapiens
FVDLDAHNH

SEQ ID NO: 148718 - protein, 9 aa, Homo Sapiens
DLESMDKAV

SEQ ID NO: 148719 - protein, 9 aa, Homo Sapiens
LQILVENIR

SEQ ID NO: 148720 - protein, 9 aa, Homo Sapiens
FSFFFCLRG

SEQ ID NO: 148721 - protein, 9 aa, Homo Sapiens
QVVYRSLGY

SEQ ID NO: 148722 - protein, 9 aa, Homo Sapiens
ALGIQDRTI

SEQ ID NO: 148723 - protein, 9 aa, Homo Sapiens
PAVMLCNLN

SEQ ID NO: 148724 - protein, 9 aa, Homo Sapiens
RAGCCVWLR

SEQ ID NO: 148725 - protein, 9 aa, Homo Sapiens
LWMANARRS

SEQ ID NO: 148726 - protein, 9 aa, Homo Sapiens
NATAEDNDQ

SEQ ID NO: 148727 - protein, 9 aa, Homo Sapiens
EYPVHEGPS

SEQ ID NO: 148728 - protein, 9 aa, Homo Sapiens
SGKTEDVVL

SEQ ID NO: 148729 - protein, 9 aa, Homo Sapiens
RIQRGMEVQ

SEQ ID NO: 148730 - protein, 9 aa, Homo Sapiens
FCWLVHRIN

SEQ ID NO: 148731 - protein, 9 aa, Homo Sapiens
CGRGRGAGR

SEQ ID NO: 148732 - protein, 9 aa, Homo Sapiens
NVDYPYLET

SEQ ID NO: 148733 - protein, 9 aa, Homo Sapiens
ACRMHPKVP

SEQ ID NO: 148734 - protein, 9 aa, Homo Sapiens
DYAQLSLHI

SEQ ID NO: 148735 - protein, 9 aa, Homo Sapiens
PNQKKRNTN

SEQ ID NO: 148736 - protein, 9 aa, Homo Sapiens
EVCHPEQVN

SEQ ID NO: 148737 - protein, 9 aa, Homo Sapiens
KCCLIDENK

SEQ ID NO: 148738 - protein, 9 aa, Homo Sapiens
CTKTIPVLC

SEQ ID NO: 148739 - protein, 9 aa, Homo Sapiens
VVLRTLHKP

SEQ ID NO: 148740 - protein, 9 aa, Homo Sapiens
APRRWSCWS

SEQ ID NO: 148741 - protein, 9 aa, Homo Sapiens
RVRGRDAPY

SEQ ID NO: 148742 - protein, 9 aa, Homo Sapiens
QILVEMEDE

SEQ ID NO: 148743 - protein, 9 aa, Homo Sapiens
DEPIFGKKH

SEQ ID NO: 148744 - protein, 9 aa, Homo Sapiens
GGLDLDPLL

SEQ ID NO: 148745 - protein, 9 aa, Homo Sapiens
LDIPGLPGI

SEQ ID NO: 148746 - protein, 9 aa, Homo Sapiens
KAREIICQS

SEQ ID NO: 148747 - protein, 9 aa, Homo Sapiens
LWPQGGGCV

SEQ ID NO: 148748 - protein, 9 aa, Homo Sapiens
EKSRWSGSH

SEQ ID NO: 148749 - protein, 9 aa, Homo Sapiens
HIVGPQWEC

SEQ ID NO: 148750 - protein, 9 aa, Homo Sapiens
EKMEDFQIY

SEQ ID NO: 148751 - protein, 9 aa, Homo Sapiens
LQRTPCSRL

SEQ ID NO: 148752 - protein, 9 aa, Homo Sapiens
RLQRSDGQV

SEQ ID NO: 148753 - protein, 9 aa, Homo Sapiens
KCKHRHLRF

SEQ ID NO: 148754 - protein, 9 aa, Homo Sapiens
FMLHLALMS

SEQ ID NO: 148755 - protein, 9 aa, Homo Sapiens
CTAKTGASS

SEQ ID NO: 148756 - protein, 9 aa, Homo Sapiens
HARHKVLAG

SEQ ID NO: 148757 - protein, 9 aa, Homo Sapiens
TPRLLAPFL

SEQ ID NO: 148758 - protein, 9 aa, Homo Sapiens
STRVDDIHP

SEQ ID NO: 148759 - protein, 9 aa, Homo Sapiens
GSKMAHWPK

SEQ ID NO: 148760 - protein, 9 aa, Homo Sapiens
IPKRRPRPK

SEQ ID NO: 148761 - protein, 9 aa, Homo Sapiens
DVLERGGRF

SEQ ID NO: 148762 - protein, 9 aa, Homo Sapiens
LEQRIQRGM

SEQ ID NO: 148763 - protein, 9 aa, Homo Sapiens
NKPLRGDPG

SEQ ID NO: 148764 - protein, 9 aa, Homo Sapiens
NVRQTAVVK

SEQ ID NO: 148765 - protein, 9 aa, Homo Sapiens
YGLPIVPFE

SEQ ID NO: 148766 - protein, 9 aa, Homo Sapiens
RKFSLTLSC

SEQ ID NO: 148767 - protein, 9 aa, Homo Sapiens
NLSNMTIQT

SEQ ID NO: 148768 - protein, 9 aa, Homo Sapiens
LSLHSLDKG

SEQ ID NO: 148769 - protein, 9 aa, Homo Sapiens
PPQVPVLTS

SEQ ID NO: 148770 - protein, 9 aa, Homo Sapiens
FSLILFQKK

SEQ ID NO: 148771 - protein, 9 aa, Homo Sapiens
LCGIVSTSS

SEQ ID NO: 148772 - protein, 9 aa, Homo Sapiens
IQKKQLALK

SEQ ID NO: 148773 - protein, 9 aa, Homo Sapiens
ASTPARSPT

SEQ ID NO: 148774 - protein, 9 aa, Homo Sapiens
MRNATQQKD

SEQ ID NO: 148775 - protein, 9 aa, Homo Sapiens
VCSGDATFP

SEQ ID NO: 148776 - protein, 9 aa, Homo Sapiens
GTDRNTQTH

SEQ ID NO: 148777 - protein, 9 aa, Homo Sapiens
PRSPAPAPP

SEQ ID NO: 148778 - protein, 9 aa, Homo Sapiens
CCRTTYCHP

SEQ ID NO: 148779 - protein, 9 aa, Homo Sapiens
VTEASLLCQ

SEQ ID NO: 148780 - protein, 9 aa, Homo Sapiens
LEKLKQGCL

SEQ ID NO: 148781 - protein, 9 aa, Homo Sapiens
KDGWPLCML

SEQ ID NO: 148782 - protein, 9 aa, Homo Sapiens
KRWQDVSMC

SEQ ID NO: 148783 - protein, 9 aa, Homo Sapiens
NYKVPESWF

SEQ ID NO: 148784 - protein, 9 aa, Homo Sapiens
FQILCILLR

SEQ ID NO: 148785 - protein, 9 aa, Homo Sapiens
KPNSRVLFH

SEQ ID NO: 148786 - protein, 9 aa, Homo Sapiens
PHTFSKSPS

SEQ ID NO: 148787 - protein, 9 aa, Homo Sapiens
TAAKPSARS

SEQ ID NO: 148788 - protein, 9 aa, Homo Sapiens
GGDGISDEY

SEQ ID NO: 148789 - protein, 9 aa, Homo Sapiens
QCLMSQRTQ

SEQ ID NO: 148790 - protein, 9 aa, Homo Sapiens
EGVNMRHLW

SEQ ID NO: 148791 - protein, 9 aa, Homo Sapiens
GSLSGWSGN

SEQ ID NO: 148792 - protein, 9 aa, Homo Sapiens
SVENFTPQN

SEQ ID NO: 148793 - protein, 9 aa, Homo Sapiens
TKTSRIYGF

SEQ ID NO: 148794 - protein, 9 aa, Homo Sapiens
HLPCGGVRN

SEQ ID NO: 148795 - protein, 9 aa, Homo Sapiens
RGQVRHSLG

SEQ ID NO: 148796 - protein, 9 aa, Homo Sapiens
SDLIAVRQV

SEQ ID NO: 148797 - protein, 9 aa, Homo Sapiens
ALADQRVAE

SEQ ID NO: 148798 - protein, 9 aa, Homo Sapiens
CPAFLCGMH

SEQ ID NO: 148799 - protein, 9 aa, Homo Sapiens
RRMERSANA

SEQ ID NO: 148800 - protein, 9 aa, Homo Sapiens
RWGWGQLLL

SEQ ID NO: 148801 - protein, 9 aa, Homo Sapiens
DTSCSLMAP

SEQ ID NO: 148802 - protein, 9 aa, Homo Sapiens
PQPRRPPMR

SEQ ID NO: 148803 - protein, 9 aa, Homo Sapiens
QHCFSSKVC

SEQ ID NO: 148804 - protein, 9 aa, Homo Sapiens
TLMVALNSC

SEQ ID NO: 148805 - protein, 9 aa, Homo Sapiens
ALFFGQNGL

SEQ ID NO: 148806 - protein, 9 aa, Homo Sapiens
RPFTVRYDP

SEQ ID NO: 148807 - protein, 9 aa, Homo Sapiens
SLQQLLELS

SEQ ID NO: 148808 - protein, 9 aa, Homo Sapiens
PRPRPHPLY

SEQ ID NO: 148809 - protein, 9 aa, Homo Sapiens
SSPRSRGSP

SEQ ID NO: 148810 - protein, 9 aa, Homo Sapiens
LHFHFRHTR

SEQ ID NO: 148811 - protein, 9 aa, Homo Sapiens
WAQSCPTFL

SEQ ID NO: 148812 - protein, 9 aa, Homo Sapiens
PLLHRRAAH

SEQ ID NO: 148813 - protein, 9 aa, Homo Sapiens
RQADALQEV

SEQ ID NO: 148814 - protein, 9 aa, Homo Sapiens
AIIQERRRT

SEQ ID NO: 148815 - protein, 9 aa, Homo Sapiens
FGQVAEDVF

SEQ ID NO: 148816 - protein, 9 aa, Homo Sapiens
LGKHLVFLG

SEQ ID NO: 148817 - protein, 9 aa, Homo Sapiens
VQVVRAREA

SEQ ID NO: 148818 - protein, 9 aa, Homo Sapiens
SPTRALGAG

SEQ ID NO: 148819 - protein, 9 aa, Homo Sapiens
WTTSWCGWR

SEQ ID NO: 148820 - protein, 9 aa, Homo Sapiens
DTYEFFTSL

SEQ ID NO: 148821 - protein, 9 aa, Homo Sapiens
PLSNHLESK

SEQ ID NO: 148822 - protein, 9 aa, Homo Sapiens
STAAWIPAS

SEQ ID NO: 148823 - protein, 9 aa, Homo Sapiens
VPLCFVLPW

SEQ ID NO: 148824 - protein, 9 aa, Homo Sapiens
PLEGGLNED

SEQ ID NO: 148825 - protein, 9 aa, Homo Sapiens
KLGNGVERP

SEQ ID NO: 148826 - protein, 9 aa, Homo Sapiens
NQGSVFIPY

SEQ ID NO: 148827 - protein, 9 aa, Homo Sapiens
ASARSPTSS

SEQ ID NO: 148828 - protein, 9 aa, Homo Sapiens
SASLAHSDN

SEQ ID NO: 148829 - protein, 9 aa, Homo Sapiens
QNGKLAKPP

SEQ ID NO: 148830 - protein, 9 aa, Homo Sapiens
CLECPSWKV

SEQ ID NO: 148831 - protein, 9 aa, Homo Sapiens
MAIAGYFDI

SEQ ID NO: 148832 - protein, 9 aa, Homo Sapiens
PVLPSQALQ

SEQ ID NO: 148833 - protein, 9 aa, Homo Sapiens
SPFGSSCLQ

SEQ ID NO: 148834 - protein, 9 aa, Homo Sapiens
LLILRSPRV

SEQ ID NO: 148835 - protein, 9 aa, Homo Sapiens
SHPQLAENK

SEQ ID NO: 148836 - protein, 9 aa, Homo Sapiens
KTATVRPKQ

SEQ ID NO: 148837 - protein, 9 aa, Homo Sapiens
APAPGSPRL

SEQ ID NO: 148838 - protein, 9 aa, Homo Sapiens
LMLTVSHGR

SEQ ID NO: 148839 - protein, 9 aa, Homo Sapiens
RGSLEWLRL

SEQ ID NO: 148840 - protein, 9 aa, Homo Sapiens
SFSWLPQRC

SEQ ID NO: 148841 - protein, 9 aa, Homo Sapiens
GGEGAWVGA

SEQ ID NO: 148842 - protein, 9 aa, Homo Sapiens
CSKAYRERY

SEQ ID NO: 148843 - protein, 9 aa, Homo Sapiens
AQGGYRDKT

SEQ ID NO: 148844 - protein, 9 aa, Homo Sapiens
STTRPPTPS

SEQ ID NO: 148845 - protein, 9 aa, Homo Sapiens
RGGTTIGEV

SEQ ID NO: 148846 - protein, 9 aa, Homo Sapiens
TAARPSATN

SEQ ID NO: 148847 - protein, 9 aa, Homo Sapiens
WCARWTVSP

SEQ ID NO: 148848 - protein, 9 aa, Homo Sapiens
IALPSLQQL

SEQ ID NO: 148849 - protein, 9 aa, Homo Sapiens
ASHISYVPP

SEQ ID NO: 148850 - protein, 9 aa, Homo Sapiens
FKEQKQNST

SEQ ID NO: 148851 - protein, 9 aa, Homo Sapiens
GPRPHSHNK

SEQ ID NO: 148852 - protein, 9 aa, Homo Sapiens
PCGELLVAL

SEQ ID NO: 148853 - protein, 9 aa, Homo Sapiens
GVWRARQVF

SEQ ID NO: 148854 - protein, 9 aa, Homo Sapiens
LPVPERTMA

SEQ ID NO: 148855 - protein, 9 aa, Homo Sapiens
VSPRLVNAV

SEQ ID NO: 148856 - protein, 9 aa, Homo Sapiens
CTADYSLRS

SEQ ID NO: 148857 - protein, 9 aa, Homo Sapiens
ADVTKKNKG

SEQ ID NO: 148858 - protein, 9 aa, Homo Sapiens
AMKKNLRIG

SEQ ID NO: 148859 - protein, 9 aa, Homo Sapiens
TLLDDVVGG

SEQ ID NO: 148860 - protein, 9 aa, Homo Sapiens
TLTYTGTHR

SEQ ID NO: 148861 - protein, 9 aa, Homo Sapiens
TRGVSRRPL

SEQ ID NO: 148862 - protein, 9 aa, Homo Sapiens
LPGWGQWHL

SEQ ID NO: 148863 - protein, 9 aa, Homo Sapiens
PPYRAFLRT

SEQ ID NO: 148864 - protein, 9 aa, Homo Sapiens
PPRSRLAAA

SEQ ID NO: 148865 - protein, 9 aa, Homo Sapiens
MLEEKEVVE

SEQ ID NO: 148866 - protein, 9 aa, Homo Sapiens
KRLGRLLIL

SEQ ID NO: 148867 - protein, 9 aa, Homo Sapiens
KNGNTVLSI

SEQ ID NO: 148868 - protein, 9 aa, Homo Sapiens
SWSQTSCFG

SEQ ID NO: 148869 - protein, 9 aa, Homo Sapiens
TGTSSGLEI

SEQ ID NO: 148870 - protein, 9 aa, Homo Sapiens
RARTCSPCS

SEQ ID NO: 148871 - protein, 9 aa, Homo Sapiens
LDGPQKNQK

SEQ ID NO: 148872 - protein, 9 aa, Homo Sapiens
CHIPVVRRE

SEQ ID NO: 148873 - protein, 9 aa, Homo Sapiens
SMGMTVSKP

SEQ ID NO: 148874 - protein, 9 aa, Homo Sapiens
RNSERVRED

SEQ ID NO: 148875 - protein, 9 aa, Homo Sapiens
GPSSRDREP

SEQ ID NO: 148876 - protein, 9 aa, Homo Sapiens
MAWLRHRLR

SEQ ID NO: 148877 - protein, 9 aa, Homo Sapiens
SSHHGSRGA

SEQ ID NO: 148878 - protein, 9 aa, Homo Sapiens
SKGYVRIME

SEQ ID NO: 148879 - protein, 9 aa, Homo Sapiens
YTPKEPGIY

SEQ ID NO: 148880 - protein, 9 aa, Homo Sapiens
PRLHSVPLC

SEQ ID NO: 148881 - protein, 9 aa, Homo Sapiens
ERSPGHPRG

SEQ ID NO: 148882 - protein, 9 aa, Homo Sapiens
GLATERSPL

SEQ ID NO: 148883 - protein, 9 aa, Homo Sapiens
SQTPPLLTL

SEQ ID NO: 148884 - protein, 9 aa, Homo Sapiens
WKTCWCYLT

SEQ ID NO: 148885 - protein, 9 aa, Homo Sapiens
TPCSRLVLG

SEQ ID NO: 148886 - protein, 9 aa, Homo Sapiens
MEANIQLYL

SEQ ID NO: 148887 - protein, 9 aa, Homo Sapiens
KKRKRNLSN

SEQ ID NO: 148888 - protein, 9 aa, Homo Sapiens
QGNPAVSYV

SEQ ID NO: 148889 - protein, 9 aa, Homo Sapiens
LTGQKRAGN

SEQ ID NO: 148890 - protein, 9 aa, Homo Sapiens
CLMSQGKFG

SEQ ID NO: 148891 - protein, 9 aa, Homo Sapiens
ATGRRRRRT

SEQ ID NO: 148892 - protein, 9 aa, Homo Sapiens
RNVKHMHQL

SEQ ID NO: 148893 - protein, 9 aa, Homo Sapiens
GIKGRGKWA

SEQ ID NO: 148894 - protein, 9 aa, Homo Sapiens
IVGNSGNLR

SEQ ID NO: 148895 - protein, 9 aa, Homo Sapiens
LYVLRSFDY

SEQ ID NO: 148896 - protein, 9 aa, Homo Sapiens
MGQGWSYSA

SEQ ID NO: 148897 - protein, 9 aa, Homo Sapiens
PHVPRQLPG

SEQ ID NO: 148898 - protein, 9 aa, Homo Sapiens
PSAIGPRSC

SEQ ID NO: 148899 - protein, 9 aa, Homo Sapiens
HLGLPGRAE

SEQ ID NO: 148900 - protein, 9 aa, Homo Sapiens
TENCGHPKD

SEQ ID NO: 148901 - protein, 9 aa, Homo Sapiens
CPQFHNLPC

SEQ ID NO: 148902 - protein, 9 aa, Homo Sapiens
EKVSKKRLP

SEQ ID NO: 148903 - protein, 9 aa, Homo Sapiens
SSRIVAPGH

SEQ ID NO: 148904 - protein, 9 aa, Homo Sapiens
ASTFSLRVP

SEQ ID NO: 148905 - protein, 9 aa, Homo Sapiens
RCTHHLLLV

SEQ ID NO: 148906 - protein, 9 aa, Homo Sapiens
HGGSWGTVW

SEQ ID NO: 148907 - protein, 9 aa, Homo Sapiens
GLPHGLWFL

SEQ ID NO: 148908 - protein, 9 aa, Homo Sapiens
SAAQGSVMI

SEQ ID NO: 148909 - protein, 9 aa, Homo Sapiens
GGPFHYQYG

SEQ ID NO: 148910 - protein, 9 aa, Homo Sapiens
SSLSDYNIQ

SEQ ID NO: 148911 - protein, 9 aa, Homo Sapiens
GLELSERCN

SEQ ID NO: 148912 - protein, 9 aa, Homo Sapiens
LVQAEAMTF

SEQ ID NO: 148913 - protein, 9 aa, Homo Sapiens
LGRSCFHLE

SEQ ID NO: 148914 - protein, 9 aa, Homo Sapiens
HLWQALLHL

SEQ ID NO: 148915 - protein, 9 aa, Homo Sapiens
QAEAMTFLL

SEQ ID NO: 148916 - protein, 9 aa, Homo Sapiens
DVNAVTRQG

SEQ ID NO: 148917 - protein, 9 aa, Homo Sapiens
RLTSAYRNK

SEQ ID NO: 148918 - protein, 9 aa, Homo Sapiens
PELMPHTFS

SEQ ID NO: 148919 - protein, 9 aa, Homo Sapiens
LPEPGCLRP

SEQ ID NO: 148920 - protein, 9 aa, Homo Sapiens
KQKVLREKV

SEQ ID NO: 148921 - protein, 9 aa, Homo Sapiens
EFDNVSLSP

SEQ ID NO: 148922 - protein, 9 aa, Homo Sapiens
LSIGDEDQR

SEQ ID NO: 148923 - protein, 9 aa, Homo Sapiens
CHRLEGWPS

SEQ ID NO: 148924 - protein, 9 aa, Homo Sapiens
TDTLACTGT

SEQ ID NO: 148925 - protein, 9 aa, Homo Sapiens
DSPDPDVDD

SEQ ID NO: 148926 - protein, 9 aa, Homo Sapiens
RHSDLPPPR

SEQ ID NO: 148927 - protein, 9 aa, Homo Sapiens
FYHAYGSYL

SEQ ID NO: 148928 - protein, 9 aa, Homo Sapiens
VPCGDPPPY

SEQ ID NO: 148929 - protein, 9 aa, Homo Sapiens
AAARPTPRV

SEQ ID NO: 148930 - protein, 9 aa, Homo Sapiens
TCLQYGIPH

SEQ ID NO: 148931 - protein, 9 aa, Homo Sapiens
PICCFQAIC

SEQ ID NO: 148932 - protein, 9 aa, Homo Sapiens
VIHHGVKEI

SEQ ID NO: 148933 - protein, 9 aa, Homo Sapiens
PSHNSEKRK

SEQ ID NO: 148934 - protein, 9 aa, Homo Sapiens
WVVFHKFKG

SEQ ID NO: 148935 - protein, 9 aa, Homo Sapiens
ALVGPHARV

SEQ ID NO: 148936 - protein, 9 aa, Homo Sapiens
PMGPPGLHG

SEQ ID NO: 148937 - protein, 9 aa, Homo Sapiens
ETPIKKKRT

SEQ ID NO: 148938 - protein, 9 aa, Homo Sapiens
KLISHLMKW

SEQ ID NO: 148939 - protein, 9 aa, Homo Sapiens
ASEAGARAA

SEQ ID NO: 148940 - protein, 9 aa, Homo Sapiens
PFHYQYGVL

SEQ ID NO: 148941 - protein, 9 aa, Homo Sapiens
LTDPVLFTP

SEQ ID NO: 148942 - protein, 9 aa, Homo Sapiens
SPTLSRLRS

SEQ ID NO: 148943 - protein, 9 aa, Homo Sapiens
AGGKRAAGQ

SEQ ID NO: 148944 - protein, 9 aa, Homo Sapiens
GSLYVREVF

SEQ ID NO: 148945 - protein, 9 aa, Homo Sapiens
LGDVFICQY

SEQ ID NO: 148946 - protein, 9 aa, Homo Sapiens
PSPPARCAR

SEQ ID NO: 148947 - protein, 9 aa, Homo Sapiens
WPRDSPTLS

SEQ ID NO: 148948 - protein, 9 aa, Homo Sapiens
PPARASPAP

SEQ ID NO: 148949 - protein, 9 aa, Homo Sapiens
PTLFALSPG

SEQ ID NO: 148950 - protein, 9 aa, Homo Sapiens
KLERMRSVH

SEQ ID NO: 148951 - protein, 9 aa, Homo Sapiens
CAMAPETTL

SEQ ID NO: 148952 - protein, 9 aa, Homo Sapiens
LHQDKNLVI

SEQ ID NO: 148953 - protein, 9 aa, Homo Sapiens
YQGKNTYPE

SEQ ID NO: 148954 - protein, 9 aa, Homo Sapiens
GLLAGLPHF

SEQ ID NO: 148955 - protein, 9 aa, Homo Sapiens
RTPLATNSP

SEQ ID NO: 148956 - protein, 9 aa, Homo Sapiens
WRGARVPEW

SEQ ID NO: 148957 - protein, 9 aa, Homo Sapiens
HGEISSCDY

SEQ ID NO: 148958 - protein, 9 aa, Homo Sapiens
LRPPHADDA

SEQ ID NO: 148959 - protein, 9 aa, Homo Sapiens
LALSPDSAG

SEQ ID NO: 148960 - protein, 9 aa, Homo Sapiens
PDDVQQKIE

SEQ ID NO: 148961 - protein, 9 aa, Homo Sapiens
TGSREKRRR

SEQ ID NO: 148962 - protein, 9 aa, Homo Sapiens
GWAPESAGP

SEQ ID NO: 148963 - protein, 9 aa, Homo Sapiens
CSCSSCSTS

SEQ ID NO: 148964 - protein, 9 aa, Homo Sapiens
ECVFREQFK

SEQ ID NO: 148965 - protein, 9 aa, Homo Sapiens
LTVLVVVAA

SEQ ID NO: 148966 - protein, 9 aa, Homo Sapiens
AFRISSCLR

SEQ ID NO: 148967 - protein, 9 aa, Homo Sapiens
CVPICSGAS

SEQ ID NO: 148968 - protein, 9 aa, Homo Sapiens
TARPRPQSE

SEQ ID NO: 148969 - protein, 9 aa, Homo Sapiens
KLMTRFPQC

SEQ ID NO: 148970 - protein, 9 aa, Homo Sapiens
GICSPTWST

SEQ ID NO: 148971 - protein, 9 aa, Homo Sapiens
LSLLSLWTC

SEQ ID NO: 148972 - protein, 9 aa, Homo Sapiens
PLTIGEKTE

SEQ ID NO: 148973 - protein, 9 aa, Homo Sapiens
CPQGQPAIL

SEQ ID NO: 148974 - protein, 9 aa, Homo Sapiens
SLPELPVTP

SEQ ID NO: 148975 - protein, 9 aa, Homo Sapiens
CLHRARAEE

SEQ ID NO: 148976 - protein, 9 aa, Homo Sapiens
RRVAPTAPA

SEQ ID NO: 148977 - protein, 9 aa, Homo Sapiens
GQTALMLTV

SEQ ID NO: 148978 - protein, 9 aa, Homo Sapiens
CSSSEVPCS

SEQ ID NO: 148979 - protein, 9 aa, Homo Sapiens
CKTSPPPQI

SEQ ID NO: 148980 - protein, 9 aa, Homo Sapiens
HHGSRGAAD

SEQ ID NO: 148981 - protein, 9 aa, Homo Sapiens
GEKPDPIPD

SEQ ID NO: 148982 - protein, 9 aa, Homo Sapiens
DQEPTHTGH

SEQ ID NO: 148983 - protein, 9 aa, Homo Sapiens
APAPPLQPR

SEQ ID NO: 148984 - protein, 9 aa, Homo Sapiens
SDKDPPKWK

SEQ ID NO: 148985 - protein, 9 aa, Homo Sapiens
LGVTTGLLV

SEQ ID NO: 148986 - protein, 9 aa, Homo Sapiens
IHCKSLPPS

SEQ ID NO: 148987 - protein, 9 aa, Homo Sapiens
AWGLFTPAP

SEQ ID NO: 148988 - protein, 9 aa, Homo Sapiens
ISDLIAVRQ

SEQ ID NO: 148989 - protein, 9 aa, Homo Sapiens
FPSHFTQQW

SEQ ID NO: 148990 - protein, 9 aa, Homo Sapiens
EECGKSGAV

SEQ ID NO: 148991 - protein, 9 aa, Homo Sapiens
HFQHHTKPN

SEQ ID NO: 148992 - protein, 9 aa, Homo Sapiens
DFMNAVKEK

SEQ ID NO: 148993 - protein, 9 aa, Homo Sapiens
LGQEAAGSL

SEQ ID NO: 148994 - protein, 9 aa, Homo Sapiens
EMIYVKINL

SEQ ID NO: 148995 - protein, 9 aa, Homo Sapiens
SLGIRAQGT

SEQ ID NO: 148996 - protein, 9 aa, Homo Sapiens
TGAAWSRRP

SEQ ID NO: 148997 - protein, 9 aa, Homo Sapiens
GWSASCGPT

SEQ ID NO: 148998 - protein, 9 aa, Homo Sapiens
EVEVTIVDA

SEQ ID NO: 148999 - protein, 9 aa, Homo Sapiens
LAPHPRPEG

SEQ ID NO: 149000 - protein, 9 aa, Homo Sapiens
SSAQVRAAR

SEQ ID NO: 149001 - protein, 9 aa, Homo Sapiens
IIPPGSSHA

SEQ ID NO: 149002 - protein, 9 aa, Homo Sapiens
PPFTYLISL

SEQ ID NO: 149003 - protein, 9 aa, Homo Sapiens
GHFFQNKIP

SEQ ID NO: 149004 - protein, 9 aa, Homo Sapiens
MPWKTCWCY

SEQ ID NO: 149005 - protein, 9 aa, Homo Sapiens
DLPWGDCYH

SEQ ID NO: 149006 - protein, 9 aa, Homo Sapiens
RGPNPIKLI

SEQ ID NO: 149007 - protein, 9 aa, Homo Sapiens
LLCSRSLRL

SEQ ID NO: 149008 - protein, 9 aa, Homo Sapiens
MKMHTVGGA

SEQ ID NO: 149009 - protein, 9 aa, Homo Sapiens
PAAAAPGEG

SEQ ID NO: 149010 - protein, 9 aa, Homo Sapiens
FRFDADVRQ

SEQ ID NO: 149011 - protein, 9 aa, Homo Sapiens
KGNFFFQNP

SEQ ID NO: 149012 - protein, 9 aa, Homo Sapiens
IFSIHQPQY

SEQ ID NO: 149013 - protein, 9 aa, Homo Sapiens
EVVGVYGSL

SEQ ID NO: 149014 - protein, 9 aa, Homo Sapiens
NSFCAMGVA

SEQ ID NO: 149015 - protein, 9 aa, Homo Sapiens
ENETWWMCD

SEQ ID NO: 149016 - protein, 9 aa, Homo Sapiens
MNDARHGGW

SEQ ID NO: 149017 - protein, 9 aa, Homo Sapiens
YRTSNISHQ

SEQ ID NO: 149018 - protein, 9 aa, Homo Sapiens
SKENQQPDG

SEQ ID NO: 149019 - protein, 9 aa, Homo Sapiens
SMCMAIAGY

SEQ ID NO: 149020 - protein, 9 aa, Homo Sapiens
NANWERERT

SEQ ID NO: 149021 - protein, 9 aa, Homo Sapiens
RCCLRTSCG

SEQ ID NO: 149022 - protein, 9 aa, Homo Sapiens
LESPALKQV

SEQ ID NO: 149023 - protein, 9 aa, Homo Sapiens
SRLVLGRAA

SEQ ID NO: 149024 - protein, 9 aa, Homo Sapiens
KVPGKPEVE

SEQ ID NO: 149025 - protein, 9 aa, Homo Sapiens
RFKKPGSKI

SEQ ID NO: 149026 - protein, 9 aa, Homo Sapiens
QVREHVLEE

SEQ ID NO: 149027 - protein, 9 aa, Homo Sapiens
SLSITSPNT

SEQ ID NO: 149028 - protein, 9 aa, Homo Sapiens
LDVRTAPLL

SEQ ID NO: 149029 - protein, 9 aa, Homo Sapiens
TMRRVNQEE

SEQ ID NO: 149030 - protein, 9 aa, Homo Sapiens
SVQPEEEGE

SEQ ID NO: 149031 - protein, 9 aa, Homo Sapiens
RSLSCCPRP

SEQ ID NO: 149032 - protein, 9 aa, Homo Sapiens
KYCQLTAHL

SEQ ID NO: 149033 - protein, 9 aa, Homo Sapiens
HKTVWRLVP

SEQ ID NO: 149034 - protein, 9 aa, Homo Sapiens
PTKKRGKSQ

SEQ ID NO: 149035 - protein, 9 aa, Homo Sapiens
RRRWASRAQ

SEQ ID NO: 149036 - protein, 9 aa, Homo Sapiens
APSAGRTSA

SEQ ID NO: 149037 - protein, 9 aa, Homo Sapiens
VHVYIVFYS

SEQ ID NO: 149038 - protein, 9 aa, Homo Sapiens
TEDDYWGGL

SEQ ID NO: 149039 - protein, 9 aa, Homo Sapiens
PDSTPRGRT

SEQ ID NO: 149040 - protein, 9 aa, Homo Sapiens
AGHVATMIA

SEQ ID NO: 149041 - protein, 9 aa, Homo Sapiens
IENVHGGHA

SEQ ID NO: 149042 - protein, 9 aa, Homo Sapiens
ENAFNGICR

SEQ ID NO: 149043 - protein, 9 aa, Homo Sapiens
DTLCKKKMP

SEQ ID NO: 149044 - protein, 9 aa, Homo Sapiens
INTGVKPYS

SEQ ID NO: 149045 - protein, 9 aa, Homo Sapiens
QDWLAVNEA

SEQ ID NO: 149046 - protein, 9 aa, Homo Sapiens
GPSLPAGGR

SEQ ID NO: 149047 - protein, 9 aa, Homo Sapiens
SYHAVASGN

SEQ ID NO: 149048 - protein, 9 aa, Homo Sapiens
DRSKARSLY

SEQ ID NO: 149049 - protein, 9 aa, Homo Sapiens
KDGRVAVPY

SEQ ID NO: 149050 - protein, 9 aa, Homo Sapiens
LRHGLPLHL

SEQ ID NO: 149051 - protein, 9 aa, Homo Sapiens
CSLTRATSP

SEQ ID NO: 149052 - protein, 9 aa, Homo Sapiens
TPPSSTLTS

SEQ ID NO: 149053 - protein, 9 aa, Homo Sapiens
GASLRPSKL

SEQ ID NO: 149054 - protein, 9 aa, Homo Sapiens
SLLPDTSCS

SEQ ID NO: 149055 - protein, 9 aa, Homo Sapiens
LPVPQGQKR

SEQ ID NO: 149056 - protein, 9 aa, Homo Sapiens
PWHLCMGLK

SEQ ID NO: 149057 - protein, 9 aa, Homo Sapiens
SAPTAAKPS

SEQ ID NO: 149058 - protein, 9 aa, Homo Sapiens
MQQEVIVLF

SEQ ID NO: 149059 - protein, 9 aa, Homo Sapiens
SACQGVYLW

SEQ ID NO: 149060 - protein, 9 aa, Homo Sapiens
SCSTLLRSS

SEQ ID NO: 149061 - protein, 9 aa, Homo Sapiens
EKLTVRIGV

SEQ ID NO: 149062 - protein, 9 aa, Homo Sapiens
VVLRLDGSQ

SEQ ID NO: 149063 - protein, 9 aa, Homo Sapiens
DPDVDDSAL

SEQ ID NO: 149064 - protein, 9 aa, Homo Sapiens
ISASLAAGT

SEQ ID NO: 149065 - protein, 9 aa, Homo Sapiens
TVHPAQTSL

SEQ ID NO: 149066 - protein, 9 aa, Homo Sapiens
ESVLRLGPH

SEQ ID NO: 149067 - protein, 9 aa, Homo Sapiens
DLDWEPAVE

SEQ ID NO: 149068 - protein, 9 aa, Homo Sapiens
CRVGTVLQL

SEQ ID NO: 149069 - protein, 9 aa, Homo Sapiens
TQAYTQTHT

SEQ ID NO: 149070 - protein, 9 aa, Homo Sapiens
QMHSSGSKR

SEQ ID NO: 149071 - protein, 9 aa, Homo Sapiens
SQACYLLYH

SEQ ID NO: 149072 - protein, 9 aa, Homo Sapiens
RCAQTAVVL

SEQ ID NO: 149073 - protein, 9 aa, Homo Sapiens
QGKFGFATL

SEQ ID NO: 149074 - protein, 9 aa, Homo Sapiens
SPQDSGVVS

SEQ ID NO: 149075 - protein, 9 aa, Homo Sapiens
HRLHLLLHP

SEQ ID NO: 149076 - protein, 9 aa, Homo Sapiens
NKRIAYKCC

SEQ ID NO: 149077 - protein, 9 aa, Homo Sapiens
LNPTQAFLL

SEQ ID NO: 149078 - protein, 9 aa, Homo Sapiens
KIKANRMSN

SEQ ID NO: 149079 - protein, 9 aa, Homo Sapiens
PSLAQAQPN

SEQ ID NO: 149080 - protein, 9 aa, Homo Sapiens
VPPTGACCT

SEQ ID NO: 149081 - protein, 9 aa, Homo Sapiens
FWLRMVSFC

SEQ ID NO: 149082 - protein, 9 aa, Homo Sapiens
GTFYTRERL

SEQ ID NO: 149083 - protein, 9 aa, Homo Sapiens
PSVQPEEEG

SEQ ID NO: 149084 - protein, 9 aa, Homo Sapiens
PRPTVAFLP

SEQ ID NO: 149085 - protein, 9 aa, Homo Sapiens
SGTAPSAVP

SEQ ID NO: 149086 - protein, 9 aa, Homo Sapiens
DLVLGVDGH

SEQ ID NO: 149087 - protein, 9 aa, Homo Sapiens
HRPASAWTS

SEQ ID NO: 149088 - protein, 9 aa, Homo Sapiens
HYDGCRVYP

SEQ ID NO: 149089 - protein, 9 aa, Homo Sapiens
DQILRVNNK

SEQ ID NO: 149090 - protein, 9 aa, Homo Sapiens
CSRFSRRVL

SEQ ID NO: 149091 - protein, 9 aa, Homo Sapiens
PDERGPLKH

SEQ ID NO: 149092 - protein, 9 aa, Homo Sapiens
ARRCTGPPA

SEQ ID NO: 149093 - protein, 9 aa, Homo Sapiens
HEDGTVLFW

SEQ ID NO: 149094 - protein, 9 aa, Homo Sapiens
LLEEYMVYM

SEQ ID NO: 149095 - protein, 9 aa, Homo Sapiens
EQLSPQSRV

SEQ ID NO: 149096 - protein, 9 aa, Homo Sapiens
CATTTCPGP

SEQ ID NO: 149097 - protein, 9 aa, Homo Sapiens
ALSEQANQG

SEQ ID NO: 149098 - protein, 9 aa, Homo Sapiens
PSLCSVTLR

SEQ ID NO: 149099 - protein, 9 aa, Homo Sapiens
GKVARKHSG

SEQ ID NO: 149100 - protein, 9 aa, Homo Sapiens
LLSPVQWVG

SEQ ID NO: 149101 - protein, 9 aa, Homo Sapiens
LQEKYVLWR

SEQ ID NO: 149102 - protein, 9 aa, Homo Sapiens
FPLQVWLLT

SEQ ID NO: 149103 - protein, 9 aa, Homo Sapiens
PSFKEWFHA

SEQ ID NO: 149104 - protein, 9 aa, Homo Sapiens
DEVPPIKKK

SEQ ID NO: 149105 - protein, 9 aa, Homo Sapiens
RGEWRQGGS

SEQ ID NO: 149106 - protein, 9 aa, Homo Sapiens
HFTQQWTKE

SEQ ID NO: 149107 - protein, 9 aa, Homo Sapiens
EQRPEVLEG

SEQ ID NO: 149108 - protein, 9 aa, Homo Sapiens
PRCRPAVAS

SEQ ID NO: 149109 - protein, 9 aa, Homo Sapiens
ALSTCTGSG

SEQ ID NO: 149110 - protein, 9 aa, Homo Sapiens
SRSGWPRTP

SEQ ID NO: 149111 - protein, 9 aa, Homo Sapiens
ETWREEKNV

SEQ ID NO: 149112 - protein, 9 aa, Homo Sapiens
EFAERTVVK

SEQ ID NO: 149113 - protein, 9 aa, Homo Sapiens
LGSSCAPLL

SEQ ID NO: 149114 - protein, 9 aa, Homo Sapiens
PAVSSRRLR

SEQ ID NO: 149115 - protein, 9 aa, Homo Sapiens
TSPPPQILE

SEQ ID NO: 149116 - protein, 9 aa, Homo Sapiens
ALHWKNVYL

SEQ ID NO: 149117 - protein, 9 aa, Homo Sapiens
WSAETLHKL

SEQ ID NO: 149118 - protein, 9 aa, Homo Sapiens
LAHSDNFPR

SEQ ID NO: 149119 - protein, 9 aa, Homo Sapiens
RWSCWSTAA

SEQ ID NO: 149120 - protein, 9 aa, Homo Sapiens
VLHPGHFPL

SEQ ID NO: 149121 - protein, 9 aa, Homo Sapiens
LPPDVLRHV

SEQ ID NO: 149122 - protein, 9 aa, Homo Sapiens
APAKGKIKV

SEQ ID NO: 149123 - protein, 9 aa, Homo Sapiens
TTRPVWGPA

SEQ ID NO: 149124 - protein, 9 aa, Homo Sapiens
TLLSTTRPP

SEQ ID NO: 149125 - protein, 9 aa, Homo Sapiens
ALPSQLVPA

SEQ ID NO: 149126 - protein, 9 aa, Homo Sapiens
IPLKGWSLG

SEQ ID NO: 149127 - protein, 9 aa, Homo Sapiens
TMRNQVRLK

SEQ ID NO: 149128 - protein, 9 aa, Homo Sapiens
ELGTLADRE

SEQ ID NO: 149129 - protein, 9 aa, Homo Sapiens
TGDAIYEVV

SEQ ID NO: 149130 - protein, 9 aa, Homo Sapiens
EIEENKSEC

SEQ ID NO: 149131 - protein, 9 aa, Homo Sapiens
QSPRGVTPL

SEQ ID NO: 149132 - protein, 9 aa, Homo Sapiens
TSSWTIPWT

SEQ ID NO: 149133 - protein, 9 aa, Homo Sapiens
FFFLHKEFL

SEQ ID NO: 149134 - protein, 9 aa, Homo Sapiens
PKGSLMALL

SEQ ID NO: 149135 - protein, 9 aa, Homo Sapiens
LSNDAVHVQ

SEQ ID NO: 149136 - protein, 9 aa, Homo Sapiens
RGWDYAHCM

SEQ ID NO: 149137 - protein, 9 aa, Homo Sapiens
GASSCASTP

SEQ ID NO: 149138 - protein, 9 aa, Homo Sapiens
PPSSQTWAR

SEQ ID NO: 149139 - protein, 9 aa, Homo Sapiens
GAHCSPLPR

SEQ ID NO: 149140 - protein, 9 aa, Homo Sapiens
PLRLWSWCG

SEQ ID NO: 149141 - protein, 9 aa, Homo Sapiens
NCIYPLSMC

SEQ ID NO: 149142 - protein, 9 aa, Homo Sapiens
SWFIFSEEH

SEQ ID NO: 149143 - protein, 9 aa, Homo Sapiens
KLPIEPHFG

SEQ ID NO: 149144 - protein, 9 aa, Homo Sapiens
SACIAIKWM

SEQ ID NO: 149145 - protein, 9 aa, Homo Sapiens
RFYGPQRRH

SEQ ID NO: 149146 - protein, 9 aa, Homo Sapiens
AQAVAEAGA

SEQ ID NO: 149147 - protein, 9 aa, Homo Sapiens
WAPYNVMVI

SEQ ID NO: 149148 - protein, 9 aa, Homo Sapiens
TTRSWRTWS

SEQ ID NO: 149149 - protein, 9 aa, Homo Sapiens
WGEHSSSST

SEQ ID NO: 149150 - protein, 9 aa, Homo Sapiens
STPTAELTG

SEQ ID NO: 149151 - protein, 9 aa, Homo Sapiens
WLLGSRMAH

SEQ ID NO: 149152 - protein, 9 aa, Homo Sapiens
CPHPPVSPR

SEQ ID NO: 149153 - protein, 9 aa, Homo Sapiens
GGKHIAHIT

SEQ ID NO: 149154 - protein, 9 aa, Homo Sapiens
PHVSVLHPV

SEQ ID NO: 149155 - protein, 9 aa, Homo Sapiens
VTLKSPSCL

SEQ ID NO: 149156 - protein, 9 aa, Homo Sapiens
QLQALMAQL

SEQ ID NO: 149157 - protein, 9 aa, Homo Sapiens
IDEPGLWSL

SEQ ID NO: 149158 - protein, 9 aa, Homo Sapiens
ETWWMCDCF

SEQ ID NO: 149159 - protein, 9 aa, Homo Sapiens
HGRARPTGA

SEQ ID NO: 149160 - protein, 9 aa, Homo Sapiens
NVHRQPVQI

SEQ ID NO: 149161 - protein, 9 aa, Homo Sapiens
FTGRGHLVG

SEQ ID NO: 149162 - protein, 9 aa, Homo Sapiens
LRCTHHLLL

SEQ ID NO: 149163 - protein, 9 aa, Homo Sapiens
CNAEAYIRN

SEQ ID NO: 149164 - protein, 9 aa, Homo Sapiens
VWARDRMGQ

SEQ ID NO: 149165 - protein, 9 aa, Homo Sapiens
GFLQLRHGL

SEQ ID NO: 149166 - protein, 9 aa, Homo Sapiens
RTLHKPATL

SEQ ID NO: 149167 - protein, 9 aa, Homo Sapiens
VPQHPPTGP

SEQ ID NO: 149168 - protein, 9 aa, Homo Sapiens
RLGDPGRAP

SEQ ID NO: 149169 - protein, 9 aa, Homo Sapiens
CGREVEVLG

SEQ ID NO: 149170 - protein, 9 aa, Homo Sapiens
LDMTSYTED

SEQ ID NO: 149171 - protein, 9 aa, Homo Sapiens
SPRSRWRHP

SEQ ID NO: 149172 - protein, 9 aa, Homo Sapiens
DTERALLYQ

SEQ ID NO: 149173 - protein, 9 aa, Homo Sapiens
ASSPGGGEG

SEQ ID NO: 149174 - protein, 9 aa, Homo Sapiens
GPANAPPLT

SEQ ID NO: 149175 - protein, 9 aa, Homo Sapiens
ADLPHSSGL

SEQ ID NO: 149176 - protein, 9 aa, Homo Sapiens
EIPGSLSGW

SEQ ID NO: 149177 - protein, 9 aa, Homo Sapiens
LVKPGTYPD

SEQ ID NO: 149178 - protein, 9 aa, Homo Sapiens
LEWLRLLVE

SEQ ID NO: 149179 - protein, 9 aa, Homo Sapiens
CLSWSSRIV

SEQ ID NO: 149180 - protein, 9 aa, Homo Sapiens
KIDPALLAV

SEQ ID NO: 149181 - protein, 9 aa, Homo Sapiens
CTVLTAPGV

SEQ ID NO: 149182 - protein, 9 aa, Homo Sapiens
LDCLSCPGR

SEQ ID NO: 149183 - protein, 9 aa, Homo Sapiens
ADIQLPNGI

SEQ ID NO: 149184 - protein, 9 aa, Homo Sapiens
LPTGCRALE

SEQ ID NO: 149185 - protein, 9 aa, Homo Sapiens
IDDVIHHGV

SEQ ID NO: 149186 - protein, 9 aa, Homo Sapiens
ANSRADGGH

SEQ ID NO: 149187 - protein, 9 aa, Homo Sapiens
PMDEDRLSP

SEQ ID NO: 149188 - protein, 9 aa, Homo Sapiens
RSRSSRRHS

SEQ ID NO: 149189 - protein, 9 aa, Homo Sapiens
AAGGLRMNT

SEQ ID NO: 149190 - protein, 9 aa, Homo Sapiens
HLETLQRTP

SEQ ID NO: 149191 - protein, 9 aa, Homo Sapiens
VTEADSRLE

SEQ ID NO: 149192 - protein, 9 aa, Homo Sapiens
RAPEVPRCA

SEQ ID NO: 149193 - protein, 9 aa, Homo Sapiens
FYQGPGWEE

SEQ ID NO: 149194 - protein, 9 aa, Homo Sapiens
IAEGAVATQ

SEQ ID NO: 149195 - protein, 9 aa, Homo Sapiens
PQVNMTDVS

SEQ ID NO: 149196 - protein, 9 aa, Homo Sapiens
APGVCWPLL

SEQ ID NO: 149197 - protein, 9 aa, Homo Sapiens
QTALMLTVS

SEQ ID NO: 149198 - protein, 9 aa, Homo Sapiens
WRRQIYAGA

SEQ ID NO: 149199 - protein, 9 aa, Homo Sapiens
CRALATEVT

SEQ ID NO: 149200 - protein, 9 aa, Homo Sapiens
CCITCRLNL

SEQ ID NO: 149201 - protein, 9 aa, Homo Sapiens
EAMTFLLIL

SEQ ID NO: 149202 - protein, 9 aa, Homo Sapiens
ALAALGPPK

SEQ ID NO: 149203 - protein, 9 aa, Homo Sapiens
KIKVVRSAP

SEQ ID NO: 149204 - protein, 9 aa, Homo Sapiens
PVPLGPWNG

SEQ ID NO: 149205 - protein, 9 aa, Homo Sapiens
LGLWENMLS

SEQ ID NO: 149206 - protein, 9 aa, Homo Sapiens
LSYSFPDLF

SEQ ID NO: 149207 - protein, 9 aa, Homo Sapiens
RRRPGGRSP

SEQ ID NO: 149208 - protein, 9 aa, Homo Sapiens
TLELLREKG

SEQ ID NO: 149209 - protein, 9 aa, Homo Sapiens
DKIDHILES

SEQ ID NO: 149210 - protein, 9 aa, Homo Sapiens
SGRSLSCCP

SEQ ID NO: 149211 - protein, 9 aa, Homo Sapiens
PTRRPRPPC

SEQ ID NO: 149212 - protein, 9 aa, Homo Sapiens
SVNSIWRRF

SEQ ID NO: 149213 - protein, 9 aa, Homo Sapiens
EPPTPPVHI

SEQ ID NO: 149214 - protein, 9 aa, Homo Sapiens
RSRSHSKSR

SEQ ID NO: 149215 - protein, 9 aa, Homo Sapiens
DIIPDYVLG

SEQ ID NO: 149216 - protein, 9 aa, Homo Sapiens
ARLVATPAL

SEQ ID NO: 149217 - protein, 9 aa, Homo Sapiens
KVQSVEAVA

SEQ ID NO: 149218 - protein, 9 aa, Homo Sapiens
VGSRLPGLP

SEQ ID NO: 149219 - protein, 9 aa, Homo Sapiens
ENVVVRNTQ

SEQ ID NO: 149220 - protein, 9 aa, Homo Sapiens
GFQARKRYI

SEQ ID NO: 149221 - protein, 9 aa, Homo Sapiens
PTRRSSGSQ

SEQ ID NO: 149222 - protein, 9 aa, Homo Sapiens
IRVRTVKCQ

SEQ ID NO: 149223 - protein, 9 aa, Homo Sapiens
VQSVEAVAK

SEQ ID NO: 149224 - protein, 9 aa, Homo Sapiens
LYKLKLEQR

SEQ ID NO: 149225 - protein, 9 aa, Homo Sapiens
AELIQSDEN

SEQ ID NO: 149226 - protein, 9 aa, Homo Sapiens
QHIHIGEMK

SEQ ID NO: 149227 - protein, 9 aa, Homo Sapiens
SLVIVESGI

SEQ ID NO: 149228 - protein, 9 aa, Homo Sapiens
ATPRIVNIS

SEQ ID NO: 149229 - protein, 9 aa, Homo Sapiens
YGPQRRHLW

SEQ ID NO: 149230 - protein, 9 aa, Homo Sapiens
CAPIALWAH

SEQ ID NO: 149231 - protein, 9 aa, Homo Sapiens
CSPAHHLCM

SEQ ID NO: 149232 - protein, 9 aa, Homo Sapiens
PPVIPLAVL

SEQ ID NO: 149233 - protein, 9 aa, Homo Sapiens
LDASHISYV

SEQ ID NO: 149234 - protein, 9 aa, Homo Sapiens
GDFSKVCVL

SEQ ID NO: 149235 - protein, 9 aa, Homo Sapiens
PSAKPPLWP

SEQ ID NO: 149236 - protein, 9 aa, Homo Sapiens
KKIKANRMS

SEQ ID NO: 149237 - protein, 9 aa, Homo Sapiens
MILVLCTAL

SEQ ID NO: 149238 - protein, 9 aa, Homo Sapiens
DERGYTLYT

SEQ ID NO: 149239 - protein, 9 aa, Homo Sapiens
ATGCWGLGT

SEQ ID NO: 149240 - protein, 9 aa, Homo Sapiens
DTIKFVLRD

SEQ ID NO: 149241 - protein, 9 aa, Homo Sapiens
SQTSCFGPS

SEQ ID NO: 149242 - protein, 9 aa, Homo Sapiens
GAKAGVHQP

SEQ ID NO: 149243 - protein, 9 aa, Homo Sapiens
NDTSELRKD

SEQ ID NO: 149244 - protein, 9 aa, Homo Sapiens
VVLLGWQAG

SEQ ID NO: 149245 - protein, 9 aa, Homo Sapiens
ASCKLTICP

SEQ ID NO: 149246 - protein, 9 aa, Homo Sapiens
ANTRPGSEQ

SEQ ID NO: 149247 - protein, 9 aa, Homo Sapiens
FGVAEKGAV

SEQ ID NO: 149248 - protein, 9 aa, Homo Sapiens
IHSYGQLIL

SEQ ID NO: 149249 - protein, 9 aa, Homo Sapiens
SPGMRRMGR

SEQ ID NO: 149250 - protein, 9 aa, Homo Sapiens
AATLRCPAV

SEQ ID NO: 149251 - protein, 9 aa, Homo Sapiens
LRMNTHVLH

SEQ ID NO: 149252 - protein, 9 aa, Homo Sapiens
RLHVTATPR

SEQ ID NO: 149253 - protein, 9 aa, Homo Sapiens
AVMLCNLNE

SEQ ID NO: 149254 - protein, 9 aa, Homo Sapiens
VTGQRPKTA

SEQ ID NO: 149255 - protein, 9 aa, Homo Sapiens
TQAMSDWMV

SEQ ID NO: 149256 - protein, 9 aa, Homo Sapiens
TKEKCRRIS

SEQ ID NO: 149257 - protein, 9 aa, Homo Sapiens
ACSGLTPPN

SEQ ID NO: 149258 - protein, 9 aa, Homo Sapiens
LAKLPIEPH

SEQ ID NO: 149259 - protein, 9 aa, Homo Sapiens
SHICGVSLL

SEQ ID NO: 149260 - protein, 9 aa, Homo Sapiens
CSPCSPTTP

SEQ ID NO: 149261 - protein, 9 aa, Homo Sapiens
KFTNTYQTF

SEQ ID NO: 149262 - protein, 9 aa, Homo Sapiens
PWGEHSSSS

SEQ ID NO: 149263 - protein, 9 aa, Homo Sapiens
ERWPGGFEA

SEQ ID NO: 149264 - protein, 9 aa, Homo Sapiens
FSEEHGEIS

SEQ ID NO: 149265 - protein, 9 aa, Homo Sapiens
RMSSPRRAP

SEQ ID NO: 149266 - protein, 9 aa, Homo Sapiens
RLCATTTCP

SEQ ID NO: 149267 - protein, 9 aa, Homo Sapiens
ARSVLRPHS

SEQ ID NO: 149268 - protein, 9 aa, Homo Sapiens
CRPSCCYPV

SEQ ID NO: 149269 - protein, 9 aa, Homo Sapiens
ARAKNECYQ

SEQ ID NO: 149270 - protein, 9 aa, Homo Sapiens
DLEPGMDYE

SEQ ID NO: 149271 - protein, 9 aa, Homo Sapiens
LKKAVGANY

SEQ ID NO: 149272 - protein, 9 aa, Homo Sapiens
AACRMHPKV

SEQ ID NO: 149273 - protein, 9 aa, Homo Sapiens
LRRPSPQSP

SEQ ID NO: 149274 - protein, 9 aa, Homo Sapiens
CGHGHNTQS

SEQ ID NO: 149275 - protein, 9 aa, Homo Sapiens
RGRNWRDIY

SEQ ID NO: 149276 - protein, 9 aa, Homo Sapiens
SNSPRRPSP

SEQ ID NO: 149277 - protein, 9 aa, Homo Sapiens
MRWHRIAQC

SEQ ID NO: 149278 - protein, 9 aa, Homo Sapiens
TQLREWCTW

SEQ ID NO: 149279 - protein, 9 aa, Homo Sapiens
QGRARAGIE

SEQ ID NO: 149280 - protein, 9 aa, Homo Sapiens
MLRQLLLAT

SEQ ID NO: 149281 - protein, 9 aa, Homo Sapiens
TLSQPPPQA

SEQ ID NO: 149282 - protein, 9 aa, Homo Sapiens
ISKCFTLSD

SEQ ID NO: 149283 - protein, 9 aa, Homo Sapiens
CLVRREFRN

SEQ ID NO: 149284 - protein, 9 aa, Homo Sapiens
SAPSLRPPH

SEQ ID NO: 149285 - protein, 9 aa, Homo Sapiens
EEQHTQQLS

SEQ ID NO: 149286 - protein, 9 aa, Homo Sapiens
AVRAVGQLQ

SEQ ID NO: 149287 - protein, 9 aa, Homo Sapiens
GVQQPQSEP

SEQ ID NO: 149288 - protein, 9 aa, Homo Sapiens
LQRSLAKYV

SEQ ID NO: 149289 - protein, 9 aa, Homo Sapiens
FGLAKAYID

SEQ ID NO: 149290 - protein, 9 aa, Homo Sapiens
GPGHGGPQD

SEQ ID NO: 149291 - protein, 9 aa, Homo Sapiens
WQDVSMCRM

SEQ ID NO: 149292 - protein, 9 aa, Homo Sapiens
CVDNCGPYG

SEQ ID NO: 149293 - protein, 9 aa, Homo Sapiens
HSQLINHQE

SEQ ID NO: 149294 - protein, 9 aa, Homo Sapiens
TCARLWMAN

SEQ ID NO: 149295 - protein, 9 aa, Homo Sapiens
TAGGGGSWS

SEQ ID NO: 149296 - protein, 9 aa, Homo Sapiens
SRADGGHCR

SEQ ID NO: 149297 - protein, 9 aa, Homo Sapiens
APEVPGLYG

SEQ ID NO: 149298 - protein, 9 aa, Homo Sapiens
GCREGRMAT

SEQ ID NO: 149299 - protein, 9 aa, Homo Sapiens
ARPPQRPST

SEQ ID NO: 149300 - protein, 9 aa, Homo Sapiens
SPQAPLRLW

SEQ ID NO: 149301 - protein, 9 aa, Homo Sapiens
TGHLCLYCD

SEQ ID NO: 149302 - protein, 9 aa, Homo Sapiens
PTAARPSAT

SEQ ID NO: 149303 - protein, 9 aa, Homo Sapiens
ETPMSPTLQ

SEQ ID NO: 149304 - protein, 9 aa, Homo Sapiens
LAACRMHPK

SEQ ID NO: 149305 - protein, 9 aa, Homo Sapiens
RSWPRKLRR

SEQ ID NO: 149306 - protein, 9 aa, Homo Sapiens
GAPGPCLAQ

SEQ ID NO: 149307 - protein, 9 aa, Homo Sapiens
IGCARSWNE

SEQ ID NO: 149308 - protein, 9 aa, Homo Sapiens
HNRQTLCSL

SEQ ID NO: 149309 - protein, 9 aa, Homo Sapiens
SLTNTMGGT

SEQ ID NO: 149310 - protein, 9 aa, Homo Sapiens
TSATTSSPE

SEQ ID NO: 149311 - protein, 9 aa, Homo Sapiens
GVQKRSHLC

SEQ ID NO: 149312 - protein, 9 aa, Homo Sapiens
SGVTTSTHR

SEQ ID NO: 149313 - protein, 9 aa, Homo Sapiens
YRKNVREAS

SEQ ID NO: 149314 - protein, 9 aa, Homo Sapiens
KTVTMKEDQ

SEQ ID NO: 149315 - protein, 9 aa, Homo Sapiens
NEDFLWNDY

SEQ ID NO: 149316 - protein, 9 aa, Homo Sapiens
VVVVGFPVT

SEQ ID NO: 149317 - protein, 9 aa, Homo Sapiens
SSSTIHIKT

SEQ ID NO: 149318 - protein, 9 aa, Homo Sapiens
HSAAHGPPL

SEQ ID NO: 149319 - protein, 9 aa, Homo Sapiens
MVSFWLRMV

SEQ ID NO: 149320 - protein, 9 aa, Homo Sapiens
RPHSYVPPT

SEQ ID NO: 149321 - protein, 9 aa, Homo Sapiens
QTPGQETLP

SEQ ID NO: 149322 - protein, 9 aa, Homo Sapiens
MRLGPTQPR

SEQ ID NO: 149323 - protein, 9 aa, Homo Sapiens
DAVLGAEIW

SEQ ID NO: 149324 - protein, 9 aa, Homo Sapiens
FQSIWNDPW

SEQ ID NO: 149325 - protein, 9 aa, Homo Sapiens
GDVGLGVQV

SEQ ID NO: 149326 - protein, 9 aa, Homo Sapiens
PWGGRWPGP

SEQ ID NO: 149327 - protein, 9 aa, Homo Sapiens
TSGWRGARV

SEQ ID NO: 149328 - protein, 9 aa, Homo Sapiens
GPWPFTTQA

SEQ ID NO: 149329 - protein, 9 aa, Homo Sapiens
VTLLSTTRP

SEQ ID NO: 149330 - protein, 9 aa, Homo Sapiens
LGSCLVHGF

SEQ ID NO: 149331 - protein, 9 aa, Homo Sapiens
ADTKLYDIM

SEQ ID NO: 149332 - protein, 9 aa, Homo Sapiens
APRPLPSPP

SEQ ID NO: 149333 - protein, 9 aa, Homo Sapiens
CCRARSSCW

SEQ ID NO: 149334 - protein, 9 aa, Homo Sapiens
NVVVRNTQI

SEQ ID NO: 149335 - protein, 9 aa, Homo Sapiens
HTHKHTHRH

SEQ ID NO: 149336 - protein, 9 aa, Homo Sapiens
STPAFAIFK

SEQ ID NO: 149337 - protein, 9 aa, Homo Sapiens
PPPRRGSSQ

SEQ ID NO: 149338 - protein, 9 aa, Homo Sapiens
QAGGPRKGS

SEQ ID NO: 149339 - protein, 9 aa, Homo Sapiens
GAVATQGPW

SEQ ID NO: 149340 - protein, 9 aa, Homo Sapiens
EVKMEGAHL

SEQ ID NO: 149341 - protein, 9 aa, Homo Sapiens
TTCIAAGGL

SEQ ID NO: 149342 - protein, 9 aa, Homo Sapiens
GCIWTGQEG

SEQ ID NO: 149343 - protein, 9 aa, Homo Sapiens
ISSKFETQE

SEQ ID NO: 149344 - protein, 9 aa, Homo Sapiens
SKGNLQTML

SEQ ID NO: 149345 - protein, 9 aa, Homo Sapiens
RAFLRTPWT

SEQ ID NO: 149346 - protein, 9 aa, Homo Sapiens
LIVREKPFT

SEQ ID NO: 149347 - protein, 9 aa, Homo Sapiens
NEEELRRCE

SEQ ID NO: 149348 - protein, 9 aa, Homo Sapiens
SSTTVASIT

SEQ ID NO: 149349 - protein, 9 aa, Homo Sapiens
DTDEKFMEV

SEQ ID NO: 149350 - protein, 9 aa, Homo Sapiens
SAQVRAARP

SEQ ID NO: 149351 - protein, 9 aa, Homo Sapiens
SWRPHPPSS

SEQ ID NO: 149352 - protein, 9 aa, Homo Sapiens
ETCGSCARS

SEQ ID NO: 149353 - protein, 9 aa, Homo Sapiens
AFIRVASMV

SEQ ID NO: 149354 - protein, 9 aa, Homo Sapiens
FIFSEEHGE

SEQ ID NO: 149355 - protein, 9 aa, Homo Sapiens
VAVLTHVLL

SEQ ID NO: 149356 - protein, 9 aa, Homo Sapiens
EAARSRDVA

SEQ ID NO: 149357 - protein, 9 aa, Homo Sapiens
DRYMVICDP

SEQ ID NO: 149358 - protein, 9 aa, Homo Sapiens
PVVGIPDNK

SEQ ID NO: 149359 - protein, 9 aa, Homo Sapiens
QEPALQEVQ

SEQ ID NO: 149360 - protein, 9 aa, Homo Sapiens
SEVYSNPCM

SEQ ID NO: 149361 - protein, 9 aa, Homo Sapiens
HGPWAARPR

SEQ ID NO: 149362 - protein, 9 aa, Homo Sapiens
HFPYKPLDI

SEQ ID NO: 149363 - protein, 9 aa, Homo Sapiens
GGLLDYIDR

SEQ ID NO: 149364 - protein, 9 aa, Homo Sapiens
PRPFTVRYD

SEQ ID NO: 149365 - protein, 9 aa, Homo Sapiens
PVHLRDLSL

SEQ ID NO: 149366 - protein, 9 aa, Homo Sapiens
GVRDRSPMV

SEQ ID NO: 149367 - protein, 9 aa, Homo Sapiens
IPGSLSGWS

SEQ ID NO: 149368 - protein, 9 aa, Homo Sapiens
VLENIMENS

SEQ ID NO: 149369 - protein, 9 aa, Homo Sapiens
MPRAWCCLM

SEQ ID NO: 149370 - protein, 9 aa, Homo Sapiens
SVKTPDKKS

SEQ ID NO: 149371 - protein, 9 aa, Homo Sapiens
AGTQEHSIT

SEQ ID NO: 149372 - protein, 9 aa, Homo Sapiens
LEGVNMRHL

SEQ ID NO: 149373 - protein, 9 aa, Homo Sapiens
SVYRMTQRG

SEQ ID NO: 149374 - protein, 9 aa, Homo Sapiens
TCACLLGLT

SEQ ID NO: 149375 - protein, 9 aa, Homo Sapiens
EGGLPVGES

SEQ ID NO: 149376 - protein, 9 aa, Homo Sapiens
VTLSRPWPH

SEQ ID NO: 149377 - protein, 9 aa, Homo Sapiens
HFRHTRENL

SEQ ID NO: 149378 - protein, 9 aa, Homo Sapiens
WWVISGCLG

SEQ ID NO: 149379 - protein, 9 aa, Homo Sapiens
AWHPGSWPV

SEQ ID NO: 149380 - protein, 9 aa, Homo Sapiens
EPPPQVPVL

SEQ ID NO: 149381 - protein, 9 aa, Homo Sapiens
YTCRALATE

SEQ ID NO: 149382 - protein, 9 aa, Homo Sapiens
SPLRPPGTG

SEQ ID NO: 149383 - protein, 9 aa, Homo Sapiens
PAQTEQHPR

SEQ ID NO: 149384 - protein, 9 aa, Homo Sapiens
FGCGRGRGA

SEQ ID NO: 149385 - protein, 9 aa, Homo Sapiens
HSTLLSQGA

SEQ ID NO: 149386 - protein, 9 aa, Homo Sapiens
KKISVLSFE

SEQ ID NO: 149387 - protein, 9 aa, Homo Sapiens
QGPWLVVPI

SEQ ID NO: 149388 - protein, 9 aa, Homo Sapiens
WSLRTARHL

SEQ ID NO: 149389 - protein, 9 aa, Homo Sapiens
LDDRSPQAP

SEQ ID NO: 149390 - protein, 9 aa, Homo Sapiens
LGGRCRGTA

SEQ ID NO: 149391 - protein, 9 aa, Homo Sapiens
GRLLILRSP

SEQ ID NO: 149392 - protein, 9 aa, Homo Sapiens
EGGRGGGEG

SEQ ID NO: 149393 - protein, 9 aa, Homo Sapiens
TVPSCRRER

SEQ ID NO: 149394 - protein, 9 aa, Homo Sapiens
VQAEAMTFL

SEQ ID NO: 149395 - protein, 9 aa, Homo Sapiens
QLPVGGDLD

SEQ ID NO: 149396 - protein, 9 aa, Homo Sapiens
QDLSMKEGC

SEQ ID NO: 149397 - protein, 9 aa, Homo Sapiens
LGSFLLDHL

SEQ ID NO: 149398 - protein, 9 aa, Homo Sapiens
LLNDYGPPS

SEQ ID NO: 149399 - protein, 9 aa, Homo Sapiens
HHESEDECT

SEQ ID NO: 149400 - protein, 9 aa, Homo Sapiens
ASDTAAPAR

SEQ ID NO: 149401 - protein, 9 aa, Homo Sapiens
LQQKMLLAC

SEQ ID NO: 149402 - protein, 9 aa, Homo Sapiens
KAGVHQPPP

SEQ ID NO: 149403 - protein, 9 aa, Homo Sapiens
MRDEERIQL

SEQ ID NO: 149404 - protein, 9 aa, Homo Sapiens
FCLLSLPWI

SEQ ID NO: 149405 - protein, 9 aa, Homo Sapiens
IPSIPKRRP

SEQ ID NO: 149406 - protein, 9 aa, Homo Sapiens
QVRLKVLRA

SEQ ID NO: 149407 - protein, 9 aa, Homo Sapiens
ARRAPRAPS

SEQ ID NO: 149408 - protein, 9 aa, Homo Sapiens
GAWRTISQY

SEQ ID NO: 149409 - protein, 9 aa, Homo Sapiens
PKIAFYVGI

SEQ ID NO: 149410 - protein, 9 aa, Homo Sapiens
VPTATAASA

SEQ ID NO: 149411 - protein, 9 aa, Homo Sapiens
EYITHSLLG

SEQ ID NO: 149412 - protein, 9 aa, Homo Sapiens
EKPPEEAAD

SEQ ID NO: 149413 - protein, 9 aa, Homo Sapiens
VLQSLTPNA

SEQ ID NO: 149414 - protein, 9 aa, Homo Sapiens
DVIHHGVKE

SEQ ID NO: 149415 - protein, 9 aa, Homo Sapiens
QASMEFRQK

SEQ ID NO: 149416 - protein, 9 aa, Homo Sapiens
LEVNECIGN

SEQ ID NO: 149417 - protein, 9 aa, Homo Sapiens
HTQAYTQTQ

SEQ ID NO: 149418 - protein, 9 aa, Homo Sapiens
LKSTHLLLL

SEQ ID NO: 149419 - protein, 9 aa, Homo Sapiens
ELGVAVDAQ

SEQ ID NO: 149420 - protein, 9 aa, Homo Sapiens
LEEVTVVGP

SEQ ID NO: 149421 - protein, 9 aa, Homo Sapiens
PCVLPHVDF

SEQ ID NO: 149422 - protein, 9 aa, Homo Sapiens
LAIPCKLEK

SEQ ID NO: 149423 - protein, 9 aa, Homo Sapiens
LHQLTASLT

SEQ ID NO: 149424 - protein, 9 aa, Homo Sapiens
NWRDIYKAS

SEQ ID NO: 149425 - protein, 9 aa, Homo Sapiens
VLEEVIREG

SEQ ID NO: 149426 - protein, 9 aa, Homo Sapiens
NGMKDVPAW

SEQ ID NO: 149427 - protein, 9 aa, Homo Sapiens
GFSARQRLE

SEQ ID NO: 149428 - protein, 9 aa, Homo Sapiens
KQGQWGPPR

SEQ ID NO: 149429 - protein, 9 aa, Homo Sapiens
VTTAQWPTL

SEQ ID NO: 149430 - protein, 9 aa, Homo Sapiens
GRRTAPERA

SEQ ID NO: 149431 - protein, 9 aa, Homo Sapiens
PPQAPSQVW

SEQ ID NO: 149432 - protein, 9 aa, Homo Sapiens
EDLHQIFML

SEQ ID NO: 149433 - protein, 9 aa, Homo Sapiens
QKLGREPHS

SEQ ID NO: 149434 - protein, 9 aa, Homo Sapiens
GDSINKDHK

SEQ ID NO: 149435 - protein, 9 aa, Homo Sapiens
TVMAVANVM

SEQ ID NO: 149436 - protein, 9 aa, Homo Sapiens
QNVTFCSSS

SEQ ID NO: 149437 - protein, 9 aa, Homo Sapiens
PRSPPRDSR

SEQ ID NO: 149438 - protein, 9 aa, Homo Sapiens
DFSKVCVLP

SEQ ID NO: 149439 - protein, 9 aa, Homo Sapiens
VVKKIHAKD

SEQ ID NO: 149440 - protein, 9 aa, Homo Sapiens
PTSCLPLSR

SEQ ID NO: 149441 - protein, 9 aa, Homo Sapiens
RHCGSTSAG

SEQ ID NO: 149442 - protein, 9 aa, Homo Sapiens
PLFPPLLVF

SEQ ID NO: 149443 - protein, 9 aa, Homo Sapiens
HRPDYAVFM

SEQ ID NO: 149444 - protein, 9 aa, Homo Sapiens
RLVATPALP

SEQ ID NO: 149445 - protein, 9 aa, Homo Sapiens
RGSSQGCRE

SEQ ID NO: 149446 - protein, 9 aa, Homo Sapiens
IMEAILNHP

SEQ ID NO: 149447 - protein, 9 aa, Homo Sapiens
LHFQKALEI

SEQ ID NO: 149448 - protein, 9 aa, Homo Sapiens
SDTGILYVL

SEQ ID NO: 149449 - protein, 9 aa, Homo Sapiens
SHPTSPLSG

SEQ ID NO: 149450 - protein, 9 aa, Homo Sapiens
PPPQVPVLT

SEQ ID NO: 149451 - protein, 9 aa, Homo Sapiens
MELGAEFLL

SEQ ID NO: 149452 - protein, 9 aa, Homo Sapiens
PSQSAAAAL

SEQ ID NO: 149453 - protein, 9 aa, Homo Sapiens
RTDPTLLRH

SEQ ID NO: 149454 - protein, 9 aa, Homo Sapiens
QSGTPPQVS

SEQ ID NO: 149455 - protein, 9 aa, Homo Sapiens
TPLATNSPG

SEQ ID NO: 149456 - protein, 9 aa, Homo Sapiens
KSGILAIAS

SEQ ID NO: 149457 - protein, 9 aa, Homo Sapiens
PPTKKRGKS

SEQ ID NO: 149458 - protein, 9 aa, Homo Sapiens
NGDDDQLIQ

SEQ ID NO: 149459 - protein, 9 aa, Homo Sapiens
ITLNRYLKV

SEQ ID NO: 149460 - protein, 9 aa, Homo Sapiens
GPDDVQQKI

SEQ ID NO: 149461 - protein, 9 aa, Homo Sapiens
AAEADQLLI

SEQ ID NO: 149462 - protein, 9 aa, Homo Sapiens
LASDKESSC

SEQ ID NO: 149463 - protein, 9 aa, Homo Sapiens
ILELEHCLF

SEQ ID NO: 149464 - protein, 9 aa, Homo Sapiens
QVLGPLSNH

SEQ ID NO: 149465 - protein, 9 aa, Homo Sapiens
LQRTEKKCY

SEQ ID NO: 149466 - protein, 9 aa, Homo Sapiens
LLQANRLPG

SEQ ID NO: 149467 - protein, 9 aa, Homo Sapiens
PRRRQAQDI

SEQ ID NO: 149468 - protein, 9 aa, Homo Sapiens
DGRSSSSLS

SEQ ID NO: 149469 - protein, 9 aa, Homo Sapiens
FAKLEEIQQ

SEQ ID NO: 149470 - protein, 9 aa, Homo Sapiens
QRWSAETLH

SEQ ID NO: 149471 - protein, 9 aa, Homo Sapiens
PPPCPSRPL

SEQ ID NO: 149472 - protein, 9 aa, Homo Sapiens
TGAPLSAGT

SEQ ID NO: 149473 - protein, 9 aa, Homo Sapiens
GGGSGSAGS

SEQ ID NO: 149474 - protein, 9 aa, Homo Sapiens
TFVPHWTPP

SEQ ID NO: 149475 - protein, 9 aa, Homo Sapiens
LVVLVGPMG

SEQ ID NO: 149476 - protein, 9 aa, Homo Sapiens
SGQTARGYA

SEQ ID NO: 149477 - protein, 9 aa, Homo Sapiens
VDVIDLIIE

SEQ ID NO: 149478 - protein, 9 aa, Homo Sapiens
VVKASYPKR

SEQ ID NO: 149479 - protein, 9 aa, Homo Sapiens
HSSSEANQV

SEQ ID NO: 149480 - protein, 9 aa, Homo Sapiens
LLSTLSQPP

SEQ ID NO: 149481 - protein, 9 aa, Homo Sapiens
PLYFRGRLP

SEQ ID NO: 149482 - protein, 9 aa, Homo Sapiens
ATERSCRPS

SEQ ID NO: 149483 - protein, 9 aa, Homo Sapiens
WPTLCLGMP

SEQ ID NO: 149484 - protein, 9 aa, Homo Sapiens
VEAIPHVPV

SEQ ID NO: 149485 - protein, 9 aa, Homo Sapiens
SILSPALMD

SEQ ID NO: 149486 - protein, 9 aa, Homo Sapiens
ASGPCHAAA

SEQ ID NO: 149487 - protein, 9 aa, Homo Sapiens
AGVEEGPAL

SEQ ID NO: 149488 - protein, 9 aa, Homo Sapiens
FTPQNVTFC

SEQ ID NO: 149489 - protein, 9 aa, Homo Sapiens
TPMSPTLQD

SEQ ID NO: 149490 - protein, 9 aa, Homo Sapiens
RRRWPRDSP

SEQ ID NO: 149491 - protein, 9 aa, Homo Sapiens
PSAPAKGKI

SEQ ID NO: 149492 - protein, 9 aa, Homo Sapiens
GSYVSVPLN

SEQ ID NO: 149493 - protein, 9 aa, Homo Sapiens
EGSYVSVPL

SEQ ID NO: 149494 - protein, 9 aa, Homo Sapiens
SPTSSPTAR

SEQ ID NO: 149495 - protein, 9 aa, Homo Sapiens
HHPLGDTPQ

SEQ ID NO: 149496 - protein, 9 aa, Homo Sapiens
LLQITELKA

SEQ ID NO: 149497 - protein, 9 aa, Homo Sapiens
RMSNSKKSK

SEQ ID NO: 149498 - protein, 9 aa, Homo Sapiens
IGDFGLATE

SEQ ID NO: 149499 - protein, 9 aa, Homo Sapiens
TFPAVMLCN

SEQ ID NO: 149500 - protein, 9 aa, Homo Sapiens
APTAAKPSA

SEQ ID NO: 149501 - protein, 9 aa, Homo Sapiens
TTAIGGGGW

SEQ ID NO: 149502 - protein, 9 aa, Homo Sapiens
CGAARPRRT

SEQ ID NO: 149503 - protein, 9 aa, Homo Sapiens
RNLFSMGMT

SEQ ID NO: 149504 - protein, 9 aa, Homo Sapiens
TADYSLRSG

SEQ ID NO: 149505 - protein, 9 aa, Homo Sapiens
DPPWSSQTH

SEQ ID NO: 149506 - protein, 9 aa, Homo Sapiens
NFAGAKLPC

SEQ ID NO: 149507 - protein, 9 aa, Homo Sapiens
HTNTGDAIY

SEQ ID NO: 149508 - protein, 9 aa, Homo Sapiens
VLHKVPGKP

SEQ ID NO: 149509 - protein, 9 aa, Homo Sapiens
HQSSSLSLE

SEQ ID NO: 149510 - protein, 9 aa, Homo Sapiens
SAVVKVPSG

SEQ ID NO: 149511 - protein, 9 aa, Homo Sapiens
QIIREMSFH

SEQ ID NO: 149512 - protein, 9 aa, Homo Sapiens
DKRRKPLVI

SEQ ID NO: 149513 - protein, 9 aa, Homo Sapiens
QVSPASPPT

SEQ ID NO: 149514 - protein, 9 aa, Homo Sapiens
TGEIRPRKA

SEQ ID NO: 149515 - protein, 9 aa, Homo Sapiens
NLTALPSQL

SEQ ID NO: 149516 - protein, 9 aa, Homo Sapiens
NVWARDRMG

SEQ ID NO: 149517 - protein, 9 aa, Homo Sapiens
FHFLDTLQC

SEQ ID NO: 149518 - protein, 9 aa, Homo Sapiens
HFCHHGGVF

SEQ ID NO: 149519 - protein, 9 aa, Homo Sapiens
PPATMTHPR

SEQ ID NO: 149520 - protein, 9 aa, Homo Sapiens
LWRRQIYAG

SEQ ID NO: 149521 - protein, 9 aa, Homo Sapiens
MHRHTHTQA

SEQ ID NO: 149522 - protein, 9 aa, Homo Sapiens
TSLCLKTPP

SEQ ID NO: 149523 - protein, 9 aa, Homo Sapiens
NGEIGGSQV

SEQ ID NO: 149524 - protein, 9 aa, Homo Sapiens
GFSVALSTN

SEQ ID NO: 149525 - protein, 9 aa, Homo Sapiens
TASFAYTLA

SEQ ID NO: 149526 - protein, 9 aa, Homo Sapiens
PPPRLPLRP

SEQ ID NO: 149527 - protein, 9 aa, Homo Sapiens
VVGIPDNKL

SEQ ID NO: 149528 - protein, 9 aa, Homo Sapiens
THTGIHRHT

SEQ ID NO: 149529 - protein, 9 aa, Homo Sapiens
LTLPLMSAL

SEQ ID NO: 149530 - protein, 9 aa, Homo Sapiens
NFTCIVAIG

SEQ ID NO: 149531 - protein, 9 aa, Homo Sapiens
YLLYHKTKS

SEQ ID NO: 149532 - protein, 9 aa, Homo Sapiens
PLTVMAVAN

SEQ ID NO: 149533 - protein, 9 aa, Homo Sapiens
RLIMDGVKH

SEQ ID NO: 149534 - protein, 9 aa, Homo Sapiens
KLAKDIYGG

SEQ ID NO: 149535 - protein, 9 aa, Homo Sapiens
PATMTHPRT

SEQ ID NO: 149536 - protein, 9 aa, Homo Sapiens
FVHSLEGPI

SEQ ID NO: 149537 - protein, 9 aa, Homo Sapiens
VPGAFSSSS

SEQ ID NO: 149538 - protein, 9 aa, Homo Sapiens
YGQGPCGYG

SEQ ID NO: 149539 - protein, 9 aa, Homo Sapiens
LTMNDSKHK

SEQ ID NO: 149540 - protein, 9 aa, Homo Sapiens
TPEDHSDPD

SEQ ID NO: 149541 - protein, 9 aa, Homo Sapiens
RKGQSLRCL

SEQ ID NO: 149542 - protein, 9 aa, Homo Sapiens
RSPWAWCAR

SEQ ID NO: 149543 - protein, 9 aa, Homo Sapiens
DAPLEALTG

SEQ ID NO: 149544 - protein, 9 aa, Homo Sapiens
LQQLLELSS

SEQ ID NO: 149545 - protein, 9 aa, Homo Sapiens
NHQETHSGL

SEQ ID NO: 149546 - protein, 9 aa, Homo Sapiens
DRGQPGLQG

SEQ ID NO: 149547 - protein, 9 aa, Homo Sapiens
GPPRAREKL

SEQ ID NO: 149548 - protein, 9 aa, Homo Sapiens
PEDAATPAA

SEQ ID NO: 149549 - protein, 9 aa, Homo Sapiens
SPRWRLPPP

SEQ ID NO: 149550 - protein, 9 aa, Homo Sapiens
RRMEVSCSW

SEQ ID NO: 149551 - protein, 9 aa, Homo Sapiens
PPQVQPPPA

SEQ ID NO: 149552 - protein, 9 aa, Homo Sapiens
NVDREQFRF

SEQ ID NO: 149553 - protein, 9 aa, Homo Sapiens
RLLNTDHHP

SEQ ID NO: 149554 - protein, 9 aa, Homo Sapiens
PEPVVGIPD

SEQ ID NO: 149555 - protein, 9 aa, Homo Sapiens
YFESLDNHM

SEQ ID NO: 149556 - protein, 9 aa, Homo Sapiens
VDKLAKDIY

SEQ ID NO: 149557 - protein, 9 aa, Homo Sapiens
HLHLARSHQ

SEQ ID NO: 149558 - protein, 9 aa, Homo Sapiens
ADALLDTEC

SEQ ID NO: 149559 - protein, 9 aa, Homo Sapiens
NSIWRRFPT

SEQ ID NO: 149560 - protein, 9 aa, Homo Sapiens
LLLLIFWIV

SEQ ID NO: 149561 - protein, 9 aa, Homo Sapiens
RPAAFPPPA

SEQ ID NO: 149562 - protein, 9 aa, Homo Sapiens
IQTLCCGCP

SEQ ID NO: 149563 - protein, 9 aa, Homo Sapiens
TWPLLRPEF

SEQ ID NO: 149564 - protein, 9 aa, Homo Sapiens
LFHSSGDLP

SEQ ID NO: 149565 - protein, 9 aa, Homo Sapiens
DSTPRGRTS

SEQ ID NO: 149566 - protein, 9 aa, Homo Sapiens
RHGFLQLRH

SEQ ID NO: 149567 - protein, 9 aa, Homo Sapiens
KELPPEILS

SEQ ID NO: 149568 - protein, 9 aa, Homo Sapiens
LDHTNLIQL

SEQ ID NO: 149569 - protein, 9 aa, Homo Sapiens
QPVCAVRAV

SEQ ID NO: 149570 - protein, 9 aa, Homo Sapiens
GSEFTPQSP

SEQ ID NO: 149571 - protein, 9 aa, Homo Sapiens
SVHAAMKTT

SEQ ID NO: 149572 - protein, 9 aa, Homo Sapiens
SFRCSLVDF

SEQ ID NO: 149573 - protein, 9 aa, Homo Sapiens
SREFGKKQS

SEQ ID NO: 149574 - protein, 9 aa, Homo Sapiens
ADLADGAHV

SEQ ID NO: 149575 - protein, 9 aa, Homo Sapiens
MQTVPEGAA

SEQ ID NO: 149576 - protein, 9 aa, Homo Sapiens
LEEALMRWH

SEQ ID NO: 149577 - protein, 9 aa, Homo Sapiens
PSLHPSQQA

SEQ ID NO: 149578 - protein, 9 aa, Homo Sapiens
GRNAWWLQV

SEQ ID NO: 149579 - protein, 9 aa, Homo Sapiens
LLGLWENML

SEQ ID NO: 149580 - protein, 9 aa, Homo Sapiens
FPDLFALLF

SEQ ID NO: 149581 - protein, 9 aa, Homo Sapiens
AVEHMFETD

SEQ ID NO: 149582 - protein, 9 aa, Homo Sapiens
DPRGSPACC

SEQ ID NO: 149583 - protein, 9 aa, Homo Sapiens
FNIHVIDFH

SEQ ID NO: 149584 - protein, 9 aa, Homo Sapiens
NELLLQSFK

SEQ ID NO: 149585 - protein, 9 aa, Homo Sapiens
AKRLHKTVW

SEQ ID NO: 149586 - protein, 9 aa, Homo Sapiens
QAEAEVRPK

SEQ ID NO: 149587 - protein, 9 aa, Homo Sapiens
TAGGGGGPG

SEQ ID NO: 149588 - protein, 9 aa, Homo Sapiens
FLSLHSLDK

SEQ ID NO: 149589 - protein, 9 aa, Homo Sapiens
VPSGPREPH

SEQ ID NO: 149590 - protein, 9 aa, Homo Sapiens
CALHSPPPE

SEQ ID NO: 149591 - protein, 9 aa, Homo Sapiens
PGGPADGLI

SEQ ID NO: 149592 - protein, 9 aa, Homo Sapiens
RVQSIEFNA

SEQ ID NO: 149593 - protein, 9 aa, Homo Sapiens
MGSLTPRTG

SEQ ID NO: 149594 - protein, 9 aa, Homo Sapiens
YIFCQELQK

SEQ ID NO: 149595 - protein, 9 aa, Homo Sapiens
SHFFQLKTS

SEQ ID NO: 149596 - protein, 9 aa, Homo Sapiens
RLYESLTYS

SEQ ID NO: 149597 - protein, 9 aa, Homo Sapiens
PAAAALDEG

SEQ ID NO: 149598 - protein, 9 aa, Homo Sapiens
HPVSPMRLE

SEQ ID NO: 149599 - protein, 9 aa, Homo Sapiens
TGLACGLPP

SEQ ID NO: 149600 - protein, 9 aa, Homo Sapiens
FEELLLLLL

SEQ ID NO: 149601 - protein, 9 aa, Homo Sapiens
SLCVSTPSS

SEQ ID NO: 149602 - protein, 9 aa, Homo Sapiens
RSVLVHADS

SEQ ID NO: 149603 - protein, 9 aa, Homo Sapiens
KPPTPKSTY

SEQ ID NO: 149604 - protein, 9 aa, Homo Sapiens
RPRRQPPHH

SEQ ID NO: 149605 - protein, 9 aa, Homo Sapiens
ARWRTTRSW

SEQ ID NO: 149606 - protein, 9 aa, Homo Sapiens
AGGGGGPGP

SEQ ID NO: 149607 - protein, 9 aa, Homo Sapiens
PRPPRFLSQ

SEQ ID NO: 149608 - protein, 9 aa, Homo Sapiens
LQGRLFISR

SEQ ID NO: 149609 - protein, 9 aa, Homo Sapiens
NKDCDGEVE

SEQ ID NO: 149610 - protein, 9 aa, Homo Sapiens
VSKAGKVKR

SEQ ID NO: 149611 - protein, 9 aa, Homo Sapiens
CSSWLRRIE

SEQ ID NO: 149612 - protein, 9 aa, Homo Sapiens
QHHTKPNIF

SEQ ID NO: 149613 - protein, 9 aa, Homo Sapiens
AHCNIHLPS

SEQ ID NO: 149614 - protein, 9 aa, Homo Sapiens
LTYTGTHRH

SEQ ID NO: 149615 - protein, 9 aa, Homo Sapiens
ALSPANPQE

SEQ ID NO: 149616 - protein, 9 aa, Homo Sapiens
HLCMQLTAT

SEQ ID NO: 149617 - protein, 9 aa, Homo Sapiens
CAPMPKKLI

SEQ ID NO: 149618 - protein, 9 aa, Homo Sapiens
HMHQLLMDR

SEQ ID NO: 149619 - protein, 9 aa, Homo Sapiens
NREISADFH

SEQ ID NO: 149620 - protein, 9 aa, Homo Sapiens
LPPFTYLIS

SEQ ID NO: 149621 - protein, 9 aa, Homo Sapiens
KNPYMCKKC

SEQ ID NO: 149622 - protein, 9 aa, Homo Sapiens
CGKSGAVNR

SEQ ID NO: 149623 - protein, 9 aa, Homo Sapiens
GTRERVWFS

SEQ ID NO: 149624 - protein, 9 aa, Homo Sapiens
GCDPRRALP

SEQ ID NO: 149625 - protein, 9 aa, Homo Sapiens
SKIFKTFFL

SEQ ID NO: 149626 - protein, 9 aa, Homo Sapiens
RPLTVMAVA

SEQ ID NO: 149627 - protein, 9 aa, Homo Sapiens
FLCTNSAKI

SEQ ID NO: 149628 - protein, 9 aa, Homo Sapiens
ILNGQLSTL

SEQ ID NO: 149629 - protein, 9 aa, Homo Sapiens
LTGSFFTFP

SEQ ID NO: 149630 - protein, 9 aa, Homo Sapiens
MFYHAYGSY

SEQ ID NO: 149631 - protein, 9 aa, Homo Sapiens
NVMVIINTF

SEQ ID NO: 149632 - protein, 9 aa, Homo Sapiens
FREVIAGSL

SEQ ID NO: 149633 - protein, 9 aa, Homo Sapiens
VYGSLHCAQ

SEQ ID NO: 149634 - protein, 9 aa, Homo Sapiens
DSLHKGAKH

SEQ ID NO: 149635 - protein, 9 aa, Homo Sapiens
KKQLALKHQ

SEQ ID NO: 149636 - protein, 9 aa, Homo Sapiens
YPRIPPELQ

SEQ ID NO: 149637 - protein, 9 aa, Homo Sapiens
WQSPWGEHS

SEQ ID NO: 149638 - protein, 9 aa, Homo Sapiens
NISKCFTLS

SEQ ID NO: 149639 - protein, 9 aa, Homo Sapiens
NQFRCVSGQ

SEQ ID NO: 149640 - protein, 9 aa, Homo Sapiens
VGTWYSKDG

SEQ ID NO: 149641 - protein, 9 aa, Homo Sapiens
WPPPGSPGH

SEQ ID NO: 149642 - protein, 9 aa, Homo Sapiens
PHPLYFRGR

SEQ ID NO: 149643 - protein, 9 aa, Homo Sapiens
PVWGPAIQP

SEQ ID NO: 149644 - protein, 9 aa, Homo Sapiens
CERKNMKQT

SEQ ID NO: 149645 - protein, 9 aa, Homo Sapiens
AAKVVVPPK

SEQ ID NO: 149646 - protein, 9 aa, Homo Sapiens
CGQSCGLVA

SEQ ID NO: 149647 - protein, 9 aa, Homo Sapiens
HRLRAGAGC

SEQ ID NO: 149648 - protein, 9 aa, Homo Sapiens
PLSPRAPVH

SEQ ID NO: 149649 - protein, 9 aa, Homo Sapiens
GDLLAVPQV

SEQ ID NO: 149650 - protein, 9 aa, Homo Sapiens
KVPCLSTIL

SEQ ID NO: 149651 - protein, 9 aa, Homo Sapiens
QALRGKSRP

SEQ ID NO: 149652 - protein, 9 aa, Homo Sapiens
FTGIEAVIC

SEQ ID NO: 149653 - protein, 9 aa, Homo Sapiens
PRWWKRHTP

SEQ ID NO: 149654 - protein, 9 aa, Homo Sapiens
ENVTKFWEY

SEQ ID NO: 149655 - protein, 9 aa, Homo Sapiens
DVSEAFISI

SEQ ID NO: 149656 - protein, 9 aa, Homo Sapiens
PGAPGPCLA

SEQ ID NO: 149657 - protein, 9 aa, Homo Sapiens
PRIPPELQI

SEQ ID NO: 149658 - protein, 9 aa, Homo Sapiens
VRVLLHFQR

SEQ ID NO: 149659 - protein, 9 aa, Homo Sapiens
EESYKHKGL

SEQ ID NO: 149660 - protein, 9 aa, Homo Sapiens
TSGTRDWLR

SEQ ID NO: 149661 - protein, 9 aa, Homo Sapiens
HHLCMQLTA

SEQ ID NO: 149662 - protein, 9 aa, Homo Sapiens
HIQKTGAPL

SEQ ID NO: 149663 - protein, 9 aa, Homo Sapiens
LIHVLNMEK

SEQ ID NO: 149664 - protein, 9 aa, Homo Sapiens
LRLQRSMEE

SEQ ID NO: 149665 - protein, 9 aa, Homo Sapiens
WAHRVPAGS

SEQ ID NO: 149666 - protein, 9 aa, Homo Sapiens
LIPGGPPGV

SEQ ID NO: 149667 - protein, 9 aa, Homo Sapiens
WAILKGSSL

SEQ ID NO: 149668 - protein, 9 aa, Homo Sapiens
LCLDLSNDA

SEQ ID NO: 149669 - protein, 9 aa, Homo Sapiens
STDKDEEFA

SEQ ID NO: 149670 - protein, 9 aa, Homo Sapiens
INPETLQSA

SEQ ID NO: 149671 - protein, 9 aa, Homo Sapiens
QPSASLAHS

SEQ ID NO: 149672 - protein, 9 aa, Homo Sapiens
EMASLTRRT

SEQ ID NO: 149673 - protein, 9 aa, Homo Sapiens
IKVVRSAPG

SEQ ID NO: 149674 - protein, 9 aa, Homo Sapiens
IVAPPSPSN

SEQ ID NO: 149675 - protein, 9 aa, Homo Sapiens
VMLCNLNEF

SEQ ID NO: 149676 - protein, 9 aa, Homo Sapiens
KPCPDVWLA

SEQ ID NO: 149677 - protein, 9 aa, Homo Sapiens
MGRPSNFAQ

SEQ ID NO: 149678 - protein, 9 aa, Homo Sapiens
ERSANAAAR

SEQ ID NO: 149679 - protein, 9 aa, Homo Sapiens
SSRVFTRDS

SEQ ID NO: 149680 - protein, 9 aa, Homo Sapiens
VMISSPASS

SEQ ID NO: 149681 - protein, 9 aa, Homo Sapiens
EFVSSVCWR

SEQ ID NO: 149682 - protein, 9 aa, Homo Sapiens
NEVLDHVPR

SEQ ID NO: 149683 - protein, 9 aa, Homo Sapiens
GGQAVVDFD

SEQ ID NO: 149684 - protein, 9 aa, Homo Sapiens
RPAPYFAAE

SEQ ID NO: 149685 - protein, 9 aa, Homo Sapiens
LGDLLAVPQ

SEQ ID NO: 149686 - protein, 9 aa, Homo Sapiens
ATNSPGPTL

SEQ ID NO: 149687 - protein, 9 aa, Homo Sapiens
LQPPPHSAA

SEQ ID NO: 149688 - protein, 9 aa, Homo Sapiens
SSRSAPSLR

SEQ ID NO: 149689 - protein, 9 aa, Homo Sapiens
SATNPTWRR

SEQ ID NO: 149690 - protein, 9 aa, Homo Sapiens
ACIEALGGF

SEQ ID NO: 149691 - protein, 9 aa, Homo Sapiens
QNSGYPTQQ

SEQ ID NO: 149692 - protein, 9 aa, Homo Sapiens
EALVAELAL

SEQ ID NO: 149693 - protein, 9 aa, Homo Sapiens
RKEVELIVR

SEQ ID NO: 149694 - protein, 9 aa, Homo Sapiens
QPPVIPLAV

SEQ ID NO: 149695 - protein, 9 aa, Homo Sapiens
STCLGGSDS

SEQ ID NO: 149696 - protein, 9 aa, Homo Sapiens
LQDSSPEDC

SEQ ID NO: 149697 - protein, 9 aa, Homo Sapiens
LFCWLVHRI

SEQ ID NO: 149698 - protein, 9 aa, Homo Sapiens
SQGKFGFAT

SEQ ID NO: 149699 - protein, 9 aa, Homo Sapiens
HSHSWIRTE

SEQ ID NO: 149700 - protein, 9 aa, Homo Sapiens
WHLGAASRG

SEQ ID NO: 149701 - protein, 9 aa, Homo Sapiens
PTSQQILFQ

SEQ ID NO: 149702 - protein, 9 aa, Homo Sapiens
EKACLEEER

SEQ ID NO: 149703 - protein, 9 aa, Homo Sapiens
CYLDNPETT

SEQ ID NO: 149704 - protein, 9 aa, Homo Sapiens
GTSKGLLEQ

SEQ ID NO: 149705 - protein, 9 aa, Homo Sapiens
STRASGPTP

SEQ ID NO: 149706 - protein, 9 aa, Homo Sapiens
AGAGGRRLP

SEQ ID NO: 149707 - protein, 9 aa, Homo Sapiens
GGWRVVDHR

SEQ ID NO: 149708 - protein, 9 aa, Homo Sapiens
RLAIPCKLE

SEQ ID NO: 149709 - protein, 9 aa, Homo Sapiens
NIRVRTVKC

SEQ ID NO: 149710 - protein, 9 aa, Homo Sapiens
AHSRVPSPR

SEQ ID NO: 149711 - protein, 9 aa, Homo Sapiens
ASYLFPQDK

SEQ ID NO: 149712 - protein, 9 aa, Homo Sapiens
SHLVSDLLQ

SEQ ID NO: 149713 - protein, 9 aa, Homo Sapiens
KRCAQTAVV

SEQ ID NO: 149714 - protein, 9 aa, Homo Sapiens
PRSCGTRLW

SEQ ID NO: 149715 - protein, 9 aa, Homo Sapiens
LVRKHHLGC

SEQ ID NO: 149716 - protein, 9 aa, Homo Sapiens
DGEAGLIFL

SEQ ID NO: 149717 - protein, 9 aa, Homo Sapiens
IQNPWWVIS

SEQ ID NO: 149718 - protein, 9 aa, Homo Sapiens
IAKNMAADI

SEQ ID NO: 149719 - protein, 9 aa, Homo Sapiens
LINPETLQS

SEQ ID NO: 149720 - protein, 9 aa, Homo Sapiens
TGASTPARS

SEQ ID NO: 149721 - protein, 9 aa, Homo Sapiens
SSKKRCDKS

SEQ ID NO: 149722 - protein, 9 aa, Homo Sapiens
ASSCASTPT

SEQ ID NO: 149723 - protein, 9 aa, Homo Sapiens
RGEMKWSGD

SEQ ID NO: 149724 - protein, 9 aa, Homo Sapiens
IVYLMFPLL

SEQ ID NO: 149725 - protein, 9 aa, Homo Sapiens
LVRFALRVR

SEQ ID NO: 149726 - protein, 9 aa, Homo Sapiens
EGSKMAHWP

SEQ ID NO: 149727 - protein, 9 aa, Homo Sapiens
LSPETGLRQ

SEQ ID NO: 149728 - protein, 9 aa, Homo Sapiens
SQPPPQAPS

SEQ ID NO: 149729 - protein, 9 aa, Homo Sapiens
PSLALRSGR

SEQ ID NO: 149730 - protein, 9 aa, Homo Sapiens
SQAGRQQPS

SEQ ID NO: 149731 - protein, 9 aa, Homo Sapiens
LCVSTPSSR

SEQ ID NO: 149732 - protein, 9 aa, Homo Sapiens
STHLLLLIA

SEQ ID NO: 149733 - protein, 9 aa, Homo Sapiens
LTFYIISSE

SEQ ID NO: 149734 - protein, 9 aa, Homo Sapiens
TQCNTQLTR

SEQ ID NO: 149735 - protein, 9 aa, Homo Sapiens
LGRWCAVHV

SEQ ID NO: 149736 - protein, 9 aa, Homo Sapiens
MSFDRYMVI

SEQ ID NO: 149737 - protein, 9 aa, Homo Sapiens
EIKDFSPKK

SEQ ID NO: 149738 - protein, 9 aa, Homo Sapiens
EAVAIHRGK

SEQ ID NO: 149739 - protein, 9 aa, Homo Sapiens
PKSPPPPPT

SEQ ID NO: 149740 - protein, 9 aa, Homo Sapiens
SVSSITRNL

SEQ ID NO: 149741 - protein, 9 aa, Homo Sapiens
RGVSRRPLS

SEQ ID NO: 149742 - protein, 9 aa, Homo Sapiens
GAPERAAKL

SEQ ID NO: 149743 - protein, 9 aa, Homo Sapiens
HRCVRDLGL

SEQ ID NO: 149744 - protein, 9 aa, Homo Sapiens
PILDDQIQW

SEQ ID NO: 149745 - protein, 9 aa, Homo Sapiens
VIPLAVLGK

SEQ ID NO: 149746 - protein, 9 aa, Homo Sapiens
HKAKIEVLD

SEQ ID NO: 149747 - protein, 9 aa, Homo Sapiens
CKAQNFPEI

SEQ ID NO: 149748 - protein, 9 aa, Homo Sapiens
SAPRTPTPV

SEQ ID NO: 149749 - protein, 9 aa, Homo Sapiens
ASLHVSGEQ

SEQ ID NO: 149750 - protein, 9 aa, Homo Sapiens
RICALPDDL

SEQ ID NO: 149751 - protein, 9 aa, Homo Sapiens
VLEGSASGE

SEQ ID NO: 149752 - protein, 9 aa, Homo Sapiens
ELLPTLPLS

SEQ ID NO: 149753 - protein, 9 aa, Homo Sapiens
ARPRPQSER

SEQ ID NO: 149754 - protein, 9 aa, Homo Sapiens
FVGWRYRRT

SEQ ID NO: 149755 - protein, 9 aa, Homo Sapiens
PARTRGAPA

SEQ ID NO: 149756 - protein, 9 aa, Homo Sapiens
AVDDILGEG

SEQ ID NO: 149757 - protein, 9 aa, Homo Sapiens
MTLPAPTAC

SEQ ID NO: 149758 - protein, 9 aa, Homo Sapiens
GRLGAGAGA

SEQ ID NO: 149759 - protein, 9 aa, Homo Sapiens
MKIHCKSLP

SEQ ID NO: 149760 - protein, 9 aa, Homo Sapiens
LGSGAFGMV

SEQ ID NO: 149761 - protein, 9 aa, Homo Sapiens
VNMTDVSTA

SEQ ID NO: 149762 - protein, 9 aa, Homo Sapiens
GKSRPVLKK

SEQ ID NO: 149763 - protein, 9 aa, Homo Sapiens
MINMFHKYT

SEQ ID NO: 149764 - protein, 9 aa, Homo Sapiens
CGCPHPPVS

SEQ ID NO: 149765 - protein, 9 aa, Homo Sapiens
LPRHPRSPT

SEQ ID NO: 149766 - protein, 9 aa, Homo Sapiens
DLPFPPAVS

SEQ ID NO: 149767 - protein, 9 aa, Homo Sapiens
DFLKVAVGT

SEQ ID NO: 149768 - protein, 9 aa, Homo Sapiens
PGAKGDRGQ

SEQ ID NO: 149769 - protein, 9 aa, Homo Sapiens
TCLGGSDSM

SEQ ID NO: 149770 - protein, 9 aa, Homo Sapiens
HEKYQCQAP

SEQ ID NO: 149771 - protein, 9 aa, Homo Sapiens
TQVTTQIAM

SEQ ID NO: 149772 - protein, 9 aa, Homo Sapiens
IPCKLEKMR

SEQ ID NO: 149773 - protein, 9 aa, Homo Sapiens
LRRSPGSLS

SEQ ID NO: 149774 - protein, 9 aa, Homo Sapiens
ESYKHKGLA

SEQ ID NO: 149775 - protein, 9 aa, Homo Sapiens
HHTKPNIFH

SEQ ID NO: 149776 - protein, 9 aa, Homo Sapiens
DPREHVFVY

SEQ ID NO: 149777 - protein, 9 aa, Homo Sapiens
TSRSRSRSH

SEQ ID NO: 149778 - protein, 9 aa, Homo Sapiens
LPSLTSGLP

SEQ ID NO: 149779 - protein, 9 aa, Homo Sapiens
QPHQEADVL

SEQ ID NO: 149780 - protein, 9 aa, Homo Sapiens
DIPGIEGLG

SEQ ID NO: 149781 - protein, 9 aa, Homo Sapiens
HLLIALGLL

SEQ ID NO: 149782 - protein, 9 aa, Homo Sapiens
SSPPGPAAS

SEQ ID NO: 149783 - protein, 9 aa, Homo Sapiens
PPPTFLPLH

SEQ ID NO: 149784 - protein, 9 aa, Homo Sapiens
HPMSSPTLS

SEQ ID NO: 149785 - protein, 9 aa, Homo Sapiens
GTQVTTQIA

SEQ ID NO: 149786 - protein, 9 aa, Homo Sapiens
QQQVTENCG

SEQ ID NO: 149787 - protein, 9 aa, Homo Sapiens
LLADTLLNF

SEQ ID NO: 149788 - protein, 9 aa, Homo Sapiens
IFSEEHGEI

SEQ ID NO: 149789 - protein, 9 aa, Homo Sapiens
TTKPISPVN

SEQ ID NO: 149790 - protein, 9 aa, Homo Sapiens
EPHSPPPSE

SEQ ID NO: 149791 - protein, 9 aa, Homo Sapiens
APDDQGPWR

SEQ ID NO: 149792 - protein, 9 aa, Homo Sapiens
PPQVSMVTL

SEQ ID NO: 149793 - protein, 9 aa, Homo Sapiens
QLPPIVPVK

SEQ ID NO: 149794 - protein, 9 aa, Homo Sapiens
PCKTSPPPQ

SEQ ID NO: 149795 - protein, 9 aa, Homo Sapiens
ADAPCRHRR

SEQ ID NO: 149796 - protein, 9 aa, Homo Sapiens
GETLERHST

SEQ ID NO: 149797 - protein, 9 aa, Homo Sapiens
SFHLLNYRT

SEQ ID NO: 149798 - protein, 9 aa, Homo Sapiens
METSAKLDH

SEQ ID NO: 149799 - protein, 9 aa, Homo Sapiens
RRSPGEWFL

SEQ ID NO: 149800 - protein, 9 aa, Homo Sapiens
GGLGGPGVP

SEQ ID NO: 149801 - protein, 9 aa, Homo Sapiens
GLPMAVIPF

SEQ ID NO: 149802 - protein, 9 aa, Homo Sapiens
KECVLTVTW

SEQ ID NO: 149803 - protein, 9 aa, Homo Sapiens
DSSLSDSIH

SEQ ID NO: 149804 - protein, 9 aa, Homo Sapiens
VHHHCFHSH

SEQ ID NO: 149805 - protein, 9 aa, Homo Sapiens
PGAVVVDMD

SEQ ID NO: 149806 - protein, 9 aa, Homo Sapiens
IPLAVLGKT

SEQ ID NO: 149807 - protein, 9 aa, Homo Sapiens
LKYEEFDCL

SEQ ID NO: 149808 - protein, 9 aa, Homo Sapiens
AVPSVARPS

SEQ ID NO: 149809 - protein, 9 aa, Homo Sapiens
LNNLMYMTV

SEQ ID NO: 149810 - protein, 9 aa, Homo Sapiens
FQEEGNGMK

SEQ ID NO: 149811 - protein, 9 aa, Homo Sapiens
CEGEKQQEE

SEQ ID NO: 149812 - protein, 9 aa, Homo Sapiens
PRPSFRGSC

SEQ ID NO: 149813 - protein, 9 aa, Homo Sapiens
IGLFSLVPW

SEQ ID NO: 149814 - protein, 9 aa, Homo Sapiens
EDAKKRGTI

SEQ ID NO: 149815 - protein, 9 aa, Homo Sapiens
QAAATMPIL

SEQ ID NO: 149816 - protein, 9 aa, Homo Sapiens
PPTPPVHIS

SEQ ID NO: 149817 - protein, 9 aa, Homo Sapiens
LLLLLLLDL

SEQ ID NO: 149818 - protein, 9 aa, Homo Sapiens
VGMGKAVEA

SEQ ID NO: 149819 - protein, 9 aa, Homo Sapiens
QKKQLALKH

SEQ ID NO: 149820 - protein, 9 aa, Homo Sapiens
VQGGQGGLD

SEQ ID NO: 149821 - protein, 9 aa, Homo Sapiens
QSRLWEREL

SEQ ID NO: 149822 - protein, 9 aa, Homo Sapiens
EWLRLLVEQ

SEQ ID NO: 149823 - protein, 9 aa, Homo Sapiens
MWHLSTGTM

SEQ ID NO: 149824 - protein, 9 aa, Homo Sapiens
SATTSSPEA

SEQ ID NO: 149825 - protein, 9 aa, Homo Sapiens
PPVTLELSP

SEQ ID NO: 149826 - protein, 9 aa, Homo Sapiens
EGPYECIEC

SEQ ID NO: 149827 - protein, 9 aa, Homo Sapiens
VGAQLKKLV

SEQ ID NO: 149828 - protein, 9 aa, Homo Sapiens
DVAVQVVRA

SEQ ID NO: 149829 - protein, 9 aa, Homo Sapiens
ITELKALVD

SEQ ID NO: 149830 - protein, 9 aa, Homo Sapiens
GAPPCRPRV

SEQ ID NO: 149831 - protein, 9 aa, Homo Sapiens
LQRSMEELE

SEQ ID NO: 149832 - protein, 9 aa, Homo Sapiens
APEKDKFLP

SEQ ID NO: 149833 - protein, 9 aa, Homo Sapiens
AIKWMPPEK

SEQ ID NO: 149834 - protein, 9 aa, Homo Sapiens
APQKISTWS

SEQ ID NO: 149835 - protein, 9 aa, Homo Sapiens
NAFTGRGHL

SEQ ID NO: 149836 - protein, 9 aa, Homo Sapiens
GKEEEELLF

SEQ ID NO: 149837 - protein, 9 aa, Homo Sapiens
RRERPRRAR

SEQ ID NO: 149838 - protein, 9 aa, Homo Sapiens
EAIIWQMGI

SEQ ID NO: 149839 - protein, 9 aa, Homo Sapiens
ASLRPSKLD

SEQ ID NO: 149840 - protein, 9 aa, Homo Sapiens
FQHHTKPNI

SEQ ID NO: 149841 - protein, 9 aa, Homo Sapiens
GAARARTCS

SEQ ID NO: 149842 - protein, 9 aa, Homo Sapiens
LVHALSLSP

SEQ ID NO: 149843 - protein, 9 aa, Homo Sapiens
VRRAPSLKA

SEQ ID NO: 149844 - protein, 9 aa, Homo Sapiens
DAGYGQGPC

SEQ ID NO: 149845 - protein, 9 aa, Homo Sapiens
PPTFLPLHL

SEQ ID NO: 149846 - protein, 9 aa, Homo Sapiens
PERAAKLGV

SEQ ID NO: 149847 - protein, 9 aa, Homo Sapiens
AVERLQRSD

SEQ ID NO: 149848 - protein, 9 aa, Homo Sapiens
TSAPTAAKP

SEQ ID NO: 149849 - protein, 9 aa, Homo Sapiens
DGPQKNQKG

SEQ ID NO: 149850 - protein, 9 aa, Homo Sapiens
PSAPPAPQA

SEQ ID NO: 149851 - protein, 9 aa, Homo Sapiens
PHPRPEGLH

SEQ ID NO: 149852 - protein, 9 aa, Homo Sapiens
PRSPSGPRP

SEQ ID NO: 149853 - protein, 9 aa, Homo Sapiens
RFSRRVLSD

SEQ ID NO: 149854 - protein, 9 aa, Homo Sapiens
THVLQSLTP

SEQ ID NO: 149855 - protein, 9 aa, Homo Sapiens
GAWKASRRS

SEQ ID NO: 149856 - protein, 9 aa, Homo Sapiens
KIARLFLGW

SEQ ID NO: 149857 - protein, 9 aa, Homo Sapiens
RVPTPPSST

SEQ ID NO: 149858 - protein, 9 aa, Homo Sapiens
PKPGLVCTT

SEQ ID NO: 149859 - protein, 9 aa, Homo Sapiens
PMEEEESEA

SEQ ID NO: 149860 - protein, 9 aa, Homo Sapiens
FPPQVNGHP

SEQ ID NO: 149861 - protein, 9 aa, Homo Sapiens
VGGFGPFQM

SEQ ID NO: 149862 - protein, 9 aa, Homo Sapiens
IACELKGGN

SEQ ID NO: 149863 - protein, 9 aa, Homo Sapiens
KLHLAAGLG

SEQ ID NO: 149864 - protein, 9 aa, Homo Sapiens
EVIIQPSSC

SEQ ID NO: 149865 - protein, 9 aa, Homo Sapiens
KSRLVHVYI

SEQ ID NO: 149866 - protein, 9 aa, Homo Sapiens
EVTEECGKS

SEQ ID NO: 149867 - protein, 9 aa, Homo Sapiens
GVVWGPLRC

SEQ ID NO: 149868 - protein, 9 aa, Homo Sapiens
IRAEGVPAP

SEQ ID NO: 149869 - protein, 9 aa, Homo Sapiens
FIAALILTL

SEQ ID NO: 149870 - protein, 9 aa, Homo Sapiens
VAVARLWWR

SEQ ID NO: 149871 - protein, 9 aa, Homo Sapiens
TRGAPAAAR

SEQ ID NO: 149872 - protein, 9 aa, Homo Sapiens
CEENTKVFV

SEQ ID NO: 149873 - protein, 9 aa, Homo Sapiens
AQAPLHPQP

SEQ ID NO: 149874 - protein, 9 aa, Homo Sapiens
SHHTPELRS

SEQ ID NO: 149875 - protein, 9 aa, Homo Sapiens
FVLQYQLAL

SEQ ID NO: 149876 - protein, 9 aa, Homo Sapiens
SAPGQALDK

SEQ ID NO: 149877 - protein, 9 aa, Homo Sapiens
PALKQVSPA

SEQ ID NO: 149878 - protein, 9 aa, Homo Sapiens
NHRPMQQVA

SEQ ID NO: 149879 - protein, 9 aa, Homo Sapiens
FHDSFNLTL

SEQ ID NO: 149880 - protein, 9 aa, Homo Sapiens
QRPKTAAAE

SEQ ID NO: 149881 - protein, 9 aa, Homo Sapiens
HCLFTSICC

SEQ ID NO: 149882 - protein, 9 aa, Homo Sapiens
GHRGAHRSP

SEQ ID NO: 149883 - protein, 9 aa, Homo Sapiens
LLGGLDRIV

SEQ ID NO: 149884 - protein, 9 aa, Homo Sapiens
PLEALTGQG

SEQ ID NO: 149885 - protein, 9 aa, Homo Sapiens
LKLASGTQE

SEQ ID NO: 149886 - protein, 9 aa, Homo Sapiens
LATLCLAGP

SEQ ID NO: 149887 - protein, 9 aa, Homo Sapiens
DLSLCAPQV

SEQ ID NO: 149888 - protein, 9 aa, Homo Sapiens
YGSNKKLTG

SEQ ID NO: 149889 - protein, 9 aa, Homo Sapiens
NGIKGRGKW

SEQ ID NO: 149890 - protein, 9 aa, Homo Sapiens
THKHTDTLA

SEQ ID NO: 149891 - protein, 9 aa, Homo Sapiens
RTVVKLEKT

SEQ ID NO: 149892 - protein, 9 aa, Homo Sapiens
FPCGELLVA

SEQ ID NO: 149893 - protein, 9 aa, Homo Sapiens
DVPPEKLHR

SEQ ID NO: 149894 - protein, 9 aa, Homo Sapiens
STMRNQVRL

SEQ ID NO: 149895 - protein, 9 aa, Homo Sapiens
GDSVASPPP

SEQ ID NO: 149896 - protein, 9 aa, Homo Sapiens
DEEMNNLQI

SEQ ID NO: 149897 - protein, 9 aa, Homo Sapiens
DSMWSWRPH

SEQ ID NO: 149898 - protein, 9 aa, Homo Sapiens
QRCGAKTIE

SEQ ID NO: 149899 - protein, 9 aa, Homo Sapiens
LLRKCCLID

SEQ ID NO: 149900 - protein, 9 aa, Homo Sapiens
EPQAGGPRK

SEQ ID NO: 149901 - protein, 9 aa, Homo Sapiens
CSQVNEGVW

SEQ ID NO: 149902 - protein, 9 aa, Homo Sapiens
QGPRLDFAF

SEQ ID NO: 149903 - protein, 9 aa, Homo Sapiens
FGVRIDYML

SEQ ID NO: 149904 - protein, 9 aa, Homo Sapiens
AMKTTTMRA

SEQ ID NO: 149905 - protein, 9 aa, Homo Sapiens
GRSCFHLET

SEQ ID NO: 149906 - protein, 9 aa, Homo Sapiens
MSEKKRLSE

SEQ ID NO: 149907 - protein, 9 aa, Homo Sapiens
PLYILYTSD

SEQ ID NO: 149908 - protein, 9 aa, Homo Sapiens
ITRNLMWDF

SEQ ID NO: 149909 - protein, 9 aa, Homo Sapiens
TGSPIQPRT

SEQ ID NO: 149910 - protein, 9 aa, Homo Sapiens
EHILQFLCA

SEQ ID NO: 149911 - protein, 9 aa, Homo Sapiens
REHVFVYAI

SEQ ID NO: 149912 - protein, 9 aa, Homo Sapiens
KAELIQSDE

SEQ ID NO: 149913 - protein, 9 aa, Homo Sapiens
PSPPVPLGP

SEQ ID NO: 149914 - protein, 9 aa, Homo Sapiens
CFAKCKHRH

SEQ ID NO: 149915 - protein, 9 aa, Homo Sapiens
RHTRENLHW

SEQ ID NO: 149916 - protein, 9 aa, Homo Sapiens
LPAGGRRTA

SEQ ID NO: 149917 - protein, 9 aa, Homo Sapiens
CLTCLEDGL

SEQ ID NO: 149918 - protein, 9 aa, Homo Sapiens
ECCPGYSGR

SEQ ID NO: 149919 - protein, 9 aa, Homo Sapiens
KHRHLRFPP

SEQ ID NO: 149920 - protein, 9 aa, Homo Sapiens
TVLFWDASG

SEQ ID NO: 149921 - protein, 9 aa, Homo Sapiens
GRGRLQQKM

SEQ ID NO: 149922 - protein, 9 aa, Homo Sapiens
IWTPWRKSG

SEQ ID NO: 149923 - protein, 9 aa, Homo Sapiens
TQVVNAKKK

SEQ ID NO: 149924 - protein, 9 aa, Homo Sapiens
PALDPMSIL

SEQ ID NO: 149925 - protein, 9 aa, Homo Sapiens
LAKQGQWGP

SEQ ID NO: 149926 - protein, 9 aa, Homo Sapiens
PCCAPIALW

SEQ ID NO: 149927 - protein, 9 aa, Homo Sapiens
GRRSAPRSC

SEQ ID NO: 149928 - protein, 9 aa, Homo Sapiens
EKKRLSEGE

SEQ ID NO: 149929 - protein, 9 aa, Homo Sapiens
GPVPKVRAI

SEQ ID NO: 149930 - protein, 9 aa, Homo Sapiens
FTYLISLHQ

SEQ ID NO: 149931 - protein, 9 aa, Homo Sapiens
QISLAEVCQ

SEQ ID NO: 149932 - protein, 9 aa, Homo Sapiens
PSTRAAPPS

SEQ ID NO: 149933 - protein, 9 aa, Homo Sapiens
EVNGKDQTM

SEQ ID NO: 149934 - protein, 9 aa, Homo Sapiens
EGQALISDL

SEQ ID NO: 149935 - protein, 9 aa, Homo Sapiens
LALVAVLTH

SEQ ID NO: 149936 - protein, 9 aa, Homo Sapiens
LMPRWSTPE

SEQ ID NO: 149937 - protein, 9 aa, Homo Sapiens
VLHLIHECP

SEQ ID NO: 149938 - protein, 9 aa, Homo Sapiens
RAPSSPRSR

SEQ ID NO: 149939 - protein, 9 aa, Homo Sapiens
KCRSKTLLR

SEQ ID NO: 149940 - protein, 9 aa, Homo Sapiens
PGPRYCVGS

SEQ ID NO: 149941 - protein, 9 aa, Homo Sapiens
TDVIAFTKQ

SEQ ID NO: 149942 - protein, 9 aa, Homo Sapiens
DFRTESPPA

SEQ ID NO: 149943 - protein, 9 aa, Homo Sapiens
ILQEAKFLQ

SEQ ID NO: 149944 - protein, 9 aa, Homo Sapiens
PVCTRPVVP

SEQ ID NO: 149945 - protein, 9 aa, Homo Sapiens
PPPPPHPPL

SEQ ID NO: 149946 - protein, 9 aa, Homo Sapiens
PETTAASEQ

SEQ ID NO: 149947 - protein, 9 aa, Homo Sapiens
WEGRRPLPP

SEQ ID NO: 149948 - protein, 9 aa, Homo Sapiens
SVCAPATPH

SEQ ID NO: 149949 - protein, 9 aa, Homo Sapiens
TATVRPKQR

SEQ ID NO: 149950 - protein, 9 aa, Homo Sapiens
NIWYLAGIV

SEQ ID NO: 149951 - protein, 9 aa, Homo Sapiens
QGSGDEAEP

SEQ ID NO: 149952 - protein, 9 aa, Homo Sapiens
IGRAQTTCI

SEQ ID NO: 149953 - protein, 9 aa, Homo Sapiens
SRPVCCPRA

SEQ ID NO: 149954 - protein, 9 aa, Homo Sapiens
NLLSWCYLQ

SEQ ID NO: 149955 - protein, 9 aa, Homo Sapiens
AAALVAAFF

SEQ ID NO: 149956 - protein, 9 aa, Homo Sapiens
REVPAAAAA

SEQ ID NO: 149957 - protein, 9 aa, Homo Sapiens
LVEAGVEEG

SEQ ID NO: 149958 - protein, 9 aa, Homo Sapiens
ANIQLYLSM

SEQ ID NO: 149959 - protein, 9 aa, Homo Sapiens
GTYPDVPPE

SEQ ID NO: 149960 - protein, 9 aa, Homo Sapiens
LMKVTENPF

SEQ ID NO: 149961 - protein, 9 aa, Homo Sapiens
RTRTMRLGP

SEQ ID NO: 149962 - protein, 9 aa, Homo Sapiens
SPCSMCCVI

SEQ ID NO: 149963 - protein, 9 aa, Homo Sapiens
PNSILCRGG

SEQ ID NO: 149964 - protein, 9 aa, Homo Sapiens
LSLEPADVP

SEQ ID NO: 149965 - protein, 9 aa, Homo Sapiens
NILVLCLDL

SEQ ID NO: 149966 - protein, 9 aa, Homo Sapiens
GTQGERLKE

SEQ ID NO: 149967 - protein, 9 aa, Homo Sapiens
SGNSGLDNS

SEQ ID NO: 149968 - protein, 9 aa, Homo Sapiens
PRWCACCVP

SEQ ID NO: 149969 - protein, 9 aa, Homo Sapiens
ALVLLAPAT

SEQ ID NO: 149970 - protein, 9 aa, Homo Sapiens
APFLRPCHL

SEQ ID NO: 149971 - protein, 9 aa, Homo Sapiens
LHPSFKEWF

SEQ ID NO: 149972 - protein, 9 aa, Homo Sapiens
SAAHHQSSS

SEQ ID NO: 149973 - protein, 9 aa, Homo Sapiens
PLGRGGGRG

SEQ ID NO: 149974 - protein, 9 aa, Homo Sapiens
MLHLALMST

SEQ ID NO: 149975 - protein, 9 aa, Homo Sapiens
IYKAHIHLN

SEQ ID NO: 149976 - protein, 9 aa, Homo Sapiens
KPPLWPPPG

SEQ ID NO: 149977 - protein, 9 aa, Homo Sapiens
IRAQGTRRS

SEQ ID NO: 149978 - protein, 9 aa, Homo Sapiens
DQGVWQGGR

SEQ ID NO: 149979 - protein, 9 aa, Homo Sapiens
DSQQTVPFM

SEQ ID NO: 149980 - protein, 9 aa, Homo Sapiens
RSLAKYVEL

SEQ ID NO: 149981 - protein, 9 aa, Homo Sapiens
GQQGRARAG

SEQ ID NO: 149982 - protein, 9 aa, Homo Sapiens
VLLGWQAGA

SEQ ID NO: 149983 - protein, 9 aa, Homo Sapiens
LMTKNPTMR

SEQ ID NO: 149984 - protein, 9 aa, Homo Sapiens
RDSRKWRKR

SEQ ID NO: 149985 - protein, 9 aa, Homo Sapiens
SITVILTAK

SEQ ID NO: 149986 - protein, 9 aa, Homo Sapiens
PTHSAQSPV

SEQ ID NO: 149987 - protein, 9 aa, Homo Sapiens
EIGTVVVLR

SEQ ID NO: 149988 - protein, 9 aa, Homo Sapiens
TLISVENFT

SEQ ID NO: 149989 - protein, 9 aa, Homo Sapiens
LRPQPWLQQ

SEQ ID NO: 149990 - protein, 9 aa, Homo Sapiens
DERNELLKH

SEQ ID NO: 149991 - protein, 9 aa, Homo Sapiens
SGLALCGIV

SEQ ID NO: 149992 - protein, 9 aa, Homo Sapiens
ECGKSGAVN

SEQ ID NO: 149993 - protein, 9 aa, Homo Sapiens
QYSIFKLFD

SEQ ID NO: 149994 - protein, 9 aa, Homo Sapiens
YTSAMAWAI

SEQ ID NO: 149995 - protein, 9 aa, Homo Sapiens
RGVPLYRHI

SEQ ID NO: 149996 - protein, 9 aa, Homo Sapiens
EINPSAPAK

SEQ ID NO: 149997 - protein, 9 aa, Homo Sapiens
ICISHTPIL

SEQ ID NO: 149998 - protein, 9 aa, Homo Sapiens
MGQVEYIFS

SEQ ID NO: 149999 - protein, 9 aa, Homo Sapiens
KEEEDQGVW

SEQ ID NO: 150000 - protein, 9 aa, Homo Sapiens
VSKGNLQTM

SEQ ID NO: 150001 - protein, 9 aa, Homo Sapiens
PQRGPRPLH

SEQ ID NO: 150002 - protein, 9 aa, Homo Sapiens
ECMAEKCYR

SEQ ID NO: 150003 - protein, 9 aa, Homo Sapiens
EVIAGSLLR

SEQ ID NO: 150004 - protein, 9 aa, Homo Sapiens
GSQGLPPMS

SEQ ID NO: 150005 - protein, 9 aa, Homo Sapiens
PCPLALAAL

SEQ ID NO: 150006 - protein, 9 aa, Homo Sapiens
LLGRAVGTA

SEQ ID NO: 150007 - protein, 9 aa, Homo Sapiens
AGVWRARQV

SEQ ID NO: 150008 - protein, 9 aa, Homo Sapiens
SRQHCFSSK

SEQ ID NO: 150009 - protein, 9 aa, Homo Sapiens
AFIMYMTMR

SEQ ID NO: 150010 - protein, 9 aa, Homo Sapiens
RNGVKFCKA

SEQ ID NO: 150011 - protein, 9 aa, Homo Sapiens
WRAAARRSG

SEQ ID NO: 150012 - protein, 9 aa, Homo Sapiens
RLLVWLEEL

SEQ ID NO: 150013 - protein, 9 aa, Homo Sapiens
RVTEADSRL

SEQ ID NO: 150014 - protein, 9 aa, Homo Sapiens
SRRLRPRWS

SEQ ID NO: 150015 - protein, 9 aa, Homo Sapiens
NQECQKTLQ

SEQ ID NO: 150016 - protein, 9 aa, Homo Sapiens
KLQGLSPCL

SEQ ID NO: 150017 - protein, 9 aa, Homo Sapiens
KRRKPLVII

SEQ ID NO: 150018 - protein, 9 aa, Homo Sapiens
LSSFLIFFI

SEQ ID NO: 150019 - protein, 9 aa, Homo Sapiens
KFETQEDIA

SEQ ID NO: 150020 - protein, 9 aa, Homo Sapiens
ETSAKLDHQ

SEQ ID NO: 150021 - protein, 9 aa, Homo Sapiens
CTPFCTLSA

SEQ ID NO: 150022 - protein, 9 aa, Homo Sapiens
MSQGKFGFA

SEQ ID NO: 150023 - protein, 9 aa, Homo Sapiens
VLALVAVLT

SEQ ID NO: 150024 - protein, 9 aa, Homo Sapiens
SPASSQRWP

SEQ ID NO: 150025 - protein, 9 aa, Homo Sapiens
CRCEIKGRE

SEQ ID NO: 150026 - protein, 9 aa, Homo Sapiens
SVVPRMSSP

SEQ ID NO: 150027 - protein, 9 aa, Homo Sapiens
NPHANRQTS

SEQ ID NO: 150028 - protein, 9 aa, Homo Sapiens
GALGQTSKL

SEQ ID NO: 150029 - protein, 9 aa, Homo Sapiens
SATNSEVKM

SEQ ID NO: 150030 - protein, 9 aa, Homo Sapiens
LGLEQFLTW

SEQ ID NO: 150031 - protein, 9 aa, Homo Sapiens
GKDKGNVLQ

SEQ ID NO: 150032 - protein, 9 aa, Homo Sapiens
PQGTKIVYR

SEQ ID NO: 150033 - protein, 9 aa, Homo Sapiens
ADGALLRGL

SEQ ID NO: 150034 - protein, 9 aa, Homo Sapiens
ATERSPLPP

SEQ ID NO: 150035 - protein, 9 aa, Homo Sapiens
GVRAASTEP

SEQ ID NO: 150036 - protein, 9 aa, Homo Sapiens
NSPRRPSPT

SEQ ID NO: 150037 - protein, 9 aa, Homo Sapiens
GQSLRCLPD

SEQ ID NO: 150038 - protein, 9 aa, Homo Sapiens
QLTLEQLRW

SEQ ID NO: 150039 - protein, 9 aa, Homo Sapiens
AMECFRNMD

SEQ ID NO: 150040 - protein, 9 aa, Homo Sapiens
RMVSFWLRM

SEQ ID NO: 150041 - protein, 9 aa, Homo Sapiens
RPFHLHLAR

SEQ ID NO: 150042 - protein, 9 aa, Homo Sapiens
SFIHSLVIV

SEQ ID NO: 150043 - protein, 9 aa, Homo Sapiens
RGSPVLAMC

SEQ ID NO: 150044 - protein, 9 aa, Homo Sapiens
YGADVNAVT

SEQ ID NO: 150045 - protein, 9 aa, Homo Sapiens
SIMTERSMP

SEQ ID NO: 150046 - protein, 9 aa, Homo Sapiens
RSCGTRLWT

SEQ ID NO: 150047 - protein, 9 aa, Homo Sapiens
HSDLPPPRR

SEQ ID NO: 150048 - protein, 9 aa, Homo Sapiens
QQPPPQQQH

SEQ ID NO: 150049 - protein, 9 aa, Homo Sapiens
PQRPPLQPV

SEQ ID NO: 150050 - protein, 9 aa, Homo Sapiens
ATAASARSP

SEQ ID NO: 150051 - protein, 9 aa, Homo Sapiens
TGPPARRHS

SEQ ID NO: 150052 - protein, 9 aa, Homo Sapiens
PRGIRCPPA

SEQ ID NO: 150053 - protein, 9 aa, Homo Sapiens
TSWCGWRTL

SEQ ID NO: 150054 - protein, 9 aa, Homo Sapiens
LPLWALIAI

SEQ ID NO: 150055 - protein, 9 aa, Homo Sapiens
SAQSEGLQL

SEQ ID NO: 150056 - protein, 9 aa, Homo Sapiens
CCGCPHPPV

SEQ ID NO: 150057 - protein, 9 aa, Homo Sapiens
RDLQPDQAH

SEQ ID NO: 150058 - protein, 9 aa, Homo Sapiens
ALLADAPCR

SEQ ID NO: 150059 - protein, 9 aa, Homo Sapiens
SLRAARAHQ

SEQ ID NO: 150060 - protein, 9 aa, Homo Sapiens
CKQDHQKDT

SEQ ID NO: 150061 - protein, 9 aa, Homo Sapiens
GGGKKDSIM

SEQ ID NO: 150062 - protein, 9 aa, Homo Sapiens
SLNDHMGQV

SEQ ID NO: 150063 - protein, 9 aa, Homo Sapiens
EPHSPPSKN

SEQ ID NO: 150064 - protein, 9 aa, Homo Sapiens
VVDFDPSTP

SEQ ID NO: 150065 - protein, 9 aa, Homo Sapiens
DIRYDRFLS

SEQ ID NO: 150066 - protein, 9 aa, Homo Sapiens
GPGPAQASA

SEQ ID NO: 150067 - protein, 9 aa, Homo Sapiens
RSTAPSPRA

SEQ ID NO: 150068 - protein, 9 aa, Homo Sapiens
LDVHQLLVL

SEQ ID NO: 150069 - protein, 9 aa, Homo Sapiens
TDHHPCQLD

SEQ ID NO: 150070 - protein, 9 aa, Homo Sapiens
ESHPTSPLS

SEQ ID NO: 150071 - protein, 9 aa, Homo Sapiens
SDNFPRPPP

SEQ ID NO: 150072 - protein, 9 aa, Homo Sapiens
IFRGDKWSC

SEQ ID NO: 150073 - protein, 9 aa, Homo Sapiens
GGGRQRGRL

SEQ ID NO: 150074 - protein, 9 aa, Homo Sapiens
GGGIQSWAV

SEQ ID NO: 150075 - protein, 9 aa, Homo Sapiens
GEGDFALIP

SEQ ID NO: 150076 - protein, 9 aa, Homo Sapiens
TQFHDKIDH

SEQ ID NO: 150077 - protein, 9 aa, Homo Sapiens
SPCSPAHHL

SEQ ID NO: 150078 - protein, 9 aa, Homo Sapiens
GVDGHTCME

SEQ ID NO: 150079 - protein, 9 aa, Homo Sapiens
PSKNPPQPM

SEQ ID NO: 150080 - protein, 9 aa, Homo Sapiens
LRAPMDEDR

SEQ ID NO: 150081 - protein, 9 aa, Homo Sapiens
SDKSAFIRV

SEQ ID NO: 150082 - protein, 9 aa, Homo Sapiens
DVPVHLRDL

SEQ ID NO: 150083 - protein, 9 aa, Homo Sapiens
SVHAFQQRL

SEQ ID NO: 150084 - protein, 9 aa, Homo Sapiens
AEGAVATQG

SEQ ID NO: 150085 - protein, 9 aa, Homo Sapiens
TCLADLEGV

SEQ ID NO: 150086 - protein, 9 aa, Homo Sapiens
IMSYVHPHA

SEQ ID NO: 150087 - protein, 9 aa, Homo Sapiens
PRPFHLHLA

SEQ ID NO: 150088 - protein, 9 aa, Homo Sapiens
KQKKKKKRK

SEQ ID NO: 150089 - protein, 9 aa, Homo Sapiens
EATVQNNWQ

SEQ ID NO: 150090 - protein, 9 aa, Homo Sapiens
LNSCTMVLE

SEQ ID NO: 150091 - protein, 9 aa, Homo Sapiens
LISAKSRFK

SEQ ID NO: 150092 - protein, 9 aa, Homo Sapiens
TQKVTCFYR

SEQ ID NO: 150093 - protein, 9 aa, Homo Sapiens
TPLGLVPPP

SEQ ID NO: 150094 - protein, 9 aa, Homo Sapiens
DHMGQVEYI

SEQ ID NO: 150095 - protein, 9 aa, Homo Sapiens
RPVTSSRSF

SEQ ID NO: 150096 - protein, 9 aa, Homo Sapiens
QPVQIQSQS

SEQ ID NO: 150097 - protein, 9 aa, Homo Sapiens
PGQALDKIS

SEQ ID NO: 150098 - protein, 9 aa, Homo Sapiens
SLSPNVVAF

SEQ ID NO: 150099 - protein, 9 aa, Homo Sapiens
SLLFIAALI

SEQ ID NO: 150100 - protein, 9 aa, Homo Sapiens
VREKPFTVE

SEQ ID NO: 150101 - protein, 9 aa, Homo Sapiens
IVALGASCT

SEQ ID NO: 150102 - protein, 9 aa, Homo Sapiens
DSLPAPGLH

SEQ ID NO: 150103 - protein, 9 aa, Homo Sapiens
GSSPCSPAH

SEQ ID NO: 150104 - protein, 9 aa, Homo Sapiens
LIFLVPAAM

SEQ ID NO: 150105 - protein, 9 aa, Homo Sapiens
GVHQPPPAR

SEQ ID NO: 150106 - protein, 9 aa, Homo Sapiens
TGHFGSASL

SEQ ID NO: 150107 - protein, 9 aa, Homo Sapiens
LAQLTAQLP

SEQ ID NO: 150108 - protein, 9 aa, Homo Sapiens
KNVREASFV

SEQ ID NO: 150109 - protein, 9 aa, Homo Sapiens
KLTVRIGVF

SEQ ID NO: 150110 - protein, 9 aa, Homo Sapiens
RTPEDHSDP

SEQ ID NO: 150111 - protein, 9 aa, Homo Sapiens
KMLVCPQGQ

SEQ ID NO: 150112 - protein, 9 aa, Homo Sapiens
RFQDTDEKF

SEQ ID NO: 150113 - protein, 9 aa, Homo Sapiens
EHWWWKSLL

SEQ ID NO: 150114 - protein, 9 aa, Homo Sapiens
CRPPRSPAP

SEQ ID NO: 150115 - protein, 9 aa, Homo Sapiens
GTQEWRWQL

SEQ ID NO: 150116 - protein, 9 aa, Homo Sapiens
AGACEAPIG

SEQ ID NO: 150117 - protein, 9 aa, Homo Sapiens
LQNLVEAGV

SEQ ID NO: 150118 - protein, 9 aa, Homo Sapiens
HIKPISRNS

SEQ ID NO: 150119 - protein, 9 aa, Homo Sapiens
SAPCWAPAP

SEQ ID NO: 150120 - protein, 9 aa, Homo Sapiens
LALWGWRTG

SEQ ID NO: 150121 - protein, 9 aa, Homo Sapiens
CIPPRTLHG

SEQ ID NO: 150122 - protein, 9 aa, Homo Sapiens
PSLKAPTPW

SEQ ID NO: 150123 - protein, 9 aa, Homo Sapiens
GGQGGQDGH

SEQ ID NO: 150124 - protein, 9 aa, Homo Sapiens
VPFLDCLSC

SEQ ID NO: 150125 - protein, 9 aa, Homo Sapiens
EEKEIEENK

SEQ ID NO: 150126 - protein, 9 aa, Homo Sapiens
PSTCLGGSD

SEQ ID NO: 150127 - protein, 9 aa, Homo Sapiens
SVEPGYPHN

SEQ ID NO: 150128 - protein, 9 aa, Homo Sapiens
LALCGIVST

SEQ ID NO: 150129 - protein, 9 aa, Homo Sapiens
SPRAGSRRC

SEQ ID NO: 150130 - protein, 9 aa, Homo Sapiens
GEGWVEVLK

SEQ ID NO: 150131 - protein, 9 aa, Homo Sapiens
QSQIKVGQN

SEQ ID NO: 150132 - protein, 9 aa, Homo Sapiens
NYRTSNISH

SEQ ID NO: 150133 - protein, 9 aa, Homo Sapiens
SRRGGGRQR

SEQ ID NO: 150134 - protein, 9 aa, Homo Sapiens
EAPPPSTAA

SEQ ID NO: 150135 - protein, 9 aa, Homo Sapiens
ELDERGYTL

SEQ ID NO: 150136 - protein, 9 aa, Homo Sapiens
VVQLQALMA

SEQ ID NO: 150137 - protein, 9 aa, Homo Sapiens
SSLGIRAQG

SEQ ID NO: 150138 - protein, 9 aa, Homo Sapiens
LVPLFIWTP

SEQ ID NO: 150139 - protein, 9 aa, Homo Sapiens
LPIEPHFGK

SEQ ID NO: 150140 - protein, 9 aa, Homo Sapiens
ICRKECVLL

SEQ ID NO: 150141 - protein, 9 aa, Homo Sapiens
LTVAEASLR

SEQ ID NO: 150142 - protein, 9 aa, Homo Sapiens
QQLPRKGQS

SEQ ID NO: 150143 - protein, 9 aa, Homo Sapiens
RPRVLSCLY

SEQ ID NO: 150144 - protein, 9 aa, Homo Sapiens
NFKQKREEL

SEQ ID NO: 150145 - protein, 9 aa, Homo Sapiens
LVLTQLPRH

SEQ ID NO: 150146 - protein, 9 aa, Homo Sapiens
EALHGPPPR

SEQ ID NO: 150147 - protein, 9 aa, Homo Sapiens
RRPSGPCPS

SEQ ID NO: 150148 - protein, 9 aa, Homo Sapiens
PHHLVPLFI

SEQ ID NO: 150149 - protein, 9 aa, Homo Sapiens
NSDTGILYV

SEQ ID NO: 150150 - protein, 9 aa, Homo Sapiens
GPLHLGTLR

SEQ ID NO: 150151 - protein, 9 aa, Homo Sapiens
EADALLAHH

SEQ ID NO: 150152 - protein, 9 aa, Homo Sapiens
NTGECCGRR

SEQ ID NO: 150153 - protein, 9 aa, Homo Sapiens
SPGCVLVLS

SEQ ID NO: 150154 - protein, 9 aa, Homo Sapiens
IKHISKGVH

SEQ ID NO: 150155 - protein, 9 aa, Homo Sapiens
PPRSPAPAP

SEQ ID NO: 150156 - protein, 9 aa, Homo Sapiens
SPIQPRTLS

SEQ ID NO: 150157 - protein, 9 aa, Homo Sapiens
RLHQAAFQK

SEQ ID NO: 150158 - protein, 9 aa, Homo Sapiens
GAPPVLHCC

SEQ ID NO: 150159 - protein, 9 aa, Homo Sapiens
VGVKRLKSV

SEQ ID NO: 150160 - protein, 9 aa, Homo Sapiens
HFCPVHRPP

SEQ ID NO: 150161 - protein, 9 aa, Homo Sapiens
SPTVCATVA

SEQ ID NO: 150162 - protein, 9 aa, Homo Sapiens
EGAHLGLPG

SEQ ID NO: 150163 - protein, 9 aa, Homo Sapiens
RQQGRLLIR

SEQ ID NO: 150164 - protein, 9 aa, Homo Sapiens
SDSSLSDSI

SEQ ID NO: 150165 - protein, 9 aa, Homo Sapiens
KESHPTSPL

SEQ ID NO: 150166 - protein, 9 aa, Homo Sapiens
WRTSCRGRI

SEQ ID NO: 150167 - protein, 9 aa, Homo Sapiens
PAASAPCWA

SEQ ID NO: 150168 - protein, 9 aa, Homo Sapiens
LPALDPMSI

SEQ ID NO: 150169 - protein, 9 aa, Homo Sapiens
SFLHHHLMV

SEQ ID NO: 150170 - protein, 9 aa, Homo Sapiens
LRVPVLIKK

SEQ ID NO: 150171 - protein, 9 aa, Homo Sapiens
PCDLPVPQG

SEQ ID NO: 150172 - protein, 9 aa, Homo Sapiens
GPIPSPSAC

SEQ ID NO: 150173 - protein, 9 aa, Homo Sapiens
ACLHPNSSA

SEQ ID NO: 150174 - protein, 9 aa, Homo Sapiens
HLEHWWWKS

SEQ ID NO: 150175 - protein, 9 aa, Homo Sapiens
QGPPLVLTE

SEQ ID NO: 150176 - protein, 9 aa, Homo Sapiens
ESLNGQNGK

SEQ ID NO: 150177 - protein, 9 aa, Homo Sapiens
GARICALPD

SEQ ID NO: 150178 - protein, 9 aa, Homo Sapiens
EHTGKCCVS

SEQ ID NO: 150179 - protein, 9 aa, Homo Sapiens
NGHSFNVDF

SEQ ID NO: 150180 - protein, 9 aa, Homo Sapiens
QAPLRLWSW

SEQ ID NO: 150181 - protein, 9 aa, Homo Sapiens
ARDMLGGDG

SEQ ID NO: 150182 - protein, 9 aa, Homo Sapiens
SLSACQGVY

SEQ ID NO: 150183 - protein, 9 aa, Homo Sapiens
PLLLLPTGC

SEQ ID NO: 150184 - protein, 9 aa, Homo Sapiens
ARGHGAPRS

SEQ ID NO: 150185 - protein, 9 aa, Homo Sapiens
RERGPWSPT

SEQ ID NO: 150186 - protein, 9 aa, Homo Sapiens
ELRSSRSAP

SEQ ID NO: 150187 - protein, 9 aa, Homo Sapiens
ERQAKTGTQ

SEQ ID NO: 150188 - protein, 9 aa, Homo Sapiens
CYMRIWSLR

SEQ ID NO: 150189 - protein, 9 aa, Homo Sapiens
DVIDLIIES

SEQ ID NO: 150190 - protein, 9 aa, Homo Sapiens
GVRIDYMLY

SEQ ID NO: 150191 - protein, 9 aa, Homo Sapiens
TATAKEAAK

SEQ ID NO: 150192 - protein, 9 aa, Homo Sapiens
PEYEIFWGL

SEQ ID NO: 150193 - protein, 9 aa, Homo Sapiens
IMYREVLES

SEQ ID NO: 150194 - protein, 9 aa, Homo Sapiens
DFMRGHFHE

SEQ ID NO: 150195 - protein, 9 aa, Homo Sapiens
LQDSLPAPG

SEQ ID NO: 150196 - protein, 9 aa, Homo Sapiens
QGGSPVGDV

SEQ ID NO: 150197 - protein, 9 aa, Homo Sapiens
RPRGPPAAW

SEQ ID NO: 150198 - protein, 9 aa, Homo Sapiens
TAGAARART

SEQ ID NO: 150199 - protein, 9 aa, Homo Sapiens
KRAGNFAIM

SEQ ID NO: 150200 - protein, 9 aa, Homo Sapiens
QGLPPMSSP

SEQ ID NO: 150201 - protein, 9 aa, Homo Sapiens
PLCMLRLGQ

SEQ ID NO: 150202 - protein, 9 aa, Homo Sapiens
TWLWRGCGT

SEQ ID NO: 150203 - protein, 9 aa, Homo Sapiens
KPPIPLPLP

SEQ ID NO: 150204 - protein, 9 aa, Homo Sapiens
LCFDISHPE

SEQ ID NO: 150205 - protein, 9 aa, Homo Sapiens
TPPQGPAQA

SEQ ID NO: 150206 - protein, 9 aa, Homo Sapiens
SDDEEFIGF

SEQ ID NO: 150207 - protein, 9 aa, Homo Sapiens
GQTPGQETL

SEQ ID NO: 150208 - protein, 9 aa, Homo Sapiens
EVVPLSTPT

SEQ ID NO: 150209 - protein, 9 aa, Homo Sapiens
PDDVQILVE

SEQ ID NO: 150210 - protein, 9 aa, Homo Sapiens
HSAQSPVPL

SEQ ID NO: 150211 - protein, 9 aa, Homo Sapiens
RRHCPRCPA

SEQ ID NO: 150212 - protein, 9 aa, Homo Sapiens
LSFLHHHLM

SEQ ID NO: 150213 - protein, 9 aa, Homo Sapiens
NHNRQTLCS

SEQ ID NO: 150214 - protein, 9 aa, Homo Sapiens
SQFFPEVIS

SEQ ID NO: 150215 - protein, 9 aa, Homo Sapiens
EEAEGLATE

SEQ ID NO: 150216 - protein, 9 aa, Homo Sapiens
AYVMMLSLS

SEQ ID NO: 150217 - protein, 9 aa, Homo Sapiens
LDYIDRLFQ

SEQ ID NO: 150218 - protein, 9 aa, Homo Sapiens
TTFRHNECL

SEQ ID NO: 150219 - protein, 9 aa, Homo Sapiens
LRQADALQE

SEQ ID NO: 150220 - protein, 9 aa, Homo Sapiens
LVLGEVARP

SEQ ID NO: 150221 - protein, 9 aa, Homo Sapiens
STIHIKTFS

SEQ ID NO: 150222 - protein, 9 aa, Homo Sapiens
CSFLTLPFH

SEQ ID NO: 150223 - protein, 9 aa, Homo Sapiens
QLREWCTWR

SEQ ID NO: 150224 - protein, 9 aa, Homo Sapiens
LAVKWGRNT

SEQ ID NO: 150225 - protein, 9 aa, Homo Sapiens
LLSLWTCLG

SEQ ID NO: 150226 - protein, 9 aa, Homo Sapiens
PRLLAPFLR

SEQ ID NO: 150227 - protein, 9 aa, Homo Sapiens
ANPGTNWGR

SEQ ID NO: 150228 - protein, 9 aa, Homo Sapiens
SWCGWRTLS

SEQ ID NO: 150229 - protein, 9 aa, Homo Sapiens
GGGQTLMSP

SEQ ID NO: 150230 - protein, 9 aa, Homo Sapiens
VPTQYNLPS

SEQ ID NO: 150231 - protein, 9 aa, Homo Sapiens
RWKGLEPQA

SEQ ID NO: 150232 - protein, 9 aa, Homo Sapiens
TRPTRRSSG

SEQ ID NO: 150233 - protein, 9 aa, Homo Sapiens
RAEDLGLKV

SEQ ID NO: 150234 - protein, 9 aa, Homo Sapiens
QFRCRMPGA

SEQ ID NO: 150235 - protein, 9 aa, Homo Sapiens
LQAIMEATV

SEQ ID NO: 150236 - protein, 9 aa, Homo Sapiens
DHKLCTKSP

SEQ ID NO: 150237 - protein, 9 aa, Homo Sapiens
KQPFFMTLG

SEQ ID NO: 150238 - protein, 9 aa, Homo Sapiens
PMSILFKMS

SEQ ID NO: 150239 - protein, 9 aa, Homo Sapiens
PGPAASLCV

SEQ ID NO: 150240 - protein, 9 aa, Homo Sapiens
TEMASLTRR

SEQ ID NO: 150241 - protein, 9 aa, Homo Sapiens
QSGQEPAAA

SEQ ID NO: 150242 - protein, 9 aa, Homo Sapiens
VSTSWGPTA

SEQ ID NO: 150243 - protein, 9 aa, Homo Sapiens
NEELKQARK

SEQ ID NO: 150244 - protein, 9 aa, Homo Sapiens
RAAADPPPE

SEQ ID NO: 150245 - protein, 9 aa, Homo Sapiens
RRQLSVRAL

SEQ ID NO: 150246 - protein, 9 aa, Homo Sapiens
AVLTHVLLI

SEQ ID NO: 150247 - protein, 9 aa, Homo Sapiens
TCCGAWAPP

SEQ ID NO: 150248 - protein, 9 aa, Homo Sapiens
DAHHRNTDQ

SEQ ID NO: 150249 - protein, 9 aa, Homo Sapiens
WFAEGRRYS

SEQ ID NO: 150250 - protein, 9 aa, Homo Sapiens
YTQTQTHTH

SEQ ID NO: 150251 - protein, 9 aa, Homo Sapiens
NSAKSGWVT

SEQ ID NO: 150252 - protein, 9 aa, Homo Sapiens
LRNSERVRE

SEQ ID NO: 150253 - protein, 9 aa, Homo Sapiens
IKLIQQFLT

SEQ ID NO: 150254 - protein, 9 aa, Homo Sapiens
KLSPETGLR

SEQ ID NO: 150255 - protein, 9 aa, Homo Sapiens
PVLAMCRRL

SEQ ID NO: 150256 - protein, 9 aa, Homo Sapiens
ELVPRLFWV

SEQ ID NO: 150257 - protein, 9 aa, Homo Sapiens
QRNMSAMEC

SEQ ID NO: 150258 - protein, 9 aa, Homo Sapiens
FLLLVQAEA

SEQ ID NO: 150259 - protein, 9 aa, Homo Sapiens
GCIAATEMD

SEQ ID NO: 150260 - protein, 9 aa, Homo Sapiens
EYLKEQCAS

SEQ ID NO: 150261 - protein, 9 aa, Homo Sapiens
LYVREQQDT

SEQ ID NO: 150262 - protein, 9 aa, Homo Sapiens
HTPELRSSR

SEQ ID NO: 150263 - protein, 9 aa, Homo Sapiens
MGSSPCSPA

SEQ ID NO: 150264 - protein, 9 aa, Homo Sapiens
TADAVAATT

SEQ ID NO: 150265 - protein, 9 aa, Homo Sapiens
EIQEHVKKN

SEQ ID NO: 150266 - protein, 9 aa, Homo Sapiens
VCGPHGPRG

SEQ ID NO: 150267 - protein, 9 aa, Homo Sapiens
LRGHPSAFN

SEQ ID NO: 150268 - protein, 9 aa, Homo Sapiens
SHKQVERYF

SEQ ID NO: 150269 - protein, 9 aa, Homo Sapiens
VGCRRCAIV

SEQ ID NO: 150270 - protein, 9 aa, Homo Sapiens
GEAPSAGVL

SEQ ID NO: 150271 - protein, 9 aa, Homo Sapiens
IVAPGHALS

SEQ ID NO: 150272 - protein, 9 aa, Homo Sapiens
YRQLLNDYG

SEQ ID NO: 150273 - protein, 9 aa, Homo Sapiens
RLGRSCFHL

SEQ ID NO: 150274 - protein, 9 aa, Homo Sapiens
HCAQSKTVI

SEQ ID NO: 150275 - protein, 9 aa, Homo Sapiens
MATLERQTL

SEQ ID NO: 150276 - protein, 9 aa, Homo Sapiens
LRDLEPGMD

SEQ ID NO: 150277 - protein, 9 aa, Homo Sapiens
RATALEQAS

SEQ ID NO: 150278 - protein, 9 aa, Homo Sapiens
LGIQDRTIP

SEQ ID NO: 150279 - protein, 9 aa, Homo Sapiens
HGSRGAADD

SEQ ID NO: 150280 - protein, 9 aa, Homo Sapiens
AGLPHFSSL

SEQ ID NO: 150281 - protein, 9 aa, Homo Sapiens
RTYTWLGAP

SEQ ID NO: 150282 - protein, 9 aa, Homo Sapiens
SQRPPRQVR

SEQ ID NO: 150283 - protein, 9 aa, Homo Sapiens
RTEFSSDDS

SEQ ID NO: 150284 - protein, 9 aa, Homo Sapiens
KDAKNSRTL

SEQ ID NO: 150285 - protein, 9 aa, Homo Sapiens
FKYFESLDN

SEQ ID NO: 150286 - protein, 9 aa, Homo Sapiens
SASVNSIWR

SEQ ID NO: 150287 - protein, 9 aa, Homo Sapiens
PHSFKSTDT

SEQ ID NO: 150288 - protein, 9 aa, Homo Sapiens
AKNKVGHEG

SEQ ID NO: 150289 - protein, 9 aa, Homo Sapiens
HWPKMLVCP

SEQ ID NO: 150290 - protein, 9 aa, Homo Sapiens
PQESTRVDD

SEQ ID NO: 150291 - protein, 9 aa, Homo Sapiens
AVRAYSDQA

SEQ ID NO: 150292 - protein, 9 aa, Homo Sapiens
VVPGPPLPS

SEQ ID NO: 150293 - protein, 9 aa, Homo Sapiens
DPTDPQWHW

SEQ ID NO: 150294 - protein, 9 aa, Homo Sapiens
PVSPMRLES

SEQ ID NO: 150295 - protein, 9 aa, Homo Sapiens
LAHHAALKE

SEQ ID NO: 150296 - protein, 9 aa, Homo Sapiens
AVDLCGREV

SEQ ID NO: 150297 - protein, 9 aa, Homo Sapiens
EFRQKGSQM

SEQ ID NO: 150298 - protein, 9 aa, Homo Sapiens
ILRMENGLW

SEQ ID NO: 150299 - protein, 9 aa, Homo Sapiens
KAYRERYVA

SEQ ID NO: 150300 - protein, 9 aa, Homo Sapiens
SWSADRFAD

SEQ ID NO: 150301 - protein, 9 aa, Homo Sapiens
ELLTAFLGD

SEQ ID NO: 150302 - protein, 9 aa, Homo Sapiens
AREQTRNEL

SEQ ID NO: 150303 - protein, 9 aa, Homo Sapiens
TSNNTTGTS

SEQ ID NO: 150304 - protein, 9 aa, Homo Sapiens
GGGLGGPGV

SEQ ID NO: 150305 - protein, 9 aa, Homo Sapiens
SHQWIRLHF

SEQ ID NO: 150306 - protein, 9 aa, Homo Sapiens
SKSIRPSLN

SEQ ID NO: 150307 - protein, 9 aa, Homo Sapiens
SLWFAEGRR

SEQ ID NO: 150308 - protein, 9 aa, Homo Sapiens
DQVRTLHRK

SEQ ID NO: 150309 - protein, 9 aa, Homo Sapiens
PAPPLFLPP

SEQ ID NO: 150310 - protein, 9 aa, Homo Sapiens
GTHRHTHKH

SEQ ID NO: 150311 - protein, 9 aa, Homo Sapiens
KKFELLPTL

SEQ ID NO: 150312 - protein, 9 aa, Homo Sapiens
HAYGSYLEN

SEQ ID NO: 150313 - protein, 9 aa, Homo Sapiens
RAHRRFVAK

SEQ ID NO: 150314 - protein, 9 aa, Homo Sapiens
PRKLRRPGL

SEQ ID NO: 150315 - protein, 9 aa, Homo Sapiens
VQLLGADSW

SEQ ID NO: 150316 - protein, 9 aa, Homo Sapiens
SRGAVKSRG

SEQ ID NO: 150317 - protein, 9 aa, Homo Sapiens
QHRKSIFFV

SEQ ID NO: 150318 - protein, 9 aa, Homo Sapiens
KFRISASLA

SEQ ID NO: 150319 - protein, 9 aa, Homo Sapiens
SVVWDRNHI

SEQ ID NO: 150320 - protein, 9 aa, Homo Sapiens
KPLVIIEKT

SEQ ID NO: 150321 - protein, 9 aa, Homo Sapiens
TLSRLRSRS

SEQ ID NO: 150322 - protein, 9 aa, Homo Sapiens
ADQRVAEYV

SEQ ID NO: 150323 - protein, 9 aa, Homo Sapiens
PPARPPQVQ

SEQ ID NO: 150324 - protein, 9 aa, Homo Sapiens
ASSPGHPLG

SEQ ID NO: 150325 - protein, 9 aa, Homo Sapiens
TQGSRPCHS

SEQ ID NO: 150326 - protein, 9 aa, Homo Sapiens
GKLILSQDT

SEQ ID NO: 150327 - protein, 9 aa, Homo Sapiens
LCKKKMPLT

SEQ ID NO: 150328 - protein, 9 aa, Homo Sapiens
EKNVHRQPV

SEQ ID NO: 150329 - protein, 9 aa, Homo Sapiens
MVCGPHGPR

SEQ ID NO: 150330 - protein, 9 aa, Homo Sapiens
VREPRKIIL

SEQ ID NO: 150331 - protein, 9 aa, Homo Sapiens
LILDLVHAL

SEQ ID NO: 150332 - protein, 9 aa, Homo Sapiens
EGCDQWITC

SEQ ID NO: 150333 - protein, 9 aa, Homo Sapiens
WLVVPILLS

SEQ ID NO: 150334 - protein, 9 aa, Homo Sapiens
RSGEAPSAG

SEQ ID NO: 150335 - protein, 9 aa, Homo Sapiens
PRWRLPPPC

SEQ ID NO: 150336 - protein, 9 aa, Homo Sapiens
HQRHPGTCQ

SEQ ID NO: 150337 - protein, 9 aa, Homo Sapiens
FWALAVDPT

SEQ ID NO: 150338 - protein, 9 aa, Homo Sapiens
YLWLMQMRE

SEQ ID NO: 150339 - protein, 9 aa, Homo Sapiens
HEQLAQLRE

SEQ ID NO: 150340 - protein, 9 aa, Homo Sapiens
GHLWRKRKP

SEQ ID NO: 150341 - protein, 9 aa, Homo Sapiens
DECTLDLDL

SEQ ID NO: 150342 - protein, 9 aa, Homo Sapiens
TAPSAVPSV

SEQ ID NO: 150343 - protein, 9 aa, Homo Sapiens
QPGPRANGA

SEQ ID NO: 150344 - protein, 9 aa, Homo Sapiens
PSLFLSIHL

SEQ ID NO: 150345 - protein, 9 aa, Homo Sapiens
NLSEVARAE

SEQ ID NO: 150346 - protein, 9 aa, Homo Sapiens
DLHFHFRHT

SEQ ID NO: 150347 - protein, 9 aa, Homo Sapiens
SSSTSSLWS

SEQ ID NO: 150348 - protein, 9 aa, Homo Sapiens
PLIQKKQLA

SEQ ID NO: 150349 - protein, 9 aa, Homo Sapiens
TVRAGDEND

SEQ ID NO: 150350 - protein, 9 aa, Homo Sapiens
QPNPRPWPP

SEQ ID NO: 150351 - protein, 9 aa, Homo Sapiens
QWDFHDSFN

SEQ ID NO: 150352 - protein, 9 aa, Homo Sapiens
NFIQDEVLH

SEQ ID NO: 150353 - protein, 9 aa, Homo Sapiens
HSTPPGEAL

SEQ ID NO: 150354 - protein, 9 aa, Homo Sapiens
LTMNEELKQ

SEQ ID NO: 150355 - protein, 9 aa, Homo Sapiens
PNHRPMQQV

SEQ ID NO: 150356 - protein, 9 aa, Homo Sapiens
QVYQAQTTV

SEQ ID NO: 150357 - protein, 9 aa, Homo Sapiens
CLLQGTFYT

SEQ ID NO: 150358 - protein, 9 aa, Homo Sapiens
FRLPVSVWL

SEQ ID NO: 150359 - protein, 9 aa, Homo Sapiens
GPRANGATG

SEQ ID NO: 150360 - protein, 9 aa, Homo Sapiens
LEMVHKSMK

SEQ ID NO: 150361 - protein, 9 aa, Homo Sapiens
RRTICGSLP

SEQ ID NO: 150362 - protein, 9 aa, Homo Sapiens
PWATSSSTW

SEQ ID NO: 150363 - protein, 9 aa, Homo Sapiens
TRKPPTPKS

SEQ ID NO: 150364 - protein, 9 aa, Homo Sapiens
SKQMSEKKR

SEQ ID NO: 150365 - protein, 9 aa, Homo Sapiens
QLRSQDPSP

SEQ ID NO: 150366 - protein, 9 aa, Homo Sapiens
SPGHLRARA

SEQ ID NO: 150367 - protein, 9 aa, Homo Sapiens
NMTIQTMKT

SEQ ID NO: 150368 - protein, 9 aa, Homo Sapiens
LPPPAARPP

SEQ ID NO: 150369 - protein, 9 aa, Homo Sapiens
GDHRRSWLL

SEQ ID NO: 150370 - protein, 9 aa, Homo Sapiens
AGAWSFQPA

SEQ ID NO: 150371 - protein, 9 aa, Homo Sapiens
GQMDTNGLV

SEQ ID NO: 150372 - protein, 9 aa, Homo Sapiens
ATWAVPQVL

SEQ ID NO: 150373 - protein, 9 aa, Homo Sapiens
ILGDVFICQ

SEQ ID NO: 150374 - protein, 9 aa, Homo Sapiens
KGLSLKLGV

SEQ ID NO: 150375 - protein, 9 aa, Homo Sapiens
KKKRKRNLS

SEQ ID NO: 150376 - protein, 9 aa, Homo Sapiens
TVPHVTTAQ

SEQ ID NO: 150377 - protein, 9 aa, Homo Sapiens
DKSCLDIQH

SEQ ID NO: 150378 - protein, 9 aa, Homo Sapiens
PGLWSLRTA

SEQ ID NO: 150379 - protein, 9 aa, Homo Sapiens
DTLKKVHIF

SEQ ID NO: 150380 - protein, 9 aa, Homo Sapiens
QKQRMEKAA

SEQ ID NO: 150381 - protein, 9 aa, Homo Sapiens
AAIWRRIGA

SEQ ID NO: 150382 - protein, 9 aa, Homo Sapiens
LWSSSGAGK

SEQ ID NO: 150383 - protein, 9 aa, Homo Sapiens
TTTIVECLH

SEQ ID NO: 150384 - protein, 9 aa, Homo Sapiens
THRHTHKHT

SEQ ID NO: 150385 - protein, 9 aa, Homo Sapiens
PPVPGDAPS

SEQ ID NO: 150386 - protein, 9 aa, Homo Sapiens
QAFCSMKCK

SEQ ID NO: 150387 - protein, 9 aa, Homo Sapiens
AELTGSGRR

SEQ ID NO: 150388 - protein, 9 aa, Homo Sapiens
PLHRWLQQT

SEQ ID NO: 150389 - protein, 9 aa, Homo Sapiens
GSSCAPLLH

SEQ ID NO: 150390 - protein, 9 aa, Homo Sapiens
REIICQSLA

SEQ ID NO: 150391 - protein, 9 aa, Homo Sapiens
GACCTMQAT

SEQ ID NO: 150392 - protein, 9 aa, Homo Sapiens
PGHFPLQVW

SEQ ID NO: 150393 - protein, 9 aa, Homo Sapiens
GSVQPVCAV

SEQ ID NO: 150394 - protein, 9 aa, Homo Sapiens
TRKEVHALK

SEQ ID NO: 150395 - protein, 9 aa, Homo Sapiens
NEMCCAYEV

SEQ ID NO: 150396 - protein, 9 aa, Homo Sapiens
LMWDFCLLS

SEQ ID NO: 150397 - protein, 9 aa, Homo Sapiens
SLGSCLVHG

SEQ ID NO: 150398 - protein, 9 aa, Homo Sapiens
CDPRRALPR

SEQ ID NO: 150399 - protein, 9 aa, Homo Sapiens
LCLSKECVL

SEQ ID NO: 150400 - protein, 9 aa, Homo Sapiens
HSDNFPRPP

SEQ ID NO: 150401 - protein, 9 aa, Homo Sapiens
DLIIESSSD

SEQ ID NO: 150402 - protein, 9 aa, Homo Sapiens
TLRLRKVLL

SEQ ID NO: 150403 - protein, 9 aa, Homo Sapiens
LTLVDTDIG

SEQ ID NO: 150404 - protein, 9 aa, Homo Sapiens
PVIGKDEDF

SEQ ID NO: 150405 - protein, 9 aa, Homo Sapiens
SLRPPHADD

SEQ ID NO: 150406 - protein, 9 aa, Homo Sapiens
QATGRRRRR

SEQ ID NO: 150407 - protein, 9 aa, Homo Sapiens
VPRIDRIFR

SEQ ID NO: 150408 - protein, 9 aa, Homo Sapiens
RSPGSLSLC

SEQ ID NO: 150409 - protein, 9 aa, Homo Sapiens
LPFPPAVSC

SEQ ID NO: 150410 - protein, 9 aa, Homo Sapiens
DFSPKKCHL

SEQ ID NO: 150411 - protein, 9 aa, Homo Sapiens
KNIQGGRPS

SEQ ID NO: 150412 - protein, 9 aa, Homo Sapiens
SCQAQGAAV

SEQ ID NO: 150413 - protein, 9 aa, Homo Sapiens
CVEAASSAL

SEQ ID NO: 150414 - protein, 9 aa, Homo Sapiens
LGPNSEMDH

SEQ ID NO: 150415 - protein, 9 aa, Homo Sapiens
RPELMPHTF

SEQ ID NO: 150416 - protein, 9 aa, Homo Sapiens
EEGPALREK

SEQ ID NO: 150417 - protein, 9 aa, Homo Sapiens
SASILSQKL

SEQ ID NO: 150418 - protein, 9 aa, Homo Sapiens
RSARMSSWS

SEQ ID NO: 150419 - protein, 9 aa, Homo Sapiens
APSAVPSVA

SEQ ID NO: 150420 - protein, 9 aa, Homo Sapiens
PFGLIPRLP

SEQ ID NO: 150421 - protein, 9 aa, Homo Sapiens
LAAPSLALR

SEQ ID NO: 150422 - protein, 9 aa, Homo Sapiens
YFRGRLPRH

SEQ ID NO: 150423 - protein, 9 aa, Homo Sapiens
AYRRQVLRY

SEQ ID NO: 150424 - protein, 9 aa, Homo Sapiens
ESPWQVMAS

SEQ ID NO: 150425 - protein, 9 aa, Homo Sapiens
QVESLAREG

SEQ ID NO: 150426 - protein, 9 aa, Homo Sapiens
AVAIHRGKD

SEQ ID NO: 150427 - protein, 9 aa, Homo Sapiens
EKNGNTVLS

SEQ ID NO: 150428 - protein, 9 aa, Homo Sapiens
KEIEENKSE

SEQ ID NO: 150429 - protein, 9 aa, Homo Sapiens
CDSVYRMTQ

SEQ ID NO: 150430 - protein, 9 aa, Homo Sapiens
LMTRCPAPS

SEQ ID NO: 150431 - protein, 9 aa, Homo Sapiens
ARPSTTRRD

SEQ ID NO: 150432 - protein, 9 aa, Homo Sapiens
SCASTPTAE

SEQ ID NO: 150433 - protein, 9 aa, Homo Sapiens
RTLTLVDTD

SEQ ID NO: 150434 - protein, 9 aa, Homo Sapiens
PSTPSSNFL

SEQ ID NO: 150435 - protein, 9 aa, Homo Sapiens
DAAHMSAST

SEQ ID NO: 150436 - protein, 9 aa, Homo Sapiens
IHIKTFSEV

SEQ ID NO: 150437 - protein, 9 aa, Homo Sapiens
MGRWTAAWP

SEQ ID NO: 150438 - protein, 9 aa, Homo Sapiens
DPDDINSAA

SEQ ID NO: 150439 - protein, 9 aa, Homo Sapiens
WLEELRRLY

SEQ ID NO: 150440 - protein, 9 aa, Homo Sapiens
AATTWNRSP

SEQ ID NO: 150441 - protein, 9 aa, Homo Sapiens
SEGLQLLPG

SEQ ID NO: 150442 - protein, 9 aa, Homo Sapiens
SFCAMGVAY

SEQ ID NO: 150443 - protein, 9 aa, Homo Sapiens
WGPRLGPAG

SEQ ID NO: 150444 - protein, 9 aa, Homo Sapiens
GRPSPCLSW

SEQ ID NO: 150445 - protein, 9 aa, Homo Sapiens
EVVKASYPK

SEQ ID NO: 150446 - protein, 9 aa, Homo Sapiens
QDCYMRIWS

SEQ ID NO: 150447 - protein, 9 aa, Homo Sapiens
QQDTYEFFT

SEQ ID NO: 150448 - protein, 9 aa, Homo Sapiens
WCMENVDYP

SEQ ID NO: 150449 - protein, 9 aa, Homo Sapiens
KKRTEFSSD

SEQ ID NO: 150450 - protein, 9 aa, Homo Sapiens
NEFVSSVCW

SEQ ID NO: 150451 - protein, 9 aa, Homo Sapiens
PLPAPPSAA

SEQ ID NO: 150452 - protein, 9 aa, Homo Sapiens
LDYIAYLSI

SEQ ID NO: 150453 - protein, 9 aa, Homo Sapiens
APTRRGEAA

SEQ ID NO: 150454 - protein, 9 aa, Homo Sapiens
PEVLEGSAS

SEQ ID NO: 150455 - protein, 9 aa, Homo Sapiens
SLVFGQTPG

SEQ ID NO: 150456 - protein, 9 aa, Homo Sapiens
CASGVTTST

SEQ ID NO: 150457 - protein, 9 aa, Homo Sapiens
LQPALLALQ

SEQ ID NO: 150458 - protein, 9 aa, Homo Sapiens
LLLLPPMGS

SEQ ID NO: 150459 - protein, 9 aa, Homo Sapiens
ESTGSPIQP

SEQ ID NO: 150460 - protein, 9 aa, Homo Sapiens
LWLMQMREF

SEQ ID NO: 150461 - protein, 9 aa, Homo Sapiens
RWPPPRWMS

SEQ ID NO: 150462 - protein, 9 aa, Homo Sapiens
PGCLRPPPA

SEQ ID NO: 150463 - protein, 9 aa, Homo Sapiens
VPAAAAAFE

SEQ ID NO: 150464 - protein, 9 aa, Homo Sapiens
PPSASQSAR

SEQ ID NO: 150465 - protein, 9 aa, Homo Sapiens
FKEWFHASV

SEQ ID NO: 150466 - protein, 9 aa, Homo Sapiens
GHGGPQDAP

SEQ ID NO: 150467 - protein, 9 aa, Homo Sapiens
YEGEVNAGR

SEQ ID NO: 150468 - protein, 9 aa, Homo Sapiens
TSRSTCARL

SEQ ID NO: 150469 - protein, 9 aa, Homo Sapiens
PGGPRWCAC

SEQ ID NO: 150470 - protein, 9 aa, Homo Sapiens
LPLSDLPSL

SEQ ID NO: 150471 - protein, 9 aa, Homo Sapiens
PKASSRQLA

SEQ ID NO: 150472 - protein, 9 aa, Homo Sapiens
AAGAFPPLE

SEQ ID NO: 150473 - protein, 9 aa, Homo Sapiens
QQSEHTLMG

SEQ ID NO: 150474 - protein, 9 aa, Homo Sapiens
ERPRRARRL

SEQ ID NO: 150475 - protein, 9 aa, Homo Sapiens
IGTELTKVW

SEQ ID NO: 150476 - protein, 9 aa, Homo Sapiens
FLLLLLLVF

SEQ ID NO: 150477 - protein, 9 aa, Homo Sapiens
NKGRLWTPA

SEQ ID NO: 150478 - protein, 9 aa, Homo Sapiens
FYINVSKAG

SEQ ID NO: 150479 - protein, 9 aa, Homo Sapiens
APGAPSYMR

SEQ ID NO: 150480 - protein, 9 aa, Homo Sapiens
YLFLSWKCL

SEQ ID NO: 150481 - protein, 9 aa, Homo Sapiens
IDLPWGDCY

SEQ ID NO: 150482 - protein, 9 aa, Homo Sapiens
PCISQPTAS

SEQ ID NO: 150483 - protein, 9 aa, Homo Sapiens
VGQLQARTG

SEQ ID NO: 150484 - protein, 9 aa, Homo Sapiens
LTKQLWEGR

SEQ ID NO: 150485 - protein, 9 aa, Homo Sapiens
PCSRLVLGR

SEQ ID NO: 150486 - protein, 9 aa, Homo Sapiens
AVLEKYYEA

SEQ ID NO: 150487 - protein, 9 aa, Homo Sapiens
FPPAVSCDS

SEQ ID NO: 150488 - protein, 9 aa, Homo Sapiens
TDTHTGIHT

SEQ ID NO: 150489 - protein, 9 aa, Homo Sapiens
TLLRNHFSL

SEQ ID NO: 150490 - protein, 9 aa, Homo Sapiens
HQIFMLTVE

SEQ ID NO: 150491 - protein, 9 aa, Homo Sapiens
FETVLACVP

SEQ ID NO: 150492 - protein, 9 aa, Homo Sapiens
APGAVVVDM

SEQ ID NO: 150493 - protein, 9 aa, Homo Sapiens
EELKLEKKS

SEQ ID NO: 150494 - protein, 9 aa, Homo Sapiens
PKTLEQRIQ

SEQ ID NO: 150495 - protein, 9 aa, Homo Sapiens
TRRPVTSSR

SEQ ID NO: 150496 - protein, 9 aa, Homo Sapiens
SRFTCHGLL

SEQ ID NO: 150497 - protein, 9 aa, Homo Sapiens
DQGPWRPLH

SEQ ID NO: 150498 - protein, 9 aa, Homo Sapiens
SPPLLRRPC

SEQ ID NO: 150499 - protein, 9 aa, Homo Sapiens
GWRYRRTVG

SEQ ID NO: 150500 - protein, 9 aa, Homo Sapiens
AAAALGPAN

SEQ ID NO: 150501 - protein, 8 aa, Homo Sapiens
QRSNHTVT

SEQ ID NO: 150502 - protein, 9 aa, Homo Sapiens
NGQNGKLAK

SEQ ID NO: 150503 - protein, 9 aa, Homo Sapiens
VEEAVRKLA

SEQ ID NO: 150504 - protein, 9 aa, Homo Sapiens
SLTRATSPG

SEQ ID NO: 150505 - protein, 9 aa, Homo Sapiens
MNRHLCCIL

SEQ ID NO: 150506 - protein, 9 aa, Homo Sapiens
YMTVKYGDE

SEQ ID NO: 150507 - protein, 9 aa, Homo Sapiens
WTELSAGCD

SEQ ID NO: 150508 - protein, 9 aa, Homo Sapiens
PPSVPGAFS

SEQ ID NO: 150509 - protein, 9 aa, Homo Sapiens
LGQRATRHG

SEQ ID NO: 150510 - protein, 9 aa, Homo Sapiens
TSGTAPSAV

SEQ ID NO: 150511 - protein, 9 aa, Homo Sapiens
HRHTHTHTG

SEQ ID NO: 150512 - protein, 9 aa, Homo Sapiens
AGVHQPPPA

SEQ ID NO: 150513 - protein, 9 aa, Homo Sapiens
GAFPPLEDA

SEQ ID NO: 150514 - protein, 9 aa, Homo Sapiens
EVWKEVRGE

SEQ ID NO: 150515 - protein, 9 aa, Homo Sapiens
PVGRVRHSL

SEQ ID NO: 150516 - protein, 9 aa, Homo Sapiens
VAFLPPMHC

SEQ ID NO: 150517 - protein, 9 aa, Homo Sapiens
TGVPLVMGY

SEQ ID NO: 150518 - protein, 9 aa, Homo Sapiens
QQPPPRLPL

SEQ ID NO: 150519 - protein, 9 aa, Homo Sapiens
SLPKKINSR

SEQ ID NO: 150520 - protein, 9 aa, Homo Sapiens
ASPPARSWS

SEQ ID NO: 150521 - protein, 9 aa, Homo Sapiens
LVHTLISVE

SEQ ID NO: 150522 - protein, 9 aa, Homo Sapiens
LEKMKHLNI

SEQ ID NO: 150523 - protein, 9 aa, Homo Sapiens
PAVSCDSFK

SEQ ID NO: 150524 - protein, 9 aa, Homo Sapiens
LIQKKQLAL

SEQ ID NO: 150525 - protein, 9 aa, Homo Sapiens
HAAMKTTTM

SEQ ID NO: 150526 - protein, 9 aa, Homo Sapiens
NIHLPSSNS

SEQ ID NO: 150527 - protein, 9 aa, Homo Sapiens
RRWSCWSTA

SEQ ID NO: 150528 - protein, 9 aa, Homo Sapiens
WRSTILGPQ

SEQ ID NO: 150529 - protein, 9 aa, Homo Sapiens
LLTGQSYIF

SEQ ID NO: 150530 - protein, 9 aa, Homo Sapiens
RRQFLAKQG

SEQ ID NO: 150531 - protein, 9 aa, Homo Sapiens
GLSPCLTCL

SEQ ID NO: 150532 - protein, 9 aa, Homo Sapiens
YAITSECVM

SEQ ID NO: 150533 - protein, 9 aa, Homo Sapiens
HPLSLPGAK

SEQ ID NO: 150534 - protein, 9 aa, Homo Sapiens
GSALTFRKE

SEQ ID NO: 150535 - protein, 9 aa, Homo Sapiens
ESCLIRLHG

SEQ ID NO: 150536 - protein, 9 aa, Homo Sapiens
MCEGESASW

SEQ ID NO: 150537 - protein, 9 aa, Homo Sapiens
TIPVLCGCF

SEQ ID NO: 150538 - protein, 9 aa, Homo Sapiens
CLEEERERK

SEQ ID NO: 150539 - protein, 9 aa, Homo Sapiens
HGTGPVGWQ

SEQ ID NO: 150540 - protein, 9 aa, Homo Sapiens
KNPPQPMGP

SEQ ID NO: 150541 - protein, 9 aa, Homo Sapiens
PCLSWSSRI

SEQ ID NO: 150542 - protein, 9 aa, Homo Sapiens
WGRNTSLAA

SEQ ID NO: 150543 - protein, 9 aa, Homo Sapiens
LTAAAAATQ

SEQ ID NO: 150544 - protein, 9 aa, Homo Sapiens
SSNLPVPER

SEQ ID NO: 150545 - protein, 9 aa, Homo Sapiens
AVPTVFTFQ

SEQ ID NO: 150546 - protein, 9 aa, Homo Sapiens
WSCWRPSQS

SEQ ID NO: 150547 - protein, 9 aa, Homo Sapiens
NVNNWRWTE

SEQ ID NO: 150548 - protein, 9 aa, Homo Sapiens
WYSVTTSVV

SEQ ID NO: 150549 - protein, 9 aa, Homo Sapiens
QTHTHTGIH

SEQ ID NO: 150550 - protein, 9 aa, Homo Sapiens
QSSSSREGP

SEQ ID NO: 150551 - protein, 9 aa, Homo Sapiens
GSAVLIFNI

SEQ ID NO: 150552 - protein, 9 aa, Homo Sapiens
IGATTPPIG

SEQ ID NO: 150553 - protein, 9 aa, Homo Sapiens
PLSLPGAKA

SEQ ID NO: 150554 - protein, 9 aa, Homo Sapiens
SMKCKDISQ

SEQ ID NO: 150555 - protein, 9 aa, Homo Sapiens
GLHLQKDVH

SEQ ID NO: 150556 - protein, 9 aa, Homo Sapiens
PGRLRPEQD

SEQ ID NO: 150557 - protein, 9 aa, Homo Sapiens
GLRGSWRRM

SEQ ID NO: 150558 - protein, 9 aa, Homo Sapiens
PPLIHPATT

SEQ ID NO: 150559 - protein, 9 aa, Homo Sapiens
KSELKKAVG

SEQ ID NO: 150560 - protein, 9 aa, Homo Sapiens
GDPDDINSA

SEQ ID NO: 150561 - protein, 9 aa, Homo Sapiens
TRAAADPPP

SEQ ID NO: 150562 - protein, 9 aa, Homo Sapiens
RLRRRMERS

SEQ ID NO: 150563 - protein, 9 aa, Homo Sapiens
KLQGSKVAN

SEQ ID NO: 150564 - protein, 9 aa, Homo Sapiens
CLQYGIPHH

SEQ ID NO: 150565 - protein, 9 aa, Homo Sapiens
FLFVQPMEL

SEQ ID NO: 150566 - protein, 9 aa, Homo Sapiens
PRPHPLYFR

SEQ ID NO: 150567 - protein, 9 aa, Homo Sapiens
EAPDSPNGP

SEQ ID NO: 150568 - protein, 9 aa, Homo Sapiens
MATMSSAQI

SEQ ID NO: 150569 - protein, 9 aa, Homo Sapiens
FFSFSWLPQ

SEQ ID NO: 150570 - protein, 9 aa, Homo Sapiens
TQQWTKETN

SEQ ID NO: 150571 - protein, 9 aa, Homo Sapiens
NLSLEPADV

SEQ ID NO: 150572 - protein, 9 aa, Homo Sapiens
QQPQSEPLR

SEQ ID NO: 150573 - protein, 9 aa, Homo Sapiens
QANTVKASP

SEQ ID NO: 150574 - protein, 9 aa, Homo Sapiens
RRRGTSGWR

SEQ ID NO: 150575 - protein, 9 aa, Homo Sapiens
ARAGIEASL

SEQ ID NO: 150576 - protein, 9 aa, Homo Sapiens
EMLEEKEVV

SEQ ID NO: 150577 - protein, 9 aa, Homo Sapiens
SQMQDYECR

SEQ ID NO: 150578 - protein, 9 aa, Homo Sapiens
ATPDLDVRK

SEQ ID NO: 150579 - protein, 9 aa, Homo Sapiens
TRYTPKQDT

SEQ ID NO: 150580 - protein, 9 aa, Homo Sapiens
KPRPPQPLP

SEQ ID NO: 150581 - protein, 9 aa, Homo Sapiens
IYKYIEYRR

SEQ ID NO: 150582 - protein, 9 aa, Homo Sapiens
PEEAADEKL

SEQ ID NO: 150583 - protein, 9 aa, Homo Sapiens
STLLRSSSA

SEQ ID NO: 150584 - protein, 9 aa, Homo Sapiens
FSQQEKKSR

SEQ ID NO: 150585 - protein, 9 aa, Homo Sapiens
GSPVGDVGL

SEQ ID NO: 150586 - protein, 9 aa, Homo Sapiens
IHLEVIMDR

SEQ ID NO: 150587 - protein, 9 aa, Homo Sapiens
PGCVLVLSR

SEQ ID NO: 150588 - protein, 9 aa, Homo Sapiens
ICGVSLLSH

SEQ ID NO: 150589 - protein, 9 aa, Homo Sapiens
GFLLGRAVG

SEQ ID NO: 150590 - protein, 9 aa, Homo Sapiens
GVTLKSPSC

SEQ ID NO: 150591 - protein, 9 aa, Homo Sapiens
QPVLQGFSD

SEQ ID NO: 150592 - protein, 9 aa, Homo Sapiens
QETLRVENK

SEQ ID NO: 150593 - protein, 9 aa, Homo Sapiens
QKGRIYSRA

SEQ ID NO: 150594 - protein, 9 aa, Homo Sapiens
MAAVAVARL

SEQ ID NO: 150595 - protein, 9 aa, Homo Sapiens
AAHMSASTG

SEQ ID NO: 150596 - protein, 9 aa, Homo Sapiens
FPKLVQILT

SEQ ID NO: 150597 - protein, 9 aa, Homo Sapiens
SGAPPPAAA

SEQ ID NO: 150598 - protein, 9 aa, Homo Sapiens
FIDTTTIVE

SEQ ID NO: 150599 - protein, 9 aa, Homo Sapiens
IIILYVKEW

SEQ ID NO: 150600 - protein, 9 aa, Homo Sapiens
PHRLYNGHT

SEQ ID NO: 150601 - protein, 9 aa, Homo Sapiens
VEQALRLGS

SEQ ID NO: 150602 - protein, 9 aa, Homo Sapiens
GGGHGPWAA

SEQ ID NO: 150603 - protein, 9 aa, Homo Sapiens
TSMCMAIAG

SEQ ID NO: 150604 - protein, 9 aa, Homo Sapiens
ENCDIFQNI

SEQ ID NO: 150605 - protein, 9 aa, Homo Sapiens
DRDSSPITN

SEQ ID NO: 150606 - protein, 9 aa, Homo Sapiens
GDDGEAGLI

SEQ ID NO: 150607 - protein, 9 aa, Homo Sapiens
LESMDKAVD

SEQ ID NO: 150608 - protein, 9 aa, Homo Sapiens
LAVKHKADS

SEQ ID NO: 150609 - protein, 9 aa, Homo Sapiens
AKDSTSWCS

SEQ ID NO: 150610 - protein, 9 aa, Homo Sapiens
FITKEKCRR

SEQ ID NO: 150611 - protein, 9 aa, Homo Sapiens
LWNDYIPDS

SEQ ID NO: 150612 - protein, 9 aa, Homo Sapiens
QLTFPAVML

SEQ ID NO: 150613 - protein, 9 aa, Homo Sapiens
EGWVEVLKA

SEQ ID NO: 150614 - protein, 9 aa, Homo Sapiens
ELHPLPLPP

SEQ ID NO: 150615 - protein, 9 aa, Homo Sapiens
ENVDYPYLE

SEQ ID NO: 150616 - protein, 9 aa, Homo Sapiens
KNYKKVHHH

SEQ ID NO: 150617 - protein, 9 aa, Homo Sapiens
TFQEEGNGM

SEQ ID NO: 150618 - protein, 9 aa, Homo Sapiens
VLPHVDFQL

SEQ ID NO: 150619 - protein, 9 aa, Homo Sapiens
PLNSWRSGG

SEQ ID NO: 150620 - protein, 9 aa, Homo Sapiens
KHKGLAETP

SEQ ID NO: 150621 - protein, 9 aa, Homo Sapiens
GCRVYPAPS

SEQ ID NO: 150622 - protein, 9 aa, Homo Sapiens
KRGRNWRDI

SEQ ID NO: 150623 - protein, 9 aa, Homo Sapiens
TTQAHPIHL

SEQ ID NO: 150624 - protein, 9 aa, Homo Sapiens
LQQLPVGGD

SEQ ID NO: 150625 - protein, 9 aa, Homo Sapiens
AEQRPEVLE

SEQ ID NO: 150626 - protein, 9 aa, Homo Sapiens
TEYPVHEGP

SEQ ID NO: 150627 - protein, 9 aa, Homo Sapiens
SPWGEHSSS

SEQ ID NO: 150628 - protein, 9 aa, Homo Sapiens
KVLYEAYHG

SEQ ID NO: 150629 - protein, 9 aa, Homo Sapiens
GADVTGGTM

SEQ ID NO: 150630 - protein, 9 aa, Homo Sapiens
VDYILATWA

SEQ ID NO: 150631 - protein, 9 aa, Homo Sapiens
TEAKKAYPS

SEQ ID NO: 150632 - protein, 9 aa, Homo Sapiens
ALLKLGVPS

SEQ ID NO: 150633 - protein, 9 aa, Homo Sapiens
HPAQTSLTP

SEQ ID NO: 150634 - protein, 9 aa, Homo Sapiens
RCDKSDHTK

SEQ ID NO: 150635 - protein, 9 aa, Homo Sapiens
PRSLQNLVE

SEQ ID NO: 150636 - protein, 9 aa, Homo Sapiens
LHRASEMAE

SEQ ID NO: 150637 - protein, 9 aa, Homo Sapiens
LGSCTAPCS

SEQ ID NO: 150638 - protein, 9 aa, Homo Sapiens
NNFFFDGMK

SEQ ID NO: 150639 - protein, 9 aa, Homo Sapiens
GSYHPGIFR

SEQ ID NO: 150640 - protein, 9 aa, Homo Sapiens
LQNYYTGGW

SEQ ID NO: 150641 - protein, 9 aa, Homo Sapiens
YNREISADF

SEQ ID NO: 150642 - protein, 9 aa, Homo Sapiens
VQQPQSEPL

SEQ ID NO: 150643 - protein, 9 aa, Homo Sapiens
SPPCLKVMH

SEQ ID NO: 150644 - protein, 9 aa, Homo Sapiens
PSDSLEIFA

SEQ ID NO: 150645 - protein, 9 aa, Homo Sapiens
PRTPRSSHN

SEQ ID NO: 150646 - protein, 9 aa, Homo Sapiens
KQKQHIHIG

SEQ ID NO: 150647 - protein, 9 aa, Homo Sapiens
CSGLTPPNA

SEQ ID NO: 150648 - protein, 9 aa, Homo Sapiens
TSGETTHIH

SEQ ID NO: 150649 - protein, 9 aa, Homo Sapiens
VLRLGPHGG

SEQ ID NO: 150650 - protein, 9 aa, Homo Sapiens
SVQGNLLSW

SEQ ID NO: 150651 - protein, 9 aa, Homo Sapiens
TVWDDSWDL

SEQ ID NO: 150652 - protein, 9 aa, Homo Sapiens
SSSSTSSLW

SEQ ID NO: 150653 - protein, 9 aa, Homo Sapiens
NECIGNLTN

SEQ ID NO: 150654 - protein, 9 aa, Homo Sapiens
KHTDTLACT

SEQ ID NO: 150655 - protein, 9 aa, Homo Sapiens
CPPAPGRAA

SEQ ID NO: 150656 - protein, 9 aa, Homo Sapiens
ALFGRDQGL

SEQ ID NO: 150657 - protein, 9 aa, Homo Sapiens
APWRPFSWE

SEQ ID NO: 150658 - protein, 9 aa, Homo Sapiens
GEDCYFFSI

SEQ ID NO: 150659 - protein, 9 aa, Homo Sapiens
AVTPFQTLQ

SEQ ID NO: 150660 - protein, 9 aa, Homo Sapiens
PAPSQPPSP

SEQ ID NO: 150661 - protein, 9 aa, Homo Sapiens
DPEMTEVNI

SEQ ID NO: 150662 - protein, 9 aa, Homo Sapiens
MSSPTLSRL

SEQ ID NO: 150663 - protein, 9 aa, Homo Sapiens
LVPKLQRRQ

SEQ ID NO: 150664 - protein, 9 aa, Homo Sapiens
HSAAFFSFS

SEQ ID NO: 150665 - protein, 9 aa, Homo Sapiens
RYDRFLSCD

SEQ ID NO: 150666 - protein, 9 aa, Homo Sapiens
GQQHQRHPG

SEQ ID NO: 150667 - protein, 9 aa, Homo Sapiens
QGCREGRMA

SEQ ID NO: 150668 - protein, 9 aa, Homo Sapiens
QFRCVSGQC

SEQ ID NO: 150669 - protein, 9 aa, Homo Sapiens
KMPWKTCWC

SEQ ID NO: 150670 - protein, 9 aa, Homo Sapiens
GVWEKENSD

SEQ ID NO: 150671 - protein, 9 aa, Homo Sapiens
QTLQLVHQL

SEQ ID NO: 150672 - protein, 9 aa, Homo Sapiens
WFCPTLPSI

SEQ ID NO: 150673 - protein, 9 aa, Homo Sapiens
HPWHQSYHS

SEQ ID NO: 150674 - protein, 9 aa, Homo Sapiens
ENAGNELLL

SEQ ID NO: 150675 - protein, 9 aa, Homo Sapiens
EEEERRLHQ

SEQ ID NO: 150676 - protein, 9 aa, Homo Sapiens
ELEREHFWK

SEQ ID NO: 150677 - protein, 9 aa, Homo Sapiens
EPHPNEWEK

SEQ ID NO: 150678 - protein, 9 aa, Homo Sapiens
IGPDDVQQK

SEQ ID NO: 150679 - protein, 9 aa, Homo Sapiens
RARCLDPSE

SEQ ID NO: 150680 - protein, 9 aa, Homo Sapiens
RRHLLRFLR

SEQ ID NO: 150681 - protein, 9 aa, Homo Sapiens
RGGGGGGST

SEQ ID NO: 150682 - protein, 9 aa, Homo Sapiens
FEFGFVALH

SEQ ID NO: 150683 - protein, 9 aa, Homo Sapiens
AGADDVLVV

SEQ ID NO: 150684 - protein, 9 aa, Homo Sapiens
EAPMEEEES

SEQ ID NO: 150685 - protein, 9 aa, Homo Sapiens
SPSLGQTFG

SEQ ID NO: 150686 - protein, 9 aa, Homo Sapiens
DQTMSECEA

SEQ ID NO: 150687 - protein, 9 aa, Homo Sapiens
PHWTPPSIT

SEQ ID NO: 150688 - protein, 9 aa, Homo Sapiens
TALTFSASI

SEQ ID NO: 150689 - protein, 9 aa, Homo Sapiens
EAGACEAPI

SEQ ID NO: 150690 - protein, 9 aa, Homo Sapiens
VWRLVPGCD

SEQ ID NO: 150691 - protein, 9 aa, Homo Sapiens
QRPPRQVRE

SEQ ID NO: 150692 - protein, 9 aa, Homo Sapiens
AAATMPILL

SEQ ID NO: 150693 - protein, 9 aa, Homo Sapiens
LLLATLCLA

SEQ ID NO: 150694 - protein, 9 aa, Homo Sapiens
PSPVPPPYT

SEQ ID NO: 150695 - protein, 9 aa, Homo Sapiens
ASRASQPSS

SEQ ID NO: 150696 - protein, 9 aa, Homo Sapiens
MTFLLILLI

SEQ ID NO: 150697 - protein, 9 aa, Homo Sapiens
STEEEEELE

SEQ ID NO: 150698 - protein, 9 aa, Homo Sapiens
DDINSAAKV

SEQ ID NO: 150699 - protein, 9 aa, Homo Sapiens
WRHPLPPRP

SEQ ID NO: 150700 - protein, 9 aa, Homo Sapiens
FGKEGIYKA

SEQ ID NO: 150701 - protein, 9 aa, Homo Sapiens
EIMSYVHPH

SEQ ID NO: 150702 - protein, 9 aa, Homo Sapiens
GKTSLPQGC

SEQ ID NO: 150703 - protein, 9 aa, Homo Sapiens
PHLVPKLQR

SEQ ID NO: 150704 - protein, 9 aa, Homo Sapiens
LYMPLHLLG

SEQ ID NO: 150705 - protein, 9 aa, Homo Sapiens
GAGSCEVTL

SEQ ID NO: 150706 - protein, 9 aa, Homo Sapiens
LQGGLQLGQ

SEQ ID NO: 150707 - protein, 9 aa, Homo Sapiens
APRRPLTRL

SEQ ID NO: 150708 - protein, 9 aa, Homo Sapiens
YENGEIGGS

SEQ ID NO: 150709 - protein, 9 aa, Homo Sapiens
EAVICALVV

SEQ ID NO: 150710 - protein, 9 aa, Homo Sapiens
TTYCHPSCC

SEQ ID NO: 150711 - protein, 9 aa, Homo Sapiens
PRYCVGSVL

SEQ ID NO: 150712 - protein, 9 aa, Homo Sapiens
KCLRTHSLS

SEQ ID NO: 150713 - protein, 9 aa, Homo Sapiens
KLRNSERVR

SEQ ID NO: 150714 - protein, 9 aa, Homo Sapiens
LYFTKNSRG

SEQ ID NO: 150715 - protein, 9 aa, Homo Sapiens
SSYNFKQKR

SEQ ID NO: 150716 - protein, 9 aa, Homo Sapiens
HLILLWLLG

SEQ ID NO: 150717 - protein, 9 aa, Homo Sapiens
TLELDRSHE

SEQ ID NO: 150718 - protein, 9 aa, Homo Sapiens
HVKITPVID

SEQ ID NO: 150719 - protein, 9 aa, Homo Sapiens
TEFVGWRYR

SEQ ID NO: 150720 - protein, 9 aa, Homo Sapiens
REGRMATLE

SEQ ID NO: 150721 - protein, 9 aa, Homo Sapiens
PKPRPPQPL

SEQ ID NO: 150722 - protein, 9 aa, Homo Sapiens
AAIKSVKTP

SEQ ID NO: 150723 - protein, 9 aa, Homo Sapiens
PRRQLPQWR

SEQ ID NO: 150724 - protein, 9 aa, Homo Sapiens
TLCLGMPRA

SEQ ID NO: 150725 - protein, 9 aa, Homo Sapiens
NPQHVESRW

SEQ ID NO: 150726 - protein, 9 aa, Homo Sapiens
APGSPRLCA

SEQ ID NO: 150727 - protein, 9 aa, Homo Sapiens
IMSRKACAH

SEQ ID NO: 150728 - protein, 9 aa, Homo Sapiens
TQAHPIHLS

SEQ ID NO: 150729 - protein, 9 aa, Homo Sapiens
LRVENKSQC

SEQ ID NO: 150730 - protein, 9 aa, Homo Sapiens
ARTRGAPAA

SEQ ID NO: 150731 - protein, 9 aa, Homo Sapiens
CLSSSSILL

SEQ ID NO: 150732 - protein, 9 aa, Homo Sapiens
AQCKQDHQK

SEQ ID NO: 150733 - protein, 9 aa, Homo Sapiens
PRTPSPCTQ

SEQ ID NO: 150734 - protein, 9 aa, Homo Sapiens
EFETVLACV

SEQ ID NO: 150735 - protein, 9 aa, Homo Sapiens
VPLVMGYTT

SEQ ID NO: 150736 - protein, 9 aa, Homo Sapiens
LINHQETHS

SEQ ID NO: 150737 - protein, 9 aa, Homo Sapiens
QGGQGGLDL

SEQ ID NO: 150738 - protein, 9 aa, Homo Sapiens
KGYTLASDK

SEQ ID NO: 150739 - protein, 9 aa, Homo Sapiens
LLLFLLAVV

SEQ ID NO: 150740 - protein, 9 aa, Homo Sapiens
ASRGAPGSH

SEQ ID NO: 150741 - protein, 9 aa, Homo Sapiens
CHQQPPVIP

SEQ ID NO: 150742 - protein, 9 aa, Homo Sapiens
SQSRARAWD

SEQ ID NO: 150743 - protein, 9 aa, Homo Sapiens
LQALMAQLT

SEQ ID NO: 150744 - protein, 9 aa, Homo Sapiens
STVSSGTST

SEQ ID NO: 150745 - protein, 9 aa, Homo Sapiens
LRGDPGVIK

SEQ ID NO: 150746 - protein, 9 aa, Homo Sapiens
TLPFHQTIR

SEQ ID NO: 150747 - protein, 9 aa, Homo Sapiens
PQNVTFCSS

SEQ ID NO: 150748 - protein, 9 aa, Homo Sapiens
CTMQATSAT

SEQ ID NO: 150749 - protein, 9 aa, Homo Sapiens
QTLMSPGSC

SEQ ID NO: 150750 - protein, 9 aa, Homo Sapiens
QAADWLLQT

SEQ ID NO: 150751 - protein, 9 aa, Homo Sapiens
CLMSQRTQR

SEQ ID NO: 150752 - protein, 9 aa, Homo Sapiens
ETQEDIAVI

SEQ ID NO: 150753 - protein, 9 aa, Homo Sapiens
WLSSSQWGP

SEQ ID NO: 150754 - protein, 9 aa, Homo Sapiens
QPPPQQQHY

SEQ ID NO: 150755 - protein, 9 aa, Homo Sapiens
LGRLLILRS

SEQ ID NO: 150756 - protein, 9 aa, Homo Sapiens
SESVYSGCS

SEQ ID NO: 150757 - protein, 9 aa, Homo Sapiens
HKQVERYFT

SEQ ID NO: 150758 - protein, 9 aa, Homo Sapiens
TDVSTAFEE

SEQ ID NO: 150759 - protein, 9 aa, Homo Sapiens
EPLSMTFVY

SEQ ID NO: 150760 - protein, 9 aa, Homo Sapiens
RRRRRTRTQ

SEQ ID NO: 150761 - protein, 9 aa, Homo Sapiens
PPGSPGHLS

SEQ ID NO: 150762 - protein, 9 aa, Homo Sapiens
QVTSKLDRR

SEQ ID NO: 150763 - protein, 9 aa, Homo Sapiens
SHSWIRTEM

SEQ ID NO: 150764 - protein, 9 aa, Homo Sapiens
CDGWADRTD

SEQ ID NO: 150765 - protein, 9 aa, Homo Sapiens
HPPHLVPKL

SEQ ID NO: 150766 - protein, 9 aa, Homo Sapiens
RKCCLIDEN

SEQ ID NO: 150767 - protein, 9 aa, Homo Sapiens
ISIFHALMY

SEQ ID NO: 150768 - protein, 9 aa, Homo Sapiens
VYSNPCMEE

SEQ ID NO: 150769 - protein, 9 aa, Homo Sapiens
WVLQWQKKW

SEQ ID NO: 150770 - protein, 9 aa, Homo Sapiens
YYQNGCLYR

SEQ ID NO: 150771 - protein, 9 aa, Homo Sapiens
QEVEHKKKL

SEQ ID NO: 150772 - protein, 9 aa, Homo Sapiens
LRGQPPPPP

SEQ ID NO: 150773 - protein, 9 aa, Homo Sapiens
SFCCSTVSR

SEQ ID NO: 150774 - protein, 9 aa, Homo Sapiens
NTVKASPPA

SEQ ID NO: 150775 - protein, 9 aa, Homo Sapiens
PQRVMSQEH

SEQ ID NO: 150776 - protein, 9 aa, Homo Sapiens
CARINESLQ

SEQ ID NO: 150777 - protein, 9 aa, Homo Sapiens
CFLYIVMSY

SEQ ID NO: 150778 - protein, 9 aa, Homo Sapiens
ICCGHGHNT

SEQ ID NO: 150779 - protein, 9 aa, Homo Sapiens
YSLFLFPDV

SEQ ID NO: 150780 - protein, 9 aa, Homo Sapiens
FCLSADHEL

SEQ ID NO: 150781 - protein, 9 aa, Homo Sapiens
NKLDADYIK

SEQ ID NO: 150782 - protein, 9 aa, Homo Sapiens
ITSSRYILS

SEQ ID NO: 150783 - protein, 9 aa, Homo Sapiens
DCQAEQDAL

SEQ ID NO: 150784 - protein, 9 aa, Homo Sapiens
CFGVYVGTA

SEQ ID NO: 150785 - protein, 9 aa, Homo Sapiens
LDLQNNDTS

SEQ ID NO: 150786 - protein, 9 aa, Homo Sapiens
RASQEAKQN

SEQ ID NO: 150787 - protein, 9 aa, Homo Sapiens
WRPSQSAAA

SEQ ID NO: 150788 - protein, 9 aa, Homo Sapiens
SSDPPSASQ

SEQ ID NO: 150789 - protein, 9 aa, Homo Sapiens
HSHKQVERY

SEQ ID NO: 150790 - protein, 9 aa, Homo Sapiens
HVHVESNSS

SEQ ID NO: 150791 - protein, 9 aa, Homo Sapiens
GWGQWHLGA

SEQ ID NO: 150792 - protein, 9 aa, Homo Sapiens
NLFSMGMTV

SEQ ID NO: 150793 - protein, 9 aa, Homo Sapiens
YIGPDDVQQ

SEQ ID NO: 150794 - protein, 9 aa, Homo Sapiens
EYGADVNAV

SEQ ID NO: 150795 - protein, 9 aa, Homo Sapiens
PTTTTSSPR

SEQ ID NO: 150796 - protein, 9 aa, Homo Sapiens
RRACVQSTG

SEQ ID NO: 150797 - protein, 9 aa, Homo Sapiens
WQPGASPRC

SEQ ID NO: 150798 - protein, 9 aa, Homo Sapiens
KILKFQNGN

SEQ ID NO: 150799 - protein, 9 aa, Homo Sapiens
FCSMKCKDI

SEQ ID NO: 150800 - protein, 9 aa, Homo Sapiens
HRSSTPKSK

SEQ ID NO: 150801 - protein, 9 aa, Homo Sapiens
GMEDVGPGA

SEQ ID NO: 150802 - protein, 9 aa, Homo Sapiens
MSPGEKPDP

SEQ ID NO: 150803 - protein, 9 aa, Homo Sapiens
SQDWLAVNE

SEQ ID NO: 150804 - protein, 8 aa, Homo Sapiens
AKPAQGAK

SEQ ID NO: 150805 - protein, 9 aa, Homo Sapiens
YQSPGRAPH

SEQ ID NO: 150806 - protein, 9 aa, Homo Sapiens
YSSHSQNEI

SEQ ID NO: 150807 - protein, 9 aa, Homo Sapiens
SCRGRIKEQ

SEQ ID NO: 150808 - protein, 9 aa, Homo Sapiens
TGAQGRGKS

SEQ ID NO: 150809 - protein, 9 aa, Homo Sapiens
LFIQNPWWV

SEQ ID NO: 150810 - protein, 9 aa, Homo Sapiens
AVPYVPVQV

SEQ ID NO: 150811 - protein, 9 aa, Homo Sapiens
DFQKQRMEK

SEQ ID NO: 150812 - protein, 9 aa, Homo Sapiens
LGLTRRSSA

SEQ ID NO: 150813 - protein, 9 aa, Homo Sapiens
TVDAYNPET

SEQ ID NO: 150814 - protein, 9 aa, Homo Sapiens
AKNLSEVAR

SEQ ID NO: 150815 - protein, 9 aa, Homo Sapiens
SIPKRRPRP

SEQ ID NO: 150816 - protein, 9 aa, Homo Sapiens
TCAVCGYNA

SEQ ID NO: 150817 - protein, 9 aa, Homo Sapiens
LAPATPPFG

SEQ ID NO: 150818 - protein, 9 aa, Homo Sapiens
IPGGPPGVF

SEQ ID NO: 150819 - protein, 9 aa, Homo Sapiens
CTQCGRAFC

SEQ ID NO: 150820 - protein, 9 aa, Homo Sapiens
HPPTGPLLC

SEQ ID NO: 150821 - protein, 9 aa, Homo Sapiens
FRKKRSQMP

SEQ ID NO: 150822 - protein, 9 aa, Homo Sapiens
DEGCDQWIT

SEQ ID NO: 150823 - protein, 9 aa, Homo Sapiens
LRSPRVFPV

SEQ ID NO: 150824 - protein, 9 aa, Homo Sapiens
QRPSTVPLP

SEQ ID NO: 150825 - protein, 9 aa, Homo Sapiens
LSDLPSLTS

SEQ ID NO: 150826 - protein, 9 aa, Homo Sapiens
LPTHLMEEC

SEQ ID NO: 150827 - protein, 9 aa, Homo Sapiens
QAVMLRMPE

SEQ ID NO: 150828 - protein, 9 aa, Homo Sapiens
IQLPNGITL

SEQ ID NO: 150829 - protein, 9 aa, Homo Sapiens
KLQRRQFLA

SEQ ID NO: 150830 - protein, 9 aa, Homo Sapiens
IPGIEGLGT

SEQ ID NO: 150831 - protein, 9 aa, Homo Sapiens
ATDDDEEMN

SEQ ID NO: 150832 - protein, 9 aa, Homo Sapiens
DTPVADDHW

SEQ ID NO: 150833 - protein, 9 aa, Homo Sapiens
KKAFVTCSS

SEQ ID NO: 150834 - protein, 9 aa, Homo Sapiens
LPGIPGPPK

SEQ ID NO: 150835 - protein, 9 aa, Homo Sapiens
CVKPNSRVL

SEQ ID NO: 150836 - protein, 9 aa, Homo Sapiens
AVVWAQWGP

SEQ ID NO: 150837 - protein, 9 aa, Homo Sapiens
LYQTNSRLY

SEQ ID NO: 150838 - protein, 9 aa, Homo Sapiens
EGGITFVPH

SEQ ID NO: 150839 - protein, 9 aa, Homo Sapiens
FVTNITTKF

SEQ ID NO: 150840 - protein, 9 aa, Homo Sapiens
PEKDKFLPT

SEQ ID NO: 150841 - protein, 9 aa, Homo Sapiens
PPALSPVAC

SEQ ID NO: 150842 - protein, 9 aa, Homo Sapiens
APATALDVG

SEQ ID NO: 150843 - protein, 9 aa, Homo Sapiens
EQNKKRQTL

SEQ ID NO: 150844 - protein, 9 aa, Homo Sapiens
NGGKVARKH

SEQ ID NO: 150845 - protein, 9 aa, Homo Sapiens
IGKDEDFKQ

SEQ ID NO: 150846 - protein, 9 aa, Homo Sapiens
ILRSPRVFP

SEQ ID NO: 150847 - protein, 9 aa, Homo Sapiens
VPGPPLPSS

SEQ ID NO: 150848 - protein, 9 aa, Homo Sapiens
FMRGHFHEE

SEQ ID NO: 150849 - protein, 9 aa, Homo Sapiens
SYTPKEPGI

SEQ ID NO: 150850 - protein, 9 aa, Homo Sapiens
DLVHALSLS

SEQ ID NO: 150851 - protein, 9 aa, Homo Sapiens
VPWEFGDII

SEQ ID NO: 150852 - protein, 9 aa, Homo Sapiens
SPTPTRRPR

SEQ ID NO: 150853 - protein, 9 aa, Homo Sapiens
GRLQQKMLL

SEQ ID NO: 150854 - protein, 9 aa, Homo Sapiens
FNEVLDHVP

SEQ ID NO: 150855 - protein, 9 aa, Homo Sapiens
SSRGQVRHS

SEQ ID NO: 150856 - protein, 9 aa, Homo Sapiens
DVRQWKERG

SEQ ID NO: 150857 - protein, 9 aa, Homo Sapiens
HHRRRLRAG

SEQ ID NO: 150858 - protein, 9 aa, Homo Sapiens
FKILKFQNG

SEQ ID NO: 150859 - protein, 9 aa, Homo Sapiens
VAQVLVTDP

SEQ ID NO: 150860 - protein, 9 aa, Homo Sapiens
WGDWVASPP

SEQ ID NO: 150861 - protein, 9 aa, Homo Sapiens
PQWECELEL

SEQ ID NO: 150862 - protein, 9 aa, Homo Sapiens
LGTLCPGGR

SEQ ID NO: 150863 - protein, 9 aa, Homo Sapiens
GMAALTAAA

SEQ ID NO: 150864 - protein, 9 aa, Homo Sapiens
GADDVLVVG

SEQ ID NO: 150865 - protein, 9 aa, Homo Sapiens
ASCGPTSGS

SEQ ID NO: 150866 - protein, 9 aa, Homo Sapiens
SRTTGAPGA

SEQ ID NO: 150867 - protein, 9 aa, Homo Sapiens
EKTRKRIFF

SEQ ID NO: 150868 - protein, 9 aa, Homo Sapiens
LPDNIFGGK

SEQ ID NO: 150869 - protein, 9 aa, Homo Sapiens
LTDAFEQMW

SEQ ID NO: 150870 - protein, 9 aa, Homo Sapiens
PKQRTRTMR

SEQ ID NO: 150871 - protein, 9 aa, Homo Sapiens
ERKSGILAI

SEQ ID NO: 150872 - protein, 9 aa, Homo Sapiens
ALLLPATTC

SEQ ID NO: 150873 - protein, 9 aa, Homo Sapiens
GYVRIMEAI

SEQ ID NO: 150874 - protein, 9 aa, Homo Sapiens
PFGSSCLQT

SEQ ID NO: 150875 - protein, 9 aa, Homo Sapiens
KHSHKQVER

SEQ ID NO: 150876 - protein, 9 aa, Homo Sapiens
DGHCATVHQ

SEQ ID NO: 150877 - protein, 9 aa, Homo Sapiens
EFGFVALHS

SEQ ID NO: 150878 - protein, 9 aa, Homo Sapiens
IFFDVDTSQ

SEQ ID NO: 150879 - protein, 9 aa, Homo Sapiens
GSFFTFPIC

SEQ ID NO: 150880 - protein, 9 aa, Homo Sapiens
SSTSLALSP

SEQ ID NO: 150881 - protein, 9 aa, Homo Sapiens
KHLEEVTVV

SEQ ID NO: 150882 - protein, 9 aa, Homo Sapiens
QQLLELSSL

SEQ ID NO: 150883 - protein, 9 aa, Homo Sapiens
PPGEQQCPG

SEQ ID NO: 150884 - protein, 9 aa, Homo Sapiens
KFFRLIMDG

SEQ ID NO: 150885 - protein, 9 aa, Homo Sapiens
ESTHTTVFP

SEQ ID NO: 150886 - protein, 9 aa, Homo Sapiens
RHVAYSVGW

SEQ ID NO: 150887 - protein, 9 aa, Homo Sapiens
RFPLGAHCS

SEQ ID NO: 150888 - protein, 9 aa, Homo Sapiens
SSSRTACGA

SEQ ID NO: 150889 - protein, 9 aa, Homo Sapiens
RSAWGDWVA

SEQ ID NO: 150890 - protein, 9 aa, Homo Sapiens
YSVTTSVVT

SEQ ID NO: 150891 - protein, 9 aa, Homo Sapiens
WCRHCGSTS

SEQ ID NO: 150892 - protein, 9 aa, Homo Sapiens
ILARLVATP

SEQ ID NO: 150893 - protein, 9 aa, Homo Sapiens
WRKSGSGSG

SEQ ID NO: 150894 - protein, 9 aa, Homo Sapiens
VDGDANHST

SEQ ID NO: 150895 - protein, 9 aa, Homo Sapiens
INPTNVKNV

SEQ ID NO: 150896 - protein, 9 aa, Homo Sapiens
RSIRRPLIF

SEQ ID NO: 150897 - protein, 9 aa, Homo Sapiens
EREISGWAM

SEQ ID NO: 150898 - protein, 9 aa, Homo Sapiens
REYYMQQEV

SEQ ID NO: 150899 - protein, 9 aa, Homo Sapiens
AREIICQSL

SEQ ID NO: 150900 - protein, 9 aa, Homo Sapiens
TRSAWGDWV

SEQ ID NO: 150901 - protein, 9 aa, Homo Sapiens
VELIVREKP

SEQ ID NO: 150902 - protein, 9 aa, Homo Sapiens
RHTPRSPWA

SEQ ID NO: 150903 - protein, 9 aa, Homo Sapiens
SWPTRRSTM

SEQ ID NO: 150904 - protein, 9 aa, Homo Sapiens
GSACIAIKW

SEQ ID NO: 150905 - protein, 9 aa, Homo Sapiens
SMEISSGDE

SEQ ID NO: 150906 - protein, 9 aa, Homo Sapiens
PGSGAPPPA

SEQ ID NO: 150907 - protein, 9 aa, Homo Sapiens
MANCEHTFI

SEQ ID NO: 150908 - protein, 9 aa, Homo Sapiens
RNLPSGEVL

SEQ ID NO: 150909 - protein, 9 aa, Homo Sapiens
KAKKPHSFK

SEQ ID NO: 150910 - protein, 9 aa, Homo Sapiens
RPAFPVAGP

SEQ ID NO: 150911 - protein, 9 aa, Homo Sapiens
EVRGVFAVQ

SEQ ID NO: 150912 - protein, 9 aa, Homo Sapiens
RFADQRAEI

SEQ ID NO: 150913 - protein, 9 aa, Homo Sapiens
HVRETEKQC

SEQ ID NO: 150914 - protein, 9 aa, Homo Sapiens
RKEPDRPRP

SEQ ID NO: 150915 - protein, 9 aa, Homo Sapiens
APRRQRASS

SEQ ID NO: 150916 - protein, 9 aa, Homo Sapiens
STTQDETRD

SEQ ID NO: 150917 - protein, 9 aa, Homo Sapiens
GTRRSSNKP

SEQ ID NO: 150918 - protein, 9 aa, Homo Sapiens
TGLRQGGTR

SEQ ID NO: 150919 - protein, 9 aa, Homo Sapiens
LHPRLQPAL

SEQ ID NO: 150920 - protein, 9 aa, Homo Sapiens
NIMENSTQW

SEQ ID NO: 150921 - protein, 9 aa, Homo Sapiens
WGEIFLFVQ

SEQ ID NO: 150922 - protein, 9 aa, Homo Sapiens
AALFMSQCL

SEQ ID NO: 150923 - protein, 9 aa, Homo Sapiens
SYKHKGLAE

SEQ ID NO: 150924 - protein, 9 aa, Homo Sapiens
LRMERPRSA

SEQ ID NO: 150925 - protein, 9 aa, Homo Sapiens
ACPMTACSI

SEQ ID NO: 150926 - protein, 9 aa, Homo Sapiens
YSELKDQSR

SEQ ID NO: 150927 - protein, 9 aa, Homo Sapiens
KNCIYPLSM

SEQ ID NO: 150928 - protein, 9 aa, Homo Sapiens
VVRNRRLGS

SEQ ID NO: 150929 - protein, 9 aa, Homo Sapiens
VLRYHPDKN

SEQ ID NO: 150930 - protein, 9 aa, Homo Sapiens
DLADGAHVW

SEQ ID NO: 150931 - protein, 9 aa, Homo Sapiens
RLMQRLLEH

SEQ ID NO: 150932 - protein, 9 aa, Homo Sapiens
LLLLLLVFL

SEQ ID NO: 150933 - protein, 9 aa, Homo Sapiens
DGEATDTVG

SEQ ID NO: 150934 - protein, 9 aa, Homo Sapiens
HTAGAVWHE

SEQ ID NO: 150935 - protein, 9 aa, Homo Sapiens
METHHLQPP

SEQ ID NO: 150936 - protein, 9 aa, Homo Sapiens
SYEDNSYTF

SEQ ID NO: 150937 - protein, 9 aa, Homo Sapiens
LNQVKQESR

SEQ ID NO: 150938 - protein, 9 aa, Homo Sapiens
RPRKALDFE

SEQ ID NO: 150939 - protein, 9 aa, Homo Sapiens
ASGPTPVPT

SEQ ID NO: 150940 - protein, 9 aa, Homo Sapiens
HVLLGPLQG

SEQ ID NO: 150941 - protein, 9 aa, Homo Sapiens
IAIPQCWVL

SEQ ID NO: 150942 - protein, 9 aa, Homo Sapiens
HLLRFLRVQ

SEQ ID NO: 150943 - protein, 9 aa, Homo Sapiens
GRRRRPGGR

SEQ ID NO: 150944 - protein, 9 aa, Homo Sapiens
CTLDLDLVT

SEQ ID NO: 150945 - protein, 9 aa, Homo Sapiens
LFIKPNPAK

SEQ ID NO: 150946 - protein, 9 aa, Homo Sapiens
AKAGVHQPP

SEQ ID NO: 150947 - protein, 9 aa, Homo Sapiens
AKNILASPG

SEQ ID NO: 150948 - protein, 9 aa, Homo Sapiens
GGTLLDDVV

SEQ ID NO: 150949 - protein, 9 aa, Homo Sapiens
GRGEIVNVA

SEQ ID NO: 150950 - protein, 9 aa, Homo Sapiens
AQLGGGQGG

SEQ ID NO: 150951 - protein, 9 aa, Homo Sapiens
IRYDRFLSC

SEQ ID NO: 150952 - protein, 9 aa, Homo Sapiens
FTRDSTCLS

SEQ ID NO: 150953 - protein, 9 aa, Homo Sapiens
PFHQTIRLN

SEQ ID NO: 150954 - protein, 9 aa, Homo Sapiens
YLANMGGSR

SEQ ID NO: 150955 - protein, 9 aa, Homo Sapiens
NPQGVLSPP

SEQ ID NO: 150956 - protein, 9 aa, Homo Sapiens
ADGAHVWLL

SEQ ID NO: 150957 - protein, 9 aa, Homo Sapiens
SVDAKVVDP

SEQ ID NO: 150958 - protein, 9 aa, Homo Sapiens
LSVEPGYPH

SEQ ID NO: 150959 - protein, 9 aa, Homo Sapiens
RVDAHVVLE

SEQ ID NO: 150960 - protein, 9 aa, Homo Sapiens
SSWRSPCSG

SEQ ID NO: 150961 - protein, 9 aa, Homo Sapiens
DRFNLPCRS

SEQ ID NO: 150962 - protein, 9 aa, Homo Sapiens
TLKSPSCLM

SEQ ID NO: 150963 - protein, 9 aa, Homo Sapiens
RNAWWLQVP

SEQ ID NO: 150964 - protein, 9 aa, Homo Sapiens
GARPGASGV

SEQ ID NO: 150965 - protein, 9 aa, Homo Sapiens
GQLQARTGT

SEQ ID NO: 150966 - protein, 9 aa, Homo Sapiens
PDTTHPTCI

SEQ ID NO: 150967 - protein, 9 aa, Homo Sapiens
SRGAPGSHL

SEQ ID NO: 150968 - protein, 9 aa, Homo Sapiens
MTIQTMKTV

SEQ ID NO: 150969 - protein, 9 aa, Homo Sapiens
SALTFRKEQ

SEQ ID NO: 150970 - protein, 9 aa, Homo Sapiens
HPGITDTAW

SEQ ID NO: 150971 - protein, 9 aa, Homo Sapiens
VTQKAPCGR

SEQ ID NO: 150972 - protein, 9 aa, Homo Sapiens
YQIFFDVDT

SEQ ID NO: 150973 - protein, 9 aa, Homo Sapiens
TERSCRPSV

SEQ ID NO: 150974 - protein, 9 aa, Homo Sapiens
EIFAKLEEI

SEQ ID NO: 150975 - protein, 9 aa, Homo Sapiens
FPESASDTI

SEQ ID NO: 150976 - protein, 9 aa, Homo Sapiens
PRPRRQPPH

SEQ ID NO: 150977 - protein, 9 aa, Homo Sapiens
VTTSVVTRI

SEQ ID NO: 150978 - protein, 9 aa, Homo Sapiens
SAGRTSARR

SEQ ID NO: 150979 - protein, 9 aa, Homo Sapiens
RHSTPPGEA

SEQ ID NO: 150980 - protein, 9 aa, Homo Sapiens
CGIVSTSSH

SEQ ID NO: 150981 - protein, 9 aa, Homo Sapiens
PPSTPSSNF

SEQ ID NO: 150982 - protein, 9 aa, Homo Sapiens
APPSTPPDR

SEQ ID NO: 150983 - protein, 9 aa, Homo Sapiens
EAVAKKRRD

SEQ ID NO: 150984 - protein, 9 aa, Homo Sapiens
KTEKLEKLT

SEQ ID NO: 150985 - protein, 9 aa, Homo Sapiens
GPQRRHLWN

SEQ ID NO: 150986 - protein, 9 aa, Homo Sapiens
LPLRLGQGP

SEQ ID NO: 150987 - protein, 9 aa, Homo Sapiens
KNMAADIAV

SEQ ID NO: 150988 - protein, 9 aa, Homo Sapiens
MENGLWLKV

SEQ ID NO: 150989 - protein, 9 aa, Homo Sapiens
TPSPCTQGR

SEQ ID NO: 150990 - protein, 9 aa, Homo Sapiens
KKPRLLVSR

SEQ ID NO: 150991 - protein, 9 aa, Homo Sapiens
GVIMILVMV

SEQ ID NO: 150992 - protein, 9 aa, Homo Sapiens
KASAASCAS

SEQ ID NO: 150993 - protein, 9 aa, Homo Sapiens
TGSALTFRK

SEQ ID NO: 150994 - protein, 9 aa, Homo Sapiens
ASLKKQYPK

SEQ ID NO: 150995 - protein, 9 aa, Homo Sapiens
EEASQVGGT

SEQ ID NO: 150996 - protein, 9 aa, Homo Sapiens
TYSAVVKVP

SEQ ID NO: 150997 - protein, 9 aa, Homo Sapiens
NRCKKVASN

SEQ ID NO: 150998 - protein, 9 aa, Homo Sapiens
SLQQQQQQE

SEQ ID NO: 150999 - protein, 9 aa, Homo Sapiens
RFDENVVVR

SEQ ID NO: 151000 - protein, 9 aa, Homo Sapiens
ITTKFPWHI

SEQ ID NO: 151001 - protein, 9 aa, Homo Sapiens
LRGGVRVKL

SEQ ID NO: 151002 - protein, 9 aa, Homo Sapiens
THTVIHTDT

SEQ ID NO: 151003 - protein, 9 aa, Homo Sapiens
SPPARCARS

SEQ ID NO: 151004 - protein, 9 aa, Homo Sapiens
RYRLSAQSE

SEQ ID NO: 151005 - protein, 9 aa, Homo Sapiens
NVHGGHAPS

SEQ ID NO: 151006 - protein, 9 aa, Homo Sapiens
SYILAVQNV

SEQ ID NO: 151007 - protein, 9 aa, Homo Sapiens
LVLCLDLSN

SEQ ID NO: 151008 - protein, 9 aa, Homo Sapiens
FPPLEDAST

SEQ ID NO: 151009 - protein, 9 aa, Homo Sapiens
ISIMTERSM

SEQ ID NO: 151010 - protein, 9 aa, Homo Sapiens
PSILLPALL

SEQ ID NO: 151011 - protein, 9 aa, Homo Sapiens
WLLFVVMAW

SEQ ID NO: 151012 - protein, 9 aa, Homo Sapiens
IYSELKDQS

SEQ ID NO: 151013 - protein, 9 aa, Homo Sapiens
VKANPKHLE

SEQ ID NO: 151014 - protein, 9 aa, Homo Sapiens
REVIAGSLL

SEQ ID NO: 151015 - protein, 9 aa, Homo Sapiens
HQLLVLTQL

SEQ ID NO: 151016 - protein, 9 aa, Homo Sapiens
SGRRATLTS

SEQ ID NO: 151017 - protein, 9 aa, Homo Sapiens
HWNYLSFLK

SEQ ID NO: 151018 - protein, 9 aa, Homo Sapiens
AVQVVRARE

SEQ ID NO: 151019 - protein, 9 aa, Homo Sapiens
RQLLNDYGP

SEQ ID NO: 151020 - protein, 9 aa, Homo Sapiens
SPCTQGRCW

SEQ ID NO: 151021 - protein, 9 aa, Homo Sapiens
TWCMENVDY

SEQ ID NO: 151022 - protein, 9 aa, Homo Sapiens
HRVFGQLTG

SEQ ID NO: 151023 - protein, 9 aa, Homo Sapiens
VRVPDQEPT

SEQ ID NO: 151024 - protein, 9 aa, Homo Sapiens
KWARSSQKE

SEQ ID NO: 151025 - protein, 9 aa, Homo Sapiens
SQSSTSILS

SEQ ID NO: 151026 - protein, 9 aa, Homo Sapiens
LPRSSRRCT

SEQ ID NO: 151027 - protein, 9 aa, Homo Sapiens
IISHTAAVR

SEQ ID NO: 151028 - protein, 9 aa, Homo Sapiens
TFRHNECLD

SEQ ID NO: 151029 - protein, 9 aa, Homo Sapiens
GSSCSFVEQ

SEQ ID NO: 151030 - protein, 9 aa, Homo Sapiens
GTLLDDVVG

SEQ ID NO: 151031 - protein, 9 aa, Homo Sapiens
CGTRLWTSV

SEQ ID NO: 151032 - protein, 9 aa, Homo Sapiens
MMRSRSNSP

SEQ ID NO: 151033 - protein, 9 aa, Homo Sapiens
PKPWQSPWG

SEQ ID NO: 151034 - protein, 9 aa, Homo Sapiens
DVTGGTMAE

SEQ ID NO: 151035 - protein, 9 aa, Homo Sapiens
AWGLLPGWG

SEQ ID NO: 151036 - protein, 9 aa, Homo Sapiens
PRTATSLDI

SEQ ID NO: 151037 - protein, 9 aa, Homo Sapiens
PGWRWRRGH

SEQ ID NO: 151038 - protein, 9 aa, Homo Sapiens
APDSPNGPL

SEQ ID NO: 151039 - protein, 9 aa, Homo Sapiens
VASEITMRD

SEQ ID NO: 151040 - protein, 9 aa, Homo Sapiens
LRQDVKQQQ

SEQ ID NO: 151041 - protein, 9 aa, Homo Sapiens
NTYQTFKAL

SEQ ID NO: 151042 - protein, 9 aa, Homo Sapiens
PGPREVPAA

SEQ ID NO: 151043 - protein, 9 aa, Homo Sapiens
QGPAQAPLH

SEQ ID NO: 151044 - protein, 9 aa, Homo Sapiens
PELAQRGRD

SEQ ID NO: 151045 - protein, 9 aa, Homo Sapiens
SLGQQHQRH

SEQ ID NO: 151046 - protein, 9 aa, Homo Sapiens
GGGRGWMWQ

SEQ ID NO: 151047 - protein, 9 aa, Homo Sapiens
QGPCGYGPQ

SEQ ID NO: 151048 - protein, 9 aa, Homo Sapiens
AEQELELEA

SEQ ID NO: 151049 - protein, 9 aa, Homo Sapiens
AGGSCRLQL

SEQ ID NO: 151050 - protein, 9 aa, Homo Sapiens
PAQAPLHPQ

SEQ ID NO: 151051 - protein, 9 aa, Homo Sapiens
TPKEPGIYT

SEQ ID NO: 151052 - protein, 9 aa, Homo Sapiens
LLRLQSLLS

SEQ ID NO: 151053 - protein, 9 aa, Homo Sapiens
CFSQQEKKS

SEQ ID NO: 151054 - protein, 9 aa, Homo Sapiens
VSRPPSLHP

SEQ ID NO: 151055 - protein, 9 aa, Homo Sapiens
VWNGGSNPH

SEQ ID NO: 151056 - protein, 9 aa, Homo Sapiens
HSIPRRQWA

SEQ ID NO: 151057 - protein, 9 aa, Homo Sapiens
VPAGSGSFV

SEQ ID NO: 151058 - protein, 9 aa, Homo Sapiens
GLPIVPFEM

SEQ ID NO: 151059 - protein, 9 aa, Homo Sapiens
IMDRPLQVF

SEQ ID NO: 151060 - protein, 9 aa, Homo Sapiens
KSRYEWNLE

SEQ ID NO: 151061 - protein, 9 aa, Homo Sapiens
SLGRALPLP

SEQ ID NO: 151062 - protein, 9 aa, Homo Sapiens
LQVPGELGT

SEQ ID NO: 151063 - protein, 9 aa, Homo Sapiens
LHQAAFQKL

SEQ ID NO: 151064 - protein, 9 aa, Homo Sapiens
TAVVKKIHA

SEQ ID NO: 151065 - protein, 9 aa, Homo Sapiens
GKNTYPEKI

SEQ ID NO: 151066 - protein, 9 aa, Homo Sapiens
PSTAATTAA

SEQ ID NO: 151067 - protein, 9 aa, Homo Sapiens
DHERLKNPL

SEQ ID NO: 151068 - protein, 9 aa, Homo Sapiens
AGYGQGPCG

SEQ ID NO: 151069 - protein, 9 aa, Homo Sapiens
RGAWKASRR

SEQ ID NO: 151070 - protein, 9 aa, Homo Sapiens
IRCFGVYVG

SEQ ID NO: 151071 - protein, 9 aa, Homo Sapiens
AVPAAACPP

SEQ ID NO: 151072 - protein, 9 aa, Homo Sapiens
NSRADGGHC

SEQ ID NO: 151073 - protein, 9 aa, Homo Sapiens
RKPSVGVPH

SEQ ID NO: 151074 - protein, 9 aa, Homo Sapiens
QDRPSHPGG

SEQ ID NO: 151075 - protein, 9 aa, Homo Sapiens
MHRGLCKSR

SEQ ID NO: 151076 - protein, 9 aa, Homo Sapiens
LWTCVLTAF

SEQ ID NO: 151077 - protein, 9 aa, Homo Sapiens
ATSVDAKVV

SEQ ID NO: 151078 - protein, 9 aa, Homo Sapiens
RTACGAASP

SEQ ID NO: 151079 - protein, 9 aa, Homo Sapiens
KDHKLCTKS

SEQ ID NO: 151080 - protein, 9 aa, Homo Sapiens
LIIGQNGVL

SEQ ID NO: 151081 - protein, 9 aa, Homo Sapiens
LPPMHCPTA

SEQ ID NO: 151082 - protein, 9 aa, Homo Sapiens
TSTHKHTHK

SEQ ID NO: 151083 - protein, 9 aa, Homo Sapiens
ACWMAWLRH

SEQ ID NO: 151084 - protein, 9 aa, Homo Sapiens
QMGFCDWSA

SEQ ID NO: 151085 - protein, 9 aa, Homo Sapiens
GTPHVSVLH

SEQ ID NO: 151086 - protein, 9 aa, Homo Sapiens
RPLPSPPGA

SEQ ID NO: 151087 - protein, 9 aa, Homo Sapiens
PREHVFVYA

SEQ ID NO: 151088 - protein, 9 aa, Homo Sapiens
EQESITVIL

SEQ ID NO: 151089 - protein, 9 aa, Homo Sapiens
GSPRLCATT

SEQ ID NO: 151090 - protein, 9 aa, Homo Sapiens
PPARCARSS

SEQ ID NO: 151091 - protein, 9 aa, Homo Sapiens
QRLPKALRC

SEQ ID NO: 151092 - protein, 9 aa, Homo Sapiens
ESWRRTWRR

SEQ ID NO: 151093 - protein, 9 aa, Homo Sapiens
LPPCWRSWW

SEQ ID NO: 151094 - protein, 9 aa, Homo Sapiens
LAAASGPCH

SEQ ID NO: 151095 - protein, 9 aa, Homo Sapiens
SNQTQIPDY

SEQ ID NO: 151096 - protein, 9 aa, Homo Sapiens
AAGGMVEGG

SEQ ID NO: 151097 - protein, 9 aa, Homo Sapiens
HSWTSCYGK

SEQ ID NO: 151098 - protein, 9 aa, Homo Sapiens
PDHGRDQGR

SEQ ID NO: 151099 - protein, 9 aa, Homo Sapiens
YTPKQDTMT

SEQ ID NO: 151100 - protein, 9 aa, Homo Sapiens
VTHSTHSAW

SEQ ID NO: 151101 - protein, 9 aa, Homo Sapiens
AFTGRGHLV

SEQ ID NO: 151102 - protein, 9 aa, Homo Sapiens
LEHPCPEQF

SEQ ID NO: 151103 - protein, 9 aa, Homo Sapiens
LQSKLSSGA

SEQ ID NO: 151104 - protein, 9 aa, Homo Sapiens
PPRRSWWRV

SEQ ID NO: 151105 - protein, 9 aa, Homo Sapiens
WQLEAAASA

SEQ ID NO: 151106 - protein, 9 aa, Homo Sapiens
CVLPTVSGK

SEQ ID NO: 151107 - protein, 9 aa, Homo Sapiens
GRCIPPRTL

SEQ ID NO: 151108 - protein, 9 aa, Homo Sapiens
SSRQHCFSS

SEQ ID NO: 151109 - protein, 9 aa, Homo Sapiens
KMAHWPKEQ

SEQ ID NO: 151110 - protein, 9 aa, Homo Sapiens
GSEAGAGAG

SEQ ID NO: 151111 - protein, 9 aa, Homo Sapiens
RCNALIAEL

SEQ ID NO: 151112 - protein, 9 aa, Homo Sapiens
HRPPWHGLM

SEQ ID NO: 151113 - protein, 9 aa, Homo Sapiens
DVQGQLDVH

SEQ ID NO: 151114 - protein, 9 aa, Homo Sapiens
SRLRSRSSR

SEQ ID NO: 151115 - protein, 9 aa, Homo Sapiens
EPGYPHNIL

SEQ ID NO: 151116 - protein, 9 aa, Homo Sapiens
DLYPSLYNG

SEQ ID NO: 151117 - protein, 9 aa, Homo Sapiens
TVTTKNQNQ

SEQ ID NO: 151118 - protein, 9 aa, Homo Sapiens
HPCPEQFWE

SEQ ID NO: 151119 - protein, 9 aa, Homo Sapiens
EKKEEEDQG

SEQ ID NO: 151120 - protein, 9 aa, Homo Sapiens
TVAEASLRF

SEQ ID NO: 151121 - protein, 9 aa, Homo Sapiens
LPGQPMAAF

SEQ ID NO: 151122 - protein, 9 aa, Homo Sapiens
VFPPSSQTW

SEQ ID NO: 151123 - protein, 9 aa, Homo Sapiens
GLGGPGVPS

SEQ ID NO: 151124 - protein, 9 aa, Homo Sapiens
RTWGGPRDP

SEQ ID NO: 151125 - protein, 9 aa, Homo Sapiens
QEERSDSSS

SEQ ID NO: 151126 - protein, 9 aa, Homo Sapiens
PLHLKLTRK

SEQ ID NO: 151127 - protein, 9 aa, Homo Sapiens
SGPCPSITT

SEQ ID NO: 151128 - protein, 9 aa, Homo Sapiens
SSQCTQGRR

SEQ ID NO: 151129 - protein, 9 aa, Homo Sapiens
FLRRKMEAN

SEQ ID NO: 151130 - protein, 9 aa, Homo Sapiens
AKPPLWPPP

SEQ ID NO: 151131 - protein, 9 aa, Homo Sapiens
NVKNVAKPL

SEQ ID NO: 151132 - protein, 9 aa, Homo Sapiens
QRRQFLAKQ

SEQ ID NO: 151133 - protein, 9 aa, Homo Sapiens
NSNFTCIVA

SEQ ID NO: 151134 - protein, 9 aa, Homo Sapiens
IMILVMVVI

SEQ ID NO: 151135 - protein, 9 aa, Homo Sapiens
PAPAYRSVS

SEQ ID NO: 151136 - protein, 9 aa, Homo Sapiens
WAVPQVLQN

SEQ ID NO: 151137 - protein, 9 aa, Homo Sapiens
MHTVPLDAR

SEQ ID NO: 151138 - protein, 9 aa, Homo Sapiens
GTGTSGTRD

SEQ ID NO: 151139 - protein, 9 aa, Homo Sapiens
TRAGDASLQ

SEQ ID NO: 151140 - protein, 9 aa, Homo Sapiens
RGALSPTCV

SEQ ID NO: 151141 - protein, 9 aa, Homo Sapiens
RSRLAAASG

SEQ ID NO: 151142 - protein, 9 aa, Homo Sapiens
SSRRHSHSW

SEQ ID NO: 151143 - protein, 9 aa, Homo Sapiens
QGPSSRDRE

SEQ ID NO: 151144 - protein, 9 aa, Homo Sapiens
IQENDRVVM

SEQ ID NO: 151145 - protein, 9 aa, Homo Sapiens
MVSFCCSTV

SEQ ID NO: 151146 - protein, 9 aa, Homo Sapiens
SSILLCSRS

SEQ ID NO: 151147 - protein, 9 aa, Homo Sapiens
PWGVGQGQS

SEQ ID NO: 151148 - protein, 9 aa, Homo Sapiens
RQGVLGGLP

SEQ ID NO: 151149 - protein, 9 aa, Homo Sapiens
YHAYGSYLE

SEQ ID NO: 151150 - protein, 9 aa, Homo Sapiens
YVASEITMR

SEQ ID NO: 151151 - protein, 9 aa, Homo Sapiens
EKPALPGTG

SEQ ID NO: 151152 - protein, 9 aa, Homo Sapiens
KPQTLAVKH

SEQ ID NO: 151153 - protein, 9 aa, Homo Sapiens
DSLHSQTPP

SEQ ID NO: 151154 - protein, 9 aa, Homo Sapiens
RLWMANARR

SEQ ID NO: 151155 - protein, 9 aa, Homo Sapiens
ATRRARRAP

SEQ ID NO: 151156 - protein, 9 aa, Homo Sapiens
APKASSRQL

SEQ ID NO: 151157 - protein, 9 aa, Homo Sapiens
DPLLGVVPG

SEQ ID NO: 151158 - protein, 9 aa, Homo Sapiens
DYQWEDKKK

SEQ ID NO: 151159 - protein, 9 aa, Homo Sapiens
KAKNKVGHE

SEQ ID NO: 151160 - protein, 9 aa, Homo Sapiens
TASTCCGAW

SEQ ID NO: 151161 - protein, 9 aa, Homo Sapiens
RPLSLADTT

SEQ ID NO: 151162 - protein, 9 aa, Homo Sapiens
QIQSQSSTS

SEQ ID NO: 151163 - protein, 9 aa, Homo Sapiens
GLSGIPGEA

SEQ ID NO: 151164 - protein, 9 aa, Homo Sapiens
PPTGPLLCL

SEQ ID NO: 151165 - protein, 9 aa, Homo Sapiens
AVHVQGAAV

SEQ ID NO: 151166 - protein, 9 aa, Homo Sapiens
GVATAHAPL

SEQ ID NO: 151167 - protein, 9 aa, Homo Sapiens
TWLGAPPVL

SEQ ID NO: 151168 - protein, 9 aa, Homo Sapiens
PGQQRVLIN

SEQ ID NO: 151169 - protein, 9 aa, Homo Sapiens
EYYLRHLEG

SEQ ID NO: 151170 - protein, 9 aa, Homo Sapiens
GGHCRDDVK

SEQ ID NO: 151171 - protein, 9 aa, Homo Sapiens
RLWERELSV

SEQ ID NO: 151172 - protein, 9 aa, Homo Sapiens
PEGALGQTS

SEQ ID NO: 151173 - protein, 9 aa, Homo Sapiens
AHSQLINHQ

SEQ ID NO: 151174 - protein, 9 aa, Homo Sapiens
RHTHKHTHR

SEQ ID NO: 151175 - protein, 9 aa, Homo Sapiens
LILRMENGL

SEQ ID NO: 151176 - protein, 9 aa, Homo Sapiens
RTPTPVPPA

SEQ ID NO: 151177 - protein, 9 aa, Homo Sapiens
WTAATLRCP

SEQ ID NO: 151178 - protein, 9 aa, Homo Sapiens
MGYTTYDAH

SEQ ID NO: 151179 - protein, 9 aa, Homo Sapiens
SGSRCLRLS

SEQ ID NO: 151180 - protein, 9 aa, Homo Sapiens
GTSSGLEIT

SEQ ID NO: 151181 - protein, 9 aa, Homo Sapiens
RVGDVAVKI

SEQ ID NO: 151182 - protein, 9 aa, Homo Sapiens
YPSSQLLVQ

SEQ ID NO: 151183 - protein, 9 aa, Homo Sapiens
TQLPRHVLL

SEQ ID NO: 151184 - protein, 9 aa, Homo Sapiens
LPATTCKVP

SEQ ID NO: 151185 - protein, 9 aa, Homo Sapiens
SGPSSPQLQ

SEQ ID NO: 151186 - protein, 9 aa, Homo Sapiens
DTFHLRCTH

SEQ ID NO: 151187 - protein, 9 aa, Homo Sapiens
SKNPPQPMG

SEQ ID NO: 151188 - protein, 9 aa, Homo Sapiens
SFTGNKFTL

SEQ ID NO: 151189 - protein, 9 aa, Homo Sapiens
EVSGSRCLR

SEQ ID NO: 151190 - protein, 9 aa, Homo Sapiens
GEIPKDEHI

SEQ ID NO: 151191 - protein, 9 aa, Homo Sapiens
CHSLPRTWR

SEQ ID NO: 151192 - protein, 9 aa, Homo Sapiens
AAVAANSAT

SEQ ID NO: 151193 - protein, 9 aa, Homo Sapiens
SLFLSIHLI

SEQ ID NO: 151194 - protein, 9 aa, Homo Sapiens
PEPDYTSLP

SEQ ID NO: 151195 - protein, 9 aa, Homo Sapiens
KKLKEAKLH

SEQ ID NO: 151196 - protein, 9 aa, Homo Sapiens
PQPPQRPPL

SEQ ID NO: 151197 - protein, 9 aa, Homo Sapiens
LWPPPGSPG

SEQ ID NO: 151198 - protein, 9 aa, Homo Sapiens
FFFCLRGHP

SEQ ID NO: 151199 - protein, 9 aa, Homo Sapiens
QRTTSTLGS

SEQ ID NO: 151200 - protein, 9 aa, Homo Sapiens
EVTRLWSSS

SEQ ID NO: 151201 - protein, 9 aa, Homo Sapiens
GQEPAAALA

SEQ ID NO: 151202 - protein, 9 aa, Homo Sapiens
GLAPPPPAV

SEQ ID NO: 151203 - protein, 9 aa, Homo Sapiens
TSVDAKVVD

SEQ ID NO: 151204 - protein, 9 aa, Homo Sapiens
QRGRLLVLL

SEQ ID NO: 151205 - protein, 9 aa, Homo Sapiens
EIFWGLRSY

SEQ ID NO: 151206 - protein, 9 aa, Homo Sapiens
HALSLSPAA

SEQ ID NO: 151207 - protein, 9 aa, Homo Sapiens
RFKEQKQNS

SEQ ID NO: 151208 - protein, 9 aa, Homo Sapiens
LETLQRTPC

SEQ ID NO: 151209 - protein, 9 aa, Homo Sapiens
QLCVRFACH

SEQ ID NO: 151210 - protein, 9 aa, Homo Sapiens
IISNNGHSF

SEQ ID NO: 151211 - protein, 9 aa, Homo Sapiens
VNATAEDND

SEQ ID NO: 151212 - protein, 9 aa, Homo Sapiens
RWCCCRARS

SEQ ID NO: 151213 - protein, 9 aa, Homo Sapiens
YEEFDCLIN

SEQ ID NO: 151214 - protein, 9 aa, Homo Sapiens
LISVENFTP

SEQ ID NO: 151215 - protein, 9 aa, Homo Sapiens
TSYTEDFLM

SEQ ID NO: 151216 - protein, 9 aa, Homo Sapiens
REVGAQLKK

SEQ ID NO: 151217 - protein, 9 aa, Homo Sapiens
PPHPPLPSP

SEQ ID NO: 151218 - protein, 9 aa, Homo Sapiens
HKIPLPLWA

SEQ ID NO: 151219 - protein, 9 aa, Homo Sapiens
FEALNLSLE

SEQ ID NO: 151220 - protein, 9 aa, Homo Sapiens
KAQITQKIS

SEQ ID NO: 151221 - protein, 9 aa, Homo Sapiens
TQLTRVLEE

SEQ ID NO: 151222 - protein, 9 aa, Homo Sapiens
STPARSPTS

SEQ ID NO: 151223 - protein, 9 aa, Homo Sapiens
TSYILAVQN

SEQ ID NO: 151224 - protein, 9 aa, Homo Sapiens
AWNGFSNLV

SEQ ID NO: 151225 - protein, 9 aa, Homo Sapiens
ILLIFLVPA

SEQ ID NO: 151226 - protein, 9 aa, Homo Sapiens
ALLSFLHHH

SEQ ID NO: 151227 - protein, 9 aa, Homo Sapiens
QGQLDVHQL

SEQ ID NO: 151228 - protein, 9 aa, Homo Sapiens
KTTSQSQLS

SEQ ID NO: 151229 - protein, 9 aa, Homo Sapiens
EDGHCATVH

SEQ ID NO: 151230 - protein, 9 aa, Homo Sapiens
TIPNQKKRN

SEQ ID NO: 151231 - protein, 9 aa, Homo Sapiens
AASEPPQCH

SEQ ID NO: 151232 - protein, 9 aa, Homo Sapiens
PPSPGKPTF

SEQ ID NO: 151233 - protein, 9 aa, Homo Sapiens
TTPPIGPSC

SEQ ID NO: 151234 - protein, 9 aa, Homo Sapiens
IISSEKITP

SEQ ID NO: 151235 - protein, 9 aa, Homo Sapiens
LMSALIDGS

SEQ ID NO: 151236 - protein, 9 aa, Homo Sapiens
LKLTRKPKG

SEQ ID NO: 151237 - protein, 9 aa, Homo Sapiens
EFGDIIPDY

SEQ ID NO: 151238 - protein, 9 aa, Homo Sapiens
RRPCLPLQP

SEQ ID NO: 151239 - protein, 9 aa, Homo Sapiens
IYYNANWER

SEQ ID NO: 151240 - protein, 9 aa, Homo Sapiens
IIDFGLAKA

SEQ ID NO: 151241 - protein, 9 aa, Homo Sapiens
TQRPQPQEW

SEQ ID NO: 151242 - protein, 9 aa, Homo Sapiens
PHRRLGPTR

SEQ ID NO: 151243 - protein, 9 aa, Homo Sapiens
ASAPGAPSY

SEQ ID NO: 151244 - protein, 9 aa, Homo Sapiens
GSPLAFEAL

SEQ ID NO: 151245 - protein, 9 aa, Homo Sapiens
TGRHKAFSA

SEQ ID NO: 151246 - protein, 9 aa, Homo Sapiens
WRSGGSGWS

SEQ ID NO: 151247 - protein, 9 aa, Homo Sapiens
SQLLVQAYQ

SEQ ID NO: 151248 - protein, 9 aa, Homo Sapiens
YLKEQCASN

SEQ ID NO: 151249 - protein, 9 aa, Homo Sapiens
HADDAPAAR

SEQ ID NO: 151250 - protein, 9 aa, Homo Sapiens
CQCVGMDWT

SEQ ID NO: 151251 - protein, 9 aa, Homo Sapiens
NRFTRNLPS

SEQ ID NO: 151252 - protein, 9 aa, Homo Sapiens
RRGSSQGCR

SEQ ID NO: 151253 - protein, 9 aa, Homo Sapiens
RSSNKPLRG

SEQ ID NO: 151254 - protein, 9 aa, Homo Sapiens
ADDVLVVGT

SEQ ID NO: 151255 - protein, 9 aa, Homo Sapiens
SSCHLITQD

SEQ ID NO: 151256 - protein, 9 aa, Homo Sapiens
WRWGWGQLL

SEQ ID NO: 151257 - protein, 9 aa, Homo Sapiens
CLQTSNNNM

SEQ ID NO: 151258 - protein, 9 aa, Homo Sapiens
SRPPSLHPS

SEQ ID NO: 151259 - protein, 9 aa, Homo Sapiens
KNYSTLQIS

SEQ ID NO: 151260 - protein, 9 aa, Homo Sapiens
TPQDSRQVL

SEQ ID NO: 151261 - protein, 9 aa, Homo Sapiens
EKLEKLTVR

SEQ ID NO: 151262 - protein, 9 aa, Homo Sapiens
SCVNVAGVS

SEQ ID NO: 151263 - protein, 9 aa, Homo Sapiens
PCRWFCPTL

SEQ ID NO: 151264 - protein, 9 aa, Homo Sapiens
NYTHALDGL

SEQ ID NO: 151265 - protein, 9 aa, Homo Sapiens
YCQLTAHLQ

SEQ ID NO: 151266 - protein, 9 aa, Homo Sapiens
PQSERAGSS

SEQ ID NO: 151267 - protein, 9 aa, Homo Sapiens
SCMCTADYS

SEQ ID NO: 151268 - protein, 9 aa, Homo Sapiens
LLSLPWIPK

SEQ ID NO: 151269 - protein, 9 aa, Homo Sapiens
RRARCLDPS

SEQ ID NO: 151270 - protein, 9 aa, Homo Sapiens
VDAHVVLEV

SEQ ID NO: 151271 - protein, 9 aa, Homo Sapiens
PSCCYPVCC

SEQ ID NO: 151272 - protein, 9 aa, Homo Sapiens
IQPAPQCRR

SEQ ID NO: 151273 - protein, 9 aa, Homo Sapiens
EREQEQQRH

SEQ ID NO: 151274 - protein, 9 aa, Homo Sapiens
VYRECGRGF

SEQ ID NO: 151275 - protein, 9 aa, Homo Sapiens
QKAPCGRQC

SEQ ID NO: 151276 - protein, 9 aa, Homo Sapiens
NEDELPSVQ

SEQ ID NO: 151277 - protein, 9 aa, Homo Sapiens
PTWCRTGAS

SEQ ID NO: 151278 - protein, 9 aa, Homo Sapiens
TTSAGTVSD

SEQ ID NO: 151279 - protein, 9 aa, Homo Sapiens
AVRLMLKED

SEQ ID NO: 151280 - protein, 9 aa, Homo Sapiens
RTLSSSASV

SEQ ID NO: 151281 - protein, 9 aa, Homo Sapiens
ATEMDMWST

SEQ ID NO: 151282 - protein, 9 aa, Homo Sapiens
WLRGPSAGL

SEQ ID NO: 151283 - protein, 9 aa, Homo Sapiens
SSLKSIFLL

SEQ ID NO: 151284 - protein, 9 aa, Homo Sapiens
RCRPAVASR

SEQ ID NO: 151285 - protein, 9 aa, Homo Sapiens
GRAFFISHS

SEQ ID NO: 151286 - protein, 9 aa, Homo Sapiens
GKAFRISSC

SEQ ID NO: 151287 - protein, 9 aa, Homo Sapiens
LSHSQSLSH

SEQ ID NO: 151288 - protein, 9 aa, Homo Sapiens
CVWLRCCGG

SEQ ID NO: 151289 - protein, 9 aa, Homo Sapiens
GQAVVDFDP

SEQ ID NO: 151290 - protein, 9 aa, Homo Sapiens
GLHGPPGPK

SEQ ID NO: 151291 - protein, 9 aa, Homo Sapiens
RRFRLQGRV

SEQ ID NO: 151292 - protein, 9 aa, Homo Sapiens
LQLPDLLFI

SEQ ID NO: 151293 - protein, 9 aa, Homo Sapiens
QLAQLREDN

SEQ ID NO: 151294 - protein, 9 aa, Homo Sapiens
VTENCGHPK

SEQ ID NO: 151295 - protein, 9 aa, Homo Sapiens
TSTGGIFEP

SEQ ID NO: 151296 - protein, 9 aa, Homo Sapiens
VRTEIVCWF

SEQ ID NO: 151297 - protein, 9 aa, Homo Sapiens
SQYSSGLRP

SEQ ID NO: 151298 - protein, 9 aa, Homo Sapiens
RPLGKDGRV

SEQ ID NO: 151299 - protein, 9 aa, Homo Sapiens
EPENYSKKA

SEQ ID NO: 151300 - protein, 9 aa, Homo Sapiens
ALGASCTAS

SEQ ID NO: 151301 - protein, 9 aa, Homo Sapiens
IGQNGVLST

SEQ ID NO: 151302 - protein, 9 aa, Homo Sapiens
PATLPCRRH

SEQ ID NO: 151303 - protein, 9 aa, Homo Sapiens
FLTFYIISS

SEQ ID NO: 151304 - protein, 9 aa, Homo Sapiens
CHGLLTGQS

SEQ ID NO: 151305 - protein, 9 aa, Homo Sapiens
PPPPGADVT

SEQ ID NO: 151306 - protein, 9 aa, Homo Sapiens
KPVIGKDED

SEQ ID NO: 151307 - protein, 9 aa, Homo Sapiens
LSINEEELR

SEQ ID NO: 151308 - protein, 9 aa, Homo Sapiens
PNHPSQQST

SEQ ID NO: 151309 - protein, 9 aa, Homo Sapiens
PPMHCPTAT

SEQ ID NO: 151310 - protein, 9 aa, Homo Sapiens
PLQDSLPAP

SEQ ID NO: 151311 - protein, 9 aa, Homo Sapiens
SRIVAPGHA

SEQ ID NO: 151312 - protein, 9 aa, Homo Sapiens
PEDDTATAK

SEQ ID NO: 151313 - protein, 9 aa, Homo Sapiens
KDMQPEDSG

SEQ ID NO: 151314 - protein, 9 aa, Homo Sapiens
PPQPLPVAP

SEQ ID NO: 151315 - protein, 9 aa, Homo Sapiens
CSSSTYVNP

SEQ ID NO: 151316 - protein, 9 aa, Homo Sapiens
RSCHGDLCP

SEQ ID NO: 151317 - protein, 9 aa, Homo Sapiens
VPSCRRERP

SEQ ID NO: 151318 - protein, 9 aa, Homo Sapiens
YKAHIHLNG

SEQ ID NO: 151319 - protein, 9 aa, Homo Sapiens
LRLQLQLRP

SEQ ID NO: 151320 - protein, 9 aa, Homo Sapiens
AFCSMKCKD

SEQ ID NO: 151321 - protein, 9 aa, Homo Sapiens
HPREQRGPD

SEQ ID NO: 151322 - protein, 9 aa, Homo Sapiens
HAKRELAQL

SEQ ID NO: 151323 - protein, 9 aa, Homo Sapiens
TVPEGAAAP

SEQ ID NO: 151324 - protein, 9 aa, Homo Sapiens
PQPSHSTPR

SEQ ID NO: 151325 - protein, 9 aa, Homo Sapiens
IDLEANLRR

SEQ ID NO: 151326 - protein, 9 aa, Homo Sapiens
GLGQECPES

SEQ ID NO: 151327 - protein, 9 aa, Homo Sapiens
YNGHTLPMP

SEQ ID NO: 151328 - protein, 9 aa, Homo Sapiens
DGSSLSDYN

SEQ ID NO: 151329 - protein, 9 aa, Homo Sapiens
VKHMHQLLM

SEQ ID NO: 151330 - protein, 9 aa, Homo Sapiens
SAPPTRIAL

SEQ ID NO: 151331 - protein, 9 aa, Homo Sapiens
VRAASKEKC

SEQ ID NO: 151332 - protein, 9 aa, Homo Sapiens
PAPSRPPTT

SEQ ID NO: 151333 - protein, 9 aa, Homo Sapiens
FISRANEKT

SEQ ID NO: 151334 - protein, 9 aa, Homo Sapiens
AVLGAEIWN

SEQ ID NO: 151335 - protein, 9 aa, Homo Sapiens
RVGGSMLMP

SEQ ID NO: 151336 - protein, 9 aa, Homo Sapiens
HLRARAEPM

SEQ ID NO: 151337 - protein, 9 aa, Homo Sapiens
KMVDVGGRG

SEQ ID NO: 151338 - protein, 9 aa, Homo Sapiens
PDPDVDDSA

SEQ ID NO: 151339 - protein, 9 aa, Homo Sapiens
PVPGDAPSH

SEQ ID NO: 151340 - protein, 9 aa, Homo Sapiens
FLELADPLV

SEQ ID NO: 151341 - protein, 9 aa, Homo Sapiens
EAAHRGAGP

SEQ ID NO: 151342 - protein, 9 aa, Homo Sapiens
KIDHILESL

SEQ ID NO: 151343 - protein, 9 aa, Homo Sapiens
QACYLLYHK

SEQ ID NO: 151344 - protein, 9 aa, Homo Sapiens
PTATAASAR

SEQ ID NO: 151345 - protein, 9 aa, Homo Sapiens
DEGRTTTCK

SEQ ID NO: 151346 - protein, 9 aa, Homo Sapiens
VERDFEMEY

SEQ ID NO: 151347 - protein, 9 aa, Homo Sapiens
LREKKFGLP

SEQ ID NO: 151348 - protein, 9 aa, Homo Sapiens
QELQKSGHR

SEQ ID NO: 151349 - protein, 9 aa, Homo Sapiens
DHKRETECV

SEQ ID NO: 151350 - protein, 9 aa, Homo Sapiens
CPSPSTAAW

SEQ ID NO: 151351 - protein, 9 aa, Homo Sapiens
YSEDSTPAF

SEQ ID NO: 151352 - protein, 9 aa, Homo Sapiens
DGGHCRDDV

SEQ ID NO: 151353 - protein, 9 aa, Homo Sapiens
LRPEFSQSN

SEQ ID NO: 151354 - protein, 9 aa, Homo Sapiens
GSHHTPSPG

SEQ ID NO: 151355 - protein, 9 aa, Homo Sapiens
FRVKFLLWL

SEQ ID NO: 151356 - protein, 9 aa, Homo Sapiens
TTRPPTPST

SEQ ID NO: 151357 - protein, 9 aa, Homo Sapiens
APSALVLLA

SEQ ID NO: 151358 - protein, 9 aa, Homo Sapiens
IRIRVQSIE

SEQ ID NO: 151359 - protein, 9 aa, Homo Sapiens
ISNNGHSFN

SEQ ID NO: 151360 - protein, 9 aa, Homo Sapiens
SSCDYAIDL

SEQ ID NO: 151361 - protein, 9 aa, Homo Sapiens
HFSSLSPPP

SEQ ID NO: 151362 - protein, 9 aa, Homo Sapiens
CALPDDLVE

SEQ ID NO: 151363 - protein, 9 aa, Homo Sapiens
SPNHRPMQQ

SEQ ID NO: 151364 - protein, 9 aa, Homo Sapiens
PPAAAALDE

SEQ ID NO: 151365 - protein, 9 aa, Homo Sapiens
MRRMGRLAA

SEQ ID NO: 151366 - protein, 9 aa, Homo Sapiens
FLEKMEDFQ

SEQ ID NO: 151367 - protein, 9 aa, Homo Sapiens
TAAWIPASR

SEQ ID NO: 151368 - protein, 9 aa, Homo Sapiens
GEAGLIFLQ

SEQ ID NO: 151369 - protein, 9 aa, Homo Sapiens
GEWRQGGSP

SEQ ID NO: 151370 - protein, 9 aa, Homo Sapiens
APEENAGNE

SEQ ID NO: 151371 - protein, 9 aa, Homo Sapiens
SPRVFPVLW

SEQ ID NO: 151372 - protein, 9 aa, Homo Sapiens
PGEADLADG

SEQ ID NO: 151373 - protein, 9 aa, Homo Sapiens
SSFLIFFIP

SEQ ID NO: 151374 - protein, 9 aa, Homo Sapiens
PQSRVFASC

SEQ ID NO: 151375 - protein, 9 aa, Homo Sapiens
AKSGWVTTK

SEQ ID NO: 151376 - protein, 9 aa, Homo Sapiens
QRAEIAELT

SEQ ID NO: 151377 - protein, 9 aa, Homo Sapiens
GHTGDPHCR

SEQ ID NO: 151378 - protein, 9 aa, Homo Sapiens
MTRFPQCNK

SEQ ID NO: 151379 - protein, 9 aa, Homo Sapiens
RYNQNRLSF

SEQ ID NO: 151380 - protein, 9 aa, Homo Sapiens
YVLRSFDYE

SEQ ID NO: 151381 - protein, 9 aa, Homo Sapiens
AAVGQDCYM

SEQ ID NO: 151382 - protein, 9 aa, Homo Sapiens
NLVINKPYG

SEQ ID NO: 151383 - protein, 9 aa, Homo Sapiens
HYQVTERGC

SEQ ID NO: 151384 - protein, 9 aa, Homo Sapiens
RIGGNFRGP

SEQ ID NO: 151385 - protein, 9 aa, Homo Sapiens
TRACTPASG

SEQ ID NO: 151386 - protein, 9 aa, Homo Sapiens
IAKMAVVSK

SEQ ID NO: 151387 - protein, 9 aa, Homo Sapiens
VQIFVIDNG

SEQ ID NO: 151388 - protein, 9 aa, Homo Sapiens
EFLSLHSLD

SEQ ID NO: 151389 - protein, 9 aa, Homo Sapiens
EGGPPRPTV

SEQ ID NO: 151390 - protein, 9 aa, Homo Sapiens
WRGCHKSII

SEQ ID NO: 151391 - protein, 9 aa, Homo Sapiens
VFICQYFTV

SEQ ID NO: 151392 - protein, 9 aa, Homo Sapiens
LEVVVVHEL

SEQ ID NO: 151393 - protein, 9 aa, Homo Sapiens
YLDENYEHI

SEQ ID NO: 151394 - protein, 9 aa, Homo Sapiens
YQTFKALKC

SEQ ID NO: 151395 - protein, 9 aa, Homo Sapiens
APKPQGTAF

SEQ ID NO: 151396 - protein, 9 aa, Homo Sapiens
RRRTRTQQR

SEQ ID NO: 151397 - protein, 9 aa, Homo Sapiens
PPPAARPPG

SEQ ID NO: 151398 - protein, 9 aa, Homo Sapiens
SHQPKDRCG

SEQ ID NO: 151399 - protein, 9 aa, Homo Sapiens
PGGEGGRGG

SEQ ID NO: 151400 - protein, 9 aa, Homo Sapiens
SSMPAAMRW

SEQ ID NO: 151401 - protein, 9 aa, Homo Sapiens
GCRPAAFPP

SEQ ID NO: 151402 - protein, 9 aa, Homo Sapiens
EAWRKLKAE

SEQ ID NO: 151403 - protein, 9 aa, Homo Sapiens
FEEGQALIS

SEQ ID NO: 151404 - protein, 9 aa, Homo Sapiens
QLPQWRTWL

SEQ ID NO: 151405 - protein, 9 aa, Homo Sapiens
LGAEIWNGM

SEQ ID NO: 151406 - protein, 9 aa, Homo Sapiens
TLRPALAAP

SEQ ID NO: 151407 - protein, 9 aa, Homo Sapiens
VDLDAHNHN

SEQ ID NO: 151408 - protein, 9 aa, Homo Sapiens
TAVASSTTV

SEQ ID NO: 151409 - protein, 9 aa, Homo Sapiens
AAAEADQLL

SEQ ID NO: 151410 - protein, 9 aa, Homo Sapiens
SQTHTRPTR

SEQ ID NO: 151411 - protein, 9 aa, Homo Sapiens
HRNINTGVK

SEQ ID NO: 151412 - protein, 9 aa, Homo Sapiens
PWPEVWKEV

SEQ ID NO: 151413 - protein, 9 aa, Homo Sapiens
AGDQGGGQT

SEQ ID NO: 151414 - protein, 9 aa, Homo Sapiens
RTLSLRGMV

SEQ ID NO: 151415 - protein, 9 aa, Homo Sapiens
LELADPLVQ

SEQ ID NO: 151416 - protein, 9 aa, Homo Sapiens
NSRTLFPSL

SEQ ID NO: 151417 - protein, 9 aa, Homo Sapiens
VALNSCTMV

SEQ ID NO: 151418 - protein, 9 aa, Homo Sapiens
PLRQTRFSS

SEQ ID NO: 151419 - protein, 9 aa, Homo Sapiens
IYKCAMCDS

SEQ ID NO: 151420 - protein, 9 aa, Homo Sapiens
CAIVGNSGN

SEQ ID NO: 151421 - protein, 9 aa, Homo Sapiens
NHISALGLL

SEQ ID NO: 151422 - protein, 9 aa, Homo Sapiens
VTQCNTQLT

SEQ ID NO: 151423 - protein, 9 aa, Homo Sapiens
AYHGVFVNI

SEQ ID NO: 151424 - protein, 9 aa, Homo Sapiens
AKQGQWGPP

SEQ ID NO: 151425 - protein, 9 aa, Homo Sapiens
LVRREFRNA

SEQ ID NO: 151426 - protein, 9 aa, Homo Sapiens
PPASKNRVH

SEQ ID NO: 151427 - protein, 9 aa, Homo Sapiens
KPRLLVSRP

SEQ ID NO: 151428 - protein, 9 aa, Homo Sapiens
GLYCFPSSD

SEQ ID NO: 151429 - protein, 9 aa, Homo Sapiens
EVEEEQQPP

SEQ ID NO: 151430 - protein, 9 aa, Homo Sapiens
AREALVAEL

SEQ ID NO: 151431 - protein, 9 aa, Homo Sapiens
EHSSSSTSS

SEQ ID NO: 151432 - protein, 9 aa, Homo Sapiens
WSPTHSAQS

SEQ ID NO: 151433 - protein, 9 aa, Homo Sapiens
PDEVHLDEQ

SEQ ID NO: 151434 - protein, 9 aa, Homo Sapiens
CFRNMDKRA

SEQ ID NO: 151435 - protein, 9 aa, Homo Sapiens
RPRRTRSAW

SEQ ID NO: 151436 - protein, 9 aa, Homo Sapiens
QLRRQASSG

SEQ ID NO: 151437 - protein, 9 aa, Homo Sapiens
VKITPVIDQ

SEQ ID NO: 151438 - protein, 9 aa, Homo Sapiens
KGLAETPET

SEQ ID NO: 151439 - protein, 9 aa, Homo Sapiens
RRCCAARCP

SEQ ID NO: 151440 - protein, 9 aa, Homo Sapiens
PDLYACGEA

SEQ ID NO: 151441 - protein, 9 aa, Homo Sapiens
DATGILKSL

SEQ ID NO: 151442 - protein, 9 aa, Homo Sapiens
AHRVQLLGA

SEQ ID NO: 151443 - protein, 9 aa, Homo Sapiens
HMKMHTVGG

SEQ ID NO: 151444 - protein, 9 aa, Homo Sapiens
WAPAPGSPR

SEQ ID NO: 151445 - protein, 9 aa, Homo Sapiens
EPEHTGKCC

SEQ ID NO: 151446 - protein, 9 aa, Homo Sapiens
FKMEKRLCK

SEQ ID NO: 151447 - protein, 9 aa, Homo Sapiens
GGLQGSPLA

SEQ ID NO: 151448 - protein, 9 aa, Homo Sapiens
LQGPLASTD

SEQ ID NO: 151449 - protein, 9 aa, Homo Sapiens
VEPGYPHNI

SEQ ID NO: 151450 - protein, 9 aa, Homo Sapiens
GQPRLTEPD

SEQ ID NO: 151451 - protein, 9 aa, Homo Sapiens
EMASQLGRL

SEQ ID NO: 151452 - protein, 9 aa, Homo Sapiens
LCLKTPPKP

SEQ ID NO: 151453 - protein, 9 aa, Homo Sapiens
PAPQKISTW

SEQ ID NO: 151454 - protein, 9 aa, Homo Sapiens
LTSNNTTGT

SEQ ID NO: 151455 - protein, 9 aa, Homo Sapiens
KEGVPSGPR

SEQ ID NO: 151456 - protein, 9 aa, Homo Sapiens
DEKGNFMEL

SEQ ID NO: 151457 - protein, 9 aa, Homo Sapiens
AWSRRPSLC

SEQ ID NO: 151458 - protein, 9 aa, Homo Sapiens
HRVCPQASL

SEQ ID NO: 151459 - protein, 9 aa, Homo Sapiens
DIEATQSPA

SEQ ID NO: 151460 - protein, 9 aa, Homo Sapiens
RLPTGLYCF

SEQ ID NO: 151461 - protein, 9 aa, Homo Sapiens
TMNDSKHKL

SEQ ID NO: 151462 - protein, 9 aa, Homo Sapiens
QPQSEPLRG

SEQ ID NO: 151463 - protein, 9 aa, Homo Sapiens
ASMTLPAPT

SEQ ID NO: 151464 - protein, 9 aa, Homo Sapiens
SWIRTEMAS

SEQ ID NO: 151465 - protein, 9 aa, Homo Sapiens
SLRAPMDED

SEQ ID NO: 151466 - protein, 9 aa, Homo Sapiens
VMSPGEKPD

SEQ ID NO: 151467 - protein, 9 aa, Homo Sapiens
PTSSPTARA

SEQ ID NO: 151468 - protein, 9 aa, Homo Sapiens
ETRDSFQMN

SEQ ID NO: 151469 - protein, 9 aa, Homo Sapiens
VSSDARNIW

SEQ ID NO: 151470 - protein, 9 aa, Homo Sapiens
FSSLDTSLC

SEQ ID NO: 151471 - protein, 9 aa, Homo Sapiens
LYVKEWSLL

SEQ ID NO: 151472 - protein, 9 aa, Homo Sapiens
LGVSSLEYI

SEQ ID NO: 151473 - protein, 9 aa, Homo Sapiens
RMGQGWSYS

SEQ ID NO: 151474 - protein, 9 aa, Homo Sapiens
VATAHAPLH

SEQ ID NO: 151475 - protein, 9 aa, Homo Sapiens
SSKAPPPAF

SEQ ID NO: 151476 - protein, 9 aa, Homo Sapiens
HLQPPPHSA

SEQ ID NO: 151477 - protein, 9 aa, Homo Sapiens
RLVVLVGPM

SEQ ID NO: 151478 - protein, 9 aa, Homo Sapiens
PSPHSDGGD

SEQ ID NO: 151479 - protein, 9 aa, Homo Sapiens
PSTARSRGA

SEQ ID NO: 151480 - protein, 9 aa, Homo Sapiens
GWPLCMLRL

SEQ ID NO: 151481 - protein, 9 aa, Homo Sapiens
LAGVLGPEA

SEQ ID NO: 151482 - protein, 9 aa, Homo Sapiens
LERNPTNVK

SEQ ID NO: 151483 - protein, 9 aa, Homo Sapiens
RSAPRSCGT

SEQ ID NO: 151484 - protein, 9 aa, Homo Sapiens
SHTPILFHI

SEQ ID NO: 151485 - protein, 9 aa, Homo Sapiens
KKRSQMPSR

SEQ ID NO: 151486 - protein, 9 aa, Homo Sapiens
APVPKKAPR

SEQ ID NO: 151487 - protein, 9 aa, Homo Sapiens
TGAETTTAS

SEQ ID NO: 151488 - protein, 9 aa, Homo Sapiens
DVLCRVSRY

SEQ ID NO: 151489 - protein, 9 aa, Homo Sapiens
FLKLASGTQ

SEQ ID NO: 151490 - protein, 9 aa, Homo Sapiens
PVITSSQYS

SEQ ID NO: 151491 - protein, 9 aa, Homo Sapiens
YRAFLRTPW

SEQ ID NO: 151492 - protein, 9 aa, Homo Sapiens
RMHPKVPVP

SEQ ID NO: 151493 - protein, 9 aa, Homo Sapiens
ELTGSGRRA

SEQ ID NO: 151494 - protein, 9 aa, Homo Sapiens
FLPPLQPQA

SEQ ID NO: 151495 - protein, 9 aa, Homo Sapiens
ESNVYMVTQ

SEQ ID NO: 151496 - protein, 9 aa, Homo Sapiens
VLIFNIHVI

SEQ ID NO: 151497 - protein, 9 aa, Homo Sapiens
KHTEAKKAY

SEQ ID NO: 151498 - protein, 9 aa, Homo Sapiens
AFEEGQALI

SEQ ID NO: 151499 - protein, 9 aa, Homo Sapiens
INHSSSEAN

SEQ ID NO: 151500 - protein, 9 aa, Homo Sapiens
QCNTQLTRV

SEQ ID NO: 151501 - protein, 9 aa, Homo Sapiens
VKMEGAHLG

SEQ ID NO: 151502 - protein, 9 aa, Homo Sapiens
CSLVDFQIE

SEQ ID NO: 151503 - protein, 9 aa, Homo Sapiens
RLWSWCGTS

SEQ ID NO: 151504 - protein, 9 aa, Homo Sapiens
KYFESLDNH

SEQ ID NO: 151505 - protein, 9 aa, Homo Sapiens
AISAHCNIH

SEQ ID NO: 151506 - protein, 9 aa, Homo Sapiens
RESTPLPAD

SEQ ID NO: 151507 - protein, 9 aa, Homo Sapiens
PFGVRIDYM

SEQ ID NO: 151508 - protein, 9 aa, Homo Sapiens
GVRRQLSVR

SEQ ID NO: 151509 - protein, 9 aa, Homo Sapiens
LPIIAKMAV

SEQ ID NO: 151510 - protein, 9 aa, Homo Sapiens
PGLSIGDED

SEQ ID NO: 151511 - protein, 9 aa, Homo Sapiens
RSAPGQALD

SEQ ID NO: 151512 - protein, 9 aa, Homo Sapiens
FFVLVNLEV

SEQ ID NO: 151513 - protein, 9 aa, Homo Sapiens
VASSPSATN

SEQ ID NO: 151514 - protein, 9 aa, Homo Sapiens
AGCIAATEM

SEQ ID NO: 151515 - protein, 9 aa, Homo Sapiens
VAGDVEAIP

SEQ ID NO: 151516 - protein, 9 aa, Homo Sapiens
CRKECVLLD

SEQ ID NO: 151517 - protein, 9 aa, Homo Sapiens
LLFLLAVVW

SEQ ID NO: 151518 - protein, 9 aa, Homo Sapiens
RTAALLTDG

SEQ ID NO: 151519 - protein, 9 aa, Homo Sapiens
WPPPRWMSS

SEQ ID NO: 151520 - protein, 9 aa, Homo Sapiens
RNRVNELKV

SEQ ID NO: 151521 - protein, 9 aa, Homo Sapiens
PSFRGSCRR

SEQ ID NO: 151522 - protein, 9 aa, Homo Sapiens
EVPGLYGEG

SEQ ID NO: 151523 - protein, 9 aa, Homo Sapiens
KAGGPWRMQ

SEQ ID NO: 151524 - protein, 9 aa, Homo Sapiens
RSQMPSRCS

SEQ ID NO: 151525 - protein, 9 aa, Homo Sapiens
SQEAKQNVE

SEQ ID NO: 151526 - protein, 9 aa, Homo Sapiens
LSGEEGRPP

SEQ ID NO: 151527 - protein, 9 aa, Homo Sapiens
GDPHCRHPL

SEQ ID NO: 151528 - protein, 9 aa, Homo Sapiens
MSYHAVASG

SEQ ID NO: 151529 - protein, 9 aa, Homo Sapiens
MDLRMERPR

SEQ ID NO: 151530 - protein, 9 aa, Homo Sapiens
AASSPAGAA

SEQ ID NO: 151531 - protein, 9 aa, Homo Sapiens
LKPGALTPL

SEQ ID NO: 151532 - protein, 9 aa, Homo Sapiens
FFRFGILQS

SEQ ID NO: 151533 - protein, 9 aa, Homo Sapiens
WRRTGASTP

SEQ ID NO: 151534 - protein, 9 aa, Homo Sapiens
KVRRAPSLK

SEQ ID NO: 151535 - protein, 9 aa, Homo Sapiens
TCIVAIGRL

SEQ ID NO: 151536 - protein, 9 aa, Homo Sapiens
KSDSDTESS

SEQ ID NO: 151537 - protein, 9 aa, Homo Sapiens
PEVEAWGEI

SEQ ID NO: 151538 - protein, 9 aa, Homo Sapiens
LLLVVVPLR

SEQ ID NO: 151539 - protein, 9 aa, Homo Sapiens
SQKLGRWCA

SEQ ID NO: 151540 - protein, 9 aa, Homo Sapiens
VPEPPTPPV

SEQ ID NO: 151541 - protein, 9 aa, Homo Sapiens
CQAEQDALR

SEQ ID NO: 151542 - protein, 9 aa, Homo Sapiens
DPVLFTPAT

SEQ ID NO: 151543 - protein, 9 aa, Homo Sapiens
SESHYCPEL

SEQ ID NO: 151544 - protein, 9 aa, Homo Sapiens
QTFKALKCH

SEQ ID NO: 151545 - protein, 9 aa, Homo Sapiens
EQTPALLRN

SEQ ID NO: 151546 - protein, 9 aa, Homo Sapiens
LRVNNKSLA

SEQ ID NO: 151547 - protein, 9 aa, Homo Sapiens
RLDPEYQST

SEQ ID NO: 151548 - protein, 9 aa, Homo Sapiens
ALGQTSKLD

SEQ ID NO: 151549 - protein, 9 aa, Homo Sapiens
DPSTSWSAS

SEQ ID NO: 151550 - protein, 9 aa, Homo Sapiens
RRHQPVVVL

SEQ ID NO: 151551 - protein, 9 aa, Homo Sapiens
LLPLSDLPS

SEQ ID NO: 151552 - protein, 9 aa, Homo Sapiens
TSTEKKHSH

SEQ ID NO: 151553 - protein, 9 aa, Homo Sapiens
GGPSGVAWL

SEQ ID NO: 151554 - protein, 9 aa, Homo Sapiens
KYIEYRRAE

SEQ ID NO: 151555 - protein, 9 aa, Homo Sapiens
APSACLHPN

SEQ ID NO: 151556 - protein, 9 aa, Homo Sapiens
HQRNVKHMH

SEQ ID NO: 151557 - protein, 9 aa, Homo Sapiens
ALRKTLPIL

SEQ ID NO: 151558 - protein, 9 aa, Homo Sapiens
VPLLLVVVL

SEQ ID NO: 151559 - protein, 9 aa, Homo Sapiens
PRPFDLGLM

SEQ ID NO: 151560 - protein, 9 aa, Homo Sapiens
GITFVPHWT

SEQ ID NO: 151561 - protein, 9 aa, Homo Sapiens
PVPFLDCLS

SEQ ID NO: 151562 - protein, 9 aa, Homo Sapiens
VQWVGDDGE

SEQ ID NO: 151563 - protein, 9 aa, Homo Sapiens
PLRCGCTAR

SEQ ID NO: 151564 - protein, 9 aa, Homo Sapiens
LTSWSMATD

SEQ ID NO: 151565 - protein, 9 aa, Homo Sapiens
IHHGVKEIG

SEQ ID NO: 151566 - protein, 9 aa, Homo Sapiens
HLGRTQAAD

SEQ ID NO: 151567 - protein, 9 aa, Homo Sapiens
TPASGPSPA

SEQ ID NO: 151568 - protein, 9 aa, Homo Sapiens
GTLLHTPGL

SEQ ID NO: 151569 - protein, 9 aa, Homo Sapiens
PDNIFGGKA

SEQ ID NO: 151570 - protein, 9 aa, Homo Sapiens
EKFYRKNVR

SEQ ID NO: 151571 - protein, 9 aa, Homo Sapiens
GWLSTTTMR

SEQ ID NO: 151572 - protein, 9 aa, Homo Sapiens
IQEHVKKNY

SEQ ID NO: 151573 - protein, 9 aa, Homo Sapiens
KNGEAAREC

SEQ ID NO: 151574 - protein, 9 aa, Homo Sapiens
RHPVRVPDQ

SEQ ID NO: 151575 - protein, 9 aa, Homo Sapiens
SIILLHFKI

SEQ ID NO: 151576 - protein, 9 aa, Homo Sapiens
LLRMHTVPL

SEQ ID NO: 151577 - protein, 9 aa, Homo Sapiens
GTTKESHPT

SEQ ID NO: 151578 - protein, 9 aa, Homo Sapiens
DRMGQGWSY

SEQ ID NO: 151579 - protein, 9 aa, Homo Sapiens
FRLDPEYQS

SEQ ID NO: 151580 - protein, 9 aa, Homo Sapiens
SSGGSDLSG

SEQ ID NO: 151581 - protein, 9 aa, Homo Sapiens
GVPLVMGYT

SEQ ID NO: 151582 - protein, 9 aa, Homo Sapiens
SLEEPELLL

SEQ ID NO: 151583 - protein, 9 aa, Homo Sapiens
GTHYSQDQF

SEQ ID NO: 151584 - protein, 9 aa, Homo Sapiens
WVHSLPVKK

SEQ ID NO: 151585 - protein, 9 aa, Homo Sapiens
WKRTSHPCR

SEQ ID NO: 151586 - protein, 9 aa, Homo Sapiens
LFESFFHYQ

SEQ ID NO: 151587 - protein, 9 aa, Homo Sapiens
ALISDLIAV

SEQ ID NO: 151588 - protein, 9 aa, Homo Sapiens
AFCAENLEK

SEQ ID NO: 151589 - protein, 9 aa, Homo Sapiens
CDQWITCKS

SEQ ID NO: 151590 - protein, 9 aa, Homo Sapiens
RGSQSALGT

SEQ ID NO: 151591 - protein, 9 aa, Homo Sapiens
SPTSAPTAA

SEQ ID NO: 151592 - protein, 9 aa, Homo Sapiens
TASRASQPS

SEQ ID NO: 151593 - protein, 9 aa, Homo Sapiens
DSDGLAPQH

SEQ ID NO: 151594 - protein, 9 aa, Homo Sapiens
NPNGDDDQL

SEQ ID NO: 151595 - protein, 9 aa, Homo Sapiens
TLPKVEVMN

SEQ ID NO: 151596 - protein, 9 aa, Homo Sapiens
SCRRGAAFG

SEQ ID NO: 151597 - protein, 9 aa, Homo Sapiens
ALGSACIAI

SEQ ID NO: 151598 - protein, 9 aa, Homo Sapiens
VRHGTGPVG

SEQ ID NO: 151599 - protein, 9 aa, Homo Sapiens
QTSGETTHI

SEQ ID NO: 151600 - protein, 9 aa, Homo Sapiens
ILFKMSNSL

SEQ ID NO: 151601 - protein, 9 aa, Homo Sapiens
EEGNGMKDV

SEQ ID NO: 151602 - protein, 9 aa, Homo Sapiens
VGGVSTSWG

SEQ ID NO: 151603 - protein, 9 aa, Homo Sapiens
LRPCHLLPL

SEQ ID NO: 151604 - protein, 9 aa, Homo Sapiens
TPWTLNPQG

SEQ ID NO: 151605 - protein, 9 aa, Homo Sapiens
EVRLMKNGE

SEQ ID NO: 151606 - protein, 9 aa, Homo Sapiens
EKEKACLEE

SEQ ID NO: 151607 - protein, 9 aa, Homo Sapiens
GCSYRVLPS

SEQ ID NO: 151608 - protein, 9 aa, Homo Sapiens
PASQSGQEP

SEQ ID NO: 151609 - protein, 9 aa, Homo Sapiens
EITNIELTD

SEQ ID NO: 151610 - protein, 9 aa, Homo Sapiens
LQLQLRPQP

SEQ ID NO: 151611 - protein, 9 aa, Homo Sapiens
DVIAFTKQV

SEQ ID NO: 151612 - protein, 9 aa, Homo Sapiens
EISADFHVD

SEQ ID NO: 151613 - protein, 9 aa, Homo Sapiens
LIMDGVKHI

SEQ ID NO: 151614 - protein, 9 aa, Homo Sapiens
GVLKFRDVA

SEQ ID NO: 151615 - protein, 9 aa, Homo Sapiens
DDIPGIEGL

SEQ ID NO: 151616 - protein, 9 aa, Homo Sapiens
GVGQQELLH

SEQ ID NO: 151617 - protein, 9 aa, Homo Sapiens
KEDSVSSIT

SEQ ID NO: 151618 - protein, 9 aa, Homo Sapiens
FPEVISFID

SEQ ID NO: 151619 - protein, 9 aa, Homo Sapiens
QKLQGSKVA

SEQ ID NO: 151620 - protein, 9 aa, Homo Sapiens
IPEGASWSV

SEQ ID NO: 151621 - protein, 9 aa, Homo Sapiens
CDFMRGHFH

SEQ ID NO: 151622 - protein, 9 aa, Homo Sapiens
TDPGVAGDV

SEQ ID NO: 151623 - protein, 9 aa, Homo Sapiens
HQAAFQKLK

SEQ ID NO: 151624 - protein, 9 aa, Homo Sapiens
KKYCQLTAH

SEQ ID NO: 151625 - protein, 9 aa, Homo Sapiens
STSLALSPD

SEQ ID NO: 151626 - protein, 9 aa, Homo Sapiens
HLDEQCERL

SEQ ID NO: 151627 - protein, 9 aa, Homo Sapiens
KSVCDRFNA

SEQ ID NO: 151628 - protein, 9 aa, Homo Sapiens
HFSKSIRPS

SEQ ID NO: 151629 - protein, 9 aa, Homo Sapiens
CQAQGAAVD

SEQ ID NO: 151630 - protein, 9 aa, Homo Sapiens
QLWWCGGGQ

SEQ ID NO: 151631 - protein, 9 aa, Homo Sapiens
INVDREQFR

SEQ ID NO: 151632 - protein, 9 aa, Homo Sapiens
NDALNTTEN

SEQ ID NO: 151633 - protein, 9 aa, Homo Sapiens
LVENIRVAS

SEQ ID NO: 151634 - protein, 9 aa, Homo Sapiens
HRHTHKHTH

SEQ ID NO: 151635 - protein, 9 aa, Homo Sapiens
LWRGCHKSI

SEQ ID NO: 151636 - protein, 9 aa, Homo Sapiens
NVKNVTKPL

SEQ ID NO: 151637 - protein, 9 aa, Homo Sapiens
PPIVPVKKI

SEQ ID NO: 151638 - protein, 9 aa, Homo Sapiens
CLYEEKQKQ

SEQ ID NO: 151639 - protein, 9 aa, Homo Sapiens
SVPGGPRWC

SEQ ID NO: 151640 - protein, 9 aa, Homo Sapiens
TVRYDPYTQ

SEQ ID NO: 151641 - protein, 9 aa, Homo Sapiens
AKVVDPSTS

SEQ ID NO: 151642 - protein, 9 aa, Homo Sapiens
IHRGKDQEE

SEQ ID NO: 151643 - protein, 9 aa, Homo Sapiens
SPSNPGQLV

SEQ ID NO: 151644 - protein, 9 aa, Homo Sapiens
EEKRNAGNT

SEQ ID NO: 151645 - protein, 9 aa, Homo Sapiens
SSNKPLRGD

SEQ ID NO: 151646 - protein, 9 aa, Homo Sapiens
GHFGSASLD

SEQ ID NO: 151647 - protein, 9 aa, Homo Sapiens
SILSALRVS

SEQ ID NO: 151648 - protein, 9 aa, Homo Sapiens
ECLIRQQQE

SEQ ID NO: 151649 - protein, 9 aa, Homo Sapiens
SCYGKKIWT

SEQ ID NO: 151650 - protein, 9 aa, Homo Sapiens
RSRWRHPLP

SEQ ID NO: 151651 - protein, 9 aa, Homo Sapiens
LPMAVIPFL

SEQ ID NO: 151652 - protein, 9 aa, Homo Sapiens
KMLLACRAP

SEQ ID NO: 151653 - protein, 9 aa, Homo Sapiens
NNGHSFNVD

SEQ ID NO: 151654 - protein, 9 aa, Homo Sapiens
NTQLTRVLE

SEQ ID NO: 151655 - protein, 9 aa, Homo Sapiens
AKGMSYLHP

SEQ ID NO: 151656 - protein, 9 aa, Homo Sapiens
GYPTQQPPS

SEQ ID NO: 151657 - protein, 9 aa, Homo Sapiens
ILTYYEGEV

SEQ ID NO: 151658 - protein, 9 aa, Homo Sapiens
LHPLPLGCI

SEQ ID NO: 151659 - protein, 9 aa, Homo Sapiens
HLWNLMEKP

SEQ ID NO: 151660 - protein, 9 aa, Homo Sapiens
MTMRNATQQ

SEQ ID NO: 151661 - protein, 9 aa, Homo Sapiens
ALVAVLTHV

SEQ ID NO: 151662 - protein, 9 aa, Homo Sapiens
LPAPGLHPG

SEQ ID NO: 151663 - protein, 9 aa, Homo Sapiens
KRCARINES

SEQ ID NO: 151664 - protein, 9 aa, Homo Sapiens
MSALIDGSQ

SEQ ID NO: 151665 - protein, 9 aa, Homo Sapiens
EKEQRCGAK

SEQ ID NO: 151666 - protein, 9 aa, Homo Sapiens
EGRRPLPPS

SEQ ID NO: 151667 - protein, 9 aa, Homo Sapiens
PWIPKRNAR

SEQ ID NO: 151668 - protein, 9 aa, Homo Sapiens
SCGGGIQSW

SEQ ID NO: 151669 - protein, 9 aa, Homo Sapiens
GSQCSLTRA

SEQ ID NO: 151670 - protein, 9 aa, Homo Sapiens
ASRSTAPSP

SEQ ID NO: 151671 - protein, 9 aa, Homo Sapiens
DALLAHHAA

SEQ ID NO: 151672 - protein, 9 aa, Homo Sapiens
KDFQKQRME

SEQ ID NO: 151673 - protein, 9 aa, Homo Sapiens
SPRRAQKTR

SEQ ID NO: 151674 - protein, 9 aa, Homo Sapiens
HILIATGGV

SEQ ID NO: 151675 - protein, 9 aa, Homo Sapiens
RAGDENDNA

SEQ ID NO: 151676 - protein, 9 aa, Homo Sapiens
HDPPQSSFV

SEQ ID NO: 151677 - protein, 9 aa, Homo Sapiens
AAHSVTVKL

SEQ ID NO: 151678 - protein, 9 aa, Homo Sapiens
ETRPERLLA

SEQ ID NO: 151679 - protein, 9 aa, Homo Sapiens
YYEGEVNAG

SEQ ID NO: 151680 - protein, 9 aa, Homo Sapiens
CLRTSCGAA

SEQ ID NO: 151681 - protein, 9 aa, Homo Sapiens
FPPLLVFFL

SEQ ID NO: 151682 - protein, 9 aa, Homo Sapiens
PCLPLQPRG

SEQ ID NO: 151683 - protein, 9 aa, Homo Sapiens
GSLSITSPN

SEQ ID NO: 151684 - protein, 9 aa, Homo Sapiens
ICVEVNGKD

SEQ ID NO: 151685 - protein, 9 aa, Homo Sapiens
CLCCCCYGG

SEQ ID NO: 151686 - protein, 9 aa, Homo Sapiens
SSPPTGSWQ

SEQ ID NO: 151687 - protein, 9 aa, Homo Sapiens
KKRGKSQGG

SEQ ID NO: 151688 - protein, 9 aa, Homo Sapiens
DSPKELPPE

SEQ ID NO: 151689 - protein, 9 aa, Homo Sapiens
TKTGAAWSR

SEQ ID NO: 151690 - protein, 9 aa, Homo Sapiens
YQATFRLPR

SEQ ID NO: 151691 - protein, 9 aa, Homo Sapiens
MENVDYPYL

SEQ ID NO: 151692 - protein, 9 aa, Homo Sapiens
PSTVPLPTT

SEQ ID NO: 151693 - protein, 9 aa, Homo Sapiens
TQVTSKLDR

SEQ ID NO: 151694 - protein, 9 aa, Homo Sapiens
GWRGARVPE

SEQ ID NO: 151695 - protein, 9 aa, Homo Sapiens
VLHPRLQPA

SEQ ID NO: 151696 - protein, 9 aa, Homo Sapiens
DDGSKDEWR

SEQ ID NO: 151697 - protein, 9 aa, Homo Sapiens
PGAKAGVHQ

SEQ ID NO: 151698 - protein, 9 aa, Homo Sapiens
EEAWRKLKA

SEQ ID NO: 151699 - protein, 9 aa, Homo Sapiens
KETWREEKN

SEQ ID NO: 151700 - protein, 9 aa, Homo Sapiens
FAYTLAVSF

SEQ ID NO: 151701 - protein, 9 aa, Homo Sapiens
CQAPSVFSV

SEQ ID NO: 151702 - protein, 9 aa, Homo Sapiens
HRSPSAPDD

SEQ ID NO: 151703 - protein, 9 aa, Homo Sapiens
STPRLLAPF

SEQ ID NO: 151704 - protein, 9 aa, Homo Sapiens
YFIDTTTIV

SEQ ID NO: 151705 - protein, 9 aa, Homo Sapiens
THSAQSPVP

SEQ ID NO: 151706 - protein, 9 aa, Homo Sapiens
LLGGGCFAA

SEQ ID NO: 151707 - protein, 9 aa, Homo Sapiens
HTMPTSAAH

SEQ ID NO: 151708 - protein, 9 aa, Homo Sapiens
SEAPDSPNG

SEQ ID NO: 151709 - protein, 9 aa, Homo Sapiens
HLLLHPCLD

SEQ ID NO: 151710 - protein, 9 aa, Homo Sapiens
IVGRTKDVE

SEQ ID NO: 151711 - protein, 9 aa, Homo Sapiens
YFHTGASPV

SEQ ID NO: 151712 - protein, 9 aa, Homo Sapiens
LQSLTPNAR

SEQ ID NO: 151713 - protein, 9 aa, Homo Sapiens
TKIVYRHVK

SEQ ID NO: 151714 - protein, 9 aa, Homo Sapiens
LRQGGTRLT

SEQ ID NO: 151715 - protein, 9 aa, Homo Sapiens
GKFPSLSIL

SEQ ID NO: 151716 - protein, 9 aa, Homo Sapiens
PAACWMAWL

SEQ ID NO: 151717 - protein, 9 aa, Homo Sapiens
WPTVHGLLR

SEQ ID NO: 151718 - protein, 9 aa, Homo Sapiens
LNDYGPPSL

SEQ ID NO: 151719 - protein, 9 aa, Homo Sapiens
RAAPPSLRA

SEQ ID NO: 151720 - protein, 9 aa, Homo Sapiens
LPRATGCWG

SEQ ID NO: 151721 - protein, 9 aa, Homo Sapiens
LSGKTEDVV

SEQ ID NO: 151722 - protein, 9 aa, Homo Sapiens
SLCLKTPPK

SEQ ID NO: 151723 - protein, 9 aa, Homo Sapiens
HPRAHRVQL

SEQ ID NO: 151724 - protein, 9 aa, Homo Sapiens
PRPPQPLPV

SEQ ID NO: 151725 - protein, 9 aa, Homo Sapiens
SYVHPHALL

SEQ ID NO: 151726 - protein, 9 aa, Homo Sapiens
RLQRLGDPG

SEQ ID NO: 151727 - protein, 9 aa, Homo Sapiens
HRRTTSAGT

SEQ ID NO: 151728 - protein, 9 aa, Homo Sapiens
STTRRDSWP

SEQ ID NO: 151729 - protein, 9 aa, Homo Sapiens
NGMSDSSLS

SEQ ID NO: 151730 - protein, 9 aa, Homo Sapiens
AHCMPYFRK

SEQ ID NO: 151731 - protein, 9 aa, Homo Sapiens
GPVGWQLVG

SEQ ID NO: 151732 - protein, 9 aa, Homo Sapiens
CRICMHNFS

SEQ ID NO: 151733 - protein, 9 aa, Homo Sapiens
GGPRDPTDP

SEQ ID NO: 151734 - protein, 9 aa, Homo Sapiens
CRMVCGPHG

SEQ ID NO: 151735 - protein, 9 aa, Homo Sapiens
PEVISFIDE

SEQ ID NO: 151736 - protein, 9 aa, Homo Sapiens
SQDPSPAGM

SEQ ID NO: 151737 - protein, 9 aa, Homo Sapiens
ALLPGPREV

SEQ ID NO: 151738 - protein, 9 aa, Homo Sapiens
TVRPYTVRA

SEQ ID NO: 151739 - protein, 9 aa, Homo Sapiens
DERGPLKHL

SEQ ID NO: 151740 - protein, 9 aa, Homo Sapiens
RSGFGFGGG

SEQ ID NO: 151741 - protein, 9 aa, Homo Sapiens
VGIKSPHEG

SEQ ID NO: 151742 - protein, 9 aa, Homo Sapiens
NAWNGFSNL

SEQ ID NO: 151743 - protein, 9 aa, Homo Sapiens
SSSTGVAVG

SEQ ID NO: 151744 - protein, 9 aa, Homo Sapiens
MIGGIYTSA

SEQ ID NO: 151745 - protein, 9 aa, Homo Sapiens
KEPGPFQSC

SEQ ID NO: 151746 - protein, 9 aa, Homo Sapiens
LWLLGSRMA

SEQ ID NO: 151747 - protein, 9 aa, Homo Sapiens
PRAVHDDPK

SEQ ID NO: 151748 - protein, 9 aa, Homo Sapiens
NPLKTVVKK

SEQ ID NO: 151749 - protein, 9 aa, Homo Sapiens
ILSQDTCLR

SEQ ID NO: 151750 - protein, 9 aa, Homo Sapiens
RVRRRFPLG

SEQ ID NO: 151751 - protein, 9 aa, Homo Sapiens
HHPHHLPRP

SEQ ID NO: 151752 - protein, 9 aa, Homo Sapiens
SFNLSYDKI

SEQ ID NO: 151753 - protein, 9 aa, Homo Sapiens
DINGLEVVG

SEQ ID NO: 151754 - protein, 9 aa, Homo Sapiens
VASRSTAPS

SEQ ID NO: 151755 - protein, 9 aa, Homo Sapiens
RLQLQLRPQ

SEQ ID NO: 151756 - protein, 9 aa, Homo Sapiens
RWPGPPSYE

SEQ ID NO: 151757 - protein, 9 aa, Homo Sapiens
SEDPHLLKE

SEQ ID NO: 151758 - protein, 9 aa, Homo Sapiens
TNTGDAIYE

SEQ ID NO: 151759 - protein, 9 aa, Homo Sapiens
RRTRTQQRT

SEQ ID NO: 151760 - protein, 9 aa, Homo Sapiens
SLCTCTVWT

SEQ ID NO: 151761 - protein, 9 aa, Homo Sapiens
PMDKPGLGP

SEQ ID NO: 151762 - protein, 9 aa, Homo Sapiens
ALHGPPPRR

SEQ ID NO: 151763 - protein, 9 aa, Homo Sapiens
MGVLKFRDV

SEQ ID NO: 151764 - protein, 9 aa, Homo Sapiens
VLPGEADLA

SEQ ID NO: 151765 - protein, 9 aa, Homo Sapiens
NKKVRRAPS

SEQ ID NO: 151766 - protein, 9 aa, Homo Sapiens
PAAMRWARR

SEQ ID NO: 151767 - protein, 9 aa, Homo Sapiens
GPLKHLYSL

SEQ ID NO: 151768 - protein, 9 aa, Homo Sapiens
PSPLDASPA

SEQ ID NO: 151769 - protein, 9 aa, Homo Sapiens
EQHPREQRG

SEQ ID NO: 151770 - protein, 9 aa, Homo Sapiens
LPCDWRRAC

SEQ ID NO: 151771 - protein, 9 aa, Homo Sapiens
EALRLQRSM

SEQ ID NO: 151772 - protein, 9 aa, Homo Sapiens
QPRRNFGQQ

SEQ ID NO: 151773 - protein, 9 aa, Homo Sapiens
LNPRFDENV

SEQ ID NO: 151774 - protein, 9 aa, Homo Sapiens
GVGWRGALG

SEQ ID NO: 151775 - protein, 9 aa, Homo Sapiens
CSRLVLGRA

SEQ ID NO: 151776 - protein, 9 aa, Homo Sapiens
QAKTEKRLL

SEQ ID NO: 151777 - protein, 9 aa, Homo Sapiens
PLLRGQSEI

SEQ ID NO: 151778 - protein, 9 aa, Homo Sapiens
PVHEGPSPL

SEQ ID NO: 151779 - protein, 9 aa, Homo Sapiens
TSLPQGCWG

SEQ ID NO: 151780 - protein, 9 aa, Homo Sapiens
AARPSATNP

SEQ ID NO: 151781 - protein, 9 aa, Homo Sapiens
LVDFQIEKK

SEQ ID NO: 151782 - protein, 9 aa, Homo Sapiens
SCPGRNAWW

SEQ ID NO: 151783 - protein, 9 aa, Homo Sapiens
LLLLLFLLA

SEQ ID NO: 151784 - protein, 9 aa, Homo Sapiens
TEECGKSGA

SEQ ID NO: 151785 - protein, 9 aa, Homo Sapiens
KFPWHIKKH

SEQ ID NO: 151786 - protein, 9 aa, Homo Sapiens
MGFCDWSAR

SEQ ID NO: 151787 - protein, 9 aa, Homo Sapiens
QEAKFLQQQ

SEQ ID NO: 151788 - protein, 9 aa, Homo Sapiens
RNALKSLLW

SEQ ID NO: 151789 - protein, 9 aa, Homo Sapiens
DHQPGDPSS

SEQ ID NO: 151790 - protein, 9 aa, Homo Sapiens
MSSPFRMAS

SEQ ID NO: 151791 - protein, 9 aa, Homo Sapiens
CKVPRLHSV

SEQ ID NO: 151792 - protein, 9 aa, Homo Sapiens
WKDYLPTVG

SEQ ID NO: 151793 - protein, 9 aa, Homo Sapiens
TLSKHQAVD

SEQ ID NO: 151794 - protein, 9 aa, Homo Sapiens
TECRSCCER

SEQ ID NO: 151795 - protein, 9 aa, Homo Sapiens
PASAWTSMH

SEQ ID NO: 151796 - protein, 9 aa, Homo Sapiens
DMREVGAQL

SEQ ID NO: 151797 - protein, 9 aa, Homo Sapiens
KREELCLSK

SEQ ID NO: 151798 - protein, 9 aa, Homo Sapiens
QPPPRSPGV

SEQ ID NO: 151799 - protein, 9 aa, Homo Sapiens
IWKNYKKVH

SEQ ID NO: 151800 - protein, 9 aa, Homo Sapiens
CLSTILINP

SEQ ID NO: 151801 - protein, 9 aa, Homo Sapiens
LLNTDHHPC

SEQ ID NO: 151802 - protein, 9 aa, Homo Sapiens
EKGIDGPPG

SEQ ID NO: 151803 - protein, 9 aa, Homo Sapiens
LHVPKVTAA

SEQ ID NO: 151804 - protein, 9 aa, Homo Sapiens
NCGHPKDAN

SEQ ID NO: 151805 - protein, 9 aa, Homo Sapiens
LNAKNLSEV

SEQ ID NO: 151806 - protein, 9 aa, Homo Sapiens
APSRPATSR

SEQ ID NO: 151807 - protein, 9 aa, Homo Sapiens
GCVRSFALE

SEQ ID NO: 151808 - protein, 9 aa, Homo Sapiens
ELWQLLQGL

SEQ ID NO: 151809 - protein, 9 aa, Homo Sapiens
RGHLVGVKR

SEQ ID NO: 151810 - protein, 9 aa, Homo Sapiens
LHFKILKFQ

SEQ ID NO: 151811 - protein, 9 aa, Homo Sapiens
KTRSQEQDV

SEQ ID NO: 151812 - protein, 9 aa, Homo Sapiens
YVKINLFFK

SEQ ID NO: 151813 - protein, 9 aa, Homo Sapiens
GHPSAFNNL

SEQ ID NO: 151814 - protein, 9 aa, Homo Sapiens
VAASSLGSS

SEQ ID NO: 151815 - protein, 9 aa, Homo Sapiens
LENQPLPMG

SEQ ID NO: 151816 - protein, 9 aa, Homo Sapiens
GGYFIDTTT

SEQ ID NO: 151817 - protein, 9 aa, Homo Sapiens
CLEEPRKGL

SEQ ID NO: 151818 - protein, 9 aa, Homo Sapiens
TASYANLLT

SEQ ID NO: 151819 - protein, 9 aa, Homo Sapiens
LLPPMGSLT

SEQ ID NO: 151820 - protein, 9 aa, Homo Sapiens
ICMHNFSRS

SEQ ID NO: 151821 - protein, 9 aa, Homo Sapiens
TVRVMEVFL

SEQ ID NO: 151822 - protein, 9 aa, Homo Sapiens
YFEAMSRGE

SEQ ID NO: 151823 - protein, 9 aa, Homo Sapiens
CAMCDSLHS

SEQ ID NO: 151824 - protein, 9 aa, Homo Sapiens
ASRSVTDKI

SEQ ID NO: 151825 - protein, 9 aa, Homo Sapiens
PPAFQVHPD

SEQ ID NO: 151826 - protein, 9 aa, Homo Sapiens
CAWDFNIDK

SEQ ID NO: 151827 - protein, 9 aa, Homo Sapiens
VLNEHKKFI

SEQ ID NO: 151828 - protein, 9 aa, Homo Sapiens
CVVHMLVMV

SEQ ID NO: 151829 - protein, 9 aa, Homo Sapiens
FLDVRTAPL

SEQ ID NO: 151830 - protein, 9 aa, Homo Sapiens
EQRIQRGME

SEQ ID NO: 151831 - protein, 9 aa, Homo Sapiens
MDLIKRYQE

SEQ ID NO: 151832 - protein, 9 aa, Homo Sapiens
PAVTPFQTL

SEQ ID NO: 151833 - protein, 9 aa, Homo Sapiens
EGDSPKELP

SEQ ID NO: 151834 - protein, 9 aa, Homo Sapiens
HVLLITVTA

SEQ ID NO: 151835 - protein, 9 aa, Homo Sapiens
GILNGQLST

SEQ ID NO: 151836 - protein, 9 aa, Homo Sapiens
KLSSWRSPC

SEQ ID NO: 151837 - protein, 9 aa, Homo Sapiens
CGSTSAGLR

SEQ ID NO: 151838 - protein, 9 aa, Homo Sapiens
RASSAQVRA

SEQ ID NO: 151839 - protein, 9 aa, Homo Sapiens
SEDSTPAFA

SEQ ID NO: 151840 - protein, 9 aa, Homo Sapiens
QESCLIRLH

SEQ ID NO: 151841 - protein, 9 aa, Homo Sapiens
PAPSAGRTS

SEQ ID NO: 151842 - protein, 9 aa, Homo Sapiens
QGATERSCR

SEQ ID NO: 151843 - protein, 9 aa, Homo Sapiens
VVYRSLGYP

SEQ ID NO: 151844 - protein, 9 aa, Homo Sapiens
RPERLLAPL

SEQ ID NO: 151845 - protein, 9 aa, Homo Sapiens
SSQFVSKGN

SEQ ID NO: 151846 - protein, 9 aa, Homo Sapiens
RNINTGVKP

SEQ ID NO: 151847 - protein, 9 aa, Homo Sapiens
ELADPLVQG

SEQ ID NO: 151848 - protein, 9 aa, Homo Sapiens
NCFGDYHVT

SEQ ID NO: 151849 - protein, 9 aa, Homo Sapiens
RPQSERAGS

SEQ ID NO: 151850 - protein, 9 aa, Homo Sapiens
QKEGLSPRR

SEQ ID NO: 151851 - protein, 9 aa, Homo Sapiens
EVPRCAMAP

SEQ ID NO: 151852 - protein, 9 aa, Homo Sapiens
NVVWSSSIS

SEQ ID NO: 151853 - protein, 9 aa, Homo Sapiens
ARPSATNPT

SEQ ID NO: 151854 - protein, 9 aa, Homo Sapiens
DEDQRRGLP

SEQ ID NO: 151855 - protein, 9 aa, Homo Sapiens
RLRHHFYWQ

SEQ ID NO: 151856 - protein, 9 aa, Homo Sapiens
TGCRALEET

SEQ ID NO: 151857 - protein, 9 aa, Homo Sapiens
CMGLKSWIS

SEQ ID NO: 151858 - protein, 9 aa, Homo Sapiens
YTRERLGAV

SEQ ID NO: 151859 - protein, 9 aa, Homo Sapiens
TMSSAQIVS

SEQ ID NO: 151860 - protein, 9 aa, Homo Sapiens
APGPCLAQA

SEQ ID NO: 151861 - protein, 9 aa, Homo Sapiens
VKVLRWIIE

SEQ ID NO: 151862 - protein, 9 aa, Homo Sapiens
VMYAVGMGK

SEQ ID NO: 151863 - protein, 9 aa, Homo Sapiens
RDRMVKHQC

SEQ ID NO: 151864 - protein, 9 aa, Homo Sapiens
PADTSAQSV

SEQ ID NO: 151865 - protein, 9 aa, Homo Sapiens
TTSTGGIFE

SEQ ID NO: 151866 - protein, 9 aa, Homo Sapiens
RHVLLGPLQ

SEQ ID NO: 151867 - protein, 9 aa, Homo Sapiens
IVAIGRLQP

SEQ ID NO: 151868 - protein, 9 aa, Homo Sapiens
DLSNDAVHV

SEQ ID NO: 151869 - protein, 9 aa, Homo Sapiens
EEVPQEVIS

SEQ ID NO: 151870 - protein, 9 aa, Homo Sapiens
AFAAQRVPP

SEQ ID NO: 151871 - protein, 9 aa, Homo Sapiens
CDYAIDLYP

SEQ ID NO: 151872 - protein, 9 aa, Homo Sapiens
HANRQTSDS

SEQ ID NO: 151873 - protein, 9 aa, Homo Sapiens
GECCGRRLP

SEQ ID NO: 151874 - protein, 9 aa, Homo Sapiens
VDLFESFFH

SEQ ID NO: 151875 - protein, 9 aa, Homo Sapiens
EALVQCHLG

SEQ ID NO: 151876 - protein, 9 aa, Homo Sapiens
PPPLSVGTS

SEQ ID NO: 151877 - protein, 9 aa, Homo Sapiens
LEEPELLLE

SEQ ID NO: 151878 - protein, 9 aa, Homo Sapiens
IAATEMDMW

SEQ ID NO: 151879 - protein, 9 aa, Homo Sapiens
PPVPLGPWN

SEQ ID NO: 151880 - protein, 9 aa, Homo Sapiens
CPARPGQQR

SEQ ID NO: 151881 - protein, 9 aa, Homo Sapiens
GQALISDLI

SEQ ID NO: 151882 - protein, 9 aa, Homo Sapiens
KRLEEQHTQ

SEQ ID NO: 151883 - protein, 9 aa, Homo Sapiens
MTGLPRKSV

SEQ ID NO: 151884 - protein, 9 aa, Homo Sapiens
FRTESPPAQ

SEQ ID NO: 151885 - protein, 9 aa, Homo Sapiens
GTPTAGPGE

SEQ ID NO: 151886 - protein, 9 aa, Homo Sapiens
LVHGFLLPG

SEQ ID NO: 151887 - protein, 9 aa, Homo Sapiens
KASSPGHPL

SEQ ID NO: 151888 - protein, 9 aa, Homo Sapiens
TRERLGAVY

SEQ ID NO: 151889 - protein, 9 aa, Homo Sapiens
GASSSPPGA

SEQ ID NO: 151890 - protein, 9 aa, Homo Sapiens
EIGGSQVKG

SEQ ID NO: 151891 - protein, 9 aa, Homo Sapiens
VAAILGVTT

SEQ ID NO: 151892 - protein, 9 aa, Homo Sapiens
CDGEVEEEI

SEQ ID NO: 151893 - protein, 9 aa, Homo Sapiens
TYQTFKALK

SEQ ID NO: 151894 - protein, 9 aa, Homo Sapiens
RSSTPKSKR

SEQ ID NO: 151895 - protein, 9 aa, Homo Sapiens
AYGSYLENA

SEQ ID NO: 151896 - protein, 9 aa, Homo Sapiens
KAPRRPLTR

SEQ ID NO: 151897 - protein, 9 aa, Homo Sapiens
RAFFISHSL

SEQ ID NO: 151898 - protein, 9 aa, Homo Sapiens
EGEKQQEED

SEQ ID NO: 151899 - protein, 9 aa, Homo Sapiens
PATSLCLKT

SEQ ID NO: 151900 - protein, 9 aa, Homo Sapiens
NLPCPFSTV

SEQ ID NO: 151901 - protein, 9 aa, Homo Sapiens
EGVPAPAYR

SEQ ID NO: 151902 - protein, 9 aa, Homo Sapiens
TYFEFETVL

SEQ ID NO: 151903 - protein, 9 aa, Homo Sapiens
HRHTQAYTQ

SEQ ID NO: 151904 - protein, 9 aa, Homo Sapiens
SPSATNSEV

SEQ ID NO: 151905 - protein, 9 aa, Homo Sapiens
WRGCGTGTS

SEQ ID NO: 151906 - protein, 9 aa, Homo Sapiens
LHKTVWRLV

SEQ ID NO: 151907 - protein, 9 aa, Homo Sapiens
QHQKIHRDA

SEQ ID NO: 151908 - protein, 9 aa, Homo Sapiens
HRRLGPTRK

SEQ ID NO: 151909 - protein, 9 aa, Homo Sapiens
LGDCILKLN

SEQ ID NO: 151910 - protein, 9 aa, Homo Sapiens
SSCWAAPVI

SEQ ID NO: 151911 - protein, 9 aa, Homo Sapiens
SPDSAGSRG

SEQ ID NO: 151912 - protein, 9 aa, Homo Sapiens
DMQPEDSGS

SEQ ID NO: 151913 - protein, 9 aa, Homo Sapiens
VCCRAQTVA

SEQ ID NO: 151914 - protein, 9 aa, Homo Sapiens
AQHLKSQGP

SEQ ID NO: 151915 - protein, 9 aa, Homo Sapiens
TVQNNWQVT

SEQ ID NO: 151916 - protein, 9 aa, Homo Sapiens
GVFSGRTPL

SEQ ID NO: 151917 - protein, 9 aa, Homo Sapiens
LPGMGPHVP

SEQ ID NO: 151918 - protein, 9 aa, Homo Sapiens
PLVTADIQL

SEQ ID NO: 151919 - protein, 9 aa, Homo Sapiens
HSPFLQKLQ

SEQ ID NO: 151920 - protein, 9 aa, Homo Sapiens
IIESYEDNS

SEQ ID NO: 151921 - protein, 9 aa, Homo Sapiens
HLVPLFIWT

SEQ ID NO: 151922 - protein, 9 aa, Homo Sapiens
CHAAALALD

SEQ ID NO: 151923 - protein, 9 aa, Homo Sapiens
SLEGPIEAY

SEQ ID NO: 151924 - protein, 9 aa, Homo Sapiens
HNILRDWMG

SEQ ID NO: 151925 - protein, 9 aa, Homo Sapiens
LRPHSYVPP

SEQ ID NO: 151926 - protein, 9 aa, Homo Sapiens
IYRRHRGAL

SEQ ID NO: 151927 - protein, 9 aa, Homo Sapiens
VEVEVTIVD

SEQ ID NO: 151928 - protein, 9 aa, Homo Sapiens
PSPAGMGSS

SEQ ID NO: 151929 - protein, 9 aa, Homo Sapiens
TTEIPDTQA

SEQ ID NO: 151930 - protein, 9 aa, Homo Sapiens
LFPQDKFYD

SEQ ID NO: 151931 - protein, 9 aa, Homo Sapiens
CNIHLPSSN

SEQ ID NO: 151932 - protein, 9 aa, Homo Sapiens
REQQDTYEF

SEQ ID NO: 151933 - protein, 9 aa, Homo Sapiens
YLVMEYTSG

SEQ ID NO: 151934 - protein, 9 aa, Homo Sapiens
CVRDLGLQL

SEQ ID NO: 151935 - protein, 9 aa, Homo Sapiens
EEERLKHTM

SEQ ID NO: 151936 - protein, 9 aa, Homo Sapiens
SVCDMHPLL

SEQ ID NO: 151937 - protein, 9 aa, Homo Sapiens
NVDNSLDDS

SEQ ID NO: 151938 - protein, 9 aa, Homo Sapiens
QAVDNKAAA

SEQ ID NO: 151939 - protein, 9 aa, Homo Sapiens
EGALGQTSK

SEQ ID NO: 151940 - protein, 9 aa, Homo Sapiens
PCGYGPQDS

SEQ ID NO: 151941 - protein, 9 aa, Homo Sapiens
DPEPPVPAL

SEQ ID NO: 151942 - protein, 9 aa, Homo Sapiens
MLTVSHGRV

SEQ ID NO: 151943 - protein, 9 aa, Homo Sapiens
LSEQANQGS

SEQ ID NO: 151944 - protein, 9 aa, Homo Sapiens
SPWQVMASL

SEQ ID NO: 151945 - protein, 9 aa, Homo Sapiens
RPLEMLEEK

SEQ ID NO: 151946 - protein, 9 aa, Homo Sapiens
TLKFIIILY

SEQ ID NO: 151947 - protein, 9 aa, Homo Sapiens
VWPISSWTC

SEQ ID NO: 151948 - protein, 9 aa, Homo Sapiens
GASLGRALP

SEQ ID NO: 151949 - protein, 9 aa, Homo Sapiens
WGLGTGQRL

SEQ ID NO: 151950 - protein, 9 aa, Homo Sapiens
SLAKYVELD

SEQ ID NO: 151951 - protein, 9 aa, Homo Sapiens
AEAMTFLLI

SEQ ID NO: 151952 - protein, 9 aa, Homo Sapiens
PPTRIALNS

SEQ ID NO: 151953 - protein, 9 aa, Homo Sapiens
CSDPFVPPA

SEQ ID NO: 151954 - protein, 9 aa, Homo Sapiens
GLRMNTHVL

SEQ ID NO: 151955 - protein, 9 aa, Homo Sapiens
MTEVNINNS

SEQ ID NO: 151956 - protein, 9 aa, Homo Sapiens
ESASDTIKF

SEQ ID NO: 151957 - protein, 9 aa, Homo Sapiens
PGAFSSSSS

SEQ ID NO: 151958 - protein, 9 aa, Homo Sapiens
WAPESAGPG

SEQ ID NO: 151959 - protein, 9 aa, Homo Sapiens
KLHNRNAPR

SEQ ID NO: 151960 - protein, 9 aa, Homo Sapiens
AAPEDAATP

SEQ ID NO: 151961 - protein, 9 aa, Homo Sapiens
QYRQLLNDY

SEQ ID NO: 151962 - protein, 9 aa, Homo Sapiens
APERAAKLG

SEQ ID NO: 151963 - protein, 9 aa, Homo Sapiens
NNSFCAMGV

SEQ ID NO: 151964 - protein, 9 aa, Homo Sapiens
GNSLLGLGD

SEQ ID NO: 151965 - protein, 9 aa, Homo Sapiens
APIALWAHR

SEQ ID NO: 151966 - protein, 9 aa, Homo Sapiens
FKTKDTHME

SEQ ID NO: 151967 - protein, 9 aa, Homo Sapiens
GLSLKLGVV

SEQ ID NO: 151968 - protein, 9 aa, Homo Sapiens
SSLRSHHTP

SEQ ID NO: 151969 - protein, 9 aa, Homo Sapiens
RSIFVSIVV

SEQ ID NO: 151970 - protein, 9 aa, Homo Sapiens
KSTDKDEEF

SEQ ID NO: 151971 - protein, 9 aa, Homo Sapiens
MTACSILAR

SEQ ID NO: 151972 - protein, 9 aa, Homo Sapiens
ISGWAMAVV

SEQ ID NO: 151973 - protein, 9 aa, Homo Sapiens
SCEVTLSRP

SEQ ID NO: 151974 - protein, 9 aa, Homo Sapiens
SGTQEWRWQ

SEQ ID NO: 151975 - protein, 9 aa, Homo Sapiens
IPVLPSQAL

SEQ ID NO: 151976 - protein, 9 aa, Homo Sapiens
FVSSVCWRA

SEQ ID NO: 151977 - protein, 9 aa, Homo Sapiens
QAETRPERL

SEQ ID NO: 151978 - protein, 9 aa, Homo Sapiens
DFQPFWQLE

SEQ ID NO: 151979 - protein, 9 aa, Homo Sapiens
MSSWSQTSC

SEQ ID NO: 151980 - protein, 9 aa, Homo Sapiens
NAGNELLLQ

SEQ ID NO: 151981 - protein, 9 aa, Homo Sapiens
ECLDPGVPV

SEQ ID NO: 151982 - protein, 9 aa, Homo Sapiens
IVLHPGHFP

SEQ ID NO: 151983 - protein, 9 aa, Homo Sapiens
PAPIIVNID

SEQ ID NO: 151984 - protein, 9 aa, Homo Sapiens
LWTSVRGCS

SEQ ID NO: 151985 - protein, 9 aa, Homo Sapiens
ARWTVSPRW

SEQ ID NO: 151986 - protein, 9 aa, Homo Sapiens
ALTPLQQRP

SEQ ID NO: 151987 - protein, 9 aa, Homo Sapiens
PDGPGRLRP

SEQ ID NO: 151988 - protein, 9 aa, Homo Sapiens
CLKVMHKTF

SEQ ID NO: 151989 - protein, 9 aa, Homo Sapiens
VKVIEKNSP

SEQ ID NO: 151990 - protein, 9 aa, Homo Sapiens
GSGSGLNAW

SEQ ID NO: 151991 - protein, 9 aa, Homo Sapiens
WRSPCSGPS

SEQ ID NO: 151992 - protein, 9 aa, Homo Sapiens
GREAVSIYQ

SEQ ID NO: 151993 - protein, 9 aa, Homo Sapiens
SVHPVSPMR

SEQ ID NO: 151994 - protein, 9 aa, Homo Sapiens
SSKSDSDTE

SEQ ID NO: 151995 - protein, 9 aa, Homo Sapiens
DPPPYEPHC

SEQ ID NO: 151996 - protein, 9 aa, Homo Sapiens
MVGKRGKTM

SEQ ID NO: 151997 - protein, 9 aa, Homo Sapiens
DCLSCPGRN

SEQ ID NO: 151998 - protein, 9 aa, Homo Sapiens
AAALGPANA

SEQ ID NO: 151999 - protein, 9 aa, Homo Sapiens
AEFAERTVV

SEQ ID NO: 152000 - protein, 9 aa, Homo Sapiens
KPLYSSHSQ

SEQ ID NO: 152001 - protein, 9 aa, Homo Sapiens
FGQLTGSFF

SEQ ID NO: 152002 - protein, 9 aa, Homo Sapiens
VHDLMRSIF

SEQ ID NO: 152003 - protein, 9 aa, Homo Sapiens
QTLGVTLKS

SEQ ID NO: 152004 - protein, 9 aa, Homo Sapiens
FGASSSPPG

SEQ ID NO: 152005 - protein, 9 aa, Homo Sapiens
TWLDFLKVA

SEQ ID NO: 152006 - protein, 9 aa, Homo Sapiens
YPSLYNGHF

SEQ ID NO: 152007 - protein, 9 aa, Homo Sapiens
KVCPSWLSV

SEQ ID NO: 152008 - protein, 9 aa, Homo Sapiens
FCSSSTYVN

SEQ ID NO: 152009 - protein, 9 aa, Homo Sapiens
REGPVPKVR

SEQ ID NO: 152010 - protein, 9 aa, Homo Sapiens
DSRGPRTPR

SEQ ID NO: 152011 - protein, 9 aa, Homo Sapiens
FPKFSRLHR

SEQ ID NO: 152012 - protein, 9 aa, Homo Sapiens
GEYLKEQCA

SEQ ID NO: 152013 - protein, 9 aa, Homo Sapiens
LTPDDVQIL

SEQ ID NO: 152014 - protein, 9 aa, Homo Sapiens
MQATSATTS

SEQ ID NO: 152015 - protein, 9 aa, Homo Sapiens
SAHCNIHLP

SEQ ID NO: 152016 - protein, 9 aa, Homo Sapiens
SWWRVPTPP

SEQ ID NO: 152017 - protein, 9 aa, Homo Sapiens
KRKPSAKPP

SEQ ID NO: 152018 - protein, 9 aa, Homo Sapiens
PELRSSRSA

SEQ ID NO: 152019 - protein, 9 aa, Homo Sapiens
HSDGGDPNQ

SEQ ID NO: 152020 - protein, 9 aa, Homo Sapiens
FGFVALHSP

SEQ ID NO: 152021 - protein, 9 aa, Homo Sapiens
LIDGSAVPY

SEQ ID NO: 152022 - protein, 9 aa, Homo Sapiens
VHLRDLSLC

SEQ ID NO: 152023 - protein, 9 aa, Homo Sapiens
LLPGWGQWH

SEQ ID NO: 152024 - protein, 9 aa, Homo Sapiens
VTADIQLPN

SEQ ID NO: 152025 - protein, 9 aa, Homo Sapiens
LASGTQEWR

SEQ ID NO: 152026 - protein, 9 aa, Homo Sapiens
SGLGRTQRW

SEQ ID NO: 152027 - protein, 9 aa, Homo Sapiens
QQKMLLACR

SEQ ID NO: 152028 - protein, 9 aa, Homo Sapiens
HELEISVYW

SEQ ID NO: 152029 - protein, 9 aa, Homo Sapiens
RMCERKNMK

SEQ ID NO: 152030 - protein, 9 aa, Homo Sapiens
DDEEMVQRW

SEQ ID NO: 152031 - protein, 9 aa, Homo Sapiens
VTTQIAMAA

SEQ ID NO: 152032 - protein, 9 aa, Homo Sapiens
QIGVNIRKF

SEQ ID NO: 152033 - protein, 9 aa, Homo Sapiens
VSAAGVRDR

SEQ ID NO: 152034 - protein, 9 aa, Homo Sapiens
GLACGLPPC

SEQ ID NO: 152035 - protein, 9 aa, Homo Sapiens
LRFLRVQHG

SEQ ID NO: 152036 - protein, 9 aa, Homo Sapiens
THTVATFQP

SEQ ID NO: 152037 - protein, 9 aa, Homo Sapiens
SQGCREGRM

SEQ ID NO: 152038 - protein, 9 aa, Homo Sapiens
VLCEDHRDR

SEQ ID NO: 152039 - protein, 9 aa, Homo Sapiens
RTSAGLLHP

SEQ ID NO: 152040 - protein, 9 aa, Homo Sapiens
GAHPGEGWV

SEQ ID NO: 152041 - protein, 9 aa, Homo Sapiens
SHAFLRSCH

SEQ ID NO: 152042 - protein, 9 aa, Homo Sapiens
LKEKVLKLY

SEQ ID NO: 152043 - protein, 9 aa, Homo Sapiens
PRWSCWRPS

SEQ ID NO: 152044 - protein, 9 aa, Homo Sapiens
GPGTTREPL

SEQ ID NO: 152045 - protein, 9 aa, Homo Sapiens
PPAATDAAH

SEQ ID NO: 152046 - protein, 9 aa, Homo Sapiens
LAWLSSSQW

SEQ ID NO: 152047 - protein, 9 aa, Homo Sapiens
TATIAAAAD

SEQ ID NO: 152048 - protein, 9 aa, Homo Sapiens
CRIGRAGGP

SEQ ID NO: 152049 - protein, 9 aa, Homo Sapiens
LDTPVADDH

SEQ ID NO: 152050 - protein, 9 aa, Homo Sapiens
YHKAHSLLC

SEQ ID NO: 152051 - protein, 9 aa, Homo Sapiens
WPGGFEAAL

SEQ ID NO: 152052 - protein, 9 aa, Homo Sapiens
AAGGTPHVS

SEQ ID NO: 152053 - protein, 9 aa, Homo Sapiens
GAISAHCNI

SEQ ID NO: 152054 - protein, 9 aa, Homo Sapiens
PSTCSDIWQ

SEQ ID NO: 152055 - protein, 9 aa, Homo Sapiens
GAWVGAHQG

SEQ ID NO: 152056 - protein, 9 aa, Homo Sapiens
SLPLGRGGG

SEQ ID NO: 152057 - protein, 9 aa, Homo Sapiens
NGDSINKDH

SEQ ID NO: 152058 - protein, 9 aa, Homo Sapiens
GGPGPAQAS

SEQ ID NO: 152059 - protein, 9 aa, Homo Sapiens
HDSFNLTLK

SEQ ID NO: 152060 - protein, 9 aa, Homo Sapiens
HHLMVADHE

SEQ ID NO: 152061 - protein, 9 aa, Homo Sapiens
QPVGRVRHS

SEQ ID NO: 152062 - protein, 9 aa, Homo Sapiens
SWRSFICRM

SEQ ID NO: 152063 - protein, 9 aa, Homo Sapiens
SASLDSQQT

SEQ ID NO: 152064 - protein, 9 aa, Homo Sapiens
GLAVHQDVK

SEQ ID NO: 152065 - protein, 9 aa, Homo Sapiens
RSPGVPRRQ

SEQ ID NO: 152066 - protein, 9 aa, Homo Sapiens
PMGSLTPRT

SEQ ID NO: 152067 - protein, 9 aa, Homo Sapiens
FPPPLSVGT

SEQ ID NO: 152068 - protein, 9 aa, Homo Sapiens
MSDSSLSDS

SEQ ID NO: 152069 - protein, 9 aa, Homo Sapiens
CPFSTVKGS

SEQ ID NO: 152070 - protein, 9 aa, Homo Sapiens
YWYSVTTSV

SEQ ID NO: 152071 - protein, 9 aa, Homo Sapiens
FLYSEDSTP

SEQ ID NO: 152072 - protein, 9 aa, Homo Sapiens
GPPRPTVAF

SEQ ID NO: 152073 - protein, 9 aa, Homo Sapiens
INHQETHSG

SEQ ID NO: 152074 - protein, 9 aa, Homo Sapiens
FVLVNLEVT

SEQ ID NO: 152075 - protein, 9 aa, Homo Sapiens
GSWQPRPPR

SEQ ID NO: 152076 - protein, 9 aa, Homo Sapiens
LLHFKILKF

SEQ ID NO: 152077 - protein, 9 aa, Homo Sapiens
ALLRGLGLQ

SEQ ID NO: 152078 - protein, 9 aa, Homo Sapiens
AIRRYQKKR

SEQ ID NO: 152079 - protein, 9 aa, Homo Sapiens
SLSLLPDTS

SEQ ID NO: 152080 - protein, 9 aa, Homo Sapiens
AEGFPPQPS

SEQ ID NO: 152081 - protein, 9 aa, Homo Sapiens
PPTGACCTM

SEQ ID NO: 152082 - protein, 9 aa, Homo Sapiens
TCVLTAFLL

SEQ ID NO: 152083 - protein, 9 aa, Homo Sapiens
FREQFKENW

SEQ ID NO: 152084 - protein, 9 aa, Homo Sapiens
TESPPAQAV

SEQ ID NO: 152085 - protein, 9 aa, Homo Sapiens
LTKVWCSLN

SEQ ID NO: 152086 - protein, 9 aa, Homo Sapiens
QEGPMQAAL

SEQ ID NO: 152087 - protein, 9 aa, Homo Sapiens
APRSPPRDS

SEQ ID NO: 152088 - protein, 9 aa, Homo Sapiens
GAQGPSSRD

SEQ ID NO: 152089 - protein, 9 aa, Homo Sapiens
MISSPASSQ

SEQ ID NO: 152090 - protein, 9 aa, Homo Sapiens
ILATWAVPQ

SEQ ID NO: 152091 - protein, 9 aa, Homo Sapiens
KEPGIYTVW

SEQ ID NO: 152092 - protein, 9 aa, Homo Sapiens
LLSTTRPPT

SEQ ID NO: 152093 - protein, 9 aa, Homo Sapiens
SMWSWRPHP

SEQ ID NO: 152094 - protein, 9 aa, Homo Sapiens
LKDMQPEDS

SEQ ID NO: 152095 - protein, 9 aa, Homo Sapiens
ETLHKLQAL

SEQ ID NO: 152096 - protein, 9 aa, Homo Sapiens
TQEDIAVIR

SEQ ID NO: 152097 - protein, 9 aa, Homo Sapiens
VGKAKKPHS

SEQ ID NO: 152098 - protein, 9 aa, Homo Sapiens
FPLGAHCSP

SEQ ID NO: 152099 - protein, 9 aa, Homo Sapiens
PRQVREHVL

SEQ ID NO: 152100 - protein, 9 aa, Homo Sapiens
PLPPVPFLD

SEQ ID NO: 152101 - protein, 9 aa, Homo Sapiens
RQWAQPVLD

SEQ ID NO: 152102 - protein, 9 aa, Homo Sapiens
ASMEFRQKG

SEQ ID NO: 152103 - protein, 9 aa, Homo Sapiens
EKYYEASGQ

SEQ ID NO: 152104 - protein, 9 aa, Homo Sapiens
AITLNRYLK

SEQ ID NO: 152105 - protein, 9 aa, Homo Sapiens
IESGHIPGT

SEQ ID NO: 152106 - protein, 9 aa, Homo Sapiens
GPRAVHDDP

SEQ ID NO: 152107 - protein, 9 aa, Homo Sapiens
MNHHQQQQQ

SEQ ID NO: 152108 - protein, 9 aa, Homo Sapiens
IDDHKTNEN

SEQ ID NO: 152109 - protein, 9 aa, Homo Sapiens
VTLELSPLL

SEQ ID NO: 152110 - protein, 9 aa, Homo Sapiens
PPRQVREHV

SEQ ID NO: 152111 - protein, 9 aa, Homo Sapiens
LHVTATPRI

SEQ ID NO: 152112 - protein, 9 aa, Homo Sapiens
LLRNHFSLI

SEQ ID NO: 152113 - protein, 9 aa, Homo Sapiens
RPSCCYPVC

SEQ ID NO: 152114 - protein, 9 aa, Homo Sapiens
PSRPATSRT

SEQ ID NO: 152115 - protein, 9 aa, Homo Sapiens
RTALAPRAP

SEQ ID NO: 152116 - protein, 9 aa, Homo Sapiens
RRKMEANIQ

SEQ ID NO: 152117 - protein, 9 aa, Homo Sapiens
LGPTRPLHR

SEQ ID NO: 152118 - protein, 9 aa, Homo Sapiens
GRGGACGQS

SEQ ID NO: 152119 - protein, 9 aa, Homo Sapiens
ATGIGTPTA

SEQ ID NO: 152120 - protein, 9 aa, Homo Sapiens
RTWWRTRAC

SEQ ID NO: 152121 - protein, 9 aa, Homo Sapiens
AVICALVVV

SEQ ID NO: 152122 - protein, 9 aa, Homo Sapiens
ASWSVSLMP

SEQ ID NO: 152123 - protein, 9 aa, Homo Sapiens
TSKQNRRSL

SEQ ID NO: 152124 - protein, 9 aa, Homo Sapiens
SGGGRELSE

SEQ ID NO: 152125 - protein, 9 aa, Homo Sapiens
IHPPLIFGA

SEQ ID NO: 152126 - protein, 9 aa, Homo Sapiens
DRFLSCDKD

SEQ ID NO: 152127 - protein, 9 aa, Homo Sapiens
FTGNKFTLD

SEQ ID NO: 152128 - protein, 9 aa, Homo Sapiens
VCPSPSTAA

SEQ ID NO: 152129 - protein, 9 aa, Homo Sapiens
VIQMHSSGS

SEQ ID NO: 152130 - protein, 9 aa, Homo Sapiens
GNFFFQNPR

SEQ ID NO: 152131 - protein, 9 aa, Homo Sapiens
IIAKMAVVS

SEQ ID NO: 152132 - protein, 9 aa, Homo Sapiens
FFKSFHSWT

SEQ ID NO: 152133 - protein, 9 aa, Homo Sapiens
LDDHLAEAL

SEQ ID NO: 152134 - protein, 9 aa, Homo Sapiens
GMSYLHPSK

SEQ ID NO: 152135 - protein, 9 aa, Homo Sapiens
ERCNALIAE

SEQ ID NO: 152136 - protein, 9 aa, Homo Sapiens
LPVTPGLGQ

SEQ ID NO: 152137 - protein, 9 aa, Homo Sapiens
QCVGMDWTG

SEQ ID NO: 152138 - protein, 9 aa, Homo Sapiens
IWNDPWLLA

SEQ ID NO: 152139 - protein, 9 aa, Homo Sapiens
VGSLGQQHQ

SEQ ID NO: 152140 - protein, 9 aa, Homo Sapiens
LEANLRRLK

SEQ ID NO: 152141 - protein, 9 aa, Homo Sapiens
WDYAHCMPY

SEQ ID NO: 152142 - protein, 9 aa, Homo Sapiens
LQYGIPHHL

SEQ ID NO: 152143 - protein, 9 aa, Homo Sapiens
LCFVLPWTE

SEQ ID NO: 152144 - protein, 9 aa, Homo Sapiens
EDILDTWFS

SEQ ID NO: 152145 - protein, 9 aa, Homo Sapiens
FATATTDNT

SEQ ID NO: 152146 - protein, 9 aa, Homo Sapiens
PTVAFLPPM

SEQ ID NO: 152147 - protein, 9 aa, Homo Sapiens
AYLSIFDQL

SEQ ID NO: 152148 - protein, 9 aa, Homo Sapiens
QQDEDILDT

SEQ ID NO: 152149 - protein, 9 aa, Homo Sapiens
PPCPRMAAA

SEQ ID NO: 152150 - protein, 9 aa, Homo Sapiens
SELKKAVGA

SEQ ID NO: 152151 - protein, 9 aa, Homo Sapiens
PAASTPAKM

SEQ ID NO: 152152 - protein, 9 aa, Homo Sapiens
QLPGPHDDF

SEQ ID NO: 152153 - protein, 9 aa, Homo Sapiens
EFEFRVGTS

SEQ ID NO: 152154 - protein, 9 aa, Homo Sapiens
QKVLREKVP

SEQ ID NO: 152155 - protein, 9 aa, Homo Sapiens
ISKGYVRIM

SEQ ID NO: 152156 - protein, 9 aa, Homo Sapiens
APGSSVLWL

SEQ ID NO: 152157 - protein, 9 aa, Homo Sapiens
EAASSALAG

SEQ ID NO: 152158 - protein, 9 aa, Homo Sapiens
APPAATDAA

SEQ ID NO: 152159 - protein, 9 aa, Homo Sapiens
LQLLILDLV

SEQ ID NO: 152160 - protein, 9 aa, Homo Sapiens
SSHACVQKV

SEQ ID NO: 152161 - protein, 9 aa, Homo Sapiens
SFAEGLRCV

SEQ ID NO: 152162 - protein, 9 aa, Homo Sapiens
VSSGTSTVT

SEQ ID NO: 152163 - protein, 9 aa, Homo Sapiens
PTRPLHRTT

SEQ ID NO: 152164 - protein, 9 aa, Homo Sapiens
ECPESLHDI

SEQ ID NO: 152165 - protein, 9 aa, Homo Sapiens
EDAATPAAA

SEQ ID NO: 152166 - protein, 9 aa, Homo Sapiens
CNLLLKDMQ

SEQ ID NO: 152167 - protein, 9 aa, Homo Sapiens
YSQDQFLRA

SEQ ID NO: 152168 - protein, 9 aa, Homo Sapiens
SSRPTVPSC

SEQ ID NO: 152169 - protein, 9 aa, Homo Sapiens
ACPAFLCGM

SEQ ID NO: 152170 - protein, 9 aa, Homo Sapiens
KEAYAQNRA

SEQ ID NO: 152171 - protein, 9 aa, Homo Sapiens
CRGGHLWRK

SEQ ID NO: 152172 - protein, 9 aa, Homo Sapiens
CDLPKTVNS

SEQ ID NO: 152173 - protein, 9 aa, Homo Sapiens
MDHVTPMIS

SEQ ID NO: 152174 - protein, 9 aa, Homo Sapiens
LTSRSGWPR

SEQ ID NO: 152175 - protein, 9 aa, Homo Sapiens
LLATLCLAG

SEQ ID NO: 152176 - protein, 9 aa, Homo Sapiens
PLDQKIVLH

SEQ ID NO: 152177 - protein, 9 aa, Homo Sapiens
AHFCHHGGV

SEQ ID NO: 152178 - protein, 9 aa, Homo Sapiens
GPCPSITTP

SEQ ID NO: 152179 - protein, 9 aa, Homo Sapiens
LTNTMGGTR

SEQ ID NO: 152180 - protein, 9 aa, Homo Sapiens
CPAVAVEQA

SEQ ID NO: 152181 - protein, 9 aa, Homo Sapiens
SRPSTGSRE

SEQ ID NO: 152182 - protein, 9 aa, Homo Sapiens
EHTLMGKEE

SEQ ID NO: 152183 - protein, 9 aa, Homo Sapiens
QLRVPVLIK

SEQ ID NO: 152184 - protein, 9 aa, Homo Sapiens
ASEAPPRSL

SEQ ID NO: 152185 - protein, 9 aa, Homo Sapiens
EKGYPRIPP

SEQ ID NO: 152186 - protein, 9 aa, Homo Sapiens
AAHALARFA

SEQ ID NO: 152187 - protein, 9 aa, Homo Sapiens
QFPMVPGET

SEQ ID NO: 152188 - protein, 9 aa, Homo Sapiens
LRWIIEVVK

SEQ ID NO: 152189 - protein, 9 aa, Homo Sapiens
LQPDQAHRP

SEQ ID NO: 152190 - protein, 9 aa, Homo Sapiens
TNSPGPTLD

SEQ ID NO: 152191 - protein, 9 aa, Homo Sapiens
LAEKFGDLN

SEQ ID NO: 152192 - protein, 9 aa, Homo Sapiens
KYHKAHSLL

SEQ ID NO: 152193 - protein, 9 aa, Homo Sapiens
NLAATDDDE

SEQ ID NO: 152194 - protein, 9 aa, Homo Sapiens
FRKSLHGQK

SEQ ID NO: 152195 - protein, 9 aa, Homo Sapiens
RRQWAQPVL

SEQ ID NO: 152196 - protein, 9 aa, Homo Sapiens
DDVQQKIEP

SEQ ID NO: 152197 - protein, 9 aa, Homo Sapiens
LGGAGTALL

SEQ ID NO: 152198 - protein, 9 aa, Homo Sapiens
AWIPASRCC

SEQ ID NO: 152199 - protein, 9 aa, Homo Sapiens
DDDNPPCLL

SEQ ID NO: 152200 - protein, 9 aa, Homo Sapiens
TRSCMCTAD

SEQ ID NO: 152201 - protein, 9 aa, Homo Sapiens
VQPPPAQSL

SEQ ID NO: 152202 - protein, 9 aa, Homo Sapiens
KKRCARINE

SEQ ID NO: 152203 - protein, 9 aa, Homo Sapiens
MGPHVPRQL

SEQ ID NO: 152204 - protein, 9 aa, Homo Sapiens
RSGGGCART

SEQ ID NO: 152205 - protein, 9 aa, Homo Sapiens
QGVLSPPPR

SEQ ID NO: 152206 - protein, 9 aa, Homo Sapiens
DDRQGVLGG

SEQ ID NO: 152207 - protein, 9 aa, Homo Sapiens
RRRRTRTQQ

SEQ ID NO: 152208 - protein, 9 aa, Homo Sapiens
LCMGLKSWI

SEQ ID NO: 152209 - protein, 9 aa, Homo Sapiens
QAPSQVWTA

SEQ ID NO: 152210 - protein, 9 aa, Homo Sapiens
NWATRKPPT

SEQ ID NO: 152211 - protein, 9 aa, Homo Sapiens
MAYPAVFGS

SEQ ID NO: 152212 - protein, 9 aa, Homo Sapiens
PTPPVHISI

SEQ ID NO: 152213 - protein, 9 aa, Homo Sapiens
SASTGTEVQ

SEQ ID NO: 152214 - protein, 9 aa, Homo Sapiens
VADLSRRLC

SEQ ID NO: 152215 - protein, 9 aa, Homo Sapiens
LSILSPALM

SEQ ID NO: 152216 - protein, 9 aa, Homo Sapiens
LALDVAVQV

SEQ ID NO: 152217 - protein, 9 aa, Homo Sapiens
VKLPGLAVH

SEQ ID NO: 152218 - protein, 9 aa, Homo Sapiens
RSDSSSLTS

SEQ ID NO: 152219 - protein, 9 aa, Homo Sapiens
RSLYSPAEE

SEQ ID NO: 152220 - protein, 9 aa, Homo Sapiens
TGGVPSTPH

SEQ ID NO: 152221 - protein, 9 aa, Homo Sapiens
MLYMPLHLL

SEQ ID NO: 152222 - protein, 9 aa, Homo Sapiens
QELTLPLMS

SEQ ID NO: 152223 - protein, 9 aa, Homo Sapiens
HGQKMLPLL

SEQ ID NO: 152224 - protein, 9 aa, Homo Sapiens
ELETKAELI

SEQ ID NO: 152225 - protein, 9 aa, Homo Sapiens
MMDLRMERP

SEQ ID NO: 152226 - protein, 9 aa, Homo Sapiens
VSMCRMEMI

SEQ ID NO: 152227 - protein, 9 aa, Homo Sapiens
LDEGRTTTC

SEQ ID NO: 152228 - protein, 9 aa, Homo Sapiens
LCRIGRAGG

SEQ ID NO: 152229 - protein, 9 aa, Homo Sapiens
FVWPISSWT

SEQ ID NO: 152230 - protein, 9 aa, Homo Sapiens
NDDIRYDRF

SEQ ID NO: 152231 - protein, 9 aa, Homo Sapiens
PALRKTLPI

SEQ ID NO: 152232 - protein, 9 aa, Homo Sapiens
CKKKMPLTE

SEQ ID NO: 152233 - protein, 9 aa, Homo Sapiens
CARSISGRQ

SEQ ID NO: 152234 - protein, 9 aa, Homo Sapiens
NTMGGTRKA

SEQ ID NO: 152235 - protein, 9 aa, Homo Sapiens
GKKIIEYYL

SEQ ID NO: 152236 - protein, 9 aa, Homo Sapiens
PRSIRRPLI

SEQ ID NO: 152237 - protein, 9 aa, Homo Sapiens
FMESTPEPH

SEQ ID NO: 152238 - protein, 9 aa, Homo Sapiens
SVPGSGAPP

SEQ ID NO: 152239 - protein, 9 aa, Homo Sapiens
AASPPARSW

SEQ ID NO: 152240 - protein, 9 aa, Homo Sapiens
STLQISQKG

SEQ ID NO: 152241 - protein, 9 aa, Homo Sapiens
IHRHTQAYT

SEQ ID NO: 152242 - protein, 9 aa, Homo Sapiens
GTELTKVWC

SEQ ID NO: 152243 - protein, 9 aa, Homo Sapiens
EGKLILSQD

SEQ ID NO: 152244 - protein, 9 aa, Homo Sapiens
IASRSVTDK

SEQ ID NO: 152245 - protein, 9 aa, Homo Sapiens
STGSREKRR

SEQ ID NO: 152246 - protein, 9 aa, Homo Sapiens
GLQLGQLGV

SEQ ID NO: 152247 - protein, 9 aa, Homo Sapiens
WWMCDCFMA

SEQ ID NO: 152248 - protein, 9 aa, Homo Sapiens
GRLPRHPRS

SEQ ID NO: 152249 - protein, 9 aa, Homo Sapiens
FQKQRMEKA

SEQ ID NO: 152250 - protein, 9 aa, Homo Sapiens
QKNMLSPDH

SEQ ID NO: 152251 - protein, 9 aa, Homo Sapiens
ITASAPGAP

SEQ ID NO: 152252 - protein, 9 aa, Homo Sapiens
THGPLDQKI

SEQ ID NO: 152253 - protein, 9 aa, Homo Sapiens
ALTDGKDKG

SEQ ID NO: 152254 - protein, 9 aa, Homo Sapiens
SLKPGALTP

SEQ ID NO: 152255 - protein, 9 aa, Homo Sapiens
LLTGCLSFP

SEQ ID NO: 152256 - protein, 9 aa, Homo Sapiens
RCCAARCPR

SEQ ID NO: 152257 - protein, 9 aa, Homo Sapiens
PLWPPPGSP

SEQ ID NO: 152258 - protein, 9 aa, Homo Sapiens
WARDRMGQG

SEQ ID NO: 152259 - protein, 9 aa, Homo Sapiens
GVPSPSSLR

SEQ ID NO: 152260 - protein, 9 aa, Homo Sapiens
PSPSTAAWI

SEQ ID NO: 152261 - protein, 9 aa, Homo Sapiens
FGLLLLIDS

SEQ ID NO: 152262 - protein, 9 aa, Homo Sapiens
GWAMAVVAV

SEQ ID NO: 152263 - protein, 9 aa, Homo Sapiens
EFDCLINDE

SEQ ID NO: 152264 - protein, 9 aa, Homo Sapiens
EFSFNIPHA

SEQ ID NO: 152265 - protein, 9 aa, Homo Sapiens
GGPADGLIQ

SEQ ID NO: 152266 - protein, 9 aa, Homo Sapiens
MLMPRWSTP

SEQ ID NO: 152267 - protein, 9 aa, Homo Sapiens
LWGWRTGLA

SEQ ID NO: 152268 - protein, 9 aa, Homo Sapiens
PAAVGNILV

SEQ ID NO: 152269 - protein, 9 aa, Homo Sapiens
GGAHPGEGW

SEQ ID NO: 152270 - protein, 9 aa, Homo Sapiens
GGPWRMQTV

SEQ ID NO: 152271 - protein, 9 aa, Homo Sapiens
RPCHLLPLS

SEQ ID NO: 152272 - protein, 9 aa, Homo Sapiens
VAIHRGKDQ

SEQ ID NO: 152273 - protein, 9 aa, Homo Sapiens
TCAPSACLH

SEQ ID NO: 152274 - protein, 9 aa, Homo Sapiens
RCEYCDSVY

SEQ ID NO: 152275 - protein, 9 aa, Homo Sapiens
ARAARAGDL

SEQ ID NO: 152276 - protein, 9 aa, Homo Sapiens
WGDCYHEWN

SEQ ID NO: 152277 - protein, 9 aa, Homo Sapiens
PLASTDLGL

SEQ ID NO: 152278 - protein, 9 aa, Homo Sapiens
RPLTRLRRR

SEQ ID NO: 152279 - protein, 9 aa, Homo Sapiens
PLPRPFDLG

SEQ ID NO: 152280 - protein, 9 aa, Homo Sapiens
ALRARGGTT

SEQ ID NO: 152281 - protein, 9 aa, Homo Sapiens
FHLLNYRTS

SEQ ID NO: 152282 - protein, 9 aa, Homo Sapiens
FSNLVRLMG

SEQ ID NO: 152283 - protein, 9 aa, Homo Sapiens
EVNECIGNL

SEQ ID NO: 152284 - protein, 9 aa, Homo Sapiens
GVAAGLLTA

SEQ ID NO: 152285 - protein, 9 aa, Homo Sapiens
GPGSTRAAA

SEQ ID NO: 152286 - protein, 9 aa, Homo Sapiens
KPLDGPQIG

SEQ ID NO: 152287 - protein, 9 aa, Homo Sapiens
VFLFFLLLV

SEQ ID NO: 152288 - protein, 9 aa, Homo Sapiens
GPPLPPPAA

SEQ ID NO: 152289 - protein, 9 aa, Homo Sapiens
RWWSTARSV

SEQ ID NO: 152290 - protein, 9 aa, Homo Sapiens
LEKVSKKRL

SEQ ID NO: 152291 - protein, 9 aa, Homo Sapiens
LSRLRSRSS

SEQ ID NO: 152292 - protein, 9 aa, Homo Sapiens
PQGGGCVQQ

SEQ ID NO: 152293 - protein, 9 aa, Homo Sapiens
GQVLGPLSN

SEQ ID NO: 152294 - protein, 9 aa, Homo Sapiens
KFMSCVSPW

SEQ ID NO: 152295 - protein, 9 aa, Homo Sapiens
GEAGITGQF

SEQ ID NO: 152296 - protein, 9 aa, Homo Sapiens
QKDIQPAPQ

SEQ ID NO: 152297 - protein, 9 aa, Homo Sapiens
FRCVSGQCV

SEQ ID NO: 152298 - protein, 9 aa, Homo Sapiens
LQWQKKWVH

SEQ ID NO: 152299 - protein, 9 aa, Homo Sapiens
MPSRCSNPT

SEQ ID NO: 152300 - protein, 9 aa, Homo Sapiens
IDKAREIIC

SEQ ID NO: 152301 - protein, 9 aa, Homo Sapiens
LLSYSFPDL

SEQ ID NO: 152302 - protein, 9 aa, Homo Sapiens
EDLPPMGRP

SEQ ID NO: 152303 - protein, 9 aa, Homo Sapiens
TPPLLTLRP

SEQ ID NO: 152304 - protein, 9 aa, Homo Sapiens
AYSSQTVQQ

SEQ ID NO: 152305 - protein, 9 aa, Homo Sapiens
TNTLMVALN

SEQ ID NO: 152306 - protein, 9 aa, Homo Sapiens
NQGNPAVSY

SEQ ID NO: 152307 - protein, 9 aa, Homo Sapiens
PEQCRCANT

SEQ ID NO: 152308 - protein, 9 aa, Homo Sapiens
VIIQPSSCH

SEQ ID NO: 152309 - protein, 9 aa, Homo Sapiens
TPFQTLQLV

SEQ ID NO: 152310 - protein, 9 aa, Homo Sapiens
VPSGVQVLM

SEQ ID NO: 152311 - protein, 9 aa, Homo Sapiens
LGWRTPEDH

SEQ ID NO: 152312 - protein, 9 aa, Homo Sapiens
ALKKASSPG

SEQ ID NO: 152313 - protein, 9 aa, Homo Sapiens
WTSVRGCSY

SEQ ID NO: 152314 - protein, 9 aa, Homo Sapiens
TQEWRWQLG

SEQ ID NO: 152315 - protein, 9 aa, Homo Sapiens
LFLFPDVFI

SEQ ID NO: 152316 - protein, 9 aa, Homo Sapiens
VSPGLLAAA

SEQ ID NO: 152317 - protein, 9 aa, Homo Sapiens
RFSSVTLVF

SEQ ID NO: 152318 - protein, 9 aa, Homo Sapiens
ASIILLHFK

SEQ ID NO: 152319 - protein, 9 aa, Homo Sapiens
HGPPGPKGD

SEQ ID NO: 152320 - protein, 9 aa, Homo Sapiens
TAPCSCSSC

SEQ ID NO: 152321 - protein, 9 aa, Homo Sapiens
AHRRFVAKK

SEQ ID NO: 152322 - protein, 9 aa, Homo Sapiens
ALDVAVQVV

SEQ ID NO: 152323 - protein, 9 aa, Homo Sapiens
PARSPTSAP

SEQ ID NO: 152324 - protein, 9 aa, Homo Sapiens
GPQIGVNIR

SEQ ID NO: 152325 - protein, 9 aa, Homo Sapiens
GTHTLALTA

SEQ ID NO: 152326 - protein, 9 aa, Homo Sapiens
TSATLTSNN

SEQ ID NO: 152327 - protein, 9 aa, Homo Sapiens
TTTTSSPRR

SEQ ID NO: 152328 - protein, 9 aa, Homo Sapiens
AYHLTDLGS

SEQ ID NO: 152329 - protein, 9 aa, Homo Sapiens
WCRRTDPTL

SEQ ID NO: 152330 - protein, 9 aa, Homo Sapiens
YNGHFFQNK

SEQ ID NO: 152331 - protein, 9 aa, Homo Sapiens
VVPGAGAME

SEQ ID NO: 152332 - protein, 9 aa, Homo Sapiens
LLSLYSVAV

SEQ ID NO: 152333 - protein, 9 aa, Homo Sapiens
REEAEAAAH

SEQ ID NO: 152334 - protein, 9 aa, Homo Sapiens
LGSSRLPLS

SEQ ID NO: 152335 - protein, 9 aa, Homo Sapiens
PIIAKMAVV

SEQ ID NO: 152336 - protein, 9 aa, Homo Sapiens
LLEHPCPEQ

SEQ ID NO: 152337 - protein, 9 aa, Homo Sapiens
QEKAQDCQA

SEQ ID NO: 152338 - protein, 9 aa, Homo Sapiens
RRTAGHVAT

SEQ ID NO: 152339 - protein, 9 aa, Homo Sapiens
LDTSLCVVL

SEQ ID NO: 152340 - protein, 9 aa, Homo Sapiens
EEQAGGPPR

SEQ ID NO: 152341 - protein, 9 aa, Homo Sapiens
SPVRNSPCS

SEQ ID NO: 152342 - protein, 9 aa, Homo Sapiens
HNECLDPGV

SEQ ID NO: 152343 - protein, 9 aa, Homo Sapiens
WRTWLGGPS

SEQ ID NO: 152344 - protein, 9 aa, Homo Sapiens
RTESPPAQA

SEQ ID NO: 152345 - protein, 9 aa, Homo Sapiens
LQLRHGLPL

SEQ ID NO: 152346 - protein, 9 aa, Homo Sapiens
EVEHKKKLE

SEQ ID NO: 152347 - protein, 9 aa, Homo Sapiens
QTFGVAEKG

SEQ ID NO: 152348 - protein, 9 aa, Homo Sapiens
HVTTAQWPT

SEQ ID NO: 152349 - protein, 9 aa, Homo Sapiens
STASRASQP

SEQ ID NO: 152350 - protein, 9 aa, Homo Sapiens
EVPWPEVWK

SEQ ID NO: 152351 - protein, 9 aa, Homo Sapiens
QEGLRVRRR

SEQ ID NO: 152352 - protein, 9 aa, Homo Sapiens
VQILVEMED

SEQ ID NO: 152353 - protein, 9 aa, Homo Sapiens
SPEASLRRS

SEQ ID NO: 152354 - protein, 9 aa, Homo Sapiens
SAFNNLKNC

SEQ ID NO: 152355 - protein, 9 aa, Homo Sapiens
HFGKMMIMG

SEQ ID NO: 152356 - protein, 9 aa, Homo Sapiens
GWACGRGAF

SEQ ID NO: 152357 - protein, 9 aa, Homo Sapiens
QGGGQTLMS

SEQ ID NO: 152358 - protein, 9 aa, Homo Sapiens
PPAQPPLPA

SEQ ID NO: 152359 - protein, 9 aa, Homo Sapiens
RHPLHPPHL

SEQ ID NO: 152360 - protein, 9 aa, Homo Sapiens
AKMAVVSKA

SEQ ID NO: 152361 - protein, 9 aa, Homo Sapiens
SGTPPQVSM

SEQ ID NO: 152362 - protein, 9 aa, Homo Sapiens
LGVVWGPLR

SEQ ID NO: 152363 - protein, 9 aa, Homo Sapiens
VWDDSWDLD

SEQ ID NO: 152364 - protein, 9 aa, Homo Sapiens
KVVRTAETS

SEQ ID NO: 152365 - protein, 9 aa, Homo Sapiens
RLPLRPQRG

SEQ ID NO: 152366 - protein, 9 aa, Homo Sapiens
APPLFLPPL

SEQ ID NO: 152367 - protein, 9 aa, Homo Sapiens
SGPSPAPSA

SEQ ID NO: 152368 - protein, 9 aa, Homo Sapiens
RPEVLEGSA

SEQ ID NO: 152369 - protein, 9 aa, Homo Sapiens
GIPLNLFNN

SEQ ID NO: 152370 - protein, 9 aa, Homo Sapiens
SAVLIFNIH

SEQ ID NO: 152371 - protein, 9 aa, Homo Sapiens
RVSPVRNSP

SEQ ID NO: 152372 - protein, 9 aa, Homo Sapiens
TNSAKIVDG

SEQ ID NO: 152373 - protein, 9 aa, Homo Sapiens
ITALIVFGA

SEQ ID NO: 152374 - protein, 9 aa, Homo Sapiens
PPQDRPSHP

SEQ ID NO: 152375 - protein, 9 aa, Homo Sapiens
YQSQIKVGQ

SEQ ID NO: 152376 - protein, 9 aa, Homo Sapiens
NTKVFVWPI

SEQ ID NO: 152377 - protein, 9 aa, Homo Sapiens
GVFHFLDTL

SEQ ID NO: 152378 - protein, 9 aa, Homo Sapiens
MKQMNDARH

SEQ ID NO: 152379 - protein, 9 aa, Homo Sapiens
GKTEDVVLK

SEQ ID NO: 152380 - protein, 9 aa, Homo Sapiens
YERQKMFLE

SEQ ID NO: 152381 - protein, 9 aa, Homo Sapiens
GSFNLSYDK

SEQ ID NO: 152382 - protein, 9 aa, Homo Sapiens
PCRAPPPAS

SEQ ID NO: 152383 - protein, 9 aa, Homo Sapiens
IIEVVKASY

SEQ ID NO: 152384 - protein, 9 aa, Homo Sapiens
YKKVHHHCF

SEQ ID NO: 152385 - protein, 9 aa, Homo Sapiens
LGPDPPTGI

SEQ ID NO: 152386 - protein, 9 aa, Homo Sapiens
VCRGEMKWS

SEQ ID NO: 152387 - protein, 9 aa, Homo Sapiens
TVSPRWWST

SEQ ID NO: 152388 - protein, 9 aa, Homo Sapiens
HPATTFPTQ

SEQ ID NO: 152389 - protein, 9 aa, Homo Sapiens
MAGKGLKVV

SEQ ID NO: 152390 - protein, 9 aa, Homo Sapiens
TPLPADLPH

SEQ ID NO: 152391 - protein, 9 aa, Homo Sapiens
ELCEEFLKT

SEQ ID NO: 152392 - protein, 9 aa, Homo Sapiens
RSCCERMIC

SEQ ID NO: 152393 - protein, 9 aa, Homo Sapiens
PLCLHRARA

SEQ ID NO: 152394 - protein, 9 aa, Homo Sapiens
QPWLQQLPR

SEQ ID NO: 152395 - protein, 9 aa, Homo Sapiens
AASSPGGGE

SEQ ID NO: 152396 - protein, 9 aa, Homo Sapiens
ITSPNTAFI

SEQ ID NO: 152397 - protein, 9 aa, Homo Sapiens
APPPASSTS

SEQ ID NO: 152398 - protein, 9 aa, Homo Sapiens
GHALSCRTR

SEQ ID NO: 152399 - protein, 9 aa, Homo Sapiens
LISHMKMHT

SEQ ID NO: 152400 - protein, 9 aa, Homo Sapiens
PRLLNTDHH

SEQ ID NO: 152401 - protein, 9 aa, Homo Sapiens
FWEDEEKMK

SEQ ID NO: 152402 - protein, 9 aa, Homo Sapiens
QGPGHGGPQ

SEQ ID NO: 152403 - protein, 9 aa, Homo Sapiens
APEVPRCAM

SEQ ID NO: 152404 - protein, 9 aa, Homo Sapiens
SDSMWSWRP

SEQ ID NO: 152405 - protein, 9 aa, Homo Sapiens
VVALYACDR

SEQ ID NO: 152406 - protein, 9 aa, Homo Sapiens
TEAVRCVEK

SEQ ID NO: 152407 - protein, 9 aa, Homo Sapiens
NKWKKFWAI

SEQ ID NO: 152408 - protein, 9 aa, Homo Sapiens
GCVQQVALK

SEQ ID NO: 152409 - protein, 9 aa, Homo Sapiens
YAVGMGKAV

SEQ ID NO: 152410 - protein, 9 aa, Homo Sapiens
FAIMEIQCP

SEQ ID NO: 152411 - protein, 9 aa, Homo Sapiens
VNQLGGGVC

SEQ ID NO: 152412 - protein, 9 aa, Homo Sapiens
TSLALSPDS

SEQ ID NO: 152413 - protein, 9 aa, Homo Sapiens
DMCDGDRWR

SEQ ID NO: 152414 - protein, 9 aa, Homo Sapiens
RVDDIHPRF

SEQ ID NO: 152415 - protein, 9 aa, Homo Sapiens
SSREGPVPK

SEQ ID NO: 152416 - protein, 9 aa, Homo Sapiens
SLWNLVCNH

SEQ ID NO: 152417 - protein, 9 aa, Homo Sapiens
GGWPGWRWR

SEQ ID NO: 152418 - protein, 9 aa, Homo Sapiens
ASLAHSDNF

SEQ ID NO: 152419 - protein, 9 aa, Homo Sapiens
VHPDSRGPR

SEQ ID NO: 152420 - protein, 9 aa, Homo Sapiens
SIHQPQYSI

SEQ ID NO: 152421 - protein, 9 aa, Homo Sapiens
EVVVVHELG

SEQ ID NO: 152422 - protein, 9 aa, Homo Sapiens
TLTSELALC

SEQ ID NO: 152423 - protein, 9 aa, Homo Sapiens
NRVHPPLDI

SEQ ID NO: 152424 - protein, 9 aa, Homo Sapiens
PGQSKRLAI

SEQ ID NO: 152425 - protein, 9 aa, Homo Sapiens
HCRDDVKLP

SEQ ID NO: 152426 - protein, 9 aa, Homo Sapiens
HVQGAAVVH

SEQ ID NO: 152427 - protein, 9 aa, Homo Sapiens
YIVMSYDRY

SEQ ID NO: 152428 - protein, 9 aa, Homo Sapiens
SLVDFQIEK

SEQ ID NO: 152429 - protein, 9 aa, Homo Sapiens
PRQELARHV

SEQ ID NO: 152430 - protein, 9 aa, Homo Sapiens
VDAYNPETD

SEQ ID NO: 152431 - protein, 9 aa, Homo Sapiens
KGAKHKGIK

SEQ ID NO: 152432 - protein, 9 aa, Homo Sapiens
MTLGWEALL

SEQ ID NO: 152433 - protein, 9 aa, Homo Sapiens
SAEKAEVGR

SEQ ID NO: 152434 - protein, 9 aa, Homo Sapiens
PLRGQPPPP

SEQ ID NO: 152435 - protein, 9 aa, Homo Sapiens
DQTELAAID

SEQ ID NO: 152436 - protein, 9 aa, Homo Sapiens
PSPSACSSA

SEQ ID NO: 152437 - protein, 9 aa, Homo Sapiens
ENNISKCFT

SEQ ID NO: 152438 - protein, 9 aa, Homo Sapiens
GGAPGGGGS

SEQ ID NO: 152439 - protein, 9 aa, Homo Sapiens
NAITGEIRP

SEQ ID NO: 152440 - protein, 9 aa, Homo Sapiens
RRKPLVIIE

SEQ ID NO: 152441 - protein, 9 aa, Homo Sapiens
PICCVPICS

SEQ ID NO: 152442 - protein, 9 aa, Homo Sapiens
GGGSTGGGS

SEQ ID NO: 152443 - protein, 9 aa, Homo Sapiens
DIQPAPQCR

SEQ ID NO: 152444 - protein, 9 aa, Homo Sapiens
TKKMMDLRM

SEQ ID NO: 152445 - protein, 9 aa, Homo Sapiens
QHMATMSSA

SEQ ID NO: 152446 - protein, 9 aa, Homo Sapiens
VWSSSISGE

SEQ ID NO: 152447 - protein, 9 aa, Homo Sapiens
AKPSARSPT

SEQ ID NO: 152448 - protein, 9 aa, Homo Sapiens
AYTLAVSFP

SEQ ID NO: 152449 - protein, 9 aa, Homo Sapiens
PAGSGSFVR

SEQ ID NO: 152450 - protein, 9 aa, Homo Sapiens
HPRYPPHPL

SEQ ID NO: 152451 - protein, 9 aa, Homo Sapiens
FPPQPSSGR

SEQ ID NO: 152452 - protein, 9 aa, Homo Sapiens
CELKGGNVT

SEQ ID NO: 152453 - protein, 9 aa, Homo Sapiens
YANLLTGCL

SEQ ID NO: 152454 - protein, 9 aa, Homo Sapiens
AAKSQIVMN

SEQ ID NO: 152455 - protein, 9 aa, Homo Sapiens
LDSESHYCP

SEQ ID NO: 152456 - protein, 9 aa, Homo Sapiens
LESWRRTWR

SEQ ID NO: 152457 - protein, 9 aa, Homo Sapiens
QEEDLHQIF

SEQ ID NO: 152458 - protein, 9 aa, Homo Sapiens
LSIADRPST

SEQ ID NO: 152459 - protein, 9 aa, Homo Sapiens
PWQPSVGCA

SEQ ID NO: 152460 - protein, 9 aa, Homo Sapiens
SLTPPSILL

SEQ ID NO: 152461 - protein, 9 aa, Homo Sapiens
GPWRPLHTA

SEQ ID NO: 152462 - protein, 9 aa, Homo Sapiens
QLPRHVLLG

SEQ ID NO: 152463 - protein, 9 aa, Homo Sapiens
TLTSNNTTG

SEQ ID NO: 152464 - protein, 9 aa, Homo Sapiens
HIFWLLHTA

SEQ ID NO: 152465 - protein, 9 aa, Homo Sapiens
LELEARVAV

SEQ ID NO: 152466 - protein, 9 aa, Homo Sapiens
GVKEIGTHI

SEQ ID NO: 152467 - protein, 9 aa, Homo Sapiens
CGRRLPTAC

SEQ ID NO: 152468 - protein, 9 aa, Homo Sapiens
MIDLEANLR

SEQ ID NO: 152469 - protein, 9 aa, Homo Sapiens
FIQNPWWVI

SEQ ID NO: 152470 - protein, 9 aa, Homo Sapiens
PFQTLQLVH

SEQ ID NO: 152471 - protein, 9 aa, Homo Sapiens
LIALPSLQQ

SEQ ID NO: 152472 - protein, 9 aa, Homo Sapiens
ISVENFTPQ

SEQ ID NO: 152473 - protein, 9 aa, Homo Sapiens
QFFPEVISF

SEQ ID NO: 152474 - protein, 9 aa, Homo Sapiens
KKIARLFLG

SEQ ID NO: 152475 - protein, 9 aa, Homo Sapiens
AILGKGNLI

SEQ ID NO: 152476 - protein, 9 aa, Homo Sapiens
IELTDAFEQ

SEQ ID NO: 152477 - protein, 9 aa, Homo Sapiens
PAHHLCMQL

SEQ ID NO: 152478 - protein, 9 aa, Homo Sapiens
LRKMQRRHI

SEQ ID NO: 152479 - protein, 9 aa, Homo Sapiens
ALLTDGTTK

SEQ ID NO: 152480 - protein, 9 aa, Homo Sapiens
REQFKENWY

SEQ ID NO: 152481 - protein, 9 aa, Homo Sapiens
LKVVRTAET

SEQ ID NO: 152482 - protein, 9 aa, Homo Sapiens
VKPGTYPDV

SEQ ID NO: 152483 - protein, 9 aa, Homo Sapiens
NSEEKKFTK

SEQ ID NO: 152484 - protein, 9 aa, Homo Sapiens
KNAEELFVE

SEQ ID NO: 152485 - protein, 9 aa, Homo Sapiens
ERPLIPEGA

SEQ ID NO: 152486 - protein, 9 aa, Homo Sapiens
PTGVPVCSG

SEQ ID NO: 152487 - protein, 9 aa, Homo Sapiens
KISVLSFET

SEQ ID NO: 152488 - protein, 9 aa, Homo Sapiens
IECGKLFTY

SEQ ID NO: 152489 - protein, 9 aa, Homo Sapiens
KINLFFKSF

SEQ ID NO: 152490 - protein, 9 aa, Homo Sapiens
EIKGREAVS

SEQ ID NO: 152491 - protein, 9 aa, Homo Sapiens
PSRPPTTPT

SEQ ID NO: 152492 - protein, 9 aa, Homo Sapiens
QECQKTLQR

SEQ ID NO: 152493 - protein, 9 aa, Homo Sapiens
KLGVNFGRS

SEQ ID NO: 152494 - protein, 9 aa, Homo Sapiens
LAACDKELI

SEQ ID NO: 152495 - protein, 9 aa, Homo Sapiens
VAPRPAPRS

SEQ ID NO: 152496 - protein, 9 aa, Homo Sapiens
PRWWSTARS

SEQ ID NO: 152497 - protein, 9 aa, Homo Sapiens
GSLGQQHQR

SEQ ID NO: 152498 - protein, 9 aa, Homo Sapiens
PSSQLLVQA

SEQ ID NO: 152499 - protein, 9 aa, Homo Sapiens
LPALAPQPR

SEQ ID NO: 152500 - protein, 9 aa, Homo Sapiens
CVIIPPGSS

SEQ ID NO: 152501 - protein, 9 aa, Homo Sapiens
ATTTTQALF

SEQ ID NO: 152502 - protein, 9 aa, Homo Sapiens
GFLYSEDST

SEQ ID NO: 152503 - protein, 9 aa, Homo Sapiens
AAPSPLCLH

SEQ ID NO: 152504 - protein, 9 aa, Homo Sapiens
SNDAVHVQG

SEQ ID NO: 152505 - protein, 9 aa, Homo Sapiens
LDFMNAVKE

SEQ ID NO: 152506 - protein, 9 aa, Homo Sapiens
RCRPRGPPA

SEQ ID NO: 152507 - protein, 9 aa, Homo Sapiens
KENWYNTYS

SEQ ID NO: 152508 - protein, 9 aa, Homo Sapiens
TVLTAPGVC

SEQ ID NO: 152509 - protein, 9 aa, Homo Sapiens
TTARPRPQS

SEQ ID NO: 152510 - protein, 9 aa, Homo Sapiens
RTRVQKEGL

SEQ ID NO: 152511 - protein, 9 aa, Homo Sapiens
LKYSVDEKS

SEQ ID NO: 152512 - protein, 9 aa, Homo Sapiens
GGCARTWLP

SEQ ID NO: 152513 - protein, 9 aa, Homo Sapiens
RCIPPRTLH

SEQ ID NO: 152514 - protein, 9 aa, Homo Sapiens
SSWFIFSEE

SEQ ID NO: 152515 - protein, 9 aa, Homo Sapiens
NDAVHVQGA

SEQ ID NO: 152516 - protein, 9 aa, Homo Sapiens
CASSGGSDL

SEQ ID NO: 152517 - protein, 9 aa, Homo Sapiens
LRGSLEWLR

SEQ ID NO: 152518 - protein, 9 aa, Homo Sapiens
GPGALLDAE

SEQ ID NO: 152519 - protein, 9 aa, Homo Sapiens
HLSPRLGRS

SEQ ID NO: 152520 - protein, 9 aa, Homo Sapiens
LVCTTTPNM

SEQ ID NO: 152521 - protein, 9 aa, Homo Sapiens
RLSLRQADA

SEQ ID NO: 152522 - protein, 9 aa, Homo Sapiens
ATVQMGFCD

SEQ ID NO: 152523 - protein, 9 aa, Homo Sapiens
TTKKSNIYK

SEQ ID NO: 152524 - protein, 9 aa, Homo Sapiens
RMRSVHLQE

SEQ ID NO: 152525 - protein, 9 aa, Homo Sapiens
WNYLSFLKG

SEQ ID NO: 152526 - protein, 9 aa, Homo Sapiens
AYTQTQTHT

SEQ ID NO: 152527 - protein, 9 aa, Homo Sapiens
AAGGRTRAN

SEQ ID NO: 152528 - protein, 9 aa, Homo Sapiens
LDFSGHTHT

SEQ ID NO: 152529 - protein, 9 aa, Homo Sapiens
EINKDCDGE

SEQ ID NO: 152530 - protein, 9 aa, Homo Sapiens
WRWTERDAS

SEQ ID NO: 152531 - protein, 9 aa, Homo Sapiens
PCRPRVTPG

SEQ ID NO: 152532 - protein, 9 aa, Homo Sapiens
PPPASSTSR

SEQ ID NO: 152533 - protein, 9 aa, Homo Sapiens
LAFIMYMTM

SEQ ID NO: 152534 - protein, 9 aa, Homo Sapiens
GLSPRRAQK

SEQ ID NO: 152535 - protein, 9 aa, Homo Sapiens
EAFGLLLLI

SEQ ID NO: 152536 - protein, 9 aa, Homo Sapiens
GGEGMLHHP

SEQ ID NO: 152537 - protein, 9 aa, Homo Sapiens
LAAPACQCL

SEQ ID NO: 152538 - protein, 9 aa, Homo Sapiens
PPPECCSSW

SEQ ID NO: 152539 - protein, 9 aa, Homo Sapiens
RGFGCGRGR

SEQ ID NO: 152540 - protein, 9 aa, Homo Sapiens
SPPRDSRKW

SEQ ID NO: 152541 - protein, 9 aa, Homo Sapiens
DYCIFYNPQ

SEQ ID NO: 152542 - protein, 9 aa, Homo Sapiens
VIDQGGKIR

SEQ ID NO: 152543 - protein, 9 aa, Homo Sapiens
GALTPLQQR

SEQ ID NO: 152544 - protein, 9 aa, Homo Sapiens
CLYQTNSRL

SEQ ID NO: 152545 - protein, 9 aa, Homo Sapiens
LTRRSSALC

SEQ ID NO: 152546 - protein, 9 aa, Homo Sapiens
QMRNVALLA

SEQ ID NO: 152547 - protein, 9 aa, Homo Sapiens
CCERMICNV

SEQ ID NO: 152548 - protein, 9 aa, Homo Sapiens
KEKACLEEE

SEQ ID NO: 152549 - protein, 9 aa, Homo Sapiens
RHNECLDPG

SEQ ID NO: 152550 - protein, 9 aa, Homo Sapiens
SCRRERPRR

SEQ ID NO: 152551 - protein, 9 aa, Homo Sapiens
GQERYHSLV

SEQ ID NO: 152552 - protein, 9 aa, Homo Sapiens
HAPPPRMAA

SEQ ID NO: 152553 - protein, 9 aa, Homo Sapiens
CCCRARSSC

SEQ ID NO: 152554 - protein, 9 aa, Homo Sapiens
DFTLLDFMN

SEQ ID NO: 152555 - protein, 9 aa, Homo Sapiens
GRRRRRTRT

SEQ ID NO: 152556 - protein, 9 aa, Homo Sapiens
TRIALNSAL

SEQ ID NO: 152557 - protein, 9 aa, Homo Sapiens
STCARLWMA

SEQ ID NO: 152558 - protein, 9 aa, Homo Sapiens
KSQGGRILL

SEQ ID NO: 152559 - protein, 9 aa, Homo Sapiens
LSVLGGAGT

SEQ ID NO: 152560 - protein, 9 aa, Homo Sapiens
HDTGSLTST

SEQ ID NO: 152561 - protein, 9 aa, Homo Sapiens
NERKSGILA

SEQ ID NO: 152562 - protein, 9 aa, Homo Sapiens
PFDLGLMTR

SEQ ID NO: 152563 - protein, 9 aa, Homo Sapiens
LPHGHGKPQ

SEQ ID NO: 152564 - protein, 9 aa, Homo Sapiens
YYMQQEVIV

SEQ ID NO: 152565 - protein, 9 aa, Homo Sapiens
CCTMQATSA

SEQ ID NO: 152566 - protein, 9 aa, Homo Sapiens
CFDISHPET

SEQ ID NO: 152567 - protein, 9 aa, Homo Sapiens
MANARRSPR

SEQ ID NO: 152568 - protein, 9 aa, Homo Sapiens
EIDIRIRVQ

SEQ ID NO: 152569 - protein, 9 aa, Homo Sapiens
QGKKVELAT

SEQ ID NO: 152570 - protein, 9 aa, Homo Sapiens
STGGGSSGG

SEQ ID NO: 152571 - protein, 9 aa, Homo Sapiens
CWPLLRGQS

SEQ ID NO: 152572 - protein, 9 aa, Homo Sapiens
TSIPSIPKR

SEQ ID NO: 152573 - protein, 9 aa, Homo Sapiens
SLWTCLGLA

SEQ ID NO: 152574 - protein, 9 aa, Homo Sapiens
ALVAAFFVL

SEQ ID NO: 152575 - protein, 9 aa, Homo Sapiens
MHPSLEIPL

SEQ ID NO: 152576 - protein, 9 aa, Homo Sapiens
MRNLASIGE

SEQ ID NO: 152577 - protein, 9 aa, Homo Sapiens
PWSPTHSAQ

SEQ ID NO: 152578 - protein, 9 aa, Homo Sapiens
AATRAAARP

SEQ ID NO: 152579 - protein, 9 aa, Homo Sapiens
VLFHSSGDL

SEQ ID NO: 152580 - protein, 9 aa, Homo Sapiens
EGVPAPAPP

SEQ ID NO: 152581 - protein, 9 aa, Homo Sapiens
SQKGRIYSR

SEQ ID NO: 152582 - protein, 9 aa, Homo Sapiens
RCGAKTIEG

SEQ ID NO: 152583 - protein, 9 aa, Homo Sapiens
RRAPLNSWR

SEQ ID NO: 152584 - protein, 9 aa, Homo Sapiens
VLYEAYHGV

SEQ ID NO: 152585 - protein, 9 aa, Homo Sapiens
QSPVPLRIH

SEQ ID NO: 152586 - protein, 9 aa, Homo Sapiens
RGRWRVGDV

SEQ ID NO: 152587 - protein, 9 aa, Homo Sapiens
LLLNQVKQE

SEQ ID NO: 152588 - protein, 9 aa, Homo Sapiens
SSTPKSKRK

SEQ ID NO: 152589 - protein, 9 aa, Homo Sapiens
FFLLLVQAE

SEQ ID NO: 152590 - protein, 9 aa, Homo Sapiens
YLRRKEPDR

SEQ ID NO: 152591 - protein, 9 aa, Homo Sapiens
VPGGPRWCA

SEQ ID NO: 152592 - protein, 9 aa, Homo Sapiens
VPILLSILW

SEQ ID NO: 152593 - protein, 9 aa, Homo Sapiens
KGEIPKDEH

SEQ ID NO: 152594 - protein, 9 aa, Homo Sapiens
EGSPPSTAR

SEQ ID NO: 152595 - protein, 9 aa, Homo Sapiens
QLTRVLEEE

SEQ ID NO: 152596 - protein, 9 aa, Homo Sapiens
PALSTCTGS

SEQ ID NO: 152597 - protein, 9 aa, Homo Sapiens
GGGGWPGWR

SEQ ID NO: 152598 - protein, 9 aa, Homo Sapiens
VLAILGKGN

SEQ ID NO: 152599 - protein, 9 aa, Homo Sapiens
QFLAKQGQW

SEQ ID NO: 152600 - protein, 9 aa, Homo Sapiens
AGSRGPAVR

SEQ ID NO: 152601 - protein, 9 aa, Homo Sapiens
SPPGAVPSG

SEQ ID NO: 152602 - protein, 9 aa, Homo Sapiens
TKFPWHIKK

SEQ ID NO: 152603 - protein, 9 aa, Homo Sapiens
KSNIYKMPL

SEQ ID NO: 152604 - protein, 9 aa, Homo Sapiens
DTLACTGTH

SEQ ID NO: 152605 - protein, 9 aa, Homo Sapiens
VMNQLDHTN

SEQ ID NO: 152606 - protein, 9 aa, Homo Sapiens
KKKALFALC

SEQ ID NO: 152607 - protein, 9 aa, Homo Sapiens
RNKMKDTPK

SEQ ID NO: 152608 - protein, 9 aa, Homo Sapiens
RCVEKMQDH

SEQ ID NO: 152609 - protein, 9 aa, Homo Sapiens
TVRIFASLH

SEQ ID NO: 152610 - protein, 9 aa, Homo Sapiens
CPRPRCRPA

SEQ ID NO: 152611 - protein, 9 aa, Homo Sapiens
EGALQASDT

SEQ ID NO: 152612 - protein, 9 aa, Homo Sapiens
AARARTCSP

SEQ ID NO: 152613 - protein, 9 aa, Homo Sapiens
ADSQGQSSA

SEQ ID NO: 152614 - protein, 9 aa, Homo Sapiens
QLRHGLPLH

SEQ ID NO: 152615 - protein, 9 aa, Homo Sapiens
SGMEDVGPG

SEQ ID NO: 152616 - protein, 9 aa, Homo Sapiens
AGPFSNQTQ

SEQ ID NO: 152617 - protein, 9 aa, Homo Sapiens
QGMIGHPWH

SEQ ID NO: 152618 - protein, 9 aa, Homo Sapiens
DDRSPQAPL

SEQ ID NO: 152619 - protein, 9 aa, Homo Sapiens
AKKAYPSEK

SEQ ID NO: 152620 - protein, 9 aa, Homo Sapiens
VHNPRVEHT

SEQ ID NO: 152621 - protein, 9 aa, Homo Sapiens
FELASLWNL

SEQ ID NO: 152622 - protein, 9 aa, Homo Sapiens
QKRAGNFAI

SEQ ID NO: 152623 - protein, 9 aa, Homo Sapiens
AFQVHPDSR

SEQ ID NO: 152624 - protein, 9 aa, Homo Sapiens
AGLIFLQPL

SEQ ID NO: 152625 - protein, 9 aa, Homo Sapiens
PAQTSLTPP

SEQ ID NO: 152626 - protein, 9 aa, Homo Sapiens
LATWAVPQV

SEQ ID NO: 152627 - protein, 9 aa, Homo Sapiens
ASGTQVTTQ

SEQ ID NO: 152628 - protein, 9 aa, Homo Sapiens
GVVALYACD

SEQ ID NO: 152629 - protein, 9 aa, Homo Sapiens
CIVAIGRLQ

SEQ ID NO: 152630 - protein, 9 aa, Homo Sapiens
MSNSKKSKT

SEQ ID NO: 152631 - protein, 9 aa, Homo Sapiens
QYSSGLRPC

SEQ ID NO: 152632 - protein, 9 aa, Homo Sapiens
ISALGLLDV

SEQ ID NO: 152633 - protein, 9 aa, Homo Sapiens
GYSNSETGS

SEQ ID NO: 152634 - protein, 9 aa, Homo Sapiens
REMSFHLLN

SEQ ID NO: 152635 - protein, 9 aa, Homo Sapiens
LLLLDLPIL

SEQ ID NO: 152636 - protein, 9 aa, Homo Sapiens
VKKIHAKDK

SEQ ID NO: 152637 - protein, 9 aa, Homo Sapiens
GQGPCGYGP

SEQ ID NO: 152638 - protein, 9 aa, Homo Sapiens
KGEKGYPRI

SEQ ID NO: 152639 - protein, 9 aa, Homo Sapiens
ASTRASGPT

SEQ ID NO: 152640 - protein, 9 aa, Homo Sapiens
VFKFIGGLR

SEQ ID NO: 152641 - protein, 9 aa, Homo Sapiens
SDSSSLTSL

SEQ ID NO: 152642 - protein, 9 aa, Homo Sapiens
RGSWRRMEV

SEQ ID NO: 152643 - protein, 9 aa, Homo Sapiens
QRLGVVWGP

SEQ ID NO: 152644 - protein, 9 aa, Homo Sapiens
PCRPPRSPA

SEQ ID NO: 152645 - protein, 9 aa, Homo Sapiens
PTPTRRPRP

SEQ ID NO: 152646 - protein, 9 aa, Homo Sapiens
SASCGPTSG

SEQ ID NO: 152647 - protein, 9 aa, Homo Sapiens
VMAVANVMS

SEQ ID NO: 152648 - protein, 9 aa, Homo Sapiens
EHLITKPVI

SEQ ID NO: 152649 - protein, 9 aa, Homo Sapiens
RHTEAVRCV

SEQ ID NO: 152650 - protein, 9 aa, Homo Sapiens
LKKVHIFQD

SEQ ID NO: 152651 - protein, 9 aa, Homo Sapiens
EEMKKTTSQ

SEQ ID NO: 152652 - protein, 9 aa, Homo Sapiens
CDPRGSPAC

SEQ ID NO: 152653 - protein, 9 aa, Homo Sapiens
YGKTVTMKE

SEQ ID NO: 152654 - protein, 9 aa, Homo Sapiens
AKLDHQVSE

SEQ ID NO: 152655 - protein, 9 aa, Homo Sapiens
DNSAKSGWV

SEQ ID NO: 152656 - protein, 9 aa, Homo Sapiens
ASTPAKMEP

SEQ ID NO: 152657 - protein, 9 aa, Homo Sapiens
CVLLDYSTD

SEQ ID NO: 152658 - protein, 9 aa, Homo Sapiens
NGVERPLIP

SEQ ID NO: 152659 - protein, 9 aa, Homo Sapiens
KRKRNLSNM

SEQ ID NO: 152660 - protein, 9 aa, Homo Sapiens
PISPVNQGI

SEQ ID NO: 152661 - protein, 9 aa, Homo Sapiens
ADTSAQSVS

SEQ ID NO: 152662 - protein, 9 aa, Homo Sapiens
RPSTVPLPT

SEQ ID NO: 152663 - protein, 9 aa, Homo Sapiens
LEHWWWKSL

SEQ ID NO: 152664 - protein, 9 aa, Homo Sapiens
IREMSFHLL

SEQ ID NO: 152665 - protein, 9 aa, Homo Sapiens
GSWPVAQRM

SEQ ID NO: 152666 - protein, 9 aa, Homo Sapiens
NEQTKFNLR

SEQ ID NO: 152667 - protein, 9 aa, Homo Sapiens
SRPPEYEIF

SEQ ID NO: 152668 - protein, 9 aa, Homo Sapiens
SSERHSPRP

SEQ ID NO: 152669 - protein, 9 aa, Homo Sapiens
VGTALVAPV

SEQ ID NO: 152670 - protein, 9 aa, Homo Sapiens
SARQRLERA

SEQ ID NO: 152671 - protein, 9 aa, Homo Sapiens
LVAELALVG

SEQ ID NO: 152672 - protein, 9 aa, Homo Sapiens
RARQVFLRQ

SEQ ID NO: 152673 - protein, 9 aa, Homo Sapiens
SEGGPPRPT

SEQ ID NO: 152674 - protein, 9 aa, Homo Sapiens
RLGVVWGPL

SEQ ID NO: 152675 - protein, 9 aa, Homo Sapiens
LHCAQIQVK

SEQ ID NO: 152676 - protein, 9 aa, Homo Sapiens
PHVDFQLVL

SEQ ID NO: 152677 - protein, 9 aa, Homo Sapiens
LRSQDPSPA

SEQ ID NO: 152678 - protein, 9 aa, Homo Sapiens
PEKQLPPIV

SEQ ID NO: 152679 - protein, 9 aa, Homo Sapiens
WIRTEMASL

SEQ ID NO: 152680 - protein, 9 aa, Homo Sapiens
PERLLAPLI

SEQ ID NO: 152681 - protein, 9 aa, Homo Sapiens
QGYLGRWGR

SEQ ID NO: 152682 - protein, 9 aa, Homo Sapiens
IMTCLQYGI

SEQ ID NO: 152683 - protein, 9 aa, Homo Sapiens
APPPPLPAP

SEQ ID NO: 152684 - protein, 9 aa, Homo Sapiens
RGSPACCPV

SEQ ID NO: 152685 - protein, 9 aa, Homo Sapiens
ASSGYDWNE

SEQ ID NO: 152686 - protein, 9 aa, Homo Sapiens
GDEAEPLGK

SEQ ID NO: 152687 - protein, 9 aa, Homo Sapiens
HSHTRGVSR

SEQ ID NO: 152688 - protein, 9 aa, Homo Sapiens
APPTEYPVH

SEQ ID NO: 152689 - protein, 9 aa, Homo Sapiens
APIPWLNWS

SEQ ID NO: 152690 - protein, 9 aa, Homo Sapiens
LHPGHFPLQ

SEQ ID NO: 152691 - protein, 9 aa, Homo Sapiens
CVNVAGVSL

SEQ ID NO: 152692 - protein, 9 aa, Homo Sapiens
PRAREKLTS

SEQ ID NO: 152693 - protein, 9 aa, Homo Sapiens
ASVCCRAQT

SEQ ID NO: 152694 - protein, 9 aa, Homo Sapiens
GRCGRRRRP

SEQ ID NO: 152695 - protein, 9 aa, Homo Sapiens
GPWQPGASP

SEQ ID NO: 152696 - protein, 9 aa, Homo Sapiens
RYTPKQDTM

SEQ ID NO: 152697 - protein, 9 aa, Homo Sapiens
STLLGICNG

SEQ ID NO: 152698 - protein, 9 aa, Homo Sapiens
FVFRMAGKG

SEQ ID NO: 152699 - protein, 9 aa, Homo Sapiens
LRCLPDQPP

SEQ ID NO: 152700 - protein, 9 aa, Homo Sapiens
CTGPPRDRW

SEQ ID NO: 152701 - protein, 9 aa, Homo Sapiens
PPEDDTATA

SEQ ID NO: 152702 - protein, 9 aa, Homo Sapiens
QLGKGTEVP

SEQ ID NO: 152703 - protein, 9 aa, Homo Sapiens
GQRRNYTHA

SEQ ID NO: 152704 - protein, 9 aa, Homo Sapiens
TYPDVPPEK

SEQ ID NO: 152705 - protein, 9 aa, Homo Sapiens
FPLADDVTL

SEQ ID NO: 152706 - protein, 9 aa, Homo Sapiens
QDVSMCRME

SEQ ID NO: 152707 - protein, 9 aa, Homo Sapiens
KDVEEAVRK

SEQ ID NO: 152708 - protein, 9 aa, Homo Sapiens
WISMKAGVI

SEQ ID NO: 152709 - protein, 9 aa, Homo Sapiens
INKKSHPQL

SEQ ID NO: 152710 - protein, 9 aa, Homo Sapiens
SSPGCRPAA

SEQ ID NO: 152711 - protein, 9 aa, Homo Sapiens
HSITLQVTF

SEQ ID NO: 152712 - protein, 9 aa, Homo Sapiens
QAVAEAGAC

SEQ ID NO: 152713 - protein, 9 aa, Homo Sapiens
GQVAEDVFT

SEQ ID NO: 152714 - protein, 9 aa, Homo Sapiens
TGQFSHHNI

SEQ ID NO: 152715 - protein, 9 aa, Homo Sapiens
PEDHSDPDA

SEQ ID NO: 152716 - protein, 9 aa, Homo Sapiens
SQQTVPFMK

SEQ ID NO: 152717 - protein, 9 aa, Homo Sapiens
PHSDGGDPN

SEQ ID NO: 152718 - protein, 9 aa, Homo Sapiens
PRRARRLRG

SEQ ID NO: 152719 - protein, 9 aa, Homo Sapiens
RSPGEWFLC

SEQ ID NO: 152720 - protein, 9 aa, Homo Sapiens
ASAWTSMHQ

SEQ ID NO: 152721 - protein, 9 aa, Homo Sapiens
LVAPRPAPR

SEQ ID NO: 152722 - protein, 9 aa, Homo Sapiens
SRAPRLPRS

SEQ ID NO: 152723 - protein, 9 aa, Homo Sapiens
SLCWPSRTT

SEQ ID NO: 152724 - protein, 9 aa, Homo Sapiens
AEIWNGMAI

SEQ ID NO: 152725 - protein, 9 aa, Homo Sapiens
VLVVVAARP

SEQ ID NO: 152726 - protein, 9 aa, Homo Sapiens
RSCFHLETL

SEQ ID NO: 152727 - protein, 9 aa, Homo Sapiens
ALHSPFLQK

SEQ ID NO: 152728 - protein, 9 aa, Homo Sapiens
GSREKRRRT

SEQ ID NO: 152729 - protein, 9 aa, Homo Sapiens
IVMQFGQVA

SEQ ID NO: 152730 - protein, 9 aa, Homo Sapiens
NVEMITALI

SEQ ID NO: 152731 - protein, 9 aa, Homo Sapiens
NSATSVDAK

SEQ ID NO: 152732 - protein, 9 aa, Homo Sapiens
RKPLVIIEK

SEQ ID NO: 152733 - protein, 9 aa, Homo Sapiens
AAVVHGQHH

SEQ ID NO: 152734 - protein, 9 aa, Homo Sapiens
LHLGIHIVG

SEQ ID NO: 152735 - protein, 9 aa, Homo Sapiens
LSGPSSPQL

SEQ ID NO: 152736 - protein, 9 aa, Homo Sapiens
AAAMHTTRP

SEQ ID NO: 152737 - protein, 9 aa, Homo Sapiens
VPLHRGWFA

SEQ ID NO: 152738 - protein, 9 aa, Homo Sapiens
FDENVVVRN

SEQ ID NO: 152739 - protein, 9 aa, Homo Sapiens
HTVGGAAGA

SEQ ID NO: 152740 - protein, 9 aa, Homo Sapiens
PTSAPTAAK

SEQ ID NO: 152741 - protein, 9 aa, Homo Sapiens
CWLVHRINK

SEQ ID NO: 152742 - protein, 9 aa, Homo Sapiens
FKENWYNTY

SEQ ID NO: 152743 - protein, 9 aa, Homo Sapiens
GLPVGESPW

SEQ ID NO: 152744 - protein, 9 aa, Homo Sapiens
LPCVLPHVD

SEQ ID NO: 152745 - protein, 9 aa, Homo Sapiens
PAATDAAHM

SEQ ID NO: 152746 - protein, 9 aa, Homo Sapiens
KKSNELLQA

SEQ ID NO: 152747 - protein, 9 aa, Homo Sapiens
IVMNVRNTI

SEQ ID NO: 152748 - protein, 9 aa, Homo Sapiens
GHGRARPTG

SEQ ID NO: 152749 - protein, 9 aa, Homo Sapiens
CWAAPVITS

SEQ ID NO: 152750 - protein, 9 aa, Homo Sapiens
SPVLAMCRR

SEQ ID NO: 152751 - protein, 9 aa, Homo Sapiens
SPLPRPFDL

SEQ ID NO: 152752 - protein, 9 aa, Homo Sapiens
RLEKVHFSQ

SEQ ID NO: 152753 - protein, 9 aa, Homo Sapiens
GPTRKEVHA

SEQ ID NO: 152754 - protein, 9 aa, Homo Sapiens
VPSVARPST

SEQ ID NO: 152755 - protein, 9 aa, Homo Sapiens
LSGQTARGY

SEQ ID NO: 152756 - protein, 9 aa, Homo Sapiens
CTGPPARRH

SEQ ID NO: 152757 - protein, 9 aa, Homo Sapiens
RVTQKAPCG

SEQ ID NO: 152758 - protein, 9 aa, Homo Sapiens
VVGPVLHKV

SEQ ID NO: 152759 - protein, 9 aa, Homo Sapiens
SMCRMEMIS

SEQ ID NO: 152760 - protein, 9 aa, Homo Sapiens
PTGSWQPRP

SEQ ID NO: 152761 - protein, 9 aa, Homo Sapiens
SRAQTHRKS

SEQ ID NO: 152762 - protein, 9 aa, Homo Sapiens
VLHPVHLPT

SEQ ID NO: 152763 - protein, 9 aa, Homo Sapiens
ATGSVQPVC

SEQ ID NO: 152764 - protein, 9 aa, Homo Sapiens
LAAKYHKAH

SEQ ID NO: 152765 - protein, 9 aa, Homo Sapiens
KTKKKEGVP

SEQ ID NO: 152766 - protein, 9 aa, Homo Sapiens
IDLYPSLYN

SEQ ID NO: 152767 - protein, 9 aa, Homo Sapiens
GHCATVHQG

SEQ ID NO: 152768 - protein, 9 aa, Homo Sapiens
GPLRCSLPD

SEQ ID NO: 152769 - protein, 9 aa, Homo Sapiens
GMGKAVEAE

SEQ ID NO: 152770 - protein, 9 aa, Homo Sapiens
PSVPGSGAP

SEQ ID NO: 152771 - protein, 9 aa, Homo Sapiens
ESEDECTLD

SEQ ID NO: 152772 - protein, 9 aa, Homo Sapiens
KLKYLINPE

SEQ ID NO: 152773 - protein, 9 aa, Homo Sapiens
SPPTQQPQT

SEQ ID NO: 152774 - protein, 9 aa, Homo Sapiens
GAHRSPSAP

SEQ ID NO: 152775 - protein, 9 aa, Homo Sapiens
STTTMRLES

SEQ ID NO: 152776 - protein, 9 aa, Homo Sapiens
IPPGSSHAC

SEQ ID NO: 152777 - protein, 9 aa, Homo Sapiens
VSAGTQEHS

SEQ ID NO: 152778 - protein, 9 aa, Homo Sapiens
LTSAYRNKL

SEQ ID NO: 152779 - protein, 9 aa, Homo Sapiens
HPLPLPPVP

SEQ ID NO: 152780 - protein, 9 aa, Homo Sapiens
RSPCSGPSK

SEQ ID NO: 152781 - protein, 9 aa, Homo Sapiens
SLDIMTCLQ

SEQ ID NO: 152782 - protein, 9 aa, Homo Sapiens
LWFLLKSTH

SEQ ID NO: 152783 - protein, 9 aa, Homo Sapiens
TAFPEPGTA

SEQ ID NO: 152784 - protein, 9 aa, Homo Sapiens
KKEGVPSGP

SEQ ID NO: 152785 - protein, 9 aa, Homo Sapiens
TWAGASTFS

SEQ ID NO: 152786 - protein, 9 aa, Homo Sapiens
SILSQKLGR

SEQ ID NO: 152787 - protein, 9 aa, Homo Sapiens
THVLHPRLQ

SEQ ID NO: 152788 - protein, 9 aa, Homo Sapiens
KNKVGHEGI

SEQ ID NO: 152789 - protein, 9 aa, Homo Sapiens
DLQNNDTSE

SEQ ID NO: 152790 - protein, 9 aa, Homo Sapiens
RYRHFSKSI

SEQ ID NO: 152791 - protein, 9 aa, Homo Sapiens
TQHQKIHRD

SEQ ID NO: 152792 - protein, 9 aa, Homo Sapiens
HSPRPIFDL

SEQ ID NO: 152793 - protein, 9 aa, Homo Sapiens
SKVANVAGV

SEQ ID NO: 152794 - protein, 9 aa, Homo Sapiens
VENFTPQNV

SEQ ID NO: 152795 - protein, 9 aa, Homo Sapiens
KSLMTKNPT

SEQ ID NO: 152796 - protein, 9 aa, Homo Sapiens
SDGLAPQHL

SEQ ID NO: 152797 - protein, 9 aa, Homo Sapiens
PPSSTPCTV

SEQ ID NO: 152798 - protein, 9 aa, Homo Sapiens
WRPDVKVLR

SEQ ID NO: 152799 - protein, 9 aa, Homo Sapiens
RRRRPGGRS

SEQ ID NO: 152800 - protein, 9 aa, Homo Sapiens
GRDAPYCVA

SEQ ID NO: 152801 - protein, 9 aa, Homo Sapiens
CSVLHIVAS

SEQ ID NO: 152802 - protein, 9 aa, Homo Sapiens
CLAPFVYLL

SEQ ID NO: 152803 - protein, 9 aa, Homo Sapiens
KLKEAKLHQ

SEQ ID NO: 152804 - protein, 9 aa, Homo Sapiens
ALAPQPRRP

SEQ ID NO: 152805 - protein, 9 aa, Homo Sapiens
KALEIKHIS

SEQ ID NO: 152806 - protein, 9 aa, Homo Sapiens
RERVWFSDK

SEQ ID NO: 152807 - protein, 9 aa, Homo Sapiens
FLLGLWENM

SEQ ID NO: 152808 - protein, 9 aa, Homo Sapiens
KDPPKWKDY

SEQ ID NO: 152809 - protein, 9 aa, Homo Sapiens
SGICSPTWS

SEQ ID NO: 152810 - protein, 9 aa, Homo Sapiens
ARSSSTIHI

SEQ ID NO: 152811 - protein, 9 aa, Homo Sapiens
PSVNEQTKF

SEQ ID NO: 152812 - protein, 9 aa, Homo Sapiens
LASPGILKF

SEQ ID NO: 152813 - protein, 9 aa, Homo Sapiens
AARCPRCRP

SEQ ID NO: 152814 - protein, 9 aa, Homo Sapiens
GNLIGCELP

SEQ ID NO: 152815 - protein, 9 aa, Homo Sapiens
FICQYFTVF

SEQ ID NO: 152816 - protein, 9 aa, Homo Sapiens
NPRGVVHRR

SEQ ID NO: 152817 - protein, 9 aa, Homo Sapiens
SESSASLGR

SEQ ID NO: 152818 - protein, 9 aa, Homo Sapiens
KQQEEDCTF

SEQ ID NO: 152819 - protein, 9 aa, Homo Sapiens
KKNKGRLWT

SEQ ID NO: 152820 - protein, 9 aa, Homo Sapiens
LKTPPKPWQ

SEQ ID NO: 152821 - protein, 9 aa, Homo Sapiens
HSSLKSIFL

SEQ ID NO: 152822 - protein, 9 aa, Homo Sapiens
TRTRSDFLT

SEQ ID NO: 152823 - protein, 9 aa, Homo Sapiens
NCSSPGCRP

SEQ ID NO: 152824 - protein, 9 aa, Homo Sapiens
PLGAHCSPL

SEQ ID NO: 152825 - protein, 9 aa, Homo Sapiens
YTQHRKSIF

SEQ ID NO: 152826 - protein, 9 aa, Homo Sapiens
GWSGNSGLD

SEQ ID NO: 152827 - protein, 9 aa, Homo Sapiens
PQKNQKGQY

SEQ ID NO: 152828 - protein, 9 aa, Homo Sapiens
PAQASAAVL

SEQ ID NO: 152829 - protein, 9 aa, Homo Sapiens
LPSTQLKGI

SEQ ID NO: 152830 - protein, 9 aa, Homo Sapiens
FPETCAHNR

SEQ ID NO: 152831 - protein, 9 aa, Homo Sapiens
IGQQGYLGR

SEQ ID NO: 152832 - protein, 9 aa, Homo Sapiens
VAVDILGCT

SEQ ID NO: 152833 - protein, 9 aa, Homo Sapiens
LGARLSRAL

SEQ ID NO: 152834 - protein, 9 aa, Homo Sapiens
AGDDSVLLI

SEQ ID NO: 152835 - protein, 9 aa, Homo Sapiens
LNSWRSGGS

SEQ ID NO: 152836 - protein, 9 aa, Homo Sapiens
NVLQEKYVL

SEQ ID NO: 152837 - protein, 9 aa, Homo Sapiens
PLSKTVCFN

SEQ ID NO: 152838 - protein, 9 aa, Homo Sapiens
PQHVESRWD

SEQ ID NO: 152839 - protein, 9 aa, Homo Sapiens
HVFVYAITS

SEQ ID NO: 152840 - protein, 9 aa, Homo Sapiens
KKNSCEVQP

SEQ ID NO: 152841 - protein, 9 aa, Homo Sapiens
FNVLGFSVA

SEQ ID NO: 152842 - protein, 9 aa, Homo Sapiens
VPGELGTLA

SEQ ID NO: 152843 - protein, 9 aa, Homo Sapiens
RLEEQLSPQ

SEQ ID NO: 152844 - protein, 9 aa, Homo Sapiens
KACEALRLQ

SEQ ID NO: 152845 - protein, 9 aa, Homo Sapiens
FLSPCVDNC

SEQ ID NO: 152846 - protein, 9 aa, Homo Sapiens
GNVTKAPDL

SEQ ID NO: 152847 - protein, 9 aa, Homo Sapiens
DTLQCGYPS

SEQ ID NO: 152848 - protein, 9 aa, Homo Sapiens
LSCQISIFH

SEQ ID NO: 152849 - protein, 9 aa, Homo Sapiens
QSALGTASE

SEQ ID NO: 152850 - protein, 9 aa, Homo Sapiens
LYCDKLYSR

SEQ ID NO: 152851 - protein, 9 aa, Homo Sapiens
MRTQLREWC

SEQ ID NO: 152852 - protein, 9 aa, Homo Sapiens
EEELRRCEE

SEQ ID NO: 152853 - protein, 9 aa, Homo Sapiens
FPEGALGQT

SEQ ID NO: 152854 - protein, 9 aa, Homo Sapiens
DGQTEQCGI

SEQ ID NO: 152855 - protein, 9 aa, Homo Sapiens
VLWLFEYHQ

SEQ ID NO: 152856 - protein, 9 aa, Homo Sapiens
PPSTPPDRS

SEQ ID NO: 152857 - protein, 9 aa, Homo Sapiens
LLCFDISHP

SEQ ID NO: 152858 - protein, 9 aa, Homo Sapiens
TVSSGTSTV

SEQ ID NO: 152859 - protein, 9 aa, Homo Sapiens
WRSWWQGRG

SEQ ID NO: 152860 - protein, 9 aa, Homo Sapiens
FIVQINPTN

SEQ ID NO: 152861 - protein, 9 aa, Homo Sapiens
QRELCAAQL

SEQ ID NO: 152862 - protein, 9 aa, Homo Sapiens
ASPLRPPGT

SEQ ID NO: 152863 - protein, 9 aa, Homo Sapiens
LENLKEPEP

SEQ ID NO: 152864 - protein, 9 aa, Homo Sapiens
LELSERCNA

SEQ ID NO: 152865 - protein, 9 aa, Homo Sapiens
QDHQKDTRW

SEQ ID NO: 152866 - protein, 9 aa, Homo Sapiens
GRVAVPYPP

SEQ ID NO: 152867 - protein, 9 aa, Homo Sapiens
DAVAATTWN

SEQ ID NO: 152868 - protein, 9 aa, Homo Sapiens
KSRDQVHDD

SEQ ID NO: 152869 - protein, 9 aa, Homo Sapiens
YNVMVIINT

SEQ ID NO: 152870 - protein, 9 aa, Homo Sapiens
APQGPWQPG

SEQ ID NO: 152871 - protein, 9 aa, Homo Sapiens
IPELLIDEA

SEQ ID NO: 152872 - protein, 9 aa, Homo Sapiens
PGPFQSCKN

SEQ ID NO: 152873 - protein, 9 aa, Homo Sapiens
EIPLKGWSL

SEQ ID NO: 152874 - protein, 9 aa, Homo Sapiens
IGPSCVPTA

SEQ ID NO: 152875 - protein, 9 aa, Homo Sapiens
THTGTQAYT

SEQ ID NO: 152876 - protein, 9 aa, Homo Sapiens
PAPPSAAQG

SEQ ID NO: 152877 - protein, 9 aa, Homo Sapiens
GQRPKTAAA

SEQ ID NO: 152878 - protein, 9 aa, Homo Sapiens
LQGPEEGRC

SEQ ID NO: 152879 - protein, 9 aa, Homo Sapiens
AGAVPRSGS

SEQ ID NO: 152880 - protein, 9 aa, Homo Sapiens
TATPRIVNI

SEQ ID NO: 152881 - protein, 9 aa, Homo Sapiens
LQLRPQPWL

SEQ ID NO: 152882 - protein, 9 aa, Homo Sapiens
SSQRWPPPR

SEQ ID NO: 152883 - protein, 9 aa, Homo Sapiens
MAEKCYRVT

SEQ ID NO: 152884 - protein, 9 aa, Homo Sapiens
NISHQWIRL

SEQ ID NO: 152885 - protein, 9 aa, Homo Sapiens
QAQPNPRPW

SEQ ID NO: 152886 - protein, 9 aa, Homo Sapiens
GLIPRLPTG

SEQ ID NO: 152887 - protein, 9 aa, Homo Sapiens
HGLPLHLIH

SEQ ID NO: 152888 - protein, 9 aa, Homo Sapiens
IPEKQTMKL

SEQ ID NO: 152889 - protein, 9 aa, Homo Sapiens
DTTTIVECL

SEQ ID NO: 152890 - protein, 9 aa, Homo Sapiens
FFSILHVPK

SEQ ID NO: 152891 - protein, 9 aa, Homo Sapiens
SCKNSYIKL

SEQ ID NO: 152892 - protein, 9 aa, Homo Sapiens
TARWRTTRS

SEQ ID NO: 152893 - protein, 9 aa, Homo Sapiens
TLPMPRLVS

SEQ ID NO: 152894 - protein, 9 aa, Homo Sapiens
TEKKCYLHH

SEQ ID NO: 152895 - protein, 9 aa, Homo Sapiens
EHTFIAIKP

SEQ ID NO: 152896 - protein, 9 aa, Homo Sapiens
RGAHRSPSA

SEQ ID NO: 152897 - protein, 9 aa, Homo Sapiens
PHQEADVLH

SEQ ID NO: 152898 - protein, 9 aa, Homo Sapiens
RDSTCLSSS

SEQ ID NO: 152899 - protein, 9 aa, Homo Sapiens
TECVVREAL

SEQ ID NO: 152900 - protein, 9 aa, Homo Sapiens
KITPKEDPE

SEQ ID NO: 152901 - protein, 9 aa, Homo Sapiens
KQLVKCRRH

SEQ ID NO: 152902 - protein, 9 aa, Homo Sapiens
TSARRRTWW

SEQ ID NO: 152903 - protein, 9 aa, Homo Sapiens
TWSAGEWSL

SEQ ID NO: 152904 - protein, 9 aa, Homo Sapiens
AFVDDPDIP

SEQ ID NO: 152905 - protein, 9 aa, Homo Sapiens
EQLRWEKID

SEQ ID NO: 152906 - protein, 9 aa, Homo Sapiens
TDGTTKTGA

SEQ ID NO: 152907 - protein, 9 aa, Homo Sapiens
AEGRRYSHA

SEQ ID NO: 152908 - protein, 9 aa, Homo Sapiens
VTAKRMSYH

SEQ ID NO: 152909 - protein, 9 aa, Homo Sapiens
VPSPSSLRR

SEQ ID NO: 152910 - protein, 9 aa, Homo Sapiens
GGTTIGEVT

SEQ ID NO: 152911 - protein, 9 aa, Homo Sapiens
PQTPQDSRQ

SEQ ID NO: 152912 - protein, 9 aa, Homo Sapiens
RGLISGWAR

SEQ ID NO: 152913 - protein, 9 aa, Homo Sapiens
AQNFPEILC

SEQ ID NO: 152914 - protein, 9 aa, Homo Sapiens
ICDNKSFAE

SEQ ID NO: 152915 - protein, 9 aa, Homo Sapiens
PAGRIGGNF

SEQ ID NO: 152916 - protein, 9 aa, Homo Sapiens
VGQVVYRSL

SEQ ID NO: 152917 - protein, 9 aa, Homo Sapiens
HSSPPTGSW

SEQ ID NO: 152918 - protein, 9 aa, Homo Sapiens
RHKAFSACG

SEQ ID NO: 152919 - protein, 9 aa, Homo Sapiens
PSGMEDVGP

SEQ ID NO: 152920 - protein, 9 aa, Homo Sapiens
ELKDQSRRK

SEQ ID NO: 152921 - protein, 9 aa, Homo Sapiens
LGLKPTIEV

SEQ ID NO: 152922 - protein, 9 aa, Homo Sapiens
WRPHPPSST

SEQ ID NO: 152923 - protein, 9 aa, Homo Sapiens
SGLTPPNAA

SEQ ID NO: 152924 - protein, 9 aa, Homo Sapiens
TLPAPTACS

SEQ ID NO: 152925 - protein, 9 aa, Homo Sapiens
EAPSTRAAP

SEQ ID NO: 152926 - protein, 9 aa, Homo Sapiens
GCTARPLLA

SEQ ID NO: 152927 - protein, 9 aa, Homo Sapiens
ISGRQSPSP

SEQ ID NO: 152928 - protein, 9 aa, Homo Sapiens
KKSHPQLAE

SEQ ID NO: 152929 - protein, 9 aa, Homo Sapiens
DFANFVLQY

SEQ ID NO: 152930 - protein, 9 aa, Homo Sapiens
EKRNAGNTV

SEQ ID NO: 152931 - protein, 9 aa, Homo Sapiens
EEEQQPPPQ

SEQ ID NO: 152932 - protein, 9 aa, Homo Sapiens
PADVPVHLR

SEQ ID NO: 152933 - protein, 9 aa, Homo Sapiens
PSCRRERPR

SEQ ID NO: 152934 - protein, 9 aa, Homo Sapiens
RSPAPAPPL

SEQ ID NO: 152935 - protein, 9 aa, Homo Sapiens
SKKRCDKSD

SEQ ID NO: 152936 - protein, 9 aa, Homo Sapiens
PLVIIEKTY

SEQ ID NO: 152937 - protein, 9 aa, Homo Sapiens
GRTQRWAAG

SEQ ID NO: 152938 - protein, 9 aa, Homo Sapiens
FLRTPWTLN

SEQ ID NO: 152939 - protein, 9 aa, Homo Sapiens
ISATVQMGF

SEQ ID NO: 152940 - protein, 9 aa, Homo Sapiens
IAIKWMPPE

SEQ ID NO: 152941 - protein, 9 aa, Homo Sapiens
SKKLKEAKL

SEQ ID NO: 152942 - protein, 9 aa, Homo Sapiens
CVLTAFLLA

SEQ ID NO: 152943 - protein, 9 aa, Homo Sapiens
PSSTLTSGP

SEQ ID NO: 152944 - protein, 9 aa, Homo Sapiens
APHRRAPPG

SEQ ID NO: 152945 - protein, 9 aa, Homo Sapiens
LAKYVELDR

SEQ ID NO: 152946 - protein, 9 aa, Homo Sapiens
LGHHIGPRA

SEQ ID NO: 152947 - protein, 9 aa, Homo Sapiens
YEIFWGLRS

SEQ ID NO: 152948 - protein, 9 aa, Homo Sapiens
GAWGLLPGW

SEQ ID NO: 152949 - protein, 9 aa, Homo Sapiens
RMAGKGLKV

SEQ ID NO: 152950 - protein, 9 aa, Homo Sapiens
ANLLTGCLS

SEQ ID NO: 152951 - protein, 9 aa, Homo Sapiens
DRNKMKDTP

SEQ ID NO: 152952 - protein, 9 aa, Homo Sapiens
MPESSGHTM

SEQ ID NO: 152953 - protein, 9 aa, Homo Sapiens
MEFRQKGSQ

SEQ ID NO: 152954 - protein, 9 aa, Homo Sapiens
GPRQELARH

SEQ ID NO: 152955 - protein, 9 aa, Homo Sapiens
GLLHPLPLG

SEQ ID NO: 152956 - protein, 9 aa, Homo Sapiens
MCFMQEHTC

SEQ ID NO: 152957 - protein, 9 aa, Homo Sapiens
PLMTLTSSS

SEQ ID NO: 152958 - protein, 9 aa, Homo Sapiens
YRPAPYFAA

SEQ ID NO: 152959 - protein, 9 aa, Homo Sapiens
MDYEVTVST

SEQ ID NO: 152960 - protein, 9 aa, Homo Sapiens
KHISKGVHR

SEQ ID NO: 152961 - protein, 9 aa, Homo Sapiens
YLINPETLQ

SEQ ID NO: 152962 - protein, 9 aa, Homo Sapiens
VCQSGERST

SEQ ID NO: 152963 - protein, 9 aa, Homo Sapiens
IVAIHIPEL

SEQ ID NO: 152964 - protein, 9 aa, Homo Sapiens
RAQTHRKSW

SEQ ID NO: 152965 - protein, 9 aa, Homo Sapiens
MGMTVSKPD

SEQ ID NO: 152966 - protein, 9 aa, Homo Sapiens
LHKLQALTL

SEQ ID NO: 152967 - protein, 9 aa, Homo Sapiens
GGRGPAATS

SEQ ID NO: 152968 - protein, 9 aa, Homo Sapiens
VHQPPPARP

SEQ ID NO: 152969 - protein, 9 aa, Homo Sapiens
FWAILKGSS

SEQ ID NO: 152970 - protein, 9 aa, Homo Sapiens
VSLMPPLLL

SEQ ID NO: 152971 - protein, 9 aa, Homo Sapiens
HAEPYTCRA

SEQ ID NO: 152972 - protein, 9 aa, Homo Sapiens
VGLFPPPLP

SEQ ID NO: 152973 - protein, 9 aa, Homo Sapiens
SYGLPIVPF

SEQ ID NO: 152974 - protein, 9 aa, Homo Sapiens
GIKSPHEGY

SEQ ID NO: 152975 - protein, 9 aa, Homo Sapiens
SVRAKVLIT

SEQ ID NO: 152976 - protein, 9 aa, Homo Sapiens
VLSRPLQRP

SEQ ID NO: 152977 - protein, 9 aa, Homo Sapiens
LRMENGLWL

SEQ ID NO: 152978 - protein, 9 aa, Homo Sapiens
QTHTRPTRR

SEQ ID NO: 152979 - protein, 9 aa, Homo Sapiens
GSRLPPHHR

SEQ ID NO: 152980 - protein, 9 aa, Homo Sapiens
WASRAQTHR

SEQ ID NO: 152981 - protein, 9 aa, Homo Sapiens
AVVKKIHAK

SEQ ID NO: 152982 - protein, 9 aa, Homo Sapiens
VMLHLGRTQ

SEQ ID NO: 152983 - protein, 9 aa, Homo Sapiens
FIQAKGYRP

SEQ ID NO: 152984 - protein, 9 aa, Homo Sapiens
EELCLSKEC

SEQ ID NO: 152985 - protein, 9 aa, Homo Sapiens
KREKFVFRM

SEQ ID NO: 152986 - protein, 9 aa, Homo Sapiens
ELKKAVGAN

SEQ ID NO: 152987 - protein, 9 aa, Homo Sapiens
RGLGLQLAL

SEQ ID NO: 152988 - protein, 9 aa, Homo Sapiens
KTAYTTGAE

SEQ ID NO: 152989 - protein, 9 aa, Homo Sapiens
SDSKEGSYV

SEQ ID NO: 152990 - protein, 9 aa, Homo Sapiens
VNEGVWEKE

SEQ ID NO: 152991 - protein, 9 aa, Homo Sapiens
EVHLDEQCE

SEQ ID NO: 152992 - protein, 9 aa, Homo Sapiens
AITGEIRPR

SEQ ID NO: 152993 - protein, 9 aa, Homo Sapiens
CHHGGVFHF

SEQ ID NO: 152994 - protein, 9 aa, Homo Sapiens
LKSLMTKNP

SEQ ID NO: 152995 - protein, 9 aa, Homo Sapiens
DETRDSFQM

SEQ ID NO: 152996 - protein, 9 aa, Homo Sapiens
ARATALEQA

SEQ ID NO: 152997 - protein, 9 aa, Homo Sapiens
MAPDGNGAS

SEQ ID NO: 152998 - protein, 9 aa, Homo Sapiens
WSFQPASSH

SEQ ID NO: 152999 - protein, 9 aa, Homo Sapiens
GQALDKISA

SEQ ID NO: 153000 - protein, 9 aa, Homo Sapiens
KCYLHHWNY

SEQ ID NO: 153001 - protein, 9 aa, Homo Sapiens
SSQYIRELR

SEQ ID NO: 153002 - protein, 9 aa, Homo Sapiens
PPPRMAARY

SEQ ID NO: 153003 - protein, 9 aa, Homo Sapiens
PRAHRVQLL

SEQ ID NO: 153004 - protein, 9 aa, Homo Sapiens
YSNSETGSH

SEQ ID NO: 153005 - protein, 9 aa, Homo Sapiens
VASITTAAS

SEQ ID NO: 153006 - protein, 9 aa, Homo Sapiens
RGGGEGWGA

SEQ ID NO: 153007 - protein, 9 aa, Homo Sapiens
HMVSEGGPE

SEQ ID NO: 153008 - protein, 9 aa, Homo Sapiens
VKRMWHLST

SEQ ID NO: 153009 - protein, 9 aa, Homo Sapiens
IQSWAVSCV

SEQ ID NO: 153010 - protein, 9 aa, Homo Sapiens
GAGADDVLV

SEQ ID NO: 153011 - protein, 9 aa, Homo Sapiens
PTPKSTYES

SEQ ID NO: 153012 - protein, 9 aa, Homo Sapiens
KSVPHLHLV

SEQ ID NO: 153013 - protein, 9 aa, Homo Sapiens
FQLKTSLSA

SEQ ID NO: 153014 - protein, 9 aa, Homo Sapiens
GKDYCIFYN

SEQ ID NO: 153015 - protein, 9 aa, Homo Sapiens
YHTREVQIF

SEQ ID NO: 153016 - protein, 9 aa, Homo Sapiens
LPNQFRCVS

SEQ ID NO: 153017 - protein, 9 aa, Homo Sapiens
HRRSWLLGF

SEQ ID NO: 153018 - protein, 9 aa, Homo Sapiens
SFHSWTSCY

SEQ ID NO: 153019 - protein, 9 aa, Homo Sapiens
AGGPFQPLA

SEQ ID NO: 153020 - protein, 9 aa, Homo Sapiens
VLPSQALQL

SEQ ID NO: 153021 - protein, 9 aa, Homo Sapiens
WAVSCVEED

SEQ ID NO: 153022 - protein, 9 aa, Homo Sapiens
GPTPVPTAT

SEQ ID NO: 153023 - protein, 9 aa, Homo Sapiens
ASLTVAEAS

SEQ ID NO: 153024 - protein, 9 aa, Homo Sapiens
REPHPMSSP

SEQ ID NO: 153025 - protein, 9 aa, Homo Sapiens
PKTRSQEQD

SEQ ID NO: 153026 - protein, 9 aa, Homo Sapiens
ASLWNLVCN

SEQ ID NO: 153027 - protein, 9 aa, Homo Sapiens
RTPCSRLVL

SEQ ID NO: 153028 - protein, 9 aa, Homo Sapiens
GDIIPDYVL

SEQ ID NO: 153029 - protein, 9 aa, Homo Sapiens
NYVNVDPTF

SEQ ID NO: 153030 - protein, 9 aa, Homo Sapiens
AREKLTSSQ

SEQ ID NO: 153031 - protein, 9 aa, Homo Sapiens
SPSTPPTTG

SEQ ID NO: 153032 - protein, 9 aa, Homo Sapiens
QARKRYIRR

SEQ ID NO: 153033 - protein, 9 aa, Homo Sapiens
MFETDDGSK

SEQ ID NO: 153034 - protein, 9 aa, Homo Sapiens
PRPLTVMAV

SEQ ID NO: 153035 - protein, 9 aa, Homo Sapiens
PPGSLSITS

SEQ ID NO: 153036 - protein, 9 aa, Homo Sapiens
GCFMPDNID

SEQ ID NO: 153037 - protein, 9 aa, Homo Sapiens
APLNSWRSG

SEQ ID NO: 153038 - protein, 9 aa, Homo Sapiens
KMKHLNIVA

SEQ ID NO: 153039 - protein, 9 aa, Homo Sapiens
SSRYILSRE

SEQ ID NO: 153040 - protein, 9 aa, Homo Sapiens
QAGGPPRSR

SEQ ID NO: 153041 - protein, 9 aa, Homo Sapiens
TLLEYGADV

SEQ ID NO: 153042 - protein, 9 aa, Homo Sapiens
LLHRRAAHS

SEQ ID NO: 153043 - protein, 9 aa, Homo Sapiens
EKLLNSINV

SEQ ID NO: 153044 - protein, 9 aa, Homo Sapiens
CASTPTAEL

SEQ ID NO: 153045 - protein, 9 aa, Homo Sapiens
SLAWRKQHQ

SEQ ID NO: 153046 - protein, 9 aa, Homo Sapiens
LGTLADRER

SEQ ID NO: 153047 - protein, 9 aa, Homo Sapiens
ESEKFRISA

SEQ ID NO: 153048 - protein, 9 aa, Homo Sapiens
KGSLMALLS

SEQ ID NO: 153049 - protein, 9 aa, Homo Sapiens
PRLQPALLA

SEQ ID NO: 153050 - protein, 9 aa, Homo Sapiens
TLAPHPRPE

SEQ ID NO: 153051 - protein, 9 aa, Homo Sapiens
LPILFGSLR

SEQ ID NO: 153052 - protein, 9 aa, Homo Sapiens
ELIKREKFV

SEQ ID NO: 153053 - protein, 9 aa, Homo Sapiens
LSTTRPPTP

SEQ ID NO: 153054 - protein, 9 aa, Homo Sapiens
LHLGTLRGD

SEQ ID NO: 153055 - protein, 9 aa, Homo Sapiens
LNPIETPDL

SEQ ID NO: 153056 - protein, 9 aa, Homo Sapiens
EERSDSSSL

SEQ ID NO: 153057 - protein, 9 aa, Homo Sapiens
HSQSLSHLL

SEQ ID NO: 153058 - protein, 9 aa, Homo Sapiens
VHQLLVLTQ

SEQ ID NO: 153059 - protein, 9 aa, Homo Sapiens
NTHVLHPRL

SEQ ID NO: 153060 - protein, 9 aa, Homo Sapiens
KFWAILKGS

SEQ ID NO: 153061 - protein, 9 aa, Homo Sapiens
RPPTTPTPP

SEQ ID NO: 153062 - protein, 9 aa, Homo Sapiens
VHPPLDIGE

SEQ ID NO: 153063 - protein, 9 aa, Homo Sapiens
EQFLTWILN

SEQ ID NO: 153064 - protein, 9 aa, Homo Sapiens
WSSSGAGKS

SEQ ID NO: 153065 - protein, 9 aa, Homo Sapiens
LILNAKNLS

SEQ ID NO: 153066 - protein, 9 aa, Homo Sapiens
AASLCVSTP

SEQ ID NO: 153067 - protein, 9 aa, Homo Sapiens
AVEAANMGD

SEQ ID NO: 153068 - protein, 9 aa, Homo Sapiens
SILLCSRSL

SEQ ID NO: 153069 - protein, 9 aa, Homo Sapiens
FFDEIQQWH

SEQ ID NO: 153070 - protein, 9 aa, Homo Sapiens
RNWRDIYKA

SEQ ID NO: 153071 - protein, 9 aa, Homo Sapiens
AARPRPASQ

SEQ ID NO: 153072 - protein, 9 aa, Homo Sapiens
RHLWRPDVK

SEQ ID NO: 153073 - protein, 9 aa, Homo Sapiens
GDRGQPGLQ

SEQ ID NO: 153074 - protein, 9 aa, Homo Sapiens
LEVSGSRCL

SEQ ID NO: 153075 - protein, 9 aa, Homo Sapiens
RPALLKLGV

SEQ ID NO: 153076 - protein, 9 aa, Homo Sapiens
RRSSNKPLR

SEQ ID NO: 153077 - protein, 9 aa, Homo Sapiens
PPASEAPPR

SEQ ID NO: 153078 - protein, 9 aa, Homo Sapiens
GRSARMSSW

SEQ ID NO: 153079 - protein, 9 aa, Homo Sapiens
MPPLLLGLA

SEQ ID NO: 153080 - protein, 9 aa, Homo Sapiens
TRPLHRTTN

SEQ ID NO: 153081 - protein, 9 aa, Homo Sapiens
EEMASQLGR

SEQ ID NO: 153082 - protein, 9 aa, Homo Sapiens
ASQEAKQNV

SEQ ID NO: 153083 - protein, 9 aa, Homo Sapiens
AWGDWVASP

SEQ ID NO: 153084 - protein, 9 aa, Homo Sapiens
LAVNEAIKK

SEQ ID NO: 153085 - protein, 9 aa, Homo Sapiens
SPADTSAQS

SEQ ID NO: 153086 - protein, 9 aa, Homo Sapiens
VIGKDEDFK

SEQ ID NO: 153087 - protein, 9 aa, Homo Sapiens
ETGSHQQLM

SEQ ID NO: 153088 - protein, 9 aa, Homo Sapiens
TAGPGEERV

SEQ ID NO: 153089 - protein, 9 aa, Homo Sapiens
LQGHLFSME

SEQ ID NO: 153090 - protein, 9 aa, Homo Sapiens
PEPRDGIES

SEQ ID NO: 153091 - protein, 9 aa, Homo Sapiens
EKYQCQAPS

SEQ ID NO: 153092 - protein, 9 aa, Homo Sapiens
MKKIFGDAS

SEQ ID NO: 153093 - protein, 9 aa, Homo Sapiens
RRAPSLKAP

SEQ ID NO: 153094 - protein, 9 aa, Homo Sapiens
LFFRFGILQ

SEQ ID NO: 153095 - protein, 9 aa, Homo Sapiens
LSQDTCLRT

SEQ ID NO: 153096 - protein, 9 aa, Homo Sapiens
GNGMKDVPA

SEQ ID NO: 153097 - protein, 9 aa, Homo Sapiens
SSQYSSGLR

SEQ ID NO: 153098 - protein, 9 aa, Homo Sapiens
PKPQGTAFP

SEQ ID NO: 153099 - protein, 9 aa, Homo Sapiens
LSTTQDETR

SEQ ID NO: 153100 - protein, 9 aa, Homo Sapiens
VVRCRSLTG

SEQ ID NO: 153101 - protein, 9 aa, Homo Sapiens
THTHTGIHT

SEQ ID NO: 153102 - protein, 9 aa, Homo Sapiens
GPLQGGLQL

SEQ ID NO: 153103 - protein, 9 aa, Homo Sapiens
FNLSYDKIF

SEQ ID NO: 153104 - protein, 9 aa, Homo Sapiens
SGPSPARSA

SEQ ID NO: 153105 - protein, 9 aa, Homo Sapiens
NTVRSAMKS

SEQ ID NO: 153106 - protein, 9 aa, Homo Sapiens
SPALRARGG

SEQ ID NO: 153107 - protein, 9 aa, Homo Sapiens
YKHKGLAET

SEQ ID NO: 153108 - protein, 9 aa, Homo Sapiens
LEQLRWEKI

SEQ ID NO: 153109 - protein, 9 aa, Homo Sapiens
SDAPLEALT

SEQ ID NO: 153110 - protein, 9 aa, Homo Sapiens
WSTAACAES

SEQ ID NO: 153111 - protein, 9 aa, Homo Sapiens
DTLLNFLVC

SEQ ID NO: 153112 - protein, 9 aa, Homo Sapiens
RRMGRLAAP

SEQ ID NO: 153113 - protein, 9 aa, Homo Sapiens
KAQNFPEIL

SEQ ID NO: 153114 - protein, 9 aa, Homo Sapiens
DSVASPPPS

SEQ ID NO: 153115 - protein, 9 aa, Homo Sapiens
PHDDFVADG

SEQ ID NO: 153116 - protein, 9 aa, Homo Sapiens
VLPTVSGKH

SEQ ID NO: 153117 - protein, 9 aa, Homo Sapiens
SCRLQLRSQ

SEQ ID NO: 153118 - protein, 9 aa, Homo Sapiens
SLRPSKLDF

SEQ ID NO: 153119 - protein, 9 aa, Homo Sapiens
PPGADQHGL

SEQ ID NO: 153120 - protein, 9 aa, Homo Sapiens
LSVGTSKGL

SEQ ID NO: 153121 - protein, 9 aa, Homo Sapiens
SRSVTDKIL

SEQ ID NO: 153122 - protein, 9 aa, Homo Sapiens
QAREQTRNE

SEQ ID NO: 153123 - protein, 9 aa, Homo Sapiens
DQKIVLHPG

SEQ ID NO: 153124 - protein, 9 aa, Homo Sapiens
DWITQAKDI

SEQ ID NO: 153125 - protein, 9 aa, Homo Sapiens
PSPAPSAGR

SEQ ID NO: 153126 - protein, 9 aa, Homo Sapiens
EEHGEISSC

SEQ ID NO: 153127 - protein, 9 aa, Homo Sapiens
GQTFGVAEK

SEQ ID NO: 153128 - protein, 9 aa, Homo Sapiens
EYMHGGKKN

SEQ ID NO: 153129 - protein, 9 aa, Homo Sapiens
KPGLVCTTT

SEQ ID NO: 153130 - protein, 9 aa, Homo Sapiens
LVAVLTHVL

SEQ ID NO: 153131 - protein, 9 aa, Homo Sapiens
SNPCMEENK

SEQ ID NO: 153132 - protein, 9 aa, Homo Sapiens
PDPCRAPPP

SEQ ID NO: 153133 - protein, 9 aa, Homo Sapiens
PPMGRPSNF

SEQ ID NO: 153134 - protein, 9 aa, Homo Sapiens
MGSLSLLPD

SEQ ID NO: 153135 - protein, 9 aa, Homo Sapiens
RTRGLISGW

SEQ ID NO: 153136 - protein, 9 aa, Homo Sapiens
GSRLPGLPQ

SEQ ID NO: 153137 - protein, 9 aa, Homo Sapiens
LSNHLESKQ

SEQ ID NO: 153138 - protein, 9 aa, Homo Sapiens
LQPRGPPLP

SEQ ID NO: 153139 - protein, 9 aa, Homo Sapiens
KTEEAWRKL

SEQ ID NO: 153140 - protein, 9 aa, Homo Sapiens
QTRHEEIFY

SEQ ID NO: 153141 - protein, 9 aa, Homo Sapiens
RMHTVPLDA

SEQ ID NO: 153142 - protein, 9 aa, Homo Sapiens
GRLRPEQDT

SEQ ID NO: 153143 - protein, 9 aa, Homo Sapiens
RISSCLRVH

SEQ ID NO: 153144 - protein, 9 aa, Homo Sapiens
PRPPPASKN

SEQ ID NO: 153145 - protein, 9 aa, Homo Sapiens
DQGGGQTLM

SEQ ID NO: 153146 - protein, 9 aa, Homo Sapiens
NGLEVVGKG

SEQ ID NO: 153147 - protein, 9 aa, Homo Sapiens
VHCALHSPP

SEQ ID NO: 153148 - protein, 9 aa, Homo Sapiens
PTGCRALEE

SEQ ID NO: 153149 - protein, 9 aa, Homo Sapiens
LEEYMVYMK

SEQ ID NO: 153150 - protein, 9 aa, Homo Sapiens
GFGGARSGF

SEQ ID NO: 153151 - protein, 9 aa, Homo Sapiens
YTELIAVNA

SEQ ID NO: 153152 - protein, 9 aa, Homo Sapiens
GSSCLQTSN

SEQ ID NO: 153153 - protein, 9 aa, Homo Sapiens
VWEEVEVLK

SEQ ID NO: 153154 - protein, 9 aa, Homo Sapiens
NGATGSVQP

SEQ ID NO: 153155 - protein, 9 aa, Homo Sapiens
ASAPCWAPA

SEQ ID NO: 153156 - protein, 9 aa, Homo Sapiens
KSPPPPPTF

SEQ ID NO: 153157 - protein, 9 aa, Homo Sapiens
FTQMDLGDC

SEQ ID NO: 153158 - protein, 9 aa, Homo Sapiens
LHLIHGLFS

SEQ ID NO: 153159 - protein, 9 aa, Homo Sapiens
LSMTFVYRD

SEQ ID NO: 153160 - protein, 9 aa, Homo Sapiens
ANMGDVEAF

SEQ ID NO: 153161 - protein, 9 aa, Homo Sapiens
DPGVAGDVE

SEQ ID NO: 153162 - protein, 9 aa, Homo Sapiens
MKNGEAARE

SEQ ID NO: 153163 - protein, 9 aa, Homo Sapiens
RIALNSALL

SEQ ID NO: 153164 - protein, 9 aa, Homo Sapiens
GSYLENAFP

SEQ ID NO: 153165 - protein, 9 aa, Homo Sapiens
LFPDVFICD

SEQ ID NO: 153166 - protein, 9 aa, Homo Sapiens
PFQCRICMH

SEQ ID NO: 153167 - protein, 9 aa, Homo Sapiens
PRSRWRHPL

SEQ ID NO: 153168 - protein, 9 aa, Homo Sapiens
VARKHSGTD

SEQ ID NO: 153169 - protein, 9 aa, Homo Sapiens
GVRVKLAHL

SEQ ID NO: 153170 - protein, 9 aa, Homo Sapiens
ESLQQQQQQ

SEQ ID NO: 153171 - protein, 9 aa, Homo Sapiens
CSHLVSDLL

SEQ ID NO: 153172 - protein, 9 aa, Homo Sapiens
VNINNSDCI

SEQ ID NO: 153173 - protein, 9 aa, Homo Sapiens
VFVYAITSE

SEQ ID NO: 153174 - protein, 9 aa, Homo Sapiens
CSLQAAVIL

SEQ ID NO: 153175 - protein, 9 aa, Homo Sapiens
HRRRLRAGQ

SEQ ID NO: 153176 - protein, 9 aa, Homo Sapiens
HTRGVSRRP

SEQ ID NO: 153177 - protein, 9 aa, Homo Sapiens
DDVLVVGTT

SEQ ID NO: 153178 - protein, 9 aa, Homo Sapiens
AQLTAQLPP

SEQ ID NO: 153179 - protein, 9 aa, Homo Sapiens
FRPSTARVI

SEQ ID NO: 153180 - protein, 9 aa, Homo Sapiens
SSSSREGPV

SEQ ID NO: 153181 - protein, 9 aa, Homo Sapiens
QQTIKKYCQ

SEQ ID NO: 153182 - protein, 9 aa, Homo Sapiens
AARSRDVAS

SEQ ID NO: 153183 - protein, 9 aa, Homo Sapiens
QVLQNYYTG

SEQ ID NO: 153184 - protein, 9 aa, Homo Sapiens
QPLEKLKQG

SEQ ID NO: 153185 - protein, 9 aa, Homo Sapiens
TQQPPSTLG

SEQ ID NO: 153186 - protein, 9 aa, Homo Sapiens
VIRFLTVIH

SEQ ID NO: 153187 - protein, 9 aa, Homo Sapiens
ATTDNTTTT

SEQ ID NO: 153188 - protein, 9 aa, Homo Sapiens
TLQLVHQLK

SEQ ID NO: 153189 - protein, 9 aa, Homo Sapiens
EITMRDEER

SEQ ID NO: 153190 - protein, 9 aa, Homo Sapiens
PIVPFEMVV

SEQ ID NO: 153191 - protein, 9 aa, Homo Sapiens
DNSYTFIDP

SEQ ID NO: 153192 - protein, 9 aa, Homo Sapiens
NSRLYESLT

SEQ ID NO: 153193 - protein, 9 aa, Homo Sapiens
AAAARQQQP

SEQ ID NO: 153194 - protein, 9 aa, Homo Sapiens
VVKMEFLSS

SEQ ID NO: 153195 - protein, 9 aa, Homo Sapiens
QLLEVVPLS

SEQ ID NO: 153196 - protein, 9 aa, Homo Sapiens
RGGACGQSC

SEQ ID NO: 153197 - protein, 9 aa, Homo Sapiens
QGNLLSWCY

SEQ ID NO: 153198 - protein, 9 aa, Homo Sapiens
SAWSLTSSL

SEQ ID NO: 153199 - protein, 9 aa, Homo Sapiens
THIHTEPTG

SEQ ID NO: 153200 - protein, 9 aa, Homo Sapiens
ARSGFGFGG

SEQ ID NO: 153201 - protein, 9 aa, Homo Sapiens
AKIISNNGH

SEQ ID NO: 153202 - protein, 9 aa, Homo Sapiens
QQKEEKTKE

SEQ ID NO: 153203 - protein, 9 aa, Homo Sapiens
FPYKPLDIP

SEQ ID NO: 153204 - protein, 9 aa, Homo Sapiens
ADDRVHEQG

SEQ ID NO: 153205 - protein, 9 aa, Homo Sapiens
LTIHSYGQL

SEQ ID NO: 153206 - protein, 9 aa, Homo Sapiens
GEKGIDGPP

SEQ ID NO: 153207 - protein, 9 aa, Homo Sapiens
RRCTVMVLG

SEQ ID NO: 153208 - protein, 9 aa, Homo Sapiens
TSRSGWPRT

SEQ ID NO: 153209 - protein, 9 aa, Homo Sapiens
LAMCRRLSF

SEQ ID NO: 153210 - protein, 9 aa, Homo Sapiens
QFHDKIDHI

SEQ ID NO: 153211 - protein, 9 aa, Homo Sapiens
ESESSSKSD

SEQ ID NO: 153212 - protein, 9 aa, Homo Sapiens
HVLSVFELL

SEQ ID NO: 153213 - protein, 9 aa, Homo Sapiens
QPMELIDGS

SEQ ID NO: 153214 - protein, 9 aa, Homo Sapiens
AAALDEGRT

SEQ ID NO: 153215 - protein, 9 aa, Homo Sapiens
EPLKCNFDW

SEQ ID NO: 153216 - protein, 9 aa, Homo Sapiens
QQPQTPQDS

SEQ ID NO: 153217 - protein, 9 aa, Homo Sapiens
TDEEKRLMA

SEQ ID NO: 153218 - protein, 9 aa, Homo Sapiens
RYQESLGLS

SEQ ID NO: 153219 - protein, 9 aa, Homo Sapiens
GHFGPFCDP

SEQ ID NO: 153220 - protein, 9 aa, Homo Sapiens
PGLVCTTTP

SEQ ID NO: 153221 - protein, 9 aa, Homo Sapiens
LSQRPSLAV

SEQ ID NO: 153222 - protein, 9 aa, Homo Sapiens
YDLQGHLFS

SEQ ID NO: 153223 - protein, 9 aa, Homo Sapiens
QGRCWKRTS

SEQ ID NO: 153224 - protein, 9 aa, Homo Sapiens
LIWKNYKKV

SEQ ID NO: 153225 - protein, 9 aa, Homo Sapiens
HLQNDPQLP

SEQ ID NO: 153226 - protein, 9 aa, Homo Sapiens
PSHYDGCRV

SEQ ID NO: 153227 - protein, 9 aa, Homo Sapiens
RHQLKGGNG

SEQ ID NO: 153228 - protein, 9 aa, Homo Sapiens
VLFWDASGV

SEQ ID NO: 153229 - protein, 9 aa, Homo Sapiens
LGREPHSPP

SEQ ID NO: 153230 - protein, 9 aa, Homo Sapiens
PCRSTDFTS

SEQ ID NO: 153231 - protein, 9 aa, Homo Sapiens
HCKSLPPSP

SEQ ID NO: 153232 - protein, 9 aa, Homo Sapiens
SPKELPPEI

SEQ ID NO: 153233 - protein, 9 aa, Homo Sapiens
CRRERPRRA

SEQ ID NO: 153234 - protein, 9 aa, Homo Sapiens
KTGASSCAS

SEQ ID NO: 153235 - protein, 9 aa, Homo Sapiens
PAATRAAAR

SEQ ID NO: 153236 - protein, 9 aa, Homo Sapiens
LVALLNIRF

SEQ ID NO: 153237 - protein, 9 aa, Homo Sapiens
LHNRNAPRD

SEQ ID NO: 153238 - protein, 9 aa, Homo Sapiens
ILLSILWTC

SEQ ID NO: 153239 - protein, 9 aa, Homo Sapiens
PPHHRRRLR

SEQ ID NO: 153240 - protein, 9 aa, Homo Sapiens
MVICDPLHY

SEQ ID NO: 153241 - protein, 9 aa, Homo Sapiens
MYAVGMGKA

SEQ ID NO: 153242 - protein, 9 aa, Homo Sapiens
SWGRRRRMH

SEQ ID NO: 153243 - protein, 9 aa, Homo Sapiens
WHRIAQCLN

SEQ ID NO: 153244 - protein, 9 aa, Homo Sapiens
HWKNVYLKA

SEQ ID NO: 153245 - protein, 9 aa, Homo Sapiens
RLQGPEEGR

SEQ ID NO: 153246 - protein, 9 aa, Homo Sapiens
RQTHTVIHT

SEQ ID NO: 153247 - protein, 9 aa, Homo Sapiens
QQPVGRVRH

SEQ ID NO: 153248 - protein, 9 aa, Homo Sapiens
GIKPSPVPP

SEQ ID NO: 153249 - protein, 9 aa, Homo Sapiens
AKLPIEPHF

SEQ ID NO: 153250 - protein, 9 aa, Homo Sapiens
EKKHSHKQV

SEQ ID NO: 153251 - protein, 9 aa, Homo Sapiens
PLQPQATGR

SEQ ID NO: 153252 - protein, 9 aa, Homo Sapiens
QNNDTSELR

SEQ ID NO: 153253 - protein, 9 aa, Homo Sapiens
WRGRWRVGD

SEQ ID NO: 153254 - protein, 9 aa, Homo Sapiens
RVQKEGLSP

SEQ ID NO: 153255 - protein, 9 aa, Homo Sapiens
FLLKSTHLL

SEQ ID NO: 153256 - protein, 9 aa, Homo Sapiens
TIHSYGQLI

SEQ ID NO: 153257 - protein, 9 aa, Homo Sapiens
SRRHSHSWI

SEQ ID NO: 153258 - protein, 9 aa, Homo Sapiens
PDAVLKEGL

SEQ ID NO: 153259 - protein, 9 aa, Homo Sapiens
LTAKKKALF

SEQ ID NO: 153260 - protein, 9 aa, Homo Sapiens
QPCLECPSW

SEQ ID NO: 153261 - protein, 9 aa, Homo Sapiens
RSPQAPLRL

SEQ ID NO: 153262 - protein, 9 aa, Homo Sapiens
RILYLQALD

SEQ ID NO: 153263 - protein, 9 aa, Homo Sapiens
GKCCVSGVV

SEQ ID NO: 153264 - protein, 9 aa, Homo Sapiens
AAQKCHKKT

SEQ ID NO: 153265 - protein, 9 aa, Homo Sapiens
LADPLVQGG

SEQ ID NO: 153266 - protein, 9 aa, Homo Sapiens
PPSTARSRG

SEQ ID NO: 153267 - protein, 9 aa, Homo Sapiens
TFSYYQIFF

SEQ ID NO: 153268 - protein, 9 aa, Homo Sapiens
NMMVFLADE

SEQ ID NO: 153269 - protein, 9 aa, Homo Sapiens
GQTEGEEEK

SEQ ID NO: 153270 - protein, 9 aa, Homo Sapiens
ARQQGRLLI

SEQ ID NO: 153271 - protein, 9 aa, Homo Sapiens
STAATTAAG

SEQ ID NO: 153272 - protein, 9 aa, Homo Sapiens
QLLNDYGPP

SEQ ID NO: 153273 - protein, 9 aa, Homo Sapiens
FSAKCGEGP

SEQ ID NO: 153274 - protein, 9 aa, Homo Sapiens
RQPGPPCRP

SEQ ID NO: 153275 - protein, 9 aa, Homo Sapiens
QSCGLVAQQ

SEQ ID NO: 153276 - protein, 9 aa, Homo Sapiens
CDTFHLRCT

SEQ ID NO: 153277 - protein, 9 aa, Homo Sapiens
EEYMVYMKH

SEQ ID NO: 153278 - protein, 9 aa, Homo Sapiens
RANEKTLLS

SEQ ID NO: 153279 - protein, 9 aa, Homo Sapiens
QQTTSIPSI

SEQ ID NO: 153280 - protein, 9 aa, Homo Sapiens
GCGTGTSGT

SEQ ID NO: 153281 - protein, 9 aa, Homo Sapiens
RDRSKARSL

SEQ ID NO: 153282 - protein, 9 aa, Homo Sapiens
RAREKLTSS

SEQ ID NO: 153283 - protein, 9 aa, Homo Sapiens
VLIVAIHIP

SEQ ID NO: 153284 - protein, 9 aa, Homo Sapiens
GQNGVLSTP

SEQ ID NO: 153285 - protein, 9 aa, Homo Sapiens
VLEKYYEAS

SEQ ID NO: 153286 - protein, 9 aa, Homo Sapiens
KFQEIINHS

SEQ ID NO: 153287 - protein, 9 aa, Homo Sapiens
LHPNSSAWF

SEQ ID NO: 153288 - protein, 9 aa, Homo Sapiens
STILINPEN

SEQ ID NO: 153289 - protein, 9 aa, Homo Sapiens
RPPCSSTST

SEQ ID NO: 153290 - protein, 9 aa, Homo Sapiens
ELIQSDENG

SEQ ID NO: 153291 - protein, 9 aa, Homo Sapiens
HKENNISKC

SEQ ID NO: 153292 - protein, 9 aa, Homo Sapiens
APPCRPRVT

SEQ ID NO: 153293 - protein, 9 aa, Homo Sapiens
GVVDVNATA

SEQ ID NO: 153294 - protein, 9 aa, Homo Sapiens
KAKKSTDKD

SEQ ID NO: 153295 - protein, 9 aa, Homo Sapiens
ELALVGPHA

SEQ ID NO: 153296 - protein, 9 aa, Homo Sapiens
VGWQLVGLA

SEQ ID NO: 153297 - protein, 9 aa, Homo Sapiens
CGCTARPLL

SEQ ID NO: 153298 - protein, 9 aa, Homo Sapiens
TYLNYECCP

SEQ ID NO: 153299 - protein, 9 aa, Homo Sapiens
QKKWVHSLP

SEQ ID NO: 153300 - protein, 9 aa, Homo Sapiens
NFFFDGMKG

SEQ ID NO: 153301 - protein, 9 aa, Homo Sapiens
QMSEKKRLS

SEQ ID NO: 153302 - protein, 9 aa, Homo Sapiens
YHPGIFRGD

SEQ ID NO: 153303 - protein, 9 aa, Homo Sapiens
MITALIVFG

SEQ ID NO: 153304 - protein, 9 aa, Homo Sapiens
GGSWSSASG

SEQ ID NO: 153305 - protein, 9 aa, Homo Sapiens
FGLATEKSR

SEQ ID NO: 153306 - protein, 9 aa, Homo Sapiens
NNTCNILCG

SEQ ID NO: 153307 - protein, 9 aa, Homo Sapiens
NGFSNLVRL

SEQ ID NO: 153308 - protein, 9 aa, Homo Sapiens
LVLTEIAPI

SEQ ID NO: 153309 - protein, 9 aa, Homo Sapiens
IIIGAVTAQ

SEQ ID NO: 153310 - protein, 9 aa, Homo Sapiens
PIVPVKKIP

SEQ ID NO: 153311 - protein, 9 aa, Homo Sapiens
ERAGRTALA

SEQ ID NO: 153312 - protein, 9 aa, Homo Sapiens
DVREPRKII

SEQ ID NO: 153313 - protein, 9 aa, Homo Sapiens
SAPDDQGPW

SEQ ID NO: 153314 - protein, 9 aa, Homo Sapiens
KVQVSPGLL

SEQ ID NO: 153315 - protein, 9 aa, Homo Sapiens
PPLPAPPSA

SEQ ID NO: 153316 - protein, 9 aa, Homo Sapiens
LEEIEEKTH

SEQ ID NO: 153317 - protein, 9 aa, Homo Sapiens
KVANVAGVW

SEQ ID NO: 153318 - protein, 9 aa, Homo Sapiens
LHGGRPLGH

SEQ ID NO: 153319 - protein, 9 aa, Homo Sapiens
GGGEGMLHH

SEQ ID NO: 153320 - protein, 9 aa, Homo Sapiens
QDEVLHLIH

SEQ ID NO: 153321 - protein, 9 aa, Homo Sapiens
REISADFHV

SEQ ID NO: 153322 - protein, 9 aa, Homo Sapiens
GVCGYLFLS

SEQ ID NO: 153323 - protein, 9 aa, Homo Sapiens
SNKKISVLS

SEQ ID NO: 153324 - protein, 9 aa, Homo Sapiens
DRMVKHQCC

SEQ ID NO: 153325 - protein, 9 aa, Homo Sapiens
LLRRPCLPL

SEQ ID NO: 153326 - protein, 9 aa, Homo Sapiens
NYSTLQISQ

SEQ ID NO: 153327 - protein, 9 aa, Homo Sapiens
AIYRRHRGA

SEQ ID NO: 153328 - protein, 9 aa, Homo Sapiens
EKNSPFGSS

SEQ ID NO: 153329 - protein, 9 aa, Homo Sapiens
GPTRPLHRT

SEQ ID NO: 153330 - protein, 9 aa, Homo Sapiens
PKNGRFALA

SEQ ID NO: 153331 - protein, 9 aa, Homo Sapiens
SGILAIASL

SEQ ID NO: 153332 - protein, 9 aa, Homo Sapiens
TNVKNVTKP

SEQ ID NO: 153333 - protein, 9 aa, Homo Sapiens
PDVKVLRWI

SEQ ID NO: 153334 - protein, 9 aa, Homo Sapiens
CCPRAPEVP

SEQ ID NO: 153335 - protein, 9 aa, Homo Sapiens
NDYGPPSLG

SEQ ID NO: 153336 - protein, 9 aa, Homo Sapiens
RSSSRTACG

SEQ ID NO: 153337 - protein, 9 aa, Homo Sapiens
GLLVAPRPA

SEQ ID NO: 153338 - protein, 9 aa, Homo Sapiens
SSVVRCRSL

SEQ ID NO: 153339 - protein, 9 aa, Homo Sapiens
SSWSQTSCF

SEQ ID NO: 153340 - protein, 9 aa, Homo Sapiens
GPSPAPSAG

SEQ ID NO: 153341 - protein, 9 aa, Homo Sapiens
LRSRSSRRH

SEQ ID NO: 153342 - protein, 9 aa, Homo Sapiens
KTEDVVLKK

SEQ ID NO: 153343 - protein, 9 aa, Homo Sapiens
WRTRACTPA

SEQ ID NO: 153344 - protein, 9 aa, Homo Sapiens
GLKHFGAAS

SEQ ID NO: 153345 - protein, 9 aa, Homo Sapiens
YLAACRMHP

SEQ ID NO: 153346 - protein, 9 aa, Homo Sapiens
TLPILFGSL

SEQ ID NO: 153347 - protein, 9 aa, Homo Sapiens
ISAEKAEVG

SEQ ID NO: 153348 - protein, 9 aa, Homo Sapiens
HEAYCLQFL

SEQ ID NO: 153349 - protein, 9 aa, Homo Sapiens
QQWTKETNC

SEQ ID NO: 153350 - protein, 9 aa, Homo Sapiens
LCVETSSWT

SEQ ID NO: 153351 - protein, 9 aa, Homo Sapiens
ELCLSKECV

SEQ ID NO: 153352 - protein, 9 aa, Homo Sapiens
QNPPNHPSQ

SEQ ID NO: 153353 - protein, 9 aa, Homo Sapiens
FVGVDSLDM

SEQ ID NO: 153354 - protein, 9 aa, Homo Sapiens
ISRANEKTL

SEQ ID NO: 153355 - protein, 9 aa, Homo Sapiens
GAKLPCYEA

SEQ ID NO: 153356 - protein, 9 aa, Homo Sapiens
DAPCRHRRL

SEQ ID NO: 153357 - protein, 9 aa, Homo Sapiens
TPPSITPSS

SEQ ID NO: 153358 - protein, 9 aa, Homo Sapiens
QKPKLHLAA

SEQ ID NO: 153359 - protein, 9 aa, Homo Sapiens
VVVRNTQID

SEQ ID NO: 153360 - protein, 9 aa, Homo Sapiens
PPELHPLPL

SEQ ID NO: 153361 - protein, 9 aa, Homo Sapiens
PPGADVTGG

SEQ ID NO: 153362 - protein, 9 aa, Homo Sapiens
GPGWEEASQ

SEQ ID NO: 153363 - protein, 9 aa, Homo Sapiens
RAKMLHRIL

SEQ ID NO: 153364 - protein, 9 aa, Homo Sapiens
PLRGDPGVI

SEQ ID NO: 153365 - protein, 9 aa, Homo Sapiens
VELDREDDF

SEQ ID NO: 153366 - protein, 9 aa, Homo Sapiens
QELNEYLAE

SEQ ID NO: 153367 - protein, 9 aa, Homo Sapiens
VSLWFAEGR

SEQ ID NO: 153368 - protein, 9 aa, Homo Sapiens
RAGDLPCAS

SEQ ID NO: 153369 - protein, 9 aa, Homo Sapiens
NGPFSRPHP

SEQ ID NO: 153370 - protein, 9 aa, Homo Sapiens
QVHPDSRGP

SEQ ID NO: 153371 - protein, 9 aa, Homo Sapiens
QERYHSLVP

SEQ ID NO: 153372 - protein, 9 aa, Homo Sapiens
SAGCDPRRA

SEQ ID NO: 153373 - protein, 9 aa, Homo Sapiens
KRETECVVR

SEQ ID NO: 153374 - protein, 9 aa, Homo Sapiens
HNAVPTVFT

SEQ ID NO: 153375 - protein, 9 aa, Homo Sapiens
MSYVHPHAL

SEQ ID NO: 153376 - protein, 9 aa, Homo Sapiens
IVPFEMVVE

SEQ ID NO: 153377 - protein, 9 aa, Homo Sapiens
VASWSADRF

SEQ ID NO: 153378 - protein, 9 aa, Homo Sapiens
TSGLPHGLW

SEQ ID NO: 153379 - protein, 9 aa, Homo Sapiens
LALQQLPVG

SEQ ID NO: 153380 - protein, 9 aa, Homo Sapiens
QKFLKYSVD

SEQ ID NO: 153381 - protein, 9 aa, Homo Sapiens
NELMRWGLH

SEQ ID NO: 153382 - protein, 9 aa, Homo Sapiens
ERVWFSDKV

SEQ ID NO: 153383 - protein, 9 aa, Homo Sapiens
ASYANLLTG

SEQ ID NO: 153384 - protein, 9 aa, Homo Sapiens
TEIQLTMND

SEQ ID NO: 153385 - protein, 9 aa, Homo Sapiens
VQQKIEPHH

SEQ ID NO: 153386 - protein, 9 aa, Homo Sapiens
QGGRGRLQQ

SEQ ID NO: 153387 - protein, 9 aa, Homo Sapiens
TATTDNTTT

SEQ ID NO: 153388 - protein, 9 aa, Homo Sapiens
PCASLLSTL

SEQ ID NO: 153389 - protein, 9 aa, Homo Sapiens
VTTSTHRPA

SEQ ID NO: 153390 - protein, 9 aa, Homo Sapiens
VDRSGEAPS

SEQ ID NO: 153391 - protein, 9 aa, Homo Sapiens
RFTRNLPSG

SEQ ID NO: 153392 - protein, 9 aa, Homo Sapiens
GQWGPPRAR

SEQ ID NO: 153393 - protein, 9 aa, Homo Sapiens
NSAKIVDGP

SEQ ID NO: 153394 - protein, 9 aa, Homo Sapiens
QNKKRQTLR

SEQ ID NO: 153395 - protein, 9 aa, Homo Sapiens
DINSAAKVV

SEQ ID NO: 153396 - protein, 9 aa, Homo Sapiens
GSTRAAADP

SEQ ID NO: 153397 - protein, 9 aa, Homo Sapiens
LVGRCFLEK

SEQ ID NO: 153398 - protein, 9 aa, Homo Sapiens
RRNYTHALD

SEQ ID NO: 153399 - protein, 9 aa, Homo Sapiens
PVPLRIHFC

SEQ ID NO: 153400 - protein, 9 aa, Homo Sapiens
HTLAWNNTC

SEQ ID NO: 153401 - protein, 9 aa, Homo Sapiens
TTRTSCIPR

SEQ ID NO: 153402 - protein, 9 aa, Homo Sapiens
GSCEVTLSR

SEQ ID NO: 153403 - protein, 9 aa, Homo Sapiens
WLDFLKVAV

SEQ ID NO: 153404 - protein, 9 aa, Homo Sapiens
HMILVLCTA

SEQ ID NO: 153405 - protein, 9 aa, Homo Sapiens
VPPPPLLKL

SEQ ID NO: 153406 - protein, 9 aa, Homo Sapiens
RKECVLLDY

SEQ ID NO: 153407 - protein, 9 aa, Homo Sapiens
PSCLMDSAW

SEQ ID NO: 153408 - protein, 9 aa, Homo Sapiens
PSSRPSTGS

SEQ ID NO: 153409 - protein, 9 aa, Homo Sapiens
RTGLACGLP

SEQ ID NO: 153410 - protein, 9 aa, Homo Sapiens
RAGSSRPTV

SEQ ID NO: 153411 - protein, 9 aa, Homo Sapiens
FRAPGTLLH

SEQ ID NO: 153412 - protein, 9 aa, Homo Sapiens
IPQCWVLNF

SEQ ID NO: 153413 - protein, 9 aa, Homo Sapiens
SLILFQKKI

SEQ ID NO: 153414 - protein, 9 aa, Homo Sapiens
ISNTDNIPP

SEQ ID NO: 153415 - protein, 9 aa, Homo Sapiens
VLRHVAGEG

SEQ ID NO: 153416 - protein, 9 aa, Homo Sapiens
SRGPRTPRS

SEQ ID NO: 153417 - protein, 9 aa, Homo Sapiens
LHLIHECPH

SEQ ID NO: 153418 - protein, 9 aa, Homo Sapiens
AARPPPAAR

SEQ ID NO: 153419 - protein, 9 aa, Homo Sapiens
TPSPASGST

SEQ ID NO: 153420 - protein, 9 aa, Homo Sapiens
PPQPSSGRE

SEQ ID NO: 153421 - protein, 9 aa, Homo Sapiens
RRKRSRTQG

SEQ ID NO: 153422 - protein, 9 aa, Homo Sapiens
LNPRGVVHR

SEQ ID NO: 153423 - protein, 9 aa, Homo Sapiens
TSQSQLSSE

SEQ ID NO: 153424 - protein, 9 aa, Homo Sapiens
KRAYRRQVL

SEQ ID NO: 153425 - protein, 9 aa, Homo Sapiens
QVKQESRDH

SEQ ID NO: 153426 - protein, 9 aa, Homo Sapiens
LRESTLRRH

SEQ ID NO: 153427 - protein, 9 aa, Homo Sapiens
PPGLEAEGW

SEQ ID NO: 153428 - protein, 9 aa, Homo Sapiens
VPHEIPMSM

SEQ ID NO: 153429 - protein, 9 aa, Homo Sapiens
LQGLSPCLT

SEQ ID NO: 153430 - protein, 9 aa, Homo Sapiens
EEDFQPFWQ

SEQ ID NO: 153431 - protein, 9 aa, Homo Sapiens
KRKHRSSTP

SEQ ID NO: 153432 - protein, 9 aa, Homo Sapiens
KNQKGQYRP

SEQ ID NO: 153433 - protein, 9 aa, Homo Sapiens
GAGAGAVPR

SEQ ID NO: 153434 - protein, 9 aa, Homo Sapiens
FQTLQLVHQ

SEQ ID NO: 153435 - protein, 9 aa, Homo Sapiens
CKEAVAAEE

SEQ ID NO: 153436 - protein, 9 aa, Homo Sapiens
QGAAVDPPW

SEQ ID NO: 153437 - protein, 9 aa, Homo Sapiens
AFMKKIFGD

SEQ ID NO: 153438 - protein, 9 aa, Homo Sapiens
KVKRQRKCL

SEQ ID NO: 153439 - protein, 9 aa, Homo Sapiens
VPRSGSEAG

SEQ ID NO: 153440 - protein, 9 aa, Homo Sapiens
PIFGKKHRI

SEQ ID NO: 153441 - protein, 9 aa, Homo Sapiens
AACDKELIK

SEQ ID NO: 153442 - protein, 9 aa, Homo Sapiens
ENCGHPKDA

SEQ ID NO: 153443 - protein, 9 aa, Homo Sapiens
SPSCLMDSA

SEQ ID NO: 153444 - protein, 9 aa, Homo Sapiens
RVKLAHLSK

SEQ ID NO: 153445 - protein, 9 aa, Homo Sapiens
PALPGTGGT

SEQ ID NO: 153446 - protein, 9 aa, Homo Sapiens
VLQGFSDAV

SEQ ID NO: 153447 - protein, 9 aa, Homo Sapiens
LPQLPGLPR

SEQ ID NO: 153448 - protein, 9 aa, Homo Sapiens
SSDPPTTII

SEQ ID NO: 153449 - protein, 9 aa, Homo Sapiens
QAFLLVNQH

SEQ ID NO: 153450 - protein, 9 aa, Homo Sapiens
EMEYGKLQQ

SEQ ID NO: 153451 - protein, 9 aa, Homo Sapiens
KLEREQEQQ

SEQ ID NO: 153452 - protein, 9 aa, Homo Sapiens
RRTDPTLLR

SEQ ID NO: 153453 - protein, 9 aa, Homo Sapiens
TYAAGGMVE

SEQ ID NO: 153454 - protein, 9 aa, Homo Sapiens
VWGPLRCSL

SEQ ID NO: 153455 - protein, 9 aa, Homo Sapiens
VKPNSRVLF

SEQ ID NO: 153456 - protein, 9 aa, Homo Sapiens
LRAARAHQR

SEQ ID NO: 153457 - protein, 9 aa, Homo Sapiens
VTVPHVTTA

SEQ ID NO: 153458 - protein, 9 aa, Homo Sapiens
PSWLSVSAA

SEQ ID NO: 153459 - protein, 9 aa, Homo Sapiens
QLRWEKIDL

SEQ ID NO: 153460 - protein, 9 aa, Homo Sapiens
RAAARRSGG

SEQ ID NO: 153461 - protein, 9 aa, Homo Sapiens
PKLQRRQFL

SEQ ID NO: 153462 - protein, 9 aa, Homo Sapiens
CPGGRPGQC

SEQ ID NO: 153463 - protein, 9 aa, Homo Sapiens
PILLSILWT

SEQ ID NO: 153464 - protein, 9 aa, Homo Sapiens
PKEDPEINP

SEQ ID NO: 153465 - protein, 9 aa, Homo Sapiens
DLPCASRAP

SEQ ID NO: 153466 - protein, 9 aa, Homo Sapiens
HTGEKPYVY

SEQ ID NO: 153467 - protein, 9 aa, Homo Sapiens
LPGGRLGAG

SEQ ID NO: 153468 - protein, 9 aa, Homo Sapiens
DKLYSRKYG

SEQ ID NO: 153469 - protein, 9 aa, Homo Sapiens
AQAPIPWLN

SEQ ID NO: 153470 - protein, 9 aa, Homo Sapiens
QLPNGITLD

SEQ ID NO: 153471 - protein, 9 aa, Homo Sapiens
MITRARKGR

SEQ ID NO: 153472 - protein, 9 aa, Homo Sapiens
WMCDCFMAT

SEQ ID NO: 153473 - protein, 9 aa, Homo Sapiens
LKQARKAFD

SEQ ID NO: 153474 - protein, 9 aa, Homo Sapiens
LRSEGGPPR

SEQ ID NO: 153475 - protein, 9 aa, Homo Sapiens
FITYPRAVT

SEQ ID NO: 153476 - protein, 9 aa, Homo Sapiens
RAQAKTEKR

SEQ ID NO: 153477 - protein, 9 aa, Homo Sapiens
YLLQITELK

SEQ ID NO: 153478 - protein, 9 aa, Homo Sapiens
SLKLGVVDV

SEQ ID NO: 153479 - protein, 9 aa, Homo Sapiens
SIGDEDQRR

SEQ ID NO: 153480 - protein, 9 aa, Homo Sapiens
DKISAEKAE

SEQ ID NO: 153481 - protein, 9 aa, Homo Sapiens
IYFITFIFL

SEQ ID NO: 153482 - protein, 9 aa, Homo Sapiens
SGGQPRLTE

SEQ ID NO: 153483 - protein, 9 aa, Homo Sapiens
PLLKLGNGV

SEQ ID NO: 153484 - protein, 9 aa, Homo Sapiens
EVPAAAAAF

SEQ ID NO: 153485 - protein, 9 aa, Homo Sapiens
GLIFLQPLL

SEQ ID NO: 153486 - protein, 9 aa, Homo Sapiens
QMPSRCSNP

SEQ ID NO: 153487 - protein, 9 aa, Homo Sapiens
IPDAVLKEG

SEQ ID NO: 153488 - protein, 9 aa, Homo Sapiens
SPCLTCLED

SEQ ID NO: 153489 - protein, 9 aa, Homo Sapiens
KITRTSMCM

SEQ ID NO: 153490 - protein, 9 aa, Homo Sapiens
ADALQEVPE

SEQ ID NO: 153491 - protein, 9 aa, Homo Sapiens
APCSCSSCS

SEQ ID NO: 153492 - protein, 9 aa, Homo Sapiens
SISGRQSPS

SEQ ID NO: 153493 - protein, 9 aa, Homo Sapiens
PSVAASSLG

SEQ ID NO: 153494 - protein, 9 aa, Homo Sapiens
RRTMRRVNQ

SEQ ID NO: 153495 - protein, 9 aa, Homo Sapiens
LTSVPGGPR

SEQ ID NO: 153496 - protein, 9 aa, Homo Sapiens
SGVVSSGRR

SEQ ID NO: 153497 - protein, 9 aa, Homo Sapiens
MGPPPECCS

SEQ ID NO: 153498 - protein, 9 aa, Homo Sapiens
ERMICNVEL

SEQ ID NO: 153499 - protein, 9 aa, Homo Sapiens
QGSPLAFEA

SEQ ID NO: 153500 - protein, 9 aa, Homo Sapiens
PRPLPSPPG

SEQ ID NO: 153501 - protein, 9 aa, Homo Sapiens
DSSFRLDPE

SEQ ID NO: 153502 - protein, 9 aa, Homo Sapiens
QNRRSLKKR

SEQ ID NO: 153503 - protein, 9 aa, Homo Sapiens
LRGLGLQLA

SEQ ID NO: 153504 - protein, 9 aa, Homo Sapiens
HTTVFPAST

SEQ ID NO: 153505 - protein, 9 aa, Homo Sapiens
HTMLSEVLQ

SEQ ID NO: 153506 - protein, 9 aa, Homo Sapiens
ERAVKRMWH

SEQ ID NO: 153507 - protein, 9 aa, Homo Sapiens
RQLPQWRTW

SEQ ID NO: 153508 - protein, 9 aa, Homo Sapiens
AYHTREVQI

SEQ ID NO: 153509 - protein, 9 aa, Homo Sapiens
LEVIKKPPI

SEQ ID NO: 153510 - protein, 9 aa, Homo Sapiens
NMEKNYNLE

SEQ ID NO: 153511 - protein, 9 aa, Homo Sapiens
RAKAGAQAV

SEQ ID NO: 153512 - protein, 9 aa, Homo Sapiens
LDMCDGDRW

SEQ ID NO: 153513 - protein, 9 aa, Homo Sapiens
DWLLQTPLG

SEQ ID NO: 153514 - protein, 9 aa, Homo Sapiens
THTTVFPAS

SEQ ID NO: 153515 - protein, 9 aa, Homo Sapiens
WIVPAHGPT

SEQ ID NO: 153516 - protein, 9 aa, Homo Sapiens
YRPGLGCFM

SEQ ID NO: 153517 - protein, 9 aa, Homo Sapiens
LGRCRMVCG

SEQ ID NO: 153518 - protein, 9 aa, Homo Sapiens
NRLRRGPSP

SEQ ID NO: 153519 - protein, 9 aa, Homo Sapiens
DEPGLWSLR

SEQ ID NO: 153520 - protein, 9 aa, Homo Sapiens
LFAFTKQVL

SEQ ID NO: 153521 - protein, 9 aa, Homo Sapiens
LSRALHVYS

SEQ ID NO: 153522 - protein, 9 aa, Homo Sapiens
ASSPAGAAP

SEQ ID NO: 153523 - protein, 9 aa, Homo Sapiens
SLSHLLPPP

SEQ ID NO: 153524 - protein, 9 aa, Homo Sapiens
RQVFLRQEG

SEQ ID NO: 153525 - protein, 9 aa, Homo Sapiens
PSITPSSET

SEQ ID NO: 153526 - protein, 9 aa, Homo Sapiens
QSEPLRGQP

SEQ ID NO: 153527 - protein, 9 aa, Homo Sapiens
SPRPSTKCG

SEQ ID NO: 153528 - protein, 9 aa, Homo Sapiens
SFVEQALRL

SEQ ID NO: 153529 - protein, 9 aa, Homo Sapiens
LAAHIPLFC

SEQ ID NO: 153530 - protein, 9 aa, Homo Sapiens
CCLYQTNSR

SEQ ID NO: 153531 - protein, 9 aa, Homo Sapiens
TATSLDIMT

SEQ ID NO: 153532 - protein, 9 aa, Homo Sapiens
GLRQGGTRL

SEQ ID NO: 153533 - protein, 9 aa, Homo Sapiens
HKHTDTLAC

SEQ ID NO: 153534 - protein, 9 aa, Homo Sapiens
VPHWTPPSI

SEQ ID NO: 153535 - protein, 9 aa, Homo Sapiens
NRNAPRDSR

SEQ ID NO: 153536 - protein, 9 aa, Homo Sapiens
ALLAHHAAL

SEQ ID NO: 153537 - protein, 9 aa, Homo Sapiens
LSWKCLVVV

SEQ ID NO: 153538 - protein, 9 aa, Homo Sapiens
MPILLYNLE

SEQ ID NO: 153539 - protein, 9 aa, Homo Sapiens
APTAPATAL

SEQ ID NO: 153540 - protein, 9 aa, Homo Sapiens
LVLCEDHRD

SEQ ID NO: 153541 - protein, 9 aa, Homo Sapiens
ILYLQALDY

SEQ ID NO: 153542 - protein, 9 aa, Homo Sapiens
DLNPSSAEF

SEQ ID NO: 153543 - protein, 9 aa, Homo Sapiens
ELRRCEENT

SEQ ID NO: 153544 - protein, 9 aa, Homo Sapiens
GPVLHKVPG

SEQ ID NO: 153545 - protein, 9 aa, Homo Sapiens
TEPDIYQEK

SEQ ID NO: 153546 - protein, 9 aa, Homo Sapiens
QRTGRQHPP

SEQ ID NO: 153547 - protein, 9 aa, Homo Sapiens
GFPPQPSSG

SEQ ID NO: 153548 - protein, 9 aa, Homo Sapiens
AAPPSLRAA

SEQ ID NO: 153549 - protein, 9 aa, Homo Sapiens
CRGEMKWSG

SEQ ID NO: 153550 - protein, 9 aa, Homo Sapiens
QGVYLWLMQ

SEQ ID NO: 153551 - protein, 9 aa, Homo Sapiens
SLHCAQIQV

SEQ ID NO: 153552 - protein, 9 aa, Homo Sapiens
CWRSWWQGR

SEQ ID NO: 153553 - protein, 9 aa, Homo Sapiens
GPLDQKIVL

SEQ ID NO: 153554 - protein, 9 aa, Homo Sapiens
CRAEGFPPQ

SEQ ID NO: 153555 - protein, 9 aa, Homo Sapiens
GPPKPCPDV

SEQ ID NO: 153556 - protein, 9 aa, Homo Sapiens
MAHWPKEQP

SEQ ID NO: 153557 - protein, 9 aa, Homo Sapiens
TLADRERGP

SEQ ID NO: 153558 - protein, 9 aa, Homo Sapiens
QGSEFTPQS

SEQ ID NO: 153559 - protein, 9 aa, Homo Sapiens
ITPSSETSS

SEQ ID NO: 153560 - protein, 9 aa, Homo Sapiens
RKRYIRRRA

SEQ ID NO: 153561 - protein, 9 aa, Homo Sapiens
GGSDSMWSW

SEQ ID NO: 153562 - protein, 9 aa, Homo Sapiens
DTNEFVSSV

SEQ ID NO: 153563 - protein, 9 aa, Homo Sapiens
HDLMRSIFL

SEQ ID NO: 153564 - protein, 9 aa, Homo Sapiens
ASGWSASCG

SEQ ID NO: 153565 - protein, 9 aa, Homo Sapiens
SLRTRVQKE

SEQ ID NO: 153566 - protein, 9 aa, Homo Sapiens
KHSSSQCTQ

SEQ ID NO: 153567 - protein, 9 aa, Homo Sapiens
DKSAFIRVA

SEQ ID NO: 153568 - protein, 9 aa, Homo Sapiens
SRGSPRPST

SEQ ID NO: 153569 - protein, 9 aa, Homo Sapiens
AVASQGLHA

SEQ ID NO: 153570 - protein, 9 aa, Homo Sapiens
GTLADRERG

SEQ ID NO: 153571 - protein, 9 aa, Homo Sapiens
NVDRSGEAP

SEQ ID NO: 153572 - protein, 9 aa, Homo Sapiens
TFRKSLHGQ

SEQ ID NO: 153573 - protein, 9 aa, Homo Sapiens
EQAGGPPRS

SEQ ID NO: 153574 - protein, 9 aa, Homo Sapiens
FIFLCSLSC

SEQ ID NO: 153575 - protein, 9 aa, Homo Sapiens
PSSQTWARR

SEQ ID NO: 153576 - protein, 9 aa, Homo Sapiens
AIMEIQCPA

SEQ ID NO: 153577 - protein, 9 aa, Homo Sapiens
KPGQIRRHL

SEQ ID NO: 153578 - protein, 9 aa, Homo Sapiens
DPPQSSFVP

SEQ ID NO: 153579 - protein, 9 aa, Homo Sapiens
STLRRHRVC

SEQ ID NO: 153580 - protein, 9 aa, Homo Sapiens
GAGAGGRRL

SEQ ID NO: 153581 - protein, 9 aa, Homo Sapiens
QNQGNPAVS

SEQ ID NO: 153582 - protein, 9 aa, Homo Sapiens
SSTSRSTCA

SEQ ID NO: 153583 - protein, 9 aa, Homo Sapiens
AALGPPKPC

SEQ ID NO: 153584 - protein, 9 aa, Homo Sapiens
KSGTHLCRV

SEQ ID NO: 153585 - protein, 9 aa, Homo Sapiens
QLNPTQAFL

SEQ ID NO: 153586 - protein, 9 aa, Homo Sapiens
REPFERLTS

SEQ ID NO: 153587 - protein, 9 aa, Homo Sapiens
SCLSSRIGG

SEQ ID NO: 153588 - protein, 9 aa, Homo Sapiens
DKLAKDIYG

SEQ ID NO: 153589 - protein, 9 aa, Homo Sapiens
PASGPSPAR

SEQ ID NO: 153590 - protein, 9 aa, Homo Sapiens
RLLYKLKLE

SEQ ID NO: 153591 - protein, 9 aa, Homo Sapiens
RGTSGWRGA

SEQ ID NO: 153592 - protein, 9 aa, Homo Sapiens
HGLLTGQSY

SEQ ID NO: 153593 - protein, 9 aa, Homo Sapiens
VYRHVKNGD

SEQ ID NO: 153594 - protein, 9 aa, Homo Sapiens
ASAAAMHTT

SEQ ID NO: 153595 - protein, 9 aa, Homo Sapiens
TLTSGPTPL

SEQ ID NO: 153596 - protein, 9 aa, Homo Sapiens
SLAEVCQSG

SEQ ID NO: 153597 - protein, 9 aa, Homo Sapiens
DITQVTSKL

SEQ ID NO: 153598 - protein, 9 aa, Homo Sapiens
AMSDWMVVG

SEQ ID NO: 153599 - protein, 9 aa, Homo Sapiens
KGSPGCVLV

SEQ ID NO: 153600 - protein, 9 aa, Homo Sapiens
LRQKEEAEQ

SEQ ID NO: 153601 - protein, 9 aa, Homo Sapiens
VHALSLSPA

SEQ ID NO: 153602 - protein, 9 aa, Homo Sapiens
TLPLSPSRR

SEQ ID NO: 153603 - protein, 9 aa, Homo Sapiens
RAEIAELTV

SEQ ID NO: 153604 - protein, 9 aa, Homo Sapiens
VYEDTPVGI

SEQ ID NO: 153605 - protein, 9 aa, Homo Sapiens
FCCSTVSRS

SEQ ID NO: 153606 - protein, 9 aa, Homo Sapiens
LYSMCLLIG

SEQ ID NO: 153607 - protein, 9 aa, Homo Sapiens
KMPMDKPGL

SEQ ID NO: 153608 - protein, 9 aa, Homo Sapiens
EVRGEWRQG

SEQ ID NO: 153609 - protein, 9 aa, Homo Sapiens
CEAPIGRAQ

SEQ ID NO: 153610 - protein, 9 aa, Homo Sapiens
SHPCRWFCP

SEQ ID NO: 153611 - protein, 9 aa, Homo Sapiens
AKKALCIRV

SEQ ID NO: 153612 - protein, 9 aa, Homo Sapiens
TEQCGINLW

SEQ ID NO: 153613 - protein, 9 aa, Homo Sapiens
AVKRMWHLS

SEQ ID NO: 153614 - protein, 9 aa, Homo Sapiens
LLILDLVHA

SEQ ID NO: 153615 - protein, 9 aa, Homo Sapiens
VPGLYGEGG

SEQ ID NO: 153616 - protein, 9 aa, Homo Sapiens
LFTGKYNNS

SEQ ID NO: 153617 - protein, 9 aa, Homo Sapiens
SRGPAVRTR

SEQ ID NO: 153618 - protein, 9 aa, Homo Sapiens
SDKESSCLA

SEQ ID NO: 153619 - protein, 9 aa, Homo Sapiens
HRHTHTQAY

SEQ ID NO: 153620 - protein, 9 aa, Homo Sapiens
ARDRMGQGW

SEQ ID NO: 153621 - protein, 9 aa, Homo Sapiens
GTDRQQTVL

SEQ ID NO: 153622 - protein, 9 aa, Homo Sapiens
TPKPRPPQP

SEQ ID NO: 153623 - protein, 9 aa, Homo Sapiens
GVAVDAQVG

SEQ ID NO: 153624 - protein, 9 aa, Homo Sapiens
PFSRPHPAL

SEQ ID NO: 153625 - protein, 9 aa, Homo Sapiens
GSQSALGTA

SEQ ID NO: 153626 - protein, 9 aa, Homo Sapiens
HSQTPPLLT

SEQ ID NO: 153627 - protein, 9 aa, Homo Sapiens
SRPELMPHT

SEQ ID NO: 153628 - protein, 9 aa, Homo Sapiens
EEGRCGRRR

SEQ ID NO: 153629 - protein, 9 aa, Homo Sapiens
HKRETECVV

SEQ ID NO: 153630 - protein, 9 aa, Homo Sapiens
KQSTQKKMF

SEQ ID NO: 153631 - protein, 9 aa, Homo Sapiens
LCGMHYLYF

SEQ ID NO: 153632 - protein, 9 aa, Homo Sapiens
HPDQVRTLH

SEQ ID NO: 153633 - protein, 9 aa, Homo Sapiens
DNPLRCGCT

SEQ ID NO: 153634 - protein, 9 aa, Homo Sapiens
GLAPQHLIR

SEQ ID NO: 153635 - protein, 9 aa, Homo Sapiens
HTTRPVWGP

SEQ ID NO: 153636 - protein, 9 aa, Homo Sapiens
RLLIRHAYS

SEQ ID NO: 153637 - protein, 9 aa, Homo Sapiens
LADLEGVNM

SEQ ID NO: 153638 - protein, 9 aa, Homo Sapiens
QCKEAVAAE

SEQ ID NO: 153639 - protein, 9 aa, Homo Sapiens
AELTVLALV

SEQ ID NO: 153640 - protein, 9 aa, Homo Sapiens
GGKALTRLN

SEQ ID NO: 153641 - protein, 9 aa, Homo Sapiens
KTIPVLCGC

SEQ ID NO: 153642 - protein, 9 aa, Homo Sapiens
APPPSTAAT

SEQ ID NO: 153643 - protein, 9 aa, Homo Sapiens
LPSEGQLFQ

SEQ ID NO: 153644 - protein, 9 aa, Homo Sapiens
TISQYLSGV

SEQ ID NO: 153645 - protein, 9 aa, Homo Sapiens
NQNQGNPAV

SEQ ID NO: 153646 - protein, 9 aa, Homo Sapiens
GSPACCPVC

SEQ ID NO: 153647 - protein, 9 aa, Homo Sapiens
FLTIHSYGQ

SEQ ID NO: 153648 - protein, 9 aa, Homo Sapiens
EEEEELERE

SEQ ID NO: 153649 - protein, 9 aa, Homo Sapiens
AGAGCGQVP

SEQ ID NO: 153650 - protein, 9 aa, Homo Sapiens
GSVPARTRG

SEQ ID NO: 153651 - protein, 9 aa, Homo Sapiens
TRERVWFSD

SEQ ID NO: 153652 - protein, 9 aa, Homo Sapiens
SWSMATDPS

SEQ ID NO: 153653 - protein, 9 aa, Homo Sapiens
WSGDILTGF

SEQ ID NO: 153654 - protein, 9 aa, Homo Sapiens
AVGSQPCLE

SEQ ID NO: 153655 - protein, 9 aa, Homo Sapiens
MVTQGRKLY

SEQ ID NO: 153656 - protein, 9 aa, Homo Sapiens
YQLALDLLS

SEQ ID NO: 153657 - protein, 9 aa, Homo Sapiens
LRLITREIV

SEQ ID NO: 153658 - protein, 9 aa, Homo Sapiens
SDPEPDYTS

SEQ ID NO: 153659 - protein, 9 aa, Homo Sapiens
AADEKLTEE

SEQ ID NO: 153660 - protein, 9 aa, Homo Sapiens
SQSGQEPAA

SEQ ID NO: 153661 - protein, 9 aa, Homo Sapiens
AQPPLPALA

SEQ ID NO: 153662 - protein, 9 aa, Homo Sapiens
QDPSPAGMG

SEQ ID NO: 153663 - protein, 9 aa, Homo Sapiens
SWNCAWEPA

SEQ ID NO: 153664 - protein, 9 aa, Homo Sapiens
HPLPLGCIW

SEQ ID NO: 153665 - protein, 9 aa, Homo Sapiens
RCRGTASAG

SEQ ID NO: 153666 - protein, 9 aa, Homo Sapiens
GPMGVGLNE

SEQ ID NO: 153667 - protein, 9 aa, Homo Sapiens
EQANQGSVF

SEQ ID NO: 153668 - protein, 9 aa, Homo Sapiens
RLQSLLSLY

SEQ ID NO: 153669 - protein, 9 aa, Homo Sapiens
AGTAGGGGS

SEQ ID NO: 153670 - protein, 9 aa, Homo Sapiens
DVDDSALNK

SEQ ID NO: 153671 - protein, 9 aa, Homo Sapiens
DLCGREVEV

SEQ ID NO: 153672 - protein, 9 aa, Homo Sapiens
LVCPQGQPA

SEQ ID NO: 153673 - protein, 9 aa, Homo Sapiens
GGSPVGDVG

SEQ ID NO: 153674 - protein, 9 aa, Homo Sapiens
RWFCPTLPS

SEQ ID NO: 153675 - protein, 9 aa, Homo Sapiens
GEVNAGRIG

SEQ ID NO: 153676 - protein, 9 aa, Homo Sapiens
PQFHNLPCP

SEQ ID NO: 153677 - protein, 9 aa, Homo Sapiens
STSTTSAAS

SEQ ID NO: 153678 - protein, 9 aa, Homo Sapiens
PPAVPAALA

SEQ ID NO: 153679 - protein, 9 aa, Homo Sapiens
LPLRPQRGP

SEQ ID NO: 153680 - protein, 9 aa, Homo Sapiens
RKKAFVTCS

SEQ ID NO: 153681 - protein, 9 aa, Homo Sapiens
WSASAAAMH

SEQ ID NO: 153682 - protein, 9 aa, Homo Sapiens
GLGQLAWLS

SEQ ID NO: 153683 - protein, 9 aa, Homo Sapiens
AGSSNLPVP

SEQ ID NO: 153684 - protein, 9 aa, Homo Sapiens
IEAPPPSTA

SEQ ID NO: 153685 - protein, 9 aa, Homo Sapiens
TQLKGIPLN

SEQ ID NO: 153686 - protein, 9 aa, Homo Sapiens
SPSAPDDQG

SEQ ID NO: 153687 - protein, 9 aa, Homo Sapiens
SSPLSGPSS

SEQ ID NO: 153688 - protein, 9 aa, Homo Sapiens
NEHKKFILE

SEQ ID NO: 153689 - protein, 9 aa, Homo Sapiens
AEKFGDLNP

SEQ ID NO: 153690 - protein, 9 aa, Homo Sapiens
GLLRQLGKG

SEQ ID NO: 153691 - protein, 9 aa, Homo Sapiens
LGADNSVVC

SEQ ID NO: 153692 - protein, 9 aa, Homo Sapiens
FIKPNPAKS

SEQ ID NO: 153693 - protein, 9 aa, Homo Sapiens
PPHPLSLPG

SEQ ID NO: 153694 - protein, 9 aa, Homo Sapiens
AEGKGERWP

SEQ ID NO: 153695 - protein, 9 aa, Homo Sapiens
QPKKSNELL

SEQ ID NO: 153696 - protein, 9 aa, Homo Sapiens
PQYSIFKLF

SEQ ID NO: 153697 - protein, 9 aa, Homo Sapiens
MEVSCSWWA

SEQ ID NO: 153698 - protein, 9 aa, Homo Sapiens
NSLDDSDVS

SEQ ID NO: 153699 - protein, 9 aa, Homo Sapiens
ITPVIDQGG

SEQ ID NO: 153700 - protein, 9 aa, Homo Sapiens
ADGQTEQCG

SEQ ID NO: 153701 - protein, 9 aa, Homo Sapiens
PLHPPHLVP

SEQ ID NO: 153702 - protein, 9 aa, Homo Sapiens
TRNLMWDFC

SEQ ID NO: 153703 - protein, 9 aa, Homo Sapiens
AAARRSGGG

SEQ ID NO: 153704 - protein, 9 aa, Homo Sapiens
PSAFNNLKN

SEQ ID NO: 153705 - protein, 9 aa, Homo Sapiens
LAASSPGGG

SEQ ID NO: 153706 - protein, 9 aa, Homo Sapiens
LCAPQVIPV

SEQ ID NO: 153707 - protein, 9 aa, Homo Sapiens
TGQEGLRVR

SEQ ID NO: 153708 - protein, 9 aa, Homo Sapiens
AAFMKKIFG

SEQ ID NO: 153709 - protein, 9 aa, Homo Sapiens
DSHICGVSL

SEQ ID NO: 153710 - protein, 9 aa, Homo Sapiens
RLMKNGEAA

SEQ ID NO: 153711 - protein, 9 aa, Homo Sapiens
INRCKKVAS

SEQ ID NO: 153712 - protein, 9 aa, Homo Sapiens
SEAGARAAR

SEQ ID NO: 153713 - protein, 9 aa, Homo Sapiens
EVEIGTVVV

SEQ ID NO: 153714 - protein, 9 aa, Homo Sapiens
ADDAPAARG

SEQ ID NO: 153715 - protein, 9 aa, Homo Sapiens
ETFRKSLHG

SEQ ID NO: 153716 - protein, 9 aa, Homo Sapiens
TQGPWLVVP

SEQ ID NO: 153717 - protein, 9 aa, Homo Sapiens
AVGTALVAP

SEQ ID NO: 153718 - protein, 9 aa, Homo Sapiens
VLEEFKMEK

SEQ ID NO: 153719 - protein, 9 aa, Homo Sapiens
PTAVLEKYY

SEQ ID NO: 153720 - protein, 9 aa, Homo Sapiens
MNEELKQAR

SEQ ID NO: 153721 - protein, 9 aa, Homo Sapiens
EAGITGQFS

SEQ ID NO: 153722 - protein, 9 aa, Homo Sapiens
AKNECYQAT

SEQ ID NO: 153723 - protein, 9 aa, Homo Sapiens
LLSGEEGRP

SEQ ID NO: 153724 - protein, 9 aa, Homo Sapiens
TQQLAWPDT

SEQ ID NO: 153725 - protein, 9 aa, Homo Sapiens
QEDIAVIRN

SEQ ID NO: 153726 - protein, 9 aa, Homo Sapiens
LGYELLTAF

SEQ ID NO: 153727 - protein, 9 aa, Homo Sapiens
CGINLWEMA

SEQ ID NO: 153728 - protein, 9 aa, Homo Sapiens
PAFLCGMHY

SEQ ID NO: 153729 - protein, 9 aa, Homo Sapiens
SASLAAGTE

SEQ ID NO: 153730 - protein, 9 aa, Homo Sapiens
DLASEFLPQ

SEQ ID NO: 153731 - protein, 9 aa, Homo Sapiens
QALAACDKE

SEQ ID NO: 153732 - protein, 9 aa, Homo Sapiens
MQMREFKPK

SEQ ID NO: 153733 - protein, 9 aa, Homo Sapiens
SNEKMRRGP

SEQ ID NO: 153734 - protein, 9 aa, Homo Sapiens
APCWAPAPG

SEQ ID NO: 153735 - protein, 9 aa, Homo Sapiens
RNRLRRGPS

SEQ ID NO: 153736 - protein, 9 aa, Homo Sapiens
IFLLFPTSY

SEQ ID NO: 153737 - protein, 9 aa, Homo Sapiens
RARAEPMAE

SEQ ID NO: 153738 - protein, 9 aa, Homo Sapiens
PRDRWKGLE

SEQ ID NO: 153739 - protein, 9 aa, Homo Sapiens
GETGLLPEC

SEQ ID NO: 153740 - protein, 9 aa, Homo Sapiens
PTNVKNVAK

SEQ ID NO: 153741 - protein, 9 aa, Homo Sapiens
CPSRPLPPP

SEQ ID NO: 153742 - protein, 9 aa, Homo Sapiens
PKHLEEVTV

SEQ ID NO: 153743 - protein, 9 aa, Homo Sapiens
RWRHPLPPR

SEQ ID NO: 153744 - protein, 9 aa, Homo Sapiens
RIRVQSIEF

SEQ ID NO: 153745 - protein, 9 aa, Homo Sapiens
SAQSVSGTA

SEQ ID NO: 153746 - protein, 9 aa, Homo Sapiens
KCCVSGVVL

SEQ ID NO: 153747 - protein, 9 aa, Homo Sapiens
MLHLGRTQA

SEQ ID NO: 153748 - protein, 9 aa, Homo Sapiens
RNAGNTVRS

SEQ ID NO: 153749 - protein, 9 aa, Homo Sapiens
LPPVPFLDC

SEQ ID NO: 153750 - protein, 9 aa, Homo Sapiens
SIFHALMYI

SEQ ID NO: 153751 - protein, 9 aa, Homo Sapiens
AGGPPRSRL

SEQ ID NO: 153752 - protein, 9 aa, Homo Sapiens
PGLAFITYP

SEQ ID NO: 153753 - protein, 9 aa, Homo Sapiens
PHFSSLSPP

SEQ ID NO: 153754 - protein, 9 aa, Homo Sapiens
ARSHQPKDR

SEQ ID NO: 153755 - protein, 9 aa, Homo Sapiens
DCCGPRDLD

SEQ ID NO: 153756 - protein, 9 aa, Homo Sapiens
HLFYIYTSG

SEQ ID NO: 153757 - protein, 9 aa, Homo Sapiens
NKLSVVPQF

SEQ ID NO: 153758 - protein, 9 aa, Homo Sapiens
MASQLGRLD

SEQ ID NO: 153759 - protein, 9 aa, Homo Sapiens
HSSSQCTQG

SEQ ID NO: 153760 - protein, 9 aa, Homo Sapiens
FMKKIFGDA

SEQ ID NO: 153761 - protein, 9 aa, Homo Sapiens
TFSASIAEG

SEQ ID NO: 153762 - protein, 9 aa, Homo Sapiens
AVIPFLTTD

SEQ ID NO: 153763 - protein, 9 aa, Homo Sapiens
SPLSGPSSP

SEQ ID NO: 153764 - protein, 9 aa, Homo Sapiens
KFGDLNPSS

SEQ ID NO: 153765 - protein, 9 aa, Homo Sapiens
ICGSLPLMT

SEQ ID NO: 153766 - protein, 9 aa, Homo Sapiens
PGTYPDVPP

SEQ ID NO: 153767 - protein, 9 aa, Homo Sapiens
PGETLERHS

SEQ ID NO: 153768 - protein, 9 aa, Homo Sapiens
TSWCSVKSA

SEQ ID NO: 153769 - protein, 9 aa, Homo Sapiens
LWNLVCNHG

SEQ ID NO: 153770 - protein, 9 aa, Homo Sapiens
PMAVIPFLT

SEQ ID NO: 153771 - protein, 9 aa, Homo Sapiens
GRGWMWQSQ

SEQ ID NO: 153772 - protein, 9 aa, Homo Sapiens
LSDCKVCPS

SEQ ID NO: 153773 - protein, 9 aa, Homo Sapiens
ACGLPPCWR

SEQ ID NO: 153774 - protein, 9 aa, Homo Sapiens
VPSTPHESQ

SEQ ID NO: 153775 - protein, 9 aa, Homo Sapiens
SLKSIFLLF

SEQ ID NO: 153776 - protein, 9 aa, Homo Sapiens
ALPSLQQLL

SEQ ID NO: 153777 - protein, 9 aa, Homo Sapiens
LEREISGWA

SEQ ID NO: 153778 - protein, 9 aa, Homo Sapiens
FALADQRVA

SEQ ID NO: 153779 - protein, 9 aa, Homo Sapiens
VQPMELIDG

SEQ ID NO: 153780 - protein, 9 aa, Homo Sapiens
ISAHCNIHL

SEQ ID NO: 153781 - protein, 9 aa, Homo Sapiens
RTATSLDIM

SEQ ID NO: 153782 - protein, 9 aa, Homo Sapiens
GEKFYRKNV

SEQ ID NO: 153783 - protein, 9 aa, Homo Sapiens
LLLPTGCRA

SEQ ID NO: 153784 - protein, 9 aa, Homo Sapiens
YVRIMEAIL

SEQ ID NO: 153785 - protein, 9 aa, Homo Sapiens
RAWGLFTPA

SEQ ID NO: 153786 - protein, 9 aa, Homo Sapiens
GDTPQPSLP

SEQ ID NO: 153787 - protein, 9 aa, Homo Sapiens
CSFAVGSRL

SEQ ID NO: 153788 - protein, 9 aa, Homo Sapiens
DGHTCMEGS

SEQ ID NO: 153789 - protein, 9 aa, Homo Sapiens
PCMEENKPG

SEQ ID NO: 153790 - protein, 9 aa, Homo Sapiens
VLGGASLGR

SEQ ID NO: 153791 - protein, 9 aa, Homo Sapiens
GTSGTRDWL

SEQ ID NO: 153792 - protein, 9 aa, Homo Sapiens
FEHSAAFFS

SEQ ID NO: 153793 - protein, 9 aa, Homo Sapiens
HIGPRAVHD

SEQ ID NO: 153794 - protein, 9 aa, Homo Sapiens
SLTGRTHQI

SEQ ID NO: 153795 - protein, 9 aa, Homo Sapiens
APEDAATPA

SEQ ID NO: 153796 - protein, 9 aa, Homo Sapiens
QIRRHLLRF

SEQ ID NO: 153797 - protein, 9 aa, Homo Sapiens
RKKKKKKKT

SEQ ID NO: 153798 - protein, 9 aa, Homo Sapiens
FGQNGLPSE

SEQ ID NO: 153799 - protein, 9 aa, Homo Sapiens
LGPHGGQLR

SEQ ID NO: 153800 - protein, 9 aa, Homo Sapiens
RTGRQHPPP

SEQ ID NO: 153801 - protein, 9 aa, Homo Sapiens
LVMGYTTYD

SEQ ID NO: 153802 - protein, 9 aa, Homo Sapiens
GPEATLEVS

SEQ ID NO: 153803 - protein, 9 aa, Homo Sapiens
LTVRIGVFS

SEQ ID NO: 153804 - protein, 9 aa, Homo Sapiens
AHHRNTDQR

SEQ ID NO: 153805 - protein, 9 aa, Homo Sapiens
GHEDGTVLF

SEQ ID NO: 153806 - protein, 9 aa, Homo Sapiens
HNSEEKKFT

SEQ ID NO: 153807 - protein, 9 aa, Homo Sapiens
GPHPRAHRV

SEQ ID NO: 153808 - protein, 9 aa, Homo Sapiens
CFQAICISH

SEQ ID NO: 153809 - protein, 9 aa, Homo Sapiens
RSPSGPRPG

SEQ ID NO: 153810 - protein, 9 aa, Homo Sapiens
RQKGSQMST

SEQ ID NO: 153811 - protein, 9 aa, Homo Sapiens
TRKASAASC

SEQ ID NO: 153812 - protein, 9 aa, Homo Sapiens
VGHEGIIPA

SEQ ID NO: 153813 - protein, 9 aa, Homo Sapiens
RAAVHCALH

SEQ ID NO: 153814 - protein, 9 aa, Homo Sapiens
HVESNSSTS

SEQ ID NO: 153815 - protein, 9 aa, Homo Sapiens
PDQAHRPDY

SEQ ID NO: 153816 - protein, 9 aa, Homo Sapiens
LDTECSLRE

SEQ ID NO: 153817 - protein, 9 aa, Homo Sapiens
KVVLFQILC

SEQ ID NO: 153818 - protein, 9 aa, Homo Sapiens
QQNSGYPTQ

SEQ ID NO: 153819 - protein, 9 aa, Homo Sapiens
TFLPLHLKL

SEQ ID NO: 153820 - protein, 9 aa, Homo Sapiens
RAGNFAIME

SEQ ID NO: 153821 - protein, 9 aa, Homo Sapiens
IMGRWTAAW

SEQ ID NO: 153822 - protein, 9 aa, Homo Sapiens
EAVEAANMG

SEQ ID NO: 153823 - protein, 9 aa, Homo Sapiens
PTQAFLLVN

SEQ ID NO: 153824 - protein, 9 aa, Homo Sapiens
KIFKTFFLL

SEQ ID NO: 153825 - protein, 9 aa, Homo Sapiens
PPLPLAASA

SEQ ID NO: 153826 - protein, 9 aa, Homo Sapiens
SPAHWLRAS

SEQ ID NO: 153827 - protein, 9 aa, Homo Sapiens
WTGQEGLRV

SEQ ID NO: 153828 - protein, 9 aa, Homo Sapiens
ICMHRGLCK

SEQ ID NO: 153829 - protein, 9 aa, Homo Sapiens
EGWPSWVGP

SEQ ID NO: 153830 - protein, 9 aa, Homo Sapiens
EQKQVESLA

SEQ ID NO: 153831 - protein, 9 aa, Homo Sapiens
RHEEIFYVG

SEQ ID NO: 153832 - protein, 9 aa, Homo Sapiens
VAAFFVLWF

SEQ ID NO: 153833 - protein, 9 aa, Homo Sapiens
MEYGKLQQL

SEQ ID NO: 153834 - protein, 9 aa, Homo Sapiens
LAWVKNAEE

SEQ ID NO: 153835 - protein, 9 aa, Homo Sapiens
AAMMGAFLS

SEQ ID NO: 153836 - protein, 9 aa, Homo Sapiens
KGREAVSIY

SEQ ID NO: 153837 - protein, 9 aa, Homo Sapiens
FLKVAVGTR

SEQ ID NO: 153838 - protein, 9 aa, Homo Sapiens
PNPRPWPPP

SEQ ID NO: 153839 - protein, 9 aa, Homo Sapiens
ELSSLKPGA

SEQ ID NO: 153840 - protein, 9 aa, Homo Sapiens
PLLLVVVLI

SEQ ID NO: 153841 - protein, 9 aa, Homo Sapiens
KKTEKAFPA

SEQ ID NO: 153842 - protein, 9 aa, Homo Sapiens
FTIDLPWGD

SEQ ID NO: 153843 - protein, 9 aa, Homo Sapiens
ERSCRPSVQ

SEQ ID NO: 153844 - protein, 9 aa, Homo Sapiens
AFLPPMHCP

SEQ ID NO: 153845 - protein, 9 aa, Homo Sapiens
LQAAVILDA

SEQ ID NO: 153846 - protein, 9 aa, Homo Sapiens
VFPASTTTS

SEQ ID NO: 153847 - protein, 9 aa, Homo Sapiens
RKLRRPGLG

SEQ ID NO: 153848 - protein, 9 aa, Homo Sapiens
KQALAACDK

SEQ ID NO: 153849 - protein, 9 aa, Homo Sapiens
NCAWEPARG

SEQ ID NO: 153850 - protein, 9 aa, Homo Sapiens
WLGTLCPGG

SEQ ID NO: 153851 - protein, 9 aa, Homo Sapiens
LLPGMGPHV

SEQ ID NO: 153852 - protein, 9 aa, Homo Sapiens
MGPPGLHGP

SEQ ID NO: 153853 - protein, 9 aa, Homo Sapiens
LSNMTIQTM

SEQ ID NO: 153854 - protein, 9 aa, Homo Sapiens
LADTTRTSC

SEQ ID NO: 153855 - protein, 9 aa, Homo Sapiens
VQKVTSSLG

SEQ ID NO: 153856 - protein, 9 aa, Homo Sapiens
ASLEDAKKR

SEQ ID NO: 153857 - protein, 9 aa, Homo Sapiens
KIVYRHVKN

SEQ ID NO: 153858 - protein, 9 aa, Homo Sapiens
ALPLPRGIR

SEQ ID NO: 153859 - protein, 9 aa, Homo Sapiens
KSQGSGDEA

SEQ ID NO: 153860 - protein, 9 aa, Homo Sapiens
QQCPGSHRL

SEQ ID NO: 153861 - protein, 9 aa, Homo Sapiens
SSFPCWGWH

SEQ ID NO: 153862 - protein, 9 aa, Homo Sapiens
ELILRMENG

SEQ ID NO: 153863 - protein, 9 aa, Homo Sapiens
PEDCGRGPP

SEQ ID NO: 153864 - protein, 9 aa, Homo Sapiens
KWRKRRKRS

SEQ ID NO: 153865 - protein, 9 aa, Homo Sapiens
DTSAQSVSG

SEQ ID NO: 153866 - protein, 9 aa, Homo Sapiens
QAHLLIALG

SEQ ID NO: 153867 - protein, 9 aa, Homo Sapiens
LLGSSCAPL

SEQ ID NO: 153868 - protein, 9 aa, Homo Sapiens
LCPTLEAAR

SEQ ID NO: 153869 - protein, 9 aa, Homo Sapiens
PGYPHNILR

SEQ ID NO: 153870 - protein, 9 aa, Homo Sapiens
LISHLMKWA

SEQ ID NO: 153871 - protein, 9 aa, Homo Sapiens
QAMSDWMVV

SEQ ID NO: 153872 - protein, 9 aa, Homo Sapiens
HKVLAGIVM

SEQ ID NO: 153873 - protein, 9 aa, Homo Sapiens
GARSGFGFG

SEQ ID NO: 153874 - protein, 9 aa, Homo Sapiens
FAIMPSSPR

SEQ ID NO: 153875 - protein, 9 aa, Homo Sapiens
VVSKASGRF

SEQ ID NO: 153876 - protein, 9 aa, Homo Sapiens
VLGFSVALS

SEQ ID NO: 153877 - protein, 9 aa, Homo Sapiens
LRQEGPMQA

SEQ ID NO: 153878 - protein, 9 aa, Homo Sapiens
SITPSSETS

SEQ ID NO: 153879 - protein, 9 aa, Homo Sapiens
EDVGPGADI

SEQ ID NO: 153880 - protein, 9 aa, Homo Sapiens
GQETLPEEQ

SEQ ID NO: 153881 - protein, 9 aa, Homo Sapiens
LSPANPQEK

SEQ ID NO: 153882 - protein, 9 aa, Homo Sapiens
ETCAHNRTT

SEQ ID NO: 153883 - protein, 9 aa, Homo Sapiens
LAVQNVDWN

SEQ ID NO: 153884 - protein, 9 aa, Homo Sapiens
LVLGRAAPL

SEQ ID NO: 153885 - protein, 9 aa, Homo Sapiens
HQPPPARPP

SEQ ID NO: 153886 - protein, 9 aa, Homo Sapiens
PWLQQLPRK

SEQ ID NO: 153887 - protein, 9 aa, Homo Sapiens
TTSSPEASL

SEQ ID NO: 153888 - protein, 9 aa, Homo Sapiens
FLPPMHCPT

SEQ ID NO: 153889 - protein, 9 aa, Homo Sapiens
GESPWQVMA

SEQ ID NO: 153890 - protein, 9 aa, Homo Sapiens
LQSLRLDAS

SEQ ID NO: 153891 - protein, 9 aa, Homo Sapiens
APAPAPRPL

SEQ ID NO: 153892 - protein, 9 aa, Homo Sapiens
IVPVKKIPH

SEQ ID NO: 153893 - protein, 9 aa, Homo Sapiens
LASSDPPSA

SEQ ID NO: 153894 - protein, 9 aa, Homo Sapiens
CVLRRARAL

SEQ ID NO: 153895 - protein, 9 aa, Homo Sapiens
GVRVLLHFQ

SEQ ID NO: 153896 - protein, 9 aa, Homo Sapiens
VAVPYPPTV

SEQ ID NO: 153897 - protein, 9 aa, Homo Sapiens
RWTAAWPCC

SEQ ID NO: 153898 - protein, 9 aa, Homo Sapiens
VPLSISGSP

SEQ ID NO: 153899 - protein, 9 aa, Homo Sapiens
LYIFCQELQ

SEQ ID NO: 153900 - protein, 9 aa, Homo Sapiens
QIKVGQNEE

SEQ ID NO: 153901 - protein, 9 aa, Homo Sapiens
GWEEASQVG

SEQ ID NO: 153902 - protein, 9 aa, Homo Sapiens
KQMNDARHG

SEQ ID NO: 153903 - protein, 9 aa, Homo Sapiens
MSAMECFRN

SEQ ID NO: 153904 - protein, 9 aa, Homo Sapiens
WWCGGGQTP

SEQ ID NO: 153905 - protein, 9 aa, Homo Sapiens
LFRFDADVR

SEQ ID NO: 153906 - protein, 9 aa, Homo Sapiens
LCVRFACHS

SEQ ID NO: 153907 - protein, 9 aa, Homo Sapiens
SSLRRTTTT

SEQ ID NO: 153908 - protein, 9 aa, Homo Sapiens
AGDVEAIPH

SEQ ID NO: 153909 - protein, 9 aa, Homo Sapiens
KMEANIQLY

SEQ ID NO: 153910 - protein, 9 aa, Homo Sapiens
AIWRRIGAT

SEQ ID NO: 153911 - protein, 9 aa, Homo Sapiens
KCRRHQPVV

SEQ ID NO: 153912 - protein, 9 aa, Homo Sapiens
PRRTRSAWG

SEQ ID NO: 153913 - protein, 9 aa, Homo Sapiens
YLRHLEGGI

SEQ ID NO: 153914 - protein, 9 aa, Homo Sapiens
MTFVYRDVT

SEQ ID NO: 153915 - protein, 9 aa, Homo Sapiens
RAAKLGVNF

SEQ ID NO: 153916 - protein, 9 aa, Homo Sapiens
VEHMFETDD

SEQ ID NO: 153917 - protein, 9 aa, Homo Sapiens
TVRSAMKSE

SEQ ID NO: 153918 - protein, 9 aa, Homo Sapiens
EMITALIVF

SEQ ID NO: 153919 - protein, 9 aa, Homo Sapiens
AKQNVEKEA

SEQ ID NO: 153920 - protein, 9 aa, Homo Sapiens
EEPELLLEH

SEQ ID NO: 153921 - protein, 9 aa, Homo Sapiens
SGQEPAAAL

SEQ ID NO: 153922 - protein, 9 aa, Homo Sapiens
RKTATVRPK

SEQ ID NO: 153923 - protein, 9 aa, Homo Sapiens
LLITVTALT

SEQ ID NO: 153924 - protein, 9 aa, Homo Sapiens
AYTQTHTGI

SEQ ID NO: 153925 - protein, 9 aa, Homo Sapiens
TPPVHISIM

SEQ ID NO: 153926 - protein, 9 aa, Homo Sapiens
PVQIQSQSS

SEQ ID NO: 153927 - protein, 9 aa, Homo Sapiens
WYEKEKACL

SEQ ID NO: 153928 - protein, 9 aa, Homo Sapiens
GCGAGADDV

SEQ ID NO: 153929 - protein, 9 aa, Homo Sapiens
NLLRLQSLL

SEQ ID NO: 153930 - protein, 9 aa, Homo Sapiens
KFYRKNVRE

SEQ ID NO: 153931 - protein, 9 aa, Homo Sapiens
NGVLSTPAV

SEQ ID NO: 153932 - protein, 9 aa, Homo Sapiens
KRLKSVPHL

SEQ ID NO: 153933 - protein, 9 aa, Homo Sapiens
KDCDGEVEE

SEQ ID NO: 153934 - protein, 9 aa, Homo Sapiens
PSTQLKGIP

SEQ ID NO: 153935 - protein, 9 aa, Homo Sapiens
TTSIPSPHS

SEQ ID NO: 153936 - protein, 9 aa, Homo Sapiens
VCKPGPITC

SEQ ID NO: 153937 - protein, 9 aa, Homo Sapiens
YSGCSHLVS

SEQ ID NO: 153938 - protein, 9 aa, Homo Sapiens
EELLLLLLQ

SEQ ID NO: 153939 - protein, 9 aa, Homo Sapiens
LTVLALVAV

SEQ ID NO: 153940 - protein, 9 aa, Homo Sapiens
DVGPGADII

SEQ ID NO: 153941 - protein, 9 aa, Homo Sapiens
SAEYELENV

SEQ ID NO: 153942 - protein, 9 aa, Homo Sapiens
AKNVFPPSS

SEQ ID NO: 153943 - protein, 9 aa, Homo Sapiens
SILLPALLL

SEQ ID NO: 153944 - protein, 9 aa, Homo Sapiens
SMKAGVIHA

SEQ ID NO: 153945 - protein, 9 aa, Homo Sapiens
QPFWQLEAA

SEQ ID NO: 153946 - protein, 9 aa, Homo Sapiens
SQGPRLDFA

SEQ ID NO: 153947 - protein, 9 aa, Homo Sapiens
GAAVDPPWS

SEQ ID NO: 153948 - protein, 9 aa, Homo Sapiens
NSRVLFHSS

SEQ ID NO: 153949 - protein, 9 aa, Homo Sapiens
NPTWRRTGA

SEQ ID NO: 153950 - protein, 9 aa, Homo Sapiens
NFNQTQKNM

SEQ ID NO: 153951 - protein, 9 aa, Homo Sapiens
QRLENLRQK

SEQ ID NO: 153952 - protein, 9 aa, Homo Sapiens
GPKSWAPAP

SEQ ID NO: 153953 - protein, 9 aa, Homo Sapiens
QKVTCFYRP

SEQ ID NO: 153954 - protein, 9 aa, Homo Sapiens
AYQSQIKVG

SEQ ID NO: 153955 - protein, 9 aa, Homo Sapiens
SALGTASEG

SEQ ID NO: 153956 - protein, 9 aa, Homo Sapiens
QKNQKGQYR

SEQ ID NO: 153957 - protein, 9 aa, Homo Sapiens
TRATSPGAP

SEQ ID NO: 153958 - protein, 9 aa, Homo Sapiens
FDRYMVICD

SEQ ID NO: 153959 - protein, 9 aa, Homo Sapiens
ELVSRAVVF

SEQ ID NO: 153960 - protein, 9 aa, Homo Sapiens
GVYVGTAIL

SEQ ID NO: 153961 - protein, 9 aa, Homo Sapiens
SRLEKVHFS

SEQ ID NO: 153962 - protein, 9 aa, Homo Sapiens
MEGAHLGLP

SEQ ID NO: 153963 - protein, 9 aa, Homo Sapiens
AALDEGRTT

SEQ ID NO: 153964 - protein, 9 aa, Homo Sapiens
HLIAKNMAA

SEQ ID NO: 153965 - protein, 9 aa, Homo Sapiens
EAEGWAPES

SEQ ID NO: 153966 - protein, 9 aa, Homo Sapiens
DPGVIKQKV

SEQ ID NO: 153967 - protein, 9 aa, Homo Sapiens
PTSTHKHTH

SEQ ID NO: 153968 - protein, 9 aa, Homo Sapiens
TSELALCKR

SEQ ID NO: 153969 - protein, 9 aa, Homo Sapiens
HYSQDQFLR

SEQ ID NO: 153970 - protein, 9 aa, Homo Sapiens
VSTSSHLIL

SEQ ID NO: 153971 - protein, 9 aa, Homo Sapiens
PLGLLVAPR

SEQ ID NO: 153972 - protein, 9 aa, Homo Sapiens
RLLAPLIQK

SEQ ID NO: 153973 - protein, 9 aa, Homo Sapiens
QGLSPCLTC

SEQ ID NO: 153974 - protein, 9 aa, Homo Sapiens
TLWLGPASV

SEQ ID NO: 153975 - protein, 9 aa, Homo Sapiens
WEFGDIIPD

SEQ ID NO: 153976 - protein, 9 aa, Homo Sapiens
WSMATDPSY

SEQ ID NO: 153977 - protein, 9 aa, Homo Sapiens
ADQRGLVPP

SEQ ID NO: 153978 - protein, 9 aa, Homo Sapiens
WRKLKAEMD

SEQ ID NO: 153979 - protein, 9 aa, Homo Sapiens
VHRPPWHGL

SEQ ID NO: 153980 - protein, 9 aa, Homo Sapiens
RQALRGKSR

SEQ ID NO: 153981 - protein, 9 aa, Homo Sapiens
ATVHPAQTS

SEQ ID NO: 153982 - protein, 9 aa, Homo Sapiens
RRQNMSLEM

SEQ ID NO: 153983 - protein, 9 aa, Homo Sapiens
VPSMETHHL

SEQ ID NO: 153984 - protein, 9 aa, Homo Sapiens
HQKIHRDAL

SEQ ID NO: 153985 - protein, 9 aa, Homo Sapiens
DIALAYHLT

SEQ ID NO: 153986 - protein, 9 aa, Homo Sapiens
VVFYINVSK

SEQ ID NO: 153987 - protein, 9 aa, Homo Sapiens
STCCGAWAP

SEQ ID NO: 153988 - protein, 9 aa, Homo Sapiens
PGPWQPSVG

SEQ ID NO: 153989 - protein, 9 aa, Homo Sapiens
AMSRGETPP

SEQ ID NO: 153990 - protein, 9 aa, Homo Sapiens
LRPRWSCWR

SEQ ID NO: 153991 - protein, 9 aa, Homo Sapiens
ATGHIISWK

SEQ ID NO: 153992 - protein, 9 aa, Homo Sapiens
AKDYQWEDK

SEQ ID NO: 153993 - protein, 9 aa, Homo Sapiens
MAVVSKASG

SEQ ID NO: 153994 - protein, 9 aa, Homo Sapiens
PCVDNCGPY

SEQ ID NO: 153995 - protein, 9 aa, Homo Sapiens
SASVCCRAQ

SEQ ID NO: 153996 - protein, 9 aa, Homo Sapiens
VDEEVFFSA

SEQ ID NO: 153997 - protein, 9 aa, Homo Sapiens
WVASKTHRD

SEQ ID NO: 153998 - protein, 9 aa, Homo Sapiens
HPLLELLCL

SEQ ID NO: 153999 - protein, 9 aa, Homo Sapiens
TRNLPSGEV

SEQ ID NO: 154000 - protein, 9 aa, Homo Sapiens
EEKTKEAYA

SEQ ID NO: 154001 - protein, 9 aa, Homo Sapiens
GTRLGVVAL

SEQ ID NO: 154002 - protein, 9 aa, Homo Sapiens
LRASSVVPR

SEQ ID NO: 154003 - protein, 9 aa, Homo Sapiens
FGSLRRQNM

SEQ ID NO: 154004 - protein, 9 aa, Homo Sapiens
SMVTLLSTT

SEQ ID NO: 154005 - protein, 9 aa, Homo Sapiens
QQDINGLEV

SEQ ID NO: 154006 - protein, 9 aa, Homo Sapiens
SHPETVDSA

SEQ ID NO: 154007 - protein, 9 aa, Homo Sapiens
IGEGPYECI

SEQ ID NO: 154008 - protein, 9 aa, Homo Sapiens
SLMPPLLLG

SEQ ID NO: 154009 - protein, 9 aa, Homo Sapiens
LGIRAQGTR

SEQ ID NO: 154010 - protein, 9 aa, Homo Sapiens
CSFVEQALR

SEQ ID NO: 154011 - protein, 9 aa, Homo Sapiens
QGTRRSSNK

SEQ ID NO: 154012 - protein, 9 aa, Homo Sapiens
PSPRSWGPR

SEQ ID NO: 154013 - protein, 9 aa, Homo Sapiens
RDRSPMVFL

SEQ ID NO: 154014 - protein, 9 aa, Homo Sapiens
LPCPFSTVK

SEQ ID NO: 154015 - protein, 9 aa, Homo Sapiens
TTSTHRPAS

SEQ ID NO: 154016 - protein, 9 aa, Homo Sapiens
GGRTRANGD

SEQ ID NO: 154017 - protein, 9 aa, Homo Sapiens
PSGPCPSIT

SEQ ID NO: 154018 - protein, 9 aa, Homo Sapiens
SESESSSKS

SEQ ID NO: 154019 - protein, 9 aa, Homo Sapiens
PDQDMREVG

SEQ ID NO: 154020 - protein, 9 aa, Homo Sapiens
AKPLDGPQI

SEQ ID NO: 154021 - protein, 9 aa, Homo Sapiens
NVTFCSSST

SEQ ID NO: 154022 - protein, 9 aa, Homo Sapiens
NITTKFPWH

SEQ ID NO: 154023 - protein, 9 aa, Homo Sapiens
LVGTWYSKD

SEQ ID NO: 154024 - protein, 9 aa, Homo Sapiens
YHSLVPMYY

SEQ ID NO: 154025 - protein, 9 aa, Homo Sapiens
PSTKCGTWR

SEQ ID NO: 154026 - protein, 9 aa, Homo Sapiens
GEGPRQELA

SEQ ID NO: 154027 - protein, 9 aa, Homo Sapiens
LGQGPLHLG

SEQ ID NO: 154028 - protein, 9 aa, Homo Sapiens
AGRRSAPRS

SEQ ID NO: 154029 - protein, 9 aa, Homo Sapiens
AVASSTTVA

SEQ ID NO: 154030 - protein, 9 aa, Homo Sapiens
WFLLKSTHL

SEQ ID NO: 154031 - protein, 9 aa, Homo Sapiens
YCENVYHLV

SEQ ID NO: 154032 - protein, 9 aa, Homo Sapiens
RTTSTLGSS

SEQ ID NO: 154033 - protein, 9 aa, Homo Sapiens
RCDGWADRT

SEQ ID NO: 154034 - protein, 9 aa, Homo Sapiens
PAARGHGAP

SEQ ID NO: 154035 - protein, 9 aa, Homo Sapiens
LQYQLALDL

SEQ ID NO: 154036 - protein, 9 aa, Homo Sapiens
KHSLSPNVV

SEQ ID NO: 154037 - protein, 9 aa, Homo Sapiens
PHADDAPAA

SEQ ID NO: 154038 - protein, 9 aa, Homo Sapiens
WVGAHQGPG

SEQ ID NO: 154039 - protein, 9 aa, Homo Sapiens
QLGQLGVGI

SEQ ID NO: 154040 - protein, 9 aa, Homo Sapiens
PTAGAARAR

SEQ ID NO: 154041 - protein, 9 aa, Homo Sapiens
EEFIGFRDD

SEQ ID NO: 154042 - protein, 9 aa, Homo Sapiens
PAEQANTVK

SEQ ID NO: 154043 - protein, 9 aa, Homo Sapiens
GASWSVSLM

SEQ ID NO: 154044 - protein, 9 aa, Homo Sapiens
ARPPQVQPP

SEQ ID NO: 154045 - protein, 9 aa, Homo Sapiens
SHSQNEISP

SEQ ID NO: 154046 - protein, 9 aa, Homo Sapiens
PGASPRCPP

SEQ ID NO: 154047 - protein, 9 aa, Homo Sapiens
EKAEVGRPA

SEQ ID NO: 154048 - protein, 9 aa, Homo Sapiens
SPALKQVSP

SEQ ID NO: 154049 - protein, 9 aa, Homo Sapiens
LHPLPLPPV

SEQ ID NO: 154050 - protein, 9 aa, Homo Sapiens
DLPILDDQI

SEQ ID NO: 154051 - protein, 9 aa, Homo Sapiens
YHPYVPPLP

SEQ ID NO: 154052 - protein, 9 aa, Homo Sapiens
SAVPSVARP

SEQ ID NO: 154053 - protein, 9 aa, Homo Sapiens
LGRWGRGGW

SEQ ID NO: 154054 - protein, 9 aa, Homo Sapiens
ARNIWYLAG

SEQ ID NO: 154055 - protein, 9 aa, Homo Sapiens
AAASSPAGA

SEQ ID NO: 154056 - protein, 9 aa, Homo Sapiens
HLLLLIALP

SEQ ID NO: 154057 - protein, 9 aa, Homo Sapiens
LEGGITFVP

SEQ ID NO: 154058 - protein, 9 aa, Homo Sapiens
VPGKPEVEA

SEQ ID NO: 154059 - protein, 9 aa, Homo Sapiens
DANERKSGI

SEQ ID NO: 154060 - protein, 9 aa, Homo Sapiens
KEQKQNSTH

SEQ ID NO: 154061 - protein, 9 aa, Homo Sapiens
VGVAAGLLT

SEQ ID NO: 154062 - protein, 9 aa, Homo Sapiens
RRGTSGWRG

SEQ ID NO: 154063 - protein, 9 aa, Homo Sapiens
LKVMHKTFG

SEQ ID NO: 154064 - protein, 9 aa, Homo Sapiens
SSWTIPWTG

SEQ ID NO: 154065 - protein, 9 aa, Homo Sapiens
TPALLRNMA

SEQ ID NO: 154066 - protein, 9 aa, Homo Sapiens
TGKCCVSGV

SEQ ID NO: 154067 - protein, 9 aa, Homo Sapiens
EVEAWGEIF

SEQ ID NO: 154068 - protein, 9 aa, Homo Sapiens
QWPTVHGLL

SEQ ID NO: 154069 - protein, 9 aa, Homo Sapiens
SFSVKNKER

SEQ ID NO: 154070 - protein, 9 aa, Homo Sapiens
LMVADHEVK

SEQ ID NO: 154071 - protein, 9 aa, Homo Sapiens
SELALCKRG

SEQ ID NO: 154072 - protein, 9 aa, Homo Sapiens
VNMRHLWRP

SEQ ID NO: 154073 - protein, 9 aa, Homo Sapiens
QIFIQVFET

SEQ ID NO: 154074 - protein, 9 aa, Homo Sapiens
IATGGVPST

SEQ ID NO: 154075 - protein, 9 aa, Homo Sapiens
VLGLKYEEF

SEQ ID NO: 154076 - protein, 9 aa, Homo Sapiens
LVVPLLLVV

SEQ ID NO: 154077 - protein, 9 aa, Homo Sapiens
AFLLAGGTS

SEQ ID NO: 154078 - protein, 9 aa, Homo Sapiens
HDAQCKQDH

SEQ ID NO: 154079 - protein, 9 aa, Homo Sapiens
GQNGLPSEG

SEQ ID NO: 154080 - protein, 9 aa, Homo Sapiens
CLHKFCFRY

SEQ ID NO: 154081 - protein, 9 aa, Homo Sapiens
QGNVDRSGE

SEQ ID NO: 154082 - protein, 9 aa, Homo Sapiens
FHQSRLWER

SEQ ID NO: 154083 - protein, 9 aa, Homo Sapiens
RTQRPQPQE

SEQ ID NO: 154084 - protein, 9 aa, Homo Sapiens
VKQQQVTEN

SEQ ID NO: 154085 - protein, 9 aa, Homo Sapiens
NRRSLKKRA

SEQ ID NO: 154086 - protein, 9 aa, Homo Sapiens
VLDEGTKAS

SEQ ID NO: 154087 - protein, 9 aa, Homo Sapiens
PRKERGPLE

SEQ ID NO: 154088 - protein, 9 aa, Homo Sapiens
TVGNINELP

SEQ ID NO: 154089 - protein, 9 aa, Homo Sapiens
VGPMGVGLN

SEQ ID NO: 154090 - protein, 9 aa, Homo Sapiens
KVKALEKTV

SEQ ID NO: 154091 - protein, 9 aa, Homo Sapiens
QGPGWEEAS

SEQ ID NO: 154092 - protein, 9 aa, Homo Sapiens
ATEKSRWSG

SEQ ID NO: 154093 - protein, 9 aa, Homo Sapiens
HGGVFHFLD

SEQ ID NO: 154094 - protein, 9 aa, Homo Sapiens
QLEDGSSLS

SEQ ID NO: 154095 - protein, 9 aa, Homo Sapiens
GEHSVRAAS

SEQ ID NO: 154096 - protein, 9 aa, Homo Sapiens
RKIGARICA

SEQ ID NO: 154097 - protein, 9 aa, Homo Sapiens
RGRLLVLLG

SEQ ID NO: 154098 - protein, 9 aa, Homo Sapiens
GPWNGTTMM

SEQ ID NO: 154099 - protein, 9 aa, Homo Sapiens
VTLNMMAVR

SEQ ID NO: 154100 - protein, 9 aa, Homo Sapiens
KLDPAMAHP

SEQ ID NO: 154101 - protein, 9 aa, Homo Sapiens
KWGRNTSLA

SEQ ID NO: 154102 - protein, 9 aa, Homo Sapiens
DIMTCLQYG

SEQ ID NO: 154103 - protein, 9 aa, Homo Sapiens
CLPLQPRGP

SEQ ID NO: 154104 - protein, 9 aa, Homo Sapiens
QGTAFPEPG

SEQ ID NO: 154105 - protein, 9 aa, Homo Sapiens
SSSLSLESW

SEQ ID NO: 154106 - protein, 9 aa, Homo Sapiens
WKTLIDLKI

SEQ ID NO: 154107 - protein, 9 aa, Homo Sapiens
AAVSHEQLA

SEQ ID NO: 154108 - protein, 9 aa, Homo Sapiens
TDNTTTTTS

SEQ ID NO: 154109 - protein, 9 aa, Homo Sapiens
CMEENKPGI

SEQ ID NO: 154110 - protein, 9 aa, Homo Sapiens
RAWCCLMSQ

SEQ ID NO: 154111 - protein, 9 aa, Homo Sapiens
VLQYQLALD

SEQ ID NO: 154112 - protein, 9 aa, Homo Sapiens
RRSLKKRAQ

SEQ ID NO: 154113 - protein, 9 aa, Homo Sapiens
CSTLLRSSS

SEQ ID NO: 154114 - protein, 9 aa, Homo Sapiens
NVEKEAQAR

SEQ ID NO: 154115 - protein, 9 aa, Homo Sapiens
PWGLMKGHS

SEQ ID NO: 154116 - protein, 9 aa, Homo Sapiens
SGCTAKTGA

SEQ ID NO: 154117 - protein, 9 aa, Homo Sapiens
TSKLDRRSQ

SEQ ID NO: 154118 - protein, 9 aa, Homo Sapiens
QVSSDPPTT

SEQ ID NO: 154119 - protein, 9 aa, Homo Sapiens
CPLALAALG

SEQ ID NO: 154120 - protein, 9 aa, Homo Sapiens
LLKLGVPSM

SEQ ID NO: 154121 - protein, 9 aa, Homo Sapiens
SERCNALIA

SEQ ID NO: 154122 - protein, 9 aa, Homo Sapiens
ACVVHMLVM

SEQ ID NO: 154123 - protein, 9 aa, Homo Sapiens
FPWHIKKHE

SEQ ID NO: 154124 - protein, 9 aa, Homo Sapiens
GGHGPWAAR

SEQ ID NO: 154125 - protein, 9 aa, Homo Sapiens
ISRNSRNSK

SEQ ID NO: 154126 - protein, 9 aa, Homo Sapiens
KMEGAHLGL

SEQ ID NO: 154127 - protein, 9 aa, Homo Sapiens
EPELLLEHC

SEQ ID NO: 154128 - protein, 9 aa, Homo Sapiens
RNKRIAYKC

SEQ ID NO: 154129 - protein, 9 aa, Homo Sapiens
ERNELLKHV

SEQ ID NO: 154130 - protein, 9 aa, Homo Sapiens
LRSCHGDLC

SEQ ID NO: 154131 - protein, 9 aa, Homo Sapiens
ERKTATVRP

SEQ ID NO: 154132 - protein, 9 aa, Homo Sapiens
GARSSSTIH

SEQ ID NO: 154133 - protein, 9 aa, Homo Sapiens
PLKCNFDWE

SEQ ID NO: 154134 - protein, 9 aa, Homo Sapiens
AGGLHSSPP

SEQ ID NO: 154135 - protein, 9 aa, Homo Sapiens
LADRERGPW

SEQ ID NO: 154136 - protein, 9 aa, Homo Sapiens
DHHPCQLDI

SEQ ID NO: 154137 - protein, 9 aa, Homo Sapiens
CQRWSAETL

SEQ ID NO: 154138 - protein, 9 aa, Homo Sapiens
PHCRHPLQD

SEQ ID NO: 154139 - protein, 9 aa, Homo Sapiens
SEEGDDQEG

SEQ ID NO: 154140 - protein, 9 aa, Homo Sapiens
LLVWLEELR

SEQ ID NO: 154141 - protein, 9 aa, Homo Sapiens
CRKATRRAR

SEQ ID NO: 154142 - protein, 9 aa, Homo Sapiens
TATTTTQAL

SEQ ID NO: 154143 - protein, 9 aa, Homo Sapiens
INVVIDRGL

SEQ ID NO: 154144 - protein, 9 aa, Homo Sapiens
QLVDLTSWD

SEQ ID NO: 154145 - protein, 9 aa, Homo Sapiens
LSQDWLAVN

SEQ ID NO: 154146 - protein, 9 aa, Homo Sapiens
PVPQGQKRG

SEQ ID NO: 154147 - protein, 9 aa, Homo Sapiens
YINVSKAGK

SEQ ID NO: 154148 - protein, 9 aa, Homo Sapiens
AWRKLKAEM

SEQ ID NO: 154149 - protein, 9 aa, Homo Sapiens
RRAEKEWGD

SEQ ID NO: 154150 - protein, 9 aa, Homo Sapiens
GGGCVQQVA

SEQ ID NO: 154151 - protein, 9 aa, Homo Sapiens
FAGAKLPCY

SEQ ID NO: 154152 - protein, 9 aa, Homo Sapiens
MEKVTLKKV

SEQ ID NO: 154153 - protein, 9 aa, Homo Sapiens
GGFVYRDCQ

SEQ ID NO: 154154 - protein, 9 aa, Homo Sapiens
RLGQGPLHL

SEQ ID NO: 154155 - protein, 9 aa, Homo Sapiens
MPPSTPSSN

SEQ ID NO: 154156 - protein, 9 aa, Homo Sapiens
DVLEVLDES

SEQ ID NO: 154157 - protein, 9 aa, Homo Sapiens
AGASPTVCA

SEQ ID NO: 154158 - protein, 9 aa, Homo Sapiens
FWISMKAGV

SEQ ID NO: 154159 - protein, 9 aa, Homo Sapiens
LPGLPQLPG

SEQ ID NO: 154160 - protein, 9 aa, Homo Sapiens
RLWTSVRGC

SEQ ID NO: 154161 - protein, 9 aa, Homo Sapiens
GFIHPPLIF

SEQ ID NO: 154162 - protein, 9 aa, Homo Sapiens
WARSSQKET

SEQ ID NO: 154163 - protein, 9 aa, Homo Sapiens
FQGPPAPSR

SEQ ID NO: 154164 - protein, 9 aa, Homo Sapiens
ACEAPIGRA

SEQ ID NO: 154165 - protein, 9 aa, Homo Sapiens
SNLVRLMGP

SEQ ID NO: 154166 - protein, 9 aa, Homo Sapiens
LAVPQVNMT

SEQ ID NO: 154167 - protein, 9 aa, Homo Sapiens
KCAMCDSLH

SEQ ID NO: 154168 - protein, 9 aa, Homo Sapiens
NMAADIAVQ

SEQ ID NO: 154169 - protein, 9 aa, Homo Sapiens
RACVVHMLV

SEQ ID NO: 154170 - protein, 9 aa, Homo Sapiens
ASQSRARAW

SEQ ID NO: 154171 - protein, 9 aa, Homo Sapiens
VKALKKASS

SEQ ID NO: 154172 - protein, 9 aa, Homo Sapiens
HHGGVFHFL

SEQ ID NO: 154173 - protein, 9 aa, Homo Sapiens
GGLPLRLGQ

SEQ ID NO: 154174 - protein, 9 aa, Homo Sapiens
PTTPSPASG

SEQ ID NO: 154175 - protein, 9 aa, Homo Sapiens
APSLRPPHA

SEQ ID NO: 154176 - protein, 9 aa, Homo Sapiens
TKPRPGLGQ

SEQ ID NO: 154177 - protein, 9 aa, Homo Sapiens
KAVGANYDA

SEQ ID NO: 154178 - protein, 9 aa, Homo Sapiens
PRTGLRGSW

SEQ ID NO: 154179 - protein, 9 aa, Homo Sapiens
VVCFLPREE

SEQ ID NO: 154180 - protein, 9 aa, Homo Sapiens
QLRHPLHPP

SEQ ID NO: 154181 - protein, 9 aa, Homo Sapiens
AYPAVFGSV

SEQ ID NO: 154182 - protein, 9 aa, Homo Sapiens
LGRTQAADW

SEQ ID NO: 154183 - protein, 9 aa, Homo Sapiens
DPEYQSTSA

SEQ ID NO: 154184 - protein, 9 aa, Homo Sapiens
KMAVVSKAS

SEQ ID NO: 154185 - protein, 9 aa, Homo Sapiens
LALHGFRPS

SEQ ID NO: 154186 - protein, 9 aa, Homo Sapiens
CFRYVQEWS

SEQ ID NO: 154187 - protein, 9 aa, Homo Sapiens
PELHPLPLP

SEQ ID NO: 154188 - protein, 9 aa, Homo Sapiens
SSTWAGAST

SEQ ID NO: 154189 - protein, 9 aa, Homo Sapiens
SLSDSIHTV

SEQ ID NO: 154190 - protein, 9 aa, Homo Sapiens
TPSGCTAKT

SEQ ID NO: 154191 - protein, 9 aa, Homo Sapiens
PVHRPPWHG

SEQ ID NO: 154192 - protein, 9 aa, Homo Sapiens
PMHARHKVL

SEQ ID NO: 154193 - protein, 9 aa, Homo Sapiens
YAGATLRFL

SEQ ID NO: 154194 - protein, 9 aa, Homo Sapiens
PDEGSHHTP

SEQ ID NO: 154195 - protein, 9 aa, Homo Sapiens
MSSPRRAPL

SEQ ID NO: 154196 - protein, 9 aa, Homo Sapiens
EVMNKRLGS

SEQ ID NO: 154197 - protein, 9 aa, Homo Sapiens
RPSPQSPGM

SEQ ID NO: 154198 - protein, 9 aa, Homo Sapiens
GLKVVLFQI

SEQ ID NO: 154199 - protein, 9 aa, Homo Sapiens
LRRVAPTAP

SEQ ID NO: 154200 - protein, 9 aa, Homo Sapiens
PAKMEPLST

SEQ ID NO: 154201 - protein, 9 aa, Homo Sapiens
QRILYLQAL

SEQ ID NO: 154202 - protein, 9 aa, Homo Sapiens
TAPHPDQVR

SEQ ID NO: 154203 - protein, 9 aa, Homo Sapiens
KNTYPEKID

SEQ ID NO: 154204 - protein, 9 aa, Homo Sapiens
EDLGLKVKA

SEQ ID NO: 154205 - protein, 9 aa, Homo Sapiens
NMGDVEAFA

SEQ ID NO: 154206 - protein, 9 aa, Homo Sapiens
QSEHTLMGK

SEQ ID NO: 154207 - protein, 9 aa, Homo Sapiens
NRRLGSCTA

SEQ ID NO: 154208 - protein, 9 aa, Homo Sapiens
FHLQNDPQL

SEQ ID NO: 154209 - protein, 9 aa, Homo Sapiens
EVCEHVKLL

SEQ ID NO: 154210 - protein, 9 aa, Homo Sapiens
SGSFVRSCT

SEQ ID NO: 154211 - protein, 9 aa, Homo Sapiens
AKNSRTLFP

SEQ ID NO: 154212 - protein, 9 aa, Homo Sapiens
YVKEEMKKT

SEQ ID NO: 154213 - protein, 9 aa, Homo Sapiens
CPSWLSVSA

SEQ ID NO: 154214 - protein, 9 aa, Homo Sapiens
AVSPNHRPM

SEQ ID NO: 154215 - protein, 9 aa, Homo Sapiens
GGGGAPAAA

SEQ ID NO: 154216 - protein, 9 aa, Homo Sapiens
ENTKVFVWP

SEQ ID NO: 154217 - protein, 9 aa, Homo Sapiens
LVVVPLRQD

SEQ ID NO: 154218 - protein, 9 aa, Homo Sapiens
LDKISAEKA

SEQ ID NO: 154219 - protein, 9 aa, Homo Sapiens
YEDNSYTFI

SEQ ID NO: 154220 - protein, 9 aa, Homo Sapiens
AHRPDYAVF

SEQ ID NO: 154221 - protein, 9 aa, Homo Sapiens
QVPVLTSLS

SEQ ID NO: 154222 - protein, 9 aa, Homo Sapiens
IHTGKNPYM

SEQ ID NO: 154223 - protein, 9 aa, Homo Sapiens
KWGCWQPLH

SEQ ID NO: 154224 - protein, 9 aa, Homo Sapiens
AACAESACD

SEQ ID NO: 154225 - protein, 9 aa, Homo Sapiens
QPPPRLPLR

SEQ ID NO: 154226 - protein, 9 aa, Homo Sapiens
LLVVVLIVC

SEQ ID NO: 154227 - protein, 9 aa, Homo Sapiens
KKRCDKSDH

SEQ ID NO: 154228 - protein, 9 aa, Homo Sapiens
DQIVPDLYA

SEQ ID NO: 154229 - protein, 9 aa, Homo Sapiens
IKKYCQLTA

SEQ ID NO: 154230 - protein, 9 aa, Homo Sapiens
ARAKAGAQA

SEQ ID NO: 154231 - protein, 9 aa, Homo Sapiens
PMSPTLQDI

SEQ ID NO: 154232 - protein, 9 aa, Homo Sapiens
KLEKLTVRI

SEQ ID NO: 154233 - protein, 9 aa, Homo Sapiens
TMPILLYNL

SEQ ID NO: 154234 - protein, 9 aa, Homo Sapiens
YEKEKACLE

SEQ ID NO: 154235 - protein, 9 aa, Homo Sapiens
LLEKVSKKR

SEQ ID NO: 154236 - protein, 9 aa, Homo Sapiens
TWRAAARRS

SEQ ID NO: 154237 - protein, 9 aa, Homo Sapiens
LWQALLHLG

SEQ ID NO: 154238 - protein, 9 aa, Homo Sapiens
EHVKKNYST

SEQ ID NO: 154239 - protein, 9 aa, Homo Sapiens
SLRRTTTTS

SEQ ID NO: 154240 - protein, 9 aa, Homo Sapiens
RMVSFCCST

SEQ ID NO: 154241 - protein, 9 aa, Homo Sapiens
GICMHRGLC

SEQ ID NO: 154242 - protein, 9 aa, Homo Sapiens
KSTHLLLLI

SEQ ID NO: 154243 - protein, 9 aa, Homo Sapiens
GHTNTGDAI

SEQ ID NO: 154244 - protein, 9 aa, Homo Sapiens
PLVLTEIAP

SEQ ID NO: 154245 - protein, 9 aa, Homo Sapiens
SEEHGEISS

SEQ ID NO: 154246 - protein, 9 aa, Homo Sapiens
SETCGSCAR

SEQ ID NO: 154247 - protein, 9 aa, Homo Sapiens
AGASLRPSK

SEQ ID NO: 154248 - protein, 9 aa, Homo Sapiens
IKYNREISA

SEQ ID NO: 154249 - protein, 9 aa, Homo Sapiens
LQFLVLCPE

SEQ ID NO: 154250 - protein, 9 aa, Homo Sapiens
VYSGCSHLV

SEQ ID NO: 154251 - protein, 9 aa, Homo Sapiens
EGIMSRKAC

SEQ ID NO: 154252 - protein, 9 aa, Homo Sapiens
DIYKASNTM

SEQ ID NO: 154253 - protein, 9 aa, Homo Sapiens
RQVREHVLE

SEQ ID NO: 154254 - protein, 9 aa, Homo Sapiens
SRDREPEAR

SEQ ID NO: 154255 - protein, 9 aa, Homo Sapiens
NPWWVISGC

SEQ ID NO: 154256 - protein, 9 aa, Homo Sapiens
WSADRFADQ

SEQ ID NO: 154257 - protein, 9 aa, Homo Sapiens
WSTARSVLR

SEQ ID NO: 154258 - protein, 9 aa, Homo Sapiens
SIVVKMEFL

SEQ ID NO: 154259 - protein, 9 aa, Homo Sapiens
AYCLQFLVL

SEQ ID NO: 154260 - protein, 9 aa, Homo Sapiens
RLMAELHNL

SEQ ID NO: 154261 - protein, 9 aa, Homo Sapiens
TREEERLKH

SEQ ID NO: 154262 - protein, 9 aa, Homo Sapiens
YCSPTKKNS

SEQ ID NO: 154263 - protein, 9 aa, Homo Sapiens
SQGGRILLQ

SEQ ID NO: 154264 - protein, 9 aa, Homo Sapiens
QLPGLPRPG

SEQ ID NO: 154265 - protein, 9 aa, Homo Sapiens
NTEFDNVSL

SEQ ID NO: 154266 - protein, 9 aa, Homo Sapiens
TERALLYQG

SEQ ID NO: 154267 - protein, 9 aa, Homo Sapiens
AQAKTEKRL

SEQ ID NO: 154268 - protein, 9 aa, Homo Sapiens
FYVGIKSPH

SEQ ID NO: 154269 - protein, 9 aa, Homo Sapiens
SPAPAPPLQ

SEQ ID NO: 154270 - protein, 9 aa, Homo Sapiens
TTLRLRLQL

SEQ ID NO: 154271 - protein, 9 aa, Homo Sapiens
SIPRRQWAQ

SEQ ID NO: 154272 - protein, 9 aa, Homo Sapiens
NHFSLILFQ

SEQ ID NO: 154273 - protein, 9 aa, Homo Sapiens
RAPRAPSSP

SEQ ID NO: 154274 - protein, 9 aa, Homo Sapiens
KYSCNMMVF

SEQ ID NO: 154275 - protein, 9 aa, Homo Sapiens
PDDQGPWRP

SEQ ID NO: 154276 - protein, 9 aa, Homo Sapiens
KLYFTKNSR

SEQ ID NO: 154277 - protein, 9 aa, Homo Sapiens
KLFRFDADV

SEQ ID NO: 154278 - protein, 9 aa, Homo Sapiens
VPMYYRGAQ

SEQ ID NO: 154279 - protein, 9 aa, Homo Sapiens
IKPSPVPPP

SEQ ID NO: 154280 - protein, 9 aa, Homo Sapiens
WVTHRKAQH

SEQ ID NO: 154281 - protein, 9 aa, Homo Sapiens
SGPGLAFIT

SEQ ID NO: 154282 - protein, 9 aa, Homo Sapiens
MAADIAVQL

SEQ ID NO: 154283 - protein, 9 aa, Homo Sapiens
ATATTDNTT

SEQ ID NO: 154284 - protein, 9 aa, Homo Sapiens
CAPQVIPVL

SEQ ID NO: 154285 - protein, 9 aa, Homo Sapiens
GRRRGTSGW

SEQ ID NO: 154286 - protein, 9 aa, Homo Sapiens
TPKEDPEIN

SEQ ID NO: 154287 - protein, 9 aa, Homo Sapiens
WGPAIQPGP

SEQ ID NO: 154288 - protein, 9 aa, Homo Sapiens
MQEKAQDCQ

SEQ ID NO: 154289 - protein, 9 aa, Homo Sapiens
MHCPTATAA

SEQ ID NO: 154290 - protein, 9 aa, Homo Sapiens
AQTWCMENV

SEQ ID NO: 154291 - protein, 9 aa, Homo Sapiens
VQSIEFNAN

SEQ ID NO: 154292 - protein, 9 aa, Homo Sapiens
LPGLPRPGH

SEQ ID NO: 154293 - protein, 9 aa, Homo Sapiens
GALLDAELL

SEQ ID NO: 154294 - protein, 9 aa, Homo Sapiens
ALPPAGRHV

SEQ ID NO: 154295 - protein, 9 aa, Homo Sapiens
DLFALLFLG

SEQ ID NO: 154296 - protein, 9 aa, Homo Sapiens
SLPPSPGPL

SEQ ID NO: 154297 - protein, 9 aa, Homo Sapiens
AKKKCHSSE

SEQ ID NO: 154298 - protein, 9 aa, Homo Sapiens
AGDENDNAP

SEQ ID NO: 154299 - protein, 9 aa, Homo Sapiens
YQNGCLYRL

SEQ ID NO: 154300 - protein, 9 aa, Homo Sapiens
SKNRVHPPL

SEQ ID NO: 154301 - protein, 9 aa, Homo Sapiens
LSAPGTDRQ

SEQ ID NO: 154302 - protein, 9 aa, Homo Sapiens
QSRARAWDR

SEQ ID NO: 154303 - protein, 9 aa, Homo Sapiens
KRRKRSRTQ

SEQ ID NO: 154304 - protein, 9 aa, Homo Sapiens
WMIGGIYTS

SEQ ID NO: 154305 - protein, 9 aa, Homo Sapiens
LASLWNLVC

SEQ ID NO: 154306 - protein, 9 aa, Homo Sapiens
ETHHLQPPP

SEQ ID NO: 154307 - protein, 9 aa, Homo Sapiens
RPGLGQECP

SEQ ID NO: 154308 - protein, 9 aa, Homo Sapiens
LKVKALEKT

SEQ ID NO: 154309 - protein, 9 aa, Homo Sapiens
AHSVTVKLH

SEQ ID NO: 154310 - protein, 9 aa, Homo Sapiens
GDIALAYHL

SEQ ID NO: 154311 - protein, 9 aa, Homo Sapiens
LLPPFTYLI

SEQ ID NO: 154312 - protein, 9 aa, Homo Sapiens
PVDGDANHS

SEQ ID NO: 154313 - protein, 9 aa, Homo Sapiens
MPTSAAHHQ

SEQ ID NO: 154314 - protein, 9 aa, Homo Sapiens
RCFGVYVGT

SEQ ID NO: 154315 - protein, 9 aa, Homo Sapiens
SIPSPHSDG

SEQ ID NO: 154316 - protein, 9 aa, Homo Sapiens
ERQKMFLEE

SEQ ID NO: 154317 - protein, 9 aa, Homo Sapiens
IQPGPRANG

SEQ ID NO: 154318 - protein, 9 aa, Homo Sapiens
FQLRVPVLI

SEQ ID NO: 154319 - protein, 9 aa, Homo Sapiens
EQFKENWYN

SEQ ID NO: 154320 - protein, 9 aa, Homo Sapiens
IKQVYQAQT

SEQ ID NO: 154321 - protein, 9 aa, Homo Sapiens
KIEVLDEGT

SEQ ID NO: 154322 - protein, 9 aa, Homo Sapiens
ACPAVAVEQ

SEQ ID NO: 154323 - protein, 9 aa, Homo Sapiens
ILDLVHALS

SEQ ID NO: 154324 - protein, 9 aa, Homo Sapiens
PPEYEIFWG

SEQ ID NO: 154325 - protein, 9 aa, Homo Sapiens
RRPSPQSPG

SEQ ID NO: 154326 - protein, 9 aa, Homo Sapiens
APGKKEAPL

SEQ ID NO: 154327 - protein, 9 aa, Homo Sapiens
GTQAYTQTH

SEQ ID NO: 154328 - protein, 9 aa, Homo Sapiens
TECSLRELA

SEQ ID NO: 154329 - protein, 9 aa, Homo Sapiens
CLPLSRPIN

SEQ ID NO: 154330 - protein, 9 aa, Homo Sapiens
CGPRDLDWE

SEQ ID NO: 154331 - protein, 9 aa, Homo Sapiens
GKFGFATLT

SEQ ID NO: 154332 - protein, 9 aa, Homo Sapiens
LGQTFGVAE

SEQ ID NO: 154333 - protein, 9 aa, Homo Sapiens
DKFTNTYQT

SEQ ID NO: 154334 - protein, 9 aa, Homo Sapiens
ASCASGVTT

SEQ ID NO: 154335 - protein, 9 aa, Homo Sapiens
GVFFSLLFI

SEQ ID NO: 154336 - protein, 9 aa, Homo Sapiens
LSFRCSLVD

SEQ ID NO: 154337 - protein, 9 aa, Homo Sapiens
FQCRICMHN

SEQ ID NO: 154338 - protein, 9 aa, Homo Sapiens
PSPLKITPK

SEQ ID NO: 154339 - protein, 9 aa, Homo Sapiens
TLEREISGW

SEQ ID NO: 154340 - protein, 9 aa, Homo Sapiens
IDGPWPFTT

SEQ ID NO: 154341 - protein, 9 aa, Homo Sapiens
RTFPEGALG

SEQ ID NO: 154342 - protein, 9 aa, Homo Sapiens
IWRRIGATT

SEQ ID NO: 154343 - protein, 9 aa, Homo Sapiens
VCPQGQPAI

SEQ ID NO: 154344 - protein, 9 aa, Homo Sapiens
GIESGHIPG

SEQ ID NO: 154345 - protein, 9 aa, Homo Sapiens
PLPPSAIGP

SEQ ID NO: 154346 - protein, 9 aa, Homo Sapiens
PMSSPFRMA

SEQ ID NO: 154347 - protein, 9 aa, Homo Sapiens
KPRPGLGQE

SEQ ID NO: 154348 - protein, 9 aa, Homo Sapiens
HLVGVKRLK

SEQ ID NO: 154349 - protein, 9 aa, Homo Sapiens
KHTHKHTDT

SEQ ID NO: 154350 - protein, 9 aa, Homo Sapiens
PQPMGPPPE

SEQ ID NO: 154351 - protein, 9 aa, Homo Sapiens
NGQDQIVPD

SEQ ID NO: 154352 - protein, 9 aa, Homo Sapiens
ATNVNNWRW

SEQ ID NO: 154353 - protein, 9 aa, Homo Sapiens
HRQPVQIQS

SEQ ID NO: 154354 - protein, 9 aa, Homo Sapiens
LHILYLEAG

SEQ ID NO: 154355 - protein, 9 aa, Homo Sapiens
APQPRRPPM

SEQ ID NO: 154356 - protein, 9 aa, Homo Sapiens
TTPSPASGS

SEQ ID NO: 154357 - protein, 9 aa, Homo Sapiens
LDVQGQLDV

SEQ ID NO: 154358 - protein, 9 aa, Homo Sapiens
WLFEYHQST

SEQ ID NO: 154359 - protein, 9 aa, Homo Sapiens
KTKDTHMED

SEQ ID NO: 154360 - protein, 9 aa, Homo Sapiens
RAPQGPWQP

SEQ ID NO: 154361 - protein, 9 aa, Homo Sapiens
FGMVYKGIW

SEQ ID NO: 154362 - protein, 9 aa, Homo Sapiens
AFTKQVLGE

SEQ ID NO: 154363 - protein, 9 aa, Homo Sapiens
GIYTSAMAW

SEQ ID NO: 154364 - protein, 9 aa, Homo Sapiens
HQRERESFY

SEQ ID NO: 154365 - protein, 9 aa, Homo Sapiens
HRRAAHSRV

SEQ ID NO: 154366 - protein, 9 aa, Homo Sapiens
STSSLWSTP

SEQ ID NO: 154367 - protein, 9 aa, Homo Sapiens
CLSKASSPL

SEQ ID NO: 154368 - protein, 9 aa, Homo Sapiens
HVADLSRRL

SEQ ID NO: 154369 - protein, 9 aa, Homo Sapiens
LQEPALQEV

SEQ ID NO: 154370 - protein, 9 aa, Homo Sapiens
HGGKKNGIK

SEQ ID NO: 154371 - protein, 9 aa, Homo Sapiens
DDVDISVCR

SEQ ID NO: 154372 - protein, 9 aa, Homo Sapiens
HPPPPVTLE

SEQ ID NO: 154373 - protein, 9 aa, Homo Sapiens
IADRPSTCA

SEQ ID NO: 154374 - protein, 9 aa, Homo Sapiens
TTGLPATSL

SEQ ID NO: 154375 - protein, 9 aa, Homo Sapiens
RHKVLAGIV

SEQ ID NO: 154376 - protein, 9 aa, Homo Sapiens
HHIGPRAVH

SEQ ID NO: 154377 - protein, 9 aa, Homo Sapiens
QAQGAAVDP

SEQ ID NO: 154378 - protein, 9 aa, Homo Sapiens
IDTLDTIPY

SEQ ID NO: 154379 - protein, 9 aa, Homo Sapiens
PWPFTTQAH

SEQ ID NO: 154380 - protein, 9 aa, Homo Sapiens
SAAFFSFSW

SEQ ID NO: 154381 - protein, 9 aa, Homo Sapiens
HFKILKFQN

SEQ ID NO: 154382 - protein, 9 aa, Homo Sapiens
GGFGPFQMR

SEQ ID NO: 154383 - protein, 9 aa, Homo Sapiens
QCPGSHRLH

SEQ ID NO: 154384 - protein, 9 aa, Homo Sapiens
ALRGKSRPV

SEQ ID NO: 154385 - protein, 9 aa, Homo Sapiens
HLQKDVHKI

SEQ ID NO: 154386 - protein, 9 aa, Homo Sapiens
EGLATERSP

SEQ ID NO: 154387 - protein, 9 aa, Homo Sapiens
KKIIEYYLR

SEQ ID NO: 154388 - protein, 9 aa, Homo Sapiens
HQDVKANPK

SEQ ID NO: 154389 - protein, 9 aa, Homo Sapiens
IAAGLPMAV

SEQ ID NO: 154390 - protein, 9 aa, Homo Sapiens
HKGAKHKGI

SEQ ID NO: 154391 - protein, 9 aa, Homo Sapiens
PALRARGGT

SEQ ID NO: 154392 - protein, 9 aa, Homo Sapiens
EIIEVGEKM

SEQ ID NO: 154393 - protein, 9 aa, Homo Sapiens
SPPGPAASL

SEQ ID NO: 154394 - protein, 9 aa, Homo Sapiens
RPRPPCSST

SEQ ID NO: 154395 - protein, 9 aa, Homo Sapiens
LIIYEMLQN

SEQ ID NO: 154396 - protein, 9 aa, Homo Sapiens
RSLVGTWYS

SEQ ID NO: 154397 - protein, 9 aa, Homo Sapiens
QSPGRAPHP

SEQ ID NO: 154398 - protein, 9 aa, Homo Sapiens
IRPSLNGRR

SEQ ID NO: 154399 - protein, 9 aa, Homo Sapiens
VWSFLLRYY

SEQ ID NO: 154400 - protein, 9 aa, Homo Sapiens
SSVAVWSCV

SEQ ID NO: 154401 - protein, 9 aa, Homo Sapiens
HKGIKSSIG

SEQ ID NO: 154402 - protein, 9 aa, Homo Sapiens
HLITKPVIG

SEQ ID NO: 154403 - protein, 9 aa, Homo Sapiens
PTRSSSRTA

SEQ ID NO: 154404 - protein, 9 aa, Homo Sapiens
VHLQEAGGD

SEQ ID NO: 154405 - protein, 9 aa, Homo Sapiens
ASPTVCATV

SEQ ID NO: 154406 - protein, 9 aa, Homo Sapiens
TTAAGASGW

SEQ ID NO: 154407 - protein, 9 aa, Homo Sapiens
ATIMNRHLC

SEQ ID NO: 154408 - protein, 9 aa, Homo Sapiens
ETLERHSTP

SEQ ID NO: 154409 - protein, 9 aa, Homo Sapiens
KCNFDWEAI

SEQ ID NO: 154410 - protein, 9 aa, Homo Sapiens
CSEGKLILS

SEQ ID NO: 154411 - protein, 9 aa, Homo Sapiens
RGERLRHHF

SEQ ID NO: 154412 - protein, 9 aa, Homo Sapiens
MPHTFSKSP

SEQ ID NO: 154413 - protein, 9 aa, Homo Sapiens
FGRDQGLTF

SEQ ID NO: 154414 - protein, 9 aa, Homo Sapiens
ERVVERRRW

SEQ ID NO: 154415 - protein, 9 aa, Homo Sapiens
PGADVTGGT

SEQ ID NO: 154416 - protein, 9 aa, Homo Sapiens
RRQPPHHLV

SEQ ID NO: 154417 - protein, 9 aa, Homo Sapiens
AWNNTCNIL

SEQ ID NO: 154418 - protein, 9 aa, Homo Sapiens
SGLNAWNGF

SEQ ID NO: 154419 - protein, 9 aa, Homo Sapiens
ARVILGKHL

SEQ ID NO: 154420 - protein, 9 aa, Homo Sapiens
EIVCWFKEN

SEQ ID NO: 154421 - protein, 9 aa, Homo Sapiens
TLALTAKHH

SEQ ID NO: 154422 - protein, 9 aa, Homo Sapiens
WFSDKVLYH

SEQ ID NO: 154423 - protein, 9 aa, Homo Sapiens
NIPEEVCEH

SEQ ID NO: 154424 - protein, 9 aa, Homo Sapiens
LVRLMGPWH

SEQ ID NO: 154425 - protein, 9 aa, Homo Sapiens
IMDPDEVHL

SEQ ID NO: 154426 - protein, 9 aa, Homo Sapiens
THRKAQHLS

SEQ ID NO: 154427 - protein, 9 aa, Homo Sapiens
PKKLISHLM

SEQ ID NO: 154428 - protein, 9 aa, Homo Sapiens
SPPQSLDLP

SEQ ID NO: 154429 - protein, 9 aa, Homo Sapiens
WWRVPTPPS

SEQ ID NO: 154430 - protein, 9 aa, Homo Sapiens
QSCKNSYIK

SEQ ID NO: 154431 - protein, 9 aa, Homo Sapiens
PHLHLVMLH

SEQ ID NO: 154432 - protein, 9 aa, Homo Sapiens
DRFPVMSDA

SEQ ID NO: 154433 - protein, 9 aa, Homo Sapiens
EKMRRGPGV

SEQ ID NO: 154434 - protein, 9 aa, Homo Sapiens
AVSSRRLRP

SEQ ID NO: 154435 - protein, 9 aa, Homo Sapiens
GWPSWVGPC

SEQ ID NO: 154436 - protein, 9 aa, Homo Sapiens
LYLSMEMIY

SEQ ID NO: 154437 - protein, 9 aa, Homo Sapiens
VDFQLVLPG

SEQ ID NO: 154438 - protein, 9 aa, Homo Sapiens
LIALERRRV

SEQ ID NO: 154439 - protein, 9 aa, Homo Sapiens
PHANRQTSD

SEQ ID NO: 154440 - protein, 9 aa, Homo Sapiens
THSLSRNPI

SEQ ID NO: 154441 - protein, 9 aa, Homo Sapiens
TPTSTHKHT

SEQ ID NO: 154442 - protein, 9 aa, Homo Sapiens
DSWPTRRST

SEQ ID NO: 154443 - protein, 9 aa, Homo Sapiens
GRLLVLLGL

SEQ ID NO: 154444 - protein, 9 aa, Homo Sapiens
GLHSSPPTG

SEQ ID NO: 154445 - protein, 9 aa, Homo Sapiens
TPVADDHWH

SEQ ID NO: 154446 - protein, 9 aa, Homo Sapiens
RPSPCLSWS

SEQ ID NO: 154447 - protein, 9 aa, Homo Sapiens
KRGSDDKKK

SEQ ID NO: 154448 - protein, 9 aa, Homo Sapiens
APAVTPFQT

SEQ ID NO: 154449 - protein, 9 aa, Homo Sapiens
LTPLQQRPG

SEQ ID NO: 154450 - protein, 9 aa, Homo Sapiens
GLGRTQRWA

SEQ ID NO: 154451 - protein, 9 aa, Homo Sapiens
EPGPFQSCK

SEQ ID NO: 154452 - protein, 9 aa, Homo Sapiens
QAGARPGAS

SEQ ID NO: 154453 - protein, 9 aa, Homo Sapiens
TGDSGAPPC

SEQ ID NO: 154454 - protein, 9 aa, Homo Sapiens
ADGGHCRDD

SEQ ID NO: 154455 - protein, 9 aa, Homo Sapiens
EKILEKLMT

SEQ ID NO: 154456 - protein, 9 aa, Homo Sapiens
PGLRHFPYK

SEQ ID NO: 154457 - protein, 9 aa, Homo Sapiens
ISFRLPVSV

SEQ ID NO: 154458 - protein, 9 aa, Homo Sapiens
PPLLLGLAQ

SEQ ID NO: 154459 - protein, 9 aa, Homo Sapiens
RQLAGVLGP

SEQ ID NO: 154460 - protein, 9 aa, Homo Sapiens
SAASCASGV

SEQ ID NO: 154461 - protein, 9 aa, Homo Sapiens
QATSATTSS

SEQ ID NO: 154462 - protein, 9 aa, Homo Sapiens
RCAMAPETT

SEQ ID NO: 154463 - protein, 9 aa, Homo Sapiens
LAAGLGQLA

SEQ ID NO: 154464 - protein, 9 aa, Homo Sapiens
LFVVMAWNW

SEQ ID NO: 154465 - protein, 9 aa, Homo Sapiens
ACAESACDP

SEQ ID NO: 154466 - protein, 9 aa, Homo Sapiens
ATDTVGCCS

SEQ ID NO: 154467 - protein, 9 aa, Homo Sapiens
VEAANMGDV

SEQ ID NO: 154468 - protein, 9 aa, Homo Sapiens
PYVPPLPLA

SEQ ID NO: 154469 - protein, 9 aa, Homo Sapiens
FSQQDINGL

SEQ ID NO: 154470 - protein, 9 aa, Homo Sapiens
KYYEASGQF

SEQ ID NO: 154471 - protein, 9 aa, Homo Sapiens
MNAVKEKYG

SEQ ID NO: 154472 - protein, 9 aa, Homo Sapiens
RATLTSSYN

SEQ ID NO: 154473 - protein, 9 aa, Homo Sapiens
QKSSKKLKE

SEQ ID NO: 154474 - protein, 9 aa, Homo Sapiens
DSSSLTSLK

SEQ ID NO: 154475 - protein, 9 aa, Homo Sapiens
IKLRNSERV

SEQ ID NO: 154476 - protein, 9 aa, Homo Sapiens
EHSITLQVT

SEQ ID NO: 154477 - protein, 9 aa, Homo Sapiens
RTVKCQDYL

SEQ ID NO: 154478 - protein, 9 aa, Homo Sapiens
GSRPELMPH

SEQ ID NO: 154479 - protein, 9 aa, Homo Sapiens
FEMEYGKLQ

SEQ ID NO: 154480 - protein, 9 aa, Homo Sapiens
WWRTRACTP

SEQ ID NO: 154481 - protein, 9 aa, Homo Sapiens
TVQNRFTRN

SEQ ID NO: 154482 - protein, 9 aa, Homo Sapiens
PRTRGLISG

SEQ ID NO: 154483 - protein, 9 aa, Homo Sapiens
NRPQQPPPR

SEQ ID NO: 154484 - protein, 9 aa, Homo Sapiens
ICYGMHGFM

SEQ ID NO: 154485 - protein, 9 aa, Homo Sapiens
QQEEDCTFS

SEQ ID NO: 154486 - protein, 9 aa, Homo Sapiens
PSPSSLRRT

SEQ ID NO: 154487 - protein, 9 aa, Homo Sapiens
WNGTTMMAT

SEQ ID NO: 154488 - protein, 9 aa, Homo Sapiens
KSLHGQKML

SEQ ID NO: 154489 - protein, 9 aa, Homo Sapiens
DIYGHFGPF

SEQ ID NO: 154490 - protein, 9 aa, Homo Sapiens
GKKQSTQKK

SEQ ID NO: 154491 - protein, 9 aa, Homo Sapiens
LESGVCFDI

SEQ ID NO: 154492 - protein, 9 aa, Homo Sapiens
WCSVKSAVT

SEQ ID NO: 154493 - protein, 9 aa, Homo Sapiens
LENLRQKEE

SEQ ID NO: 154494 - protein, 9 aa, Homo Sapiens
LPLQPRGPP

SEQ ID NO: 154495 - protein, 9 aa, Homo Sapiens
DGSDAPLEA

SEQ ID NO: 154496 - protein, 9 aa, Homo Sapiens
TKQVLGESG

SEQ ID NO: 154497 - protein, 9 aa, Homo Sapiens
IKSVKTPDK

SEQ ID NO: 154498 - protein, 9 aa, Homo Sapiens
APEPVVGIP

SEQ ID NO: 154499 - protein, 9 aa, Homo Sapiens
PSLYNGHFF

SEQ ID NO: 154500 - protein, 9 aa, Homo Sapiens
LLLLLLDLP

SEQ ID NO: 154501 - protein, 9 aa, Homo Sapiens
RDYEEMASQ

SEQ ID NO: 154502 - protein, 9 aa, Homo Sapiens
LLDYIDRLF

SEQ ID NO: 154503 - protein, 9 aa, Homo Sapiens
PAFPVAGPP

SEQ ID NO: 154504 - protein, 9 aa, Homo Sapiens
QILRVNNKS

SEQ ID NO: 154505 - protein, 9 aa, Homo Sapiens
TTARSVHAA

SEQ ID NO: 154506 - protein, 9 aa, Homo Sapiens
IHTDTHADT

SEQ ID NO: 154507 - protein, 9 aa, Homo Sapiens
LEQCKEAVA

SEQ ID NO: 154508 - protein, 9 aa, Homo Sapiens
ARKHSGTDR

SEQ ID NO: 154509 - protein, 9 aa, Homo Sapiens
AVLIFNIHV

SEQ ID NO: 154510 - protein, 9 aa, Homo Sapiens
VLAGIVMTK

SEQ ID NO: 154511 - protein, 9 aa, Homo Sapiens
HRTTNPHSP

SEQ ID NO: 154512 - protein, 9 aa, Homo Sapiens
GRLFISRAN

SEQ ID NO: 154513 - protein, 9 aa, Homo Sapiens
PEVGSPSYA

SEQ ID NO: 154514 - protein, 9 aa, Homo Sapiens
LRMHTVPLD

SEQ ID NO: 154515 - protein, 9 aa, Homo Sapiens
VHGQHHRCV

SEQ ID NO: 154516 - protein, 9 aa, Homo Sapiens
GRSPTTTAR

SEQ ID NO: 154517 - protein, 9 aa, Homo Sapiens
AVDPPWSSQ

SEQ ID NO: 154518 - protein, 9 aa, Homo Sapiens
EGAPERAAK

SEQ ID NO: 154519 - protein, 9 aa, Homo Sapiens
LAPFLRPCH

SEQ ID NO: 154520 - protein, 9 aa, Homo Sapiens
LRHLEGGIT

SEQ ID NO: 154521 - protein, 9 aa, Homo Sapiens
FWLQELNEY

SEQ ID NO: 154522 - protein, 9 aa, Homo Sapiens
LLEHCIEFV

SEQ ID NO: 154523 - protein, 9 aa, Homo Sapiens
EKEDGEATD

SEQ ID NO: 154524 - protein, 9 aa, Homo Sapiens
LLGADSWKQ

SEQ ID NO: 154525 - protein, 9 aa, Homo Sapiens
PEHTGKCCV

SEQ ID NO: 154526 - protein, 9 aa, Homo Sapiens
CLPSCNNRH

SEQ ID NO: 154527 - protein, 9 aa, Homo Sapiens
LTGHFGSAS

SEQ ID NO: 154528 - protein, 9 aa, Homo Sapiens
DSSPITNSK

SEQ ID NO: 154529 - protein, 9 aa, Homo Sapiens
EGRKKAFVT

SEQ ID NO: 154530 - protein, 9 aa, Homo Sapiens
SCFHLETLQ

SEQ ID NO: 154531 - protein, 9 aa, Homo Sapiens
VPTPATTLR

SEQ ID NO: 154532 - protein, 9 aa, Homo Sapiens
AQGPSSRDR

SEQ ID NO: 154533 - protein, 9 aa, Homo Sapiens
RPGHTGDPH

SEQ ID NO: 154534 - protein, 9 aa, Homo Sapiens
DVKKQPFFM

SEQ ID NO: 154535 - protein, 9 aa, Homo Sapiens
LGCIWTGQE

SEQ ID NO: 154536 - protein, 9 aa, Homo Sapiens
SSTYVNPQH

SEQ ID NO: 154537 - protein, 9 aa, Homo Sapiens
VGRPAQKSS

SEQ ID NO: 154538 - protein, 9 aa, Homo Sapiens
ELSAGCDPR

SEQ ID NO: 154539 - protein, 9 aa, Homo Sapiens
TCKGSTPTD

SEQ ID NO: 154540 - protein, 9 aa, Homo Sapiens
CRCANTRPG

SEQ ID NO: 154541 - protein, 9 aa, Homo Sapiens
PRAAIWRRI

SEQ ID NO: 154542 - protein, 9 aa, Homo Sapiens
PAVPAALAG

SEQ ID NO: 154543 - protein, 9 aa, Homo Sapiens
GRPLGHPSR

SEQ ID NO: 154544 - protein, 9 aa, Homo Sapiens
QTKFNLRLI

SEQ ID NO: 154545 - protein, 9 aa, Homo Sapiens
AESACDPRG

SEQ ID NO: 154546 - protein, 9 aa, Homo Sapiens
NCIGCARSW

SEQ ID NO: 154547 - protein, 9 aa, Homo Sapiens
GSASVNSIW

SEQ ID NO: 154548 - protein, 9 aa, Homo Sapiens
LQALDYDRF

SEQ ID NO: 154549 - protein, 9 aa, Homo Sapiens
PVLQGFSDA

SEQ ID NO: 154550 - protein, 9 aa, Homo Sapiens
YKYIEYRRA

SEQ ID NO: 154551 - protein, 9 aa, Homo Sapiens
TQEHSITLQ

SEQ ID NO: 154552 - protein, 9 aa, Homo Sapiens
PTARATSGT

SEQ ID NO: 154553 - protein, 9 aa, Homo Sapiens
NLEKIHKRN

SEQ ID NO: 154554 - protein, 9 aa, Homo Sapiens
FMEGDEHIH

SEQ ID NO: 154555 - protein, 9 aa, Homo Sapiens
CLIRLHGWL

SEQ ID NO: 154556 - protein, 9 aa, Homo Sapiens
SSMLYMPLH

SEQ ID NO: 154557 - protein, 9 aa, Homo Sapiens
ELTVLALVA

SEQ ID NO: 154558 - protein, 9 aa, Homo Sapiens
ELSPLLLLP

SEQ ID NO: 154559 - protein, 9 aa, Homo Sapiens
RPSLCWPSR

SEQ ID NO: 154560 - protein, 9 aa, Homo Sapiens
DCASSGGSD

SEQ ID NO: 154561 - protein, 9 aa, Homo Sapiens
GGSRPELMP

SEQ ID NO: 154562 - protein, 9 aa, Homo Sapiens
VPEQCRCAN

SEQ ID NO: 154563 - protein, 9 aa, Homo Sapiens
YIISSEKIT

SEQ ID NO: 154564 - protein, 9 aa, Homo Sapiens
WRKRRKRSR

SEQ ID NO: 154565 - protein, 9 aa, Homo Sapiens
FPQDKFYDV

SEQ ID NO: 154566 - protein, 9 aa, Homo Sapiens
TFHLRCTHH

SEQ ID NO: 154567 - protein, 9 aa, Homo Sapiens
ASLMITRAR

SEQ ID NO: 154568 - protein, 9 aa, Homo Sapiens
EDFTLLDFM

SEQ ID NO: 154569 - protein, 9 aa, Homo Sapiens
HERLKNPLK

SEQ ID NO: 154570 - protein, 9 aa, Homo Sapiens
LMAQLTAAA

SEQ ID NO: 154571 - protein, 9 aa, Homo Sapiens
QKHLEHWWW

SEQ ID NO: 154572 - protein, 9 aa, Homo Sapiens
TRRARRAPR

SEQ ID NO: 154573 - protein, 9 aa, Homo Sapiens
FFSAKCGEG

SEQ ID NO: 154574 - protein, 9 aa, Homo Sapiens
EKAFPAHLA

SEQ ID NO: 154575 - protein, 9 aa, Homo Sapiens
RQNMSLEMW

SEQ ID NO: 154576 - protein, 9 aa, Homo Sapiens
AKKSTDKDE

SEQ ID NO: 154577 - protein, 9 aa, Homo Sapiens
LGSACIAIK

SEQ ID NO: 154578 - protein, 9 aa, Homo Sapiens
SACLHPNSS

SEQ ID NO: 154579 - protein, 9 aa, Homo Sapiens
HNSEKRKLK

SEQ ID NO: 154580 - protein, 9 aa, Homo Sapiens
RKKRSQMPS

SEQ ID NO: 154581 - protein, 9 aa, Homo Sapiens
WTCLADLEG

SEQ ID NO: 154582 - protein, 9 aa, Homo Sapiens
DRTDHSDEL

SEQ ID NO: 154583 - protein, 9 aa, Homo Sapiens
LNLSLEPAD

SEQ ID NO: 154584 - protein, 9 aa, Homo Sapiens
SCWAAPVIT

SEQ ID NO: 154585 - protein, 9 aa, Homo Sapiens
HPIHLSKFM

SEQ ID NO: 154586 - protein, 9 aa, Homo Sapiens
IKKKRTEFS

SEQ ID NO: 154587 - protein, 9 aa, Homo Sapiens
PRRQPPHHL

SEQ ID NO: 154588 - protein, 9 aa, Homo Sapiens
AVSSRMVSF

SEQ ID NO: 154589 - protein, 9 aa, Homo Sapiens
ATVTILGQE

SEQ ID NO: 154590 - protein, 9 aa, Homo Sapiens
TRENLHWDG

SEQ ID NO: 154591 - protein, 9 aa, Homo Sapiens
VSIRGEVWS

SEQ ID NO: 154592 - protein, 9 aa, Homo Sapiens
LSPVSGVGQ

SEQ ID NO: 154593 - protein, 9 aa, Homo Sapiens
ADRDSSPIT

SEQ ID NO: 154594 - protein, 9 aa, Homo Sapiens
FLLGRAVGT

SEQ ID NO: 154595 - protein, 9 aa, Homo Sapiens
CGYLFLSWK

SEQ ID NO: 154596 - protein, 9 aa, Homo Sapiens
PFERLTSAY

SEQ ID NO: 154597 - protein, 9 aa, Homo Sapiens
EPFERLTSA

SEQ ID NO: 154598 - protein, 9 aa, Homo Sapiens
QQSPKVQVS

SEQ ID NO: 154599 - protein, 9 aa, Homo Sapiens
LEGGLNEDE

SEQ ID NO: 154600 - protein, 9 aa, Homo Sapiens
TSCFGPSKI

SEQ ID NO: 154601 - protein, 9 aa, Homo Sapiens
HLMFAVWEE

SEQ ID NO: 154602 - protein, 9 aa, Homo Sapiens
TPVPTATAA

SEQ ID NO: 154603 - protein, 9 aa, Homo Sapiens
GATLRFLKL

SEQ ID NO: 154604 - protein, 9 aa, Homo Sapiens
SPRLVNAVA

SEQ ID NO: 154605 - protein, 9 aa, Homo Sapiens
NVAGVWRAR

SEQ ID NO: 154606 - protein, 9 aa, Homo Sapiens
VKLFRFDAD

SEQ ID NO: 154607 - protein, 9 aa, Homo Sapiens
HCPTATAAC

SEQ ID NO: 154608 - protein, 9 aa, Homo Sapiens
LFFLLLVQA

SEQ ID NO: 154609 - protein, 9 aa, Homo Sapiens
MVTVPHVTT

SEQ ID NO: 154610 - protein, 9 aa, Homo Sapiens
TPASLMITR

SEQ ID NO: 154611 - protein, 9 aa, Homo Sapiens
KGAQLGGGQ

SEQ ID NO: 154612 - protein, 9 aa, Homo Sapiens
TVCATVAQF

SEQ ID NO: 154613 - protein, 9 aa, Homo Sapiens
TGLPRKSVT

SEQ ID NO: 154614 - protein, 9 aa, Homo Sapiens
EFMEGDEHI

SEQ ID NO: 154615 - protein, 9 aa, Homo Sapiens
TEEAWRKLK

SEQ ID NO: 154616 - protein, 9 aa, Homo Sapiens
LEGGLPVGE

SEQ ID NO: 154617 - protein, 9 aa, Homo Sapiens
IPLKPTMKM

SEQ ID NO: 154618 - protein, 9 aa, Homo Sapiens
VSTAFEEGQ

SEQ ID NO: 154619 - protein, 9 aa, Homo Sapiens
KKAYPSEKS

SEQ ID NO: 154620 - protein, 9 aa, Homo Sapiens
FLLWLLRGR

SEQ ID NO: 154621 - protein, 9 aa, Homo Sapiens
QMDTNGLVR

SEQ ID NO: 154622 - protein, 9 aa, Homo Sapiens
VHEKYQCQA

SEQ ID NO: 154623 - protein, 9 aa, Homo Sapiens
GPHGGQLRL

SEQ ID NO: 154624 - protein, 9 aa, Homo Sapiens
SATLTSNNT

SEQ ID NO: 154625 - protein, 9 aa, Homo Sapiens
QPDQAHRPD

SEQ ID NO: 154626 - protein, 9 aa, Homo Sapiens
NPRFDENVV

SEQ ID NO: 154627 - protein, 9 aa, Homo Sapiens
VAPATLPCR

SEQ ID NO: 154628 - protein, 9 aa, Homo Sapiens
RVCPSPSTA

SEQ ID NO: 154629 - protein, 9 aa, Homo Sapiens
EELRRCEEN

SEQ ID NO: 154630 - protein, 9 aa, Homo Sapiens
LLTAASLVG

SEQ ID NO: 154631 - protein, 9 aa, Homo Sapiens
LSPVQWVGD

SEQ ID NO: 154632 - protein, 9 aa, Homo Sapiens
LPKVEVMNK

SEQ ID NO: 154633 - protein, 9 aa, Homo Sapiens
EGRCGRRRR

SEQ ID NO: 154634 - protein, 9 aa, Homo Sapiens
AATEMDMWS

SEQ ID NO: 154635 - protein, 9 aa, Homo Sapiens
LDDVDISVC

SEQ ID NO: 154636 - protein, 9 aa, Homo Sapiens
VKSRDQVHD

SEQ ID NO: 154637 - protein, 9 aa, Homo Sapiens
QVNMTDVST

SEQ ID NO: 154638 - protein, 9 aa, Homo Sapiens
KPPSLAQAQ

SEQ ID NO: 154639 - protein, 9 aa, Homo Sapiens
LARSHQPKD

SEQ ID NO: 154640 - protein, 9 aa, Homo Sapiens
RRQASSGYD

SEQ ID NO: 154641 - protein, 9 aa, Homo Sapiens
VRRQLSVRA

SEQ ID NO: 154642 - protein, 9 aa, Homo Sapiens
DFTVKQTRH

SEQ ID NO: 154643 - protein, 9 aa, Homo Sapiens
RQTLRTLSL

SEQ ID NO: 154644 - protein, 9 aa, Homo Sapiens
RGSPRPSTK

SEQ ID NO: 154645 - protein, 9 aa, Homo Sapiens
TPAKGRCIP

SEQ ID NO: 154646 - protein, 9 aa, Homo Sapiens
MSYLHPSKT

SEQ ID NO: 154647 - protein, 9 aa, Homo Sapiens
VHPAQTSLT

SEQ ID NO: 154648 - protein, 9 aa, Homo Sapiens
RKPKGSLMA

SEQ ID NO: 154649 - protein, 9 aa, Homo Sapiens
VPRMSSPRR

SEQ ID NO: 154650 - protein, 9 aa, Homo Sapiens
APATPPFGL

SEQ ID NO: 154651 - protein, 9 aa, Homo Sapiens
RPPRQVREH

SEQ ID NO: 154652 - protein, 9 aa, Homo Sapiens
TTSWCGWRT

SEQ ID NO: 154653 - protein, 9 aa, Homo Sapiens
GSDAPLEAL

SEQ ID NO: 154654 - protein, 9 aa, Homo Sapiens
MTVGNINEL

SEQ ID NO: 154655 - protein, 9 aa, Homo Sapiens
FGPFQMRNV

SEQ ID NO: 154656 - protein, 9 aa, Homo Sapiens
EGRTTTCKG

SEQ ID NO: 154657 - protein, 9 aa, Homo Sapiens
SNDPEPPVP

SEQ ID NO: 154658 - protein, 9 aa, Homo Sapiens
AIDLYPSLY

SEQ ID NO: 154659 - protein, 9 aa, Homo Sapiens
SVAPATLPC

SEQ ID NO: 154660 - protein, 9 aa, Homo Sapiens
DAKVVDPST

SEQ ID NO: 154661 - protein, 9 aa, Homo Sapiens
TVLALVAVL

SEQ ID NO: 154662 - protein, 9 aa, Homo Sapiens
KTYLLGLDD

SEQ ID NO: 154663 - protein, 9 aa, Homo Sapiens
FGLIPRLPT

SEQ ID NO: 154664 - protein, 9 aa, Homo Sapiens
RLQLRSQDP

SEQ ID NO: 154665 - protein, 9 aa, Homo Sapiens
NNLMYMTVK

SEQ ID NO: 154666 - protein, 9 aa, Homo Sapiens
RTRGAPAAA

SEQ ID NO: 154667 - protein, 9 aa, Homo Sapiens
PGVPRRQLP

SEQ ID NO: 154668 - protein, 9 aa, Homo Sapiens
TAPERAGRT

SEQ ID NO: 154669 - protein, 9 aa, Homo Sapiens
AFITYPRAV

SEQ ID NO: 154670 - protein, 9 aa, Homo Sapiens
YQCQAPSVF

SEQ ID NO: 154671 - protein, 9 aa, Homo Sapiens
SDAVSHLLQ

SEQ ID NO: 154672 - protein, 9 aa, Homo Sapiens
PGYSGPSLP

SEQ ID NO: 154673 - protein, 9 aa, Homo Sapiens
GRHVAYSVG

SEQ ID NO: 154674 - protein, 9 aa, Homo Sapiens
KGGNGWRNS

SEQ ID NO: 154675 - protein, 9 aa, Homo Sapiens
GAPLSAGTW

SEQ ID NO: 154676 - protein, 9 aa, Homo Sapiens
SAGEWSLCT

SEQ ID NO: 154677 - protein, 9 aa, Homo Sapiens
IPWLNWSSC

SEQ ID NO: 154678 - protein, 9 aa, Homo Sapiens
RVRHGFLQL

SEQ ID NO: 154679 - protein, 9 aa, Homo Sapiens
KAFRISSCL

SEQ ID NO: 154680 - protein, 9 aa, Homo Sapiens
WRRACVQST

SEQ ID NO: 154681 - protein, 9 aa, Homo Sapiens
SRALCLAPF

SEQ ID NO: 154682 - protein, 9 aa, Homo Sapiens
AHITPSAPS

SEQ ID NO: 154683 - protein, 9 aa, Homo Sapiens
LQTSNNNME

SEQ ID NO: 154684 - protein, 9 aa, Homo Sapiens
HQLTASLTV

SEQ ID NO: 154685 - protein, 9 aa, Homo Sapiens
QWQKKWVHS

SEQ ID NO: 154686 - protein, 9 aa, Homo Sapiens
FFLTFYIIS

SEQ ID NO: 154687 - protein, 9 aa, Homo Sapiens
QTARGYAVS

SEQ ID NO: 154688 - protein, 9 aa, Homo Sapiens
GEEGRPPDV

SEQ ID NO: 154689 - protein, 9 aa, Homo Sapiens
SWRSPCSGP

SEQ ID NO: 154690 - protein, 9 aa, Homo Sapiens
ACEALRLQR

SEQ ID NO: 154691 - protein, 9 aa, Homo Sapiens
TVSRSCSTL

SEQ ID NO: 154692 - protein, 9 aa, Homo Sapiens
AGPPGCAAL

SEQ ID NO: 154693 - protein, 9 aa, Homo Sapiens
LELDRSHEL

SEQ ID NO: 154694 - protein, 9 aa, Homo Sapiens
TKPLNNFRS

SEQ ID NO: 154695 - protein, 9 aa, Homo Sapiens
YPKRLGRLL

SEQ ID NO: 154696 - protein, 9 aa, Homo Sapiens
APQAEAEVR

SEQ ID NO: 154697 - protein, 9 aa, Homo Sapiens
QRGRDDDVS

SEQ ID NO: 154698 - protein, 9 aa, Homo Sapiens
YNQNRLSFY

SEQ ID NO: 154699 - protein, 9 aa, Homo Sapiens
NNKSLARVT

SEQ ID NO: 154700 - protein, 9 aa, Homo Sapiens
LLPGQPMAA

SEQ ID NO: 154701 - protein, 9 aa, Homo Sapiens
MSSEVTRLW

SEQ ID NO: 154702 - protein, 9 aa, Homo Sapiens
AVVGVATAH

SEQ ID NO: 154703 - protein, 9 aa, Homo Sapiens
TQGERLKEA

SEQ ID NO: 154704 - protein, 9 aa, Homo Sapiens
CRLKELILS

SEQ ID NO: 154705 - protein, 9 aa, Homo Sapiens
LSFLKGQII

SEQ ID NO: 154706 - protein, 9 aa, Homo Sapiens
LKHQLRHPL

SEQ ID NO: 154707 - protein, 9 aa, Homo Sapiens
QTEGEEEKK

SEQ ID NO: 154708 - protein, 9 aa, Homo Sapiens
EADLADGAH

SEQ ID NO: 154709 - protein, 9 aa, Homo Sapiens
ATPHVPHAR

SEQ ID NO: 154710 - protein, 9 aa, Homo Sapiens
SPGHPRGSQ

SEQ ID NO: 154711 - protein, 9 aa, Homo Sapiens
WPGPPSYEA

SEQ ID NO: 154712 - protein, 9 aa, Homo Sapiens
GPMGPPGLH

SEQ ID NO: 154713 - protein, 9 aa, Homo Sapiens
CPALRKTLP

SEQ ID NO: 154714 - protein, 9 aa, Homo Sapiens
THKGEIPKD

SEQ ID NO: 154715 - protein, 9 aa, Homo Sapiens
AGRTALAPR

SEQ ID NO: 154716 - protein, 9 aa, Homo Sapiens
DVEAIPHVP

SEQ ID NO: 154717 - protein, 9 aa, Homo Sapiens
LGSSPSTPP

SEQ ID NO: 154718 - protein, 9 aa, Homo Sapiens
SGDEAEPLG

SEQ ID NO: 154719 - protein, 9 aa, Homo Sapiens
WGGRWPGPP

SEQ ID NO: 154720 - protein, 9 aa, Homo Sapiens
APQHLIRVE

SEQ ID NO: 154721 - protein, 9 aa, Homo Sapiens
AAATAAGGR

SEQ ID NO: 154722 - protein, 9 aa, Homo Sapiens
PRAPAPAPR

SEQ ID NO: 154723 - protein, 9 aa, Homo Sapiens
KINSRCGSQ

SEQ ID NO: 154724 - protein, 9 aa, Homo Sapiens
GLKVKALEK

SEQ ID NO: 154725 - protein, 9 aa, Homo Sapiens
EEDLHQIFM

SEQ ID NO: 154726 - protein, 9 aa, Homo Sapiens
PGETGLLPE

SEQ ID NO: 154727 - protein, 9 aa, Homo Sapiens
QNVEKEAQA

SEQ ID NO: 154728 - protein, 9 aa, Homo Sapiens
VGESPWQVM

SEQ ID NO: 154729 - protein, 9 aa, Homo Sapiens
MDKPGLGPS

SEQ ID NO: 154730 - protein, 9 aa, Homo Sapiens
DRERGPWSP

SEQ ID NO: 154731 - protein, 9 aa, Homo Sapiens
GFRPSTARV

SEQ ID NO: 154732 - protein, 9 aa, Homo Sapiens
NTNTPGSAS

SEQ ID NO: 154733 - protein, 9 aa, Homo Sapiens
AKNQAYVMM

SEQ ID NO: 154734 - protein, 9 aa, Homo Sapiens
WHGLMAADR

SEQ ID NO: 154735 - protein, 9 aa, Homo Sapiens
CVPAKDSTS

SEQ ID NO: 154736 - protein, 9 aa, Homo Sapiens
SLWSTPAPQ

SEQ ID NO: 154737 - protein, 9 aa, Homo Sapiens
SGGSDLSGF

SEQ ID NO: 154738 - protein, 9 aa, Homo Sapiens
RASPAPGSS

SEQ ID NO: 154739 - protein, 9 aa, Homo Sapiens
EMGSLSLLP

SEQ ID NO: 154740 - protein, 9 aa, Homo Sapiens
LRTLSLRGM

SEQ ID NO: 154741 - protein, 9 aa, Homo Sapiens
NDPEPPVPA

SEQ ID NO: 154742 - protein, 9 aa, Homo Sapiens
KPKLHLAAG

SEQ ID NO: 154743 - protein, 9 aa, Homo Sapiens
DEEGLKHFG

SEQ ID NO: 154744 - protein, 9 aa, Homo Sapiens
GWRTLSSSA

SEQ ID NO: 154745 - protein, 9 aa, Homo Sapiens
LYVREVFPG

SEQ ID NO: 154746 - protein, 9 aa, Homo Sapiens
PPLQPRPCP

SEQ ID NO: 154747 - protein, 9 aa, Homo Sapiens
TSVRGCSYR

SEQ ID NO: 154748 - protein, 9 aa, Homo Sapiens
GDCILKLNT

SEQ ID NO: 154749 - protein, 9 aa, Homo Sapiens
QPRPCPLAL

SEQ ID NO: 154750 - protein, 9 aa, Homo Sapiens
TILGPQDLS

SEQ ID NO: 154751 - protein, 9 aa, Homo Sapiens
VPAPAPPLF

SEQ ID NO: 154752 - protein, 9 aa, Homo Sapiens
QKGSQMSTD

SEQ ID NO: 154753 - protein, 9 aa, Homo Sapiens
SRTLFPSLY

SEQ ID NO: 154754 - protein, 9 aa, Homo Sapiens
GGKRATPDL

SEQ ID NO: 154755 - protein, 9 aa, Homo Sapiens
QRPSLAVSS

SEQ ID NO: 154756 - protein, 9 aa, Homo Sapiens
GASAPLWAS

SEQ ID NO: 154757 - protein, 9 aa, Homo Sapiens
ANGDPLLRR

SEQ ID NO: 154758 - protein, 9 aa, Homo Sapiens
RGSCRRGAA

SEQ ID NO: 154759 - protein, 9 aa, Homo Sapiens
LYILYTSDT

SEQ ID NO: 154760 - protein, 9 aa, Homo Sapiens
HPCLDIPGL

SEQ ID NO: 154761 - protein, 9 aa, Homo Sapiens
SWRRTWRRS

SEQ ID NO: 154762 - protein, 9 aa, Homo Sapiens
RDDVKLPGL

SEQ ID NO: 154763 - protein, 9 aa, Homo Sapiens
PVNQGIRGK

SEQ ID NO: 154764 - protein, 9 aa, Homo Sapiens
QKISVHAFQ

SEQ ID NO: 154765 - protein, 9 aa, Homo Sapiens
SGHTMPTSA

SEQ ID NO: 154766 - protein, 9 aa, Homo Sapiens
HCATVHQGL

SEQ ID NO: 154767 - protein, 9 aa, Homo Sapiens
PSATNPTWR

SEQ ID NO: 154768 - protein, 9 aa, Homo Sapiens
GLRCVKPNS

SEQ ID NO: 154769 - protein, 9 aa, Homo Sapiens
HAAAEADQL

SEQ ID NO: 154770 - protein, 9 aa, Homo Sapiens
ILINPENMG

SEQ ID NO: 154771 - protein, 9 aa, Homo Sapiens
LQYAGDDSV

SEQ ID NO: 154772 - protein, 9 aa, Homo Sapiens
SDDSDPEPD

SEQ ID NO: 154773 - protein, 9 aa, Homo Sapiens
GGVSTSWGP

SEQ ID NO: 154774 - protein, 9 aa, Homo Sapiens
SCARSISGR

SEQ ID NO: 154775 - protein, 9 aa, Homo Sapiens
RLRRPSPQS

SEQ ID NO: 154776 - protein, 9 aa, Homo Sapiens
GLKSWISVP

SEQ ID NO: 154777 - protein, 9 aa, Homo Sapiens
PPPPLLKLG

SEQ ID NO: 154778 - protein, 9 aa, Homo Sapiens
WPEVWKEVR

SEQ ID NO: 154779 - protein, 9 aa, Homo Sapiens
IEMGSFNLS

SEQ ID NO: 154780 - protein, 9 aa, Homo Sapiens
AAPSLALRS

SEQ ID NO: 154781 - protein, 9 aa, Homo Sapiens
CKAGAAERG

SEQ ID NO: 154782 - protein, 9 aa, Homo Sapiens
VACPQRLPK

SEQ ID NO: 154783 - protein, 9 aa, Homo Sapiens
AAMKTTTMR

SEQ ID NO: 154784 - protein, 9 aa, Homo Sapiens
SVRAASKEK

SEQ ID NO: 154785 - protein, 9 aa, Homo Sapiens
FFLHKEFLL

SEQ ID NO: 154786 - protein, 9 aa, Homo Sapiens
ALLNPIETP

SEQ ID NO: 154787 - protein, 9 aa, Homo Sapiens
FSGRTPLPA

SEQ ID NO: 154788 - protein, 9 aa, Homo Sapiens
PPCKTSPPP

SEQ ID NO: 154789 - protein, 9 aa, Homo Sapiens
RKEVHALKR

SEQ ID NO: 154790 - protein, 9 aa, Homo Sapiens
RTAPERAGR

SEQ ID NO: 154791 - protein, 9 aa, Homo Sapiens
AYEFLCTNS

SEQ ID NO: 154792 - protein, 9 aa, Homo Sapiens
LVLLQEPAL

SEQ ID NO: 154793 - protein, 9 aa, Homo Sapiens
PTAELTGSG

SEQ ID NO: 154794 - protein, 9 aa, Homo Sapiens
IGRAGGPFQ

SEQ ID NO: 154795 - protein, 9 aa, Homo Sapiens
TGIHTDTHT

SEQ ID NO: 154796 - protein, 9 aa, Homo Sapiens
LFIAALILT

SEQ ID NO: 154797 - protein, 9 aa, Homo Sapiens
PPPPPRRCC

SEQ ID NO: 154798 - protein, 9 aa, Homo Sapiens
LPSTCSDIW

SEQ ID NO: 154799 - protein, 9 aa, Homo Sapiens
SESSSKSDS

SEQ ID NO: 154800 - protein, 9 aa, Homo Sapiens
ARMTRTRSD

SEQ ID NO: 154801 - protein, 9 aa, Homo Sapiens
LNMEKNYNL

SEQ ID NO: 154802 - protein, 9 aa, Homo Sapiens
RHTHTQAYT

SEQ ID NO: 154803 - protein, 9 aa, Homo Sapiens
AAPRRWSCW

SEQ ID NO: 154804 - protein, 9 aa, Homo Sapiens
KVTSSLGIR

SEQ ID NO: 154805 - protein, 9 aa, Homo Sapiens
CHPRYPPHP

SEQ ID NO: 154806 - protein, 9 aa, Homo Sapiens
FRISASLAA

SEQ ID NO: 154807 - protein, 9 aa, Homo Sapiens
QGRHPVRVP

SEQ ID NO: 154808 - protein, 9 aa, Homo Sapiens
PPPLPAPPS

SEQ ID NO: 154809 - protein, 9 aa, Homo Sapiens
LADAPCRHR

SEQ ID NO: 154810 - protein, 9 aa, Homo Sapiens
GQEAAGSLI

SEQ ID NO: 154811 - protein, 9 aa, Homo Sapiens
SHSQSLSHL

SEQ ID NO: 154812 - protein, 9 aa, Homo Sapiens
PSLCWPSRT

SEQ ID NO: 154813 - protein, 9 aa, Homo Sapiens
GLKYEEFDC

SEQ ID NO: 154814 - protein, 9 aa, Homo Sapiens
LTDGKDKGN

SEQ ID NO: 154815 - protein, 9 aa, Homo Sapiens
AQKSSKKLK

SEQ ID NO: 154816 - protein, 9 aa, Homo Sapiens
PLSMTFVYR

SEQ ID NO: 154817 - protein, 9 aa, Homo Sapiens
KLEQRGRLL

SEQ ID NO: 154818 - protein, 9 aa, Homo Sapiens
SKARSLYSP

SEQ ID NO: 154819 - protein, 9 aa, Homo Sapiens
LMPAQLFLR

SEQ ID NO: 154820 - protein, 9 aa, Homo Sapiens
PRRGSSQGC

SEQ ID NO: 154821 - protein, 9 aa, Homo Sapiens
RDWLRGPSA

SEQ ID NO: 154822 - protein, 9 aa, Homo Sapiens
DVKLPGLAV

SEQ ID NO: 154823 - protein, 9 aa, Homo Sapiens
SGWPRTPSP

SEQ ID NO: 154824 - protein, 9 aa, Homo Sapiens
VPDQEPTHT

SEQ ID NO: 154825 - protein, 9 aa, Homo Sapiens
PLLRPEFSQ

SEQ ID NO: 154826 - protein, 9 aa, Homo Sapiens
DLPPMGRPS

SEQ ID NO: 154827 - protein, 9 aa, Homo Sapiens
REISGWAMA

SEQ ID NO: 154828 - protein, 9 aa, Homo Sapiens
QQGYLGRWG

SEQ ID NO: 154829 - protein, 9 aa, Homo Sapiens
LWLSQRPSL

SEQ ID NO: 154830 - protein, 9 aa, Homo Sapiens
SDGQVSKSN

SEQ ID NO: 154831 - protein, 9 aa, Homo Sapiens
DDFTVINRC

SEQ ID NO: 154832 - protein, 9 aa, Homo Sapiens
PLKPTMKML

SEQ ID NO: 154833 - protein, 9 aa, Homo Sapiens
ADRAWGLFT

SEQ ID NO: 154834 - protein, 9 aa, Homo Sapiens
AGAFPPLED

SEQ ID NO: 154835 - protein, 9 aa, Homo Sapiens
SGFRNSGIM

SEQ ID NO: 154836 - protein, 9 aa, Homo Sapiens
WLQELNEYL

SEQ ID NO: 154837 - protein, 9 aa, Homo Sapiens
HPAHFCHHG

SEQ ID NO: 154838 - protein, 9 aa, Homo Sapiens
RAGQTEGEE

SEQ ID NO: 154839 - protein, 9 aa, Homo Sapiens
LDGSQRPPR

SEQ ID NO: 154840 - protein, 9 aa, Homo Sapiens
APRTSAGLL

SEQ ID NO: 154841 - protein, 9 aa, Homo Sapiens
GLYIFCQEL

SEQ ID NO: 154842 - protein, 9 aa, Homo Sapiens
RKPPTPKST

SEQ ID NO: 154843 - protein, 9 aa, Homo Sapiens
MEYTSGGEV

SEQ ID NO: 154844 - protein, 9 aa, Homo Sapiens
RGPRTPRSS

SEQ ID NO: 154845 - protein, 9 aa, Homo Sapiens
THSAWRRPS

SEQ ID NO: 154846 - protein, 9 aa, Homo Sapiens
PSKLDFFRS

SEQ ID NO: 154847 - protein, 9 aa, Homo Sapiens
YPVPQHPPT

SEQ ID NO: 154848 - protein, 9 aa, Homo Sapiens
SSLGARLSR

SEQ ID NO: 154849 - protein, 9 aa, Homo Sapiens
HTFSKSPST

SEQ ID NO: 154850 - protein, 9 aa, Homo Sapiens
FVSKGNLQT

SEQ ID NO: 154851 - protein, 9 aa, Homo Sapiens
KAPCGRQCL

SEQ ID NO: 154852 - protein, 9 aa, Homo Sapiens
PAAMMGAFL

SEQ ID NO: 154853 - protein, 9 aa, Homo Sapiens
KLDYIAYLS

SEQ ID NO: 154854 - protein, 9 aa, Homo Sapiens
AGYSVRAKV

SEQ ID NO: 154855 - protein, 9 aa, Homo Sapiens
CPESLHDIM

SEQ ID NO: 154856 - protein, 9 aa, Homo Sapiens
NAMWYINGT

SEQ ID NO: 154857 - protein, 9 aa, Homo Sapiens
WQPRPPRFL

SEQ ID NO: 154858 - protein, 9 aa, Homo Sapiens
AYTLTYTGT

SEQ ID NO: 154859 - protein, 9 aa, Homo Sapiens
VIPEKQTMK

SEQ ID NO: 154860 - protein, 9 aa, Homo Sapiens
LEGAQAFVD

SEQ ID NO: 154861 - protein, 9 aa, Homo Sapiens
LRVRRRFPL

SEQ ID NO: 154862 - protein, 9 aa, Homo Sapiens
APPRSLQNL

SEQ ID NO: 154863 - protein, 9 aa, Homo Sapiens
VEHKKKLEA

SEQ ID NO: 154864 - protein, 9 aa, Homo Sapiens
GRLWTPAKG

SEQ ID NO: 154865 - protein, 9 aa, Homo Sapiens
TAGTQNCEV

SEQ ID NO: 154866 - protein, 9 aa, Homo Sapiens
SGFSARQRL

SEQ ID NO: 154867 - protein, 9 aa, Homo Sapiens
FSLLFIAAL

SEQ ID NO: 154868 - protein, 9 aa, Homo Sapiens
MWYINGTRL

SEQ ID NO: 154869 - protein, 9 aa, Homo Sapiens
VPVDGDANH

SEQ ID NO: 154870 - protein, 9 aa, Homo Sapiens
RLSRALHVY

SEQ ID NO: 154871 - protein, 9 aa, Homo Sapiens
AGHNGGPPW

SEQ ID NO: 154872 - protein, 9 aa, Homo Sapiens
GPWSPTHSA

SEQ ID NO: 154873 - protein, 9 aa, Homo Sapiens
EAMSRGETP

SEQ ID NO: 154874 - protein, 9 aa, Homo Sapiens
TTNIVAPPS

SEQ ID NO: 154875 - protein, 9 aa, Homo Sapiens
RDKTRMQRI

SEQ ID NO: 154876 - protein, 9 aa, Homo Sapiens
EQTKFNLRL

SEQ ID NO: 154877 - protein, 9 aa, Homo Sapiens
SNISHQWIR

SEQ ID NO: 154878 - protein, 9 aa, Homo Sapiens
TPALPTQQL

SEQ ID NO: 154879 - protein, 9 aa, Homo Sapiens
APPLQPRPC

SEQ ID NO: 154880 - protein, 9 aa, Homo Sapiens
GRRARCLDP

SEQ ID NO: 154881 - protein, 9 aa, Homo Sapiens
ASPCISQPT

SEQ ID NO: 154882 - protein, 9 aa, Homo Sapiens
MDTNGLVRA

SEQ ID NO: 154883 - protein, 9 aa, Homo Sapiens
AASTEPERI

SEQ ID NO: 154884 - protein, 9 aa, Homo Sapiens
VVGGQSWNC

SEQ ID NO: 154885 - protein, 9 aa, Homo Sapiens
IKPNPAKSL

SEQ ID NO: 154886 - protein, 9 aa, Homo Sapiens
LRGDELVRF

SEQ ID NO: 154887 - protein, 9 aa, Homo Sapiens
HFLDTLQCG

SEQ ID NO: 154888 - protein, 9 aa, Homo Sapiens
FFTFPICCF

SEQ ID NO: 154889 - protein, 9 aa, Homo Sapiens
FMHLENLKE

SEQ ID NO: 154890 - protein, 9 aa, Homo Sapiens
CGSLPLMTL

SEQ ID NO: 154891 - protein, 9 aa, Homo Sapiens
TTHIHTEPT

SEQ ID NO: 154892 - protein, 9 aa, Homo Sapiens
LHSPFLQKL

SEQ ID NO: 154893 - protein, 9 aa, Homo Sapiens
SQTVQQKVT

SEQ ID NO: 154894 - protein, 9 aa, Homo Sapiens
GMEALVQCH

SEQ ID NO: 154895 - protein, 9 aa, Homo Sapiens
CRHPLQDSL

SEQ ID NO: 154896 - protein, 9 aa, Homo Sapiens
VQTGKYKAH

SEQ ID NO: 154897 - protein, 9 aa, Homo Sapiens
PFLDCLSCP

SEQ ID NO: 154898 - protein, 9 aa, Homo Sapiens
ICCFQAICI

SEQ ID NO: 154899 - protein, 9 aa, Homo Sapiens
GKKEAPLWR

SEQ ID NO: 154900 - protein, 9 aa, Homo Sapiens
LPRGIRCPP

SEQ ID NO: 154901 - protein, 9 aa, Homo Sapiens
IYIVGGVST

SEQ ID NO: 154902 - protein, 9 aa, Homo Sapiens
SLPWARHTH

SEQ ID NO: 154903 - protein, 9 aa, Homo Sapiens
GDEEVIRFL

SEQ ID NO: 154904 - protein, 9 aa, Homo Sapiens
LLRGQSEIV

SEQ ID NO: 154905 - protein, 9 aa, Homo Sapiens
KLVQILTAF

SEQ ID NO: 154906 - protein, 9 aa, Homo Sapiens
VLGKTSLPQ

SEQ ID NO: 154907 - protein, 9 aa, Homo Sapiens
PSARRQPGP

SEQ ID NO: 154908 - protein, 9 aa, Homo Sapiens
PAPEVPGLY

SEQ ID NO: 154909 - protein, 9 aa, Homo Sapiens
NPGTNWGRL

SEQ ID NO: 154910 - protein, 9 aa, Homo Sapiens
IRRYQKKRQ

SEQ ID NO: 154911 - protein, 9 aa, Homo Sapiens
TVTMKEDQV

SEQ ID NO: 154912 - protein, 9 aa, Homo Sapiens
SITRNLMWD

SEQ ID NO: 154913 - protein, 9 aa, Homo Sapiens
LLAVLSRPL

SEQ ID NO: 154914 - protein, 9 aa, Homo Sapiens
HLLPLSDLP

SEQ ID NO: 154915 - protein, 9 aa, Homo Sapiens
RHFPYKPLD

SEQ ID NO: 154916 - protein, 9 aa, Homo Sapiens
PPGETLERH

SEQ ID NO: 154917 - protein, 9 aa, Homo Sapiens
RGGVRVKLA

SEQ ID NO: 154918 - protein, 9 aa, Homo Sapiens
GLTFDYSHP

SEQ ID NO: 154919 - protein, 9 aa, Homo Sapiens
IQHNPFNIH

SEQ ID NO: 154920 - protein, 9 aa, Homo Sapiens
WRTWSAGEW

SEQ ID NO: 154921 - protein, 9 aa, Homo Sapiens
RGVVHRRAA

SEQ ID NO: 154922 - protein, 9 aa, Homo Sapiens
RSHLCNNPT

SEQ ID NO: 154923 - protein, 9 aa, Homo Sapiens
HQSLPLGRG

SEQ ID NO: 154924 - protein, 9 aa, Homo Sapiens
KDLLRQELW

SEQ ID NO: 154925 - protein, 9 aa, Homo Sapiens
RDPTDPQWH

SEQ ID NO: 154926 - protein, 9 aa, Homo Sapiens
APLFALLSW

SEQ ID NO: 154927 - protein, 9 aa, Homo Sapiens
SCVVSFCLS

SEQ ID NO: 154928 - protein, 9 aa, Homo Sapiens
RRWPRDSPT

SEQ ID NO: 154929 - protein, 9 aa, Homo Sapiens
FLQKLQGSK

SEQ ID NO: 154930 - protein, 9 aa, Homo Sapiens
EQQCPGSHR

SEQ ID NO: 154931 - protein, 9 aa, Homo Sapiens
MRWGLHLQK

SEQ ID NO: 154932 - protein, 9 aa, Homo Sapiens
EVAQVLVTD

SEQ ID NO: 154933 - protein, 9 aa, Homo Sapiens
AYKCCITCR

SEQ ID NO: 154934 - protein, 9 aa, Homo Sapiens
GSAVPYVPV

SEQ ID NO: 154935 - protein, 9 aa, Homo Sapiens
KQVESLARE

SEQ ID NO: 154936 - protein, 9 aa, Homo Sapiens
PPDVLRHVA

SEQ ID NO: 154937 - protein, 9 aa, Homo Sapiens
GASTRASGP

SEQ ID NO: 154938 - protein, 9 aa, Homo Sapiens
VIKQKVLRE

SEQ ID NO: 154939 - protein, 9 aa, Homo Sapiens
SQRTQRPQP

SEQ ID NO: 154940 - protein, 9 aa, Homo Sapiens
SSPTARATS

SEQ ID NO: 154941 - protein, 9 aa, Homo Sapiens
RNAPRDSRL

SEQ ID NO: 154942 - protein, 9 aa, Homo Sapiens
GAARPRRTR

SEQ ID NO: 154943 - protein, 9 aa, Homo Sapiens
HRGKDQEER

SEQ ID NO: 154944 - protein, 9 aa, Homo Sapiens
NQKKRNTNT

SEQ ID NO: 154945 - protein, 9 aa, Homo Sapiens
IVNVASWSA

SEQ ID NO: 154946 - protein, 9 aa, Homo Sapiens
CGTDVIAFT

SEQ ID NO: 154947 - protein, 9 aa, Homo Sapiens
TQASMTLPA

SEQ ID NO: 154948 - protein, 9 aa, Homo Sapiens
TSQEVPLHR

SEQ ID NO: 154949 - protein, 9 aa, Homo Sapiens
EPFRRYSST

SEQ ID NO: 154950 - protein, 9 aa, Homo Sapiens
QLGRLDAVL

SEQ ID NO: 154951 - protein, 9 aa, Homo Sapiens
TLKKVHIFQ

SEQ ID NO: 154952 - protein, 9 aa, Homo Sapiens
APAGAWSFQ

SEQ ID NO: 154953 - protein, 9 aa, Homo Sapiens
TSWDGAWFL

SEQ ID NO: 154954 - protein, 9 aa, Homo Sapiens
ILQSVIQMH

SEQ ID NO: 154955 - protein, 9 aa, Homo Sapiens
PEPPVPALQ

SEQ ID NO: 154956 - protein, 9 aa, Homo Sapiens
SQPSSSVWS

SEQ ID NO: 154957 - protein, 9 aa, Homo Sapiens
SEVTRLWSS

SEQ ID NO: 154958 - protein, 9 aa, Homo Sapiens
TAASARSPT

SEQ ID NO: 154959 - protein, 9 aa, Homo Sapiens
DSIMYREVL

SEQ ID NO: 154960 - protein, 9 aa, Homo Sapiens
SQSAAAALG

SEQ ID NO: 154961 - protein, 9 aa, Homo Sapiens
LEKLTVRIG

SEQ ID NO: 154962 - protein, 9 aa, Homo Sapiens
CATVAQFNT

SEQ ID NO: 154963 - protein, 9 aa, Homo Sapiens
PCHAAALAL

SEQ ID NO: 154964 - protein, 9 aa, Homo Sapiens
PGRAPQGPW

SEQ ID NO: 154965 - protein, 9 aa, Homo Sapiens
GDLNPSSAE

SEQ ID NO: 154966 - protein, 9 aa, Homo Sapiens
FTCHGLLTG

SEQ ID NO: 154967 - protein, 9 aa, Homo Sapiens
TFYFAGVPP

SEQ ID NO: 154968 - protein, 9 aa, Homo Sapiens
KTCWCYLTS

SEQ ID NO: 154969 - protein, 9 aa, Homo Sapiens
TIAAAADIA

SEQ ID NO: 154970 - protein, 9 aa, Homo Sapiens
AGAAPRRWS

SEQ ID NO: 154971 - protein, 9 aa, Homo Sapiens
LDENYEHIN

SEQ ID NO: 154972 - protein, 9 aa, Homo Sapiens
VYTQHRKSI

SEQ ID NO: 154973 - protein, 9 aa, Homo Sapiens
CAPSACLHP

SEQ ID NO: 154974 - protein, 9 aa, Homo Sapiens
PPAASTPAK

SEQ ID NO: 154975 - protein, 9 aa, Homo Sapiens
LPLMSALID

SEQ ID NO: 154976 - protein, 9 aa, Homo Sapiens
RRSSGSQCS

SEQ ID NO: 154977 - protein, 9 aa, Homo Sapiens
APSTRAAPP

SEQ ID NO: 154978 - protein, 9 aa, Homo Sapiens
HPSKTEVHG

SEQ ID NO: 154979 - protein, 9 aa, Homo Sapiens
DPPTTIIWT

SEQ ID NO: 154980 - protein, 9 aa, Homo Sapiens
RDVLEVLDE

SEQ ID NO: 154981 - protein, 9 aa, Homo Sapiens
PWSSQTHTR

SEQ ID NO: 154982 - protein, 9 aa, Homo Sapiens
DGISDEYHV

SEQ ID NO: 154983 - protein, 9 aa, Homo Sapiens
PGWEEASQV

SEQ ID NO: 154984 - protein, 9 aa, Homo Sapiens
RKFIVQINP

SEQ ID NO: 154985 - protein, 9 aa, Homo Sapiens
SCWSTAACA

SEQ ID NO: 154986 - protein, 9 aa, Homo Sapiens
RKERGPLEG

SEQ ID NO: 154987 - protein, 9 aa, Homo Sapiens
GVYGSLHCA

SEQ ID NO: 154988 - protein, 9 aa, Homo Sapiens
LEGSASGEA

SEQ ID NO: 154989 - protein, 9 aa, Homo Sapiens
TLQILELEH

SEQ ID NO: 154990 - protein, 9 aa, Homo Sapiens
AQIYMCFMQ

SEQ ID NO: 154991 - protein, 9 aa, Homo Sapiens
PTLCLGMPR

SEQ ID NO: 154992 - protein, 9 aa, Homo Sapiens
DMHPLLELL

SEQ ID NO: 154993 - protein, 9 aa, Homo Sapiens
VLDGPQKNQ

SEQ ID NO: 154994 - protein, 9 aa, Homo Sapiens
SLNGQNGKL

SEQ ID NO: 154995 - protein, 9 aa, Homo Sapiens
FPPPLPPPQ

SEQ ID NO: 154996 - protein, 9 aa, Homo Sapiens
ARTWLPRAA

SEQ ID NO: 154997 - protein, 9 aa, Homo Sapiens
TPGAAVAAN

SEQ ID NO: 154998 - protein, 9 aa, Homo Sapiens
INMFHKYTR

SEQ ID NO: 154999 - protein, 9 aa, Homo Sapiens
FHFRHTREN

SEQ ID NO: 155000 - protein, 9 aa, Homo Sapiens
AWSLTSSLP

SEQ ID NO: 155001 - protein, 9 aa, Homo Sapiens
QLVPAGRSV

SEQ ID NO: 155002 - protein, 9 aa, Homo Sapiens
PNGPFSRPH

SEQ ID NO: 155003 - protein, 9 aa, Homo Sapiens
AATMPILLY

SEQ ID NO: 155004 - protein, 9 aa, Homo Sapiens
ASKQMSEKK

SEQ ID NO: 155005 - protein, 9 aa, Homo Sapiens
GSMLMPRWS

SEQ ID NO: 155006 - protein, 9 aa, Homo Sapiens
SRTQGSRPC

SEQ ID NO: 155007 - protein, 9 aa, Homo Sapiens
KVQGHPAHF

SEQ ID NO: 155008 - protein, 9 aa, Homo Sapiens
PPWGVGQGQ

SEQ ID NO: 155009 - protein, 9 aa, Homo Sapiens
TRGLISGWA

SEQ ID NO: 155010 - protein, 9 aa, Homo Sapiens
FLRSCHGDL

SEQ ID NO: 155011 - protein, 9 aa, Homo Sapiens
EFLCTNSAK

SEQ ID NO: 155012 - protein, 9 aa, Homo Sapiens
KMHTVGGAA

SEQ ID NO: 155013 - protein, 9 aa, Homo Sapiens
VNNKSLARV

SEQ ID NO: 155014 - protein, 9 aa, Homo Sapiens
PVPALQYLG

SEQ ID NO: 155015 - protein, 9 aa, Homo Sapiens
TEMLAYSNS

SEQ ID NO: 155016 - protein, 9 aa, Homo Sapiens
YHVTFYFAG

SEQ ID NO: 155017 - protein, 9 aa, Homo Sapiens
FIGGLRRSS

SEQ ID NO: 155018 - protein, 9 aa, Homo Sapiens
RPSNFAQNT

SEQ ID NO: 155019 - protein, 9 aa, Homo Sapiens
MHLENLKEP

SEQ ID NO: 155020 - protein, 9 aa, Homo Sapiens
VGTSDRGSP

SEQ ID NO: 155021 - protein, 9 aa, Homo Sapiens
PTFQKPKLH

SEQ ID NO: 155022 - protein, 9 aa, Homo Sapiens
PEDEDGAWR

SEQ ID NO: 155023 - protein, 9 aa, Homo Sapiens
GAGTALLCA

SEQ ID NO: 155024 - protein, 9 aa, Homo Sapiens
AGLLHPLPL

SEQ ID NO: 155025 - protein, 9 aa, Homo Sapiens
GAAIKSVKT

SEQ ID NO: 155026 - protein, 9 aa, Homo Sapiens
GIGMKPNLS

SEQ ID NO: 155027 - protein, 9 aa, Homo Sapiens
LACTGTHRH

SEQ ID NO: 155028 - protein, 9 aa, Homo Sapiens
TPDDVQILV

SEQ ID NO: 155029 - protein, 9 aa, Homo Sapiens
ARRSPRSCS

SEQ ID NO: 155030 - protein, 9 aa, Homo Sapiens
PSIPKRRPR

SEQ ID NO: 155031 - protein, 9 aa, Homo Sapiens
ISGWARNGT

SEQ ID NO: 155032 - protein, 9 aa, Homo Sapiens
DRQGVLGGL

SEQ ID NO: 155033 - protein, 9 aa, Homo Sapiens
KPGRKGTAG

SEQ ID NO: 155034 - protein, 9 aa, Homo Sapiens
ADQRAEIAE

SEQ ID NO: 155035 - protein, 9 aa, Homo Sapiens
RCRMVCGPH

SEQ ID NO: 155036 - protein, 9 aa, Homo Sapiens
RSTSLNDHM

SEQ ID NO: 155037 - protein, 9 aa, Homo Sapiens
PWTLNPQGV

SEQ ID NO: 155038 - protein, 9 aa, Homo Sapiens
LRARGGTTI

SEQ ID NO: 155039 - protein, 9 aa, Homo Sapiens
EKKFGLPPA

SEQ ID NO: 155040 - protein, 9 aa, Homo Sapiens
HKFCFRYVQ

SEQ ID NO: 155041 - protein, 9 aa, Homo Sapiens
HTDTLACTG

SEQ ID NO: 155042 - protein, 9 aa, Homo Sapiens
KQMALFFGQ

SEQ ID NO: 155043 - protein, 9 aa, Homo Sapiens
WVEVLKAST

SEQ ID NO: 155044 - protein, 9 aa, Homo Sapiens
GHPKDANSR

SEQ ID NO: 155045 - protein, 9 aa, Homo Sapiens
SKMAHWPKE

SEQ ID NO: 155046 - protein, 9 aa, Homo Sapiens
SCFSQQEKK

SEQ ID NO: 155047 - protein, 9 aa, Homo Sapiens
HPPPAKHSS

SEQ ID NO: 155048 - protein, 9 aa, Homo Sapiens
TCILGQRAT

SEQ ID NO: 155049 - protein, 9 aa, Homo Sapiens
ASAAVLNPR

SEQ ID NO: 155050 - protein, 9 aa, Homo Sapiens
KGDRGQPGL

SEQ ID NO: 155051 - protein, 9 aa, Homo Sapiens
ETPPQESTR

SEQ ID NO: 155052 - protein, 9 aa, Homo Sapiens
PASLMITRA

SEQ ID NO: 155053 - protein, 9 aa, Homo Sapiens
IHTHTGTHT

SEQ ID NO: 155054 - protein, 9 aa, Homo Sapiens
NPIETPDLK

SEQ ID NO: 155055 - protein, 9 aa, Homo Sapiens
SVQPVCAVR

SEQ ID NO: 155056 - protein, 9 aa, Homo Sapiens
YVPPLPLAA

SEQ ID NO: 155057 - protein, 9 aa, Homo Sapiens
VSMWFLGIV

SEQ ID NO: 155058 - protein, 9 aa, Homo Sapiens
TGIHTHTGT

SEQ ID NO: 155059 - protein, 9 aa, Homo Sapiens
NFAIMEIQC

SEQ ID NO: 155060 - protein, 9 aa, Homo Sapiens
DDEEFIGFR

SEQ ID NO: 155061 - protein, 9 aa, Homo Sapiens
STSRRTRPN

SEQ ID NO: 155062 - protein, 9 aa, Homo Sapiens
MFPNHYCEA

SEQ ID NO: 155063 - protein, 9 aa, Homo Sapiens
FAKCKHRHL

SEQ ID NO: 155064 - protein, 9 aa, Homo Sapiens
YRKALDLAS

SEQ ID NO: 155065 - protein, 9 aa, Homo Sapiens
ICNGGLQGS

SEQ ID NO: 155066 - protein, 9 aa, Homo Sapiens
YMVYMKHTY

SEQ ID NO: 155067 - protein, 9 aa, Homo Sapiens
VADDHWHMV

SEQ ID NO: 155068 - protein, 9 aa, Homo Sapiens
WLAVNEAIK

SEQ ID NO: 155069 - protein, 9 aa, Homo Sapiens
LLLVDDRQG

SEQ ID NO: 155070 - protein, 9 aa, Homo Sapiens
DTGSLTSTS

SEQ ID NO: 155071 - protein, 9 aa, Homo Sapiens
DPSPAGMGS

SEQ ID NO: 155072 - protein, 9 aa, Homo Sapiens
DEGTKASGA

SEQ ID NO: 155073 - protein, 9 aa, Homo Sapiens
DRIVDKVKE

SEQ ID NO: 155074 - protein, 9 aa, Homo Sapiens
SRFWALAVD

SEQ ID NO: 155075 - protein, 9 aa, Homo Sapiens
TCGTDVIAF

SEQ ID NO: 155076 - protein, 9 aa, Homo Sapiens
PGWGQWHLG

SEQ ID NO: 155077 - protein, 9 aa, Homo Sapiens
TRTSCIPRS

SEQ ID NO: 155078 - protein, 9 aa, Homo Sapiens
RAEKEWGDG

SEQ ID NO: 155079 - protein, 9 aa, Homo Sapiens
LLLIFWIVP

SEQ ID NO: 155080 - protein, 9 aa, Homo Sapiens
KSAVTHSTH

SEQ ID NO: 155081 - protein, 9 aa, Homo Sapiens
PCRASEAGA

SEQ ID NO: 155082 - protein, 9 aa, Homo Sapiens
LGGMEVWWC

SEQ ID NO: 155083 - protein, 9 aa, Homo Sapiens
LGGPGVPSP

SEQ ID NO: 155084 - protein, 9 aa, Homo Sapiens
ALALWGWRT

SEQ ID NO: 155085 - protein, 9 aa, Homo Sapiens
TRRSSGSQC

SEQ ID NO: 155086 - protein, 9 aa, Homo Sapiens
SVEAVAKKR

SEQ ID NO: 155087 - protein, 9 aa, Homo Sapiens
LVFLFFLLL

SEQ ID NO: 155088 - protein, 9 aa, Homo Sapiens
GPTAGAARA

SEQ ID NO: 155089 - protein, 9 aa, Homo Sapiens
SMDKAVDDI

SEQ ID NO: 155090 - protein, 9 aa, Homo Sapiens
AAKYHKAHS

SEQ ID NO: 155091 - protein, 9 aa, Homo Sapiens
CMQLTATAP

SEQ ID NO: 155092 - protein, 9 aa, Homo Sapiens
PPRDSRKWR

SEQ ID NO: 155093 - protein, 9 aa, Homo Sapiens
LGGASLGRA

SEQ ID NO: 155094 - protein, 9 aa, Homo Sapiens
ERGVPLYRH

SEQ ID NO: 155095 - protein, 9 aa, Homo Sapiens
HTHTQAYTL

SEQ ID NO: 155096 - protein, 9 aa, Homo Sapiens
VFPGDSKSM

SEQ ID NO: 155097 - protein, 9 aa, Homo Sapiens
RLITREIVF

SEQ ID NO: 155098 - protein, 9 aa, Homo Sapiens
TGSFFTFPI

SEQ ID NO: 155099 - protein, 9 aa, Homo Sapiens
HADGQTEQC

SEQ ID NO: 155100 - protein, 9 aa, Homo Sapiens
YLHHWNYLS

SEQ ID NO: 155101 - protein, 9 aa, Homo Sapiens
TGRGHLVGV

SEQ ID NO: 155102 - protein, 9 aa, Homo Sapiens
ERHSTPPGE

SEQ ID NO: 155103 - protein, 9 aa, Homo Sapiens
SPAPGSSVL

SEQ ID NO: 155104 - protein, 9 aa, Homo Sapiens
FLQPLLLLL

SEQ ID NO: 155105 - protein, 9 aa, Homo Sapiens
VNTEFDNVS

SEQ ID NO: 155106 - protein, 9 aa, Homo Sapiens
MRKETTARS

SEQ ID NO: 155107 - protein, 9 aa, Homo Sapiens
VPYVPVQVT

SEQ ID NO: 155108 - protein, 9 aa, Homo Sapiens
YEHINVPVP

SEQ ID NO: 155109 - protein, 9 aa, Homo Sapiens
DSPPCLKVM

SEQ ID NO: 155110 - protein, 9 aa, Homo Sapiens
CAARCPRCR

SEQ ID NO: 155111 - protein, 9 aa, Homo Sapiens
CFLPREEGP

SEQ ID NO: 155112 - protein, 9 aa, Homo Sapiens
GQSWNCAWE

SEQ ID NO: 155113 - protein, 9 aa, Homo Sapiens
PSPSNPGQL

SEQ ID NO: 155114 - protein, 9 aa, Homo Sapiens
RRQLPQWRT

SEQ ID NO: 155115 - protein, 9 aa, Homo Sapiens
SSLEYITHS

SEQ ID NO: 155116 - protein, 9 aa, Homo Sapiens
RHNTMAIGV

SEQ ID NO: 155117 - protein, 9 aa, Homo Sapiens
RSLTGRTHQ

SEQ ID NO: 155118 - protein, 9 aa, Homo Sapiens
SFFTFPICC

SEQ ID NO: 155119 - protein, 9 aa, Homo Sapiens
RTTNPHSPG

SEQ ID NO: 155120 - protein, 9 aa, Homo Sapiens
QASMTLPAP

SEQ ID NO: 155121 - protein, 9 aa, Homo Sapiens
EKRRRTICG

SEQ ID NO: 155122 - protein, 9 aa, Homo Sapiens
TMRNATQQK

SEQ ID NO: 155123 - protein, 9 aa, Homo Sapiens
SSRIGGGGQ

SEQ ID NO: 155124 - protein, 9 aa, Homo Sapiens
VGWRYRRTV

SEQ ID NO: 155125 - protein, 9 aa, Homo Sapiens
MCERKNMKQ

SEQ ID NO: 155126 - protein, 9 aa, Homo Sapiens
AALPDEGSH

SEQ ID NO: 155127 - protein, 9 aa, Homo Sapiens
GNVDRSGEA

SEQ ID NO: 155128 - protein, 9 aa, Homo Sapiens
GDFALIPGG

SEQ ID NO: 155129 - protein, 9 aa, Homo Sapiens
LILLIFLVP

SEQ ID NO: 155130 - protein, 9 aa, Homo Sapiens
SYHYRLDDP

SEQ ID NO: 155131 - protein, 9 aa, Homo Sapiens
VVLIVCCCI

SEQ ID NO: 155132 - protein, 9 aa, Homo Sapiens
VHRPFARPG

SEQ ID NO: 155133 - protein, 9 aa, Homo Sapiens
PPGLLVLGE

SEQ ID NO: 155134 - protein, 9 aa, Homo Sapiens
DDVKLPGLA

SEQ ID NO: 155135 - protein, 9 aa, Homo Sapiens
NKDHKLCTK

SEQ ID NO: 155136 - protein, 9 aa, Homo Sapiens
TTMRLESNN

SEQ ID NO: 155137 - protein, 9 aa, Homo Sapiens
YVGIKSPHE

SEQ ID NO: 155138 - protein, 9 aa, Homo Sapiens
PIYSELKDQ

SEQ ID NO: 155139 - protein, 9 aa, Homo Sapiens
YRPMGREEE

SEQ ID NO: 155140 - protein, 9 aa, Homo Sapiens
LYNGHTLPM

SEQ ID NO: 155141 - protein, 9 aa, Homo Sapiens
LNIVAFFNS

SEQ ID NO: 155142 - protein, 9 aa, Homo Sapiens
AFFSFSWLP

SEQ ID NO: 155143 - protein, 9 aa, Homo Sapiens
RSQSICLQV

SEQ ID NO: 155144 - protein, 9 aa, Homo Sapiens
TVSHGRVDV

SEQ ID NO: 155145 - protein, 9 aa, Homo Sapiens
GEHSSSSTS

SEQ ID NO: 155146 - protein, 9 aa, Homo Sapiens
DAQVGPLPC

SEQ ID NO: 155147 - protein, 9 aa, Homo Sapiens
KKPPIPLPL

SEQ ID NO: 155148 - protein, 9 aa, Homo Sapiens
KSQGPRLDF

SEQ ID NO: 155149 - protein, 9 aa, Homo Sapiens
FRKEQCAAY

SEQ ID NO: 155150 - protein, 9 aa, Homo Sapiens
GGVRVKLAH

SEQ ID NO: 155151 - protein, 9 aa, Homo Sapiens
HLIHGLFSL

SEQ ID NO: 155152 - protein, 9 aa, Homo Sapiens
ECYQATFRL

SEQ ID NO: 155153 - protein, 9 aa, Homo Sapiens
SVLWLSQRP

SEQ ID NO: 155154 - protein, 9 aa, Homo Sapiens
CARSWNEKQ

SEQ ID NO: 155155 - protein, 9 aa, Homo Sapiens
LEGPIEAYR

SEQ ID NO: 155156 - protein, 9 aa, Homo Sapiens
SRANEKTLL

SEQ ID NO: 155157 - protein, 9 aa, Homo Sapiens
LIPRTRGLI

SEQ ID NO: 155158 - protein, 9 aa, Homo Sapiens
TGTQAYTQT

SEQ ID NO: 155159 - protein, 9 aa, Homo Sapiens
AVHCALHSP

SEQ ID NO: 155160 - protein, 9 aa, Homo Sapiens
TEDVVLKKL

SEQ ID NO: 155161 - protein, 9 aa, Homo Sapiens
LQQTTGCSQ

SEQ ID NO: 155162 - protein, 9 aa, Homo Sapiens
GLLLLIDSF

SEQ ID NO: 155163 - protein, 9 aa, Homo Sapiens
DPRRALPRA

SEQ ID NO: 155164 - protein, 9 aa, Homo Sapiens
QFVSKGNLQ

SEQ ID NO: 155165 - protein, 9 aa, Homo Sapiens
EQPAAAFMR

SEQ ID NO: 155166 - protein, 9 aa, Homo Sapiens
DTVPPPPLL

SEQ ID NO: 155167 - protein, 9 aa, Homo Sapiens
KAVDDILGE

SEQ ID NO: 155168 - protein, 9 aa, Homo Sapiens
PRASRRRAC

SEQ ID NO: 155169 - protein, 9 aa, Homo Sapiens
GASPRCPPC

SEQ ID NO: 155170 - protein, 9 aa, Homo Sapiens
GEIFLFVQP

SEQ ID NO: 155171 - protein, 9 aa, Homo Sapiens
TAPGVGWRG

SEQ ID NO: 155172 - protein, 9 aa, Homo Sapiens
APLHPQPAP

SEQ ID NO: 155173 - protein, 9 aa, Homo Sapiens
TPSSRPSTG

SEQ ID NO: 155174 - protein, 9 aa, Homo Sapiens
LPPQTLEMT

SEQ ID NO: 155175 - protein, 9 aa, Homo Sapiens
DTHTGTDRN

SEQ ID NO: 155176 - protein, 9 aa, Homo Sapiens
NIIEQLVII

SEQ ID NO: 155177 - protein, 9 aa, Homo Sapiens
SSPRWRLPP

SEQ ID NO: 155178 - protein, 9 aa, Homo Sapiens
KFGLPPAQP

SEQ ID NO: 155179 - protein, 9 aa, Homo Sapiens
ARRSGGGCA

SEQ ID NO: 155180 - protein, 9 aa, Homo Sapiens
DQVNGGKVA

SEQ ID NO: 155181 - protein, 9 aa, Homo Sapiens
KNSRTLFPS

SEQ ID NO: 155182 - protein, 9 aa, Homo Sapiens
AQAVASQGL

SEQ ID NO: 155183 - protein, 9 aa, Homo Sapiens
PLWALIAIA

SEQ ID NO: 155184 - protein, 9 aa, Homo Sapiens
HFSLILFQK

SEQ ID NO: 155185 - protein, 9 aa, Homo Sapiens
RASEAGARA

SEQ ID NO: 155186 - protein, 9 aa, Homo Sapiens
QCGINLWEM

SEQ ID NO: 155187 - protein, 9 aa, Homo Sapiens
QYIRELRTR

SEQ ID NO: 155188 - protein, 9 aa, Homo Sapiens
LCLHRARAE

SEQ ID NO: 155189 - protein, 9 aa, Homo Sapiens
LDPMSILFK

SEQ ID NO: 155190 - protein, 9 aa, Homo Sapiens
PAARPPPAA

SEQ ID NO: 155191 - protein, 9 aa, Homo Sapiens
MNDSKHKLE

SEQ ID NO: 155192 - protein, 9 aa, Homo Sapiens
TKLSSWRSP

SEQ ID NO: 155193 - protein, 9 aa, Homo Sapiens
MREVGAQLK

SEQ ID NO: 155194 - protein, 9 aa, Homo Sapiens
PETTLWLGP

SEQ ID NO: 155195 - protein, 9 aa, Homo Sapiens
HRHTGMHRH

SEQ ID NO: 155196 - protein, 9 aa, Homo Sapiens
DPTLLRHCA

SEQ ID NO: 155197 - protein, 9 aa, Homo Sapiens
RRAHRRFVA

SEQ ID NO: 155198 - protein, 9 aa, Homo Sapiens
SPPTGSWQP

SEQ ID NO: 155199 - protein, 9 aa, Homo Sapiens
WGWRTGLAC

SEQ ID NO: 155200 - protein, 9 aa, Homo Sapiens
KALQHMATM

SEQ ID NO: 155201 - protein, 9 aa, Homo Sapiens
WSGNSGLDN

SEQ ID NO: 155202 - protein, 9 aa, Homo Sapiens
CQSLAWRKQ

SEQ ID NO: 155203 - protein, 9 aa, Homo Sapiens
PLEMLEEKE

SEQ ID NO: 155204 - protein, 9 aa, Homo Sapiens
FCKAGGPWR

SEQ ID NO: 155205 - protein, 9 aa, Homo Sapiens
DVDISVCRD

SEQ ID NO: 155206 - protein, 9 aa, Homo Sapiens
YAIDLYPSL

SEQ ID NO: 155207 - protein, 9 aa, Homo Sapiens
LLLGLAQLT

SEQ ID NO: 155208 - protein, 9 aa, Homo Sapiens
VVLFQILCI

SEQ ID NO: 155209 - protein, 9 aa, Homo Sapiens
SNIIEQLVI

SEQ ID NO: 155210 - protein, 9 aa, Homo Sapiens
YRRQVLRYH

SEQ ID NO: 155211 - protein, 9 aa, Homo Sapiens
HLPEYTWHL

SEQ ID NO: 155212 - protein, 9 aa, Homo Sapiens
TQCGRAFCE

SEQ ID NO: 155213 - protein, 9 aa, Homo Sapiens
KRLSEGEAK

SEQ ID NO: 155214 - protein, 9 aa, Homo Sapiens
KRQRKCLVQ

SEQ ID NO: 155215 - protein, 9 aa, Homo Sapiens
RCRMPGAYF

SEQ ID NO: 155216 - protein, 9 aa, Homo Sapiens
EKTEIQLTM

SEQ ID NO: 155217 - protein, 9 aa, Homo Sapiens
PWHGLMAAD

SEQ ID NO: 155218 - protein, 9 aa, Homo Sapiens
TPLTIGEKT

SEQ ID NO: 155219 - protein, 9 aa, Homo Sapiens
AGAKLPCYE

SEQ ID NO: 155220 - protein, 9 aa, Homo Sapiens
PLHLIHGLF

SEQ ID NO: 155221 - protein, 9 aa, Homo Sapiens
RIVAPGHAL

SEQ ID NO: 155222 - protein, 9 aa, Homo Sapiens
RLRPRWSCW

SEQ ID NO: 155223 - protein, 9 aa, Homo Sapiens
LTAEYCENV

SEQ ID NO: 155224 - protein, 9 aa, Homo Sapiens
SSEESYKHK

SEQ ID NO: 155225 - protein, 9 aa, Homo Sapiens
KASYPKRLG

SEQ ID NO: 155226 - protein, 9 aa, Homo Sapiens
RVQLLGADS

SEQ ID NO: 155227 - protein, 9 aa, Homo Sapiens
DFSSLDTSL

SEQ ID NO: 155228 - protein, 9 aa, Homo Sapiens
GACPAVAVE

SEQ ID NO: 155229 - protein, 9 aa, Homo Sapiens
GALQASDTA

SEQ ID NO: 155230 - protein, 9 aa, Homo Sapiens
PEGKDYCIF

SEQ ID NO: 155231 - protein, 9 aa, Homo Sapiens
RCVSGQCVL

SEQ ID NO: 155232 - protein, 9 aa, Homo Sapiens
GLPPPPGAD

SEQ ID NO: 155233 - protein, 9 aa, Homo Sapiens
SVMNQLDHT

SEQ ID NO: 155234 - protein, 9 aa, Homo Sapiens
AWLESWEVR

SEQ ID NO: 155235 - protein, 9 aa, Homo Sapiens
VSPRWWSTA

SEQ ID NO: 155236 - protein, 9 aa, Homo Sapiens
GSCLVHGFL

SEQ ID NO: 155237 - protein, 9 aa, Homo Sapiens
LKLGNGVER

SEQ ID NO: 155238 - protein, 9 aa, Homo Sapiens
LGGGQGGQD

SEQ ID NO: 155239 - protein, 9 aa, Homo Sapiens
APAPNPQRV

SEQ ID NO: 155240 - protein, 9 aa, Homo Sapiens
TSLTPPSIL

SEQ ID NO: 155241 - protein, 9 aa, Homo Sapiens
PQCWVLNFK

SEQ ID NO: 155242 - protein, 9 aa, Homo Sapiens
WKEVRGEWR

SEQ ID NO: 155243 - protein, 9 aa, Homo Sapiens
SSPEASLRR

SEQ ID NO: 155244 - protein, 9 aa, Homo Sapiens
SNSETGSHQ

SEQ ID NO: 155245 - protein, 9 aa, Homo Sapiens
GRCRMVCGP

SEQ ID NO: 155246 - protein, 9 aa, Homo Sapiens
SAQSPVPLR

SEQ ID NO: 155247 - protein, 9 aa, Homo Sapiens
DRPSTCACL

SEQ ID NO: 155248 - protein, 9 aa, Homo Sapiens
HHQQQQQQK

SEQ ID NO: 155249 - protein, 9 aa, Homo Sapiens
AKGKIKVVR

SEQ ID NO: 155250 - protein, 9 aa, Homo Sapiens
NHSSSEANQ

SEQ ID NO: 155251 - protein, 9 aa, Homo Sapiens
TASAPGAPS

SEQ ID NO: 155252 - protein, 9 aa, Homo Sapiens
AGARAARAG

SEQ ID NO: 155253 - protein, 9 aa, Homo Sapiens
SPASGSTSR

SEQ ID NO: 155254 - protein, 9 aa, Homo Sapiens
GVTTSTHRP

SEQ ID NO: 155255 - protein, 9 aa, Homo Sapiens
TPDLDVRKC

SEQ ID NO: 155256 - protein, 9 aa, Homo Sapiens
VRNSPCSMC

SEQ ID NO: 155257 - protein, 9 aa, Homo Sapiens
SSLGSSRLP

SEQ ID NO: 155258 - protein, 9 aa, Homo Sapiens
VERRRWPRD

SEQ ID NO: 155259 - protein, 9 aa, Homo Sapiens
HLRFPPMDT

SEQ ID NO: 155260 - protein, 9 aa, Homo Sapiens
VPHLHLVML

SEQ ID NO: 155261 - protein, 9 aa, Homo Sapiens
DCQSERLYG

SEQ ID NO: 155262 - protein, 9 aa, Homo Sapiens
PATTLRLRL

SEQ ID NO: 155263 - protein, 9 aa, Homo Sapiens
TKDKNTAVR

SEQ ID NO: 155264 - protein, 9 aa, Homo Sapiens
LEVIPEKQT

SEQ ID NO: 155265 - protein, 9 aa, Homo Sapiens
IHVLNMEKN

SEQ ID NO: 155266 - protein, 9 aa, Homo Sapiens
LQLWWCGGG

SEQ ID NO: 155267 - protein, 9 aa, Homo Sapiens
KLSSGAPPA

SEQ ID NO: 155268 - protein, 9 aa, Homo Sapiens
STRAAADPP

SEQ ID NO: 155269 - protein, 9 aa, Homo Sapiens
LKDFQKQRM

SEQ ID NO: 155270 - protein, 9 aa, Homo Sapiens
EVNINNSDC

SEQ ID NO: 155271 - protein, 9 aa, Homo Sapiens
PSPLCLHRA

SEQ ID NO: 155272 - protein, 9 aa, Homo Sapiens
GIEAVICAL

SEQ ID NO: 155273 - protein, 9 aa, Homo Sapiens
ALKHQLRHP

SEQ ID NO: 155274 - protein, 9 aa, Homo Sapiens
HWLRASSVV

SEQ ID NO: 155275 - protein, 9 aa, Homo Sapiens
ATAEDNDQA

SEQ ID NO: 155276 - protein, 9 aa, Homo Sapiens
HTHTVATFQ

SEQ ID NO: 155277 - protein, 9 aa, Homo Sapiens
PSTPPTTGL

SEQ ID NO: 155278 - protein, 9 aa, Homo Sapiens
PCLPSPRSR

SEQ ID NO: 155279 - protein, 9 aa, Homo Sapiens
QQLPVGGDL

SEQ ID NO: 155280 - protein, 9 aa, Homo Sapiens
PSACSSASS

SEQ ID NO: 155281 - protein, 9 aa, Homo Sapiens
HVVLEVVVV

SEQ ID NO: 155282 - protein, 9 aa, Homo Sapiens
AGQRREHVL

SEQ ID NO: 155283 - protein, 9 aa, Homo Sapiens
GSWRRMEVS

SEQ ID NO: 155284 - protein, 9 aa, Homo Sapiens
YALQYAGDD

SEQ ID NO: 155285 - protein, 9 aa, Homo Sapiens
VKLDPAMAH

SEQ ID NO: 155286 - protein, 9 aa, Homo Sapiens
GSRGAADDR

SEQ ID NO: 155287 - protein, 9 aa, Homo Sapiens
HPKDANSRA

SEQ ID NO: 155288 - protein, 9 aa, Homo Sapiens
PLMSALIDG

SEQ ID NO: 155289 - protein, 9 aa, Homo Sapiens
RLISAKSRF

SEQ ID NO: 155290 - protein, 9 aa, Homo Sapiens
VGILPSTCS

SEQ ID NO: 155291 - protein, 9 aa, Homo Sapiens
KMEPLSTTS

SEQ ID NO: 155292 - protein, 9 aa, Homo Sapiens
VALLNPIET

SEQ ID NO: 155293 - protein, 9 aa, Homo Sapiens
WAWCARWTV

SEQ ID NO: 155294 - protein, 9 aa, Homo Sapiens
SFCKAGGPW

SEQ ID NO: 155295 - protein, 9 aa, Homo Sapiens
GQSKRLAIP

SEQ ID NO: 155296 - protein, 9 aa, Homo Sapiens
KSKEEEIAV

SEQ ID NO: 155297 - protein, 9 aa, Homo Sapiens
TGASTRASG

SEQ ID NO: 155298 - protein, 9 aa, Homo Sapiens
EAVRCVEKM

SEQ ID NO: 155299 - protein, 9 aa, Homo Sapiens
KTVCFNVLK

SEQ ID NO: 155300 - protein, 9 aa, Homo Sapiens
RDAPYCVAE

SEQ ID NO: 155301 - protein, 9 aa, Homo Sapiens
PLRCSLPDP

SEQ ID NO: 155302 - protein, 9 aa, Homo Sapiens
NTGAQGRGK

SEQ ID NO: 155303 - protein, 9 aa, Homo Sapiens
RKASCKLTI

SEQ ID NO: 155304 - protein, 9 aa, Homo Sapiens
PYSYHYRLD

SEQ ID NO: 155305 - protein, 9 aa, Homo Sapiens
GFSDAVSHL

SEQ ID NO: 155306 - protein, 9 aa, Homo Sapiens
QVRAARPAG

SEQ ID NO: 155307 - protein, 9 aa, Homo Sapiens
LLLLIDSFN

SEQ ID NO: 155308 - protein, 9 aa, Homo Sapiens
PSEDPHLLK

SEQ ID NO: 155309 - protein, 9 aa, Homo Sapiens
RPPPASKNR

SEQ ID NO: 155310 - protein, 9 aa, Homo Sapiens
TFFLLLPPF

SEQ ID NO: 155311 - protein, 9 aa, Homo Sapiens
LLVLEEFKM

SEQ ID NO: 155312 - protein, 9 aa, Homo Sapiens
QKRSHLCNN

SEQ ID NO: 155313 - protein, 9 aa, Homo Sapiens
MAIGVAVDI

SEQ ID NO: 155314 - protein, 9 aa, Homo Sapiens
QGPLHLGTL

SEQ ID NO: 155315 - protein, 9 aa, Homo Sapiens
ILAVQNVDW

SEQ ID NO: 155316 - protein, 9 aa, Homo Sapiens
EVWSFLLRY

SEQ ID NO: 155317 - protein, 9 aa, Homo Sapiens
LEKILEKLM

SEQ ID NO: 155318 - protein, 9 aa, Homo Sapiens
PWWVISGCL

SEQ ID NO: 155319 - protein, 9 aa, Homo Sapiens
RSNPGTFMC

SEQ ID NO: 155320 - protein, 9 aa, Homo Sapiens
IKPISRNSR

SEQ ID NO: 155321 - protein, 9 aa, Homo Sapiens
RPFDLGLMT

SEQ ID NO: 155322 - protein, 9 aa, Homo Sapiens
SDLPPPRRG

SEQ ID NO: 155323 - protein, 9 aa, Homo Sapiens
QTLCCGCPH

SEQ ID NO: 155324 - protein, 9 aa, Homo Sapiens
SGHIPGTVN

SEQ ID NO: 155325 - protein, 9 aa, Homo Sapiens
PAPTPPAPH

SEQ ID NO: 155326 - protein, 9 aa, Homo Sapiens
KIPSPLKIT

SEQ ID NO: 155327 - protein, 9 aa, Homo Sapiens
FQAICISHT

SEQ ID NO: 155328 - protein, 9 aa, Homo Sapiens
TLACTGTHR

SEQ ID NO: 155329 - protein, 9 aa, Homo Sapiens
WRPLHTAGG

SEQ ID NO: 155330 - protein, 9 aa, Homo Sapiens
ARGRGFGCG

SEQ ID NO: 155331 - protein, 9 aa, Homo Sapiens
LRRTTTTST

SEQ ID NO: 155332 - protein, 9 aa, Homo Sapiens
YELLTAFLG

SEQ ID NO: 155333 - protein, 9 aa, Homo Sapiens
ESCTGPPRD

SEQ ID NO: 155334 - protein, 9 aa, Homo Sapiens
WGRRRRMHV

SEQ ID NO: 155335 - protein, 9 aa, Homo Sapiens
SCWPPGYSG

SEQ ID NO: 155336 - protein, 9 aa, Homo Sapiens
KLEKKSRYE

SEQ ID NO: 155337 - protein, 9 aa, Homo Sapiens
YVDVDGAWC

SEQ ID NO: 155338 - protein, 9 aa, Homo Sapiens
AGNTVRSAM

SEQ ID NO: 155339 - protein, 9 aa, Homo Sapiens
HPKVPVPVY

SEQ ID NO: 155340 - protein, 9 aa, Homo Sapiens
ASILSQKLG

SEQ ID NO: 155341 - protein, 9 aa, Homo Sapiens
CRMPGAYFF

SEQ ID NO: 155342 - protein, 9 aa, Homo Sapiens
HTLALTAKH

SEQ ID NO: 155343 - protein, 9 aa, Homo Sapiens
CVRRRRRHR

SEQ ID NO: 155344 - protein, 9 aa, Homo Sapiens
AEIAELTVL

SEQ ID NO: 155345 - protein, 9 aa, Homo Sapiens
VYVGTAILV

SEQ ID NO: 155346 - protein, 9 aa, Homo Sapiens
HPHALLHPS

SEQ ID NO: 155347 - protein, 9 aa, Homo Sapiens
YKLKLEQRG

SEQ ID NO: 155348 - protein, 9 aa, Homo Sapiens
PLQLQRLGV

SEQ ID NO: 155349 - protein, 9 aa, Homo Sapiens
LEEPRKGLW

SEQ ID NO: 155350 - protein, 9 aa, Homo Sapiens
TLERHSTPP

SEQ ID NO: 155351 - protein, 9 aa, Homo Sapiens
AEAAAHALA

SEQ ID NO: 155352 - protein, 9 aa, Homo Sapiens
WTPPSITPS

SEQ ID NO: 155353 - protein, 9 aa, Homo Sapiens
TTCQRQARE

SEQ ID NO: 155354 - protein, 9 aa, Homo Sapiens
RACVQSTGN

SEQ ID NO: 155355 - protein, 9 aa, Homo Sapiens
RTSMCMAIA

SEQ ID NO: 155356 - protein, 9 aa, Homo Sapiens
SALVLLAPA

SEQ ID NO: 155357 - protein, 9 aa, Homo Sapiens
ADVTGGTMA

SEQ ID NO: 155358 - protein, 9 aa, Homo Sapiens
LSQPPPQAP

SEQ ID NO: 155359 - protein, 9 aa, Homo Sapiens
PRMSSPRRA

SEQ ID NO: 155360 - protein, 9 aa, Homo Sapiens
STPPDRSKG

SEQ ID NO: 155361 - protein, 9 aa, Homo Sapiens
VFVWPISSW

SEQ ID NO: 155362 - protein, 9 aa, Homo Sapiens
HHHLMVADH

SEQ ID NO: 155363 - protein, 9 aa, Homo Sapiens
MEALVQCHL

SEQ ID NO: 155364 - protein, 9 aa, Homo Sapiens
CTASTCCGA

SEQ ID NO: 155365 - protein, 9 aa, Homo Sapiens
TAHAPLHSV

SEQ ID NO: 155366 - protein, 9 aa, Homo Sapiens
SETSSSSCK

SEQ ID NO: 155367 - protein, 9 aa, Homo Sapiens
SLGREWDLS

SEQ ID NO: 155368 - protein, 9 aa, Homo Sapiens
GKDQTMSEC

SEQ ID NO: 155369 - protein, 9 aa, Homo Sapiens
AALIIYEML

SEQ ID NO: 155370 - protein, 9 aa, Homo Sapiens
TSGGEVFDY

SEQ ID NO: 155371 - protein, 9 aa, Homo Sapiens
PYPAASAPC

SEQ ID NO: 155372 - protein, 9 aa, Homo Sapiens
LLPALLLPA

SEQ ID NO: 155373 - protein, 9 aa, Homo Sapiens
PCRRHCPRC

SEQ ID NO: 155374 - protein, 9 aa, Homo Sapiens
YIAEEFDVS

SEQ ID NO: 155375 - protein, 9 aa, Homo Sapiens
HTREVQIFV

SEQ ID NO: 155376 - protein, 9 aa, Homo Sapiens
RVFTRDSTC

SEQ ID NO: 155377 - protein, 9 aa, Homo Sapiens
GVVSSGRRK

SEQ ID NO: 155378 - protein, 9 aa, Homo Sapiens
TTRRDSWPT

SEQ ID NO: 155379 - protein, 9 aa, Homo Sapiens
PGCSLGSCL

SEQ ID NO: 155380 - protein, 9 aa, Homo Sapiens
SSCSFVEQA

SEQ ID NO: 155381 - protein, 9 aa, Homo Sapiens
DDEEMNNLQ

SEQ ID NO: 155382 - protein, 9 aa, Homo Sapiens
GKQLEDGSS

SEQ ID NO: 155383 - protein, 9 aa, Homo Sapiens
VHGFLLPGQ

SEQ ID NO: 155384 - protein, 9 aa, Homo Sapiens
AHPIHLSKF

SEQ ID NO: 155385 - protein, 9 aa, Homo Sapiens
DTTGLPKGV

SEQ ID NO: 155386 - protein, 9 aa, Homo Sapiens
LQLKSGTHL

SEQ ID NO: 155387 - protein, 9 aa, Homo Sapiens
ASLDSQQTV

SEQ ID NO: 155388 - protein, 9 aa, Homo Sapiens
CSSCSTSCG

SEQ ID NO: 155389 - protein, 9 aa, Homo Sapiens
TQASMEFRQ

SEQ ID NO: 155390 - protein, 9 aa, Homo Sapiens
STSILSALR

SEQ ID NO: 155391 - protein, 9 aa, Homo Sapiens
KKEWINQEC

SEQ ID NO: 155392 - protein, 9 aa, Homo Sapiens
DQDMREVGA

SEQ ID NO: 155393 - protein, 9 aa, Homo Sapiens
IQGGRPSPC

SEQ ID NO: 155394 - protein, 9 aa, Homo Sapiens
ALDYDRFSR

SEQ ID NO: 155395 - protein, 9 aa, Homo Sapiens
AAHGPPLAL

SEQ ID NO: 155396 - protein, 9 aa, Homo Sapiens
SWAPAPRRQ

SEQ ID NO: 155397 - protein, 9 aa, Homo Sapiens
CLGPTRPLH

SEQ ID NO: 155398 - protein, 9 aa, Homo Sapiens
QTRFSSVTL

SEQ ID NO: 155399 - protein, 9 aa, Homo Sapiens
NGKLAKPPQ

SEQ ID NO: 155400 - protein, 9 aa, Homo Sapiens
SCGPTSGST

SEQ ID NO: 155401 - protein, 9 aa, Homo Sapiens
DTRCPSLTG

SEQ ID NO: 155402 - protein, 9 aa, Homo Sapiens
MAELHNLYR

SEQ ID NO: 155403 - protein, 9 aa, Homo Sapiens
SATQASMTL

SEQ ID NO: 155404 - protein, 9 aa, Homo Sapiens
VREDAERRN

SEQ ID NO: 155405 - protein, 9 aa, Homo Sapiens
ECQKTLQRL

SEQ ID NO: 155406 - protein, 9 aa, Homo Sapiens
RNLLRLQSL

SEQ ID NO: 155407 - protein, 9 aa, Homo Sapiens
KVVDPSTSW

SEQ ID NO: 155408 - protein, 9 aa, Homo Sapiens
FRNALKSLL

SEQ ID NO: 155409 - protein, 9 aa, Homo Sapiens
WRNPNGDDD

SEQ ID NO: 155410 - protein, 9 aa, Homo Sapiens
NVAKPLDGP

SEQ ID NO: 155411 - protein, 9 aa, Homo Sapiens
TGPPRDRWK

SEQ ID NO: 155412 - protein, 9 aa, Homo Sapiens
RETECVVRE

SEQ ID NO: 155413 - protein, 9 aa, Homo Sapiens
PTAPATALD

SEQ ID NO: 155414 - protein, 9 aa, Homo Sapiens
SPSGPRPGL

SEQ ID NO: 155415 - protein, 9 aa, Homo Sapiens
LTAFLGDLL

SEQ ID NO: 155416 - protein, 9 aa, Homo Sapiens
RTSCRGRIK

SEQ ID NO: 155417 - protein, 9 aa, Homo Sapiens
WRRIGATTP

SEQ ID NO: 155418 - protein, 9 aa, Homo Sapiens
QWVGDDGEA

SEQ ID NO: 155419 - protein, 9 aa, Homo Sapiens
TDDGSKDEW

SEQ ID NO: 155420 - protein, 9 aa, Homo Sapiens
DLRMERPRS

SEQ ID NO: 155421 - protein, 9 aa, Homo Sapiens
TRTWLWRGC

SEQ ID NO: 155422 - protein, 9 aa, Homo Sapiens
MGVAYGSRI

SEQ ID NO: 155423 - protein, 9 aa, Homo Sapiens
LKIAAALVA

SEQ ID NO: 155424 - protein, 9 aa, Homo Sapiens
VWLRCCGGG

SEQ ID NO: 155425 - protein, 9 aa, Homo Sapiens
RLPRHPRSP

SEQ ID NO: 155426 - protein, 9 aa, Homo Sapiens
DNTTTTTSQ

SEQ ID NO: 155427 - protein, 9 aa, Homo Sapiens
LLTAFLGDL

SEQ ID NO: 155428 - protein, 9 aa, Homo Sapiens
PPGWACGRG

SEQ ID NO: 155429 - protein, 9 aa, Homo Sapiens
CSLPDPCRA

SEQ ID NO: 155430 - protein, 9 aa, Homo Sapiens
HVYIVFYSA

SEQ ID NO: 155431 - protein, 9 aa, Homo Sapiens
RCANTRPGS

SEQ ID NO: 155432 - protein, 9 aa, Homo Sapiens
ARRRTWWRT

SEQ ID NO: 155433 - protein, 9 aa, Homo Sapiens
PTPVPTATA

SEQ ID NO: 155434 - protein, 9 aa, Homo Sapiens
TSSPRRSPA

SEQ ID NO: 155435 - protein, 9 aa, Homo Sapiens
GLRVRRRFP

SEQ ID NO: 155436 - protein, 9 aa, Homo Sapiens
LLDDVVGGR

SEQ ID NO: 155437 - protein, 9 aa, Homo Sapiens
KQARKAFDE

SEQ ID NO: 155438 - protein, 9 aa, Homo Sapiens
DSKEGSYVS

SEQ ID NO: 155439 - protein, 9 aa, Homo Sapiens
GLWFLLKST

SEQ ID NO: 155440 - protein, 9 aa, Homo Sapiens
VNAYPSSQL

SEQ ID NO: 155441 - protein, 9 aa, Homo Sapiens
ETTKPISPV

SEQ ID NO: 155442 - protein, 9 aa, Homo Sapiens
FGQTPGQET

SEQ ID NO: 155443 - protein, 9 aa, Homo Sapiens
IRLHGWLQE

SEQ ID NO: 155444 - protein, 9 aa, Homo Sapiens
TQEVEIGTV

SEQ ID NO: 155445 - protein, 9 aa, Homo Sapiens
KKRRLISAK

SEQ ID NO: 155446 - protein, 9 aa, Homo Sapiens
QLLLLLLLD

SEQ ID NO: 155447 - protein, 9 aa, Homo Sapiens
SCLPLSRPI

SEQ ID NO: 155448 - protein, 9 aa, Homo Sapiens
LQQRPGAPG

SEQ ID NO: 155449 - protein, 9 aa, Homo Sapiens
KPEVEAWGE

SEQ ID NO: 155450 - protein, 9 aa, Homo Sapiens
PASVAPATL

SEQ ID NO: 155451 - protein, 9 aa, Homo Sapiens
CISHTPILF

SEQ ID NO: 155452 - protein, 9 aa, Homo Sapiens
PRAGCCVWL

SEQ ID NO: 155453 - protein, 9 aa, Homo Sapiens
VELATRLQK

SEQ ID NO: 155454 - protein, 9 aa, Homo Sapiens
RALGAGASA

SEQ ID NO: 155455 - protein, 9 aa, Homo Sapiens
QESLGLSWK

SEQ ID NO: 155456 - protein, 9 aa, Homo Sapiens
SGPCHAAAL

SEQ ID NO: 155457 - protein, 9 aa, Homo Sapiens
GPSSPQLQP

SEQ ID NO: 155458 - protein, 9 aa, Homo Sapiens
GTQEVEIGT

SEQ ID NO: 155459 - protein, 9 aa, Homo Sapiens
KSIFLLFPT

SEQ ID NO: 155460 - protein, 9 aa, Homo Sapiens
MQRRHISNT

SEQ ID NO: 155461 - protein, 9 aa, Homo Sapiens
PRPAPRSWP

SEQ ID NO: 155462 - protein, 9 aa, Homo Sapiens
KGMSYLHPS

SEQ ID NO: 155463 - protein, 9 aa, Homo Sapiens
RGRLQQKML

SEQ ID NO: 155464 - protein, 9 aa, Homo Sapiens
AINLSASST

SEQ ID NO: 155465 - protein, 9 aa, Homo Sapiens
FQEEDLHQI

SEQ ID NO: 155466 - protein, 9 aa, Homo Sapiens
HRGLCKSRQ

SEQ ID NO: 155467 - protein, 9 aa, Homo Sapiens
MKCKDISQV

SEQ ID NO: 155468 - protein, 9 aa, Homo Sapiens
GRPAQKSSK

SEQ ID NO: 155469 - protein, 9 aa, Homo Sapiens
VSCSWWAQR

SEQ ID NO: 155470 - protein, 9 aa, Homo Sapiens
EDGEATDTV

SEQ ID NO: 155471 - protein, 9 aa, Homo Sapiens
SPPSTARSR

SEQ ID NO: 155472 - protein, 9 aa, Homo Sapiens
YQGPGWEEA

SEQ ID NO: 155473 - protein, 9 aa, Homo Sapiens
SPFRMASSP

SEQ ID NO: 155474 - protein, 9 aa, Homo Sapiens
VAVWSCVNV

SEQ ID NO: 155475 - protein, 9 aa, Homo Sapiens
QSAAAALGP

SEQ ID NO: 155476 - protein, 9 aa, Homo Sapiens
QSEGLQLLP

SEQ ID NO: 155477 - protein, 9 aa, Homo Sapiens
SPSACSSAS

SEQ ID NO: 155478 - protein, 9 aa, Homo Sapiens
NYYTGGWHH

SEQ ID NO: 155479 - protein, 9 aa, Homo Sapiens
QQELLHRVA

SEQ ID NO: 155480 - protein, 9 aa, Homo Sapiens
SVGVPHPPP

SEQ ID NO: 155481 - protein, 9 aa, Homo Sapiens
PKKTLLKCW

SEQ ID NO: 155482 - protein, 9 aa, Homo Sapiens
YRHVKNGDI

SEQ ID NO: 155483 - protein, 9 aa, Homo Sapiens
QSAKSGSTA

SEQ ID NO: 155484 - protein, 9 aa, Homo Sapiens
GKKNGIKGR

SEQ ID NO: 155485 - protein, 9 aa, Homo Sapiens
ENYSKKAKE

SEQ ID NO: 155486 - protein, 9 aa, Homo Sapiens
TGLLVHFLA

SEQ ID NO: 155487 - protein, 9 aa, Homo Sapiens
FQMRNVALL

SEQ ID NO: 155488 - protein, 9 aa, Homo Sapiens
ADYSLRSGQ

SEQ ID NO: 155489 - protein, 9 aa, Homo Sapiens
LAAASEPPQ

SEQ ID NO: 155490 - protein, 9 aa, Homo Sapiens
IVMYAVGMG

SEQ ID NO: 155491 - protein, 9 aa, Homo Sapiens
YRVLPSPSM

SEQ ID NO: 155492 - protein, 9 aa, Homo Sapiens
PQGPWQPGA

SEQ ID NO: 155493 - protein, 9 aa, Homo Sapiens
RHLEGGITF

SEQ ID NO: 155494 - protein, 9 aa, Homo Sapiens
SCTASTCCG

SEQ ID NO: 155495 - protein, 9 aa, Homo Sapiens
DDAPAARGH

SEQ ID NO: 155496 - protein, 9 aa, Homo Sapiens
RQRKCLVQM

SEQ ID NO: 155497 - protein, 9 aa, Homo Sapiens
QPSSSVWSS

SEQ ID NO: 155498 - protein, 9 aa, Homo Sapiens
KAMFYHAYG

SEQ ID NO: 155499 - protein, 9 aa, Homo Sapiens
CTTSCDTKL

SEQ ID NO: 155500 - protein, 9 aa, Homo Sapiens
ADTLLNFLV

SEQ ID NO: 155501 - protein, 9 aa, Homo Sapiens
ELQQPVGRV

SEQ ID NO: 155502 - protein, 9 aa, Homo Sapiens
AFPVAGPPC

SEQ ID NO: 155503 - protein, 9 aa, Homo Sapiens
STQLKGIPL

SEQ ID NO: 155504 - protein, 9 aa, Homo Sapiens
YTWLGAPPV

SEQ ID NO: 155505 - protein, 9 aa, Homo Sapiens
CSLGSCLVH

SEQ ID NO: 155506 - protein, 9 aa, Homo Sapiens
AGAMEVAMA

SEQ ID NO: 155507 - protein, 9 aa, Homo Sapiens
FMELGAEFL

SEQ ID NO: 155508 - protein, 9 aa, Homo Sapiens
NPGPAEGVV

SEQ ID NO: 155509 - protein, 9 aa, Homo Sapiens
EMSFHLLNY

SEQ ID NO: 155510 - protein, 9 aa, Homo Sapiens
VGEKMLLLT

SEQ ID NO: 155511 - protein, 9 aa, Homo Sapiens
RLHFQKALE

SEQ ID NO: 155512 - protein, 9 aa, Homo Sapiens
GGKKNGIKG

SEQ ID NO: 155513 - protein, 9 aa, Homo Sapiens
SAWGDWVAS

SEQ ID NO: 155514 - protein, 9 aa, Homo Sapiens
RRYSHAAGE

SEQ ID NO: 155515 - protein, 9 aa, Homo Sapiens
RLFISRANE

SEQ ID NO: 155516 - protein, 9 aa, Homo Sapiens
APSDDEEFI

SEQ ID NO: 155517 - protein, 9 aa, Homo Sapiens
QTIKKYCQL

SEQ ID NO: 155518 - protein, 9 aa, Homo Sapiens
HTNLIQLYD

SEQ ID NO: 155519 - protein, 9 aa, Homo Sapiens
PPLEDASTP

SEQ ID NO: 155520 - protein, 9 aa, Homo Sapiens
KYEEFDCLI

SEQ ID NO: 155521 - protein, 9 aa, Homo Sapiens
SSPTLSRLR

SEQ ID NO: 155522 - protein, 9 aa, Homo Sapiens
IQMHSSGSK

SEQ ID NO: 155523 - protein, 9 aa, Homo Sapiens
VCWFKENRC

SEQ ID NO: 155524 - protein, 9 aa, Homo Sapiens
RLIHVLNME

SEQ ID NO: 155525 - protein, 9 aa, Homo Sapiens
IPHHLHFDA

SEQ ID NO: 155526 - protein, 9 aa, Homo Sapiens
SKHGRRARC

SEQ ID NO: 155527 - protein, 9 aa, Homo Sapiens
PKAVASSPS

SEQ ID NO: 155528 - protein, 9 aa, Homo Sapiens
KPELILRME

SEQ ID NO: 155529 - protein, 9 aa, Homo Sapiens
GPPRDRWKG

SEQ ID NO: 155530 - protein, 9 aa, Homo Sapiens
PGTGGTSPA

SEQ ID NO: 155531 - protein, 9 aa, Homo Sapiens
GLWENMLSG

SEQ ID NO: 155532 - protein, 9 aa, Homo Sapiens
AARATALEQ

SEQ ID NO: 155533 - protein, 9 aa, Homo Sapiens
DISHPETVD

SEQ ID NO: 155534 - protein, 9 aa, Homo Sapiens
PQWHWPKML

SEQ ID NO: 155535 - protein, 9 aa, Homo Sapiens
ATSSSTWAG

SEQ ID NO: 155536 - protein, 9 aa, Homo Sapiens
WAPAPRRQR

SEQ ID NO: 155537 - protein, 9 aa, Homo Sapiens
CVRSFALEL

SEQ ID NO: 155538 - protein, 9 aa, Homo Sapiens
FGGPDSTPR

SEQ ID NO: 155539 - protein, 9 aa, Homo Sapiens
KKSTDKDEE

SEQ ID NO: 155540 - protein, 9 aa, Homo Sapiens
IPPRTLHGG

SEQ ID NO: 155541 - protein, 9 aa, Homo Sapiens
LMSQGKFGF

SEQ ID NO: 155542 - protein, 9 aa, Homo Sapiens
PPVLHCCME

SEQ ID NO: 155543 - protein, 9 aa, Homo Sapiens
LSMKEGCSF

SEQ ID NO: 155544 - protein, 9 aa, Homo Sapiens
EQCGINLWE

SEQ ID NO: 155545 - protein, 9 aa, Homo Sapiens
WTIPWTGAC

SEQ ID NO: 155546 - protein, 9 aa, Homo Sapiens
GGDSVASPP

SEQ ID NO: 155547 - protein, 9 aa, Homo Sapiens
GGKVARKHS

SEQ ID NO: 155548 - protein, 9 aa, Homo Sapiens
TTVFPASTT

SEQ ID NO: 155549 - protein, 9 aa, Homo Sapiens
GAWHPGSWP

SEQ ID NO: 155550 - protein, 9 aa, Homo Sapiens
GKLAKPPQP

SEQ ID NO: 155551 - protein, 9 aa, Homo Sapiens
PLRIHFCPV

SEQ ID NO: 155552 - protein, 9 aa, Homo Sapiens
PQEVISIYN

SEQ ID NO: 155553 - protein, 9 aa, Homo Sapiens
AFGLLLLID

SEQ ID NO: 155554 - protein, 9 aa, Homo Sapiens
RMEVSCSWW

SEQ ID NO: 155555 - protein, 9 aa, Homo Sapiens
LPHVDFQLV

SEQ ID NO: 155556 - protein, 9 aa, Homo Sapiens
SDTIKFVLR

SEQ ID NO: 155557 - protein, 9 aa, Homo Sapiens
EEELEREHF

SEQ ID NO: 155558 - protein, 9 aa, Homo Sapiens
PQSPPQSLD

SEQ ID NO: 155559 - protein, 9 aa, Homo Sapiens
SSGLALCGI

SEQ ID NO: 155560 - protein, 9 aa, Homo Sapiens
EEKRLMAEL

SEQ ID NO: 155561 - protein, 9 aa, Homo Sapiens
LSSLTHVLQ

SEQ ID NO: 155562 - protein, 9 aa, Homo Sapiens
ESITVILTA

SEQ ID NO: 155563 - protein, 9 aa, Homo Sapiens
TLGVTLKSP

SEQ ID NO: 155564 - protein, 9 aa, Homo Sapiens
RRHSHTRGV

SEQ ID NO: 155565 - protein, 9 aa, Homo Sapiens
TKPPSLAQA

SEQ ID NO: 155566 - protein, 9 aa, Homo Sapiens
LLYSLFLFP

SEQ ID NO: 155567 - protein, 9 aa, Homo Sapiens
AEVCQSGER

SEQ ID NO: 155568 - protein, 9 aa, Homo Sapiens
VNEAIKKGN

SEQ ID NO: 155569 - protein, 9 aa, Homo Sapiens
CKGSTPTDA

SEQ ID NO: 155570 - protein, 9 aa, Homo Sapiens
HPTSPLSGG

SEQ ID NO: 155571 - protein, 9 aa, Homo Sapiens
IGFRDDVPM

SEQ ID NO: 155572 - protein, 9 aa, Homo Sapiens
RCTVMVLGG

SEQ ID NO: 155573 - protein, 9 aa, Homo Sapiens
ERLKHTMLS

SEQ ID NO: 155574 - protein, 9 aa, Homo Sapiens
GTCAVCGYN

SEQ ID NO: 155575 - protein, 9 aa, Homo Sapiens
KTVGILPST

SEQ ID NO: 155576 - protein, 9 aa, Homo Sapiens
VFGQLTGSF

SEQ ID NO: 155577 - protein, 9 aa, Homo Sapiens
RPPRSPAPA

SEQ ID NO: 155578 - protein, 9 aa, Homo Sapiens
DSAWSLTSS

SEQ ID NO: 155579 - protein, 9 aa, Homo Sapiens
RRPLSLADT

SEQ ID NO: 155580 - protein, 9 aa, Homo Sapiens
PPQRPSTVP

SEQ ID NO: 155581 - protein, 9 aa, Homo Sapiens
QTVQQKVTQ

SEQ ID NO: 155582 - protein, 9 aa, Homo Sapiens
PSFPYSYHY

SEQ ID NO: 155583 - protein, 9 aa, Homo Sapiens
VTPPQGPAQ

SEQ ID NO: 155584 - protein, 9 aa, Homo Sapiens
MLSGDHRRS

SEQ ID NO: 155585 - protein, 9 aa, Homo Sapiens
YELIKREKF

SEQ ID NO: 155586 - protein, 9 aa, Homo Sapiens
LLGLTRRSS

SEQ ID NO: 155587 - protein, 9 aa, Homo Sapiens
ETSSSSCKK

SEQ ID NO: 155588 - protein, 9 aa, Homo Sapiens
RIPPELQIA

SEQ ID NO: 155589 - protein, 9 aa, Homo Sapiens
HRRAPPGWA

SEQ ID NO: 155590 - protein, 9 aa, Homo Sapiens
IPKAPKKTL

SEQ ID NO: 155591 - protein, 9 aa, Homo Sapiens
VTALTFSAS

SEQ ID NO: 155592 - protein, 9 aa, Homo Sapiens
NYENGEIGG

SEQ ID NO: 155593 - protein, 9 aa, Homo Sapiens
NKKSHPQLA

SEQ ID NO: 155594 - protein, 9 aa, Homo Sapiens
PHPPSSTPC

SEQ ID NO: 155595 - protein, 9 aa, Homo Sapiens
PAVAVEQAG

SEQ ID NO: 155596 - protein, 9 aa, Homo Sapiens
LIHELVLLQ

SEQ ID NO: 155597 - protein, 9 aa, Homo Sapiens
RSEAPDSPN

SEQ ID NO: 155598 - protein, 9 aa, Homo Sapiens
PKQKKKKKR

SEQ ID NO: 155599 - protein, 9 aa, Homo Sapiens
QHNPFNIHP

SEQ ID NO: 155600 - protein, 9 aa, Homo Sapiens
LIFWIVPAH

SEQ ID NO: 155601 - protein, 9 aa, Homo Sapiens
VNECIGNLT

SEQ ID NO: 155602 - protein, 9 aa, Homo Sapiens
PPHHLVPLF

SEQ ID NO: 155603 - protein, 9 aa, Homo Sapiens
EVFPGDSKS

SEQ ID NO: 155604 - protein, 9 aa, Homo Sapiens
RPSLAVSSR

SEQ ID NO: 155605 - protein, 9 aa, Homo Sapiens
LGGGCFAAT

SEQ ID NO: 155606 - protein, 9 aa, Homo Sapiens
SSQTWARRH

SEQ ID NO: 155607 - protein, 9 aa, Homo Sapiens
KFIVQINPT

SEQ ID NO: 155608 - protein, 9 aa, Homo Sapiens
VTVPVDGDA

SEQ ID NO: 155609 - protein, 9 aa, Homo Sapiens
QPDGRSSSS

SEQ ID NO: 155610 - protein, 9 aa, Homo Sapiens
KAEGKGERW

SEQ ID NO: 155611 - protein, 9 aa, Homo Sapiens
PQHPPTGPL

SEQ ID NO: 155612 - protein, 9 aa, Homo Sapiens
FSFNIPHAK

SEQ ID NO: 155613 - protein, 9 aa, Homo Sapiens
VPVLTSLSE

SEQ ID NO: 155614 - protein, 9 aa, Homo Sapiens
ENKLEVEQQ

SEQ ID NO: 155615 - protein, 9 aa, Homo Sapiens
QAESTHTTV

SEQ ID NO: 155616 - protein, 9 aa, Homo Sapiens
ERQTLGVTL

SEQ ID NO: 155617 - protein, 9 aa, Homo Sapiens
LLRIGQQGY

SEQ ID NO: 155618 - protein, 9 aa, Homo Sapiens
RPRRARRLR

SEQ ID NO: 155619 - protein, 9 aa, Homo Sapiens
ANGATGSVQ

SEQ ID NO: 155620 - protein, 9 aa, Homo Sapiens
KCRRISATT

SEQ ID NO: 155621 - protein, 9 aa, Homo Sapiens
LGIVFRRVE

SEQ ID NO: 155622 - protein, 9 aa, Homo Sapiens
CTGTHRHTH

SEQ ID NO: 155623 - protein, 9 aa, Homo Sapiens
PPAARPPPA

SEQ ID NO: 155624 - protein, 9 aa, Homo Sapiens
LLAPFLRPC

SEQ ID NO: 155625 - protein, 9 aa, Homo Sapiens
LLAPATPPF

SEQ ID NO: 155626 - protein, 9 aa, Homo Sapiens
PKMLVCPQG

SEQ ID NO: 155627 - protein, 9 aa, Homo Sapiens
TPRTGLRGS

SEQ ID NO: 155628 - protein, 9 aa, Homo Sapiens
KSFAEGLRC

SEQ ID NO: 155629 - protein, 9 aa, Homo Sapiens
EFLKTAMSV

SEQ ID NO: 155630 - protein, 9 aa, Homo Sapiens
VSFCLSADH

SEQ ID NO: 155631 - protein, 9 aa, Homo Sapiens
TSSSSCKKQ

SEQ ID NO: 155632 - protein, 9 aa, Homo Sapiens
HTGKCCVSG

SEQ ID NO: 155633 - protein, 9 aa, Homo Sapiens
AECMAEKCY

SEQ ID NO: 155634 - protein, 9 aa, Homo Sapiens
LVLGVDGHT

SEQ ID NO: 155635 - protein, 9 aa, Homo Sapiens
CIQTLCCGC

SEQ ID NO: 155636 - protein, 9 aa, Homo Sapiens
ADWLLQTPL

SEQ ID NO: 155637 - protein, 9 aa, Homo Sapiens
RMPGAYFFS

SEQ ID NO: 155638 - protein, 9 aa, Homo Sapiens
EWFLCGGIL

SEQ ID NO: 155639 - protein, 9 aa, Homo Sapiens
RPTVAFLPP

SEQ ID NO: 155640 - protein, 9 aa, Homo Sapiens
GKRCEGEKQ

SEQ ID NO: 155641 - protein, 9 aa, Homo Sapiens
CGLPPCWRS

SEQ ID NO: 155642 - protein, 9 aa, Homo Sapiens
CIAAGGLRM

SEQ ID NO: 155643 - protein, 9 aa, Homo Sapiens
PVPPALSPV

SEQ ID NO: 155644 - protein, 9 aa, Homo Sapiens
DEDGAWRQR

SEQ ID NO: 155645 - protein, 9 aa, Homo Sapiens
TICGSLPLM

SEQ ID NO: 155646 - protein, 9 aa, Homo Sapiens
QRRHLWNLM

SEQ ID NO: 155647 - protein, 9 aa, Homo Sapiens
RMGSLRAPM

SEQ ID NO: 155648 - protein, 9 aa, Homo Sapiens
RDQVHDDRS

SEQ ID NO: 155649 - protein, 9 aa, Homo Sapiens
LPSPPVPLG

SEQ ID NO: 155650 - protein, 9 aa, Homo Sapiens
MATDPSYPC

SEQ ID NO: 155651 - protein, 9 aa, Homo Sapiens
VCFNVLKVT

SEQ ID NO: 155652 - protein, 9 aa, Homo Sapiens
RRLRAGQTE

SEQ ID NO: 155653 - protein, 9 aa, Homo Sapiens
LGIHIVGPQ

SEQ ID NO: 155654 - protein, 9 aa, Homo Sapiens
AVLKEGLSG

SEQ ID NO: 155655 - protein, 9 aa, Homo Sapiens
GMVYKGIWV

SEQ ID NO: 155656 - protein, 9 aa, Homo Sapiens
TAAAAATQK

SEQ ID NO: 155657 - protein, 9 aa, Homo Sapiens
TLLRSSSAP

SEQ ID NO: 155658 - protein, 9 aa, Homo Sapiens
QSLPLGRGG

SEQ ID NO: 155659 - protein, 9 aa, Homo Sapiens
GSKVANVAG

SEQ ID NO: 155660 - protein, 9 aa, Homo Sapiens
GASPTVCAT

SEQ ID NO: 155661 - protein, 9 aa, Homo Sapiens
PAPNPQRVM

SEQ ID NO: 155662 - protein, 9 aa, Homo Sapiens
HSPGPGLRP

SEQ ID NO: 155663 - protein, 9 aa, Homo Sapiens
LKEAKLHQM

SEQ ID NO: 155664 - protein, 9 aa, Homo Sapiens
KHQAVDNKA

SEQ ID NO: 155665 - protein, 9 aa, Homo Sapiens
GGEYLKEQC

SEQ ID NO: 155666 - protein, 9 aa, Homo Sapiens
GVAVDILGC

SEQ ID NO: 155667 - protein, 9 aa, Homo Sapiens
ASSDPPSAS

SEQ ID NO: 155668 - protein, 9 aa, Homo Sapiens
FVRSCTRRP

SEQ ID NO: 155669 - protein, 9 aa, Homo Sapiens
PSTCACLLG

SEQ ID NO: 155670 - protein, 9 aa, Homo Sapiens
RPPQPLPVA

SEQ ID NO: 155671 - protein, 9 aa, Homo Sapiens
LSLKLGVVD

SEQ ID NO: 155672 - protein, 9 aa, Homo Sapiens
SGPSLPAGG

SEQ ID NO: 155673 - protein, 9 aa, Homo Sapiens
PTEYPVHEG

SEQ ID NO: 155674 - protein, 9 aa, Homo Sapiens
NLFFKSFHS

SEQ ID NO: 155675 - protein, 9 aa, Homo Sapiens
LVGVKRLKS

SEQ ID NO: 155676 - protein, 9 aa, Homo Sapiens
AVGQLQART

SEQ ID NO: 155677 - protein, 9 aa, Homo Sapiens
LSLESWRRT

SEQ ID NO: 155678 - protein, 9 aa, Homo Sapiens
RPATSRTPS

SEQ ID NO: 155679 - protein, 9 aa, Homo Sapiens
NLIGCELPR

SEQ ID NO: 155680 - protein, 9 aa, Homo Sapiens
VFICDNKSF

SEQ ID NO: 155681 - protein, 9 aa, Homo Sapiens
LTHVLLITV

SEQ ID NO: 155682 - protein, 9 aa, Homo Sapiens
IPMSMEFQE

SEQ ID NO: 155683 - protein, 9 aa, Homo Sapiens
NGHFFQNKI

SEQ ID NO: 155684 - protein, 9 aa, Homo Sapiens
AGFFQGPPA

SEQ ID NO: 155685 - protein, 9 aa, Homo Sapiens
RWLQQTTGC

SEQ ID NO: 155686 - protein, 9 aa, Homo Sapiens
SVWSSAATT

SEQ ID NO: 155687 - protein, 9 aa, Homo Sapiens
MDEDRLSPL

SEQ ID NO: 155688 - protein, 9 aa, Homo Sapiens
LCPGGRPGQ

SEQ ID NO: 155689 - protein, 9 aa, Homo Sapiens
PFRRYSSTF

SEQ ID NO: 155690 - protein, 9 aa, Homo Sapiens
FIPLKPTMK

SEQ ID NO: 155691 - protein, 9 aa, Homo Sapiens
AMRWARRCT

SEQ ID NO: 155692 - protein, 9 aa, Homo Sapiens
WERELSVQL

SEQ ID NO: 155693 - protein, 9 aa, Homo Sapiens
FMETSAKLD

SEQ ID NO: 155694 - protein, 9 aa, Homo Sapiens
SVPCPNLLP

SEQ ID NO: 155695 - protein, 9 aa, Homo Sapiens
DQRGLVPPG

SEQ ID NO: 155696 - protein, 9 aa, Homo Sapiens
IMDRFNLPC

SEQ ID NO: 155697 - protein, 9 aa, Homo Sapiens
GAGAMEVAM

SEQ ID NO: 155698 - protein, 9 aa, Homo Sapiens
TAACAESAC

SEQ ID NO: 155699 - protein, 9 aa, Homo Sapiens
PRKGQSLRC

SEQ ID NO: 155700 - protein, 9 aa, Homo Sapiens
VPTAARPSA

SEQ ID NO: 155701 - protein, 9 aa, Homo Sapiens
ELAAIDLDK

SEQ ID NO: 155702 - protein, 9 aa, Homo Sapiens
TNQHRRTTS

SEQ ID NO: 155703 - protein, 9 aa, Homo Sapiens
KTLLRNHFS

SEQ ID NO: 155704 - protein, 9 aa, Homo Sapiens
LGRAAPLGC

SEQ ID NO: 155705 - protein, 9 aa, Homo Sapiens
GSGSFVRSC

SEQ ID NO: 155706 - protein, 9 aa, Homo Sapiens
RRQVLRYHP

SEQ ID NO: 155707 - protein, 9 aa, Homo Sapiens
APPLTPAAT

SEQ ID NO: 155708 - protein, 9 aa, Homo Sapiens
TCQRQAREQ

SEQ ID NO: 155709 - protein, 9 aa, Homo Sapiens
MQAHLLIAL

SEQ ID NO: 155710 - protein, 9 aa, Homo Sapiens
QEKWLRKRT

SEQ ID NO: 155711 - protein, 9 aa, Homo Sapiens
SKEKCVYFF

SEQ ID NO: 155712 - protein, 9 aa, Homo Sapiens
PELWVTHRK

SEQ ID NO: 155713 - protein, 9 aa, Homo Sapiens
LFALSPGLP

SEQ ID NO: 155714 - protein, 9 aa, Homo Sapiens
RDSWPTRRS

SEQ ID NO: 155715 - protein, 9 aa, Homo Sapiens
KKFWAILKG

SEQ ID NO: 155716 - protein, 9 aa, Homo Sapiens
QDTDEKFME

SEQ ID NO: 155717 - protein, 9 aa, Homo Sapiens
LQLALFYQG

SEQ ID NO: 155718 - protein, 9 aa, Homo Sapiens
GMIGHPWHQ

SEQ ID NO: 155719 - protein, 9 aa, Homo Sapiens
CMENVDYPY

SEQ ID NO: 155720 - protein, 9 aa, Homo Sapiens
WRKRKPSAK

SEQ ID NO: 155721 - protein, 9 aa, Homo Sapiens
MHGGTLLDD

SEQ ID NO: 155722 - protein, 9 aa, Homo Sapiens
ESSSKSDSD

SEQ ID NO: 155723 - protein, 9 aa, Homo Sapiens
LSVVPQFLP

SEQ ID NO: 155724 - protein, 9 aa, Homo Sapiens
KFSRLHRGL

SEQ ID NO: 155725 - protein, 9 aa, Homo Sapiens
LVPRLFWVA

SEQ ID NO: 155726 - protein, 9 aa, Homo Sapiens
TAIASRSVT

SEQ ID NO: 155727 - protein, 9 aa, Homo Sapiens
RTGASTPAR

SEQ ID NO: 155728 - protein, 9 aa, Homo Sapiens
LYAKKEWNE

SEQ ID NO: 155729 - protein, 9 aa, Homo Sapiens
NAQMRLGGA

SEQ ID NO: 155730 - protein, 9 aa, Homo Sapiens
VVNAKKKCH

SEQ ID NO: 155731 - protein, 9 aa, Homo Sapiens
VNAKKKCHS

SEQ ID NO: 155732 - protein, 9 aa, Homo Sapiens
LILRSPRVF

SEQ ID NO: 155733 - protein, 9 aa, Homo Sapiens
TNIPEEVCE

SEQ ID NO: 155734 - protein, 9 aa, Homo Sapiens
PIALWAHRV

SEQ ID NO: 155735 - protein, 9 aa, Homo Sapiens
ERGPLKHLY

SEQ ID NO: 155736 - protein, 9 aa, Homo Sapiens
KKRNTNTPG

SEQ ID NO: 155737 - protein, 9 aa, Homo Sapiens
SKSSTSLAL

SEQ ID NO: 155738 - protein, 9 aa, Homo Sapiens
EGWAPESAG

SEQ ID NO: 155739 - protein, 9 aa, Homo Sapiens
FCAENLEKI

SEQ ID NO: 155740 - protein, 9 aa, Homo Sapiens
GCLRPPPAR

SEQ ID NO: 155741 - protein, 9 aa, Homo Sapiens
GRMATLERQ

SEQ ID NO: 155742 - protein, 9 aa, Homo Sapiens
PWARHTHPS

SEQ ID NO: 155743 - protein, 9 aa, Homo Sapiens
MFPESASDT

SEQ ID NO: 155744 - protein, 9 aa, Homo Sapiens
PAVASRSTA

SEQ ID NO: 155745 - protein, 9 aa, Homo Sapiens
VRCVEKMQD

SEQ ID NO: 155746 - protein, 9 aa, Homo Sapiens
LRSDSKEGS

SEQ ID NO: 155747 - protein, 9 aa, Homo Sapiens
SSLSLESWR

SEQ ID NO: 155748 - protein, 9 aa, Homo Sapiens
LVTDPGVAG

SEQ ID NO: 155749 - protein, 9 aa, Homo Sapiens
RGHGAPRSP

SEQ ID NO: 155750 - protein, 9 aa, Homo Sapiens
SSPEDCGRG

SEQ ID NO: 155751 - protein, 9 aa, Homo Sapiens
QEGYSNSET

SEQ ID NO: 155752 - protein, 9 aa, Homo Sapiens
GTYLNYECC

SEQ ID NO: 155753 - protein, 9 aa, Homo Sapiens
VPKLQRRQF

SEQ ID NO: 155754 - protein, 9 aa, Homo Sapiens
FKFIGGLRR

SEQ ID NO: 155755 - protein, 9 aa, Homo Sapiens
PGLEAEGWA

SEQ ID NO: 155756 - protein, 9 aa, Homo Sapiens
DKIPSPLKI

SEQ ID NO: 155757 - protein, 9 aa, Homo Sapiens
CASRAPRLP

SEQ ID NO: 155758 - protein, 9 aa, Homo Sapiens
GCWQPLHPG

SEQ ID NO: 155759 - protein, 9 aa, Homo Sapiens
DHQVSEVFN

SEQ ID NO: 155760 - protein, 9 aa, Homo Sapiens
CWPPGYSGP

SEQ ID NO: 155761 - protein, 9 aa, Homo Sapiens
RLAAASGPC

SEQ ID NO: 155762 - protein, 9 aa, Homo Sapiens
SNLPVPERT

SEQ ID NO: 155763 - protein, 9 aa, Homo Sapiens
CGWRTLSSS

SEQ ID NO: 155764 - protein, 9 aa, Homo Sapiens
RLEEQHTQQ

SEQ ID NO: 155765 - protein, 9 aa, Homo Sapiens
NLKNCIYPL

SEQ ID NO: 155766 - protein, 9 aa, Homo Sapiens
DILFAFTKQ

SEQ ID NO: 155767 - protein, 9 aa, Homo Sapiens
DRSHELEIS

SEQ ID NO: 155768 - protein, 9 aa, Homo Sapiens
LAPPPPLPA

SEQ ID NO: 155769 - protein, 9 aa, Homo Sapiens
SLSGWSGNS

SEQ ID NO: 155770 - protein, 9 aa, Homo Sapiens
RSPTSAPTA

SEQ ID NO: 155771 - protein, 9 aa, Homo Sapiens
STCSDIWQV

SEQ ID NO: 155772 - protein, 9 aa, Homo Sapiens
LEAEGWAPE

SEQ ID NO: 155773 - protein, 9 aa, Homo Sapiens
QAICISHTP

SEQ ID NO: 155774 - protein, 9 aa, Homo Sapiens
TRALGAGAS

SEQ ID NO: 155775 - protein, 9 aa, Homo Sapiens
PLKHLYSLH

SEQ ID NO: 155776 - protein, 9 aa, Homo Sapiens
PWRMQTVPE

SEQ ID NO: 155777 - protein, 9 aa, Homo Sapiens
MIHGCSVLH

SEQ ID NO: 155778 - protein, 9 aa, Homo Sapiens
LSVVLLGWQ

SEQ ID NO: 155779 - protein, 9 aa, Homo Sapiens
SGSTSRRTR

SEQ ID NO: 155780 - protein, 9 aa, Homo Sapiens
TAFLLAGGT

SEQ ID NO: 155781 - protein, 9 aa, Homo Sapiens
SWPRKLRRP

SEQ ID NO: 155782 - protein, 9 aa, Homo Sapiens
NDYIPDSIQ

SEQ ID NO: 155783 - protein, 9 aa, Homo Sapiens
RRRTICGSL

SEQ ID NO: 155784 - protein, 9 aa, Homo Sapiens
TSRTPSGCT

SEQ ID NO: 155785 - protein, 9 aa, Homo Sapiens
VRDLGLQLP

SEQ ID NO: 155786 - protein, 9 aa, Homo Sapiens
PEATLEVSG

SEQ ID NO: 155787 - protein, 9 aa, Homo Sapiens
PPRSPGVPR

SEQ ID NO: 155788 - protein, 9 aa, Homo Sapiens
EVGAQLKKL

SEQ ID NO: 155789 - protein, 9 aa, Homo Sapiens
YKVPVTLAL

SEQ ID NO: 155790 - protein, 9 aa, Homo Sapiens
PGSWPVAQR

SEQ ID NO: 155791 - protein, 9 aa, Homo Sapiens
DEGIMSRKA

SEQ ID NO: 155792 - protein, 9 aa, Homo Sapiens
AAQGSVMIS

SEQ ID NO: 155793 - protein, 9 aa, Homo Sapiens
HRIEESITE

SEQ ID NO: 155794 - protein, 9 aa, Homo Sapiens
MKGHSARII

SEQ ID NO: 155795 - protein, 9 aa, Homo Sapiens
EVYSNPCME

SEQ ID NO: 155796 - protein, 9 aa, Homo Sapiens
SYNFKQKRE

SEQ ID NO: 155797 - protein, 9 aa, Homo Sapiens
FCPVHRPPW

SEQ ID NO: 155798 - protein, 9 aa, Homo Sapiens
KKRQTLRTL

SEQ ID NO: 155799 - protein, 9 aa, Homo Sapiens
PSRTTGAPG

SEQ ID NO: 155800 - protein, 9 aa, Homo Sapiens
RSWWRVPTP

SEQ ID NO: 155801 - protein, 9 aa, Homo Sapiens
LGLVPPPKS

SEQ ID NO: 155802 - protein, 9 aa, Homo Sapiens
INVSKAGKV

SEQ ID NO: 155803 - protein, 9 aa, Homo Sapiens
WCCLMSQGK

SEQ ID NO: 155804 - protein, 9 aa, Homo Sapiens
AVAATTWNR

SEQ ID NO: 155805 - protein, 9 aa, Homo Sapiens
WNWAQSCPT

SEQ ID NO: 155806 - protein, 9 aa, Homo Sapiens
WDSHICGVS

SEQ ID NO: 155807 - protein, 9 aa, Homo Sapiens
PARSAAAAS

SEQ ID NO: 155808 - protein, 9 aa, Homo Sapiens
DVTKKNKGR

SEQ ID NO: 155809 - protein, 9 aa, Homo Sapiens
LQCGYPSLF

SEQ ID NO: 155810 - protein, 9 aa, Homo Sapiens
RRHISNTDN

SEQ ID NO: 155811 - protein, 9 aa, Homo Sapiens
GGGGGAPAA

SEQ ID NO: 155812 - protein, 9 aa, Homo Sapiens
SHHPHHLPR

SEQ ID NO: 155813 - protein, 9 aa, Homo Sapiens
KEDGEATDT

SEQ ID NO: 155814 - protein, 9 aa, Homo Sapiens
VDHRVFGQL

SEQ ID NO: 155815 - protein, 9 aa, Homo Sapiens
KTAAAEEAS

SEQ ID NO: 155816 - protein, 9 aa, Homo Sapiens
VSGVGQQEL

SEQ ID NO: 155817 - protein, 9 aa, Homo Sapiens
THRPASAWT

SEQ ID NO: 155818 - protein, 9 aa, Homo Sapiens
CRASEAGAR

SEQ ID NO: 155819 - protein, 9 aa, Homo Sapiens
LPDPCRAPP

SEQ ID NO: 155820 - protein, 9 aa, Homo Sapiens
HTGTDRNTQ

SEQ ID NO: 155821 - protein, 9 aa, Homo Sapiens
HADSQGQSS

SEQ ID NO: 155822 - protein, 9 aa, Homo Sapiens
QPTASWHPR

SEQ ID NO: 155823 - protein, 9 aa, Homo Sapiens
IKKPPIPLP

SEQ ID NO: 155824 - protein, 9 aa, Homo Sapiens
DAATPAAAA

SEQ ID NO: 155825 - protein, 9 aa, Homo Sapiens
TIPRPFTVR

SEQ ID NO: 155826 - protein, 9 aa, Homo Sapiens
TIEVAQVLV

SEQ ID NO: 155827 - protein, 9 aa, Homo Sapiens
RPSGPCPSI

SEQ ID NO: 155828 - protein, 9 aa, Homo Sapiens
NRESTPLPA

SEQ ID NO: 155829 - protein, 9 aa, Homo Sapiens
DGQTRAGDA

SEQ ID NO: 155830 - protein, 9 aa, Homo Sapiens
LLVFLFFLL

SEQ ID NO: 155831 - protein, 9 aa, Homo Sapiens
AQLSLHILY

SEQ ID NO: 155832 - protein, 9 aa, Homo Sapiens
RNAGLSTGA

SEQ ID NO: 155833 - protein, 9 aa, Homo Sapiens
PELPVTPGL

SEQ ID NO: 155834 - protein, 9 aa, Homo Sapiens
VVNAYPSSQ

SEQ ID NO: 155835 - protein, 9 aa, Homo Sapiens
VAATTWNRS

SEQ ID NO: 155836 - protein, 9 aa, Homo Sapiens
THTGTDRNT

SEQ ID NO: 155837 - protein, 9 aa, Homo Sapiens
YAGDDSVLL

SEQ ID NO: 155838 - protein, 9 aa, Homo Sapiens
KKIHAKDKL

SEQ ID NO: 155839 - protein, 9 aa, Homo Sapiens
VMIHPLPVK

SEQ ID NO: 155840 - protein, 9 aa, Homo Sapiens
VAHNKLSVV

SEQ ID NO: 155841 - protein, 9 aa, Homo Sapiens
QAALLRIGQ

SEQ ID NO: 155842 - protein, 9 aa, Homo Sapiens
PGLPPATMT

SEQ ID NO: 155843 - protein, 9 aa, Homo Sapiens
PNAAPEVGS

SEQ ID NO: 155844 - protein, 9 aa, Homo Sapiens
GSRMAHPRL

SEQ ID NO: 155845 - protein, 9 aa, Homo Sapiens
AKMPMDKPG

SEQ ID NO: 155846 - protein, 9 aa, Homo Sapiens
ASMASLKKQ

SEQ ID NO: 155847 - protein, 9 aa, Homo Sapiens
FCAMGVAYG

SEQ ID NO: 155848 - protein, 9 aa, Homo Sapiens
SGSQCSLTR

SEQ ID NO: 155849 - protein, 9 aa, Homo Sapiens
TDAIIQERR

SEQ ID NO: 155850 - protein, 9 aa, Homo Sapiens
LGRTQRWAA

SEQ ID NO: 155851 - protein, 9 aa, Homo Sapiens
EEGQALISD

SEQ ID NO: 155852 - protein, 9 aa, Homo Sapiens
GHPAHFCHH

SEQ ID NO: 155853 - protein, 9 aa, Homo Sapiens
VCTTTPNMN

SEQ ID NO: 155854 - protein, 9 aa, Homo Sapiens
HSLGFCDTT

SEQ ID NO: 155855 - protein, 9 aa, Homo Sapiens
PGSSHACVQ

SEQ ID NO: 155856 - protein, 9 aa, Homo Sapiens
DQGGKIRHF

SEQ ID NO: 155857 - protein, 9 aa, Homo Sapiens
SPRAAIWRR

SEQ ID NO: 155858 - protein, 9 aa, Homo Sapiens
VPAAMMGAF

SEQ ID NO: 155859 - protein, 9 aa, Homo Sapiens
IRHAYSFHQ

SEQ ID NO: 155860 - protein, 9 aa, Homo Sapiens
NVDPTFNPN

SEQ ID NO: 155861 - protein, 9 aa, Homo Sapiens
SSCRKATRR

SEQ ID NO: 155862 - protein, 9 aa, Homo Sapiens
AASARSPTS

SEQ ID NO: 155863 - protein, 9 aa, Homo Sapiens
QCGYPSLFL

SEQ ID NO: 155864 - protein, 9 aa, Homo Sapiens
LVQCHLGTA

SEQ ID NO: 155865 - protein, 9 aa, Homo Sapiens
CQCPLLLPQ

SEQ ID NO: 155866 - protein, 9 aa, Homo Sapiens
STSSHLILL

SEQ ID NO: 155867 - protein, 9 aa, Homo Sapiens
RAAPLGCCP

SEQ ID NO: 155868 - protein, 9 aa, Homo Sapiens
EGPVPKVRA

SEQ ID NO: 155869 - protein, 9 aa, Homo Sapiens
PLIPEGASW

SEQ ID NO: 155870 - protein, 9 aa, Homo Sapiens
FPTSYILAV

SEQ ID NO: 155871 - protein, 9 aa, Homo Sapiens
SNKPLRGDP

SEQ ID NO: 155872 - protein, 9 aa, Homo Sapiens
PPSLAQAQP

SEQ ID NO: 155873 - protein, 9 aa, Homo Sapiens
HLCNNPTPQ

SEQ ID NO: 155874 - protein, 9 aa, Homo Sapiens
RVREDAERR

SEQ ID NO: 155875 - protein, 9 aa, Homo Sapiens
ALGPGALLD

SEQ ID NO: 155876 - protein, 9 aa, Homo Sapiens
VRIFASLHV

SEQ ID NO: 155877 - protein, 9 aa, Homo Sapiens
QPRPPRFLS

SEQ ID NO: 155878 - protein, 9 aa, Homo Sapiens
EKQMALFFG

SEQ ID NO: 155879 - protein, 9 aa, Homo Sapiens
CCRAQTVAP

SEQ ID NO: 155880 - protein, 9 aa, Homo Sapiens
VIKKPPIPL

SEQ ID NO: 155881 - protein, 9 aa, Homo Sapiens
PPQCHPRYP

SEQ ID NO: 155882 - protein, 9 aa, Homo Sapiens
TLRGDELVR

SEQ ID NO: 155883 - protein, 9 aa, Homo Sapiens
NEAIKKGNG

SEQ ID NO: 155884 - protein, 9 aa, Homo Sapiens
YHVRWFPET

SEQ ID NO: 155885 - protein, 9 aa, Homo Sapiens
RTCSPCSPT

SEQ ID NO: 155886 - protein, 9 aa, Homo Sapiens
EKSNKKISV

SEQ ID NO: 155887 - protein, 9 aa, Homo Sapiens
PRLGPAGRI

SEQ ID NO: 155888 - protein, 9 aa, Homo Sapiens
SLEIFAKLE

SEQ ID NO: 155889 - protein, 9 aa, Homo Sapiens
GKEHRRVND

SEQ ID NO: 155890 - protein, 9 aa, Homo Sapiens
SHYDGCRVY

SEQ ID NO: 155891 - protein, 9 aa, Homo Sapiens
MTERSMPHL

SEQ ID NO: 155892 - protein, 9 aa, Homo Sapiens
PTIPNQKKR

SEQ ID NO: 155893 - protein, 9 aa, Homo Sapiens
DGPWPFTTQ

SEQ ID NO: 155894 - protein, 9 aa, Homo Sapiens
ADRFADQRA

SEQ ID NO: 155895 - protein, 9 aa, Homo Sapiens
MKEDQVMQQ

SEQ ID NO: 155896 - protein, 9 aa, Homo Sapiens
AQRVPPGEQ

SEQ ID NO: 155897 - protein, 9 aa, Homo Sapiens
VGGSLPKKI

SEQ ID NO: 155898 - protein, 9 aa, Homo Sapiens
STYVNPQHV

SEQ ID NO: 155899 - protein, 9 aa, Homo Sapiens
PPKPGLVCT

SEQ ID NO: 155900 - protein, 9 aa, Homo Sapiens
VNPQHVESR

SEQ ID NO: 155901 - protein, 9 aa, Homo Sapiens
GFLLPGQPM

SEQ ID NO: 155902 - protein, 9 aa, Homo Sapiens
DLIKRYQES

SEQ ID NO: 155903 - protein, 9 aa, Homo Sapiens
TYPRAVTLM

SEQ ID NO: 155904 - protein, 9 aa, Homo Sapiens
SPPPPPTFL

SEQ ID NO: 155905 - protein, 9 aa, Homo Sapiens
GLDLDPLLG

SEQ ID NO: 155906 - protein, 9 aa, Homo Sapiens
PICSGASTS

SEQ ID NO: 155907 - protein, 9 aa, Homo Sapiens
GAASPPARS

SEQ ID NO: 155908 - protein, 9 aa, Homo Sapiens
TTSAASGSC

SEQ ID NO: 155909 - protein, 9 aa, Homo Sapiens
RPPLQLQRL

SEQ ID NO: 155910 - protein, 9 aa, Homo Sapiens
ENFTPQNVT

SEQ ID NO: 155911 - protein, 9 aa, Homo Sapiens
CRRCAIVGN

SEQ ID NO: 155912 - protein, 9 aa, Homo Sapiens
AQDIEATQS

SEQ ID NO: 155913 - protein, 9 aa, Homo Sapiens
TGNKFTLDS

SEQ ID NO: 155914 - protein, 9 aa, Homo Sapiens
FTCIVAIGR

SEQ ID NO: 155915 - protein, 9 aa, Homo Sapiens
HTRENLHWD

SEQ ID NO: 155916 - protein, 9 aa, Homo Sapiens
QAHPIHLSK

SEQ ID NO: 155917 - protein, 9 aa, Homo Sapiens
FTFPICCFQ

SEQ ID NO: 155918 - protein, 9 aa, Homo Sapiens
SLGVSSLEY

SEQ ID NO: 155919 - protein, 9 aa, Homo Sapiens
LWEGRRPLP

SEQ ID NO: 155920 - protein, 9 aa, Homo Sapiens
EPVVGIPDN

SEQ ID NO: 155921 - protein, 9 aa, Homo Sapiens
LDFSQQDIN

SEQ ID NO: 155922 - protein, 9 aa, Homo Sapiens
EALMRWHRI

SEQ ID NO: 155923 - protein, 9 aa, Homo Sapiens
GYRPTPTWR

SEQ ID NO: 155924 - protein, 9 aa, Homo Sapiens
QAPIPWLNW

SEQ ID NO: 155925 - protein, 9 aa, Homo Sapiens
AASGPCHAA

SEQ ID NO: 155926 - protein, 9 aa, Homo Sapiens
VIHTDTHAD

SEQ ID NO: 155927 - protein, 9 aa, Homo Sapiens
AQTEQHPRE

SEQ ID NO: 155928 - protein, 9 aa, Homo Sapiens
SRSHSKSRS

SEQ ID NO: 155929 - protein, 9 aa, Homo Sapiens
MHARHKVLA

SEQ ID NO: 155930 - protein, 9 aa, Homo Sapiens
SNMTIQTMK

SEQ ID NO: 155931 - protein, 9 aa, Homo Sapiens
GDHDTGSLT

SEQ ID NO: 155932 - protein, 9 aa, Homo Sapiens
SQLVPAGRS

SEQ ID NO: 155933 - protein, 9 aa, Homo Sapiens
RPVPEPPTP

SEQ ID NO: 155934 - protein, 9 aa, Homo Sapiens
GIPGEAMVK

SEQ ID NO: 155935 - protein, 9 aa, Homo Sapiens
EVIKKPPIP

SEQ ID NO: 155936 - protein, 9 aa, Homo Sapiens
ANCEHTFIA

SEQ ID NO: 155937 - protein, 9 aa, Homo Sapiens
KKVDVIDLI

SEQ ID NO: 155938 - protein, 9 aa, Homo Sapiens
EYTWHLPCG

SEQ ID NO: 155939 - protein, 9 aa, Homo Sapiens
WNGMAIIRP

SEQ ID NO: 155940 - protein, 9 aa, Homo Sapiens
QTIRLNPLR

SEQ ID NO: 155941 - protein, 9 aa, Homo Sapiens
VGTAILVNY

SEQ ID NO: 155942 - protein, 9 aa, Homo Sapiens
KHSFKTKDT

SEQ ID NO: 155943 - protein, 9 aa, Homo Sapiens
RGIRCPPAA

SEQ ID NO: 155944 - protein, 9 aa, Homo Sapiens
SERVREDAE

SEQ ID NO: 155945 - protein, 9 aa, Homo Sapiens
VEIGTVVVL

SEQ ID NO: 155946 - protein, 9 aa, Homo Sapiens
VNVDPTFNP

SEQ ID NO: 155947 - protein, 9 aa, Homo Sapiens
IPRTFPEGA

SEQ ID NO: 155948 - protein, 9 aa, Homo Sapiens
ILIATGGVP

SEQ ID NO: 155949 - protein, 9 aa, Homo Sapiens
GICNGGLQG

SEQ ID NO: 155950 - protein, 9 aa, Homo Sapiens
TAQWPTLCL

SEQ ID NO: 155951 - protein, 9 aa, Homo Sapiens
RAPVHNPRV

SEQ ID NO: 155952 - protein, 9 aa, Homo Sapiens
KTPPKPWQS

SEQ ID NO: 155953 - protein, 9 aa, Homo Sapiens
HCGSTSAGL

SEQ ID NO: 155954 - protein, 9 aa, Homo Sapiens
PMLPIGLSG

SEQ ID NO: 155955 - protein, 9 aa, Homo Sapiens
GEEFMEGDE

SEQ ID NO: 155956 - protein, 9 aa, Homo Sapiens
GRNWRDIYK

SEQ ID NO: 155957 - protein, 9 aa, Homo Sapiens
VHQGLTQLS

SEQ ID NO: 155958 - protein, 9 aa, Homo Sapiens
FGDDIPGIE

SEQ ID NO: 155959 - protein, 9 aa, Homo Sapiens
GGIQSWAVS

SEQ ID NO: 155960 - protein, 9 aa, Homo Sapiens
PTLEAARSR

SEQ ID NO: 155961 - protein, 9 aa, Homo Sapiens
LRHRLRAGA

SEQ ID NO: 155962 - protein, 9 aa, Homo Sapiens
PGHLRARAE

SEQ ID NO: 155963 - protein, 9 aa, Homo Sapiens
IGDEDQRRG

SEQ ID NO: 155964 - protein, 9 aa, Homo Sapiens
SPVSGVGQQ

SEQ ID NO: 155965 - protein, 9 aa, Homo Sapiens
LPEYTWHLP

SEQ ID NO: 155966 - protein, 9 aa, Homo Sapiens
RAWDRNNVL

SEQ ID NO: 155967 - protein, 9 aa, Homo Sapiens
VPVQVTVPV

SEQ ID NO: 155968 - protein, 9 aa, Homo Sapiens
AARAGDLPC

SEQ ID NO: 155969 - protein, 9 aa, Homo Sapiens
GRQCLMSQR

SEQ ID NO: 155970 - protein, 9 aa, Homo Sapiens
RLLEHPCPE

SEQ ID NO: 155971 - protein, 9 aa, Homo Sapiens
PCLCLEEPR

SEQ ID NO: 155972 - protein, 9 aa, Homo Sapiens
VPTVFTFQD

SEQ ID NO: 155973 - protein, 9 aa, Homo Sapiens
EVIPEKQTM

SEQ ID NO: 155974 - protein, 9 aa, Homo Sapiens
SGAVNRVII

SEQ ID NO: 155975 - protein, 9 aa, Homo Sapiens
GRCWKRTSH

SEQ ID NO: 155976 - protein, 9 aa, Homo Sapiens
AGASTFSLR

SEQ ID NO: 155977 - protein, 9 aa, Homo Sapiens
QDPIEAPPP

SEQ ID NO: 155978 - protein, 9 aa, Homo Sapiens
RRVNDALNT

SEQ ID NO: 155979 - protein, 9 aa, Homo Sapiens
CIENVHGGH

SEQ ID NO: 155980 - protein, 9 aa, Homo Sapiens
SRPWPHVLS

SEQ ID NO: 155981 - protein, 9 aa, Homo Sapiens
HTRPTRRSS

SEQ ID NO: 155982 - protein, 9 aa, Homo Sapiens
GPLPCVLPH

SEQ ID NO: 155983 - protein, 9 aa, Homo Sapiens
LDFLKVAVG

SEQ ID NO: 155984 - protein, 9 aa, Homo Sapiens
GKNIQGGRP

SEQ ID NO: 155985 - protein, 9 aa, Homo Sapiens
APPVLHCCM

SEQ ID NO: 155986 - protein, 9 aa, Homo Sapiens
VGPGADIIG

SEQ ID NO: 155987 - protein, 9 aa, Homo Sapiens
FFLLLPPFT

SEQ ID NO: 155988 - protein, 9 aa, Homo Sapiens
SQSALGTAS

SEQ ID NO: 155989 - protein, 9 aa, Homo Sapiens
LVFLGLKPT

SEQ ID NO: 155990 - protein, 9 aa, Homo Sapiens
LRPALAAPA

SEQ ID NO: 155991 - protein, 9 aa, Homo Sapiens
LELEHCLFT

SEQ ID NO: 155992 - protein, 9 aa, Homo Sapiens
LALFYQGPG

SEQ ID NO: 155993 - protein, 9 aa, Homo Sapiens
TQIAMAAQM

SEQ ID NO: 155994 - protein, 9 aa, Homo Sapiens
RHSHTRGVS

SEQ ID NO: 155995 - protein, 9 aa, Homo Sapiens
PQVPVLTSL

SEQ ID NO: 155996 - protein, 9 aa, Homo Sapiens
GMDDHLFYI

SEQ ID NO: 155997 - protein, 9 aa, Homo Sapiens
NPTNVKNVT

SEQ ID NO: 155998 - protein, 9 aa, Homo Sapiens
ERGPWSPTH

SEQ ID NO: 155999 - protein, 9 aa, Homo Sapiens
QLDHTNLIQ

SEQ ID NO: 156000 - protein, 9 aa, Homo Sapiens
ELATRLQKM

SEQ ID NO: 156001 - protein, 9 aa, Homo Sapiens
LLLVFLFFL

SEQ ID NO: 156002 - protein, 9 aa, Homo Sapiens
RYSSTFPTI

SEQ ID NO: 156003 - protein, 9 aa, Homo Sapiens
ISPVNQGIR

SEQ ID NO: 156004 - protein, 9 aa, Homo Sapiens
RRGPSPSPP

SEQ ID NO: 156005 - protein, 9 aa, Homo Sapiens
NPTNVKNVA

SEQ ID NO: 156006 - protein, 9 aa, Homo Sapiens
EEALMRWHR

SEQ ID NO: 156007 - protein, 9 aa, Homo Sapiens
GYLGRWGRG

SEQ ID NO: 156008 - protein, 9 aa, Homo Sapiens
SVLRLGPHG

SEQ ID NO: 156009 - protein, 9 aa, Homo Sapiens
DVNATAEDN

SEQ ID NO: 156010 - protein, 9 aa, Homo Sapiens
KRSQMPSRC

SEQ ID NO: 156011 - protein, 9 aa, Homo Sapiens
GRPGQCAGA

SEQ ID NO: 156012 - protein, 9 aa, Homo Sapiens
TICRVGTVL

SEQ ID NO: 156013 - protein, 9 aa, Homo Sapiens
IRLHFQKAL

SEQ ID NO: 156014 - protein, 9 aa, Homo Sapiens
VDPPWSSQT

SEQ ID NO: 156015 - protein, 9 aa, Homo Sapiens
HRKSIFFVG

SEQ ID NO: 156016 - protein, 9 aa, Homo Sapiens
AGLPMAVIP

SEQ ID NO: 156017 - protein, 9 aa, Homo Sapiens
RRTRPNRVL

SEQ ID NO: 156018 - protein, 9 aa, Homo Sapiens
RDSSPITNS

SEQ ID NO: 156019 - protein, 9 aa, Homo Sapiens
GKPTFQKPK

SEQ ID NO: 156020 - protein, 9 aa, Homo Sapiens
PPLPPPQVT

SEQ ID NO: 156021 - protein, 9 aa, Homo Sapiens
SREGPVPKV

SEQ ID NO: 156022 - protein, 9 aa, Homo Sapiens
GSPPSTARS

SEQ ID NO: 156023 - protein, 9 aa, Homo Sapiens
ICRVGTVLQ

SEQ ID NO: 156024 - protein, 9 aa, Homo Sapiens
TATAASARS

SEQ ID NO: 156025 - protein, 9 aa, Homo Sapiens
EYGKTVTMK

SEQ ID NO: 156026 - protein, 9 aa, Homo Sapiens
GKSGAVNRV

SEQ ID NO: 156027 - protein, 9 aa, Homo Sapiens
GVNMRHLWR

SEQ ID NO: 156028 - protein, 9 aa, Homo Sapiens
GSTAPGVGW

SEQ ID NO: 156029 - protein, 9 aa, Homo Sapiens
WRTLSSSAS

SEQ ID NO: 156030 - protein, 9 aa, Homo Sapiens
QTEQCGINL

SEQ ID NO: 156031 - protein, 9 aa, Homo Sapiens
QSPSPAACW

SEQ ID NO: 156032 - protein, 9 aa, Homo Sapiens
KQLCVRFAC

SEQ ID NO: 156033 - protein, 9 aa, Homo Sapiens
QQRHTAYIS

SEQ ID NO: 156034 - protein, 9 aa, Homo Sapiens
RVVGQQGRA

SEQ ID NO: 156035 - protein, 9 aa, Homo Sapiens
EGPRQELAR

SEQ ID NO: 156036 - protein, 9 aa, Homo Sapiens
WCRTGASTR

SEQ ID NO: 156037 - protein, 9 aa, Homo Sapiens
LPPRPRPHP

SEQ ID NO: 156038 - protein, 9 aa, Homo Sapiens
HQDKNLVIN

SEQ ID NO: 156039 - protein, 9 aa, Homo Sapiens
GRQRGRLNS

SEQ ID NO: 156040 - protein, 9 aa, Homo Sapiens
MFAVWEEVE

SEQ ID NO: 156041 - protein, 9 aa, Homo Sapiens
PRPGLSAPG

SEQ ID NO: 156042 - protein, 9 aa, Homo Sapiens
AFHQSRLWE

SEQ ID NO: 156043 - protein, 9 aa, Homo Sapiens
YVLWRGCHK

SEQ ID NO: 156044 - protein, 9 aa, Homo Sapiens
DVKGGTLNM

SEQ ID NO: 156045 - protein, 9 aa, Homo Sapiens
IFLVPAAMM

SEQ ID NO: 156046 - protein, 9 aa, Homo Sapiens
TNEFVSSVC

SEQ ID NO: 156047 - protein, 9 aa, Homo Sapiens
EFRQRELCA

SEQ ID NO: 156048 - protein, 9 aa, Homo Sapiens
GADYFEAMS

SEQ ID NO: 156049 - protein, 9 aa, Homo Sapiens
YVGWLSTTT

SEQ ID NO: 156050 - protein, 9 aa, Homo Sapiens
VLNPRGVVH

SEQ ID NO: 156051 - protein, 9 aa, Homo Sapiens
ILASPGILK

SEQ ID NO: 156052 - protein, 9 aa, Homo Sapiens
LGHPSRNHC

SEQ ID NO: 156053 - protein, 9 aa, Homo Sapiens
PCGDPPPYE

SEQ ID NO: 156054 - protein, 9 aa, Homo Sapiens
RDMLGGDGI

SEQ ID NO: 156055 - protein, 9 aa, Homo Sapiens
PDVIAKMPM

SEQ ID NO: 156056 - protein, 9 aa, Homo Sapiens
LATEKSRWS

SEQ ID NO: 156057 - protein, 9 aa, Homo Sapiens
PANAPPLTP

SEQ ID NO: 156058 - protein, 9 aa, Homo Sapiens
RPCHSLPRT

SEQ ID NO: 156059 - protein, 9 aa, Homo Sapiens
DQFLRALSN

SEQ ID NO: 156060 - protein, 9 aa, Homo Sapiens
GGPEAPSTR

SEQ ID NO: 156061 - protein, 9 aa, Homo Sapiens
PPLPPPAAR

SEQ ID NO: 156062 - protein, 9 aa, Homo Sapiens
GFRNSGIMV

SEQ ID NO: 156063 - protein, 9 aa, Homo Sapiens
EHVFVYAIT

SEQ ID NO: 156064 - protein, 9 aa, Homo Sapiens
GWHGSLYPL

SEQ ID NO: 156065 - protein, 9 aa, Homo Sapiens
DTDIGMTKA

SEQ ID NO: 156066 - protein, 9 aa, Homo Sapiens
RVVERRRWP

SEQ ID NO: 156067 - protein, 9 aa, Homo Sapiens
TSLFIKPNP

SEQ ID NO: 156068 - protein, 9 aa, Homo Sapiens
AWRKQHQVD

SEQ ID NO: 156069 - protein, 9 aa, Homo Sapiens
QQEFENKLE

SEQ ID NO: 156070 - protein, 9 aa, Homo Sapiens
RQHCFSSKV

SEQ ID NO: 156071 - protein, 9 aa, Homo Sapiens
LLYKLKLEQ

SEQ ID NO: 156072 - protein, 9 aa, Homo Sapiens
GRGPAATSS

SEQ ID NO: 156073 - protein, 9 aa, Homo Sapiens
ESPPAQAVM

SEQ ID NO: 156074 - protein, 9 aa, Homo Sapiens
CCGRRLPTA

SEQ ID NO: 156075 - protein, 9 aa, Homo Sapiens
DVGLGVQVL

SEQ ID NO: 156076 - protein, 9 aa, Homo Sapiens
AVHDLMRSI

SEQ ID NO: 156077 - protein, 9 aa, Homo Sapiens
AGASGWSAS

SEQ ID NO: 156078 - protein, 9 aa, Homo Sapiens
LFWVASKTH

SEQ ID NO: 156079 - protein, 9 aa, Homo Sapiens
DQETLRVEN

SEQ ID NO: 156080 - protein, 9 aa, Homo Sapiens
CCLCCCCYG

SEQ ID NO: 156081 - protein, 9 aa, Homo Sapiens
AYIRNAGLS

SEQ ID NO: 156082 - protein, 9 aa, Homo Sapiens
QGPEEGRCG

SEQ ID NO: 156083 - protein, 9 aa, Homo Sapiens
QAQEDAHHR

SEQ ID NO: 156084 - protein, 9 aa, Homo Sapiens
AWWLQVPGE

SEQ ID NO: 156085 - protein, 9 aa, Homo Sapiens
QWHWPKMLV

SEQ ID NO: 156086 - protein, 9 aa, Homo Sapiens
DAVHVQGAA

SEQ ID NO: 156087 - protein, 9 aa, Homo Sapiens
GPAASLCVS

SEQ ID NO: 156088 - protein, 9 aa, Homo Sapiens
LKTAMSVET

SEQ ID NO: 156089 - protein, 9 aa, Homo Sapiens
VRDKRRKPL

SEQ ID NO: 156090 - protein, 9 aa, Homo Sapiens
PLFIWTPWR

SEQ ID NO: 156091 - protein, 9 aa, Homo Sapiens
SAGSRGPAV

SEQ ID NO: 156092 - protein, 9 aa, Homo Sapiens
SKRRTAGHV

SEQ ID NO: 156093 - protein, 9 aa, Homo Sapiens
MWRTSCRGR

SEQ ID NO: 156094 - protein, 9 aa, Homo Sapiens
LAPPPPAVS

SEQ ID NO: 156095 - protein, 9 aa, Homo Sapiens
AHRGAGPPG

SEQ ID NO: 156096 - protein, 9 aa, Homo Sapiens
GFGCGRGRG

SEQ ID NO: 156097 - protein, 9 aa, Homo Sapiens
SFRLPVSVW

SEQ ID NO: 156098 - protein, 9 aa, Homo Sapiens
QALMAQLTA

SEQ ID NO: 156099 - protein, 9 aa, Homo Sapiens
IKSPHEGYE

SEQ ID NO: 156100 - protein, 9 aa, Homo Sapiens
ANPQEKWLR

SEQ ID NO: 156101 - protein, 9 aa, Homo Sapiens
PDSAGSRGP

SEQ ID NO: 156102 - protein, 9 aa, Homo Sapiens
PRCRPRGPP

SEQ ID NO: 156103 - protein, 9 aa, Homo Sapiens
STVSRSCST

SEQ ID NO: 156104 - protein, 9 aa, Homo Sapiens
ILGVTTGLL

SEQ ID NO: 156105 - protein, 9 aa, Homo Sapiens
LPPATMTHP

SEQ ID NO: 156106 - protein, 9 aa, Homo Sapiens
PPQGPAQAP

SEQ ID NO: 156107 - protein, 9 aa, Homo Sapiens
LRQLLLATL

SEQ ID NO: 156108 - protein, 9 aa, Homo Sapiens
LEKMEDFQI

SEQ ID NO: 156109 - protein, 9 aa, Homo Sapiens
TSWSASAAA

SEQ ID NO: 156110 - protein, 9 aa, Homo Sapiens
GGYRDKTRM

SEQ ID NO: 156111 - protein, 9 aa, Homo Sapiens
CIDDVIHHG

SEQ ID NO: 156112 - protein, 9 aa, Homo Sapiens
PKKAPRRPL

SEQ ID NO: 156113 - protein, 9 aa, Homo Sapiens
SPACCPVCT

SEQ ID NO: 156114 - protein, 9 aa, Homo Sapiens
GLLPGWGQW

SEQ ID NO: 156115 - protein, 9 aa, Homo Sapiens
ETPDLKLAI

SEQ ID NO: 156116 - protein, 9 aa, Homo Sapiens
PSLPGPCAS

SEQ ID NO: 156117 - protein, 9 aa, Homo Sapiens
HVDFQLVLP

SEQ ID NO: 156118 - protein, 9 aa, Homo Sapiens
PPGVQQPQS

SEQ ID NO: 156119 - protein, 9 aa, Homo Sapiens
GVNQLGGGV

SEQ ID NO: 156120 - protein, 9 aa, Homo Sapiens
AQHRNINTG

SEQ ID NO: 156121 - protein, 9 aa, Homo Sapiens
FDISHPETV

SEQ ID NO: 156122 - protein, 9 aa, Homo Sapiens
LLIDSFNST

SEQ ID NO: 156123 - protein, 9 aa, Homo Sapiens
ETLKVINKL

SEQ ID NO: 156124 - protein, 9 aa, Homo Sapiens
ELEQREALV

SEQ ID NO: 156125 - protein, 9 aa, Homo Sapiens
LNYRTSNIS

SEQ ID NO: 156126 - protein, 9 aa, Homo Sapiens
PPLLVFFLL

SEQ ID NO: 156127 - protein, 9 aa, Homo Sapiens
TTICRVGTV

SEQ ID NO: 156128 - protein, 9 aa, Homo Sapiens
ALWAHRVPA

SEQ ID NO: 156129 - protein, 9 aa, Homo Sapiens
QVTVPVDGD

SEQ ID NO: 156130 - protein, 9 aa, Homo Sapiens
GLSAPGTDR

SEQ ID NO: 156131 - protein, 9 aa, Homo Sapiens
IHSLVIVES

SEQ ID NO: 156132 - protein, 9 aa, Homo Sapiens
VPQEVISIY

SEQ ID NO: 156133 - protein, 9 aa, Homo Sapiens
SHMKMHTVG

SEQ ID NO: 156134 - protein, 9 aa, Homo Sapiens
RQRASSAQV

SEQ ID NO: 156135 - protein, 9 aa, Homo Sapiens
LAARHGEEV

SEQ ID NO: 156136 - protein, 9 aa, Homo Sapiens
TLEQLRWEK

SEQ ID NO: 156137 - protein, 9 aa, Homo Sapiens
KCFTLSDLC

SEQ ID NO: 156138 - protein, 9 aa, Homo Sapiens
CRRTDPTLL

SEQ ID NO: 156139 - protein, 9 aa, Homo Sapiens
AHAPLHSVG

SEQ ID NO: 156140 - protein, 9 aa, Homo Sapiens
FINQLLEVV

SEQ ID NO: 156141 - protein, 9 aa, Homo Sapiens
HSLVPMYYR

SEQ ID NO: 156142 - protein, 9 aa, Homo Sapiens
VCGDHQPGD

SEQ ID NO: 156143 - protein, 9 aa, Homo Sapiens
DDGEAGLIF

SEQ ID NO: 156144 - protein, 9 aa, Homo Sapiens
ITTPGAAVA

SEQ ID NO: 156145 - protein, 9 aa, Homo Sapiens
LGDTPQPSL

SEQ ID NO: 156146 - protein, 9 aa, Homo Sapiens
HRHLGYELL

SEQ ID NO: 156147 - protein, 9 aa, Homo Sapiens
SAAKVVVPP

SEQ ID NO: 156148 - protein, 9 aa, Homo Sapiens
CSRSLRLLV

SEQ ID NO: 156149 - protein, 9 aa, Homo Sapiens
AADRAWGLF

SEQ ID NO: 156150 - protein, 9 aa, Homo Sapiens
CTVMVLGGA

SEQ ID NO: 156151 - protein, 9 aa, Homo Sapiens
PSSPRWRLP

SEQ ID NO: 156152 - protein, 9 aa, Homo Sapiens
TLERQTLGV

SEQ ID NO: 156153 - protein, 9 aa, Homo Sapiens
GHFHEEATL

SEQ ID NO: 156154 - protein, 9 aa, Homo Sapiens
RRFPLGAHC

SEQ ID NO: 156155 - protein, 9 aa, Homo Sapiens
MKAGVIHAN

SEQ ID NO: 156156 - protein, 9 aa, Homo Sapiens
PGIFRGDKW

SEQ ID NO: 156157 - protein, 9 aa, Homo Sapiens
LPDQPPPRS

SEQ ID NO: 156158 - protein, 9 aa, Homo Sapiens
RDDDVSSTS

SEQ ID NO: 156159 - protein, 9 aa, Homo Sapiens
FLDQRFQDT

SEQ ID NO: 156160 - protein, 9 aa, Homo Sapiens
ETDDGSKDE

SEQ ID NO: 156161 - protein, 9 aa, Homo Sapiens
RSTILGPQD

SEQ ID NO: 156162 - protein, 9 aa, Homo Sapiens
PAVRTRSTS

SEQ ID NO: 156163 - protein, 9 aa, Homo Sapiens
SLSILSPAL

SEQ ID NO: 156164 - protein, 9 aa, Homo Sapiens
SNFLTTKSE

SEQ ID NO: 156165 - protein, 9 aa, Homo Sapiens
DNSNFTCIV

SEQ ID NO: 156166 - protein, 9 aa, Homo Sapiens
SYANLLTGC

SEQ ID NO: 156167 - protein, 9 aa, Homo Sapiens
RQKMFLEEL

SEQ ID NO: 156168 - protein, 9 aa, Homo Sapiens
RHQPVVVLN

SEQ ID NO: 156169 - protein, 9 aa, Homo Sapiens
ALAACDKEL

SEQ ID NO: 156170 - protein, 9 aa, Homo Sapiens
YTSDTTGLP

SEQ ID NO: 156171 - protein, 9 aa, Homo Sapiens
NEIFFLTFY

SEQ ID NO: 156172 - protein, 9 aa, Homo Sapiens
HPSEEQGGR

SEQ ID NO: 156173 - protein, 9 aa, Homo Sapiens
VLPWTELSA

SEQ ID NO: 156174 - protein, 9 aa, Homo Sapiens
NSGLDNSAK

SEQ ID NO: 156175 - protein, 9 aa, Homo Sapiens
PGSKIFKTF

SEQ ID NO: 156176 - protein, 9 aa, Homo Sapiens
ISLQQDEDI

SEQ ID NO: 156177 - protein, 9 aa, Homo Sapiens
SGGSGWSGR

SEQ ID NO: 156178 - protein, 9 aa, Homo Sapiens
YSTLQISQK

SEQ ID NO: 156179 - protein, 9 aa, Homo Sapiens
ALAGVLLLV

SEQ ID NO: 156180 - protein, 9 aa, Homo Sapiens
SQALQLLIL

SEQ ID NO: 156181 - protein, 9 aa, Homo Sapiens
AQSPVPLRI

SEQ ID NO: 156182 - protein, 9 aa, Homo Sapiens
ASSPPGPAA

SEQ ID NO: 156183 - protein, 9 aa, Homo Sapiens
VWTAATLRC

SEQ ID NO: 156184 - protein, 9 aa, Homo Sapiens
PARCARSSD

SEQ ID NO: 156185 - protein, 9 aa, Homo Sapiens
GAGPPGCAA

SEQ ID NO: 156186 - protein, 9 aa, Homo Sapiens
LKLKYLINP

SEQ ID NO: 156187 - protein, 9 aa, Homo Sapiens
CGGGIQSWA

SEQ ID NO: 156188 - protein, 9 aa, Homo Sapiens
SLPAPGLHP

SEQ ID NO: 156189 - protein, 9 aa, Homo Sapiens
CCGHGHNTQ

SEQ ID NO: 156190 - protein, 9 aa, Homo Sapiens
PTGPLLCLG

SEQ ID NO: 156191 - protein, 9 aa, Homo Sapiens
TSLSADIIQ

SEQ ID NO: 156192 - protein, 9 aa, Homo Sapiens
GHTMPTSAA

SEQ ID NO: 156193 - protein, 9 aa, Homo Sapiens
HSRVPSPRS

SEQ ID NO: 156194 - protein, 9 aa, Homo Sapiens
EINKKSHPQ

SEQ ID NO: 156195 - protein, 9 aa, Homo Sapiens
SPFLQKLQG

SEQ ID NO: 156196 - protein, 9 aa, Homo Sapiens
RLWSSSGAG

SEQ ID NO: 156197 - protein, 9 aa, Homo Sapiens
EDAHHRNTD

SEQ ID NO: 156198 - protein, 9 aa, Homo Sapiens
LRLQSLLSL

SEQ ID NO: 156199 - protein, 9 aa, Homo Sapiens
CPVHRPPWH

SEQ ID NO: 156200 - protein, 9 aa, Homo Sapiens
RRCAIVGNS

SEQ ID NO: 156201 - protein, 9 aa, Homo Sapiens
RRRMERSAN

SEQ ID NO: 156202 - protein, 9 aa, Homo Sapiens
QNRFTRNLP

SEQ ID NO: 156203 - protein, 9 aa, Homo Sapiens
EGPALREKK

SEQ ID NO: 156204 - protein, 9 aa, Homo Sapiens
VRAVGQLQA

SEQ ID NO: 156205 - protein, 9 aa, Homo Sapiens
SSETSSSSC

SEQ ID NO: 156206 - protein, 9 aa, Homo Sapiens
PLPFQNTGA

SEQ ID NO: 156207 - protein, 9 aa, Homo Sapiens
TSAYRNKLA

SEQ ID NO: 156208 - protein, 9 aa, Homo Sapiens
TMKEDQVMQ

SEQ ID NO: 156209 - protein, 9 aa, Homo Sapiens
RPSTTRRDS

SEQ ID NO: 156210 - protein, 9 aa, Homo Sapiens
AGQTALMLT

SEQ ID NO: 156211 - protein, 9 aa, Homo Sapiens
APPPAAAAL

SEQ ID NO: 156212 - protein, 9 aa, Homo Sapiens
GSPVLAMCR

SEQ ID NO: 156213 - protein, 9 aa, Homo Sapiens
LSQAGRQQP

SEQ ID NO: 156214 - protein, 9 aa, Homo Sapiens
VVVDMDLTP

SEQ ID NO: 156215 - protein, 9 aa, Homo Sapiens
IAYLSIFDQ

SEQ ID NO: 156216 - protein, 9 aa, Homo Sapiens
RHAPPPRMA

SEQ ID NO: 156217 - protein, 9 aa, Homo Sapiens
LMSQRTQRP

SEQ ID NO: 156218 - protein, 9 aa, Homo Sapiens
GRHPVRVPD

SEQ ID NO: 156219 - protein, 9 aa, Homo Sapiens
PAYRSVSEP

SEQ ID NO: 156220 - protein, 9 aa, Homo Sapiens
SRHSDLPPP

SEQ ID NO: 156221 - protein, 9 aa, Homo Sapiens
ERYHSLVPM

SEQ ID NO: 156222 - protein, 9 aa, Homo Sapiens
TIYIVGGVS

SEQ ID NO: 156223 - protein, 9 aa, Homo Sapiens
SCSLMAPWS

SEQ ID NO: 156224 - protein, 9 aa, Homo Sapiens
VRAKDIYGH

SEQ ID NO: 156225 - protein, 9 aa, Homo Sapiens
SHTAAVRLM

SEQ ID NO: 156226 - protein, 9 aa, Homo Sapiens
RNRFKWGPT

SEQ ID NO: 156227 - protein, 9 aa, Homo Sapiens
LAAGAFPPL

SEQ ID NO: 156228 - protein, 9 aa, Homo Sapiens
SSSLTSLKK

SEQ ID NO: 156229 - protein, 9 aa, Homo Sapiens
PFREVIAGS

SEQ ID NO: 156230 - protein, 9 aa, Homo Sapiens
RCLPDQPPP

SEQ ID NO: 156231 - protein, 9 aa, Homo Sapiens
EERREVWVS

SEQ ID NO: 156232 - protein, 9 aa, Homo Sapiens
PEPPTPPVH

SEQ ID NO: 156233 - protein, 9 aa, Homo Sapiens
YLDWITQAK

SEQ ID NO: 156234 - protein, 9 aa, Homo Sapiens
FLKYSVDEK

SEQ ID NO: 156235 - protein, 9 aa, Homo Sapiens
LVLLAPATP

SEQ ID NO: 156236 - protein, 9 aa, Homo Sapiens
ISHTPILFH

SEQ ID NO: 156237 - protein, 9 aa, Homo Sapiens
TAPATALDV

SEQ ID NO: 156238 - protein, 9 aa, Homo Sapiens
PRAGSRRCC

SEQ ID NO: 156239 - protein, 9 aa, Homo Sapiens
TCLSSSSIL

SEQ ID NO: 156240 - protein, 9 aa, Homo Sapiens
LEQPAAAFM

SEQ ID NO: 156241 - protein, 9 aa, Homo Sapiens
IYTTICRVG

SEQ ID NO: 156242 - protein, 9 aa, Homo Sapiens
RTWLGGPSA

SEQ ID NO: 156243 - protein, 9 aa, Homo Sapiens
PVCSGDATF

SEQ ID NO: 156244 - protein, 9 aa, Homo Sapiens
PTVPSCRRE

SEQ ID NO: 156245 - protein, 9 aa, Homo Sapiens
LHGPPPRRS

SEQ ID NO: 156246 - protein, 9 aa, Homo Sapiens
PWAARPRPA

SEQ ID NO: 156247 - protein, 9 aa, Homo Sapiens
WIRLHFQKA

SEQ ID NO: 156248 - protein, 9 aa, Homo Sapiens
NGVKFCKAQ

SEQ ID NO: 156249 - protein, 9 aa, Homo Sapiens
ARGGTTIGE

SEQ ID NO: 156250 - protein, 9 aa, Homo Sapiens
HILESLERI

SEQ ID NO: 156251 - protein, 9 aa, Homo Sapiens
GPSPSPPAR

SEQ ID NO: 156252 - protein, 9 aa, Homo Sapiens
THTGHLWLG

SEQ ID NO: 156253 - protein, 9 aa, Homo Sapiens
RDLGLQLPD

SEQ ID NO: 156254 - protein, 9 aa, Homo Sapiens
CILGQRATR

SEQ ID NO: 156255 - protein, 9 aa, Homo Sapiens
PGHGGPQDA

SEQ ID NO: 156256 - protein, 9 aa, Homo Sapiens
FSMGMTVSK

SEQ ID NO: 156257 - protein, 9 aa, Homo Sapiens
GPCASLLST

SEQ ID NO: 156258 - protein, 9 aa, Homo Sapiens
MISEFGLSK

SEQ ID NO: 156259 - protein, 9 aa, Homo Sapiens
DDRVHEQGY

SEQ ID NO: 156260 - protein, 9 aa, Homo Sapiens
NCESICCGH

SEQ ID NO: 156261 - protein, 9 aa, Homo Sapiens
SSCASTPTA

SEQ ID NO: 156262 - protein, 9 aa, Homo Sapiens
ETLQRTPCS

SEQ ID NO: 156263 - protein, 9 aa, Homo Sapiens
TQAYTQTQT

SEQ ID NO: 156264 - protein, 9 aa, Homo Sapiens
YSCNMMVFL

SEQ ID NO: 156265 - protein, 9 aa, Homo Sapiens
LTIGEKTEI

SEQ ID NO: 156266 - protein, 9 aa, Homo Sapiens
PRAWCCLMS

SEQ ID NO: 156267 - protein, 9 aa, Homo Sapiens
VHELGVAVD

SEQ ID NO: 156268 - protein, 9 aa, Homo Sapiens
SSDANERKS

SEQ ID NO: 156269 - protein, 9 aa, Homo Sapiens
EEQLSPQSR

SEQ ID NO: 156270 - protein, 9 aa, Homo Sapiens
AQTSLTPPS

SEQ ID NO: 156271 - protein, 9 aa, Homo Sapiens
TWAVPQVLQ

SEQ ID NO: 156272 - protein, 9 aa, Homo Sapiens
MCDSLHSQT

SEQ ID NO: 156273 - protein, 9 aa, Homo Sapiens
PVRNSPCSM

SEQ ID NO: 156274 - protein, 9 aa, Homo Sapiens
EKRLLYKLK

SEQ ID NO: 156275 - protein, 9 aa, Homo Sapiens
EERLKHTML

SEQ ID NO: 156276 - protein, 9 aa, Homo Sapiens
CPLEVNECI

SEQ ID NO: 156277 - protein, 9 aa, Homo Sapiens
TWWMCDCFM

SEQ ID NO: 156278 - protein, 9 aa, Homo Sapiens
ITFIFLCSL

SEQ ID NO: 156279 - protein, 9 aa, Homo Sapiens
VGPKSWAPA

SEQ ID NO: 156280 - protein, 9 aa, Homo Sapiens
THTDTHTGI

SEQ ID NO: 156281 - protein, 9 aa, Homo Sapiens
ASCTASTCC

SEQ ID NO: 156282 - protein, 9 aa, Homo Sapiens
KVDVIDLII

SEQ ID NO: 156283 - protein, 9 aa, Homo Sapiens
ISSCDYAID

SEQ ID NO: 156284 - protein, 9 aa, Homo Sapiens
EAPIGRAQT

SEQ ID NO: 156285 - protein, 9 aa, Homo Sapiens
KIGARICAL

SEQ ID NO: 156286 - protein, 9 aa, Homo Sapiens
GAGAVPRSG

SEQ ID NO: 156287 - protein, 9 aa, Homo Sapiens
LSSRIGGGG

SEQ ID NO: 156288 - protein, 9 aa, Homo Sapiens
TDIGMTKAD

SEQ ID NO: 156289 - protein, 9 aa, Homo Sapiens
SCNMMVFLA

SEQ ID NO: 156290 - protein, 9 aa, Homo Sapiens
LREAEQELE

SEQ ID NO: 156291 - protein, 9 aa, Homo Sapiens
AAFFSFSWL

SEQ ID NO: 156292 - protein, 9 aa, Homo Sapiens
PTSGLGRTQ

SEQ ID NO: 156293 - protein, 9 aa, Homo Sapiens
GLEQFLTWI

SEQ ID NO: 156294 - protein, 9 aa, Homo Sapiens
HDKDGWPLC

SEQ ID NO: 156295 - protein, 9 aa, Homo Sapiens
PLFKLHNRN

SEQ ID NO: 156296 - protein, 9 aa, Homo Sapiens
RPSTCACLL

SEQ ID NO: 156297 - protein, 9 aa, Homo Sapiens
CAWEPARGA

SEQ ID NO: 156298 - protein, 9 aa, Homo Sapiens
GPADGLIQE

SEQ ID NO: 156299 - protein, 9 aa, Homo Sapiens
LRHPLHPPH

SEQ ID NO: 156300 - protein, 9 aa, Homo Sapiens
ICRLKELIL

SEQ ID NO: 156301 - protein, 9 aa, Homo Sapiens
HLGYELLTA

SEQ ID NO: 156302 - protein, 9 aa, Homo Sapiens
LSPRRAQKT

SEQ ID NO: 156303 - protein, 9 aa, Homo Sapiens
TCIAAGGLR

SEQ ID NO: 156304 - protein, 9 aa, Homo Sapiens
PLLLLPPMG

SEQ ID NO: 156305 - protein, 9 aa, Homo Sapiens
KFRCSSSEV

SEQ ID NO: 156306 - protein, 9 aa, Homo Sapiens
CIAATEMDM

SEQ ID NO: 156307 - protein, 9 aa, Homo Sapiens
PLVMGYTTY

SEQ ID NO: 156308 - protein, 9 aa, Homo Sapiens
KGNLIGCEL

SEQ ID NO: 156309 - protein, 9 aa, Homo Sapiens
LVQILTAFS

SEQ ID NO: 156310 - protein, 9 aa, Homo Sapiens
QPGPPCRPP

SEQ ID NO: 156311 - protein, 9 aa, Homo Sapiens
CLDIPGLPG

SEQ ID NO: 156312 - protein, 9 aa, Homo Sapiens
RHTHPSSMP

SEQ ID NO: 156313 - protein, 9 aa, Homo Sapiens
SFVPTQYNL

SEQ ID NO: 156314 - protein, 9 aa, Homo Sapiens
LMKNGEAAR

SEQ ID NO: 156315 - protein, 9 aa, Homo Sapiens
PLGPWNGTT

SEQ ID NO: 156316 - protein, 9 aa, Homo Sapiens
AHNKLSVVP

SEQ ID NO: 156317 - protein, 9 aa, Homo Sapiens
DTTHPTCIL

SEQ ID NO: 156318 - protein, 9 aa, Homo Sapiens
TEKRLLYKL

SEQ ID NO: 156319 - protein, 9 aa, Homo Sapiens
LPHFSSLSP

SEQ ID NO: 156320 - protein, 9 aa, Homo Sapiens
RSCFHLGHH

SEQ ID NO: 156321 - protein, 9 aa, Homo Sapiens
HTPRSPWAW

SEQ ID NO: 156322 - protein, 9 aa, Homo Sapiens
PGQETLPEE

SEQ ID NO: 156323 - protein, 9 aa, Homo Sapiens
QEEGNGMKD

SEQ ID NO: 156324 - protein, 9 aa, Homo Sapiens
YPSEKSNKK

SEQ ID NO: 156325 - protein, 9 aa, Homo Sapiens
HTHPSSMPA

SEQ ID NO: 156326 - protein, 9 aa, Homo Sapiens
ALLAVLSRP

SEQ ID NO: 156327 - protein, 9 aa, Homo Sapiens
SCLVHGFLL

SEQ ID NO: 156328 - protein, 9 aa, Homo Sapiens
WADRTDHSD

SEQ ID NO: 156329 - protein, 9 aa, Homo Sapiens
TQAFCSMKC

SEQ ID NO: 156330 - protein, 9 aa, Homo Sapiens
SQQDINGLE

SEQ ID NO: 156331 - protein, 9 aa, Homo Sapiens
MPAAMRWAR

SEQ ID NO: 156332 - protein, 9 aa, Homo Sapiens
PAGMGSSPC

SEQ ID NO: 156333 - protein, 9 aa, Homo Sapiens
NLSYDKIFS

SEQ ID NO: 156334 - protein, 9 aa, Homo Sapiens
CRSTDFTSR

SEQ ID NO: 156335 - protein, 9 aa, Homo Sapiens
RLTEPDIYQ

SEQ ID NO: 156336 - protein, 9 aa, Homo Sapiens
MERSANAAA

SEQ ID NO: 156337 - protein, 9 aa, Homo Sapiens
GRRWGAWHP

SEQ ID NO: 156338 - protein, 9 aa, Homo Sapiens
PLSAPPTRI

SEQ ID NO: 156339 - protein, 9 aa, Homo Sapiens
AGAARARTC

SEQ ID NO: 156340 - protein, 9 aa, Homo Sapiens
LHRRAAHSR

SEQ ID NO: 156341 - protein, 9 aa, Homo Sapiens
AQPNPRPWP

SEQ ID NO: 156342 - protein, 9 aa, Homo Sapiens
APSYMRKET

SEQ ID NO: 156343 - protein, 9 aa, Homo Sapiens
RLRRGPSPS

SEQ ID NO: 156344 - protein, 9 aa, Homo Sapiens
GRAPQGPWQ

SEQ ID NO: 156345 - protein, 9 aa, Homo Sapiens
AIGVAVDIL

SEQ ID NO: 156346 - protein, 9 aa, Homo Sapiens
AKCKHRHLR

SEQ ID NO: 156347 - protein, 9 aa, Homo Sapiens
AATTAAGAS

SEQ ID NO: 156348 - protein, 9 aa, Homo Sapiens
PLGLVPPPK

SEQ ID NO: 156349 - protein, 9 aa, Homo Sapiens
KQHIHIGEM

SEQ ID NO: 156350 - protein, 9 aa, Homo Sapiens
SEKLDYIAY

SEQ ID NO: 156351 - protein, 9 aa, Homo Sapiens
TLRCPAVPA

SEQ ID NO: 156352 - protein, 9 aa, Homo Sapiens
TVFPASTTT

SEQ ID NO: 156353 - protein, 9 aa, Homo Sapiens
RLSTVDAYN

SEQ ID NO: 156354 - protein, 9 aa, Homo Sapiens
SYWYSVTTS

SEQ ID NO: 156355 - protein, 9 aa, Homo Sapiens
EDCGRGPPA

SEQ ID NO: 156356 - protein, 9 aa, Homo Sapiens
PGQIRRHLL

SEQ ID NO: 156357 - protein, 9 aa, Homo Sapiens
LWDSHICGV

SEQ ID NO: 156358 - protein, 9 aa, Homo Sapiens
IPSPLKITP

SEQ ID NO: 156359 - protein, 9 aa, Homo Sapiens
GATTPPIGP

SEQ ID NO: 156360 - protein, 9 aa, Homo Sapiens
EWNLESLNG

SEQ ID NO: 156361 - protein, 9 aa, Homo Sapiens
QSRVFASCA

SEQ ID NO: 156362 - protein, 9 aa, Homo Sapiens
HPSSDEGIM

SEQ ID NO: 156363 - protein, 9 aa, Homo Sapiens
PNQFRCVSG

SEQ ID NO: 156364 - protein, 9 aa, Homo Sapiens
GGPRWCACC

SEQ ID NO: 156365 - protein, 9 aa, Homo Sapiens
PGVQQPQSE

SEQ ID NO: 156366 - protein, 9 aa, Homo Sapiens
TLVDTDIGM

SEQ ID NO: 156367 - protein, 9 aa, Homo Sapiens
TPQSPPQSL

SEQ ID NO: 156368 - protein, 9 aa, Homo Sapiens
ITEFVGWRY

SEQ ID NO: 156369 - protein, 9 aa, Homo Sapiens
YLNYECCPG

SEQ ID NO: 156370 - protein, 9 aa, Homo Sapiens
LFPPLLVFF

SEQ ID NO: 156371 - protein, 9 aa, Homo Sapiens
KASCKLTIC

SEQ ID NO: 156372 - protein, 9 aa, Homo Sapiens
RHHFYWQML

SEQ ID NO: 156373 - protein, 9 aa, Homo Sapiens
SPLKITPKE

SEQ ID NO: 156374 - protein, 9 aa, Homo Sapiens
LYSVCEQCL

SEQ ID NO: 156375 - protein, 9 aa, Homo Sapiens
PEYQSTSAS

SEQ ID NO: 156376 - protein, 9 aa, Homo Sapiens
SNKWKKFWA

SEQ ID NO: 156377 - protein, 9 aa, Homo Sapiens
CSPLPRPFD

SEQ ID NO: 156378 - protein, 9 aa, Homo Sapiens
DPDGPGRLR

SEQ ID NO: 156379 - protein, 9 aa, Homo Sapiens
TTKNQNQGN

SEQ ID NO: 156380 - protein, 9 aa, Homo Sapiens
RPAPTRRGE

SEQ ID NO: 156381 - protein, 9 aa, Homo Sapiens
CLDPSEATP

SEQ ID NO: 156382 - protein, 9 aa, Homo Sapiens
KEQRCGAKT

SEQ ID NO: 156383 - protein, 9 aa, Homo Sapiens
CHLITQDGQ

SEQ ID NO: 156384 - protein, 9 aa, Homo Sapiens
VKCRRHQPV

SEQ ID NO: 156385 - protein, 9 aa, Homo Sapiens
KACIEALGG

SEQ ID NO: 156386 - protein, 9 aa, Homo Sapiens
SGEEGRPPD

SEQ ID NO: 156387 - protein, 9 aa, Homo Sapiens
ASAGRRSAP

SEQ ID NO: 156388 - protein, 9 aa, Homo Sapiens
LVSRAVVFL

SEQ ID NO: 156389 - protein, 9 aa, Homo Sapiens
QPSSGREMG

SEQ ID NO: 156390 - protein, 9 aa, Homo Sapiens
AVASSPSAT

SEQ ID NO: 156391 - protein, 9 aa, Homo Sapiens
SSLDTSLCV

SEQ ID NO: 156392 - protein, 9 aa, Homo Sapiens
KDFSPKKCH

SEQ ID NO: 156393 - protein, 9 aa, Homo Sapiens
ARSLYSPAE

SEQ ID NO: 156394 - protein, 9 aa, Homo Sapiens
WRARQVFLR

SEQ ID NO: 156395 - protein, 9 aa, Homo Sapiens
DSEEGDDQE

SEQ ID NO: 156396 - protein, 9 aa, Homo Sapiens
IMNRHLCCI

SEQ ID NO: 156397 - protein, 9 aa, Homo Sapiens
LDVAVQVVR

SEQ ID NO: 156398 - protein, 9 aa, Homo Sapiens
LHSHAFLRS

SEQ ID NO: 156399 - protein, 9 aa, Homo Sapiens
KAEVGRPAQ

SEQ ID NO: 156400 - protein, 9 aa, Homo Sapiens
AETEQNKKR

SEQ ID NO: 156401 - protein, 9 aa, Homo Sapiens
RSSQKETTC

SEQ ID NO: 156402 - protein, 9 aa, Homo Sapiens
QSRRKMQTV

SEQ ID NO: 156403 - protein, 9 aa, Homo Sapiens
EEVIREGWR

SEQ ID NO: 156404 - protein, 9 aa, Homo Sapiens
LLLPATTCK

SEQ ID NO: 156405 - protein, 9 aa, Homo Sapiens
SNGICMHRG

SEQ ID NO: 156406 - protein, 9 aa, Homo Sapiens
SPTKKNSCE

SEQ ID NO: 156407 - protein, 9 aa, Homo Sapiens
MSTMRNQVR

SEQ ID NO: 156408 - protein, 9 aa, Homo Sapiens
HLCMGLKSW

SEQ ID NO: 156409 - protein, 9 aa, Homo Sapiens
AKTYLLGLD

SEQ ID NO: 156410 - protein, 9 aa, Homo Sapiens
TGCWGLGTG

SEQ ID NO: 156411 - protein, 9 aa, Homo Sapiens
TSAKLDHQV

SEQ ID NO: 156412 - protein, 9 aa, Homo Sapiens
EHVADLSRR

SEQ ID NO: 156413 - protein, 9 aa, Homo Sapiens
AAHIPLFCT

SEQ ID NO: 156414 - protein, 9 aa, Homo Sapiens
HVLQSLTPN

SEQ ID NO: 156415 - protein, 9 aa, Homo Sapiens
SGWSGRSAR

SEQ ID NO: 156416 - protein, 9 aa, Homo Sapiens
GKYASIILL

SEQ ID NO: 156417 - protein, 9 aa, Homo Sapiens
AFNNLKNCI

SEQ ID NO: 156418 - protein, 9 aa, Homo Sapiens
GLPGIPGPP

SEQ ID NO: 156419 - protein, 9 aa, Homo Sapiens
FIQDEVLHL

SEQ ID NO: 156420 - protein, 9 aa, Homo Sapiens
WKGLEPQAG

SEQ ID NO: 156421 - protein, 9 aa, Homo Sapiens
FAAQRVPPG

SEQ ID NO: 156422 - protein, 9 aa, Homo Sapiens
MQPEDSGSY

SEQ ID NO: 156423 - protein, 9 aa, Homo Sapiens
LRPPPARAS

SEQ ID NO: 156424 - protein, 9 aa, Homo Sapiens
VIDRGLAFE

SEQ ID NO: 156425 - protein, 9 aa, Homo Sapiens
RRLPTACTI

SEQ ID NO: 156426 - protein, 9 aa, Homo Sapiens
PRLVNAVAT

SEQ ID NO: 156427 - protein, 9 aa, Homo Sapiens
RRLGPTRKE

SEQ ID NO: 156428 - protein, 9 aa, Homo Sapiens
SRIGGGGQW

SEQ ID NO: 156429 - protein, 9 aa, Homo Sapiens
LHWKNVYLK

SEQ ID NO: 156430 - protein, 9 aa, Homo Sapiens
VVPQFLPRS

SEQ ID NO: 156431 - protein, 9 aa, Homo Sapiens
HLVMLHLGR

SEQ ID NO: 156432 - protein, 9 aa, Homo Sapiens
LMPHTFSKS

SEQ ID NO: 156433 - protein, 9 aa, Homo Sapiens
NWERERTNQ

SEQ ID NO: 156434 - protein, 9 aa, Homo Sapiens
HPLPPRPRP

SEQ ID NO: 156435 - protein, 9 aa, Homo Sapiens
NGSFTGNKF

SEQ ID NO: 156436 - protein, 9 aa, Homo Sapiens
CSVTLRLRK

SEQ ID NO: 156437 - protein, 9 aa, Homo Sapiens
GGPRKGSPG

SEQ ID NO: 156438 - protein, 9 aa, Homo Sapiens
GQPMAAFAA

SEQ ID NO: 156439 - protein, 9 aa, Homo Sapiens
AHHAALKEE

SEQ ID NO: 156440 - protein, 9 aa, Homo Sapiens
NPETTAASE

SEQ ID NO: 156441 - protein, 9 aa, Homo Sapiens
GADPGPWQP

SEQ ID NO: 156442 - protein, 9 aa, Homo Sapiens
LARKASCKL

SEQ ID NO: 156443 - protein, 9 aa, Homo Sapiens
QQGRARAGI

SEQ ID NO: 156444 - protein, 9 aa, Homo Sapiens
SKGMDDHLF

SEQ ID NO: 156445 - protein, 9 aa, Homo Sapiens
HSPPPSEHL

SEQ ID NO: 156446 - protein, 9 aa, Homo Sapiens
LQQDEDILD

SEQ ID NO: 156447 - protein, 9 aa, Homo Sapiens
RWSAETLHK

SEQ ID NO: 156448 - protein, 9 aa, Homo Sapiens
SGPREPHPM

SEQ ID NO: 156449 - protein, 9 aa, Homo Sapiens
QCAGAWGLL

SEQ ID NO: 156450 - protein, 9 aa, Homo Sapiens
EITASAPGA

SEQ ID NO: 156451 - protein, 9 aa, Homo Sapiens
FFGQNGLPS

SEQ ID NO: 156452 - protein, 9 aa, Homo Sapiens
ATALEQASE

SEQ ID NO: 156453 - protein, 9 aa, Homo Sapiens
AWLQKFRCS

SEQ ID NO: 156454 - protein, 9 aa, Homo Sapiens
GQIRRHLLR

SEQ ID NO: 156455 - protein, 9 aa, Homo Sapiens
GPTSCLPLS

SEQ ID NO: 156456 - protein, 9 aa, Homo Sapiens
SPNVVAFTR

SEQ ID NO: 156457 - protein, 9 aa, Homo Sapiens
GLATEKSRW

SEQ ID NO: 156458 - protein, 9 aa, Homo Sapiens
RLTGFPPAV

SEQ ID NO: 156459 - protein, 9 aa, Homo Sapiens
EPPVPALQY

SEQ ID NO: 156460 - protein, 9 aa, Homo Sapiens
LLTLRPALA

SEQ ID NO: 156461 - protein, 9 aa, Homo Sapiens
SLEIPLKGW

SEQ ID NO: 156462 - protein, 9 aa, Homo Sapiens
WPLCMLRLG

SEQ ID NO: 156463 - protein, 9 aa, Homo Sapiens
VKKKRRLIS

SEQ ID NO: 156464 - protein, 9 aa, Homo Sapiens
KVVRSAPGQ

SEQ ID NO: 156465 - protein, 9 aa, Homo Sapiens
TNGLVRALG

SEQ ID NO: 156466 - protein, 9 aa, Homo Sapiens
SMWRTSCRG

SEQ ID NO: 156467 - protein, 9 aa, Homo Sapiens
HTSNSGGGR

SEQ ID NO: 156468 - protein, 9 aa, Homo Sapiens
DLNVHSLLT

SEQ ID NO: 156469 - protein, 9 aa, Homo Sapiens
VLTSLSEEE

SEQ ID NO: 156470 - protein, 9 aa, Homo Sapiens
GLLADTLLN

SEQ ID NO: 156471 - protein, 9 aa, Homo Sapiens
EIWNGMAII

SEQ ID NO: 156472 - protein, 9 aa, Homo Sapiens
VRIMEAILN

SEQ ID NO: 156473 - protein, 9 aa, Homo Sapiens
NSPFGSSCL

SEQ ID NO: 156474 - protein, 9 aa, Homo Sapiens
GIMSRKACA

SEQ ID NO: 156475 - protein, 9 aa, Homo Sapiens
VMEYTSGGE

SEQ ID NO: 156476 - protein, 9 aa, Homo Sapiens
CRPRVTPGP

SEQ ID NO: 156477 - protein, 9 aa, Homo Sapiens
MALFFGQNG

SEQ ID NO: 156478 - protein, 9 aa, Homo Sapiens
DSGAPPCRP

SEQ ID NO: 156479 - protein, 9 aa, Homo Sapiens
HTGDPHCRH

SEQ ID NO: 156480 - protein, 9 aa, Homo Sapiens
IKRAYRRQV

SEQ ID NO: 156481 - protein, 9 aa, Homo Sapiens
SVPARTRGA

SEQ ID NO: 156482 - protein, 9 aa, Homo Sapiens
LRLGQGPLH

SEQ ID NO: 156483 - protein, 9 aa, Homo Sapiens
ADYFEAMSR

SEQ ID NO: 156484 - protein, 9 aa, Homo Sapiens
AFLCGMHYL

SEQ ID NO: 156485 - protein, 9 aa, Homo Sapiens
SAVTHSTHS

SEQ ID NO: 156486 - protein, 9 aa, Homo Sapiens
SASSTLELL

SEQ ID NO: 156487 - protein, 9 aa, Homo Sapiens
GARAARAGD

SEQ ID NO: 156488 - protein, 9 aa, Homo Sapiens
VSSVCWRAL

SEQ ID NO: 156489 - protein, 9 aa, Homo Sapiens
EVLHLIHEC

SEQ ID NO: 156490 - protein, 9 aa, Homo Sapiens
AFPPPAAST

SEQ ID NO: 156491 - protein, 9 aa, Homo Sapiens
AVDAQVGPL

SEQ ID NO: 156492 - protein, 9 aa, Homo Sapiens
SLEWLRLLV

SEQ ID NO: 156493 - protein, 9 aa, Homo Sapiens
PRGPPAAWP

SEQ ID NO: 156494 - protein, 9 aa, Homo Sapiens
SGWSASCGP

SEQ ID NO: 156495 - protein, 9 aa, Homo Sapiens
NCYLDNPET

SEQ ID NO: 156496 - protein, 9 aa, Homo Sapiens
LSCLYSVCE

SEQ ID NO: 156497 - protein, 9 aa, Homo Sapiens
QPQYSIFKL

SEQ ID NO: 156498 - protein, 9 aa, Homo Sapiens
ESTRVDDIH

SEQ ID NO: 156499 - protein, 9 aa, Homo Sapiens
KPTIEVAQV

SEQ ID NO: 156500 - protein, 9 aa, Homo Sapiens
PTQPRPALL

SEQ ID NO: 156501 - protein, 9 aa, Homo Sapiens
SGLEITASA

SEQ ID NO: 156502 - protein, 9 aa, Homo Sapiens
CGMHYLYFA

SEQ ID NO: 156503 - protein, 9 aa, Homo Sapiens
VQPEEEGEK

SEQ ID NO: 156504 - protein, 9 aa, Homo Sapiens
GGNVTKAPD

SEQ ID NO: 156505 - protein, 9 aa, Homo Sapiens
PRRPLTRLR

SEQ ID NO: 156506 - protein, 9 aa, Homo Sapiens
GRGFGCGRG

SEQ ID NO: 156507 - protein, 9 aa, Homo Sapiens
SITTPGAAV

SEQ ID NO: 156508 - protein, 9 aa, Homo Sapiens
QSPPQSLDL

SEQ ID NO: 156509 - protein, 9 aa, Homo Sapiens
TFRKEQCAA

SEQ ID NO: 156510 - protein, 9 aa, Homo Sapiens
INEEELRRC

SEQ ID NO: 156511 - protein, 9 aa, Homo Sapiens
RGKSRPVLK

SEQ ID NO: 156512 - protein, 9 aa, Homo Sapiens
TPCTVLTAP

SEQ ID NO: 156513 - protein, 9 aa, Homo Sapiens
QMALFFGQN

SEQ ID NO: 156514 - protein, 9 aa, Homo Sapiens
AVAEAGACE

SEQ ID NO: 156515 - protein, 9 aa, Homo Sapiens
TMPTSAAHH

SEQ ID NO: 156516 - protein, 9 aa, Homo Sapiens
MAVIPFLTT

SEQ ID NO: 156517 - protein, 9 aa, Homo Sapiens
WDPVHRPFA

SEQ ID NO: 156518 - protein, 9 aa, Homo Sapiens
ASWSADRFA

SEQ ID NO: 156519 - protein, 9 aa, Homo Sapiens
TASWHPRPS

SEQ ID NO: 156520 - protein, 9 aa, Homo Sapiens
FQKEDAALI

SEQ ID NO: 156521 - protein, 9 aa, Homo Sapiens
SWTCLADLE

SEQ ID NO: 156522 - protein, 9 aa, Homo Sapiens
APSLALRSG

SEQ ID NO: 156523 - protein, 9 aa, Homo Sapiens
KEAPLWRVT

SEQ ID NO: 156524 - protein, 9 aa, Homo Sapiens
WAARPRPAS

SEQ ID NO: 156525 - protein, 9 aa, Homo Sapiens
EMTEVNINN

SEQ ID NO: 156526 - protein, 9 aa, Homo Sapiens
EKDKFLPTS

SEQ ID NO: 156527 - protein, 9 aa, Homo Sapiens
ELAQRGRDD

SEQ ID NO: 156528 - protein, 9 aa, Homo Sapiens
QHPPPAKHS

SEQ ID NO: 156529 - protein, 9 aa, Homo Sapiens
VSPVRNSPC

SEQ ID NO: 156530 - protein, 9 aa, Homo Sapiens
LRPSKLDFF

SEQ ID NO: 156531 - protein, 9 aa, Homo Sapiens
GMHGFMDLV

SEQ ID NO: 156532 - protein, 9 aa, Homo Sapiens
RCVKPNSRV

SEQ ID NO: 156533 - protein, 9 aa, Homo Sapiens
PKGEKGYPR

SEQ ID NO: 156534 - protein, 9 aa, Homo Sapiens
LDNSAKSGW

SEQ ID NO: 156535 - protein, 9 aa, Homo Sapiens
KKPHSFKST

SEQ ID NO: 156536 - protein, 9 aa, Homo Sapiens
LNPSSAEFF

SEQ ID NO: 156537 - protein, 9 aa, Homo Sapiens
RAPPPASST

SEQ ID NO: 156538 - protein, 9 aa, Homo Sapiens
LLLPPMGSL

SEQ ID NO: 156539 - protein, 9 aa, Homo Sapiens
VEVDTVRVM

SEQ ID NO: 156540 - protein, 9 aa, Homo Sapiens
VQRILYLQA

SEQ ID NO: 156541 - protein, 9 aa, Homo Sapiens
KIPLPLWAL

SEQ ID NO: 156542 - protein, 9 aa, Homo Sapiens
LHKVPGKPE

SEQ ID NO: 156543 - protein, 9 aa, Homo Sapiens
LLQGTFYTR

SEQ ID NO: 156544 - protein, 9 aa, Homo Sapiens
NLSKNLNSR

SEQ ID NO: 156545 - protein, 9 aa, Homo Sapiens
ARSPTWCRT

SEQ ID NO: 156546 - protein, 9 aa, Homo Sapiens
VGQDCYMRI

SEQ ID NO: 156547 - protein, 9 aa, Homo Sapiens
WRYRRTVGI

SEQ ID NO: 156548 - protein, 9 aa, Homo Sapiens
TSIPSPHSD

SEQ ID NO: 156549 - protein, 9 aa, Homo Sapiens
PHAKRELAQ

SEQ ID NO: 156550 - protein, 9 aa, Homo Sapiens
ARPRPASQS

SEQ ID NO: 156551 - protein, 9 aa, Homo Sapiens
IMTERSMPH

SEQ ID NO: 156552 - protein, 9 aa, Homo Sapiens
GLHPGCSLG

SEQ ID NO: 156553 - protein, 9 aa, Homo Sapiens
KRPPINVVI

SEQ ID NO: 156554 - protein, 9 aa, Homo Sapiens
EHKKKLEAQ

SEQ ID NO: 156555 - protein, 9 aa, Homo Sapiens
GGNFRGPHP

SEQ ID NO: 156556 - protein, 9 aa, Homo Sapiens
PVFLLGLWE

SEQ ID NO: 156557 - protein, 9 aa, Homo Sapiens
DLDAHNHNR

SEQ ID NO: 156558 - protein, 9 aa, Homo Sapiens
CSTVSRSCS

SEQ ID NO: 156559 - protein, 9 aa, Homo Sapiens
IKRRSQSIC

SEQ ID NO: 156560 - protein, 9 aa, Homo Sapiens
PTASWHPRP

SEQ ID NO: 156561 - protein, 9 aa, Homo Sapiens
KKCRSKTLL

SEQ ID NO: 156562 - protein, 9 aa, Homo Sapiens
HGSASVNSI

SEQ ID NO: 156563 - protein, 9 aa, Homo Sapiens
ELKLEKKSR

SEQ ID NO: 156564 - protein, 9 aa, Homo Sapiens
KNLRIGNGF

SEQ ID NO: 156565 - protein, 9 aa, Homo Sapiens
LAVLSRPLQ

SEQ ID NO: 156566 - protein, 9 aa, Homo Sapiens
CCAARCPRC

SEQ ID NO: 156567 - protein, 9 aa, Homo Sapiens
QHPREQRGP

SEQ ID NO: 156568 - protein, 9 aa, Homo Sapiens
QTVLPHGHG

SEQ ID NO: 156569 - protein, 9 aa, Homo Sapiens
RWPGGFEAA

SEQ ID NO: 156570 - protein, 9 aa, Homo Sapiens
FQVHPDSRG

SEQ ID NO: 156571 - protein, 9 aa, Homo Sapiens
LGPTRKEVH

SEQ ID NO: 156572 - protein, 9 aa, Homo Sapiens
SEMDHVTPM

SEQ ID NO: 156573 - protein, 9 aa, Homo Sapiens
GNRGAWKAS

SEQ ID NO: 156574 - protein, 9 aa, Homo Sapiens
MVHKSMKDH

SEQ ID NO: 156575 - protein, 9 aa, Homo Sapiens
CGRAFFISH

SEQ ID NO: 156576 - protein, 9 aa, Homo Sapiens
QGDENKSVC

SEQ ID NO: 156577 - protein, 9 aa, Homo Sapiens
GHCRDDVKL

SEQ ID NO: 156578 - protein, 9 aa, Homo Sapiens
HGSLYPLIL

SEQ ID NO: 156579 - protein, 9 aa, Homo Sapiens
SNPHANRQT

SEQ ID NO: 156580 - protein, 9 aa, Homo Sapiens
GSTECFLYI

SEQ ID NO: 156581 - protein, 9 aa, Homo Sapiens
PQVQPPPAQ

SEQ ID NO: 156582 - protein, 9 aa, Homo Sapiens
CERPAPTRR

SEQ ID NO: 156583 - protein, 9 aa, Homo Sapiens
SRGHRGAHR

SEQ ID NO: 156584 - protein, 9 aa, Homo Sapiens
GTGLRGGVR

SEQ ID NO: 156585 - protein, 9 aa, Homo Sapiens
IFCQELQKS

SEQ ID NO: 156586 - protein, 9 aa, Homo Sapiens
WSSCWAAPV

SEQ ID NO: 156587 - protein, 9 aa, Homo Sapiens
LLVFSFFFC

SEQ ID NO: 156588 - protein, 9 aa, Homo Sapiens
FDLGLMTRC

SEQ ID NO: 156589 - protein, 9 aa, Homo Sapiens
IQLYLSMEM

SEQ ID NO: 156590 - protein, 9 aa, Homo Sapiens
PRTFPEGAL

SEQ ID NO: 156591 - protein, 9 aa, Homo Sapiens
RDQGRHPVR

SEQ ID NO: 156592 - protein, 9 aa, Homo Sapiens
CVSGVVLVD

SEQ ID NO: 156593 - protein, 9 aa, Homo Sapiens
GSSNLPVPE

SEQ ID NO: 156594 - protein, 9 aa, Homo Sapiens
ILSQKLGRW

SEQ ID NO: 156595 - protein, 9 aa, Homo Sapiens
HDFTDAIIQ

SEQ ID NO: 156596 - protein, 9 aa, Homo Sapiens
TTCHCQCVG

SEQ ID NO: 156597 - protein, 9 aa, Homo Sapiens
WWSTARSVL

SEQ ID NO: 156598 - protein, 9 aa, Homo Sapiens
YLQALDYDR

SEQ ID NO: 156599 - protein, 9 aa, Homo Sapiens
AELWVVFHK

SEQ ID NO: 156600 - protein, 9 aa, Homo Sapiens
RLLAPFLRP

SEQ ID NO: 156601 - protein, 9 aa, Homo Sapiens
TLRLRLQLQ

SEQ ID NO: 156602 - protein, 9 aa, Homo Sapiens
RQPPHHLVP

SEQ ID NO: 156603 - protein, 9 aa, Homo Sapiens
RLGRLLILR

SEQ ID NO: 156604 - protein, 9 aa, Homo Sapiens
PGPAQASAA

SEQ ID NO: 156605 - protein, 9 aa, Homo Sapiens
CFHLETLQR

SEQ ID NO: 156606 - protein, 9 aa, Homo Sapiens
RPRCRPAVA

SEQ ID NO: 156607 - protein, 9 aa, Homo Sapiens
QAKTYLLGL

SEQ ID NO: 156608 - protein, 9 aa, Homo Sapiens
LQKFRCSSS

SEQ ID NO: 156609 - protein, 9 aa, Homo Sapiens
IALERRRVV

SEQ ID NO: 156610 - protein, 9 aa, Homo Sapiens
PGALLDAEL

SEQ ID NO: 156611 - protein, 9 aa, Homo Sapiens
AEQANTVKA

SEQ ID NO: 156612 - protein, 9 aa, Homo Sapiens
CGGGQTPAS

SEQ ID NO: 156613 - protein, 9 aa, Homo Sapiens
IGDFSKVCV

SEQ ID NO: 156614 - protein, 9 aa, Homo Sapiens
QLALKHQLR

SEQ ID NO: 156615 - protein, 9 aa, Homo Sapiens
HQKIHTGKN

SEQ ID NO: 156616 - protein, 9 aa, Homo Sapiens
RWGAWHPGS

SEQ ID NO: 156617 - protein, 9 aa, Homo Sapiens
DKSDHTKPR

SEQ ID NO: 156618 - protein, 9 aa, Homo Sapiens
TSSPTARAT

SEQ ID NO: 156619 - protein, 9 aa, Homo Sapiens
GWADRTDHS

SEQ ID NO: 156620 - protein, 9 aa, Homo Sapiens
HILQFLCAW

SEQ ID NO: 156621 - protein, 9 aa, Homo Sapiens
TNIVAPPSP

SEQ ID NO: 156622 - protein, 9 aa, Homo Sapiens
HQVDYILAT

SEQ ID NO: 156623 - protein, 9 aa, Homo Sapiens
LPQGCWGCC

SEQ ID NO: 156624 - protein, 9 aa, Homo Sapiens
RKPSAKPPL

SEQ ID NO: 156625 - protein, 9 aa, Homo Sapiens
AAGVRDRSP

SEQ ID NO: 156626 - protein, 9 aa, Homo Sapiens
CFYRPAPYF

SEQ ID NO: 156627 - protein, 9 aa, Homo Sapiens
AAQAVASQG

SEQ ID NO: 156628 - protein, 9 aa, Homo Sapiens
KFWEYKAIE

SEQ ID NO: 156629 - protein, 9 aa, Homo Sapiens
SLSGKTEDV

SEQ ID NO: 156630 - protein, 9 aa, Homo Sapiens
HGCSVLHIV

SEQ ID NO: 156631 - protein, 9 aa, Homo Sapiens
WQGRGGEGA

SEQ ID NO: 156632 - protein, 9 aa, Homo Sapiens
TGIEAVICA

SEQ ID NO: 156633 - protein, 9 aa, Homo Sapiens
QESITVILT

SEQ ID NO: 156634 - protein, 9 aa, Homo Sapiens
LHSQTPPLL

SEQ ID NO: 156635 - protein, 9 aa, Homo Sapiens
MEAILNHPA

SEQ ID NO: 156636 - protein, 9 aa, Homo Sapiens
PGTLLHTPG

SEQ ID NO: 156637 - protein, 9 aa, Homo Sapiens
EKFVFRMAG

SEQ ID NO: 156638 - protein, 9 aa, Homo Sapiens
AMAPDGNGA

SEQ ID NO: 156639 - protein, 9 aa, Homo Sapiens
CVVPGAGAM

SEQ ID NO: 156640 - protein, 9 aa, Homo Sapiens
RRRQAQDIE

SEQ ID NO: 156641 - protein, 9 aa, Homo Sapiens
AVPQVLQNY

SEQ ID NO: 156642 - protein, 9 aa, Homo Sapiens
RVVRLPHGR

SEQ ID NO: 156643 - protein, 9 aa, Homo Sapiens
LLIALPSLQ

SEQ ID NO: 156644 - protein, 9 aa, Homo Sapiens
PSSDEGIMS

SEQ ID NO: 156645 - protein, 9 aa, Homo Sapiens
RPLGLLVAP

SEQ ID NO: 156646 - protein, 9 aa, Homo Sapiens
GAFSSSSSA

SEQ ID NO: 156647 - protein, 9 aa, Homo Sapiens
PHSPPSKNP

SEQ ID NO: 156648 - protein, 9 aa, Homo Sapiens
GPGRLRPEQ

SEQ ID NO: 156649 - protein, 9 aa, Homo Sapiens
IILLHFKIL

SEQ ID NO: 156650 - protein, 9 aa, Homo Sapiens
KAGAQAVAE

SEQ ID NO: 156651 - protein, 9 aa, Homo Sapiens
SVRALARFP

SEQ ID NO: 156652 - protein, 9 aa, Homo Sapiens
LNDHMGQVE

SEQ ID NO: 156653 - protein, 9 aa, Homo Sapiens
GGYGLGLEQ

SEQ ID NO: 156654 - protein, 9 aa, Homo Sapiens
FAEGRRYSH

SEQ ID NO: 156655 - protein, 9 aa, Homo Sapiens
AKLEEIQQQ

SEQ ID NO: 156656 - protein, 9 aa, Homo Sapiens
PGPRANGAT

SEQ ID NO: 156657 - protein, 9 aa, Homo Sapiens
HKGEIPKDE

SEQ ID NO: 156658 - protein, 9 aa, Homo Sapiens
HGAPRSPSG

SEQ ID NO: 156659 - protein, 9 aa, Homo Sapiens
LGPASVAPA

SEQ ID NO: 156660 - protein, 9 aa, Homo Sapiens
RLGQMDTNG

SEQ ID NO: 156661 - protein, 9 aa, Homo Sapiens
MASLKKQYP

SEQ ID NO: 156662 - protein, 9 aa, Homo Sapiens
RNIWYLAGI

SEQ ID NO: 156663 - protein, 9 aa, Homo Sapiens
PVKVIEKNS

SEQ ID NO: 156664 - protein, 9 aa, Homo Sapiens
DPFMHLENL

SEQ ID NO: 156665 - protein, 9 aa, Homo Sapiens
SESSKQHDK

SEQ ID NO: 156666 - protein, 9 aa, Homo Sapiens
AVVVDMDLT

SEQ ID NO: 156667 - protein, 9 aa, Homo Sapiens
MCCAYEVTQ

SEQ ID NO: 156668 - protein, 9 aa, Homo Sapiens
SSFRLDPEY

SEQ ID NO: 156669 - protein, 9 aa, Homo Sapiens
PMRVCPSPS

SEQ ID NO: 156670 - protein, 9 aa, Homo Sapiens
KRNLSNMTI

SEQ ID NO: 156671 - protein, 9 aa, Homo Sapiens
RGKSQGGRI

SEQ ID NO: 156672 - protein, 9 aa, Homo Sapiens
PTIEVAQVL

SEQ ID NO: 156673 - protein, 9 aa, Homo Sapiens
QNISAKQRL

SEQ ID NO: 156674 - protein, 9 aa, Homo Sapiens
KQLWEGRRP

SEQ ID NO: 156675 - protein, 9 aa, Homo Sapiens
VRLMGPWHL

SEQ ID NO: 156676 - protein, 9 aa, Homo Sapiens
AQAFVDDPD

SEQ ID NO: 156677 - protein, 9 aa, Homo Sapiens
ATKTSRIYG

SEQ ID NO: 156678 - protein, 9 aa, Homo Sapiens
PTAGPGEER

SEQ ID NO: 156679 - protein, 9 aa, Homo Sapiens
GPIEAYRTN

SEQ ID NO: 156680 - protein, 9 aa, Homo Sapiens
MCDCFMATC

SEQ ID NO: 156681 - protein, 9 aa, Homo Sapiens
FLLILLIFL

SEQ ID NO: 156682 - protein, 9 aa, Homo Sapiens
LEKIHKRNS

SEQ ID NO: 156683 - protein, 9 aa, Homo Sapiens
TLSFRCSLV

SEQ ID NO: 156684 - protein, 9 aa, Homo Sapiens
ASLAAGTEV

SEQ ID NO: 156685 - protein, 9 aa, Homo Sapiens
PSCNNRHFW

SEQ ID NO: 156686 - protein, 9 aa, Homo Sapiens
PLVQGGQGG

SEQ ID NO: 156687 - protein, 9 aa, Homo Sapiens
PCPSRPLPP

SEQ ID NO: 156688 - protein, 9 aa, Homo Sapiens
ARHKVLAGI

SEQ ID NO: 156689 - protein, 9 aa, Homo Sapiens
AENLEKIHK

SEQ ID NO: 156690 - protein, 9 aa, Homo Sapiens
SCRKATRRA

SEQ ID NO: 156691 - protein, 9 aa, Homo Sapiens
LTEIAPIRP

SEQ ID NO: 156692 - protein, 9 aa, Homo Sapiens
RAPAPAPRP

SEQ ID NO: 156693 - protein, 9 aa, Homo Sapiens
RAEGFPPQP

SEQ ID NO: 156694 - protein, 9 aa, Homo Sapiens
DVNTEFDNV

SEQ ID NO: 156695 - protein, 9 aa, Homo Sapiens
MQDYECRSH

SEQ ID NO: 156696 - protein, 9 aa, Homo Sapiens
RSWWQGRGG

SEQ ID NO: 156697 - protein, 9 aa, Homo Sapiens
FCQELQKSG

SEQ ID NO: 156698 - protein, 9 aa, Homo Sapiens
RGCGTGTSG

SEQ ID NO: 156699 - protein, 9 aa, Homo Sapiens
ERAAKLGVN

SEQ ID NO: 156700 - protein, 9 aa, Homo Sapiens
ACVQKVTSS

SEQ ID NO: 156701 - protein, 9 aa, Homo Sapiens
CPSKKKVQG

SEQ ID NO: 156702 - protein, 9 aa, Homo Sapiens
YECIECGKL

SEQ ID NO: 156703 - protein, 9 aa, Homo Sapiens
HLMVADHEV

SEQ ID NO: 156704 - protein, 9 aa, Homo Sapiens
SAPLWASSP

SEQ ID NO: 156705 - protein, 9 aa, Homo Sapiens
GIVMYAVGM

SEQ ID NO: 156706 - protein, 9 aa, Homo Sapiens
RCPPCPRMA

SEQ ID NO: 156707 - protein, 9 aa, Homo Sapiens
MVFLADEYC

SEQ ID NO: 156708 - protein, 9 aa, Homo Sapiens
NIKKGKKII

SEQ ID NO: 156709 - protein, 9 aa, Homo Sapiens
SHACVQKVT

SEQ ID NO: 156710 - protein, 9 aa, Homo Sapiens
DEEVIRFLT

SEQ ID NO: 156711 - protein, 9 aa, Homo Sapiens
NFLTEMLAY

SEQ ID NO: 156712 - protein, 9 aa, Homo Sapiens
NSGYPTQQP

SEQ ID NO: 156713 - protein, 9 aa, Homo Sapiens
HSLPRTWRA

SEQ ID NO: 156714 - protein, 9 aa, Homo Sapiens
NGKDQTMSE

SEQ ID NO: 156715 - protein, 9 aa, Homo Sapiens
YMKHTYMRL

SEQ ID NO: 156716 - protein, 9 aa, Homo Sapiens
VPLGPWNGT

SEQ ID NO: 156717 - protein, 9 aa, Homo Sapiens
PSAGLCSLP

SEQ ID NO: 156718 - protein, 9 aa, Homo Sapiens
PARPGQQRV

SEQ ID NO: 156719 - protein, 9 aa, Homo Sapiens
IQWPTVHGL

SEQ ID NO: 156720 - protein, 9 aa, Homo Sapiens
LDDVVGGRQ

SEQ ID NO: 156721 - protein, 9 aa, Homo Sapiens
YPVHEGPSP

SEQ ID NO: 156722 - protein, 9 aa, Homo Sapiens
GQLFQSIWN

SEQ ID NO: 156723 - protein, 9 aa, Homo Sapiens
FSKSIRPSL

SEQ ID NO: 156724 - protein, 9 aa, Homo Sapiens
HGGQLRLST

SEQ ID NO: 156725 - protein, 9 aa, Homo Sapiens
GFEFGFVAL

SEQ ID NO: 156726 - protein, 9 aa, Homo Sapiens
QLKTSLSAD

SEQ ID NO: 156727 - protein, 9 aa, Homo Sapiens
PTNVKNVTK

SEQ ID NO: 156728 - protein, 9 aa, Homo Sapiens
GKRAAGQRR

SEQ ID NO: 156729 - protein, 9 aa, Homo Sapiens
GREMGSLSL

SEQ ID NO: 156730 - protein, 9 aa, Homo Sapiens
FQPASSHHG

SEQ ID NO: 156731 - protein, 9 aa, Homo Sapiens
SGSTPGSGP

SEQ ID NO: 156732 - protein, 9 aa, Homo Sapiens
ETGLRQGGT

SEQ ID NO: 156733 - protein, 9 aa, Homo Sapiens
LPDTSCSLM

SEQ ID NO: 156734 - protein, 9 aa, Homo Sapiens
TGDIALAYH

SEQ ID NO: 156735 - protein, 9 aa, Homo Sapiens
AQLPPQTLE

SEQ ID NO: 156736 - protein, 9 aa, Homo Sapiens
SHFTQQWTK

SEQ ID NO: 156737 - protein, 9 aa, Homo Sapiens
PHPPPPVTL

SEQ ID NO: 156738 - protein, 9 aa, Homo Sapiens
DNCGPYGQC

SEQ ID NO: 156739 - protein, 9 aa, Homo Sapiens
RSTCARLWM

SEQ ID NO: 156740 - protein, 9 aa, Homo Sapiens
HNGGPPWGV

SEQ ID NO: 156741 - protein, 9 aa, Homo Sapiens
WSTPAPQKI

SEQ ID NO: 156742 - protein, 9 aa, Homo Sapiens
RPSTGSREK

SEQ ID NO: 156743 - protein, 9 aa, Homo Sapiens
ESTLRRHRV

SEQ ID NO: 156744 - protein, 9 aa, Homo Sapiens
SNNGHSFNV

SEQ ID NO: 156745 - protein, 9 aa, Homo Sapiens
PSSGREMGS

SEQ ID NO: 156746 - protein, 9 aa, Homo Sapiens
VCGYNAACQ

SEQ ID NO: 156747 - protein, 9 aa, Homo Sapiens
RLRPEQDTL

SEQ ID NO: 156748 - protein, 9 aa, Homo Sapiens
APMDEDRLS

SEQ ID NO: 156749 - protein, 9 aa, Homo Sapiens
YDIMGVPPG

SEQ ID NO: 156750 - protein, 9 aa, Homo Sapiens
CKPICCVPI

SEQ ID NO: 156751 - protein, 9 aa, Homo Sapiens
HGHNTQSRV

SEQ ID NO: 156752 - protein, 9 aa, Homo Sapiens
IPQAGARPG

SEQ ID NO: 156753 - protein, 9 aa, Homo Sapiens
RFLSCDKDP

SEQ ID NO: 156754 - protein, 9 aa, Homo Sapiens
QLRLSTVDA

SEQ ID NO: 156755 - protein, 9 aa, Homo Sapiens
LLAGLPHFS

SEQ ID NO: 156756 - protein, 9 aa, Homo Sapiens
MDRPLQVFH

SEQ ID NO: 156757 - protein, 9 aa, Homo Sapiens
WVISGCLGT

SEQ ID NO: 156758 - protein, 9 aa, Homo Sapiens
TAPSPRAGS

SEQ ID NO: 156759 - protein, 9 aa, Homo Sapiens
PMSSPTLSR

SEQ ID NO: 156760 - protein, 9 aa, Homo Sapiens
RPGLGVLGT

SEQ ID NO: 156761 - protein, 9 aa, Homo Sapiens
NSAAKVVVP

SEQ ID NO: 156762 - protein, 9 aa, Homo Sapiens
DEDILDTWF

SEQ ID NO: 156763 - protein, 9 aa, Homo Sapiens
AASRGHRGA

SEQ ID NO: 156764 - protein, 9 aa, Homo Sapiens
VALTDGKDK

SEQ ID NO: 156765 - protein, 9 aa, Homo Sapiens
RLGYSITAE

SEQ ID NO: 156766 - protein, 9 aa, Homo Sapiens
LEKKSRYEW

SEQ ID NO: 156767 - protein, 9 aa, Homo Sapiens
HIAHITPSA

SEQ ID NO: 156768 - protein, 9 aa, Homo Sapiens
DCGRGPPAD

SEQ ID NO: 156769 - protein, 9 aa, Homo Sapiens
QMSGMAALT

SEQ ID NO: 156770 - protein, 9 aa, Homo Sapiens
LIDSFNSTQ

SEQ ID NO: 156771 - protein, 9 aa, Homo Sapiens
EEFDVSEAF

SEQ ID NO: 156772 - protein, 9 aa, Homo Sapiens
WEEASQVGG

SEQ ID NO: 156773 - protein, 9 aa, Homo Sapiens
SLRSHHTPE

SEQ ID NO: 156774 - protein, 9 aa, Homo Sapiens
GPPAPSRPP

SEQ ID NO: 156775 - protein, 9 aa, Homo Sapiens
GLMKGHSAR

SEQ ID NO: 156776 - protein, 9 aa, Homo Sapiens
CRSLTGRTH

SEQ ID NO: 156777 - protein, 9 aa, Homo Sapiens
RKEQCAAYN

SEQ ID NO: 156778 - protein, 9 aa, Homo Sapiens
NHPSQQSTL

SEQ ID NO: 156779 - protein, 9 aa, Homo Sapiens
EGLKHFGAA

SEQ ID NO: 156780 - protein, 9 aa, Homo Sapiens
TDPTLLRHC

SEQ ID NO: 156781 - protein, 9 aa, Homo Sapiens
GEVWSFLLR

SEQ ID NO: 156782 - protein, 9 aa, Homo Sapiens
NENKQSLKE

SEQ ID NO: 156783 - protein, 9 aa, Homo Sapiens
AQSGTPPQV

SEQ ID NO: 156784 - protein, 9 aa, Homo Sapiens
TSTTSAASS

SEQ ID NO: 156785 - protein, 9 aa, Homo Sapiens
TVAFLPPMH

SEQ ID NO: 156786 - protein, 9 aa, Homo Sapiens
IYLDENYEH

SEQ ID NO: 156787 - protein, 9 aa, Homo Sapiens
MLYKAVSGF

SEQ ID NO: 156788 - protein, 9 aa, Homo Sapiens
LHKIPLPLW

SEQ ID NO: 156789 - protein, 9 aa, Homo Sapiens
DFGLATEKS

SEQ ID NO: 156790 - protein, 9 aa, Homo Sapiens
ADLSRRLCG

SEQ ID NO: 156791 - protein, 9 aa, Homo Sapiens
PSPSPPARC

SEQ ID NO: 156792 - protein, 9 aa, Homo Sapiens
QPSLPGPCA

SEQ ID NO: 156793 - protein, 9 aa, Homo Sapiens
PLPLWALIA

SEQ ID NO: 156794 - protein, 9 aa, Homo Sapiens
VKRLKSVPH

SEQ ID NO: 156795 - protein, 9 aa, Homo Sapiens
RSVHAAMKT

SEQ ID NO: 156796 - protein, 9 aa, Homo Sapiens
RWSCWRPSQ

SEQ ID NO: 156797 - protein, 9 aa, Homo Sapiens
LIPKAPKKT

SEQ ID NO: 156798 - protein, 9 aa, Homo Sapiens
HGPPPRRSW

SEQ ID NO: 156799 - protein, 9 aa, Homo Sapiens
GHVATMIAI

SEQ ID NO: 156800 - protein, 9 aa, Homo Sapiens
VKWGRNTSL

SEQ ID NO: 156801 - protein, 9 aa, Homo Sapiens
RARGGTTIG

SEQ ID NO: 156802 - protein, 9 aa, Homo Sapiens
SKKRKHRSS

SEQ ID NO: 156803 - protein, 9 aa, Homo Sapiens
TATAACPMT

SEQ ID NO: 156804 - protein, 9 aa, Homo Sapiens
VLGAEIWNG

SEQ ID NO: 156805 - protein, 9 aa, Homo Sapiens
LEINKKSHP

SEQ ID NO: 156806 - protein, 9 aa, Homo Sapiens
GAQLGGGQG

SEQ ID NO: 156807 - protein, 9 aa, Homo Sapiens
DVSTAFEEG

SEQ ID NO: 156808 - protein, 9 aa, Homo Sapiens
QRKCLVQMQ

SEQ ID NO: 156809 - protein, 9 aa, Homo Sapiens
WNDYIPDSI

SEQ ID NO: 156810 - protein, 9 aa, Homo Sapiens
SLFLFPDVF

SEQ ID NO: 156811 - protein, 9 aa, Homo Sapiens
RWCACCVPA

SEQ ID NO: 156812 - protein, 9 aa, Homo Sapiens
FDEAFPQFL

SEQ ID NO: 156813 - protein, 9 aa, Homo Sapiens
GTVRIFASL

SEQ ID NO: 156814 - protein, 9 aa, Homo Sapiens
LKAPTPWDA

SEQ ID NO: 156815 - protein, 9 aa, Homo Sapiens
LSREFGKKQ

SEQ ID NO: 156816 - protein, 9 aa, Homo Sapiens
QAAVILDAN

SEQ ID NO: 156817 - protein, 9 aa, Homo Sapiens
HLWRKRKPS

SEQ ID NO: 156818 - protein, 9 aa, Homo Sapiens
YSVCEQCLQ

SEQ ID NO: 156819 - protein, 9 aa, Homo Sapiens
LKSIFLLFP

SEQ ID NO: 156820 - protein, 9 aa, Homo Sapiens
NIKEMSLQS

SEQ ID NO: 156821 - protein, 9 aa, Homo Sapiens
PPHNNFFFD

SEQ ID NO: 156822 - protein, 9 aa, Homo Sapiens
QITQKISVH

SEQ ID NO: 156823 - protein, 9 aa, Homo Sapiens
VPCPNLLPA

SEQ ID NO: 156824 - protein, 9 aa, Homo Sapiens
HEEIFYVGH

SEQ ID NO: 156825 - protein, 9 aa, Homo Sapiens
FVDDPDIPK

SEQ ID NO: 156826 - protein, 9 aa, Homo Sapiens
TRKRIFFAW

SEQ ID NO: 156827 - protein, 9 aa, Homo Sapiens
GVLGGLPLR

SEQ ID NO: 156828 - protein, 9 aa, Homo Sapiens
ACVQSTGNS

SEQ ID NO: 156829 - protein, 9 aa, Homo Sapiens
CDLPVPQGQ

SEQ ID NO: 156830 - protein, 9 aa, Homo Sapiens
MSRGETPPV

SEQ ID NO: 156831 - protein, 9 aa, Homo Sapiens
RARAWDRNN

SEQ ID NO: 156832 - protein, 9 aa, Homo Sapiens
QDCQAEQDA

SEQ ID NO: 156833 - protein, 9 aa, Homo Sapiens
ILDDQIQWP

SEQ ID NO: 156834 - protein, 9 aa, Homo Sapiens
TKTIPVLCG

SEQ ID NO: 156835 - protein, 9 aa, Homo Sapiens
RAHRVQLLG

SEQ ID NO: 156836 - protein, 9 aa, Homo Sapiens
GGGVCERPA

SEQ ID NO: 156837 - protein, 9 aa, Homo Sapiens
VPRRQLPQW

SEQ ID NO: 156838 - protein, 9 aa, Homo Sapiens
VQVSPGLLA

SEQ ID NO: 156839 - protein, 9 aa, Homo Sapiens
VGQNEERLS

SEQ ID NO: 156840 - protein, 9 aa, Homo Sapiens
PPAPGRAAP

SEQ ID NO: 156841 - protein, 9 aa, Homo Sapiens
SPWAWCARW

SEQ ID NO: 156842 - protein, 9 aa, Homo Sapiens
QVRDKRRKP

SEQ ID NO: 156843 - protein, 9 aa, Homo Sapiens
RTMRLGPTQ

SEQ ID NO: 156844 - protein, 9 aa, Homo Sapiens
FTQQWTKET

SEQ ID NO: 156845 - protein, 9 aa, Homo Sapiens
NDARHGGWT

SEQ ID NO: 156846 - protein, 9 aa, Homo Sapiens
QTTCIAAGG

SEQ ID NO: 156847 - protein, 9 aa, Homo Sapiens
PWTGACPAV

SEQ ID NO: 156848 - protein, 9 aa, Homo Sapiens
YTLTYTGTH

SEQ ID NO: 156849 - protein, 9 aa, Homo Sapiens
LISGWARNG

SEQ ID NO: 156850 - protein, 9 aa, Homo Sapiens
SSRRCTVMV

SEQ ID NO: 156851 - protein, 9 aa, Homo Sapiens
SCGLVAQQP

SEQ ID NO: 156852 - protein, 9 aa, Homo Sapiens
ATVQNRFTR

SEQ ID NO: 156853 - protein, 9 aa, Homo Sapiens
GYELLTAFL

SEQ ID NO: 156854 - protein, 9 aa, Homo Sapiens
LAPRAPAPA

SEQ ID NO: 156855 - protein, 9 aa, Homo Sapiens
SGRTPLPAT

SEQ ID NO: 156856 - protein, 9 aa, Homo Sapiens
IDSFNSTQN

SEQ ID NO: 156857 - protein, 9 aa, Homo Sapiens
APRAPSSPR

SEQ ID NO: 156858 - protein, 9 aa, Homo Sapiens
ADTTRTSCI

SEQ ID NO: 156859 - protein, 9 aa, Homo Sapiens
PPCWRSWWQ

SEQ ID NO: 156860 - protein, 9 aa, Homo Sapiens
IEENKSECY

SEQ ID NO: 156861 - protein, 9 aa, Homo Sapiens
GCVLVLSRP

SEQ ID NO: 156862 - protein, 9 aa, Homo Sapiens
QPEEEGEKK

SEQ ID NO: 156863 - protein, 9 aa, Homo Sapiens
GRSEAPDSP

SEQ ID NO: 156864 - protein, 9 aa, Homo Sapiens
DSPQDSGVV

SEQ ID NO: 156865 - protein, 9 aa, Homo Sapiens
IVNIDTLDT

SEQ ID NO: 156866 - protein, 9 aa, Homo Sapiens
LFLLAVVWA

SEQ ID NO: 156867 - protein, 9 aa, Homo Sapiens
GGGSPRSTQ

SEQ ID NO: 156868 - protein, 9 aa, Homo Sapiens
HSSSSTSSL

SEQ ID NO: 156869 - protein, 9 aa, Homo Sapiens
AFNLASAYK

SEQ ID NO: 156870 - protein, 9 aa, Homo Sapiens
VHEQGYVPD

SEQ ID NO: 156871 - protein, 9 aa, Homo Sapiens
APNPQRVMS

SEQ ID NO: 156872 - protein, 9 aa, Homo Sapiens
EGPMQAALL

SEQ ID NO: 156873 - protein, 9 aa, Homo Sapiens
KPISPVNQG

SEQ ID NO: 156874 - protein, 9 aa, Homo Sapiens
PQSEPLRGQ

SEQ ID NO: 156875 - protein, 9 aa, Homo Sapiens
FVYRDCQSE

SEQ ID NO: 156876 - protein, 9 aa, Homo Sapiens
PAGAWSFQP

SEQ ID NO: 156877 - protein, 9 aa, Homo Sapiens
VEQAGGSCR

SEQ ID NO: 156878 - protein, 9 aa, Homo Sapiens
YIDRLFQIS

SEQ ID NO: 156879 - protein, 9 aa, Homo Sapiens
PAPPLQPRP

SEQ ID NO: 156880 - protein, 9 aa, Homo Sapiens
LALCKRGRR

SEQ ID NO: 156881 - protein, 9 aa, Homo Sapiens
LEHQSSAPP

SEQ ID NO: 156882 - protein, 9 aa, Homo Sapiens
RTLHGGRPL

SEQ ID NO: 156883 - protein, 9 aa, Homo Sapiens
TAAVRLMLK

SEQ ID NO: 156884 - protein, 9 aa, Homo Sapiens
YHQSTLQPS

SEQ ID NO: 156885 - protein, 9 aa, Homo Sapiens
KMFMLHLAL

SEQ ID NO: 156886 - protein, 9 aa, Homo Sapiens
ETTHIHTEP

SEQ ID NO: 156887 - protein, 9 aa, Homo Sapiens
QWHLGAASR

SEQ ID NO: 156888 - protein, 9 aa, Homo Sapiens
VGMLFLLIK

SEQ ID NO: 156889 - protein, 9 aa, Homo Sapiens
ATIPRPFTV

SEQ ID NO: 156890 - protein, 9 aa, Homo Sapiens
NINNSDCIT

SEQ ID NO: 156891 - protein, 9 aa, Homo Sapiens
PHVLSVFEL

SEQ ID NO: 156892 - protein, 9 aa, Homo Sapiens
ILLPALLLP

SEQ ID NO: 156893 - protein, 9 aa, Homo Sapiens
VIPFLTTDL

SEQ ID NO: 156894 - protein, 9 aa, Homo Sapiens
RARRLRGRR

SEQ ID NO: 156895 - protein, 9 aa, Homo Sapiens
TEFSSDDSI

SEQ ID NO: 156896 - protein, 9 aa, Homo Sapiens
VAPPSPSNP

SEQ ID NO: 156897 - protein, 9 aa, Homo Sapiens
MEECLIRQQ

SEQ ID NO: 156898 - protein, 9 aa, Homo Sapiens
PTCILGQRA

SEQ ID NO: 156899 - protein, 9 aa, Homo Sapiens
FIGFRDDVP

SEQ ID NO: 156900 - protein, 9 aa, Homo Sapiens
EWSLCTCTV

SEQ ID NO: 156901 - protein, 9 aa, Homo Sapiens
PPINVVIDR

SEQ ID NO: 156902 - protein, 9 aa, Homo Sapiens
IRPRKALDF

SEQ ID NO: 156903 - protein, 9 aa, Homo Sapiens
SNNNMEKVT

SEQ ID NO: 156904 - protein, 9 aa, Homo Sapiens
GELLVALLN

SEQ ID NO: 156905 - protein, 9 aa, Homo Sapiens
LIDDDNPPC

SEQ ID NO: 156906 - protein, 9 aa, Homo Sapiens
LHRGLKAEA

SEQ ID NO: 156907 - protein, 9 aa, Homo Sapiens
QSPWGEHSS

SEQ ID NO: 156908 - protein, 9 aa, Homo Sapiens
HTEAKKAYP

SEQ ID NO: 156909 - protein, 9 aa, Homo Sapiens
VWRARQVFL

SEQ ID NO: 156910 - protein, 9 aa, Homo Sapiens
FYRKNVREA

SEQ ID NO: 156911 - protein, 9 aa, Homo Sapiens
RNMSAMECF

SEQ ID NO: 156912 - protein, 9 aa, Homo Sapiens
RDLDWEPAV

SEQ ID NO: 156913 - protein, 9 aa, Homo Sapiens
TVIHTDTHA

SEQ ID NO: 156914 - protein, 9 aa, Homo Sapiens
QAKDIDPEN

SEQ ID NO: 156915 - protein, 9 aa, Homo Sapiens
TLKVINKLG

SEQ ID NO: 156916 - protein, 9 aa, Homo Sapiens
IKANRMSNS

SEQ ID NO: 156917 - protein, 9 aa, Homo Sapiens
YCIFYNPQW

SEQ ID NO: 156918 - protein, 9 aa, Homo Sapiens
EMDHVTPMI

SEQ ID NO: 156919 - protein, 9 aa, Homo Sapiens
TEPERISEE

SEQ ID NO: 156920 - protein, 9 aa, Homo Sapiens
VLTHVLLIT

SEQ ID NO: 156921 - protein, 9 aa, Homo Sapiens
TRVQKEGLS

SEQ ID NO: 156922 - protein, 9 aa, Homo Sapiens
PKVQVSPGL

SEQ ID NO: 156923 - protein, 9 aa, Homo Sapiens
LQGRVTEAD

SEQ ID NO: 156924 - protein, 9 aa, Homo Sapiens
HLCVETSSW

SEQ ID NO: 156925 - protein, 9 aa, Homo Sapiens
HKKFILERN

SEQ ID NO: 156926 - protein, 9 aa, Homo Sapiens
KKLISHLMK

SEQ ID NO: 156927 - protein, 9 aa, Homo Sapiens
KEKHSLSPN

SEQ ID NO: 156928 - protein, 9 aa, Homo Sapiens
FATLTSRSG

SEQ ID NO: 156929 - protein, 9 aa, Homo Sapiens
REVQIFVID

SEQ ID NO: 156930 - protein, 9 aa, Homo Sapiens
VLGEVARPP

SEQ ID NO: 156931 - protein, 9 aa, Homo Sapiens
GLRPCLPSP

SEQ ID NO: 156932 - protein, 9 aa, Homo Sapiens
TKKKEGVPS

SEQ ID NO: 156933 - protein, 9 aa, Homo Sapiens
DLEANLRRL

SEQ ID NO: 156934 - protein, 9 aa, Homo Sapiens
QASAAVLNP

SEQ ID NO: 156935 - protein, 9 aa, Homo Sapiens
TTFPTQRPI

SEQ ID NO: 156936 - protein, 9 aa, Homo Sapiens
IFFVGQLEA

SEQ ID NO: 156937 - protein, 9 aa, Homo Sapiens
AESTHTTVF

SEQ ID NO: 156938 - protein, 9 aa, Homo Sapiens
LDQKIVLHP

SEQ ID NO: 156939 - protein, 9 aa, Homo Sapiens
SQGSGDEAE

SEQ ID NO: 156940 - protein, 9 aa, Homo Sapiens
LRRQNMSLE

SEQ ID NO: 156941 - protein, 9 aa, Homo Sapiens
QSTLQPSLQ

SEQ ID NO: 156942 - protein, 9 aa, Homo Sapiens
PSPARSAAA

SEQ ID NO: 156943 - protein, 9 aa, Homo Sapiens
TLHGGRPLG

SEQ ID NO: 156944 - protein, 9 aa, Homo Sapiens
LQHMATMSS

SEQ ID NO: 156945 - protein, 9 aa, Homo Sapiens
SPAPIIVNI

SEQ ID NO: 156946 - protein, 9 aa, Homo Sapiens
VLREKVPCL

SEQ ID NO: 156947 - protein, 9 aa, Homo Sapiens
LGGQAVVDF

SEQ ID NO: 156948 - protein, 9 aa, Homo Sapiens
DSFNLTLKQ

SEQ ID NO: 156949 - protein, 9 aa, Homo Sapiens
TTIIWTLNG

SEQ ID NO: 156950 - protein, 9 aa, Homo Sapiens
LKFRDVAVE

SEQ ID NO: 156951 - protein, 9 aa, Homo Sapiens
AGPRSIRRP

SEQ ID NO: 156952 - protein, 9 aa, Homo Sapiens
RSSRRCTVM

SEQ ID NO: 156953 - protein, 9 aa, Homo Sapiens
APLEALTGQ

SEQ ID NO: 156954 - protein, 9 aa, Homo Sapiens
LKHVRETEK

SEQ ID NO: 156955 - protein, 9 aa, Homo Sapiens
QEAKQNVEK

SEQ ID NO: 156956 - protein, 9 aa, Homo Sapiens
VLQDSSPED

SEQ ID NO: 156957 - protein, 9 aa, Homo Sapiens
QPLTAKKKA

SEQ ID NO: 156958 - protein, 9 aa, Homo Sapiens
QASSGYDWN

SEQ ID NO: 156959 - protein, 9 aa, Homo Sapiens
SRRPSLCWP

SEQ ID NO: 156960 - protein, 9 aa, Homo Sapiens
CCLMSQGKF

SEQ ID NO: 156961 - protein, 9 aa, Homo Sapiens
DGQVSKSNN

SEQ ID NO: 156962 - protein, 9 aa, Homo Sapiens
HRASEMAEP

SEQ ID NO: 156963 - protein, 9 aa, Homo Sapiens
EMKWSGDIL

SEQ ID NO: 156964 - protein, 9 aa, Homo Sapiens
MTDVSTAFE

SEQ ID NO: 156965 - protein, 9 aa, Homo Sapiens
AKGDRGQPG

SEQ ID NO: 156966 - protein, 9 aa, Homo Sapiens
VFRRVENAE

SEQ ID NO: 156967 - protein, 9 aa, Homo Sapiens
KGRLWTPAK

SEQ ID NO: 156968 - protein, 9 aa, Homo Sapiens
WIIEVVKAS

SEQ ID NO: 156969 - protein, 9 aa, Homo Sapiens
ETATTTTQA

SEQ ID NO: 156970 - protein, 9 aa, Homo Sapiens
SDPAVCGDH

SEQ ID NO: 156971 - protein, 9 aa, Homo Sapiens
TIRLNPLRL

SEQ ID NO: 156972 - protein, 9 aa, Homo Sapiens
EEEQKQVES

SEQ ID NO: 156973 - protein, 9 aa, Homo Sapiens
AGAGAGGRR

SEQ ID NO: 156974 - protein, 9 aa, Homo Sapiens
GTHLCRVCG

SEQ ID NO: 156975 - protein, 9 aa, Homo Sapiens
RWFPETCAH

SEQ ID NO: 156976 - protein, 9 aa, Homo Sapiens
CVEKMQDHK

SEQ ID NO: 156977 - protein, 9 aa, Homo Sapiens
QDVKANPKH

SEQ ID NO: 156978 - protein, 9 aa, Homo Sapiens
GGMVEGGVS

SEQ ID NO: 156979 - protein, 9 aa, Homo Sapiens
PCRHRRLRG

SEQ ID NO: 156980 - protein, 9 aa, Homo Sapiens
EKQTMKLEN

SEQ ID NO: 156981 - protein, 9 aa, Homo Sapiens
WGSQGLPPM

SEQ ID NO: 156982 - protein, 9 aa, Homo Sapiens
PTTGLPATS

SEQ ID NO: 156983 - protein, 9 aa, Homo Sapiens
YVPVQVTVP

SEQ ID NO: 156984 - protein, 9 aa, Homo Sapiens
WMAWLRHRL

SEQ ID NO: 156985 - protein, 9 aa, Homo Sapiens
PGSHRLHLL

SEQ ID NO: 156986 - protein, 9 aa, Homo Sapiens
ETTCHCQCV

SEQ ID NO: 156987 - protein, 9 aa, Homo Sapiens
CVSTPSSRP

SEQ ID NO: 156988 - protein, 9 aa, Homo Sapiens
GPWGGRWPG

SEQ ID NO: 156989 - protein, 9 aa, Homo Sapiens
PAALAGVLL

SEQ ID NO: 156990 - protein, 9 aa, Homo Sapiens
AAKPSARSP

SEQ ID NO: 156991 - protein, 9 aa, Homo Sapiens
HGGHAPSPL

SEQ ID NO: 156992 - protein, 9 aa, Homo Sapiens
GPPPRRSWW

SEQ ID NO: 156993 - protein, 9 aa, Homo Sapiens
LCLEEPRKG

SEQ ID NO: 156994 - protein, 9 aa, Homo Sapiens
LFGASSSPP

SEQ ID NO: 156995 - protein, 9 aa, Homo Sapiens
QVTTQIAMA

SEQ ID NO: 156996 - protein, 9 aa, Homo Sapiens
SPREYYMQQ

SEQ ID NO: 156997 - protein, 9 aa, Homo Sapiens
AGITGQFSH

SEQ ID NO: 156998 - protein, 9 aa, Homo Sapiens
ATSATTSSP

SEQ ID NO: 156999 - protein, 9 aa, Homo Sapiens
KHKLESPAL

SEQ ID NO: 157000 - protein, 9 aa, Homo Sapiens
RRRVVRLPH

SEQ ID NO: 157001 - protein, 9 aa, Homo Sapiens
ECVVREALE

SEQ ID NO: 157002 - protein, 9 aa, Homo Sapiens
PDVPPEKLH

SEQ ID NO: 157003 - protein, 9 aa, Homo Sapiens
EEFRQRELC

SEQ ID NO: 157004 - protein, 9 aa, Homo Sapiens
LTLPPPPRL

SEQ ID NO: 157005 - protein, 9 aa, Homo Sapiens
LNVHSLLTS

SEQ ID NO: 157006 - protein, 9 aa, Homo Sapiens
TGGWHHHDK

SEQ ID NO: 157007 - protein, 9 aa, Homo Sapiens
TSSLGIRAQ

SEQ ID NO: 157008 - protein, 9 aa, Homo Sapiens
SCGTYSSCR

SEQ ID NO: 157009 - protein, 9 aa, Homo Sapiens
GIGTELTKV

SEQ ID NO: 157010 - protein, 9 aa, Homo Sapiens
GREPHSPPP

SEQ ID NO: 157011 - protein, 9 aa, Homo Sapiens
TMTHPRTAT

SEQ ID NO: 157012 - protein, 9 aa, Homo Sapiens
CTWRAAARR

SEQ ID NO: 157013 - protein, 9 aa, Homo Sapiens
TAELTGSGR

SEQ ID NO: 157014 - protein, 9 aa, Homo Sapiens
PCLTCLEDG

SEQ ID NO: 157015 - protein, 9 aa, Homo Sapiens
LMFPLLKFS

SEQ ID NO: 157016 - protein, 9 aa, Homo Sapiens
RLKNPLKTV

SEQ ID NO: 157017 - protein, 9 aa, Homo Sapiens
SVMISSPAS

SEQ ID NO: 157018 - protein, 9 aa, Homo Sapiens
AEERMTGHG

SEQ ID NO: 157019 - protein, 9 aa, Homo Sapiens
ASSTLELLR

SEQ ID NO: 157020 - protein, 9 aa, Homo Sapiens
DYHVTFYFA

SEQ ID NO: 157021 - protein, 9 aa, Homo Sapiens
LSPLLLLPP

SEQ ID NO: 157022 - protein, 9 aa, Homo Sapiens
PASPPTQQP

SEQ ID NO: 157023 - protein, 9 aa, Homo Sapiens
PACSPSRLS

SEQ ID NO: 157024 - protein, 9 aa, Homo Sapiens
FRISSCLRV

SEQ ID NO: 157025 - protein, 9 aa, Homo Sapiens
GLAKAYIDP

SEQ ID NO: 157026 - protein, 9 aa, Homo Sapiens
RKGTAGLRK

SEQ ID NO: 157027 - protein, 9 aa, Homo Sapiens
HSPPSKNPP

SEQ ID NO: 157028 - protein, 9 aa, Homo Sapiens
LKCNFDWEA

SEQ ID NO: 157029 - protein, 9 aa, Homo Sapiens
ILEINKKSH

SEQ ID NO: 157030 - protein, 9 aa, Homo Sapiens
QTSNNNMEK

SEQ ID NO: 157031 - protein, 9 aa, Homo Sapiens
QGGLDLDPL

SEQ ID NO: 157032 - protein, 9 aa, Homo Sapiens
ENMLSGDHR

SEQ ID NO: 157033 - protein, 9 aa, Homo Sapiens
YMQQEVIVL

SEQ ID NO: 157034 - protein, 9 aa, Homo Sapiens
DRSPMVFLP

SEQ ID NO: 157035 - protein, 9 aa, Homo Sapiens
RRPLPPSAI

SEQ ID NO: 157036 - protein, 9 aa, Homo Sapiens
ADRPSTCAC

SEQ ID NO: 157037 - protein, 9 aa, Homo Sapiens
VPSPRSWGP

SEQ ID NO: 157038 - protein, 9 aa, Homo Sapiens
ASRALCLAP

SEQ ID NO: 157039 - protein, 9 aa, Homo Sapiens
WRFAGPFSN

SEQ ID NO: 157040 - protein, 9 aa, Homo Sapiens
SGWVTTKTT

SEQ ID NO: 157041 - protein, 9 aa, Homo Sapiens
PEASLRRSP

SEQ ID NO: 157042 - protein, 9 aa, Homo Sapiens
FALIPGGPP

SEQ ID NO: 157043 - protein, 9 aa, Homo Sapiens
CWQPLHPGI

SEQ ID NO: 157044 - protein, 9 aa, Homo Sapiens
GLSIGDEDQ

SEQ ID NO: 157045 - protein, 9 aa, Homo Sapiens
WTSCYGKKI

SEQ ID NO: 157046 - protein, 9 aa, Homo Sapiens
VVRLPHGRP

SEQ ID NO: 157047 - protein, 9 aa, Homo Sapiens
PPMSSPFRM

SEQ ID NO: 157048 - protein, 9 aa, Homo Sapiens
HSFKSTDTL

SEQ ID NO: 157049 - protein, 9 aa, Homo Sapiens
GILYVLRSF

SEQ ID NO: 157050 - protein, 9 aa, Homo Sapiens
KKFQEIINH

SEQ ID NO: 157051 - protein, 9 aa, Homo Sapiens
NLRLITREI

SEQ ID NO: 157052 - protein, 9 aa, Homo Sapiens
QSFIHSLVI

SEQ ID NO: 157053 - protein, 9 aa, Homo Sapiens
SRASRALCL

SEQ ID NO: 157054 - protein, 9 aa, Homo Sapiens
QEDAHHRNT

SEQ ID NO: 157055 - protein, 9 aa, Homo Sapiens
LLRQELWQL

SEQ ID NO: 157056 - protein, 9 aa, Homo Sapiens
DLSGQTARG

SEQ ID NO: 157057 - protein, 9 aa, Homo Sapiens
AFYVGIKSP

SEQ ID NO: 157058 - protein, 9 aa, Homo Sapiens
YVPPTGACC

SEQ ID NO: 157059 - protein, 9 aa, Homo Sapiens
GLPLRLGQG

SEQ ID NO: 157060 - protein, 9 aa, Homo Sapiens
CFVLPWTEL

SEQ ID NO: 157061 - protein, 9 aa, Homo Sapiens
TTHPTCILG

SEQ ID NO: 157062 - protein, 9 aa, Homo Sapiens
MGPWHLCMG

SEQ ID NO: 157063 - protein, 9 aa, Homo Sapiens
LLDTECSLR

SEQ ID NO: 157064 - protein, 9 aa, Homo Sapiens
DHSDPDACT

SEQ ID NO: 157065 - protein, 9 aa, Homo Sapiens
LLSQGAEVL

SEQ ID NO: 157066 - protein, 9 aa, Homo Sapiens
GAADDRVHE

SEQ ID NO: 157067 - protein, 9 aa, Homo Sapiens
SAAVLNPRG

SEQ ID NO: 157068 - protein, 9 aa, Homo Sapiens
TACGAASPP

SEQ ID NO: 157069 - protein, 9 aa, Homo Sapiens
PPECCSSWL

SEQ ID NO: 157070 - protein, 9 aa, Homo Sapiens
NSSTLRLKD

SEQ ID NO: 157071 - protein, 9 aa, Homo Sapiens
LPILDDQIQ

SEQ ID NO: 157072 - protein, 9 aa, Homo Sapiens
LEEQLSPQS

SEQ ID NO: 157073 - protein, 9 aa, Homo Sapiens
SKAGKVKRQ

SEQ ID NO: 157074 - protein, 9 aa, Homo Sapiens
CPAVPAAAC

SEQ ID NO: 157075 - protein, 9 aa, Homo Sapiens
DDRCRLFEC

SEQ ID NO: 157076 - protein, 9 aa, Homo Sapiens
REKKFGLPP

SEQ ID NO: 157077 - protein, 9 aa, Homo Sapiens
DGALLRGLG

SEQ ID NO: 157078 - protein, 9 aa, Homo Sapiens
PRGRTSGRS

SEQ ID NO: 157079 - protein, 9 aa, Homo Sapiens
AEVGRPAQK

SEQ ID NO: 157080 - protein, 9 aa, Homo Sapiens
ELPPEILSG

SEQ ID NO: 157081 - protein, 9 aa, Homo Sapiens
GGSTGGGSS

SEQ ID NO: 157082 - protein, 9 aa, Homo Sapiens
RTEMASLTR

SEQ ID NO: 157083 - protein, 9 aa, Homo Sapiens
GRKGTAGLR

SEQ ID NO: 157084 - protein, 9 aa, Homo Sapiens
YTLASDKES

SEQ ID NO: 157085 - protein, 9 aa, Homo Sapiens
PPNAAVGSQ

SEQ ID NO: 157086 - protein, 9 aa, Homo Sapiens
TVPLPTTQA

SEQ ID NO: 157087 - protein, 9 aa, Homo Sapiens
RHGGWTTKM

SEQ ID NO: 157088 - protein, 9 aa, Homo Sapiens
DFHDSFNLT

SEQ ID NO: 157089 - protein, 9 aa, Homo Sapiens
TVVKLEKTI

SEQ ID NO: 157090 - protein, 9 aa, Homo Sapiens
KSGWVTTKT

SEQ ID NO: 157091 - protein, 9 aa, Homo Sapiens
TSNISHQWI

SEQ ID NO: 157092 - protein, 9 aa, Homo Sapiens
GGGGHGPWA

SEQ ID NO: 157093 - protein, 9 aa, Homo Sapiens
ASAFELASL

SEQ ID NO: 157094 - protein, 9 aa, Homo Sapiens
KVEVMNKRL

SEQ ID NO: 157095 - protein, 9 aa, Homo Sapiens
WSWCGTSQT

SEQ ID NO: 157096 - protein, 9 aa, Homo Sapiens
NTVDITQVT

SEQ ID NO: 157097 - protein, 9 aa, Homo Sapiens
GSLRAPMDE

SEQ ID NO: 157098 - protein, 9 aa, Homo Sapiens
EDELPSVQP

SEQ ID NO: 157099 - protein, 9 aa, Homo Sapiens
LHSPPPEAR

SEQ ID NO: 157100 - protein, 9 aa, Homo Sapiens
DGSQRPPRQ

SEQ ID NO: 157101 - protein, 9 aa, Homo Sapiens
YRHFSKSIR

SEQ ID NO: 157102 - protein, 9 aa, Homo Sapiens
LEQFLTWIL

SEQ ID NO: 157103 - protein, 9 aa, Homo Sapiens
HGLMAADRA

SEQ ID NO: 157104 - protein, 9 aa, Homo Sapiens
FFTGIEAVI

SEQ ID NO: 157105 - protein, 9 aa, Homo Sapiens
RSMPHLQKV

SEQ ID NO: 157106 - protein, 9 aa, Homo Sapiens
PALAPQPRR

SEQ ID NO: 157107 - protein, 9 aa, Homo Sapiens
NMSAMECFR

SEQ ID NO: 157108 - protein, 9 aa, Homo Sapiens
EENKSECYS

SEQ ID NO: 157109 - protein, 9 aa, Homo Sapiens
LPSVQPEEE

SEQ ID NO: 157110 - protein, 9 aa, Homo Sapiens
HSSGLALCG

SEQ ID NO: 157111 - protein, 9 aa, Homo Sapiens
PTQQPPSTL

SEQ ID NO: 157112 - protein, 9 aa, Homo Sapiens
ADTPTSTHK

SEQ ID NO: 157113 - protein, 9 aa, Homo Sapiens
DLLRQELWQ

SEQ ID NO: 157114 - protein, 9 aa, Homo Sapiens
WRDIYKASN

SEQ ID NO: 157115 - protein, 9 aa, Homo Sapiens
LQFLCAWDF

SEQ ID NO: 157116 - protein, 9 aa, Homo Sapiens
VLTQLPRHV

SEQ ID NO: 157117 - protein, 9 aa, Homo Sapiens
GWSGRSARM

SEQ ID NO: 157118 - protein, 9 aa, Homo Sapiens
AMCDSLHSQ

SEQ ID NO: 157119 - protein, 9 aa, Homo Sapiens
RDIYKASNT

SEQ ID NO: 157120 - protein, 9 aa, Homo Sapiens
DVKQQQVTE

SEQ ID NO: 157121 - protein, 9 aa, Homo Sapiens
WLNWSSCWA

SEQ ID NO: 157122 - protein, 9 aa, Homo Sapiens
HSLSPNVVA

SEQ ID NO: 157123 - protein, 9 aa, Homo Sapiens
TREVQIFVI

SEQ ID NO: 157124 - protein, 9 aa, Homo Sapiens
GSLEWLRLL

SEQ ID NO: 157125 - protein, 9 aa, Homo Sapiens
AVGANYDAQ

SEQ ID NO: 157126 - protein, 9 aa, Homo Sapiens
GVPAPAPPL

SEQ ID NO: 157127 - protein, 9 aa, Homo Sapiens
YRSLGYPGV

SEQ ID NO: 157128 - protein, 9 aa, Homo Sapiens
LGPANAPPL

SEQ ID NO: 157129 - protein, 9 aa, Homo Sapiens
AQRRRWASR

SEQ ID NO: 157130 - protein, 9 aa, Homo Sapiens
PVCAVRAVG

SEQ ID NO: 157131 - protein, 9 aa, Homo Sapiens
PRPASQSGQ

SEQ ID NO: 157132 - protein, 9 aa, Homo Sapiens
APHPRPEGL

SEQ ID NO: 157133 - protein, 9 aa, Homo Sapiens
SCRTRRRWS

SEQ ID NO: 157134 - protein, 9 aa, Homo Sapiens
PPLFLPPLQ

SEQ ID NO: 157135 - protein, 9 aa, Homo Sapiens
SPPVPLGPW

SEQ ID NO: 157136 - protein, 9 aa, Homo Sapiens
VGIIIGAVT

SEQ ID NO: 157137 - protein, 9 aa, Homo Sapiens
VNDALNTTE

SEQ ID NO: 157138 - protein, 9 aa, Homo Sapiens
DDYWGGLRG

SEQ ID NO: 157139 - protein, 9 aa, Homo Sapiens
TMQATSATT

SEQ ID NO: 157140 - protein, 9 aa, Homo Sapiens
QWGPPRARE

SEQ ID NO: 157141 - protein, 9 aa, Homo Sapiens
AAHRGAGPP

SEQ ID NO: 157142 - protein, 9 aa, Homo Sapiens
PIPLPLPCS

SEQ ID NO: 157143 - protein, 9 aa, Homo Sapiens
EWRWQLGTA

SEQ ID NO: 157144 - protein, 9 aa, Homo Sapiens
VPQVNMTDV

SEQ ID NO: 157145 - protein, 9 aa, Homo Sapiens
YTASFAYTL

SEQ ID NO: 157146 - protein, 9 aa, Homo Sapiens
DLQPDQAHR

SEQ ID NO: 157147 - protein, 9 aa, Homo Sapiens
EFDVSEAFI

SEQ ID NO: 157148 - protein, 9 aa, Homo Sapiens
SLPGAKAGV

SEQ ID NO: 157149 - protein, 9 aa, Homo Sapiens
VVFLTFLEL

SEQ ID NO: 157150 - protein, 9 aa, Homo Sapiens
FRFGILQSV

SEQ ID NO: 157151 - protein, 9 aa, Homo Sapiens
SDSLEIFAK

SEQ ID NO: 157152 - protein, 9 aa, Homo Sapiens
TNTMGGTRK

SEQ ID NO: 157153 - protein, 9 aa, Homo Sapiens
VASSTTVAS

SEQ ID NO: 157154 - protein, 9 aa, Homo Sapiens
HTKPNIFHK

SEQ ID NO: 157155 - protein, 9 aa, Homo Sapiens
AAAALDEGR

SEQ ID NO: 157156 - protein, 9 aa, Homo Sapiens
QEQDVLERG

SEQ ID NO: 157157 - protein, 9 aa, Homo Sapiens
LQETHKGEI

SEQ ID NO: 157158 - protein, 9 aa, Homo Sapiens
PNNSFCAMG

SEQ ID NO: 157159 - protein, 9 aa, Homo Sapiens
SCDYAIDLY

SEQ ID NO: 157160 - protein, 9 aa, Homo Sapiens
QDAAPPSTP

SEQ ID NO: 157161 - protein, 9 aa, Homo Sapiens
HKAFSACGS

SEQ ID NO: 157162 - protein, 9 aa, Homo Sapiens
TVMIHPLPV

SEQ ID NO: 157163 - protein, 9 aa, Homo Sapiens
VCNLLLKDM

SEQ ID NO: 157164 - protein, 9 aa, Homo Sapiens
SPTTTARPR

SEQ ID NO: 157165 - protein, 9 aa, Homo Sapiens
TPVPPALSP

SEQ ID NO: 157166 - protein, 9 aa, Homo Sapiens
LSLCAPQVI

SEQ ID NO: 157167 - protein, 9 aa, Homo Sapiens
RGRGFGCGR

SEQ ID NO: 157168 - protein, 9 aa, Homo Sapiens
DTPVGIIIG

SEQ ID NO: 157169 - protein, 9 aa, Homo Sapiens
GGRWPGPPS

SEQ ID NO: 157170 - protein, 9 aa, Homo Sapiens
ARQQQPPPP

SEQ ID NO: 157171 - protein, 9 aa, Homo Sapiens
AGLGQLAWL

SEQ ID NO: 157172 - protein, 9 aa, Homo Sapiens
GGRILLQRN

SEQ ID NO: 157173 - protein, 9 aa, Homo Sapiens
TGASSCAST

SEQ ID NO: 157174 - protein, 9 aa, Homo Sapiens
GLFPPPLPP

SEQ ID NO: 157175 - protein, 9 aa, Homo Sapiens
KLESPALKQ

SEQ ID NO: 157176 - protein, 9 aa, Homo Sapiens
TEQNKKRQT

SEQ ID NO: 157177 - protein, 9 aa, Homo Sapiens
YRLSLRQAD

SEQ ID NO: 157178 - protein, 9 aa, Homo Sapiens
KYLINPETL

SEQ ID NO: 157179 - protein, 9 aa, Homo Sapiens
LYSLFLFPD

SEQ ID NO: 157180 - protein, 9 aa, Homo Sapiens
IGTVVVLRL

SEQ ID NO: 157181 - protein, 9 aa, Homo Sapiens
PRRAPLNSW

SEQ ID NO: 157182 - protein, 9 aa, Homo Sapiens
GGGQGGQDG

SEQ ID NO: 157183 - protein, 9 aa, Homo Sapiens
CYLLYHKTK

SEQ ID NO: 157184 - protein, 9 aa, Homo Sapiens
VVAARPGCE

SEQ ID NO: 157185 - protein, 9 aa, Homo Sapiens
TPIKKKRTE

SEQ ID NO: 157186 - protein, 9 aa, Homo Sapiens
KSVKTPDKK

SEQ ID NO: 157187 - protein, 9 aa, Homo Sapiens
SAVPYVPVQ

SEQ ID NO: 157188 - protein, 9 aa, Homo Sapiens
TCGSCARSI

SEQ ID NO: 157189 - protein, 9 aa, Homo Sapiens
NLRQKEEAE

SEQ ID NO: 157190 - protein, 9 aa, Homo Sapiens
SQIKVGQNE

SEQ ID NO: 157191 - protein, 9 aa, Homo Sapiens
QVTENCGHP

SEQ ID NO: 157192 - protein, 9 aa, Homo Sapiens
VPLRIHFCP

SEQ ID NO: 157193 - protein, 9 aa, Homo Sapiens
AQDEWEIPG

SEQ ID NO: 157194 - protein, 9 aa, Homo Sapiens
SSHLILLWL

SEQ ID NO: 157195 - protein, 9 aa, Homo Sapiens
NVASWSADR

SEQ ID NO: 157196 - protein, 9 aa, Homo Sapiens
RFKCLRTHS

SEQ ID NO: 157197 - protein, 9 aa, Homo Sapiens
RHSPRPIFD

SEQ ID NO: 157198 - protein, 9 aa, Homo Sapiens
RDQGLTFDY

SEQ ID NO: 157199 - protein, 9 aa, Homo Sapiens
HTLISVENF

SEQ ID NO: 157200 - protein, 9 aa, Homo Sapiens
GDCYHEWNT

SEQ ID NO: 157201 - protein, 9 aa, Homo Sapiens
ASTARWRTT

SEQ ID NO: 157202 - protein, 9 aa, Homo Sapiens
LPGLAVHQD

SEQ ID NO: 157203 - protein, 9 aa, Homo Sapiens
SMTFVYRDV

SEQ ID NO: 157204 - protein, 9 aa, Homo Sapiens
GNLQTMLRD

SEQ ID NO: 157205 - protein, 9 aa, Homo Sapiens
PSLEIPLKG

SEQ ID NO: 157206 - protein, 9 aa, Homo Sapiens
NVTKFWEYK

SEQ ID NO: 157207 - protein, 9 aa, Homo Sapiens
LDERGYTLY

SEQ ID NO: 157208 - protein, 9 aa, Homo Sapiens
RTWSAGEWS

SEQ ID NO: 157209 - protein, 9 aa, Homo Sapiens
TFLSPCVDN

SEQ ID NO: 157210 - protein, 9 aa, Homo Sapiens
LGKEHRRVN

SEQ ID NO: 157211 - protein, 9 aa, Homo Sapiens
ERSDSSSLT

SEQ ID NO: 157212 - protein, 9 aa, Homo Sapiens
PHNNFFFDG

SEQ ID NO: 157213 - protein, 9 aa, Homo Sapiens
NHHQQQQQQ

SEQ ID NO: 157214 - protein, 9 aa, Homo Sapiens
IHGCSVLHI

SEQ ID NO: 157215 - protein, 9 aa, Homo Sapiens
ASQPSSSVW

SEQ ID NO: 157216 - protein, 9 aa, Homo Sapiens
LLLVQAEAM

SEQ ID NO: 157217 - protein, 9 aa, Homo Sapiens
EQEQQRHTA

SEQ ID NO: 157218 - protein, 9 aa, Homo Sapiens
KSIFFVGQL

SEQ ID NO: 157219 - protein, 9 aa, Homo Sapiens
FVYAITSEC

SEQ ID NO: 157220 - protein, 9 aa, Homo Sapiens
RFLRVQHGL

SEQ ID NO: 157221 - protein, 9 aa, Homo Sapiens
KFINQLLEV

SEQ ID NO: 157222 - protein, 9 aa, Homo Sapiens
AQGAAVDPP

SEQ ID NO: 157223 - protein, 9 aa, Homo Sapiens
HPRTATSLD

SEQ ID NO: 157224 - protein, 9 aa, Homo Sapiens
ELPSVQPEE

SEQ ID NO: 157225 - protein, 9 aa, Homo Sapiens
KTSPPPQIL

SEQ ID NO: 157226 - protein, 9 aa, Homo Sapiens
QSVIQMHSS

SEQ ID NO: 157227 - protein, 9 aa, Homo Sapiens
HPSSMPAAM

SEQ ID NO: 157228 - protein, 9 aa, Homo Sapiens
SAMECFRNM

SEQ ID NO: 157229 - protein, 9 aa, Homo Sapiens
SPPLIHPAT

SEQ ID NO: 157230 - protein, 9 aa, Homo Sapiens
RNQVRLKVL

SEQ ID NO: 157231 - protein, 9 aa, Homo Sapiens
TTSSPRRSP

SEQ ID NO: 157232 - protein, 9 aa, Homo Sapiens
ISGSPALEL

SEQ ID NO: 157233 - protein, 9 aa, Homo Sapiens
PPGLPPATM

SEQ ID NO: 157234 - protein, 9 aa, Homo Sapiens
PILFHIQHL

SEQ ID NO: 157235 - protein, 9 aa, Homo Sapiens
FDEIQQWHG

SEQ ID NO: 157236 - protein, 9 aa, Homo Sapiens
GQLRLSTVD

SEQ ID NO: 157237 - protein, 9 aa, Homo Sapiens
QGPWRPLHT

SEQ ID NO: 157238 - protein, 9 aa, Homo Sapiens
GRGGWRVVD

SEQ ID NO: 157239 - protein, 9 aa, Homo Sapiens
SWGPRLGPA

SEQ ID NO: 157240 - protein, 9 aa, Homo Sapiens
WHHHDKDGW

SEQ ID NO: 157241 - protein, 9 aa, Homo Sapiens
STAPGVGWR

SEQ ID NO: 157242 - protein, 9 aa, Homo Sapiens
PVQWVGDDG

SEQ ID NO: 157243 - protein, 9 aa, Homo Sapiens
AARHGEEVV

SEQ ID NO: 157244 - protein, 9 aa, Homo Sapiens
ATLERQTLG

SEQ ID NO: 157245 - protein, 9 aa, Homo Sapiens
LEKVHFSQA

SEQ ID NO: 157246 - protein, 9 aa, Homo Sapiens
AISSKFETQ

SEQ ID NO: 157247 - protein, 9 aa, Homo Sapiens
QPAAAFMRL

SEQ ID NO: 157248 - protein, 9 aa, Homo Sapiens
SARRRTWWR

SEQ ID NO: 157249 - protein, 9 aa, Homo Sapiens
PPPGADVTG

SEQ ID NO: 157250 - protein, 9 aa, Homo Sapiens
SLMITRARK

SEQ ID NO: 157251 - protein, 9 aa, Homo Sapiens
RRALPRATG

SEQ ID NO: 157252 - protein, 9 aa, Homo Sapiens
YRERYVASV

SEQ ID NO: 157253 - protein, 9 aa, Homo Sapiens
ATSLFIKPN

SEQ ID NO: 157254 - protein, 9 aa, Homo Sapiens
HVLEEVIRE

SEQ ID NO: 157255 - protein, 9 aa, Homo Sapiens
VGVPHPPPP

SEQ ID NO: 157256 - protein, 9 aa, Homo Sapiens
FNQTQKNML

SEQ ID NO: 157257 - protein, 9 aa, Homo Sapiens
PQPAPAGAW

SEQ ID NO: 157258 - protein, 9 aa, Homo Sapiens
KTSKQNRRS

SEQ ID NO: 157259 - protein, 9 aa, Homo Sapiens
DKNTAVRAY

SEQ ID NO: 157260 - protein, 9 aa, Homo Sapiens
LPFQNTGAQ

SEQ ID NO: 157261 - protein, 9 aa, Homo Sapiens
LALAALGPP

SEQ ID NO: 157262 - protein, 9 aa, Homo Sapiens
SPMVFLPEP

SEQ ID NO: 157263 - protein, 9 aa, Homo Sapiens
PGALTPLQQ

SEQ ID NO: 157264 - protein, 9 aa, Homo Sapiens
VEVNGKDQT

SEQ ID NO: 157265 - protein, 9 aa, Homo Sapiens
RQVLRYHPD

SEQ ID NO: 157266 - protein, 9 aa, Homo Sapiens
VFELLLLVV

SEQ ID NO: 157267 - protein, 9 aa, Homo Sapiens
FELLLLVVV

SEQ ID NO: 157268 - protein, 9 aa, Homo Sapiens
VPAKDSTSW

SEQ ID NO: 157269 - protein, 9 aa, Homo Sapiens
KNTAVRAYS

SEQ ID NO: 157270 - protein, 9 aa, Homo Sapiens
KRATPDLDV

SEQ ID NO: 157271 - protein, 9 aa, Homo Sapiens
PPKWKDYLP

SEQ ID NO: 157272 - protein, 9 aa, Homo Sapiens
RTDHSDELN

SEQ ID NO: 157273 - protein, 9 aa, Homo Sapiens
PSITTPGAA

SEQ ID NO: 157274 - protein, 9 aa, Homo Sapiens
SGKHSFKTK

SEQ ID NO: 157275 - protein, 9 aa, Homo Sapiens
HEGIIPANY

SEQ ID NO: 157276 - protein, 9 aa, Homo Sapiens
CACLLGLTR

SEQ ID NO: 157277 - protein, 9 aa, Homo Sapiens
GKKHRIEES

SEQ ID NO: 157278 - protein, 9 aa, Homo Sapiens
DGCRVYPAP

SEQ ID NO: 157279 - protein, 9 aa, Homo Sapiens
LDCASSGGS

SEQ ID NO: 157280 - protein, 9 aa, Homo Sapiens
LVFSFFFCL

SEQ ID NO: 157281 - protein, 9 aa, Homo Sapiens
RRPLTRLRR

SEQ ID NO: 157282 - protein, 9 aa, Homo Sapiens
GGSQVKGGE

SEQ ID NO: 157283 - protein, 9 aa, Homo Sapiens
SRPHPALWR

SEQ ID NO: 157284 - protein, 9 aa, Homo Sapiens
LVMEYTSGG

SEQ ID NO: 157285 - protein, 9 aa, Homo Sapiens
IGNLTNAEN

SEQ ID NO: 157286 - protein, 9 aa, Homo Sapiens
NQHRRTTSA

SEQ ID NO: 157287 - protein, 9 aa, Homo Sapiens
GLFSLPPDV

SEQ ID NO: 157288 - protein, 9 aa, Homo Sapiens
TNVDKLAKD

SEQ ID NO: 157289 - protein, 9 aa, Homo Sapiens
SSPAGAAPR

SEQ ID NO: 157290 - protein, 9 aa, Homo Sapiens
CCVSGVVLV

SEQ ID NO: 157291 - protein, 9 aa, Homo Sapiens
WAQWGPNLS

SEQ ID NO: 157292 - protein, 9 aa, Homo Sapiens
ASLGRALPL

SEQ ID NO: 157293 - protein, 9 aa, Homo Sapiens
EGVVGPKVA

SEQ ID NO: 157294 - protein, 9 aa, Homo Sapiens
LPRKGQSLR

SEQ ID NO: 157295 - protein, 9 aa, Homo Sapiens
KGMDDHLFY

SEQ ID NO: 157296 - protein, 9 aa, Homo Sapiens
KKGNFFFQN

SEQ ID NO: 157297 - protein, 9 aa, Homo Sapiens
RPHPLYFRG

SEQ ID NO: 157298 - protein, 9 aa, Homo Sapiens
TDAFEQMWQ

SEQ ID NO: 157299 - protein, 9 aa, Homo Sapiens
GIMVGKRGK

SEQ ID NO: 157300 - protein, 9 aa, Homo Sapiens
SKNLNSRDI

SEQ ID NO: 157301 - protein, 9 aa, Homo Sapiens
ERLRHHFYW

SEQ ID NO: 157302 - protein, 9 aa, Homo Sapiens
QYGIPHHLH

SEQ ID NO: 157303 - protein, 9 aa, Homo Sapiens
SSPITNSKL

SEQ ID NO: 157304 - protein, 9 aa, Homo Sapiens
RSQDPSPAG

SEQ ID NO: 157305 - protein, 9 aa, Homo Sapiens
RNHFSLILF

SEQ ID NO: 157306 - protein, 9 aa, Homo Sapiens
CRDVTLNMM

SEQ ID NO: 157307 - protein, 9 aa, Homo Sapiens
AKKPHSFKS

SEQ ID NO: 157308 - protein, 9 aa, Homo Sapiens
GFGDDIPGI

SEQ ID NO: 157309 - protein, 9 aa, Homo Sapiens
PPHLVPKLQ

SEQ ID NO: 157310 - protein, 9 aa, Homo Sapiens
GLPRKSVTT

SEQ ID NO: 157311 - protein, 9 aa, Homo Sapiens
RRRACVVHM

SEQ ID NO: 157312 - protein, 9 aa, Homo Sapiens
SVVLRTLHK

SEQ ID NO: 157313 - protein, 9 aa, Homo Sapiens
AAILGVTTG

SEQ ID NO: 157314 - protein, 9 aa, Homo Sapiens
FIHPPLIFG

SEQ ID NO: 157315 - protein, 9 aa, Homo Sapiens
TLLHTPGLP

SEQ ID NO: 157316 - protein, 9 aa, Homo Sapiens
HFQKALEIK

SEQ ID NO: 157317 - protein, 9 aa, Homo Sapiens
TSILSALRV

SEQ ID NO: 157318 - protein, 9 aa, Homo Sapiens
CESICCGHG

SEQ ID NO: 157319 - protein, 9 aa, Homo Sapiens
KGERWPGGF

SEQ ID NO: 157320 - protein, 9 aa, Homo Sapiens
LSCPGRNAW

SEQ ID NO: 157321 - protein, 9 aa, Homo Sapiens
RPQPWLQQL

SEQ ID NO: 157322 - protein, 9 aa, Homo Sapiens
SRRLCGIIP

SEQ ID NO: 157323 - protein, 9 aa, Homo Sapiens
IINHSSSEA

SEQ ID NO: 157324 - protein, 9 aa, Homo Sapiens
PIGPSCVPT

SEQ ID NO: 157325 - protein, 9 aa, Homo Sapiens
SLHGQKMLP

SEQ ID NO: 157326 - protein, 9 aa, Homo Sapiens
LSKHQAVDN

SEQ ID NO: 157327 - protein, 9 aa, Homo Sapiens
GGSGGGGGH

SEQ ID NO: 157328 - protein, 9 aa, Homo Sapiens
SSPRRAPLN

SEQ ID NO: 157329 - protein, 9 aa, Homo Sapiens
SPELWVTHR

SEQ ID NO: 157330 - protein, 9 aa, Homo Sapiens
VICDPLHYT

SEQ ID NO: 157331 - protein, 9 aa, Homo Sapiens
WWKRHTPRS

SEQ ID NO: 157332 - protein, 9 aa, Homo Sapiens
RIYSRAAKD

SEQ ID NO: 157333 - protein, 9 aa, Homo Sapiens
TRPPSSPTR

SEQ ID NO: 157334 - protein, 9 aa, Homo Sapiens
KTSRIYGFI

SEQ ID NO: 157335 - protein, 9 aa, Homo Sapiens
TWWRTRACT

SEQ ID NO: 157336 - protein, 9 aa, Homo Sapiens
SERAGSSRP

SEQ ID NO: 157337 - protein, 9 aa, Homo Sapiens
PQDKFYDVS

SEQ ID NO: 157338 - protein, 9 aa, Homo Sapiens
CCFQAICIS

SEQ ID NO: 157339 - protein, 9 aa, Homo Sapiens
IYAGATLRF

SEQ ID NO: 157340 - protein, 9 aa, Homo Sapiens
WAWLQKFRC

SEQ ID NO: 157341 - protein, 9 aa, Homo Sapiens
PGSLSGWSG

SEQ ID NO: 157342 - protein, 9 aa, Homo Sapiens
PLHCLSKAS

SEQ ID NO: 157343 - protein, 9 aa, Homo Sapiens
VATQGPWLV

SEQ ID NO: 157344 - protein, 9 aa, Homo Sapiens
AHHQSSSLS

SEQ ID NO: 157345 - protein, 9 aa, Homo Sapiens
PNPIKLIQQ

SEQ ID NO: 157346 - protein, 9 aa, Homo Sapiens
CAGHNGGPP

SEQ ID NO: 157347 - protein, 9 aa, Homo Sapiens
ASLLCQCPL

SEQ ID NO: 157348 - protein, 9 aa, Homo Sapiens
TGSHQQLMP

SEQ ID NO: 157349 - protein, 9 aa, Homo Sapiens
VPRLFWVAS

SEQ ID NO: 157350 - protein, 9 aa, Homo Sapiens
TQKISVHAF

SEQ ID NO: 157351 - protein, 9 aa, Homo Sapiens
PVRVEVDTV

SEQ ID NO: 157352 - protein, 9 aa, Homo Sapiens
RCVRDLGLQ

SEQ ID NO: 157353 - protein, 9 aa, Homo Sapiens
ECIGNLTNA

SEQ ID NO: 157354 - protein, 9 aa, Homo Sapiens
CRLFECGQG

SEQ ID NO: 157355 - protein, 9 aa, Homo Sapiens
EIKHISKGV

SEQ ID NO: 157356 - protein, 9 aa, Homo Sapiens
WECELELVS

SEQ ID NO: 157357 - protein, 9 aa, Homo Sapiens
LVVVLIVCC

SEQ ID NO: 157358 - protein, 9 aa, Homo Sapiens
CDSPDPDVD

SEQ ID NO: 157359 - protein, 9 aa, Homo Sapiens
ASEITMRDE

SEQ ID NO: 157360 - protein, 9 aa, Homo Sapiens
TLGSSPSTP

SEQ ID NO: 157361 - protein, 9 aa, Homo Sapiens
DCKVCPSWL

SEQ ID NO: 157362 - protein, 9 aa, Homo Sapiens
RAPLNSWRS

SEQ ID NO: 157363 - protein, 9 aa, Homo Sapiens
NTGDAIYEV

SEQ ID NO: 157364 - protein, 9 aa, Homo Sapiens
RTRSTSQEV

SEQ ID NO: 157365 - protein, 9 aa, Homo Sapiens
KHHLGCVLR

SEQ ID NO: 157366 - protein, 9 aa, Homo Sapiens
SVSGTATQT

SEQ ID NO: 157367 - protein, 9 aa, Homo Sapiens
ILYVKEWSL

SEQ ID NO: 157368 - protein, 9 aa, Homo Sapiens
CRWFCPTLP

SEQ ID NO: 157369 - protein, 9 aa, Homo Sapiens
PTPQVCVSC

SEQ ID NO: 157370 - protein, 9 aa, Homo Sapiens
PDVLRHVAG

SEQ ID NO: 157371 - protein, 9 aa, Homo Sapiens
VVSSGRRKT

SEQ ID NO: 157372 - protein, 9 aa, Homo Sapiens
ALWGWRTGL

SEQ ID NO: 157373 - protein, 9 aa, Homo Sapiens
RPLHRTTNP

SEQ ID NO: 157374 - protein, 9 aa, Homo Sapiens
TTPGAAVAA

SEQ ID NO: 157375 - protein, 9 aa, Homo Sapiens
DDSDVSEPA

SEQ ID NO: 157376 - protein, 9 aa, Homo Sapiens
VTDKILDLY

SEQ ID NO: 157377 - protein, 9 aa, Homo Sapiens
GVVGPKVAL

SEQ ID NO: 157378 - protein, 9 aa, Homo Sapiens
WTPWRKSGS

SEQ ID NO: 157379 - protein, 9 aa, Homo Sapiens
ERDEKGNFM

SEQ ID NO: 157380 - protein, 9 aa, Homo Sapiens
PAQKSSKKL

SEQ ID NO: 157381 - protein, 9 aa, Homo Sapiens
CCLIDENKL

SEQ ID NO: 157382 - protein, 9 aa, Homo Sapiens
YLHPSKTEV

SEQ ID NO: 157383 - protein, 9 aa, Homo Sapiens
HPGEGWVEV

SEQ ID NO: 157384 - protein, 9 aa, Homo Sapiens
LTAFLLAGG

SEQ ID NO: 157385 - protein, 9 aa, Homo Sapiens
RQAKNQAYV

SEQ ID NO: 157386 - protein, 9 aa, Homo Sapiens
PHPRAHRVQ

SEQ ID NO: 157387 - protein, 9 aa, Homo Sapiens
RASGPTPVP

SEQ ID NO: 157388 - protein, 9 aa, Homo Sapiens
PLRPQRGPR

SEQ ID NO: 157389 - protein, 9 aa, Homo Sapiens
TKQLWEGRR

SEQ ID NO: 157390 - protein, 9 aa, Homo Sapiens
HVWLLPGMG

SEQ ID NO: 157391 - protein, 9 aa, Homo Sapiens
PSYMRKETT

SEQ ID NO: 157392 - protein, 9 aa, Homo Sapiens
FGGKALTRL

SEQ ID NO: 157393 - protein, 9 aa, Homo Sapiens
TPARRAQGN

SEQ ID NO: 157394 - protein, 9 aa, Homo Sapiens
LTAKHHSTP

SEQ ID NO: 157395 - protein, 9 aa, Homo Sapiens
SKECVLTVT

SEQ ID NO: 157396 - protein, 9 aa, Homo Sapiens
SHEQLAQLR

SEQ ID NO: 157397 - protein, 9 aa, Homo Sapiens
RLVNAVATR

SEQ ID NO: 157398 - protein, 9 aa, Homo Sapiens
AVSCDSFKN

SEQ ID NO: 157399 - protein, 9 aa, Homo Sapiens
GTVVVLRLD

SEQ ID NO: 157400 - protein, 9 aa, Homo Sapiens
GEIRPRKAL

SEQ ID NO: 157401 - protein, 9 aa, Homo Sapiens
YIVGGVSTS

SEQ ID NO: 157402 - protein, 9 aa, Homo Sapiens
TPSAPSPAV

SEQ ID NO: 157403 - protein, 9 aa, Homo Sapiens
EAISMETLK

SEQ ID NO: 157404 - protein, 9 aa, Homo Sapiens
IKDAKNSRT

SEQ ID NO: 157405 - protein, 9 aa, Homo Sapiens
HHQSSSLSL

SEQ ID NO: 157406 - protein, 9 aa, Homo Sapiens
WSQTSCFGP

SEQ ID NO: 157407 - protein, 9 aa, Homo Sapiens
PGELGTLAD

SEQ ID NO: 157408 - protein, 9 aa, Homo Sapiens
FGDIIPDYV

SEQ ID NO: 157409 - protein, 9 aa, Homo Sapiens
SSSRQHCFS

SEQ ID NO: 157410 - protein, 9 aa, Homo Sapiens
ICQSLAWRK

SEQ ID NO: 157411 - protein, 9 aa, Homo Sapiens
GNELLLQSF

SEQ ID NO: 157412 - protein, 9 aa, Homo Sapiens
EHSIPRRQW

SEQ ID NO: 157413 - protein, 9 aa, Homo Sapiens
YASIILLHF

SEQ ID NO: 157414 - protein, 9 aa, Homo Sapiens
PRSWGPRLG

SEQ ID NO: 157415 - protein, 9 aa, Homo Sapiens
RTSGRSLSC

SEQ ID NO: 157416 - protein, 9 aa, Homo Sapiens
VQILTAFSS

SEQ ID NO: 157417 - protein, 9 aa, Homo Sapiens
PAKDSTSWC

SEQ ID NO: 157418 - protein, 9 aa, Homo Sapiens
QPTDTVMIH

SEQ ID NO: 157419 - protein, 9 aa, Homo Sapiens
HPPLPSPPV

SEQ ID NO: 157420 - protein, 9 aa, Homo Sapiens
DRAWGLFTP

SEQ ID NO: 157421 - protein, 9 aa, Homo Sapiens
SILARLVAT

SEQ ID NO: 157422 - protein, 9 aa, Homo Sapiens
LSCQAQGAA

SEQ ID NO: 157423 - protein, 9 aa, Homo Sapiens
FTNTYQTFK

SEQ ID NO: 157424 - protein, 9 aa, Homo Sapiens
SWWQGRGGE

SEQ ID NO: 157425 - protein, 9 aa, Homo Sapiens
YDGCRVYPA

SEQ ID NO: 157426 - protein, 9 aa, Homo Sapiens
NHSTLLSQG

SEQ ID NO: 157427 - protein, 9 aa, Homo Sapiens
ALHGFRPST

SEQ ID NO: 157428 - protein, 9 aa, Homo Sapiens
ARPPPAARP

SEQ ID NO: 157429 - protein, 9 aa, Homo Sapiens
VREPFERLT

SEQ ID NO: 157430 - protein, 9 aa, Homo Sapiens
TDRQQTVLP

SEQ ID NO: 157431 - protein, 9 aa, Homo Sapiens
GMDYEVTVS

SEQ ID NO: 157432 - protein, 9 aa, Homo Sapiens
EAPPRSLQN

SEQ ID NO: 157433 - protein, 9 aa, Homo Sapiens
VMNKRLGSL

SEQ ID NO: 157434 - protein, 9 aa, Homo Sapiens
MRSVHLQEA

SEQ ID NO: 157435 - protein, 9 aa, Homo Sapiens
ARQRLERAV

SEQ ID NO: 157436 - protein, 9 aa, Homo Sapiens
GGMEVWWCA

SEQ ID NO: 157437 - protein, 9 aa, Homo Sapiens
VLKKEIYIY

SEQ ID NO: 157438 - protein, 9 aa, Homo Sapiens
SPLCLHRAR

SEQ ID NO: 157439 - protein, 9 aa, Homo Sapiens
EIAELTVLA

SEQ ID NO: 157440 - protein, 9 aa, Homo Sapiens
SRSTAPSPR

SEQ ID NO: 157441 - protein, 9 aa, Homo Sapiens
SACDPRGSP

SEQ ID NO: 157442 - protein, 9 aa, Homo Sapiens
SWISVPCPN

SEQ ID NO: 157443 - protein, 9 aa, Homo Sapiens
GTHRHTHTH

SEQ ID NO: 157444 - protein, 9 aa, Homo Sapiens
STLSQPPPQ

SEQ ID NO: 157445 - protein, 9 aa, Homo Sapiens
FETDDGSKD

SEQ ID NO: 157446 - protein, 9 aa, Homo Sapiens
FSLTLSCLR

SEQ ID NO: 157447 - protein, 9 aa, Homo Sapiens
DGLAPQHLI

SEQ ID NO: 157448 - protein, 9 aa, Homo Sapiens
IDGSAVPYV

SEQ ID NO: 157449 - protein, 9 aa, Homo Sapiens
ACPQRLPKA

SEQ ID NO: 157450 - protein, 9 aa, Homo Sapiens
GSKIFKTFF

SEQ ID NO: 157451 - protein, 9 aa, Homo Sapiens
ECIECGKLF

SEQ ID NO: 157452 - protein, 9 aa, Homo Sapiens
TPELRSSRS

SEQ ID NO: 157453 - protein, 9 aa, Homo Sapiens
RIMEAILNH

SEQ ID NO: 157454 - protein, 9 aa, Homo Sapiens
MSQMQDYEC

SEQ ID NO: 157455 - protein, 9 aa, Homo Sapiens
LLLGGGCFA

SEQ ID NO: 157456 - protein, 9 aa, Homo Sapiens
VPLFIWTPW

SEQ ID NO: 157457 - protein, 9 aa, Homo Sapiens
QEQQRHTAY

SEQ ID NO: 157458 - protein, 9 aa, Homo Sapiens
AQGTRRSSN

SEQ ID NO: 157459 - protein, 9 aa, Homo Sapiens
QFLQYYYQN

SEQ ID NO: 157460 - protein, 9 aa, Homo Sapiens
GGPPRPTVA

SEQ ID NO: 157461 - protein, 9 aa, Homo Sapiens
VNQGIRGKR

SEQ ID NO: 157462 - protein, 9 aa, Homo Sapiens
IHFCPVHRP

SEQ ID NO: 157463 - protein, 9 aa, Homo Sapiens
RLWTPAKGR

SEQ ID NO: 157464 - protein, 9 aa, Homo Sapiens
AAASPRAAI

SEQ ID NO: 157465 - protein, 9 aa, Homo Sapiens
VGVATAHAP

SEQ ID NO: 157466 - protein, 9 aa, Homo Sapiens
CDRFNARQF

SEQ ID NO: 157467 - protein, 9 aa, Homo Sapiens
SEPLSMTFV

SEQ ID NO: 157468 - protein, 9 aa, Homo Sapiens
NGLAHRWAA

SEQ ID NO: 157469 - protein, 9 aa, Homo Sapiens
WAAPVITSS

SEQ ID NO: 157470 - protein, 9 aa, Homo Sapiens
TWCRTGAST

SEQ ID NO: 157471 - protein, 9 aa, Homo Sapiens
HDKIDHILE

SEQ ID NO: 157472 - protein, 9 aa, Homo Sapiens
LQPLLLLLF

SEQ ID NO: 157473 - protein, 9 aa, Homo Sapiens
ITPKEDPEI

SEQ ID NO: 157474 - protein, 9 aa, Homo Sapiens
SWRTWSAGE

SEQ ID NO: 157475 - protein, 9 aa, Homo Sapiens
PRKALDFEE

SEQ ID NO: 157476 - protein, 9 aa, Homo Sapiens
MCSDPFVPP

SEQ ID NO: 157477 - protein, 9 aa, Homo Sapiens
IYIYNIILL

SEQ ID NO: 157478 - protein, 9 aa, Homo Sapiens
PHPPLPSPP

SEQ ID NO: 157479 - protein, 9 aa, Homo Sapiens
SSGSQCSLT

SEQ ID NO: 157480 - protein, 9 aa, Homo Sapiens
GHFPLQVWL

SEQ ID NO: 157481 - protein, 9 aa, Homo Sapiens
RAQTVAPRW

SEQ ID NO: 157482 - protein, 9 aa, Homo Sapiens
TPQNVTFCS

SEQ ID NO: 157483 - protein, 9 aa, Homo Sapiens
TFFFLHKEF

SEQ ID NO: 157484 - protein, 9 aa, Homo Sapiens
FFSLLFIAA

SEQ ID NO: 157485 - protein, 9 aa, Homo Sapiens
GDVFICQYF

SEQ ID NO: 157486 - protein, 9 aa, Homo Sapiens
SSPCSPAHH

SEQ ID NO: 157487 - protein, 9 aa, Homo Sapiens
KAFPAHLAS

SEQ ID NO: 157488 - protein, 9 aa, Homo Sapiens
DELVRFALR

SEQ ID NO: 157489 - protein, 9 aa, Homo Sapiens
GPQDLSMKE

SEQ ID NO: 157490 - protein, 9 aa, Homo Sapiens
DGPQIGVNI

SEQ ID NO: 157491 - protein, 9 aa, Homo Sapiens
QGTKIVYRH

SEQ ID NO: 157492 - protein, 9 aa, Homo Sapiens
GTDVIAFTK

SEQ ID NO: 157493 - protein, 9 aa, Homo Sapiens
EVCQSGERS

SEQ ID NO: 157494 - protein, 9 aa, Homo Sapiens
LRMPESSGH

SEQ ID NO: 157495 - protein, 9 aa, Homo Sapiens
IEATQSPAP

SEQ ID NO: 157496 - protein, 9 aa, Homo Sapiens
MHPKVPVPV

SEQ ID NO: 157497 - protein, 9 aa, Homo Sapiens
QSSFVPTQY

SEQ ID NO: 157498 - protein, 9 aa, Homo Sapiens
SLEPADVPV

SEQ ID NO: 157499 - protein, 9 aa, Homo Sapiens
TGTHTLALT

SEQ ID NO: 157500 - protein, 9 aa, Homo Sapiens
TRWHQECHQ

SEQ ID NO: 157501 - protein, 9 aa, Homo Sapiens
PPCLKVMHK

SEQ ID NO: 157502 - protein, 9 aa, Homo Sapiens
GVIHANTHL

SEQ ID NO: 157503 - protein, 9 aa, Homo Sapiens
RSSSTIHIK

SEQ ID NO: 157504 - protein, 9 aa, Homo Sapiens
VQNRFTRNL

SEQ ID NO: 157505 - protein, 9 aa, Homo Sapiens
TTCPGPSWH

SEQ ID NO: 157506 - protein, 9 aa, Homo Sapiens
CFNVLKVTK

SEQ ID NO: 157507 - protein, 9 aa, Homo Sapiens
WQAGASGQL

SEQ ID NO: 157508 - protein, 9 aa, Homo Sapiens
RTPLPATTS

SEQ ID NO: 157509 - protein, 9 aa, Homo Sapiens
PPSITPSSE

SEQ ID NO: 157510 - protein, 9 aa, Homo Sapiens
MSLNVWAIG

SEQ ID NO: 157511 - protein, 9 aa, Homo Sapiens
RPGQCAGAW

SEQ ID NO: 157512 - protein, 9 aa, Homo Sapiens
AEAGACEAP

SEQ ID NO: 157513 - protein, 9 aa, Homo Sapiens
AFVTCSSHM

SEQ ID NO: 157514 - protein, 9 aa, Homo Sapiens
STPPTTGLP

SEQ ID NO: 157515 - protein, 9 aa, Homo Sapiens
LANMGGSRP

SEQ ID NO: 157516 - protein, 9 aa, Homo Sapiens
KHLYSLHIP

SEQ ID NO: 157517 - protein, 9 aa, Homo Sapiens
GEAAHRGAG

SEQ ID NO: 157518 - protein, 9 aa, Homo Sapiens
ALFALCSLL

SEQ ID NO: 157519 - protein, 9 aa, Homo Sapiens
RVRHSLCEL

SEQ ID NO: 157520 - protein, 9 aa, Homo Sapiens
SVPLCFVLP

SEQ ID NO: 157521 - protein, 9 aa, Homo Sapiens
ISRFWALAV

SEQ ID NO: 157522 - protein, 9 aa, Homo Sapiens
MSLQSLAKP

SEQ ID NO: 157523 - protein, 9 aa, Homo Sapiens
DNISYGLPI

SEQ ID NO: 157524 - protein, 9 aa, Homo Sapiens
DLDCASSGG

SEQ ID NO: 157525 - protein, 9 aa, Homo Sapiens
ARPGRGGAC

SEQ ID NO: 157526 - protein, 9 aa, Homo Sapiens
QVGGTQEVE

SEQ ID NO: 157527 - protein, 9 aa, Homo Sapiens
AKNMAADIA

SEQ ID NO: 157528 - protein, 9 aa, Homo Sapiens
LNEHKKFIL

SEQ ID NO: 157529 - protein, 9 aa, Homo Sapiens
IPSPSACSS

SEQ ID NO: 157530 - protein, 9 aa, Homo Sapiens
SSTVSSGTS

SEQ ID NO: 157531 - protein, 9 aa, Homo Sapiens
DRSGEAPSA

SEQ ID NO: 157532 - protein, 9 aa, Homo Sapiens
AEYCENVYH

SEQ ID NO: 157533 - protein, 9 aa, Homo Sapiens
YCDFMRGHF

SEQ ID NO: 157534 - protein, 9 aa, Homo Sapiens
YEDTPVGII

SEQ ID NO: 157535 - protein, 9 aa, Homo Sapiens
MGVGLNELK

SEQ ID NO: 157536 - protein, 9 aa, Homo Sapiens
SGAPPCRPR

SEQ ID NO: 157537 - protein, 9 aa, Homo Sapiens
FFMTLGWEA

SEQ ID NO: 157538 - protein, 9 aa, Homo Sapiens
PGPCLAQAP

SEQ ID NO: 157539 - protein, 9 aa, Homo Sapiens
ISVCRDLDV

SEQ ID NO: 157540 - protein, 9 aa, Homo Sapiens
NPCMEENKP

SEQ ID NO: 157541 - protein, 9 aa, Homo Sapiens
VGILNGQLS

SEQ ID NO: 157542 - protein, 9 aa, Homo Sapiens
KSYLLQITE

SEQ ID NO: 157543 - protein, 9 aa, Homo Sapiens
LSDDSDPEP

SEQ ID NO: 157544 - protein, 9 aa, Homo Sapiens
CQERLALHG

SEQ ID NO: 157545 - protein, 9 aa, Homo Sapiens
YVPDHGRDQ

SEQ ID NO: 157546 - protein, 9 aa, Homo Sapiens
RWAALLHYE

SEQ ID NO: 157547 - protein, 9 aa, Homo Sapiens
RWYEKEKAC

SEQ ID NO: 157548 - protein, 9 aa, Homo Sapiens
LLEKMKHLN

SEQ ID NO: 157549 - protein, 9 aa, Homo Sapiens
LALTAKHHS

SEQ ID NO: 157550 - protein, 9 aa, Homo Sapiens
SWTSCYGKK

SEQ ID NO: 157551 - protein, 9 aa, Homo Sapiens
QCTFFFLHK

SEQ ID NO: 157552 - protein, 9 aa, Homo Sapiens
PPPRLGYSI

SEQ ID NO: 157553 - protein, 9 aa, Homo Sapiens
GCCVWLRCC

SEQ ID NO: 157554 - protein, 9 aa, Homo Sapiens
AAALALWGW

SEQ ID NO: 157555 - protein, 9 aa, Homo Sapiens
RPGAPGPCL

SEQ ID NO: 157556 - protein, 9 aa, Homo Sapiens
FDLIWNWAQ

SEQ ID NO: 157557 - protein, 9 aa, Homo Sapiens
LGQMDTNGL

SEQ ID NO: 157558 - protein, 9 aa, Homo Sapiens
IEVLDEGTK

SEQ ID NO: 157559 - protein, 9 aa, Homo Sapiens
RRATLTSSY

SEQ ID NO: 157560 - protein, 9 aa, Homo Sapiens
DTPTSTHKH

SEQ ID NO: 157561 - protein, 9 aa, Homo Sapiens
GRGLPPPPG

SEQ ID NO: 157562 - protein, 9 aa, Homo Sapiens
LHDIMCQCW

SEQ ID NO: 157563 - protein, 9 aa, Homo Sapiens
SRHQLKGGN

SEQ ID NO: 157564 - protein, 9 aa, Homo Sapiens
WCYLTSGGF

SEQ ID NO: 157565 - protein, 9 aa, Homo Sapiens
HFPLQVWLL

SEQ ID NO: 157566 - protein, 9 aa, Homo Sapiens
SAKASYLFP

SEQ ID NO: 157567 - protein, 9 aa, Homo Sapiens
LSGWSGNSG

SEQ ID NO: 157568 - protein, 9 aa, Homo Sapiens
RSHHTPELR

SEQ ID NO: 157569 - protein, 9 aa, Homo Sapiens
CYFFSILHV

SEQ ID NO: 157570 - protein, 9 aa, Homo Sapiens
LLYHKTKSF

SEQ ID NO: 157571 - protein, 9 aa, Homo Sapiens
VIEKNSPFG

SEQ ID NO: 157572 - protein, 9 aa, Homo Sapiens
KEWINQECQ

SEQ ID NO: 157573 - protein, 9 aa, Homo Sapiens
SAGTQEHSI

SEQ ID NO: 157574 - protein, 9 aa, Homo Sapiens
IPLNLFNNL

SEQ ID NO: 157575 - protein, 9 aa, Homo Sapiens
AGGLRMNTH

SEQ ID NO: 157576 - protein, 9 aa, Homo Sapiens
SPVPPPYTP

SEQ ID NO: 157577 - protein, 9 aa, Homo Sapiens
FNCIGCARS

SEQ ID NO: 157578 - protein, 9 aa, Homo Sapiens
ALQHMATMS

SEQ ID NO: 157579 - protein, 9 aa, Homo Sapiens
KGFKYFESL

SEQ ID NO: 157580 - protein, 9 aa, Homo Sapiens
TKFINQLLE

SEQ ID NO: 157581 - protein, 9 aa, Homo Sapiens
HTHTGIHTH

SEQ ID NO: 157582 - protein, 9 aa, Homo Sapiens
KGLKVVLFQ

SEQ ID NO: 157583 - protein, 9 aa, Homo Sapiens
LAGCIAATE

SEQ ID NO: 157584 - protein, 9 aa, Homo Sapiens
QHRRTTSAG

SEQ ID NO: 157585 - protein, 9 aa, Homo Sapiens
SLVPMYYRG

SEQ ID NO: 157586 - protein, 9 aa, Homo Sapiens
SRSAPSLRP

SEQ ID NO: 157587 - protein, 9 aa, Homo Sapiens
NYSKKAKER

SEQ ID NO: 157588 - protein, 9 aa, Homo Sapiens
PTTTARPRP

SEQ ID NO: 157589 - protein, 9 aa, Homo Sapiens
LAGLPHFSS

SEQ ID NO: 157590 - protein, 9 aa, Homo Sapiens
IIQRTTSTL

SEQ ID NO: 157591 - protein, 9 aa, Homo Sapiens
AFLLVNQHS

SEQ ID NO: 157592 - protein, 9 aa, Homo Sapiens
VPPPYTPPT

SEQ ID NO: 157593 - protein, 9 aa, Homo Sapiens
FITFIFLCS

SEQ ID NO: 157594 - protein, 9 aa, Homo Sapiens
WSSQTHTRP

SEQ ID NO: 157595 - protein, 9 aa, Homo Sapiens
FRHNECLDP

SEQ ID NO: 157596 - protein, 9 aa, Homo Sapiens
STPCTVLTA

SEQ ID NO: 157597 - protein, 9 aa, Homo Sapiens
TLPLMSALI

SEQ ID NO: 157598 - protein, 9 aa, Homo Sapiens
MEDVGPGAD

SEQ ID NO: 157599 - protein, 9 aa, Homo Sapiens
IRCPPAAWR

SEQ ID NO: 157600 - protein, 9 aa, Homo Sapiens
PCYEALRGE

SEQ ID NO: 157601 - protein, 9 aa, Homo Sapiens
MPLIIMGRW

SEQ ID NO: 157602 - protein, 9 aa, Homo Sapiens
QGHLFSMEI

SEQ ID NO: 157603 - protein, 9 aa, Homo Sapiens
RCGRRRRPG

SEQ ID NO: 157604 - protein, 9 aa, Homo Sapiens
FGGARSGFG

SEQ ID NO: 157605 - protein, 9 aa, Homo Sapiens
RPPGTGPQQ

SEQ ID NO: 157606 - protein, 9 aa, Homo Sapiens
VLWLSQRPS

SEQ ID NO: 157607 - protein, 9 aa, Homo Sapiens
LVFGQTPGQ

SEQ ID NO: 157608 - protein, 9 aa, Homo Sapiens
EHKENNISK

SEQ ID NO: 157609 - protein, 9 aa, Homo Sapiens
GGPGVPSPS

SEQ ID NO: 157610 - protein, 9 aa, Homo Sapiens
LLLLLVFLF

SEQ ID NO: 157611 - protein, 9 aa, Homo Sapiens
NMFPNHYCE

SEQ ID NO: 157612 - protein, 9 aa, Homo Sapiens
FPNGPFSRP

SEQ ID NO: 157613 - protein, 9 aa, Homo Sapiens
LAYHLTDLG

SEQ ID NO: 157614 - protein, 9 aa, Homo Sapiens
PRLPTGLYC

SEQ ID NO: 157615 - protein, 9 aa, Homo Sapiens
SEKRKLKAL

SEQ ID NO: 157616 - protein, 9 aa, Homo Sapiens
VIKTSKQNR

SEQ ID NO: 157617 - protein, 9 aa, Homo Sapiens
RVSRYNQNR

SEQ ID NO: 157618 - protein, 9 aa, Homo Sapiens
LLVQAEAMT

SEQ ID NO: 157619 - protein, 9 aa, Homo Sapiens
HYATIMNRH

SEQ ID NO: 157620 - protein, 9 aa, Homo Sapiens
AWCARWTVS

SEQ ID NO: 157621 - protein, 9 aa, Homo Sapiens
LLAPLIQKK

SEQ ID NO: 157622 - protein, 9 aa, Homo Sapiens
PAIVLQILV

SEQ ID NO: 157623 - protein, 9 aa, Homo Sapiens
PGVGWRGAL

SEQ ID NO: 157624 - protein, 9 aa, Homo Sapiens
PPPHSAAHG

SEQ ID NO: 157625 - protein, 9 aa, Homo Sapiens
LSMEMIYVK

SEQ ID NO: 157626 - protein, 9 aa, Homo Sapiens
KKKARMTRT

SEQ ID NO: 157627 - protein, 9 aa, Homo Sapiens
CDKSDHTKP

SEQ ID NO: 157628 - protein, 9 aa, Homo Sapiens
ACGQSCGLV

SEQ ID NO: 157629 - protein, 9 aa, Homo Sapiens
KCCITCRLN

SEQ ID NO: 157630 - protein, 9 aa, Homo Sapiens
SAKSGSTAS

SEQ ID NO: 157631 - protein, 9 aa, Homo Sapiens
KDIDPENED

SEQ ID NO: 157632 - protein, 9 aa, Homo Sapiens
AWCCLMSQG

SEQ ID NO: 157633 - protein, 9 aa, Homo Sapiens
SRTACGAAS

SEQ ID NO: 157634 - protein, 9 aa, Homo Sapiens
HNVWARDRM

SEQ ID NO: 157635 - protein, 9 aa, Homo Sapiens
QARTGTSSG

SEQ ID NO: 157636 - protein, 9 aa, Homo Sapiens
LKSYLLQIT

SEQ ID NO: 157637 - protein, 9 aa, Homo Sapiens
RSPPRDSRK

SEQ ID NO: 157638 - protein, 9 aa, Homo Sapiens
LTGSGRRAT

SEQ ID NO: 157639 - protein, 9 aa, Homo Sapiens
QEPTHTGHL

SEQ ID NO: 157640 - protein, 9 aa, Homo Sapiens
ALDLASEFL

SEQ ID NO: 157641 - protein, 9 aa, Homo Sapiens
GWPRTPSPC

SEQ ID NO: 157642 - protein, 9 aa, Homo Sapiens
ETSSWTIPW

SEQ ID NO: 157643 - protein, 9 aa, Homo Sapiens
IFVSIVVKM

SEQ ID NO: 157644 - protein, 9 aa, Homo Sapiens
PLQQRPGAP

SEQ ID NO: 157645 - protein, 9 aa, Homo Sapiens
RGGWRVVDH

SEQ ID NO: 157646 - protein, 9 aa, Homo Sapiens
DPGRAPQGP

SEQ ID NO: 157647 - protein, 9 aa, Homo Sapiens
SLYSVAVWP

SEQ ID NO: 157648 - protein, 9 aa, Homo Sapiens
PPPAKHSSS

SEQ ID NO: 157649 - protein, 9 aa, Homo Sapiens
SLSPAAVGN

SEQ ID NO: 157650 - protein, 9 aa, Homo Sapiens
QDDGSDAPL

SEQ ID NO: 157651 - protein, 9 aa, Homo Sapiens
EAKNILASP

SEQ ID NO: 157652 - protein, 9 aa, Homo Sapiens
VVQHFWSIQ

SEQ ID NO: 157653 - protein, 9 aa, Homo Sapiens
RVFQEEDLH

SEQ ID NO: 157654 - protein, 9 aa, Homo Sapiens
VCERPAPTR

SEQ ID NO: 157655 - protein, 9 aa, Homo Sapiens
DDIRYDRFL

SEQ ID NO: 157656 - protein, 9 aa, Homo Sapiens
PPLVLTEIA

SEQ ID NO: 157657 - protein, 9 aa, Homo Sapiens
LKLGVVDVN

SEQ ID NO: 157658 - protein, 9 aa, Homo Sapiens
VSFCCSTVS

SEQ ID NO: 157659 - protein, 9 aa, Homo Sapiens
CVQSTGNSR

SEQ ID NO: 157660 - protein, 9 aa, Homo Sapiens
SRSRSHSKS

SEQ ID NO: 157661 - protein, 9 aa, Homo Sapiens
RVGQVVYRS

SEQ ID NO: 157662 - protein, 9 aa, Homo Sapiens
ADVKGGTLN

SEQ ID NO: 157663 - protein, 9 aa, Homo Sapiens
KHKADSEEE

SEQ ID NO: 157664 - protein, 9 aa, Homo Sapiens
YGSYLENAF

SEQ ID NO: 157665 - protein, 9 aa, Homo Sapiens
VHAAMKTTT

SEQ ID NO: 157666 - protein, 9 aa, Homo Sapiens
PFCTLSAKH

SEQ ID NO: 157667 - protein, 9 aa, Homo Sapiens
ESSGHTMPT

SEQ ID NO: 157668 - protein, 9 aa, Homo Sapiens
KVIEKNSPF

SEQ ID NO: 157669 - protein, 9 aa, Homo Sapiens
PRLTEPDIY

SEQ ID NO: 157670 - protein, 9 aa, Homo Sapiens
VRVGQVVYR

SEQ ID NO: 157671 - protein, 9 aa, Homo Sapiens
LRCRDVTLN

SEQ ID NO: 157672 - protein, 9 aa, Homo Sapiens
SPRSCSPAH

SEQ ID NO: 157673 - protein, 9 aa, Homo Sapiens
GGVCERPAP

SEQ ID NO: 157674 - protein, 9 aa, Homo Sapiens
RRTAVDLCG

SEQ ID NO: 157675 - protein, 9 aa, Homo Sapiens
TSKAECMAE

SEQ ID NO: 157676 - protein, 9 aa, Homo Sapiens
HKGLAETPE

SEQ ID NO: 157677 - protein, 9 aa, Homo Sapiens
IPRPFTVRY

SEQ ID NO: 157678 - protein, 9 aa, Homo Sapiens
FRCRMPGAY

SEQ ID NO: 157679 - protein, 9 aa, Homo Sapiens
CLPDQPPPR

SEQ ID NO: 157680 - protein, 9 aa, Homo Sapiens
LRRRMERSA

SEQ ID NO: 157681 - protein, 9 aa, Homo Sapiens
QQGRLLIRH

SEQ ID NO: 157682 - protein, 9 aa, Homo Sapiens
VSHEQLAQL

SEQ ID NO: 157683 - protein, 9 aa, Homo Sapiens
HTCMEGSPE

SEQ ID NO: 157684 - protein, 9 aa, Homo Sapiens
FLTEMLAYS

SEQ ID NO: 157685 - protein, 9 aa, Homo Sapiens
HCQCVGMDW

SEQ ID NO: 157686 - protein, 9 aa, Homo Sapiens
LWRPDVKVL

SEQ ID NO: 157687 - protein, 9 aa, Homo Sapiens
GAQAVAEAG

SEQ ID NO: 157688 - protein, 9 aa, Homo Sapiens
GRLLIRHAY

SEQ ID NO: 157689 - protein, 9 aa, Homo Sapiens
RLGGADPGP

SEQ ID NO: 157690 - protein, 9 aa, Homo Sapiens
VNIDTLDTI

SEQ ID NO: 157691 - protein, 9 aa, Homo Sapiens
TVLGGMEVW

SEQ ID NO: 157692 - protein, 9 aa, Homo Sapiens
KFCKAQNFP

SEQ ID NO: 157693 - protein, 9 aa, Homo Sapiens
ALLDAELLG

SEQ ID NO: 157694 - protein, 9 aa, Homo Sapiens
IGMKPNLSQ

SEQ ID NO: 157695 - protein, 9 aa, Homo Sapiens
RTEIVCWFK

SEQ ID NO: 157696 - protein, 9 aa, Homo Sapiens
QKMFLEELM

SEQ ID NO: 157697 - protein, 9 aa, Homo Sapiens
LMLKEDSVS

SEQ ID NO: 157698 - protein, 9 aa, Homo Sapiens
PDGRSSSSL

SEQ ID NO: 157699 - protein, 9 aa, Homo Sapiens
CHCQCVGMD

SEQ ID NO: 157700 - protein, 9 aa, Homo Sapiens
QKQVESLAR

SEQ ID NO: 157701 - protein, 9 aa, Homo Sapiens
RSNSPRRPS

SEQ ID NO: 157702 - protein, 9 aa, Homo Sapiens
PEVEEEQQP

SEQ ID NO: 157703 - protein, 9 aa, Homo Sapiens
TAYTTGAET

SEQ ID NO: 157704 - protein, 9 aa, Homo Sapiens
CRPRGPPAA

SEQ ID NO: 157705 - protein, 9 aa, Homo Sapiens
TLFALSPGL

SEQ ID NO: 157706 - protein, 9 aa, Homo Sapiens
FPLLKFSKA

SEQ ID NO: 157707 - protein, 9 aa, Homo Sapiens
EASLLCQCP

SEQ ID NO: 157708 - protein, 9 aa, Homo Sapiens
GTLRGDELV

SEQ ID NO: 157709 - protein, 9 aa, Homo Sapiens
GPRWCACCV

SEQ ID NO: 157710 - protein, 9 aa, Homo Sapiens
YTLYTSDYT

SEQ ID NO: 157711 - protein, 9 aa, Homo Sapiens
PRRSWWRVP

SEQ ID NO: 157712 - protein, 9 aa, Homo Sapiens
PLAPPPPLP

SEQ ID NO: 157713 - protein, 9 aa, Homo Sapiens
LLVAPRPAP

SEQ ID NO: 157714 - protein, 9 aa, Homo Sapiens
TPDLKLAIV

SEQ ID NO: 157715 - protein, 9 aa, Homo Sapiens
AVHDAQCKQ

SEQ ID NO: 157716 - protein, 9 aa, Homo Sapiens
CPGYSGRPF

SEQ ID NO: 157717 - protein, 9 aa, Homo Sapiens
LCATTTCPG

SEQ ID NO: 157718 - protein, 9 aa, Homo Sapiens
DRFADQRAE

SEQ ID NO: 157719 - protein, 9 aa, Homo Sapiens
DKDPPKWKD

SEQ ID NO: 157720 - protein, 9 aa, Homo Sapiens
AHRVPAGSG

SEQ ID NO: 157721 - protein, 9 aa, Homo Sapiens
WPPPSVPGA

SEQ ID NO: 157722 - protein, 9 aa, Homo Sapiens
AASPRAAIW

SEQ ID NO: 157723 - protein, 9 aa, Homo Sapiens
LQPRPCPLA

SEQ ID NO: 157724 - protein, 9 aa, Homo Sapiens
TLEVSGSRC

SEQ ID NO: 157725 - protein, 9 aa, Homo Sapiens
PSKTEVHGR

SEQ ID NO: 157726 - protein, 9 aa, Homo Sapiens
ADPGPWQPS

SEQ ID NO: 157727 - protein, 9 aa, Homo Sapiens
DFTVINRCK

SEQ ID NO: 157728 - protein, 9 aa, Homo Sapiens
AQRGRDDDV

SEQ ID NO: 157729 - protein, 9 aa, Homo Sapiens
HKLCTKSPR

SEQ ID NO: 157730 - protein, 9 aa, Homo Sapiens
PAAALALWG

SEQ ID NO: 157731 - protein, 9 aa, Homo Sapiens
ITQVTSKLD

SEQ ID NO: 157732 - protein, 9 aa, Homo Sapiens
WNGGSNPHA

SEQ ID NO: 157733 - protein, 9 aa, Homo Sapiens
ERQKFLKYS

SEQ ID NO: 157734 - protein, 9 aa, Homo Sapiens
HKLLVTPPQ

SEQ ID NO: 157735 - protein, 9 aa, Homo Sapiens
HSHNKVLNP

SEQ ID NO: 157736 - protein, 9 aa, Homo Sapiens
VGIPDNKLD

SEQ ID NO: 157737 - protein, 9 aa, Homo Sapiens
YYQIFFDVD

SEQ ID NO: 157738 - protein, 9 aa, Homo Sapiens
LLVALLNIR

SEQ ID NO: 157739 - protein, 9 aa, Homo Sapiens
SPAEQANTV

SEQ ID NO: 157740 - protein, 9 aa, Homo Sapiens
LLKLGNGVE

SEQ ID NO: 157741 - protein, 9 aa, Homo Sapiens
ISSPASSQR

SEQ ID NO: 157742 - protein, 9 aa, Homo Sapiens
HIHTEPTGD

SEQ ID NO: 157743 - protein, 9 aa, Homo Sapiens
GDVEAIPHV

SEQ ID NO: 157744 - protein, 9 aa, Homo Sapiens
QVGMLFLLI

SEQ ID NO: 157745 - protein, 9 aa, Homo Sapiens
ISAKQRLSL

SEQ ID NO: 157746 - protein, 9 aa, Homo Sapiens
KRPTFPKIK

SEQ ID NO: 157747 - protein, 9 aa, Homo Sapiens
LRMHPSLEI

SEQ ID NO: 157748 - protein, 9 aa, Homo Sapiens
GVGKFPSLS

SEQ ID NO: 157749 - protein, 9 aa, Homo Sapiens
TNVNNWRWT

SEQ ID NO: 157750 - protein, 9 aa, Homo Sapiens
QHLKSQGPR

SEQ ID NO: 157751 - protein, 9 aa, Homo Sapiens
PPGPRYCVG

SEQ ID NO: 157752 - protein, 9 aa, Homo Sapiens
PLSDLPSLT

SEQ ID NO: 157753 - protein, 9 aa, Homo Sapiens
KHQLRHPLH

SEQ ID NO: 157754 - protein, 9 aa, Homo Sapiens
LGFYTSAMA

SEQ ID NO: 157755 - protein, 9 aa, Homo Sapiens
CIGNLTNAE

SEQ ID NO: 157756 - protein, 9 aa, Homo Sapiens
QLSLHILYL

SEQ ID NO: 157757 - protein, 9 aa, Homo Sapiens
FKSFHSWTS

SEQ ID NO: 157758 - protein, 9 aa, Homo Sapiens
AWDFNIDKA

SEQ ID NO: 157759 - protein, 9 aa, Homo Sapiens
STQWLMKLE

SEQ ID NO: 157760 - protein, 9 aa, Homo Sapiens
TMRLGPTQP

SEQ ID NO: 157761 - protein, 9 aa, Homo Sapiens
LIVYLMFPL

SEQ ID NO: 157762 - protein, 9 aa, Homo Sapiens
HGPLDQKIV

SEQ ID NO: 157763 - protein, 9 aa, Homo Sapiens
GRELSELVY

SEQ ID NO: 157764 - protein, 9 aa, Homo Sapiens
PPRLGYSIT

SEQ ID NO: 157765 - protein, 9 aa, Homo Sapiens
QWIRLHFQK

SEQ ID NO: 157766 - protein, 9 aa, Homo Sapiens
SPGVPRRQL

SEQ ID NO: 157767 - protein, 9 aa, Homo Sapiens
GVQAAATMP

SEQ ID NO: 157768 - protein, 9 aa, Homo Sapiens
PCSSTSTTS

SEQ ID NO: 157769 - protein, 9 aa, Homo Sapiens
LGPPKPCPD

SEQ ID NO: 157770 - protein, 9 aa, Homo Sapiens
MFPLLKFSK

SEQ ID NO: 157771 - protein, 9 aa, Homo Sapiens
PMPKKLISH

SEQ ID NO: 157772 - protein, 9 aa, Homo Sapiens
FCFRYVQEW

SEQ ID NO: 157773 - protein, 9 aa, Homo Sapiens
ARAGDLPCA

SEQ ID NO: 157774 - protein, 9 aa, Homo Sapiens
FSARQRLER

SEQ ID NO: 157775 - protein, 9 aa, Homo Sapiens
LDASPAGPL

SEQ ID NO: 157776 - protein, 9 aa, Homo Sapiens
RLGPTQPRP

SEQ ID NO: 157777 - protein, 9 aa, Homo Sapiens
RRQRASSAQ

SEQ ID NO: 157778 - protein, 9 aa, Homo Sapiens
RSGCVRSFA

SEQ ID NO: 157779 - protein, 9 aa, Homo Sapiens
TVWRLVPGC

SEQ ID NO: 157780 - protein, 9 aa, Homo Sapiens
TPWRKSGSG

SEQ ID NO: 157781 - protein, 9 aa, Homo Sapiens
LSVRALARF

SEQ ID NO: 157782 - protein, 9 aa, Homo Sapiens
RGKDQEERT

SEQ ID NO: 157783 - protein, 9 aa, Homo Sapiens
APYNVMVII

SEQ ID NO: 157784 - protein, 9 aa, Homo Sapiens
QLKSGTHLC

SEQ ID NO: 157785 - protein, 9 aa, Homo Sapiens
REEEERRLH

SEQ ID NO: 157786 - protein, 9 aa, Homo Sapiens
QRRRGGPGT

SEQ ID NO: 157787 - protein, 9 aa, Homo Sapiens
YLRCRDVTL

SEQ ID NO: 157788 - protein, 9 aa, Homo Sapiens
MVFLPEPGC

SEQ ID NO: 157789 - protein, 9 aa, Homo Sapiens
NGICRLKEL

SEQ ID NO: 157790 - protein, 9 aa, Homo Sapiens
QKFRCSSSE

SEQ ID NO: 157791 - protein, 9 aa, Homo Sapiens
DRNHISALG

SEQ ID NO: 157792 - protein, 9 aa, Homo Sapiens
SEAGAGAGG

SEQ ID NO: 157793 - protein, 9 aa, Homo Sapiens
VGAHQGPGH

SEQ ID NO: 157794 - protein, 9 aa, Homo Sapiens
LHPQPAPAG

SEQ ID NO: 157795 - protein, 9 aa, Homo Sapiens
LWQLLQGLR

SEQ ID NO: 157796 - protein, 9 aa, Homo Sapiens
FNNLKNCIY

SEQ ID NO: 157797 - protein, 9 aa, Homo Sapiens
DFLGEAGIT

SEQ ID NO: 157798 - protein, 9 aa, Homo Sapiens
FHSWTSCYG

SEQ ID NO: 157799 - protein, 9 aa, Homo Sapiens
SGSTASRAS

SEQ ID NO: 157800 - protein, 9 aa, Homo Sapiens
LSERCNALI

SEQ ID NO: 157801 - protein, 9 aa, Homo Sapiens
ASQSGQEPA

SEQ ID NO: 157802 - protein, 9 aa, Homo Sapiens
LHTSNSGGG

SEQ ID NO: 157803 - protein, 9 aa, Homo Sapiens
RLGPTRKEV

SEQ ID NO: 157804 - protein, 9 aa, Homo Sapiens
APSRPPTTP

SEQ ID NO: 157805 - protein, 9 aa, Homo Sapiens
AMMGAFLSL

SEQ ID NO: 157806 - protein, 9 aa, Homo Sapiens
LCRVSRYNQ

SEQ ID NO: 157807 - protein, 9 aa, Homo Sapiens
WGCWQPLHP

SEQ ID NO: 157808 - protein, 9 aa, Homo Sapiens
WGLLPGWGQ

SEQ ID NO: 157809 - protein, 9 aa, Homo Sapiens
PVIDQGGKI

SEQ ID NO: 157810 - protein, 9 aa, Homo Sapiens
GTQEHSITL

SEQ ID NO: 157811 - protein, 9 aa, Homo Sapiens
RHTQAYTQT

SEQ ID NO: 157812 - protein, 9 aa, Homo Sapiens
KMKDTPKRP

SEQ ID NO: 157813 - protein, 9 aa, Homo Sapiens
IPLFCTPFC

SEQ ID NO: 157814 - protein, 9 aa, Homo Sapiens
PCSPTTPSP

SEQ ID NO: 157815 - protein, 9 aa, Homo Sapiens
TGLPATSLC

SEQ ID NO: 157816 - protein, 9 aa, Homo Sapiens
PPSSTLTSG

SEQ ID NO: 157817 - protein, 9 aa, Homo Sapiens
LDRSHELEI

SEQ ID NO: 157818 - protein, 9 aa, Homo Sapiens
LKGIPLNLF

SEQ ID NO: 157819 - protein, 9 aa, Homo Sapiens
LILLWLLGS

SEQ ID NO: 157820 - protein, 9 aa, Homo Sapiens
EPGCLRPPP

SEQ ID NO: 157821 - protein, 9 aa, Homo Sapiens
VKNVTKPLN

SEQ ID NO: 157822 - protein, 9 aa, Homo Sapiens
MAEPPQMPN

SEQ ID NO: 157823 - protein, 9 aa, Homo Sapiens
GADVNAVTR

SEQ ID NO: 157824 - protein, 9 aa, Homo Sapiens
TGVPVCSGD

SEQ ID NO: 157825 - protein, 9 aa, Homo Sapiens
SRPVLKKTP

SEQ ID NO: 157826 - protein, 9 aa, Homo Sapiens
VLRTLHKPA

SEQ ID NO: 157827 - protein, 9 aa, Homo Sapiens
PNLLPAPSA

SEQ ID NO: 157828 - protein, 9 aa, Homo Sapiens
PEPPPQVPV

SEQ ID NO: 157829 - protein, 9 aa, Homo Sapiens
GDLPCDWRR

SEQ ID NO: 157830 - protein, 9 aa, Homo Sapiens
CGTYSSCRK

SEQ ID NO: 157831 - protein, 9 aa, Homo Sapiens
SCKLTICPQ

SEQ ID NO: 157832 - protein, 9 aa, Homo Sapiens
YMHGGKKNG

SEQ ID NO: 157833 - protein, 9 aa, Homo Sapiens
LTAPGVCWP

SEQ ID NO: 157834 - protein, 9 aa, Homo Sapiens
EEEIAVDKG

SEQ ID NO: 157835 - protein, 9 aa, Homo Sapiens
ENIKEMSLQ

SEQ ID NO: 157836 - protein, 9 aa, Homo Sapiens
LHEAYCLQF

SEQ ID NO: 157837 - protein, 9 aa, Homo Sapiens
PLPCSPPLL

SEQ ID NO: 157838 - protein, 9 aa, Homo Sapiens
PLAFEALNL

SEQ ID NO: 157839 - protein, 9 aa, Homo Sapiens
SYGFGGARS

SEQ ID NO: 157840 - protein, 9 aa, Homo Sapiens
AELALVGPH

SEQ ID NO: 157841 - protein, 9 aa, Homo Sapiens
AAGQRREHV

SEQ ID NO: 157842 - protein, 9 aa, Homo Sapiens
TQMDLGDCI

SEQ ID NO: 157843 - protein, 9 aa, Homo Sapiens
KRAAGQRRE

SEQ ID NO: 157844 - protein, 9 aa, Homo Sapiens
CKDISQVLR

SEQ ID NO: 157845 - protein, 9 aa, Homo Sapiens
CPTATAACP

SEQ ID NO: 157846 - protein, 9 aa, Homo Sapiens
GDYHVTFYF

SEQ ID NO: 157847 - protein, 9 aa, Homo Sapiens
ITQAKDIDP

SEQ ID NO: 157848 - protein, 9 aa, Homo Sapiens
IQLFTTHFL

SEQ ID NO: 157849 - protein, 9 aa, Homo Sapiens
GITGQFSHH

SEQ ID NO: 157850 - protein, 9 aa, Homo Sapiens
RRPRPPCSS

SEQ ID NO: 157851 - protein, 9 aa, Homo Sapiens
TLRTRSIFV

SEQ ID NO: 157852 - protein, 9 aa, Homo Sapiens
SIIGMINMF

SEQ ID NO: 157853 - protein, 9 aa, Homo Sapiens
APIGRAQTT

SEQ ID NO: 157854 - protein, 9 aa, Homo Sapiens
GPEAPSTRA

SEQ ID NO: 157855 - protein, 9 aa, Homo Sapiens
FQDTDEKFM

SEQ ID NO: 157856 - protein, 9 aa, Homo Sapiens
PDDINSAAK

SEQ ID NO: 157857 - protein, 9 aa, Homo Sapiens
AKLPCYEAL

SEQ ID NO: 157858 - protein, 9 aa, Homo Sapiens
FAGPFSNQT

SEQ ID NO: 157859 - protein, 9 aa, Homo Sapiens
RSEGGPPRP

SEQ ID NO: 157860 - protein, 9 aa, Homo Sapiens
LWLFEYHQS

SEQ ID NO: 157861 - protein, 9 aa, Homo Sapiens
RLLVSRPPS

SEQ ID NO: 157862 - protein, 9 aa, Homo Sapiens
WRTGLACGL

SEQ ID NO: 157863 - protein, 9 aa, Homo Sapiens
KVTCFYRPA

SEQ ID NO: 157864 - protein, 9 aa, Homo Sapiens
LHLLLHPCL

SEQ ID NO: 157865 - protein, 9 aa, Homo Sapiens
GLNAWNGFS

SEQ ID NO: 157866 - protein, 9 aa, Homo Sapiens
IIFSIHQPQ

SEQ ID NO: 157867 - protein, 9 aa, Homo Sapiens
HLRCTHHLL

SEQ ID NO: 157868 - protein, 9 aa, Homo Sapiens
HLVFLGLKP

SEQ ID NO: 157869 - protein, 9 aa, Homo Sapiens
WDFNIDKAR

SEQ ID NO: 157870 - protein, 9 aa, Homo Sapiens
RGDPGVIKQ

SEQ ID NO: 157871 - protein, 9 aa, Homo Sapiens
EAGARAARA

SEQ ID NO: 157872 - protein, 9 aa, Homo Sapiens
QNGLPSEGQ

SEQ ID NO: 157873 - protein, 9 aa, Homo Sapiens
GLPPGLLVL

SEQ ID NO: 157874 - protein, 9 aa, Homo Sapiens
LLVTPPQGP

SEQ ID NO: 157875 - protein, 9 aa, Homo Sapiens
LLLIALPSL

SEQ ID NO: 157876 - protein, 9 aa, Homo Sapiens
ERMRSVHLQ

SEQ ID NO: 157877 - protein, 9 aa, Homo Sapiens
PARRHSHTR

SEQ ID NO: 157878 - protein, 9 aa, Homo Sapiens
ALPTQQLAW

SEQ ID NO: 157879 - protein, 9 aa, Homo Sapiens
LHIQKTGAP

SEQ ID NO: 157880 - protein, 9 aa, Homo Sapiens
PGPPCRPPR

SEQ ID NO: 157881 - protein, 9 aa, Homo Sapiens
TSTSDSEEG

SEQ ID NO: 157882 - protein, 9 aa, Homo Sapiens
PPRRGSSQG

SEQ ID NO: 157883 - protein, 9 aa, Homo Sapiens
RASQPSSSV

SEQ ID NO: 157884 - protein, 9 aa, Homo Sapiens
MVALNSCTM

SEQ ID NO: 157885 - protein, 9 aa, Homo Sapiens
RPRPASQSG

SEQ ID NO: 157886 - protein, 9 aa, Homo Sapiens
ATRKPPTPK

SEQ ID NO: 157887 - protein, 9 aa, Homo Sapiens
AVTHSTHSA

SEQ ID NO: 157888 - protein, 9 aa, Homo Sapiens
TGQFRCRMP

SEQ ID NO: 157889 - protein, 9 aa, Homo Sapiens
PLGGKRATP

SEQ ID NO: 157890 - protein, 9 aa, Homo Sapiens
AVHQDVKAN

SEQ ID NO: 157891 - protein, 9 aa, Homo Sapiens
DVIAKMPMD

SEQ ID NO: 157892 - protein, 9 aa, Homo Sapiens
KVFVWPISS

SEQ ID NO: 157893 - protein, 9 aa, Homo Sapiens
EDQGPPLVL

SEQ ID NO: 157894 - protein, 9 aa, Homo Sapiens
GGLYIFCQE

SEQ ID NO: 157895 - protein, 9 aa, Homo Sapiens
LSPCLTCLE

SEQ ID NO: 157896 - protein, 9 aa, Homo Sapiens
GDDEEMVQR

SEQ ID NO: 157897 - protein, 9 aa, Homo Sapiens
GFVYRDCQS

SEQ ID NO: 157898 - protein, 9 aa, Homo Sapiens
PFWQLEAAA

SEQ ID NO: 157899 - protein, 9 aa, Homo Sapiens
GLLDYIDRL

SEQ ID NO: 157900 - protein, 9 aa, Homo Sapiens
PASSTSRST

SEQ ID NO: 157901 - protein, 9 aa, Homo Sapiens
DLTGQKRAG

SEQ ID NO: 157902 - protein, 9 aa, Homo Sapiens
LFLPPLQPQ

SEQ ID NO: 157903 - protein, 9 aa, Homo Sapiens
TLRRHRVCP

SEQ ID NO: 157904 - protein, 9 aa, Homo Sapiens
GHGPWAARP

SEQ ID NO: 157905 - protein, 9 aa, Homo Sapiens
SSCSTSCGT

SEQ ID NO: 157906 - protein, 9 aa, Homo Sapiens
VNEDFLWND

SEQ ID NO: 157907 - protein, 9 aa, Homo Sapiens
PPMRVCPSP

SEQ ID NO: 157908 - protein, 9 aa, Homo Sapiens
SPRSRGSPR

SEQ ID NO: 157909 - protein, 9 aa, Homo Sapiens
TKESHPTSP

SEQ ID NO: 157910 - protein, 9 aa, Homo Sapiens
CGAASPPAR

SEQ ID NO: 157911 - protein, 9 aa, Homo Sapiens
KGQSLRCLP

SEQ ID NO: 157912 - protein, 9 aa, Homo Sapiens
VIAGSLLRN

SEQ ID NO: 157913 - protein, 9 aa, Homo Sapiens
ARPRRTRSA

SEQ ID NO: 157914 - protein, 9 aa, Homo Sapiens
RQRLERAVS

SEQ ID NO: 157915 - protein, 9 aa, Homo Sapiens
RVLFHSSGD

SEQ ID NO: 157916 - protein, 9 aa, Homo Sapiens
VFLLGLWEN

SEQ ID NO: 157917 - protein, 9 aa, Homo Sapiens
GWQAGASGQ

SEQ ID NO: 157918 - protein, 9 aa, Homo Sapiens
AGASAPLWA

SEQ ID NO: 157919 - protein, 9 aa, Homo Sapiens
HLSKFMSCV

SEQ ID NO: 157920 - protein, 9 aa, Homo Sapiens
DQLLILKAF

SEQ ID NO: 157921 - protein, 9 aa, Homo Sapiens
CQSGERSTR

SEQ ID NO: 157922 - protein, 9 aa, Homo Sapiens
EGFPPQPSS

SEQ ID NO: 157923 - protein, 9 aa, Homo Sapiens
VSRAVVFLT

SEQ ID NO: 157924 - protein, 9 aa, Homo Sapiens
DDQGPWRPL

SEQ ID NO: 157925 - protein, 9 aa, Homo Sapiens
QDKNLVINK

SEQ ID NO: 157926 - protein, 9 aa, Homo Sapiens
IRVQSIEFN

SEQ ID NO: 157927 - protein, 9 aa, Homo Sapiens
RKFFRLIMD

SEQ ID NO: 157928 - protein, 9 aa, Homo Sapiens
IYKASNTMA

SEQ ID NO: 157929 - protein, 9 aa, Homo Sapiens
LHTAGTQNC

SEQ ID NO: 157930 - protein, 9 aa, Homo Sapiens
LLDLPILDD

SEQ ID NO: 157931 - protein, 9 aa, Homo Sapiens
RLFECGQGD

SEQ ID NO: 157932 - protein, 9 aa, Homo Sapiens
LEALTGQGM

SEQ ID NO: 157933 - protein, 9 aa, Homo Sapiens
PSTGVPLVM

SEQ ID NO: 157934 - protein, 9 aa, Homo Sapiens
EGEEEKKEE

SEQ ID NO: 157935 - protein, 9 aa, Homo Sapiens
PFTVRYDPY

SEQ ID NO: 157936 - protein, 9 aa, Homo Sapiens
STARSRGAP

SEQ ID NO: 157937 - protein, 9 aa, Homo Sapiens
VALSTNIMD

SEQ ID NO: 157938 - protein, 9 aa, Homo Sapiens
ACQGVYLWL

SEQ ID NO: 157939 - protein, 9 aa, Homo Sapiens
QSKLSSGAP

SEQ ID NO: 157940 - protein, 9 aa, Homo Sapiens
NLSPLFPPL

SEQ ID NO: 157941 - protein, 9 aa, Homo Sapiens
RRACVVHML

SEQ ID NO: 157942 - protein, 9 aa, Homo Sapiens
AVVFLTFLE

SEQ ID NO: 157943 - protein, 9 aa, Homo Sapiens
ICTRYTPKQ

SEQ ID NO: 157944 - protein, 9 aa, Homo Sapiens
WWQGRGGEG

SEQ ID NO: 157945 - protein, 9 aa, Homo Sapiens
SLRGMVPRT

SEQ ID NO: 157946 - protein, 9 aa, Homo Sapiens
SKFETQEDI

SEQ ID NO: 157947 - protein, 9 aa, Homo Sapiens
AGGPRKGSP

SEQ ID NO: 157948 - protein, 9 aa, Homo Sapiens
VDTERALLY

SEQ ID NO: 157949 - protein, 9 aa, Homo Sapiens
WLSTTTMRL

SEQ ID NO: 157950 - protein, 9 aa, Homo Sapiens
ISHPETVDS

SEQ ID NO: 157951 - protein, 9 aa, Homo Sapiens
GGTLNMKAN

SEQ ID NO: 157952 - protein, 9 aa, Homo Sapiens
DAVLKEGLS

SEQ ID NO: 157953 - protein, 9 aa, Homo Sapiens
GRAGGPFQP

SEQ ID NO: 157954 - protein, 9 aa, Homo Sapiens
IGGLRRSSP

SEQ ID NO: 157955 - protein, 9 aa, Homo Sapiens
KKEAPLWRV

SEQ ID NO: 157956 - protein, 9 aa, Homo Sapiens
KDSIMYREV

SEQ ID NO: 157957 - protein, 9 aa, Homo Sapiens
GKDGRVAVP

SEQ ID NO: 157958 - protein, 9 aa, Homo Sapiens
DDLNVHSLL

SEQ ID NO: 157959 - protein, 9 aa, Homo Sapiens
GEISSCDYA

SEQ ID NO: 157960 - protein, 9 aa, Homo Sapiens
ELIVREKPF

SEQ ID NO: 157961 - protein, 9 aa, Homo Sapiens
LHGWLQETH

SEQ ID NO: 157962 - protein, 9 aa, Homo Sapiens
AAALALDVA

SEQ ID NO: 157963 - protein, 9 aa, Homo Sapiens
IEVAQVLVT

SEQ ID NO: 157964 - protein, 9 aa, Homo Sapiens
RPGASGVPG

SEQ ID NO: 157965 - protein, 9 aa, Homo Sapiens
RRAQKTRSL

SEQ ID NO: 157966 - protein, 9 aa, Homo Sapiens
GSDKSAFIR

SEQ ID NO: 157967 - protein, 9 aa, Homo Sapiens
FHLPEYTWH

SEQ ID NO: 157968 - protein, 9 aa, Homo Sapiens
IFASLHVSG

SEQ ID NO: 157969 - protein, 9 aa, Homo Sapiens
VSKKRLPKL

SEQ ID NO: 157970 - protein, 9 aa, Homo Sapiens
HMSASTGTE

SEQ ID NO: 157971 - protein, 9 aa, Homo Sapiens
SYPKRLGRL

SEQ ID NO: 157972 - protein, 9 aa, Homo Sapiens
RVPPGEQQC

SEQ ID NO: 157973 - protein, 9 aa, Homo Sapiens
SAAHGPPLA

SEQ ID NO: 157974 - protein, 9 aa, Homo Sapiens
MHGGKKNGI

SEQ ID NO: 157975 - protein, 9 aa, Homo Sapiens
SSQGCREGR

SEQ ID NO: 157976 - protein, 9 aa, Homo Sapiens
KKFGLPPAQ

SEQ ID NO: 157977 - protein, 9 aa, Homo Sapiens
SSPSATNSE

SEQ ID NO: 157978 - protein, 9 aa, Homo Sapiens
GGQPRLTEP

SEQ ID NO: 157979 - protein, 9 aa, Homo Sapiens
KLAKPPQPS

SEQ ID NO: 157980 - protein, 9 aa, Homo Sapiens
THPRTATSL

SEQ ID NO: 157981 - protein, 9 aa, Homo Sapiens
VYLMFPLLK

SEQ ID NO: 157982 - protein, 9 aa, Homo Sapiens
VVIPDAVLK

SEQ ID NO: 157983 - protein, 9 aa, Homo Sapiens
RVLSDCKVC

SEQ ID NO: 157984 - protein, 9 aa, Homo Sapiens
AATDDDEEM

SEQ ID NO: 157985 - protein, 9 aa, Homo Sapiens
CTPASGPSP

SEQ ID NO: 157986 - protein, 9 aa, Homo Sapiens
LIHPATTFP

SEQ ID NO: 157987 - protein, 9 aa, Homo Sapiens
DVNESNVYM

SEQ ID NO: 157988 - protein, 9 aa, Homo Sapiens
SGDILTGFL

SEQ ID NO: 157989 - protein, 9 aa, Homo Sapiens
LVNAVATRT

SEQ ID NO: 157990 - protein, 9 aa, Homo Sapiens
LFSLPPDVL

SEQ ID NO: 157991 - protein, 9 aa, Homo Sapiens
KKQPFFMTL

SEQ ID NO: 157992 - protein, 9 aa, Homo Sapiens
CHKSIISHT

SEQ ID NO: 157993 - protein, 9 aa, Homo Sapiens
FLIMTTKKS

SEQ ID NO: 157994 - protein, 9 aa, Homo Sapiens
TNSRLYESL

SEQ ID NO: 157995 - protein, 9 aa, Homo Sapiens
PYTVRAGDE

SEQ ID NO: 157996 - protein, 9 aa, Homo Sapiens
TPILFHIQH

SEQ ID NO: 157997 - protein, 9 aa, Homo Sapiens
EGVQAAATM

SEQ ID NO: 157998 - protein, 9 aa, Homo Sapiens
HLHLVMLHL

SEQ ID NO: 157999 - protein, 9 aa, Homo Sapiens
TAMSVETCL

SEQ ID NO: 158000 - protein, 9 aa, Homo Sapiens
PKDANSRAD

SEQ ID NO: 158001 - protein, 9 aa, Homo Sapiens
AFAVSPNHR

SEQ ID NO: 158002 - protein, 9 aa, Homo Sapiens
GGLQLGQLG

SEQ ID NO: 158003 - protein, 9 aa, Homo Sapiens
GVPRRQLPQ

SEQ ID NO: 158004 - protein, 9 aa, Homo Sapiens
STAACAESA

SEQ ID NO: 158005 - protein, 9 aa, Homo Sapiens
KYTELIAVN

SEQ ID NO: 158006 - protein, 9 aa, Homo Sapiens
RVPAGSGSF

SEQ ID NO: 158007 - protein, 9 aa, Homo Sapiens
LGQLGVGIL

SEQ ID NO: 158008 - protein, 9 aa, Homo Sapiens
LGPGALLDA

SEQ ID NO: 158009 - protein, 9 aa, Homo Sapiens
PFQSCKNSY

SEQ ID NO: 158010 - protein, 9 aa, Homo Sapiens
HRPICRKEC

SEQ ID NO: 158011 - protein, 9 aa, Homo Sapiens
QTLEMTRRD

SEQ ID NO: 158012 - protein, 9 aa, Homo Sapiens
PLPCVLPHV

SEQ ID NO: 158013 - protein, 9 aa, Homo Sapiens
TTGLLVHFL

SEQ ID NO: 158014 - protein, 9 aa, Homo Sapiens
DEEMVQRWA

SEQ ID NO: 158015 - protein, 9 aa, Homo Sapiens
QCRCANTRP

SEQ ID NO: 158016 - protein, 9 aa, Homo Sapiens
PPQTLEMTR

SEQ ID NO: 158017 - protein, 9 aa, Homo Sapiens
PLRGKQLCV

SEQ ID NO: 158018 - protein, 9 aa, Homo Sapiens
KGRIYSRAA

SEQ ID NO: 158019 - protein, 9 aa, Homo Sapiens
KKKPRLLVS

SEQ ID NO: 158020 - protein, 9 aa, Homo Sapiens
PAPGSSVLW

SEQ ID NO: 158021 - protein, 9 aa, Homo Sapiens
TCSDIWQVL

SEQ ID NO: 158022 - protein, 9 aa, Homo Sapiens
EMDMWSTQD

SEQ ID NO: 158023 - protein, 9 aa, Homo Sapiens
SRLYESLTY

SEQ ID NO: 158024 - protein, 9 aa, Homo Sapiens
TCFYRPAPY

SEQ ID NO: 158025 - protein, 9 aa, Homo Sapiens
TLHEAYCLQ

SEQ ID NO: 158026 - protein, 9 aa, Homo Sapiens
TGDPHCRHP

SEQ ID NO: 158027 - protein, 9 aa, Homo Sapiens
SAWRRPSGP

SEQ ID NO: 158028 - protein, 9 aa, Homo Sapiens
GTLCPGGRP

SEQ ID NO: 158029 - protein, 9 aa, Homo Sapiens
HRDRMVKHQ

SEQ ID NO: 158030 - protein, 9 aa, Homo Sapiens
CRAPSLRTR

SEQ ID NO: 158031 - protein, 9 aa, Homo Sapiens
LLGLDDHLA

SEQ ID NO: 158032 - protein, 9 aa, Homo Sapiens
TTTCKGSTP

SEQ ID NO: 158033 - protein, 9 aa, Homo Sapiens
TVWTTSWCG

SEQ ID NO: 158034 - protein, 9 aa, Homo Sapiens
PSAAQGSVM

SEQ ID NO: 158035 - protein, 9 aa, Homo Sapiens
QRGPRPLHR

SEQ ID NO: 158036 - protein, 9 aa, Homo Sapiens
ENSTQWLMK

SEQ ID NO: 158037 - protein, 9 aa, Homo Sapiens
IMPSSPRWR

SEQ ID NO: 158038 - protein, 9 aa, Homo Sapiens
RGAADDRVH

SEQ ID NO: 158039 - protein, 9 aa, Homo Sapiens
EQGYVPDHG

SEQ ID NO: 158040 - protein, 9 aa, Homo Sapiens
LTKHAIVQT

SEQ ID NO: 158041 - protein, 9 aa, Homo Sapiens
RTSHPCRWF

SEQ ID NO: 158042 - protein, 9 aa, Homo Sapiens
KTPDKKSIE

SEQ ID NO: 158043 - protein, 9 aa, Homo Sapiens
LQLGQLGVG

SEQ ID NO: 158044 - protein, 9 aa, Homo Sapiens
GSSVLWLSQ

SEQ ID NO: 158045 - protein, 9 aa, Homo Sapiens
AVMLRMPES

SEQ ID NO: 158046 - protein, 9 aa, Homo Sapiens
TSCYGKKIW

SEQ ID NO: 158047 - protein, 9 aa, Homo Sapiens
QVWTAATLR

SEQ ID NO: 158048 - protein, 9 aa, Homo Sapiens
RLYNGHTLP

SEQ ID NO: 158049 - protein, 9 aa, Homo Sapiens
ARSSCWPPG

SEQ ID NO: 158050 - protein, 9 aa, Homo Sapiens
GPRKGSPGC

SEQ ID NO: 158051 - protein, 9 aa, Homo Sapiens
SSESESSSK

SEQ ID NO: 158052 - protein, 9 aa, Homo Sapiens
GLQIFIQVF

SEQ ID NO: 158053 - protein, 9 aa, Homo Sapiens
KVLRWIIEV

SEQ ID NO: 158054 - protein, 9 aa, Homo Sapiens
RGRLPRHPR

SEQ ID NO: 158055 - protein, 9 aa, Homo Sapiens
VAVQVVRAR

SEQ ID NO: 158056 - protein, 9 aa, Homo Sapiens
EQRGRLLVL

SEQ ID NO: 158057 - protein, 9 aa, Homo Sapiens
KASYLFPQD

SEQ ID NO: 158058 - protein, 9 aa, Homo Sapiens
KQNVEKEAQ

SEQ ID NO: 158059 - protein, 9 aa, Homo Sapiens
RVNDALNTT

SEQ ID NO: 158060 - protein, 9 aa, Homo Sapiens
NECLDPGVP

SEQ ID NO: 158061 - protein, 9 aa, Homo Sapiens
VLLAPATPP

SEQ ID NO: 158062 - protein, 9 aa, Homo Sapiens
SPGHLSPRL

SEQ ID NO: 158063 - protein, 9 aa, Homo Sapiens
KKVQGHPAH

SEQ ID NO: 158064 - protein, 9 aa, Homo Sapiens
RTRSIFVSI

SEQ ID NO: 158065 - protein, 9 aa, Homo Sapiens
TRSSSRTAC

SEQ ID NO: 158066 - protein, 9 aa, Homo Sapiens
LLHFQRKLS

SEQ ID NO: 158067 - protein, 9 aa, Homo Sapiens
QSLTPNARG

SEQ ID NO: 158068 - protein, 9 aa, Homo Sapiens
GPAIQPGPR

SEQ ID NO: 158069 - protein, 9 aa, Homo Sapiens
HSLLCLLRH

SEQ ID NO: 158070 - protein, 9 aa, Homo Sapiens
LITVTALTF

SEQ ID NO: 158071 - protein, 9 aa, Homo Sapiens
EMSLQSLAK

SEQ ID NO: 158072 - protein, 9 aa, Homo Sapiens
LHKGAKHKG

SEQ ID NO: 158073 - protein, 9 aa, Homo Sapiens
KPGAQIYMC

SEQ ID NO: 158074 - protein, 9 aa, Homo Sapiens
IPDNKLDAD

SEQ ID NO: 158075 - protein, 9 aa, Homo Sapiens
DGKDKGNVL

SEQ ID NO: 158076 - protein, 9 aa, Homo Sapiens
PQSPGMRRM

SEQ ID NO: 158077 - protein, 9 aa, Homo Sapiens
ECFLYIVMS

SEQ ID NO: 158078 - protein, 9 aa, Homo Sapiens
GLTPPNAAV

SEQ ID NO: 158079 - protein, 9 aa, Homo Sapiens
CFAATVHPA

SEQ ID NO: 158080 - protein, 9 aa, Homo Sapiens
RQELWQLLQ

SEQ ID NO: 158081 - protein, 9 aa, Homo Sapiens
MDKAVDDIL

SEQ ID NO: 158082 - protein, 9 aa, Homo Sapiens
AAFAAQRVP

SEQ ID NO: 158083 - protein, 9 aa, Homo Sapiens
SLPVKKKRR

SEQ ID NO: 158084 - protein, 9 aa, Homo Sapiens
QLTASLTVA

SEQ ID NO: 158085 - protein, 9 aa, Homo Sapiens
NELLQANRL

SEQ ID NO: 158086 - protein, 9 aa, Homo Sapiens
NESNVYMVT

SEQ ID NO: 158087 - protein, 9 aa, Homo Sapiens
HLPRPFHLH

SEQ ID NO: 158088 - protein, 9 aa, Homo Sapiens
LGVRAASTE

SEQ ID NO: 158089 - protein, 9 aa, Homo Sapiens
EAYHGVFVN

SEQ ID NO: 158090 - protein, 9 aa, Homo Sapiens
IRAKMLHRI

SEQ ID NO: 158091 - protein, 9 aa, Homo Sapiens
THTLALTAK

SEQ ID NO: 158092 - protein, 9 aa, Homo Sapiens
DLPCDWRRA

SEQ ID NO: 158093 - protein, 9 aa, Homo Sapiens
TVINRCKKV

SEQ ID NO: 158094 - protein, 9 aa, Homo Sapiens
VPRQLPGPH

SEQ ID NO: 158095 - protein, 9 aa, Homo Sapiens
ARRHSHTRG

SEQ ID NO: 158096 - protein, 9 aa, Homo Sapiens
SPLLLLPPM

SEQ ID NO: 158097 - protein, 9 aa, Homo Sapiens
KMEKRLCKM

SEQ ID NO: 158098 - protein, 9 aa, Homo Sapiens
TSPGAPRSP

SEQ ID NO: 158099 - protein, 9 aa, Homo Sapiens
LPLMTLTSS

SEQ ID NO: 158100 - protein, 9 aa, Homo Sapiens
SSHSQNEIS

SEQ ID NO: 158101 - protein, 9 aa, Homo Sapiens
VWGPAIQPG

SEQ ID NO: 158102 - protein, 9 aa, Homo Sapiens
GTAGGGGSW

SEQ ID NO: 158103 - protein, 9 aa, Homo Sapiens
WVGDDGEAG

SEQ ID NO: 158104 - protein, 9 aa, Homo Sapiens
GDYAQLSLH

SEQ ID NO: 158105 - protein, 9 aa, Homo Sapiens
KFNLRLITR

SEQ ID NO: 158106 - protein, 9 aa, Homo Sapiens
YEWNLESLN

SEQ ID NO: 158107 - protein, 9 aa, Homo Sapiens
HPLQDSLPA

SEQ ID NO: 158108 - protein, 9 aa, Homo Sapiens
VLVHADSQG

SEQ ID NO: 158109 - protein, 9 aa, Homo Sapiens
QDTYEFFTS

SEQ ID NO: 158110 - protein, 9 aa, Homo Sapiens
HNFSRSDHL

SEQ ID NO: 158111 - protein, 9 aa, Homo Sapiens
LGSRMAHPR

SEQ ID NO: 158112 - protein, 9 aa, Homo Sapiens
HPLPFQNTG

SEQ ID NO: 158113 - protein, 9 aa, Homo Sapiens
RIGRAGGPF

SEQ ID NO: 158114 - protein, 9 aa, Homo Sapiens
EYYMQQEVI

SEQ ID NO: 158115 - protein, 9 aa, Homo Sapiens
RPKTAAAEE

SEQ ID NO: 158116 - protein, 9 aa, Homo Sapiens
RTPWTLNPQ

SEQ ID NO: 158117 - protein, 9 aa, Homo Sapiens
TELAAIDLD

SEQ ID NO: 158118 - protein, 9 aa, Homo Sapiens
YCPARPGQQ

SEQ ID NO: 158119 - protein, 9 aa, Homo Sapiens
LSDKDPPKW

SEQ ID NO: 158120 - protein, 9 aa, Homo Sapiens
SILCRGGHL

SEQ ID NO: 158121 - protein, 9 aa, Homo Sapiens
WGAWHPGSW

SEQ ID NO: 158122 - protein, 9 aa, Homo Sapiens
FLSIHLIWK

SEQ ID NO: 158123 - protein, 9 aa, Homo Sapiens
RRQIYAGAT

SEQ ID NO: 158124 - protein, 9 aa, Homo Sapiens
LDLDPLLGV

SEQ ID NO: 158125 - protein, 9 aa, Homo Sapiens
DVFICDNKS

SEQ ID NO: 158126 - protein, 9 aa, Homo Sapiens
RAVGTALVA

SEQ ID NO: 158127 - protein, 9 aa, Homo Sapiens
PAPRPLPSP

SEQ ID NO: 158128 - protein, 9 aa, Homo Sapiens
VWLEELRRL

SEQ ID NO: 158129 - protein, 9 aa, Homo Sapiens
NIPHAKREL

SEQ ID NO: 158130 - protein, 9 aa, Homo Sapiens
EKQKQHIHI

SEQ ID NO: 158131 - protein, 9 aa, Homo Sapiens
FSILHVPKV

SEQ ID NO: 158132 - protein, 9 aa, Homo Sapiens
TEQHPREQR

SEQ ID NO: 158133 - protein, 9 aa, Homo Sapiens
HKSMKDHSS

SEQ ID NO: 158134 - protein, 9 aa, Homo Sapiens
VIPDAVLKE

SEQ ID NO: 158135 - protein, 9 aa, Homo Sapiens
SWRRMEVSC

SEQ ID NO: 158136 - protein, 9 aa, Homo Sapiens
CKNSYIKLS

SEQ ID NO: 158137 - protein, 9 aa, Homo Sapiens
KSWISVPCP

SEQ ID NO: 158138 - protein, 9 aa, Homo Sapiens
GLLPECFRH

SEQ ID NO: 158139 - protein, 9 aa, Homo Sapiens
LMAADRAWG

SEQ ID NO: 158140 - protein, 9 aa, Homo Sapiens
LRTHSLSRN

SEQ ID NO: 158141 - protein, 9 aa, Homo Sapiens
AVQTGKYKA

SEQ ID NO: 158142 - protein, 9 aa, Homo Sapiens
SLRQADALQ

SEQ ID NO: 158143 - protein, 9 aa, Homo Sapiens
PGVAGDVEA

SEQ ID NO: 158144 - protein, 9 aa, Homo Sapiens
WSIPQAGAR

SEQ ID NO: 158145 - protein, 9 aa, Homo Sapiens
DAFNLASAY

SEQ ID NO: 158146 - protein, 9 aa, Homo Sapiens
HTHRHTGMH

SEQ ID NO: 158147 - protein, 9 aa, Homo Sapiens
YVYRECGRG

SEQ ID NO: 158148 - protein, 9 aa, Homo Sapiens
SGIMVGKRG

SEQ ID NO: 158149 - protein, 9 aa, Homo Sapiens
VPAPAYRSV

SEQ ID NO: 158150 - protein, 9 aa, Homo Sapiens
HQPGDPSSG

SEQ ID NO: 158151 - protein, 9 aa, Homo Sapiens
LPADLPHSS

SEQ ID NO: 158152 - protein, 9 aa, Homo Sapiens
KGIPLNLFN

SEQ ID NO: 158153 - protein, 9 aa, Homo Sapiens
QCRRAGRAA

SEQ ID NO: 158154 - protein, 9 aa, Homo Sapiens
LSLLPDTSC

SEQ ID NO: 158155 - protein, 9 aa, Homo Sapiens
STEKKHSHK

SEQ ID NO: 158156 - protein, 9 aa, Homo Sapiens
GHLCLYCDK

SEQ ID NO: 158157 - protein, 9 aa, Homo Sapiens
WNCAWEPAR

SEQ ID NO: 158158 - protein, 9 aa, Homo Sapiens
QLSVRALAR

SEQ ID NO: 158159 - protein, 9 aa, Homo Sapiens
VKVPSGVQV

SEQ ID NO: 158160 - protein, 9 aa, Homo Sapiens
WPHVLSVFE

SEQ ID NO: 158161 - protein, 9 aa, Homo Sapiens
YFEFETVLA

SEQ ID NO: 158162 - protein, 9 aa, Homo Sapiens
QVDYILATW

SEQ ID NO: 158163 - protein, 9 aa, Homo Sapiens
EEVFFSAKC

SEQ ID NO: 158164 - protein, 9 aa, Homo Sapiens
HRWAALLHY

SEQ ID NO: 158165 - protein, 9 aa, Homo Sapiens
VINRCKKVA

SEQ ID NO: 158166 - protein, 9 aa, Homo Sapiens
ATTTCPGPS

SEQ ID NO: 158167 - protein, 9 aa, Homo Sapiens
SFQPASSHH

SEQ ID NO: 158168 - protein, 9 aa, Homo Sapiens
SPETGLRQG

SEQ ID NO: 158169 - protein, 9 aa, Homo Sapiens
SFNIPHAKR

SEQ ID NO: 158170 - protein, 9 aa, Homo Sapiens
GGGGSGSAG

SEQ ID NO: 158171 - protein, 9 aa, Homo Sapiens
VLLGPLQGG

SEQ ID NO: 158172 - protein, 9 aa, Homo Sapiens
ANWERERTN

SEQ ID NO: 158173 - protein, 9 aa, Homo Sapiens
GGRRLPARL

SEQ ID NO: 158174 - protein, 9 aa, Homo Sapiens
GAGKSETCG

SEQ ID NO: 158175 - protein, 9 aa, Homo Sapiens
VHSLEGPIE

SEQ ID NO: 158176 - protein, 9 aa, Homo Sapiens
EEPRKGLWE

SEQ ID NO: 158177 - protein, 9 aa, Homo Sapiens
LPNGITLDL

SEQ ID NO: 158178 - protein, 9 aa, Homo Sapiens
AGGPWRMQT

SEQ ID NO: 158179 - protein, 9 aa, Homo Sapiens
TTLWLGPAS

SEQ ID NO: 158180 - protein, 9 aa, Homo Sapiens
WKRHTPRSP

SEQ ID NO: 158181 - protein, 9 aa, Homo Sapiens
DDQIQWPTV

SEQ ID NO: 158182 - protein, 9 aa, Homo Sapiens
KAQDCQAEQ

SEQ ID NO: 158183 - protein, 9 aa, Homo Sapiens
VEAWGEIFL

SEQ ID NO: 158184 - protein, 9 aa, Homo Sapiens
ADAENAMWY

SEQ ID NO: 158185 - protein, 9 aa, Homo Sapiens
EVWRGRWRV

SEQ ID NO: 158186 - protein, 9 aa, Homo Sapiens
ENVHGGHAP

SEQ ID NO: 158187 - protein, 9 aa, Homo Sapiens
CGGGGSGTG

SEQ ID NO: 158188 - protein, 9 aa, Homo Sapiens
TQGRCWKRT

SEQ ID NO: 158189 - protein, 9 aa, Homo Sapiens
RMEKAAREY

SEQ ID NO: 158190 - protein, 9 aa, Homo Sapiens
KLEMVHKSM

SEQ ID NO: 158191 - protein, 9 aa, Homo Sapiens
TLSSSASVC

SEQ ID NO: 158192 - protein, 9 aa, Homo Sapiens
PPRPTVAFL

SEQ ID NO: 158193 - protein, 9 aa, Homo Sapiens
LLAHHAALK

SEQ ID NO: 158194 - protein, 9 aa, Homo Sapiens
MELIDGSAV

SEQ ID NO: 158195 - protein, 9 aa, Homo Sapiens
RLYGSNKKL

SEQ ID NO: 158196 - protein, 9 aa, Homo Sapiens
GFATLTSRS

SEQ ID NO: 158197 - protein, 9 aa, Homo Sapiens
SPGILKFWA

SEQ ID NO: 158198 - protein, 9 aa, Homo Sapiens
LLDLQNNDT

SEQ ID NO: 158199 - protein, 9 aa, Homo Sapiens
PPAGRHVAY

SEQ ID NO: 158200 - protein, 9 aa, Homo Sapiens
RTENIKEMS

SEQ ID NO: 158201 - protein, 9 aa, Homo Sapiens
PGKPTFQKP

SEQ ID NO: 158202 - protein, 9 aa, Homo Sapiens
PRFDENVVV

SEQ ID NO: 158203 - protein, 9 aa, Homo Sapiens
IAELWVVFH

SEQ ID NO: 158204 - protein, 9 aa, Homo Sapiens
CSLRELAQP

SEQ ID NO: 158205 - protein, 9 aa, Homo Sapiens
KEQCAAYNH

SEQ ID NO: 158206 - protein, 9 aa, Homo Sapiens
HGGTLLDDV

SEQ ID NO: 158207 - protein, 9 aa, Homo Sapiens
PICRKECVL

SEQ ID NO: 158208 - protein, 9 aa, Homo Sapiens
VLGGLPLRL

SEQ ID NO: 158209 - protein, 9 aa, Homo Sapiens
IFFLTFYII

SEQ ID NO: 158210 - protein, 9 aa, Homo Sapiens
WRVVDHRVF

SEQ ID NO: 158211 - protein, 9 aa, Homo Sapiens
LMGKEEEEL

SEQ ID NO: 158212 - protein, 9 aa, Homo Sapiens
SHELEISVY

SEQ ID NO: 158213 - protein, 9 aa, Homo Sapiens
LCAWDFNID

SEQ ID NO: 158214 - protein, 9 aa, Homo Sapiens
PPVPALQYL

SEQ ID NO: 158215 - protein, 9 aa, Homo Sapiens
REKVPCLCL

SEQ ID NO: 158216 - protein, 9 aa, Homo Sapiens
IHAAAEADQ

SEQ ID NO: 158217 - protein, 9 aa, Homo Sapiens
GQLYLRRKE

SEQ ID NO: 158218 - protein, 9 aa, Homo Sapiens
RPLIPEGAS

SEQ ID NO: 158219 - protein, 9 aa, Homo Sapiens
PCHLLPLSD

SEQ ID NO: 158220 - protein, 9 aa, Homo Sapiens
EGTCAVCGY

SEQ ID NO: 158221 - protein, 9 aa, Homo Sapiens
PRSRLAAAS

SEQ ID NO: 158222 - protein, 9 aa, Homo Sapiens
NGCLYRLRA

SEQ ID NO: 158223 - protein, 9 aa, Homo Sapiens
QMRLGGADP

SEQ ID NO: 158224 - protein, 9 aa, Homo Sapiens
NWSSCWAAP

SEQ ID NO: 158225 - protein, 9 aa, Homo Sapiens
ASQVGGTQE

SEQ ID NO: 158226 - protein, 9 aa, Homo Sapiens
WEEVEVLKE

SEQ ID NO: 158227 - protein, 9 aa, Homo Sapiens
TLMGKEEEE

SEQ ID NO: 158228 - protein, 9 aa, Homo Sapiens
RCLDPSEAT

SEQ ID NO: 158229 - protein, 9 aa, Homo Sapiens
DSVYRMTQR

SEQ ID NO: 158230 - protein, 9 aa, Homo Sapiens
TFYTRERLG

SEQ ID NO: 158231 - protein, 9 aa, Homo Sapiens
TGLRGSWRR

SEQ ID NO: 158232 - protein, 9 aa, Homo Sapiens
ILDTWFSSG

SEQ ID NO: 158233 - protein, 9 aa, Homo Sapiens
PEGDSPKEL

SEQ ID NO: 158234 - protein, 9 aa, Homo Sapiens
GKWARSSQK

SEQ ID NO: 158235 - protein, 9 aa, Homo Sapiens
ILERNPTNV

SEQ ID NO: 158236 - protein, 9 aa, Homo Sapiens
TIYTTICRV

SEQ ID NO: 158237 - protein, 9 aa, Homo Sapiens
LAQHRNINT

SEQ ID NO: 158238 - protein, 9 aa, Homo Sapiens
AAASEPPQC

SEQ ID NO: 158239 - protein, 9 aa, Homo Sapiens
GPSCVPTAA

SEQ ID NO: 158240 - protein, 9 aa, Homo Sapiens
GQDQIVPDL

SEQ ID NO: 158241 - protein, 9 aa, Homo Sapiens
TLRVENKSQ

SEQ ID NO: 158242 - protein, 9 aa, Homo Sapiens
TRSQEQDVL

SEQ ID NO: 158243 - protein, 9 aa, Homo Sapiens
PKPCPDVWL

SEQ ID NO: 158244 - protein, 9 aa, Homo Sapiens
AAPLGCCPA

SEQ ID NO: 158245 - protein, 9 aa, Homo Sapiens
LSTLSQPPP

SEQ ID NO: 158246 - protein, 9 aa, Homo Sapiens
SPAHHLCMQ

SEQ ID NO: 158247 - protein, 9 aa, Homo Sapiens
GGRPSPCLS

SEQ ID NO: 158248 - protein, 9 aa, Homo Sapiens
VFLADEYCN

SEQ ID NO: 158249 - protein, 9 aa, Homo Sapiens
EKHSLSPNV

SEQ ID NO: 158250 - protein, 9 aa, Homo Sapiens
SSATQASMT

SEQ ID NO: 158251 - protein, 9 aa, Homo Sapiens
GTVLFWDAS

SEQ ID NO: 158252 - protein, 9 aa, Homo Sapiens
SRQLAGVLG

SEQ ID NO: 158253 - protein, 9 aa, Homo Sapiens
QQSSSSREG

SEQ ID NO: 158254 - protein, 9 aa, Homo Sapiens
AAPSRPATS

SEQ ID NO: 158255 - protein, 9 aa, Homo Sapiens
VTKKNKGRL

SEQ ID NO: 158256 - protein, 9 aa, Homo Sapiens
TAPLLADDN

SEQ ID NO: 158257 - protein, 9 aa, Homo Sapiens
AKLQGLSPC

SEQ ID NO: 158258 - protein, 9 aa, Homo Sapiens
TSLNDHMGQ

SEQ ID NO: 158259 - protein, 9 aa, Homo Sapiens
CGGYFIDTT

SEQ ID NO: 158260 - protein, 9 aa, Homo Sapiens
RQFLAKQGQ

SEQ ID NO: 158261 - protein, 9 aa, Homo Sapiens
WCACCVPAK

SEQ ID NO: 158262 - protein, 9 aa, Homo Sapiens
DSEAPMEEE

SEQ ID NO: 158263 - protein, 9 aa, Homo Sapiens
DILDTWFSS

SEQ ID NO: 158264 - protein, 9 aa, Homo Sapiens
VYRDCQSER

SEQ ID NO: 158265 - protein, 9 aa, Homo Sapiens
WCGTSQTYF

SEQ ID NO: 158266 - protein, 9 aa, Homo Sapiens
PGAAPSPLC

SEQ ID NO: 158267 - protein, 9 aa, Homo Sapiens
GAPRSPPRD

SEQ ID NO: 158268 - protein, 9 aa, Homo Sapiens
AEGLATERS

SEQ ID NO: 158269 - protein, 9 aa, Homo Sapiens
VGVDSLDMC

SEQ ID NO: 158270 - protein, 9 aa, Homo Sapiens
EHSAAFFSF

SEQ ID NO: 158271 - protein, 9 aa, Homo Sapiens
SNFTCIVAI

SEQ ID NO: 158272 - protein, 9 aa, Homo Sapiens
RRTRSAWGD

SEQ ID NO: 158273 - protein, 9 aa, Homo Sapiens
HGRDQGRHP

SEQ ID NO: 158274 - protein, 9 aa, Homo Sapiens
PSSSVWSSA

SEQ ID NO: 158275 - protein, 9 aa, Homo Sapiens
SFVRSCTRR

SEQ ID NO: 158276 - protein, 9 aa, Homo Sapiens
YIAYLSIFD

SEQ ID NO: 158277 - protein, 9 aa, Homo Sapiens
NPIKLIQQF

SEQ ID NO: 158278 - protein, 9 aa, Homo Sapiens
RPDVKVLRW

SEQ ID NO: 158279 - protein, 9 aa, Homo Sapiens
LCRGGHLWR

SEQ ID NO: 158280 - protein, 9 aa, Homo Sapiens
ARMSSWSQT

SEQ ID NO: 158281 - protein, 9 aa, Homo Sapiens
ATMSSAQIV

SEQ ID NO: 158282 - protein, 9 aa, Homo Sapiens
PHPMSSPTL

SEQ ID NO: 158283 - protein, 9 aa, Homo Sapiens
DSTNVDKLA

SEQ ID NO: 158284 - protein, 9 aa, Homo Sapiens
ELCAAQLAR

SEQ ID NO: 158285 - protein, 9 aa, Homo Sapiens
NAEAYIRNA

SEQ ID NO: 158286 - protein, 9 aa, Homo Sapiens
ANVAGVWRA

SEQ ID NO: 158287 - protein, 9 aa, Homo Sapiens
QQTVPFMKS

SEQ ID NO: 158288 - protein, 9 aa, Homo Sapiens
TRDSTCLSS

SEQ ID NO: 158289 - protein, 9 aa, Homo Sapiens
HFSQACYLL

SEQ ID NO: 158290 - protein, 9 aa, Homo Sapiens
SKAYRERYV

SEQ ID NO: 158291 - protein, 9 aa, Homo Sapiens
SNNTTGTSI

SEQ ID NO: 158292 - protein, 9 aa, Homo Sapiens
KNILASPGI

SEQ ID NO: 158293 - protein, 9 aa, Homo Sapiens
GGRQRGRLN

SEQ ID NO: 158294 - protein, 9 aa, Homo Sapiens
LPSCNNRHF

SEQ ID NO: 158295 - protein, 9 aa, Homo Sapiens
SWCGTSQTY

SEQ ID NO: 158296 - protein, 9 aa, Homo Sapiens
RHTGMHRHT

SEQ ID NO: 158297 - protein, 9 aa, Homo Sapiens
RPLSKTVCF

SEQ ID NO: 158298 - protein, 9 aa, Homo Sapiens
SDTTGLPKG

SEQ ID NO: 158299 - protein, 9 aa, Homo Sapiens
ELQKSGHRR

SEQ ID NO: 158300 - protein, 9 aa, Homo Sapiens
GNLLSWCYL

SEQ ID NO: 158301 - protein, 9 aa, Homo Sapiens
PTPAQTEQH

SEQ ID NO: 158302 - protein, 9 aa, Homo Sapiens
GPHGPRGPG

SEQ ID NO: 158303 - protein, 9 aa, Homo Sapiens
GLIVYLMFP

SEQ ID NO: 158304 - protein, 9 aa, Homo Sapiens
VQLQALMAQ

SEQ ID NO: 158305 - protein, 9 aa, Homo Sapiens
KNSPFGSSC

SEQ ID NO: 158306 - protein, 9 aa, Homo Sapiens
HPSFKEWFH

SEQ ID NO: 158307 - protein, 9 aa, Homo Sapiens
SRPTVPSCR

SEQ ID NO: 158308 - protein, 9 aa, Homo Sapiens
KYNREISAD

SEQ ID NO: 158309 - protein, 9 aa, Homo Sapiens
RPALAAPAC

SEQ ID NO: 158310 - protein, 9 aa, Homo Sapiens
AQITQKISV

SEQ ID NO: 158311 - protein, 9 aa, Homo Sapiens
RDRMGQGWS

SEQ ID NO: 158312 - protein, 9 aa, Homo Sapiens
AKHVPLSIS

SEQ ID NO: 158313 - protein, 9 aa, Homo Sapiens
HSLDKGIMA

SEQ ID NO: 158314 - protein, 9 aa, Homo Sapiens
DFSQQDING

SEQ ID NO: 158315 - protein, 9 aa, Homo Sapiens
TAASLVGIL

SEQ ID NO: 158316 - protein, 9 aa, Homo Sapiens
CQKTLQRLR

SEQ ID NO: 158317 - protein, 9 aa, Homo Sapiens
SVYSGCSHL

SEQ ID NO: 158318 - protein, 9 aa, Homo Sapiens
FKWGPTSQQ

SEQ ID NO: 158319 - protein, 9 aa, Homo Sapiens
HTGTHTDTH

SEQ ID NO: 158320 - protein, 9 aa, Homo Sapiens
PGAAVAANS

SEQ ID NO: 158321 - protein, 9 aa, Homo Sapiens
VLQNYYTGG

SEQ ID NO: 158322 - protein, 9 aa, Homo Sapiens
IHLPSSNSS

SEQ ID NO: 158323 - protein, 9 aa, Homo Sapiens
NVVIDRGLA

SEQ ID NO: 158324 - protein, 9 aa, Homo Sapiens
GMRRMGRLA

SEQ ID NO: 158325 - protein, 9 aa, Homo Sapiens
RADGGHCRD

SEQ ID NO: 158326 - protein, 9 aa, Homo Sapiens
WKKRRTMRR

SEQ ID NO: 158327 - protein, 9 aa, Homo Sapiens
GYVPDHGRD

SEQ ID NO: 158328 - protein, 9 aa, Homo Sapiens
IGHPWHQSY

SEQ ID NO: 158329 - protein, 9 aa, Homo Sapiens
AGGMVEGGV

SEQ ID NO: 158330 - protein, 9 aa, Homo Sapiens
GRWGRGGWR

SEQ ID NO: 158331 - protein, 9 aa, Homo Sapiens
LPTGLYCFP

SEQ ID NO: 158332 - protein, 9 aa, Homo Sapiens
RPYNVDTER

SEQ ID NO: 158333 - protein, 9 aa, Homo Sapiens
AKHSSSQCT

SEQ ID NO: 158334 - protein, 9 aa, Homo Sapiens
HGRRARCLD

SEQ ID NO: 158335 - protein, 9 aa, Homo Sapiens
DDGSDAPLE

SEQ ID NO: 158336 - protein, 9 aa, Homo Sapiens
RPSATNPTW

SEQ ID NO: 158337 - protein, 9 aa, Homo Sapiens
QGGRILLQR

SEQ ID NO: 158338 - protein, 9 aa, Homo Sapiens
KLLNSINVD

SEQ ID NO: 158339 - protein, 9 aa, Homo Sapiens
PQAGGPRKG

SEQ ID NO: 158340 - protein, 9 aa, Homo Sapiens
CRDDVKLPG

SEQ ID NO: 158341 - protein, 9 aa, Homo Sapiens
RSKARSLYS

SEQ ID NO: 158342 - protein, 9 aa, Homo Sapiens
RLGPAGRIG

SEQ ID NO: 158343 - protein, 9 aa, Homo Sapiens
IQTMKTVPS

SEQ ID NO: 158344 - protein, 9 aa, Homo Sapiens
PWPPPSVPG

SEQ ID NO: 158345 - protein, 9 aa, Homo Sapiens
RQQQPPPPQ

SEQ ID NO: 158346 - protein, 9 aa, Homo Sapiens
TGACCTMQA

SEQ ID NO: 158347 - protein, 9 aa, Homo Sapiens
ARAHQRTGR

SEQ ID NO: 158348 - protein, 9 aa, Homo Sapiens
ISSCLRVHV

SEQ ID NO: 158349 - protein, 9 aa, Homo Sapiens
AHHLCMQLT

SEQ ID NO: 158350 - protein, 9 aa, Homo Sapiens
PLIHPATTF

SEQ ID NO: 158351 - protein, 9 aa, Homo Sapiens
IGMINMFHK

SEQ ID NO: 158352 - protein, 9 aa, Homo Sapiens
RKGSPGCVL

SEQ ID NO: 158353 - protein, 9 aa, Homo Sapiens
QDINGLEVV

SEQ ID NO: 158354 - protein, 9 aa, Homo Sapiens
SPLFPPLLV

SEQ ID NO: 158355 - protein, 9 aa, Homo Sapiens
VEAGVEEGP

SEQ ID NO: 158356 - protein, 9 aa, Homo Sapiens
NTYAAGGMV

SEQ ID NO: 158357 - protein, 9 aa, Homo Sapiens
AGTHYSQDQ

SEQ ID NO: 158358 - protein, 9 aa, Homo Sapiens
DHRVFGQLT

SEQ ID NO: 158359 - protein, 9 aa, Homo Sapiens
EKEIEENKS

SEQ ID NO: 158360 - protein, 9 aa, Homo Sapiens
PLPLAASAS

SEQ ID NO: 158361 - protein, 9 aa, Homo Sapiens
TPPDRSKGA

SEQ ID NO: 158362 - protein, 9 aa, Homo Sapiens
KMQRRHISN

SEQ ID NO: 158363 - protein, 9 aa, Homo Sapiens
KIMISEFGL

SEQ ID NO: 158364 - protein, 9 aa, Homo Sapiens
PPRSLQNLV

SEQ ID NO: 158365 - protein, 9 aa, Homo Sapiens
LKPTIEVAQ

SEQ ID NO: 158366 - protein, 9 aa, Homo Sapiens
CMHNFSRSD

SEQ ID NO: 158367 - protein, 9 aa, Homo Sapiens
MTVKYGDEV

SEQ ID NO: 158368 - protein, 9 aa, Homo Sapiens
SWSASAAAM

SEQ ID NO: 158369 - protein, 9 aa, Homo Sapiens
LIPRLPTGL

SEQ ID NO: 158370 - protein, 9 aa, Homo Sapiens
AAKLGVNFG

SEQ ID NO: 158371 - protein, 9 aa, Homo Sapiens
PIGLSGIPG

SEQ ID NO: 158372 - protein, 9 aa, Homo Sapiens
PGLLVLGEV

SEQ ID NO: 158373 - protein, 9 aa, Homo Sapiens
PESASDTIK

SEQ ID NO: 158374 - protein, 9 aa, Homo Sapiens
ANFVLQYQL

SEQ ID NO: 158375 - protein, 9 aa, Homo Sapiens
PGEQQCPGS

SEQ ID NO: 158376 - protein, 9 aa, Homo Sapiens
KNVAKPLDG

SEQ ID NO: 158377 - protein, 9 aa, Homo Sapiens
VVIDRGLAF

SEQ ID NO: 158378 - protein, 9 aa, Homo Sapiens
GGVIMILVM

SEQ ID NO: 158379 - protein, 9 aa, Homo Sapiens
PSSETSSSS

SEQ ID NO: 158380 - protein, 9 aa, Homo Sapiens
EWINQECQK

SEQ ID NO: 158381 - protein, 9 aa, Homo Sapiens
IYGFIGLCW

SEQ ID NO: 158382 - protein, 9 aa, Homo Sapiens
PLMNIQHNP

SEQ ID NO: 158383 - protein, 9 aa, Homo Sapiens
EQQPPPQQQ

SEQ ID NO: 158384 - protein, 9 aa, Homo Sapiens
ISEFGLSKM

SEQ ID NO: 158385 - protein, 9 aa, Homo Sapiens
YSNPCMEEN

SEQ ID NO: 158386 - protein, 9 aa, Homo Sapiens
VLPSPSMWR

SEQ ID NO: 158387 - protein, 9 aa, Homo Sapiens
SVPHLHLVM

SEQ ID NO: 158388 - protein, 9 aa, Homo Sapiens
GCGRGRGAG

SEQ ID NO: 158389 - protein, 9 aa, Homo Sapiens
NALIAELLQ

SEQ ID NO: 158390 - protein, 9 aa, Homo Sapiens
LSPVACPQR

SEQ ID NO: 158391 - protein, 9 aa, Homo Sapiens
QAHRPDYAV

SEQ ID NO: 158392 - protein, 9 aa, Homo Sapiens
QISQGMIGH

SEQ ID NO: 158393 - protein, 9 aa, Homo Sapiens
RSWGPRLGP

SEQ ID NO: 158394 - protein, 9 aa, Homo Sapiens
SMLMPRWST

SEQ ID NO: 158395 - protein, 9 aa, Homo Sapiens
SRPRAGCCV

SEQ ID NO: 158396 - protein, 9 aa, Homo Sapiens
SINVDREQF

SEQ ID NO: 158397 - protein, 9 aa, Homo Sapiens
SPPARSWSA

SEQ ID NO: 158398 - protein, 9 aa, Homo Sapiens
GHPWHQSYH

SEQ ID NO: 158399 - protein, 9 aa, Homo Sapiens
QAYTQTHTG

SEQ ID NO: 158400 - protein, 9 aa, Homo Sapiens
LKSPSCLMD

SEQ ID NO: 158401 - protein, 9 aa, Homo Sapiens
TASLTVAEA

SEQ ID NO: 158402 - protein, 9 aa, Homo Sapiens
KGYPRIPPE

SEQ ID NO: 158403 - protein, 9 aa, Homo Sapiens
CSGDATFPK

SEQ ID NO: 158404 - protein, 9 aa, Homo Sapiens
HPYVPPLPL

SEQ ID NO: 158405 - protein, 9 aa, Homo Sapiens
LCQCPLLLP

SEQ ID NO: 158406 - protein, 9 aa, Homo Sapiens
DIFQNISAK

SEQ ID NO: 158407 - protein, 9 aa, Homo Sapiens
LMQAHLLIA

SEQ ID NO: 158408 - protein, 9 aa, Homo Sapiens
CCSTVSRSC

SEQ ID NO: 158409 - protein, 9 aa, Homo Sapiens
RDHLIAKNM

SEQ ID NO: 158410 - protein, 9 aa, Homo Sapiens
PSPELWVTH

SEQ ID NO: 158411 - protein, 9 aa, Homo Sapiens
QNPWWVISG

SEQ ID NO: 158412 - protein, 9 aa, Homo Sapiens
IRRHLLRFL

SEQ ID NO: 158413 - protein, 9 aa, Homo Sapiens
ASRAPRLPR

SEQ ID NO: 158414 - protein, 9 aa, Homo Sapiens
KGGTLNMKA

SEQ ID NO: 158415 - protein, 9 aa, Homo Sapiens
VYRSLGYPG

SEQ ID NO: 158416 - protein, 9 aa, Homo Sapiens
TMAEERMTG

SEQ ID NO: 158417 - protein, 9 aa, Homo Sapiens
ETTAASEQG

SEQ ID NO: 158418 - protein, 9 aa, Homo Sapiens
DSKDEKTKI

SEQ ID NO: 158419 - protein, 9 aa, Homo Sapiens
DPQWHWPKM

SEQ ID NO: 158420 - protein, 9 aa, Homo Sapiens
TYVNPQHVE

SEQ ID NO: 158421 - protein, 9 aa, Homo Sapiens
CSVKSAVTH

SEQ ID NO: 158422 - protein, 9 aa, Homo Sapiens
ARSCFSQQE

SEQ ID NO: 158423 - protein, 9 aa, Homo Sapiens
SHSTPRLLA

SEQ ID NO: 158424 - protein, 9 aa, Homo Sapiens
NNISKCFTL

SEQ ID NO: 158425 - protein, 9 aa, Homo Sapiens
VEAVAKKRR

SEQ ID NO: 158426 - protein, 9 aa, Homo Sapiens
GKIKVVRSA

SEQ ID NO: 158427 - protein, 9 aa, Homo Sapiens
ITQKISVHA

SEQ ID NO: 158428 - protein, 9 aa, Homo Sapiens
HTHKHTDTL

SEQ ID NO: 158429 - protein, 9 aa, Homo Sapiens
FLQYYYQNG

SEQ ID NO: 158430 - protein, 9 aa, Homo Sapiens
VSSRRLRPR

SEQ ID NO: 158431 - protein, 9 aa, Homo Sapiens
RFRLQGRVT

SEQ ID NO: 158432 - protein, 9 aa, Homo Sapiens
PPSSPTRAL

SEQ ID NO: 158433 - protein, 9 aa, Homo Sapiens
QALQLLILD

SEQ ID NO: 158434 - protein, 9 aa, Homo Sapiens
RSHELEISV

SEQ ID NO: 158435 - protein, 9 aa, Homo Sapiens
RGQPGLQGV

SEQ ID NO: 158436 - protein, 9 aa, Homo Sapiens
QQRTAALLT

SEQ ID NO: 158437 - protein, 9 aa, Homo Sapiens
PPGLSIGDE

SEQ ID NO: 158438 - protein, 9 aa, Homo Sapiens
ALSPDSAGS

SEQ ID NO: 158439 - protein, 9 aa, Homo Sapiens
PQCHPRYPP

SEQ ID NO: 158440 - protein, 9 aa, Homo Sapiens
QQPSASLAH

SEQ ID NO: 158441 - protein, 9 aa, Homo Sapiens
VAVDAQVGP

SEQ ID NO: 158442 - protein, 9 aa, Homo Sapiens
PHGLWFLLK

SEQ ID NO: 158443 - protein, 9 aa, Homo Sapiens
TAIGGGGWP

SEQ ID NO: 158444 - protein, 9 aa, Homo Sapiens
KDTPKRPFS

SEQ ID NO: 158445 - protein, 9 aa, Homo Sapiens
SVCCRAQTV

SEQ ID NO: 158446 - protein, 9 aa, Homo Sapiens
LVGGFVYRD

SEQ ID NO: 158447 - protein, 9 aa, Homo Sapiens
IFYRPMGRE

SEQ ID NO: 158448 - protein, 9 aa, Homo Sapiens
HSHHPHHLP

SEQ ID NO: 158449 - protein, 9 aa, Homo Sapiens
APRLPRSSR

SEQ ID NO: 158450 - protein, 9 aa, Homo Sapiens
GHLFSMEIS

SEQ ID NO: 158451 - protein, 9 aa, Homo Sapiens
PDNKLDADY

SEQ ID NO: 158452 - protein, 9 aa, Homo Sapiens
SVCWRALPD

SEQ ID NO: 158453 - protein, 9 aa, Homo Sapiens
YGGAYFHTG

SEQ ID NO: 158454 - protein, 9 aa, Homo Sapiens
PRRQRASSA

SEQ ID NO: 158455 - protein, 9 aa, Homo Sapiens
MILVMVVIL

SEQ ID NO: 158456 - protein, 9 aa, Homo Sapiens
GRARAGIEA

SEQ ID NO: 158457 - protein, 9 aa, Homo Sapiens
YQFQNLADC

SEQ ID NO: 158458 - protein, 9 aa, Homo Sapiens
LACRAPSLR

SEQ ID NO: 158459 - protein, 9 aa, Homo Sapiens
GDWVASPPT

SEQ ID NO: 158460 - protein, 9 aa, Homo Sapiens
RSSSAPPAA

SEQ ID NO: 158461 - protein, 9 aa, Homo Sapiens
PTHLMEECL

SEQ ID NO: 158462 - protein, 9 aa, Homo Sapiens
AAPRTSAGL

SEQ ID NO: 158463 - protein, 9 aa, Homo Sapiens
ELKGGNVTK

SEQ ID NO: 158464 - protein, 9 aa, Homo Sapiens
MPRWSTPEE

SEQ ID NO: 158465 - protein, 9 aa, Homo Sapiens
TSTVTNSES

SEQ ID NO: 158466 - protein, 9 aa, Homo Sapiens
MRNQVRLKV

SEQ ID NO: 158467 - protein, 9 aa, Homo Sapiens
LPLHLKLTR

SEQ ID NO: 158468 - protein, 9 aa, Homo Sapiens
KRMCERKNM

SEQ ID NO: 158469 - protein, 9 aa, Homo Sapiens
CPPCPRMAA

SEQ ID NO: 158470 - protein, 9 aa, Homo Sapiens
NPHSPGPGL

SEQ ID NO: 158471 - protein, 9 aa, Homo Sapiens
AFTKQVLKG

SEQ ID NO: 158472 - protein, 9 aa, Homo Sapiens
GETTHIHTE

SEQ ID NO: 158473 - protein, 9 aa, Homo Sapiens
SINEEELRR

SEQ ID NO: 158474 - protein, 9 aa, Homo Sapiens
ATTSTGGIF

SEQ ID NO: 158475 - protein, 9 aa, Homo Sapiens
AGATLRFLK

SEQ ID NO: 158476 - protein, 9 aa, Homo Sapiens
QKQHIHIGE

SEQ ID NO: 158477 - protein, 9 aa, Homo Sapiens
VDNSLDDSD

SEQ ID NO: 158478 - protein, 9 aa, Homo Sapiens
GAKGEKGID

SEQ ID NO: 158479 - protein, 9 aa, Homo Sapiens
CLSSRIGGG

SEQ ID NO: 158480 - protein, 9 aa, Homo Sapiens
PWPHVLSVF

SEQ ID NO: 158481 - protein, 9 aa, Homo Sapiens
GGVATGHII

SEQ ID NO: 158482 - protein, 9 aa, Homo Sapiens
IQLTMNDSK

SEQ ID NO: 158483 - protein, 9 aa, Homo Sapiens
TGILYVLRS

SEQ ID NO: 158484 - protein, 9 aa, Homo Sapiens
GGQSWNCAW

SEQ ID NO: 158485 - protein, 9 aa, Homo Sapiens
YSRAAKDYQ

SEQ ID NO: 158486 - protein, 9 aa, Homo Sapiens
GAAVVHGQH

SEQ ID NO: 158487 - protein, 9 aa, Homo Sapiens
YSALLADAP

SEQ ID NO: 158488 - protein, 9 aa, Homo Sapiens
PRSRGSPRP

SEQ ID NO: 158489 - protein, 9 aa, Homo Sapiens
IFNIHVIDF

SEQ ID NO: 158490 - protein, 9 aa, Homo Sapiens
VVDHRVFGQ

SEQ ID NO: 158491 - protein, 9 aa, Homo Sapiens
LPGPHDDFV

SEQ ID NO: 158492 - protein, 9 aa, Homo Sapiens
AHVWLLPGM

SEQ ID NO: 158493 - protein, 9 aa, Homo Sapiens
PEENAGNEL

SEQ ID NO: 158494 - protein, 9 aa, Homo Sapiens
VLSSMLYMP

SEQ ID NO: 158495 - protein, 9 aa, Homo Sapiens
NYECCPGYS

SEQ ID NO: 158496 - protein, 9 aa, Homo Sapiens
PEKQTMKLE

SEQ ID NO: 158497 - protein, 9 aa, Homo Sapiens
GPLEGGLNE

SEQ ID NO: 158498 - protein, 9 aa, Homo Sapiens
PVHMILVLC

SEQ ID NO: 158499 - protein, 9 aa, Homo Sapiens
QRWPPPRWM

SEQ ID NO: 158500 - protein, 9 aa, Homo Sapiens
VHTLISVEN

SEQ ID NO: 158501 - protein, 9 aa, Homo Sapiens
VLQRTEKKC

SEQ ID NO: 158502 - protein, 9 aa, Homo Sapiens
LKSWISVPC

SEQ ID NO: 158503 - protein, 9 aa, Homo Sapiens
PQVCVSCPE

SEQ ID NO: 158504 - protein, 9 aa, Homo Sapiens
MEKAAREYR

SEQ ID NO: 158505 - protein, 9 aa, Homo Sapiens
TYLLGLDDH

SEQ ID NO: 158506 - protein, 9 aa, Homo Sapiens
RSQEQDVLE

SEQ ID NO: 158507 - protein, 9 aa, Homo Sapiens
WAMAVVAVL

SEQ ID NO: 158508 - protein, 9 aa, Homo Sapiens
AGVRDRSPM

SEQ ID NO: 158509 - protein, 9 aa, Homo Sapiens
KKNLRIGNG

SEQ ID NO: 158510 - protein, 9 aa, Homo Sapiens
SLYVREVFP

SEQ ID NO: 158511 - protein, 9 aa, Homo Sapiens
KHMHQLLMD

SEQ ID NO: 158512 - protein, 9 aa, Homo Sapiens
YGMHGFMDL

SEQ ID NO: 158513 - protein, 9 aa, Homo Sapiens
IVFRRVENA

SEQ ID NO: 158514 - protein, 9 aa, Homo Sapiens
QLYLSMEMI

SEQ ID NO: 158515 - protein, 9 aa, Homo Sapiens
GGQTPASLM

SEQ ID NO: 158516 - protein, 9 aa, Homo Sapiens
IPSPHSDGG

SEQ ID NO: 158517 - protein, 9 aa, Homo Sapiens
CQYFTVFDR

SEQ ID NO: 158518 - protein, 9 aa, Homo Sapiens
QPASSHHGS

SEQ ID NO: 158519 - protein, 9 aa, Homo Sapiens
DHWHMVLLT

SEQ ID NO: 158520 - protein, 9 aa, Homo Sapiens
ALSPTCVEA

SEQ ID NO: 158521 - protein, 9 aa, Homo Sapiens
QASRAPASA

SEQ ID NO: 158522 - protein, 9 aa, Homo Sapiens
HALSCRTRR

SEQ ID NO: 158523 - protein, 9 aa, Homo Sapiens
WPISSWTCL

SEQ ID NO: 158524 - protein, 9 aa, Homo Sapiens
VSRRPLSLA

SEQ ID NO: 158525 - protein, 9 aa, Homo Sapiens
RVRKFFRLI

SEQ ID NO: 158526 - protein, 9 aa, Homo Sapiens
AAPEVGSPS

SEQ ID NO: 158527 - protein, 9 aa, Homo Sapiens
VFPCGELLV

SEQ ID NO: 158528 - protein, 9 aa, Homo Sapiens
RLRAGQTEG

SEQ ID NO: 158529 - protein, 9 aa, Homo Sapiens
CIGCARSWN

SEQ ID NO: 158530 - protein, 9 aa, Homo Sapiens
GYPRIPPEL

SEQ ID NO: 158531 - protein, 9 aa, Homo Sapiens
KDKNTAVRA

SEQ ID NO: 158532 - protein, 9 aa, Homo Sapiens
VLGSGAFGM

SEQ ID NO: 158533 - protein, 9 aa, Homo Sapiens
WKKFWAILK

SEQ ID NO: 158534 - protein, 9 aa, Homo Sapiens
GLPQLPGLP

SEQ ID NO: 158535 - protein, 9 aa, Homo Sapiens
PTSKAECMA

SEQ ID NO: 158536 - protein, 9 aa, Homo Sapiens
TGECCGRRL

SEQ ID NO: 158537 - protein, 9 aa, Homo Sapiens
PQPSLPGPC

SEQ ID NO: 158538 - protein, 9 aa, Homo Sapiens
ADRTDHSDE

SEQ ID NO: 158539 - protein, 9 aa, Homo Sapiens
RVLNEHKKF

SEQ ID NO: 158540 - protein, 9 aa, Homo Sapiens
SSQYRQLLN

SEQ ID NO: 158541 - protein, 9 aa, Homo Sapiens
PSSLRRTTT

SEQ ID NO: 158542 - protein, 9 aa, Homo Sapiens
DSNGICMHR

SEQ ID NO: 158543 - protein, 9 aa, Homo Sapiens
HQPQYSIFK

SEQ ID NO: 158544 - protein, 9 aa, Homo Sapiens
SAAAAAAVA

SEQ ID NO: 158545 - protein, 9 aa, Homo Sapiens
WGPTSQQIL

SEQ ID NO: 158546 - protein, 9 aa, Homo Sapiens
GVAGDVEAI

SEQ ID NO: 158547 - protein, 9 aa, Homo Sapiens
TEKKHSHKQ

SEQ ID NO: 158548 - protein, 9 aa, Homo Sapiens
VSRYNQNRL

SEQ ID NO: 158549 - protein, 9 aa, Homo Sapiens
LPPPPGADV

SEQ ID NO: 158550 - protein, 9 aa, Homo Sapiens
LDRIVDKVK

SEQ ID NO: 158551 - protein, 9 aa, Homo Sapiens
TPPQVSMVT

SEQ ID NO: 158552 - protein, 9 aa, Homo Sapiens
TEASLLCQC

SEQ ID NO: 158553 - protein, 9 aa, Homo Sapiens
PWLVVPILL

SEQ ID NO: 158554 - protein, 9 aa, Homo Sapiens
TQKKMFMLH

SEQ ID NO: 158555 - protein, 9 aa, Homo Sapiens
LSPRLGRSC

SEQ ID NO: 158556 - protein, 9 aa, Homo Sapiens
EKVHFSQAC

SEQ ID NO: 158557 - protein, 9 aa, Homo Sapiens
KDNSNFTCI

SEQ ID NO: 158558 - protein, 9 aa, Homo Sapiens
APLHCLSKA

SEQ ID NO: 158559 - protein, 9 aa, Homo Sapiens
PRPHSHNKV

SEQ ID NO: 158560 - protein, 9 aa, Homo Sapiens
FTLLDFMNA

SEQ ID NO: 158561 - protein, 9 aa, Homo Sapiens
EIFLFVQPM

SEQ ID NO: 158562 - protein, 9 aa, Homo Sapiens
FLTFLELAD

SEQ ID NO: 158563 - protein, 9 aa, Homo Sapiens
SYLHPSKTE

SEQ ID NO: 158564 - protein, 9 aa, Homo Sapiens
APSLKAPTP

SEQ ID NO: 158565 - protein, 9 aa, Homo Sapiens
LRDLSLCAP

SEQ ID NO: 158566 - protein, 9 aa, Homo Sapiens
TPGQETLPE

SEQ ID NO: 158567 - protein, 9 aa, Homo Sapiens
RCRLFECGQ

SEQ ID NO: 158568 - protein, 9 aa, Homo Sapiens
SGCSHLVSD

SEQ ID NO: 158569 - protein, 9 aa, Homo Sapiens
CASLLSTLS

SEQ ID NO: 158570 - protein, 9 aa, Homo Sapiens
TPAATRAAA

SEQ ID NO: 158571 - protein, 9 aa, Homo Sapiens
RSTSQEVPL

SEQ ID NO: 158572 - protein, 9 aa, Homo Sapiens
ELMRWGLHL

SEQ ID NO: 158573 - protein, 9 aa, Homo Sapiens
MNQLDHTNL

SEQ ID NO: 158574 - protein, 9 aa, Homo Sapiens
HPNSSAWFP

SEQ ID NO: 158575 - protein, 9 aa, Homo Sapiens
NIDTLDTIP

SEQ ID NO: 158576 - protein, 9 aa, Homo Sapiens
KRMWHLSTG

SEQ ID NO: 158577 - protein, 9 aa, Homo Sapiens
TKNQNQGNP

SEQ ID NO: 158578 - protein, 9 aa, Homo Sapiens
EVFFSAKCG

SEQ ID NO: 158579 - protein, 9 aa, Homo Sapiens
LCADRNYVN

SEQ ID NO: 158580 - protein, 9 aa, Homo Sapiens
GRDDDVSST

SEQ ID NO: 158581 - protein, 9 aa, Homo Sapiens
QNLVEAGVE

SEQ ID NO: 158582 - protein, 9 aa, Homo Sapiens
MRNVALLAL

SEQ ID NO: 158583 - protein, 9 aa, Homo Sapiens
FIQVFETFS

SEQ ID NO: 158584 - protein, 9 aa, Homo Sapiens
PQLPGLPRP

SEQ ID NO: 158585 - protein, 9 aa, Homo Sapiens
TSDTTGLPK

SEQ ID NO: 158586 - protein, 9 aa, Homo Sapiens
VPQVLQNYY

SEQ ID NO: 158587 - protein, 9 aa, Homo Sapiens
SWLLGFEFG

SEQ ID NO: 158588 - protein, 9 aa, Homo Sapiens
VPCLSTILI

SEQ ID NO: 158589 - protein, 9 aa, Homo Sapiens
APETTLWLG

SEQ ID NO: 158590 - protein, 9 aa, Homo Sapiens
HWPKEQPST

SEQ ID NO: 158591 - protein, 9 aa, Homo Sapiens
PQAPSQVWT

SEQ ID NO: 158592 - protein, 9 aa, Homo Sapiens
RYHSLVPMY

SEQ ID NO: 158593 - protein, 9 aa, Homo Sapiens
EKRLMAELH

SEQ ID NO: 158594 - protein, 9 aa, Homo Sapiens
DQRFQDTDE

SEQ ID NO: 158595 - protein, 9 aa, Homo Sapiens
DAPAARGHG

SEQ ID NO: 158596 - protein, 9 aa, Homo Sapiens
ILLLLVVFY

SEQ ID NO: 158597 - protein, 9 aa, Homo Sapiens
VKALEKTVA

SEQ ID NO: 158598 - protein, 9 aa, Homo Sapiens
ASDKESSCL

SEQ ID NO: 158599 - protein, 9 aa, Homo Sapiens
TAPWPPYRA

SEQ ID NO: 158600 - protein, 9 aa, Homo Sapiens
ASLLSTLSQ

SEQ ID NO: 158601 - protein, 9 aa, Homo Sapiens
SGVGQQELL

SEQ ID NO: 158602 - protein, 9 aa, Homo Sapiens
ASRAQTHRK

SEQ ID NO: 158603 - protein, 9 aa, Homo Sapiens
LADTLLNFL

SEQ ID NO: 158604 - protein, 9 aa, Homo Sapiens
HTPILFHIQ

SEQ ID NO: 158605 - protein, 9 aa, Homo Sapiens
SRRVLSDCK

SEQ ID NO: 158606 - protein, 9 aa, Homo Sapiens
AARRSGGGC

SEQ ID NO: 158607 - protein, 9 aa, Homo Sapiens
QCASNIYVP

SEQ ID NO: 158608 - protein, 9 aa, Homo Sapiens
KKSNIYKMP

SEQ ID NO: 158609 - protein, 9 aa, Homo Sapiens
PRAPSSPRS

SEQ ID NO: 158610 - protein, 9 aa, Homo Sapiens
QGGGCVQQV

SEQ ID NO: 158611 - protein, 9 aa, Homo Sapiens
GAPGLRHFP

SEQ ID NO: 158612 - protein, 9 aa, Homo Sapiens
EEGLKHFGA

SEQ ID NO: 158613 - protein, 9 aa, Homo Sapiens
WTVSPRWWS

SEQ ID NO: 158614 - protein, 9 aa, Homo Sapiens
MEPLSTTSA

SEQ ID NO: 158615 - protein, 9 aa, Homo Sapiens
TCVEAASSA

SEQ ID NO: 158616 - protein, 9 aa, Homo Sapiens
PEPEEVPQE

SEQ ID NO: 158617 - protein, 9 aa, Homo Sapiens
ESGHIPGTV

SEQ ID NO: 158618 - protein, 9 aa, Homo Sapiens
PLLCLGPTR

SEQ ID NO: 158619 - protein, 9 aa, Homo Sapiens
LTEPDIYQE

SEQ ID NO: 158620 - protein, 9 aa, Homo Sapiens
RLPGDGQTR

SEQ ID NO: 158621 - protein, 9 aa, Homo Sapiens
DENVVVRNT

SEQ ID NO: 158622 - protein, 9 aa, Homo Sapiens
IHTEPTGDG

SEQ ID NO: 158623 - protein, 9 aa, Homo Sapiens
GILKSLMTK

SEQ ID NO: 158624 - protein, 9 aa, Homo Sapiens
YQFPMVPGE

SEQ ID NO: 158625 - protein, 9 aa, Homo Sapiens
SLTPRTGLR

SEQ ID NO: 158626 - protein, 9 aa, Homo Sapiens
PSSPRSRGS

SEQ ID NO: 158627 - protein, 9 aa, Homo Sapiens
HQKDTRWHQ

SEQ ID NO: 158628 - protein, 9 aa, Homo Sapiens
RLVLGRAAP

SEQ ID NO: 158629 - protein, 9 aa, Homo Sapiens
RPLPPPPAC

SEQ ID NO: 158630 - protein, 9 aa, Homo Sapiens
RQPVQIQSQ

SEQ ID NO: 158631 - protein, 9 aa, Homo Sapiens
GPSVPGSGA

SEQ ID NO: 158632 - protein, 9 aa, Homo Sapiens
AVGMGKAVE

SEQ ID NO: 158633 - protein, 9 aa, Homo Sapiens
SWCSVKSAV

SEQ ID NO: 158634 - protein, 9 aa, Homo Sapiens
PNSRVLFHS

SEQ ID NO: 158635 - protein, 9 aa, Homo Sapiens
APLMNIQHN

SEQ ID NO: 158636 - protein, 9 aa, Homo Sapiens
RHLRFPPMD

SEQ ID NO: 158637 - protein, 9 aa, Homo Sapiens
QSKTVIFFK

SEQ ID NO: 158638 - protein, 9 aa, Homo Sapiens
ARSPTSSPT

SEQ ID NO: 158639 - protein, 9 aa, Homo Sapiens
RSRHQLKGG

SEQ ID NO: 158640 - protein, 9 aa, Homo Sapiens
KLGRWCAVH

SEQ ID NO: 158641 - protein, 9 aa, Homo Sapiens
KPGSKIFKT

SEQ ID NO: 158642 - protein, 9 aa, Homo Sapiens
INLSASSTL

SEQ ID NO: 158643 - protein, 9 aa, Homo Sapiens
KKGKKIIEY

SEQ ID NO: 158644 - protein, 9 aa, Homo Sapiens
VHQDVKANP

SEQ ID NO: 158645 - protein, 9 aa, Homo Sapiens
PGFLDVRTA

SEQ ID NO: 158646 - protein, 9 aa, Homo Sapiens
WNGLAHRWA

SEQ ID NO: 158647 - protein, 9 aa, Homo Sapiens
HHLQPPPHS

SEQ ID NO: 158648 - protein, 9 aa, Homo Sapiens
YEFLSLHSL

SEQ ID NO: 158649 - protein, 9 aa, Homo Sapiens
SLAALFMSQ

SEQ ID NO: 158650 - protein, 9 aa, Homo Sapiens
HHTPSPGLP

SEQ ID NO: 158651 - protein, 9 aa, Homo Sapiens
LQGTFYTRE

SEQ ID NO: 158652 - protein, 9 aa, Homo Sapiens
LCEDHRDRM

SEQ ID NO: 158653 - protein, 9 aa, Homo Sapiens
HGVKEIGTH

SEQ ID NO: 158654 - protein, 9 aa, Homo Sapiens
IAAALVAAF

SEQ ID NO: 158655 - protein, 9 aa, Homo Sapiens
EEIEEKTHN

SEQ ID NO: 158656 - protein, 9 aa, Homo Sapiens
IVREKPFTV

SEQ ID NO: 158657 - protein, 9 aa, Homo Sapiens
DNKSFAEGL

SEQ ID NO: 158658 - protein, 9 aa, Homo Sapiens
AAPPSTPPD

SEQ ID NO: 158659 - protein, 9 aa, Homo Sapiens
FRCEYCDSV

SEQ ID NO: 158660 - protein, 9 aa, Homo Sapiens
PGLGCFMPD

SEQ ID NO: 158661 - protein, 9 aa, Homo Sapiens
TLSAKHVPL

SEQ ID NO: 158662 - protein, 9 aa, Homo Sapiens
KGLWERSPG

SEQ ID NO: 158663 - protein, 9 aa, Homo Sapiens
FLRVQHGLK

SEQ ID NO: 158664 - protein, 9 aa, Homo Sapiens
PPACSPSRL

SEQ ID NO: 158665 - protein, 9 aa, Homo Sapiens
PNGDDDQLI

SEQ ID NO: 158666 - protein, 9 aa, Homo Sapiens
APCRHRRLR

SEQ ID NO: 158667 - protein, 9 aa, Homo Sapiens
EDHSDPDAC

SEQ ID NO: 158668 - protein, 9 aa, Homo Sapiens
GSESSKQHD

SEQ ID NO: 158669 - protein, 9 aa, Homo Sapiens
RSRSNSPRR

SEQ ID NO: 158670 - protein, 9 aa, Homo Sapiens
DIRIRVQSI

SEQ ID NO: 158671 - protein, 9 aa, Homo Sapiens
PSGVAWLES

SEQ ID NO: 158672 - protein, 9 aa, Homo Sapiens
LPTLFALSP

SEQ ID NO: 158673 - protein, 9 aa, Homo Sapiens
KQGCLKRTG

SEQ ID NO: 158674 - protein, 9 aa, Homo Sapiens
VTRLWSSSG

SEQ ID NO: 158675 - protein, 9 aa, Homo Sapiens
TMNEELKQA

SEQ ID NO: 158676 - protein, 9 aa, Homo Sapiens
MIHPLPVKP

SEQ ID NO: 158677 - protein, 9 aa, Homo Sapiens
GLDRIVDKV

SEQ ID NO: 158678 - protein, 9 aa, Homo Sapiens
GGGRELSEL

SEQ ID NO: 158679 - protein, 9 aa, Homo Sapiens
VKHKADSEE

SEQ ID NO: 158680 - protein, 9 aa, Homo Sapiens
PADPILQEA

SEQ ID NO: 158681 - protein, 9 aa, Homo Sapiens
WWAQRRRWA

SEQ ID NO: 158682 - protein, 9 aa, Homo Sapiens
DGGLGDHDT

SEQ ID NO: 158683 - protein, 9 aa, Homo Sapiens
AFGKEGIYK

SEQ ID NO: 158684 - protein, 9 aa, Homo Sapiens
YMRIWSLRH

SEQ ID NO: 158685 - protein, 9 aa, Homo Sapiens
LTVSHGRVD

SEQ ID NO: 158686 - protein, 9 aa, Homo Sapiens
ATDAAHMSA

SEQ ID NO: 158687 - protein, 9 aa, Homo Sapiens
FRCSSSEVP

SEQ ID NO: 158688 - protein, 9 aa, Homo Sapiens
GTGQRLSQA

SEQ ID NO: 158689 - protein, 9 aa, Homo Sapiens
TPRGRTSGR

SEQ ID NO: 158690 - protein, 9 aa, Homo Sapiens
NIQHNPFNI

SEQ ID NO: 158691 - protein, 9 aa, Homo Sapiens
CQGVYLWLM

SEQ ID NO: 158692 - protein, 9 aa, Homo Sapiens
APHPERKTA

SEQ ID NO: 158693 - protein, 9 aa, Homo Sapiens
PHNILRDWM

SEQ ID NO: 158694 - protein, 9 aa, Homo Sapiens
QPRGPPLPP

SEQ ID NO: 158695 - protein, 9 aa, Homo Sapiens
VSCDSFKNQ

SEQ ID NO: 158696 - protein, 9 aa, Homo Sapiens
TDKDEEFAG

SEQ ID NO: 158697 - protein, 9 aa, Homo Sapiens
KRLHKTVWR

SEQ ID NO: 158698 - protein, 9 aa, Homo Sapiens
GRRPLPPSA

SEQ ID NO: 158699 - protein, 9 aa, Homo Sapiens
KLGEEFMEG

SEQ ID NO: 158700 - protein, 9 aa, Homo Sapiens
NKKRQTLRT

SEQ ID NO: 158701 - protein, 9 aa, Homo Sapiens
ENYEHINVP

SEQ ID NO: 158702 - protein, 9 aa, Homo Sapiens
PRVLSCLYS

SEQ ID NO: 158703 - protein, 9 aa, Homo Sapiens
LKYLINPET

SEQ ID NO: 158704 - protein, 9 aa, Homo Sapiens
GREERREVW

SEQ ID NO: 158705 - protein, 9 aa, Homo Sapiens
LTQHQKIHR

SEQ ID NO: 158706 - protein, 9 aa, Homo Sapiens
QGHPAHFCH

SEQ ID NO: 158707 - protein, 9 aa, Homo Sapiens
STAPSPRAG

SEQ ID NO: 158708 - protein, 9 aa, Homo Sapiens
HIPLFCTPF

SEQ ID NO: 158709 - protein, 9 aa, Homo Sapiens
VEAASSALA

SEQ ID NO: 158710 - protein, 9 aa, Homo Sapiens
LDLSNDAVH

SEQ ID NO: 158711 - protein, 9 aa, Homo Sapiens
LDTLQCGYP

SEQ ID NO: 158712 - protein, 9 aa, Homo Sapiens
YTWHLPCGG

SEQ ID NO: 158713 - protein, 9 aa, Homo Sapiens
DKAREIICQ

SEQ ID NO: 158714 - protein, 9 aa, Homo Sapiens
WLRMVSFCC

SEQ ID NO: 158715 - protein, 9 aa, Homo Sapiens
AGGRTRANG

SEQ ID NO: 158716 - protein, 9 aa, Homo Sapiens
FYTSAMAYP

SEQ ID NO: 158717 - protein, 9 aa, Homo Sapiens
GKVKRQRKC

SEQ ID NO: 158718 - protein, 9 aa, Homo Sapiens
LTFSASIAE

SEQ ID NO: 158719 - protein, 9 aa, Homo Sapiens
INGLEVVGK

SEQ ID NO: 158720 - protein, 9 aa, Homo Sapiens
RIGGGGQWR

SEQ ID NO: 158721 - protein, 9 aa, Homo Sapiens
GRAPHPERK

SEQ ID NO: 158722 - protein, 9 aa, Homo Sapiens
PGSGPSPAP

SEQ ID NO: 158723 - protein, 9 aa, Homo Sapiens
KMFLEELMA

SEQ ID NO: 158724 - protein, 9 aa, Homo Sapiens
AALALWGWR

SEQ ID NO: 158725 - protein, 9 aa, Homo Sapiens
HLWLGTLCP

SEQ ID NO: 158726 - protein, 9 aa, Homo Sapiens
CRRAGRAAG

SEQ ID NO: 158727 - protein, 9 aa, Homo Sapiens
WLQVPGELG

SEQ ID NO: 158728 - protein, 9 aa, Homo Sapiens
ATLEVSGSR

SEQ ID NO: 158729 - protein, 9 aa, Homo Sapiens
LSVFELLLL

SEQ ID NO: 158730 - protein, 9 aa, Homo Sapiens
SCCERMICN

SEQ ID NO: 158731 - protein, 9 aa, Homo Sapiens
GDAPSHSPP

SEQ ID NO: 158732 - protein, 9 aa, Homo Sapiens
SNPGTFMCS

SEQ ID NO: 158733 - protein, 9 aa, Homo Sapiens
IKDFSPKKC

SEQ ID NO: 158734 - protein, 9 aa, Homo Sapiens
PMGPPPECC

SEQ ID NO: 158735 - protein, 9 aa, Homo Sapiens
RMATLERQT

SEQ ID NO: 158736 - protein, 9 aa, Homo Sapiens
QPRPALLKL

SEQ ID NO: 158737 - protein, 9 aa, Homo Sapiens
HPQPAPAGA

SEQ ID NO: 158738 - protein, 9 aa, Homo Sapiens
NAVATRTWL

SEQ ID NO: 158739 - protein, 9 aa, Homo Sapiens
VIHANTHLE

SEQ ID NO: 158740 - protein, 9 aa, Homo Sapiens
VWCRHCGST

SEQ ID NO: 158741 - protein, 9 aa, Homo Sapiens
VDNCGPYGQ

SEQ ID NO: 158742 - protein, 9 aa, Homo Sapiens
LNWSSCWAA

SEQ ID NO: 158743 - protein, 9 aa, Homo Sapiens
FQLVLPGEA

SEQ ID NO: 158744 - protein, 9 aa, Homo Sapiens
RPGGDVREP

SEQ ID NO: 158745 - protein, 9 aa, Homo Sapiens
CWRPSQSAA

SEQ ID NO: 158746 - protein, 9 aa, Homo Sapiens
NSPCSMCCV

SEQ ID NO: 158747 - protein, 9 aa, Homo Sapiens
SCCPRPRCR

SEQ ID NO: 158748 - protein, 9 aa, Homo Sapiens
ECFRNMDKR

SEQ ID NO: 158749 - protein, 9 aa, Homo Sapiens
GWRTPEDHS

SEQ ID NO: 158750 - protein, 9 aa, Homo Sapiens
RRTWWRTRA

SEQ ID NO: 158751 - protein, 9 aa, Homo Sapiens
WNGFSNLVR

SEQ ID NO: 158752 - protein, 9 aa, Homo Sapiens
TARGYAVSS

SEQ ID NO: 158753 - protein, 9 aa, Homo Sapiens
VGSESSKQH

SEQ ID NO: 158754 - protein, 9 aa, Homo Sapiens
SEKEQRCGA

SEQ ID NO: 158755 - protein, 9 aa, Homo Sapiens
PEMTEVNIN

SEQ ID NO: 158756 - protein, 9 aa, Homo Sapiens
IDLIIESSS

SEQ ID NO: 158757 - protein, 9 aa, Homo Sapiens
RRGEAAHRG

SEQ ID NO: 158758 - protein, 9 aa, Homo Sapiens
STPLPADLP

SEQ ID NO: 158759 - protein, 9 aa, Homo Sapiens
GQLSTLLGI

SEQ ID NO: 158760 - protein, 9 aa, Homo Sapiens
KNECYQATF

SEQ ID NO: 158761 - protein, 9 aa, Homo Sapiens
SINKDHKLC

SEQ ID NO: 158762 - protein, 9 aa, Homo Sapiens
HQSRLWERE

SEQ ID NO: 158763 - protein, 9 aa, Homo Sapiens
RLKHTMLSE

SEQ ID NO: 158764 - protein, 9 aa, Homo Sapiens
MSRKACAHW

SEQ ID NO: 158765 - protein, 9 aa, Homo Sapiens
LTLPKVEVM

SEQ ID NO: 158766 - protein, 9 aa, Homo Sapiens
AQSVSGTAT

SEQ ID NO: 158767 - protein, 9 aa, Homo Sapiens
LHTPGLPQF

SEQ ID NO: 158768 - protein, 9 aa, Homo Sapiens
LFLSWKCLV

SEQ ID NO: 158769 - protein, 9 aa, Homo Sapiens
SQVWTAATL

SEQ ID NO: 158770 - protein, 9 aa, Homo Sapiens
GAWCTTSCD

SEQ ID NO: 158771 - protein, 9 aa, Homo Sapiens
FPNHYCEAA

SEQ ID NO: 158772 - protein, 9 aa, Homo Sapiens
CTYSAVVKV

SEQ ID NO: 158773 - protein, 9 aa, Homo Sapiens
APPPELHPL

SEQ ID NO: 158774 - protein, 9 aa, Homo Sapiens
VHADSQGQS

SEQ ID NO: 158775 - protein, 9 aa, Homo Sapiens
VAANSATSV

SEQ ID NO: 158776 - protein, 9 aa, Homo Sapiens
QPSHSTPRL

SEQ ID NO: 158777 - protein, 9 aa, Homo Sapiens
FISATVQMG

SEQ ID NO: 158778 - protein, 9 aa, Homo Sapiens
PSPCTQGRC

SEQ ID NO: 158779 - protein, 9 aa, Homo Sapiens
WHLSTGTMT

SEQ ID NO: 158780 - protein, 9 aa, Homo Sapiens
LKEGFAKYT

SEQ ID NO: 158781 - protein, 9 aa, Homo Sapiens
VQGNLLSWC

SEQ ID NO: 158782 - protein, 9 aa, Homo Sapiens
SVSLMPPLL

SEQ ID NO: 158783 - protein, 9 aa, Homo Sapiens
NPETLQSAF

SEQ ID NO: 158784 - protein, 9 aa, Homo Sapiens
LSPTCVEAA

SEQ ID NO: 158785 - protein, 9 aa, Homo Sapiens
CKPGPITCL

SEQ ID NO: 158786 - protein, 9 aa, Homo Sapiens
KPTFQKPKL

SEQ ID NO: 158787 - protein, 9 aa, Homo Sapiens
TVHGLLRQL

SEQ ID NO: 158788 - protein, 9 aa, Homo Sapiens
RAAIWRRIG

SEQ ID NO: 158789 - protein, 9 aa, Homo Sapiens
TLSLRGMVP

SEQ ID NO: 158790 - protein, 9 aa, Homo Sapiens
YPHNILRDW

SEQ ID NO: 158791 - protein, 9 aa, Homo Sapiens
LGKTSLPQG

SEQ ID NO: 158792 - protein, 9 aa, Homo Sapiens
GIPHHLHFD

SEQ ID NO: 158793 - protein, 9 aa, Homo Sapiens
RASRRRACV

SEQ ID NO: 158794 - protein, 9 aa, Homo Sapiens
PGLPQLPGL

SEQ ID NO: 158795 - protein, 9 aa, Homo Sapiens
MLRLGQMDT

SEQ ID NO: 158796 - protein, 9 aa, Homo Sapiens
ACIENVHGG

SEQ ID NO: 158797 - protein, 9 aa, Homo Sapiens
SLQAAVILD

SEQ ID NO: 158798 - protein, 9 aa, Homo Sapiens
SPDPDVDDS

SEQ ID NO: 158799 - protein, 9 aa, Homo Sapiens
ISSEKITPW

SEQ ID NO: 158800 - protein, 9 aa, Homo Sapiens
AWDRNNVLN

SEQ ID NO: 158801 - protein, 9 aa, Homo Sapiens
YRECGRGFS

SEQ ID NO: 158802 - protein, 9 aa, Homo Sapiens
NVSLSPLNS

SEQ ID NO: 158803 - protein, 9 aa, Homo Sapiens
YPSHYDGCR

SEQ ID NO: 158804 - protein, 9 aa, Homo Sapiens
FPPSSQTWA

SEQ ID NO: 158805 - protein, 9 aa, Homo Sapiens
EQCKEAVAA

SEQ ID NO: 158806 - protein, 9 aa, Homo Sapiens
GSWGTVWDD

SEQ ID NO: 158807 - protein, 9 aa, Homo Sapiens
MGGSRPELM

SEQ ID NO: 158808 - protein, 9 aa, Homo Sapiens
VPALQYLGR

SEQ ID NO: 158809 - protein, 9 aa, Homo Sapiens
QQCECGLDK

SEQ ID NO: 158810 - protein, 9 aa, Homo Sapiens
ECVLLDYST

SEQ ID NO: 158811 - protein, 9 aa, Homo Sapiens
CLHPNSSAW

SEQ ID NO: 158812 - protein, 9 aa, Homo Sapiens
FLDCLSCPG

SEQ ID NO: 158813 - protein, 9 aa, Homo Sapiens
WERERTNQS

SEQ ID NO: 158814 - protein, 9 aa, Homo Sapiens
STHKHTHKH

SEQ ID NO: 158815 - protein, 9 aa, Homo Sapiens
YVGTAILVN

SEQ ID NO: 158816 - protein, 9 aa, Homo Sapiens
EIYIYNIIL

SEQ ID NO: 158817 - protein, 9 aa, Homo Sapiens
VRFALRVRH

SEQ ID NO: 158818 - protein, 9 aa, Homo Sapiens
RLHRGLKAE

SEQ ID NO: 158819 - protein, 9 aa, Homo Sapiens
DQPPPRSPG

SEQ ID NO: 158820 - protein, 9 aa, Homo Sapiens
IPRLPTGLY

SEQ ID NO: 158821 - protein, 9 aa, Homo Sapiens
LTPRTGLRG

SEQ ID NO: 158822 - protein, 9 aa, Homo Sapiens
IPLPLWALI

SEQ ID NO: 158823 - protein, 9 aa, Homo Sapiens
NVWAIGGLF

SEQ ID NO: 158824 - protein, 9 aa, Homo Sapiens
PPAPSRPPT

SEQ ID NO: 158825 - protein, 9 aa, Homo Sapiens
DLTLPKVEV

SEQ ID NO: 158826 - protein, 9 aa, Homo Sapiens
LRQELWQLL

SEQ ID NO: 158827 - protein, 9 aa, Homo Sapiens
SRNVVWSSS

SEQ ID NO: 158828 - protein, 9 aa, Homo Sapiens
RSPTTTARP

SEQ ID NO: 158829 - protein, 9 aa, Homo Sapiens
VVGVATAHA

SEQ ID NO: 158830 - protein, 9 aa, Homo Sapiens
EPRDGIESG

SEQ ID NO: 158831 - protein, 9 aa, Homo Sapiens
TAAPARFLE

SEQ ID NO: 158832 - protein, 9 aa, Homo Sapiens
AWGEIFLFV

SEQ ID NO: 158833 - protein, 9 aa, Homo Sapiens
WARRCTGPP

SEQ ID NO: 158834 - protein, 9 aa, Homo Sapiens
VPKVTAAHS

SEQ ID NO: 158835 - protein, 9 aa, Homo Sapiens
GTSDRGSPA

SEQ ID NO: 158836 - protein, 9 aa, Homo Sapiens
SFISATVQM

SEQ ID NO: 158837 - protein, 9 aa, Homo Sapiens
FRYVQEWSK

SEQ ID NO: 158838 - protein, 9 aa, Homo Sapiens
FQQNSGYPT

SEQ ID NO: 158839 - protein, 9 aa, Homo Sapiens
SQCSLTRAT

SEQ ID NO: 158840 - protein, 9 aa, Homo Sapiens
EEKKEEEDQ

SEQ ID NO: 158841 - protein, 9 aa, Homo Sapiens
DVQILVEME

SEQ ID NO: 158842 - protein, 9 aa, Homo Sapiens
VHSLPVKKK

SEQ ID NO: 158843 - protein, 9 aa, Homo Sapiens
SACSSASSW

SEQ ID NO: 158844 - protein, 9 aa, Homo Sapiens
HLGCVLRRA

SEQ ID NO: 158845 - protein, 9 aa, Homo Sapiens
SVFELLLLV

SEQ ID NO: 158846 - protein, 9 aa, Homo Sapiens
ERIDEPGLW

SEQ ID NO: 158847 - protein, 9 aa, Homo Sapiens
SRLAAASGP

SEQ ID NO: 158848 - protein, 9 aa, Homo Sapiens
WRLVPGCDV

SEQ ID NO: 158849 - protein, 9 aa, Homo Sapiens
LVLEEFKME

SEQ ID NO: 158850 - protein, 9 aa, Homo Sapiens
PWQSPWGEH

SEQ ID NO: 158851 - protein, 9 aa, Homo Sapiens
GKGNLIGCE

SEQ ID NO: 158852 - protein, 9 aa, Homo Sapiens
KEDPEINPS

SEQ ID NO: 158853 - protein, 9 aa, Homo Sapiens
ASSTSRSTC

SEQ ID NO: 158854 - protein, 9 aa, Homo Sapiens
PGIEGLGTD

SEQ ID NO: 158855 - protein, 9 aa, Homo Sapiens
GGSVPARTR

SEQ ID NO: 158856 - protein, 9 aa, Homo Sapiens
AAAVAAARC

SEQ ID NO: 158857 - protein, 9 aa, Homo Sapiens
PGMTGLPRK

SEQ ID NO: 158858 - protein, 9 aa, Homo Sapiens
NLVEAGVEE

SEQ ID NO: 158859 - protein, 9 aa, Homo Sapiens
GETLTSWSM

SEQ ID NO: 158860 - protein, 9 aa, Homo Sapiens
EFRKKRSQM

SEQ ID NO: 158861 - protein, 9 aa, Homo Sapiens
AKASYLFPQ

SEQ ID NO: 158862 - protein, 9 aa, Homo Sapiens
GGCGAGADD

SEQ ID NO: 158863 - protein, 9 aa, Homo Sapiens
QSLLSLYSV

SEQ ID NO: 158864 - protein, 9 aa, Homo Sapiens
ISVHAFQQR

SEQ ID NO: 158865 - protein, 9 aa, Homo Sapiens
KIISNNGHS

SEQ ID NO: 158866 - protein, 9 aa, Homo Sapiens
TCCRTTYCH

SEQ ID NO: 158867 - protein, 9 aa, Homo Sapiens
YECCPGYSG

SEQ ID NO: 158868 - protein, 9 aa, Homo Sapiens
TMGGTRKAS

SEQ ID NO: 158869 - protein, 9 aa, Homo Sapiens
GEKMLLLTS

SEQ ID NO: 158870 - protein, 9 aa, Homo Sapiens
NYEHINVPV

SEQ ID NO: 158871 - protein, 9 aa, Homo Sapiens
HVPRIDRIF

SEQ ID NO: 158872 - protein, 9 aa, Homo Sapiens
DAENAMWYI

SEQ ID NO: 158873 - protein, 9 aa, Homo Sapiens
VAYSVGWEM

SEQ ID NO: 158874 - protein, 9 aa, Homo Sapiens
ISKGVHRVG

SEQ ID NO: 158875 - protein, 9 aa, Homo Sapiens
VKFLLWLLR

SEQ ID NO: 158876 - protein, 9 aa, Homo Sapiens
CILKLNTEI

SEQ ID NO: 158877 - protein, 9 aa, Homo Sapiens
FLRTWGGPR

SEQ ID NO: 158878 - protein, 9 aa, Homo Sapiens
EVTLSRPWP

SEQ ID NO: 158879 - protein, 9 aa, Homo Sapiens
MQFGQVAED

SEQ ID NO: 158880 - protein, 9 aa, Homo Sapiens
TPGSGPSPA

SEQ ID NO: 158881 - protein, 9 aa, Homo Sapiens
APPSLRAAR

SEQ ID NO: 158882 - protein, 9 aa, Homo Sapiens
PESSGHTMP

SEQ ID NO: 158883 - protein, 9 aa, Homo Sapiens
SVPGAFSSS

SEQ ID NO: 158884 - protein, 9 aa, Homo Sapiens
GTMAEERMT

SEQ ID NO: 158885 - protein, 9 aa, Homo Sapiens
CNFDWEAIF

SEQ ID NO: 158886 - protein, 9 aa, Homo Sapiens
NLMYMTVKY

SEQ ID NO: 158887 - protein, 9 aa, Homo Sapiens
FPKIKKPLS

SEQ ID NO: 158888 - protein, 9 aa, Homo Sapiens
QDEDILDTW

SEQ ID NO: 158889 - protein, 9 aa, Homo Sapiens
AAFMRLNEA

SEQ ID NO: 158890 - protein, 9 aa, Homo Sapiens
SITLQVTFP

SEQ ID NO: 158891 - protein, 9 aa, Homo Sapiens
SLEDAKKRG

SEQ ID NO: 158892 - protein, 9 aa, Homo Sapiens
DNVEMITAL

SEQ ID NO: 158893 - protein, 9 aa, Homo Sapiens
HSSGSKRNA

SEQ ID NO: 158894 - protein, 9 aa, Homo Sapiens
IYELIKREK

SEQ ID NO: 158895 - protein, 9 aa, Homo Sapiens
TLMSPGSCL

SEQ ID NO: 158896 - protein, 9 aa, Homo Sapiens
IQQWHGLAN

SEQ ID NO: 158897 - protein, 9 aa, Homo Sapiens
DANHSTLLS

SEQ ID NO: 158898 - protein, 9 aa, Homo Sapiens
MGKEEEELL

SEQ ID NO: 158899 - protein, 9 aa, Homo Sapiens
PTRIALNSA

SEQ ID NO: 158900 - protein, 9 aa, Homo Sapiens
GLQGSPLAF

SEQ ID NO: 158901 - protein, 9 aa, Homo Sapiens
YRDCQSERL

SEQ ID NO: 158902 - protein, 9 aa, Homo Sapiens
IICQSLAWR

SEQ ID NO: 158903 - protein, 9 aa, Homo Sapiens
HLARSHQPK

SEQ ID NO: 158904 - protein, 9 aa, Homo Sapiens
RDCQSERLY

SEQ ID NO: 158905 - protein, 9 aa, Homo Sapiens
SVIQMHSSG

SEQ ID NO: 158906 - protein, 9 aa, Homo Sapiens
RHFSKSIRP

SEQ ID NO: 158907 - protein, 9 aa, Homo Sapiens
TPSSETSSS

SEQ ID NO: 158908 - protein, 9 aa, Homo Sapiens
VNEQTKFNL

SEQ ID NO: 158909 - protein, 9 aa, Homo Sapiens
PELFTGKYN

SEQ ID NO: 158910 - protein, 9 aa, Homo Sapiens
GHLRARAEP

SEQ ID NO: 158911 - protein, 9 aa, Homo Sapiens
LLVLTQLPR

SEQ ID NO: 158912 - protein, 9 aa, Homo Sapiens
ATLPCRRHC

SEQ ID NO: 158913 - protein, 9 aa, Homo Sapiens
SPLDASPAG

SEQ ID NO: 158914 - protein, 9 aa, Homo Sapiens
CLSADHELL

SEQ ID NO: 158915 - protein, 9 aa, Homo Sapiens
AAFPPPAAS

SEQ ID NO: 158916 - protein, 9 aa, Homo Sapiens
TAPSSAPRT

SEQ ID NO: 158917 - protein, 9 aa, Homo Sapiens
MNTHVLHPR

SEQ ID NO: 158918 - protein, 9 aa, Homo Sapiens
CGCFLLWNL

SEQ ID NO: 158919 - protein, 9 aa, Homo Sapiens
GHGAPRSPS

SEQ ID NO: 158920 - protein, 9 aa, Homo Sapiens
QESRDHTTL

SEQ ID NO: 158921 - protein, 9 aa, Homo Sapiens
SPAGAAPRR

SEQ ID NO: 158922 - protein, 9 aa, Homo Sapiens
DPEPDYTSL

SEQ ID NO: 158923 - protein, 9 aa, Homo Sapiens
PLHPGITDT

SEQ ID NO: 158924 - protein, 9 aa, Homo Sapiens
GGVQKRSHL

SEQ ID NO: 158925 - protein, 9 aa, Homo Sapiens
LVMVVILQL

SEQ ID NO: 158926 - protein, 9 aa, Homo Sapiens
RRSWLLGFE

SEQ ID NO: 158927 - protein, 9 aa, Homo Sapiens
RGYTLYTSD

SEQ ID NO: 158928 - protein, 9 aa, Homo Sapiens
GIRAQGTRR

SEQ ID NO: 158929 - protein, 9 aa, Homo Sapiens
SRSLRLLVW

SEQ ID NO: 158930 - protein, 9 aa, Homo Sapiens
RGRDAPYCV

SEQ ID NO: 158931 - protein, 9 aa, Homo Sapiens
LQITELKAL

SEQ ID NO: 158932 - protein, 9 aa, Homo Sapiens
LHRTTNPHS

SEQ ID NO: 158933 - protein, 9 aa, Homo Sapiens
AVGQDCYMR

SEQ ID NO: 158934 - protein, 9 aa, Homo Sapiens
FNLPCRSTD

SEQ ID NO: 158935 - protein, 9 aa, Homo Sapiens
DQGLTFDYS

SEQ ID NO: 158936 - protein, 9 aa, Homo Sapiens
SFRLDPEYQ

SEQ ID NO: 158937 - protein, 9 aa, Homo Sapiens
TIKKYCQLT

SEQ ID NO: 158938 - protein, 9 aa, Homo Sapiens
PMGREEESD

SEQ ID NO: 158939 - protein, 9 aa, Homo Sapiens
QICYGMHGF

SEQ ID NO: 158940 - protein, 9 aa, Homo Sapiens
PCLSTILIN

SEQ ID NO: 158941 - protein, 9 aa, Homo Sapiens
LAVSSRMVS

SEQ ID NO: 158942 - protein, 9 aa, Homo Sapiens
PSPGKPTFQ

SEQ ID NO: 158943 - protein, 9 aa, Homo Sapiens
RRVLSDCKV

SEQ ID NO: 158944 - protein, 9 aa, Homo Sapiens
SEPLRGQPP

SEQ ID NO: 158945 - protein, 9 aa, Homo Sapiens
LIKRYQESL

SEQ ID NO: 158946 - protein, 9 aa, Homo Sapiens
RSPRVFPVL

SEQ ID NO: 158947 - protein, 9 aa, Homo Sapiens
VAWLESWEV

SEQ ID NO: 158948 - protein, 9 aa, Homo Sapiens
AAGASGWSA

SEQ ID NO: 158949 - protein, 9 aa, Homo Sapiens
LMPPLLLGL

SEQ ID NO: 158950 - protein, 9 aa, Homo Sapiens
HHWNYLSFL

SEQ ID NO: 158951 - protein, 9 aa, Homo Sapiens
QLVKCRRHQ

SEQ ID NO: 158952 - protein, 9 aa, Homo Sapiens
HRGLKAEAV

SEQ ID NO: 158953 - protein, 9 aa, Homo Sapiens
DVDGAWCTT

SEQ ID NO: 158954 - protein, 9 aa, Homo Sapiens
SLHKGAKHK

SEQ ID NO: 158955 - protein, 9 aa, Homo Sapiens
LLEVVPLST

SEQ ID NO: 158956 - protein, 9 aa, Homo Sapiens
CPQRLPKAL

SEQ ID NO: 158957 - protein, 9 aa, Homo Sapiens
WTPAKGRCI

SEQ ID NO: 158958 - protein, 9 aa, Homo Sapiens
EDGSSLSDY

SEQ ID NO: 158959 - protein, 9 aa, Homo Sapiens
THTGTHTDT

SEQ ID NO: 158960 - protein, 9 aa, Homo Sapiens
MEIQCPALR

SEQ ID NO: 158961 - protein, 9 aa, Homo Sapiens
KEEEIAVDK

SEQ ID NO: 158962 - protein, 9 aa, Homo Sapiens
TAFEEGQAL

SEQ ID NO: 158963 - protein, 9 aa, Homo Sapiens
TKPNIFHKD

SEQ ID NO: 158964 - protein, 9 aa, Homo Sapiens
NFRHFQHHT

SEQ ID NO: 158965 - protein, 9 aa, Homo Sapiens
PCWGWHGSL

SEQ ID NO: 158966 - protein, 9 aa, Homo Sapiens
LDLASEFLP

SEQ ID NO: 158967 - protein, 9 aa, Homo Sapiens
QSICLQVLT

SEQ ID NO: 158968 - protein, 9 aa, Homo Sapiens
NVFPPSSQT

SEQ ID NO: 158969 - protein, 9 aa, Homo Sapiens
YAAGGMVEG

SEQ ID NO: 158970 - protein, 9 aa, Homo Sapiens
FNLASAYKV

SEQ ID NO: 158971 - protein, 9 aa, Homo Sapiens
SGRSARMSS

SEQ ID NO: 158972 - protein, 9 aa, Homo Sapiens
DGAWRQRRK

SEQ ID NO: 158973 - protein, 9 aa, Homo Sapiens
RIDYMLYKA

SEQ ID NO: 158974 - protein, 9 aa, Homo Sapiens
VRREFRNAL

SEQ ID NO: 158975 - protein, 9 aa, Homo Sapiens
TGKYNNSVD

SEQ ID NO: 158976 - protein, 9 aa, Homo Sapiens
QVFLRQEGP

SEQ ID NO: 158977 - protein, 9 aa, Homo Sapiens
AQKTEEAWR

SEQ ID NO: 158978 - protein, 9 aa, Homo Sapiens
RAASKEKCV

SEQ ID NO: 158979 - protein, 9 aa, Homo Sapiens
RLVHVYIVF

SEQ ID NO: 158980 - protein, 9 aa, Homo Sapiens
HVLNMEKNY

SEQ ID NO: 158981 - protein, 9 aa, Homo Sapiens
MWSWRPHPP

SEQ ID NO: 158982 - protein, 9 aa, Homo Sapiens
DPVHRPFAR

SEQ ID NO: 158983 - protein, 9 aa, Homo Sapiens
SATVQMGFC

SEQ ID NO: 158984 - protein, 9 aa, Homo Sapiens
GGPSARRQP

SEQ ID NO: 158985 - protein, 9 aa, Homo Sapiens
PVMSDAYDR

SEQ ID NO: 158986 - protein, 9 aa, Homo Sapiens
LPVKKKRRL

SEQ ID NO: 158987 - protein, 9 aa, Homo Sapiens
LGGDGISDE

SEQ ID NO: 158988 - protein, 9 aa, Homo Sapiens
GQQGYLGRW

SEQ ID NO: 158989 - protein, 9 aa, Homo Sapiens
LQANRLPGI

SEQ ID NO: 158990 - protein, 9 aa, Homo Sapiens
RVFGQLTGS

SEQ ID NO: 158991 - protein, 9 aa, Homo Sapiens
VPGETGLLP

SEQ ID NO: 158992 - protein, 9 aa, Homo Sapiens
NIRKFIVQI

SEQ ID NO: 158993 - protein, 9 aa, Homo Sapiens
IVYRHVKNG

SEQ ID NO: 158994 - protein, 9 aa, Homo Sapiens
QSRWCCCRA

SEQ ID NO: 158995 - protein, 9 aa, Homo Sapiens
QFLCAWDFN

SEQ ID NO: 158996 - protein, 9 aa, Homo Sapiens
PSQPPSPGK

SEQ ID NO: 158997 - protein, 9 aa, Homo Sapiens
RSPMVFLPE

SEQ ID NO: 158998 - protein, 9 aa, Homo Sapiens
TARSVHAAM

SEQ ID NO: 158999 - protein, 9 aa, Homo Sapiens
APSPRAGSR

SEQ ID NO: 159000 - protein, 9 aa, Homo Sapiens
GWRVVDHRV

SEQ ID NO: 159001 - protein, 9 aa, Homo Sapiens
MRLNEAVLL

SEQ ID NO: 159002 - protein, 9 aa, Homo Sapiens
CSHFFQLKT

SEQ ID NO: 159003 - protein, 9 aa, Homo Sapiens
KEWFHASVR

SEQ ID NO: 159004 - protein, 9 aa, Homo Sapiens
SFNVLGFSV

SEQ ID NO: 159005 - protein, 9 aa, Homo Sapiens
AGRTSARRR

SEQ ID NO: 159006 - protein, 9 aa, Homo Sapiens
KVHIFQDCE

SEQ ID NO: 159007 - protein, 9 aa, Homo Sapiens
HTLMGKEEE

SEQ ID NO: 159008 - protein, 9 aa, Homo Sapiens
VDAKVVDPS

SEQ ID NO: 159009 - protein, 9 aa, Homo Sapiens
LTFPAVMLC

SEQ ID NO: 159010 - protein, 9 aa, Homo Sapiens
GPSAGLCSL

SEQ ID NO: 159011 - protein, 9 aa, Homo Sapiens
HLYSMCLLI

SEQ ID NO: 159012 - protein, 9 aa, Homo Sapiens
PTQQPQTPQ

SEQ ID NO: 159013 - protein, 9 aa, Homo Sapiens
LWTPAKGRC

SEQ ID NO: 159014 - protein, 9 aa, Homo Sapiens
RRSAPRSCG

SEQ ID NO: 159015 - protein, 9 aa, Homo Sapiens
TQKNMLSPD

SEQ ID NO: 159016 - protein, 9 aa, Homo Sapiens
QGEDCYFFS

SEQ ID NO: 159017 - protein, 9 aa, Homo Sapiens
LGVLGTQAK

SEQ ID NO: 159018 - protein, 9 aa, Homo Sapiens
SKQNRRSLK

SEQ ID NO: 159019 - protein, 9 aa, Homo Sapiens
GCSLGSCLV

SEQ ID NO: 159020 - protein, 9 aa, Homo Sapiens
SSCKKQAAS

SEQ ID NO: 159021 - protein, 9 aa, Homo Sapiens
SLAVSSRMV

SEQ ID NO: 159022 - protein, 9 aa, Homo Sapiens
AHLGLPGRA

SEQ ID NO: 159023 - protein, 9 aa, Homo Sapiens
PPTRSSSRT

SEQ ID NO: 159024 - protein, 9 aa, Homo Sapiens
GLKPTIEVA

SEQ ID NO: 159025 - protein, 9 aa, Homo Sapiens
VVDEEVFFS

SEQ ID NO: 159026 - protein, 9 aa, Homo Sapiens
VKKQPFFMT

SEQ ID NO: 159027 - protein, 9 aa, Homo Sapiens
AVLSRPLQR

SEQ ID NO: 159028 - protein, 9 aa, Homo Sapiens
FLDTLQCGY

SEQ ID NO: 159029 - protein, 9 aa, Homo Sapiens
HGFLQLRHG

SEQ ID NO: 159030 - protein, 9 aa, Homo Sapiens
VPPGADQHG

SEQ ID NO: 159031 - protein, 9 aa, Homo Sapiens
PKSWAPAPR

SEQ ID NO: 159032 - protein, 9 aa, Homo Sapiens
WRRPSGPCP

SEQ ID NO: 159033 - protein, 9 aa, Homo Sapiens
LGTLRGDEL

SEQ ID NO: 159034 - protein, 9 aa, Homo Sapiens
TATVTILGQ

SEQ ID NO: 159035 - protein, 9 aa, Homo Sapiens
KMMDLRMER

SEQ ID NO: 159036 - protein, 9 aa, Homo Sapiens
IPDTQAMSD

SEQ ID NO: 159037 - protein, 9 aa, Homo Sapiens
AKMEPLSTT

SEQ ID NO: 159038 - protein, 9 aa, Homo Sapiens
HTLPMPRLV

SEQ ID NO: 159039 - protein, 9 aa, Homo Sapiens
TTAASEQGD

SEQ ID NO: 159040 - protein, 9 aa, Homo Sapiens
TPLPATTST

SEQ ID NO: 159041 - protein, 9 aa, Homo Sapiens
YQQTIKKYC

SEQ ID NO: 159042 - protein, 9 aa, Homo Sapiens
LFFKSFHSW

SEQ ID NO: 159043 - protein, 9 aa, Homo Sapiens
RPPPARASP

SEQ ID NO: 159044 - protein, 9 aa, Homo Sapiens
SSGYDWNES

SEQ ID NO: 159045 - protein, 9 aa, Homo Sapiens
DLFESFFHY

SEQ ID NO: 159046 - protein, 9 aa, Homo Sapiens
EYHQSTLQP

SEQ ID NO: 159047 - protein, 9 aa, Homo Sapiens
APGVGWRGA

SEQ ID NO: 159048 - protein, 9 aa, Homo Sapiens
SKDNVEMIT

SEQ ID NO: 159049 - protein, 9 aa, Homo Sapiens
SLPGGTDTM

SEQ ID NO: 159050 - protein, 9 aa, Homo Sapiens
NMSLEMWCR

SEQ ID NO: 159051 - protein, 9 aa, Homo Sapiens
PRKGSPGCV

SEQ ID NO: 159052 - protein, 9 aa, Homo Sapiens
AAVHCALHS

SEQ ID NO: 159053 - protein, 9 aa, Homo Sapiens
FYRPAPYFA

SEQ ID NO: 159054 - protein, 9 aa, Homo Sapiens
PLEVNECIG

SEQ ID NO: 159055 - protein, 9 aa, Homo Sapiens
LNPLRLPSE

SEQ ID NO: 159056 - protein, 9 aa, Homo Sapiens
NPTSKAECM

SEQ ID NO: 159057 - protein, 9 aa, Homo Sapiens
PFSNQTQIP

SEQ ID NO: 159058 - protein, 9 aa, Homo Sapiens
VAAGLLTAA

SEQ ID NO: 159059 - protein, 9 aa, Homo Sapiens
VHLDEQCER

SEQ ID NO: 159060 - protein, 9 aa, Homo Sapiens
EASLRRSPG

SEQ ID NO: 159061 - protein, 9 aa, Homo Sapiens
IEVVKASYP

SEQ ID NO: 159062 - protein, 9 aa, Homo Sapiens
PQRLPKALR

SEQ ID NO: 159063 - protein, 9 aa, Homo Sapiens
SRLHRGLKA

SEQ ID NO: 159064 - protein, 9 aa, Homo Sapiens
PIKKKRTEF

SEQ ID NO: 159065 - protein, 9 aa, Homo Sapiens
RDLEPGMDY

SEQ ID NO: 159066 - protein, 9 aa, Homo Sapiens
FTPQSPPQS

SEQ ID NO: 159067 - protein, 9 aa, Homo Sapiens
ENKSVCDRF

SEQ ID NO: 159068 - protein, 9 aa, Homo Sapiens
YCEAAFGGG

SEQ ID NO: 159069 - protein, 9 aa, Homo Sapiens
CSPAHWLRA

SEQ ID NO: 159070 - protein, 9 aa, Homo Sapiens
QARKAFDEA

SEQ ID NO: 159071 - protein, 9 aa, Homo Sapiens
FFRLIMDGV

SEQ ID NO: 159072 - protein, 9 aa, Homo Sapiens
TRHGPYPAA

SEQ ID NO: 159073 - protein, 9 aa, Homo Sapiens
LPWARHTHP

SEQ ID NO: 159074 - protein, 9 aa, Homo Sapiens
AFGMVYKGI

SEQ ID NO: 159075 - protein, 9 aa, Homo Sapiens
SWSSRIVAP

SEQ ID NO: 159076 - protein, 9 aa, Homo Sapiens
KKKVQGHPA

SEQ ID NO: 159077 - protein, 9 aa, Homo Sapiens
QTPALLRNM

SEQ ID NO: 159078 - protein, 9 aa, Homo Sapiens
QNYYTGGWH

SEQ ID NO: 159079 - protein, 9 aa, Homo Sapiens
SRRPLSLAD

SEQ ID NO: 159080 - protein, 9 aa, Homo Sapiens
VRSAPGQAL

SEQ ID NO: 159081 - protein, 9 aa, Homo Sapiens
SSLSGKTED

SEQ ID NO: 159082 - protein, 9 aa, Homo Sapiens
KRQTLRTLS

SEQ ID NO: 159083 - protein, 9 aa, Homo Sapiens
DSINKDHKL

SEQ ID NO: 159084 - protein, 9 aa, Homo Sapiens
AHALARFAQ

SEQ ID NO: 159085 - protein, 9 aa, Homo Sapiens
PCPDVWLAA

SEQ ID NO: 159086 - protein, 9 aa, Homo Sapiens
DDVTLTKHA

SEQ ID NO: 159087 - protein, 9 aa, Homo Sapiens
ATTPPIGPS

SEQ ID NO: 159088 - protein, 9 aa, Homo Sapiens
RPPTPSTCL

SEQ ID NO: 159089 - protein, 9 aa, Homo Sapiens
SVLRPHSYV

SEQ ID NO: 159090 - protein, 9 aa, Homo Sapiens
ASTGTEVQM

SEQ ID NO: 159091 - protein, 9 aa, Homo Sapiens
QIYMCFMQE

SEQ ID NO: 159092 - protein, 9 aa, Homo Sapiens
FGRHTAGAV

SEQ ID NO: 159093 - protein, 9 aa, Homo Sapiens
PKIKKPLSY

SEQ ID NO: 159094 - protein, 9 aa, Homo Sapiens
VGPVLHKVP

SEQ ID NO: 159095 - protein, 9 aa, Homo Sapiens
TFIFLCSLS

SEQ ID NO: 159096 - protein, 9 aa, Homo Sapiens
PRLCATTTC

SEQ ID NO: 159097 - protein, 9 aa, Homo Sapiens
SQCTQGRRW

SEQ ID NO: 159098 - protein, 9 aa, Homo Sapiens
IIESSSDEE

SEQ ID NO: 159099 - protein, 9 aa, Homo Sapiens
LADQRVAEY

SEQ ID NO: 159100 - protein, 9 aa, Homo Sapiens
PLLTLRPAL

SEQ ID NO: 159101 - protein, 9 aa, Homo Sapiens
FAVGSRLPG

SEQ ID NO: 159102 - protein, 9 aa, Homo Sapiens
RPAAAPWRP

SEQ ID NO: 159103 - protein, 9 aa, Homo Sapiens
GSCTAPCSC

SEQ ID NO: 159104 - protein, 9 aa, Homo Sapiens
ATSPGAPRS

SEQ ID NO: 159105 - protein, 9 aa, Homo Sapiens
TNPTWRRTG

SEQ ID NO: 159106 - protein, 9 aa, Homo Sapiens
VLIKKIARL

SEQ ID NO: 159107 - protein, 9 aa, Homo Sapiens
TPRIVNISV

SEQ ID NO: 159108 - protein, 9 aa, Homo Sapiens
EDLESMDKA

SEQ ID NO: 159109 - protein, 9 aa, Homo Sapiens
SFCLSADHE

SEQ ID NO: 159110 - protein, 9 aa, Homo Sapiens
FHSSGDLPC

SEQ ID NO: 159111 - protein, 9 aa, Homo Sapiens
LPPSPGPLG

SEQ ID NO: 159112 - protein, 9 aa, Homo Sapiens
LPPAQPPLP

SEQ ID NO: 159113 - protein, 9 aa, Homo Sapiens
PPSLRAARA

SEQ ID NO: 159114 - protein, 9 aa, Homo Sapiens
RMTGHGRAR

SEQ ID NO: 159115 - protein, 9 aa, Homo Sapiens
VCATVAQFN

SEQ ID NO: 159116 - protein, 9 aa, Homo Sapiens
PLFCTPFCT

SEQ ID NO: 159117 - protein, 9 aa, Homo Sapiens
HFVTQCNTQ

SEQ ID NO: 159118 - protein, 9 aa, Homo Sapiens
HSLSRNPIS

SEQ ID NO: 159119 - protein, 9 aa, Homo Sapiens
LPGAKAGVH

SEQ ID NO: 159120 - protein, 9 aa, Homo Sapiens
IEGLGTDIT

SEQ ID NO: 159121 - protein, 9 aa, Homo Sapiens
SYYQIFFDV

SEQ ID NO: 159122 - protein, 9 aa, Homo Sapiens
QPSSCHLIT

SEQ ID NO: 159123 - protein, 9 aa, Homo Sapiens
LVTKRCAQT

SEQ ID NO: 159124 - protein, 9 aa, Homo Sapiens
RKGRPLGLL

SEQ ID NO: 159125 - protein, 9 aa, Homo Sapiens
EGLSPRRAQ

SEQ ID NO: 159126 - protein, 9 aa, Homo Sapiens
EYCENVYHL

SEQ ID NO: 159127 - protein, 9 aa, Homo Sapiens
GVDSLDMCD

SEQ ID NO: 159128 - protein, 9 aa, Homo Sapiens
SSLTSLKKS

SEQ ID NO: 159129 - protein, 9 aa, Homo Sapiens
PHFGKMMIM

SEQ ID NO: 159130 - protein, 9 aa, Homo Sapiens
MCDGDRWRE

SEQ ID NO: 159131 - protein, 9 aa, Homo Sapiens
YTQTHTGIH

SEQ ID NO: 159132 - protein, 9 aa, Homo Sapiens
LTFDYSHPR

SEQ ID NO: 159133 - protein, 9 aa, Homo Sapiens
GPMQAALLR

SEQ ID NO: 159134 - protein, 9 aa, Homo Sapiens
PPAQAVMLR

SEQ ID NO: 159135 - protein, 9 aa, Homo Sapiens
GSRRGGGRQ

SEQ ID NO: 159136 - protein, 9 aa, Homo Sapiens
HPVRVPDQE

SEQ ID NO: 159137 - protein, 9 aa, Homo Sapiens
ACSSASSWS

SEQ ID NO: 159138 - protein, 9 aa, Homo Sapiens
EEVLTAEYC

SEQ ID NO: 159139 - protein, 9 aa, Homo Sapiens
KAECMAEKC

SEQ ID NO: 159140 - protein, 9 aa, Homo Sapiens
LGGPSARRQ

SEQ ID NO: 159141 - protein, 9 aa, Homo Sapiens
WALAVDPTE

SEQ ID NO: 159142 - protein, 9 aa, Homo Sapiens
NSWRSGGSG

SEQ ID NO: 159143 - protein, 9 aa, Homo Sapiens
GTDTMSAST

SEQ ID NO: 159144 - protein, 9 aa, Homo Sapiens
PPRRCCAAR

SEQ ID NO: 159145 - protein, 9 aa, Homo Sapiens
EELDERGYT

SEQ ID NO: 159146 - protein, 9 aa, Homo Sapiens
ASVCAPATP

SEQ ID NO: 159147 - protein, 9 aa, Homo Sapiens
SGCVRSFAL

SEQ ID NO: 159148 - protein, 9 aa, Homo Sapiens
KGHTNTGDA

SEQ ID NO: 159149 - protein, 9 aa, Homo Sapiens
KKRLSEGEA

SEQ ID NO: 159150 - protein, 9 aa, Homo Sapiens
NYERQKMFL

SEQ ID NO: 159151 - protein, 9 aa, Homo Sapiens
GIDGPPGKP

SEQ ID NO: 159152 - protein, 9 aa, Homo Sapiens
VHGLLRQLG

SEQ ID NO: 159153 - protein, 9 aa, Homo Sapiens
MGSLRAPMD

SEQ ID NO: 159154 - protein, 9 aa, Homo Sapiens
GQWHLGAAS

SEQ ID NO: 159155 - protein, 9 aa, Homo Sapiens
LSQFFPEVI

SEQ ID NO: 159156 - protein, 9 aa, Homo Sapiens
RHIKPISRN

SEQ ID NO: 159157 - protein, 9 aa, Homo Sapiens
AEERQKFLK

SEQ ID NO: 159158 - protein, 9 aa, Homo Sapiens
SLDMCDGDR

SEQ ID NO: 159159 - protein, 9 aa, Homo Sapiens
AKTGTQGER

SEQ ID NO: 159160 - protein, 9 aa, Homo Sapiens
CTTTPNMNP

SEQ ID NO: 159161 - protein, 9 aa, Homo Sapiens
PPLLRRPCL

SEQ ID NO: 159162 - protein, 9 aa, Homo Sapiens
LMNIQHNPF

SEQ ID NO: 159163 - protein, 9 aa, Homo Sapiens
HCALHSPPP

SEQ ID NO: 159164 - protein, 9 aa, Homo Sapiens
SMWFLGIVF

SEQ ID NO: 159165 - protein, 9 aa, Homo Sapiens
RPLHTAGGG

SEQ ID NO: 159166 - protein, 9 aa, Homo Sapiens
MASSPPGPA

SEQ ID NO: 159167 - protein, 9 aa, Homo Sapiens
AAHHQSSSL

SEQ ID NO: 159168 - protein, 9 aa, Homo Sapiens
AAIDLDKYE

SEQ ID NO: 159169 - protein, 9 aa, Homo Sapiens
CPGSHRLHL

SEQ ID NO: 159170 - protein, 9 aa, Homo Sapiens
AALLRIGQQ

SEQ ID NO: 159171 - protein, 9 aa, Homo Sapiens
RRDSWPTRR

SEQ ID NO: 159172 - protein, 9 aa, Homo Sapiens
VDGAWCTTS

SEQ ID NO: 159173 - protein, 9 aa, Homo Sapiens
THLMEECLI

SEQ ID NO: 159174 - protein, 9 aa, Homo Sapiens
LGSDKSAFI

SEQ ID NO: 159175 - protein, 9 aa, Homo Sapiens
KLGPNSEMD

SEQ ID NO: 159176 - protein, 9 aa, Homo Sapiens
LPDEGSHHT

SEQ ID NO: 159177 - protein, 9 aa, Homo Sapiens
YRNLFSMGM

SEQ ID NO: 159178 - protein, 9 aa, Homo Sapiens
GGRPLGHPS

SEQ ID NO: 159179 - protein, 9 aa, Homo Sapiens
IYPSHYDGC

SEQ ID NO: 159180 - protein, 9 aa, Homo Sapiens
NYKKVHHHC

SEQ ID NO: 159181 - protein, 9 aa, Homo Sapiens
TVFTFQDPT

SEQ ID NO: 159182 - protein, 9 aa, Homo Sapiens
LLGLAQLTA

SEQ ID NO: 159183 - protein, 9 aa, Homo Sapiens
WTAAWPCCA

SEQ ID NO: 159184 - protein, 9 aa, Homo Sapiens
PAAGGTPHV

SEQ ID NO: 159185 - protein, 9 aa, Homo Sapiens
CCCYGGGGS

SEQ ID NO: 159186 - protein, 9 aa, Homo Sapiens
SASIAEGAV

SEQ ID NO: 159187 - protein, 9 aa, Homo Sapiens
DYILATWAV

SEQ ID NO: 159188 - protein, 9 aa, Homo Sapiens
PLSLADTTR

SEQ ID NO: 159189 - protein, 9 aa, Homo Sapiens
IALAYHLTD

SEQ ID NO: 159190 - protein, 9 aa, Homo Sapiens
CCCCYGGGG

SEQ ID NO: 159191 - protein, 9 aa, Homo Sapiens
AANMGDVEA

SEQ ID NO: 159192 - protein, 9 aa, Homo Sapiens
GSRGPAVRT

SEQ ID NO: 159193 - protein, 9 aa, Homo Sapiens
PSSEPLSMT

SEQ ID NO: 159194 - protein, 9 aa, Homo Sapiens
ESSRYQFQN

SEQ ID NO: 159195 - protein, 9 aa, Homo Sapiens
ATLCMCTRC

SEQ ID NO: 159196 - protein, 9 aa, Homo Sapiens
VPGDAPSHS

SEQ ID NO: 159197 - protein, 9 aa, Homo Sapiens
FEPSIRGSV

SEQ ID NO: 159198 - protein, 9 aa, Homo Sapiens
HMGQVEYIF

SEQ ID NO: 159199 - protein, 9 aa, Homo Sapiens
GAAPRRWSC

SEQ ID NO: 159200 - protein, 9 aa, Homo Sapiens
WGADYFEAM

SEQ ID NO: 159201 - protein, 9 aa, Homo Sapiens
DTECSLREL

SEQ ID NO: 159202 - protein, 9 aa, Homo Sapiens
LGEEFMEGD

SEQ ID NO: 159203 - protein, 9 aa, Homo Sapiens
WLQKFRCSS

SEQ ID NO: 159204 - protein, 9 aa, Homo Sapiens
GRDQGRHPV

SEQ ID NO: 159205 - protein, 9 aa, Homo Sapiens
LLNQVKQES

SEQ ID NO: 159206 - protein, 9 aa, Homo Sapiens
LLILNAKNL

SEQ ID NO: 159207 - protein, 9 aa, Homo Sapiens
QLQARTGTS

SEQ ID NO: 159208 - protein, 9 aa, Homo Sapiens
VSLEEPELL

SEQ ID NO: 159209 - protein, 9 aa, Homo Sapiens
IFEPSIRGS

SEQ ID NO: 159210 - protein, 9 aa, Homo Sapiens
NVTKAPDLL

SEQ ID NO: 159211 - protein, 9 aa, Homo Sapiens
PHPPVSPRL

SEQ ID NO: 159212 - protein, 9 aa, Homo Sapiens
ILVLCTALN

SEQ ID NO: 159213 - protein, 9 aa, Homo Sapiens
RKMEANIQL

SEQ ID NO: 159214 - protein, 9 aa, Homo Sapiens
ELASLWNLV

SEQ ID NO: 159215 - protein, 9 aa, Homo Sapiens
NVSKAGKVK

SEQ ID NO: 159216 - protein, 9 aa, Homo Sapiens
VTKFWEYKA

SEQ ID NO: 159217 - protein, 9 aa, Homo Sapiens
RSCTWPLLR

SEQ ID NO: 159218 - protein, 9 aa, Homo Sapiens
FKQKREELC

SEQ ID NO: 159219 - protein, 9 aa, Homo Sapiens
YSMCLLIGL

SEQ ID NO: 159220 - protein, 9 aa, Homo Sapiens
WGLFTPAPT

SEQ ID NO: 159221 - protein, 9 aa, Homo Sapiens
PTRALGAGA

SEQ ID NO: 159222 - protein, 9 aa, Homo Sapiens
SAGLLHPLP

SEQ ID NO: 159223 - protein, 9 aa, Homo Sapiens
VLSINEEEL

SEQ ID NO: 159224 - protein, 9 aa, Homo Sapiens
QQQQQEEAL

SEQ ID NO: 159225 - protein, 9 aa, Homo Sapiens
GMVSNIIEQ

SEQ ID NO: 159226 - protein, 9 aa, Homo Sapiens
FFQGPPAPS

SEQ ID NO: 159227 - protein, 9 aa, Homo Sapiens
ALDEGRTTT

SEQ ID NO: 159228 - protein, 9 aa, Homo Sapiens
PGLHPGCSL

SEQ ID NO: 159229 - protein, 9 aa, Homo Sapiens
RAVKRMWHL

SEQ ID NO: 159230 - protein, 9 aa, Homo Sapiens
PIGRAQTTC

SEQ ID NO: 159231 - protein, 9 aa, Homo Sapiens
EELRRLYCS

SEQ ID NO: 159232 - protein, 9 aa, Homo Sapiens
PPPAFQVHP

SEQ ID NO: 159233 - protein, 9 aa, Homo Sapiens
ATSGTAPSA

SEQ ID NO: 159234 - protein, 9 aa, Homo Sapiens
GSGLNAWNG

SEQ ID NO: 159235 - protein, 9 aa, Homo Sapiens
MECFRNMDK

SEQ ID NO: 159236 - protein, 9 aa, Homo Sapiens
SSTFPTINI

SEQ ID NO: 159237 - protein, 9 aa, Homo Sapiens
LPLVHTLIS

SEQ ID NO: 159238 - protein, 9 aa, Homo Sapiens
ESSTVSSGT

SEQ ID NO: 159239 - protein, 9 aa, Homo Sapiens
RTGTSSGLE

SEQ ID NO: 159240 - protein, 9 aa, Homo Sapiens
PCSPPLLRR

SEQ ID NO: 159241 - protein, 9 aa, Homo Sapiens
QSIWNDPWL

SEQ ID NO: 159242 - protein, 9 aa, Homo Sapiens
ASPGHLRAR

SEQ ID NO: 159243 - protein, 9 aa, Homo Sapiens
EIAVDKGDL

SEQ ID NO: 159244 - protein, 9 aa, Homo Sapiens
TPVGIIIGA

SEQ ID NO: 159245 - protein, 9 aa, Homo Sapiens
HIKTFSEVL

SEQ ID NO: 159246 - protein, 9 aa, Homo Sapiens
VDHERLKNP

SEQ ID NO: 159247 - protein, 9 aa, Homo Sapiens
GFVALHSPF

SEQ ID NO: 159248 - protein, 9 aa, Homo Sapiens
KQVSPASPP

SEQ ID NO: 159249 - protein, 9 aa, Homo Sapiens
LWALIAIAI

SEQ ID NO: 159250 - protein, 9 aa, Homo Sapiens
GAAVAANSA

SEQ ID NO: 159251 - protein, 9 aa, Homo Sapiens
ASLCVSTPS

SEQ ID NO: 159252 - protein, 9 aa, Homo Sapiens
ASAPAAQAV

SEQ ID NO: 159253 - protein, 9 aa, Homo Sapiens
WHLCMGLKS

SEQ ID NO: 159254 - protein, 9 aa, Homo Sapiens
DRVGGSMLM

SEQ ID NO: 159255 - protein, 9 aa, Homo Sapiens
PLPATTSTG

SEQ ID NO: 159256 - protein, 9 aa, Homo Sapiens
AARPPGVQQ

SEQ ID NO: 159257 - protein, 9 aa, Homo Sapiens
TSAQSVSGT

SEQ ID NO: 159258 - protein, 9 aa, Homo Sapiens
GSFCKAGGP

SEQ ID NO: 159259 - protein, 9 aa, Homo Sapiens
ALGPPKPCP

SEQ ID NO: 159260 - protein, 9 aa, Homo Sapiens
QEIINHSSS

SEQ ID NO: 159261 - protein, 9 aa, Homo Sapiens
PRPGLGQEC

SEQ ID NO: 159262 - protein, 9 aa, Homo Sapiens
IIVNIDTLD

SEQ ID NO: 159263 - protein, 9 aa, Homo Sapiens
LGAGASAPL

SEQ ID NO: 159264 - protein, 9 aa, Homo Sapiens
VHTLAWNNT

SEQ ID NO: 159265 - protein, 9 aa, Homo Sapiens
SLLSLYSVA

SEQ ID NO: 159266 - protein, 9 aa, Homo Sapiens
GAPSYMRKE

SEQ ID NO: 159267 - protein, 9 aa, Homo Sapiens
LWERSPGHP

SEQ ID NO: 159268 - protein, 9 aa, Homo Sapiens
ASSVVPRMS

SEQ ID NO: 159269 - protein, 9 aa, Homo Sapiens
KEIYIYNII

SEQ ID NO: 159270 - protein, 9 aa, Homo Sapiens
GVSTSWGPT

SEQ ID NO: 159271 - protein, 9 aa, Homo Sapiens
SRGQVRHSL

SEQ ID NO: 159272 - protein, 9 aa, Homo Sapiens
GRGGGRGWM

SEQ ID NO: 159273 - protein, 9 aa, Homo Sapiens
IDHSVCDMH

SEQ ID NO: 159274 - protein, 9 aa, Homo Sapiens
ALCGIVSTS

SEQ ID NO: 159275 - protein, 9 aa, Homo Sapiens
TCRALATEV

SEQ ID NO: 159276 - protein, 9 aa, Homo Sapiens
TPTRRPRPP

SEQ ID NO: 159277 - protein, 9 aa, Homo Sapiens
TLCPGGRPG

SEQ ID NO: 159278 - protein, 9 aa, Homo Sapiens
LRHHFYWQM

SEQ ID NO: 159279 - protein, 9 aa, Homo Sapiens
SRRRACVVH

SEQ ID NO: 159280 - protein, 9 aa, Homo Sapiens
QALISDLIA

SEQ ID NO: 159281 - protein, 9 aa, Homo Sapiens
SPTARATSG

SEQ ID NO: 159282 - protein, 9 aa, Homo Sapiens
SKAECMAEK

SEQ ID NO: 159283 - protein, 9 aa, Homo Sapiens
PQATGRRRR

SEQ ID NO: 159284 - protein, 9 aa, Homo Sapiens
RALPLPRGI

SEQ ID NO: 159285 - protein, 9 aa, Homo Sapiens
ARLRRPSPQ

SEQ ID NO: 159286 - protein, 9 aa, Homo Sapiens
LMRWHRIAQ

SEQ ID NO: 159287 - protein, 9 aa, Homo Sapiens
EGFAKYTEL

SEQ ID NO: 159288 - protein, 9 aa, Homo Sapiens
LLLLVFLFF

SEQ ID NO: 159289 - protein, 9 aa, Homo Sapiens
GQWRAQTEL

SEQ ID NO: 159290 - protein, 9 aa, Homo Sapiens
GCWGLGTGQ

SEQ ID NO: 159291 - protein, 9 aa, Homo Sapiens
ECSLRELAQ

SEQ ID NO: 159292 - protein, 9 aa, Homo Sapiens
MALLSFLHH

SEQ ID NO: 159293 - protein, 9 aa, Homo Sapiens
FIIILYVKE

SEQ ID NO: 159294 - protein, 9 aa, Homo Sapiens
PQVSMVTLL

SEQ ID NO: 159295 - protein, 9 aa, Homo Sapiens
MDNAGYSVR

SEQ ID NO: 159296 - protein, 9 aa, Homo Sapiens
MEMIYVKIN

SEQ ID NO: 159297 - protein, 9 aa, Homo Sapiens
WLLQTPLGL

SEQ ID NO: 159298 - protein, 9 aa, Homo Sapiens
APATPHVPH

SEQ ID NO: 159299 - protein, 9 aa, Homo Sapiens
FQKPKLHLA

SEQ ID NO: 159300 - protein, 9 aa, Homo Sapiens
HINVPVPQF

SEQ ID NO: 159301 - protein, 9 aa, Homo Sapiens
AWMRTQLRE

SEQ ID NO: 159302 - protein, 9 aa, Homo Sapiens
HTHTHTGTQ

SEQ ID NO: 159303 - protein, 9 aa, Homo Sapiens
SCSTSCGTY

SEQ ID NO: 159304 - protein, 9 aa, Homo Sapiens
ASSGGSDLS

SEQ ID NO: 159305 - protein, 9 aa, Homo Sapiens
DHTKPRPGL

SEQ ID NO: 159306 - protein, 9 aa, Homo Sapiens
LAALFMSQC

SEQ ID NO: 159307 - protein, 9 aa, Homo Sapiens
HSQNEISPS

SEQ ID NO: 159308 - protein, 9 aa, Homo Sapiens
KPQGTKIVY

SEQ ID NO: 159309 - protein, 9 aa, Homo Sapiens
SYMRKETTA

SEQ ID NO: 159310 - protein, 9 aa, Homo Sapiens
RGGEGAWVG

SEQ ID NO: 159311 - protein, 9 aa, Homo Sapiens
SPGAPRSPP

SEQ ID NO: 159312 - protein, 9 aa, Homo Sapiens
LLAGGTSSL

SEQ ID NO: 159313 - protein, 9 aa, Homo Sapiens
APSPLCLHR

SEQ ID NO: 159314 - protein, 9 aa, Homo Sapiens
WENMLSGDH

SEQ ID NO: 159315 - protein, 9 aa, Homo Sapiens
LLCCTCPPA

SEQ ID NO: 159316 - protein, 9 aa, Homo Sapiens
WLQQTTGCS

SEQ ID NO: 159317 - protein, 9 aa, Homo Sapiens
LPCASRAPR

SEQ ID NO: 159318 - protein, 9 aa, Homo Sapiens
LEREQEQQR

SEQ ID NO: 159319 - protein, 9 aa, Homo Sapiens
PMELIDGSA

SEQ ID NO: 159320 - protein, 9 aa, Homo Sapiens
GPSARRQPG

SEQ ID NO: 159321 - protein, 9 aa, Homo Sapiens
RCRDCVFRS

SEQ ID NO: 159322 - protein, 9 aa, Homo Sapiens
GKKVELATR

SEQ ID NO: 159323 - protein, 9 aa, Homo Sapiens
LKPLGMVSN

SEQ ID NO: 159324 - protein, 9 aa, Homo Sapiens
KGTAGLRKR

SEQ ID NO: 159325 - protein, 9 aa, Homo Sapiens
EPHFGKMMI

SEQ ID NO: 159326 - protein, 9 aa, Homo Sapiens
ILFGSLRRQ

SEQ ID NO: 159327 - protein, 9 aa, Homo Sapiens
NPSAPAKGK

SEQ ID NO: 159328 - protein, 9 aa, Homo Sapiens
LDPEYQSTS

SEQ ID NO: 159329 - protein, 9 aa, Homo Sapiens
VQGHPAHFC

SEQ ID NO: 159330 - protein, 9 aa, Homo Sapiens
PPLSVGTSK

SEQ ID NO: 159331 - protein, 9 aa, Homo Sapiens
RHTHTHTGT

SEQ ID NO: 159332 - protein, 9 aa, Homo Sapiens
GRAAPLGCC

SEQ ID NO: 159333 - protein, 9 aa, Homo Sapiens
NAFNGICRL

SEQ ID NO: 159334 - protein, 9 aa, Homo Sapiens
GAWRQRRKQ

SEQ ID NO: 159335 - protein, 9 aa, Homo Sapiens
DIPGLPGIP

SEQ ID NO: 159336 - protein, 9 aa, Homo Sapiens
AVAAARCKA

SEQ ID NO: 159337 - protein, 9 aa, Homo Sapiens
VVVVHELGV

SEQ ID NO: 159338 - protein, 9 aa, Homo Sapiens
MENSHPPTT

SEQ ID NO: 159339 - protein, 9 aa, Homo Sapiens
DPGPWQPSV

SEQ ID NO: 159340 - protein, 9 aa, Homo Sapiens
STPKSKRKS

SEQ ID NO: 159341 - protein, 9 aa, Homo Sapiens
GLPSEGQLF

SEQ ID NO: 159342 - protein, 9 aa, Homo Sapiens
SLTSGLPHG

SEQ ID NO: 159343 - protein, 9 aa, Homo Sapiens
KCQDYLSKT

SEQ ID NO: 159344 - protein, 9 aa, Homo Sapiens
MRMVTVPHV

SEQ ID NO: 159345 - protein, 9 aa, Homo Sapiens
QPLHPGITD

SEQ ID NO: 159346 - protein, 9 aa, Homo Sapiens
QLLGADSWK

SEQ ID NO: 159347 - protein, 9 aa, Homo Sapiens
EIICQSLAW

SEQ ID NO: 159348 - protein, 9 aa, Homo Sapiens
SLEVIPEKQ

SEQ ID NO: 159349 - protein, 9 aa, Homo Sapiens
TFHLQNDPQ

SEQ ID NO: 159350 - protein, 9 aa, Homo Sapiens
DGDDEEMVQ

SEQ ID NO: 159351 - protein, 9 aa, Homo Sapiens
CRSKTLLRN

SEQ ID NO: 159352 - protein, 9 aa, Homo Sapiens
LLIRHAYSF

SEQ ID NO: 159353 - protein, 9 aa, Homo Sapiens
DWLAVNEAI

SEQ ID NO: 159354 - protein, 9 aa, Homo Sapiens
SHLMKWAHP

SEQ ID NO: 159355 - protein, 9 aa, Homo Sapiens
RYMVICDPL

SEQ ID NO: 159356 - protein, 9 aa, Homo Sapiens
LHPCLDIPG

SEQ ID NO: 159357 - protein, 9 aa, Homo Sapiens
DSQGQSSAL

SEQ ID NO: 159358 - protein, 9 aa, Homo Sapiens
IVCWFKENR

SEQ ID NO: 159359 - protein, 9 aa, Homo Sapiens
AEPPQMPND

SEQ ID NO: 159360 - protein, 9 aa, Homo Sapiens
KDNVEMITA

SEQ ID NO: 159361 - protein, 9 aa, Homo Sapiens
PPAPHRRAP

SEQ ID NO: 159362 - protein, 9 aa, Homo Sapiens
LSTVDAYNP

SEQ ID NO: 159363 - protein, 9 aa, Homo Sapiens
VFSSSRQHC

SEQ ID NO: 159364 - protein, 9 aa, Homo Sapiens
TSWSMATDP

SEQ ID NO: 159365 - protein, 9 aa, Homo Sapiens
LHSLDKGIM

SEQ ID NO: 159366 - protein, 9 aa, Homo Sapiens
FFLLLLLLV

SEQ ID NO: 159367 - protein, 9 aa, Homo Sapiens
FASLHVSGE

SEQ ID NO: 159368 - protein, 9 aa, Homo Sapiens
GLPRPGHTG

SEQ ID NO: 159369 - protein, 9 aa, Homo Sapiens
VGQQELLHR

SEQ ID NO: 159370 - protein, 9 aa, Homo Sapiens
RLAYSSQTV

SEQ ID NO: 159371 - protein, 9 aa, Homo Sapiens
LTPPSILLP

SEQ ID NO: 159372 - protein, 9 aa, Homo Sapiens
EKCSLQAAV

SEQ ID NO: 159373 - protein, 9 aa, Homo Sapiens
QRGRLNSAS

SEQ ID NO: 159374 - protein, 9 aa, Homo Sapiens
PCSCSSCST

SEQ ID NO: 159375 - protein, 9 aa, Homo Sapiens
ETECVVREA

SEQ ID NO: 159376 - protein, 9 aa, Homo Sapiens
ATLCLAGPP

SEQ ID NO: 159377 - protein, 9 aa, Homo Sapiens
DANSRADGG

SEQ ID NO: 159378 - protein, 9 aa, Homo Sapiens
KGYRPTPTW

SEQ ID NO: 159379 - protein, 9 aa, Homo Sapiens
TSNSGGGRE

SEQ ID NO: 159380 - protein, 9 aa, Homo Sapiens
LPPLQPQAT

SEQ ID NO: 159381 - protein, 9 aa, Homo Sapiens
DEHILQFLC

SEQ ID NO: 159382 - protein, 9 aa, Homo Sapiens
LRCSLPDPC

SEQ ID NO: 159383 - protein, 9 aa, Homo Sapiens
RVPSPRSWG

SEQ ID NO: 159384 - protein, 9 aa, Homo Sapiens
GVNIRKFIV

SEQ ID NO: 159385 - protein, 9 aa, Homo Sapiens
QLTATAPSS

SEQ ID NO: 159386 - protein, 9 aa, Homo Sapiens
AATDAAHMS

SEQ ID NO: 159387 - protein, 9 aa, Homo Sapiens
KNSRGAVKS

SEQ ID NO: 159388 - protein, 9 aa, Homo Sapiens
EEKKFTKLA

SEQ ID NO: 159389 - protein, 9 aa, Homo Sapiens
PLRPAFPVA

SEQ ID NO: 159390 - protein, 9 aa, Homo Sapiens
KAPGGPFHY

SEQ ID NO: 159391 - protein, 9 aa, Homo Sapiens
GNFMELGAE

SEQ ID NO: 159392 - protein, 9 aa, Homo Sapiens
SALRVSPVR

SEQ ID NO: 159393 - protein, 9 aa, Homo Sapiens
VIDLIIESS

SEQ ID NO: 159394 - protein, 9 aa, Homo Sapiens
PRDGIESGH

SEQ ID NO: 159395 - protein, 9 aa, Homo Sapiens
GGVPSTPHE

SEQ ID NO: 159396 - protein, 9 aa, Homo Sapiens
SGEAPSAGV

SEQ ID NO: 159397 - protein, 9 aa, Homo Sapiens
EQREALVLG

SEQ ID NO: 159398 - protein, 9 aa, Homo Sapiens
PASSHHGSR

SEQ ID NO: 159399 - protein, 9 aa, Homo Sapiens
TKFNLRLIT

SEQ ID NO: 159400 - protein, 9 aa, Homo Sapiens
SYLRCRDVT

SEQ ID NO: 159401 - protein, 9 aa, Homo Sapiens
LLLKDMQPE

SEQ ID NO: 159402 - protein, 9 aa, Homo Sapiens
VRHGFLQLR

SEQ ID NO: 159403 - protein, 9 aa, Homo Sapiens
YFFSILHVP

SEQ ID NO: 159404 - protein, 9 aa, Homo Sapiens
AATVHPAQT

SEQ ID NO: 159405 - protein, 9 aa, Homo Sapiens
GAPPPAAAA

SEQ ID NO: 159406 - protein, 9 aa, Homo Sapiens
GAPGSHLCV

SEQ ID NO: 159407 - protein, 9 aa, Homo Sapiens
MKTTTMRAR

SEQ ID NO: 159408 - protein, 9 aa, Homo Sapiens
GDDIPGIEG

SEQ ID NO: 159409 - protein, 9 aa, Homo Sapiens
QYLSGVGVA

SEQ ID NO: 159410 - protein, 9 aa, Homo Sapiens
DQWITCKSL

SEQ ID NO: 159411 - protein, 9 aa, Homo Sapiens
KRLMAELHN

SEQ ID NO: 159412 - protein, 9 aa, Homo Sapiens
GQTRAGDAS

SEQ ID NO: 159413 - protein, 9 aa, Homo Sapiens
LLQEPALQE

SEQ ID NO: 159414 - protein, 9 aa, Homo Sapiens
SNMFPNHYC

SEQ ID NO: 159415 - protein, 9 aa, Homo Sapiens
VGSLYVREV

SEQ ID NO: 159416 - protein, 9 aa, Homo Sapiens
LETATTTTQ

SEQ ID NO: 159417 - protein, 9 aa, Homo Sapiens
RPLGHPSRN

SEQ ID NO: 159418 - protein, 9 aa, Homo Sapiens
QDVLERGGR

SEQ ID NO: 159419 - protein, 9 aa, Homo Sapiens
PPLPSPPVP

SEQ ID NO: 159420 - protein, 9 aa, Homo Sapiens
KFELLPTLP

SEQ ID NO: 159421 - protein, 9 aa, Homo Sapiens
AGPLAPPPP

SEQ ID NO: 159422 - protein, 9 aa, Homo Sapiens
TGGSTAPGV

SEQ ID NO: 159423 - protein, 9 aa, Homo Sapiens
CGTSQTYFG

SEQ ID NO: 159424 - protein, 9 aa, Homo Sapiens
LRIGQQGYL

SEQ ID NO: 159425 - protein, 9 aa, Homo Sapiens
MFMLHLALM

SEQ ID NO: 159426 - protein, 9 aa, Homo Sapiens
KQNRRSLKK

SEQ ID NO: 159427 - protein, 9 aa, Homo Sapiens
RHPLQDSLP

SEQ ID NO: 159428 - protein, 9 aa, Homo Sapiens
KHTHRHTGM

SEQ ID NO: 159429 - protein, 9 aa, Homo Sapiens
ALLRIGQQG

SEQ ID NO: 159430 - protein, 9 aa, Homo Sapiens
ASFAYTLAV

SEQ ID NO: 159431 - protein, 9 aa, Homo Sapiens
FRHFQHHTK

SEQ ID NO: 159432 - protein, 9 aa, Homo Sapiens
ERGPLEGGL

SEQ ID NO: 159433 - protein, 9 aa, Homo Sapiens
LGQLAWLSS

SEQ ID NO: 159434 - protein, 9 aa, Homo Sapiens
HRGAHRSPS

SEQ ID NO: 159435 - protein, 9 aa, Homo Sapiens
VVDPSTSWS

SEQ ID NO: 159436 - protein, 9 aa, Homo Sapiens
DDILCFLTI

SEQ ID NO: 159437 - protein, 9 aa, Homo Sapiens
EQDVLERGG

SEQ ID NO: 159438 - protein, 9 aa, Homo Sapiens
LFHIQHLLF

SEQ ID NO: 159439 - protein, 9 aa, Homo Sapiens
CYEALRGEQ

SEQ ID NO: 159440 - protein, 9 aa, Homo Sapiens
KGNKVLYEA

SEQ ID NO: 159441 - protein, 9 aa, Homo Sapiens
NGLPSEGQL

SEQ ID NO: 159442 - protein, 9 aa, Homo Sapiens
LQRNLLRLQ

SEQ ID NO: 159443 - protein, 9 aa, Homo Sapiens
TTKFPWHIK

SEQ ID NO: 159444 - protein, 9 aa, Homo Sapiens
GPFSNQTQI

SEQ ID NO: 159445 - protein, 9 aa, Homo Sapiens
AGQTEGEEE

SEQ ID NO: 159446 - protein, 9 aa, Homo Sapiens
WLSQRPSLA

SEQ ID NO: 159447 - protein, 9 aa, Homo Sapiens
PFRMASSPP

SEQ ID NO: 159448 - protein, 9 aa, Homo Sapiens
TPQPSLPGP

SEQ ID NO: 159449 - protein, 9 aa, Homo Sapiens
ALPDEGSHH

SEQ ID NO: 159450 - protein, 9 aa, Homo Sapiens
QGSVFIPYR

SEQ ID NO: 159451 - protein, 9 aa, Homo Sapiens
FSQACYLLY

SEQ ID NO: 159452 - protein, 9 aa, Homo Sapiens
LLLLPTGCR

SEQ ID NO: 159453 - protein, 9 aa, Homo Sapiens
SAKHVPLSI

SEQ ID NO: 159454 - protein, 9 aa, Homo Sapiens
GIYKAHIHL

SEQ ID NO: 159455 - protein, 9 aa, Homo Sapiens
MKDHSSGNP

SEQ ID NO: 159456 - protein, 9 aa, Homo Sapiens
TSSSTWAGA

SEQ ID NO: 159457 - protein, 9 aa, Homo Sapiens
DAGPRSIRR

SEQ ID NO: 159458 - protein, 9 aa, Homo Sapiens
APPPRMAAR

SEQ ID NO: 159459 - protein, 9 aa, Homo Sapiens
GSAAAAAAV

SEQ ID NO: 159460 - protein, 9 aa, Homo Sapiens
AQMRLGGAD

SEQ ID NO: 159461 - protein, 9 aa, Homo Sapiens
PRSPGVPRR

SEQ ID NO: 159462 - protein, 9 aa, Homo Sapiens
ITFVPHWTP

SEQ ID NO: 159463 - protein, 9 aa, Homo Sapiens
VAAARCKAA

SEQ ID NO: 159464 - protein, 9 aa, Homo Sapiens
SNELLQANR

SEQ ID NO: 159465 - protein, 9 aa, Homo Sapiens
FLQLRHGLP

SEQ ID NO: 159466 - protein, 9 aa, Homo Sapiens
EAYIRNAGL

SEQ ID NO: 159467 - protein, 9 aa, Homo Sapiens
WFIFSEEHG

SEQ ID NO: 159468 - protein, 9 aa, Homo Sapiens
KTFFLLLPP

SEQ ID NO: 159469 - protein, 9 aa, Homo Sapiens
PTLLRHCAL

SEQ ID NO: 159470 - protein, 9 aa, Homo Sapiens
RPPEYEIFW

SEQ ID NO: 159471 - protein, 9 aa, Homo Sapiens
LAPKPQGTA

SEQ ID NO: 159472 - protein, 9 aa, Homo Sapiens
MKDTPKRPF

SEQ ID NO: 159473 - protein, 9 aa, Homo Sapiens
NSTQWLMKL

SEQ ID NO: 159474 - protein, 9 aa, Homo Sapiens
LFPPPLPPP

SEQ ID NO: 159475 - protein, 9 aa, Homo Sapiens
HPGCSLGSC

SEQ ID NO: 159476 - protein, 9 aa, Homo Sapiens
CAVRAVGQL

SEQ ID NO: 159477 - protein, 9 aa, Homo Sapiens
TKKNSCEVQ

SEQ ID NO: 159478 - protein, 9 aa, Homo Sapiens
PGGPFHYQY

SEQ ID NO: 159479 - protein, 9 aa, Homo Sapiens
GSGPSPAPS

SEQ ID NO: 159480 - protein, 9 aa, Homo Sapiens
LAFPNGPFS

SEQ ID NO: 159481 - protein, 9 aa, Homo Sapiens
TDKILDLYK

SEQ ID NO: 159482 - protein, 9 aa, Homo Sapiens
YLDNPETTA

SEQ ID NO: 159483 - protein, 9 aa, Homo Sapiens
LTGFPPAVP

SEQ ID NO: 159484 - protein, 9 aa, Homo Sapiens
PPPAARPPP

SEQ ID NO: 159485 - protein, 9 aa, Homo Sapiens
MACIENVHG

SEQ ID NO: 159486 - protein, 9 aa, Homo Sapiens
PTKPPSLAQ

SEQ ID NO: 159487 - protein, 9 aa, Homo Sapiens
IVGPQWECE

SEQ ID NO: 159488 - protein, 9 aa, Homo Sapiens
GRTSARRRT

SEQ ID NO: 159489 - protein, 9 aa, Homo Sapiens
YPGKEVKKV

SEQ ID NO: 159490 - protein, 9 aa, Homo Sapiens
YLSMEMIYV

SEQ ID NO: 159491 - protein, 9 aa, Homo Sapiens
KKVELATRL

SEQ ID NO: 159492 - protein, 9 aa, Homo Sapiens
FVAKKALCI

SEQ ID NO: 159493 - protein, 9 aa, Homo Sapiens
KSGSTASRA

SEQ ID NO: 159494 - protein, 9 aa, Homo Sapiens
ALSLSPAAV

SEQ ID NO: 159495 - protein, 9 aa, Homo Sapiens
YRRHRGALS

SEQ ID NO: 159496 - protein, 9 aa, Homo Sapiens
GAVVVDMDL

SEQ ID NO: 159497 - protein, 9 aa, Homo Sapiens
LRPQRGPRP

SEQ ID NO: 159498 - protein, 9 aa, Homo Sapiens
PQTLEMTRR

SEQ ID NO: 159499 - protein, 9 aa, Homo Sapiens
VGKFPSLSI

SEQ ID NO: 159500 - protein, 9 aa, Homo Sapiens
KSHLMFAVW

SEQ ID NO: 159501 - protein, 9 aa, Homo Sapiens
IEPHFGKMM

SEQ ID NO: 159502 - protein, 9 aa, Homo Sapiens
VVSFCLSAD

SEQ ID NO: 159503 - protein, 9 aa, Homo Sapiens
MTATIAAAA

SEQ ID NO: 159504 - protein, 9 aa, Homo Sapiens
AAAASPRAA

SEQ ID NO: 159505 - protein, 9 aa, Homo Sapiens
LVLPGEADL

SEQ ID NO: 159506 - protein, 9 aa, Homo Sapiens
VAGEGPRQE

SEQ ID NO: 159507 - protein, 9 aa, Homo Sapiens
NDHMGQVEY

SEQ ID NO: 159508 - protein, 9 aa, Homo Sapiens
GPSPARSAA

SEQ ID NO: 159509 - protein, 9 aa, Homo Sapiens
GPPWGVGQG

SEQ ID NO: 159510 - protein, 9 aa, Homo Sapiens
ADVRQWKER

SEQ ID NO: 159511 - protein, 9 aa, Homo Sapiens
KNSCEVQPD

SEQ ID NO: 159512 - protein, 9 aa, Homo Sapiens
ITVILTAKV

SEQ ID NO: 159513 - protein, 9 aa, Homo Sapiens
VWDRNHISA

SEQ ID NO: 159514 - protein, 9 aa, Homo Sapiens
PSLTGSSPR

SEQ ID NO: 159515 - protein, 9 aa, Homo Sapiens
SLESWRRTW

SEQ ID NO: 159516 - protein, 9 aa, Homo Sapiens
RNSPCSMCC

SEQ ID NO: 159517 - protein, 9 aa, Homo Sapiens
MLAYSNSSA

SEQ ID NO: 159518 - protein, 9 aa, Homo Sapiens
GFVHSLEGP

SEQ ID NO: 159519 - protein, 9 aa, Homo Sapiens
VTCFYRPAP

SEQ ID NO: 159520 - protein, 9 aa, Homo Sapiens
RARAKAGAQ

SEQ ID NO: 159521 - protein, 9 aa, Homo Sapiens
AVVSKASGR

SEQ ID NO: 159522 - protein, 9 aa, Homo Sapiens
VREHVLEEV

SEQ ID NO: 159523 - protein, 9 aa, Homo Sapiens
SSPFRMASS

SEQ ID NO: 159524 - protein, 9 aa, Homo Sapiens
PCHSLPRTW

SEQ ID NO: 159525 - protein, 9 aa, Homo Sapiens
RSPSAPDDQ

SEQ ID NO: 159526 - protein, 9 aa, Homo Sapiens
GFAKYTELI

SEQ ID NO: 159527 - protein, 9 aa, Homo Sapiens
WMSSEVTRL

SEQ ID NO: 159528 - protein, 9 aa, Homo Sapiens
VPNNSFCAM

SEQ ID NO: 159529 - protein, 9 aa, Homo Sapiens
SQSLSHLLP

SEQ ID NO: 159530 - protein, 9 aa, Homo Sapiens
LQNNDTSEL

SEQ ID NO: 159531 - protein, 9 aa, Homo Sapiens
KRRTMRRVN

SEQ ID NO: 159532 - protein, 9 aa, Homo Sapiens
TRTMRLGPT

SEQ ID NO: 159533 - protein, 9 aa, Homo Sapiens
GPHARVDAH

SEQ ID NO: 159534 - protein, 9 aa, Homo Sapiens
REEERLKHT

SEQ ID NO: 159535 - protein, 9 aa, Homo Sapiens
DPPKWKDYL

SEQ ID NO: 159536 - protein, 9 aa, Homo Sapiens
GLDSESHYC

SEQ ID NO: 159537 - protein, 9 aa, Homo Sapiens
ARRAQGNSL

SEQ ID NO: 159538 - protein, 9 aa, Homo Sapiens
DSSVAVWSC

SEQ ID NO: 159539 - protein, 9 aa, Homo Sapiens
KKPGRKGTA

SEQ ID NO: 159540 - protein, 9 aa, Homo Sapiens
LSGIPGEAM

SEQ ID NO: 159541 - protein, 9 aa, Homo Sapiens
FWKTLIDLK

SEQ ID NO: 159542 - protein, 9 aa, Homo Sapiens
VTILGQEAA

SEQ ID NO: 159543 - protein, 9 aa, Homo Sapiens
RSWLLGFEF

SEQ ID NO: 159544 - protein, 9 aa, Homo Sapiens
AGCCVWLRC

SEQ ID NO: 159545 - protein, 9 aa, Homo Sapiens
RWQDVSMCR

SEQ ID NO: 159546 - protein, 9 aa, Homo Sapiens
VNESNVYMV

SEQ ID NO: 159547 - protein, 9 aa, Homo Sapiens
PGLPRPGHT

SEQ ID NO: 159548 - protein, 9 aa, Homo Sapiens
LYCSRFSRR

SEQ ID NO: 159549 - protein, 9 aa, Homo Sapiens
SAPAAQAVA

SEQ ID NO: 159550 - protein, 9 aa, Homo Sapiens
EAPSAGVLL

SEQ ID NO: 159551 - protein, 9 aa, Homo Sapiens
SKKEKHSLS

SEQ ID NO: 159552 - protein, 9 aa, Homo Sapiens
YAHCMPYFR

SEQ ID NO: 159553 - protein, 9 aa, Homo Sapiens
PMHCPTATA

SEQ ID NO: 159554 - protein, 9 aa, Homo Sapiens
TQAKDIDPE

SEQ ID NO: 159555 - protein, 9 aa, Homo Sapiens
MDLTPAAPS

SEQ ID NO: 159556 - protein, 9 aa, Homo Sapiens
SQDAAPPST

SEQ ID NO: 159557 - protein, 9 aa, Homo Sapiens
AASSLGSSR

SEQ ID NO: 159558 - protein, 9 aa, Homo Sapiens
NSGIMVGKR

SEQ ID NO: 159559 - protein, 9 aa, Homo Sapiens
IGAWRTISQ

SEQ ID NO: 159560 - protein, 9 aa, Homo Sapiens
SRALHVYSL

SEQ ID NO: 159561 - protein, 9 aa, Homo Sapiens
QPALLALQQ

SEQ ID NO: 159562 - protein, 9 aa, Homo Sapiens
CFMQEHTCY

SEQ ID NO: 159563 - protein, 9 aa, Homo Sapiens
VRKFFRLIM

SEQ ID NO: 159564 - protein, 9 aa, Homo Sapiens
VGGRGQSAK

SEQ ID NO: 159565 - protein, 9 aa, Homo Sapiens
ENQPLPMGR

SEQ ID NO: 159566 - protein, 9 aa, Homo Sapiens
FVPTQYNLP

SEQ ID NO: 159567 - protein, 9 aa, Homo Sapiens
FTRNLPSGE

SEQ ID NO: 159568 - protein, 9 aa, Homo Sapiens
SSASVCCRA

SEQ ID NO: 159569 - protein, 9 aa, Homo Sapiens
AMTFLLILL

SEQ ID NO: 159570 - protein, 9 aa, Homo Sapiens
RLQRSMEEL

SEQ ID NO: 159571 - protein, 9 aa, Homo Sapiens
PSSCHLITQ

SEQ ID NO: 159572 - protein, 9 aa, Homo Sapiens
SLTHVLQSL

SEQ ID NO: 159573 - protein, 9 aa, Homo Sapiens
RYPPHPLSL

SEQ ID NO: 159574 - protein, 9 aa, Homo Sapiens
REGWRWGWG

SEQ ID NO: 159575 - protein, 9 aa, Homo Sapiens
PGEGWVEVL

SEQ ID NO: 159576 - protein, 9 aa, Homo Sapiens
DKALQHMAT

SEQ ID NO: 159577 - protein, 9 aa, Homo Sapiens
VFQEEDLHQ

SEQ ID NO: 159578 - protein, 9 aa, Homo Sapiens
THSTHSAWR

SEQ ID NO: 159579 - protein, 9 aa, Homo Sapiens
VILGKHLVF

SEQ ID NO: 159580 - protein, 9 aa, Homo Sapiens
RQLPGPHDD

SEQ ID NO: 159581 - protein, 9 aa, Homo Sapiens
PFMHLENLK

SEQ ID NO: 159582 - protein, 9 aa, Homo Sapiens
CGAKTIEGS

SEQ ID NO: 159583 - protein, 9 aa, Homo Sapiens
LPAPSALVL

SEQ ID NO: 159584 - protein, 9 aa, Homo Sapiens
EEAVRKLAY

SEQ ID NO: 159585 - protein, 9 aa, Homo Sapiens
AGMGSSPCS

SEQ ID NO: 159586 - protein, 9 aa, Homo Sapiens
ERHSPRPIF

SEQ ID NO: 159587 - protein, 9 aa, Homo Sapiens
RDVTLNMMA

SEQ ID NO: 159588 - protein, 9 aa, Homo Sapiens
FIWTPWRKS

SEQ ID NO: 159589 - protein, 9 aa, Homo Sapiens
PAPHRRAPP

SEQ ID NO: 159590 - protein, 9 aa, Homo Sapiens
PHSYVPPTG

SEQ ID NO: 159591 - protein, 9 aa, Homo Sapiens
GTTIGEVTS

SEQ ID NO: 159592 - protein, 9 aa, Homo Sapiens
LVKCRRHQP

SEQ ID NO: 159593 - protein, 9 aa, Homo Sapiens
SRARAWDRN

SEQ ID NO: 159594 - protein, 9 aa, Homo Sapiens
RTKDVEEAV

SEQ ID NO: 159595 - protein, 9 aa, Homo Sapiens
GPWQPSVGC

SEQ ID NO: 159596 - protein, 9 aa, Homo Sapiens
HDDFVADGA

SEQ ID NO: 159597 - protein, 9 aa, Homo Sapiens
DVLAWVKNA

SEQ ID NO: 159598 - protein, 9 aa, Homo Sapiens
IIWQMGIGM

SEQ ID NO: 159599 - protein, 9 aa, Homo Sapiens
LSRPWPHVL

SEQ ID NO: 159600 - protein, 9 aa, Homo Sapiens
LGLKYEEFD

SEQ ID NO: 159601 - protein, 9 aa, Homo Sapiens
DPVKVIEKN

SEQ ID NO: 159602 - protein, 9 aa, Homo Sapiens
PWQVMASLT

SEQ ID NO: 159603 - protein, 9 aa, Homo Sapiens
VASPPTRSS

SEQ ID NO: 159604 - protein, 9 aa, Homo Sapiens
SKEEEIAVD

SEQ ID NO: 159605 - protein, 9 aa, Homo Sapiens
SLNVWAIGG

SEQ ID NO: 159606 - protein, 9 aa, Homo Sapiens
VWRGRWRVG

SEQ ID NO: 159607 - protein, 9 aa, Homo Sapiens
VSSLEYITH

SEQ ID NO: 159608 - protein, 9 aa, Homo Sapiens
VDVDGAWCT

SEQ ID NO: 159609 - protein, 9 aa, Homo Sapiens
RRATLCMCT

SEQ ID NO: 159610 - protein, 9 aa, Homo Sapiens
IPLPLPCSP

SEQ ID NO: 159611 - protein, 9 aa, Homo Sapiens
GLVAQQPHQ

SEQ ID NO: 159612 - protein, 9 aa, Homo Sapiens
VRALARFPG

SEQ ID NO: 159613 - protein, 9 aa, Homo Sapiens
NTDHHPCQL

SEQ ID NO: 159614 - protein, 9 aa, Homo Sapiens
LNEMCCAYE

SEQ ID NO: 159615 - protein, 9 aa, Homo Sapiens
CDNKSFAEG

SEQ ID NO: 159616 - protein, 9 aa, Homo Sapiens
SARRQPGPP

SEQ ID NO: 159617 - protein, 9 aa, Homo Sapiens
HSVPLCFVL

SEQ ID NO: 159618 - protein, 9 aa, Homo Sapiens
HLIHECPHQ

SEQ ID NO: 159619 - protein, 9 aa, Homo Sapiens
ERPAPTRRG

SEQ ID NO: 159620 - protein, 9 aa, Homo Sapiens
RRQPGPPCR

SEQ ID NO: 159621 - protein, 9 aa, Homo Sapiens
RVHEQGYVP

SEQ ID NO: 159622 - protein, 9 aa, Homo Sapiens
LPPMGRPSN

SEQ ID NO: 159623 - protein, 9 aa, Homo Sapiens
MDLGDCILK

SEQ ID NO: 159624 - protein, 9 aa, Homo Sapiens
HEIPMSMEF

SEQ ID NO: 159625 - protein, 9 aa, Homo Sapiens
EVPPIKKKP

SEQ ID NO: 159626 - protein, 9 aa, Homo Sapiens
QTSCFGPSK

SEQ ID NO: 159627 - protein, 9 aa, Homo Sapiens
LFTTHFLEA

SEQ ID NO: 159628 - protein, 9 aa, Homo Sapiens
NQVKQESRD

SEQ ID NO: 159629 - protein, 9 aa, Homo Sapiens
LAAIDLDKY

SEQ ID NO: 159630 - protein, 9 aa, Homo Sapiens
LLPLLSCHI

SEQ ID NO: 159631 - protein, 9 aa, Homo Sapiens
RSVTDKILD

SEQ ID NO: 159632 - protein, 9 aa, Homo Sapiens
PFTYLISLH

SEQ ID NO: 159633 - protein, 9 aa, Homo Sapiens
LDWEPAVER

SEQ ID NO: 159634 - protein, 9 aa, Homo Sapiens
QYAGDDSVL

SEQ ID NO: 159635 - protein, 9 aa, Homo Sapiens
LAKDIYGGD

SEQ ID NO: 159636 - protein, 9 aa, Homo Sapiens
LIMTTKKSN

SEQ ID NO: 159637 - protein, 9 aa, Homo Sapiens
ILWTCVLTA

SEQ ID NO: 159638 - protein, 9 aa, Homo Sapiens
GRTKDVEEA

SEQ ID NO: 159639 - protein, 9 aa, Homo Sapiens
NLMWDFCLL

SEQ ID NO: 159640 - protein, 9 aa, Homo Sapiens
LSILWTCVL

SEQ ID NO: 159641 - protein, 9 aa, Homo Sapiens
RPWPHVLSV

SEQ ID NO: 159642 - protein, 9 aa, Homo Sapiens
TGIGTPTAG

SEQ ID NO: 159643 - protein, 9 aa, Homo Sapiens
GLPPCWRSW

SEQ ID NO: 159644 - protein, 9 aa, Homo Sapiens
LAHRWAALL

SEQ ID NO: 159645 - protein, 9 aa, Homo Sapiens
IKREKFVFR

SEQ ID NO: 159646 - protein, 9 aa, Homo Sapiens
TTQDETRDS

SEQ ID NO: 159647 - protein, 9 aa, Homo Sapiens
MEENKPGIV

SEQ ID NO: 159648 - protein, 9 aa, Homo Sapiens
FNLRLITRE

SEQ ID NO: 159649 - protein, 9 aa, Homo Sapiens
ANRMSNSKK

SEQ ID NO: 159650 - protein, 9 aa, Homo Sapiens
GQNEERLSH

SEQ ID NO: 159651 - protein, 9 aa, Homo Sapiens
GCARSWNEK

SEQ ID NO: 159652 - protein, 9 aa, Homo Sapiens
EVPQEVISI

SEQ ID NO: 159653 - protein, 9 aa, Homo Sapiens
SIWRRFPTD

SEQ ID NO: 159654 - protein, 9 aa, Homo Sapiens
RYEWNLESL

SEQ ID NO: 159655 - protein, 9 aa, Homo Sapiens
CMPYFRKAQ

SEQ ID NO: 159656 - protein, 9 aa, Homo Sapiens
WSRRPSLCW

SEQ ID NO: 159657 - protein, 9 aa, Homo Sapiens
RGKQLCVRF

SEQ ID NO: 159658 - protein, 9 aa, Homo Sapiens
KHVRETEKQ

SEQ ID NO: 159659 - protein, 9 aa, Homo Sapiens
PDTRCPSLT

SEQ ID NO: 159660 - protein, 9 aa, Homo Sapiens
DRRTAVDLC

SEQ ID NO: 159661 - protein, 9 aa, Homo Sapiens
RWRVGDVAV

SEQ ID NO: 159662 - protein, 9 aa, Homo Sapiens
RRSGGGCAR

SEQ ID NO: 159663 - protein, 9 aa, Homo Sapiens
NPLRLPSEQ

SEQ ID NO: 159664 - protein, 9 aa, Homo Sapiens
LGNGVERPL

SEQ ID NO: 159665 - protein, 9 aa, Homo Sapiens
TASAGRRSA

SEQ ID NO: 159666 - protein, 9 aa, Homo Sapiens
VWWCATSDP

SEQ ID NO: 159667 - protein, 9 aa, Homo Sapiens
KPHSFKSTD

SEQ ID NO: 159668 - protein, 9 aa, Homo Sapiens
TLCKKKMPL

SEQ ID NO: 159669 - protein, 9 aa, Homo Sapiens
ETTLWLGPA

SEQ ID NO: 159670 - protein, 9 aa, Homo Sapiens
LVHVYIVFY

SEQ ID NO: 159671 - protein, 9 aa, Homo Sapiens
PCPSITTPG

SEQ ID NO: 159672 - protein, 9 aa, Homo Sapiens
KGRGKWARS

SEQ ID NO: 159673 - protein, 9 aa, Homo Sapiens
QQQQEEALK

SEQ ID NO: 159674 - protein, 9 aa, Homo Sapiens
CNGGLQGSP

SEQ ID NO: 159675 - protein, 9 aa, Homo Sapiens
LIFNIHVID

SEQ ID NO: 159676 - protein, 9 aa, Homo Sapiens
RKSLHGQKM

SEQ ID NO: 159677 - protein, 9 aa, Homo Sapiens
PCWRSWWQG

SEQ ID NO: 159678 - protein, 9 aa, Homo Sapiens
CKKQAASMA

SEQ ID NO: 159679 - protein, 9 aa, Homo Sapiens
TFRVKFLLW

SEQ ID NO: 159680 - protein, 9 aa, Homo Sapiens
VQINPTNVK

SEQ ID NO: 159681 - protein, 9 aa, Homo Sapiens
PSCVPTAAR

SEQ ID NO: 159682 - protein, 9 aa, Homo Sapiens
SLTVAEASL

SEQ ID NO: 159683 - protein, 9 aa, Homo Sapiens
PRAPVHNPR

SEQ ID NO: 159684 - protein, 9 aa, Homo Sapiens
QSPGMRRMG

SEQ ID NO: 159685 - protein, 9 aa, Homo Sapiens
QQPDGRSSS

SEQ ID NO: 159686 - protein, 9 aa, Homo Sapiens
SHLCVETSS

SEQ ID NO: 159687 - protein, 9 aa, Homo Sapiens
GLWERSPGH

SEQ ID NO: 159688 - protein, 9 aa, Homo Sapiens
PLPPRPRPH

SEQ ID NO: 159689 - protein, 9 aa, Homo Sapiens
TLTKHAIVQ

SEQ ID NO: 159690 - protein, 9 aa, Homo Sapiens
AVTEASLLC

SEQ ID NO: 159691 - protein, 9 aa, Homo Sapiens
RTRACTPAS

SEQ ID NO: 159692 - protein, 9 aa, Homo Sapiens
RVQPMAKAG

SEQ ID NO: 159693 - protein, 9 aa, Homo Sapiens
QKRCLEAEM

SEQ ID NO: 159694 - protein, 9 aa, Homo Sapiens
VDVCLDGLD

SEQ ID NO: 159695 - protein, 9 aa, Homo Sapiens
KEQLESKGR

SEQ ID NO: 159696 - protein, 9 aa, Homo Sapiens
QRSWVALRE

SEQ ID NO: 159697 - protein, 9 aa, Homo Sapiens
TRDQHIRDV

SEQ ID NO: 159698 - protein, 9 aa, Homo Sapiens
AVAAAPGVL

SEQ ID NO: 159699 - protein, 9 aa, Homo Sapiens
NDSGVYYCV

SEQ ID NO: 159700 - protein, 9 aa, Homo Sapiens
EGGSAPGTA

SEQ ID NO: 159701 - protein, 9 aa, Homo Sapiens
RVHANVDRW

SEQ ID NO: 159702 - protein, 9 aa, Homo Sapiens
KAFCVWESA

SEQ ID NO: 159703 - protein, 9 aa, Homo Sapiens
SAFMVRVPS

SEQ ID NO: 159704 - protein, 9 aa, Homo Sapiens
PTRRRVHPH

SEQ ID NO: 159705 - protein, 9 aa, Homo Sapiens
GQEYQFCVK

SEQ ID NO: 159706 - protein, 9 aa, Homo Sapiens
FGTFRIPFL

SEQ ID NO: 159707 - protein, 9 aa, Homo Sapiens
IQPQMQQIL

SEQ ID NO: 159708 - protein, 9 aa, Homo Sapiens
SLEMNQGIS

SEQ ID NO: 159709 - protein, 9 aa, Homo Sapiens
ERLSDSTKQ

SEQ ID NO: 159710 - protein, 9 aa, Homo Sapiens
KIYSKPCNH

SEQ ID NO: 159711 - protein, 9 aa, Homo Sapiens
VQTTICQER

SEQ ID NO: 159712 - protein, 9 aa, Homo Sapiens
IHCAHSFYY

SEQ ID NO: 159713 - protein, 9 aa, Homo Sapiens
LFISAFMVR

SEQ ID NO: 159714 - protein, 9 aa, Homo Sapiens
SVCTDKLSP

SEQ ID NO: 159715 - protein, 9 aa, Homo Sapiens
STMIEKLRA

SEQ ID NO: 159716 - protein, 9 aa, Homo Sapiens
RRTPSSSTP

SEQ ID NO: 159717 - protein, 9 aa, Homo Sapiens
PTAGKKDDK

SEQ ID NO: 159718 - protein, 9 aa, Homo Sapiens
ARDALPFFM

SEQ ID NO: 159719 - protein, 9 aa, Homo Sapiens
VPPKKSHCS

SEQ ID NO: 159720 - protein, 9 aa, Homo Sapiens
HPPQLVPPE

SEQ ID NO: 159721 - protein, 9 aa, Homo Sapiens
GPARVRTGQ

SEQ ID NO: 159722 - protein, 9 aa, Homo Sapiens
RESGKSNVD

SEQ ID NO: 159723 - protein, 9 aa, Homo Sapiens
CGVAFSRSK

SEQ ID NO: 159724 - protein, 9 aa, Homo Sapiens
VILKIPSAK

SEQ ID NO: 159725 - protein, 9 aa, Homo Sapiens
TKDNVMWAL

SEQ ID NO: 159726 - protein, 9 aa, Homo Sapiens
QTPASLMIT

SEQ ID NO: 159727 - protein, 9 aa, Homo Sapiens
SEGAQRDWF

SEQ ID NO: 159728 - protein, 9 aa, Homo Sapiens
PPRTTRATS

SEQ ID NO: 159729 - protein, 9 aa, Homo Sapiens
WAAGPDEAD

SEQ ID NO: 159730 - protein, 9 aa, Homo Sapiens
MLGLLIEVS

SEQ ID NO: 159731 - protein, 9 aa, Homo Sapiens
ISPLKFSPF

SEQ ID NO: 159732 - protein, 9 aa, Homo Sapiens
QVWTAATLR

SEQ ID NO: 159733 - protein, 9 aa, Homo Sapiens
GIQNGKCPG

SEQ ID NO: 159734 - protein, 9 aa, Homo Sapiens
EYQFCVKAY

SEQ ID NO: 159735 - protein, 9 aa, Homo Sapiens
ATINVKIFQ

SEQ ID NO: 159736 - protein, 9 aa, Homo Sapiens
CFSPLWLMT

SEQ ID NO: 159737 - protein, 9 aa, Homo Sapiens
SMRDKKRRS

SEQ ID NO: 159738 - protein, 9 aa, Homo Sapiens
QAGKQRLKL

SEQ ID NO: 159739 - protein, 9 aa, Homo Sapiens
ELELKEREM

SEQ ID NO: 159740 - protein, 9 aa, Homo Sapiens
MPSKSLYNL

SEQ ID NO: 159741 - protein, 9 aa, Homo Sapiens
ASCVTPTRR

SEQ ID NO: 159742 - protein, 9 aa, Homo Sapiens
IDDGIFWAA

SEQ ID NO: 159743 - protein, 9 aa, Homo Sapiens
GLSDLEVLI

SEQ ID NO: 159744 - protein, 9 aa, Homo Sapiens
QQRTKYYEL

SEQ ID NO: 159745 - protein, 9 aa, Homo Sapiens
IGQRRKATE

SEQ ID NO: 159746 - protein, 9 aa, Homo Sapiens
CVQTTICQE

SEQ ID NO: 159747 - protein, 9 aa, Homo Sapiens
FFCTVHEIL

SEQ ID NO: 159748 - protein, 9 aa, Homo Sapiens
YKAGLFFRY

SEQ ID NO: 159749 - protein, 9 aa, Homo Sapiens
SRSSITASL

SEQ ID NO: 159750 - protein, 9 aa, Homo Sapiens
ILIMQGVLS

SEQ ID NO: 159751 - protein, 9 aa, Homo Sapiens
KQIWWTGWP

SEQ ID NO: 159752 - protein, 9 aa, Homo Sapiens
FAAKAVSEQ

SEQ ID NO: 159753 - protein, 9 aa, Homo Sapiens
VILLLLWYL

SEQ ID NO: 159754 - protein, 9 aa, Homo Sapiens
QCPDQTYGD

SEQ ID NO: 159755 - protein, 9 aa, Homo Sapiens
TSAALQMHF

SEQ ID NO: 159756 - protein, 9 aa, Homo Sapiens
KLEQEIEKA

SEQ ID NO: 159757 - protein, 9 aa, Homo Sapiens
NSPSETHRE

SEQ ID NO: 159758 - protein, 9 aa, Homo Sapiens
ARVRTGQPA

SEQ ID NO: 159759 - protein, 9 aa, Homo Sapiens
APRENGEFC

SEQ ID NO: 159760 - protein, 9 aa, Homo Sapiens
KAFYTLRTQ

SEQ ID NO: 159761 - protein, 9 aa, Homo Sapiens
LSCYSLAPR

SEQ ID NO: 159762 - protein, 9 aa, Homo Sapiens
AMEEVSPYS

SEQ ID NO: 159763 - protein, 9 aa, Homo Sapiens
PPTMCQFIT

SEQ ID NO: 159764 - protein, 9 aa, Homo Sapiens
RAFAWKWEF

SEQ ID NO: 159765 - protein, 9 aa, Homo Sapiens
MTRSLVLRF

SEQ ID NO: 159766 - protein, 9 aa, Homo Sapiens
DGMEAMNGA

SEQ ID NO: 159767 - protein, 9 aa, Homo Sapiens
TEVDGVVAT

SEQ ID NO: 159768 - protein, 9 aa, Homo Sapiens
LVSVPKNHH

SEQ ID NO: 159769 - protein, 9 aa, Homo Sapiens
CVVCHRSLD

SEQ ID NO: 159770 - protein, 9 aa, Homo Sapiens
CDGMEAMNG

SEQ ID NO: 159771 - protein, 9 aa, Homo Sapiens
QGSVQDDTP

SEQ ID NO: 159772 - protein, 9 aa, Homo Sapiens
CPDQTYGDV

SEQ ID NO: 159773 - protein, 9 aa, Homo Sapiens
MAKAGRQPR

SEQ ID NO: 159774 - protein, 9 aa, Homo Sapiens
LMITRARKG

SEQ ID NO: 159775 - protein, 9 aa, Homo Sapiens
LLGSSDSPP

SEQ ID NO: 159776 - protein, 9 aa, Homo Sapiens
PKPQSQKKK

SEQ ID NO: 159777 - protein, 9 aa, Homo Sapiens
RDGERKSMC

SEQ ID NO: 159778 - protein, 9 aa, Homo Sapiens
KVLLMLGLL

SEQ ID NO: 159779 - protein, 9 aa, Homo Sapiens
AAVTLAVSP

SEQ ID NO: 159780 - protein, 9 aa, Homo Sapiens
KHHWLRCSP

SEQ ID NO: 159781 - protein, 9 aa, Homo Sapiens
QHEKVVELL

SEQ ID NO: 159782 - protein, 9 aa, Homo Sapiens
DIVELKKIN

SEQ ID NO: 159783 - protein, 9 aa, Homo Sapiens
SDGEFFPHS

SEQ ID NO: 159784 - protein, 9 aa, Homo Sapiens
LQRAFAWKW

SEQ ID NO: 159785 - protein, 9 aa, Homo Sapiens
ADPQEKGQS

SEQ ID NO: 159786 - protein, 9 aa, Homo Sapiens
PGGQEKKFW

SEQ ID NO: 159787 - protein, 9 aa, Homo Sapiens
VSAEKLYFS

SEQ ID NO: 159788 - protein, 9 aa, Homo Sapiens
QKGDQYVCA

SEQ ID NO: 159789 - protein, 9 aa, Homo Sapiens
RIAAVILKI

SEQ ID NO: 159790 - protein, 9 aa, Homo Sapiens
GLSLWGVPQ

SEQ ID NO: 159791 - protein, 9 aa, Homo Sapiens
NDVDPPGSV

SEQ ID NO: 159792 - protein, 9 aa, Homo Sapiens
KSDCVQTTI

SEQ ID NO: 159793 - protein, 9 aa, Homo Sapiens
GRGEDDEEE

SEQ ID NO: 159794 - protein, 9 aa, Homo Sapiens
DELHVQEFE

SEQ ID NO: 159795 - protein, 9 aa, Homo Sapiens
QPRPPPLPT

SEQ ID NO: 159796 - protein, 9 aa, Homo Sapiens
NEAEALHGE

SEQ ID NO: 159797 - protein, 9 aa, Homo Sapiens
LPPPSPLPL

SEQ ID NO: 159798 - protein, 9 aa, Homo Sapiens
LEDAILIMQ

SEQ ID NO: 159799 - protein, 9 aa, Homo Sapiens
PAVPAAACP

SEQ ID NO: 159800 - protein, 9 aa, Homo Sapiens
DGERKSMCV

SEQ ID NO: 159801 - protein, 9 aa, Homo Sapiens
TLLANINSF

SEQ ID NO: 159802 - protein, 9 aa, Homo Sapiens
STYELKKKT

SEQ ID NO: 159803 - protein, 9 aa, Homo Sapiens
GTHLNMLLG

SEQ ID NO: 159804 - protein, 9 aa, Homo Sapiens
LSADVVEEV

SEQ ID NO: 159805 - protein, 9 aa, Homo Sapiens
GWPIPWVKG

SEQ ID NO: 159806 - protein, 9 aa, Homo Sapiens
ACLLPLAAN

SEQ ID NO: 159807 - protein, 9 aa, Homo Sapiens
TLRTQAINR

SEQ ID NO: 159808 - protein, 9 aa, Homo Sapiens
LTGRRPRAP

SEQ ID NO: 159809 - protein, 9 aa, Homo Sapiens
MQLEEQKHL

SEQ ID NO: 159810 - protein, 9 aa, Homo Sapiens
PVPLHLRNT

SEQ ID NO: 159811 - protein, 9 aa, Homo Sapiens
SLPGPCASL

SEQ ID NO: 159812 - protein, 9 aa, Homo Sapiens
VHEILVHNI

SEQ ID NO: 159813 - protein, 9 aa, Homo Sapiens
LGDYVARVS

SEQ ID NO: 159814 - protein, 9 aa, Homo Sapiens
HLGIVDEEE

SEQ ID NO: 159815 - protein, 9 aa, Homo Sapiens
QTQELDILE

SEQ ID NO: 159816 - protein, 9 aa, Homo Sapiens
QRPQYPVLQ

SEQ ID NO: 159817 - protein, 9 aa, Homo Sapiens
NTLMKTLQR

SEQ ID NO: 159818 - protein, 9 aa, Homo Sapiens
VKCLQTHCY

SEQ ID NO: 159819 - protein, 9 aa, Homo Sapiens
EHMAWAADA

SEQ ID NO: 159820 - protein, 9 aa, Homo Sapiens
QRITSTQQQ

SEQ ID NO: 159821 - protein, 9 aa, Homo Sapiens
LVLATLCHP

SEQ ID NO: 159822 - protein, 9 aa, Homo Sapiens
SPSRSSITA

SEQ ID NO: 159823 - protein, 9 aa, Homo Sapiens
LGIVDEEEL

SEQ ID NO: 159824 - protein, 9 aa, Homo Sapiens
DKKRRSKIE

SEQ ID NO: 159825 - protein, 9 aa, Homo Sapiens
FILDYMGTL

SEQ ID NO: 159826 - protein, 9 aa, Homo Sapiens
ERVVRCCTQ

SEQ ID NO: 159827 - protein, 9 aa, Homo Sapiens
IKELACRFA

SEQ ID NO: 159828 - protein, 9 aa, Homo Sapiens
CTDKLSPGE

SEQ ID NO: 159829 - protein, 9 aa, Homo Sapiens
RNRKEEKRA

SEQ ID NO: 159830 - protein, 9 aa, Homo Sapiens
SLTGAGGGG

SEQ ID NO: 159831 - protein, 9 aa, Homo Sapiens
NSSPRAPIS

SEQ ID NO: 159832 - protein, 9 aa, Homo Sapiens
PKGVESVHV

SEQ ID NO: 159833 - protein, 9 aa, Homo Sapiens
RTTRATSGD

SEQ ID NO: 159834 - protein, 9 aa, Homo Sapiens
GQMGPTEQD

SEQ ID NO: 159835 - protein, 9 aa, Homo Sapiens
ITYVIGVAW

SEQ ID NO: 159836 - protein, 9 aa, Homo Sapiens
SSRPGTSRV

SEQ ID NO: 159837 - protein, 9 aa, Homo Sapiens
CQKSIIDAH

SEQ ID NO: 159838 - protein, 9 aa, Homo Sapiens
TPTRLMKDL

SEQ ID NO: 159839 - protein, 9 aa, Homo Sapiens
QEQSLCVAS

SEQ ID NO: 159840 - protein, 9 aa, Homo Sapiens
GEQCWTVRI

SEQ ID NO: 159841 - protein, 9 aa, Homo Sapiens
QALDVHPPA

SEQ ID NO: 159842 - protein, 9 aa, Homo Sapiens
GCDSAERGQ

SEQ ID NO: 159843 - protein, 9 aa, Homo Sapiens
HIFRRAWRK

SEQ ID NO: 159844 - protein, 9 aa, Homo Sapiens
ALRETPAPR

SEQ ID NO: 159845 - protein, 9 aa, Homo Sapiens
KCPGQLCVI

SEQ ID NO: 159846 - protein, 9 aa, Homo Sapiens
TTGRLMTRS

SEQ ID NO: 159847 - protein, 9 aa, Homo Sapiens
VILALQDHL

SEQ ID NO: 159848 - protein, 9 aa, Homo Sapiens
PSKSLYNLS

SEQ ID NO: 159849 - protein, 9 aa, Homo Sapiens
VSPVPPCGD

SEQ ID NO: 159850 - protein, 9 aa, Homo Sapiens
PASLMITRA

SEQ ID NO: 159851 - protein, 9 aa, Homo Sapiens
DQWTPIATM

SEQ ID NO: 159852 - protein, 9 aa, Homo Sapiens
HGDSLLSNT

SEQ ID NO: 159853 - protein, 9 aa, Homo Sapiens
MMEKLGAPR

SEQ ID NO: 159854 - protein, 9 aa, Homo Sapiens
FEVFFFTIG

SEQ ID NO: 159855 - protein, 9 aa, Homo Sapiens
GPNSPSETH

SEQ ID NO: 159856 - protein, 9 aa, Homo Sapiens
TSTPSTWPS

SEQ ID NO: 159857 - protein, 9 aa, Homo Sapiens
CKKMFEAEK

SEQ ID NO: 159858 - protein, 9 aa, Homo Sapiens
GDEFQKSES

SEQ ID NO: 159859 - protein, 9 aa, Homo Sapiens
SDVREKWKH

SEQ ID NO: 159860 - protein, 9 aa, Homo Sapiens
LPPVTTYNM

SEQ ID NO: 159861 - protein, 9 aa, Homo Sapiens
VVRGPPLHT

SEQ ID NO: 159862 - protein, 9 aa, Homo Sapiens
TAKEMEQIA

SEQ ID NO: 159863 - protein, 9 aa, Homo Sapiens
VQDDTPFPA

SEQ ID NO: 159864 - protein, 9 aa, Homo Sapiens
LATLCHPLE

SEQ ID NO: 159865 - protein, 9 aa, Homo Sapiens
AATECFLIA

SEQ ID NO: 159866 - protein, 9 aa, Homo Sapiens
RSHKLVEAK

SEQ ID NO: 159867 - protein, 9 aa, Homo Sapiens
TSSPHSMDS

SEQ ID NO: 159868 - protein, 9 aa, Homo Sapiens
AAWTHMQGF

SEQ ID NO: 159869 - protein, 9 aa, Homo Sapiens
SVQQSIIVN

SEQ ID NO: 159870 - protein, 9 aa, Homo Sapiens
MPPDSTMIE

SEQ ID NO: 159871 - protein, 9 aa, Homo Sapiens
IEDIVELKK

SEQ ID NO: 159872 - protein, 9 aa, Homo Sapiens
AVSTTPHIT

SEQ ID NO: 159873 - protein, 9 aa, Homo Sapiens
AVLLTVLIP

SEQ ID NO: 159874 - protein, 9 aa, Homo Sapiens
NAGPGLLKA

SEQ ID NO: 159875 - protein, 9 aa, Homo Sapiens
GRKVIVLAI

SEQ ID NO: 159876 - protein, 9 aa, Homo Sapiens
MLKKTSFII

SEQ ID NO: 159877 - protein, 9 aa, Homo Sapiens
SETHRERAF

SEQ ID NO: 159878 - protein, 9 aa, Homo Sapiens
NFAVCDGSL

SEQ ID NO: 159879 - protein, 9 aa, Homo Sapiens
LCHPLEVGL

SEQ ID NO: 159880 - protein, 9 aa, Homo Sapiens
TMRPRLTGR

SEQ ID NO: 159881 - protein, 9 aa, Homo Sapiens
KRRGIGLNG

SEQ ID NO: 159882 - protein, 9 aa, Homo Sapiens
EKLYFSVDA

SEQ ID NO: 159883 - protein, 9 aa, Homo Sapiens
TSFIIRSLQ

SEQ ID NO: 159884 - protein, 9 aa, Homo Sapiens
LLTVLIPCF

SEQ ID NO: 159885 - protein, 9 aa, Homo Sapiens
FCCFGNFIW

SEQ ID NO: 159886 - protein, 9 aa, Homo Sapiens
RLGTHLNML

SEQ ID NO: 159887 - protein, 9 aa, Homo Sapiens
LQHFTTGRL

SEQ ID NO: 159888 - protein, 9 aa, Homo Sapiens
LANINSFYA

SEQ ID NO: 159889 - protein, 9 aa, Homo Sapiens
DGLDGELGP

SEQ ID NO: 159890 - protein, 9 aa, Homo Sapiens
PYECKECGV

SEQ ID NO: 159891 - protein, 9 aa, Homo Sapiens
FAKHHWLRC

SEQ ID NO: 159892 - protein, 9 aa, Homo Sapiens
KKTSFIIRS

SEQ ID NO: 159893 - protein, 9 aa, Homo Sapiens
GGDEEAIQP

SEQ ID NO: 159894 - protein, 9 aa, Homo Sapiens
ARLGDYVAR

SEQ ID NO: 159895 - protein, 9 aa, Homo Sapiens
LTKLNKVRK

SEQ ID NO: 159896 - protein, 9 aa, Homo Sapiens
SFMLDVLEG

SEQ ID NO: 159897 - protein, 9 aa, Homo Sapiens
VIDDGIFWA

SEQ ID NO: 159898 - protein, 9 aa, Homo Sapiens
KAIEAVLPG

SEQ ID NO: 159899 - protein, 9 aa, Homo Sapiens
GRLMTRSLV

SEQ ID NO: 159900 - protein, 9 aa, Homo Sapiens
WFPGRKQPG

SEQ ID NO: 159901 - protein, 9 aa, Homo Sapiens
PNWLCPPCR

SEQ ID NO: 159902 - protein, 9 aa, Homo Sapiens
SVPKNHHMG

SEQ ID NO: 159903 - protein, 9 aa, Homo Sapiens
DGSESEATI

SEQ ID NO: 159904 - protein, 9 aa, Homo Sapiens
STTPHITGG

SEQ ID NO: 159905 - protein, 9 aa, Homo Sapiens
AAAPVASSG

SEQ ID NO: 159906 - protein, 9 aa, Homo Sapiens
NALSFSSNA

SEQ ID NO: 159907 - protein, 9 aa, Homo Sapiens
FLWIGCSLL

SEQ ID NO: 159908 - protein, 9 aa, Homo Sapiens
WTVRIRAVG

SEQ ID NO: 159909 - protein, 9 aa, Homo Sapiens
SFVPESPGG

SEQ ID NO: 159910 - protein, 9 aa, Homo Sapiens
FDSVSSFEG

SEQ ID NO: 159911 - protein, 9 aa, Homo Sapiens
HMFQIYQTS

SEQ ID NO: 159912 - protein, 9 aa, Homo Sapiens
RTRSPCCTM

SEQ ID NO: 159913 - protein, 9 aa, Homo Sapiens
ESTALFAKH

SEQ ID NO: 159914 - protein, 9 aa, Homo Sapiens
KRNRKEEKR

SEQ ID NO: 159915 - protein, 9 aa, Homo Sapiens
NIRGEMALH

SEQ ID NO: 159916 - protein, 9 aa, Homo Sapiens
YILIRAGAL

SEQ ID NO: 159917 - protein, 9 aa, Homo Sapiens
LLLGPSICV

SEQ ID NO: 159918 - protein, 9 aa, Homo Sapiens
PSQCYFHDG

SEQ ID NO: 159919 - protein, 9 aa, Homo Sapiens
ISPGTKDNV

SEQ ID NO: 159920 - protein, 9 aa, Homo Sapiens
KNSVQTTQI

SEQ ID NO: 159921 - protein, 9 aa, Homo Sapiens
YCPPSPSRS

SEQ ID NO: 159922 - protein, 9 aa, Homo Sapiens
PSVVSNVFP

SEQ ID NO: 159923 - protein, 9 aa, Homo Sapiens
ATSKAKASS

SEQ ID NO: 159924 - protein, 9 aa, Homo Sapiens
ICPPVSVCS

SEQ ID NO: 159925 - protein, 9 aa, Homo Sapiens
TVRVQPMAK

SEQ ID NO: 159926 - protein, 9 aa, Homo Sapiens
PPVPPKKSH

SEQ ID NO: 159927 - protein, 9 aa, Homo Sapiens
YPCEHMAWA

SEQ ID NO: 159928 - protein, 9 aa, Homo Sapiens
WTHMQGFPL

SEQ ID NO: 159929 - protein, 9 aa, Homo Sapiens
CRSFPSSHG

SEQ ID NO: 159930 - protein, 9 aa, Homo Sapiens
LEEWDVKCL

SEQ ID NO: 159931 - protein, 9 aa, Homo Sapiens
KQRLKLEQE

SEQ ID NO: 159932 - protein, 9 aa, Homo Sapiens
VLSYSYLAM

SEQ ID NO: 159933 - protein, 9 aa, Homo Sapiens
CFQKNSVQT

SEQ ID NO: 159934 - protein, 9 aa, Homo Sapiens
QAYDAGEQC

SEQ ID NO: 159935 - protein, 9 aa, Homo Sapiens
GFQALDVHP

SEQ ID NO: 159936 - protein, 9 aa, Homo Sapiens
KTSAALQMH

SEQ ID NO: 159937 - protein, 9 aa, Homo Sapiens
MEAMNGAGP

SEQ ID NO: 159938 - protein, 9 aa, Homo Sapiens
HRERAFDAN

SEQ ID NO: 159939 - protein, 9 aa, Homo Sapiens
LDGLDGELG

SEQ ID NO: 159940 - protein, 9 aa, Homo Sapiens
RLGSWRGSF

SEQ ID NO: 159941 - protein, 9 aa, Homo Sapiens
DEPSQCYFH

SEQ ID NO: 159942 - protein, 9 aa, Homo Sapiens
MWSFCFSPL

SEQ ID NO: 159943 - protein, 9 aa, Homo Sapiens
CARWQSWRT

SEQ ID NO: 159944 - protein, 9 aa, Homo Sapiens
ATMLRGQSD

SEQ ID NO: 159945 - protein, 9 aa, Homo Sapiens
TNEKDADVI

SEQ ID NO: 159946 - protein, 9 aa, Homo Sapiens
PMPSTQLLA

SEQ ID NO: 159947 - protein, 9 aa, Homo Sapiens
SLLAPLPTA

SEQ ID NO: 159948 - protein, 9 aa, Homo Sapiens
GSPITCPDT

SEQ ID NO: 159949 - protein, 9 aa, Homo Sapiens
RLQRAFAWK

SEQ ID NO: 159950 - protein, 9 aa, Homo Sapiens
PMPTSAPTP

SEQ ID NO: 159951 - protein, 9 aa, Homo Sapiens
FCFSPLWLM

SEQ ID NO: 159952 - protein, 9 aa, Homo Sapiens
RSEKTVLFL

SEQ ID NO: 159953 - protein, 9 aa, Homo Sapiens
STQATVRDV

SEQ ID NO: 159954 - protein, 9 aa, Homo Sapiens
LYGHTSTVC

SEQ ID NO: 159955 - protein, 9 aa, Homo Sapiens
ASVPSAPWR

SEQ ID NO: 159956 - protein, 9 aa, Homo Sapiens
HHQQPGEAE

SEQ ID NO: 159957 - protein, 9 aa, Homo Sapiens
HCKLCLLGS

SEQ ID NO: 159958 - protein, 9 aa, Homo Sapiens
RKAIEAVLP

SEQ ID NO: 159959 - protein, 9 aa, Homo Sapiens
AIYNQLCYK

SEQ ID NO: 159960 - protein, 9 aa, Homo Sapiens
GPTEQDPYA

SEQ ID NO: 159961 - protein, 9 aa, Homo Sapiens
LLIEVSEEL

SEQ ID NO: 159962 - protein, 9 aa, Homo Sapiens
LRLSLDYQQ

SEQ ID NO: 159963 - protein, 9 aa, Homo Sapiens
HMAWAADAR

SEQ ID NO: 159964 - protein, 9 aa, Homo Sapiens
AAGLWWASV

SEQ ID NO: 159965 - protein, 9 aa, Homo Sapiens
AERGQRVQL

SEQ ID NO: 159966 - protein, 9 aa, Homo Sapiens
SRAAAAAPV

SEQ ID NO: 159967 - protein, 9 aa, Homo Sapiens
DKKECAVEC

SEQ ID NO: 159968 - protein, 9 aa, Homo Sapiens
AKAVSEQQA

SEQ ID NO: 159969 - protein, 9 aa, Homo Sapiens
FSFRMYQKL

SEQ ID NO: 159970 - protein, 9 aa, Homo Sapiens
SSGHLLGGL

SEQ ID NO: 159971 - protein, 9 aa, Homo Sapiens
CSPRAAPLG

SEQ ID NO: 159972 - protein, 9 aa, Homo Sapiens
HAAWTHMQG

SEQ ID NO: 159973 - protein, 9 aa, Homo Sapiens
EPRHSTPAT

SEQ ID NO: 159974 - protein, 9 aa, Homo Sapiens
GYSGSVTQH

SEQ ID NO: 159975 - protein, 9 aa, Homo Sapiens
SPGTKDNVM

SEQ ID NO: 159976 - protein, 9 aa, Homo Sapiens
LLMGEIQAG

SEQ ID NO: 159977 - protein, 9 aa, Homo Sapiens
AKASSTEAT

SEQ ID NO: 159978 - protein, 9 aa, Homo Sapiens
LFVCQVPGV

SEQ ID NO: 159979 - protein, 9 aa, Homo Sapiens
AGKQRLKLE

SEQ ID NO: 159980 - protein, 9 aa, Homo Sapiens
AWKWEFIFM

SEQ ID NO: 159981 - protein, 9 aa, Homo Sapiens
VSCFQKNSV

SEQ ID NO: 159982 - protein, 9 aa, Homo Sapiens
TAGAIGGAY

SEQ ID NO: 159983 - protein, 9 aa, Homo Sapiens
ETCWRPLLS

SEQ ID NO: 159984 - protein, 9 aa, Homo Sapiens
EKVAYPAYE

SEQ ID NO: 159985 - protein, 9 aa, Homo Sapiens
TEQKRCLEA

SEQ ID NO: 159986 - protein, 9 aa, Homo Sapiens
QATDGSHEW

SEQ ID NO: 159987 - protein, 9 aa, Homo Sapiens
VRKKARDAL

SEQ ID NO: 159988 - protein, 9 aa, Homo Sapiens
PTEGVYVYD

SEQ ID NO: 159989 - protein, 9 aa, Homo Sapiens
PGEGGSAPG

SEQ ID NO: 159990 - protein, 9 aa, Homo Sapiens
FRMYQKLRA

SEQ ID NO: 159991 - protein, 9 aa, Homo Sapiens
RGVQCTNSR

SEQ ID NO: 159992 - protein, 9 aa, Homo Sapiens
GVESVHVLF

SEQ ID NO: 159993 - protein, 9 aa, Homo Sapiens
RKSMCVERT

SEQ ID NO: 159994 - protein, 9 aa, Homo Sapiens
HGEIQSLKE

SEQ ID NO: 159995 - protein, 9 aa, Homo Sapiens
PQPPPTMCQ

SEQ ID NO: 159996 - protein, 9 aa, Homo Sapiens
LQLWWCGGG

SEQ ID NO: 159997 - protein, 9 aa, Homo Sapiens
REMCCQFSF

SEQ ID NO: 159998 - protein, 9 aa, Homo Sapiens
FCVWESATP

SEQ ID NO: 159999 - protein, 9 aa, Homo Sapiens
VLSYVDDIK

SEQ ID NO: 160000 - protein, 9 aa, Homo Sapiens
QKYRRVKKN

SEQ ID NO: 160001 - protein, 9 aa, Homo Sapiens
LSERFTSYQ

SEQ ID NO: 160002 - protein, 9 aa, Homo Sapiens
RAAPLGLLQ

SEQ ID NO: 160003 - protein, 9 aa, Homo Sapiens
YQKGDQYVC

SEQ ID NO: 160004 - protein, 9 aa, Homo Sapiens
DPTFPQLTS

SEQ ID NO: 160005 - protein, 9 aa, Homo Sapiens
TPSTWPSSA

SEQ ID NO: 160006 - protein, 9 aa, Homo Sapiens
RSSRRTPSS

SEQ ID NO: 160007 - protein, 9 aa, Homo Sapiens
AYKAGLFFR

SEQ ID NO: 160008 - protein, 9 aa, Homo Sapiens
LQMHFNEVH

SEQ ID NO: 160009 - protein, 9 aa, Homo Sapiens
TASSRPGTS

SEQ ID NO: 160010 - protein, 9 aa, Homo Sapiens
LTGAGGGGF

SEQ ID NO: 160011 - protein, 9 aa, Homo Sapiens
SSTEATEHR

SEQ ID NO: 160012 - protein, 9 aa, Homo Sapiens
GATTTAPPL

SEQ ID NO: 160013 - protein, 9 aa, Homo Sapiens
EFFLQHVDR

SEQ ID NO: 160014 - protein, 9 aa, Homo Sapiens
PSRSSITAS

SEQ ID NO: 160015 - protein, 9 aa, Homo Sapiens
ATPPRTTRA

SEQ ID NO: 160016 - protein, 9 aa, Homo Sapiens
NVSPHVQPE

SEQ ID NO: 160017 - protein, 9 aa, Homo Sapiens
YNLSVTTGA

SEQ ID NO: 160018 - protein, 9 aa, Homo Sapiens
SHTAPLMSS

SEQ ID NO: 160019 - protein, 9 aa, Homo Sapiens
DPPGSVWIL

SEQ ID NO: 160020 - protein, 9 aa, Homo Sapiens
ELQGAVQTN

SEQ ID NO: 160021 - protein, 9 aa, Homo Sapiens
QGAPGRPKQ

SEQ ID NO: 160022 - protein, 9 aa, Homo Sapiens
KRFNLFPCV

SEQ ID NO: 160023 - protein, 9 aa, Homo Sapiens
FPLLKQYLD

SEQ ID NO: 160024 - protein, 9 aa, Homo Sapiens
LWRGQTSSD

SEQ ID NO: 160025 - protein, 9 aa, Homo Sapiens
EPMNPFQPI

SEQ ID NO: 160026 - protein, 9 aa, Homo Sapiens
LHVQEFEAF

SEQ ID NO: 160027 - protein, 9 aa, Homo Sapiens
LRCSPRAAP

SEQ ID NO: 160028 - protein, 9 aa, Homo Sapiens
ISEGAQRDW

SEQ ID NO: 160029 - protein, 9 aa, Homo Sapiens
SVVSNVFPK

SEQ ID NO: 160030 - protein, 9 aa, Homo Sapiens
SDQFVVTDV

SEQ ID NO: 160031 - protein, 9 aa, Homo Sapiens
FKEQLESKG

SEQ ID NO: 160032 - protein, 9 aa, Homo Sapiens
GDSLLSNTF

SEQ ID NO: 160033 - protein, 9 aa, Homo Sapiens
FFFTIGITW

SEQ ID NO: 160034 - protein, 9 aa, Homo Sapiens
WWSNSGMYL

SEQ ID NO: 160035 - protein, 9 aa, Homo Sapiens
FTGRALLEK

SEQ ID NO: 160036 - protein, 9 aa, Homo Sapiens
PFEPACLLP

SEQ ID NO: 160037 - protein, 9 aa, Homo Sapiens
RPRKVAHSD

SEQ ID NO: 160038 - protein, 9 aa, Homo Sapiens
PLLKQYLDV

SEQ ID NO: 160039 - protein, 9 aa, Homo Sapiens
SPRAPISPL

SEQ ID NO: 160040 - protein, 9 aa, Homo Sapiens
IHKSNALHQ

SEQ ID NO: 160041 - protein, 9 aa, Homo Sapiens
SSFPLLKQY

SEQ ID NO: 160042 - protein, 9 aa, Homo Sapiens
CVERTFSEI

SEQ ID NO: 160043 - protein, 9 aa, Homo Sapiens
HKSNALHQD

SEQ ID NO: 160044 - protein, 9 aa, Homo Sapiens
LRKAIEAVL

SEQ ID NO: 160045 - protein, 9 aa, Homo Sapiens
PVLQGTVDV

SEQ ID NO: 160046 - protein, 9 aa, Homo Sapiens
NAVKERESE

SEQ ID NO: 160047 - protein, 9 aa, Homo Sapiens
LSWQLSGRE

SEQ ID NO: 160048 - protein, 9 aa, Homo Sapiens
VDPPGSVWI

SEQ ID NO: 160049 - protein, 9 aa, Homo Sapiens
FVCQVPGVV

SEQ ID NO: 160050 - protein, 9 aa, Homo Sapiens
FQFDAAMPL

SEQ ID NO: 160051 - protein, 9 aa, Homo Sapiens
MRPRLTGRR

SEQ ID NO: 160052 - protein, 9 aa, Homo Sapiens
YLIELEKTC

SEQ ID NO: 160053 - protein, 9 aa, Homo Sapiens
EGAQRDWFP

SEQ ID NO: 160054 - protein, 9 aa, Homo Sapiens
VKIRKENPV

SEQ ID NO: 160055 - protein, 9 aa, Homo Sapiens
MEKLGAPRP

SEQ ID NO: 160056 - protein, 9 aa, Homo Sapiens
RKKARDALP

SEQ ID NO: 160057 - protein, 9 aa, Homo Sapiens
SLTKLNKVR

SEQ ID NO: 160058 - protein, 9 aa, Homo Sapiens
FTRDQHIRD

SEQ ID NO: 160059 - protein, 9 aa, Homo Sapiens
GAALFLKKS

SEQ ID NO: 160060 - protein, 9 aa, Homo Sapiens
HTSVLTYPP

SEQ ID NO: 160061 - protein, 9 aa, Homo Sapiens
RKRWFILWR

SEQ ID NO: 160062 - protein, 9 aa, Homo Sapiens
VPRSSRRTP

SEQ ID NO: 160063 - protein, 9 aa, Homo Sapiens
TAATLRCPA

SEQ ID NO: 160064 - protein, 9 aa, Homo Sapiens
QQHIGLAVD

SEQ ID NO: 160065 - protein, 9 aa, Homo Sapiens
ILGVRRNNI

SEQ ID NO: 160066 - protein, 9 aa, Homo Sapiens
CDSAERGQR

SEQ ID NO: 160067 - protein, 9 aa, Homo Sapiens
KKPRENCRK

SEQ ID NO: 160068 - protein, 9 aa, Homo Sapiens
CFPFAFCYD

SEQ ID NO: 160069 - protein, 9 aa, Homo Sapiens
VIGVAWAAQ

SEQ ID NO: 160070 - protein, 9 aa, Homo Sapiens
QPGTPSSSP

SEQ ID NO: 160071 - protein, 9 aa, Homo Sapiens
EGAWGALPG

SEQ ID NO: 160072 - protein, 9 aa, Homo Sapiens
PPCGDSSTC

SEQ ID NO: 160073 - protein, 9 aa, Homo Sapiens
VTTYNMIDD

SEQ ID NO: 160074 - protein, 9 aa, Homo Sapiens
QRDHHQQPG

SEQ ID NO: 160075 - protein, 9 aa, Homo Sapiens
RFCDIRSES

SEQ ID NO: 160076 - protein, 9 aa, Homo Sapiens
PYVTLKRRL

SEQ ID NO: 160077 - protein, 9 aa, Homo Sapiens
DITHPHEFD

SEQ ID NO: 160078 - protein, 9 aa, Homo Sapiens
EVDEFLGCA

SEQ ID NO: 160079 - protein, 9 aa, Homo Sapiens
KLYTKEWDE

SEQ ID NO: 160080 - protein, 9 aa, Homo Sapiens
SSSFPLLKQ

SEQ ID NO: 160081 - protein, 9 aa, Homo Sapiens
TEGVYVYDL

SEQ ID NO: 160082 - protein, 9 aa, Homo Sapiens
RDIVQVVSA

SEQ ID NO: 160083 - protein, 9 aa, Homo Sapiens
SLARQFFGC

SEQ ID NO: 160084 - protein, 9 aa, Homo Sapiens
FVPESPGGQ

SEQ ID NO: 160085 - protein, 9 aa, Homo Sapiens
STCAQRWKL

SEQ ID NO: 160086 - protein, 9 aa, Homo Sapiens
INLLKNRTA

SEQ ID NO: 160087 - protein, 9 aa, Homo Sapiens
PPKKSHCSR

SEQ ID NO: 160088 - protein, 9 aa, Homo Sapiens
HEILVHNIV

SEQ ID NO: 160089 - protein, 9 aa, Homo Sapiens
THPHEFDFY

SEQ ID NO: 160090 - protein, 9 aa, Homo Sapiens
QPMAKAGRQ

SEQ ID NO: 160091 - protein, 9 aa, Homo Sapiens
SAEKLYFSV

SEQ ID NO: 160092 - protein, 9 aa, Homo Sapiens
DYKAEAAVK

SEQ ID NO: 160093 - protein, 9 aa, Homo Sapiens
SLDYQQREE

SEQ ID NO: 160094 - protein, 9 aa, Homo Sapiens
SHSLAHLLL

SEQ ID NO: 160095 - protein, 9 aa, Homo Sapiens
VVIDDGIFW

SEQ ID NO: 160096 - protein, 9 aa, Homo Sapiens
QQSIIVNQK

SEQ ID NO: 160097 - protein, 9 aa, Homo Sapiens
PLTQEFGSA

SEQ ID NO: 160098 - protein, 9 aa, Homo Sapiens
DSLLSNTFT

SEQ ID NO: 160099 - protein, 9 aa, Homo Sapiens
YPAYERSRD

SEQ ID NO: 160100 - protein, 9 aa, Homo Sapiens
WAQKAAPHP

SEQ ID NO: 160101 - protein, 9 aa, Homo Sapiens
QTNERLKVA

SEQ ID NO: 160102 - protein, 9 aa, Homo Sapiens
YFIQLSHPY

SEQ ID NO: 160103 - protein, 9 aa, Homo Sapiens
KRVHANVDR

SEQ ID NO: 160104 - protein, 9 aa, Homo Sapiens
PAPRRMRAS

SEQ ID NO: 160105 - protein, 9 aa, Homo Sapiens
LEISAGPIT

SEQ ID NO: 160106 - protein, 9 aa, Homo Sapiens
SFRMYQKLR

SEQ ID NO: 160107 - protein, 9 aa, Homo Sapiens
PSGCDSAER

SEQ ID NO: 160108 - protein, 9 aa, Homo Sapiens
AEALHGEIQ

SEQ ID NO: 160109 - protein, 9 aa, Homo Sapiens
TNIRGEMAL

SEQ ID NO: 160110 - protein, 9 aa, Homo Sapiens
SLYNLSVTT

SEQ ID NO: 160111 - protein, 9 aa, Homo Sapiens
KASSTEATE

SEQ ID NO: 160112 - protein, 9 aa, Homo Sapiens
MTLSERFTS

SEQ ID NO: 160113 - protein, 9 aa, Homo Sapiens
LRVSAEKLY

SEQ ID NO: 160114 - protein, 9 aa, Homo Sapiens
GGPQSLVIP

SEQ ID NO: 160115 - protein, 9 aa, Homo Sapiens
IMQGVLSDI

SEQ ID NO: 160116 - protein, 9 aa, Homo Sapiens
PAYERSRDI

SEQ ID NO: 160117 - protein, 9 aa, Homo Sapiens
CCMHLHEKR

SEQ ID NO: 160118 - protein, 9 aa, Homo Sapiens
GVYVYDLYL

SEQ ID NO: 160119 - protein, 9 aa, Homo Sapiens
AAHGIVATA

SEQ ID NO: 160120 - protein, 9 aa, Homo Sapiens
SEPIRNAVK

SEQ ID NO: 160121 - protein, 9 aa, Homo Sapiens
PPGGGRGQE

SEQ ID NO: 160122 - protein, 9 aa, Homo Sapiens
LSPGERPSL

SEQ ID NO: 160123 - protein, 9 aa, Homo Sapiens
DDFEVFFFT

SEQ ID NO: 160124 - protein, 9 aa, Homo Sapiens
PECKNLKWI

SEQ ID NO: 160125 - protein, 9 aa, Homo Sapiens
LTRSQMLSC

SEQ ID NO: 160126 - protein, 9 aa, Homo Sapiens
RLSDSTKQE

SEQ ID NO: 160127 - protein, 9 aa, Homo Sapiens
PFDHMFQIY

SEQ ID NO: 160128 - protein, 9 aa, Homo Sapiens
PDEADTLCI

SEQ ID NO: 160129 - protein, 9 aa, Homo Sapiens
VSTANYIQL

SEQ ID NO: 160130 - protein, 9 aa, Homo Sapiens
CLDGLDGEL

SEQ ID NO: 160131 - protein, 9 aa, Homo Sapiens
NRLEEKKSL

SEQ ID NO: 160132 - protein, 9 aa, Homo Sapiens
ESAAGGPAR

SEQ ID NO: 160133 - protein, 9 aa, Homo Sapiens
TRSHKLVEA

SEQ ID NO: 160134 - protein, 9 aa, Homo Sapiens
SIIVNQKAA

SEQ ID NO: 160135 - protein, 9 aa, Homo Sapiens
VFLSMFGHS

SEQ ID NO: 160136 - protein, 9 aa, Homo Sapiens
QHFTTGRLM

SEQ ID NO: 160137 - protein, 9 aa, Homo Sapiens
TPPRTTRAT

SEQ ID NO: 160138 - protein, 9 aa, Homo Sapiens
VIFTRDQHI

SEQ ID NO: 160139 - protein, 9 aa, Homo Sapiens
PRLTGRRPR

SEQ ID NO: 160140 - protein, 9 aa, Homo Sapiens
RAVQGAAHG

SEQ ID NO: 160141 - protein, 9 aa, Homo Sapiens
CQHDFQKVK

SEQ ID NO: 160142 - protein, 9 aa, Homo Sapiens
CVCPPPPGL

SEQ ID NO: 160143 - protein, 9 aa, Homo Sapiens
PKNHHMGSP

SEQ ID NO: 160144 - protein, 9 aa, Homo Sapiens
GVGGLPSDP

SEQ ID NO: 160145 - protein, 9 aa, Homo Sapiens
VFLYMWSFC

SEQ ID NO: 160146 - protein, 9 aa, Homo Sapiens
IENVILLLL

SEQ ID NO: 160147 - protein, 9 aa, Homo Sapiens
AMTLSERFT

SEQ ID NO: 160148 - protein, 9 aa, Homo Sapiens
QRPGRRSPL

SEQ ID NO: 160149 - protein, 9 aa, Homo Sapiens
EISAGPITG

SEQ ID NO: 160150 - protein, 9 aa, Homo Sapiens
QLGPARSEK

SEQ ID NO: 160151 - protein, 9 aa, Homo Sapiens
TMCQFITAT

SEQ ID NO: 160152 - protein, 9 aa, Homo Sapiens
TCRMKRNRK

SEQ ID NO: 160153 - protein, 9 aa, Homo Sapiens
DCVQTTICQ

SEQ ID NO: 160154 - protein, 9 aa, Homo Sapiens
KGSMRDKKR

SEQ ID NO: 160155 - protein, 9 aa, Homo Sapiens
YTRIAAVIL

SEQ ID NO: 160156 - protein, 9 aa, Homo Sapiens
GSKWSRHLS

SEQ ID NO: 160157 - protein, 9 aa, Homo Sapiens
VDGVVATDF

SEQ ID NO: 160158 - protein, 9 aa, Homo Sapiens
VFIGAGEST

SEQ ID NO: 160159 - protein, 9 aa, Homo Sapiens
QMHFNEVHA

SEQ ID NO: 160160 - protein, 9 aa, Homo Sapiens
WLSASHFTT

SEQ ID NO: 160161 - protein, 9 aa, Homo Sapiens
PHVQPEEEE

SEQ ID NO: 160162 - protein, 9 aa, Homo Sapiens
HPVPANHLD

SEQ ID NO: 160163 - protein, 9 aa, Homo Sapiens
LMGEIQAGQ

SEQ ID NO: 160164 - protein, 9 aa, Homo Sapiens
SVSSFEGKP

SEQ ID NO: 160165 - protein, 9 aa, Homo Sapiens
KSHCSREEN

SEQ ID NO: 160166 - protein, 9 aa, Homo Sapiens
LFLLVCFLF

SEQ ID NO: 160167 - protein, 9 aa, Homo Sapiens
RSSSSKQRS

SEQ ID NO: 160168 - protein, 9 aa, Homo Sapiens
KLMPPDSTM

SEQ ID NO: 160169 - protein, 9 aa, Homo Sapiens
LACRFALTF

SEQ ID NO: 160170 - protein, 9 aa, Homo Sapiens
PIRNAVKER

SEQ ID NO: 160171 - protein, 9 aa, Homo Sapiens
LMTRSLVLR

SEQ ID NO: 160172 - protein, 9 aa, Homo Sapiens
LWWCGGGQT

SEQ ID NO: 160173 - protein, 9 aa, Homo Sapiens
IVELKKINP

SEQ ID NO: 160174 - protein, 9 aa, Homo Sapiens
LGCAIDARS

SEQ ID NO: 160175 - protein, 9 aa, Homo Sapiens
CPNAIVYGL

SEQ ID NO: 160176 - protein, 9 aa, Homo Sapiens
NSRDGFQCG

SEQ ID NO: 160177 - protein, 9 aa, Homo Sapiens
WGGVGGLPS

SEQ ID NO: 160178 - protein, 9 aa, Homo Sapiens
VIPLNKSTV

SEQ ID NO: 160179 - protein, 9 aa, Homo Sapiens
AYPAYERSR

SEQ ID NO: 160180 - protein, 9 aa, Homo Sapiens
CCTMRPRLT

SEQ ID NO: 160181 - protein, 9 aa, Homo Sapiens
TVCLNHGTL

SEQ ID NO: 160182 - protein, 9 aa, Homo Sapiens
GCSLLFQIR

SEQ ID NO: 160183 - protein, 9 aa, Homo Sapiens
KLPSVQQKK

SEQ ID NO: 160184 - protein, 9 aa, Homo Sapiens
GLIDNAIDW

SEQ ID NO: 160185 - protein, 9 aa, Homo Sapiens
RTILKLPSV

SEQ ID NO: 160186 - protein, 9 aa, Homo Sapiens
VLECMLKKT

SEQ ID NO: 160187 - protein, 9 aa, Homo Sapiens
ESVHVLFVC

SEQ ID NO: 160188 - protein, 9 aa, Homo Sapiens
QFCVKAYNE

SEQ ID NO: 160189 - protein, 9 aa, Homo Sapiens
CHPLEVGLI

SEQ ID NO: 160190 - protein, 9 aa, Homo Sapiens
NLLPHQPPL

SEQ ID NO: 160191 - protein, 9 aa, Homo Sapiens
SAAMTLSER

SEQ ID NO: 160192 - protein, 9 aa, Homo Sapiens
QATVRDVVV

SEQ ID NO: 160193 - protein, 9 aa, Homo Sapiens
DCQARPLLE

SEQ ID NO: 160194 - protein, 9 aa, Homo Sapiens
LSFSSNAGP

SEQ ID NO: 160195 - protein, 9 aa, Homo Sapiens
GTPSSSPTV

SEQ ID NO: 160196 - protein, 9 aa, Homo Sapiens
GSTRRAGGS

SEQ ID NO: 160197 - protein, 9 aa, Homo Sapiens
FCYDCEFRE

SEQ ID NO: 160198 - protein, 9 aa, Homo Sapiens
SKAKASSTE

SEQ ID NO: 160199 - protein, 9 aa, Homo Sapiens
ENIGQRRKA

SEQ ID NO: 160200 - protein, 9 aa, Homo Sapiens
QEYQFCVKA

SEQ ID NO: 160201 - protein, 9 aa, Homo Sapiens
GAVQTNERL

SEQ ID NO: 160202 - protein, 9 aa, Homo Sapiens
HLLGGLSLA

SEQ ID NO: 160203 - protein, 9 aa, Homo Sapiens
CTMRPRLTG

SEQ ID NO: 160204 - protein, 9 aa, Homo Sapiens
VSPHVQPEE

SEQ ID NO: 160205 - protein, 9 aa, Homo Sapiens
KTDLMFKKK

SEQ ID NO: 160206 - protein, 9 aa, Homo Sapiens
QHIGLAVDM

SEQ ID NO: 160207 - protein, 9 aa, Homo Sapiens
AQLSWQLSG

SEQ ID NO: 160208 - protein, 9 aa, Homo Sapiens
DNVSPHVQP

SEQ ID NO: 160209 - protein, 9 aa, Homo Sapiens
ASVPEALPM

SEQ ID NO: 160210 - protein, 9 aa, Homo Sapiens
QCTNSRDGF

SEQ ID NO: 160211 - protein, 9 aa, Homo Sapiens
TLLRNAIFC

SEQ ID NO: 160212 - protein, 9 aa, Homo Sapiens
KVIKKSRFQ

SEQ ID NO: 160213 - protein, 9 aa, Homo Sapiens
CVKAYNEKG

SEQ ID NO: 160214 - protein, 9 aa, Homo Sapiens
VPFEPACLL

SEQ ID NO: 160215 - protein, 9 aa, Homo Sapiens
DFEVFFFTI

SEQ ID NO: 160216 - protein, 9 aa, Homo Sapiens
KKTYCYHKY

SEQ ID NO: 160217 - protein, 9 aa, Homo Sapiens
CCQFSFRMY

SEQ ID NO: 160218 - protein, 9 aa, Homo Sapiens
NSCPNAIVY

SEQ ID NO: 160219 - protein, 9 aa, Homo Sapiens
IQPRPPPLP

SEQ ID NO: 160220 - protein, 9 aa, Homo Sapiens
PQPGTPSSS

SEQ ID NO: 160221 - protein, 9 aa, Homo Sapiens
KRKCQHDFQ

SEQ ID NO: 160222 - protein, 9 aa, Homo Sapiens
DAGEQCRFQ

SEQ ID NO: 160223 - protein, 9 aa, Homo Sapiens
KTALAAKLQ

SEQ ID NO: 160224 - protein, 9 aa, Homo Sapiens
HDLFRFLQL

SEQ ID NO: 160225 - protein, 9 aa, Homo Sapiens
LRDVGDLKA

SEQ ID NO: 160226 - protein, 9 aa, Homo Sapiens
PLIIPTKVG

SEQ ID NO: 160227 - protein, 9 aa, Homo Sapiens
YRRVKKNVR

SEQ ID NO: 160228 - protein, 9 aa, Homo Sapiens
RSYLRCRDI

SEQ ID NO: 160229 - protein, 9 aa, Homo Sapiens
HPLEVGLIG

SEQ ID NO: 160230 - protein, 9 aa, Homo Sapiens
GGQEKKFWE

SEQ ID NO: 160231 - protein, 9 aa, Homo Sapiens
QLEEQKHLM

SEQ ID NO: 160232 - protein, 9 aa, Homo Sapiens
STLTSTPST

SEQ ID NO: 160233 - protein, 9 aa, Homo Sapiens
FVSPGFVPL

SEQ ID NO: 160234 - protein, 9 aa, Homo Sapiens
RRRPATPPR

SEQ ID NO: 160235 - protein, 9 aa, Homo Sapiens
SGQEYQFCV

SEQ ID NO: 160236 - protein, 9 aa, Homo Sapiens
IQGTRYICP

SEQ ID NO: 160237 - protein, 9 aa, Homo Sapiens
KEVFGTFRI

SEQ ID NO: 160238 - protein, 9 aa, Homo Sapiens
PLSGKGNPE

SEQ ID NO: 160239 - protein, 9 aa, Homo Sapiens
PKQEKTLMK

SEQ ID NO: 160240 - protein, 9 aa, Homo Sapiens
VDPSGGDHF

SEQ ID NO: 160241 - protein, 9 aa, Homo Sapiens
VLRFKVLLM

SEQ ID NO: 160242 - protein, 9 aa, Homo Sapiens
LGPARSEKT

SEQ ID NO: 160243 - protein, 9 aa, Homo Sapiens
MQQQQRDHH

SEQ ID NO: 160244 - protein, 9 aa, Homo Sapiens
GLFFRYPEE

SEQ ID NO: 160245 - protein, 9 aa, Homo Sapiens
SRRHPLSHT

SEQ ID NO: 160246 - protein, 9 aa, Homo Sapiens
ATPGSSRAT

SEQ ID NO: 160247 - protein, 9 aa, Homo Sapiens
LPTAGKKDD

SEQ ID NO: 160248 - protein, 9 aa, Homo Sapiens
LIRAGALMM

SEQ ID NO: 160249 - protein, 9 aa, Homo Sapiens
KIQEQSLCV

SEQ ID NO: 160250 - protein, 9 aa, Homo Sapiens
QRLGSWRGS

SEQ ID NO: 160251 - protein, 9 aa, Homo Sapiens
GQRRKATEG

SEQ ID NO: 160252 - protein, 9 aa, Homo Sapiens
SDSTKQELM

SEQ ID NO: 160253 - protein, 9 aa, Homo Sapiens
VFLVRRFCC

SEQ ID NO: 160254 - protein, 9 aa, Homo Sapiens
KLAYEKSRM

SEQ ID NO: 160255 - protein, 9 aa, Homo Sapiens
FAWKWEFIF

SEQ ID NO: 160256 - protein, 9 aa, Homo Sapiens
SFCARWQSW

SEQ ID NO: 160257 - protein, 9 aa, Homo Sapiens
VELSADVVE

SEQ ID NO: 160258 - protein, 9 aa, Homo Sapiens
PGRPKQLGP

SEQ ID NO: 160259 - protein, 9 aa, Homo Sapiens
AIEAVLPGL

SEQ ID NO: 160260 - protein, 9 aa, Homo Sapiens
FTIHRILPL

SEQ ID NO: 160261 - protein, 9 aa, Homo Sapiens
APHPPQLVP

SEQ ID NO: 160262 - protein, 9 aa, Homo Sapiens
LYNLSVTTG

SEQ ID NO: 160263 - protein, 9 aa, Homo Sapiens
TTTRFDSVS

SEQ ID NO: 160264 - protein, 9 aa, Homo Sapiens
AYPTVKIYF

SEQ ID NO: 160265 - protein, 9 aa, Homo Sapiens
SLLSTLSQP

SEQ ID NO: 160266 - protein, 9 aa, Homo Sapiens
PPTVVPSSP

SEQ ID NO: 160267 - protein, 9 aa, Homo Sapiens
SHKLVEAKD

SEQ ID NO: 160268 - protein, 9 aa, Homo Sapiens
PPGLPHPCM

SEQ ID NO: 160269 - protein, 9 aa, Homo Sapiens
QWTPIATML

SEQ ID NO: 160270 - protein, 9 aa, Homo Sapiens
QEKGQSGPG

SEQ ID NO: 160271 - protein, 9 aa, Homo Sapiens
SNIYTGLFL

SEQ ID NO: 160272 - protein, 9 aa, Homo Sapiens
RNAVKERES

SEQ ID NO: 160273 - protein, 9 aa, Homo Sapiens
HVHGQSLTG

SEQ ID NO: 160274 - protein, 9 aa, Homo Sapiens
YQFCVKAYN

SEQ ID NO: 160275 - protein, 9 aa, Homo Sapiens
EAPHPPQLV

SEQ ID NO: 160276 - protein, 9 aa, Homo Sapiens
PITCPDTVC

SEQ ID NO: 160277 - protein, 9 aa, Homo Sapiens
HHWLRCSPR

SEQ ID NO: 160278 - protein, 9 aa, Homo Sapiens
KEMEQIAEV

SEQ ID NO: 160279 - protein, 9 aa, Homo Sapiens
VLVKMECWP

SEQ ID NO: 160280 - protein, 9 aa, Homo Sapiens
RYICPPVSV

SEQ ID NO: 160281 - protein, 9 aa, Homo Sapiens
DAHANEEID

SEQ ID NO: 160282 - protein, 9 aa, Homo Sapiens
WDLLHVPYL

SEQ ID NO: 160283 - protein, 9 aa, Homo Sapiens
PLHLRNTPT

SEQ ID NO: 160284 - protein, 9 aa, Homo Sapiens
TRSPCCTMR

SEQ ID NO: 160285 - protein, 9 aa, Homo Sapiens
QPIASILEE

SEQ ID NO: 160286 - protein, 9 aa, Homo Sapiens
ADVILAAGD

SEQ ID NO: 160287 - protein, 9 aa, Homo Sapiens
IVVSYQEND

SEQ ID NO: 160288 - protein, 9 aa, Homo Sapiens
SASARLCSF

SEQ ID NO: 160289 - protein, 9 aa, Homo Sapiens
QPPPQAPSQ

SEQ ID NO: 160290 - protein, 9 aa, Homo Sapiens
LNSSPRAPI

SEQ ID NO: 160291 - protein, 9 aa, Homo Sapiens
SPLMSSPEN

SEQ ID NO: 160292 - protein, 9 aa, Homo Sapiens
STEATEHRR

SEQ ID NO: 160293 - protein, 9 aa, Homo Sapiens
LDYQQREEL

SEQ ID NO: 160294 - protein, 9 aa, Homo Sapiens
GVVATDFFT

SEQ ID NO: 160295 - protein, 9 aa, Homo Sapiens
LIIPTKVGT

SEQ ID NO: 160296 - protein, 9 aa, Homo Sapiens
DLCQDMLVL

SEQ ID NO: 160297 - protein, 9 aa, Homo Sapiens
HPLGDTPQP

SEQ ID NO: 160298 - protein, 9 aa, Homo Sapiens
IMELEHQGN

SEQ ID NO: 160299 - protein, 9 aa, Homo Sapiens
ALQMHFNEV

SEQ ID NO: 160300 - protein, 9 aa, Homo Sapiens
VTWDRHSDS

SEQ ID NO: 160301 - protein, 9 aa, Homo Sapiens
QVLQRPQYP

SEQ ID NO: 160302 - protein, 9 aa, Homo Sapiens
GGEEKDGDE

SEQ ID NO: 160303 - protein, 9 aa, Homo Sapiens
YLLAFLVDD

SEQ ID NO: 160304 - protein, 9 aa, Homo Sapiens
PPGPPRRRP

SEQ ID NO: 160305 - protein, 9 aa, Homo Sapiens
PVTTYNMID

SEQ ID NO: 160306 - protein, 9 aa, Homo Sapiens
PMAAGATPS

SEQ ID NO: 160307 - protein, 9 aa, Homo Sapiens
QLESKGRSH

SEQ ID NO: 160308 - protein, 9 aa, Homo Sapiens
EMSSPQRIT

SEQ ID NO: 160309 - protein, 9 aa, Homo Sapiens
LLVCFLFFC

SEQ ID NO: 160310 - protein, 9 aa, Homo Sapiens
AEAAVKIRK

SEQ ID NO: 160311 - protein, 9 aa, Homo Sapiens
IRQCPDQTY

SEQ ID NO: 160312 - protein, 9 aa, Homo Sapiens
CNCPIMDIQ

SEQ ID NO: 160313 - protein, 9 aa, Homo Sapiens
AIGGAYEHR

SEQ ID NO: 160314 - protein, 9 aa, Homo Sapiens
IYFYERAKR

SEQ ID NO: 160315 - protein, 9 aa, Homo Sapiens
YLQQTQELD

SEQ ID NO: 160316 - protein, 9 aa, Homo Sapiens
AVTLAVSPL

SEQ ID NO: 160317 - protein, 9 aa, Homo Sapiens
KKCAKAFSF

SEQ ID NO: 160318 - protein, 9 aa, Homo Sapiens
EAQVNPECK

SEQ ID NO: 160319 - protein, 9 aa, Homo Sapiens
VTQHLSHRA

SEQ ID NO: 160320 - protein, 9 aa, Homo Sapiens
TRGRERSQP

SEQ ID NO: 160321 - protein, 9 aa, Homo Sapiens
LEMQLEEQK

SEQ ID NO: 160322 - protein, 9 aa, Homo Sapiens
VTLKRRLAV

SEQ ID NO: 160323 - protein, 9 aa, Homo Sapiens
GLDGELGPV

SEQ ID NO: 160324 - protein, 9 aa, Homo Sapiens
ILAYTRSHK

SEQ ID NO: 160325 - protein, 9 aa, Homo Sapiens
SPAIAVMQP

SEQ ID NO: 160326 - protein, 9 aa, Homo Sapiens
LEVGLIGLP

SEQ ID NO: 160327 - protein, 9 aa, Homo Sapiens
GATPSPGPG

SEQ ID NO: 160328 - protein, 9 aa, Homo Sapiens
GPSICVFLV

SEQ ID NO: 160329 - protein, 9 aa, Homo Sapiens
DPEPMNPFQ

SEQ ID NO: 160330 - protein, 9 aa, Homo Sapiens
AAGPDEADT

SEQ ID NO: 160331 - protein, 9 aa, Homo Sapiens
FIRAVWAYN

SEQ ID NO: 160332 - protein, 9 aa, Homo Sapiens
AVPAAACPP

SEQ ID NO: 160333 - protein, 9 aa, Homo Sapiens
EVWQVCDFK

SEQ ID NO: 160334 - protein, 9 aa, Homo Sapiens
CTVHEILVH

SEQ ID NO: 160335 - protein, 9 aa, Homo Sapiens
FPHSHYSDS

SEQ ID NO: 160336 - protein, 9 aa, Homo Sapiens
VVELLKAAQ

SEQ ID NO: 160337 - protein, 9 aa, Homo Sapiens
DIVQVVSAG

SEQ ID NO: 160338 - protein, 9 aa, Homo Sapiens
LGTHLNMLL

SEQ ID NO: 160339 - protein, 9 aa, Homo Sapiens
PRRRPATPP

SEQ ID NO: 160340 - protein, 9 aa, Homo Sapiens
KKSRFQLTR

SEQ ID NO: 160341 - protein, 9 aa, Homo Sapiens
MEQIAEVEP

SEQ ID NO: 160342 - protein, 9 aa, Homo Sapiens
YPTVKIYFY

SEQ ID NO: 160343 - protein, 9 aa, Homo Sapiens
SSEALERVV

SEQ ID NO: 160344 - protein, 9 aa, Homo Sapiens
FNAMFVSPG

SEQ ID NO: 160345 - protein, 9 aa, Homo Sapiens
SFYAHTTVS

SEQ ID NO: 160346 - protein, 9 aa, Homo Sapiens
GMSRLLGGR

SEQ ID NO: 160347 - protein, 9 aa, Homo Sapiens
AGGCDGMEA

SEQ ID NO: 160348 - protein, 9 aa, Homo Sapiens
QQAGKQRLK

SEQ ID NO: 160349 - protein, 9 aa, Homo Sapiens
AFYTLRTQA

SEQ ID NO: 160350 - protein, 9 aa, Homo Sapiens
NVILLLLWY

SEQ ID NO: 160351 - protein, 9 aa, Homo Sapiens
VSNVFPKGV

SEQ ID NO: 160352 - protein, 9 aa, Homo Sapiens
RPGRRSPLM

SEQ ID NO: 160353 - protein, 9 aa, Homo Sapiens
LYCPPSPSR

SEQ ID NO: 160354 - protein, 9 aa, Homo Sapiens
ECKECGVAF

SEQ ID NO: 160355 - protein, 9 aa, Homo Sapiens
GQRVQLPGG

SEQ ID NO: 160356 - protein, 9 aa, Homo Sapiens
YVAHTSVLT

SEQ ID NO: 160357 - protein, 9 aa, Homo Sapiens
RFKVLLMLG

SEQ ID NO: 160358 - protein, 9 aa, Homo Sapiens
IRFIENVIL

SEQ ID NO: 160359 - protein, 9 aa, Homo Sapiens
SFPLLKQYL

SEQ ID NO: 160360 - protein, 9 aa, Homo Sapiens
LPDNPKRFN

SEQ ID NO: 160361 - protein, 9 aa, Homo Sapiens
WRGQTSSDP

SEQ ID NO: 160362 - protein, 9 aa, Homo Sapiens
AKEMEQIAE

SEQ ID NO: 160363 - protein, 9 aa, Homo Sapiens
PGRRSPLMS

SEQ ID NO: 160364 - protein, 9 aa, Homo Sapiens
SAVANVVFT

SEQ ID NO: 160365 - protein, 9 aa, Homo Sapiens
LQFVDDALT

SEQ ID NO: 160366 - protein, 9 aa, Homo Sapiens
PLSHTAPLM

SEQ ID NO: 160367 - protein, 9 aa, Homo Sapiens
DYQKGDQYV

SEQ ID NO: 160368 - protein, 9 aa, Homo Sapiens
PTDRNLPMP

SEQ ID NO: 160369 - protein, 9 aa, Homo Sapiens
SPLWLMTAM

SEQ ID NO: 160370 - protein, 9 aa, Homo Sapiens
VLWILSDKK

SEQ ID NO: 160371 - protein, 9 aa, Homo Sapiens
TPTRRRVHP

SEQ ID NO: 160372 - protein, 9 aa, Homo Sapiens
DLEVLIVVI

SEQ ID NO: 160373 - protein, 9 aa, Homo Sapiens
GGGDEEAIQ

SEQ ID NO: 160374 - protein, 9 aa, Homo Sapiens
WAYNGENWR

SEQ ID NO: 160375 - protein, 9 aa, Homo Sapiens
YFNAMFVSP

SEQ ID NO: 160376 - protein, 9 aa, Homo Sapiens
SRRTPSSST

SEQ ID NO: 160377 - protein, 9 aa, Homo Sapiens
TFRIPFLLR

SEQ ID NO: 160378 - protein, 9 aa, Homo Sapiens
GQSLTGAGG

SEQ ID NO: 160379 - protein, 9 aa, Homo Sapiens
WVALRETPA

SEQ ID NO: 160380 - protein, 9 aa, Homo Sapiens
DRRKKKPIV

SEQ ID NO: 160381 - protein, 9 aa, Homo Sapiens
DGSFKEQLE

SEQ ID NO: 160382 - protein, 9 aa, Homo Sapiens
MTAMWLSAS

SEQ ID NO: 160383 - protein, 9 aa, Homo Sapiens
FLLSSVFGY

SEQ ID NO: 160384 - protein, 9 aa, Homo Sapiens
DHVFILDYM

SEQ ID NO: 160385 - protein, 9 aa, Homo Sapiens
RLAVCPDLV

SEQ ID NO: 160386 - protein, 9 aa, Homo Sapiens
QVCDFKQLY

SEQ ID NO: 160387 - protein, 9 aa, Homo Sapiens
VQDNGEDSL

SEQ ID NO: 160388 - protein, 9 aa, Homo Sapiens
YTRSHKLVE

SEQ ID NO: 160389 - protein, 9 aa, Homo Sapiens
PLPTPARSQ

SEQ ID NO: 160390 - protein, 9 aa, Homo Sapiens
LQNDEFTHD

SEQ ID NO: 160391 - protein, 9 aa, Homo Sapiens
DFIGSSQEC

SEQ ID NO: 160392 - protein, 9 aa, Homo Sapiens
SLAAGLWWA

SEQ ID NO: 160393 - protein, 9 aa, Homo Sapiens
PRRCPHCLP

SEQ ID NO: 160394 - protein, 9 aa, Homo Sapiens
MLDVLEGRA

SEQ ID NO: 160395 - protein, 9 aa, Homo Sapiens
CHSLSWAQK

SEQ ID NO: 160396 - protein, 9 aa, Homo Sapiens
RRFCCFGNF

SEQ ID NO: 160397 - protein, 9 aa, Homo Sapiens
WTAATLRCP

SEQ ID NO: 160398 - protein, 9 aa, Homo Sapiens
VRKKQKTDL

SEQ ID NO: 160399 - protein, 9 aa, Homo Sapiens
QATYYRFGI

SEQ ID NO: 160400 - protein, 9 aa, Homo Sapiens
VWAYNGENW

SEQ ID NO: 160401 - protein, 9 aa, Homo Sapiens
SSSKQRSWV

SEQ ID NO: 160402 - protein, 9 aa, Homo Sapiens
VWQAIKLLP

SEQ ID NO: 160403 - protein, 9 aa, Homo Sapiens
LRTQAINRR

SEQ ID NO: 160404 - protein, 9 aa, Homo Sapiens
DQATYYRFG

SEQ ID NO: 160405 - protein, 9 aa, Homo Sapiens
TLRCPAVPA

SEQ ID NO: 160406 - protein, 9 aa, Homo Sapiens
VVLMLLLLP

SEQ ID NO: 160407 - protein, 9 aa, Homo Sapiens
SSQECIKPV

SEQ ID NO: 160408 - protein, 9 aa, Homo Sapiens
AQVFLVVFL

SEQ ID NO: 160409 - protein, 9 aa, Homo Sapiens
EPSQCYFHD

SEQ ID NO: 160410 - protein, 9 aa, Homo Sapiens
PSDQFVVTD

SEQ ID NO: 160411 - protein, 9 aa, Homo Sapiens
GLYWAQDSA

SEQ ID NO: 160412 - protein, 9 aa, Homo Sapiens
PPQPGTPSS

SEQ ID NO: 160413 - protein, 9 aa, Homo Sapiens
GEFCKMGRY

SEQ ID NO: 160414 - protein, 9 aa, Homo Sapiens
TMLRGQSDV

SEQ ID NO: 160415 - protein, 9 aa, Homo Sapiens
GGQVLQRPQ

SEQ ID NO: 160416 - protein, 9 aa, Homo Sapiens
NVFPKGVES

SEQ ID NO: 160417 - protein, 9 aa, Homo Sapiens
HPLSHTAPL

SEQ ID NO: 160418 - protein, 9 aa, Homo Sapiens
LSFMLDVLE

SEQ ID NO: 160419 - protein, 9 aa, Homo Sapiens
VEVWQVCDF

SEQ ID NO: 160420 - protein, 9 aa, Homo Sapiens
HFCLGQLSN

SEQ ID NO: 160421 - protein, 9 aa, Homo Sapiens
HGIVATAQF

SEQ ID NO: 160422 - protein, 9 aa, Homo Sapiens
RDALPFFMM

SEQ ID NO: 160423 - protein, 9 aa, Homo Sapiens
LAVPFEPAC

SEQ ID NO: 160424 - protein, 9 aa, Homo Sapiens
HEFDFYLCS

SEQ ID NO: 160425 - protein, 9 aa, Homo Sapiens
PDSTMIEKL

SEQ ID NO: 160426 - protein, 9 aa, Homo Sapiens
AAVILKIPS

SEQ ID NO: 160427 - protein, 9 aa, Homo Sapiens
PPPTVVPSS

SEQ ID NO: 160428 - protein, 9 aa, Homo Sapiens
LEHQGNVLV

SEQ ID NO: 160429 - protein, 9 aa, Homo Sapiens
GLWWASVPS

SEQ ID NO: 160430 - protein, 9 aa, Homo Sapiens
TAGKKDDKA

SEQ ID NO: 160431 - protein, 9 aa, Homo Sapiens
EPVIMELEH

SEQ ID NO: 160432 - protein, 9 aa, Homo Sapiens
KPIVVSYQE

SEQ ID NO: 160433 - protein, 9 aa, Homo Sapiens
AWGALPGST

SEQ ID NO: 160434 - protein, 9 aa, Homo Sapiens
RKEEKRALD

SEQ ID NO: 160435 - protein, 9 aa, Homo Sapiens
HPHEFDFYL

SEQ ID NO: 160436 - protein, 9 aa, Homo Sapiens
EEKKSLTKL

SEQ ID NO: 160437 - protein, 9 aa, Homo Sapiens
KVEIVCTPQ

SEQ ID NO: 160438 - protein, 9 aa, Homo Sapiens
SGATTTAPP

SEQ ID NO: 160439 - protein, 9 aa, Homo Sapiens
IDNVSPHVQ

SEQ ID NO: 160440 - protein, 9 aa, Homo Sapiens
GSEPGEGGS

SEQ ID NO: 160441 - protein, 9 aa, Homo Sapiens
RFCCFGNFI

SEQ ID NO: 160442 - protein, 9 aa, Homo Sapiens
TCPDTVCLN

SEQ ID NO: 160443 - protein, 9 aa, Homo Sapiens
DRLAFHRHP

SEQ ID NO: 160444 - protein, 9 aa, Homo Sapiens
NGEFCKMGR

SEQ ID NO: 160445 - protein, 9 aa, Homo Sapiens
ECFLIALEL

SEQ ID NO: 160446 - protein, 9 aa, Homo Sapiens
DIALNMMAV

SEQ ID NO: 160447 - protein, 9 aa, Homo Sapiens
VGLYWAQDS

SEQ ID NO: 160448 - protein, 9 aa, Homo Sapiens
TKKLYKQYA

SEQ ID NO: 160449 - protein, 9 aa, Homo Sapiens
AQKAAPHPT

SEQ ID NO: 160450 - protein, 9 aa, Homo Sapiens
PHPSVVSNV

SEQ ID NO: 160451 - protein, 9 aa, Homo Sapiens
LFIRAVWAY

SEQ ID NO: 160452 - protein, 9 aa, Homo Sapiens
FFTIGITWI

SEQ ID NO: 160453 - protein, 9 aa, Homo Sapiens
CVNCVWWSN

SEQ ID NO: 160454 - protein, 9 aa, Homo Sapiens
KMFEAEKVN

SEQ ID NO: 160455 - protein, 9 aa, Homo Sapiens
CFRGVQCTN

SEQ ID NO: 160456 - protein, 9 aa, Homo Sapiens
QKKQLAEQE

SEQ ID NO: 160457 - protein, 9 aa, Homo Sapiens
LKKTSFIIR

SEQ ID NO: 160458 - protein, 9 aa, Homo Sapiens
RDQHIRDVA

SEQ ID NO: 160459 - protein, 9 aa, Homo Sapiens
LPREPRHST

SEQ ID NO: 160460 - protein, 9 aa, Homo Sapiens
SGPTAMNRA

SEQ ID NO: 160461 - protein, 9 aa, Homo Sapiens
HHPLGDTPQ

SEQ ID NO: 160462 - protein, 9 aa, Homo Sapiens
GSESEATIN

SEQ ID NO: 160463 - protein, 9 aa, Homo Sapiens
LSLWGVPQK

SEQ ID NO: 160464 - protein, 9 aa, Homo Sapiens
SRSSRSVLL

SEQ ID NO: 160465 - protein, 9 aa, Homo Sapiens
DLPDNPKRF

SEQ ID NO: 160466 - protein, 9 aa, Homo Sapiens
FLYMWSFCF

SEQ ID NO: 160467 - protein, 9 aa, Homo Sapiens
AMFVSPGFV

SEQ ID NO: 160468 - protein, 9 aa, Homo Sapiens
PPPPPPCRS

SEQ ID NO: 160469 - protein, 9 aa, Homo Sapiens
APRRMRASR

SEQ ID NO: 160470 - protein, 9 aa, Homo Sapiens
SQHGDSLLS

SEQ ID NO: 160471 - protein, 9 aa, Homo Sapiens
MGRKVIVLA

SEQ ID NO: 160472 - protein, 9 aa, Homo Sapiens
ITALPSDQF

SEQ ID NO: 160473 - protein, 9 aa, Homo Sapiens
VQVVSAGTY

SEQ ID NO: 160474 - protein, 9 aa, Homo Sapiens
EYLIELEKT

SEQ ID NO: 160475 - protein, 9 aa, Homo Sapiens
RGRERSQPI

SEQ ID NO: 160476 - protein, 9 aa, Homo Sapiens
ATEHRRQRR

SEQ ID NO: 160477 - protein, 9 aa, Homo Sapiens
QELDILETI

SEQ ID NO: 160478 - protein, 9 aa, Homo Sapiens
VPQKPGSEN

SEQ ID NO: 160479 - protein, 9 aa, Homo Sapiens
SPITCPDTV

SEQ ID NO: 160480 - protein, 9 aa, Homo Sapiens
WRTRSPCCT

SEQ ID NO: 160481 - protein, 9 aa, Homo Sapiens
GETPSTASS

SEQ ID NO: 160482 - protein, 9 aa, Homo Sapiens
GIVDEEELL

SEQ ID NO: 160483 - protein, 9 aa, Homo Sapiens
YTKEWDESK

SEQ ID NO: 160484 - protein, 9 aa, Homo Sapiens
SITASLAAG

SEQ ID NO: 160485 - protein, 9 aa, Homo Sapiens
VPSHIFRRA

SEQ ID NO: 160486 - protein, 9 aa, Homo Sapiens
EAVLPGLYR

SEQ ID NO: 160487 - protein, 9 aa, Homo Sapiens
CWRPLLSSQ

SEQ ID NO: 160488 - protein, 9 aa, Homo Sapiens
TGYSGSVTQ

SEQ ID NO: 160489 - protein, 9 aa, Homo Sapiens
VELKKINPD

SEQ ID NO: 160490 - protein, 9 aa, Homo Sapiens
VPSSPSVVP

SEQ ID NO: 160491 - protein, 9 aa, Homo Sapiens
RRKKKPIVV

SEQ ID NO: 160492 - protein, 9 aa, Homo Sapiens
PQRITSTQQ

SEQ ID NO: 160493 - protein, 9 aa, Homo Sapiens
HIGLAVDMD

SEQ ID NO: 160494 - protein, 9 aa, Homo Sapiens
QRTKYYELI

SEQ ID NO: 160495 - protein, 9 aa, Homo Sapiens
ATTTAPPLS

SEQ ID NO: 160496 - protein, 9 aa, Homo Sapiens
ILDYMGTLF

SEQ ID NO: 160497 - protein, 9 aa, Homo Sapiens
RFIENVILL

SEQ ID NO: 160498 - protein, 9 aa, Homo Sapiens
IALELEASS

SEQ ID NO: 160499 - protein, 9 aa, Homo Sapiens
KGQQRTKYY

SEQ ID NO: 160500 - protein, 9 aa, Homo Sapiens
KVVELLKAA

SEQ ID NO: 160501 - protein, 9 aa, Homo Sapiens
KGPSTFRDV

SEQ ID NO: 160502 - protein, 9 aa, Homo Sapiens
NCVWWSNSG

SEQ ID NO: 160503 - protein, 9 aa, Homo Sapiens
LDDFIGSSQ

SEQ ID NO: 160504 - protein, 9 aa, Homo Sapiens
IRGSVSTAN

SEQ ID NO: 160505 - protein, 9 aa, Homo Sapiens
GVAFSRSKN

SEQ ID NO: 160506 - protein, 9 aa, Homo Sapiens
RILPLTQEF

SEQ ID NO: 160507 - protein, 9 aa, Homo Sapiens
KQEKTLMKA

SEQ ID NO: 160508 - protein, 9 aa, Homo Sapiens
RHLVLWADC

SEQ ID NO: 160509 - protein, 9 aa, Homo Sapiens
DVILAAGDS

SEQ ID NO: 160510 - protein, 9 aa, Homo Sapiens
AEKLYFSVD

SEQ ID NO: 160511 - protein, 9 aa, Homo Sapiens
QKTDLMFKK

SEQ ID NO: 160512 - protein, 9 aa, Homo Sapiens
LNSTAGAIG

SEQ ID NO: 160513 - protein, 9 aa, Homo Sapiens
NVFTGRALL

SEQ ID NO: 160514 - protein, 9 aa, Homo Sapiens
HSKCTRLGT

SEQ ID NO: 160515 - protein, 9 aa, Homo Sapiens
EQDPYAKTY

SEQ ID NO: 160516 - protein, 9 aa, Homo Sapiens
DQFVVTDVE

SEQ ID NO: 160517 - protein, 9 aa, Homo Sapiens
KIRFCDIRS

SEQ ID NO: 160518 - protein, 9 aa, Homo Sapiens
TRYICPPVS

SEQ ID NO: 160519 - protein, 9 aa, Homo Sapiens
QDILRDVGD

SEQ ID NO: 160520 - protein, 9 aa, Homo Sapiens
RLTGRRPRA

SEQ ID NO: 160521 - protein, 9 aa, Homo Sapiens
SSNAGPGLL

SEQ ID NO: 160522 - protein, 9 aa, Homo Sapiens
VCCMHLHEK

SEQ ID NO: 160523 - protein, 9 aa, Homo Sapiens
PFPNLLPHQ

SEQ ID NO: 160524 - protein, 9 aa, Homo Sapiens
YEKGPSTFR

SEQ ID NO: 160525 - protein, 9 aa, Homo Sapiens
GTSRVPRSS

SEQ ID NO: 160526 - protein, 9 aa, Homo Sapiens
LAVCPDLVD

SEQ ID NO: 160527 - protein, 9 aa, Homo Sapiens
TSRSSRSVL

SEQ ID NO: 160528 - protein, 9 aa, Homo Sapiens
YMIRFIENV

SEQ ID NO: 160529 - protein, 9 aa, Homo Sapiens
IIVNQKAAL

SEQ ID NO: 160530 - protein, 9 aa, Homo Sapiens
TSKAKASST

SEQ ID NO: 160531 - protein, 9 aa, Homo Sapiens
SLDLVFLSM

SEQ ID NO: 160532 - protein, 9 aa, Homo Sapiens
EETEQKRCL

SEQ ID NO: 160533 - protein, 9 aa, Homo Sapiens
WLMTAMWLS

SEQ ID NO: 160534 - protein, 9 aa, Homo Sapiens
STFRDVAIE

SEQ ID NO: 160535 - protein, 9 aa, Homo Sapiens
QPPLLVFPP

SEQ ID NO: 160536 - protein, 9 aa, Homo Sapiens
FCARWQSWR

SEQ ID NO: 160537 - protein, 9 aa, Homo Sapiens
NHHMGSPRR

SEQ ID NO: 160538 - protein, 9 aa, Homo Sapiens
GPDEADTLC

SEQ ID NO: 160539 - protein, 9 aa, Homo Sapiens
ETHRERAFD

SEQ ID NO: 160540 - protein, 9 aa, Homo Sapiens
ISQHGDSLL

SEQ ID NO: 160541 - protein, 9 aa, Homo Sapiens
TAMNRASME

SEQ ID NO: 160542 - protein, 9 aa, Homo Sapiens
LNKVRKKQK

SEQ ID NO: 160543 - protein, 9 aa, Homo Sapiens
MVRVPSSVG

SEQ ID NO: 160544 - protein, 9 aa, Homo Sapiens
LELKEREMC

SEQ ID NO: 160545 - protein, 9 aa, Homo Sapiens
TKLNKVRKK

SEQ ID NO: 160546 - protein, 9 aa, Homo Sapiens
LSSAVANVV

SEQ ID NO: 160547 - protein, 9 aa, Homo Sapiens
ITASLAAGL

SEQ ID NO: 160548 - protein, 9 aa, Homo Sapiens
HVLFVCQVP

SEQ ID NO: 160549 - protein, 9 aa, Homo Sapiens
VPKNHHMGS

SEQ ID NO: 160550 - protein, 9 aa, Homo Sapiens
HISPGTKDN

SEQ ID NO: 160551 - protein, 9 aa, Homo Sapiens
YSGSVTQHL

SEQ ID NO: 160552 - protein, 9 aa, Homo Sapiens
KAGDDLCQD

SEQ ID NO: 160553 - protein, 9 aa, Homo Sapiens
GDLKALANM

SEQ ID NO: 160554 - protein, 9 aa, Homo Sapiens
KLSPGERPS

SEQ ID NO: 160555 - protein, 9 aa, Homo Sapiens
LGDTPQPSL

SEQ ID NO: 160556 - protein, 9 aa, Homo Sapiens
QLAQLSWQL

SEQ ID NO: 160557 - protein, 9 aa, Homo Sapiens
VGTFIAPPV

SEQ ID NO: 160558 - protein, 9 aa, Homo Sapiens
ITCPDTVCL

SEQ ID NO: 160559 - protein, 9 aa, Homo Sapiens
RYLLAFLVD

SEQ ID NO: 160560 - protein, 9 aa, Homo Sapiens
AHCKLCLLG

SEQ ID NO: 160561 - protein, 9 aa, Homo Sapiens
LFLFTFLFL

SEQ ID NO: 160562 - protein, 9 aa, Homo Sapiens
LSDSTKQEL

SEQ ID NO: 160563 - protein, 9 aa, Homo Sapiens
LIMQGVLSD

SEQ ID NO: 160564 - protein, 9 aa, Homo Sapiens
VQCTNSRDG

SEQ ID NO: 160565 - protein, 9 aa, Homo Sapiens
DLLHVPYLK

SEQ ID NO: 160566 - protein, 9 aa, Homo Sapiens
RVPRSSRRT

SEQ ID NO: 160567 - protein, 9 aa, Homo Sapiens
TMSPAIAVM

SEQ ID NO: 160568 - protein, 9 aa, Homo Sapiens
PREPRHSTP

SEQ ID NO: 160569 - protein, 9 aa, Homo Sapiens
CVTPTRRRV

SEQ ID NO: 160570 - protein, 9 aa, Homo Sapiens
NGPPQPGTP

SEQ ID NO: 160571 - protein, 9 aa, Homo Sapiens
PSSSTLTST

SEQ ID NO: 160572 - protein, 9 aa, Homo Sapiens
YPVLQGTVD

SEQ ID NO: 160573 - protein, 9 aa, Homo Sapiens
PSLYLSTPS

SEQ ID NO: 160574 - protein, 9 aa, Homo Sapiens
GERKSMCVE

SEQ ID NO: 160575 - protein, 9 aa, Homo Sapiens
LSMFGHSVV

SEQ ID NO: 160576 - protein, 9 aa, Homo Sapiens
LHQDALVEE

SEQ ID NO: 160577 - protein, 9 aa, Homo Sapiens
CTPQSPPKN

SEQ ID NO: 160578 - protein, 9 aa, Homo Sapiens
VWTAATLRC

SEQ ID NO: 160579 - protein, 9 aa, Homo Sapiens
AFLLSSVFG

SEQ ID NO: 160580 - protein, 9 aa, Homo Sapiens
KQYAFLRCE

SEQ ID NO: 160581 - protein, 9 aa, Homo Sapiens
QGISEERIH

SEQ ID NO: 160582 - protein, 9 aa, Homo Sapiens
GGGRGQEEK

SEQ ID NO: 160583 - protein, 9 aa, Homo Sapiens
EGVYVYDLY

SEQ ID NO: 160584 - protein, 9 aa, Homo Sapiens
TAMWLSASH

SEQ ID NO: 160585 - protein, 9 aa, Homo Sapiens
PRTTRATSG

SEQ ID NO: 160586 - protein, 9 aa, Homo Sapiens
LHVPYLKIL

SEQ ID NO: 160587 - protein, 9 aa, Homo Sapiens
AAKLQRNPT

SEQ ID NO: 160588 - protein, 9 aa, Homo Sapiens
PLGLLQFVD

SEQ ID NO: 160589 - protein, 9 aa, Homo Sapiens
CIDEPSQCY

SEQ ID NO: 160590 - protein, 9 aa, Homo Sapiens
IKGQQRTKY

SEQ ID NO: 160591 - protein, 9 aa, Homo Sapiens
GGCDGMEAM

SEQ ID NO: 160592 - protein, 9 aa, Homo Sapiens
TEHRRQRRL

SEQ ID NO: 160593 - protein, 9 aa, Homo Sapiens
KLLPYFIQL

SEQ ID NO: 160594 - protein, 9 aa, Homo Sapiens
DIKGQQRTK

SEQ ID NO: 160595 - protein, 9 aa, Homo Sapiens
AIAYKAGLF

SEQ ID NO: 160596 - protein, 9 aa, Homo Sapiens
VWQVCDFKQ

SEQ ID NO: 160597 - protein, 9 aa, Homo Sapiens
TANYIQLPK

SEQ ID NO: 160598 - protein, 9 aa, Homo Sapiens
IEKTIEDIV

SEQ ID NO: 160599 - protein, 9 aa, Homo Sapiens
YEAIRKAFC

SEQ ID NO: 160600 - protein, 9 aa, Homo Sapiens
AKAFSFVKD

SEQ ID NO: 160601 - protein, 9 aa, Homo Sapiens
GDDLCQDML

SEQ ID NO: 160602 - protein, 9 aa, Homo Sapiens
QRLKLEQEI

SEQ ID NO: 160603 - protein, 9 aa, Homo Sapiens
KELACRFAL

SEQ ID NO: 160604 - protein, 9 aa, Homo Sapiens
LAQLSWQLS

SEQ ID NO: 160605 - protein, 9 aa, Homo Sapiens
VQPMAKAGR

SEQ ID NO: 160606 - protein, 9 aa, Homo Sapiens
EVFGTFRIP

SEQ ID NO: 160607 - protein, 9 aa, Homo Sapiens
EPIRNAVKE

SEQ ID NO: 160608 - protein, 9 aa, Homo Sapiens
LLFQIRVFI

SEQ ID NO: 160609 - protein, 9 aa, Homo Sapiens
LLKQYLDVS

SEQ ID NO: 160610 - protein, 9 aa, Homo Sapiens
EERREVWVS

SEQ ID NO: 160611 - protein, 9 aa, Homo Sapiens
YVCAICLDE

SEQ ID NO: 160612 - protein, 9 aa, Homo Sapiens
AFLVDDLGG

SEQ ID NO: 160613 - protein, 9 aa, Homo Sapiens
RSWVALRET

SEQ ID NO: 160614 - protein, 9 aa, Homo Sapiens
LLPPPSPLP

SEQ ID NO: 160615 - protein, 9 aa, Homo Sapiens
LYKQYAFLR

SEQ ID NO: 160616 - protein, 9 aa, Homo Sapiens
ALERVVRCC

SEQ ID NO: 160617 - protein, 9 aa, Homo Sapiens
KVAYPAYER

SEQ ID NO: 160618 - protein, 9 aa, Homo Sapiens
HFTTGRLMT

SEQ ID NO: 160619 - protein, 9 aa, Homo Sapiens
GSSRATGLP

SEQ ID NO: 160620 - protein, 9 aa, Homo Sapiens
QHLSHRANN

SEQ ID NO: 160621 - protein, 9 aa, Homo Sapiens
PAIAVMQPI

SEQ ID NO: 160622 - protein, 9 aa, Homo Sapiens
ATPSPGPGP

SEQ ID NO: 160623 - protein, 9 aa, Homo Sapiens
GSQRPGRRS

SEQ ID NO: 160624 - protein, 9 aa, Homo Sapiens
SVPSAPWRA

SEQ ID NO: 160625 - protein, 9 aa, Homo Sapiens
STTTRFDSV

SEQ ID NO: 160626 - protein, 9 aa, Homo Sapiens
APGQAYDAG

SEQ ID NO: 160627 - protein, 9 aa, Homo Sapiens
MLLLLPPPS

SEQ ID NO: 160628 - protein, 9 aa, Homo Sapiens
EMQLEEQKH

SEQ ID NO: 160629 - protein, 9 aa, Homo Sapiens
QQRLGSWRG

SEQ ID NO: 160630 - protein, 9 aa, Homo Sapiens
HMGSPRRCP

SEQ ID NO: 160631 - protein, 9 aa, Homo Sapiens
VHPPAGPFW

SEQ ID NO: 160632 - protein, 9 aa, Homo Sapiens
NGPELEPDE

SEQ ID NO: 160633 - protein, 9 aa, Homo Sapiens
RKKQKTDLM

SEQ ID NO: 160634 - protein, 9 aa, Homo Sapiens
QMGPTEQDP

SEQ ID NO: 160635 - protein, 9 aa, Homo Sapiens
GTVDVCLDG

SEQ ID NO: 160636 - protein, 9 aa, Homo Sapiens
GAAHGIVAT

SEQ ID NO: 160637 - protein, 9 aa, Homo Sapiens
HNASSGHLL

SEQ ID NO: 160638 - protein, 9 aa, Homo Sapiens
QVVSAGTYP

SEQ ID NO: 160639 - protein, 9 aa, Homo Sapiens
KPRENCRKP

SEQ ID NO: 160640 - protein, 9 aa, Homo Sapiens
PGVLGSLHA

SEQ ID NO: 160641 - protein, 9 aa, Homo Sapiens
VHANVDRWD

SEQ ID NO: 160642 - protein, 9 aa, Homo Sapiens
WTGWPIPWV

SEQ ID NO: 160643 - protein, 9 aa, Homo Sapiens
LKLPSVQQK

SEQ ID NO: 160644 - protein, 9 aa, Homo Sapiens
TYELKKKTY

SEQ ID NO: 160645 - protein, 9 aa, Homo Sapiens
GEVIFTRDQ

SEQ ID NO: 160646 - protein, 9 aa, Homo Sapiens
VIHCAHSFY

SEQ ID NO: 160647 - protein, 9 aa, Homo Sapiens
LVKMECWPS

SEQ ID NO: 160648 - protein, 9 aa, Homo Sapiens
LRCPAVPAA

SEQ ID NO: 160649 - protein, 9 aa, Homo Sapiens
ETPSTASSR

SEQ ID NO: 160650 - protein, 9 aa, Homo Sapiens
EAEKVNCIC

SEQ ID NO: 160651 - protein, 9 aa, Homo Sapiens
NRASMEITS

SEQ ID NO: 160652 - protein, 9 aa, Homo Sapiens
ASRRHPLSH

SEQ ID NO: 160653 - protein, 9 aa, Homo Sapiens
GSWRGSFCA

SEQ ID NO: 160654 - protein, 9 aa, Homo Sapiens
YECKECGVA

SEQ ID NO: 160655 - protein, 9 aa, Homo Sapiens
GIGLNGPEL

SEQ ID NO: 160656 - protein, 9 aa, Homo Sapiens
QTYGDVATG

SEQ ID NO: 160657 - protein, 9 aa, Homo Sapiens
KLQRNPTSR

SEQ ID NO: 160658 - protein, 9 aa, Homo Sapiens
FILWRGQTS

SEQ ID NO: 160659 - protein, 9 aa, Homo Sapiens
ENEAEALHG

SEQ ID NO: 160660 - protein, 9 aa, Homo Sapiens
IGLNGPELE

SEQ ID NO: 160661 - protein, 9 aa, Homo Sapiens
AVANVVFTQ

SEQ ID NO: 160662 - protein, 9 aa, Homo Sapiens
LIALELEAS

SEQ ID NO: 160663 - protein, 9 aa, Homo Sapiens
LQQRLGSWR

SEQ ID NO: 160664 - protein, 9 aa, Homo Sapiens
DHLGLSDLE

SEQ ID NO: 160665 - protein, 9 aa, Homo Sapiens
LSTLSQPPP

SEQ ID NO: 160666 - protein, 9 aa, Homo Sapiens
AVWAYNGEN

SEQ ID NO: 160667 - protein, 9 aa, Homo Sapiens
GGRWSASAR

SEQ ID NO: 160668 - protein, 9 aa, Homo Sapiens
VPSAPWRAS

SEQ ID NO: 160669 - protein, 9 aa, Homo Sapiens
FYTLRTQAI

SEQ ID NO: 160670 - protein, 9 aa, Homo Sapiens
IRFCDIRSE

SEQ ID NO: 160671 - protein, 9 aa, Homo Sapiens
TVLIPCFPN

SEQ ID NO: 160672 - protein, 9 aa, Homo Sapiens
HVPYLKILL

SEQ ID NO: 160673 - protein, 9 aa, Homo Sapiens
LPVPKWTEL

SEQ ID NO: 160674 - protein, 9 aa, Homo Sapiens
PTFPQLTSS

SEQ ID NO: 160675 - protein, 9 aa, Homo Sapiens
LRETPAPRR

SEQ ID NO: 160676 - protein, 9 aa, Homo Sapiens
SRYLLAFLV

SEQ ID NO: 160677 - protein, 9 aa, Homo Sapiens
IRGEMALHM

SEQ ID NO: 160678 - protein, 9 aa, Homo Sapiens
GQSGPGGAA

SEQ ID NO: 160679 - protein, 9 aa, Homo Sapiens
DLYLEGAGW

SEQ ID NO: 160680 - protein, 9 aa, Homo Sapiens
NKVRKKQKT

SEQ ID NO: 160681 - protein, 9 aa, Homo Sapiens
IRSLQHFTT

SEQ ID NO: 160682 - protein, 9 aa, Homo Sapiens
RATPGSSRA

SEQ ID NO: 160683 - protein, 9 aa, Homo Sapiens
TDITHPHEF

SEQ ID NO: 160684 - protein, 9 aa, Homo Sapiens
RAGGSQRPG

SEQ ID NO: 160685 - protein, 9 aa, Homo Sapiens
LLSTLSQPP

SEQ ID NO: 160686 - protein, 9 aa, Homo Sapiens
GEMSSPQRI

SEQ ID NO: 160687 - protein, 9 aa, Homo Sapiens
LGSSDSPPS

SEQ ID NO: 160688 - protein, 9 aa, Homo Sapiens
FGIQNGKCP

SEQ ID NO: 160689 - protein, 9 aa, Homo Sapiens
VKIYFYERA

SEQ ID NO: 160690 - protein, 9 aa, Homo Sapiens
LGPVGPAPH

SEQ ID NO: 160691 - protein, 9 aa, Homo Sapiens
NKVIKKSRF

SEQ ID NO: 160692 - protein, 9 aa, Homo Sapiens
YVDPSGGDH

SEQ ID NO: 160693 - protein, 9 aa, Homo Sapiens
EKAFYTLRT

SEQ ID NO: 160694 - protein, 9 aa, Homo Sapiens
FPNLLPHQP

SEQ ID NO: 160695 - protein, 9 aa, Homo Sapiens
QLYYPCEHM

SEQ ID NO: 160696 - protein, 9 aa, Homo Sapiens
KGDQYVCAI

SEQ ID NO: 160697 - protein, 9 aa, Homo Sapiens
AIPKPAIYN

SEQ ID NO: 160698 - protein, 9 aa, Homo Sapiens
AKLQRNPTS

SEQ ID NO: 160699 - protein, 9 aa, Homo Sapiens
QKNSVQTTQ

SEQ ID NO: 160700 - protein, 9 aa, Homo Sapiens
RDHHQQPGE

SEQ ID NO: 160701 - protein, 9 aa, Homo Sapiens
LTSTPSTWP

SEQ ID NO: 160702 - protein, 9 aa, Homo Sapiens
ILPLTQEFG

SEQ ID NO: 160703 - protein, 9 aa, Homo Sapiens
YVIGVAWAA

SEQ ID NO: 160704 - protein, 9 aa, Homo Sapiens
LKTGQMHPV

SEQ ID NO: 160705 - protein, 9 aa, Homo Sapiens
RFDSVSSFE

SEQ ID NO: 160706 - protein, 9 aa, Homo Sapiens
LLLIQGAPG

SEQ ID NO: 160707 - protein, 9 aa, Homo Sapiens
DSTMIEKLR

SEQ ID NO: 160708 - protein, 9 aa, Homo Sapiens
QRVQLPGGT

SEQ ID NO: 160709 - protein, 9 aa, Homo Sapiens
MECWPSTQE

SEQ ID NO: 160710 - protein, 9 aa, Homo Sapiens
LYMWSFCFS

SEQ ID NO: 160711 - protein, 9 aa, Homo Sapiens
PTEQDPYAK

SEQ ID NO: 160712 - protein, 9 aa, Homo Sapiens
TPFPALLAQ

SEQ ID NO: 160713 - protein, 9 aa, Homo Sapiens
DEVDEFLGC

SEQ ID NO: 160714 - protein, 9 aa, Homo Sapiens
REPRHSTPA

SEQ ID NO: 160715 - protein, 9 aa, Homo Sapiens
SFKEQLESK

SEQ ID NO: 160716 - protein, 9 aa, Homo Sapiens
VKMECWPST

SEQ ID NO: 160717 - protein, 9 aa, Homo Sapiens
YVLEQQHIG

SEQ ID NO: 160718 - protein, 9 aa, Homo Sapiens
TPIATMLRG

SEQ ID NO: 160719 - protein, 9 aa, Homo Sapiens
VFGTFRIPF

SEQ ID NO: 160720 - protein, 9 aa, Homo Sapiens
YCVTWDRHS

SEQ ID NO: 160721 - protein, 9 aa, Homo Sapiens
EVDGVVATD

SEQ ID NO: 160722 - protein, 9 aa, Homo Sapiens
TLCHPLEVG

SEQ ID NO: 160723 - protein, 9 aa, Homo Sapiens
LCQDMLVLQ

SEQ ID NO: 160724 - protein, 9 aa, Homo Sapiens
VQEFEAFVA

SEQ ID NO: 160725 - protein, 9 aa, Homo Sapiens
GLNGPELEP

SEQ ID NO: 160726 - protein, 9 aa, Homo Sapiens
LLHVPYLKI

SEQ ID NO: 160727 - protein, 9 aa, Homo Sapiens
RRCPHCLPT

SEQ ID NO: 160728 - protein, 9 aa, Homo Sapiens
KPYECKKCA

SEQ ID NO: 160729 - protein, 9 aa, Homo Sapiens
GGLPSDPRG

SEQ ID NO: 160730 - protein, 9 aa, Homo Sapiens
RCSPRAAPL

SEQ ID NO: 160731 - protein, 9 aa, Homo Sapiens
LQGKKSSVI

SEQ ID NO: 160732 - protein, 9 aa, Homo Sapiens
AAIRQCPDQ

SEQ ID NO: 160733 - protein, 9 aa, Homo Sapiens
ALLDPNWLC

SEQ ID NO: 160734 - protein, 9 aa, Homo Sapiens
TINVKIFQK

SEQ ID NO: 160735 - protein, 9 aa, Homo Sapiens
EAEALHGEI

SEQ ID NO: 160736 - protein, 9 aa, Homo Sapiens
LAYEKSRMT

SEQ ID NO: 160737 - protein, 9 aa, Homo Sapiens
QEQLAQLSW

SEQ ID NO: 160738 - protein, 9 aa, Homo Sapiens
AGGSQRPGR

SEQ ID NO: 160739 - protein, 9 aa, Homo Sapiens
SLAHLLLRH

SEQ ID NO: 160740 - protein, 9 aa, Homo Sapiens
GSVSTANYI

SEQ ID NO: 160741 - protein, 9 aa, Homo Sapiens
RWQSWRTRS

SEQ ID NO: 160742 - protein, 9 aa, Homo Sapiens
NEAQVNPEC

SEQ ID NO: 160743 - protein, 9 aa, Homo Sapiens
WSLCSLDLV

SEQ ID NO: 160744 - protein, 9 aa, Homo Sapiens
ERNVTAKMA

SEQ ID NO: 160745 - protein, 9 aa, Homo Sapiens
LPGGTSLLL

SEQ ID NO: 160746 - protein, 9 aa, Homo Sapiens
LLGGRWSAS

SEQ ID NO: 160747 - protein, 9 aa, Homo Sapiens
NWLCPPCRG

SEQ ID NO: 160748 - protein, 9 aa, Homo Sapiens
ERGQRVQLP

SEQ ID NO: 160749 - protein, 9 aa, Homo Sapiens
GVYYCVTWD

SEQ ID NO: 160750 - protein, 9 aa, Homo Sapiens
TGLFLFTFL

SEQ ID NO: 160751 - protein, 9 aa, Homo Sapiens
RKAFCVWES

SEQ ID NO: 160752 - protein, 9 aa, Homo Sapiens
WPSSSTLTS

SEQ ID NO: 160753 - protein, 9 aa, Homo Sapiens
QLTSSPHSM

SEQ ID NO: 160754 - protein, 9 aa, Homo Sapiens
FFLQHVDRA

SEQ ID NO: 160755 - protein, 9 aa, Homo Sapiens
EGETPSTAS

SEQ ID NO: 160756 - protein, 9 aa, Homo Sapiens
HGPLTADST

SEQ ID NO: 160757 - protein, 9 aa, Homo Sapiens
KAGLFFRYP

SEQ ID NO: 160758 - protein, 9 aa, Homo Sapiens
SSAVANVVF

SEQ ID NO: 160759 - protein, 9 aa, Homo Sapiens
TLMKTLQRD

SEQ ID NO: 160760 - protein, 9 aa, Homo Sapiens
IYTGLFLFT

SEQ ID NO: 160761 - protein, 9 aa, Homo Sapiens
NPTSRSSRS

SEQ ID NO: 160762 - protein, 9 aa, Homo Sapiens
LLAFLVDDL

SEQ ID NO: 160763 - protein, 9 aa, Homo Sapiens
RRHPLSHTA

SEQ ID NO: 160764 - protein, 9 aa, Homo Sapiens
TVETCWRPL

SEQ ID NO: 160765 - protein, 9 aa, Homo Sapiens
IATMLRGQS

SEQ ID NO: 160766 - protein, 9 aa, Homo Sapiens
SVHVLFVCQ

SEQ ID NO: 160767 - protein, 9 aa, Homo Sapiens
FERLSDSTK

SEQ ID NO: 160768 - protein, 9 aa, Homo Sapiens
SLITLLRNA

SEQ ID NO: 160769 - protein, 9 aa, Homo Sapiens
SGCDSAERG

SEQ ID NO: 160770 - protein, 9 aa, Homo Sapiens
ISFVPESPG

SEQ ID NO: 160771 - protein, 9 aa, Homo Sapiens
SPGFVPLGW

SEQ ID NO: 160772 - protein, 9 aa, Homo Sapiens
HSVVWQAIK

SEQ ID NO: 160773 - protein, 9 aa, Homo Sapiens
TPASRATPG

SEQ ID NO: 160774 - protein, 9 aa, Homo Sapiens
SRATPGSSR

SEQ ID NO: 160775 - protein, 9 aa, Homo Sapiens
QSLVIPLNK

SEQ ID NO: 160776 - protein, 9 aa, Homo Sapiens
RHLSKPPLV

SEQ ID NO: 160777 - protein, 9 aa, Homo Sapiens
SSTCAQRWK

SEQ ID NO: 160778 - protein, 9 aa, Homo Sapiens
FFPHSHYSD

SEQ ID NO: 160779 - protein, 9 aa, Homo Sapiens
WQAIKLLPY

SEQ ID NO: 160780 - protein, 9 aa, Homo Sapiens
PPPPCRSFP

SEQ ID NO: 160781 - protein, 9 aa, Homo Sapiens
VAHTSVLTY

SEQ ID NO: 160782 - protein, 9 aa, Homo Sapiens
LAYTRSHKL

SEQ ID NO: 160783 - protein, 9 aa, Homo Sapiens
KIYFYERAK

SEQ ID NO: 160784 - protein, 9 aa, Homo Sapiens
FIGAGESTA

SEQ ID NO: 160785 - protein, 9 aa, Homo Sapiens
VTPTRRRVH

SEQ ID NO: 160786 - protein, 9 aa, Homo Sapiens
EKDADVILA

SEQ ID NO: 160787 - protein, 9 aa, Homo Sapiens
PATPPRTTR

SEQ ID NO: 160788 - protein, 9 aa, Homo Sapiens
RASMEITSS

SEQ ID NO: 160789 - protein, 9 aa, Homo Sapiens
VCEGGQVLQ

SEQ ID NO: 160790 - protein, 9 aa, Homo Sapiens
VSPYSLLDI

SEQ ID NO: 160791 - protein, 9 aa, Homo Sapiens
TRSLVLRFK

SEQ ID NO: 160792 - protein, 9 aa, Homo Sapiens
HCLPTSLWS

SEQ ID NO: 160793 - protein, 9 aa, Homo Sapiens
RSDGEFFPH

SEQ ID NO: 160794 - protein, 9 aa, Homo Sapiens
TTTAPPLSG

SEQ ID NO: 160795 - protein, 9 aa, Homo Sapiens
VPKWTELAL

SEQ ID NO: 160796 - protein, 9 aa, Homo Sapiens
RLGDYVARV

SEQ ID NO: 160797 - protein, 9 aa, Homo Sapiens
VLATLCHPL

SEQ ID NO: 160798 - protein, 9 aa, Homo Sapiens
IEEKVAYPA

SEQ ID NO: 160799 - protein, 9 aa, Homo Sapiens
YRFGIQNGK

SEQ ID NO: 160800 - protein, 9 aa, Homo Sapiens
NPLWCDCQA

SEQ ID NO: 160801 - protein, 9 aa, Homo Sapiens
NQSAGSKWS

SEQ ID NO: 160802 - protein, 9 aa, Homo Sapiens
PVPPCGDSS

SEQ ID NO: 160803 - protein, 9 aa, Homo Sapiens
LAHLLLRHG

SEQ ID NO: 160804 - protein, 9 aa, Homo Sapiens
HTSTVCCMH

SEQ ID NO: 160805 - protein, 9 aa, Homo Sapiens
RWFILWRGQ

SEQ ID NO: 160806 - protein, 9 aa, Homo Sapiens
EEKDGDEFQ

SEQ ID NO: 160807 - protein, 9 aa, Homo Sapiens
HRPPGGGRG

SEQ ID NO: 160808 - protein, 9 aa, Homo Sapiens
PGGTSLLLI

SEQ ID NO: 160809 - protein, 9 aa, Homo Sapiens
EKGPSTFRD

SEQ ID NO: 160810 - protein, 9 aa, Homo Sapiens
MNQGISEER

SEQ ID NO: 160811 - protein, 9 aa, Homo Sapiens
IFWAAGPDE

SEQ ID NO: 160812 - protein, 9 aa, Homo Sapiens
TCAQRWKLS

SEQ ID NO: 160813 - protein, 9 aa, Homo Sapiens
GDVRKKARD

SEQ ID NO: 160814 - protein, 9 aa, Homo Sapiens
LCSLDLVFL

SEQ ID NO: 160815 - protein, 9 aa, Homo Sapiens
TPSSSPTVK

SEQ ID NO: 160816 - protein, 9 aa, Homo Sapiens
PQYPVLQGT

SEQ ID NO: 160817 - protein, 9 aa, Homo Sapiens
PPPGLPHPC

SEQ ID NO: 160818 - protein, 9 aa, Homo Sapiens
MAAGATPSP

SEQ ID NO: 160819 - protein, 9 aa, Homo Sapiens
SNNGRGEDD

SEQ ID NO: 160820 - protein, 9 aa, Homo Sapiens
THMQGFPLG

SEQ ID NO: 160821 - protein, 9 aa, Homo Sapiens
ELDILETIM

SEQ ID NO: 160822 - protein, 9 aa, Homo Sapiens
TADSTTEAR

SEQ ID NO: 160823 - protein, 9 aa, Homo Sapiens
QDNGEDSLR

SEQ ID NO: 160824 - protein, 9 aa, Homo Sapiens
VALRETPAP

SEQ ID NO: 160825 - protein, 9 aa, Homo Sapiens
IRNAVKERE

SEQ ID NO: 160826 - protein, 9 aa, Homo Sapiens
HASHSLAHL

SEQ ID NO: 160827 - protein, 9 aa, Homo Sapiens
IFTRDQHIR

SEQ ID NO: 160828 - protein, 9 aa, Homo Sapiens
QVFLVVFLY

SEQ ID NO: 160829 - protein, 9 aa, Homo Sapiens
CSREENIGQ

SEQ ID NO: 160830 - protein, 9 aa, Homo Sapiens
FISAFMVRV

SEQ ID NO: 160831 - protein, 9 aa, Homo Sapiens
IYNQLCYKK

SEQ ID NO: 160832 - protein, 9 aa, Homo Sapiens
IIQATDGSH

SEQ ID NO: 160833 - protein, 9 aa, Homo Sapiens
DMCKKMFEA

SEQ ID NO: 160834 - protein, 9 aa, Homo Sapiens
NILGVRRNN

SEQ ID NO: 160835 - protein, 9 aa, Homo Sapiens
PGTPSSSPT

SEQ ID NO: 160836 - protein, 9 aa, Homo Sapiens
PYECKKCAK

SEQ ID NO: 160837 - protein, 9 aa, Homo Sapiens
DVVEEVEKY

SEQ ID NO: 160838 - protein, 9 aa, Homo Sapiens
CKECGVAFS

SEQ ID NO: 160839 - protein, 9 aa, Homo Sapiens
CGGGQTPAS

SEQ ID NO: 160840 - protein, 9 aa, Homo Sapiens
GLRPRKVAH

SEQ ID NO: 160841 - protein, 9 aa, Homo Sapiens
RLPLSFMLD

SEQ ID NO: 160842 - protein, 9 aa, Homo Sapiens
VDIPKQEKT

SEQ ID NO: 160843 - protein, 9 aa, Homo Sapiens
QGTVDVCLD

SEQ ID NO: 160844 - protein, 9 aa, Homo Sapiens
GPLTADSTT

SEQ ID NO: 160845 - protein, 9 aa, Homo Sapiens
TDKLSPGER

SEQ ID NO: 160846 - protein, 9 aa, Homo Sapiens
LSASHFTTL

SEQ ID NO: 160847 - protein, 9 aa, Homo Sapiens
ATYYRFGIQ

SEQ ID NO: 160848 - protein, 9 aa, Homo Sapiens
IKKDAELKA

SEQ ID NO: 160849 - protein, 9 aa, Homo Sapiens
KSLYNLSVT

SEQ ID NO: 160850 - protein, 9 aa, Homo Sapiens
YFDTETYNT

SEQ ID NO: 160851 - protein, 9 aa, Homo Sapiens
PYFIQLSHP

SEQ ID NO: 160852 - protein, 9 aa, Homo Sapiens
RRMRASRRH

SEQ ID NO: 160853 - protein, 9 aa, Homo Sapiens
VDEFLGCAI

SEQ ID NO: 160854 - protein, 9 aa, Homo Sapiens
YVTLKRRLA

SEQ ID NO: 160855 - protein, 9 aa, Homo Sapiens
TGGEALNSD

SEQ ID NO: 160856 - protein, 9 aa, Homo Sapiens
AAVKIRKEN

SEQ ID NO: 160857 - protein, 9 aa, Homo Sapiens
DEFTHDLFR

SEQ ID NO: 160858 - protein, 9 aa, Homo Sapiens
FYEKGPSTF

SEQ ID NO: 160859 - protein, 9 aa, Homo Sapiens
LHGEIQSLK

SEQ ID NO: 160860 - protein, 9 aa, Homo Sapiens
LWWASVPSA

SEQ ID NO: 160861 - protein, 9 aa, Homo Sapiens
RLAFHRHPV

SEQ ID NO: 160862 - protein, 9 aa, Homo Sapiens
EADTLCIGG

SEQ ID NO: 160863 - protein, 9 aa, Homo Sapiens
GPSTFRDVA

SEQ ID NO: 160864 - protein, 9 aa, Homo Sapiens
GHNASSGHL

SEQ ID NO: 160865 - protein, 9 aa, Homo Sapiens
VLQGTVDVC

SEQ ID NO: 160866 - protein, 9 aa, Homo Sapiens
CDIRSESIV

SEQ ID NO: 160867 - protein, 9 aa, Homo Sapiens
TKQELMDFK

SEQ ID NO: 160868 - protein, 9 aa, Homo Sapiens
NGPPPTVVP

SEQ ID NO: 160869 - protein, 9 aa, Homo Sapiens
ITHPHEFDF

SEQ ID NO: 160870 - protein, 9 aa, Homo Sapiens
PSSSTPASR

SEQ ID NO: 160871 - protein, 9 aa, Homo Sapiens
QMHPVPANH

SEQ ID NO: 160872 - protein, 9 aa, Homo Sapiens
TRARKGREE

SEQ ID NO: 160873 - protein, 9 aa, Homo Sapiens
GPPRRRPAT

SEQ ID NO: 160874 - protein, 9 aa, Homo Sapiens
KVIVLAIAN

SEQ ID NO: 160875 - protein, 9 aa, Homo Sapiens
VHGQSLTGA

SEQ ID NO: 160876 - protein, 9 aa, Homo Sapiens
ALAAKLQRN

SEQ ID NO: 160877 - protein, 9 aa, Homo Sapiens
RAGALMMLV

SEQ ID NO: 160878 - protein, 9 aa, Homo Sapiens
RRNNIQIVS

SEQ ID NO: 160879 - protein, 9 aa, Homo Sapiens
QPQMQQILD

SEQ ID NO: 160880 - protein, 9 aa, Homo Sapiens
QDDTPFPAL

SEQ ID NO: 160881 - protein, 9 aa, Homo Sapiens
TGLPREPRH

SEQ ID NO: 160882 - protein, 9 aa, Homo Sapiens
YRIRGSVST

SEQ ID NO: 160883 - protein, 9 aa, Homo Sapiens
SCFQKNSVQ

SEQ ID NO: 160884 - protein, 9 aa, Homo Sapiens
VSVPKNHHM

SEQ ID NO: 160885 - protein, 9 aa, Homo Sapiens
EIVCTPQSP

SEQ ID NO: 160886 - protein, 9 aa, Homo Sapiens
KELQKKQLA

SEQ ID NO: 160887 - protein, 9 aa, Homo Sapiens
HQDALVEED

SEQ ID NO: 160888 - protein, 9 aa, Homo Sapiens
WKWEFIFMQ

SEQ ID NO: 160889 - protein, 9 aa, Homo Sapiens
AMNRASMEI

SEQ ID NO: 160890 - protein, 9 aa, Homo Sapiens
TCVVCHRSL

SEQ ID NO: 160891 - protein, 9 aa, Homo Sapiens
RNAIFCENT

SEQ ID NO: 160892 - protein, 9 aa, Homo Sapiens
LCPPCRGIC

SEQ ID NO: 160893 - protein, 9 aa, Homo Sapiens
PGPPRRRPA

SEQ ID NO: 160894 - protein, 9 aa, Homo Sapiens
DDIKKDAEL

SEQ ID NO: 160895 - protein, 9 aa, Homo Sapiens
GVPQKPGSE

SEQ ID NO: 160896 - protein, 9 aa, Homo Sapiens
VLGSLHAGG

SEQ ID NO: 160897 - protein, 9 aa, Homo Sapiens
PSAPWRASC

SEQ ID NO: 160898 - protein, 9 aa, Homo Sapiens
SHRSDGEFF

SEQ ID NO: 160899 - protein, 9 aa, Homo Sapiens
EDRQQLPVP

SEQ ID NO: 160900 - protein, 9 aa, Homo Sapiens
TCYSPKPSL

SEQ ID NO: 160901 - protein, 9 aa, Homo Sapiens
HLACVNCVW

SEQ ID NO: 160902 - protein, 9 aa, Homo Sapiens
KYQMSGLID

SEQ ID NO: 160903 - protein, 9 aa, Homo Sapiens
AKAHEGYAC

SEQ ID NO: 160904 - protein, 9 aa, Homo Sapiens
ERKSMCVER

SEQ ID NO: 160905 - protein, 9 aa, Homo Sapiens
SAAVSTTPH

SEQ ID NO: 160906 - protein, 9 aa, Homo Sapiens
PAAGGCDGM

SEQ ID NO: 160907 - protein, 9 aa, Homo Sapiens
SFSSNAGPG

SEQ ID NO: 160908 - protein, 9 aa, Homo Sapiens
RTPSSSTPA

SEQ ID NO: 160909 - protein, 9 aa, Homo Sapiens
WDVKCLQTH

SEQ ID NO: 160910 - protein, 9 aa, Homo Sapiens
RKGREERRE

SEQ ID NO: 160911 - protein, 9 aa, Homo Sapiens
PRENCRKPW

SEQ ID NO: 160912 - protein, 9 aa, Homo Sapiens
LSWAQKAAP

SEQ ID NO: 160913 - protein, 9 aa, Homo Sapiens
HSLSWAQKA

SEQ ID NO: 160914 - protein, 9 aa, Homo Sapiens
LNLRDIVQV

SEQ ID NO: 160915 - protein, 9 aa, Homo Sapiens
AAMTLSERF

SEQ ID NO: 160916 - protein, 9 aa, Homo Sapiens
SVSTANYIQ

SEQ ID NO: 160917 - protein, 9 aa, Homo Sapiens
NGRGEDDEE

SEQ ID NO: 160918 - protein, 9 aa, Homo Sapiens
LPGPCASLL

SEQ ID NO: 160919 - protein, 9 aa, Homo Sapiens
SPGGQEKKF

SEQ ID NO: 160920 - protein, 9 aa, Homo Sapiens
TLKRRLAVC

SEQ ID NO: 160921 - protein, 9 aa, Homo Sapiens
GAIGGAYEH

SEQ ID NO: 160922 - protein, 9 aa, Homo Sapiens
YELKKKTYC

SEQ ID NO: 160923 - protein, 9 aa, Homo Sapiens
GPPPTVVPS

SEQ ID NO: 160924 - protein, 9 aa, Homo Sapiens
RKKKPIVVS

SEQ ID NO: 160925 - protein, 9 aa, Homo Sapiens
AIQPQMQQI

SEQ ID NO: 160926 - protein, 9 aa, Homo Sapiens
NALHQDALV

SEQ ID NO: 160927 - protein, 9 aa, Homo Sapiens
TRFDSVSSF

SEQ ID NO: 160928 - protein, 9 aa, Homo Sapiens
HPPAGPFWI

SEQ ID NO: 160929 - protein, 9 aa, Homo Sapiens
RVSAEKLYF

SEQ ID NO: 160930 - protein, 9 aa, Homo Sapiens
QLSWQLSGR

SEQ ID NO: 160931 - protein, 9 aa, Homo Sapiens
YLKILLSKG

SEQ ID NO: 160932 - protein, 9 aa, Homo Sapiens
QGNPLWCDC

SEQ ID NO: 160933 - protein, 9 aa, Homo Sapiens
SRHLSKPPL

SEQ ID NO: 160934 - protein, 9 aa, Homo Sapiens
RWSASARLC

SEQ ID NO: 160935 - protein, 9 aa, Homo Sapiens
KDADVILAA

SEQ ID NO: 160936 - protein, 9 aa, Homo Sapiens
PQPLNLEIS

SEQ ID NO: 160937 - protein, 9 aa, Homo Sapiens
QAPSQVWTA

SEQ ID NO: 160938 - protein, 9 aa, Homo Sapiens
DKYQMSGLI

SEQ ID NO: 160939 - protein, 9 aa, Homo Sapiens
RWDIACQIF

SEQ ID NO: 160940 - protein, 9 aa, Homo Sapiens
LWGGVGGLP

SEQ ID NO: 160941 - protein, 9 aa, Homo Sapiens
RSPCCTMRP

SEQ ID NO: 160942 - protein, 9 aa, Homo Sapiens
SSLLAAVTL

SEQ ID NO: 160943 - protein, 9 aa, Homo Sapiens
RKDEMTDEE

SEQ ID NO: 160944 - protein, 9 aa, Homo Sapiens
STSKGGRCW

SEQ ID NO: 160945 - protein, 9 aa, Homo Sapiens
GHSVVWQAI

SEQ ID NO: 160946 - protein, 9 aa, Homo Sapiens
QPSLPGPCA

SEQ ID NO: 160947 - protein, 9 aa, Homo Sapiens
EAIRKAFCV

SEQ ID NO: 160948 - protein, 9 aa, Homo Sapiens
KKRRSKIEA

SEQ ID NO: 160949 - protein, 9 aa, Homo Sapiens
GEDDEEEDD

SEQ ID NO: 160950 - protein, 9 aa, Homo Sapiens
SLWGVPQKP

SEQ ID NO: 160951 - protein, 9 aa, Homo Sapiens
LKLEQEIEK

SEQ ID NO: 160952 - protein, 9 aa, Homo Sapiens
RDWFPGRKQ

SEQ ID NO: 160953 - protein, 9 aa, Homo Sapiens
TTYNMIDDS

SEQ ID NO: 160954 - protein, 9 aa, Homo Sapiens
TALFAKHHW

SEQ ID NO: 160955 - protein, 9 aa, Homo Sapiens
KSRMTSAVL

SEQ ID NO: 160956 - protein, 9 aa, Homo Sapiens
QIAEVEPPG

SEQ ID NO: 160957 - protein, 9 aa, Homo Sapiens
STVRVQPMA

SEQ ID NO: 160958 - protein, 9 aa, Homo Sapiens
HQPPLLVFP

SEQ ID NO: 160959 - protein, 9 aa, Homo Sapiens
QLGEQCWTV

SEQ ID NO: 160960 - protein, 9 aa, Homo Sapiens
TVRIRAVGL

SEQ ID NO: 160961 - protein, 9 aa, Homo Sapiens
EGPFDHMFQ

SEQ ID NO: 160962 - protein, 9 aa, Homo Sapiens
SESEATINV

SEQ ID NO: 160963 - protein, 9 aa, Homo Sapiens
TYNMIDDST

SEQ ID NO: 160964 - protein, 9 aa, Homo Sapiens
QDHLGLSDL

SEQ ID NO: 160965 - protein, 9 aa, Homo Sapiens
LRPRKVAHS

SEQ ID NO: 160966 - protein, 9 aa, Homo Sapiens
SPKPSLYLS

SEQ ID NO: 160967 - protein, 9 aa, Homo Sapiens
YDCEFREAS

SEQ ID NO: 160968 - protein, 9 aa, Homo Sapiens
VVATDFFTV

SEQ ID NO: 160969 - protein, 9 aa, Homo Sapiens
VQLPGGTSL

SEQ ID NO: 160970 - protein, 9 aa, Homo Sapiens
QLTRSQMLS

SEQ ID NO: 160971 - protein, 9 aa, Homo Sapiens
ACQKGCSFV

SEQ ID NO: 160972 - protein, 9 aa, Homo Sapiens
GQLLVLATL

SEQ ID NO: 160973 - protein, 9 aa, Homo Sapiens
WPIPWVKGA

SEQ ID NO: 160974 - protein, 9 aa, Homo Sapiens
LRDVEGEDS

SEQ ID NO: 160975 - protein, 9 aa, Homo Sapiens
KAVSEQQAD

SEQ ID NO: 160976 - protein, 9 aa, Homo Sapiens
EMCCQFSFR

SEQ ID NO: 160977 - protein, 9 aa, Homo Sapiens
GAQRDWFPG

SEQ ID NO: 160978 - protein, 9 aa, Homo Sapiens
FTTGRLMTR

SEQ ID NO: 160979 - protein, 9 aa, Homo Sapiens
KKMFEAEKV

SEQ ID NO: 160980 - protein, 9 aa, Homo Sapiens
PAIYNQLCY

SEQ ID NO: 160981 - protein, 9 aa, Homo Sapiens
RFQLTRSQM

SEQ ID NO: 160982 - protein, 9 aa, Homo Sapiens
EPLIIPTKV

SEQ ID NO: 160983 - protein, 9 aa, Homo Sapiens
QAIKLLPYF

SEQ ID NO: 160984 - protein, 9 aa, Homo Sapiens
QHGDSLLSN

SEQ ID NO: 160985 - protein, 9 aa, Homo Sapiens
KQLGPARSE

SEQ ID NO: 160986 - protein, 9 aa, Homo Sapiens
SSTPASRAT

SEQ ID NO: 160987 - protein, 9 aa, Homo Sapiens
FVLVNLEVT

SEQ ID NO: 160988 - protein, 9 aa, Homo Sapiens
LITLLRNAI

SEQ ID NO: 160989 - protein, 9 aa, Homo Sapiens
LLMLGLLIE

SEQ ID NO: 160990 - protein, 9 aa, Homo Sapiens
LERVVRCCT

SEQ ID NO: 160991 - protein, 9 aa, Homo Sapiens
RSLVLRFKV

SEQ ID NO: 160992 - protein, 9 aa, Homo Sapiens
RDKKRRSKI

SEQ ID NO: 160993 - protein, 9 aa, Homo Sapiens
IVVIDDGIF

SEQ ID NO: 160994 - protein, 9 aa, Homo Sapiens
EEEGPFDHM

SEQ ID NO: 160995 - protein, 9 aa, Homo Sapiens
GALPGSTRR

SEQ ID NO: 160996 - protein, 9 aa, Homo Sapiens
GSTSKGGRC

SEQ ID NO: 160997 - protein, 9 aa, Homo Sapiens
RQCPDQTYG

SEQ ID NO: 160998 - protein, 9 aa, Homo Sapiens
KTCRMKRNR

SEQ ID NO: 160999 - protein, 9 aa, Homo Sapiens
RMKRNRKEE

SEQ ID NO: 161000 - protein, 9 aa, Homo Sapiens
VYFFCTVHE

SEQ ID NO: 161001 - protein, 9 aa, Homo Sapiens
PKRFNLFPC

SEQ ID NO: 161002 - protein, 9 aa, Homo Sapiens
GPARSEKTV

SEQ ID NO: 161003 - protein, 9 aa, Homo Sapiens
ARSEKTVLF

SEQ ID NO: 161004 - protein, 9 aa, Homo Sapiens
SAERGQRVQ

SEQ ID NO: 161005 - protein, 9 aa, Homo Sapiens
DTNEKDADV

SEQ ID NO: 161006 - protein, 9 aa, Homo Sapiens
DSTKQELMD

SEQ ID NO: 161007 - protein, 9 aa, Homo Sapiens
SLVLRFKVL

SEQ ID NO: 161008 - protein, 9 aa, Homo Sapiens
ACRFALTFG

SEQ ID NO: 161009 - protein, 9 aa, Homo Sapiens
SGFQALDVH

SEQ ID NO: 161010 - protein, 9 aa, Homo Sapiens
ECEKAFRHS

SEQ ID NO: 161011 - protein, 9 aa, Homo Sapiens
LVPPEEQGL

SEQ ID NO: 161012 - protein, 9 aa, Homo Sapiens
ETEQKRCLE

SEQ ID NO: 161013 - protein, 9 aa, Homo Sapiens
KSLTKLNKV

SEQ ID NO: 161014 - protein, 9 aa, Homo Sapiens
IAAVILKIP

SEQ ID NO: 161015 - protein, 9 aa, Homo Sapiens
HPHRVAQTM

SEQ ID NO: 161016 - protein, 9 aa, Homo Sapiens
TPPVPPKKS

SEQ ID NO: 161017 - protein, 9 aa, Homo Sapiens
QLPVPKWTE

SEQ ID NO: 161018 - protein, 9 aa, Homo Sapiens
ACVNCVWWS

SEQ ID NO: 161019 - protein, 9 aa, Homo Sapiens
SWRTRSPCC

SEQ ID NO: 161020 - protein, 9 aa, Homo Sapiens
DTPFPALLA

SEQ ID NO: 161021 - protein, 9 aa, Homo Sapiens
EKLGAPRPT

SEQ ID NO: 161022 - protein, 9 aa, Homo Sapiens
ARWQSWRTR

SEQ ID NO: 161023 - protein, 9 aa, Homo Sapiens
CDGSLWRYR

SEQ ID NO: 161024 - protein, 9 aa, Homo Sapiens
RDVVVGRPS

SEQ ID NO: 161025 - protein, 9 aa, Homo Sapiens
CKLCLLGSS

SEQ ID NO: 161026 - protein, 9 aa, Homo Sapiens
FRIPFLLRI

SEQ ID NO: 161027 - protein, 9 aa, Homo Sapiens
WCGGGQTPA

SEQ ID NO: 161028 - protein, 9 aa, Homo Sapiens
VPPCGDSST

SEQ ID NO: 161029 - protein, 9 aa, Homo Sapiens
FFCQKSIID

SEQ ID NO: 161030 - protein, 9 aa, Homo Sapiens
GSSQECIKP

SEQ ID NO: 161031 - protein, 9 aa, Homo Sapiens
LQGAVQTNE

SEQ ID NO: 161032 - protein, 9 aa, Homo Sapiens
TYVAHTSVL

SEQ ID NO: 161033 - protein, 9 aa, Homo Sapiens
TALHLSSAV

SEQ ID NO: 161034 - protein, 9 aa, Homo Sapiens
VCTDKLSPG

SEQ ID NO: 161035 - protein, 9 aa, Homo Sapiens
EALNSDVRE

SEQ ID NO: 161036 - protein, 9 aa, Homo Sapiens
IRKAFCVWE

SEQ ID NO: 161037 - protein, 9 aa, Homo Sapiens
PHVHGQSLT

SEQ ID NO: 161038 - protein, 9 aa, Homo Sapiens
DEGLRPRKV

SEQ ID NO: 161039 - protein, 9 aa, Homo Sapiens
FPQCNCPIM

SEQ ID NO: 161040 - protein, 9 aa, Homo Sapiens
QCHSLSWAQ

SEQ ID NO: 161041 - protein, 9 aa, Homo Sapiens
EEWDVKCLQ

SEQ ID NO: 161042 - protein, 9 aa, Homo Sapiens
SSRATGLPR

SEQ ID NO: 161043 - protein, 9 aa, Homo Sapiens
ERRLPLSFM

SEQ ID NO: 161044 - protein, 9 aa, Homo Sapiens
FQIRVFIGA

SEQ ID NO: 161045 - protein, 9 aa, Homo Sapiens
LSQPPPQAP

SEQ ID NO: 161046 - protein, 9 aa, Homo Sapiens
FTHDLFRFL

SEQ ID NO: 161047 - protein, 9 aa, Homo Sapiens
PISPLKFSP

SEQ ID NO: 161048 - protein, 9 aa, Homo Sapiens
KSNVDTSGD

SEQ ID NO: 161049 - protein, 9 aa, Homo Sapiens
GVYILIRAG

SEQ ID NO: 161050 - protein, 9 aa, Homo Sapiens
QQTQELDIL

SEQ ID NO: 161051 - protein, 9 aa, Homo Sapiens
EPACLLPLA

SEQ ID NO: 161052 - protein, 9 aa, Homo Sapiens
FIGSSQECI

SEQ ID NO: 161053 - protein, 9 aa, Homo Sapiens
AAVAAAPGV

SEQ ID NO: 161054 - protein, 9 aa, Homo Sapiens
MCVCPPPPG

SEQ ID NO: 161055 - protein, 9 aa, Homo Sapiens
IAYKAGLFF

SEQ ID NO: 161056 - protein, 9 aa, Homo Sapiens
QKAAPHPTF

SEQ ID NO: 161057 - protein, 9 aa, Homo Sapiens
GLLIEVSEE

SEQ ID NO: 161058 - protein, 9 aa, Homo Sapiens
IGLPHPSVV

SEQ ID NO: 161059 - protein, 9 aa, Homo Sapiens
ASSTEATEH

SEQ ID NO: 161060 - protein, 9 aa, Homo Sapiens
IPKQEKTLM

SEQ ID NO: 161061 - protein, 9 aa, Homo Sapiens
AAVSTTPHI

SEQ ID NO: 161062 - protein, 9 aa, Homo Sapiens
QSWRTRSPC

SEQ ID NO: 161063 - protein, 9 aa, Homo Sapiens
STASSRPGT

SEQ ID NO: 161064 - protein, 9 aa, Homo Sapiens
TWPSSAASV

SEQ ID NO: 161065 - protein, 9 aa, Homo Sapiens
PHQPPLLVF

SEQ ID NO: 161066 - protein, 9 aa, Homo Sapiens
VVPSSPSVV

SEQ ID NO: 161067 - protein, 9 aa, Homo Sapiens
QLVPPEEQG

SEQ ID NO: 161068 - protein, 9 aa, Homo Sapiens
FDTETYNTL

SEQ ID NO: 161069 - protein, 9 aa, Homo Sapiens
DEEAIQPQM

SEQ ID NO: 161070 - protein, 9 aa, Homo Sapiens
PRRMRASRR

SEQ ID NO: 161071 - protein, 9 aa, Homo Sapiens
AQVNPECKN

SEQ ID NO: 161072 - protein, 9 aa, Homo Sapiens
KAPEGAWGA

SEQ ID NO: 161073 - protein, 9 aa, Homo Sapiens
VPEALPMPS

SEQ ID NO: 161074 - protein, 9 aa, Homo Sapiens
PTAMNRASM

SEQ ID NO: 161075 - protein, 9 aa, Homo Sapiens
YYCVTWDRH

SEQ ID NO: 161076 - protein, 9 aa, Homo Sapiens
FKSAAMTLS

SEQ ID NO: 161077 - protein, 9 aa, Homo Sapiens
CYSPKPSLY

SEQ ID NO: 161078 - protein, 9 aa, Homo Sapiens
AEKVNCICV

SEQ ID NO: 161079 - protein, 9 aa, Homo Sapiens
LCVIHCAHS

SEQ ID NO: 161080 - protein, 9 aa, Homo Sapiens
TSQLTMHQR

SEQ ID NO: 161081 - protein, 9 aa, Homo Sapiens
LIDNAIDWN

SEQ ID NO: 161082 - protein, 9 aa, Homo Sapiens
LMLGLLIEV

SEQ ID NO: 161083 - protein, 9 aa, Homo Sapiens
GNGPPQPGT

SEQ ID NO: 161084 - protein, 9 aa, Homo Sapiens
AKHHWLRCS

SEQ ID NO: 161085 - protein, 9 aa, Homo Sapiens
IPKPAIYNQ

SEQ ID NO: 161086 - protein, 9 aa, Homo Sapiens
AYFNSCPNA

SEQ ID NO: 161087 - protein, 9 aa, Homo Sapiens
AFMVRVPSS

SEQ ID NO: 161088 - protein, 9 aa, Homo Sapiens
DTETYNTLM

SEQ ID NO: 161089 - protein, 9 aa, Homo Sapiens
DKLSPGERP

SEQ ID NO: 161090 - protein, 9 aa, Homo Sapiens
STRRAGGSQ

SEQ ID NO: 161091 - protein, 9 aa, Homo Sapiens
LMLLLLPPP

SEQ ID NO: 161092 - protein, 9 aa, Homo Sapiens
SADVVEEVE

SEQ ID NO: 161093 - protein, 9 aa, Homo Sapiens
LFFCQKSII

SEQ ID NO: 161094 - protein, 9 aa, Homo Sapiens
LESSSFPLL

SEQ ID NO: 161095 - protein, 9 aa, Homo Sapiens
SFCFSPLWL

SEQ ID NO: 161096 - protein, 9 aa, Homo Sapiens
AMLVPVFLL

SEQ ID NO: 161097 - protein, 9 aa, Homo Sapiens
IWLPSNIYT

SEQ ID NO: 161098 - protein, 9 aa, Homo Sapiens
AHTSVLTYP

SEQ ID NO: 161099 - protein, 9 aa, Homo Sapiens
RPATPPRTT

SEQ ID NO: 161100 - protein, 9 aa, Homo Sapiens
AAAPGVLGS

SEQ ID NO: 161101 - protein, 9 aa, Homo Sapiens
CPPSPSRSS

SEQ ID NO: 161102 - protein, 9 aa, Homo Sapiens
SPPPPPPCR

SEQ ID NO: 161103 - protein, 9 aa, Homo Sapiens
SGSVTQHLS

SEQ ID NO: 161104 - protein, 9 aa, Homo Sapiens
ERSVCTDKL

SEQ ID NO: 161105 - protein, 9 aa, Homo Sapiens
GISEERIHL

SEQ ID NO: 161106 - protein, 9 aa, Homo Sapiens
CPAVPAAAC

SEQ ID NO: 161107 - protein, 9 aa, Homo Sapiens
GAGESTALF

SEQ ID NO: 161108 - protein, 9 aa, Homo Sapiens
VETCWRPLL

SEQ ID NO: 161109 - protein, 9 aa, Homo Sapiens
KRRSKIEAS

SEQ ID NO: 161110 - protein, 9 aa, Homo Sapiens
TLSERFTSY

SEQ ID NO: 161111 - protein, 9 aa, Homo Sapiens
EAAVKIRKE

SEQ ID NO: 161112 - protein, 9 aa, Homo Sapiens
TMIEKLRAI

SEQ ID NO: 161113 - protein, 9 aa, Homo Sapiens
FKAGDDLCQ

SEQ ID NO: 161114 - protein, 9 aa, Homo Sapiens
PVPKWTELA

SEQ ID NO: 161115 - protein, 9 aa, Homo Sapiens
ENGEFCKMG

SEQ ID NO: 161116 - protein, 9 aa, Homo Sapiens
VNPECKNLK

SEQ ID NO: 161117 - protein, 9 aa, Homo Sapiens
LQDHLGLSD

SEQ ID NO: 161118 - protein, 9 aa, Homo Sapiens
TQATVRDVV

SEQ ID NO: 161119 - protein, 9 aa, Homo Sapiens
VDTDITHPH

SEQ ID NO: 161120 - protein, 9 aa, Homo Sapiens
VCTPQSPPK

SEQ ID NO: 161121 - protein, 9 aa, Homo Sapiens
ELHVQEFEA

SEQ ID NO: 161122 - protein, 9 aa, Homo Sapiens
RQRRLPSSS

SEQ ID NO: 161123 - protein, 9 aa, Homo Sapiens
AIAVMQPIL

SEQ ID NO: 161124 - protein, 9 aa, Homo Sapiens
LVVFLYMWS

SEQ ID NO: 161125 - protein, 9 aa, Homo Sapiens
SGMCVCPPP

SEQ ID NO: 161126 - protein, 9 aa, Homo Sapiens
APISPLKFS

SEQ ID NO: 161127 - protein, 9 aa, Homo Sapiens
LAFHRHPVA

SEQ ID NO: 161128 - protein, 9 aa, Homo Sapiens
CAKAFSFVK

SEQ ID NO: 161129 - protein, 9 aa, Homo Sapiens
MSGLIDNAI

SEQ ID NO: 161130 - protein, 9 aa, Homo Sapiens
NPKRFNLFP

SEQ ID NO: 161131 - protein, 9 aa, Homo Sapiens
DEFLGCAID

SEQ ID NO: 161132 - protein, 9 aa, Homo Sapiens
EFFPHSHYS

SEQ ID NO: 161133 - protein, 9 aa, Homo Sapiens
DVCLDGLDG

SEQ ID NO: 161134 - protein, 9 aa, Homo Sapiens
PQPSLPGPC

SEQ ID NO: 161135 - protein, 9 aa, Homo Sapiens
PTMCQFITA

SEQ ID NO: 161136 - protein, 9 aa, Homo Sapiens
AVCDGSLWR

SEQ ID NO: 161137 - protein, 9 aa, Homo Sapiens
STALFAKHH

SEQ ID NO: 161138 - protein, 9 aa, Homo Sapiens
YSYLAMLVP

SEQ ID NO: 161139 - protein, 9 aa, Homo Sapiens
SRFQLTRSQ

SEQ ID NO: 161140 - protein, 9 aa, Homo Sapiens
LKGVITYVI

SEQ ID NO: 161141 - protein, 9 aa, Homo Sapiens
RPQYPVLQG

SEQ ID NO: 161142 - protein, 9 aa, Homo Sapiens
LTMHQRRHT

SEQ ID NO: 161143 - protein, 9 aa, Homo Sapiens
EVLIVVIDD

SEQ ID NO: 161144 - protein, 9 aa, Homo Sapiens
IMDIQIMEY

SEQ ID NO: 161145 - protein, 9 aa, Homo Sapiens
PLWLMTAMW

SEQ ID NO: 161146 - protein, 9 aa, Homo Sapiens
QRDWFPGRK

SEQ ID NO: 161147 - protein, 9 aa, Homo Sapiens
VYIIQATDG

SEQ ID NO: 161148 - protein, 9 aa, Homo Sapiens
FLVRRFCCF

SEQ ID NO: 161149 - protein, 9 aa, Homo Sapiens
PPCRSFPSS

SEQ ID NO: 161150 - protein, 9 aa, Homo Sapiens
HEGYACQKG

SEQ ID NO: 161151 - protein, 9 aa, Homo Sapiens
VVMGLSLLV

SEQ ID NO: 161152 - protein, 9 aa, Homo Sapiens
PPPCRSFPS

SEQ ID NO: 161153 - protein, 9 aa, Homo Sapiens
PLPTAGKKD

SEQ ID NO: 161154 - protein, 9 aa, Homo Sapiens
RCLAQSLAR

SEQ ID NO: 161155 - protein, 9 aa, Homo Sapiens
WCDCQARPL

SEQ ID NO: 161156 - protein, 9 aa, Homo Sapiens
DVHPPAGPF

SEQ ID NO: 161157 - protein, 9 aa, Homo Sapiens
ASLLSTLSQ

SEQ ID NO: 161158 - protein, 9 aa, Homo Sapiens
PGVVAVLVD

SEQ ID NO: 161159 - protein, 9 aa, Homo Sapiens
IGCSLLFQI

SEQ ID NO: 161160 - protein, 9 aa, Homo Sapiens
FLIALELEA

SEQ ID NO: 161161 - protein, 9 aa, Homo Sapiens
LRCRDIALN

SEQ ID NO: 161162 - protein, 9 aa, Homo Sapiens
ILALQDHLG

SEQ ID NO: 161163 - protein, 9 aa, Homo Sapiens
NIGQRRKAT

SEQ ID NO: 161164 - protein, 9 aa, Homo Sapiens
LSLLAPLPT

SEQ ID NO: 161165 - protein, 9 aa, Homo Sapiens
WQSWRTRSP

SEQ ID NO: 161166 - protein, 9 aa, Homo Sapiens
PMHFTVGKS

SEQ ID NO: 161167 - protein, 9 aa, Homo Sapiens
IGTVGLYWA

SEQ ID NO: 161168 - protein, 9 aa, Homo Sapiens
TPPGPPRRR

SEQ ID NO: 161169 - protein, 9 aa, Homo Sapiens
VLLTVLIPC

SEQ ID NO: 161170 - protein, 9 aa, Homo Sapiens
KKRRTENGN

SEQ ID NO: 161171 - protein, 9 aa, Homo Sapiens
FKVLLMLGL

SEQ ID NO: 161172 - protein, 9 aa, Homo Sapiens
DQTYGDVAT

SEQ ID NO: 161173 - protein, 9 aa, Homo Sapiens
YICPPVSVC

SEQ ID NO: 161174 - protein, 9 aa, Homo Sapiens
RVFIGAGES

SEQ ID NO: 161175 - protein, 9 aa, Homo Sapiens
RCLEAEMSK

SEQ ID NO: 161176 - protein, 9 aa, Homo Sapiens
RRKELQKKQ

SEQ ID NO: 161177 - protein, 9 aa, Homo Sapiens
DKKIRFCDI

SEQ ID NO: 161178 - protein, 9 aa, Homo Sapiens
LTVLIPCFP

SEQ ID NO: 161179 - protein, 9 aa, Homo Sapiens
SFYEKGPST

SEQ ID NO: 161180 - protein, 9 aa, Homo Sapiens
TCWRPLLSS

SEQ ID NO: 161181 - protein, 9 aa, Homo Sapiens
KKKPIVVSY

SEQ ID NO: 161182 - protein, 9 aa, Homo Sapiens
KKRKCQHDF

SEQ ID NO: 161183 - protein, 9 aa, Homo Sapiens
FLFLLVCFL

SEQ ID NO: 161184 - protein, 9 aa, Homo Sapiens
PDQTYGDVA

SEQ ID NO: 161185 - protein, 9 aa, Homo Sapiens
VVEVWQVCD

SEQ ID NO: 161186 - protein, 9 aa, Homo Sapiens
QAGQLLVLA

SEQ ID NO: 161187 - protein, 9 aa, Homo Sapiens
RNVTAKMAS

SEQ ID NO: 161188 - protein, 9 aa, Homo Sapiens
KMECWPSTQ

SEQ ID NO: 161189 - protein, 9 aa, Homo Sapiens
TFPQLTSSP

SEQ ID NO: 161190 - protein, 9 aa, Homo Sapiens
VLPGLYRVS

SEQ ID NO: 161191 - protein, 9 aa, Homo Sapiens
REETEQKRC

SEQ ID NO: 161192 - protein, 9 aa, Homo Sapiens
LGEQCWTVR

SEQ ID NO: 161193 - protein, 9 aa, Homo Sapiens
NSVQTTQIV

SEQ ID NO: 161194 - protein, 9 aa, Homo Sapiens
ADVVEEVEK

SEQ ID NO: 161195 - protein, 9 aa, Homo Sapiens
APLPTAGKK

SEQ ID NO: 161196 - protein, 9 aa, Homo Sapiens
YECKKCAKA

SEQ ID NO: 161197 - protein, 9 aa, Homo Sapiens
QHVDRACVF

SEQ ID NO: 161198 - protein, 9 aa, Homo Sapiens
ECKNLKWIG

SEQ ID NO: 161199 - protein, 9 aa, Homo Sapiens
AHEGYACQK

SEQ ID NO: 161200 - protein, 9 aa, Homo Sapiens
GVRRNNIQI

SEQ ID NO: 161201 - protein, 9 aa, Homo Sapiens
GQQRTKYYE

SEQ ID NO: 161202 - protein, 9 aa, Homo Sapiens
CLAQSLARQ

SEQ ID NO: 161203 - protein, 9 aa, Homo Sapiens
GELGPVGPA

SEQ ID NO: 161204 - protein, 9 aa, Homo Sapiens
PPPPPCRSF

SEQ ID NO: 161205 - protein, 9 aa, Homo Sapiens
MSMSRTMED

SEQ ID NO: 161206 - protein, 9 aa, Homo Sapiens
FVLSYVDDI

SEQ ID NO: 161207 - protein, 9 aa, Homo Sapiens
AKMASKSGF

SEQ ID NO: 161208 - protein, 9 aa, Homo Sapiens
SLLLIQGAP

SEQ ID NO: 161209 - protein, 9 aa, Homo Sapiens
LGPSICVFL

SEQ ID NO: 161210 - protein, 9 aa, Homo Sapiens
TYVIGVAWA

SEQ ID NO: 161211 - protein, 9 aa, Homo Sapiens
TPGSSRATG

SEQ ID NO: 161212 - protein, 9 aa, Homo Sapiens
RVVRCCTQA

SEQ ID NO: 161213 - protein, 9 aa, Homo Sapiens
SLMITRARK

SEQ ID NO: 161214 - protein, 9 aa, Homo Sapiens
MHFNEVHAK

SEQ ID NO: 161215 - protein, 9 aa, Homo Sapiens
SDELHVQEF

SEQ ID NO: 161216 - protein, 9 aa, Homo Sapiens
IKLLPYFIQ

SEQ ID NO: 161217 - protein, 9 aa, Homo Sapiens
MRASRRHPL

SEQ ID NO: 161218 - protein, 9 aa, Homo Sapiens
FLVVFLYMW

SEQ ID NO: 161219 - protein, 9 aa, Homo Sapiens
SVQDDTPFP

SEQ ID NO: 161220 - protein, 9 aa, Homo Sapiens
SEATINVKI

SEQ ID NO: 161221 - protein, 9 aa, Homo Sapiens
VLTYPPGSR

SEQ ID NO: 161222 - protein, 9 aa, Homo Sapiens
GGEVIFTRD

SEQ ID NO: 161223 - protein, 9 aa, Homo Sapiens
ESLFIRAVW

SEQ ID NO: 161224 - protein, 9 aa, Homo Sapiens
ECKKCAKAF

SEQ ID NO: 161225 - protein, 9 aa, Homo Sapiens
DHMFQIYQT

SEQ ID NO: 161226 - protein, 9 aa, Homo Sapiens
SNAGPGLLK

SEQ ID NO: 161227 - protein, 9 aa, Homo Sapiens
SLLAAVTLA

SEQ ID NO: 161228 - protein, 9 aa, Homo Sapiens
GDSSTCAQR

SEQ ID NO: 161229 - protein, 9 aa, Homo Sapiens
ELGPVGPAP

SEQ ID NO: 161230 - protein, 9 aa, Homo Sapiens
PPSPSRSSI

SEQ ID NO: 161231 - protein, 9 aa, Homo Sapiens
LPHQPPLLV

SEQ ID NO: 161232 - protein, 9 aa, Homo Sapiens
TPATSKAKA

SEQ ID NO: 161233 - protein, 9 aa, Homo Sapiens
RQFFGCFIS

SEQ ID NO: 161234 - protein, 9 aa, Homo Sapiens
AVLPGLYRV

SEQ ID NO: 161235 - protein, 9 aa, Homo Sapiens
PMAKAGRQP

SEQ ID NO: 161236 - protein, 9 aa, Homo Sapiens
SPRRCPHCL

SEQ ID NO: 161237 - protein, 9 aa, Homo Sapiens
LRNAIFCEN

SEQ ID NO: 161238 - protein, 9 aa, Homo Sapiens
LLAYFNSCP

SEQ ID NO: 161239 - protein, 9 aa, Homo Sapiens
QGAAHGIVA

SEQ ID NO: 161240 - protein, 9 aa, Homo Sapiens
LLIQGAPGR

SEQ ID NO: 161241 - protein, 9 aa, Homo Sapiens
IEAVLPGLY

SEQ ID NO: 161242 - protein, 9 aa, Homo Sapiens
QSAGSKWSR

SEQ ID NO: 161243 - protein, 9 aa, Homo Sapiens
KWSRHLSKP

SEQ ID NO: 161244 - protein, 9 aa, Homo Sapiens
CWPSTQEWI

SEQ ID NO: 161245 - protein, 9 aa, Homo Sapiens
EALHGEIQS

SEQ ID NO: 161246 - protein, 9 aa, Homo Sapiens
EIQAGQLLV

SEQ ID NO: 161247 - protein, 9 aa, Homo Sapiens
DYQQREELA

SEQ ID NO: 161248 - protein, 9 aa, Homo Sapiens
LARQFFGCF

SEQ ID NO: 161249 - protein, 9 aa, Homo Sapiens
EEKVAYPAY

SEQ ID NO: 161250 - protein, 9 aa, Homo Sapiens
RENCRKPWN

SEQ ID NO: 161251 - protein, 9 aa, Homo Sapiens
CQDMLVLQL

SEQ ID NO: 161252 - protein, 9 aa, Homo Sapiens
AVKERESER

SEQ ID NO: 161253 - protein, 9 aa, Homo Sapiens
VPPEEQGLL

SEQ ID NO: 161254 - protein, 9 aa, Homo Sapiens
TGVYILIRA

SEQ ID NO: 161255 - protein, 9 aa, Homo Sapiens
ISAGPITGL

SEQ ID NO: 161256 - protein, 9 aa, Homo Sapiens
AGHGPRKDE

SEQ ID NO: 161257 - protein, 9 aa, Homo Sapiens
RRLPLSFML

SEQ ID NO: 161258 - protein, 9 aa, Homo Sapiens
MKSDCVQTT

SEQ ID NO: 161259 - protein, 9 aa, Homo Sapiens
LILAYTRSH

SEQ ID NO: 161260 - protein, 9 aa, Homo Sapiens
GGPARVRTG

SEQ ID NO: 161261 - protein, 9 aa, Homo Sapiens
PGAPRENGE

SEQ ID NO: 161262 - protein, 9 aa, Homo Sapiens
TCSTMTGPM

SEQ ID NO: 161263 - protein, 9 aa, Homo Sapiens
VVAVLVDHA

SEQ ID NO: 161264 - protein, 9 aa, Homo Sapiens
KTLMKAVAT

SEQ ID NO: 161265 - protein, 9 aa, Homo Sapiens
RFERLSDST

SEQ ID NO: 161266 - protein, 9 aa, Homo Sapiens
SEKTVLFLW

SEQ ID NO: 161267 - protein, 9 aa, Homo Sapiens
CLTTTQSKV

SEQ ID NO: 161268 - protein, 9 aa, Homo Sapiens
VLFVCQVPG

SEQ ID NO: 161269 - protein, 9 aa, Homo Sapiens
RPRLTGRRP

SEQ ID NO: 161270 - protein, 9 aa, Homo Sapiens
KRWFILWRG

SEQ ID NO: 161271 - protein, 9 aa, Homo Sapiens
IRAVWAYNG

SEQ ID NO: 161272 - protein, 9 aa, Homo Sapiens
WLPSNIYTG

SEQ ID NO: 161273 - protein, 9 aa, Homo Sapiens
QCWTVRIRA

SEQ ID NO: 161274 - protein, 9 aa, Homo Sapiens
SSAASVPEA

SEQ ID NO: 161275 - protein, 9 aa, Homo Sapiens
QQQRDHHQQ

SEQ ID NO: 161276 - protein, 9 aa, Homo Sapiens
QGLSLWGVP

SEQ ID NO: 161277 - protein, 9 aa, Homo Sapiens
MALHMAARA

SEQ ID NO: 161278 - protein, 9 aa, Homo Sapiens
HRSDGEFFP

SEQ ID NO: 161279 - protein, 9 aa, Homo Sapiens
PLEVGLIGL

SEQ ID NO: 161280 - protein, 9 aa, Homo Sapiens
SHCSREENI

SEQ ID NO: 161281 - protein, 9 aa, Homo Sapiens
SLCSLDLVF

SEQ ID NO: 161282 - protein, 9 aa, Homo Sapiens
GQMHPVPAN

SEQ ID NO: 161283 - protein, 9 aa, Homo Sapiens
SMFGHSVVW

SEQ ID NO: 161284 - protein, 9 aa, Homo Sapiens
FLQHVDRAC

SEQ ID NO: 161285 - protein, 9 aa, Homo Sapiens
PVIMELEHQ

SEQ ID NO: 161286 - protein, 9 aa, Homo Sapiens
INSFYAHTT

SEQ ID NO: 161287 - protein, 9 aa, Homo Sapiens
LAMLVPVFL

SEQ ID NO: 161288 - protein, 9 aa, Homo Sapiens
LVFLSMFGH

SEQ ID NO: 161289 - protein, 9 aa, Homo Sapiens
DTPQPSLPG

SEQ ID NO: 161290 - protein, 9 aa, Homo Sapiens
MLVPVFLLT

SEQ ID NO: 161291 - protein, 9 aa, Homo Sapiens
PKPSLYLST

SEQ ID NO: 161292 - protein, 9 aa, Homo Sapiens
RLEEKKSLT

SEQ ID NO: 161293 - protein, 9 aa, Homo Sapiens
DALLDPNWL

SEQ ID NO: 161294 - protein, 9 aa, Homo Sapiens
VLEEWDVKC

SEQ ID NO: 161295 - protein, 9 aa, Homo Sapiens
PRAPISPLK

SEQ ID NO: 161296 - protein, 9 aa, Homo Sapiens
TVCCMHLHE

SEQ ID NO: 161297 - protein, 9 aa, Homo Sapiens
AIRKAFCVW

SEQ ID NO: 161298 - protein, 9 aa, Homo Sapiens
YYPCEHMAW

SEQ ID NO: 161299 - protein, 9 aa, Homo Sapiens
VQTNERLKV

SEQ ID NO: 161300 - protein, 9 aa, Homo Sapiens
LPGSTRRAG

SEQ ID NO: 161301 - protein, 9 aa, Homo Sapiens
YFFCTVHEI

SEQ ID NO: 161302 - protein, 9 aa, Homo Sapiens
MGEIQAGQL

SEQ ID NO: 161303 - protein, 9 aa, Homo Sapiens
DILETIMLQ

SEQ ID NO: 161304 - protein, 9 aa, Homo Sapiens
RHGPLTADS

SEQ ID NO: 161305 - protein, 9 aa, Homo Sapiens
CVWWSNSGM

SEQ ID NO: 161306 - protein, 9 aa, Homo Sapiens
SSRSVLLIK

SEQ ID NO: 161307 - protein, 9 aa, Homo Sapiens
SQKLYTKEW

SEQ ID NO: 161308 - protein, 9 aa, Homo Sapiens
SLRDVEGED

SEQ ID NO: 161309 - protein, 9 aa, Homo Sapiens
PIVVSYQEN

SEQ ID NO: 161310 - protein, 9 aa, Homo Sapiens
HLRNTPTRL

SEQ ID NO: 161311 - protein, 9 aa, Homo Sapiens
AGQLLVLAT

SEQ ID NO: 161312 - protein, 9 aa, Homo Sapiens
YEDRQQLPV

SEQ ID NO: 161313 - protein, 9 aa, Homo Sapiens
TSVLTYPPG

SEQ ID NO: 161314 - protein, 9 aa, Homo Sapiens
VFTGRALLE

SEQ ID NO: 161315 - protein, 9 aa, Homo Sapiens
SSITASLAA

SEQ ID NO: 161316 - protein, 9 aa, Homo Sapiens
CAIDARSID

SEQ ID NO: 161317 - protein, 9 aa, Homo Sapiens
IKIQEQSLC

SEQ ID NO: 161318 - protein, 9 aa, Homo Sapiens
GDFGNFAVC

SEQ ID NO: 161319 - protein, 9 aa, Homo Sapiens
TQHLSHRAN

SEQ ID NO: 161320 - protein, 9 aa, Homo Sapiens
GPRKDEMTD

SEQ ID NO: 161321 - protein, 9 aa, Homo Sapiens
KEREMCCQF

SEQ ID NO: 161322 - protein, 9 aa, Homo Sapiens
VYFQFDAAM

SEQ ID NO: 161323 - protein, 9 aa, Homo Sapiens
FSSNAGPGL

SEQ ID NO: 161324 - protein, 9 aa, Homo Sapiens
RNPTSRSSR

SEQ ID NO: 161325 - protein, 9 aa, Homo Sapiens
ASARLCSFS

SEQ ID NO: 161326 - protein, 9 aa, Homo Sapiens
ELQKKQLAE

SEQ ID NO: 161327 - protein, 9 aa, Homo Sapiens
HLLLRHGAD

SEQ ID NO: 161328 - protein, 9 aa, Homo Sapiens
KSRFQLTRS

SEQ ID NO: 161329 - protein, 9 aa, Homo Sapiens
PHRPPGGGR

SEQ ID NO: 161330 - protein, 9 aa, Homo Sapiens
PQLVPPEEQ

SEQ ID NO: 161331 - protein, 9 aa, Homo Sapiens
LPTDRNLPM

SEQ ID NO: 161332 - protein, 9 aa, Homo Sapiens
HQGNVLVIS

SEQ ID NO: 161333 - protein, 9 aa, Homo Sapiens
HLKGVITYV

SEQ ID NO: 161334 - protein, 9 aa, Homo Sapiens
TPAPRRMRA

SEQ ID NO: 161335 - protein, 9 aa, Homo Sapiens
CSLDLVFLS

SEQ ID NO: 161336 - protein, 9 aa, Homo Sapiens
CPIMDIQIM

SEQ ID NO: 161337 - protein, 9 aa, Homo Sapiens
PARSQLQSS

SEQ ID NO: 161338 - protein, 9 aa, Homo Sapiens
AWNAVPSHI

SEQ ID NO: 161339 - protein, 9 aa, Homo Sapiens
ARSQLQSSP

SEQ ID NO: 161340 - protein, 9 aa, Homo Sapiens
QKLAYEKSR

SEQ ID NO: 161341 - protein, 9 aa, Homo Sapiens
YAPQPPPTM

SEQ ID NO: 161342 - protein, 9 aa, Homo Sapiens
MDIQIMEYT

SEQ ID NO: 161343 - protein, 9 aa, Homo Sapiens
AHLLLRHGA

SEQ ID NO: 161344 - protein, 9 aa, Homo Sapiens
QYVCAICLD

SEQ ID NO: 161345 - protein, 9 aa, Homo Sapiens
ISAFMVRVP

SEQ ID NO: 161346 - protein, 9 aa, Homo Sapiens
EREMCCQFS

SEQ ID NO: 161347 - protein, 9 aa, Homo Sapiens
PSICVFLVR

SEQ ID NO: 161348 - protein, 9 aa, Homo Sapiens
CFLFFCQKS

SEQ ID NO: 161349 - protein, 9 aa, Homo Sapiens
PSSLLAAVT

SEQ ID NO: 161350 - protein, 9 aa, Homo Sapiens
GRPKQLGPA

SEQ ID NO: 161351 - protein, 9 aa, Homo Sapiens
STLSQPPPQ

SEQ ID NO: 161352 - protein, 9 aa, Homo Sapiens
IVQVVSAGT

SEQ ID NO: 161353 - protein, 9 aa, Homo Sapiens
HGPRKDEMT

SEQ ID NO: 161354 - protein, 9 aa, Homo Sapiens
EQKRCLEAE

SEQ ID NO: 161355 - protein, 9 aa, Homo Sapiens
EEAIQPQMQ

SEQ ID NO: 161356 - protein, 9 aa, Homo Sapiens
LAQSLARQF

SEQ ID NO: 161357 - protein, 9 aa, Homo Sapiens
KSIIDAHAN

SEQ ID NO: 161358 - protein, 9 aa, Homo Sapiens
LPSSSGPTA

SEQ ID NO: 161359 - protein, 9 aa, Homo Sapiens
ALDVHPPAG

SEQ ID NO: 161360 - protein, 9 aa, Homo Sapiens
YKAEAAVKI

SEQ ID NO: 161361 - protein, 9 aa, Homo Sapiens
DGDEFQKSE

SEQ ID NO: 161362 - protein, 9 aa, Homo Sapiens
ILVSVPKNH

SEQ ID NO: 161363 - protein, 9 aa, Homo Sapiens
RISQHGDSL

SEQ ID NO: 161364 - protein, 9 aa, Homo Sapiens
AVKIRKENP

SEQ ID NO: 161365 - protein, 9 aa, Homo Sapiens
SYSYLAMLV

SEQ ID NO: 161366 - protein, 9 aa, Homo Sapiens
LPYFIQLSH

SEQ ID NO: 161367 - protein, 9 aa, Homo Sapiens
TIEDIVELK

SEQ ID NO: 161368 - protein, 9 aa, Homo Sapiens
ALFAKHHWL

SEQ ID NO: 161369 - protein, 9 aa, Homo Sapiens
ELLMGEIQA

SEQ ID NO: 161370 - protein, 9 aa, Homo Sapiens
QQQQRDHHQ

SEQ ID NO: 161371 - protein, 9 aa, Homo Sapiens
EALERVVRC

SEQ ID NO: 161372 - protein, 9 aa, Homo Sapiens
KLCLLGSSD

SEQ ID NO: 161373 - protein, 9 aa, Homo Sapiens
MELEHQGNV

SEQ ID NO: 161374 - protein, 9 aa, Homo Sapiens
IRAGALMML

SEQ ID NO: 161375 - protein, 9 aa, Homo Sapiens
YVYDLYLEG

SEQ ID NO: 161376 - protein, 9 aa, Homo Sapiens
LKEREMCCQ

SEQ ID NO: 161377 - protein, 9 aa, Homo Sapiens
KLNQCLTTT

SEQ ID NO: 161378 - protein, 9 aa, Homo Sapiens
RFGIQNGKC

SEQ ID NO: 161379 - protein, 9 aa, Homo Sapiens
STVCCMHLH

SEQ ID NO: 161380 - protein, 9 aa, Homo Sapiens
LYWAQDSAQ

SEQ ID NO: 161381 - protein, 9 aa, Homo Sapiens
LSDKKECAV

SEQ ID NO: 161382 - protein, 9 aa, Homo Sapiens
LESEPIRNA

SEQ ID NO: 161383 - protein, 9 aa, Homo Sapiens
LYLKTGQMH

SEQ ID NO: 161384 - protein, 9 aa, Homo Sapiens
EKKPRENCR

SEQ ID NO: 161385 - protein, 9 aa, Homo Sapiens
RKELQKKQL

SEQ ID NO: 161386 - protein, 9 aa, Homo Sapiens
SSSTLTSTP

SEQ ID NO: 161387 - protein, 9 aa, Homo Sapiens
GPCASLLST

SEQ ID NO: 161388 - protein, 9 aa, Homo Sapiens
IPLNKSTVL

SEQ ID NO: 161389 - protein, 9 aa, Homo Sapiens
CPHCLPTSL

SEQ ID NO: 161390 - protein, 9 aa, Homo Sapiens
AGGPARVRT

SEQ ID NO: 161391 - protein, 9 aa, Homo Sapiens
EDSLRDVEG

SEQ ID NO: 161392 - protein, 9 aa, Homo Sapiens
MNVSPVPPC

SEQ ID NO: 161393 - protein, 9 aa, Homo Sapiens
MPQPLNLEI

SEQ ID NO: 161394 - protein, 9 aa, Homo Sapiens
SIIDAHANE

SEQ ID NO: 161395 - protein, 9 aa, Homo Sapiens
KPAIYNQLC

SEQ ID NO: 161396 - protein, 9 aa, Homo Sapiens
NSSEALERV

SEQ ID NO: 161397 - protein, 9 aa, Homo Sapiens
GITALPSDQ

SEQ ID NO: 161398 - protein, 9 aa, Homo Sapiens
FVKDDDRLA

SEQ ID NO: 161399 - protein, 9 aa, Homo Sapiens
GTKDNVMWA

SEQ ID NO: 161400 - protein, 9 aa, Homo Sapiens
MHPVPANHL

SEQ ID NO: 161401 - protein, 9 aa, Homo Sapiens
MGTLFFLKN

SEQ ID NO: 161402 - protein, 9 aa, Homo Sapiens
MEEVSPYSL

SEQ ID NO: 161403 - protein, 9 aa, Homo Sapiens
GPVTEVDGV

SEQ ID NO: 161404 - protein, 9 aa, Homo Sapiens
NLQGKKSSV

SEQ ID NO: 161405 - protein, 9 aa, Homo Sapiens
YQQREELAS

SEQ ID NO: 161406 - protein, 9 aa, Homo Sapiens
EWDESKMKD

SEQ ID NO: 161407 - protein, 9 aa, Homo Sapiens
STTEARSAM

SEQ ID NO: 161408 - protein, 9 aa, Homo Sapiens
ETPAPRRMR

SEQ ID NO: 161409 - protein, 9 aa, Homo Sapiens
PDNPKRFNL

SEQ ID NO: 161410 - protein, 9 aa, Homo Sapiens
CVFLVRRFC

SEQ ID NO: 161411 - protein, 9 aa, Homo Sapiens
VRDVVVGRP

SEQ ID NO: 161412 - protein, 9 aa, Homo Sapiens
EGEQHEKVV

SEQ ID NO: 161413 - protein, 9 aa, Homo Sapiens
AVQGAAHGI

SEQ ID NO: 161414 - protein, 9 aa, Homo Sapiens
KEKKPRENC

SEQ ID NO: 161415 - protein, 9 aa, Homo Sapiens
GGEALNSDV

SEQ ID NO: 161416 - protein, 9 aa, Homo Sapiens
VSEQQADTS

SEQ ID NO: 161417 - protein, 9 aa, Homo Sapiens
RDEGLRPRK

SEQ ID NO: 161418 - protein, 9 aa, Homo Sapiens
PPGSVWILP

SEQ ID NO: 161419 - protein, 9 aa, Homo Sapiens
VDRWDIACQ

SEQ ID NO: 161420 - protein, 9 aa, Homo Sapiens
DPNWLCPPC

SEQ ID NO: 161421 - protein, 9 aa, Homo Sapiens
NNIQIVSLQ

SEQ ID NO: 161422 - protein, 9 aa, Homo Sapiens
LLRNAIFCE

SEQ ID NO: 161423 - protein, 9 aa, Homo Sapiens
THLNMLLGQ

SEQ ID NO: 161424 - protein, 9 aa, Homo Sapiens
VSTTPHITG

SEQ ID NO: 161425 - protein, 9 aa, Homo Sapiens
MWLSASHFT

SEQ ID NO: 161426 - protein, 9 aa, Homo Sapiens
RENGEFCKM

SEQ ID NO: 161427 - protein, 9 aa, Homo Sapiens
QVNPECKNL

SEQ ID NO: 161428 - protein, 9 aa, Homo Sapiens
PRSSRRTPS

SEQ ID NO: 161429 - protein, 9 aa, Homo Sapiens
PGSSRATGL

SEQ ID NO: 161430 - protein, 9 aa, Homo Sapiens
PARVRTGQP

SEQ ID NO: 161431 - protein, 9 aa, Homo Sapiens
ASSGHLLGG

SEQ ID NO: 161432 - protein, 9 aa, Homo Sapiens
GIKTVETCW

SEQ ID NO: 161433 - protein, 9 aa, Homo Sapiens
AVILKIPSA

SEQ ID NO: 161434 - protein, 9 aa, Homo Sapiens
NGDVRKKAR

SEQ ID NO: 161435 - protein, 9 aa, Homo Sapiens
RWKYMTLIN

SEQ ID NO: 161436 - protein, 9 aa, Homo Sapiens
PSETHRERA

SEQ ID NO: 161437 - protein, 9 aa, Homo Sapiens
CTSSWPSSS

SEQ ID NO: 161438 - protein, 9 aa, Homo Sapiens
SRPGTSRVP

SEQ ID NO: 161439 - protein, 9 aa, Homo Sapiens
SPHVQPEEE

SEQ ID NO: 161440 - protein, 9 aa, Homo Sapiens
SRMTSAVLL

SEQ ID NO: 161441 - protein, 9 aa, Homo Sapiens
GDHFCLGQL

SEQ ID NO: 161442 - protein, 9 aa, Homo Sapiens
RCPHCLPTS

SEQ ID NO: 161443 - protein, 9 aa, Homo Sapiens
VFPKGVESV

SEQ ID NO: 161444 - protein, 9 aa, Homo Sapiens
SRVPRSSRR

SEQ ID NO: 161445 - protein, 9 aa, Homo Sapiens
LLGPSICVF

SEQ ID NO: 161446 - protein, 9 aa, Homo Sapiens
RRRSVQQSI

SEQ ID NO: 161447 - protein, 9 aa, Homo Sapiens
ASLAAGLWW

SEQ ID NO: 161448 - protein, 9 aa, Homo Sapiens
PSNIYTGLF

SEQ ID NO: 161449 - protein, 9 aa, Homo Sapiens
TVHEILVHN

SEQ ID NO: 161450 - protein, 9 aa, Homo Sapiens
LEKTCRMKR

SEQ ID NO: 161451 - protein, 9 aa, Homo Sapiens
RPKQLGPAR

SEQ ID NO: 161452 - protein, 9 aa, Homo Sapiens
DILRDVGDL

SEQ ID NO: 161453 - protein, 9 aa, Homo Sapiens
RRSPLMSSP

SEQ ID NO: 161454 - protein, 9 aa, Homo Sapiens
GPSEVNRLK

SEQ ID NO: 161455 - protein, 9 aa, Homo Sapiens
EQHEKVVEL

SEQ ID NO: 161456 - protein, 9 aa, Homo Sapiens
KTYCYHKYK

SEQ ID NO: 161457 - protein, 9 aa, Homo Sapiens
LYTKEWDES

SEQ ID NO: 161458 - protein, 9 aa, Homo Sapiens
IRAYPTVKI

SEQ ID NO: 161459 - protein, 9 aa, Homo Sapiens
IKTVETCWR

SEQ ID NO: 161460 - protein, 9 aa, Homo Sapiens
ITSTQQQTR

SEQ ID NO: 161461 - protein, 9 aa, Homo Sapiens
IGGAYEHRY

SEQ ID NO: 161462 - protein, 9 aa, Homo Sapiens
LRDIVQVVS

SEQ ID NO: 161463 - protein, 9 aa, Homo Sapiens
ALHGEIQSL

SEQ ID NO: 161464 - protein, 9 aa, Homo Sapiens
VRRNNIQIV

SEQ ID NO: 161465 - protein, 9 aa, Homo Sapiens
SEALERVVR

SEQ ID NO: 161466 - protein, 9 aa, Homo Sapiens
TQHYYEGET

SEQ ID NO: 161467 - protein, 9 aa, Homo Sapiens
ATECFLIAL

SEQ ID NO: 161468 - protein, 9 aa, Homo Sapiens
PSTASSRPG

SEQ ID NO: 161469 - protein, 9 aa, Homo Sapiens
EENIGQRRK

SEQ ID NO: 161470 - protein, 9 aa, Homo Sapiens
SGLIDNAID

SEQ ID NO: 161471 - protein, 9 aa, Homo Sapiens
ELACRFALT

SEQ ID NO: 161472 - protein, 9 aa, Homo Sapiens
LQQTQELDI

SEQ ID NO: 161473 - protein, 9 aa, Homo Sapiens
NGVVEVWQV

SEQ ID NO: 161474 - protein, 9 aa, Homo Sapiens
LKEAGHGPR

SEQ ID NO: 161475 - protein, 9 aa, Homo Sapiens
RKVIVLAIA

SEQ ID NO: 161476 - protein, 9 aa, Homo Sapiens
DNVMWALDG

SEQ ID NO: 161477 - protein, 9 aa, Homo Sapiens
KKSLTKLNK

SEQ ID NO: 161478 - protein, 9 aa, Homo Sapiens
DIQPRPPPL

SEQ ID NO: 161479 - protein, 9 aa, Homo Sapiens
ARQFFGCFI

SEQ ID NO: 161480 - protein, 9 aa, Homo Sapiens
VLFLWIGCS

SEQ ID NO: 161481 - protein, 9 aa, Homo Sapiens
VVFLYMWSF

SEQ ID NO: 161482 - protein, 9 aa, Homo Sapiens
HRRQRRLPS

SEQ ID NO: 161483 - protein, 9 aa, Homo Sapiens
NIYTGLFLF

SEQ ID NO: 161484 - protein, 9 aa, Homo Sapiens
HWLRCSPRA

SEQ ID NO: 161485 - protein, 9 aa, Homo Sapiens
WSFCFSPLW

SEQ ID NO: 161486 - protein, 9 aa, Homo Sapiens
GEMALHMAA

SEQ ID NO: 161487 - protein, 9 aa, Homo Sapiens
LMTAMWLSA

SEQ ID NO: 161488 - protein, 9 aa, Homo Sapiens
RVSEGARLG

SEQ ID NO: 161489 - protein, 9 aa, Homo Sapiens
VHPHRVAQT

SEQ ID NO: 161490 - protein, 9 aa, Homo Sapiens
GVITYVIGV

SEQ ID NO: 161491 - protein, 9 aa, Homo Sapiens
KLYFSVDAE

SEQ ID NO: 161492 - protein, 9 aa, Homo Sapiens
TILKLPSVQ

SEQ ID NO: 161493 - protein, 9 aa, Homo Sapiens
HENEAEALH

SEQ ID NO: 161494 - protein, 9 aa, Homo Sapiens
RAVSCFQKN

SEQ ID NO: 161495 - protein, 9 aa, Homo Sapiens
YMGTLFFLK

SEQ ID NO: 161496 - protein, 9 aa, Homo Sapiens
QSLPPVTTY

SEQ ID NO: 161497 - protein, 9 aa, Homo Sapiens
TSTVCCMHL

SEQ ID NO: 161498 - protein, 9 aa, Homo Sapiens
PMNPFQPIA

SEQ ID NO: 161499 - protein, 9 aa, Homo Sapiens
VILVSVPKN

SEQ ID NO: 161500 - protein, 9 aa, Homo Sapiens
NTPTRLMKD

SEQ ID NO: 161501 - protein, 9 aa, Homo Sapiens
LLSSVFGYL

SEQ ID NO: 161502 - protein, 9 aa, Homo Sapiens
NRKEEKRAL

SEQ ID NO: 161503 - protein, 9 aa, Homo Sapiens
GVQCTNSRD

SEQ ID NO: 161504 - protein, 9 aa, Homo Sapiens
TAPPLSGKG

SEQ ID NO: 161505 - protein, 9 aa, Homo Sapiens
KKEKKPREN

SEQ ID NO: 161506 - protein, 9 aa, Homo Sapiens
NYFNAMFVS

SEQ ID NO: 161507 - protein, 9 aa, Homo Sapiens
QVPGVVAVL

SEQ ID NO: 161508 - protein, 9 aa, Homo Sapiens
QSGGEEKDG

SEQ ID NO: 161509 - protein, 9 aa, Homo Sapiens
NAMFVSPGF

SEQ ID NO: 161510 - protein, 9 aa, Homo Sapiens
NINSFYAHT

SEQ ID NO: 161511 - protein, 9 aa, Homo Sapiens
LAAKLQRNP

SEQ ID NO: 161512 - protein, 9 aa, Homo Sapiens
DDTPFPALL

SEQ ID NO: 161513 - protein, 9 aa, Homo Sapiens
LLQFVDDAL

SEQ ID NO: 161514 - protein, 9 aa, Homo Sapiens
LFFRYPEED

SEQ ID NO: 161515 - protein, 9 aa, Homo Sapiens
WWASVPSAP

SEQ ID NO: 161516 - protein, 9 aa, Homo Sapiens
EPGEGGSAP

SEQ ID NO: 161517 - protein, 9 aa, Homo Sapiens
INVKIFQKL

SEQ ID NO: 161518 - protein, 9 aa, Homo Sapiens
ESEPIRNAV

SEQ ID NO: 161519 - protein, 9 aa, Homo Sapiens
RRSKIEASP

SEQ ID NO: 161520 - protein, 9 aa, Homo Sapiens
FIWLPSNIY

SEQ ID NO: 161521 - protein, 9 aa, Homo Sapiens
LLANINSFY

SEQ ID NO: 161522 - protein, 9 aa, Homo Sapiens
WGVPQKPGS

SEQ ID NO: 161523 - protein, 9 aa, Homo Sapiens
VIMELEHQG

SEQ ID NO: 161524 - protein, 9 aa, Homo Sapiens
PARSEKTVL

SEQ ID NO: 161525 - protein, 9 aa, Homo Sapiens
LKQYLDVSS

SEQ ID NO: 161526 - protein, 9 aa, Homo Sapiens
CCFGNFIWL

SEQ ID NO: 161527 - protein, 9 aa, Homo Sapiens
VRGPPLHTR

SEQ ID NO: 161528 - protein, 9 aa, Homo Sapiens
CRAVQGAAH

SEQ ID NO: 161529 - protein, 9 aa, Homo Sapiens
AAAAAPVAS

SEQ ID NO: 161530 - protein, 9 aa, Homo Sapiens
SSKQRSWVA

SEQ ID NO: 161531 - protein, 9 aa, Homo Sapiens
CLLPLAANG

SEQ ID NO: 161532 - protein, 9 aa, Homo Sapiens
VCDGSLWRY

SEQ ID NO: 161533 - protein, 9 aa, Homo Sapiens
HLSKPPLVT

SEQ ID NO: 161534 - protein, 9 aa, Homo Sapiens
TLMKAVATV

SEQ ID NO: 161535 - protein, 9 aa, Homo Sapiens
DRWDIACQI

SEQ ID NO: 161536 - protein, 9 aa, Homo Sapiens
QKSIIDAHA

SEQ ID NO: 161537 - protein, 9 aa, Homo Sapiens
ATDGSHEWT

SEQ ID NO: 161538 - protein, 9 aa, Homo Sapiens
DIPKQEKTL

SEQ ID NO: 161539 - protein, 9 aa, Homo Sapiens
DLVFLSMFG

SEQ ID NO: 161540 - protein, 9 aa, Homo Sapiens
LGSWRGSFC

SEQ ID NO: 161541 - protein, 9 aa, Homo Sapiens
SGGDHFCLG

SEQ ID NO: 161542 - protein, 9 aa, Homo Sapiens
VTAKMASKS

SEQ ID NO: 161543 - protein, 9 aa, Homo Sapiens
CQGSVQDDT

SEQ ID NO: 161544 - protein, 9 aa, Homo Sapiens
DVGDLKALA

SEQ ID NO: 161545 - protein, 9 aa, Homo Sapiens
IQATDGSHE

SEQ ID NO: 161546 - protein, 9 aa, Homo Sapiens
KAEAAVKIR

SEQ ID NO: 161547 - protein, 9 aa, Homo Sapiens
RLSLDYQQR

SEQ ID NO: 161548 - protein, 9 aa, Homo Sapiens
PAPHLGIVD

SEQ ID NO: 161549 - protein, 9 aa, Homo Sapiens
QGFPLGGPD

SEQ ID NO: 161550 - protein, 9 aa, Homo Sapiens
CNHWFQHDD

SEQ ID NO: 161551 - protein, 9 aa, Homo Sapiens
SCVTPTRRR

SEQ ID NO: 161552 - protein, 9 aa, Homo Sapiens
QNLQGKKSS

SEQ ID NO: 161553 - protein, 9 aa, Homo Sapiens
PEGAWGALP

SEQ ID NO: 161554 - protein, 9 aa, Homo Sapiens
FQALDVHPP

SEQ ID NO: 161555 - protein, 9 aa, Homo Sapiens
PFAFCYDCE

SEQ ID NO: 161556 - protein, 9 aa, Homo Sapiens
KDDDRLAFH

SEQ ID NO: 161557 - protein, 9 aa, Homo Sapiens
YKQYAFLRC

SEQ ID NO: 161558 - protein, 9 aa, Homo Sapiens
LLVLATLCH

SEQ ID NO: 161559 - protein, 9 aa, Homo Sapiens
FLGCAIDAR

SEQ ID NO: 161560 - protein, 9 aa, Homo Sapiens
TFLFLLVCF

SEQ ID NO: 161561 - protein, 9 aa, Homo Sapiens
STPATSKAK

SEQ ID NO: 161562 - protein, 9 aa, Homo Sapiens
PPLPTPARS

SEQ ID NO: 161563 - protein, 9 aa, Homo Sapiens
SMSRTMEDS

SEQ ID NO: 161564 - protein, 9 aa, Homo Sapiens
DTVCLNHGT

SEQ ID NO: 161565 - protein, 9 aa, Homo Sapiens
KSNALHQDA

SEQ ID NO: 161566 - protein, 9 aa, Homo Sapiens
ALPGSTRRA

SEQ ID NO: 161567 - protein, 9 aa, Homo Sapiens
TKEWDESKM

SEQ ID NO: 161568 - protein, 9 aa, Homo Sapiens
LPLTQEFGS

SEQ ID NO: 161569 - protein, 9 aa, Homo Sapiens
WAQDSAQLS

SEQ ID NO: 161570 - protein, 9 aa, Homo Sapiens
AIRQCPDQT

SEQ ID NO: 161571 - protein, 9 aa, Homo Sapiens
WPSSAASVP

SEQ ID NO: 161572 - protein, 9 aa, Homo Sapiens
GGSQRPGRR

SEQ ID NO: 161573 - protein, 9 aa, Homo Sapiens
PVPPKKSHC

SEQ ID NO: 161574 - protein, 9 aa, Homo Sapiens
ATLCHPLEV

SEQ ID NO: 161575 - protein, 9 aa, Homo Sapiens
IQEQSLCVA

SEQ ID NO: 161576 - protein, 9 aa, Homo Sapiens
LEEQKHLME

SEQ ID NO: 161577 - protein, 9 aa, Homo Sapiens
HGQSLTGAG

SEQ ID NO: 161578 - protein, 9 aa, Homo Sapiens
FAFCYDCEF

SEQ ID NO: 161579 - protein, 9 aa, Homo Sapiens
LQGTVDVCL

SEQ ID NO: 161580 - protein, 9 aa, Homo Sapiens
FDHMFQIYQ

SEQ ID NO: 161581 - protein, 9 aa, Homo Sapiens
CSFSACCTS

SEQ ID NO: 161582 - protein, 9 aa, Homo Sapiens
PPVTTYNMI

SEQ ID NO: 161583 - protein, 9 aa, Homo Sapiens
AQRDWFPGR

SEQ ID NO: 161584 - protein, 9 aa, Homo Sapiens
RLCSFSACC

SEQ ID NO: 161585 - protein, 9 aa, Homo Sapiens
MQGFPLGGP

SEQ ID NO: 161586 - protein, 9 aa, Homo Sapiens
EKDGDEFQK

SEQ ID NO: 161587 - protein, 9 aa, Homo Sapiens
ASHSLAHLL

SEQ ID NO: 161588 - protein, 9 aa, Homo Sapiens
QRRLPSSSG

SEQ ID NO: 161589 - protein, 9 aa, Homo Sapiens
LSHTAPLMS

SEQ ID NO: 161590 - protein, 9 aa, Homo Sapiens
VPESPGGQE

SEQ ID NO: 161591 - protein, 9 aa, Homo Sapiens
GPPQPGTPS

SEQ ID NO: 161592 - protein, 9 aa, Homo Sapiens
KECEKAFRH

SEQ ID NO: 161593 - protein, 9 aa, Homo Sapiens
SSGPTAMNR

SEQ ID NO: 161594 - protein, 9 aa, Homo Sapiens
RHSTPATSK

SEQ ID NO: 161595 - protein, 9 aa, Homo Sapiens
FLFTFLFLL

SEQ ID NO: 161596 - protein, 9 aa, Homo Sapiens
QSGPGGAAG

SEQ ID NO: 161597 - protein, 9 aa, Homo Sapiens
GGQTPASLM

SEQ ID NO: 161598 - protein, 9 aa, Homo Sapiens
ALHLSSAVA

SEQ ID NO: 161599 - protein, 9 aa, Homo Sapiens
EGYACQKGC

SEQ ID NO: 161600 - protein, 9 aa, Homo Sapiens
CGAALFLKK

SEQ ID NO: 161601 - protein, 9 aa, Homo Sapiens
MLWGGVGGL

SEQ ID NO: 161602 - protein, 9 aa, Homo Sapiens
VPGVVAVLV

SEQ ID NO: 161603 - protein, 9 aa, Homo Sapiens
NAIFCENTE

SEQ ID NO: 161604 - protein, 9 aa, Homo Sapiens
TALAAKLQR

SEQ ID NO: 161605 - protein, 9 aa, Homo Sapiens
IPTKVGTFI

SEQ ID NO: 161606 - protein, 9 aa, Homo Sapiens
VYYCVTWDR

SEQ ID NO: 161607 - protein, 9 aa, Homo Sapiens
HRILPLTQE

SEQ ID NO: 161608 - protein, 9 aa, Homo Sapiens
VLMLLLLPP

SEQ ID NO: 161609 - protein, 9 aa, Homo Sapiens
GLLQFVDDA

SEQ ID NO: 161610 - protein, 9 aa, Homo Sapiens
GHASHSLAH

SEQ ID NO: 161611 - protein, 9 aa, Homo Sapiens
GTRYICPPV

SEQ ID NO: 161612 - protein, 9 aa, Homo Sapiens
ATLRCPAVP

SEQ ID NO: 161613 - protein, 9 aa, Homo Sapiens
DFERNVTAK

SEQ ID NO: 161614 - protein, 9 aa, Homo Sapiens
DQYVCAICL

SEQ ID NO: 161615 - protein, 9 aa, Homo Sapiens
KTIEDIVEL

SEQ ID NO: 161616 - protein, 9 aa, Homo Sapiens
SQRPGRRSP

SEQ ID NO: 161617 - protein, 9 aa, Homo Sapiens
NIQIVSLQS

SEQ ID NO: 161618 - protein, 9 aa, Homo Sapiens
IQGAPGRPK

SEQ ID NO: 161619 - protein, 9 aa, Homo Sapiens
EVNRLKGDF

SEQ ID NO: 161620 - protein, 9 aa, Homo Sapiens
YSKPCNHWF

SEQ ID NO: 161621 - protein, 9 aa, Homo Sapiens
LWLMTAMWL

SEQ ID NO: 161622 - protein, 9 aa, Homo Sapiens
CRKPWNLNQ

SEQ ID NO: 161623 - protein, 9 aa, Homo Sapiens
PPPTMCQFI

SEQ ID NO: 161624 - protein, 9 aa, Homo Sapiens
CKVEIVCTP

SEQ ID NO: 161625 - protein, 9 aa, Homo Sapiens
FFRYPEEDY

SEQ ID NO: 161626 - protein, 9 aa, Homo Sapiens
GAWGALPGS

SEQ ID NO: 161627 - protein, 9 aa, Homo Sapiens
GEIQAGQLL

SEQ ID NO: 161628 - protein, 9 aa, Homo Sapiens
LRDEGLRPR

SEQ ID NO: 161629 - protein, 9 aa, Homo Sapiens
REELYCPPS

SEQ ID NO: 161630 - protein, 9 aa, Homo Sapiens
HVQPEEEER

SEQ ID NO: 161631 - protein, 9 aa, Homo Sapiens
LALQDHLGL

SEQ ID NO: 161632 - protein, 9 aa, Homo Sapiens
EYGSTSKGG

SEQ ID NO: 161633 - protein, 9 aa, Homo Sapiens
TDLMFKKKL

SEQ ID NO: 161634 - protein, 9 aa, Homo Sapiens
QLCVIHCAH

SEQ ID NO: 161635 - protein, 9 aa, Homo Sapiens
HQNLQGKKS

SEQ ID NO: 161636 - protein, 9 aa, Homo Sapiens
PEPMNPFQP

SEQ ID NO: 161637 - protein, 9 aa, Homo Sapiens
GPQSLVIPL

SEQ ID NO: 161638 - protein, 9 aa, Homo Sapiens
SQTPPGPPR

SEQ ID NO: 161639 - protein, 9 aa, Homo Sapiens
LTGGEALNS

SEQ ID NO: 161640 - protein, 9 aa, Homo Sapiens
KPCNHWFQH

SEQ ID NO: 161641 - protein, 9 aa, Homo Sapiens
SLLFQIRVF

SEQ ID NO: 161642 - protein, 9 aa, Homo Sapiens
VIKKSRFQL

SEQ ID NO: 161643 - protein, 9 aa, Homo Sapiens
DRQQLPVPK

SEQ ID NO: 161644 - protein, 9 aa, Homo Sapiens
SPSETHRER

SEQ ID NO: 161645 - protein, 9 aa, Homo Sapiens
PTKVGTFIA

SEQ ID NO: 161646 - protein, 9 aa, Homo Sapiens
HWFQHDDSP

SEQ ID NO: 161647 - protein, 9 aa, Homo Sapiens
EDDEEEDDD

SEQ ID NO: 161648 - protein, 9 aa, Homo Sapiens
AQSLARQFF

SEQ ID NO: 161649 - protein, 9 aa, Homo Sapiens
QNDEFTHDL

SEQ ID NO: 161650 - protein, 9 aa, Homo Sapiens
GRWSASARL

SEQ ID NO: 161651 - protein, 9 aa, Homo Sapiens
AEVEPPGRL

SEQ ID NO: 161652 - protein, 9 aa, Homo Sapiens
MSPAIAVMQ

SEQ ID NO: 161653 - protein, 9 aa, Homo Sapiens
TGRALLEKL

SEQ ID NO: 161654 - protein, 9 aa, Homo Sapiens
FFVLVNLEV

SEQ ID NO: 161655 - protein, 9 aa, Homo Sapiens
TQAINRRTL

SEQ ID NO: 161656 - protein, 9 aa, Homo Sapiens
HCSREENIG

SEQ ID NO: 161657 - protein, 9 aa, Homo Sapiens
ERSQPIASI

SEQ ID NO: 161658 - protein, 9 aa, Homo Sapiens
PCCTMRPRL

SEQ ID NO: 161659 - protein, 9 aa, Homo Sapiens
FQNVFTGRA

SEQ ID NO: 161660 - protein, 9 aa, Homo Sapiens
VAVLVDHAL

SEQ ID NO: 161661 - protein, 9 aa, Homo Sapiens
NVDTSGDHD

SEQ ID NO: 161662 - protein, 9 aa, Homo Sapiens
QDPYAKTYE

SEQ ID NO: 161663 - protein, 9 aa, Homo Sapiens
NLEISAGPI

SEQ ID NO: 161664 - protein, 9 aa, Homo Sapiens
HLGLSDLEV

SEQ ID NO: 161665 - protein, 9 aa, Homo Sapiens
GVVAVLVDH

SEQ ID NO: 161666 - protein, 9 aa, Homo Sapiens
MIRFIENVI

SEQ ID NO: 161667 - protein, 9 aa, Homo Sapiens
LFTFLFLLV

SEQ ID NO: 161668 - protein, 9 aa, Homo Sapiens
WWTGWPIPW

SEQ ID NO: 161669 - protein, 9 aa, Homo Sapiens
KEAGHGPRK

SEQ ID NO: 161670 - protein, 9 aa, Homo Sapiens
YDAGEQCRF

SEQ ID NO: 161671 - protein, 9 aa, Homo Sapiens
KYRRVKKNV

SEQ ID NO: 161672 - protein, 9 aa, Homo Sapiens
TPQSPPKNC

SEQ ID NO: 161673 - protein, 9 aa, Homo Sapiens
LPTSLWSLC

SEQ ID NO: 161674 - protein, 9 aa, Homo Sapiens
FYMLLVVMG

SEQ ID NO: 161675 - protein, 9 aa, Homo Sapiens
PWNLNQSAG

SEQ ID NO: 161676 - protein, 9 aa, Homo Sapiens
ALNSDVREK

SEQ ID NO: 161677 - protein, 9 aa, Homo Sapiens
VWWSNSGMY

SEQ ID NO: 161678 - protein, 9 aa, Homo Sapiens
LYLSTPSSA

SEQ ID NO: 161679 - protein, 9 aa, Homo Sapiens
RCPAVPAAA

SEQ ID NO: 161680 - protein, 9 aa, Homo Sapiens
VITYVIGVA

SEQ ID NO: 161681 - protein, 9 aa, Homo Sapiens
CNLKDDFEV

SEQ ID NO: 161682 - protein, 9 aa, Homo Sapiens
SEPGEGGSA

SEQ ID NO: 161683 - protein, 9 aa, Homo Sapiens
GLFLFTFLF

SEQ ID NO: 161684 - protein, 9 aa, Homo Sapiens
DEEEDDDWD

SEQ ID NO: 161685 - protein, 9 aa, Homo Sapiens
LCKVEIVCT

SEQ ID NO: 161686 - protein, 9 aa, Homo Sapiens
RASCVTPTR

SEQ ID NO: 161687 - protein, 9 aa, Homo Sapiens
YFSVDAESG

SEQ ID NO: 161688 - protein, 9 aa, Homo Sapiens
GNFAVCDGS

SEQ ID NO: 161689 - protein, 9 aa, Homo Sapiens
GPVGPAPHL

SEQ ID NO: 161690 - protein, 9 aa, Homo Sapiens
VTNIRGEMA

SEQ ID NO: 161691 - protein, 9 aa, Homo Sapiens
FCQKSIIDA

SEQ ID NO: 161692 - protein, 9 aa, Homo Sapiens
KSMCVERTF

SEQ ID NO: 161693 - protein, 9 aa, Homo Sapiens
LDVHPPAGP

SEQ ID NO: 161694 - protein, 9 aa, Homo Sapiens
VCPPPPGLP

SEQ ID NO: 161695 - protein, 9 aa, Homo Sapiens
TVYIIQATD

SEQ ID NO: 161696 - protein, 9 aa, Homo Sapiens
VIVLAIANT

SEQ ID NO: 161697 - protein, 9 aa, Homo Sapiens
PGSVWILPC

SEQ ID NO: 161698 - protein, 9 aa, Homo Sapiens
QSLCVASPG

SEQ ID NO: 161699 - protein, 9 aa, Homo Sapiens
SYVDDIKKD

SEQ ID NO: 161700 - protein, 9 aa, Homo Sapiens
HKEVFGTFR

SEQ ID NO: 161701 - protein, 9 aa, Homo Sapiens
GIKELACRF

SEQ ID NO: 161702 - protein, 9 aa, Homo Sapiens
EFAAKAVSE

SEQ ID NO: 161703 - protein, 9 aa, Homo Sapiens
PPPQAPSQV

SEQ ID NO: 161704 - protein, 9 aa, Homo Sapiens
TKYYELIVN

SEQ ID NO: 161705 - protein, 9 aa, Homo Sapiens
KLNLRDIVQ

SEQ ID NO: 161706 - protein, 9 aa, Homo Sapiens
RMTSAVLLT

SEQ ID NO: 161707 - protein, 9 aa, Homo Sapiens
SYLRCRDIA

SEQ ID NO: 161708 - protein, 9 aa, Homo Sapiens
KKARDALPF

SEQ ID NO: 161709 - protein, 9 aa, Homo Sapiens
EEKGEYGST

SEQ ID NO: 161710 - protein, 9 aa, Homo Sapiens
YNMIDDSTD

SEQ ID NO: 161711 - protein, 9 aa, Homo Sapiens
LFAKHHWLR

SEQ ID NO: 161712 - protein, 9 aa, Homo Sapiens
GGGQTPASL

SEQ ID NO: 161713 - protein, 9 aa, Homo Sapiens
LGVRRNNIQ

SEQ ID NO: 161714 - protein, 9 aa, Homo Sapiens
SVLTYPPGS

SEQ ID NO: 161715 - protein, 9 aa, Homo Sapiens
IVLVKMECW

SEQ ID NO: 161716 - protein, 9 aa, Homo Sapiens
SSTLTSTPS

SEQ ID NO: 161717 - protein, 9 aa, Homo Sapiens
MIEKLRAIC

SEQ ID NO: 161718 - protein, 9 aa, Homo Sapiens
ELDPEPMNP

SEQ ID NO: 161719 - protein, 9 aa, Homo Sapiens
GLPREPRHS

SEQ ID NO: 161720 - protein, 9 aa, Homo Sapiens
PQAPSQVWT

SEQ ID NO: 161721 - protein, 9 aa, Homo Sapiens
GEALNSDVR

SEQ ID NO: 161722 - protein, 9 aa, Homo Sapiens
DPYAKTYEG

SEQ ID NO: 161723 - protein, 9 aa, Homo Sapiens
SICVFLVRR

SEQ ID NO: 161724 - protein, 9 aa, Homo Sapiens
RASRRHPLS

SEQ ID NO: 161725 - protein, 9 aa, Homo Sapiens
SEVNRLKGD

SEQ ID NO: 161726 - protein, 9 aa, Homo Sapiens
QRNPTSRSS

SEQ ID NO: 161727 - protein, 9 aa, Homo Sapiens
PSGGDHFCL

SEQ ID NO: 161728 - protein, 9 aa, Homo Sapiens
SFIIRSLQH

SEQ ID NO: 161729 - protein, 9 aa, Homo Sapiens
AFAWKWEFI

SEQ ID NO: 161730 - protein, 9 aa, Homo Sapiens
PSHIFRRAW

SEQ ID NO: 161731 - protein, 9 aa, Homo Sapiens
VSSFEGKPG

SEQ ID NO: 161732 - protein, 9 aa, Homo Sapiens
LSYVDDIKK

SEQ ID NO: 161733 - protein, 9 aa, Homo Sapiens
EMEQIAEVE

SEQ ID NO: 161734 - protein, 9 aa, Homo Sapiens
MCKKMFEAE

SEQ ID NO: 161735 - protein, 9 aa, Homo Sapiens
VLLMLGLLI

SEQ ID NO: 161736 - protein, 9 aa, Homo Sapiens
RRLAVCPDL

SEQ ID NO: 161737 - protein, 9 aa, Homo Sapiens
FTNTSQLTM

SEQ ID NO: 161738 - protein, 9 aa, Homo Sapiens
YMLLVVMGL

SEQ ID NO: 161739 - protein, 9 aa, Homo Sapiens
LDPEPMNPF

SEQ ID NO: 161740 - protein, 9 aa, Homo Sapiens
WNAVPSHIF

SEQ ID NO: 161741 - protein, 9 aa, Homo Sapiens
MHQRRHTGE

SEQ ID NO: 161742 - protein, 9 aa, Homo Sapiens
ETYNTLMKT

SEQ ID NO: 161743 - protein, 9 aa, Homo Sapiens
FYVLEQQHI

SEQ ID NO: 161744 - protein, 9 aa, Homo Sapiens
ELEHQGNVL

SEQ ID NO: 161745 - protein, 9 aa, Homo Sapiens
AAQKCHKKT

SEQ ID NO: 161746 - protein, 9 aa, Homo Sapiens
RNLPMPTSA

SEQ ID NO: 161747 - protein, 9 aa, Homo Sapiens
RDVGDLKAL

SEQ ID NO: 161748 - protein, 9 aa, Homo Sapiens
AAEEFNDTD

SEQ ID NO: 161749 - protein, 9 aa, Homo Sapiens
TLINLLKNR

SEQ ID NO: 161750 - protein, 9 aa, Homo Sapiens
PSPSRSSIT

SEQ ID NO: 161751 - protein, 9 aa, Homo Sapiens
DDGIFWAAG

SEQ ID NO: 161752 - protein, 9 aa, Homo Sapiens
SSSSKQRSW

SEQ ID NO: 161753 - protein, 9 aa, Homo Sapiens
RGQRVQLPG

SEQ ID NO: 161754 - protein, 9 aa, Homo Sapiens
SAVLLTVLI

SEQ ID NO: 161755 - protein, 9 aa, Homo Sapiens
YTVYIIQAT

SEQ ID NO: 161756 - protein, 9 aa, Homo Sapiens
QRAFAWKWE

SEQ ID NO: 161757 - protein, 9 aa, Homo Sapiens
EDGSFKEQL

SEQ ID NO: 161758 - protein, 9 aa, Homo Sapiens
VLEQQHIGL

SEQ ID NO: 161759 - protein, 9 aa, Homo Sapiens
LYFSVDAES

SEQ ID NO: 161760 - protein, 9 aa, Homo Sapiens
CRFALTFGL

SEQ ID NO: 161761 - protein, 9 aa, Homo Sapiens
FVDDALTPS

SEQ ID NO: 161762 - protein, 9 aa, Homo Sapiens
AGATPSPGP

SEQ ID NO: 161763 - protein, 9 aa, Homo Sapiens
EKTVLFLWI

SEQ ID NO: 161764 - protein, 9 aa, Homo Sapiens
FSPLWLMTA

SEQ ID NO: 161765 - protein, 9 aa, Homo Sapiens
IFRRAWRKL

SEQ ID NO: 161766 - protein, 9 aa, Homo Sapiens
REERREVWV

SEQ ID NO: 161767 - protein, 9 aa, Homo Sapiens
EVFFFTIGI

SEQ ID NO: 161768 - protein, 9 aa, Homo Sapiens
GAAMEEVSP

SEQ ID NO: 161769 - protein, 9 aa, Homo Sapiens
YYRFGIQNG

SEQ ID NO: 161770 - protein, 9 aa, Homo Sapiens
PNLLPHQPP

SEQ ID NO: 161771 - protein, 9 aa, Homo Sapiens
VFLVVFLYM

SEQ ID NO: 161772 - protein, 9 aa, Homo Sapiens
ITRARKGRE

SEQ ID NO: 161773 - protein, 9 aa, Homo Sapiens
TRRAGGSQR

SEQ ID NO: 161774 - protein, 9 aa, Homo Sapiens
EMNQGISEE

SEQ ID NO: 161775 - protein, 9 aa, Homo Sapiens
LWCDCQARP

SEQ ID NO: 161776 - protein, 9 aa, Homo Sapiens
LKKKTYCYH

SEQ ID NO: 161777 - protein, 9 aa, Homo Sapiens
RAYPTVKIY

SEQ ID NO: 161778 - protein, 9 aa, Homo Sapiens
EKTCRMKRN

SEQ ID NO: 161779 - protein, 9 aa, Homo Sapiens
LPGLYRVSI

SEQ ID NO: 161780 - protein, 9 aa, Homo Sapiens
CLQTHCYKV

SEQ ID NO: 161781 - protein, 9 aa, Homo Sapiens
MCQFITATE

SEQ ID NO: 161782 - protein, 9 aa, Homo Sapiens
QPLNLEISA

SEQ ID NO: 161783 - protein, 9 aa, Homo Sapiens
KLGAPRPTW

SEQ ID NO: 161784 - protein, 9 aa, Homo Sapiens
SNALSFSSN

SEQ ID NO: 161785 - protein, 9 aa, Homo Sapiens
SVVWQAIKL

SEQ ID NO: 161786 - protein, 9 aa, Homo Sapiens
HSTPATSKA

SEQ ID NO: 161787 - protein, 9 aa, Homo Sapiens
HPSVVSNVF

SEQ ID NO: 161788 - protein, 9 aa, Homo Sapiens
TVRDVVVGR

SEQ ID NO: 161789 - protein, 9 aa, Homo Sapiens
LKDDFEVFF

SEQ ID NO: 161790 - protein, 9 aa, Homo Sapiens
KGQSGPGGA

SEQ ID NO: 161791 - protein, 9 aa, Homo Sapiens
SRATGLPRE

SEQ ID NO: 161792 - protein, 9 aa, Homo Sapiens
LVIPLNKST

SEQ ID NO: 161793 - protein, 9 aa, Homo Sapiens
EKQIWWTGW

SEQ ID NO: 161794 - protein, 9 aa, Homo Sapiens
TAKMASKSG

SEQ ID NO: 161795 - protein, 9 aa, Homo Sapiens
RRPATPPRT

SEQ ID NO: 161796 - protein, 9 aa, Homo Sapiens
TYYRFGIQN

SEQ ID NO: 161797 - protein, 9 aa, Homo Sapiens
SNVFPKGVE

SEQ ID NO: 161798 - protein, 9 aa, Homo Sapiens
RPPPLPTPA

SEQ ID NO: 161799 - protein, 9 aa, Homo Sapiens
SDCVQTTIC

SEQ ID NO: 161800 - protein, 9 aa, Homo Sapiens
DGEFFPHSH

SEQ ID NO: 161801 - protein, 9 aa, Homo Sapiens
IWWTGWPIP

SEQ ID NO: 161802 - protein, 9 aa, Homo Sapiens
ILLFISAFM

SEQ ID NO: 161803 - protein, 9 aa, Homo Sapiens
LYYPCEHMA

SEQ ID NO: 161804 - protein, 9 aa, Homo Sapiens
VAAAPGVLG

SEQ ID NO: 161805 - protein, 9 aa, Homo Sapiens
PHLGIVDEE

SEQ ID NO: 161806 - protein, 9 aa, Homo Sapiens
LIQGAPGRP

SEQ ID NO: 161807 - protein, 9 aa, Homo Sapiens
DWFPGRKQP

SEQ ID NO: 161808 - protein, 9 aa, Homo Sapiens
RGSVSTANY

SEQ ID NO: 161809 - protein, 9 aa, Homo Sapiens
SNVDTSGDH

SEQ ID NO: 161810 - protein, 9 aa, Homo Sapiens
LTQEFGSAV

SEQ ID NO: 161811 - protein, 9 aa, Homo Sapiens
TKVGTFIAP

SEQ ID NO: 161812 - protein, 9 aa, Homo Sapiens
APGRPKQLG

SEQ ID NO: 161813 - protein, 9 aa, Homo Sapiens
RSSRSVLLI

SEQ ID NO: 161814 - protein, 9 aa, Homo Sapiens
PLGDTPQPS

SEQ ID NO: 161815 - protein, 9 aa, Homo Sapiens
EQSLCVASP

SEQ ID NO: 161816 - protein, 9 aa, Homo Sapiens
KGVITYVIG

SEQ ID NO: 161817 - protein, 9 aa, Homo Sapiens
LDYMGTLFF

SEQ ID NO: 161818 - protein, 9 aa, Homo Sapiens
RRQRRLPSS

SEQ ID NO: 161819 - protein, 9 aa, Homo Sapiens
FLVDDLGGL

SEQ ID NO: 161820 - protein, 9 aa, Homo Sapiens
LPTPARSQL

SEQ ID NO: 161821 - protein, 9 aa, Homo Sapiens
PRNDVDPPG

SEQ ID NO: 161822 - protein, 9 aa, Homo Sapiens
RSQPIASIL

SEQ ID NO: 161823 - protein, 9 aa, Homo Sapiens
KNHHMGSPR

SEQ ID NO: 161824 - protein, 9 aa, Homo Sapiens
SGGEEKDGD

SEQ ID NO: 161825 - protein, 9 aa, Homo Sapiens
AGEQCRFQH

SEQ ID NO: 161826 - protein, 9 aa, Homo Sapiens
CDCQARPLL

SEQ ID NO: 161827 - protein, 9 aa, Homo Sapiens
QIWWTGWPI

SEQ ID NO: 161828 - protein, 9 aa, Homo Sapiens
DGIFWAAGP

SEQ ID NO: 161829 - protein, 9 aa, Homo Sapiens
TVGLYWAQD

SEQ ID NO: 161830 - protein, 9 aa, Homo Sapiens
LKGDFRAQE

SEQ ID NO: 161831 - protein, 9 aa, Homo Sapiens
SERFTSYQK

SEQ ID NO: 161832 - protein, 9 aa, Homo Sapiens
QWDLLHVPY

SEQ ID NO: 161833 - protein, 9 aa, Homo Sapiens
VHVLFVCQV

SEQ ID NO: 161834 - protein, 9 aa, Homo Sapiens
NGEDSLRDV

SEQ ID NO: 161835 - protein, 9 aa, Homo Sapiens
PCASLLSTL

SEQ ID NO: 161836 - protein, 9 aa, Homo Sapiens
WILSDKKEC

SEQ ID NO: 161837 - protein, 9 aa, Homo Sapiens
IAVMQPILR

SEQ ID NO: 161838 - protein, 9 aa, Homo Sapiens
VLIVVIDDG

SEQ ID NO: 161839 - protein, 9 aa, Homo Sapiens
LPLSFMLDV

SEQ ID NO: 161840 - protein, 9 aa, Homo Sapiens
YSFYEKGPS

SEQ ID NO: 161841 - protein, 9 aa, Homo Sapiens
FWAAGPDEA

SEQ ID NO: 161842 - protein, 9 aa, Homo Sapiens
PPRRRPATP

SEQ ID NO: 161843 - protein, 9 aa, Homo Sapiens
EQLAQLSWQ

SEQ ID NO: 161844 - protein, 9 aa, Homo Sapiens
AVMQPILRF

SEQ ID NO: 161845 - protein, 9 aa, Homo Sapiens
PHEFDFYLC

SEQ ID NO: 161846 - protein, 9 aa, Homo Sapiens
ECWPSTQEW

SEQ ID NO: 161847 - protein, 9 aa, Homo Sapiens
TIDNVSPHV

SEQ ID NO: 161848 - protein, 9 aa, Homo Sapiens
FNCIDEPSQ

SEQ ID NO: 161849 - protein, 9 aa, Homo Sapiens
CGDSSTCAQ

SEQ ID NO: 161850 - protein, 9 aa, Homo Sapiens
GGVGGLPSD

SEQ ID NO: 161851 - protein, 9 aa, Homo Sapiens
NVTAKMASK

SEQ ID NO: 161852 - protein, 9 aa, Homo Sapiens
DIKKDAELK

SEQ ID NO: 161853 - protein, 9 aa, Homo Sapiens
RSVQQSIIV

SEQ ID NO: 161854 - protein, 9 aa, Homo Sapiens
FGNFIWLPS

SEQ ID NO: 161855 - protein, 9 aa, Homo Sapiens
GLPSDPRGH

SEQ ID NO: 161856 - protein, 9 aa, Homo Sapiens
VCFLFFCQK

SEQ ID NO: 161857 - protein, 9 aa, Homo Sapiens
TSSWPSSST

SEQ ID NO: 161858 - protein, 9 aa, Homo Sapiens
LWSLCSLDL

SEQ ID NO: 161859 - protein, 9 aa, Homo Sapiens
TEATEHRRQ

SEQ ID NO: 161860 - protein, 9 aa, Homo Sapiens
LVVMGLSLL

SEQ ID NO: 161861 - protein, 9 aa, Homo Sapiens
TNKVIKKSR

SEQ ID NO: 161862 - protein, 9 aa, Homo Sapiens
DVRKKARDA

SEQ ID NO: 161863 - protein, 9 aa, Homo Sapiens
IYSKPCNHW

SEQ ID NO: 161864 - protein, 9 aa, Homo Sapiens
YFQFDAAMP

SEQ ID NO: 161865 - protein, 9 aa, Homo Sapiens
VMQPILRFL

SEQ ID NO: 161866 - protein, 9 aa, Homo Sapiens
YYEGETPST

SEQ ID NO: 161867 - protein, 9 aa, Homo Sapiens
KECGVAFSR

SEQ ID NO: 161868 - protein, 9 aa, Homo Sapiens
VNCVWWSNS

SEQ ID NO: 161869 - protein, 9 aa, Homo Sapiens
PGGGRGQEE

SEQ ID NO: 161870 - protein, 9 aa, Homo Sapiens
PHITGGTGL

SEQ ID NO: 161871 - protein, 9 aa, Homo Sapiens
AALQMHFNE

SEQ ID NO: 161872 - protein, 9 aa, Homo Sapiens
TGQMHPVPA

SEQ ID NO: 161873 - protein, 9 aa, Homo Sapiens
SGGEVIFTR

SEQ ID NO: 161874 - protein, 9 aa, Homo Sapiens
RLKKEKKPR

SEQ ID NO: 161875 - protein, 9 aa, Homo Sapiens
EDIVELKKI

SEQ ID NO: 161876 - protein, 9 aa, Homo Sapiens
DNPKRFNLF

SEQ ID NO: 161877 - protein, 9 aa, Homo Sapiens
EKSRMTSAV

SEQ ID NO: 161878 - protein, 9 aa, Homo Sapiens
AYEKSRMTS

SEQ ID NO: 161879 - protein, 9 aa, Homo Sapiens
PGQLCVIHC

SEQ ID NO: 161880 - protein, 9 aa, Homo Sapiens
VDTSGDHDD

SEQ ID NO: 161881 - protein, 9 aa, Homo Sapiens
PTVKIYFYE

SEQ ID NO: 161882 - protein, 9 aa, Homo Sapiens
RGIGLNGPE

SEQ ID NO: 161883 - protein, 9 aa, Homo Sapiens
RLKGDFRAQ

SEQ ID NO: 161884 - protein, 9 aa, Homo Sapiens
YEKSRMTSA

SEQ ID NO: 161885 - protein, 9 aa, Homo Sapiens
PASRATPGS

SEQ ID NO: 161886 - protein, 9 aa, Homo Sapiens
PPQLVPPEE

SEQ ID NO: 161887 - protein, 9 aa, Homo Sapiens
SAHCKLCLL

SEQ ID NO: 161888 - protein, 9 aa, Homo Sapiens
GEDSLRDVE

SEQ ID NO: 161889 - protein, 9 aa, Homo Sapiens
QNVFTGRAL

SEQ ID NO: 161890 - protein, 9 aa, Homo Sapiens
TGAGGGGFL

SEQ ID NO: 161891 - protein, 9 aa, Homo Sapiens
LKRRGIGLN

SEQ ID NO: 161892 - protein, 9 aa, Homo Sapiens
KKQKTDLMF

SEQ ID NO: 161893 - protein, 9 aa, Homo Sapiens
ELEKTCRMK

SEQ ID NO: 161894 - protein, 9 aa, Homo Sapiens
SVPEALPMP

SEQ ID NO: 161895 - protein, 9 aa, Homo Sapiens
MCCQFSFRM

SEQ ID NO: 161896 - protein, 9 aa, Homo Sapiens
TRIAAVILK

SEQ ID NO: 161897 - protein, 9 aa, Homo Sapiens
VTMSPAIAV

SEQ ID NO: 161898 - protein, 9 aa, Homo Sapiens
KQKTDLMFK

SEQ ID NO: 161899 - protein, 9 aa, Homo Sapiens
NSDVREKWK

SEQ ID NO: 161900 - protein, 9 aa, Homo Sapiens
TRHLVLWAD

SEQ ID NO: 161901 - protein, 9 aa, Homo Sapiens
MITRARKGR

SEQ ID NO: 161902 - protein, 9 aa, Homo Sapiens
VSPGFVPLG

SEQ ID NO: 161903 - protein, 9 aa, Homo Sapiens
DHHQQPGEA

SEQ ID NO: 161904 - protein, 9 aa, Homo Sapiens
KTVETCWRP

SEQ ID NO: 161905 - protein, 9 aa, Homo Sapiens
EKTLMKAVA

SEQ ID NO: 161906 - protein, 9 aa, Homo Sapiens
KCQHDFQKV

SEQ ID NO: 161907 - protein, 9 aa, Homo Sapiens
AFCVWESAT

SEQ ID NO: 161908 - protein, 9 aa, Homo Sapiens
KVRKKQKTD

SEQ ID NO: 161909 - protein, 9 aa, Homo Sapiens
SPRAAPLGL

SEQ ID NO: 161910 - protein, 9 aa, Homo Sapiens
QGAVQTNER

SEQ ID NO: 161911 - protein, 9 aa, Homo Sapiens
KKIRFCDIR

SEQ ID NO: 161912 - protein, 9 aa, Homo Sapiens
EGGQVLQRP

SEQ ID NO: 161913 - protein, 9 aa, Homo Sapiens
KAKASSTEA

SEQ ID NO: 161914 - protein, 9 aa, Homo Sapiens
LFQIRVFIG

SEQ ID NO: 161915 - protein, 9 aa, Homo Sapiens
EALPMPSTQ

SEQ ID NO: 161916 - protein, 9 aa, Homo Sapiens
MQGVLSDIN

SEQ ID NO: 161917 - protein, 9 aa, Homo Sapiens
PTSRSSRSV

SEQ ID NO: 161918 - protein, 9 aa, Homo Sapiens
TQELDILET

SEQ ID NO: 161919 - protein, 9 aa, Homo Sapiens
QFSFRMYQK

SEQ ID NO: 161920 - protein, 9 aa, Homo Sapiens
TPSSSTPAS

SEQ ID NO: 161921 - protein, 9 aa, Homo Sapiens
NVMWALDGL

SEQ ID NO: 161922 - protein, 9 aa, Homo Sapiens
LEPMAAGAT

SEQ ID NO: 161923 - protein, 9 aa, Homo Sapiens
LQKKQLAEQ

SEQ ID NO: 161924 - protein, 9 aa, Homo Sapiens
YIVLVKMEC

SEQ ID NO: 161925 - protein, 9 aa, Homo Sapiens
VYDLYLEGA

SEQ ID NO: 161926 - protein, 9 aa, Homo Sapiens
ASLEMNQGI

SEQ ID NO: 161927 - protein, 9 aa, Homo Sapiens
WFILWRGQT

SEQ ID NO: 161928 - protein, 9 aa, Homo Sapiens
DSGVYYCVT

SEQ ID NO: 161929 - protein, 9 aa, Homo Sapiens
EQLESKGRS

SEQ ID NO: 161930 - protein, 9 aa, Homo Sapiens
SLFIRAVWA

SEQ ID NO: 161931 - protein, 9 aa, Homo Sapiens
YLRCRDIAL

SEQ ID NO: 161932 - protein, 9 aa, Homo Sapiens
RATGLPREP

SEQ ID NO: 161933 - protein, 9 aa, Homo Sapiens
LNLEISAGP

SEQ ID NO: 161934 - protein, 9 aa, Homo Sapiens
PIQGTRYIC

SEQ ID NO: 161935 - protein, 9 aa, Homo Sapiens
VLQQRLGSW

SEQ ID NO: 161936 - protein, 9 aa, Homo Sapiens
GVVRGPPLH

SEQ ID NO: 161937 - protein, 9 aa, Homo Sapiens
RRTENGNLE

SEQ ID NO: 161938 - protein, 9 aa, Homo Sapiens
GVFYMLLVV

SEQ ID NO: 161939 - protein, 9 aa, Homo Sapiens
RGEDDEEED

SEQ ID NO: 161940 - protein, 9 aa, Homo Sapiens
GTVGLYWAQ

SEQ ID NO: 161941 - protein, 9 aa, Homo Sapiens
KSAAMTLSE

SEQ ID NO: 161942 - protein, 9 aa, Homo Sapiens
GQVLQRPQY

SEQ ID NO: 161943 - protein, 9 aa, Homo Sapiens
WIGCSLLFQ

SEQ ID NO: 161944 - protein, 9 aa, Homo Sapiens
NHWFQHDDS

SEQ ID NO: 161945 - protein, 9 aa, Homo Sapiens
SGHLLGGLS

SEQ ID NO: 161946 - protein, 9 aa, Homo Sapiens
GIFWAAGPD

SEQ ID NO: 161947 - protein, 9 aa, Homo Sapiens
GHTSTVCCM

SEQ ID NO: 161948 - protein, 9 aa, Homo Sapiens
KCTRLGTHL

SEQ ID NO: 161949 - protein, 9 aa, Homo Sapiens
YQMSGLIDN

SEQ ID NO: 161950 - protein, 9 aa, Homo Sapiens
LACVNCVWW

SEQ ID NO: 161951 - protein, 9 aa, Homo Sapiens
PGTSRVPRS

SEQ ID NO: 161952 - protein, 9 aa, Homo Sapiens
SSPHSMDSM

SEQ ID NO: 161953 - protein, 9 aa, Homo Sapiens
QCYFHDGDG

SEQ ID NO: 161954 - protein, 9 aa, Homo Sapiens
GHGPRKDEM

SEQ ID NO: 161955 - protein, 9 aa, Homo Sapiens
GSPRRCPHC

SEQ ID NO: 161956 - protein, 9 aa, Homo Sapiens
WRKRWFILW

SEQ ID NO: 161957 - protein, 9 aa, Homo Sapiens
GKTALAAKL

SEQ ID NO: 161958 - protein, 9 aa, Homo Sapiens
YLKTGQMHP

SEQ ID NO: 161959 - protein, 9 aa, Homo Sapiens
NFIWLPSNI

SEQ ID NO: 161960 - protein, 9 aa, Homo Sapiens
WQVCDFKQL

SEQ ID NO: 161961 - protein, 9 aa, Homo Sapiens
EKKSLTKLN

SEQ ID NO: 161962 - protein, 9 aa, Homo Sapiens
AFHRHPVAQ

SEQ ID NO: 161963 - protein, 9 aa, Homo Sapiens
MHFTVGKSR

SEQ ID NO: 161964 - protein, 9 aa, Homo Sapiens
VCLDGLDGE

SEQ ID NO: 161965 - protein, 9 aa, Homo Sapiens
TYNTLMKTL

SEQ ID NO: 161966 - protein, 9 aa, Homo Sapiens
KGREERREV

SEQ ID NO: 161967 - protein, 9 aa, Homo Sapiens
STANYIQLP

SEQ ID NO: 161968 - protein, 9 aa, Homo Sapiens
RIPFLLRIH

SEQ ID NO: 161969 - protein, 9 aa, Homo Sapiens
PPPPGLPHP

SEQ ID NO: 161970 - protein, 9 aa, Homo Sapiens
MAWAADARV

SEQ ID NO: 161971 - protein, 9 aa, Homo Sapiens
LAELDPEPM

SEQ ID NO: 161972 - protein, 9 aa, Homo Sapiens
AALIKIQEQ

SEQ ID NO: 161973 - protein, 9 aa, Homo Sapiens
PQLTSSPHS

SEQ ID NO: 161974 - protein, 9 aa, Homo Sapiens
GPAPHLGIV

SEQ ID NO: 161975 - protein, 9 aa, Homo Sapiens
LSDLEVLIV

SEQ ID NO: 161976 - protein, 9 aa, Homo Sapiens
AHAAWTHMQ

SEQ ID NO: 161977 - protein, 9 aa, Homo Sapiens
AWTHMQGFP

SEQ ID NO: 161978 - protein, 9 aa, Homo Sapiens
FERNVTAKM

SEQ ID NO: 161979 - protein, 9 aa, Homo Sapiens
KGVESVHVL

SEQ ID NO: 161980 - protein, 9 aa, Homo Sapiens
DVTNIRGEM

SEQ ID NO: 161981 - protein, 9 aa, Homo Sapiens
GQAYDAGEQ

SEQ ID NO: 161982 - protein, 9 aa, Homo Sapiens
PLTADSTTE

SEQ ID NO: 161983 - protein, 9 aa, Homo Sapiens
EHQGNVLVI

SEQ ID NO: 161984 - protein, 9 aa, Homo Sapiens
VELELKERE

SEQ ID NO: 161985 - protein, 9 aa, Homo Sapiens
DVKCLQTHC

SEQ ID NO: 161986 - protein, 9 aa, Homo Sapiens
ALLEKLFSQ

SEQ ID NO: 161987 - protein, 9 aa, Homo Sapiens
HITGGTGLL

SEQ ID NO: 161988 - protein, 9 aa, Homo Sapiens
SAPWRASCV

SEQ ID NO: 161989 - protein, 9 aa, Homo Sapiens
MHERVPKKK

SEQ ID NO: 161990 - protein, 9 aa, Homo Sapiens
FAVCDGSLW

SEQ ID NO: 161991 - protein, 9 aa, Homo Sapiens
GEGGSAPGT

SEQ ID NO: 161992 - protein, 9 aa, Homo Sapiens
LSYSYLAML

SEQ ID NO: 161993 - protein, 9 aa, Homo Sapiens
RNDVDPPGS

SEQ ID NO: 161994 - protein, 9 aa, Homo Sapiens
ILRDVGDLK

SEQ ID NO: 161995 - protein, 9 aa, Homo Sapiens
KQRSWVALR

SEQ ID NO: 161996 - protein, 9 aa, Homo Sapiens
CVIHCAHSF

SEQ ID NO: 161997 - protein, 9 aa, Homo Sapiens
DSTTEARSA

SEQ ID NO: 161998 - protein, 9 aa, Homo Sapiens
LDIKGQQRT

SEQ ID NO: 161999 - protein, 9 aa, Homo Sapiens
STMTGPMHF

SEQ ID NO: 162000 - protein, 9 aa, Homo Sapiens
TPSTASSRP

SEQ ID NO: 162001 - protein, 9 aa, Homo Sapiens
KGEYGSTSK

SEQ ID NO: 162002 - protein, 9 aa, Homo Sapiens
LWIGCSLLF

SEQ ID NO: 162003 - protein, 9 aa, Homo Sapiens
ILWRGQTSS

SEQ ID NO: 162004 - protein, 9 aa, Homo Sapiens
STPASRATP

SEQ ID NO: 162005 - protein, 9 aa, Homo Sapiens
SYLAMLVPV

SEQ ID NO: 162006 - protein, 9 aa, Homo Sapiens
SKPCNHWFQ

SEQ ID NO: 162007 - protein, 9 aa, Homo Sapiens
LWGVPQKPG

SEQ ID NO: 162008 - protein, 9 aa, Homo Sapiens
EELLMGEIQ

SEQ ID NO: 162009 - protein, 9 aa, Homo Sapiens
RHPLSHTAP

SEQ ID NO: 162010 - protein, 9 aa, Homo Sapiens
ENCRKPWNL

SEQ ID NO: 162011 - protein, 9 aa, Homo Sapiens
PVGPAPHLG

SEQ ID NO: 162012 - protein, 9 aa, Homo Sapiens
RVRTGQPAQ

SEQ ID NO: 162013 - protein, 9 aa, Homo Sapiens
LQHVDRACV

SEQ ID NO: 162014 - protein, 9 aa, Homo Sapiens
GGDHFCLGQ

SEQ ID NO: 162015 - protein, 9 aa, Homo Sapiens
RVHPHRVAQ

SEQ ID NO: 162016 - protein, 9 aa, Homo Sapiens
QYPVLQGTV

SEQ ID NO: 162017 - protein, 9 aa, Homo Sapiens
ELKKKTYCY

SEQ ID NO: 162018 - protein, 9 aa, Homo Sapiens
LLAAVTLAV

SEQ ID NO: 162019 - protein, 9 aa, Homo Sapiens
SDKKECAVE

SEQ ID NO: 162020 - protein, 9 aa, Homo Sapiens
WKYMTLINL

SEQ ID NO: 162021 - protein, 9 aa, Homo Sapiens
RALLEKLFS

SEQ ID NO: 162022 - protein, 9 aa, Homo Sapiens
PCRSFPSSH

SEQ ID NO: 162023 - protein, 9 aa, Homo Sapiens
LAAGLWWAS

SEQ ID NO: 162024 - protein, 9 aa, Homo Sapiens
DLDDFIGSS

SEQ ID NO: 162025 - protein, 9 aa, Homo Sapiens
TRLGTHLNM

SEQ ID NO: 162026 - protein, 9 aa, Homo Sapiens
GSVTQHLSH

SEQ ID NO: 162027 - protein, 9 aa, Homo Sapiens
DSAERGQRV

SEQ ID NO: 162028 - protein, 9 aa, Homo Sapiens
EVLQQRLGS

SEQ ID NO: 162029 - protein, 9 aa, Homo Sapiens
IVCTPQSPP

SEQ ID NO: 162030 - protein, 9 aa, Homo Sapiens
HYYEGETPS

SEQ ID NO: 162031 - protein, 9 aa, Homo Sapiens
SMCVERTFS

SEQ ID NO: 162032 - protein, 9 aa, Homo Sapiens
LRFKVLLML

SEQ ID NO: 162033 - protein, 9 aa, Homo Sapiens
SDFERNVTA

SEQ ID NO: 162034 - protein, 9 aa, Homo Sapiens
LHLRNTPTR

SEQ ID NO: 162035 - protein, 9 aa, Homo Sapiens
QFDAAMPLC

SEQ ID NO: 162036 - protein, 9 aa, Homo Sapiens
LTADSTTEA

SEQ ID NO: 162037 - protein, 9 aa, Homo Sapiens
DNGEDSLRD

SEQ ID NO: 162038 - protein, 9 aa, Homo Sapiens
VSLITLLRN

SEQ ID NO: 162039 - protein, 9 aa, Homo Sapiens
NSTAGAIGG

SEQ ID NO: 162040 - protein, 9 aa, Homo Sapiens
HSGMCVCPP

SEQ ID NO: 162041 - protein, 9 aa, Homo Sapiens
GTFRIPFLL

SEQ ID NO: 162042 - protein, 9 aa, Homo Sapiens
LAPLPTAGK

SEQ ID NO: 162043 - protein, 9 aa, Homo Sapiens
LTRHLVLWA

SEQ ID NO: 162044 - protein, 9 aa, Homo Sapiens
AVPFEPACL

SEQ ID NO: 162045 - protein, 9 aa, Homo Sapiens
EWDVKCLQT

SEQ ID NO: 162046 - protein, 9 aa, Homo Sapiens
KVGTFIAPP

SEQ ID NO: 162047 - protein, 9 aa, Homo Sapiens
CPPPPGLPH

SEQ ID NO: 162048 - protein, 9 aa, Homo Sapiens
KDGDEFQKS

SEQ ID NO: 162049 - protein, 9 aa, Homo Sapiens
VYVYDLYLE

SEQ ID NO: 162050 - protein, 9 aa, Homo Sapiens
IEAIPKPAI

SEQ ID NO: 162051 - protein, 9 aa, Homo Sapiens
WNLNQSAGS

SEQ ID NO: 162052 - protein, 9 aa, Homo Sapiens
LLPHQPPLL

SEQ ID NO: 162053 - protein, 9 aa, Homo Sapiens
YDYKAEAAV

SEQ ID NO: 162054 - protein, 9 aa, Homo Sapiens
TPHITGGTG

SEQ ID NO: 162055 - protein, 9 aa, Homo Sapiens
HVQEFEAFV

SEQ ID NO: 162056 - protein, 9 aa, Homo Sapiens
RAVWAYNGE

SEQ ID NO: 162057 - protein, 9 aa, Homo Sapiens
TPASLMITR

SEQ ID NO: 162058 - protein, 9 aa, Homo Sapiens
AAEFAAKAV

SEQ ID NO: 162059 - protein, 9 aa, Homo Sapiens
RLKLEQEIE

SEQ ID NO: 162060 - protein, 9 aa, Homo Sapiens
GEYGSTSKG

SEQ ID NO: 162061 - protein, 9 aa, Homo Sapiens
KTGQMHPVP

SEQ ID NO: 162062 - protein, 9 aa, Homo Sapiens
MKRNRKEEK

SEQ ID NO: 162063 - protein, 9 aa, Homo Sapiens
APLGLLQFV

SEQ ID NO: 162064 - protein, 9 aa, Homo Sapiens
LLLLPPPSP

SEQ ID NO: 162065 - protein, 9 aa, Homo Sapiens
CASLLSTLS

SEQ ID NO: 162066 - protein, 9 aa, Homo Sapiens
SPQRITSTQ

SEQ ID NO: 162067 - protein, 9 aa, Homo Sapiens
WTPIATMLR

SEQ ID NO: 162068 - protein, 9 aa, Homo Sapiens
RSKIEASPI

SEQ ID NO: 162069 - protein, 9 aa, Homo Sapiens
KIEASPIGS

SEQ ID NO: 162070 - protein, 9 aa, Homo Sapiens
AHGIVATAQ

SEQ ID NO: 162071 - protein, 9 aa, Homo Sapiens
KRRTENGNL

SEQ ID NO: 162072 - protein, 9 aa, Homo Sapiens
PRAAPLGLL

SEQ ID NO: 162073 - protein, 9 aa, Homo Sapiens
PIATMLRGQ

SEQ ID NO: 162074 - protein, 9 aa, Homo Sapiens
SLPPVTTYN

SEQ ID NO: 162075 - protein, 9 aa, Homo Sapiens
SKQRSWVAL

SEQ ID NO: 162076 - protein, 9 aa, Homo Sapiens
AVSCFQKNS

SEQ ID NO: 162077 - protein, 9 aa, Homo Sapiens
FMVRVPSSV

SEQ ID NO: 162078 - protein, 9 aa, Homo Sapiens
TTRFDSVSS

SEQ ID NO: 162079 - protein, 9 aa, Homo Sapiens
LINLLKNRT

SEQ ID NO: 162080 - protein, 9 aa, Homo Sapiens
LTYVAHTSV

SEQ ID NO: 162081 - protein, 9 aa, Homo Sapiens
ELSADVVEE

SEQ ID NO: 162082 - protein, 9 aa, Homo Sapiens
SQLTMHQRR

SEQ ID NO: 162083 - protein, 9 aa, Homo Sapiens
VQGAAHGIV

SEQ ID NO: 162084 - protein, 9 aa, Homo Sapiens
QPPPTMCQF

SEQ ID NO: 162085 - protein, 9 aa, Homo Sapiens
LRNTPTRLM

SEQ ID NO: 162086 - protein, 9 aa, Homo Sapiens
LIKIQEQSL

SEQ ID NO: 162087 - protein, 9 aa, Homo Sapiens
AAATECFLI

SEQ ID NO: 162088 - protein, 9 aa, Homo Sapiens
RARKGREER

SEQ ID NO: 162089 - protein, 9 aa, Homo Sapiens
CPDTVCLNH

SEQ ID NO: 162090 - protein, 9 aa, Homo Sapiens
ILIRAGALM

SEQ ID NO: 162091 - protein, 9 aa, Homo Sapiens
ILKLPSVQQ

SEQ ID NO: 162092 - protein, 9 aa, Homo Sapiens
ELYCPPSPS

SEQ ID NO: 162093 - protein, 9 aa, Homo Sapiens
EEGPFDHMF

SEQ ID NO: 162094 - protein, 9 aa, Homo Sapiens
ATVRDVVVG

SEQ ID NO: 162095 - protein, 9 aa, Homo Sapiens
STWPSSAAS

SEQ ID NO: 162096 - protein, 9 aa, Homo Sapiens
GSMRDKKRR

SEQ ID NO: 162097 - protein, 9 aa, Homo Sapiens
FCDIRSESI

SEQ ID NO: 162098 - protein, 9 aa, Homo Sapiens
TTAPPLSGK

SEQ ID NO: 162099 - protein, 9 aa, Homo Sapiens
VRIRAVGLL

SEQ ID NO: 162100 - protein, 9 aa, Homo Sapiens
PRKDEMTDE

SEQ ID NO: 162101 - protein, 9 aa, Homo Sapiens
ESEATINVK

SEQ ID NO: 162102 - protein, 9 aa, Homo Sapiens
PCNHWFQHD

SEQ ID NO: 162103 - protein, 9 aa, Homo Sapiens
VESVHVLFV

SEQ ID NO: 162104 - protein, 9 aa, Homo Sapiens
MFVSPGFVP

SEQ ID NO: 162105 - protein, 9 aa, Homo Sapiens
TMHQRRHTG

SEQ ID NO: 162106 - protein, 9 aa, Homo Sapiens
TECFLIALE

SEQ ID NO: 162107 - protein, 9 aa, Homo Sapiens
QLTMHQRRH

SEQ ID NO: 162108 - protein, 9 aa, Homo Sapiens
PVTEVDGVV

SEQ ID NO: 162109 - protein, 9 aa, Homo Sapiens
SHIFRRAWR

SEQ ID NO: 162110 - protein, 9 aa, Homo Sapiens
KRLKKEKKP

SEQ ID NO: 162111 - protein, 9 aa, Homo Sapiens
SQPIASILE

SEQ ID NO: 162112 - protein, 9 aa, Homo Sapiens
AVQTNERLK

SEQ ID NO: 162113 - protein, 9 aa, Homo Sapiens
GDTPQPSLP

SEQ ID NO: 162114 - protein, 9 aa, Homo Sapiens
VPLHLRNTP

SEQ ID NO: 162115 - protein, 9 aa, Homo Sapiens
IHRILPLTQ

SEQ ID NO: 162116 - protein, 9 aa, Homo Sapiens
FGNFAVCDG

SEQ ID NO: 162117 - protein, 9 aa, Homo Sapiens
EVLWILSDK

SEQ ID NO: 162118 - protein, 9 aa, Homo Sapiens
IELEKTCRM

SEQ ID NO: 162119 - protein, 9 aa, Homo Sapiens
NASSGHLLG

SEQ ID NO: 162120 - protein, 9 aa, Homo Sapiens
QQRDHHQQP

SEQ ID NO: 162121 - protein, 9 aa, Homo Sapiens
GGTSLLLIQ

SEQ ID NO: 162122 - protein, 9 aa, Homo Sapiens
GVLGSLHAG

SEQ ID NO: 162123 - protein, 9 aa, Homo Sapiens
EKVVELLKA

SEQ ID NO: 162124 - protein, 9 aa, Homo Sapiens
WGITALPSD

SEQ ID NO: 162125 - protein, 9 aa, Homo Sapiens
QIRVFIGAG

SEQ ID NO: 162126 - protein, 9 aa, Homo Sapiens
YFNSCPNAI

SEQ ID NO: 162127 - protein, 9 aa, Homo Sapiens
QLWWCGGGQ

SEQ ID NO: 162128 - protein, 9 aa, Homo Sapiens
LCSFSACCT

SEQ ID NO: 162129 - protein, 9 aa, Homo Sapiens
VEGEQHEKV

SEQ ID NO: 162130 - protein, 9 aa, Homo Sapiens
AAGGPARVR

SEQ ID NO: 162131 - protein, 9 aa, Homo Sapiens
QAGAAMEEV

SEQ ID NO: 162132 - protein, 9 aa, Homo Sapiens
ARVSEGARL

SEQ ID NO: 162133 - protein, 9 aa, Homo Sapiens
REENIGQRR

SEQ ID NO: 162134 - protein, 9 aa, Homo Sapiens
LGLLQFVDD

SEQ ID NO: 162135 - protein, 9 aa, Homo Sapiens
HLRDEGLRP

SEQ ID NO: 162136 - protein, 9 aa, Homo Sapiens
QEFEAFVAA

SEQ ID NO: 162137 - protein, 9 aa, Homo Sapiens
VFILDYMGT

SEQ ID NO: 162138 - protein, 9 aa, Homo Sapiens
LGLSDLEVL

SEQ ID NO: 162139 - protein, 9 aa, Homo Sapiens
FPQLTSSPH

SEQ ID NO: 162140 - protein, 9 aa, Homo Sapiens
TIHRILPLT

SEQ ID NO: 162141 - protein, 9 aa, Homo Sapiens
IQAGQLLVL

SEQ ID NO: 162142 - protein, 9 aa, Homo Sapiens
AHSGMCVCP

SEQ ID NO: 162143 - protein, 9 aa, Homo Sapiens
PLNKSTVLE

SEQ ID NO: 162144 - protein, 9 aa, Homo Sapiens
VNRLEEKKS

SEQ ID NO: 162145 - protein, 9 aa, Homo Sapiens
PQCNCPIMD

SEQ ID NO: 162146 - protein, 9 aa, Homo Sapiens
GREERREVW

SEQ ID NO: 162147 - protein, 9 aa, Homo Sapiens
PTPARSQLQ

SEQ ID NO: 162148 - protein, 9 aa, Homo Sapiens
SLVIPLNKS

SEQ ID NO: 162149 - protein, 9 aa, Homo Sapiens
WRASCVTPT

SEQ ID NO: 162150 - protein, 9 aa, Homo Sapiens
PRKVAHSDK

SEQ ID NO: 162151 - protein, 9 aa, Homo Sapiens
RERSQPIAS

SEQ ID NO: 162152 - protein, 9 aa, Homo Sapiens
FLSMFGHSV

SEQ ID NO: 162153 - protein, 9 aa, Homo Sapiens
ILSDKKECA

SEQ ID NO: 162154 - protein, 9 aa, Homo Sapiens
DGVVATDFF

SEQ ID NO: 162155 - protein, 9 aa, Homo Sapiens
IFKAGDDLC

SEQ ID NO: 162156 - protein, 9 aa, Homo Sapiens
ESPGGQEKK

SEQ ID NO: 162157 - protein, 9 aa, Homo Sapiens
EGARLGDYV

SEQ ID NO: 162158 - protein, 9 aa, Homo Sapiens
PGPCASLLS

SEQ ID NO: 162159 - protein, 9 aa, Homo Sapiens
LLPYFIQLS

SEQ ID NO: 162160 - protein, 9 aa, Homo Sapiens
DDFIGSSQE

SEQ ID NO: 162161 - protein, 9 aa, Homo Sapiens
SCPNAIVYG

SEQ ID NO: 162162 - protein, 9 aa, Homo Sapiens
QTPPGPPRR

SEQ ID NO: 162163 - protein, 9 aa, Homo Sapiens
ESSSFPLLK

SEQ ID NO: 162164 - protein, 9 aa, Homo Sapiens
RACVFWNAS

SEQ ID NO: 162165 - protein, 9 aa, Homo Sapiens
EAGHGPRKD

SEQ ID NO: 162166 - protein, 9 aa, Homo Sapiens
AILIMQGVL

SEQ ID NO: 162167 - protein, 9 aa, Homo Sapiens
PKPAIYNQL

SEQ ID NO: 162168 - protein, 9 aa, Homo Sapiens
ARWKYMTLI

SEQ ID NO: 162169 - protein, 9 aa, Homo Sapiens
IEASPIGSI

SEQ ID NO: 162170 - protein, 9 aa, Homo Sapiens
GQLCVIHCA

SEQ ID NO: 162171 - protein, 9 aa, Homo Sapiens
LPSDQFVVT

SEQ ID NO: 162172 - protein, 9 aa, Homo Sapiens
CCTSSWPSS

SEQ ID NO: 162173 - protein, 9 aa, Homo Sapiens
VGGLPSDPR

SEQ ID NO: 162174 - protein, 9 aa, Homo Sapiens
LGLLIEVSE

SEQ ID NO: 162175 - protein, 9 aa, Homo Sapiens
ALSFSSNAG

SEQ ID NO: 162176 - protein, 9 aa, Homo Sapiens
EKTIEDIVE

SEQ ID NO: 162177 - protein, 9 aa, Homo Sapiens
ASSRPGTSR

SEQ ID NO: 162178 - protein, 9 aa, Homo Sapiens
KPIQGTRYI

SEQ ID NO: 162179 - protein, 9 aa, Homo Sapiens
QEKTLMKAV

SEQ ID NO: 162180 - protein, 9 aa, Homo Sapiens
YIIQATDGS

SEQ ID NO: 162181 - protein, 9 aa, Homo Sapiens
LHLSSAVAN

SEQ ID NO: 162182 - protein, 9 aa, Homo Sapiens
VTEVDGVVA

SEQ ID NO: 162183 - protein, 9 aa, Homo Sapiens
RPGTSRVPR

SEQ ID NO: 162184 - protein, 9 aa, Homo Sapiens
LLDPNWLCP

SEQ ID NO: 162185 - protein, 9 aa, Homo Sapiens
FQKNSVQTT

SEQ ID NO: 162186 - protein, 9 aa, Homo Sapiens
GNPLWCDCQ

SEQ ID NO: 162187 - protein, 9 aa, Homo Sapiens
VRRFCCFGN

SEQ ID NO: 162188 - protein, 9 aa, Homo Sapiens
PYLKILLSK

SEQ ID NO: 162189 - protein, 9 aa, Homo Sapiens
RCRDIALNM

SEQ ID NO: 162190 - protein, 9 aa, Homo Sapiens
WQLSGREQE

SEQ ID NO: 162191 - protein, 9 aa, Homo Sapiens
YEGETPSTA

SEQ ID NO: 162192 - protein, 9 aa, Homo Sapiens
FLFFCQKSI

SEQ ID NO: 162193 - protein, 9 aa, Homo Sapiens
ALPMPSTQL

SEQ ID NO: 162194 - protein, 9 aa, Homo Sapiens
WWCGGGQTP

SEQ ID NO: 162195 - protein, 9 aa, Homo Sapiens
NPECKNLKW

SEQ ID NO: 162196 - protein, 9 aa, Homo Sapiens
ANVDRWDIA

SEQ ID NO: 162197 - protein, 9 aa, Homo Sapiens
MSRLLGGRW

SEQ ID NO: 162198 - protein, 9 aa, Homo Sapiens
DDLCQDMLV

SEQ ID NO: 162199 - protein, 9 aa, Homo Sapiens
PATSKAKAS

SEQ ID NO: 162200 - protein, 9 aa, Homo Sapiens
FEAEKVNCI

SEQ ID NO: 162201 - protein, 9 aa, Homo Sapiens
ARISQHGDS

SEQ ID NO: 162202 - protein, 9 aa, Homo Sapiens
HQQPGEAEP

SEQ ID NO: 162203 - protein, 9 aa, Homo Sapiens
DAILIMQGV

SEQ ID NO: 162204 - protein, 9 aa, Homo Sapiens
HSLAHLLLR

SEQ ID NO: 162205 - protein, 9 aa, Homo Sapiens
WGALPGSTR

SEQ ID NO: 162206 - protein, 9 aa, Homo Sapiens
RKPWNLNQS

SEQ ID NO: 162207 - protein, 9 aa, Homo Sapiens
QLPGGTSLL

SEQ ID NO: 162208 - protein, 9 aa, Homo Sapiens
APGVLGSLH

SEQ ID NO: 162209 - protein, 9 aa, Homo Sapiens
THRERAFDA

SEQ ID NO: 162210 - protein, 9 aa, Homo Sapiens
VLTRHLVLW

SEQ ID NO: 162211 - protein, 9 aa, Homo Sapiens
PKKSHCSRE

SEQ ID NO: 162212 - protein, 9 aa, Homo Sapiens
WRGSFCARW

SEQ ID NO: 162213 - protein, 9 aa, Homo Sapiens
SLYLSTPSS

SEQ ID NO: 162214 - protein, 9 aa, Homo Sapiens
AAAEEFNDT

SEQ ID NO: 162215 - protein, 9 aa, Homo Sapiens
VGDLKALAN

SEQ ID NO: 162216 - protein, 9 aa, Homo Sapiens
LVCFLFFCQ

SEQ ID NO: 162217 - protein, 9 aa, Homo Sapiens
AATLRCPAV

SEQ ID NO: 162218 - protein, 9 aa, Homo Sapiens
DEEELLMGE

SEQ ID NO: 162219 - protein, 9 aa, Homo Sapiens
MLLVVMGLS

SEQ ID NO: 162220 - protein, 9 aa, Homo Sapiens
SKSLYNLSV

SEQ ID NO: 162221 - protein, 9 aa, Homo Sapiens
EELYCPPSP

SEQ ID NO: 162222 - protein, 9 aa, Homo Sapiens
GMCVCPPPP

SEQ ID NO: 162223 - protein, 9 aa, Homo Sapiens
PQEKGQSGP

SEQ ID NO: 162224 - protein, 9 aa, Homo Sapiens
LDILETIML

SEQ ID NO: 162225 - protein, 9 aa, Homo Sapiens
AAMEEVSPY

SEQ ID NO: 162226 - protein, 9 aa, Homo Sapiens
AVSEQQADT

SEQ ID NO: 162227 - protein, 9 aa, Homo Sapiens
RQQLPVPKW

SEQ ID NO: 162228 - protein, 9 aa, Homo Sapiens
IIRSLQHFT

SEQ ID NO: 162229 - protein, 9 aa, Homo Sapiens
ARQRRKELQ

SEQ ID NO: 162230 - protein, 9 aa, Homo Sapiens
HMQGFPLGG

SEQ ID NO: 162231 - protein, 9 aa, Homo Sapiens
PSQVWTAAT

SEQ ID NO: 162232 - protein, 9 aa, Homo Sapiens
STLLANINS

SEQ ID NO: 162233 - protein, 9 aa, Homo Sapiens
APEGAWGAL

SEQ ID NO: 162234 - protein, 9 aa, Homo Sapiens
TDRNLPMPT

SEQ ID NO: 162235 - protein, 9 aa, Homo Sapiens
LSLDYQQRE

SEQ ID NO: 162236 - protein, 9 aa, Homo Sapiens
DVVVGRPSM

SEQ ID NO: 162237 - protein, 9 aa, Homo Sapiens
TSRVPRSSR

SEQ ID NO: 162238 - protein, 9 aa, Homo Sapiens
AAKAVSEQQ

SEQ ID NO: 162239 - protein, 9 aa, Homo Sapiens
RSLQHFTTG

SEQ ID NO: 162240 - protein, 9 aa, Homo Sapiens
IDEPSQCYF

SEQ ID NO: 162241 - protein, 9 aa, Homo Sapiens
KDDFEVFFF

SEQ ID NO: 162242 - protein, 9 aa, Homo Sapiens
TLSQPPPQA

SEQ ID NO: 162243 - protein, 9 aa, Homo Sapiens
SIEEKVAYP

SEQ ID NO: 162244 - protein, 9 aa, Homo Sapiens
PLTKKLYKQ

SEQ ID NO: 162245 - protein, 9 aa, Homo Sapiens
CKNLKWIGL

SEQ ID NO: 162246 - protein, 9 aa, Homo Sapiens
SAGSKWSRH

SEQ ID NO: 162247 - protein, 9 aa, Homo Sapiens
TVDVCLDGL

SEQ ID NO: 162248 - protein, 9 aa, Homo Sapiens
EDAILIMQG

SEQ ID NO: 162249 - protein, 9 aa, Homo Sapiens
GQTPASLMI

SEQ ID NO: 162250 - protein, 9 aa, Homo Sapiens
GEEKDGDEF

SEQ ID NO: 162251 - protein, 9 aa, Homo Sapiens
FGHSVVWQA

SEQ ID NO: 162252 - protein, 9 aa, Homo Sapiens
SWPSSSTLT

SEQ ID NO: 162253 - protein, 9 aa, Homo Sapiens
LIGLPHPSV

SEQ ID NO: 162254 - protein, 9 aa, Homo Sapiens
AMLWGGVGG

SEQ ID NO: 162255 - protein, 9 aa, Homo Sapiens
GNFIWLPSN

SEQ ID NO: 162256 - protein, 9 aa, Homo Sapiens
EPGAPRENG

SEQ ID NO: 162257 - protein, 9 aa, Homo Sapiens
QCNCPIMDI

SEQ ID NO: 162258 - protein, 9 aa, Homo Sapiens
AYDAGEQCR

SEQ ID NO: 162259 - protein, 9 aa, Homo Sapiens
LDPNWLCPP

SEQ ID NO: 162260 - protein, 9 aa, Homo Sapiens
GRRSPLMSS

SEQ ID NO: 162261 - protein, 9 aa, Homo Sapiens
LPSVQQKKK

SEQ ID NO: 162262 - protein, 9 aa, Homo Sapiens
LSKPPLVTV

SEQ ID NO: 162263 - protein, 9 aa, Homo Sapiens
RDRRKKKPI

SEQ ID NO: 162264 - protein, 9 aa, Homo Sapiens
EQCWTVRIR

SEQ ID NO: 162265 - protein, 9 aa, Homo Sapiens
VQPEEEERE

SEQ ID NO: 162266 - protein, 9 aa, Homo Sapiens
GDQYVCAIC

SEQ ID NO: 162267 - protein, 9 aa, Homo Sapiens
LVILALQDH

SEQ ID NO: 162268 - protein, 9 aa, Homo Sapiens
RETPAPRRM

SEQ ID NO: 162269 - protein, 9 aa, Homo Sapiens
CMLKKTSFI

SEQ ID NO: 162270 - protein, 9 aa, Homo Sapiens
MGPTEQDPY

SEQ ID NO: 162271 - protein, 9 aa, Homo Sapiens
RRGIGLNGP

SEQ ID NO: 162272 - protein, 9 aa, Homo Sapiens
MPTSAPTPG

SEQ ID NO: 162273 - protein, 9 aa, Homo Sapiens
VVWQAIKLL

SEQ ID NO: 162274 - protein, 9 aa, Homo Sapiens
CRDIALNMM

SEQ ID NO: 162275 - protein, 9 aa, Homo Sapiens
NQGISEERI

SEQ ID NO: 162276 - protein, 9 aa, Homo Sapiens
SGKSNVDTS

SEQ ID NO: 162277 - protein, 9 aa, Homo Sapiens
PLSFMLDVL

SEQ ID NO: 162278 - protein, 9 aa, Homo Sapiens
GSVQDDTPF

SEQ ID NO: 162279 - protein, 9 aa, Homo Sapiens
GCDGMEAMN

SEQ ID NO: 162280 - protein, 9 aa, Homo Sapiens
LPSNIYTGL

SEQ ID NO: 162281 - protein, 9 aa, Homo Sapiens
SKIEASPIG

SEQ ID NO: 162282 - protein, 9 aa, Homo Sapiens
EVIFTRDQH

SEQ ID NO: 162283 - protein, 9 aa, Homo Sapiens
SWVALRETP

SEQ ID NO: 162284 - protein, 9 aa, Homo Sapiens
PQDILRDVG

SEQ ID NO: 162285 - protein, 9 aa, Homo Sapiens
QQGLSLWGV

SEQ ID NO: 162286 - protein, 9 aa, Homo Sapiens
QFVDDALTP

SEQ ID NO: 162287 - protein, 9 aa, Homo Sapiens
TGWPIPWVK

SEQ ID NO: 162288 - protein, 9 aa, Homo Sapiens
ASRATPGSS

SEQ ID NO: 162289 - protein, 9 aa, Homo Sapiens
CTNKVIKKS

SEQ ID NO: 162290 - protein, 9 aa, Homo Sapiens
APPLSGKGN

SEQ ID NO: 162291 - protein, 9 aa, Homo Sapiens
PPPSPLPLA

SEQ ID NO: 162292 - protein, 9 aa, Homo Sapiens
KYMTLINLL

SEQ ID NO: 162293 - protein, 9 aa, Homo Sapiens
SAAGGPARV

SEQ ID NO: 162294 - protein, 9 aa, Homo Sapiens
VVVGRPSMD

SEQ ID NO: 162295 - protein, 9 aa, Homo Sapiens
GSAPGTAQQ

SEQ ID NO: 162296 - protein, 9 aa, Homo Sapiens
RAAAAAPVA

SEQ ID NO: 162297 - protein, 9 aa, Homo Sapiens
TASLAAGLW

SEQ ID NO: 162298 - protein, 9 aa, Homo Sapiens
TSLLLIQGA

SEQ ID NO: 162299 - protein, 9 aa, Homo Sapiens
LQRNPTSRS

SEQ ID NO: 162300 - protein, 9 aa, Homo Sapiens
SSSGPTAMN

SEQ ID NO: 162301 - protein, 9 aa, Homo Sapiens
WLCPPCRGI

SEQ ID NO: 162302 - protein, 9 aa, Homo Sapiens
ENVILLLLW

SEQ ID NO: 162303 - protein, 9 aa, Homo Sapiens
SSSTPASRA

SEQ ID NO: 162304 - protein, 9 aa, Homo Sapiens
AIKLLPYFI

SEQ ID NO: 162305 - protein, 9 aa, Homo Sapiens
VAFSRSKNL

SEQ ID NO: 162306 - protein, 9 aa, Homo Sapiens
VCDFKQLYI

SEQ ID NO: 162307 - protein, 9 aa, Homo Sapiens
PTVVPSSPS

SEQ ID NO: 162308 - protein, 9 aa, Homo Sapiens
PIMDIQIME

SEQ ID NO: 162309 - protein, 9 aa, Homo Sapiens
KKLYKQYAF

SEQ ID NO: 162310 - protein, 9 aa, Homo Sapiens
LQGNPLWCD

SEQ ID NO: 162311 - protein, 9 aa, Homo Sapiens
SLQHFTTGR

SEQ ID NO: 162312 - protein, 9 aa, Homo Sapiens
PQKLAYEKS

SEQ ID NO: 162313 - protein, 9 aa, Homo Sapiens
RGSFCARWQ

SEQ ID NO: 162314 - protein, 9 aa, Homo Sapiens
SVVELSADV

SEQ ID NO: 162315 - protein, 9 aa, Homo Sapiens
VVCHRSLDG

SEQ ID NO: 162316 - protein, 9 aa, Homo Sapiens
YVYFFCTVH

SEQ ID NO: 162317 - protein, 9 aa, Homo Sapiens
GDEEAIQPQ

SEQ ID NO: 162318 - protein, 9 aa, Homo Sapiens
TLTSTPSTW

SEQ ID NO: 162319 - protein, 9 aa, Homo Sapiens
EFTHDLFRF

SEQ ID NO: 162320 - protein, 9 aa, Homo Sapiens
SVTQHLSHR

SEQ ID NO: 162321 - protein, 9 aa, Homo Sapiens
FCTVHEILV

SEQ ID NO: 162322 - protein, 9 aa, Homo Sapiens
YMTLINLLK

SEQ ID NO: 162323 - protein, 9 aa, Homo Sapiens
RSSITASLA

SEQ ID NO: 162324 - protein, 9 aa, Homo Sapiens
SACCTSSWP

SEQ ID NO: 162325 - protein, 9 aa, Homo Sapiens
PHPPQLVPP

SEQ ID NO: 162326 - protein, 9 aa, Homo Sapiens
CFGNFIWLP

SEQ ID NO: 162327 - protein, 9 aa, Homo Sapiens
PCGDSSTCA

SEQ ID NO: 162328 - protein, 9 aa, Homo Sapiens
PPPLPTPAR

SEQ ID NO: 162329 - protein, 9 aa, Homo Sapiens
FDKKIRFCD

SEQ ID NO: 162330 - protein, 9 aa, Homo Sapiens
EEVSPYSLL

SEQ ID NO: 162331 - protein, 9 aa, Homo Sapiens
GVVEVWQVC

SEQ ID NO: 162332 - protein, 9 aa, Homo Sapiens
PCEHMAWAA

SEQ ID NO: 162333 - protein, 9 aa, Homo Sapiens
GESTALFAK

SEQ ID NO: 162334 - protein, 9 aa, Homo Sapiens
AASVPEALP

SEQ ID NO: 162335 - protein, 9 aa, Homo Sapiens
PPLSGKGNP

SEQ ID NO: 162336 - protein, 9 aa, Homo Sapiens
EVSPYSLLD

SEQ ID NO: 162337 - protein, 9 aa, Homo Sapiens
ALIKIQEQS

SEQ ID NO: 162338 - protein, 9 aa, Homo Sapiens
PPQAPSQVW

SEQ ID NO: 162339 - protein, 9 aa, Homo Sapiens
GMEAMNGAG

SEQ ID NO: 162340 - protein, 9 aa, Homo Sapiens
STQHYYEGE

SEQ ID NO: 162341 - protein, 9 aa, Homo Sapiens
GCAIDARSI

SEQ ID NO: 162342 - protein, 9 aa, Homo Sapiens
PSTWPSSAA

SEQ ID NO: 162343 - protein, 9 aa, Homo Sapiens
LLEDAILIM

SEQ ID NO: 162344 - protein, 9 aa, Homo Sapiens
LVRRFCCFG

SEQ ID NO: 162345 - protein, 9 aa, Homo Sapiens
YDLYLEGAG

SEQ ID NO: 162346 - protein, 9 aa, Homo Sapiens
LVLRFKVLL

SEQ ID NO: 162347 - protein, 9 aa, Homo Sapiens
EATEHRRQR

SEQ ID NO: 162348 - protein, 9 aa, Homo Sapiens
MSRTMEDSC

SEQ ID NO: 162349 - protein, 9 aa, Homo Sapiens
PRENGEFCK

SEQ ID NO: 162350 - protein, 9 aa, Homo Sapiens
ITGGTGLLL

SEQ ID NO: 162351 - protein, 9 aa, Homo Sapiens
YACQKGCSF

SEQ ID NO: 162352 - protein, 9 aa, Homo Sapiens
GSFCARWQS

SEQ ID NO: 162353 - protein, 9 aa, Homo Sapiens
RMRASRRHP

SEQ ID NO: 162354 - protein, 9 aa, Homo Sapiens
LLVVMGLSL

SEQ ID NO: 162355 - protein, 9 aa, Homo Sapiens
TRSQMLSCI

SEQ ID NO: 162356 - protein, 9 aa, Homo Sapiens
RRAGGSQRP

SEQ ID NO: 162357 - protein, 9 aa, Homo Sapiens
KEWDESKMK

SEQ ID NO: 162358 - protein, 9 aa, Homo Sapiens
LFFVLVNLE

SEQ ID NO: 162359 - protein, 9 aa, Homo Sapiens
LAYFNSCPN

SEQ ID NO: 162360 - protein, 9 aa, Homo Sapiens
ATGLPREPR

SEQ ID NO: 162361 - protein, 9 aa, Homo Sapiens
ECMLKKTSF

SEQ ID NO: 162362 - protein, 9 aa, Homo Sapiens
SPVPPCGDS

SEQ ID NO: 162363 - protein, 9 aa, Homo Sapiens
RKCQHDFQK

SEQ ID NO: 162364 - protein, 9 aa, Homo Sapiens
QQREELASC

SEQ ID NO: 162365 - protein, 9 aa, Homo Sapiens
DSVSSFEGK

SEQ ID NO: 162366 - protein, 9 aa, Homo Sapiens
AGSKWSRHL

SEQ ID NO: 162367 - protein, 9 aa, Homo Sapiens
GGSAPGTAQ

SEQ ID NO: 162368 - protein, 9 aa, Homo Sapiens
FLNSTAGAI

SEQ ID NO: 162369 - protein, 9 aa, Homo Sapiens
IIDAHANEE

SEQ ID NO: 162370 - protein, 9 aa, Homo Sapiens
TVVPSSPSV

SEQ ID NO: 162371 - protein, 9 aa, Homo Sapiens
AGAAMEEVS

SEQ ID NO: 162372 - protein, 9 aa, Homo Sapiens
AFCYDCEFR

SEQ ID NO: 162373 - protein, 9 aa, Homo Sapiens
QNGKCPGQL

SEQ ID NO: 162374 - protein, 9 aa, Homo Sapiens
SDKYQMSGL

SEQ ID NO: 162375 - protein, 9 aa, Homo Sapiens
FEPACLLPL

SEQ ID NO: 162376 - protein, 9 aa, Homo Sapiens
PQSLVIPLN

SEQ ID NO: 162377 - protein, 9 aa, Homo Sapiens
RSQMLSCIH

SEQ ID NO: 162378 - protein, 9 aa, Homo Sapiens
PGSTRRAGG

SEQ ID NO: 162379 - protein, 9 aa, Homo Sapiens
EKGEYGSTS

SEQ ID NO: 162380 - protein, 9 aa, Homo Sapiens
LEVLIVVID

SEQ ID NO: 162381 - protein, 9 aa, Homo Sapiens
DSSTCAQRW

SEQ ID NO: 162382 - protein, 9 aa, Homo Sapiens
YGSTSKGGR

SEQ ID NO: 162383 - protein, 9 aa, Homo Sapiens
DYMGTLFFL

SEQ ID NO: 162384 - protein, 9 aa, Homo Sapiens
CSLLFQIRV

SEQ ID NO: 162385 - protein, 9 aa, Homo Sapiens
YNTLMKTLQ

SEQ ID NO: 162386 - protein, 9 aa, Homo Sapiens
PDTVCLNHG

SEQ ID NO: 162387 - protein, 9 aa, Homo Sapiens
YTGVYILIR

SEQ ID NO: 162388 - protein, 9 aa, Homo Sapiens
PNAIVYGLL

SEQ ID NO: 162389 - protein, 9 aa, Homo Sapiens
NGKCPGQLC

SEQ ID NO: 162390 - protein, 9 aa, Homo Sapiens
LQRPQYPVL

SEQ ID NO: 162391 - protein, 9 aa, Homo Sapiens
PSLPGPCAS

SEQ ID NO: 162392 - protein, 9 aa, Homo Sapiens
EMALHMAAR

SEQ ID NO: 162393 - protein, 9 aa, Homo Sapiens
DFGNFAVCD

SEQ ID NO: 162394 - protein, 9 aa, Homo Sapiens
GLIGLPHPS

SEQ ID NO: 162395 - protein, 9 aa, Homo Sapiens
VVRCCTQAS

SEQ ID NO: 162396 - protein, 9 aa, Homo Sapiens
PESPGGQEK

SEQ ID NO: 162397 - protein, 9 aa, Homo Sapiens
SWRGSFCAR

SEQ ID NO: 162398 - protein, 9 aa, Homo Sapiens
ILRLSLDYQ

SEQ ID NO: 162399 - protein, 9 aa, Homo Sapiens
ARKGREERR

SEQ ID NO: 162400 - protein, 9 aa, Homo Sapiens
AGLWWASVP

SEQ ID NO: 162401 - protein, 9 aa, Homo Sapiens
CSTMTGPMH

SEQ ID NO: 162402 - protein, 9 aa, Homo Sapiens
SWAQKAAPH

SEQ ID NO: 162403 - protein, 9 aa, Homo Sapiens
PSEVNRLKG

SEQ ID NO: 162404 - protein, 9 aa, Homo Sapiens
NGIKTVETC

SEQ ID NO: 162405 - protein, 9 aa, Homo Sapiens
GAPRENGEF

SEQ ID NO: 162406 - protein, 9 aa, Homo Sapiens
VGPAPHLGI

SEQ ID NO: 162407 - protein, 9 aa, Homo Sapiens
PNSPSETHR

SEQ ID NO: 162408 - protein, 9 aa, Homo Sapiens
PSSAASVPE

SEQ ID NO: 162409 - protein, 9 aa, Homo Sapiens
KPWNLNQSA

SEQ ID NO: 162410 - protein, 9 aa, Homo Sapiens
YTGLFLFTF

SEQ ID NO: 162411 - protein, 9 aa, Homo Sapiens
TALPSDQFV

SEQ ID NO: 162412 - protein, 9 aa, Homo Sapiens
RSVCTDKLS

SEQ ID NO: 162413 - protein, 9 aa, Homo Sapiens
FIENVILLL

SEQ ID NO: 162414 - protein, 9 aa, Homo Sapiens
GNGPPPTVV

SEQ ID NO: 162415 - protein, 9 aa, Homo Sapiens
CKKCAKAFS

SEQ ID NO: 162416 - protein, 9 aa, Homo Sapiens
KKSHCSREE

SEQ ID NO: 162417 - protein, 9 aa, Homo Sapiens
DPQEKGQSG

SEQ ID NO: 162418 - protein, 9 aa, Homo Sapiens
APQPPPTMC

SEQ ID NO: 162419 - protein, 9 aa, Homo Sapiens
YGHTSTVCC

SEQ ID NO: 162420 - protein, 9 aa, Homo Sapiens
YVDDIKKDA

SEQ ID NO: 162421 - protein, 9 aa, Homo Sapiens
GSFKEQLES

SEQ ID NO: 162422 - protein, 9 aa, Homo Sapiens
EKAFRHSSY

SEQ ID NO: 162423 - protein, 9 aa, Homo Sapiens
TGPMHFTVG

SEQ ID NO: 162424 - protein, 9 aa, Homo Sapiens
LAAVTLAVS

SEQ ID NO: 162425 - protein, 9 aa, Homo Sapiens
PSSSGPTAM

SEQ ID NO: 162426 - protein, 9 aa, Homo Sapiens
PKQLGPARS

SEQ ID NO: 162427 - protein, 9 aa, Homo Sapiens
VFFFTIGIT

SEQ ID NO: 162428 - protein, 9 aa, Homo Sapiens
FRGVQCTNS

SEQ ID NO: 162429 - protein, 9 aa, Homo Sapiens
CPGQLCVIH

SEQ ID NO: 162430 - protein, 9 aa, Homo Sapiens
ADSTTEARS

SEQ ID NO: 162431 - protein, 9 aa, Homo Sapiens
VNRLKGDFR

SEQ ID NO: 162432 - protein, 9 aa, Homo Sapiens
AALFLKKSV

SEQ ID NO: 162433 - protein, 9 aa, Homo Sapiens
AGESTALFA

SEQ ID NO: 162434 - protein, 9 aa, Homo Sapiens
NRLKGDFRA

SEQ ID NO: 162435 - protein, 9 aa, Homo Sapiens
KPSLYLSTP

SEQ ID NO: 162436 - protein, 9 aa, Homo Sapiens
SQVWTAATL

SEQ ID NO: 162437 - protein, 9 aa, Homo Sapiens
TPARSQLQS

SEQ ID NO: 162438 - protein, 9 aa, Homo Sapiens
QSLTGAGGG

SEQ ID NO: 162439 - protein, 9 aa, Homo Sapiens
DPSGGDHFC

SEQ ID NO: 162440 - protein, 9 aa, Homo Sapiens
AMWLSASHF

SEQ ID NO: 162441 - protein, 9 aa, Homo Sapiens
SEDGSFKEQ

SEQ ID NO: 162442 - protein, 9 aa, Homo Sapiens
EQQHIGLAV

SEQ ID NO: 162443 - protein, 9 aa, Homo Sapiens
ESGKSNVDT

SEQ ID NO: 162444 - protein, 9 aa, Homo Sapiens
AEFAAKAVS

SEQ ID NO: 162445 - protein, 9 aa, Homo Sapiens
MFGHSVVWQ

SEQ ID NO: 162446 - protein, 9 aa, Homo Sapiens
AGPDEADTL

SEQ ID NO: 162447 - protein, 9 aa, Homo Sapiens
RVCEGGQVL

SEQ ID NO: 162448 - protein, 9 aa, Homo Sapiens
RLLGGRWSA

SEQ ID NO: 162449 - protein, 9 aa, Homo Sapiens
MTGPMHFTV

SEQ ID NO: 162450 - protein, 9 aa, Homo Sapiens
DDDRLAFHR

SEQ ID NO: 162451 - protein, 9 aa, Homo Sapiens
VRVQPMAKA

SEQ ID NO: 162452 - protein, 9 aa, Homo Sapiens
QKLYTKEWD

SEQ ID NO: 162453 - protein, 9 aa, Homo Sapiens
MTSAVLLTV

SEQ ID NO: 162454 - protein, 9 aa, Homo Sapiens
NSFYAHTTV

SEQ ID NO: 162455 - protein, 9 aa, Homo Sapiens
NEKDADVIL

SEQ ID NO: 162456 - protein, 9 aa, Homo Sapiens
LFLWIGCSL

SEQ ID NO: 162457 - protein, 9 aa, Homo Sapiens
LMPPDSTMI

SEQ ID NO: 162458 - protein, 9 aa, Homo Sapiens
ICVFLVRRF

SEQ ID NO: 162459 - protein, 9 aa, Homo Sapiens
PLWCDCQAR

SEQ ID NO: 162460 - protein, 9 aa, Homo Sapiens
DVDPPGSVW

SEQ ID NO: 162461 - protein, 9 aa, Homo Sapiens
TPSPGPGPG

SEQ ID NO: 162462 - protein, 9 aa, Homo Sapiens
SREENIGQR

SEQ ID NO: 162463 - protein, 9 aa, Homo Sapiens
CRMKRNRKE

SEQ ID NO: 162464 - protein, 9 aa, Homo Sapiens
NTSQLTMHQ

SEQ ID NO: 162465 - protein, 9 aa, Homo Sapiens
LAFLVDDLG

SEQ ID NO: 162466 - protein, 9 aa, Homo Sapiens
VTLAVSPLL

SEQ ID NO: 162467 - protein, 9 aa, Homo Sapiens
SSRRTPSSS

SEQ ID NO: 162468 - protein, 9 aa, Homo Sapiens
KLYKQYAFL

SEQ ID NO: 162469 - protein, 9 aa, Homo Sapiens
RIRGSVSTA

SEQ ID NO: 162470 - protein, 9 aa, Homo Sapiens
GKQRLKLEQ

SEQ ID NO: 162471 - protein, 9 aa, Homo Sapiens
NLRDIVQVV

SEQ ID NO: 162472 - protein, 9 aa, Homo Sapiens
AGDDLCQDM

SEQ ID NO: 162473 - protein, 9 aa, Homo Sapiens
ELKEREMCC

SEQ ID NO: 162474 - protein, 9 aa, Homo Sapiens
LGGRWSASA

SEQ ID NO: 162475 - protein, 9 aa, Homo Sapiens
YLAMLVPVF

SEQ ID NO: 162476 - protein, 9 aa, Homo Sapiens
NVDRWDIAC

SEQ ID NO: 162477 - protein, 9 aa, Homo Sapiens
LLFISAFMV

SEQ ID NO: 162478 - protein, 9 aa, Homo Sapiens
RITSTQQQT

SEQ ID NO: 162479 - protein, 9 aa, Homo Sapiens
WSRHLSKPP

SEQ ID NO: 162480 - protein, 9 aa, Homo Sapiens
LPMPTSAPT

SEQ ID NO: 162481 - protein, 9 aa, Homo Sapiens
RRVHPHRVA

SEQ ID NO: 162482 - protein, 9 aa, Homo Sapiens
TDLDDFIGS

SEQ ID NO: 162483 - protein, 9 aa, Homo Sapiens
CEGGQVLQR

SEQ ID NO: 162484 - protein, 9 aa, Homo Sapiens
TMTGPMHFT

SEQ ID NO: 162485 - protein, 9 aa, Homo Sapiens
CQVPGVVAV

SEQ ID NO: 162486 - protein, 9 aa, Homo Sapiens
LGAPRPTWA

SEQ ID NO: 162487 - protein, 9 aa, Homo Sapiens
MNRASMEIT

SEQ ID NO: 162488 - protein, 9 aa, Homo Sapiens
HFDKKIRFC

SEQ ID NO: 162489 - protein, 9 aa, Homo Sapiens
VDRACVFWN

SEQ ID NO: 162490 - protein, 9 aa, Homo Sapiens
RLPSSSGPT

SEQ ID NO: 162491 - protein, 9 aa, Homo Sapiens
ISEERIHLG

SEQ ID NO: 162492 - protein, 9 aa, Homo Sapiens
SGPGGAAGI

SEQ ID NO: 162493 - protein, 9 aa, Homo Sapiens
SGHNASSGH

SEQ ID NO: 162494 - protein, 9 aa, Homo Sapiens
EEELLMGEI

SEQ ID NO: 162495 - protein, 9 aa, Homo Sapiens
SYTRIAAVI

SEQ ID NO: 162496 - protein, 9 aa, Homo Sapiens
AAAAPVASS

SEQ ID NO: 162497 - protein, 9 aa, Homo Sapiens
GHLLGGLSL

SEQ ID NO: 162498 - protein, 9 aa, Homo Sapiens
KAHEGYACQ

SEQ ID NO: 162499 - protein, 9 aa, Homo Sapiens
PGTKDNVMW

SEQ ID NO: 162500 - protein, 9 aa, Homo Sapiens
TGRLMTRSL

SEQ ID NO: 162501 - protein, 9 aa, Homo Sapiens
KLNKVRKKQ

SEQ ID NO: 162502 - protein, 9 aa, Homo Sapiens
FTRGRERSQ

SEQ ID NO: 162503 - protein, 9 aa, Homo Sapiens
LDGELGPVG

SEQ ID NO: 162504 - protein, 9 aa, Homo Sapiens
GKCPGQLCV

SEQ ID NO: 162505 - protein, 9 aa, Homo Sapiens
SWQLSGREQ

SEQ ID NO: 162506 - protein, 9 aa, Homo Sapiens
SLLSNTFTE

SEQ ID NO: 162507 - protein, 9 aa, Homo Sapiens
ISQKLYTKE

SEQ ID NO: 162508 - protein, 9 aa, Homo Sapiens
GEQCRFQHG

SEQ ID NO: 162509 - protein, 9 aa, Homo Sapiens
GAPGRPKQL

SEQ ID NO: 162510 - protein, 9 aa, Homo Sapiens
TNSRDGFQC

SEQ ID NO: 162511 - protein, 9 aa, Homo Sapiens
RGVVRGPPL

SEQ ID NO: 162512 - protein, 9 aa, Homo Sapiens
MTLINLLKN

SEQ ID NO: 162513 - protein, 9 aa, Homo Sapiens
WASVPSAPW

SEQ ID NO: 162514 - protein, 9 aa, Homo Sapiens
PRHSTPATS

SEQ ID NO: 162515 - protein, 9 aa, Homo Sapiens
NCPIMDIQI

SEQ ID NO: 162516 - protein, 9 aa, Homo Sapiens
AELDPEPMN

SEQ ID NO: 162517 - protein, 9 aa, Homo Sapiens
QLLVLATLC

SEQ ID NO: 162518 - protein, 9 aa, Homo Sapiens
QRRKELQKK

SEQ ID NO: 162519 - protein, 9 aa, Homo Sapiens
FQLTRSQML

SEQ ID NO: 162520 - protein, 9 aa, Homo Sapiens
GKSNVDTSG

SEQ ID NO: 162521 - protein, 9 aa, Homo Sapiens
VILAAGDSE

SEQ ID NO: 162522 - protein, 9 aa, Homo Sapiens
QAELQGAVQ

SEQ ID NO: 162523 - protein, 9 aa, Homo Sapiens
QMSGLIDNA

SEQ ID NO: 162524 - protein, 9 aa, Homo Sapiens
KRRLAVCPD

SEQ ID NO: 162525 - protein, 9 aa, Homo Sapiens
DADVILAAG

SEQ ID NO: 162526 - protein, 9 aa, Homo Sapiens
CVWESATPL

SEQ ID NO: 162527 - protein, 9 aa, Homo Sapiens
TVLFLWIGC

SEQ ID NO: 162528 - protein, 9 aa, Homo Sapiens
STPSTWPSS

SEQ ID NO: 162529 - protein, 9 aa, Homo Sapiens
IIPTKVGTF

SEQ ID NO: 162530 - protein, 9 aa, Homo Sapiens
LPMPSTQLL

SEQ ID NO: 162531 - protein, 9 aa, Homo Sapiens
CLEAEMSKR

SEQ ID NO: 162532 - protein, 9 aa, Homo Sapiens
FNSCPNAIV

SEQ ID NO: 162533 - protein, 9 aa, Homo Sapiens
HKLVEAKDE

SEQ ID NO: 162534 - protein, 9 aa, Homo Sapiens
RRRVHPHRV

SEQ ID NO: 162535 - protein, 9 aa, Homo Sapiens
SSPRAPISP

SEQ ID NO: 162536 - protein, 9 aa, Homo Sapiens
KARDALPFF

SEQ ID NO: 162537 - protein, 9 aa, Homo Sapiens
YTLRTQAIN

SEQ ID NO: 162538 - protein, 9 aa, Homo Sapiens
LIVVIDDGI

SEQ ID NO: 162539 - protein, 9 aa, Homo Sapiens
SQPPPQAPS

SEQ ID NO: 162540 - protein, 9 aa, Homo Sapiens
EHRRQRRLP

SEQ ID NO: 162541 - protein, 9 aa, Homo Sapiens
THDLFRFLQ

SEQ ID NO: 162542 - protein, 9 aa, Homo Sapiens
STKQELMDF

SEQ ID NO: 162543 - protein, 9 aa, Homo Sapiens
FTCVVCHRS

SEQ ID NO: 162544 - protein, 9 aa, Homo Sapiens
PRPPPLPTP

SEQ ID NO: 162545 - protein, 9 aa, Homo Sapiens
SAPGTAQQP

SEQ ID NO: 162546 - protein, 9 aa, Homo Sapiens
CTRLGTHLN

SEQ ID NO: 162547 - protein, 9 aa, Homo Sapiens
NCRKPWNLN

SEQ ID NO: 162548 - protein, 9 aa, Homo Sapiens
QSLARQFFG

SEQ ID NO: 162549 - protein, 9 aa, Homo Sapiens
RTKYYELIV

SEQ ID NO: 162550 - protein, 9 aa, Homo Sapiens
PEALPMPST

SEQ ID NO: 162551 - protein, 9 aa, Homo Sapiens
RDIALNMMA

SEQ ID NO: 162552 - protein, 9 aa, Homo Sapiens
DTSGDHDDS

SEQ ID NO: 162553 - protein, 9 aa, Homo Sapiens
KCLQTHCYK

SEQ ID NO: 162554 - protein, 9 aa, Homo Sapiens
AHANEEIDT

SEQ ID NO: 162555 - protein, 9 aa, Homo Sapiens
PWRASCVTP

SEQ ID NO: 162556 - protein, 9 aa, Homo Sapiens
ARLQRAFAW

SEQ ID NO: 162557 - protein, 9 aa, Homo Sapiens
QYAFLRCEE

SEQ ID NO: 162558 - protein, 9 aa, Homo Sapiens
HVFILDYMG

SEQ ID NO: 162559 - protein, 9 aa, Homo Sapiens
GPTAMNRAS

SEQ ID NO: 162560 - protein, 9 aa, Homo Sapiens
CFLIALELE

SEQ ID NO: 162561 - protein, 9 aa, Homo Sapiens
SFSACCTSS

SEQ ID NO: 162562 - protein, 9 aa, Homo Sapiens
WSASARLCS

SEQ ID NO: 162563 - protein, 9 aa, Homo Sapiens
LTSSPHSMD

SEQ ID NO: 162564 - protein, 9 aa, Homo Sapiens
GYACQKGCS

SEQ ID NO: 162565 - protein, 9 aa, Homo Sapiens
DSLRDVEGE

SEQ ID NO: 162566 - protein, 9 aa, Homo Sapiens
TVKIYFYER

SEQ ID NO: 162567 - protein, 9 aa, Homo Sapiens
CLPTSLWSL

SEQ ID NO: 162568 - protein, 9 aa, Homo Sapiens
VSGIKELAC

SEQ ID NO: 162569 - protein, 9 aa, Homo Sapiens
RSPLMSSPE

SEQ ID NO: 162570 - protein, 9 aa, Homo Sapiens
LIELEKTCR

SEQ ID NO: 162571 - protein, 9 aa, Homo Sapiens
VLQRPQYPV

SEQ ID NO: 162572 - protein, 9 aa, Homo Sapiens
VCQVPGVVA

SEQ ID NO: 162573 - protein, 9 aa, Homo Sapiens
HVDRACVFW

SEQ ID NO: 162574 - protein, 9 aa, Homo Sapiens
AAGATPSPG

SEQ ID NO: 162575 - protein, 9 aa, Homo Sapiens
QHYYEGETP

SEQ ID NO: 162576 - protein, 9 aa, Homo Sapiens
ECGVAFSRS

SEQ ID NO: 162577 - protein, 9 aa, Homo Sapiens
MNPFQPIAS

SEQ ID NO: 162578 - protein, 9 aa, Homo Sapiens
HERVPKKKS

SEQ ID NO: 162579 - protein, 9 aa, Homo Sapiens
PSTFRDVAI

SEQ ID NO: 162580 - protein, 9 aa, Homo Sapiens
LLLPPPSPL

SEQ ID NO: 162581 - protein, 9 aa, Homo Sapiens
STAGAIGGA

SEQ ID NO: 162582 - protein, 9 aa, Homo Sapiens
VAYPAYERS

SEQ ID NO: 162583 - protein, 9 aa, Homo Sapiens
TSAVLLTVL

SEQ ID NO: 162584 - protein, 9 aa, Homo Sapiens
QSIIVNQKA

SEQ ID NO: 162585 - protein, 9 aa, Homo Sapiens
DDEEEDDDW

SEQ ID NO: 162586 - protein, 9 aa, Homo Sapiens
CSYTRIAAV

SEQ ID NO: 162587 - protein, 9 aa, Homo Sapiens
VEIVCTPQS

SEQ ID NO: 162588 - protein, 9 aa, Homo Sapiens
IKKSRFQLT

SEQ ID NO: 162589 - protein, 9 aa, Homo Sapiens
APSQVWTAA

SEQ ID NO: 162590 - protein, 9 aa, Homo Sapiens
TRRRVHPHR

SEQ ID NO: 162591 - protein, 9 aa, Homo Sapiens
LNQSAGSKW

SEQ ID NO: 162592 - protein, 9 aa, Homo Sapiens
VQQSIIVNQ

SEQ ID NO: 162593 - protein, 9 aa, Homo Sapiens
VDDIKKDAE

SEQ ID NO: 162594 - protein, 9 aa, Homo Sapiens
PGQAYDAGE

SEQ ID NO: 162595 - protein, 9 aa, Homo Sapiens
EKGQSGPGG

SEQ ID NO: 162596 - protein, 9 aa, Homo Sapiens
NNGRGEDDE

SEQ ID NO: 162597 - protein, 9 aa, Homo Sapiens
LDLVFLSMF

SEQ ID NO: 162598 - protein, 9 aa, Homo Sapiens
YIIRTILKL

SEQ ID NO: 162599 - protein, 9 aa, Homo Sapiens
DEADTLCIG

SEQ ID NO: 162600 - protein, 9 aa, Homo Sapiens
IALNMMAVR

SEQ ID NO: 162601 - protein, 9 aa, Homo Sapiens
IAEVEPPGR

SEQ ID NO: 162602 - protein, 9 aa, Homo Sapiens
SPCCTMRPR

SEQ ID NO: 162603 - protein, 9 aa, Homo Sapiens
SSPQRITST

SEQ ID NO: 162604 - protein, 9 aa, Homo Sapiens
VLQNDEFTH

SEQ ID NO: 162605 - protein, 9 aa, Homo Sapiens
VVSNVFPKG

SEQ ID NO: 162606 - protein, 9 aa, Homo Sapiens
EFLGCAIDA

SEQ ID NO: 162607 - protein, 9 aa, Homo Sapiens
FLLVCFLFF

SEQ ID NO: 162608 - protein, 9 aa, Homo Sapiens
KTSFIIRSL

SEQ ID NO: 162609 - protein, 9 aa, Homo Sapiens
VANVVFTQL

SEQ ID NO: 162610 - protein, 9 aa, Homo Sapiens
FMLDVLEGR

SEQ ID NO: 162611 - protein, 9 aa, Homo Sapiens
AGAIGGAYE

SEQ ID NO: 162612 - protein, 9 aa, Homo Sapiens
IIHKSNALH

SEQ ID NO: 162613 - protein, 9 aa, Homo Sapiens
EATINVKIF

SEQ ID NO: 162614 - protein, 9 aa, Homo Sapiens
HANVDRWDI

SEQ ID NO: 162615 - protein, 9 aa, Homo Sapiens
SKCTRLGTH

SEQ ID NO: 162616 - protein, 9 aa, Homo Sapiens
VFYMLLVVM

SEQ ID NO: 162617 - protein, 9 aa, Homo Sapiens
ASLMITRAR

SEQ ID NO: 162618 - protein, 9 aa, Homo Sapiens
EPMAAGATP

SEQ ID NO: 162619 - protein, 9 aa, Homo Sapiens
NDEFTHDLF

SEQ ID NO: 162620 - protein, 9 aa, Homo Sapiens
VYILIRAGA

SEQ ID NO: 162621 - protein, 9 aa, Homo Sapiens
YWAQDSAQL

SEQ ID NO: 162622 - protein, 9 aa, Homo Sapiens
KSPPPPPPC

SEQ ID NO: 162623 - protein, 9 aa, Homo Sapiens
TPQPSLPGP

SEQ ID NO: 162624 - protein, 9 aa, Homo Sapiens
QQLPVPKWT

SEQ ID NO: 162625 - protein, 9 aa, Homo Sapiens
GARLGDYVA

SEQ ID NO: 162626 - protein, 9 aa, Homo Sapiens
CYDCEFREA

SEQ ID NO: 162627 - protein, 9 aa, Homo Sapiens
KRCLEAEMS

SEQ ID NO: 162628 - protein, 9 aa, Homo Sapiens
IDAHANEEI

SEQ ID NO: 162629 - protein, 9 aa, Homo Sapiens
HEKVVELLK

SEQ ID NO: 162630 - protein, 9 aa, Homo Sapiens
RTENGNLEI

SEQ ID NO: 162631 - protein, 9 aa, Homo Sapiens
TNTSQLTMH

SEQ ID NO: 162632 - protein, 9 aa, Homo Sapiens
SKPPLVTVA

SEQ ID NO: 162633 - protein, 9 aa, Homo Sapiens
LWILSDKKE

SEQ ID NO: 162634 - protein, 9 aa, Homo Sapiens
LNGPELEPD

SEQ ID NO: 162635 - protein, 9 aa, Homo Sapiens
VCHRSLDGI

SEQ ID NO: 162636 - protein, 9 aa, Homo Sapiens
RPPGGGRGQ

SEQ ID NO: 162637 - protein, 9 aa, Homo Sapiens
GRALLEKLF

SEQ ID NO: 162638 - protein, 9 aa, Homo Sapiens
FTFLFLLVC

SEQ ID NO: 162639 - protein, 9 aa, Homo Sapiens
IRVFIGAGE

SEQ ID NO: 162640 - protein, 9 aa, Homo Sapiens
FCVKAYNEK

SEQ ID NO: 162641 - protein, 9 aa, Homo Sapiens
APHLGIVDE

SEQ ID NO: 162642 - protein, 9 aa, Homo Sapiens
LKKEKKPRE

SEQ ID NO: 162643 - protein, 9 aa, Homo Sapiens
KKPIVVSYQ

SEQ ID NO: 162644 - protein, 9 aa, Homo Sapiens
NLKDDFEVF

SEQ ID NO: 162645 - protein, 9 aa, Homo Sapiens
DEEEGPFDH

SEQ ID NO: 162646 - protein, 9 aa, Homo Sapiens
TEQDPYAKT

SEQ ID NO: 162647 - protein, 9 aa, Homo Sapiens
SDLEVLIVV

SEQ ID NO: 162648 - protein, 9 aa, Homo Sapiens
LPSSLLAAV

SEQ ID NO: 162649 - protein, 9 aa, Homo Sapiens
SLWSLCSLD

SEQ ID NO: 162650 - protein, 9 aa, Homo Sapiens
NLPMPTSAP

SEQ ID NO: 162651 - protein, 9 aa, Homo Sapiens
MFEAEKVNC

SEQ ID NO: 162652 - protein, 9 aa, Homo Sapiens
DRNLPMPTS

SEQ ID NO: 162653 - protein, 9 aa, Homo Sapiens
TETYNTLMK

SEQ ID NO: 162654 - protein, 9 aa, Homo Sapiens
AAPLGLLQF

SEQ ID NO: 162655 - protein, 9 aa, Homo Sapiens
PPDSTMIEK

SEQ ID NO: 162656 - protein, 9 aa, Homo Sapiens
FPFAFCYDC

SEQ ID NO: 162657 - protein, 9 aa, Homo Sapiens
MSSPQRITS

SEQ ID NO: 162658 - protein, 9 aa, Homo Sapiens
FKTSAALQM

SEQ ID NO: 162659 - protein, 9 aa, Homo Sapiens
GPMHFTVGK

SEQ ID NO: 162660 - protein, 9 aa, Homo Sapiens
RTQAINRRT

SEQ ID NO: 162661 - protein, 9 aa, Homo Sapiens
RIGTVGLYW

SEQ ID NO: 162662 - protein, 9 aa, Homo Sapiens
MCVERTFSE

SEQ ID NO: 162663 - protein, 9 aa, Homo Sapiens
SRLLGGRWS

SEQ ID NO: 162664 - protein, 9 aa, Homo Sapiens
CWTVRIRAV

SEQ ID NO: 162665 - protein, 9 aa, Homo Sapiens
VSEGARLGD

SEQ ID NO: 162666 - protein, 9 aa, Homo Sapiens
DDRLAFHRH

SEQ ID NO: 162667 - protein, 9 aa, Homo Sapiens
ALHQDALVE

SEQ ID NO: 162668 - protein, 9 aa, Homo Sapiens
SNALHQDAL

SEQ ID NO: 162669 - protein, 9 aa, Homo Sapiens
KDNVMWALD

SEQ ID NO: 162670 - protein, 9 aa, Homo Sapiens
TSKGGRCWP

SEQ ID NO: 162671 - protein, 9 aa, Homo Sapiens
RVQLPGGTS

SEQ ID NO: 162672 - protein, 9 aa, Homo Sapiens
RGEMALHMA

SEQ ID NO: 162673 - protein, 9 aa, Homo Sapiens
IQNGKCPGQ

SEQ ID NO: 162674 - protein, 9 aa, Homo Sapiens
CTNSRDGFQ

SEQ ID NO: 162675 - protein, 9 aa, Homo Sapiens
HAKAHEGYA

SEQ ID NO: 162676 - protein, 9 aa, Homo Sapiens
RNTPTRLMK

SEQ ID NO: 162677 - protein, 9 aa, Homo Sapiens
DHFCLGQLS

SEQ ID NO: 162678 - protein, 9 aa, Homo Sapiens
EVGLIGLPH

SEQ ID NO: 162679 - protein, 9 aa, Homo Sapiens
SLSWAQKAA

SEQ ID NO: 162680 - protein, 9 aa, Homo Sapiens
PACLLPLAA

SEQ ID NO: 162681 - protein, 9 aa, Homo Sapiens
NCIDEPSQC

SEQ ID NO: 162682 - protein, 9 aa, Homo Sapiens
HSTVRVQPM

SEQ ID NO: 162683 - protein, 9 aa, Homo Sapiens
NVSPVPPCG

SEQ ID NO: 162684 - protein, 9 aa, Homo Sapiens
AYTRSHKLV

SEQ ID NO: 162685 - protein, 9 aa, Homo Sapiens
LDQWTPIAT

SEQ ID NO: 162686 - protein, 9 aa, Homo Sapiens
ALQDHLGLS

SEQ ID NO: 162687 - protein, 9 aa, Homo Sapiens
SQCYFHDGD

SEQ ID NO: 162688 - protein, 9 aa, Homo Sapiens
VKDDDRLAF

SEQ ID NO: 162689 - protein, 9 aa, Homo Sapiens
LEMNQGISE

SEQ ID NO: 162690 - protein, 9 aa, Homo Sapiens
VVELSADVV

SEQ ID NO: 162691 - protein, 9 aa, Homo Sapiens
GEFFPHSHY

SEQ ID NO: 162692 - protein, 9 aa, Homo Sapiens
LLAPLPTAG

SEQ ID NO: 162693 - protein, 9 aa, Homo Sapiens
LTKKLYKQY

SEQ ID NO: 162694 - protein, 9 aa, Homo Sapiens
SGIKELACR

SEQ ID NO: 162695 - protein, 9 aa, Homo Sapiens
ACFPFAFCY

SEQ ID NO: 162696 - protein, 9 aa, Homo Sapiens
QQDLPDNPK

SEQ ID NO: 162697 - protein, 9 aa, Homo Sapiens
HLSSAVANV

SEQ ID NO: 162698 - protein, 9 aa, Homo Sapiens
GTSLLLIQG

SEQ ID NO: 162699 - protein, 9 aa, Homo Sapiens
YSPKPSLYL

SEQ ID NO: 162700 - protein, 9 aa, Homo Sapiens
RGPSEVNRL

SEQ ID NO: 162701 - protein, 9 aa, Homo Sapiens
VMGLSLLVF

SEQ ID NO: 162702 - protein, 9 aa, Homo Sapiens
SKWSRHLSK

SEQ ID NO: 162703 - protein, 9 aa, Homo Sapiens
IIRTILKLP

SEQ ID NO: 162704 - protein, 9 aa, Homo Sapiens
RQRRKELQK

SEQ ID NO: 162705 - protein, 9 aa, Homo Sapiens
VPYLKILLS

SEQ ID NO: 162706 - protein, 9 aa, Homo Sapiens
PTSLWSLCS

SEQ ID NO: 162707 - protein, 9 aa, Homo Sapiens
QDLPDNPKR

SEQ ID NO: 162708 - protein, 9 aa, Homo Sapiens
GPFDHMFQI

SEQ ID NO: 162709 - protein, 9 aa, Homo Sapiens
LKRRLAVCP

SEQ ID NO: 162710 - protein, 9 aa, Homo Sapiens
FIIRSLQHF

SEQ ID NO: 162711 - protein, 9 aa, Homo Sapiens
LEQQHIGLA

SEQ ID NO: 162712 - protein, 9 aa, Homo Sapiens
DGELGPVGP

SEQ ID NO: 162713 - protein, 9 aa, Homo Sapiens
RAPISPLKF

SEQ ID NO: 162714 - protein, 9 aa, Homo Sapiens
TKKRKCQHD

SEQ ID NO: 162715 - protein, 9 aa, Homo Sapiens
QGTRYICPP

SEQ ID NO: 162716 - protein, 9 aa, Homo Sapiens
AAGGCDGME

SEQ ID NO: 162717 - protein, 9 aa, Homo Sapiens
AELQGAVQT

SEQ ID NO: 162718 - protein, 9 aa, Homo Sapiens
ITLLRNAIF

SEQ ID NO: 162719 - protein, 9 aa, Homo Sapiens
SSGQEYQFC

SEQ ID NO: 162720 - protein, 9 aa, Homo Sapiens
ACCTSSWPS

SEQ ID NO: 162721 - protein, 9 aa, Homo Sapiens
AVPSHIFRR

SEQ ID NO: 162722 - protein, 9 aa, Homo Sapiens
NLNQSAGSK

SEQ ID NO: 162723 - protein, 9 aa, Homo Sapiens
QSVVELSAD

SEQ ID NO: 162724 - protein, 9 aa, Homo Sapiens
EGLRPRKVA

SEQ ID NO: 162725 - protein, 9 aa, Homo Sapiens
PHCLPTSLW

SEQ ID NO: 162726 - protein, 9 aa, Homo Sapiens
GRERSQPIA

SEQ ID NO: 162727 - protein, 9 aa, Homo Sapiens
EAIPKPAIY

SEQ ID NO: 162728 - protein, 9 aa, Homo Sapiens
IRTILKLPS

SEQ ID NO: 162729 - protein, 9 aa, Homo Sapiens
VDEEELLMG

SEQ ID NO: 162730 - protein, 9 aa, Homo Sapiens
IVDEEELLM

SEQ ID NO: 162731 - protein, 9 aa, Homo Sapiens
SARLCSFSA

SEQ ID NO: 162732 - protein, 9 aa, Homo Sapiens
APWRASCVT

SEQ ID NO: 162733 - protein, 9 aa, Homo Sapiens
RRSVQQSII

SEQ ID NO: 162734 - protein, 9 aa, Homo Sapiens
KTVLFLWIG

SEQ ID NO: 162735 - protein, 9 aa, Homo Sapiens
EQIAEVEPP

SEQ ID NO: 162736 - protein, 9 aa, Homo Sapiens
CEHMAWAAD

SEQ ID NO: 162737 - protein, 9 aa, Homo Sapiens
LEEKKSLTK

SEQ ID NO: 162738 - protein, 9 aa, Homo Sapiens
CVTWDRHSD

SEQ ID NO: 162739 - protein, 9 aa, Homo Sapiens
ERVPKKKSK

SEQ ID NO: 162740 - protein, 9 aa, Homo Sapiens
LPHPSVVSN

SEQ ID NO: 162741 - protein, 9 aa, Homo Sapiens
KKECAVECL

SEQ ID NO: 162742 - protein, 9 aa, Homo Sapiens
SAALQMHFN

SEQ ID NO: 162743 - protein, 9 aa, Homo Sapiens
PLNLEISAG

SEQ ID NO: 162744 - protein, 9 aa, Homo Sapiens
AGLFFRYPE

SEQ ID NO: 162745 - protein, 9 aa, Homo Sapiens
EAIQPQMQQ

SEQ ID NO: 162746 - protein, 9 aa, Homo Sapiens
KCAKAFSFV

SEQ ID NO: 162747 - protein, 9 aa, Homo Sapiens
WLRCSPRAA

SEQ ID NO: 162748 - protein, 9 aa, Homo Sapiens
DRACVFWNA

SEQ ID NO: 162749 - protein, 9 aa, Homo Sapiens
TSLWSLCSL

SEQ ID NO: 162750 - protein, 9 aa, Homo Sapiens
RLMTRSLVL

SEQ ID NO: 162751 - protein, 9 aa, Homo Sapiens
HHMGSPRRC

SEQ ID NO: 162752 - protein, 9 aa, Homo Sapiens
KKKTYCYHK

SEQ ID NO: 162753 - protein, 9 aa, Homo Sapiens
SEGARLGDY

SEQ ID NO: 162754 - protein, 9 aa, Homo Sapiens
TTPHITGGT

SEQ ID NO: 162755 - protein, 9 aa, Homo Sapiens
LNSDVREKW

SEQ ID NO: 162756 - protein, 9 aa, Homo Sapiens
MGSPRRCPH

SEQ ID NO: 162757 - protein, 9 aa, Homo Sapiens
ANINSFYAH

SEQ ID NO: 162758 - protein, 9 aa, Homo Sapiens
ARLCSFSAC

SEQ ID NO: 162759 - protein, 9 aa, Homo Sapiens
DTDITHPHE

SEQ ID NO: 162760 - protein, 9 aa, Homo Sapiens
FSACCTSSW

SEQ ID NO: 162761 - protein, 9 aa, Homo Sapiens
GEQHEKVVE

SEQ ID NO: 162762 - protein, 9 aa, Homo Sapiens
VGLIGLPHP

SEQ ID NO: 162763 - protein, 9 aa, Homo Sapiens
MTKKRKCQH

SEQ ID NO: 162764 - protein, 9 aa, Homo Sapiens
MRDKKRRSK

SEQ ID NO: 162765 - protein, 9 aa, Homo Sapiens
NAVPSHIFR

SEQ ID NO: 162766 - protein, 9 aa, Homo Sapiens
TYTVYIIQA

SEQ ID NO: 162767 - protein, 9 aa, Homo Sapiens
SAASVPEAL

SEQ ID NO: 162768 - protein, 9 aa, Homo Sapiens
SSWPSSSTL

SEQ ID NO: 162769 - protein, 9 aa, Homo Sapiens
YMWSFCFSP

SEQ ID NO: 162770 - protein, 9 aa, Homo Sapiens
GLPHPSVVS

SEQ ID NO: 162771 - protein, 9 aa, Homo Sapiens
RRLPSSSGP

SEQ ID NO: 162772 - protein, 9 aa, Homo Sapiens
AAPGVLGSL

SEQ ID NO: 162773 - protein, 9 aa, Homo Sapiens
SGVYYCVTW

SEQ ID NO: 162774 - protein, 9 aa, Homo Sapiens
FPKGVESVH

SEQ ID NO: 162775 - protein, 9 aa, Homo Sapiens
IGAGESTAL

SEQ ID NO: 162776 - protein, 9 aa, Homo Sapiens
CQFSFRMYQ

SEQ ID NO: 162777 - protein, 9 aa, Homo Sapiens
IGSSQECIK

SEQ ID NO: 162778 - protein, 9 aa, Homo Sapiens
RNNIQIVSL

SEQ ID NO: 162779 - protein, 9 aa, Homo Sapiens
LECMLKKTS

SEQ ID NO: 162780 - protein, 9 aa, Homo Sapiens
ALPSDQFVV

SEQ ID NO: 162781 - protein, 9 aa, Homo Sapiens
CWPLRWGWW

SEQ ID NO: 162782 - protein, 9 aa, Homo Sapiens
IDRQVSVYI

SEQ ID NO: 162783 - protein, 9 aa, Homo Sapiens
HARDTQDPS

SEQ ID NO: 162784 - protein, 9 aa, Homo Sapiens
RWRTQRPGP

SEQ ID NO: 162785 - protein, 9 aa, Homo Sapiens
CQGLGEPGC

SEQ ID NO: 162786 - protein, 9 aa, Homo Sapiens
HPLTPGRLP

SEQ ID NO: 162787 - protein, 9 aa, Homo Sapiens
APNPKIICQ

SEQ ID NO: 162788 - protein, 9 aa, Homo Sapiens
LLFSTYWFF

SEQ ID NO: 162789 - protein, 9 aa, Homo Sapiens
YGFLPVSLR

SEQ ID NO: 162790 - protein, 9 aa, Homo Sapiens
GAARGELRP

SEQ ID NO: 162791 - protein, 9 aa, Homo Sapiens
SPDNPDQNT

SEQ ID NO: 162792 - protein, 9 aa, Homo Sapiens
WLGYANTAL

SEQ ID NO: 162793 - protein, 9 aa, Homo Sapiens
WGKGLTSAV

SEQ ID NO: 162794 - protein, 9 aa, Homo Sapiens
NGITNHGLV

SEQ ID NO: 162795 - protein, 9 aa, Homo Sapiens
RAWADVRHE

SEQ ID NO: 162796 - protein, 9 aa, Homo Sapiens
HGPYNLKQC

SEQ ID NO: 162797 - protein, 9 aa, Homo Sapiens
SESESDIFC

SEQ ID NO: 162798 - protein, 9 aa, Homo Sapiens
SQIAKKSNW

SEQ ID NO: 162799 - protein, 9 aa, Homo Sapiens
LNLQGGCLL

SEQ ID NO: 162800 - protein, 9 aa, Homo Sapiens
PLFFMEAKP

SEQ ID NO: 162801 - protein, 9 aa, Homo Sapiens
QNLLVEVHQ

SEQ ID NO: 162802 - protein, 9 aa, Homo Sapiens
LWPRRWDQD

SEQ ID NO: 162803 - protein, 9 aa, Homo Sapiens
LHNIWLGSG

SEQ ID NO: 162804 - protein, 9 aa, Homo Sapiens
WAWNDVPCI

SEQ ID NO: 162805 - protein, 9 aa, Homo Sapiens
SSDIDSDEV

SEQ ID NO: 162806 - protein, 9 aa, Homo Sapiens
SNFRILADI

SEQ ID NO: 162807 - protein, 9 aa, Homo Sapiens
ACTMPPLLH

SEQ ID NO: 162808 - protein, 9 aa, Homo Sapiens
DGQPQWEVE

SEQ ID NO: 162809 - protein, 9 aa, Homo Sapiens
ITVTLCSFG

SEQ ID NO: 162810 - protein, 9 aa, Homo Sapiens
IRWTRGWMT

SEQ ID NO: 162811 - protein, 9 aa, Homo Sapiens
SQVSVTQNI

SEQ ID NO: 162812 - protein, 9 aa, Homo Sapiens
PPELKWPRL

SEQ ID NO: 162813 - protein, 9 aa, Homo Sapiens
DLREPASID

SEQ ID NO: 162814 - protein, 9 aa, Homo Sapiens
SGLQGCLHG

SEQ ID NO: 162815 - protein, 9 aa, Homo Sapiens
YPEVTPHRT

SEQ ID NO: 162816 - protein, 9 aa, Homo Sapiens
YIDLGHELS

SEQ ID NO: 162817 - protein, 9 aa, Homo Sapiens
VCVSLNRKC

SEQ ID NO: 162818 - protein, 9 aa, Homo Sapiens
PEYLSHGLM

SEQ ID NO: 162819 - protein, 9 aa, Homo Sapiens
PTRAKKMQK

SEQ ID NO: 162820 - protein, 9 aa, Homo Sapiens
PPPSASYSP

SEQ ID NO: 162821 - protein, 9 aa, Homo Sapiens
LLDGQWVKL

SEQ ID NO: 162822 - protein, 9 aa, Homo Sapiens
EKPGICPGP

SEQ ID NO: 162823 - protein, 9 aa, Homo Sapiens
SRQIYFMAC

SEQ ID NO: 162824 - protein, 9 aa, Homo Sapiens
FSQTPLGAN

SEQ ID NO: 162825 - protein, 9 aa, Homo Sapiens
YSSLDVSHH

SEQ ID NO: 162826 - protein, 9 aa, Homo Sapiens
CFSPLWLMT

SEQ ID NO: 162827 - protein, 9 aa, Homo Sapiens
IPYYRESKP

SEQ ID NO: 162828 - protein, 9 aa, Homo Sapiens
SLGTTVITT

SEQ ID NO: 162829 - protein, 9 aa, Homo Sapiens
GAKDMPLLS

SEQ ID NO: 162830 - protein, 9 aa, Homo Sapiens
KTEHGSQKR

SEQ ID NO: 162831 - protein, 9 aa, Homo Sapiens
IDSDSSPQK

SEQ ID NO: 162832 - protein, 9 aa, Homo Sapiens
ARLVRYMEE

SEQ ID NO: 162833 - protein, 9 aa, Homo Sapiens
GANKNVNRS

SEQ ID NO: 162834 - protein, 9 aa, Homo Sapiens
RAPGGPAVA

SEQ ID NO: 162835 - protein, 9 aa, Homo Sapiens
CPRAPEVPR

SEQ ID NO: 162836 - protein, 9 aa, Homo Sapiens
VHFNHSLWA

SEQ ID NO: 162837 - protein, 9 aa, Homo Sapiens
WYHATNSKK

SEQ ID NO: 162838 - protein, 9 aa, Homo Sapiens
CTCPPVFSY

SEQ ID NO: 162839 - protein, 9 aa, Homo Sapiens
DSQGPHNAN

SEQ ID NO: 162840 - protein, 9 aa, Homo Sapiens
ISPKMLVDL

SEQ ID NO: 162841 - protein, 9 aa, Homo Sapiens
DQDPFFLSK

SEQ ID NO: 162842 - protein, 9 aa, Homo Sapiens
TPECINFRK

SEQ ID NO: 162843 - protein, 9 aa, Homo Sapiens
KELNRGRDI

SEQ ID NO: 162844 - protein, 9 aa, Homo Sapiens
QDVFSVSIP

SEQ ID NO: 162845 - protein, 9 aa, Homo Sapiens
GFLTEDKKN

SEQ ID NO: 162846 - protein, 9 aa, Homo Sapiens
HPALHALLH

SEQ ID NO: 162847 - protein, 9 aa, Homo Sapiens
NGSPTSDRC

SEQ ID NO: 162848 - protein, 9 aa, Homo Sapiens
HEDEQLLQE

SEQ ID NO: 162849 - protein, 9 aa, Homo Sapiens
VPPCRLYRT

SEQ ID NO: 162850 - protein, 9 aa, Homo Sapiens
SPYWMKKVK

SEQ ID NO: 162851 - protein, 9 aa, Homo Sapiens
EDSTVNRDF

SEQ ID NO: 162852 - protein, 9 aa, Homo Sapiens
EFHCKLQED

SEQ ID NO: 162853 - protein, 9 aa, Homo Sapiens
KKTLNWKRG

SEQ ID NO: 162854 - protein, 9 aa, Homo Sapiens
WYRCYYGSD

SEQ ID NO: 162855 - protein, 9 aa, Homo Sapiens
PRTPPHPAA

SEQ ID NO: 162856 - protein, 9 aa, Homo Sapiens
PHRRVGARS

SEQ ID NO: 162857 - protein, 9 aa, Homo Sapiens
MEAPRGTCS

SEQ ID NO: 162858 - protein, 9 aa, Homo Sapiens
LRPTQKHWV

SEQ ID NO: 162859 - protein, 9 aa, Homo Sapiens
VSPRIPDCQ

SEQ ID NO: 162860 - protein, 9 aa, Homo Sapiens
TVPKLVLFT

SEQ ID NO: 162861 - protein, 9 aa, Homo Sapiens
WLSASHFTT

SEQ ID NO: 162862 - protein, 9 aa, Homo Sapiens
FFPSNGLTS

SEQ ID NO: 162863 - protein, 9 aa, Homo Sapiens
VMKGLNDAL

SEQ ID NO: 162864 - protein, 9 aa, Homo Sapiens
SYPLPHPPP

SEQ ID NO: 162865 - protein, 9 aa, Homo Sapiens
ILFPCLRLL

SEQ ID NO: 162866 - protein, 9 aa, Homo Sapiens
DKAFHRSSN

SEQ ID NO: 162867 - protein, 9 aa, Homo Sapiens
FVKSVEYFF

SEQ ID NO: 162868 - protein, 9 aa, Homo Sapiens
IDSFQEIAK

SEQ ID NO: 162869 - protein, 9 aa, Homo Sapiens
AVQVLVVLS

SEQ ID NO: 162870 - protein, 9 aa, Homo Sapiens
SESCSVPMT

SEQ ID NO: 162871 - protein, 9 aa, Homo Sapiens
LQSILSTMN

SEQ ID NO: 162872 - protein, 9 aa, Homo Sapiens
TLEGCISVK

SEQ ID NO: 162873 - protein, 9 aa, Homo Sapiens
RSSLAVHQV

SEQ ID NO: 162874 - protein, 9 aa, Homo Sapiens
ALQWEVAEE

SEQ ID NO: 162875 - protein, 9 aa, Homo Sapiens
RNRKMGGPP

SEQ ID NO: 162876 - protein, 9 aa, Homo Sapiens
LLGLDKMLL

SEQ ID NO: 162877 - protein, 9 aa, Homo Sapiens
HFGGDQSLH

SEQ ID NO: 162878 - protein, 9 aa, Homo Sapiens
RVGRTGMFT

SEQ ID NO: 162879 - protein, 9 aa, Homo Sapiens
QACYRIPRE

SEQ ID NO: 162880 - protein, 9 aa, Homo Sapiens
VLMDRNTRP

SEQ ID NO: 162881 - protein, 9 aa, Homo Sapiens
LECMFARTH

SEQ ID NO: 162882 - protein, 9 aa, Homo Sapiens
LFFMEAKPW

SEQ ID NO: 162883 - protein, 9 aa, Homo Sapiens
PRLPPQSFL

SEQ ID NO: 162884 - protein, 9 aa, Homo Sapiens
LQHFRPQDY

SEQ ID NO: 162885 - protein, 9 aa, Homo Sapiens
YKTTWGRWW

SEQ ID NO: 162886 - protein, 9 aa, Homo Sapiens
SQLPALVIY

SEQ ID NO: 162887 - protein, 9 aa, Homo Sapiens
ENDILLVRR

SEQ ID NO: 162888 - protein, 9 aa, Homo Sapiens
LKATTIDQI

SEQ ID NO: 162889 - protein, 9 aa, Homo Sapiens
CNLALRMMR

SEQ ID NO: 162890 - protein, 9 aa, Homo Sapiens
LQERGGVAT

SEQ ID NO: 162891 - protein, 9 aa, Homo Sapiens
MACTVAYAV

SEQ ID NO: 162892 - protein, 9 aa, Homo Sapiens
TSTVWPTAW

SEQ ID NO: 162893 - protein, 9 aa, Homo Sapiens
WPRRWDQDR

SEQ ID NO: 162894 - protein, 9 aa, Homo Sapiens
ASASHEMDH

SEQ ID NO: 162895 - protein, 9 aa, Homo Sapiens
RQATKDVGA

SEQ ID NO: 162896 - protein, 9 aa, Homo Sapiens
GAILHLQNQ

SEQ ID NO: 162897 - protein, 9 aa, Homo Sapiens
TATAAAAAT

SEQ ID NO: 162898 - protein, 9 aa, Homo Sapiens
VRSTVCAMD

SEQ ID NO: 162899 - protein, 9 aa, Homo Sapiens
GRVLVVHLV

SEQ ID NO: 162900 - protein, 9 aa, Homo Sapiens
PAVPAAACP

SEQ ID NO: 162901 - protein, 9 aa, Homo Sapiens
ETINHQLNM

SEQ ID NO: 162902 - protein, 9 aa, Homo Sapiens
DVPLVIPDG

SEQ ID NO: 162903 - protein, 9 aa, Homo Sapiens
PRACLWASL

SEQ ID NO: 162904 - protein, 9 aa, Homo Sapiens
NISSRTRVL

SEQ ID NO: 162905 - protein, 9 aa, Homo Sapiens
LVVVNQLGH

SEQ ID NO: 162906 - protein, 9 aa, Homo Sapiens
AADEMVIKY

SEQ ID NO: 162907 - protein, 9 aa, Homo Sapiens
ALRQPLYNI

SEQ ID NO: 162908 - protein, 9 aa, Homo Sapiens
RHYLSEELC

SEQ ID NO: 162909 - protein, 9 aa, Homo Sapiens
WTKVRFRVH

SEQ ID NO: 162910 - protein, 9 aa, Homo Sapiens
RKFHEDEQL

SEQ ID NO: 162911 - protein, 9 aa, Homo Sapiens
FLAQTQDQL

SEQ ID NO: 162912 - protein, 9 aa, Homo Sapiens
FPMSVQEPP

SEQ ID NO: 162913 - protein, 9 aa, Homo Sapiens
SLPGPCASL

SEQ ID NO: 162914 - protein, 9 aa, Homo Sapiens
LLRTPAPQA

SEQ ID NO: 162915 - protein, 9 aa, Homo Sapiens
SLSSLDSNS

SEQ ID NO: 162916 - protein, 9 aa, Homo Sapiens
TVGAGTGDV

SEQ ID NO: 162917 - protein, 9 aa, Homo Sapiens
MDSCSLNWK

SEQ ID NO: 162918 - protein, 9 aa, Homo Sapiens
RAAIVLGLR

SEQ ID NO: 162919 - protein, 9 aa, Homo Sapiens
LFFFSFFYF

SEQ ID NO: 162920 - protein, 9 aa, Homo Sapiens
YPAIILFSR

SEQ ID NO: 162921 - protein, 9 aa, Homo Sapiens
FADGEHSTF

SEQ ID NO: 162922 - protein, 9 aa, Homo Sapiens
PQALHLAAG

SEQ ID NO: 162923 - protein, 9 aa, Homo Sapiens
LCLRRNKVT

SEQ ID NO: 162924 - protein, 9 aa, Homo Sapiens
WAPAPGSPR

SEQ ID NO: 162925 - protein, 9 aa, Homo Sapiens
LKSGIKMSE

SEQ ID NO: 162926 - protein, 9 aa, Homo Sapiens
KVRFRVHLA

SEQ ID NO: 162927 - protein, 9 aa, Homo Sapiens
SRHLPALEG

SEQ ID NO: 162928 - protein, 9 aa, Homo Sapiens
WRSPTHLFH

SEQ ID NO: 162929 - protein, 9 aa, Homo Sapiens
MDFRNMNMF

SEQ ID NO: 162930 - protein, 9 aa, Homo Sapiens
RMSSFPKKF

SEQ ID NO: 162931 - protein, 9 aa, Homo Sapiens
KTLNWKRGP

SEQ ID NO: 162932 - protein, 9 aa, Homo Sapiens
AAVSLFDVL

SEQ ID NO: 162933 - protein, 9 aa, Homo Sapiens
LFHTDRHTG

SEQ ID NO: 162934 - protein, 9 aa, Homo Sapiens
VPSTAPVCG

SEQ ID NO: 162935 - protein, 9 aa, Homo Sapiens
GTRDAHQGR

SEQ ID NO: 162936 - protein, 9 aa, Homo Sapiens
FRNMNMFYI

SEQ ID NO: 162937 - protein, 9 aa, Homo Sapiens
CSLDAHLHR

SEQ ID NO: 162938 - protein, 9 aa, Homo Sapiens
NNLGVYTEA

SEQ ID NO: 162939 - protein, 9 aa, Homo Sapiens
GTFRRVLQQ

SEQ ID NO: 162940 - protein, 9 aa, Homo Sapiens
RWDQDRPWK

SEQ ID NO: 162941 - protein, 9 aa, Homo Sapiens
TIRYWDLKS

SEQ ID NO: 162942 - protein, 9 aa, Homo Sapiens
KAYPSEKSN

SEQ ID NO: 162943 - protein, 9 aa, Homo Sapiens
KMGGPPRLL

SEQ ID NO: 162944 - protein, 9 aa, Homo Sapiens
SYHPGIFRG

SEQ ID NO: 162945 - protein, 9 aa, Homo Sapiens
PLFRSLWPR

SEQ ID NO: 162946 - protein, 9 aa, Homo Sapiens
SPSAPAPAV

SEQ ID NO: 162947 - protein, 9 aa, Homo Sapiens
AGNFPEAAG

SEQ ID NO: 162948 - protein, 9 aa, Homo Sapiens
AKETCLNWV

SEQ ID NO: 162949 - protein, 9 aa, Homo Sapiens
RQPETPAHV

SEQ ID NO: 162950 - protein, 9 aa, Homo Sapiens
DRLNDDAKH

SEQ ID NO: 162951 - protein, 9 aa, Homo Sapiens
SPHRRVGAR

SEQ ID NO: 162952 - protein, 9 aa, Homo Sapiens
AKTGRPGRT

SEQ ID NO: 162953 - protein, 9 aa, Homo Sapiens
ADINDNTPV

SEQ ID NO: 162954 - protein, 9 aa, Homo Sapiens
PSGEWALQS

SEQ ID NO: 162955 - protein, 9 aa, Homo Sapiens
SCILSTKAS

SEQ ID NO: 162956 - protein, 9 aa, Homo Sapiens
LKNIYRKSG

SEQ ID NO: 162957 - protein, 9 aa, Homo Sapiens
IMLLALRLR

SEQ ID NO: 162958 - protein, 9 aa, Homo Sapiens
IDVQGKKIL

SEQ ID NO: 162959 - protein, 9 aa, Homo Sapiens
PLGGQRSMN

SEQ ID NO: 162960 - protein, 9 aa, Homo Sapiens
LWLGYANTA

SEQ ID NO: 162961 - protein, 9 aa, Homo Sapiens
GGVGETGRP

SEQ ID NO: 162962 - protein, 9 aa, Homo Sapiens
PEKCQFSTK

SEQ ID NO: 162963 - protein, 9 aa, Homo Sapiens
SKKVSWYSH

SEQ ID NO: 162964 - protein, 9 aa, Homo Sapiens
RRPLLQGHF

SEQ ID NO: 162965 - protein, 9 aa, Homo Sapiens
CAGAVVPSY

SEQ ID NO: 162966 - protein, 9 aa, Homo Sapiens
YQCVATAES

SEQ ID NO: 162967 - protein, 9 aa, Homo Sapiens
HHMALSKAF

SEQ ID NO: 162968 - protein, 9 aa, Homo Sapiens
VPPLPDSER

SEQ ID NO: 162969 - protein, 9 aa, Homo Sapiens
KYMLMRLPQ

SEQ ID NO: 162970 - protein, 9 aa, Homo Sapiens
HHRAPGGPA

SEQ ID NO: 162971 - protein, 9 aa, Homo Sapiens
LVLLVGVCV

SEQ ID NO: 162972 - protein, 9 aa, Homo Sapiens
STKSRPCPW

SEQ ID NO: 162973 - protein, 9 aa, Homo Sapiens
VEEAQRKQF

SEQ ID NO: 162974 - protein, 9 aa, Homo Sapiens
TWYHATNSK

SEQ ID NO: 162975 - protein, 9 aa, Homo Sapiens
RAPRVWEEL

SEQ ID NO: 162976 - protein, 9 aa, Homo Sapiens
GVRQMLSNA

SEQ ID NO: 162977 - protein, 9 aa, Homo Sapiens
LLVSLAMFR

SEQ ID NO: 162978 - protein, 9 aa, Homo Sapiens
HLDDITWYG

SEQ ID NO: 162979 - protein, 9 aa, Homo Sapiens
QPGHLVVQQ

SEQ ID NO: 162980 - protein, 9 aa, Homo Sapiens
FLYNRELIY

SEQ ID NO: 162981 - protein, 9 aa, Homo Sapiens
HHTHLSEEV

SEQ ID NO: 162982 - protein, 9 aa, Homo Sapiens
LQSCILSTK

SEQ ID NO: 162983 - protein, 9 aa, Homo Sapiens
FHQGLDKGG

SEQ ID NO: 162984 - protein, 9 aa, Homo Sapiens
AQLPTATTG

SEQ ID NO: 162985 - protein, 9 aa, Homo Sapiens
VSKATSTPV

SEQ ID NO: 162986 - protein, 9 aa, Homo Sapiens
RFPASSSQF

SEQ ID NO: 162987 - protein, 9 aa, Homo Sapiens
LALRMMRRQ

SEQ ID NO: 162988 - protein, 9 aa, Homo Sapiens
RPRSQQPKC

SEQ ID NO: 162989 - protein, 9 aa, Homo Sapiens
IAGSLDSRV

SEQ ID NO: 162990 - protein, 9 aa, Homo Sapiens
RAAEHQGNG

SEQ ID NO: 162991 - protein, 9 aa, Homo Sapiens
YKCDDFDKA

SEQ ID NO: 162992 - protein, 9 aa, Homo Sapiens
PKKSYALSN

SEQ ID NO: 162993 - protein, 9 aa, Homo Sapiens
CEEPTCHNR

SEQ ID NO: 162994 - protein, 9 aa, Homo Sapiens
KEFLCDLPC

SEQ ID NO: 162995 - protein, 9 aa, Homo Sapiens
LLYPRPWRR

SEQ ID NO: 162996 - protein, 9 aa, Homo Sapiens
GPTPRRPSS

SEQ ID NO: 162997 - protein, 9 aa, Homo Sapiens
SKLTLENLE

SEQ ID NO: 162998 - protein, 9 aa, Homo Sapiens
DFRNMNMFY

SEQ ID NO: 162999 - protein, 9 aa, Homo Sapiens
RGFRALLEK

SEQ ID NO: 163000 - protein, 9 aa, Homo Sapiens
QVLKSHIPY

SEQ ID NO: 163001 - protein, 9 aa, Homo Sapiens
LVFLELIRA

SEQ ID NO: 163002 - protein, 9 aa, Homo Sapiens
KDGKELNRG

SEQ ID NO: 163003 - protein, 9 aa, Homo Sapiens
TATKIYSQR

SEQ ID NO: 163004 - protein, 9 aa, Homo Sapiens
VDFLIQKGA

SEQ ID NO: 163005 - protein, 9 aa, Homo Sapiens
LTRAVAASP

SEQ ID NO: 163006 - protein, 9 aa, Homo Sapiens
PQYLDPPST

SEQ ID NO: 163007 - protein, 9 aa, Homo Sapiens
TGEGNFNWC

SEQ ID NO: 163008 - protein, 9 aa, Homo Sapiens
HGPRFMTLE

SEQ ID NO: 163009 - protein, 9 aa, Homo Sapiens
DGKHQPNQT

SEQ ID NO: 163010 - protein, 9 aa, Homo Sapiens
CPGPRRAWR

SEQ ID NO: 163011 - protein, 9 aa, Homo Sapiens
TAPGCSDSP

SEQ ID NO: 163012 - protein, 9 aa, Homo Sapiens
RRAAIVLGL

SEQ ID NO: 163013 - protein, 9 aa, Homo Sapiens
THLVGHQKI

SEQ ID NO: 163014 - protein, 9 aa, Homo Sapiens
ASSLTSCLQ

SEQ ID NO: 163015 - protein, 9 aa, Homo Sapiens
APVQCLPAA

SEQ ID NO: 163016 - protein, 9 aa, Homo Sapiens
RTSGEPWDT

SEQ ID NO: 163017 - protein, 9 aa, Homo Sapiens
LSIVLEQMR

SEQ ID NO: 163018 - protein, 9 aa, Homo Sapiens
SSKVKLHTD

SEQ ID NO: 163019 - protein, 9 aa, Homo Sapiens
LHRKGPLNL

SEQ ID NO: 163020 - protein, 9 aa, Homo Sapiens
RAGTGTRIA

SEQ ID NO: 163021 - protein, 9 aa, Homo Sapiens
MSLSWGTAL

SEQ ID NO: 163022 - protein, 9 aa, Homo Sapiens
RMNSKSASA

SEQ ID NO: 163023 - protein, 9 aa, Homo Sapiens
KETRHQDRA

SEQ ID NO: 163024 - protein, 9 aa, Homo Sapiens
FCPDTWASR

SEQ ID NO: 163025 - protein, 9 aa, Homo Sapiens
HLAAGPLPP

SEQ ID NO: 163026 - protein, 9 aa, Homo Sapiens
PAQLQALPD

SEQ ID NO: 163027 - protein, 9 aa, Homo Sapiens
IQFERVLLK

SEQ ID NO: 163028 - protein, 9 aa, Homo Sapiens
ILSIPVLLI

SEQ ID NO: 163029 - protein, 9 aa, Homo Sapiens
KDRRPCKDR

SEQ ID NO: 163030 - protein, 9 aa, Homo Sapiens
VQVDGSIGQ

SEQ ID NO: 163031 - protein, 9 aa, Homo Sapiens
ADLLQQDGQ

SEQ ID NO: 163032 - protein, 9 aa, Homo Sapiens
LPASHPLFG

SEQ ID NO: 163033 - protein, 9 aa, Homo Sapiens
YGCSHIPEQ

SEQ ID NO: 163034 - protein, 9 aa, Homo Sapiens
PEALRSRPG

SEQ ID NO: 163035 - protein, 9 aa, Homo Sapiens
CTDPKGQGE

SEQ ID NO: 163036 - protein, 9 aa, Homo Sapiens
SYRPWRGTT

SEQ ID NO: 163037 - protein, 9 aa, Homo Sapiens
GAPEYNRPH

SEQ ID NO: 163038 - protein, 9 aa, Homo Sapiens
AIQATLYKS

SEQ ID NO: 163039 - protein, 9 aa, Homo Sapiens
AAQTSATIT

SEQ ID NO: 163040 - protein, 9 aa, Homo Sapiens
QKGQPRWCR

SEQ ID NO: 163041 - protein, 9 aa, Homo Sapiens
GPRQQKGWL

SEQ ID NO: 163042 - protein, 9 aa, Homo Sapiens
WQWVDIALE

SEQ ID NO: 163043 - protein, 9 aa, Homo Sapiens
ISCPFQSPT

SEQ ID NO: 163044 - protein, 9 aa, Homo Sapiens
HSRLSSVEC

SEQ ID NO: 163045 - protein, 9 aa, Homo Sapiens
SRPTGRTPT

SEQ ID NO: 163046 - protein, 9 aa, Homo Sapiens
TQAITSCRL

SEQ ID NO: 163047 - protein, 9 aa, Homo Sapiens
DHISYKSGN

SEQ ID NO: 163048 - protein, 9 aa, Homo Sapiens
YPLPHPPPV

SEQ ID NO: 163049 - protein, 9 aa, Homo Sapiens
GGSNILMTE

SEQ ID NO: 163050 - protein, 9 aa, Homo Sapiens
RKDRRPCKD

SEQ ID NO: 163051 - protein, 9 aa, Homo Sapiens
PASATFPMS

SEQ ID NO: 163052 - protein, 9 aa, Homo Sapiens
SSGCGTRKR

SEQ ID NO: 163053 - protein, 9 aa, Homo Sapiens
QVLAGMVIT

SEQ ID NO: 163054 - protein, 9 aa, Homo Sapiens
IDNVSGKRV

SEQ ID NO: 163055 - protein, 9 aa, Homo Sapiens
QPCQRRGRC

SEQ ID NO: 163056 - protein, 9 aa, Homo Sapiens
GKGPLGPVD

SEQ ID NO: 163057 - protein, 9 aa, Homo Sapiens
MFYIQELQA

SEQ ID NO: 163058 - protein, 9 aa, Homo Sapiens
HSPASARLR

SEQ ID NO: 163059 - protein, 9 aa, Homo Sapiens
QKLQMPRSP

SEQ ID NO: 163060 - protein, 9 aa, Homo Sapiens
ETSEEIQKK

SEQ ID NO: 163061 - protein, 9 aa, Homo Sapiens
MWSFCFSPL

SEQ ID NO: 163062 - protein, 9 aa, Homo Sapiens
QQPKCKCRP

SEQ ID NO: 163063 - protein, 9 aa, Homo Sapiens
TQKTQRRSF

SEQ ID NO: 163064 - protein, 9 aa, Homo Sapiens
PASSSQFSD

SEQ ID NO: 163065 - protein, 9 aa, Homo Sapiens
GPPTWPTQT

SEQ ID NO: 163066 - protein, 9 aa, Homo Sapiens
GINLTISGH

SEQ ID NO: 163067 - protein, 9 aa, Homo Sapiens
HCPANGAGW

SEQ ID NO: 163068 - protein, 9 aa, Homo Sapiens
QLIGKVWPG

SEQ ID NO: 163069 - protein, 9 aa, Homo Sapiens
PPAPAPWLP

SEQ ID NO: 163070 - protein, 9 aa, Homo Sapiens
RAEAGHLAG

SEQ ID NO: 163071 - protein, 9 aa, Homo Sapiens
KVSKATSTP

SEQ ID NO: 163072 - protein, 9 aa, Homo Sapiens
PAPTSWTAT

SEQ ID NO: 163073 - protein, 9 aa, Homo Sapiens
LVDSKGMDQ

SEQ ID NO: 163074 - protein, 9 aa, Homo Sapiens
WRYPRYAPN

SEQ ID NO: 163075 - protein, 9 aa, Homo Sapiens
QEFTHLTVN

SEQ ID NO: 163076 - protein, 9 aa, Homo Sapiens
LVSAGDHHH

SEQ ID NO: 163077 - protein, 9 aa, Homo Sapiens
MHNSDISAC

SEQ ID NO: 163078 - protein, 9 aa, Homo Sapiens
QYQVVPQIQ

SEQ ID NO: 163079 - protein, 9 aa, Homo Sapiens
SGVGDTPGT

SEQ ID NO: 163080 - protein, 9 aa, Homo Sapiens
KESQLPALV

SEQ ID NO: 163081 - protein, 9 aa, Homo Sapiens
GHPVGGAPC

SEQ ID NO: 163082 - protein, 9 aa, Homo Sapiens
LQLGLRLLL

SEQ ID NO: 163083 - protein, 9 aa, Homo Sapiens
RSPSHVRHL

SEQ ID NO: 163084 - protein, 9 aa, Homo Sapiens
ATRDTPPEA

SEQ ID NO: 163085 - protein, 9 aa, Homo Sapiens
TRLPRRSCC

SEQ ID NO: 163086 - protein, 9 aa, Homo Sapiens
LSVPHTTIL

SEQ ID NO: 163087 - protein, 9 aa, Homo Sapiens
AACPMTACS

SEQ ID NO: 163088 - protein, 9 aa, Homo Sapiens
TRPPARRPR

SEQ ID NO: 163089 - protein, 9 aa, Homo Sapiens
AKSMDSIVK

SEQ ID NO: 163090 - protein, 9 aa, Homo Sapiens
SMWSSPSAS

SEQ ID NO: 163091 - protein, 9 aa, Homo Sapiens
CPHLRAVLE

SEQ ID NO: 163092 - protein, 9 aa, Homo Sapiens
NEGNHTLTL

SEQ ID NO: 163093 - protein, 9 aa, Homo Sapiens
AEPFPLVGL

SEQ ID NO: 163094 - protein, 9 aa, Homo Sapiens
AELGEQINN

SEQ ID NO: 163095 - protein, 9 aa, Homo Sapiens
GVDSQGPAA

SEQ ID NO: 163096 - protein, 9 aa, Homo Sapiens
SSHKTTKSM

SEQ ID NO: 163097 - protein, 9 aa, Homo Sapiens
CRLLLGKVL

SEQ ID NO: 163098 - protein, 9 aa, Homo Sapiens
WAPKSDHIV

SEQ ID NO: 163099 - protein, 9 aa, Homo Sapiens
PPQSFLLLP

SEQ ID NO: 163100 - protein, 9 aa, Homo Sapiens
IPDCQGSKS

SEQ ID NO: 163101 - protein, 9 aa, Homo Sapiens
DPRRRPSYR

SEQ ID NO: 163102 - protein, 9 aa, Homo Sapiens
VKKRKKREK

SEQ ID NO: 163103 - protein, 9 aa, Homo Sapiens
GLSLAPGYL

SEQ ID NO: 163104 - protein, 9 aa, Homo Sapiens
LSSPRDHPP

SEQ ID NO: 163105 - protein, 9 aa, Homo Sapiens
IREPATPAV

SEQ ID NO: 163106 - protein, 9 aa, Homo Sapiens
TFACICPPG

SEQ ID NO: 163107 - protein, 9 aa, Homo Sapiens
SASTVTKWT

SEQ ID NO: 163108 - protein, 9 aa, Homo Sapiens
FRVFCLLGT

SEQ ID NO: 163109 - protein, 9 aa, Homo Sapiens
KHQPNQTKG

SEQ ID NO: 163110 - protein, 9 aa, Homo Sapiens
GLLGSLSHW

SEQ ID NO: 163111 - protein, 9 aa, Homo Sapiens
TMYSRLREI

SEQ ID NO: 163112 - protein, 9 aa, Homo Sapiens
ADHQNLLVE

SEQ ID NO: 163113 - protein, 9 aa, Homo Sapiens
KKSITTERY

SEQ ID NO: 163114 - protein, 9 aa, Homo Sapiens
GLTRSRMAA

SEQ ID NO: 163115 - protein, 9 aa, Homo Sapiens
RPPQATRAR

SEQ ID NO: 163116 - protein, 9 aa, Homo Sapiens
PCVPCKNNS

SEQ ID NO: 163117 - protein, 9 aa, Homo Sapiens
PQAFSQTPL

SEQ ID NO: 163118 - protein, 9 aa, Homo Sapiens
PLTTIDNVS

SEQ ID NO: 163119 - protein, 9 aa, Homo Sapiens
QQLFLLTAA

SEQ ID NO: 163120 - protein, 9 aa, Homo Sapiens
YWGATGVRT

SEQ ID NO: 163121 - protein, 9 aa, Homo Sapiens
TEFVEKRRV

SEQ ID NO: 163122 - protein, 9 aa, Homo Sapiens
KDENIVITE

SEQ ID NO: 163123 - protein, 9 aa, Homo Sapiens
HSSASSWSE

SEQ ID NO: 163124 - protein, 9 aa, Homo Sapiens
SWTATLPDL

SEQ ID NO: 163125 - protein, 9 aa, Homo Sapiens
IPNLPQERL

SEQ ID NO: 163126 - protein, 9 aa, Homo Sapiens
LEGLRECGY

SEQ ID NO: 163127 - protein, 9 aa, Homo Sapiens
RAKKMQKRR

SEQ ID NO: 163128 - protein, 9 aa, Homo Sapiens
AGGTLQPRG

SEQ ID NO: 163129 - protein, 9 aa, Homo Sapiens
EALPLLLLG

SEQ ID NO: 163130 - protein, 9 aa, Homo Sapiens
FEQIVLGKW

SEQ ID NO: 163131 - protein, 9 aa, Homo Sapiens
MPPHGMCGP

SEQ ID NO: 163132 - protein, 9 aa, Homo Sapiens
YDTLERPRG

SEQ ID NO: 163133 - protein, 9 aa, Homo Sapiens
PAWSLTLST

SEQ ID NO: 163134 - protein, 9 aa, Homo Sapiens
GSGHVTFNN

SEQ ID NO: 163135 - protein, 9 aa, Homo Sapiens
RPRRSFLRM

SEQ ID NO: 163136 - protein, 9 aa, Homo Sapiens
HRWDPCMPS

SEQ ID NO: 163137 - protein, 9 aa, Homo Sapiens
CPRSAWKRR

SEQ ID NO: 163138 - protein, 9 aa, Homo Sapiens
EFELQKICY

SEQ ID NO: 163139 - protein, 9 aa, Homo Sapiens
LDYRHMLME

SEQ ID NO: 163140 - protein, 9 aa, Homo Sapiens
GPARMASVN

SEQ ID NO: 163141 - protein, 9 aa, Homo Sapiens
LRPLSLQCQ

SEQ ID NO: 163142 - protein, 9 aa, Homo Sapiens
CRHFRQPQW

SEQ ID NO: 163143 - protein, 9 aa, Homo Sapiens
KLPVSQHTL

SEQ ID NO: 163144 - protein, 9 aa, Homo Sapiens
GLMERAAWL

SEQ ID NO: 163145 - protein, 9 aa, Homo Sapiens
IYFDFWFQM

SEQ ID NO: 163146 - protein, 9 aa, Homo Sapiens
SGSFAESGA

SEQ ID NO: 163147 - protein, 9 aa, Homo Sapiens
WGESPWQVM

SEQ ID NO: 163148 - protein, 9 aa, Homo Sapiens
KLPPAPAPW

SEQ ID NO: 163149 - protein, 9 aa, Homo Sapiens
SLLAQWFTP

SEQ ID NO: 163150 - protein, 9 aa, Homo Sapiens
RSATTTLHV

SEQ ID NO: 163151 - protein, 9 aa, Homo Sapiens
CSHGDKLFK

SEQ ID NO: 163152 - protein, 9 aa, Homo Sapiens
HQKAALWRE

SEQ ID NO: 163153 - protein, 9 aa, Homo Sapiens
GPYPAASAP

SEQ ID NO: 163154 - protein, 9 aa, Homo Sapiens
CSRPVCCPR

SEQ ID NO: 163155 - protein, 9 aa, Homo Sapiens
FAFTMTFFG

SEQ ID NO: 163156 - protein, 9 aa, Homo Sapiens
LVESNCGAL

SEQ ID NO: 163157 - protein, 9 aa, Homo Sapiens
VAVRENHTL

SEQ ID NO: 163158 - protein, 9 aa, Homo Sapiens
LMERAAWLP

SEQ ID NO: 163159 - protein, 9 aa, Homo Sapiens
TRLMAPVGS

SEQ ID NO: 163160 - protein, 9 aa, Homo Sapiens
WQVYRLGTR

SEQ ID NO: 163161 - protein, 9 aa, Homo Sapiens
QDYVVSLGT

SEQ ID NO: 163162 - protein, 9 aa, Homo Sapiens
WTRLPRRSC

SEQ ID NO: 163163 - protein, 9 aa, Homo Sapiens
RECGYPENP

SEQ ID NO: 163164 - protein, 9 aa, Homo Sapiens
VWGKGLTSA

SEQ ID NO: 163165 - protein, 9 aa, Homo Sapiens
LMAPVGSVM

SEQ ID NO: 163166 - protein, 9 aa, Homo Sapiens
LEKLQVEEQ

SEQ ID NO: 163167 - protein, 9 aa, Homo Sapiens
QGGVACRQR

SEQ ID NO: 163168 - protein, 9 aa, Homo Sapiens
YLSRTAWTE

SEQ ID NO: 163169 - protein, 9 aa, Homo Sapiens
ASLDGEEQA

SEQ ID NO: 163170 - protein, 9 aa, Homo Sapiens
HVLVTPGEK

SEQ ID NO: 163171 - protein, 9 aa, Homo Sapiens
SFAAVRLCG

SEQ ID NO: 163172 - protein, 9 aa, Homo Sapiens
AVPLGPART

SEQ ID NO: 163173 - protein, 9 aa, Homo Sapiens
LFLLVSLAM

SEQ ID NO: 163174 - protein, 9 aa, Homo Sapiens
PHEELHVEE

SEQ ID NO: 163175 - protein, 9 aa, Homo Sapiens
SKFDIDIRL

SEQ ID NO: 163176 - protein, 9 aa, Homo Sapiens
CHMYRFPTT

SEQ ID NO: 163177 - protein, 9 aa, Homo Sapiens
SITAIREGD

SEQ ID NO: 163178 - protein, 9 aa, Homo Sapiens
PALSAGNFP

SEQ ID NO: 163179 - protein, 9 aa, Homo Sapiens
DLTRPSGLL

SEQ ID NO: 163180 - protein, 9 aa, Homo Sapiens
REYAVSSRR

SEQ ID NO: 163181 - protein, 9 aa, Homo Sapiens
LLSQGTTLS

SEQ ID NO: 163182 - protein, 9 aa, Homo Sapiens
GTTRNCSST

SEQ ID NO: 163183 - protein, 9 aa, Homo Sapiens
EREDIITIE

SEQ ID NO: 163184 - protein, 9 aa, Homo Sapiens
QIEGVRQML

SEQ ID NO: 163185 - protein, 9 aa, Homo Sapiens
MPPRSSSRD

SEQ ID NO: 163186 - protein, 9 aa, Homo Sapiens
SDASTLSTT

SEQ ID NO: 163187 - protein, 9 aa, Homo Sapiens
PLLITVTLC

SEQ ID NO: 163188 - protein, 9 aa, Homo Sapiens
RRSPFPPTK

SEQ ID NO: 163189 - protein, 9 aa, Homo Sapiens
FSPLWLMTA

SEQ ID NO: 163190 - protein, 9 aa, Homo Sapiens
KTQRRSFSS

SEQ ID NO: 163191 - protein, 9 aa, Homo Sapiens
FLWESLYPE

SEQ ID NO: 163192 - protein, 9 aa, Homo Sapiens
SPANGSLWP

SEQ ID NO: 163193 - protein, 9 aa, Homo Sapiens
TSWWAPPPS

SEQ ID NO: 163194 - protein, 9 aa, Homo Sapiens
TVIGGPTAG

SEQ ID NO: 163195 - protein, 9 aa, Homo Sapiens
AAAQTSATI

SEQ ID NO: 163196 - protein, 9 aa, Homo Sapiens
FLKALAVQT

SEQ ID NO: 163197 - protein, 9 aa, Homo Sapiens
CFVYCLSQL

SEQ ID NO: 163198 - protein, 9 aa, Homo Sapiens
EAPGPLGVS

SEQ ID NO: 163199 - protein, 9 aa, Homo Sapiens
EKIVALMSS

SEQ ID NO: 163200 - protein, 9 aa, Homo Sapiens
ARTASLASV

SEQ ID NO: 163201 - protein, 9 aa, Homo Sapiens
DLEEQLWSV

SEQ ID NO: 163202 - protein, 9 aa, Homo Sapiens
PGRTTPVNP

SEQ ID NO: 163203 - protein, 9 aa, Homo Sapiens
NGGYEVEPG

SEQ ID NO: 163204 - protein, 9 aa, Homo Sapiens
PRSPPLPPG

SEQ ID NO: 163205 - protein, 9 aa, Homo Sapiens
QERGGVATP

SEQ ID NO: 163206 - protein, 9 aa, Homo Sapiens
DCLLKMKAC

SEQ ID NO: 163207 - protein, 9 aa, Homo Sapiens
GAGNHSYYR

SEQ ID NO: 163208 - protein, 9 aa, Homo Sapiens
GPLPASHPL

SEQ ID NO: 163209 - protein, 9 aa, Homo Sapiens
RAKCQAQQE

SEQ ID NO: 163210 - protein, 9 aa, Homo Sapiens
PPPKMPPPR

SEQ ID NO: 163211 - protein, 9 aa, Homo Sapiens
WSPGEALPL

SEQ ID NO: 163212 - protein, 9 aa, Homo Sapiens
LQPLPQQHR

SEQ ID NO: 163213 - protein, 9 aa, Homo Sapiens
TMLLDPPLI

SEQ ID NO: 163214 - protein, 9 aa, Homo Sapiens
HDEMLGLVP

SEQ ID NO: 163215 - protein, 9 aa, Homo Sapiens
WLSVCSCRE

SEQ ID NO: 163216 - protein, 9 aa, Homo Sapiens
SNKKISVLS

SEQ ID NO: 163217 - protein, 9 aa, Homo Sapiens
KLNLGRYLN

SEQ ID NO: 163218 - protein, 9 aa, Homo Sapiens
DLNEGNHTL

SEQ ID NO: 163219 - protein, 9 aa, Homo Sapiens
MFFSEARTR

SEQ ID NO: 163220 - protein, 9 aa, Homo Sapiens
WSEVVENAE

SEQ ID NO: 163221 - protein, 9 aa, Homo Sapiens
REKRLKQKN

SEQ ID NO: 163222 - protein, 9 aa, Homo Sapiens
PPAAATTSW

SEQ ID NO: 163223 - protein, 9 aa, Homo Sapiens
SRSSKVTEH

SEQ ID NO: 163224 - protein, 9 aa, Homo Sapiens
GIKMSEVNA

SEQ ID NO: 163225 - protein, 9 aa, Homo Sapiens
QLLCQNPEK

SEQ ID NO: 163226 - protein, 9 aa, Homo Sapiens
LSLPPCLPA

SEQ ID NO: 163227 - protein, 9 aa, Homo Sapiens
GGLSLAPGY

SEQ ID NO: 163228 - protein, 9 aa, Homo Sapiens
DKVAQSEAL

SEQ ID NO: 163229 - protein, 9 aa, Homo Sapiens
IYALGMGDQ

SEQ ID NO: 163230 - protein, 9 aa, Homo Sapiens
LFVTPRQQH

SEQ ID NO: 163231 - protein, 9 aa, Homo Sapiens
MWSSPSASS

SEQ ID NO: 163232 - protein, 9 aa, Homo Sapiens
EAGPMAFLF

SEQ ID NO: 163233 - protein, 9 aa, Homo Sapiens
VTENDNTML

SEQ ID NO: 163234 - protein, 9 aa, Homo Sapiens
KIIDCGKVF

SEQ ID NO: 163235 - protein, 9 aa, Homo Sapiens
QDMGNTCYE

SEQ ID NO: 163236 - protein, 9 aa, Homo Sapiens
RPTKAHSIS

SEQ ID NO: 163237 - protein, 9 aa, Homo Sapiens
WSFCFSPLW

SEQ ID NO: 163238 - protein, 9 aa, Homo Sapiens
LDREAWQGV

SEQ ID NO: 163239 - protein, 9 aa, Homo Sapiens
YPTRILPRA

SEQ ID NO: 163240 - protein, 9 aa, Homo Sapiens
KPKIAAITS

SEQ ID NO: 163241 - protein, 9 aa, Homo Sapiens
GRWWRKLTL

SEQ ID NO: 163242 - protein, 9 aa, Homo Sapiens
EGGGIGRVG

SEQ ID NO: 163243 - protein, 9 aa, Homo Sapiens
EGAERGSAA

SEQ ID NO: 163244 - protein, 9 aa, Homo Sapiens
QILFPCLRL

SEQ ID NO: 163245 - protein, 9 aa, Homo Sapiens
GRTPTTRLM

SEQ ID NO: 163246 - protein, 9 aa, Homo Sapiens
AILHLQNQP

SEQ ID NO: 163247 - protein, 9 aa, Homo Sapiens
DQCQVAGWC

SEQ ID NO: 163248 - protein, 9 aa, Homo Sapiens
RTPYRPPTA

SEQ ID NO: 163249 - protein, 9 aa, Homo Sapiens
CQSEPREGW

SEQ ID NO: 163250 - protein, 9 aa, Homo Sapiens
FSPYWMKKV

SEQ ID NO: 163251 - protein, 9 aa, Homo Sapiens
VIPVRLQLF

SEQ ID NO: 163252 - protein, 9 aa, Homo Sapiens
SSSRDDLYD

SEQ ID NO: 163253 - protein, 9 aa, Homo Sapiens
TRTEPGREE

SEQ ID NO: 163254 - protein, 9 aa, Homo Sapiens
DGQWVKLKL

SEQ ID NO: 163255 - protein, 9 aa, Homo Sapiens
ETEVGATEE

SEQ ID NO: 163256 - protein, 9 aa, Homo Sapiens
PIVVCLCTI

SEQ ID NO: 163257 - protein, 9 aa, Homo Sapiens
PCGLNRART

SEQ ID NO: 163258 - protein, 9 aa, Homo Sapiens
HKVVKKGNA

SEQ ID NO: 163259 - protein, 9 aa, Homo Sapiens
ACSRPVCCP

SEQ ID NO: 163260 - protein, 9 aa, Homo Sapiens
QPEQEERRE

SEQ ID NO: 163261 - protein, 9 aa, Homo Sapiens
QYKKSTAWF

SEQ ID NO: 163262 - protein, 9 aa, Homo Sapiens
GKELNRGRD

SEQ ID NO: 163263 - protein, 9 aa, Homo Sapiens
LYKKKKPKK

SEQ ID NO: 163264 - protein, 9 aa, Homo Sapiens
GARPAGGGP

SEQ ID NO: 163265 - protein, 9 aa, Homo Sapiens
ARLPPPTHL

SEQ ID NO: 163266 - protein, 9 aa, Homo Sapiens
GSCCTATVG

SEQ ID NO: 163267 - protein, 9 aa, Homo Sapiens
PSCPQGTLG

SEQ ID NO: 163268 - protein, 9 aa, Homo Sapiens
PTLGSPGCL

SEQ ID NO: 163269 - protein, 9 aa, Homo Sapiens
TKVRFRVHL

SEQ ID NO: 163270 - protein, 9 aa, Homo Sapiens
RPCASCPGP

SEQ ID NO: 163271 - protein, 9 aa, Homo Sapiens
GLQGCLHGA

SEQ ID NO: 163272 - protein, 9 aa, Homo Sapiens
LSWGTALMT

SEQ ID NO: 163273 - protein, 9 aa, Homo Sapiens
INNLQRVKQ

SEQ ID NO: 163274 - protein, 9 aa, Homo Sapiens
CCSQDCGTG

SEQ ID NO: 163275 - protein, 9 aa, Homo Sapiens
KFHEDEQLL

SEQ ID NO: 163276 - protein, 9 aa, Homo Sapiens
LSFMDSCSL

SEQ ID NO: 163277 - protein, 9 aa, Homo Sapiens
GTTVITTCT

SEQ ID NO: 163278 - protein, 9 aa, Homo Sapiens
PSCCRWGAP

SEQ ID NO: 163279 - protein, 9 aa, Homo Sapiens
ERVAPEQCD

SEQ ID NO: 163280 - protein, 9 aa, Homo Sapiens
SRSPSHVRH

SEQ ID NO: 163281 - protein, 9 aa, Homo Sapiens
TTNKKPGLG

SEQ ID NO: 163282 - protein, 9 aa, Homo Sapiens
HSAHLWQRA

SEQ ID NO: 163283 - protein, 9 aa, Homo Sapiens
LPPGSSWRS

SEQ ID NO: 163284 - protein, 9 aa, Homo Sapiens
DLTIRYWDL

SEQ ID NO: 163285 - protein, 9 aa, Homo Sapiens
EETTTEMIS

SEQ ID NO: 163286 - protein, 9 aa, Homo Sapiens
RARGGGDIW

SEQ ID NO: 163287 - protein, 9 aa, Homo Sapiens
GVGKTACSC

SEQ ID NO: 163288 - protein, 9 aa, Homo Sapiens
NQKWLEKLL

SEQ ID NO: 163289 - protein, 9 aa, Homo Sapiens
SPQEGVFWT

SEQ ID NO: 163290 - protein, 9 aa, Homo Sapiens
FSIWQHREL

SEQ ID NO: 163291 - protein, 9 aa, Homo Sapiens
NWKRGPSVV

SEQ ID NO: 163292 - protein, 9 aa, Homo Sapiens
GWAARVAHI

SEQ ID NO: 163293 - protein, 9 aa, Homo Sapiens
VPHEELHVE

SEQ ID NO: 163294 - protein, 9 aa, Homo Sapiens
LGCMVEPPR

SEQ ID NO: 163295 - protein, 9 aa, Homo Sapiens
LEDIQSSPL

SEQ ID NO: 163296 - protein, 9 aa, Homo Sapiens
TTLHCHLSP

SEQ ID NO: 163297 - protein, 9 aa, Homo Sapiens
KLPHPTAPV

SEQ ID NO: 163298 - protein, 9 aa, Homo Sapiens
GGGSPSRSA

SEQ ID NO: 163299 - protein, 9 aa, Homo Sapiens
AVCFFLGLF

SEQ ID NO: 163300 - protein, 9 aa, Homo Sapiens
LTPLKLAVK

SEQ ID NO: 163301 - protein, 9 aa, Homo Sapiens
LDPFLYFLI

SEQ ID NO: 163302 - protein, 9 aa, Homo Sapiens
CLLKMKACG

SEQ ID NO: 163303 - protein, 9 aa, Homo Sapiens
SGRRGIAIT

SEQ ID NO: 163304 - protein, 9 aa, Homo Sapiens
VLVRRSHLL

SEQ ID NO: 163305 - protein, 9 aa, Homo Sapiens
EDFGPRKDL

SEQ ID NO: 163306 - protein, 9 aa, Homo Sapiens
WRETLKKTR

SEQ ID NO: 163307 - protein, 9 aa, Homo Sapiens
LELPEPNGS

SEQ ID NO: 163308 - protein, 9 aa, Homo Sapiens
HPYQCDSCC

SEQ ID NO: 163309 - protein, 9 aa, Homo Sapiens
LWPTLNLSS

SEQ ID NO: 163310 - protein, 9 aa, Homo Sapiens
LPMRSLGEP

SEQ ID NO: 163311 - protein, 9 aa, Homo Sapiens
PAARSSSCC

SEQ ID NO: 163312 - protein, 9 aa, Homo Sapiens
HFDWVVSHI

SEQ ID NO: 163313 - protein, 9 aa, Homo Sapiens
GTPQGPAWS

SEQ ID NO: 163314 - protein, 9 aa, Homo Sapiens
PPTWPTQTW

SEQ ID NO: 163315 - protein, 9 aa, Homo Sapiens
GRKSVHTVG

SEQ ID NO: 163316 - protein, 9 aa, Homo Sapiens
SQLGNGITN

SEQ ID NO: 163317 - protein, 9 aa, Homo Sapiens
QRGQDRVHS

SEQ ID NO: 163318 - protein, 9 aa, Homo Sapiens
GPLLPEPGP

SEQ ID NO: 163319 - protein, 9 aa, Homo Sapiens
KVHRDLRLW

SEQ ID NO: 163320 - protein, 9 aa, Homo Sapiens
KRFSTAGEY

SEQ ID NO: 163321 - protein, 9 aa, Homo Sapiens
LLIDHLLNT

SEQ ID NO: 163322 - protein, 9 aa, Homo Sapiens
PPCLPAGKW

SEQ ID NO: 163323 - protein, 9 aa, Homo Sapiens
QECRLVGPE

SEQ ID NO: 163324 - protein, 9 aa, Homo Sapiens
CHDEVRMDG

SEQ ID NO: 163325 - protein, 9 aa, Homo Sapiens
AAVGAGLQD

SEQ ID NO: 163326 - protein, 9 aa, Homo Sapiens
AALWRETLK

SEQ ID NO: 163327 - protein, 9 aa, Homo Sapiens
PARRPRTPE

SEQ ID NO: 163328 - protein, 9 aa, Homo Sapiens
KEKQMASML

SEQ ID NO: 163329 - protein, 9 aa, Homo Sapiens
RTGLLPGEA

SEQ ID NO: 163330 - protein, 9 aa, Homo Sapiens
RGWDSESWA

SEQ ID NO: 163331 - protein, 9 aa, Homo Sapiens
AATTSWWRL

SEQ ID NO: 163332 - protein, 9 aa, Homo Sapiens
RRARQFAQI

SEQ ID NO: 163333 - protein, 9 aa, Homo Sapiens
PPKRVKEAD

SEQ ID NO: 163334 - protein, 9 aa, Homo Sapiens
ATGSCEACT

SEQ ID NO: 163335 - protein, 9 aa, Homo Sapiens
VSLAFLYGL

SEQ ID NO: 163336 - protein, 9 aa, Homo Sapiens
VSSDASTLS

SEQ ID NO: 163337 - protein, 9 aa, Homo Sapiens
MDRNTRPGP

SEQ ID NO: 163338 - protein, 9 aa, Homo Sapiens
LPAGAARGE

SEQ ID NO: 163339 - protein, 9 aa, Homo Sapiens
NVSKDEIDS

SEQ ID NO: 163340 - protein, 9 aa, Homo Sapiens
GALMHSFGS

SEQ ID NO: 163341 - protein, 9 aa, Homo Sapiens
VQLLVTRLH

SEQ ID NO: 163342 - protein, 9 aa, Homo Sapiens
TNCSAAHSC

SEQ ID NO: 163343 - protein, 9 aa, Homo Sapiens
NLKCFLKTR

SEQ ID NO: 163344 - protein, 9 aa, Homo Sapiens
TRGSQVAGD

SEQ ID NO: 163345 - protein, 9 aa, Homo Sapiens
EDDYWGATG

SEQ ID NO: 163346 - protein, 9 aa, Homo Sapiens
SPGASPMSL

SEQ ID NO: 163347 - protein, 9 aa, Homo Sapiens
VLAEGQWIL

SEQ ID NO: 163348 - protein, 9 aa, Homo Sapiens
RASTRNWAR

SEQ ID NO: 163349 - protein, 9 aa, Homo Sapiens
LVGPEKKTW

SEQ ID NO: 163350 - protein, 9 aa, Homo Sapiens
AHGRRHLRV

SEQ ID NO: 163351 - protein, 9 aa, Homo Sapiens
GLYYNGFKV

SEQ ID NO: 163352 - protein, 9 aa, Homo Sapiens
FMEAKPWLA

SEQ ID NO: 163353 - protein, 9 aa, Homo Sapiens
RYAALLKRG

SEQ ID NO: 163354 - protein, 9 aa, Homo Sapiens
PSGPQAFSQ

SEQ ID NO: 163355 - protein, 9 aa, Homo Sapiens
HAAHQLRAD

SEQ ID NO: 163356 - protein, 9 aa, Homo Sapiens
SYNKIVPST

SEQ ID NO: 163357 - protein, 9 aa, Homo Sapiens
IRHVLVTPG

SEQ ID NO: 163358 - protein, 9 aa, Homo Sapiens
KDNDFLWNT

SEQ ID NO: 163359 - protein, 9 aa, Homo Sapiens
MGATVATLA

SEQ ID NO: 163360 - protein, 9 aa, Homo Sapiens
TPRRPSSGC

SEQ ID NO: 163361 - protein, 9 aa, Homo Sapiens
SGKCGVCLM

SEQ ID NO: 163362 - protein, 9 aa, Homo Sapiens
CKLLDHEEE

SEQ ID NO: 163363 - protein, 9 aa, Homo Sapiens
TVSLLFCYG

SEQ ID NO: 163364 - protein, 9 aa, Homo Sapiens
RGQGPSFEE

SEQ ID NO: 163365 - protein, 9 aa, Homo Sapiens
QTLYLNLHA

SEQ ID NO: 163366 - protein, 9 aa, Homo Sapiens
VCLARGDLC

SEQ ID NO: 163367 - protein, 9 aa, Homo Sapiens
TEGSGAGGT

SEQ ID NO: 163368 - protein, 9 aa, Homo Sapiens
RTLRSSPKS

SEQ ID NO: 163369 - protein, 9 aa, Homo Sapiens
EKERELGHL

SEQ ID NO: 163370 - protein, 9 aa, Homo Sapiens
TNSVWLLFF

SEQ ID NO: 163371 - protein, 9 aa, Homo Sapiens
LQLLLVIQL

SEQ ID NO: 163372 - protein, 9 aa, Homo Sapiens
EAVQQKAQR

SEQ ID NO: 163373 - protein, 9 aa, Homo Sapiens
PATSSLAEP

SEQ ID NO: 163374 - protein, 9 aa, Homo Sapiens
LQGQPANQS

SEQ ID NO: 163375 - protein, 9 aa, Homo Sapiens
SKEHKLREH

SEQ ID NO: 163376 - protein, 9 aa, Homo Sapiens
EECSLEAAW

SEQ ID NO: 163377 - protein, 9 aa, Homo Sapiens
AQGLGNITD

SEQ ID NO: 163378 - protein, 9 aa, Homo Sapiens
AQELAGQWG

SEQ ID NO: 163379 - protein, 9 aa, Homo Sapiens
TVKMDVLNT

SEQ ID NO: 163380 - protein, 9 aa, Homo Sapiens
RRPSSGCGT

SEQ ID NO: 163381 - protein, 9 aa, Homo Sapiens
KRLKQKNKS

SEQ ID NO: 163382 - protein, 9 aa, Homo Sapiens
TEKSRWSGS

SEQ ID NO: 163383 - protein, 9 aa, Homo Sapiens
QFSTKSGWR

SEQ ID NO: 163384 - protein, 9 aa, Homo Sapiens
EKKGRRVTQ

SEQ ID NO: 163385 - protein, 9 aa, Homo Sapiens
TTNPHSPGP

SEQ ID NO: 163386 - protein, 9 aa, Homo Sapiens
CKKCVDEPG

SEQ ID NO: 163387 - protein, 9 aa, Homo Sapiens
HQPQHLGAG

SEQ ID NO: 163388 - protein, 9 aa, Homo Sapiens
MWQASWTKV

SEQ ID NO: 163389 - protein, 9 aa, Homo Sapiens
PFAPLQPPQ

SEQ ID NO: 163390 - protein, 9 aa, Homo Sapiens
FLYFLISKT

SEQ ID NO: 163391 - protein, 9 aa, Homo Sapiens
VPRHRLQRR

SEQ ID NO: 163392 - protein, 9 aa, Homo Sapiens
GGPPRLLGP

SEQ ID NO: 163393 - protein, 9 aa, Homo Sapiens
TLRAVKRPL

SEQ ID NO: 163394 - protein, 9 aa, Homo Sapiens
SENGSFTNC

SEQ ID NO: 163395 - protein, 9 aa, Homo Sapiens
YNVFEPNQN

SEQ ID NO: 163396 - protein, 9 aa, Homo Sapiens
WDQDRPWKW

SEQ ID NO: 163397 - protein, 9 aa, Homo Sapiens
AHVVSAGGG

SEQ ID NO: 163398 - protein, 9 aa, Homo Sapiens
LALKEDLLY

SEQ ID NO: 163399 - protein, 9 aa, Homo Sapiens
GADKGNHKE

SEQ ID NO: 163400 - protein, 9 aa, Homo Sapiens
HMDTTASAK

SEQ ID NO: 163401 - protein, 9 aa, Homo Sapiens
AVKEGKIEI

SEQ ID NO: 163402 - protein, 9 aa, Homo Sapiens
TMPPLLHPQ

SEQ ID NO: 163403 - protein, 9 aa, Homo Sapiens
VMDCHHTHL

SEQ ID NO: 163404 - protein, 9 aa, Homo Sapiens
AAATTSWWR

SEQ ID NO: 163405 - protein, 9 aa, Homo Sapiens
RDDFKMKVL

SEQ ID NO: 163406 - protein, 9 aa, Homo Sapiens
RLLLLLLSP

SEQ ID NO: 163407 - protein, 9 aa, Homo Sapiens
PQFQEAMHK

SEQ ID NO: 163408 - protein, 9 aa, Homo Sapiens
WLMGLTTFH

SEQ ID NO: 163409 - protein, 9 aa, Homo Sapiens
IDAVIRRFE

SEQ ID NO: 163410 - protein, 9 aa, Homo Sapiens
SPSPLSEAS

SEQ ID NO: 163411 - protein, 9 aa, Homo Sapiens
DYWGATGVR

SEQ ID NO: 163412 - protein, 9 aa, Homo Sapiens
CGACAACLQ

SEQ ID NO: 163413 - protein, 9 aa, Homo Sapiens
APQPLLSSP

SEQ ID NO: 163414 - protein, 9 aa, Homo Sapiens
TISRMAQTQ

SEQ ID NO: 163415 - protein, 9 aa, Homo Sapiens
GSGDLELES

SEQ ID NO: 163416 - protein, 9 aa, Homo Sapiens
ISGATSDPA

SEQ ID NO: 163417 - protein, 9 aa, Homo Sapiens
QSILLLKFS

SEQ ID NO: 163418 - protein, 9 aa, Homo Sapiens
PRAWQVPLL

SEQ ID NO: 163419 - protein, 9 aa, Homo Sapiens
ERAKARLVR

SEQ ID NO: 163420 - protein, 9 aa, Homo Sapiens
LTPAQLPTA

SEQ ID NO: 163421 - protein, 9 aa, Homo Sapiens
PAAPQARQG

SEQ ID NO: 163422 - protein, 9 aa, Homo Sapiens
KIDRQVSVY

SEQ ID NO: 163423 - protein, 9 aa, Homo Sapiens
DLPTEQPPA

SEQ ID NO: 163424 - protein, 9 aa, Homo Sapiens
LSEELCLPP

SEQ ID NO: 163425 - protein, 9 aa, Homo Sapiens
GVVLHGKPD

SEQ ID NO: 163426 - protein, 9 aa, Homo Sapiens
HILMNGTLK

SEQ ID NO: 163427 - protein, 9 aa, Homo Sapiens
PLNRRTIVQ

SEQ ID NO: 163428 - protein, 9 aa, Homo Sapiens
SSPKARRSS

SEQ ID NO: 163429 - protein, 9 aa, Homo Sapiens
KVSWYSHQK

SEQ ID NO: 163430 - protein, 9 aa, Homo Sapiens
EPGEEVATV

SEQ ID NO: 163431 - protein, 9 aa, Homo Sapiens
VCTHWRKPC

SEQ ID NO: 163432 - protein, 9 aa, Homo Sapiens
SSSMSTWTP

SEQ ID NO: 163433 - protein, 9 aa, Homo Sapiens
NMIYVIYFD

SEQ ID NO: 163434 - protein, 9 aa, Homo Sapiens
VGMSYLHEV

SEQ ID NO: 163435 - protein, 9 aa, Homo Sapiens
DLRDLAKSM

SEQ ID NO: 163436 - protein, 9 aa, Homo Sapiens
DVLLPKSGK

SEQ ID NO: 163437 - protein, 9 aa, Homo Sapiens
ARTRSRTWE

SEQ ID NO: 163438 - protein, 9 aa, Homo Sapiens
SKVANPGGD

SEQ ID NO: 163439 - protein, 9 aa, Homo Sapiens
EIRHVLVTP

SEQ ID NO: 163440 - protein, 9 aa, Homo Sapiens
MVTGANLMD

SEQ ID NO: 163441 - protein, 9 aa, Homo Sapiens
APTLTPAQL

SEQ ID NO: 163442 - protein, 9 aa, Homo Sapiens
VSLITPPQS

SEQ ID NO: 163443 - protein, 9 aa, Homo Sapiens
CSILARLVA

SEQ ID NO: 163444 - protein, 9 aa, Homo Sapiens
LDLSFNVIL

SEQ ID NO: 163445 - protein, 9 aa, Homo Sapiens
GNGKWRLTT

SEQ ID NO: 163446 - protein, 9 aa, Homo Sapiens
RKMGGPPRL

SEQ ID NO: 163447 - protein, 9 aa, Homo Sapiens
AIEELSTLH

SEQ ID NO: 163448 - protein, 9 aa, Homo Sapiens
DQLISLKRI

SEQ ID NO: 163449 - protein, 9 aa, Homo Sapiens
NCHLQSPYF

SEQ ID NO: 163450 - protein, 9 aa, Homo Sapiens
VFDLSLAGW

SEQ ID NO: 163451 - protein, 9 aa, Homo Sapiens
PRPRPGRTT

SEQ ID NO: 163452 - protein, 9 aa, Homo Sapiens
NTELEEPQL

SEQ ID NO: 163453 - protein, 9 aa, Homo Sapiens
ATQASMTLP

SEQ ID NO: 163454 - protein, 9 aa, Homo Sapiens
EMCVETMEL

SEQ ID NO: 163455 - protein, 9 aa, Homo Sapiens
AGAPYAEEN

SEQ ID NO: 163456 - protein, 9 aa, Homo Sapiens
FDIYTVGAG

SEQ ID NO: 163457 - protein, 9 aa, Homo Sapiens
NTASSSATR

SEQ ID NO: 163458 - protein, 9 aa, Homo Sapiens
PDAILHAQA

SEQ ID NO: 163459 - protein, 9 aa, Homo Sapiens
TAPLACLHL

SEQ ID NO: 163460 - protein, 9 aa, Homo Sapiens
PEFAAIPKK

SEQ ID NO: 163461 - protein, 9 aa, Homo Sapiens
MGGSRTPMC

SEQ ID NO: 163462 - protein, 9 aa, Homo Sapiens
DGLLYLHQL

SEQ ID NO: 163463 - protein, 9 aa, Homo Sapiens
QKRTISQSS

SEQ ID NO: 163464 - protein, 9 aa, Homo Sapiens
PKIAAITSM

SEQ ID NO: 163465 - protein, 9 aa, Homo Sapiens
YISVFICTH

SEQ ID NO: 163466 - protein, 9 aa, Homo Sapiens
PPASNPATS

SEQ ID NO: 163467 - protein, 9 aa, Homo Sapiens
VVRDTPWTA

SEQ ID NO: 163468 - protein, 9 aa, Homo Sapiens
SPLWLMTAM

SEQ ID NO: 163469 - protein, 9 aa, Homo Sapiens
WLMWVTDER

SEQ ID NO: 163470 - protein, 9 aa, Homo Sapiens
YMVFVQFLQ

SEQ ID NO: 163471 - protein, 9 aa, Homo Sapiens
IQYQVVPQI

SEQ ID NO: 163472 - protein, 9 aa, Homo Sapiens
VHTGVGSGL

SEQ ID NO: 163473 - protein, 9 aa, Homo Sapiens
RTLEGCISV

SEQ ID NO: 163474 - protein, 9 aa, Homo Sapiens
KPLSDPTPF

SEQ ID NO: 163475 - protein, 9 aa, Homo Sapiens
KEEQTWKLA

SEQ ID NO: 163476 - protein, 9 aa, Homo Sapiens
WPNWGAIPR

SEQ ID NO: 163477 - protein, 9 aa, Homo Sapiens
LYKLQTKWM

SEQ ID NO: 163478 - protein, 9 aa, Homo Sapiens
CGTRRLWPP

SEQ ID NO: 163479 - protein, 9 aa, Homo Sapiens
PFPTRGRSF

SEQ ID NO: 163480 - protein, 9 aa, Homo Sapiens
FGPEREDII

SEQ ID NO: 163481 - protein, 9 aa, Homo Sapiens
RTSMEGTHL

SEQ ID NO: 163482 - protein, 9 aa, Homo Sapiens
LAAAERAKC

SEQ ID NO: 163483 - protein, 9 aa, Homo Sapiens
WGWWVWGPP

SEQ ID NO: 163484 - protein, 9 aa, Homo Sapiens
AGARPPAGL

SEQ ID NO: 163485 - protein, 9 aa, Homo Sapiens
KGMDQDPFF

SEQ ID NO: 163486 - protein, 9 aa, Homo Sapiens
ACGTMVIWD

SEQ ID NO: 163487 - protein, 9 aa, Homo Sapiens
QKYPQAAAV

SEQ ID NO: 163488 - protein, 9 aa, Homo Sapiens
GDHARDTQD

SEQ ID NO: 163489 - protein, 9 aa, Homo Sapiens
EASKEHKLR

SEQ ID NO: 163490 - protein, 9 aa, Homo Sapiens
RPRSRPSSE

SEQ ID NO: 163491 - protein, 9 aa, Homo Sapiens
RGGLSLAPG

SEQ ID NO: 163492 - protein, 9 aa, Homo Sapiens
EYPQFQEAM

SEQ ID NO: 163493 - protein, 9 aa, Homo Sapiens
RHLRVPRHR

SEQ ID NO: 163494 - protein, 9 aa, Homo Sapiens
EFLCDLPCG

SEQ ID NO: 163495 - protein, 9 aa, Homo Sapiens
INQQQPQQQ

SEQ ID NO: 163496 - protein, 9 aa, Homo Sapiens
WTRGWMTRP

SEQ ID NO: 163497 - protein, 9 aa, Homo Sapiens
HRAPGGPAV

SEQ ID NO: 163498 - protein, 9 aa, Homo Sapiens
QDLPISRCQ

SEQ ID NO: 163499 - protein, 9 aa, Homo Sapiens
SWTKVRFRV

SEQ ID NO: 163500 - protein, 9 aa, Homo Sapiens
VSLIQVGMG

SEQ ID NO: 163501 - protein, 9 aa, Homo Sapiens
ACVPRAARV

SEQ ID NO: 163502 - protein, 9 aa, Homo Sapiens
YKDGVVTIS

SEQ ID NO: 163503 - protein, 9 aa, Homo Sapiens
ETRHQDRAL

SEQ ID NO: 163504 - protein, 9 aa, Homo Sapiens
EECADVLRW

SEQ ID NO: 163505 - protein, 9 aa, Homo Sapiens
DQCLSFKRC

SEQ ID NO: 163506 - protein, 9 aa, Homo Sapiens
LEEIWKVNI

SEQ ID NO: 163507 - protein, 9 aa, Homo Sapiens
LKTFSLLLL

SEQ ID NO: 163508 - protein, 9 aa, Homo Sapiens
CCPASPHSP

SEQ ID NO: 163509 - protein, 9 aa, Homo Sapiens
RSNAFAEKM

SEQ ID NO: 163510 - protein, 9 aa, Homo Sapiens
RSRHLPALE

SEQ ID NO: 163511 - protein, 9 aa, Homo Sapiens
LWSSLNISG

SEQ ID NO: 163512 - protein, 9 aa, Homo Sapiens
ITSCRLQHP

SEQ ID NO: 163513 - protein, 9 aa, Homo Sapiens
SPSSKTALL

SEQ ID NO: 163514 - protein, 9 aa, Homo Sapiens
ESEDAPPKK

SEQ ID NO: 163515 - protein, 9 aa, Homo Sapiens
AARSSSCCP

SEQ ID NO: 163516 - protein, 9 aa, Homo Sapiens
LQVLKSHIP

SEQ ID NO: 163517 - protein, 9 aa, Homo Sapiens
SPCLLPTAT

SEQ ID NO: 163518 - protein, 9 aa, Homo Sapiens
RQVKKGVIS

SEQ ID NO: 163519 - protein, 9 aa, Homo Sapiens
SPTHLFHTD

SEQ ID NO: 163520 - protein, 9 aa, Homo Sapiens
SVPHTTILV

SEQ ID NO: 163521 - protein, 9 aa, Homo Sapiens
MVIWDGLAL

SEQ ID NO: 163522 - protein, 9 aa, Homo Sapiens
GGTLQPRGS

SEQ ID NO: 163523 - protein, 9 aa, Homo Sapiens
ARTGLLPGE

SEQ ID NO: 163524 - protein, 9 aa, Homo Sapiens
ATPAVPSTG

SEQ ID NO: 163525 - protein, 9 aa, Homo Sapiens
YRYADDHFS

SEQ ID NO: 163526 - protein, 9 aa, Homo Sapiens
LVVQVGLFH

SEQ ID NO: 163527 - protein, 9 aa, Homo Sapiens
RPHTFKDLH

SEQ ID NO: 163528 - protein, 9 aa, Homo Sapiens
VKYSDMELE

SEQ ID NO: 163529 - protein, 9 aa, Homo Sapiens
IKLLFSTYW

SEQ ID NO: 163530 - protein, 9 aa, Homo Sapiens
ARMSAGAAR

SEQ ID NO: 163531 - protein, 9 aa, Homo Sapiens
NEVPVTGSS

SEQ ID NO: 163532 - protein, 9 aa, Homo Sapiens
EEVAFRMDE

SEQ ID NO: 163533 - protein, 9 aa, Homo Sapiens
PVNRGFRAL

SEQ ID NO: 163534 - protein, 9 aa, Homo Sapiens
AARVAFGSG

SEQ ID NO: 163535 - protein, 9 aa, Homo Sapiens
PPILQCSYN

SEQ ID NO: 163536 - protein, 9 aa, Homo Sapiens
WREGRARGL

SEQ ID NO: 163537 - protein, 9 aa, Homo Sapiens
QFSGSMHTK

SEQ ID NO: 163538 - protein, 9 aa, Homo Sapiens
RARQSCCLP

SEQ ID NO: 163539 - protein, 9 aa, Homo Sapiens
PTVIRQCCN

SEQ ID NO: 163540 - protein, 9 aa, Homo Sapiens
LDHGLKGTS

SEQ ID NO: 163541 - protein, 9 aa, Homo Sapiens
LPPPTHLRN

SEQ ID NO: 163542 - protein, 9 aa, Homo Sapiens
IPHELIHTR

SEQ ID NO: 163543 - protein, 9 aa, Homo Sapiens
CAWVETFIN

SEQ ID NO: 163544 - protein, 9 aa, Homo Sapiens
LHLKMKTLK

SEQ ID NO: 163545 - protein, 9 aa, Homo Sapiens
CVPRPPAME

SEQ ID NO: 163546 - protein, 9 aa, Homo Sapiens
LDFFSRSHL

SEQ ID NO: 163547 - protein, 9 aa, Homo Sapiens
LSLVNAFAD

SEQ ID NO: 163548 - protein, 9 aa, Homo Sapiens
QKNCELAFT

SEQ ID NO: 163549 - protein, 9 aa, Homo Sapiens
HFRQPQWQL

SEQ ID NO: 163550 - protein, 9 aa, Homo Sapiens
EMESTFSLD

SEQ ID NO: 163551 - protein, 9 aa, Homo Sapiens
QSLNTELLS

SEQ ID NO: 163552 - protein, 9 aa, Homo Sapiens
ARSSSCCPA

SEQ ID NO: 163553 - protein, 9 aa, Homo Sapiens
MDVLNTFKY

SEQ ID NO: 163554 - protein, 9 aa, Homo Sapiens
WYSTANYEN

SEQ ID NO: 163555 - protein, 9 aa, Homo Sapiens
TSQEEYLDG

SEQ ID NO: 163556 - protein, 9 aa, Homo Sapiens
LDYLQQEAP

SEQ ID NO: 163557 - protein, 9 aa, Homo Sapiens
GLHQFQGRD

SEQ ID NO: 163558 - protein, 9 aa, Homo Sapiens
ISLLHSTDM

SEQ ID NO: 163559 - protein, 9 aa, Homo Sapiens
GCPQASAWP

SEQ ID NO: 163560 - protein, 9 aa, Homo Sapiens
PTLTDAAAE

SEQ ID NO: 163561 - protein, 9 aa, Homo Sapiens
TEVGATEET

SEQ ID NO: 163562 - protein, 9 aa, Homo Sapiens
YSLGQPLEN

SEQ ID NO: 163563 - protein, 9 aa, Homo Sapiens
VVVQQQDWN

SEQ ID NO: 163564 - protein, 9 aa, Homo Sapiens
SSMRTSSSM

SEQ ID NO: 163565 - protein, 9 aa, Homo Sapiens
AGPGPPPLS

SEQ ID NO: 163566 - protein, 9 aa, Homo Sapiens
YRFDLLWGV

SEQ ID NO: 163567 - protein, 9 aa, Homo Sapiens
SLSLSGDSS

SEQ ID NO: 163568 - protein, 9 aa, Homo Sapiens
ISHKTRRTR

SEQ ID NO: 163569 - protein, 9 aa, Homo Sapiens
WLELLRQLR

SEQ ID NO: 163570 - protein, 9 aa, Homo Sapiens
FSPEGQPIR

SEQ ID NO: 163571 - protein, 9 aa, Homo Sapiens
FEQEQMEQE

SEQ ID NO: 163572 - protein, 9 aa, Homo Sapiens
WMTRPRAGR

SEQ ID NO: 163573 - protein, 9 aa, Homo Sapiens
VQNCKPKGN

SEQ ID NO: 163574 - protein, 9 aa, Homo Sapiens
STRCGSGGP

SEQ ID NO: 163575 - protein, 9 aa, Homo Sapiens
AKRQTVAME

SEQ ID NO: 163576 - protein, 9 aa, Homo Sapiens
VQCANVAPA

SEQ ID NO: 163577 - protein, 9 aa, Homo Sapiens
SKKSITTER

SEQ ID NO: 163578 - protein, 9 aa, Homo Sapiens
AHCAATGYM

SEQ ID NO: 163579 - protein, 9 aa, Homo Sapiens
TLRCPAVPA

SEQ ID NO: 163580 - protein, 9 aa, Homo Sapiens
GTFYYNRAF

SEQ ID NO: 163581 - protein, 9 aa, Homo Sapiens
STAPVCGKK

SEQ ID NO: 163582 - protein, 9 aa, Homo Sapiens
QGLGEPGCT

SEQ ID NO: 163583 - protein, 9 aa, Homo Sapiens
GRRRTVPGG

SEQ ID NO: 163584 - protein, 9 aa, Homo Sapiens
VPREKRAQW

SEQ ID NO: 163585 - protein, 9 aa, Homo Sapiens
KVVTKWKKM

SEQ ID NO: 163586 - protein, 9 aa, Homo Sapiens
FIRMNKGPL

SEQ ID NO: 163587 - protein, 9 aa, Homo Sapiens
GEPPRSATT

SEQ ID NO: 163588 - protein, 9 aa, Homo Sapiens
GIPGVTHSV

SEQ ID NO: 163589 - protein, 9 aa, Homo Sapiens
THLRNRLPA

SEQ ID NO: 163590 - protein, 9 aa, Homo Sapiens
YAVSSHRNV

SEQ ID NO: 163591 - protein, 9 aa, Homo Sapiens
AAARGGGEA

SEQ ID NO: 163592 - protein, 9 aa, Homo Sapiens
DFKMKVLVI

SEQ ID NO: 163593 - protein, 9 aa, Homo Sapiens
CLPQPTHRF

SEQ ID NO: 163594 - protein, 9 aa, Homo Sapiens
LMLYCEAFL

SEQ ID NO: 163595 - protein, 9 aa, Homo Sapiens
PFCAERLRH

SEQ ID NO: 163596 - protein, 9 aa, Homo Sapiens
EGAEPRQHS

SEQ ID NO: 163597 - protein, 9 aa, Homo Sapiens
VVPPTTAAS

SEQ ID NO: 163598 - protein, 9 aa, Homo Sapiens
ATWTCSLLT

SEQ ID NO: 163599 - protein, 9 aa, Homo Sapiens
SLWPVVPEA

SEQ ID NO: 163600 - protein, 9 aa, Homo Sapiens
GLICLGYVS

SEQ ID NO: 163601 - protein, 9 aa, Homo Sapiens
TLYLVVVAA

SEQ ID NO: 163602 - protein, 9 aa, Homo Sapiens
YIQESTERA

SEQ ID NO: 163603 - protein, 9 aa, Homo Sapiens
IEERCIHQE

SEQ ID NO: 163604 - protein, 9 aa, Homo Sapiens
WGRAWGQMQ

SEQ ID NO: 163605 - protein, 9 aa, Homo Sapiens
ALHNIWLGS

SEQ ID NO: 163606 - protein, 9 aa, Homo Sapiens
QQYQDATTE

SEQ ID NO: 163607 - protein, 9 aa, Homo Sapiens
RTVPGGPGT

SEQ ID NO: 163608 - protein, 9 aa, Homo Sapiens
KRGEQLLEA

SEQ ID NO: 163609 - protein, 9 aa, Homo Sapiens
NPDKVHRDL

SEQ ID NO: 163610 - protein, 9 aa, Homo Sapiens
LRCPAVPAA

SEQ ID NO: 163611 - protein, 9 aa, Homo Sapiens
AQDLPSGLL

SEQ ID NO: 163612 - protein, 9 aa, Homo Sapiens
GHLVVQQVP

SEQ ID NO: 163613 - protein, 9 aa, Homo Sapiens
HPTCILGQR

SEQ ID NO: 163614 - protein, 9 aa, Homo Sapiens
LPPFLLLTV

SEQ ID NO: 163615 - protein, 9 aa, Homo Sapiens
DAELRRWPW

SEQ ID NO: 163616 - protein, 9 aa, Homo Sapiens
PGHGAWNSR

SEQ ID NO: 163617 - protein, 9 aa, Homo Sapiens
QRVETPNSS

SEQ ID NO: 163618 - protein, 9 aa, Homo Sapiens
CRYRCLACH

SEQ ID NO: 163619 - protein, 9 aa, Homo Sapiens
QMPVLKPMD

SEQ ID NO: 163620 - protein, 9 aa, Homo Sapiens
PLAEPRLQR

SEQ ID NO: 163621 - protein, 9 aa, Homo Sapiens
TNSKKAMTA

SEQ ID NO: 163622 - protein, 9 aa, Homo Sapiens
YMQFSGSMH

SEQ ID NO: 163623 - protein, 9 aa, Homo Sapiens
GSILQPDMM

SEQ ID NO: 163624 - protein, 9 aa, Homo Sapiens
NRMNQCAAS

SEQ ID NO: 163625 - protein, 9 aa, Homo Sapiens
EYLDGVRRV

SEQ ID NO: 163626 - protein, 9 aa, Homo Sapiens
CRRHCPRCP

SEQ ID NO: 163627 - protein, 9 aa, Homo Sapiens
LANNRQVCM

SEQ ID NO: 163628 - protein, 9 aa, Homo Sapiens
PATVSLLFC

SEQ ID NO: 163629 - protein, 9 aa, Homo Sapiens
EKTQSRSVI

SEQ ID NO: 163630 - protein, 9 aa, Homo Sapiens
GTAQSNTTC

SEQ ID NO: 163631 - protein, 9 aa, Homo Sapiens
APRPVREAG

SEQ ID NO: 163632 - protein, 9 aa, Homo Sapiens
VVVAAAVSC

SEQ ID NO: 163633 - protein, 9 aa, Homo Sapiens
IRGYTETEP

SEQ ID NO: 163634 - protein, 9 aa, Homo Sapiens
CRLYRTRAG

SEQ ID NO: 163635 - protein, 9 aa, Homo Sapiens
ESEGVEAQE

SEQ ID NO: 163636 - protein, 9 aa, Homo Sapiens
GIFAYLNHH

SEQ ID NO: 163637 - protein, 9 aa, Homo Sapiens
LACHLKYSP

SEQ ID NO: 163638 - protein, 9 aa, Homo Sapiens
AACHPQRVS

SEQ ID NO: 163639 - protein, 9 aa, Homo Sapiens
PSGLLPPVL

SEQ ID NO: 163640 - protein, 9 aa, Homo Sapiens
TERAAEMVK

SEQ ID NO: 163641 - protein, 9 aa, Homo Sapiens
NGAGWPCPA

SEQ ID NO: 163642 - protein, 9 aa, Homo Sapiens
NMKCLTFLM

SEQ ID NO: 163643 - protein, 9 aa, Homo Sapiens
TGPLLCLGP

SEQ ID NO: 163644 - protein, 9 aa, Homo Sapiens
SCPRSAWKR

SEQ ID NO: 163645 - protein, 9 aa, Homo Sapiens
HPVGGAPCT

SEQ ID NO: 163646 - protein, 9 aa, Homo Sapiens
VGGEDAELR

SEQ ID NO: 163647 - protein, 9 aa, Homo Sapiens
QSCTFCKPQ

SEQ ID NO: 163648 - protein, 9 aa, Homo Sapiens
KLQEDTNFP

SEQ ID NO: 163649 - protein, 9 aa, Homo Sapiens
DQALQNDTI

SEQ ID NO: 163650 - protein, 9 aa, Homo Sapiens
EKRHDEMLG

SEQ ID NO: 163651 - protein, 9 aa, Homo Sapiens
TGRAPRVWE

SEQ ID NO: 163652 - protein, 9 aa, Homo Sapiens
DFKRVCTVE

SEQ ID NO: 163653 - protein, 9 aa, Homo Sapiens
KCKCRPRSR

SEQ ID NO: 163654 - protein, 9 aa, Homo Sapiens
MMGIPIRKY

SEQ ID NO: 163655 - protein, 9 aa, Homo Sapiens
QESRLKCSN

SEQ ID NO: 163656 - protein, 9 aa, Homo Sapiens
ICFSLKTPN

SEQ ID NO: 163657 - protein, 9 aa, Homo Sapiens
AQLAESLGG

SEQ ID NO: 163658 - protein, 9 aa, Homo Sapiens
AFYSYTFFL

SEQ ID NO: 163659 - protein, 9 aa, Homo Sapiens
SLKTPNSPP

SEQ ID NO: 163660 - protein, 9 aa, Homo Sapiens
LSIPVLLIM

SEQ ID NO: 163661 - protein, 9 aa, Homo Sapiens
HHVDAHATL

SEQ ID NO: 163662 - protein, 9 aa, Homo Sapiens
IDVHQPQHL

SEQ ID NO: 163663 - protein, 9 aa, Homo Sapiens
HVRHLHHGW

SEQ ID NO: 163664 - protein, 9 aa, Homo Sapiens
PTVCGVLDL

SEQ ID NO: 163665 - protein, 9 aa, Homo Sapiens
CSNPLAREI

SEQ ID NO: 163666 - protein, 9 aa, Homo Sapiens
VATLGPLDP

SEQ ID NO: 163667 - protein, 9 aa, Homo Sapiens
REVNALRQP

SEQ ID NO: 163668 - protein, 9 aa, Homo Sapiens
RARVTCPRS

SEQ ID NO: 163669 - protein, 9 aa, Homo Sapiens
PWSTCVCLL

SEQ ID NO: 163670 - protein, 9 aa, Homo Sapiens
EQCDVHHVE

SEQ ID NO: 163671 - protein, 9 aa, Homo Sapiens
VKGRGQSYI

SEQ ID NO: 163672 - protein, 9 aa, Homo Sapiens
PGSPVWGKG

SEQ ID NO: 163673 - protein, 9 aa, Homo Sapiens
RRWWPSWSP

SEQ ID NO: 163674 - protein, 9 aa, Homo Sapiens
YGSYLYKLQ

SEQ ID NO: 163675 - protein, 9 aa, Homo Sapiens
KVAQSEALS

SEQ ID NO: 163676 - protein, 9 aa, Homo Sapiens
LLGPDWHTP

SEQ ID NO: 163677 - protein, 9 aa, Homo Sapiens
VNMSQKLCL

SEQ ID NO: 163678 - protein, 9 aa, Homo Sapiens
PRLGELPLP

SEQ ID NO: 163679 - protein, 9 aa, Homo Sapiens
AYPSEKSNK

SEQ ID NO: 163680 - protein, 9 aa, Homo Sapiens
TKTVEKNHQ

SEQ ID NO: 163681 - protein, 9 aa, Homo Sapiens
FRFVQSCAG

SEQ ID NO: 163682 - protein, 9 aa, Homo Sapiens
PGLTHPAHQ

SEQ ID NO: 163683 - protein, 9 aa, Homo Sapiens
NPATSSLAE

SEQ ID NO: 163684 - protein, 9 aa, Homo Sapiens
YSQLGNGIT

SEQ ID NO: 163685 - protein, 9 aa, Homo Sapiens
DDFKMKVLV

SEQ ID NO: 163686 - protein, 9 aa, Homo Sapiens
INLTAKRET

SEQ ID NO: 163687 - protein, 9 aa, Homo Sapiens
GAGLQDMGN

SEQ ID NO: 163688 - protein, 9 aa, Homo Sapiens
LPAATQKTQ

SEQ ID NO: 163689 - protein, 9 aa, Homo Sapiens
SPSRSAACG

SEQ ID NO: 163690 - protein, 9 aa, Homo Sapiens
PKVAMAPGT

SEQ ID NO: 163691 - protein, 9 aa, Homo Sapiens
AGVPPPPGV

SEQ ID NO: 163692 - protein, 9 aa, Homo Sapiens
IWWIVQNSF

SEQ ID NO: 163693 - protein, 9 aa, Homo Sapiens
HTVGFPLFL

SEQ ID NO: 163694 - protein, 9 aa, Homo Sapiens
CPPVFSYSW

SEQ ID NO: 163695 - protein, 9 aa, Homo Sapiens
VRYMEEKDD

SEQ ID NO: 163696 - protein, 9 aa, Homo Sapiens
RDTHNGSVG

SEQ ID NO: 163697 - protein, 9 aa, Homo Sapiens
ENFWGEKIV

SEQ ID NO: 163698 - protein, 9 aa, Homo Sapiens
TGSTSDCAL

SEQ ID NO: 163699 - protein, 9 aa, Homo Sapiens
TTKSMQTQD

SEQ ID NO: 163700 - protein, 9 aa, Homo Sapiens
GTSSPSSKT

SEQ ID NO: 163701 - protein, 9 aa, Homo Sapiens
RRSHWSCCR

SEQ ID NO: 163702 - protein, 9 aa, Homo Sapiens
VLLPKSGKR

SEQ ID NO: 163703 - protein, 9 aa, Homo Sapiens
DVGHEGGHH

SEQ ID NO: 163704 - protein, 9 aa, Homo Sapiens
WMGGKTPWL

SEQ ID NO: 163705 - protein, 9 aa, Homo Sapiens
KTCPQKNSA

SEQ ID NO: 163706 - protein, 9 aa, Homo Sapiens
YQRNMIIWS

SEQ ID NO: 163707 - protein, 9 aa, Homo Sapiens
FGSGKCGVC

SEQ ID NO: 163708 - protein, 9 aa, Homo Sapiens
LHAFLISVS

SEQ ID NO: 163709 - protein, 9 aa, Homo Sapiens
TRRLWPPVA

SEQ ID NO: 163710 - protein, 9 aa, Homo Sapiens
PILQCSYNT

SEQ ID NO: 163711 - protein, 9 aa, Homo Sapiens
PPPGVSLSL

SEQ ID NO: 163712 - protein, 9 aa, Homo Sapiens
FYIQELQAL

SEQ ID NO: 163713 - protein, 9 aa, Homo Sapiens
QRAPLNWHM

SEQ ID NO: 163714 - protein, 9 aa, Homo Sapiens
FSTYWFFFL

SEQ ID NO: 163715 - protein, 9 aa, Homo Sapiens
LRQLRTGNL

SEQ ID NO: 163716 - protein, 9 aa, Homo Sapiens
CATATTIAN

SEQ ID NO: 163717 - protein, 9 aa, Homo Sapiens
RGPPDRWVQ

SEQ ID NO: 163718 - protein, 9 aa, Homo Sapiens
SNAFAEKMD

SEQ ID NO: 163719 - protein, 9 aa, Homo Sapiens
QDVAGPRQQ

SEQ ID NO: 163720 - protein, 9 aa, Homo Sapiens
SNESQPILQ

SEQ ID NO: 163721 - protein, 9 aa, Homo Sapiens
TLLFLIITT

SEQ ID NO: 163722 - protein, 9 aa, Homo Sapiens
SAQSSSCLR

SEQ ID NO: 163723 - protein, 9 aa, Homo Sapiens
NRGGLPVDD

SEQ ID NO: 163724 - protein, 9 aa, Homo Sapiens
GWYRCYYGS

SEQ ID NO: 163725 - protein, 9 aa, Homo Sapiens
APSPQEGVF

SEQ ID NO: 163726 - protein, 9 aa, Homo Sapiens
LGSPGCLRP

SEQ ID NO: 163727 - protein, 9 aa, Homo Sapiens
VCMGGRVAV

SEQ ID NO: 163728 - protein, 9 aa, Homo Sapiens
YYMSAHHMA

SEQ ID NO: 163729 - protein, 9 aa, Homo Sapiens
QVSHSMHKK

SEQ ID NO: 163730 - protein, 9 aa, Homo Sapiens
ILKIVADFL

SEQ ID NO: 163731 - protein, 9 aa, Homo Sapiens
DNRQCDTVV

SEQ ID NO: 163732 - protein, 9 aa, Homo Sapiens
LAQAIAVQA

SEQ ID NO: 163733 - protein, 9 aa, Homo Sapiens
NAEEAKKAI

SEQ ID NO: 163734 - protein, 9 aa, Homo Sapiens
GSLSHWDAE

SEQ ID NO: 163735 - protein, 9 aa, Homo Sapiens
IDCGKVFYQ

SEQ ID NO: 163736 - protein, 9 aa, Homo Sapiens
LYLRTSGEP

SEQ ID NO: 163737 - protein, 9 aa, Homo Sapiens
KRRGCPRKQ

SEQ ID NO: 163738 - protein, 9 aa, Homo Sapiens
TETTSSEEE

SEQ ID NO: 163739 - protein, 9 aa, Homo Sapiens
VVTKTVEKN

SEQ ID NO: 163740 - protein, 9 aa, Homo Sapiens
TKISLPKKK

SEQ ID NO: 163741 - protein, 9 aa, Homo Sapiens
WRIGGGTPL

SEQ ID NO: 163742 - protein, 9 aa, Homo Sapiens
RNCMAATLT

SEQ ID NO: 163743 - protein, 9 aa, Homo Sapiens
KVSREELNQ

SEQ ID NO: 163744 - protein, 9 aa, Homo Sapiens
SMLKGRPKL

SEQ ID NO: 163745 - protein, 9 aa, Homo Sapiens
LKTPNSPPT

SEQ ID NO: 163746 - protein, 9 aa, Homo Sapiens
GGTFPRVLT

SEQ ID NO: 163747 - protein, 9 aa, Homo Sapiens
ARMDSQDTL

SEQ ID NO: 163748 - protein, 9 aa, Homo Sapiens
EPGPAAGGC

SEQ ID NO: 163749 - protein, 9 aa, Homo Sapiens
VAPAPTSWT

SEQ ID NO: 163750 - protein, 9 aa, Homo Sapiens
RAPSSRRSR

SEQ ID NO: 163751 - protein, 9 aa, Homo Sapiens
IEVSKKTHT

SEQ ID NO: 163752 - protein, 9 aa, Homo Sapiens
CQKWPFIVK

SEQ ID NO: 163753 - protein, 9 aa, Homo Sapiens
SKKKDLHDV

SEQ ID NO: 163754 - protein, 9 aa, Homo Sapiens
QPPGQRVET

SEQ ID NO: 163755 - protein, 9 aa, Homo Sapiens
ERQVKKGVI

SEQ ID NO: 163756 - protein, 9 aa, Homo Sapiens
FVPAFLNCW

SEQ ID NO: 163757 - protein, 9 aa, Homo Sapiens
MLSNQSFSN

SEQ ID NO: 163758 - protein, 9 aa, Homo Sapiens
DATWERMWK

SEQ ID NO: 163759 - protein, 9 aa, Homo Sapiens
QKTQRRSFS

SEQ ID NO: 163760 - protein, 9 aa, Homo Sapiens
SLKATTIDQ

SEQ ID NO: 163761 - protein, 9 aa, Homo Sapiens
VEKLNLGID

SEQ ID NO: 163762 - protein, 9 aa, Homo Sapiens
LAEQTATEK

SEQ ID NO: 163763 - protein, 9 aa, Homo Sapiens
GLAKLLLGF

SEQ ID NO: 163764 - protein, 9 aa, Homo Sapiens
RMMRRQWSL

SEQ ID NO: 163765 - protein, 9 aa, Homo Sapiens
LPKEKTIKK

SEQ ID NO: 163766 - protein, 9 aa, Homo Sapiens
NFLPLLVEV

SEQ ID NO: 163767 - protein, 9 aa, Homo Sapiens
TAMWLSASH

SEQ ID NO: 163768 - protein, 9 aa, Homo Sapiens
TWPTQTWTR

SEQ ID NO: 163769 - protein, 9 aa, Homo Sapiens
REYWRDCLL

SEQ ID NO: 163770 - protein, 9 aa, Homo Sapiens
FCRPPPEHF

SEQ ID NO: 163771 - protein, 9 aa, Homo Sapiens
GSLQLVEHP

SEQ ID NO: 163772 - protein, 9 aa, Homo Sapiens
RETSEEIQK

SEQ ID NO: 163773 - protein, 9 aa, Homo Sapiens
PLHRTTNPH

SEQ ID NO: 163774 - protein, 9 aa, Homo Sapiens
SHSQHLPST

SEQ ID NO: 163775 - protein, 9 aa, Homo Sapiens
GFCLSSQLA

SEQ ID NO: 163776 - protein, 9 aa, Homo Sapiens
KERELGHLK

SEQ ID NO: 163777 - protein, 9 aa, Homo Sapiens
AFTMTFFGL

SEQ ID NO: 163778 - protein, 9 aa, Homo Sapiens
RSRRCEQSS

SEQ ID NO: 163779 - protein, 9 aa, Homo Sapiens
PLSLQCQSL

SEQ ID NO: 163780 - protein, 9 aa, Homo Sapiens
LIYDTLERP

SEQ ID NO: 163781 - protein, 9 aa, Homo Sapiens
PLPAQTRWC

SEQ ID NO: 163782 - protein, 9 aa, Homo Sapiens
LPEYLSHGL

SEQ ID NO: 163783 - protein, 9 aa, Homo Sapiens
CLLTGYLNL

SEQ ID NO: 163784 - protein, 9 aa, Homo Sapiens
KSQIAKKSN

SEQ ID NO: 163785 - protein, 9 aa, Homo Sapiens
IRKARGVFV

SEQ ID NO: 163786 - protein, 9 aa, Homo Sapiens
LYPEISYCQ

SEQ ID NO: 163787 - protein, 9 aa, Homo Sapiens
NGCSRMNSK

SEQ ID NO: 163788 - protein, 9 aa, Homo Sapiens
RPRAGRTSH

SEQ ID NO: 163789 - protein, 9 aa, Homo Sapiens
LQTKWMLQS

SEQ ID NO: 163790 - protein, 9 aa, Homo Sapiens
DSNSSNSDQ

SEQ ID NO: 163791 - protein, 9 aa, Homo Sapiens
PAAGGCPQD

SEQ ID NO: 163792 - protein, 9 aa, Homo Sapiens
ATVPKLVLF

SEQ ID NO: 163793 - protein, 9 aa, Homo Sapiens
QGWEDRTKR

SEQ ID NO: 163794 - protein, 9 aa, Homo Sapiens
CMAATLTIT

SEQ ID NO: 163795 - protein, 9 aa, Homo Sapiens
KRVCTVELS

SEQ ID NO: 163796 - protein, 9 aa, Homo Sapiens
GAIRGWAAR

SEQ ID NO: 163797 - protein, 9 aa, Homo Sapiens
HGLMVSLST

SEQ ID NO: 163798 - protein, 9 aa, Homo Sapiens
LWFKCGARA

SEQ ID NO: 163799 - protein, 9 aa, Homo Sapiens
PVGSGSPRR

SEQ ID NO: 163800 - protein, 9 aa, Homo Sapiens
PATTLARVP

SEQ ID NO: 163801 - protein, 9 aa, Homo Sapiens
PRFHSSPDL

SEQ ID NO: 163802 - protein, 9 aa, Homo Sapiens
CQRRGRCIN

SEQ ID NO: 163803 - protein, 9 aa, Homo Sapiens
LLGWLINDQ

SEQ ID NO: 163804 - protein, 9 aa, Homo Sapiens
VVFNGALKH

SEQ ID NO: 163805 - protein, 9 aa, Homo Sapiens
WTHPQPRSG

SEQ ID NO: 163806 - protein, 9 aa, Homo Sapiens
PAATQKTQR

SEQ ID NO: 163807 - protein, 9 aa, Homo Sapiens
CVSTPGPAS

SEQ ID NO: 163808 - protein, 9 aa, Homo Sapiens
ATTLARVPA

SEQ ID NO: 163809 - protein, 9 aa, Homo Sapiens
REESIPKKS

SEQ ID NO: 163810 - protein, 9 aa, Homo Sapiens
SPKPSRMLG

SEQ ID NO: 163811 - protein, 9 aa, Homo Sapiens
LFFVVMKGL

SEQ ID NO: 163812 - protein, 9 aa, Homo Sapiens
LTLKRFPAS

SEQ ID NO: 163813 - protein, 9 aa, Homo Sapiens
VHHHLDSNF

SEQ ID NO: 163814 - protein, 9 aa, Homo Sapiens
EEVVEHLKA

SEQ ID NO: 163815 - protein, 9 aa, Homo Sapiens
PPSIYTITP

SEQ ID NO: 163816 - protein, 9 aa, Homo Sapiens
KRRAAIVLG

SEQ ID NO: 163817 - protein, 9 aa, Homo Sapiens
AGVGLAASF

SEQ ID NO: 163818 - protein, 9 aa, Homo Sapiens
KSMQTQDSS

SEQ ID NO: 163819 - protein, 9 aa, Homo Sapiens
KTRGQILFP

SEQ ID NO: 163820 - protein, 9 aa, Homo Sapiens
PLKWYTPEC

SEQ ID NO: 163821 - protein, 9 aa, Homo Sapiens
HETLRCPHL

SEQ ID NO: 163822 - protein, 9 aa, Homo Sapiens
GRPCDDEDW

SEQ ID NO: 163823 - protein, 9 aa, Homo Sapiens
KQHRRTSME

SEQ ID NO: 163824 - protein, 9 aa, Homo Sapiens
TCISMTTIS

SEQ ID NO: 163825 - protein, 9 aa, Homo Sapiens
RNRLPALTS

SEQ ID NO: 163826 - protein, 9 aa, Homo Sapiens
RVRGARPAG

SEQ ID NO: 163827 - protein, 9 aa, Homo Sapiens
RLVATPALP

SEQ ID NO: 163828 - protein, 9 aa, Homo Sapiens
VLLFIAETD

SEQ ID NO: 163829 - protein, 9 aa, Homo Sapiens
CCDNCPYNH

SEQ ID NO: 163830 - protein, 9 aa, Homo Sapiens
LLERQVKKG

SEQ ID NO: 163831 - protein, 9 aa, Homo Sapiens
SVWNASRPP

SEQ ID NO: 163832 - protein, 9 aa, Homo Sapiens
NFLNPPQGV

SEQ ID NO: 163833 - protein, 9 aa, Homo Sapiens
LSFKRCGNI

SEQ ID NO: 163834 - protein, 9 aa, Homo Sapiens
RVAFGSGKC

SEQ ID NO: 163835 - protein, 9 aa, Homo Sapiens
GELRPASAR

SEQ ID NO: 163836 - protein, 9 aa, Homo Sapiens
DKHGPYNLK

SEQ ID NO: 163837 - protein, 9 aa, Homo Sapiens
CRILRGHDG

SEQ ID NO: 163838 - protein, 9 aa, Homo Sapiens
EGIPPTSRG

SEQ ID NO: 163839 - protein, 9 aa, Homo Sapiens
TGVGSGLQG

SEQ ID NO: 163840 - protein, 9 aa, Homo Sapiens
TPVVCHDEV

SEQ ID NO: 163841 - protein, 9 aa, Homo Sapiens
EEKTQSRSV

SEQ ID NO: 163842 - protein, 9 aa, Homo Sapiens
GMGDQALID

SEQ ID NO: 163843 - protein, 9 aa, Homo Sapiens
LHGKPDVDH

SEQ ID NO: 163844 - protein, 9 aa, Homo Sapiens
ALCSRWPQE

SEQ ID NO: 163845 - protein, 9 aa, Homo Sapiens
PPGQRVETP

SEQ ID NO: 163846 - protein, 9 aa, Homo Sapiens
KKKKMPKLH

SEQ ID NO: 163847 - protein, 9 aa, Homo Sapiens
VSEEIEAWI

SEQ ID NO: 163848 - protein, 9 aa, Homo Sapiens
LLAWPVPSV

SEQ ID NO: 163849 - protein, 9 aa, Homo Sapiens
EAQRKQFPD

SEQ ID NO: 163850 - protein, 9 aa, Homo Sapiens
LLYLHQLPV

SEQ ID NO: 163851 - protein, 9 aa, Homo Sapiens
ECDKVCSRV

SEQ ID NO: 163852 - protein, 9 aa, Homo Sapiens
GRLVIVGHG

SEQ ID NO: 163853 - protein, 9 aa, Homo Sapiens
KECRMSGDL

SEQ ID NO: 163854 - protein, 9 aa, Homo Sapiens
VQLSKSKNL

SEQ ID NO: 163855 - protein, 9 aa, Homo Sapiens
MPPPANPQL

SEQ ID NO: 163856 - protein, 9 aa, Homo Sapiens
YQDATTEEE

SEQ ID NO: 163857 - protein, 9 aa, Homo Sapiens
EKRRVALER

SEQ ID NO: 163858 - protein, 9 aa, Homo Sapiens
RTDLLGLHV

SEQ ID NO: 163859 - protein, 9 aa, Homo Sapiens
ISSRTRVLM

SEQ ID NO: 163860 - protein, 9 aa, Homo Sapiens
AGLQDMGNT

SEQ ID NO: 163861 - protein, 9 aa, Homo Sapiens
PGSPRLCAT

SEQ ID NO: 163862 - protein, 9 aa, Homo Sapiens
VCDITDLDM

SEQ ID NO: 163863 - protein, 9 aa, Homo Sapiens
LYKSKKTLN

SEQ ID NO: 163864 - protein, 9 aa, Homo Sapiens
RAAGAIRGW

SEQ ID NO: 163865 - protein, 9 aa, Homo Sapiens
LIHTENRIG

SEQ ID NO: 163866 - protein, 9 aa, Homo Sapiens
REPATPAVP

SEQ ID NO: 163867 - protein, 9 aa, Homo Sapiens
TCAQVPAHS

SEQ ID NO: 163868 - protein, 9 aa, Homo Sapiens
SVSHSVLLF

SEQ ID NO: 163869 - protein, 9 aa, Homo Sapiens
RDRLVGRSQ

SEQ ID NO: 163870 - protein, 9 aa, Homo Sapiens
FRCPAADNP

SEQ ID NO: 163871 - protein, 9 aa, Homo Sapiens
RVFCLLGTF

SEQ ID NO: 163872 - protein, 9 aa, Homo Sapiens
RSFLRMPLM

SEQ ID NO: 163873 - protein, 9 aa, Homo Sapiens
ELAGQWGGG

SEQ ID NO: 163874 - protein, 9 aa, Homo Sapiens
NLALRMMRR

SEQ ID NO: 163875 - protein, 9 aa, Homo Sapiens
PPPAPESGP

SEQ ID NO: 163876 - protein, 9 aa, Homo Sapiens
PIPSPSAHS

SEQ ID NO: 163877 - protein, 9 aa, Homo Sapiens
RWGAPMQKP

SEQ ID NO: 163878 - protein, 9 aa, Homo Sapiens
LFPCLRLLP

SEQ ID NO: 163879 - protein, 9 aa, Homo Sapiens
RWTWRPGSR

SEQ ID NO: 163880 - protein, 9 aa, Homo Sapiens
NILMTEENK

SEQ ID NO: 163881 - protein, 9 aa, Homo Sapiens
MAPETTLWL

SEQ ID NO: 163882 - protein, 9 aa, Homo Sapiens
REARLVSKA

SEQ ID NO: 163883 - protein, 9 aa, Homo Sapiens
LWEADSGAG

SEQ ID NO: 163884 - protein, 9 aa, Homo Sapiens
LDVSLAFLY

SEQ ID NO: 163885 - protein, 9 aa, Homo Sapiens
ERELEGGWG

SEQ ID NO: 163886 - protein, 9 aa, Homo Sapiens
VGNEVPVTG

SEQ ID NO: 163887 - protein, 9 aa, Homo Sapiens
TVRRFESPE

SEQ ID NO: 163888 - protein, 9 aa, Homo Sapiens
RAAMAPSCC

SEQ ID NO: 163889 - protein, 9 aa, Homo Sapiens
WPPPYQWDP

SEQ ID NO: 163890 - protein, 9 aa, Homo Sapiens
VRLQKYPQA

SEQ ID NO: 163891 - protein, 9 aa, Homo Sapiens
QPLELRLLS

SEQ ID NO: 163892 - protein, 9 aa, Homo Sapiens
QCQACFSQR

SEQ ID NO: 163893 - protein, 9 aa, Homo Sapiens
LKRLLSRVR

SEQ ID NO: 163894 - protein, 9 aa, Homo Sapiens
CTMPPLLHP

SEQ ID NO: 163895 - protein, 9 aa, Homo Sapiens
TEGNCSNYP

SEQ ID NO: 163896 - protein, 9 aa, Homo Sapiens
MSVQEPPTK

SEQ ID NO: 163897 - protein, 9 aa, Homo Sapiens
GAMGGSRTP

SEQ ID NO: 163898 - protein, 9 aa, Homo Sapiens
RVLLKWTEY

SEQ ID NO: 163899 - protein, 9 aa, Homo Sapiens
PHLRAVLES

SEQ ID NO: 163900 - protein, 9 aa, Homo Sapiens
FTHLTVNIR

SEQ ID NO: 163901 - protein, 9 aa, Homo Sapiens
LSLVVVNQL

SEQ ID NO: 163902 - protein, 9 aa, Homo Sapiens
SWRKRDQKR

SEQ ID NO: 163903 - protein, 9 aa, Homo Sapiens
GNVSKDEID

SEQ ID NO: 163904 - protein, 9 aa, Homo Sapiens
IVFILVWGP

SEQ ID NO: 163905 - protein, 9 aa, Homo Sapiens
VSPVGPSAG

SEQ ID NO: 163906 - protein, 9 aa, Homo Sapiens
TSGPHCTRA

SEQ ID NO: 163907 - protein, 9 aa, Homo Sapiens
GHELSSLHS

SEQ ID NO: 163908 - protein, 9 aa, Homo Sapiens
SGAGNHSYY

SEQ ID NO: 163909 - protein, 9 aa, Homo Sapiens
CSSIYRSSS

SEQ ID NO: 163910 - protein, 9 aa, Homo Sapiens
SYPDAILHA

SEQ ID NO: 163911 - protein, 9 aa, Homo Sapiens
ATLTLAVAP

SEQ ID NO: 163912 - protein, 9 aa, Homo Sapiens
TGQIDKSYP

SEQ ID NO: 163913 - protein, 9 aa, Homo Sapiens
LGTTVITTC

SEQ ID NO: 163914 - protein, 9 aa, Homo Sapiens
MVCNLALRM

SEQ ID NO: 163915 - protein, 9 aa, Homo Sapiens
VRSLKAGNV

SEQ ID NO: 163916 - protein, 9 aa, Homo Sapiens
KTDNLHHSW

SEQ ID NO: 163917 - protein, 9 aa, Homo Sapiens
SAWTHPQPR

SEQ ID NO: 163918 - protein, 9 aa, Homo Sapiens
IIDVSNEHM

SEQ ID NO: 163919 - protein, 9 aa, Homo Sapiens
TSINEHILA

SEQ ID NO: 163920 - protein, 9 aa, Homo Sapiens
GEWALQSSA

SEQ ID NO: 163921 - protein, 9 aa, Homo Sapiens
CRGTESTMW

SEQ ID NO: 163922 - protein, 9 aa, Homo Sapiens
VHLFEWQWV

SEQ ID NO: 163923 - protein, 9 aa, Homo Sapiens
HEAETLALV

SEQ ID NO: 163924 - protein, 9 aa, Homo Sapiens
CQLVLPEPN

SEQ ID NO: 163925 - protein, 9 aa, Homo Sapiens
IVIMAIICF

SEQ ID NO: 163926 - protein, 9 aa, Homo Sapiens
FCLSSQLAW

SEQ ID NO: 163927 - protein, 9 aa, Homo Sapiens
LPAQTRWCW

SEQ ID NO: 163928 - protein, 9 aa, Homo Sapiens
LQGHGQDVA

SEQ ID NO: 163929 - protein, 9 aa, Homo Sapiens
PPAWSALRV

SEQ ID NO: 163930 - protein, 9 aa, Homo Sapiens
YFLYFSDLE

SEQ ID NO: 163931 - protein, 9 aa, Homo Sapiens
DPLNRRTIV

SEQ ID NO: 163932 - protein, 9 aa, Homo Sapiens
FSSDQWYRA

SEQ ID NO: 163933 - protein, 9 aa, Homo Sapiens
TAAMAYGLH

SEQ ID NO: 163934 - protein, 9 aa, Homo Sapiens
VLLCLDGKR

SEQ ID NO: 163935 - protein, 9 aa, Homo Sapiens
CTATVGPWM

SEQ ID NO: 163936 - protein, 9 aa, Homo Sapiens
CLARGDLCA

SEQ ID NO: 163937 - protein, 9 aa, Homo Sapiens
DSFAAVRLC

SEQ ID NO: 163938 - protein, 9 aa, Homo Sapiens
STEGAGETF

SEQ ID NO: 163939 - protein, 9 aa, Homo Sapiens
KAYKTTWGR

SEQ ID NO: 163940 - protein, 9 aa, Homo Sapiens
DRCYERGLT

SEQ ID NO: 163941 - protein, 9 aa, Homo Sapiens
DPRLPPQSF

SEQ ID NO: 163942 - protein, 9 aa, Homo Sapiens
LLVEVHQKK

SEQ ID NO: 163943 - protein, 9 aa, Homo Sapiens
GCMVEPPRM

SEQ ID NO: 163944 - protein, 9 aa, Homo Sapiens
VETFINVKA

SEQ ID NO: 163945 - protein, 9 aa, Homo Sapiens
LGHLLHQEF

SEQ ID NO: 163946 - protein, 9 aa, Homo Sapiens
SNGLTSGPH

SEQ ID NO: 163947 - protein, 9 aa, Homo Sapiens
SHHLNAVLA

SEQ ID NO: 163948 - protein, 9 aa, Homo Sapiens
ASRWWSWQQ

SEQ ID NO: 163949 - protein, 9 aa, Homo Sapiens
WGAVECFVS

SEQ ID NO: 163950 - protein, 9 aa, Homo Sapiens
CLLLVVGSY

SEQ ID NO: 163951 - protein, 9 aa, Homo Sapiens
VDNINTLDS

SEQ ID NO: 163952 - protein, 9 aa, Homo Sapiens
RVTMATYPD

SEQ ID NO: 163953 - protein, 9 aa, Homo Sapiens
HGCQPISTA

SEQ ID NO: 163954 - protein, 9 aa, Homo Sapiens
RSHLDFSPY

SEQ ID NO: 163955 - protein, 9 aa, Homo Sapiens
FFLSLVVVN

SEQ ID NO: 163956 - protein, 9 aa, Homo Sapiens
EVVENAETE

SEQ ID NO: 163957 - protein, 9 aa, Homo Sapiens
VSHLSQEHR

SEQ ID NO: 163958 - protein, 9 aa, Homo Sapiens
GPHAPPTWL

SEQ ID NO: 163959 - protein, 9 aa, Homo Sapiens
TAARARAGG

SEQ ID NO: 163960 - protein, 9 aa, Homo Sapiens
HDTFSGVLC

SEQ ID NO: 163961 - protein, 9 aa, Homo Sapiens
KLLFSTYWF

SEQ ID NO: 163962 - protein, 9 aa, Homo Sapiens
ERPTKAHSI

SEQ ID NO: 163963 - protein, 9 aa, Homo Sapiens
KLLEGKECR

SEQ ID NO: 163964 - protein, 9 aa, Homo Sapiens
SPSASSLTS

SEQ ID NO: 163965 - protein, 9 aa, Homo Sapiens
ALYRDGMLE

SEQ ID NO: 163966 - protein, 9 aa, Homo Sapiens
RARPAAPQA

SEQ ID NO: 163967 - protein, 9 aa, Homo Sapiens
CLLGGRCNW

SEQ ID NO: 163968 - protein, 9 aa, Homo Sapiens
PGSPALCFA

SEQ ID NO: 163969 - protein, 9 aa, Homo Sapiens
ATCEPSPCQ

SEQ ID NO: 163970 - protein, 9 aa, Homo Sapiens
SLFDHHVQG

SEQ ID NO: 163971 - protein, 9 aa, Homo Sapiens
NGGSRGKGE

SEQ ID NO: 163972 - protein, 9 aa, Homo Sapiens
DWNLALGKT

SEQ ID NO: 163973 - protein, 9 aa, Homo Sapiens
ENGSPGKSP

SEQ ID NO: 163974 - protein, 9 aa, Homo Sapiens
ALPLLLLGQ

SEQ ID NO: 163975 - protein, 9 aa, Homo Sapiens
TSTPVPPSP

SEQ ID NO: 163976 - protein, 9 aa, Homo Sapiens
YVYRASQGG

SEQ ID NO: 163977 - protein, 9 aa, Homo Sapiens
STNFLPLLV

SEQ ID NO: 163978 - protein, 9 aa, Homo Sapiens
GEGAERGSA

SEQ ID NO: 163979 - protein, 9 aa, Homo Sapiens
PCTTPPAWR

SEQ ID NO: 163980 - protein, 9 aa, Homo Sapiens
KYPQAAAVP

SEQ ID NO: 163981 - protein, 9 aa, Homo Sapiens
RDCLLKMKA

SEQ ID NO: 163982 - protein, 9 aa, Homo Sapiens
SPPTAAVAV

SEQ ID NO: 163983 - protein, 9 aa, Homo Sapiens
FVEKRRVAL

SEQ ID NO: 163984 - protein, 9 aa, Homo Sapiens
YSTANYENQ

SEQ ID NO: 163985 - protein, 9 aa, Homo Sapiens
THSTSANGI

SEQ ID NO: 163986 - protein, 9 aa, Homo Sapiens
RPRSQRSWH

SEQ ID NO: 163987 - protein, 9 aa, Homo Sapiens
QPDMMCARG

SEQ ID NO: 163988 - protein, 9 aa, Homo Sapiens
LYTFLREVA

SEQ ID NO: 163989 - protein, 9 aa, Homo Sapiens
FQYLPSSWP

SEQ ID NO: 163990 - protein, 9 aa, Homo Sapiens
ANPQLLCQN

SEQ ID NO: 163991 - protein, 9 aa, Homo Sapiens
APGSPRLCA

SEQ ID NO: 163992 - protein, 9 aa, Homo Sapiens
LLLLGQGWE

SEQ ID NO: 163993 - protein, 9 aa, Homo Sapiens
WSTADGQCY

SEQ ID NO: 163994 - protein, 9 aa, Homo Sapiens
VAELGEQIN

SEQ ID NO: 163995 - protein, 9 aa, Homo Sapiens
PQPRSGWRT

SEQ ID NO: 163996 - protein, 9 aa, Homo Sapiens
LRKCVDIIL

SEQ ID NO: 163997 - protein, 9 aa, Homo Sapiens
TQRRASTKS

SEQ ID NO: 163998 - protein, 9 aa, Homo Sapiens
VHHKENTEL

SEQ ID NO: 163999 - protein, 9 aa, Homo Sapiens
QWAPHSAGL

SEQ ID NO: 164000 - protein, 9 aa, Homo Sapiens
TATWTCSLL

SEQ ID NO: 164001 - protein, 9 aa, Homo Sapiens
LGKWVIRKT

SEQ ID NO: 164002 - protein, 9 aa, Homo Sapiens
AGTGTRIAA

SEQ ID NO: 164003 - protein, 9 aa, Homo Sapiens
LDSSRSEKI

SEQ ID NO: 164004 - protein, 9 aa, Homo Sapiens
TWKLAILAE

SEQ ID NO: 164005 - protein, 9 aa, Homo Sapiens
LNTASSSAT

SEQ ID NO: 164006 - protein, 9 aa, Homo Sapiens
GNTGTILLI

SEQ ID NO: 164007 - protein, 9 aa, Homo Sapiens
WSPGHGAWN

SEQ ID NO: 164008 - protein, 9 aa, Homo Sapiens
RGFDTYFGC

SEQ ID NO: 164009 - protein, 9 aa, Homo Sapiens
VGGAPCTTP

SEQ ID NO: 164010 - protein, 9 aa, Homo Sapiens
AGETFRGTS

SEQ ID NO: 164011 - protein, 9 aa, Homo Sapiens
RLYRTRAGY

SEQ ID NO: 164012 - protein, 9 aa, Homo Sapiens
LTSWASRSP

SEQ ID NO: 164013 - protein, 9 aa, Homo Sapiens
EGCFIATVR

SEQ ID NO: 164014 - protein, 9 aa, Homo Sapiens
QSILSTMNV

SEQ ID NO: 164015 - protein, 9 aa, Homo Sapiens
VKQVSHSMH

SEQ ID NO: 164016 - protein, 9 aa, Homo Sapiens
SCSWCPTTS

SEQ ID NO: 164017 - protein, 9 aa, Homo Sapiens
LPEPGPAAG

SEQ ID NO: 164018 - protein, 9 aa, Homo Sapiens
LSLLAGVPP

SEQ ID NO: 164019 - protein, 9 aa, Homo Sapiens
LDMLKTKQR

SEQ ID NO: 164020 - protein, 9 aa, Homo Sapiens
LSRTAWTEA

SEQ ID NO: 164021 - protein, 9 aa, Homo Sapiens
ESANARVTN

SEQ ID NO: 164022 - protein, 9 aa, Homo Sapiens
LRVTHSAAP

SEQ ID NO: 164023 - protein, 9 aa, Homo Sapiens
IFLNMRGLY

SEQ ID NO: 164024 - protein, 9 aa, Homo Sapiens
VNPGMVISG

SEQ ID NO: 164025 - protein, 9 aa, Homo Sapiens
LWPVVPEAS

SEQ ID NO: 164026 - protein, 9 aa, Homo Sapiens
LGYVSLKLE

SEQ ID NO: 164027 - protein, 9 aa, Homo Sapiens
GPGTAEGPA

SEQ ID NO: 164028 - protein, 9 aa, Homo Sapiens
TFGMSVCSW

SEQ ID NO: 164029 - protein, 9 aa, Homo Sapiens
CRVPLGKEG

SEQ ID NO: 164030 - protein, 9 aa, Homo Sapiens
CHAEGIPIP

SEQ ID NO: 164031 - protein, 9 aa, Homo Sapiens
RKDLDGLLY

SEQ ID NO: 164032 - protein, 9 aa, Homo Sapiens
PQPPVMVKT

SEQ ID NO: 164033 - protein, 9 aa, Homo Sapiens
PDNDNWLED

SEQ ID NO: 164034 - protein, 9 aa, Homo Sapiens
PRRPSSGCG

SEQ ID NO: 164035 - protein, 9 aa, Homo Sapiens
NTIRTYQVY

SEQ ID NO: 164036 - protein, 9 aa, Homo Sapiens
NDKHEPFWE

SEQ ID NO: 164037 - protein, 9 aa, Homo Sapiens
TLGPLDPPV

SEQ ID NO: 164038 - protein, 9 aa, Homo Sapiens
FTMTFFGLA

SEQ ID NO: 164039 - protein, 9 aa, Homo Sapiens
GSVHLHRFT

SEQ ID NO: 164040 - protein, 9 aa, Homo Sapiens
CKDRKLDRR

SEQ ID NO: 164041 - protein, 9 aa, Homo Sapiens
TPRQQHEST

SEQ ID NO: 164042 - protein, 9 aa, Homo Sapiens
AVAKGFLTC

SEQ ID NO: 164043 - protein, 9 aa, Homo Sapiens
FCWHIHKKG

SEQ ID NO: 164044 - protein, 9 aa, Homo Sapiens
PGSSWRSYP

SEQ ID NO: 164045 - protein, 9 aa, Homo Sapiens
HRGPVRHLH

SEQ ID NO: 164046 - protein, 9 aa, Homo Sapiens
EREAKAEMH

SEQ ID NO: 164047 - protein, 9 aa, Homo Sapiens
SQVAGDPDV

SEQ ID NO: 164048 - protein, 9 aa, Homo Sapiens
TRPRGAGAA

SEQ ID NO: 164049 - protein, 9 aa, Homo Sapiens
RLVGRSQPG

SEQ ID NO: 164050 - protein, 9 aa, Homo Sapiens
ESKPAQQKR

SEQ ID NO: 164051 - protein, 9 aa, Homo Sapiens
RLPPPTHLR

SEQ ID NO: 164052 - protein, 9 aa, Homo Sapiens
FLYKSKKTL

SEQ ID NO: 164053 - protein, 9 aa, Homo Sapiens
HSQVSVTQN

SEQ ID NO: 164054 - protein, 9 aa, Homo Sapiens
CSKFDIDIR

SEQ ID NO: 164055 - protein, 9 aa, Homo Sapiens
SSWKMAALF

SEQ ID NO: 164056 - protein, 9 aa, Homo Sapiens
DKMLLTLAQ

SEQ ID NO: 164057 - protein, 9 aa, Homo Sapiens
RNDQPEQEE

SEQ ID NO: 164058 - protein, 9 aa, Homo Sapiens
KAFSRSSKV

SEQ ID NO: 164059 - protein, 9 aa, Homo Sapiens
ANIQYQVVP

SEQ ID NO: 164060 - protein, 9 aa, Homo Sapiens
LPTEQPPAP

SEQ ID NO: 164061 - protein, 9 aa, Homo Sapiens
KAFLTQTHL

SEQ ID NO: 164062 - protein, 9 aa, Homo Sapiens
NVEAIGFLG

SEQ ID NO: 164063 - protein, 9 aa, Homo Sapiens
TTPVNPRVS

SEQ ID NO: 164064 - protein, 9 aa, Homo Sapiens
TQEKWGYPR

SEQ ID NO: 164065 - protein, 9 aa, Homo Sapiens
LRNLFVPAF

SEQ ID NO: 164066 - protein, 9 aa, Homo Sapiens
TLHCHLSPE

SEQ ID NO: 164067 - protein, 9 aa, Homo Sapiens
NLHLFYDVC

SEQ ID NO: 164068 - protein, 9 aa, Homo Sapiens
SRGPSTPAC

SEQ ID NO: 164069 - protein, 9 aa, Homo Sapiens
NHSKCITEC

SEQ ID NO: 164070 - protein, 9 aa, Homo Sapiens
DVKRREIQW

SEQ ID NO: 164071 - protein, 9 aa, Homo Sapiens
QITQTEVQR

SEQ ID NO: 164072 - protein, 9 aa, Homo Sapiens
EIQWLETLA

SEQ ID NO: 164073 - protein, 9 aa, Homo Sapiens
WKKRHTLEK

SEQ ID NO: 164074 - protein, 9 aa, Homo Sapiens
FSWLMWVTD

SEQ ID NO: 164075 - protein, 9 aa, Homo Sapiens
PSEKSNKKI

SEQ ID NO: 164076 - protein, 9 aa, Homo Sapiens
ISVKDHRTS

SEQ ID NO: 164077 - protein, 9 aa, Homo Sapiens
AFLCGPQRS

SEQ ID NO: 164078 - protein, 9 aa, Homo Sapiens
VKEGKIEIF

SEQ ID NO: 164079 - protein, 9 aa, Homo Sapiens
ALLPHSFPA

SEQ ID NO: 164080 - protein, 9 aa, Homo Sapiens
LPRALARLP

SEQ ID NO: 164081 - protein, 9 aa, Homo Sapiens
RYEVYGGEM

SEQ ID NO: 164082 - protein, 9 aa, Homo Sapiens
NVILQIGWS

SEQ ID NO: 164083 - protein, 9 aa, Homo Sapiens
PRAPEVPRC

SEQ ID NO: 164084 - protein, 9 aa, Homo Sapiens
AFSQTPLGA

SEQ ID NO: 164085 - protein, 9 aa, Homo Sapiens
LAAPSVTPA

SEQ ID NO: 164086 - protein, 9 aa, Homo Sapiens
KCQFSTKSG

SEQ ID NO: 164087 - protein, 9 aa, Homo Sapiens
TLERPRGWA

SEQ ID NO: 164088 - protein, 9 aa, Homo Sapiens
KMALQDYVV

SEQ ID NO: 164089 - protein, 9 aa, Homo Sapiens
PCRLTIDSN

SEQ ID NO: 164090 - protein, 9 aa, Homo Sapiens
NCGGDTIQE

SEQ ID NO: 164091 - protein, 9 aa, Homo Sapiens
LKGPAASLT

SEQ ID NO: 164092 - protein, 9 aa, Homo Sapiens
SNITEELFL

SEQ ID NO: 164093 - protein, 9 aa, Homo Sapiens
QDGQPQWEV

SEQ ID NO: 164094 - protein, 9 aa, Homo Sapiens
TPAVPSTGP

SEQ ID NO: 164095 - protein, 9 aa, Homo Sapiens
MFWIGVTSI

SEQ ID NO: 164096 - protein, 9 aa, Homo Sapiens
PTFNPRECK

SEQ ID NO: 164097 - protein, 9 aa, Homo Sapiens
AQVVGAPRP

SEQ ID NO: 164098 - protein, 9 aa, Homo Sapiens
TLQGQPANQ

SEQ ID NO: 164099 - protein, 9 aa, Homo Sapiens
VVHELGHTL

SEQ ID NO: 164100 - protein, 9 aa, Homo Sapiens
GMSYLHEVL

SEQ ID NO: 164101 - protein, 9 aa, Homo Sapiens
AVPRGREGA

SEQ ID NO: 164102 - protein, 9 aa, Homo Sapiens
GVLEEKLFP

SEQ ID NO: 164103 - protein, 9 aa, Homo Sapiens
RFRVHLAPV

SEQ ID NO: 164104 - protein, 9 aa, Homo Sapiens
SSATRRWRW

SEQ ID NO: 164105 - protein, 9 aa, Homo Sapiens
MWSCTKNSW

SEQ ID NO: 164106 - protein, 9 aa, Homo Sapiens
QWSLWVLPT

SEQ ID NO: 164107 - protein, 9 aa, Homo Sapiens
LNWKRGPSV

SEQ ID NO: 164108 - protein, 9 aa, Homo Sapiens
PDAGRLDGP

SEQ ID NO: 164109 - protein, 9 aa, Homo Sapiens
PPRHIQFDP

SEQ ID NO: 164110 - protein, 9 aa, Homo Sapiens
CPSRLSTTR

SEQ ID NO: 164111 - protein, 9 aa, Homo Sapiens
HELSSLHSL

SEQ ID NO: 164112 - protein, 9 aa, Homo Sapiens
DRHTGFSLF

SEQ ID NO: 164113 - protein, 9 aa, Homo Sapiens
RVGKLGLTR

SEQ ID NO: 164114 - protein, 9 aa, Homo Sapiens
LAQHRPGAQ

SEQ ID NO: 164115 - protein, 9 aa, Homo Sapiens
PSPASACTM

SEQ ID NO: 164116 - protein, 9 aa, Homo Sapiens
RTRQTLLHH

SEQ ID NO: 164117 - protein, 9 aa, Homo Sapiens
MQAEIDNIK

SEQ ID NO: 164118 - protein, 9 aa, Homo Sapiens
PQLLCQNPE

SEQ ID NO: 164119 - protein, 9 aa, Homo Sapiens
PTWGRPTAA

SEQ ID NO: 164120 - protein, 9 aa, Homo Sapiens
RQGAEEALG

SEQ ID NO: 164121 - protein, 9 aa, Homo Sapiens
AQSVTTKKY

SEQ ID NO: 164122 - protein, 9 aa, Homo Sapiens
ITTKNSNIY

SEQ ID NO: 164123 - protein, 9 aa, Homo Sapiens
NEMPKTELI

SEQ ID NO: 164124 - protein, 9 aa, Homo Sapiens
YTEARLGLQ

SEQ ID NO: 164125 - protein, 9 aa, Homo Sapiens
LRNRKMGGP

SEQ ID NO: 164126 - protein, 9 aa, Homo Sapiens
GHVVAKVRT

SEQ ID NO: 164127 - protein, 9 aa, Homo Sapiens
NGLLLAQKL

SEQ ID NO: 164128 - protein, 9 aa, Homo Sapiens
TLGPATVSL

SEQ ID NO: 164129 - protein, 9 aa, Homo Sapiens
DLTLYLVVV

SEQ ID NO: 164130 - protein, 9 aa, Homo Sapiens
VPQQEISVV

SEQ ID NO: 164131 - protein, 9 aa, Homo Sapiens
LIQVGMGAT

SEQ ID NO: 164132 - protein, 9 aa, Homo Sapiens
RRWDQDRPW

SEQ ID NO: 164133 - protein, 9 aa, Homo Sapiens
DLSKARFHS

SEQ ID NO: 164134 - protein, 9 aa, Homo Sapiens
PLAGLRRAY

SEQ ID NO: 164135 - protein, 9 aa, Homo Sapiens
RPSPLNQSV

SEQ ID NO: 164136 - protein, 9 aa, Homo Sapiens
GTCSPAPRA

SEQ ID NO: 164137 - protein, 9 aa, Homo Sapiens
VLEHFLQVT

SEQ ID NO: 164138 - protein, 9 aa, Homo Sapiens
CAQVPAHSP

SEQ ID NO: 164139 - protein, 9 aa, Homo Sapiens
MSILLRMIP

SEQ ID NO: 164140 - protein, 9 aa, Homo Sapiens
ASCSYVAHK

SEQ ID NO: 164141 - protein, 9 aa, Homo Sapiens
RSRMAACHP

SEQ ID NO: 164142 - protein, 9 aa, Homo Sapiens
TRRWRWTWR

SEQ ID NO: 164143 - protein, 9 aa, Homo Sapiens
CNYSVLCQS

SEQ ID NO: 164144 - protein, 9 aa, Homo Sapiens
IVLGKWVIR

SEQ ID NO: 164145 - protein, 9 aa, Homo Sapiens
YLVVVAAAV

SEQ ID NO: 164146 - protein, 9 aa, Homo Sapiens
TPTCPLEKS

SEQ ID NO: 164147 - protein, 9 aa, Homo Sapiens
CKPVRCPVP

SEQ ID NO: 164148 - protein, 9 aa, Homo Sapiens
FVNELFWML

SEQ ID NO: 164149 - protein, 9 aa, Homo Sapiens
TALFLGGLI

SEQ ID NO: 164150 - protein, 9 aa, Homo Sapiens
NGSPGKSPE

SEQ ID NO: 164151 - protein, 9 aa, Homo Sapiens
PYSSLDVSH

SEQ ID NO: 164152 - protein, 9 aa, Homo Sapiens
PPKSSASRG

SEQ ID NO: 164153 - protein, 9 aa, Homo Sapiens
AGRLDGPLL

SEQ ID NO: 164154 - protein, 9 aa, Homo Sapiens
MSCSLLTQP

SEQ ID NO: 164155 - protein, 9 aa, Homo Sapiens
GVDINVEPP

SEQ ID NO: 164156 - protein, 9 aa, Homo Sapiens
FWKDFLATS

SEQ ID NO: 164157 - protein, 9 aa, Homo Sapiens
KSKSQKTCP

SEQ ID NO: 164158 - protein, 9 aa, Homo Sapiens
RWWVDHLCS

SEQ ID NO: 164159 - protein, 9 aa, Homo Sapiens
GFAISVPYF

SEQ ID NO: 164160 - protein, 9 aa, Homo Sapiens
AIASLRPHT

SEQ ID NO: 164161 - protein, 9 aa, Homo Sapiens
HFSPFFRTN

SEQ ID NO: 164162 - protein, 9 aa, Homo Sapiens
LLCICVVAA

SEQ ID NO: 164163 - protein, 9 aa, Homo Sapiens
PGEKMTEEE

SEQ ID NO: 164164 - protein, 9 aa, Homo Sapiens
SILLLKFST

SEQ ID NO: 164165 - protein, 9 aa, Homo Sapiens
LNLGRYLNY

SEQ ID NO: 164166 - protein, 9 aa, Homo Sapiens
RVVLDLPQP

SEQ ID NO: 164167 - protein, 9 aa, Homo Sapiens
RNAEEAKKA

SEQ ID NO: 164168 - protein, 9 aa, Homo Sapiens
YNAPFPCVP

SEQ ID NO: 164169 - protein, 9 aa, Homo Sapiens
TFRHLHDPS

SEQ ID NO: 164170 - protein, 9 aa, Homo Sapiens
LLKITGRDQ

SEQ ID NO: 164171 - protein, 9 aa, Homo Sapiens
LPGPCASLL

SEQ ID NO: 164172 - protein, 9 aa, Homo Sapiens
TTRLSGIPT

SEQ ID NO: 164173 - protein, 9 aa, Homo Sapiens
TEEEEDFGE

SEQ ID NO: 164174 - protein, 9 aa, Homo Sapiens
HTSINEHIL

SEQ ID NO: 164175 - protein, 9 aa, Homo Sapiens
GWRAGDRTR

SEQ ID NO: 164176 - protein, 9 aa, Homo Sapiens
QPLAEPFPL

SEQ ID NO: 164177 - protein, 9 aa, Homo Sapiens
KEKRHDEML

SEQ ID NO: 164178 - protein, 9 aa, Homo Sapiens
DDAYYFMGP

SEQ ID NO: 164179 - protein, 9 aa, Homo Sapiens
RQWSLWVLP

SEQ ID NO: 164180 - protein, 9 aa, Homo Sapiens
RGFGMAIVG

SEQ ID NO: 164181 - protein, 9 aa, Homo Sapiens
QRHLMEATQ

SEQ ID NO: 164182 - protein, 9 aa, Homo Sapiens
TIYALGMGD

SEQ ID NO: 164183 - protein, 9 aa, Homo Sapiens
QKKLTVPHS

SEQ ID NO: 164184 - protein, 9 aa, Homo Sapiens
AMAPSCCRW

SEQ ID NO: 164185 - protein, 9 aa, Homo Sapiens
QAPSQVWTA

SEQ ID NO: 164186 - protein, 9 aa, Homo Sapiens
TNKKPGLGT

SEQ ID NO: 164187 - protein, 9 aa, Homo Sapiens
QRSWHGDSD

SEQ ID NO: 164188 - protein, 9 aa, Homo Sapiens
MKNCWVYDR

SEQ ID NO: 164189 - protein, 9 aa, Homo Sapiens
IYTITPNGR

SEQ ID NO: 164190 - protein, 9 aa, Homo Sapiens
CGQCQACFS

SEQ ID NO: 164191 - protein, 9 aa, Homo Sapiens
ITETESQCR

SEQ ID NO: 164192 - protein, 9 aa, Homo Sapiens
YSLHFLLIL

SEQ ID NO: 164193 - protein, 9 aa, Homo Sapiens
KTPWLNHVS

SEQ ID NO: 164194 - protein, 9 aa, Homo Sapiens
IQKKMTSIK

SEQ ID NO: 164195 - protein, 9 aa, Homo Sapiens
DYVRAMCEM

SEQ ID NO: 164196 - protein, 9 aa, Homo Sapiens
GGACGTMVI

SEQ ID NO: 164197 - protein, 9 aa, Homo Sapiens
STTSPWPGG

SEQ ID NO: 164198 - protein, 9 aa, Homo Sapiens
FWRHLEDLI

SEQ ID NO: 164199 - protein, 9 aa, Homo Sapiens
YWRDCLLKM

SEQ ID NO: 164200 - protein, 9 aa, Homo Sapiens
HVDARGEIH

SEQ ID NO: 164201 - protein, 9 aa, Homo Sapiens
TLLHHPRRQ

SEQ ID NO: 164202 - protein, 9 aa, Homo Sapiens
KCCPYTKYQ

SEQ ID NO: 164203 - protein, 9 aa, Homo Sapiens
LSKARFHSG

SEQ ID NO: 164204 - protein, 9 aa, Homo Sapiens
RAFKENRET

SEQ ID NO: 164205 - protein, 9 aa, Homo Sapiens
PGSRMSWRR

SEQ ID NO: 164206 - protein, 9 aa, Homo Sapiens
PARPSRLPG

SEQ ID NO: 164207 - protein, 9 aa, Homo Sapiens
FSFFYFLWI

SEQ ID NO: 164208 - protein, 9 aa, Homo Sapiens
WKRGPSVVP

SEQ ID NO: 164209 - protein, 9 aa, Homo Sapiens
QSCCLPGLT

SEQ ID NO: 164210 - protein, 9 aa, Homo Sapiens
RLPALTSMG

SEQ ID NO: 164211 - protein, 9 aa, Homo Sapiens
KERPTKAHS

SEQ ID NO: 164212 - protein, 9 aa, Homo Sapiens
FPTVIRQCC

SEQ ID NO: 164213 - protein, 9 aa, Homo Sapiens
HGRLVIVGH

SEQ ID NO: 164214 - protein, 9 aa, Homo Sapiens
DLSYEESDS

SEQ ID NO: 164215 - protein, 9 aa, Homo Sapiens
ETATISRMA

SEQ ID NO: 164216 - protein, 9 aa, Homo Sapiens
PTPLCTPYC

SEQ ID NO: 164217 - protein, 9 aa, Homo Sapiens
SGDSSAEGS

SEQ ID NO: 164218 - protein, 9 aa, Homo Sapiens
SGISSIRAG

SEQ ID NO: 164219 - protein, 9 aa, Homo Sapiens
PPQSTKRKI

SEQ ID NO: 164220 - protein, 9 aa, Homo Sapiens
LRCSQAPGD

SEQ ID NO: 164221 - protein, 9 aa, Homo Sapiens
GHIAALTLH

SEQ ID NO: 164222 - protein, 9 aa, Homo Sapiens
RKRCREINA

SEQ ID NO: 164223 - protein, 9 aa, Homo Sapiens
SGQWAQPPF

SEQ ID NO: 164224 - protein, 9 aa, Homo Sapiens
LMHETSQIR

SEQ ID NO: 164225 - protein, 9 aa, Homo Sapiens
GSRCAPALP

SEQ ID NO: 164226 - protein, 9 aa, Homo Sapiens
LSVFCWHIH

SEQ ID NO: 164227 - protein, 9 aa, Homo Sapiens
QWLEMVESC

SEQ ID NO: 164228 - protein, 9 aa, Homo Sapiens
VPPPPGVSL

SEQ ID NO: 164229 - protein, 9 aa, Homo Sapiens
RLREIISMD

SEQ ID NO: 164230 - protein, 9 aa, Homo Sapiens
GTPLSISRP

SEQ ID NO: 164231 - protein, 9 aa, Homo Sapiens
ALLKRGEQL

SEQ ID NO: 164232 - protein, 9 aa, Homo Sapiens
TCPPTSCPS

SEQ ID NO: 164233 - protein, 9 aa, Homo Sapiens
PATMEVLYS

SEQ ID NO: 164234 - protein, 9 aa, Homo Sapiens
PPAMEAPRG

SEQ ID NO: 164235 - protein, 9 aa, Homo Sapiens
IHTRQLESV

SEQ ID NO: 164236 - protein, 9 aa, Homo Sapiens
EESFQSCTF

SEQ ID NO: 164237 - protein, 9 aa, Homo Sapiens
TATTGESPT

SEQ ID NO: 164238 - protein, 9 aa, Homo Sapiens
VQAGDGHGR

SEQ ID NO: 164239 - protein, 9 aa, Homo Sapiens
FARTHSTSA

SEQ ID NO: 164240 - protein, 9 aa, Homo Sapiens
MVPEFAAIP

SEQ ID NO: 164241 - protein, 9 aa, Homo Sapiens
PLRKCVDII

SEQ ID NO: 164242 - protein, 9 aa, Homo Sapiens
IPTRAKKMQ

SEQ ID NO: 164243 - protein, 9 aa, Homo Sapiens
EEEEEAFIA

SEQ ID NO: 164244 - protein, 9 aa, Homo Sapiens
IKIPVVPPT

SEQ ID NO: 164245 - protein, 9 aa, Homo Sapiens
HGHGVCTDP

SEQ ID NO: 164246 - protein, 9 aa, Homo Sapiens
IQRMQAEID

SEQ ID NO: 164247 - protein, 9 aa, Homo Sapiens
RSSTFLKAL

SEQ ID NO: 164248 - protein, 9 aa, Homo Sapiens
EVVEHLKAQ

SEQ ID NO: 164249 - protein, 9 aa, Homo Sapiens
SSSATRRWR

SEQ ID NO: 164250 - protein, 9 aa, Homo Sapiens
SLDGEEQAV

SEQ ID NO: 164251 - protein, 9 aa, Homo Sapiens
LDEVVSDNQ

SEQ ID NO: 164252 - protein, 9 aa, Homo Sapiens
RFIISFSSD

SEQ ID NO: 164253 - protein, 9 aa, Homo Sapiens
RCEEVAFRM

SEQ ID NO: 164254 - protein, 9 aa, Homo Sapiens
ETVELARKL

SEQ ID NO: 164255 - protein, 9 aa, Homo Sapiens
MQTQDSSFQ

SEQ ID NO: 164256 - protein, 9 aa, Homo Sapiens
RLESVDLPS

SEQ ID NO: 164257 - protein, 9 aa, Homo Sapiens
VGTTLAAPS

SEQ ID NO: 164258 - protein, 9 aa, Homo Sapiens
TFLKALAVQ

SEQ ID NO: 164259 - protein, 9 aa, Homo Sapiens
HQLLVGGEV

SEQ ID NO: 164260 - protein, 9 aa, Homo Sapiens
PVPRSRHEV

SEQ ID NO: 164261 - protein, 9 aa, Homo Sapiens
KRLSQDAYH

SEQ ID NO: 164262 - protein, 9 aa, Homo Sapiens
PGGCVPGPD

SEQ ID NO: 164263 - protein, 9 aa, Homo Sapiens
ANTVVHELG

SEQ ID NO: 164264 - protein, 9 aa, Homo Sapiens
CRKKHREEK

SEQ ID NO: 164265 - protein, 9 aa, Homo Sapiens
FFGGQQPRH

SEQ ID NO: 164266 - protein, 9 aa, Homo Sapiens
ERLRFEQEQ

SEQ ID NO: 164267 - protein, 9 aa, Homo Sapiens
QACFSQRRY

SEQ ID NO: 164268 - protein, 9 aa, Homo Sapiens
ANTALNPIL

SEQ ID NO: 164269 - protein, 9 aa, Homo Sapiens
FRILADIVL

SEQ ID NO: 164270 - protein, 9 aa, Homo Sapiens
YMPPRSSSR

SEQ ID NO: 164271 - protein, 9 aa, Homo Sapiens
YTVDNEVQS

SEQ ID NO: 164272 - protein, 9 aa, Homo Sapiens
VLLALWEAD

SEQ ID NO: 164273 - protein, 9 aa, Homo Sapiens
EVQRGQQQF

SEQ ID NO: 164274 - protein, 9 aa, Homo Sapiens
HESRLLQLL

SEQ ID NO: 164275 - protein, 9 aa, Homo Sapiens
SRARQSCCL

SEQ ID NO: 164276 - protein, 9 aa, Homo Sapiens
SGTRDDPAG

SEQ ID NO: 164277 - protein, 9 aa, Homo Sapiens
PPAPSQARL

SEQ ID NO: 164278 - protein, 9 aa, Homo Sapiens
DLCSSPLCP

SEQ ID NO: 164279 - protein, 9 aa, Homo Sapiens
KIVALMSST

SEQ ID NO: 164280 - protein, 9 aa, Homo Sapiens
LTTRVVLRP

SEQ ID NO: 164281 - protein, 9 aa, Homo Sapiens
PALCFASCS

SEQ ID NO: 164282 - protein, 9 aa, Homo Sapiens
LEKGQDGQP

SEQ ID NO: 164283 - protein, 9 aa, Homo Sapiens
PCIFEASRI

SEQ ID NO: 164284 - protein, 9 aa, Homo Sapiens
HHPGIPGVT

SEQ ID NO: 164285 - protein, 9 aa, Homo Sapiens
RDTQDPSQS

SEQ ID NO: 164286 - protein, 9 aa, Homo Sapiens
EGCISVKDH

SEQ ID NO: 164287 - protein, 9 aa, Homo Sapiens
QEGTMIWSN

SEQ ID NO: 164288 - protein, 9 aa, Homo Sapiens
HLRNRLPAL

SEQ ID NO: 164289 - protein, 9 aa, Homo Sapiens
THPTCILGQ

SEQ ID NO: 164290 - protein, 9 aa, Homo Sapiens
PGKCTVCKE

SEQ ID NO: 164291 - protein, 9 aa, Homo Sapiens
EDIQSSPLQ

SEQ ID NO: 164292 - protein, 9 aa, Homo Sapiens
ILLVRRDSI

SEQ ID NO: 164293 - protein, 9 aa, Homo Sapiens
WPVVPEASV

SEQ ID NO: 164294 - protein, 9 aa, Homo Sapiens
LEHFFNFCG

SEQ ID NO: 164295 - protein, 9 aa, Homo Sapiens
VGLFHGNEM

SEQ ID NO: 164296 - protein, 9 aa, Homo Sapiens
IWSNPVQEF

SEQ ID NO: 164297 - protein, 9 aa, Homo Sapiens
FKPKGANRK

SEQ ID NO: 164298 - protein, 9 aa, Homo Sapiens
RPARTPPGG

SEQ ID NO: 164299 - protein, 9 aa, Homo Sapiens
ITEDFTIKL

SEQ ID NO: 164300 - protein, 9 aa, Homo Sapiens
GLGNITDTN

SEQ ID NO: 164301 - protein, 9 aa, Homo Sapiens
CSLEAAWEE

SEQ ID NO: 164302 - protein, 9 aa, Homo Sapiens
KKPGLGTPN

SEQ ID NO: 164303 - protein, 9 aa, Homo Sapiens
KSLKLKMTR

SEQ ID NO: 164304 - protein, 9 aa, Homo Sapiens
IQKGAEVDL

SEQ ID NO: 164305 - protein, 9 aa, Homo Sapiens
MEETEVGAT

SEQ ID NO: 164306 - protein, 9 aa, Homo Sapiens
MNLESLTCG

SEQ ID NO: 164307 - protein, 9 aa, Homo Sapiens
AVGAGLQDM

SEQ ID NO: 164308 - protein, 9 aa, Homo Sapiens
GHEGGHHLS

SEQ ID NO: 164309 - protein, 9 aa, Homo Sapiens
DALELRDVE

SEQ ID NO: 164310 - protein, 9 aa, Homo Sapiens
PLRTLVLRG

SEQ ID NO: 164311 - protein, 9 aa, Homo Sapiens
YHPGIFRGD

SEQ ID NO: 164312 - protein, 9 aa, Homo Sapiens
HSKCITECV

SEQ ID NO: 164313 - protein, 9 aa, Homo Sapiens
TERNLRPLS

SEQ ID NO: 164314 - protein, 9 aa, Homo Sapiens
FHLITEPNQ

SEQ ID NO: 164315 - protein, 9 aa, Homo Sapiens
IWEVMPRTL

SEQ ID NO: 164316 - protein, 9 aa, Homo Sapiens
VQCLPAATQ

SEQ ID NO: 164317 - protein, 9 aa, Homo Sapiens
STKSGWRCV

SEQ ID NO: 164318 - protein, 9 aa, Homo Sapiens
AQHRPGAQD

SEQ ID NO: 164319 - protein, 9 aa, Homo Sapiens
EALRSRPGS

SEQ ID NO: 164320 - protein, 9 aa, Homo Sapiens
GMVITGDVL

SEQ ID NO: 164321 - protein, 9 aa, Homo Sapiens
SPCQDLPDT

SEQ ID NO: 164322 - protein, 9 aa, Homo Sapiens
HFFNFCGLD

SEQ ID NO: 164323 - protein, 9 aa, Homo Sapiens
KIGIMPDHI

SEQ ID NO: 164324 - protein, 9 aa, Homo Sapiens
QQVPHEELH

SEQ ID NO: 164325 - protein, 9 aa, Homo Sapiens
KGYCFVYCL

SEQ ID NO: 164326 - protein, 9 aa, Homo Sapiens
SPVFHFLRT

SEQ ID NO: 164327 - protein, 9 aa, Homo Sapiens
WYSHQKKLT

SEQ ID NO: 164328 - protein, 9 aa, Homo Sapiens
VLTLKRFPA

SEQ ID NO: 164329 - protein, 9 aa, Homo Sapiens
PGPENNLGV

SEQ ID NO: 164330 - protein, 9 aa, Homo Sapiens
LRSEGGPPR

SEQ ID NO: 164331 - protein, 9 aa, Homo Sapiens
HHVRPFFFS

SEQ ID NO: 164332 - protein, 9 aa, Homo Sapiens
MVMCAKDNV

SEQ ID NO: 164333 - protein, 9 aa, Homo Sapiens
STAYSSHSS

SEQ ID NO: 164334 - protein, 9 aa, Homo Sapiens
SFRVFCLLG

SEQ ID NO: 164335 - protein, 9 aa, Homo Sapiens
NSFEVCVCA

SEQ ID NO: 164336 - protein, 9 aa, Homo Sapiens
RRSGGCSLS

SEQ ID NO: 164337 - protein, 9 aa, Homo Sapiens
EKLEKKRIM

SEQ ID NO: 164338 - protein, 9 aa, Homo Sapiens
PAAATTSWW

SEQ ID NO: 164339 - protein, 9 aa, Homo Sapiens
SMTLPAPTA

SEQ ID NO: 164340 - protein, 9 aa, Homo Sapiens
YMLMRLPQM

SEQ ID NO: 164341 - protein, 9 aa, Homo Sapiens
SGALTVKLG

SEQ ID NO: 164342 - protein, 9 aa, Homo Sapiens
PGIPGVTHS

SEQ ID NO: 164343 - protein, 9 aa, Homo Sapiens
EDLLEEFSE

SEQ ID NO: 164344 - protein, 9 aa, Homo Sapiens
SQMLAWLLR

SEQ ID NO: 164345 - protein, 9 aa, Homo Sapiens
FPTRTARRT

SEQ ID NO: 164346 - protein, 9 aa, Homo Sapiens
CGILYMKPH

SEQ ID NO: 164347 - protein, 9 aa, Homo Sapiens
RVPRHRLQR

SEQ ID NO: 164348 - protein, 9 aa, Homo Sapiens
PYRPPTAAV

SEQ ID NO: 164349 - protein, 9 aa, Homo Sapiens
PCQPHQPVP

SEQ ID NO: 164350 - protein, 9 aa, Homo Sapiens
LKANTGAWI

SEQ ID NO: 164351 - protein, 9 aa, Homo Sapiens
FSRDRVSLC

SEQ ID NO: 164352 - protein, 9 aa, Homo Sapiens
SICRSSTFL

SEQ ID NO: 164353 - protein, 9 aa, Homo Sapiens
AMGGSRTPM

SEQ ID NO: 164354 - protein, 9 aa, Homo Sapiens
GATTVVCVC

SEQ ID NO: 164355 - protein, 9 aa, Homo Sapiens
DSFPTRTAR

SEQ ID NO: 164356 - protein, 9 aa, Homo Sapiens
PDMMCARGP

SEQ ID NO: 164357 - protein, 9 aa, Homo Sapiens
MCVLQCKYM

SEQ ID NO: 164358 - protein, 9 aa, Homo Sapiens
LEGGWGGAQ

SEQ ID NO: 164359 - protein, 9 aa, Homo Sapiens
GVACRQRCW

SEQ ID NO: 164360 - protein, 9 aa, Homo Sapiens
LQTKTLNAL

SEQ ID NO: 164361 - protein, 9 aa, Homo Sapiens
YLREDDALS

SEQ ID NO: 164362 - protein, 9 aa, Homo Sapiens
APCASTATW

SEQ ID NO: 164363 - protein, 9 aa, Homo Sapiens
TQQMYEPDS

SEQ ID NO: 164364 - protein, 9 aa, Homo Sapiens
AKHYSCTPR

SEQ ID NO: 164365 - protein, 9 aa, Homo Sapiens
LVGLVDCPD

SEQ ID NO: 164366 - protein, 9 aa, Homo Sapiens
CLHLPSPPV

SEQ ID NO: 164367 - protein, 9 aa, Homo Sapiens
DSNLSIRIA

SEQ ID NO: 164368 - protein, 9 aa, Homo Sapiens
RLSPVVIRH

SEQ ID NO: 164369 - protein, 9 aa, Homo Sapiens
GTFPRVLTL

SEQ ID NO: 164370 - protein, 9 aa, Homo Sapiens
ILFLYNREL

SEQ ID NO: 164371 - protein, 9 aa, Homo Sapiens
DLVLLNGLH

SEQ ID NO: 164372 - protein, 9 aa, Homo Sapiens
PASIDVDPL

SEQ ID NO: 164373 - protein, 9 aa, Homo Sapiens
PLLVEVQNI

SEQ ID NO: 164374 - protein, 9 aa, Homo Sapiens
KVNITLLDH

SEQ ID NO: 164375 - protein, 9 aa, Homo Sapiens
RWEVCLTIS

SEQ ID NO: 164376 - protein, 9 aa, Homo Sapiens
ASSIPRPHT

SEQ ID NO: 164377 - protein, 9 aa, Homo Sapiens
MKVLVIMLS

SEQ ID NO: 164378 - protein, 9 aa, Homo Sapiens
CVETMELCV

SEQ ID NO: 164379 - protein, 9 aa, Homo Sapiens
AWSHGLLPK

SEQ ID NO: 164380 - protein, 9 aa, Homo Sapiens
SKATSTPVP

SEQ ID NO: 164381 - protein, 9 aa, Homo Sapiens
IASLRPHTF

SEQ ID NO: 164382 - protein, 9 aa, Homo Sapiens
PASITAIRE

SEQ ID NO: 164383 - protein, 9 aa, Homo Sapiens
PARQPSRPT

SEQ ID NO: 164384 - protein, 9 aa, Homo Sapiens
LFLYNRELI

SEQ ID NO: 164385 - protein, 9 aa, Homo Sapiens
KGEGAERGS

SEQ ID NO: 164386 - protein, 9 aa, Homo Sapiens
GIGRVGVCK

SEQ ID NO: 164387 - protein, 9 aa, Homo Sapiens
PHGRLPQES

SEQ ID NO: 164388 - protein, 9 aa, Homo Sapiens
GLRLGEKHS

SEQ ID NO: 164389 - protein, 9 aa, Homo Sapiens
HVGTKFSAS

SEQ ID NO: 164390 - protein, 9 aa, Homo Sapiens
ARGLQGVPP

SEQ ID NO: 164391 - protein, 9 aa, Homo Sapiens
RPVSGVGDT

SEQ ID NO: 164392 - protein, 9 aa, Homo Sapiens
DFLATSSPT

SEQ ID NO: 164393 - protein, 9 aa, Homo Sapiens
RWIQTQAIT

SEQ ID NO: 164394 - protein, 9 aa, Homo Sapiens
GLLPPVLEH

SEQ ID NO: 164395 - protein, 9 aa, Homo Sapiens
SSATSSATG

SEQ ID NO: 164396 - protein, 9 aa, Homo Sapiens
LGLLVLLVG

SEQ ID NO: 164397 - protein, 9 aa, Homo Sapiens
LCSRWPQEL

SEQ ID NO: 164398 - protein, 9 aa, Homo Sapiens
ATHQLEWVS

SEQ ID NO: 164399 - protein, 9 aa, Homo Sapiens
VDVNLPKVD

SEQ ID NO: 164400 - protein, 9 aa, Homo Sapiens
QEAMHKVSQ

SEQ ID NO: 164401 - protein, 9 aa, Homo Sapiens
IKKISSGCR

SEQ ID NO: 164402 - protein, 9 aa, Homo Sapiens
STASQMLAW

SEQ ID NO: 164403 - protein, 9 aa, Homo Sapiens
DRKDLMLYC

SEQ ID NO: 164404 - protein, 9 aa, Homo Sapiens
PPVSHCVSP

SEQ ID NO: 164405 - protein, 9 aa, Homo Sapiens
TDMRPYNWS

SEQ ID NO: 164406 - protein, 9 aa, Homo Sapiens
ALRGGAAGR

SEQ ID NO: 164407 - protein, 9 aa, Homo Sapiens
EKRAQWVSV

SEQ ID NO: 164408 - protein, 9 aa, Homo Sapiens
LVVFLYMWS

SEQ ID NO: 164409 - protein, 9 aa, Homo Sapiens
GIEIVAYVT

SEQ ID NO: 164410 - protein, 9 aa, Homo Sapiens
ISTLHFCET

SEQ ID NO: 164411 - protein, 9 aa, Homo Sapiens
RTLARPRLP

SEQ ID NO: 164412 - protein, 9 aa, Homo Sapiens
RNLRPLSLQ

SEQ ID NO: 164413 - protein, 9 aa, Homo Sapiens
ENTHRRETL

SEQ ID NO: 164414 - protein, 9 aa, Homo Sapiens
HPENDLRHL

SEQ ID NO: 164415 - protein, 9 aa, Homo Sapiens
NINTLDSEI

SEQ ID NO: 164416 - protein, 9 aa, Homo Sapiens
TETLVFNKL

SEQ ID NO: 164417 - protein, 9 aa, Homo Sapiens
DMPEEMCVE

SEQ ID NO: 164418 - protein, 9 aa, Homo Sapiens
PAPGSPRLC

SEQ ID NO: 164419 - protein, 9 aa, Homo Sapiens
QLWSVSSVD

SEQ ID NO: 164420 - protein, 9 aa, Homo Sapiens
PFPLVGLAK

SEQ ID NO: 164421 - protein, 9 aa, Homo Sapiens
DNSTESEGA

SEQ ID NO: 164422 - protein, 9 aa, Homo Sapiens
GEGNFNWCF

SEQ ID NO: 164423 - protein, 9 aa, Homo Sapiens
FYYKLAGFF

SEQ ID NO: 164424 - protein, 9 aa, Homo Sapiens
GLVKLPHPT

SEQ ID NO: 164425 - protein, 9 aa, Homo Sapiens
LAFLCGPQR

SEQ ID NO: 164426 - protein, 9 aa, Homo Sapiens
DQLRCSQAP

SEQ ID NO: 164427 - protein, 9 aa, Homo Sapiens
EEIEAWILA

SEQ ID NO: 164428 - protein, 9 aa, Homo Sapiens
IDTKNLYLL

SEQ ID NO: 164429 - protein, 9 aa, Homo Sapiens
VATRPRGAG

SEQ ID NO: 164430 - protein, 9 aa, Homo Sapiens
TPGLTEPPA

SEQ ID NO: 164431 - protein, 9 aa, Homo Sapiens
PSRLSTTRL

SEQ ID NO: 164432 - protein, 9 aa, Homo Sapiens
LRLCYMANW

SEQ ID NO: 164433 - protein, 9 aa, Homo Sapiens
PARQARAQD

SEQ ID NO: 164434 - protein, 9 aa, Homo Sapiens
MGDQALIDQ

SEQ ID NO: 164435 - protein, 9 aa, Homo Sapiens
RGGPGQAAG

SEQ ID NO: 164436 - protein, 9 aa, Homo Sapiens
ESPTCLGHP

SEQ ID NO: 164437 - protein, 9 aa, Homo Sapiens
IEEWKVLPT

SEQ ID NO: 164438 - protein, 9 aa, Homo Sapiens
RLMAPVGSV

SEQ ID NO: 164439 - protein, 9 aa, Homo Sapiens
FHTALFLGG

SEQ ID NO: 164440 - protein, 9 aa, Homo Sapiens
QRRTVTCQI

SEQ ID NO: 164441 - protein, 9 aa, Homo Sapiens
CQHHKPPFT

SEQ ID NO: 164442 - protein, 9 aa, Homo Sapiens
AVLANVPII

SEQ ID NO: 164443 - protein, 9 aa, Homo Sapiens
TATAACPMT

SEQ ID NO: 164444 - protein, 9 aa, Homo Sapiens
QRLPPALMP

SEQ ID NO: 164445 - protein, 9 aa, Homo Sapiens
YYRESKPAQ

SEQ ID NO: 164446 - protein, 9 aa, Homo Sapiens
MPEEMCVET

SEQ ID NO: 164447 - protein, 9 aa, Homo Sapiens
LHFASRIRK

SEQ ID NO: 164448 - protein, 9 aa, Homo Sapiens
APAPTSWTA

SEQ ID NO: 164449 - protein, 9 aa, Homo Sapiens
SYSPSVSSA

SEQ ID NO: 164450 - protein, 9 aa, Homo Sapiens
NMIIWSTQF

SEQ ID NO: 164451 - protein, 9 aa, Homo Sapiens
MACQGLGEP

SEQ ID NO: 164452 - protein, 9 aa, Homo Sapiens
WHGDSDGTR

SEQ ID NO: 164453 - protein, 9 aa, Homo Sapiens
GVRAAPVLV

SEQ ID NO: 164454 - protein, 9 aa, Homo Sapiens
RLVSKARPA

SEQ ID NO: 164455 - protein, 9 aa, Homo Sapiens
LRHLPDVAM

SEQ ID NO: 164456 - protein, 9 aa, Homo Sapiens
MVALSLFYH

SEQ ID NO: 164457 - protein, 9 aa, Homo Sapiens
SILSTMNVP

SEQ ID NO: 164458 - protein, 9 aa, Homo Sapiens
CPMTACSIL

SEQ ID NO: 164459 - protein, 9 aa, Homo Sapiens
LEWVMEMKS

SEQ ID NO: 164460 - protein, 9 aa, Homo Sapiens
GLQQGESHL

SEQ ID NO: 164461 - protein, 9 aa, Homo Sapiens
LKQKNKSTQ

SEQ ID NO: 164462 - protein, 9 aa, Homo Sapiens
MEDYQTAEE

SEQ ID NO: 164463 - protein, 9 aa, Homo Sapiens
CRQLQGHGQ

SEQ ID NO: 164464 - protein, 9 aa, Homo Sapiens
WPGWYKFSG

SEQ ID NO: 164465 - protein, 9 aa, Homo Sapiens
PYAEENECF

SEQ ID NO: 164466 - protein, 9 aa, Homo Sapiens
PGPASTAAT

SEQ ID NO: 164467 - protein, 9 aa, Homo Sapiens
RAKVAGPGP

SEQ ID NO: 164468 - protein, 9 aa, Homo Sapiens
HKGLMERAA

SEQ ID NO: 164469 - protein, 9 aa, Homo Sapiens
PLQLVGLRL

SEQ ID NO: 164470 - protein, 9 aa, Homo Sapiens
DTQDPSQSL

SEQ ID NO: 164471 - protein, 9 aa, Homo Sapiens
QLRAHFVKS

SEQ ID NO: 164472 - protein, 9 aa, Homo Sapiens
ARCEEVAFR

SEQ ID NO: 164473 - protein, 9 aa, Homo Sapiens
RDFKVTWSR

SEQ ID NO: 164474 - protein, 9 aa, Homo Sapiens
KRHDEMLGL

SEQ ID NO: 164475 - protein, 9 aa, Homo Sapiens
VTGSTSDCA

SEQ ID NO: 164476 - protein, 9 aa, Homo Sapiens
GTLKRLLSR

SEQ ID NO: 164477 - protein, 9 aa, Homo Sapiens
PSVPSIPEA

SEQ ID NO: 164478 - protein, 9 aa, Homo Sapiens
KDVGAIAGL

SEQ ID NO: 164479 - protein, 9 aa, Homo Sapiens
QPSRPTGRT

SEQ ID NO: 164480 - protein, 9 aa, Homo Sapiens
VGSVMSCSL

SEQ ID NO: 164481 - protein, 9 aa, Homo Sapiens
GTGSCWTST

SEQ ID NO: 164482 - protein, 9 aa, Homo Sapiens
WSHGLLPKC

SEQ ID NO: 164483 - protein, 9 aa, Homo Sapiens
DIVLAYVGH

SEQ ID NO: 164484 - protein, 9 aa, Homo Sapiens
KLCAGAPYA

SEQ ID NO: 164485 - protein, 9 aa, Homo Sapiens
DHIHKKGRI

SEQ ID NO: 164486 - protein, 9 aa, Homo Sapiens
EELEYHDTD

SEQ ID NO: 164487 - protein, 9 aa, Homo Sapiens
DARGEIHGD

SEQ ID NO: 164488 - protein, 9 aa, Homo Sapiens
FLIITTKNS

SEQ ID NO: 164489 - protein, 9 aa, Homo Sapiens
ELPLPEDNY

SEQ ID NO: 164490 - protein, 9 aa, Homo Sapiens
TFGQLQLQV

SEQ ID NO: 164491 - protein, 9 aa, Homo Sapiens
VCHDEVRMD

SEQ ID NO: 164492 - protein, 9 aa, Homo Sapiens
AGLRRAYAA

SEQ ID NO: 164493 - protein, 9 aa, Homo Sapiens
SRMSWRRLS

SEQ ID NO: 164494 - protein, 9 aa, Homo Sapiens
VTTRVCQQV

SEQ ID NO: 164495 - protein, 9 aa, Homo Sapiens
AQTSATITN

SEQ ID NO: 164496 - protein, 9 aa, Homo Sapiens
QQAAAVYAG

SEQ ID NO: 164497 - protein, 9 aa, Homo Sapiens
DLQSILSTM

SEQ ID NO: 164498 - protein, 9 aa, Homo Sapiens
FSEARTRSR

SEQ ID NO: 164499 - protein, 9 aa, Homo Sapiens
DLPRRKSSP

SEQ ID NO: 164500 - protein, 9 aa, Homo Sapiens
RAAWLPPRP

SEQ ID NO: 164501 - protein, 9 aa, Homo Sapiens
VSSLFLLLV

SEQ ID NO: 164502 - protein, 9 aa, Homo Sapiens
MLRYIQEST

SEQ ID NO: 164503 - protein, 9 aa, Homo Sapiens
VCVCVSLNR

SEQ ID NO: 164504 - protein, 9 aa, Homo Sapiens
RPPARRPRA

SEQ ID NO: 164505 - protein, 9 aa, Homo Sapiens
QEDVPLVIP

SEQ ID NO: 164506 - protein, 9 aa, Homo Sapiens
PPRPPKVPA

SEQ ID NO: 164507 - protein, 9 aa, Homo Sapiens
GKDNRQCDT

SEQ ID NO: 164508 - protein, 9 aa, Homo Sapiens
PSTSPTRWN

SEQ ID NO: 164509 - protein, 9 aa, Homo Sapiens
APQAASPAM

SEQ ID NO: 164510 - protein, 9 aa, Homo Sapiens
NIDHTQREP

SEQ ID NO: 164511 - protein, 9 aa, Homo Sapiens
GGRKSVHTV

SEQ ID NO: 164512 - protein, 9 aa, Homo Sapiens
EVAMEAKWE

SEQ ID NO: 164513 - protein, 9 aa, Homo Sapiens
SYLHEVLKP

SEQ ID NO: 164514 - protein, 9 aa, Homo Sapiens
QRAAGMGGV

SEQ ID NO: 164515 - protein, 9 aa, Homo Sapiens
PSPLPQTPT

SEQ ID NO: 164516 - protein, 9 aa, Homo Sapiens
KTMRVHEVE

SEQ ID NO: 164517 - protein, 9 aa, Homo Sapiens
QSLEHEEVV

SEQ ID NO: 164518 - protein, 9 aa, Homo Sapiens
FCANYLTTK

SEQ ID NO: 164519 - protein, 9 aa, Homo Sapiens
KMKVLVIML

SEQ ID NO: 164520 - protein, 9 aa, Homo Sapiens
PLAEPFPLV

SEQ ID NO: 164521 - protein, 9 aa, Homo Sapiens
ALMHSFGSF

SEQ ID NO: 164522 - protein, 9 aa, Homo Sapiens
ALPDPHLLR

SEQ ID NO: 164523 - protein, 9 aa, Homo Sapiens
ALVIYQTLD

SEQ ID NO: 164524 - protein, 9 aa, Homo Sapiens
VTHPGIQGN

SEQ ID NO: 164525 - protein, 9 aa, Homo Sapiens
CWTSTVWPT

SEQ ID NO: 164526 - protein, 9 aa, Homo Sapiens
SLASSRPMR

SEQ ID NO: 164527 - protein, 9 aa, Homo Sapiens
ALCDAFAFT

SEQ ID NO: 164528 - protein, 9 aa, Homo Sapiens
HLCIIDVSN

SEQ ID NO: 164529 - protein, 9 aa, Homo Sapiens
PLVSDMDMD

SEQ ID NO: 164530 - protein, 9 aa, Homo Sapiens
CQVAGWCTT

SEQ ID NO: 164531 - protein, 9 aa, Homo Sapiens
TRNWARRWW

SEQ ID NO: 164532 - protein, 9 aa, Homo Sapiens
MRNFSDPRN

SEQ ID NO: 164533 - protein, 9 aa, Homo Sapiens
IISFSSDQW

SEQ ID NO: 164534 - protein, 9 aa, Homo Sapiens
APLACLHLP

SEQ ID NO: 164535 - protein, 9 aa, Homo Sapiens
GEDAELRRW

SEQ ID NO: 164536 - protein, 9 aa, Homo Sapiens
APSQARLPP

SEQ ID NO: 164537 - protein, 9 aa, Homo Sapiens
RVKNMIYVI

SEQ ID NO: 164538 - protein, 9 aa, Homo Sapiens
TCLLLCRLE

SEQ ID NO: 164539 - protein, 9 aa, Homo Sapiens
HVGDGNSHC

SEQ ID NO: 164540 - protein, 9 aa, Homo Sapiens
KNVEAIGFL

SEQ ID NO: 164541 - protein, 9 aa, Homo Sapiens
ERAHRQRVC

SEQ ID NO: 164542 - protein, 9 aa, Homo Sapiens
NTSQEEYLD

SEQ ID NO: 164543 - protein, 9 aa, Homo Sapiens
KTDHIDTCL

SEQ ID NO: 164544 - protein, 9 aa, Homo Sapiens
MKTPTVCGV

SEQ ID NO: 164545 - protein, 9 aa, Homo Sapiens
QSRSRPSAQ

SEQ ID NO: 164546 - protein, 9 aa, Homo Sapiens
LLTGYLNLL

SEQ ID NO: 164547 - protein, 9 aa, Homo Sapiens
SFGSGALTV

SEQ ID NO: 164548 - protein, 9 aa, Homo Sapiens
DNGNCIHRT

SEQ ID NO: 164549 - protein, 9 aa, Homo Sapiens
SESNKRLQL

SEQ ID NO: 164550 - protein, 9 aa, Homo Sapiens
ETETLAVQP

SEQ ID NO: 164551 - protein, 9 aa, Homo Sapiens
WGYPRAIQA

SEQ ID NO: 164552 - protein, 9 aa, Homo Sapiens
VQNSFLLPF

SEQ ID NO: 164553 - protein, 9 aa, Homo Sapiens
PTGPLFFME

SEQ ID NO: 164554 - protein, 9 aa, Homo Sapiens
PDEVSVMPK

SEQ ID NO: 164555 - protein, 9 aa, Homo Sapiens
NHPRAVLIP

SEQ ID NO: 164556 - protein, 9 aa, Homo Sapiens
VSKARPALQ

SEQ ID NO: 164557 - protein, 9 aa, Homo Sapiens
TYSVYMYMA

SEQ ID NO: 164558 - protein, 9 aa, Homo Sapiens
QLPALVIYQ

SEQ ID NO: 164559 - protein, 9 aa, Homo Sapiens
ISGKDNRQC

SEQ ID NO: 164560 - protein, 9 aa, Homo Sapiens
LEQAAILAW

SEQ ID NO: 164561 - protein, 9 aa, Homo Sapiens
YVTETLVFN

SEQ ID NO: 164562 - protein, 9 aa, Homo Sapiens
KLAVKEGKI

SEQ ID NO: 164563 - protein, 9 aa, Homo Sapiens
SVFSSCQLH

SEQ ID NO: 164564 - protein, 9 aa, Homo Sapiens
GWRCVRITS

SEQ ID NO: 164565 - protein, 9 aa, Homo Sapiens
LISKTRNHS

SEQ ID NO: 164566 - protein, 9 aa, Homo Sapiens
TTHLRSHSG

SEQ ID NO: 164567 - protein, 9 aa, Homo Sapiens
NTTLHCHLS

SEQ ID NO: 164568 - protein, 9 aa, Homo Sapiens
VEGAVQPGH

SEQ ID NO: 164569 - protein, 9 aa, Homo Sapiens
NWCFLFPFQ

SEQ ID NO: 164570 - protein, 9 aa, Homo Sapiens
AAHLYYYWE

SEQ ID NO: 164571 - protein, 9 aa, Homo Sapiens
SYDDFCSLD

SEQ ID NO: 164572 - protein, 9 aa, Homo Sapiens
SPGPGLRPG

SEQ ID NO: 164573 - protein, 9 aa, Homo Sapiens
DTPQPSLPG

SEQ ID NO: 164574 - protein, 9 aa, Homo Sapiens
SALNIRVGR

SEQ ID NO: 164575 - protein, 9 aa, Homo Sapiens
PSPLPSRLY

SEQ ID NO: 164576 - protein, 9 aa, Homo Sapiens
TPPGPENNL

SEQ ID NO: 164577 - protein, 9 aa, Homo Sapiens
SQGPHNANE

SEQ ID NO: 164578 - protein, 9 aa, Homo Sapiens
ITGDVLVRR

SEQ ID NO: 164579 - protein, 9 aa, Homo Sapiens
DNVSGKRVV

SEQ ID NO: 164580 - protein, 9 aa, Homo Sapiens
RHLQWPSLP

SEQ ID NO: 164581 - protein, 9 aa, Homo Sapiens
SREAISTLH

SEQ ID NO: 164582 - protein, 9 aa, Homo Sapiens
IQMACQGLG

SEQ ID NO: 164583 - protein, 9 aa, Homo Sapiens
SVGADVQFC

SEQ ID NO: 164584 - protein, 9 aa, Homo Sapiens
HPQSRGLDS

SEQ ID NO: 164585 - protein, 9 aa, Homo Sapiens
RHGPYPAAS

SEQ ID NO: 164586 - protein, 9 aa, Homo Sapiens
AWDAWLKED

SEQ ID NO: 164587 - protein, 9 aa, Homo Sapiens
TSSPSSKTA

SEQ ID NO: 164588 - protein, 9 aa, Homo Sapiens
LAVKEGKIE

SEQ ID NO: 164589 - protein, 9 aa, Homo Sapiens
SLFYHLQTQ

SEQ ID NO: 164590 - protein, 9 aa, Homo Sapiens
IRLQLLGLV

SEQ ID NO: 164591 - protein, 9 aa, Homo Sapiens
RAQDRWRTQ

SEQ ID NO: 164592 - protein, 9 aa, Homo Sapiens
FINSETPSG

SEQ ID NO: 164593 - protein, 9 aa, Homo Sapiens
GALPAPMKE

SEQ ID NO: 164594 - protein, 9 aa, Homo Sapiens
PKSSASRGP

SEQ ID NO: 164595 - protein, 9 aa, Homo Sapiens
EETGVVAAM

SEQ ID NO: 164596 - protein, 9 aa, Homo Sapiens
AKRMHLEIY

SEQ ID NO: 164597 - protein, 9 aa, Homo Sapiens
FVVMKGLND

SEQ ID NO: 164598 - protein, 9 aa, Homo Sapiens
IEPPQYWIR

SEQ ID NO: 164599 - protein, 9 aa, Homo Sapiens
TSVTLVASA

SEQ ID NO: 164600 - protein, 9 aa, Homo Sapiens
STTLVVSSD

SEQ ID NO: 164601 - protein, 9 aa, Homo Sapiens
AYKCASALQ

SEQ ID NO: 164602 - protein, 9 aa, Homo Sapiens
KGMLNGEKV

SEQ ID NO: 164603 - protein, 9 aa, Homo Sapiens
KQFKCRSCQ

SEQ ID NO: 164604 - protein, 9 aa, Homo Sapiens
AFSRSSKVT

SEQ ID NO: 164605 - protein, 9 aa, Homo Sapiens
SEGLEGLRE

SEQ ID NO: 164606 - protein, 9 aa, Homo Sapiens
GSENDFADG

SEQ ID NO: 164607 - protein, 9 aa, Homo Sapiens
HQVGKEKGK

SEQ ID NO: 164608 - protein, 9 aa, Homo Sapiens
LAAVSLFDV

SEQ ID NO: 164609 - protein, 9 aa, Homo Sapiens
VCSRQIYFM

SEQ ID NO: 164610 - protein, 9 aa, Homo Sapiens
LVPQHVSPF

SEQ ID NO: 164611 - protein, 9 aa, Homo Sapiens
SIPNLPQER

SEQ ID NO: 164612 - protein, 9 aa, Homo Sapiens
TLENLEAVS

SEQ ID NO: 164613 - protein, 9 aa, Homo Sapiens
RTPAPQAAS

SEQ ID NO: 164614 - protein, 9 aa, Homo Sapiens
DDEKRWIVF

SEQ ID NO: 164615 - protein, 9 aa, Homo Sapiens
GGGGSWSSA

SEQ ID NO: 164616 - protein, 9 aa, Homo Sapiens
VALSLFYHL

SEQ ID NO: 164617 - protein, 9 aa, Homo Sapiens
GPQVGPAQL

SEQ ID NO: 164618 - protein, 9 aa, Homo Sapiens
KHFVSPRGV

SEQ ID NO: 164619 - protein, 9 aa, Homo Sapiens
KAPLQLVGL

SEQ ID NO: 164620 - protein, 9 aa, Homo Sapiens
VMNPCGGED

SEQ ID NO: 164621 - protein, 9 aa, Homo Sapiens
VVQQQDWNL

SEQ ID NO: 164622 - protein, 9 aa, Homo Sapiens
AVSNLEEPT

SEQ ID NO: 164623 - protein, 9 aa, Homo Sapiens
SLGEPWRAG

SEQ ID NO: 164624 - protein, 9 aa, Homo Sapiens
RNSFEVCVC

SEQ ID NO: 164625 - protein, 9 aa, Homo Sapiens
GLQVLAGMV

SEQ ID NO: 164626 - protein, 9 aa, Homo Sapiens
PCVQALMAE

SEQ ID NO: 164627 - protein, 9 aa, Homo Sapiens
TAWASLASS

SEQ ID NO: 164628 - protein, 9 aa, Homo Sapiens
EETEVGATE

SEQ ID NO: 164629 - protein, 9 aa, Homo Sapiens
TVSELRITT

SEQ ID NO: 164630 - protein, 9 aa, Homo Sapiens
QVCMLADLS

SEQ ID NO: 164631 - protein, 9 aa, Homo Sapiens
VCFFLGLFP

SEQ ID NO: 164632 - protein, 9 aa, Homo Sapiens
INLTNSRED

SEQ ID NO: 164633 - protein, 9 aa, Homo Sapiens
RTNRNNLNP

SEQ ID NO: 164634 - protein, 9 aa, Homo Sapiens
QPLTKSMWS

SEQ ID NO: 164635 - protein, 9 aa, Homo Sapiens
PSPSPLPQT

SEQ ID NO: 164636 - protein, 9 aa, Homo Sapiens
TVTHPGIQG

SEQ ID NO: 164637 - protein, 9 aa, Homo Sapiens
LEGKECRMS

SEQ ID NO: 164638 - protein, 9 aa, Homo Sapiens
VFGGAICHM

SEQ ID NO: 164639 - protein, 9 aa, Homo Sapiens
MCSRGSDTE

SEQ ID NO: 164640 - protein, 9 aa, Homo Sapiens
LVSTVCALD

SEQ ID NO: 164641 - protein, 9 aa, Homo Sapiens
IRFIISFSS

SEQ ID NO: 164642 - protein, 9 aa, Homo Sapiens
VFILVWGPQ

SEQ ID NO: 164643 - protein, 9 aa, Homo Sapiens
MNNTEVLTS

SEQ ID NO: 164644 - protein, 9 aa, Homo Sapiens
GGPGGLQPL

SEQ ID NO: 164645 - protein, 9 aa, Homo Sapiens
RTVDADSGY

SEQ ID NO: 164646 - protein, 9 aa, Homo Sapiens
QTGKGFIHN

SEQ ID NO: 164647 - protein, 9 aa, Homo Sapiens
EVSRPEPRS

SEQ ID NO: 164648 - protein, 9 aa, Homo Sapiens
PAPYLSLVN

SEQ ID NO: 164649 - protein, 9 aa, Homo Sapiens
PAVPLGPAR

SEQ ID NO: 164650 - protein, 9 aa, Homo Sapiens
FSDPWPGGS

SEQ ID NO: 164651 - protein, 9 aa, Homo Sapiens
REPASIDVD

SEQ ID NO: 164652 - protein, 9 aa, Homo Sapiens
RLGEKHSPL

SEQ ID NO: 164653 - protein, 9 aa, Homo Sapiens
PAPEAQDGS

SEQ ID NO: 164654 - protein, 9 aa, Homo Sapiens
LAGQWGGGS

SEQ ID NO: 164655 - protein, 9 aa, Homo Sapiens
QPTHRFPFG

SEQ ID NO: 164656 - protein, 9 aa, Homo Sapiens
QQPRHGHPG

SEQ ID NO: 164657 - protein, 9 aa, Homo Sapiens
SAVTPLAQH

SEQ ID NO: 164658 - protein, 9 aa, Homo Sapiens
SPSTFGMSV

SEQ ID NO: 164659 - protein, 9 aa, Homo Sapiens
WPSWSPAAS

SEQ ID NO: 164660 - protein, 9 aa, Homo Sapiens
ISLPKKKKR

SEQ ID NO: 164661 - protein, 9 aa, Homo Sapiens
NDFLWNTVH

SEQ ID NO: 164662 - protein, 9 aa, Homo Sapiens
GSSQFPHRQ

SEQ ID NO: 164663 - protein, 9 aa, Homo Sapiens
GDSQMYSIT

SEQ ID NO: 164664 - protein, 9 aa, Homo Sapiens
PPSVRTSSA

SEQ ID NO: 164665 - protein, 9 aa, Homo Sapiens
LTISAAHLY

SEQ ID NO: 164666 - protein, 9 aa, Homo Sapiens
DPLFVEFAD

SEQ ID NO: 164667 - protein, 9 aa, Homo Sapiens
ADFLQVLKS

SEQ ID NO: 164668 - protein, 9 aa, Homo Sapiens
EVPSTAPVC

SEQ ID NO: 164669 - protein, 9 aa, Homo Sapiens
LIKTDNLHH

SEQ ID NO: 164670 - protein, 9 aa, Homo Sapiens
MLFVTPRQQ

SEQ ID NO: 164671 - protein, 9 aa, Homo Sapiens
DSLAGRGLP

SEQ ID NO: 164672 - protein, 9 aa, Homo Sapiens
RHHEWVHSD

SEQ ID NO: 164673 - protein, 9 aa, Homo Sapiens
PEQEERREI

SEQ ID NO: 164674 - protein, 9 aa, Homo Sapiens
RCAMAPETT

SEQ ID NO: 164675 - protein, 9 aa, Homo Sapiens
ITKKISECC

SEQ ID NO: 164676 - protein, 9 aa, Homo Sapiens
SGKDNRQCD

SEQ ID NO: 164677 - protein, 9 aa, Homo Sapiens
ACFSQRRYL

SEQ ID NO: 164678 - protein, 9 aa, Homo Sapiens
SAGAARRRL

SEQ ID NO: 164679 - protein, 9 aa, Homo Sapiens
SMDLKSQRK

SEQ ID NO: 164680 - protein, 9 aa, Homo Sapiens
VPHIKKQHR

SEQ ID NO: 164681 - protein, 9 aa, Homo Sapiens
GLSQFRGGS

SEQ ID NO: 164682 - protein, 9 aa, Homo Sapiens
RSLTNLCVA

SEQ ID NO: 164683 - protein, 9 aa, Homo Sapiens
PRPLTTIDN

SEQ ID NO: 164684 - protein, 9 aa, Homo Sapiens
QETATISRM

SEQ ID NO: 164685 - protein, 9 aa, Homo Sapiens
LERGVRMKS

SEQ ID NO: 164686 - protein, 9 aa, Homo Sapiens
IQNNQKKQG

SEQ ID NO: 164687 - protein, 9 aa, Homo Sapiens
RLKQKNKST

SEQ ID NO: 164688 - protein, 9 aa, Homo Sapiens
SPRGKKLVS

SEQ ID NO: 164689 - protein, 9 aa, Homo Sapiens
LTPGLTEPP

SEQ ID NO: 164690 - protein, 9 aa, Homo Sapiens
QGHGQDVAG

SEQ ID NO: 164691 - protein, 9 aa, Homo Sapiens
HPGIFRGDK

SEQ ID NO: 164692 - protein, 9 aa, Homo Sapiens
TCSLLTGAM

SEQ ID NO: 164693 - protein, 9 aa, Homo Sapiens
QNNQKKQGN

SEQ ID NO: 164694 - protein, 9 aa, Homo Sapiens
TSCRLQHPT

SEQ ID NO: 164695 - protein, 9 aa, Homo Sapiens
VPAVRPPHT

SEQ ID NO: 164696 - protein, 9 aa, Homo Sapiens
VRGARPAGG

SEQ ID NO: 164697 - protein, 9 aa, Homo Sapiens
WRLTTRVVL

SEQ ID NO: 164698 - protein, 9 aa, Homo Sapiens
LFLRHLGII

SEQ ID NO: 164699 - protein, 9 aa, Homo Sapiens
APPHRLLGP

SEQ ID NO: 164700 - protein, 9 aa, Homo Sapiens
LQRLGPVWP

SEQ ID NO: 164701 - protein, 9 aa, Homo Sapiens
LVLMDRNTR

SEQ ID NO: 164702 - protein, 9 aa, Homo Sapiens
IGTNLHLFY

SEQ ID NO: 164703 - protein, 9 aa, Homo Sapiens
GPDEEELYL

SEQ ID NO: 164704 - protein, 9 aa, Homo Sapiens
PPPLSSSLR

SEQ ID NO: 164705 - protein, 9 aa, Homo Sapiens
WFFFLFFFS

SEQ ID NO: 164706 - protein, 9 aa, Homo Sapiens
GQNYQNCIK

SEQ ID NO: 164707 - protein, 9 aa, Homo Sapiens
RQRRTVTCQ

SEQ ID NO: 164708 - protein, 9 aa, Homo Sapiens
RHDEMLGLV

SEQ ID NO: 164709 - protein, 9 aa, Homo Sapiens
ACLWASLVK

SEQ ID NO: 164710 - protein, 9 aa, Homo Sapiens
LGLQQGESH

SEQ ID NO: 164711 - protein, 9 aa, Homo Sapiens
RGTSSPSSK

SEQ ID NO: 164712 - protein, 9 aa, Homo Sapiens
EPQSFASKQ

SEQ ID NO: 164713 - protein, 9 aa, Homo Sapiens
DDFCSLDAH

SEQ ID NO: 164714 - protein, 9 aa, Homo Sapiens
SLSSGHILM

SEQ ID NO: 164715 - protein, 9 aa, Homo Sapiens
SYVAHKRLS

SEQ ID NO: 164716 - protein, 9 aa, Homo Sapiens
VESNCGALP

SEQ ID NO: 164717 - protein, 9 aa, Homo Sapiens
VLDYLQQEA

SEQ ID NO: 164718 - protein, 9 aa, Homo Sapiens
SHLYIAYQF

SEQ ID NO: 164719 - protein, 9 aa, Homo Sapiens
HCVSPTWPI

SEQ ID NO: 164720 - protein, 9 aa, Homo Sapiens
RTSLEGVAA

SEQ ID NO: 164721 - protein, 9 aa, Homo Sapiens
DIQSSPLQQ

SEQ ID NO: 164722 - protein, 9 aa, Homo Sapiens
EVKGRGQSY

SEQ ID NO: 164723 - protein, 9 aa, Homo Sapiens
EKETRHQDR

SEQ ID NO: 164724 - protein, 9 aa, Homo Sapiens
HGMCGPPPL

SEQ ID NO: 164725 - protein, 9 aa, Homo Sapiens
ALPARRPRT

SEQ ID NO: 164726 - protein, 9 aa, Homo Sapiens
HTGFSLFYY

SEQ ID NO: 164727 - protein, 9 aa, Homo Sapiens
MLYCEAFLT

SEQ ID NO: 164728 - protein, 9 aa, Homo Sapiens
YPRPWRRTG

SEQ ID NO: 164729 - protein, 9 aa, Homo Sapiens
PPKKKIKSE

SEQ ID NO: 164730 - protein, 9 aa, Homo Sapiens
LNEMPKTEL

SEQ ID NO: 164731 - protein, 9 aa, Homo Sapiens
QECRNAEEA

SEQ ID NO: 164732 - protein, 9 aa, Homo Sapiens
MRRWRRRGR

SEQ ID NO: 164733 - protein, 9 aa, Homo Sapiens
QQHESTIES

SEQ ID NO: 164734 - protein, 9 aa, Homo Sapiens
RVLLALWEA

SEQ ID NO: 164735 - protein, 9 aa, Homo Sapiens
DEEITETES

SEQ ID NO: 164736 - protein, 9 aa, Homo Sapiens
KKKEKRHDE

SEQ ID NO: 164737 - protein, 9 aa, Homo Sapiens
SELPPGRAW

SEQ ID NO: 164738 - protein, 9 aa, Homo Sapiens
SSNKMLQSM

SEQ ID NO: 164739 - protein, 9 aa, Homo Sapiens
LDLVAKGIR

SEQ ID NO: 164740 - protein, 9 aa, Homo Sapiens
RHGHPGSHH

SEQ ID NO: 164741 - protein, 9 aa, Homo Sapiens
LNTLQRHRR

SEQ ID NO: 164742 - protein, 9 aa, Homo Sapiens
QDGAAVRVH

SEQ ID NO: 164743 - protein, 9 aa, Homo Sapiens
LTKISLPKK

SEQ ID NO: 164744 - protein, 9 aa, Homo Sapiens
KKMTSIKTK

SEQ ID NO: 164745 - protein, 9 aa, Homo Sapiens
PVLVLARAL

SEQ ID NO: 164746 - protein, 9 aa, Homo Sapiens
AGPMAFLFH

SEQ ID NO: 164747 - protein, 9 aa, Homo Sapiens
RCPHCGAHY

SEQ ID NO: 164748 - protein, 9 aa, Homo Sapiens
LEVTWYHAT

SEQ ID NO: 164749 - protein, 9 aa, Homo Sapiens
SRRSSRAPS

SEQ ID NO: 164750 - protein, 9 aa, Homo Sapiens
HLDFSPYWM

SEQ ID NO: 164751 - protein, 9 aa, Homo Sapiens
PNQRTDLLG

SEQ ID NO: 164752 - protein, 9 aa, Homo Sapiens
SPSSSMRTS

SEQ ID NO: 164753 - protein, 9 aa, Homo Sapiens
LAVGVSEEI

SEQ ID NO: 164754 - protein, 9 aa, Homo Sapiens
NHSYYRNPD

SEQ ID NO: 164755 - protein, 9 aa, Homo Sapiens
HVIATHQLE

SEQ ID NO: 164756 - protein, 9 aa, Homo Sapiens
GESHLSPLE

SEQ ID NO: 164757 - protein, 9 aa, Homo Sapiens
DCQGSKSPK

SEQ ID NO: 164758 - protein, 9 aa, Homo Sapiens
VPVSFENGI

SEQ ID NO: 164759 - protein, 9 aa, Homo Sapiens
FLTFVIMLL

SEQ ID NO: 164760 - protein, 9 aa, Homo Sapiens
GHDGLSRGC

SEQ ID NO: 164761 - protein, 9 aa, Homo Sapiens
HDEVRMDGC

SEQ ID NO: 164762 - protein, 9 aa, Homo Sapiens
GTPLLVFLE

SEQ ID NO: 164763 - protein, 9 aa, Homo Sapiens
EEKERELGH

SEQ ID NO: 164764 - protein, 9 aa, Homo Sapiens
DGMLENYGN

SEQ ID NO: 164765 - protein, 9 aa, Homo Sapiens
GATEETEVA

SEQ ID NO: 164766 - protein, 9 aa, Homo Sapiens
ELIRLTQRR

SEQ ID NO: 164767 - protein, 9 aa, Homo Sapiens
VETLTPGLT

SEQ ID NO: 164768 - protein, 9 aa, Homo Sapiens
KLYCQVTGT

SEQ ID NO: 164769 - protein, 9 aa, Homo Sapiens
SMGPTWGRP

SEQ ID NO: 164770 - protein, 9 aa, Homo Sapiens
CVQEVETLT

SEQ ID NO: 164771 - protein, 9 aa, Homo Sapiens
EPRLQRQHH

SEQ ID NO: 164772 - protein, 9 aa, Homo Sapiens
GPQAFSQTP

SEQ ID NO: 164773 - protein, 9 aa, Homo Sapiens
GHMDTTASA

SEQ ID NO: 164774 - protein, 9 aa, Homo Sapiens
VISGVLLVF

SEQ ID NO: 164775 - protein, 9 aa, Homo Sapiens
LETSQPPDC

SEQ ID NO: 164776 - protein, 9 aa, Homo Sapiens
VCCKRLDGL

SEQ ID NO: 164777 - protein, 9 aa, Homo Sapiens
CVSVFLDLC

SEQ ID NO: 164778 - protein, 9 aa, Homo Sapiens
QKKLEKLQV

SEQ ID NO: 164779 - protein, 9 aa, Homo Sapiens
ARFHSGLYT

SEQ ID NO: 164780 - protein, 9 aa, Homo Sapiens
YMARGLFER

SEQ ID NO: 164781 - protein, 9 aa, Homo Sapiens
LKIVADFLQ

SEQ ID NO: 164782 - protein, 9 aa, Homo Sapiens
KKKMPKLHF

SEQ ID NO: 164783 - protein, 9 aa, Homo Sapiens
EYLHFVNGA

SEQ ID NO: 164784 - protein, 9 aa, Homo Sapiens
LKEDLLYLR

SEQ ID NO: 164785 - protein, 9 aa, Homo Sapiens
SGQYGDKSI

SEQ ID NO: 164786 - protein, 9 aa, Homo Sapiens
HVGTVRRFE

SEQ ID NO: 164787 - protein, 9 aa, Homo Sapiens
ALRSQKQGI

SEQ ID NO: 164788 - protein, 9 aa, Homo Sapiens
STLPCMKQK

SEQ ID NO: 164789 - protein, 9 aa, Homo Sapiens
VSSKRFSTA

SEQ ID NO: 164790 - protein, 9 aa, Homo Sapiens
AFVDPALAP

SEQ ID NO: 164791 - protein, 9 aa, Homo Sapiens
GPGILSIPV

SEQ ID NO: 164792 - protein, 9 aa, Homo Sapiens
PSVSVAWLL

SEQ ID NO: 164793 - protein, 9 aa, Homo Sapiens
NGIEVSKKT

SEQ ID NO: 164794 - protein, 9 aa, Homo Sapiens
WHLYNYVYR

SEQ ID NO: 164795 - protein, 9 aa, Homo Sapiens
SVEHGQWRL

SEQ ID NO: 164796 - protein, 9 aa, Homo Sapiens
FTILTNIHG

SEQ ID NO: 164797 - protein, 9 aa, Homo Sapiens
LGRPVLLCC

SEQ ID NO: 164798 - protein, 9 aa, Homo Sapiens
GREGAQELA

SEQ ID NO: 164799 - protein, 9 aa, Homo Sapiens
GPLLPPRPL

SEQ ID NO: 164800 - protein, 9 aa, Homo Sapiens
MGAFASMDL

SEQ ID NO: 164801 - protein, 9 aa, Homo Sapiens
VGGEITDDL

SEQ ID NO: 164802 - protein, 9 aa, Homo Sapiens
DEKRWIVFS

SEQ ID NO: 164803 - protein, 9 aa, Homo Sapiens
KPCCCSSGY

SEQ ID NO: 164804 - protein, 9 aa, Homo Sapiens
PTWLPARPS

SEQ ID NO: 164805 - protein, 9 aa, Homo Sapiens
SPSPLPQTP

SEQ ID NO: 164806 - protein, 9 aa, Homo Sapiens
LWESLYPEV

SEQ ID NO: 164807 - protein, 9 aa, Homo Sapiens
FFLWESLYP

SEQ ID NO: 164808 - protein, 9 aa, Homo Sapiens
REEAPGPLG

SEQ ID NO: 164809 - protein, 9 aa, Homo Sapiens
SPFDIVGSP

SEQ ID NO: 164810 - protein, 9 aa, Homo Sapiens
VSGVGDTPG

SEQ ID NO: 164811 - protein, 9 aa, Homo Sapiens
EWQWVDIAL

SEQ ID NO: 164812 - protein, 9 aa, Homo Sapiens
VQSCAGAVV

SEQ ID NO: 164813 - protein, 9 aa, Homo Sapiens
PGTAEGPAA

SEQ ID NO: 164814 - protein, 9 aa, Homo Sapiens
LIDHLLNTQ

SEQ ID NO: 164815 - protein, 9 aa, Homo Sapiens
EKLNLGIDS

SEQ ID NO: 164816 - protein, 9 aa, Homo Sapiens
PSVWNASRP

SEQ ID NO: 164817 - protein, 9 aa, Homo Sapiens
RGTCSPAPR

SEQ ID NO: 164818 - protein, 9 aa, Homo Sapiens
HCLLTTMPP

SEQ ID NO: 164819 - protein, 9 aa, Homo Sapiens
DLAKSMDSI

SEQ ID NO: 164820 - protein, 9 aa, Homo Sapiens
HKTTKSMQT

SEQ ID NO: 164821 - protein, 9 aa, Homo Sapiens
AADLEHFFN

SEQ ID NO: 164822 - protein, 9 aa, Homo Sapiens
LQPDMMCAR

SEQ ID NO: 164823 - protein, 9 aa, Homo Sapiens
PRPPAMEAP

SEQ ID NO: 164824 - protein, 9 aa, Homo Sapiens
PTPPSVRTS

SEQ ID NO: 164825 - protein, 9 aa, Homo Sapiens
SRPSAQRPM

SEQ ID NO: 164826 - protein, 9 aa, Homo Sapiens
GAGAAWATR

SEQ ID NO: 164827 - protein, 9 aa, Homo Sapiens
YAVSSRRNV

SEQ ID NO: 164828 - protein, 9 aa, Homo Sapiens
ICLGYVSLK

SEQ ID NO: 164829 - protein, 9 aa, Homo Sapiens
FPTRGRSFL

SEQ ID NO: 164830 - protein, 9 aa, Homo Sapiens
TQRQKNCEL

SEQ ID NO: 164831 - protein, 9 aa, Homo Sapiens
KVRTVDADS

SEQ ID NO: 164832 - protein, 9 aa, Homo Sapiens
AITEPENGY

SEQ ID NO: 164833 - protein, 9 aa, Homo Sapiens
RHCPRCPAP

SEQ ID NO: 164834 - protein, 9 aa, Homo Sapiens
LTPRAGSRT

SEQ ID NO: 164835 - protein, 9 aa, Homo Sapiens
VSDMDMDAP

SEQ ID NO: 164836 - protein, 9 aa, Homo Sapiens
LYRFDLLWG

SEQ ID NO: 164837 - protein, 9 aa, Homo Sapiens
YHVMVKASN

SEQ ID NO: 164838 - protein, 9 aa, Homo Sapiens
SNVVNNFFV

SEQ ID NO: 164839 - protein, 9 aa, Homo Sapiens
GRERHLQWP

SEQ ID NO: 164840 - protein, 9 aa, Homo Sapiens
LVATPALPT

SEQ ID NO: 164841 - protein, 9 aa, Homo Sapiens
RDRRPGPSR

SEQ ID NO: 164842 - protein, 9 aa, Homo Sapiens
AIRTCLLTG

SEQ ID NO: 164843 - protein, 9 aa, Homo Sapiens
RPLSTASQM

SEQ ID NO: 164844 - protein, 9 aa, Homo Sapiens
LGPVDALVP

SEQ ID NO: 164845 - protein, 9 aa, Homo Sapiens
TCHNRTRHL

SEQ ID NO: 164846 - protein, 9 aa, Homo Sapiens
NPHSPGPGL

SEQ ID NO: 164847 - protein, 9 aa, Homo Sapiens
SVEKLNLGI

SEQ ID NO: 164848 - protein, 9 aa, Homo Sapiens
QSPTDEIAN

SEQ ID NO: 164849 - protein, 9 aa, Homo Sapiens
LPRAGTGTR

SEQ ID NO: 164850 - protein, 9 aa, Homo Sapiens
ILEQKFMLY

SEQ ID NO: 164851 - protein, 9 aa, Homo Sapiens
VLPLHKTGQ

SEQ ID NO: 164852 - protein, 9 aa, Homo Sapiens
KENRETSPF

SEQ ID NO: 164853 - protein, 9 aa, Homo Sapiens
TRPSGLLAQ

SEQ ID NO: 164854 - protein, 9 aa, Homo Sapiens
CYNAPFPCV

SEQ ID NO: 164855 - protein, 9 aa, Homo Sapiens
SLFANTVVH

SEQ ID NO: 164856 - protein, 9 aa, Homo Sapiens
NTFKYPLLI

SEQ ID NO: 164857 - protein, 9 aa, Homo Sapiens
RSPPLPPGS

SEQ ID NO: 164858 - protein, 9 aa, Homo Sapiens
ESAPVARCQ

SEQ ID NO: 164859 - protein, 9 aa, Homo Sapiens
AHQPSLTHH

SEQ ID NO: 164860 - protein, 9 aa, Homo Sapiens
LQNDTIFLN

SEQ ID NO: 164861 - protein, 9 aa, Homo Sapiens
CRSSTFLKA

SEQ ID NO: 164862 - protein, 9 aa, Homo Sapiens
CFSQRRYLL

SEQ ID NO: 164863 - protein, 9 aa, Homo Sapiens
TQDQLISLK

SEQ ID NO: 164864 - protein, 9 aa, Homo Sapiens
TGPARMASV

SEQ ID NO: 164865 - protein, 9 aa, Homo Sapiens
QLNTLQRHR

SEQ ID NO: 164866 - protein, 9 aa, Homo Sapiens
APVGSVMSC

SEQ ID NO: 164867 - protein, 9 aa, Homo Sapiens
SRTAWTEAC

SEQ ID NO: 164868 - protein, 9 aa, Homo Sapiens
NAMKKDKDK

SEQ ID NO: 164869 - protein, 9 aa, Homo Sapiens
LLDMDMEGA

SEQ ID NO: 164870 - protein, 9 aa, Homo Sapiens
LPPRPRPGR

SEQ ID NO: 164871 - protein, 9 aa, Homo Sapiens
PEREDIITI

SEQ ID NO: 164872 - protein, 9 aa, Homo Sapiens
GAERGSAAG

SEQ ID NO: 164873 - protein, 9 aa, Homo Sapiens
AILHAQAAD

SEQ ID NO: 164874 - protein, 9 aa, Homo Sapiens
WTWVLSSCP

SEQ ID NO: 164875 - protein, 9 aa, Homo Sapiens
YVIGGYDGH

SEQ ID NO: 164876 - protein, 9 aa, Homo Sapiens
KGTLSPKPS

SEQ ID NO: 164877 - protein, 9 aa, Homo Sapiens
CCRWGAPMQ

SEQ ID NO: 164878 - protein, 9 aa, Homo Sapiens
GAPDPRRRP

SEQ ID NO: 164879 - protein, 9 aa, Homo Sapiens
GDPMNIFFI

SEQ ID NO: 164880 - protein, 9 aa, Homo Sapiens
QMLSNAPRS

SEQ ID NO: 164881 - protein, 9 aa, Homo Sapiens
RPGPASSPG

SEQ ID NO: 164882 - protein, 9 aa, Homo Sapiens
RGSAAGLLP

SEQ ID NO: 164883 - protein, 9 aa, Homo Sapiens
LQSSAVRVT

SEQ ID NO: 164884 - protein, 9 aa, Homo Sapiens
QQDGQDGAA

SEQ ID NO: 164885 - protein, 9 aa, Homo Sapiens
VLQDPLDRC

SEQ ID NO: 164886 - protein, 9 aa, Homo Sapiens
HKLTFHENA

SEQ ID NO: 164887 - protein, 9 aa, Homo Sapiens
KKVSKATST

SEQ ID NO: 164888 - protein, 9 aa, Homo Sapiens
IISYLNTAS

SEQ ID NO: 164889 - protein, 9 aa, Homo Sapiens
WWSWQQDSF

SEQ ID NO: 164890 - protein, 9 aa, Homo Sapiens
HRRTSMEGT

SEQ ID NO: 164891 - protein, 9 aa, Homo Sapiens
SPGGSRRPH

SEQ ID NO: 164892 - protein, 9 aa, Homo Sapiens
AMPQALHLA

SEQ ID NO: 164893 - protein, 9 aa, Homo Sapiens
SAGNFPEAA

SEQ ID NO: 164894 - protein, 9 aa, Homo Sapiens
CPFQSPTKR

SEQ ID NO: 164895 - protein, 9 aa, Homo Sapiens
RSRHEVPPQ

SEQ ID NO: 164896 - protein, 9 aa, Homo Sapiens
GRLDGPLLP

SEQ ID NO: 164897 - protein, 9 aa, Homo Sapiens
LELLRQLRT

SEQ ID NO: 164898 - protein, 9 aa, Homo Sapiens
PPHPARTLA

SEQ ID NO: 164899 - protein, 9 aa, Homo Sapiens
HGVAVVLAG

SEQ ID NO: 164900 - protein, 9 aa, Homo Sapiens
CPSSSSSSS

SEQ ID NO: 164901 - protein, 9 aa, Homo Sapiens
APHSAGLSP

SEQ ID NO: 164902 - protein, 9 aa, Homo Sapiens
SGQACYRIP

SEQ ID NO: 164903 - protein, 9 aa, Homo Sapiens
ARPHPTPLC

SEQ ID NO: 164904 - protein, 9 aa, Homo Sapiens
TCIICLAFV

SEQ ID NO: 164905 - protein, 9 aa, Homo Sapiens
LLAQKLTAA

SEQ ID NO: 164906 - protein, 9 aa, Homo Sapiens
NWARRWWPS

SEQ ID NO: 164907 - protein, 9 aa, Homo Sapiens
ETLNLSLGV

SEQ ID NO: 164908 - protein, 9 aa, Homo Sapiens
ICQEEGLHA

SEQ ID NO: 164909 - protein, 9 aa, Homo Sapiens
FLTEDKKNG

SEQ ID NO: 164910 - protein, 9 aa, Homo Sapiens
QPPAPSQAR

SEQ ID NO: 164911 - protein, 9 aa, Homo Sapiens
EEVRKLTAL

SEQ ID NO: 164912 - protein, 9 aa, Homo Sapiens
APVPGEAHG

SEQ ID NO: 164913 - protein, 9 aa, Homo Sapiens
GRWVNENCH

SEQ ID NO: 164914 - protein, 9 aa, Homo Sapiens
QVYNVFEPN

SEQ ID NO: 164915 - protein, 9 aa, Homo Sapiens
ATLRCPAVP

SEQ ID NO: 164916 - protein, 9 aa, Homo Sapiens
QSFPGAPQP

SEQ ID NO: 164917 - protein, 9 aa, Homo Sapiens
SGHMDTTAS

SEQ ID NO: 164918 - protein, 9 aa, Homo Sapiens
SGPPPSVIT

SEQ ID NO: 164919 - protein, 9 aa, Homo Sapiens
PTEDDYWGA

SEQ ID NO: 164920 - protein, 9 aa, Homo Sapiens
TTLAAPSVT

SEQ ID NO: 164921 - protein, 9 aa, Homo Sapiens
RRRPSYRPW

SEQ ID NO: 164922 - protein, 9 aa, Homo Sapiens
LTSMGPTWG

SEQ ID NO: 164923 - protein, 9 aa, Homo Sapiens
EAELWRVTG

SEQ ID NO: 164924 - protein, 9 aa, Homo Sapiens
MDCHHTHLS

SEQ ID NO: 164925 - protein, 9 aa, Homo Sapiens
VCGVLDLDR

SEQ ID NO: 164926 - protein, 9 aa, Homo Sapiens
VTPRQQHES

SEQ ID NO: 164927 - protein, 9 aa, Homo Sapiens
APKSDHIVT

SEQ ID NO: 164928 - protein, 9 aa, Homo Sapiens
DALLEHTQH

SEQ ID NO: 164929 - protein, 9 aa, Homo Sapiens
GGRRFCGGI

SEQ ID NO: 164930 - protein, 9 aa, Homo Sapiens
ACRPACTCI

SEQ ID NO: 164931 - protein, 9 aa, Homo Sapiens
KNMKCLTFL

SEQ ID NO: 164932 - protein, 9 aa, Homo Sapiens
PSASYSPSV

SEQ ID NO: 164933 - protein, 9 aa, Homo Sapiens
LIDSFQEIA

SEQ ID NO: 164934 - protein, 9 aa, Homo Sapiens
EPPRSATTT

SEQ ID NO: 164935 - protein, 9 aa, Homo Sapiens
DSTVNRDFK

SEQ ID NO: 164936 - protein, 9 aa, Homo Sapiens
RPVLLCCSL

SEQ ID NO: 164937 - protein, 9 aa, Homo Sapiens
IELRHHEWV

SEQ ID NO: 164938 - protein, 9 aa, Homo Sapiens
LDRRGGPGQ

SEQ ID NO: 164939 - protein, 9 aa, Homo Sapiens
LITVTLCSF

SEQ ID NO: 164940 - protein, 9 aa, Homo Sapiens
HIIPWRRSH

SEQ ID NO: 164941 - protein, 9 aa, Homo Sapiens
LPLLLLGQG

SEQ ID NO: 164942 - protein, 9 aa, Homo Sapiens
GPASSPGSR

SEQ ID NO: 164943 - protein, 9 aa, Homo Sapiens
HFASRIRKI

SEQ ID NO: 164944 - protein, 9 aa, Homo Sapiens
AVDFTAASG

SEQ ID NO: 164945 - protein, 9 aa, Homo Sapiens
PPDRWVQVS

SEQ ID NO: 164946 - protein, 9 aa, Homo Sapiens
DKSDDTLEE

SEQ ID NO: 164947 - protein, 9 aa, Homo Sapiens
NNQKKQGNE

SEQ ID NO: 164948 - protein, 9 aa, Homo Sapiens
WDQTETAPG

SEQ ID NO: 164949 - protein, 9 aa, Homo Sapiens
LEKLEKKRI

SEQ ID NO: 164950 - protein, 9 aa, Homo Sapiens
RDLRLWLTS

SEQ ID NO: 164951 - protein, 9 aa, Homo Sapiens
WEDRTKRTA

SEQ ID NO: 164952 - protein, 9 aa, Homo Sapiens
NAIASLRPH

SEQ ID NO: 164953 - protein, 9 aa, Homo Sapiens
WNIHDLEAR

SEQ ID NO: 164954 - protein, 9 aa, Homo Sapiens
TITPNGRFK

SEQ ID NO: 164955 - protein, 9 aa, Homo Sapiens
RKALQTEMT

SEQ ID NO: 164956 - protein, 9 aa, Homo Sapiens
PLSISRPTS

SEQ ID NO: 164957 - protein, 9 aa, Homo Sapiens
TTRVVLRPW

SEQ ID NO: 164958 - protein, 9 aa, Homo Sapiens
ETLICIVVT

SEQ ID NO: 164959 - protein, 9 aa, Homo Sapiens
DNTMLLDPP

SEQ ID NO: 164960 - protein, 9 aa, Homo Sapiens
HRRRPGAPE

SEQ ID NO: 164961 - protein, 9 aa, Homo Sapiens
VFGAQECRL

SEQ ID NO: 164962 - protein, 9 aa, Homo Sapiens
ALQPLPQQH

SEQ ID NO: 164963 - protein, 9 aa, Homo Sapiens
NDNTMLLDP

SEQ ID NO: 164964 - protein, 9 aa, Homo Sapiens
DMLKTKQRD

SEQ ID NO: 164965 - protein, 9 aa, Homo Sapiens
CRQRAPLNW

SEQ ID NO: 164966 - protein, 9 aa, Homo Sapiens
LRTLKERLS

SEQ ID NO: 164967 - protein, 9 aa, Homo Sapiens
LEGKKDSRM

SEQ ID NO: 164968 - protein, 9 aa, Homo Sapiens
PRGCLQCAV

SEQ ID NO: 164969 - protein, 9 aa, Homo Sapiens
LDSNFRILA

SEQ ID NO: 164970 - protein, 9 aa, Homo Sapiens
HFSTSPSTF

SEQ ID NO: 164971 - protein, 9 aa, Homo Sapiens
PYLTSWASR

SEQ ID NO: 164972 - protein, 9 aa, Homo Sapiens
EGNFNWCFL

SEQ ID NO: 164973 - protein, 9 aa, Homo Sapiens
TRGRSFLLS

SEQ ID NO: 164974 - protein, 9 aa, Homo Sapiens
EVCLTISEK

SEQ ID NO: 164975 - protein, 9 aa, Homo Sapiens
TTLSGWYHL

SEQ ID NO: 164976 - protein, 9 aa, Homo Sapiens
GLPKVAMAP

SEQ ID NO: 164977 - protein, 9 aa, Homo Sapiens
LMDRNTRPG

SEQ ID NO: 164978 - protein, 9 aa, Homo Sapiens
TKSLKEKPL

SEQ ID NO: 164979 - protein, 9 aa, Homo Sapiens
ELYLFVESS

SEQ ID NO: 164980 - protein, 9 aa, Homo Sapiens
DMSYFVPEG

SEQ ID NO: 164981 - protein, 9 aa, Homo Sapiens
HNANEDYRE

SEQ ID NO: 164982 - protein, 9 aa, Homo Sapiens
LNTFKYPLL

SEQ ID NO: 164983 - protein, 9 aa, Homo Sapiens
HHKENTELE

SEQ ID NO: 164984 - protein, 9 aa, Homo Sapiens
DPMNIFFIY

SEQ ID NO: 164985 - protein, 9 aa, Homo Sapiens
SNLEEPTSP

SEQ ID NO: 164986 - protein, 9 aa, Homo Sapiens
LFRSLWPRW

SEQ ID NO: 164987 - protein, 9 aa, Homo Sapiens
GLHVHHHLD

SEQ ID NO: 164988 - protein, 9 aa, Homo Sapiens
GDRSRGAME

SEQ ID NO: 164989 - protein, 9 aa, Homo Sapiens
VCRLLLGKV

SEQ ID NO: 164990 - protein, 9 aa, Homo Sapiens
SLDALLEHT

SEQ ID NO: 164991 - protein, 9 aa, Homo Sapiens
RRQRRTVTC

SEQ ID NO: 164992 - protein, 9 aa, Homo Sapiens
FIFTGSPQL

SEQ ID NO: 164993 - protein, 9 aa, Homo Sapiens
YHVLHFSTS

SEQ ID NO: 164994 - protein, 9 aa, Homo Sapiens
YRSQHIIPW

SEQ ID NO: 164995 - protein, 9 aa, Homo Sapiens
FHSTFDALR

SEQ ID NO: 164996 - protein, 9 aa, Homo Sapiens
MDSSPDNDN

SEQ ID NO: 164997 - protein, 9 aa, Homo Sapiens
RCPAVPAAA

SEQ ID NO: 164998 - protein, 9 aa, Homo Sapiens
SHKTTKSMQ

SEQ ID NO: 164999 - protein, 9 aa, Homo Sapiens
PGLPPCSSL

SEQ ID NO: 165000 - protein, 9 aa, Homo Sapiens
VLESWQRLP

SEQ ID NO: 165001 - protein, 9 aa, Homo Sapiens
TAMEDVPWT

SEQ ID NO: 165002 - protein, 9 aa, Homo Sapiens
MAAMAPTLT

SEQ ID NO: 165003 - protein, 9 aa, Homo Sapiens
ERPRSQRSW

SEQ ID NO: 165004 - protein, 9 aa, Homo Sapiens
FPLVGLAKL

SEQ ID NO: 165005 - protein, 9 aa, Homo Sapiens
CVPCKNNSP

SEQ ID NO: 165006 - protein, 9 aa, Homo Sapiens
GDFGLATEK

SEQ ID NO: 165007 - protein, 9 aa, Homo Sapiens
GPAALQPLP

SEQ ID NO: 165008 - protein, 9 aa, Homo Sapiens
SKNGVLVSA

SEQ ID NO: 165009 - protein, 9 aa, Homo Sapiens
YLYKLQTKW

SEQ ID NO: 165010 - protein, 9 aa, Homo Sapiens
DICNEADLC

SEQ ID NO: 165011 - protein, 9 aa, Homo Sapiens
VATVAATEE

SEQ ID NO: 165012 - protein, 9 aa, Homo Sapiens
KCSTPATLT

SEQ ID NO: 165013 - protein, 9 aa, Homo Sapiens
GAEGASAEV

SEQ ID NO: 165014 - protein, 9 aa, Homo Sapiens
VDSKGMDQD

SEQ ID NO: 165015 - protein, 9 aa, Homo Sapiens
EQNSPPKRV

SEQ ID NO: 165016 - protein, 9 aa, Homo Sapiens
RHHPIGIGV

SEQ ID NO: 165017 - protein, 9 aa, Homo Sapiens
RGEDGTPII

SEQ ID NO: 165018 - protein, 9 aa, Homo Sapiens
QALQNDTIF

SEQ ID NO: 165019 - protein, 9 aa, Homo Sapiens
RENHTLTSL

SEQ ID NO: 165020 - protein, 9 aa, Homo Sapiens
PSQARLPPP

SEQ ID NO: 165021 - protein, 9 aa, Homo Sapiens
LITPPQSSR

SEQ ID NO: 165022 - protein, 9 aa, Homo Sapiens
LARRYSDVF

SEQ ID NO: 165023 - protein, 9 aa, Homo Sapiens
RVHEVEVVP

SEQ ID NO: 165024 - protein, 9 aa, Homo Sapiens
GSYPPARQP

SEQ ID NO: 165025 - protein, 9 aa, Homo Sapiens
MLERGEAEW

SEQ ID NO: 165026 - protein, 9 aa, Homo Sapiens
WWTMVCNLA

SEQ ID NO: 165027 - protein, 8 aa, Homo Sapiens
ALTRPVRL

SEQ ID NO: 165028 - protein, 9 aa, Homo Sapiens
HFWKDFLAT

SEQ ID NO: 165029 - protein, 9 aa, Homo Sapiens
ADQPILLRL

SEQ ID NO: 165030 - protein, 9 aa, Homo Sapiens
GHGAWNSRE

SEQ ID NO: 165031 - protein, 9 aa, Homo Sapiens
GSHWGCCPS

SEQ ID NO: 165032 - protein, 9 aa, Homo Sapiens
PPSLPRAWQ

SEQ ID NO: 165033 - protein, 9 aa, Homo Sapiens
SQDAYHRNS

SEQ ID NO: 165034 - protein, 9 aa, Homo Sapiens
EAKWEEETT

SEQ ID NO: 165035 - protein, 9 aa, Homo Sapiens
WLPPDTRVY

SEQ ID NO: 165036 - protein, 9 aa, Homo Sapiens
PAPQAASPA

SEQ ID NO: 165037 - protein, 9 aa, Homo Sapiens
SLDREAWQG

SEQ ID NO: 165038 - protein, 9 aa, Homo Sapiens
VRTSSAWTH

SEQ ID NO: 165039 - protein, 9 aa, Homo Sapiens
CHNRTRHLP

SEQ ID NO: 165040 - protein, 9 aa, Homo Sapiens
ARKWKKGKR

SEQ ID NO: 165041 - protein, 9 aa, Homo Sapiens
EQQLRHADV

SEQ ID NO: 165042 - protein, 9 aa, Homo Sapiens
LGLAAGAVL

SEQ ID NO: 165043 - protein, 9 aa, Homo Sapiens
LRTPAPQAA

SEQ ID NO: 165044 - protein, 9 aa, Homo Sapiens
FLHFVGDSE

SEQ ID NO: 165045 - protein, 9 aa, Homo Sapiens
LGTPNSANT

SEQ ID NO: 165046 - protein, 9 aa, Homo Sapiens
VQPRAKPFP

SEQ ID NO: 165047 - protein, 9 aa, Homo Sapiens
YYRNPDEDP

SEQ ID NO: 165048 - protein, 9 aa, Homo Sapiens
TQENDMEVE

SEQ ID NO: 165049 - protein, 9 aa, Homo Sapiens
KSSHCLLTA

SEQ ID NO: 165050 - protein, 9 aa, Homo Sapiens
EQTATEKQH

SEQ ID NO: 165051 - protein, 9 aa, Homo Sapiens
QALHLAAGP

SEQ ID NO: 165052 - protein, 9 aa, Homo Sapiens
KKSGTPPAA

SEQ ID NO: 165053 - protein, 9 aa, Homo Sapiens
VPRSRHEVP

SEQ ID NO: 165054 - protein, 9 aa, Homo Sapiens
ETPPWSGPQ

SEQ ID NO: 165055 - protein, 9 aa, Homo Sapiens
LYYNGFKVL

SEQ ID NO: 165056 - protein, 9 aa, Homo Sapiens
LIVHRVDGA

SEQ ID NO: 165057 - protein, 9 aa, Homo Sapiens
PKCKCRPRS

SEQ ID NO: 165058 - protein, 9 aa, Homo Sapiens
GLLPGEAAP

SEQ ID NO: 165059 - protein, 9 aa, Homo Sapiens
DVSHHLNAV

SEQ ID NO: 165060 - protein, 9 aa, Homo Sapiens
GPGPPPLSS

SEQ ID NO: 165061 - protein, 9 aa, Homo Sapiens
IDVDPLSGF

SEQ ID NO: 165062 - protein, 9 aa, Homo Sapiens
GAVECFVSE

SEQ ID NO: 165063 - protein, 9 aa, Homo Sapiens
ARLGLQQGE

SEQ ID NO: 165064 - protein, 9 aa, Homo Sapiens
VGSTRCGSG

SEQ ID NO: 165065 - protein, 9 aa, Homo Sapiens
KWYAYKQYG

SEQ ID NO: 165066 - protein, 9 aa, Homo Sapiens
TKCHLARCH

SEQ ID NO: 165067 - protein, 9 aa, Homo Sapiens
HEQEKIWEQ

SEQ ID NO: 165068 - protein, 9 aa, Homo Sapiens
EKKTWYLLA

SEQ ID NO: 165069 - protein, 9 aa, Homo Sapiens
SRAPSSRRS

SEQ ID NO: 165070 - protein, 9 aa, Homo Sapiens
RSAACGGRE

SEQ ID NO: 165071 - protein, 9 aa, Homo Sapiens
HETSQIRAD

SEQ ID NO: 165072 - protein, 9 aa, Homo Sapiens
HLWSSLNIS

SEQ ID NO: 165073 - protein, 9 aa, Homo Sapiens
MAGIVCASL

SEQ ID NO: 165074 - protein, 9 aa, Homo Sapiens
RPGAQDLPS

SEQ ID NO: 165075 - protein, 9 aa, Homo Sapiens
LESLTCGQL

SEQ ID NO: 165076 - protein, 9 aa, Homo Sapiens
GSYHPGIFR

SEQ ID NO: 165077 - protein, 9 aa, Homo Sapiens
HMSILLRMI

SEQ ID NO: 165078 - protein, 9 aa, Homo Sapiens
DFSPYWMKK

SEQ ID NO: 165079 - protein, 9 aa, Homo Sapiens
TLTAGSKHK

SEQ ID NO: 165080 - protein, 9 aa, Homo Sapiens
VREALFAFS

SEQ ID NO: 165081 - protein, 9 aa, Homo Sapiens
PRGREGAQE

SEQ ID NO: 165082 - protein, 9 aa, Homo Sapiens
NSTESEGAG

SEQ ID NO: 165083 - protein, 9 aa, Homo Sapiens
HNKHLDDIT

SEQ ID NO: 165084 - protein, 9 aa, Homo Sapiens
WEGCWRAVA

SEQ ID NO: 165085 - protein, 9 aa, Homo Sapiens
QGQMVPPLP

SEQ ID NO: 165086 - protein, 9 aa, Homo Sapiens
RPVCCPRAP

SEQ ID NO: 165087 - protein, 9 aa, Homo Sapiens
PRRWDQDRP

SEQ ID NO: 165088 - protein, 9 aa, Homo Sapiens
GFLGGQKSK

SEQ ID NO: 165089 - protein, 9 aa, Homo Sapiens
ASCSWCPTT

SEQ ID NO: 165090 - protein, 9 aa, Homo Sapiens
IMPDHIHKK

SEQ ID NO: 165091 - protein, 9 aa, Homo Sapiens
FHLHRKGPL

SEQ ID NO: 165092 - protein, 9 aa, Homo Sapiens
EQMEQERQE

SEQ ID NO: 165093 - protein, 9 aa, Homo Sapiens
DFIFVQKIV

SEQ ID NO: 165094 - protein, 9 aa, Homo Sapiens
CREINARPI

SEQ ID NO: 165095 - protein, 9 aa, Homo Sapiens
RVVSWSQVG

SEQ ID NO: 165096 - protein, 9 aa, Homo Sapiens
LHHSWADEE

SEQ ID NO: 165097 - protein, 9 aa, Homo Sapiens
GTALMTSPR

SEQ ID NO: 165098 - protein, 9 aa, Homo Sapiens
PDHIHKKGR

SEQ ID NO: 165099 - protein, 9 aa, Homo Sapiens
KKRASDSHK

SEQ ID NO: 165100 - protein, 9 aa, Homo Sapiens
DPWPGGSPP

SEQ ID NO: 165101 - protein, 9 aa, Homo Sapiens
SRPKPPIES

SEQ ID NO: 165102 - protein, 9 aa, Homo Sapiens
VTRLHCPSD

SEQ ID NO: 165103 - protein, 9 aa, Homo Sapiens
FQSCTFCKP

SEQ ID NO: 165104 - protein, 9 aa, Homo Sapiens
LLLSFRVFC

SEQ ID NO: 165105 - protein, 9 aa, Homo Sapiens
HALAQAIAV

SEQ ID NO: 165106 - protein, 9 aa, Homo Sapiens
RGTESTMWS

SEQ ID NO: 165107 - protein, 9 aa, Homo Sapiens
CHLQSPYFS

SEQ ID NO: 165108 - protein, 9 aa, Homo Sapiens
YLFWHMKDH

SEQ ID NO: 165109 - protein, 9 aa, Homo Sapiens
HRTWLCDRD

SEQ ID NO: 165110 - protein, 9 aa, Homo Sapiens
PTSPRGCLQ

SEQ ID NO: 165111 - protein, 9 aa, Homo Sapiens
RASTKSRPC

SEQ ID NO: 165112 - protein, 9 aa, Homo Sapiens
RERRLDGLA

SEQ ID NO: 165113 - protein, 9 aa, Homo Sapiens
KKKKIGLFT

SEQ ID NO: 165114 - protein, 9 aa, Homo Sapiens
LGVYTEARL

SEQ ID NO: 165115 - protein, 9 aa, Homo Sapiens
SMCVLQCKY

SEQ ID NO: 165116 - protein, 9 aa, Homo Sapiens
LWSCGPNII

SEQ ID NO: 165117 - protein, 9 aa, Homo Sapiens
PAARAKVAG

SEQ ID NO: 165118 - protein, 9 aa, Homo Sapiens
GHFGGDQSL

SEQ ID NO: 165119 - protein, 9 aa, Homo Sapiens
SHWSCCRRR

SEQ ID NO: 165120 - protein, 9 aa, Homo Sapiens
EYMRNFSDP

SEQ ID NO: 165121 - protein, 9 aa, Homo Sapiens
SFPPSVSVA

SEQ ID NO: 165122 - protein, 9 aa, Homo Sapiens
SRGFGMAIV

SEQ ID NO: 165123 - protein, 9 aa, Homo Sapiens
DQSFPGAPQ

SEQ ID NO: 165124 - protein, 9 aa, Homo Sapiens
TTLPKSSRM

SEQ ID NO: 165125 - protein, 9 aa, Homo Sapiens
RVARAAEHQ

SEQ ID NO: 165126 - protein, 9 aa, Homo Sapiens
ERQIEEWKV

SEQ ID NO: 165127 - protein, 9 aa, Homo Sapiens
SEKSNKKIS

SEQ ID NO: 165128 - protein, 9 aa, Homo Sapiens
AHPLTPGRL

SEQ ID NO: 165129 - protein, 9 aa, Homo Sapiens
GGLRCTASA

SEQ ID NO: 165130 - protein, 9 aa, Homo Sapiens
TKKYPPQLT

SEQ ID NO: 165131 - protein, 9 aa, Homo Sapiens
AQVPAHSPA

SEQ ID NO: 165132 - protein, 9 aa, Homo Sapiens
VRVHHLLAL

SEQ ID NO: 165133 - protein, 9 aa, Homo Sapiens
SLSDSPPGV

SEQ ID NO: 165134 - protein, 9 aa, Homo Sapiens
STRAPGCPC

SEQ ID NO: 165135 - protein, 9 aa, Homo Sapiens
QTKWMLQSM

SEQ ID NO: 165136 - protein, 9 aa, Homo Sapiens
DTENGSPGK

SEQ ID NO: 165137 - protein, 9 aa, Homo Sapiens
LMGWSDMNS

SEQ ID NO: 165138 - protein, 9 aa, Homo Sapiens
HCAATGYMC

SEQ ID NO: 165139 - protein, 9 aa, Homo Sapiens
CLLGTFRRV

SEQ ID NO: 165140 - protein, 9 aa, Homo Sapiens
PLGDTPQPS

SEQ ID NO: 165141 - protein, 9 aa, Homo Sapiens
AHRQRVCGL

SEQ ID NO: 165142 - protein, 9 aa, Homo Sapiens
QPHQPVPHQ

SEQ ID NO: 165143 - protein, 9 aa, Homo Sapiens
HSFRIHFSR

SEQ ID NO: 165144 - protein, 9 aa, Homo Sapiens
NKAYKCASA

SEQ ID NO: 165145 - protein, 9 aa, Homo Sapiens
FPRVLTLKR

SEQ ID NO: 165146 - protein, 9 aa, Homo Sapiens
RLDALELRD

SEQ ID NO: 165147 - protein, 9 aa, Homo Sapiens
TVCAMDSLR

SEQ ID NO: 165148 - protein, 9 aa, Homo Sapiens
VCTDPKGQG

SEQ ID NO: 165149 - protein, 9 aa, Homo Sapiens
ARLYNRKTS

SEQ ID NO: 165150 - protein, 9 aa, Homo Sapiens
QTWKLAILA

SEQ ID NO: 165151 - protein, 9 aa, Homo Sapiens
HMKIFLRQK

SEQ ID NO: 165152 - protein, 9 aa, Homo Sapiens
PAQLPTATT

SEQ ID NO: 165153 - protein, 9 aa, Homo Sapiens
RRARVTCPR

SEQ ID NO: 165154 - protein, 9 aa, Homo Sapiens
GVEEEEDDD

SEQ ID NO: 165155 - protein, 9 aa, Homo Sapiens
QITEALVSR

SEQ ID NO: 165156 - protein, 9 aa, Homo Sapiens
ARWKKLVLM

SEQ ID NO: 165157 - protein, 9 aa, Homo Sapiens
ARPSCIGKS

SEQ ID NO: 165158 - protein, 9 aa, Homo Sapiens
PDCQIRAFH

SEQ ID NO: 165159 - protein, 9 aa, Homo Sapiens
ICYLPLNTF

SEQ ID NO: 165160 - protein, 9 aa, Homo Sapiens
WRHLEDLIQ

SEQ ID NO: 165161 - protein, 9 aa, Homo Sapiens
VGDCPKRPE

SEQ ID NO: 165162 - protein, 9 aa, Homo Sapiens
HHVEEAQRK

SEQ ID NO: 165163 - protein, 9 aa, Homo Sapiens
NLGRYLNYF

SEQ ID NO: 165164 - protein, 9 aa, Homo Sapiens
GENTTLHCH

SEQ ID NO: 165165 - protein, 9 aa, Homo Sapiens
SPWWSTTRT

SEQ ID NO: 165166 - protein, 9 aa, Homo Sapiens
GPLLCLGPT

SEQ ID NO: 165167 - protein, 9 aa, Homo Sapiens
YRPPTAAVG

SEQ ID NO: 165168 - protein, 9 aa, Homo Sapiens
SRVIPVRLQ

SEQ ID NO: 165169 - protein, 9 aa, Homo Sapiens
FAPNPKIIC

SEQ ID NO: 165170 - protein, 9 aa, Homo Sapiens
QQYKKNSNQ

SEQ ID NO: 165171 - protein, 9 aa, Homo Sapiens
EGCWRAVAT

SEQ ID NO: 165172 - protein, 9 aa, Homo Sapiens
CPKRPEQLP

SEQ ID NO: 165173 - protein, 9 aa, Homo Sapiens
EAREGWSLI

SEQ ID NO: 165174 - protein, 9 aa, Homo Sapiens
DTFADLCSE

SEQ ID NO: 165175 - protein, 9 aa, Homo Sapiens
KWPLKWYTP

SEQ ID NO: 165176 - protein, 9 aa, Homo Sapiens
LSISRPTSR

SEQ ID NO: 165177 - protein, 9 aa, Homo Sapiens
FPRAEAGHL

SEQ ID NO: 165178 - protein, 9 aa, Homo Sapiens
WILPRVVWW

SEQ ID NO: 165179 - protein, 9 aa, Homo Sapiens
FQSRVIPVR

SEQ ID NO: 165180 - protein, 9 aa, Homo Sapiens
ECTECDKVC

SEQ ID NO: 165181 - protein, 9 aa, Homo Sapiens
NLESLTCGQ

SEQ ID NO: 165182 - protein, 9 aa, Homo Sapiens
WPLSSPPSP

SEQ ID NO: 165183 - protein, 9 aa, Homo Sapiens
DMVTGANLM

SEQ ID NO: 165184 - protein, 9 aa, Homo Sapiens
HFRTRQTLL

SEQ ID NO: 165185 - protein, 9 aa, Homo Sapiens
QLDEVVSDN

SEQ ID NO: 165186 - protein, 9 aa, Homo Sapiens
DLPCGFQEV

SEQ ID NO: 165187 - protein, 9 aa, Homo Sapiens
SIQFERVLL

SEQ ID NO: 165188 - protein, 9 aa, Homo Sapiens
PALPTQQLA

SEQ ID NO: 165189 - protein, 9 aa, Homo Sapiens
LPQARPSPL

SEQ ID NO: 165190 - protein, 9 aa, Homo Sapiens
NWGAIPRKA

SEQ ID NO: 165191 - protein, 9 aa, Homo Sapiens
ATKIYSQRS

SEQ ID NO: 165192 - protein, 9 aa, Homo Sapiens
CSPLQRSFL

SEQ ID NO: 165193 - protein, 9 aa, Homo Sapiens
KPTWEHLYC

SEQ ID NO: 165194 - protein, 9 aa, Homo Sapiens
YLHFVNGAV

SEQ ID NO: 165195 - protein, 9 aa, Homo Sapiens
LLQQRAVED

SEQ ID NO: 165196 - protein, 9 aa, Homo Sapiens
MAVHLGAFH

SEQ ID NO: 165197 - protein, 9 aa, Homo Sapiens
ISRCQSEPR

SEQ ID NO: 165198 - protein, 9 aa, Homo Sapiens
IRMNKGPLE

SEQ ID NO: 165199 - protein, 9 aa, Homo Sapiens
MLAASSVKK

SEQ ID NO: 165200 - protein, 9 aa, Homo Sapiens
AVYAVQVCC

SEQ ID NO: 165201 - protein, 9 aa, Homo Sapiens
PQDPRLSLP

SEQ ID NO: 165202 - protein, 9 aa, Homo Sapiens
PEAQDGSPS

SEQ ID NO: 165203 - protein, 9 aa, Homo Sapiens
EGNHTLTLA

SEQ ID NO: 165204 - protein, 9 aa, Homo Sapiens
QFRGGSVHL

SEQ ID NO: 165205 - protein, 9 aa, Homo Sapiens
ALKHLQDFL

SEQ ID NO: 165206 - protein, 9 aa, Homo Sapiens
AITYEDEGS

SEQ ID NO: 165207 - protein, 9 aa, Homo Sapiens
LINDQLPFL

SEQ ID NO: 165208 - protein, 9 aa, Homo Sapiens
QNYLFWHMK

SEQ ID NO: 165209 - protein, 9 aa, Homo Sapiens
AKQPGDICN

SEQ ID NO: 165210 - protein, 9 aa, Homo Sapiens
GACGTMVIW

SEQ ID NO: 165211 - protein, 9 aa, Homo Sapiens
RPWCPGLPP

SEQ ID NO: 165212 - protein, 9 aa, Homo Sapiens
PFECFFLWE

SEQ ID NO: 165213 - protein, 9 aa, Homo Sapiens
GAEPRQHSA

SEQ ID NO: 165214 - protein, 9 aa, Homo Sapiens
LAQTQDQLI

SEQ ID NO: 165215 - protein, 9 aa, Homo Sapiens
VQGQMVPPL

SEQ ID NO: 165216 - protein, 9 aa, Homo Sapiens
TFVIMLLAL

SEQ ID NO: 165217 - protein, 9 aa, Homo Sapiens
TRVCQQVAG

SEQ ID NO: 165218 - protein, 9 aa, Homo Sapiens
LQRCCQGHC

SEQ ID NO: 165219 - protein, 9 aa, Homo Sapiens
KSPRFCPDT

SEQ ID NO: 165220 - protein, 9 aa, Homo Sapiens
SIDVDPLSG

SEQ ID NO: 165221 - protein, 9 aa, Homo Sapiens
PSSNKMLQS

SEQ ID NO: 165222 - protein, 9 aa, Homo Sapiens
ICTHVYICV

SEQ ID NO: 165223 - protein, 9 aa, Homo Sapiens
GHVTFNNQR

SEQ ID NO: 165224 - protein, 9 aa, Homo Sapiens
RRESQVWQL

SEQ ID NO: 165225 - protein, 9 aa, Homo Sapiens
QVAGWCTTA

SEQ ID NO: 165226 - protein, 9 aa, Homo Sapiens
RWIVFSVKE

SEQ ID NO: 165227 - protein, 9 aa, Homo Sapiens
PACTCISMT

SEQ ID NO: 165228 - protein, 9 aa, Homo Sapiens
LVGMSYLHE

SEQ ID NO: 165229 - protein, 9 aa, Homo Sapiens
DTLQRLGPV

SEQ ID NO: 165230 - protein, 9 aa, Homo Sapiens
LRAVLESWQ

SEQ ID NO: 165231 - protein, 9 aa, Homo Sapiens
WCPGLPPCS

SEQ ID NO: 165232 - protein, 9 aa, Homo Sapiens
KSKKTLNWK

SEQ ID NO: 165233 - protein, 9 aa, Homo Sapiens
FPDAHILRC

SEQ ID NO: 165234 - protein, 9 aa, Homo Sapiens
LYAQGLGNI

SEQ ID NO: 165235 - protein, 9 aa, Homo Sapiens
ALSLFYHLQ

SEQ ID NO: 165236 - protein, 9 aa, Homo Sapiens
RRQGPAPQG

SEQ ID NO: 165237 - protein, 9 aa, Homo Sapiens
LCIPLLITV

SEQ ID NO: 165238 - protein, 9 aa, Homo Sapiens
LKEEQTWKL

SEQ ID NO: 165239 - protein, 9 aa, Homo Sapiens
HTAKIVTPE

SEQ ID NO: 165240 - protein, 9 aa, Homo Sapiens
TLSIVLEQM

SEQ ID NO: 165241 - protein, 9 aa, Homo Sapiens
LVNAFADQV

SEQ ID NO: 165242 - protein, 9 aa, Homo Sapiens
QPNQTKGLL

SEQ ID NO: 165243 - protein, 9 aa, Homo Sapiens
TNRNNLNPA

SEQ ID NO: 165244 - protein, 9 aa, Homo Sapiens
TGRTPTTRL

SEQ ID NO: 165245 - protein, 9 aa, Homo Sapiens
YLTSWASRS

SEQ ID NO: 165246 - protein, 9 aa, Homo Sapiens
RRCRPRTAG

SEQ ID NO: 165247 - protein, 9 aa, Homo Sapiens
LLVFLELIR

SEQ ID NO: 165248 - protein, 9 aa, Homo Sapiens
DTCLSVIAQ

SEQ ID NO: 165249 - protein, 9 aa, Homo Sapiens
FSGSMHTKL

SEQ ID NO: 165250 - protein, 9 aa, Homo Sapiens
ANGAGWPCP

SEQ ID NO: 165251 - protein, 9 aa, Homo Sapiens
MPKTELIPN

SEQ ID NO: 165252 - protein, 9 aa, Homo Sapiens
EADHQNLLV

SEQ ID NO: 165253 - protein, 9 aa, Homo Sapiens
PLLCICVVA

SEQ ID NO: 165254 - protein, 9 aa, Homo Sapiens
LKRESWYST

SEQ ID NO: 165255 - protein, 9 aa, Homo Sapiens
FASCSWCPT

SEQ ID NO: 165256 - protein, 9 aa, Homo Sapiens
GWPGWRWRR

SEQ ID NO: 165257 - protein, 9 aa, Homo Sapiens
VGLAKLLLG

SEQ ID NO: 165258 - protein, 9 aa, Homo Sapiens
VWPTAWASL

SEQ ID NO: 165259 - protein, 9 aa, Homo Sapiens
AERQIEEWK

SEQ ID NO: 165260 - protein, 9 aa, Homo Sapiens
LLPHHMVHT

SEQ ID NO: 165261 - protein, 9 aa, Homo Sapiens
VGSGSPRRR

SEQ ID NO: 165262 - protein, 9 aa, Homo Sapiens
LAWLLRTPR

SEQ ID NO: 165263 - protein, 9 aa, Homo Sapiens
NVEPPLHQA

SEQ ID NO: 165264 - protein, 9 aa, Homo Sapiens
TINSTERKR

SEQ ID NO: 165265 - protein, 9 aa, Homo Sapiens
TYSGPPQGQ

SEQ ID NO: 165266 - protein, 9 aa, Homo Sapiens
GKAFRQSSV

SEQ ID NO: 165267 - protein, 9 aa, Homo Sapiens
IFVGFFPEL

SEQ ID NO: 165268 - protein, 9 aa, Homo Sapiens
QDPRLSLPP

SEQ ID NO: 165269 - protein, 9 aa, Homo Sapiens
RGGGEAGKP

SEQ ID NO: 165270 - protein, 9 aa, Homo Sapiens
SLSPSHPPR

SEQ ID NO: 165271 - protein, 9 aa, Homo Sapiens
DITDLDMAN

SEQ ID NO: 165272 - protein, 9 aa, Homo Sapiens
TKDVGAIAG

SEQ ID NO: 165273 - protein, 9 aa, Homo Sapiens
VSAFLNRMN

SEQ ID NO: 165274 - protein, 9 aa, Homo Sapiens
SSVLMVFFS

SEQ ID NO: 165275 - protein, 9 aa, Homo Sapiens
KLTALRRND

SEQ ID NO: 165276 - protein, 9 aa, Homo Sapiens
ICRSSTFLK

SEQ ID NO: 165277 - protein, 9 aa, Homo Sapiens
CAPALPARR

SEQ ID NO: 165278 - protein, 9 aa, Homo Sapiens
GPAASLTPG

SEQ ID NO: 165279 - protein, 9 aa, Homo Sapiens
SVLLFIAET

SEQ ID NO: 165280 - protein, 9 aa, Homo Sapiens
INDQLPFLV

SEQ ID NO: 165281 - protein, 9 aa, Homo Sapiens
RAGRTSHRI

SEQ ID NO: 165282 - protein, 9 aa, Homo Sapiens
PFPCVPCKN

SEQ ID NO: 165283 - protein, 9 aa, Homo Sapiens
IATHQLEWV

SEQ ID NO: 165284 - protein, 9 aa, Homo Sapiens
SRHVCSHGD

SEQ ID NO: 165285 - protein, 9 aa, Homo Sapiens
RKKREKIIN

SEQ ID NO: 165286 - protein, 9 aa, Homo Sapiens
KITGRDQSI

SEQ ID NO: 165287 - protein, 9 aa, Homo Sapiens
QARPSPLNQ

SEQ ID NO: 165288 - protein, 9 aa, Homo Sapiens
WHFSIWQHR

SEQ ID NO: 165289 - protein, 9 aa, Homo Sapiens
LRGHDGLSR

SEQ ID NO: 165290 - protein, 9 aa, Homo Sapiens
GSHSQHLPS

SEQ ID NO: 165291 - protein, 9 aa, Homo Sapiens
PSPTLGSPG

SEQ ID NO: 165292 - protein, 9 aa, Homo Sapiens
QNNTSAMKE

SEQ ID NO: 165293 - protein, 9 aa, Homo Sapiens
TVTCQIMVM

SEQ ID NO: 165294 - protein, 9 aa, Homo Sapiens
RKSSPTSWW

SEQ ID NO: 165295 - protein, 9 aa, Homo Sapiens
PQGQGLPAG

SEQ ID NO: 165296 - protein, 9 aa, Homo Sapiens
NGVLDFFSR

SEQ ID NO: 165297 - protein, 9 aa, Homo Sapiens
GTVRRFESP

SEQ ID NO: 165298 - protein, 9 aa, Homo Sapiens
RGGGDIWDV

SEQ ID NO: 165299 - protein, 9 aa, Homo Sapiens
CTSEDKVAQ

SEQ ID NO: 165300 - protein, 9 aa, Homo Sapiens
NAVKLVAIR

SEQ ID NO: 165301 - protein, 9 aa, Homo Sapiens
VGPEKKTWY

SEQ ID NO: 165302 - protein, 9 aa, Homo Sapiens
HQEIVLCQL

SEQ ID NO: 165303 - protein, 9 aa, Homo Sapiens
ISVSHSVLL

SEQ ID NO: 165304 - protein, 9 aa, Homo Sapiens
NCYGPGVST

SEQ ID NO: 165305 - protein, 9 aa, Homo Sapiens
SCSLNWKMC

SEQ ID NO: 165306 - protein, 9 aa, Homo Sapiens
RPWRGTTRN

SEQ ID NO: 165307 - protein, 9 aa, Homo Sapiens
SYDLTIRYW

SEQ ID NO: 165308 - protein, 9 aa, Homo Sapiens
DLFVNELFW

SEQ ID NO: 165309 - protein, 9 aa, Homo Sapiens
SHCVSPTWP

SEQ ID NO: 165310 - protein, 9 aa, Homo Sapiens
KWRLTTRVV

SEQ ID NO: 165311 - protein, 9 aa, Homo Sapiens
IAFQAHTDD

SEQ ID NO: 165312 - protein, 9 aa, Homo Sapiens
PRGTCSPAP

SEQ ID NO: 165313 - protein, 9 aa, Homo Sapiens
SITWEHAGW

SEQ ID NO: 165314 - protein, 9 aa, Homo Sapiens
RGAGAAWAT

SEQ ID NO: 165315 - protein, 9 aa, Homo Sapiens
IFQNYYPNI

SEQ ID NO: 165316 - protein, 9 aa, Homo Sapiens
PKGPLALQA

SEQ ID NO: 165317 - protein, 9 aa, Homo Sapiens
ETESQCREL

SEQ ID NO: 165318 - protein, 9 aa, Homo Sapiens
WLPMRSLGE

SEQ ID NO: 165319 - protein, 9 aa, Homo Sapiens
LLQRCCQGH

SEQ ID NO: 165320 - protein, 9 aa, Homo Sapiens
EIQNNQKKQ

SEQ ID NO: 165321 - protein, 9 aa, Homo Sapiens
FATHGVAVV

SEQ ID NO: 165322 - protein, 9 aa, Homo Sapiens
LSVSRRARQ

SEQ ID NO: 165323 - protein, 9 aa, Homo Sapiens
EGKKDSRML

SEQ ID NO: 165324 - protein, 9 aa, Homo Sapiens
VEEQKQLQE

SEQ ID NO: 165325 - protein, 9 aa, Homo Sapiens
WAPPPSASY

SEQ ID NO: 165326 - protein, 9 aa, Homo Sapiens
PLLIDHLLN

SEQ ID NO: 165327 - protein, 9 aa, Homo Sapiens
DRTRTEPGR

SEQ ID NO: 165328 - protein, 9 aa, Homo Sapiens
PTCHNRTRH

SEQ ID NO: 165329 - protein, 9 aa, Homo Sapiens
GRWIQTQAI

SEQ ID NO: 165330 - protein, 9 aa, Homo Sapiens
STSPTRWNT

SEQ ID NO: 165331 - protein, 9 aa, Homo Sapiens
GRRRLFTRS

SEQ ID NO: 165332 - protein, 9 aa, Homo Sapiens
CEMNGKYVG

SEQ ID NO: 165333 - protein, 9 aa, Homo Sapiens
NFRILADIV

SEQ ID NO: 165334 - protein, 9 aa, Homo Sapiens
NENCHLQSP

SEQ ID NO: 165335 - protein, 9 aa, Homo Sapiens
AMEETEVGA

SEQ ID NO: 165336 - protein, 9 aa, Homo Sapiens
KSNKKISVL

SEQ ID NO: 165337 - protein, 9 aa, Homo Sapiens
KSDHIVTCG

SEQ ID NO: 165338 - protein, 9 aa, Homo Sapiens
CRPRSRRSS

SEQ ID NO: 165339 - protein, 9 aa, Homo Sapiens
DTYSGPPQG

SEQ ID NO: 165340 - protein, 9 aa, Homo Sapiens
LLVLLVGVC

SEQ ID NO: 165341 - protein, 9 aa, Homo Sapiens
CASVSSVLM

SEQ ID NO: 165342 - protein, 9 aa, Homo Sapiens
SSTNGCQPL

SEQ ID NO: 165343 - protein, 9 aa, Homo Sapiens
MRRQWSLWV

SEQ ID NO: 165344 - protein, 9 aa, Homo Sapiens
HSLWARIEK

SEQ ID NO: 165345 - protein, 9 aa, Homo Sapiens
WLINDQLPF

SEQ ID NO: 165346 - protein, 9 aa, Homo Sapiens
LWTAQVKRL

SEQ ID NO: 165347 - protein, 9 aa, Homo Sapiens
LQQDGQDGA

SEQ ID NO: 165348 - protein, 9 aa, Homo Sapiens
PRRESQVWQ

SEQ ID NO: 165349 - protein, 9 aa, Homo Sapiens
DLWNIHDLE

SEQ ID NO: 165350 - protein, 9 aa, Homo Sapiens
KGGVGPYSS

SEQ ID NO: 165351 - protein, 9 aa, Homo Sapiens
CGPQRSHFF

SEQ ID NO: 165352 - protein, 9 aa, Homo Sapiens
GTDEETLIC

SEQ ID NO: 165353 - protein, 9 aa, Homo Sapiens
VCCPRAPEV

SEQ ID NO: 165354 - protein, 9 aa, Homo Sapiens
TVVVAVATV

SEQ ID NO: 165355 - protein, 9 aa, Homo Sapiens
LFHHHHRLP

SEQ ID NO: 165356 - protein, 9 aa, Homo Sapiens
WSVSSVDEL

SEQ ID NO: 165357 - protein, 9 aa, Homo Sapiens
PQPLRWAAS

SEQ ID NO: 165358 - protein, 9 aa, Homo Sapiens
HLPALEGLK

SEQ ID NO: 165359 - protein, 9 aa, Homo Sapiens
AMEAPRGTC

SEQ ID NO: 165360 - protein, 9 aa, Homo Sapiens
QGPSFEELQ

SEQ ID NO: 165361 - protein, 9 aa, Homo Sapiens
SLQFTYREE

SEQ ID NO: 165362 - protein, 9 aa, Homo Sapiens
FHDQHFSPF

SEQ ID NO: 165363 - protein, 9 aa, Homo Sapiens
YALLLQRCC

SEQ ID NO: 165364 - protein, 9 aa, Homo Sapiens
FGQLQLQVV

SEQ ID NO: 165365 - protein, 9 aa, Homo Sapiens
VRFRCPAAD

SEQ ID NO: 165366 - protein, 9 aa, Homo Sapiens
NPPQGVGPY

SEQ ID NO: 165367 - protein, 9 aa, Homo Sapiens
ISTAECQAW

SEQ ID NO: 165368 - protein, 9 aa, Homo Sapiens
PVSLRAHST

SEQ ID NO: 165369 - protein, 9 aa, Homo Sapiens
KLRPTQKHW

SEQ ID NO: 165370 - protein, 9 aa, Homo Sapiens
SLPPATTLA

SEQ ID NO: 165371 - protein, 9 aa, Homo Sapiens
TSQIRADNK

SEQ ID NO: 165372 - protein, 9 aa, Homo Sapiens
PIRKYICAS

SEQ ID NO: 165373 - protein, 9 aa, Homo Sapiens
ESMEGFWIE

SEQ ID NO: 165374 - protein, 9 aa, Homo Sapiens
KNCWVYDRA

SEQ ID NO: 165375 - protein, 9 aa, Homo Sapiens
YSKRFHSTF

SEQ ID NO: 165376 - protein, 9 aa, Homo Sapiens
IDPQTPPSR

SEQ ID NO: 165377 - protein, 9 aa, Homo Sapiens
PPHPAARSS

SEQ ID NO: 165378 - protein, 9 aa, Homo Sapiens
RNCSSTSCG

SEQ ID NO: 165379 - protein, 9 aa, Homo Sapiens
GNAKKALKE

SEQ ID NO: 165380 - protein, 9 aa, Homo Sapiens
SSGHILMNG

SEQ ID NO: 165381 - protein, 9 aa, Homo Sapiens
AGNVSKDEI

SEQ ID NO: 165382 - protein, 9 aa, Homo Sapiens
HDQHFSPFF

SEQ ID NO: 165383 - protein, 9 aa, Homo Sapiens
DDFDKAFSQ

SEQ ID NO: 165384 - protein, 9 aa, Homo Sapiens
DGSIGQSPT

SEQ ID NO: 165385 - protein, 9 aa, Homo Sapiens
LWLGLAAGA

SEQ ID NO: 165386 - protein, 9 aa, Homo Sapiens
SGLLPPVLE

SEQ ID NO: 165387 - protein, 9 aa, Homo Sapiens
RHLHDPSWR

SEQ ID NO: 165388 - protein, 9 aa, Homo Sapiens
TIGTNLHLF

SEQ ID NO: 165389 - protein, 9 aa, Homo Sapiens
RLQKYPQAA

SEQ ID NO: 165390 - protein, 9 aa, Homo Sapiens
PLLPKAPLQ

SEQ ID NO: 165391 - protein, 9 aa, Homo Sapiens
RRRSRHLPA

SEQ ID NO: 165392 - protein, 9 aa, Homo Sapiens
ESSSGDPPV

SEQ ID NO: 165393 - protein, 9 aa, Homo Sapiens
DMGNTCYEN

SEQ ID NO: 165394 - protein, 9 aa, Homo Sapiens
GGGSWSSAS

SEQ ID NO: 165395 - protein, 9 aa, Homo Sapiens
TTEEEEDFG

SEQ ID NO: 165396 - protein, 9 aa, Homo Sapiens
TFSGVLCAY

SEQ ID NO: 165397 - protein, 9 aa, Homo Sapiens
ARKLRPTQK

SEQ ID NO: 165398 - protein, 9 aa, Homo Sapiens
WEVCLTISE

SEQ ID NO: 165399 - protein, 9 aa, Homo Sapiens
LMVALSLFY

SEQ ID NO: 165400 - protein, 9 aa, Homo Sapiens
MVPPLPDSE

SEQ ID NO: 165401 - protein, 9 aa, Homo Sapiens
RSPHRRVGA

SEQ ID NO: 165402 - protein, 9 aa, Homo Sapiens
EMDHISYKS

SEQ ID NO: 165403 - protein, 9 aa, Homo Sapiens
VVLRPWCPG

SEQ ID NO: 165404 - protein, 9 aa, Homo Sapiens
SRMAACHPQ

SEQ ID NO: 165405 - protein, 9 aa, Homo Sapiens
SQDTLDREA

SEQ ID NO: 165406 - protein, 9 aa, Homo Sapiens
TRCVWQQPS

SEQ ID NO: 165407 - protein, 9 aa, Homo Sapiens
VCKPVRCPV

SEQ ID NO: 165408 - protein, 9 aa, Homo Sapiens
KRREIQWLE

SEQ ID NO: 165409 - protein, 9 aa, Homo Sapiens
DLLQQDGQD

SEQ ID NO: 165410 - protein, 9 aa, Homo Sapiens
LHKTGQIDK

SEQ ID NO: 165411 - protein, 9 aa, Homo Sapiens
ASLWLSVCS

SEQ ID NO: 165412 - protein, 9 aa, Homo Sapiens
HLVTRFVNE

SEQ ID NO: 165413 - protein, 9 aa, Homo Sapiens
SSNLTLTAG

SEQ ID NO: 165414 - protein, 9 aa, Homo Sapiens
SATTTLHVL

SEQ ID NO: 165415 - protein, 9 aa, Homo Sapiens
APDAFVDPA

SEQ ID NO: 165416 - protein, 9 aa, Homo Sapiens
QASWTKVRF

SEQ ID NO: 165417 - protein, 9 aa, Homo Sapiens
WMFLRILEQ

SEQ ID NO: 165418 - protein, 9 aa, Homo Sapiens
LAEPNGLAP

SEQ ID NO: 165419 - protein, 9 aa, Homo Sapiens
PREKRAQWV

SEQ ID NO: 165420 - protein, 9 aa, Homo Sapiens
LVINTEDWK

SEQ ID NO: 165421 - protein, 9 aa, Homo Sapiens
QLAESLGGQ

SEQ ID NO: 165422 - protein, 9 aa, Homo Sapiens
DAGRLDGPL

SEQ ID NO: 165423 - protein, 9 aa, Homo Sapiens
AGDHHHACG

SEQ ID NO: 165424 - protein, 9 aa, Homo Sapiens
RPPSSPKAR

SEQ ID NO: 165425 - protein, 9 aa, Homo Sapiens
KSRPCPWSP

SEQ ID NO: 165426 - protein, 9 aa, Homo Sapiens
PQPARQARA

SEQ ID NO: 165427 - protein, 9 aa, Homo Sapiens
PVPHQQSKA

SEQ ID NO: 165428 - protein, 9 aa, Homo Sapiens
HIHCWLSPP

SEQ ID NO: 165429 - protein, 9 aa, Homo Sapiens
LFEWQWVDI

SEQ ID NO: 165430 - protein, 9 aa, Homo Sapiens
ARIKLRMNN

SEQ ID NO: 165431 - protein, 9 aa, Homo Sapiens
DALVPQHVS

SEQ ID NO: 165432 - protein, 9 aa, Homo Sapiens
APGVQGQMV

SEQ ID NO: 165433 - protein, 9 aa, Homo Sapiens
PVVIRHIQV

SEQ ID NO: 165434 - protein, 9 aa, Homo Sapiens
SSASRGPST

SEQ ID NO: 165435 - protein, 9 aa, Homo Sapiens
NIRLCWDLV

SEQ ID NO: 165436 - protein, 9 aa, Homo Sapiens
AGPGGCVPG

SEQ ID NO: 165437 - protein, 9 aa, Homo Sapiens
DRNPRPGCG

SEQ ID NO: 165438 - protein, 9 aa, Homo Sapiens
GQIDKSYPT

SEQ ID NO: 165439 - protein, 9 aa, Homo Sapiens
STNGCQPLT

SEQ ID NO: 165440 - protein, 9 aa, Homo Sapiens
FLLLVLLFV

SEQ ID NO: 165441 - protein, 9 aa, Homo Sapiens
LHVHHHLDS

SEQ ID NO: 165442 - protein, 9 aa, Homo Sapiens
RKARGVFVA

SEQ ID NO: 165443 - protein, 9 aa, Homo Sapiens
VLKDNDFLW

SEQ ID NO: 165444 - protein, 9 aa, Homo Sapiens
ANTGAWILR

SEQ ID NO: 165445 - protein, 9 aa, Homo Sapiens
SFNGCSRMN

SEQ ID NO: 165446 - protein, 9 aa, Homo Sapiens
RRRRARMSA

SEQ ID NO: 165447 - protein, 9 aa, Homo Sapiens
TPDCQIRAF

SEQ ID NO: 165448 - protein, 9 aa, Homo Sapiens
RTPPHPAAR

SEQ ID NO: 165449 - protein, 9 aa, Homo Sapiens
ELQTLYLNL

SEQ ID NO: 165450 - protein, 9 aa, Homo Sapiens
PHPARTLAR

SEQ ID NO: 165451 - protein, 9 aa, Homo Sapiens
SETPSGKIV

SEQ ID NO: 165452 - protein, 9 aa, Homo Sapiens
CLSNKRHHP

SEQ ID NO: 165453 - protein, 9 aa, Homo Sapiens
LYGSYPPAR

SEQ ID NO: 165454 - protein, 9 aa, Homo Sapiens
WTWRPGSRM

SEQ ID NO: 165455 - protein, 9 aa, Homo Sapiens
EHPENDLRH

SEQ ID NO: 165456 - protein, 9 aa, Homo Sapiens
IEAWILAVA

SEQ ID NO: 165457 - protein, 9 aa, Homo Sapiens
KKKIGLFTR

SEQ ID NO: 165458 - protein, 9 aa, Homo Sapiens
RTSDSGSTT

SEQ ID NO: 165459 - protein, 9 aa, Homo Sapiens
GSRTTCPKC

SEQ ID NO: 165460 - protein, 9 aa, Homo Sapiens
CCLPGLTHP

SEQ ID NO: 165461 - protein, 9 aa, Homo Sapiens
DLRCPLTAP

SEQ ID NO: 165462 - protein, 9 aa, Homo Sapiens
ESEGAGESQ

SEQ ID NO: 165463 - protein, 9 aa, Homo Sapiens
TQTEVQRGQ

SEQ ID NO: 165464 - protein, 9 aa, Homo Sapiens
TWLCDRDND

SEQ ID NO: 165465 - protein, 9 aa, Homo Sapiens
LFAPLGPPS

SEQ ID NO: 165466 - protein, 9 aa, Homo Sapiens
ERGEAEWHK

SEQ ID NO: 165467 - protein, 9 aa, Homo Sapiens
VSHLESLSA

SEQ ID NO: 165468 - protein, 9 aa, Homo Sapiens
TVTSLQMPV

SEQ ID NO: 165469 - protein, 9 aa, Homo Sapiens
LHPQSRGLD

SEQ ID NO: 165470 - protein, 9 aa, Homo Sapiens
PSNAQYLPR

SEQ ID NO: 165471 - protein, 9 aa, Homo Sapiens
WFWVRDMLT

SEQ ID NO: 165472 - protein, 9 aa, Homo Sapiens
FYHLQTQLC

SEQ ID NO: 165473 - protein, 9 aa, Homo Sapiens
EAEWHKLLI

SEQ ID NO: 165474 - protein, 9 aa, Homo Sapiens
GITGMSHHV

SEQ ID NO: 165475 - protein, 9 aa, Homo Sapiens
GFPGPKGPL

SEQ ID NO: 165476 - protein, 9 aa, Homo Sapiens
WGLELSLSP

SEQ ID NO: 165477 - protein, 9 aa, Homo Sapiens
SENDFADGE

SEQ ID NO: 165478 - protein, 9 aa, Homo Sapiens
PASPSMTSP

SEQ ID NO: 165479 - protein, 9 aa, Homo Sapiens
ATRHGPYPA

SEQ ID NO: 165480 - protein, 9 aa, Homo Sapiens
LTALRRNDT

SEQ ID NO: 165481 - protein, 9 aa, Homo Sapiens
TFDGFSYHL

SEQ ID NO: 165482 - protein, 9 aa, Homo Sapiens
RRTGRGLRQ

SEQ ID NO: 165483 - protein, 9 aa, Homo Sapiens
VGPYSPRPP

SEQ ID NO: 165484 - protein, 9 aa, Homo Sapiens
VKMDVLNTF

SEQ ID NO: 165485 - protein, 9 aa, Homo Sapiens
ATTTVAAAA

SEQ ID NO: 165486 - protein, 9 aa, Homo Sapiens
RHLEDLIQG

SEQ ID NO: 165487 - protein, 9 aa, Homo Sapiens
LLLTVVVQQ

SEQ ID NO: 165488 - protein, 9 aa, Homo Sapiens
NPTISCPFQ

SEQ ID NO: 165489 - protein, 9 aa, Homo Sapiens
REGRARGLQ

SEQ ID NO: 165490 - protein, 9 aa, Homo Sapiens
AWAPAPPTR

SEQ ID NO: 165491 - protein, 9 aa, Homo Sapiens
STPATLTLA

SEQ ID NO: 165492 - protein, 9 aa, Homo Sapiens
PRAGTGTRI

SEQ ID NO: 165493 - protein, 9 aa, Homo Sapiens
APALPARRP

SEQ ID NO: 165494 - protein, 9 aa, Homo Sapiens
KMIWILPRV

SEQ ID NO: 165495 - protein, 9 aa, Homo Sapiens
AFLYGLKRE

SEQ ID NO: 165496 - protein, 9 aa, Homo Sapiens
DVRHESRLL

SEQ ID NO: 165497 - protein, 9 aa, Homo Sapiens
MRCPSRLST

SEQ ID NO: 165498 - protein, 9 aa, Homo Sapiens
HAHYIPPVC

SEQ ID NO: 165499 - protein, 9 aa, Homo Sapiens
LRLAVLVNN

SEQ ID NO: 165500 - protein, 9 aa, Homo Sapiens
SLAEPNGLA

SEQ ID NO: 165501 - protein, 9 aa, Homo Sapiens
EFLYKSKKT

SEQ ID NO: 165502 - protein, 9 aa, Homo Sapiens
LLALWEADS

SEQ ID NO: 165503 - protein, 9 aa, Homo Sapiens
FDLLWGVGA

SEQ ID NO: 165504 - protein, 9 aa, Homo Sapiens
KGGPTPRRP

SEQ ID NO: 165505 - protein, 9 aa, Homo Sapiens
QAETLVTLG

SEQ ID NO: 165506 - protein, 9 aa, Homo Sapiens
RRPRALGAG

SEQ ID NO: 165507 - protein, 9 aa, Homo Sapiens
DDDEKRWIV

SEQ ID NO: 165508 - protein, 9 aa, Homo Sapiens
AIVVKFFLQ

SEQ ID NO: 165509 - protein, 9 aa, Homo Sapiens
SHCLLTAHL

SEQ ID NO: 165510 - protein, 9 aa, Homo Sapiens
EAYGCSHIP

SEQ ID NO: 165511 - protein, 9 aa, Homo Sapiens
MWVTDERVC

SEQ ID NO: 165512 - protein, 9 aa, Homo Sapiens
YVHFNHSLW

SEQ ID NO: 165513 - protein, 9 aa, Homo Sapiens
VPIILWLGL

SEQ ID NO: 165514 - protein, 9 aa, Homo Sapiens
QPETPAHVD

SEQ ID NO: 165515 - protein, 9 aa, Homo Sapiens
QARCEEVAF

SEQ ID NO: 165516 - protein, 9 aa, Homo Sapiens
FLVAAALCI

SEQ ID NO: 165517 - protein, 9 aa, Homo Sapiens
PDPRRRPSY

SEQ ID NO: 165518 - protein, 9 aa, Homo Sapiens
KLSGFQGTS

SEQ ID NO: 165519 - protein, 9 aa, Homo Sapiens
FECFFLWES

SEQ ID NO: 165520 - protein, 9 aa, Homo Sapiens
KGPLGPVDA

SEQ ID NO: 165521 - protein, 9 aa, Homo Sapiens
GRGRVGKLG

SEQ ID NO: 165522 - protein, 9 aa, Homo Sapiens
RRPPQEHFC

SEQ ID NO: 165523 - protein, 9 aa, Homo Sapiens
GPPPAPESG

SEQ ID NO: 165524 - protein, 9 aa, Homo Sapiens
RATRHGPYP

SEQ ID NO: 165525 - protein, 9 aa, Homo Sapiens
FNWCFLFPF

SEQ ID NO: 165526 - protein, 9 aa, Homo Sapiens
LVAGVGLAA

SEQ ID NO: 165527 - protein, 9 aa, Homo Sapiens
PIREVLAKQ

SEQ ID NO: 165528 - protein, 9 aa, Homo Sapiens
ADTGVREDE

SEQ ID NO: 165529 - protein, 9 aa, Homo Sapiens
TVVHELGHT

SEQ ID NO: 165530 - protein, 9 aa, Homo Sapiens
KKLEKLQVE

SEQ ID NO: 165531 - protein, 9 aa, Homo Sapiens
QAFSQTPLG

SEQ ID NO: 165532 - protein, 9 aa, Homo Sapiens
ITSVTLVAS

SEQ ID NO: 165533 - protein, 9 aa, Homo Sapiens
GGGPPGALR

SEQ ID NO: 165534 - protein, 9 aa, Homo Sapiens
ENIVITEDF

SEQ ID NO: 165535 - protein, 9 aa, Homo Sapiens
HSTSANGIS

SEQ ID NO: 165536 - protein, 9 aa, Homo Sapiens
ALELRDVEL

SEQ ID NO: 165537 - protein, 9 aa, Homo Sapiens
KSRPCTWSC

SEQ ID NO: 165538 - protein, 9 aa, Homo Sapiens
IQALQWEVA

SEQ ID NO: 165539 - protein, 9 aa, Homo Sapiens
KLRLAVLVN

SEQ ID NO: 165540 - protein, 9 aa, Homo Sapiens
PPGGKPERS

SEQ ID NO: 165541 - protein, 9 aa, Homo Sapiens
DNPTPSISW

SEQ ID NO: 165542 - protein, 9 aa, Homo Sapiens
LLKRGEQLL

SEQ ID NO: 165543 - protein, 9 aa, Homo Sapiens
ESREAISTL

SEQ ID NO: 165544 - protein, 9 aa, Homo Sapiens
SAISPKMLV

SEQ ID NO: 165545 - protein, 9 aa, Homo Sapiens
FFEHDGHPY

SEQ ID NO: 165546 - protein, 9 aa, Homo Sapiens
EPNGSPTSD

SEQ ID NO: 165547 - protein, 9 aa, Homo Sapiens
WLMFNNARL

SEQ ID NO: 165548 - protein, 9 aa, Homo Sapiens
MGGKTPWLN

SEQ ID NO: 165549 - protein, 9 aa, Homo Sapiens
GIEVSKKTH

SEQ ID NO: 165550 - protein, 9 aa, Homo Sapiens
TPIITFPEF

SEQ ID NO: 165551 - protein, 9 aa, Homo Sapiens
FLIPLTVFD

SEQ ID NO: 165552 - protein, 9 aa, Homo Sapiens
DLKKNGALP

SEQ ID NO: 165553 - protein, 9 aa, Homo Sapiens
LACLNGGYE

SEQ ID NO: 165554 - protein, 9 aa, Homo Sapiens
MAPPTPPSV

SEQ ID NO: 165555 - protein, 9 aa, Homo Sapiens
KAVQVLVVL

SEQ ID NO: 165556 - protein, 9 aa, Homo Sapiens
WLAICWRSP

SEQ ID NO: 165557 - protein, 9 aa, Homo Sapiens
VLANVPIIL

SEQ ID NO: 165558 - protein, 9 aa, Homo Sapiens
KDGNGEDLL

SEQ ID NO: 165559 - protein, 9 aa, Homo Sapiens
GPMPPHGMC

SEQ ID NO: 165560 - protein, 9 aa, Homo Sapiens
QALQASLGK

SEQ ID NO: 165561 - protein, 9 aa, Homo Sapiens
AFLFHHHHR

SEQ ID NO: 165562 - protein, 9 aa, Homo Sapiens
PRPWRRTGR

SEQ ID NO: 165563 - protein, 9 aa, Homo Sapiens
GTESTMWSC

SEQ ID NO: 165564 - protein, 9 aa, Homo Sapiens
SPRDHPPSP

SEQ ID NO: 165565 - protein, 9 aa, Homo Sapiens
RTIVQDQGC

SEQ ID NO: 165566 - protein, 9 aa, Homo Sapiens
PPSSSSSDI

SEQ ID NO: 165567 - protein, 9 aa, Homo Sapiens
SQKRTISQS

SEQ ID NO: 165568 - protein, 9 aa, Homo Sapiens
DTTHPTCIL

SEQ ID NO: 165569 - protein, 9 aa, Homo Sapiens
SCLRSLRTI

SEQ ID NO: 165570 - protein, 9 aa, Homo Sapiens
GIPIRKYIC

SEQ ID NO: 165571 - protein, 9 aa, Homo Sapiens
RDTPPEARG

SEQ ID NO: 165572 - protein, 9 aa, Homo Sapiens
GSGLQGCLH

SEQ ID NO: 165573 - protein, 9 aa, Homo Sapiens
CYCDAAHCA

SEQ ID NO: 165574 - protein, 9 aa, Homo Sapiens
SLVNAFADQ

SEQ ID NO: 165575 - protein, 9 aa, Homo Sapiens
KLLSESNKR

SEQ ID NO: 165576 - protein, 9 aa, Homo Sapiens
EGDTVSLQF

SEQ ID NO: 165577 - protein, 9 aa, Homo Sapiens
AGAARGELR

SEQ ID NO: 165578 - protein, 9 aa, Homo Sapiens
ISAFSETET

SEQ ID NO: 165579 - protein, 9 aa, Homo Sapiens
LDMFHQGLD

SEQ ID NO: 165580 - protein, 9 aa, Homo Sapiens
SAHMKLNWA

SEQ ID NO: 165581 - protein, 9 aa, Homo Sapiens
VLALSGSNI

SEQ ID NO: 165582 - protein, 9 aa, Homo Sapiens
FLYRFDLLW

SEQ ID NO: 165583 - protein, 9 aa, Homo Sapiens
CITECVRTA

SEQ ID NO: 165584 - protein, 9 aa, Homo Sapiens
TALSRVVLV

SEQ ID NO: 165585 - protein, 9 aa, Homo Sapiens
RAYAAVPRG

SEQ ID NO: 165586 - protein, 9 aa, Homo Sapiens
CVRITSTGT

SEQ ID NO: 165587 - protein, 9 aa, Homo Sapiens
SSLNISGAT

SEQ ID NO: 165588 - protein, 9 aa, Homo Sapiens
DSSRSEKIE

SEQ ID NO: 165589 - protein, 9 aa, Homo Sapiens
HPPSPTSLT

SEQ ID NO: 165590 - protein, 9 aa, Homo Sapiens
RVGGLGCGV

SEQ ID NO: 165591 - protein, 9 aa, Homo Sapiens
QEVKGRGQS

SEQ ID NO: 165592 - protein, 9 aa, Homo Sapiens
GMLENYGNL

SEQ ID NO: 165593 - protein, 9 aa, Homo Sapiens
STERAAEMV

SEQ ID NO: 165594 - protein, 9 aa, Homo Sapiens
YFRKARDTL

SEQ ID NO: 165595 - protein, 9 aa, Homo Sapiens
ADLEHFFNF

SEQ ID NO: 165596 - protein, 9 aa, Homo Sapiens
RGAMEETVV

SEQ ID NO: 165597 - protein, 9 aa, Homo Sapiens
RGQILFPCL

SEQ ID NO: 165598 - protein, 9 aa, Homo Sapiens
LWSVSSVDE

SEQ ID NO: 165599 - protein, 9 aa, Homo Sapiens
ATVETEVEA

SEQ ID NO: 165600 - protein, 9 aa, Homo Sapiens
QGSPPELKW

SEQ ID NO: 165601 - protein, 9 aa, Homo Sapiens
VNALRQPLY

SEQ ID NO: 165602 - protein, 9 aa, Homo Sapiens
VNAARAGME

SEQ ID NO: 165603 - protein, 9 aa, Homo Sapiens
VCSCREGLG

SEQ ID NO: 165604 - protein, 9 aa, Homo Sapiens
TVSLQFTYR

SEQ ID NO: 165605 - protein, 9 aa, Homo Sapiens
GEAHGRRHL

SEQ ID NO: 165606 - protein, 9 aa, Homo Sapiens
FPSNGLTSG

SEQ ID NO: 165607 - protein, 9 aa, Homo Sapiens
SDYYFSWLM

SEQ ID NO: 165608 - protein, 9 aa, Homo Sapiens
DWVVSHIGS

SEQ ID NO: 165609 - protein, 9 aa, Homo Sapiens
PHLELPLPS

SEQ ID NO: 165610 - protein, 9 aa, Homo Sapiens
ELHLKMKTL

SEQ ID NO: 165611 - protein, 9 aa, Homo Sapiens
LDGLLYLHQ

SEQ ID NO: 165612 - protein, 9 aa, Homo Sapiens
EVHALYEET

SEQ ID NO: 165613 - protein, 9 aa, Homo Sapiens
QLMHETSQI

SEQ ID NO: 165614 - protein, 9 aa, Homo Sapiens
FLLILCCVV

SEQ ID NO: 165615 - protein, 9 aa, Homo Sapiens
LRLLSLYRP

SEQ ID NO: 165616 - protein, 9 aa, Homo Sapiens
AGLNTIQTY

SEQ ID NO: 165617 - protein, 9 aa, Homo Sapiens
NKSGTYTIY

SEQ ID NO: 165618 - protein, 9 aa, Homo Sapiens
DVSNEHMLT

SEQ ID NO: 165619 - protein, 9 aa, Homo Sapiens
ILHNIDCLL

SEQ ID NO: 165620 - protein, 9 aa, Homo Sapiens
THSAAPSTL

SEQ ID NO: 165621 - protein, 9 aa, Homo Sapiens
QRLTRGSQV

SEQ ID NO: 165622 - protein, 9 aa, Homo Sapiens
FCSLDAHLH

SEQ ID NO: 165623 - protein, 9 aa, Homo Sapiens
RPRPGRTTP

SEQ ID NO: 165624 - protein, 9 aa, Homo Sapiens
RVHHLLALF

SEQ ID NO: 165625 - protein, 9 aa, Homo Sapiens
ARQFAQIGK

SEQ ID NO: 165626 - protein, 9 aa, Homo Sapiens
LARKLRPTQ

SEQ ID NO: 165627 - protein, 9 aa, Homo Sapiens
IVVKFFLQL

SEQ ID NO: 165628 - protein, 9 aa, Homo Sapiens
SHEYIQYCS

SEQ ID NO: 165629 - protein, 9 aa, Homo Sapiens
EQEKIWEQE

SEQ ID NO: 165630 - protein, 9 aa, Homo Sapiens
QKFMLYWAN

SEQ ID NO: 165631 - protein, 9 aa, Homo Sapiens
VSRRARQFA

SEQ ID NO: 165632 - protein, 9 aa, Homo Sapiens
RQKGQHYFG

SEQ ID NO: 165633 - protein, 9 aa, Homo Sapiens
LPGLTHPAH

SEQ ID NO: 165634 - protein, 9 aa, Homo Sapiens
SLWPRWHDT

SEQ ID NO: 165635 - protein, 9 aa, Homo Sapiens
MFARTHSTS

SEQ ID NO: 165636 - protein, 9 aa, Homo Sapiens
ATISRMAQT

SEQ ID NO: 165637 - protein, 9 aa, Homo Sapiens
LPQWWERGP

SEQ ID NO: 165638 - protein, 9 aa, Homo Sapiens
YSTFIEPPQ

SEQ ID NO: 165639 - protein, 9 aa, Homo Sapiens
CLGYVSLKL

SEQ ID NO: 165640 - protein, 9 aa, Homo Sapiens
TETINHQLN

SEQ ID NO: 165641 - protein, 9 aa, Homo Sapiens
MAEEWYERA

SEQ ID NO: 165642 - protein, 9 aa, Homo Sapiens
KSHQVGKEK

SEQ ID NO: 165643 - protein, 9 aa, Homo Sapiens
SQTPLGANH

SEQ ID NO: 165644 - protein, 9 aa, Homo Sapiens
PHSQVSVTQ

SEQ ID NO: 165645 - protein, 9 aa, Homo Sapiens
PLSLVLCLL

SEQ ID NO: 165646 - protein, 9 aa, Homo Sapiens
RWWRKLTLQ

SEQ ID NO: 165647 - protein, 9 aa, Homo Sapiens
LGKTRVGGL

SEQ ID NO: 165648 - protein, 9 aa, Homo Sapiens
RVETPNSSV

SEQ ID NO: 165649 - protein, 9 aa, Homo Sapiens
HHSAHLWQR

SEQ ID NO: 165650 - protein, 9 aa, Homo Sapiens
SRPSSESCS

SEQ ID NO: 165651 - protein, 9 aa, Homo Sapiens
LGWLPPDTR

SEQ ID NO: 165652 - protein, 9 aa, Homo Sapiens
QNYQNCIKE

SEQ ID NO: 165653 - protein, 9 aa, Homo Sapiens
YFSWLMWVT

SEQ ID NO: 165654 - protein, 9 aa, Homo Sapiens
KWYTPECIN

SEQ ID NO: 165655 - protein, 9 aa, Homo Sapiens
LVMDCHHTH

SEQ ID NO: 165656 - protein, 9 aa, Homo Sapiens
EHGQWRLIF

SEQ ID NO: 165657 - protein, 9 aa, Homo Sapiens
LMGLTTFHA

SEQ ID NO: 165658 - protein, 9 aa, Homo Sapiens
ASDRNPRPG

SEQ ID NO: 165659 - protein, 9 aa, Homo Sapiens
VWQLAWIGD

SEQ ID NO: 165660 - protein, 9 aa, Homo Sapiens
GFIHNPHTR

SEQ ID NO: 165661 - protein, 9 aa, Homo Sapiens
YLQQEAPRA

SEQ ID NO: 165662 - protein, 9 aa, Homo Sapiens
PEARGNGPG

SEQ ID NO: 165663 - protein, 9 aa, Homo Sapiens
AKEVGQLAE

SEQ ID NO: 165664 - protein, 9 aa, Homo Sapiens
NNTSAMKEG

SEQ ID NO: 165665 - protein, 9 aa, Homo Sapiens
QGSWEGSSD

SEQ ID NO: 165666 - protein, 9 aa, Homo Sapiens
FRQGLRQLR

SEQ ID NO: 165667 - protein, 9 aa, Homo Sapiens
YPNIWKYTL

SEQ ID NO: 165668 - protein, 9 aa, Homo Sapiens
RSFLVLLLG

SEQ ID NO: 165669 - protein, 9 aa, Homo Sapiens
KTRGQGPSF

SEQ ID NO: 165670 - protein, 9 aa, Homo Sapiens
WASLASSRP

SEQ ID NO: 165671 - protein, 9 aa, Homo Sapiens
EYHDTDIFN

SEQ ID NO: 165672 - protein, 9 aa, Homo Sapiens
PRVPHWGPS

SEQ ID NO: 165673 - protein, 9 aa, Homo Sapiens
YAPLGGQRS

SEQ ID NO: 165674 - protein, 9 aa, Homo Sapiens
RWVNENCHL

SEQ ID NO: 165675 - protein, 9 aa, Homo Sapiens
IDKTDHIDT

SEQ ID NO: 165676 - protein, 9 aa, Homo Sapiens
LGFLVREEV

SEQ ID NO: 165677 - protein, 9 aa, Homo Sapiens
RLPRWPPSC

SEQ ID NO: 165678 - protein, 9 aa, Homo Sapiens
RGQDRVHSC

SEQ ID NO: 165679 - protein, 9 aa, Homo Sapiens
PGTHACATA

SEQ ID NO: 165680 - protein, 9 aa, Homo Sapiens
PSYRPWRGT

SEQ ID NO: 165681 - protein, 9 aa, Homo Sapiens
KKKRERTRI

SEQ ID NO: 165682 - protein, 9 aa, Homo Sapiens
RNMNMFYIQ

SEQ ID NO: 165683 - protein, 9 aa, Homo Sapiens
PASVAPATL

SEQ ID NO: 165684 - protein, 9 aa, Homo Sapiens
WQVPLLPQA

SEQ ID NO: 165685 - protein, 9 aa, Homo Sapiens
PRQHSAPVR

SEQ ID NO: 165686 - protein, 9 aa, Homo Sapiens
LVIPDGGDS

SEQ ID NO: 165687 - protein, 9 aa, Homo Sapiens
SILYAWDAW

SEQ ID NO: 165688 - protein, 9 aa, Homo Sapiens
RPHGPQNGH

SEQ ID NO: 165689 - protein, 9 aa, Homo Sapiens
TVAITEPEN

SEQ ID NO: 165690 - protein, 9 aa, Homo Sapiens
AYVTETLVF

SEQ ID NO: 165691 - protein, 9 aa, Homo Sapiens
ETAPGCSDS

SEQ ID NO: 165692 - protein, 9 aa, Homo Sapiens
LRITTQEND

SEQ ID NO: 165693 - protein, 9 aa, Homo Sapiens
RQVCMLADL

SEQ ID NO: 165694 - protein, 9 aa, Homo Sapiens
IKTWHFSIW

SEQ ID NO: 165695 - protein, 9 aa, Homo Sapiens
GITNHGLVP

SEQ ID NO: 165696 - protein, 9 aa, Homo Sapiens
SHLLLPPFL

SEQ ID NO: 165697 - protein, 9 aa, Homo Sapiens
LFFVLVNLE

SEQ ID NO: 165698 - protein, 9 aa, Homo Sapiens
PPVMVKTDA

SEQ ID NO: 165699 - protein, 9 aa, Homo Sapiens
NFFVTEGNC

SEQ ID NO: 165700 - protein, 9 aa, Homo Sapiens
ERMRMERER

SEQ ID NO: 165701 - protein, 9 aa, Homo Sapiens
TTIDQISIS

SEQ ID NO: 165702 - protein, 9 aa, Homo Sapiens
KQRNDQPEQ

SEQ ID NO: 165703 - protein, 9 aa, Homo Sapiens
MALQDYVVS

SEQ ID NO: 165704 - protein, 9 aa, Homo Sapiens
IILWLGLAA

SEQ ID NO: 165705 - protein, 9 aa, Homo Sapiens
IVIGLGGGF

SEQ ID NO: 165706 - protein, 9 aa, Homo Sapiens
LLPGPLPAS

SEQ ID NO: 165707 - protein, 9 aa, Homo Sapiens
RVTGPAGVG

SEQ ID NO: 165708 - protein, 9 aa, Homo Sapiens
RMQAEIDNI

SEQ ID NO: 165709 - protein, 9 aa, Homo Sapiens
YCSKFDIDI

SEQ ID NO: 165710 - protein, 9 aa, Homo Sapiens
QQPPAAAAA

SEQ ID NO: 165711 - protein, 9 aa, Homo Sapiens
MWMGGKTPW

SEQ ID NO: 165712 - protein, 9 aa, Homo Sapiens
KHSPLSLLA

SEQ ID NO: 165713 - protein, 9 aa, Homo Sapiens
QKGAEVDLV

SEQ ID NO: 165714 - protein, 9 aa, Homo Sapiens
RERHLQWPS

SEQ ID NO: 165715 - protein, 9 aa, Homo Sapiens
TWYLLAVDF

SEQ ID NO: 165716 - protein, 9 aa, Homo Sapiens
QDKKNASSH

SEQ ID NO: 165717 - protein, 9 aa, Homo Sapiens
ARAGMESTA

SEQ ID NO: 165718 - protein, 9 aa, Homo Sapiens
RLVRYMEEK

SEQ ID NO: 165719 - protein, 9 aa, Homo Sapiens
SFSSICRSS

SEQ ID NO: 165720 - protein, 9 aa, Homo Sapiens
IRTCLLTGY

SEQ ID NO: 165721 - protein, 9 aa, Homo Sapiens
ESELERGVR

SEQ ID NO: 165722 - protein, 9 aa, Homo Sapiens
YCALRVTLF

SEQ ID NO: 165723 - protein, 9 aa, Homo Sapiens
ANVAPAPTS

SEQ ID NO: 165724 - protein, 9 aa, Homo Sapiens
HQQPEGRLS

SEQ ID NO: 165725 - protein, 9 aa, Homo Sapiens
IGCPQASAW

SEQ ID NO: 165726 - protein, 9 aa, Homo Sapiens
SLWLSVCSC

SEQ ID NO: 165727 - protein, 9 aa, Homo Sapiens
YPRAIQATL

SEQ ID NO: 165728 - protein, 9 aa, Homo Sapiens
NALHLQSEP

SEQ ID NO: 165729 - protein, 9 aa, Homo Sapiens
RTSQNHSKC

SEQ ID NO: 165730 - protein, 9 aa, Homo Sapiens
IGKEGATIH

SEQ ID NO: 165731 - protein, 9 aa, Homo Sapiens
RAPLNWHMK

SEQ ID NO: 165732 - protein, 9 aa, Homo Sapiens
LGPATVSLL

SEQ ID NO: 165733 - protein, 9 aa, Homo Sapiens
IIDTKNLYL

SEQ ID NO: 165734 - protein, 9 aa, Homo Sapiens
CMFARTHST

SEQ ID NO: 165735 - protein, 9 aa, Homo Sapiens
MPSCHSPRP

SEQ ID NO: 165736 - protein, 9 aa, Homo Sapiens
PLNSQIKIF

SEQ ID NO: 165737 - protein, 9 aa, Homo Sapiens
STAGEYDIL

SEQ ID NO: 165738 - protein, 9 aa, Homo Sapiens
RRPGAPEYN

SEQ ID NO: 165739 - protein, 9 aa, Homo Sapiens
FEKQFKCRS

SEQ ID NO: 165740 - protein, 9 aa, Homo Sapiens
SPQPLRWAA

SEQ ID NO: 165741 - protein, 9 aa, Homo Sapiens
MAEQLRLQA

SEQ ID NO: 165742 - protein, 9 aa, Homo Sapiens
AGAAWATRW

SEQ ID NO: 165743 - protein, 9 aa, Homo Sapiens
RASSPPRHI

SEQ ID NO: 165744 - protein, 9 aa, Homo Sapiens
RQLRTGNLF

SEQ ID NO: 165745 - protein, 9 aa, Homo Sapiens
LCFASCSWC

SEQ ID NO: 165746 - protein, 9 aa, Homo Sapiens
GCPRKQPTQ

SEQ ID NO: 165747 - protein, 9 aa, Homo Sapiens
HTDDQASTR

SEQ ID NO: 165748 - protein, 9 aa, Homo Sapiens
GVLCAYFRP

SEQ ID NO: 165749 - protein, 9 aa, Homo Sapiens
LLSRVRSDV

SEQ ID NO: 165750 - protein, 9 aa, Homo Sapiens
LCTIEPHSF

SEQ ID NO: 165751 - protein, 9 aa, Homo Sapiens
AGRGGTTCP

SEQ ID NO: 165752 - protein, 9 aa, Homo Sapiens
CNMATVYKI

SEQ ID NO: 165753 - protein, 9 aa, Homo Sapiens
KKISECCDF

SEQ ID NO: 165754 - protein, 9 aa, Homo Sapiens
AIILFSRSL

SEQ ID NO: 165755 - protein, 9 aa, Homo Sapiens
KQKNKSTQE

SEQ ID NO: 165756 - protein, 9 aa, Homo Sapiens
DKHEPFWED

SEQ ID NO: 165757 - protein, 9 aa, Homo Sapiens
PGPCASLLS

SEQ ID NO: 165758 - protein, 9 aa, Homo Sapiens
VFLYMWSFC

SEQ ID NO: 165759 - protein, 9 aa, Homo Sapiens
DKEGIPPTS

SEQ ID NO: 165760 - protein, 9 aa, Homo Sapiens
MASPRPRWR

SEQ ID NO: 165761 - protein, 9 aa, Homo Sapiens
FENQSILLL

SEQ ID NO: 165762 - protein, 9 aa, Homo Sapiens
PPHTSINEH

SEQ ID NO: 165763 - protein, 9 aa, Homo Sapiens
RAKLDESIK

SEQ ID NO: 165764 - protein, 9 aa, Homo Sapiens
RMLKYIRLQ

SEQ ID NO: 165765 - protein, 9 aa, Homo Sapiens
SSLCRQPPL

SEQ ID NO: 165766 - protein, 9 aa, Homo Sapiens
STVWPTAWA

SEQ ID NO: 165767 - protein, 9 aa, Homo Sapiens
RSLRISHKT

SEQ ID NO: 165768 - protein, 9 aa, Homo Sapiens
SQAGGHIAA

SEQ ID NO: 165769 - protein, 9 aa, Homo Sapiens
RQVSVYIVA

SEQ ID NO: 165770 - protein, 9 aa, Homo Sapiens
LEHEEVVEH

SEQ ID NO: 165771 - protein, 9 aa, Homo Sapiens
TRHQDRALA

SEQ ID NO: 165772 - protein, 9 aa, Homo Sapiens
KQYGMYRCL

SEQ ID NO: 165773 - protein, 9 aa, Homo Sapiens
SSSGDPPVN

SEQ ID NO: 165774 - protein, 9 aa, Homo Sapiens
GKPPLAEPR

SEQ ID NO: 165775 - protein, 9 aa, Homo Sapiens
YGSLQLVEH

SEQ ID NO: 165776 - protein, 9 aa, Homo Sapiens
PVFQLKKTG

SEQ ID NO: 165777 - protein, 9 aa, Homo Sapiens
TFMIGAILH

SEQ ID NO: 165778 - protein, 9 aa, Homo Sapiens
AAGRVARAA

SEQ ID NO: 165779 - protein, 9 aa, Homo Sapiens
QPQHRAYPQ

SEQ ID NO: 165780 - protein, 9 aa, Homo Sapiens
TLPKSSRMQ

SEQ ID NO: 165781 - protein, 9 aa, Homo Sapiens
VNSSWGTRL

SEQ ID NO: 165782 - protein, 9 aa, Homo Sapiens
CHHTHLSEE

SEQ ID NO: 165783 - protein, 9 aa, Homo Sapiens
CTYERTLMM

SEQ ID NO: 165784 - protein, 9 aa, Homo Sapiens
VGPAQLQAL

SEQ ID NO: 165785 - protein, 9 aa, Homo Sapiens
TPSGKIVYN

SEQ ID NO: 165786 - protein, 9 aa, Homo Sapiens
AMWLSASHF

SEQ ID NO: 165787 - protein, 9 aa, Homo Sapiens
GAICHMYRF

SEQ ID NO: 165788 - protein, 9 aa, Homo Sapiens
FRLIRIFRV

SEQ ID NO: 165789 - protein, 9 aa, Homo Sapiens
GQRVETPNS

SEQ ID NO: 165790 - protein, 9 aa, Homo Sapiens
SPTLGSPGC

SEQ ID NO: 165791 - protein, 9 aa, Homo Sapiens
VCGKKHRPP

SEQ ID NO: 165792 - protein, 9 aa, Homo Sapiens
QMEQERQEQ

SEQ ID NO: 165793 - protein, 9 aa, Homo Sapiens
QARGKKQQK

SEQ ID NO: 165794 - protein, 9 aa, Homo Sapiens
LQVLAGMVI

SEQ ID NO: 165795 - protein, 9 aa, Homo Sapiens
VCAMDSLRP

SEQ ID NO: 165796 - protein, 9 aa, Homo Sapiens
DEPGKCTVC

SEQ ID NO: 165797 - protein, 9 aa, Homo Sapiens
LHCHLSPEK

SEQ ID NO: 165798 - protein, 9 aa, Homo Sapiens
NIYDARIPQ

SEQ ID NO: 165799 - protein, 9 aa, Homo Sapiens
LSGGWRNRL

SEQ ID NO: 165800 - protein, 9 aa, Homo Sapiens
HRLLGPSRW

SEQ ID NO: 165801 - protein, 9 aa, Homo Sapiens
PTCLGHPVL

SEQ ID NO: 165802 - protein, 9 aa, Homo Sapiens
RAISVSHSV

SEQ ID NO: 165803 - protein, 9 aa, Homo Sapiens
QARLPPPTH

SEQ ID NO: 165804 - protein, 9 aa, Homo Sapiens
KGLMERAAW

SEQ ID NO: 165805 - protein, 9 aa, Homo Sapiens
PPSSRTTLP

SEQ ID NO: 165806 - protein, 9 aa, Homo Sapiens
LPARRPRTP

SEQ ID NO: 165807 - protein, 9 aa, Homo Sapiens
TTFHALCVL

SEQ ID NO: 165808 - protein, 9 aa, Homo Sapiens
DPPVNRGFR

SEQ ID NO: 165809 - protein, 9 aa, Homo Sapiens
ASSSPWVQH

SEQ ID NO: 165810 - protein, 9 aa, Homo Sapiens
GNHKETIEE

SEQ ID NO: 165811 - protein, 9 aa, Homo Sapiens
PQAPERPRS

SEQ ID NO: 165812 - protein, 9 aa, Homo Sapiens
SSLTSCLQR

SEQ ID NO: 165813 - protein, 9 aa, Homo Sapiens
LSGIPTRAK

SEQ ID NO: 165814 - protein, 9 aa, Homo Sapiens
EGPAARAKV

SEQ ID NO: 165815 - protein, 9 aa, Homo Sapiens
FQNYYPNIW

SEQ ID NO: 165816 - protein, 9 aa, Homo Sapiens
DEDLTRPSG

SEQ ID NO: 165817 - protein, 9 aa, Homo Sapiens
GWRNRLWHQ

SEQ ID NO: 165818 - protein, 9 aa, Homo Sapiens
LCVAGLSQF

SEQ ID NO: 165819 - protein, 9 aa, Homo Sapiens
MTTISRATW

SEQ ID NO: 165820 - protein, 9 aa, Homo Sapiens
VREEVFGAQ

SEQ ID NO: 165821 - protein, 9 aa, Homo Sapiens
VRVFQYLPS

SEQ ID NO: 165822 - protein, 9 aa, Homo Sapiens
PKRPEQLPQ

SEQ ID NO: 165823 - protein, 9 aa, Homo Sapiens
DTFSGVLCA

SEQ ID NO: 165824 - protein, 9 aa, Homo Sapiens
GGYDGHSRL

SEQ ID NO: 165825 - protein, 9 aa, Homo Sapiens
QTVTHPGIQ

SEQ ID NO: 165826 - protein, 9 aa, Homo Sapiens
RRKLKTINL

SEQ ID NO: 165827 - protein, 9 aa, Homo Sapiens
REDIITIES

SEQ ID NO: 165828 - protein, 9 aa, Homo Sapiens
SPQSLNTEL

SEQ ID NO: 165829 - protein, 9 aa, Homo Sapiens
AQGGVACRQ

SEQ ID NO: 165830 - protein, 9 aa, Homo Sapiens
AATAAPALS

SEQ ID NO: 165831 - protein, 9 aa, Homo Sapiens
MVESCQMDE

SEQ ID NO: 165832 - protein, 9 aa, Homo Sapiens
DKLLSESNK

SEQ ID NO: 165833 - protein, 9 aa, Homo Sapiens
GEAQRCPHC

SEQ ID NO: 165834 - protein, 9 aa, Homo Sapiens
GLHPYQCDS

SEQ ID NO: 165835 - protein, 9 aa, Homo Sapiens
PCLLPTATT

SEQ ID NO: 165836 - protein, 9 aa, Homo Sapiens
IQATLYKSS

SEQ ID NO: 165837 - protein, 9 aa, Homo Sapiens
EQLRTNRNN

SEQ ID NO: 165838 - protein, 9 aa, Homo Sapiens
RHFRQPQWQ

SEQ ID NO: 165839 - protein, 9 aa, Homo Sapiens
MDAPEEEED

SEQ ID NO: 165840 - protein, 9 aa, Homo Sapiens
IKGNIDAVI

SEQ ID NO: 165841 - protein, 9 aa, Homo Sapiens
MKLVGMSYL

SEQ ID NO: 165842 - protein, 9 aa, Homo Sapiens
YEEEELWIS

SEQ ID NO: 165843 - protein, 9 aa, Homo Sapiens
MGQSSAHMK

SEQ ID NO: 165844 - protein, 9 aa, Homo Sapiens
RQPPLPAQT

SEQ ID NO: 165845 - protein, 9 aa, Homo Sapiens
PDLPRRKSS

SEQ ID NO: 165846 - protein, 9 aa, Homo Sapiens
RMSWRRLSH

SEQ ID NO: 165847 - protein, 9 aa, Homo Sapiens
QDGSPSPLS

SEQ ID NO: 165848 - protein, 9 aa, Homo Sapiens
QHPPTGPLL

SEQ ID NO: 165849 - protein, 9 aa, Homo Sapiens
LLFLIITTK

SEQ ID NO: 165850 - protein, 9 aa, Homo Sapiens
LQPLKSGIK

SEQ ID NO: 165851 - protein, 9 aa, Homo Sapiens
VHPQLPCPQ

SEQ ID NO: 165852 - protein, 9 aa, Homo Sapiens
DGVRRVALR

SEQ ID NO: 165853 - protein, 9 aa, Homo Sapiens
LKHSTRGLL

SEQ ID NO: 165854 - protein, 9 aa, Homo Sapiens
YRKLLEGKE

SEQ ID NO: 165855 - protein, 9 aa, Homo Sapiens
PSAHSSASS

SEQ ID NO: 165856 - protein, 9 aa, Homo Sapiens
SLRNLFVPA

SEQ ID NO: 165857 - protein, 9 aa, Homo Sapiens
KEKKIWWIV

SEQ ID NO: 165858 - protein, 9 aa, Homo Sapiens
HVQGAVCDT

SEQ ID NO: 165859 - protein, 9 aa, Homo Sapiens
VCYPERITI

SEQ ID NO: 165860 - protein, 9 aa, Homo Sapiens
HSVLLFIAE

SEQ ID NO: 165861 - protein, 9 aa, Homo Sapiens
SDGGGRRFC

SEQ ID NO: 165862 - protein, 9 aa, Homo Sapiens
KQFTQLNTL

SEQ ID NO: 165863 - protein, 9 aa, Homo Sapiens
TSGEPWDTE

SEQ ID NO: 165864 - protein, 9 aa, Homo Sapiens
PLTKSMWSS

SEQ ID NO: 165865 - protein, 9 aa, Homo Sapiens
HTFKDLHFL

SEQ ID NO: 165866 - protein, 9 aa, Homo Sapiens
ELLRQLRTG

SEQ ID NO: 165867 - protein, 9 aa, Homo Sapiens
LNTQQPLTK

SEQ ID NO: 165868 - protein, 9 aa, Homo Sapiens
CSFGLWFRL

SEQ ID NO: 165869 - protein, 9 aa, Homo Sapiens
PQQLFLLTA

SEQ ID NO: 165870 - protein, 9 aa, Homo Sapiens
FFLASGTVQ

SEQ ID NO: 165871 - protein, 9 aa, Homo Sapiens
PEGQPIRGY

SEQ ID NO: 165872 - protein, 9 aa, Homo Sapiens
VRMKSVGIL

SEQ ID NO: 165873 - protein, 9 aa, Homo Sapiens
AWASLASSR

SEQ ID NO: 165874 - protein, 9 aa, Homo Sapiens
CPAQGNLQS

SEQ ID NO: 165875 - protein, 9 aa, Homo Sapiens
MERERRKEQ

SEQ ID NO: 165876 - protein, 9 aa, Homo Sapiens
LQTIYGAEV

SEQ ID NO: 165877 - protein, 9 aa, Homo Sapiens
RLERAVSHL

SEQ ID NO: 165878 - protein, 9 aa, Homo Sapiens
QAPPKSSAS

SEQ ID NO: 165879 - protein, 9 aa, Homo Sapiens
EGLPKEKTI

SEQ ID NO: 165880 - protein, 9 aa, Homo Sapiens
PEVPRCAMA

SEQ ID NO: 165881 - protein, 9 aa, Homo Sapiens
ILPGAPSLL

SEQ ID NO: 165882 - protein, 9 aa, Homo Sapiens
LSQDAYHRN

SEQ ID NO: 165883 - protein, 9 aa, Homo Sapiens
PPWIECQHH

SEQ ID NO: 165884 - protein, 9 aa, Homo Sapiens
RLGLQQGES

SEQ ID NO: 165885 - protein, 9 aa, Homo Sapiens
SWQKGQPRW

SEQ ID NO: 165886 - protein, 9 aa, Homo Sapiens
QSRPKGPEK

SEQ ID NO: 165887 - protein, 9 aa, Homo Sapiens
VGAPRPVRE

SEQ ID NO: 165888 - protein, 9 aa, Homo Sapiens
IRQCCNAVK

SEQ ID NO: 165889 - protein, 9 aa, Homo Sapiens
AKGEGAERG

SEQ ID NO: 165890 - protein, 9 aa, Homo Sapiens
PCSPLQRSF

SEQ ID NO: 165891 - protein, 9 aa, Homo Sapiens
CLLLLSFRV

SEQ ID NO: 165892 - protein, 9 aa, Homo Sapiens
ALPVEELHV

SEQ ID NO: 165893 - protein, 9 aa, Homo Sapiens
RLWMFLRIL

SEQ ID NO: 165894 - protein, 9 aa, Homo Sapiens
SRPCPWSPG

SEQ ID NO: 165895 - protein, 9 aa, Homo Sapiens
YDVSFGSGA

SEQ ID NO: 165896 - protein, 9 aa, Homo Sapiens
ALIMDEVDD

SEQ ID NO: 165897 - protein, 9 aa, Homo Sapiens
RTKTFRLKL

SEQ ID NO: 165898 - protein, 9 aa, Homo Sapiens
ILEKLEKKR

SEQ ID NO: 165899 - protein, 9 aa, Homo Sapiens
QSCILSTKA

SEQ ID NO: 165900 - protein, 9 aa, Homo Sapiens
VSSRRNVIC

SEQ ID NO: 165901 - protein, 9 aa, Homo Sapiens
IQALGTQVM

SEQ ID NO: 165902 - protein, 9 aa, Homo Sapiens
SKSQKTCPQ

SEQ ID NO: 165903 - protein, 9 aa, Homo Sapiens
KCQAQQERD

SEQ ID NO: 165904 - protein, 9 aa, Homo Sapiens
HKLREHSEN

SEQ ID NO: 165905 - protein, 9 aa, Homo Sapiens
FRKARDTLY

SEQ ID NO: 165906 - protein, 9 aa, Homo Sapiens
QGAEEALGG

SEQ ID NO: 165907 - protein, 9 aa, Homo Sapiens
IQSSPLQQE

SEQ ID NO: 165908 - protein, 9 aa, Homo Sapiens
DSQGPAARW

SEQ ID NO: 165909 - protein, 9 aa, Homo Sapiens
REGWSLIDY

SEQ ID NO: 165910 - protein, 9 aa, Homo Sapiens
GQCQACFSQ

SEQ ID NO: 165911 - protein, 9 aa, Homo Sapiens
MAALFLTTT

SEQ ID NO: 165912 - protein, 9 aa, Homo Sapiens
NRIGSDFSL

SEQ ID NO: 165913 - protein, 9 aa, Homo Sapiens
PTLTPAQLP

SEQ ID NO: 165914 - protein, 9 aa, Homo Sapiens
YMETPVKKN

SEQ ID NO: 165915 - protein, 9 aa, Homo Sapiens
YGATTVVCV

SEQ ID NO: 165916 - protein, 9 aa, Homo Sapiens
NGEDLLEEF

SEQ ID NO: 165917 - protein, 9 aa, Homo Sapiens
DTPWTASSS

SEQ ID NO: 165918 - protein, 9 aa, Homo Sapiens
PQQHRGPVR

SEQ ID NO: 165919 - protein, 9 aa, Homo Sapiens
VDSMLAASS

SEQ ID NO: 165920 - protein, 9 aa, Homo Sapiens
TRIKKWLTF

SEQ ID NO: 165921 - protein, 9 aa, Homo Sapiens
RPLYFQRII

SEQ ID NO: 165922 - protein, 9 aa, Homo Sapiens
PTQTWTRLP

SEQ ID NO: 165923 - protein, 9 aa, Homo Sapiens
PLLSDGNPK

SEQ ID NO: 165924 - protein, 9 aa, Homo Sapiens
PKPSRMLGS

SEQ ID NO: 165925 - protein, 9 aa, Homo Sapiens
GQVVLQDHF

SEQ ID NO: 165926 - protein, 9 aa, Homo Sapiens
SSPRDHPPS

SEQ ID NO: 165927 - protein, 9 aa, Homo Sapiens
IAEAEDRYK

SEQ ID NO: 165928 - protein, 9 aa, Homo Sapiens
KIVKSKTVA

SEQ ID NO: 165929 - protein, 9 aa, Homo Sapiens
FADLCSEKQ

SEQ ID NO: 165930 - protein, 9 aa, Homo Sapiens
LSSGHILMN

SEQ ID NO: 165931 - protein, 9 aa, Homo Sapiens
TQSRSVIQA

SEQ ID NO: 165932 - protein, 9 aa, Homo Sapiens
QLAWCVDCF

SEQ ID NO: 165933 - protein, 9 aa, Homo Sapiens
VAMEAKWEE

SEQ ID NO: 165934 - protein, 9 aa, Homo Sapiens
APSQVWTAA

SEQ ID NO: 165935 - protein, 9 aa, Homo Sapiens
QVPHEELHV

SEQ ID NO: 165936 - protein, 9 aa, Homo Sapiens
HFCRPPPEH

SEQ ID NO: 165937 - protein, 9 aa, Homo Sapiens
LQCKYMLMR

SEQ ID NO: 165938 - protein, 9 aa, Homo Sapiens
RPGSRMSWR

SEQ ID NO: 165939 - protein, 9 aa, Homo Sapiens
AAAPTLTPA

SEQ ID NO: 165940 - protein, 9 aa, Homo Sapiens
LLVRRDSIF

SEQ ID NO: 165941 - protein, 9 aa, Homo Sapiens
DGVVTISCV

SEQ ID NO: 165942 - protein, 9 aa, Homo Sapiens
PAMEAPRGT

SEQ ID NO: 165943 - protein, 9 aa, Homo Sapiens
FLVQWELLD

SEQ ID NO: 165944 - protein, 9 aa, Homo Sapiens
QPPQTALGH

SEQ ID NO: 165945 - protein, 9 aa, Homo Sapiens
QKAALWRET

SEQ ID NO: 165946 - protein, 9 aa, Homo Sapiens
CLHPQSRGL

SEQ ID NO: 165947 - protein, 9 aa, Homo Sapiens
DAVTLRYGH

SEQ ID NO: 165948 - protein, 9 aa, Homo Sapiens
LGHLKQLLS

SEQ ID NO: 165949 - protein, 9 aa, Homo Sapiens
RRAFKENRE

SEQ ID NO: 165950 - protein, 9 aa, Homo Sapiens
GSCEACTRT

SEQ ID NO: 165951 - protein, 9 aa, Homo Sapiens
WLEMVESCQ

SEQ ID NO: 165952 - protein, 9 aa, Homo Sapiens
VGGLGCGVC

SEQ ID NO: 165953 - protein, 9 aa, Homo Sapiens
PKSYRKSPR

SEQ ID NO: 165954 - protein, 9 aa, Homo Sapiens
PSQVWTAAT

SEQ ID NO: 165955 - protein, 9 aa, Homo Sapiens
LSAGNFPEA

SEQ ID NO: 165956 - protein, 9 aa, Homo Sapiens
FFYFLWILW

SEQ ID NO: 165957 - protein, 9 aa, Homo Sapiens
VTADNGDDG

SEQ ID NO: 165958 - protein, 9 aa, Homo Sapiens
TLSPKPSRM

SEQ ID NO: 165959 - protein, 9 aa, Homo Sapiens
EVETLTPGL

SEQ ID NO: 165960 - protein, 9 aa, Homo Sapiens
KYVGQNIRQ

SEQ ID NO: 165961 - protein, 9 aa, Homo Sapiens
ADKGNHKET

SEQ ID NO: 165962 - protein, 9 aa, Homo Sapiens
HNSRGFGMA

SEQ ID NO: 165963 - protein, 9 aa, Homo Sapiens
GTNLHLFYD

SEQ ID NO: 165964 - protein, 9 aa, Homo Sapiens
APPAWSALR

SEQ ID NO: 165965 - protein, 9 aa, Homo Sapiens
MVSAPPFLG

SEQ ID NO: 165966 - protein, 9 aa, Homo Sapiens
RNRLWHQHQ

SEQ ID NO: 165967 - protein, 9 aa, Homo Sapiens
LTSCLQRLI

SEQ ID NO: 165968 - protein, 9 aa, Homo Sapiens
RPQAPPKSS

SEQ ID NO: 165969 - protein, 9 aa, Homo Sapiens
GDKPLSDPT

SEQ ID NO: 165970 - protein, 9 aa, Homo Sapiens
RGGLPVDDA

SEQ ID NO: 165971 - protein, 9 aa, Homo Sapiens
HCLHPQSRG

SEQ ID NO: 165972 - protein, 9 aa, Homo Sapiens
CLSFKRCGN

SEQ ID NO: 165973 - protein, 9 aa, Homo Sapiens
EVHQKKSQQ

SEQ ID NO: 165974 - protein, 9 aa, Homo Sapiens
RNYSHYFRK

SEQ ID NO: 165975 - protein, 9 aa, Homo Sapiens
GSIGQSPTD

SEQ ID NO: 165976 - protein, 9 aa, Homo Sapiens
SRTSYNKIV

SEQ ID NO: 165977 - protein, 9 aa, Homo Sapiens
INTLDSEIK

SEQ ID NO: 165978 - protein, 9 aa, Homo Sapiens
PYFERKLLF

SEQ ID NO: 165979 - protein, 9 aa, Homo Sapiens
KILFHYPHF

SEQ ID NO: 165980 - protein, 9 aa, Homo Sapiens
RMASVNAAR

SEQ ID NO: 165981 - protein, 9 aa, Homo Sapiens
TVILGCMVE

SEQ ID NO: 165982 - protein, 9 aa, Homo Sapiens
CCMRCPSRL

SEQ ID NO: 165983 - protein, 9 aa, Homo Sapiens
PRHGHPGSH

SEQ ID NO: 165984 - protein, 9 aa, Homo Sapiens
SGSMHTKLY

SEQ ID NO: 165985 - protein, 9 aa, Homo Sapiens
CQIMVMMWM

SEQ ID NO: 165986 - protein, 9 aa, Homo Sapiens
KARRSSWQK

SEQ ID NO: 165987 - protein, 9 aa, Homo Sapiens
TETAPGCSD

SEQ ID NO: 165988 - protein, 9 aa, Homo Sapiens
RQARAQDRW

SEQ ID NO: 165989 - protein, 9 aa, Homo Sapiens
PGGKPERSP

SEQ ID NO: 165990 - protein, 9 aa, Homo Sapiens
WIVFSVKEK

SEQ ID NO: 165991 - protein, 9 aa, Homo Sapiens
MAPSCCRWG

SEQ ID NO: 165992 - protein, 9 aa, Homo Sapiens
LGEKHSPLS

SEQ ID NO: 165993 - protein, 9 aa, Homo Sapiens
ALCFASCSW

SEQ ID NO: 165994 - protein, 9 aa, Homo Sapiens
NGPPTWPTQ

SEQ ID NO: 165995 - protein, 9 aa, Homo Sapiens
VACCHSSLC

SEQ ID NO: 165996 - protein, 9 aa, Homo Sapiens
RHTYANGVR

SEQ ID NO: 165997 - protein, 9 aa, Homo Sapiens
EEAYGCSHI

SEQ ID NO: 165998 - protein, 9 aa, Homo Sapiens
QPGLYSHLL

SEQ ID NO: 165999 - protein, 9 aa, Homo Sapiens
PMTACSILA

SEQ ID NO: 166000 - protein, 9 aa, Homo Sapiens
KTGQIDKSY

SEQ ID NO: 166001 - protein, 9 aa, Homo Sapiens
LLSFRVFCL

SEQ ID NO: 166002 - protein, 9 aa, Homo Sapiens
AGSDGGGRR

SEQ ID NO: 166003 - protein, 9 aa, Homo Sapiens
GRRGIAITY

SEQ ID NO: 166004 - protein, 9 aa, Homo Sapiens
PSSPKARRS

SEQ ID NO: 166005 - protein, 9 aa, Homo Sapiens
RPFECFFLW

SEQ ID NO: 166006 - protein, 9 aa, Homo Sapiens
SSKTALLKI

SEQ ID NO: 166007 - protein, 9 aa, Homo Sapiens
TTHYKLTST

SEQ ID NO: 166008 - protein, 9 aa, Homo Sapiens
QDATTEEEE

SEQ ID NO: 166009 - protein, 9 aa, Homo Sapiens
DGLYYLAGT

SEQ ID NO: 166010 - protein, 9 aa, Homo Sapiens
SGFQGTSCG

SEQ ID NO: 166011 - protein, 9 aa, Homo Sapiens
NPLPEYLSH

SEQ ID NO: 166012 - protein, 9 aa, Homo Sapiens
PLNQSVSRL

SEQ ID NO: 166013 - protein, 9 aa, Homo Sapiens
AEQMDFHAN

SEQ ID NO: 166014 - protein, 9 aa, Homo Sapiens
KVAPQITIP

SEQ ID NO: 166015 - protein, 9 aa, Homo Sapiens
WSLIDYVFS

SEQ ID NO: 166016 - protein, 9 aa, Homo Sapiens
LRPRSQQPK

SEQ ID NO: 166017 - protein, 9 aa, Homo Sapiens
DVKGDLFVN

SEQ ID NO: 166018 - protein, 9 aa, Homo Sapiens
LAPNGACVP

SEQ ID NO: 166019 - protein, 9 aa, Homo Sapiens
RGLRQRRGF

SEQ ID NO: 166020 - protein, 9 aa, Homo Sapiens
PGTPGIRGP

SEQ ID NO: 166021 - protein, 9 aa, Homo Sapiens
YFMGPGILS

SEQ ID NO: 166022 - protein, 9 aa, Homo Sapiens
PRPGCGAPD

SEQ ID NO: 166023 - protein, 9 aa, Homo Sapiens
TTVITTCTS

SEQ ID NO: 166024 - protein, 9 aa, Homo Sapiens
LTLYLVVVA

SEQ ID NO: 166025 - protein, 9 aa, Homo Sapiens
TDRKDLMLY

SEQ ID NO: 166026 - protein, 9 aa, Homo Sapiens
LVALKVCYP

SEQ ID NO: 166027 - protein, 9 aa, Homo Sapiens
TSPTRWNTA

SEQ ID NO: 166028 - protein, 9 aa, Homo Sapiens
WGWEGCWRA

SEQ ID NO: 166029 - protein, 9 aa, Homo Sapiens
KCFREYHIQ

SEQ ID NO: 166030 - protein, 9 aa, Homo Sapiens
TWTCSLLTG

SEQ ID NO: 166031 - protein, 9 aa, Homo Sapiens
YRCLACHLK

SEQ ID NO: 166032 - protein, 9 aa, Homo Sapiens
RMKLVVQVG

SEQ ID NO: 166033 - protein, 9 aa, Homo Sapiens
AIRGWAARV

SEQ ID NO: 166034 - protein, 9 aa, Homo Sapiens
ARPAGGGPP

SEQ ID NO: 166035 - protein, 9 aa, Homo Sapiens
TLPCRRHCP

SEQ ID NO: 166036 - protein, 9 aa, Homo Sapiens
LLRHPLKSF

SEQ ID NO: 166037 - protein, 9 aa, Homo Sapiens
LQDHFLEKF

SEQ ID NO: 166038 - protein, 9 aa, Homo Sapiens
RALARLPPA

SEQ ID NO: 166039 - protein, 9 aa, Homo Sapiens
RSQHIIPWR

SEQ ID NO: 166040 - protein, 9 aa, Homo Sapiens
CSLNWKMCV

SEQ ID NO: 166041 - protein, 9 aa, Homo Sapiens
RSRPSSESC

SEQ ID NO: 166042 - protein, 9 aa, Homo Sapiens
GKSPVFHFL

SEQ ID NO: 166043 - protein, 9 aa, Homo Sapiens
HEYIQYCSK

SEQ ID NO: 166044 - protein, 9 aa, Homo Sapiens
VTCLLLCRL

SEQ ID NO: 166045 - protein, 9 aa, Homo Sapiens
EARSGGHST

SEQ ID NO: 166046 - protein, 9 aa, Homo Sapiens
CHTKIHHVD

SEQ ID NO: 166047 - protein, 9 aa, Homo Sapiens
VKEADHQNL

SEQ ID NO: 166048 - protein, 9 aa, Homo Sapiens
SLIDYVFSQ

SEQ ID NO: 166049 - protein, 9 aa, Homo Sapiens
ELRDVELEK

SEQ ID NO: 166050 - protein, 9 aa, Homo Sapiens
GLGTPNSAN

SEQ ID NO: 166051 - protein, 9 aa, Homo Sapiens
SPALCFASC

SEQ ID NO: 166052 - protein, 9 aa, Homo Sapiens
LPALVIYQT

SEQ ID NO: 166053 - protein, 9 aa, Homo Sapiens
IHGTSNKRS

SEQ ID NO: 166054 - protein, 9 aa, Homo Sapiens
IVVCLCTIF

SEQ ID NO: 166055 - protein, 9 aa, Homo Sapiens
QRGQQQFSQ

SEQ ID NO: 166056 - protein, 9 aa, Homo Sapiens
GTHCARGGL

SEQ ID NO: 166057 - protein, 9 aa, Homo Sapiens
KAYKCASAL

SEQ ID NO: 166058 - protein, 9 aa, Homo Sapiens
KERLSYHHP

SEQ ID NO: 166059 - protein, 9 aa, Homo Sapiens
VMQLQEDAA

SEQ ID NO: 166060 - protein, 9 aa, Homo Sapiens
LQALPDPHL

SEQ ID NO: 166061 - protein, 9 aa, Homo Sapiens
RNWARRWWP

SEQ ID NO: 166062 - protein, 9 aa, Homo Sapiens
EATTETTSS

SEQ ID NO: 166063 - protein, 9 aa, Homo Sapiens
GGDQSLHGH

SEQ ID NO: 166064 - protein, 9 aa, Homo Sapiens
SAPCCWRLW

SEQ ID NO: 166065 - protein, 9 aa, Homo Sapiens
GPRLGELPL

SEQ ID NO: 166066 - protein, 9 aa, Homo Sapiens
RCHAEGIPI

SEQ ID NO: 166067 - protein, 9 aa, Homo Sapiens
RYADDHFSV

SEQ ID NO: 166068 - protein, 9 aa, Homo Sapiens
AVCTHWRKP

SEQ ID NO: 166069 - protein, 9 aa, Homo Sapiens
LRPASARSP

SEQ ID NO: 166070 - protein, 9 aa, Homo Sapiens
PGPKGPLAL

SEQ ID NO: 166071 - protein, 9 aa, Homo Sapiens
PHGMCGPPP

SEQ ID NO: 166072 - protein, 9 aa, Homo Sapiens
NKKISVLSF

SEQ ID NO: 166073 - protein, 9 aa, Homo Sapiens
SHECTECDK

SEQ ID NO: 166074 - protein, 9 aa, Homo Sapiens
AQGNLQSSP

SEQ ID NO: 166075 - protein, 9 aa, Homo Sapiens
PGAPQPARQ

SEQ ID NO: 166076 - protein, 9 aa, Homo Sapiens
SKEATTETT

SEQ ID NO: 166077 - protein, 9 aa, Homo Sapiens
TRWCWSLWR

SEQ ID NO: 166078 - protein, 9 aa, Homo Sapiens
CCRRRCRPR

SEQ ID NO: 166079 - protein, 9 aa, Homo Sapiens
TLCSFGLWF

SEQ ID NO: 166080 - protein, 9 aa, Homo Sapiens
LLGLVLLAW

SEQ ID NO: 166081 - protein, 9 aa, Homo Sapiens
CLPGLTHPA

SEQ ID NO: 166082 - protein, 9 aa, Homo Sapiens
LYNRELIYP

SEQ ID NO: 166083 - protein, 9 aa, Homo Sapiens
LHIGNALFI

SEQ ID NO: 166084 - protein, 9 aa, Homo Sapiens
MFHQGLDKG

SEQ ID NO: 166085 - protein, 9 aa, Homo Sapiens
RFESPEEVV

SEQ ID NO: 166086 - protein, 9 aa, Homo Sapiens
WSSLNISGA

SEQ ID NO: 166087 - protein, 9 aa, Homo Sapiens
QSSPLQQEA

SEQ ID NO: 166088 - protein, 9 aa, Homo Sapiens
QYMQFSGSM

SEQ ID NO: 166089 - protein, 9 aa, Homo Sapiens
GHVVYQGTF

SEQ ID NO: 166090 - protein, 9 aa, Homo Sapiens
TLSSVIFPL

SEQ ID NO: 166091 - protein, 9 aa, Homo Sapiens
CGPPPLMPP

SEQ ID NO: 166092 - protein, 9 aa, Homo Sapiens
ILKQRNDQP

SEQ ID NO: 166093 - protein, 9 aa, Homo Sapiens
ESHLSPLEP

SEQ ID NO: 166094 - protein, 9 aa, Homo Sapiens
PNAMQASGN

SEQ ID NO: 166095 - protein, 9 aa, Homo Sapiens
VLPLLFLLM

SEQ ID NO: 166096 - protein, 9 aa, Homo Sapiens
CYSSAISPK

SEQ ID NO: 166097 - protein, 9 aa, Homo Sapiens
APGCSDSPG

SEQ ID NO: 166098 - protein, 9 aa, Homo Sapiens
LVEVHQKKS

SEQ ID NO: 166099 - protein, 9 aa, Homo Sapiens
VTTAIPGLI

SEQ ID NO: 166100 - protein, 9 aa, Homo Sapiens
NPKIICQEE

SEQ ID NO: 166101 - protein, 9 aa, Homo Sapiens
IEGVRQMLS

SEQ ID NO: 166102 - protein, 9 aa, Homo Sapiens
ASMTLPAPT

SEQ ID NO: 166103 - protein, 9 aa, Homo Sapiens
PKAPLQLVG

SEQ ID NO: 166104 - protein, 9 aa, Homo Sapiens
ELPPGRAWA

SEQ ID NO: 166105 - protein, 9 aa, Homo Sapiens
CLRSLRTIA

SEQ ID NO: 166106 - protein, 9 aa, Homo Sapiens
QPQQQLQQR

SEQ ID NO: 166107 - protein, 9 aa, Homo Sapiens
CCSLLRGSP

SEQ ID NO: 166108 - protein, 9 aa, Homo Sapiens
APFPCVPCK

SEQ ID NO: 166109 - protein, 9 aa, Homo Sapiens
IIGHDAGGW

SEQ ID NO: 166110 - protein, 9 aa, Homo Sapiens
KKDSRMLKY

SEQ ID NO: 166111 - protein, 9 aa, Homo Sapiens
GDRTRTEPG

SEQ ID NO: 166112 - protein, 9 aa, Homo Sapiens
CTSFMSFGV

SEQ ID NO: 166113 - protein, 9 aa, Homo Sapiens
QVTGTNYFY

SEQ ID NO: 166114 - protein, 9 aa, Homo Sapiens
EGQELQVIS

SEQ ID NO: 166115 - protein, 9 aa, Homo Sapiens
VRRATASKL

SEQ ID NO: 166116 - protein, 9 aa, Homo Sapiens
RVTQALQAS

SEQ ID NO: 166117 - protein, 9 aa, Homo Sapiens
AGASAPLWA

SEQ ID NO: 166118 - protein, 9 aa, Homo Sapiens
PCCPATCEP

SEQ ID NO: 166119 - protein, 9 aa, Homo Sapiens
ARALDTQSR

SEQ ID NO: 166120 - protein, 9 aa, Homo Sapiens
AMAPTLTDA

SEQ ID NO: 166121 - protein, 9 aa, Homo Sapiens
RLTIDSNLS

SEQ ID NO: 166122 - protein, 9 aa, Homo Sapiens
RNCGGDTIQ

SEQ ID NO: 166123 - protein, 9 aa, Homo Sapiens
QRSMNLESL

SEQ ID NO: 166124 - protein, 9 aa, Homo Sapiens
EFAAIPKKE

SEQ ID NO: 166125 - protein, 9 aa, Homo Sapiens
LTHPAHQPL

SEQ ID NO: 166126 - protein, 9 aa, Homo Sapiens
VTLKWPPPY

SEQ ID NO: 166127 - protein, 9 aa, Homo Sapiens
TPLLVFLEL

SEQ ID NO: 166128 - protein, 9 aa, Homo Sapiens
LCSSPLCPS

SEQ ID NO: 166129 - protein, 9 aa, Homo Sapiens
TMTSGPTYG

SEQ ID NO: 166130 - protein, 9 aa, Homo Sapiens
RSSRAPSSR

SEQ ID NO: 166131 - protein, 9 aa, Homo Sapiens
VRAMCEMNG

SEQ ID NO: 166132 - protein, 9 aa, Homo Sapiens
RVVLVCATA

SEQ ID NO: 166133 - protein, 9 aa, Homo Sapiens
NRELAEQTA

SEQ ID NO: 166134 - protein, 9 aa, Homo Sapiens
QRNMIIWST

SEQ ID NO: 166135 - protein, 9 aa, Homo Sapiens
RQFAQIGKV

SEQ ID NO: 166136 - protein, 9 aa, Homo Sapiens
PALMPISTG

SEQ ID NO: 166137 - protein, 9 aa, Homo Sapiens
VTPLAQHRP

SEQ ID NO: 166138 - protein, 9 aa, Homo Sapiens
DATTEEEED

SEQ ID NO: 166139 - protein, 9 aa, Homo Sapiens
AVTTAIPGL

SEQ ID NO: 166140 - protein, 9 aa, Homo Sapiens
TRRRRQRRT

SEQ ID NO: 166141 - protein, 9 aa, Homo Sapiens
RPSCIGKSP

SEQ ID NO: 166142 - protein, 9 aa, Homo Sapiens
GRAWGQMQT

SEQ ID NO: 166143 - protein, 9 aa, Homo Sapiens
GKWVIRKTD

SEQ ID NO: 166144 - protein, 9 aa, Homo Sapiens
LEQMRYEGV

SEQ ID NO: 166145 - protein, 9 aa, Homo Sapiens
PAASAPCWA

SEQ ID NO: 166146 - protein, 9 aa, Homo Sapiens
SREETAVCR

SEQ ID NO: 166147 - protein, 9 aa, Homo Sapiens
PTRILPRAG

SEQ ID NO: 166148 - protein, 9 aa, Homo Sapiens
CPPKYPPQC

SEQ ID NO: 166149 - protein, 9 aa, Homo Sapiens
IGVTSILLL

SEQ ID NO: 166150 - protein, 9 aa, Homo Sapiens
RIIKMIWIL

SEQ ID NO: 166151 - protein, 9 aa, Homo Sapiens
RIAAAPTLT

SEQ ID NO: 166152 - protein, 9 aa, Homo Sapiens
AACLQRMDC

SEQ ID NO: 166153 - protein, 9 aa, Homo Sapiens
SAEGSGDLE

SEQ ID NO: 166154 - protein, 9 aa, Homo Sapiens
LQVGNEVPV

SEQ ID NO: 166155 - protein, 9 aa, Homo Sapiens
VNPRVSMRT

SEQ ID NO: 166156 - protein, 9 aa, Homo Sapiens
PASACTMPP

SEQ ID NO: 166157 - protein, 9 aa, Homo Sapiens
PARTGLLPG

SEQ ID NO: 166158 - protein, 9 aa, Homo Sapiens
LQDFLLSPA

SEQ ID NO: 166159 - protein, 9 aa, Homo Sapiens
TSEPPVLPP

SEQ ID NO: 166160 - protein, 9 aa, Homo Sapiens
EYIQYCSKF

SEQ ID NO: 166161 - protein, 9 aa, Homo Sapiens
HHLNAVLAN

SEQ ID NO: 166162 - protein, 9 aa, Homo Sapiens
CQPHQPVPH

SEQ ID NO: 166163 - protein, 9 aa, Homo Sapiens
SKCITECVR

SEQ ID NO: 166164 - protein, 9 aa, Homo Sapiens
ITNANPLST

SEQ ID NO: 166165 - protein, 9 aa, Homo Sapiens
HRESMEGFW

SEQ ID NO: 166166 - protein, 9 aa, Homo Sapiens
AGIRRSSIS

SEQ ID NO: 166167 - protein, 9 aa, Homo Sapiens
VTGTNYFYL

SEQ ID NO: 166168 - protein, 9 aa, Homo Sapiens
ETHKLTFHE

SEQ ID NO: 166169 - protein, 9 aa, Homo Sapiens
DVGDCCDNC

SEQ ID NO: 166170 - protein, 9 aa, Homo Sapiens
QIEEWKVLP

SEQ ID NO: 166171 - protein, 9 aa, Homo Sapiens
CSFVQPCTC

SEQ ID NO: 166172 - protein, 9 aa, Homo Sapiens
MHRKAKELQ

SEQ ID NO: 166173 - protein, 9 aa, Homo Sapiens
QTKTLNALH

SEQ ID NO: 166174 - protein, 9 aa, Homo Sapiens
WHTPHCQPR

SEQ ID NO: 166175 - protein, 9 aa, Homo Sapiens
ESPWQVMAS

SEQ ID NO: 166176 - protein, 9 aa, Homo Sapiens
HASPASPSM

SEQ ID NO: 166177 - protein, 9 aa, Homo Sapiens
KNPTTLSSV

SEQ ID NO: 166178 - protein, 9 aa, Homo Sapiens
TEPENGYMR

SEQ ID NO: 166179 - protein, 9 aa, Homo Sapiens
ALWKHFVSP

SEQ ID NO: 166180 - protein, 9 aa, Homo Sapiens
CYERGLTWY

SEQ ID NO: 166181 - protein, 9 aa, Homo Sapiens
WRRLSHRGL

SEQ ID NO: 166182 - protein, 9 aa, Homo Sapiens
PGSAAAPTL

SEQ ID NO: 166183 - protein, 9 aa, Homo Sapiens
ARAQAVTLL

SEQ ID NO: 166184 - protein, 9 aa, Homo Sapiens
STPACSCST

SEQ ID NO: 166185 - protein, 9 aa, Homo Sapiens
SSMSTWTPG

SEQ ID NO: 166186 - protein, 9 aa, Homo Sapiens
AFRQSSVLI

SEQ ID NO: 166187 - protein, 9 aa, Homo Sapiens
SSCVPRPPA

SEQ ID NO: 166188 - protein, 9 aa, Homo Sapiens
WGHPVGGAP

SEQ ID NO: 166189 - protein, 9 aa, Homo Sapiens
EPWLMGLTT

SEQ ID NO: 166190 - protein, 9 aa, Homo Sapiens
SQPGLYSHL

SEQ ID NO: 166191 - protein, 9 aa, Homo Sapiens
SRLKCSNPL

SEQ ID NO: 166192 - protein, 9 aa, Homo Sapiens
QAASPAMSC

SEQ ID NO: 166193 - protein, 9 aa, Homo Sapiens
VKTKGMATV

SEQ ID NO: 166194 - protein, 9 aa, Homo Sapiens
LLGGRCNWS

SEQ ID NO: 166195 - protein, 9 aa, Homo Sapiens
LLCLGPTRP

SEQ ID NO: 166196 - protein, 9 aa, Homo Sapiens
CNKAYKCAS

SEQ ID NO: 166197 - protein, 9 aa, Homo Sapiens
LPCVQALMA

SEQ ID NO: 166198 - protein, 9 aa, Homo Sapiens
HLEQLRTNR

SEQ ID NO: 166199 - protein, 9 aa, Homo Sapiens
ASACTMPPL

SEQ ID NO: 166200 - protein, 9 aa, Homo Sapiens
SVPGLPKVA

SEQ ID NO: 166201 - protein, 9 aa, Homo Sapiens
ASLASSRPM

SEQ ID NO: 166202 - protein, 9 aa, Homo Sapiens
GQDGAAVRV

SEQ ID NO: 166203 - protein, 9 aa, Homo Sapiens
EKPLHFPTV

SEQ ID NO: 166204 - protein, 9 aa, Homo Sapiens
GVHPQLPCP

SEQ ID NO: 166205 - protein, 9 aa, Homo Sapiens
ARTPPGGGR

SEQ ID NO: 166206 - protein, 9 aa, Homo Sapiens
GQQLIGKVW

SEQ ID NO: 166207 - protein, 9 aa, Homo Sapiens
SVFLDLCSS

SEQ ID NO: 166208 - protein, 9 aa, Homo Sapiens
NFPEAAGPG

SEQ ID NO: 166209 - protein, 9 aa, Homo Sapiens
ISRPTSRAR

SEQ ID NO: 166210 - protein, 9 aa, Homo Sapiens
VSEFEDSYF

SEQ ID NO: 166211 - protein, 9 aa, Homo Sapiens
ITEELFLLV

SEQ ID NO: 166212 - protein, 9 aa, Homo Sapiens
NNRQVCMLA

SEQ ID NO: 166213 - protein, 9 aa, Homo Sapiens
PRSRPSSES

SEQ ID NO: 166214 - protein, 9 aa, Homo Sapiens
RHRWDWSEV

SEQ ID NO: 166215 - protein, 9 aa, Homo Sapiens
QRTDLLGLH

SEQ ID NO: 166216 - protein, 9 aa, Homo Sapiens
SHIDQFLIA

SEQ ID NO: 166217 - protein, 9 aa, Homo Sapiens
PYPAASAPC

SEQ ID NO: 166218 - protein, 9 aa, Homo Sapiens
SLLFRHKSR

SEQ ID NO: 166219 - protein, 9 aa, Homo Sapiens
CRLMQTDKL

SEQ ID NO: 166220 - protein, 9 aa, Homo Sapiens
SQEEYLDGV

SEQ ID NO: 166221 - protein, 9 aa, Homo Sapiens
STVARPCRG

SEQ ID NO: 166222 - protein, 9 aa, Homo Sapiens
FLLPTTNSV

SEQ ID NO: 166223 - protein, 9 aa, Homo Sapiens
VGTLSPSAV

SEQ ID NO: 166224 - protein, 9 aa, Homo Sapiens
EEMCVETME

SEQ ID NO: 166225 - protein, 9 aa, Homo Sapiens
ARAAEHQGN

SEQ ID NO: 166226 - protein, 9 aa, Homo Sapiens
VITEDFTIK

SEQ ID NO: 166227 - protein, 9 aa, Homo Sapiens
AEEWYERAL

SEQ ID NO: 166228 - protein, 9 aa, Homo Sapiens
LQQVPCSPL

SEQ ID NO: 166229 - protein, 9 aa, Homo Sapiens
PGVTHSVIS

SEQ ID NO: 166230 - protein, 9 aa, Homo Sapiens
AKVAGPGPP

SEQ ID NO: 166231 - protein, 9 aa, Homo Sapiens
DVELEKRLR

SEQ ID NO: 166232 - protein, 9 aa, Homo Sapiens
LSFINSETP

SEQ ID NO: 166233 - protein, 9 aa, Homo Sapiens
CRNAEEAKK

SEQ ID NO: 166234 - protein, 9 aa, Homo Sapiens
AVCRLLLGK

SEQ ID NO: 166235 - protein, 9 aa, Homo Sapiens
HHVPRTRRE

SEQ ID NO: 166236 - protein, 9 aa, Homo Sapiens
KTPNSPPTP

SEQ ID NO: 166237 - protein, 9 aa, Homo Sapiens
NAQGTWGFP

SEQ ID NO: 166238 - protein, 9 aa, Homo Sapiens
LSDLQSILS

SEQ ID NO: 166239 - protein, 9 aa, Homo Sapiens
KRTALWLYP

SEQ ID NO: 166240 - protein, 9 aa, Homo Sapiens
RATVIGGPT

SEQ ID NO: 166241 - protein, 9 aa, Homo Sapiens
VTEGNCSNY

SEQ ID NO: 166242 - protein, 9 aa, Homo Sapiens
HRQRVCGLE

SEQ ID NO: 166243 - protein, 9 aa, Homo Sapiens
ELKKKEKRH

SEQ ID NO: 166244 - protein, 9 aa, Homo Sapiens
RLYVPPPLT

SEQ ID NO: 166245 - protein, 9 aa, Homo Sapiens
SRGTSSPSS

SEQ ID NO: 166246 - protein, 9 aa, Homo Sapiens
VEYFFLSLV

SEQ ID NO: 166247 - protein, 9 aa, Homo Sapiens
LVEVQNILD

SEQ ID NO: 166248 - protein, 9 aa, Homo Sapiens
WTMVCNLAL

SEQ ID NO: 166249 - protein, 9 aa, Homo Sapiens
HNIWLGSGQ

SEQ ID NO: 166250 - protein, 9 aa, Homo Sapiens
AARALDTQS

SEQ ID NO: 166251 - protein, 9 aa, Homo Sapiens
SRLSTTRLS

SEQ ID NO: 166252 - protein, 9 aa, Homo Sapiens
RQMLSNAPR

SEQ ID NO: 166253 - protein, 9 aa, Homo Sapiens
WTAQVKRLA

SEQ ID NO: 166254 - protein, 9 aa, Homo Sapiens
GCNTSDLCV

SEQ ID NO: 166255 - protein, 9 aa, Homo Sapiens
DVPWTKMAG

SEQ ID NO: 166256 - protein, 9 aa, Homo Sapiens
YDLTIRYWD

SEQ ID NO: 166257 - protein, 9 aa, Homo Sapiens
KESREAIST

SEQ ID NO: 166258 - protein, 9 aa, Homo Sapiens
INPTISCPF

SEQ ID NO: 166259 - protein, 9 aa, Homo Sapiens
SYCQGTGMV

SEQ ID NO: 166260 - protein, 9 aa, Homo Sapiens
VAHKRLSYA

SEQ ID NO: 166261 - protein, 9 aa, Homo Sapiens
RMPLMWQAS

SEQ ID NO: 166262 - protein, 9 aa, Homo Sapiens
CVDIILKKC

SEQ ID NO: 166263 - protein, 9 aa, Homo Sapiens
SRPKGPEKQ

SEQ ID NO: 166264 - protein, 9 aa, Homo Sapiens
RAWGQMQTT

SEQ ID NO: 166265 - protein, 9 aa, Homo Sapiens
HRQKGQHYF

SEQ ID NO: 166266 - protein, 9 aa, Homo Sapiens
LYVGVREAL

SEQ ID NO: 166267 - protein, 9 aa, Homo Sapiens
LQHALAQAI

SEQ ID NO: 166268 - protein, 9 aa, Homo Sapiens
WRRTGRGLR

SEQ ID NO: 166269 - protein, 9 aa, Homo Sapiens
LGWLINDQL

SEQ ID NO: 166270 - protein, 9 aa, Homo Sapiens
CRLTIDSNL

SEQ ID NO: 166271 - protein, 9 aa, Homo Sapiens
PLPPGSSWR

SEQ ID NO: 166272 - protein, 9 aa, Homo Sapiens
INDNTPVFD

SEQ ID NO: 166273 - protein, 9 aa, Homo Sapiens
DEKAQDAGI

SEQ ID NO: 166274 - protein, 9 aa, Homo Sapiens
HHPIGIGVQ

SEQ ID NO: 166275 - protein, 9 aa, Homo Sapiens
APAPPTRCV

SEQ ID NO: 166276 - protein, 9 aa, Homo Sapiens
SLKEKPLHF

SEQ ID NO: 166277 - protein, 9 aa, Homo Sapiens
NRGRDIRIK

SEQ ID NO: 166278 - protein, 9 aa, Homo Sapiens
SFLRMPLMW

SEQ ID NO: 166279 - protein, 9 aa, Homo Sapiens
AATPTEQPL

SEQ ID NO: 166280 - protein, 9 aa, Homo Sapiens
GENVGHVII

SEQ ID NO: 166281 - protein, 9 aa, Homo Sapiens
SHRIRSRGL

SEQ ID NO: 166282 - protein, 9 aa, Homo Sapiens
DYSVSLEWV

SEQ ID NO: 166283 - protein, 9 aa, Homo Sapiens
VVHLVEGAV

SEQ ID NO: 166284 - protein, 9 aa, Homo Sapiens
INHQLNMFK

SEQ ID NO: 166285 - protein, 9 aa, Homo Sapiens
KRSSKVMTK

SEQ ID NO: 166286 - protein, 9 aa, Homo Sapiens
AWLLRTPRG

SEQ ID NO: 166287 - protein, 9 aa, Homo Sapiens
QPVPHQQSK

SEQ ID NO: 166288 - protein, 9 aa, Homo Sapiens
REAISTLHF

SEQ ID NO: 166289 - protein, 9 aa, Homo Sapiens
TGYLNLLLN

SEQ ID NO: 166290 - protein, 9 aa, Homo Sapiens
PPHRLLGPS

SEQ ID NO: 166291 - protein, 9 aa, Homo Sapiens
KGLTSAVTP

SEQ ID NO: 166292 - protein, 9 aa, Homo Sapiens
EGGPPRPTV

SEQ ID NO: 166293 - protein, 9 aa, Homo Sapiens
FLNRMNQCA

SEQ ID NO: 166294 - protein, 9 aa, Homo Sapiens
PAPSQARLP

SEQ ID NO: 166295 - protein, 9 aa, Homo Sapiens
ITDLDMANA

SEQ ID NO: 166296 - protein, 9 aa, Homo Sapiens
KKLRLAVLV

SEQ ID NO: 166297 - protein, 9 aa, Homo Sapiens
NIWLGSGQY

SEQ ID NO: 166298 - protein, 9 aa, Homo Sapiens
DAAHCAATG

SEQ ID NO: 166299 - protein, 9 aa, Homo Sapiens
SEPPVLPPK

SEQ ID NO: 166300 - protein, 9 aa, Homo Sapiens
TTPDCQIRA

SEQ ID NO: 166301 - protein, 9 aa, Homo Sapiens
ALLEHTQHG

SEQ ID NO: 166302 - protein, 9 aa, Homo Sapiens
RAGDRTRTE

SEQ ID NO: 166303 - protein, 9 aa, Homo Sapiens
LNQETQTRE

SEQ ID NO: 166304 - protein, 9 aa, Homo Sapiens
RAWAPAPPT

SEQ ID NO: 166305 - protein, 9 aa, Homo Sapiens
MMSVMTPSD

SEQ ID NO: 166306 - protein, 9 aa, Homo Sapiens
ILQCSYNTA

SEQ ID NO: 166307 - protein, 9 aa, Homo Sapiens
QPEGRLSPA

SEQ ID NO: 166308 - protein, 9 aa, Homo Sapiens
LLEAPDGQR

SEQ ID NO: 166309 - protein, 9 aa, Homo Sapiens
SAQVVGAPR

SEQ ID NO: 166310 - protein, 9 aa, Homo Sapiens
VQQVPHEEL

SEQ ID NO: 166311 - protein, 9 aa, Homo Sapiens
LQDMGNTCY

SEQ ID NO: 166312 - protein, 9 aa, Homo Sapiens
TRAKKMQKR

SEQ ID NO: 166313 - protein, 9 aa, Homo Sapiens
VDNSTESEG

SEQ ID NO: 166314 - protein, 9 aa, Homo Sapiens
AEHIRKARG

SEQ ID NO: 166315 - protein, 9 aa, Homo Sapiens
RGPSTPACS

SEQ ID NO: 166316 - protein, 9 aa, Homo Sapiens
LFLIITTKN

SEQ ID NO: 166317 - protein, 9 aa, Homo Sapiens
IKESDTSKI

SEQ ID NO: 166318 - protein, 9 aa, Homo Sapiens
IPLTVFDLS

SEQ ID NO: 166319 - protein, 9 aa, Homo Sapiens
LGVSRADML

SEQ ID NO: 166320 - protein, 9 aa, Homo Sapiens
LNGGYEVEP

SEQ ID NO: 166321 - protein, 9 aa, Homo Sapiens
PLLPLPPLP

SEQ ID NO: 166322 - protein, 9 aa, Homo Sapiens
WPGGTFPRV

SEQ ID NO: 166323 - protein, 9 aa, Homo Sapiens
IVCASLDGE

SEQ ID NO: 166324 - protein, 9 aa, Homo Sapiens
DEDDDEKRW

SEQ ID NO: 166325 - protein, 9 aa, Homo Sapiens
DTLERPRGW

SEQ ID NO: 166326 - protein, 9 aa, Homo Sapiens
QQMYEPDSP

SEQ ID NO: 166327 - protein, 9 aa, Homo Sapiens
CMRCPSRLS

SEQ ID NO: 166328 - protein, 9 aa, Homo Sapiens
AARWSPRPR

SEQ ID NO: 166329 - protein, 9 aa, Homo Sapiens
QSSGPEDNV

SEQ ID NO: 166330 - protein, 9 aa, Homo Sapiens
PEAISSSVD

SEQ ID NO: 166331 - protein, 9 aa, Homo Sapiens
LPRAWQVPL

SEQ ID NO: 166332 - protein, 9 aa, Homo Sapiens
YHDTDIFNT

SEQ ID NO: 166333 - protein, 9 aa, Homo Sapiens
DVEEKTQSR

SEQ ID NO: 166334 - protein, 9 aa, Homo Sapiens
DAILHAQAA

SEQ ID NO: 166335 - protein, 9 aa, Homo Sapiens
EGAVQPGHL

SEQ ID NO: 166336 - protein, 9 aa, Homo Sapiens
GTILLIRGD

SEQ ID NO: 166337 - protein, 9 aa, Homo Sapiens
SHYFRKARD

SEQ ID NO: 166338 - protein, 9 aa, Homo Sapiens
SASRGPSTP

SEQ ID NO: 166339 - protein, 9 aa, Homo Sapiens
WASRGTSSP

SEQ ID NO: 166340 - protein, 9 aa, Homo Sapiens
FVGDSEMFL

SEQ ID NO: 166341 - protein, 9 aa, Homo Sapiens
KVLVIMLSS

SEQ ID NO: 166342 - protein, 9 aa, Homo Sapiens
ATPHGRLPQ

SEQ ID NO: 166343 - protein, 9 aa, Homo Sapiens
TYRKLLEGK

SEQ ID NO: 166344 - protein, 9 aa, Homo Sapiens
KAAPVPGEA

SEQ ID NO: 166345 - protein, 9 aa, Homo Sapiens
GFQGTSCGP

SEQ ID NO: 166346 - protein, 9 aa, Homo Sapiens
CRELLSQGT

SEQ ID NO: 166347 - protein, 9 aa, Homo Sapiens
AETETLAVQ

SEQ ID NO: 166348 - protein, 9 aa, Homo Sapiens
MAFLFHHHH

SEQ ID NO: 166349 - protein, 9 aa, Homo Sapiens
FICTHVYIC

SEQ ID NO: 166350 - protein, 9 aa, Homo Sapiens
TLGAKTGRP

SEQ ID NO: 166351 - protein, 9 aa, Homo Sapiens
LDPPSTATS

SEQ ID NO: 166352 - protein, 9 aa, Homo Sapiens
PYKCDDFDK

SEQ ID NO: 166353 - protein, 9 aa, Homo Sapiens
LPKAPLQLV

SEQ ID NO: 166354 - protein, 9 aa, Homo Sapiens
WQRAVQKLY

SEQ ID NO: 166355 - protein, 9 aa, Homo Sapiens
GALPLTLSP

SEQ ID NO: 166356 - protein, 9 aa, Homo Sapiens
KFSNTPKNV

SEQ ID NO: 166357 - protein, 9 aa, Homo Sapiens
LCLGPTRPL

SEQ ID NO: 166358 - protein, 9 aa, Homo Sapiens
NNPVPRSRH

SEQ ID NO: 166359 - protein, 9 aa, Homo Sapiens
PHCQPRSPG

SEQ ID NO: 166360 - protein, 9 aa, Homo Sapiens
VADINDNTP

SEQ ID NO: 166361 - protein, 9 aa, Homo Sapiens
PLAMPQALH

SEQ ID NO: 166362 - protein, 9 aa, Homo Sapiens
PEVLQDPLD

SEQ ID NO: 166363 - protein, 9 aa, Homo Sapiens
TFHENAKAK

SEQ ID NO: 166364 - protein, 9 aa, Homo Sapiens
SKTALLKIT

SEQ ID NO: 166365 - protein, 9 aa, Homo Sapiens
AVRCPVPVS

SEQ ID NO: 166366 - protein, 9 aa, Homo Sapiens
TVITTCTSV

SEQ ID NO: 166367 - protein, 9 aa, Homo Sapiens
RRVGARSPH

SEQ ID NO: 166368 - protein, 9 aa, Homo Sapiens
EMVIKYVGQ

SEQ ID NO: 166369 - protein, 9 aa, Homo Sapiens
LFSRSLSSS

SEQ ID NO: 166370 - protein, 9 aa, Homo Sapiens
KWVIRKTDL

SEQ ID NO: 166371 - protein, 9 aa, Homo Sapiens
GRPWPPSFS

SEQ ID NO: 166372 - protein, 9 aa, Homo Sapiens
SMRTSSSMS

SEQ ID NO: 166373 - protein, 9 aa, Homo Sapiens
ACTCISMTT

SEQ ID NO: 166374 - protein, 9 aa, Homo Sapiens
LGHPVLTPR

SEQ ID NO: 166375 - protein, 9 aa, Homo Sapiens
MDSLRPVRL

SEQ ID NO: 166376 - protein, 9 aa, Homo Sapiens
VSALPFLHE

SEQ ID NO: 166377 - protein, 9 aa, Homo Sapiens
GPRRAWRAL

SEQ ID NO: 166378 - protein, 9 aa, Homo Sapiens
VLCQLVLPE

SEQ ID NO: 166379 - protein, 9 aa, Homo Sapiens
SASPRSGQW

SEQ ID NO: 166380 - protein, 9 aa, Homo Sapiens
EHNKHLDDI

SEQ ID NO: 166381 - protein, 9 aa, Homo Sapiens
LKKKEKRHD

SEQ ID NO: 166382 - protein, 9 aa, Homo Sapiens
VIYFDFWFQ

SEQ ID NO: 166383 - protein, 9 aa, Homo Sapiens
IEAKGMLNG

SEQ ID NO: 166384 - protein, 9 aa, Homo Sapiens
KTFSLLLLR

SEQ ID NO: 166385 - protein, 9 aa, Homo Sapiens
TPGRPWPPS

SEQ ID NO: 166386 - protein, 9 aa, Homo Sapiens
KGWLLGPDW

SEQ ID NO: 166387 - protein, 9 aa, Homo Sapiens
SVCSCREGL

SEQ ID NO: 166388 - protein, 9 aa, Homo Sapiens
DLDGLLYLH

SEQ ID NO: 166389 - protein, 9 aa, Homo Sapiens
HYRKRCREI

SEQ ID NO: 166390 - protein, 9 aa, Homo Sapiens
PSLRPRSQQ

SEQ ID NO: 166391 - protein, 9 aa, Homo Sapiens
KGANRKQKT

SEQ ID NO: 166392 - protein, 9 aa, Homo Sapiens
SLSHWDAEH

SEQ ID NO: 166393 - protein, 9 aa, Homo Sapiens
AATLTITER

SEQ ID NO: 166394 - protein, 9 aa, Homo Sapiens
AITSMKSPE

SEQ ID NO: 166395 - protein, 9 aa, Homo Sapiens
EFVEKRRVA

SEQ ID NO: 166396 - protein, 9 aa, Homo Sapiens
HQDRSGTRD

SEQ ID NO: 166397 - protein, 9 aa, Homo Sapiens
CRLVGPEKK

SEQ ID NO: 166398 - protein, 9 aa, Homo Sapiens
VFIGCPQAS

SEQ ID NO: 166399 - protein, 9 aa, Homo Sapiens
WKFARKWKK

SEQ ID NO: 166400 - protein, 9 aa, Homo Sapiens
CDKVCSRVS

SEQ ID NO: 166401 - protein, 9 aa, Homo Sapiens
QFQGRDDIL

SEQ ID NO: 166402 - protein, 9 aa, Homo Sapiens
SSHIDQFLI

SEQ ID NO: 166403 - protein, 9 aa, Homo Sapiens
LICLGYVSL

SEQ ID NO: 166404 - protein, 9 aa, Homo Sapiens
DLEHFFNFC

SEQ ID NO: 166405 - protein, 9 aa, Homo Sapiens
KGPLALQAR

SEQ ID NO: 166406 - protein, 9 aa, Homo Sapiens
HPIGIGVQG

SEQ ID NO: 166407 - protein, 9 aa, Homo Sapiens
VPVDMVAEE

SEQ ID NO: 166408 - protein, 9 aa, Homo Sapiens
EQPLELRLL

SEQ ID NO: 166409 - protein, 9 aa, Homo Sapiens
NKRLQLHLK

SEQ ID NO: 166410 - protein, 9 aa, Homo Sapiens
VTCPAQGNL

SEQ ID NO: 166411 - protein, 9 aa, Homo Sapiens
PRAGSRTTC

SEQ ID NO: 166412 - protein, 9 aa, Homo Sapiens
EELFLLVSL

SEQ ID NO: 166413 - protein, 9 aa, Homo Sapiens
ACCHSSLCR

SEQ ID NO: 166414 - protein, 9 aa, Homo Sapiens
IYDTLERPR

SEQ ID NO: 166415 - protein, 9 aa, Homo Sapiens
PQEGVFWTT

SEQ ID NO: 166416 - protein, 9 aa, Homo Sapiens
RLQRRQGPA

SEQ ID NO: 166417 - protein, 9 aa, Homo Sapiens
NCMAATLTI

SEQ ID NO: 166418 - protein, 9 aa, Homo Sapiens
PMRSLGEPW

SEQ ID NO: 166419 - protein, 9 aa, Homo Sapiens
CIIDVSNEH

SEQ ID NO: 166420 - protein, 9 aa, Homo Sapiens
QASAWPSTS

SEQ ID NO: 166421 - protein, 9 aa, Homo Sapiens
EARTKAPPV

SEQ ID NO: 166422 - protein, 9 aa, Homo Sapiens
PLKSGIKMS

SEQ ID NO: 166423 - protein, 9 aa, Homo Sapiens
DSEMFLLTV

SEQ ID NO: 166424 - protein, 9 aa, Homo Sapiens
AAKRMHLEI

SEQ ID NO: 166425 - protein, 9 aa, Homo Sapiens
PEPRSDGTG

SEQ ID NO: 166426 - protein, 9 aa, Homo Sapiens
PPFLLLTVV

SEQ ID NO: 166427 - protein, 9 aa, Homo Sapiens
PHRLLGPSR

SEQ ID NO: 166428 - protein, 9 aa, Homo Sapiens
ASVGSTRCG

SEQ ID NO: 166429 - protein, 9 aa, Homo Sapiens
SGSNISKKV

SEQ ID NO: 166430 - protein, 9 aa, Homo Sapiens
VNQLGHLLH

SEQ ID NO: 166431 - protein, 9 aa, Homo Sapiens
GPMAFLFHH

SEQ ID NO: 166432 - protein, 9 aa, Homo Sapiens
QSLPPATTL

SEQ ID NO: 166433 - protein, 9 aa, Homo Sapiens
HVSPFPEVL

SEQ ID NO: 166434 - protein, 9 aa, Homo Sapiens
AHLLRLWMF

SEQ ID NO: 166435 - protein, 9 aa, Homo Sapiens
RTYQVYNVF

SEQ ID NO: 166436 - protein, 9 aa, Homo Sapiens
GVSEEIEAW

SEQ ID NO: 166437 - protein, 9 aa, Homo Sapiens
DFLWNTVHR

SEQ ID NO: 166438 - protein, 9 aa, Homo Sapiens
CCTATVGPW

SEQ ID NO: 166439 - protein, 9 aa, Homo Sapiens
VTQALQASL

SEQ ID NO: 166440 - protein, 9 aa, Homo Sapiens
DYRHMLMED

SEQ ID NO: 166441 - protein, 9 aa, Homo Sapiens
HRLQRRQGP

SEQ ID NO: 166442 - protein, 9 aa, Homo Sapiens
KLMRAYMQD

SEQ ID NO: 166443 - protein, 9 aa, Homo Sapiens
RAYMPPRSS

SEQ ID NO: 166444 - protein, 9 aa, Homo Sapiens
ESTMWSCTK

SEQ ID NO: 166445 - protein, 9 aa, Homo Sapiens
QQDWNLALG

SEQ ID NO: 166446 - protein, 9 aa, Homo Sapiens
AGWMRRWRR

SEQ ID NO: 166447 - protein, 9 aa, Homo Sapiens
HVHHHLDSN

SEQ ID NO: 166448 - protein, 9 aa, Homo Sapiens
WYAYKQYGM

SEQ ID NO: 166449 - protein, 9 aa, Homo Sapiens
GCLQCAVGW

SEQ ID NO: 166450 - protein, 9 aa, Homo Sapiens
ARVPASWGL

SEQ ID NO: 166451 - protein, 9 aa, Homo Sapiens
LIRNHITEV

SEQ ID NO: 166452 - protein, 9 aa, Homo Sapiens
QEGVFWTTL

SEQ ID NO: 166453 - protein, 9 aa, Homo Sapiens
LLPGRLLQS

SEQ ID NO: 166454 - protein, 9 aa, Homo Sapiens
PAPQGALTP

SEQ ID NO: 166455 - protein, 9 aa, Homo Sapiens
AILAWSHGL

SEQ ID NO: 166456 - protein, 9 aa, Homo Sapiens
GTLGHGHKG

SEQ ID NO: 166457 - protein, 9 aa, Homo Sapiens
EQDARTASL

SEQ ID NO: 166458 - protein, 9 aa, Homo Sapiens
THPQPRSGW

SEQ ID NO: 166459 - protein, 9 aa, Homo Sapiens
LTLAVAPLW

SEQ ID NO: 166460 - protein, 9 aa, Homo Sapiens
PQEHFCRPP

SEQ ID NO: 166461 - protein, 9 aa, Homo Sapiens
DQHFSPFFR

SEQ ID NO: 166462 - protein, 9 aa, Homo Sapiens
HHHHRLPRW

SEQ ID NO: 166463 - protein, 9 aa, Homo Sapiens
GFLVQWELL

SEQ ID NO: 166464 - protein, 9 aa, Homo Sapiens
PPVRSTVCA

SEQ ID NO: 166465 - protein, 9 aa, Homo Sapiens
PPLSSSLRM

SEQ ID NO: 166466 - protein, 9 aa, Homo Sapiens
VLMVFFSSQ

SEQ ID NO: 166467 - protein, 9 aa, Homo Sapiens
DRWRTQRPG

SEQ ID NO: 166468 - protein, 9 aa, Homo Sapiens
EWALQSSAV

SEQ ID NO: 166469 - protein, 9 aa, Homo Sapiens
PPHLELPLP

SEQ ID NO: 166470 - protein, 9 aa, Homo Sapiens
TMLGNTGTI

SEQ ID NO: 166471 - protein, 9 aa, Homo Sapiens
LVGGEVDLK

SEQ ID NO: 166472 - protein, 9 aa, Homo Sapiens
KEKPLHFPT

SEQ ID NO: 166473 - protein, 9 aa, Homo Sapiens
APCCWRLWP

SEQ ID NO: 166474 - protein, 9 aa, Homo Sapiens
ILRQVSLIT

SEQ ID NO: 166475 - protein, 9 aa, Homo Sapiens
QLCTIEPHS

SEQ ID NO: 166476 - protein, 9 aa, Homo Sapiens
EINTVLQYV

SEQ ID NO: 166477 - protein, 9 aa, Homo Sapiens
PERSPKPGP

SEQ ID NO: 166478 - protein, 9 aa, Homo Sapiens
LAVHQVIHT

SEQ ID NO: 166479 - protein, 9 aa, Homo Sapiens
PINIITITK

SEQ ID NO: 166480 - protein, 9 aa, Homo Sapiens
QSSSSAPVV

SEQ ID NO: 166481 - protein, 9 aa, Homo Sapiens
DGNGEDLLE

SEQ ID NO: 166482 - protein, 9 aa, Homo Sapiens
ERAKCQAQQ

SEQ ID NO: 166483 - protein, 9 aa, Homo Sapiens
TMPSGEWAL

SEQ ID NO: 166484 - protein, 9 aa, Homo Sapiens
KYPPQLTKI

SEQ ID NO: 166485 - protein, 9 aa, Homo Sapiens
AIQGDMTQA

SEQ ID NO: 166486 - protein, 9 aa, Homo Sapiens
GTAGGGGSW

SEQ ID NO: 166487 - protein, 9 aa, Homo Sapiens
EGAGETFRG

SEQ ID NO: 166488 - protein, 9 aa, Homo Sapiens
FEGYIDLGH

SEQ ID NO: 166489 - protein, 9 aa, Homo Sapiens
WVCLKTHMR

SEQ ID NO: 166490 - protein, 9 aa, Homo Sapiens
ADGEHSTFE

SEQ ID NO: 166491 - protein, 9 aa, Homo Sapiens
CQEDLSYEE

SEQ ID NO: 166492 - protein, 9 aa, Homo Sapiens
SSHCLLTAH

SEQ ID NO: 166493 - protein, 9 aa, Homo Sapiens
LPTQQLAWP

SEQ ID NO: 166494 - protein, 9 aa, Homo Sapiens
SRLREIISM

SEQ ID NO: 166495 - protein, 9 aa, Homo Sapiens
VHLAPVQCL

SEQ ID NO: 166496 - protein, 9 aa, Homo Sapiens
DNMKDLKKN

SEQ ID NO: 166497 - protein, 9 aa, Homo Sapiens
FQLKANTGA

SEQ ID NO: 166498 - protein, 9 aa, Homo Sapiens
EKLKYIKKI

SEQ ID NO: 166499 - protein, 9 aa, Homo Sapiens
HCARGGLSL

SEQ ID NO: 166500 - protein, 9 aa, Homo Sapiens
EGAGESQED

SEQ ID NO: 166501 - protein, 9 aa, Homo Sapiens
GGLVGLVDC

SEQ ID NO: 166502 - protein, 9 aa, Homo Sapiens
LNDALLRWP

SEQ ID NO: 166503 - protein, 9 aa, Homo Sapiens
GRRHLRVPR

SEQ ID NO: 166504 - protein, 9 aa, Homo Sapiens
CLPDIFIVE

SEQ ID NO: 166505 - protein, 9 aa, Homo Sapiens
TLALVGGEI

SEQ ID NO: 166506 - protein, 9 aa, Homo Sapiens
RVPLGKEGC

SEQ ID NO: 166507 - protein, 9 aa, Homo Sapiens
SLRNCGGDT

SEQ ID NO: 166508 - protein, 9 aa, Homo Sapiens
KKKKPKKKK

SEQ ID NO: 166509 - protein, 9 aa, Homo Sapiens
VAFSVATAC

SEQ ID NO: 166510 - protein, 9 aa, Homo Sapiens
TPPAATAKS

SEQ ID NO: 166511 - protein, 9 aa, Homo Sapiens
ESDTSKIPG

SEQ ID NO: 166512 - protein, 9 aa, Homo Sapiens
NIDPNAMQA

SEQ ID NO: 166513 - protein, 9 aa, Homo Sapiens
SSLDSNSSN

SEQ ID NO: 166514 - protein, 9 aa, Homo Sapiens
SGVDSQGPA

SEQ ID NO: 166515 - protein, 9 aa, Homo Sapiens
KVTIYALGM

SEQ ID NO: 166516 - protein, 9 aa, Homo Sapiens
TWGFPIVYC

SEQ ID NO: 166517 - protein, 9 aa, Homo Sapiens
GETFRGTSA

SEQ ID NO: 166518 - protein, 9 aa, Homo Sapiens
LILQAFSQL

SEQ ID NO: 166519 - protein, 9 aa, Homo Sapiens
LPSSRNNKE

SEQ ID NO: 166520 - protein, 9 aa, Homo Sapiens
AFGSGKCGV

SEQ ID NO: 166521 - protein, 9 aa, Homo Sapiens
VYISVFICT

SEQ ID NO: 166522 - protein, 9 aa, Homo Sapiens
WASRWWSWQ

SEQ ID NO: 166523 - protein, 9 aa, Homo Sapiens
CIFEASRIC

SEQ ID NO: 166524 - protein, 9 aa, Homo Sapiens
MIWILPRVV

SEQ ID NO: 166525 - protein, 9 aa, Homo Sapiens
LLATQSSSS

SEQ ID NO: 166526 - protein, 9 aa, Homo Sapiens
SVEYFFLSL

SEQ ID NO: 166527 - protein, 9 aa, Homo Sapiens
PRPRRSFLR

SEQ ID NO: 166528 - protein, 9 aa, Homo Sapiens
AAHQLRADL

SEQ ID NO: 166529 - protein, 9 aa, Homo Sapiens
REELNQETQ

SEQ ID NO: 166530 - protein, 9 aa, Homo Sapiens
QGKKILFHY

SEQ ID NO: 166531 - protein, 9 aa, Homo Sapiens
LYSKRFHST

SEQ ID NO: 166532 - protein, 9 aa, Homo Sapiens
TILVTGAQL

SEQ ID NO: 166533 - protein, 9 aa, Homo Sapiens
SPAPRACLW

SEQ ID NO: 166534 - protein, 9 aa, Homo Sapiens
SYALSNKNL

SEQ ID NO: 166535 - protein, 9 aa, Homo Sapiens
VGHVGDGNS

SEQ ID NO: 166536 - protein, 9 aa, Homo Sapiens
CSFLEKPPA

SEQ ID NO: 166537 - protein, 9 aa, Homo Sapiens
RLLSLYRPP

SEQ ID NO: 166538 - protein, 9 aa, Homo Sapiens
QTVPTETIH

SEQ ID NO: 166539 - protein, 9 aa, Homo Sapiens
VTLGAKTGR

SEQ ID NO: 166540 - protein, 9 aa, Homo Sapiens
HRPGAQDLP

SEQ ID NO: 166541 - protein, 9 aa, Homo Sapiens
GGTVILGCM

SEQ ID NO: 166542 - protein, 9 aa, Homo Sapiens
ITNHGLVPC

SEQ ID NO: 166543 - protein, 9 aa, Homo Sapiens
ATPALPTQQ

SEQ ID NO: 166544 - protein, 9 aa, Homo Sapiens
FHYPHFWKD

SEQ ID NO: 166545 - protein, 9 aa, Homo Sapiens
SFLLLPPTP

SEQ ID NO: 166546 - protein, 9 aa, Homo Sapiens
SETETQSTG

SEQ ID NO: 166547 - protein, 9 aa, Homo Sapiens
AWKGLWRYP

SEQ ID NO: 166548 - protein, 9 aa, Homo Sapiens
RETSPFITP

SEQ ID NO: 166549 - protein, 9 aa, Homo Sapiens
HLELPLPSQ

SEQ ID NO: 166550 - protein, 9 aa, Homo Sapiens
EETLICIVV

SEQ ID NO: 166551 - protein, 9 aa, Homo Sapiens
QKTRLWSCG

SEQ ID NO: 166552 - protein, 9 aa, Homo Sapiens
KLDESIKEE

SEQ ID NO: 166553 - protein, 9 aa, Homo Sapiens
PQGALTPPH

SEQ ID NO: 166554 - protein, 9 aa, Homo Sapiens
PLVIPDGGD

SEQ ID NO: 166555 - protein, 9 aa, Homo Sapiens
MPSGEWALQ

SEQ ID NO: 166556 - protein, 9 aa, Homo Sapiens
LTVNIRLCW

SEQ ID NO: 166557 - protein, 9 aa, Homo Sapiens
FLQVLKSHI

SEQ ID NO: 166558 - protein, 9 aa, Homo Sapiens
EDDDEKRWI

SEQ ID NO: 166559 - protein, 9 aa, Homo Sapiens
KKNGALPAP

SEQ ID NO: 166560 - protein, 9 aa, Homo Sapiens
SVSSLFLLL

SEQ ID NO: 166561 - protein, 9 aa, Homo Sapiens
RNHITEVGL

SEQ ID NO: 166562 - protein, 9 aa, Homo Sapiens
NTGAWILRL

SEQ ID NO: 166563 - protein, 9 aa, Homo Sapiens
SLLSTLSQP

SEQ ID NO: 166564 - protein, 9 aa, Homo Sapiens
VKRPLPCVQ

SEQ ID NO: 166565 - protein, 9 aa, Homo Sapiens
PVGSVMSCS

SEQ ID NO: 166566 - protein, 9 aa, Homo Sapiens
PCLPAGKWL

SEQ ID NO: 166567 - protein, 9 aa, Homo Sapiens
ARRTLRSSP

SEQ ID NO: 166568 - protein, 9 aa, Homo Sapiens
GDGNSHCIL

SEQ ID NO: 166569 - protein, 9 aa, Homo Sapiens
ESMKECRNW

SEQ ID NO: 166570 - protein, 9 aa, Homo Sapiens
ASMDLKSQR

SEQ ID NO: 166571 - protein, 9 aa, Homo Sapiens
CKCCVIEHT

SEQ ID NO: 166572 - protein, 9 aa, Homo Sapiens
RESMEGFWI

SEQ ID NO: 166573 - protein, 9 aa, Homo Sapiens
YSGPPQGQA

SEQ ID NO: 166574 - protein, 9 aa, Homo Sapiens
GGYEVEPGY

SEQ ID NO: 166575 - protein, 9 aa, Homo Sapiens
GAGWPCPAV

SEQ ID NO: 166576 - protein, 9 aa, Homo Sapiens
AAVPRTVTH

SEQ ID NO: 166577 - protein, 9 aa, Homo Sapiens
LVTLGTLKR

SEQ ID NO: 166578 - protein, 9 aa, Homo Sapiens
LANVPIILW

SEQ ID NO: 166579 - protein, 9 aa, Homo Sapiens
TCPAQGNLQ

SEQ ID NO: 166580 - protein, 9 aa, Homo Sapiens
QPILQLVLP

SEQ ID NO: 166581 - protein, 9 aa, Homo Sapiens
RVEEERDVG

SEQ ID NO: 166582 - protein, 9 aa, Homo Sapiens
LKLKMTRPL

SEQ ID NO: 166583 - protein, 9 aa, Homo Sapiens
MQLQEDAAR

SEQ ID NO: 166584 - protein, 9 aa, Homo Sapiens
EVLKNIYRK

SEQ ID NO: 166585 - protein, 9 aa, Homo Sapiens
GISASTVTK

SEQ ID NO: 166586 - protein, 9 aa, Homo Sapiens
LYNYVYRAS

SEQ ID NO: 166587 - protein, 9 aa, Homo Sapiens
HEWVHSDFH

SEQ ID NO: 166588 - protein, 9 aa, Homo Sapiens
VRPFECFFL

SEQ ID NO: 166589 - protein, 9 aa, Homo Sapiens
VFRCGPASI

SEQ ID NO: 166590 - protein, 9 aa, Homo Sapiens
SSSLKATTI

SEQ ID NO: 166591 - protein, 9 aa, Homo Sapiens
RHKVIAEAE

SEQ ID NO: 166592 - protein, 9 aa, Homo Sapiens
CTQKRKEEN

SEQ ID NO: 166593 - protein, 9 aa, Homo Sapiens
CPPTSCPSW

SEQ ID NO: 166594 - protein, 9 aa, Homo Sapiens
EMNRAIQRM

SEQ ID NO: 166595 - protein, 9 aa, Homo Sapiens
EAKGMLNGE

SEQ ID NO: 166596 - protein, 9 aa, Homo Sapiens
RHLCLRLRL

SEQ ID NO: 166597 - protein, 9 aa, Homo Sapiens
HTQREPLSS

SEQ ID NO: 166598 - protein, 9 aa, Homo Sapiens
PQWAPHSAG

SEQ ID NO: 166599 - protein, 9 aa, Homo Sapiens
SRMQGLGFL

SEQ ID NO: 166600 - protein, 9 aa, Homo Sapiens
PANPQLLCQ

SEQ ID NO: 166601 - protein, 9 aa, Homo Sapiens
VDTSCKDVL

SEQ ID NO: 166602 - protein, 9 aa, Homo Sapiens
NSSWGTRLN

SEQ ID NO: 166603 - protein, 9 aa, Homo Sapiens
PRPPPAELP

SEQ ID NO: 166604 - protein, 9 aa, Homo Sapiens
MLLDPPLIA

SEQ ID NO: 166605 - protein, 9 aa, Homo Sapiens
EQTWKLAIL

SEQ ID NO: 166606 - protein, 9 aa, Homo Sapiens
SRINPESPV

SEQ ID NO: 166607 - protein, 9 aa, Homo Sapiens
AQYLPRNQK

SEQ ID NO: 166608 - protein, 9 aa, Homo Sapiens
QHFSPFFRT

SEQ ID NO: 166609 - protein, 9 aa, Homo Sapiens
VHAQLAESL

SEQ ID NO: 166610 - protein, 9 aa, Homo Sapiens
VWSELPPGR

SEQ ID NO: 166611 - protein, 9 aa, Homo Sapiens
YLNLLLNIP

SEQ ID NO: 166612 - protein, 9 aa, Homo Sapiens
NIVITEDFT

SEQ ID NO: 166613 - protein, 9 aa, Homo Sapiens
NMDKNPTTL

SEQ ID NO: 166614 - protein, 9 aa, Homo Sapiens
ILADIVLAY

SEQ ID NO: 166615 - protein, 9 aa, Homo Sapiens
TMRVHEVEV

SEQ ID NO: 166616 - protein, 9 aa, Homo Sapiens
GASSTLPCM

SEQ ID NO: 166617 - protein, 9 aa, Homo Sapiens
PTATAACPM

SEQ ID NO: 166618 - protein, 9 aa, Homo Sapiens
PWLAICWRS

SEQ ID NO: 166619 - protein, 9 aa, Homo Sapiens
EVPVTGSSP

SEQ ID NO: 166620 - protein, 9 aa, Homo Sapiens
LRADLLQQD

SEQ ID NO: 166621 - protein, 9 aa, Homo Sapiens
RPPLAPLLP

SEQ ID NO: 166622 - protein, 9 aa, Homo Sapiens
EEQLWSVSS

SEQ ID NO: 166623 - protein, 9 aa, Homo Sapiens
ASSSQFSDP

SEQ ID NO: 166624 - protein, 9 aa, Homo Sapiens
DLQHALAQA

SEQ ID NO: 166625 - protein, 9 aa, Homo Sapiens
LALWEADSG

SEQ ID NO: 166626 - protein, 9 aa, Homo Sapiens
SRPQGLVPC

SEQ ID NO: 166627 - protein, 9 aa, Homo Sapiens
GWLKIDSRT

SEQ ID NO: 166628 - protein, 9 aa, Homo Sapiens
FLKTRGQIL

SEQ ID NO: 166629 - protein, 9 aa, Homo Sapiens
QMASMLKGR

SEQ ID NO: 166630 - protein, 9 aa, Homo Sapiens
YVPQQEISV

SEQ ID NO: 166631 - protein, 9 aa, Homo Sapiens
TFYYNRAFT

SEQ ID NO: 166632 - protein, 9 aa, Homo Sapiens
EATQDWNML

SEQ ID NO: 166633 - protein, 9 aa, Homo Sapiens
QKTCPQKNS

SEQ ID NO: 166634 - protein, 9 aa, Homo Sapiens
FVSPRGVAF

SEQ ID NO: 166635 - protein, 9 aa, Homo Sapiens
AKGFLTCRL

SEQ ID NO: 166636 - protein, 9 aa, Homo Sapiens
RLKEEQTWK

SEQ ID NO: 166637 - protein, 9 aa, Homo Sapiens
PAVTTAIPG

SEQ ID NO: 166638 - protein, 9 aa, Homo Sapiens
QFQEAMHKV

SEQ ID NO: 166639 - protein, 9 aa, Homo Sapiens
VHHLLALFR

SEQ ID NO: 166640 - protein, 9 aa, Homo Sapiens
LPRRKSSPT

SEQ ID NO: 166641 - protein, 9 aa, Homo Sapiens
CLLTAHLLR

SEQ ID NO: 166642 - protein, 9 aa, Homo Sapiens
AWASRWWSW

SEQ ID NO: 166643 - protein, 9 aa, Homo Sapiens
KLVSHLSQE

SEQ ID NO: 166644 - protein, 9 aa, Homo Sapiens
MTSPWWSTT

SEQ ID NO: 166645 - protein, 9 aa, Homo Sapiens
HKLNLGRYL

SEQ ID NO: 166646 - protein, 9 aa, Homo Sapiens
QLRADLLQQ

SEQ ID NO: 166647 - protein, 9 aa, Homo Sapiens
ASSTLPCMK

SEQ ID NO: 166648 - protein, 9 aa, Homo Sapiens
PDGGDSEQF

SEQ ID NO: 166649 - protein, 9 aa, Homo Sapiens
EDGTPIITF

SEQ ID NO: 166650 - protein, 9 aa, Homo Sapiens
GEITDDLDV

SEQ ID NO: 166651 - protein, 9 aa, Homo Sapiens
CRVRGARPA

SEQ ID NO: 166652 - protein, 9 aa, Homo Sapiens
SHEARSGGH

SEQ ID NO: 166653 - protein, 9 aa, Homo Sapiens
HNRTRHLPL

SEQ ID NO: 166654 - protein, 9 aa, Homo Sapiens
ILLRMIPTM

SEQ ID NO: 166655 - protein, 9 aa, Homo Sapiens
GVREALFAF

SEQ ID NO: 166656 - protein, 9 aa, Homo Sapiens
ITLLDHQIF

SEQ ID NO: 166657 - protein, 9 aa, Homo Sapiens
HDSRTSYNK

SEQ ID NO: 166658 - protein, 9 aa, Homo Sapiens
TDEETLICI

SEQ ID NO: 166659 - protein, 9 aa, Homo Sapiens
RPYMVFVQF

SEQ ID NO: 166660 - protein, 9 aa, Homo Sapiens
HSTDAHSRG

SEQ ID NO: 166661 - protein, 9 aa, Homo Sapiens
QIMVMMWMG

SEQ ID NO: 166662 - protein, 9 aa, Homo Sapiens
LVLHMSILL

SEQ ID NO: 166663 - protein, 9 aa, Homo Sapiens
RQQKGWLLG

SEQ ID NO: 166664 - protein, 9 aa, Homo Sapiens
SDEDIQFHL

SEQ ID NO: 166665 - protein, 9 aa, Homo Sapiens
WLLFFLGLQ

SEQ ID NO: 166666 - protein, 9 aa, Homo Sapiens
PHQPVPHQQ

SEQ ID NO: 166667 - protein, 9 aa, Homo Sapiens
LPRRSCCSR

SEQ ID NO: 166668 - protein, 9 aa, Homo Sapiens
STVTSLQMP

SEQ ID NO: 166669 - protein, 9 aa, Homo Sapiens
EVGGVPGPG

SEQ ID NO: 166670 - protein, 9 aa, Homo Sapiens
KVKLHTDSQ

SEQ ID NO: 166671 - protein, 9 aa, Homo Sapiens
WDPCMPSCH

SEQ ID NO: 166672 - protein, 9 aa, Homo Sapiens
FVKKRRGCP

SEQ ID NO: 166673 - protein, 9 aa, Homo Sapiens
ALWRETLKK

SEQ ID NO: 166674 - protein, 9 aa, Homo Sapiens
SSLRMTPTC

SEQ ID NO: 166675 - protein, 9 aa, Homo Sapiens
NNFTILTNI

SEQ ID NO: 166676 - protein, 9 aa, Homo Sapiens
PAPPTRCVW

SEQ ID NO: 166677 - protein, 9 aa, Homo Sapiens
ETPVKKNQV

SEQ ID NO: 166678 - protein, 9 aa, Homo Sapiens
PENISSRTR

SEQ ID NO: 166679 - protein, 9 aa, Homo Sapiens
SLSSFLIFF

SEQ ID NO: 166680 - protein, 9 aa, Homo Sapiens
DTQSRPKGP

SEQ ID NO: 166681 - protein, 9 aa, Homo Sapiens
KAPCASTAT

SEQ ID NO: 166682 - protein, 9 aa, Homo Sapiens
SRSEKIEVW

SEQ ID NO: 166683 - protein, 9 aa, Homo Sapiens
HLMEATQDW

SEQ ID NO: 166684 - protein, 9 aa, Homo Sapiens
MPDHIHKKG

SEQ ID NO: 166685 - protein, 9 aa, Homo Sapiens
IPKKSYALS

SEQ ID NO: 166686 - protein, 9 aa, Homo Sapiens
RLIRKAMVK

SEQ ID NO: 166687 - protein, 9 aa, Homo Sapiens
LSNNRISML

SEQ ID NO: 166688 - protein, 9 aa, Homo Sapiens
FRMSSFPKK

SEQ ID NO: 166689 - protein, 9 aa, Homo Sapiens
EEINTVLQY

SEQ ID NO: 166690 - protein, 9 aa, Homo Sapiens
GHQLLVGGE

SEQ ID NO: 166691 - protein, 9 aa, Homo Sapiens
ETQSTGEAS

SEQ ID NO: 166692 - protein, 9 aa, Homo Sapiens
GVRTSEGSR

SEQ ID NO: 166693 - protein, 9 aa, Homo Sapiens
DVSLAFLYG

SEQ ID NO: 166694 - protein, 9 aa, Homo Sapiens
RAAPVLVLA

SEQ ID NO: 166695 - protein, 9 aa, Homo Sapiens
LCTSFMSFG

SEQ ID NO: 166696 - protein, 9 aa, Homo Sapiens
NTLQRHRRI

SEQ ID NO: 166697 - protein, 9 aa, Homo Sapiens
TGSCWTSTV

SEQ ID NO: 166698 - protein, 9 aa, Homo Sapiens
RKLKTINLT

SEQ ID NO: 166699 - protein, 9 aa, Homo Sapiens
PTPRRPSSG

SEQ ID NO: 166700 - protein, 9 aa, Homo Sapiens
QLGHLLHQE

SEQ ID NO: 166701 - protein, 9 aa, Homo Sapiens
KALAVQTLK

SEQ ID NO: 166702 - protein, 9 aa, Homo Sapiens
VGFFFLLPV

SEQ ID NO: 166703 - protein, 9 aa, Homo Sapiens
ERVLLKWTE

SEQ ID NO: 166704 - protein, 9 aa, Homo Sapiens
SASYSPSVS

SEQ ID NO: 166705 - protein, 9 aa, Homo Sapiens
GCWRAVATR

SEQ ID NO: 166706 - protein, 9 aa, Homo Sapiens
VGETGRPGE

SEQ ID NO: 166707 - protein, 9 aa, Homo Sapiens
VEGQGGERV

SEQ ID NO: 166708 - protein, 9 aa, Homo Sapiens
LLTAHLLRL

SEQ ID NO: 166709 - protein, 9 aa, Homo Sapiens
THGVAVVLA

SEQ ID NO: 166710 - protein, 9 aa, Homo Sapiens
TILLDGQWV

SEQ ID NO: 166711 - protein, 9 aa, Homo Sapiens
MQIWGAVEC

SEQ ID NO: 166712 - protein, 9 aa, Homo Sapiens
DLPISRCQS

SEQ ID NO: 166713 - protein, 9 aa, Homo Sapiens
NIDCLLSNS

SEQ ID NO: 166714 - protein, 9 aa, Homo Sapiens
VLQDHFLEK

SEQ ID NO: 166715 - protein, 9 aa, Homo Sapiens
HQPVPHQQS

SEQ ID NO: 166716 - protein, 9 aa, Homo Sapiens
PVSGVGDTP

SEQ ID NO: 166717 - protein, 9 aa, Homo Sapiens
QCRHFRQPQ

SEQ ID NO: 166718 - protein, 9 aa, Homo Sapiens
TVTLCSFGL

SEQ ID NO: 166719 - protein, 9 aa, Homo Sapiens
TPTFNPREC

SEQ ID NO: 166720 - protein, 9 aa, Homo Sapiens
LSPRGKKLV

SEQ ID NO: 166721 - protein, 9 aa, Homo Sapiens
AARGELRPA

SEQ ID NO: 166722 - protein, 9 aa, Homo Sapiens
ALLEKKGRR

SEQ ID NO: 166723 - protein, 9 aa, Homo Sapiens
YLSHGLMVS

SEQ ID NO: 166724 - protein, 9 aa, Homo Sapiens
YQDSDGLYY

SEQ ID NO: 166725 - protein, 9 aa, Homo Sapiens
KRAQWVSVA

SEQ ID NO: 166726 - protein, 9 aa, Homo Sapiens
NMSQKLCLL

SEQ ID NO: 166727 - protein, 9 aa, Homo Sapiens
GSAGARPPA

SEQ ID NO: 166728 - protein, 9 aa, Homo Sapiens
SIYTITPNG

SEQ ID NO: 166729 - protein, 9 aa, Homo Sapiens
YDDFCSLDA

SEQ ID NO: 166730 - protein, 9 aa, Homo Sapiens
EGKDEEITE

SEQ ID NO: 166731 - protein, 9 aa, Homo Sapiens
GGRGEDGTP

SEQ ID NO: 166732 - protein, 9 aa, Homo Sapiens
SYYRNPDED

SEQ ID NO: 166733 - protein, 9 aa, Homo Sapiens
HVVSAGGGL

SEQ ID NO: 166734 - protein, 9 aa, Homo Sapiens
IFLGLSKRT

SEQ ID NO: 166735 - protein, 9 aa, Homo Sapiens
NLIGTFACI

SEQ ID NO: 166736 - protein, 9 aa, Homo Sapiens
QPPAAAAAA

SEQ ID NO: 166737 - protein, 9 aa, Homo Sapiens
RISMLSNQS

SEQ ID NO: 166738 - protein, 9 aa, Homo Sapiens
LAKLLLGFL

SEQ ID NO: 166739 - protein, 9 aa, Homo Sapiens
WPGFAISVP

SEQ ID NO: 166740 - protein, 9 aa, Homo Sapiens
GGSVHLHRF

SEQ ID NO: 166741 - protein, 9 aa, Homo Sapiens
DRVHSCLEK

SEQ ID NO: 166742 - protein, 9 aa, Homo Sapiens
RFSLDREAW

SEQ ID NO: 166743 - protein, 9 aa, Homo Sapiens
KEADHQNLL

SEQ ID NO: 166744 - protein, 9 aa, Homo Sapiens
LHGINLTIS

SEQ ID NO: 166745 - protein, 9 aa, Homo Sapiens
WKKVVTKWK

SEQ ID NO: 166746 - protein, 9 aa, Homo Sapiens
VGTVRRFES

SEQ ID NO: 166747 - protein, 9 aa, Homo Sapiens
QLTPHSQVS

SEQ ID NO: 166748 - protein, 9 aa, Homo Sapiens
PAFEMVMCA

SEQ ID NO: 166749 - protein, 9 aa, Homo Sapiens
GERVAPEQC

SEQ ID NO: 166750 - protein, 9 aa, Homo Sapiens
PCRRHCPRC

SEQ ID NO: 166751 - protein, 9 aa, Homo Sapiens
PLHKTGQID

SEQ ID NO: 166752 - protein, 9 aa, Homo Sapiens
TCRLMQTDK

SEQ ID NO: 166753 - protein, 9 aa, Homo Sapiens
KKLTVPHSL

SEQ ID NO: 166754 - protein, 9 aa, Homo Sapiens
GGVGPYSSL

SEQ ID NO: 166755 - protein, 9 aa, Homo Sapiens
PVDTCIPKL

SEQ ID NO: 166756 - protein, 9 aa, Homo Sapiens
PLAPLLPLP

SEQ ID NO: 166757 - protein, 9 aa, Homo Sapiens
VDMVAEESG

SEQ ID NO: 166758 - protein, 9 aa, Homo Sapiens
TELEEPQLK

SEQ ID NO: 166759 - protein, 9 aa, Homo Sapiens
ERDRKFHED

SEQ ID NO: 166760 - protein, 9 aa, Homo Sapiens
ASLTPGPQS

SEQ ID NO: 166761 - protein, 9 aa, Homo Sapiens
ASGISSIRA

SEQ ID NO: 166762 - protein, 9 aa, Homo Sapiens
PDAFVDPAL

SEQ ID NO: 166763 - protein, 9 aa, Homo Sapiens
PDAHILRCQ

SEQ ID NO: 166764 - protein, 9 aa, Homo Sapiens
LLVINTEDW

SEQ ID NO: 166765 - protein, 9 aa, Homo Sapiens
ATVGPWMAP

SEQ ID NO: 166766 - protein, 9 aa, Homo Sapiens
ESIPKKSYA

SEQ ID NO: 166767 - protein, 9 aa, Homo Sapiens
AKAEMHRKA

SEQ ID NO: 166768 - protein, 9 aa, Homo Sapiens
PTHLFHTDR

SEQ ID NO: 166769 - protein, 9 aa, Homo Sapiens
NRKQKTDRE

SEQ ID NO: 166770 - protein, 9 aa, Homo Sapiens
DGNSHCILL

SEQ ID NO: 166771 - protein, 9 aa, Homo Sapiens
QEESERAKL

SEQ ID NO: 166772 - protein, 9 aa, Homo Sapiens
RSPATMEVL

SEQ ID NO: 166773 - protein, 9 aa, Homo Sapiens
PDEEELYLF

SEQ ID NO: 166774 - protein, 9 aa, Homo Sapiens
GFPLFLRHL

SEQ ID NO: 166775 - protein, 9 aa, Homo Sapiens
WIQTQAITS

SEQ ID NO: 166776 - protein, 9 aa, Homo Sapiens
VGPYSSLDV

SEQ ID NO: 166777 - protein, 9 aa, Homo Sapiens
GGGIGRVGV

SEQ ID NO: 166778 - protein, 9 aa, Homo Sapiens
HFTRRRDQK

SEQ ID NO: 166779 - protein, 9 aa, Homo Sapiens
SVFCWHIHK

SEQ ID NO: 166780 - protein, 9 aa, Homo Sapiens
INSETPSGK

SEQ ID NO: 166781 - protein, 9 aa, Homo Sapiens
TSYNKIVPS

SEQ ID NO: 166782 - protein, 9 aa, Homo Sapiens
RGRGIRQNT

SEQ ID NO: 166783 - protein, 9 aa, Homo Sapiens
PTATTGESP

SEQ ID NO: 166784 - protein, 9 aa, Homo Sapiens
DLSNNRISM

SEQ ID NO: 166785 - protein, 9 aa, Homo Sapiens
PPVACCHSS

SEQ ID NO: 166786 - protein, 9 aa, Homo Sapiens
APPTWLPAR

SEQ ID NO: 166787 - protein, 9 aa, Homo Sapiens
PGLGTPNSA

SEQ ID NO: 166788 - protein, 9 aa, Homo Sapiens
LQRRQGPAP

SEQ ID NO: 166789 - protein, 9 aa, Homo Sapiens
AGWPCPAVP

SEQ ID NO: 166790 - protein, 9 aa, Homo Sapiens
TFRRVLQQV

SEQ ID NO: 166791 - protein, 9 aa, Homo Sapiens
GQCYALLQG

SEQ ID NO: 166792 - protein, 9 aa, Homo Sapiens
LTKSLKEKP

SEQ ID NO: 166793 - protein, 9 aa, Homo Sapiens
QMDFHANLQ

SEQ ID NO: 166794 - protein, 9 aa, Homo Sapiens
TSMKSPEAD

SEQ ID NO: 166795 - protein, 9 aa, Homo Sapiens
QSRGLDSLA

SEQ ID NO: 166796 - protein, 9 aa, Homo Sapiens
KAQDAGIRR

SEQ ID NO: 166797 - protein, 9 aa, Homo Sapiens
TLQRHRRIH

SEQ ID NO: 166798 - protein, 9 aa, Homo Sapiens
MDHISYKSG

SEQ ID NO: 166799 - protein, 9 aa, Homo Sapiens
AAPALSAGN

SEQ ID NO: 166800 - protein, 9 aa, Homo Sapiens
LDGPLLPEP

SEQ ID NO: 166801 - protein, 9 aa, Homo Sapiens
SLIQVGMGA

SEQ ID NO: 166802 - protein, 9 aa, Homo Sapiens
SHLDFSPYW

SEQ ID NO: 166803 - protein, 9 aa, Homo Sapiens
LHFLLILCC

SEQ ID NO: 166804 - protein, 9 aa, Homo Sapiens
WPCRLTIDS

SEQ ID NO: 166805 - protein, 9 aa, Homo Sapiens
YRPPRPPKV

SEQ ID NO: 166806 - protein, 9 aa, Homo Sapiens
DLTPLKLAV

SEQ ID NO: 166807 - protein, 9 aa, Homo Sapiens
LAMPQALHL

SEQ ID NO: 166808 - protein, 9 aa, Homo Sapiens
ARTHSTSAN

SEQ ID NO: 166809 - protein, 9 aa, Homo Sapiens
LTVFDLSLA

SEQ ID NO: 166810 - protein, 9 aa, Homo Sapiens
LARVPASWG

SEQ ID NO: 166811 - protein, 9 aa, Homo Sapiens
LALRSQKQG

SEQ ID NO: 166812 - protein, 9 aa, Homo Sapiens
VLLLGWLIN

SEQ ID NO: 166813 - protein, 9 aa, Homo Sapiens
RRVTQALQA

SEQ ID NO: 166814 - protein, 9 aa, Homo Sapiens
AIIPHELIH

SEQ ID NO: 166815 - protein, 9 aa, Homo Sapiens
YYFSWLMWV

SEQ ID NO: 166816 - protein, 9 aa, Homo Sapiens
LSYEESDSC

SEQ ID NO: 166817 - protein, 9 aa, Homo Sapiens
WRKLTLQCS

SEQ ID NO: 166818 - protein, 9 aa, Homo Sapiens
RKLRPTQKH

SEQ ID NO: 166819 - protein, 9 aa, Homo Sapiens
EQTPRIRLQ

SEQ ID NO: 166820 - protein, 9 aa, Homo Sapiens
GGVPGPGAA

SEQ ID NO: 166821 - protein, 9 aa, Homo Sapiens
LNQSVSRLF

SEQ ID NO: 166822 - protein, 9 aa, Homo Sapiens
SPTWPIPAP

SEQ ID NO: 166823 - protein, 9 aa, Homo Sapiens
GRGEDGTPI

SEQ ID NO: 166824 - protein, 9 aa, Homo Sapiens
LQQAAAVYA

SEQ ID NO: 166825 - protein, 9 aa, Homo Sapiens
RLGPVWPRW

SEQ ID NO: 166826 - protein, 9 aa, Homo Sapiens
ESTERAAEM

SEQ ID NO: 166827 - protein, 9 aa, Homo Sapiens
PKGANRKQK

SEQ ID NO: 166828 - protein, 9 aa, Homo Sapiens
VGDPMNIFF

SEQ ID NO: 166829 - protein, 9 aa, Homo Sapiens
WVNENCHLQ

SEQ ID NO: 166830 - protein, 9 aa, Homo Sapiens
ALGAGASAP

SEQ ID NO: 166831 - protein, 9 aa, Homo Sapiens
LRMNNTEVL

SEQ ID NO: 166832 - protein, 9 aa, Homo Sapiens
SPPLPPGSS

SEQ ID NO: 166833 - protein, 9 aa, Homo Sapiens
VGAGTGDVA

SEQ ID NO: 166834 - protein, 9 aa, Homo Sapiens
SESDIFCMS

SEQ ID NO: 166835 - protein, 9 aa, Homo Sapiens
CSCREGLGW

SEQ ID NO: 166836 - protein, 9 aa, Homo Sapiens
PVLGAGLET

SEQ ID NO: 166837 - protein, 9 aa, Homo Sapiens
SWQQDSFPT

SEQ ID NO: 166838 - protein, 9 aa, Homo Sapiens
PMGWCTQNN

SEQ ID NO: 166839 - protein, 9 aa, Homo Sapiens
GCRRVIIKK

SEQ ID NO: 166840 - protein, 9 aa, Homo Sapiens
WILTKSCRE

SEQ ID NO: 166841 - protein, 9 aa, Homo Sapiens
ETYVQLLVT

SEQ ID NO: 166842 - protein, 9 aa, Homo Sapiens
PTSWTATLP

SEQ ID NO: 166843 - protein, 9 aa, Homo Sapiens
RKPEGRPCD

SEQ ID NO: 166844 - protein, 9 aa, Homo Sapiens
LSEWKKAVR

SEQ ID NO: 166845 - protein, 9 aa, Homo Sapiens
SIISYLNTA

SEQ ID NO: 166846 - protein, 9 aa, Homo Sapiens
DVDHVEGQG

SEQ ID NO: 166847 - protein, 9 aa, Homo Sapiens
KRCREINAR

SEQ ID NO: 166848 - protein, 9 aa, Homo Sapiens
WLAPAALCS

SEQ ID NO: 166849 - protein, 9 aa, Homo Sapiens
QNYYPNIWK

SEQ ID NO: 166850 - protein, 9 aa, Homo Sapiens
AQQYSHYFC

SEQ ID NO: 166851 - protein, 9 aa, Homo Sapiens
PYDDAYYFM

SEQ ID NO: 166852 - protein, 9 aa, Homo Sapiens
ARSPSRRAR

SEQ ID NO: 166853 - protein, 9 aa, Homo Sapiens
WGFPIVYCS

SEQ ID NO: 166854 - protein, 9 aa, Homo Sapiens
TTCPKCSTP

SEQ ID NO: 166855 - protein, 9 aa, Homo Sapiens
CGKGFCHSS

SEQ ID NO: 166856 - protein, 9 aa, Homo Sapiens
NPQLLCQNP

SEQ ID NO: 166857 - protein, 9 aa, Homo Sapiens
NDTIFLNMR

SEQ ID NO: 166858 - protein, 9 aa, Homo Sapiens
LPLLCICVV

SEQ ID NO: 166859 - protein, 9 aa, Homo Sapiens
SLGTEGFLV

SEQ ID NO: 166860 - protein, 9 aa, Homo Sapiens
VDPALAPAP

SEQ ID NO: 166861 - protein, 9 aa, Homo Sapiens
VTSEPPVLP

SEQ ID NO: 166862 - protein, 9 aa, Homo Sapiens
TMWSCTKNS

SEQ ID NO: 166863 - protein, 9 aa, Homo Sapiens
ARGGGDIWD

SEQ ID NO: 166864 - protein, 9 aa, Homo Sapiens
LSLFYHLQT

SEQ ID NO: 166865 - protein, 9 aa, Homo Sapiens
APGTPGIRG

SEQ ID NO: 166866 - protein, 9 aa, Homo Sapiens
PPQLTKISL

SEQ ID NO: 166867 - protein, 9 aa, Homo Sapiens
YTCAQVPAH

SEQ ID NO: 166868 - protein, 9 aa, Homo Sapiens
VKGTLSPKP

SEQ ID NO: 166869 - protein, 9 aa, Homo Sapiens
SLQQKLDEF

SEQ ID NO: 166870 - protein, 9 aa, Homo Sapiens
AHLWQRAVQ

SEQ ID NO: 166871 - protein, 9 aa, Homo Sapiens
PTRCVWQQP

SEQ ID NO: 166872 - protein, 9 aa, Homo Sapiens
SPSHPPRPA

SEQ ID NO: 166873 - protein, 9 aa, Homo Sapiens
LVREEVFGA

SEQ ID NO: 166874 - protein, 9 aa, Homo Sapiens
QLRHADVDT

SEQ ID NO: 166875 - protein, 9 aa, Homo Sapiens
SGHLQQVGT

SEQ ID NO: 166876 - protein, 9 aa, Homo Sapiens
VTSILLLFI

SEQ ID NO: 166877 - protein, 9 aa, Homo Sapiens
HWLLEAPDG

SEQ ID NO: 166878 - protein, 9 aa, Homo Sapiens
MLSNAPRSE

SEQ ID NO: 166879 - protein, 9 aa, Homo Sapiens
MNIFFIYFP

SEQ ID NO: 166880 - protein, 9 aa, Homo Sapiens
QHIIPWRRS

SEQ ID NO: 166881 - protein, 9 aa, Homo Sapiens
FAISVPYFE

SEQ ID NO: 166882 - protein, 9 aa, Homo Sapiens
EGVAAPRPP

SEQ ID NO: 166883 - protein, 9 aa, Homo Sapiens
MNRAIQRMQ

SEQ ID NO: 166884 - protein, 9 aa, Homo Sapiens
EEVATVAAT

SEQ ID NO: 166885 - protein, 9 aa, Homo Sapiens
GMGARPSCI

SEQ ID NO: 166886 - protein, 9 aa, Homo Sapiens
LTPLARVVS

SEQ ID NO: 166887 - protein, 9 aa, Homo Sapiens
SPHLQGPWS

SEQ ID NO: 166888 - protein, 9 aa, Homo Sapiens
SPPGVPSLH

SEQ ID NO: 166889 - protein, 9 aa, Homo Sapiens
GAAGRVARA

SEQ ID NO: 166890 - protein, 9 aa, Homo Sapiens
PGALLPHSF

SEQ ID NO: 166891 - protein, 9 aa, Homo Sapiens
MTAMWLSAS

SEQ ID NO: 166892 - protein, 9 aa, Homo Sapiens
PVPQHPPTG

SEQ ID NO: 166893 - protein, 9 aa, Homo Sapiens
GLLVLLVGV

SEQ ID NO: 166894 - protein, 9 aa, Homo Sapiens
KTWHFSIWQ

SEQ ID NO: 166895 - protein, 9 aa, Homo Sapiens
FSLDHGLKG

SEQ ID NO: 166896 - protein, 9 aa, Homo Sapiens
LHPQWAPHS

SEQ ID NO: 166897 - protein, 9 aa, Homo Sapiens
QHTPPPIPI

SEQ ID NO: 166898 - protein, 9 aa, Homo Sapiens
RVTCPRSLT

SEQ ID NO: 166899 - protein, 9 aa, Homo Sapiens
RFLSTEGAP

SEQ ID NO: 166900 - protein, 9 aa, Homo Sapiens
IDTDIDSFI

SEQ ID NO: 166901 - protein, 9 aa, Homo Sapiens
PSLTHHRNR

SEQ ID NO: 166902 - protein, 9 aa, Homo Sapiens
YQQYQDATT

SEQ ID NO: 166903 - protein, 9 aa, Homo Sapiens
LCQNPEKLA

SEQ ID NO: 166904 - protein, 9 aa, Homo Sapiens
CPAVPLGPA

SEQ ID NO: 166905 - protein, 9 aa, Homo Sapiens
SKKSSHCLL

SEQ ID NO: 166906 - protein, 9 aa, Homo Sapiens
CTTPPAWRS

SEQ ID NO: 166907 - protein, 9 aa, Homo Sapiens
LHLFYDVCK

SEQ ID NO: 166908 - protein, 9 aa, Homo Sapiens
NQETQTRET

SEQ ID NO: 166909 - protein, 9 aa, Homo Sapiens
PGPDAGRLD

SEQ ID NO: 166910 - protein, 9 aa, Homo Sapiens
AFAEKMDFR

SEQ ID NO: 166911 - protein, 9 aa, Homo Sapiens
HREEKYEKE

SEQ ID NO: 166912 - protein, 9 aa, Homo Sapiens
FKVLNMAAE

SEQ ID NO: 166913 - protein, 9 aa, Homo Sapiens
IAVAVRENH

SEQ ID NO: 166914 - protein, 9 aa, Homo Sapiens
FLYGLKREE

SEQ ID NO: 166915 - protein, 9 aa, Homo Sapiens
WTATLPDLP

SEQ ID NO: 166916 - protein, 9 aa, Homo Sapiens
EDRTKRTAL

SEQ ID NO: 166917 - protein, 9 aa, Homo Sapiens
AFAFTMTFF

SEQ ID NO: 166918 - protein, 9 aa, Homo Sapiens
HRNVICQLL

SEQ ID NO: 166919 - protein, 9 aa, Homo Sapiens
SQVWQLAWI

SEQ ID NO: 166920 - protein, 9 aa, Homo Sapiens
GMATVPKLV

SEQ ID NO: 166921 - protein, 9 aa, Homo Sapiens
LGTEGFLVQ

SEQ ID NO: 166922 - protein, 9 aa, Homo Sapiens
RHGWLKKAF

SEQ ID NO: 166923 - protein, 9 aa, Homo Sapiens
EARLGLQQG

SEQ ID NO: 166924 - protein, 9 aa, Homo Sapiens
DDAKHYSCT

SEQ ID NO: 166925 - protein, 9 aa, Homo Sapiens
SSPDNDNWL

SEQ ID NO: 166926 - protein, 9 aa, Homo Sapiens
GYIDLGHEL

SEQ ID NO: 166927 - protein, 9 aa, Homo Sapiens
RGRDIRIKY

SEQ ID NO: 166928 - protein, 9 aa, Homo Sapiens
FPEAAGPGG

SEQ ID NO: 166929 - protein, 9 aa, Homo Sapiens
LIGLQLLLV

SEQ ID NO: 166930 - protein, 9 aa, Homo Sapiens
ARDLRCPLT

SEQ ID NO: 166931 - protein, 9 aa, Homo Sapiens
SEILHNIDC

SEQ ID NO: 166932 - protein, 9 aa, Homo Sapiens
KESVQDLKR

SEQ ID NO: 166933 - protein, 9 aa, Homo Sapiens
MTRPRAGRT

SEQ ID NO: 166934 - protein, 9 aa, Homo Sapiens
QLQYGSHSQ

SEQ ID NO: 166935 - protein, 9 aa, Homo Sapiens
SLDLSFNVI

SEQ ID NO: 166936 - protein, 9 aa, Homo Sapiens
NHITEVGLE

SEQ ID NO: 166937 - protein, 9 aa, Homo Sapiens
HAEGIPIPR

SEQ ID NO: 166938 - protein, 9 aa, Homo Sapiens
GPVDALVPQ

SEQ ID NO: 166939 - protein, 9 aa, Homo Sapiens
KACRYRCLA

SEQ ID NO: 166940 - protein, 9 aa, Homo Sapiens
SVSVAWLLS

SEQ ID NO: 166941 - protein, 9 aa, Homo Sapiens
RAVSHLESL

SEQ ID NO: 166942 - protein, 9 aa, Homo Sapiens
CEQSSSRNS

SEQ ID NO: 166943 - protein, 9 aa, Homo Sapiens
TRTSLEGVA

SEQ ID NO: 166944 - protein, 9 aa, Homo Sapiens
CTVELSCKG

SEQ ID NO: 166945 - protein, 9 aa, Homo Sapiens
PKGNTIAVF

SEQ ID NO: 166946 - protein, 9 aa, Homo Sapiens
VSHIGSSFP

SEQ ID NO: 166947 - protein, 9 aa, Homo Sapiens
REGQNYQNC

SEQ ID NO: 166948 - protein, 9 aa, Homo Sapiens
VDIILKKCP

SEQ ID NO: 166949 - protein, 9 aa, Homo Sapiens
MLCSYLPQW

SEQ ID NO: 166950 - protein, 9 aa, Homo Sapiens
GHHLSHVQL

SEQ ID NO: 166951 - protein, 9 aa, Homo Sapiens
RLGELPLPE

SEQ ID NO: 166952 - protein, 9 aa, Homo Sapiens
GGVATPGRP

SEQ ID NO: 166953 - protein, 9 aa, Homo Sapiens
ICIVVTRAE

SEQ ID NO: 166954 - protein, 9 aa, Homo Sapiens
THACATATT

SEQ ID NO: 166955 - protein, 9 aa, Homo Sapiens
EKSQIAKKS

SEQ ID NO: 166956 - protein, 9 aa, Homo Sapiens
LKKDICRCH

SEQ ID NO: 166957 - protein, 9 aa, Homo Sapiens
LSPKPSRML

SEQ ID NO: 166958 - protein, 9 aa, Homo Sapiens
APATLPCRR

SEQ ID NO: 166959 - protein, 9 aa, Homo Sapiens
EGTMIWSNP

SEQ ID NO: 166960 - protein, 9 aa, Homo Sapiens
RLMGAFASM

SEQ ID NO: 166961 - protein, 9 aa, Homo Sapiens
EQLWSVSSV

SEQ ID NO: 166962 - protein, 9 aa, Homo Sapiens
DVGAIAGLN

SEQ ID NO: 166963 - protein, 9 aa, Homo Sapiens
RRATASKLG

SEQ ID NO: 166964 - protein, 9 aa, Homo Sapiens
FFPIVVCLC

SEQ ID NO: 166965 - protein, 9 aa, Homo Sapiens
PFPPTKCHL

SEQ ID NO: 166966 - protein, 9 aa, Homo Sapiens
LALGKTRVG

SEQ ID NO: 166967 - protein, 9 aa, Homo Sapiens
ESFEELEYH

SEQ ID NO: 166968 - protein, 9 aa, Homo Sapiens
CCQGHCEEF

SEQ ID NO: 166969 - protein, 9 aa, Homo Sapiens
GGDTIQEDL

SEQ ID NO: 166970 - protein, 9 aa, Homo Sapiens
GHLQQVGTL

SEQ ID NO: 166971 - protein, 9 aa, Homo Sapiens
WLGPASVAP

SEQ ID NO: 166972 - protein, 9 aa, Homo Sapiens
PGPPPLSSS

SEQ ID NO: 166973 - protein, 9 aa, Homo Sapiens
AMELLESER

SEQ ID NO: 166974 - protein, 9 aa, Homo Sapiens
ISAETVRGD

SEQ ID NO: 166975 - protein, 9 aa, Homo Sapiens
WLMGWSDMN

SEQ ID NO: 166976 - protein, 9 aa, Homo Sapiens
AAVLCTSFM

SEQ ID NO: 166977 - protein, 9 aa, Homo Sapiens
LCQSAVIDH

SEQ ID NO: 166978 - protein, 9 aa, Homo Sapiens
TISCVGFPN

SEQ ID NO: 166979 - protein, 9 aa, Homo Sapiens
CAHHRHGWL

SEQ ID NO: 166980 - protein, 9 aa, Homo Sapiens
AWNDVPCIF

SEQ ID NO: 166981 - protein, 9 aa, Homo Sapiens
YSRFLSTEG

SEQ ID NO: 166982 - protein, 9 aa, Homo Sapiens
VRAAPVLVL

SEQ ID NO: 166983 - protein, 9 aa, Homo Sapiens
NASVGSTRC

SEQ ID NO: 166984 - protein, 9 aa, Homo Sapiens
LVIYQTLDD

SEQ ID NO: 166985 - protein, 9 aa, Homo Sapiens
FWKFARKWK

SEQ ID NO: 166986 - protein, 9 aa, Homo Sapiens
VLQCKYMLM

SEQ ID NO: 166987 - protein, 9 aa, Homo Sapiens
VSTPGPAST

SEQ ID NO: 166988 - protein, 9 aa, Homo Sapiens
APRPPPAEL

SEQ ID NO: 166989 - protein, 9 aa, Homo Sapiens
FVIVIMAII

SEQ ID NO: 166990 - protein, 9 aa, Homo Sapiens
FAPLQPPQS

SEQ ID NO: 166991 - protein, 9 aa, Homo Sapiens
GLNDALLRW

SEQ ID NO: 166992 - protein, 9 aa, Homo Sapiens
FSNTPKNVL

SEQ ID NO: 166993 - protein, 9 aa, Homo Sapiens
VPEPAAPPH

SEQ ID NO: 166994 - protein, 9 aa, Homo Sapiens
QDLCVSPYD

SEQ ID NO: 166995 - protein, 9 aa, Homo Sapiens
PAAPPHRLL

SEQ ID NO: 166996 - protein, 9 aa, Homo Sapiens
KKLVLMDRN

SEQ ID NO: 166997 - protein, 9 aa, Homo Sapiens
EVCVCACPG

SEQ ID NO: 166998 - protein, 9 aa, Homo Sapiens
YTITPNGRF

SEQ ID NO: 166999 - protein, 9 aa, Homo Sapiens
PPVLHCLLT

SEQ ID NO: 167000 - protein, 9 aa, Homo Sapiens
CIGKSPGRP

SEQ ID NO: 167001 - protein, 9 aa, Homo Sapiens
RQRDGKHQP

SEQ ID NO: 167002 - protein, 9 aa, Homo Sapiens
CLTFLMLPE

SEQ ID NO: 167003 - protein, 9 aa, Homo Sapiens
PEQKKSKSQ

SEQ ID NO: 167004 - protein, 9 aa, Homo Sapiens
FSLFYYKLA

SEQ ID NO: 167005 - protein, 9 aa, Homo Sapiens
NNLQRVKQK

SEQ ID NO: 167006 - protein, 9 aa, Homo Sapiens
QLNRMKKHA

SEQ ID NO: 167007 - protein, 9 aa, Homo Sapiens
QVAIVVKFF

SEQ ID NO: 167008 - protein, 9 aa, Homo Sapiens
PAATAAPAL

SEQ ID NO: 167009 - protein, 9 aa, Homo Sapiens
HIQVPQDSL

SEQ ID NO: 167010 - protein, 9 aa, Homo Sapiens
APRACLWAS

SEQ ID NO: 167011 - protein, 9 aa, Homo Sapiens
NVPIILWLG

SEQ ID NO: 167012 - protein, 9 aa, Homo Sapiens
MKDLKKNGA

SEQ ID NO: 167013 - protein, 9 aa, Homo Sapiens
QRPHQCRHF

SEQ ID NO: 167014 - protein, 9 aa, Homo Sapiens
QRKQFPDAH

SEQ ID NO: 167015 - protein, 9 aa, Homo Sapiens
LQKTRLWSC

SEQ ID NO: 167016 - protein, 9 aa, Homo Sapiens
NGALPAPMK

SEQ ID NO: 167017 - protein, 9 aa, Homo Sapiens
ACSILARLV

SEQ ID NO: 167018 - protein, 9 aa, Homo Sapiens
RARTSFCVY

SEQ ID NO: 167019 - protein, 9 aa, Homo Sapiens
PSSSMRTSS

SEQ ID NO: 167020 - protein, 9 aa, Homo Sapiens
TVSLIQVGM

SEQ ID NO: 167021 - protein, 9 aa, Homo Sapiens
WQESRLKCS

SEQ ID NO: 167022 - protein, 9 aa, Homo Sapiens
AYSSHSSAA

SEQ ID NO: 167023 - protein, 9 aa, Homo Sapiens
VIREPATPA

SEQ ID NO: 167024 - protein, 9 aa, Homo Sapiens
ALLYPRPWR

SEQ ID NO: 167025 - protein, 9 aa, Homo Sapiens
DIVYRYADD

SEQ ID NO: 167026 - protein, 9 aa, Homo Sapiens
VGSQAGGHI

SEQ ID NO: 167027 - protein, 9 aa, Homo Sapiens
RTAVCTHWR

SEQ ID NO: 167028 - protein, 9 aa, Homo Sapiens
ASVSSVLMV

SEQ ID NO: 167029 - protein, 9 aa, Homo Sapiens
TASLASVES

SEQ ID NO: 167030 - protein, 9 aa, Homo Sapiens
PSHVRHLHH

SEQ ID NO: 167031 - protein, 9 aa, Homo Sapiens
ALDGHQLLV

SEQ ID NO: 167032 - protein, 9 aa, Homo Sapiens
SSESCSVPM

SEQ ID NO: 167033 - protein, 9 aa, Homo Sapiens
TCPRSLTRA

SEQ ID NO: 167034 - protein, 9 aa, Homo Sapiens
VCGLEEQVS

SEQ ID NO: 167035 - protein, 9 aa, Homo Sapiens
QVISCLHEF

SEQ ID NO: 167036 - protein, 9 aa, Homo Sapiens
DYASFHETL

SEQ ID NO: 167037 - protein, 9 aa, Homo Sapiens
GLNRARTSF

SEQ ID NO: 167038 - protein, 9 aa, Homo Sapiens
TRPRAGRTS

SEQ ID NO: 167039 - protein, 9 aa, Homo Sapiens
GRPTAAPYL

SEQ ID NO: 167040 - protein, 9 aa, Homo Sapiens
EEQTWKLAI

SEQ ID NO: 167041 - protein, 9 aa, Homo Sapiens
PLQRSFLVL

SEQ ID NO: 167042 - protein, 9 aa, Homo Sapiens
QLPTATTGE

SEQ ID NO: 167043 - protein, 9 aa, Homo Sapiens
DSSAEGSGD

SEQ ID NO: 167044 - protein, 9 aa, Homo Sapiens
DHEEEVITL

SEQ ID NO: 167045 - protein, 9 aa, Homo Sapiens
PARMASVNA

SEQ ID NO: 167046 - protein, 9 aa, Homo Sapiens
LLRPTGPLF

SEQ ID NO: 167047 - protein, 9 aa, Homo Sapiens
ILPRAGTGT

SEQ ID NO: 167048 - protein, 9 aa, Homo Sapiens
PVRCPVPVS

SEQ ID NO: 167049 - protein, 9 aa, Homo Sapiens
LTGAMGGSR

SEQ ID NO: 167050 - protein, 9 aa, Homo Sapiens
QVKKRKKRE

SEQ ID NO: 167051 - protein, 9 aa, Homo Sapiens
HHLSHVQLW

SEQ ID NO: 167052 - protein, 9 aa, Homo Sapiens
LQGHFRTRQ

SEQ ID NO: 167053 - protein, 9 aa, Homo Sapiens
PREYWRDCL

SEQ ID NO: 167054 - protein, 9 aa, Homo Sapiens
LNINLTNSR

SEQ ID NO: 167055 - protein, 9 aa, Homo Sapiens
TGCSSQGRH

SEQ ID NO: 167056 - protein, 9 aa, Homo Sapiens
AVLCTSFMS

SEQ ID NO: 167057 - protein, 9 aa, Homo Sapiens
SDTSKIPGK

SEQ ID NO: 167058 - protein, 9 aa, Homo Sapiens
SQGTTLSGW

SEQ ID NO: 167059 - protein, 9 aa, Homo Sapiens
SPNRDFKVT

SEQ ID NO: 167060 - protein, 9 aa, Homo Sapiens
PNWGAIPRK

SEQ ID NO: 167061 - protein, 9 aa, Homo Sapiens
AKWEEETTT

SEQ ID NO: 167062 - protein, 9 aa, Homo Sapiens
SAIAYSAYM

SEQ ID NO: 167063 - protein, 9 aa, Homo Sapiens
SFMDSCSLN

SEQ ID NO: 167064 - protein, 9 aa, Homo Sapiens
VFKIASIRE

SEQ ID NO: 167065 - protein, 9 aa, Homo Sapiens
STLSQPPPQ

SEQ ID NO: 167066 - protein, 9 aa, Homo Sapiens
RAHFVKSVE

SEQ ID NO: 167067 - protein, 9 aa, Homo Sapiens
GYGSSCCQS

SEQ ID NO: 167068 - protein, 9 aa, Homo Sapiens
RPLPCVQAL

SEQ ID NO: 167069 - protein, 9 aa, Homo Sapiens
LVLRGMGAR

SEQ ID NO: 167070 - protein, 9 aa, Homo Sapiens
MALQVISVV

SEQ ID NO: 167071 - protein, 9 aa, Homo Sapiens
ILWLMGWSD

SEQ ID NO: 167072 - protein, 9 aa, Homo Sapiens
AYMFPDALM

SEQ ID NO: 167073 - protein, 9 aa, Homo Sapiens
PPQGQARDL

SEQ ID NO: 167074 - protein, 9 aa, Homo Sapiens
AEASKEHKL

SEQ ID NO: 167075 - protein, 9 aa, Homo Sapiens
VGPSAGAVP

SEQ ID NO: 167076 - protein, 9 aa, Homo Sapiens
PPGALRHPR

SEQ ID NO: 167077 - protein, 9 aa, Homo Sapiens
PSLYKKKKP

SEQ ID NO: 167078 - protein, 9 aa, Homo Sapiens
NCELAFTMA

SEQ ID NO: 167079 - protein, 9 aa, Homo Sapiens
KDHRTSQNH

SEQ ID NO: 167080 - protein, 9 aa, Homo Sapiens
RRSFLRMPL

SEQ ID NO: 167081 - protein, 9 aa, Homo Sapiens
CLLLCRLEL

SEQ ID NO: 167082 - protein, 9 aa, Homo Sapiens
QCLPAATQK

SEQ ID NO: 167083 - protein, 9 aa, Homo Sapiens
WRALLYPRP

SEQ ID NO: 167084 - protein, 9 aa, Homo Sapiens
SAQRPMIVE

SEQ ID NO: 167085 - protein, 9 aa, Homo Sapiens
ELNRGRDIR

SEQ ID NO: 167086 - protein, 9 aa, Homo Sapiens
GHFRPPVDT

SEQ ID NO: 167087 - protein, 9 aa, Homo Sapiens
ADGQCYALL

SEQ ID NO: 167088 - protein, 9 aa, Homo Sapiens
VTMGQSSAH

SEQ ID NO: 167089 - protein, 9 aa, Homo Sapiens
PLELRLLSL

SEQ ID NO: 167090 - protein, 9 aa, Homo Sapiens
STTRTRAAM

SEQ ID NO: 167091 - protein, 9 aa, Homo Sapiens
LEYHDTDIF

SEQ ID NO: 167092 - protein, 9 aa, Homo Sapiens
LNRMKKHAH

SEQ ID NO: 167093 - protein, 9 aa, Homo Sapiens
TRDDPAGQE

SEQ ID NO: 167094 - protein, 9 aa, Homo Sapiens
KMLQSMGGG

SEQ ID NO: 167095 - protein, 9 aa, Homo Sapiens
ASVNAARAG

SEQ ID NO: 167096 - protein, 9 aa, Homo Sapiens
REEVFGAQE

SEQ ID NO: 167097 - protein, 9 aa, Homo Sapiens
RWSPRPRRS

SEQ ID NO: 167098 - protein, 9 aa, Homo Sapiens
KGRGQSYID

SEQ ID NO: 167099 - protein, 9 aa, Homo Sapiens
ATSSLAEPN

SEQ ID NO: 167100 - protein, 9 aa, Homo Sapiens
EKLFPQCQP

SEQ ID NO: 167101 - protein, 9 aa, Homo Sapiens
KKRSSKVMT

SEQ ID NO: 167102 - protein, 9 aa, Homo Sapiens
GTTLSGWYH

SEQ ID NO: 167103 - protein, 9 aa, Homo Sapiens
LKGRPKLGS

SEQ ID NO: 167104 - protein, 9 aa, Homo Sapiens
SRRLRLCYM

SEQ ID NO: 167105 - protein, 9 aa, Homo Sapiens
ACKLLDHEE

SEQ ID NO: 167106 - protein, 9 aa, Homo Sapiens
LGSLSHWDA

SEQ ID NO: 167107 - protein, 9 aa, Homo Sapiens
RALLYPRPW

SEQ ID NO: 167108 - protein, 9 aa, Homo Sapiens
SPASPSMTS

SEQ ID NO: 167109 - protein, 9 aa, Homo Sapiens
MRVHEVEVV

SEQ ID NO: 167110 - protein, 9 aa, Homo Sapiens
YYQRNMIIW

SEQ ID NO: 167111 - protein, 9 aa, Homo Sapiens
GKVFYQNRH

SEQ ID NO: 167112 - protein, 9 aa, Homo Sapiens
LQPRGSAGA

SEQ ID NO: 167113 - protein, 9 aa, Homo Sapiens
YRTRAGYLT

SEQ ID NO: 167114 - protein, 9 aa, Homo Sapiens
GKPERSPKP

SEQ ID NO: 167115 - protein, 9 aa, Homo Sapiens
RPAHPLTPG

SEQ ID NO: 167116 - protein, 9 aa, Homo Sapiens
LATRDTPPE

SEQ ID NO: 167117 - protein, 9 aa, Homo Sapiens
HEMDHISYK

SEQ ID NO: 167118 - protein, 9 aa, Homo Sapiens
TFIEPPQYW

SEQ ID NO: 167119 - protein, 9 aa, Homo Sapiens
EHLSHLYIA

SEQ ID NO: 167120 - protein, 9 aa, Homo Sapiens
THRFPFGAS

SEQ ID NO: 167121 - protein, 9 aa, Homo Sapiens
KMDFRNMNM

SEQ ID NO: 167122 - protein, 9 aa, Homo Sapiens
KLLRHPLKS

SEQ ID NO: 167123 - protein, 9 aa, Homo Sapiens
DTDTVHAEF

SEQ ID NO: 167124 - protein, 9 aa, Homo Sapiens
KSTQEKWGY

SEQ ID NO: 167125 - protein, 9 aa, Homo Sapiens
PVPPPAATA

SEQ ID NO: 167126 - protein, 9 aa, Homo Sapiens
VVKPFGDSQ

SEQ ID NO: 167127 - protein, 9 aa, Homo Sapiens
SEFEDSYFE

SEQ ID NO: 167128 - protein, 9 aa, Homo Sapiens
CYALLQGHE

SEQ ID NO: 167129 - protein, 9 aa, Homo Sapiens
FRTRQTLLH

SEQ ID NO: 167130 - protein, 9 aa, Homo Sapiens
KLQTKTLNA

SEQ ID NO: 167131 - protein, 9 aa, Homo Sapiens
RRSFSSICR

SEQ ID NO: 167132 - protein, 9 aa, Homo Sapiens
PPEARGNGP

SEQ ID NO: 167133 - protein, 9 aa, Homo Sapiens
LGRNSFEVC

SEQ ID NO: 167134 - protein, 9 aa, Homo Sapiens
TACSILARL

SEQ ID NO: 167135 - protein, 9 aa, Homo Sapiens
ATTVVCVCE

SEQ ID NO: 167136 - protein, 9 aa, Homo Sapiens
APRGTCSPA

SEQ ID NO: 167137 - protein, 9 aa, Homo Sapiens
HSTDMRPYN

SEQ ID NO: 167138 - protein, 9 aa, Homo Sapiens
FMKLVGMSY

SEQ ID NO: 167139 - protein, 9 aa, Homo Sapiens
ACHPQRVSP

SEQ ID NO: 167140 - protein, 9 aa, Homo Sapiens
QEISVVHIH

SEQ ID NO: 167141 - protein, 9 aa, Homo Sapiens
IMVMMWMGG

SEQ ID NO: 167142 - protein, 9 aa, Homo Sapiens
VFQQGTQQM

SEQ ID NO: 167143 - protein, 9 aa, Homo Sapiens
DRDDVGDCC

SEQ ID NO: 167144 - protein, 9 aa, Homo Sapiens
PTEQPPAPS

SEQ ID NO: 167145 - protein, 9 aa, Homo Sapiens
SAWRTARPH

SEQ ID NO: 167146 - protein, 9 aa, Homo Sapiens
PKKKKKKIG

SEQ ID NO: 167147 - protein, 9 aa, Homo Sapiens
LERAVSHLE

SEQ ID NO: 167148 - protein, 9 aa, Homo Sapiens
HATNSKKAM

SEQ ID NO: 167149 - protein, 9 aa, Homo Sapiens
SPWPGGTFP

SEQ ID NO: 167150 - protein, 9 aa, Homo Sapiens
RRFCGGINC

SEQ ID NO: 167151 - protein, 9 aa, Homo Sapiens
SDMDMDAPE

SEQ ID NO: 167152 - protein, 9 aa, Homo Sapiens
RGPVRHLHQ

SEQ ID NO: 167153 - protein, 9 aa, Homo Sapiens
TVGPWMAPP

SEQ ID NO: 167154 - protein, 9 aa, Homo Sapiens
SPCCPATCE

SEQ ID NO: 167155 - protein, 9 aa, Homo Sapiens
RAGFQWGES

SEQ ID NO: 167156 - protein, 9 aa, Homo Sapiens
KRMHLEIYQ

SEQ ID NO: 167157 - protein, 9 aa, Homo Sapiens
IETHKLTFH

SEQ ID NO: 167158 - protein, 9 aa, Homo Sapiens
PSSESCSVP

SEQ ID NO: 167159 - protein, 9 aa, Homo Sapiens
LPGAPSLLA

SEQ ID NO: 167160 - protein, 9 aa, Homo Sapiens
SSAHMKLNW

SEQ ID NO: 167161 - protein, 9 aa, Homo Sapiens
TECDKVCSR

SEQ ID NO: 167162 - protein, 9 aa, Homo Sapiens
LGAKTGRPG

SEQ ID NO: 167163 - protein, 9 aa, Homo Sapiens
DSFDEDLTR

SEQ ID NO: 167164 - protein, 9 aa, Homo Sapiens
EGQGGERVA

SEQ ID NO: 167165 - protein, 9 aa, Homo Sapiens
SISAFSETE

SEQ ID NO: 167166 - protein, 9 aa, Homo Sapiens
TIDQISISA

SEQ ID NO: 167167 - protein, 9 aa, Homo Sapiens
GRGLPSPPP

SEQ ID NO: 167168 - protein, 9 aa, Homo Sapiens
TPYCDTSTA

SEQ ID NO: 167169 - protein, 9 aa, Homo Sapiens
HSFPAPAPP

SEQ ID NO: 167170 - protein, 9 aa, Homo Sapiens
IVHRVDGAQ

SEQ ID NO: 167171 - protein, 9 aa, Homo Sapiens
STDMRPYNW

SEQ ID NO: 167172 - protein, 9 aa, Homo Sapiens
QQLIGKVWP

SEQ ID NO: 167173 - protein, 9 aa, Homo Sapiens
ATLTITERN

SEQ ID NO: 167174 - protein, 9 aa, Homo Sapiens
PHCGAHYKL

SEQ ID NO: 167175 - protein, 9 aa, Homo Sapiens
RGLDSLAGR

SEQ ID NO: 167176 - protein, 9 aa, Homo Sapiens
GCQPISTAE

SEQ ID NO: 167177 - protein, 9 aa, Homo Sapiens
RARGLQGVP

SEQ ID NO: 167178 - protein, 9 aa, Homo Sapiens
FLAYNCYGP

SEQ ID NO: 167179 - protein, 9 aa, Homo Sapiens
HVEEAQRKQ

SEQ ID NO: 167180 - protein, 9 aa, Homo Sapiens
AKVAPQITI

SEQ ID NO: 167181 - protein, 9 aa, Homo Sapiens
GPDWHTPHC

SEQ ID NO: 167182 - protein, 9 aa, Homo Sapiens
WDLIGLQLL

SEQ ID NO: 167183 - protein, 9 aa, Homo Sapiens
HRHGWLKKA

SEQ ID NO: 167184 - protein, 9 aa, Homo Sapiens
WPWVPQVPI

SEQ ID NO: 167185 - protein, 9 aa, Homo Sapiens
AGRWGVCVC

SEQ ID NO: 167186 - protein, 9 aa, Homo Sapiens
TLPSVPSIP

SEQ ID NO: 167187 - protein, 9 aa, Homo Sapiens
SILQPDMMC

SEQ ID NO: 167188 - protein, 9 aa, Homo Sapiens
QLRCSQAPG

SEQ ID NO: 167189 - protein, 9 aa, Homo Sapiens
RKGPLNLQG

SEQ ID NO: 167190 - protein, 9 aa, Homo Sapiens
AMCIQALQW

SEQ ID NO: 167191 - protein, 9 aa, Homo Sapiens
SWGTALMTS

SEQ ID NO: 167192 - protein, 9 aa, Homo Sapiens
CYGPGVSTD

SEQ ID NO: 167193 - protein, 9 aa, Homo Sapiens
RAARHRWDW

SEQ ID NO: 167194 - protein, 9 aa, Homo Sapiens
SPLFRSLWP

SEQ ID NO: 167195 - protein, 9 aa, Homo Sapiens
EEAPGPLGV

SEQ ID NO: 167196 - protein, 9 aa, Homo Sapiens
NINLTNSRE

SEQ ID NO: 167197 - protein, 9 aa, Homo Sapiens
VQQQDWNLA

SEQ ID NO: 167198 - protein, 9 aa, Homo Sapiens
YDMSAFIRR

SEQ ID NO: 167199 - protein, 9 aa, Homo Sapiens
LWNIHDLEA

SEQ ID NO: 167200 - protein, 9 aa, Homo Sapiens
VVVAVATVE

SEQ ID NO: 167201 - protein, 9 aa, Homo Sapiens
PWPGGTFPR

SEQ ID NO: 167202 - protein, 9 aa, Homo Sapiens
IKTDNLHHS

SEQ ID NO: 167203 - protein, 9 aa, Homo Sapiens
WTPGTGSCW

SEQ ID NO: 167204 - protein, 9 aa, Homo Sapiens
RPDEVSVMP

SEQ ID NO: 167205 - protein, 9 aa, Homo Sapiens
SVMTPSDGL

SEQ ID NO: 167206 - protein, 9 aa, Homo Sapiens
NALRQPLYN

SEQ ID NO: 167207 - protein, 9 aa, Homo Sapiens
ALHLQSEPP

SEQ ID NO: 167208 - protein, 9 aa, Homo Sapiens
PQPLLSSPR

SEQ ID NO: 167209 - protein, 9 aa, Homo Sapiens
YALLQGHES

SEQ ID NO: 167210 - protein, 9 aa, Homo Sapiens
SVYMYMARG

SEQ ID NO: 167211 - protein, 9 aa, Homo Sapiens
GARSPHLQG

SEQ ID NO: 167212 - protein, 9 aa, Homo Sapiens
LCSEKQKKE

SEQ ID NO: 167213 - protein, 9 aa, Homo Sapiens
LSRHVCSHG

SEQ ID NO: 167214 - protein, 9 aa, Homo Sapiens
AAILAWSHG

SEQ ID NO: 167215 - protein, 9 aa, Homo Sapiens
LGGSNILMT

SEQ ID NO: 167216 - protein, 9 aa, Homo Sapiens
HTSRSLRIS

SEQ ID NO: 167217 - protein, 9 aa, Homo Sapiens
DLLYLRTSG

SEQ ID NO: 167218 - protein, 9 aa, Homo Sapiens
ETVRGDAPS

SEQ ID NO: 167219 - protein, 9 aa, Homo Sapiens
KISSGCRNV

SEQ ID NO: 167220 - protein, 9 aa, Homo Sapiens
NDNTPVFDQ

SEQ ID NO: 167221 - protein, 9 aa, Homo Sapiens
GRLLQSCIL

SEQ ID NO: 167222 - protein, 9 aa, Homo Sapiens
SVPYFERKL

SEQ ID NO: 167223 - protein, 9 aa, Homo Sapiens
ITLQGQPAN

SEQ ID NO: 167224 - protein, 9 aa, Homo Sapiens
GSNIGRQYL

SEQ ID NO: 167225 - protein, 9 aa, Homo Sapiens
QPSPASACT

SEQ ID NO: 167226 - protein, 9 aa, Homo Sapiens
CQGHCEEFC

SEQ ID NO: 167227 - protein, 9 aa, Homo Sapiens
VAGAGRRPL

SEQ ID NO: 167228 - protein, 9 aa, Homo Sapiens
ARVAFGSGK

SEQ ID NO: 167229 - protein, 9 aa, Homo Sapiens
LPVSLRAHS

SEQ ID NO: 167230 - protein, 9 aa, Homo Sapiens
REYAVSSHR

SEQ ID NO: 167231 - protein, 9 aa, Homo Sapiens
RDVGHEGGH

SEQ ID NO: 167232 - protein, 9 aa, Homo Sapiens
SGSYDLTIR

SEQ ID NO: 167233 - protein, 9 aa, Homo Sapiens
VFCANYLTT

SEQ ID NO: 167234 - protein, 9 aa, Homo Sapiens
MVEPPRMNV

SEQ ID NO: 167235 - protein, 9 aa, Homo Sapiens
EGLIVHRVD

SEQ ID NO: 167236 - protein, 9 aa, Homo Sapiens
HNIDCLLSN

SEQ ID NO: 167237 - protein, 9 aa, Homo Sapiens
TLAVQPRAK

SEQ ID NO: 167238 - protein, 9 aa, Homo Sapiens
HRWDWSEVV

SEQ ID NO: 167239 - protein, 9 aa, Homo Sapiens
CLLTTMPPA

SEQ ID NO: 167240 - protein, 9 aa, Homo Sapiens
NLGVYTEAR

SEQ ID NO: 167241 - protein, 9 aa, Homo Sapiens
VKFFLQLQG

SEQ ID NO: 167242 - protein, 9 aa, Homo Sapiens
SLTSCLQRL

SEQ ID NO: 167243 - protein, 9 aa, Homo Sapiens
PRCAMAPET

SEQ ID NO: 167244 - protein, 9 aa, Homo Sapiens
GERDDDVPV

SEQ ID NO: 167245 - protein, 9 aa, Homo Sapiens
VNITLLDHQ

SEQ ID NO: 167246 - protein, 9 aa, Homo Sapiens
EPAAPPHRL

SEQ ID NO: 167247 - protein, 9 aa, Homo Sapiens
CRPPPEHFR

SEQ ID NO: 167248 - protein, 9 aa, Homo Sapiens
SSLSVPHTT

SEQ ID NO: 167249 - protein, 9 aa, Homo Sapiens
CKPKGNTIA

SEQ ID NO: 167250 - protein, 9 aa, Homo Sapiens
YPAASAPCW

SEQ ID NO: 167251 - protein, 9 aa, Homo Sapiens
APDPRRRPS

SEQ ID NO: 167252 - protein, 9 aa, Homo Sapiens
PGPSRAHCP

SEQ ID NO: 167253 - protein, 9 aa, Homo Sapiens
GRARGLQGV

SEQ ID NO: 167254 - protein, 9 aa, Homo Sapiens
KCRSCQMEF

SEQ ID NO: 167255 - protein, 9 aa, Homo Sapiens
IWLGSGQYG

SEQ ID NO: 167256 - protein, 9 aa, Homo Sapiens
RPPPAELPP

SEQ ID NO: 167257 - protein, 9 aa, Homo Sapiens
MCDHDYDVL

SEQ ID NO: 167258 - protein, 9 aa, Homo Sapiens
VTHSAAPST

SEQ ID NO: 167259 - protein, 9 aa, Homo Sapiens
WVKLKLWDT

SEQ ID NO: 167260 - protein, 9 aa, Homo Sapiens
VKRREIQWL

SEQ ID NO: 167261 - protein, 9 aa, Homo Sapiens
TAAVAVAQE

SEQ ID NO: 167262 - protein, 9 aa, Homo Sapiens
HHGWASVPG

SEQ ID NO: 167263 - protein, 9 aa, Homo Sapiens
NWVFKIASI

SEQ ID NO: 167264 - protein, 9 aa, Homo Sapiens
RGWMTRPRA

SEQ ID NO: 167265 - protein, 9 aa, Homo Sapiens
DIFCMSSLS

SEQ ID NO: 167266 - protein, 9 aa, Homo Sapiens
SISVEHGQW

SEQ ID NO: 167267 - protein, 9 aa, Homo Sapiens
TRGQILFPC

SEQ ID NO: 167268 - protein, 9 aa, Homo Sapiens
LGPLRTLVL

SEQ ID NO: 167269 - protein, 9 aa, Homo Sapiens
ERRLDGLAS

SEQ ID NO: 167270 - protein, 9 aa, Homo Sapiens
RMDSQDTLD

SEQ ID NO: 167271 - protein, 9 aa, Homo Sapiens
ISFSSDQWY

SEQ ID NO: 167272 - protein, 9 aa, Homo Sapiens
FLHENDLSI

SEQ ID NO: 167273 - protein, 9 aa, Homo Sapiens
QLEEWLCDK

SEQ ID NO: 167274 - protein, 9 aa, Homo Sapiens
PGMVISGVL

SEQ ID NO: 167275 - protein, 9 aa, Homo Sapiens
LFEELWTAQ

SEQ ID NO: 167276 - protein, 9 aa, Homo Sapiens
PLTVFDLSL

SEQ ID NO: 167277 - protein, 9 aa, Homo Sapiens
ELLGLDKML

SEQ ID NO: 167278 - protein, 9 aa, Homo Sapiens
AGRAQPVIR

SEQ ID NO: 167279 - protein, 9 aa, Homo Sapiens
IDSDEVDRI

SEQ ID NO: 167280 - protein, 9 aa, Homo Sapiens
PAASNTAQR

SEQ ID NO: 167281 - protein, 9 aa, Homo Sapiens
SLRISHKTR

SEQ ID NO: 167282 - protein, 9 aa, Homo Sapiens
APGYLLPPE

SEQ ID NO: 167283 - protein, 9 aa, Homo Sapiens
LSSDTVFGP

SEQ ID NO: 167284 - protein, 9 aa, Homo Sapiens
PGTGSCWTS

SEQ ID NO: 167285 - protein, 9 aa, Homo Sapiens
KGFCHSSTL

SEQ ID NO: 167286 - protein, 9 aa, Homo Sapiens
LATLLFLII

SEQ ID NO: 167287 - protein, 9 aa, Homo Sapiens
ALFLGGLIA

SEQ ID NO: 167288 - protein, 9 aa, Homo Sapiens
FSAPCCWRL

SEQ ID NO: 167289 - protein, 9 aa, Homo Sapiens
ERGGVATPG

SEQ ID NO: 167290 - protein, 9 aa, Homo Sapiens
VGDSEMFLL

SEQ ID NO: 167291 - protein, 9 aa, Homo Sapiens
PPQATRARS

SEQ ID NO: 167292 - protein, 9 aa, Homo Sapiens
LARVVSWSQ

SEQ ID NO: 167293 - protein, 9 aa, Homo Sapiens
LLDHEEEVI

SEQ ID NO: 167294 - protein, 9 aa, Homo Sapiens
FHHHHRLPR

SEQ ID NO: 167295 - protein, 9 aa, Homo Sapiens
QNSFLLPFR

SEQ ID NO: 167296 - protein, 9 aa, Homo Sapiens
ARGGLSLAP

SEQ ID NO: 167297 - protein, 9 aa, Homo Sapiens
PPTHLRNRL

SEQ ID NO: 167298 - protein, 9 aa, Homo Sapiens
KRKEENAMI

SEQ ID NO: 167299 - protein, 9 aa, Homo Sapiens
NKMLQSMGG

SEQ ID NO: 167300 - protein, 9 aa, Homo Sapiens
VNENCHLQS

SEQ ID NO: 167301 - protein, 9 aa, Homo Sapiens
ANPGGDTTG

SEQ ID NO: 167302 - protein, 9 aa, Homo Sapiens
TDNLHHSWA

SEQ ID NO: 167303 - protein, 9 aa, Homo Sapiens
PTETIHLMA

SEQ ID NO: 167304 - protein, 9 aa, Homo Sapiens
FMACTVAYA

SEQ ID NO: 167305 - protein, 9 aa, Homo Sapiens
ICRCHRMSR

SEQ ID NO: 167306 - protein, 9 aa, Homo Sapiens
AESLGTIIS

SEQ ID NO: 167307 - protein, 9 aa, Homo Sapiens
FYFLWILWL

SEQ ID NO: 167308 - protein, 9 aa, Homo Sapiens
ARRWWPSWS

SEQ ID NO: 167309 - protein, 9 aa, Homo Sapiens
PPVLEHFLQ

SEQ ID NO: 167310 - protein, 9 aa, Homo Sapiens
NLTAQQYSH

SEQ ID NO: 167311 - protein, 9 aa, Homo Sapiens
RTLKERLSY

SEQ ID NO: 167312 - protein, 9 aa, Homo Sapiens
KIVADFLQV

SEQ ID NO: 167313 - protein, 9 aa, Homo Sapiens
IDPNAMQAS

SEQ ID NO: 167314 - protein, 9 aa, Homo Sapiens
FLISVSGSF

SEQ ID NO: 167315 - protein, 9 aa, Homo Sapiens
AAPRPPPAE

SEQ ID NO: 167316 - protein, 9 aa, Homo Sapiens
AMDSLRPVR

SEQ ID NO: 167317 - protein, 9 aa, Homo Sapiens
QLQGLVAGV

SEQ ID NO: 167318 - protein, 9 aa, Homo Sapiens
PVRSTVCAM

SEQ ID NO: 167319 - protein, 9 aa, Homo Sapiens
RLFAPLGPP

SEQ ID NO: 167320 - protein, 9 aa, Homo Sapiens
FNIDPNAMQ

SEQ ID NO: 167321 - protein, 9 aa, Homo Sapiens
HLQEVKGRG

SEQ ID NO: 167322 - protein, 9 aa, Homo Sapiens
ETTTEMISA

SEQ ID NO: 167323 - protein, 9 aa, Homo Sapiens
AEGPAARAK

SEQ ID NO: 167324 - protein, 9 aa, Homo Sapiens
SPGHGAWNS

SEQ ID NO: 167325 - protein, 9 aa, Homo Sapiens
GTLQPRGSA

SEQ ID NO: 167326 - protein, 9 aa, Homo Sapiens
RRHLRVPRH

SEQ ID NO: 167327 - protein, 9 aa, Homo Sapiens
SRRPHGPQN

SEQ ID NO: 167328 - protein, 9 aa, Homo Sapiens
TIVVSSLDW

SEQ ID NO: 167329 - protein, 9 aa, Homo Sapiens
PWRGTTRNC

SEQ ID NO: 167330 - protein, 9 aa, Homo Sapiens
GQRSMNLES

SEQ ID NO: 167331 - protein, 9 aa, Homo Sapiens
MDKNPTTLS

SEQ ID NO: 167332 - protein, 9 aa, Homo Sapiens
RMHLEIYQS

SEQ ID NO: 167333 - protein, 9 aa, Homo Sapiens
LHGDQRGQD

SEQ ID NO: 167334 - protein, 9 aa, Homo Sapiens
TLGSPGCLR

SEQ ID NO: 167335 - protein, 9 aa, Homo Sapiens
IYHVLHFST

SEQ ID NO: 167336 - protein, 9 aa, Homo Sapiens
GPPQGQARD

SEQ ID NO: 167337 - protein, 9 aa, Homo Sapiens
LPRWPPSCP

SEQ ID NO: 167338 - protein, 9 aa, Homo Sapiens
PRKDLDGLL

SEQ ID NO: 167339 - protein, 9 aa, Homo Sapiens
LASSRPMRT

SEQ ID NO: 167340 - protein, 9 aa, Homo Sapiens
TLACLNGGY

SEQ ID NO: 167341 - protein, 9 aa, Homo Sapiens
VTPHRTSEN

SEQ ID NO: 167342 - protein, 9 aa, Homo Sapiens
ADVQFCIWD

SEQ ID NO: 167343 - protein, 9 aa, Homo Sapiens
LNRGRDIRI

SEQ ID NO: 167344 - protein, 9 aa, Homo Sapiens
RKKHREEKY

SEQ ID NO: 167345 - protein, 9 aa, Homo Sapiens
PLDSPHICR

SEQ ID NO: 167346 - protein, 9 aa, Homo Sapiens
GPYNLKQCK

SEQ ID NO: 167347 - protein, 9 aa, Homo Sapiens
LAGMVITGD

SEQ ID NO: 167348 - protein, 9 aa, Homo Sapiens
TSPWPGGTF

SEQ ID NO: 167349 - protein, 9 aa, Homo Sapiens
PVLLIMVQE

SEQ ID NO: 167350 - protein, 9 aa, Homo Sapiens
KYSDMELEC

SEQ ID NO: 167351 - protein, 9 aa, Homo Sapiens
MEGFWIEME

SEQ ID NO: 167352 - protein, 9 aa, Homo Sapiens
QFERVLLKW

SEQ ID NO: 167353 - protein, 9 aa, Homo Sapiens
IKKQHRRTS

SEQ ID NO: 167354 - protein, 9 aa, Homo Sapiens
DNRLTRATA

SEQ ID NO: 167355 - protein, 9 aa, Homo Sapiens
RPLVLHMSI

SEQ ID NO: 167356 - protein, 9 aa, Homo Sapiens
LKLADFVLL

SEQ ID NO: 167357 - protein, 9 aa, Homo Sapiens
ACYSSAISP

SEQ ID NO: 167358 - protein, 9 aa, Homo Sapiens
TTGESPTCL

SEQ ID NO: 167359 - protein, 9 aa, Homo Sapiens
FEDSYFEEL

SEQ ID NO: 167360 - protein, 9 aa, Homo Sapiens
VARPCRGSC

SEQ ID NO: 167361 - protein, 9 aa, Homo Sapiens
HHLDSNFRI

SEQ ID NO: 167362 - protein, 9 aa, Homo Sapiens
EVVSDNQRL

SEQ ID NO: 167363 - protein, 9 aa, Homo Sapiens
SGGRGEDGT

SEQ ID NO: 167364 - protein, 9 aa, Homo Sapiens
PDKVHRDLR

SEQ ID NO: 167365 - protein, 9 aa, Homo Sapiens
GTHACATAT

SEQ ID NO: 167366 - protein, 9 aa, Homo Sapiens
VITGDVLVR

SEQ ID NO: 167367 - protein, 9 aa, Homo Sapiens
DTIQEDLKS

SEQ ID NO: 167368 - protein, 9 aa, Homo Sapiens
GPVWPRWTW

SEQ ID NO: 167369 - protein, 9 aa, Homo Sapiens
TSSATGSCE

SEQ ID NO: 167370 - protein, 9 aa, Homo Sapiens
KCFLKTRGQ

SEQ ID NO: 167371 - protein, 9 aa, Homo Sapiens
GDICNEADL

SEQ ID NO: 167372 - protein, 9 aa, Homo Sapiens
FQFSGQACY

SEQ ID NO: 167373 - protein, 9 aa, Homo Sapiens
PHQCRHFRQ

SEQ ID NO: 167374 - protein, 9 aa, Homo Sapiens
TVVVQQQDW

SEQ ID NO: 167375 - protein, 9 aa, Homo Sapiens
LAWSHGLLP

SEQ ID NO: 167376 - protein, 9 aa, Homo Sapiens
NITLLDHQI

SEQ ID NO: 167377 - protein, 9 aa, Homo Sapiens
ARGAERELE

SEQ ID NO: 167378 - protein, 9 aa, Homo Sapiens
PISTAECQA

SEQ ID NO: 167379 - protein, 9 aa, Homo Sapiens
RETPPWSGP

SEQ ID NO: 167380 - protein, 9 aa, Homo Sapiens
PGGPGTAEG

SEQ ID NO: 167381 - protein, 9 aa, Homo Sapiens
AGRTSHRIR

SEQ ID NO: 167382 - protein, 9 aa, Homo Sapiens
ASTVTKWTI

SEQ ID NO: 167383 - protein, 9 aa, Homo Sapiens
FGGDQSLHG

SEQ ID NO: 167384 - protein, 9 aa, Homo Sapiens
VQNILDVHT

SEQ ID NO: 167385 - protein, 9 aa, Homo Sapiens
ALHLAAGPL

SEQ ID NO: 167386 - protein, 9 aa, Homo Sapiens
GGSTAARAR

SEQ ID NO: 167387 - protein, 9 aa, Homo Sapiens
TGPRDDDKS

SEQ ID NO: 167388 - protein, 9 aa, Homo Sapiens
PHRQKGQHY

SEQ ID NO: 167389 - protein, 9 aa, Homo Sapiens
HMYRFPTTD

SEQ ID NO: 167390 - protein, 9 aa, Homo Sapiens
VIKESDTSK

SEQ ID NO: 167391 - protein, 9 aa, Homo Sapiens
LGELPLPED

SEQ ID NO: 167392 - protein, 9 aa, Homo Sapiens
LDNIYDARI

SEQ ID NO: 167393 - protein, 9 aa, Homo Sapiens
HRLKKDICR

SEQ ID NO: 167394 - protein, 9 aa, Homo Sapiens
AWPSTSPTR

SEQ ID NO: 167395 - protein, 9 aa, Homo Sapiens
STVNRDFKK

SEQ ID NO: 167396 - protein, 9 aa, Homo Sapiens
HVTFNNQRS

SEQ ID NO: 167397 - protein, 9 aa, Homo Sapiens
TGAWILRLR

SEQ ID NO: 167398 - protein, 9 aa, Homo Sapiens
TLGHGHKGL

SEQ ID NO: 167399 - protein, 9 aa, Homo Sapiens
RMTPTCPLE

SEQ ID NO: 167400 - protein, 9 aa, Homo Sapiens
WPGWRWRRG

SEQ ID NO: 167401 - protein, 9 aa, Homo Sapiens
LKGRVDNIN

SEQ ID NO: 167402 - protein, 9 aa, Homo Sapiens
ALQASLGKM

SEQ ID NO: 167403 - protein, 9 aa, Homo Sapiens
EIWKVNITL

SEQ ID NO: 167404 - protein, 9 aa, Homo Sapiens
LEKPPASNP

SEQ ID NO: 167405 - protein, 9 aa, Homo Sapiens
LPHHMVHTG

SEQ ID NO: 167406 - protein, 9 aa, Homo Sapiens
LMWQASWTK

SEQ ID NO: 167407 - protein, 9 aa, Homo Sapiens
TINHQLNMF

SEQ ID NO: 167408 - protein, 9 aa, Homo Sapiens
CLAFVPIYF

SEQ ID NO: 167409 - protein, 9 aa, Homo Sapiens
PMIVELGAL

SEQ ID NO: 167410 - protein, 9 aa, Homo Sapiens
IRKYICASN

SEQ ID NO: 167411 - protein, 9 aa, Homo Sapiens
CEACTRTSL

SEQ ID NO: 167412 - protein, 9 aa, Homo Sapiens
LHFSTSPST

SEQ ID NO: 167413 - protein, 9 aa, Homo Sapiens
SVVHIHCWL

SEQ ID NO: 167414 - protein, 9 aa, Homo Sapiens
HPPPVLHCL

SEQ ID NO: 167415 - protein, 9 aa, Homo Sapiens
SPRLCATTT

SEQ ID NO: 167416 - protein, 9 aa, Homo Sapiens
WRGTTRNCS

SEQ ID NO: 167417 - protein, 9 aa, Homo Sapiens
NLYLLAFKK

SEQ ID NO: 167418 - protein, 9 aa, Homo Sapiens
AFLNCWLAK

SEQ ID NO: 167419 - protein, 9 aa, Homo Sapiens
NYSVLCQSA

SEQ ID NO: 167420 - protein, 9 aa, Homo Sapiens
MQKPSASPR

SEQ ID NO: 167421 - protein, 9 aa, Homo Sapiens
LGLFEELWT

SEQ ID NO: 167422 - protein, 9 aa, Homo Sapiens
TETLAVQPR

SEQ ID NO: 167423 - protein, 9 aa, Homo Sapiens
TGDVLVRRS

SEQ ID NO: 167424 - protein, 9 aa, Homo Sapiens
LMEEINTVL

SEQ ID NO: 167425 - protein, 9 aa, Homo Sapiens
TCPQKNSAQ

SEQ ID NO: 167426 - protein, 9 aa, Homo Sapiens
RTSEGSRCA

SEQ ID NO: 167427 - protein, 9 aa, Homo Sapiens
EHYRKRCRE

SEQ ID NO: 167428 - protein, 9 aa, Homo Sapiens
SEAYSRFLS

SEQ ID NO: 167429 - protein, 9 aa, Homo Sapiens
TWVLSSCPM

SEQ ID NO: 167430 - protein, 9 aa, Homo Sapiens
QPLRWAASG

SEQ ID NO: 167431 - protein, 9 aa, Homo Sapiens
LQARMDSQD

SEQ ID NO: 167432 - protein, 9 aa, Homo Sapiens
VYTEARLGL

SEQ ID NO: 167433 - protein, 9 aa, Homo Sapiens
VQALMAEQL

SEQ ID NO: 167434 - protein, 9 aa, Homo Sapiens
DWSEVVENA

SEQ ID NO: 167435 - protein, 9 aa, Homo Sapiens
DEEELYLFV

SEQ ID NO: 167436 - protein, 9 aa, Homo Sapiens
CCSSGYGSS

SEQ ID NO: 167437 - protein, 9 aa, Homo Sapiens
GNCSNYPAI

SEQ ID NO: 167438 - protein, 9 aa, Homo Sapiens
QELQALLLW

SEQ ID NO: 167439 - protein, 9 aa, Homo Sapiens
CDIVYRYAD

SEQ ID NO: 167440 - protein, 9 aa, Homo Sapiens
HSSLCRQPP

SEQ ID NO: 167441 - protein, 9 aa, Homo Sapiens
FDIVGSPDN

SEQ ID NO: 167442 - protein, 9 aa, Homo Sapiens
QGLGNITDT

SEQ ID NO: 167443 - protein, 9 aa, Homo Sapiens
GPKPGQSQF

SEQ ID NO: 167444 - protein, 9 aa, Homo Sapiens
SQLAWCVDC

SEQ ID NO: 167445 - protein, 9 aa, Homo Sapiens
PVNLLCAPV

SEQ ID NO: 167446 - protein, 9 aa, Homo Sapiens
LVLLLGWLI

SEQ ID NO: 167447 - protein, 9 aa, Homo Sapiens
TVASVLPLL

SEQ ID NO: 167448 - protein, 9 aa, Homo Sapiens
APAALCSRW

SEQ ID NO: 167449 - protein, 9 aa, Homo Sapiens
VGHGHEAET

SEQ ID NO: 167450 - protein, 9 aa, Homo Sapiens
QCKYMLMRL

SEQ ID NO: 167451 - protein, 9 aa, Homo Sapiens
ENDLRHLPD

SEQ ID NO: 167452 - protein, 9 aa, Homo Sapiens
GVGETGRPG

SEQ ID NO: 167453 - protein, 9 aa, Homo Sapiens
ARPSRLPGS

SEQ ID NO: 167454 - protein, 9 aa, Homo Sapiens
QEHFCRPPP

SEQ ID NO: 167455 - protein, 9 aa, Homo Sapiens
IVITEDFTI

SEQ ID NO: 167456 - protein, 9 aa, Homo Sapiens
SMTSPWWST

SEQ ID NO: 167457 - protein, 9 aa, Homo Sapiens
NNQIQTVPT

SEQ ID NO: 167458 - protein, 9 aa, Homo Sapiens
RSLWPRWHD

SEQ ID NO: 167459 - protein, 9 aa, Homo Sapiens
LQDLPISRC

SEQ ID NO: 167460 - protein, 9 aa, Homo Sapiens
KKSSHCLLT

SEQ ID NO: 167461 - protein, 9 aa, Homo Sapiens
QHALAQAIA

SEQ ID NO: 167462 - protein, 9 aa, Homo Sapiens
KTEKPGICP

SEQ ID NO: 167463 - protein, 9 aa, Homo Sapiens
SNVGDPMNI

SEQ ID NO: 167464 - protein, 9 aa, Homo Sapiens
DLGHELSSL

SEQ ID NO: 167465 - protein, 9 aa, Homo Sapiens
ESDIFCMSS

SEQ ID NO: 167466 - protein, 9 aa, Homo Sapiens
LLGPQVGPA

SEQ ID NO: 167467 - protein, 9 aa, Homo Sapiens
AEPKVLFAK

SEQ ID NO: 167468 - protein, 9 aa, Homo Sapiens
PVCCPRAPE

SEQ ID NO: 167469 - protein, 9 aa, Homo Sapiens
NHSLWARIE

SEQ ID NO: 167470 - protein, 9 aa, Homo Sapiens
KQTQNDMVT

SEQ ID NO: 167471 - protein, 9 aa, Homo Sapiens
CYRIPREIL

SEQ ID NO: 167472 - protein, 9 aa, Homo Sapiens
IQTLIYDTL

SEQ ID NO: 167473 - protein, 9 aa, Homo Sapiens
PHGRSRRCE

SEQ ID NO: 167474 - protein, 9 aa, Homo Sapiens
MYEPDSPPE

SEQ ID NO: 167475 - protein, 9 aa, Homo Sapiens
KKCVDEPGK

SEQ ID NO: 167476 - protein, 9 aa, Homo Sapiens
FRLFHTALF

SEQ ID NO: 167477 - protein, 9 aa, Homo Sapiens
YRLGTRDAH

SEQ ID NO: 167478 - protein, 9 aa, Homo Sapiens
SKDLEEQLW

SEQ ID NO: 167479 - protein, 9 aa, Homo Sapiens
MSVMTPSDG

SEQ ID NO: 167480 - protein, 9 aa, Homo Sapiens
ALNIRVGRT

SEQ ID NO: 167481 - protein, 9 aa, Homo Sapiens
WRWTWRPGS

SEQ ID NO: 167482 - protein, 9 aa, Homo Sapiens
QSFASKQAL

SEQ ID NO: 167483 - protein, 9 aa, Homo Sapiens
CLWASLVKG

SEQ ID NO: 167484 - protein, 9 aa, Homo Sapiens
ISASTVTKW

SEQ ID NO: 167485 - protein, 9 aa, Homo Sapiens
PPSPTSLTF

SEQ ID NO: 167486 - protein, 9 aa, Homo Sapiens
TWGRWWRKL

SEQ ID NO: 167487 - protein, 9 aa, Homo Sapiens
GVTHSVIST

SEQ ID NO: 167488 - protein, 9 aa, Homo Sapiens
VEELHVYCA

SEQ ID NO: 167489 - protein, 9 aa, Homo Sapiens
MGVEEEEDD

SEQ ID NO: 167490 - protein, 9 aa, Homo Sapiens
PLNWHMKKH

SEQ ID NO: 167491 - protein, 9 aa, Homo Sapiens
NSPPKRVKE

SEQ ID NO: 167492 - protein, 9 aa, Homo Sapiens
RTQRPGPAS

SEQ ID NO: 167493 - protein, 9 aa, Homo Sapiens
LLRLWMFLR

SEQ ID NO: 167494 - protein, 9 aa, Homo Sapiens
KIEVWRENA

SEQ ID NO: 167495 - protein, 9 aa, Homo Sapiens
FLLPFRMSS

SEQ ID NO: 167496 - protein, 9 aa, Homo Sapiens
SPMSLSWGT

SEQ ID NO: 167497 - protein, 9 aa, Homo Sapiens
GDKKSGTPP

SEQ ID NO: 167498 - protein, 9 aa, Homo Sapiens
RDLSEWKKA

SEQ ID NO: 167499 - protein, 9 aa, Homo Sapiens
KDKTDTLEH

SEQ ID NO: 167500 - protein, 9 aa, Homo Sapiens
CDITDLDMA

SEQ ID NO: 167501 - protein, 9 aa, Homo Sapiens
EQEQMEQER

SEQ ID NO: 167502 - protein, 9 aa, Homo Sapiens
AFEMVMCAK

SEQ ID NO: 167503 - protein, 9 aa, Homo Sapiens
LDVAEPKVL

SEQ ID NO: 167504 - protein, 9 aa, Homo Sapiens
PGLPKVAMA

SEQ ID NO: 167505 - protein, 9 aa, Homo Sapiens
GPLSLVLCL

SEQ ID NO: 167506 - protein, 9 aa, Homo Sapiens
GEQINNLQR

SEQ ID NO: 167507 - protein, 9 aa, Homo Sapiens
LYPRPWRRT

SEQ ID NO: 167508 - protein, 9 aa, Homo Sapiens
CGKVFYQNR

SEQ ID NO: 167509 - protein, 9 aa, Homo Sapiens
EPPQYWIRK

SEQ ID NO: 167510 - protein, 9 aa, Homo Sapiens
PSVRTSSAW

SEQ ID NO: 167511 - protein, 9 aa, Homo Sapiens
VAAMEETEV

SEQ ID NO: 167512 - protein, 9 aa, Homo Sapiens
VLLCCSLLR

SEQ ID NO: 167513 - protein, 9 aa, Homo Sapiens
SGPQAFSQT

SEQ ID NO: 167514 - protein, 9 aa, Homo Sapiens
RHLLQQRAV

SEQ ID NO: 167515 - protein, 9 aa, Homo Sapiens
PTCPLEKSP

SEQ ID NO: 167516 - protein, 9 aa, Homo Sapiens
YCQVTGTNY

SEQ ID NO: 167517 - protein, 9 aa, Homo Sapiens
LRRWPWQGS

SEQ ID NO: 167518 - protein, 9 aa, Homo Sapiens
LSDGNPKVN

SEQ ID NO: 167519 - protein, 9 aa, Homo Sapiens
ALESAPVAR

SEQ ID NO: 167520 - protein, 9 aa, Homo Sapiens
VQEVETLTP

SEQ ID NO: 167521 - protein, 9 aa, Homo Sapiens
ERERMRMER

SEQ ID NO: 167522 - protein, 9 aa, Homo Sapiens
VLAENLCLP

SEQ ID NO: 167523 - protein, 9 aa, Homo Sapiens
RMNNTEVLT

SEQ ID NO: 167524 - protein, 9 aa, Homo Sapiens
WGRPTAAPY

SEQ ID NO: 167525 - protein, 9 aa, Homo Sapiens
GIDSDSSPQ

SEQ ID NO: 167526 - protein, 9 aa, Homo Sapiens
APCIKIPVV

SEQ ID NO: 167527 - protein, 9 aa, Homo Sapiens
SAFSETETQ

SEQ ID NO: 167528 - protein, 9 aa, Homo Sapiens
LQVVKEGDE

SEQ ID NO: 167529 - protein, 9 aa, Homo Sapiens
PAADNPTPS

SEQ ID NO: 167530 - protein, 9 aa, Homo Sapiens
FLFHHHHRL

SEQ ID NO: 167531 - protein, 9 aa, Homo Sapiens
LREPASIDV

SEQ ID NO: 167532 - protein, 9 aa, Homo Sapiens
AIGGGGWPG

SEQ ID NO: 167533 - protein, 9 aa, Homo Sapiens
VWLMFNNAR

SEQ ID NO: 167534 - protein, 9 aa, Homo Sapiens
MKKDKDKTD

SEQ ID NO: 167535 - protein, 9 aa, Homo Sapiens
ASVAPATLP

SEQ ID NO: 167536 - protein, 9 aa, Homo Sapiens
YQTVTHPGI

SEQ ID NO: 167537 - protein, 9 aa, Homo Sapiens
CQAQQERDE

SEQ ID NO: 167538 - protein, 9 aa, Homo Sapiens
FQEAMHKVS

SEQ ID NO: 167539 - protein, 9 aa, Homo Sapiens
DLHPMGWCT

SEQ ID NO: 167540 - protein, 9 aa, Homo Sapiens
FKRVCTVEL

SEQ ID NO: 167541 - protein, 9 aa, Homo Sapiens
FSTSPSTFG

SEQ ID NO: 167542 - protein, 9 aa, Homo Sapiens
CVFLTFVIM

SEQ ID NO: 167543 - protein, 9 aa, Homo Sapiens
DSDGLYYLA

SEQ ID NO: 167544 - protein, 9 aa, Homo Sapiens
WMRRWRRRG

SEQ ID NO: 167545 - protein, 9 aa, Homo Sapiens
ECRNAEEAK

SEQ ID NO: 167546 - protein, 9 aa, Homo Sapiens
AAHCAATGY

SEQ ID NO: 167547 - protein, 9 aa, Homo Sapiens
IPVVPPTTA

SEQ ID NO: 167548 - protein, 9 aa, Homo Sapiens
HTTILVTGA

SEQ ID NO: 167549 - protein, 9 aa, Homo Sapiens
HFLQVTCLL

SEQ ID NO: 167550 - protein, 9 aa, Homo Sapiens
LLCQNPEKL

SEQ ID NO: 167551 - protein, 9 aa, Homo Sapiens
SWWRLGRWI

SEQ ID NO: 167552 - protein, 9 aa, Homo Sapiens
MGAEGASAE

SEQ ID NO: 167553 - protein, 9 aa, Homo Sapiens
LTLTAGSKH

SEQ ID NO: 167554 - protein, 9 aa, Homo Sapiens
NLGIDSDSS

SEQ ID NO: 167555 - protein, 9 aa, Homo Sapiens
QDAYHRNSV

SEQ ID NO: 167556 - protein, 9 aa, Homo Sapiens
SIHNIDHTQ

SEQ ID NO: 167557 - protein, 9 aa, Homo Sapiens
AQLCTIEPH

SEQ ID NO: 167558 - protein, 9 aa, Homo Sapiens
RLPPQSFLL

SEQ ID NO: 167559 - protein, 9 aa, Homo Sapiens
RYPRYAPNV

SEQ ID NO: 167560 - protein, 9 aa, Homo Sapiens
LLRQLRTGN

SEQ ID NO: 167561 - protein, 9 aa, Homo Sapiens
TPPHPAARS

SEQ ID NO: 167562 - protein, 9 aa, Homo Sapiens
WDWSEVVEN

SEQ ID NO: 167563 - protein, 9 aa, Homo Sapiens
VIGGPTAGG

SEQ ID NO: 167564 - protein, 9 aa, Homo Sapiens
GTPPGPENN

SEQ ID NO: 167565 - protein, 9 aa, Homo Sapiens
ALQVISVVE

SEQ ID NO: 167566 - protein, 9 aa, Homo Sapiens
LLLNDNRLT

SEQ ID NO: 167567 - protein, 9 aa, Homo Sapiens
HQGNGKWRL

SEQ ID NO: 167568 - protein, 9 aa, Homo Sapiens
RLLREVNAL

SEQ ID NO: 167569 - protein, 9 aa, Homo Sapiens
LHQEFTHLT

SEQ ID NO: 167570 - protein, 9 aa, Homo Sapiens
PYMVFVQFL

SEQ ID NO: 167571 - protein, 9 aa, Homo Sapiens
VENAETETL

SEQ ID NO: 167572 - protein, 9 aa, Homo Sapiens
PNGACVPRA

SEQ ID NO: 167573 - protein, 9 aa, Homo Sapiens
AAMAPTLTD

SEQ ID NO: 167574 - protein, 9 aa, Homo Sapiens
LRQRRGFAE

SEQ ID NO: 167575 - protein, 9 aa, Homo Sapiens
SSQFSDPWP

SEQ ID NO: 167576 - protein, 9 aa, Homo Sapiens
CIVVTRAEV

SEQ ID NO: 167577 - protein, 9 aa, Homo Sapiens
VRFRVHLAP

SEQ ID NO: 167578 - protein, 9 aa, Homo Sapiens
CCRKKHREE

SEQ ID NO: 167579 - protein, 9 aa, Homo Sapiens
LRILEQKFM

SEQ ID NO: 167580 - protein, 9 aa, Homo Sapiens
PGCGAPDPR

SEQ ID NO: 167581 - protein, 9 aa, Homo Sapiens
HICRRCNCE

SEQ ID NO: 167582 - protein, 9 aa, Homo Sapiens
PTQKHWVLQ

SEQ ID NO: 167583 - protein, 9 aa, Homo Sapiens
TFCKPQRVT

SEQ ID NO: 167584 - protein, 9 aa, Homo Sapiens
EIIFVGFFP

SEQ ID NO: 167585 - protein, 9 aa, Homo Sapiens
DKNPTTLSS

SEQ ID NO: 167586 - protein, 9 aa, Homo Sapiens
DVQFCIWDP

SEQ ID NO: 167587 - protein, 9 aa, Homo Sapiens
SGHVTFNNQ

SEQ ID NO: 167588 - protein, 9 aa, Homo Sapiens
THPGIQGNL

SEQ ID NO: 167589 - protein, 9 aa, Homo Sapiens
EAPRAFVNL

SEQ ID NO: 167590 - protein, 9 aa, Homo Sapiens
SWASRSPHR

SEQ ID NO: 167591 - protein, 9 aa, Homo Sapiens
TSEGSRCAP

SEQ ID NO: 167592 - protein, 9 aa, Homo Sapiens
QHLEQLRTN

SEQ ID NO: 167593 - protein, 9 aa, Homo Sapiens
NMFYIQELQ

SEQ ID NO: 167594 - protein, 9 aa, Homo Sapiens
WDAWLKEDG

SEQ ID NO: 167595 - protein, 9 aa, Homo Sapiens
GLQGYDMSA

SEQ ID NO: 167596 - protein, 9 aa, Homo Sapiens
IRGWAARVA

SEQ ID NO: 167597 - protein, 9 aa, Homo Sapiens
CGGDTIQED

SEQ ID NO: 167598 - protein, 9 aa, Homo Sapiens
LQMPRSPHR

SEQ ID NO: 167599 - protein, 9 aa, Homo Sapiens
AWSALRVPR

SEQ ID NO: 167600 - protein, 9 aa, Homo Sapiens
RLVGPEKKT

SEQ ID NO: 167601 - protein, 9 aa, Homo Sapiens
CATAMEDVP

SEQ ID NO: 167602 - protein, 9 aa, Homo Sapiens
SSDEDIQFH

SEQ ID NO: 167603 - protein, 9 aa, Homo Sapiens
STLHFCETF

SEQ ID NO: 167604 - protein, 9 aa, Homo Sapiens
ALQARMDSQ

SEQ ID NO: 167605 - protein, 9 aa, Homo Sapiens
IVYLQHFRP

SEQ ID NO: 167606 - protein, 9 aa, Homo Sapiens
DHHVQGAVC

SEQ ID NO: 167607 - protein, 9 aa, Homo Sapiens
LLSLYRPPL

SEQ ID NO: 167608 - protein, 9 aa, Homo Sapiens
LRTSGEPWD

SEQ ID NO: 167609 - protein, 9 aa, Homo Sapiens
VCNKAYKCA

SEQ ID NO: 167610 - protein, 9 aa, Homo Sapiens
CQSAVIDHM

SEQ ID NO: 167611 - protein, 9 aa, Homo Sapiens
RGGAAGRVA

SEQ ID NO: 167612 - protein, 9 aa, Homo Sapiens
RCPAADNPT

SEQ ID NO: 167613 - protein, 9 aa, Homo Sapiens
SSTLPCMKQ

SEQ ID NO: 167614 - protein, 9 aa, Homo Sapiens
EAAKKKEKK

SEQ ID NO: 167615 - protein, 9 aa, Homo Sapiens
PFDIVGSPD

SEQ ID NO: 167616 - protein, 9 aa, Homo Sapiens
LNRRTIVQD

SEQ ID NO: 167617 - protein, 9 aa, Homo Sapiens
RDDVGDCCD

SEQ ID NO: 167618 - protein, 9 aa, Homo Sapiens
CWRAVATRP

SEQ ID NO: 167619 - protein, 9 aa, Homo Sapiens
RGGGSPSRS

SEQ ID NO: 167620 - protein, 9 aa, Homo Sapiens
RSDGTGPGL

SEQ ID NO: 167621 - protein, 9 aa, Homo Sapiens
VSWYSHQKK

SEQ ID NO: 167622 - protein, 9 aa, Homo Sapiens
SQRQATKDV

SEQ ID NO: 167623 - protein, 9 aa, Homo Sapiens
TVPHSLLFR

SEQ ID NO: 167624 - protein, 9 aa, Homo Sapiens
AEAGHLAGT

SEQ ID NO: 167625 - protein, 9 aa, Homo Sapiens
TKSGWRCVR

SEQ ID NO: 167626 - protein, 9 aa, Homo Sapiens
DDSPVNLLC

SEQ ID NO: 167627 - protein, 9 aa, Homo Sapiens
AAERAKCQA

SEQ ID NO: 167628 - protein, 9 aa, Homo Sapiens
ASITAIREG

SEQ ID NO: 167629 - protein, 9 aa, Homo Sapiens
HLLHQEFTH

SEQ ID NO: 167630 - protein, 9 aa, Homo Sapiens
RSPKPGPPV

SEQ ID NO: 167631 - protein, 9 aa, Homo Sapiens
VPRCAMAPE

SEQ ID NO: 167632 - protein, 9 aa, Homo Sapiens
FCIWDPVLS

SEQ ID NO: 167633 - protein, 9 aa, Homo Sapiens
SPFPEVLVT

SEQ ID NO: 167634 - protein, 9 aa, Homo Sapiens
YENQKWLEK

SEQ ID NO: 167635 - protein, 9 aa, Homo Sapiens
ELHIGNALF

SEQ ID NO: 167636 - protein, 9 aa, Homo Sapiens
IPKKETLIQ

SEQ ID NO: 167637 - protein, 9 aa, Homo Sapiens
SKSTYLLPH

SEQ ID NO: 167638 - protein, 9 aa, Homo Sapiens
LCTPYCDTS

SEQ ID NO: 167639 - protein, 9 aa, Homo Sapiens
LTHHRNREL

SEQ ID NO: 167640 - protein, 9 aa, Homo Sapiens
EEWKVLPTT

SEQ ID NO: 167641 - protein, 9 aa, Homo Sapiens
PLSSSLRMT

SEQ ID NO: 167642 - protein, 9 aa, Homo Sapiens
GLGLPLSPC

SEQ ID NO: 167643 - protein, 9 aa, Homo Sapiens
AQDRWRTQR

SEQ ID NO: 167644 - protein, 9 aa, Homo Sapiens
ILSTMNVPA

SEQ ID NO: 167645 - protein, 9 aa, Homo Sapiens
KLTFHENAK

SEQ ID NO: 167646 - protein, 9 aa, Homo Sapiens
APAVTTAIP

SEQ ID NO: 167647 - protein, 9 aa, Homo Sapiens
EEYGFLPVS

SEQ ID NO: 167648 - protein, 9 aa, Homo Sapiens
FAPLGPPSP

SEQ ID NO: 167649 - protein, 9 aa, Homo Sapiens
KNMIYVIYF

SEQ ID NO: 167650 - protein, 9 aa, Homo Sapiens
SGVFCANYL

SEQ ID NO: 167651 - protein, 9 aa, Homo Sapiens
AGMVITGDV

SEQ ID NO: 167652 - protein, 9 aa, Homo Sapiens
KARGVFVAD

SEQ ID NO: 167653 - protein, 9 aa, Homo Sapiens
DGAAVRVHH

SEQ ID NO: 167654 - protein, 9 aa, Homo Sapiens
ESSSDGRGE

SEQ ID NO: 167655 - protein, 9 aa, Homo Sapiens
ACQEDLSYE

SEQ ID NO: 167656 - protein, 9 aa, Homo Sapiens
GKMALQDYV

SEQ ID NO: 167657 - protein, 9 aa, Homo Sapiens
APAGANKNV

SEQ ID NO: 167658 - protein, 9 aa, Homo Sapiens
RLSHRGLAA

SEQ ID NO: 167659 - protein, 9 aa, Homo Sapiens
IFSRDRVSL

SEQ ID NO: 167660 - protein, 9 aa, Homo Sapiens
RKAKSHQVG

SEQ ID NO: 167661 - protein, 9 aa, Homo Sapiens
VSLGTEGFL

SEQ ID NO: 167662 - protein, 9 aa, Homo Sapiens
IGLGGGFMV

SEQ ID NO: 167663 - protein, 9 aa, Homo Sapiens
LRPTGPLFF

SEQ ID NO: 167664 - protein, 9 aa, Homo Sapiens
TEWWTMVCN

SEQ ID NO: 167665 - protein, 9 aa, Homo Sapiens
YNKIVPSTS

SEQ ID NO: 167666 - protein, 9 aa, Homo Sapiens
IGKSPGRPC

SEQ ID NO: 167667 - protein, 9 aa, Homo Sapiens
DHIVTCGAD

SEQ ID NO: 167668 - protein, 9 aa, Homo Sapiens
HEDFGPRKD

SEQ ID NO: 167669 - protein, 9 aa, Homo Sapiens
AMAPETTLW

SEQ ID NO: 167670 - protein, 9 aa, Homo Sapiens
DAFVDPALA

SEQ ID NO: 167671 - protein, 9 aa, Homo Sapiens
QKAQRVGQS

SEQ ID NO: 167672 - protein, 9 aa, Homo Sapiens
TPHGRLPQE

SEQ ID NO: 167673 - protein, 9 aa, Homo Sapiens
TKKISECCD

SEQ ID NO: 167674 - protein, 9 aa, Homo Sapiens
WRVTGPAGV

SEQ ID NO: 167675 - protein, 9 aa, Homo Sapiens
NKHLDDITW

SEQ ID NO: 167676 - protein, 9 aa, Homo Sapiens
LLAFKKSKK

SEQ ID NO: 167677 - protein, 9 aa, Homo Sapiens
EAQDGSPSP

SEQ ID NO: 167678 - protein, 9 aa, Homo Sapiens
RCWPLRWGW

SEQ ID NO: 167679 - protein, 9 aa, Homo Sapiens
SLNISGATS

SEQ ID NO: 167680 - protein, 9 aa, Homo Sapiens
SEDKVAQSE

SEQ ID NO: 167681 - protein, 9 aa, Homo Sapiens
MQDPLFVEF

SEQ ID NO: 167682 - protein, 9 aa, Homo Sapiens
GHGHEAETL

SEQ ID NO: 167683 - protein, 9 aa, Homo Sapiens
GLAAVCFFL

SEQ ID NO: 167684 - protein, 9 aa, Homo Sapiens
WGTRLNCTP

SEQ ID NO: 167685 - protein, 9 aa, Homo Sapiens
LWLELLRQL

SEQ ID NO: 167686 - protein, 9 aa, Homo Sapiens
TFPMSVQEP

SEQ ID NO: 167687 - protein, 9 aa, Homo Sapiens
MKKRASDSH

SEQ ID NO: 167688 - protein, 9 aa, Homo Sapiens
PHELIHTRQ

SEQ ID NO: 167689 - protein, 9 aa, Homo Sapiens
GFNKSGTYT

SEQ ID NO: 167690 - protein, 9 aa, Homo Sapiens
SSAWTHPQP

SEQ ID NO: 167691 - protein, 9 aa, Homo Sapiens
HEVPPQLQP

SEQ ID NO: 167692 - protein, 9 aa, Homo Sapiens
EESIPKKSY

SEQ ID NO: 167693 - protein, 9 aa, Homo Sapiens
HPQPRSGWR

SEQ ID NO: 167694 - protein, 9 aa, Homo Sapiens
KKDKDKTDT

SEQ ID NO: 167695 - protein, 9 aa, Homo Sapiens
LVVQQVPHE

SEQ ID NO: 167696 - protein, 9 aa, Homo Sapiens
GLDKGGVGP

SEQ ID NO: 167697 - protein, 9 aa, Homo Sapiens
RNKVTIVVS

SEQ ID NO: 167698 - protein, 9 aa, Homo Sapiens
KLRMNNTEV

SEQ ID NO: 167699 - protein, 9 aa, Homo Sapiens
PAASLTPGP

SEQ ID NO: 167700 - protein, 9 aa, Homo Sapiens
PKPPILQCS

SEQ ID NO: 167701 - protein, 9 aa, Homo Sapiens
VRGDAPSQP

SEQ ID NO: 167702 - protein, 9 aa, Homo Sapiens
SDMELECEV

SEQ ID NO: 167703 - protein, 9 aa, Homo Sapiens
VHYSLHFLL

SEQ ID NO: 167704 - protein, 9 aa, Homo Sapiens
IQESTERAA

SEQ ID NO: 167705 - protein, 9 aa, Homo Sapiens
SWLMWVTDE

SEQ ID NO: 167706 - protein, 9 aa, Homo Sapiens
LEQKFMLYW

SEQ ID NO: 167707 - protein, 9 aa, Homo Sapiens
EELYLFVES

SEQ ID NO: 167708 - protein, 9 aa, Homo Sapiens
GSLQVGNEV

SEQ ID NO: 167709 - protein, 9 aa, Homo Sapiens
FANCEDDIN

SEQ ID NO: 167710 - protein, 9 aa, Homo Sapiens
LVIMLSSVP

SEQ ID NO: 167711 - protein, 9 aa, Homo Sapiens
GWASVPGLP

SEQ ID NO: 167712 - protein, 9 aa, Homo Sapiens
GPRKDLDGL

SEQ ID NO: 167713 - protein, 9 aa, Homo Sapiens
FQWGESPWQ

SEQ ID NO: 167714 - protein, 9 aa, Homo Sapiens
EGRLSPAGR

SEQ ID NO: 167715 - protein, 9 aa, Homo Sapiens
WNTVHRHEP

SEQ ID NO: 167716 - protein, 9 aa, Homo Sapiens
GSYPDAILH

SEQ ID NO: 167717 - protein, 9 aa, Homo Sapiens
PGPLGVSRA

SEQ ID NO: 167718 - protein, 9 aa, Homo Sapiens
ELEGGWGGA

SEQ ID NO: 167719 - protein, 9 aa, Homo Sapiens
AVHLGAFHP

SEQ ID NO: 167720 - protein, 9 aa, Homo Sapiens
PPVNRGFRA

SEQ ID NO: 167721 - protein, 9 aa, Homo Sapiens
VLGAGLETS

SEQ ID NO: 167722 - protein, 9 aa, Homo Sapiens
VSSHRNVIC

SEQ ID NO: 167723 - protein, 9 aa, Homo Sapiens
VATTMSSAG

SEQ ID NO: 167724 - protein, 9 aa, Homo Sapiens
VLLVGVCVF

SEQ ID NO: 167725 - protein, 9 aa, Homo Sapiens
ALTAVMNPC

SEQ ID NO: 167726 - protein, 9 aa, Homo Sapiens
WTVDWPGWY

SEQ ID NO: 167727 - protein, 9 aa, Homo Sapiens
QPISTAECQ

SEQ ID NO: 167728 - protein, 9 aa, Homo Sapiens
RVTAIQGDM

SEQ ID NO: 167729 - protein, 9 aa, Homo Sapiens
ALHALLHGD

SEQ ID NO: 167730 - protein, 9 aa, Homo Sapiens
HEPFWEDEE

SEQ ID NO: 167731 - protein, 9 aa, Homo Sapiens
ECRLVGPEK

SEQ ID NO: 167732 - protein, 9 aa, Homo Sapiens
RPSSNKMLQ

SEQ ID NO: 167733 - protein, 9 aa, Homo Sapiens
HLLALFRQG

SEQ ID NO: 167734 - protein, 9 aa, Homo Sapiens
AAITSMKSP

SEQ ID NO: 167735 - protein, 9 aa, Homo Sapiens
PAVPSTGPA

SEQ ID NO: 167736 - protein, 9 aa, Homo Sapiens
PRLQRQHHR

SEQ ID NO: 167737 - protein, 9 aa, Homo Sapiens
LKWPRLDEN

SEQ ID NO: 167738 - protein, 9 aa, Homo Sapiens
VRRRSRHLP

SEQ ID NO: 167739 - protein, 9 aa, Homo Sapiens
MSYLHEVLK

SEQ ID NO: 167740 - protein, 9 aa, Homo Sapiens
GIPIPRITW

SEQ ID NO: 167741 - protein, 9 aa, Homo Sapiens
TVPPVPAAL

SEQ ID NO: 167742 - protein, 9 aa, Homo Sapiens
NFSLLITLQ

SEQ ID NO: 167743 - protein, 9 aa, Homo Sapiens
SQAPGDSHG

SEQ ID NO: 167744 - protein, 9 aa, Homo Sapiens
LLGQGWEDR

SEQ ID NO: 167745 - protein, 9 aa, Homo Sapiens
PHRHRPSLR

SEQ ID NO: 167746 - protein, 9 aa, Homo Sapiens
GSYLYKLQT

SEQ ID NO: 167747 - protein, 9 aa, Homo Sapiens
IGSHWGCCP

SEQ ID NO: 167748 - protein, 9 aa, Homo Sapiens
WNLALGKTR

SEQ ID NO: 167749 - protein, 9 aa, Homo Sapiens
RCRRRRARM

SEQ ID NO: 167750 - protein, 9 aa, Homo Sapiens
IVGHGHEAE

SEQ ID NO: 167751 - protein, 9 aa, Homo Sapiens
MGGPPRLLG

SEQ ID NO: 167752 - protein, 9 aa, Homo Sapiens
GLLLAQKLT

SEQ ID NO: 167753 - protein, 9 aa, Homo Sapiens
DNIYDARIP

SEQ ID NO: 167754 - protein, 9 aa, Homo Sapiens
EKRWIVFSV

SEQ ID NO: 167755 - protein, 9 aa, Homo Sapiens
KKAGRAQPV

SEQ ID NO: 167756 - protein, 9 aa, Homo Sapiens
KWPFIVKRH

SEQ ID NO: 167757 - protein, 9 aa, Homo Sapiens
WPLKWYTPE

SEQ ID NO: 167758 - protein, 9 aa, Homo Sapiens
RRKWYAYKQ

SEQ ID NO: 167759 - protein, 9 aa, Homo Sapiens
RPTGPLFFM

SEQ ID NO: 167760 - protein, 9 aa, Homo Sapiens
TAAVPRTVT

SEQ ID NO: 167761 - protein, 9 aa, Homo Sapiens
APVARCQTL

SEQ ID NO: 167762 - protein, 9 aa, Homo Sapiens
AGGGGSWSS

SEQ ID NO: 167763 - protein, 9 aa, Homo Sapiens
PLWLMTAMW

SEQ ID NO: 167764 - protein, 9 aa, Homo Sapiens
WPRVPHWGP

SEQ ID NO: 167765 - protein, 9 aa, Homo Sapiens
GFSYHLQGR

SEQ ID NO: 167766 - protein, 9 aa, Homo Sapiens
QLWDLIGLQ

SEQ ID NO: 167767 - protein, 9 aa, Homo Sapiens
HLLNTQQPL

SEQ ID NO: 167768 - protein, 9 aa, Homo Sapiens
DEDIQFHLV

SEQ ID NO: 167769 - protein, 9 aa, Homo Sapiens
AVAASPSSS

SEQ ID NO: 167770 - protein, 9 aa, Homo Sapiens
RSKHPTGEC

SEQ ID NO: 167771 - protein, 9 aa, Homo Sapiens
PGVQGQMVP

SEQ ID NO: 167772 - protein, 9 aa, Homo Sapiens
GAVLRVEEE

SEQ ID NO: 167773 - protein, 9 aa, Homo Sapiens
RGAERELEG

SEQ ID NO: 167774 - protein, 9 aa, Homo Sapiens
LRDLAKSMD

SEQ ID NO: 167775 - protein, 9 aa, Homo Sapiens
QLPQHALVC

SEQ ID NO: 167776 - protein, 9 aa, Homo Sapiens
FPGPKGPLA

SEQ ID NO: 167777 - protein, 9 aa, Homo Sapiens
LNDNRLTRA

SEQ ID NO: 167778 - protein, 9 aa, Homo Sapiens
FNNARLYNR

SEQ ID NO: 167779 - protein, 9 aa, Homo Sapiens
LEAPDGQRL

SEQ ID NO: 167780 - protein, 9 aa, Homo Sapiens
PHPTPLCTP

SEQ ID NO: 167781 - protein, 9 aa, Homo Sapiens
LIHTRQLES

SEQ ID NO: 167782 - protein, 9 aa, Homo Sapiens
VSLFDVLLL

SEQ ID NO: 167783 - protein, 9 aa, Homo Sapiens
YPPQCPAPC

SEQ ID NO: 167784 - protein, 9 aa, Homo Sapiens
SHSVLLFIA

SEQ ID NO: 167785 - protein, 9 aa, Homo Sapiens
HQYILEFNG

SEQ ID NO: 167786 - protein, 9 aa, Homo Sapiens
AASAPCWAP

SEQ ID NO: 167787 - protein, 9 aa, Homo Sapiens
GSQLPHSIS

SEQ ID NO: 167788 - protein, 9 aa, Homo Sapiens
SMRAIRIVN

SEQ ID NO: 167789 - protein, 9 aa, Homo Sapiens
SKSPPTAAV

SEQ ID NO: 167790 - protein, 9 aa, Homo Sapiens
TSKIPGKKV

SEQ ID NO: 167791 - protein, 9 aa, Homo Sapiens
PATCEPSPC

SEQ ID NO: 167792 - protein, 9 aa, Homo Sapiens
WIVQNSFLL

SEQ ID NO: 167793 - protein, 9 aa, Homo Sapiens
PGRLLQSCI

SEQ ID NO: 167794 - protein, 9 aa, Homo Sapiens
DLKLADFVL

SEQ ID NO: 167795 - protein, 9 aa, Homo Sapiens
HGRSRRCEQ

SEQ ID NO: 167796 - protein, 9 aa, Homo Sapiens
EAKKAYPSE

SEQ ID NO: 167797 - protein, 9 aa, Homo Sapiens
YFSPNRDFK

SEQ ID NO: 167798 - protein, 9 aa, Homo Sapiens
VAITEPENG

SEQ ID NO: 167799 - protein, 9 aa, Homo Sapiens
SHKAAPVPG

SEQ ID NO: 167800 - protein, 9 aa, Homo Sapiens
QCLSFKRCG

SEQ ID NO: 167801 - protein, 9 aa, Homo Sapiens
APQGQGLPA

SEQ ID NO: 167802 - protein, 9 aa, Homo Sapiens
LIPNKKLTW

SEQ ID NO: 167803 - protein, 9 aa, Homo Sapiens
PVFHFLRTL

SEQ ID NO: 167804 - protein, 9 aa, Homo Sapiens
YMRNFSDPR

SEQ ID NO: 167805 - protein, 9 aa, Homo Sapiens
APCTTPPAW

SEQ ID NO: 167806 - protein, 9 aa, Homo Sapiens
RSGGGGGNN

SEQ ID NO: 167807 - protein, 9 aa, Homo Sapiens
PTQQLAWPD

SEQ ID NO: 167808 - protein, 9 aa, Homo Sapiens
SSLKATTID

SEQ ID NO: 167809 - protein, 9 aa, Homo Sapiens
MEETGVVAA

SEQ ID NO: 167810 - protein, 9 aa, Homo Sapiens
GRHVGTKFS

SEQ ID NO: 167811 - protein, 9 aa, Homo Sapiens
PCPAVPLGP

SEQ ID NO: 167812 - protein, 9 aa, Homo Sapiens
AGRGLPSPP

SEQ ID NO: 167813 - protein, 9 aa, Homo Sapiens
LQSMGGGQR

SEQ ID NO: 167814 - protein, 9 aa, Homo Sapiens
EQAAILAWS

SEQ ID NO: 167815 - protein, 9 aa, Homo Sapiens
SGQHGCQPI

SEQ ID NO: 167816 - protein, 9 aa, Homo Sapiens
VSGHMDTTA

SEQ ID NO: 167817 - protein, 9 aa, Homo Sapiens
HLSHVQLWD

SEQ ID NO: 167818 - protein, 9 aa, Homo Sapiens
INCGPTWLP

SEQ ID NO: 167819 - protein, 9 aa, Homo Sapiens
WGRWWRKLT

SEQ ID NO: 167820 - protein, 9 aa, Homo Sapiens
PGAPSLLAQ

SEQ ID NO: 167821 - protein, 9 aa, Homo Sapiens
SRPEPRSDG

SEQ ID NO: 167822 - protein, 9 aa, Homo Sapiens
APGTAQSNT

SEQ ID NO: 167823 - protein, 9 aa, Homo Sapiens
QYCSKFDID

SEQ ID NO: 167824 - protein, 9 aa, Homo Sapiens
LLVEVQNIL

SEQ ID NO: 167825 - protein, 9 aa, Homo Sapiens
CPDDDEDDD

SEQ ID NO: 167826 - protein, 9 aa, Homo Sapiens
LQPPQSLPP

SEQ ID NO: 167827 - protein, 9 aa, Homo Sapiens
IYVIYFDFW

SEQ ID NO: 167828 - protein, 9 aa, Homo Sapiens
YSHQKKLTV

SEQ ID NO: 167829 - protein, 9 aa, Homo Sapiens
KARPALQAP

SEQ ID NO: 167830 - protein, 9 aa, Homo Sapiens
SVTTKKYPP

SEQ ID NO: 167831 - protein, 9 aa, Homo Sapiens
SPVWGKGLT

SEQ ID NO: 167832 - protein, 9 aa, Homo Sapiens
VIKYVGQNI

SEQ ID NO: 167833 - protein, 9 aa, Homo Sapiens
RTPRGTHCA

SEQ ID NO: 167834 - protein, 9 aa, Homo Sapiens
ASTKSRPCP

SEQ ID NO: 167835 - protein, 9 aa, Homo Sapiens
FSSICRSST

SEQ ID NO: 167836 - protein, 9 aa, Homo Sapiens
IIFCCRKKH

SEQ ID NO: 167837 - protein, 9 aa, Homo Sapiens
APVRGPRLP

SEQ ID NO: 167838 - protein, 9 aa, Homo Sapiens
WFVIVIMAI

SEQ ID NO: 167839 - protein, 9 aa, Homo Sapiens
HIADMSYFV

SEQ ID NO: 167840 - protein, 9 aa, Homo Sapiens
AMVKFQYLL

SEQ ID NO: 167841 - protein, 9 aa, Homo Sapiens
RTRVLMVNA

SEQ ID NO: 167842 - protein, 9 aa, Homo Sapiens
ETEVEAMEE

SEQ ID NO: 167843 - protein, 9 aa, Homo Sapiens
FWVRDMLTD

SEQ ID NO: 167844 - protein, 9 aa, Homo Sapiens
DKVHRDLRL

SEQ ID NO: 167845 - protein, 9 aa, Homo Sapiens
QDAGIRRSS

SEQ ID NO: 167846 - protein, 9 aa, Homo Sapiens
PSPQEGVFW

SEQ ID NO: 167847 - protein, 9 aa, Homo Sapiens
DNTPVFDQT

SEQ ID NO: 167848 - protein, 9 aa, Homo Sapiens
SWRSYPLPH

SEQ ID NO: 167849 - protein, 9 aa, Homo Sapiens
LQARGKKQQ

SEQ ID NO: 167850 - protein, 9 aa, Homo Sapiens
FVQSCAGAV

SEQ ID NO: 167851 - protein, 9 aa, Homo Sapiens
HALLHGDQR

SEQ ID NO: 167852 - protein, 9 aa, Homo Sapiens
TCPGPSWHP

SEQ ID NO: 167853 - protein, 9 aa, Homo Sapiens
ADMSYFVPE

SEQ ID NO: 167854 - protein, 9 aa, Homo Sapiens
HRKGPLNLQ

SEQ ID NO: 167855 - protein, 9 aa, Homo Sapiens
SKGMDQDPF

SEQ ID NO: 167856 - protein, 9 aa, Homo Sapiens
HRTTNPHSP

SEQ ID NO: 167857 - protein, 9 aa, Homo Sapiens
DDKSDDTLE

SEQ ID NO: 167858 - protein, 9 aa, Homo Sapiens
MPTILWLMG

SEQ ID NO: 167859 - protein, 9 aa, Homo Sapiens
YDDAYYFMG

SEQ ID NO: 167860 - protein, 9 aa, Homo Sapiens
APPVGSGSP

SEQ ID NO: 167861 - protein, 9 aa, Homo Sapiens
SGTPPAATA

SEQ ID NO: 167862 - protein, 9 aa, Homo Sapiens
KSPANGSLW

SEQ ID NO: 167863 - protein, 9 aa, Homo Sapiens
LPLSPCLLP

SEQ ID NO: 167864 - protein, 9 aa, Homo Sapiens
DDITWYGWH

SEQ ID NO: 167865 - protein, 9 aa, Homo Sapiens
FELQKICYL

SEQ ID NO: 167866 - protein, 9 aa, Homo Sapiens
MYKEEGLKH

SEQ ID NO: 167867 - protein, 9 aa, Homo Sapiens
CNWSLWPRR

SEQ ID NO: 167868 - protein, 9 aa, Homo Sapiens
PWKWREGRA

SEQ ID NO: 167869 - protein, 9 aa, Homo Sapiens
AEYRPAASE

SEQ ID NO: 167870 - protein, 9 aa, Homo Sapiens
DNPPEFTTS

SEQ ID NO: 167871 - protein, 9 aa, Homo Sapiens
QELAGQWGG

SEQ ID NO: 167872 - protein, 9 aa, Homo Sapiens
TCFRCCSQD

SEQ ID NO: 167873 - protein, 9 aa, Homo Sapiens
RRNDTENGS

SEQ ID NO: 167874 - protein, 9 aa, Homo Sapiens
AWTHPQPRS

SEQ ID NO: 167875 - protein, 9 aa, Homo Sapiens
PFPEVLVTL

SEQ ID NO: 167876 - protein, 9 aa, Homo Sapiens
GWQVYRLGT

SEQ ID NO: 167877 - protein, 9 aa, Homo Sapiens
RDDDKSDDT

SEQ ID NO: 167878 - protein, 9 aa, Homo Sapiens
CPKCSTPAT

SEQ ID NO: 167879 - protein, 9 aa, Homo Sapiens
KRLSYAFSV

SEQ ID NO: 167880 - protein, 9 aa, Homo Sapiens
ECDKAFHRS

SEQ ID NO: 167881 - protein, 9 aa, Homo Sapiens
NKVTIVVSS

SEQ ID NO: 167882 - protein, 9 aa, Homo Sapiens
PVWPRWTWV

SEQ ID NO: 167883 - protein, 9 aa, Homo Sapiens
HQPSLTHHR

SEQ ID NO: 167884 - protein, 9 aa, Homo Sapiens
SNILMTEEN

SEQ ID NO: 167885 - protein, 9 aa, Homo Sapiens
SMQTQDSSF

SEQ ID NO: 167886 - protein, 9 aa, Homo Sapiens
RPWRRTGRG

SEQ ID NO: 167887 - protein, 9 aa, Homo Sapiens
VLNTFKYPL

SEQ ID NO: 167888 - protein, 9 aa, Homo Sapiens
SQLPINIIT

SEQ ID NO: 167889 - protein, 9 aa, Homo Sapiens
PRPVREAGP

SEQ ID NO: 167890 - protein, 9 aa, Homo Sapiens
REKLCAGAP

SEQ ID NO: 167891 - protein, 9 aa, Homo Sapiens
RLRLCYMAN

SEQ ID NO: 167892 - protein, 9 aa, Homo Sapiens
PTTRLMAPV

SEQ ID NO: 167893 - protein, 9 aa, Homo Sapiens
EDLTRPSGL

SEQ ID NO: 167894 - protein, 9 aa, Homo Sapiens
VGADVQFCI

SEQ ID NO: 167895 - protein, 9 aa, Homo Sapiens
APCQPHQPV

SEQ ID NO: 167896 - protein, 9 aa, Homo Sapiens
PANGSLWPT

SEQ ID NO: 167897 - protein, 9 aa, Homo Sapiens
GGHFGGDQS

SEQ ID NO: 167898 - protein, 9 aa, Homo Sapiens
RHGPRFMTL

SEQ ID NO: 167899 - protein, 9 aa, Homo Sapiens
LTAVMNPCG

SEQ ID NO: 167900 - protein, 9 aa, Homo Sapiens
HCHLSPEKN

SEQ ID NO: 167901 - protein, 9 aa, Homo Sapiens
QVGKYFWPQ

SEQ ID NO: 167902 - protein, 9 aa, Homo Sapiens
ECSLEAAWE

SEQ ID NO: 167903 - protein, 9 aa, Homo Sapiens
RRSPATMEV

SEQ ID NO: 167904 - protein, 9 aa, Homo Sapiens
ATLLFLIIT

SEQ ID NO: 167905 - protein, 9 aa, Homo Sapiens
ATLGPLDPP

SEQ ID NO: 167906 - protein, 9 aa, Homo Sapiens
EDIITIESQ

SEQ ID NO: 167907 - protein, 9 aa, Homo Sapiens
DNYCALRVT

SEQ ID NO: 167908 - protein, 9 aa, Homo Sapiens
GQRATRHGP

SEQ ID NO: 167909 - protein, 9 aa, Homo Sapiens
EECDKAFHR

SEQ ID NO: 167910 - protein, 9 aa, Homo Sapiens
VVGFFFLLP

SEQ ID NO: 167911 - protein, 9 aa, Homo Sapiens
GKWRLTTRV

SEQ ID NO: 167912 - protein, 9 aa, Homo Sapiens
NVAPAPTSW

SEQ ID NO: 167913 - protein, 9 aa, Homo Sapiens
EHQGNGKWR

SEQ ID NO: 167914 - protein, 9 aa, Homo Sapiens
SFHETLRCP

SEQ ID NO: 167915 - protein, 9 aa, Homo Sapiens
RILPGAPSL

SEQ ID NO: 167916 - protein, 9 aa, Homo Sapiens
RGWAARVAH

SEQ ID NO: 167917 - protein, 9 aa, Homo Sapiens
DLVAAFHPR

SEQ ID NO: 167918 - protein, 9 aa, Homo Sapiens
TRVVLRPWC

SEQ ID NO: 167919 - protein, 9 aa, Homo Sapiens
PLYFQRIIK

SEQ ID NO: 167920 - protein, 9 aa, Homo Sapiens
NYQNCIKEV

SEQ ID NO: 167921 - protein, 9 aa, Homo Sapiens
SSISVEHGQ

SEQ ID NO: 167922 - protein, 9 aa, Homo Sapiens
AKRKPEGRP

SEQ ID NO: 167923 - protein, 9 aa, Homo Sapiens
EAKKAITDA

SEQ ID NO: 167924 - protein, 9 aa, Homo Sapiens
CSPAPRACL

SEQ ID NO: 167925 - protein, 9 aa, Homo Sapiens
LAEPFPLVG

SEQ ID NO: 167926 - protein, 9 aa, Homo Sapiens
QEAPRAFVN

SEQ ID NO: 167927 - protein, 9 aa, Homo Sapiens
GAGETFRGT

SEQ ID NO: 167928 - protein, 9 aa, Homo Sapiens
TPPQSSRCP

SEQ ID NO: 167929 - protein, 9 aa, Homo Sapiens
GRDQSIISY

SEQ ID NO: 167930 - protein, 9 aa, Homo Sapiens
RWCWSLWRA

SEQ ID NO: 167931 - protein, 9 aa, Homo Sapiens
RRLWPPVAC

SEQ ID NO: 167932 - protein, 9 aa, Homo Sapiens
CTASASWLL

SEQ ID NO: 167933 - protein, 9 aa, Homo Sapiens
EQMRYEGVV

SEQ ID NO: 167934 - protein, 9 aa, Homo Sapiens
EKTIKKIWL

SEQ ID NO: 167935 - protein, 9 aa, Homo Sapiens
LPPLPAPQG

SEQ ID NO: 167936 - protein, 9 aa, Homo Sapiens
TQNDMVTGA

SEQ ID NO: 167937 - protein, 9 aa, Homo Sapiens
PEKKTWYLL

SEQ ID NO: 167938 - protein, 9 aa, Homo Sapiens
EHDGHPYCE

SEQ ID NO: 167939 - protein, 9 aa, Homo Sapiens
APSLLAQWF

SEQ ID NO: 167940 - protein, 9 aa, Homo Sapiens
DAVIRRFEE

SEQ ID NO: 167941 - protein, 9 aa, Homo Sapiens
ATMLGNTGT

SEQ ID NO: 167942 - protein, 9 aa, Homo Sapiens
AAALCIPLL

SEQ ID NO: 167943 - protein, 9 aa, Homo Sapiens
DFADGEHST

SEQ ID NO: 167944 - protein, 9 aa, Homo Sapiens
PPTCSFVQP

SEQ ID NO: 167945 - protein, 9 aa, Homo Sapiens
TYTIYINNM

SEQ ID NO: 167946 - protein, 9 aa, Homo Sapiens
RTTNPHSPG

SEQ ID NO: 167947 - protein, 9 aa, Homo Sapiens
ALRVPREKR

SEQ ID NO: 167948 - protein, 9 aa, Homo Sapiens
GLPAGAARG

SEQ ID NO: 167949 - protein, 9 aa, Homo Sapiens
LRCPLTAPL

SEQ ID NO: 167950 - protein, 9 aa, Homo Sapiens
SLHGHLFHL

SEQ ID NO: 167951 - protein, 9 aa, Homo Sapiens
HVLHFSTSP

SEQ ID NO: 167952 - protein, 9 aa, Homo Sapiens
SPNRKMKRR

SEQ ID NO: 167953 - protein, 9 aa, Homo Sapiens
GKVTGSTSD

SEQ ID NO: 167954 - protein, 9 aa, Homo Sapiens
ESLYPEVTP

SEQ ID NO: 167955 - protein, 9 aa, Homo Sapiens
TQDPSQSLG

SEQ ID NO: 167956 - protein, 9 aa, Homo Sapiens
TGHTAKIVT

SEQ ID NO: 167957 - protein, 9 aa, Homo Sapiens
KAKSHQVGK

SEQ ID NO: 167958 - protein, 9 aa, Homo Sapiens
PLCTPYCDT

SEQ ID NO: 167959 - protein, 9 aa, Homo Sapiens
IPWRRSHWS

SEQ ID NO: 167960 - protein, 9 aa, Homo Sapiens
SCGQCQACF

SEQ ID NO: 167961 - protein, 9 aa, Homo Sapiens
IDTFADLCS

SEQ ID NO: 167962 - protein, 9 aa, Homo Sapiens
FMIGAILHL

SEQ ID NO: 167963 - protein, 9 aa, Homo Sapiens
KCLTFLMLP

SEQ ID NO: 167964 - protein, 9 aa, Homo Sapiens
NLLCAPVPS

SEQ ID NO: 167965 - protein, 9 aa, Homo Sapiens
AGWCTTAAR

SEQ ID NO: 167966 - protein, 9 aa, Homo Sapiens
QASLGKMAL

SEQ ID NO: 167967 - protein, 9 aa, Homo Sapiens
HEVEVVPSN

SEQ ID NO: 167968 - protein, 9 aa, Homo Sapiens
VFNGALKHL

SEQ ID NO: 167969 - protein, 9 aa, Homo Sapiens
FRHKSRRLR

SEQ ID NO: 167970 - protein, 9 aa, Homo Sapiens
CRRRRARMS

SEQ ID NO: 167971 - protein, 9 aa, Homo Sapiens
KYICASNQN

SEQ ID NO: 167972 - protein, 9 aa, Homo Sapiens
GRPVSGHMD

SEQ ID NO: 167973 - protein, 9 aa, Homo Sapiens
EAVLSTIFT

SEQ ID NO: 167974 - protein, 9 aa, Homo Sapiens
WSCCRRRCR

SEQ ID NO: 167975 - protein, 9 aa, Homo Sapiens
RLNDDAKHY

SEQ ID NO: 167976 - protein, 9 aa, Homo Sapiens
LSESNKRLQ

SEQ ID NO: 167977 - protein, 9 aa, Homo Sapiens
LMTAMWLSA

SEQ ID NO: 167978 - protein, 9 aa, Homo Sapiens
ARSGGHSTD

SEQ ID NO: 167979 - protein, 9 aa, Homo Sapiens
MATYPDGFR

SEQ ID NO: 167980 - protein, 9 aa, Homo Sapiens
LTISLLHST

SEQ ID NO: 167981 - protein, 9 aa, Homo Sapiens
VSDNQRLKV

SEQ ID NO: 167982 - protein, 9 aa, Homo Sapiens
LGKMALQDY

SEQ ID NO: 167983 - protein, 9 aa, Homo Sapiens
SGTHQMRTA

SEQ ID NO: 167984 - protein, 9 aa, Homo Sapiens
ATVSLLFCY

SEQ ID NO: 167985 - protein, 9 aa, Homo Sapiens
HQLRADLLQ

SEQ ID NO: 167986 - protein, 9 aa, Homo Sapiens
ALRVTLFQA

SEQ ID NO: 167987 - protein, 9 aa, Homo Sapiens
AWVETFINV

SEQ ID NO: 167988 - protein, 9 aa, Homo Sapiens
CPLTAPLAC

SEQ ID NO: 167989 - protein, 9 aa, Homo Sapiens
GEPWDTERN

SEQ ID NO: 167990 - protein, 9 aa, Homo Sapiens
PQAPPKSSA

SEQ ID NO: 167991 - protein, 9 aa, Homo Sapiens
GSLDSRVVL

SEQ ID NO: 167992 - protein, 9 aa, Homo Sapiens
AVHQVIHTG

SEQ ID NO: 167993 - protein, 9 aa, Homo Sapiens
SGGWRNRLW

SEQ ID NO: 167994 - protein, 9 aa, Homo Sapiens
WSSPSASSL

SEQ ID NO: 167995 - protein, 9 aa, Homo Sapiens
ASRGPSTPA

SEQ ID NO: 167996 - protein, 9 aa, Homo Sapiens
IVTPETPEN

SEQ ID NO: 167997 - protein, 9 aa, Homo Sapiens
PENDLRHLP

SEQ ID NO: 167998 - protein, 9 aa, Homo Sapiens
PQSFLLLPP

SEQ ID NO: 167999 - protein, 9 aa, Homo Sapiens
KVSIQFERV

SEQ ID NO: 168000 - protein, 9 aa, Homo Sapiens
VFHFLRTLK

SEQ ID NO: 168001 - protein, 9 aa, Homo Sapiens
LESWQRLPP

SEQ ID NO: 168002 - protein, 9 aa, Homo Sapiens
EEEEEEAFI

SEQ ID NO: 168003 - protein, 9 aa, Homo Sapiens
ENAETETLA

SEQ ID NO: 168004 - protein, 9 aa, Homo Sapiens
ARAEVQHAA

SEQ ID NO: 168005 - protein, 9 aa, Homo Sapiens
TSKSESHVT

SEQ ID NO: 168006 - protein, 9 aa, Homo Sapiens
PRGKKLVSH

SEQ ID NO: 168007 - protein, 9 aa, Homo Sapiens
PDGQRLHLH

SEQ ID NO: 168008 - protein, 9 aa, Homo Sapiens
SVWLLFFLG

SEQ ID NO: 168009 - protein, 9 aa, Homo Sapiens
SIPQWYHVM

SEQ ID NO: 168010 - protein, 9 aa, Homo Sapiens
VKPFGDSQM

SEQ ID NO: 168011 - protein, 9 aa, Homo Sapiens
TYQVYNVFE

SEQ ID NO: 168012 - protein, 9 aa, Homo Sapiens
EDDALSIWP

SEQ ID NO: 168013 - protein, 9 aa, Homo Sapiens
CDKNLMNSG

SEQ ID NO: 168014 - protein, 9 aa, Homo Sapiens
GTSLSSGHI

SEQ ID NO: 168015 - protein, 9 aa, Homo Sapiens
VPCKNNSPL

SEQ ID NO: 168016 - protein, 9 aa, Homo Sapiens
WSLWVLPTI

SEQ ID NO: 168017 - protein, 9 aa, Homo Sapiens
GGCSLSSDT

SEQ ID NO: 168018 - protein, 9 aa, Homo Sapiens
HECTECDKV

SEQ ID NO: 168019 - protein, 9 aa, Homo Sapiens
KIMGVEEEE

SEQ ID NO: 168020 - protein, 9 aa, Homo Sapiens
AQDGSPSPL

SEQ ID NO: 168021 - protein, 9 aa, Homo Sapiens
AFSVATACV

SEQ ID NO: 168022 - protein, 9 aa, Homo Sapiens
TSTFAGEVP

SEQ ID NO: 168023 - protein, 9 aa, Homo Sapiens
MSQKLCLLL

SEQ ID NO: 168024 - protein, 9 aa, Homo Sapiens
PVVPPTTAA

SEQ ID NO: 168025 - protein, 9 aa, Homo Sapiens
EGKECRMSG

SEQ ID NO: 168026 - protein, 9 aa, Homo Sapiens
LFYHLQTQL

SEQ ID NO: 168027 - protein, 9 aa, Homo Sapiens
RPAGGGPPG

SEQ ID NO: 168028 - protein, 9 aa, Homo Sapiens
SYLYKLQTK

SEQ ID NO: 168029 - protein, 9 aa, Homo Sapiens
GPCASLLST

SEQ ID NO: 168030 - protein, 9 aa, Homo Sapiens
TAACPMTAC

SEQ ID NO: 168031 - protein, 9 aa, Homo Sapiens
VNDYFSPNR

SEQ ID NO: 168032 - protein, 9 aa, Homo Sapiens
AIIDFMHSA

SEQ ID NO: 168033 - protein, 9 aa, Homo Sapiens
EVLGYKIDR

SEQ ID NO: 168034 - protein, 9 aa, Homo Sapiens
STTRLSGIP

SEQ ID NO: 168035 - protein, 9 aa, Homo Sapiens
DCPDDDEDD

SEQ ID NO: 168036 - protein, 9 aa, Homo Sapiens
CLHDSRTSY

SEQ ID NO: 168037 - protein, 9 aa, Homo Sapiens
KAALWRETL

SEQ ID NO: 168038 - protein, 9 aa, Homo Sapiens
MRRAFKENR

SEQ ID NO: 168039 - protein, 9 aa, Homo Sapiens
GDTVSLQFT

SEQ ID NO: 168040 - protein, 9 aa, Homo Sapiens
LTISEKGFQ

SEQ ID NO: 168041 - protein, 9 aa, Homo Sapiens
TGLKGPAAS

SEQ ID NO: 168042 - protein, 9 aa, Homo Sapiens
VAASPSSSM

SEQ ID NO: 168043 - protein, 9 aa, Homo Sapiens
ASFHETLRC

SEQ ID NO: 168044 - protein, 9 aa, Homo Sapiens
GSLWPTLNL

SEQ ID NO: 168045 - protein, 9 aa, Homo Sapiens
TTTCPGPSW

SEQ ID NO: 168046 - protein, 9 aa, Homo Sapiens
CASLDGEEQ

SEQ ID NO: 168047 - protein, 9 aa, Homo Sapiens
KRLQLHLKE

SEQ ID NO: 168048 - protein, 9 aa, Homo Sapiens
SSGYGSSCC

SEQ ID NO: 168049 - protein, 9 aa, Homo Sapiens
LEKKGRRVT

SEQ ID NO: 168050 - protein, 9 aa, Homo Sapiens
QPPPQAPSQ

SEQ ID NO: 168051 - protein, 9 aa, Homo Sapiens
TWYRSLMPR

SEQ ID NO: 168052 - protein, 9 aa, Homo Sapiens
SHQKKLTVP

SEQ ID NO: 168053 - protein, 9 aa, Homo Sapiens
PFEKQFKCR

SEQ ID NO: 168054 - protein, 9 aa, Homo Sapiens
SNVQQHQKA

SEQ ID NO: 168055 - protein, 9 aa, Homo Sapiens
PRSDGTGPG

SEQ ID NO: 168056 - protein, 9 aa, Homo Sapiens
RLSPAGRNH

SEQ ID NO: 168057 - protein, 9 aa, Homo Sapiens
KPPSIYTIT

SEQ ID NO: 168058 - protein, 9 aa, Homo Sapiens
HENAKAKTD

SEQ ID NO: 168059 - protein, 9 aa, Homo Sapiens
KTLNALHLQ

SEQ ID NO: 168060 - protein, 9 aa, Homo Sapiens
GQHGCQPIS

SEQ ID NO: 168061 - protein, 9 aa, Homo Sapiens
FKKSKKSSH

SEQ ID NO: 168062 - protein, 9 aa, Homo Sapiens
GIVCASLDG

SEQ ID NO: 168063 - protein, 9 aa, Homo Sapiens
QEDLSYEES

SEQ ID NO: 168064 - protein, 9 aa, Homo Sapiens
SPTSWWAPP

SEQ ID NO: 168065 - protein, 9 aa, Homo Sapiens
TQPPQTALG

SEQ ID NO: 168066 - protein, 9 aa, Homo Sapiens
SMEGFWIEM

SEQ ID NO: 168067 - protein, 9 aa, Homo Sapiens
GPQNGHFRP

SEQ ID NO: 168068 - protein, 9 aa, Homo Sapiens
DPALAPAPA

SEQ ID NO: 168069 - protein, 9 aa, Homo Sapiens
EEITETESQ

SEQ ID NO: 168070 - protein, 9 aa, Homo Sapiens
MKEGTAMLL

SEQ ID NO: 168071 - protein, 9 aa, Homo Sapiens
DDMAGNEDR

SEQ ID NO: 168072 - protein, 9 aa, Homo Sapiens
SKRFSTAGE

SEQ ID NO: 168073 - protein, 9 aa, Homo Sapiens
SGCGTRKRC

SEQ ID NO: 168074 - protein, 9 aa, Homo Sapiens
QTTYVLIEA

SEQ ID NO: 168075 - protein, 9 aa, Homo Sapiens
IRIFRVLKL

SEQ ID NO: 168076 - protein, 9 aa, Homo Sapiens
ILFHLHRKG

SEQ ID NO: 168077 - protein, 9 aa, Homo Sapiens
PHPQVPPQL

SEQ ID NO: 168078 - protein, 9 aa, Homo Sapiens
PPSPPSSRT

SEQ ID NO: 168079 - protein, 9 aa, Homo Sapiens
CMGGRVAVK

SEQ ID NO: 168080 - protein, 9 aa, Homo Sapiens
TCSPAPRAC

SEQ ID NO: 168081 - protein, 9 aa, Homo Sapiens
ASAPLWASS

SEQ ID NO: 168082 - protein, 9 aa, Homo Sapiens
ATRPRGAGA

SEQ ID NO: 168083 - protein, 9 aa, Homo Sapiens
MWLSASHFT

SEQ ID NO: 168084 - protein, 9 aa, Homo Sapiens
VGGEVDLKN

SEQ ID NO: 168085 - protein, 9 aa, Homo Sapiens
AFIRRYSRY

SEQ ID NO: 168086 - protein, 9 aa, Homo Sapiens
GMESTALSR

SEQ ID NO: 168087 - protein, 9 aa, Homo Sapiens
EQIVLGKWV

SEQ ID NO: 168088 - protein, 9 aa, Homo Sapiens
GGGLRCTAS

SEQ ID NO: 168089 - protein, 9 aa, Homo Sapiens
QMVPPLPDS

SEQ ID NO: 168090 - protein, 9 aa, Homo Sapiens
EMHRKAKEL

SEQ ID NO: 168091 - protein, 9 aa, Homo Sapiens
LKSHIPYYR

SEQ ID NO: 168092 - protein, 9 aa, Homo Sapiens
APGDSHGRE

SEQ ID NO: 168093 - protein, 9 aa, Homo Sapiens
VYMYMARGL

SEQ ID NO: 168094 - protein, 9 aa, Homo Sapiens
NRRTIVQDQ

SEQ ID NO: 168095 - protein, 9 aa, Homo Sapiens
TRNCSSTSC

SEQ ID NO: 168096 - protein, 9 aa, Homo Sapiens
PLPHPPPVL

SEQ ID NO: 168097 - protein, 9 aa, Homo Sapiens
LSQFRGGSV

SEQ ID NO: 168098 - protein, 9 aa, Homo Sapiens
PSPTSLTFP

SEQ ID NO: 168099 - protein, 9 aa, Homo Sapiens
GSYDLTIRY

SEQ ID NO: 168100 - protein, 9 aa, Homo Sapiens
FKAIIDFMH

SEQ ID NO: 168101 - protein, 9 aa, Homo Sapiens
WDLVLLNGL

SEQ ID NO: 168102 - protein, 9 aa, Homo Sapiens
NEWFCCPEA

SEQ ID NO: 168103 - protein, 9 aa, Homo Sapiens
EKIEVWREN

SEQ ID NO: 168104 - protein, 9 aa, Homo Sapiens
PTSCPSWSP

SEQ ID NO: 168105 - protein, 9 aa, Homo Sapiens
NLQSSPSME

SEQ ID NO: 168106 - protein, 9 aa, Homo Sapiens
REKIINPTI

SEQ ID NO: 168107 - protein, 9 aa, Homo Sapiens
VATVETEVE

SEQ ID NO: 168108 - protein, 9 aa, Homo Sapiens
VKKGNAKKA

SEQ ID NO: 168109 - protein, 9 aa, Homo Sapiens
QRQATKDVG

SEQ ID NO: 168110 - protein, 9 aa, Homo Sapiens
PVLLCCSLL

SEQ ID NO: 168111 - protein, 9 aa, Homo Sapiens
ELPPAAATT

SEQ ID NO: 168112 - protein, 9 aa, Homo Sapiens
RFHSSPDLM

SEQ ID NO: 168113 - protein, 9 aa, Homo Sapiens
LPSRLYVPP

SEQ ID NO: 168114 - protein, 9 aa, Homo Sapiens
TSPSTFGMS

SEQ ID NO: 168115 - protein, 9 aa, Homo Sapiens
LCVSPYDPI

SEQ ID NO: 168116 - protein, 9 aa, Homo Sapiens
GIFRGDKWS

SEQ ID NO: 168117 - protein, 9 aa, Homo Sapiens
LSLVLCLLS

SEQ ID NO: 168118 - protein, 9 aa, Homo Sapiens
NLEGKKDSR

SEQ ID NO: 168119 - protein, 9 aa, Homo Sapiens
GNGEDLLEE

SEQ ID NO: 168120 - protein, 9 aa, Homo Sapiens
MHETSQIRA

SEQ ID NO: 168121 - protein, 9 aa, Homo Sapiens
PGTAQSNTT

SEQ ID NO: 168122 - protein, 9 aa, Homo Sapiens
PASARSPSR

SEQ ID NO: 168123 - protein, 9 aa, Homo Sapiens
RSFSSICRS

SEQ ID NO: 168124 - protein, 9 aa, Homo Sapiens
TSEEIQKKM

SEQ ID NO: 168125 - protein, 9 aa, Homo Sapiens
YTVASVLPL

SEQ ID NO: 168126 - protein, 9 aa, Homo Sapiens
CTRTSLEGV

SEQ ID NO: 168127 - protein, 9 aa, Homo Sapiens
TDQCLSFKR

SEQ ID NO: 168128 - protein, 9 aa, Homo Sapiens
ILHLQNQPY

SEQ ID NO: 168129 - protein, 9 aa, Homo Sapiens
VIRHIQVPQ

SEQ ID NO: 168130 - protein, 9 aa, Homo Sapiens
RPTSRARQS

SEQ ID NO: 168131 - protein, 9 aa, Homo Sapiens
GIWEVMPRT

SEQ ID NO: 168132 - protein, 9 aa, Homo Sapiens
ESTGNGPPT

SEQ ID NO: 168133 - protein, 9 aa, Homo Sapiens
HSPGASPMS

SEQ ID NO: 168134 - protein, 9 aa, Homo Sapiens
GRVARAAEH

SEQ ID NO: 168135 - protein, 9 aa, Homo Sapiens
RKEENAMIA

SEQ ID NO: 168136 - protein, 9 aa, Homo Sapiens
LHVYCALLA

SEQ ID NO: 168137 - protein, 9 aa, Homo Sapiens
FLLLTVVVQ

SEQ ID NO: 168138 - protein, 9 aa, Homo Sapiens
IWGAVECFV

SEQ ID NO: 168139 - protein, 9 aa, Homo Sapiens
SAAHSCQAL

SEQ ID NO: 168140 - protein, 9 aa, Homo Sapiens
NYVPQQEIS

SEQ ID NO: 168141 - protein, 9 aa, Homo Sapiens
LPLPPLPAP

SEQ ID NO: 168142 - protein, 9 aa, Homo Sapiens
KPPSNAQYL

SEQ ID NO: 168143 - protein, 9 aa, Homo Sapiens
TALNPILYA

SEQ ID NO: 168144 - protein, 9 aa, Homo Sapiens
LPVEELHVY

SEQ ID NO: 168145 - protein, 9 aa, Homo Sapiens
KSKKSSHCL

SEQ ID NO: 168146 - protein, 9 aa, Homo Sapiens
VGSPDNPDQ

SEQ ID NO: 168147 - protein, 9 aa, Homo Sapiens
REVLAKQGS

SEQ ID NO: 168148 - protein, 9 aa, Homo Sapiens
IVLCQLVLP

SEQ ID NO: 168149 - protein, 9 aa, Homo Sapiens
EGRARGLQG

SEQ ID NO: 168150 - protein, 9 aa, Homo Sapiens
DTNFPLRPF

SEQ ID NO: 168151 - protein, 9 aa, Homo Sapiens
LRVTMATYP

SEQ ID NO: 168152 - protein, 9 aa, Homo Sapiens
LIGTFACIC

SEQ ID NO: 168153 - protein, 9 aa, Homo Sapiens
SENTHRRET

SEQ ID NO: 168154 - protein, 9 aa, Homo Sapiens
AAPQARQGA

SEQ ID NO: 168155 - protein, 9 aa, Homo Sapiens
LPGSAAAPT

SEQ ID NO: 168156 - protein, 9 aa, Homo Sapiens
HKENTELEE

SEQ ID NO: 168157 - protein, 9 aa, Homo Sapiens
LWPPVACCH

SEQ ID NO: 168158 - protein, 9 aa, Homo Sapiens
DNDFLWNTV

SEQ ID NO: 168159 - protein, 9 aa, Homo Sapiens
ALARLPPAV

SEQ ID NO: 168160 - protein, 9 aa, Homo Sapiens
DKKSGTPPA

SEQ ID NO: 168161 - protein, 9 aa, Homo Sapiens
EELHVYCAL

SEQ ID NO: 168162 - protein, 9 aa, Homo Sapiens
TGHVVYQGT

SEQ ID NO: 168163 - protein, 9 aa, Homo Sapiens
THLTVNIRL

SEQ ID NO: 168164 - protein, 9 aa, Homo Sapiens
AGNHSYYRN

SEQ ID NO: 168165 - protein, 9 aa, Homo Sapiens
KKKKKKRER

SEQ ID NO: 168166 - protein, 9 aa, Homo Sapiens
STLHAHYIP

SEQ ID NO: 168167 - protein, 9 aa, Homo Sapiens
EYLSHGLMV

SEQ ID NO: 168168 - protein, 9 aa, Homo Sapiens
QWQESRLKC

SEQ ID NO: 168169 - protein, 9 aa, Homo Sapiens
LLVGGEVDL

SEQ ID NO: 168170 - protein, 9 aa, Homo Sapiens
ARQPSRPTG

SEQ ID NO: 168171 - protein, 9 aa, Homo Sapiens
VLEQMRYEG

SEQ ID NO: 168172 - protein, 9 aa, Homo Sapiens
LRDALDNIY

SEQ ID NO: 168173 - protein, 9 aa, Homo Sapiens
RAARVAFGS

SEQ ID NO: 168174 - protein, 9 aa, Homo Sapiens
GRVGVCKVM

SEQ ID NO: 168175 - protein, 9 aa, Homo Sapiens
GWRWRRGHR

SEQ ID NO: 168176 - protein, 9 aa, Homo Sapiens
SSRRSRPQG

SEQ ID NO: 168177 - protein, 9 aa, Homo Sapiens
GSGAGGTLQ

SEQ ID NO: 168178 - protein, 9 aa, Homo Sapiens
AMCEMNGKY

SEQ ID NO: 168179 - protein, 9 aa, Homo Sapiens
RVCQQVAGG

SEQ ID NO: 168180 - protein, 9 aa, Homo Sapiens
KPERSPKPG

SEQ ID NO: 168181 - protein, 9 aa, Homo Sapiens
SSQLAWCVD

SEQ ID NO: 168182 - protein, 9 aa, Homo Sapiens
MSAGAARRR

SEQ ID NO: 168183 - protein, 9 aa, Homo Sapiens
VVQRAEYRP

SEQ ID NO: 168184 - protein, 9 aa, Homo Sapiens
RHMLMEDFS

SEQ ID NO: 168185 - protein, 9 aa, Homo Sapiens
GPTAGGALS

SEQ ID NO: 168186 - protein, 9 aa, Homo Sapiens
KMKRRRKLK

SEQ ID NO: 168187 - protein, 9 aa, Homo Sapiens
KKSTAWFWV

SEQ ID NO: 168188 - protein, 9 aa, Homo Sapiens
RRLDGLASQ

SEQ ID NO: 168189 - protein, 9 aa, Homo Sapiens
QTQAITSCR

SEQ ID NO: 168190 - protein, 9 aa, Homo Sapiens
TVAMELLES

SEQ ID NO: 168191 - protein, 9 aa, Homo Sapiens
ACLHLPSPP

SEQ ID NO: 168192 - protein, 9 aa, Homo Sapiens
TPLAQHRPG

SEQ ID NO: 168193 - protein, 9 aa, Homo Sapiens
LCATTTCPG

SEQ ID NO: 168194 - protein, 9 aa, Homo Sapiens
RPALQAPPA

SEQ ID NO: 168195 - protein, 9 aa, Homo Sapiens
KKNASSHPA

SEQ ID NO: 168196 - protein, 9 aa, Homo Sapiens
SEGVEAQEA

SEQ ID NO: 168197 - protein, 9 aa, Homo Sapiens
ALASYRHLC

SEQ ID NO: 168198 - protein, 9 aa, Homo Sapiens
LESANARVT

SEQ ID NO: 168199 - protein, 9 aa, Homo Sapiens
PYSPRPPDF

SEQ ID NO: 168200 - protein, 9 aa, Homo Sapiens
EDAELRRWP

SEQ ID NO: 168201 - protein, 9 aa, Homo Sapiens
QFAQIGKVC

SEQ ID NO: 168202 - protein, 9 aa, Homo Sapiens
FVYCLSQLC

SEQ ID NO: 168203 - protein, 9 aa, Homo Sapiens
HPAARSSSC

SEQ ID NO: 168204 - protein, 9 aa, Homo Sapiens
RLGTRDAHQ

SEQ ID NO: 168205 - protein, 9 aa, Homo Sapiens
QLISLKRIN

SEQ ID NO: 168206 - protein, 9 aa, Homo Sapiens
KHLRGGGSP

SEQ ID NO: 168207 - protein, 9 aa, Homo Sapiens
ARLARRYSD

SEQ ID NO: 168208 - protein, 9 aa, Homo Sapiens
GSPSRSAAC

SEQ ID NO: 168209 - protein, 9 aa, Homo Sapiens
LGPVWPRWT

SEQ ID NO: 168210 - protein, 9 aa, Homo Sapiens
PPQSLPPAT

SEQ ID NO: 168211 - protein, 9 aa, Homo Sapiens
GLEGDLQHA

SEQ ID NO: 168212 - protein, 9 aa, Homo Sapiens
PGAPEYNRP

SEQ ID NO: 168213 - protein, 9 aa, Homo Sapiens
KYQDSDGLY

SEQ ID NO: 168214 - protein, 9 aa, Homo Sapiens
RAGTGCSSQ

SEQ ID NO: 168215 - protein, 9 aa, Homo Sapiens
SLEWVMEMK

SEQ ID NO: 168216 - protein, 9 aa, Homo Sapiens
VSRPKPPIE

SEQ ID NO: 168217 - protein, 9 aa, Homo Sapiens
WLETLATKE

SEQ ID NO: 168218 - protein, 9 aa, Homo Sapiens
RLPRHCLHP

SEQ ID NO: 168219 - protein, 9 aa, Homo Sapiens
WWVWGPPTC

SEQ ID NO: 168220 - protein, 9 aa, Homo Sapiens
SRVRSDVLD

SEQ ID NO: 168221 - protein, 9 aa, Homo Sapiens
CFSLKTPNS

SEQ ID NO: 168222 - protein, 9 aa, Homo Sapiens
IRDRCSSIY

SEQ ID NO: 168223 - protein, 9 aa, Homo Sapiens
TIATGKGPL

SEQ ID NO: 168224 - protein, 9 aa, Homo Sapiens
ISYCQGTGM

SEQ ID NO: 168225 - protein, 9 aa, Homo Sapiens
RSETLNLSL

SEQ ID NO: 168226 - protein, 9 aa, Homo Sapiens
EWYERALQV

SEQ ID NO: 168227 - protein, 9 aa, Homo Sapiens
HGRRHLRVP

SEQ ID NO: 168228 - protein, 9 aa, Homo Sapiens
WNDVPCIFE

SEQ ID NO: 168229 - protein, 9 aa, Homo Sapiens
IVLAYVGHA

SEQ ID NO: 168230 - protein, 9 aa, Homo Sapiens
FNGCSRMNS

SEQ ID NO: 168231 - protein, 9 aa, Homo Sapiens
GAVATTMSS

SEQ ID NO: 168232 - protein, 9 aa, Homo Sapiens
GLKHSTRGL

SEQ ID NO: 168233 - protein, 9 aa, Homo Sapiens
GGLIAGSLD

SEQ ID NO: 168234 - protein, 9 aa, Homo Sapiens
HIDTCLSVI

SEQ ID NO: 168235 - protein, 9 aa, Homo Sapiens
KIIDTKNLY

SEQ ID NO: 168236 - protein, 9 aa, Homo Sapiens
DTDIDSFIQ

SEQ ID NO: 168237 - protein, 9 aa, Homo Sapiens
GAGGSTAAR

SEQ ID NO: 168238 - protein, 9 aa, Homo Sapiens
ITTQENDME

SEQ ID NO: 168239 - protein, 9 aa, Homo Sapiens
EPTCHNRTR

SEQ ID NO: 168240 - protein, 9 aa, Homo Sapiens
VAIRTCLLT

SEQ ID NO: 168241 - protein, 9 aa, Homo Sapiens
PCKDRKLDR

SEQ ID NO: 168242 - protein, 9 aa, Homo Sapiens
TILLIRGDR

SEQ ID NO: 168243 - protein, 9 aa, Homo Sapiens
NQIQTVPTE

SEQ ID NO: 168244 - protein, 9 aa, Homo Sapiens
ARCRRRRAR

SEQ ID NO: 168245 - protein, 9 aa, Homo Sapiens
LLPGEAAPS

SEQ ID NO: 168246 - protein, 9 aa, Homo Sapiens
IRGPHAPPT

SEQ ID NO: 168247 - protein, 9 aa, Homo Sapiens
PQVVKQKKT

SEQ ID NO: 168248 - protein, 9 aa, Homo Sapiens
GLPPCSSLW

SEQ ID NO: 168249 - protein, 9 aa, Homo Sapiens
VVSHIGSSF

SEQ ID NO: 168250 - protein, 9 aa, Homo Sapiens
MRFERFGCR

SEQ ID NO: 168251 - protein, 9 aa, Homo Sapiens
PAPESGPPP

SEQ ID NO: 168252 - protein, 9 aa, Homo Sapiens
ELIPNKKLT

SEQ ID NO: 168253 - protein, 9 aa, Homo Sapiens
AQSSSCLRS

SEQ ID NO: 168254 - protein, 9 aa, Homo Sapiens
DVHQPQHLG

SEQ ID NO: 168255 - protein, 9 aa, Homo Sapiens
ITYSVYMYM

SEQ ID NO: 168256 - protein, 9 aa, Homo Sapiens
SVGSTRCGS

SEQ ID NO: 168257 - protein, 9 aa, Homo Sapiens
EGGRKSVHT

SEQ ID NO: 168258 - protein, 9 aa, Homo Sapiens
KISLPKKKK

SEQ ID NO: 168259 - protein, 9 aa, Homo Sapiens
YSPSVSSAT

SEQ ID NO: 168260 - protein, 9 aa, Homo Sapiens
IPSPSAHSS

SEQ ID NO: 168261 - protein, 9 aa, Homo Sapiens
PAGGGPPGA

SEQ ID NO: 168262 - protein, 9 aa, Homo Sapiens
YKKSTAWFW

SEQ ID NO: 168263 - protein, 9 aa, Homo Sapiens
DKPLSDPTP

SEQ ID NO: 168264 - protein, 9 aa, Homo Sapiens
YHLQGRMTY

SEQ ID NO: 168265 - protein, 9 aa, Homo Sapiens
EMCDHDYDV

SEQ ID NO: 168266 - protein, 9 aa, Homo Sapiens
KEATTETTS

SEQ ID NO: 168267 - protein, 9 aa, Homo Sapiens
DVAEPKVLF

SEQ ID NO: 168268 - protein, 9 aa, Homo Sapiens
TCLSVIAQA

SEQ ID NO: 168269 - protein, 9 aa, Homo Sapiens
MSYFVPEGS

SEQ ID NO: 168270 - protein, 9 aa, Homo Sapiens
FDWVVSHIG

SEQ ID NO: 168271 - protein, 9 aa, Homo Sapiens
RAVATRPRG

SEQ ID NO: 168272 - protein, 9 aa, Homo Sapiens
MKKHAHLTD

SEQ ID NO: 168273 - protein, 9 aa, Homo Sapiens
GFPEDLWNI

SEQ ID NO: 168274 - protein, 9 aa, Homo Sapiens
TLHAHYIPP

SEQ ID NO: 168275 - protein, 9 aa, Homo Sapiens
EGHVGTVRR

SEQ ID NO: 168276 - protein, 9 aa, Homo Sapiens
GTCFRCCSQ

SEQ ID NO: 168277 - protein, 9 aa, Homo Sapiens
GFKVLNMAA

SEQ ID NO: 168278 - protein, 9 aa, Homo Sapiens
TAKRETSEE

SEQ ID NO: 168279 - protein, 9 aa, Homo Sapiens
NLIRNHITE

SEQ ID NO: 168280 - protein, 9 aa, Homo Sapiens
HTLTLALIW

SEQ ID NO: 168281 - protein, 9 aa, Homo Sapiens
PRYAPNVQG

SEQ ID NO: 168282 - protein, 9 aa, Homo Sapiens
NHMQSGLWV

SEQ ID NO: 168283 - protein, 9 aa, Homo Sapiens
ESLTCGQLA

SEQ ID NO: 168284 - protein, 9 aa, Homo Sapiens
AEAEDRYKS

SEQ ID NO: 168285 - protein, 9 aa, Homo Sapiens
YFNIDPNAM

SEQ ID NO: 168286 - protein, 9 aa, Homo Sapiens
PASHPLFGR

SEQ ID NO: 168287 - protein, 9 aa, Homo Sapiens
VELSCKGRC

SEQ ID NO: 168288 - protein, 9 aa, Homo Sapiens
LMGAFASMD

SEQ ID NO: 168289 - protein, 9 aa, Homo Sapiens
VSEERLWSV

SEQ ID NO: 168290 - protein, 9 aa, Homo Sapiens
MLLALRLRH

SEQ ID NO: 168291 - protein, 9 aa, Homo Sapiens
GGQRSMNLE

SEQ ID NO: 168292 - protein, 9 aa, Homo Sapiens
SWPWVPQVP

SEQ ID NO: 168293 - protein, 9 aa, Homo Sapiens
SAGARPPAG

SEQ ID NO: 168294 - protein, 9 aa, Homo Sapiens
HPRGTPPGP

SEQ ID NO: 168295 - protein, 9 aa, Homo Sapiens
DHHHACGHS

SEQ ID NO: 168296 - protein, 9 aa, Homo Sapiens
YLNHHVPRT

SEQ ID NO: 168297 - protein, 9 aa, Homo Sapiens
GSNILMTEE

SEQ ID NO: 168298 - protein, 9 aa, Homo Sapiens
HGWASVPGL

SEQ ID NO: 168299 - protein, 9 aa, Homo Sapiens
YNYVYRASQ

SEQ ID NO: 168300 - protein, 9 aa, Homo Sapiens
GMGATVATL

SEQ ID NO: 168301 - protein, 9 aa, Homo Sapiens
PVLEHFLQV

SEQ ID NO: 168302 - protein, 9 aa, Homo Sapiens
WRLGRWIQT

SEQ ID NO: 168303 - protein, 9 aa, Homo Sapiens
SVLPLLFLL

SEQ ID NO: 168304 - protein, 9 aa, Homo Sapiens
QNDMVTGAN

SEQ ID NO: 168305 - protein, 9 aa, Homo Sapiens
LWLMTAMWL

SEQ ID NO: 168306 - protein, 9 aa, Homo Sapiens
SMNLESLTC

SEQ ID NO: 168307 - protein, 9 aa, Homo Sapiens
LSRVVLVCA

SEQ ID NO: 168308 - protein, 9 aa, Homo Sapiens
QFTQLNTLQ

SEQ ID NO: 168309 - protein, 9 aa, Homo Sapiens
VCQQVAGGG

SEQ ID NO: 168310 - protein, 9 aa, Homo Sapiens
HAQLAESLG

SEQ ID NO: 168311 - protein, 9 aa, Homo Sapiens
GNEEAYGCS

SEQ ID NO: 168312 - protein, 9 aa, Homo Sapiens
ETCLNWVFK

SEQ ID NO: 168313 - protein, 9 aa, Homo Sapiens
GAPYAEENE

SEQ ID NO: 168314 - protein, 9 aa, Homo Sapiens
IPSSLRIGI

SEQ ID NO: 168315 - protein, 9 aa, Homo Sapiens
VAGPGPPPL

SEQ ID NO: 168316 - protein, 9 aa, Homo Sapiens
KMQKRRAAI

SEQ ID NO: 168317 - protein, 9 aa, Homo Sapiens
GARPPAGLS

SEQ ID NO: 168318 - protein, 9 aa, Homo Sapiens
FILVWGPQH

SEQ ID NO: 168319 - protein, 9 aa, Homo Sapiens
GEKIVALMS

SEQ ID NO: 168320 - protein, 9 aa, Homo Sapiens
RGFAEGRRR

SEQ ID NO: 168321 - protein, 9 aa, Homo Sapiens
EYGFLPVSL

SEQ ID NO: 168322 - protein, 9 aa, Homo Sapiens
SAPPFLGVL

SEQ ID NO: 168323 - protein, 9 aa, Homo Sapiens
VRRSHLLLP

SEQ ID NO: 168324 - protein, 9 aa, Homo Sapiens
KPSRMLGSC

SEQ ID NO: 168325 - protein, 9 aa, Homo Sapiens
RLRYAPLGG

SEQ ID NO: 168326 - protein, 9 aa, Homo Sapiens
MLKGRPKLG

SEQ ID NO: 168327 - protein, 9 aa, Homo Sapiens
QAIQMACQG

SEQ ID NO: 168328 - protein, 9 aa, Homo Sapiens
PKLHFASRI

SEQ ID NO: 168329 - protein, 9 aa, Homo Sapiens
CPHCGAHYK

SEQ ID NO: 168330 - protein, 9 aa, Homo Sapiens
GEAEWHKLL

SEQ ID NO: 168331 - protein, 9 aa, Homo Sapiens
NPVQEFHFS

SEQ ID NO: 168332 - protein, 9 aa, Homo Sapiens
SPSRRARPA

SEQ ID NO: 168333 - protein, 9 aa, Homo Sapiens
SAFLNRMNQ

SEQ ID NO: 168334 - protein, 9 aa, Homo Sapiens
SSSSAPVVV

SEQ ID NO: 168335 - protein, 9 aa, Homo Sapiens
DSQDTLDRE

SEQ ID NO: 168336 - protein, 9 aa, Homo Sapiens
IHCWLSPPL

SEQ ID NO: 168337 - protein, 9 aa, Homo Sapiens
QNPEKLALK

SEQ ID NO: 168338 - protein, 9 aa, Homo Sapiens
QNGVLDFFS

SEQ ID NO: 168339 - protein, 9 aa, Homo Sapiens
SERNLKCFL

SEQ ID NO: 168340 - protein, 9 aa, Homo Sapiens
PEIQNNQKK

SEQ ID NO: 168341 - protein, 9 aa, Homo Sapiens
GACKICQKW

SEQ ID NO: 168342 - protein, 9 aa, Homo Sapiens
MDVYYQRNM

SEQ ID NO: 168343 - protein, 9 aa, Homo Sapiens
REETAVCRL

SEQ ID NO: 168344 - protein, 9 aa, Homo Sapiens
AEKMDFRNM

SEQ ID NO: 168345 - protein, 9 aa, Homo Sapiens
KKSKSQKTC

SEQ ID NO: 168346 - protein, 9 aa, Homo Sapiens
FFVLVNLEV

SEQ ID NO: 168347 - protein, 9 aa, Homo Sapiens
PGYLLPPEG

SEQ ID NO: 168348 - protein, 9 aa, Homo Sapiens
KGPAASLTP

SEQ ID NO: 168349 - protein, 9 aa, Homo Sapiens
SLEGVAAPR

SEQ ID NO: 168350 - protein, 9 aa, Homo Sapiens
IGRRPAHPL

SEQ ID NO: 168351 - protein, 9 aa, Homo Sapiens
NKGPLEMIK

SEQ ID NO: 168352 - protein, 9 aa, Homo Sapiens
VPTETIHLM

SEQ ID NO: 168353 - protein, 9 aa, Homo Sapiens
PKKELELHI

SEQ ID NO: 168354 - protein, 9 aa, Homo Sapiens
PQRSHFFLP

SEQ ID NO: 168355 - protein, 9 aa, Homo Sapiens
KPPRTPPHP

SEQ ID NO: 168356 - protein, 9 aa, Homo Sapiens
HGAWNSRES

SEQ ID NO: 168357 - protein, 9 aa, Homo Sapiens
HRDLRLWLT

SEQ ID NO: 168358 - protein, 9 aa, Homo Sapiens
VNLLCAPVP

SEQ ID NO: 168359 - protein, 9 aa, Homo Sapiens
GTRPPARRP

SEQ ID NO: 168360 - protein, 9 aa, Homo Sapiens
GKKILFHYP

SEQ ID NO: 168361 - protein, 9 aa, Homo Sapiens
AIVSTVQNY

SEQ ID NO: 168362 - protein, 9 aa, Homo Sapiens
SNFLNPPQG

SEQ ID NO: 168363 - protein, 9 aa, Homo Sapiens
PFLHENDLS

SEQ ID NO: 168364 - protein, 9 aa, Homo Sapiens
TIHNITKQT

SEQ ID NO: 168365 - protein, 9 aa, Homo Sapiens
LLRTPRGTH

SEQ ID NO: 168366 - protein, 9 aa, Homo Sapiens
RRRTVPGGP

SEQ ID NO: 168367 - protein, 9 aa, Homo Sapiens
ILYMKPHMK

SEQ ID NO: 168368 - protein, 9 aa, Homo Sapiens
LIVYLQHFR

SEQ ID NO: 168369 - protein, 9 aa, Homo Sapiens
VAAFHPRFH

SEQ ID NO: 168370 - protein, 9 aa, Homo Sapiens
TGVVAAMEE

SEQ ID NO: 168371 - protein, 9 aa, Homo Sapiens
YQVVPQIQA

SEQ ID NO: 168372 - protein, 9 aa, Homo Sapiens
CWHIHKKGR

SEQ ID NO: 168373 - protein, 9 aa, Homo Sapiens
TTLVVSSDA

SEQ ID NO: 168374 - protein, 9 aa, Homo Sapiens
PPLAPLLPL

SEQ ID NO: 168375 - protein, 9 aa, Homo Sapiens
VAGVGLAAS

SEQ ID NO: 168376 - protein, 9 aa, Homo Sapiens
QSFLLLPPT

SEQ ID NO: 168377 - protein, 9 aa, Homo Sapiens
AMEETVVVA

SEQ ID NO: 168378 - protein, 9 aa, Homo Sapiens
SCVGFPNVG

SEQ ID NO: 168379 - protein, 9 aa, Homo Sapiens
ILGQRATRH

SEQ ID NO: 168380 - protein, 9 aa, Homo Sapiens
DFGPRKDLD

SEQ ID NO: 168381 - protein, 9 aa, Homo Sapiens
APSCCRWGA

SEQ ID NO: 168382 - protein, 9 aa, Homo Sapiens
NTLRVTHSA

SEQ ID NO: 168383 - protein, 9 aa, Homo Sapiens
TASQMLAWL

SEQ ID NO: 168384 - protein, 9 aa, Homo Sapiens
DAHILRCQR

SEQ ID NO: 168385 - protein, 9 aa, Homo Sapiens
RQPSRPTGR

SEQ ID NO: 168386 - protein, 9 aa, Homo Sapiens
EVSPRIPDC

SEQ ID NO: 168387 - protein, 9 aa, Homo Sapiens
VGKTACSCS

SEQ ID NO: 168388 - protein, 9 aa, Homo Sapiens
VVSSDASTL

SEQ ID NO: 168389 - protein, 9 aa, Homo Sapiens
SQFSDPWPG

SEQ ID NO: 168390 - protein, 9 aa, Homo Sapiens
LQVTCLLLC

SEQ ID NO: 168391 - protein, 9 aa, Homo Sapiens
LPPAPAPWL

SEQ ID NO: 168392 - protein, 9 aa, Homo Sapiens
PHTTILVTG

SEQ ID NO: 168393 - protein, 9 aa, Homo Sapiens
PPPQAPSQV

SEQ ID NO: 168394 - protein, 9 aa, Homo Sapiens
WPSLPGPAA

SEQ ID NO: 168395 - protein, 9 aa, Homo Sapiens
NYVYRASQG

SEQ ID NO: 168396 - protein, 9 aa, Homo Sapiens
EDDINCGPT

SEQ ID NO: 168397 - protein, 9 aa, Homo Sapiens
LHAHYIPPV

SEQ ID NO: 168398 - protein, 9 aa, Homo Sapiens
CIHQESELH

SEQ ID NO: 168399 - protein, 9 aa, Homo Sapiens
TLSPSAVSS

SEQ ID NO: 168400 - protein, 9 aa, Homo Sapiens
GNHSYYRNP

SEQ ID NO: 168401 - protein, 9 aa, Homo Sapiens
QVTCLLLCR

SEQ ID NO: 168402 - protein, 9 aa, Homo Sapiens
SSWGTRLNC

SEQ ID NO: 168403 - protein, 9 aa, Homo Sapiens
TGNGPPTWP

SEQ ID NO: 168404 - protein, 9 aa, Homo Sapiens
TRKAAKRMH

SEQ ID NO: 168405 - protein, 9 aa, Homo Sapiens
VDDATWERM

SEQ ID NO: 168406 - protein, 9 aa, Homo Sapiens
HPMGWCTQN

SEQ ID NO: 168407 - protein, 9 aa, Homo Sapiens
EGCSIDTDI

SEQ ID NO: 168408 - protein, 9 aa, Homo Sapiens
NWLSICLYT

SEQ ID NO: 168409 - protein, 9 aa, Homo Sapiens
GLTWYRSLM

SEQ ID NO: 168410 - protein, 9 aa, Homo Sapiens
CHSSLCRQP

SEQ ID NO: 168411 - protein, 9 aa, Homo Sapiens
LYVPPPLTQ

SEQ ID NO: 168412 - protein, 9 aa, Homo Sapiens
LGLTRSRMA

SEQ ID NO: 168413 - protein, 9 aa, Homo Sapiens
ERRDRRPGP

SEQ ID NO: 168414 - protein, 9 aa, Homo Sapiens
VVLPPSLPR

SEQ ID NO: 168415 - protein, 9 aa, Homo Sapiens
PPVFSYSWP

SEQ ID NO: 168416 - protein, 9 aa, Homo Sapiens
LPAGKWLYH

SEQ ID NO: 168417 - protein, 9 aa, Homo Sapiens
PGRPWPPSF

SEQ ID NO: 168418 - protein, 9 aa, Homo Sapiens
ATQTGKGFI

SEQ ID NO: 168419 - protein, 9 aa, Homo Sapiens
TVNIRLCWD

SEQ ID NO: 168420 - protein, 9 aa, Homo Sapiens
AARGGGEAG

SEQ ID NO: 168421 - protein, 9 aa, Homo Sapiens
IPIRKYICA

SEQ ID NO: 168422 - protein, 9 aa, Homo Sapiens
MYSRLREII

SEQ ID NO: 168423 - protein, 9 aa, Homo Sapiens
VLVVLSLIL

SEQ ID NO: 168424 - protein, 9 aa, Homo Sapiens
AKSHQVGKE

SEQ ID NO: 168425 - protein, 9 aa, Homo Sapiens
YHLQTQLCT

SEQ ID NO: 168426 - protein, 9 aa, Homo Sapiens
RTGMFTVRM

SEQ ID NO: 168427 - protein, 9 aa, Homo Sapiens
GILYMKPHM

SEQ ID NO: 168428 - protein, 9 aa, Homo Sapiens
QFSGQACYR

SEQ ID NO: 168429 - protein, 9 aa, Homo Sapiens
QPRHGHPGS

SEQ ID NO: 168430 - protein, 9 aa, Homo Sapiens
STSPSTFGM

SEQ ID NO: 168431 - protein, 9 aa, Homo Sapiens
ACTRTSLEG

SEQ ID NO: 168432 - protein, 9 aa, Homo Sapiens
SVPENISSR

SEQ ID NO: 168433 - protein, 9 aa, Homo Sapiens
LPVSQHTLK

SEQ ID NO: 168434 - protein, 9 aa, Homo Sapiens
NVGTPLLVF

SEQ ID NO: 168435 - protein, 9 aa, Homo Sapiens
ASYSPSVSS

SEQ ID NO: 168436 - protein, 9 aa, Homo Sapiens
LRNRLPALT

SEQ ID NO: 168437 - protein, 9 aa, Homo Sapiens
ELSLSPSHP

SEQ ID NO: 168438 - protein, 9 aa, Homo Sapiens
LAQKLTAAL

SEQ ID NO: 168439 - protein, 9 aa, Homo Sapiens
RIPDCQGSK

SEQ ID NO: 168440 - protein, 9 aa, Homo Sapiens
PIDVHQPQH

SEQ ID NO: 168441 - protein, 9 aa, Homo Sapiens
HDYDVLLPK

SEQ ID NO: 168442 - protein, 9 aa, Homo Sapiens
TDDSPVNLL

SEQ ID NO: 168443 - protein, 9 aa, Homo Sapiens
GPAWSLTLS

SEQ ID NO: 168444 - protein, 9 aa, Homo Sapiens
VYNVFEPNQ

SEQ ID NO: 168445 - protein, 9 aa, Homo Sapiens
GSMRAIRIV

SEQ ID NO: 168446 - protein, 9 aa, Homo Sapiens
DMGAAVLCT

SEQ ID NO: 168447 - protein, 9 aa, Homo Sapiens
KECRNWQDN

SEQ ID NO: 168448 - protein, 9 aa, Homo Sapiens
TTLSSVIFP

SEQ ID NO: 168449 - protein, 9 aa, Homo Sapiens
ACICPPGMR

SEQ ID NO: 168450 - protein, 9 aa, Homo Sapiens
TNPHSPGPG

SEQ ID NO: 168451 - protein, 9 aa, Homo Sapiens
DQDRPWKWR

SEQ ID NO: 168452 - protein, 9 aa, Homo Sapiens
QCYALLQGH

SEQ ID NO: 168453 - protein, 9 aa, Homo Sapiens
ETPVVCHDE

SEQ ID NO: 168454 - protein, 9 aa, Homo Sapiens
SCPGPRRAW

SEQ ID NO: 168455 - protein, 9 aa, Homo Sapiens
LTVLAENLC

SEQ ID NO: 168456 - protein, 9 aa, Homo Sapiens
SDGRGENVG

SEQ ID NO: 168457 - protein, 9 aa, Homo Sapiens
PNQTKGLLR

SEQ ID NO: 168458 - protein, 9 aa, Homo Sapiens
LKAGNVSKD

SEQ ID NO: 168459 - protein, 9 aa, Homo Sapiens
PGACRPACT

SEQ ID NO: 168460 - protein, 9 aa, Homo Sapiens
KDGVVTISC

SEQ ID NO: 168461 - protein, 9 aa, Homo Sapiens
TLYLNLHAY

SEQ ID NO: 168462 - protein, 9 aa, Homo Sapiens
NPESPVDTC

SEQ ID NO: 168463 - protein, 9 aa, Homo Sapiens
KGRKDRRPC

SEQ ID NO: 168464 - protein, 9 aa, Homo Sapiens
ILLLFIVYA

SEQ ID NO: 168465 - protein, 9 aa, Homo Sapiens
AALFLTTTS

SEQ ID NO: 168466 - protein, 9 aa, Homo Sapiens
QFPHRQKGQ

SEQ ID NO: 168467 - protein, 9 aa, Homo Sapiens
EERDVGHEG

SEQ ID NO: 168468 - protein, 9 aa, Homo Sapiens
DGKELNRGR

SEQ ID NO: 168469 - protein, 9 aa, Homo Sapiens
WLLRTPAPQ

SEQ ID NO: 168470 - protein, 9 aa, Homo Sapiens
LWILWLITQ

SEQ ID NO: 168471 - protein, 9 aa, Homo Sapiens
FRPPVDTRA

SEQ ID NO: 168472 - protein, 9 aa, Homo Sapiens
KPVRCPVPV

SEQ ID NO: 168473 - protein, 9 aa, Homo Sapiens
SPVPPPAAT

SEQ ID NO: 168474 - protein, 9 aa, Homo Sapiens
KHLDDITWY

SEQ ID NO: 168475 - protein, 9 aa, Homo Sapiens
TPHCQPRSP

SEQ ID NO: 168476 - protein, 9 aa, Homo Sapiens
CVDFLIQKG

SEQ ID NO: 168477 - protein, 9 aa, Homo Sapiens
LHFPTVIRQ

SEQ ID NO: 168478 - protein, 9 aa, Homo Sapiens
ENAMIAKMN

SEQ ID NO: 168479 - protein, 9 aa, Homo Sapiens
SPRFCPDTW

SEQ ID NO: 168480 - protein, 9 aa, Homo Sapiens
TMEVLYSGW

SEQ ID NO: 168481 - protein, 9 aa, Homo Sapiens
HKTGQIDKS

SEQ ID NO: 168482 - protein, 9 aa, Homo Sapiens
GRNSFEVCV

SEQ ID NO: 168483 - protein, 9 aa, Homo Sapiens
ANSESESDI

SEQ ID NO: 168484 - protein, 9 aa, Homo Sapiens
LLKEEQTPR

SEQ ID NO: 168485 - protein, 9 aa, Homo Sapiens
NNFFNESMK

SEQ ID NO: 168486 - protein, 9 aa, Homo Sapiens
ASCPGPRRA

SEQ ID NO: 168487 - protein, 9 aa, Homo Sapiens
DISACTYER

SEQ ID NO: 168488 - protein, 9 aa, Homo Sapiens
IHNITKQTQ

SEQ ID NO: 168489 - protein, 9 aa, Homo Sapiens
WRAGFQWGE

SEQ ID NO: 168490 - protein, 9 aa, Homo Sapiens
QLRLQAETL

SEQ ID NO: 168491 - protein, 9 aa, Homo Sapiens
LDVSHHLNA

SEQ ID NO: 168492 - protein, 9 aa, Homo Sapiens
ASFPPSVSV

SEQ ID NO: 168493 - protein, 9 aa, Homo Sapiens
KHTSRSLRI

SEQ ID NO: 168494 - protein, 9 aa, Homo Sapiens
TYVLIEAIT

SEQ ID NO: 168495 - protein, 9 aa, Homo Sapiens
GFDTYFGCL

SEQ ID NO: 168496 - protein, 9 aa, Homo Sapiens
TIVQDQGCL

SEQ ID NO: 168497 - protein, 9 aa, Homo Sapiens
CAEERDTHN

SEQ ID NO: 168498 - protein, 9 aa, Homo Sapiens
PQQQLQQRL

SEQ ID NO: 168499 - protein, 9 aa, Homo Sapiens
RRLRLCYMA

SEQ ID NO: 168500 - protein, 9 aa, Homo Sapiens
GWSDMNSNL

SEQ ID NO: 168501 - protein, 9 aa, Homo Sapiens
DLLWGVGAA

SEQ ID NO: 168502 - protein, 9 aa, Homo Sapiens
TMYTTCIIC

SEQ ID NO: 168503 - protein, 9 aa, Homo Sapiens
MPPLLHPQW

SEQ ID NO: 168504 - protein, 9 aa, Homo Sapiens
SLAGRGLPS

SEQ ID NO: 168505 - protein, 9 aa, Homo Sapiens
LNEGNHTLT

SEQ ID NO: 168506 - protein, 9 aa, Homo Sapiens
HWPCRLTID

SEQ ID NO: 168507 - protein, 9 aa, Homo Sapiens
TMSSAGDHN

SEQ ID NO: 168508 - protein, 9 aa, Homo Sapiens
GRYYMSAHH

SEQ ID NO: 168509 - protein, 9 aa, Homo Sapiens
QKLCLLLVV

SEQ ID NO: 168510 - protein, 9 aa, Homo Sapiens
FPEAISSSV

SEQ ID NO: 168511 - protein, 9 aa, Homo Sapiens
ACGGRERRD

SEQ ID NO: 168512 - protein, 9 aa, Homo Sapiens
RKSLKLKMT

SEQ ID NO: 168513 - protein, 9 aa, Homo Sapiens
TLQPRGSAG

SEQ ID NO: 168514 - protein, 9 aa, Homo Sapiens
GAIPRKAPC

SEQ ID NO: 168515 - protein, 9 aa, Homo Sapiens
AQECRLVGP

SEQ ID NO: 168516 - protein, 9 aa, Homo Sapiens
LLTTMPPAS

SEQ ID NO: 168517 - protein, 9 aa, Homo Sapiens
DQSLHGHLF

SEQ ID NO: 168518 - protein, 9 aa, Homo Sapiens
VQPGHLVVQ

SEQ ID NO: 168519 - protein, 9 aa, Homo Sapiens
TVYQTVTHP

SEQ ID NO: 168520 - protein, 9 aa, Homo Sapiens
TELIPNKKL

SEQ ID NO: 168521 - protein, 9 aa, Homo Sapiens
KGNAKKALK

SEQ ID NO: 168522 - protein, 9 aa, Homo Sapiens
RFGCRRVII

SEQ ID NO: 168523 - protein, 9 aa, Homo Sapiens
IDLGHELSS

SEQ ID NO: 168524 - protein, 9 aa, Homo Sapiens
SVMSCSLLT

SEQ ID NO: 168525 - protein, 9 aa, Homo Sapiens
RTKAPPVGS

SEQ ID NO: 168526 - protein, 9 aa, Homo Sapiens
SEGSRCAPA

SEQ ID NO: 168527 - protein, 9 aa, Homo Sapiens
GCISVKDHR

SEQ ID NO: 168528 - protein, 9 aa, Homo Sapiens
ACTYERTLM

SEQ ID NO: 168529 - protein, 9 aa, Homo Sapiens
RHRPSLRPR

SEQ ID NO: 168530 - protein, 9 aa, Homo Sapiens
IGHDAGGWL

SEQ ID NO: 168531 - protein, 9 aa, Homo Sapiens
GSNISKKVS

SEQ ID NO: 168532 - protein, 9 aa, Homo Sapiens
SNKMLQSMG

SEQ ID NO: 168533 - protein, 9 aa, Homo Sapiens
DDALSIWPL

SEQ ID NO: 168534 - protein, 9 aa, Homo Sapiens
FGLWFRLFH

SEQ ID NO: 168535 - protein, 9 aa, Homo Sapiens
HFVNGAVAN

SEQ ID NO: 168536 - protein, 9 aa, Homo Sapiens
ASHEMDHIS

SEQ ID NO: 168537 - protein, 9 aa, Homo Sapiens
TQREPLSSE

SEQ ID NO: 168538 - protein, 9 aa, Homo Sapiens
VSLQERGGV

SEQ ID NO: 168539 - protein, 9 aa, Homo Sapiens
VEHPHALAG

SEQ ID NO: 168540 - protein, 9 aa, Homo Sapiens
KIGFWRHLE

SEQ ID NO: 168541 - protein, 9 aa, Homo Sapiens
ITEPNQRTD

SEQ ID NO: 168542 - protein, 9 aa, Homo Sapiens
CSSTSCGSC

SEQ ID NO: 168543 - protein, 9 aa, Homo Sapiens
KPGGRHVGT

SEQ ID NO: 168544 - protein, 9 aa, Homo Sapiens
RILRGHDGL

SEQ ID NO: 168545 - protein, 9 aa, Homo Sapiens
GDPPVNYVP

SEQ ID NO: 168546 - protein, 9 aa, Homo Sapiens
VADFLQVLK

SEQ ID NO: 168547 - protein, 9 aa, Homo Sapiens
LAFKKSKKS

SEQ ID NO: 168548 - protein, 9 aa, Homo Sapiens
GGWLKIDSR

SEQ ID NO: 168549 - protein, 9 aa, Homo Sapiens
EGVEAQEAE

SEQ ID NO: 168550 - protein, 9 aa, Homo Sapiens
EPGKCTVCK

SEQ ID NO: 168551 - protein, 9 aa, Homo Sapiens
KEDSTVNRD

SEQ ID NO: 168552 - protein, 9 aa, Homo Sapiens
GLTSAVTPL

SEQ ID NO: 168553 - protein, 9 aa, Homo Sapiens
VPHSLLFRH

SEQ ID NO: 168554 - protein, 9 aa, Homo Sapiens
KSGWRCVRI

SEQ ID NO: 168555 - protein, 9 aa, Homo Sapiens
EAHGRRHLR

SEQ ID NO: 168556 - protein, 9 aa, Homo Sapiens
VAVAAWGWE

SEQ ID NO: 168557 - protein, 9 aa, Homo Sapiens
PHPPPVLHC

SEQ ID NO: 168558 - protein, 9 aa, Homo Sapiens
GGHIAALTL

SEQ ID NO: 168559 - protein, 9 aa, Homo Sapiens
SGLYYNGFK

SEQ ID NO: 168560 - protein, 9 aa, Homo Sapiens
EKGYCFVYC

SEQ ID NO: 168561 - protein, 9 aa, Homo Sapiens
KEGATIHNI

SEQ ID NO: 168562 - protein, 9 aa, Homo Sapiens
VRRDSIFRS

SEQ ID NO: 168563 - protein, 9 aa, Homo Sapiens
KSHIPYYRE

SEQ ID NO: 168564 - protein, 9 aa, Homo Sapiens
WVETFINVK

SEQ ID NO: 168565 - protein, 9 aa, Homo Sapiens
LFDVLLLLA

SEQ ID NO: 168566 - protein, 9 aa, Homo Sapiens
CYPERITIL

SEQ ID NO: 168567 - protein, 9 aa, Homo Sapiens
SWLLRTPAP

SEQ ID NO: 168568 - protein, 9 aa, Homo Sapiens
SELRITTQE

SEQ ID NO: 168569 - protein, 9 aa, Homo Sapiens
SSICRSSTF

SEQ ID NO: 168570 - protein, 9 aa, Homo Sapiens
VTAIQGDMT

SEQ ID NO: 168571 - protein, 9 aa, Homo Sapiens
ATEETEVAM

SEQ ID NO: 168572 - protein, 9 aa, Homo Sapiens
AAPTLPRAL

SEQ ID NO: 168573 - protein, 9 aa, Homo Sapiens
GQDLNEGNH

SEQ ID NO: 168574 - protein, 9 aa, Homo Sapiens
KKGRRVTQA

SEQ ID NO: 168575 - protein, 9 aa, Homo Sapiens
QRLRRARVT

SEQ ID NO: 168576 - protein, 9 aa, Homo Sapiens
PGEEVATVA

SEQ ID NO: 168577 - protein, 9 aa, Homo Sapiens
PPVGSGSPR

SEQ ID NO: 168578 - protein, 9 aa, Homo Sapiens
ARQARAQDR

SEQ ID NO: 168579 - protein, 9 aa, Homo Sapiens
GRRQVPLLP

SEQ ID NO: 168580 - protein, 9 aa, Homo Sapiens
VPPEGDAHI

SEQ ID NO: 168581 - protein, 9 aa, Homo Sapiens
VLTPRAGSR

SEQ ID NO: 168582 - protein, 9 aa, Homo Sapiens
QAVRCPVPV

SEQ ID NO: 168583 - protein, 9 aa, Homo Sapiens
KLQTKWMLQ

SEQ ID NO: 168584 - protein, 9 aa, Homo Sapiens
PKARRSSWQ

SEQ ID NO: 168585 - protein, 9 aa, Homo Sapiens
KDNRQCDTV

SEQ ID NO: 168586 - protein, 9 aa, Homo Sapiens
RCQTLLGLI

SEQ ID NO: 168587 - protein, 9 aa, Homo Sapiens
QQDSFPTRT

SEQ ID NO: 168588 - protein, 9 aa, Homo Sapiens
QGGCLLLLS

SEQ ID NO: 168589 - protein, 9 aa, Homo Sapiens
FLFFFSFFY

SEQ ID NO: 168590 - protein, 9 aa, Homo Sapiens
HPARTLARP

SEQ ID NO: 168591 - protein, 9 aa, Homo Sapiens
MAPGTPGIR

SEQ ID NO: 168592 - protein, 9 aa, Homo Sapiens
GCCPSAWRT

SEQ ID NO: 168593 - protein, 9 aa, Homo Sapiens
TLNLSLGVH

SEQ ID NO: 168594 - protein, 9 aa, Homo Sapiens
VKLVAIRTC

SEQ ID NO: 168595 - protein, 9 aa, Homo Sapiens
ACKICQKWP

SEQ ID NO: 168596 - protein, 9 aa, Homo Sapiens
FHLVTRFVN

SEQ ID NO: 168597 - protein, 9 aa, Homo Sapiens
VQQHQKAAL

SEQ ID NO: 168598 - protein, 9 aa, Homo Sapiens
DTSTAKAAR

SEQ ID NO: 168599 - protein, 9 aa, Homo Sapiens
LSTEGAPDF

SEQ ID NO: 168600 - protein, 9 aa, Homo Sapiens
GYYQCVATA

SEQ ID NO: 168601 - protein, 9 aa, Homo Sapiens
RKYICASNQ

SEQ ID NO: 168602 - protein, 9 aa, Homo Sapiens
EGFWIEMEQ

SEQ ID NO: 168603 - protein, 9 aa, Homo Sapiens
AHVDVRAID

SEQ ID NO: 168604 - protein, 9 aa, Homo Sapiens
KNKSTQEKW

SEQ ID NO: 168605 - protein, 9 aa, Homo Sapiens
YSDVFQIRL

SEQ ID NO: 168606 - protein, 9 aa, Homo Sapiens
ITAIREGDV

SEQ ID NO: 168607 - protein, 9 aa, Homo Sapiens
ETLVTLGTL

SEQ ID NO: 168608 - protein, 9 aa, Homo Sapiens
GCSHIPEQL

SEQ ID NO: 168609 - protein, 9 aa, Homo Sapiens
VKKAGRAQP

SEQ ID NO: 168610 - protein, 9 aa, Homo Sapiens
DVDTSCKDV

SEQ ID NO: 168611 - protein, 9 aa, Homo Sapiens
GWLLGPDWH

SEQ ID NO: 168612 - protein, 9 aa, Homo Sapiens
HGHEAETLA

SEQ ID NO: 168613 - protein, 9 aa, Homo Sapiens
DINCGPTWL

SEQ ID NO: 168614 - protein, 9 aa, Homo Sapiens
TTLACLNGG

SEQ ID NO: 168615 - protein, 9 aa, Homo Sapiens
PAHQPLGSM

SEQ ID NO: 168616 - protein, 9 aa, Homo Sapiens
IPNCDKHGP

SEQ ID NO: 168617 - protein, 9 aa, Homo Sapiens
KTRLWSCGP

SEQ ID NO: 168618 - protein, 9 aa, Homo Sapiens
GVEAQEAEG

SEQ ID NO: 168619 - protein, 9 aa, Homo Sapiens
SSVFSSCQL

SEQ ID NO: 168620 - protein, 9 aa, Homo Sapiens
APAPGSPRL

SEQ ID NO: 168621 - protein, 9 aa, Homo Sapiens
LPDLPRRKS

SEQ ID NO: 168622 - protein, 9 aa, Homo Sapiens
KLEKLQVEE

SEQ ID NO: 168623 - protein, 9 aa, Homo Sapiens
GRVGKLGLT

SEQ ID NO: 168624 - protein, 9 aa, Homo Sapiens
GSSSSSSSI

SEQ ID NO: 168625 - protein, 9 aa, Homo Sapiens
KYPIGSGHV

SEQ ID NO: 168626 - protein, 9 aa, Homo Sapiens
ANAQGTWGF

SEQ ID NO: 168627 - protein, 9 aa, Homo Sapiens
LRNPNDKHE

SEQ ID NO: 168628 - protein, 9 aa, Homo Sapiens
SVDPGLEES

SEQ ID NO: 168629 - protein, 9 aa, Homo Sapiens
QGRDDILGG

SEQ ID NO: 168630 - protein, 9 aa, Homo Sapiens
RLARRYSDV

SEQ ID NO: 168631 - protein, 9 aa, Homo Sapiens
FLGLSKRTP

SEQ ID NO: 168632 - protein, 9 aa, Homo Sapiens
AVQAGDGHG

SEQ ID NO: 168633 - protein, 9 aa, Homo Sapiens
AYMQDPLFV

SEQ ID NO: 168634 - protein, 9 aa, Homo Sapiens
NGIWEVMPR

SEQ ID NO: 168635 - protein, 9 aa, Homo Sapiens
ILQPDMMCA

SEQ ID NO: 168636 - protein, 9 aa, Homo Sapiens
LMTEENKDE

SEQ ID NO: 168637 - protein, 9 aa, Homo Sapiens
PSRTMTSGP

SEQ ID NO: 168638 - protein, 9 aa, Homo Sapiens
DHARDTQDP

SEQ ID NO: 168639 - protein, 9 aa, Homo Sapiens
AMEDVPWTK

SEQ ID NO: 168640 - protein, 9 aa, Homo Sapiens
SGGGGGNNN

SEQ ID NO: 168641 - protein, 9 aa, Homo Sapiens
VIDVQGKKI

SEQ ID NO: 168642 - protein, 9 aa, Homo Sapiens
RFVQSCAGA

SEQ ID NO: 168643 - protein, 9 aa, Homo Sapiens
GLRCTASAS

SEQ ID NO: 168644 - protein, 9 aa, Homo Sapiens
PAAAAAAAR

SEQ ID NO: 168645 - protein, 9 aa, Homo Sapiens
RALDTQSRP

SEQ ID NO: 168646 - protein, 9 aa, Homo Sapiens
LRHPRGTPP

SEQ ID NO: 168647 - protein, 9 aa, Homo Sapiens
TSTAKAARR

SEQ ID NO: 168648 - protein, 9 aa, Homo Sapiens
MFNNARLYN

SEQ ID NO: 168649 - protein, 9 aa, Homo Sapiens
PMNIFFIYF

SEQ ID NO: 168650 - protein, 9 aa, Homo Sapiens
HLVVQQVPH

SEQ ID NO: 168651 - protein, 9 aa, Homo Sapiens
AKCQAQQER

SEQ ID NO: 168652 - protein, 9 aa, Homo Sapiens
WSLWRASTR

SEQ ID NO: 168653 - protein, 9 aa, Homo Sapiens
YGGDRSRGA

SEQ ID NO: 168654 - protein, 9 aa, Homo Sapiens
VLPLNSHMC

SEQ ID NO: 168655 - protein, 9 aa, Homo Sapiens
DQASTREIL

SEQ ID NO: 168656 - protein, 9 aa, Homo Sapiens
PSLPGPAAL

SEQ ID NO: 168657 - protein, 9 aa, Homo Sapiens
SKVKLHTDS

SEQ ID NO: 168658 - protein, 9 aa, Homo Sapiens
GVRMKSVGI

SEQ ID NO: 168659 - protein, 9 aa, Homo Sapiens
PQEGGGIGR

SEQ ID NO: 168660 - protein, 9 aa, Homo Sapiens
EAAWEENVP

SEQ ID NO: 168661 - protein, 9 aa, Homo Sapiens
STLGPATVS

SEQ ID NO: 168662 - protein, 9 aa, Homo Sapiens
CAMAPETTL

SEQ ID NO: 168663 - protein, 9 aa, Homo Sapiens
MPISTGPSP

SEQ ID NO: 168664 - protein, 9 aa, Homo Sapiens
SVTLVASAC

SEQ ID NO: 168665 - protein, 9 aa, Homo Sapiens
VAKGFLTCR

SEQ ID NO: 168666 - protein, 9 aa, Homo Sapiens
HEGGHHLSH

SEQ ID NO: 168667 - protein, 9 aa, Homo Sapiens
REPIRDRCS

SEQ ID NO: 168668 - protein, 9 aa, Homo Sapiens
KENTELEEP

SEQ ID NO: 168669 - protein, 9 aa, Homo Sapiens
ESGFPKPPI

SEQ ID NO: 168670 - protein, 9 aa, Homo Sapiens
GSAAAPTLP

SEQ ID NO: 168671 - protein, 9 aa, Homo Sapiens
PQGPAWSLT

SEQ ID NO: 168672 - protein, 9 aa, Homo Sapiens
ANASKKTLN

SEQ ID NO: 168673 - protein, 9 aa, Homo Sapiens
VGAIAGLNV

SEQ ID NO: 168674 - protein, 9 aa, Homo Sapiens
GFFGGQQPR

SEQ ID NO: 168675 - protein, 9 aa, Homo Sapiens
RQHSAPVRG

SEQ ID NO: 168676 - protein, 9 aa, Homo Sapiens
LRLWLTSLP

SEQ ID NO: 168677 - protein, 9 aa, Homo Sapiens
VHLHRFTRG

SEQ ID NO: 168678 - protein, 9 aa, Homo Sapiens
SSPWVQHTP

SEQ ID NO: 168679 - protein, 9 aa, Homo Sapiens
WPRWHDTAM

SEQ ID NO: 168680 - protein, 9 aa, Homo Sapiens
YELMKNCWV

SEQ ID NO: 168681 - protein, 9 aa, Homo Sapiens
PWTKMAGIV

SEQ ID NO: 168682 - protein, 9 aa, Homo Sapiens
ESLGGQPAP

SEQ ID NO: 168683 - protein, 9 aa, Homo Sapiens
EQKFMLYWA

SEQ ID NO: 168684 - protein, 9 aa, Homo Sapiens
YGLKREEDS

SEQ ID NO: 168685 - protein, 9 aa, Homo Sapiens
STATWTCSL

SEQ ID NO: 168686 - protein, 9 aa, Homo Sapiens
GHGVCTDPK

SEQ ID NO: 168687 - protein, 9 aa, Homo Sapiens
HSYYRNPDE

SEQ ID NO: 168688 - protein, 9 aa, Homo Sapiens
PAPRACLWA

SEQ ID NO: 168689 - protein, 9 aa, Homo Sapiens
ETLTPGLTE

SEQ ID NO: 168690 - protein, 9 aa, Homo Sapiens
CPRSLTRAV

SEQ ID NO: 168691 - protein, 9 aa, Homo Sapiens
KPGSPVWGK

SEQ ID NO: 168692 - protein, 9 aa, Homo Sapiens
GKTPWLNHV

SEQ ID NO: 168693 - protein, 9 aa, Homo Sapiens
WWSTTRTRA

SEQ ID NO: 168694 - protein, 9 aa, Homo Sapiens
HLQSPYFSP

SEQ ID NO: 168695 - protein, 9 aa, Homo Sapiens
VANPGGDTT

SEQ ID NO: 168696 - protein, 9 aa, Homo Sapiens
QEDTNFPLR

SEQ ID NO: 168697 - protein, 9 aa, Homo Sapiens
QHRRTSMEG

SEQ ID NO: 168698 - protein, 9 aa, Homo Sapiens
HSRPYMVFV

SEQ ID NO: 168699 - protein, 9 aa, Homo Sapiens
AERGSAAGL

SEQ ID NO: 168700 - protein, 9 aa, Homo Sapiens
QLGNGITNH

SEQ ID NO: 168701 - protein, 9 aa, Homo Sapiens
SCCLPGLTH

SEQ ID NO: 168702 - protein, 9 aa, Homo Sapiens
LDESIKEED

SEQ ID NO: 168703 - protein, 9 aa, Homo Sapiens
RDTPWTASS

SEQ ID NO: 168704 - protein, 9 aa, Homo Sapiens
HQGLDKGGV

SEQ ID NO: 168705 - protein, 9 aa, Homo Sapiens
GLAPNGACV

SEQ ID NO: 168706 - protein, 9 aa, Homo Sapiens
QVISVVELS

SEQ ID NO: 168707 - protein, 9 aa, Homo Sapiens
SNIGRQYLA

SEQ ID NO: 168708 - protein, 9 aa, Homo Sapiens
CHWLLEAPD

SEQ ID NO: 168709 - protein, 9 aa, Homo Sapiens
RTSSSMSTW

SEQ ID NO: 168710 - protein, 9 aa, Homo Sapiens
PGRERHLQW

SEQ ID NO: 168711 - protein, 9 aa, Homo Sapiens
RKSGTHQMR

SEQ ID NO: 168712 - protein, 9 aa, Homo Sapiens
HHLLALFRQ

SEQ ID NO: 168713 - protein, 9 aa, Homo Sapiens
YAQGLGNIT

SEQ ID NO: 168714 - protein, 9 aa, Homo Sapiens
VVLDLPQPL

SEQ ID NO: 168715 - protein, 9 aa, Homo Sapiens
SGRGPPDRW

SEQ ID NO: 168716 - protein, 9 aa, Homo Sapiens
SATITNANP

SEQ ID NO: 168717 - protein, 9 aa, Homo Sapiens
EQKKSKSQK

SEQ ID NO: 168718 - protein, 9 aa, Homo Sapiens
GAPRPVREA

SEQ ID NO: 168719 - protein, 9 aa, Homo Sapiens
TARPHPTPL

SEQ ID NO: 168720 - protein, 9 aa, Homo Sapiens
CTECDKVCS

SEQ ID NO: 168721 - protein, 9 aa, Homo Sapiens
IWDVNTNSE

SEQ ID NO: 168722 - protein, 9 aa, Homo Sapiens
INIITITKK

SEQ ID NO: 168723 - protein, 9 aa, Homo Sapiens
CLRRNKVTI

SEQ ID NO: 168724 - protein, 9 aa, Homo Sapiens
SSAEGSGDL

SEQ ID NO: 168725 - protein, 9 aa, Homo Sapiens
PQGTLGHGH

SEQ ID NO: 168726 - protein, 9 aa, Homo Sapiens
WHIHKKGRY

SEQ ID NO: 168727 - protein, 9 aa, Homo Sapiens
SALPFLHEN

SEQ ID NO: 168728 - protein, 9 aa, Homo Sapiens
ACAHHRHGW

SEQ ID NO: 168729 - protein, 9 aa, Homo Sapiens
AATIGTNLH

SEQ ID NO: 168730 - protein, 9 aa, Homo Sapiens
SSPSSKTAL

SEQ ID NO: 168731 - protein, 9 aa, Homo Sapiens
SSDGRGENV

SEQ ID NO: 168732 - protein, 9 aa, Homo Sapiens
GLIGRRPAH

SEQ ID NO: 168733 - protein, 9 aa, Homo Sapiens
GKLGLTRSR

SEQ ID NO: 168734 - protein, 9 aa, Homo Sapiens
GVHLCIIDV

SEQ ID NO: 168735 - protein, 9 aa, Homo Sapiens
GVGPYSPRP

SEQ ID NO: 168736 - protein, 9 aa, Homo Sapiens
FLTTTSRKS

SEQ ID NO: 168737 - protein, 9 aa, Homo Sapiens
DFMHSAHLA

SEQ ID NO: 168738 - protein, 9 aa, Homo Sapiens
LTRSRMAAC

SEQ ID NO: 168739 - protein, 9 aa, Homo Sapiens
PARTPPGGG

SEQ ID NO: 168740 - protein, 9 aa, Homo Sapiens
RAIQATLYK

SEQ ID NO: 168741 - protein, 9 aa, Homo Sapiens
LAVPPWIEC

SEQ ID NO: 168742 - protein, 9 aa, Homo Sapiens
PSDYVRAMC

SEQ ID NO: 168743 - protein, 9 aa, Homo Sapiens
KCVDEPGKC

SEQ ID NO: 168744 - protein, 9 aa, Homo Sapiens
FEMVMCAKD

SEQ ID NO: 168745 - protein, 9 aa, Homo Sapiens
PTQRQKNCE

SEQ ID NO: 168746 - protein, 9 aa, Homo Sapiens
EKQFKCRSC

SEQ ID NO: 168747 - protein, 9 aa, Homo Sapiens
FEELWTAQV

SEQ ID NO: 168748 - protein, 9 aa, Homo Sapiens
NDFADGEHS

SEQ ID NO: 168749 - protein, 9 aa, Homo Sapiens
AHISSLSKE

SEQ ID NO: 168750 - protein, 9 aa, Homo Sapiens
ATTAATTTV

SEQ ID NO: 168751 - protein, 9 aa, Homo Sapiens
GTRRLWPPV

SEQ ID NO: 168752 - protein, 9 aa, Homo Sapiens
RSWHGDSDG

SEQ ID NO: 168753 - protein, 9 aa, Homo Sapiens
DAHISSLSK

SEQ ID NO: 168754 - protein, 9 aa, Homo Sapiens
PQHVSPFPE

SEQ ID NO: 168755 - protein, 9 aa, Homo Sapiens
GPAARWSPR

SEQ ID NO: 168756 - protein, 9 aa, Homo Sapiens
SLLFCYGLK

SEQ ID NO: 168757 - protein, 9 aa, Homo Sapiens
LSSQLAWCV

SEQ ID NO: 168758 - protein, 9 aa, Homo Sapiens
LGPPSPLPS

SEQ ID NO: 168759 - protein, 9 aa, Homo Sapiens
WWRLGRWIQ

SEQ ID NO: 168760 - protein, 9 aa, Homo Sapiens
RDREKETRH

SEQ ID NO: 168761 - protein, 9 aa, Homo Sapiens
MSENGSFTN

SEQ ID NO: 168762 - protein, 9 aa, Homo Sapiens
TKTFRLKLP

SEQ ID NO: 168763 - protein, 9 aa, Homo Sapiens
EERCIHQES

SEQ ID NO: 168764 - protein, 9 aa, Homo Sapiens
NCSAAHSCQ

SEQ ID NO: 168765 - protein, 9 aa, Homo Sapiens
VPYGSLQLV

SEQ ID NO: 168766 - protein, 9 aa, Homo Sapiens
PLTAPLACL

SEQ ID NO: 168767 - protein, 9 aa, Homo Sapiens
TTRTRAAMA

SEQ ID NO: 168768 - protein, 9 aa, Homo Sapiens
LFFFCNMAT

SEQ ID NO: 168769 - protein, 9 aa, Homo Sapiens
VAAPRPPPA

SEQ ID NO: 168770 - protein, 9 aa, Homo Sapiens
EVLQDPLDR

SEQ ID NO: 168771 - protein, 9 aa, Homo Sapiens
AKPWLAICW

SEQ ID NO: 168772 - protein, 9 aa, Homo Sapiens
PWLMGLTTF

SEQ ID NO: 168773 - protein, 9 aa, Homo Sapiens
LFQFSGQAC

SEQ ID NO: 168774 - protein, 9 aa, Homo Sapiens
SFDEDLTRP

SEQ ID NO: 168775 - protein, 9 aa, Homo Sapiens
SLPKKKKRK

SEQ ID NO: 168776 - protein, 9 aa, Homo Sapiens
GGSWSSASG

SEQ ID NO: 168777 - protein, 9 aa, Homo Sapiens
PPTAAVAVA

SEQ ID NO: 168778 - protein, 9 aa, Homo Sapiens
KESDTSKIP

SEQ ID NO: 168779 - protein, 9 aa, Homo Sapiens
SLNWKMCVA

SEQ ID NO: 168780 - protein, 9 aa, Homo Sapiens
CVAGLSQFR

SEQ ID NO: 168781 - protein, 9 aa, Homo Sapiens
TGRSSLAVH

SEQ ID NO: 168782 - protein, 9 aa, Homo Sapiens
LWLSVCSCR

SEQ ID NO: 168783 - protein, 9 aa, Homo Sapiens
SFFEHDGHP

SEQ ID NO: 168784 - protein, 9 aa, Homo Sapiens
DKGGVGPYS

SEQ ID NO: 168785 - protein, 9 aa, Homo Sapiens
EEAAKKKEK

SEQ ID NO: 168786 - protein, 9 aa, Homo Sapiens
EKIINPTIS

SEQ ID NO: 168787 - protein, 9 aa, Homo Sapiens
PSLLAQWFT

SEQ ID NO: 168788 - protein, 9 aa, Homo Sapiens
EECRILRGH

SEQ ID NO: 168789 - protein, 9 aa, Homo Sapiens
DGRGENVGH

SEQ ID NO: 168790 - protein, 9 aa, Homo Sapiens
RFEQEQMEQ

SEQ ID NO: 168791 - protein, 9 aa, Homo Sapiens
AQAIAVQAG

SEQ ID NO: 168792 - protein, 9 aa, Homo Sapiens
PRPTVAFLP

SEQ ID NO: 168793 - protein, 9 aa, Homo Sapiens
PPPANPQLL

SEQ ID NO: 168794 - protein, 9 aa, Homo Sapiens
VPPWIECQH

SEQ ID NO: 168795 - protein, 9 aa, Homo Sapiens
GHSTDAHSR

SEQ ID NO: 168796 - protein, 9 aa, Homo Sapiens
LCAGAPYAE

SEQ ID NO: 168797 - protein, 9 aa, Homo Sapiens
PTAPVTVKR

SEQ ID NO: 168798 - protein, 9 aa, Homo Sapiens
RGSAGARPP

SEQ ID NO: 168799 - protein, 9 aa, Homo Sapiens
CATTTCPGP

SEQ ID NO: 168800 - protein, 9 aa, Homo Sapiens
LDSLAGRGL

SEQ ID NO: 168801 - protein, 9 aa, Homo Sapiens
DDDKSDDTL

SEQ ID NO: 168802 - protein, 9 aa, Homo Sapiens
RGGTTCPPT

SEQ ID NO: 168803 - protein, 9 aa, Homo Sapiens
LPSGLLPPV

SEQ ID NO: 168804 - protein, 9 aa, Homo Sapiens
SGGCSLSSD

SEQ ID NO: 168805 - protein, 9 aa, Homo Sapiens
CCVIEHTNP

SEQ ID NO: 168806 - protein, 9 aa, Homo Sapiens
GPLGPVDAL

SEQ ID NO: 168807 - protein, 9 aa, Homo Sapiens
KGFLTCRLM

SEQ ID NO: 168808 - protein, 9 aa, Homo Sapiens
AALQPLPQQ

SEQ ID NO: 168809 - protein, 9 aa, Homo Sapiens
KIVTPETPE

SEQ ID NO: 168810 - protein, 9 aa, Homo Sapiens
FGCLLGSED

SEQ ID NO: 168811 - protein, 9 aa, Homo Sapiens
IVGAQLCTI

SEQ ID NO: 168812 - protein, 9 aa, Homo Sapiens
WVGASFPPS

SEQ ID NO: 168813 - protein, 9 aa, Homo Sapiens
MHTKLYQEV

SEQ ID NO: 168814 - protein, 9 aa, Homo Sapiens
FFLQLQGLV

SEQ ID NO: 168815 - protein, 9 aa, Homo Sapiens
YAAVPRGRE

SEQ ID NO: 168816 - protein, 9 aa, Homo Sapiens
CQEEGLHAG

SEQ ID NO: 168817 - protein, 9 aa, Homo Sapiens
GLFEELWTA

SEQ ID NO: 168818 - protein, 9 aa, Homo Sapiens
AEGLIVHRV

SEQ ID NO: 168819 - protein, 9 aa, Homo Sapiens
VWRENAELV

SEQ ID NO: 168820 - protein, 9 aa, Homo Sapiens
GWDSESWAY

SEQ ID NO: 168821 - protein, 9 aa, Homo Sapiens
QIKIFQNYY

SEQ ID NO: 168822 - protein, 9 aa, Homo Sapiens
QGRPPSSPK

SEQ ID NO: 168823 - protein, 9 aa, Homo Sapiens
TTYVLIEAI

SEQ ID NO: 168824 - protein, 9 aa, Homo Sapiens
DVHTGVGSG

SEQ ID NO: 168825 - protein, 9 aa, Homo Sapiens
NHKETIEER

SEQ ID NO: 168826 - protein, 9 aa, Homo Sapiens
PAGKWLYHP

SEQ ID NO: 168827 - protein, 9 aa, Homo Sapiens
EPWDTERNL

SEQ ID NO: 168828 - protein, 9 aa, Homo Sapiens
TVSALPFLH

SEQ ID NO: 168829 - protein, 9 aa, Homo Sapiens
VGVREALFA

SEQ ID NO: 168830 - protein, 9 aa, Homo Sapiens
IPGVTHSVI

SEQ ID NO: 168831 - protein, 9 aa, Homo Sapiens
SRVVLVCAT

SEQ ID NO: 168832 - protein, 9 aa, Homo Sapiens
LQGGCLLLL

SEQ ID NO: 168833 - protein, 9 aa, Homo Sapiens
FSEGQELQV

SEQ ID NO: 168834 - protein, 9 aa, Homo Sapiens
SFSSDQWYR

SEQ ID NO: 168835 - protein, 9 aa, Homo Sapiens
HENDLSIMH

SEQ ID NO: 168836 - protein, 9 aa, Homo Sapiens
NYCALRVTL

SEQ ID NO: 168837 - protein, 9 aa, Homo Sapiens
QDRPWKWRE

SEQ ID NO: 168838 - protein, 9 aa, Homo Sapiens
KRHCKCCVI

SEQ ID NO: 168839 - protein, 9 aa, Homo Sapiens
AFLPPMHCP

SEQ ID NO: 168840 - protein, 9 aa, Homo Sapiens
LKYIKKISS

SEQ ID NO: 168841 - protein, 9 aa, Homo Sapiens
SCIGKSPGR

SEQ ID NO: 168842 - protein, 9 aa, Homo Sapiens
TTETTSSEE

SEQ ID NO: 168843 - protein, 9 aa, Homo Sapiens
GRVAVKKAG

SEQ ID NO: 168844 - protein, 9 aa, Homo Sapiens
LLSDGNPKV

SEQ ID NO: 168845 - protein, 9 aa, Homo Sapiens
STSLGTTVI

SEQ ID NO: 168846 - protein, 9 aa, Homo Sapiens
RSYDDFCSL

SEQ ID NO: 168847 - protein, 9 aa, Homo Sapiens
SSSDIDSDE

SEQ ID NO: 168848 - protein, 9 aa, Homo Sapiens
GFPKPPILQ

SEQ ID NO: 168849 - protein, 9 aa, Homo Sapiens
RAYMQDPLF

SEQ ID NO: 168850 - protein, 9 aa, Homo Sapiens
SQLPHSIST

SEQ ID NO: 168851 - protein, 9 aa, Homo Sapiens
TGVREDEPA

SEQ ID NO: 168852 - protein, 9 aa, Homo Sapiens
EPASIDVDP

SEQ ID NO: 168853 - protein, 9 aa, Homo Sapiens
KKRKREKKR

SEQ ID NO: 168854 - protein, 9 aa, Homo Sapiens
IEAREGWSL

SEQ ID NO: 168855 - protein, 9 aa, Homo Sapiens
VVMKGLNDA

SEQ ID NO: 168856 - protein, 9 aa, Homo Sapiens
HDRRERRLD

SEQ ID NO: 168857 - protein, 9 aa, Homo Sapiens
SRMNSKSAS

SEQ ID NO: 168858 - protein, 9 aa, Homo Sapiens
PQGQARDLR

SEQ ID NO: 168859 - protein, 9 aa, Homo Sapiens
ASTRNWARR

SEQ ID NO: 168860 - protein, 9 aa, Homo Sapiens
ILQLVLPTY

SEQ ID NO: 168861 - protein, 9 aa, Homo Sapiens
DAKHYSCTP

SEQ ID NO: 168862 - protein, 9 aa, Homo Sapiens
DSRTSYNKI

SEQ ID NO: 168863 - protein, 9 aa, Homo Sapiens
GSMHTKLYQ

SEQ ID NO: 168864 - protein, 9 aa, Homo Sapiens
FLRHLGIIG

SEQ ID NO: 168865 - protein, 9 aa, Homo Sapiens
GKEGCFIAT

SEQ ID NO: 168866 - protein, 9 aa, Homo Sapiens
TSCLQRLIR

SEQ ID NO: 168867 - protein, 9 aa, Homo Sapiens
CQMDESEQY

SEQ ID NO: 168868 - protein, 9 aa, Homo Sapiens
QGTLGHGHK

SEQ ID NO: 168869 - protein, 9 aa, Homo Sapiens
QTPTSTPVH

SEQ ID NO: 168870 - protein, 9 aa, Homo Sapiens
GTWGFPIVY

SEQ ID NO: 168871 - protein, 9 aa, Homo Sapiens
ILFSRSLSS

SEQ ID NO: 168872 - protein, 9 aa, Homo Sapiens
QVFRLIRIF

SEQ ID NO: 168873 - protein, 9 aa, Homo Sapiens
IADMSYFVP

SEQ ID NO: 168874 - protein, 9 aa, Homo Sapiens
FPASSSQFS

SEQ ID NO: 168875 - protein, 9 aa, Homo Sapiens
QGLGFLLLP

SEQ ID NO: 168876 - protein, 9 aa, Homo Sapiens
DLSFNVILQ

SEQ ID NO: 168877 - protein, 9 aa, Homo Sapiens
QVPCSPLQR

SEQ ID NO: 168878 - protein, 9 aa, Homo Sapiens
RFLAYNCYG

SEQ ID NO: 168879 - protein, 9 aa, Homo Sapiens
VVSWSQVGV

SEQ ID NO: 168880 - protein, 9 aa, Homo Sapiens
NESQPILQL

SEQ ID NO: 168881 - protein, 9 aa, Homo Sapiens
SHWGCCPSA

SEQ ID NO: 168882 - protein, 9 aa, Homo Sapiens
PSLPRAWQV

SEQ ID NO: 168883 - protein, 9 aa, Homo Sapiens
KRVKEADHQ

SEQ ID NO: 168884 - protein, 9 aa, Homo Sapiens
ARLVATPAL

SEQ ID NO: 168885 - protein, 9 aa, Homo Sapiens
NFWGEKIVA

SEQ ID NO: 168886 - protein, 9 aa, Homo Sapiens
PRGTHCARG

SEQ ID NO: 168887 - protein, 9 aa, Homo Sapiens
QFSDPWPGG

SEQ ID NO: 168888 - protein, 9 aa, Homo Sapiens
PKPKIAAIT

SEQ ID NO: 168889 - protein, 9 aa, Homo Sapiens
CRSCQMEFG

SEQ ID NO: 168890 - protein, 9 aa, Homo Sapiens
SHIGSSFPG

SEQ ID NO: 168891 - protein, 9 aa, Homo Sapiens
AVTLLLDMF

SEQ ID NO: 168892 - protein, 9 aa, Homo Sapiens
CIICLAFVP

SEQ ID NO: 168893 - protein, 9 aa, Homo Sapiens
SLKAGNVSK

SEQ ID NO: 168894 - protein, 9 aa, Homo Sapiens
APLLPLPPL

SEQ ID NO: 168895 - protein, 9 aa, Homo Sapiens
PCMKQKGLK

SEQ ID NO: 168896 - protein, 9 aa, Homo Sapiens
NSPQPLRWA

SEQ ID NO: 168897 - protein, 9 aa, Homo Sapiens
PNCDKHGPY

SEQ ID NO: 168898 - protein, 9 aa, Homo Sapiens
AEERDTHNG

SEQ ID NO: 168899 - protein, 9 aa, Homo Sapiens
RKLTLQCSI

SEQ ID NO: 168900 - protein, 9 aa, Homo Sapiens
GKKLVSHLS

SEQ ID NO: 168901 - protein, 9 aa, Homo Sapiens
RARQFAQIG

SEQ ID NO: 168902 - protein, 9 aa, Homo Sapiens
YLPSSWPNW

SEQ ID NO: 168903 - protein, 9 aa, Homo Sapiens
SIEERCIHQ

SEQ ID NO: 168904 - protein, 9 aa, Homo Sapiens
LRMPLMWQA

SEQ ID NO: 168905 - protein, 9 aa, Homo Sapiens
LYLLAFKKS

SEQ ID NO: 168906 - protein, 9 aa, Homo Sapiens
PRFMTLEYN

SEQ ID NO: 168907 - protein, 9 aa, Homo Sapiens
NGNRIGSDF

SEQ ID NO: 168908 - protein, 9 aa, Homo Sapiens
AATLRCPAV

SEQ ID NO: 168909 - protein, 9 aa, Homo Sapiens
PPLPAPQGA

SEQ ID NO: 168910 - protein, 9 aa, Homo Sapiens
PSGDHARDT

SEQ ID NO: 168911 - protein, 9 aa, Homo Sapiens
STMNVPAGP

SEQ ID NO: 168912 - protein, 9 aa, Homo Sapiens
IHKKGRYTS

SEQ ID NO: 168913 - protein, 9 aa, Homo Sapiens
GVHIADMSY

SEQ ID NO: 168914 - protein, 9 aa, Homo Sapiens
SRPPQATRA

SEQ ID NO: 168915 - protein, 9 aa, Homo Sapiens
GKGFCHSST

SEQ ID NO: 168916 - protein, 9 aa, Homo Sapiens
AWHLYNYVY

SEQ ID NO: 168917 - protein, 9 aa, Homo Sapiens
FLWILWLIT

SEQ ID NO: 168918 - protein, 9 aa, Homo Sapiens
QTPRIRLQL

SEQ ID NO: 168919 - protein, 9 aa, Homo Sapiens
CHPQRVSPR

SEQ ID NO: 168920 - protein, 9 aa, Homo Sapiens
PELKWPRLD

SEQ ID NO: 168921 - protein, 9 aa, Homo Sapiens
DMDMEGAEP

SEQ ID NO: 168922 - protein, 9 aa, Homo Sapiens
QRRASTKSR

SEQ ID NO: 168923 - protein, 9 aa, Homo Sapiens
AWQVPLLPQ

SEQ ID NO: 168924 - protein, 9 aa, Homo Sapiens
CQVTGTNYF

SEQ ID NO: 168925 - protein, 9 aa, Homo Sapiens
VGFPLFLRH

SEQ ID NO: 168926 - protein, 9 aa, Homo Sapiens
KEPEVLQDP

SEQ ID NO: 168927 - protein, 9 aa, Homo Sapiens
TEARLGLQQ

SEQ ID NO: 168928 - protein, 9 aa, Homo Sapiens
GKIIDTKNL

SEQ ID NO: 168929 - protein, 9 aa, Homo Sapiens
WLCDKNLMN

SEQ ID NO: 168930 - protein, 9 aa, Homo Sapiens
SRGLDSLAG

SEQ ID NO: 168931 - protein, 9 aa, Homo Sapiens
TLSQPPPQA

SEQ ID NO: 168932 - protein, 9 aa, Homo Sapiens
SSGDPPVNY

SEQ ID NO: 168933 - protein, 9 aa, Homo Sapiens
ICEEPTCHN

SEQ ID NO: 168934 - protein, 9 aa, Homo Sapiens
GAERELEGG

SEQ ID NO: 168935 - protein, 9 aa, Homo Sapiens
GNITDTNTV

SEQ ID NO: 168936 - protein, 9 aa, Homo Sapiens
LDVHTGVGS

SEQ ID NO: 168937 - protein, 9 aa, Homo Sapiens
CQPLTKSMW

SEQ ID NO: 168938 - protein, 9 aa, Homo Sapiens
SYHLQGRMT

SEQ ID NO: 168939 - protein, 9 aa, Homo Sapiens
VSQLEEWLC

SEQ ID NO: 168940 - protein, 9 aa, Homo Sapiens
ELRLLSLYR

SEQ ID NO: 168941 - protein, 9 aa, Homo Sapiens
GRDDILGGH

SEQ ID NO: 168942 - protein, 9 aa, Homo Sapiens
QLPHSISTE

SEQ ID NO: 168943 - protein, 9 aa, Homo Sapiens
AENLCLPDI

SEQ ID NO: 168944 - protein, 9 aa, Homo Sapiens
YASFHETLR

SEQ ID NO: 168945 - protein, 9 aa, Homo Sapiens
TAGGGGSWS

SEQ ID NO: 168946 - protein, 9 aa, Homo Sapiens
QHTLKHGTL

SEQ ID NO: 168947 - protein, 9 aa, Homo Sapiens
MGPGILSIP

SEQ ID NO: 168948 - protein, 9 aa, Homo Sapiens
SNCAEERDT

SEQ ID NO: 168949 - protein, 9 aa, Homo Sapiens
TGMSHHVRP

SEQ ID NO: 168950 - protein, 9 aa, Homo Sapiens
GSSDQLRCS

SEQ ID NO: 168951 - protein, 9 aa, Homo Sapiens
TPWTASSSE

SEQ ID NO: 168952 - protein, 9 aa, Homo Sapiens
PPHGMCGPP

SEQ ID NO: 168953 - protein, 9 aa, Homo Sapiens
KKTRGQGPS

SEQ ID NO: 168954 - protein, 9 aa, Homo Sapiens
ESQPCQRRG

SEQ ID NO: 168955 - protein, 9 aa, Homo Sapiens
QALQWEVAE

SEQ ID NO: 168956 - protein, 9 aa, Homo Sapiens
RDDPAGQET

SEQ ID NO: 168957 - protein, 9 aa, Homo Sapiens
PKCSTPATL

SEQ ID NO: 168958 - protein, 9 aa, Homo Sapiens
DGHQLLVGG

SEQ ID NO: 168959 - protein, 9 aa, Homo Sapiens
GLVGLVDCP

SEQ ID NO: 168960 - protein, 9 aa, Homo Sapiens
NPVPRSRHE

SEQ ID NO: 168961 - protein, 9 aa, Homo Sapiens
QTAEETAFV

SEQ ID NO: 168962 - protein, 9 aa, Homo Sapiens
AYYFMGPGI

SEQ ID NO: 168963 - protein, 9 aa, Homo Sapiens
EKKKKKKKR

SEQ ID NO: 168964 - protein, 9 aa, Homo Sapiens
RRPHGPQNG

SEQ ID NO: 168965 - protein, 9 aa, Homo Sapiens
EGQPIRGYT

SEQ ID NO: 168966 - protein, 9 aa, Homo Sapiens
LALVGGEIT

SEQ ID NO: 168967 - protein, 9 aa, Homo Sapiens
LLPLLCICV

SEQ ID NO: 168968 - protein, 9 aa, Homo Sapiens
EWRCGSMRD

SEQ ID NO: 168969 - protein, 9 aa, Homo Sapiens
HRAYPQQLF

SEQ ID NO: 168970 - protein, 9 aa, Homo Sapiens
LQLQVVKEG

SEQ ID NO: 168971 - protein, 9 aa, Homo Sapiens
TRPLYFQRI

SEQ ID NO: 168972 - protein, 9 aa, Homo Sapiens
NDQLPFLVA

SEQ ID NO: 168973 - protein, 9 aa, Homo Sapiens
MSCTFRPTG

SEQ ID NO: 168974 - protein, 9 aa, Homo Sapiens
RAAGMGGVG

SEQ ID NO: 168975 - protein, 9 aa, Homo Sapiens
SPTSLTFPA

SEQ ID NO: 168976 - protein, 9 aa, Homo Sapiens
VLSSCPMVR

SEQ ID NO: 168977 - protein, 9 aa, Homo Sapiens
AMEAKWEEE

SEQ ID NO: 168978 - protein, 9 aa, Homo Sapiens
LEEWLCDKN

SEQ ID NO: 168979 - protein, 9 aa, Homo Sapiens
SVSRRARQF

SEQ ID NO: 168980 - protein, 9 aa, Homo Sapiens
AGANKNVNR

SEQ ID NO: 168981 - protein, 9 aa, Homo Sapiens
PVEELHVYC

SEQ ID NO: 168982 - protein, 9 aa, Homo Sapiens
RWTWVLSSC

SEQ ID NO: 168983 - protein, 9 aa, Homo Sapiens
LQRQHHRAP

SEQ ID NO: 168984 - protein, 9 aa, Homo Sapiens
WRRRGRGRG

SEQ ID NO: 168985 - protein, 9 aa, Homo Sapiens
PDCQGSKSP

SEQ ID NO: 168986 - protein, 9 aa, Homo Sapiens
VMSALTNKA

SEQ ID NO: 168987 - protein, 9 aa, Homo Sapiens
EQARCEEVA

SEQ ID NO: 168988 - protein, 9 aa, Homo Sapiens
RRTLRSSPK

SEQ ID NO: 168989 - protein, 9 aa, Homo Sapiens
SSVDPGLEE

SEQ ID NO: 168990 - protein, 9 aa, Homo Sapiens
PMVRRATAS

SEQ ID NO: 168991 - protein, 9 aa, Homo Sapiens
GEAGKPPLA

SEQ ID NO: 168992 - protein, 9 aa, Homo Sapiens
AEHQGNGKW

SEQ ID NO: 168993 - protein, 9 aa, Homo Sapiens
APNVQGACK

SEQ ID NO: 168994 - protein, 9 aa, Homo Sapiens
SILESANAR

SEQ ID NO: 168995 - protein, 9 aa, Homo Sapiens
AQWFTPCCM

SEQ ID NO: 168996 - protein, 9 aa, Homo Sapiens
SSGPEDNVV

SEQ ID NO: 168997 - protein, 9 aa, Homo Sapiens
FSGQACYRI

SEQ ID NO: 168998 - protein, 9 aa, Homo Sapiens
PRGSAGARP

SEQ ID NO: 168999 - protein, 9 aa, Homo Sapiens
KSHECTECD

SEQ ID NO: 169000 - protein, 9 aa, Homo Sapiens
GAFASMDLK

SEQ ID NO: 169001 - protein, 9 aa, Homo Sapiens
RPWPPSFSA

SEQ ID NO: 169002 - protein, 9 aa, Homo Sapiens
LFVPAFLNC

SEQ ID NO: 169003 - protein, 9 aa, Homo Sapiens
CSAAHSCQA

SEQ ID NO: 169004 - protein, 9 aa, Homo Sapiens
LLVGVCVFV

SEQ ID NO: 169005 - protein, 9 aa, Homo Sapiens
QLVEGLLGS

SEQ ID NO: 169006 - protein, 9 aa, Homo Sapiens
GYFQLKANT

SEQ ID NO: 169007 - protein, 9 aa, Homo Sapiens
VVYQGTFYY

SEQ ID NO: 169008 - protein, 9 aa, Homo Sapiens
DGPKPGQSQ

SEQ ID NO: 169009 - protein, 9 aa, Homo Sapiens
QGLRQLRAH

SEQ ID NO: 169010 - protein, 9 aa, Homo Sapiens
CVSPTWPIP

SEQ ID NO: 169011 - protein, 9 aa, Homo Sapiens
GTTLAAPSV

SEQ ID NO: 169012 - protein, 9 aa, Homo Sapiens
PVQCLPAAT

SEQ ID NO: 169013 - protein, 9 aa, Homo Sapiens
GELPLPEDN

SEQ ID NO: 169014 - protein, 9 aa, Homo Sapiens
AQQKRIRRS

SEQ ID NO: 169015 - protein, 9 aa, Homo Sapiens
NVITADQPI

SEQ ID NO: 169016 - protein, 9 aa, Homo Sapiens
KKISVLSFE

SEQ ID NO: 169017 - protein, 9 aa, Homo Sapiens
GLTTFHALC

SEQ ID NO: 169018 - protein, 9 aa, Homo Sapiens
TVWPTAWAS

SEQ ID NO: 169019 - protein, 9 aa, Homo Sapiens
VSQHTLKHG

SEQ ID NO: 169020 - protein, 9 aa, Homo Sapiens
RREIQWLET

SEQ ID NO: 169021 - protein, 9 aa, Homo Sapiens
RPAPQPLLS

SEQ ID NO: 169022 - protein, 9 aa, Homo Sapiens
LRISHKTRR

SEQ ID NO: 169023 - protein, 9 aa, Homo Sapiens
VIYQTLDDE

SEQ ID NO: 169024 - protein, 9 aa, Homo Sapiens
KICQKWPFI

SEQ ID NO: 169025 - protein, 9 aa, Homo Sapiens
VSLQFTYRE

SEQ ID NO: 169026 - protein, 9 aa, Homo Sapiens
LTFDGFSYH

SEQ ID NO: 169027 - protein, 9 aa, Homo Sapiens
QEIAKEVGQ

SEQ ID NO: 169028 - protein, 9 aa, Homo Sapiens
AQDAGIRRS

SEQ ID NO: 169029 - protein, 9 aa, Homo Sapiens
TPQGSMRAI

SEQ ID NO: 169030 - protein, 9 aa, Homo Sapiens
LIITAAVPR

SEQ ID NO: 169031 - protein, 9 aa, Homo Sapiens
PAHVDVRAI

SEQ ID NO: 169032 - protein, 9 aa, Homo Sapiens
NKHLRGGGS

SEQ ID NO: 169033 - protein, 9 aa, Homo Sapiens
PSNGLTSGP

SEQ ID NO: 169034 - protein, 9 aa, Homo Sapiens
GKTACSCSL

SEQ ID NO: 169035 - protein, 9 aa, Homo Sapiens
VDPGLEESP

SEQ ID NO: 169036 - protein, 9 aa, Homo Sapiens
ELNQETQTR

SEQ ID NO: 169037 - protein, 9 aa, Homo Sapiens
SELERGVRM

SEQ ID NO: 169038 - protein, 9 aa, Homo Sapiens
PGVHPQLPC

SEQ ID NO: 169039 - protein, 9 aa, Homo Sapiens
APNGACVPR

SEQ ID NO: 169040 - protein, 9 aa, Homo Sapiens
PSRMLGSCC

SEQ ID NO: 169041 - protein, 9 aa, Homo Sapiens
MAMIQFTIN

SEQ ID NO: 169042 - protein, 9 aa, Homo Sapiens
VMSCSLLTQ

SEQ ID NO: 169043 - protein, 9 aa, Homo Sapiens
GLDSLAGRG

SEQ ID NO: 169044 - protein, 9 aa, Homo Sapiens
RHPRGTPPG

SEQ ID NO: 169045 - protein, 9 aa, Homo Sapiens
HQCRHFRQP

SEQ ID NO: 169046 - protein, 9 aa, Homo Sapiens
GPATVSLLF

SEQ ID NO: 169047 - protein, 9 aa, Homo Sapiens
TVCGVLDLD

SEQ ID NO: 169048 - protein, 9 aa, Homo Sapiens
YRPAASENY

SEQ ID NO: 169049 - protein, 9 aa, Homo Sapiens
LQEVKGRGQ

SEQ ID NO: 169050 - protein, 9 aa, Homo Sapiens
HEARSGGHS

SEQ ID NO: 169051 - protein, 9 aa, Homo Sapiens
FEPPMPPPA

SEQ ID NO: 169052 - protein, 9 aa, Homo Sapiens
LKEKKIWWI

SEQ ID NO: 169053 - protein, 9 aa, Homo Sapiens
FTGSPQLQD

SEQ ID NO: 169054 - protein, 9 aa, Homo Sapiens
PPQAPSQVW

SEQ ID NO: 169055 - protein, 9 aa, Homo Sapiens
AGTGCSSQG

SEQ ID NO: 169056 - protein, 9 aa, Homo Sapiens
CWSLWRAST

SEQ ID NO: 169057 - protein, 9 aa, Homo Sapiens
PGWYKFSGT

SEQ ID NO: 169058 - protein, 9 aa, Homo Sapiens
PPAATAKSH

SEQ ID NO: 169059 - protein, 9 aa, Homo Sapiens
GDAPSQPRG

SEQ ID NO: 169060 - protein, 9 aa, Homo Sapiens
YFMACTVAY

SEQ ID NO: 169061 - protein, 9 aa, Homo Sapiens
ATLPDLPRR

SEQ ID NO: 169062 - protein, 9 aa, Homo Sapiens
KDLEEQLWS

SEQ ID NO: 169063 - protein, 9 aa, Homo Sapiens
ATTMSSAGD

SEQ ID NO: 169064 - protein, 9 aa, Homo Sapiens
IGFWRHLED

SEQ ID NO: 169065 - protein, 9 aa, Homo Sapiens
TAGEYDILS

SEQ ID NO: 169066 - protein, 9 aa, Homo Sapiens
HNIDHTQRE

SEQ ID NO: 169067 - protein, 9 aa, Homo Sapiens
PLLQGHFRT

SEQ ID NO: 169068 - protein, 9 aa, Homo Sapiens
TDPKGQGEY

SEQ ID NO: 169069 - protein, 9 aa, Homo Sapiens
LDGLASQEP

SEQ ID NO: 169070 - protein, 9 aa, Homo Sapiens
GMCGPPPLM

SEQ ID NO: 169071 - protein, 9 aa, Homo Sapiens
QQLMHETSQ

SEQ ID NO: 169072 - protein, 9 aa, Homo Sapiens
SQKQGIMSF

SEQ ID NO: 169073 - protein, 9 aa, Homo Sapiens
TGRPGERGE

SEQ ID NO: 169074 - protein, 9 aa, Homo Sapiens
RPWKWREGR

SEQ ID NO: 169075 - protein, 9 aa, Homo Sapiens
EELKEKKLR

SEQ ID NO: 169076 - protein, 9 aa, Homo Sapiens
LKAVQVLVV

SEQ ID NO: 169077 - protein, 9 aa, Homo Sapiens
GVCPLAGLR

SEQ ID NO: 169078 - protein, 9 aa, Homo Sapiens
AAVAVAQEI

SEQ ID NO: 169079 - protein, 9 aa, Homo Sapiens
CVHYSLHFL

SEQ ID NO: 169080 - protein, 9 aa, Homo Sapiens
HWTVDWPGW

SEQ ID NO: 169081 - protein, 9 aa, Homo Sapiens
SPKARRSSW

SEQ ID NO: 169082 - protein, 9 aa, Homo Sapiens
QLAIRWTRG

SEQ ID NO: 169083 - protein, 9 aa, Homo Sapiens
SREDSYMTS

SEQ ID NO: 169084 - protein, 9 aa, Homo Sapiens
YSHYFRKAR

SEQ ID NO: 169085 - protein, 9 aa, Homo Sapiens
LAGLRRAYA

SEQ ID NO: 169086 - protein, 9 aa, Homo Sapiens
PAHQPSLTH

SEQ ID NO: 169087 - protein, 9 aa, Homo Sapiens
QGPAARWSP

SEQ ID NO: 169088 - protein, 9 aa, Homo Sapiens
PVVCHDEVR

SEQ ID NO: 169089 - protein, 9 aa, Homo Sapiens
KGQDGQPQW

SEQ ID NO: 169090 - protein, 9 aa, Homo Sapiens
YQTAEETAF

SEQ ID NO: 169091 - protein, 9 aa, Homo Sapiens
PQKNSAQTS

SEQ ID NO: 169092 - protein, 9 aa, Homo Sapiens
DTRAKVVLP

SEQ ID NO: 169093 - protein, 9 aa, Homo Sapiens
TRAGYLTTP

SEQ ID NO: 169094 - protein, 9 aa, Homo Sapiens
ARLPPAVGG

SEQ ID NO: 169095 - protein, 9 aa, Homo Sapiens
HHPLGDTPQ

SEQ ID NO: 169096 - protein, 9 aa, Homo Sapiens
LPKVDLDVS

SEQ ID NO: 169097 - protein, 9 aa, Homo Sapiens
IGDFGLATE

SEQ ID NO: 169098 - protein, 9 aa, Homo Sapiens
SNTPKNVLW

SEQ ID NO: 169099 - protein, 9 aa, Homo Sapiens
LFHLHRKGP

SEQ ID NO: 169100 - protein, 9 aa, Homo Sapiens
TTAIGGGGW

SEQ ID NO: 169101 - protein, 9 aa, Homo Sapiens
TPEEVLKNI

SEQ ID NO: 169102 - protein, 9 aa, Homo Sapiens
TLTISAAHL

SEQ ID NO: 169103 - protein, 9 aa, Homo Sapiens
DLSEWKKAV

SEQ ID NO: 169104 - protein, 9 aa, Homo Sapiens
PPGRAWAPA

SEQ ID NO: 169105 - protein, 9 aa, Homo Sapiens
SGFPKPPIL

SEQ ID NO: 169106 - protein, 9 aa, Homo Sapiens
GIPTRAKKM

SEQ ID NO: 169107 - protein, 9 aa, Homo Sapiens
LAAAHSVCL

SEQ ID NO: 169108 - protein, 9 aa, Homo Sapiens
PRNGMDRSG

SEQ ID NO: 169109 - protein, 9 aa, Homo Sapiens
EYFFLSLVV

SEQ ID NO: 169110 - protein, 9 aa, Homo Sapiens
REIQWLETL

SEQ ID NO: 169111 - protein, 9 aa, Homo Sapiens
VPRAARVAF

SEQ ID NO: 169112 - protein, 9 aa, Homo Sapiens
FNGALKHLQ

SEQ ID NO: 169113 - protein, 9 aa, Homo Sapiens
PPKVPARCR

SEQ ID NO: 169114 - protein, 9 aa, Homo Sapiens
TGLHPYQCD

SEQ ID NO: 169115 - protein, 9 aa, Homo Sapiens
RETLKKTRG

SEQ ID NO: 169116 - protein, 9 aa, Homo Sapiens
QRNDQPEQE

SEQ ID NO: 169117 - protein, 9 aa, Homo Sapiens
RGQSQFDVY

SEQ ID NO: 169118 - protein, 9 aa, Homo Sapiens
HEEVVEHLK

SEQ ID NO: 169119 - protein, 9 aa, Homo Sapiens
VATACVAHV

SEQ ID NO: 169120 - protein, 9 aa, Homo Sapiens
SPRIPDCQG

SEQ ID NO: 169121 - protein, 9 aa, Homo Sapiens
LVAAALCIP

SEQ ID NO: 169122 - protein, 9 aa, Homo Sapiens
LERKAKSHQ

SEQ ID NO: 169123 - protein, 9 aa, Homo Sapiens
LHLNLIRNH

SEQ ID NO: 169124 - protein, 9 aa, Homo Sapiens
PQSRGLDSL

SEQ ID NO: 169125 - protein, 9 aa, Homo Sapiens
LREVNALRQ

SEQ ID NO: 169126 - protein, 9 aa, Homo Sapiens
PFGDSQMYS

SEQ ID NO: 169127 - protein, 9 aa, Homo Sapiens
EIQKKMTSI

SEQ ID NO: 169128 - protein, 9 aa, Homo Sapiens
PHTFKDLHF

SEQ ID NO: 169129 - protein, 9 aa, Homo Sapiens
NTSDLCVQW

SEQ ID NO: 169130 - protein, 9 aa, Homo Sapiens
ETPSGKIVY

SEQ ID NO: 169131 - protein, 9 aa, Homo Sapiens
TLKERLSYH

SEQ ID NO: 169132 - protein, 9 aa, Homo Sapiens
HCWLSPPLG

SEQ ID NO: 169133 - protein, 9 aa, Homo Sapiens
LTFHENAKA

SEQ ID NO: 169134 - protein, 9 aa, Homo Sapiens
VAMELLESE

SEQ ID NO: 169135 - protein, 9 aa, Homo Sapiens
SVNAARAGM

SEQ ID NO: 169136 - protein, 9 aa, Homo Sapiens
PYGSLQLVE

SEQ ID NO: 169137 - protein, 9 aa, Homo Sapiens
ITGRDQSII

SEQ ID NO: 169138 - protein, 9 aa, Homo Sapiens
EMPKTELIP

SEQ ID NO: 169139 - protein, 9 aa, Homo Sapiens
IKVEQARCE

SEQ ID NO: 169140 - protein, 9 aa, Homo Sapiens
GVQNCKPKG

SEQ ID NO: 169141 - protein, 9 aa, Homo Sapiens
FFLFFFSFF

SEQ ID NO: 169142 - protein, 9 aa, Homo Sapiens
LSTLHAHYI

SEQ ID NO: 169143 - protein, 9 aa, Homo Sapiens
AGFNKSGTY

SEQ ID NO: 169144 - protein, 9 aa, Homo Sapiens
KDLKKNGAL

SEQ ID NO: 169145 - protein, 9 aa, Homo Sapiens
HLRGGGSPS

SEQ ID NO: 169146 - protein, 9 aa, Homo Sapiens
HFVGDSEMF

SEQ ID NO: 169147 - protein, 9 aa, Homo Sapiens
GSTTSPWPG

SEQ ID NO: 169148 - protein, 9 aa, Homo Sapiens
VFFPIVVCL

SEQ ID NO: 169149 - protein, 9 aa, Homo Sapiens
EPTTAAMAY

SEQ ID NO: 169150 - protein, 9 aa, Homo Sapiens
LPRHCLHPQ

SEQ ID NO: 169151 - protein, 9 aa, Homo Sapiens
KSLKEKPLH

SEQ ID NO: 169152 - protein, 9 aa, Homo Sapiens
NSVWLLFFL

SEQ ID NO: 169153 - protein, 9 aa, Homo Sapiens
KRWIVFSVK

SEQ ID NO: 169154 - protein, 9 aa, Homo Sapiens
EDAPPKKKI

SEQ ID NO: 169155 - protein, 9 aa, Homo Sapiens
PRIRLQLLG

SEQ ID NO: 169156 - protein, 9 aa, Homo Sapiens
SQHIIPWRR

SEQ ID NO: 169157 - protein, 9 aa, Homo Sapiens
CWRSPTHLF

SEQ ID NO: 169158 - protein, 9 aa, Homo Sapiens
GGLICLGYV

SEQ ID NO: 169159 - protein, 9 aa, Homo Sapiens
IHGDIFMNR

SEQ ID NO: 169160 - protein, 9 aa, Homo Sapiens
FSSCQLHQL

SEQ ID NO: 169161 - protein, 9 aa, Homo Sapiens
GDNYCALRV

SEQ ID NO: 169162 - protein, 9 aa, Homo Sapiens
TPCCMRCPS

SEQ ID NO: 169163 - protein, 9 aa, Homo Sapiens
EAWHLYNYV

SEQ ID NO: 169164 - protein, 9 aa, Homo Sapiens
HLSHLYIAY

SEQ ID NO: 169165 - protein, 9 aa, Homo Sapiens
QGLDKGGVG

SEQ ID NO: 169166 - protein, 9 aa, Homo Sapiens
TKITSVTLV

SEQ ID NO: 169167 - protein, 9 aa, Homo Sapiens
AVRENHTLT

SEQ ID NO: 169168 - protein, 9 aa, Homo Sapiens
RLCWDLVLL

SEQ ID NO: 169169 - protein, 9 aa, Homo Sapiens
KCASALQKH

SEQ ID NO: 169170 - protein, 9 aa, Homo Sapiens
EHGSQKRTI

SEQ ID NO: 169171 - protein, 9 aa, Homo Sapiens
PENLTNGVT

SEQ ID NO: 169172 - protein, 9 aa, Homo Sapiens
CVPGPDAGR

SEQ ID NO: 169173 - protein, 9 aa, Homo Sapiens
YRHLCLRLR

SEQ ID NO: 169174 - protein, 9 aa, Homo Sapiens
KSMWSSPSA

SEQ ID NO: 169175 - protein, 9 aa, Homo Sapiens
VCPLAGLRR

SEQ ID NO: 169176 - protein, 9 aa, Homo Sapiens
SQARLPPPT

SEQ ID NO: 169177 - protein, 9 aa, Homo Sapiens
FNKSGTYTI

SEQ ID NO: 169178 - protein, 9 aa, Homo Sapiens
QGTSCGPYW

SEQ ID NO: 169179 - protein, 9 aa, Homo Sapiens
ITLPSVPSI

SEQ ID NO: 169180 - protein, 9 aa, Homo Sapiens
PGGTFPRVL

SEQ ID NO: 169181 - protein, 9 aa, Homo Sapiens
TDTVHAEFP

SEQ ID NO: 169182 - protein, 9 aa, Homo Sapiens
GPLRTLVLR

SEQ ID NO: 169183 - protein, 9 aa, Homo Sapiens
TLRCPHLRA

SEQ ID NO: 169184 - protein, 9 aa, Homo Sapiens
LPPALMPIS

SEQ ID NO: 169185 - protein, 9 aa, Homo Sapiens
AGTRPPARR

SEQ ID NO: 169186 - protein, 9 aa, Homo Sapiens
YRVLLALWE

SEQ ID NO: 169187 - protein, 9 aa, Homo Sapiens
CVCLLGGRC

SEQ ID NO: 169188 - protein, 9 aa, Homo Sapiens
WALQSSAVR

SEQ ID NO: 169189 - protein, 9 aa, Homo Sapiens
SKPAQQKRI

SEQ ID NO: 169190 - protein, 9 aa, Homo Sapiens
LHLQNQPYM

SEQ ID NO: 169191 - protein, 9 aa, Homo Sapiens
GSPDNPDQN

SEQ ID NO: 169192 - protein, 9 aa, Homo Sapiens
TEETEVAME

SEQ ID NO: 169193 - protein, 9 aa, Homo Sapiens
NAMIAKMNR

SEQ ID NO: 169194 - protein, 9 aa, Homo Sapiens
FLLLPPTPV

SEQ ID NO: 169195 - protein, 9 aa, Homo Sapiens
RHKSRRLRL

SEQ ID NO: 169196 - protein, 9 aa, Homo Sapiens
HLCLRLRLA

SEQ ID NO: 169197 - protein, 9 aa, Homo Sapiens
PVLPPKPLA

SEQ ID NO: 169198 - protein, 9 aa, Homo Sapiens
NVGDPMNIF

SEQ ID NO: 169199 - protein, 9 aa, Homo Sapiens
LGLVLLAWP

SEQ ID NO: 169200 - protein, 9 aa, Homo Sapiens
PRDDDKSDD

SEQ ID NO: 169201 - protein, 9 aa, Homo Sapiens
EGQWILTKS

SEQ ID NO: 169202 - protein, 9 aa, Homo Sapiens
TPPHPARTL

SEQ ID NO: 169203 - protein, 9 aa, Homo Sapiens
MDISKKSIT

SEQ ID NO: 169204 - protein, 9 aa, Homo Sapiens
FLRILEQKF

SEQ ID NO: 169205 - protein, 9 aa, Homo Sapiens
TMVIWDGLA

SEQ ID NO: 169206 - protein, 9 aa, Homo Sapiens
CSLLTGAMG

SEQ ID NO: 169207 - protein, 9 aa, Homo Sapiens
LSHGLMVSL

SEQ ID NO: 169208 - protein, 9 aa, Homo Sapiens
EEWLCDKNL

SEQ ID NO: 169209 - protein, 9 aa, Homo Sapiens
LSTVALGSQ

SEQ ID NO: 169210 - protein, 9 aa, Homo Sapiens
RCGPASITA

SEQ ID NO: 169211 - protein, 9 aa, Homo Sapiens
AAPPHRLLG

SEQ ID NO: 169212 - protein, 9 aa, Homo Sapiens
KEKKLRLAV

SEQ ID NO: 169213 - protein, 9 aa, Homo Sapiens
VAYVTETLV

SEQ ID NO: 169214 - protein, 9 aa, Homo Sapiens
TTILVTGAQ

SEQ ID NO: 169215 - protein, 9 aa, Homo Sapiens
PHSLLFRHK

SEQ ID NO: 169216 - protein, 9 aa, Homo Sapiens
TCLLTGYLN

SEQ ID NO: 169217 - protein, 9 aa, Homo Sapiens
FLSTEGAPD

SEQ ID NO: 169218 - protein, 9 aa, Homo Sapiens
TAVMNPCGG

SEQ ID NO: 169219 - protein, 9 aa, Homo Sapiens
TEDDYWGAT

SEQ ID NO: 169220 - protein, 9 aa, Homo Sapiens
VKACRYRCL

SEQ ID NO: 169221 - protein, 9 aa, Homo Sapiens
GNEVPVTGS

SEQ ID NO: 169222 - protein, 9 aa, Homo Sapiens
KVVGFFFLL

SEQ ID NO: 169223 - protein, 9 aa, Homo Sapiens
GHSCPGRER

SEQ ID NO: 169224 - protein, 9 aa, Homo Sapiens
SQFPHRQKG

SEQ ID NO: 169225 - protein, 9 aa, Homo Sapiens
GGRCNWSLW

SEQ ID NO: 169226 - protein, 9 aa, Homo Sapiens
NLLVEVHQK

SEQ ID NO: 169227 - protein, 9 aa, Homo Sapiens
IKYVGQNIR

SEQ ID NO: 169228 - protein, 9 aa, Homo Sapiens
LMAEQLRLQ

SEQ ID NO: 169229 - protein, 9 aa, Homo Sapiens
VPVFIGCPQ

SEQ ID NO: 169230 - protein, 9 aa, Homo Sapiens
DRRPCKDRK

SEQ ID NO: 169231 - protein, 9 aa, Homo Sapiens
IAAITSMKS

SEQ ID NO: 169232 - protein, 9 aa, Homo Sapiens
PRAKPFPTR

SEQ ID NO: 169233 - protein, 9 aa, Homo Sapiens
ARHRWDWSE

SEQ ID NO: 169234 - protein, 9 aa, Homo Sapiens
SHIPYYRES

SEQ ID NO: 169235 - protein, 9 aa, Homo Sapiens
SQNHSKCIT

SEQ ID NO: 169236 - protein, 9 aa, Homo Sapiens
YLWFKCGAR

SEQ ID NO: 169237 - protein, 9 aa, Homo Sapiens
ERDTHNGSV

SEQ ID NO: 169238 - protein, 9 aa, Homo Sapiens
ETSQIRADN

SEQ ID NO: 169239 - protein, 9 aa, Homo Sapiens
SGRTTHYKL

SEQ ID NO: 169240 - protein, 9 aa, Homo Sapiens
ELCAWVETF

SEQ ID NO: 169241 - protein, 9 aa, Homo Sapiens
IPIPRITWL

SEQ ID NO: 169242 - protein, 9 aa, Homo Sapiens
PPPLTQPPQ

SEQ ID NO: 169243 - protein, 9 aa, Homo Sapiens
VLGWLPPDT

SEQ ID NO: 169244 - protein, 9 aa, Homo Sapiens
AGGCPQDPR

SEQ ID NO: 169245 - protein, 9 aa, Homo Sapiens
FSRSSKVTE

SEQ ID NO: 169246 - protein, 9 aa, Homo Sapiens
GHGHKGLME

SEQ ID NO: 169247 - protein, 9 aa, Homo Sapiens
VTETLVFNK

SEQ ID NO: 169248 - protein, 9 aa, Homo Sapiens
RNPRPGCGA

SEQ ID NO: 169249 - protein, 9 aa, Homo Sapiens
HQNLLVEVH

SEQ ID NO: 169250 - protein, 9 aa, Homo Sapiens
SQPPPQAPS

SEQ ID NO: 169251 - protein, 9 aa, Homo Sapiens
VDFPRAEAG

SEQ ID NO: 169252 - protein, 9 aa, Homo Sapiens
GKVVGFFFL

SEQ ID NO: 169253 - protein, 9 aa, Homo Sapiens
PSPPVRSTV

SEQ ID NO: 169254 - protein, 9 aa, Homo Sapiens
CSHIPEQLM

SEQ ID NO: 169255 - protein, 9 aa, Homo Sapiens
SHGMKKRAS

SEQ ID NO: 169256 - protein, 9 aa, Homo Sapiens
FPCVPCKNN

SEQ ID NO: 169257 - protein, 9 aa, Homo Sapiens
QCQVAGWCT

SEQ ID NO: 169258 - protein, 9 aa, Homo Sapiens
CLSQLCGDP

SEQ ID NO: 169259 - protein, 9 aa, Homo Sapiens
VTLRAVKRP

SEQ ID NO: 169260 - protein, 9 aa, Homo Sapiens
SLELPEPNG

SEQ ID NO: 169261 - protein, 9 aa, Homo Sapiens
LRAVKRPLP

SEQ ID NO: 169262 - protein, 9 aa, Homo Sapiens
YEREAKEKT

SEQ ID NO: 169263 - protein, 9 aa, Homo Sapiens
IAAAPTLTP

SEQ ID NO: 169264 - protein, 9 aa, Homo Sapiens
PAPAVTTAI

SEQ ID NO: 169265 - protein, 9 aa, Homo Sapiens
FRGTSALAQ

SEQ ID NO: 169266 - protein, 9 aa, Homo Sapiens
PPATTLARV

SEQ ID NO: 169267 - protein, 9 aa, Homo Sapiens
AISILESAN

SEQ ID NO: 169268 - protein, 9 aa, Homo Sapiens
NCSNYPAII

SEQ ID NO: 169269 - protein, 9 aa, Homo Sapiens
GVGPYSSLD

SEQ ID NO: 169270 - protein, 9 aa, Homo Sapiens
FTTSTFAGE

SEQ ID NO: 169271 - protein, 9 aa, Homo Sapiens
TPPSRTMTS

SEQ ID NO: 169272 - protein, 9 aa, Homo Sapiens
VVSAGGGLR

SEQ ID NO: 169273 - protein, 9 aa, Homo Sapiens
AELLGLDKM

SEQ ID NO: 169274 - protein, 9 aa, Homo Sapiens
SPGRPCRVP

SEQ ID NO: 169275 - protein, 9 aa, Homo Sapiens
LVLRVAFSV

SEQ ID NO: 169276 - protein, 9 aa, Homo Sapiens
LTVPHSLLF

SEQ ID NO: 169277 - protein, 9 aa, Homo Sapiens
GTHQMRTAP

SEQ ID NO: 169278 - protein, 9 aa, Homo Sapiens
KPLHFPTVI

SEQ ID NO: 169279 - protein, 9 aa, Homo Sapiens
HSLLFRHKS

SEQ ID NO: 169280 - protein, 9 aa, Homo Sapiens
THHRNRELK

SEQ ID NO: 169281 - protein, 9 aa, Homo Sapiens
SSLDVSHHL

SEQ ID NO: 169282 - protein, 9 aa, Homo Sapiens
VGKYFWPQI

SEQ ID NO: 169283 - protein, 9 aa, Homo Sapiens
EKQMASMLK

SEQ ID NO: 169284 - protein, 9 aa, Homo Sapiens
AWGVNPGMV

SEQ ID NO: 169285 - protein, 9 aa, Homo Sapiens
TMGQSSAHM

SEQ ID NO: 169286 - protein, 9 aa, Homo Sapiens
PHFWKDFLA

SEQ ID NO: 169287 - protein, 9 aa, Homo Sapiens
PFRMSSFPK

SEQ ID NO: 169288 - protein, 9 aa, Homo Sapiens
FGSGALTVK

SEQ ID NO: 169289 - protein, 9 aa, Homo Sapiens
MKECRNWQD

SEQ ID NO: 169290 - protein, 9 aa, Homo Sapiens
SLWVLPTIC

SEQ ID NO: 169291 - protein, 9 aa, Homo Sapiens
RKSPRFCPD

SEQ ID NO: 169292 - protein, 9 aa, Homo Sapiens
PAWSALRVP

SEQ ID NO: 169293 - protein, 9 aa, Homo Sapiens
LGKEGCFIA

SEQ ID NO: 169294 - protein, 9 aa, Homo Sapiens
HGASSTLPC

SEQ ID NO: 169295 - protein, 9 aa, Homo Sapiens
FLLVSLAMF

SEQ ID NO: 169296 - protein, 9 aa, Homo Sapiens
GWRTAVCTH

SEQ ID NO: 169297 - protein, 9 aa, Homo Sapiens
HGVCMGGRV

SEQ ID NO: 169298 - protein, 9 aa, Homo Sapiens
ASPSSSMRT

SEQ ID NO: 169299 - protein, 9 aa, Homo Sapiens
PQPLAEPFP

SEQ ID NO: 169300 - protein, 9 aa, Homo Sapiens
LLPPRPLST

SEQ ID NO: 169301 - protein, 9 aa, Homo Sapiens
KKELELHIG

SEQ ID NO: 169302 - protein, 9 aa, Homo Sapiens
KYFWPQITK

SEQ ID NO: 169303 - protein, 9 aa, Homo Sapiens
NLRDALDNI

SEQ ID NO: 169304 - protein, 9 aa, Homo Sapiens
QAAAVYAGM

SEQ ID NO: 169305 - protein, 9 aa, Homo Sapiens
RFERFGCRR

SEQ ID NO: 169306 - protein, 9 aa, Homo Sapiens
AGVVLHGKP

SEQ ID NO: 169307 - protein, 9 aa, Homo Sapiens
RVFQYLPSS

SEQ ID NO: 169308 - protein, 9 aa, Homo Sapiens
FTAASGISS

SEQ ID NO: 169309 - protein, 9 aa, Homo Sapiens
TDLDMANAS

SEQ ID NO: 169310 - protein, 9 aa, Homo Sapiens
PTGRTPTTR

SEQ ID NO: 169311 - protein, 9 aa, Homo Sapiens
TFRYKQQLT

SEQ ID NO: 169312 - protein, 9 aa, Homo Sapiens
GTGCSSQGR

SEQ ID NO: 169313 - protein, 9 aa, Homo Sapiens
DACYSSAIS

SEQ ID NO: 169314 - protein, 9 aa, Homo Sapiens
SSPCQDLPD

SEQ ID NO: 169315 - protein, 9 aa, Homo Sapiens
SHEMDHISY

SEQ ID NO: 169316 - protein, 9 aa, Homo Sapiens
TPYRPPTAA

SEQ ID NO: 169317 - protein, 9 aa, Homo Sapiens
ATPTEQPLE

SEQ ID NO: 169318 - protein, 9 aa, Homo Sapiens
RGFVVRDTP

SEQ ID NO: 169319 - protein, 9 aa, Homo Sapiens
HSVCLARGD

SEQ ID NO: 169320 - protein, 9 aa, Homo Sapiens
PEGVPLGPL

SEQ ID NO: 169321 - protein, 9 aa, Homo Sapiens
LGEAELWRV

SEQ ID NO: 169322 - protein, 9 aa, Homo Sapiens
SKVTEHKII

SEQ ID NO: 169323 - protein, 9 aa, Homo Sapiens
NMKTMRVHE

SEQ ID NO: 169324 - protein, 9 aa, Homo Sapiens
SPTQRQKNC

SEQ ID NO: 169325 - protein, 9 aa, Homo Sapiens
GWYKFSGTT

SEQ ID NO: 169326 - protein, 9 aa, Homo Sapiens
GRLSPAGRN

SEQ ID NO: 169327 - protein, 9 aa, Homo Sapiens
TPRIRLQLL

SEQ ID NO: 169328 - protein, 9 aa, Homo Sapiens
QALGTQVMQ

SEQ ID NO: 169329 - protein, 9 aa, Homo Sapiens
IFEASRICK

SEQ ID NO: 169330 - protein, 9 aa, Homo Sapiens
AQTQDQLIS

SEQ ID NO: 169331 - protein, 9 aa, Homo Sapiens
MHKVSQMIA

SEQ ID NO: 169332 - protein, 9 aa, Homo Sapiens
FVIMLLALR

SEQ ID NO: 169333 - protein, 9 aa, Homo Sapiens
DVVGLAAVC

SEQ ID NO: 169334 - protein, 9 aa, Homo Sapiens
PVRGPRLPL

SEQ ID NO: 169335 - protein, 9 aa, Homo Sapiens
MTLEYNSKY

SEQ ID NO: 169336 - protein, 9 aa, Homo Sapiens
GYCFVYCLS

SEQ ID NO: 169337 - protein, 9 aa, Homo Sapiens
CRRVIIKKG

SEQ ID NO: 169338 - protein, 9 aa, Homo Sapiens
LSTTRLSGI

SEQ ID NO: 169339 - protein, 9 aa, Homo Sapiens
KPKGNTIAV

SEQ ID NO: 169340 - protein, 9 aa, Homo Sapiens
QLVGLRLGE

SEQ ID NO: 169341 - protein, 9 aa, Homo Sapiens
GRYLNYFAT

SEQ ID NO: 169342 - protein, 9 aa, Homo Sapiens
KKLVSHLSQ

SEQ ID NO: 169343 - protein, 9 aa, Homo Sapiens
AWRALLYPR

SEQ ID NO: 169344 - protein, 9 aa, Homo Sapiens
AAVCFFLGL

SEQ ID NO: 169345 - protein, 9 aa, Homo Sapiens
FTSSTNGCQ

SEQ ID NO: 169346 - protein, 9 aa, Homo Sapiens
AASNTAQRL

SEQ ID NO: 169347 - protein, 9 aa, Homo Sapiens
ESTALSRVV

SEQ ID NO: 169348 - protein, 9 aa, Homo Sapiens
VMPRTLEGC

SEQ ID NO: 169349 - protein, 9 aa, Homo Sapiens
KTQSRSVIQ

SEQ ID NO: 169350 - protein, 9 aa, Homo Sapiens
HLQWPSLPG

SEQ ID NO: 169351 - protein, 9 aa, Homo Sapiens
VAKVRTVDA

SEQ ID NO: 169352 - protein, 9 aa, Homo Sapiens
STSCGSCPR

SEQ ID NO: 169353 - protein, 9 aa, Homo Sapiens
IAKKSNWKF

SEQ ID NO: 169354 - protein, 9 aa, Homo Sapiens
KRKKREKII

SEQ ID NO: 169355 - protein, 9 aa, Homo Sapiens
QYQDATTEE

SEQ ID NO: 169356 - protein, 9 aa, Homo Sapiens
FEVCVCACP

SEQ ID NO: 169357 - protein, 9 aa, Homo Sapiens
TQKRKEENA

SEQ ID NO: 169358 - protein, 9 aa, Homo Sapiens
GCGAPDPRR

SEQ ID NO: 169359 - protein, 9 aa, Homo Sapiens
CIKIPVVPP

SEQ ID NO: 169360 - protein, 9 aa, Homo Sapiens
TATISRMAQ

SEQ ID NO: 169361 - protein, 9 aa, Homo Sapiens
DPQTPPSRT

SEQ ID NO: 169362 - protein, 9 aa, Homo Sapiens
SNNRISMLS

SEQ ID NO: 169363 - protein, 9 aa, Homo Sapiens
GSGVFCANY

SEQ ID NO: 169364 - protein, 9 aa, Homo Sapiens
ACYRIPREI

SEQ ID NO: 169365 - protein, 9 aa, Homo Sapiens
SRGQSQFDV

SEQ ID NO: 169366 - protein, 9 aa, Homo Sapiens
DPNAMQASG

SEQ ID NO: 169367 - protein, 9 aa, Homo Sapiens
CQFSTKSGW

SEQ ID NO: 169368 - protein, 9 aa, Homo Sapiens
ARTKAPPVG

SEQ ID NO: 169369 - protein, 9 aa, Homo Sapiens
HTALFLGGL

SEQ ID NO: 169370 - protein, 9 aa, Homo Sapiens
TAIGGGGWP

SEQ ID NO: 169371 - protein, 9 aa, Homo Sapiens
GESPTCLGH

SEQ ID NO: 169372 - protein, 9 aa, Homo Sapiens
CRQPPLPAQ

SEQ ID NO: 169373 - protein, 9 aa, Homo Sapiens
MCTEPVTSF

SEQ ID NO: 169374 - protein, 9 aa, Homo Sapiens
GPTSPRGCL

SEQ ID NO: 169375 - protein, 9 aa, Homo Sapiens
EIEAWILAV

SEQ ID NO: 169376 - protein, 9 aa, Homo Sapiens
ACSCSLAVQ

SEQ ID NO: 169377 - protein, 9 aa, Homo Sapiens
DENIVITED

SEQ ID NO: 169378 - protein, 9 aa, Homo Sapiens
FDTYFGCLL

SEQ ID NO: 169379 - protein, 9 aa, Homo Sapiens
VMLKRHLLQ

SEQ ID NO: 169380 - protein, 9 aa, Homo Sapiens
RSSSRDDLY

SEQ ID NO: 169381 - protein, 9 aa, Homo Sapiens
GDLPKIKKI

SEQ ID NO: 169382 - protein, 9 aa, Homo Sapiens
CTPYCDTST

SEQ ID NO: 169383 - protein, 9 aa, Homo Sapiens
TPRGTHCAR

SEQ ID NO: 169384 - protein, 9 aa, Homo Sapiens
VQGACKICQ

SEQ ID NO: 169385 - protein, 9 aa, Homo Sapiens
RYGHNFCRG

SEQ ID NO: 169386 - protein, 9 aa, Homo Sapiens
ALKVCYPER

SEQ ID NO: 169387 - protein, 9 aa, Homo Sapiens
MSAFIRRYS

SEQ ID NO: 169388 - protein, 9 aa, Homo Sapiens
GHFRTRQTL

SEQ ID NO: 169389 - protein, 9 aa, Homo Sapiens
VSSVLMVFF

SEQ ID NO: 169390 - protein, 9 aa, Homo Sapiens
VNLGSEHSF

SEQ ID NO: 169391 - protein, 9 aa, Homo Sapiens
GGGFMVLYY

SEQ ID NO: 169392 - protein, 9 aa, Homo Sapiens
FAPSPQEGV

SEQ ID NO: 169393 - protein, 9 aa, Homo Sapiens
ELPEPNGSP

SEQ ID NO: 169394 - protein, 9 aa, Homo Sapiens
MGLTTFHAL

SEQ ID NO: 169395 - protein, 9 aa, Homo Sapiens
LFHLITEPN

SEQ ID NO: 169396 - protein, 9 aa, Homo Sapiens
LSSLDSNSS

SEQ ID NO: 169397 - protein, 9 aa, Homo Sapiens
YIKKISSGC

SEQ ID NO: 169398 - protein, 9 aa, Homo Sapiens
WEQEEKRQE

SEQ ID NO: 169399 - protein, 9 aa, Homo Sapiens
STRKKCCPY

SEQ ID NO: 169400 - protein, 9 aa, Homo Sapiens
LDKGGVGPY

SEQ ID NO: 169401 - protein, 9 aa, Homo Sapiens
VPLLPKAPL

SEQ ID NO: 169402 - protein, 9 aa, Homo Sapiens
IDWAPKSDH

SEQ ID NO: 169403 - protein, 9 aa, Homo Sapiens
ITQVYLSRT

SEQ ID NO: 169404 - protein, 9 aa, Homo Sapiens
HLYPGPMVT

SEQ ID NO: 169405 - protein, 9 aa, Homo Sapiens
QRRGFAEGR

SEQ ID NO: 169406 - protein, 9 aa, Homo Sapiens
KAFRQSSVL

SEQ ID NO: 169407 - protein, 9 aa, Homo Sapiens
DMDAPEEEE

SEQ ID NO: 169408 - protein, 9 aa, Homo Sapiens
VVEVDSMLA

SEQ ID NO: 169409 - protein, 9 aa, Homo Sapiens
FVDPALAPA

SEQ ID NO: 169410 - protein, 9 aa, Homo Sapiens
TAQSNTTCK

SEQ ID NO: 169411 - protein, 9 aa, Homo Sapiens
KKEDSTVNR

SEQ ID NO: 169412 - protein, 9 aa, Homo Sapiens
PIGSHWGCC

SEQ ID NO: 169413 - protein, 9 aa, Homo Sapiens
DPRNGMDRS

SEQ ID NO: 169414 - protein, 9 aa, Homo Sapiens
RLQRQHHRA

SEQ ID NO: 169415 - protein, 9 aa, Homo Sapiens
SVFGGAICH

SEQ ID NO: 169416 - protein, 9 aa, Homo Sapiens
VAMAPGTPG

SEQ ID NO: 169417 - protein, 9 aa, Homo Sapiens
SRPVCCPRA

SEQ ID NO: 169418 - protein, 9 aa, Homo Sapiens
AQRALYRDG

SEQ ID NO: 169419 - protein, 9 aa, Homo Sapiens
WKWREGRAR

SEQ ID NO: 169420 - protein, 9 aa, Homo Sapiens
VVNNFFVTE

SEQ ID NO: 169421 - protein, 9 aa, Homo Sapiens
ATLPCRRHC

SEQ ID NO: 169422 - protein, 9 aa, Homo Sapiens
VMCAKDNVY

SEQ ID NO: 169423 - protein, 9 aa, Homo Sapiens
SPASATFPM

SEQ ID NO: 169424 - protein, 9 aa, Homo Sapiens
HLQNQPYMG

SEQ ID NO: 169425 - protein, 9 aa, Homo Sapiens
YPDAILHAQ

SEQ ID NO: 169426 - protein, 9 aa, Homo Sapiens
LTCGQLAIR

SEQ ID NO: 169427 - protein, 9 aa, Homo Sapiens
GQPGSQLPH

SEQ ID NO: 169428 - protein, 9 aa, Homo Sapiens
GSNISHKAA

SEQ ID NO: 169429 - protein, 9 aa, Homo Sapiens
GQPQWEVEG

SEQ ID NO: 169430 - protein, 9 aa, Homo Sapiens
SLSFINSET

SEQ ID NO: 169431 - protein, 9 aa, Homo Sapiens
YLIVIGLGG

SEQ ID NO: 169432 - protein, 9 aa, Homo Sapiens
WRDCLLKMK

SEQ ID NO: 169433 - protein, 9 aa, Homo Sapiens
SLRPRSQQP

SEQ ID NO: 169434 - protein, 9 aa, Homo Sapiens
MERAAWLPP

SEQ ID NO: 169435 - protein, 9 aa, Homo Sapiens
IIFVGFFPE

SEQ ID NO: 169436 - protein, 9 aa, Homo Sapiens
LGGQRSMNL

SEQ ID NO: 169437 - protein, 9 aa, Homo Sapiens
LLHGDQRGQ

SEQ ID NO: 169438 - protein, 9 aa, Homo Sapiens
LQCQSLALP

SEQ ID NO: 169439 - protein, 9 aa, Homo Sapiens
LTQPSPASA

SEQ ID NO: 169440 - protein, 9 aa, Homo Sapiens
SIPRPHTPS

SEQ ID NO: 169441 - protein, 9 aa, Homo Sapiens
YLTTKTSLW

SEQ ID NO: 169442 - protein, 9 aa, Homo Sapiens
SHLSPLEPG

SEQ ID NO: 169443 - protein, 9 aa, Homo Sapiens
PRVSMRTSD

SEQ ID NO: 169444 - protein, 9 aa, Homo Sapiens
LVRRSHLLL

SEQ ID NO: 169445 - protein, 9 aa, Homo Sapiens
DREAWQGVS

SEQ ID NO: 169446 - protein, 9 aa, Homo Sapiens
EELCLPPQT

SEQ ID NO: 169447 - protein, 9 aa, Homo Sapiens
KKRRGCPRK

SEQ ID NO: 169448 - protein, 9 aa, Homo Sapiens
TLDREARLV

SEQ ID NO: 169449 - protein, 9 aa, Homo Sapiens
SHVQLWDLI

SEQ ID NO: 169450 - protein, 9 aa, Homo Sapiens
EKPPASNPA

SEQ ID NO: 169451 - protein, 9 aa, Homo Sapiens
PRDHPPSPT

SEQ ID NO: 169452 - protein, 9 aa, Homo Sapiens
LARRSPATM

SEQ ID NO: 169453 - protein, 9 aa, Homo Sapiens
VPLVIPDGG

SEQ ID NO: 169454 - protein, 9 aa, Homo Sapiens
TESTMWSCT

SEQ ID NO: 169455 - protein, 9 aa, Homo Sapiens
EALLQDLCV

SEQ ID NO: 169456 - protein, 9 aa, Homo Sapiens
SVQDLKRES

SEQ ID NO: 169457 - protein, 9 aa, Homo Sapiens
GSWPWVPQV

SEQ ID NO: 169458 - protein, 9 aa, Homo Sapiens
STKITSVTL

SEQ ID NO: 169459 - protein, 9 aa, Homo Sapiens
KQVSHSMHK

SEQ ID NO: 169460 - protein, 9 aa, Homo Sapiens
PAGANKNVN

SEQ ID NO: 169461 - protein, 9 aa, Homo Sapiens
VQQKAQRVG

SEQ ID NO: 169462 - protein, 9 aa, Homo Sapiens
GSTAYSSHS

SEQ ID NO: 169463 - protein, 9 aa, Homo Sapiens
HMKLNWAVA

SEQ ID NO: 169464 - protein, 9 aa, Homo Sapiens
FGGQQPRHG

SEQ ID NO: 169465 - protein, 9 aa, Homo Sapiens
TAATTTVAA

SEQ ID NO: 169466 - protein, 9 aa, Homo Sapiens
SVRAPAGAN

SEQ ID NO: 169467 - protein, 9 aa, Homo Sapiens
QLQGHGQDV

SEQ ID NO: 169468 - protein, 9 aa, Homo Sapiens
REKETRHQD

SEQ ID NO: 169469 - protein, 9 aa, Homo Sapiens
STYLLPHHM

SEQ ID NO: 169470 - protein, 9 aa, Homo Sapiens
QMYFLYFSD

SEQ ID NO: 169471 - protein, 9 aa, Homo Sapiens
SHGLMVSLS

SEQ ID NO: 169472 - protein, 9 aa, Homo Sapiens
CMKQKGLKI

SEQ ID NO: 169473 - protein, 9 aa, Homo Sapiens
SSLAEPNGL

SEQ ID NO: 169474 - protein, 9 aa, Homo Sapiens
DLIHTENRI

SEQ ID NO: 169475 - protein, 9 aa, Homo Sapiens
STFGMSVCS

SEQ ID NO: 169476 - protein, 9 aa, Homo Sapiens
PEKLALKED

SEQ ID NO: 169477 - protein, 9 aa, Homo Sapiens
PHLQGPWST

SEQ ID NO: 169478 - protein, 9 aa, Homo Sapiens
FLGGLIAGS

SEQ ID NO: 169479 - protein, 9 aa, Homo Sapiens
MGGRVAVKK

SEQ ID NO: 169480 - protein, 9 aa, Homo Sapiens
SVDLPSSRN

SEQ ID NO: 169481 - protein, 9 aa, Homo Sapiens
RTPTTRLMA

SEQ ID NO: 169482 - protein, 9 aa, Homo Sapiens
RGEQLLEAS

SEQ ID NO: 169483 - protein, 9 aa, Homo Sapiens
WLLGPDWHT

SEQ ID NO: 169484 - protein, 9 aa, Homo Sapiens
PHSPGASPM

SEQ ID NO: 169485 - protein, 9 aa, Homo Sapiens
AAKRQTVAM

SEQ ID NO: 169486 - protein, 9 aa, Homo Sapiens
HFRPQDYQR

SEQ ID NO: 169487 - protein, 9 aa, Homo Sapiens
PSAPAPAVT

SEQ ID NO: 169488 - protein, 9 aa, Homo Sapiens
TGSCEACTR

SEQ ID NO: 169489 - protein, 9 aa, Homo Sapiens
LGGRCNWSL

SEQ ID NO: 169490 - protein, 9 aa, Homo Sapiens
WVQHTPPPI

SEQ ID NO: 169491 - protein, 9 aa, Homo Sapiens
SPRPRRSFL

SEQ ID NO: 169492 - protein, 9 aa, Homo Sapiens
HCGAHYKLV

SEQ ID NO: 169493 - protein, 9 aa, Homo Sapiens
HGDSKVANP

SEQ ID NO: 169494 - protein, 9 aa, Homo Sapiens
CGALPLTLS

SEQ ID NO: 169495 - protein, 9 aa, Homo Sapiens
QMYEPDSPP

SEQ ID NO: 169496 - protein, 9 aa, Homo Sapiens
DLCVQWCPL

SEQ ID NO: 169497 - protein, 9 aa, Homo Sapiens
DQVKKRKKR

SEQ ID NO: 169498 - protein, 9 aa, Homo Sapiens
SDSPPGVPS

SEQ ID NO: 169499 - protein, 9 aa, Homo Sapiens
LLGTFRRVL

SEQ ID NO: 169500 - protein, 9 aa, Homo Sapiens
DREARLVSK

SEQ ID NO: 169501 - protein, 9 aa, Homo Sapiens
RRPCKDRKL

SEQ ID NO: 169502 - protein, 9 aa, Homo Sapiens
TTTLHVLLV

SEQ ID NO: 169503 - protein, 9 aa, Homo Sapiens
SPRSGQWAQ

SEQ ID NO: 169504 - protein, 9 aa, Homo Sapiens
ELWTAQVKR

SEQ ID NO: 169505 - protein, 9 aa, Homo Sapiens
AHKRLSYAF

SEQ ID NO: 169506 - protein, 9 aa, Homo Sapiens
SPPVRSTVC

SEQ ID NO: 169507 - protein, 9 aa, Homo Sapiens
VINEPTTAA

SEQ ID NO: 169508 - protein, 9 aa, Homo Sapiens
CPGLPPCSS

SEQ ID NO: 169509 - protein, 9 aa, Homo Sapiens
AALCSRWPQ

SEQ ID NO: 169510 - protein, 9 aa, Homo Sapiens
LLGLLVLLV

SEQ ID NO: 169511 - protein, 9 aa, Homo Sapiens
VGHEGGHHL

SEQ ID NO: 169512 - protein, 9 aa, Homo Sapiens
GQWILTKSC

SEQ ID NO: 169513 - protein, 9 aa, Homo Sapiens
KVAGPGPPP

SEQ ID NO: 169514 - protein, 9 aa, Homo Sapiens
LSVFFPIVV

SEQ ID NO: 169515 - protein, 9 aa, Homo Sapiens
RLERERMRM

SEQ ID NO: 169516 - protein, 9 aa, Homo Sapiens
AHLYYYWER

SEQ ID NO: 169517 - protein, 9 aa, Homo Sapiens
RPSSESCSV

SEQ ID NO: 169518 - protein, 9 aa, Homo Sapiens
WPPSFSAPC

SEQ ID NO: 169519 - protein, 9 aa, Homo Sapiens
WKDFLATSS

SEQ ID NO: 169520 - protein, 9 aa, Homo Sapiens
NVSPVPPPA

SEQ ID NO: 169521 - protein, 9 aa, Homo Sapiens
SASWLLRTP

SEQ ID NO: 169522 - protein, 9 aa, Homo Sapiens
GPEKKTWYL

SEQ ID NO: 169523 - protein, 9 aa, Homo Sapiens
VPLGPLRTL

SEQ ID NO: 169524 - protein, 9 aa, Homo Sapiens
KDEEITETE

SEQ ID NO: 169525 - protein, 9 aa, Homo Sapiens
LDGQWVKLK

SEQ ID NO: 169526 - protein, 9 aa, Homo Sapiens
NRETSPFIT

SEQ ID NO: 169527 - protein, 9 aa, Homo Sapiens
SRSPHRRVG

SEQ ID NO: 169528 - protein, 9 aa, Homo Sapiens
TPGTSNGAT

SEQ ID NO: 169529 - protein, 9 aa, Homo Sapiens
PASPHSPGA

SEQ ID NO: 169530 - protein, 9 aa, Homo Sapiens
SSRSEKIEV

SEQ ID NO: 169531 - protein, 9 aa, Homo Sapiens
NLSRHVCSH

SEQ ID NO: 169532 - protein, 9 aa, Homo Sapiens
PALTSMGPT

SEQ ID NO: 169533 - protein, 9 aa, Homo Sapiens
SDIDSDEVD

SEQ ID NO: 169534 - protein, 9 aa, Homo Sapiens
ALVPQHVSP

SEQ ID NO: 169535 - protein, 9 aa, Homo Sapiens
HADVDTSCK

SEQ ID NO: 169536 - protein, 9 aa, Homo Sapiens
MNKHLRGGG

SEQ ID NO: 169537 - protein, 9 aa, Homo Sapiens
VGPWMAPPT

SEQ ID NO: 169538 - protein, 9 aa, Homo Sapiens
NISGATSDP

SEQ ID NO: 169539 - protein, 9 aa, Homo Sapiens
GLQGVPPWS

SEQ ID NO: 169540 - protein, 9 aa, Homo Sapiens
TTCPPTSCP

SEQ ID NO: 169541 - protein, 9 aa, Homo Sapiens
SAPCWAPAP

SEQ ID NO: 169542 - protein, 9 aa, Homo Sapiens
ASKEHKLRE

SEQ ID NO: 169543 - protein, 9 aa, Homo Sapiens
LHALLHGDQ

SEQ ID NO: 169544 - protein, 9 aa, Homo Sapiens
GGKPERSPK

SEQ ID NO: 169545 - protein, 9 aa, Homo Sapiens
TRAVAASPS

SEQ ID NO: 169546 - protein, 9 aa, Homo Sapiens
PGPLLPPRP

SEQ ID NO: 169547 - protein, 9 aa, Homo Sapiens
HSAPVRGPR

SEQ ID NO: 169548 - protein, 9 aa, Homo Sapiens
ALDRRGGPG

SEQ ID NO: 169549 - protein, 9 aa, Homo Sapiens
QRCPHCGAH

SEQ ID NO: 169550 - protein, 9 aa, Homo Sapiens
GDQSLHGHL

SEQ ID NO: 169551 - protein, 9 aa, Homo Sapiens
HLTVNIRLC

SEQ ID NO: 169552 - protein, 9 aa, Homo Sapiens
ATTIDQISI

SEQ ID NO: 169553 - protein, 9 aa, Homo Sapiens
EDKVAQSEA

SEQ ID NO: 169554 - protein, 9 aa, Homo Sapiens
LPKSSRMQG

SEQ ID NO: 169555 - protein, 9 aa, Homo Sapiens
EPNQRTDLL

SEQ ID NO: 169556 - protein, 9 aa, Homo Sapiens
REAKEKTEK

SEQ ID NO: 169557 - protein, 9 aa, Homo Sapiens
PPANPQLLC

SEQ ID NO: 169558 - protein, 9 aa, Homo Sapiens
MRSLGEPWR

SEQ ID NO: 169559 - protein, 9 aa, Homo Sapiens
FPPTKCHLA

SEQ ID NO: 169560 - protein, 9 aa, Homo Sapiens
AADNPTPSI

SEQ ID NO: 169561 - protein, 9 aa, Homo Sapiens
GKANASKKT

SEQ ID NO: 169562 - protein, 9 aa, Homo Sapiens
TGRDQSIIS

SEQ ID NO: 169563 - protein, 9 aa, Homo Sapiens
SWLAPGRTK

SEQ ID NO: 169564 - protein, 9 aa, Homo Sapiens
ALALTAVMN

SEQ ID NO: 169565 - protein, 9 aa, Homo Sapiens
RGTHCARGG

SEQ ID NO: 169566 - protein, 9 aa, Homo Sapiens
LQMPVLKPM

SEQ ID NO: 169567 - protein, 9 aa, Homo Sapiens
HRIRSRGLH

SEQ ID NO: 169568 - protein, 9 aa, Homo Sapiens
QTQNDMVTG

SEQ ID NO: 169569 - protein, 9 aa, Homo Sapiens
QWVSVATLG

SEQ ID NO: 169570 - protein, 9 aa, Homo Sapiens
GPGGCVPGP

SEQ ID NO: 169571 - protein, 9 aa, Homo Sapiens
GPIPSPSAH

SEQ ID NO: 169572 - protein, 9 aa, Homo Sapiens
CVPRAARVA

SEQ ID NO: 169573 - protein, 9 aa, Homo Sapiens
GQWVKLKLW

SEQ ID NO: 169574 - protein, 9 aa, Homo Sapiens
ERGSAAGLL

SEQ ID NO: 169575 - protein, 9 aa, Homo Sapiens
VPASWGLEL

SEQ ID NO: 169576 - protein, 9 aa, Homo Sapiens
RPVREAGPM

SEQ ID NO: 169577 - protein, 9 aa, Homo Sapiens
IDSNLSIRI

SEQ ID NO: 169578 - protein, 9 aa, Homo Sapiens
KANTGAWIL

SEQ ID NO: 169579 - protein, 9 aa, Homo Sapiens
FNHSLWARI

SEQ ID NO: 169580 - protein, 9 aa, Homo Sapiens
HIVTCGADR

SEQ ID NO: 169581 - protein, 9 aa, Homo Sapiens
PPPTHLRNR

SEQ ID NO: 169582 - protein, 9 aa, Homo Sapiens
CNTSDLCVQ

SEQ ID NO: 169583 - protein, 9 aa, Homo Sapiens
LRSQKQGIM

SEQ ID NO: 169584 - protein, 9 aa, Homo Sapiens
RRNKVTIVV

SEQ ID NO: 169585 - protein, 9 aa, Homo Sapiens
KSPGRPCRV

SEQ ID NO: 169586 - protein, 9 aa, Homo Sapiens
ESSKVKLHT

SEQ ID NO: 169587 - protein, 9 aa, Homo Sapiens
HGPYPAASA

SEQ ID NO: 169588 - protein, 9 aa, Homo Sapiens
GVLDFFSRS

SEQ ID NO: 169589 - protein, 9 aa, Homo Sapiens
CSRQIYFMA

SEQ ID NO: 169590 - protein, 9 aa, Homo Sapiens
LQHSDQGEF

SEQ ID NO: 169591 - protein, 9 aa, Homo Sapiens
LFRHKSRRL

SEQ ID NO: 169592 - protein, 9 aa, Homo Sapiens
DLKRESWYS

SEQ ID NO: 169593 - protein, 9 aa, Homo Sapiens
AWRTARPHP

SEQ ID NO: 169594 - protein, 9 aa, Homo Sapiens
AATQKTQRR

SEQ ID NO: 169595 - protein, 9 aa, Homo Sapiens
RRHCPRCPA

SEQ ID NO: 169596 - protein, 9 aa, Homo Sapiens
IDFMHSAHL

SEQ ID NO: 169597 - protein, 9 aa, Homo Sapiens
MQIELRHHE

SEQ ID NO: 169598 - protein, 9 aa, Homo Sapiens
ALLHGDQRG

SEQ ID NO: 169599 - protein, 9 aa, Homo Sapiens
IAITYEDEG

SEQ ID NO: 169600 - protein, 9 aa, Homo Sapiens
VDVRAIDLP

SEQ ID NO: 169601 - protein, 9 aa, Homo Sapiens
LCDKNLMNS

SEQ ID NO: 169602 - protein, 9 aa, Homo Sapiens
EVWRENAEL

SEQ ID NO: 169603 - protein, 9 aa, Homo Sapiens
GPAPQGQGL

SEQ ID NO: 169604 - protein, 9 aa, Homo Sapiens
CPDTWASRG

SEQ ID NO: 169605 - protein, 9 aa, Homo Sapiens
ENRETSPFI

SEQ ID NO: 169606 - protein, 9 aa, Homo Sapiens
VHEVEVVPS

SEQ ID NO: 169607 - protein, 9 aa, Homo Sapiens
ATIHNITKQ

SEQ ID NO: 169608 - protein, 9 aa, Homo Sapiens
AIAYSAYMF

SEQ ID NO: 169609 - protein, 9 aa, Homo Sapiens
RERMRMERE

SEQ ID NO: 169610 - protein, 9 aa, Homo Sapiens
PLARVVSWS

SEQ ID NO: 169611 - protein, 9 aa, Homo Sapiens
TGQVVLQDH

SEQ ID NO: 169612 - protein, 9 aa, Homo Sapiens
DRSRGAMEE

SEQ ID NO: 169613 - protein, 9 aa, Homo Sapiens
IRLCWDLVL

SEQ ID NO: 169614 - protein, 9 aa, Homo Sapiens
VAVAQEIQM

SEQ ID NO: 169615 - protein, 9 aa, Homo Sapiens
TSAMKEGTA

SEQ ID NO: 169616 - protein, 9 aa, Homo Sapiens
SLGKMALQD

SEQ ID NO: 169617 - protein, 9 aa, Homo Sapiens
YRESKPAQQ

SEQ ID NO: 169618 - protein, 9 aa, Homo Sapiens
YGSYPPARQ

SEQ ID NO: 169619 - protein, 9 aa, Homo Sapiens
VWGPQHGHL

SEQ ID NO: 169620 - protein, 9 aa, Homo Sapiens
INVEPPLHQ

SEQ ID NO: 169621 - protein, 9 aa, Homo Sapiens
PAFLNCWLA

SEQ ID NO: 169622 - protein, 9 aa, Homo Sapiens
QGPWSTCVC

SEQ ID NO: 169623 - protein, 9 aa, Homo Sapiens
PLPIPKQDT

SEQ ID NO: 169624 - protein, 9 aa, Homo Sapiens
AKLLLGFLV

SEQ ID NO: 169625 - protein, 9 aa, Homo Sapiens
CCPYTKYQT

SEQ ID NO: 169626 - protein, 9 aa, Homo Sapiens
RAPDAFVDP

SEQ ID NO: 169627 - protein, 9 aa, Homo Sapiens
HRPDEVSVM

SEQ ID NO: 169628 - protein, 9 aa, Homo Sapiens
EVLAKQGSW

SEQ ID NO: 169629 - protein, 9 aa, Homo Sapiens
LAVAPLWPP

SEQ ID NO: 169630 - protein, 9 aa, Homo Sapiens
RGFPEDLWN

SEQ ID NO: 169631 - protein, 9 aa, Homo Sapiens
SSPPRHIQF

SEQ ID NO: 169632 - protein, 9 aa, Homo Sapiens
VIPDGGDSE

SEQ ID NO: 169633 - protein, 9 aa, Homo Sapiens
QRATVIGGP

SEQ ID NO: 169634 - protein, 9 aa, Homo Sapiens
PWSGPQAPE

SEQ ID NO: 169635 - protein, 9 aa, Homo Sapiens
SNTIAPSTE

SEQ ID NO: 169636 - protein, 9 aa, Homo Sapiens
STFLKALAV

SEQ ID NO: 169637 - protein, 9 aa, Homo Sapiens
ICWRSPTHL

SEQ ID NO: 169638 - protein, 9 aa, Homo Sapiens
RINPESPVD

SEQ ID NO: 169639 - protein, 9 aa, Homo Sapiens
LLGLHVHHH

SEQ ID NO: 169640 - protein, 9 aa, Homo Sapiens
TTEMISATD

SEQ ID NO: 169641 - protein, 9 aa, Homo Sapiens
YQGTFYYNR

SEQ ID NO: 169642 - protein, 9 aa, Homo Sapiens
QTETAPGCS

SEQ ID NO: 169643 - protein, 9 aa, Homo Sapiens
ASWTKVRFR

SEQ ID NO: 169644 - protein, 9 aa, Homo Sapiens
TATTAATTT

SEQ ID NO: 169645 - protein, 9 aa, Homo Sapiens
RLPPALMPI

SEQ ID NO: 169646 - protein, 9 aa, Homo Sapiens
SWQRLPPAL

SEQ ID NO: 169647 - protein, 9 aa, Homo Sapiens
YLSLVNAFA

SEQ ID NO: 169648 - protein, 9 aa, Homo Sapiens
NRMKKHAHL

SEQ ID NO: 169649 - protein, 9 aa, Homo Sapiens
AYSAYMFPD

SEQ ID NO: 169650 - protein, 9 aa, Homo Sapiens
LVGGEITDD

SEQ ID NO: 169651 - protein, 9 aa, Homo Sapiens
RMKTPTVCG

SEQ ID NO: 169652 - protein, 9 aa, Homo Sapiens
PSRPTGRTP

SEQ ID NO: 169653 - protein, 9 aa, Homo Sapiens
LLWGVGAAV

SEQ ID NO: 169654 - protein, 9 aa, Homo Sapiens
TGPLFFMEA

SEQ ID NO: 169655 - protein, 9 aa, Homo Sapiens
ILARLVATP

SEQ ID NO: 169656 - protein, 9 aa, Homo Sapiens
VCTVELSCK

SEQ ID NO: 169657 - protein, 9 aa, Homo Sapiens
GPQRSHFFL

SEQ ID NO: 169658 - protein, 9 aa, Homo Sapiens
YVSLKLEDV

SEQ ID NO: 169659 - protein, 9 aa, Homo Sapiens
LLYVGVREA

SEQ ID NO: 169660 - protein, 9 aa, Homo Sapiens
VVLAGTAEA

SEQ ID NO: 169661 - protein, 9 aa, Homo Sapiens
EEYLDGVRR

SEQ ID NO: 169662 - protein, 9 aa, Homo Sapiens
YPPQLTKIS

SEQ ID NO: 169663 - protein, 9 aa, Homo Sapiens
HACATATTI

SEQ ID NO: 169664 - protein, 9 aa, Homo Sapiens
IQYCSKFDI

SEQ ID NO: 169665 - protein, 9 aa, Homo Sapiens
QDLNEGNHT

SEQ ID NO: 169666 - protein, 9 aa, Homo Sapiens
SRTTCPKCS

SEQ ID NO: 169667 - protein, 9 aa, Homo Sapiens
VHFTRRRDQ

SEQ ID NO: 169668 - protein, 9 aa, Homo Sapiens
EQLRLQAET

SEQ ID NO: 169669 - protein, 9 aa, Homo Sapiens
RTARPHPTP

SEQ ID NO: 169670 - protein, 9 aa, Homo Sapiens
HELIHTRQL

SEQ ID NO: 169671 - protein, 9 aa, Homo Sapiens
IQFHLVTRF

SEQ ID NO: 169672 - protein, 9 aa, Homo Sapiens
SWWAPPPSA

SEQ ID NO: 169673 - protein, 9 aa, Homo Sapiens
HSPLSLLAG

SEQ ID NO: 169674 - protein, 9 aa, Homo Sapiens
TAQQYSHYF

SEQ ID NO: 169675 - protein, 9 aa, Homo Sapiens
RGYTETEPH

SEQ ID NO: 169676 - protein, 9 aa, Homo Sapiens
ITYEDEGSG

SEQ ID NO: 169677 - protein, 9 aa, Homo Sapiens
YKEFELQKI

SEQ ID NO: 169678 - protein, 9 aa, Homo Sapiens
TAQRLRRAR

SEQ ID NO: 169679 - protein, 9 aa, Homo Sapiens
ATYPDGFRL

SEQ ID NO: 169680 - protein, 9 aa, Homo Sapiens
APTSWTATL

SEQ ID NO: 169681 - protein, 9 aa, Homo Sapiens
YSSHSSAAH

SEQ ID NO: 169682 - protein, 9 aa, Homo Sapiens
LKLAVKEGK

SEQ ID NO: 169683 - protein, 9 aa, Homo Sapiens
CASCPGPRR

SEQ ID NO: 169684 - protein, 9 aa, Homo Sapiens
FCAERLRHT

SEQ ID NO: 169685 - protein, 9 aa, Homo Sapiens
LGPQVGPAQ

SEQ ID NO: 169686 - protein, 9 aa, Homo Sapiens
TVFDLSLAG

SEQ ID NO: 169687 - protein, 9 aa, Homo Sapiens
ETDRKDLML

SEQ ID NO: 169688 - protein, 9 aa, Homo Sapiens
DPGTHACAT

SEQ ID NO: 169689 - protein, 9 aa, Homo Sapiens
LYLREDDAL

SEQ ID NO: 169690 - protein, 9 aa, Homo Sapiens
LTQRRASTK

SEQ ID NO: 169691 - protein, 9 aa, Homo Sapiens
RALYRDGML

SEQ ID NO: 169692 - protein, 9 aa, Homo Sapiens
QYLPSSWPN

SEQ ID NO: 169693 - protein, 9 aa, Homo Sapiens
CPGRERHLQ

SEQ ID NO: 169694 - protein, 9 aa, Homo Sapiens
PPPPPPPAM

SEQ ID NO: 169695 - protein, 9 aa, Homo Sapiens
DVSFGSGAL

SEQ ID NO: 169696 - protein, 9 aa, Homo Sapiens
PQWWERGPE

SEQ ID NO: 169697 - protein, 9 aa, Homo Sapiens
SPPSPPSSR

SEQ ID NO: 169698 - protein, 9 aa, Homo Sapiens
RKQFPDAHI

SEQ ID NO: 169699 - protein, 9 aa, Homo Sapiens
KSGTPPAAT

SEQ ID NO: 169700 - protein, 9 aa, Homo Sapiens
NTMLLDPPL

SEQ ID NO: 169701 - protein, 9 aa, Homo Sapiens
NAMQASGNC

SEQ ID NO: 169702 - protein, 9 aa, Homo Sapiens
YRKSPRFCP

SEQ ID NO: 169703 - protein, 9 aa, Homo Sapiens
QQHQKAALW

SEQ ID NO: 169704 - protein, 9 aa, Homo Sapiens
KAIIDFMHS

SEQ ID NO: 169705 - protein, 9 aa, Homo Sapiens
RGGVATPGR

SEQ ID NO: 169706 - protein, 9 aa, Homo Sapiens
QMQTTSANE

SEQ ID NO: 169707 - protein, 9 aa, Homo Sapiens
LCICVVAAH

SEQ ID NO: 169708 - protein, 9 aa, Homo Sapiens
SPTRWNTAA

SEQ ID NO: 169709 - protein, 9 aa, Homo Sapiens
SAPVARCQT

SEQ ID NO: 169710 - protein, 9 aa, Homo Sapiens
HIRKARGVF

SEQ ID NO: 169711 - protein, 9 aa, Homo Sapiens
DVLLLLAVA

SEQ ID NO: 169712 - protein, 9 aa, Homo Sapiens
SSHPASAIS

SEQ ID NO: 169713 - protein, 9 aa, Homo Sapiens
GGLPVDDAT

SEQ ID NO: 169714 - protein, 9 aa, Homo Sapiens
SGCRNVSRF

SEQ ID NO: 169715 - protein, 9 aa, Homo Sapiens
LTPPHPART

SEQ ID NO: 169716 - protein, 9 aa, Homo Sapiens
SRTTLPKSS

SEQ ID NO: 169717 - protein, 9 aa, Homo Sapiens
GQAAGRGGT

SEQ ID NO: 169718 - protein, 9 aa, Homo Sapiens
SMLSNQSFS

SEQ ID NO: 169719 - protein, 9 aa, Homo Sapiens
RLQLFEVHE

SEQ ID NO: 169720 - protein, 9 aa, Homo Sapiens
SSCCPASPH

SEQ ID NO: 169721 - protein, 9 aa, Homo Sapiens
EQERTSLQQ

SEQ ID NO: 169722 - protein, 9 aa, Homo Sapiens
KGPLEMIKL

SEQ ID NO: 169723 - protein, 9 aa, Homo Sapiens
DFDKAFSQA

SEQ ID NO: 169724 - protein, 9 aa, Homo Sapiens
QWVKLKLWD

SEQ ID NO: 169725 - protein, 9 aa, Homo Sapiens
RPGSPALCF

SEQ ID NO: 169726 - protein, 9 aa, Homo Sapiens
PPARQPSRP

SEQ ID NO: 169727 - protein, 9 aa, Homo Sapiens
RAQAVTLLL

SEQ ID NO: 169728 - protein, 9 aa, Homo Sapiens
MQTTSANEN

SEQ ID NO: 169729 - protein, 9 aa, Homo Sapiens
KVGVHIADM

SEQ ID NO: 169730 - protein, 9 aa, Homo Sapiens
GALRHPRGT

SEQ ID NO: 169731 - protein, 9 aa, Homo Sapiens
QCRQRAPLN

SEQ ID NO: 169732 - protein, 9 aa, Homo Sapiens
CRCHRMSRR

SEQ ID NO: 169733 - protein, 9 aa, Homo Sapiens
TPVFDQTSY

SEQ ID NO: 169734 - protein, 9 aa, Homo Sapiens
PLRWGWWVW

SEQ ID NO: 169735 - protein, 9 aa, Homo Sapiens
MRTAPSVWN

SEQ ID NO: 169736 - protein, 9 aa, Homo Sapiens
FMHSAHLAL

SEQ ID NO: 169737 - protein, 9 aa, Homo Sapiens
MATVYKICA

SEQ ID NO: 169738 - protein, 9 aa, Homo Sapiens
RVPREKRAQ

SEQ ID NO: 169739 - protein, 9 aa, Homo Sapiens
NIMGLFKKN

SEQ ID NO: 169740 - protein, 9 aa, Homo Sapiens
LADIVLAYV

SEQ ID NO: 169741 - protein, 9 aa, Homo Sapiens
EDKAEAMSS

SEQ ID NO: 169742 - protein, 9 aa, Homo Sapiens
LYRDGMLEN

SEQ ID NO: 169743 - protein, 9 aa, Homo Sapiens
CLNWVFKIA

SEQ ID NO: 169744 - protein, 9 aa, Homo Sapiens
PPSNAQYLP

SEQ ID NO: 169745 - protein, 9 aa, Homo Sapiens
AVSSHRNVI

SEQ ID NO: 169746 - protein, 9 aa, Homo Sapiens
RHESRLLQL

SEQ ID NO: 169747 - protein, 9 aa, Homo Sapiens
KKREKIINP

SEQ ID NO: 169748 - protein, 9 aa, Homo Sapiens
IPLLITVTL

SEQ ID NO: 169749 - protein, 9 aa, Homo Sapiens
IKMIWILPR

SEQ ID NO: 169750 - protein, 9 aa, Homo Sapiens
NTIAPSTEW

SEQ ID NO: 169751 - protein, 9 aa, Homo Sapiens
EAQRCPHCG

SEQ ID NO: 169752 - protein, 9 aa, Homo Sapiens
SVCSWPLSS

SEQ ID NO: 169753 - protein, 9 aa, Homo Sapiens
RELEGGWGG

SEQ ID NO: 169754 - protein, 9 aa, Homo Sapiens
VQLWDLIGL

SEQ ID NO: 169755 - protein, 9 aa, Homo Sapiens
HLFHLITEP

SEQ ID NO: 169756 - protein, 9 aa, Homo Sapiens
ENLCLPDIF

SEQ ID NO: 169757 - protein, 9 aa, Homo Sapiens
LRQPLYNIQ

SEQ ID NO: 169758 - protein, 9 aa, Homo Sapiens
GWEDRTKRT

SEQ ID NO: 169759 - protein, 9 aa, Homo Sapiens
PCCMRCPSR

SEQ ID NO: 169760 - protein, 9 aa, Homo Sapiens
APTLPRALA

SEQ ID NO: 169761 - protein, 9 aa, Homo Sapiens
ASIRSETLN

SEQ ID NO: 169762 - protein, 9 aa, Homo Sapiens
RGCPRKQPT

SEQ ID NO: 169763 - protein, 9 aa, Homo Sapiens
IRIVNAAGF

SEQ ID NO: 169764 - protein, 9 aa, Homo Sapiens
HKRLSYAFS

SEQ ID NO: 169765 - protein, 9 aa, Homo Sapiens
QNHSKCITE

SEQ ID NO: 169766 - protein, 9 aa, Homo Sapiens
NAQYLPRNQ

SEQ ID NO: 169767 - protein, 9 aa, Homo Sapiens
CVDEPGKCT

SEQ ID NO: 169768 - protein, 9 aa, Homo Sapiens
QGVPPWSPG

SEQ ID NO: 169769 - protein, 9 aa, Homo Sapiens
PLGKEGCFI

SEQ ID NO: 169770 - protein, 9 aa, Homo Sapiens
IGAILHLQN

SEQ ID NO: 169771 - protein, 9 aa, Homo Sapiens
GDEPQYLDP

SEQ ID NO: 169772 - protein, 9 aa, Homo Sapiens
RRPRTPEAL

SEQ ID NO: 169773 - protein, 9 aa, Homo Sapiens
DQRGQDRVH

SEQ ID NO: 169774 - protein, 9 aa, Homo Sapiens
CGGRERRDR

SEQ ID NO: 169775 - protein, 9 aa, Homo Sapiens
PSFNGCSRM

SEQ ID NO: 169776 - protein, 9 aa, Homo Sapiens
KKEKRHDEM

SEQ ID NO: 169777 - protein, 9 aa, Homo Sapiens
KTSEILHNI

SEQ ID NO: 169778 - protein, 9 aa, Homo Sapiens
PQITKVHFK

SEQ ID NO: 169779 - protein, 9 aa, Homo Sapiens
DQSIISYLN

SEQ ID NO: 169780 - protein, 9 aa, Homo Sapiens
LEELHLKMK

SEQ ID NO: 169781 - protein, 9 aa, Homo Sapiens
LSLQCQSLA

SEQ ID NO: 169782 - protein, 9 aa, Homo Sapiens
QDARTASLA

SEQ ID NO: 169783 - protein, 9 aa, Homo Sapiens
RSGQWAQPP

SEQ ID NO: 169784 - protein, 9 aa, Homo Sapiens
NGHFRPPVD

SEQ ID NO: 169785 - protein, 9 aa, Homo Sapiens
GVNPGMVIS

SEQ ID NO: 169786 - protein, 9 aa, Homo Sapiens
ETLAVQPRA

SEQ ID NO: 169787 - protein, 9 aa, Homo Sapiens
LHDSRTSYN

SEQ ID NO: 169788 - protein, 9 aa, Homo Sapiens
SGPQAPERP

SEQ ID NO: 169789 - protein, 9 aa, Homo Sapiens
WLAPGRTKT

SEQ ID NO: 169790 - protein, 9 aa, Homo Sapiens
KMKMAGLNT

SEQ ID NO: 169791 - protein, 9 aa, Homo Sapiens
GNGPPTWPT

SEQ ID NO: 169792 - protein, 9 aa, Homo Sapiens
GPSPAGWMR

SEQ ID NO: 169793 - protein, 9 aa, Homo Sapiens
RRRQRRTVT

SEQ ID NO: 169794 - protein, 9 aa, Homo Sapiens
AHSSASSWS

SEQ ID NO: 169795 - protein, 9 aa, Homo Sapiens
RSRPSAQRP

SEQ ID NO: 169796 - protein, 9 aa, Homo Sapiens
WRAVATRPR

SEQ ID NO: 169797 - protein, 9 aa, Homo Sapiens
LRQLRAHFV

SEQ ID NO: 169798 - protein, 9 aa, Homo Sapiens
TQRRSFSSI

SEQ ID NO: 169799 - protein, 9 aa, Homo Sapiens
YPSGPQAFS

SEQ ID NO: 169800 - protein, 9 aa, Homo Sapiens
YRDGMLENY

SEQ ID NO: 169801 - protein, 9 aa, Homo Sapiens
VCLTISEKG

SEQ ID NO: 169802 - protein, 9 aa, Homo Sapiens
GPAAGGCPQ

SEQ ID NO: 169803 - protein, 9 aa, Homo Sapiens
IEHLSHLYI

SEQ ID NO: 169804 - protein, 9 aa, Homo Sapiens
KLTVPHSLL

SEQ ID NO: 169805 - protein, 9 aa, Homo Sapiens
ATIGTNLHL

SEQ ID NO: 169806 - protein, 9 aa, Homo Sapiens
GSGALTVKL

SEQ ID NO: 169807 - protein, 9 aa, Homo Sapiens
DAGIRRSSI

SEQ ID NO: 169808 - protein, 9 aa, Homo Sapiens
KKKPKKKKK

SEQ ID NO: 169809 - protein, 9 aa, Homo Sapiens
CDLPCGFQE

SEQ ID NO: 169810 - protein, 9 aa, Homo Sapiens
FLSLVVVNQ

SEQ ID NO: 169811 - protein, 9 aa, Homo Sapiens
LGQRATRHG

SEQ ID NO: 169812 - protein, 9 aa, Homo Sapiens
RHPLKSFFI

SEQ ID NO: 169813 - protein, 9 aa, Homo Sapiens
PGSAQSSSC

SEQ ID NO: 169814 - protein, 9 aa, Homo Sapiens
FSTKSGWRC

SEQ ID NO: 169815 - protein, 9 aa, Homo Sapiens
AVLSTIFTS

SEQ ID NO: 169816 - protein, 9 aa, Homo Sapiens
RGSPGGPSS

SEQ ID NO: 169817 - protein, 9 aa, Homo Sapiens
DLDMANASL

SEQ ID NO: 169818 - protein, 9 aa, Homo Sapiens
RGARPAGGG

SEQ ID NO: 169819 - protein, 9 aa, Homo Sapiens
VAFLPPMHC

SEQ ID NO: 169820 - protein, 9 aa, Homo Sapiens
CTTAARRVK

SEQ ID NO: 169821 - protein, 9 aa, Homo Sapiens
SSSPCQDLP

SEQ ID NO: 169822 - protein, 9 aa, Homo Sapiens
QPVIREPAT

SEQ ID NO: 169823 - protein, 9 aa, Homo Sapiens
LAASSVKKP

SEQ ID NO: 169824 - protein, 9 aa, Homo Sapiens
CLPPQTLEG

SEQ ID NO: 169825 - protein, 9 aa, Homo Sapiens
DMDMDAPEE

SEQ ID NO: 169826 - protein, 9 aa, Homo Sapiens
LQCSYNTAQ

SEQ ID NO: 169827 - protein, 9 aa, Homo Sapiens
CRQRCWPLR

SEQ ID NO: 169828 - protein, 9 aa, Homo Sapiens
VPLNSQIKI

SEQ ID NO: 169829 - protein, 9 aa, Homo Sapiens
SIPVLLIMV

SEQ ID NO: 169830 - protein, 9 aa, Homo Sapiens
SNPGVHPQL

SEQ ID NO: 169831 - protein, 9 aa, Homo Sapiens
EGSGDLELE

SEQ ID NO: 169832 - protein, 9 aa, Homo Sapiens
QCANVAPAP

SEQ ID NO: 169833 - protein, 9 aa, Homo Sapiens
TQLLLNDNR

SEQ ID NO: 169834 - protein, 9 aa, Homo Sapiens
TLDLVAKGI

SEQ ID NO: 169835 - protein, 9 aa, Homo Sapiens
LRVAFSVAT

SEQ ID NO: 169836 - protein, 9 aa, Homo Sapiens
AVVLAGTAE

SEQ ID NO: 169837 - protein, 9 aa, Homo Sapiens
RVLQQVPCS

SEQ ID NO: 169838 - protein, 9 aa, Homo Sapiens
QGPHNANED

SEQ ID NO: 169839 - protein, 9 aa, Homo Sapiens
GTQQMYEPD

SEQ ID NO: 169840 - protein, 9 aa, Homo Sapiens
LNIAPCVHF

SEQ ID NO: 169841 - protein, 9 aa, Homo Sapiens
IIDTFADLC

SEQ ID NO: 169842 - protein, 9 aa, Homo Sapiens
KGGVGKTAC

SEQ ID NO: 169843 - protein, 9 aa, Homo Sapiens
WKMAALFLT

SEQ ID NO: 169844 - protein, 9 aa, Homo Sapiens
AEAWHLYNY

SEQ ID NO: 169845 - protein, 9 aa, Homo Sapiens
LLLAQKLTA

SEQ ID NO: 169846 - protein, 9 aa, Homo Sapiens
VRAWADVRH

SEQ ID NO: 169847 - protein, 9 aa, Homo Sapiens
FHPRFHSSP

SEQ ID NO: 169848 - protein, 9 aa, Homo Sapiens
QKPSASPRS

SEQ ID NO: 169849 - protein, 9 aa, Homo Sapiens
SWHGDSDGT

SEQ ID NO: 169850 - protein, 9 aa, Homo Sapiens
AAAVYAGMI

SEQ ID NO: 169851 - protein, 9 aa, Homo Sapiens
LTRGSQVAG

SEQ ID NO: 169852 - protein, 9 aa, Homo Sapiens
ILSTKASNT

SEQ ID NO: 169853 - protein, 9 aa, Homo Sapiens
FSLKTPNSP

SEQ ID NO: 169854 - protein, 9 aa, Homo Sapiens
KVLAEGQWI

SEQ ID NO: 169855 - protein, 9 aa, Homo Sapiens
LGYANTALN

SEQ ID NO: 169856 - protein, 9 aa, Homo Sapiens
PGRPCRVPC

SEQ ID NO: 169857 - protein, 9 aa, Homo Sapiens
EQVIKESDT

SEQ ID NO: 169858 - protein, 9 aa, Homo Sapiens
QGWRAGDRT

SEQ ID NO: 169859 - protein, 9 aa, Homo Sapiens
EGAQELAGQ

SEQ ID NO: 169860 - protein, 9 aa, Homo Sapiens
QRSFLVLLL

SEQ ID NO: 169861 - protein, 9 aa, Homo Sapiens
SSLFLLLVL

SEQ ID NO: 169862 - protein, 9 aa, Homo Sapiens
KSITTERYP

SEQ ID NO: 169863 - protein, 9 aa, Homo Sapiens
MSGCRKWCK

SEQ ID NO: 169864 - protein, 9 aa, Homo Sapiens
AAVTLKWPP

SEQ ID NO: 169865 - protein, 9 aa, Homo Sapiens
DVPCIFEAS

SEQ ID NO: 169866 - protein, 9 aa, Homo Sapiens
VEHGQWRLI

SEQ ID NO: 169867 - protein, 9 aa, Homo Sapiens
NHHVPRTRR

SEQ ID NO: 169868 - protein, 9 aa, Homo Sapiens
LALFRQGLR

SEQ ID NO: 169869 - protein, 9 aa, Homo Sapiens
RTGRGLRQR

SEQ ID NO: 169870 - protein, 9 aa, Homo Sapiens
ESILYAWDA

SEQ ID NO: 169871 - protein, 9 aa, Homo Sapiens
NIHGTSNKR

SEQ ID NO: 169872 - protein, 9 aa, Homo Sapiens
REDSYMTSM

SEQ ID NO: 169873 - protein, 9 aa, Homo Sapiens
AEEALGGPG

SEQ ID NO: 169874 - protein, 9 aa, Homo Sapiens
HFLLILCCV

SEQ ID NO: 169875 - protein, 9 aa, Homo Sapiens
VFSVSIPNL

SEQ ID NO: 169876 - protein, 9 aa, Homo Sapiens
ITPPQSSRC

SEQ ID NO: 169877 - protein, 9 aa, Homo Sapiens
RVVLRPWCP

SEQ ID NO: 169878 - protein, 9 aa, Homo Sapiens
AAGPGGCVP

SEQ ID NO: 169879 - protein, 9 aa, Homo Sapiens
RLLQSCILS

SEQ ID NO: 169880 - protein, 9 aa, Homo Sapiens
MPRTLEGCI

SEQ ID NO: 169881 - protein, 9 aa, Homo Sapiens
RAAADLEHF

SEQ ID NO: 169882 - protein, 9 aa, Homo Sapiens
TSDSGSTTS

SEQ ID NO: 169883 - protein, 9 aa, Homo Sapiens
SLRMTPTCP

SEQ ID NO: 169884 - protein, 9 aa, Homo Sapiens
LPQTPTSTP

SEQ ID NO: 169885 - protein, 9 aa, Homo Sapiens
EKCQFSTKS

SEQ ID NO: 169886 - protein, 9 aa, Homo Sapiens
FLHQGRPPS

SEQ ID NO: 169887 - protein, 9 aa, Homo Sapiens
APPTPPSVR

SEQ ID NO: 169888 - protein, 9 aa, Homo Sapiens
RPEQLPQHA

SEQ ID NO: 169889 - protein, 9 aa, Homo Sapiens
PSNPGVHPQ

SEQ ID NO: 169890 - protein, 9 aa, Homo Sapiens
VTGPDEEEL

SEQ ID NO: 169891 - protein, 9 aa, Homo Sapiens
NGLHQFQGR

SEQ ID NO: 169892 - protein, 9 aa, Homo Sapiens
DIDSDEVDR

SEQ ID NO: 169893 - protein, 9 aa, Homo Sapiens
PRSGWRTAV

SEQ ID NO: 169894 - protein, 9 aa, Homo Sapiens
PCCCSSGYG

SEQ ID NO: 169895 - protein, 9 aa, Homo Sapiens
ALGMGDQAL

SEQ ID NO: 169896 - protein, 9 aa, Homo Sapiens
TLGTLKRLL

SEQ ID NO: 169897 - protein, 9 aa, Homo Sapiens
CLRLLPGRL

SEQ ID NO: 169898 - protein, 9 aa, Homo Sapiens
SGSSQFPHR

SEQ ID NO: 169899 - protein, 9 aa, Homo Sapiens
RNFSDPRNG

SEQ ID NO: 169900 - protein, 9 aa, Homo Sapiens
EAISTLHFC

SEQ ID NO: 169901 - protein, 9 aa, Homo Sapiens
GGAGGSTAA

SEQ ID NO: 169902 - protein, 9 aa, Homo Sapiens
EYNRPHRYS

SEQ ID NO: 169903 - protein, 9 aa, Homo Sapiens
VHIHCWLSP

SEQ ID NO: 169904 - protein, 9 aa, Homo Sapiens
VVKFFLQLQ

SEQ ID NO: 169905 - protein, 9 aa, Homo Sapiens
PQQQPPAAA

SEQ ID NO: 169906 - protein, 9 aa, Homo Sapiens
KNCELAFTM

SEQ ID NO: 169907 - protein, 9 aa, Homo Sapiens
CMPSCHSPR

SEQ ID NO: 169908 - protein, 9 aa, Homo Sapiens
NENDILLVR

SEQ ID NO: 169909 - protein, 9 aa, Homo Sapiens
RKWCKREIL

SEQ ID NO: 169910 - protein, 9 aa, Homo Sapiens
PPLLHPQWA

SEQ ID NO: 169911 - protein, 9 aa, Homo Sapiens
MKLVVQVGL

SEQ ID NO: 169912 - protein, 9 aa, Homo Sapiens
FLATSSPTR

SEQ ID NO: 169913 - protein, 9 aa, Homo Sapiens
ASVPGLPKV

SEQ ID NO: 169914 - protein, 9 aa, Homo Sapiens
TPNSPPTPA

SEQ ID NO: 169915 - protein, 9 aa, Homo Sapiens
RIGGGTPLS

SEQ ID NO: 169916 - protein, 9 aa, Homo Sapiens
TEAKKAYPS

SEQ ID NO: 169917 - protein, 9 aa, Homo Sapiens
PHRTSENTH

SEQ ID NO: 169918 - protein, 9 aa, Homo Sapiens
NTSAMKEGT

SEQ ID NO: 169919 - protein, 9 aa, Homo Sapiens
ATAMEDVPW

SEQ ID NO: 169920 - protein, 9 aa, Homo Sapiens
KSLERGRGI

SEQ ID NO: 169921 - protein, 9 aa, Homo Sapiens
SYMAMIQFT

SEQ ID NO: 169922 - protein, 9 aa, Homo Sapiens
DAHNASAPF

SEQ ID NO: 169923 - protein, 9 aa, Homo Sapiens
QAVTLLLDM

SEQ ID NO: 169924 - protein, 9 aa, Homo Sapiens
VGLAAVCFF

SEQ ID NO: 169925 - protein, 9 aa, Homo Sapiens
CFWKFARKW

SEQ ID NO: 169926 - protein, 9 aa, Homo Sapiens
LSHLYIAYQ

SEQ ID NO: 169927 - protein, 9 aa, Homo Sapiens
WCTTAARRV

SEQ ID NO: 169928 - protein, 9 aa, Homo Sapiens
SQIKIFQNY

SEQ ID NO: 169929 - protein, 9 aa, Homo Sapiens
FSRSHLDFS

SEQ ID NO: 169930 - protein, 9 aa, Homo Sapiens
SLVKGTLSP

SEQ ID NO: 169931 - protein, 9 aa, Homo Sapiens
QFHLVTRFV

SEQ ID NO: 169932 - protein, 9 aa, Homo Sapiens
GSSWRSYPL

SEQ ID NO: 169933 - protein, 9 aa, Homo Sapiens
PGSRSPSHV

SEQ ID NO: 169934 - protein, 9 aa, Homo Sapiens
PSPPPHPQV

SEQ ID NO: 169935 - protein, 9 aa, Homo Sapiens
SNISKKVSW

SEQ ID NO: 169936 - protein, 9 aa, Homo Sapiens
CVSLNRKCN

SEQ ID NO: 169937 - protein, 9 aa, Homo Sapiens
GHGRLVIVG

SEQ ID NO: 169938 - protein, 9 aa, Homo Sapiens
IGGPTAGGA

SEQ ID NO: 169939 - protein, 9 aa, Homo Sapiens
STRGLLLSG

SEQ ID NO: 169940 - protein, 9 aa, Homo Sapiens
PVRLQKYPQ

SEQ ID NO: 169941 - protein, 9 aa, Homo Sapiens
LHLYPGPMV

SEQ ID NO: 169942 - protein, 9 aa, Homo Sapiens
RQCDTVVED

SEQ ID NO: 169943 - protein, 9 aa, Homo Sapiens
THQMRTAPS

SEQ ID NO: 169944 - protein, 9 aa, Homo Sapiens
AEPNGLAPN

SEQ ID NO: 169945 - protein, 9 aa, Homo Sapiens
LPPMHCPTA

SEQ ID NO: 169946 - protein, 9 aa, Homo Sapiens
GSCPRSAWK

SEQ ID NO: 169947 - protein, 9 aa, Homo Sapiens
MAACHPQRV

SEQ ID NO: 169948 - protein, 9 aa, Homo Sapiens
TAATLRCPA

SEQ ID NO: 169949 - protein, 9 aa, Homo Sapiens
LTLSTRAPG

SEQ ID NO: 169950 - protein, 9 aa, Homo Sapiens
HIQFDPFPF

SEQ ID NO: 169951 - protein, 9 aa, Homo Sapiens
YPAPYLSLV

SEQ ID NO: 169952 - protein, 9 aa, Homo Sapiens
SKARFHSGL

SEQ ID NO: 169953 - protein, 9 aa, Homo Sapiens
DHRTSQNHS

SEQ ID NO: 169954 - protein, 9 aa, Homo Sapiens
IQTVPTETI

SEQ ID NO: 169955 - protein, 9 aa, Homo Sapiens
PESPVDTCI

SEQ ID NO: 169956 - protein, 9 aa, Homo Sapiens
LYKTCRRPH

SEQ ID NO: 169957 - protein, 9 aa, Homo Sapiens
ALGKTRVGG

SEQ ID NO: 169958 - protein, 9 aa, Homo Sapiens
LLPEPGPAA

SEQ ID NO: 169959 - protein, 9 aa, Homo Sapiens
SRRCEQSSS

SEQ ID NO: 169960 - protein, 9 aa, Homo Sapiens
GRTTPVNPR

SEQ ID NO: 169961 - protein, 9 aa, Homo Sapiens
DAFAFTMTF

SEQ ID NO: 169962 - protein, 9 aa, Homo Sapiens
SNAQYLPRN

SEQ ID NO: 169963 - protein, 9 aa, Homo Sapiens
PQARQGAEE

SEQ ID NO: 169964 - protein, 9 aa, Homo Sapiens
NETGQQLIG

SEQ ID NO: 169965 - protein, 9 aa, Homo Sapiens
SRRSRPQGL

SEQ ID NO: 169966 - protein, 9 aa, Homo Sapiens
REAWQGVSE

SEQ ID NO: 169967 - protein, 9 aa, Homo Sapiens
QELQVISCL

SEQ ID NO: 169968 - protein, 9 aa, Homo Sapiens
ISYLNTASS

SEQ ID NO: 169969 - protein, 9 aa, Homo Sapiens
RAQWVSVAT

SEQ ID NO: 169970 - protein, 9 aa, Homo Sapiens
TWGRPTAAP

SEQ ID NO: 169971 - protein, 9 aa, Homo Sapiens
DPGEPENGN

SEQ ID NO: 169972 - protein, 9 aa, Homo Sapiens
GCRNVSRFQ

SEQ ID NO: 169973 - protein, 9 aa, Homo Sapiens
PGEALPLLL

SEQ ID NO: 169974 - protein, 9 aa, Homo Sapiens
WPFIVKRHE

SEQ ID NO: 169975 - protein, 9 aa, Homo Sapiens
ADVDTSCKD

SEQ ID NO: 169976 - protein, 9 aa, Homo Sapiens
HLQHSDQGE

SEQ ID NO: 169977 - protein, 9 aa, Homo Sapiens
AAPSVTPAL

SEQ ID NO: 169978 - protein, 9 aa, Homo Sapiens
ISVVHIHCW

SEQ ID NO: 169979 - protein, 9 aa, Homo Sapiens
KKYPPQLTK

SEQ ID NO: 169980 - protein, 9 aa, Homo Sapiens
PQSLPPATT

SEQ ID NO: 169981 - protein, 9 aa, Homo Sapiens
EFTHLTVNI

SEQ ID NO: 169982 - protein, 9 aa, Homo Sapiens
QLQVVKEGD

SEQ ID NO: 169983 - protein, 9 aa, Homo Sapiens
VQGAVCDTR

SEQ ID NO: 169984 - protein, 9 aa, Homo Sapiens
HSFGSFLQG

SEQ ID NO: 169985 - protein, 9 aa, Homo Sapiens
RSRGAMEET

SEQ ID NO: 169986 - protein, 9 aa, Homo Sapiens
RDGMLENYG

SEQ ID NO: 169987 - protein, 9 aa, Homo Sapiens
GKWPLKWYT

SEQ ID NO: 169988 - protein, 9 aa, Homo Sapiens
WAWKGLWRY

SEQ ID NO: 169989 - protein, 9 aa, Homo Sapiens
SQFDVYEVV

SEQ ID NO: 169990 - protein, 9 aa, Homo Sapiens
VHLGAFHPA

SEQ ID NO: 169991 - protein, 9 aa, Homo Sapiens
VMVKTDAVI

SEQ ID NO: 169992 - protein, 9 aa, Homo Sapiens
VESELERGV

SEQ ID NO: 169993 - protein, 9 aa, Homo Sapiens
LSFRVFCLL

SEQ ID NO: 169994 - protein, 9 aa, Homo Sapiens
WLSPPLGLH

SEQ ID NO: 169995 - protein, 9 aa, Homo Sapiens
VTSAQVVGA

SEQ ID NO: 169996 - protein, 9 aa, Homo Sapiens
WPPSCPQGT

SEQ ID NO: 169997 - protein, 9 aa, Homo Sapiens
VAVVLAGTA

SEQ ID NO: 169998 - protein, 9 aa, Homo Sapiens
CGVLDLDRP

SEQ ID NO: 169999 - protein, 9 aa, Homo Sapiens
HTPSPESHR

SEQ ID NO: 170000 - protein, 9 aa, Homo Sapiens
TVDWPGWYK

SEQ ID NO: 170001 - protein, 9 aa, Homo Sapiens
FFFPSNGLT

SEQ ID NO: 170002 - protein, 9 aa, Homo Sapiens
EHFFNFCGL

SEQ ID NO: 170003 - protein, 9 aa, Homo Sapiens
LLLGFLVRE

SEQ ID NO: 170004 - protein, 9 aa, Homo Sapiens
TRILPRAGT

SEQ ID NO: 170005 - protein, 9 aa, Homo Sapiens
VTLTISAAH

SEQ ID NO: 170006 - protein, 9 aa, Homo Sapiens
PSFSAPCCW

SEQ ID NO: 170007 - protein, 9 aa, Homo Sapiens
VSPTWPIPA

SEQ ID NO: 170008 - protein, 9 aa, Homo Sapiens
RWWSWQQDS

SEQ ID NO: 170009 - protein, 9 aa, Homo Sapiens
SSDQLRCSQ

SEQ ID NO: 170010 - protein, 9 aa, Homo Sapiens
EGQNYQNCI

SEQ ID NO: 170011 - protein, 9 aa, Homo Sapiens
LQAPPAWSA

SEQ ID NO: 170012 - protein, 9 aa, Homo Sapiens
CDDFDKAFS

SEQ ID NO: 170013 - protein, 9 aa, Homo Sapiens
RHVLVTPGE

SEQ ID NO: 170014 - protein, 9 aa, Homo Sapiens
SETLNLSLG

SEQ ID NO: 170015 - protein, 9 aa, Homo Sapiens
VLRWWVDHL

SEQ ID NO: 170016 - protein, 9 aa, Homo Sapiens
TGVRTSEGS

SEQ ID NO: 170017 - protein, 9 aa, Homo Sapiens
GQSPTDEIA

SEQ ID NO: 170018 - protein, 9 aa, Homo Sapiens
PNPKIICQE

SEQ ID NO: 170019 - protein, 9 aa, Homo Sapiens
DQPEQEERR

SEQ ID NO: 170020 - protein, 9 aa, Homo Sapiens
PEPNGSPTS

SEQ ID NO: 170021 - protein, 9 aa, Homo Sapiens
AGGSTAARA

SEQ ID NO: 170022 - protein, 9 aa, Homo Sapiens
VIAEAEDRY

SEQ ID NO: 170023 - protein, 9 aa, Homo Sapiens
KCSNPLARE

SEQ ID NO: 170024 - protein, 9 aa, Homo Sapiens
AQAVRCPVP

SEQ ID NO: 170025 - protein, 9 aa, Homo Sapiens
FPEDLWNIH

SEQ ID NO: 170026 - protein, 9 aa, Homo Sapiens
NGAVANAAC

SEQ ID NO: 170027 - protein, 9 aa, Homo Sapiens
SKRTPQQVV

SEQ ID NO: 170028 - protein, 9 aa, Homo Sapiens
ADEMVIKYV

SEQ ID NO: 170029 - protein, 9 aa, Homo Sapiens
RTRAGYLTT

SEQ ID NO: 170030 - protein, 9 aa, Homo Sapiens
RPACTCISM

SEQ ID NO: 170031 - protein, 9 aa, Homo Sapiens
DCHHTHLSE

SEQ ID NO: 170032 - protein, 9 aa, Homo Sapiens
VLDLPQPLA

SEQ ID NO: 170033 - protein, 9 aa, Homo Sapiens
KWREGRARG

SEQ ID NO: 170034 - protein, 9 aa, Homo Sapiens
SADLRDLAK

SEQ ID NO: 170035 - protein, 9 aa, Homo Sapiens
APESGPPPS

SEQ ID NO: 170036 - protein, 9 aa, Homo Sapiens
LVVLSLILC

SEQ ID NO: 170037 - protein, 9 aa, Homo Sapiens
LSPSHPPRP

SEQ ID NO: 170038 - protein, 9 aa, Homo Sapiens
STGNGPPTW

SEQ ID NO: 170039 - protein, 9 aa, Homo Sapiens
FKCRSCQME

SEQ ID NO: 170040 - protein, 9 aa, Homo Sapiens
QIVLGKWVI

SEQ ID NO: 170041 - protein, 9 aa, Homo Sapiens
GRPPSSPKA

SEQ ID NO: 170042 - protein, 9 aa, Homo Sapiens
GTPGIRGPH

SEQ ID NO: 170043 - protein, 9 aa, Homo Sapiens
SPQLQDGSL

SEQ ID NO: 170044 - protein, 9 aa, Homo Sapiens
HLRVPRHRL

SEQ ID NO: 170045 - protein, 9 aa, Homo Sapiens
ELRHHEWVH

SEQ ID NO: 170046 - protein, 9 aa, Homo Sapiens
KRRRKLKTI

SEQ ID NO: 170047 - protein, 9 aa, Homo Sapiens
VLLAWPVPS

SEQ ID NO: 170048 - protein, 9 aa, Homo Sapiens
SLAPGYLLP

SEQ ID NO: 170049 - protein, 9 aa, Homo Sapiens
TKMAGIVCA

SEQ ID NO: 170050 - protein, 9 aa, Homo Sapiens
QITIPRKTS

SEQ ID NO: 170051 - protein, 9 aa, Homo Sapiens
PFIVKRHES

SEQ ID NO: 170052 - protein, 9 aa, Homo Sapiens
TISGHEVVG

SEQ ID NO: 170053 - protein, 9 aa, Homo Sapiens
SGSNIGRQY

SEQ ID NO: 170054 - protein, 9 aa, Homo Sapiens
LPLLVEVQN

SEQ ID NO: 170055 - protein, 9 aa, Homo Sapiens
TTLHVLLVD

SEQ ID NO: 170056 - protein, 9 aa, Homo Sapiens
FPGAPQPAR

SEQ ID NO: 170057 - protein, 9 aa, Homo Sapiens
MDAHNASAP

SEQ ID NO: 170058 - protein, 9 aa, Homo Sapiens
FSTAGEYDI

SEQ ID NO: 170059 - protein, 9 aa, Homo Sapiens
LRHQRTHMG

SEQ ID NO: 170060 - protein, 9 aa, Homo Sapiens
ASKLTLENL

SEQ ID NO: 170061 - protein, 9 aa, Homo Sapiens
LYLVVVAAA

SEQ ID NO: 170062 - protein, 9 aa, Homo Sapiens
SPHSPGASP

SEQ ID NO: 170063 - protein, 9 aa, Homo Sapiens
GQDGQPQWE

SEQ ID NO: 170064 - protein, 9 aa, Homo Sapiens
FRCCSQDCG

SEQ ID NO: 170065 - protein, 9 aa, Homo Sapiens
AAGAVLRVE

SEQ ID NO: 170066 - protein, 9 aa, Homo Sapiens
HPPTGPLLC

SEQ ID NO: 170067 - protein, 9 aa, Homo Sapiens
METPVKKNQ

SEQ ID NO: 170068 - protein, 9 aa, Homo Sapiens
RHCLHPQSR

SEQ ID NO: 170069 - protein, 9 aa, Homo Sapiens
PGRTKTFRL

SEQ ID NO: 170070 - protein, 9 aa, Homo Sapiens
LWFRLFHTA

SEQ ID NO: 170071 - protein, 9 aa, Homo Sapiens
RHRLQRRQG

SEQ ID NO: 170072 - protein, 9 aa, Homo Sapiens
LSLWPVVPE

SEQ ID NO: 170073 - protein, 9 aa, Homo Sapiens
QVSLITPPQ

SEQ ID NO: 170074 - protein, 9 aa, Homo Sapiens
PMLCSYLPQ

SEQ ID NO: 170075 - protein, 9 aa, Homo Sapiens
EEKLFPQCQ

SEQ ID NO: 170076 - protein, 9 aa, Homo Sapiens
GTQVMQLQE

SEQ ID NO: 170077 - protein, 9 aa, Homo Sapiens
ILGGHFGGD

SEQ ID NO: 170078 - protein, 9 aa, Homo Sapiens
NGALKHLQD

SEQ ID NO: 170079 - protein, 9 aa, Homo Sapiens
WNASRPPQA

SEQ ID NO: 170080 - protein, 9 aa, Homo Sapiens
HLYGSYPPA

SEQ ID NO: 170081 - protein, 9 aa, Homo Sapiens
ALGRPVLLC

SEQ ID NO: 170082 - protein, 9 aa, Homo Sapiens
YRKSGTHQM

SEQ ID NO: 170083 - protein, 9 aa, Homo Sapiens
QLLGLVLLA

SEQ ID NO: 170084 - protein, 9 aa, Homo Sapiens
VVKKGNAKK

SEQ ID NO: 170085 - protein, 9 aa, Homo Sapiens
QGACKICQK

SEQ ID NO: 170086 - protein, 9 aa, Homo Sapiens
ARRSPATME

SEQ ID NO: 170087 - protein, 9 aa, Homo Sapiens
NRARTSFCV

SEQ ID NO: 170088 - protein, 9 aa, Homo Sapiens
EPWRAGFQW

SEQ ID NO: 170089 - protein, 9 aa, Homo Sapiens
VEEKTQSRS

SEQ ID NO: 170090 - protein, 9 aa, Homo Sapiens
ITECVRTAL

SEQ ID NO: 170091 - protein, 9 aa, Homo Sapiens
FERFGCRRV

SEQ ID NO: 170092 - protein, 9 aa, Homo Sapiens
LSRVRSDVL

SEQ ID NO: 170093 - protein, 9 aa, Homo Sapiens
ETVVVAVAT

SEQ ID NO: 170094 - protein, 9 aa, Homo Sapiens
DVHHVEEAQ

SEQ ID NO: 170095 - protein, 9 aa, Homo Sapiens
VLVCATAME

SEQ ID NO: 170096 - protein, 9 aa, Homo Sapiens
GSPALCFAS

SEQ ID NO: 170097 - protein, 9 aa, Homo Sapiens
ATTTCPGPS

SEQ ID NO: 170098 - protein, 9 aa, Homo Sapiens
CFVSEIIGI

SEQ ID NO: 170099 - protein, 9 aa, Homo Sapiens
NNTEVLTSD

SEQ ID NO: 170100 - protein, 9 aa, Homo Sapiens
VLGKWVIRK

SEQ ID NO: 170101 - protein, 9 aa, Homo Sapiens
MHSFGSFLQ

SEQ ID NO: 170102 - protein, 9 aa, Homo Sapiens
FGMSVCSWP

SEQ ID NO: 170103 - protein, 9 aa, Homo Sapiens
ARRPRALGA

SEQ ID NO: 170104 - protein, 9 aa, Homo Sapiens
GLQWGRRRL

SEQ ID NO: 170105 - protein, 9 aa, Homo Sapiens
CSIDTDIDS

SEQ ID NO: 170106 - protein, 9 aa, Homo Sapiens
APEAQDGSP

SEQ ID NO: 170107 - protein, 9 aa, Homo Sapiens
VDEPGKCTV

SEQ ID NO: 170108 - protein, 9 aa, Homo Sapiens
LTLENLEAV

SEQ ID NO: 170109 - protein, 9 aa, Homo Sapiens
AYHRNSVRF

SEQ ID NO: 170110 - protein, 9 aa, Homo Sapiens
RCSSIYRSS

SEQ ID NO: 170111 - protein, 9 aa, Homo Sapiens
LRTNRNNLN

SEQ ID NO: 170112 - protein, 9 aa, Homo Sapiens
VYPTRILPR

SEQ ID NO: 170113 - protein, 9 aa, Homo Sapiens
SLEAAWEEN

SEQ ID NO: 170114 - protein, 9 aa, Homo Sapiens
LGTQVMQLQ

SEQ ID NO: 170115 - protein, 9 aa, Homo Sapiens
PRLSLPPCL

SEQ ID NO: 170116 - protein, 9 aa, Homo Sapiens
EELCAWVET

SEQ ID NO: 170117 - protein, 9 aa, Homo Sapiens
IIDFMHSAH

SEQ ID NO: 170118 - protein, 9 aa, Homo Sapiens
MKRRRKLKT

SEQ ID NO: 170119 - protein, 9 aa, Homo Sapiens
DRLVGRSQP

SEQ ID NO: 170120 - protein, 9 aa, Homo Sapiens
STFIEPPQY

SEQ ID NO: 170121 - protein, 9 aa, Homo Sapiens
GDVLVRRSH

SEQ ID NO: 170122 - protein, 9 aa, Homo Sapiens
HGHLFHLIT

SEQ ID NO: 170123 - protein, 9 aa, Homo Sapiens
PGKSPEIQM

SEQ ID NO: 170124 - protein, 9 aa, Homo Sapiens
TETESQCRE

SEQ ID NO: 170125 - protein, 9 aa, Homo Sapiens
LGCGVCPLA

SEQ ID NO: 170126 - protein, 9 aa, Homo Sapiens
GDVEEKTQS

SEQ ID NO: 170127 - protein, 9 aa, Homo Sapiens
GHPVLTPRA

SEQ ID NO: 170128 - protein, 9 aa, Homo Sapiens
RPAAPQARQ

SEQ ID NO: 170129 - protein, 9 aa, Homo Sapiens
VVCLCTIFL

SEQ ID NO: 170130 - protein, 9 aa, Homo Sapiens
RYKQQLTTH

SEQ ID NO: 170131 - protein, 9 aa, Homo Sapiens
GPARTGLLP

SEQ ID NO: 170132 - protein, 9 aa, Homo Sapiens
LNRMNQCAA

SEQ ID NO: 170133 - protein, 9 aa, Homo Sapiens
SRSAACGGR

SEQ ID NO: 170134 - protein, 9 aa, Homo Sapiens
EETVVVAVA

SEQ ID NO: 170135 - protein, 9 aa, Homo Sapiens
GPRFMTLEY

SEQ ID NO: 170136 - protein, 9 aa, Homo Sapiens
IVKSKTVAQ

SEQ ID NO: 170137 - protein, 9 aa, Homo Sapiens
LRTPYRPPT

SEQ ID NO: 170138 - protein, 9 aa, Homo Sapiens
EDVPLVIPD

SEQ ID NO: 170139 - protein, 9 aa, Homo Sapiens
GLIAGSLDS

SEQ ID NO: 170140 - protein, 9 aa, Homo Sapiens
GRGLRQRRG

SEQ ID NO: 170141 - protein, 9 aa, Homo Sapiens
RQIEEWKVL

SEQ ID NO: 170142 - protein, 9 aa, Homo Sapiens
VLKNIYRKS

SEQ ID NO: 170143 - protein, 9 aa, Homo Sapiens
ESQVWQLAW

SEQ ID NO: 170144 - protein, 9 aa, Homo Sapiens
ACPMTACSI

SEQ ID NO: 170145 - protein, 9 aa, Homo Sapiens
TCVCLLGGR

SEQ ID NO: 170146 - protein, 9 aa, Homo Sapiens
PKEKTIKKI

SEQ ID NO: 170147 - protein, 9 aa, Homo Sapiens
DCCDNCPYN

SEQ ID NO: 170148 - protein, 9 aa, Homo Sapiens
QLLLNDNRL

SEQ ID NO: 170149 - protein, 9 aa, Homo Sapiens
LVRYMEEKD

SEQ ID NO: 170150 - protein, 9 aa, Homo Sapiens
SPAASNTAQ

SEQ ID NO: 170151 - protein, 9 aa, Homo Sapiens
FMDSCSLNW

SEQ ID NO: 170152 - protein, 9 aa, Homo Sapiens
EAIGFLGGQ

SEQ ID NO: 170153 - protein, 9 aa, Homo Sapiens
SAPVRGPRL

SEQ ID NO: 170154 - protein, 9 aa, Homo Sapiens
QKLPVSQHT

SEQ ID NO: 170155 - protein, 9 aa, Homo Sapiens
VPQHPPTGP

SEQ ID NO: 170156 - protein, 9 aa, Homo Sapiens
VIRRFEECC

SEQ ID NO: 170157 - protein, 9 aa, Homo Sapiens
IAVQAGDGH

SEQ ID NO: 170158 - protein, 9 aa, Homo Sapiens
AEQTATEKQ

SEQ ID NO: 170159 - protein, 9 aa, Homo Sapiens
QRATRHGPY

SEQ ID NO: 170160 - protein, 9 aa, Homo Sapiens
PLVGLAKLL

SEQ ID NO: 170161 - protein, 9 aa, Homo Sapiens
SFEELEYHD

SEQ ID NO: 170162 - protein, 9 aa, Homo Sapiens
KSTAWFWVR

SEQ ID NO: 170163 - protein, 9 aa, Homo Sapiens
VKHKPQPPV

SEQ ID NO: 170164 - protein, 9 aa, Homo Sapiens
PLSSPPSPP

SEQ ID NO: 170165 - protein, 9 aa, Homo Sapiens
SVKDHRTSQ

SEQ ID NO: 170166 - protein, 9 aa, Homo Sapiens
CMVEPPRMN

SEQ ID NO: 170167 - protein, 9 aa, Homo Sapiens
TNGVTADNG

SEQ ID NO: 170168 - protein, 9 aa, Homo Sapiens
QHGCQPIST

SEQ ID NO: 170169 - protein, 9 aa, Homo Sapiens
PQTPTSTPV

SEQ ID NO: 170170 - protein, 9 aa, Homo Sapiens
KLKTINLTA

SEQ ID NO: 170171 - protein, 9 aa, Homo Sapiens
SIVHLFEWQ

SEQ ID NO: 170172 - protein, 9 aa, Homo Sapiens
TTRNCSSTS

SEQ ID NO: 170173 - protein, 9 aa, Homo Sapiens
CSSQGRHTG

SEQ ID NO: 170174 - protein, 9 aa, Homo Sapiens
HQEFTHLTV

SEQ ID NO: 170175 - protein, 9 aa, Homo Sapiens
HLWQRAVQK

SEQ ID NO: 170176 - protein, 9 aa, Homo Sapiens
NFTILTNIH

SEQ ID NO: 170177 - protein, 9 aa, Homo Sapiens
MEDVPWTKM

SEQ ID NO: 170178 - protein, 9 aa, Homo Sapiens
IFRGDKWSC

SEQ ID NO: 170179 - protein, 9 aa, Homo Sapiens
RLLPGRLLQ

SEQ ID NO: 170180 - protein, 9 aa, Homo Sapiens
PDTTHPTCI

SEQ ID NO: 170181 - protein, 9 aa, Homo Sapiens
VCVCACPGR

SEQ ID NO: 170182 - protein, 9 aa, Homo Sapiens
GQDRVHSCL

SEQ ID NO: 170183 - protein, 9 aa, Homo Sapiens
KVFYQNRHL

SEQ ID NO: 170184 - protein, 9 aa, Homo Sapiens
LTFLMLPET

SEQ ID NO: 170185 - protein, 9 aa, Homo Sapiens
PPLTQPPQT

SEQ ID NO: 170186 - protein, 9 aa, Homo Sapiens
GNRIGSDFS

SEQ ID NO: 170187 - protein, 9 aa, Homo Sapiens
VTLVASACE

SEQ ID NO: 170188 - protein, 9 aa, Homo Sapiens
CGLEEQVST

SEQ ID NO: 170189 - protein, 9 aa, Homo Sapiens
QAHTDDQAS

SEQ ID NO: 170190 - protein, 9 aa, Homo Sapiens
ASQMLAWLL

SEQ ID NO: 170191 - protein, 9 aa, Homo Sapiens
MIQFTINST

SEQ ID NO: 170192 - protein, 9 aa, Homo Sapiens
RPSRLPGSA

SEQ ID NO: 170193 - protein, 9 aa, Homo Sapiens
LSPGACRPA

SEQ ID NO: 170194 - protein, 9 aa, Homo Sapiens
ERAKLDESI

SEQ ID NO: 170195 - protein, 9 aa, Homo Sapiens
LHFVNGAVA

SEQ ID NO: 170196 - protein, 9 aa, Homo Sapiens
AFSQLPINI

SEQ ID NO: 170197 - protein, 9 aa, Homo Sapiens
PVACCHSSL

SEQ ID NO: 170198 - protein, 9 aa, Homo Sapiens
QAPERPRSQ

SEQ ID NO: 170199 - protein, 9 aa, Homo Sapiens
APLGPPSPL

SEQ ID NO: 170200 - protein, 9 aa, Homo Sapiens
PQVPPQLPQ

SEQ ID NO: 170201 - protein, 9 aa, Homo Sapiens
SCPMVRVFQ

SEQ ID NO: 170202 - protein, 9 aa, Homo Sapiens
STFSLDHGL

SEQ ID NO: 170203 - protein, 9 aa, Homo Sapiens
EERDTHNGS

SEQ ID NO: 170204 - protein, 9 aa, Homo Sapiens
WSLWPRRWD

SEQ ID NO: 170205 - protein, 9 aa, Homo Sapiens
KRKPEGRPC

SEQ ID NO: 170206 - protein, 9 aa, Homo Sapiens
KKKKKKIGL

SEQ ID NO: 170207 - protein, 9 aa, Homo Sapiens
SVMSALTNK

SEQ ID NO: 170208 - protein, 9 aa, Homo Sapiens
ARGGGEAGK

SEQ ID NO: 170209 - protein, 9 aa, Homo Sapiens
RPLTTIDNV

SEQ ID NO: 170210 - protein, 9 aa, Homo Sapiens
WEVMPRTLE

SEQ ID NO: 170211 - protein, 9 aa, Homo Sapiens
CSWPLSSPP

SEQ ID NO: 170212 - protein, 9 aa, Homo Sapiens
MPSVSPVGP

SEQ ID NO: 170213 - protein, 9 aa, Homo Sapiens
KANASKKTL

SEQ ID NO: 170214 - protein, 9 aa, Homo Sapiens
RRKSLKLKM

SEQ ID NO: 170215 - protein, 9 aa, Homo Sapiens
LQRLTRGSQ

SEQ ID NO: 170216 - protein, 9 aa, Homo Sapiens
SPHICRRCN

SEQ ID NO: 170217 - protein, 9 aa, Homo Sapiens
KRHLLQQRA

SEQ ID NO: 170218 - protein, 9 aa, Homo Sapiens
GRVDNINTL

SEQ ID NO: 170219 - protein, 9 aa, Homo Sapiens
WDTERNLRP

SEQ ID NO: 170220 - protein, 9 aa, Homo Sapiens
VTDQCLSFK

SEQ ID NO: 170221 - protein, 9 aa, Homo Sapiens
SQLEEWLCD

SEQ ID NO: 170222 - protein, 9 aa, Homo Sapiens
ALVGGEITD

SEQ ID NO: 170223 - protein, 9 aa, Homo Sapiens
AEMHRKAKE

SEQ ID NO: 170224 - protein, 9 aa, Homo Sapiens
EPENGNRIG

SEQ ID NO: 170225 - protein, 9 aa, Homo Sapiens
PENGNRIGS

SEQ ID NO: 170226 - protein, 9 aa, Homo Sapiens
CHRKVLRDN

SEQ ID NO: 170227 - protein, 9 aa, Homo Sapiens
ISHKAAPVP

SEQ ID NO: 170228 - protein, 9 aa, Homo Sapiens
DREKETRHQ

SEQ ID NO: 170229 - protein, 9 aa, Homo Sapiens
EAYSRFLST

SEQ ID NO: 170230 - protein, 9 aa, Homo Sapiens
PPKMPPPRS

SEQ ID NO: 170231 - protein, 9 aa, Homo Sapiens
LKCFLKTRG

SEQ ID NO: 170232 - protein, 9 aa, Homo Sapiens
DEQDARTAS

SEQ ID NO: 170233 - protein, 9 aa, Homo Sapiens
AIPRKAPCA

SEQ ID NO: 170234 - protein, 9 aa, Homo Sapiens
ISVEHGQWR

SEQ ID NO: 170235 - protein, 9 aa, Homo Sapiens
QNCKPKGNT

SEQ ID NO: 170236 - protein, 9 aa, Homo Sapiens
PGWRWRRGH

SEQ ID NO: 170237 - protein, 9 aa, Homo Sapiens
TATVGPWMA

SEQ ID NO: 170238 - protein, 9 aa, Homo Sapiens
HAFLISVSG

SEQ ID NO: 170239 - protein, 9 aa, Homo Sapiens
PRSLTRAVA

SEQ ID NO: 170240 - protein, 9 aa, Homo Sapiens
REAGPMAFL

SEQ ID NO: 170241 - protein, 9 aa, Homo Sapiens
GAVCDTRAK

SEQ ID NO: 170242 - protein, 9 aa, Homo Sapiens
AMHKVSQMI

SEQ ID NO: 170243 - protein, 9 aa, Homo Sapiens
SRPYMVFVQ

SEQ ID NO: 170244 - protein, 9 aa, Homo Sapiens
LYFQRIIKM

SEQ ID NO: 170245 - protein, 9 aa, Homo Sapiens
ARRSSWQKG

SEQ ID NO: 170246 - protein, 9 aa, Homo Sapiens
LGLSKRTPQ

SEQ ID NO: 170247 - protein, 9 aa, Homo Sapiens
PAGRNHCRQ

SEQ ID NO: 170248 - protein, 9 aa, Homo Sapiens
LIPLTVFDL

SEQ ID NO: 170249 - protein, 9 aa, Homo Sapiens
SSHSSAAHR

SEQ ID NO: 170250 - protein, 9 aa, Homo Sapiens
DWHTPHCQP

SEQ ID NO: 170251 - protein, 9 aa, Homo Sapiens
PPTSRGSSL

SEQ ID NO: 170252 - protein, 9 aa, Homo Sapiens
LASDRNPRP

SEQ ID NO: 170253 - protein, 9 aa, Homo Sapiens
GNFPEAAGP

SEQ ID NO: 170254 - protein, 9 aa, Homo Sapiens
SSSCLRSLR

SEQ ID NO: 170255 - protein, 9 aa, Homo Sapiens
PARRPRALG

SEQ ID NO: 170256 - protein, 9 aa, Homo Sapiens
PPLAEPRLQ

SEQ ID NO: 170257 - protein, 9 aa, Homo Sapiens
WLPARPSRL

SEQ ID NO: 170258 - protein, 9 aa, Homo Sapiens
AVPAAACPP

SEQ ID NO: 170259 - protein, 9 aa, Homo Sapiens
KSDDTLEEN

SEQ ID NO: 170260 - protein, 9 aa, Homo Sapiens
EGALWKHFV

SEQ ID NO: 170261 - protein, 9 aa, Homo Sapiens
LPLHKTGQI

SEQ ID NO: 170262 - protein, 9 aa, Homo Sapiens
YQCRQRAPL

SEQ ID NO: 170263 - protein, 9 aa, Homo Sapiens
VSAPPFLGV

SEQ ID NO: 170264 - protein, 9 aa, Homo Sapiens
SFFYFLWIL

SEQ ID NO: 170265 - protein, 9 aa, Homo Sapiens
QQLRHADVD

SEQ ID NO: 170266 - protein, 9 aa, Homo Sapiens
PALPARRPR

SEQ ID NO: 170267 - protein, 9 aa, Homo Sapiens
HARSTRKKC

SEQ ID NO: 170268 - protein, 9 aa, Homo Sapiens
ALQTEMTRI

SEQ ID NO: 170269 - protein, 9 aa, Homo Sapiens
LPVDDATWE

SEQ ID NO: 170270 - protein, 9 aa, Homo Sapiens
VQVFRLIRI

SEQ ID NO: 170271 - protein, 9 aa, Homo Sapiens
PEVLVTLRA

SEQ ID NO: 170272 - protein, 9 aa, Homo Sapiens
LQVISVVEL

SEQ ID NO: 170273 - protein, 9 aa, Homo Sapiens
LVEHPHALA

SEQ ID NO: 170274 - protein, 9 aa, Homo Sapiens
GSGKCGVCL

SEQ ID NO: 170275 - protein, 9 aa, Homo Sapiens
SPPIREVLA

SEQ ID NO: 170276 - protein, 9 aa, Homo Sapiens
AQLQALPDP

SEQ ID NO: 170277 - protein, 9 aa, Homo Sapiens
KATTIDQIS

SEQ ID NO: 170278 - protein, 9 aa, Homo Sapiens
QRRSFSSIC

SEQ ID NO: 170279 - protein, 9 aa, Homo Sapiens
QDRVHSCLE

SEQ ID NO: 170280 - protein, 9 aa, Homo Sapiens
WSLFANTVV

SEQ ID NO: 170281 - protein, 9 aa, Homo Sapiens
EAGKPPLAE

SEQ ID NO: 170282 - protein, 9 aa, Homo Sapiens
ARSPHLQGP

SEQ ID NO: 170283 - protein, 9 aa, Homo Sapiens
QNSPPKRVK

SEQ ID NO: 170284 - protein, 9 aa, Homo Sapiens
KITSVTLVA

SEQ ID NO: 170285 - protein, 9 aa, Homo Sapiens
RQQQQQQQR

SEQ ID NO: 170286 - protein, 9 aa, Homo Sapiens
KDSRMLKYI

SEQ ID NO: 170287 - protein, 9 aa, Homo Sapiens
VSPRGVAFN

SEQ ID NO: 170288 - protein, 9 aa, Homo Sapiens
SLLTQPSPA

SEQ ID NO: 170289 - protein, 9 aa, Homo Sapiens
EDFANGLLL

SEQ ID NO: 170290 - protein, 9 aa, Homo Sapiens
PEYNRPHRY

SEQ ID NO: 170291 - protein, 9 aa, Homo Sapiens
AICWRSPTH

SEQ ID NO: 170292 - protein, 9 aa, Homo Sapiens
CTEPVTSFF

SEQ ID NO: 170293 - protein, 9 aa, Homo Sapiens
IPVLLIMVQ

SEQ ID NO: 170294 - protein, 9 aa, Homo Sapiens
PFQSPTKRL

SEQ ID NO: 170295 - protein, 9 aa, Homo Sapiens
GETGRPGER

SEQ ID NO: 170296 - protein, 9 aa, Homo Sapiens
LVTPGEKMT

SEQ ID NO: 170297 - protein, 9 aa, Homo Sapiens
ELWISINEK

SEQ ID NO: 170298 - protein, 9 aa, Homo Sapiens
LDGHQLLVG

SEQ ID NO: 170299 - protein, 9 aa, Homo Sapiens
SPEGQPIRG

SEQ ID NO: 170300 - protein, 9 aa, Homo Sapiens
GHARAQAVT

SEQ ID NO: 170301 - protein, 9 aa, Homo Sapiens
EKKIWWIVQ

SEQ ID NO: 170302 - protein, 9 aa, Homo Sapiens
HQLEWVSFN

SEQ ID NO: 170303 - protein, 9 aa, Homo Sapiens
PCLRLLPGR

SEQ ID NO: 170304 - protein, 9 aa, Homo Sapiens
PAALCSRWP

SEQ ID NO: 170305 - protein, 9 aa, Homo Sapiens
RVCTVELSC

SEQ ID NO: 170306 - protein, 9 aa, Homo Sapiens
GRGGTTCPP

SEQ ID NO: 170307 - protein, 9 aa, Homo Sapiens
EPRQHSAPV

SEQ ID NO: 170308 - protein, 9 aa, Homo Sapiens
SRGESTVAR

SEQ ID NO: 170309 - protein, 9 aa, Homo Sapiens
HAPPTWLPA

SEQ ID NO: 170310 - protein, 9 aa, Homo Sapiens
VHLVEGAVQ

SEQ ID NO: 170311 - protein, 9 aa, Homo Sapiens
PSPAGWMRR

SEQ ID NO: 170312 - protein, 9 aa, Homo Sapiens
QLALRSQKQ

SEQ ID NO: 170313 - protein, 9 aa, Homo Sapiens
VTLRYGHNF

SEQ ID NO: 170314 - protein, 9 aa, Homo Sapiens
RAVAASPSS

SEQ ID NO: 170315 - protein, 9 aa, Homo Sapiens
APSVWNASR

SEQ ID NO: 170316 - protein, 9 aa, Homo Sapiens
NYVSKVGSW

SEQ ID NO: 170317 - protein, 9 aa, Homo Sapiens
LKEYLHFVN

SEQ ID NO: 170318 - protein, 9 aa, Homo Sapiens
QALMAEQLR

SEQ ID NO: 170319 - protein, 9 aa, Homo Sapiens
GKHQPNQTK

SEQ ID NO: 170320 - protein, 9 aa, Homo Sapiens
QRSHFFLPV

SEQ ID NO: 170321 - protein, 9 aa, Homo Sapiens
RQVSLITPP

SEQ ID NO: 170322 - protein, 9 aa, Homo Sapiens
PSCIGKSPG

SEQ ID NO: 170323 - protein, 9 aa, Homo Sapiens
SESPNRKMK

SEQ ID NO: 170324 - protein, 9 aa, Homo Sapiens
CSRGSDTEG

SEQ ID NO: 170325 - protein, 9 aa, Homo Sapiens
RALLEKKGR

SEQ ID NO: 170326 - protein, 9 aa, Homo Sapiens
WDVNTNSEN

SEQ ID NO: 170327 - protein, 9 aa, Homo Sapiens
RIKLLFSTY

SEQ ID NO: 170328 - protein, 9 aa, Homo Sapiens
FVLLCLDGK

SEQ ID NO: 170329 - protein, 9 aa, Homo Sapiens
NLANNRQVC

SEQ ID NO: 170330 - protein, 9 aa, Homo Sapiens
EWVCLKTHM

SEQ ID NO: 170331 - protein, 9 aa, Homo Sapiens
ALRSRPGSP

SEQ ID NO: 170332 - protein, 9 aa, Homo Sapiens
DEMVIKYVG

SEQ ID NO: 170333 - protein, 9 aa, Homo Sapiens
LRYAPLGGQ

SEQ ID NO: 170334 - protein, 9 aa, Homo Sapiens
EPEVLQDPL

SEQ ID NO: 170335 - protein, 9 aa, Homo Sapiens
DGFSYHLQG

SEQ ID NO: 170336 - protein, 9 aa, Homo Sapiens
WTAATLRCP

SEQ ID NO: 170337 - protein, 9 aa, Homo Sapiens
ISCVGFPNV

SEQ ID NO: 170338 - protein, 9 aa, Homo Sapiens
TKAPPVGSG

SEQ ID NO: 170339 - protein, 9 aa, Homo Sapiens
ALLQDLCVS

SEQ ID NO: 170340 - protein, 9 aa, Homo Sapiens
LCQLVLPEP

SEQ ID NO: 170341 - protein, 9 aa, Homo Sapiens
CPSAWRTAR

SEQ ID NO: 170342 - protein, 9 aa, Homo Sapiens
LLRHQRTHM

SEQ ID NO: 170343 - protein, 9 aa, Homo Sapiens
LTQTHLVGH

SEQ ID NO: 170344 - protein, 9 aa, Homo Sapiens
DSSPDNDNW

SEQ ID NO: 170345 - protein, 9 aa, Homo Sapiens
VPARCRRRR

SEQ ID NO: 170346 - protein, 9 aa, Homo Sapiens
SQGPAARWS

SEQ ID NO: 170347 - protein, 9 aa, Homo Sapiens
LQDLCVSPY

SEQ ID NO: 170348 - protein, 9 aa, Homo Sapiens
YTTCIICLA

SEQ ID NO: 170349 - protein, 9 aa, Homo Sapiens
RGTPPGPEN

SEQ ID NO: 170350 - protein, 9 aa, Homo Sapiens
TYFDIYTVG

SEQ ID NO: 170351 - protein, 9 aa, Homo Sapiens
RPLLMEEIN

SEQ ID NO: 170352 - protein, 9 aa, Homo Sapiens
EVRKLTALR

SEQ ID NO: 170353 - protein, 9 aa, Homo Sapiens
QSQFDVYEV

SEQ ID NO: 170354 - protein, 9 aa, Homo Sapiens
AAGAIRGWA

SEQ ID NO: 170355 - protein, 9 aa, Homo Sapiens
ETAVCRLLL

SEQ ID NO: 170356 - protein, 9 aa, Homo Sapiens
HPQVPPQLP

SEQ ID NO: 170357 - protein, 9 aa, Homo Sapiens
ELQKICYLP

SEQ ID NO: 170358 - protein, 9 aa, Homo Sapiens
AGISASTVT

SEQ ID NO: 170359 - protein, 9 aa, Homo Sapiens
ALAQAIAVQ

SEQ ID NO: 170360 - protein, 9 aa, Homo Sapiens
ANKNVNRSQ

SEQ ID NO: 170361 - protein, 9 aa, Homo Sapiens
RAHCPANGA

SEQ ID NO: 170362 - protein, 9 aa, Homo Sapiens
SSRDDLYDQ

SEQ ID NO: 170363 - protein, 9 aa, Homo Sapiens
GEKHSPLSL

SEQ ID NO: 170364 - protein, 9 aa, Homo Sapiens
KNGALPAPM

SEQ ID NO: 170365 - protein, 9 aa, Homo Sapiens
SFLLPFRMS

SEQ ID NO: 170366 - protein, 9 aa, Homo Sapiens
LSQGTTLSG

SEQ ID NO: 170367 - protein, 9 aa, Homo Sapiens
IKMSEVNAL

SEQ ID NO: 170368 - protein, 9 aa, Homo Sapiens
LTSHEATPH

SEQ ID NO: 170369 - protein, 9 aa, Homo Sapiens
CGLNRARTS

SEQ ID NO: 170370 - protein, 9 aa, Homo Sapiens
ASAEVLSIN

SEQ ID NO: 170371 - protein, 9 aa, Homo Sapiens
SLYKKKKPK

SEQ ID NO: 170372 - protein, 9 aa, Homo Sapiens
ETPAHVDVR

SEQ ID NO: 170373 - protein, 9 aa, Homo Sapiens
ELGHLKQLL

SEQ ID NO: 170374 - protein, 9 aa, Homo Sapiens
LCVQWCPLS

SEQ ID NO: 170375 - protein, 9 aa, Homo Sapiens
KISECCDFC

SEQ ID NO: 170376 - protein, 9 aa, Homo Sapiens
DAGGWLKID

SEQ ID NO: 170377 - protein, 9 aa, Homo Sapiens
SRAHCPANG

SEQ ID NO: 170378 - protein, 9 aa, Homo Sapiens
SVSPVGPSA

SEQ ID NO: 170379 - protein, 9 aa, Homo Sapiens
VINTEDWKK

SEQ ID NO: 170380 - protein, 9 aa, Homo Sapiens
QDTLDREAR

SEQ ID NO: 170381 - protein, 9 aa, Homo Sapiens
RRFESPEEV

SEQ ID NO: 170382 - protein, 9 aa, Homo Sapiens
NGKWRLTTR

SEQ ID NO: 170383 - protein, 9 aa, Homo Sapiens
QWPSLPGPA

SEQ ID NO: 170384 - protein, 9 aa, Homo Sapiens
NIITITKKI

SEQ ID NO: 170385 - protein, 9 aa, Homo Sapiens
CVHFTRRRD

SEQ ID NO: 170386 - protein, 9 aa, Homo Sapiens
PGPPPAPES

SEQ ID NO: 170387 - protein, 9 aa, Homo Sapiens
SAKVAPQIT

SEQ ID NO: 170388 - protein, 9 aa, Homo Sapiens
AEPRQHSAP

SEQ ID NO: 170389 - protein, 9 aa, Homo Sapiens
MKPHMKIFL

SEQ ID NO: 170390 - protein, 9 aa, Homo Sapiens
GDGHGRLVI

SEQ ID NO: 170391 - protein, 9 aa, Homo Sapiens
RAKPFPTRG

SEQ ID NO: 170392 - protein, 9 aa, Homo Sapiens
FANGLLLAQ

SEQ ID NO: 170393 - protein, 9 aa, Homo Sapiens
TEGAGETFR

SEQ ID NO: 170394 - protein, 9 aa, Homo Sapiens
ALQLGLRLL

SEQ ID NO: 170395 - protein, 9 aa, Homo Sapiens
MEAKWEEET

SEQ ID NO: 170396 - protein, 9 aa, Homo Sapiens
ATSSATGSC

SEQ ID NO: 170397 - protein, 9 aa, Homo Sapiens
GPASITAIR

SEQ ID NO: 170398 - protein, 9 aa, Homo Sapiens
PTEQPLELR

SEQ ID NO: 170399 - protein, 9 aa, Homo Sapiens
LGNGITNHG

SEQ ID NO: 170400 - protein, 9 aa, Homo Sapiens
RTTHYKLTS

SEQ ID NO: 170401 - protein, 9 aa, Homo Sapiens
VAEHIRKAR

SEQ ID NO: 170402 - protein, 9 aa, Homo Sapiens
NSREDSYMT

SEQ ID NO: 170403 - protein, 9 aa, Homo Sapiens
VPENISSRT

SEQ ID NO: 170404 - protein, 9 aa, Homo Sapiens
GLAAAHSVC

SEQ ID NO: 170405 - protein, 9 aa, Homo Sapiens
KARLVRYME

SEQ ID NO: 170406 - protein, 9 aa, Homo Sapiens
GRRPLLQGH

SEQ ID NO: 170407 - protein, 9 aa, Homo Sapiens
TRGWMTRPR

SEQ ID NO: 170408 - protein, 9 aa, Homo Sapiens
WQKGQPRWC

SEQ ID NO: 170409 - protein, 9 aa, Homo Sapiens
KPGLGTPNS

SEQ ID NO: 170410 - protein, 9 aa, Homo Sapiens
RVDNINTLD

SEQ ID NO: 170411 - protein, 9 aa, Homo Sapiens
QHRAYPQQL

SEQ ID NO: 170412 - protein, 9 aa, Homo Sapiens
KAEAMSSHI

SEQ ID NO: 170413 - protein, 9 aa, Homo Sapiens
MLHLYPGPM

SEQ ID NO: 170414 - protein, 9 aa, Homo Sapiens
NMLERGEAE

SEQ ID NO: 170415 - protein, 9 aa, Homo Sapiens
PNVQGACKI

SEQ ID NO: 170416 - protein, 9 aa, Homo Sapiens
TPLARVVSW

SEQ ID NO: 170417 - protein, 9 aa, Homo Sapiens
ALYVHFNHS

SEQ ID NO: 170418 - protein, 9 aa, Homo Sapiens
LQRSFLVLL

SEQ ID NO: 170419 - protein, 9 aa, Homo Sapiens
GHLLHQEFT

SEQ ID NO: 170420 - protein, 9 aa, Homo Sapiens
KLNLGIDSD

SEQ ID NO: 170421 - protein, 9 aa, Homo Sapiens
VCGKGFCHS

SEQ ID NO: 170422 - protein, 9 aa, Homo Sapiens
GVVTISCVG

SEQ ID NO: 170423 - protein, 9 aa, Homo Sapiens
RVAPEQCDV

SEQ ID NO: 170424 - protein, 9 aa, Homo Sapiens
DRKFHEDEQ

SEQ ID NO: 170425 - protein, 9 aa, Homo Sapiens
PVSHCVSPT

SEQ ID NO: 170426 - protein, 9 aa, Homo Sapiens
GARAARHRW

SEQ ID NO: 170427 - protein, 9 aa, Homo Sapiens
WPLRWGWWV

SEQ ID NO: 170428 - protein, 9 aa, Homo Sapiens
PGILSIPVL

SEQ ID NO: 170429 - protein, 9 aa, Homo Sapiens
LPGPLPASH

SEQ ID NO: 170430 - protein, 9 aa, Homo Sapiens
TTSTFAGEV

SEQ ID NO: 170431 - protein, 9 aa, Homo Sapiens
VAAALCIPL

SEQ ID NO: 170432 - protein, 9 aa, Homo Sapiens
HVRPFFFSL

SEQ ID NO: 170433 - protein, 9 aa, Homo Sapiens
EQPPAPSQA

SEQ ID NO: 170434 - protein, 9 aa, Homo Sapiens
WVLSSCPMV

SEQ ID NO: 170435 - protein, 9 aa, Homo Sapiens
QHRPGAQDL

SEQ ID NO: 170436 - protein, 9 aa, Homo Sapiens
DRRPGPSRA

SEQ ID NO: 170437 - protein, 9 aa, Homo Sapiens
GNGITNHGL

SEQ ID NO: 170438 - protein, 9 aa, Homo Sapiens
VRHLHQQPE

SEQ ID NO: 170439 - protein, 9 aa, Homo Sapiens
PPMHCPTAT

SEQ ID NO: 170440 - protein, 9 aa, Homo Sapiens
VHRDLRLWL

SEQ ID NO: 170441 - protein, 9 aa, Homo Sapiens
WGAPMQKPS

SEQ ID NO: 170442 - protein, 9 aa, Homo Sapiens
LPSPPVRST

SEQ ID NO: 170443 - protein, 9 aa, Homo Sapiens
VEQARCEEV

SEQ ID NO: 170444 - protein, 9 aa, Homo Sapiens
ALPLTLSPM

SEQ ID NO: 170445 - protein, 9 aa, Homo Sapiens
EIVAYVTET

SEQ ID NO: 170446 - protein, 9 aa, Homo Sapiens
EGDAHISSL

SEQ ID NO: 170447 - protein, 9 aa, Homo Sapiens
PSSKTALLK

SEQ ID NO: 170448 - protein, 9 aa, Homo Sapiens
RKLLEGKEC

SEQ ID NO: 170449 - protein, 9 aa, Homo Sapiens
GQMVPPLPD

SEQ ID NO: 170450 - protein, 9 aa, Homo Sapiens
LERGRGIRQ

SEQ ID NO: 170451 - protein, 9 aa, Homo Sapiens
VYQGTFYYN

SEQ ID NO: 170452 - protein, 9 aa, Homo Sapiens
GAGGTLQPR

SEQ ID NO: 170453 - protein, 9 aa, Homo Sapiens
AIRWTRGWM

SEQ ID NO: 170454 - protein, 9 aa, Homo Sapiens
MRTSDSGST

SEQ ID NO: 170455 - protein, 9 aa, Homo Sapiens
LQYGSHSQH

SEQ ID NO: 170456 - protein, 9 aa, Homo Sapiens
DEPQYLDPP

SEQ ID NO: 170457 - protein, 9 aa, Homo Sapiens
GGTPLSISR

SEQ ID NO: 170458 - protein, 9 aa, Homo Sapiens
RPSYRPWRG

SEQ ID NO: 170459 - protein, 9 aa, Homo Sapiens
DLDVGDCPK

SEQ ID NO: 170460 - protein, 9 aa, Homo Sapiens
LLLQRCCQG

SEQ ID NO: 170461 - protein, 9 aa, Homo Sapiens
KWCKREILK

SEQ ID NO: 170462 - protein, 9 aa, Homo Sapiens
PLLMEEINT

SEQ ID NO: 170463 - protein, 9 aa, Homo Sapiens
EKSRWSGSH

SEQ ID NO: 170464 - protein, 9 aa, Homo Sapiens
NPRVSMRTS

SEQ ID NO: 170465 - protein, 9 aa, Homo Sapiens
VSHSMHKKL

SEQ ID NO: 170466 - protein, 9 aa, Homo Sapiens
YSHYFCEAQ

SEQ ID NO: 170467 - protein, 9 aa, Homo Sapiens
SDLQSILST

SEQ ID NO: 170468 - protein, 9 aa, Homo Sapiens
DDVGDCCDN

SEQ ID NO: 170469 - protein, 9 aa, Homo Sapiens
GGQQPRHGH

SEQ ID NO: 170470 - protein, 9 aa, Homo Sapiens
GWSLIDYVF

SEQ ID NO: 170471 - protein, 9 aa, Homo Sapiens
FQGTSCGPY

SEQ ID NO: 170472 - protein, 9 aa, Homo Sapiens
VGATEETEV

SEQ ID NO: 170473 - protein, 9 aa, Homo Sapiens
TKWTIDEVF

SEQ ID NO: 170474 - protein, 9 aa, Homo Sapiens
SASPQETAT

SEQ ID NO: 170475 - protein, 9 aa, Homo Sapiens
RVLTLKRFP

SEQ ID NO: 170476 - protein, 9 aa, Homo Sapiens
MCARGPGDA

SEQ ID NO: 170477 - protein, 9 aa, Homo Sapiens
KKKKKIGLF

SEQ ID NO: 170478 - protein, 9 aa, Homo Sapiens
VPQHVSPFP

SEQ ID NO: 170479 - protein, 9 aa, Homo Sapiens
GSRMSWRRL

SEQ ID NO: 170480 - protein, 9 aa, Homo Sapiens
EAPRGTCSP

SEQ ID NO: 170481 - protein, 9 aa, Homo Sapiens
PPPPGVSLS

SEQ ID NO: 170482 - protein, 9 aa, Homo Sapiens
SQQPKCKCR

SEQ ID NO: 170483 - protein, 9 aa, Homo Sapiens
AACGGRERR

SEQ ID NO: 170484 - protein, 9 aa, Homo Sapiens
SSFLIFFIP

SEQ ID NO: 170485 - protein, 9 aa, Homo Sapiens
LPTTNSVWL

SEQ ID NO: 170486 - protein, 9 aa, Homo Sapiens
SAWPSTSPT

SEQ ID NO: 170487 - protein, 9 aa, Homo Sapiens
SPSHVRHLH

SEQ ID NO: 170488 - protein, 9 aa, Homo Sapiens
PRSSSRDDL

SEQ ID NO: 170489 - protein, 9 aa, Homo Sapiens
QVVGAPRPV

SEQ ID NO: 170490 - protein, 9 aa, Homo Sapiens
ERNMLERGE

SEQ ID NO: 170491 - protein, 9 aa, Homo Sapiens
HRRETLCLQ

SEQ ID NO: 170492 - protein, 9 aa, Homo Sapiens
GRGPPDRWV

SEQ ID NO: 170493 - protein, 9 aa, Homo Sapiens
TARRTLRSS

SEQ ID NO: 170494 - protein, 9 aa, Homo Sapiens
NEEVRKLTA

SEQ ID NO: 170495 - protein, 9 aa, Homo Sapiens
PFKPPSIYT

SEQ ID NO: 170496 - protein, 9 aa, Homo Sapiens
MVKFQYLLS

SEQ ID NO: 170497 - protein, 9 aa, Homo Sapiens
SSSSDIDSD

SEQ ID NO: 170498 - protein, 9 aa, Homo Sapiens
TASLWLSVC

SEQ ID NO: 170499 - protein, 9 aa, Homo Sapiens
PSSKEATTE

SEQ ID NO: 170500 - protein, 9 aa, Homo Sapiens
LMVFFSSQY

SEQ ID NO: 170501 - protein, 9 aa, Homo Sapiens
AYPQQLFLL

SEQ ID NO: 170502 - protein, 9 aa, Homo Sapiens
CIPLLITVT

SEQ ID NO: 170503 - protein, 9 aa, Homo Sapiens
TRLWSCGPN

SEQ ID NO: 170504 - protein, 9 aa, Homo Sapiens
KSVHTVGFP

SEQ ID NO: 170505 - protein, 9 aa, Homo Sapiens
GCLLLLSFR

SEQ ID NO: 170506 - protein, 9 aa, Homo Sapiens
ATASKLGEF

SEQ ID NO: 170507 - protein, 9 aa, Homo Sapiens
LALASYRHL

SEQ ID NO: 170508 - protein, 9 aa, Homo Sapiens
SLSSDTVFG

SEQ ID NO: 170509 - protein, 9 aa, Homo Sapiens
KLQVEEQKQ

SEQ ID NO: 170510 - protein, 9 aa, Homo Sapiens
SAAAPTLPR

SEQ ID NO: 170511 - protein, 9 aa, Homo Sapiens
ALQDYVVSL

SEQ ID NO: 170512 - protein, 9 aa, Homo Sapiens
CESQPCQRR

SEQ ID NO: 170513 - protein, 9 aa, Homo Sapiens
PERIDPQTP

SEQ ID NO: 170514 - protein, 9 aa, Homo Sapiens
KIAAITSMK

SEQ ID NO: 170515 - protein, 9 aa, Homo Sapiens
TFHDTFSGV

SEQ ID NO: 170516 - protein, 9 aa, Homo Sapiens
HPQRVSPRC

SEQ ID NO: 170517 - protein, 9 aa, Homo Sapiens
GRGRGRVGK

SEQ ID NO: 170518 - protein, 9 aa, Homo Sapiens
KPFGDSQMY

SEQ ID NO: 170519 - protein, 9 aa, Homo Sapiens
EIHGDIFMN

SEQ ID NO: 170520 - protein, 9 aa, Homo Sapiens
TSLGTTVIT

SEQ ID NO: 170521 - protein, 9 aa, Homo Sapiens
LTNLCVAGL

SEQ ID NO: 170522 - protein, 9 aa, Homo Sapiens
LDKMLLTLA

SEQ ID NO: 170523 - protein, 9 aa, Homo Sapiens
PEGRPCDDE

SEQ ID NO: 170524 - protein, 9 aa, Homo Sapiens
RSGGCSLSS

SEQ ID NO: 170525 - protein, 9 aa, Homo Sapiens
NGNCIHRTW

SEQ ID NO: 170526 - protein, 9 aa, Homo Sapiens
TSLQMPVLK

SEQ ID NO: 170527 - protein, 9 aa, Homo Sapiens
SQIRADNKL

SEQ ID NO: 170528 - protein, 9 aa, Homo Sapiens
QAPPAWSAL

SEQ ID NO: 170529 - protein, 9 aa, Homo Sapiens
EPFPLVGLA

SEQ ID NO: 170530 - protein, 9 aa, Homo Sapiens
KATSTPVPP

SEQ ID NO: 170531 - protein, 9 aa, Homo Sapiens
LTGYLNLLL

SEQ ID NO: 170532 - protein, 9 aa, Homo Sapiens
SASSLTSCL

SEQ ID NO: 170533 - protein, 9 aa, Homo Sapiens
PPPHPQVPP

SEQ ID NO: 170534 - protein, 9 aa, Homo Sapiens
ERGLTWYRS

SEQ ID NO: 170535 - protein, 9 aa, Homo Sapiens
VGVSEEIEA

SEQ ID NO: 170536 - protein, 9 aa, Homo Sapiens
EEELYLFVE

SEQ ID NO: 170537 - protein, 9 aa, Homo Sapiens
VEKRRVALE

SEQ ID NO: 170538 - protein, 9 aa, Homo Sapiens
AKEKTEKPG

SEQ ID NO: 170539 - protein, 9 aa, Homo Sapiens
FYVLILQAF

SEQ ID NO: 170540 - protein, 9 aa, Homo Sapiens
WCWSLWRAS

SEQ ID NO: 170541 - protein, 9 aa, Homo Sapiens
EHVVSEFED

SEQ ID NO: 170542 - protein, 9 aa, Homo Sapiens
FAQAVRCPV

SEQ ID NO: 170543 - protein, 9 aa, Homo Sapiens
HMNGNVITA

SEQ ID NO: 170544 - protein, 9 aa, Homo Sapiens
PRALGAGAS

SEQ ID NO: 170545 - protein, 9 aa, Homo Sapiens
SRCAPALPA

SEQ ID NO: 170546 - protein, 9 aa, Homo Sapiens
VECFVSEII

SEQ ID NO: 170547 - protein, 9 aa, Homo Sapiens
QKKSKSQKT

SEQ ID NO: 170548 - protein, 9 aa, Homo Sapiens
KIEAKGMLN

SEQ ID NO: 170549 - protein, 9 aa, Homo Sapiens
SPVGPSAGA

SEQ ID NO: 170550 - protein, 9 aa, Homo Sapiens
PDRWVQVSH

SEQ ID NO: 170551 - protein, 9 aa, Homo Sapiens
ILPRVVWWK

SEQ ID NO: 170552 - protein, 9 aa, Homo Sapiens
TVARPCRGS

SEQ ID NO: 170553 - protein, 9 aa, Homo Sapiens
TSGPTYGAW

SEQ ID NO: 170554 - protein, 9 aa, Homo Sapiens
AVLESWQRL

SEQ ID NO: 170555 - protein, 9 aa, Homo Sapiens
VVFLYMWSF

SEQ ID NO: 170556 - protein, 9 aa, Homo Sapiens
VPHTTILVT

SEQ ID NO: 170557 - protein, 9 aa, Homo Sapiens
NGLAPNGAC

SEQ ID NO: 170558 - protein, 9 aa, Homo Sapiens
DWKKRHTLE

SEQ ID NO: 170559 - protein, 9 aa, Homo Sapiens
ELGEQINNL

SEQ ID NO: 170560 - protein, 9 aa, Homo Sapiens
HLNLIRNHI

SEQ ID NO: 170561 - protein, 9 aa, Homo Sapiens
AIVLGLRLP

SEQ ID NO: 170562 - protein, 9 aa, Homo Sapiens
LVCATAMED

SEQ ID NO: 170563 - protein, 9 aa, Homo Sapiens
VRSDVLDEL

SEQ ID NO: 170564 - protein, 9 aa, Homo Sapiens
PRRRPSYRP

SEQ ID NO: 170565 - protein, 9 aa, Homo Sapiens
GSTAARARA

SEQ ID NO: 170566 - protein, 9 aa, Homo Sapiens
QTIYGAEVR

SEQ ID NO: 170567 - protein, 9 aa, Homo Sapiens
TCRRPHPVV

SEQ ID NO: 170568 - protein, 9 aa, Homo Sapiens
PPRSATTTL

SEQ ID NO: 170569 - protein, 9 aa, Homo Sapiens
ERPARTPPG

SEQ ID NO: 170570 - protein, 9 aa, Homo Sapiens
RRMQQMAVH

SEQ ID NO: 170571 - protein, 9 aa, Homo Sapiens
VAGWCTTAA

SEQ ID NO: 170572 - protein, 9 aa, Homo Sapiens
IDHTQREPL

SEQ ID NO: 170573 - protein, 9 aa, Homo Sapiens
AARHRWDWS

SEQ ID NO: 170574 - protein, 9 aa, Homo Sapiens
RCQRERGRV

SEQ ID NO: 170575 - protein, 9 aa, Homo Sapiens
ATAACPMTA

SEQ ID NO: 170576 - protein, 9 aa, Homo Sapiens
LCCSLLRGS

SEQ ID NO: 170577 - protein, 9 aa, Homo Sapiens
GGSPSRSAA

SEQ ID NO: 170578 - protein, 9 aa, Homo Sapiens
RRGCPRKQP

SEQ ID NO: 170579 - protein, 9 aa, Homo Sapiens
QQYSHYFCE

SEQ ID NO: 170580 - protein, 9 aa, Homo Sapiens
MDTTASAKT

SEQ ID NO: 170581 - protein, 9 aa, Homo Sapiens
LVSKARPAL

SEQ ID NO: 170582 - protein, 9 aa, Homo Sapiens
HDGHPYCEV

SEQ ID NO: 170583 - protein, 9 aa, Homo Sapiens
YHATNSKKA

SEQ ID NO: 170584 - protein, 9 aa, Homo Sapiens
HYSLHFLLI

SEQ ID NO: 170585 - protein, 9 aa, Homo Sapiens
MSIHNIDHT

SEQ ID NO: 170586 - protein, 9 aa, Homo Sapiens
LEWVSFNEE

SEQ ID NO: 170587 - protein, 9 aa, Homo Sapiens
SSRTTLPKS

SEQ ID NO: 170588 - protein, 9 aa, Homo Sapiens
ASPASPSMT

SEQ ID NO: 170589 - protein, 9 aa, Homo Sapiens
LIRKAMVKF

SEQ ID NO: 170590 - protein, 9 aa, Homo Sapiens
EPPVSHCVS

SEQ ID NO: 170591 - protein, 9 aa, Homo Sapiens
VLYSKRFHS

SEQ ID NO: 170592 - protein, 9 aa, Homo Sapiens
HPLRKCVDI

SEQ ID NO: 170593 - protein, 9 aa, Homo Sapiens
GIRGPHAPP

SEQ ID NO: 170594 - protein, 9 aa, Homo Sapiens
APGRTKTFR

SEQ ID NO: 170595 - protein, 9 aa, Homo Sapiens
RFDLLWGVG

SEQ ID NO: 170596 - protein, 9 aa, Homo Sapiens
VRPFFFSLL

SEQ ID NO: 170597 - protein, 9 aa, Homo Sapiens
GYQCRQRAP

SEQ ID NO: 170598 - protein, 9 aa, Homo Sapiens
FSLDREAWQ

SEQ ID NO: 170599 - protein, 9 aa, Homo Sapiens
QGQPGSQLP

SEQ ID NO: 170600 - protein, 9 aa, Homo Sapiens
RHADVDTSC

SEQ ID NO: 170601 - protein, 9 aa, Homo Sapiens
NLALGKTRV

SEQ ID NO: 170602 - protein, 9 aa, Homo Sapiens
GLRRAYAAV

SEQ ID NO: 170603 - protein, 9 aa, Homo Sapiens
ASAWPSTSP

SEQ ID NO: 170604 - protein, 9 aa, Homo Sapiens
PLPGALLPH

SEQ ID NO: 170605 - protein, 9 aa, Homo Sapiens
AELRRWPWQ

SEQ ID NO: 170606 - protein, 9 aa, Homo Sapiens
ATATTIANR

SEQ ID NO: 170607 - protein, 9 aa, Homo Sapiens
RSYPLPHPP

SEQ ID NO: 170608 - protein, 9 aa, Homo Sapiens
PQARPSPLN

SEQ ID NO: 170609 - protein, 9 aa, Homo Sapiens
LRRARVTCP

SEQ ID NO: 170610 - protein, 9 aa, Homo Sapiens
AETLALVGG

SEQ ID NO: 170611 - protein, 9 aa, Homo Sapiens
SDSGSTTSP

SEQ ID NO: 170612 - protein, 9 aa, Homo Sapiens
LQTEMTRIK

SEQ ID NO: 170613 - protein, 9 aa, Homo Sapiens
MFLRILEQK

SEQ ID NO: 170614 - protein, 9 aa, Homo Sapiens
NTLDSEIKK

SEQ ID NO: 170615 - protein, 9 aa, Homo Sapiens
MATVPKLVL

SEQ ID NO: 170616 - protein, 9 aa, Homo Sapiens
RMKKHAHLT

SEQ ID NO: 170617 - protein, 9 aa, Homo Sapiens
KQFPDAHIL

SEQ ID NO: 170618 - protein, 9 aa, Homo Sapiens
FNVILQIGW

SEQ ID NO: 170619 - protein, 9 aa, Homo Sapiens
PLSLLAGVP

SEQ ID NO: 170620 - protein, 9 aa, Homo Sapiens
PLSPCLLPT

SEQ ID NO: 170621 - protein, 9 aa, Homo Sapiens
PSAQRPMIV

SEQ ID NO: 170622 - protein, 9 aa, Homo Sapiens
LHRWDPCMP

SEQ ID NO: 170623 - protein, 9 aa, Homo Sapiens
GGLGCGVCP

SEQ ID NO: 170624 - protein, 9 aa, Homo Sapiens
YKQQLTTHL

SEQ ID NO: 170625 - protein, 9 aa, Homo Sapiens
LAPLLPLPP

SEQ ID NO: 170626 - protein, 9 aa, Homo Sapiens
SKKTHTIRY

SEQ ID NO: 170627 - protein, 9 aa, Homo Sapiens
PPCSSLWAW

SEQ ID NO: 170628 - protein, 9 aa, Homo Sapiens
REIISMDGS

SEQ ID NO: 170629 - protein, 9 aa, Homo Sapiens
LGLRLLLLL

SEQ ID NO: 170630 - protein, 9 aa, Homo Sapiens
ITSMKSPEA

SEQ ID NO: 170631 - protein, 9 aa, Homo Sapiens
AHSCQALSC

SEQ ID NO: 170632 - protein, 9 aa, Homo Sapiens
IATGKGPLG

SEQ ID NO: 170633 - protein, 9 aa, Homo Sapiens
PTAAVAVAQ

SEQ ID NO: 170634 - protein, 9 aa, Homo Sapiens
TKSMQTQDS

SEQ ID NO: 170635 - protein, 9 aa, Homo Sapiens
PRHIQFDPF

SEQ ID NO: 170636 - protein, 9 aa, Homo Sapiens
ASMLKGRPK

SEQ ID NO: 170637 - protein, 9 aa, Homo Sapiens
VVAAAVSCV

SEQ ID NO: 170638 - protein, 9 aa, Homo Sapiens
VETEVEAME

SEQ ID NO: 170639 - protein, 9 aa, Homo Sapiens
MLNGEKVEH

SEQ ID NO: 170640 - protein, 9 aa, Homo Sapiens
GKCGVCLMT

SEQ ID NO: 170641 - protein, 9 aa, Homo Sapiens
LRGGGSPSR

SEQ ID NO: 170642 - protein, 9 aa, Homo Sapiens
CWVYDRARR

SEQ ID NO: 170643 - protein, 9 aa, Homo Sapiens
LSSCVSTPG

SEQ ID NO: 170644 - protein, 9 aa, Homo Sapiens
QLREQWKKV

SEQ ID NO: 170645 - protein, 9 aa, Homo Sapiens
FPQCQPLHN

SEQ ID NO: 170646 - protein, 9 aa, Homo Sapiens
QNILDVHTG

SEQ ID NO: 170647 - protein, 9 aa, Homo Sapiens
IQTQAITSC

SEQ ID NO: 170648 - protein, 9 aa, Homo Sapiens
LLSVFCWHI

SEQ ID NO: 170649 - protein, 9 aa, Homo Sapiens
VVKYSDMEL

SEQ ID NO: 170650 - protein, 9 aa, Homo Sapiens
RPRTPEALR

SEQ ID NO: 170651 - protein, 9 aa, Homo Sapiens
TQMYFLYFS

SEQ ID NO: 170652 - protein, 9 aa, Homo Sapiens
SSSGPRLGE

SEQ ID NO: 170653 - protein, 9 aa, Homo Sapiens
HEEEVITLN

SEQ ID NO: 170654 - protein, 9 aa, Homo Sapiens
RLTDDSPVN

SEQ ID NO: 170655 - protein, 9 aa, Homo Sapiens
LSTRAPGCP

SEQ ID NO: 170656 - protein, 9 aa, Homo Sapiens
PLSTASQML

SEQ ID NO: 170657 - protein, 9 aa, Homo Sapiens
SNCGALPLT

SEQ ID NO: 170658 - protein, 9 aa, Homo Sapiens
SHPPRPAPQ

SEQ ID NO: 170659 - protein, 9 aa, Homo Sapiens
SQPCQRRGR

SEQ ID NO: 170660 - protein, 9 aa, Homo Sapiens
CPLAGLRRA

SEQ ID NO: 170661 - protein, 9 aa, Homo Sapiens
AAADLEHFF

SEQ ID NO: 170662 - protein, 9 aa, Homo Sapiens
MQGLGFLLL

SEQ ID NO: 170663 - protein, 9 aa, Homo Sapiens
RSGWRTAVC

SEQ ID NO: 170664 - protein, 9 aa, Homo Sapiens
YTFLREVAG

SEQ ID NO: 170665 - protein, 9 aa, Homo Sapiens
GVQGQMVPP

SEQ ID NO: 170666 - protein, 9 aa, Homo Sapiens
PWRAGFQWG

SEQ ID NO: 170667 - protein, 9 aa, Homo Sapiens
LCIIDVSNE

SEQ ID NO: 170668 - protein, 9 aa, Homo Sapiens
IQFDPFPFL

SEQ ID NO: 170669 - protein, 9 aa, Homo Sapiens
AAPYLTSWA

SEQ ID NO: 170670 - protein, 9 aa, Homo Sapiens
GHLWSSLNI

SEQ ID NO: 170671 - protein, 9 aa, Homo Sapiens
SAETVRGDA

SEQ ID NO: 170672 - protein, 9 aa, Homo Sapiens
GGGDIWDVN

SEQ ID NO: 170673 - protein, 9 aa, Homo Sapiens
SRHEVPPQL

SEQ ID NO: 170674 - protein, 9 aa, Homo Sapiens
LQQVGTLSP

SEQ ID NO: 170675 - protein, 9 aa, Homo Sapiens
YAYKQYGMY

SEQ ID NO: 170676 - protein, 9 aa, Homo Sapiens
YFDIYTVGA

SEQ ID NO: 170677 - protein, 9 aa, Homo Sapiens
CKICQKWPF

SEQ ID NO: 170678 - protein, 9 aa, Homo Sapiens
NPRPGCGAP

SEQ ID NO: 170679 - protein, 9 aa, Homo Sapiens
GRAGGVGET

SEQ ID NO: 170680 - protein, 9 aa, Homo Sapiens
QYLPRNQKE

SEQ ID NO: 170681 - protein, 9 aa, Homo Sapiens
RGQSYIDKV

SEQ ID NO: 170682 - protein, 9 aa, Homo Sapiens
IPRKAPCAS

SEQ ID NO: 170683 - protein, 9 aa, Homo Sapiens
LNTIQTYVP

SEQ ID NO: 170684 - protein, 9 aa, Homo Sapiens
PPRLLGPQV

SEQ ID NO: 170685 - protein, 9 aa, Homo Sapiens
LAAVCFFLG

SEQ ID NO: 170686 - protein, 9 aa, Homo Sapiens
QAFSQLPIN

SEQ ID NO: 170687 - protein, 9 aa, Homo Sapiens
VGLAASFAV

SEQ ID NO: 170688 - protein, 9 aa, Homo Sapiens
QGLPAGAAR

SEQ ID NO: 170689 - protein, 9 aa, Homo Sapiens
KHGPYNLKQ

SEQ ID NO: 170690 - protein, 9 aa, Homo Sapiens
RTAPSVWNA

SEQ ID NO: 170691 - protein, 9 aa, Homo Sapiens
QVYLSRTAW

SEQ ID NO: 170692 - protein, 9 aa, Homo Sapiens
PELKEKKIW

SEQ ID NO: 170693 - protein, 9 aa, Homo Sapiens
MDQDPFFLS

SEQ ID NO: 170694 - protein, 9 aa, Homo Sapiens
SNLSRHVCS

SEQ ID NO: 170695 - protein, 9 aa, Homo Sapiens
RKAMVKFQY

SEQ ID NO: 170696 - protein, 9 aa, Homo Sapiens
WWRKLTLQC

SEQ ID NO: 170697 - protein, 9 aa, Homo Sapiens
EGGHHLSHV

SEQ ID NO: 170698 - protein, 9 aa, Homo Sapiens
QGEMLDYRH

SEQ ID NO: 170699 - protein, 9 aa, Homo Sapiens
HPLDSPHIC

SEQ ID NO: 170700 - protein, 9 aa, Homo Sapiens
AFQAHTDDQ

SEQ ID NO: 170701 - protein, 9 aa, Homo Sapiens
CGHSCPGRE

SEQ ID NO: 170702 - protein, 9 aa, Homo Sapiens
TPHRTSENT

SEQ ID NO: 170703 - protein, 9 aa, Homo Sapiens
TEELFLLVS

SEQ ID NO: 170704 - protein, 9 aa, Homo Sapiens
MNPCGGEDI

SEQ ID NO: 170705 - protein, 9 aa, Homo Sapiens
SKFPPHLEL

SEQ ID NO: 170706 - protein, 9 aa, Homo Sapiens
QHVSPFPEV

SEQ ID NO: 170707 - protein, 9 aa, Homo Sapiens
TAEETAFVV

SEQ ID NO: 170708 - protein, 9 aa, Homo Sapiens
TFKYPLLIG

SEQ ID NO: 170709 - protein, 9 aa, Homo Sapiens
LQLQGLVAG

SEQ ID NO: 170710 - protein, 9 aa, Homo Sapiens
LNHHVPRTR

SEQ ID NO: 170711 - protein, 9 aa, Homo Sapiens
KSSPTSWWA

SEQ ID NO: 170712 - protein, 9 aa, Homo Sapiens
AEPRLQRQH

SEQ ID NO: 170713 - protein, 9 aa, Homo Sapiens
GQELQVISC

SEQ ID NO: 170714 - protein, 9 aa, Homo Sapiens
RTVTCQIMV

SEQ ID NO: 170715 - protein, 9 aa, Homo Sapiens
ELEEPQLKG

SEQ ID NO: 170716 - protein, 9 aa, Homo Sapiens
SFENQSILL

SEQ ID NO: 170717 - protein, 9 aa, Homo Sapiens
EAAGPGGCV

SEQ ID NO: 170718 - protein, 9 aa, Homo Sapiens
KAQRVGQSR

SEQ ID NO: 170719 - protein, 9 aa, Homo Sapiens
PVDMVAEES

SEQ ID NO: 170720 - protein, 9 aa, Homo Sapiens
LADTGVRED

SEQ ID NO: 170721 - protein, 9 aa, Homo Sapiens
LLLLLLSPQ

SEQ ID NO: 170722 - protein, 9 aa, Homo Sapiens
GQLAIRWTR

SEQ ID NO: 170723 - protein, 9 aa, Homo Sapiens
GAKTGRPGR

SEQ ID NO: 170724 - protein, 9 aa, Homo Sapiens
TFLREVAGE

SEQ ID NO: 170725 - protein, 9 aa, Homo Sapiens
QSCAGAVVP

SEQ ID NO: 170726 - protein, 9 aa, Homo Sapiens
FQELQTLYL

SEQ ID NO: 170727 - protein, 9 aa, Homo Sapiens
RVHLAPVQC

SEQ ID NO: 170728 - protein, 9 aa, Homo Sapiens
APAPAVTTA

SEQ ID NO: 170729 - protein, 9 aa, Homo Sapiens
ISILESANA

SEQ ID NO: 170730 - protein, 9 aa, Homo Sapiens
AEWRCGSMR

SEQ ID NO: 170731 - protein, 9 aa, Homo Sapiens
YLHQLPVQL

SEQ ID NO: 170732 - protein, 9 aa, Homo Sapiens
RQHHRAPGG

SEQ ID NO: 170733 - protein, 9 aa, Homo Sapiens
RPTAAPYLT

SEQ ID NO: 170734 - protein, 9 aa, Homo Sapiens
VDLIHTENR

SEQ ID NO: 170735 - protein, 9 aa, Homo Sapiens
PGASPMSLS

SEQ ID NO: 170736 - protein, 9 aa, Homo Sapiens
WRSYPLPHP

SEQ ID NO: 170737 - protein, 9 aa, Homo Sapiens
QNDTIFLNM

SEQ ID NO: 170738 - protein, 9 aa, Homo Sapiens
ERGRVLVVH

SEQ ID NO: 170739 - protein, 9 aa, Homo Sapiens
LYPEVTPHR

SEQ ID NO: 170740 - protein, 9 aa, Homo Sapiens
RPCPWSPGH

SEQ ID NO: 170741 - protein, 9 aa, Homo Sapiens
CWLSPPLGL

SEQ ID NO: 170742 - protein, 9 aa, Homo Sapiens
EHIRKARGV

SEQ ID NO: 170743 - protein, 9 aa, Homo Sapiens
TLVVSSDAS

SEQ ID NO: 170744 - protein, 9 aa, Homo Sapiens
TLRVTHSAA

SEQ ID NO: 170745 - protein, 9 aa, Homo Sapiens
VKDHRTSQN

SEQ ID NO: 170746 - protein, 9 aa, Homo Sapiens
FTQLNTLQR

SEQ ID NO: 170747 - protein, 9 aa, Homo Sapiens
QWWERGPEA

SEQ ID NO: 170748 - protein, 9 aa, Homo Sapiens
ATVIGGPTA

SEQ ID NO: 170749 - protein, 9 aa, Homo Sapiens
KEEGLKHST

SEQ ID NO: 170750 - protein, 9 aa, Homo Sapiens
ARVVSWSQV

SEQ ID NO: 170751 - protein, 9 aa, Homo Sapiens
ELMKNCWVY

SEQ ID NO: 170752 - protein, 9 aa, Homo Sapiens
EKRLKQKNK

SEQ ID NO: 170753 - protein, 9 aa, Homo Sapiens
FSCGQCQAC

SEQ ID NO: 170754 - protein, 9 aa, Homo Sapiens
FEWQWVDIA

SEQ ID NO: 170755 - protein, 9 aa, Homo Sapiens
RRQVPLLPK

SEQ ID NO: 170756 - protein, 9 aa, Homo Sapiens
RQTLLHHPR

SEQ ID NO: 170757 - protein, 9 aa, Homo Sapiens
QGQARDLRC

SEQ ID NO: 170758 - protein, 9 aa, Homo Sapiens
YSVYMYMAR

SEQ ID NO: 170759 - protein, 9 aa, Homo Sapiens
SNYPAIILF

SEQ ID NO: 170760 - protein, 9 aa, Homo Sapiens
EELWTAQVK

SEQ ID NO: 170761 - protein, 9 aa, Homo Sapiens
KCPPKYPPQ

SEQ ID NO: 170762 - protein, 9 aa, Homo Sapiens
VNRGFRALL

SEQ ID NO: 170763 - protein, 9 aa, Homo Sapiens
SHQVGKEKG

SEQ ID NO: 170764 - protein, 9 aa, Homo Sapiens
QFTINSTER

SEQ ID NO: 170765 - protein, 9 aa, Homo Sapiens
WQHRELIPR

SEQ ID NO: 170766 - protein, 9 aa, Homo Sapiens
GVPPWSPGE

SEQ ID NO: 170767 - protein, 9 aa, Homo Sapiens
VKKRRGCPR

SEQ ID NO: 170768 - protein, 9 aa, Homo Sapiens
ASARSPSRR

SEQ ID NO: 170769 - protein, 9 aa, Homo Sapiens
DFLQVLKSH

SEQ ID NO: 170770 - protein, 9 aa, Homo Sapiens
ATTEEEEDF

SEQ ID NO: 170771 - protein, 9 aa, Homo Sapiens
LSPVVIRHI

SEQ ID NO: 170772 - protein, 9 aa, Homo Sapiens
GFSLFYYKL

SEQ ID NO: 170773 - protein, 9 aa, Homo Sapiens
DIVGSPDNP

SEQ ID NO: 170774 - protein, 9 aa, Homo Sapiens
GFCHSSTLL

SEQ ID NO: 170775 - protein, 9 aa, Homo Sapiens
DVQGKKILF

SEQ ID NO: 170776 - protein, 9 aa, Homo Sapiens
VLKSHIPYY

SEQ ID NO: 170777 - protein, 9 aa, Homo Sapiens
FPCLRLLPG

SEQ ID NO: 170778 - protein, 9 aa, Homo Sapiens
PKSDHIVTC

SEQ ID NO: 170779 - protein, 9 aa, Homo Sapiens
AVMNPCGGE

SEQ ID NO: 170780 - protein, 9 aa, Homo Sapiens
TVLAENLCL

SEQ ID NO: 170781 - protein, 9 aa, Homo Sapiens
GEVFSEWVC

SEQ ID NO: 170782 - protein, 9 aa, Homo Sapiens
RKKKSVGLL

SEQ ID NO: 170783 - protein, 9 aa, Homo Sapiens
HRHRPSLRP

SEQ ID NO: 170784 - protein, 9 aa, Homo Sapiens
MLKRHLLQQ

SEQ ID NO: 170785 - protein, 9 aa, Homo Sapiens
NPCGGEDIV

SEQ ID NO: 170786 - protein, 9 aa, Homo Sapiens
LNLIRNHIT

SEQ ID NO: 170787 - protein, 9 aa, Homo Sapiens
LFDHHVQGA

SEQ ID NO: 170788 - protein, 9 aa, Homo Sapiens
KVAMAPGTP

SEQ ID NO: 170789 - protein, 9 aa, Homo Sapiens
AVQQKAQRV

SEQ ID NO: 170790 - protein, 9 aa, Homo Sapiens
WADVRHESR

SEQ ID NO: 170791 - protein, 9 aa, Homo Sapiens
HPYCEVHYH

SEQ ID NO: 170792 - protein, 9 aa, Homo Sapiens
KREKIINPT

SEQ ID NO: 170793 - protein, 9 aa, Homo Sapiens
VINVDLIHT

SEQ ID NO: 170794 - protein, 9 aa, Homo Sapiens
FDGFSYHLQ

SEQ ID NO: 170795 - protein, 9 aa, Homo Sapiens
WGPPTCSFV

SEQ ID NO: 170796 - protein, 9 aa, Homo Sapiens
PAHPLTPGR

SEQ ID NO: 170797 - protein, 9 aa, Homo Sapiens
RRTIVQDQG

SEQ ID NO: 170798 - protein, 9 aa, Homo Sapiens
LPHPTAPVT

SEQ ID NO: 170799 - protein, 9 aa, Homo Sapiens
LWKHFVSPR

SEQ ID NO: 170800 - protein, 9 aa, Homo Sapiens
EREVHALYE

SEQ ID NO: 170801 - protein, 9 aa, Homo Sapiens
VPGGPGTAE

SEQ ID NO: 170802 - protein, 9 aa, Homo Sapiens
EHEEVVEHL

SEQ ID NO: 170803 - protein, 9 aa, Homo Sapiens
QKNKSTQEK

SEQ ID NO: 170804 - protein, 9 aa, Homo Sapiens
ATQSSSSAP

SEQ ID NO: 170805 - protein, 9 aa, Homo Sapiens
GSGSPRRRP

SEQ ID NO: 170806 - protein, 9 aa, Homo Sapiens
EVLGWLPPD

SEQ ID NO: 170807 - protein, 9 aa, Homo Sapiens
LPGRLLQSC

SEQ ID NO: 170808 - protein, 9 aa, Homo Sapiens
YLAFLCGPQ

SEQ ID NO: 170809 - protein, 9 aa, Homo Sapiens
NPPEFTTST

SEQ ID NO: 170810 - protein, 9 aa, Homo Sapiens
PPTGPLLCL

SEQ ID NO: 170811 - protein, 9 aa, Homo Sapiens
VSAGDHHHA

SEQ ID NO: 170812 - protein, 9 aa, Homo Sapiens
VVSSKRFST

SEQ ID NO: 170813 - protein, 9 aa, Homo Sapiens
LGQGWEDRT

SEQ ID NO: 170814 - protein, 9 aa, Homo Sapiens
WGVNPGMVI

SEQ ID NO: 170815 - protein, 9 aa, Homo Sapiens
PASSPGSRS

SEQ ID NO: 170816 - protein, 9 aa, Homo Sapiens
PWRRTGRGL

SEQ ID NO: 170817 - protein, 9 aa, Homo Sapiens
FFNESMKEC

SEQ ID NO: 170818 - protein, 9 aa, Homo Sapiens
FARLARRYS

SEQ ID NO: 170819 - protein, 9 aa, Homo Sapiens
TSRSLRISH

SEQ ID NO: 170820 - protein, 9 aa, Homo Sapiens
KNIYRKSGT

SEQ ID NO: 170821 - protein, 9 aa, Homo Sapiens
SEGAGESQE

SEQ ID NO: 170822 - protein, 9 aa, Homo Sapiens
GVGDTPGTS

SEQ ID NO: 170823 - protein, 9 aa, Homo Sapiens
NANIQYQVV

SEQ ID NO: 170824 - protein, 9 aa, Homo Sapiens
SEPEQKKSK

SEQ ID NO: 170825 - protein, 9 aa, Homo Sapiens
QRALYRDGM

SEQ ID NO: 170826 - protein, 9 aa, Homo Sapiens
FYQGYLWFK

SEQ ID NO: 170827 - protein, 9 aa, Homo Sapiens
ESTFSLDHG

SEQ ID NO: 170828 - protein, 9 aa, Homo Sapiens
TCILGQRAT

SEQ ID NO: 170829 - protein, 9 aa, Homo Sapiens
ADLRDLAKS

SEQ ID NO: 170830 - protein, 9 aa, Homo Sapiens
LSASHFTTL

SEQ ID NO: 170831 - protein, 9 aa, Homo Sapiens
LVTCPAQGN

SEQ ID NO: 170832 - protein, 9 aa, Homo Sapiens
APERDTDPH

SEQ ID NO: 170833 - protein, 9 aa, Homo Sapiens
LCGPQRSHF

SEQ ID NO: 170834 - protein, 9 aa, Homo Sapiens
RQERDRKFH

SEQ ID NO: 170835 - protein, 9 aa, Homo Sapiens
TFINVKAHH

SEQ ID NO: 170836 - protein, 9 aa, Homo Sapiens
TTAATTTVA

SEQ ID NO: 170837 - protein, 9 aa, Homo Sapiens
DRRERRLDG

SEQ ID NO: 170838 - protein, 9 aa, Homo Sapiens
SAFIRRYSR

SEQ ID NO: 170839 - protein, 9 aa, Homo Sapiens
EHTQHGIRE

SEQ ID NO: 170840 - protein, 9 aa, Homo Sapiens
VFSYSWPRV

SEQ ID NO: 170841 - protein, 9 aa, Homo Sapiens
LRLWMFLRI

SEQ ID NO: 170842 - protein, 9 aa, Homo Sapiens
EISYCQGTG

SEQ ID NO: 170843 - protein, 9 aa, Homo Sapiens
TRSRMAACH

SEQ ID NO: 170844 - protein, 9 aa, Homo Sapiens
PQNGHFRPP

SEQ ID NO: 170845 - protein, 9 aa, Homo Sapiens
AHHRHGWLK

SEQ ID NO: 170846 - protein, 9 aa, Homo Sapiens
PHSFPAPAP

SEQ ID NO: 170847 - protein, 9 aa, Homo Sapiens
TISAAHLYY

SEQ ID NO: 170848 - protein, 9 aa, Homo Sapiens
SWYSTANYE

SEQ ID NO: 170849 - protein, 9 aa, Homo Sapiens
AEQLRLQAE

SEQ ID NO: 170850 - protein, 9 aa, Homo Sapiens
SLEHEEVVE

SEQ ID NO: 170851 - protein, 9 aa, Homo Sapiens
ATAAPALSA

SEQ ID NO: 170852 - protein, 9 aa, Homo Sapiens
RHLPALEGL

SEQ ID NO: 170853 - protein, 9 aa, Homo Sapiens
ITITKKISE

SEQ ID NO: 170854 - protein, 9 aa, Homo Sapiens
EEVLKNIYR

SEQ ID NO: 170855 - protein, 9 aa, Homo Sapiens
AQPVIREPA

SEQ ID NO: 170856 - protein, 9 aa, Homo Sapiens
TANYENQKW

SEQ ID NO: 170857 - protein, 9 aa, Homo Sapiens
LSNKRHHPI

SEQ ID NO: 170858 - protein, 9 aa, Homo Sapiens
KPPASNPAT

SEQ ID NO: 170859 - protein, 9 aa, Homo Sapiens
GGPGTAEGP

SEQ ID NO: 170860 - protein, 9 aa, Homo Sapiens
VGRTGMFTV

SEQ ID NO: 170861 - protein, 9 aa, Homo Sapiens
PARTLARPR

SEQ ID NO: 170862 - protein, 9 aa, Homo Sapiens
VDLPSSRNN

SEQ ID NO: 170863 - protein, 9 aa, Homo Sapiens
QSMGGGQRP

SEQ ID NO: 170864 - protein, 9 aa, Homo Sapiens
ITEALVSRP

SEQ ID NO: 170865 - protein, 9 aa, Homo Sapiens
QDQLISLKR

SEQ ID NO: 170866 - protein, 9 aa, Homo Sapiens
LLGSLSHWD

SEQ ID NO: 170867 - protein, 9 aa, Homo Sapiens
VSIQFERVL

SEQ ID NO: 170868 - protein, 9 aa, Homo Sapiens
SGCNTSDLC

SEQ ID NO: 170869 - protein, 9 aa, Homo Sapiens
VDINVEPPL

SEQ ID NO: 170870 - protein, 9 aa, Homo Sapiens
EEETTTEMI

SEQ ID NO: 170871 - protein, 9 aa, Homo Sapiens
DLCVSPYDP

SEQ ID NO: 170872 - protein, 9 aa, Homo Sapiens
LWRVTGPAG

SEQ ID NO: 170873 - protein, 9 aa, Homo Sapiens
LELRLLSLY

SEQ ID NO: 170874 - protein, 9 aa, Homo Sapiens
PYYRESKPA

SEQ ID NO: 170875 - protein, 9 aa, Homo Sapiens
SEHEREVHA

SEQ ID NO: 170876 - protein, 9 aa, Homo Sapiens
CFFLWESLY

SEQ ID NO: 170877 - protein, 9 aa, Homo Sapiens
RLQAETLVT

SEQ ID NO: 170878 - protein, 9 aa, Homo Sapiens
RAGMESTAL

SEQ ID NO: 170879 - protein, 9 aa, Homo Sapiens
SNKRLQLHL

SEQ ID NO: 170880 - protein, 9 aa, Homo Sapiens
HTDSQSEAV

SEQ ID NO: 170881 - protein, 9 aa, Homo Sapiens
LYRPPLAPL

SEQ ID NO: 170882 - protein, 9 aa, Homo Sapiens
GEDLLEEFS

SEQ ID NO: 170883 - protein, 9 aa, Homo Sapiens
GSPSPLSEA

SEQ ID NO: 170884 - protein, 9 aa, Homo Sapiens
FSEGLEGLR

SEQ ID NO: 170885 - protein, 9 aa, Homo Sapiens
FRSLWPRWH

SEQ ID NO: 170886 - protein, 9 aa, Homo Sapiens
CAACLQRMD

SEQ ID NO: 170887 - protein, 9 aa, Homo Sapiens
LMFNNARLY

SEQ ID NO: 170888 - protein, 9 aa, Homo Sapiens
ATTGESPTC

SEQ ID NO: 170889 - protein, 9 aa, Homo Sapiens
FLQVTCLLL

SEQ ID NO: 170890 - protein, 9 aa, Homo Sapiens
FVQKIVKSK

SEQ ID NO: 170891 - protein, 9 aa, Homo Sapiens
AGRVARAAE

SEQ ID NO: 170892 - protein, 9 aa, Homo Sapiens
VCNVTLGAK

SEQ ID NO: 170893 - protein, 9 aa, Homo Sapiens
DCGTRRLWP

SEQ ID NO: 170894 - protein, 9 aa, Homo Sapiens
YDGHSRLSS

SEQ ID NO: 170895 - protein, 9 aa, Homo Sapiens
HVQLWDLIG

SEQ ID NO: 170896 - protein, 9 aa, Homo Sapiens
SVNLGSEHS

SEQ ID NO: 170897 - protein, 9 aa, Homo Sapiens
GPLVSDMDM

SEQ ID NO: 170898 - protein, 9 aa, Homo Sapiens
FLISKTRNH

SEQ ID NO: 170899 - protein, 9 aa, Homo Sapiens
VSAGGGLRC

SEQ ID NO: 170900 - protein, 9 aa, Homo Sapiens
VCATAMEDV

SEQ ID NO: 170901 - protein, 9 aa, Homo Sapiens
HWRIGGGTP

SEQ ID NO: 170902 - protein, 9 aa, Homo Sapiens
RLPRRSCCS

SEQ ID NO: 170903 - protein, 9 aa, Homo Sapiens
PSRLYVPPP

SEQ ID NO: 170904 - protein, 9 aa, Homo Sapiens
GTPIITFPE

SEQ ID NO: 170905 - protein, 9 aa, Homo Sapiens
KVEQARCEE

SEQ ID NO: 170906 - protein, 9 aa, Homo Sapiens
QRGSPGGPS

SEQ ID NO: 170907 - protein, 9 aa, Homo Sapiens
QEEYLDGVR

SEQ ID NO: 170908 - protein, 9 aa, Homo Sapiens
RAGGVGETG

SEQ ID NO: 170909 - protein, 9 aa, Homo Sapiens
PAVRPPHTS

SEQ ID NO: 170910 - protein, 9 aa, Homo Sapiens
HMCTEPVTS

SEQ ID NO: 170911 - protein, 9 aa, Homo Sapiens
QEVETLTPG

SEQ ID NO: 170912 - protein, 9 aa, Homo Sapiens
FACICPPGM

SEQ ID NO: 170913 - protein, 9 aa, Homo Sapiens
MCAKDNVYH

SEQ ID NO: 170914 - protein, 9 aa, Homo Sapiens
RLCATTTCP

SEQ ID NO: 170915 - protein, 9 aa, Homo Sapiens
GGCLLLLSF

SEQ ID NO: 170916 - protein, 9 aa, Homo Sapiens
TTIDNVSGK

SEQ ID NO: 170917 - protein, 9 aa, Homo Sapiens
FIISFSSDQ

SEQ ID NO: 170918 - protein, 9 aa, Homo Sapiens
TMIWSNPVQ

SEQ ID NO: 170919 - protein, 9 aa, Homo Sapiens
SPPSSRTTL

SEQ ID NO: 170920 - protein, 9 aa, Homo Sapiens
PRIPDCQGS

SEQ ID NO: 170921 - protein, 9 aa, Homo Sapiens
LWRYPRYAP

SEQ ID NO: 170922 - protein, 9 aa, Homo Sapiens
IRSETLNLS

SEQ ID NO: 170923 - protein, 9 aa, Homo Sapiens
RQLDEVVSD

SEQ ID NO: 170924 - protein, 9 aa, Homo Sapiens
VAAAVSCVF

SEQ ID NO: 170925 - protein, 9 aa, Homo Sapiens
GYDMSAFIR

SEQ ID NO: 170926 - protein, 9 aa, Homo Sapiens
GGGEAGKPP

SEQ ID NO: 170927 - protein, 9 aa, Homo Sapiens
ANGSLWPTL

SEQ ID NO: 170928 - protein, 9 aa, Homo Sapiens
GPPGALRHP

SEQ ID NO: 170929 - protein, 9 aa, Homo Sapiens
ETFINVKAH

SEQ ID NO: 170930 - protein, 9 aa, Homo Sapiens
DFHANLQRQ

SEQ ID NO: 170931 - protein, 9 aa, Homo Sapiens
MTACSILAR

SEQ ID NO: 170932 - protein, 9 aa, Homo Sapiens
AATTTVAAA

SEQ ID NO: 170933 - protein, 9 aa, Homo Sapiens
RAMCEMNGK

SEQ ID NO: 170934 - protein, 9 aa, Homo Sapiens
LNLGIDSDS

SEQ ID NO: 170935 - protein, 9 aa, Homo Sapiens
NDNPPEFTT

SEQ ID NO: 170936 - protein, 9 aa, Homo Sapiens
YLLAVDFTA

SEQ ID NO: 170937 - protein, 9 aa, Homo Sapiens
ASNPATSSL

SEQ ID NO: 170938 - protein, 9 aa, Homo Sapiens
MLGNTGTIL

SEQ ID NO: 170939 - protein, 9 aa, Homo Sapiens
VIVIMAIIC

SEQ ID NO: 170940 - protein, 9 aa, Homo Sapiens
SAGGGLRCT

SEQ ID NO: 170941 - protein, 9 aa, Homo Sapiens
WRCVRITST

SEQ ID NO: 170942 - protein, 9 aa, Homo Sapiens
QTHLVGHQK

SEQ ID NO: 170943 - protein, 9 aa, Homo Sapiens
YLVSTVCAL

SEQ ID NO: 170944 - protein, 9 aa, Homo Sapiens
PTSLTFPAA

SEQ ID NO: 170945 - protein, 9 aa, Homo Sapiens
IAFYSYTFF

SEQ ID NO: 170946 - protein, 9 aa, Homo Sapiens
KTTKSMQTQ

SEQ ID NO: 170947 - protein, 9 aa, Homo Sapiens
LFTRSLTNL

SEQ ID NO: 170948 - protein, 9 aa, Homo Sapiens
SQTTYVLIE

SEQ ID NO: 170949 - protein, 9 aa, Homo Sapiens
PKNVLWRKT

SEQ ID NO: 170950 - protein, 9 aa, Homo Sapiens
ESEPEQKKS

SEQ ID NO: 170951 - protein, 9 aa, Homo Sapiens
RSGTRDDPA

SEQ ID NO: 170952 - protein, 9 aa, Homo Sapiens
KLALKEDLL

SEQ ID NO: 170953 - protein, 9 aa, Homo Sapiens
AAVRLCGGL

SEQ ID NO: 170954 - protein, 9 aa, Homo Sapiens
TYLLPHHMV

SEQ ID NO: 170955 - protein, 9 aa, Homo Sapiens
EKGQDGQPQ

SEQ ID NO: 170956 - protein, 9 aa, Homo Sapiens
SLLTGAMGG

SEQ ID NO: 170957 - protein, 9 aa, Homo Sapiens
AHFVKSVEY

SEQ ID NO: 170958 - protein, 9 aa, Homo Sapiens
CSSLWAWKG

SEQ ID NO: 170959 - protein, 9 aa, Homo Sapiens
HGQDVAGPR

SEQ ID NO: 170960 - protein, 9 aa, Homo Sapiens
KKKIKSEAS

SEQ ID NO: 170961 - protein, 9 aa, Homo Sapiens
KDMPLLSDG

SEQ ID NO: 170962 - protein, 9 aa, Homo Sapiens
NVSGKRVVN

SEQ ID NO: 170963 - protein, 9 aa, Homo Sapiens
PHFDWVVSH

SEQ ID NO: 170964 - protein, 9 aa, Homo Sapiens
LTAQQYSHY

SEQ ID NO: 170965 - protein, 9 aa, Homo Sapiens
LLLGWLIND

SEQ ID NO: 170966 - protein, 9 aa, Homo Sapiens
LSTVTSLQM

SEQ ID NO: 170967 - protein, 9 aa, Homo Sapiens
LAENLCLPD

SEQ ID NO: 170968 - protein, 9 aa, Homo Sapiens
ASPSMTSPW

SEQ ID NO: 170969 - protein, 9 aa, Homo Sapiens
HPAHQPLGS

SEQ ID NO: 170970 - protein, 9 aa, Homo Sapiens
LPLLFLLMY

SEQ ID NO: 170971 - protein, 9 aa, Homo Sapiens
FAEKMDFRN

SEQ ID NO: 170972 - protein, 9 aa, Homo Sapiens
LLQDLCVSP

SEQ ID NO: 170973 - protein, 9 aa, Homo Sapiens
VHLQEVKGR

SEQ ID NO: 170974 - protein, 9 aa, Homo Sapiens
PHGPQNGHF

SEQ ID NO: 170975 - protein, 9 aa, Homo Sapiens
TRSRTWEAS

SEQ ID NO: 170976 - protein, 9 aa, Homo Sapiens
FAYLNHHVP

SEQ ID NO: 170977 - protein, 9 aa, Homo Sapiens
SHPLFGRLV

SEQ ID NO: 170978 - protein, 9 aa, Homo Sapiens
HFRPPVDTR

SEQ ID NO: 170979 - protein, 9 aa, Homo Sapiens
LSPCLLPTA

SEQ ID NO: 170980 - protein, 9 aa, Homo Sapiens
GSPRLCATT

SEQ ID NO: 170981 - protein, 9 aa, Homo Sapiens
KIGLFTRWR

SEQ ID NO: 170982 - protein, 9 aa, Homo Sapiens
VLLNGLHQF

SEQ ID NO: 170983 - protein, 9 aa, Homo Sapiens
FGPRKDLDG

SEQ ID NO: 170984 - protein, 9 aa, Homo Sapiens
GGPAVAGAG

SEQ ID NO: 170985 - protein, 9 aa, Homo Sapiens
LMKNCWVYD

SEQ ID NO: 170986 - protein, 9 aa, Homo Sapiens
QKGWLLGPD

SEQ ID NO: 170987 - protein, 9 aa, Homo Sapiens
TDDLDVGDC

SEQ ID NO: 170988 - protein, 9 aa, Homo Sapiens
GPRDDDKSD

SEQ ID NO: 170989 - protein, 9 aa, Homo Sapiens
GWLPPDTRV

SEQ ID NO: 170990 - protein, 9 aa, Homo Sapiens
GVPLGPLRT

SEQ ID NO: 170991 - protein, 9 aa, Homo Sapiens
AGLETSQPP

SEQ ID NO: 170992 - protein, 9 aa, Homo Sapiens
QMRTAPSVW

SEQ ID NO: 170993 - protein, 9 aa, Homo Sapiens
LEMVESCQM

SEQ ID NO: 170994 - protein, 9 aa, Homo Sapiens
SLPPCLPAG

SEQ ID NO: 170995 - protein, 9 aa, Homo Sapiens
HLHRKGPLN

SEQ ID NO: 170996 - protein, 9 aa, Homo Sapiens
AAKKKEKKK

SEQ ID NO: 170997 - protein, 9 aa, Homo Sapiens
APSTEWWTM

SEQ ID NO: 170998 - protein, 9 aa, Homo Sapiens
SDRNPRPGC

SEQ ID NO: 170999 - protein, 9 aa, Homo Sapiens
SCGPNIIGH

SEQ ID NO: 171000 - protein, 9 aa, Homo Sapiens
GPPRPTVAF

SEQ ID NO: 171001 - protein, 9 aa, Homo Sapiens
DRWVQVSHV

SEQ ID NO: 171002 - protein, 9 aa, Homo Sapiens
WLPPRPRPG

SEQ ID NO: 171003 - protein, 9 aa, Homo Sapiens
FVLVNLEVT

SEQ ID NO: 171004 - protein, 9 aa, Homo Sapiens
FEELEYHDT

SEQ ID NO: 171005 - protein, 9 aa, Homo Sapiens
AHILRCQRE

SEQ ID NO: 171006 - protein, 9 aa, Homo Sapiens
SGHILMNGT

SEQ ID NO: 171007 - protein, 9 aa, Homo Sapiens
PSRLPGSAA

SEQ ID NO: 171008 - protein, 9 aa, Homo Sapiens
EFSEGQELQ

SEQ ID NO: 171009 - protein, 9 aa, Homo Sapiens
HGDSDGTRS

SEQ ID NO: 171010 - protein, 9 aa, Homo Sapiens
GPENNLGVY

SEQ ID NO: 171011 - protein, 9 aa, Homo Sapiens
AISPKMLVD

SEQ ID NO: 171012 - protein, 9 aa, Homo Sapiens
AELPPAAAT

SEQ ID NO: 171013 - protein, 9 aa, Homo Sapiens
EGSSDQLRC

SEQ ID NO: 171014 - protein, 9 aa, Homo Sapiens
EKTEKPGIC

SEQ ID NO: 171015 - protein, 9 aa, Homo Sapiens
RRPQAPPKS

SEQ ID NO: 171016 - protein, 9 aa, Homo Sapiens
PSIYTITPN

SEQ ID NO: 171017 - protein, 9 aa, Homo Sapiens
LTQMYFLYF

SEQ ID NO: 171018 - protein, 9 aa, Homo Sapiens
ILGCMVEPP

SEQ ID NO: 171019 - protein, 9 aa, Homo Sapiens
LQGLVAGVG

SEQ ID NO: 171020 - protein, 9 aa, Homo Sapiens
TGTILLIRG

SEQ ID NO: 171021 - protein, 9 aa, Homo Sapiens
MRMERERRK

SEQ ID NO: 171022 - protein, 9 aa, Homo Sapiens
PPRSSSRDD

SEQ ID NO: 171023 - protein, 9 aa, Homo Sapiens
AEGASAEVL

SEQ ID NO: 171024 - protein, 9 aa, Homo Sapiens
MSSFPKKFF

SEQ ID NO: 171025 - protein, 9 aa, Homo Sapiens
PGPAALQPL

SEQ ID NO: 171026 - protein, 9 aa, Homo Sapiens
GSRSPSHVR

SEQ ID NO: 171027 - protein, 9 aa, Homo Sapiens
AGAVLRVEE

SEQ ID NO: 171028 - protein, 9 aa, Homo Sapiens
RTHMGERPY

SEQ ID NO: 171029 - protein, 9 aa, Homo Sapiens
RLVIVGHGH

SEQ ID NO: 171030 - protein, 9 aa, Homo Sapiens
SRCQSEPRE

SEQ ID NO: 171031 - protein, 9 aa, Homo Sapiens
PCASTATWT

SEQ ID NO: 171032 - protein, 9 aa, Homo Sapiens
RRVLQQVPC

SEQ ID NO: 171033 - protein, 9 aa, Homo Sapiens
GWMTRPRAG

SEQ ID NO: 171034 - protein, 9 aa, Homo Sapiens
RTHSTSANG

SEQ ID NO: 171035 - protein, 9 aa, Homo Sapiens
LHHGWASVP

SEQ ID NO: 171036 - protein, 9 aa, Homo Sapiens
HLLQQRAVE

SEQ ID NO: 171037 - protein, 9 aa, Homo Sapiens
DLSLAGWRV

SEQ ID NO: 171038 - protein, 9 aa, Homo Sapiens
QPQWEVEGK

SEQ ID NO: 171039 - protein, 9 aa, Homo Sapiens
THVYISVFI

SEQ ID NO: 171040 - protein, 9 aa, Homo Sapiens
VVLQDHFLE

SEQ ID NO: 171041 - protein, 9 aa, Homo Sapiens
EEELWISIN

SEQ ID NO: 171042 - protein, 9 aa, Homo Sapiens
KKSVGLLPP

SEQ ID NO: 171043 - protein, 9 aa, Homo Sapiens
RLGRWIQTQ

SEQ ID NO: 171044 - protein, 9 aa, Homo Sapiens
PTVAFLPPM

SEQ ID NO: 171045 - protein, 9 aa, Homo Sapiens
ERAVSHLES

SEQ ID NO: 171046 - protein, 9 aa, Homo Sapiens
SEEIEAWIL

SEQ ID NO: 171047 - protein, 9 aa, Homo Sapiens
LSTKASNTI

SEQ ID NO: 171048 - protein, 9 aa, Homo Sapiens
VAPATLPCR

SEQ ID NO: 171049 - protein, 9 aa, Homo Sapiens
PLMWQASWT

SEQ ID NO: 171050 - protein, 9 aa, Homo Sapiens
YRKRCREIN

SEQ ID NO: 171051 - protein, 9 aa, Homo Sapiens
STESEGAGE

SEQ ID NO: 171052 - protein, 9 aa, Homo Sapiens
PRPLSTASQ

SEQ ID NO: 171053 - protein, 9 aa, Homo Sapiens
WGVCVCVSL

SEQ ID NO: 171054 - protein, 9 aa, Homo Sapiens
QLRTNRNNL

SEQ ID NO: 171055 - protein, 9 aa, Homo Sapiens
SLVVVNQLG

SEQ ID NO: 171056 - protein, 9 aa, Homo Sapiens
NIGRQYLAQ

SEQ ID NO: 171057 - protein, 9 aa, Homo Sapiens
SAGLSPGAC

SEQ ID NO: 171058 - protein, 9 aa, Homo Sapiens
QIVFILVWG

SEQ ID NO: 171059 - protein, 9 aa, Homo Sapiens
LEGVAAPRP

SEQ ID NO: 171060 - protein, 9 aa, Homo Sapiens
AGSKHKISF

SEQ ID NO: 171061 - protein, 9 aa, Homo Sapiens
DRPWKWREG

SEQ ID NO: 171062 - protein, 9 aa, Homo Sapiens
NQRTDLLGL

SEQ ID NO: 171063 - protein, 9 aa, Homo Sapiens
QLSTVALGS

SEQ ID NO: 171064 - protein, 9 aa, Homo Sapiens
LVAAFHPRF

SEQ ID NO: 171065 - protein, 9 aa, Homo Sapiens
APERIDPQT

SEQ ID NO: 171066 - protein, 9 aa, Homo Sapiens
QVGNEVPVT

SEQ ID NO: 171067 - protein, 9 aa, Homo Sapiens
ARDTQDPSQ

SEQ ID NO: 171068 - protein, 9 aa, Homo Sapiens
TLEYNSKYL

SEQ ID NO: 171069 - protein, 9 aa, Homo Sapiens
RTSSAWTHP

SEQ ID NO: 171070 - protein, 9 aa, Homo Sapiens
PRGAGAAWA

SEQ ID NO: 171071 - protein, 9 aa, Homo Sapiens
LLVALKVCY

SEQ ID NO: 171072 - protein, 9 aa, Homo Sapiens
CHSSTLLQH

SEQ ID NO: 171073 - protein, 9 aa, Homo Sapiens
LLLLRPTGP

SEQ ID NO: 171074 - protein, 9 aa, Homo Sapiens
WWVDHLCSP

SEQ ID NO: 171075 - protein, 9 aa, Homo Sapiens
LPQQHRGPV

SEQ ID NO: 171076 - protein, 9 aa, Homo Sapiens
RRRARMSAG

SEQ ID NO: 171077 - protein, 9 aa, Homo Sapiens
PPTRCVWQQ

SEQ ID NO: 171078 - protein, 9 aa, Homo Sapiens
HPQLPCPQC

SEQ ID NO: 171079 - protein, 9 aa, Homo Sapiens
GLTPLARVV

SEQ ID NO: 171080 - protein, 9 aa, Homo Sapiens
PPKYPPQCP

SEQ ID NO: 171081 - protein, 9 aa, Homo Sapiens
GILSIPVLL

SEQ ID NO: 171082 - protein, 9 aa, Homo Sapiens
PSAWRTARP

SEQ ID NO: 171083 - protein, 9 aa, Homo Sapiens
LCLPDIFIV

SEQ ID NO: 171084 - protein, 9 aa, Homo Sapiens
RPHPTPLCT

SEQ ID NO: 171085 - protein, 9 aa, Homo Sapiens
GGGAGGSTA

SEQ ID NO: 171086 - protein, 9 aa, Homo Sapiens
KSGTYTIYI

SEQ ID NO: 171087 - protein, 9 aa, Homo Sapiens
VDGSIGQSP

SEQ ID NO: 171088 - protein, 9 aa, Homo Sapiens
HPVLTPRAG

SEQ ID NO: 171089 - protein, 9 aa, Homo Sapiens
RTKRTALWL

SEQ ID NO: 171090 - protein, 9 aa, Homo Sapiens
QEKWGYPRA

SEQ ID NO: 171091 - protein, 9 aa, Homo Sapiens
GISSIRAGQ

SEQ ID NO: 171092 - protein, 9 aa, Homo Sapiens
RSTVCAMDS

SEQ ID NO: 171093 - protein, 9 aa, Homo Sapiens
ILRGHDGLS

SEQ ID NO: 171094 - protein, 9 aa, Homo Sapiens
QMPRSPHRH

SEQ ID NO: 171095 - protein, 9 aa, Homo Sapiens
TFLSQTTYV

SEQ ID NO: 171096 - protein, 9 aa, Homo Sapiens
YCFVYCLSQ

SEQ ID NO: 171097 - protein, 9 aa, Homo Sapiens
TTSWWRLGR

SEQ ID NO: 171098 - protein, 9 aa, Homo Sapiens
DGHPYCEVH

SEQ ID NO: 171099 - protein, 9 aa, Homo Sapiens
EFLVSAFLN

SEQ ID NO: 171100 - protein, 9 aa, Homo Sapiens
DVNLPKVDL

SEQ ID NO: 171101 - protein, 9 aa, Homo Sapiens
PRPPKVPAR

SEQ ID NO: 171102 - protein, 9 aa, Homo Sapiens
PVFIGCPQA

SEQ ID NO: 171103 - protein, 9 aa, Homo Sapiens
RRYSDVFQI

SEQ ID NO: 171104 - protein, 9 aa, Homo Sapiens
GAPQPARQA

SEQ ID NO: 171105 - protein, 9 aa, Homo Sapiens
AAGGCPQDP

SEQ ID NO: 171106 - protein, 9 aa, Homo Sapiens
LTSGPHCTR

SEQ ID NO: 171107 - protein, 9 aa, Homo Sapiens
QAGFNKSGT

SEQ ID NO: 171108 - protein, 9 aa, Homo Sapiens
TPRAGSRTT

SEQ ID NO: 171109 - protein, 9 aa, Homo Sapiens
HAGWYRCYY

SEQ ID NO: 171110 - protein, 9 aa, Homo Sapiens
QKQGIMSFL

SEQ ID NO: 171111 - protein, 9 aa, Homo Sapiens
PAQQKRIRR

SEQ ID NO: 171112 - protein, 9 aa, Homo Sapiens
HLLRLWMFL

SEQ ID NO: 171113 - protein, 9 aa, Homo Sapiens
GDTDTVHAE

SEQ ID NO: 171114 - protein, 9 aa, Homo Sapiens
PGDSHGREV

SEQ ID NO: 171115 - protein, 9 aa, Homo Sapiens
LIRLTQRRA

SEQ ID NO: 171116 - protein, 9 aa, Homo Sapiens
PKKKIKSEA

SEQ ID NO: 171117 - protein, 9 aa, Homo Sapiens
PLGPARTGL

SEQ ID NO: 171118 - protein, 9 aa, Homo Sapiens
CVATAESLG

SEQ ID NO: 171119 - protein, 9 aa, Homo Sapiens
RAKVVLPPS

SEQ ID NO: 171120 - protein, 9 aa, Homo Sapiens
REGAQELAG

SEQ ID NO: 171121 - protein, 9 aa, Homo Sapiens
ASDSHKDLL

SEQ ID NO: 171122 - protein, 9 aa, Homo Sapiens
GLDKMLLTL

SEQ ID NO: 171123 - protein, 9 aa, Homo Sapiens
RLSLPPCLP

SEQ ID NO: 171124 - protein, 9 aa, Homo Sapiens
ITLSIVLEQ

SEQ ID NO: 171125 - protein, 9 aa, Homo Sapiens
SCCRWGAPM

SEQ ID NO: 171126 - protein, 9 aa, Homo Sapiens
VYAVQVCCK

SEQ ID NO: 171127 - protein, 9 aa, Homo Sapiens
SSGPRLGEL

SEQ ID NO: 171128 - protein, 9 aa, Homo Sapiens
QGTQQMYEP

SEQ ID NO: 171129 - protein, 9 aa, Homo Sapiens
FFSEARTRS

SEQ ID NO: 171130 - protein, 9 aa, Homo Sapiens
SEGGRKSVH

SEQ ID NO: 171131 - protein, 9 aa, Homo Sapiens
YLLAFKKSK

SEQ ID NO: 171132 - protein, 9 aa, Homo Sapiens
HTPPPIPIP

SEQ ID NO: 171133 - protein, 9 aa, Homo Sapiens
FAAVRLCGG

SEQ ID NO: 171134 - protein, 9 aa, Homo Sapiens
LIPSSLRIG

SEQ ID NO: 171135 - protein, 9 aa, Homo Sapiens
LRAHFVKSV

SEQ ID NO: 171136 - protein, 9 aa, Homo Sapiens
ASLVKGTLS

SEQ ID NO: 171137 - protein, 9 aa, Homo Sapiens
FLRTLKERL

SEQ ID NO: 171138 - protein, 9 aa, Homo Sapiens
GAEEALGGP

SEQ ID NO: 171139 - protein, 9 aa, Homo Sapiens
SLWPRRWDQ

SEQ ID NO: 171140 - protein, 9 aa, Homo Sapiens
SWPRVPHWG

SEQ ID NO: 171141 - protein, 9 aa, Homo Sapiens
VTCQIMVMM

SEQ ID NO: 171142 - protein, 9 aa, Homo Sapiens
IQFTINSTE

SEQ ID NO: 171143 - protein, 9 aa, Homo Sapiens
YKIIDCGKV

SEQ ID NO: 171144 - protein, 9 aa, Homo Sapiens
KIFQNYYPN

SEQ ID NO: 171145 - protein, 9 aa, Homo Sapiens
YPIGSGHVT

SEQ ID NO: 171146 - protein, 9 aa, Homo Sapiens
LAPVQCLPA

SEQ ID NO: 171147 - protein, 9 aa, Homo Sapiens
LAEGQWILT

SEQ ID NO: 171148 - protein, 9 aa, Homo Sapiens
RTRAAMAPS

SEQ ID NO: 171149 - protein, 9 aa, Homo Sapiens
RVTHSAAPS

SEQ ID NO: 171150 - protein, 9 aa, Homo Sapiens
GHLFHLITE

SEQ ID NO: 171151 - protein, 9 aa, Homo Sapiens
LKTINLTAK

SEQ ID NO: 171152 - protein, 9 aa, Homo Sapiens
KNVLWRKTL

SEQ ID NO: 171153 - protein, 9 aa, Homo Sapiens
LMWVTDERV

SEQ ID NO: 171154 - protein, 9 aa, Homo Sapiens
TWEHLYCVL

SEQ ID NO: 171155 - protein, 9 aa, Homo Sapiens
NDILLVRRD

SEQ ID NO: 171156 - protein, 9 aa, Homo Sapiens
PKVLFAKEQ

SEQ ID NO: 171157 - protein, 9 aa, Homo Sapiens
AYAAVPRGR

SEQ ID NO: 171158 - protein, 9 aa, Homo Sapiens
PGTCFRCCS

SEQ ID NO: 171159 - protein, 9 aa, Homo Sapiens
LGLHVHHHL

SEQ ID NO: 171160 - protein, 9 aa, Homo Sapiens
IICFILLIL

SEQ ID NO: 171161 - protein, 9 aa, Homo Sapiens
IPVRLQLFE

SEQ ID NO: 171162 - protein, 9 aa, Homo Sapiens
AVSLFDVLL

SEQ ID NO: 171163 - protein, 9 aa, Homo Sapiens
YCLSQLCGD

SEQ ID NO: 171164 - protein, 9 aa, Homo Sapiens
VVCHDEVRM

SEQ ID NO: 171165 - protein, 9 aa, Homo Sapiens
FHETLRCPH

SEQ ID NO: 171166 - protein, 9 aa, Homo Sapiens
GTMVIWDGL

SEQ ID NO: 171167 - protein, 9 aa, Homo Sapiens
ISNEWFCCP

SEQ ID NO: 171168 - protein, 9 aa, Homo Sapiens
AMEETGVVA

SEQ ID NO: 171169 - protein, 9 aa, Homo Sapiens
PMQIELRHH

SEQ ID NO: 171170 - protein, 9 aa, Homo Sapiens
QIAKKSNWK

SEQ ID NO: 171171 - protein, 9 aa, Homo Sapiens
GPAVAGAGR

SEQ ID NO: 171172 - protein, 9 aa, Homo Sapiens
LFAKEQLAR

SEQ ID NO: 171173 - protein, 9 aa, Homo Sapiens
TISEKGFQQ

SEQ ID NO: 171174 - protein, 9 aa, Homo Sapiens
YVLIEAITE

SEQ ID NO: 171175 - protein, 9 aa, Homo Sapiens
LEEKLFPQC

SEQ ID NO: 171176 - protein, 9 aa, Homo Sapiens
VFRLIRIFR

SEQ ID NO: 171177 - protein, 9 aa, Homo Sapiens
SQPILQLVL

SEQ ID NO: 171178 - protein, 9 aa, Homo Sapiens
LDVGDCPKR

SEQ ID NO: 171179 - protein, 9 aa, Homo Sapiens
AGGHIAALT

SEQ ID NO: 171180 - protein, 9 aa, Homo Sapiens
FSLLITLQG

SEQ ID NO: 171181 - protein, 9 aa, Homo Sapiens
PPQGVGPYS

SEQ ID NO: 171182 - protein, 9 aa, Homo Sapiens
RERGRVLVV

SEQ ID NO: 171183 - protein, 9 aa, Homo Sapiens
YGAWASRWW

SEQ ID NO: 171184 - protein, 9 aa, Homo Sapiens
PQPSLPGPC

SEQ ID NO: 171185 - protein, 9 aa, Homo Sapiens
LGAGLETSQ

SEQ ID NO: 171186 - protein, 9 aa, Homo Sapiens
PRSRRSSRA

SEQ ID NO: 171187 - protein, 9 aa, Homo Sapiens
WSPAASNTA

SEQ ID NO: 171188 - protein, 9 aa, Homo Sapiens
EATPHGRLP

SEQ ID NO: 171189 - protein, 9 aa, Homo Sapiens
GADVQFCIW

SEQ ID NO: 171190 - protein, 9 aa, Homo Sapiens
VEVDSMLAA

SEQ ID NO: 171191 - protein, 9 aa, Homo Sapiens
SWGTRLNCT

SEQ ID NO: 171192 - protein, 9 aa, Homo Sapiens
EESERAKLD

SEQ ID NO: 171193 - protein, 9 aa, Homo Sapiens
SLTNLCVAG

SEQ ID NO: 171194 - protein, 9 aa, Homo Sapiens
VHRLKKDIC

SEQ ID NO: 171195 - protein, 9 aa, Homo Sapiens
YPRYAPNVQ

SEQ ID NO: 171196 - protein, 9 aa, Homo Sapiens
WYLLAVDFT

SEQ ID NO: 171197 - protein, 9 aa, Homo Sapiens
TRKKCCPYT

SEQ ID NO: 171198 - protein, 9 aa, Homo Sapiens
GPLNLQGGC

SEQ ID NO: 171199 - protein, 9 aa, Homo Sapiens
CASTATWTC

SEQ ID NO: 171200 - protein, 9 aa, Homo Sapiens
LIMDEVDDM

SEQ ID NO: 171201 - protein, 9 aa, Homo Sapiens
GQGLPAGAA

SEQ ID NO: 171202 - protein, 9 aa, Homo Sapiens
PHAPPTWLP

SEQ ID NO: 171203 - protein, 9 aa, Homo Sapiens
ARTSFCVYS

SEQ ID NO: 171204 - protein, 9 aa, Homo Sapiens
LALTAVMNP

SEQ ID NO: 171205 - protein, 9 aa, Homo Sapiens
QALPDPHLL

SEQ ID NO: 171206 - protein, 9 aa, Homo Sapiens
SDIFCMSSL

SEQ ID NO: 171207 - protein, 9 aa, Homo Sapiens
HIGNALFIG

SEQ ID NO: 171208 - protein, 9 aa, Homo Sapiens
SWPLSSPPS

SEQ ID NO: 171209 - protein, 9 aa, Homo Sapiens
CDTVVEDML

SEQ ID NO: 171210 - protein, 9 aa, Homo Sapiens
NPAHQPSLT

SEQ ID NO: 171211 - protein, 9 aa, Homo Sapiens
PQLTKISLP

SEQ ID NO: 171212 - protein, 9 aa, Homo Sapiens
RPPRPPKVP

SEQ ID NO: 171213 - protein, 9 aa, Homo Sapiens
SPVNLLCAP

SEQ ID NO: 171214 - protein, 9 aa, Homo Sapiens
AYVGHARAQ

SEQ ID NO: 171215 - protein, 9 aa, Homo Sapiens
KVLFAKEQL

SEQ ID NO: 171216 - protein, 9 aa, Homo Sapiens
EVTWYHATN

SEQ ID NO: 171217 - protein, 9 aa, Homo Sapiens
GKAFLTQTH

SEQ ID NO: 171218 - protein, 9 aa, Homo Sapiens
PTGLLYVGV

SEQ ID NO: 171219 - protein, 9 aa, Homo Sapiens
QKQKLQMPR

SEQ ID NO: 171220 - protein, 9 aa, Homo Sapiens
NQSILLLKF

SEQ ID NO: 171221 - protein, 9 aa, Homo Sapiens
DSNFRILAD

SEQ ID NO: 171222 - protein, 9 aa, Homo Sapiens
PEEMCVETM

SEQ ID NO: 171223 - protein, 9 aa, Homo Sapiens
RTLVLRGMG

SEQ ID NO: 171224 - protein, 9 aa, Homo Sapiens
PEVTPHRTS

SEQ ID NO: 171225 - protein, 9 aa, Homo Sapiens
PLLFLLMYI

SEQ ID NO: 171226 - protein, 9 aa, Homo Sapiens
LNISGATSD

SEQ ID NO: 171227 - protein, 9 aa, Homo Sapiens
VVENAETET

SEQ ID NO: 171228 - protein, 9 aa, Homo Sapiens
LRPVSKKKD

SEQ ID NO: 171229 - protein, 9 aa, Homo Sapiens
FDHHVQGAV

SEQ ID NO: 171230 - protein, 9 aa, Homo Sapiens
YKSKKTLNW

SEQ ID NO: 171231 - protein, 9 aa, Homo Sapiens
WKHFVSPRG

SEQ ID NO: 171232 - protein, 9 aa, Homo Sapiens
LQHLEQLRT

SEQ ID NO: 171233 - protein, 9 aa, Homo Sapiens
RPASARSPS

SEQ ID NO: 171234 - protein, 9 aa, Homo Sapiens
PETTLWLGP

SEQ ID NO: 171235 - protein, 9 aa, Homo Sapiens
RQQHESTIE

SEQ ID NO: 171236 - protein, 9 aa, Homo Sapiens
APEVPRCAM

SEQ ID NO: 171237 - protein, 9 aa, Homo Sapiens
VSTVQNYLF

SEQ ID NO: 171238 - protein, 9 aa, Homo Sapiens
AKVVLPPSL

SEQ ID NO: 171239 - protein, 9 aa, Homo Sapiens
NMKDLKKNG

SEQ ID NO: 171240 - protein, 9 aa, Homo Sapiens
GNHTLTLAL

SEQ ID NO: 171241 - protein, 9 aa, Homo Sapiens
DDHFSVYIT

SEQ ID NO: 171242 - protein, 9 aa, Homo Sapiens
STVCAMDSL

SEQ ID NO: 171243 - protein, 9 aa, Homo Sapiens
AWSLTLSTR

SEQ ID NO: 171244 - protein, 9 aa, Homo Sapiens
QSVTTKKYP

SEQ ID NO: 171245 - protein, 9 aa, Homo Sapiens
GGWPGWRWR

SEQ ID NO: 171246 - protein, 9 aa, Homo Sapiens
GQGPSFEEL

SEQ ID NO: 171247 - protein, 9 aa, Homo Sapiens
ICLYTFLRE

SEQ ID NO: 171248 - protein, 9 aa, Homo Sapiens
ETSQPPDCR

SEQ ID NO: 171249 - protein, 9 aa, Homo Sapiens
EHSFRIHFS

SEQ ID NO: 171250 - protein, 9 aa, Homo Sapiens
LRWAASGGS

SEQ ID NO: 171251 - protein, 9 aa, Homo Sapiens
AAIVLGLRL

SEQ ID NO: 171252 - protein, 9 aa, Homo Sapiens
AAAPTLPRA

SEQ ID NO: 171253 - protein, 9 aa, Homo Sapiens
RPGRTTPVN

SEQ ID NO: 171254 - protein, 9 aa, Homo Sapiens
LTQLLLNDN

SEQ ID NO: 171255 - protein, 9 aa, Homo Sapiens
PHPTAPVTV

SEQ ID NO: 171256 - protein, 9 aa, Homo Sapiens
SGWRCVRIT

SEQ ID NO: 171257 - protein, 9 aa, Homo Sapiens
HANLQRQVK

SEQ ID NO: 171258 - protein, 9 aa, Homo Sapiens
VRTVDADSG

SEQ ID NO: 171259 - protein, 9 aa, Homo Sapiens
CISMTTISR

SEQ ID NO: 171260 - protein, 9 aa, Homo Sapiens
NWLEDQWER

SEQ ID NO: 171261 - protein, 9 aa, Homo Sapiens
LTIRYWDLK

SEQ ID NO: 171262 - protein, 9 aa, Homo Sapiens
VRCPVPVSF

SEQ ID NO: 171263 - protein, 9 aa, Homo Sapiens
KSVEYFFLS

SEQ ID NO: 171264 - protein, 9 aa, Homo Sapiens
YVIYFDFWF

SEQ ID NO: 171265 - protein, 9 aa, Homo Sapiens
PRSQQPKCK

SEQ ID NO: 171266 - protein, 9 aa, Homo Sapiens
PWPPSFSAP

SEQ ID NO: 171267 - protein, 9 aa, Homo Sapiens
PCASCPGPR

SEQ ID NO: 171268 - protein, 9 aa, Homo Sapiens
RWPPSCPQG

SEQ ID NO: 171269 - protein, 9 aa, Homo Sapiens
LRGGAAGRV

SEQ ID NO: 171270 - protein, 9 aa, Homo Sapiens
GPTWGRPTA

SEQ ID NO: 171271 - protein, 9 aa, Homo Sapiens
TAAPYLTSW

SEQ ID NO: 171272 - protein, 9 aa, Homo Sapiens
SKKTLNWKR

SEQ ID NO: 171273 - protein, 9 aa, Homo Sapiens
KDFLATSSP

SEQ ID NO: 171274 - protein, 9 aa, Homo Sapiens
ALSGSNIGR

SEQ ID NO: 171275 - protein, 9 aa, Homo Sapiens
GRRVTQALQ

SEQ ID NO: 171276 - protein, 9 aa, Homo Sapiens
KTWYLLAVD

SEQ ID NO: 171277 - protein, 9 aa, Homo Sapiens
ASATFPMSV

SEQ ID NO: 171278 - protein, 9 aa, Homo Sapiens
TVGFPLFLR

SEQ ID NO: 171279 - protein, 9 aa, Homo Sapiens
VHHVEEAQR

SEQ ID NO: 171280 - protein, 9 aa, Homo Sapiens
KKGNAKKAL

SEQ ID NO: 171281 - protein, 9 aa, Homo Sapiens
TALLKITGR

SEQ ID NO: 171282 - protein, 9 aa, Homo Sapiens
GPPSPLPSR

SEQ ID NO: 171283 - protein, 9 aa, Homo Sapiens
FSGVLCAYF

SEQ ID NO: 171284 - protein, 9 aa, Homo Sapiens
GQIQSLQQA

SEQ ID NO: 171285 - protein, 9 aa, Homo Sapiens
HSDMPEEMC

SEQ ID NO: 171286 - protein, 9 aa, Homo Sapiens
TIRTYQVYN

SEQ ID NO: 171287 - protein, 9 aa, Homo Sapiens
NLTLTAGSK

SEQ ID NO: 171288 - protein, 9 aa, Homo Sapiens
QLPFLVAAA

SEQ ID NO: 171289 - protein, 9 aa, Homo Sapiens
RDDILGGHF

SEQ ID NO: 171290 - protein, 9 aa, Homo Sapiens
PCWAPAPGS

SEQ ID NO: 171291 - protein, 9 aa, Homo Sapiens
TYWFFFLFF

SEQ ID NO: 171292 - protein, 9 aa, Homo Sapiens
GPGPLLPPR

SEQ ID NO: 171293 - protein, 9 aa, Homo Sapiens
LLYAQGLGN

SEQ ID NO: 171294 - protein, 9 aa, Homo Sapiens
LLEKKGRRV

SEQ ID NO: 171295 - protein, 9 aa, Homo Sapiens
SLQERGGVA

SEQ ID NO: 171296 - protein, 9 aa, Homo Sapiens
ELQVISCLH

SEQ ID NO: 171297 - protein, 9 aa, Homo Sapiens
GPSRAHCPA

SEQ ID NO: 171298 - protein, 9 aa, Homo Sapiens
TLEGCSIDT

SEQ ID NO: 171299 - protein, 9 aa, Homo Sapiens
VGKLGLTRS

SEQ ID NO: 171300 - protein, 9 aa, Homo Sapiens
PTAAVGAAP

SEQ ID NO: 171301 - protein, 9 aa, Homo Sapiens
YSLHRPDEV

SEQ ID NO: 171302 - protein, 9 aa, Homo Sapiens
KISVLSFET

SEQ ID NO: 171303 - protein, 9 aa, Homo Sapiens
ITISNEWFC

SEQ ID NO: 171304 - protein, 9 aa, Homo Sapiens
PENGYMRPE

SEQ ID NO: 171305 - protein, 9 aa, Homo Sapiens
EYAVSSRRN

SEQ ID NO: 171306 - protein, 9 aa, Homo Sapiens
KWEEETTTE

SEQ ID NO: 171307 - protein, 9 aa, Homo Sapiens
CLQCAVGWG

SEQ ID NO: 171308 - protein, 9 aa, Homo Sapiens
VPYFERKLL

SEQ ID NO: 171309 - protein, 9 aa, Homo Sapiens
LLPKAPLQL

SEQ ID NO: 171310 - protein, 9 aa, Homo Sapiens
EQMDFHANL

SEQ ID NO: 171311 - protein, 9 aa, Homo Sapiens
CLACHLKYS

SEQ ID NO: 171312 - protein, 9 aa, Homo Sapiens
SPLPQTPTS

SEQ ID NO: 171313 - protein, 9 aa, Homo Sapiens
LVLLNGLHQ

SEQ ID NO: 171314 - protein, 9 aa, Homo Sapiens
DPLDRCYST

SEQ ID NO: 171315 - protein, 9 aa, Homo Sapiens
SFGLWFRLF

SEQ ID NO: 171316 - protein, 9 aa, Homo Sapiens
YGHNFCRGC

SEQ ID NO: 171317 - protein, 9 aa, Homo Sapiens
EFATHGVAV

SEQ ID NO: 171318 - protein, 9 aa, Homo Sapiens
NDVPCIFEA

SEQ ID NO: 171319 - protein, 9 aa, Homo Sapiens
TEFIFTGSP

SEQ ID NO: 171320 - protein, 9 aa, Homo Sapiens
TESEGAGES

SEQ ID NO: 171321 - protein, 9 aa, Homo Sapiens
VCMLADLSL

SEQ ID NO: 171322 - protein, 9 aa, Homo Sapiens
PDCGTRRLW

SEQ ID NO: 171323 - protein, 9 aa, Homo Sapiens
RGREGAQEL

SEQ ID NO: 171324 - protein, 9 aa, Homo Sapiens
ILWLITQQV

SEQ ID NO: 171325 - protein, 9 aa, Homo Sapiens
ATNSKKAMT

SEQ ID NO: 171326 - protein, 9 aa, Homo Sapiens
PQWYHVMVK

SEQ ID NO: 171327 - protein, 9 aa, Homo Sapiens
SVSGSFAES

SEQ ID NO: 171328 - protein, 9 aa, Homo Sapiens
HSSAAHRRE

SEQ ID NO: 171329 - protein, 9 aa, Homo Sapiens
QVSVTQNIT

SEQ ID NO: 171330 - protein, 9 aa, Homo Sapiens
LTKSMWSSP

SEQ ID NO: 171331 - protein, 9 aa, Homo Sapiens
ICAKQPGDI

SEQ ID NO: 171332 - protein, 9 aa, Homo Sapiens
PPEFTTSTF

SEQ ID NO: 171333 - protein, 9 aa, Homo Sapiens
SGWRTAVCT

SEQ ID NO: 171334 - protein, 9 aa, Homo Sapiens
GALVGARAA

SEQ ID NO: 171335 - protein, 9 aa, Homo Sapiens
EGFGPERED

SEQ ID NO: 171336 - protein, 9 aa, Homo Sapiens
LRHPLKSFF

SEQ ID NO: 171337 - protein, 9 aa, Homo Sapiens
VQSSGPEDN

SEQ ID NO: 171338 - protein, 9 aa, Homo Sapiens
LGGGFMVLY

SEQ ID NO: 171339 - protein, 9 aa, Homo Sapiens
PCRLYRTRA

SEQ ID NO: 171340 - protein, 9 aa, Homo Sapiens
RSSSCCPAS

SEQ ID NO: 171341 - protein, 9 aa, Homo Sapiens
QVLVVLSLI

SEQ ID NO: 171342 - protein, 9 aa, Homo Sapiens
QHQKAALWR

SEQ ID NO: 171343 - protein, 9 aa, Homo Sapiens
PPSFSAPCC

SEQ ID NO: 171344 - protein, 9 aa, Homo Sapiens
GRCNWSLWP

SEQ ID NO: 171345 - protein, 9 aa, Homo Sapiens
FLPVSLRAH

SEQ ID NO: 171346 - protein, 9 aa, Homo Sapiens
MDTYSGPPQ

SEQ ID NO: 171347 - protein, 9 aa, Homo Sapiens
VAFGSGKCG

SEQ ID NO: 171348 - protein, 9 aa, Homo Sapiens
VFSSCQLHQ

SEQ ID NO: 171349 - protein, 9 aa, Homo Sapiens
VTMATYPDG

SEQ ID NO: 171350 - protein, 9 aa, Homo Sapiens
RRSSRAPSS

SEQ ID NO: 171351 - protein, 9 aa, Homo Sapiens
DPKTEHGSQ

SEQ ID NO: 171352 - protein, 9 aa, Homo Sapiens
GLQDMGNTC

SEQ ID NO: 171353 - protein, 9 aa, Homo Sapiens
LLLKFSTGG

SEQ ID NO: 171354 - protein, 9 aa, Homo Sapiens
ARMASVNAA

SEQ ID NO: 171355 - protein, 9 aa, Homo Sapiens
LSTMNVPAG

SEQ ID NO: 171356 - protein, 9 aa, Homo Sapiens
RRPGPSRAH

SEQ ID NO: 171357 - protein, 9 aa, Homo Sapiens
GLGEPGCTQ

SEQ ID NO: 171358 - protein, 9 aa, Homo Sapiens
KGNIDAVIR

SEQ ID NO: 171359 - protein, 9 aa, Homo Sapiens
EGLLGSLSH

SEQ ID NO: 171360 - protein, 9 aa, Homo Sapiens
RAKARLVRY

SEQ ID NO: 171361 - protein, 9 aa, Homo Sapiens
CAKQPGDIC

SEQ ID NO: 171362 - protein, 9 aa, Homo Sapiens
CPWSPGHGA

SEQ ID NO: 171363 - protein, 9 aa, Homo Sapiens
ANGLLLAQK

SEQ ID NO: 171364 - protein, 9 aa, Homo Sapiens
SPWVQHTPP

SEQ ID NO: 171365 - protein, 9 aa, Homo Sapiens
THCARGGLS

SEQ ID NO: 171366 - protein, 9 aa, Homo Sapiens
GLLYLHQLP

SEQ ID NO: 171367 - protein, 9 aa, Homo Sapiens
GGGGWPGWR

SEQ ID NO: 171368 - protein, 9 aa, Homo Sapiens
WCKREILKF

SEQ ID NO: 171369 - protein, 9 aa, Homo Sapiens
APLQLVGLR

SEQ ID NO: 171370 - protein, 9 aa, Homo Sapiens
IGGGTPLSI

SEQ ID NO: 171371 - protein, 9 aa, Homo Sapiens
GGHSTDAHS

SEQ ID NO: 171372 - protein, 9 aa, Homo Sapiens
CPQGTLGHG

SEQ ID NO: 171373 - protein, 9 aa, Homo Sapiens
KEGCFIATV

SEQ ID NO: 171374 - protein, 9 aa, Homo Sapiens
VHALYEETE

SEQ ID NO: 171375 - protein, 9 aa, Homo Sapiens
LQQRAVEDY

SEQ ID NO: 171376 - protein, 9 aa, Homo Sapiens
FHDTFSGVL

SEQ ID NO: 171377 - protein, 9 aa, Homo Sapiens
VGLVDCPDD

SEQ ID NO: 171378 - protein, 9 aa, Homo Sapiens
VSPFPEVLV

SEQ ID NO: 171379 - protein, 9 aa, Homo Sapiens
GEPENGNRI

SEQ ID NO: 171380 - protein, 9 aa, Homo Sapiens
LPSVPSIPE

SEQ ID NO: 171381 - protein, 9 aa, Homo Sapiens
FHENAKAKT

SEQ ID NO: 171382 - protein, 9 aa, Homo Sapiens
AKKAYPSEK

SEQ ID NO: 171383 - protein, 9 aa, Homo Sapiens
RIRLQLLGL

SEQ ID NO: 171384 - protein, 9 aa, Homo Sapiens
APLGGQRSM

SEQ ID NO: 171385 - protein, 9 aa, Homo Sapiens
TRGQGPSFE

SEQ ID NO: 171386 - protein, 9 aa, Homo Sapiens
YRHMLMEDF

SEQ ID NO: 171387 - protein, 9 aa, Homo Sapiens
MLAWLLRTP

SEQ ID NO: 171388 - protein, 9 aa, Homo Sapiens
QGTFYYNRA

SEQ ID NO: 171389 - protein, 9 aa, Homo Sapiens
SASHEMDHI

SEQ ID NO: 171390 - protein, 9 aa, Homo Sapiens
VMMWMGGKT

SEQ ID NO: 171391 - protein, 9 aa, Homo Sapiens
DPKGQGEYT

SEQ ID NO: 171392 - protein, 9 aa, Homo Sapiens
VVGAPRPVR

SEQ ID NO: 171393 - protein, 9 aa, Homo Sapiens
DNDNWLEDQ

SEQ ID NO: 171394 - protein, 9 aa, Homo Sapiens
ISEKGFQQI

SEQ ID NO: 171395 - protein, 9 aa, Homo Sapiens
RRNVICQLL

SEQ ID NO: 171396 - protein, 9 aa, Homo Sapiens
IGGYDGHSR

SEQ ID NO: 171397 - protein, 9 aa, Homo Sapiens
HRRVGARSP

SEQ ID NO: 171398 - protein, 9 aa, Homo Sapiens
FHCKLQEDT

SEQ ID NO: 171399 - protein, 9 aa, Homo Sapiens
AKLIVYLQH

SEQ ID NO: 171400 - protein, 9 aa, Homo Sapiens
GHTAKIVTP

SEQ ID NO: 171401 - protein, 9 aa, Homo Sapiens
IVMLKRHLL

SEQ ID NO: 171402 - protein, 9 aa, Homo Sapiens
MVRRATASK

SEQ ID NO: 171403 - protein, 9 aa, Homo Sapiens
VRITSTGTR

SEQ ID NO: 171404 - protein, 9 aa, Homo Sapiens
TKNLYLLAF

SEQ ID NO: 171405 - protein, 9 aa, Homo Sapiens
MKTMRVHEV

SEQ ID NO: 171406 - protein, 9 aa, Homo Sapiens
AGKPPLAEP

SEQ ID NO: 171407 - protein, 9 aa, Homo Sapiens
AAVRVHHLL

SEQ ID NO: 171408 - protein, 9 aa, Homo Sapiens
ARPSPLNQS

SEQ ID NO: 171409 - protein, 9 aa, Homo Sapiens
TFSLDHGLK

SEQ ID NO: 171410 - protein, 9 aa, Homo Sapiens
EGRRRTVPG

SEQ ID NO: 171411 - protein, 9 aa, Homo Sapiens
PVPVSFENG

SEQ ID NO: 171412 - protein, 9 aa, Homo Sapiens
GHSRLSSVE

SEQ ID NO: 171413 - protein, 9 aa, Homo Sapiens
GNCIHRTWL

SEQ ID NO: 171414 - protein, 9 aa, Homo Sapiens
GTFYQGYLW

SEQ ID NO: 171415 - protein, 9 aa, Homo Sapiens
PSTGPARMA

SEQ ID NO: 171416 - protein, 9 aa, Homo Sapiens
RYAPNVQGA

SEQ ID NO: 171417 - protein, 9 aa, Homo Sapiens
SEGGPPRPT

SEQ ID NO: 171418 - protein, 9 aa, Homo Sapiens
IVVQRAEYR

SEQ ID NO: 171419 - protein, 9 aa, Homo Sapiens
CGKKHRPPG

SEQ ID NO: 171420 - protein, 9 aa, Homo Sapiens
SDQWYRAFI

SEQ ID NO: 171421 - protein, 9 aa, Homo Sapiens
INPESPVDT

SEQ ID NO: 171422 - protein, 9 aa, Homo Sapiens
IHGDSKVAN

SEQ ID NO: 171423 - protein, 9 aa, Homo Sapiens
NFVKKRRGC

SEQ ID NO: 171424 - protein, 9 aa, Homo Sapiens
VGDTPGTSN

SEQ ID NO: 171425 - protein, 9 aa, Homo Sapiens
QFMKLVGMS

SEQ ID NO: 171426 - protein, 9 aa, Homo Sapiens
DHVIATHQL

SEQ ID NO: 171427 - protein, 9 aa, Homo Sapiens
NITDTNTVP

SEQ ID NO: 171428 - protein, 9 aa, Homo Sapiens
EYRPAASEN

SEQ ID NO: 171429 - protein, 9 aa, Homo Sapiens
ISMTTISRA

SEQ ID NO: 171430 - protein, 9 aa, Homo Sapiens
IKKEDSTVN

SEQ ID NO: 171431 - protein, 9 aa, Homo Sapiens
PCTCPPVFS

SEQ ID NO: 171432 - protein, 9 aa, Homo Sapiens
RILADIVLA

SEQ ID NO: 171433 - protein, 9 aa, Homo Sapiens
HYSCTPRNY

SEQ ID NO: 171434 - protein, 9 aa, Homo Sapiens
GKKDSRMLK

SEQ ID NO: 171435 - protein, 9 aa, Homo Sapiens
EELQSPPIR

SEQ ID NO: 171436 - protein, 9 aa, Homo Sapiens
TSSTNGCQP

SEQ ID NO: 171437 - protein, 9 aa, Homo Sapiens
ERTSLQQKL

SEQ ID NO: 171438 - protein, 9 aa, Homo Sapiens
SIGVQNCKP

SEQ ID NO: 171439 - protein, 9 aa, Homo Sapiens
HGVCTDPKG

SEQ ID NO: 171440 - protein, 9 aa, Homo Sapiens
PGFAISVPY

SEQ ID NO: 171441 - protein, 9 aa, Homo Sapiens
RRLSHRGLA

SEQ ID NO: 171442 - protein, 9 aa, Homo Sapiens
SWRRLSHRG

SEQ ID NO: 171443 - protein, 9 aa, Homo Sapiens
MVMMWMGGK

SEQ ID NO: 171444 - protein, 9 aa, Homo Sapiens
SPPELKWPR

SEQ ID NO: 171445 - protein, 9 aa, Homo Sapiens
TEVQRGQQQ

SEQ ID NO: 171446 - protein, 9 aa, Homo Sapiens
PTWPTQTWT

SEQ ID NO: 171447 - protein, 9 aa, Homo Sapiens
DHGLKGTST

SEQ ID NO: 171448 - protein, 9 aa, Homo Sapiens
STAKAARRF

SEQ ID NO: 171449 - protein, 9 aa, Homo Sapiens
SPSAHSSAS

SEQ ID NO: 171450 - protein, 9 aa, Homo Sapiens
QVDGSIGQS

SEQ ID NO: 171451 - protein, 9 aa, Homo Sapiens
GATIHNITK

SEQ ID NO: 171452 - protein, 9 aa, Homo Sapiens
ESWQRLPPA

SEQ ID NO: 171453 - protein, 9 aa, Homo Sapiens
WLYPEISYC

SEQ ID NO: 171454 - protein, 9 aa, Homo Sapiens
KGLNDALLR

SEQ ID NO: 171455 - protein, 9 aa, Homo Sapiens
FWPQITKVH

SEQ ID NO: 171456 - protein, 9 aa, Homo Sapiens
ALFLTTTSR

SEQ ID NO: 171457 - protein, 9 aa, Homo Sapiens
WRAGDRTRT

SEQ ID NO: 171458 - protein, 9 aa, Homo Sapiens
CAERLRHTY

SEQ ID NO: 171459 - protein, 9 aa, Homo Sapiens
SRAGTGCSS

SEQ ID NO: 171460 - protein, 9 aa, Homo Sapiens
LGPLDPPVN

SEQ ID NO: 171461 - protein, 9 aa, Homo Sapiens
PTTLSSVIF

SEQ ID NO: 171462 - protein, 9 aa, Homo Sapiens
LRVEEERDV

SEQ ID NO: 171463 - protein, 9 aa, Homo Sapiens
QVPLLPKAP

SEQ ID NO: 171464 - protein, 9 aa, Homo Sapiens
TATTIANRS

SEQ ID NO: 171465 - protein, 9 aa, Homo Sapiens
ATQDWNMLE

SEQ ID NO: 171466 - protein, 9 aa, Homo Sapiens
QHSAPVRGP

SEQ ID NO: 171467 - protein, 9 aa, Homo Sapiens
GLVDCPDDD

SEQ ID NO: 171468 - protein, 9 aa, Homo Sapiens
PGPLPASHP

SEQ ID NO: 171469 - protein, 9 aa, Homo Sapiens
AAPTLTPAQ

SEQ ID NO: 171470 - protein, 9 aa, Homo Sapiens
RCPVPVSFE

SEQ ID NO: 171471 - protein, 9 aa, Homo Sapiens
PPAPESGPP

SEQ ID NO: 171472 - protein, 9 aa, Homo Sapiens
RSHLLLPPF

SEQ ID NO: 171473 - protein, 9 aa, Homo Sapiens
VEVHQKKSQ

SEQ ID NO: 171474 - protein, 9 aa, Homo Sapiens
RAIRIVNAA

SEQ ID NO: 171475 - protein, 9 aa, Homo Sapiens
YHPALHALL

SEQ ID NO: 171476 - protein, 9 aa, Homo Sapiens
RARMSAGAA

SEQ ID NO: 171477 - protein, 9 aa, Homo Sapiens
PHPVVTTTT

SEQ ID NO: 171478 - protein, 9 aa, Homo Sapiens
EEIWKVNIT

SEQ ID NO: 171479 - protein, 9 aa, Homo Sapiens
GPHNANEDY

SEQ ID NO: 171480 - protein, 9 aa, Homo Sapiens
NTALNPILY

SEQ ID NO: 171481 - protein, 9 aa, Homo Sapiens
CGKAFLTQT

SEQ ID NO: 171482 - protein, 9 aa, Homo Sapiens
RLQLLGLVL

SEQ ID NO: 171483 - protein, 9 aa, Homo Sapiens
TPGPASTAA

SEQ ID NO: 171484 - protein, 9 aa, Homo Sapiens
TPLKLAVKE

SEQ ID NO: 171485 - protein, 9 aa, Homo Sapiens
HSAGLSPGA

SEQ ID NO: 171486 - protein, 9 aa, Homo Sapiens
LGYKIDRQV

SEQ ID NO: 171487 - protein, 9 aa, Homo Sapiens
LEGDLQHAL

SEQ ID NO: 171488 - protein, 9 aa, Homo Sapiens
VPPTTAASS

SEQ ID NO: 171489 - protein, 9 aa, Homo Sapiens
ILESANARV

SEQ ID NO: 171490 - protein, 9 aa, Homo Sapiens
GLELSLSPS

SEQ ID NO: 171491 - protein, 9 aa, Homo Sapiens
LESAPVARC

SEQ ID NO: 171492 - protein, 9 aa, Homo Sapiens
ALGRRQVPL

SEQ ID NO: 171493 - protein, 9 aa, Homo Sapiens
APSSRRSRP

SEQ ID NO: 171494 - protein, 9 aa, Homo Sapiens
KTPEEVLKN

SEQ ID NO: 171495 - protein, 9 aa, Homo Sapiens
PTWEHLYCV

SEQ ID NO: 171496 - protein, 9 aa, Homo Sapiens
FSVATACVA

SEQ ID NO: 171497 - protein, 9 aa, Homo Sapiens
LACLHLPSP

SEQ ID NO: 171498 - protein, 9 aa, Homo Sapiens
VGSWPWVPQ

SEQ ID NO: 171499 - protein, 9 aa, Homo Sapiens
PHTSINEHI

SEQ ID NO: 171500 - protein, 9 aa, Homo Sapiens
LVKLPHPTA

SEQ ID NO: 171501 - protein, 9 aa, Homo Sapiens
AIICFILLI

SEQ ID NO: 171502 - protein, 9 aa, Homo Sapiens
ACLNGGYEV

SEQ ID NO: 171503 - protein, 9 aa, Homo Sapiens
NSDISACTY

SEQ ID NO: 171504 - protein, 9 aa, Homo Sapiens
KVGSWPWVP

SEQ ID NO: 171505 - protein, 9 aa, Homo Sapiens
ESHVTMLQR

SEQ ID NO: 171506 - protein, 9 aa, Homo Sapiens
GYKIDRQVS

SEQ ID NO: 171507 - protein, 9 aa, Homo Sapiens
MLAHKLNLG

SEQ ID NO: 171508 - protein, 9 aa, Homo Sapiens
IGRVGVCKV

SEQ ID NO: 171509 - protein, 9 aa, Homo Sapiens
HRKAKELQQ

SEQ ID NO: 171510 - protein, 9 aa, Homo Sapiens
LREIISMDG

SEQ ID NO: 171511 - protein, 9 aa, Homo Sapiens
HLQGRMTYV

SEQ ID NO: 171512 - protein, 9 aa, Homo Sapiens
LRVPRHRLQ

SEQ ID NO: 171513 - protein, 9 aa, Homo Sapiens
GFGPEREDI

SEQ ID NO: 171514 - protein, 9 aa, Homo Sapiens
GAQELAGQW

SEQ ID NO: 171515 - protein, 9 aa, Homo Sapiens
LLLGQGWED

SEQ ID NO: 171516 - protein, 9 aa, Homo Sapiens
TAYSSHSSA

SEQ ID NO: 171517 - protein, 9 aa, Homo Sapiens
DEHASPASP

SEQ ID NO: 171518 - protein, 9 aa, Homo Sapiens
GEIHGDIFM

SEQ ID NO: 171519 - protein, 9 aa, Homo Sapiens
KASNTIAPS

SEQ ID NO: 171520 - protein, 9 aa, Homo Sapiens
GTKFSASLV

SEQ ID NO: 171521 - protein, 9 aa, Homo Sapiens
IFLAQTQDQ

SEQ ID NO: 171522 - protein, 9 aa, Homo Sapiens
AWGQMQTTS

SEQ ID NO: 171523 - protein, 9 aa, Homo Sapiens
ASLRPHTFK

SEQ ID NO: 171524 - protein, 9 aa, Homo Sapiens
NLTAKRETS

SEQ ID NO: 171525 - protein, 9 aa, Homo Sapiens
LDFSPYWMK

SEQ ID NO: 171526 - protein, 9 aa, Homo Sapiens
DGEHSTFED

SEQ ID NO: 171527 - protein, 9 aa, Homo Sapiens
NTPKNVLWR

SEQ ID NO: 171528 - protein, 9 aa, Homo Sapiens
ELRPASARS

SEQ ID NO: 171529 - protein, 9 aa, Homo Sapiens
FLTCRLMQT

SEQ ID NO: 171530 - protein, 9 aa, Homo Sapiens
LSSVIFPLV

SEQ ID NO: 171531 - protein, 9 aa, Homo Sapiens
RRGRCINLW

SEQ ID NO: 171532 - protein, 9 aa, Homo Sapiens
SLHFLLILC

SEQ ID NO: 171533 - protein, 9 aa, Homo Sapiens
SFPGAPQPA

SEQ ID NO: 171534 - protein, 9 aa, Homo Sapiens
LHENDLSIM

SEQ ID NO: 171535 - protein, 9 aa, Homo Sapiens
ITDDLDVGD

SEQ ID NO: 171536 - protein, 9 aa, Homo Sapiens
RSPTHLFHT

SEQ ID NO: 171537 - protein, 9 aa, Homo Sapiens
RIKLRMNNT

SEQ ID NO: 171538 - protein, 9 aa, Homo Sapiens
LTTFHALCV

SEQ ID NO: 171539 - protein, 9 aa, Homo Sapiens
EVDDMAGNE

SEQ ID NO: 171540 - protein, 9 aa, Homo Sapiens
KAGNVSKDE

SEQ ID NO: 171541 - protein, 9 aa, Homo Sapiens
PSTPACSCS

SEQ ID NO: 171542 - protein, 9 aa, Homo Sapiens
IFCCRKKHR

SEQ ID NO: 171543 - protein, 9 aa, Homo Sapiens
YWFFFLFFF

SEQ ID NO: 171544 - protein, 9 aa, Homo Sapiens
EQLNRMKKH

SEQ ID NO: 171545 - protein, 9 aa, Homo Sapiens
ELSTLHAHY

SEQ ID NO: 171546 - protein, 9 aa, Homo Sapiens
NIYRKSGTH

SEQ ID NO: 171547 - protein, 9 aa, Homo Sapiens
SLTHHRNRE

SEQ ID NO: 171548 - protein, 9 aa, Homo Sapiens
RPLHRTTNP

SEQ ID NO: 171549 - protein, 9 aa, Homo Sapiens
TKKYQDSDG

SEQ ID NO: 171550 - protein, 9 aa, Homo Sapiens
SDGTGPGLG

SEQ ID NO: 171551 - protein, 9 aa, Homo Sapiens
TPLCTPYCD

SEQ ID NO: 171552 - protein, 9 aa, Homo Sapiens
LLNTQQPLT

SEQ ID NO: 171553 - protein, 9 aa, Homo Sapiens
LHNIDCLLS

SEQ ID NO: 171554 - protein, 9 aa, Homo Sapiens
FRYKQQLTT

SEQ ID NO: 171555 - protein, 9 aa, Homo Sapiens
QERTSLQQK

SEQ ID NO: 171556 - protein, 9 aa, Homo Sapiens
AVAEASKEH

SEQ ID NO: 171557 - protein, 9 aa, Homo Sapiens
SEMLKKRSS

SEQ ID NO: 171558 - protein, 9 aa, Homo Sapiens
PKCPPKYPP

SEQ ID NO: 171559 - protein, 9 aa, Homo Sapiens
ESVQDLKRE

SEQ ID NO: 171560 - protein, 9 aa, Homo Sapiens
ILVWGPQHG

SEQ ID NO: 171561 - protein, 9 aa, Homo Sapiens
LENLEAVSQ

SEQ ID NO: 171562 - protein, 9 aa, Homo Sapiens
LHFVGDSEM

SEQ ID NO: 171563 - protein, 9 aa, Homo Sapiens
PGDKKSGTP

SEQ ID NO: 171564 - protein, 9 aa, Homo Sapiens
VCTAECKIL

SEQ ID NO: 171565 - protein, 9 aa, Homo Sapiens
NTIQTYVPW

SEQ ID NO: 171566 - protein, 9 aa, Homo Sapiens
RRVALERYL

SEQ ID NO: 171567 - protein, 9 aa, Homo Sapiens
ETFRGTSAL

SEQ ID NO: 171568 - protein, 9 aa, Homo Sapiens
QDWNLALGK

SEQ ID NO: 171569 - protein, 9 aa, Homo Sapiens
SLSGDSSAE

SEQ ID NO: 171570 - protein, 9 aa, Homo Sapiens
RHVGTKFSA

SEQ ID NO: 171571 - protein, 9 aa, Homo Sapiens
GEEVATVAA

SEQ ID NO: 171572 - protein, 9 aa, Homo Sapiens
AWADVRHES

SEQ ID NO: 171573 - protein, 9 aa, Homo Sapiens
AFLTQTHLV

SEQ ID NO: 171574 - protein, 9 aa, Homo Sapiens
LKRGEQLLE

SEQ ID NO: 171575 - protein, 9 aa, Homo Sapiens
KARFHSGLY

SEQ ID NO: 171576 - protein, 9 aa, Homo Sapiens
NSPPTPAPL

SEQ ID NO: 171577 - protein, 9 aa, Homo Sapiens
FGCRRVIIK

SEQ ID NO: 171578 - protein, 9 aa, Homo Sapiens
AYLNHHVPR

SEQ ID NO: 171579 - protein, 9 aa, Homo Sapiens
FRQSSVLIQ

SEQ ID NO: 171580 - protein, 9 aa, Homo Sapiens
TPGEKMTEE

SEQ ID NO: 171581 - protein, 9 aa, Homo Sapiens
SNPVQEFHF

SEQ ID NO: 171582 - protein, 9 aa, Homo Sapiens
LTIDSNLSI

SEQ ID NO: 171583 - protein, 9 aa, Homo Sapiens
LLITLQGQP

SEQ ID NO: 171584 - protein, 9 aa, Homo Sapiens
WETPVVCHD

SEQ ID NO: 171585 - protein, 9 aa, Homo Sapiens
HWGCCPSAW

SEQ ID NO: 171586 - protein, 9 aa, Homo Sapiens
FNGGSRGKG

SEQ ID NO: 171587 - protein, 9 aa, Homo Sapiens
VTKWKKMNF

SEQ ID NO: 171588 - protein, 9 aa, Homo Sapiens
LEALLQDLC

SEQ ID NO: 171589 - protein, 9 aa, Homo Sapiens
GMSHHVRPF

SEQ ID NO: 171590 - protein, 9 aa, Homo Sapiens
CANVAPAPT

SEQ ID NO: 171591 - protein, 9 aa, Homo Sapiens
TRDTPPEAR

SEQ ID NO: 171592 - protein, 9 aa, Homo Sapiens
SSGAVATTM

SEQ ID NO: 171593 - protein, 9 aa, Homo Sapiens
AKARLVRYM

SEQ ID NO: 171594 - protein, 9 aa, Homo Sapiens
RYIQESTER

SEQ ID NO: 171595 - protein, 9 aa, Homo Sapiens
EEPGEEVAT

SEQ ID NO: 171596 - protein, 9 aa, Homo Sapiens
ALRMMRRQW

SEQ ID NO: 171597 - protein, 9 aa, Homo Sapiens
KEDLLYLRT

SEQ ID NO: 171598 - protein, 9 aa, Homo Sapiens
CPTATAACP

SEQ ID NO: 171599 - protein, 9 aa, Homo Sapiens
QLLVGGEVD

SEQ ID NO: 171600 - protein, 9 aa, Homo Sapiens
TLAAPSVTP

SEQ ID NO: 171601 - protein, 9 aa, Homo Sapiens
QMVPEFAAI

SEQ ID NO: 171602 - protein, 9 aa, Homo Sapiens
KSPVFHFLR

SEQ ID NO: 171603 - protein, 9 aa, Homo Sapiens
EKTTPDCQI

SEQ ID NO: 171604 - protein, 9 aa, Homo Sapiens
KQKKTATKI

SEQ ID NO: 171605 - protein, 9 aa, Homo Sapiens
RGRGRVGKL

SEQ ID NO: 171606 - protein, 9 aa, Homo Sapiens
ANRKQKTDR

SEQ ID NO: 171607 - protein, 9 aa, Homo Sapiens
HLYYYWERD

SEQ ID NO: 171608 - protein, 9 aa, Homo Sapiens
IEIVAYVTE

SEQ ID NO: 171609 - protein, 9 aa, Homo Sapiens
SIVLEQMRY

SEQ ID NO: 171610 - protein, 9 aa, Homo Sapiens
TVDNEVQSS

SEQ ID NO: 171611 - protein, 9 aa, Homo Sapiens
VVSLGTEGF

SEQ ID NO: 171612 - protein, 9 aa, Homo Sapiens
VIATHQLEW

SEQ ID NO: 171613 - protein, 9 aa, Homo Sapiens
AFKERPTKA

SEQ ID NO: 171614 - protein, 9 aa, Homo Sapiens
LVWGPQHGH

SEQ ID NO: 171615 - protein, 9 aa, Homo Sapiens
RATASKLGE

SEQ ID NO: 171616 - protein, 9 aa, Homo Sapiens
KRFHSTFDA

SEQ ID NO: 171617 - protein, 9 aa, Homo Sapiens
NLEAVSQLL

SEQ ID NO: 171618 - protein, 9 aa, Homo Sapiens
RLFTRSLTN

SEQ ID NO: 171619 - protein, 9 aa, Homo Sapiens
FQQGTQQMY

SEQ ID NO: 171620 - protein, 9 aa, Homo Sapiens
YKIDRQVSV

SEQ ID NO: 171621 - protein, 9 aa, Homo Sapiens
NASKKTLNS

SEQ ID NO: 171622 - protein, 9 aa, Homo Sapiens
STALSRVVL

SEQ ID NO: 171623 - protein, 9 aa, Homo Sapiens
GRDIRIKYG

SEQ ID NO: 171624 - protein, 9 aa, Homo Sapiens
GLYLREDDA

SEQ ID NO: 171625 - protein, 9 aa, Homo Sapiens
DPPVNYVPQ

SEQ ID NO: 171626 - protein, 9 aa, Homo Sapiens
DDATWERMW

SEQ ID NO: 171627 - protein, 9 aa, Homo Sapiens
VLRGMGARP

SEQ ID NO: 171628 - protein, 9 aa, Homo Sapiens
ASPMSLSWG

SEQ ID NO: 171629 - protein, 9 aa, Homo Sapiens
AASGISSIR

SEQ ID NO: 171630 - protein, 9 aa, Homo Sapiens
IREVLAKQG

SEQ ID NO: 171631 - protein, 9 aa, Homo Sapiens
QVVKQKKTA

SEQ ID NO: 171632 - protein, 9 aa, Homo Sapiens
QWAQPPFRC

SEQ ID NO: 171633 - protein, 9 aa, Homo Sapiens
GSFLQGLLG

SEQ ID NO: 171634 - protein, 9 aa, Homo Sapiens
PMSLSWGTA

SEQ ID NO: 171635 - protein, 9 aa, Homo Sapiens
SPLQQEAPA

SEQ ID NO: 171636 - protein, 9 aa, Homo Sapiens
RRPCASCPG

SEQ ID NO: 171637 - protein, 9 aa, Homo Sapiens
VPVTGSSPL

SEQ ID NO: 171638 - protein, 9 aa, Homo Sapiens
RACLWASLV

SEQ ID NO: 171639 - protein, 9 aa, Homo Sapiens
TPATLTLAV

SEQ ID NO: 171640 - protein, 9 aa, Homo Sapiens
QMACQGLGE

SEQ ID NO: 171641 - protein, 9 aa, Homo Sapiens
HPTAPVTVK

SEQ ID NO: 171642 - protein, 9 aa, Homo Sapiens
NDYFSPNRD

SEQ ID NO: 171643 - protein, 9 aa, Homo Sapiens
SSDASTLST

SEQ ID NO: 171644 - protein, 9 aa, Homo Sapiens
LVLARALVL

SEQ ID NO: 171645 - protein, 9 aa, Homo Sapiens
PTILWLMGW

SEQ ID NO: 171646 - protein, 9 aa, Homo Sapiens
TVQNYLFWH

SEQ ID NO: 171647 - protein, 9 aa, Homo Sapiens
HTLTSLHLQ

SEQ ID NO: 171648 - protein, 9 aa, Homo Sapiens
DFCSLDAHL

SEQ ID NO: 171649 - protein, 9 aa, Homo Sapiens
GEHNKHLDD

SEQ ID NO: 171650 - protein, 9 aa, Homo Sapiens
SLCRQPPLP

SEQ ID NO: 171651 - protein, 9 aa, Homo Sapiens
EQINNLQRV

SEQ ID NO: 171652 - protein, 9 aa, Homo Sapiens
TAEGPAARA

SEQ ID NO: 171653 - protein, 9 aa, Homo Sapiens
PWLAPAALC

SEQ ID NO: 171654 - protein, 9 aa, Homo Sapiens
PHNANEDYR

SEQ ID NO: 171655 - protein, 9 aa, Homo Sapiens
SSSQFSDPW

SEQ ID NO: 171656 - protein, 9 aa, Homo Sapiens
GGAICHMYR

SEQ ID NO: 171657 - protein, 9 aa, Homo Sapiens
FARKWKKGK

SEQ ID NO: 171658 - protein, 9 aa, Homo Sapiens
LPFLHENDL

SEQ ID NO: 171659 - protein, 9 aa, Homo Sapiens
AFKKSKKSS

SEQ ID NO: 171660 - protein, 9 aa, Homo Sapiens
TLICIVVTR

SEQ ID NO: 171661 - protein, 9 aa, Homo Sapiens
HSTRGLLLS

SEQ ID NO: 171662 - protein, 9 aa, Homo Sapiens
LAASFAVSS

SEQ ID NO: 171663 - protein, 9 aa, Homo Sapiens
ETGVVAAME

SEQ ID NO: 171664 - protein, 9 aa, Homo Sapiens
RTRSRTWEA

SEQ ID NO: 171665 - protein, 9 aa, Homo Sapiens
LQRATVIGG

SEQ ID NO: 171666 - protein, 9 aa, Homo Sapiens
KPFPTRGRS

SEQ ID NO: 171667 - protein, 9 aa, Homo Sapiens
VFLVVFLYM

SEQ ID NO: 171668 - protein, 9 aa, Homo Sapiens
IGIMPDHIH

SEQ ID NO: 171669 - protein, 9 aa, Homo Sapiens
SQKLCLLLV

SEQ ID NO: 171670 - protein, 9 aa, Homo Sapiens
VVTISCVGF

SEQ ID NO: 171671 - protein, 9 aa, Homo Sapiens
RGKKLVSHL

SEQ ID NO: 171672 - protein, 9 aa, Homo Sapiens
GGRVAVKKA

SEQ ID NO: 171673 - protein, 9 aa, Homo Sapiens
GKCTVCKEG

SEQ ID NO: 171674 - protein, 9 aa, Homo Sapiens
EVSKKTHTI

SEQ ID NO: 171675 - protein, 9 aa, Homo Sapiens
GEPWRAGFQ

SEQ ID NO: 171676 - protein, 9 aa, Homo Sapiens
PAGWMRRWR

SEQ ID NO: 171677 - protein, 9 aa, Homo Sapiens
FFLGLQWGR

SEQ ID NO: 171678 - protein, 9 aa, Homo Sapiens
IHRTWLCDR

SEQ ID NO: 171679 - protein, 9 aa, Homo Sapiens
AERELEGGW

SEQ ID NO: 171680 - protein, 9 aa, Homo Sapiens
LDALLEHTQ

SEQ ID NO: 171681 - protein, 9 aa, Homo Sapiens
RPHQCRHFR

SEQ ID NO: 171682 - protein, 9 aa, Homo Sapiens
QKKMTSIKT

SEQ ID NO: 171683 - protein, 9 aa, Homo Sapiens
GPPDRWVQV

SEQ ID NO: 171684 - protein, 9 aa, Homo Sapiens
NRDFKVTWS

SEQ ID NO: 171685 - protein, 9 aa, Homo Sapiens
GVGSGLQGC

SEQ ID NO: 171686 - protein, 9 aa, Homo Sapiens
SHRNVICQL

SEQ ID NO: 171687 - protein, 9 aa, Homo Sapiens
WWPSWSPAA

SEQ ID NO: 171688 - protein, 9 aa, Homo Sapiens
ATKDVGAIA

SEQ ID NO: 171689 - protein, 9 aa, Homo Sapiens
AFKENRETS

SEQ ID NO: 171690 - protein, 9 aa, Homo Sapiens
QYSHYFCEA

SEQ ID NO: 171691 - protein, 9 aa, Homo Sapiens
SWYSHQKKL

SEQ ID NO: 171692 - protein, 9 aa, Homo Sapiens
DNWLEDQWE

SEQ ID NO: 171693 - protein, 9 aa, Homo Sapiens
PAHSPASAR

SEQ ID NO: 171694 - protein, 9 aa, Homo Sapiens
QTSATITNA

SEQ ID NO: 171695 - protein, 9 aa, Homo Sapiens
QTWTRLPRR

SEQ ID NO: 171696 - protein, 9 aa, Homo Sapiens
SRLFAPLGP

SEQ ID NO: 171697 - protein, 9 aa, Homo Sapiens
VPAFLNCWL

SEQ ID NO: 171698 - protein, 9 aa, Homo Sapiens
EARLVSKAR

SEQ ID NO: 171699 - protein, 9 aa, Homo Sapiens
TQTHLVGHQ

SEQ ID NO: 171700 - protein, 9 aa, Homo Sapiens
GLWRYPRYA

SEQ ID NO: 171701 - protein, 9 aa, Homo Sapiens
QATKDVGAI

SEQ ID NO: 171702 - protein, 9 aa, Homo Sapiens
VPPPLTQPP

SEQ ID NO: 171703 - protein, 9 aa, Homo Sapiens
RCNWSLWPR

SEQ ID NO: 171704 - protein, 9 aa, Homo Sapiens
ARAPDAFVD

SEQ ID NO: 171705 - protein, 9 aa, Homo Sapiens
VGDCCDNCP

SEQ ID NO: 171706 - protein, 9 aa, Homo Sapiens
NARLYNRKT

SEQ ID NO: 171707 - protein, 9 aa, Homo Sapiens
SYEESDSCA

SEQ ID NO: 171708 - protein, 9 aa, Homo Sapiens
GAQECRLVG

SEQ ID NO: 171709 - protein, 9 aa, Homo Sapiens
SLPGPAALQ

SEQ ID NO: 171710 - protein, 9 aa, Homo Sapiens
EGRPVSGHM

SEQ ID NO: 171711 - protein, 9 aa, Homo Sapiens
LGPTRPLHR

SEQ ID NO: 171712 - protein, 9 aa, Homo Sapiens
HARAQAVTL

SEQ ID NO: 171713 - protein, 9 aa, Homo Sapiens
GMAIVGNYT

SEQ ID NO: 171714 - protein, 9 aa, Homo Sapiens
RGIRQNTHI

SEQ ID NO: 171715 - protein, 9 aa, Homo Sapiens
WLYHPALHA

SEQ ID NO: 171716 - protein, 9 aa, Homo Sapiens
PGALRHPRG

SEQ ID NO: 171717 - protein, 9 aa, Homo Sapiens
VILGCMVEP

SEQ ID NO: 171718 - protein, 9 aa, Homo Sapiens
SSWPNWGAI

SEQ ID NO: 171719 - protein, 9 aa, Homo Sapiens
GRSEGGRKS

SEQ ID NO: 171720 - protein, 9 aa, Homo Sapiens
VGLLPPQLP

SEQ ID NO: 171721 - protein, 9 aa, Homo Sapiens
SRSHLDFSP

SEQ ID NO: 171722 - protein, 9 aa, Homo Sapiens
EVQNILDVH

SEQ ID NO: 171723 - protein, 9 aa, Homo Sapiens
LDGEEQAVT

SEQ ID NO: 171724 - protein, 9 aa, Homo Sapiens
FLCDLPCGF

SEQ ID NO: 171725 - protein, 9 aa, Homo Sapiens
TINLTAKRE

SEQ ID NO: 171726 - protein, 9 aa, Homo Sapiens
CPQASAWPS

SEQ ID NO: 171727 - protein, 9 aa, Homo Sapiens
AKKMQKRRA

SEQ ID NO: 171728 - protein, 9 aa, Homo Sapiens
VSMRTSDSG

SEQ ID NO: 171729 - protein, 9 aa, Homo Sapiens
MAPTLTDAA

SEQ ID NO: 171730 - protein, 9 aa, Homo Sapiens
VDFTAASGI

SEQ ID NO: 171731 - protein, 9 aa, Homo Sapiens
LLALFRQGL

SEQ ID NO: 171732 - protein, 9 aa, Homo Sapiens
GVPGPGAAR

SEQ ID NO: 171733 - protein, 9 aa, Homo Sapiens
SSPLFRSLW

SEQ ID NO: 171734 - protein, 9 aa, Homo Sapiens
HTGVGSGLQ

SEQ ID NO: 171735 - protein, 9 aa, Homo Sapiens
VLSTIFTSS

SEQ ID NO: 171736 - protein, 9 aa, Homo Sapiens
PESGPPPSV

SEQ ID NO: 171737 - protein, 9 aa, Homo Sapiens
DDPAGQETT

SEQ ID NO: 171738 - protein, 9 aa, Homo Sapiens
GGGWPGWRW

SEQ ID NO: 171739 - protein, 9 aa, Homo Sapiens
CASLLSTLS

SEQ ID NO: 171740 - protein, 9 aa, Homo Sapiens
EAETLALVG

SEQ ID NO: 171741 - protein, 9 aa, Homo Sapiens
LKRFPASSS

SEQ ID NO: 171742 - protein, 9 aa, Homo Sapiens
VTSLQMPVL

SEQ ID NO: 171743 - protein, 9 aa, Homo Sapiens
DWPGWYKFS

SEQ ID NO: 171744 - protein, 9 aa, Homo Sapiens
LQKYPQAAA

SEQ ID NO: 171745 - protein, 9 aa, Homo Sapiens
AAWLPPRPR

SEQ ID NO: 171746 - protein, 9 aa, Homo Sapiens
GKGLTSAVT

SEQ ID NO: 171747 - protein, 9 aa, Homo Sapiens
ASLLPLLCI

SEQ ID NO: 171748 - protein, 9 aa, Homo Sapiens
RGEAEWHKL

SEQ ID NO: 171749 - protein, 9 aa, Homo Sapiens
AAPVPGEAH

SEQ ID NO: 171750 - protein, 9 aa, Homo Sapiens
HSHGMKKRA

SEQ ID NO: 171751 - protein, 9 aa, Homo Sapiens
GHPYCEVHY

SEQ ID NO: 171752 - protein, 9 aa, Homo Sapiens
RRDSIFRSS

SEQ ID NO: 171753 - protein, 9 aa, Homo Sapiens
PHMKIFLRQ

SEQ ID NO: 171754 - protein, 9 aa, Homo Sapiens
MRAYMQDPL

SEQ ID NO: 171755 - protein, 9 aa, Homo Sapiens
ADIVLAYVG

SEQ ID NO: 171756 - protein, 9 aa, Homo Sapiens
MSHHVRPFF

SEQ ID NO: 171757 - protein, 9 aa, Homo Sapiens
LAPGYLLPP

SEQ ID NO: 171758 - protein, 9 aa, Homo Sapiens
TTSPWPGGT

SEQ ID NO: 171759 - protein, 9 aa, Homo Sapiens
AAMAPSCCR

SEQ ID NO: 171760 - protein, 9 aa, Homo Sapiens
WPSTSPTRW

SEQ ID NO: 171761 - protein, 9 aa, Homo Sapiens
QTEVQRGQQ

SEQ ID NO: 171762 - protein, 9 aa, Homo Sapiens
WGSRAGTGC

SEQ ID NO: 171763 - protein, 9 aa, Homo Sapiens
FVTEGNCSN

SEQ ID NO: 171764 - protein, 9 aa, Homo Sapiens
PPVNYVPQQ

SEQ ID NO: 171765 - protein, 9 aa, Homo Sapiens
LHQLPVQLS

SEQ ID NO: 171766 - protein, 9 aa, Homo Sapiens
LSVCSCREG

SEQ ID NO: 171767 - protein, 9 aa, Homo Sapiens
LLLCRLELP

SEQ ID NO: 171768 - protein, 9 aa, Homo Sapiens
MPLMWQASW

SEQ ID NO: 171769 - protein, 9 aa, Homo Sapiens
ERAAWLPPR

SEQ ID NO: 171770 - protein, 9 aa, Homo Sapiens
KGMATVPKL

SEQ ID NO: 171771 - protein, 9 aa, Homo Sapiens
DTKNLYLLA

SEQ ID NO: 171772 - protein, 9 aa, Homo Sapiens
QLLLVIQLC

SEQ ID NO: 171773 - protein, 9 aa, Homo Sapiens
GATGVRTSE

SEQ ID NO: 171774 - protein, 9 aa, Homo Sapiens
QLRTGNLFH

SEQ ID NO: 171775 - protein, 9 aa, Homo Sapiens
DISKKSITT

SEQ ID NO: 171776 - protein, 9 aa, Homo Sapiens
ESCQMDESE

SEQ ID NO: 171777 - protein, 9 aa, Homo Sapiens
QQQINQQQP

SEQ ID NO: 171778 - protein, 9 aa, Homo Sapiens
NTELLSMTS

SEQ ID NO: 171779 - protein, 9 aa, Homo Sapiens
QPPVMVKTD

SEQ ID NO: 171780 - protein, 9 aa, Homo Sapiens
DVYEVVNPK

SEQ ID NO: 171781 - protein, 9 aa, Homo Sapiens
RPRSRRSSR

SEQ ID NO: 171782 - protein, 9 aa, Homo Sapiens
PTAWASLAS

SEQ ID NO: 171783 - protein, 9 aa, Homo Sapiens
PQHALVCLR

SEQ ID NO: 171784 - protein, 9 aa, Homo Sapiens
LTCRLMQTD

SEQ ID NO: 171785 - protein, 9 aa, Homo Sapiens
QGPAWSLTL

SEQ ID NO: 171786 - protein, 9 aa, Homo Sapiens
ATEQERTSL

SEQ ID NO: 171787 - protein, 9 aa, Homo Sapiens
DEVSVMPKK

SEQ ID NO: 171788 - protein, 9 aa, Homo Sapiens
FLVLLLGWL

SEQ ID NO: 171789 - protein, 9 aa, Homo Sapiens
GVREDEPAS

SEQ ID NO: 171790 - protein, 9 aa, Homo Sapiens
LRLQAETLV

SEQ ID NO: 171791 - protein, 9 aa, Homo Sapiens
VNYVPQQEI

SEQ ID NO: 171792 - protein, 9 aa, Homo Sapiens
DRSGTRDDP

SEQ ID NO: 171793 - protein, 9 aa, Homo Sapiens
KRPEQLPQH

SEQ ID NO: 171794 - protein, 9 aa, Homo Sapiens
WCESQPCQR

SEQ ID NO: 171795 - protein, 9 aa, Homo Sapiens
SQFRGGSVH

SEQ ID NO: 171796 - protein, 9 aa, Homo Sapiens
DYFSPNRDF

SEQ ID NO: 171797 - protein, 9 aa, Homo Sapiens
PWSPGEALP

SEQ ID NO: 171798 - protein, 9 aa, Homo Sapiens
NTGTILLIR

SEQ ID NO: 171799 - protein, 9 aa, Homo Sapiens
EMLKKRSSK

SEQ ID NO: 171800 - protein, 9 aa, Homo Sapiens
SVHAQLAES

SEQ ID NO: 171801 - protein, 9 aa, Homo Sapiens
RTSHRIRSR

SEQ ID NO: 171802 - protein, 9 aa, Homo Sapiens
KIWEQEEKR

SEQ ID NO: 171803 - protein, 9 aa, Homo Sapiens
PMHCPTATA

SEQ ID NO: 171804 - protein, 9 aa, Homo Sapiens
LGTLKRLLS

SEQ ID NO: 171805 - protein, 9 aa, Homo Sapiens
LLEELHLKM

SEQ ID NO: 171806 - protein, 9 aa, Homo Sapiens
IPDGGDSEQ

SEQ ID NO: 171807 - protein, 9 aa, Homo Sapiens
HLGAGSPAP

SEQ ID NO: 171808 - protein, 9 aa, Homo Sapiens
EREAKEKTE

SEQ ID NO: 171809 - protein, 9 aa, Homo Sapiens
FFSFFYFLW

SEQ ID NO: 171810 - protein, 9 aa, Homo Sapiens
LPGALLPHS

SEQ ID NO: 171811 - protein, 9 aa, Homo Sapiens
TITNANPLS

SEQ ID NO: 171812 - protein, 9 aa, Homo Sapiens
ILWLGLAAG

SEQ ID NO: 171813 - protein, 9 aa, Homo Sapiens
IQVGMGATV

SEQ ID NO: 171814 - protein, 9 aa, Homo Sapiens
TDDQASTRE

SEQ ID NO: 171815 - protein, 9 aa, Homo Sapiens
PILQLVLPT

SEQ ID NO: 171816 - protein, 9 aa, Homo Sapiens
GHEAETLAL

SEQ ID NO: 171817 - protein, 9 aa, Homo Sapiens
LHSTDMRPY

SEQ ID NO: 171818 - protein, 9 aa, Homo Sapiens
YICASNQNH

SEQ ID NO: 171819 - protein, 9 aa, Homo Sapiens
GVPPPPGVS

SEQ ID NO: 171820 - protein, 9 aa, Homo Sapiens
GDLQHALAQ

SEQ ID NO: 171821 - protein, 9 aa, Homo Sapiens
TEKPGICPG

SEQ ID NO: 171822 - protein, 9 aa, Homo Sapiens
HNITKQTQS

SEQ ID NO: 171823 - protein, 9 aa, Homo Sapiens
HLRAVLESW

SEQ ID NO: 171824 - protein, 9 aa, Homo Sapiens
IVYRYADDH

SEQ ID NO: 171825 - protein, 9 aa, Homo Sapiens
NNARLYNRK

SEQ ID NO: 171826 - protein, 9 aa, Homo Sapiens
MLDYRHMLM

SEQ ID NO: 171827 - protein, 9 aa, Homo Sapiens
DDVPVDMVA

SEQ ID NO: 171828 - protein, 9 aa, Homo Sapiens
RQIYFMACT

SEQ ID NO: 171829 - protein, 9 aa, Homo Sapiens
GGGACGTMV

SEQ ID NO: 171830 - protein, 9 aa, Homo Sapiens
PAQGNLQSS

SEQ ID NO: 171831 - protein, 9 aa, Homo Sapiens
ISTGPSPAG

SEQ ID NO: 171832 - protein, 9 aa, Homo Sapiens
PWMAPPTPP

SEQ ID NO: 171833 - protein, 9 aa, Homo Sapiens
NPGMVISGV

SEQ ID NO: 171834 - protein, 9 aa, Homo Sapiens
SSGDVEEKT

SEQ ID NO: 171835 - protein, 9 aa, Homo Sapiens
LVKQVSHSM

SEQ ID NO: 171836 - protein, 9 aa, Homo Sapiens
ACRYRCLAC

SEQ ID NO: 171837 - protein, 9 aa, Homo Sapiens
GGPPGALRH

SEQ ID NO: 171838 - protein, 9 aa, Homo Sapiens
SSPKSYRKS

SEQ ID NO: 171839 - protein, 9 aa, Homo Sapiens
RKARDTLYM

SEQ ID NO: 171840 - protein, 9 aa, Homo Sapiens
RQSSVLIQH

SEQ ID NO: 171841 - protein, 9 aa, Homo Sapiens
ALPFLHEND

SEQ ID NO: 171842 - protein, 9 aa, Homo Sapiens
RKEFLCDLP

SEQ ID NO: 171843 - protein, 9 aa, Homo Sapiens
GGVIPSWQI

SEQ ID NO: 171844 - protein, 9 aa, Homo Sapiens
RHLPDVAMT

SEQ ID NO: 171845 - protein, 9 aa, Homo Sapiens
PIRDRCSSI

SEQ ID NO: 171846 - protein, 9 aa, Homo Sapiens
LICIVVTRA

SEQ ID NO: 171847 - protein, 9 aa, Homo Sapiens
FFSRSHLDF

SEQ ID NO: 171848 - protein, 9 aa, Homo Sapiens
CVSPYDPIG

SEQ ID NO: 171849 - protein, 9 aa, Homo Sapiens
KIINPTISC

SEQ ID NO: 171850 - protein, 9 aa, Homo Sapiens
SQHTLKHGT

SEQ ID NO: 171851 - protein, 9 aa, Homo Sapiens
DYLQQEAPR

SEQ ID NO: 171852 - protein, 9 aa, Homo Sapiens
GCFIATVRL

SEQ ID NO: 171853 - protein, 9 aa, Homo Sapiens
TEIIFVGFF

SEQ ID NO: 171854 - protein, 9 aa, Homo Sapiens
LHQFQGRDD

SEQ ID NO: 171855 - protein, 9 aa, Homo Sapiens
MARGLFERD

SEQ ID NO: 171856 - protein, 9 aa, Homo Sapiens
VQPCTCPPV

SEQ ID NO: 171857 - protein, 9 aa, Homo Sapiens
YMKPHMKIF

SEQ ID NO: 171858 - protein, 9 aa, Homo Sapiens
TLHFCETFT

SEQ ID NO: 171859 - protein, 9 aa, Homo Sapiens
LFRQGLRQL

SEQ ID NO: 171860 - protein, 9 aa, Homo Sapiens
GCVPGPDAG

SEQ ID NO: 171861 - protein, 9 aa, Homo Sapiens
RFRCPAADN

SEQ ID NO: 171862 - protein, 9 aa, Homo Sapiens
LHWRIGGGT

SEQ ID NO: 171863 - protein, 9 aa, Homo Sapiens
QHAAHQLRA

SEQ ID NO: 171864 - protein, 9 aa, Homo Sapiens
WASRSPHRR

SEQ ID NO: 171865 - protein, 9 aa, Homo Sapiens
EGSGAGGTL

SEQ ID NO: 171866 - protein, 9 aa, Homo Sapiens
TDRHTGFSL

SEQ ID NO: 171867 - protein, 9 aa, Homo Sapiens
QTVAMELLE

SEQ ID NO: 171868 - protein, 9 aa, Homo Sapiens
TSEILHNID

SEQ ID NO: 171869 - protein, 9 aa, Homo Sapiens
AGWYRCYYG

SEQ ID NO: 171870 - protein, 9 aa, Homo Sapiens
GGAPCTTPP

SEQ ID NO: 171871 - protein, 9 aa, Homo Sapiens
GSCVDFLIQ

SEQ ID NO: 171872 - protein, 9 aa, Homo Sapiens
RQTVAMELL

SEQ ID NO: 171873 - protein, 9 aa, Homo Sapiens
IFHLQHSDQ

SEQ ID NO: 171874 - protein, 9 aa, Homo Sapiens
HLITEPNQR

SEQ ID NO: 171875 - protein, 9 aa, Homo Sapiens
HISYKSGNI

SEQ ID NO: 171876 - protein, 9 aa, Homo Sapiens
FGLATEKSR

SEQ ID NO: 171877 - protein, 9 aa, Homo Sapiens
TPTEQPLEL

SEQ ID NO: 171878 - protein, 9 aa, Homo Sapiens
TEDKKNGIW

SEQ ID NO: 171879 - protein, 9 aa, Homo Sapiens
GPWMAPPTP

SEQ ID NO: 171880 - protein, 9 aa, Homo Sapiens
LPPATTLAR

SEQ ID NO: 171881 - protein, 9 aa, Homo Sapiens
KSRRLRLCY

SEQ ID NO: 171882 - protein, 9 aa, Homo Sapiens
EVFGAQECR

SEQ ID NO: 171883 - protein, 9 aa, Homo Sapiens
STEGAPDFL

SEQ ID NO: 171884 - protein, 9 aa, Homo Sapiens
STWTPGTGS

SEQ ID NO: 171885 - protein, 9 aa, Homo Sapiens
VALERYLQR

SEQ ID NO: 171886 - protein, 9 aa, Homo Sapiens
IQELQALLL

SEQ ID NO: 171887 - protein, 9 aa, Homo Sapiens
KWLYHPALH

SEQ ID NO: 171888 - protein, 9 aa, Homo Sapiens
RVTLFQAMS

SEQ ID NO: 171889 - protein, 9 aa, Homo Sapiens
CGAPDPRRR

SEQ ID NO: 171890 - protein, 9 aa, Homo Sapiens
SWGLELSLS

SEQ ID NO: 171891 - protein, 9 aa, Homo Sapiens
RMNKGPLEM

SEQ ID NO: 171892 - protein, 9 aa, Homo Sapiens
PPSSPKARR

SEQ ID NO: 171893 - protein, 9 aa, Homo Sapiens
ACLQRMDCG

SEQ ID NO: 171894 - protein, 9 aa, Homo Sapiens
EFIFTGSPQ

SEQ ID NO: 171895 - protein, 9 aa, Homo Sapiens
VEHYRKRCR

SEQ ID NO: 171896 - protein, 9 aa, Homo Sapiens
PCPWSPGHG

SEQ ID NO: 171897 - protein, 9 aa, Homo Sapiens
ASWLLRTPA

SEQ ID NO: 171898 - protein, 9 aa, Homo Sapiens
GPTRPLHRT

SEQ ID NO: 171899 - protein, 9 aa, Homo Sapiens
CCPRAPEVP

SEQ ID NO: 171900 - protein, 9 aa, Homo Sapiens
HIPYYRESK

SEQ ID NO: 171901 - protein, 9 aa, Homo Sapiens
IGGGGWPGW

SEQ ID NO: 171902 - protein, 9 aa, Homo Sapiens
ENQKWLEKL

SEQ ID NO: 171903 - protein, 9 aa, Homo Sapiens
IISKPTWEH

SEQ ID NO: 171904 - protein, 9 aa, Homo Sapiens
DLPQPLAEP

SEQ ID NO: 171905 - protein, 9 aa, Homo Sapiens
PPPAATAAP

SEQ ID NO: 171906 - protein, 9 aa, Homo Sapiens
DPRLSLPPC

SEQ ID NO: 171907 - protein, 9 aa, Homo Sapiens
IASIRSETL

SEQ ID NO: 171908 - protein, 9 aa, Homo Sapiens
PGYSLHRPD

SEQ ID NO: 171909 - protein, 9 aa, Homo Sapiens
HLQQVGTLS

SEQ ID NO: 171910 - protein, 9 aa, Homo Sapiens
GDCPKRPEQ

SEQ ID NO: 171911 - protein, 9 aa, Homo Sapiens
WGTGGTPQG

SEQ ID NO: 171912 - protein, 9 aa, Homo Sapiens
RCPSRLSTT

SEQ ID NO: 171913 - protein, 9 aa, Homo Sapiens
ARAKVAGPG

SEQ ID NO: 171914 - protein, 9 aa, Homo Sapiens
PSHPPRPAP

SEQ ID NO: 171915 - protein, 9 aa, Homo Sapiens
ACATATTIA

SEQ ID NO: 171916 - protein, 9 aa, Homo Sapiens
SMTTISRAT

SEQ ID NO: 171917 - protein, 9 aa, Homo Sapiens
QARAQDRWR

SEQ ID NO: 171918 - protein, 9 aa, Homo Sapiens
WLLRTPRGT

SEQ ID NO: 171919 - protein, 9 aa, Homo Sapiens
AFHDQHFSP

SEQ ID NO: 171920 - protein, 9 aa, Homo Sapiens
WRTAVCTHW

SEQ ID NO: 171921 - protein, 9 aa, Homo Sapiens
SESHVTMLQ

SEQ ID NO: 171922 - protein, 9 aa, Homo Sapiens
WQVMASLTG

SEQ ID NO: 171923 - protein, 9 aa, Homo Sapiens
AKRETSEEI

SEQ ID NO: 171924 - protein, 9 aa, Homo Sapiens
CTFCKPQRV

SEQ ID NO: 171925 - protein, 9 aa, Homo Sapiens
NITEELFLL

SEQ ID NO: 171926 - protein, 9 aa, Homo Sapiens
KLVLMDRNT

SEQ ID NO: 171927 - protein, 9 aa, Homo Sapiens
GLADTGVRE

SEQ ID NO: 171928 - protein, 9 aa, Homo Sapiens
IDHLLNTQQ

SEQ ID NO: 171929 - protein, 9 aa, Homo Sapiens
TGESPTCLG

SEQ ID NO: 171930 - protein, 9 aa, Homo Sapiens
SLQVGNEVP

SEQ ID NO: 171931 - protein, 9 aa, Homo Sapiens
RWRRRGRGR

SEQ ID NO: 171932 - protein, 9 aa, Homo Sapiens
TECVRTALN

SEQ ID NO: 171933 - protein, 9 aa, Homo Sapiens
RPTGRTPTT

SEQ ID NO: 171934 - protein, 9 aa, Homo Sapiens
KSSASRGPS

SEQ ID NO: 171935 - protein, 9 aa, Homo Sapiens
AGLYLREDD

SEQ ID NO: 171936 - protein, 9 aa, Homo Sapiens
LAYVGHARA

SEQ ID NO: 171937 - protein, 9 aa, Homo Sapiens
LLMEEINTV

SEQ ID NO: 171938 - protein, 9 aa, Homo Sapiens
YHKVVKKGN

SEQ ID NO: 171939 - protein, 9 aa, Homo Sapiens
PCASLLSTL

SEQ ID NO: 171940 - protein, 9 aa, Homo Sapiens
CDAFAFTMT

SEQ ID NO: 171941 - protein, 9 aa, Homo Sapiens
VWNASRPPQ

SEQ ID NO: 171942 - protein, 9 aa, Homo Sapiens
SSRMQGLGF

SEQ ID NO: 171943 - protein, 9 aa, Homo Sapiens
RGRVGKLGL

SEQ ID NO: 171944 - protein, 9 aa, Homo Sapiens
TLVNSSWGT

SEQ ID NO: 171945 - protein, 9 aa, Homo Sapiens
DSGVDSQGP

SEQ ID NO: 171946 - protein, 9 aa, Homo Sapiens
PVQLSTVAL

SEQ ID NO: 171947 - protein, 9 aa, Homo Sapiens
FAAIPKKET

SEQ ID NO: 171948 - protein, 9 aa, Homo Sapiens
LDLPQPLAE

SEQ ID NO: 171949 - protein, 9 aa, Homo Sapiens
VNAFADQVV

SEQ ID NO: 171950 - protein, 9 aa, Homo Sapiens
LGSEHSFRI

SEQ ID NO: 171951 - protein, 9 aa, Homo Sapiens
LPPQSFLLL

SEQ ID NO: 171952 - protein, 9 aa, Homo Sapiens
GAPCTTPPA

SEQ ID NO: 171953 - protein, 9 aa, Homo Sapiens
TEPNQRTDL

SEQ ID NO: 171954 - protein, 9 aa, Homo Sapiens
SRKSRPCTW

SEQ ID NO: 171955 - protein, 9 aa, Homo Sapiens
NPGGDTTGK

SEQ ID NO: 171956 - protein, 9 aa, Homo Sapiens
PPAATAAPA

SEQ ID NO: 171957 - protein, 9 aa, Homo Sapiens
GLQLLLVIQ

SEQ ID NO: 171958 - protein, 9 aa, Homo Sapiens
VVTKWKKMN

SEQ ID NO: 171959 - protein, 9 aa, Homo Sapiens
NTMYSRLRE

SEQ ID NO: 171960 - protein, 9 aa, Homo Sapiens
LPFRMSSFP

SEQ ID NO: 171961 - protein, 9 aa, Homo Sapiens
HPQWAPHSA

SEQ ID NO: 171962 - protein, 9 aa, Homo Sapiens
SLDVSHHLN

SEQ ID NO: 171963 - protein, 9 aa, Homo Sapiens
GFWRHLEDL

SEQ ID NO: 171964 - protein, 9 aa, Homo Sapiens
FTRGRSEGG

SEQ ID NO: 171965 - protein, 9 aa, Homo Sapiens
GRFSLDREA

SEQ ID NO: 171966 - protein, 9 aa, Homo Sapiens
DGQDGAAVR

SEQ ID NO: 171967 - protein, 9 aa, Homo Sapiens
LQGVPPWSP

SEQ ID NO: 171968 - protein, 9 aa, Homo Sapiens
SRRARPAAP

SEQ ID NO: 171969 - protein, 9 aa, Homo Sapiens
RVTSKSESH

SEQ ID NO: 171970 - protein, 9 aa, Homo Sapiens
ADNPTPSIS

SEQ ID NO: 171971 - protein, 9 aa, Homo Sapiens
TSSAWTHPQ

SEQ ID NO: 171972 - protein, 9 aa, Homo Sapiens
GPDAGRLDG

SEQ ID NO: 171973 - protein, 9 aa, Homo Sapiens
SPAGWMRRW

SEQ ID NO: 171974 - protein, 9 aa, Homo Sapiens
DSQMYSITF

SEQ ID NO: 171975 - protein, 9 aa, Homo Sapiens
FRHLHDPSW

SEQ ID NO: 171976 - protein, 9 aa, Homo Sapiens
KSGTHQMRT

SEQ ID NO: 171977 - protein, 9 aa, Homo Sapiens
DFFSRSHLD

SEQ ID NO: 171978 - protein, 9 aa, Homo Sapiens
VIRQCCNAV

SEQ ID NO: 171979 - protein, 9 aa, Homo Sapiens
ATSTPVPPS

SEQ ID NO: 171980 - protein, 9 aa, Homo Sapiens
SRMLKYIRL

SEQ ID NO: 171981 - protein, 9 aa, Homo Sapiens
LHQQPEGRL

SEQ ID NO: 171982 - protein, 9 aa, Homo Sapiens
EKAQDAGIR

SEQ ID NO: 171983 - protein, 9 aa, Homo Sapiens
EMTRIKKWL

SEQ ID NO: 171984 - protein, 9 aa, Homo Sapiens
YPQFQEAMH

SEQ ID NO: 171985 - protein, 9 aa, Homo Sapiens
SCPFQSPTK

SEQ ID NO: 171986 - protein, 9 aa, Homo Sapiens
LNRELAEQT

SEQ ID NO: 171987 - protein, 9 aa, Homo Sapiens
LEEQLWSVS

SEQ ID NO: 171988 - protein, 9 aa, Homo Sapiens
ESFQSCTFC

SEQ ID NO: 171989 - protein, 9 aa, Homo Sapiens
GTEGFLVQW

SEQ ID NO: 171990 - protein, 9 aa, Homo Sapiens
ALRHPRGTP

SEQ ID NO: 171991 - protein, 9 aa, Homo Sapiens
PANGAGWPC

SEQ ID NO: 171992 - protein, 9 aa, Homo Sapiens
VYRLGTRDA

SEQ ID NO: 171993 - protein, 9 aa, Homo Sapiens
LLTGAMGGS

SEQ ID NO: 171994 - protein, 9 aa, Homo Sapiens
QHLGAGSPA

SEQ ID NO: 171995 - protein, 9 aa, Homo Sapiens
PDWHTPHCQ

SEQ ID NO: 171996 - protein, 9 aa, Homo Sapiens
KIHHVDAHA

SEQ ID NO: 171997 - protein, 9 aa, Homo Sapiens
AGAIRGWAA

SEQ ID NO: 171998 - protein, 9 aa, Homo Sapiens
TNSREDSYM

SEQ ID NO: 171999 - protein, 9 aa, Homo Sapiens
VRAPAGANK

SEQ ID NO: 172000 - protein, 9 aa, Homo Sapiens
MEATQDWNM

SEQ ID NO: 172001 - protein, 9 aa, Homo Sapiens
LQLVGLRLG

SEQ ID NO: 172002 - protein, 9 aa, Homo Sapiens
AVPSTGPAR

SEQ ID NO: 172003 - protein, 9 aa, Homo Sapiens
HIVGAQLCT

SEQ ID NO: 172004 - protein, 9 aa, Homo Sapiens
IFTGSPQLQ

SEQ ID NO: 172005 - protein, 9 aa, Homo Sapiens
RSLTRAVAA

SEQ ID NO: 172006 - protein, 9 aa, Homo Sapiens
GQSSAHMKL

SEQ ID NO: 172007 - protein, 9 aa, Homo Sapiens
LTIFHLQHS

SEQ ID NO: 172008 - protein, 9 aa, Homo Sapiens
HSMHKKLTA

SEQ ID NO: 172009 - protein, 9 aa, Homo Sapiens
FLCGPQRSH

SEQ ID NO: 172010 - protein, 9 aa, Homo Sapiens
QRTHMGERP

SEQ ID NO: 172011 - protein, 9 aa, Homo Sapiens
LARPRLPRH

SEQ ID NO: 172012 - protein, 9 aa, Homo Sapiens
TNGCQPLTK

SEQ ID NO: 172013 - protein, 9 aa, Homo Sapiens
AATATTAAT

SEQ ID NO: 172014 - protein, 9 aa, Homo Sapiens
VYRYADDHF

SEQ ID NO: 172015 - protein, 9 aa, Homo Sapiens
RPGCGAPDP

SEQ ID NO: 172016 - protein, 9 aa, Homo Sapiens
AVTTRVCQQ

SEQ ID NO: 172017 - protein, 9 aa, Homo Sapiens
QGVGPYSPR

SEQ ID NO: 172018 - protein, 9 aa, Homo Sapiens
ASSWKMAAL

SEQ ID NO: 172019 - protein, 9 aa, Homo Sapiens
QWRLIFETQ

SEQ ID NO: 172020 - protein, 9 aa, Homo Sapiens
HLEDLIQGL

SEQ ID NO: 172021 - protein, 9 aa, Homo Sapiens
AHHMALSKA

SEQ ID NO: 172022 - protein, 9 aa, Homo Sapiens
PAGAARGEL

SEQ ID NO: 172023 - protein, 9 aa, Homo Sapiens
ELKEKKIWW

SEQ ID NO: 172024 - protein, 9 aa, Homo Sapiens
GLPSPPPHP

SEQ ID NO: 172025 - protein, 9 aa, Homo Sapiens
RSPFPPTKC

SEQ ID NO: 172026 - protein, 9 aa, Homo Sapiens
YNCYGPGVS

SEQ ID NO: 172027 - protein, 9 aa, Homo Sapiens
YVLILQAFS

SEQ ID NO: 172028 - protein, 9 aa, Homo Sapiens
RLYNRKTSR

SEQ ID NO: 172029 - protein, 9 aa, Homo Sapiens
KRFPASSSQ

SEQ ID NO: 172030 - protein, 9 aa, Homo Sapiens
LSKRTPQQV

SEQ ID NO: 172031 - protein, 9 aa, Homo Sapiens
RITTQENDM

SEQ ID NO: 172032 - protein, 9 aa, Homo Sapiens
LGRYYMSAH

SEQ ID NO: 172033 - protein, 9 aa, Homo Sapiens
AGFQWGESP

SEQ ID NO: 172034 - protein, 9 aa, Homo Sapiens
DSRMLKYIR

SEQ ID NO: 172035 - protein, 9 aa, Homo Sapiens
QLPVQLSTV

SEQ ID NO: 172036 - protein, 9 aa, Homo Sapiens
SEWVCLKTH

SEQ ID NO: 172037 - protein, 9 aa, Homo Sapiens
EILHNIDCL

SEQ ID NO: 172038 - protein, 9 aa, Homo Sapiens
GAPMQKPSA

SEQ ID NO: 172039 - protein, 9 aa, Homo Sapiens
ERKKKSVGL

SEQ ID NO: 172040 - protein, 9 aa, Homo Sapiens
ILDVHTGVG

SEQ ID NO: 172041 - protein, 9 aa, Homo Sapiens
TLSTRAPGC

SEQ ID NO: 172042 - protein, 9 aa, Homo Sapiens
SLAFLYGLK

SEQ ID NO: 172043 - protein, 9 aa, Homo Sapiens
HSSTLLQHH

SEQ ID NO: 172044 - protein, 9 aa, Homo Sapiens
LKHLQDFLL

SEQ ID NO: 172045 - protein, 9 aa, Homo Sapiens
ARVTCPRSL

SEQ ID NO: 172046 - protein, 9 aa, Homo Sapiens
RNMIIWSTQ

SEQ ID NO: 172047 - protein, 9 aa, Homo Sapiens
GKECRMSGD

SEQ ID NO: 172048 - protein, 9 aa, Homo Sapiens
KAFHDQHFS

SEQ ID NO: 172049 - protein, 9 aa, Homo Sapiens
HTHLSEEVL

SEQ ID NO: 172050 - protein, 9 aa, Homo Sapiens
GFVVRDTPW

SEQ ID NO: 172051 - protein, 9 aa, Homo Sapiens
VAIVVKFFL

SEQ ID NO: 172052 - protein, 9 aa, Homo Sapiens
FTRSLTNLC

SEQ ID NO: 172053 - protein, 9 aa, Homo Sapiens
LAVDFTAAS

SEQ ID NO: 172054 - protein, 9 aa, Homo Sapiens
FGSFLQGLL

SEQ ID NO: 172055 - protein, 9 aa, Homo Sapiens
HVVYQGTFY

SEQ ID NO: 172056 - protein, 9 aa, Homo Sapiens
GRGQSYIDK

SEQ ID NO: 172057 - protein, 9 aa, Homo Sapiens
RLRRARVTC

SEQ ID NO: 172058 - protein, 9 aa, Homo Sapiens
KKKRKREKK

SEQ ID NO: 172059 - protein, 9 aa, Homo Sapiens
DFANGLLLA

SEQ ID NO: 172060 - protein, 9 aa, Homo Sapiens
RERRDRRPG

SEQ ID NO: 172061 - protein, 9 aa, Homo Sapiens
LFHYPHFWK

SEQ ID NO: 172062 - protein, 9 aa, Homo Sapiens
ILEFNGGSR

SEQ ID NO: 172063 - protein, 9 aa, Homo Sapiens
DDDVPVDMV

SEQ ID NO: 172064 - protein, 9 aa, Homo Sapiens
FQAHTDDQA

SEQ ID NO: 172065 - protein, 9 aa, Homo Sapiens
DILGGHFGG

SEQ ID NO: 172066 - protein, 9 aa, Homo Sapiens
IIPWRRSHW

SEQ ID NO: 172067 - protein, 9 aa, Homo Sapiens
EKHSPLSLL

SEQ ID NO: 172068 - protein, 9 aa, Homo Sapiens
CKYMLMRLP

SEQ ID NO: 172069 - protein, 9 aa, Homo Sapiens
SSPSASSLT

SEQ ID NO: 172070 - protein, 9 aa, Homo Sapiens
TAPSVWNAS

SEQ ID NO: 172071 - protein, 9 aa, Homo Sapiens
WISINEKCA

SEQ ID NO: 172072 - protein, 9 aa, Homo Sapiens
AKLDESIKE

SEQ ID NO: 172073 - protein, 9 aa, Homo Sapiens
LMHSFGSFL

SEQ ID NO: 172074 - protein, 9 aa, Homo Sapiens
LERGEAEWH

SEQ ID NO: 172075 - protein, 9 aa, Homo Sapiens
ADVLRWWVD

SEQ ID NO: 172076 - protein, 9 aa, Homo Sapiens
ENCHLQSPY

SEQ ID NO: 172077 - protein, 9 aa, Homo Sapiens
LVCNVTLGA

SEQ ID NO: 172078 - protein, 9 aa, Homo Sapiens
QVGMGATVA

SEQ ID NO: 172079 - protein, 9 aa, Homo Sapiens
LKPPRTPPH

SEQ ID NO: 172080 - protein, 9 aa, Homo Sapiens
QPLKSGIKM

SEQ ID NO: 172081 - protein, 9 aa, Homo Sapiens
SSGRTTHYK

SEQ ID NO: 172082 - protein, 9 aa, Homo Sapiens
CQQVAGGGP

SEQ ID NO: 172083 - protein, 9 aa, Homo Sapiens
AVAGAGRRP

SEQ ID NO: 172084 - protein, 9 aa, Homo Sapiens
KKTSEILHN

SEQ ID NO: 172085 - protein, 9 aa, Homo Sapiens
WPPVACCHS

SEQ ID NO: 172086 - protein, 9 aa, Homo Sapiens
HHHSAHLWQ

SEQ ID NO: 172087 - protein, 9 aa, Homo Sapiens
RASDSHKDL

SEQ ID NO: 172088 - protein, 9 aa, Homo Sapiens
HVEGQGGER

SEQ ID NO: 172089 - protein, 9 aa, Homo Sapiens
AVRVHHLLA

SEQ ID NO: 172090 - protein, 9 aa, Homo Sapiens
LAAQGGVAC

SEQ ID NO: 172091 - protein, 9 aa, Homo Sapiens
HSAHLALTS

SEQ ID NO: 172092 - protein, 9 aa, Homo Sapiens
NAARAGMES

SEQ ID NO: 172093 - protein, 9 aa, Homo Sapiens
WIECQHHKP

SEQ ID NO: 172094 - protein, 9 aa, Homo Sapiens
AAGRGGTTC

SEQ ID NO: 172095 - protein, 9 aa, Homo Sapiens
SFPKKFFFL

SEQ ID NO: 172096 - protein, 9 aa, Homo Sapiens
LIQKGAEVD

SEQ ID NO: 172097 - protein, 9 aa, Homo Sapiens
TKRTALWLY

SEQ ID NO: 172098 - protein, 9 aa, Homo Sapiens
PTSWWAPPP

SEQ ID NO: 172099 - protein, 9 aa, Homo Sapiens
FGGAICHMY

SEQ ID NO: 172100 - protein, 9 aa, Homo Sapiens
HDAGGWLKI

SEQ ID NO: 172101 - protein, 9 aa, Homo Sapiens
DSKVANPGG

SEQ ID NO: 172102 - protein, 9 aa, Homo Sapiens
NVPHIKKQH

SEQ ID NO: 172103 - protein, 9 aa, Homo Sapiens
SERKKKSVG

SEQ ID NO: 172104 - protein, 9 aa, Homo Sapiens
LTAHLLRLW

SEQ ID NO: 172105 - protein, 9 aa, Homo Sapiens
KDKDKTDTL

SEQ ID NO: 172106 - protein, 9 aa, Homo Sapiens
DAPEPDCGT

SEQ ID NO: 172107 - protein, 9 aa, Homo Sapiens
FHEDEQLLQ

SEQ ID NO: 172108 - protein, 9 aa, Homo Sapiens
GVVAAMEET

SEQ ID NO: 172109 - protein, 9 aa, Homo Sapiens
VCLKTHMRA

SEQ ID NO: 172110 - protein, 9 aa, Homo Sapiens
EEVFGAQEC

SEQ ID NO: 172111 - protein, 9 aa, Homo Sapiens
FWIEMEQEL

SEQ ID NO: 172112 - protein, 9 aa, Homo Sapiens
FVQLSKSKN

SEQ ID NO: 172113 - protein, 9 aa, Homo Sapiens
PPLGLHSSI

SEQ ID NO: 172114 - protein, 9 aa, Homo Sapiens
TKIYSQRSY

SEQ ID NO: 172115 - protein, 9 aa, Homo Sapiens
KSMDSIVKL

SEQ ID NO: 172116 - protein, 9 aa, Homo Sapiens
NLCVAGLSQ

SEQ ID NO: 172117 - protein, 9 aa, Homo Sapiens
FGDSQMYSI

SEQ ID NO: 172118 - protein, 9 aa, Homo Sapiens
VQVCCKRLD

SEQ ID NO: 172119 - protein, 9 aa, Homo Sapiens
LLHQEFTHL

SEQ ID NO: 172120 - protein, 9 aa, Homo Sapiens
LICEEPTCH

SEQ ID NO: 172121 - protein, 9 aa, Homo Sapiens
EWFCCPEAL

SEQ ID NO: 172122 - protein, 9 aa, Homo Sapiens
TSAVTPLAQ

SEQ ID NO: 172123 - protein, 9 aa, Homo Sapiens
IWQHRELIP

SEQ ID NO: 172124 - protein, 9 aa, Homo Sapiens
DGQRLHLHF

SEQ ID NO: 172125 - protein, 9 aa, Homo Sapiens
TTWGRWWRK

SEQ ID NO: 172126 - protein, 9 aa, Homo Sapiens
QVEEQKQLQ

SEQ ID NO: 172127 - protein, 9 aa, Homo Sapiens
IRQNTHIRN

SEQ ID NO: 172128 - protein, 9 aa, Homo Sapiens
RPSSGCGTR

SEQ ID NO: 172129 - protein, 9 aa, Homo Sapiens
NKNVNRSQS

SEQ ID NO: 172130 - protein, 9 aa, Homo Sapiens
PDPHLLRGV

SEQ ID NO: 172131 - protein, 9 aa, Homo Sapiens
LLPHSFPAP

SEQ ID NO: 172132 - protein, 9 aa, Homo Sapiens
LKEEQTPRI

SEQ ID NO: 172133 - protein, 9 aa, Homo Sapiens
VAAWGWEGC

SEQ ID NO: 172134 - protein, 9 aa, Homo Sapiens
DNLHHSWAD

SEQ ID NO: 172135 - protein, 9 aa, Homo Sapiens
TSWLAPGRT

SEQ ID NO: 172136 - protein, 9 aa, Homo Sapiens
QLLATQSSS

SEQ ID NO: 172137 - protein, 9 aa, Homo Sapiens
AMSSHIDQF

SEQ ID NO: 172138 - protein, 9 aa, Homo Sapiens
RGIAITYED

SEQ ID NO: 172139 - protein, 9 aa, Homo Sapiens
CEEVAFRMD

SEQ ID NO: 172140 - protein, 9 aa, Homo Sapiens
HQLPVQLST

SEQ ID NO: 172141 - protein, 9 aa, Homo Sapiens
RPPTAAVGA

SEQ ID NO: 172142 - protein, 9 aa, Homo Sapiens
SCGSCPRSA

SEQ ID NO: 172143 - protein, 9 aa, Homo Sapiens
TFPRVLTLK

SEQ ID NO: 172144 - protein, 9 aa, Homo Sapiens
SVSSVLMVF

SEQ ID NO: 172145 - protein, 9 aa, Homo Sapiens
VLAYVGHAR

SEQ ID NO: 172146 - protein, 9 aa, Homo Sapiens
FPLFLRHLG

SEQ ID NO: 172147 - protein, 9 aa, Homo Sapiens
LSPPLGLHS

SEQ ID NO: 172148 - protein, 9 aa, Homo Sapiens
RCAPALPAR

SEQ ID NO: 172149 - protein, 9 aa, Homo Sapiens
RGPHAPPTW

SEQ ID NO: 172150 - protein, 9 aa, Homo Sapiens
SGVLCAYFR

SEQ ID NO: 172151 - protein, 9 aa, Homo Sapiens
AGTAGGGGS

SEQ ID NO: 172152 - protein, 9 aa, Homo Sapiens
GTMIWSNPV

SEQ ID NO: 172153 - protein, 9 aa, Homo Sapiens
SGLWVCTAE

SEQ ID NO: 172154 - protein, 9 aa, Homo Sapiens
GHNSRGFGM

SEQ ID NO: 172155 - protein, 9 aa, Homo Sapiens
NAKKALKEF

SEQ ID NO: 172156 - protein, 9 aa, Homo Sapiens
PLLPPRPLS

SEQ ID NO: 172157 - protein, 9 aa, Homo Sapiens
PFLLLTVVV

SEQ ID NO: 172158 - protein, 9 aa, Homo Sapiens
DMELECEVT

SEQ ID NO: 172159 - protein, 9 aa, Homo Sapiens
GEHSTFEDN

SEQ ID NO: 172160 - protein, 9 aa, Homo Sapiens
KRASDSHKD

SEQ ID NO: 172161 - protein, 9 aa, Homo Sapiens
ELHVYCALL

SEQ ID NO: 172162 - protein, 9 aa, Homo Sapiens
YVPPEGDAH

SEQ ID NO: 172163 - protein, 9 aa, Homo Sapiens
KVPARCRRR

SEQ ID NO: 172164 - protein, 9 aa, Homo Sapiens
RGKKQQKGW

SEQ ID NO: 172165 - protein, 9 aa, Homo Sapiens
DPCMPSCHS

SEQ ID NO: 172166 - protein, 9 aa, Homo Sapiens
SEARTRSRT

SEQ ID NO: 172167 - protein, 9 aa, Homo Sapiens
RTWLCDRDN

SEQ ID NO: 172168 - protein, 9 aa, Homo Sapiens
DSRVVLDLP

SEQ ID NO: 172169 - protein, 9 aa, Homo Sapiens
KEKTEKPGI

SEQ ID NO: 172170 - protein, 9 aa, Homo Sapiens
GHGQDVAGP

SEQ ID NO: 172171 - protein, 9 aa, Homo Sapiens
QPHGRSRRC

SEQ ID NO: 172172 - protein, 9 aa, Homo Sapiens
WGPQHGHLQ

SEQ ID NO: 172173 - protein, 9 aa, Homo Sapiens
TLAVAPLWP

SEQ ID NO: 172174 - protein, 9 aa, Homo Sapiens
PLLHPQWAP

SEQ ID NO: 172175 - protein, 9 aa, Homo Sapiens
QRLGPVWPR

SEQ ID NO: 172176 - protein, 9 aa, Homo Sapiens
SAHHMALSK

SEQ ID NO: 172177 - protein, 9 aa, Homo Sapiens
KYPPQCPAP

SEQ ID NO: 172178 - protein, 9 aa, Homo Sapiens
SMHKKLTAC

SEQ ID NO: 172179 - protein, 9 aa, Homo Sapiens
VLLLLAVAK

SEQ ID NO: 172180 - protein, 9 aa, Homo Sapiens
PMPPHGMCG

SEQ ID NO: 172181 - protein, 9 aa, Homo Sapiens
ARPRLPRHC

SEQ ID NO: 172182 - protein, 9 aa, Homo Sapiens
PVSGHMDTT

SEQ ID NO: 172183 - protein, 9 aa, Homo Sapiens
TSGRGPPDR

SEQ ID NO: 172184 - protein, 9 aa, Homo Sapiens
LHRPDEVSV

SEQ ID NO: 172185 - protein, 9 aa, Homo Sapiens
GARPSCIGK

SEQ ID NO: 172186 - protein, 9 aa, Homo Sapiens
TQQLAWPDT

SEQ ID NO: 172187 - protein, 9 aa, Homo Sapiens
QDSFPTRTA

SEQ ID NO: 172188 - protein, 9 aa, Homo Sapiens
YRNPDEDPR

SEQ ID NO: 172189 - protein, 9 aa, Homo Sapiens
MSSHIDQFL

SEQ ID NO: 172190 - protein, 9 aa, Homo Sapiens
RTAWTEACQ

SEQ ID NO: 172191 - protein, 9 aa, Homo Sapiens
QATLYKSSK

SEQ ID NO: 172192 - protein, 9 aa, Homo Sapiens
APCWAPAPG

SEQ ID NO: 172193 - protein, 9 aa, Homo Sapiens
VAEASKEHK

SEQ ID NO: 172194 - protein, 9 aa, Homo Sapiens
GPSTPACSC

SEQ ID NO: 172195 - protein, 9 aa, Homo Sapiens
LSICLYTFL

SEQ ID NO: 172196 - protein, 9 aa, Homo Sapiens
THSVISTRT

SEQ ID NO: 172197 - protein, 9 aa, Homo Sapiens
VGARAARHR

SEQ ID NO: 172198 - protein, 9 aa, Homo Sapiens
ENLEAVSQL

SEQ ID NO: 172199 - protein, 9 aa, Homo Sapiens
QPQQQPPAA

SEQ ID NO: 172200 - protein, 9 aa, Homo Sapiens
RLPPAVGGC

SEQ ID NO: 172201 - protein, 9 aa, Homo Sapiens
NNFFVTEGN

SEQ ID NO: 172202 - protein, 9 aa, Homo Sapiens
LSGSYDLTI

SEQ ID NO: 172203 - protein, 9 aa, Homo Sapiens
MVFVQFLQE

SEQ ID NO: 172204 - protein, 9 aa, Homo Sapiens
DSPPGVPSL

SEQ ID NO: 172205 - protein, 9 aa, Homo Sapiens
GGAAGRVAR

SEQ ID NO: 172206 - protein, 9 aa, Homo Sapiens
LADFVLLCL

SEQ ID NO: 172207 - protein, 9 aa, Homo Sapiens
CLGHPVLTP

SEQ ID NO: 172208 - protein, 9 aa, Homo Sapiens
DSMLAASSV

SEQ ID NO: 172209 - protein, 9 aa, Homo Sapiens
PSSGCGTRK

SEQ ID NO: 172210 - protein, 9 aa, Homo Sapiens
QKNSAQTSC

SEQ ID NO: 172211 - protein, 9 aa, Homo Sapiens
SSSPWVQHT

SEQ ID NO: 172212 - protein, 9 aa, Homo Sapiens
TILWLMGWS

SEQ ID NO: 172213 - protein, 9 aa, Homo Sapiens
PRAIQATLY

SEQ ID NO: 172214 - protein, 9 aa, Homo Sapiens
APGGPAVAG

SEQ ID NO: 172215 - protein, 9 aa, Homo Sapiens
PLHFPTVIR

SEQ ID NO: 172216 - protein, 9 aa, Homo Sapiens
SLNTELLSM

SEQ ID NO: 172217 - protein, 9 aa, Homo Sapiens
WVIRKTDLN

SEQ ID NO: 172218 - protein, 9 aa, Homo Sapiens
RVIPVRLQL

SEQ ID NO: 172219 - protein, 9 aa, Homo Sapiens
ATPGRPWPP

SEQ ID NO: 172220 - protein, 9 aa, Homo Sapiens
PLCLPQPTH

SEQ ID NO: 172221 - protein, 9 aa, Homo Sapiens
THRRETLCL

SEQ ID NO: 172222 - protein, 9 aa, Homo Sapiens
AYKQYGMYR

SEQ ID NO: 172223 - protein, 9 aa, Homo Sapiens
RMRMERERR

SEQ ID NO: 172224 - protein, 9 aa, Homo Sapiens
PLLAAQGGV

SEQ ID NO: 172225 - protein, 9 aa, Homo Sapiens
SSSLRMTPT

SEQ ID NO: 172226 - protein, 9 aa, Homo Sapiens
TCQIMVMMW

SEQ ID NO: 172227 - protein, 9 aa, Homo Sapiens
KTATKIYSQ

SEQ ID NO: 172228 - protein, 9 aa, Homo Sapiens
SSCQLHQLE

SEQ ID NO: 172229 - protein, 9 aa, Homo Sapiens
MEAKPWLAI

SEQ ID NO: 172230 - protein, 9 aa, Homo Sapiens
PVIREPATP

SEQ ID NO: 172231 - protein, 9 aa, Homo Sapiens
AGLSQFRGG

SEQ ID NO: 172232 - protein, 9 aa, Homo Sapiens
AASPAMSCT

SEQ ID NO: 172233 - protein, 9 aa, Homo Sapiens
GDTPQPSLP

SEQ ID NO: 172234 - protein, 9 aa, Homo Sapiens
TSAQVVGAP

SEQ ID NO: 172235 - protein, 9 aa, Homo Sapiens
PEPGPAAGG

SEQ ID NO: 172236 - protein, 9 aa, Homo Sapiens
ASNTIAPST

SEQ ID NO: 172237 - protein, 9 aa, Homo Sapiens
SNANIQYQV

SEQ ID NO: 172238 - protein, 9 aa, Homo Sapiens
LHDPSWRKR

SEQ ID NO: 172239 - protein, 9 aa, Homo Sapiens
KTACSCSLA

SEQ ID NO: 172240 - protein, 9 aa, Homo Sapiens
YKPPSNAQY

SEQ ID NO: 172241 - protein, 9 aa, Homo Sapiens
WGTALMTSP

SEQ ID NO: 172242 - protein, 9 aa, Homo Sapiens
GKEGATIHN

SEQ ID NO: 172243 - protein, 9 aa, Homo Sapiens
LIAGSLDSR

SEQ ID NO: 172244 - protein, 9 aa, Homo Sapiens
LGGPGGLQP

SEQ ID NO: 172245 - protein, 9 aa, Homo Sapiens
HFTGRSSLA

SEQ ID NO: 172246 - protein, 9 aa, Homo Sapiens
ARAARHRWD

SEQ ID NO: 172247 - protein, 9 aa, Homo Sapiens
WKLAILAEQ

SEQ ID NO: 172248 - protein, 9 aa, Homo Sapiens
SSGCRNVSR

SEQ ID NO: 172249 - protein, 9 aa, Homo Sapiens
KKYQDSDGL

SEQ ID NO: 172250 - protein, 9 aa, Homo Sapiens
ALMPISTGP

SEQ ID NO: 172251 - protein, 9 aa, Homo Sapiens
ITNETGQQL

SEQ ID NO: 172252 - protein, 9 aa, Homo Sapiens
WSNPVQEFH

SEQ ID NO: 172253 - protein, 9 aa, Homo Sapiens
LLSGSYDLT

SEQ ID NO: 172254 - protein, 9 aa, Homo Sapiens
LAIRWTRGW

SEQ ID NO: 172255 - protein, 9 aa, Homo Sapiens
PGAKDMPLL

SEQ ID NO: 172256 - protein, 9 aa, Homo Sapiens
DHQEIVLCQ

SEQ ID NO: 172257 - protein, 9 aa, Homo Sapiens
WILWLITQQ

SEQ ID NO: 172258 - protein, 9 aa, Homo Sapiens
YIIGHDAGG

SEQ ID NO: 172259 - protein, 9 aa, Homo Sapiens
WKGLWRYPR

SEQ ID NO: 172260 - protein, 9 aa, Homo Sapiens
TAVCTHWRK

SEQ ID NO: 172261 - protein, 9 aa, Homo Sapiens
AGRNHCRQL

SEQ ID NO: 172262 - protein, 9 aa, Homo Sapiens
VQGKKILFH

SEQ ID NO: 172263 - protein, 9 aa, Homo Sapiens
VRLQLFEVH

SEQ ID NO: 172264 - protein, 9 aa, Homo Sapiens
VKNMIYVIY

SEQ ID NO: 172265 - protein, 9 aa, Homo Sapiens
PRGTPPGPE

SEQ ID NO: 172266 - protein, 9 aa, Homo Sapiens
IGVQNCKPK

SEQ ID NO: 172267 - protein, 9 aa, Homo Sapiens
SDVFQIRLG

SEQ ID NO: 172268 - protein, 9 aa, Homo Sapiens
AGDTDTVHA

SEQ ID NO: 172269 - protein, 9 aa, Homo Sapiens
LGGHFGGDQ

SEQ ID NO: 172270 - protein, 9 aa, Homo Sapiens
AVGVSEEIE

SEQ ID NO: 172271 - protein, 9 aa, Homo Sapiens
VVSDNQRLK

SEQ ID NO: 172272 - protein, 9 aa, Homo Sapiens
PGPRRAWRA

SEQ ID NO: 172273 - protein, 9 aa, Homo Sapiens
HLFYDVCKL

SEQ ID NO: 172274 - protein, 9 aa, Homo Sapiens
QFDVYEVVN

SEQ ID NO: 172275 - protein, 9 aa, Homo Sapiens
EGWSLIDYV

SEQ ID NO: 172276 - protein, 9 aa, Homo Sapiens
TRAKVVLPP

SEQ ID NO: 172277 - protein, 9 aa, Homo Sapiens
GAGASAPLW

SEQ ID NO: 172278 - protein, 9 aa, Homo Sapiens
WEENVPKDP

SEQ ID NO: 172279 - protein, 9 aa, Homo Sapiens
PPVDTRAKV

SEQ ID NO: 172280 - protein, 9 aa, Homo Sapiens
LALQARMDS

SEQ ID NO: 172281 - protein, 9 aa, Homo Sapiens
LGLPLSPCL

SEQ ID NO: 172282 - protein, 9 aa, Homo Sapiens
HEATPHGRL

SEQ ID NO: 172283 - protein, 9 aa, Homo Sapiens
SPFEKQFKC

SEQ ID NO: 172284 - protein, 9 aa, Homo Sapiens
TTTSRKSRP

SEQ ID NO: 172285 - protein, 9 aa, Homo Sapiens
ERLRHTYAN

SEQ ID NO: 172286 - protein, 9 aa, Homo Sapiens
VQKIVKSKT

SEQ ID NO: 172287 - protein, 9 aa, Homo Sapiens
SGHEVVGIV

SEQ ID NO: 172288 - protein, 9 aa, Homo Sapiens
KICYLPLNT

SEQ ID NO: 172289 - protein, 9 aa, Homo Sapiens
TTCIICLAF

SEQ ID NO: 172290 - protein, 9 aa, Homo Sapiens
WKKLVLMDR

SEQ ID NO: 172291 - protein, 9 aa, Homo Sapiens
NGYMRPEAC

SEQ ID NO: 172292 - protein, 9 aa, Homo Sapiens
GRAQPVIRE

SEQ ID NO: 172293 - protein, 9 aa, Homo Sapiens
VWLLFFLGL

SEQ ID NO: 172294 - protein, 9 aa, Homo Sapiens
NRGFRALLE

SEQ ID NO: 172295 - protein, 9 aa, Homo Sapiens
SLQQAAAVY

SEQ ID NO: 172296 - protein, 9 aa, Homo Sapiens
TTGPRDDDK

SEQ ID NO: 172297 - protein, 9 aa, Homo Sapiens
PTISCPFQS

SEQ ID NO: 172298 - protein, 9 aa, Homo Sapiens
ASIDVDPLS

SEQ ID NO: 172299 - protein, 9 aa, Homo Sapiens
VSRLFAPLG

SEQ ID NO: 172300 - protein, 9 aa, Homo Sapiens
PKSSRMQGL

SEQ ID NO: 172301 - protein, 9 aa, Homo Sapiens
CLTISEKGF

SEQ ID NO: 172302 - protein, 9 aa, Homo Sapiens
SLFYYKLAG

SEQ ID NO: 172303 - protein, 9 aa, Homo Sapiens
RVSSPCCPA

SEQ ID NO: 172304 - protein, 9 aa, Homo Sapiens
RAWRALLYP

SEQ ID NO: 172305 - protein, 9 aa, Homo Sapiens
LFYYKLAGF

SEQ ID NO: 172306 - protein, 9 aa, Homo Sapiens
ESNKRLQLH

SEQ ID NO: 172307 - protein, 9 aa, Homo Sapiens
GGEAGKPPL

SEQ ID NO: 172308 - protein, 9 aa, Homo Sapiens
YVVSLGTEG

SEQ ID NO: 172309 - protein, 9 aa, Homo Sapiens
PEAAGPGGC

SEQ ID NO: 172310 - protein, 9 aa, Homo Sapiens
LAPAALCSR

SEQ ID NO: 172311 - protein, 9 aa, Homo Sapiens
LEQLRTNRN

SEQ ID NO: 172312 - protein, 9 aa, Homo Sapiens
NYPAIILFS

SEQ ID NO: 172313 - protein, 9 aa, Homo Sapiens
STQEKWGYP

SEQ ID NO: 172314 - protein, 9 aa, Homo Sapiens
YKQYGMYRC

SEQ ID NO: 172315 - protein, 9 aa, Homo Sapiens
VAGDTDTVH

SEQ ID NO: 172316 - protein, 9 aa, Homo Sapiens
QKGRGWDSE

SEQ ID NO: 172317 - protein, 9 aa, Homo Sapiens
PRQQKGWLL

SEQ ID NO: 172318 - protein, 9 aa, Homo Sapiens
FLPPMHCPT

SEQ ID NO: 172319 - protein, 9 aa, Homo Sapiens
GESPWQVMA

SEQ ID NO: 172320 - protein, 9 aa, Homo Sapiens
SFCFSPLWL

SEQ ID NO: 172321 - protein, 9 aa, Homo Sapiens
YKCASALQK

SEQ ID NO: 172322 - protein, 9 aa, Homo Sapiens
TRCGSGGPG

SEQ ID NO: 172323 - protein, 9 aa, Homo Sapiens
EHLYCVLFI

SEQ ID NO: 172324 - protein, 9 aa, Homo Sapiens
QRVGQSRLE

SEQ ID NO: 172325 - protein, 9 aa, Homo Sapiens
SHYFCEAQE

SEQ ID NO: 172326 - protein, 9 aa, Homo Sapiens
HGKPDVDHV

SEQ ID NO: 172327 - protein, 9 aa, Homo Sapiens
KGRGWDSES

SEQ ID NO: 172328 - protein, 9 aa, Homo Sapiens
GTLSPSAVS

SEQ ID NO: 172329 - protein, 9 aa, Homo Sapiens
KKNVEAIGF

SEQ ID NO: 172330 - protein, 9 aa, Homo Sapiens
VSVATLGPL

SEQ ID NO: 172331 - protein, 9 aa, Homo Sapiens
GAVVPSYIP

SEQ ID NO: 172332 - protein, 9 aa, Homo Sapiens
KQQLTTHLR

SEQ ID NO: 172333 - protein, 9 aa, Homo Sapiens
PVCGKKHRP

SEQ ID NO: 172334 - protein, 9 aa, Homo Sapiens
RRERRLDGL

SEQ ID NO: 172335 - protein, 9 aa, Homo Sapiens
NCAEERDTH

SEQ ID NO: 172336 - protein, 9 aa, Homo Sapiens
LGRWIQTQA

SEQ ID NO: 172337 - protein, 9 aa, Homo Sapiens
LQSPPIREV

SEQ ID NO: 172338 - protein, 9 aa, Homo Sapiens
IAADEMVIK

SEQ ID NO: 172339 - protein, 9 aa, Homo Sapiens
LISVSGSFA

SEQ ID NO: 172340 - protein, 9 aa, Homo Sapiens
SKPTWEHLY

SEQ ID NO: 172341 - protein, 9 aa, Homo Sapiens
FVNGAVANA

SEQ ID NO: 172342 - protein, 9 aa, Homo Sapiens
VSKKKDLHD

SEQ ID NO: 172343 - protein, 9 aa, Homo Sapiens
TPPWSGPQA

SEQ ID NO: 172344 - protein, 9 aa, Homo Sapiens
PKVPARCRR

SEQ ID NO: 172345 - protein, 9 aa, Homo Sapiens
PSPPSSRTT

SEQ ID NO: 172346 - protein, 9 aa, Homo Sapiens
SEEEVGGVP

SEQ ID NO: 172347 - protein, 9 aa, Homo Sapiens
TKGMATVPK

SEQ ID NO: 172348 - protein, 9 aa, Homo Sapiens
EAMSSHIDQ

SEQ ID NO: 172349 - protein, 9 aa, Homo Sapiens
FFLHFVGDS

SEQ ID NO: 172350 - protein, 9 aa, Homo Sapiens
EEAKKAITD

SEQ ID NO: 172351 - protein, 9 aa, Homo Sapiens
TGKGPLGPV

SEQ ID NO: 172352 - protein, 9 aa, Homo Sapiens
LLQGHFRTR

SEQ ID NO: 172353 - protein, 9 aa, Homo Sapiens
ELFLLVSLA

SEQ ID NO: 172354 - protein, 9 aa, Homo Sapiens
QWILTKSCR

SEQ ID NO: 172355 - protein, 9 aa, Homo Sapiens
RLWSCGPNI

SEQ ID NO: 172356 - protein, 9 aa, Homo Sapiens
LLPQARPSP

SEQ ID NO: 172357 - protein, 9 aa, Homo Sapiens
SYLPQWWER

SEQ ID NO: 172358 - protein, 9 aa, Homo Sapiens
WEHLYCVLF

SEQ ID NO: 172359 - protein, 9 aa, Homo Sapiens
PWRRSHWSC

SEQ ID NO: 172360 - protein, 9 aa, Homo Sapiens
LSGSNIGRQ

SEQ ID NO: 172361 - protein, 9 aa, Homo Sapiens
HHACGHSCP

SEQ ID NO: 172362 - protein, 9 aa, Homo Sapiens
QWVDIALEC

SEQ ID NO: 172363 - protein, 9 aa, Homo Sapiens
SHLESLSAE

SEQ ID NO: 172364 - protein, 9 aa, Homo Sapiens
RGHDGLSRG

SEQ ID NO: 172365 - protein, 9 aa, Homo Sapiens
YLSEELCLP

SEQ ID NO: 172366 - protein, 9 aa, Homo Sapiens
KLVGMSYLH

SEQ ID NO: 172367 - protein, 9 aa, Homo Sapiens
PRKAPCAST

SEQ ID NO: 172368 - protein, 9 aa, Homo Sapiens
LCWDLVLLN

SEQ ID NO: 172369 - protein, 9 aa, Homo Sapiens
FLTQTHLVG

SEQ ID NO: 172370 - protein, 9 aa, Homo Sapiens
TLRYGHNFC

SEQ ID NO: 172371 - protein, 9 aa, Homo Sapiens
KPKGANRKQ

SEQ ID NO: 172372 - protein, 9 aa, Homo Sapiens
HQLQYGSHS

SEQ ID NO: 172373 - protein, 9 aa, Homo Sapiens
AQAVTLLLD

SEQ ID NO: 172374 - protein, 9 aa, Homo Sapiens
GAAVRVHHL

SEQ ID NO: 172375 - protein, 9 aa, Homo Sapiens
TLWLGPASV

SEQ ID NO: 172376 - protein, 9 aa, Homo Sapiens
DASTLSTTP

SEQ ID NO: 172377 - protein, 9 aa, Homo Sapiens
KAEMHRKAK

SEQ ID NO: 172378 - protein, 9 aa, Homo Sapiens
SDMPEEMCV

SEQ ID NO: 172379 - protein, 9 aa, Homo Sapiens
HMRVHTGLH

SEQ ID NO: 172380 - protein, 9 aa, Homo Sapiens
VWPRWTWVL

SEQ ID NO: 172381 - protein, 9 aa, Homo Sapiens
GPPTCSFVQ

SEQ ID NO: 172382 - protein, 9 aa, Homo Sapiens
IITITKKIS

SEQ ID NO: 172383 - protein, 9 aa, Homo Sapiens
YSWPRVPHW

SEQ ID NO: 172384 - protein, 9 aa, Homo Sapiens
VVAKVRTVD

SEQ ID NO: 172385 - protein, 9 aa, Homo Sapiens
ETGQQLIGK

SEQ ID NO: 172386 - protein, 9 aa, Homo Sapiens
YFGCLLGSE

SEQ ID NO: 172387 - protein, 9 aa, Homo Sapiens
RCREINARP

SEQ ID NO: 172388 - protein, 9 aa, Homo Sapiens
AARAGMEST

SEQ ID NO: 172389 - protein, 9 aa, Homo Sapiens
FRALLEKKG

SEQ ID NO: 172390 - protein, 9 aa, Homo Sapiens
VTLCSFGLW

SEQ ID NO: 172391 - protein, 9 aa, Homo Sapiens
SGCRKWCKR

SEQ ID NO: 172392 - protein, 9 aa, Homo Sapiens
VNFPRSKHP

SEQ ID NO: 172393 - protein, 9 aa, Homo Sapiens
LEMDISKKS

SEQ ID NO: 172394 - protein, 9 aa, Homo Sapiens
ACAACLQRM

SEQ ID NO: 172395 - protein, 9 aa, Homo Sapiens
SPATMEVLY

SEQ ID NO: 172396 - protein, 9 aa, Homo Sapiens
DAYYFMGPG

SEQ ID NO: 172397 - protein, 9 aa, Homo Sapiens
CDAAHCAAT

SEQ ID NO: 172398 - protein, 9 aa, Homo Sapiens
AGADKGNHK

SEQ ID NO: 172399 - protein, 9 aa, Homo Sapiens
EVEHYRKRC

SEQ ID NO: 172400 - protein, 9 aa, Homo Sapiens
MHSAHLALT

SEQ ID NO: 172401 - protein, 9 aa, Homo Sapiens
PCMPSCHSP

SEQ ID NO: 172402 - protein, 9 aa, Homo Sapiens
LRTPRGTHC

SEQ ID NO: 172403 - protein, 9 aa, Homo Sapiens
RDGKHQPNQ

SEQ ID NO: 172404 - protein, 9 aa, Homo Sapiens
QIELRHHEW

SEQ ID NO: 172405 - protein, 9 aa, Homo Sapiens
YVADINDNT

SEQ ID NO: 172406 - protein, 9 aa, Homo Sapiens
KNLYLLAFK

SEQ ID NO: 172407 - protein, 9 aa, Homo Sapiens
LATQSSSSA

SEQ ID NO: 172408 - protein, 9 aa, Homo Sapiens
ELKWPRLDE

SEQ ID NO: 172409 - protein, 9 aa, Homo Sapiens
SCCPASPHS

SEQ ID NO: 172410 - protein, 9 aa, Homo Sapiens
AEKSQIAKK

SEQ ID NO: 172411 - protein, 9 aa, Homo Sapiens
SECCDFCDI

SEQ ID NO: 172412 - protein, 9 aa, Homo Sapiens
TWLPARPSR

SEQ ID NO: 172413 - protein, 9 aa, Homo Sapiens
ECADVLRWW

SEQ ID NO: 172414 - protein, 9 aa, Homo Sapiens
VSIPNLPQE

SEQ ID NO: 172415 - protein, 9 aa, Homo Sapiens
LDTQSRPKG

SEQ ID NO: 172416 - protein, 9 aa, Homo Sapiens
PLDPPVNRG

SEQ ID NO: 172417 - protein, 9 aa, Homo Sapiens
VSHSVLLFI

SEQ ID NO: 172418 - protein, 9 aa, Homo Sapiens
NGVLVSAGD

SEQ ID NO: 172419 - protein, 9 aa, Homo Sapiens
EPIRDRCSS

SEQ ID NO: 172420 - protein, 9 aa, Homo Sapiens
QPRGSAGAR

SEQ ID NO: 172421 - protein, 9 aa, Homo Sapiens
ADTLQRLGP

SEQ ID NO: 172422 - protein, 9 aa, Homo Sapiens
FTNCCEAGG

SEQ ID NO: 172423 - protein, 9 aa, Homo Sapiens
ANARVTNTK

SEQ ID NO: 172424 - protein, 9 aa, Homo Sapiens
LEGCISVKD

SEQ ID NO: 172425 - protein, 9 aa, Homo Sapiens
NGKIIDTKN

SEQ ID NO: 172426 - protein, 9 aa, Homo Sapiens
LRLESVDLP

SEQ ID NO: 172427 - protein, 9 aa, Homo Sapiens
DILLVRRDS

SEQ ID NO: 172428 - protein, 9 aa, Homo Sapiens
LSLYRPPLA

SEQ ID NO: 172429 - protein, 9 aa, Homo Sapiens
LVTLRAVKR

SEQ ID NO: 172430 - protein, 9 aa, Homo Sapiens
SRMLGSCCT

SEQ ID NO: 172431 - protein, 9 aa, Homo Sapiens
MCEMNGKYV

SEQ ID NO: 172432 - protein, 9 aa, Homo Sapiens
PQHPPTGPL

SEQ ID NO: 172433 - protein, 9 aa, Homo Sapiens
EGRPCDDED

SEQ ID NO: 172434 - protein, 9 aa, Homo Sapiens
HYLSEELCL

SEQ ID NO: 172435 - protein, 9 aa, Homo Sapiens
VVKQKKTAT

SEQ ID NO: 172436 - protein, 9 aa, Homo Sapiens
FLWNTVHRH

SEQ ID NO: 172437 - protein, 9 aa, Homo Sapiens
MTQAHEVAA

SEQ ID NO: 172438 - protein, 9 aa, Homo Sapiens
LLPPFLLLT

SEQ ID NO: 172439 - protein, 9 aa, Homo Sapiens
RVLVVHLVE

SEQ ID NO: 172440 - protein, 9 aa, Homo Sapiens
EPPVLPPKP

SEQ ID NO: 172441 - protein, 9 aa, Homo Sapiens
SSIRAGQCG

SEQ ID NO: 172442 - protein, 9 aa, Homo Sapiens
TLTGQVVLQ

SEQ ID NO: 172443 - protein, 9 aa, Homo Sapiens
LELRDVELE

SEQ ID NO: 172444 - protein, 9 aa, Homo Sapiens
MTPTFNPRE

SEQ ID NO: 172445 - protein, 9 aa, Homo Sapiens
PQHLGAGSP

SEQ ID NO: 172446 - protein, 9 aa, Homo Sapiens
DKAEAMSSH

SEQ ID NO: 172447 - protein, 9 aa, Homo Sapiens
CALDSDFGE

SEQ ID NO: 172448 - protein, 9 aa, Homo Sapiens
LLEVLGWLP

SEQ ID NO: 172449 - protein, 9 aa, Homo Sapiens
SPHFDWVVS

SEQ ID NO: 172450 - protein, 9 aa, Homo Sapiens
RRRLFTRSL

SEQ ID NO: 172451 - protein, 9 aa, Homo Sapiens
TSENTHRRE

SEQ ID NO: 172452 - protein, 9 aa, Homo Sapiens
LTAGSKHKI

SEQ ID NO: 172453 - protein, 9 aa, Homo Sapiens
EACTRTSLE

SEQ ID NO: 172454 - protein, 9 aa, Homo Sapiens
KMDVLNTFK

SEQ ID NO: 172455 - protein, 9 aa, Homo Sapiens
GEAELWRVT

SEQ ID NO: 172456 - protein, 9 aa, Homo Sapiens
EMVMCAKDN

SEQ ID NO: 172457 - protein, 9 aa, Homo Sapiens
VYLQHFRPQ

SEQ ID NO: 172458 - protein, 9 aa, Homo Sapiens
HRNSVRFLQ

SEQ ID NO: 172459 - protein, 9 aa, Homo Sapiens
SMRTSDSGS

SEQ ID NO: 172460 - protein, 9 aa, Homo Sapiens
LSFNVILQI

SEQ ID NO: 172461 - protein, 9 aa, Homo Sapiens
PSFEELQSP

SEQ ID NO: 172462 - protein, 9 aa, Homo Sapiens
PAALQPLPQ

SEQ ID NO: 172463 - protein, 9 aa, Homo Sapiens
NEPTTAAMA

SEQ ID NO: 172464 - protein, 9 aa, Homo Sapiens
CKLQEDTNF

SEQ ID NO: 172465 - protein, 9 aa, Homo Sapiens
QGAVCDTRA

SEQ ID NO: 172466 - protein, 9 aa, Homo Sapiens
PVDTRAKVV

SEQ ID NO: 172467 - protein, 9 aa, Homo Sapiens
ATEKSRWSG

SEQ ID NO: 172468 - protein, 9 aa, Homo Sapiens
SSRRNVICQ

SEQ ID NO: 172469 - protein, 9 aa, Homo Sapiens
TLVTLGTLK

SEQ ID NO: 172470 - protein, 9 aa, Homo Sapiens
EVGATEETE

SEQ ID NO: 172471 - protein, 9 aa, Homo Sapiens
IYDARIPQL

SEQ ID NO: 172472 - protein, 9 aa, Homo Sapiens
QTATEKQHI

SEQ ID NO: 172473 - protein, 9 aa, Homo Sapiens
SQNNTSAMK

SEQ ID NO: 172474 - protein, 9 aa, Homo Sapiens
PLLLLGQGW

SEQ ID NO: 172475 - protein, 9 aa, Homo Sapiens
PLAQHRPGA

SEQ ID NO: 172476 - protein, 9 aa, Homo Sapiens
ALQSSAVRV

SEQ ID NO: 172477 - protein, 9 aa, Homo Sapiens
ISKKVSWYS

SEQ ID NO: 172478 - protein, 9 aa, Homo Sapiens
TSMGPTWGR

SEQ ID NO: 172479 - protein, 9 aa, Homo Sapiens
RPCKDRKLD

SEQ ID NO: 172480 - protein, 9 aa, Homo Sapiens
GKVLAEGQW

SEQ ID NO: 172481 - protein, 9 aa, Homo Sapiens
LLFRHKSRR

SEQ ID NO: 172482 - protein, 9 aa, Homo Sapiens
EENAMIAKM

SEQ ID NO: 172483 - protein, 9 aa, Homo Sapiens
ARPPAGLST

SEQ ID NO: 172484 - protein, 9 aa, Homo Sapiens
VVHIHCWLS

SEQ ID NO: 172485 - protein, 9 aa, Homo Sapiens
TISLLHSTD

SEQ ID NO: 172486 - protein, 9 aa, Homo Sapiens
RPMIVELGA

SEQ ID NO: 172487 - protein, 9 aa, Homo Sapiens
PLQLLATQS

SEQ ID NO: 172488 - protein, 9 aa, Homo Sapiens
SNKRHHPIG

SEQ ID NO: 172489 - protein, 9 aa, Homo Sapiens
TPVKKNQVM

SEQ ID NO: 172490 - protein, 9 aa, Homo Sapiens
DSPHICRRC

SEQ ID NO: 172491 - protein, 9 aa, Homo Sapiens
QWEVAEEDL

SEQ ID NO: 172492 - protein, 9 aa, Homo Sapiens
YTVGAGTGD

SEQ ID NO: 172493 - protein, 9 aa, Homo Sapiens
DSLRPVRLQ

SEQ ID NO: 172494 - protein, 9 aa, Homo Sapiens
QHVDARGEI

SEQ ID NO: 172495 - protein, 9 aa, Homo Sapiens
PMVRVFQYL

SEQ ID NO: 172496 - protein, 9 aa, Homo Sapiens
ENTTLHCHL

SEQ ID NO: 172497 - protein, 9 aa, Homo Sapiens
LAKSMDSIV

SEQ ID NO: 172498 - protein, 9 aa, Homo Sapiens
VLRVAFSVA

SEQ ID NO: 172499 - protein, 9 aa, Homo Sapiens
CFLFPFQYL

SEQ ID NO: 172500 - protein, 9 aa, Homo Sapiens
NISHKAAPV

SEQ ID NO: 172501 - protein, 9 aa, Homo Sapiens
RRGFAEGRR

SEQ ID NO: 172502 - protein, 9 aa, Homo Sapiens
KKTWYLLAV

SEQ ID NO: 172503 - protein, 9 aa, Homo Sapiens
HQMRTAPSV

SEQ ID NO: 172504 - protein, 9 aa, Homo Sapiens
QVCCKRLDG

SEQ ID NO: 172505 - protein, 9 aa, Homo Sapiens
MVIKYVGQN

SEQ ID NO: 172506 - protein, 9 aa, Homo Sapiens
LLWLELLRQ

SEQ ID NO: 172507 - protein, 9 aa, Homo Sapiens
QSLDLSFNV

SEQ ID NO: 172508 - protein, 9 aa, Homo Sapiens
PPWSPGEAL

SEQ ID NO: 172509 - protein, 9 aa, Homo Sapiens
QGDMTQAHE

SEQ ID NO: 172510 - protein, 9 aa, Homo Sapiens
RGRVLVVHL

SEQ ID NO: 172511 - protein, 9 aa, Homo Sapiens
GKTRVGGLG

SEQ ID NO: 172512 - protein, 9 aa, Homo Sapiens
SRGFVVRDT

SEQ ID NO: 172513 - protein, 9 aa, Homo Sapiens
LREQWKKVV

SEQ ID NO: 172514 - protein, 9 aa, Homo Sapiens
FKERPTKAH

SEQ ID NO: 172515 - protein, 9 aa, Homo Sapiens
AKVRTVDAD

SEQ ID NO: 172516 - protein, 9 aa, Homo Sapiens
FPKPPILQC

SEQ ID NO: 172517 - protein, 9 aa, Homo Sapiens
SLHRPDEVS

SEQ ID NO: 172518 - protein, 9 aa, Homo Sapiens
KKILFHYPH

SEQ ID NO: 172519 - protein, 9 aa, Homo Sapiens
SSFPKKFFF

SEQ ID NO: 172520 - protein, 9 aa, Homo Sapiens
TQSSSSAPV

SEQ ID NO: 172521 - protein, 9 aa, Homo Sapiens
LNTLRVTHS

SEQ ID NO: 172522 - protein, 9 aa, Homo Sapiens
TPGIRGPHA

SEQ ID NO: 172523 - protein, 9 aa, Homo Sapiens
KCCVIEHTN

SEQ ID NO: 172524 - protein, 9 aa, Homo Sapiens
RRGRGRGRV

SEQ ID NO: 172525 - protein, 9 aa, Homo Sapiens
PNSPPTPAP

SEQ ID NO: 172526 - protein, 9 aa, Homo Sapiens
AYNCYGPGV

SEQ ID NO: 172527 - protein, 9 aa, Homo Sapiens
QKKQGNEQN

SEQ ID NO: 172528 - protein, 9 aa, Homo Sapiens
LVKGTLSPK

SEQ ID NO: 172529 - protein, 9 aa, Homo Sapiens
PTKCHLARC

SEQ ID NO: 172530 - protein, 9 aa, Homo Sapiens
MEVLYSGWE

SEQ ID NO: 172531 - protein, 9 aa, Homo Sapiens
TLIYDTLER

SEQ ID NO: 172532 - protein, 9 aa, Homo Sapiens
FFFLFFFSF

SEQ ID NO: 172533 - protein, 9 aa, Homo Sapiens
LCDAFAFTM

SEQ ID NO: 172534 - protein, 9 aa, Homo Sapiens
NEEAYGCSH

SEQ ID NO: 172535 - protein, 9 aa, Homo Sapiens
GFLTCRLMQ

SEQ ID NO: 172536 - protein, 9 aa, Homo Sapiens
VSVFLDLCS

SEQ ID NO: 172537 - protein, 9 aa, Homo Sapiens
LFHTALFLG

SEQ ID NO: 172538 - protein, 9 aa, Homo Sapiens
LQGPWSTCV

SEQ ID NO: 172539 - protein, 9 aa, Homo Sapiens
THLFHTDRH

SEQ ID NO: 172540 - protein, 9 aa, Homo Sapiens
SGTYTIYIN

SEQ ID NO: 172541 - protein, 9 aa, Homo Sapiens
PRSPHRHRP

SEQ ID NO: 172542 - protein, 9 aa, Homo Sapiens
PLALQARMD

SEQ ID NO: 172543 - protein, 9 aa, Homo Sapiens
TASASWLLR

SEQ ID NO: 172544 - protein, 9 aa, Homo Sapiens
RCYERGLTW

SEQ ID NO: 172545 - protein, 9 aa, Homo Sapiens
SEGQELQVI

SEQ ID NO: 172546 - protein, 9 aa, Homo Sapiens
PSSWPNWGA

SEQ ID NO: 172547 - protein, 9 aa, Homo Sapiens
TSLTFPAAS

SEQ ID NO: 172548 - protein, 9 aa, Homo Sapiens
ALDTQSRPK

SEQ ID NO: 172549 - protein, 9 aa, Homo Sapiens
WVVSHIGSS

SEQ ID NO: 172550 - protein, 9 aa, Homo Sapiens
QPPQSLPPA

SEQ ID NO: 172551 - protein, 9 aa, Homo Sapiens
ICVVAAHLA

SEQ ID NO: 172552 - protein, 9 aa, Homo Sapiens
KLKYIKKIS

SEQ ID NO: 172553 - protein, 9 aa, Homo Sapiens
RTSLQQKLD

SEQ ID NO: 172554 - protein, 9 aa, Homo Sapiens
LRDVELEKR

SEQ ID NO: 172555 - protein, 9 aa, Homo Sapiens
RMQGLGFLL

SEQ ID NO: 172556 - protein, 9 aa, Homo Sapiens
LRPHTFKDL

SEQ ID NO: 172557 - protein, 9 aa, Homo Sapiens
VARAAEHQG

SEQ ID NO: 172558 - protein, 9 aa, Homo Sapiens
EKLALKEDL

SEQ ID NO: 172559 - protein, 9 aa, Homo Sapiens
WDSESWAYP

SEQ ID NO: 172560 - protein, 9 aa, Homo Sapiens
STAARARAG

SEQ ID NO: 172561 - protein, 9 aa, Homo Sapiens
SFHKLDFVL

SEQ ID NO: 172562 - protein, 9 aa, Homo Sapiens
VFYQNRHLI

SEQ ID NO: 172563 - protein, 9 aa, Homo Sapiens
PMAFLFHHH

SEQ ID NO: 172564 - protein, 9 aa, Homo Sapiens
CSLLTQPSP

SEQ ID NO: 172565 - protein, 9 aa, Homo Sapiens
SDHIVTCGA

SEQ ID NO: 172566 - protein, 9 aa, Homo Sapiens
SSPTRRRRQ

SEQ ID NO: 172567 - protein, 9 aa, Homo Sapiens
IGTFACICP

SEQ ID NO: 172568 - protein, 9 aa, Homo Sapiens
AGRRPLLQG

SEQ ID NO: 172569 - protein, 9 aa, Homo Sapiens
SCVDFLIQK

SEQ ID NO: 172570 - protein, 9 aa, Homo Sapiens
QGGERVAPE

SEQ ID NO: 172571 - protein, 9 aa, Homo Sapiens
TVCALDSDF

SEQ ID NO: 172572 - protein, 9 aa, Homo Sapiens
GIVVQRAEY

SEQ ID NO: 172573 - protein, 9 aa, Homo Sapiens
RYYMSAHHM

SEQ ID NO: 172574 - protein, 9 aa, Homo Sapiens
SFVQPCTCP

SEQ ID NO: 172575 - protein, 9 aa, Homo Sapiens
VEGLLGSLS

SEQ ID NO: 172576 - protein, 9 aa, Homo Sapiens
SRVVLDLPQ

SEQ ID NO: 172577 - protein, 9 aa, Homo Sapiens
PVTSEPPVL

SEQ ID NO: 172578 - protein, 9 aa, Homo Sapiens
IFAYLNHHV

SEQ ID NO: 172579 - protein, 9 aa, Homo Sapiens
GMDQDPFFL

SEQ ID NO: 172580 - protein, 9 aa, Homo Sapiens
EHEREVHAL

SEQ ID NO: 172581 - protein, 9 aa, Homo Sapiens
ACQGLGEPG

SEQ ID NO: 172582 - protein, 9 aa, Homo Sapiens
AVATTMSSA

SEQ ID NO: 172583 - protein, 9 aa, Homo Sapiens
PSWSPAASN

SEQ ID NO: 172584 - protein, 9 aa, Homo Sapiens
WVSVATLGP

SEQ ID NO: 172585 - protein, 9 aa, Homo Sapiens
HRTSQNHSK

SEQ ID NO: 172586 - protein, 9 aa, Homo Sapiens
PSRRARPAA

SEQ ID NO: 172587 - protein, 9 aa, Homo Sapiens
GPQAPERPR

SEQ ID NO: 172588 - protein, 9 aa, Homo Sapiens
MSTWTPGTG

SEQ ID NO: 172589 - protein, 9 aa, Homo Sapiens
TKAHSISKI

SEQ ID NO: 172590 - protein, 9 aa, Homo Sapiens
RPPKVPARC

SEQ ID NO: 172591 - protein, 9 aa, Homo Sapiens
TNFLPLLVE

SEQ ID NO: 172592 - protein, 9 aa, Homo Sapiens
GSQNNTSAM

SEQ ID NO: 172593 - protein, 9 aa, Homo Sapiens
WRNRLWHQH

SEQ ID NO: 172594 - protein, 9 aa, Homo Sapiens
CQLHQLEQM

SEQ ID NO: 172595 - protein, 9 aa, Homo Sapiens
QLGLRLLLL

SEQ ID NO: 172596 - protein, 9 aa, Homo Sapiens
HWSCCRRRC

SEQ ID NO: 172597 - protein, 9 aa, Homo Sapiens
NHTLTSLHL

SEQ ID NO: 172598 - protein, 9 aa, Homo Sapiens
SPRRRPCAS

SEQ ID NO: 172599 - protein, 9 aa, Homo Sapiens
QLHRWDPCM

SEQ ID NO: 172600 - protein, 9 aa, Homo Sapiens
MHCPTATAA

SEQ ID NO: 172601 - protein, 9 aa, Homo Sapiens
TPSPSPLPQ

SEQ ID NO: 172602 - protein, 9 aa, Homo Sapiens
AMSCTFRPT

SEQ ID NO: 172603 - protein, 9 aa, Homo Sapiens
IAALTLHLY

SEQ ID NO: 172604 - protein, 9 aa, Homo Sapiens
AEGSGDLEL

SEQ ID NO: 172605 - protein, 9 aa, Homo Sapiens
GWCTTAARR

SEQ ID NO: 172606 - protein, 9 aa, Homo Sapiens
HKAAPVPGE

SEQ ID NO: 172607 - protein, 9 aa, Homo Sapiens
APYAEENEC

SEQ ID NO: 172608 - protein, 9 aa, Homo Sapiens
RKLTALRRN

SEQ ID NO: 172609 - protein, 9 aa, Homo Sapiens
KSQKTCPQK

SEQ ID NO: 172610 - protein, 9 aa, Homo Sapiens
GGCVPGPDA

SEQ ID NO: 172611 - protein, 9 aa, Homo Sapiens
EEAVQQKAQ

SEQ ID NO: 172612 - protein, 9 aa, Homo Sapiens
LLHSTDMRP

SEQ ID NO: 172613 - protein, 9 aa, Homo Sapiens
RRPAHPLTP

SEQ ID NO: 172614 - protein, 9 aa, Homo Sapiens
QRAEYRPAA

SEQ ID NO: 172615 - protein, 9 aa, Homo Sapiens
DEETLICIV

SEQ ID NO: 172616 - protein, 9 aa, Homo Sapiens
FKPPSIYTI

SEQ ID NO: 172617 - protein, 9 aa, Homo Sapiens
ELAEQTATE

SEQ ID NO: 172618 - protein, 9 aa, Homo Sapiens
HHHRLPRWP

SEQ ID NO: 172619 - protein, 9 aa, Homo Sapiens
RLTTRVVLR

SEQ ID NO: 172620 - protein, 9 aa, Homo Sapiens
QESTERAAE

SEQ ID NO: 172621 - protein, 9 aa, Homo Sapiens
AERLRHTYA

SEQ ID NO: 172622 - protein, 9 aa, Homo Sapiens
YRPPLAPLL

SEQ ID NO: 172623 - protein, 9 aa, Homo Sapiens
ECMFARTHS

SEQ ID NO: 172624 - protein, 9 aa, Homo Sapiens
ASPQETATI

SEQ ID NO: 172625 - protein, 9 aa, Homo Sapiens
VHIADMSYF

SEQ ID NO: 172626 - protein, 9 aa, Homo Sapiens
EEIQKKMTS

SEQ ID NO: 172627 - protein, 9 aa, Homo Sapiens
LPQHALVCL

SEQ ID NO: 172628 - protein, 9 aa, Homo Sapiens
RWAASGGSG

SEQ ID NO: 172629 - protein, 9 aa, Homo Sapiens
TNCHTKIHH

SEQ ID NO: 172630 - protein, 9 aa, Homo Sapiens
VAPEQCDVH

SEQ ID NO: 172631 - protein, 9 aa, Homo Sapiens
SAHLWQRAV

SEQ ID NO: 172632 - protein, 9 aa, Homo Sapiens
TEPWLMGLT

SEQ ID NO: 172633 - protein, 9 aa, Homo Sapiens
AWLYPEISY

SEQ ID NO: 172634 - protein, 9 aa, Homo Sapiens
ERKAKSHQV

SEQ ID NO: 172635 - protein, 9 aa, Homo Sapiens
SILLLFIVY

SEQ ID NO: 172636 - protein, 9 aa, Homo Sapiens
DHVEGQGGE

SEQ ID NO: 172637 - protein, 9 aa, Homo Sapiens
HVMVKASNR

SEQ ID NO: 172638 - protein, 9 aa, Homo Sapiens
RELIYPKVL

SEQ ID NO: 172639 - protein, 9 aa, Homo Sapiens
KCDDFDKAF

SEQ ID NO: 172640 - protein, 9 aa, Homo Sapiens
PPRPLSTAS

SEQ ID NO: 172641 - protein, 9 aa, Homo Sapiens
LYMKPHMKI

SEQ ID NO: 172642 - protein, 9 aa, Homo Sapiens
RDRIKLLFS

SEQ ID NO: 172643 - protein, 9 aa, Homo Sapiens
RPLSLQCQS

SEQ ID NO: 172644 - protein, 9 aa, Homo Sapiens
GHVGDGNSH

SEQ ID NO: 172645 - protein, 9 aa, Homo Sapiens
CDTSTAKAA

SEQ ID NO: 172646 - protein, 9 aa, Homo Sapiens
GAQDLPSGL

SEQ ID NO: 172647 - protein, 9 aa, Homo Sapiens
GLETSQPPD

SEQ ID NO: 172648 - protein, 9 aa, Homo Sapiens
LPKKKKRKR

SEQ ID NO: 172649 - protein, 9 aa, Homo Sapiens
RNMLERGEA

SEQ ID NO: 172650 - protein, 9 aa, Homo Sapiens
TADQPILLR

SEQ ID NO: 172651 - protein, 9 aa, Homo Sapiens
NLFVPAFLN

SEQ ID NO: 172652 - protein, 9 aa, Homo Sapiens
RQRCWPLRW

SEQ ID NO: 172653 - protein, 9 aa, Homo Sapiens
LLNDNRLTR

SEQ ID NO: 172654 - protein, 9 aa, Homo Sapiens
FMSNVGDPM

SEQ ID NO: 172655 - protein, 9 aa, Homo Sapiens
GNVITADQP

SEQ ID NO: 172656 - protein, 9 aa, Homo Sapiens
VYQTVTHPG

SEQ ID NO: 172657 - protein, 9 aa, Homo Sapiens
RKSVHTVGF

SEQ ID NO: 172658 - protein, 9 aa, Homo Sapiens
PPARRPRAL

SEQ ID NO: 172659 - protein, 9 aa, Homo Sapiens
LLQSCILST

SEQ ID NO: 172660 - protein, 9 aa, Homo Sapiens
GYANTALNP

SEQ ID NO: 172661 - protein, 9 aa, Homo Sapiens
VHELGHTLG

SEQ ID NO: 172662 - protein, 9 aa, Homo Sapiens
HQFQGRDDI

SEQ ID NO: 172663 - protein, 9 aa, Homo Sapiens
LNIRVGRTG

SEQ ID NO: 172664 - protein, 9 aa, Homo Sapiens
VLCTSFMSF

SEQ ID NO: 172665 - protein, 9 aa, Homo Sapiens
TMATYPDGF

SEQ ID NO: 172666 - protein, 9 aa, Homo Sapiens
CIQALQWEV

SEQ ID NO: 172667 - protein, 9 aa, Homo Sapiens
VGGGACGTM

SEQ ID NO: 172668 - protein, 9 aa, Homo Sapiens
VSLRAHSTL

SEQ ID NO: 172669 - protein, 9 aa, Homo Sapiens
EHFLQVTCL

SEQ ID NO: 172670 - protein, 9 aa, Homo Sapiens
RHQRTHMGE

SEQ ID NO: 172671 - protein, 9 aa, Homo Sapiens
RRTVTCQIM

SEQ ID NO: 172672 - protein, 9 aa, Homo Sapiens
SGSTTSPWP

SEQ ID NO: 172673 - protein, 9 aa, Homo Sapiens
ALQAPPAWS

SEQ ID NO: 172674 - protein, 9 aa, Homo Sapiens
RSEGGRKSV

SEQ ID NO: 172675 - protein, 9 aa, Homo Sapiens
GRPVLLCCS

SEQ ID NO: 172676 - protein, 9 aa, Homo Sapiens
KMPKLHFAS

SEQ ID NO: 172677 - protein, 9 aa, Homo Sapiens
VPEFAAIPK

SEQ ID NO: 172678 - protein, 9 aa, Homo Sapiens
AVQVCCKRL

SEQ ID NO: 172679 - protein, 9 aa, Homo Sapiens
GALKHLQDF

SEQ ID NO: 172680 - protein, 9 aa, Homo Sapiens
EHHHSAHLW

SEQ ID NO: 172681 - protein, 9 aa, Homo Sapiens
EDYQTAEET

SEQ ID NO: 172682 - protein, 9 aa, Homo Sapiens
PGGSRRPHG

SEQ ID NO: 172683 - protein, 9 aa, Homo Sapiens
TPLSISRPT

SEQ ID NO: 172684 - protein, 9 aa, Homo Sapiens
LEKIGFWRH

SEQ ID NO: 172685 - protein, 9 aa, Homo Sapiens
SPWQVMASL

SEQ ID NO: 172686 - protein, 9 aa, Homo Sapiens
RSSKVTEHK

SEQ ID NO: 172687 - protein, 9 aa, Homo Sapiens
EEAQRKQFP

SEQ ID NO: 172688 - protein, 9 aa, Homo Sapiens
MGWCTQNNK

SEQ ID NO: 172689 - protein, 9 aa, Homo Sapiens
MSALTNKAI

SEQ ID NO: 172690 - protein, 9 aa, Homo Sapiens
DNEVQSSGP

SEQ ID NO: 172691 - protein, 9 aa, Homo Sapiens
RIQTLIYDT

SEQ ID NO: 172692 - protein, 9 aa, Homo Sapiens
KETCLNWVF

SEQ ID NO: 172693 - protein, 9 aa, Homo Sapiens
WASLVKGTL

SEQ ID NO: 172694 - protein, 9 aa, Homo Sapiens
PPPVLHCLL

SEQ ID NO: 172695 - protein, 9 aa, Homo Sapiens
AQRLRRARV

SEQ ID NO: 172696 - protein, 9 aa, Homo Sapiens
VNELFWMLH

SEQ ID NO: 172697 - protein, 9 aa, Homo Sapiens
LQLLGLVLL

SEQ ID NO: 172698 - protein, 9 aa, Homo Sapiens
ARWSPRPRR

SEQ ID NO: 172699 - protein, 9 aa, Homo Sapiens
SLDHGLKGT

SEQ ID NO: 172700 - protein, 9 aa, Homo Sapiens
MHKKLTACL

SEQ ID NO: 172701 - protein, 9 aa, Homo Sapiens
MKCLTFLML

SEQ ID NO: 172702 - protein, 9 aa, Homo Sapiens
YLRTSGEPW

SEQ ID NO: 172703 - protein, 9 aa, Homo Sapiens
PPCRLYRTR

SEQ ID NO: 172704 - protein, 9 aa, Homo Sapiens
GFQKGRGWD

SEQ ID NO: 172705 - protein, 9 aa, Homo Sapiens
HFSIWQHRE

SEQ ID NO: 172706 - protein, 9 aa, Homo Sapiens
MKGLNDALL

SEQ ID NO: 172707 - protein, 9 aa, Homo Sapiens
TITERNFPE

SEQ ID NO: 172708 - protein, 9 aa, Homo Sapiens
GASPMSLSW

SEQ ID NO: 172709 - protein, 9 aa, Homo Sapiens
DMEGAEPRQ

SEQ ID NO: 172710 - protein, 9 aa, Homo Sapiens
PPTSCPSWS

SEQ ID NO: 172711 - protein, 9 aa, Homo Sapiens
MRVHTGLHP

SEQ ID NO: 172712 - protein, 9 aa, Homo Sapiens
ETETQSTGE

SEQ ID NO: 172713 - protein, 9 aa, Homo Sapiens
DQIVFILVW

SEQ ID NO: 172714 - protein, 9 aa, Homo Sapiens
RSQKQGIMS

SEQ ID NO: 172715 - protein, 9 aa, Homo Sapiens
IDKDGNGED

SEQ ID NO: 172716 - protein, 9 aa, Homo Sapiens
VHTVGFPLF

SEQ ID NO: 172717 - protein, 9 aa, Homo Sapiens
QVPAHSPAS

SEQ ID NO: 172718 - protein, 9 aa, Homo Sapiens
LIGRRPAHP

SEQ ID NO: 172719 - protein, 9 aa, Homo Sapiens
FLPLLVEVQ

SEQ ID NO: 172720 - protein, 9 aa, Homo Sapiens
INLTISGHE

SEQ ID NO: 172721 - protein, 9 aa, Homo Sapiens
PSVSPVGPS

SEQ ID NO: 172722 - protein, 9 aa, Homo Sapiens
RGCLQCAVG

SEQ ID NO: 172723 - protein, 9 aa, Homo Sapiens
PVMVKTDAV

SEQ ID NO: 172724 - protein, 9 aa, Homo Sapiens
TPVNPRVSM

SEQ ID NO: 172725 - protein, 9 aa, Homo Sapiens
SSNLSRHVC

SEQ ID NO: 172726 - protein, 9 aa, Homo Sapiens
VLCAYFRPR

SEQ ID NO: 172727 - protein, 9 aa, Homo Sapiens
NSSSLKATT

SEQ ID NO: 172728 - protein, 9 aa, Homo Sapiens
HRTSENTHR

SEQ ID NO: 172729 - protein, 9 aa, Homo Sapiens
SSCVSTPGP

SEQ ID NO: 172730 - protein, 9 aa, Homo Sapiens
PWWSTTRTR

SEQ ID NO: 172731 - protein, 9 aa, Homo Sapiens
SVHTVGFPL

SEQ ID NO: 172732 - protein, 9 aa, Homo Sapiens
GSGQYGDKS

SEQ ID NO: 172733 - protein, 9 aa, Homo Sapiens
LTITERNFP

SEQ ID NO: 172734 - protein, 9 aa, Homo Sapiens
VAVATVETE

SEQ ID NO: 172735 - protein, 9 aa, Homo Sapiens
SSPTSWWAP

SEQ ID NO: 172736 - protein, 9 aa, Homo Sapiens
PRTLEGCIS

SEQ ID NO: 172737 - protein, 9 aa, Homo Sapiens
EEEELWISI

SEQ ID NO: 172738 - protein, 9 aa, Homo Sapiens
QTPPSRTMT

SEQ ID NO: 172739 - protein, 9 aa, Homo Sapiens
VAAGTRPPA

SEQ ID NO: 172740 - protein, 9 aa, Homo Sapiens
RTASLASVE

SEQ ID NO: 172741 - protein, 9 aa, Homo Sapiens
VVNQLGHLL

SEQ ID NO: 172742 - protein, 9 aa, Homo Sapiens
SGAVATTMS

SEQ ID NO: 172743 - protein, 9 aa, Homo Sapiens
KGDLFVNEL

SEQ ID NO: 172744 - protein, 9 aa, Homo Sapiens
DRIKLLFST

SEQ ID NO: 172745 - protein, 9 aa, Homo Sapiens
GGEITDDLD

SEQ ID NO: 172746 - protein, 9 aa, Homo Sapiens
PAPQGQGLP

SEQ ID NO: 172747 - protein, 9 aa, Homo Sapiens
TELLSMTSS

SEQ ID NO: 172748 - protein, 9 aa, Homo Sapiens
LSPAGRNHC

SEQ ID NO: 172749 - protein, 9 aa, Homo Sapiens
ASPRSGQWA

SEQ ID NO: 172750 - protein, 9 aa, Homo Sapiens
CQRERGRVL

SEQ ID NO: 172751 - protein, 9 aa, Homo Sapiens
HRFTRGRSE

SEQ ID NO: 172752 - protein, 9 aa, Homo Sapiens
QATRARSLR

SEQ ID NO: 172753 - protein, 9 aa, Homo Sapiens
GCSLSSDTV

SEQ ID NO: 172754 - protein, 9 aa, Homo Sapiens
KKVVTKWKK

SEQ ID NO: 172755 - protein, 9 aa, Homo Sapiens
ELKEKKLRL

SEQ ID NO: 172756 - protein, 9 aa, Homo Sapiens
CLPAGKWLY

SEQ ID NO: 172757 - protein, 9 aa, Homo Sapiens
TVRGDAPSQ

SEQ ID NO: 172758 - protein, 9 aa, Homo Sapiens
RGRSEGGRK

SEQ ID NO: 172759 - protein, 9 aa, Homo Sapiens
QRPMIVELG

SEQ ID NO: 172760 - protein, 9 aa, Homo Sapiens
LWLGPASVA

SEQ ID NO: 172761 - protein, 9 aa, Homo Sapiens
QLTTHLRSH

SEQ ID NO: 172762 - protein, 9 aa, Homo Sapiens
PPSASYSPS

SEQ ID NO: 172763 - protein, 9 aa, Homo Sapiens
APALSAGNF

SEQ ID NO: 172764 - protein, 9 aa, Homo Sapiens
RNPNDKHEP

SEQ ID NO: 172765 - protein, 9 aa, Homo Sapiens
RSMNLESLT

SEQ ID NO: 172766 - protein, 9 aa, Homo Sapiens
LWDLIGLQL

SEQ ID NO: 172767 - protein, 9 aa, Homo Sapiens
VKFQYLLSK

SEQ ID NO: 172768 - protein, 9 aa, Homo Sapiens
CQNPEKLAL

SEQ ID NO: 172769 - protein, 9 aa, Homo Sapiens
DKTDHIDTC

SEQ ID NO: 172770 - protein, 9 aa, Homo Sapiens
GAEVRKESR

SEQ ID NO: 172771 - protein, 9 aa, Homo Sapiens
SSWRSYPLP

SEQ ID NO: 172772 - protein, 9 aa, Homo Sapiens
FLRMPLMWQ

SEQ ID NO: 172773 - protein, 9 aa, Homo Sapiens
RGLTWYRSL

SEQ ID NO: 172774 - protein, 9 aa, Homo Sapiens
PPSCPQGTL

SEQ ID NO: 172775 - protein, 9 aa, Homo Sapiens
STRNWARRW

SEQ ID NO: 172776 - protein, 9 aa, Homo Sapiens
NPNDKHEPF

SEQ ID NO: 172777 - protein, 9 aa, Homo Sapiens
VSESPNRKM

SEQ ID NO: 172778 - protein, 9 aa, Homo Sapiens
EGNCSNYPA

SEQ ID NO: 172779 - protein, 9 aa, Homo Sapiens
LRNYSHYFR

SEQ ID NO: 172780 - protein, 9 aa, Homo Sapiens
RRKSSPTSW

SEQ ID NO: 172781 - protein, 9 aa, Homo Sapiens
KLGLTRSRM

SEQ ID NO: 172782 - protein, 9 aa, Homo Sapiens
LAHKLNLGR

SEQ ID NO: 172783 - protein, 9 aa, Homo Sapiens
MIESILYAW

SEQ ID NO: 172784 - protein, 9 aa, Homo Sapiens
RLTQRRAST

SEQ ID NO: 172785 - protein, 9 aa, Homo Sapiens
LELHIGNAL

SEQ ID NO: 172786 - protein, 9 aa, Homo Sapiens
GLGCGVCPL

SEQ ID NO: 172787 - protein, 9 aa, Homo Sapiens
TSATITNAN

SEQ ID NO: 172788 - protein, 9 aa, Homo Sapiens
RALGAGASA

SEQ ID NO: 172789 - protein, 9 aa, Homo Sapiens
CVCVSLNRK

SEQ ID NO: 172790 - protein, 9 aa, Homo Sapiens
EVTPHRTSE

SEQ ID NO: 172791 - protein, 9 aa, Homo Sapiens
SLWAWKGLW

SEQ ID NO: 172792 - protein, 9 aa, Homo Sapiens
TSPWWSTTR

SEQ ID NO: 172793 - protein, 9 aa, Homo Sapiens
QFTYREELR

SEQ ID NO: 172794 - protein, 9 aa, Homo Sapiens
FERVLLKWT

SEQ ID NO: 172795 - protein, 9 aa, Homo Sapiens
DRHKVIAEA

SEQ ID NO: 172796 - protein, 9 aa, Homo Sapiens
EGSRCAPAL

SEQ ID NO: 172797 - protein, 9 aa, Homo Sapiens
PLPCVQALM

SEQ ID NO: 172798 - protein, 9 aa, Homo Sapiens
FDEDLTRPS

SEQ ID NO: 172799 - protein, 9 aa, Homo Sapiens
YSSAISPKM

SEQ ID NO: 172800 - protein, 9 aa, Homo Sapiens
PIGSGHVTF

SEQ ID NO: 172801 - protein, 9 aa, Homo Sapiens
FLASGTVQA

SEQ ID NO: 172802 - protein, 9 aa, Homo Sapiens
QPARQARAQ

SEQ ID NO: 172803 - protein, 9 aa, Homo Sapiens
PRSATTTLH

SEQ ID NO: 172804 - protein, 9 aa, Homo Sapiens
VGVVDFPRA

SEQ ID NO: 172805 - protein, 9 aa, Homo Sapiens
VEVVKYSDM

SEQ ID NO: 172806 - protein, 9 aa, Homo Sapiens
YMYMARGLF

SEQ ID NO: 172807 - protein, 9 aa, Homo Sapiens
SLTRAVAAS

SEQ ID NO: 172808 - protein, 9 aa, Homo Sapiens
PRRAWRALL

SEQ ID NO: 172809 - protein, 9 aa, Homo Sapiens
GTGTRIAAA

SEQ ID NO: 172810 - protein, 9 aa, Homo Sapiens
WESLYPEVT

SEQ ID NO: 172811 - protein, 9 aa, Homo Sapiens
SEVVENAET

SEQ ID NO: 172812 - protein, 9 aa, Homo Sapiens
QGHFRTRQT

SEQ ID NO: 172813 - protein, 9 aa, Homo Sapiens
ISKTRNHST

SEQ ID NO: 172814 - protein, 9 aa, Homo Sapiens
LYMWSFCFS

SEQ ID NO: 172815 - protein, 9 aa, Homo Sapiens
GGPGQAAGR

SEQ ID NO: 172816 - protein, 9 aa, Homo Sapiens
GGGTPLSIS

SEQ ID NO: 172817 - protein, 9 aa, Homo Sapiens
GACAACLQR

SEQ ID NO: 172818 - protein, 9 aa, Homo Sapiens
NQKKQGNEQ

SEQ ID NO: 172819 - protein, 9 aa, Homo Sapiens
HLPSPPVRS

SEQ ID NO: 172820 - protein, 9 aa, Homo Sapiens
HPTPLCTPY

SEQ ID NO: 172821 - protein, 9 aa, Homo Sapiens
VRMKTPTVC

SEQ ID NO: 172822 - protein, 9 aa, Homo Sapiens
PVLHCLLTT

SEQ ID NO: 172823 - protein, 9 aa, Homo Sapiens
GLPLSPCLL

SEQ ID NO: 172824 - protein, 9 aa, Homo Sapiens
QGYLWFKCG

SEQ ID NO: 172825 - protein, 9 aa, Homo Sapiens
KAFSQASSY

SEQ ID NO: 172826 - protein, 9 aa, Homo Sapiens
IRVGRTGMF

SEQ ID NO: 172827 - protein, 9 aa, Homo Sapiens
EELHLKMKT

SEQ ID NO: 172828 - protein, 9 aa, Homo Sapiens
VTKWTIDEV

SEQ ID NO: 172829 - protein, 9 aa, Homo Sapiens
DVLRWWVDH

SEQ ID NO: 172830 - protein, 9 aa, Homo Sapiens
QPLPQQHRG

SEQ ID NO: 172831 - protein, 9 aa, Homo Sapiens
AWGWEGCWR

SEQ ID NO: 172832 - protein, 9 aa, Homo Sapiens
SLITPPQSS

SEQ ID NO: 172833 - protein, 9 aa, Homo Sapiens
AQWVSVATL

SEQ ID NO: 172834 - protein, 9 aa, Homo Sapiens
HRLPRWPPS

SEQ ID NO: 172835 - protein, 9 aa, Homo Sapiens
RWGWWVWGP

SEQ ID NO: 172836 - protein, 9 aa, Homo Sapiens
KLLLGFLVR

SEQ ID NO: 172837 - protein, 9 aa, Homo Sapiens
KKAYPSEKS

SEQ ID NO: 172838 - protein, 9 aa, Homo Sapiens
HCPTATAAC

SEQ ID NO: 172839 - protein, 9 aa, Homo Sapiens
GAPSLLAQW

SEQ ID NO: 172840 - protein, 9 aa, Homo Sapiens
CRKWCKREI

SEQ ID NO: 172841 - protein, 9 aa, Homo Sapiens
ATITNANPL

SEQ ID NO: 172842 - protein, 9 aa, Homo Sapiens
DALSIWPLT

SEQ ID NO: 172843 - protein, 9 aa, Homo Sapiens
SPLNQSVSR

SEQ ID NO: 172844 - protein, 9 aa, Homo Sapiens
KRETSEEIQ

SEQ ID NO: 172845 - protein, 9 aa, Homo Sapiens
SPTRRRRQR

SEQ ID NO: 172846 - protein, 9 aa, Homo Sapiens
WWAPPPSAS

SEQ ID NO: 172847 - protein, 9 aa, Homo Sapiens
VYLSRTAWT

SEQ ID NO: 172848 - protein, 9 aa, Homo Sapiens
KTPTVCGVL

SEQ ID NO: 172849 - protein, 9 aa, Homo Sapiens
LAYNCYGPG

SEQ ID NO: 172850 - protein, 9 aa, Homo Sapiens
RNVICQLLS

SEQ ID NO: 172851 - protein, 9 aa, Homo Sapiens
GGSRRPHGP

SEQ ID NO: 172852 - protein, 9 aa, Homo Sapiens
GSPRRRPCA

SEQ ID NO: 172853 - protein, 9 aa, Homo Sapiens
MPLLSDGNP

SEQ ID NO: 172854 - protein, 9 aa, Homo Sapiens
LGGLICLGY

SEQ ID NO: 172855 - protein, 9 aa, Homo Sapiens
TSWWRLGRW

SEQ ID NO: 172856 - protein, 9 aa, Homo Sapiens
SNISHKAAP

SEQ ID NO: 172857 - protein, 9 aa, Homo Sapiens
ELELHIGNA

SEQ ID NO: 172858 - protein, 9 aa, Homo Sapiens
ETEVAMEAK

SEQ ID NO: 172859 - protein, 9 aa, Homo Sapiens
ELWRVTGPA

SEQ ID NO: 172860 - protein, 9 aa, Homo Sapiens
HACGHSCPG

SEQ ID NO: 172861 - protein, 9 aa, Homo Sapiens
QAPGDSHGR

SEQ ID NO: 172862 - protein, 9 aa, Homo Sapiens
RTPEALRSR

SEQ ID NO: 172863 - protein, 9 aa, Homo Sapiens
RAHRQRVCG

SEQ ID NO: 172864 - protein, 9 aa, Homo Sapiens
PLACLHLPS

SEQ ID NO: 172865 - protein, 9 aa, Homo Sapiens
GLEGLRECG

SEQ ID NO: 172866 - protein, 9 aa, Homo Sapiens
VIGLGGGFM

SEQ ID NO: 172867 - protein, 9 aa, Homo Sapiens
HTDRHTGFS

SEQ ID NO: 172868 - protein, 9 aa, Homo Sapiens
DSKGMDQDP

SEQ ID NO: 172869 - protein, 9 aa, Homo Sapiens
RRSRHLPAL

SEQ ID NO: 172870 - protein, 9 aa, Homo Sapiens
KVTIVVSSL

SEQ ID NO: 172871 - protein, 9 aa, Homo Sapiens
LACQEDLSY

SEQ ID NO: 172872 - protein, 9 aa, Homo Sapiens
TQPSPASAC

SEQ ID NO: 172873 - protein, 9 aa, Homo Sapiens
TAGSKHKIS

SEQ ID NO: 172874 - protein, 9 aa, Homo Sapiens
SVAPATLPC

SEQ ID NO: 172875 - protein, 9 aa, Homo Sapiens
SAMKEGTAM

SEQ ID NO: 172876 - protein, 9 aa, Homo Sapiens
DPFLYFLIS

SEQ ID NO: 172877 - protein, 9 aa, Homo Sapiens
LTEDKKNGI

SEQ ID NO: 172878 - protein, 9 aa, Homo Sapiens
RGVRMKSVG

SEQ ID NO: 172879 - protein, 9 aa, Homo Sapiens
ARGVFVADE

SEQ ID NO: 172880 - protein, 9 aa, Homo Sapiens
DMFHQGLDK

SEQ ID NO: 172881 - protein, 9 aa, Homo Sapiens
LAWLYPEIS

SEQ ID NO: 172882 - protein, 9 aa, Homo Sapiens
GSQVAGDPD

SEQ ID NO: 172883 - protein, 9 aa, Homo Sapiens
LLAAQGGVA

SEQ ID NO: 172884 - protein, 9 aa, Homo Sapiens
VVCVCEVTY

SEQ ID NO: 172885 - protein, 9 aa, Homo Sapiens
SPLQRSFLV

SEQ ID NO: 172886 - protein, 9 aa, Homo Sapiens
DCQIRAFHL

SEQ ID NO: 172887 - protein, 9 aa, Homo Sapiens
IHTENRIGD

SEQ ID NO: 172888 - protein, 9 aa, Homo Sapiens
IHNIDHTQR

SEQ ID NO: 172889 - protein, 9 aa, Homo Sapiens
PAARWSPRP

SEQ ID NO: 172890 - protein, 9 aa, Homo Sapiens
PKVDLDVSG

SEQ ID NO: 172891 - protein, 9 aa, Homo Sapiens
LLYGDLPKI

SEQ ID NO: 172892 - protein, 9 aa, Homo Sapiens
SMAEEWYER

SEQ ID NO: 172893 - protein, 9 aa, Homo Sapiens
SLDSRVVLD

SEQ ID NO: 172894 - protein, 9 aa, Homo Sapiens
GAGLETSQP

SEQ ID NO: 172895 - protein, 9 aa, Homo Sapiens
TIFTSSTNG

SEQ ID NO: 172896 - protein, 9 aa, Homo Sapiens
PVWGKGLTS

SEQ ID NO: 172897 - protein, 9 aa, Homo Sapiens
HLFEWQWVD

SEQ ID NO: 172898 - protein, 9 aa, Homo Sapiens
RLSGIPTRA

SEQ ID NO: 172899 - protein, 9 aa, Homo Sapiens
TIQEDLKSA

SEQ ID NO: 172900 - protein, 9 aa, Homo Sapiens
AASPSSSMR

SEQ ID NO: 172901 - protein, 9 aa, Homo Sapiens
CLQRMDCGR

SEQ ID NO: 172902 - protein, 9 aa, Homo Sapiens
SEHVVSEFE

SEQ ID NO: 172903 - protein, 9 aa, Homo Sapiens
RFHSGLYTE

SEQ ID NO: 172904 - protein, 9 aa, Homo Sapiens
VNGAVANAA

SEQ ID NO: 172905 - protein, 9 aa, Homo Sapiens
CAVYAVQVC

SEQ ID NO: 172906 - protein, 9 aa, Homo Sapiens
RVINEPTTA

SEQ ID NO: 172907 - protein, 9 aa, Homo Sapiens
ELIHTRQLE

SEQ ID NO: 172908 - protein, 9 aa, Homo Sapiens
RHEVPPQLQ

SEQ ID NO: 172909 - protein, 9 aa, Homo Sapiens
ARPAAPQAR

SEQ ID NO: 172910 - protein, 9 aa, Homo Sapiens
CPATCEPSP

SEQ ID NO: 172911 - protein, 9 aa, Homo Sapiens
LVGRSQPGL

SEQ ID NO: 172912 - protein, 9 aa, Homo Sapiens
IESILYAWD

SEQ ID NO: 172913 - protein, 9 aa, Homo Sapiens
SGPRLGELP

SEQ ID NO: 172914 - protein, 9 aa, Homo Sapiens
LMEATQDWN

SEQ ID NO: 172915 - protein, 9 aa, Homo Sapiens
HLQDFLLSP

SEQ ID NO: 172916 - protein, 9 aa, Homo Sapiens
TTRVCQQVA

SEQ ID NO: 172917 - protein, 9 aa, Homo Sapiens
LRFEQEQME

SEQ ID NO: 172918 - protein, 9 aa, Homo Sapiens
VTIVVSSLD

SEQ ID NO: 172919 - protein, 9 aa, Homo Sapiens
HCKCCVIEH

SEQ ID NO: 172920 - protein, 9 aa, Homo Sapiens
VSHCVSPTW

SEQ ID NO: 172921 - protein, 9 aa, Homo Sapiens
DDYEEEELW

SEQ ID NO: 172922 - protein, 9 aa, Homo Sapiens
HSTFDALRK

SEQ ID NO: 172923 - protein, 9 aa, Homo Sapiens
WPTLNLSSG

SEQ ID NO: 172924 - protein, 9 aa, Homo Sapiens
NCKPKGNTI

SEQ ID NO: 172925 - protein, 9 aa, Homo Sapiens
TSWTATLPD

SEQ ID NO: 172926 - protein, 9 aa, Homo Sapiens
GMLNGEKVE

SEQ ID NO: 172927 - protein, 9 aa, Homo Sapiens
PCIKIPVVP

SEQ ID NO: 172928 - protein, 9 aa, Homo Sapiens
CDHDYDVLL

SEQ ID NO: 172929 - protein, 9 aa, Homo Sapiens
DLLEEFSEY

SEQ ID NO: 172930 - protein, 9 aa, Homo Sapiens
SCLQRLIRK

SEQ ID NO: 172931 - protein, 9 aa, Homo Sapiens
PEGRLSPAG

SEQ ID NO: 172932 - protein, 9 aa, Homo Sapiens
LRCTASASW

SEQ ID NO: 172933 - protein, 9 aa, Homo Sapiens
FLDLCSSPL

SEQ ID NO: 172934 - protein, 9 aa, Homo Sapiens
ARQSCCLPG

SEQ ID NO: 172935 - protein, 9 aa, Homo Sapiens
QRERGRVLV

SEQ ID NO: 172936 - protein, 9 aa, Homo Sapiens
KKSKKSSHC

SEQ ID NO: 172937 - protein, 9 aa, Homo Sapiens
SYRKSPRFC

SEQ ID NO: 172938 - protein, 9 aa, Homo Sapiens
LRRNKVTIV

SEQ ID NO: 172939 - protein, 9 aa, Homo Sapiens
KNGIWEVMP

SEQ ID NO: 172940 - protein, 9 aa, Homo Sapiens
GHILMNGTL

SEQ ID NO: 172941 - protein, 9 aa, Homo Sapiens
NLQGGCLLL

SEQ ID NO: 172942 - protein, 9 aa, Homo Sapiens
FSETETQST

SEQ ID NO: 172943 - protein, 9 aa, Homo Sapiens
LLVTRLHCP

SEQ ID NO: 172944 - protein, 9 aa, Homo Sapiens
HISSLSKEG

SEQ ID NO: 172945 - protein, 9 aa, Homo Sapiens
GASAPLWAS

SEQ ID NO: 172946 - protein, 9 aa, Homo Sapiens
QVGTLSPSA

SEQ ID NO: 172947 - protein, 9 aa, Homo Sapiens
TLTDAAAEA

SEQ ID NO: 172948 - protein, 9 aa, Homo Sapiens
RCSQAPGDS

SEQ ID NO: 172949 - protein, 9 aa, Homo Sapiens
DKDKTDTLE

SEQ ID NO: 172950 - protein, 9 aa, Homo Sapiens
LFLLLVLLF

SEQ ID NO: 172951 - protein, 9 aa, Homo Sapiens
IVALMSSTI

SEQ ID NO: 172952 - protein, 9 aa, Homo Sapiens
LRRSGGCSL

SEQ ID NO: 172953 - protein, 9 aa, Homo Sapiens
NTTCKNPLE

SEQ ID NO: 172954 - protein, 9 aa, Homo Sapiens
YYNGFKVLN

SEQ ID NO: 172955 - protein, 9 aa, Homo Sapiens
CCCSSGYGS

SEQ ID NO: 172956 - protein, 9 aa, Homo Sapiens
YVGVREALF

SEQ ID NO: 172957 - protein, 9 aa, Homo Sapiens
NAETETLAV

SEQ ID NO: 172958 - protein, 9 aa, Homo Sapiens
GLWVCTAEC

SEQ ID NO: 172959 - protein, 9 aa, Homo Sapiens
TEQPPAPSQ

SEQ ID NO: 172960 - protein, 9 aa, Homo Sapiens
EDHQEIVLC

SEQ ID NO: 172961 - protein, 9 aa, Homo Sapiens
CSSPLCPSA

SEQ ID NO: 172962 - protein, 9 aa, Homo Sapiens
YKLQTKWML

SEQ ID NO: 172963 - protein, 9 aa, Homo Sapiens
RVCGLEEQV

SEQ ID NO: 172964 - protein, 9 aa, Homo Sapiens
SHGVCMGGR

SEQ ID NO: 172965 - protein, 9 aa, Homo Sapiens
HNSDISACT

SEQ ID NO: 172966 - protein, 9 aa, Homo Sapiens
GPPPLSSSL

SEQ ID NO: 172967 - protein, 9 aa, Homo Sapiens
FSQLPINII

SEQ ID NO: 172968 - protein, 9 aa, Homo Sapiens
SPRPRWRDQ

SEQ ID NO: 172969 - protein, 9 aa, Homo Sapiens
HALYEETEQ

SEQ ID NO: 172970 - protein, 9 aa, Homo Sapiens
PFLYFLISK

SEQ ID NO: 172971 - protein, 9 aa, Homo Sapiens
NQLGHLLHQ

SEQ ID NO: 172972 - protein, 9 aa, Homo Sapiens
AGIVCASLD

SEQ ID NO: 172973 - protein, 9 aa, Homo Sapiens
TFLMLPETV

SEQ ID NO: 172974 - protein, 9 aa, Homo Sapiens
VGAGLQDMG

SEQ ID NO: 172975 - protein, 9 aa, Homo Sapiens
NHPLDSPHI

SEQ ID NO: 172976 - protein, 9 aa, Homo Sapiens
CSYLPQWWE

SEQ ID NO: 172977 - protein, 9 aa, Homo Sapiens
GVIPSWQIR

SEQ ID NO: 172978 - protein, 9 aa, Homo Sapiens
ENVGHVIIG

SEQ ID NO: 172979 - protein, 9 aa, Homo Sapiens
GGWRNRLWH

SEQ ID NO: 172980 - protein, 9 aa, Homo Sapiens
VLGYKIDRQ

SEQ ID NO: 172981 - protein, 9 aa, Homo Sapiens
QTLIYDTLE

SEQ ID NO: 172982 - protein, 9 aa, Homo Sapiens
PQQEISVVH

SEQ ID NO: 172983 - protein, 9 aa, Homo Sapiens
LRVPREKRA

SEQ ID NO: 172984 - protein, 9 aa, Homo Sapiens
QGSMRAIRI

SEQ ID NO: 172985 - protein, 9 aa, Homo Sapiens
EQWKKVVTK

SEQ ID NO: 172986 - protein, 9 aa, Homo Sapiens
LTGQVVLQD

SEQ ID NO: 172987 - protein, 9 aa, Homo Sapiens
TEDWKKRHT

SEQ ID NO: 172988 - protein, 9 aa, Homo Sapiens
WFRLFHTAL

SEQ ID NO: 172989 - protein, 9 aa, Homo Sapiens
AETVRGDAP

SEQ ID NO: 172990 - protein, 9 aa, Homo Sapiens
NGSFTNCCE

SEQ ID NO: 172991 - protein, 9 aa, Homo Sapiens
EEESFQSCT

SEQ ID NO: 172992 - protein, 9 aa, Homo Sapiens
TGPDEEELY

SEQ ID NO: 172993 - protein, 9 aa, Homo Sapiens
VSKDEIDSA

SEQ ID NO: 172994 - protein, 9 aa, Homo Sapiens
LITQVYLSR

SEQ ID NO: 172995 - protein, 9 aa, Homo Sapiens
CWDLVLLNG

SEQ ID NO: 172996 - protein, 9 aa, Homo Sapiens
NSRGFGMAI

SEQ ID NO: 172997 - protein, 9 aa, Homo Sapiens
WKVLPTTMM

SEQ ID NO: 172998 - protein, 9 aa, Homo Sapiens
KCVDIILKK

SEQ ID NO: 172999 - protein, 9 aa, Homo Sapiens
RCTASASWL

SEQ ID NO: 173000 - protein, 9 aa, Homo Sapiens
ATGLADTGV

SEQ ID NO: 173001 - protein, 9 aa, Homo Sapiens
SRFLSTEGA

SEQ ID NO: 173002 - protein, 9 aa, Homo Sapiens
PPWSGPQAP

SEQ ID NO: 173003 - protein, 9 aa, Homo Sapiens
KEEQTPRIR

SEQ ID NO: 173004 - protein, 9 aa, Homo Sapiens
KDICRCHRM

SEQ ID NO: 173005 - protein, 9 aa, Homo Sapiens
LYGDLPKIK

SEQ ID NO: 173006 - protein, 9 aa, Homo Sapiens
HGSQKRTIS

SEQ ID NO: 173007 - protein, 9 aa, Homo Sapiens
EISVVHIHC

SEQ ID NO: 173008 - protein, 9 aa, Homo Sapiens
NGFKVLNMA

SEQ ID NO: 173009 - protein, 9 aa, Homo Sapiens
SNPATSSLA

SEQ ID NO: 173010 - protein, 9 aa, Homo Sapiens
VTLLLDMFH

SEQ ID NO: 173011 - protein, 9 aa, Homo Sapiens
VRILPGAPS

SEQ ID NO: 173012 - protein, 9 aa, Homo Sapiens
VPWTKMAGI

SEQ ID NO: 173013 - protein, 9 aa, Homo Sapiens
AVSHLESLS

SEQ ID NO: 173014 - protein, 9 aa, Homo Sapiens
LDLSKARFH

SEQ ID NO: 173015 - protein, 9 aa, Homo Sapiens
AKDMPLLSD

SEQ ID NO: 173016 - protein, 9 aa, Homo Sapiens
DGLASQEPG

SEQ ID NO: 173017 - protein, 9 aa, Homo Sapiens
SVATACVAH

SEQ ID NO: 173018 - protein, 9 aa, Homo Sapiens
NASSHPASA

SEQ ID NO: 173019 - protein, 9 aa, Homo Sapiens
KKTATKIYS

SEQ ID NO: 173020 - protein, 9 aa, Homo Sapiens
AAGMGGVGL

SEQ ID NO: 173021 - protein, 9 aa, Homo Sapiens
PALQAPPAW

SEQ ID NO: 173022 - protein, 9 aa, Homo Sapiens
AYMPPRSSS

SEQ ID NO: 173023 - protein, 9 aa, Homo Sapiens
ALVSRPKPP

SEQ ID NO: 173024 - protein, 9 aa, Homo Sapiens
EDLLYLRTS

SEQ ID NO: 173025 - protein, 9 aa, Homo Sapiens
EVATVAATE

SEQ ID NO: 173026 - protein, 9 aa, Homo Sapiens
AVIRRFEEC

SEQ ID NO: 173027 - protein, 9 aa, Homo Sapiens
VLRPWCPGL

SEQ ID NO: 173028 - protein, 9 aa, Homo Sapiens
LTTIDNVSG

SEQ ID NO: 173029 - protein, 9 aa, Homo Sapiens
KVVLPPSLP

SEQ ID NO: 173030 - protein, 9 aa, Homo Sapiens
DWAPKSDHI

SEQ ID NO: 173031 - protein, 9 aa, Homo Sapiens
LLQQDGQDG

SEQ ID NO: 173032 - protein, 9 aa, Homo Sapiens
HVYISVFIC

SEQ ID NO: 173033 - protein, 9 aa, Homo Sapiens
EDEQDARTA

SEQ ID NO: 173034 - protein, 9 aa, Homo Sapiens
YQVYNVFEP

SEQ ID NO: 173035 - protein, 9 aa, Homo Sapiens
LPTATTGES

SEQ ID NO: 173036 - protein, 9 aa, Homo Sapiens
PLDRCYSTP

SEQ ID NO: 173037 - protein, 9 aa, Homo Sapiens
EGYIDLGHE

SEQ ID NO: 173038 - protein, 9 aa, Homo Sapiens
EWETPVVCH

SEQ ID NO: 173039 - protein, 9 aa, Homo Sapiens
WARRWWPSW

SEQ ID NO: 173040 - protein, 9 aa, Homo Sapiens
CQIRAFHLQ

SEQ ID NO: 173041 - protein, 9 aa, Homo Sapiens
LTQPPQTAL

SEQ ID NO: 173042 - protein, 9 aa, Homo Sapiens
TSRGSSLQA

SEQ ID NO: 173043 - protein, 9 aa, Homo Sapiens
RSPHRHRPS

SEQ ID NO: 173044 - protein, 9 aa, Homo Sapiens
HLAPVQCLP

SEQ ID NO: 173045 - protein, 9 aa, Homo Sapiens
WLGSGQYGD

SEQ ID NO: 173046 - protein, 9 aa, Homo Sapiens
TAAPALSAG

SEQ ID NO: 173047 - protein, 9 aa, Homo Sapiens
PQATRARSL

SEQ ID NO: 173048 - protein, 9 aa, Homo Sapiens
YSAYMFPDA

SEQ ID NO: 173049 - protein, 9 aa, Homo Sapiens
TPAHVDVRA

SEQ ID NO: 173050 - protein, 9 aa, Homo Sapiens
IICLAFVPI

SEQ ID NO: 173051 - protein, 9 aa, Homo Sapiens
QLKKTGAEL

SEQ ID NO: 173052 - protein, 9 aa, Homo Sapiens
QPLLSSPRD

SEQ ID NO: 173053 - protein, 9 aa, Homo Sapiens
PPPAELPPA

SEQ ID NO: 173054 - protein, 9 aa, Homo Sapiens
YLDGVRRVA

SEQ ID NO: 173055 - protein, 9 aa, Homo Sapiens
MRTSSSMST

SEQ ID NO: 173056 - protein, 9 aa, Homo Sapiens
FFFSFFYFL

SEQ ID NO: 173057 - protein, 9 aa, Homo Sapiens
NHCRQLQGH

SEQ ID NO: 173058 - protein, 9 aa, Homo Sapiens
LALSGSNIG

SEQ ID NO: 173059 - protein, 9 aa, Homo Sapiens
WEADSGAGD

SEQ ID NO: 173060 - protein, 9 aa, Homo Sapiens
GGGGAGGST

SEQ ID NO: 173061 - protein, 9 aa, Homo Sapiens
EELWISINE

SEQ ID NO: 173062 - protein, 9 aa, Homo Sapiens
WGVGAAVMR

SEQ ID NO: 173063 - protein, 9 aa, Homo Sapiens
ASRPPQATR

SEQ ID NO: 173064 - protein, 9 aa, Homo Sapiens
VRDTPWTAS

SEQ ID NO: 173065 - protein, 9 aa, Homo Sapiens
MMCARGPGD

SEQ ID NO: 173066 - protein, 9 aa, Homo Sapiens
GFNASVGST

SEQ ID NO: 173067 - protein, 9 aa, Homo Sapiens
RKRGVDINV

SEQ ID NO: 173068 - protein, 9 aa, Homo Sapiens
QVGPAQLQA

SEQ ID NO: 173069 - protein, 9 aa, Homo Sapiens
LAKQGSWEG

SEQ ID NO: 173070 - protein, 9 aa, Homo Sapiens
LQRMDCGRC

SEQ ID NO: 173071 - protein, 9 aa, Homo Sapiens
RHLMEATQD

SEQ ID NO: 173072 - protein, 9 aa, Homo Sapiens
FDVLLLLAV

SEQ ID NO: 173073 - protein, 9 aa, Homo Sapiens
STANYENQK

SEQ ID NO: 173074 - protein, 9 aa, Homo Sapiens
PLQLALRSQ

SEQ ID NO: 173075 - protein, 9 aa, Homo Sapiens
AAEWRCGSM

SEQ ID NO: 173076 - protein, 9 aa, Homo Sapiens
AEGQWILTK

SEQ ID NO: 173077 - protein, 9 aa, Homo Sapiens
NSETPSGKI

SEQ ID NO: 173078 - protein, 9 aa, Homo Sapiens
YFLISKTRN

SEQ ID NO: 173079 - protein, 9 aa, Homo Sapiens
IECQHHKPP

SEQ ID NO: 173080 - protein, 9 aa, Homo Sapiens
HLKMKTLKV

SEQ ID NO: 173081 - protein, 9 aa, Homo Sapiens
ISSGCRNVS

SEQ ID NO: 173082 - protein, 9 aa, Homo Sapiens
LQFTYREEL

SEQ ID NO: 173083 - protein, 9 aa, Homo Sapiens
IVQNSFLLP

SEQ ID NO: 173084 - protein, 9 aa, Homo Sapiens
LWAWKGLWR

SEQ ID NO: 173085 - protein, 9 aa, Homo Sapiens
IRLTQRRAS

SEQ ID NO: 173086 - protein, 9 aa, Homo Sapiens
GSPPELKWP

SEQ ID NO: 173087 - protein, 9 aa, Homo Sapiens
RPPAMEAPR

SEQ ID NO: 173088 - protein, 9 aa, Homo Sapiens
DIFLGLSKR

SEQ ID NO: 173089 - protein, 9 aa, Homo Sapiens
PATPAVPST

SEQ ID NO: 173090 - protein, 9 aa, Homo Sapiens
ETETINHQL

SEQ ID NO: 173091 - protein, 9 aa, Homo Sapiens
EGLEGLREC

SEQ ID NO: 173092 - protein, 9 aa, Homo Sapiens
PLQPPQSLP

SEQ ID NO: 173093 - protein, 9 aa, Homo Sapiens
VLVTPGEKM

SEQ ID NO: 173094 - protein, 9 aa, Homo Sapiens
KNASSHPAS

SEQ ID NO: 173095 - protein, 9 aa, Homo Sapiens
GKGFIHNPH

SEQ ID NO: 173096 - protein, 9 aa, Homo Sapiens
SPVDTCIPK

SEQ ID NO: 173097 - protein, 9 aa, Homo Sapiens
SVPSIPEAS

SEQ ID NO: 173098 - protein, 9 aa, Homo Sapiens
FTPCCMRCP

SEQ ID NO: 173099 - protein, 9 aa, Homo Sapiens
APYLSLVNA

SEQ ID NO: 173100 - protein, 9 aa, Homo Sapiens
CALRVTLFQ

SEQ ID NO: 173101 - protein, 9 aa, Homo Sapiens
QYILEFNGG

SEQ ID NO: 173102 - protein, 9 aa, Homo Sapiens
LPKVAMAPG

SEQ ID NO: 173103 - protein, 9 aa, Homo Sapiens
PLGPPSPLP

SEQ ID NO: 173104 - protein, 9 aa, Homo Sapiens
TFSLLLLRP

SEQ ID NO: 173105 - protein, 9 aa, Homo Sapiens
ALLKITGRD

SEQ ID NO: 173106 - protein, 9 aa, Homo Sapiens
VITADQPIL

SEQ ID NO: 173107 - protein, 9 aa, Homo Sapiens
TPQQVVAVN

SEQ ID NO: 173108 - protein, 9 aa, Homo Sapiens
ILHAQAADK

SEQ ID NO: 173109 - protein, 9 aa, Homo Sapiens
VIVGHGHEA

SEQ ID NO: 173110 - protein, 9 aa, Homo Sapiens
CMLADLSLV

SEQ ID NO: 173111 - protein, 9 aa, Homo Sapiens
HGPQNGHFR

SEQ ID NO: 173112 - protein, 9 aa, Homo Sapiens
HYPHFWKDF

SEQ ID NO: 173113 - protein, 9 aa, Homo Sapiens
YHRNSVRFL

SEQ ID NO: 173114 - protein, 9 aa, Homo Sapiens
AAFHPRFHS

SEQ ID NO: 173115 - protein, 9 aa, Homo Sapiens
TPPEARGNG

SEQ ID NO: 173116 - protein, 9 aa, Homo Sapiens
ELSNESQPI

SEQ ID NO: 173117 - protein, 9 aa, Homo Sapiens
RGLPSPPPH

SEQ ID NO: 173118 - protein, 9 aa, Homo Sapiens
DHDYDVLLP

SEQ ID NO: 173119 - protein, 9 aa, Homo Sapiens
GMKKRASDS

SEQ ID NO: 173120 - protein, 9 aa, Homo Sapiens
PHICRRCNC

SEQ ID NO: 173121 - protein, 9 aa, Homo Sapiens
CRPACTCIS

SEQ ID NO: 173122 - protein, 9 aa, Homo Sapiens
DTWASRGTS

SEQ ID NO: 173123 - protein, 9 aa, Homo Sapiens
CEDDINCGP

SEQ ID NO: 173124 - protein, 9 aa, Homo Sapiens
KLLDHEEEV

SEQ ID NO: 173125 - protein, 9 aa, Homo Sapiens
LCLPQPTHR

SEQ ID NO: 173126 - protein, 9 aa, Homo Sapiens
SVRTSSAWT

SEQ ID NO: 173127 - protein, 9 aa, Homo Sapiens
ITQTEVQRG

SEQ ID NO: 173128 - protein, 9 aa, Homo Sapiens
DSCSLNWKM

SEQ ID NO: 173129 - protein, 9 aa, Homo Sapiens
GQARDLRCP

SEQ ID NO: 173130 - protein, 9 aa, Homo Sapiens
YCDTSTAKA

SEQ ID NO: 173131 - protein, 9 aa, Homo Sapiens
DGVLEEKLF

SEQ ID NO: 173132 - protein, 9 aa, Homo Sapiens
RRSRPQGLV

SEQ ID NO: 173133 - protein, 9 aa, Homo Sapiens
PVPGEAHGR

SEQ ID NO: 173134 - protein, 9 aa, Homo Sapiens
GQWAQPPFR

SEQ ID NO: 173135 - protein, 9 aa, Homo Sapiens
LPALEGLKP

SEQ ID NO: 173136 - protein, 9 aa, Homo Sapiens
RAIQRMQAE

SEQ ID NO: 173137 - protein, 9 aa, Homo Sapiens
GPKGPLALQ

SEQ ID NO: 173138 - protein, 9 aa, Homo Sapiens
WSPRPRRSF

SEQ ID NO: 173139 - protein, 9 aa, Homo Sapiens
PNDKHEPFW

SEQ ID NO: 173140 - protein, 9 aa, Homo Sapiens
LKEKPLHFP

SEQ ID NO: 173141 - protein, 9 aa, Homo Sapiens
TQLNTLQRH

SEQ ID NO: 173142 - protein, 9 aa, Homo Sapiens
EFNGGSRGK

SEQ ID NO: 173143 - protein, 9 aa, Homo Sapiens
CSRMNSKSA

SEQ ID NO: 173144 - protein, 9 aa, Homo Sapiens
GCSSQGRHT

SEQ ID NO: 173145 - protein, 9 aa, Homo Sapiens
AELWRVTGP

SEQ ID NO: 173146 - protein, 9 aa, Homo Sapiens
TSLSSGHIL

SEQ ID NO: 173147 - protein, 9 aa, Homo Sapiens
LDDITWYGW

SEQ ID NO: 173148 - protein, 9 aa, Homo Sapiens
FQLKKTGAE

SEQ ID NO: 173149 - protein, 9 aa, Homo Sapiens
PWIECQHHK

SEQ ID NO: 173150 - protein, 9 aa, Homo Sapiens
ANCEDDINC

SEQ ID NO: 173151 - protein, 9 aa, Homo Sapiens
GGCPQDPRL

SEQ ID NO: 173152 - protein, 9 aa, Homo Sapiens
GFRALLEKK

SEQ ID NO: 173153 - protein, 9 aa, Homo Sapiens
TSLEGVAAP

SEQ ID NO: 173154 - protein, 9 aa, Homo Sapiens
GRAPRVWEE

SEQ ID NO: 173155 - protein, 9 aa, Homo Sapiens
LPPRPLSTA

SEQ ID NO: 173156 - protein, 9 aa, Homo Sapiens
SCEACTRTS

SEQ ID NO: 173157 - protein, 9 aa, Homo Sapiens
MVCDITDLD

SEQ ID NO: 173158 - protein, 9 aa, Homo Sapiens
RRWRRRGRG

SEQ ID NO: 173159 - protein, 9 aa, Homo Sapiens
ARGEIHGDI

SEQ ID NO: 173160 - protein, 9 aa, Homo Sapiens
LSGFQGTSC

SEQ ID NO: 173161 - protein, 9 aa, Homo Sapiens
GCPQDPRLS

SEQ ID NO: 173162 - protein, 9 aa, Homo Sapiens
RRQWSLWVL

SEQ ID NO: 173163 - protein, 9 aa, Homo Sapiens
PARCRRRRA

SEQ ID NO: 173164 - protein, 9 aa, Homo Sapiens
THYKLTSTV

SEQ ID NO: 173165 - protein, 9 aa, Homo Sapiens
SLYRPPLAP

SEQ ID NO: 173166 - protein, 9 aa, Homo Sapiens
TAESLGTII

SEQ ID NO: 173167 - protein, 9 aa, Homo Sapiens
WSCGPNIIG

SEQ ID NO: 173168 - protein, 9 aa, Homo Sapiens
LTSAVTPLA

SEQ ID NO: 173169 - protein, 9 aa, Homo Sapiens
QGTTLSGWY

SEQ ID NO: 173170 - protein, 9 aa, Homo Sapiens
YYGKVTGST

SEQ ID NO: 173171 - protein, 9 aa, Homo Sapiens
NSQIKIFQN

SEQ ID NO: 173172 - protein, 9 aa, Homo Sapiens
AHSVCLARG

SEQ ID NO: 173173 - protein, 9 aa, Homo Sapiens
RAEYRPAAS

SEQ ID NO: 173174 - protein, 9 aa, Homo Sapiens
YMQDPLFVE

SEQ ID NO: 173175 - protein, 9 aa, Homo Sapiens
LATSSPTRR

SEQ ID NO: 173176 - protein, 9 aa, Homo Sapiens
SRWWSWQQD

SEQ ID NO: 173177 - protein, 9 aa, Homo Sapiens
YKTCRRPHP

SEQ ID NO: 173178 - protein, 9 aa, Homo Sapiens
PTLPRALAR

SEQ ID NO: 173179 - protein, 9 aa, Homo Sapiens
RSQRSWHGD

SEQ ID NO: 173180 - protein, 9 aa, Homo Sapiens
VGSNISHKA

SEQ ID NO: 173181 - protein, 9 aa, Homo Sapiens
PRRRPCASC

SEQ ID NO: 173182 - protein, 9 aa, Homo Sapiens
EVPRCAMAP

SEQ ID NO: 173183 - protein, 9 aa, Homo Sapiens
AHTDDQAST

SEQ ID NO: 173184 - protein, 9 aa, Homo Sapiens
FLNPPQGVG

SEQ ID NO: 173185 - protein, 9 aa, Homo Sapiens
LSQTTYVLI

SEQ ID NO: 173186 - protein, 9 aa, Homo Sapiens
WVCTAECKI

SEQ ID NO: 173187 - protein, 9 aa, Homo Sapiens
RKWYAYKQY

SEQ ID NO: 173188 - protein, 9 aa, Homo Sapiens
LRHHEWVHS

SEQ ID NO: 173189 - protein, 9 aa, Homo Sapiens
QWGRRRLFT

SEQ ID NO: 173190 - protein, 9 aa, Homo Sapiens
SGFIRMNKG

SEQ ID NO: 173191 - protein, 9 aa, Homo Sapiens
WRCGSMRDL

SEQ ID NO: 173192 - protein, 9 aa, Homo Sapiens
LVGLRLGEK

SEQ ID NO: 173193 - protein, 9 aa, Homo Sapiens
RGLQGVPPW

SEQ ID NO: 173194 - protein, 9 aa, Homo Sapiens
GVCMGGRVA

SEQ ID NO: 173195 - protein, 9 aa, Homo Sapiens
LKTRGQILF

SEQ ID NO: 173196 - protein, 9 aa, Homo Sapiens
PPMPPPANP

SEQ ID NO: 173197 - protein, 9 aa, Homo Sapiens
EIAKEVGQL

SEQ ID NO: 173198 - protein, 9 aa, Homo Sapiens
KNGVLVSAG

SEQ ID NO: 173199 - protein, 9 aa, Homo Sapiens
YMFPDALMC

SEQ ID NO: 173200 - protein, 9 aa, Homo Sapiens
QDSDGLYYL

SEQ ID NO: 173201 - protein, 9 aa, Homo Sapiens
QDKEGIPPT

SEQ ID NO: 173202 - protein, 9 aa, Homo Sapiens
LFANTVVHE

SEQ ID NO: 173203 - protein, 9 aa, Homo Sapiens
MSNVGDPMN

SEQ ID NO: 173204 - protein, 9 aa, Homo Sapiens
WEVAEEDLV

SEQ ID NO: 173205 - protein, 9 aa, Homo Sapiens
YVGHARAQA

SEQ ID NO: 173206 - protein, 9 aa, Homo Sapiens
AAATQTGKG

SEQ ID NO: 173207 - protein, 9 aa, Homo Sapiens
CSSGYGSSC

SEQ ID NO: 173208 - protein, 9 aa, Homo Sapiens
WPTAWASLA

SEQ ID NO: 173209 - protein, 9 aa, Homo Sapiens
NTVLQYVVG

SEQ ID NO: 173210 - protein, 9 aa, Homo Sapiens
PPEGDAHIS

SEQ ID NO: 173211 - protein, 9 aa, Homo Sapiens
DYVVSLGTE

SEQ ID NO: 173212 - protein, 9 aa, Homo Sapiens
GEALPLLLL

SEQ ID NO: 173213 - protein, 9 aa, Homo Sapiens
NLHHSWADE

SEQ ID NO: 173214 - protein, 9 aa, Homo Sapiens
RMLGSCCTA

SEQ ID NO: 173215 - protein, 9 aa, Homo Sapiens
MNKGPLEMI

SEQ ID NO: 173216 - protein, 9 aa, Homo Sapiens
QSSVLIQHQ

SEQ ID NO: 173217 - protein, 9 aa, Homo Sapiens
CCHSSLCRQ

SEQ ID NO: 173218 - protein, 9 aa, Homo Sapiens
EAVTTRVCQ

SEQ ID NO: 173219 - protein, 9 aa, Homo Sapiens
CSTPATLTL

SEQ ID NO: 173220 - protein, 9 aa, Homo Sapiens
GDHHHACGH

SEQ ID NO: 173221 - protein, 9 aa, Homo Sapiens
KSYALSNKN

SEQ ID NO: 173222 - protein, 9 aa, Homo Sapiens
NPTTLSSVI

SEQ ID NO: 173223 - protein, 9 aa, Homo Sapiens
AETLVTLGT

SEQ ID NO: 173224 - protein, 9 aa, Homo Sapiens
YALSNKNLL

SEQ ID NO: 173225 - protein, 9 aa, Homo Sapiens
ALMAEQLRL

SEQ ID NO: 173226 - protein, 9 aa, Homo Sapiens
WPRLDENKG

SEQ ID NO: 173227 - protein, 9 aa, Homo Sapiens
VTKTVEKNH

SEQ ID NO: 173228 - protein, 9 aa, Homo Sapiens
ARGLQVLAG

SEQ ID NO: 173229 - protein, 9 aa, Homo Sapiens
LTDDSPVNL

SEQ ID NO: 173230 - protein, 9 aa, Homo Sapiens
ASPAMSCTF

SEQ ID NO: 173231 - protein, 9 aa, Homo Sapiens
RLCGGLRGA

SEQ ID NO: 173232 - protein, 9 aa, Homo Sapiens
TTMSSAGDH

SEQ ID NO: 173233 - protein, 9 aa, Homo Sapiens
KGRVDNINT

SEQ ID NO: 173234 - protein, 9 aa, Homo Sapiens
AEGRRRTVP

SEQ ID NO: 173235 - protein, 9 aa, Homo Sapiens
TDLLGLHVH

SEQ ID NO: 173236 - protein, 9 aa, Homo Sapiens
RFTRGRSEG

SEQ ID NO: 173237 - protein, 9 aa, Homo Sapiens
FAEGRRRTV

SEQ ID NO: 173238 - protein, 9 aa, Homo Sapiens
AFLNRMNQC

SEQ ID NO: 173239 - protein, 9 aa, Homo Sapiens
LHGHLFHLI

SEQ ID NO: 173240 - protein, 9 aa, Homo Sapiens
RLKKDICRC

SEQ ID NO: 173241 - protein, 9 aa, Homo Sapiens
AGGVGETGR

SEQ ID NO: 173242 - protein, 9 aa, Homo Sapiens
QKIVKSKTV

SEQ ID NO: 173243 - protein, 9 aa, Homo Sapiens
ESEHEREVH

SEQ ID NO: 173244 - protein, 9 aa, Homo Sapiens
NSMAEEWYE

SEQ ID NO: 173245 - protein, 9 aa, Homo Sapiens
PQVGPAQLQ

SEQ ID NO: 173246 - protein, 9 aa, Homo Sapiens
LPHPPPVLH

SEQ ID NO: 173247 - protein, 9 aa, Homo Sapiens
GTYTIYINN

SEQ ID NO: 173248 - protein, 9 aa, Homo Sapiens
RTSGRGPPD

SEQ ID NO: 173249 - protein, 9 aa, Homo Sapiens
PLQQEAPAQ

SEQ ID NO: 173250 - protein, 9 aa, Homo Sapiens
RTRTEPGRE

SEQ ID NO: 173251 - protein, 9 aa, Homo Sapiens
RHLHHGWAS

SEQ ID NO: 173252 - protein, 9 aa, Homo Sapiens
VLVSAGDHH

SEQ ID NO: 173253 - protein, 9 aa, Homo Sapiens
VGENTTLHC

SEQ ID NO: 173254 - protein, 9 aa, Homo Sapiens
GMSVCSWPL

SEQ ID NO: 173255 - protein, 9 aa, Homo Sapiens
VLARALVLG

SEQ ID NO: 173256 - protein, 9 aa, Homo Sapiens
NIRVGRTGM

SEQ ID NO: 173257 - protein, 9 aa, Homo Sapiens
FCFSPLWLM

SEQ ID NO: 173258 - protein, 9 aa, Homo Sapiens
WSGPQAPER

SEQ ID NO: 173259 - protein, 9 aa, Homo Sapiens
AGPRQQKGW

SEQ ID NO: 173260 - protein, 9 aa, Homo Sapiens
PPRTPPHPA

SEQ ID NO: 173261 - protein, 9 aa, Homo Sapiens
LKKTRGQGP

SEQ ID NO: 173262 - protein, 9 aa, Homo Sapiens
CCNAVKLVA

SEQ ID NO: 173263 - protein, 9 aa, Homo Sapiens
GPASVAPAT

SEQ ID NO: 173264 - protein, 9 aa, Homo Sapiens
WQQDSFPTR

SEQ ID NO: 173265 - protein, 9 aa, Homo Sapiens
FRVHLAPVQ

SEQ ID NO: 173266 - protein, 9 aa, Homo Sapiens
CQPISTAEC

SEQ ID NO: 173267 - protein, 9 aa, Homo Sapiens
ETLRCPHLR

SEQ ID NO: 173268 - protein, 9 aa, Homo Sapiens
DLIGLQLLL

SEQ ID NO: 173269 - protein, 9 aa, Homo Sapiens
TQKLPVSQH

SEQ ID NO: 173270 - protein, 9 aa, Homo Sapiens
VEAIGFLGG

SEQ ID NO: 173271 - protein, 9 aa, Homo Sapiens
LCLPPQTLE

SEQ ID NO: 173272 - protein, 9 aa, Homo Sapiens
HLNAVLANV

SEQ ID NO: 173273 - protein, 9 aa, Homo Sapiens
FLEKPPASN

SEQ ID NO: 173274 - protein, 9 aa, Homo Sapiens
ATATTAATT

SEQ ID NO: 173275 - protein, 9 aa, Homo Sapiens
VPRPPAMEA

SEQ ID NO: 173276 - protein, 9 aa, Homo Sapiens
DHPPSPTSL

SEQ ID NO: 173277 - protein, 9 aa, Homo Sapiens
QVAGDPDVG

SEQ ID NO: 173278 - protein, 9 aa, Homo Sapiens
HLHQQPEGR

SEQ ID NO: 173279 - protein, 9 aa, Homo Sapiens
VYCLSQLCG

SEQ ID NO: 173280 - protein, 9 aa, Homo Sapiens
LRQVSLITP

SEQ ID NO: 173281 - protein, 9 aa, Homo Sapiens
KRRVALERY

SEQ ID NO: 173282 - protein, 9 aa, Homo Sapiens
FHLQHSDQG

SEQ ID NO: 173283 - protein, 9 aa, Homo Sapiens
TRDAHQGRP

SEQ ID NO: 173284 - protein, 9 aa, Homo Sapiens
NGSLWPTLN

SEQ ID NO: 173285 - protein, 9 aa, Homo Sapiens
LNDDAKHYS

SEQ ID NO: 173286 - protein, 9 aa, Homo Sapiens
EPATPAVPS

SEQ ID NO: 173287 - protein, 9 aa, Homo Sapiens
SREPIRDRC

SEQ ID NO: 173288 - protein, 9 aa, Homo Sapiens
QLQALPDPH

SEQ ID NO: 173289 - protein, 9 aa, Homo Sapiens
SIRSETLNL

SEQ ID NO: 173290 - protein, 9 aa, Homo Sapiens
APPTRCVWQ

SEQ ID NO: 173291 - protein, 9 aa, Homo Sapiens
RGRGRGRVG

SEQ ID NO: 173292 - protein, 9 aa, Homo Sapiens
HPRFHSSPD

SEQ ID NO: 173293 - protein, 9 aa, Homo Sapiens
PPIREVLAK

SEQ ID NO: 173294 - protein, 9 aa, Homo Sapiens
WQRLPPALM

SEQ ID NO: 173295 - protein, 9 aa, Homo Sapiens
VPLGKEGCF

SEQ ID NO: 173296 - protein, 9 aa, Homo Sapiens
FLEKGQDGQ

SEQ ID NO: 173297 - protein, 9 aa, Homo Sapiens
VVLVCATAM

SEQ ID NO: 173298 - protein, 9 aa, Homo Sapiens
QDHFLEKFG

SEQ ID NO: 173299 - protein, 9 aa, Homo Sapiens
YSRLREIIS

SEQ ID NO: 173300 - protein, 9 aa, Homo Sapiens
AILFHLHRK

SEQ ID NO: 173301 - protein, 9 aa, Homo Sapiens
PTAAPYLTS

SEQ ID NO: 173302 - protein, 9 aa, Homo Sapiens
KALLEVLGW

SEQ ID NO: 173303 - protein, 9 aa, Homo Sapiens
LYCQVTGTN

SEQ ID NO: 173304 - protein, 9 aa, Homo Sapiens
AVTLRYGHN

SEQ ID NO: 173305 - protein, 9 aa, Homo Sapiens
LDGVRRVAL

SEQ ID NO: 173306 - protein, 9 aa, Homo Sapiens
LTPHSQVSV

SEQ ID NO: 173307 - protein, 9 aa, Homo Sapiens
IQWLETLAT

SEQ ID NO: 173308 - protein, 9 aa, Homo Sapiens
ELERGVRMK

SEQ ID NO: 173309 - protein, 9 aa, Homo Sapiens
CVLQCKYML

SEQ ID NO: 173310 - protein, 9 aa, Homo Sapiens
AGDGHGRLV

SEQ ID NO: 173311 - protein, 9 aa, Homo Sapiens
PPGSSWRSY

SEQ ID NO: 173312 - protein, 9 aa, Homo Sapiens
VFSEWVCLK

SEQ ID NO: 173313 - protein, 9 aa, Homo Sapiens
HCKLQEDTN

SEQ ID NO: 173314 - protein, 9 aa, Homo Sapiens
VTCPRSLTR

SEQ ID NO: 173315 - protein, 9 aa, Homo Sapiens
KVTEHKIIH

SEQ ID NO: 173316 - protein, 9 aa, Homo Sapiens
ITADQPILL

SEQ ID NO: 173317 - protein, 9 aa, Homo Sapiens
PPTWLPARP

SEQ ID NO: 173318 - protein, 9 aa, Homo Sapiens
MGARPSCIG

SEQ ID NO: 173319 - protein, 9 aa, Homo Sapiens
ASNTAQRLR

SEQ ID NO: 173320 - protein, 9 aa, Homo Sapiens
LVGARAARH

SEQ ID NO: 173321 - protein, 9 aa, Homo Sapiens
LGNTGTILL

SEQ ID NO: 173322 - protein, 9 aa, Homo Sapiens
TPLCLPQPT

SEQ ID NO: 173323 - protein, 9 aa, Homo Sapiens
GLSPGACRP

SEQ ID NO: 173324 - protein, 9 aa, Homo Sapiens
DHLLNTQQP

SEQ ID NO: 173325 - protein, 9 aa, Homo Sapiens
LCAWVETFI

SEQ ID NO: 173326 - protein, 9 aa, Homo Sapiens
FASMDLKSQ

SEQ ID NO: 173327 - protein, 9 aa, Homo Sapiens
HDPSWRKRD

SEQ ID NO: 173328 - protein, 9 aa, Homo Sapiens
QAGGHIAAL

SEQ ID NO: 173329 - protein, 9 aa, Homo Sapiens
SPPPHPQVP

SEQ ID NO: 173330 - protein, 9 aa, Homo Sapiens
SEEIQKKMT

SEQ ID NO: 173331 - protein, 9 aa, Homo Sapiens
RHVCSHGDK

SEQ ID NO: 173332 - protein, 9 aa, Homo Sapiens
MLVMDCHHT

SEQ ID NO: 173333 - protein, 9 aa, Homo Sapiens
RSLKAGNVS

SEQ ID NO: 173334 - protein, 9 aa, Homo Sapiens
CSNYPAIIL

SEQ ID NO: 173335 - protein, 9 aa, Homo Sapiens
LRSSPKSYR

SEQ ID NO: 173336 - protein, 9 aa, Homo Sapiens
TRPLHRTTN

SEQ ID NO: 173337 - protein, 9 aa, Homo Sapiens
QYLDPPSTA

SEQ ID NO: 173338 - protein, 9 aa, Homo Sapiens
PVSQHTLKH

SEQ ID NO: 173339 - protein, 9 aa, Homo Sapiens
HSWADEEDE

SEQ ID NO: 173340 - protein, 9 aa, Homo Sapiens
RQLRAHFVK

SEQ ID NO: 173341 - protein, 9 aa, Homo Sapiens
RMQQMAVHL

SEQ ID NO: 173342 - protein, 9 aa, Homo Sapiens
EGIPIPRIT

SEQ ID NO: 173343 - protein, 9 aa, Homo Sapiens
VDTRAKVVL

SEQ ID NO: 173344 - protein, 9 aa, Homo Sapiens
QMYSITFTK

SEQ ID NO: 173345 - protein, 9 aa, Homo Sapiens
PISRCQSEP

SEQ ID NO: 173346 - protein, 9 aa, Homo Sapiens
RAEVQHAAH

SEQ ID NO: 173347 - protein, 9 aa, Homo Sapiens
MAIVGNYTA

SEQ ID NO: 173348 - protein, 9 aa, Homo Sapiens
KKQQKGWFP

SEQ ID NO: 173349 - protein, 9 aa, Homo Sapiens
SPRGCLQCA

SEQ ID NO: 173350 - protein, 9 aa, Homo Sapiens
PGPASSPGS

SEQ ID NO: 173351 - protein, 9 aa, Homo Sapiens
LPIPKQDTV

SEQ ID NO: 173352 - protein, 9 aa, Homo Sapiens
RLWPPVACC

SEQ ID NO: 173353 - protein, 9 aa, Homo Sapiens
ENQSILLLK

SEQ ID NO: 173354 - protein, 9 aa, Homo Sapiens
VLAKQGSWE

SEQ ID NO: 173355 - protein, 9 aa, Homo Sapiens
LPCMKQKGL

SEQ ID NO: 173356 - protein, 9 aa, Homo Sapiens
KLFPQCQPL

SEQ ID NO: 173357 - protein, 9 aa, Homo Sapiens
PGAQDLPSG

SEQ ID NO: 173358 - protein, 9 aa, Homo Sapiens
DSGSTTSPW

SEQ ID NO: 173359 - protein, 9 aa, Homo Sapiens
TSHRIRSRG

SEQ ID NO: 173360 - protein, 9 aa, Homo Sapiens
VESCQMDES

SEQ ID NO: 173361 - protein, 9 aa, Homo Sapiens
KTTPDCQIR

SEQ ID NO: 173362 - protein, 9 aa, Homo Sapiens
LLDMFHQGL

SEQ ID NO: 173363 - protein, 9 aa, Homo Sapiens
YGSSCCQSS

SEQ ID NO: 173364 - protein, 9 aa, Homo Sapiens
PYNLKQCKM

SEQ ID NO: 173365 - protein, 9 aa, Homo Sapiens
HSGCNTSDL

SEQ ID NO: 173366 - protein, 9 aa, Homo Sapiens
PEISYCQGT

SEQ ID NO: 173367 - protein, 9 aa, Homo Sapiens
FTYREELRD

SEQ ID NO: 173368 - protein, 9 aa, Homo Sapiens
PRPGRTTPV

SEQ ID NO: 173369 - protein, 9 aa, Homo Sapiens
PLFLRHLGI

SEQ ID NO: 173370 - protein, 9 aa, Homo Sapiens
LLLLSFRVF

SEQ ID NO: 173371 - protein, 9 aa, Homo Sapiens
PSPSAHSSA

SEQ ID NO: 173372 - protein, 9 aa, Homo Sapiens
WPTQTWTRL

SEQ ID NO: 173373 - protein, 9 aa, Homo Sapiens
INEPTTAAM

SEQ ID NO: 173374 - protein, 9 aa, Homo Sapiens
GGHHLSHVQ

SEQ ID NO: 173375 - protein, 9 aa, Homo Sapiens
SCCTATVGP

SEQ ID NO: 173376 - protein, 9 aa, Homo Sapiens
RGENVGHVI

SEQ ID NO: 173377 - protein, 9 aa, Homo Sapiens
RPHPVVTTT

SEQ ID NO: 173378 - protein, 9 aa, Homo Sapiens
IILKKCPTE

SEQ ID NO: 173379 - protein, 9 aa, Homo Sapiens
NCGPTWLPL

SEQ ID NO: 173380 - protein, 9 aa, Homo Sapiens
EEEAAKKKE

SEQ ID NO: 173381 - protein, 9 aa, Homo Sapiens
GFWIEMEQE

SEQ ID NO: 173382 - protein, 9 aa, Homo Sapiens
CPQDPRLSL

SEQ ID NO: 173383 - protein, 9 aa, Homo Sapiens
GIRQNTHIR

SEQ ID NO: 173384 - protein, 9 aa, Homo Sapiens
LSQPPPQAP

SEQ ID NO: 173385 - protein, 9 aa, Homo Sapiens
AITSCRLQH

SEQ ID NO: 173386 - protein, 9 aa, Homo Sapiens
TMVCNLALR

SEQ ID NO: 173387 - protein, 9 aa, Homo Sapiens
LVVVAAAVS

SEQ ID NO: 173388 - protein, 9 aa, Homo Sapiens
TAASGISSI

SEQ ID NO: 173389 - protein, 9 aa, Homo Sapiens
SPGEALPLL

SEQ ID NO: 173390 - protein, 9 aa, Homo Sapiens
EITDDLDVG

SEQ ID NO: 173391 - protein, 9 aa, Homo Sapiens
EDLSYEESD

SEQ ID NO: 173392 - protein, 9 aa, Homo Sapiens
PPGVSLSLS

SEQ ID NO: 173393 - protein, 9 aa, Homo Sapiens
RDRCSSIYR

SEQ ID NO: 173394 - protein, 9 aa, Homo Sapiens
QIEQLNRMK

SEQ ID NO: 173395 - protein, 9 aa, Homo Sapiens
LSHVQLWDL

SEQ ID NO: 173396 - protein, 9 aa, Homo Sapiens
NQSVSRLFA

SEQ ID NO: 173397 - protein, 9 aa, Homo Sapiens
MVISGVLLV

SEQ ID NO: 173398 - protein, 9 aa, Homo Sapiens
IVADFLQVL

SEQ ID NO: 173399 - protein, 9 aa, Homo Sapiens
QQGESHLSP

SEQ ID NO: 173400 - protein, 9 aa, Homo Sapiens
LTAKRETSE

SEQ ID NO: 173401 - protein, 9 aa, Homo Sapiens
ARLVSKARP

SEQ ID NO: 173402 - protein, 9 aa, Homo Sapiens
TISNEWFCC

SEQ ID NO: 173403 - protein, 9 aa, Homo Sapiens
TVHAEFPTG

SEQ ID NO: 173404 - protein, 9 aa, Homo Sapiens
CLGPTRPLH

SEQ ID NO: 173405 - protein, 9 aa, Homo Sapiens
HTGLHPYQC

SEQ ID NO: 173406 - protein, 9 aa, Homo Sapiens
YPDGFRLEG

SEQ ID NO: 173407 - protein, 9 aa, Homo Sapiens
PVRLQLFEV

SEQ ID NO: 173408 - protein, 9 aa, Homo Sapiens
YPPARQPSR

SEQ ID NO: 173409 - protein, 9 aa, Homo Sapiens
KLHTDSQSE

SEQ ID NO: 173410 - protein, 9 aa, Homo Sapiens
PDTWASRGT

SEQ ID NO: 173411 - protein, 9 aa, Homo Sapiens
KIPVVPPTT

SEQ ID NO: 173412 - protein, 9 aa, Homo Sapiens
TISCPFQSP

SEQ ID NO: 173413 - protein, 9 aa, Homo Sapiens
RSRRSSRAP

SEQ ID NO: 173414 - protein, 9 aa, Homo Sapiens
EEVGGVPGP

SEQ ID NO: 173415 - protein, 9 aa, Homo Sapiens
TSFMSFGVK

SEQ ID NO: 173416 - protein, 9 aa, Homo Sapiens
FFMEAKPWL

SEQ ID NO: 173417 - protein, 9 aa, Homo Sapiens
SCNYSVLCQ

SEQ ID NO: 173418 - protein, 9 aa, Homo Sapiens
VLHFSTSPS

SEQ ID NO: 173419 - protein, 9 aa, Homo Sapiens
TACSCSLAV

SEQ ID NO: 173420 - protein, 9 aa, Homo Sapiens
QFCIWDPVL

SEQ ID NO: 173421 - protein, 9 aa, Homo Sapiens
PTGECKDLI

SEQ ID NO: 173422 - protein, 9 aa, Homo Sapiens
MTPTCPLEK

SEQ ID NO: 173423 - protein, 9 aa, Homo Sapiens
LPQPLAEPF

SEQ ID NO: 173424 - protein, 9 aa, Homo Sapiens
LWQRAVQKL

SEQ ID NO: 173425 - protein, 9 aa, Homo Sapiens
SRTRVLMVN

SEQ ID NO: 173426 - protein, 9 aa, Homo Sapiens
QHHRAPGGP

SEQ ID NO: 173427 - protein, 9 aa, Homo Sapiens
KDLKLADFV

SEQ ID NO: 173428 - protein, 9 aa, Homo Sapiens
FTGRSSLAV

SEQ ID NO: 173429 - protein, 9 aa, Homo Sapiens
LLANAQGTW

SEQ ID NO: 173430 - protein, 9 aa, Homo Sapiens
SRRNVICQL

SEQ ID NO: 173431 - protein, 9 aa, Homo Sapiens
FLVSAFLNR

SEQ ID NO: 173432 - protein, 9 aa, Homo Sapiens
NSIEERCIH

SEQ ID NO: 173433 - protein, 9 aa, Homo Sapiens
DITWYGWHG

SEQ ID NO: 173434 - protein, 9 aa, Homo Sapiens
GQDVAGPRQ

SEQ ID NO: 173435 - protein, 9 aa, Homo Sapiens
GNFNWCFLF

SEQ ID NO: 173436 - protein, 9 aa, Homo Sapiens
KLKMTRPLY

SEQ ID NO: 173437 - protein, 9 aa, Homo Sapiens
FRLDMLKTK

SEQ ID NO: 173438 - protein, 9 aa, Homo Sapiens
RMLFVTPRQ

SEQ ID NO: 173439 - protein, 9 aa, Homo Sapiens
HGDQRGQDR

SEQ ID NO: 173440 - protein, 9 aa, Homo Sapiens
SSLAVHQVI

SEQ ID NO: 173441 - protein, 9 aa, Homo Sapiens
IICQEEGLH

SEQ ID NO: 173442 - protein, 9 aa, Homo Sapiens
DSPVNLLCA

SEQ ID NO: 173443 - protein, 9 aa, Homo Sapiens
SAACGGRER

SEQ ID NO: 173444 - protein, 9 aa, Homo Sapiens
TIFLNMRGL

SEQ ID NO: 173445 - protein, 9 aa, Homo Sapiens
AAHSCQALS

SEQ ID NO: 173446 - protein, 9 aa, Homo Sapiens
PSVSSATSS

SEQ ID NO: 173447 - protein, 9 aa, Homo Sapiens
RGQQQFSQF

SEQ ID NO: 173448 - protein, 9 aa, Homo Sapiens
TAPVCGKKH

SEQ ID NO: 173449 - protein, 9 aa, Homo Sapiens
QDTVPPVPA

SEQ ID NO: 173450 - protein, 9 aa, Homo Sapiens
AATGYMCKS

SEQ ID NO: 173451 - protein, 9 aa, Homo Sapiens
LESFEELEY

SEQ ID NO: 173452 - protein, 9 aa, Homo Sapiens
TSILLLFIV

SEQ ID NO: 173453 - protein, 9 aa, Homo Sapiens
VLWLGYANT

SEQ ID NO: 173454 - protein, 9 aa, Homo Sapiens
HGQWRLIFE

SEQ ID NO: 173455 - protein, 9 aa, Homo Sapiens
LYFLISKTR

SEQ ID NO: 173456 - protein, 9 aa, Homo Sapiens
QEIVLCQLV

SEQ ID NO: 173457 - protein, 9 aa, Homo Sapiens
RANSESESD

SEQ ID NO: 173458 - protein, 9 aa, Homo Sapiens
TDIDSFIQA

SEQ ID NO: 173459 - protein, 9 aa, Homo Sapiens
GRGIRQNTH

SEQ ID NO: 173460 - protein, 9 aa, Homo Sapiens
AVKKAGRAQ

SEQ ID NO: 173461 - protein, 9 aa, Homo Sapiens
LVNSSWGTR

SEQ ID NO: 173462 - protein, 9 aa, Homo Sapiens
DIWDVNTNS

SEQ ID NO: 173463 - protein, 9 aa, Homo Sapiens
PLGLHSSIQ

SEQ ID NO: 173464 - protein, 9 aa, Homo Sapiens
LLPTTNSVW

SEQ ID NO: 173465 - protein, 9 aa, Homo Sapiens
PDFKRVCTV

SEQ ID NO: 173466 - protein, 9 aa, Homo Sapiens
EGFLVQWEL

SEQ ID NO: 173467 - protein, 9 aa, Homo Sapiens
FKENRETSP

SEQ ID NO: 173468 - protein, 9 aa, Homo Sapiens
IERAKARLV

SEQ ID NO: 173469 - protein, 9 aa, Homo Sapiens
PAPQPLLSS

SEQ ID NO: 173470 - protein, 9 aa, Homo Sapiens
NYLTTKTSL

SEQ ID NO: 173471 - protein, 9 aa, Homo Sapiens
MDSFDEDLT

SEQ ID NO: 173472 - protein, 9 aa, Homo Sapiens
WLKAVQVLV

SEQ ID NO: 173473 - protein, 9 aa, Homo Sapiens
VVQQVPHEE

SEQ ID NO: 173474 - protein, 9 aa, Homo Sapiens
EMVESCQMD

SEQ ID NO: 173475 - protein, 9 aa, Homo Sapiens
MQFSGSMHT

SEQ ID NO: 173476 - protein, 9 aa, Homo Sapiens
QPRSGWRTA

SEQ ID NO: 173477 - protein, 9 aa, Homo Sapiens
RGVFVADEI

SEQ ID NO: 173478 - protein, 9 aa, Homo Sapiens
MTRPLYFQR

SEQ ID NO: 173479 - protein, 9 aa, Homo Sapiens
RGVDINVEP

SEQ ID NO: 173480 - protein, 9 aa, Homo Sapiens
PTTNSVWLL

SEQ ID NO: 173481 - protein, 9 aa, Homo Sapiens
TLTLAVAPL

SEQ ID NO: 173482 - protein, 9 aa, Homo Sapiens
GTVILGCMV

SEQ ID NO: 173483 - protein, 9 aa, Homo Sapiens
PGPAAGGCP

SEQ ID NO: 173484 - protein, 9 aa, Homo Sapiens
PGQAAGRGG

SEQ ID NO: 173485 - protein, 9 aa, Homo Sapiens
TENDNTMLL

SEQ ID NO: 173486 - protein, 9 aa, Homo Sapiens
VFKPKGANR

SEQ ID NO: 173487 - protein, 9 aa, Homo Sapiens
MTLPAPTAC

SEQ ID NO: 173488 - protein, 9 aa, Homo Sapiens
QVVLQDHFL

SEQ ID NO: 173489 - protein, 9 aa, Homo Sapiens
SSCPMVRVF

SEQ ID NO: 173490 - protein, 9 aa, Homo Sapiens
STPGPASTA

SEQ ID NO: 173491 - protein, 9 aa, Homo Sapiens
GRGENVGHV

SEQ ID NO: 173492 - protein, 9 aa, Homo Sapiens
ATAAAAATS

SEQ ID NO: 173493 - protein, 9 aa, Homo Sapiens
LKMTRPLYF

SEQ ID NO: 173494 - protein, 9 aa, Homo Sapiens
MGERPYKCP

SEQ ID NO: 173495 - protein, 9 aa, Homo Sapiens
SFNVILQIG

SEQ ID NO: 173496 - protein, 9 aa, Homo Sapiens
TIAPSTEWW

SEQ ID NO: 173497 - protein, 9 aa, Homo Sapiens
QLKANTGAW

SEQ ID NO: 173498 - protein, 9 aa, Homo Sapiens
VVPQIQASN

SEQ ID NO: 173499 - protein, 9 aa, Homo Sapiens
RGLTPLARV

SEQ ID NO: 173500 - protein, 9 aa, Homo Sapiens
GAWASRWWS

SEQ ID NO: 173501 - protein, 9 aa, Homo Sapiens
VVDFPRAEA

SEQ ID NO: 173502 - protein, 9 aa, Homo Sapiens
EAMHKVSQM

SEQ ID NO: 173503 - protein, 9 aa, Homo Sapiens
LTTHLRSHS

SEQ ID NO: 173504 - protein, 9 aa, Homo Sapiens
LAWPVPSVS

SEQ ID NO: 173505 - protein, 9 aa, Homo Sapiens
LITEPNQRT

SEQ ID NO: 173506 - protein, 9 aa, Homo Sapiens
TPMVRRATA

SEQ ID NO: 173507 - protein, 9 aa, Homo Sapiens
GGVGKTACS

SEQ ID NO: 173508 - protein, 9 aa, Homo Sapiens
ERFGCRRVI

SEQ ID NO: 173509 - protein, 9 aa, Homo Sapiens
TSEDKVAQS

SEQ ID NO: 173510 - protein, 9 aa, Homo Sapiens
RKCVDIILK

SEQ ID NO: 173511 - protein, 9 aa, Homo Sapiens
PRHRLQRRQ

SEQ ID NO: 173512 - protein, 9 aa, Homo Sapiens
PALVIYQTL

SEQ ID NO: 173513 - protein, 9 aa, Homo Sapiens
GTFACICPP

SEQ ID NO: 173514 - protein, 9 aa, Homo Sapiens
QRMQAEIDN

SEQ ID NO: 173515 - protein, 9 aa, Homo Sapiens
WLSICLYTF

SEQ ID NO: 173516 - protein, 9 aa, Homo Sapiens
PAQTRWCWS

SEQ ID NO: 173517 - protein, 9 aa, Homo Sapiens
AVAAWGWEG

SEQ ID NO: 173518 - protein, 9 aa, Homo Sapiens
CNVTLGAKT

SEQ ID NO: 173519 - protein, 9 aa, Homo Sapiens
GKDEEITET

SEQ ID NO: 173520 - protein, 9 aa, Homo Sapiens
PYCDTSTAK

SEQ ID NO: 173521 - protein, 9 aa, Homo Sapiens
SNTAQRLRR

SEQ ID NO: 173522 - protein, 9 aa, Homo Sapiens
ASAKVAPQI

SEQ ID NO: 173523 - protein, 9 aa, Homo Sapiens
AREEAPGPL

SEQ ID NO: 173524 - protein, 9 aa, Homo Sapiens
AGKWLYHPA

SEQ ID NO: 173525 - protein, 9 aa, Homo Sapiens
FWIGVTSIL

SEQ ID NO: 173526 - protein, 9 aa, Homo Sapiens
ISGHEVVGI

SEQ ID NO: 173527 - protein, 9 aa, Homo Sapiens
WAPAPPTRC

SEQ ID NO: 173528 - protein, 9 aa, Homo Sapiens
SGIKMSEVN

SEQ ID NO: 173529 - protein, 9 aa, Homo Sapiens
SVEEPGEEV

SEQ ID NO: 173530 - protein, 9 aa, Homo Sapiens
LAQWFTPCC

SEQ ID NO: 173531 - protein, 9 aa, Homo Sapiens
PTCSFVQPC

SEQ ID NO: 173532 - protein, 9 aa, Homo Sapiens
DGHSRLSSV

SEQ ID NO: 173533 - protein, 9 aa, Homo Sapiens
KKDICRCHR

SEQ ID NO: 173534 - protein, 9 aa, Homo Sapiens
WAARVAHIV

SEQ ID NO: 173535 - protein, 9 aa, Homo Sapiens
LQGYDMSAF

SEQ ID NO: 173536 - protein, 9 aa, Homo Sapiens
LWMFLRILE

SEQ ID NO: 173537 - protein, 9 aa, Homo Sapiens
QERDRKFHE

SEQ ID NO: 173538 - protein, 9 aa, Homo Sapiens
LGLDKMLLT

SEQ ID NO: 173539 - protein, 9 aa, Homo Sapiens
GNLQSSPSM

SEQ ID NO: 173540 - protein, 9 aa, Homo Sapiens
MKMAGLNTI

SEQ ID NO: 173541 - protein, 9 aa, Homo Sapiens
PVCNKAYKC

SEQ ID NO: 173542 - protein, 9 aa, Homo Sapiens
PNRKMKRRR

SEQ ID NO: 173543 - protein, 9 aa, Homo Sapiens
HKYPIGSGH

SEQ ID NO: 173544 - protein, 9 aa, Homo Sapiens
DNINTLDSE

SEQ ID NO: 173545 - protein, 9 aa, Homo Sapiens
QSLQQAAAV

SEQ ID NO: 173546 - protein, 9 aa, Homo Sapiens
NLTNGVTAD

SEQ ID NO: 173547 - protein, 9 aa, Homo Sapiens
TQKHWVLQS

SEQ ID NO: 173548 - protein, 9 aa, Homo Sapiens
VLIPSSLRI

SEQ ID NO: 173549 - protein, 9 aa, Homo Sapiens
NLTISGHEV

SEQ ID NO: 173550 - protein, 9 aa, Homo Sapiens
ERGRGIRQN

SEQ ID NO: 173551 - protein, 9 aa, Homo Sapiens
YLNTASSSA

SEQ ID NO: 173552 - protein, 9 aa, Homo Sapiens
SEKIEVWRE

SEQ ID NO: 173553 - protein, 9 aa, Homo Sapiens
NIDAVIRRF

SEQ ID NO: 173554 - protein, 9 aa, Homo Sapiens
WAASGGSGS

SEQ ID NO: 173555 - protein, 9 aa, Homo Sapiens
LEAVSQLLN

SEQ ID NO: 173556 - protein, 9 aa, Homo Sapiens
MIYVIYFDF

SEQ ID NO: 173557 - protein, 9 aa, Homo Sapiens
PPRPAPQPL

SEQ ID NO: 173558 - protein, 9 aa, Homo Sapiens
LHTDSQSEA

SEQ ID NO: 173559 - protein, 9 aa, Homo Sapiens
SHVTMLQRQ

SEQ ID NO: 173560 - protein, 9 aa, Homo Sapiens
RSQQPKCKC

SEQ ID NO: 173561 - protein, 9 aa, Homo Sapiens
KVCYPERIT

SEQ ID NO: 173562 - protein, 9 aa, Homo Sapiens
RDVELEKRL

SEQ ID NO: 173563 - protein, 9 aa, Homo Sapiens
QLQLQVVKE

SEQ ID NO: 173564 - protein, 9 aa, Homo Sapiens
QKRKEENAM

SEQ ID NO: 173565 - protein, 9 aa, Homo Sapiens
EKLQVEEQK

SEQ ID NO: 173566 - protein, 9 aa, Homo Sapiens
VENFWGEKI

SEQ ID NO: 173567 - protein, 9 aa, Homo Sapiens
ILQAFSQLP

SEQ ID NO: 173568 - protein, 9 aa, Homo Sapiens
KDFIFVQKI

SEQ ID NO: 173569 - protein, 9 aa, Homo Sapiens
GDCCDNCPY

SEQ ID NO: 173570 - protein, 9 aa, Homo Sapiens
DVLVRRSHL

SEQ ID NO: 173571 - protein, 9 aa, Homo Sapiens
YPQQLFLLT

SEQ ID NO: 173572 - protein, 9 aa, Homo Sapiens
RPTVAFLPP

SEQ ID NO: 173573 - protein, 9 aa, Homo Sapiens
SLTPGPQSP

SEQ ID NO: 173574 - protein, 9 aa, Homo Sapiens
RSGGHSTDA

SEQ ID NO: 173575 - protein, 9 aa, Homo Sapiens
APQGALTPP

SEQ ID NO: 173576 - protein, 9 aa, Homo Sapiens
DCGKVFYQN

SEQ ID NO: 173577 - protein, 9 aa, Homo Sapiens
KTIKKIWLV

SEQ ID NO: 173578 - protein, 9 aa, Homo Sapiens
PSMTSPWWS

SEQ ID NO: 173579 - protein, 9 aa, Homo Sapiens
SVLIQHQRM

SEQ ID NO: 173580 - protein, 9 aa, Homo Sapiens
VPPQLPQAG

SEQ ID NO: 173581 - protein, 9 aa, Homo Sapiens
HLHDPSWRK

SEQ ID NO: 173582 - protein, 9 aa, Homo Sapiens
ARCQTLLGL

SEQ ID NO: 173583 - protein, 9 aa, Homo Sapiens
SVSSATSSA

SEQ ID NO: 173584 - protein, 9 aa, Homo Sapiens
QSPPIREVL

SEQ ID NO: 173585 - protein, 9 aa, Homo Sapiens
TLKRFPASS

SEQ ID NO: 173586 - protein, 9 aa, Homo Sapiens
IAYSAYMFP

SEQ ID NO: 173587 - protein, 9 aa, Homo Sapiens
PRSRHEVPP

SEQ ID NO: 173588 - protein, 9 aa, Homo Sapiens
FLSQTTYVL

SEQ ID NO: 173589 - protein, 9 aa, Homo Sapiens
HSPGPGLRP

SEQ ID NO: 173590 - protein, 9 aa, Homo Sapiens
DTVPPVPAA

SEQ ID NO: 173591 - protein, 9 aa, Homo Sapiens
VTGPAGVGG

SEQ ID NO: 173592 - protein, 9 aa, Homo Sapiens
VGVHIADMS

SEQ ID NO: 173593 - protein, 9 aa, Homo Sapiens
LGRRQVPLL

SEQ ID NO: 173594 - protein, 9 aa, Homo Sapiens
GPYSPRPPD

SEQ ID NO: 173595 - protein, 9 aa, Homo Sapiens
PHSAGLSPG

SEQ ID NO: 173596 - protein, 9 aa, Homo Sapiens
PPSTATSVN

SEQ ID NO: 173597 - protein, 9 aa, Homo Sapiens
SFEVCVCAC

SEQ ID NO: 173598 - protein, 9 aa, Homo Sapiens
SSVLIQHQR

SEQ ID NO: 173599 - protein, 9 aa, Homo Sapiens
HTYANGVRA

SEQ ID NO: 173600 - protein, 9 aa, Homo Sapiens
KKMQKRRAA

SEQ ID NO: 173601 - protein, 9 aa, Homo Sapiens
PLLPQARPS

SEQ ID NO: 173602 - protein, 9 aa, Homo Sapiens
PVNYVPQQE

SEQ ID NO: 173603 - protein, 9 aa, Homo Sapiens
PVLTPRAGS

SEQ ID NO: 173604 - protein, 9 aa, Homo Sapiens
TSHEATPHG

SEQ ID NO: 173605 - protein, 9 aa, Homo Sapiens
WFKCGARAH

SEQ ID NO: 173606 - protein, 9 aa, Homo Sapiens
TQVMQLQED

SEQ ID NO: 173607 - protein, 9 aa, Homo Sapiens
RMERERRKE

SEQ ID NO: 173608 - protein, 9 aa, Homo Sapiens
SVSRLFAPL

SEQ ID NO: 173609 - protein, 9 aa, Homo Sapiens
IDVSNEHML

SEQ ID NO: 173610 - protein, 9 aa, Homo Sapiens
MYTTCIICL

SEQ ID NO: 173611 - protein, 9 aa, Homo Sapiens
VDEHASPAS

SEQ ID NO: 173612 - protein, 9 aa, Homo Sapiens
STCVCLLGG

SEQ ID NO: 173613 - protein, 9 aa, Homo Sapiens
HFLRTLKER

SEQ ID NO: 173614 - protein, 9 aa, Homo Sapiens
KTTWGRWWR

SEQ ID NO: 173615 - protein, 9 aa, Homo Sapiens
VSGSFAESG

SEQ ID NO: 173616 - protein, 9 aa, Homo Sapiens
QVGLFHGNE

SEQ ID NO: 173617 - protein, 9 aa, Homo Sapiens
LPISRCQSE

SEQ ID NO: 173618 - protein, 9 aa, Homo Sapiens
NVVNNFFVT

SEQ ID NO: 173619 - protein, 9 aa, Homo Sapiens
ANNRQVCML

SEQ ID NO: 173620 - protein, 9 aa, Homo Sapiens
REIEHLSHL

SEQ ID NO: 173621 - protein, 9 aa, Homo Sapiens
LGPDWHTPH

SEQ ID NO: 173622 - protein, 9 aa, Homo Sapiens
SATGSCEAC

SEQ ID NO: 173623 - protein, 9 aa, Homo Sapiens
EHASPASPS

SEQ ID NO: 173624 - protein, 9 aa, Homo Sapiens
LWPRWHDTA

SEQ ID NO: 173625 - protein, 9 aa, Homo Sapiens
LLSESNKRL

SEQ ID NO: 173626 - protein, 9 aa, Homo Sapiens
SYPPARQPS

SEQ ID NO: 173627 - protein, 9 aa, Homo Sapiens
QARMDSQDT

SEQ ID NO: 173628 - protein, 9 aa, Homo Sapiens
HPLGDTPQP

SEQ ID NO: 173629 - protein, 9 aa, Homo Sapiens
FHTDRHTGF

SEQ ID NO: 173630 - protein, 9 aa, Homo Sapiens
VGRSQPGLY

SEQ ID NO: 173631 - protein, 9 aa, Homo Sapiens
PSTEWWTMV

SEQ ID NO: 173632 - protein, 9 aa, Homo Sapiens
VLCQSAVID

SEQ ID NO: 173633 - protein, 9 aa, Homo Sapiens
SLLITLQGQ

SEQ ID NO: 173634 - protein, 9 aa, Homo Sapiens
NAFAEKMDF

SEQ ID NO: 173635 - protein, 9 aa, Homo Sapiens
AEVRKESRG

SEQ ID NO: 173636 - protein, 9 aa, Homo Sapiens
PQETATISR

SEQ ID NO: 173637 - protein, 9 aa, Homo Sapiens
QQLTTHLRS

SEQ ID NO: 173638 - protein, 9 aa, Homo Sapiens
TPPSVRTSS

SEQ ID NO: 173639 - protein, 9 aa, Homo Sapiens
ICPPGMRPL

SEQ ID NO: 173640 - protein, 9 aa, Homo Sapiens
LDSPHICRR

SEQ ID NO: 173641 - protein, 9 aa, Homo Sapiens
LPPGRAWAP

SEQ ID NO: 173642 - protein, 9 aa, Homo Sapiens
RKSRPCTWS

SEQ ID NO: 173643 - protein, 9 aa, Homo Sapiens
SWKMAALFL

SEQ ID NO: 173644 - protein, 9 aa, Homo Sapiens
MQASGNCGT

SEQ ID NO: 173645 - protein, 9 aa, Homo Sapiens
QMAVHLGAF

SEQ ID NO: 173646 - protein, 9 aa, Homo Sapiens
ASSPPRHIQ

SEQ ID NO: 173647 - protein, 9 aa, Homo Sapiens
KSGIKMSEV

SEQ ID NO: 173648 - protein, 9 aa, Homo Sapiens
IRRSSISSW

SEQ ID NO: 173649 - protein, 9 aa, Homo Sapiens
DMPLLSDGN

SEQ ID NO: 173650 - protein, 9 aa, Homo Sapiens
YALGMGDQA

SEQ ID NO: 173651 - protein, 9 aa, Homo Sapiens
VQRAEYRPA

SEQ ID NO: 173652 - protein, 9 aa, Homo Sapiens
GSGFIRMNK

SEQ ID NO: 173653 - protein, 9 aa, Homo Sapiens
MREIEHLSH

SEQ ID NO: 173654 - protein, 9 aa, Homo Sapiens
ASVMSALTN

SEQ ID NO: 173655 - protein, 9 aa, Homo Sapiens
LLTVVVQQQ

SEQ ID NO: 173656 - protein, 9 aa, Homo Sapiens
CSRWPQELL

SEQ ID NO: 173657 - protein, 9 aa, Homo Sapiens
WYTPECINF

SEQ ID NO: 173658 - protein, 9 aa, Homo Sapiens
DLPSGLLPP

SEQ ID NO: 173659 - protein, 9 aa, Homo Sapiens
VHDSQGPHN

SEQ ID NO: 173660 - protein, 9 aa, Homo Sapiens
RRRRQRRTV

SEQ ID NO: 173661 - protein, 9 aa, Homo Sapiens
CSEKQKKEE

SEQ ID NO: 173662 - protein, 9 aa, Homo Sapiens
WNSIEERCI

SEQ ID NO: 173663 - protein, 9 aa, Homo Sapiens
LDLCSSPLC

SEQ ID NO: 173664 - protein, 9 aa, Homo Sapiens
SITVYQTVT

SEQ ID NO: 173665 - protein, 9 aa, Homo Sapiens
DVPVDMVAE

SEQ ID NO: 173666 - protein, 9 aa, Homo Sapiens
TLPCMKQKG

SEQ ID NO: 173667 - protein, 9 aa, Homo Sapiens
EWKKAVRFP

SEQ ID NO: 173668 - protein, 9 aa, Homo Sapiens
VAGPRQQKG

SEQ ID NO: 173669 - protein, 9 aa, Homo Sapiens
IPAFEMVMC

SEQ ID NO: 173670 - protein, 9 aa, Homo Sapiens
SFPTRTARR

SEQ ID NO: 173671 - protein, 9 aa, Homo Sapiens
VVVNQLGHL

SEQ ID NO: 173672 - protein, 9 aa, Homo Sapiens
STVTKWTID

SEQ ID NO: 173673 - protein, 9 aa, Homo Sapiens
RDLAKSMDS

SEQ ID NO: 173674 - protein, 9 aa, Homo Sapiens
PHHMVHTGE

SEQ ID NO: 173675 - protein, 9 aa, Homo Sapiens
AVCGKGFCH

SEQ ID NO: 173676 - protein, 9 aa, Homo Sapiens
AWLPPRPRP

SEQ ID NO: 173677 - protein, 9 aa, Homo Sapiens
CSSSSPCQD

SEQ ID NO: 173678 - protein, 9 aa, Homo Sapiens
EAQEAEGEA

SEQ ID NO: 173679 - protein, 9 aa, Homo Sapiens
TGLADTGVR

SEQ ID NO: 173680 - protein, 9 aa, Homo Sapiens
QCRGTESTM

SEQ ID NO: 173681 - protein, 9 aa, Homo Sapiens
CFRCCSQDC

SEQ ID NO: 173682 - protein, 9 aa, Homo Sapiens
PVGGAPCTT

SEQ ID NO: 173683 - protein, 9 aa, Homo Sapiens
RRLFTRSLT

SEQ ID NO: 173684 - protein, 9 aa, Homo Sapiens
ATTSWWRLG

SEQ ID NO: 173685 - protein, 9 aa, Homo Sapiens
SFINSETPS

SEQ ID NO: 173686 - protein, 9 aa, Homo Sapiens
SLDSNSSNS

SEQ ID NO: 173687 - protein, 9 aa, Homo Sapiens
MQKRRAAIV

SEQ ID NO: 173688 - protein, 9 aa, Homo Sapiens
PLPQTPTST

SEQ ID NO: 173689 - protein, 9 aa, Homo Sapiens
RFSTAGEYD

SEQ ID NO: 173690 - protein, 9 aa, Homo Sapiens
GGRHVGTKF

SEQ ID NO: 173691 - protein, 9 aa, Homo Sapiens
AASSIPRPH

SEQ ID NO: 173692 - protein, 9 aa, Homo Sapiens
VPREYWRDC

SEQ ID NO: 173693 - protein, 9 aa, Homo Sapiens
GAERQIEEW

SEQ ID NO: 173694 - protein, 9 aa, Homo Sapiens
RQGLRQLRA

SEQ ID NO: 173695 - protein, 9 aa, Homo Sapiens
VTTKKYPPQ

SEQ ID NO: 173696 - protein, 9 aa, Homo Sapiens
LNRARTSFC

SEQ ID NO: 173697 - protein, 9 aa, Homo Sapiens
NKSTQEKWG

SEQ ID NO: 173698 - protein, 9 aa, Homo Sapiens
KHTEAKKAY

SEQ ID NO: 173699 - protein, 9 aa, Homo Sapiens
WVYDRARRP

SEQ ID NO: 173700 - protein, 9 aa, Homo Sapiens
AVATRPRGA

SEQ ID NO: 173701 - protein, 9 aa, Homo Sapiens
SSKRFSTAG

SEQ ID NO: 173702 - protein, 9 aa, Homo Sapiens
RWRWTWRPG

SEQ ID NO: 173703 - protein, 9 aa, Homo Sapiens
RLTQLLLND

SEQ ID NO: 173704 - protein, 9 aa, Homo Sapiens
ICLAFVPIY

SEQ ID NO: 173705 - protein, 9 aa, Homo Sapiens
KLTLENLEA

SEQ ID NO: 173706 - protein, 9 aa, Homo Sapiens
APRAFVNLV

SEQ ID NO: 173707 - protein, 9 aa, Homo Sapiens
ACLSNKRHH

SEQ ID NO: 173708 - protein, 9 aa, Homo Sapiens
LSIPQWYHV

SEQ ID NO: 173709 - protein, 9 aa, Homo Sapiens
MAPVGSVMS

SEQ ID NO: 173710 - protein, 9 aa, Homo Sapiens
LEVLGWLPP

SEQ ID NO: 173711 - protein, 9 aa, Homo Sapiens
IILFSRSLS

SEQ ID NO: 173712 - protein, 9 aa, Homo Sapiens
TKSRPCPWS

SEQ ID NO: 173713 - protein, 9 aa, Homo Sapiens
LLREVNALR

SEQ ID NO: 173714 - protein, 9 aa, Homo Sapiens
PSSRRSRPQ

SEQ ID NO: 173715 - protein, 9 aa, Homo Sapiens
TAKIVTPET

SEQ ID NO: 173716 - protein, 9 aa, Homo Sapiens
NSFLLPFRM

SEQ ID NO: 173717 - protein, 9 aa, Homo Sapiens
SACTYERTL

SEQ ID NO: 173718 - protein, 9 aa, Homo Sapiens
ATHGVAVVL

SEQ ID NO: 173719 - protein, 9 aa, Homo Sapiens
GYVSLKLED

SEQ ID NO: 173720 - protein, 9 aa, Homo Sapiens
SCAGAVVPS

SEQ ID NO: 173721 - protein, 9 aa, Homo Sapiens
AARAKVAGP

SEQ ID NO: 173722 - protein, 9 aa, Homo Sapiens
FFVVMKGLN

SEQ ID NO: 173723 - protein, 9 aa, Homo Sapiens
TVETEVEAM

SEQ ID NO: 173724 - protein, 9 aa, Homo Sapiens
LRLLLLLLS

SEQ ID NO: 173725 - protein, 9 aa, Homo Sapiens
LYAWDAWLK

SEQ ID NO: 173726 - protein, 9 aa, Homo Sapiens
PRLLGPQVG

SEQ ID NO: 173727 - protein, 9 aa, Homo Sapiens
NIHDLEARY

SEQ ID NO: 173728 - protein, 9 aa, Homo Sapiens
FMTLEYNSK

SEQ ID NO: 173729 - protein, 9 aa, Homo Sapiens
RPEPRSDGT

SEQ ID NO: 173730 - protein, 9 aa, Homo Sapiens
EKSNKKISV

SEQ ID NO: 173731 - protein, 9 aa, Homo Sapiens
PRHCLHPQS

SEQ ID NO: 173732 - protein, 9 aa, Homo Sapiens
HLESLSAES

SEQ ID NO: 173733 - protein, 9 aa, Homo Sapiens
PGEPENGNR

SEQ ID NO: 173734 - protein, 9 aa, Homo Sapiens
SAYMFPDAL

SEQ ID NO: 173735 - protein, 9 aa, Homo Sapiens
PQAASPAMS

SEQ ID NO: 173736 - protein, 9 aa, Homo Sapiens
VDSQGPAAR

SEQ ID NO: 173737 - protein, 9 aa, Homo Sapiens
EWVMEMKSY

SEQ ID NO: 173738 - protein, 9 aa, Homo Sapiens
MPKLHFASR

SEQ ID NO: 173739 - protein, 9 aa, Homo Sapiens
GSEHSFRIH

SEQ ID NO: 173740 - protein, 9 aa, Homo Sapiens
DKQTQNDMV

SEQ ID NO: 173741 - protein, 9 aa, Homo Sapiens
HQLNMFKVF

SEQ ID NO: 173742 - protein, 9 aa, Homo Sapiens
VLVTLRAVK

SEQ ID NO: 173743 - protein, 9 aa, Homo Sapiens
STIFTSSTN

SEQ ID NO: 173744 - protein, 9 aa, Homo Sapiens
LVDCPDDDE

SEQ ID NO: 173745 - protein, 9 aa, Homo Sapiens
PENNLGVYT

SEQ ID NO: 173746 - protein, 9 aa, Homo Sapiens
LPDPHLLRG

SEQ ID NO: 173747 - protein, 9 aa, Homo Sapiens
VRKLTALRR

SEQ ID NO: 173748 - protein, 9 aa, Homo Sapiens
SGPPQGQAR

SEQ ID NO: 173749 - protein, 9 aa, Homo Sapiens
SAHSSASSW

SEQ ID NO: 173750 - protein, 9 aa, Homo Sapiens
MPRSPHRHR

SEQ ID NO: 173751 - protein, 9 aa, Homo Sapiens
PLARKLRPT

SEQ ID NO: 173752 - protein, 9 aa, Homo Sapiens
SPKMLVDLL

SEQ ID NO: 173753 - protein, 9 aa, Homo Sapiens
VLVLARALV

SEQ ID NO: 173754 - protein, 9 aa, Homo Sapiens
LPALTSMGP

SEQ ID NO: 173755 - protein, 9 aa, Homo Sapiens
EGVPLGPLR

SEQ ID NO: 173756 - protein, 9 aa, Homo Sapiens
SEDAPPKKK

SEQ ID NO: 173757 - protein, 9 aa, Homo Sapiens
GVSLSLSGD

SEQ ID NO: 173758 - protein, 9 aa, Homo Sapiens
ETGRPGERG

SEQ ID NO: 173759 - protein, 9 aa, Homo Sapiens
LEKLLRHPL

SEQ ID NO: 173760 - protein, 9 aa, Homo Sapiens
PDVDHVEGQ

SEQ ID NO: 173761 - protein, 9 aa, Homo Sapiens
PNGLAPNGA

SEQ ID NO: 173762 - protein, 9 aa, Homo Sapiens
GASFPPSVS

SEQ ID NO: 173763 - protein, 9 aa, Homo Sapiens
VAVKKAGRA

SEQ ID NO: 173764 - protein, 9 aa, Homo Sapiens
AQVFLVVFL

SEQ ID NO: 173765 - protein, 9 aa, Homo Sapiens
KQPGDICNE

SEQ ID NO: 173766 - protein, 9 aa, Homo Sapiens
PQITIPRKT

SEQ ID NO: 173767 - protein, 9 aa, Homo Sapiens
LNTELLSMT

SEQ ID NO: 173768 - protein, 9 aa, Homo Sapiens
DEVVSDNQR

SEQ ID NO: 173769 - protein, 9 aa, Homo Sapiens
QLLVTRLHC

SEQ ID NO: 173770 - protein, 9 aa, Homo Sapiens
KWPRLDENK

SEQ ID NO: 173771 - protein, 9 aa, Homo Sapiens
FIFVQKIVK

SEQ ID NO: 173772 - protein, 9 aa, Homo Sapiens
DLPSSRNNK

SEQ ID NO: 173773 - protein, 9 aa, Homo Sapiens
EKMDFRNMN

SEQ ID NO: 173774 - protein, 9 aa, Homo Sapiens
SVATLGPLD

SEQ ID NO: 173775 - protein, 9 aa, Homo Sapiens
SGAGGTLQP

SEQ ID NO: 173776 - protein, 9 aa, Homo Sapiens
LDHEEEVIT

SEQ ID NO: 173777 - protein, 9 aa, Homo Sapiens
LWRASTRNW

SEQ ID NO: 173778 - protein, 9 aa, Homo Sapiens
KCHRKVLRD

SEQ ID NO: 173779 - protein, 9 aa, Homo Sapiens
RQPPGQRVE

SEQ ID NO: 173780 - protein, 9 aa, Homo Sapiens
GLPVDDATW

SEQ ID NO: 173781 - protein, 9 aa, Homo Sapiens
TAWFWVRDM

SEQ ID NO: 173782 - protein, 9 aa, Homo Sapiens
TQTWTRLPR

SEQ ID NO: 173783 - protein, 9 aa, Homo Sapiens
TLNALHLQS

SEQ ID NO: 173784 - protein, 9 aa, Homo Sapiens
KKCCPYTKY

SEQ ID NO: 173785 - protein, 9 aa, Homo Sapiens
ALWEADSGA

SEQ ID NO: 173786 - protein, 9 aa, Homo Sapiens
ASPRPRWRD

SEQ ID NO: 173787 - protein, 9 aa, Homo Sapiens
VLEEKLFPQ

SEQ ID NO: 173788 - protein, 9 aa, Homo Sapiens
GPGQAAGRG

SEQ ID NO: 173789 - protein, 9 aa, Homo Sapiens
PQPTHRFPF

SEQ ID NO: 173790 - protein, 9 aa, Homo Sapiens
TLKWPPPYQ

SEQ ID NO: 173791 - protein, 9 aa, Homo Sapiens
VARCQTLLG

SEQ ID NO: 173792 - protein, 9 aa, Homo Sapiens
NCGALPLTL

SEQ ID NO: 173793 - protein, 9 aa, Homo Sapiens
DIYTVGAGT

SEQ ID NO: 173794 - protein, 9 aa, Homo Sapiens
KVVQVFRLI

SEQ ID NO: 173795 - protein, 9 aa, Homo Sapiens
PVSKKKDLH

SEQ ID NO: 173796 - protein, 9 aa, Homo Sapiens
TTVVCVCEV

SEQ ID NO: 173797 - protein, 9 aa, Homo Sapiens
SAPAPAVTT

SEQ ID NO: 173798 - protein, 9 aa, Homo Sapiens
GRNHCRQLQ

SEQ ID NO: 173799 - protein, 9 aa, Homo Sapiens
PLGPLRTLV

SEQ ID NO: 173800 - protein, 9 aa, Homo Sapiens
TRHGPYPAA

SEQ ID NO: 173801 - protein, 9 aa, Homo Sapiens
TLLLDMFHQ

SEQ ID NO: 173802 - protein, 9 aa, Homo Sapiens
KICAKQPGD

SEQ ID NO: 173803 - protein, 9 aa, Homo Sapiens
RVGARSPHL

SEQ ID NO: 173804 - protein, 9 aa, Homo Sapiens
SVHDSQGPH

SEQ ID NO: 173805 - protein, 9 aa, Homo Sapiens
LFQELQTLY

SEQ ID NO: 173806 - protein, 9 aa, Homo Sapiens
AMQASGNCG

SEQ ID NO: 173807 - protein, 9 aa, Homo Sapiens
RGLQVLAGM

SEQ ID NO: 173808 - protein, 9 aa, Homo Sapiens
LRVINEPTT

SEQ ID NO: 173809 - protein, 9 aa, Homo Sapiens
EELNQETQT

SEQ ID NO: 173810 - protein, 9 aa, Homo Sapiens
FNMKTMRVH

SEQ ID NO: 173811 - protein, 9 aa, Homo Sapiens
YSVLCQSAV

SEQ ID NO: 173812 - protein, 9 aa, Homo Sapiens
TQVYLSRTA

SEQ ID NO: 173813 - protein, 9 aa, Homo Sapiens
SPKSYRKSP

SEQ ID NO: 173814 - protein, 9 aa, Homo Sapiens
RPHTPSPES

SEQ ID NO: 173815 - protein, 9 aa, Homo Sapiens
PPSPLPSRL

SEQ ID NO: 173816 - protein, 9 aa, Homo Sapiens
KVDLDVSGP

SEQ ID NO: 173817 - protein, 9 aa, Homo Sapiens
ETLKKTRGQ

SEQ ID NO: 173818 - protein, 9 aa, Homo Sapiens
LCDLPCGFQ

SEQ ID NO: 173819 - protein, 9 aa, Homo Sapiens
SLWPTLNLS

SEQ ID NO: 173820 - protein, 9 aa, Homo Sapiens
AFSETETQS

SEQ ID NO: 173821 - protein, 9 aa, Homo Sapiens
GFGMAIVGN

SEQ ID NO: 173822 - protein, 9 aa, Homo Sapiens
PCDDEDWQP

SEQ ID NO: 173823 - protein, 9 aa, Homo Sapiens
APQITIPRK

SEQ ID NO: 173824 - protein, 9 aa, Homo Sapiens
LLCCSLLRG

SEQ ID NO: 173825 - protein, 9 aa, Homo Sapiens
RILPRAGTG

SEQ ID NO: 173826 - protein, 9 aa, Homo Sapiens
LPFLVAAAL

SEQ ID NO: 173827 - protein, 9 aa, Homo Sapiens
QCDTVVEDM

SEQ ID NO: 173828 - protein, 9 aa, Homo Sapiens
ILAWSHGLL

SEQ ID NO: 173829 - protein, 9 aa, Homo Sapiens
VSREELNQE

SEQ ID NO: 173830 - protein, 9 aa, Homo Sapiens
LFVNELFWM

SEQ ID NO: 173831 - protein, 9 aa, Homo Sapiens
SHEATPHGR

SEQ ID NO: 173832 - protein, 9 aa, Homo Sapiens
LAGRGLPSP

SEQ ID NO: 173833 - protein, 9 aa, Homo Sapiens
QQEAPRAFV

SEQ ID NO: 173834 - protein, 9 aa, Homo Sapiens
RDLRCPLTA

SEQ ID NO: 173835 - protein, 9 aa, Homo Sapiens
TGTNYFYLL

SEQ ID NO: 173836 - protein, 9 aa, Homo Sapiens
FSPNRDFKV

SEQ ID NO: 173837 - protein, 9 aa, Homo Sapiens
PRQQHESTI

SEQ ID NO: 173838 - protein, 9 aa, Homo Sapiens
GQSQFDVYE

SEQ ID NO: 173839 - protein, 9 aa, Homo Sapiens
SGPTYGAWA

SEQ ID NO: 173840 - protein, 9 aa, Homo Sapiens
GGTPQGPAW

SEQ ID NO: 173841 - protein, 9 aa, Homo Sapiens
HIAALTLHL

SEQ ID NO: 173842 - protein, 9 aa, Homo Sapiens
GSTSDCALC

SEQ ID NO: 173843 - protein, 9 aa, Homo Sapiens
LKWPPPYQW

SEQ ID NO: 173844 - protein, 9 aa, Homo Sapiens
GHDAGGWLK

SEQ ID NO: 173845 - protein, 9 aa, Homo Sapiens
KGLWRYPRY

SEQ ID NO: 173846 - protein, 9 aa, Homo Sapiens
HEREVHALY

SEQ ID NO: 173847 - protein, 9 aa, Homo Sapiens
LRARGLQVL

SEQ ID NO: 173848 - protein, 9 aa, Homo Sapiens
TSQNHSKCI

SEQ ID NO: 173849 - protein, 9 aa, Homo Sapiens
VRPPHTSIN

SEQ ID NO: 173850 - protein, 9 aa, Homo Sapiens
RLKCSNPLA

SEQ ID NO: 173851 - protein, 9 aa, Homo Sapiens
ETLALVGGE

SEQ ID NO: 173852 - protein, 9 aa, Homo Sapiens
GDSSAEGSG

SEQ ID NO: 173853 - protein, 9 aa, Homo Sapiens
FMGPGILSI

SEQ ID NO: 173854 - protein, 9 aa, Homo Sapiens
LLLPPFLLL

SEQ ID NO: 173855 - protein, 9 aa, Homo Sapiens
GTPPAATAK

SEQ ID NO: 173856 - protein, 9 aa, Homo Sapiens
CIHRTWLCD

SEQ ID NO: 173857 - protein, 9 aa, Homo Sapiens
ISAAHLYYY

SEQ ID NO: 173858 - protein, 9 aa, Homo Sapiens
NLTNSREDS

SEQ ID NO: 173859 - protein, 9 aa, Homo Sapiens
RRPHPVVTT

SEQ ID NO: 173860 - protein, 9 aa, Homo Sapiens
IVLEQMRYE

SEQ ID NO: 173861 - protein, 9 aa, Homo Sapiens
VIMLLALRL

SEQ ID NO: 173862 - protein, 9 aa, Homo Sapiens
EDIQFHLVT

SEQ ID NO: 173863 - protein, 9 aa, Homo Sapiens
RFCGGINCQ

SEQ ID NO: 173864 - protein, 9 aa, Homo Sapiens
LATEKSRWS

SEQ ID NO: 173865 - protein, 9 aa, Homo Sapiens
TENRIGDII

SEQ ID NO: 173866 - protein, 9 aa, Homo Sapiens
LNAMKKDKD

SEQ ID NO: 173867 - protein, 9 aa, Homo Sapiens
SLLLLRPTG

SEQ ID NO: 173868 - protein, 9 aa, Homo Sapiens
NSSNSDQNY

SEQ ID NO: 173869 - protein, 9 aa, Homo Sapiens
CISVKDHRT

SEQ ID NO: 173870 - protein, 9 aa, Homo Sapiens
QLVEHPHAL

SEQ ID NO: 173871 - protein, 9 aa, Homo Sapiens
LWGVGAAVM

SEQ ID NO: 173872 - protein, 9 aa, Homo Sapiens
YAPNVQGAC

SEQ ID NO: 173873 - protein, 9 aa, Homo Sapiens
ATRRWRWTW

SEQ ID NO: 173874 - protein, 9 aa, Homo Sapiens
GRAWAPAPP

SEQ ID NO: 173875 - protein, 9 aa, Homo Sapiens
SDPWPGGSP

SEQ ID NO: 173876 - protein, 9 aa, Homo Sapiens
PTRTARRTL

SEQ ID NO: 173877 - protein, 9 aa, Homo Sapiens
WEGSSDQLR

SEQ ID NO: 173878 - protein, 9 aa, Homo Sapiens
HPTGECKDL

SEQ ID NO: 173879 - protein, 9 aa, Homo Sapiens
SPQETATIS

SEQ ID NO: 173880 - protein, 9 aa, Homo Sapiens
MQQMAVHLG

SEQ ID NO: 173881 - protein, 9 aa, Homo Sapiens
LLPFRMSSF

SEQ ID NO: 173882 - protein, 9 aa, Homo Sapiens
LVSHLSQEH

SEQ ID NO: 173883 - protein, 9 aa, Homo Sapiens
KKKVSKATS

SEQ ID NO: 173884 - protein, 9 aa, Homo Sapiens
TEALVSRPK

SEQ ID NO: 173885 - protein, 9 aa, Homo Sapiens
GSDGGGRRF

SEQ ID NO: 173886 - protein, 9 aa, Homo Sapiens
HHHACGHSC

SEQ ID NO: 173887 - protein, 9 aa, Homo Sapiens
QPGDICNEA

SEQ ID NO: 173888 - protein, 9 aa, Homo Sapiens
SHSSAAHRR

SEQ ID NO: 173889 - protein, 9 aa, Homo Sapiens
STSDCALCA

SEQ ID NO: 173890 - protein, 9 aa, Homo Sapiens
CPMVRVFQY

SEQ ID NO: 173891 - protein, 9 aa, Homo Sapiens
PGHLVVQQV

SEQ ID NO: 173892 - protein, 9 aa, Homo Sapiens
VSLLFCYGL

SEQ ID NO: 173893 - protein, 9 aa, Homo Sapiens
QGPAPQGQG

SEQ ID NO: 173894 - protein, 9 aa, Homo Sapiens
TGLLYVGVR

SEQ ID NO: 173895 - protein, 9 aa, Homo Sapiens
GQPIRGYTE

SEQ ID NO: 173896 - protein, 9 aa, Homo Sapiens
VKLHTDSQS

SEQ ID NO: 173897 - protein, 9 aa, Homo Sapiens
IAPCVHFTR

SEQ ID NO: 173898 - protein, 9 aa, Homo Sapiens
GQACYRIPR

SEQ ID NO: 173899 - protein, 9 aa, Homo Sapiens
TEMTRIKKW

SEQ ID NO: 173900 - protein, 9 aa, Homo Sapiens
AVTLKWPPP

SEQ ID NO: 173901 - protein, 9 aa, Homo Sapiens
PSLPGPCAS

SEQ ID NO: 173902 - protein, 9 aa, Homo Sapiens
HFPTVIRQC

SEQ ID NO: 173903 - protein, 9 aa, Homo Sapiens
FPKKELELH

SEQ ID NO: 173904 - protein, 9 aa, Homo Sapiens
QRKEFLCDL

SEQ ID NO: 173905 - protein, 9 aa, Homo Sapiens
PKYPPQCPA

SEQ ID NO: 173906 - protein, 9 aa, Homo Sapiens
PRAGRTSHR

SEQ ID NO: 173907 - protein, 9 aa, Homo Sapiens
PYLSLVNAF

SEQ ID NO: 173908 - protein, 9 aa, Homo Sapiens
AVAVAQEIQ

SEQ ID NO: 173909 - protein, 9 aa, Homo Sapiens
VCLLGGRCN

SEQ ID NO: 173910 - protein, 9 aa, Homo Sapiens
QMRYEGVVD

SEQ ID NO: 173911 - protein, 9 aa, Homo Sapiens
LELSLSPSH

SEQ ID NO: 173912 - protein, 9 aa, Homo Sapiens
LLNGLHQFQ

SEQ ID NO: 173913 - protein, 9 aa, Homo Sapiens
AAAERAKCQ

SEQ ID NO: 173914 - protein, 9 aa, Homo Sapiens
PIILWLGLA

SEQ ID NO: 173915 - protein, 9 aa, Homo Sapiens
WTCSLLTGA

SEQ ID NO: 173916 - protein, 9 aa, Homo Sapiens
EDWKKRHTL

SEQ ID NO: 173917 - protein, 9 aa, Homo Sapiens
EKIGFWRHL

SEQ ID NO: 173918 - protein, 9 aa, Homo Sapiens
LQAETLVTL

SEQ ID NO: 173919 - protein, 9 aa, Homo Sapiens
GVCTDPKGQ

SEQ ID NO: 173920 - protein, 9 aa, Homo Sapiens
YILEFNGGS

SEQ ID NO: 173921 - protein, 9 aa, Homo Sapiens
LGDTPQPSL

SEQ ID NO: 173922 - protein, 9 aa, Homo Sapiens
QKKTATKIY

SEQ ID NO: 173923 - protein, 9 aa, Homo Sapiens
PASNPATSS

SEQ ID NO: 173924 - protein, 9 aa, Homo Sapiens
VCASLDGEE

SEQ ID NO: 173925 - protein, 9 aa, Homo Sapiens
SQMYSITFT

SEQ ID NO: 173926 - protein, 9 aa, Homo Sapiens
TPALPTQQL

SEQ ID NO: 173927 - protein, 9 aa, Homo Sapiens
GRRPAHPLT

SEQ ID NO: 173928 - protein, 9 aa, Homo Sapiens
YDRDDVGDC

SEQ ID NO: 173929 - protein, 9 aa, Homo Sapiens
NVDLIHTEN

SEQ ID NO: 173930 - protein, 9 aa, Homo Sapiens
AAGTRPPAR

SEQ ID NO: 173931 - protein, 9 aa, Homo Sapiens
PGIFRGDKW

SEQ ID NO: 173932 - protein, 9 aa, Homo Sapiens
ERLERAVSH

SEQ ID NO: 173933 - protein, 9 aa, Homo Sapiens
GSFTNCCEA

SEQ ID NO: 173934 - protein, 9 aa, Homo Sapiens
KRTPQQVVA

SEQ ID NO: 173935 - protein, 9 aa, Homo Sapiens
ADLCSEKQK

SEQ ID NO: 173936 - protein, 9 aa, Homo Sapiens
GKGGVGKTA

SEQ ID NO: 173937 - protein, 9 aa, Homo Sapiens
SLFDVLLLL

SEQ ID NO: 173938 - protein, 9 aa, Homo Sapiens
PRSQRSWHG

SEQ ID NO: 173939 - protein, 9 aa, Homo Sapiens
VLILQAFSQ

SEQ ID NO: 173940 - protein, 9 aa, Homo Sapiens
MFPDALMCT

SEQ ID NO: 173941 - protein, 9 aa, Homo Sapiens
CTCISMTTI

SEQ ID NO: 173942 - protein, 9 aa, Homo Sapiens
QEDEQDART

SEQ ID NO: 173943 - protein, 9 aa, Homo Sapiens
SLRFLAYNC

SEQ ID NO: 173944 - protein, 9 aa, Homo Sapiens
MAAEWRCGS

SEQ ID NO: 173945 - protein, 9 aa, Homo Sapiens
TRVGGLGCG

SEQ ID NO: 173946 - protein, 9 aa, Homo Sapiens
EARTRSRTW

SEQ ID NO: 173947 - protein, 9 aa, Homo Sapiens
TFYQGYLWF

SEQ ID NO: 173948 - protein, 9 aa, Homo Sapiens
VWTAATLRC

SEQ ID NO: 173949 - protein, 9 aa, Homo Sapiens
ASRGTSSPS

SEQ ID NO: 173950 - protein, 9 aa, Homo Sapiens
AYGCSHIPE

SEQ ID NO: 173951 - protein, 9 aa, Homo Sapiens
TFRGTSALA

SEQ ID NO: 173952 - protein, 9 aa, Homo Sapiens
DKDGNGEDL

SEQ ID NO: 173953 - protein, 9 aa, Homo Sapiens
LCSFGLWFR

SEQ ID NO: 173954 - protein, 9 aa, Homo Sapiens
ASVLPLLFL

SEQ ID NO: 173955 - protein, 9 aa, Homo Sapiens
SLQCQSLAL

SEQ ID NO: 173956 - protein, 9 aa, Homo Sapiens
PLNLQGGCL

SEQ ID NO: 173957 - protein, 9 aa, Homo Sapiens
VLQQVPCSP

SEQ ID NO: 173958 - protein, 9 aa, Homo Sapiens
NGACVPRAA

SEQ ID NO: 173959 - protein, 9 aa, Homo Sapiens
PHIKKQHRR

SEQ ID NO: 173960 - protein, 9 aa, Homo Sapiens
AISTLHFCE

SEQ ID NO: 173961 - protein, 9 aa, Homo Sapiens
STADGQCYA

SEQ ID NO: 173962 - protein, 9 aa, Homo Sapiens
SFQSCTFCK

SEQ ID NO: 173963 - protein, 9 aa, Homo Sapiens
AAVPRGREG

SEQ ID NO: 173964 - protein, 9 aa, Homo Sapiens
QGQPANQSV

SEQ ID NO: 173965 - protein, 9 aa, Homo Sapiens
LPHSISTEF

SEQ ID NO: 173966 - protein, 9 aa, Homo Sapiens
KQQKGWFPA

SEQ ID NO: 173967 - protein, 9 aa, Homo Sapiens
DTLDREARL

SEQ ID NO: 173968 - protein, 9 aa, Homo Sapiens
GVAAPRPPP

SEQ ID NO: 173969 - protein, 9 aa, Homo Sapiens
RPRLPRHCL

SEQ ID NO: 173970 - protein, 9 aa, Homo Sapiens
GNVGTPLLV

SEQ ID NO: 173971 - protein, 9 aa, Homo Sapiens
TPHSQVSVT

SEQ ID NO: 173972 - protein, 9 aa, Homo Sapiens
VASVLPLLF

SEQ ID NO: 173973 - protein, 9 aa, Homo Sapiens
SIPKKSYAL

SEQ ID NO: 173974 - protein, 9 aa, Homo Sapiens
ATTTLHVLL

SEQ ID NO: 173975 - protein, 9 aa, Homo Sapiens
MESTALSRV

SEQ ID NO: 173976 - protein, 9 aa, Homo Sapiens
STGPARMAS

SEQ ID NO: 173977 - protein, 9 aa, Homo Sapiens
PHSPGPGLR

SEQ ID NO: 173978 - protein, 9 aa, Homo Sapiens
VDLDVSGPK

SEQ ID NO: 173979 - protein, 9 aa, Homo Sapiens
LQAFSQLPI

SEQ ID NO: 173980 - protein, 9 aa, Homo Sapiens
LEFNGGSRG

SEQ ID NO: 173981 - protein, 9 aa, Homo Sapiens
SACTMPPLL

SEQ ID NO: 173982 - protein, 9 aa, Homo Sapiens
TQALQASLG

SEQ ID NO: 173983 - protein, 9 aa, Homo Sapiens
EAPDGQRLH

SEQ ID NO: 173984 - protein, 9 aa, Homo Sapiens
AGSLDSRVV

SEQ ID NO: 173985 - protein, 9 aa, Homo Sapiens
SWEGSSDQL

SEQ ID NO: 173986 - protein, 9 aa, Homo Sapiens
GRTSHRIRS

SEQ ID NO: 173987 - protein, 9 aa, Homo Sapiens
SSRAPSSRR

SEQ ID NO: 173988 - protein, 9 aa, Homo Sapiens
LLAQWFTPC

SEQ ID NO: 173989 - protein, 9 aa, Homo Sapiens
IPRITWLKN

SEQ ID NO: 173990 - protein, 9 aa, Homo Sapiens
LGSGQYGDK

SEQ ID NO: 173991 - protein, 9 aa, Homo Sapiens
DKLSGFQGT

SEQ ID NO: 173992 - protein, 9 aa, Homo Sapiens
LSLSGDSSA

SEQ ID NO: 173993 - protein, 9 aa, Homo Sapiens
WQLAWIGDG

SEQ ID NO: 173994 - protein, 9 aa, Homo Sapiens
WSWQQDSFP

SEQ ID NO: 173995 - protein, 9 aa, Homo Sapiens
SANARVTNT

SEQ ID NO: 173996 - protein, 9 aa, Homo Sapiens
RPPVDTRAK

SEQ ID NO: 173997 - protein, 9 aa, Homo Sapiens
LYHPALHAL

SEQ ID NO: 173998 - protein, 9 aa, Homo Sapiens
PRAARVAFG

SEQ ID NO: 173999 - protein, 9 aa, Homo Sapiens
DLMLYCEAF

SEQ ID NO: 174000 - protein, 9 aa, Homo Sapiens
RGNVGTPLL

SEQ ID NO: 174001 - protein, 9 aa, Homo Sapiens
TSSPTRRRR

SEQ ID NO: 174002 - protein, 9 aa, Homo Sapiens
TGAMGGSRT

SEQ ID NO: 174003 - protein, 9 aa, Homo Sapiens
CILGQRATR

SEQ ID NO: 174004 - protein, 9 aa, Homo Sapiens
ESNCGALPL

SEQ ID NO: 174005 - protein, 9 aa, Homo Sapiens
KWPPPYQWD

SEQ ID NO: 174006 - protein, 9 aa, Homo Sapiens
ASSSATRRW

SEQ ID NO: 174007 - protein, 9 aa, Homo Sapiens
PIPKQDTVP

SEQ ID NO: 174008 - protein, 9 aa, Homo Sapiens
AATQTGKGF

SEQ ID NO: 174009 - protein, 9 aa, Homo Sapiens
SLQLVEHPH

SEQ ID NO: 174010 - protein, 9 aa, Homo Sapiens
TRLHCPSDA

SEQ ID NO: 174011 - protein, 9 aa, Homo Sapiens
GTRLNCTPM

SEQ ID NO: 174012 - protein, 9 aa, Homo Sapiens
RLSTTRLSG

SEQ ID NO: 174013 - protein, 9 aa, Homo Sapiens
QHFRPQDYQ

SEQ ID NO: 174014 - protein, 9 aa, Homo Sapiens
AVSSRRNVI

SEQ ID NO: 174015 - protein, 9 aa, Homo Sapiens
MVGENTTLH

SEQ ID NO: 174016 - protein, 9 aa, Homo Sapiens
RLRFEQEQM

SEQ ID NO: 174017 - protein, 9 aa, Homo Sapiens
RVAFSVATA

SEQ ID NO: 174018 - protein, 9 aa, Homo Sapiens
PLLSSPRDH

SEQ ID NO: 174019 - protein, 9 aa, Homo Sapiens
SNTMYSRLR

SEQ ID NO: 174020 - protein, 9 aa, Homo Sapiens
VGMGATVAT

SEQ ID NO: 174021 - protein, 9 aa, Homo Sapiens
KCRPRSRRS

SEQ ID NO: 174022 - protein, 9 aa, Homo Sapiens
GCGVCPLAG

SEQ ID NO: 174023 - protein, 9 aa, Homo Sapiens
GWLINDQLP

SEQ ID NO: 174024 - protein, 9 aa, Homo Sapiens
EVVKYSDME

SEQ ID NO: 174025 - protein, 9 aa, Homo Sapiens
RRASTKSRP

SEQ ID NO: 174026 - protein, 9 aa, Homo Sapiens
HHVQGAVCD

SEQ ID NO: 174027 - protein, 9 aa, Homo Sapiens
WGRRRLFTR

SEQ ID NO: 174028 - protein, 9 aa, Homo Sapiens
MDMEGAEPR

SEQ ID NO: 174029 - protein, 9 aa, Homo Sapiens
CLLGSEDYY

SEQ ID NO: 174030 - protein, 9 aa, Homo Sapiens
TVDADSGYN

SEQ ID NO: 174031 - protein, 9 aa, Homo Sapiens
LLRNPNDKH

SEQ ID NO: 174032 - protein, 9 aa, Homo Sapiens
YVSKVGSWP

SEQ ID NO: 174033 - protein, 9 aa, Homo Sapiens
EEQTPRIRL

SEQ ID NO: 174034 - protein, 9 aa, Homo Sapiens
GFLVREEVF

SEQ ID NO: 174035 - protein, 9 aa, Homo Sapiens
VQNYLFWHM

SEQ ID NO: 174036 - protein, 9 aa, Homo Sapiens
ATAESLGTI

SEQ ID NO: 174037 - protein, 9 aa, Homo Sapiens
QSSAHMKLN

SEQ ID NO: 174038 - protein, 9 aa, Homo Sapiens
KHYSCTPRN

SEQ ID NO: 174039 - protein, 9 aa, Homo Sapiens
APWLPMRSL

SEQ ID NO: 174040 - protein, 9 aa, Homo Sapiens
GDTPGTSNG

SEQ ID NO: 174041 - protein, 9 aa, Homo Sapiens
RTSENTHRR

SEQ ID NO: 174042 - protein, 9 aa, Homo Sapiens
DQLPFLVAA

SEQ ID NO: 174043 - protein, 9 aa, Homo Sapiens
VWGPPTCSF

SEQ ID NO: 174044 - protein, 9 aa, Homo Sapiens
APERPRSQR

SEQ ID NO: 174045 - protein, 9 aa, Homo Sapiens
ARGELRPAS

SEQ ID NO: 174046 - protein, 9 aa, Homo Sapiens
TLPRALARL

SEQ ID NO: 174047 - protein, 9 aa, Homo Sapiens
KKVSWYSHQ

SEQ ID NO: 174048 - protein, 9 aa, Homo Sapiens
PAPWLPMRS

SEQ ID NO: 174049 - protein, 9 aa, Homo Sapiens
EDKKNGIWE

SEQ ID NO: 174050 - protein, 9 aa, Homo Sapiens
QYKKNSNQI

SEQ ID NO: 174051 - protein, 9 aa, Homo Sapiens
SFLVLLLGW

SEQ ID NO: 174052 - protein, 9 aa, Homo Sapiens
AVRLCGGLR

SEQ ID NO: 174053 - protein, 9 aa, Homo Sapiens
RSRPQGLVP

SEQ ID NO: 174054 - protein, 9 aa, Homo Sapiens
PQASAWPST

SEQ ID NO: 174055 - protein, 9 aa, Homo Sapiens
ESPVDTCIP

SEQ ID NO: 174056 - protein, 9 aa, Homo Sapiens
WPCPAVPLG

SEQ ID NO: 174057 - protein, 9 aa, Homo Sapiens
AIGFLGGQK

SEQ ID NO: 174058 - protein, 9 aa, Homo Sapiens
NVTLGAKTG

SEQ ID NO: 174059 - protein, 9 aa, Homo Sapiens
YPSEKSNKK

SEQ ID NO: 174060 - protein, 9 aa, Homo Sapiens
TAAAAATSL

SEQ ID NO: 174061 - protein, 9 aa, Homo Sapiens
ALSRVVLVC

SEQ ID NO: 174062 - protein, 9 aa, Homo Sapiens
KSTYLLPHH

SEQ ID NO: 174063 - protein, 9 aa, Homo Sapiens
QINNLQRVK

SEQ ID NO: 174064 - protein, 9 aa, Homo Sapiens
MGWSDMNSN

SEQ ID NO: 174065 - protein, 9 aa, Homo Sapiens
TYPDGFRLE

SEQ ID NO: 174066 - protein, 9 aa, Homo Sapiens
GKKQQKGWF

SEQ ID NO: 174067 - protein, 9 aa, Homo Sapiens
QSLHGHLFH

SEQ ID NO: 174068 - protein, 9 aa, Homo Sapiens
PGIRGPHAP

SEQ ID NO: 174069 - protein, 9 aa, Homo Sapiens
HCRQLQGHG

SEQ ID NO: 174070 - protein, 9 aa, Homo Sapiens
GLRQLRAHF

SEQ ID NO: 174071 - protein, 9 aa, Homo Sapiens
HVYCALLAG

SEQ ID NO: 174072 - protein, 9 aa, Homo Sapiens
LIVIGLGGG

SEQ ID NO: 174073 - protein, 9 aa, Homo Sapiens
LLSTLSQPP

SEQ ID NO: 174074 - protein, 9 aa, Homo Sapiens
CARGGLSLA

SEQ ID NO: 174075 - protein, 9 aa, Homo Sapiens
KTALLKITG

SEQ ID NO: 174076 - protein, 9 aa, Homo Sapiens
VHRVDGAQH

SEQ ID NO: 174077 - protein, 9 aa, Homo Sapiens
LTRPSGLLA

SEQ ID NO: 174078 - protein, 9 aa, Homo Sapiens
LTNSREDSY

SEQ ID NO: 174079 - protein, 9 aa, Homo Sapiens
ISVFICTHV

SEQ ID NO: 174080 - protein, 9 aa, Homo Sapiens
APPKKKIKS

SEQ ID NO: 174081 - protein, 9 aa, Homo Sapiens
VFRETPPWS

SEQ ID NO: 174082 - protein, 9 aa, Homo Sapiens
NELFWMLHL

SEQ ID NO: 174083 - protein, 9 aa, Homo Sapiens
EPEQKKSKS

SEQ ID NO: 174084 - protein, 9 aa, Homo Sapiens
PPVLPPKPL

SEQ ID NO: 174085 - protein, 9 aa, Homo Sapiens
GSTRCGSGG

SEQ ID NO: 174086 - protein, 9 aa, Homo Sapiens
QSSSCLRSL

SEQ ID NO: 174087 - protein, 9 aa, Homo Sapiens
TWTPGTGSC

SEQ ID NO: 174088 - protein, 9 aa, Homo Sapiens
RSSVFSSCQ

SEQ ID NO: 174089 - protein, 9 aa, Homo Sapiens
PQHRAYPQQ

SEQ ID NO: 174090 - protein, 9 aa, Homo Sapiens
TPAPQAASP

SEQ ID NO: 174091 - protein, 9 aa, Homo Sapiens
TQSRPKGPE

SEQ ID NO: 174092 - protein, 9 aa, Homo Sapiens
PVKKNQVMT

SEQ ID NO: 174093 - protein, 9 aa, Homo Sapiens
RVAVKKAGR

SEQ ID NO: 174094 - protein, 9 aa, Homo Sapiens
APCVHFTRR

SEQ ID NO: 174095 - protein, 9 aa, Homo Sapiens
PTRRRRQRR

SEQ ID NO: 174096 - protein, 9 aa, Homo Sapiens
HHEWVHSDF

SEQ ID NO: 174097 - protein, 9 aa, Homo Sapiens
NKKPGLGTP

SEQ ID NO: 174098 - protein, 9 aa, Homo Sapiens
RPGPSRAHC

SEQ ID NO: 174099 - protein, 9 aa, Homo Sapiens
FIGCPQASA

SEQ ID NO: 174100 - protein, 9 aa, Homo Sapiens
RCEQSSSRN

SEQ ID NO: 174101 - protein, 9 aa, Homo Sapiens
TILTNIHGT

SEQ ID NO: 174102 - protein, 9 aa, Homo Sapiens
AVLIPSSLR

SEQ ID NO: 174103 - protein, 9 aa, Homo Sapiens
ADVRHESRL

SEQ ID NO: 174104 - protein, 9 aa, Homo Sapiens
ILMTEENKD

SEQ ID NO: 174105 - protein, 9 aa, Homo Sapiens
PGQRVETPN

SEQ ID NO: 174106 - protein, 9 aa, Homo Sapiens
HRVDGAQHS

SEQ ID NO: 174107 - protein, 9 aa, Homo Sapiens
EYAVSSHRN

SEQ ID NO: 174108 - protein, 9 aa, Homo Sapiens
ERSPKPGPP

SEQ ID NO: 174109 - protein, 9 aa, Homo Sapiens
LRLLPGRLL

SEQ ID NO: 174110 - protein, 9 aa, Homo Sapiens
VTWYHATNS

SEQ ID NO: 174111 - protein, 9 aa, Homo Sapiens
DTSKIPGKK

SEQ ID NO: 174112 - protein, 9 aa, Homo Sapiens
RTTCPKCST

SEQ ID NO: 174113 - protein, 9 aa, Homo Sapiens
STVQNYLFW

SEQ ID NO: 174114 - protein, 9 aa, Homo Sapiens
SVLMVFFSS

SEQ ID NO: 174115 - protein, 9 aa, Homo Sapiens
KKNGIWEVM

SEQ ID NO: 174116 - protein, 9 aa, Homo Sapiens
YFFLSLVVV

SEQ ID NO: 174117 - protein, 9 aa, Homo Sapiens
DPPSTATSV

SEQ ID NO: 174118 - protein, 9 aa, Homo Sapiens
LNWVFKIAS

SEQ ID NO: 174119 - protein, 9 aa, Homo Sapiens
KKISSGCRN

SEQ ID NO: 174120 - protein, 9 aa, Homo Sapiens
ESRLKCSNP

SEQ ID NO: 174121 - protein, 9 aa, Homo Sapiens
HPLKSFFIL

SEQ ID NO: 174122 - protein, 9 aa, Homo Sapiens
SVPLLLKKP

SEQ ID NO: 174123 - protein, 9 aa, Homo Sapiens
VATPALPTQ

SEQ ID NO: 174124 - protein, 9 aa, Homo Sapiens
TTNSVWLLF

SEQ ID NO: 174125 - protein, 9 aa, Homo Sapiens
ASVNLGSEH

SEQ ID NO: 174126 - protein, 9 aa, Homo Sapiens
VYYQRNMII

SEQ ID NO: 174127 - protein, 9 aa, Homo Sapiens
PHTPSPESH

SEQ ID NO: 174128 - protein, 9 aa, Homo Sapiens
DAYHRNSVR

SEQ ID NO: 174129 - protein, 9 aa, Homo Sapiens
GTLSPKPSR

SEQ ID NO: 174130 - protein, 9 aa, Homo Sapiens
IYGAEVRKE

SEQ ID NO: 174131 - protein, 9 aa, Homo Sapiens
ENHTLTSLH

SEQ ID NO: 174132 - protein, 9 aa, Homo Sapiens
DCLTQMYFL

SEQ ID NO: 174133 - protein, 9 aa, Homo Sapiens
TWEHAGWYR

SEQ ID NO: 174134 - protein, 9 aa, Homo Sapiens
TALRRNDTE

SEQ ID NO: 174135 - protein, 9 aa, Homo Sapiens
IAPSTEWWT

SEQ ID NO: 174136 - protein, 9 aa, Homo Sapiens
EGDLQHALA

SEQ ID NO: 174137 - protein, 9 aa, Homo Sapiens
LPARPSRLP

SEQ ID NO: 174138 - protein, 9 aa, Homo Sapiens
SISRPTSRA

SEQ ID NO: 174139 - protein, 9 aa, Homo Sapiens
GRSQPGLYS

SEQ ID NO: 174140 - protein, 9 aa, Homo Sapiens
LNAVLANVP

SEQ ID NO: 174141 - protein, 9 aa, Homo Sapiens
LEHTQHGIR

SEQ ID NO: 174142 - protein, 9 aa, Homo Sapiens
EWLCDKNLM

SEQ ID NO: 174143 - protein, 9 aa, Homo Sapiens
LLASDRNPR

SEQ ID NO: 174144 - protein, 9 aa, Homo Sapiens
QRCWPLRWG

SEQ ID NO: 174145 - protein, 9 aa, Homo Sapiens
KKIWWIVQN

SEQ ID NO: 174146 - protein, 9 aa, Homo Sapiens
RQVAIVVKF

SEQ ID NO: 174147 - protein, 9 aa, Homo Sapiens
GLATEKSRW

SEQ ID NO: 174148 - protein, 9 aa, Homo Sapiens
RWNSIEERC

SEQ ID NO: 174149 - protein, 9 aa, Homo Sapiens
QQVGTLSPS

SEQ ID NO: 174150 - protein, 9 aa, Homo Sapiens
VSNLEEPTS

SEQ ID NO: 174151 - protein, 9 aa, Homo Sapiens
AAPGTAQSN

SEQ ID NO: 174152 - protein, 9 aa, Homo Sapiens
YMAMIQFTI

SEQ ID NO: 174153 - protein, 9 aa, Homo Sapiens
KQKLQMPRS

SEQ ID NO: 174154 - protein, 9 aa, Homo Sapiens
AISVSHSVL

SEQ ID NO: 174155 - protein, 9 aa, Homo Sapiens
PVFSYSWPR

SEQ ID NO: 174156 - protein, 9 aa, Homo Sapiens
IGQSPTDEI

SEQ ID NO: 174157 - protein, 9 aa, Homo Sapiens
GPAQLQALP

SEQ ID NO: 174158 - protein, 9 aa, Homo Sapiens
RGESTVARP

SEQ ID NO: 174159 - protein, 9 aa, Homo Sapiens
IQGDMTQAH

SEQ ID NO: 174160 - protein, 9 aa, Homo Sapiens
SDISACTYE

SEQ ID NO: 174161 - protein, 9 aa, Homo Sapiens
PCVHFTRRR

SEQ ID NO: 174162 - protein, 9 aa, Homo Sapiens
LRVTLFQAM

SEQ ID NO: 174163 - protein, 9 aa, Homo Sapiens
NLCLPDIFI

SEQ ID NO: 174164 - protein, 9 aa, Homo Sapiens
VCALDSDFG

SEQ ID NO: 174165 - protein, 9 aa, Homo Sapiens
NCIHRTWLC

SEQ ID NO: 174166 - protein, 9 aa, Homo Sapiens
PPRPRPGRT

SEQ ID NO: 174167 - protein, 9 aa, Homo Sapiens
TCSFVQPCT

SEQ ID NO: 174168 - protein, 9 aa, Homo Sapiens
GLNIAPCVH

SEQ ID NO: 174169 - protein, 9 aa, Homo Sapiens
EKKKVSKAT

SEQ ID NO: 174170 - protein, 9 aa, Homo Sapiens
LRECGYPEN

SEQ ID NO: 174171 - protein, 9 aa, Homo Sapiens
RRRCRPRTA

SEQ ID NO: 174172 - protein, 9 aa, Homo Sapiens
QFFLASGTV

SEQ ID NO: 174173 - protein, 9 aa, Homo Sapiens
RNSPQPLRW

SEQ ID NO: 174174 - protein, 9 aa, Homo Sapiens
VGSGLQGCL

SEQ ID NO: 174175 - protein, 9 aa, Homo Sapiens
PSPLNQSVS

SEQ ID NO: 174176 - protein, 9 aa, Homo Sapiens
ASLGKMALQ

SEQ ID NO: 174177 - protein, 9 aa, Homo Sapiens
QDPLDRCYS

SEQ ID NO: 174178 - protein, 9 aa, Homo Sapiens
TPWLNHVSC

SEQ ID NO: 174179 - protein, 9 aa, Homo Sapiens
KFQYLLSKW

SEQ ID NO: 174180 - protein, 9 aa, Homo Sapiens
PKQDTVPPV

SEQ ID NO: 174181 - protein, 9 aa, Homo Sapiens
DTGVREDEP

SEQ ID NO: 174182 - protein, 9 aa, Homo Sapiens
FVVRDTPWT

SEQ ID NO: 174183 - protein, 9 aa, Homo Sapiens
EDLWNIHDL

SEQ ID NO: 174184 - protein, 9 aa, Homo Sapiens
TVELSCKGR

SEQ ID NO: 174185 - protein, 9 aa, Homo Sapiens
SKARPALQA

SEQ ID NO: 174186 - protein, 9 aa, Homo Sapiens
RESKPAQQK

SEQ ID NO: 174187 - protein, 9 aa, Homo Sapiens
KKRKKREKI

SEQ ID NO: 174188 - protein, 9 aa, Homo Sapiens
LVSAFLNRM

SEQ ID NO: 174189 - protein, 9 aa, Homo Sapiens
CLLPTATTN

SEQ ID NO: 174190 - protein, 9 aa, Homo Sapiens
TKIHHVDAH

SEQ ID NO: 174191 - protein, 9 aa, Homo Sapiens
CLYTFLREV

SEQ ID NO: 174192 - protein, 9 aa, Homo Sapiens
LGHGHKGLM

SEQ ID NO: 174193 - protein, 9 aa, Homo Sapiens
MIGAILHLQ

SEQ ID NO: 174194 - protein, 9 aa, Homo Sapiens
GVGLAASFA

SEQ ID NO: 174195 - protein, 9 aa, Homo Sapiens
DLCSEKQKK

SEQ ID NO: 174196 - protein, 9 aa, Homo Sapiens
RFRLDMLKT

SEQ ID NO: 174197 - protein, 9 aa, Homo Sapiens
RGMGARPSC

SEQ ID NO: 174198 - protein, 9 aa, Homo Sapiens
SCPQGTLGH

SEQ ID NO: 174199 - protein, 9 aa, Homo Sapiens
VPEKCQFST

SEQ ID NO: 174200 - protein, 9 aa, Homo Sapiens
NLEEPTSPA

SEQ ID NO: 174201 - protein, 9 aa, Homo Sapiens
KCITECVRT

SEQ ID NO: 174202 - protein, 9 aa, Homo Sapiens
LLAVDFTAA

SEQ ID NO: 174203 - protein, 9 aa, Homo Sapiens
RDQSIISYL

SEQ ID NO: 174204 - protein, 9 aa, Homo Sapiens
YERALQVAH

SEQ ID NO: 174205 - protein, 9 aa, Homo Sapiens
PSSSSSDID

SEQ ID NO: 174206 - protein, 9 aa, Homo Sapiens
VALKVCYPE

SEQ ID NO: 174207 - protein, 9 aa, Homo Sapiens
PRRSFLRMP

SEQ ID NO: 174208 - protein, 9 aa, Homo Sapiens
SFSAPCCWR

SEQ ID NO: 174209 - protein, 9 aa, Homo Sapiens
WLEKLLRHP

SEQ ID NO: 174210 - protein, 9 aa, Homo Sapiens
NFSDPRNGM

SEQ ID NO: 174211 - protein, 9 aa, Homo Sapiens
TIYGAEVRK

SEQ ID NO: 174212 - protein, 9 aa, Homo Sapiens
AFHPRFHSS

SEQ ID NO: 174213 - protein, 9 aa, Homo Sapiens
CPASPHSPG

SEQ ID NO: 174214 - protein, 9 aa, Homo Sapiens
QKWLEKLLR

SEQ ID NO: 174215 - protein, 9 aa, Homo Sapiens
VPGEAHGRR

SEQ ID NO: 174216 - protein, 9 aa, Homo Sapiens
YLDPPSTAT

SEQ ID NO: 174217 - protein, 9 aa, Homo Sapiens
SSRPMRTAC

SEQ ID NO: 174218 - protein, 9 aa, Homo Sapiens
QCVATAESL

SEQ ID NO: 174219 - protein, 9 aa, Homo Sapiens
QTEMTRIKK

SEQ ID NO: 174220 - protein, 9 aa, Homo Sapiens
RTMTSGPTY

SEQ ID NO: 174221 - protein, 9 aa, Homo Sapiens
LHLAAGPLP

SEQ ID NO: 174222 - protein, 9 aa, Homo Sapiens
AFLISVSGS

SEQ ID NO: 174223 - protein, 9 aa, Homo Sapiens
GCQPLTKSM

SEQ ID NO: 174224 - protein, 9 aa, Homo Sapiens
SNEWFCCPE

SEQ ID NO: 174225 - protein, 9 aa, Homo Sapiens
KPEGRPCDD

SEQ ID NO: 174226 - protein, 9 aa, Homo Sapiens
VPGLPKVAM

SEQ ID NO: 174227 - protein, 9 aa, Homo Sapiens
AISSSVDPG

SEQ ID NO: 174228 - protein, 9 aa, Homo Sapiens
LERQVKKGV

SEQ ID NO: 174229 - protein, 9 aa, Homo Sapiens
HLDSNFRIL

SEQ ID NO: 174230 - protein, 9 aa, Homo Sapiens
RTSYNKIVP

SEQ ID NO: 174231 - protein, 9 aa, Homo Sapiens
EEPTCHNRT

SEQ ID NO: 174232 - protein, 9 aa, Homo Sapiens
GVAVVLAGT

SEQ ID NO: 174233 - protein, 9 aa, Homo Sapiens
IAKEVGQLA

SEQ ID NO: 174234 - protein, 9 aa, Homo Sapiens
TGQQLIGKV

SEQ ID NO: 174235 - protein, 9 aa, Homo Sapiens
SPHRHRPSL

SEQ ID NO: 174236 - protein, 9 aa, Homo Sapiens
QVFLVVFLY

SEQ ID NO: 174237 - protein, 9 aa, Homo Sapiens
PIPRITWLK

SEQ ID NO: 174238 - protein, 9 aa, Homo Sapiens
STYWFFFLF

SEQ ID NO: 174239 - protein, 9 aa, Homo Sapiens
QAAGRGGTT

SEQ ID NO: 174240 - protein, 9 aa, Homo Sapiens
GRTTHYKLT

SEQ ID NO: 174241 - protein, 9 aa, Homo Sapiens
TSQPPDCRC

SEQ ID NO: 174242 - protein, 9 aa, Homo Sapiens
ERLFQELQT

SEQ ID NO: 174243 - protein, 9 aa, Homo Sapiens
MSWRRLSHR

SEQ ID NO: 174244 - protein, 9 aa, Homo Sapiens
TLKRLLSRV

SEQ ID NO: 174245 - protein, 9 aa, Homo Sapiens
HSCQALSCK

SEQ ID NO: 174246 - protein, 9 aa, Homo Sapiens
VALQLGLRL

SEQ ID NO: 174247 - protein, 9 aa, Homo Sapiens
DSNFLNPPQ

SEQ ID NO: 174248 - protein, 9 aa, Homo Sapiens
NRKMGGPPR

SEQ ID NO: 174249 - protein, 9 aa, Homo Sapiens
PHSRPYMVF

SEQ ID NO: 174250 - protein, 9 aa, Homo Sapiens
FSKSTYLLP

SEQ ID NO: 174251 - protein, 9 aa, Homo Sapiens
KHREEKYEK

SEQ ID NO: 174252 - protein, 9 aa, Homo Sapiens
ELEYHDTDI

SEQ ID NO: 174253 - protein, 9 aa, Homo Sapiens
LTFVIMLLA

SEQ ID NO: 174254 - protein, 9 aa, Homo Sapiens
TMTFFGLAS

SEQ ID NO: 174255 - protein, 9 aa, Homo Sapiens
TLLVALKVC

SEQ ID NO: 174256 - protein, 9 aa, Homo Sapiens
AVAPLWPPA

SEQ ID NO: 174257 - protein, 9 aa, Homo Sapiens
NRKMKRRRK

SEQ ID NO: 174258 - protein, 9 aa, Homo Sapiens
LSNESQPIL

SEQ ID NO: 174259 - protein, 9 aa, Homo Sapiens
SGDVEEKTQ

SEQ ID NO: 174260 - protein, 9 aa, Homo Sapiens
RIDPQTPPS

SEQ ID NO: 174261 - protein, 9 aa, Homo Sapiens
AHSPASARL

SEQ ID NO: 174262 - protein, 9 aa, Homo Sapiens
QFKCRSCQM

SEQ ID NO: 174263 - protein, 9 aa, Homo Sapiens
CTIEPHSFQ

SEQ ID NO: 174264 - protein, 9 aa, Homo Sapiens
ITVYQTVTH

SEQ ID NO: 174265 - protein, 9 aa, Homo Sapiens
VRLCGGLRG

SEQ ID NO: 174266 - protein, 9 aa, Homo Sapiens
MCVETMELC

SEQ ID NO: 174267 - protein, 9 aa, Homo Sapiens
RGDAPSQPR

SEQ ID NO: 174268 - protein, 9 aa, Homo Sapiens
FCHSSTLLQ

SEQ ID NO: 174269 - protein, 9 aa, Homo Sapiens
QSVSRLFAP

SEQ ID NO: 174270 - protein, 9 aa, Homo Sapiens
LGPASVAPA

SEQ ID NO: 174271 - protein, 9 aa, Homo Sapiens
ALFRQGLRQ

SEQ ID NO: 174272 - protein, 9 aa, Homo Sapiens
RNLKCFLKT

SEQ ID NO: 174273 - protein, 9 aa, Homo Sapiens
HGHKGLMER

SEQ ID NO: 174274 - protein, 9 aa, Homo Sapiens
TQASMTLPA

SEQ ID NO: 174275 - protein, 9 aa, Homo Sapiens
HILRCQRER

SEQ ID NO: 174276 - protein, 9 aa, Homo Sapiens
IEELSTLHA

SEQ ID NO: 174277 - protein, 9 aa, Homo Sapiens
NLPKVDLDV

SEQ ID NO: 174278 - protein, 9 aa, Homo Sapiens
KAPPVGSGS

SEQ ID NO: 174279 - protein, 9 aa, Homo Sapiens
TGSPQLQDG

SEQ ID NO: 174280 - protein, 9 aa, Homo Sapiens
GARGAEREL

SEQ ID NO: 174281 - protein, 9 aa, Homo Sapiens
ERIDPQTPP

SEQ ID NO: 174282 - protein, 9 aa, Homo Sapiens
QPSLTHHRN

SEQ ID NO: 174283 - protein, 9 aa, Homo Sapiens
TADGQCYAL

SEQ ID NO: 174284 - protein, 9 aa, Homo Sapiens
ISSIRAGQC

SEQ ID NO: 174285 - protein, 9 aa, Homo Sapiens
MASMLKGRP

SEQ ID NO: 174286 - protein, 9 aa, Homo Sapiens
TPTTRLMAP

SEQ ID NO: 174287 - protein, 9 aa, Homo Sapiens
YYPNIWKYT

SEQ ID NO: 174288 - protein, 9 aa, Homo Sapiens
RRGIAITYE

SEQ ID NO: 174289 - protein, 9 aa, Homo Sapiens
GCRKWCKRE

SEQ ID NO: 174290 - protein, 9 aa, Homo Sapiens
YERGLTWYR

SEQ ID NO: 174291 - protein, 9 aa, Homo Sapiens
VLHMSILLR

SEQ ID NO: 174292 - protein, 9 aa, Homo Sapiens
SSLWAWKGL

SEQ ID NO: 174293 - protein, 9 aa, Homo Sapiens
VPCSPLQRS

SEQ ID NO: 174294 - protein, 9 aa, Homo Sapiens
ARQGAEEAL

SEQ ID NO: 174295 - protein, 9 aa, Homo Sapiens
SSSSSDIDS

SEQ ID NO: 174296 - protein, 9 aa, Homo Sapiens
FFCNMATVY

SEQ ID NO: 174297 - protein, 9 aa, Homo Sapiens
HSLELPEPN

SEQ ID NO: 174298 - protein, 9 aa, Homo Sapiens
CCKRLDGLG

SEQ ID NO: 174299 - protein, 9 aa, Homo Sapiens
TSRKSRPCT

SEQ ID NO: 174300 - protein, 9 aa, Homo Sapiens
GVATPGRPW

SEQ ID NO: 174301 - protein, 9 aa, Homo Sapiens
GFFFLLPVA

SEQ ID NO: 174302 - protein, 9 aa, Homo Sapiens
AAWGWEGCW

SEQ ID NO: 174303 - protein, 9 aa, Homo Sapiens
ESTVARPCR

SEQ ID NO: 174304 - protein, 9 aa, Homo Sapiens
HLVEGAVQP

SEQ ID NO: 174305 - protein, 9 aa, Homo Sapiens
RLRHTYANG

SEQ ID NO: 174306 - protein, 9 aa, Homo Sapiens
QTMVCDITD

SEQ ID NO: 174307 - protein, 9 aa, Homo Sapiens
QWLETLATK

SEQ ID NO: 174308 - protein, 9 aa, Homo Sapiens
STEWWTMVC

SEQ ID NO: 174309 - protein, 9 aa, Homo Sapiens
NYENQKWLE

SEQ ID NO: 174310 - protein, 9 aa, Homo Sapiens
SLQMPVLKP

SEQ ID NO: 174311 - protein, 9 aa, Homo Sapiens
GALTPPHPA

SEQ ID NO: 174312 - protein, 9 aa, Homo Sapiens
VHQPQHLGA

SEQ ID NO: 174313 - protein, 9 aa, Homo Sapiens
GLAAGAVLR

SEQ ID NO: 174314 - protein, 9 aa, Homo Sapiens
SRSLRISHK

SEQ ID NO: 174315 - protein, 9 aa, Homo Sapiens
NSHMCTEPV

SEQ ID NO: 174316 - protein, 9 aa, Homo Sapiens
LRPVRLQKY

SEQ ID NO: 174317 - protein, 9 aa, Homo Sapiens
GGKTPWLNH

SEQ ID NO: 174318 - protein, 9 aa, Homo Sapiens
FSLLLLRPT

SEQ ID NO: 174319 - protein, 9 aa, Homo Sapiens
RWKKLVLMD

SEQ ID NO: 174320 - protein, 9 aa, Homo Sapiens
PSSRNNKEH

SEQ ID NO: 174321 - protein, 9 aa, Homo Sapiens
PSWRKRDQK

SEQ ID NO: 174322 - protein, 9 aa, Homo Sapiens
QPKCKCRPR

SEQ ID NO: 174323 - protein, 9 aa, Homo Sapiens
LFLTTTSRK

SEQ ID NO: 174324 - protein, 9 aa, Homo Sapiens
GMETETINH

SEQ ID NO: 174325 - protein, 9 aa, Homo Sapiens
RRTVPGGPG

SEQ ID NO: 174326 - protein, 9 aa, Homo Sapiens
LSSSLRMTP

SEQ ID NO: 174327 - protein, 9 aa, Homo Sapiens
AAHSVCLAR

SEQ ID NO: 174328 - protein, 9 aa, Homo Sapiens
PLNSHMCTE

SEQ ID NO: 174329 - protein, 9 aa, Homo Sapiens
GRERRDRRP

SEQ ID NO: 174330 - protein, 9 aa, Homo Sapiens
WSALRVPRE

SEQ ID NO: 174331 - protein, 9 aa, Homo Sapiens
KGPLNLQGG

SEQ ID NO: 174332 - protein, 9 aa, Homo Sapiens
QIYFMACTV

SEQ ID NO: 174333 - protein, 9 aa, Homo Sapiens
TETDRKDLM

SEQ ID NO: 174334 - protein, 9 aa, Homo Sapiens
GWMRRWRRR

SEQ ID NO: 174335 - protein, 9 aa, Homo Sapiens
VLPPKPLAA

SEQ ID NO: 174336 - protein, 9 aa, Homo Sapiens
GAMEETVVV

SEQ ID NO: 174337 - protein, 9 aa, Homo Sapiens
VQLDLSKAR

SEQ ID NO: 174338 - protein, 9 aa, Homo Sapiens
TPAQLPTAT

SEQ ID NO: 174339 - protein, 9 aa, Homo Sapiens
QQHRGPVRH

SEQ ID NO: 174340 - protein, 9 aa, Homo Sapiens
WSLTLSTRA

SEQ ID NO: 174341 - protein, 9 aa, Homo Sapiens
VKSVEYFFL

SEQ ID NO: 174342 - protein, 9 aa, Homo Sapiens
DFLIQKGAE

SEQ ID NO: 174343 - protein, 9 aa, Homo Sapiens
AKPFPTRGR

SEQ ID NO: 174344 - protein, 9 aa, Homo Sapiens
NDQPEQEER

SEQ ID NO: 174345 - protein, 9 aa, Homo Sapiens
FCLLGTFRR

SEQ ID NO: 174346 - protein, 9 aa, Homo Sapiens
LPHSFPAPA

SEQ ID NO: 174347 - protein, 9 aa, Homo Sapiens
LRSYDDFCS

SEQ ID NO: 174348 - protein, 9 aa, Homo Sapiens
AEVQHAAHQ

SEQ ID NO: 174349 - protein, 9 aa, Homo Sapiens
TRLSGIPTR

SEQ ID NO: 174350 - protein, 9 aa, Homo Sapiens
RMSAGAARR

SEQ ID NO: 174351 - protein, 9 aa, Homo Sapiens
EEALGGPGG

SEQ ID NO: 174352 - protein, 9 aa, Homo Sapiens
MYFLYFSDL

SEQ ID NO: 174353 - protein, 9 aa, Homo Sapiens
KLIVYLQHF

SEQ ID NO: 174354 - protein, 9 aa, Homo Sapiens
VGHARAQAV

SEQ ID NO: 174355 - protein, 9 aa, Homo Sapiens
VDARGEIHG

SEQ ID NO: 174356 - protein, 9 aa, Homo Sapiens
ALKEDLLYL

SEQ ID NO: 174357 - protein, 9 aa, Homo Sapiens
DHIDTCLSV

SEQ ID NO: 174358 - protein, 9 aa, Homo Sapiens
LNSHMCTEP

SEQ ID NO: 174359 - protein, 9 aa, Homo Sapiens
QGQGLPAGA

SEQ ID NO: 174360 - protein, 9 aa, Homo Sapiens
VPPPAATAA

SEQ ID NO: 174361 - protein, 9 aa, Homo Sapiens
QWFTPCCMR

SEQ ID NO: 174362 - protein, 9 aa, Homo Sapiens
DMSAFIRRY

SEQ ID NO: 174363 - protein, 9 aa, Homo Sapiens
PEQLPQHAL

SEQ ID NO: 174364 - protein, 9 aa, Homo Sapiens
THQLEWVSF

SEQ ID NO: 174365 - protein, 9 aa, Homo Sapiens
RARGLQVLA

SEQ ID NO: 174366 - protein, 9 aa, Homo Sapiens
QQPEGRLSP

SEQ ID NO: 174367 - protein, 9 aa, Homo Sapiens
ALSNKNLLI

SEQ ID NO: 174368 - protein, 9 aa, Homo Sapiens
LPPCSSLWA

SEQ ID NO: 174369 - protein, 9 aa, Homo Sapiens
YADDHFSVY

SEQ ID NO: 174370 - protein, 9 aa, Homo Sapiens
DLRHLPDVA

SEQ ID NO: 174371 - protein, 9 aa, Homo Sapiens
LPPVLEHFL

SEQ ID NO: 174372 - protein, 9 aa, Homo Sapiens
DFGLATEKS

SEQ ID NO: 174373 - protein, 9 aa, Homo Sapiens
ARRPRTPEA

SEQ ID NO: 174374 - protein, 9 aa, Homo Sapiens
QPSLPGPCA

SEQ ID NO: 174375 - protein, 9 aa, Homo Sapiens
GSVMSCSLL

SEQ ID NO: 174376 - protein, 9 aa, Homo Sapiens
QAAILAWSH

SEQ ID NO: 174377 - protein, 9 aa, Homo Sapiens
PGEAHGRRH

SEQ ID NO: 174378 - protein, 9 aa, Homo Sapiens
WVWGPPTCS

SEQ ID NO: 174379 - protein, 9 aa, Homo Sapiens
QGTWGFPIV

SEQ ID NO: 174380 - protein, 9 aa, Homo Sapiens
RLLSRVRSD

SEQ ID NO: 174381 - protein, 9 aa, Homo Sapiens
DTVSLQFTY

SEQ ID NO: 174382 - protein, 9 aa, Homo Sapiens
VGAQLCTIE

SEQ ID NO: 174383 - protein, 9 aa, Homo Sapiens
PQTPPSRTM

SEQ ID NO: 174384 - protein, 9 aa, Homo Sapiens
ISECCDFCD

SEQ ID NO: 174385 - protein, 9 aa, Homo Sapiens
RNLFVPAFL

SEQ ID NO: 174386 - protein, 9 aa, Homo Sapiens
WIEMEQELQ

SEQ ID NO: 174387 - protein, 9 aa, Homo Sapiens
PWGHPVGGA

SEQ ID NO: 174388 - protein, 9 aa, Homo Sapiens
YVLYSKRFH

SEQ ID NO: 174389 - protein, 9 aa, Homo Sapiens
LLEGKECRM

SEQ ID NO: 174390 - protein, 9 aa, Homo Sapiens
MASVNAARA

SEQ ID NO: 174391 - protein, 9 aa, Homo Sapiens
AYSRFLSTE

SEQ ID NO: 174392 - protein, 9 aa, Homo Sapiens
EKLLRHPLK

SEQ ID NO: 174393 - protein, 9 aa, Homo Sapiens
LLLVVGSYA

SEQ ID NO: 174394 - protein, 9 aa, Homo Sapiens
GLVLLAWPV

SEQ ID NO: 174395 - protein, 9 aa, Homo Sapiens
LYLFVESSH

SEQ ID NO: 174396 - protein, 9 aa, Homo Sapiens
ESWYSTANY

SEQ ID NO: 174397 - protein, 9 aa, Homo Sapiens
IRNHITEVG

SEQ ID NO: 174398 - protein, 9 aa, Homo Sapiens
TPKNVLWRK

SEQ ID NO: 174399 - protein, 9 aa, Homo Sapiens
CASALQKHQ

SEQ ID NO: 174400 - protein, 9 aa, Homo Sapiens
WGATGVRTS

SEQ ID NO: 174401 - protein, 9 aa, Homo Sapiens
EPDCGTRRL

SEQ ID NO: 174402 - protein, 9 aa, Homo Sapiens
LDPPVNRGF

SEQ ID NO: 174403 - protein, 9 aa, Homo Sapiens
VPIGSHWGC

SEQ ID NO: 174404 - protein, 9 aa, Homo Sapiens
RELLSQGTT

SEQ ID NO: 174405 - protein, 9 aa, Homo Sapiens
RPPHTSINE

SEQ ID NO: 174406 - protein, 9 aa, Homo Sapiens
SFLEKPPAS

SEQ ID NO: 174407 - protein, 9 aa, Homo Sapiens
LVVHLVEGA

SEQ ID NO: 174408 - protein, 9 aa, Homo Sapiens
RPKPPIESH

SEQ ID NO: 174409 - protein, 9 aa, Homo Sapiens
QGLVAGVGL

SEQ ID NO: 174410 - protein, 9 aa, Homo Sapiens
IPQWYHVMV

SEQ ID NO: 174411 - protein, 9 aa, Homo Sapiens
LLEHTQHGI

SEQ ID NO: 174412 - protein, 9 aa, Homo Sapiens
EAKEKTEKP

SEQ ID NO: 174413 - protein, 9 aa, Homo Sapiens
GGPTPRRPS

SEQ ID NO: 174414 - protein, 9 aa, Homo Sapiens
VDNEVQSSG

SEQ ID NO: 174415 - protein, 9 aa, Homo Sapiens
LWISINEKC

SEQ ID NO: 174416 - protein, 9 aa, Homo Sapiens
RRDRRPGPS

SEQ ID NO: 174417 - protein, 9 aa, Homo Sapiens
VFQYLPSSW

SEQ ID NO: 174418 - protein, 9 aa, Homo Sapiens
NCDKHGPYN

SEQ ID NO: 174419 - protein, 9 aa, Homo Sapiens
VQRGQQQFS

SEQ ID NO: 174420 - protein, 9 aa, Homo Sapiens
LRGMGARPS

SEQ ID NO: 174421 - protein, 9 aa, Homo Sapiens
ISVPYFERK

SEQ ID NO: 174422 - protein, 9 aa, Homo Sapiens
LHCLLTTMP

SEQ ID NO: 174423 - protein, 9 aa, Homo Sapiens
TKIEAKGML

SEQ ID NO: 174424 - protein, 9 aa, Homo Sapiens
TETQSTGEA

SEQ ID NO: 174425 - protein, 9 aa, Homo Sapiens
QPGSQLPHS

SEQ ID NO: 174426 - protein, 9 aa, Homo Sapiens
SPLSLLAGV

SEQ ID NO: 174427 - protein, 9 aa, Homo Sapiens
LFFLHFVGD

SEQ ID NO: 174428 - protein, 9 aa, Homo Sapiens
VCNLALRMM

SEQ ID NO: 174429 - protein, 9 aa, Homo Sapiens
QDRSGTRDD

SEQ ID NO: 174430 - protein, 9 aa, Homo Sapiens
RFMTLEYNS

SEQ ID NO: 174431 - protein, 9 aa, Homo Sapiens
TFADLCSEK

SEQ ID NO: 174432 - protein, 9 aa, Homo Sapiens
ASTATWTCS

SEQ ID NO: 174433 - protein, 9 aa, Homo Sapiens
CGPASITAI

SEQ ID NO: 174434 - protein, 9 aa, Homo Sapiens
VEEEEDDDD

SEQ ID NO: 174435 - protein, 9 aa, Homo Sapiens
EVQHAAHQL

SEQ ID NO: 174436 - protein, 9 aa, Homo Sapiens
GDSKVANPG

SEQ ID NO: 174437 - protein, 9 aa, Homo Sapiens
VGASFPPSV

SEQ ID NO: 174438 - protein, 9 aa, Homo Sapiens
NCEDDINCG

SEQ ID NO: 174439 - protein, 9 aa, Homo Sapiens
AQGTWGFPI

SEQ ID NO: 174440 - protein, 9 aa, Homo Sapiens
RSHWSCCRR

SEQ ID NO: 174441 - protein, 9 aa, Homo Sapiens
YGKVTGSTS

SEQ ID NO: 174442 - protein, 9 aa, Homo Sapiens
KVANPGGDT

SEQ ID NO: 174443 - protein, 9 aa, Homo Sapiens
HPVFQLKKT

SEQ ID NO: 174444 - protein, 9 aa, Homo Sapiens
SVSLEWVME

SEQ ID NO: 174445 - protein, 9 aa, Homo Sapiens
LPSSWPNWG

SEQ ID NO: 174446 - protein, 9 aa, Homo Sapiens
SILLRMIPT

SEQ ID NO: 174447 - protein, 9 aa, Homo Sapiens
AKQGSWEGS

SEQ ID NO: 174448 - protein, 9 aa, Homo Sapiens
WPRWTWVLS

SEQ ID NO: 174449 - protein, 9 aa, Homo Sapiens
PLPAPQGAL

SEQ ID NO: 174450 - protein, 9 aa, Homo Sapiens
RTSFCVYSI

SEQ ID NO: 174451 - protein, 9 aa, Homo Sapiens
TDHIDTCLS

SEQ ID NO: 174452 - protein, 9 aa, Homo Sapiens
GIRRSSISS

SEQ ID NO: 174453 - protein, 9 aa, Homo Sapiens
SAGDHHHAC

SEQ ID NO: 174454 - protein, 9 aa, Homo Sapiens
ENGYMRPEA

SEQ ID NO: 174455 - protein, 9 aa, Homo Sapiens
SEAVTTRVC

SEQ ID NO: 174456 - protein, 9 aa, Homo Sapiens
PPQEHFCRP

SEQ ID NO: 174457 - protein, 9 aa, Homo Sapiens
RPVRLQKYP

SEQ ID NO: 174458 - protein, 9 aa, Homo Sapiens
GVTSILLLF

SEQ ID NO: 174459 - protein, 9 aa, Homo Sapiens
LVVSSDAST

SEQ ID NO: 174460 - protein, 9 aa, Homo Sapiens
EALVSRPKP

SEQ ID NO: 174461 - protein, 9 aa, Homo Sapiens
RSSKVMTKV

SEQ ID NO: 174462 - protein, 9 aa, Homo Sapiens
SSDQWYRAF

SEQ ID NO: 174463 - protein, 9 aa, Homo Sapiens
GWEGCWRAV

SEQ ID NO: 174464 - protein, 9 aa, Homo Sapiens
QWKKVVTKW

SEQ ID NO: 174465 - protein, 9 aa, Homo Sapiens
ATQKLPVSQ

SEQ ID NO: 174466 - protein, 9 aa, Homo Sapiens
IWEQEEKRQ

SEQ ID NO: 174467 - protein, 9 aa, Homo Sapiens
APEYNRPHR

SEQ ID NO: 174468 - protein, 9 aa, Homo Sapiens
AAMEETEVG

SEQ ID NO: 174469 - protein, 9 aa, Homo Sapiens
GSWEGSSDQ

SEQ ID NO: 174470 - protein, 9 aa, Homo Sapiens
YSDMELECE

SEQ ID NO: 174471 - protein, 9 aa, Homo Sapiens
QIDKSYPTV

SEQ ID NO: 174472 - protein, 9 aa, Homo Sapiens
GLGGGFMVL

SEQ ID NO: 174473 - protein, 9 aa, Homo Sapiens
PTCILGQRA

SEQ ID NO: 174474 - protein, 9 aa, Homo Sapiens
AICHMYRFP

SEQ ID NO: 174475 - protein, 9 aa, Homo Sapiens
INTEDWKKR

SEQ ID NO: 174476 - protein, 9 aa, Homo Sapiens
RAYPQQLFL

SEQ ID NO: 174477 - protein, 9 aa, Homo Sapiens
QLPINIITI

SEQ ID NO: 174478 - protein, 9 aa, Homo Sapiens
LSSPPSPPS

SEQ ID NO: 174479 - protein, 9 aa, Homo Sapiens
AAAARGGGE

SEQ ID NO: 174480 - protein, 9 aa, Homo Sapiens
HTEAKKAYP

SEQ ID NO: 174481 - protein, 9 aa, Homo Sapiens
MSAHHMALS

SEQ ID NO: 174482 - protein, 9 aa, Homo Sapiens
VMRFERFGC

SEQ ID NO: 174483 - protein, 9 aa, Homo Sapiens
SRGAMEETV

SEQ ID NO: 174484 - protein, 9 aa, Homo Sapiens
AIQRMQAEI

SEQ ID NO: 174485 - protein, 9 aa, Homo Sapiens
SFQEIAKEV

SEQ ID NO: 174486 - protein, 9 aa, Homo Sapiens
YANTALNPI

SEQ ID NO: 174487 - protein, 9 aa, Homo Sapiens
HMLMEDFSL

SEQ ID NO: 174488 - protein, 9 aa, Homo Sapiens
QCSYNTAQL

SEQ ID NO: 174489 - protein, 9 aa, Homo Sapiens
ILLDGQWVK

SEQ ID NO: 174490 - protein, 9 aa, Homo Sapiens
CVQALMAEQ

SEQ ID NO: 174491 - protein, 9 aa, Homo Sapiens
PVDNSTESE

SEQ ID NO: 174492 - protein, 9 aa, Homo Sapiens
SPTCLGHPV

SEQ ID NO: 174493 - protein, 9 aa, Homo Sapiens
PLPEYLSHG

SEQ ID NO: 174494 - protein, 9 aa, Homo Sapiens
TAQVKRLAS

SEQ ID NO: 174495 - protein, 9 aa, Homo Sapiens
PLTQPPQTA

SEQ ID NO: 174496 - protein, 9 aa, Homo Sapiens
VKGDLFVNE

SEQ ID NO: 174497 - protein, 9 aa, Homo Sapiens
LYRTRAGYL

SEQ ID NO: 174498 - protein, 9 aa, Homo Sapiens
SDQLRCSQA

SEQ ID NO: 174499 - protein, 9 aa, Homo Sapiens
PRWTWVLSS

SEQ ID NO: 174500 - protein, 9 aa, Homo Sapiens
LQLVEHPHA

SEQ ID NO: 174501 - protein, 9 aa, Homo Sapiens
RWTRGWMTR

SEQ ID NO: 174502 - protein, 9 aa, Homo Sapiens
WLKKAFCLW

SEQ ID NO: 174503 - protein, 9 aa, Homo Sapiens
TVVCVCEVT

SEQ ID NO: 174504 - protein, 9 aa, Homo Sapiens
STGPSPAGW

SEQ ID NO: 174505 - protein, 9 aa, Homo Sapiens
FSDPRNGMD

SEQ ID NO: 174506 - protein, 9 aa, Homo Sapiens
IPKQDTVPP

SEQ ID NO: 174507 - protein, 9 aa, Homo Sapiens
RKWKKGKRD

SEQ ID NO: 174508 - protein, 9 aa, Homo Sapiens
GSPQLQDGS

SEQ ID NO: 174509 - protein, 9 aa, Homo Sapiens
KLHFASRIR

SEQ ID NO: 174510 - protein, 9 aa, Homo Sapiens
RQSCCLPGL

SEQ ID NO: 174511 - protein, 9 aa, Homo Sapiens
KSSRMQGLG

SEQ ID NO: 174512 - protein, 9 aa, Homo Sapiens
SRPTSRARQ

SEQ ID NO: 174513 - protein, 9 aa, Homo Sapiens
VREAGPMAF

SEQ ID NO: 174514 - protein, 9 aa, Homo Sapiens
VLIEAITEY

SEQ ID NO: 174515 - protein, 9 aa, Homo Sapiens
CCPEALFQP

SEQ ID NO: 174516 - protein, 9 aa, Homo Sapiens
SCTFCKPQR

SEQ ID NO: 174517 - protein, 9 aa, Homo Sapiens
MNSKSASAT

SEQ ID NO: 174518 - protein, 9 aa, Homo Sapiens
GKQFTQLNT

SEQ ID NO: 174519 - protein, 9 aa, Homo Sapiens
EPQYLDPPS

SEQ ID NO: 174520 - protein, 9 aa, Homo Sapiens
HCLLTAHLL

SEQ ID NO: 174521 - protein, 9 aa, Homo Sapiens
HKSRRLRLC

SEQ ID NO: 174522 - protein, 9 aa, Homo Sapiens
LLYLRTSGE

SEQ ID NO: 174523 - protein, 9 aa, Homo Sapiens
PLVLHMSIL

SEQ ID NO: 174524 - protein, 9 aa, Homo Sapiens
YLQHFRPQD

SEQ ID NO: 174525 - protein, 9 aa, Homo Sapiens
LARIKLRMN

SEQ ID NO: 174526 - protein, 9 aa, Homo Sapiens
TQRPGPASS

SEQ ID NO: 174527 - protein, 9 aa, Homo Sapiens
CSLSSDTVF

SEQ ID NO: 174528 - protein, 9 aa, Homo Sapiens
VVGLAAVCF

SEQ ID NO: 174529 - protein, 9 aa, Homo Sapiens
DYDVLLPKS

SEQ ID NO: 174530 - protein, 9 aa, Homo Sapiens
VPGPGAARG

SEQ ID NO: 174531 - protein, 9 aa, Homo Sapiens
YGSHSQHLP

SEQ ID NO: 174532 - protein, 9 aa, Homo Sapiens
VLVIMLSSV

SEQ ID NO: 174533 - protein, 9 aa, Homo Sapiens
KPHMKIFLR

SEQ ID NO: 174534 - protein, 9 aa, Homo Sapiens
EDSYFEELR

SEQ ID NO: 174535 - protein, 9 aa, Homo Sapiens
LSTIFTSST

SEQ ID NO: 174536 - protein, 9 aa, Homo Sapiens
FWGEKIVAL

SEQ ID NO: 174537 - protein, 9 aa, Homo Sapiens
GIAITYEDE

SEQ ID NO: 174538 - protein, 9 aa, Homo Sapiens
PWVQHTPPP

SEQ ID NO: 174539 - protein, 9 aa, Homo Sapiens
VSHHLNAVL

SEQ ID NO: 174540 - protein, 9 aa, Homo Sapiens
SPSMTSPWW

SEQ ID NO: 174541 - protein, 9 aa, Homo Sapiens
PRFCPDTWA

SEQ ID NO: 174542 - protein, 9 aa, Homo Sapiens
ILYAWDAWL

SEQ ID NO: 174543 - protein, 9 aa, Homo Sapiens
QITKVHFKE

SEQ ID NO: 174544 - protein, 9 aa, Homo Sapiens
WSTCVCLLG

SEQ ID NO: 174545 - protein, 9 aa, Homo Sapiens
RPRALGAGA

SEQ ID NO: 174546 - protein, 9 aa, Homo Sapiens
IVSTVQNYL

SEQ ID NO: 174547 - protein, 9 aa, Homo Sapiens
GPEREDIIT

SEQ ID NO: 174548 - protein, 9 aa, Homo Sapiens
SHMCTEPVT

SEQ ID NO: 174549 - protein, 9 aa, Homo Sapiens
ATSSPTRRR

SEQ ID NO: 174550 - protein, 9 aa, Homo Sapiens
QDRWRTQRP

SEQ ID NO: 174551 - protein, 9 aa, Homo Sapiens
QVPPQLPQA

SEQ ID NO: 174552 - protein, 9 aa, Homo Sapiens
TSDCALCAC

SEQ ID NO: 174553 - protein, 9 aa, Homo Sapiens
KTCRRPHPV

SEQ ID NO: 174554 - protein, 9 aa, Homo Sapiens
RPVSKKKDL

SEQ ID NO: 174555 - protein, 9 aa, Homo Sapiens
EALGGPGGL

SEQ ID NO: 174556 - protein, 9 aa, Homo Sapiens
NIQYQVVPQ

SEQ ID NO: 174557 - protein, 9 aa, Homo Sapiens
GYEVEPGYG

SEQ ID NO: 174558 - protein, 9 aa, Homo Sapiens
GPSFEELQS

SEQ ID NO: 174559 - protein, 9 aa, Homo Sapiens
VPPWSPGEA

SEQ ID NO: 174560 - protein, 9 aa, Homo Sapiens
EVMPRTLEG

SEQ ID NO: 174561 - protein, 9 aa, Homo Sapiens
GGPTAGGAL

SEQ ID NO: 174562 - protein, 9 aa, Homo Sapiens
RALPVEELH

SEQ ID NO: 174563 - protein, 9 aa, Homo Sapiens
ILMNGTLKQ

SEQ ID NO: 174564 - protein, 9 aa, Homo Sapiens
CQALSCKMA

SEQ ID NO: 174565 - protein, 9 aa, Homo Sapiens
SREELNQET

SEQ ID NO: 174566 - protein, 9 aa, Homo Sapiens
FKMKVLVIM

SEQ ID NO: 174567 - protein, 9 aa, Homo Sapiens
HIKKQHRRT

SEQ ID NO: 174568 - protein, 9 aa, Homo Sapiens
GGIGRVGVC

SEQ ID NO: 174569 - protein, 9 aa, Homo Sapiens
KRLLSRVRS

SEQ ID NO: 174570 - protein, 9 aa, Homo Sapiens
ARRYSDVFQ

SEQ ID NO: 174571 - protein, 9 aa, Homo Sapiens
IMGVEEEED

SEQ ID NO: 174572 - protein, 9 aa, Homo Sapiens
VTISCVGFP

SEQ ID NO: 174573 - protein, 9 aa, Homo Sapiens
HKVIAEAED

SEQ ID NO: 174574 - protein, 9 aa, Homo Sapiens
WPQITKVHF

SEQ ID NO: 174575 - protein, 9 aa, Homo Sapiens
REVHALYEE

SEQ ID NO: 174576 - protein, 9 aa, Homo Sapiens
YQNCIKEVE

SEQ ID NO: 174577 - protein, 9 aa, Homo Sapiens
CSSNLTLTA

SEQ ID NO: 174578 - protein, 9 aa, Homo Sapiens
FRCGPASIT

SEQ ID NO: 174579 - protein, 9 aa, Homo Sapiens
RHTGFSLFY

SEQ ID NO: 174580 - protein, 9 aa, Homo Sapiens
YNGFKVLNM

SEQ ID NO: 174581 - protein, 9 aa, Homo Sapiens
TEVEAMEET

SEQ ID NO: 174582 - protein, 9 aa, Homo Sapiens
KLVAIRTCL

SEQ ID NO: 174583 - protein, 9 aa, Homo Sapiens
YFWPQITKV

SEQ ID NO: 174584 - protein, 9 aa, Homo Sapiens
KRESWYSTA

SEQ ID NO: 174585 - protein, 9 aa, Homo Sapiens
WCFLFPFQY

SEQ ID NO: 174586 - protein, 9 aa, Homo Sapiens
LQRLIRKAM

SEQ ID NO: 174587 - protein, 9 aa, Homo Sapiens
GQWRLIFET

SEQ ID NO: 174588 - protein, 9 aa, Homo Sapiens
IEVWRENAE

SEQ ID NO: 174589 - protein, 9 aa, Homo Sapiens
TTHPTCILG

SEQ ID NO: 174590 - protein, 9 aa, Homo Sapiens
QIRAFHLQS

SEQ ID NO: 174591 - protein, 9 aa, Homo Sapiens
SKVGSWPWV

SEQ ID NO: 174592 - protein, 9 aa, Homo Sapiens
PRALARLPP

SEQ ID NO: 174593 - protein, 9 aa, Homo Sapiens
LSHRGLAAS

SEQ ID NO: 174594 - protein, 9 aa, Homo Sapiens
KGRRVTQAL

SEQ ID NO: 174595 - protein, 9 aa, Homo Sapiens
GVFCANYLT

SEQ ID NO: 174596 - protein, 9 aa, Homo Sapiens
ERMKLVVQV

SEQ ID NO: 174597 - protein, 9 aa, Homo Sapiens
LVIVGHGHE

SEQ ID NO: 174598 - protein, 9 aa, Homo Sapiens
FLGGQKSKA

SEQ ID NO: 174599 - protein, 9 aa, Homo Sapiens
CPAVPAAAC

SEQ ID NO: 174600 - protein, 9 aa, Homo Sapiens
LPAPQGALT

SEQ ID NO: 174601 - protein, 9 aa, Homo Sapiens
SALRVPREK

SEQ ID NO: 174602 - protein, 9 aa, Homo Sapiens
FASKQALKP

SEQ ID NO: 174603 - protein, 9 aa, Homo Sapiens
PTHLRNRLP

SEQ ID NO: 174604 - protein, 9 aa, Homo Sapiens
HFVKSVEYF

SEQ ID NO: 174605 - protein, 9 aa, Homo Sapiens
LHLPSPPVR

SEQ ID NO: 174606 - protein, 9 aa, Homo Sapiens
GQQPRHGHP

SEQ ID NO: 174607 - protein, 9 aa, Homo Sapiens
NPEKLALKE

SEQ ID NO: 174608 - protein, 9 aa, Homo Sapiens
ECFFLWESL

SEQ ID NO: 174609 - protein, 9 aa, Homo Sapiens
EYWRDCLLK

SEQ ID NO: 174610 - protein, 9 aa, Homo Sapiens
MEGAEPRQH

SEQ ID NO: 174611 - protein, 9 aa, Homo Sapiens
LVTRLHCPS

SEQ ID NO: 174612 - protein, 9 aa, Homo Sapiens
HLQGPWSTC

SEQ ID NO: 174613 - protein, 9 aa, Homo Sapiens
GKGGPTPRR

SEQ ID NO: 174614 - protein, 9 aa, Homo Sapiens
TYVQLLVTR

SEQ ID NO: 174615 - protein, 9 aa, Homo Sapiens
MSSAGDHNG

SEQ ID NO: 174616 - protein, 9 aa, Homo Sapiens
PLGPVDALV

SEQ ID NO: 174617 - protein, 9 aa, Homo Sapiens
LHAQAADKI

SEQ ID NO: 174618 - protein, 9 aa, Homo Sapiens
SPASACTMP

SEQ ID NO: 174619 - protein, 9 aa, Homo Sapiens
LKRHLLQQR

SEQ ID NO: 174620 - protein, 9 aa, Homo Sapiens
TIQTYVPWN

SEQ ID NO: 174621 - protein, 9 aa, Homo Sapiens
GRSSLAVHQ

SEQ ID NO: 174622 - protein, 9 aa, Homo Sapiens
FTINSTERK

SEQ ID NO: 174623 - protein, 9 aa, Homo Sapiens
GGEDAELRR

SEQ ID NO: 174624 - protein, 9 aa, Homo Sapiens
SIDTDIDSF

SEQ ID NO: 174625 - protein, 9 aa, Homo Sapiens
HYFRKARDT

SEQ ID NO: 174626 - protein, 9 aa, Homo Sapiens
LSLAPGYLL

SEQ ID NO: 174627 - protein, 9 aa, Homo Sapiens
FEHDGHPYC

SEQ ID NO: 174628 - protein, 9 aa, Homo Sapiens
EVRKESRGT

SEQ ID NO: 174629 - protein, 9 aa, Homo Sapiens
NPGVHPQLP

SEQ ID NO: 174630 - protein, 9 aa, Homo Sapiens
ECFVSEIIG

SEQ ID NO: 174631 - protein, 9 aa, Homo Sapiens
SCSLLTQPS

SEQ ID NO: 174632 - protein, 9 aa, Homo Sapiens
RKAAKRMHL

SEQ ID NO: 174633 - protein, 9 aa, Homo Sapiens
PAMSCTFRP

SEQ ID NO: 174634 - protein, 9 aa, Homo Sapiens
EEEVITLNA

SEQ ID NO: 174635 - protein, 9 aa, Homo Sapiens
AREGWSLID

SEQ ID NO: 174636 - protein, 9 aa, Homo Sapiens
HSDQGEFYC

SEQ ID NO: 174637 - protein, 9 aa, Homo Sapiens
GRGWDSESW

SEQ ID NO: 174638 - protein, 9 aa, Homo Sapiens
HHRLPRWPP

SEQ ID NO: 174639 - protein, 9 aa, Homo Sapiens
VLLKWTEYT

SEQ ID NO: 174640 - protein, 9 aa, Homo Sapiens
VISVVELSG

SEQ ID NO: 174641 - protein, 9 aa, Homo Sapiens
TEHGSQKRT

SEQ ID NO: 174642 - protein, 9 aa, Homo Sapiens
CGQLAIRWT

SEQ ID NO: 174643 - protein, 9 aa, Homo Sapiens
NHQLNMFKV

SEQ ID NO: 174644 - protein, 9 aa, Homo Sapiens
AVECFVSEI

SEQ ID NO: 174645 - protein, 9 aa, Homo Sapiens
LHPMGWCTQ

SEQ ID NO: 174646 - protein, 9 aa, Homo Sapiens
GSQAGGHIA

SEQ ID NO: 174647 - protein, 9 aa, Homo Sapiens
AERAKCQAQ

SEQ ID NO: 174648 - protein, 9 aa, Homo Sapiens
VGGVPGPGA

SEQ ID NO: 174649 - protein, 9 aa, Homo Sapiens
ESQLPALVI

SEQ ID NO: 174650 - protein, 9 aa, Homo Sapiens
QGSTAYSSH

SEQ ID NO: 174651 - protein, 9 aa, Homo Sapiens
CELAFTMAE

SEQ ID NO: 174652 - protein, 9 aa, Homo Sapiens
FPRSKHPTG

SEQ ID NO: 174653 - protein, 9 aa, Homo Sapiens
ACRQRCWPL

SEQ ID NO: 174654 - protein, 9 aa, Homo Sapiens
HQRTHMGER

SEQ ID NO: 174655 - protein, 9 aa, Homo Sapiens
VTEHKIIHT

SEQ ID NO: 174656 - protein, 9 aa, Homo Sapiens
QREGQNYQN

SEQ ID NO: 174657 - protein, 9 aa, Homo Sapiens
RRRGRGRGR

SEQ ID NO: 174658 - protein, 9 aa, Homo Sapiens
RQGPAPQGQ

SEQ ID NO: 174659 - protein, 9 aa, Homo Sapiens
EETAVCRLL

SEQ ID NO: 174660 - protein, 9 aa, Homo Sapiens
RLDGLASQE

SEQ ID NO: 174661 - protein, 9 aa, Homo Sapiens
RLTRGSQVA

SEQ ID NO: 174662 - protein, 9 aa, Homo Sapiens
SATSSATGS

SEQ ID NO: 174663 - protein, 9 aa, Homo Sapiens
EGVRQMLSN

SEQ ID NO: 174664 - protein, 9 aa, Homo Sapiens
AVRPPHTSI

SEQ ID NO: 174665 - protein, 9 aa, Homo Sapiens
LGRYLNYFA

SEQ ID NO: 174666 - protein, 9 aa, Homo Sapiens
KKSYALSNK

SEQ ID NO: 174667 - protein, 9 aa, Homo Sapiens
LPVQLSTVA

SEQ ID NO: 174668 - protein, 9 aa, Homo Sapiens
QASMTLPAP

SEQ ID NO: 174669 - protein, 9 aa, Homo Sapiens
PALHALLHG

SEQ ID NO: 174670 - protein, 9 aa, Homo Sapiens
RQRRGFAEG

SEQ ID NO: 174671 - protein, 9 aa, Homo Sapiens
HLPDVAMTG

SEQ ID NO: 174672 - protein, 9 aa, Homo Sapiens
ARAQDRWRT

SEQ ID NO: 174673 - protein, 9 aa, Homo Sapiens
ENNLGVYTE

SEQ ID NO: 174674 - protein, 9 aa, Homo Sapiens
ESLSSLDSN

SEQ ID NO: 174675 - protein, 9 aa, Homo Sapiens
SSKVTEHKI

SEQ ID NO: 174676 - protein, 9 aa, Homo Sapiens
GYPRAIQAT

SEQ ID NO: 174677 - protein, 9 aa, Homo Sapiens
PRAEAGHLA

SEQ ID NO: 174678 - protein, 9 aa, Homo Sapiens
HPGIPGVTH

SEQ ID NO: 174679 - protein, 9 aa, Homo Sapiens
GSFFEHDGH

SEQ ID NO: 174680 - protein, 9 aa, Homo Sapiens
TATLPDLPR

SEQ ID NO: 174681 - protein, 9 aa, Homo Sapiens
LQQGESHLS

SEQ ID NO: 174682 - protein, 9 aa, Homo Sapiens
GPLFFMEAK

SEQ ID NO: 174683 - protein, 9 aa, Homo Sapiens
STVCALDSD

SEQ ID NO: 174684 - protein, 9 aa, Homo Sapiens
PRPAPQPLL

SEQ ID NO: 174685 - protein, 9 aa, Homo Sapiens
RQKNCELAF

SEQ ID NO: 174686 - protein, 9 aa, Homo Sapiens
TGTRIAAAP

SEQ ID NO: 174687 - protein, 9 aa, Homo Sapiens
SSPLQQEAP

SEQ ID NO: 174688 - protein, 9 aa, Homo Sapiens
QFPDAHILR

SEQ ID NO: 174689 - protein, 9 aa, Homo Sapiens
RELGHLKQL

SEQ ID NO: 174690 - protein, 9 aa, Homo Sapiens
TWRPGSRMS

SEQ ID NO: 174691 - protein, 9 aa, Homo Sapiens
LDMDMEGAE

SEQ ID NO: 174692 - protein, 9 aa, Homo Sapiens
AHQLRADLL

SEQ ID NO: 174693 - protein, 9 aa, Homo Sapiens
TSEMLKKRS

SEQ ID NO: 174694 - protein, 9 aa, Homo Sapiens
TNLHLFYDV

SEQ ID NO: 174695 - protein, 9 aa, Homo Sapiens
SEVSPRIPD

SEQ ID NO: 174696 - protein, 9 aa, Homo Sapiens
SARSPSRRA

SEQ ID NO: 174697 - protein, 9 aa, Homo Sapiens
SDLCVQWCP

SEQ ID NO: 174698 - protein, 9 aa, Homo Sapiens
SGYGSSCCQ

SEQ ID NO: 174699 - protein, 9 aa, Homo Sapiens
SCWTSTVWP

SEQ ID NO: 174700 - protein, 9 aa, Homo Sapiens
CAGADKGNH

SEQ ID NO: 174701 - protein, 9 aa, Homo Sapiens
SSCLRSLRT

SEQ ID NO: 174702 - protein, 9 aa, Homo Sapiens
PPLPPGSSW

SEQ ID NO: 174703 - protein, 9 aa, Homo Sapiens
EVDSMLAAS

SEQ ID NO: 174704 - protein, 9 aa, Homo Sapiens
TLQKTRLWS

SEQ ID NO: 174705 - protein, 9 aa, Homo Sapiens
SRAAADLEH

SEQ ID NO: 174706 - protein, 9 aa, Homo Sapiens
TCGQLAIRW

SEQ ID NO: 174707 - protein, 9 aa, Homo Sapiens
NFFNESMKE

SEQ ID NO: 174708 - protein, 9 aa, Homo Sapiens
VLVVHLVEG

SEQ ID NO: 174709 - protein, 9 aa, Homo Sapiens
LPGPAALQP

SEQ ID NO: 174710 - protein, 9 aa, Homo Sapiens
WTKMAGIVC

SEQ ID NO: 174711 - protein, 9 aa, Homo Sapiens
APEQCDVHH

SEQ ID NO: 174712 - protein, 9 aa, Homo Sapiens
GRWGVCVCV

SEQ ID NO: 174713 - protein, 9 aa, Homo Sapiens
FLGLQWGRR

SEQ ID NO: 174714 - protein, 9 aa, Homo Sapiens
GQILFPCLR

SEQ ID NO: 174715 - protein, 9 aa, Homo Sapiens
VRENHTLTS

SEQ ID NO: 174716 - protein, 9 aa, Homo Sapiens
LGNITDTNT

SEQ ID NO: 174717 - protein, 9 aa, Homo Sapiens
RKMKRRRKL

SEQ ID NO: 174718 - protein, 9 aa, Homo Sapiens
LRNCGGDTI

SEQ ID NO: 174719 - protein, 9 aa, Homo Sapiens
YQGYLWFKC

SEQ ID NO: 174720 - protein, 9 aa, Homo Sapiens
GEQLLEASA

SEQ ID NO: 174721 - protein, 9 aa, Homo Sapiens
SCVPRPPAM

SEQ ID NO: 174722 - protein, 9 aa, Homo Sapiens
TGGTPQGPA

SEQ ID NO: 174723 - protein, 9 aa, Homo Sapiens
SNLTLTAGS

SEQ ID NO: 174724 - protein, 9 aa, Homo Sapiens
AGSRTTCPK

SEQ ID NO: 174725 - protein, 9 aa, Homo Sapiens
FLVVFLYMW

SEQ ID NO: 174726 - protein, 9 aa, Homo Sapiens
VVLSLILCC

SEQ ID NO: 174727 - protein, 9 aa, Homo Sapiens
RVHSCLEKE

SEQ ID NO: 174728 - protein, 9 aa, Homo Sapiens
LLHPQWAPH

SEQ ID NO: 174729 - protein, 9 aa, Homo Sapiens
ATFPMSVQE

SEQ ID NO: 174730 - protein, 9 aa, Homo Sapiens
TEQERTSLQ

SEQ ID NO: 174731 - protein, 9 aa, Homo Sapiens
SHVRHLHHG

SEQ ID NO: 174732 - protein, 9 aa, Homo Sapiens
STMWSCTKN

SEQ ID NO: 174733 - protein, 9 aa, Homo Sapiens
RFHSTFDAL

SEQ ID NO: 174734 - protein, 9 aa, Homo Sapiens
EETEVAMEA

SEQ ID NO: 174735 - protein, 9 aa, Homo Sapiens
GGRERRDRR

SEQ ID NO: 174736 - protein, 9 aa, Homo Sapiens
RSPHLQGPW

SEQ ID NO: 174737 - protein, 9 aa, Homo Sapiens
RCPLTAPLA

SEQ ID NO: 174738 - protein, 9 aa, Homo Sapiens
GQLQLQVVK

SEQ ID NO: 174739 - protein, 9 aa, Homo Sapiens
SCQLHQLEQ

SEQ ID NO: 174740 - protein, 9 aa, Homo Sapiens
QQPQQQLQQ

SEQ ID NO: 174741 - protein, 9 aa, Homo Sapiens
IWILPRVVW

SEQ ID NO: 174742 - protein, 9 aa, Homo Sapiens
VGDGNSHCI

SEQ ID NO: 174743 - protein, 9 aa, Homo Sapiens
LWRETLKKT

SEQ ID NO: 174744 - protein, 9 aa, Homo Sapiens
QPIRGYTET

SEQ ID NO: 174745 - protein, 9 aa, Homo Sapiens
RTTPVNPRV

SEQ ID NO: 174746 - protein, 9 aa, Homo Sapiens
GIASIRSET

SEQ ID NO: 174747 - protein, 9 aa, Homo Sapiens
QCCNAVKLV

SEQ ID NO: 174748 - protein, 9 aa, Homo Sapiens
KGNHKETIE

SEQ ID NO: 174749 - protein, 9 aa, Homo Sapiens
RPSLRPRSQ

SEQ ID NO: 174750 - protein, 9 aa, Homo Sapiens
TLTPGLTEP

SEQ ID NO: 174751 - protein, 9 aa, Homo Sapiens
SVFRETPPW

SEQ ID NO: 174752 - protein, 9 aa, Homo Sapiens
CLNGGYEVE

SEQ ID NO: 174753 - protein, 9 aa, Homo Sapiens
LSDSPPGVP

SEQ ID NO: 174754 - protein, 9 aa, Homo Sapiens
KPHSRPYMV

SEQ ID NO: 174755 - protein, 9 aa, Homo Sapiens
ELQSPPIRE

SEQ ID NO: 174756 - protein, 9 aa, Homo Sapiens
SKSESHVTM

SEQ ID NO: 174757 - protein, 9 aa, Homo Sapiens
NDTENGSPG

SEQ ID NO: 174758 - protein, 9 aa, Homo Sapiens
IKDENIVIT

SEQ ID NO: 174759 - protein, 9 aa, Homo Sapiens
EAMEETGVV

SEQ ID NO: 174760 - protein, 9 aa, Homo Sapiens
VVIRHIQVP

SEQ ID NO: 174761 - protein, 9 aa, Homo Sapiens
SERRPQAPP

SEQ ID NO: 174762 - protein, 9 aa, Homo Sapiens
KEHKLREHS

SEQ ID NO: 174763 - protein, 9 aa, Homo Sapiens
DVDVNLPKV

SEQ ID NO: 174764 - protein, 9 aa, Homo Sapiens
CPQKNSAQT

SEQ ID NO: 174765 - protein, 9 aa, Homo Sapiens
EGIKKEDST

SEQ ID NO: 174766 - protein, 9 aa, Homo Sapiens
LGGLIAGSL

SEQ ID NO: 174767 - protein, 9 aa, Homo Sapiens
KGFIHNPHT

SEQ ID NO: 174768 - protein, 9 aa, Homo Sapiens
QQKAQRVGQ

SEQ ID NO: 174769 - protein, 9 aa, Homo Sapiens
IRTYQVYNV

SEQ ID NO: 174770 - protein, 9 aa, Homo Sapiens
VEEPGEEVA

SEQ ID NO: 174771 - protein, 9 aa, Homo Sapiens
RNDTENGSP

SEQ ID NO: 174772 - protein, 9 aa, Homo Sapiens
SSKEATTET

SEQ ID NO: 174773 - protein, 9 aa, Homo Sapiens
LRSRPGSPA

SEQ ID NO: 174774 - protein, 9 aa, Homo Sapiens
EDVPWTKMA

SEQ ID NO: 174775 - protein, 9 aa, Homo Sapiens
RCQSEPREG

SEQ ID NO: 174776 - protein, 9 aa, Homo Sapiens
YFQRIIKMI

SEQ ID NO: 174777 - protein, 9 aa, Homo Sapiens
GSAQSSSCL

SEQ ID NO: 174778 - protein, 9 aa, Homo Sapiens
PLKLAVKEG

SEQ ID NO: 174779 - protein, 9 aa, Homo Sapiens
EFTTSTFAG

SEQ ID NO: 174780 - protein, 9 aa, Homo Sapiens
LTAPLACLH

SEQ ID NO: 174781 - protein, 9 aa, Homo Sapiens
GLRECGYPE

SEQ ID NO: 174782 - protein, 9 aa, Homo Sapiens
PLLPEPGPA

SEQ ID NO: 174783 - protein, 9 aa, Homo Sapiens
ERHLQWPSL

SEQ ID NO: 174784 - protein, 9 aa, Homo Sapiens
LCRQPPLPA

SEQ ID NO: 174785 - protein, 9 aa, Homo Sapiens
FFVTEGNCS

SEQ ID NO: 174786 - protein, 9 aa, Homo Sapiens
TIDSNLSIR

SEQ ID NO: 174787 - protein, 9 aa, Homo Sapiens
GCSRMNSKS

SEQ ID NO: 174788 - protein, 9 aa, Homo Sapiens
LAGVPPPPG

SEQ ID NO: 174789 - protein, 9 aa, Homo Sapiens
QDLKRESWY

SEQ ID NO: 174790 - protein, 9 aa, Homo Sapiens
CFFLGLFPV

SEQ ID NO: 174791 - protein, 9 aa, Homo Sapiens
LRTLVLRGM

SEQ ID NO: 174792 - protein, 9 aa, Homo Sapiens
SLLAGVPPP

SEQ ID NO: 174793 - protein, 9 aa, Homo Sapiens
YCDAAHCAA

SEQ ID NO: 174794 - protein, 9 aa, Homo Sapiens
PSSRTTLPK

SEQ ID NO: 174795 - protein, 9 aa, Homo Sapiens
SYSWPRVPH

SEQ ID NO: 174796 - protein, 9 aa, Homo Sapiens
FQYLLSKWL

SEQ ID NO: 174797 - protein, 9 aa, Homo Sapiens
TGLLPGEAA

SEQ ID NO: 174798 - protein, 9 aa, Homo Sapiens
CDKHGPYNL

SEQ ID NO: 174799 - protein, 9 aa, Homo Sapiens
SLTCGQLAI

SEQ ID NO: 174800 - protein, 9 aa, Homo Sapiens
VSNEHMLTV

SEQ ID NO: 174801 - protein, 9 aa, Homo Sapiens
APLQPPQSL

SEQ ID NO: 174802 - protein, 9 aa, Homo Sapiens
RRPSYRPWR

SEQ ID NO: 174803 - protein, 9 aa, Homo Sapiens
FSVSIPNLP

SEQ ID NO: 174804 - protein, 9 aa, Homo Sapiens
QIQTVPTET

SEQ ID NO: 174805 - protein, 9 aa, Homo Sapiens
GPLGVSRAD

SEQ ID NO: 174806 - protein, 9 aa, Homo Sapiens
FPQEGGGIG

SEQ ID NO: 174807 - protein, 9 aa, Homo Sapiens
VRHESRLLQ

SEQ ID NO: 174808 - protein, 9 aa, Homo Sapiens
SSPGSRSPS

SEQ ID NO: 174809 - protein, 9 aa, Homo Sapiens
PKTEHGSQK

SEQ ID NO: 174810 - protein, 9 aa, Homo Sapiens
LPCRRHCPR

SEQ ID NO: 174811 - protein, 9 aa, Homo Sapiens
GEDGTPIIT

SEQ ID NO: 174812 - protein, 9 aa, Homo Sapiens
PSASPRSGQ

SEQ ID NO: 174813 - protein, 9 aa, Homo Sapiens
KEYLHFVNG

SEQ ID NO: 174814 - protein, 9 aa, Homo Sapiens
ECCDFCDIP

SEQ ID NO: 174815 - protein, 9 aa, Homo Sapiens
RVALERYLQ

SEQ ID NO: 174816 - protein, 9 aa, Homo Sapiens
YYQCVATAE

SEQ ID NO: 174817 - protein, 9 aa, Homo Sapiens
QHRGPVRHL

SEQ ID NO: 174818 - protein, 9 aa, Homo Sapiens
LPLTLSPMS

SEQ ID NO: 174819 - protein, 9 aa, Homo Sapiens
AFASMDLKS

SEQ ID NO: 174820 - protein, 9 aa, Homo Sapiens
YIQYCSKFD

SEQ ID NO: 174821 - protein, 9 aa, Homo Sapiens
RTPQQVVAV

SEQ ID NO: 174822 - protein, 9 aa, Homo Sapiens
NSHCILLVN

SEQ ID NO: 174823 - protein, 9 aa, Homo Sapiens
RRARMSAGA

SEQ ID NO: 174824 - protein, 9 aa, Homo Sapiens
FLIQKGAEV

SEQ ID NO: 174825 - protein, 9 aa, Homo Sapiens
EAAVTLKWP

SEQ ID NO: 174826 - protein, 9 aa, Homo Sapiens
CVCACPGRD

SEQ ID NO: 174827 - protein, 9 aa, Homo Sapiens
LGEQINNLQ

SEQ ID NO: 174828 - protein, 9 aa, Homo Sapiens
FLVREEVFG

SEQ ID NO: 174829 - protein, 9 aa, Homo Sapiens
ALQNDTIFL

SEQ ID NO: 174830 - protein, 9 aa, Homo Sapiens
LQASLGKMA

SEQ ID NO: 174831 - protein, 9 aa, Homo Sapiens
SYRHLCLRL

SEQ ID NO: 174832 - protein, 9 aa, Homo Sapiens
DMAGNEDRG

SEQ ID NO: 174833 - protein, 9 aa, Homo Sapiens
LPPAAATTS

SEQ ID NO: 174834 - protein, 9 aa, Homo Sapiens
REQWKKVVT

SEQ ID NO: 174835 - protein, 9 aa, Homo Sapiens
PDNPDQNTE

SEQ ID NO: 174836 - protein, 9 aa, Homo Sapiens
NRISMLSNQ

SEQ ID NO: 174837 - protein, 9 aa, Homo Sapiens
VVQVFRLIR

SEQ ID NO: 174838 - protein, 9 aa, Homo Sapiens
GALLPHSFP

SEQ ID NO: 174839 - protein, 9 aa, Homo Sapiens
NDDAKHYSC

SEQ ID NO: 174840 - protein, 9 aa, Homo Sapiens
MVRVFQYLP

SEQ ID NO: 174841 - protein, 9 aa, Homo Sapiens
WGAIPRKAP

SEQ ID NO: 174842 - protein, 9 aa, Homo Sapiens
SLSVPHTTI

SEQ ID NO: 174843 - protein, 9 aa, Homo Sapiens
LRFLAYNCY

SEQ ID NO: 174844 - protein, 9 aa, Homo Sapiens
TSPRGCLQC

SEQ ID NO: 174845 - protein, 9 aa, Homo Sapiens
QQVPCSPLQ

SEQ ID NO: 174846 - protein, 9 aa, Homo Sapiens
METVELARK

SEQ ID NO: 174847 - protein, 9 aa, Homo Sapiens
SSSSPCQDL

SEQ ID NO: 174848 - protein, 9 aa, Homo Sapiens
RKDLMLYCE

SEQ ID NO: 174849 - protein, 9 aa, Homo Sapiens
RCCSQDCGT

SEQ ID NO: 174850 - protein, 9 aa, Homo Sapiens
PGVSLSLSG

SEQ ID NO: 174851 - protein, 9 aa, Homo Sapiens
VIMAIICFI

SEQ ID NO: 174852 - protein, 9 aa, Homo Sapiens
SDGLYYLAG

SEQ ID NO: 174853 - protein, 9 aa, Homo Sapiens
ARPCRGSCG

SEQ ID NO: 174854 - protein, 9 aa, Homo Sapiens
YMSAHHMAL

SEQ ID NO: 174855 - protein, 9 aa, Homo Sapiens
GRRFCGGIN

SEQ ID NO: 174856 - protein, 9 aa, Homo Sapiens
IPVTSEPPV

SEQ ID NO: 174857 - protein, 9 aa, Homo Sapiens
CESSKVKLH

SEQ ID NO: 174858 - protein, 9 aa, Homo Sapiens
CPRKQPTQF

SEQ ID NO: 174859 - protein, 9 aa, Homo Sapiens
LRRAYAAVP

SEQ ID NO: 174860 - protein, 9 aa, Homo Sapiens
THNGSVGKG

SEQ ID NO: 174861 - protein, 9 aa, Homo Sapiens
SQKTCPQKN

SEQ ID NO: 174862 - protein, 9 aa, Homo Sapiens
HSCPGRERH

SEQ ID NO: 174863 - protein, 9 aa, Homo Sapiens
NIAPCVHFT

SEQ ID NO: 174864 - protein, 9 aa, Homo Sapiens
LGYLVSTVC

SEQ ID NO: 174865 - protein, 9 aa, Homo Sapiens
NCHTKIHHV

SEQ ID NO: 174866 - protein, 9 aa, Homo Sapiens
PWLPMRSLG

SEQ ID NO: 174867 - protein, 9 aa, Homo Sapiens
PTHRFPFGA

SEQ ID NO: 174868 - protein, 9 aa, Homo Sapiens
WAQPPFRCW

SEQ ID NO: 174869 - protein, 9 aa, Homo Sapiens
WTSTVWPTA

SEQ ID NO: 174870 - protein, 9 aa, Homo Sapiens
PAELPPAAA

SEQ ID NO: 174871 - protein, 9 aa, Homo Sapiens
KAGRAQPVI

SEQ ID NO: 174872 - protein, 9 aa, Homo Sapiens
VDTCIPKLN

SEQ ID NO: 174873 - protein, 9 aa, Homo Sapiens
CPANGAGWP

SEQ ID NO: 174874 - protein, 9 aa, Homo Sapiens
QSIISYLNT

SEQ ID NO: 174875 - protein, 9 aa, Homo Sapiens
VVAAMEETE

SEQ ID NO: 174876 - protein, 9 aa, Homo Sapiens
ALDNIYDAR

SEQ ID NO: 174877 - protein, 9 aa, Homo Sapiens
GLRQRRGFA

SEQ ID NO: 174878 - protein, 9 aa, Homo Sapiens
QARDLRCPL

SEQ ID NO: 174879 - protein, 9 aa, Homo Sapiens
RPCDDEDWQ

SEQ ID NO: 174880 - protein, 9 aa, Homo Sapiens
KRHHPIGIG

SEQ ID NO: 174881 - protein, 9 aa, Homo Sapiens
LNGLHQFQG

SEQ ID NO: 174882 - protein, 9 aa, Homo Sapiens
WVMEMKSYQ

SEQ ID NO: 174883 - protein, 9 aa, Homo Sapiens
CQACFSQRR

SEQ ID NO: 174884 - protein, 9 aa, Homo Sapiens
AESLGGQPA

SEQ ID NO: 174885 - protein, 9 aa, Homo Sapiens
LAESLGGQP

SEQ ID NO: 174886 - protein, 9 aa, Homo Sapiens
VGLRLGEKH

SEQ ID NO: 174887 - protein, 9 aa, Homo Sapiens
GYLNLLLNI

SEQ ID NO: 174888 - protein, 9 aa, Homo Sapiens
RRRPGAPEY

SEQ ID NO: 174889 - protein, 9 aa, Homo Sapiens
NFPRSKHPT

SEQ ID NO: 174890 - protein, 9 aa, Homo Sapiens
AIAVQAGDG

SEQ ID NO: 174891 - protein, 9 aa, Homo Sapiens
SCPGRERHL

SEQ ID NO: 174892 - protein, 9 aa, Homo Sapiens
KPPLAEPRL

SEQ ID NO: 174893 - protein, 9 aa, Homo Sapiens
WGCCPSAWR

SEQ ID NO: 174894 - protein, 9 aa, Homo Sapiens
MVITGDVLV

SEQ ID NO: 174895 - protein, 9 aa, Homo Sapiens
KKHREEKYE

SEQ ID NO: 174896 - protein, 9 aa, Homo Sapiens
DTGHTAKIV

SEQ ID NO: 174897 - protein, 9 aa, Homo Sapiens
LRYGHNFCR

SEQ ID NO: 174898 - protein, 9 aa, Homo Sapiens
KTRVGGLGC

SEQ ID NO: 174899 - protein, 9 aa, Homo Sapiens
QQPQQQPPA

SEQ ID NO: 174900 - protein, 9 aa, Homo Sapiens
GEMLDYRHM

SEQ ID NO: 174901 - protein, 9 aa, Homo Sapiens
SVLCQSAVI

SEQ ID NO: 174902 - protein, 9 aa, Homo Sapiens
ECKIGIMPD

SEQ ID NO: 174903 - protein, 9 aa, Homo Sapiens
AIYHVLHFS

SEQ ID NO: 174904 - protein, 9 aa, Homo Sapiens
SWPNWGAIP

SEQ ID NO: 174905 - protein, 9 aa, Homo Sapiens
ATMEVLYSG

SEQ ID NO: 174906 - protein, 9 aa, Homo Sapiens
LQDYVVSLG

SEQ ID NO: 174907 - protein, 9 aa, Homo Sapiens
QLDLSKARF

SEQ ID NO: 174908 - protein, 9 aa, Homo Sapiens
TTCPGPSWH

SEQ ID NO: 174909 - protein, 9 aa, Homo Sapiens
SIGQSPTDE

SEQ ID NO: 174910 - protein, 9 aa, Homo Sapiens
LLLVLLFVA

SEQ ID NO: 174911 - protein, 9 aa, Homo Sapiens
RAWQVPLLP

SEQ ID NO: 174912 - protein, 9 aa, Homo Sapiens
KEELKEKKL

SEQ ID NO: 174913 - protein, 9 aa, Homo Sapiens
VRKESRGTH

SEQ ID NO: 174914 - protein, 9 aa, Homo Sapiens
WRASTRNWA

SEQ ID NO: 174915 - protein, 9 aa, Homo Sapiens
LGTFRRVLQ

SEQ ID NO: 174916 - protein, 9 aa, Homo Sapiens
TSWASRSPH

SEQ ID NO: 174917 - protein, 9 aa, Homo Sapiens
VLALASYRH

SEQ ID NO: 174918 - protein, 9 aa, Homo Sapiens
GKPDVDHVE

SEQ ID NO: 174919 - protein, 9 aa, Homo Sapiens
YVQLLVTRL

SEQ ID NO: 174920 - protein, 9 aa, Homo Sapiens
PFLVAAALC

SEQ ID NO: 174921 - protein, 9 aa, Homo Sapiens
LAAGAVLRV

SEQ ID NO: 174922 - protein, 9 aa, Homo Sapiens
MNVSPVPPP

SEQ ID NO: 174923 - protein, 9 aa, Homo Sapiens
PSTFGMSVC

SEQ ID NO: 174924 - protein, 9 aa, Homo Sapiens
TVAFLPPMH

SEQ ID NO: 174925 - protein, 9 aa, Homo Sapiens
LKDNDFLWN

SEQ ID NO: 174926 - protein, 9 aa, Homo Sapiens
MDMDAPEEE

SEQ ID NO: 174927 - protein, 9 aa, Homo Sapiens
QKRRAAIVL

SEQ ID NO: 174928 - protein, 9 aa, Homo Sapiens
SHPASAISG

SEQ ID NO: 174929 - protein, 9 aa, Homo Sapiens
LLKFSTGGS

SEQ ID NO: 174930 - protein, 9 aa, Homo Sapiens
PASWGLELS

SEQ ID NO: 174931 - protein, 9 aa, Homo Sapiens
KKKDLHDVP

SEQ ID NO: 174932 - protein, 9 aa, Homo Sapiens
GACRPACTC

SEQ ID NO: 174933 - protein, 9 aa, Homo Sapiens
HTPHCQPRS

SEQ ID NO: 174934 - protein, 9 aa, Homo Sapiens
SDSTSLGTT

SEQ ID NO: 174935 - protein, 9 aa, Homo Sapiens
SFEELQSPP

SEQ ID NO: 174936 - protein, 9 aa, Homo Sapiens
DDLDVGDCP

SEQ ID NO: 174937 - protein, 9 aa, Homo Sapiens
TLARVPASW

SEQ ID NO: 174938 - protein, 9 aa, Homo Sapiens
VPAHSPASA

SEQ ID NO: 174939 - protein, 9 aa, Homo Sapiens
DVGDCPKRP

SEQ ID NO: 174940 - protein, 9 aa, Homo Sapiens
ELRITTQEN

SEQ ID NO: 174941 - protein, 9 aa, Homo Sapiens
PEQCDVHHV

SEQ ID NO: 174942 - protein, 9 aa, Homo Sapiens
PPHPQVPPQ

SEQ ID NO: 174943 - protein, 9 aa, Homo Sapiens
DHQNLLVEV

SEQ ID NO: 174944 - protein, 9 aa, Homo Sapiens
VQVGLFHGN

SEQ ID NO: 174945 - protein, 9 aa, Homo Sapiens
VLFAKEQLA

SEQ ID NO: 174946 - protein, 9 aa, Homo Sapiens
LKVCYPERI

SEQ ID NO: 174947 - protein, 9 aa, Homo Sapiens
PEFTTSTFA

SEQ ID NO: 174948 - protein, 9 aa, Homo Sapiens
KPAQQKRIR

SEQ ID NO: 174949 - protein, 9 aa, Homo Sapiens
SILARLVAT

SEQ ID NO: 174950 - protein, 9 aa, Homo Sapiens
QELQTLYLN

SEQ ID NO: 174951 - protein, 9 aa, Homo Sapiens
LPQPTHRFP

SEQ ID NO: 174952 - protein, 9 aa, Homo Sapiens
IGFLGGQKS

SEQ ID NO: 174953 - protein, 9 aa, Homo Sapiens
DGHGRLVIV

SEQ ID NO: 174954 - protein, 9 aa, Homo Sapiens
VIPSWQIRT

SEQ ID NO: 174955 - protein, 9 aa, Homo Sapiens
TKFSASLVI

SEQ ID NO: 174956 - protein, 9 aa, Homo Sapiens
KRGPSVVPW

SEQ ID NO: 174957 - protein, 9 aa, Homo Sapiens
YAVQVCCKR

SEQ ID NO: 174958 - protein, 9 aa, Homo Sapiens
VSKKTHTIR

SEQ ID NO: 174959 - protein, 9 aa, Homo Sapiens
PPSVSVAWL

SEQ ID NO: 174960 - protein, 9 aa, Homo Sapiens
LRYIQESTE

SEQ ID NO: 174961 - protein, 9 aa, Homo Sapiens
AGGWLKIDS

SEQ ID NO: 174962 - protein, 9 aa, Homo Sapiens
FHFLRTLKE

SEQ ID NO: 174963 - protein, 9 aa, Homo Sapiens
EPDSFAAVR

SEQ ID NO: 174964 - protein, 9 aa, Homo Sapiens
TRGRSEGGR

SEQ ID NO: 174965 - protein, 9 aa, Homo Sapiens
LRLGEKHSP

SEQ ID NO: 174966 - protein, 9 aa, Homo Sapiens
GWPCPAVPL

SEQ ID NO: 174967 - protein, 9 aa, Homo Sapiens
AYRVLLALW

SEQ ID NO: 174968 - protein, 9 aa, Homo Sapiens
GGFQKGRGW

SEQ ID NO: 174969 - protein, 9 aa, Homo Sapiens
LRPWCPGLP

SEQ ID NO: 174970 - protein, 9 aa, Homo Sapiens
GALTVKLGG

SEQ ID NO: 174971 - protein, 9 aa, Homo Sapiens
KDKQTQNDM

SEQ ID NO: 174972 - protein, 9 aa, Homo Sapiens
WRTARPHPT

SEQ ID NO: 174973 - protein, 9 aa, Homo Sapiens
IVTENDNTM

SEQ ID NO: 174974 - protein, 9 aa, Homo Sapiens
CDKAFHRSS

SEQ ID NO: 174975 - protein, 9 aa, Homo Sapiens
PQSFASKQA

SEQ ID NO: 174976 - protein, 9 aa, Homo Sapiens
LAPGRTKTF

SEQ ID NO: 174977 - protein, 9 aa, Homo Sapiens
CAGAPYAEE

SEQ ID NO: 174978 - protein, 9 aa, Homo Sapiens
EPRSDGTGP

SEQ ID NO: 174979 - protein, 9 aa, Homo Sapiens
VESEDAPPK

SEQ ID NO: 174980 - protein, 9 aa, Homo Sapiens
RFVKRHCKC

SEQ ID NO: 174981 - protein, 9 aa, Homo Sapiens
QPPLPAQTR

SEQ ID NO: 174982 - protein, 9 aa, Homo Sapiens
FQRIIKMIW

SEQ ID NO: 174983 - protein, 9 aa, Homo Sapiens
ENTELEEPQ

SEQ ID NO: 174984 - protein, 9 aa, Homo Sapiens
RQLQGHGQD

SEQ ID NO: 174985 - protein, 9 aa, Homo Sapiens
LVRRDSIFR

SEQ ID NO: 174986 - protein, 9 aa, Homo Sapiens
AGAGRRPLL

SEQ ID NO: 174987 - protein, 9 aa, Homo Sapiens
AGKGGPTPR

SEQ ID NO: 174988 - protein, 9 aa, Homo Sapiens
LTWYRSLMP

SEQ ID NO: 174989 - protein, 9 aa, Homo Sapiens
AHQYILEFN

SEQ ID NO: 174990 - protein, 9 aa, Homo Sapiens
TRQTLLHHP

SEQ ID NO: 174991 - protein, 9 aa, Homo Sapiens
GMDVYYQRN

SEQ ID NO: 174992 - protein, 9 aa, Homo Sapiens
PIRGYTETE

SEQ ID NO: 174993 - protein, 9 aa, Homo Sapiens
VLPPSLPRA

SEQ ID NO: 174994 - protein, 9 aa, Homo Sapiens
IIKMIWILP

SEQ ID NO: 174995 - protein, 9 aa, Homo Sapiens
RSLGEPWRA

SEQ ID NO: 174996 - protein, 9 aa, Homo Sapiens
HHRHGWLKK

SEQ ID NO: 174997 - protein, 9 aa, Homo Sapiens
LHIVGAQLC

SEQ ID NO: 174998 - protein, 9 aa, Homo Sapiens
QQMAVHLGA

SEQ ID NO: 174999 - protein, 9 aa, Homo Sapiens
FPENLTNGV

SEQ ID NO: 175000 - protein, 9 aa, Homo Sapiens
RDDDVPVDM

SEQ ID NO: 175001 - protein, 9 aa, Homo Sapiens
DIQFHLVTR

SEQ ID NO: 175002 - protein, 9 aa, Homo Sapiens
QRPGPASSP

SEQ ID NO: 175003 - protein, 9 aa, Homo Sapiens
AMAPGTPGI

SEQ ID NO: 175004 - protein, 9 aa, Homo Sapiens
VAPQITIPR

SEQ ID NO: 175005 - protein, 9 aa, Homo Sapiens
TAIQGDMTQ

SEQ ID NO: 175006 - protein, 9 aa, Homo Sapiens
GAAVLCTSF

SEQ ID NO: 175007 - protein, 9 aa, Homo Sapiens
DEQNSPPKR

SEQ ID NO: 175008 - protein, 9 aa, Homo Sapiens
CLSSQLAWC

SEQ ID NO: 175009 - protein, 9 aa, Homo Sapiens
GTGGTPQGP

SEQ ID NO: 175010 - protein, 9 aa, Homo Sapiens
KYGATTVVC

SEQ ID NO: 175011 - protein, 9 aa, Homo Sapiens
HLYNYVYRA

SEQ ID NO: 175012 - protein, 9 aa, Homo Sapiens
GRSRRCEQS

SEQ ID NO: 175013 - protein, 9 aa, Homo Sapiens
SLTLSTRAP

SEQ ID NO: 175014 - protein, 9 aa, Homo Sapiens
VLAGMVITG

SEQ ID NO: 175015 - protein, 9 aa, Homo Sapiens
MEETVVVAV

SEQ ID NO: 175016 - protein, 9 aa, Homo Sapiens
QGALTPPHP

SEQ ID NO: 175017 - protein, 9 aa, Homo Sapiens
EQLPQHALV

SEQ ID NO: 175018 - protein, 9 aa, Homo Sapiens
HLYCVLFIL

SEQ ID NO: 175019 - protein, 9 aa, Homo Sapiens
NRQVCMLAD

SEQ ID NO: 175020 - protein, 9 aa, Homo Sapiens
VVSEFEDSY

SEQ ID NO: 175021 - protein, 9 aa, Homo Sapiens
LGHELSSLH

SEQ ID NO: 175022 - protein, 9 aa, Homo Sapiens
SPGSRSPSH

SEQ ID NO: 175023 - protein, 9 aa, Homo Sapiens
QTLLHHPRR

SEQ ID NO: 175024 - protein, 9 aa, Homo Sapiens
GCLLGSEDY

SEQ ID NO: 175025 - protein, 9 aa, Homo Sapiens
LLPPVLEHF

SEQ ID NO: 175026 - protein, 9 aa, Homo Sapiens
HGMKKRASD

SEQ ID NO: 175027 - protein, 9 aa, Homo Sapiens
RPCSSSSPC

SEQ ID NO: 175028 - protein, 9 aa, Homo Sapiens
KFPPHLELP

SEQ ID NO: 175029 - protein, 9 aa, Homo Sapiens
SFLQGLLGV

SEQ ID NO: 175030 - protein, 9 aa, Homo Sapiens
HPRAVLIPS

SEQ ID NO: 175031 - protein, 9 aa, Homo Sapiens
RPVSGHMDT

SEQ ID NO: 175032 - protein, 9 aa, Homo Sapiens
NLMPPGKNH

SEQ ID NO: 175033 - protein, 9 aa, Homo Sapiens
KDLMLYCEA

SEQ ID NO: 175034 - protein, 9 aa, Homo Sapiens
DLRLWLTSL

SEQ ID NO: 175035 - protein, 9 aa, Homo Sapiens
TQKRSFKKI

SEQ ID NO: 175036 - protein, 9 aa, Homo Sapiens
VATAESLGT

SEQ ID NO: 175037 - protein, 9 aa, Homo Sapiens
PRTPEALRS

SEQ ID NO: 175038 - protein, 9 aa, Homo Sapiens
YLLPHHMVH

SEQ ID NO: 175039 - protein, 9 aa, Homo Sapiens
AEAMSSHID

SEQ ID NO: 175040 - protein, 9 aa, Homo Sapiens
NQRPHQCRH

SEQ ID NO: 175041 - protein, 9 aa, Homo Sapiens
SCQALSCKM

SEQ ID NO: 175042 - protein, 9 aa, Homo Sapiens
IRHIQVPQD

SEQ ID NO: 175043 - protein, 9 aa, Homo Sapiens
ALTSMGPTW

SEQ ID NO: 175044 - protein, 9 aa, Homo Sapiens
IPRPHTPSP

SEQ ID NO: 175045 - protein, 9 aa, Homo Sapiens
TMVCDITDL

SEQ ID NO: 175046 - protein, 9 aa, Homo Sapiens
GKSPGRPCR

SEQ ID NO: 175047 - protein, 9 aa, Homo Sapiens
LLFFLGLQW

SEQ ID NO: 175048 - protein, 9 aa, Homo Sapiens
TASKLGEFA

SEQ ID NO: 175049 - protein, 9 aa, Homo Sapiens
LASYRHLCL

SEQ ID NO: 175050 - protein, 9 aa, Homo Sapiens
PAEQMDFHA

SEQ ID NO: 175051 - protein, 9 aa, Homo Sapiens
VTSKSESHV

SEQ ID NO: 175052 - protein, 9 aa, Homo Sapiens
VHLCIIDVS

SEQ ID NO: 175053 - protein, 9 aa, Homo Sapiens
ADLHPMGWC

SEQ ID NO: 175054 - protein, 9 aa, Homo Sapiens
DVFSVSIPN

SEQ ID NO: 175055 - protein, 9 aa, Homo Sapiens
QYGSHSQHL

SEQ ID NO: 175056 - protein, 9 aa, Homo Sapiens
LQDPLDRCY

SEQ ID NO: 175057 - protein, 9 aa, Homo Sapiens
LDSRVVLDL

SEQ ID NO: 175058 - protein, 9 aa, Homo Sapiens
NEVQSSGPE

SEQ ID NO: 175059 - protein, 9 aa, Homo Sapiens
QPRAKPFPT

SEQ ID NO: 175060 - protein, 9 aa, Homo Sapiens
LEAAWEENV

SEQ ID NO: 175061 - protein, 9 aa, Homo Sapiens
LRRSPFPPT

SEQ ID NO: 175062 - protein, 9 aa, Homo Sapiens
VYTVASVLP

SEQ ID NO: 175063 - protein, 9 aa, Homo Sapiens
RVSMRTSDS

SEQ ID NO: 175064 - protein, 9 aa, Homo Sapiens
SCCRRRCRP

SEQ ID NO: 175065 - protein, 9 aa, Homo Sapiens
VRHLHHGWA

SEQ ID NO: 175066 - protein, 9 aa, Homo Sapiens
ERNLRPLSL

SEQ ID NO: 175067 - protein, 9 aa, Homo Sapiens
WGEKIVALM

SEQ ID NO: 175068 - protein, 9 aa, Homo Sapiens
PPSRTMTSG

SEQ ID NO: 175069 - protein, 9 aa, Homo Sapiens
ADFVLLCLD

SEQ ID NO: 175070 - protein, 9 aa, Homo Sapiens
RRSHLLLPP

SEQ ID NO: 175071 - protein, 9 aa, Homo Sapiens
DKVCSRVSS

SEQ ID NO: 175072 - protein, 9 aa, Homo Sapiens
NNRISMLSN

SEQ ID NO: 175073 - protein, 9 aa, Homo Sapiens
GPLDPPVNR

SEQ ID NO: 175074 - protein, 9 aa, Homo Sapiens
GLPKEKTIK

SEQ ID NO: 175075 - protein, 9 aa, Homo Sapiens
SLLPLLCIC

SEQ ID NO: 175076 - protein, 9 aa, Homo Sapiens
KIICQEEGL

SEQ ID NO: 175077 - protein, 9 aa, Homo Sapiens
SHCILLVNP

SEQ ID NO: 175078 - protein, 9 aa, Homo Sapiens
CCPATCEPS

SEQ ID NO: 175079 - protein, 9 aa, Homo Sapiens
TRAAMAPSC

SEQ ID NO: 175080 - protein, 9 aa, Homo Sapiens
TDYSVSLEW

SEQ ID NO: 175081 - protein, 9 aa, Homo Sapiens
DKKNGIWEV

SEQ ID NO: 175082 - protein, 9 aa, Homo Sapiens
LQTLYLNLH

SEQ ID NO: 175083 - protein, 9 aa, Homo Sapiens
FQEIAKEVG

SEQ ID NO: 175084 - protein, 9 aa, Homo Sapiens
TRIAAAPTL

SEQ ID NO: 175085 - protein, 9 aa, Homo Sapiens
LKKNGALPA

SEQ ID NO: 175086 - protein, 9 aa, Homo Sapiens
ENLTAQQYS

SEQ ID NO: 175087 - protein, 9 aa, Homo Sapiens
NWSLWPRRW

SEQ ID NO: 175088 - protein, 9 aa, Homo Sapiens
GSPGKSPEI

SEQ ID NO: 175089 - protein, 9 aa, Homo Sapiens
LGLHSSIQA

SEQ ID NO: 175090 - protein, 9 aa, Homo Sapiens
SSWQKGQPR

SEQ ID NO: 175091 - protein, 9 aa, Homo Sapiens
VFLDLCSSP

SEQ ID NO: 175092 - protein, 9 aa, Homo Sapiens
PPTAAVGAA

SEQ ID NO: 175093 - protein, 9 aa, Homo Sapiens
ELLSQGTTL

SEQ ID NO: 175094 - protein, 9 aa, Homo Sapiens
REGRFSLDR

SEQ ID NO: 175095 - protein, 9 aa, Homo Sapiens
RYSDVFQIR

SEQ ID NO: 175096 - protein, 9 aa, Homo Sapiens
EHFCRPPPE

SEQ ID NO: 175097 - protein, 9 aa, Homo Sapiens
VPGPDAGRL

SEQ ID NO: 175098 - protein, 9 aa, Homo Sapiens
CAMDSLRPV

SEQ ID NO: 175099 - protein, 9 aa, Homo Sapiens
KFARKWKKG

SEQ ID NO: 175100 - protein, 9 aa, Homo Sapiens
LLPLPPLPA

SEQ ID NO: 175101 - protein, 9 aa, Homo Sapiens
GNIDAVIRR

SEQ ID NO: 175102 - protein, 9 aa, Homo Sapiens
VALMSSTII

SEQ ID NO: 175103 - protein, 9 aa, Homo Sapiens
EGLKHSTRG

SEQ ID NO: 175104 - protein, 9 aa, Homo Sapiens
GAVQPGHLV

SEQ ID NO: 175105 - protein, 9 aa, Homo Sapiens
QIWGAVECF

SEQ ID NO: 175106 - protein, 9 aa, Homo Sapiens
PMSVQEPPT

SEQ ID NO: 175107 - protein, 9 aa, Homo Sapiens
SFTFSKKCT

SEQ ID NO: 175108 - protein, 9 aa, Homo Sapiens
GGGRRFCGG

SEQ ID NO: 175109 - protein, 9 aa, Homo Sapiens
GMVISGVLL

SEQ ID NO: 175110 - protein, 9 aa, Homo Sapiens
VSTVCALDS

SEQ ID NO: 175111 - protein, 9 aa, Homo Sapiens
HPVVTTTTS

SEQ ID NO: 175112 - protein, 9 aa, Homo Sapiens
IYFMACTVA

SEQ ID NO: 175113 - protein, 9 aa, Homo Sapiens
NILDVHTGV

SEQ ID NO: 175114 - protein, 9 aa, Homo Sapiens
QEQMEQERQ

SEQ ID NO: 175115 - protein, 9 aa, Homo Sapiens
QGNLQSSPS

SEQ ID NO: 175116 - protein, 9 aa, Homo Sapiens
SSPPSPPSS

SEQ ID NO: 175117 - protein, 9 aa, Homo Sapiens
VPRGREGAQ

SEQ ID NO: 175118 - protein, 9 aa, Homo Sapiens
QINQQQPQQ

SEQ ID NO: 175119 - protein, 9 aa, Homo Sapiens
DRCSSIYRS

SEQ ID NO: 175120 - protein, 9 aa, Homo Sapiens
KKMPKLHFA

SEQ ID NO: 175121 - protein, 9 aa, Homo Sapiens
RVHTGLHPY

SEQ ID NO: 175122 - protein, 9 aa, Homo Sapiens
TTILLDGQW

SEQ ID NO: 175123 - protein, 9 aa, Homo Sapiens
ISMLSNQSF

SEQ ID NO: 175124 - protein, 9 aa, Homo Sapiens
KMTRPLYFQ

SEQ ID NO: 175125 - protein, 9 aa, Homo Sapiens
TEGFLVQWE

SEQ ID NO: 175126 - protein, 9 aa, Homo Sapiens
HLLLPPFLL

SEQ ID NO: 175127 - protein, 9 aa, Homo Sapiens
LLITVTLCS

SEQ ID NO: 175128 - protein, 9 aa, Homo Sapiens
FRGGSVHLH

SEQ ID NO: 175129 - protein, 9 aa, Homo Sapiens
AAIPKKETL

SEQ ID NO: 175130 - protein, 9 aa, Homo Sapiens
VEAMEETGV

SEQ ID NO: 175131 - protein, 9 aa, Homo Sapiens
TVIRQCCNA

SEQ ID NO: 175132 - protein, 9 aa, Homo Sapiens
HVDVRAIDL

SEQ ID NO: 175133 - protein, 9 aa, Homo Sapiens
GRSSVFSSC

SEQ ID NO: 175134 - protein, 9 aa, Homo Sapiens
KTKGMATVP

SEQ ID NO: 175135 - protein, 9 aa, Homo Sapiens
PEPAAPPHR

SEQ ID NO: 175136 - protein, 9 aa, Homo Sapiens
GTAEGPAAR

SEQ ID NO: 175137 - protein, 9 aa, Homo Sapiens
LFPQCQPLH

SEQ ID NO: 175138 - protein, 9 aa, Homo Sapiens
HQKKLTVPH

SEQ ID NO: 175139 - protein, 9 aa, Homo Sapiens
RYRCLACHL

SEQ ID NO: 175140 - protein, 9 aa, Homo Sapiens
PATLTLAVA

SEQ ID NO: 175141 - protein, 9 aa, Homo Sapiens
CPPKCPPKY

SEQ ID NO: 175142 - protein, 9 aa, Homo Sapiens
ATTETTSSE

SEQ ID NO: 175143 - protein, 9 aa, Homo Sapiens
LEYNSKYLR

SEQ ID NO: 175144 - protein, 9 aa, Homo Sapiens
NARVTNTKT

SEQ ID NO: 175145 - protein, 9 aa, Homo Sapiens
VTEFIFTGS

SEQ ID NO: 175146 - protein, 9 aa, Homo Sapiens
DVYYQRNMI

SEQ ID NO: 175147 - protein, 9 aa, Homo Sapiens
APDGQRLHL

SEQ ID NO: 175148 - protein, 9 aa, Homo Sapiens
RSEGGPPRP

SEQ ID NO: 175149 - protein, 9 aa, Homo Sapiens
ISKKSITTE

SEQ ID NO: 175150 - protein, 9 aa, Homo Sapiens
QVVKEGDEE

SEQ ID NO: 175151 - protein, 9 aa, Homo Sapiens
WSRGESTVA

SEQ ID NO: 175152 - protein, 9 aa, Homo Sapiens
GSCWTSTVW

SEQ ID NO: 175153 - protein, 9 aa, Homo Sapiens
YPEISYCQG

SEQ ID NO: 175154 - protein, 9 aa, Homo Sapiens
SERAKLDES

SEQ ID NO: 175155 - protein, 9 aa, Homo Sapiens
YKEEGLKHS

SEQ ID NO: 175156 - protein, 9 aa, Homo Sapiens
QVYRLGTRD

SEQ ID NO: 175157 - protein, 9 aa, Homo Sapiens
DSTSLGTTV

SEQ ID NO: 175158 - protein, 9 aa, Homo Sapiens
NISKKVSWY

SEQ ID NO: 175159 - protein, 9 aa, Homo Sapiens
GAILFHLHR

SEQ ID NO: 175160 - protein, 9 aa, Homo Sapiens
RDRKFHEDE

SEQ ID NO: 175161 - protein, 9 aa, Homo Sapiens
PLPASHPLF

SEQ ID NO: 175162 - protein, 9 aa, Homo Sapiens
MTEENKDEY

SEQ ID NO: 175163 - protein, 9 aa, Homo Sapiens
ERGVRMKSV

SEQ ID NO: 175164 - protein, 9 aa, Homo Sapiens
PPLPAQTRW

SEQ ID NO: 175165 - protein, 9 aa, Homo Sapiens
VGARSPHLQ

SEQ ID NO: 175166 - protein, 9 aa, Homo Sapiens
AAQGGVACR

SEQ ID NO: 175167 - protein, 9 aa, Homo Sapiens
ALPTQQLAW

SEQ ID NO: 175168 - protein, 9 aa, Homo Sapiens
PVNPRVSMR

SEQ ID NO: 175169 - protein, 9 aa, Homo Sapiens
ILRCQRERG

SEQ ID NO: 175170 - protein, 9 aa, Homo Sapiens
SMKECRNWQ

SEQ ID NO: 175171 - protein, 9 aa, Homo Sapiens
VGVCVFVLF

SEQ ID NO: 175172 - protein, 9 aa, Homo Sapiens
CANYLTTKT

SEQ ID NO: 175173 - protein, 9 aa, Homo Sapiens
LLVLLFVAV

SEQ ID NO: 175174 - protein, 9 aa, Homo Sapiens
GSRAGTGCS

SEQ ID NO: 175175 - protein, 9 aa, Homo Sapiens
ISACTYERT

SEQ ID NO: 175176 - protein, 9 aa, Homo Sapiens
KWGYPRAIQ

SEQ ID NO: 175177 - protein, 9 aa, Homo Sapiens
QSAVIDHMS

SEQ ID NO: 175178 - protein, 9 aa, Homo Sapiens
GAGRRPLLQ

SEQ ID NO: 175179 - protein, 9 aa, Homo Sapiens
TCLNWVFKI

SEQ ID NO: 175180 - protein, 9 aa, Homo Sapiens
NVQQHQKAA

SEQ ID NO: 175181 - protein, 9 aa, Homo Sapiens
CGTMVIWDG

SEQ ID NO: 175182 - protein, 9 aa, Homo Sapiens
MDEVDDMAG

SEQ ID NO: 175183 - protein, 9 aa, Homo Sapiens
SCQMDESEQ

SEQ ID NO: 175184 - protein, 9 aa, Homo Sapiens
SSIPRPHTP

SEQ ID NO: 175185 - protein, 9 aa, Homo Sapiens
AWFWVRDML

SEQ ID NO: 175186 - protein, 9 aa, Homo Sapiens
LSTASQMLA

SEQ ID NO: 175187 - protein, 9 aa, Homo Sapiens
GIMPDHIHK

SEQ ID NO: 175188 - protein, 9 aa, Homo Sapiens
VQVLVVLSL

SEQ ID NO: 175189 - protein, 9 aa, Homo Sapiens
AALCIPLLI

SEQ ID NO: 175190 - protein, 9 aa, Homo Sapiens
VDDMAGNED

SEQ ID NO: 175191 - protein, 9 aa, Homo Sapiens
VATPGRPWP

SEQ ID NO: 175192 - protein, 9 aa, Homo Sapiens
IYRKSGTHQ

SEQ ID NO: 175193 - protein, 9 aa, Homo Sapiens
TLPAPTACS

SEQ ID NO: 175194 - protein, 9 aa, Homo Sapiens
NRLPALTSM

SEQ ID NO: 175195 - protein, 9 aa, Homo Sapiens
LRMMRRQWS

SEQ ID NO: 175196 - protein, 9 aa, Homo Sapiens
KTKKYQDSD

SEQ ID NO: 175197 - protein, 9 aa, Homo Sapiens
EVEAMEETG

SEQ ID NO: 175198 - protein, 9 aa, Homo Sapiens
ELNTLRVTH

SEQ ID NO: 175199 - protein, 9 aa, Homo Sapiens
TPQGPAWSL

SEQ ID NO: 175200 - protein, 9 aa, Homo Sapiens
TLTITERNF

SEQ ID NO: 175201 - protein, 9 aa, Homo Sapiens
VSFGSGALT

SEQ ID NO: 175202 - protein, 9 aa, Homo Sapiens
YIQELQALL

SEQ ID NO: 175203 - protein, 9 aa, Homo Sapiens
KIWWIVQNS

SEQ ID NO: 175204 - protein, 9 aa, Homo Sapiens
LDREARLVS

SEQ ID NO: 175205 - protein, 9 aa, Homo Sapiens
MMRRQWSLW

SEQ ID NO: 175206 - protein, 9 aa, Homo Sapiens
VGTPLLVFL

SEQ ID NO: 175207 - protein, 9 aa, Homo Sapiens
KHPTGECKD

SEQ ID NO: 175208 - protein, 9 aa, Homo Sapiens
PRSGQWAQP

SEQ ID NO: 175209 - protein, 9 aa, Homo Sapiens
QRCCQGHCE

SEQ ID NO: 175210 - protein, 9 aa, Homo Sapiens
ASASWLLRT

SEQ ID NO: 175211 - protein, 9 aa, Homo Sapiens
LIRIFRVLK

SEQ ID NO: 175212 - protein, 9 aa, Homo Sapiens
PPGPENNLG

SEQ ID NO: 175213 - protein, 9 aa, Homo Sapiens
LQWPSLPGP

SEQ ID NO: 175214 - protein, 9 aa, Homo Sapiens
KAHSISKIL

SEQ ID NO: 175215 - protein, 9 aa, Homo Sapiens
LSSCPMVRV

SEQ ID NO: 175216 - protein, 9 aa, Homo Sapiens
FEELQSPPI

SEQ ID NO: 175217 - protein, 9 aa, Homo Sapiens
LQWEVAEED

SEQ ID NO: 175218 - protein, 9 aa, Homo Sapiens
MGFCLSSQL

SEQ ID NO: 175219 - protein, 9 aa, Homo Sapiens
VSSPCCPAT

SEQ ID NO: 175220 - protein, 9 aa, Homo Sapiens
WAPHSAGLS

SEQ ID NO: 175221 - protein, 9 aa, Homo Sapiens
VEEERDVGH

SEQ ID NO: 175222 - protein, 9 aa, Homo Sapiens
RILEQKFML

SEQ ID NO: 175223 - protein, 9 aa, Homo Sapiens
ELLSMTSSV

SEQ ID NO: 175224 - protein, 9 aa, Homo Sapiens
GTRDDPAGQ

SEQ ID NO: 175225 - protein, 9 aa, Homo Sapiens
LRHADVDTS

SEQ ID NO: 175226 - protein, 9 aa, Homo Sapiens
NTFGQLQLQ

SEQ ID NO: 175227 - protein, 9 aa, Homo Sapiens
FNESMKECR

SEQ ID NO: 175228 - protein, 9 aa, Homo Sapiens
YVPPPLTQP

SEQ ID NO: 175229 - protein, 9 aa, Homo Sapiens
WASVPGLPK

SEQ ID NO: 175230 - protein, 9 aa, Homo Sapiens
DKKNASSHP

SEQ ID NO: 175231 - protein, 9 aa, Homo Sapiens
DEVDDMAGN

SEQ ID NO: 175232 - protein, 9 aa, Homo Sapiens
EVFSEWVCL

SEQ ID NO: 175233 - protein, 9 aa, Homo Sapiens
PRWPPSCPQ

SEQ ID NO: 175234 - protein, 9 aa, Homo Sapiens
PTRDREKET

SEQ ID NO: 175235 - protein, 9 aa, Homo Sapiens
WLMTAMWLS

SEQ ID NO: 175236 - protein, 9 aa, Homo Sapiens
EEERDVGHE

SEQ ID NO: 175237 - protein, 9 aa, Homo Sapiens
EAKAEMHRK

SEQ ID NO: 175238 - protein, 9 aa, Homo Sapiens
AVAVRENHT

SEQ ID NO: 175239 - protein, 9 aa, Homo Sapiens
DINVEPPLH

SEQ ID NO: 175240 - protein, 9 aa, Homo Sapiens
HLYIAYQFL

SEQ ID NO: 175241 - protein, 9 aa, Homo Sapiens
QSRVIPVRL

SEQ ID NO: 175242 - protein, 9 aa, Homo Sapiens
MTRIKKWLT

SEQ ID NO: 175243 - protein, 9 aa, Homo Sapiens
KQGSWEGSS

SEQ ID NO: 175244 - protein, 9 aa, Homo Sapiens
EGLRECGYP

SEQ ID NO: 175245 - protein, 9 aa, Homo Sapiens
VLRVEEERD

SEQ ID NO: 175246 - protein, 9 aa, Homo Sapiens
SLLHSTDMR

SEQ ID NO: 175247 - protein, 9 aa, Homo Sapiens
NMATVYKIC

SEQ ID NO: 175248 - protein, 9 aa, Homo Sapiens
HAQAADKIH

SEQ ID NO: 175249 - protein, 9 aa, Homo Sapiens
SVHLHRFTR

SEQ ID NO: 175250 - protein, 9 aa, Homo Sapiens
ENDNTMLLD

SEQ ID NO: 175251 - protein, 9 aa, Homo Sapiens
TRDREKETR

SEQ ID NO: 175252 - protein, 9 aa, Homo Sapiens
HDSQGPHNA

SEQ ID NO: 175253 - protein, 9 aa, Homo Sapiens
HTENRIGDI

SEQ ID NO: 175254 - protein, 9 aa, Homo Sapiens
LGEPWRAGF

SEQ ID NO: 175255 - protein, 9 aa, Homo Sapiens
NLRPLSLQC

SEQ ID NO: 175256 - protein, 9 aa, Homo Sapiens
RKAPCASTA

SEQ ID NO: 175257 - protein, 9 aa, Homo Sapiens
VSVTQNITV

SEQ ID NO: 175258 - protein, 9 aa, Homo Sapiens
QAIAVQAGD

SEQ ID NO: 175259 - protein, 9 aa, Homo Sapiens
NDNWLEDQW

SEQ ID NO: 175260 - protein, 9 aa, Homo Sapiens
SGEPWDTER

SEQ ID NO: 175261 - protein, 9 aa, Homo Sapiens
SFTNCCEAG

SEQ ID NO: 175262 - protein, 9 aa, Homo Sapiens
ELRRWPWQG

SEQ ID NO: 175263 - protein, 9 aa, Homo Sapiens
GYLWFKCGA

SEQ ID NO: 175264 - protein, 9 aa, Homo Sapiens
YPHFWKDFL

SEQ ID NO: 175265 - protein, 9 aa, Homo Sapiens
WIGVTSILL

SEQ ID NO: 175266 - protein, 9 aa, Homo Sapiens
LQWGRRRLF

SEQ ID NO: 175267 - protein, 9 aa, Homo Sapiens
QRDGKHQPN

SEQ ID NO: 175268 - protein, 9 aa, Homo Sapiens
SAPLWASSP

SEQ ID NO: 175269 - protein, 9 aa, Homo Sapiens
DYYFSWLMW

SEQ ID NO: 175270 - protein, 9 aa, Homo Sapiens
SPGKSPEIQ

SEQ ID NO: 175271 - protein, 9 aa, Homo Sapiens
KDLDGLLYL

SEQ ID NO: 175272 - protein, 9 aa, Homo Sapiens
MLQSMGGGQ

SEQ ID NO: 175273 - protein, 9 aa, Homo Sapiens
LVSRPKPPI

SEQ ID NO: 175274 - protein, 9 aa, Homo Sapiens
VPHQQSKAQ

SEQ ID NO: 175275 - protein, 9 aa, Homo Sapiens
ASHPLFGRL

SEQ ID NO: 175276 - protein, 9 aa, Homo Sapiens
SLRPHTFKD

SEQ ID NO: 175277 - protein, 9 aa, Homo Sapiens
RGELRPASA

SEQ ID NO: 175278 - protein, 9 aa, Homo Sapiens
VSPVPPPAA

SEQ ID NO: 175279 - protein, 9 aa, Homo Sapiens
GTTCPPTSC

SEQ ID NO: 175280 - protein, 9 aa, Homo Sapiens
DNQRLKVPS

SEQ ID NO: 175281 - protein, 9 aa, Homo Sapiens
GASAEVLSI

SEQ ID NO: 175282 - protein, 9 aa, Homo Sapiens
SQRSWHGDS

SEQ ID NO: 175283 - protein, 9 aa, Homo Sapiens
AMKEGTAML

SEQ ID NO: 175284 - protein, 9 aa, Homo Sapiens
LYLHQLPVQ

SEQ ID NO: 175285 - protein, 9 aa, Homo Sapiens
SPFPPTKCH

SEQ ID NO: 175286 - protein, 9 aa, Homo Sapiens
SRPCTWSCA

SEQ ID NO: 175287 - protein, 9 aa, Homo Sapiens
LPEPNGSPT

SEQ ID NO: 175288 - protein, 9 aa, Homo Sapiens
NFNVPHIKK

SEQ ID NO: 175289 - protein, 9 aa, Homo Sapiens
YTPECINFR

SEQ ID NO: 175290 - protein, 9 aa, Homo Sapiens
LAEPRLQRQ

SEQ ID NO: 175291 - protein, 9 aa, Homo Sapiens
SSHRNVICQ

SEQ ID NO: 175292 - protein, 9 aa, Homo Sapiens
QRVCGLEEQ

SEQ ID NO: 175293 - protein, 9 aa, Homo Sapiens
LVGLAKLLL

SEQ ID NO: 175294 - protein, 9 aa, Homo Sapiens
RWGRAWGQM

SEQ ID NO: 175295 - protein, 9 aa, Homo Sapiens
QGESHLSPL

SEQ ID NO: 175296 - protein, 9 aa, Homo Sapiens
PTKAHSISK

SEQ ID NO: 175297 - protein, 9 aa, Homo Sapiens
DLLGLHVHH

SEQ ID NO: 175298 - protein, 9 aa, Homo Sapiens
GDTIQEDLK

SEQ ID NO: 175299 - protein, 9 aa, Homo Sapiens
VNLPKVDLD

SEQ ID NO: 175300 - protein, 9 aa, Homo Sapiens
QVWTAATLR

SEQ ID NO: 175301 - protein, 9 aa, Homo Sapiens
SFGSFLQGL

SEQ ID NO: 175302 - protein, 9 aa, Homo Sapiens
PSRSAACGG

SEQ ID NO: 175303 - protein, 9 aa, Homo Sapiens
VQHAAHQLR

SEQ ID NO: 175304 - protein, 9 aa, Homo Sapiens
ERALQVAHK

SEQ ID NO: 175305 - protein, 9 aa, Homo Sapiens
VTLFQAMSQ

SEQ ID NO: 175306 - protein, 9 aa, Homo Sapiens
EKKLRLAVL

SEQ ID NO: 175307 - protein, 9 aa, Homo Sapiens
VCVCEVTYD

SEQ ID NO: 175308 - protein, 9 aa, Homo Sapiens
EAKPWLAIC

SEQ ID NO: 175309 - protein, 9 aa, Homo Sapiens
VLIQHQRMH

SEQ ID NO: 175310 - protein, 9 aa, Homo Sapiens
AHGHGVCTD

SEQ ID NO: 175311 - protein, 9 aa, Homo Sapiens
GALWKHFVS

SEQ ID NO: 175312 - protein, 9 aa, Homo Sapiens
HHSWADEED

SEQ ID NO: 175313 - protein, 9 aa, Homo Sapiens
VKRHCKCCV

SEQ ID NO: 175314 - protein, 9 aa, Homo Sapiens
SICLYTFLR

SEQ ID NO: 175315 - protein, 9 aa, Homo Sapiens
LSRGQSQFD

SEQ ID NO: 175316 - protein, 9 aa, Homo Sapiens
LVGVCVFVL

SEQ ID NO: 175317 - protein, 9 aa, Homo Sapiens
DIITIESQD

SEQ ID NO: 175318 - protein, 9 aa, Homo Sapiens
PGRAWAPAP

SEQ ID NO: 175319 - protein, 9 aa, Homo Sapiens
ERRPQAPPK

SEQ ID NO: 175320 - protein, 9 aa, Homo Sapiens
PKIICQEEG

SEQ ID NO: 175321 - protein, 9 aa, Homo Sapiens
SVFFPIVVC

SEQ ID NO: 175322 - protein, 9 aa, Homo Sapiens
IGSGHVTFN

SEQ ID NO: 175323 - protein, 9 aa, Homo Sapiens
FNASVGSTR

SEQ ID NO: 175324 - protein, 9 aa, Homo Sapiens
QEKIWEQEE

SEQ ID NO: 175325 - protein, 9 aa, Homo Sapiens
PWDTERNLR

SEQ ID NO: 175326 - protein, 9 aa, Homo Sapiens
GESTVARPC

SEQ ID NO: 175327 - protein, 9 aa, Homo Sapiens
QHSDQGEFY

SEQ ID NO: 175328 - protein, 9 aa, Homo Sapiens
LVPEKCQFS

SEQ ID NO: 175329 - protein, 9 aa, Homo Sapiens
ICRRCNCES

SEQ ID NO: 175330 - protein, 9 aa, Homo Sapiens
LPPSLPRAW

SEQ ID NO: 175331 - protein, 9 aa, Homo Sapiens
LVEGAVQPG

SEQ ID NO: 175332 - protein, 9 aa, Homo Sapiens
LWNTVHRHE

SEQ ID NO: 175333 - protein, 9 aa, Homo Sapiens
LMPPGKNHN

SEQ ID NO: 175334 - protein, 9 aa, Homo Sapiens
PSASSLTSC

SEQ ID NO: 175335 - protein, 9 aa, Homo Sapiens
HGWLKKAFC

SEQ ID NO: 175336 - protein, 9 aa, Homo Sapiens
KRKREKKRK

SEQ ID NO: 175337 - protein, 9 aa, Homo Sapiens
QAGDGHGRL

SEQ ID NO: 175338 - protein, 9 aa, Homo Sapiens
TEDFTIKLI

SEQ ID NO: 175339 - protein, 9 aa, Homo Sapiens
YVAHKRLSY

SEQ ID NO: 175340 - protein, 9 aa, Homo Sapiens
APPKSSASR

SEQ ID NO: 175341 - protein, 9 aa, Homo Sapiens
DKGNHKETI

SEQ ID NO: 175342 - protein, 9 aa, Homo Sapiens
FDLSLAGWR

SEQ ID NO: 175343 - protein, 9 aa, Homo Sapiens
ALSAGNFPE

SEQ ID NO: 175344 - protein, 9 aa, Homo Sapiens
LRRMQQMAV

SEQ ID NO: 175345 - protein, 9 aa, Homo Sapiens
ITEPENGYM

SEQ ID NO: 175346 - protein, 9 aa, Homo Sapiens
SSRTRVLMV

SEQ ID NO: 175347 - protein, 9 aa, Homo Sapiens
PCSSLWAWK

SEQ ID NO: 175348 - protein, 9 aa, Homo Sapiens
PNRDFKVTW

SEQ ID NO: 175349 - protein, 9 aa, Homo Sapiens
SVSIPNLPQ

SEQ ID NO: 175350 - protein, 9 aa, Homo Sapiens
SDYVRAMCE

SEQ ID NO: 175351 - protein, 9 aa, Homo Sapiens
YKKKKPKKK

SEQ ID NO: 175352 - protein, 9 aa, Homo Sapiens
LFSTYWFFF

SEQ ID NO: 175353 - protein, 9 aa, Homo Sapiens
SFKRCGNIC

SEQ ID NO: 175354 - protein, 9 aa, Homo Sapiens
TSSLAEPNG

SEQ ID NO: 175355 - protein, 9 aa, Homo Sapiens
FNVPHIKKQ

SEQ ID NO: 175356 - protein, 9 aa, Homo Sapiens
LQLALRSQK

SEQ ID NO: 175357 - protein, 9 aa, Homo Sapiens
NTVVHELGH

SEQ ID NO: 175358 - protein, 9 aa, Homo Sapiens
RYAPLGGQR

SEQ ID NO: 175359 - protein, 9 aa, Homo Sapiens
ARPALQAPP

SEQ ID NO: 175360 - protein, 9 aa, Homo Sapiens
ESPNRKMKR

SEQ ID NO: 175361 - protein, 9 aa, Homo Sapiens
GRRKWYAYK

SEQ ID NO: 175362 - protein, 9 aa, Homo Sapiens
ERELGHLKQ

SEQ ID NO: 175363 - protein, 9 aa, Homo Sapiens
LEEPQLKGI

SEQ ID NO: 175364 - protein, 9 aa, Homo Sapiens
FPIVVCLCT

SEQ ID NO: 175365 - protein, 9 aa, Homo Sapiens
MTSGPTYGA

SEQ ID NO: 175366 - protein, 9 aa, Homo Sapiens
FVTPRQQHE

SEQ ID NO: 175367 - protein, 9 aa, Homo Sapiens
QAITSCRLQ

SEQ ID NO: 175368 - protein, 9 aa, Homo Sapiens
EITETESQC

SEQ ID NO: 175369 - protein, 9 aa, Homo Sapiens
PWCPGLPPC

SEQ ID NO: 175370 - protein, 9 aa, Homo Sapiens
ATQKTQRRS

SEQ ID NO: 175371 - protein, 9 aa, Homo Sapiens
SEWKKAVRF

SEQ ID NO: 175372 - protein, 9 aa, Homo Sapiens
DDILGGHFG

SEQ ID NO: 175373 - protein, 9 aa, Homo Sapiens
EPPMPPPAN

SEQ ID NO: 175374 - protein, 9 aa, Homo Sapiens
APAPWLPMR

SEQ ID NO: 175375 - protein, 9 aa, Homo Sapiens
QNHPRAVLI

SEQ ID NO: 175376 - protein, 9 aa, Homo Sapiens
WYERALQVA

SEQ ID NO: 175377 - protein, 9 aa, Homo Sapiens
HHHLDSNFR

SEQ ID NO: 175378 - protein, 9 aa, Homo Sapiens
INVDLIHTE

SEQ ID NO: 175379 - protein, 9 aa, Homo Sapiens
ATGKGPLGP

SEQ ID NO: 175380 - protein, 9 aa, Homo Sapiens
NASRPPQAT

SEQ ID NO: 175381 - protein, 9 aa, Homo Sapiens
LRWGWWVWG

SEQ ID NO: 175382 - protein, 9 aa, Homo Sapiens
RSPSRRARP

SEQ ID NO: 175383 - protein, 9 aa, Homo Sapiens
THPAHQPLG

SEQ ID NO: 175384 - protein, 9 aa, Homo Sapiens
PSPGTCFRC

SEQ ID NO: 175385 - protein, 9 aa, Homo Sapiens
VPLGPARTG

SEQ ID NO: 175386 - protein, 9 aa, Homo Sapiens
HFVSPRGVA

SEQ ID NO: 175387 - protein, 9 aa, Homo Sapiens
PEDLWNIHD

SEQ ID NO: 175388 - protein, 9 aa, Homo Sapiens
HVCSHGDKL

SEQ ID NO: 175389 - protein, 9 aa, Homo Sapiens
TIDNVSGKR

SEQ ID NO: 175390 - protein, 9 aa, Homo Sapiens
MPQALHLAA

SEQ ID NO: 175391 - protein, 9 aa, Homo Sapiens
KMAGLNTIQ

SEQ ID NO: 175392 - protein, 9 aa, Homo Sapiens
PKTELIPNK

SEQ ID NO: 175393 - protein, 9 aa, Homo Sapiens
GPWSTCVCL

SEQ ID NO: 175394 - protein, 9 aa, Homo Sapiens
AVKLVAIRT

SEQ ID NO: 175395 - protein, 9 aa, Homo Sapiens
SSATGSCEA

SEQ ID NO: 175396 - protein, 9 aa, Homo Sapiens
SPPLGLHSS

SEQ ID NO: 175397 - protein, 9 aa, Homo Sapiens
QSNTTCKNP

SEQ ID NO: 175398 - protein, 9 aa, Homo Sapiens
DKAFSQASS

SEQ ID NO: 175399 - protein, 9 aa, Homo Sapiens
LPPCLPAGK

SEQ ID NO: 175400 - protein, 9 aa, Homo Sapiens
KPSASPRSG

SEQ ID NO: 175401 - protein, 9 aa, Homo Sapiens
TTLWLGPAS

SEQ ID NO: 175402 - protein, 9 aa, Homo Sapiens
ACGHSCPGR

SEQ ID NO: 175403 - protein, 9 aa, Homo Sapiens
DRQVSVYIV

SEQ ID NO: 175404 - protein, 9 aa, Homo Sapiens
CDVHHVEEA

SEQ ID NO: 175405 - protein, 9 aa, Homo Sapiens
IEGIKKEDS

SEQ ID NO: 175406 - protein, 9 aa, Homo Sapiens
QMLAWLLRT

SEQ ID NO: 175407 - protein, 9 aa, Homo Sapiens
PCQRRGRCI

SEQ ID NO: 175408 - protein, 9 aa, Homo Sapiens
LGMGDQALI

SEQ ID NO: 175409 - protein, 9 aa, Homo Sapiens
HLEIYQSSQ

SEQ ID NO: 175410 - protein, 9 aa, Homo Sapiens
VGTKFSASL

SEQ ID NO: 175411 - protein, 9 aa, Homo Sapiens
PAPAPWLPM

SEQ ID NO: 175412 - protein, 9 aa, Homo Sapiens
YRPWRGTTR

SEQ ID NO: 175413 - protein, 9 aa, Homo Sapiens
PWGTGGTPQ

SEQ ID NO: 175414 - protein, 9 aa, Homo Sapiens
ESGPPPSVI

SEQ ID NO: 175415 - protein, 9 aa, Homo Sapiens
SLPRAWQVP

SEQ ID NO: 175416 - protein, 9 aa, Homo Sapiens
RRAWRALLY

SEQ ID NO: 175417 - protein, 9 aa, Homo Sapiens
PPRPTVAFL

SEQ ID NO: 175418 - protein, 9 aa, Homo Sapiens
EAISSSVDP

SEQ ID NO: 175419 - protein, 9 aa, Homo Sapiens
VDCPDDDED

SEQ ID NO: 175420 - protein, 9 aa, Homo Sapiens
PEGDAHISS

SEQ ID NO: 175421 - protein, 9 aa, Homo Sapiens
IINPTISCP

SEQ ID NO: 175422 - protein, 9 aa, Homo Sapiens
KPQPPVMVK

SEQ ID NO: 175423 - protein, 9 aa, Homo Sapiens
SGGHSTDAH

SEQ ID NO: 175424 - protein, 9 aa, Homo Sapiens
AVPPWIECQ

SEQ ID NO: 175425 - protein, 9 aa, Homo Sapiens
METETINHQ

SEQ ID NO: 175426 - protein, 9 aa, Homo Sapiens
IITAAVPRT

SEQ ID NO: 175427 - protein, 9 aa, Homo Sapiens
QVWQLAWIG

SEQ ID NO: 175428 - protein, 9 aa, Homo Sapiens
IFVQKIVKS

SEQ ID NO: 175429 - protein, 9 aa, Homo Sapiens
ALGTQVMQL

SEQ ID NO: 175430 - protein, 9 aa, Homo Sapiens
GLLYVGVRE

SEQ ID NO: 175431 - protein, 9 aa, Homo Sapiens
TASSSATRR

SEQ ID NO: 175432 - protein, 9 aa, Homo Sapiens
SLKLKMTRP

SEQ ID NO: 175433 - protein, 9 aa, Homo Sapiens
IYTVGAGTG

SEQ ID NO: 175434 - protein, 9 aa, Homo Sapiens
PDSFAAVRL

SEQ ID NO: 175435 - protein, 9 aa, Homo Sapiens
PMQKPSASP

SEQ ID NO: 175436 - protein, 9 aa, Homo Sapiens
RWDWSEVVE

SEQ ID NO: 175437 - protein, 9 aa, Homo Sapiens
CGVCPLAGL

SEQ ID NO: 175438 - protein, 9 aa, Homo Sapiens
AAAHSVCLA

SEQ ID NO: 175439 - protein, 9 aa, Homo Sapiens
SSQFPHRQK

SEQ ID NO: 175440 - protein, 9 aa, Homo Sapiens
ECQHHKPPF

SEQ ID NO: 175441 - protein, 9 aa, Homo Sapiens
FGAQECRLV

SEQ ID NO: 175442 - protein, 9 aa, Homo Sapiens
LQQEAPRAF

SEQ ID NO: 175443 - protein, 9 aa, Homo Sapiens
FDVYEVVNP

SEQ ID NO: 175444 - protein, 9 aa, Homo Sapiens
QRLIRKAMV

SEQ ID NO: 175445 - protein, 9 aa, Homo Sapiens
KSYRKSPRF

SEQ ID NO: 175446 - protein, 9 aa, Homo Sapiens
MLGSCCTAT

SEQ ID NO: 175447 - protein, 9 aa, Homo Sapiens
GTRIAAAPT

SEQ ID NO: 175448 - protein, 9 aa, Homo Sapiens
WRTQRPGPA

SEQ ID NO: 175449 - protein, 9 aa, Homo Sapiens
VSLEWVMEM

SEQ ID NO: 175450 - protein, 9 aa, Homo Sapiens
PHPAARSSS

SEQ ID NO: 175451 - protein, 9 aa, Homo Sapiens
RRARPAAPQ

SEQ ID NO: 175452 - protein, 9 aa, Homo Sapiens
VSELRITTQ

SEQ ID NO: 175453 - protein, 9 aa, Homo Sapiens
RLDGPLLPE

SEQ ID NO: 175454 - protein, 9 aa, Homo Sapiens
LSGDSSAEG

SEQ ID NO: 175455 - protein, 9 aa, Homo Sapiens
QQQDWNLAL

SEQ ID NO: 175456 - protein, 9 aa, Homo Sapiens
QSGLWVCTA

SEQ ID NO: 175457 - protein, 9 aa, Homo Sapiens
PATLPCRRH

SEQ ID NO: 175458 - protein, 9 aa, Homo Sapiens
EELSTLHAH

SEQ ID NO: 175459 - protein, 9 aa, Homo Sapiens
LSTLSQPPP

SEQ ID NO: 175460 - protein, 9 aa, Homo Sapiens
LPPAVGGCV

SEQ ID NO: 175461 - protein, 9 aa, Homo Sapiens
REDDALSIW

SEQ ID NO: 175462 - protein, 9 aa, Homo Sapiens
CTKIEAKGM

SEQ ID NO: 175463 - protein, 9 aa, Homo Sapiens
SSATQASMT

SEQ ID NO: 175464 - protein, 9 aa, Homo Sapiens
ENGSFTNCC

SEQ ID NO: 175465 - protein, 9 aa, Homo Sapiens
HFNHSLWAR

SEQ ID NO: 175466 - protein, 9 aa, Homo Sapiens
RELAEQTAT

SEQ ID NO: 175467 - protein, 9 aa, Homo Sapiens
VIADLHPMG

SEQ ID NO: 175468 - protein, 9 aa, Homo Sapiens
LTVVVQQQD

SEQ ID NO: 175469 - protein, 9 aa, Homo Sapiens
EEEVGGVPG

SEQ ID NO: 175470 - protein, 9 aa, Homo Sapiens
EHKLREHSE

SEQ ID NO: 175471 - protein, 9 aa, Homo Sapiens
INTVLQYVV

SEQ ID NO: 175472 - protein, 9 aa, Homo Sapiens
VDALVPQHV

SEQ ID NO: 175473 - protein, 9 aa, Homo Sapiens
MGPLSLVLC

SEQ ID NO: 175474 - protein, 9 aa, Homo Sapiens
ENGNRIGSD

SEQ ID NO: 175475 - protein, 9 aa, Homo Sapiens
TVPGGPGTA

SEQ ID NO: 175476 - protein, 9 aa, Homo Sapiens
KRPLPCVQA

SEQ ID NO: 175477 - protein, 9 aa, Homo Sapiens
FCCRKKHRE

SEQ ID NO: 175478 - protein, 9 aa, Homo Sapiens
LQEDTNFPL

SEQ ID NO: 175479 - protein, 9 aa, Homo Sapiens
LLSSPRDHP

SEQ ID NO: 175480 - protein, 9 aa, Homo Sapiens
VVLHGKPDV

SEQ ID NO: 175481 - protein, 9 aa, Homo Sapiens
KSESHVTML

SEQ ID NO: 175482 - protein, 9 aa, Homo Sapiens
VHAEFPTGL

SEQ ID NO: 175483 - protein, 9 aa, Homo Sapiens
RVPHWGPSW

SEQ ID NO: 175484 - protein, 9 aa, Homo Sapiens
SHSMHKKLT

SEQ ID NO: 175485 - protein, 9 aa, Homo Sapiens
DTVHAEFPT

SEQ ID NO: 175486 - protein, 9 aa, Homo Sapiens
RGGSVHLHR

SEQ ID NO: 175487 - protein, 9 aa, Homo Sapiens
ECRILRGHD

SEQ ID NO: 175488 - protein, 9 aa, Homo Sapiens
VTLGTLKRL

SEQ ID NO: 175489 - protein, 9 aa, Homo Sapiens
RSRPGSPAL

SEQ ID NO: 175490 - protein, 9 aa, Homo Sapiens
IYLIVIGLG

SEQ ID NO: 175491 - protein, 9 aa, Homo Sapiens
TIKKIWLVD

SEQ ID NO: 175492 - protein, 9 aa, Homo Sapiens
MDLKSQRKE

SEQ ID NO: 175493 - protein, 9 aa, Homo Sapiens
THMGERPYK

SEQ ID NO: 175494 - protein, 9 aa, Homo Sapiens
TEVAMEAKW

SEQ ID NO: 175495 - protein, 9 aa, Homo Sapiens
FPFPHATGR

SEQ ID NO: 175496 - protein, 9 aa, Homo Sapiens
QIRADNKLD

SEQ ID NO: 175497 - protein, 9 aa, Homo Sapiens
TITKKISEC

SEQ ID NO: 175498 - protein, 9 aa, Homo Sapiens
VSSATSSAT

SEQ ID NO: 175499 - protein, 9 aa, Homo Sapiens
GLTHPAHQP

SEQ ID NO: 175500 - protein, 9 aa, Homo Sapiens
KKKKKRERT

SEQ ID NO: 175501 - protein, 9 aa, Homo Sapiens
VKLPHPTAP

SEQ ID NO: 175502 - protein, 9 aa, Homo Sapiens
PPALMPIST

SEQ ID NO: 175503 - protein, 9 aa, Homo Sapiens
PLPQQHRGP

SEQ ID NO: 175504 - protein, 9 aa, Homo Sapiens
VAEPKVLFA

SEQ ID NO: 175505 - protein, 9 aa, Homo Sapiens
ASKQALKPK

SEQ ID NO: 175506 - protein, 9 aa, Homo Sapiens
SSSCCPASP

SEQ ID NO: 175507 - protein, 9 aa, Homo Sapiens
NYSHYFRKA

SEQ ID NO: 175508 - protein, 9 aa, Homo Sapiens
YDVLLPKSG

SEQ ID NO: 175509 - protein, 9 aa, Homo Sapiens
IRAFHLQSS

SEQ ID NO: 175510 - protein, 9 aa, Homo Sapiens
ALTVKLGGD

SEQ ID NO: 175511 - protein, 9 aa, Homo Sapiens
TNCCEAGGW

SEQ ID NO: 175512 - protein, 9 aa, Homo Sapiens
SPFFRTNQV

SEQ ID NO: 175513 - protein, 9 aa, Homo Sapiens
SNSSNSDQN

SEQ ID NO: 175514 - protein, 9 aa, Homo Sapiens
QQKGWLLGP

SEQ ID NO: 175515 - protein, 9 aa, Homo Sapiens
PMPPPANPQ

SEQ ID NO: 175516 - protein, 9 aa, Homo Sapiens
CTSEMLKKR

SEQ ID NO: 175517 - protein, 9 aa, Homo Sapiens
SDNQRLKVP

SEQ ID NO: 175518 - protein, 9 aa, Homo Sapiens
SSTSCGSCP

SEQ ID NO: 175519 - protein, 9 aa, Homo Sapiens
SCSYVAHKR

SEQ ID NO: 175520 - protein, 9 aa, Homo Sapiens
SVCLARGDL

SEQ ID NO: 175521 - protein, 9 aa, Homo Sapiens
LWLMGWSDM

SEQ ID NO: 175522 - protein, 9 aa, Homo Sapiens
VVQVGLFHG

SEQ ID NO: 175523 - protein, 9 aa, Homo Sapiens
IGRQYLAQQ

SEQ ID NO: 175524 - protein, 9 aa, Homo Sapiens
RLSQDAYHR

SEQ ID NO: 175525 - protein, 9 aa, Homo Sapiens
NAVLANVPI

SEQ ID NO: 175526 - protein, 9 aa, Homo Sapiens
ERCIHQESE

SEQ ID NO: 175527 - protein, 9 aa, Homo Sapiens
TKASNTIAP

SEQ ID NO: 175528 - protein, 9 aa, Homo Sapiens
SPKPGPPVQ

SEQ ID NO: 175529 - protein, 9 aa, Homo Sapiens
TSSSMSTWT

SEQ ID NO: 175530 - protein, 9 aa, Homo Sapiens
SSTFLKALA

SEQ ID NO: 175531 - protein, 9 aa, Homo Sapiens
AQTRWCWSL

SEQ ID NO: 175532 - protein, 9 aa, Homo Sapiens
PQGVGPYSP

SEQ ID NO: 175533 - protein, 9 aa, Homo Sapiens
PTRGRSFLL

SEQ ID NO: 175534 - protein, 9 aa, Homo Sapiens
AHMKLNWAV

SEQ ID NO: 175535 - protein, 9 aa, Homo Sapiens
EVQSSGPED

SEQ ID NO: 175536 - protein, 9 aa, Homo Sapiens
PEPDCGTRR

SEQ ID NO: 175537 - protein, 9 aa, Homo Sapiens
VQLSTVALG

SEQ ID NO: 175538 - protein, 9 aa, Homo Sapiens
PRVLTLKRF

SEQ ID NO: 175539 - protein, 9 aa, Homo Sapiens
MQSGLWVCT

SEQ ID NO: 175540 - protein, 9 aa, Homo Sapiens
GSRRPHGPQ

SEQ ID NO: 175541 - protein, 9 aa, Homo Sapiens
GDMTQAHEV

SEQ ID NO: 175542 - protein, 9 aa, Homo Sapiens
TLQRLGPVW

SEQ ID NO: 175543 - protein, 9 aa, Homo Sapiens
APGPLGVSR

SEQ ID NO: 175544 - protein, 9 aa, Homo Sapiens
MELECEVTG

SEQ ID NO: 175545 - protein, 9 aa, Homo Sapiens
KYIKKISSG

SEQ ID NO: 175546 - protein, 9 aa, Homo Sapiens
QKWPFIVKR

SEQ ID NO: 175547 - protein, 9 aa, Homo Sapiens
NDMVTGANL

SEQ ID NO: 175548 - protein, 9 aa, Homo Sapiens
TNLCVAGLS

SEQ ID NO: 175549 - protein, 9 aa, Homo Sapiens
SATFPMSVQ

SEQ ID NO: 175550 - protein, 9 aa, Homo Sapiens
VVIADLHPM

SEQ ID NO: 175551 - protein, 9 aa, Homo Sapiens
KTINLTAKR

SEQ ID NO: 175552 - protein, 9 aa, Homo Sapiens
KAAKRMHLE

SEQ ID NO: 175553 - protein, 9 aa, Homo Sapiens
TNIHGTSNK

SEQ ID NO: 175554 - protein, 9 aa, Homo Sapiens
GPAARAKVA

SEQ ID NO: 175555 - protein, 9 aa, Homo Sapiens
QWYHVMVKA

SEQ ID NO: 175556 - protein, 9 aa, Homo Sapiens
PTRPLHRTT

SEQ ID NO: 175557 - protein, 9 aa, Homo Sapiens
TTSRKSRPC

SEQ ID NO: 175558 - protein, 9 aa, Homo Sapiens
LHPYQCDSC

SEQ ID NO: 175559 - protein, 9 aa, Homo Sapiens
PVGPSAGAV

SEQ ID NO: 175560 - protein, 9 aa, Homo Sapiens
SVGLLPPQL

SEQ ID NO: 175561 - protein, 9 aa, Homo Sapiens
CGSCPRSAW

SEQ ID NO: 175562 - protein, 9 aa, Homo Sapiens
DSPQSLNTE

SEQ ID NO: 175563 - protein, 9 aa, Homo Sapiens
GSPGCLRPR

SEQ ID NO: 175564 - protein, 9 aa, Homo Sapiens
GRTGMFTVR

SEQ ID NO: 175565 - protein, 9 aa, Homo Sapiens
TRTARRTLR

SEQ ID NO: 175566 - protein, 9 aa, Homo Sapiens
PLPSRLYVP

SEQ ID NO: 175567 - protein, 9 aa, Homo Sapiens
TPSSKEATT

SEQ ID NO: 175568 - protein, 9 aa, Homo Sapiens
APVCGKKHR

SEQ ID NO: 175569 - protein, 9 aa, Homo Sapiens
KMAGIVCAS

SEQ ID NO: 175570 - protein, 9 aa, Homo Sapiens
LRMTPTCPL

SEQ ID NO: 175571 - protein, 9 aa, Homo Sapiens
DSFQEIAKE

SEQ ID NO: 175572 - protein, 9 aa, Homo Sapiens
GVCVCVSLN

SEQ ID NO: 175573 - protein, 9 aa, Homo Sapiens
CRRPHPVVT

SEQ ID NO: 175574 - protein, 9 aa, Homo Sapiens
EGATIHNIT

SEQ ID NO: 175575 - protein, 9 aa, Homo Sapiens
IIDCGKVFY

SEQ ID NO: 175576 - protein, 9 aa, Homo Sapiens
QQQPPAAAA

SEQ ID NO: 175577 - protein, 9 aa, Homo Sapiens
LLAGVPPPP

SEQ ID NO: 175578 - protein, 9 aa, Homo Sapiens
CFASCSWCP

SEQ ID NO: 175579 - protein, 9 aa, Homo Sapiens
AADPLNRRT

SEQ ID NO: 175580 - protein, 9 aa, Homo Sapiens
VACRQRCWP

SEQ ID NO: 175581 - protein, 9 aa, Homo Sapiens
VFVQFLQEK

SEQ ID NO: 175582 - protein, 9 aa, Homo Sapiens
SSAISPKML

SEQ ID NO: 175583 - protein, 9 aa, Homo Sapiens
GLTSGPHCT

SEQ ID NO: 175584 - protein, 9 aa, Homo Sapiens
VDHVEGQGG

SEQ ID NO: 175585 - protein, 9 aa, Homo Sapiens
PVAVAAWGW

SEQ ID NO: 175586 - protein, 9 aa, Homo Sapiens
SKHPTGECK

SEQ ID NO: 175587 - protein, 9 aa, Homo Sapiens
RCLACHLKY

SEQ ID NO: 175588 - protein, 9 aa, Homo Sapiens
LRCPHLRAV

SEQ ID NO: 175589 - protein, 9 aa, Homo Sapiens
PCSSSSPCQ

SEQ ID NO: 175590 - protein, 9 aa, Homo Sapiens
HRWEVCLTI

SEQ ID NO: 175591 - protein, 9 aa, Homo Sapiens
LKQRNDQPE

SEQ ID NO: 175592 - protein, 9 aa, Homo Sapiens
FRRVLQQVP

SEQ ID NO: 175593 - protein, 9 aa, Homo Sapiens
NTPVFDQTS

SEQ ID NO: 175594 - protein, 9 aa, Homo Sapiens
HLFHTDRHT

SEQ ID NO: 175595 - protein, 9 aa, Homo Sapiens
RCCQGHCEE

SEQ ID NO: 175596 - protein, 9 aa, Homo Sapiens
SRLPGSAAA

SEQ ID NO: 175597 - protein, 9 aa, Homo Sapiens
DRRGGPGQA

SEQ ID NO: 175598 - protein, 9 aa, Homo Sapiens
LIITTKNSN

SEQ ID NO: 175599 - protein, 9 aa, Homo Sapiens
LEHFLQVTC

SEQ ID NO: 175600 - protein, 9 aa, Homo Sapiens
KEENAMIAK

SEQ ID NO: 175601 - protein, 9 aa, Homo Sapiens
FVQPCTCPP

SEQ ID NO: 175602 - protein, 9 aa, Homo Sapiens
LEGCSIDTD

SEQ ID NO: 175603 - protein, 9 aa, Homo Sapiens
SFASKQALK

SEQ ID NO: 175604 - protein, 9 aa, Homo Sapiens
IVAYVTETL

SEQ ID NO: 175605 - protein, 9 aa, Homo Sapiens
ESESDIFCM

SEQ ID NO: 175606 - protein, 9 aa, Homo Sapiens
TCPKCSTPA

SEQ ID NO: 175607 - protein, 9 aa, Homo Sapiens
HMGERPYKC

SEQ ID NO: 175608 - protein, 9 aa, Homo Sapiens
RWGVCVCVS

SEQ ID NO: 175609 - protein, 9 aa, Homo Sapiens
LNPPQGVGP

SEQ ID NO: 175610 - protein, 9 aa, Homo Sapiens
WSTTRTRAA

SEQ ID NO: 175611 - protein, 9 aa, Homo Sapiens
KSPPTAAVA

SEQ ID NO: 175612 - protein, 9 aa, Homo Sapiens
CGIFAYLNH

SEQ ID NO: 175613 - protein, 9 aa, Homo Sapiens
ILLLKFSTG

SEQ ID NO: 175614 - protein, 9 aa, Homo Sapiens
SLWRASTRN

SEQ ID NO: 175615 - protein, 9 aa, Homo Sapiens
KHLQDFLLS

SEQ ID NO: 175616 - protein, 9 aa, Homo Sapiens
KKKSVGLLP

SEQ ID NO: 175617 - protein, 9 aa, Homo Sapiens
KVIAEAEDR

SEQ ID NO: 175618 - protein, 9 aa, Homo Sapiens
LANAQGTWG

SEQ ID NO: 175619 - protein, 9 aa, Homo Sapiens
LNALHLQSE

SEQ ID NO: 175620 - protein, 9 aa, Homo Sapiens
CPVPVSFEN

SEQ ID NO: 175621 - protein, 9 aa, Homo Sapiens
PGGPAVAGA

SEQ ID NO: 175622 - protein, 9 aa, Homo Sapiens
EPENGYMRP

SEQ ID NO: 175623 - protein, 9 aa, Homo Sapiens
ILFHYPHFW

SEQ ID NO: 175624 - protein, 9 aa, Homo Sapiens
VSRPEPRSD

SEQ ID NO: 175625 - protein, 9 aa, Homo Sapiens
APEPDCGTR

SEQ ID NO: 175626 - protein, 9 aa, Homo Sapiens
GSQKRTISQ

SEQ ID NO: 175627 - protein, 9 aa, Homo Sapiens
CRWGAPMQK

SEQ ID NO: 175628 - protein, 9 aa, Homo Sapiens
WRRSHWSCC

SEQ ID NO: 175629 - protein, 9 aa, Homo Sapiens
GQGGERVAP

SEQ ID NO: 175630 - protein, 9 aa, Homo Sapiens
HKPQPPVMV

SEQ ID NO: 175631 - protein, 9 aa, Homo Sapiens
ALLEVLGWL

SEQ ID NO: 175632 - protein, 9 aa, Homo Sapiens
MRAIRIVNA

SEQ ID NO: 175633 - protein, 9 aa, Homo Sapiens
VAGLSQFRG

SEQ ID NO: 175634 - protein, 9 aa, Homo Sapiens
AQSEALSRV

SEQ ID NO: 175635 - protein, 9 aa, Homo Sapiens
PTTAAMAYG

SEQ ID NO: 175636 - protein, 9 aa, Homo Sapiens
PAIILFSRS

SEQ ID NO: 175637 - protein, 9 aa, Homo Sapiens
LNSQIKIFQ

SEQ ID NO: 175638 - protein, 9 aa, Homo Sapiens
AAEHQGNGK

SEQ ID NO: 175639 - protein, 9 aa, Homo Sapiens
ITWEHAGWY

SEQ ID NO: 175640 - protein, 9 aa, Homo Sapiens
IQSLQQAAA

SEQ ID NO: 175641 - protein, 9 aa, Homo Sapiens
DTPMVRRAT

SEQ ID NO: 175642 - protein, 9 aa, Homo Sapiens
CICVVAAHL

SEQ ID NO: 175643 - protein, 9 aa, Homo Sapiens
ASPHSPGAS

SEQ ID NO: 175644 - protein, 9 aa, Homo Sapiens
GHVGTVRRF

SEQ ID NO: 175645 - protein, 9 aa, Homo Sapiens
RVKEADHQN

SEQ ID NO: 175646 - protein, 9 aa, Homo Sapiens
VRTSEGSRC

SEQ ID NO: 175647 - protein, 9 aa, Homo Sapiens
GLNTIQTYV

SEQ ID NO: 175648 - protein, 9 aa, Homo Sapiens
APQPARQAR

SEQ ID NO: 175649 - protein, 9 aa, Homo Sapiens
PEEVLKNIY

SEQ ID NO: 175650 - protein, 9 aa, Homo Sapiens
ASSPGSRSP

SEQ ID NO: 175651 - protein, 9 aa, Homo Sapiens
NRAIQRMQA

SEQ ID NO: 175652 - protein, 9 aa, Homo Sapiens
MGAAVLCTS

SEQ ID NO: 175653 - protein, 9 aa, Homo Sapiens
HSQHLPSTT

SEQ ID NO: 175654 - protein, 9 aa, Homo Sapiens
VKQKKTATK

SEQ ID NO: 175655 - protein, 9 aa, Homo Sapiens
FTLFFFCNM

SEQ ID NO: 175656 - protein, 9 aa, Homo Sapiens
GVYTEARLG

SEQ ID NO: 175657 - protein, 9 aa, Homo Sapiens
NGVTADNGD

SEQ ID NO: 175658 - protein, 9 aa, Homo Sapiens
ERNLKCFLK

SEQ ID NO: 175659 - protein, 9 aa, Homo Sapiens
FPPHLELPL

SEQ ID NO: 175660 - protein, 9 aa, Homo Sapiens
DMTQAHEVA

SEQ ID NO: 175661 - protein, 9 aa, Homo Sapiens
YLPQWWERG

SEQ ID NO: 175662 - protein, 9 aa, Homo Sapiens
MPVLKPMDL

SEQ ID NO: 175663 - protein, 9 aa, Homo Sapiens
EKSSGRTTH

SEQ ID NO: 175664 - protein, 9 aa, Homo Sapiens
MIWSNPVQE

SEQ ID NO: 175665 - protein, 9 aa, Homo Sapiens
WILFLYNRE

SEQ ID NO: 175666 - protein, 9 aa, Homo Sapiens
GPLALQARM

SEQ ID NO: 175667 - protein, 9 aa, Homo Sapiens
GDQRGQDRV

SEQ ID NO: 175668 - protein, 9 aa, Homo Sapiens
NTEDWKKRH

SEQ ID NO: 175669 - protein, 9 aa, Homo Sapiens
TTKKYPPQL

SEQ ID NO: 175670 - protein, 9 aa, Homo Sapiens
TSVPLLLKK

SEQ ID NO: 175671 - protein, 9 aa, Homo Sapiens
VREDEPASL

SEQ ID NO: 175672 - protein, 9 aa, Homo Sapiens
ASAPCWAPA

SEQ ID NO: 175673 - protein, 9 aa, Homo Sapiens
VQHTPPPIP

SEQ ID NO: 175674 - protein, 9 aa, Homo Sapiens
NLGSEHSFR

SEQ ID NO: 175675 - protein, 9 aa, Homo Sapiens
TGPSPAGWM

SEQ ID NO: 175676 - protein, 9 aa, Homo Sapiens
IEQLNRMKK

SEQ ID NO: 175677 - protein, 9 aa, Homo Sapiens
KLCLLLVVG

SEQ ID NO: 175678 - protein, 9 aa, Homo Sapiens
EWWTMVCNL

SEQ ID NO: 175679 - protein, 9 aa, Homo Sapiens
QARQGAEEA

SEQ ID NO: 175680 - protein, 9 aa, Homo Sapiens
AEGIPIPRI

SEQ ID NO: 175681 - protein, 9 aa, Homo Sapiens
RLFHTALFL

SEQ ID NO: 175682 - protein, 9 aa, Homo Sapiens
WFTPCCMRC

SEQ ID NO: 175683 - protein, 9 aa, Homo Sapiens
NMNMFYIQE

SEQ ID NO: 175684 - protein, 9 aa, Homo Sapiens
APETTLWLG

SEQ ID NO: 175685 - protein, 9 aa, Homo Sapiens
PWSPGHGAW

SEQ ID NO: 175686 - protein, 9 aa, Homo Sapiens
PQAPSQVWT

SEQ ID NO: 175687 - protein, 9 aa, Homo Sapiens
LKCSNPLAR

SEQ ID NO: 175688 - protein, 9 aa, Homo Sapiens
GYLVSTVCA

SEQ ID NO: 175689 - protein, 9 aa, Homo Sapiens
SPVVIRHIQ

SEQ ID NO: 175690 - protein, 9 aa, Homo Sapiens
RPPQEHFCR

SEQ ID NO: 175691 - protein, 9 aa, Homo Sapiens
GRTKTFRLK

SEQ ID NO: 175692 - protein, 9 aa, Homo Sapiens
SIWQHRELI

SEQ ID NO: 175693 - protein, 9 aa, Homo Sapiens
ASLLSTLSQ

SEQ ID NO: 175694 - protein, 9 aa, Homo Sapiens
VRRFESPEE

SEQ ID NO: 175695 - protein, 9 aa, Homo Sapiens
LSLSPSHPP

SEQ ID NO: 175696 - protein, 9 aa, Homo Sapiens
LWVCTAECK

SEQ ID NO: 175697 - protein, 9 aa, Homo Sapiens
CSYVAHKRL

SEQ ID NO: 175698 - protein, 9 aa, Homo Sapiens
PQTALGHRY

SEQ ID NO: 175699 - protein, 9 aa, Homo Sapiens
LSGLYYNGF

SEQ ID NO: 175700 - protein, 9 aa, Homo Sapiens
LHRFTRGRS

SEQ ID NO: 175701 - protein, 9 aa, Homo Sapiens
LRHTYANGV

SEQ ID NO: 175702 - protein, 9 aa, Homo Sapiens
PPTKCHLAR

SEQ ID NO: 175703 - protein, 9 aa, Homo Sapiens
VATEQERTS

SEQ ID NO: 175704 - protein, 9 aa, Homo Sapiens
GPVRHLHQQ

SEQ ID NO: 175705 - protein, 9 aa, Homo Sapiens
AGMESTALS

SEQ ID NO: 175706 - protein, 9 aa, Homo Sapiens
PLLCLGPTR

SEQ ID NO: 175707 - protein, 9 aa, Homo Sapiens
QWGESPWQV

SEQ ID NO: 175708 - protein, 9 aa, Homo Sapiens
SGSPRRRPC

SEQ ID NO: 175709 - protein, 9 aa, Homo Sapiens
HPASAISGQ

SEQ ID NO: 175710 - protein, 9 aa, Homo Sapiens
QPCTCPPVF

SEQ ID NO: 175711 - protein, 9 aa, Homo Sapiens
LVLLAWPVP

SEQ ID NO: 175712 - protein, 9 aa, Homo Sapiens
NRELIYPKV

SEQ ID NO: 175713 - protein, 9 aa, Homo Sapiens
LGIDSDSSP

SEQ ID NO: 175714 - protein, 9 aa, Homo Sapiens
APPPSASYS

SEQ ID NO: 175715 - protein, 9 aa, Homo Sapiens
TEQPLELRL

SEQ ID NO: 175716 - protein, 9 aa, Homo Sapiens
MNMFYIQEL

SEQ ID NO: 175717 - protein, 9 aa, Homo Sapiens
EIEHLSHLY

SEQ ID NO: 175718 - protein, 9 aa, Homo Sapiens
RAGSRTTCP

SEQ ID NO: 175719 - protein, 9 aa, Homo Sapiens
ISKPTWEHL

SEQ ID NO: 175720 - protein, 9 aa, Homo Sapiens
QGYDMSAFI

SEQ ID NO: 175721 - protein, 9 aa, Homo Sapiens
HQPNQTKGL

SEQ ID NO: 175722 - protein, 9 aa, Homo Sapiens
EVLVTLRAV

SEQ ID NO: 175723 - protein, 9 aa, Homo Sapiens
MDFHANLQR

SEQ ID NO: 175724 - protein, 9 aa, Homo Sapiens
IIPHELIHT

SEQ ID NO: 175725 - protein, 9 aa, Homo Sapiens
EIVLCQLVL

SEQ ID NO: 175726 - protein, 9 aa, Homo Sapiens
QDGQDGAAV

SEQ ID NO: 175727 - protein, 9 aa, Homo Sapiens
RDAVTLRYG

SEQ ID NO: 175728 - protein, 9 aa, Homo Sapiens
RQCCNAVKL

SEQ ID NO: 175729 - protein, 9 aa, Homo Sapiens
RHIQFDPFP

SEQ ID NO: 175730 - protein, 9 aa, Homo Sapiens
PLPPLPAPQ

SEQ ID NO: 175731 - protein, 9 aa, Homo Sapiens
TVELARKLQ

SEQ ID NO: 175732 - protein, 9 aa, Homo Sapiens
LTNGVTADN

SEQ ID NO: 175733 - protein, 9 aa, Homo Sapiens
DVDPLSGFV

SEQ ID NO: 175734 - protein, 9 aa, Homo Sapiens
AQRKQFPDA

SEQ ID NO: 175735 - protein, 9 aa, Homo Sapiens
HIHKKGRYT

SEQ ID NO: 175736 - protein, 9 aa, Homo Sapiens
AVKRPLPCV

SEQ ID NO: 175737 - protein, 9 aa, Homo Sapiens
TTLARVPAS

SEQ ID NO: 175738 - protein, 9 aa, Homo Sapiens
KMAALFLTT

SEQ ID NO: 175739 - protein, 9 aa, Homo Sapiens
GLKGPAASL

SEQ ID NO: 175740 - protein, 9 aa, Homo Sapiens
GRKDRRPCK

SEQ ID NO: 175741 - protein, 9 aa, Homo Sapiens
STKASNTIA

SEQ ID NO: 175742 - protein, 9 aa, Homo Sapiens
LGTRDAHQG

SEQ ID NO: 175743 - protein, 9 aa, Homo Sapiens
QQINQQQPQ

SEQ ID NO: 175744 - protein, 9 aa, Homo Sapiens
SPDNDNWLE

SEQ ID NO: 175745 - protein, 9 aa, Homo Sapiens
DGGGRRFCG

SEQ ID NO: 175746 - protein, 9 aa, Homo Sapiens
QPQHLGAGS

SEQ ID NO: 175747 - protein, 9 aa, Homo Sapiens
FPEVLVTLR

SEQ ID NO: 175748 - protein, 9 aa, Homo Sapiens
GLIVHRVDG

SEQ ID NO: 175749 - protein, 9 aa, Homo Sapiens
GFLPVSLRA

SEQ ID NO: 175750 - protein, 9 aa, Homo Sapiens
IITTKNSNI

SEQ ID NO: 175751 - protein, 9 aa, Homo Sapiens
PLLVFLELI

SEQ ID NO: 175752 - protein, 9 aa, Homo Sapiens
VETPNSSVS

SEQ ID NO: 175753 - protein, 9 aa, Homo Sapiens
ESVDLPSSR

SEQ ID NO: 175754 - protein, 9 aa, Homo Sapiens
SMHTKLYQE

SEQ ID NO: 175755 - protein, 9 aa, Homo Sapiens
LHQGRPPSS

SEQ ID NO: 175756 - protein, 9 aa, Homo Sapiens
TPTVCGVLD

SEQ ID NO: 175757 - protein, 9 aa, Homo Sapiens
FIEPPQYWI

SEQ ID NO: 175758 - protein, 9 aa, Homo Sapiens
TKTLNALHL

SEQ ID NO: 175759 - protein, 9 aa, Homo Sapiens
AKIVTPETP

SEQ ID NO: 175760 - protein, 9 aa, Homo Sapiens
WMAPPTPPS

SEQ ID NO: 175761 - protein, 9 aa, Homo Sapiens
CIWDPVLSV

SEQ ID NO: 175762 - protein, 9 aa, Homo Sapiens
ASSRPMRTA

SEQ ID NO: 175763 - protein, 9 aa, Homo Sapiens
ESQPILQLV

SEQ ID NO: 175764 - protein, 9 aa, Homo Sapiens
RTCLLTGYL

SEQ ID NO: 175765 - protein, 9 aa, Homo Sapiens
RDHPPSPTS

SEQ ID NO: 175766 - protein, 9 aa, Homo Sapiens
ILERKAKSH

SEQ ID NO: 175767 - protein, 9 aa, Homo Sapiens
MESTFSLDH

SEQ ID NO: 175768 - protein, 9 aa, Homo Sapiens
TSLQQKLDE

SEQ ID NO: 175769 - protein, 9 aa, Homo Sapiens
GDSEMFLLT

SEQ ID NO: 175770 - protein, 9 aa, Homo Sapiens
YNRELIYPK

SEQ ID NO: 175771 - protein, 9 aa, Homo Sapiens
KPPILQCSY

SEQ ID NO: 175772 - protein, 9 aa, Homo Sapiens
LLTQPSPAS

SEQ ID NO: 175773 - protein, 9 aa, Homo Sapiens
KHSTRGLLL

SEQ ID NO: 175774 - protein, 9 aa, Homo Sapiens
PNGSPTSDR

SEQ ID NO: 175775 - protein, 9 aa, Homo Sapiens
LLGFLVREE

SEQ ID NO: 175776 - protein, 9 aa, Homo Sapiens
CAATGYMCK

SEQ ID NO: 175777 - protein, 9 aa, Homo Sapiens
DAPSQPRGI

SEQ ID NO: 175778 - protein, 9 aa, Homo Sapiens
LKWYTPECI

SEQ ID NO: 175779 - protein, 9 aa, Homo Sapiens
GKWLYHPAL

SEQ ID NO: 175780 - protein, 9 aa, Homo Sapiens
ADDHFSVYI

SEQ ID NO: 175781 - protein, 9 aa, Homo Sapiens
WALYVHFNH

SEQ ID NO: 175782 - protein, 9 aa, Homo Sapiens
VLDFFSRSH

SEQ ID NO: 175783 - protein, 9 aa, Homo Sapiens
IQIEQLNRM

SEQ ID NO: 175784 - protein, 9 aa, Homo Sapiens
LDSNSSNSD

SEQ ID NO: 175785 - protein, 9 aa, Homo Sapiens
VCSHGDKLF

SEQ ID NO: 175786 - protein, 9 aa, Homo Sapiens
AGDRTRTEP

SEQ ID NO: 175787 - protein, 9 aa, Homo Sapiens
GHLKQLLSR

SEQ ID NO: 175788 - protein, 9 aa, Homo Sapiens
QASSWKMAA

SEQ ID NO: 175789 - protein, 9 aa, Homo Sapiens
YACKLLDHE

SEQ ID NO: 175790 - protein, 9 aa, Homo Sapiens
DFTAASGIS

SEQ ID NO: 175791 - protein, 9 aa, Homo Sapiens
AQSLEHEEV

SEQ ID NO: 175792 - protein, 9 aa, Homo Sapiens
MAATLTITE

SEQ ID NO: 175793 - protein, 9 aa, Homo Sapiens
QVPLLPQAR

SEQ ID NO: 175794 - protein, 9 aa, Homo Sapiens
FSPFFRTNQ

SEQ ID NO: 175795 - protein, 9 aa, Homo Sapiens
AQSNTTCKN

SEQ ID NO: 175796 - protein, 9 aa, Homo Sapiens
LKERLSYHH

SEQ ID NO: 175797 - protein, 9 aa, Homo Sapiens
KQDTVPPVP

SEQ ID NO: 175798 - protein, 9 aa, Homo Sapiens
IADLHPMGW

SEQ ID NO: 175799 - protein, 9 aa, Homo Sapiens
QEGGGIGRV

SEQ ID NO: 175800 - protein, 9 aa, Homo Sapiens
VPCIFEASR

SEQ ID NO: 175801 - protein, 9 aa, Homo Sapiens
ISSSVDPGL

SEQ ID NO: 175802 - protein, 9 aa, Homo Sapiens
FVGFFPELE

SEQ ID NO: 175803 - protein, 9 aa, Homo Sapiens
LQVEEQKQL

SEQ ID NO: 175804 - protein, 9 aa, Homo Sapiens
LRWWVDHLC

SEQ ID NO: 175805 - protein, 9 aa, Homo Sapiens
GWLKKAFCL

SEQ ID NO: 175806 - protein, 9 aa, Homo Sapiens
SQVWTAATL

SEQ ID NO: 175807 - protein, 9 aa, Homo Sapiens
FRDAVTLRY

SEQ ID NO: 175808 - protein, 9 aa, Homo Sapiens
QRMDCGRCD

SEQ ID NO: 175809 - protein, 9 aa, Homo Sapiens
LMRAYMQDP

SEQ ID NO: 175810 - protein, 9 aa, Homo Sapiens
ENDFADGEH

SEQ ID NO: 175811 - protein, 9 aa, Homo Sapiens
QVIKESDTS

SEQ ID NO: 175812 - protein, 9 aa, Homo Sapiens
TWTRLPRRS

SEQ ID NO: 175813 - protein, 9 aa, Homo Sapiens
IMAIICFIL

SEQ ID NO: 175814 - protein, 9 aa, Homo Sapiens
AAWEENVPK

SEQ ID NO: 175815 - protein, 9 aa, Homo Sapiens
LRQPPGQRV

SEQ ID NO: 175816 - protein, 9 aa, Homo Sapiens
KAMVKFQYL

SEQ ID NO: 175817 - protein, 9 aa, Homo Sapiens
IDTCLSVIA

SEQ ID NO: 175818 - protein, 9 aa, Homo Sapiens
GIPPTSRGS

SEQ ID NO: 175819 - protein, 9 aa, Homo Sapiens
PPTPPSVRT

SEQ ID NO: 175820 - protein, 9 aa, Homo Sapiens
DYEEEELWI

SEQ ID NO: 175821 - protein, 9 aa, Homo Sapiens
PLGVSRADM

SEQ ID NO: 175822 - protein, 9 aa, Homo Sapiens
RKKCCPYTK

SEQ ID NO: 175823 - protein, 9 aa, Homo Sapiens
RLSIPQWYH

SEQ ID NO: 175824 - protein, 9 aa, Homo Sapiens
ASREETAVC

SEQ ID NO: 175825 - protein, 9 aa, Homo Sapiens
HLHRFTRGR

SEQ ID NO: 175826 - protein, 9 aa, Homo Sapiens
VVAVATVET

SEQ ID NO: 175827 - protein, 9 aa, Homo Sapiens
HGRLPQESP

SEQ ID NO: 175828 - protein, 9 aa, Homo Sapiens
ARTLARPRL

SEQ ID NO: 175829 - protein, 9 aa, Homo Sapiens
TLTPAQLPT

SEQ ID NO: 175830 - protein, 9 aa, Homo Sapiens
APMQKPSAS

SEQ ID NO: 175831 - protein, 9 aa, Homo Sapiens
YEESDSCAL

SEQ ID NO: 175832 - protein, 9 aa, Homo Sapiens
SEHSFRIHF

SEQ ID NO: 175833 - protein, 9 aa, Homo Sapiens
TPGTGSCWT

SEQ ID NO: 175834 - protein, 9 aa, Homo Sapiens
DGSPSPLSE

SEQ ID NO: 175835 - protein, 9 aa, Homo Sapiens
AKVSREELN

SEQ ID NO: 175836 - protein, 9 aa, Homo Sapiens
TLVLRGMGA

SEQ ID NO: 175837 - protein, 9 aa, Homo Sapiens
AISVPYFER

SEQ ID NO: 175838 - protein, 9 aa, Homo Sapiens
CRRRCRPRT

SEQ ID NO: 175839 - protein, 9 aa, Homo Sapiens
SPLPSRLYV

SEQ ID NO: 175840 - protein, 9 aa, Homo Sapiens
GGTTCPPTS

SEQ ID NO: 175841 - protein, 9 aa, Homo Sapiens
FALGRRQVP

SEQ ID NO: 175842 - protein, 9 aa, Homo Sapiens
LCLLLVVGS

SEQ ID NO: 175843 - protein, 9 aa, Homo Sapiens
LARLPPAVG

SEQ ID NO: 175844 - protein, 9 aa, Homo Sapiens
AASLTPGPQ

SEQ ID NO: 175845 - protein, 9 aa, Homo Sapiens
GDLFVNELF

SEQ ID NO: 175846 - protein, 9 aa, Homo Sapiens
EDDDDDDDN

SEQ ID NO: 175847 - protein, 9 aa, Homo Sapiens
PTYFDIYTV

SEQ ID NO: 175848 - protein, 9 aa, Homo Sapiens
CVCEVTYDK

SEQ ID NO: 175849 - protein, 9 aa, Homo Sapiens
IRKAMVKFQ

SEQ ID NO: 175850 - protein, 9 aa, Homo Sapiens
NGLTSGPHC

SEQ ID NO: 175851 - protein, 9 aa, Homo Sapiens
IPPTSRGSS

SEQ ID NO: 175852 - protein, 9 aa, Homo Sapiens
RCIHQESEL

SEQ ID NO: 175853 - protein, 9 aa, Homo Sapiens
VPLLPQARP

SEQ ID NO: 175854 - protein, 9 aa, Homo Sapiens
MAIICFILL

SEQ ID NO: 175855 - protein, 9 aa, Homo Sapiens
LSNAPRSEI

SEQ ID NO: 175856 - protein, 9 aa, Homo Sapiens
ATGVRTSEG

SEQ ID NO: 175857 - protein, 9 aa, Homo Sapiens
LMPISTGPS

SEQ ID NO: 175858 - protein, 9 aa, Homo Sapiens
QIQSLQQAA

SEQ ID NO: 175859 - protein, 9 aa, Homo Sapiens
CDRHKVIAE

SEQ ID NO: 175860 - protein, 9 aa, Homo Sapiens
QLEWVSFNE

SEQ ID NO: 175861 - protein, 9 aa, Homo Sapiens
KQRKEFLCD

SEQ ID NO: 175862 - protein, 9 aa, Homo Sapiens
IWKVNITLL

SEQ ID NO: 175863 - protein, 9 aa, Homo Sapiens
ILTNIHGTS

SEQ ID NO: 175864 - protein, 9 aa, Homo Sapiens
RRWPWQGSL

SEQ ID NO: 175865 - protein, 9 aa, Homo Sapiens
MEEINTVLQ

SEQ ID NO: 175866 - protein, 9 aa, Homo Sapiens
AVLRVEEER

SEQ ID NO: 175867 - protein, 9 aa, Homo Sapiens
FPPSVSVAW

SEQ ID NO: 175868 - protein, 9 aa, Homo Sapiens
GPPRLLGPQ

SEQ ID NO: 175869 - protein, 9 aa, Homo Sapiens
MCGPPPLMP

SEQ ID NO: 175870 - protein, 9 aa, Homo Sapiens
GCSIDTDID

SEQ ID NO: 175871 - protein, 9 aa, Homo Sapiens
AQRVGQSRL

SEQ ID NO: 175872 - protein, 9 aa, Homo Sapiens
YPVPQHPPT

SEQ ID NO: 175873 - protein, 9 aa, Homo Sapiens
WYKFSGTTF

SEQ ID NO: 175874 - protein, 9 aa, Homo Sapiens
SLERGRGIR

SEQ ID NO: 175875 - protein, 9 aa, Homo Sapiens
GPTYGAWAS

SEQ ID NO: 175876 - protein, 9 aa, Homo Sapiens
QRQHHRAPG

SEQ ID NO: 175877 - protein, 9 aa, Homo Sapiens
APVLVLARA

SEQ ID NO: 175878 - protein, 9 aa, Homo Sapiens
RESWYSTAN

SEQ ID NO: 175879 - protein, 9 aa, Homo Sapiens
SNTTCKNPL

SEQ ID NO: 175880 - protein, 9 aa, Homo Sapiens
IGLQLLLVI

SEQ ID NO: 175881 - protein, 9 aa, Homo Sapiens
GDSHGREVT

SEQ ID NO: 175882 - protein, 9 aa, Homo Sapiens
MVVEVDSML

SEQ ID NO: 175883 - protein, 9 aa, Homo Sapiens
WKVNITLLD

SEQ ID NO: 175884 - protein, 9 aa, Homo Sapiens
NTHRRETLC

SEQ ID NO: 175885 - protein, 9 aa, Homo Sapiens
SPGTCFRCC

SEQ ID NO: 175886 - protein, 9 aa, Homo Sapiens
DTERNLRPL

SEQ ID NO: 175887 - protein, 9 aa, Homo Sapiens
SQHLPSTTG

SEQ ID NO: 175888 - protein, 9 aa, Homo Sapiens
APYLTSWAS

SEQ ID NO: 175889 - protein, 9 aa, Homo Sapiens
NCWVYDRAR

SEQ ID NO: 175890 - protein, 9 aa, Homo Sapiens
QDPLFVEFA

SEQ ID NO: 175891 - protein, 9 aa, Homo Sapiens
NYLFWHMKD

SEQ ID NO: 175892 - protein, 9 aa, Homo Sapiens
ALCIPLLIT

SEQ ID NO: 175893 - protein, 9 aa, Homo Sapiens
MAPERIDPQ

SEQ ID NO: 175894 - protein, 9 aa, Homo Sapiens
SSPCCPATC

SEQ ID NO: 175895 - protein, 9 aa, Homo Sapiens
MDSQDTLDR

SEQ ID NO: 175896 - protein, 9 aa, Homo Sapiens
LESVDLPSS

SEQ ID NO: 175897 - protein, 9 aa, Homo Sapiens
IHHVDAHAT

SEQ ID NO: 175898 - protein, 9 aa, Homo Sapiens
TGRGLRQRR

SEQ ID NO: 175899 - protein, 9 aa, Homo Sapiens
DALDNIYDA

SEQ ID NO: 175900 - protein, 9 aa, Homo Sapiens
PPQTALGHR

SEQ ID NO: 175901 - protein, 9 aa, Homo Sapiens
SCTSEDKVA

SEQ ID NO: 175902 - protein, 9 aa, Homo Sapiens
SSSVDPGLE

SEQ ID NO: 175903 - protein, 9 aa, Homo Sapiens
HLHHGWASV

SEQ ID NO: 175904 - protein, 9 aa, Homo Sapiens
CPAADNPTP

SEQ ID NO: 175905 - protein, 9 aa, Homo Sapiens
DICRCHRMS

SEQ ID NO: 175906 - protein, 9 aa, Homo Sapiens
TETIHLMAL

SEQ ID NO: 175907 - protein, 9 aa, Homo Sapiens
RCKLYCQVT

SEQ ID NO: 175908 - protein, 9 aa, Homo Sapiens
DAPPKKKIK

SEQ ID NO: 175909 - protein, 9 aa, Homo Sapiens
NRQCDTVVE

SEQ ID NO: 175910 - protein, 9 aa, Homo Sapiens
SHHVRPFFF

SEQ ID NO: 175911 - protein, 9 aa, Homo Sapiens
FITNETGQQ

SEQ ID NO: 175912 - protein, 9 aa, Homo Sapiens
DTHNGSVGK

SEQ ID NO: 175913 - protein, 9 aa, Homo Sapiens
FSYHLQGRM

SEQ ID NO: 175914 - protein, 9 aa, Homo Sapiens
SPPRHIQFD

SEQ ID NO: 175915 - protein, 9 aa, Homo Sapiens
QEKSSGRTT

SEQ ID NO: 175916 - protein, 9 aa, Homo Sapiens
ADTGHTAKI

SEQ ID NO: 175917 - protein, 9 aa, Homo Sapiens
ESCSVPMTG

SEQ ID NO: 175918 - protein, 9 aa, Homo Sapiens
FHANLQRQV

SEQ ID NO: 175919 - protein, 9 aa, Homo Sapiens
LHRTTNPHS

SEQ ID NO: 175920 - protein, 9 aa, Homo Sapiens
YYFMGPGIL

SEQ ID NO: 175921 - protein, 9 aa, Homo Sapiens
EEWYERALQ

SEQ ID NO: 175922 - protein, 9 aa, Homo Sapiens
EVKTKGMAT

SEQ ID NO: 175923 - protein, 9 aa, Homo Sapiens
ASYRHLCLR

SEQ ID NO: 175924 - protein, 9 aa, Homo Sapiens
CADVLRWWV

SEQ ID NO: 175925 - protein, 9 aa, Homo Sapiens
RPSAQRPMI

SEQ ID NO: 175926 - protein, 9 aa, Homo Sapiens
FSEWVCLKT

SEQ ID NO: 175927 - protein, 9 aa, Homo Sapiens
SVFICTHVY

SEQ ID NO: 175928 - protein, 9 aa, Homo Sapiens
ARSTRKKCC

SEQ ID NO: 175929 - protein, 9 aa, Homo Sapiens
IFTSSTNGC

SEQ ID NO: 175930 - protein, 9 aa, Homo Sapiens
AGGGPPGAL

SEQ ID NO: 175931 - protein, 9 aa, Homo Sapiens
TVPTETIHL

SEQ ID NO: 175932 - protein, 9 aa, Homo Sapiens
MHLEIYQSS

SEQ ID NO: 175933 - protein, 9 aa, Homo Sapiens
GIKKEDSTV

SEQ ID NO: 175934 - protein, 9 aa, Homo Sapiens
LLLRPTGPL

SEQ ID NO: 175935 - protein, 9 aa, Homo Sapiens
GQGWEDRTK

SEQ ID NO: 175936 - protein, 9 aa, Homo Sapiens
DVAGPRQQK

SEQ ID NO: 175937 - protein, 9 aa, Homo Sapiens
NQQQPQQQL

SEQ ID NO: 175938 - protein, 9 aa, Homo Sapiens
EGRFSLDRE

SEQ ID NO: 175939 - protein, 9 aa, Homo Sapiens
TKSMWSSPS

SEQ ID NO: 175940 - protein, 9 aa, Homo Sapiens
GLAASFAVS

SEQ ID NO: 175941 - protein, 9 aa, Homo Sapiens
SAAHLYYYW

SEQ ID NO: 175942 - protein, 9 aa, Homo Sapiens
KVFKPKGAN

SEQ ID NO: 175943 - protein, 9 aa, Homo Sapiens
TTAAMAYGL

SEQ ID NO: 175944 - protein, 9 aa, Homo Sapiens
HITEVGLEG

SEQ ID NO: 175945 - protein, 9 aa, Homo Sapiens
SPGACRPAC

SEQ ID NO: 175946 - protein, 9 aa, Homo Sapiens
KPWLAICWR

SEQ ID NO: 175947 - protein, 9 aa, Homo Sapiens
RLDMLKTKQ

SEQ ID NO: 175948 - protein, 9 aa, Homo Sapiens
SLSWGTALM

SEQ ID NO: 175949 - protein, 9 aa, Homo Sapiens
AIRIVNAAG

SEQ ID NO: 175950 - protein, 9 aa, Homo Sapiens
MELLESERK

SEQ ID NO: 175951 - protein, 9 aa, Homo Sapiens
PEAAVTLKW

SEQ ID NO: 175952 - protein, 9 aa, Homo Sapiens
TSRARQSCC

SEQ ID NO: 175953 - protein, 9 aa, Homo Sapiens
KRLKEEQTW

SEQ ID NO: 175954 - protein, 9 aa, Homo Sapiens
LGSCCTATV

SEQ ID NO: 175955 - protein, 9 aa, Homo Sapiens
NVQGACKIC

SEQ ID NO: 175956 - protein, 9 aa, Homo Sapiens
PGGRHVGTK

SEQ ID NO: 175957 - protein, 9 aa, Homo Sapiens
GLSKRTPQQ

SEQ ID NO: 175958 - protein, 9 aa, Homo Sapiens
HMQSGLWVC

SEQ ID NO: 175959 - protein, 9 aa, Homo Sapiens
AVQPGHLVV

SEQ ID NO: 175960 - protein, 9 aa, Homo Sapiens
STAWFWVRD

SEQ ID NO: 175961 - protein, 9 aa, Homo Sapiens
RCPHLRAVL

SEQ ID NO: 175962 - protein, 9 aa, Homo Sapiens
HDGLSRGCA

SEQ ID NO: 175963 - protein, 9 aa, Homo Sapiens
KPDVDHVEG

SEQ ID NO: 175964 - protein, 9 aa, Homo Sapiens
RPGAPEYNR

SEQ ID NO: 175965 - protein, 9 aa, Homo Sapiens
YSVSLEWVM

SEQ ID NO: 175966 - protein, 9 aa, Homo Sapiens
PTYGAWASR

SEQ ID NO: 175967 - protein, 9 aa, Homo Sapiens
EKLCAGAPY

SEQ ID NO: 175968 - protein, 9 aa, Homo Sapiens
NKRHHPIGI

SEQ ID NO: 175969 - protein, 9 aa, Homo Sapiens
FANTVVHEL

SEQ ID NO: 175970 - protein, 9 aa, Homo Sapiens
SMLAASSVK

SEQ ID NO: 175971 - protein, 9 aa, Homo Sapiens
TSCGSCPRS

SEQ ID NO: 175972 - protein, 9 aa, Homo Sapiens
FGMAIVGNY

SEQ ID NO: 175973 - protein, 9 aa, Homo Sapiens
GDIWDVNTN

SEQ ID NO: 175974 - protein, 9 aa, Homo Sapiens
FRETPPWSG

SEQ ID NO: 175975 - protein, 9 aa, Homo Sapiens
DIILKKCPT

SEQ ID NO: 175976 - protein, 9 aa, Homo Sapiens
ASRSPHRRV

SEQ ID NO: 175977 - protein, 9 aa, Homo Sapiens
ALGGPGGLQ

SEQ ID NO: 175978 - protein, 9 aa, Homo Sapiens
SCVSTPGPA

SEQ ID NO: 175979 - protein, 9 aa, Homo Sapiens
VYDRARRPH

SEQ ID NO: 175980 - protein, 9 aa, Homo Sapiens
SPAGRNHCR

SEQ ID NO: 175981 - protein, 9 aa, Homo Sapiens
AKGMLNGEK

SEQ ID NO: 175982 - protein, 9 aa, Homo Sapiens
SRLYVPPPL

SEQ ID NO: 175983 - protein, 9 aa, Homo Sapiens
CILSTKASN

SEQ ID NO: 175984 - protein, 9 aa, Homo Sapiens
TYGAWASRW

SEQ ID NO: 175985 - protein, 9 aa, Homo Sapiens
DDYWGATGV

SEQ ID NO: 175986 - protein, 9 aa, Homo Sapiens
PRAVLIPSS

SEQ ID NO: 175987 - protein, 9 aa, Homo Sapiens
LVSDMDMDA

SEQ ID NO: 175988 - protein, 9 aa, Homo Sapiens
YAALLKRGE

SEQ ID NO: 175989 - protein, 9 aa, Homo Sapiens
EVNALRQPL

SEQ ID NO: 175990 - protein, 9 aa, Homo Sapiens
KTELIPNKK

SEQ ID NO: 175991 - protein, 9 aa, Homo Sapiens
LYVHFNHSL

SEQ ID NO: 175992 - protein, 9 aa, Homo Sapiens
EMDISKKSI

SEQ ID NO: 175993 - protein, 9 aa, Homo Sapiens
VFCLLGTFR

SEQ ID NO: 175994 - protein, 9 aa, Homo Sapiens
HTKIHHVDA

SEQ ID NO: 175995 - protein, 9 aa, Homo Sapiens
QVMQLQEDA

SEQ ID NO: 175996 - protein, 9 aa, Homo Sapiens
PVARCQTLL

SEQ ID NO: 175997 - protein, 9 aa, Homo Sapiens
NDLRHLPDV

SEQ ID NO: 175998 - protein, 9 aa, Homo Sapiens
LPLNSHMCT

SEQ ID NO: 175999 - protein, 9 aa, Homo Sapiens
HSAAPSTLD

SEQ ID NO: 176000 - protein, 9 aa, Homo Sapiens
ESERAKLDE

SEQ ID NO: 176001 - protein, 9 aa, Homo Sapiens
HTQHGIREG

SEQ ID NO: 176002 - protein, 9 aa, Homo Sapiens
LTISGHEVV

SEQ ID NO: 176003 - protein, 9 aa, Homo Sapiens
DHTQREPLS

SEQ ID NO: 176004 - protein, 9 aa, Homo Sapiens
NFNWCFLFP

SEQ ID NO: 176005 - protein, 9 aa, Homo Sapiens
KLNAMKKDK

SEQ ID NO: 176006 - protein, 9 aa, Homo Sapiens
NCSSTSCGS

SEQ ID NO: 176007 - protein, 9 aa, Homo Sapiens
NNLMPPGKN

SEQ ID NO: 176008 - protein, 9 aa, Homo Sapiens
RCVRITSTG

SEQ ID NO: 176009 - protein, 9 aa, Homo Sapiens
GLVAGVGLA

SEQ ID NO: 176010 - protein, 9 aa, Homo Sapiens
HAEFPTGLI

SEQ ID NO: 176011 - protein, 9 aa, Homo Sapiens
SRTMTSGPT

SEQ ID NO: 176012 - protein, 9 aa, Homo Sapiens
RGTTRNCSS

SEQ ID NO: 176013 - protein, 9 aa, Homo Sapiens
RPLLQGHFR

SEQ ID NO: 176014 - protein, 9 aa, Homo Sapiens
GGDRSRGAM

SEQ ID NO: 176015 - protein, 9 aa, Homo Sapiens
PERPRSQRS

SEQ ID NO: 176016 - protein, 9 aa, Homo Sapiens
DLVDSKGMD

SEQ ID NO: 176017 - protein, 9 aa, Homo Sapiens
QQEISVVHI

SEQ ID NO: 176018 - protein, 9 aa, Homo Sapiens
FLYMWSFCF

SEQ ID NO: 176019 - protein, 9 aa, Homo Sapiens
KHEPFWEDE

SEQ ID NO: 176020 - protein, 9 aa, Homo Sapiens
VFICTHVYI

SEQ ID NO: 176021 - protein, 9 aa, Homo Sapiens
AHCPANGAG

SEQ ID NO: 176022 - protein, 9 aa, Homo Sapiens
MLKKRSSKV

SEQ ID NO: 176023 - protein, 9 aa, Homo Sapiens
LRCQRERGR

SEQ ID NO: 176024 - protein, 9 aa, Homo Sapiens
TAVCRLLLG

SEQ ID NO: 176025 - protein, 9 aa, Homo Sapiens
WLGLAAGAV

SEQ ID NO: 176026 - protein, 9 aa, Homo Sapiens
SCAGADKGN

SEQ ID NO: 176027 - protein, 9 aa, Homo Sapiens
CKIGIMPDH

SEQ ID NO: 176028 - protein, 9 aa, Homo Sapiens
ISVSGSFAE

SEQ ID NO: 176029 - protein, 9 aa, Homo Sapiens
VSFTFSKKC

SEQ ID NO: 176030 - protein, 9 aa, Homo Sapiens
YAWDAWLKE

SEQ ID NO: 176031 - protein, 9 aa, Homo Sapiens
KEGLPKEKT

SEQ ID NO: 176032 - protein, 9 aa, Homo Sapiens
LKKRSSKVM

SEQ ID NO: 176033 - protein, 9 aa, Homo Sapiens
KKKKRERTR

SEQ ID NO: 176034 - protein, 9 aa, Homo Sapiens
MNGNVITAD

SEQ ID NO: 176035 - protein, 9 aa, Homo Sapiens
RAVKRPLPC

SEQ ID NO: 176036 - protein, 9 aa, Homo Sapiens
CICPPGMRP

SEQ ID NO: 176037 - protein, 9 aa, Homo Sapiens
RWWPSWSPA

SEQ ID NO: 176038 - protein, 9 aa, Homo Sapiens
AGGGLRCTA

SEQ ID NO: 176039 - protein, 9 aa, Homo Sapiens
PRLCATTTC

SEQ ID NO: 176040 - protein, 9 aa, Homo Sapiens
HVVSEFEDS

SEQ ID NO: 176041 - protein, 9 aa, Homo Sapiens
GGDIWDVNT

SEQ ID NO: 176042 - protein, 9 aa, Homo Sapiens
QRRGRCINL

SEQ ID NO: 176043 - protein, 9 aa, Homo Sapiens
VCSWPLSSP

SEQ ID NO: 176044 - protein, 9 aa, Homo Sapiens
YGDLPKIKK

SEQ ID NO: 176045 - protein, 9 aa, Homo Sapiens
ALTPPHPAR

SEQ ID NO: 176046 - protein, 9 aa, Homo Sapiens
PTGPLLCLG

SEQ ID NO: 176047 - protein, 9 aa, Homo Sapiens
WYHVMVKAS

SEQ ID NO: 176048 - protein, 9 aa, Homo Sapiens
KGEAQRCPH

SEQ ID NO: 176049 - protein, 9 aa, Homo Sapiens
TNETGQQLI

SEQ ID NO: 176050 - protein, 9 aa, Homo Sapiens
KTGRAPRVW

SEQ ID NO: 176051 - protein, 9 aa, Homo Sapiens
IVHLFEWQW

SEQ ID NO: 176052 - protein, 9 aa, Homo Sapiens
ITIPRKTSA

SEQ ID NO: 176053 - protein, 9 aa, Homo Sapiens
LGLQWGRRR

SEQ ID NO: 176054 - protein, 9 aa, Homo Sapiens
RAVLESWQR

SEQ ID NO: 176055 - protein, 9 aa, Homo Sapiens
EPKVLFAKE

SEQ ID NO: 176056 - protein, 9 aa, Homo Sapiens
PKKKKRKRE

SEQ ID NO: 176057 - protein, 9 aa, Homo Sapiens
LYGLKREED

SEQ ID NO: 176058 - protein, 9 aa, Homo Sapiens
VFQLKKTGA

SEQ ID NO: 176059 - protein, 9 aa, Homo Sapiens
KLGGSNILM

SEQ ID NO: 176060 - protein, 9 aa, Homo Sapiens
EKWGYPRAI

SEQ ID NO: 176061 - protein, 9 aa, Homo Sapiens
DTPGTSNGA

SEQ ID NO: 176062 - protein, 9 aa, Homo Sapiens
GPYSSLDVS

SEQ ID NO: 176063 - protein, 9 aa, Homo Sapiens
CGEVFSEWV

SEQ ID NO: 176064 - protein, 9 aa, Homo Sapiens
ANYENQKWL

SEQ ID NO: 176065 - protein, 9 aa, Homo Sapiens
RWDPCMPSC

SEQ ID NO: 176066 - protein, 9 aa, Homo Sapiens
RQRAPLNWH

SEQ ID NO: 176067 - protein, 9 aa, Homo Sapiens
LTTTSRKSR

SEQ ID NO: 176068 - protein, 9 aa, Homo Sapiens
HPRRESQVW

SEQ ID NO: 176069 - protein, 9 aa, Homo Sapiens
ENISSRTRV

SEQ ID NO: 176070 - protein, 9 aa, Homo Sapiens
TLEDIQSSP

SEQ ID NO: 176071 - protein, 9 aa, Homo Sapiens
RRRPCASCP

SEQ ID NO: 176072 - protein, 9 aa, Homo Sapiens
HRPSLRPRS

SEQ ID NO: 176073 - protein, 9 aa, Homo Sapiens
ERDDDVPVD

SEQ ID NO: 176074 - protein, 9 aa, Homo Sapiens
AMKKDKDKT

SEQ ID NO: 176075 - protein, 9 aa, Homo Sapiens
VPHWGPSWA

SEQ ID NO: 176076 - protein, 9 aa, Homo Sapiens
KHKPQPPVM

SEQ ID NO: 176077 - protein, 9 aa, Homo Sapiens
ELCLPPQTL

SEQ ID NO: 176078 - protein, 9 aa, Homo Sapiens
KEGIPPTSR

SEQ ID NO: 176079 - protein, 9 aa, Homo Sapiens
QGNGKWRLT

SEQ ID NO: 176080 - protein, 9 aa, Homo Sapiens
DMMCARGPG

SEQ ID NO: 176081 - protein, 9 aa, Homo Sapiens
SRPGSPALC

SEQ ID NO: 176082 - protein, 9 aa, Homo Sapiens
LPINIITIT

SEQ ID NO: 176083 - protein, 9 aa, Homo Sapiens
GKYFWPQIT

SEQ ID NO: 176084 - protein, 9 aa, Homo Sapiens
LVLLFVAVR

SEQ ID NO: 176085 - protein, 9 aa, Homo Sapiens
ALLLQRCCQ

SEQ ID NO: 176086 - protein, 9 aa, Homo Sapiens
GYSLHRPDE

SEQ ID NO: 176087 - protein, 9 aa, Homo Sapiens
AAPVLVLAR

SEQ ID NO: 176088 - protein, 9 aa, Homo Sapiens
CLQRLIRKA

SEQ ID NO: 176089 - protein, 9 aa, Homo Sapiens
RTTLPKSSR

SEQ ID NO: 176090 - protein, 9 aa, Homo Sapiens
TGKGFIHNP

SEQ ID NO: 176091 - protein, 9 aa, Homo Sapiens
QRQKNCELA

SEQ ID NO: 176092 - protein, 9 aa, Homo Sapiens
DDINCGPTW

SEQ ID NO: 176093 - protein, 9 aa, Homo Sapiens
HGINLTISG

SEQ ID NO: 176094 - protein, 9 aa, Homo Sapiens
DQLTPHSQV

SEQ ID NO: 176095 - protein, 9 aa, Homo Sapiens
EPNGLAPNG

SEQ ID NO: 176096 - protein, 9 aa, Homo Sapiens
DGQCYALLQ

SEQ ID NO: 176097 - protein, 9 aa, Homo Sapiens
QCDRHKVIA

SEQ ID NO: 176098 - protein, 9 aa, Homo Sapiens
RRRKLKTIN

SEQ ID NO: 176099 - protein, 9 aa, Homo Sapiens
HCQPRSPGV

SEQ ID NO: 176100 - protein, 9 aa, Homo Sapiens
MSVHAQLAE

SEQ ID NO: 176101 - protein, 9 aa, Homo Sapiens
HVTMLQRQG

SEQ ID NO: 176102 - protein, 9 aa, Homo Sapiens
GLWFRLFHT

SEQ ID NO: 176103 - protein, 9 aa, Homo Sapiens
TGNEEAYGC

SEQ ID NO: 176104 - protein, 9 aa, Homo Sapiens
HQGRPPSSP

SEQ ID NO: 176105 - protein, 9 aa, Homo Sapiens
GGVACRQRC

SEQ ID NO: 176106 - protein, 9 aa, Homo Sapiens
PLRWAASGG

SEQ ID NO: 176107 - protein, 9 aa, Homo Sapiens
DYQTAEETA

SEQ ID NO: 176108 - protein, 9 aa, Homo Sapiens
KSVGLLPPQ

SEQ ID NO: 176109 - protein, 9 aa, Homo Sapiens
RAQPVIREP

SEQ ID NO: 176110 - protein, 9 aa, Homo Sapiens
SWSPAASNT

SEQ ID NO: 176111 - protein, 9 aa, Homo Sapiens
GQGQPGSQL

SEQ ID NO: 176112 - protein, 9 aa, Homo Sapiens
SMSTWTPGT

SEQ ID NO: 176113 - protein, 9 aa, Homo Sapiens
RQRVCGLEE

SEQ ID NO: 176114 - protein, 9 aa, Homo Sapiens
PWQVMASLT

SEQ ID NO: 176115 - protein, 9 aa, Homo Sapiens
PKHTEAKKA

SEQ ID NO: 176116 - protein, 9 aa, Homo Sapiens
MLKTKQRDL

SEQ ID NO: 176117 - protein, 9 aa, Homo Sapiens
VFCWHIHKK

SEQ ID NO: 176118 - protein, 9 aa, Homo Sapiens
CNAVKLVAI

SEQ ID NO: 176119 - protein, 9 aa, Homo Sapiens
MYMARGLFE

SEQ ID NO: 176120 - protein, 9 aa, Homo Sapiens
MAKGEGAER

SEQ ID NO: 176121 - protein, 9 aa, Homo Sapiens
LDALELRDV

SEQ ID NO: 176122 - protein, 9 aa, Homo Sapiens
GYDGHSRLS

SEQ ID NO: 176123 - protein, 9 aa, Homo Sapiens
RQVPLLPKA

SEQ ID NO: 176124 - protein, 9 aa, Homo Sapiens
LQLLATQSS

SEQ ID NO: 176125 - protein, 9 aa, Homo Sapiens
EGPTSPRGC

SEQ ID NO: 176126 - protein, 9 aa, Homo Sapiens
SGIPTRAKK

SEQ ID NO: 176127 - protein, 9 aa, Homo Sapiens
DTIFLNMRG

SEQ ID NO: 176128 - protein, 9 aa, Homo Sapiens
TTQENDMEV

SEQ ID NO: 176129 - protein, 9 aa, Homo Sapiens
NSESESDIF

SEQ ID NO: 176130 - protein, 9 aa, Homo Sapiens
CKLYCQVTG

SEQ ID NO: 176131 - protein, 9 aa, Homo Sapiens
LTNIHGTSN

SEQ ID NO: 176132 - protein, 9 aa, Homo Sapiens
RSSPKSYRK

SEQ ID NO: 176133 - protein, 9 aa, Homo Sapiens
FSYSWPRVP

SEQ ID NO: 176134 - protein, 9 aa, Homo Sapiens
EDTNFPLRP

SEQ ID NO: 176135 - protein, 9 aa, Homo Sapiens
VCLCTIFLV

SEQ ID NO: 176136 - protein, 9 aa, Homo Sapiens
PVRHLHQQP

SEQ ID NO: 176137 - protein, 9 aa, Homo Sapiens
KWLEKLLRH

SEQ ID NO: 176138 - protein, 9 aa, Homo Sapiens
ECASVSSVL

SEQ ID NO: 176139 - protein, 9 aa, Homo Sapiens
SSSMRTSSS

SEQ ID NO: 176140 - protein, 9 aa, Homo Sapiens
ELQARGKKQ

SEQ ID NO: 176141 - protein, 9 aa, Homo Sapiens
RLLGPQVGP

SEQ ID NO: 176142 - protein, 9 aa, Homo Sapiens
WGQMQTTSA

SEQ ID NO: 176143 - protein, 9 aa, Homo Sapiens
AYKTTWGRW

SEQ ID NO: 176144 - protein, 9 aa, Homo Sapiens
SYLNTASSS

SEQ ID NO: 176145 - protein, 9 aa, Homo Sapiens
SEELCLPPQ

SEQ ID NO: 176146 - protein, 9 aa, Homo Sapiens
VLHGKPDVD

SEQ ID NO: 176147 - protein, 9 aa, Homo Sapiens
YEVYGGEMR

SEQ ID NO: 176148 - protein, 9 aa, Homo Sapiens
KSERKKKSV

SEQ ID NO: 176149 - protein, 9 aa, Homo Sapiens
QKICYLPLN

SEQ ID NO: 176150 - protein, 9 aa, Homo Sapiens
NESMKECRN

SEQ ID NO: 176151 - protein, 9 aa, Homo Sapiens
RGSQVAGDP

SEQ ID NO: 176152 - protein, 9 aa, Homo Sapiens
RHIQVPQDS

SEQ ID NO: 176153 - protein, 9 aa, Homo Sapiens
DGPLLPEPG

SEQ ID NO: 176154 - protein, 9 aa, Homo Sapiens
ANVPIILWL

SEQ ID NO: 176155 - protein, 9 aa, Homo Sapiens
TQTGKGFIH

SEQ ID NO: 176156 - protein, 9 aa, Homo Sapiens
SLRAHSTLQ

SEQ ID NO: 176157 - protein, 9 aa, Homo Sapiens
ICQKWPFIV

SEQ ID NO: 176158 - protein, 9 aa, Homo Sapiens
VHTGLHPYQ

SEQ ID NO: 176159 - protein, 9 aa, Homo Sapiens
DQTETAPGC

SEQ ID NO: 176160 - protein, 9 aa, Homo Sapiens
QQKGWFPAS

SEQ ID NO: 176161 - protein, 9 aa, Homo Sapiens
TLKKTRGQG

SEQ ID NO: 176162 - protein, 9 aa, Homo Sapiens
LGAGASAPL

SEQ ID NO: 176163 - protein, 9 aa, Homo Sapiens
QRIIKMIWI

SEQ ID NO: 176164 - protein, 9 aa, Homo Sapiens
AVATVETEV

SEQ ID NO: 176165 - protein, 9 aa, Homo Sapiens
KRQTVAMEL

SEQ ID NO: 176166 - protein, 9 aa, Homo Sapiens
SKRFHSTFD

SEQ ID NO: 176167 - protein, 9 aa, Homo Sapiens
QLTKISLPK

SEQ ID NO: 176168 - protein, 9 aa, Homo Sapiens
KRGVDINVE

SEQ ID NO: 176169 - protein, 9 aa, Homo Sapiens
LFLGGLIAG

SEQ ID NO: 176170 - protein, 9 aa, Homo Sapiens
TLARPRLPR

SEQ ID NO: 176171 - protein, 9 aa, Homo Sapiens
PTIATGKGP

SEQ ID NO: 176172 - protein, 9 aa, Homo Sapiens
PSTAPVCGK

SEQ ID NO: 176173 - protein, 9 aa, Homo Sapiens
PPAELPPAA

SEQ ID NO: 176174 - protein, 9 aa, Homo Sapiens
YFQLKANTG

SEQ ID NO: 176175 - protein, 9 aa, Homo Sapiens
VRQMLSNAP

SEQ ID NO: 176176 - protein, 9 aa, Homo Sapiens
PRRKSSPTS

SEQ ID NO: 176177 - protein, 9 aa, Homo Sapiens
HVVAKVRTV

SEQ ID NO: 176178 - protein, 9 aa, Homo Sapiens
TRTRAAMAP

SEQ ID NO: 176179 - protein, 9 aa, Homo Sapiens
DTPPEARGN

SEQ ID NO: 176180 - protein, 9 aa, Homo Sapiens
LSSFLIFFI

SEQ ID NO: 176181 - protein, 9 aa, Homo Sapiens
CSQAPGDSH

SEQ ID NO: 176182 - protein, 9 aa, Homo Sapiens
VDWPGWYKF

SEQ ID NO: 176183 - protein, 9 aa, Homo Sapiens
RRTSMEGTH

SEQ ID NO: 176184 - protein, 9 aa, Homo Sapiens
SDPRNGMDR

SEQ ID NO: 176185 - protein, 9 aa, Homo Sapiens
TAAVGAAPA

SEQ ID NO: 176186 - protein, 9 aa, Homo Sapiens
RGEIHGDIF

SEQ ID NO: 176187 - protein, 9 aa, Homo Sapiens
RRSSWQKGQ

SEQ ID NO: 176188 - protein, 9 aa, Homo Sapiens
VVEHLKAQL

SEQ ID NO: 176189 - protein, 9 aa, Homo Sapiens
SRRARQFAQ

SEQ ID NO: 176190 - protein, 9 aa, Homo Sapiens
PRLPRHCLH

SEQ ID NO: 176191 - protein, 9 aa, Homo Sapiens
ARGKKQQKG

SEQ ID NO: 176192 - protein, 9 aa, Homo Sapiens
TTTEMISAT

SEQ ID NO: 176193 - protein, 9 aa, Homo Sapiens
RAVLIPSSL

SEQ ID NO: 176194 - protein, 9 aa, Homo Sapiens
GGPPRPTVA

SEQ ID NO: 176195 - protein, 9 aa, Homo Sapiens
PRPHTPSPE

SEQ ID NO: 176196 - protein, 9 aa, Homo Sapiens
TLPDLPRRK

SEQ ID NO: 176197 - protein, 9 aa, Homo Sapiens
THKLTFHEN

SEQ ID NO: 176198 - protein, 9 aa, Homo Sapiens
LLLDMFHQG

SEQ ID NO: 176199 - protein, 9 aa, Homo Sapiens
APQARQGAE

SEQ ID NO: 176200 - protein, 9 aa, Homo Sapiens
RNHCRQLQG

SEQ ID NO: 176201 - protein, 9 aa, Homo Sapiens
ALVGARAAR

SEQ ID NO: 176202 - protein, 9 aa, Homo Sapiens
QQGTQQMYE

SEQ ID NO: 176203 - protein, 9 aa, Homo Sapiens
VLHCLLTTM

SEQ ID NO: 176204 - protein, 9 aa, Homo Sapiens
FFFCNMATV

SEQ ID NO: 176205 - protein, 9 aa, Homo Sapiens
DTYFGCLLG

SEQ ID NO: 176206 - protein, 9 aa, Homo Sapiens
ASSHPASAI

SEQ ID NO: 176207 - protein, 9 aa, Homo Sapiens
WLLEAPDGQ

SEQ ID NO: 176208 - protein, 9 aa, Homo Sapiens
WWIVQNSFL

SEQ ID NO: 176209 - protein, 9 aa, Homo Sapiens
NTQQPLTKK

SEQ ID NO: 176210 - protein, 9 aa, Homo Sapiens
KQMASMLKG

SEQ ID NO: 176211 - protein, 9 aa, Homo Sapiens
EFEDSYFEE

SEQ ID NO: 176212 - protein, 9 aa, Homo Sapiens
ADPLNRRTI

SEQ ID NO: 176213 - protein, 9 aa, Homo Sapiens
APLNWHMKK

SEQ ID NO: 176214 - protein, 9 aa, Homo Sapiens
TVTKWTIDE

SEQ ID NO: 176215 - protein, 9 aa, Homo Sapiens
QTRWCWSLW

SEQ ID NO: 176216 - protein, 9 aa, Homo Sapiens
PRSKHPTGE

SEQ ID NO: 176217 - protein, 9 aa, Homo Sapiens
TSDLCVQWC

SEQ ID NO: 176218 - protein, 9 aa, Homo Sapiens
GGERVAPEQ

SEQ ID NO: 176219 - protein, 9 aa, Homo Sapiens
HTRQLESVH

SEQ ID NO: 176220 - protein, 9 aa, Homo Sapiens
ALRRNDTEN

SEQ ID NO: 176221 - protein, 9 aa, Homo Sapiens
PTSRARQSC

SEQ ID NO: 176222 - protein, 9 aa, Homo Sapiens
LAVQPRAKP

SEQ ID NO: 176223 - protein, 9 aa, Homo Sapiens
SATQASMTL

SEQ ID NO: 176224 - protein, 9 aa, Homo Sapiens
NTAQRLRRA

SEQ ID NO: 176225 - protein, 9 aa, Homo Sapiens
LPELKEKKI

SEQ ID NO: 176226 - protein, 9 aa, Homo Sapiens
GVTADNGDD

SEQ ID NO: 176227 - protein, 9 aa, Homo Sapiens
ELIYPKVLD

SEQ ID NO: 176228 - protein, 9 aa, Homo Sapiens
SPAMSCTFR

SEQ ID NO: 176229 - protein, 9 aa, Homo Sapiens
RESQVWQLA

SEQ ID NO: 176230 - protein, 9 aa, Homo Sapiens
DGTPIITFP

SEQ ID NO: 176231 - protein, 9 aa, Homo Sapiens
NGNVITADQ

SEQ ID NO: 176232 - protein, 9 aa, Homo Sapiens
CLPAATQKT

SEQ ID NO: 176233 - protein, 9 aa, Homo Sapiens
KLQMPRSPH

SEQ ID NO: 176234 - protein, 9 aa, Homo Sapiens
QRRQGPAPQ

SEQ ID NO: 176235 - protein, 9 aa, Homo Sapiens
PPKCPPKYP

SEQ ID NO: 176236 - protein, 9 aa, Homo Sapiens
MAGLNTIQT

SEQ ID NO: 176237 - protein, 9 aa, Homo Sapiens
PSRAHCPAN

SEQ ID NO: 176238 - protein, 9 aa, Homo Sapiens
MGPTWGRPT

SEQ ID NO: 176239 - protein, 9 aa, Homo Sapiens
EHAGWYRCY

SEQ ID NO: 176240 - protein, 9 aa, Homo Sapiens
LKEKKLRLA

SEQ ID NO: 176241 - protein, 9 aa, Homo Sapiens
KEKTIKKIW

SEQ ID NO: 176242 - protein, 9 aa, Homo Sapiens
ITGMSHHVR

SEQ ID NO: 176243 - protein, 9 aa, Homo Sapiens
EMISATDHT

SEQ ID NO: 176244 - protein, 9 aa, Homo Sapiens
TGFSLFYYK

SEQ ID NO: 176245 - protein, 9 aa, Homo Sapiens
PKRVKEADH

SEQ ID NO: 176246 - protein, 9 aa, Homo Sapiens
LRKRGVDIN

SEQ ID NO: 176247 - protein, 9 aa, Homo Sapiens
TTRLMAPVG

SEQ ID NO: 176248 - protein, 9 aa, Homo Sapiens
VIGGYDGHS

SEQ ID NO: 176249 - protein, 9 aa, Homo Sapiens
VQFCIWDPV

SEQ ID NO: 176250 - protein, 9 aa, Homo Sapiens
AVTPLAQHR

SEQ ID NO: 176251 - protein, 9 aa, Homo Sapiens
GNSHCILLV

SEQ ID NO: 176252 - protein, 9 aa, Homo Sapiens
YVRAMCEMN

SEQ ID NO: 176253 - protein, 9 aa, Homo Sapiens
GFQWGESPW

SEQ ID NO: 176254 - protein, 9 aa, Homo Sapiens
PETPAHVDV

SEQ ID NO: 176255 - protein, 9 aa, Homo Sapiens
AYSQLGNGI

SEQ ID NO: 176256 - protein, 9 aa, Homo Sapiens
VEVQNILDV

SEQ ID NO: 176257 - protein, 9 aa, Homo Sapiens
QDLPSGLLP

SEQ ID NO: 176258 - protein, 9 aa, Homo Sapiens
KELELHIGN

SEQ ID NO: 176259 - protein, 9 aa, Homo Sapiens
FPHRQKGQH

SEQ ID NO: 176260 - protein, 9 aa, Homo Sapiens
GACVPRAAR

SEQ ID NO: 176261 - protein, 9 aa, Homo Sapiens
MGIPIRKYI

SEQ ID NO: 176262 - protein, 9 aa, Homo Sapiens
RVPASWGLE

SEQ ID NO: 176263 - protein, 9 aa, Homo Sapiens
QNGHFRPPV

SEQ ID NO: 176264 - protein, 9 aa, Homo Sapiens
AQRPMIVEL

SEQ ID NO: 176265 - protein, 9 aa, Homo Sapiens
GDAHISSLS

SEQ ID NO: 176266 - protein, 9 aa, Homo Sapiens
HLKQLLSRA

SEQ ID NO: 176267 - protein, 9 aa, Homo Sapiens
MMWMGGKTP

SEQ ID NO: 176268 - protein, 9 aa, Homo Sapiens
SLRPVRLQK

SEQ ID NO: 176269 - protein, 9 aa, Homo Sapiens
SLYPEVTPH

SEQ ID NO: 176270 - protein, 9 aa, Homo Sapiens
CCPSAWRTA

SEQ ID NO: 176271 - protein, 9 aa, Homo Sapiens
RTARRTLRS

SEQ ID NO: 176272 - protein, 9 aa, Homo Sapiens
ITAAVPRTV

SEQ ID NO: 176273 - protein, 9 aa, Homo Sapiens
FQGRDDILG

SEQ ID NO: 176274 - protein, 9 aa, Homo Sapiens
TIFHLQHSD

SEQ ID NO: 176275 - protein, 9 aa, Homo Sapiens
GANRKQKTD

SEQ ID NO: 176276 - protein, 9 aa, Homo Sapiens
PQGSMRAIR

SEQ ID NO: 176277 - protein, 9 aa, Homo Sapiens
ERDVGHEGG

SEQ ID NO: 176278 - protein, 9 aa, Homo Sapiens
WRPGSRMSW

SEQ ID NO: 176279 - protein, 9 aa, Homo Sapiens
AEEAKKAIT

SEQ ID NO: 176280 - protein, 9 aa, Homo Sapiens
KLADFVLLC

SEQ ID NO: 176281 - protein, 9 aa, Homo Sapiens
CFLKTRGQI

SEQ ID NO: 176282 - protein, 9 aa, Homo Sapiens
CKCRPRSRR

SEQ ID NO: 176283 - protein, 9 aa, Homo Sapiens
QCDVHHVEE

SEQ ID NO: 176284 - protein, 9 aa, Homo Sapiens
SGEWALQSS

SEQ ID NO: 176285 - protein, 9 aa, Homo Sapiens
TRSGGGGGN

SEQ ID NO: 176286 - protein, 9 aa, Homo Sapiens
GHKGLMERA

SEQ ID NO: 176287 - protein, 9 aa, Homo Sapiens
GFAEGRRRT

SEQ ID NO: 176288 - protein, 9 aa, Homo Sapiens
TTTNKKPGL

SEQ ID NO: 176289 - protein, 9 aa, Homo Sapiens
DCPKRPEQL

SEQ ID NO: 176290 - protein, 9 aa, Homo Sapiens
VLRSYDDFC

SEQ ID NO: 176291 - protein, 9 aa, Homo Sapiens
PTSRGSSLQ

SEQ ID NO: 176292 - protein, 9 aa, Homo Sapiens
TCLGHPVLT

SEQ ID NO: 176293 - protein, 9 aa, Homo Sapiens
FQKGRGWDS

SEQ ID NO: 176294 - protein, 9 aa, Homo Sapiens
LPSPPPHPQ

SEQ ID NO: 176295 - protein, 9 aa, Homo Sapiens
SQDVFSVSI

SEQ ID NO: 176296 - protein, 9 aa, Homo Sapiens
LCSYLPQWW

SEQ ID NO: 176297 - protein, 9 aa, Homo Sapiens
APTLTDAAA

SEQ ID NO: 176298 - protein, 9 aa, Homo Sapiens
KKQHRRTSM

SEQ ID NO: 176299 - protein, 9 aa, Homo Sapiens
CAKDNVYHL

SEQ ID NO: 176300 - protein, 9 aa, Homo Sapiens
RDALDNIYD

SEQ ID NO: 176301 - protein, 9 aa, Homo Sapiens
TPQPSLPGP

SEQ ID NO: 176302 - protein, 9 aa, Homo Sapiens
DRTKRTALW

SEQ ID NO: 176303 - protein, 9 aa, Homo Sapiens
KPKKKKKKI

SEQ ID NO: 176304 - protein, 9 aa, Homo Sapiens
GAQLCTIEP

SEQ ID NO: 176305 - protein, 9 aa, Homo Sapiens
DVLNTFKYP

SEQ ID NO: 176306 - protein, 9 aa, Homo Sapiens
PSSSSSSSV

SEQ ID NO: 176307 - protein, 9 aa, Homo Sapiens
WEEETTTEM

SEQ ID NO: 176308 - protein, 9 aa, Homo Sapiens
ANYLTTKTS

SEQ ID NO: 176309 - protein, 9 aa, Homo Sapiens
TLFFFCNMA

SEQ ID NO: 176310 - protein, 9 aa, Homo Sapiens
KALQTEMTR

SEQ ID NO: 176311 - protein, 9 aa, Homo Sapiens
EGASAEVLS

SEQ ID NO: 176312 - protein, 9 aa, Homo Sapiens
TCPPVFSYS

SEQ ID NO: 176313 - protein, 9 aa, Homo Sapiens
YIEAREGWS

SEQ ID NO: 176314 - protein, 9 aa, Homo Sapiens
VEAQEAEGE

SEQ ID NO: 176315 - protein, 9 aa, Homo Sapiens
TATEKQHIT

SEQ ID NO: 176316 - protein, 9 aa, Homo Sapiens
AVQPRAKPF

SEQ ID NO: 176317 - protein, 9 aa, Homo Sapiens
GMLVMDCHH

SEQ ID NO: 176318 - protein, 9 aa, Homo Sapiens
RHCKCCVIE

SEQ ID NO: 176319 - protein, 9 aa, Homo Sapiens
GSPVWGKGL

SEQ ID NO: 176320 - protein, 9 aa, Homo Sapiens
TSFCVYSIL

SEQ ID NO: 176321 - protein, 9 aa, Homo Sapiens
AIQMACQGL

SEQ ID NO: 176322 - protein, 9 aa, Homo Sapiens
WEHAGWYRC

SEQ ID NO: 176323 - protein, 9 aa, Homo Sapiens
LITLQGQPA

SEQ ID NO: 176324 - protein, 9 aa, Homo Sapiens
IKLRMNNTE

SEQ ID NO: 176325 - protein, 9 aa, Homo Sapiens
QTQDQLISL

SEQ ID NO: 176326 - protein, 9 aa, Homo Sapiens
VNNFFVTEG

SEQ ID NO: 176327 - protein, 9 aa, Homo Sapiens
AIPKKETLI

SEQ ID NO: 176328 - protein, 9 aa, Homo Sapiens
GWWVWGPPT

SEQ ID NO: 176329 - protein, 9 aa, Homo Sapiens
REAKAEMHR

SEQ ID NO: 176330 - protein, 9 aa, Homo Sapiens
SLFLLLVLL

SEQ ID NO: 176331 - protein, 9 aa, Homo Sapiens
NHTLTLALI

SEQ ID NO: 176332 - protein, 9 aa, Homo Sapiens
NDNRLTRAT

SEQ ID NO: 176333 - protein, 9 aa, Homo Sapiens
WSELPPGRA

SEQ ID NO: 176334 - protein, 9 aa, Homo Sapiens
ICHMYRFPT

SEQ ID NO: 176335 - protein, 9 aa, Homo Sapiens
PGSQLPHSI

SEQ ID NO: 176336 - protein, 9 aa, Homo Sapiens
FLQLQGLVA

SEQ ID NO: 176337 - protein, 9 aa, Homo Sapiens
ASWGLELSL

SEQ ID NO: 176338 - protein, 9 aa, Homo Sapiens
TWASRGTSS

SEQ ID NO: 176339 - protein, 9 aa, Homo Sapiens
AGLSPGACR

SEQ ID NO: 176340 - protein, 9 aa, Homo Sapiens
DFVLLCLDG

SEQ ID NO: 176341 - protein, 9 aa, Homo Sapiens
DARTASLAS

SEQ ID NO: 176342 - protein, 9 aa, Homo Sapiens
RHLHQQPEG

SEQ ID NO: 176343 - protein, 9 aa, Homo Sapiens
LFFLGLQWG

SEQ ID NO: 176344 - protein, 9 aa, Homo Sapiens
GQMQTTSAN

SEQ ID NO: 176345 - protein, 9 aa, Homo Sapiens
IPAEQMDFH

SEQ ID NO: 176346 - protein, 9 aa, Homo Sapiens
KFFLQLQGL

SEQ ID NO: 176347 - protein, 9 aa, Homo Sapiens
WQASWTKVR

SEQ ID NO: 176348 - protein, 9 aa, Homo Sapiens
LQKICYLPL

SEQ ID NO: 176349 - protein, 9 aa, Homo Sapiens
FVKRHCKCC

SEQ ID NO: 176350 - protein, 9 aa, Homo Sapiens
VILQIGWSD

SEQ ID NO: 176351 - protein, 9 aa, Homo Sapiens
EMLDYRHML

SEQ ID NO: 176352 - protein, 9 aa, Homo Sapiens
SRSRPSAQR

SEQ ID NO: 176353 - protein, 9 aa, Homo Sapiens
AMIQFTINS

SEQ ID NO: 176354 - protein, 9 aa, Homo Sapiens
LWASLVKGT

SEQ ID NO: 176355 - protein, 9 aa, Homo Sapiens
PQSLNTELL

SEQ ID NO: 176356 - protein, 9 aa, Homo Sapiens
LHMSILLRM

SEQ ID NO: 176357 - protein, 9 aa, Homo Sapiens
VTPGEKMTE

SEQ ID NO: 176358 - protein, 9 aa, Homo Sapiens
PISTGPSPA

SEQ ID NO: 176359 - protein, 9 aa, Homo Sapiens
KVVKKGNAK

SEQ ID NO: 176360 - protein, 9 aa, Homo Sapiens
KVTGSTSDC

SEQ ID NO: 176361 - protein, 9 aa, Homo Sapiens
TRSLTNLCV

SEQ ID NO: 176362 - protein, 9 aa, Homo Sapiens
DFPRAEAGH

SEQ ID NO: 176363 - protein, 9 aa, Homo Sapiens
FCNMATVYK

SEQ ID NO: 176364 - protein, 9 aa, Homo Sapiens
FTNCHTKIH

SEQ ID NO: 176365 - protein, 9 aa, Homo Sapiens
PVREAGPMA

SEQ ID NO: 176366 - protein, 9 aa, Homo Sapiens
LVAIRTCLL

SEQ ID NO: 176367 - protein, 9 aa, Homo Sapiens
LKITGRDQS

SEQ ID NO: 176368 - protein, 9 aa, Homo Sapiens
VPSTGPARM

SEQ ID NO: 176369 - protein, 9 aa, Homo Sapiens
YFLWILWLI

SEQ ID NO: 176370 - protein, 9 aa, Homo Sapiens
AQRCPHCGA

SEQ ID NO: 176371 - protein, 9 aa, Homo Sapiens
TPEALRSRP

SEQ ID NO: 176372 - protein, 9 aa, Homo Sapiens
VSKVGSWPW

SEQ ID NO: 176373 - protein, 9 aa, Homo Sapiens
HPPRPAPQP

SEQ ID NO: 176374 - protein, 9 aa, Homo Sapiens
VSLSLSGDS

SEQ ID NO: 176375 - protein, 9 aa, Homo Sapiens
RLIRIFRVL

SEQ ID NO: 176376 - protein, 9 aa, Homo Sapiens
RSQPGLYSH

SEQ ID NO: 176377 - protein, 9 aa, Homo Sapiens
TLNWKRGPS

SEQ ID NO: 176378 - protein, 9 aa, Homo Sapiens
RSSWQKGQP

SEQ ID NO: 176379 - protein, 9 aa, Homo Sapiens
TWHFSIWQH

SEQ ID NO: 176380 - protein, 9 aa, Homo Sapiens
MSVCSWPLS

SEQ ID NO: 176381 - protein, 9 aa, Homo Sapiens
RRCEQSSSR

SEQ ID NO: 176382 - protein, 9 aa, Homo Sapiens
RPRGAGAAW

SEQ ID NO: 176383 - protein, 9 aa, Homo Sapiens
RMAACHPQR

SEQ ID NO: 176384 - protein, 9 aa, Homo Sapiens
VTHSVISTR

SEQ ID NO: 176385 - protein, 9 aa, Homo Sapiens
SLAVHQVIH

SEQ ID NO: 176386 - protein, 9 aa, Homo Sapiens
SGDPPVNYV

SEQ ID NO: 176387 - protein, 9 aa, Homo Sapiens
KLVVQVGLF

SEQ ID NO: 176388 - protein, 9 aa, Homo Sapiens
TENGSPGKS

SEQ ID NO: 176389 - protein, 9 aa, Homo Sapiens
QVVPQIQAS

SEQ ID NO: 176390 - protein, 9 aa, Homo Sapiens
VNIRLCWDL

SEQ ID NO: 176391 - protein, 9 aa, Homo Sapiens
TYFGCLLGS

SEQ ID NO: 176392 - protein, 9 aa, Homo Sapiens
LERERMRME

SEQ ID NO: 176393 - protein, 9 aa, Homo Sapiens
LKALAVQTL

SEQ ID NO: 176394 - protein, 9 aa, Homo Sapiens
RRGGPGQAA

SEQ ID NO: 176395 - protein, 9 aa, Homo Sapiens
LQQYKKNSN

SEQ ID NO: 176396 - protein, 9 aa, Homo Sapiens
AKCHRKVLR

SEQ ID NO: 176397 - protein, 9 aa, Homo Sapiens
TLRSSPKSY

SEQ ID NO: 176398 - protein, 9 aa, Homo Sapiens
NYYPNIWKY

SEQ ID NO: 176399 - protein, 9 aa, Homo Sapiens
TEMISATDH

SEQ ID NO: 176400 - protein, 9 aa, Homo Sapiens
AWEENVPKD

SEQ ID NO: 176401 - protein, 9 aa, Homo Sapiens
IVGSPDNPD

SEQ ID NO: 176402 - protein, 9 aa, Homo Sapiens
TQHGIREGF

SEQ ID NO: 176403 - protein, 9 aa, Homo Sapiens
TAPVTVKRK

SEQ ID NO: 176404 - protein, 9 aa, Homo Sapiens
SLRVTMATY

SEQ ID NO: 176405 - protein, 9 aa, Homo Sapiens
RISHKTRRT

SEQ ID NO: 176406 - protein, 9 aa, Homo Sapiens
RLTIFHLQH

SEQ ID NO: 176407 - protein, 9 aa, Homo Sapiens
LAFLYGLKR

SEQ ID NO: 176408 - protein, 9 aa, Homo Sapiens
KKIGLFTRW

SEQ ID NO: 176409 - protein, 9 aa, Homo Sapiens
RAPAGANKN

SEQ ID NO: 176410 - protein, 9 aa, Homo Sapiens
SATRRWRWT

SEQ ID NO: 176411 - protein, 9 aa, Homo Sapiens
RLPGSAAAP

SEQ ID NO: 176412 - protein, 9 aa, Homo Sapiens
VFLTFVIML

SEQ ID NO: 176413 - protein, 9 aa, Homo Sapiens
KSSGRTTHY

SEQ ID NO: 176414 - protein, 9 aa, Homo Sapiens
IKIFQNYYP

SEQ ID NO: 176415 - protein, 9 aa, Homo Sapiens
YGAEVRKES

SEQ ID NO: 176416 - protein, 9 aa, Homo Sapiens
RFCPDTWAS

SEQ ID NO: 176417 - protein, 9 aa, Homo Sapiens
RRWRWTWRP

SEQ ID NO: 176418 - protein, 9 aa, Homo Sapiens
NGCQPLTKS

SEQ ID NO: 176419 - protein, 9 aa, Homo Sapiens
AGAVVPSYI

SEQ ID NO: 176420 - protein, 9 aa, Homo Sapiens
AALLKRGEQ

SEQ ID NO: 176421 - protein, 9 aa, Homo Sapiens
SSSDGRGEN

SEQ ID NO: 176422 - protein, 9 aa, Homo Sapiens
REKRAQWVS

SEQ ID NO: 176423 - protein, 9 aa, Homo Sapiens
RLFQELQTL

SEQ ID NO: 176424 - protein, 9 aa, Homo Sapiens
MCIQALQWE

SEQ ID NO: 176425 - protein, 9 aa, Homo Sapiens
PVDDATWER

SEQ ID NO: 176426 - protein, 9 aa, Homo Sapiens
GFIRMNKGP

SEQ ID NO: 176427 - protein, 9 aa, Homo Sapiens
FDKAFSQAS

SEQ ID NO: 176428 - protein, 9 aa, Homo Sapiens
PGDICNEAD

SEQ ID NO: 176429 - protein, 9 aa, Homo Sapiens
EWKVLPTTM

SEQ ID NO: 176430 - protein, 9 aa, Homo Sapiens
RAPEVPRCA

SEQ ID NO: 176431 - protein, 9 aa, Homo Sapiens
RVRSDVLDE

SEQ ID NO: 176432 - protein, 9 aa, Homo Sapiens
IMDEVDDMA

SEQ ID NO: 176433 - protein, 9 aa, Homo Sapiens
VQDLKRESW

SEQ ID NO: 176434 - protein, 9 aa, Homo Sapiens
RSTRKKCCP

SEQ ID NO: 176435 - protein, 9 aa, Homo Sapiens
AHKLNLGRY

SEQ ID NO: 176436 - protein, 9 aa, Homo Sapiens
LAICWRSPT

SEQ ID NO: 176437 - protein, 9 aa, Homo Sapiens
RRAYAAVPR

SEQ ID NO: 176438 - protein, 9 aa, Homo Sapiens
LGPARTGLL

SEQ ID NO: 176439 - protein, 9 aa, Homo Sapiens
RSEKIEVWR

SEQ ID NO: 176440 - protein, 9 aa, Homo Sapiens
WVFKIASIR

SEQ ID NO: 176441 - protein, 9 aa, Homo Sapiens
RPTQKHWVL

SEQ ID NO: 176442 - protein, 9 aa, Homo Sapiens
LRRNDTENG

SEQ ID NO: 176443 - protein, 9 aa, Homo Sapiens
DDQASTREI

SEQ ID NO: 176444 - protein, 9 aa, Homo Sapiens
VTIYALGMG

SEQ ID NO: 176445 - protein, 9 aa, Homo Sapiens
YVDEHASPA

SEQ ID NO: 176446 - protein, 9 aa, Homo Sapiens
ETTLWLGPA

SEQ ID NO: 176447 - protein, 9 aa, Homo Sapiens
TAHLLRLWM

SEQ ID NO: 176448 - protein, 9 aa, Homo Sapiens
LVEGLLGSL

SEQ ID NO: 176449 - protein, 9 aa, Homo Sapiens
SGDHARDTQ

SEQ ID NO: 176450 - protein, 9 aa, Homo Sapiens
YLPRNQKEH

SEQ ID NO: 176451 - protein, 9 aa, Homo Sapiens
GVVDFPRAE

SEQ ID NO: 176452 - protein, 9 aa, Homo Sapiens
PVDALVPQH

SEQ ID NO: 176453 - protein, 9 aa, Homo Sapiens
DPSWRKRDQ

SEQ ID NO: 176454 - protein, 9 aa, Homo Sapiens
YMWSFCFSP

SEQ ID NO: 176455 - protein, 9 aa, Homo Sapiens
WVRRRSRHL

SEQ ID NO: 176456 - protein, 9 aa, Homo Sapiens
EEGLKHSTR

SEQ ID NO: 176457 - protein, 9 aa, Homo Sapiens
KEFELQKIC

SEQ ID NO: 176458 - protein, 9 aa, Homo Sapiens
GVLVSAGDH

SEQ ID NO: 176459 - protein, 9 aa, Homo Sapiens
RADLLQQDG

SEQ ID NO: 176460 - protein, 9 aa, Homo Sapiens
SPPKRVKEA

SEQ ID NO: 176461 - protein, 9 aa, Homo Sapiens
LREDDALSI

SEQ ID NO: 176462 - protein, 9 aa, Homo Sapiens
LQVISCLHE

SEQ ID NO: 176463 - protein, 9 aa, Homo Sapiens
VAQSEALSR

SEQ ID NO: 176464 - protein, 9 aa, Homo Sapiens
EECYPILDG

SEQ ID NO: 176465 - protein, 9 aa, Homo Sapiens
VPPRAPASP

SEQ ID NO: 176466 - protein, 9 aa, Homo Sapiens
VWLSLISPN

SEQ ID NO: 176467 - protein, 9 aa, Homo Sapiens
LKQFEERSA

SEQ ID NO: 176468 - protein, 9 aa, Homo Sapiens
EAQMHGELL

SEQ ID NO: 176469 - protein, 9 aa, Homo Sapiens
WGRVLFEEI

SEQ ID NO: 176470 - protein, 9 aa, Homo Sapiens
GNARHRLSF

SEQ ID NO: 176471 - protein, 9 aa, Homo Sapiens
GRGLPTNKI

SEQ ID NO: 176472 - protein, 9 aa, Homo Sapiens
PCWEATHNC

SEQ ID NO: 176473 - protein, 9 aa, Homo Sapiens
LEDWVLCLH

SEQ ID NO: 176474 - protein, 9 aa, Homo Sapiens
IGNGYCKFL

SEQ ID NO: 176475 - protein, 9 aa, Homo Sapiens
SGELGGGWI

SEQ ID NO: 176476 - protein, 9 aa, Homo Sapiens
NIYVVDGRD

SEQ ID NO: 176477 - protein, 9 aa, Homo Sapiens
IGSASSLQT

SEQ ID NO: 176478 - protein, 9 aa, Homo Sapiens
RQRLFAQEK

SEQ ID NO: 176479 - protein, 9 aa, Homo Sapiens
GKQFPNHPS

SEQ ID NO: 176480 - protein, 9 aa, Homo Sapiens
ENEYQLRLT

SEQ ID NO: 176481 - protein, 9 aa, Homo Sapiens
EGLDLVSAE

SEQ ID NO: 176482 - protein, 9 aa, Homo Sapiens
PLRKVRVPK

SEQ ID NO: 176483 - protein, 9 aa, Homo Sapiens
LHLEKMEIT

SEQ ID NO: 176484 - protein, 9 aa, Homo Sapiens
GCAKEAADQ

SEQ ID NO: 176485 - protein, 9 aa, Homo Sapiens
RLSPPEAAF

SEQ ID NO: 176486 - protein, 9 aa, Homo Sapiens
QCECRPKKR

SEQ ID NO: 176487 - protein, 9 aa, Homo Sapiens
QTCGPVHLL

SEQ ID NO: 176488 - protein, 9 aa, Homo Sapiens
TTAATLPVG

SEQ ID NO: 176489 - protein, 9 aa, Homo Sapiens
KWGFTKFNV

SEQ ID NO: 176490 - protein, 9 aa, Homo Sapiens
EVDLSVNQL

SEQ ID NO: 176491 - protein, 9 aa, Homo Sapiens
DCDYIDFLV

SEQ ID NO: 176492 - protein, 9 aa, Homo Sapiens
KWQGEEVAV

SEQ ID NO: 176493 - protein, 9 aa, Homo Sapiens
AMNIKHFKN

SEQ ID NO: 176494 - protein, 9 aa, Homo Sapiens
RPRAATPAP

SEQ ID NO: 176495 - protein, 9 aa, Homo Sapiens
HHKHHKHGK

SEQ ID NO: 176496 - protein, 9 aa, Homo Sapiens
PWNLYRKEG

SEQ ID NO: 176497 - protein, 9 aa, Homo Sapiens
LGSLNPCPF

SEQ ID NO: 176498 - protein, 9 aa, Homo Sapiens
HLATETRAL

SEQ ID NO: 176499 - protein, 9 aa, Homo Sapiens
GNSFQENVL

SEQ ID NO: 176500 - protein, 9 aa, Homo Sapiens
SFTSIFAGI

SEQ ID NO: 176501 - protein, 9 aa, Homo Sapiens
APQKISTWS

SEQ ID NO: 176502 - protein, 9 aa, Homo Sapiens
SGEQIPGLL

SEQ ID NO: 176503 - protein, 9 aa, Homo Sapiens
MNAKKAAAN

SEQ ID NO: 176504 - protein, 9 aa, Homo Sapiens
NLKIKTQKS

SEQ ID NO: 176505 - protein, 9 aa, Homo Sapiens
RVDADMPPL

SEQ ID NO: 176506 - protein, 9 aa, Homo Sapiens
EDLSIFLST

SEQ ID NO: 176507 - protein, 9 aa, Homo Sapiens
VVLLISGSL

SEQ ID NO: 176508 - protein, 9 aa, Homo Sapiens
PGSCPPSRA

SEQ ID NO: 176509 - protein, 9 aa, Homo Sapiens
SSLPYSAYY

SEQ ID NO: 176510 - protein, 9 aa, Homo Sapiens
WKKLVIVGD

SEQ ID NO: 176511 - protein, 9 aa, Homo Sapiens
GDFVLSVLG

SEQ ID NO: 176512 - protein, 9 aa, Homo Sapiens
QSAEKLMHI

SEQ ID NO: 176513 - protein, 9 aa, Homo Sapiens
IKCVNKTGR

SEQ ID NO: 176514 - protein, 9 aa, Homo Sapiens
RRILEREGS

SEQ ID NO: 176515 - protein, 9 aa, Homo Sapiens
DKTVLVTVS

SEQ ID NO: 176516 - protein, 9 aa, Homo Sapiens
PNSTAATNE

SEQ ID NO: 176517 - protein, 9 aa, Homo Sapiens
QLCQQGHIQ

SEQ ID NO: 176518 - protein, 9 aa, Homo Sapiens
SSLDPTITC

SEQ ID NO: 176519 - protein, 9 aa, Homo Sapiens
CWRSRWQGP

SEQ ID NO: 176520 - protein, 9 aa, Homo Sapiens
PPNLASSTL

SEQ ID NO: 176521 - protein, 9 aa, Homo Sapiens
LSRHLAEYV

SEQ ID NO: 176522 - protein, 9 aa, Homo Sapiens
LKRDPQQGQ

SEQ ID NO: 176523 - protein, 9 aa, Homo Sapiens
LLLIKPKNE

SEQ ID NO: 176524 - protein, 9 aa, Homo Sapiens
QVLLGHLSP

SEQ ID NO: 176525 - protein, 9 aa, Homo Sapiens
CCCCFDVLY

SEQ ID NO: 176526 - protein, 9 aa, Homo Sapiens
TPEWTHQDS

SEQ ID NO: 176527 - protein, 9 aa, Homo Sapiens
MLKTPHVSP

SEQ ID NO: 176528 - protein, 9 aa, Homo Sapiens
RPATSSRRP

SEQ ID NO: 176529 - protein, 9 aa, Homo Sapiens
IHTGKNPIF

SEQ ID NO: 176530 - protein, 9 aa, Homo Sapiens
TPASTNRAP

SEQ ID NO: 176531 - protein, 9 aa, Homo Sapiens
EPSSPAPSS

SEQ ID NO: 176532 - protein, 9 aa, Homo Sapiens
TVIKKKGIS

SEQ ID NO: 176533 - protein, 9 aa, Homo Sapiens
PFDFAFDRK

SEQ ID NO: 176534 - protein, 9 aa, Homo Sapiens
ASLSARTAS

SEQ ID NO: 176535 - protein, 9 aa, Homo Sapiens
QEGCQLMGV

SEQ ID NO: 176536 - protein, 9 aa, Homo Sapiens
RDRLSFKEL

SEQ ID NO: 176537 - protein, 9 aa, Homo Sapiens
YGKMAVMEC

SEQ ID NO: 176538 - protein, 9 aa, Homo Sapiens
SFEAPEDKD

SEQ ID NO: 176539 - protein, 9 aa, Homo Sapiens
PQDSRQVLA

SEQ ID NO: 176540 - protein, 9 aa, Homo Sapiens
YQRALDMLL

SEQ ID NO: 176541 - protein, 9 aa, Homo Sapiens
SQGDEDDKL

SEQ ID NO: 176542 - protein, 9 aa, Homo Sapiens
HQELLGKKL

SEQ ID NO: 176543 - protein, 9 aa, Homo Sapiens
EKKKAPSAS

SEQ ID NO: 176544 - protein, 9 aa, Homo Sapiens
HSLEPPYLH

SEQ ID NO: 176545 - protein, 9 aa, Homo Sapiens
LFAQLAEGG

SEQ ID NO: 176546 - protein, 9 aa, Homo Sapiens
KDMIAHPRQ

SEQ ID NO: 176547 - protein, 9 aa, Homo Sapiens
LDRFTGDFF

SEQ ID NO: 176548 - protein, 9 aa, Homo Sapiens
SVGKPSVGN

SEQ ID NO: 176549 - protein, 9 aa, Homo Sapiens
ATLETKQPC

SEQ ID NO: 176550 - protein, 9 aa, Homo Sapiens
SSSILDRFT

SEQ ID NO: 176551 - protein, 9 aa, Homo Sapiens
GSVLCTHHT

SEQ ID NO: 176552 - protein, 9 aa, Homo Sapiens
VTRGGTVKL

SEQ ID NO: 176553 - protein, 9 aa, Homo Sapiens
MQPSVTSQP

SEQ ID NO: 176554 - protein, 9 aa, Homo Sapiens
LRKELGVNL

SEQ ID NO: 176555 - protein, 9 aa, Homo Sapiens
PTATWAAAA

SEQ ID NO: 176556 - protein, 9 aa, Homo Sapiens
ILARLPARA

SEQ ID NO: 176557 - protein, 9 aa, Homo Sapiens
SSVCSAPSS

SEQ ID NO: 176558 - protein, 9 aa, Homo Sapiens
RALLHSPVP

SEQ ID NO: 176559 - protein, 9 aa, Homo Sapiens
SQPPTLPWT

SEQ ID NO: 176560 - protein, 9 aa, Homo Sapiens
DAMLENYRN

SEQ ID NO: 176561 - protein, 9 aa, Homo Sapiens
DHMRNHVSH

SEQ ID NO: 176562 - protein, 9 aa, Homo Sapiens
DLPELKHVV

SEQ ID NO: 176563 - protein, 9 aa, Homo Sapiens
YSSVLRKHR

SEQ ID NO: 176564 - protein, 9 aa, Homo Sapiens
PIDQVGLFL

SEQ ID NO: 176565 - protein, 9 aa, Homo Sapiens
PSSPAPSSG

SEQ ID NO: 176566 - protein, 9 aa, Homo Sapiens
NGIRVIRTD

SEQ ID NO: 176567 - protein, 9 aa, Homo Sapiens
KQYYSNSFN

SEQ ID NO: 176568 - protein, 9 aa, Homo Sapiens
VTTCSFNSS

SEQ ID NO: 176569 - protein, 9 aa, Homo Sapiens
PYDSAQLGP

SEQ ID NO: 176570 - protein, 9 aa, Homo Sapiens
EEKKRLKKR

SEQ ID NO: 176571 - protein, 9 aa, Homo Sapiens
TLPRKGRKG

SEQ ID NO: 176572 - protein, 9 aa, Homo Sapiens
MEQIPHLKS

SEQ ID NO: 176573 - protein, 9 aa, Homo Sapiens
SGEVEASRL

SEQ ID NO: 176574 - protein, 9 aa, Homo Sapiens
WKKNEEFKK

SEQ ID NO: 176575 - protein, 9 aa, Homo Sapiens
SKGLNQRLL

SEQ ID NO: 176576 - protein, 9 aa, Homo Sapiens
TRKGPDFGS

SEQ ID NO: 176577 - protein, 9 aa, Homo Sapiens
SVDDVIKMI

SEQ ID NO: 176578 - protein, 9 aa, Homo Sapiens
TFNSIWDQN

SEQ ID NO: 176579 - protein, 9 aa, Homo Sapiens
LGVNLLEVL

SEQ ID NO: 176580 - protein, 9 aa, Homo Sapiens
FLDCAHQVH

SEQ ID NO: 176581 - protein, 9 aa, Homo Sapiens
CQYFIGVLD

SEQ ID NO: 176582 - protein, 9 aa, Homo Sapiens
VLFDEKHRE

SEQ ID NO: 176583 - protein, 9 aa, Homo Sapiens
SLKWQFLLE

SEQ ID NO: 176584 - protein, 9 aa, Homo Sapiens
HVIDGLHDV

SEQ ID NO: 176585 - protein, 9 aa, Homo Sapiens
LLQRNLLRL

SEQ ID NO: 176586 - protein, 9 aa, Homo Sapiens
ALQVMVSVS

SEQ ID NO: 176587 - protein, 9 aa, Homo Sapiens
SSGLQGCVQ

SEQ ID NO: 176588 - protein, 9 aa, Homo Sapiens
ISNVFQGML

SEQ ID NO: 176589 - protein, 9 aa, Homo Sapiens
HRQKFLSRH

SEQ ID NO: 176590 - protein, 9 aa, Homo Sapiens
VRGSCGWWA

SEQ ID NO: 176591 - protein, 9 aa, Homo Sapiens
GQASAAAPA

SEQ ID NO: 176592 - protein, 9 aa, Homo Sapiens
ERLLLQEEQ

SEQ ID NO: 176593 - protein, 9 aa, Homo Sapiens
DVHQKQRRK

SEQ ID NO: 176594 - protein, 9 aa, Homo Sapiens
EGPTAKRTM

SEQ ID NO: 176595 - protein, 9 aa, Homo Sapiens
RGTTSSTGN

SEQ ID NO: 176596 - protein, 9 aa, Homo Sapiens
IKDDLMLFQ

SEQ ID NO: 176597 - protein, 9 aa, Homo Sapiens
AALMDEESR

SEQ ID NO: 176598 - protein, 9 aa, Homo Sapiens
GNWPPMDDV

SEQ ID NO: 176599 - protein, 9 aa, Homo Sapiens
PRWGQRALH

SEQ ID NO: 176600 - protein, 9 aa, Homo Sapiens
QLVQLLARA

SEQ ID NO: 176601 - protein, 9 aa, Homo Sapiens
IQEDGMIMY

SEQ ID NO: 176602 - protein, 9 aa, Homo Sapiens
HGIQEITRS

SEQ ID NO: 176603 - protein, 9 aa, Homo Sapiens
SDLLAGWMR

SEQ ID NO: 176604 - protein, 9 aa, Homo Sapiens
SENPNEVFC

SEQ ID NO: 176605 - protein, 9 aa, Homo Sapiens
YRDAMLENY

SEQ ID NO: 176606 - protein, 9 aa, Homo Sapiens
KPSVGNQTS

SEQ ID NO: 176607 - protein, 9 aa, Homo Sapiens
TVVISTCDH

SEQ ID NO: 176608 - protein, 9 aa, Homo Sapiens
YSDPEDEGK

SEQ ID NO: 176609 - protein, 9 aa, Homo Sapiens
KSFDAHPRW

SEQ ID NO: 176610 - protein, 9 aa, Homo Sapiens
PVLLLPTQP

SEQ ID NO: 176611 - protein, 9 aa, Homo Sapiens
PRKGRKGSV

SEQ ID NO: 176612 - protein, 9 aa, Homo Sapiens
NMCPSVNLF

SEQ ID NO: 176613 - protein, 9 aa, Homo Sapiens
DPYPKDDNI

SEQ ID NO: 176614 - protein, 9 aa, Homo Sapiens
IRPMWQLAS

SEQ ID NO: 176615 - protein, 9 aa, Homo Sapiens
AQLEEKLMT

SEQ ID NO: 176616 - protein, 9 aa, Homo Sapiens
YHHRNIATY

SEQ ID NO: 176617 - protein, 9 aa, Homo Sapiens
IQPHGQKMT

SEQ ID NO: 176618 - protein, 9 aa, Homo Sapiens
RFSWHDPHP

SEQ ID NO: 176619 - protein, 9 aa, Homo Sapiens
VEVLLLRVV

SEQ ID NO: 176620 - protein, 9 aa, Homo Sapiens
ALGPLGSRT

SEQ ID NO: 176621 - protein, 9 aa, Homo Sapiens
GSWAACVNY

SEQ ID NO: 176622 - protein, 9 aa, Homo Sapiens
RTSGEPWDT

SEQ ID NO: 176623 - protein, 9 aa, Homo Sapiens
HSVPSTPPW

SEQ ID NO: 176624 - protein, 9 aa, Homo Sapiens
HRLWLAALP

SEQ ID NO: 176625 - protein, 9 aa, Homo Sapiens
ALPHIDGRE

SEQ ID NO: 176626 - protein, 9 aa, Homo Sapiens
IPALKTILD

SEQ ID NO: 176627 - protein, 9 aa, Homo Sapiens
AHVLWPFGF

SEQ ID NO: 176628 - protein, 9 aa, Homo Sapiens
PKQPQISGS

SEQ ID NO: 176629 - protein, 9 aa, Homo Sapiens
TWAPHIGNT

SEQ ID NO: 176630 - protein, 9 aa, Homo Sapiens
FPQCTFFFL

SEQ ID NO: 176631 - protein, 9 aa, Homo Sapiens
STKTWQWKF

SEQ ID NO: 176632 - protein, 9 aa, Homo Sapiens
DGKVPQHAG

SEQ ID NO: 176633 - protein, 9 aa, Homo Sapiens
TGPGSCPPS

SEQ ID NO: 176634 - protein, 9 aa, Homo Sapiens
RPNTCNLRK

SEQ ID NO: 176635 - protein, 9 aa, Homo Sapiens
VRGLGEGSP

SEQ ID NO: 176636 - protein, 9 aa, Homo Sapiens
GLLLQLLQT

SEQ ID NO: 176637 - protein, 9 aa, Homo Sapiens
IHKNFTEEE

SEQ ID NO: 176638 - protein, 9 aa, Homo Sapiens
LKGANPEDV

SEQ ID NO: 176639 - protein, 9 aa, Homo Sapiens
PIFVMNVGS

SEQ ID NO: 176640 - protein, 9 aa, Homo Sapiens
VALCLSASA

SEQ ID NO: 176641 - protein, 9 aa, Homo Sapiens
SLSPRKVPV

SEQ ID NO: 176642 - protein, 9 aa, Homo Sapiens
CRHAGSSAL

SEQ ID NO: 176643 - protein, 9 aa, Homo Sapiens
HHWLFVSVP

SEQ ID NO: 176644 - protein, 9 aa, Homo Sapiens
KLQPTEKQQ

SEQ ID NO: 176645 - protein, 9 aa, Homo Sapiens
LIAICHHRG

SEQ ID NO: 176646 - protein, 9 aa, Homo Sapiens
KVAQHEGLI

SEQ ID NO: 176647 - protein, 9 aa, Homo Sapiens
WERQDYGKM

SEQ ID NO: 176648 - protein, 9 aa, Homo Sapiens
SAIFNLGHL

SEQ ID NO: 176649 - protein, 9 aa, Homo Sapiens
YPKSLSQEA

SEQ ID NO: 176650 - protein, 9 aa, Homo Sapiens
PSSWTTFGV

SEQ ID NO: 176651 - protein, 9 aa, Homo Sapiens
AFSDDPSPG

SEQ ID NO: 176652 - protein, 9 aa, Homo Sapiens
KKRRIHKNF

SEQ ID NO: 176653 - protein, 9 aa, Homo Sapiens
PFPFSLRGN

SEQ ID NO: 176654 - protein, 9 aa, Homo Sapiens
LSQWDLKYH

SEQ ID NO: 176655 - protein, 9 aa, Homo Sapiens
SSPGHPLGP

SEQ ID NO: 176656 - protein, 9 aa, Homo Sapiens
VGMPLIYVG

SEQ ID NO: 176657 - protein, 9 aa, Homo Sapiens
LLSHGSLAH

SEQ ID NO: 176658 - protein, 9 aa, Homo Sapiens
SGTTRTSLR

SEQ ID NO: 176659 - protein, 9 aa, Homo Sapiens
AAAPAATVS

SEQ ID NO: 176660 - protein, 9 aa, Homo Sapiens
AASPTTAAT

SEQ ID NO: 176661 - protein, 9 aa, Homo Sapiens
VNSPRSSLI

SEQ ID NO: 176662 - protein, 9 aa, Homo Sapiens
LNRSIEKRS

SEQ ID NO: 176663 - protein, 9 aa, Homo Sapiens
FHSSAQLAD

SEQ ID NO: 176664 - protein, 9 aa, Homo Sapiens
GSPLLSGAR

SEQ ID NO: 176665 - protein, 9 aa, Homo Sapiens
WKEVLLHYL

SEQ ID NO: 176666 - protein, 9 aa, Homo Sapiens
GSSKLPVPL

SEQ ID NO: 176667 - protein, 9 aa, Homo Sapiens
DTSHSLRNL

SEQ ID NO: 176668 - protein, 9 aa, Homo Sapiens
EVWVQSIVV

SEQ ID NO: 176669 - protein, 9 aa, Homo Sapiens
GGMRMSSGR

SEQ ID NO: 176670 - protein, 9 aa, Homo Sapiens
RPMTAKKKA

SEQ ID NO: 176671 - protein, 9 aa, Homo Sapiens
VCTTAPPTA

SEQ ID NO: 176672 - protein, 9 aa, Homo Sapiens
GRCVERYSC

SEQ ID NO: 176673 - protein, 9 aa, Homo Sapiens
MNIKHFKNC

SEQ ID NO: 176674 - protein, 9 aa, Homo Sapiens
GFDRISSVK

SEQ ID NO: 176675 - protein, 9 aa, Homo Sapiens
SPCHLAHLS

SEQ ID NO: 176676 - protein, 9 aa, Homo Sapiens
REEEVKKEM

SEQ ID NO: 176677 - protein, 9 aa, Homo Sapiens
RPGTPPPLI

SEQ ID NO: 176678 - protein, 9 aa, Homo Sapiens
KKRCSLMEQ

SEQ ID NO: 176679 - protein, 9 aa, Homo Sapiens
SPHPEVEYD

SEQ ID NO: 176680 - protein, 9 aa, Homo Sapiens
LSLENLPCF

SEQ ID NO: 176681 - protein, 9 aa, Homo Sapiens
RPENQVLLG

SEQ ID NO: 176682 - protein, 9 aa, Homo Sapiens
LYSVHLDGL

SEQ ID NO: 176683 - protein, 9 aa, Homo Sapiens
TRATSWMAH

SEQ ID NO: 176684 - protein, 9 aa, Homo Sapiens
KKLIQKSHG

SEQ ID NO: 176685 - protein, 9 aa, Homo Sapiens
LHSCDPPSS

SEQ ID NO: 176686 - protein, 9 aa, Homo Sapiens
IMSTTGWLE

SEQ ID NO: 176687 - protein, 9 aa, Homo Sapiens
YLAEIMLES

SEQ ID NO: 176688 - protein, 9 aa, Homo Sapiens
LWRPTAIRQ

SEQ ID NO: 176689 - protein, 9 aa, Homo Sapiens
LSTAWTTRK

SEQ ID NO: 176690 - protein, 9 aa, Homo Sapiens
RKEDVNKKR

SEQ ID NO: 176691 - protein, 9 aa, Homo Sapiens
KSENVDVGN

SEQ ID NO: 176692 - protein, 9 aa, Homo Sapiens
LTRAPQSGS

SEQ ID NO: 176693 - protein, 9 aa, Homo Sapiens
WKKSVWTLQ

SEQ ID NO: 176694 - protein, 9 aa, Homo Sapiens
IKEGAVVID

SEQ ID NO: 176695 - protein, 9 aa, Homo Sapiens
LDFAQNFTT

SEQ ID NO: 176696 - protein, 9 aa, Homo Sapiens
HKSKPFRRR

SEQ ID NO: 176697 - protein, 9 aa, Homo Sapiens
KTKGRGEEQ

SEQ ID NO: 176698 - protein, 9 aa, Homo Sapiens
GIYIKQVAL

SEQ ID NO: 176699 - protein, 9 aa, Homo Sapiens
EVLLIDNSA

SEQ ID NO: 176700 - protein, 9 aa, Homo Sapiens
EDGMIMYIF

SEQ ID NO: 176701 - protein, 9 aa, Homo Sapiens
IEFKNMLKT

SEQ ID NO: 176702 - protein, 9 aa, Homo Sapiens
LWSWCGTSQ

SEQ ID NO: 176703 - protein, 9 aa, Homo Sapiens
CGEYVVRWC

SEQ ID NO: 176704 - protein, 9 aa, Homo Sapiens
SPSPWAAPA

SEQ ID NO: 176705 - protein, 9 aa, Homo Sapiens
TVDTPPACA

SEQ ID NO: 176706 - protein, 9 aa, Homo Sapiens
VTRNRLKIQ

SEQ ID NO: 176707 - protein, 9 aa, Homo Sapiens
VQIVETEKL

SEQ ID NO: 176708 - protein, 9 aa, Homo Sapiens
ERYSCYTCD

SEQ ID NO: 176709 - protein, 9 aa, Homo Sapiens
DGAAATFAY

SEQ ID NO: 176710 - protein, 9 aa, Homo Sapiens
PAPRLESAF

SEQ ID NO: 176711 - protein, 9 aa, Homo Sapiens
RGDIFRPPR

SEQ ID NO: 176712 - protein, 9 aa, Homo Sapiens
LLQLLQTLR

SEQ ID NO: 176713 - protein, 9 aa, Homo Sapiens
RPEDFEFGK

SEQ ID NO: 176714 - protein, 9 aa, Homo Sapiens
LRPLSLQCQ

SEQ ID NO: 176715 - protein, 9 aa, Homo Sapiens
LLLLCQLRV

SEQ ID NO: 176716 - protein, 9 aa, Homo Sapiens
KVRESKWVA

SEQ ID NO: 176717 - protein, 9 aa, Homo Sapiens
GLVKATGRS

SEQ ID NO: 176718 - protein, 9 aa, Homo Sapiens
RDASHCPAT

SEQ ID NO: 176719 - protein, 9 aa, Homo Sapiens
AVHITHHAH

SEQ ID NO: 176720 - protein, 9 aa, Homo Sapiens
SRALATKDT

SEQ ID NO: 176721 - protein, 9 aa, Homo Sapiens
LVTVSVLGS

SEQ ID NO: 176722 - protein, 9 aa, Homo Sapiens
AVPLQHMCV

SEQ ID NO: 176723 - protein, 9 aa, Homo Sapiens
LLATMGPID

SEQ ID NO: 176724 - protein, 9 aa, Homo Sapiens
RRPHRHCHP

SEQ ID NO: 176725 - protein, 9 aa, Homo Sapiens
ATPSSSGAT

SEQ ID NO: 176726 - protein, 9 aa, Homo Sapiens
INHARALVR

SEQ ID NO: 176727 - protein, 9 aa, Homo Sapiens
SLPTIGESQ

SEQ ID NO: 176728 - protein, 9 aa, Homo Sapiens
ASPSEVVFW

SEQ ID NO: 176729 - protein, 9 aa, Homo Sapiens
FQILVTVKF

SEQ ID NO: 176730 - protein, 9 aa, Homo Sapiens
WTLRKQPQG

SEQ ID NO: 176731 - protein, 9 aa, Homo Sapiens
SDMVPVAEV

SEQ ID NO: 176732 - protein, 9 aa, Homo Sapiens
WREHKHRAK

SEQ ID NO: 176733 - protein, 9 aa, Homo Sapiens
RTFSSIRCR

SEQ ID NO: 176734 - protein, 9 aa, Homo Sapiens
EHVVCPRPR

SEQ ID NO: 176735 - protein, 9 aa, Homo Sapiens
VEKKLSRRL

SEQ ID NO: 176736 - protein, 9 aa, Homo Sapiens
RLEICSARP

SEQ ID NO: 176737 - protein, 9 aa, Homo Sapiens
WSVCGFSTR

SEQ ID NO: 176738 - protein, 9 aa, Homo Sapiens
LFVLKEMLP

SEQ ID NO: 176739 - protein, 9 aa, Homo Sapiens
CISWMLLKA

SEQ ID NO: 176740 - protein, 9 aa, Homo Sapiens
TLSAEEGIR

SEQ ID NO: 176741 - protein, 9 aa, Homo Sapiens
EHLVNSVDD

SEQ ID NO: 176742 - protein, 9 aa, Homo Sapiens
RWTAQGHVN

SEQ ID NO: 176743 - protein, 9 aa, Homo Sapiens
VVNGPQTEE

SEQ ID NO: 176744 - protein, 9 aa, Homo Sapiens
QPQGPSCSR

SEQ ID NO: 176745 - protein, 9 aa, Homo Sapiens
YCEVCQRGG

SEQ ID NO: 176746 - protein, 9 aa, Homo Sapiens
CKFLSSTHP

SEQ ID NO: 176747 - protein, 9 aa, Homo Sapiens
WDSREMRDY

SEQ ID NO: 176748 - protein, 9 aa, Homo Sapiens
MKKLKTRMH

SEQ ID NO: 176749 - protein, 9 aa, Homo Sapiens
KGVSVDCNG

SEQ ID NO: 176750 - protein, 9 aa, Homo Sapiens
ETALVSMSP

SEQ ID NO: 176751 - protein, 9 aa, Homo Sapiens
VRSPLLQGE

SEQ ID NO: 176752 - protein, 9 aa, Homo Sapiens
PKKKEALFL

SEQ ID NO: 176753 - protein, 9 aa, Homo Sapiens
SKQMPPVML

SEQ ID NO: 176754 - protein, 9 aa, Homo Sapiens
AHLLPQALC

SEQ ID NO: 176755 - protein, 9 aa, Homo Sapiens
PEPRFGSMV

SEQ ID NO: 176756 - protein, 9 aa, Homo Sapiens
CKSPSNTKV

SEQ ID NO: 176757 - protein, 9 aa, Homo Sapiens
RVGQTIEHM

SEQ ID NO: 176758 - protein, 9 aa, Homo Sapiens
CAGARRGRW

SEQ ID NO: 176759 - protein, 9 aa, Homo Sapiens
EIGHILETR

SEQ ID NO: 176760 - protein, 9 aa, Homo Sapiens
TKKTFNPIR

SEQ ID NO: 176761 - protein, 9 aa, Homo Sapiens
NEAAVTAVL

SEQ ID NO: 176762 - protein, 9 aa, Homo Sapiens
VIFFFFVYI

SEQ ID NO: 176763 - protein, 9 aa, Homo Sapiens
IVQGSLQTS

SEQ ID NO: 176764 - protein, 9 aa, Homo Sapiens
QPSVTSQPR

SEQ ID NO: 176765 - protein, 9 aa, Homo Sapiens
QAPLRLWSW

SEQ ID NO: 176766 - protein, 9 aa, Homo Sapiens
VECPSYHLK

SEQ ID NO: 176767 - protein, 9 aa, Homo Sapiens
LTEDIMSSG

SEQ ID NO: 176768 - protein, 9 aa, Homo Sapiens
SRRAPGETS

SEQ ID NO: 176769 - protein, 9 aa, Homo Sapiens
ETDALQKTP

SEQ ID NO: 176770 - protein, 9 aa, Homo Sapiens
DTGVVEGGL

SEQ ID NO: 176771 - protein, 9 aa, Homo Sapiens
YIKRRSMIC

SEQ ID NO: 176772 - protein, 9 aa, Homo Sapiens
VWNVTRNRL

SEQ ID NO: 176773 - protein, 9 aa, Homo Sapiens
PVAEVVGVA

SEQ ID NO: 176774 - protein, 9 aa, Homo Sapiens
SSLRSQHRY

SEQ ID NO: 176775 - protein, 9 aa, Homo Sapiens
LLCGMREMR

SEQ ID NO: 176776 - protein, 9 aa, Homo Sapiens
DPSSWTTFG

SEQ ID NO: 176777 - protein, 9 aa, Homo Sapiens
VEASRLRRL

SEQ ID NO: 176778 - protein, 9 aa, Homo Sapiens
PPPKMPPPR

SEQ ID NO: 176779 - protein, 9 aa, Homo Sapiens
QTSRRLKRF

SEQ ID NO: 176780 - protein, 9 aa, Homo Sapiens
SALLHHWLF

SEQ ID NO: 176781 - protein, 9 aa, Homo Sapiens
DSGLALKGF

SEQ ID NO: 176782 - protein, 9 aa, Homo Sapiens
HVFPWGLLP

SEQ ID NO: 176783 - protein, 9 aa, Homo Sapiens
SPSSWKSPL

SEQ ID NO: 176784 - protein, 9 aa, Homo Sapiens
VANVDLLNR

SEQ ID NO: 176785 - protein, 9 aa, Homo Sapiens
SPQALKKFF

SEQ ID NO: 176786 - protein, 9 aa, Homo Sapiens
KTWQWKFWN

SEQ ID NO: 176787 - protein, 9 aa, Homo Sapiens
RKLGYNSGF

SEQ ID NO: 176788 - protein, 9 aa, Homo Sapiens
WQWKFWNCL

SEQ ID NO: 176789 - protein, 9 aa, Homo Sapiens
TSLLVRRMR

SEQ ID NO: 176790 - protein, 9 aa, Homo Sapiens
CKRVILYFY

SEQ ID NO: 176791 - protein, 9 aa, Homo Sapiens
KRFRASCED

SEQ ID NO: 176792 - protein, 9 aa, Homo Sapiens
VVVDVGAGR

SEQ ID NO: 176793 - protein, 9 aa, Homo Sapiens
EPVVTGTSV

SEQ ID NO: 176794 - protein, 9 aa, Homo Sapiens
AAWCGKVPR

SEQ ID NO: 176795 - protein, 9 aa, Homo Sapiens
IISELPFTI

SEQ ID NO: 176796 - protein, 9 aa, Homo Sapiens
GGEPLLSVC

SEQ ID NO: 176797 - protein, 9 aa, Homo Sapiens
RRPPRLSEI

SEQ ID NO: 176798 - protein, 9 aa, Homo Sapiens
HAVKTVYFH

SEQ ID NO: 176799 - protein, 9 aa, Homo Sapiens
LPPTARARS

SEQ ID NO: 176800 - protein, 9 aa, Homo Sapiens
GAAVPAPRL

SEQ ID NO: 176801 - protein, 9 aa, Homo Sapiens
LYRKIIGYV

SEQ ID NO: 176802 - protein, 9 aa, Homo Sapiens
ITVRCFFFN

SEQ ID NO: 176803 - protein, 9 aa, Homo Sapiens
LLLVYIMST

SEQ ID NO: 176804 - protein, 9 aa, Homo Sapiens
GSSALGPLG

SEQ ID NO: 176805 - protein, 9 aa, Homo Sapiens
RILLQRNLL

SEQ ID NO: 176806 - protein, 9 aa, Homo Sapiens
ADIIQRTTS

SEQ ID NO: 176807 - protein, 9 aa, Homo Sapiens
LSEEKLCQE

SEQ ID NO: 176808 - protein, 9 aa, Homo Sapiens
KRCSLMEQI

SEQ ID NO: 176809 - protein, 9 aa, Homo Sapiens
SHSPLLQKN

SEQ ID NO: 176810 - protein, 9 aa, Homo Sapiens
GTSQTYFGS

SEQ ID NO: 176811 - protein, 9 aa, Homo Sapiens
NVDEFEDMV

SEQ ID NO: 176812 - protein, 9 aa, Homo Sapiens
LLLARASPT

SEQ ID NO: 176813 - protein, 9 aa, Homo Sapiens
LSADIIQRT

SEQ ID NO: 176814 - protein, 9 aa, Homo Sapiens
SRGSQRAVR

SEQ ID NO: 176815 - protein, 9 aa, Homo Sapiens
VVVLQYGCC

SEQ ID NO: 176816 - protein, 9 aa, Homo Sapiens
ADPIKHIRI

SEQ ID NO: 176817 - protein, 9 aa, Homo Sapiens
EFGLLLQLL

SEQ ID NO: 176818 - protein, 9 aa, Homo Sapiens
EGKWHKYGC

SEQ ID NO: 176819 - protein, 9 aa, Homo Sapiens
DMWDSREMR

SEQ ID NO: 176820 - protein, 9 aa, Homo Sapiens
LHESQEGRE

SEQ ID NO: 176821 - protein, 9 aa, Homo Sapiens
VTPPPTSGT

SEQ ID NO: 176822 - protein, 9 aa, Homo Sapiens
GPPPCLSPT

SEQ ID NO: 176823 - protein, 9 aa, Homo Sapiens
SPGSSPTMQ

SEQ ID NO: 176824 - protein, 9 aa, Homo Sapiens
EGIFHSSAQ

SEQ ID NO: 176825 - protein, 9 aa, Homo Sapiens
DLSKSSDDG

SEQ ID NO: 176826 - protein, 9 aa, Homo Sapiens
VFKTHKKAG

SEQ ID NO: 176827 - protein, 9 aa, Homo Sapiens
TPLTLSQEA

SEQ ID NO: 176828 - protein, 9 aa, Homo Sapiens
NSVGSSSVV

SEQ ID NO: 176829 - protein, 9 aa, Homo Sapiens
RPTPRPRVH

SEQ ID NO: 176830 - protein, 9 aa, Homo Sapiens
CYGMASHLR

SEQ ID NO: 176831 - protein, 9 aa, Homo Sapiens
CFRNALLLL

SEQ ID NO: 176832 - protein, 9 aa, Homo Sapiens
ADVQAVDKD

SEQ ID NO: 176833 - protein, 9 aa, Homo Sapiens
LIPLQPNMD

SEQ ID NO: 176834 - protein, 9 aa, Homo Sapiens
LLSLRFRLP

SEQ ID NO: 176835 - protein, 9 aa, Homo Sapiens
VIYSSPKNH

SEQ ID NO: 176836 - protein, 9 aa, Homo Sapiens
KEAFTKVKM

SEQ ID NO: 176837 - protein, 9 aa, Homo Sapiens
TVSTGGHTH

SEQ ID NO: 176838 - protein, 9 aa, Homo Sapiens
QHEGLIRLI

SEQ ID NO: 176839 - protein, 9 aa, Homo Sapiens
RLRQCRSQQ

SEQ ID NO: 176840 - protein, 9 aa, Homo Sapiens
KRLCNLSSR

SEQ ID NO: 176841 - protein, 9 aa, Homo Sapiens
TTGAARWGL

SEQ ID NO: 176842 - protein, 9 aa, Homo Sapiens
VVLEKATHK

SEQ ID NO: 176843 - protein, 9 aa, Homo Sapiens
KINNQIIVN

SEQ ID NO: 176844 - protein, 9 aa, Homo Sapiens
QDAFLPHVE

SEQ ID NO: 176845 - protein, 9 aa, Homo Sapiens
PFVELVAGQ

SEQ ID NO: 176846 - protein, 9 aa, Homo Sapiens
QCGEADRWG

SEQ ID NO: 176847 - protein, 9 aa, Homo Sapiens
QYLDEAERE

SEQ ID NO: 176848 - protein, 9 aa, Homo Sapiens
ATGRSMEQF

SEQ ID NO: 176849 - protein, 9 aa, Homo Sapiens
LTSMPVRHM

SEQ ID NO: 176850 - protein, 9 aa, Homo Sapiens
WICWRSRWQ

SEQ ID NO: 176851 - protein, 9 aa, Homo Sapiens
TPGRGVPPR

SEQ ID NO: 176852 - protein, 9 aa, Homo Sapiens
ENLRLSRID

SEQ ID NO: 176853 - protein, 9 aa, Homo Sapiens
EEHPQSVVV

SEQ ID NO: 176854 - protein, 9 aa, Homo Sapiens
DPDEVLFGP

SEQ ID NO: 176855 - protein, 9 aa, Homo Sapiens
SVEGVSHHA

SEQ ID NO: 176856 - protein, 9 aa, Homo Sapiens
VVIDVGINR

SEQ ID NO: 176857 - protein, 9 aa, Homo Sapiens
FPQPLLHNL

SEQ ID NO: 176858 - protein, 9 aa, Homo Sapiens
MDEESRKNW

SEQ ID NO: 176859 - protein, 9 aa, Homo Sapiens
LLEVLLIDN

SEQ ID NO: 176860 - protein, 9 aa, Homo Sapiens
IEGPAPPRI

SEQ ID NO: 176861 - protein, 9 aa, Homo Sapiens
WQDAHHRRQ

SEQ ID NO: 176862 - protein, 9 aa, Homo Sapiens
GPLGSRTLK

SEQ ID NO: 176863 - protein, 9 aa, Homo Sapiens
HLAPPMGVD

SEQ ID NO: 176864 - protein, 9 aa, Homo Sapiens
SLSINAMNI

SEQ ID NO: 176865 - protein, 9 aa, Homo Sapiens
YEYEPPCAS

SEQ ID NO: 176866 - protein, 9 aa, Homo Sapiens
GLHDVKHFL

SEQ ID NO: 176867 - protein, 9 aa, Homo Sapiens
GDAAVLVKV

SEQ ID NO: 176868 - protein, 9 aa, Homo Sapiens
SPTTAATLP

SEQ ID NO: 176869 - protein, 9 aa, Homo Sapiens
LGCIEIMGG

SEQ ID NO: 176870 - protein, 9 aa, Homo Sapiens
IQFWDWKIQ

SEQ ID NO: 176871 - protein, 9 aa, Homo Sapiens
VGNSYHHMV

SEQ ID NO: 176872 - protein, 9 aa, Homo Sapiens
EKLLCPGRQ

SEQ ID NO: 176873 - protein, 9 aa, Homo Sapiens
KAKIKKKTG

SEQ ID NO: 176874 - protein, 9 aa, Homo Sapiens
WAHGRRHGL

SEQ ID NO: 176875 - protein, 9 aa, Homo Sapiens
QNLLLRSGF

SEQ ID NO: 176876 - protein, 9 aa, Homo Sapiens
VGQTIEHMG

SEQ ID NO: 176877 - protein, 9 aa, Homo Sapiens
YWKEVLLHY

SEQ ID NO: 176878 - protein, 9 aa, Homo Sapiens
CDKKRGASS

SEQ ID NO: 176879 - protein, 9 aa, Homo Sapiens
VQLLARALL

SEQ ID NO: 176880 - protein, 9 aa, Homo Sapiens
GNGYCKFLS

SEQ ID NO: 176881 - protein, 9 aa, Homo Sapiens
NFSPMKSIL

SEQ ID NO: 176882 - protein, 9 aa, Homo Sapiens
EQEGGWRRR

SEQ ID NO: 176883 - protein, 9 aa, Homo Sapiens
CSLGSRLHS

SEQ ID NO: 176884 - protein, 9 aa, Homo Sapiens
SSSPVVRRG

SEQ ID NO: 176885 - protein, 9 aa, Homo Sapiens
PHPEVEYDH

SEQ ID NO: 176886 - protein, 9 aa, Homo Sapiens
ERKLGATSA

SEQ ID NO: 176887 - protein, 9 aa, Homo Sapiens
TIQVMGELF

SEQ ID NO: 176888 - protein, 9 aa, Homo Sapiens
AQWAQLLLQ

SEQ ID NO: 176889 - protein, 9 aa, Homo Sapiens
MVPVAEVVG

SEQ ID NO: 176890 - protein, 9 aa, Homo Sapiens
AMKCLANWS

SEQ ID NO: 176891 - protein, 9 aa, Homo Sapiens
TMTNNEGLF

SEQ ID NO: 176892 - protein, 9 aa, Homo Sapiens
GFGGPDAQL

SEQ ID NO: 176893 - protein, 9 aa, Homo Sapiens
TETRALARS

SEQ ID NO: 176894 - protein, 9 aa, Homo Sapiens
EECHLNKMQ

SEQ ID NO: 176895 - protein, 9 aa, Homo Sapiens
LYFYIKRRS

SEQ ID NO: 176896 - protein, 9 aa, Homo Sapiens
GILGSTGCS

SEQ ID NO: 176897 - protein, 9 aa, Homo Sapiens
GRPCHLIEQ

SEQ ID NO: 176898 - protein, 9 aa, Homo Sapiens
AQNFTTNNT

SEQ ID NO: 176899 - protein, 9 aa, Homo Sapiens
SKWVALQID

SEQ ID NO: 176900 - protein, 9 aa, Homo Sapiens
SEMSTQSGR

SEQ ID NO: 176901 - protein, 9 aa, Homo Sapiens
KIRASTKTW

SEQ ID NO: 176902 - protein, 9 aa, Homo Sapiens
DIMSSGDLL

SEQ ID NO: 176903 - protein, 9 aa, Homo Sapiens
PTLGLIFTP

SEQ ID NO: 176904 - protein, 9 aa, Homo Sapiens
RATKHALPR

SEQ ID NO: 176905 - protein, 9 aa, Homo Sapiens
ITHHPPVWA

SEQ ID NO: 176906 - protein, 9 aa, Homo Sapiens
KFWNCLSGF

SEQ ID NO: 176907 - protein, 9 aa, Homo Sapiens
NTSSKNGAL

SEQ ID NO: 176908 - protein, 9 aa, Homo Sapiens
LDKVFVVTD

SEQ ID NO: 176909 - protein, 9 aa, Homo Sapiens
FTTNNTSSV

SEQ ID NO: 176910 - protein, 9 aa, Homo Sapiens
RRDIRLVDA

SEQ ID NO: 176911 - protein, 9 aa, Homo Sapiens
AEDLSIFLS

SEQ ID NO: 176912 - protein, 9 aa, Homo Sapiens
LLAVELHLL

SEQ ID NO: 176913 - protein, 9 aa, Homo Sapiens
LCAGPSWKR

SEQ ID NO: 176914 - protein, 9 aa, Homo Sapiens
LICFLKMES

SEQ ID NO: 176915 - protein, 9 aa, Homo Sapiens
SVTGPDGVP

SEQ ID NO: 176916 - protein, 9 aa, Homo Sapiens
ERQPREPTK

SEQ ID NO: 176917 - protein, 9 aa, Homo Sapiens
SVGSSSVVS

SEQ ID NO: 176918 - protein, 9 aa, Homo Sapiens
RRPYDSAQL

SEQ ID NO: 176919 - protein, 9 aa, Homo Sapiens
NSHFTYSVT

SEQ ID NO: 176920 - protein, 9 aa, Homo Sapiens
HGRRHGLGP

SEQ ID NO: 176921 - protein, 9 aa, Homo Sapiens
QVAEDHVEM

SEQ ID NO: 176922 - protein, 9 aa, Homo Sapiens
LKARGQALA

SEQ ID NO: 176923 - protein, 9 aa, Homo Sapiens
RQVRYWAKG

SEQ ID NO: 176924 - protein, 9 aa, Homo Sapiens
WRRGDPGPP

SEQ ID NO: 176925 - protein, 9 aa, Homo Sapiens
TSVPGKKCG

SEQ ID NO: 176926 - protein, 9 aa, Homo Sapiens
RAASLLFSI

SEQ ID NO: 176927 - protein, 9 aa, Homo Sapiens
LLGHLSPPK

SEQ ID NO: 176928 - protein, 9 aa, Homo Sapiens
HKVDSECQA

SEQ ID NO: 176929 - protein, 9 aa, Homo Sapiens
LALKEDLLY

SEQ ID NO: 176930 - protein, 9 aa, Homo Sapiens
HKHHKHGKH

SEQ ID NO: 176931 - protein, 9 aa, Homo Sapiens
EKKVTWMKR

SEQ ID NO: 176932 - protein, 9 aa, Homo Sapiens
TSRSVVPGF

SEQ ID NO: 176933 - protein, 9 aa, Homo Sapiens
KMEPLNNMC

SEQ ID NO: 176934 - protein, 9 aa, Homo Sapiens
ASPCHPVWA

SEQ ID NO: 176935 - protein, 9 aa, Homo Sapiens
SGSWPPLLR

SEQ ID NO: 176936 - protein, 9 aa, Homo Sapiens
AVHADRMRG

SEQ ID NO: 176937 - protein, 9 aa, Homo Sapiens
GLDDRSPQA

SEQ ID NO: 176938 - protein, 9 aa, Homo Sapiens
DLQLLAREF

SEQ ID NO: 176939 - protein, 9 aa, Homo Sapiens
SQILICFLK

SEQ ID NO: 176940 - protein, 9 aa, Homo Sapiens
ADYYFLHHT

SEQ ID NO: 176941 - protein, 9 aa, Homo Sapiens
YSYENNTPY

SEQ ID NO: 176942 - protein, 9 aa, Homo Sapiens
SLQQWHLFR

SEQ ID NO: 176943 - protein, 9 aa, Homo Sapiens
ATTQTASRG

SEQ ID NO: 176944 - protein, 9 aa, Homo Sapiens
SVKGKLAPG

SEQ ID NO: 176945 - protein, 9 aa, Homo Sapiens
DGLLFCRVR

SEQ ID NO: 176946 - protein, 9 aa, Homo Sapiens
FPSPPSPTD

SEQ ID NO: 176947 - protein, 9 aa, Homo Sapiens
YAFVIQRLP

SEQ ID NO: 176948 - protein, 9 aa, Homo Sapiens
GDPGPPFPP

SEQ ID NO: 176949 - protein, 9 aa, Homo Sapiens
APARMMSLG

SEQ ID NO: 176950 - protein, 9 aa, Homo Sapiens
FQAMDSFLR

SEQ ID NO: 176951 - protein, 9 aa, Homo Sapiens
LRMQNAAKE

SEQ ID NO: 176952 - protein, 9 aa, Homo Sapiens
WCGKVPRKD

SEQ ID NO: 176953 - protein, 9 aa, Homo Sapiens
LSLRFRLPG

SEQ ID NO: 176954 - protein, 9 aa, Homo Sapiens
TLTSVPGKK

SEQ ID NO: 176955 - protein, 9 aa, Homo Sapiens
WRKSWGRWC

SEQ ID NO: 176956 - protein, 9 aa, Homo Sapiens
TFAYLLVIM

SEQ ID NO: 176957 - protein, 9 aa, Homo Sapiens
HRHCHPRSR

SEQ ID NO: 176958 - protein, 9 aa, Homo Sapiens
LLPQALCLL

SEQ ID NO: 176959 - protein, 9 aa, Homo Sapiens
ARPEQVPRA

SEQ ID NO: 176960 - protein, 9 aa, Homo Sapiens
RDMWDSREM

SEQ ID NO: 176961 - protein, 9 aa, Homo Sapiens
TFRCYSYEN

SEQ ID NO: 176962 - protein, 9 aa, Homo Sapiens
NAMAVLWPS

SEQ ID NO: 176963 - protein, 9 aa, Homo Sapiens
NWSNCSDLK

SEQ ID NO: 176964 - protein, 9 aa, Homo Sapiens
GGVGRRCLT

SEQ ID NO: 176965 - protein, 9 aa, Homo Sapiens
PRKLHSDLE

SEQ ID NO: 176966 - protein, 9 aa, Homo Sapiens
EFQTTVAKS

SEQ ID NO: 176967 - protein, 9 aa, Homo Sapiens
GHTAQENDD

SEQ ID NO: 176968 - protein, 9 aa, Homo Sapiens
GNQTSFAIR

SEQ ID NO: 176969 - protein, 9 aa, Homo Sapiens
EKAELKKVV

SEQ ID NO: 176970 - protein, 9 aa, Homo Sapiens
LNPPPPLTL

SEQ ID NO: 176971 - protein, 9 aa, Homo Sapiens
QKFMEDLKE

SEQ ID NO: 176972 - protein, 9 aa, Homo Sapiens
RGAGGMRMS

SEQ ID NO: 176973 - protein, 9 aa, Homo Sapiens
SEEKKFHKT

SEQ ID NO: 176974 - protein, 9 aa, Homo Sapiens
LLEADPIKH

SEQ ID NO: 176975 - protein, 9 aa, Homo Sapiens
HLLLPLLLE

SEQ ID NO: 176976 - protein, 9 aa, Homo Sapiens
SQETLVLPS

SEQ ID NO: 176977 - protein, 9 aa, Homo Sapiens
FPSTHLTPY

SEQ ID NO: 176978 - protein, 9 aa, Homo Sapiens
KLQLTNSDI

SEQ ID NO: 176979 - protein, 9 aa, Homo Sapiens
QPRWGQRAL

SEQ ID NO: 176980 - protein, 9 aa, Homo Sapiens
GILALYGGL

SEQ ID NO: 176981 - protein, 9 aa, Homo Sapiens
SASFFDIEE

SEQ ID NO: 176982 - protein, 9 aa, Homo Sapiens
PQRTVPRCS

SEQ ID NO: 176983 - protein, 9 aa, Homo Sapiens
KILENTVPA

SEQ ID NO: 176984 - protein, 9 aa, Homo Sapiens
PTTLNSIDS

SEQ ID NO: 176985 - protein, 9 aa, Homo Sapiens
LRDQWNWLD

SEQ ID NO: 176986 - protein, 9 aa, Homo Sapiens
PRPRSCVVD

SEQ ID NO: 176987 - protein, 9 aa, Homo Sapiens
AEEKFIKRG

SEQ ID NO: 176988 - protein, 9 aa, Homo Sapiens
PLPFSTVRL

SEQ ID NO: 176989 - protein, 9 aa, Homo Sapiens
YGKEIDTKR

SEQ ID NO: 176990 - protein, 9 aa, Homo Sapiens
EEVLPIIPS

SEQ ID NO: 176991 - protein, 9 aa, Homo Sapiens
ASSTLYWKA

SEQ ID NO: 176992 - protein, 9 aa, Homo Sapiens
YQMHLRSFL

SEQ ID NO: 176993 - protein, 9 aa, Homo Sapiens
GAHINPAMT

SEQ ID NO: 176994 - protein, 9 aa, Homo Sapiens
GKGKEKKVP

SEQ ID NO: 176995 - protein, 9 aa, Homo Sapiens
TRPQSTCAR

SEQ ID NO: 176996 - protein, 9 aa, Homo Sapiens
ACGIRTSLL

SEQ ID NO: 176997 - protein, 9 aa, Homo Sapiens
HHELYFKNL

SEQ ID NO: 176998 - protein, 9 aa, Homo Sapiens
SWHDPHPWR

SEQ ID NO: 176999 - protein, 9 aa, Homo Sapiens
FRQESQTRR

SEQ ID NO: 177000 - protein, 9 aa, Homo Sapiens
LSSSPSALP

SEQ ID NO: 177001 - protein, 9 aa, Homo Sapiens
ARIGAVKCK

SEQ ID NO: 177002 - protein, 9 aa, Homo Sapiens
PLNTSSKNG

SEQ ID NO: 177003 - protein, 9 aa, Homo Sapiens
AEEEKWLSA

SEQ ID NO: 177004 - protein, 9 aa, Homo Sapiens
EDQRDCKEV

SEQ ID NO: 177005 - protein, 9 aa, Homo Sapiens
NMGGTGLFV

SEQ ID NO: 177006 - protein, 9 aa, Homo Sapiens
DSIIGPQLT

SEQ ID NO: 177007 - protein, 9 aa, Homo Sapiens
RRCLTRAPQ

SEQ ID NO: 177008 - protein, 9 aa, Homo Sapiens
ALCNLDHLG

SEQ ID NO: 177009 - protein, 9 aa, Homo Sapiens
ICVMPLGPG

SEQ ID NO: 177010 - protein, 9 aa, Homo Sapiens
RGSSSSVFG

SEQ ID NO: 177011 - protein, 9 aa, Homo Sapiens
LTSVPGKKC

SEQ ID NO: 177012 - protein, 9 aa, Homo Sapiens
GRKETRPQL

SEQ ID NO: 177013 - protein, 9 aa, Homo Sapiens
QDYGKMAVM

SEQ ID NO: 177014 - protein, 9 aa, Homo Sapiens
PKLHCHEIN

SEQ ID NO: 177015 - protein, 9 aa, Homo Sapiens
ASAASCASG

SEQ ID NO: 177016 - protein, 9 aa, Homo Sapiens
PASAVSTAA

SEQ ID NO: 177017 - protein, 9 aa, Homo Sapiens
LLYYQYMNP

SEQ ID NO: 177018 - protein, 9 aa, Homo Sapiens
SLDPTITCS

SEQ ID NO: 177019 - protein, 9 aa, Homo Sapiens
LRNHLNTHR

SEQ ID NO: 177020 - protein, 9 aa, Homo Sapiens
LLLLARASP

SEQ ID NO: 177021 - protein, 9 aa, Homo Sapiens
AKIKKKTGS

SEQ ID NO: 177022 - protein, 9 aa, Homo Sapiens
LRKQPQGPS

SEQ ID NO: 177023 - protein, 9 aa, Homo Sapiens
QRTLIEALV

SEQ ID NO: 177024 - protein, 9 aa, Homo Sapiens
CPHSPKPVA

SEQ ID NO: 177025 - protein, 9 aa, Homo Sapiens
DHRWVLIAA

SEQ ID NO: 177026 - protein, 9 aa, Homo Sapiens
SRGSIYHNV

SEQ ID NO: 177027 - protein, 9 aa, Homo Sapiens
RASWLTRHR

SEQ ID NO: 177028 - protein, 9 aa, Homo Sapiens
SVLCTHHTN

SEQ ID NO: 177029 - protein, 9 aa, Homo Sapiens
QEVVEMWKK

SEQ ID NO: 177030 - protein, 9 aa, Homo Sapiens
WAKTFLQQE

SEQ ID NO: 177031 - protein, 9 aa, Homo Sapiens
AAAAAIRWL

SEQ ID NO: 177032 - protein, 9 aa, Homo Sapiens
LSQEALYWM

SEQ ID NO: 177033 - protein, 9 aa, Homo Sapiens
PVPRLPRAG

SEQ ID NO: 177034 - protein, 9 aa, Homo Sapiens
ESPKLHCHE

SEQ ID NO: 177035 - protein, 9 aa, Homo Sapiens
LLELCAQRL

SEQ ID NO: 177036 - protein, 9 aa, Homo Sapiens
APGRVMLSP

SEQ ID NO: 177037 - protein, 9 aa, Homo Sapiens
AGQASAAAP

SEQ ID NO: 177038 - protein, 9 aa, Homo Sapiens
SSNRLWMEF

SEQ ID NO: 177039 - protein, 9 aa, Homo Sapiens
TKDCDYIDF

SEQ ID NO: 177040 - protein, 9 aa, Homo Sapiens
SMAVCLTLC

SEQ ID NO: 177041 - protein, 9 aa, Homo Sapiens
SHHHPLTVQ

SEQ ID NO: 177042 - protein, 9 aa, Homo Sapiens
PPGAREEKQ

SEQ ID NO: 177043 - protein, 9 aa, Homo Sapiens
KQGNDGRVS

SEQ ID NO: 177044 - protein, 9 aa, Homo Sapiens
ASWRACCPL

SEQ ID NO: 177045 - protein, 9 aa, Homo Sapiens
FEDDPYGAR

SEQ ID NO: 177046 - protein, 9 aa, Homo Sapiens
YFEPYLGCI

SEQ ID NO: 177047 - protein, 9 aa, Homo Sapiens
ETWLWDLFH

SEQ ID NO: 177048 - protein, 9 aa, Homo Sapiens
GFESTVEKL

SEQ ID NO: 177049 - protein, 9 aa, Homo Sapiens
THAKLPGPA

SEQ ID NO: 177050 - protein, 9 aa, Homo Sapiens
VLLGHLSPP

SEQ ID NO: 177051 - protein, 9 aa, Homo Sapiens
NDDHPSLDD

SEQ ID NO: 177052 - protein, 9 aa, Homo Sapiens
DGLHDVKHF

SEQ ID NO: 177053 - protein, 9 aa, Homo Sapiens
DCKKIRAST

SEQ ID NO: 177054 - protein, 9 aa, Homo Sapiens
VIDNYLYIC

SEQ ID NO: 177055 - protein, 9 aa, Homo Sapiens
CQACLRRQE

SEQ ID NO: 177056 - protein, 9 aa, Homo Sapiens
RFLDTSNQH

SEQ ID NO: 177057 - protein, 9 aa, Homo Sapiens
VIPELLGHR

SEQ ID NO: 177058 - protein, 9 aa, Homo Sapiens
FLSEEKLCQ

SEQ ID NO: 177059 - protein, 9 aa, Homo Sapiens
QLPRCLLNI

SEQ ID NO: 177060 - protein, 9 aa, Homo Sapiens
SILRQEMLE

SEQ ID NO: 177061 - protein, 9 aa, Homo Sapiens
ETPKKKEAL

SEQ ID NO: 177062 - protein, 9 aa, Homo Sapiens
PTKMWHQSR

SEQ ID NO: 177063 - protein, 9 aa, Homo Sapiens
EYQLRLTDM

SEQ ID NO: 177064 - protein, 9 aa, Homo Sapiens
KIVAGYASH

SEQ ID NO: 177065 - protein, 9 aa, Homo Sapiens
LVKTWTQFR

SEQ ID NO: 177066 - protein, 9 aa, Homo Sapiens
PARMMSLGA

SEQ ID NO: 177067 - protein, 9 aa, Homo Sapiens
GKLVAYKCK

SEQ ID NO: 177068 - protein, 9 aa, Homo Sapiens
YEPPCASLC

SEQ ID NO: 177069 - protein, 9 aa, Homo Sapiens
ILNCQKAMD

SEQ ID NO: 177070 - protein, 9 aa, Homo Sapiens
PDPDHPWHQ

SEQ ID NO: 177071 - protein, 9 aa, Homo Sapiens
SLLAFGIVQ

SEQ ID NO: 177072 - protein, 9 aa, Homo Sapiens
PGGPSDSGK

SEQ ID NO: 177073 - protein, 9 aa, Homo Sapiens
RCEAFGWNI

SEQ ID NO: 177074 - protein, 9 aa, Homo Sapiens
HIGVAILQI

SEQ ID NO: 177075 - protein, 9 aa, Homo Sapiens
NHGQTSHKV

SEQ ID NO: 177076 - protein, 9 aa, Homo Sapiens
LHLLQILAH

SEQ ID NO: 177077 - protein, 9 aa, Homo Sapiens
FQGHHELYF

SEQ ID NO: 177078 - protein, 9 aa, Homo Sapiens
QAMSCGIPE

SEQ ID NO: 177079 - protein, 9 aa, Homo Sapiens
SRHLAEYVH

SEQ ID NO: 177080 - protein, 9 aa, Homo Sapiens
LTQCQSHCT

SEQ ID NO: 177081 - protein, 9 aa, Homo Sapiens
GPETALVSM

SEQ ID NO: 177082 - protein, 9 aa, Homo Sapiens
TDPCTGLTP

SEQ ID NO: 177083 - protein, 9 aa, Homo Sapiens
HDTCYSSDE

SEQ ID NO: 177084 - protein, 9 aa, Homo Sapiens
MRRTPTPAS

SEQ ID NO: 177085 - protein, 9 aa, Homo Sapiens
DVTTEISPE

SEQ ID NO: 177086 - protein, 9 aa, Homo Sapiens
EANNLAAAV

SEQ ID NO: 177087 - protein, 9 aa, Homo Sapiens
AGHQEVTTR

SEQ ID NO: 177088 - protein, 9 aa, Homo Sapiens
QRLLLLIKP

SEQ ID NO: 177089 - protein, 9 aa, Homo Sapiens
AYKCKPSSS

SEQ ID NO: 177090 - protein, 9 aa, Homo Sapiens
RASCEDGCA

SEQ ID NO: 177091 - protein, 9 aa, Homo Sapiens
IRHPRTVLS

SEQ ID NO: 177092 - protein, 9 aa, Homo Sapiens
AIRLLTQCQ

SEQ ID NO: 177093 - protein, 9 aa, Homo Sapiens
KETDALQKT

SEQ ID NO: 177094 - protein, 9 aa, Homo Sapiens
GAPPSRLSP

SEQ ID NO: 177095 - protein, 9 aa, Homo Sapiens
YVETGVADH

SEQ ID NO: 177096 - protein, 9 aa, Homo Sapiens
FTEAPKFPT

SEQ ID NO: 177097 - protein, 9 aa, Homo Sapiens
GMREMRAGG

SEQ ID NO: 177098 - protein, 9 aa, Homo Sapiens
FVLEAPVQD

SEQ ID NO: 177099 - protein, 9 aa, Homo Sapiens
AKQTRKVPE

SEQ ID NO: 177100 - protein, 9 aa, Homo Sapiens
SSPGSPCSR

SEQ ID NO: 177101 - protein, 9 aa, Homo Sapiens
VTEMRRTPT

SEQ ID NO: 177102 - protein, 9 aa, Homo Sapiens
AELKKVVQK

SEQ ID NO: 177103 - protein, 9 aa, Homo Sapiens
SAVSTAASM

SEQ ID NO: 177104 - protein, 9 aa, Homo Sapiens
RTFQDVTTE

SEQ ID NO: 177105 - protein, 9 aa, Homo Sapiens
LVLLLTLPC

SEQ ID NO: 177106 - protein, 9 aa, Homo Sapiens
EAIQVFHVR

SEQ ID NO: 177107 - protein, 9 aa, Homo Sapiens
QAVIDDAFA

SEQ ID NO: 177108 - protein, 9 aa, Homo Sapiens
RYPESHHDQ

SEQ ID NO: 177109 - protein, 9 aa, Homo Sapiens
GVGRTRAGP

SEQ ID NO: 177110 - protein, 9 aa, Homo Sapiens
CITDEIYQW

SEQ ID NO: 177111 - protein, 9 aa, Homo Sapiens
PFSLNSPNL

SEQ ID NO: 177112 - protein, 9 aa, Homo Sapiens
HQFPRSLLE

SEQ ID NO: 177113 - protein, 9 aa, Homo Sapiens
IMLESFNVP

SEQ ID NO: 177114 - protein, 9 aa, Homo Sapiens
EERRCDDPS

SEQ ID NO: 177115 - protein, 9 aa, Homo Sapiens
VDIWILLQP

SEQ ID NO: 177116 - protein, 9 aa, Homo Sapiens
QNKGERWTF

SEQ ID NO: 177117 - protein, 9 aa, Homo Sapiens
LLHNLAELP

SEQ ID NO: 177118 - protein, 9 aa, Homo Sapiens
YSRGSIYHN

SEQ ID NO: 177119 - protein, 9 aa, Homo Sapiens
LTCPRAVIL

SEQ ID NO: 177120 - protein, 9 aa, Homo Sapiens
EEGIRKCQG

SEQ ID NO: 177121 - protein, 9 aa, Homo Sapiens
NVPQLTDPT

SEQ ID NO: 177122 - protein, 9 aa, Homo Sapiens
TIIVGIMFF

SEQ ID NO: 177123 - protein, 9 aa, Homo Sapiens
WPPMDDVHR

SEQ ID NO: 177124 - protein, 9 aa, Homo Sapiens
EHPQSVVVG

SEQ ID NO: 177125 - protein, 9 aa, Homo Sapiens
TSTDEHLVK

SEQ ID NO: 177126 - protein, 9 aa, Homo Sapiens
DTWLVCRAI

SEQ ID NO: 177127 - protein, 9 aa, Homo Sapiens
CLSASARYT

SEQ ID NO: 177128 - protein, 9 aa, Homo Sapiens
GKKLVKISE

SEQ ID NO: 177129 - protein, 9 aa, Homo Sapiens
PPTATWAAA

SEQ ID NO: 177130 - protein, 9 aa, Homo Sapiens
PEGPAHPTV

SEQ ID NO: 177131 - protein, 9 aa, Homo Sapiens
KGLNQRLLL

SEQ ID NO: 177132 - protein, 9 aa, Homo Sapiens
LFLLIQFWD

SEQ ID NO: 177133 - protein, 9 aa, Homo Sapiens
LCKASDQPS

SEQ ID NO: 177134 - protein, 9 aa, Homo Sapiens
WAGSRIVWM

SEQ ID NO: 177135 - protein, 9 aa, Homo Sapiens
PKSLSQEAV

SEQ ID NO: 177136 - protein, 9 aa, Homo Sapiens
WLEQEEPRT

SEQ ID NO: 177137 - protein, 9 aa, Homo Sapiens
LFQVIPELL

SEQ ID NO: 177138 - protein, 9 aa, Homo Sapiens
VLSLNASGR

SEQ ID NO: 177139 - protein, 9 aa, Homo Sapiens
QAAAAAIRW

SEQ ID NO: 177140 - protein, 9 aa, Homo Sapiens
EVLGSVLCT

SEQ ID NO: 177141 - protein, 9 aa, Homo Sapiens
GQKGEKKAV

SEQ ID NO: 177142 - protein, 9 aa, Homo Sapiens
CATLIFFAI

SEQ ID NO: 177143 - protein, 9 aa, Homo Sapiens
EIQLTMNDS

SEQ ID NO: 177144 - protein, 9 aa, Homo Sapiens
LTLYITSRD

SEQ ID NO: 177145 - protein, 9 aa, Homo Sapiens
LRDTMARQL

SEQ ID NO: 177146 - protein, 9 aa, Homo Sapiens
APGCALRRC

SEQ ID NO: 177147 - protein, 9 aa, Homo Sapiens
HVPVGHLPS

SEQ ID NO: 177148 - protein, 9 aa, Homo Sapiens
QTRRGIKGT

SEQ ID NO: 177149 - protein, 9 aa, Homo Sapiens
ESNFPKKNY

SEQ ID NO: 177150 - protein, 9 aa, Homo Sapiens
TSQPRSLDS

SEQ ID NO: 177151 - protein, 9 aa, Homo Sapiens
IPSQPPTLP

SEQ ID NO: 177152 - protein, 9 aa, Homo Sapiens
TIGEKTEIQ

SEQ ID NO: 177153 - protein, 9 aa, Homo Sapiens
DILADLMPK

SEQ ID NO: 177154 - protein, 9 aa, Homo Sapiens
FAQNFTTNN

SEQ ID NO: 177155 - protein, 9 aa, Homo Sapiens
PTPLTLSQE

SEQ ID NO: 177156 - protein, 9 aa, Homo Sapiens
QGEEVAVKI

SEQ ID NO: 177157 - protein, 9 aa, Homo Sapiens
TLSGSWPPL

SEQ ID NO: 177158 - protein, 9 aa, Homo Sapiens
VKDALHTTE

SEQ ID NO: 177159 - protein, 9 aa, Homo Sapiens
PCVLFVLKE

SEQ ID NO: 177160 - protein, 9 aa, Homo Sapiens
PEAVNMSMG

SEQ ID NO: 177161 - protein, 9 aa, Homo Sapiens
FRGFSVQLV

SEQ ID NO: 177162 - protein, 9 aa, Homo Sapiens
AHINPAMTV

SEQ ID NO: 177163 - protein, 9 aa, Homo Sapiens
EDDDDDDGD

SEQ ID NO: 177164 - protein, 9 aa, Homo Sapiens
MGWSVCGFS

SEQ ID NO: 177165 - protein, 9 aa, Homo Sapiens
RQEMLEPFL

SEQ ID NO: 177166 - protein, 9 aa, Homo Sapiens
ILVSVHLLE

SEQ ID NO: 177167 - protein, 9 aa, Homo Sapiens
KPVLLLPTQ

SEQ ID NO: 177168 - protein, 9 aa, Homo Sapiens
NAFLNMFVC

SEQ ID NO: 177169 - protein, 9 aa, Homo Sapiens
PVRHMPVAS

SEQ ID NO: 177170 - protein, 9 aa, Homo Sapiens
SFWTLLPTT

SEQ ID NO: 177171 - protein, 9 aa, Homo Sapiens
YLSVANVDL

SEQ ID NO: 177172 - protein, 9 aa, Homo Sapiens
TGAARWGLQ

SEQ ID NO: 177173 - protein, 9 aa, Homo Sapiens
LNASGRTTG

SEQ ID NO: 177174 - protein, 9 aa, Homo Sapiens
LRAVNLNLC

SEQ ID NO: 177175 - protein, 9 aa, Homo Sapiens
AMDERQEAT

SEQ ID NO: 177176 - protein, 9 aa, Homo Sapiens
LAGWMRVQD

SEQ ID NO: 177177 - protein, 9 aa, Homo Sapiens
LYLIAICHH

SEQ ID NO: 177178 - protein, 9 aa, Homo Sapiens
FISFQAMDS

SEQ ID NO: 177179 - protein, 9 aa, Homo Sapiens
QRPPRSILS

SEQ ID NO: 177180 - protein, 9 aa, Homo Sapiens
PLRASWLTR

SEQ ID NO: 177181 - protein, 9 aa, Homo Sapiens
AGRGQAHAV

SEQ ID NO: 177182 - protein, 9 aa, Homo Sapiens
KKTVLRMPM

SEQ ID NO: 177183 - protein, 9 aa, Homo Sapiens
VIRHPRTVL

SEQ ID NO: 177184 - protein, 9 aa, Homo Sapiens
RAIMVGVKG

SEQ ID NO: 177185 - protein, 9 aa, Homo Sapiens
RRGPLGGRE

SEQ ID NO: 177186 - protein, 9 aa, Homo Sapiens
NRGVQQVSE

SEQ ID NO: 177187 - protein, 9 aa, Homo Sapiens
SSTGNASGT

SEQ ID NO: 177188 - protein, 9 aa, Homo Sapiens
FGSMVRRAA

SEQ ID NO: 177189 - protein, 9 aa, Homo Sapiens
SPKPVAAST

SEQ ID NO: 177190 - protein, 9 aa, Homo Sapiens
QVITSFRIL

SEQ ID NO: 177191 - protein, 9 aa, Homo Sapiens
PLLLVYIMS

SEQ ID NO: 177192 - protein, 9 aa, Homo Sapiens
WSTISCPRP

SEQ ID NO: 177193 - protein, 9 aa, Homo Sapiens
AFDRKALTR

SEQ ID NO: 177194 - protein, 9 aa, Homo Sapiens
TPSSSGATG

SEQ ID NO: 177195 - protein, 9 aa, Homo Sapiens
AQMLGGLGV

SEQ ID NO: 177196 - protein, 9 aa, Homo Sapiens
SLLLSHQQL

SEQ ID NO: 177197 - protein, 9 aa, Homo Sapiens
PDSQETLVL

SEQ ID NO: 177198 - protein, 9 aa, Homo Sapiens
LYLRTSGEP

SEQ ID NO: 177199 - protein, 9 aa, Homo Sapiens
LGGWHGFPG

SEQ ID NO: 177200 - protein, 9 aa, Homo Sapiens
VVRGLGEGS

SEQ ID NO: 177201 - protein, 9 aa, Homo Sapiens
TCSFNSSLF

SEQ ID NO: 177202 - protein, 9 aa, Homo Sapiens
GQTIEHMGS

SEQ ID NO: 177203 - protein, 9 aa, Homo Sapiens
WGKTEPVAG

SEQ ID NO: 177204 - protein, 9 aa, Homo Sapiens
AGSRIVWMP

SEQ ID NO: 177205 - protein, 9 aa, Homo Sapiens
ADKWDKTTM

SEQ ID NO: 177206 - protein, 9 aa, Homo Sapiens
INEELFNIL

SEQ ID NO: 177207 - protein, 9 aa, Homo Sapiens
DAGRKRGLG

SEQ ID NO: 177208 - protein, 9 aa, Homo Sapiens
KTAQFGQEL

SEQ ID NO: 177209 - protein, 9 aa, Homo Sapiens
FAIRKLTQA

SEQ ID NO: 177210 - protein, 9 aa, Homo Sapiens
IQVIQEDGM

SEQ ID NO: 177211 - protein, 9 aa, Homo Sapiens
HSARQQPCE

SEQ ID NO: 177212 - protein, 9 aa, Homo Sapiens
QPNSTAATN

SEQ ID NO: 177213 - protein, 9 aa, Homo Sapiens
RRPLKKWPT

SEQ ID NO: 177214 - protein, 9 aa, Homo Sapiens
SPSALPCAQ

SEQ ID NO: 177215 - protein, 9 aa, Homo Sapiens
SQNWSSQKW

SEQ ID NO: 177216 - protein, 9 aa, Homo Sapiens
PEDFEFGKI

SEQ ID NO: 177217 - protein, 9 aa, Homo Sapiens
NIFSNMFSS

SEQ ID NO: 177218 - protein, 9 aa, Homo Sapiens
WCPFVELVA

SEQ ID NO: 177219 - protein, 9 aa, Homo Sapiens
CSARPEQVP

SEQ ID NO: 177220 - protein, 9 aa, Homo Sapiens
GAVSPRQTP

SEQ ID NO: 177221 - protein, 9 aa, Homo Sapiens
QDHYETDHT

SEQ ID NO: 177222 - protein, 9 aa, Homo Sapiens
EGALYEIGA

SEQ ID NO: 177223 - protein, 9 aa, Homo Sapiens
KSPIVHVPT

SEQ ID NO: 177224 - protein, 9 aa, Homo Sapiens
IYGKEIDTK

SEQ ID NO: 177225 - protein, 9 aa, Homo Sapiens
GHLSPPKQP

SEQ ID NO: 177226 - protein, 9 aa, Homo Sapiens
GERAMQRLQ

SEQ ID NO: 177227 - protein, 9 aa, Homo Sapiens
HGQTSHKVL

SEQ ID NO: 177228 - protein, 9 aa, Homo Sapiens
GAGASCANL

SEQ ID NO: 177229 - protein, 9 aa, Homo Sapiens
AEKVMAHVP

SEQ ID NO: 177230 - protein, 9 aa, Homo Sapiens
LVRGDIFRP

SEQ ID NO: 177231 - protein, 9 aa, Homo Sapiens
PLSLQCQSL

SEQ ID NO: 177232 - protein, 9 aa, Homo Sapiens
RCFCTRAVL

SEQ ID NO: 177233 - protein, 9 aa, Homo Sapiens
GFNKKCKKN

SEQ ID NO: 177234 - protein, 9 aa, Homo Sapiens
DMMGHRSDY

SEQ ID NO: 177235 - protein, 9 aa, Homo Sapiens
KKFHKTCKK

SEQ ID NO: 177236 - protein, 9 aa, Homo Sapiens
FAAAKDTIL

SEQ ID NO: 177237 - protein, 9 aa, Homo Sapiens
KALVSGKPT

SEQ ID NO: 177238 - protein, 9 aa, Homo Sapiens
ETSPTATPT

SEQ ID NO: 177239 - protein, 9 aa, Homo Sapiens
IKPSRMCKY

SEQ ID NO: 177240 - protein, 9 aa, Homo Sapiens
HTTENKLLD

SEQ ID NO: 177241 - protein, 9 aa, Homo Sapiens
QVDRLQPEP

SEQ ID NO: 177242 - protein, 9 aa, Homo Sapiens
MGLSLASTT

SEQ ID NO: 177243 - protein, 9 aa, Homo Sapiens
GAGVSLRKE

SEQ ID NO: 177244 - protein, 9 aa, Homo Sapiens
ASPGAWGGA

SEQ ID NO: 177245 - protein, 9 aa, Homo Sapiens
CTFFFLHKE

SEQ ID NO: 177246 - protein, 9 aa, Homo Sapiens
SEQETEPPL

SEQ ID NO: 177247 - protein, 9 aa, Homo Sapiens
LVTLRHHKY

SEQ ID NO: 177248 - protein, 9 aa, Homo Sapiens
SGAGGGSHL

SEQ ID NO: 177249 - protein, 9 aa, Homo Sapiens
FACSYPMDM

SEQ ID NO: 177250 - protein, 9 aa, Homo Sapiens
VSHYKCPLC

SEQ ID NO: 177251 - protein, 9 aa, Homo Sapiens
QRLCKASDQ

SEQ ID NO: 177252 - protein, 9 aa, Homo Sapiens
FDRKALTRE

SEQ ID NO: 177253 - protein, 9 aa, Homo Sapiens
KATKQRHWD

SEQ ID NO: 177254 - protein, 9 aa, Homo Sapiens
RCPAAEPGL

SEQ ID NO: 177255 - protein, 9 aa, Homo Sapiens
IDCFFVQVE

SEQ ID NO: 177256 - protein, 9 aa, Homo Sapiens
TLETKQPCQ

SEQ ID NO: 177257 - protein, 9 aa, Homo Sapiens
KVTDLVSDF

SEQ ID NO: 177258 - protein, 9 aa, Homo Sapiens
NLTDTGCYT

SEQ ID NO: 177259 - protein, 9 aa, Homo Sapiens
PRRPHRHCH

SEQ ID NO: 177260 - protein, 9 aa, Homo Sapiens
QAPGHRRNP

SEQ ID NO: 177261 - protein, 9 aa, Homo Sapiens
RPAGKESRS

SEQ ID NO: 177262 - protein, 9 aa, Homo Sapiens
PFFQSPGSM

SEQ ID NO: 177263 - protein, 9 aa, Homo Sapiens
HGSAYLTIQ

SEQ ID NO: 177264 - protein, 9 aa, Homo Sapiens
WEVTPRSIH

SEQ ID NO: 177265 - protein, 9 aa, Homo Sapiens
KLHCHEINC

SEQ ID NO: 177266 - protein, 9 aa, Homo Sapiens
KKINNQIIV

SEQ ID NO: 177267 - protein, 9 aa, Homo Sapiens
HLLLLCRWD

SEQ ID NO: 177268 - protein, 9 aa, Homo Sapiens
GRVMLSPCH

SEQ ID NO: 177269 - protein, 9 aa, Homo Sapiens
GQDPGVVRG

SEQ ID NO: 177270 - protein, 9 aa, Homo Sapiens
ETEKKTQWE

SEQ ID NO: 177271 - protein, 9 aa, Homo Sapiens
GHFVPVLGF

SEQ ID NO: 177272 - protein, 9 aa, Homo Sapiens
ACVNYSECQ

SEQ ID NO: 177273 - protein, 9 aa, Homo Sapiens
APASSPTCS

SEQ ID NO: 177274 - protein, 9 aa, Homo Sapiens
PLKVAPGRV

SEQ ID NO: 177275 - protein, 9 aa, Homo Sapiens
AVELSPENT

SEQ ID NO: 177276 - protein, 9 aa, Homo Sapiens
GNNMGWSVC

SEQ ID NO: 177277 - protein, 9 aa, Homo Sapiens
SLQTHPREA

SEQ ID NO: 177278 - protein, 9 aa, Homo Sapiens
FVPRSGLGV

SEQ ID NO: 177279 - protein, 9 aa, Homo Sapiens
PSTNLAYTT

SEQ ID NO: 177280 - protein, 9 aa, Homo Sapiens
WRPFHFQHL

SEQ ID NO: 177281 - protein, 9 aa, Homo Sapiens
DHLPATPRD

SEQ ID NO: 177282 - protein, 9 aa, Homo Sapiens
RSALLPRHP

SEQ ID NO: 177283 - protein, 9 aa, Homo Sapiens
RKELGVNLL

SEQ ID NO: 177284 - protein, 9 aa, Homo Sapiens
IQPNSAPSV

SEQ ID NO: 177285 - protein, 9 aa, Homo Sapiens
GAAGEQGPG

SEQ ID NO: 177286 - protein, 9 aa, Homo Sapiens
PFTCISWML

SEQ ID NO: 177287 - protein, 9 aa, Homo Sapiens
GWQCMVGNS

SEQ ID NO: 177288 - protein, 9 aa, Homo Sapiens
EALEEANIL

SEQ ID NO: 177289 - protein, 9 aa, Homo Sapiens
PKPKNDVHQ

SEQ ID NO: 177290 - protein, 9 aa, Homo Sapiens
ASPPTQQPQ

SEQ ID NO: 177291 - protein, 9 aa, Homo Sapiens
ILEQRNMPT

SEQ ID NO: 177292 - protein, 9 aa, Homo Sapiens
DSEELDWRA

SEQ ID NO: 177293 - protein, 9 aa, Homo Sapiens
SSPKGVPFS

SEQ ID NO: 177294 - protein, 9 aa, Homo Sapiens
ITHHAHLQG

SEQ ID NO: 177295 - protein, 9 aa, Homo Sapiens
AFTTGAARW

SEQ ID NO: 177296 - protein, 9 aa, Homo Sapiens
QGQFIPSQP

SEQ ID NO: 177297 - protein, 9 aa, Homo Sapiens
SNFPKKNYK

SEQ ID NO: 177298 - protein, 9 aa, Homo Sapiens
SLGEQGPLE

SEQ ID NO: 177299 - protein, 9 aa, Homo Sapiens
VKALIVVHL

SEQ ID NO: 177300 - protein, 9 aa, Homo Sapiens
PRDTARGRP

SEQ ID NO: 177301 - protein, 9 aa, Homo Sapiens
SHLTVVVLQ

SEQ ID NO: 177302 - protein, 9 aa, Homo Sapiens
LDDIAHVLW

SEQ ID NO: 177303 - protein, 9 aa, Homo Sapiens
HQNSERQLP

SEQ ID NO: 177304 - protein, 9 aa, Homo Sapiens
LRQVRYWAK

SEQ ID NO: 177305 - protein, 9 aa, Homo Sapiens
AFLPHVECG

SEQ ID NO: 177306 - protein, 9 aa, Homo Sapiens
PTTSRRRPS

SEQ ID NO: 177307 - protein, 9 aa, Homo Sapiens
TSSKNGALF

SEQ ID NO: 177308 - protein, 9 aa, Homo Sapiens
EEGLGQLPK

SEQ ID NO: 177309 - protein, 9 aa, Homo Sapiens
SRSVVPGFQ

SEQ ID NO: 177310 - protein, 9 aa, Homo Sapiens
SSLWSTPAP

SEQ ID NO: 177311 - protein, 9 aa, Homo Sapiens
PLGPHEEVL

SEQ ID NO: 177312 - protein, 9 aa, Homo Sapiens
LPRCLLNIG

SEQ ID NO: 177313 - protein, 9 aa, Homo Sapiens
AAHIYPLPF

SEQ ID NO: 177314 - protein, 9 aa, Homo Sapiens
DVVLEKATH

SEQ ID NO: 177315 - protein, 9 aa, Homo Sapiens
WRSSKERIE

SEQ ID NO: 177316 - protein, 9 aa, Homo Sapiens
CVTACPWAT

SEQ ID NO: 177317 - protein, 9 aa, Homo Sapiens
GSSSVVSQT

SEQ ID NO: 177318 - protein, 9 aa, Homo Sapiens
HLNTHRYSS

SEQ ID NO: 177319 - protein, 9 aa, Homo Sapiens
SERLQYEKS

SEQ ID NO: 177320 - protein, 9 aa, Homo Sapiens
WHGFPGPWG

SEQ ID NO: 177321 - protein, 9 aa, Homo Sapiens
TGMLEFEGG

SEQ ID NO: 177322 - protein, 9 aa, Homo Sapiens
AFKTKDCDY

SEQ ID NO: 177323 - protein, 9 aa, Homo Sapiens
VHLLPSMCC

SEQ ID NO: 177324 - protein, 8 aa, Homo Sapiens
ATSAVPSD

SEQ ID NO: 177325 - protein, 9 aa, Homo Sapiens
QDICYYNFI

SEQ ID NO: 177326 - protein, 9 aa, Homo Sapiens
LRDEVVRAQ

SEQ ID NO: 177327 - protein, 9 aa, Homo Sapiens
QCFRNIFSN

SEQ ID NO: 177328 - protein, 9 aa, Homo Sapiens
HITHHAHLQ

SEQ ID NO: 177329 - protein, 9 aa, Homo Sapiens
IMPSNACFA

SEQ ID NO: 177330 - protein, 9 aa, Homo Sapiens
QALGGERDK

SEQ ID NO: 177331 - protein, 9 aa, Homo Sapiens
FGNQSIITL

SEQ ID NO: 177332 - protein, 9 aa, Homo Sapiens
LGAAGRHRV

SEQ ID NO: 177333 - protein, 9 aa, Homo Sapiens
NFRRCCWYC

SEQ ID NO: 177334 - protein, 9 aa, Homo Sapiens
SIRCRLSSK

SEQ ID NO: 177335 - protein, 9 aa, Homo Sapiens
AAPGAPSLG

SEQ ID NO: 177336 - protein, 9 aa, Homo Sapiens
PITDQQLIE

SEQ ID NO: 177337 - protein, 9 aa, Homo Sapiens
NLYRKEGLS

SEQ ID NO: 177338 - protein, 9 aa, Homo Sapiens
WPKREHGDP

SEQ ID NO: 177339 - protein, 9 aa, Homo Sapiens
SFLLTGGKM

SEQ ID NO: 177340 - protein, 9 aa, Homo Sapiens
AAGRQRAHG

SEQ ID NO: 177341 - protein, 9 aa, Homo Sapiens
IYQWMVYDG

SEQ ID NO: 177342 - protein, 9 aa, Homo Sapiens
SVHLDGLLF

SEQ ID NO: 177343 - protein, 9 aa, Homo Sapiens
RKQPQGPSC

SEQ ID NO: 177344 - protein, 9 aa, Homo Sapiens
AWDSEDFGS

SEQ ID NO: 177345 - protein, 9 aa, Homo Sapiens
CSLYGKKLV

SEQ ID NO: 177346 - protein, 9 aa, Homo Sapiens
MFGEGMTCS

SEQ ID NO: 177347 - protein, 9 aa, Homo Sapiens
PSVTSQPRS

SEQ ID NO: 177348 - protein, 9 aa, Homo Sapiens
AQRLQAQMD

SEQ ID NO: 177349 - protein, 9 aa, Homo Sapiens
AVQDGLRTH

SEQ ID NO: 177350 - protein, 9 aa, Homo Sapiens
VALCKFHSV

SEQ ID NO: 177351 - protein, 9 aa, Homo Sapiens
PENQVLGQY

SEQ ID NO: 177352 - protein, 9 aa, Homo Sapiens
DLLAGWMRV

SEQ ID NO: 177353 - protein, 9 aa, Homo Sapiens
GTTPPRAEV

SEQ ID NO: 177354 - protein, 9 aa, Homo Sapiens
GLVLQLDGR

SEQ ID NO: 177355 - protein, 9 aa, Homo Sapiens
SWPRVRCAR

SEQ ID NO: 177356 - protein, 9 aa, Homo Sapiens
TNLAYTTAW

SEQ ID NO: 177357 - protein, 9 aa, Homo Sapiens
QCMVGNSYH

SEQ ID NO: 177358 - protein, 9 aa, Homo Sapiens
GSLAHQNSE

SEQ ID NO: 177359 - protein, 9 aa, Homo Sapiens
PPQKRVDSP

SEQ ID NO: 177360 - protein, 9 aa, Homo Sapiens
LWQTLTTQT

SEQ ID NO: 177361 - protein, 9 aa, Homo Sapiens
ETIGKRLAT

SEQ ID NO: 177362 - protein, 9 aa, Homo Sapiens
PSSIQQMEI

SEQ ID NO: 177363 - protein, 9 aa, Homo Sapiens
PGPCVTACP

SEQ ID NO: 177364 - protein, 9 aa, Homo Sapiens
VCSADESLS

SEQ ID NO: 177365 - protein, 9 aa, Homo Sapiens
EEVDPDEVL

SEQ ID NO: 177366 - protein, 9 aa, Homo Sapiens
REEKIDRCI

SEQ ID NO: 177367 - protein, 9 aa, Homo Sapiens
KEMAHPNEE

SEQ ID NO: 177368 - protein, 9 aa, Homo Sapiens
KSNPFCVLF

SEQ ID NO: 177369 - protein, 9 aa, Homo Sapiens
VWTLQRSMA

SEQ ID NO: 177370 - protein, 9 aa, Homo Sapiens
ATSLPRPPR

SEQ ID NO: 177371 - protein, 9 aa, Homo Sapiens
CAEGNGRPS

SEQ ID NO: 177372 - protein, 9 aa, Homo Sapiens
SAYLTIQVM

SEQ ID NO: 177373 - protein, 9 aa, Homo Sapiens
TGCSLGSRL

SEQ ID NO: 177374 - protein, 9 aa, Homo Sapiens
ENIRPMWQL

SEQ ID NO: 177375 - protein, 9 aa, Homo Sapiens
QEKDNGFFL

SEQ ID NO: 177376 - protein, 9 aa, Homo Sapiens
VDEFEDMVA

SEQ ID NO: 177377 - protein, 9 aa, Homo Sapiens
LRRYRDTKG

SEQ ID NO: 177378 - protein, 9 aa, Homo Sapiens
NSVYMWSAS

SEQ ID NO: 177379 - protein, 9 aa, Homo Sapiens
RVTPPPTSG

SEQ ID NO: 177380 - protein, 9 aa, Homo Sapiens
NEYQLRLTD

SEQ ID NO: 177381 - protein, 9 aa, Homo Sapiens
SLLVRRMRR

SEQ ID NO: 177382 - protein, 9 aa, Homo Sapiens
IYYFVVGGV

SEQ ID NO: 177383 - protein, 9 aa, Homo Sapiens
EVLERGLGL

SEQ ID NO: 177384 - protein, 9 aa, Homo Sapiens
QRDCKEVKE

SEQ ID NO: 177385 - protein, 9 aa, Homo Sapiens
SECQACLRR

SEQ ID NO: 177386 - protein, 9 aa, Homo Sapiens
EFWQQERSF

SEQ ID NO: 177387 - protein, 9 aa, Homo Sapiens
NAFTTGAAR

SEQ ID NO: 177388 - protein, 9 aa, Homo Sapiens
GGFPQPLLH

SEQ ID NO: 177389 - protein, 9 aa, Homo Sapiens
TIGSPVRLA

SEQ ID NO: 177390 - protein, 9 aa, Homo Sapiens
RSTWKGPEH

SEQ ID NO: 177391 - protein, 9 aa, Homo Sapiens
VNAMAVLWP

SEQ ID NO: 177392 - protein, 9 aa, Homo Sapiens
LVKTFATLN

SEQ ID NO: 177393 - protein, 9 aa, Homo Sapiens
YRQLSRLCR

SEQ ID NO: 177394 - protein, 9 aa, Homo Sapiens
QEFAGGVFS

SEQ ID NO: 177395 - protein, 9 aa, Homo Sapiens
FSPGLELVF

SEQ ID NO: 177396 - protein, 9 aa, Homo Sapiens
LGSTGCSLG

SEQ ID NO: 177397 - protein, 9 aa, Homo Sapiens
PQALKKFFL

SEQ ID NO: 177398 - protein, 9 aa, Homo Sapiens
EDGGFFEEK

SEQ ID NO: 177399 - protein, 9 aa, Homo Sapiens
AAICFRNAL

SEQ ID NO: 177400 - protein, 9 aa, Homo Sapiens
HALPRTGGL

SEQ ID NO: 177401 - protein, 9 aa, Homo Sapiens
QGTVLMKLL

SEQ ID NO: 177402 - protein, 9 aa, Homo Sapiens
YNGVIEEFW

SEQ ID NO: 177403 - protein, 9 aa, Homo Sapiens
LQLDGRNEL

SEQ ID NO: 177404 - protein, 9 aa, Homo Sapiens
DRAIMVGVK

SEQ ID NO: 177405 - protein, 9 aa, Homo Sapiens
SGAGASCAN

SEQ ID NO: 177406 - protein, 9 aa, Homo Sapiens
CFCTRAVLA

SEQ ID NO: 177407 - protein, 9 aa, Homo Sapiens
QKSHGRKSL

SEQ ID NO: 177408 - protein, 9 aa, Homo Sapiens
NQTSFAIRK

SEQ ID NO: 177409 - protein, 9 aa, Homo Sapiens
RRWSTISCP

SEQ ID NO: 177410 - protein, 9 aa, Homo Sapiens
AGRHRVITI

SEQ ID NO: 177411 - protein, 9 aa, Homo Sapiens
DVEEWGKLH

SEQ ID NO: 177412 - protein, 9 aa, Homo Sapiens
SPPSPTDHP

SEQ ID NO: 177413 - protein, 9 aa, Homo Sapiens
LVFALRAKL

SEQ ID NO: 177414 - protein, 9 aa, Homo Sapiens
HVSPQMISI

SEQ ID NO: 177415 - protein, 9 aa, Homo Sapiens
EVKEKAQAL

SEQ ID NO: 177416 - protein, 9 aa, Homo Sapiens
KTQKSKGLN

SEQ ID NO: 177417 - protein, 9 aa, Homo Sapiens
AVMMFAGFL

SEQ ID NO: 177418 - protein, 9 aa, Homo Sapiens
PIYADGYGT

SEQ ID NO: 177419 - protein, 9 aa, Homo Sapiens
GGPDAQLEE

SEQ ID NO: 177420 - protein, 9 aa, Homo Sapiens
KFTFPTVWE

SEQ ID NO: 177421 - protein, 9 aa, Homo Sapiens
HRVRVGEAV

SEQ ID NO: 177422 - protein, 9 aa, Homo Sapiens
QALKKFFLC

SEQ ID NO: 177423 - protein, 9 aa, Homo Sapiens
IGNTHLKYV

SEQ ID NO: 177424 - protein, 9 aa, Homo Sapiens
QSPGSMPFS

SEQ ID NO: 177425 - protein, 9 aa, Homo Sapiens
SSLVEKKLS

SEQ ID NO: 177426 - protein, 9 aa, Homo Sapiens
NHKDIAQDM

SEQ ID NO: 177427 - protein, 9 aa, Homo Sapiens
RKSSVCSAP

SEQ ID NO: 177428 - protein, 9 aa, Homo Sapiens
GVLSTPAVS

SEQ ID NO: 177429 - protein, 9 aa, Homo Sapiens
DLLSRIYLD

SEQ ID NO: 177430 - protein, 9 aa, Homo Sapiens
CGSPTTRSC

SEQ ID NO: 177431 - protein, 9 aa, Homo Sapiens
LLMSPQPLT

SEQ ID NO: 177432 - protein, 9 aa, Homo Sapiens
ERWTFISSE

SEQ ID NO: 177433 - protein, 9 aa, Homo Sapiens
QVMINEVDA

SEQ ID NO: 177434 - protein, 9 aa, Homo Sapiens
AAVLVKVIQ

SEQ ID NO: 177435 - protein, 9 aa, Homo Sapiens
RVGEAVVVD

SEQ ID NO: 177436 - protein, 9 aa, Homo Sapiens
EKSLNQPNL

SEQ ID NO: 177437 - protein, 9 aa, Homo Sapiens
PVPSKPRRG

SEQ ID NO: 177438 - protein, 9 aa, Homo Sapiens
LSWRAAGVR

SEQ ID NO: 177439 - protein, 9 aa, Homo Sapiens
VTHTAAAPG

SEQ ID NO: 177440 - protein, 9 aa, Homo Sapiens
EEEVKKEMA

SEQ ID NO: 177441 - protein, 9 aa, Homo Sapiens
RPPRSILSL

SEQ ID NO: 177442 - protein, 9 aa, Homo Sapiens
LGVCGEDGQ

SEQ ID NO: 177443 - protein, 9 aa, Homo Sapiens
EIMLESFNV

SEQ ID NO: 177444 - protein, 9 aa, Homo Sapiens
LCLLSWCGR

SEQ ID NO: 177445 - protein, 9 aa, Homo Sapiens
GGWICWRSR

SEQ ID NO: 177446 - protein, 9 aa, Homo Sapiens
FGLDRIVDI

SEQ ID NO: 177447 - protein, 9 aa, Homo Sapiens
PRHPTWRPF

SEQ ID NO: 177448 - protein, 9 aa, Homo Sapiens
QCAVCIGHR

SEQ ID NO: 177449 - protein, 9 aa, Homo Sapiens
SPSSAVAGG

SEQ ID NO: 177450 - protein, 9 aa, Homo Sapiens
VKGKLAPGF

SEQ ID NO: 177451 - protein, 9 aa, Homo Sapiens
VQQVSECAV

SEQ ID NO: 177452 - protein, 9 aa, Homo Sapiens
KTHKKAGDF

SEQ ID NO: 177453 - protein, 9 aa, Homo Sapiens
GYQALPWAR

SEQ ID NO: 177454 - protein, 9 aa, Homo Sapiens
SCRGASDSL

SEQ ID NO: 177455 - protein, 9 aa, Homo Sapiens
CTLSAEEGI

SEQ ID NO: 177456 - protein, 9 aa, Homo Sapiens
IQVEGPIKP

SEQ ID NO: 177457 - protein, 9 aa, Homo Sapiens
TLEFMMRQP

SEQ ID NO: 177458 - protein, 9 aa, Homo Sapiens
EPPGAREEK

SEQ ID NO: 177459 - protein, 9 aa, Homo Sapiens
SQCPSMEEI

SEQ ID NO: 177460 - protein, 9 aa, Homo Sapiens
IGPQLTVLA

SEQ ID NO: 177461 - protein, 9 aa, Homo Sapiens
KTETVEEQL

SEQ ID NO: 177462 - protein, 9 aa, Homo Sapiens
LRVVRIRAP

SEQ ID NO: 177463 - protein, 9 aa, Homo Sapiens
SVGNQTSFA

SEQ ID NO: 177464 - protein, 9 aa, Homo Sapiens
NLDAVETLG

SEQ ID NO: 177465 - protein, 9 aa, Homo Sapiens
QEVFQAERL

SEQ ID NO: 177466 - protein, 9 aa, Homo Sapiens
EQEQPRRKH

SEQ ID NO: 177467 - protein, 9 aa, Homo Sapiens
SVGNKHRDS

SEQ ID NO: 177468 - protein, 9 aa, Homo Sapiens
RVSETGKGL

SEQ ID NO: 177469 - protein, 9 aa, Homo Sapiens
YYYSWKKNS

SEQ ID NO: 177470 - protein, 9 aa, Homo Sapiens
STAASMKMN

SEQ ID NO: 177471 - protein, 9 aa, Homo Sapiens
PQLLCQNPE

SEQ ID NO: 177472 - protein, 9 aa, Homo Sapiens
PERRHSSSS

SEQ ID NO: 177473 - protein, 9 aa, Homo Sapiens
PAPRPASDG

SEQ ID NO: 177474 - protein, 9 aa, Homo Sapiens
GLINKKCYG

SEQ ID NO: 177475 - protein, 9 aa, Homo Sapiens
FGMRVQEYG

SEQ ID NO: 177476 - protein, 9 aa, Homo Sapiens
ELEVVPNIP

SEQ ID NO: 177477 - protein, 9 aa, Homo Sapiens
LSIFLSTRC

SEQ ID NO: 177478 - protein, 9 aa, Homo Sapiens
SLCLKTPPK

SEQ ID NO: 177479 - protein, 9 aa, Homo Sapiens
PATEFLSLR

SEQ ID NO: 177480 - protein, 9 aa, Homo Sapiens
YPVPGGPSD

SEQ ID NO: 177481 - protein, 9 aa, Homo Sapiens
GKITFYILV

SEQ ID NO: 177482 - protein, 9 aa, Homo Sapiens
SRLSPPEAA

SEQ ID NO: 177483 - protein, 9 aa, Homo Sapiens
RINSAVCSA

SEQ ID NO: 177484 - protein, 9 aa, Homo Sapiens
PEPESIRKW

SEQ ID NO: 177485 - protein, 9 aa, Homo Sapiens
VQRIPKVGL

SEQ ID NO: 177486 - protein, 9 aa, Homo Sapiens
EGEKLHGDS

SEQ ID NO: 177487 - protein, 9 aa, Homo Sapiens
ARRQSSLFI

SEQ ID NO: 177488 - protein, 9 aa, Homo Sapiens
VYKKAVELS

SEQ ID NO: 177489 - protein, 9 aa, Homo Sapiens
LLSLVMNYK

SEQ ID NO: 177490 - protein, 9 aa, Homo Sapiens
WTLQRSMAV

SEQ ID NO: 177491 - protein, 9 aa, Homo Sapiens
QRVLEEERK

SEQ ID NO: 177492 - protein, 9 aa, Homo Sapiens
GAAGQRRGV

SEQ ID NO: 177493 - protein, 9 aa, Homo Sapiens
LDPAPPPLK

SEQ ID NO: 177494 - protein, 9 aa, Homo Sapiens
ALKFREQDA

SEQ ID NO: 177495 - protein, 9 aa, Homo Sapiens
TSSRRPSGR

SEQ ID NO: 177496 - protein, 9 aa, Homo Sapiens
STHLTPYLS

SEQ ID NO: 177497 - protein, 9 aa, Homo Sapiens
ASTPASTNR

SEQ ID NO: 177498 - protein, 9 aa, Homo Sapiens
TAEQVITSF

SEQ ID NO: 177499 - protein, 9 aa, Homo Sapiens
DVHRTWPFP

SEQ ID NO: 177500 - protein, 9 aa, Homo Sapiens
SSALGPLGS

SEQ ID NO: 177501 - protein, 9 aa, Homo Sapiens
VGRADVLVC

SEQ ID NO: 177502 - protein, 9 aa, Homo Sapiens
LLALVTLRH

SEQ ID NO: 177503 - protein, 9 aa, Homo Sapiens
VPVGHLPSS

SEQ ID NO: 177504 - protein, 9 aa, Homo Sapiens
VTFSCQEGC

SEQ ID NO: 177505 - protein, 9 aa, Homo Sapiens
YKCPYCDYA

SEQ ID NO: 177506 - protein, 9 aa, Homo Sapiens
TANDNLKVS

SEQ ID NO: 177507 - protein, 9 aa, Homo Sapiens
AHAVKTVYF

SEQ ID NO: 177508 - protein, 9 aa, Homo Sapiens
LESEMSTQS

SEQ ID NO: 177509 - protein, 9 aa, Homo Sapiens
ASSHTTTKS

SEQ ID NO: 177510 - protein, 9 aa, Homo Sapiens
SAYGALTFP

SEQ ID NO: 177511 - protein, 9 aa, Homo Sapiens
LTLTPEWTH

SEQ ID NO: 177512 - protein, 9 aa, Homo Sapiens
RWCWWGRGC

SEQ ID NO: 177513 - protein, 9 aa, Homo Sapiens
AKLPGPAPD

SEQ ID NO: 177514 - protein, 9 aa, Homo Sapiens
RGAAGQRRG

SEQ ID NO: 177515 - protein, 9 aa, Homo Sapiens
ARALQVMVS

SEQ ID NO: 177516 - protein, 9 aa, Homo Sapiens
IVAGYASHF

SEQ ID NO: 177517 - protein, 9 aa, Homo Sapiens
FANPAHHYP

SEQ ID NO: 177518 - protein, 9 aa, Homo Sapiens
QEMLEPFLE

SEQ ID NO: 177519 - protein, 9 aa, Homo Sapiens
TGNVATCES

SEQ ID NO: 177520 - protein, 9 aa, Homo Sapiens
VEQDDTTEQ

SEQ ID NO: 177521 - protein, 9 aa, Homo Sapiens
SKERIEWSL

SEQ ID NO: 177522 - protein, 9 aa, Homo Sapiens
VKIPKKERA

SEQ ID NO: 177523 - protein, 9 aa, Homo Sapiens
VCWRGSTRT

SEQ ID NO: 177524 - protein, 9 aa, Homo Sapiens
TRKKEWGKT

SEQ ID NO: 177525 - protein, 9 aa, Homo Sapiens
LTQGPRLAS

SEQ ID NO: 177526 - protein, 9 aa, Homo Sapiens
VPIVGFLIL

SEQ ID NO: 177527 - protein, 9 aa, Homo Sapiens
SRSFFTSAH

SEQ ID NO: 177528 - protein, 9 aa, Homo Sapiens
ELRELRHAP

SEQ ID NO: 177529 - protein, 9 aa, Homo Sapiens
DIIQRTTST

SEQ ID NO: 177530 - protein, 9 aa, Homo Sapiens
KRASVSFWT

SEQ ID NO: 177531 - protein, 9 aa, Homo Sapiens
LKRGINHAR

SEQ ID NO: 177532 - protein, 9 aa, Homo Sapiens
QGNDGRVSL

SEQ ID NO: 177533 - protein, 9 aa, Homo Sapiens
AKSIRAKKP

SEQ ID NO: 177534 - protein, 9 aa, Homo Sapiens
YGHIGVAIL

SEQ ID NO: 177535 - protein, 9 aa, Homo Sapiens
KAQLHFAAE

SEQ ID NO: 177536 - protein, 9 aa, Homo Sapiens
TPEECHLNK

SEQ ID NO: 177537 - protein, 9 aa, Homo Sapiens
HTGEFISFQ

SEQ ID NO: 177538 - protein, 9 aa, Homo Sapiens
MTCSSCHRP

SEQ ID NO: 177539 - protein, 9 aa, Homo Sapiens
QPPQRPPLQ

SEQ ID NO: 177540 - protein, 9 aa, Homo Sapiens
QSPGSSPTM

SEQ ID NO: 177541 - protein, 9 aa, Homo Sapiens
AGPRTNGQE

SEQ ID NO: 177542 - protein, 9 aa, Homo Sapiens
SGGGVGRRC

SEQ ID NO: 177543 - protein, 9 aa, Homo Sapiens
LEEVDLSVN

SEQ ID NO: 177544 - protein, 9 aa, Homo Sapiens
ATETRALAR

SEQ ID NO: 177545 - protein, 9 aa, Homo Sapiens
KATGRSMEQ

SEQ ID NO: 177546 - protein, 9 aa, Homo Sapiens
KKDLEDGKV

SEQ ID NO: 177547 - protein, 9 aa, Homo Sapiens
TTSTLGSSP

SEQ ID NO: 177548 - protein, 9 aa, Homo Sapiens
CGKVLEDGG

SEQ ID NO: 177549 - protein, 9 aa, Homo Sapiens
CALRRCPLS

SEQ ID NO: 177550 - protein, 9 aa, Homo Sapiens
GQKDALERY

SEQ ID NO: 177551 - protein, 9 aa, Homo Sapiens
AGVSLRKEL

SEQ ID NO: 177552 - protein, 9 aa, Homo Sapiens
GCQLMGVTK

SEQ ID NO: 177553 - protein, 9 aa, Homo Sapiens
AKTAQFGQE

SEQ ID NO: 177554 - protein, 9 aa, Homo Sapiens
QFPNHPSTA

SEQ ID NO: 177555 - protein, 9 aa, Homo Sapiens
QGRTFQDVT

SEQ ID NO: 177556 - protein, 9 aa, Homo Sapiens
PTWRPFHFQ

SEQ ID NO: 177557 - protein, 9 aa, Homo Sapiens
QIFGSFLLI

SEQ ID NO: 177558 - protein, 9 aa, Homo Sapiens
LPECRVRVL

SEQ ID NO: 177559 - protein, 9 aa, Homo Sapiens
GRPSCRITF

SEQ ID NO: 177560 - protein, 9 aa, Homo Sapiens
SQCGKVLED

SEQ ID NO: 177561 - protein, 9 aa, Homo Sapiens
TPHVSPQMI

SEQ ID NO: 177562 - protein, 9 aa, Homo Sapiens
IQYQMHLRS

SEQ ID NO: 177563 - protein, 9 aa, Homo Sapiens
NTAWKTKKT

SEQ ID NO: 177564 - protein, 9 aa, Homo Sapiens
YVCRMCSQG

SEQ ID NO: 177565 - protein, 9 aa, Homo Sapiens
YRKLTPNCY

SEQ ID NO: 177566 - protein, 9 aa, Homo Sapiens
HLTVVVLQY

SEQ ID NO: 177567 - protein, 9 aa, Homo Sapiens
NHFWPQMTC

SEQ ID NO: 177568 - protein, 9 aa, Homo Sapiens
KIKYWELLN

SEQ ID NO: 177569 - protein, 9 aa, Homo Sapiens
PLPCVQGQE

SEQ ID NO: 177570 - protein, 9 aa, Homo Sapiens
LLGGFLPPV

SEQ ID NO: 177571 - protein, 9 aa, Homo Sapiens
IQTSRRLKR

SEQ ID NO: 177572 - protein, 9 aa, Homo Sapiens
FLCLKKEVW

SEQ ID NO: 177573 - protein, 9 aa, Homo Sapiens
LDSAGHGHI

SEQ ID NO: 177574 - protein, 9 aa, Homo Sapiens
CQNKGERWT

SEQ ID NO: 177575 - protein, 9 aa, Homo Sapiens
DAHSARQQP

SEQ ID NO: 177576 - protein, 9 aa, Homo Sapiens
LVTVKFLHD

SEQ ID NO: 177577 - protein, 9 aa, Homo Sapiens
VAKSNELFT

SEQ ID NO: 177578 - protein, 9 aa, Homo Sapiens
LCPHSPKPV

SEQ ID NO: 177579 - protein, 9 aa, Homo Sapiens
TEMRRTPTP

SEQ ID NO: 177580 - protein, 9 aa, Homo Sapiens
CVIIVLSIL

SEQ ID NO: 177581 - protein, 9 aa, Homo Sapiens
MTVTTARTP

SEQ ID NO: 177582 - protein, 9 aa, Homo Sapiens
ECGFCLHQF

SEQ ID NO: 177583 - protein, 9 aa, Homo Sapiens
YLGGLGVCG

SEQ ID NO: 177584 - protein, 9 aa, Homo Sapiens
HAHGAVTKP

SEQ ID NO: 177585 - protein, 9 aa, Homo Sapiens
RARRCDQKL

SEQ ID NO: 177586 - protein, 9 aa, Homo Sapiens
TSLRSCRTS

SEQ ID NO: 177587 - protein, 9 aa, Homo Sapiens
HSSAQLADT

SEQ ID NO: 177588 - protein, 9 aa, Homo Sapiens
ISGSLFSLS

SEQ ID NO: 177589 - protein, 9 aa, Homo Sapiens
KSADTMWDI

SEQ ID NO: 177590 - protein, 9 aa, Homo Sapiens
KEGWHKFIQ

SEQ ID NO: 177591 - protein, 9 aa, Homo Sapiens
NPAMTVACL

SEQ ID NO: 177592 - protein, 9 aa, Homo Sapiens
VSAKDIYYN

SEQ ID NO: 177593 - protein, 9 aa, Homo Sapiens
GNASGTRKQ

SEQ ID NO: 177594 - protein, 9 aa, Homo Sapiens
QVDGLISQL

SEQ ID NO: 177595 - protein, 9 aa, Homo Sapiens
SLRMQNAAK

SEQ ID NO: 177596 - protein, 9 aa, Homo Sapiens
KQAPGHRRN

SEQ ID NO: 177597 - protein, 9 aa, Homo Sapiens
SLRPENQVL

SEQ ID NO: 177598 - protein, 9 aa, Homo Sapiens
VEEWGKLHV

SEQ ID NO: 177599 - protein, 9 aa, Homo Sapiens
AYYYPIYEI

SEQ ID NO: 177600 - protein, 9 aa, Homo Sapiens
FESTVEKLQ

SEQ ID NO: 177601 - protein, 9 aa, Homo Sapiens
GNKHRDSFE

SEQ ID NO: 177602 - protein, 9 aa, Homo Sapiens
CSRRWRSSK

SEQ ID NO: 177603 - protein, 9 aa, Homo Sapiens
ADLSRGHAA

SEQ ID NO: 177604 - protein, 9 aa, Homo Sapiens
NSSLFRQED

SEQ ID NO: 177605 - protein, 9 aa, Homo Sapiens
AAAATARAP

SEQ ID NO: 177606 - protein, 9 aa, Homo Sapiens
FAAGERAMQ

SEQ ID NO: 177607 - protein, 9 aa, Homo Sapiens
QAIQNPQAP

SEQ ID NO: 177608 - protein, 9 aa, Homo Sapiens
LADLWGKRK

SEQ ID NO: 177609 - protein, 9 aa, Homo Sapiens
RWWWSARTV

SEQ ID NO: 177610 - protein, 9 aa, Homo Sapiens
CMQLSSHCV

SEQ ID NO: 177611 - protein, 9 aa, Homo Sapiens
PRQGCLPWR

SEQ ID NO: 177612 - protein, 9 aa, Homo Sapiens
GADIQGVSI

SEQ ID NO: 177613 - protein, 9 aa, Homo Sapiens
RLKRFRASC

SEQ ID NO: 177614 - protein, 9 aa, Homo Sapiens
SMGSYGPQR

SEQ ID NO: 177615 - protein, 9 aa, Homo Sapiens
TNTEPSTAK

SEQ ID NO: 177616 - protein, 9 aa, Homo Sapiens
QEEAKPGGD

SEQ ID NO: 177617 - protein, 9 aa, Homo Sapiens
KKIEEAMDR

SEQ ID NO: 177618 - protein, 9 aa, Homo Sapiens
RGLGEGSPR

SEQ ID NO: 177619 - protein, 9 aa, Homo Sapiens
PLLSVCPMV

SEQ ID NO: 177620 - protein, 9 aa, Homo Sapiens
SKEPSSPAP

SEQ ID NO: 177621 - protein, 9 aa, Homo Sapiens
LWTTNLQDS

SEQ ID NO: 177622 - protein, 9 aa, Homo Sapiens
KDTRKSQER

SEQ ID NO: 177623 - protein, 9 aa, Homo Sapiens
RSNGVTTGT

SEQ ID NO: 177624 - protein, 9 aa, Homo Sapiens
TTNNTSSVI

SEQ ID NO: 177625 - protein, 9 aa, Homo Sapiens
RLWAGSRIV

SEQ ID NO: 177626 - protein, 9 aa, Homo Sapiens
IADEQSKDR

SEQ ID NO: 177627 - protein, 9 aa, Homo Sapiens
RKRLPSQNV

SEQ ID NO: 177628 - protein, 9 aa, Homo Sapiens
LNSPNLLYS

SEQ ID NO: 177629 - protein, 9 aa, Homo Sapiens
ISAQQNCVV

SEQ ID NO: 177630 - protein, 9 aa, Homo Sapiens
VMNVGSPSA

SEQ ID NO: 177631 - protein, 9 aa, Homo Sapiens
DTRKSQERS

SEQ ID NO: 177632 - protein, 9 aa, Homo Sapiens
VPFFQSPGS

SEQ ID NO: 177633 - protein, 9 aa, Homo Sapiens
FMEVWVQSI

SEQ ID NO: 177634 - protein, 9 aa, Homo Sapiens
WRPTAIRQT

SEQ ID NO: 177635 - protein, 9 aa, Homo Sapiens
PIKCQYPVP

SEQ ID NO: 177636 - protein, 9 aa, Homo Sapiens
MRNHTFIVL

SEQ ID NO: 177637 - protein, 9 aa, Homo Sapiens
QAFRGSLLG

SEQ ID NO: 177638 - protein, 9 aa, Homo Sapiens
VILSMDNNC

SEQ ID NO: 177639 - protein, 9 aa, Homo Sapiens
GNWWRKSWG

SEQ ID NO: 177640 - protein, 9 aa, Homo Sapiens
CVGSSPSSR

SEQ ID NO: 177641 - protein, 9 aa, Homo Sapiens
FYDQIAVMS

SEQ ID NO: 177642 - protein, 9 aa, Homo Sapiens
LPATSLCLK

SEQ ID NO: 177643 - protein, 9 aa, Homo Sapiens
LLSQWDLKY

SEQ ID NO: 177644 - protein, 9 aa, Homo Sapiens
TERNLRPLS

SEQ ID NO: 177645 - protein, 9 aa, Homo Sapiens
QCLQSFANP

SEQ ID NO: 177646 - protein, 9 aa, Homo Sapiens
GEQGPGGPK

SEQ ID NO: 177647 - protein, 9 aa, Homo Sapiens
SLLCPHSPK

SEQ ID NO: 177648 - protein, 9 aa, Homo Sapiens
RKIMGVEED

SEQ ID NO: 177649 - protein, 9 aa, Homo Sapiens
AVSTAASMK

SEQ ID NO: 177650 - protein, 9 aa, Homo Sapiens
DRKALTRER

SEQ ID NO: 177651 - protein, 9 aa, Homo Sapiens
VREVDPNGQ

SEQ ID NO: 177652 - protein, 9 aa, Homo Sapiens
GPWPMHPDG

SEQ ID NO: 177653 - protein, 9 aa, Homo Sapiens
CVQVTFSPG

SEQ ID NO: 177654 - protein, 9 aa, Homo Sapiens
PIFQMPQNK

SEQ ID NO: 177655 - protein, 9 aa, Homo Sapiens
EVLPIIPSA

SEQ ID NO: 177656 - protein, 9 aa, Homo Sapiens
LATETRALA

SEQ ID NO: 177657 - protein, 9 aa, Homo Sapiens
VDCNGHIIV

SEQ ID NO: 177658 - protein, 9 aa, Homo Sapiens
GFKFTFPTV

SEQ ID NO: 177659 - protein, 9 aa, Homo Sapiens
ALCLLFQVI

SEQ ID NO: 177660 - protein, 9 aa, Homo Sapiens
LIAAHCSGS

SEQ ID NO: 177661 - protein, 9 aa, Homo Sapiens
LQLHTARTD

SEQ ID NO: 177662 - protein, 9 aa, Homo Sapiens
LFFGPGTFT

SEQ ID NO: 177663 - protein, 9 aa, Homo Sapiens
RNELAEVRE

SEQ ID NO: 177664 - protein, 9 aa, Homo Sapiens
LNMFVCAQL

SEQ ID NO: 177665 - protein, 9 aa, Homo Sapiens
LSKGISKKE

SEQ ID NO: 177666 - protein, 9 aa, Homo Sapiens
LSHGSLAHQ

SEQ ID NO: 177667 - protein, 9 aa, Homo Sapiens
EMRRLDLEY

SEQ ID NO: 177668 - protein, 9 aa, Homo Sapiens
PAGLLALVT

SEQ ID NO: 177669 - protein, 9 aa, Homo Sapiens
PPGTTPPRA

SEQ ID NO: 177670 - protein, 9 aa, Homo Sapiens
SDDFLCARQ

SEQ ID NO: 177671 - protein, 9 aa, Homo Sapiens
DKERAWRLE

SEQ ID NO: 177672 - protein, 9 aa, Homo Sapiens
KDDYFAKKK

SEQ ID NO: 177673 - protein, 9 aa, Homo Sapiens
WCSNKKNVA

SEQ ID NO: 177674 - protein, 9 aa, Homo Sapiens
ASMKMNAKK

SEQ ID NO: 177675 - protein, 9 aa, Homo Sapiens
HNVEGPLTG

SEQ ID NO: 177676 - protein, 9 aa, Homo Sapiens
LCQQSPGSS

SEQ ID NO: 177677 - protein, 9 aa, Homo Sapiens
IHGLVRESV

SEQ ID NO: 177678 - protein, 9 aa, Homo Sapiens
KCKPSSSTS

SEQ ID NO: 177679 - protein, 9 aa, Homo Sapiens
IIIGSGVSC

SEQ ID NO: 177680 - protein, 9 aa, Homo Sapiens
LAQWAQLLL

SEQ ID NO: 177681 - protein, 9 aa, Homo Sapiens
IHAQVASVK

SEQ ID NO: 177682 - protein, 9 aa, Homo Sapiens
VQSQACPHQ

SEQ ID NO: 177683 - protein, 9 aa, Homo Sapiens
SQRAVRGTS

SEQ ID NO: 177684 - protein, 9 aa, Homo Sapiens
QMKCLTAVD

SEQ ID NO: 177685 - protein, 9 aa, Homo Sapiens
AVNMSMGLS

SEQ ID NO: 177686 - protein, 9 aa, Homo Sapiens
CGPSSSPTW

SEQ ID NO: 177687 - protein, 9 aa, Homo Sapiens
RAKLLLPVA

SEQ ID NO: 177688 - protein, 9 aa, Homo Sapiens
GLRTHDLTL

SEQ ID NO: 177689 - protein, 9 aa, Homo Sapiens
CLKKEVWNV

SEQ ID NO: 177690 - protein, 9 aa, Homo Sapiens
RCIRRTQNA

SEQ ID NO: 177691 - protein, 9 aa, Homo Sapiens
RVKDALHTT

SEQ ID NO: 177692 - protein, 9 aa, Homo Sapiens
LSILVCCLP

SEQ ID NO: 177693 - protein, 9 aa, Homo Sapiens
SHISDTSVA

SEQ ID NO: 177694 - protein, 9 aa, Homo Sapiens
NAFSLLCPH

SEQ ID NO: 177695 - protein, 9 aa, Homo Sapiens
LCLSASARY

SEQ ID NO: 177696 - protein, 9 aa, Homo Sapiens
LAVRRKLHS

SEQ ID NO: 177697 - protein, 9 aa, Homo Sapiens
QHNRPCWEA

SEQ ID NO: 177698 - protein, 9 aa, Homo Sapiens
LYWMMQRSK

SEQ ID NO: 177699 - protein, 9 aa, Homo Sapiens
VTQAELFVL

SEQ ID NO: 177700 - protein, 9 aa, Homo Sapiens
RPQLDYEVP

SEQ ID NO: 177701 - protein, 9 aa, Homo Sapiens
PAPPPLKVA

SEQ ID NO: 177702 - protein, 9 aa, Homo Sapiens
EMMTNKATK

SEQ ID NO: 177703 - protein, 9 aa, Homo Sapiens
NTFNSIWDQ

SEQ ID NO: 177704 - protein, 9 aa, Homo Sapiens
VLDHPAEVL

SEQ ID NO: 177705 - protein, 9 aa, Homo Sapiens
ERLQYEKSL

SEQ ID NO: 177706 - protein, 9 aa, Homo Sapiens
ICYERNDSK

SEQ ID NO: 177707 - protein, 9 aa, Homo Sapiens
KSYKITSTI

SEQ ID NO: 177708 - protein, 9 aa, Homo Sapiens
KNVAVMDQE

SEQ ID NO: 177709 - protein, 9 aa, Homo Sapiens
PRPCGSPTT

SEQ ID NO: 177710 - protein, 9 aa, Homo Sapiens
HRCTHAGQT

SEQ ID NO: 177711 - protein, 9 aa, Homo Sapiens
FIQRAVYKD

SEQ ID NO: 177712 - protein, 9 aa, Homo Sapiens
ERQQYQRAL

SEQ ID NO: 177713 - protein, 9 aa, Homo Sapiens
IQKSHGRKS

SEQ ID NO: 177714 - protein, 9 aa, Homo Sapiens
QLAEGGGHA

SEQ ID NO: 177715 - protein, 9 aa, Homo Sapiens
RHCHPRSRP

SEQ ID NO: 177716 - protein, 9 aa, Homo Sapiens
EAAKCEWIN

SEQ ID NO: 177717 - protein, 9 aa, Homo Sapiens
EADHTPHYS

SEQ ID NO: 177718 - protein, 9 aa, Homo Sapiens
LEEKRAFEE

SEQ ID NO: 177719 - protein, 9 aa, Homo Sapiens
PTATPTTCT

SEQ ID NO: 177720 - protein, 9 aa, Homo Sapiens
PSFLPPGAP

SEQ ID NO: 177721 - protein, 9 aa, Homo Sapiens
KKKAQLHFA

SEQ ID NO: 177722 - protein, 9 aa, Homo Sapiens
QAKCSCLAA

SEQ ID NO: 177723 - protein, 9 aa, Homo Sapiens
WMTQRVLGS

SEQ ID NO: 177724 - protein, 9 aa, Homo Sapiens
GTRKASAAS

SEQ ID NO: 177725 - protein, 9 aa, Homo Sapiens
WHNSEEKKF

SEQ ID NO: 177726 - protein, 9 aa, Homo Sapiens
ETDFGLCVA

SEQ ID NO: 177727 - protein, 9 aa, Homo Sapiens
MTMSFWKRR

SEQ ID NO: 177728 - protein, 9 aa, Homo Sapiens
VMVKATFCD

SEQ ID NO: 177729 - protein, 9 aa, Homo Sapiens
MCCCCFDVL

SEQ ID NO: 177730 - protein, 9 aa, Homo Sapiens
PLCNDNLPT

SEQ ID NO: 177731 - protein, 9 aa, Homo Sapiens
MTQRVLGSH

SEQ ID NO: 177732 - protein, 9 aa, Homo Sapiens
GAARWGLQQ

SEQ ID NO: 177733 - protein, 9 aa, Homo Sapiens
YDIGIVAQV

SEQ ID NO: 177734 - protein, 9 aa, Homo Sapiens
FTFLRDQWN

SEQ ID NO: 177735 - protein, 9 aa, Homo Sapiens
CRKDLEIVL

SEQ ID NO: 177736 - protein, 9 aa, Homo Sapiens
STVRLLHFF

SEQ ID NO: 177737 - protein, 9 aa, Homo Sapiens
SPLKRDPQQ

SEQ ID NO: 177738 - protein, 9 aa, Homo Sapiens
HLLQILAHL

SEQ ID NO: 177739 - protein, 9 aa, Homo Sapiens
HQRIHTGKN

SEQ ID NO: 177740 - protein, 9 aa, Homo Sapiens
VLVECPSYH

SEQ ID NO: 177741 - protein, 9 aa, Homo Sapiens
ISPQLQSPV

SEQ ID NO: 177742 - protein, 9 aa, Homo Sapiens
DIVPGDNVE

SEQ ID NO: 177743 - protein, 9 aa, Homo Sapiens
TATWAAAAT

SEQ ID NO: 177744 - protein, 9 aa, Homo Sapiens
EMSTQSGRC

SEQ ID NO: 177745 - protein, 9 aa, Homo Sapiens
QVFKTHKKA

SEQ ID NO: 177746 - protein, 9 aa, Homo Sapiens
LTDPSLSRA

SEQ ID NO: 177747 - protein, 9 aa, Homo Sapiens
KGWFGTRVT

SEQ ID NO: 177748 - protein, 9 aa, Homo Sapiens
DHPSLDDIA

SEQ ID NO: 177749 - protein, 9 aa, Homo Sapiens
WTHQDSSQG

SEQ ID NO: 177750 - protein, 9 aa, Homo Sapiens
SDTSVAVKM

SEQ ID NO: 177751 - protein, 9 aa, Homo Sapiens
LLRILLQQL

SEQ ID NO: 177752 - protein, 9 aa, Homo Sapiens
NNMCAKKMD

SEQ ID NO: 177753 - protein, 9 aa, Homo Sapiens
NKKCYGMAS

SEQ ID NO: 177754 - protein, 9 aa, Homo Sapiens
LWKHQHVGD

SEQ ID NO: 177755 - protein, 9 aa, Homo Sapiens
ILSASWKQT

SEQ ID NO: 177756 - protein, 9 aa, Homo Sapiens
KMEITHHPP

SEQ ID NO: 177757 - protein, 9 aa, Homo Sapiens
LEVARRRLE

SEQ ID NO: 177758 - protein, 9 aa, Homo Sapiens
IFGSFLLIS

SEQ ID NO: 177759 - protein, 9 aa, Homo Sapiens
DRIVDIWIL

SEQ ID NO: 177760 - protein, 9 aa, Homo Sapiens
APPPLKVAP

SEQ ID NO: 177761 - protein, 9 aa, Homo Sapiens
TIGESQALM

SEQ ID NO: 177762 - protein, 9 aa, Homo Sapiens
VGETRRPYD

SEQ ID NO: 177763 - protein, 9 aa, Homo Sapiens
DLQSSENPQ

SEQ ID NO: 177764 - protein, 9 aa, Homo Sapiens
CIKKGRVMV

SEQ ID NO: 177765 - protein, 9 aa, Homo Sapiens
LMIIPWREH

SEQ ID NO: 177766 - protein, 9 aa, Homo Sapiens
RVRMCNHPP

SEQ ID NO: 177767 - protein, 9 aa, Homo Sapiens
KKPSMILGN

SEQ ID NO: 177768 - protein, 9 aa, Homo Sapiens
EDEGKITFY

SEQ ID NO: 177769 - protein, 9 aa, Homo Sapiens
KWVALQIDE

SEQ ID NO: 177770 - protein, 9 aa, Homo Sapiens
SPLLQGELL

SEQ ID NO: 177771 - protein, 9 aa, Homo Sapiens
QGHHELYFK

SEQ ID NO: 177772 - protein, 9 aa, Homo Sapiens
LLLHHWAKV

SEQ ID NO: 177773 - protein, 9 aa, Homo Sapiens
CRTKNDCDN

SEQ ID NO: 177774 - protein, 9 aa, Homo Sapiens
ENCDGHTAQ

SEQ ID NO: 177775 - protein, 9 aa, Homo Sapiens
TPLPFSTVR

SEQ ID NO: 177776 - protein, 9 aa, Homo Sapiens
AWCGKVPRK

SEQ ID NO: 177777 - protein, 9 aa, Homo Sapiens
LSTELLEAQ

SEQ ID NO: 177778 - protein, 9 aa, Homo Sapiens
KILTNVVTF

SEQ ID NO: 177779 - protein, 9 aa, Homo Sapiens
WDWKIQKTP

SEQ ID NO: 177780 - protein, 9 aa, Homo Sapiens
WHQPSHHHP

SEQ ID NO: 177781 - protein, 9 aa, Homo Sapiens
PPQRPPLQP

SEQ ID NO: 177782 - protein, 9 aa, Homo Sapiens
SGIGAGVSL

SEQ ID NO: 177783 - protein, 9 aa, Homo Sapiens
PVVVLLISG

SEQ ID NO: 177784 - protein, 9 aa, Homo Sapiens
ELGAAGRHR

SEQ ID NO: 177785 - protein, 9 aa, Homo Sapiens
HPVWARRQA

SEQ ID NO: 177786 - protein, 9 aa, Homo Sapiens
RDSRSFFTS

SEQ ID NO: 177787 - protein, 9 aa, Homo Sapiens
PEPASGDGE

SEQ ID NO: 177788 - protein, 9 aa, Homo Sapiens
AQGHVNHGF

SEQ ID NO: 177789 - protein, 9 aa, Homo Sapiens
RASTKTWQW

SEQ ID NO: 177790 - protein, 9 aa, Homo Sapiens
TEVAQEEAK

SEQ ID NO: 177791 - protein, 9 aa, Homo Sapiens
APASPSRRR

SEQ ID NO: 177792 - protein, 9 aa, Homo Sapiens
EDSGRRVKS

SEQ ID NO: 177793 - protein, 9 aa, Homo Sapiens
ESRNKFSNI

SEQ ID NO: 177794 - protein, 9 aa, Homo Sapiens
FSPMKSILR

SEQ ID NO: 177795 - protein, 9 aa, Homo Sapiens
RGSLLGCVS

SEQ ID NO: 177796 - protein, 9 aa, Homo Sapiens
QQERSFLDL

SEQ ID NO: 177797 - protein, 9 aa, Homo Sapiens
HGLGPIHSR

SEQ ID NO: 177798 - protein, 9 aa, Homo Sapiens
CQYVTSYHP

SEQ ID NO: 177799 - protein, 9 aa, Homo Sapiens
SLRELGFSS

SEQ ID NO: 177800 - protein, 9 aa, Homo Sapiens
QVNSPRSSL

SEQ ID NO: 177801 - protein, 9 aa, Homo Sapiens
INAMNIKHF

SEQ ID NO: 177802 - protein, 9 aa, Homo Sapiens
TMQHSCTHC

SEQ ID NO: 177803 - protein, 9 aa, Homo Sapiens
HTLCMMVQK

SEQ ID NO: 177804 - protein, 9 aa, Homo Sapiens
EKKTQWETL

SEQ ID NO: 177805 - protein, 9 aa, Homo Sapiens
LLSRIYLDE

SEQ ID NO: 177806 - protein, 9 aa, Homo Sapiens
PSTPRPTSP

SEQ ID NO: 177807 - protein, 9 aa, Homo Sapiens
INSHFHLSK

SEQ ID NO: 177808 - protein, 9 aa, Homo Sapiens
FARALQQEF

SEQ ID NO: 177809 - protein, 9 aa, Homo Sapiens
PLREKVHPM

SEQ ID NO: 177810 - protein, 9 aa, Homo Sapiens
KNKLIFLEG

SEQ ID NO: 177811 - protein, 9 aa, Homo Sapiens
RCKCQWEEQ

SEQ ID NO: 177812 - protein, 9 aa, Homo Sapiens
YKDTVAENN

SEQ ID NO: 177813 - protein, 9 aa, Homo Sapiens
PQHEGPPRL

SEQ ID NO: 177814 - protein, 9 aa, Homo Sapiens
AVGAVGAKD

SEQ ID NO: 177815 - protein, 9 aa, Homo Sapiens
IDGRSQEGK

SEQ ID NO: 177816 - protein, 9 aa, Homo Sapiens
PRGAGGMRM

SEQ ID NO: 177817 - protein, 9 aa, Homo Sapiens
LCNLSSRDH

SEQ ID NO: 177818 - protein, 9 aa, Homo Sapiens
GVPGKKCGI

SEQ ID NO: 177819 - protein, 9 aa, Homo Sapiens
MYFQCCAVM

SEQ ID NO: 177820 - protein, 9 aa, Homo Sapiens
NVKQTDAWL

SEQ ID NO: 177821 - protein, 9 aa, Homo Sapiens
EIGASSAQE

SEQ ID NO: 177822 - protein, 9 aa, Homo Sapiens
GRGCCLRIH

SEQ ID NO: 177823 - protein, 9 aa, Homo Sapiens
HRHAVLLAV

SEQ ID NO: 177824 - protein, 9 aa, Homo Sapiens
AGVCVLRKK

SEQ ID NO: 177825 - protein, 9 aa, Homo Sapiens
AALDMTGKP

SEQ ID NO: 177826 - protein, 9 aa, Homo Sapiens
CSEDLKNAQ

SEQ ID NO: 177827 - protein, 9 aa, Homo Sapiens
DPNGQLDED

SEQ ID NO: 177828 - protein, 9 aa, Homo Sapiens
ESTDVHVCS

SEQ ID NO: 177829 - protein, 9 aa, Homo Sapiens
SLNSPNLLY

SEQ ID NO: 177830 - protein, 9 aa, Homo Sapiens
SCLHGNTAP

SEQ ID NO: 177831 - protein, 9 aa, Homo Sapiens
QVRTLSGSW

SEQ ID NO: 177832 - protein, 9 aa, Homo Sapiens
RRHGLGPIH

SEQ ID NO: 177833 - protein, 9 aa, Homo Sapiens
RGPVRLLLG

SEQ ID NO: 177834 - protein, 9 aa, Homo Sapiens
IITPPPHQM

SEQ ID NO: 177835 - protein, 9 aa, Homo Sapiens
PAEDMEGTE

SEQ ID NO: 177836 - protein, 9 aa, Homo Sapiens
QTPGRGVPP

SEQ ID NO: 177837 - protein, 9 aa, Homo Sapiens
PQCAVCIGH

SEQ ID NO: 177838 - protein, 9 aa, Homo Sapiens
LEREGSRAF

SEQ ID NO: 177839 - protein, 9 aa, Homo Sapiens
DKMNKLENH

SEQ ID NO: 177840 - protein, 9 aa, Homo Sapiens
YFARCQGFT

SEQ ID NO: 177841 - protein, 9 aa, Homo Sapiens
KIPKKERAW

SEQ ID NO: 177842 - protein, 9 aa, Homo Sapiens
THHISFHSA

SEQ ID NO: 177843 - protein, 9 aa, Homo Sapiens
RLWMEFVSD

SEQ ID NO: 177844 - protein, 9 aa, Homo Sapiens
GEKFYLFPL

SEQ ID NO: 177845 - protein, 9 aa, Homo Sapiens
SLNSDYKRL

SEQ ID NO: 177846 - protein, 9 aa, Homo Sapiens
LGLHGLLAL

SEQ ID NO: 177847 - protein, 9 aa, Homo Sapiens
VWRGKWQGE

SEQ ID NO: 177848 - protein, 9 aa, Homo Sapiens
QKSGGNVKQ

SEQ ID NO: 177849 - protein, 9 aa, Homo Sapiens
CNICKDVVT

SEQ ID NO: 177850 - protein, 9 aa, Homo Sapiens
SRNKFSNII

SEQ ID NO: 177851 - protein, 9 aa, Homo Sapiens
RGGINFKDI

SEQ ID NO: 177852 - protein, 9 aa, Homo Sapiens
TVVVLQYGC

SEQ ID NO: 177853 - protein, 9 aa, Homo Sapiens
GERGFPGYT

SEQ ID NO: 177854 - protein, 9 aa, Homo Sapiens
NTEVKEQTL

SEQ ID NO: 177855 - protein, 9 aa, Homo Sapiens
VLFGPGRKL

SEQ ID NO: 177856 - protein, 9 aa, Homo Sapiens
PQMTCRPNT

SEQ ID NO: 177857 - protein, 9 aa, Homo Sapiens
PSTPTGMLE

SEQ ID NO: 177858 - protein, 9 aa, Homo Sapiens
VDLAVNVCI

SEQ ID NO: 177859 - protein, 9 aa, Homo Sapiens
QALPWARYI

SEQ ID NO: 177860 - protein, 9 aa, Homo Sapiens
KEGMISLVM

SEQ ID NO: 177861 - protein, 9 aa, Homo Sapiens
IEEAMDRSE

SEQ ID NO: 177862 - protein, 9 aa, Homo Sapiens
RPCRMRLYQ

SEQ ID NO: 177863 - protein, 9 aa, Homo Sapiens
VTSSSILDR

SEQ ID NO: 177864 - protein, 9 aa, Homo Sapiens
CAHQVHLQF

SEQ ID NO: 177865 - protein, 9 aa, Homo Sapiens
ALFLQEVFQ

SEQ ID NO: 177866 - protein, 9 aa, Homo Sapiens
NIITPPPHQ

SEQ ID NO: 177867 - protein, 9 aa, Homo Sapiens
SGSVRATDR

SEQ ID NO: 177868 - protein, 9 aa, Homo Sapiens
PAAEPGLDA

SEQ ID NO: 177869 - protein, 9 aa, Homo Sapiens
SIWDQNQAI

SEQ ID NO: 177870 - protein, 9 aa, Homo Sapiens
VHLDGLLFC

SEQ ID NO: 177871 - protein, 9 aa, Homo Sapiens
TKGDSIRNE

SEQ ID NO: 177872 - protein, 9 aa, Homo Sapiens
VKVIQVEGP

SEQ ID NO: 177873 - protein, 9 aa, Homo Sapiens
VLEDGGFFE

SEQ ID NO: 177874 - protein, 9 aa, Homo Sapiens
VLRRGLESR

SEQ ID NO: 177875 - protein, 9 aa, Homo Sapiens
EIYQWMVYD

SEQ ID NO: 177876 - protein, 9 aa, Homo Sapiens
LMEQIPHLK

SEQ ID NO: 177877 - protein, 9 aa, Homo Sapiens
PGQRYYGRT

SEQ ID NO: 177878 - protein, 9 aa, Homo Sapiens
LVKNLDAVE

SEQ ID NO: 177879 - protein, 9 aa, Homo Sapiens
ECQACLRRQ

SEQ ID NO: 177880 - protein, 9 aa, Homo Sapiens
QADVGFKFT

SEQ ID NO: 177881 - protein, 9 aa, Homo Sapiens
WEEEEEEER

SEQ ID NO: 177882 - protein, 9 aa, Homo Sapiens
HKLESPALK

SEQ ID NO: 177883 - protein, 9 aa, Homo Sapiens
NLTYRFLDT

SEQ ID NO: 177884 - protein, 9 aa, Homo Sapiens
GRWCWWGRG

SEQ ID NO: 177885 - protein, 9 aa, Homo Sapiens
PQLGPRGPE

SEQ ID NO: 177886 - protein, 9 aa, Homo Sapiens
VRESKWVAL

SEQ ID NO: 177887 - protein, 9 aa, Homo Sapiens
QLIDGKVTE

SEQ ID NO: 177888 - protein, 9 aa, Homo Sapiens
RVRVLAHHV

SEQ ID NO: 177889 - protein, 9 aa, Homo Sapiens
KNPMGVLSV

SEQ ID NO: 177890 - protein, 9 aa, Homo Sapiens
QHADKWDKT

SEQ ID NO: 177891 - protein, 9 aa, Homo Sapiens
RSSLISIYS

SEQ ID NO: 177892 - protein, 9 aa, Homo Sapiens
CLKIKYWEL

SEQ ID NO: 177893 - protein, 9 aa, Homo Sapiens
SWSSQTAAE

SEQ ID NO: 177894 - protein, 9 aa, Homo Sapiens
CQSHCTMRG

SEQ ID NO: 177895 - protein, 9 aa, Homo Sapiens
TDPSLSRAR

SEQ ID NO: 177896 - protein, 9 aa, Homo Sapiens
DVGNPALGK

SEQ ID NO: 177897 - protein, 9 aa, Homo Sapiens
TTNLQDSLQ

SEQ ID NO: 177898 - protein, 9 aa, Homo Sapiens
YYSWKKNSL

SEQ ID NO: 177899 - protein, 9 aa, Homo Sapiens
AVGFNGCSP

SEQ ID NO: 177900 - protein, 9 aa, Homo Sapiens
GLLNEDDEC

SEQ ID NO: 177901 - protein, 9 aa, Homo Sapiens
NCIYTYRIL

SEQ ID NO: 177902 - protein, 9 aa, Homo Sapiens
ALQHGQQAL

SEQ ID NO: 177903 - protein, 9 aa, Homo Sapiens
QKTGTPIGL

SEQ ID NO: 177904 - protein, 9 aa, Homo Sapiens
DVVCITDEI

SEQ ID NO: 177905 - protein, 9 aa, Homo Sapiens
SPSEVVFWM

SEQ ID NO: 177906 - protein, 9 aa, Homo Sapiens
TGVRTRGSP

SEQ ID NO: 177907 - protein, 9 aa, Homo Sapiens
VELVAGQPA

SEQ ID NO: 177908 - protein, 9 aa, Homo Sapiens
TPRSCKRVI

SEQ ID NO: 177909 - protein, 9 aa, Homo Sapiens
RGLFRGVED

SEQ ID NO: 177910 - protein, 9 aa, Homo Sapiens
QLKTGRQRL

SEQ ID NO: 177911 - protein, 9 aa, Homo Sapiens
KSIRAKKPI

SEQ ID NO: 177912 - protein, 9 aa, Homo Sapiens
AHEDKERAW

SEQ ID NO: 177913 - protein, 9 aa, Homo Sapiens
SMGLSLAST

SEQ ID NO: 177914 - protein, 9 aa, Homo Sapiens
EVREGEEGL

SEQ ID NO: 177915 - protein, 9 aa, Homo Sapiens
HLEEWRTLV

SEQ ID NO: 177916 - protein, 9 aa, Homo Sapiens
LTDTGCYTL

SEQ ID NO: 177917 - protein, 9 aa, Homo Sapiens
CDQKLQRCF

SEQ ID NO: 177918 - protein, 9 aa, Homo Sapiens
NQSLNSDYK

SEQ ID NO: 177919 - protein, 9 aa, Homo Sapiens
TPRPGRLPP

SEQ ID NO: 177920 - protein, 9 aa, Homo Sapiens
QPSNWIQKT

SEQ ID NO: 177921 - protein, 9 aa, Homo Sapiens
SPHIALLGS

SEQ ID NO: 177922 - protein, 9 aa, Homo Sapiens
HHRRQLRWK

SEQ ID NO: 177923 - protein, 9 aa, Homo Sapiens
STISCPRPS

SEQ ID NO: 177924 - protein, 9 aa, Homo Sapiens
VDLQVPRSG

SEQ ID NO: 177925 - protein, 9 aa, Homo Sapiens
YHLAPPMGV

SEQ ID NO: 177926 - protein, 9 aa, Homo Sapiens
RGINHARAL

SEQ ID NO: 177927 - protein, 9 aa, Homo Sapiens
SEVVFWMTS

SEQ ID NO: 177928 - protein, 9 aa, Homo Sapiens
TLKLPETIG

SEQ ID NO: 177929 - protein, 9 aa, Homo Sapiens
HALHRHAVL

SEQ ID NO: 177930 - protein, 9 aa, Homo Sapiens
ENMCCNKSG

SEQ ID NO: 177931 - protein, 9 aa, Homo Sapiens
ARAVAHLLA

SEQ ID NO: 177932 - protein, 9 aa, Homo Sapiens
TAAELQAFF

SEQ ID NO: 177933 - protein, 9 aa, Homo Sapiens
CAKEAADQG

SEQ ID NO: 177934 - protein, 9 aa, Homo Sapiens
MITTVGKVV

SEQ ID NO: 177935 - protein, 9 aa, Homo Sapiens
AAVSPRGLQ

SEQ ID NO: 177936 - protein, 9 aa, Homo Sapiens
YGWQCMVGN

SEQ ID NO: 177937 - protein, 9 aa, Homo Sapiens
LRTHDLTLA

SEQ ID NO: 177938 - protein, 9 aa, Homo Sapiens
LCQAMSCGI

SEQ ID NO: 177939 - protein, 9 aa, Homo Sapiens
TGEKQFHCP

SEQ ID NO: 177940 - protein, 9 aa, Homo Sapiens
CSRGSQRAV

SEQ ID NO: 177941 - protein, 9 aa, Homo Sapiens
RGGEIILCD

SEQ ID NO: 177942 - protein, 9 aa, Homo Sapiens
IGNLLYYQY

SEQ ID NO: 177943 - protein, 9 aa, Homo Sapiens
HRRLLSLVM

SEQ ID NO: 177944 - protein, 9 aa, Homo Sapiens
GSPCSRRWR

SEQ ID NO: 177945 - protein, 9 aa, Homo Sapiens
VKVTDLVSD

SEQ ID NO: 177946 - protein, 9 aa, Homo Sapiens
SPQLQSPVY

SEQ ID NO: 177947 - protein, 9 aa, Homo Sapiens
WLVKVTDLV

SEQ ID NO: 177948 - protein, 9 aa, Homo Sapiens
GLDPSSWTT

SEQ ID NO: 177949 - protein, 9 aa, Homo Sapiens
PWRSGDEAP

SEQ ID NO: 177950 - protein, 9 aa, Homo Sapiens
RPFHLEEWR

SEQ ID NO: 177951 - protein, 9 aa, Homo Sapiens
ECRVRVLAH

SEQ ID NO: 177952 - protein, 9 aa, Homo Sapiens
EKLADLWGK

SEQ ID NO: 177953 - protein, 9 aa, Homo Sapiens
QAVLSLNAS

SEQ ID NO: 177954 - protein, 9 aa, Homo Sapiens
PLRLTLWPP

SEQ ID NO: 177955 - protein, 9 aa, Homo Sapiens
GQSKIFFQT

SEQ ID NO: 177956 - protein, 9 aa, Homo Sapiens
YNRSSGNFS

SEQ ID NO: 177957 - protein, 9 aa, Homo Sapiens
PTRATGWPW

SEQ ID NO: 177958 - protein, 9 aa, Homo Sapiens
MERLKRGIN

SEQ ID NO: 177959 - protein, 9 aa, Homo Sapiens
EKSGIGAGV

SEQ ID NO: 177960 - protein, 9 aa, Homo Sapiens
LCAQRLHLL

SEQ ID NO: 177961 - protein, 9 aa, Homo Sapiens
CPWATSLPR

SEQ ID NO: 177962 - protein, 9 aa, Homo Sapiens
GLITVRCFF

SEQ ID NO: 177963 - protein, 9 aa, Homo Sapiens
VMPTVAMPP

SEQ ID NO: 177964 - protein, 9 aa, Homo Sapiens
RFVFAAAKD

SEQ ID NO: 177965 - protein, 9 aa, Homo Sapiens
DVEPFFVTL

SEQ ID NO: 177966 - protein, 9 aa, Homo Sapiens
EAAFQRMLA

SEQ ID NO: 177967 - protein, 9 aa, Homo Sapiens
LTLPCTSWL

SEQ ID NO: 177968 - protein, 9 aa, Homo Sapiens
ERHVPSASF

SEQ ID NO: 177969 - protein, 9 aa, Homo Sapiens
YAKLEPRDR

SEQ ID NO: 177970 - protein, 9 aa, Homo Sapiens
AGERAMQRL

SEQ ID NO: 177971 - protein, 9 aa, Homo Sapiens
LKIKYWELL

SEQ ID NO: 177972 - protein, 9 aa, Homo Sapiens
AVCTTAPPT

SEQ ID NO: 177973 - protein, 9 aa, Homo Sapiens
TVPLNPPPP

SEQ ID NO: 177974 - protein, 9 aa, Homo Sapiens
HLPSSQNIT

SEQ ID NO: 177975 - protein, 9 aa, Homo Sapiens
FGIQVIQED

SEQ ID NO: 177976 - protein, 9 aa, Homo Sapiens
VTTEISPEK

SEQ ID NO: 177977 - protein, 9 aa, Homo Sapiens
VDVLPAPVI

SEQ ID NO: 177978 - protein, 9 aa, Homo Sapiens
TARIEGPAP

SEQ ID NO: 177979 - protein, 9 aa, Homo Sapiens
IKKGRVMVK

SEQ ID NO: 177980 - protein, 9 aa, Homo Sapiens
WLERAYGRL

SEQ ID NO: 177981 - protein, 9 aa, Homo Sapiens
WFGTRVTNS

SEQ ID NO: 177982 - protein, 9 aa, Homo Sapiens
AGTIFTIDE

SEQ ID NO: 177983 - protein, 9 aa, Homo Sapiens
MDRSETPQL

SEQ ID NO: 177984 - protein, 9 aa, Homo Sapiens
EKKINNQII

SEQ ID NO: 177985 - protein, 9 aa, Homo Sapiens
QTIEHMGSG

SEQ ID NO: 177986 - protein, 9 aa, Homo Sapiens
KEGLSVNML

SEQ ID NO: 177987 - protein, 9 aa, Homo Sapiens
VPGDNVEIA

SEQ ID NO: 177988 - protein, 9 aa, Homo Sapiens
CKYPNRPSK

SEQ ID NO: 177989 - protein, 9 aa, Homo Sapiens
CLSVIFFFF

SEQ ID NO: 177990 - protein, 9 aa, Homo Sapiens
RHGLCDQWR

SEQ ID NO: 177991 - protein, 9 aa, Homo Sapiens
LLIQFWDWK

SEQ ID NO: 177992 - protein, 9 aa, Homo Sapiens
HQAAFQKLK

SEQ ID NO: 177993 - protein, 9 aa, Homo Sapiens
KTPWFIHGL

SEQ ID NO: 177994 - protein, 9 aa, Homo Sapiens
ECRPKKRTV

SEQ ID NO: 177995 - protein, 9 aa, Homo Sapiens
GLNQRLLLL

SEQ ID NO: 177996 - protein, 9 aa, Homo Sapiens
GERWTFISS

SEQ ID NO: 177997 - protein, 9 aa, Homo Sapiens
GDLTSLGLH

SEQ ID NO: 177998 - protein, 9 aa, Homo Sapiens
LYFFYYGWQ

SEQ ID NO: 177999 - protein, 9 aa, Homo Sapiens
QYEKSLNQP

SEQ ID NO: 178000 - protein, 9 aa, Homo Sapiens
ALRDMPQMR

SEQ ID NO: 178001 - protein, 9 aa, Homo Sapiens
HLEEVDLSV

SEQ ID NO: 178002 - protein, 9 aa, Homo Sapiens
MHDGGMLML

SEQ ID NO: 178003 - protein, 9 aa, Homo Sapiens
MLLRQHEAE

SEQ ID NO: 178004 - protein, 9 aa, Homo Sapiens
TAWKTKKTS

SEQ ID NO: 178005 - protein, 9 aa, Homo Sapiens
QCDAHSARQ

SEQ ID NO: 178006 - protein, 9 aa, Homo Sapiens
LSPTIPGPL

SEQ ID NO: 178007 - protein, 9 aa, Homo Sapiens
QYPAIMTVG

SEQ ID NO: 178008 - protein, 9 aa, Homo Sapiens
GRNELAEVR

SEQ ID NO: 178009 - protein, 9 aa, Homo Sapiens
VGRRCLTRA

SEQ ID NO: 178010 - protein, 9 aa, Homo Sapiens
YMWSASSGD

SEQ ID NO: 178011 - protein, 9 aa, Homo Sapiens
YWKPSTFGS

SEQ ID NO: 178012 - protein, 9 aa, Homo Sapiens
RASPTFISI

SEQ ID NO: 178013 - protein, 9 aa, Homo Sapiens
EERRLHQAA

SEQ ID NO: 178014 - protein, 9 aa, Homo Sapiens
TKHALPRTG

SEQ ID NO: 178015 - protein, 9 aa, Homo Sapiens
APPPSSPPQ

SEQ ID NO: 178016 - protein, 9 aa, Homo Sapiens
SLYSVAVWP

SEQ ID NO: 178017 - protein, 9 aa, Homo Sapiens
LMALELSNE

SEQ ID NO: 178018 - protein, 9 aa, Homo Sapiens
KEVEYHTTT

SEQ ID NO: 178019 - protein, 9 aa, Homo Sapiens
HGLCDQWRI

SEQ ID NO: 178020 - protein, 9 aa, Homo Sapiens
TKGRGEEQN

SEQ ID NO: 178021 - protein, 9 aa, Homo Sapiens
HHKHGKHSS

SEQ ID NO: 178022 - protein, 9 aa, Homo Sapiens
HTHRVRVGE

SEQ ID NO: 178023 - protein, 9 aa, Homo Sapiens
KWTAVPLQH

SEQ ID NO: 178024 - protein, 9 aa, Homo Sapiens
QSLLSLYSV

SEQ ID NO: 178025 - protein, 9 aa, Homo Sapiens
DSGLMVIEL

SEQ ID NO: 178026 - protein, 9 aa, Homo Sapiens
RKLHSWKKS

SEQ ID NO: 178027 - protein, 9 aa, Homo Sapiens
TGLPATSLC

SEQ ID NO: 178028 - protein, 9 aa, Homo Sapiens
HKHQKHHKH

SEQ ID NO: 178029 - protein, 9 aa, Homo Sapiens
PPELPPASP

SEQ ID NO: 178030 - protein, 9 aa, Homo Sapiens
GSHLYYSFK

SEQ ID NO: 178031 - protein, 9 aa, Homo Sapiens
VMAHVPDAV

SEQ ID NO: 178032 - protein, 9 aa, Homo Sapiens
QCDKKRGAS

SEQ ID NO: 178033 - protein, 9 aa, Homo Sapiens
HQVTHTAAA

SEQ ID NO: 178034 - protein, 9 aa, Homo Sapiens
VRHMPVASS

SEQ ID NO: 178035 - protein, 9 aa, Homo Sapiens
KMSQTLLLW

SEQ ID NO: 178036 - protein, 9 aa, Homo Sapiens
RTRGSPLRL

SEQ ID NO: 178037 - protein, 9 aa, Homo Sapiens
VPPEWKALR

SEQ ID NO: 178038 - protein, 9 aa, Homo Sapiens
MLPRRPATS

SEQ ID NO: 178039 - protein, 9 aa, Homo Sapiens
LKRFRASCE

SEQ ID NO: 178040 - protein, 9 aa, Homo Sapiens
VQDGLRTHD

SEQ ID NO: 178041 - protein, 9 aa, Homo Sapiens
RPGPCPPPQ

SEQ ID NO: 178042 - protein, 9 aa, Homo Sapiens
ACSWKASPC

SEQ ID NO: 178043 - protein, 9 aa, Homo Sapiens
REHGDPSRH

SEQ ID NO: 178044 - protein, 9 aa, Homo Sapiens
PRAATPAPR

SEQ ID NO: 178045 - protein, 9 aa, Homo Sapiens
EDPVLMALE

SEQ ID NO: 178046 - protein, 9 aa, Homo Sapiens
LTIQVMGEL

SEQ ID NO: 178047 - protein, 9 aa, Homo Sapiens
PARAAVCTT

SEQ ID NO: 178048 - protein, 9 aa, Homo Sapiens
FRCYSYENN

SEQ ID NO: 178049 - protein, 9 aa, Homo Sapiens
LGYNSGFFL

SEQ ID NO: 178050 - protein, 9 aa, Homo Sapiens
LNEDDECHA

SEQ ID NO: 178051 - protein, 9 aa, Homo Sapiens
GVSLGEWMT

SEQ ID NO: 178052 - protein, 9 aa, Homo Sapiens
GRRSMGKRA

SEQ ID NO: 178053 - protein, 9 aa, Homo Sapiens
KTVYFHTRC

SEQ ID NO: 178054 - protein, 9 aa, Homo Sapiens
KYKKSVSRP

SEQ ID NO: 178055 - protein, 9 aa, Homo Sapiens
KCGDMIVVV

SEQ ID NO: 178056 - protein, 9 aa, Homo Sapiens
PGQKGEKKA

SEQ ID NO: 178057 - protein, 9 aa, Homo Sapiens
GAPQWPLST

SEQ ID NO: 178058 - protein, 9 aa, Homo Sapiens
VAGITWFLA

SEQ ID NO: 178059 - protein, 9 aa, Homo Sapiens
KVPVVVLLI

SEQ ID NO: 178060 - protein, 9 aa, Homo Sapiens
YNTPCRALF

SEQ ID NO: 178061 - protein, 9 aa, Homo Sapiens
WSKDPSQCP

SEQ ID NO: 178062 - protein, 9 aa, Homo Sapiens
FQEENQSLN

SEQ ID NO: 178063 - protein, 9 aa, Homo Sapiens
IPELLGHRA

SEQ ID NO: 178064 - protein, 9 aa, Homo Sapiens
FAGIVTFSI

SEQ ID NO: 178065 - protein, 9 aa, Homo Sapiens
STSRDSRSF

SEQ ID NO: 178066 - protein, 9 aa, Homo Sapiens
AADQGQGPH

SEQ ID NO: 178067 - protein, 9 aa, Homo Sapiens
PRRPATSSR

SEQ ID NO: 178068 - protein, 9 aa, Homo Sapiens
VTDAVRKEY

SEQ ID NO: 178069 - protein, 9 aa, Homo Sapiens
HRVLLWPRW

SEQ ID NO: 178070 - protein, 9 aa, Homo Sapiens
PQAPLRLWS

SEQ ID NO: 178071 - protein, 9 aa, Homo Sapiens
LHYLHNFQG

SEQ ID NO: 178072 - protein, 9 aa, Homo Sapiens
STSCGDSDS

SEQ ID NO: 178073 - protein, 9 aa, Homo Sapiens
ASPPSACTR

SEQ ID NO: 178074 - protein, 9 aa, Homo Sapiens
VNTAWKTKK

SEQ ID NO: 178075 - protein, 9 aa, Homo Sapiens
GGFLPPVSW

SEQ ID NO: 178076 - protein, 9 aa, Homo Sapiens
AVKTVYFHT

SEQ ID NO: 178077 - protein, 9 aa, Homo Sapiens
MPPLLATMG

SEQ ID NO: 178078 - protein, 9 aa, Homo Sapiens
HMRNHVSHY

SEQ ID NO: 178079 - protein, 9 aa, Homo Sapiens
RGARPEGGP

SEQ ID NO: 178080 - protein, 9 aa, Homo Sapiens
TYTPRHPRS

SEQ ID NO: 178081 - protein, 9 aa, Homo Sapiens
SRGSSSSVF

SEQ ID NO: 178082 - protein, 9 aa, Homo Sapiens
PEDGLSTEL

SEQ ID NO: 178083 - protein, 9 aa, Homo Sapiens
QILICFLKM

SEQ ID NO: 178084 - protein, 9 aa, Homo Sapiens
NLGHLYEEY

SEQ ID NO: 178085 - protein, 9 aa, Homo Sapiens
LRTSGEPWD

SEQ ID NO: 178086 - protein, 9 aa, Homo Sapiens
SECAVRTAV

SEQ ID NO: 178087 - protein, 9 aa, Homo Sapiens
PATSSRRPS

SEQ ID NO: 178088 - protein, 9 aa, Homo Sapiens
HRYSSSQVP

SEQ ID NO: 178089 - protein, 9 aa, Homo Sapiens
RILEREGSR

SEQ ID NO: 178090 - protein, 9 aa, Homo Sapiens
SLRSQHRYS

SEQ ID NO: 178091 - protein, 9 aa, Homo Sapiens
SAREAIAVV

SEQ ID NO: 178092 - protein, 9 aa, Homo Sapiens
SLFRQEDDR

SEQ ID NO: 178093 - protein, 9 aa, Homo Sapiens
PPPSSPPQA

SEQ ID NO: 178094 - protein, 9 aa, Homo Sapiens
EVVEMWKKN

SEQ ID NO: 178095 - protein, 9 aa, Homo Sapiens
MRAQRVHMG

SEQ ID NO: 178096 - protein, 9 aa, Homo Sapiens
VLVCLLFLL

SEQ ID NO: 178097 - protein, 9 aa, Homo Sapiens
AKIQSGTAY

SEQ ID NO: 178098 - protein, 9 aa, Homo Sapiens
VSCLAAARQ

SEQ ID NO: 178099 - protein, 9 aa, Homo Sapiens
SLAHQNSER

SEQ ID NO: 178100 - protein, 9 aa, Homo Sapiens
YLYICYERN

SEQ ID NO: 178101 - protein, 9 aa, Homo Sapiens
TVVLRRTPP

SEQ ID NO: 178102 - protein, 9 aa, Homo Sapiens
GNGRPSCRI

SEQ ID NO: 178103 - protein, 9 aa, Homo Sapiens
IFNLGHLYE

SEQ ID NO: 178104 - protein, 9 aa, Homo Sapiens
REQDALEAV

SEQ ID NO: 178105 - protein, 9 aa, Homo Sapiens
VTSQPRSLD

SEQ ID NO: 178106 - protein, 9 aa, Homo Sapiens
IRAKKPIKY

SEQ ID NO: 178107 - protein, 9 aa, Homo Sapiens
ARGAALQTG

SEQ ID NO: 178108 - protein, 9 aa, Homo Sapiens
GLELVFALR

SEQ ID NO: 178109 - protein, 9 aa, Homo Sapiens
GLLAERAQM

SEQ ID NO: 178110 - protein, 9 aa, Homo Sapiens
EWINSHFHL

SEQ ID NO: 178111 - protein, 9 aa, Homo Sapiens
RKGPDFGSL

SEQ ID NO: 178112 - protein, 9 aa, Homo Sapiens
PNHPSTAQS

SEQ ID NO: 178113 - protein, 9 aa, Homo Sapiens
MKLLRILLQ

SEQ ID NO: 178114 - protein, 9 aa, Homo Sapiens
KENIRPMWQ

SEQ ID NO: 178115 - protein, 9 aa, Homo Sapiens
GEGASPGAW

SEQ ID NO: 178116 - protein, 9 aa, Homo Sapiens
KRLEEKRAF

SEQ ID NO: 178117 - protein, 9 aa, Homo Sapiens
FVVVTNHFW

SEQ ID NO: 178118 - protein, 9 aa, Homo Sapiens
ELERKLGAT

SEQ ID NO: 178119 - protein, 9 aa, Homo Sapiens
RTQTASTPA

SEQ ID NO: 178120 - protein, 9 aa, Homo Sapiens
LGQDHSDGI

SEQ ID NO: 178121 - protein, 9 aa, Homo Sapiens
RRSMGKRAC

SEQ ID NO: 178122 - protein, 9 aa, Homo Sapiens
AKTFLQQEH

SEQ ID NO: 178123 - protein, 9 aa, Homo Sapiens
QPTVSTGGH

SEQ ID NO: 178124 - protein, 9 aa, Homo Sapiens
LAVEGPTAK

SEQ ID NO: 178125 - protein, 9 aa, Homo Sapiens
DMIKEGAVV

SEQ ID NO: 178126 - protein, 9 aa, Homo Sapiens
VITILIEHT

SEQ ID NO: 178127 - protein, 9 aa, Homo Sapiens
MMTTVATDY

SEQ ID NO: 178128 - protein, 9 aa, Homo Sapiens
GTLGMSLTS

SEQ ID NO: 178129 - protein, 9 aa, Homo Sapiens
MAVLWPSQV

SEQ ID NO: 178130 - protein, 9 aa, Homo Sapiens
AEITLTRQR

SEQ ID NO: 178131 - protein, 9 aa, Homo Sapiens
LFLPNHTLF

SEQ ID NO: 178132 - protein, 9 aa, Homo Sapiens
QHSCTHCWA

SEQ ID NO: 178133 - protein, 9 aa, Homo Sapiens
GLGGWHGFP

SEQ ID NO: 178134 - protein, 9 aa, Homo Sapiens
HLSAASPCH

SEQ ID NO: 178135 - protein, 9 aa, Homo Sapiens
KTSLSADII

SEQ ID NO: 178136 - protein, 9 aa, Homo Sapiens
DECHASFLR

SEQ ID NO: 178137 - protein, 9 aa, Homo Sapiens
PRWRDYKRL

SEQ ID NO: 178138 - protein, 9 aa, Homo Sapiens
KPSMILGNA

SEQ ID NO: 178139 - protein, 9 aa, Homo Sapiens
HLSRRRKNQ

SEQ ID NO: 178140 - protein, 9 aa, Homo Sapiens
SVLRKHRII

SEQ ID NO: 178141 - protein, 9 aa, Homo Sapiens
GRSQEGKKP

SEQ ID NO: 178142 - protein, 9 aa, Homo Sapiens
NSDINLKIK

SEQ ID NO: 178143 - protein, 9 aa, Homo Sapiens
PWTLRKQPQ

SEQ ID NO: 178144 - protein, 9 aa, Homo Sapiens
LERHVPSAS

SEQ ID NO: 178145 - protein, 9 aa, Homo Sapiens
ARAAVCTTA

SEQ ID NO: 178146 - protein, 9 aa, Homo Sapiens
GQVAEDHVE

SEQ ID NO: 178147 - protein, 9 aa, Homo Sapiens
SWTSRSVVP

SEQ ID NO: 178148 - protein, 9 aa, Homo Sapiens
CVKETLLFY

SEQ ID NO: 178149 - protein, 9 aa, Homo Sapiens
EDHVEMLYP

SEQ ID NO: 178150 - protein, 9 aa, Homo Sapiens
GGRGHPDGG

SEQ ID NO: 178151 - protein, 9 aa, Homo Sapiens
GSPLRLTLW

SEQ ID NO: 178152 - protein, 9 aa, Homo Sapiens
SDPLEPVVT

SEQ ID NO: 178153 - protein, 9 aa, Homo Sapiens
THTGEKQFH

SEQ ID NO: 178154 - protein, 9 aa, Homo Sapiens
PLTQLEVAR

SEQ ID NO: 178155 - protein, 9 aa, Homo Sapiens
PPDITTCKS

SEQ ID NO: 178156 - protein, 9 aa, Homo Sapiens
NKKWKRFVV

SEQ ID NO: 178157 - protein, 9 aa, Homo Sapiens
VLSTPAVSC

SEQ ID NO: 178158 - protein, 9 aa, Homo Sapiens
YIEFANLDG

SEQ ID NO: 178159 - protein, 9 aa, Homo Sapiens
ASSLQTHPR

SEQ ID NO: 178160 - protein, 9 aa, Homo Sapiens
SPTDHPGLH

SEQ ID NO: 178161 - protein, 9 aa, Homo Sapiens
YLWTTNLQD

SEQ ID NO: 178162 - protein, 9 aa, Homo Sapiens
AFSLLCPHS

SEQ ID NO: 178163 - protein, 9 aa, Homo Sapiens
VSPASPPTQ

SEQ ID NO: 178164 - protein, 9 aa, Homo Sapiens
ATNYSLMVR

SEQ ID NO: 178165 - protein, 9 aa, Homo Sapiens
SAEDLSIFL

SEQ ID NO: 178166 - protein, 9 aa, Homo Sapiens
DFLCARQPR

SEQ ID NO: 178167 - protein, 9 aa, Homo Sapiens
CTMRGARGI

SEQ ID NO: 178168 - protein, 9 aa, Homo Sapiens
VLWPFGFED

SEQ ID NO: 178169 - protein, 9 aa, Homo Sapiens
YSEQETEPP

SEQ ID NO: 178170 - protein, 9 aa, Homo Sapiens
RTQNAELCV

SEQ ID NO: 178171 - protein, 9 aa, Homo Sapiens
LVSAEDLAG

SEQ ID NO: 178172 - protein, 9 aa, Homo Sapiens
WLAALPQAT

SEQ ID NO: 178173 - protein, 9 aa, Homo Sapiens
AKKKAQLHF

SEQ ID NO: 178174 - protein, 9 aa, Homo Sapiens
CVLFVLKEM

SEQ ID NO: 178175 - protein, 9 aa, Homo Sapiens
ANILFDGVS

SEQ ID NO: 178176 - protein, 9 aa, Homo Sapiens
YLTIQVMGE

SEQ ID NO: 178177 - protein, 9 aa, Homo Sapiens
TTRSCGPSS

SEQ ID NO: 178178 - protein, 9 aa, Homo Sapiens
GEGVSLGEW

SEQ ID NO: 178179 - protein, 9 aa, Homo Sapiens
PLGGREKKK

SEQ ID NO: 178180 - protein, 9 aa, Homo Sapiens
LKTSLSADI

SEQ ID NO: 178181 - protein, 9 aa, Homo Sapiens
SAHPSRPCR

SEQ ID NO: 178182 - protein, 9 aa, Homo Sapiens
GKKVPTVSQ

SEQ ID NO: 178183 - protein, 9 aa, Homo Sapiens
QEQPRRKHS

SEQ ID NO: 178184 - protein, 9 aa, Homo Sapiens
NMGWSVCGF

SEQ ID NO: 178185 - protein, 9 aa, Homo Sapiens
GSRAFYRGY

SEQ ID NO: 178186 - protein, 9 aa, Homo Sapiens
SYENNTPYV

SEQ ID NO: 178187 - protein, 9 aa, Homo Sapiens
GLSVNMLVR

SEQ ID NO: 178188 - protein, 9 aa, Homo Sapiens
VVVNGLSTV

SEQ ID NO: 178189 - protein, 9 aa, Homo Sapiens
GCYTLKTVT

SEQ ID NO: 178190 - protein, 9 aa, Homo Sapiens
RRPAGKESR

SEQ ID NO: 178191 - protein, 9 aa, Homo Sapiens
RSPASLSFA

SEQ ID NO: 178192 - protein, 9 aa, Homo Sapiens
CRHMRGNQL

SEQ ID NO: 178193 - protein, 9 aa, Homo Sapiens
PQRGQYGPQ

SEQ ID NO: 178194 - protein, 9 aa, Homo Sapiens
FFQSPGSMP

SEQ ID NO: 178195 - protein, 9 aa, Homo Sapiens
QLLLQLVQL

SEQ ID NO: 178196 - protein, 9 aa, Homo Sapiens
VVLGQSGAA

SEQ ID NO: 178197 - protein, 9 aa, Homo Sapiens
MGSYGPQRG

SEQ ID NO: 178198 - protein, 9 aa, Homo Sapiens
KAGAATMKK

SEQ ID NO: 178199 - protein, 9 aa, Homo Sapiens
KTVIIVLSI

SEQ ID NO: 178200 - protein, 9 aa, Homo Sapiens
PNEVFCFLV

SEQ ID NO: 178201 - protein, 9 aa, Homo Sapiens
TWRPFHFQH

SEQ ID NO: 178202 - protein, 9 aa, Homo Sapiens
IRCRLSSKG

SEQ ID NO: 178203 - protein, 9 aa, Homo Sapiens
VRVGEAVVV

SEQ ID NO: 178204 - protein, 9 aa, Homo Sapiens
ILRKPEWIF

SEQ ID NO: 178205 - protein, 9 aa, Homo Sapiens
RQPNSTAAT

SEQ ID NO: 178206 - protein, 9 aa, Homo Sapiens
VLMALELSN

SEQ ID NO: 178207 - protein, 9 aa, Homo Sapiens
TSPSQGILG

SEQ ID NO: 178208 - protein, 9 aa, Homo Sapiens
PSMILGNAR

SEQ ID NO: 178209 - protein, 9 aa, Homo Sapiens
ADMPPLPQE

SEQ ID NO: 178210 - protein, 9 aa, Homo Sapiens
NVNRIKKPI

SEQ ID NO: 178211 - protein, 9 aa, Homo Sapiens
MTKKTFNPI

SEQ ID NO: 178212 - protein, 9 aa, Homo Sapiens
TRSSPTLTS

SEQ ID NO: 178213 - protein, 9 aa, Homo Sapiens
GEKTEIQLT

SEQ ID NO: 178214 - protein, 9 aa, Homo Sapiens
GVWPCDISR

SEQ ID NO: 178215 - protein, 9 aa, Homo Sapiens
QVRYWAKGE

SEQ ID NO: 178216 - protein, 9 aa, Homo Sapiens
KRLPSQNVC

SEQ ID NO: 178217 - protein, 9 aa, Homo Sapiens
HAKLPGPAP

SEQ ID NO: 178218 - protein, 9 aa, Homo Sapiens
LRDSRDMWD

SEQ ID NO: 178219 - protein, 9 aa, Homo Sapiens
DAVETLGST

SEQ ID NO: 178220 - protein, 9 aa, Homo Sapiens
QQYQRALDM

SEQ ID NO: 178221 - protein, 9 aa, Homo Sapiens
ISVNSVSVE

SEQ ID NO: 178222 - protein, 9 aa, Homo Sapiens
PFGFEDDPY

SEQ ID NO: 178223 - protein, 9 aa, Homo Sapiens
LMPKEQARI

SEQ ID NO: 178224 - protein, 9 aa, Homo Sapiens
AFPQPLPCV

SEQ ID NO: 178225 - protein, 9 aa, Homo Sapiens
DMKKLKTRM

SEQ ID NO: 178226 - protein, 9 aa, Homo Sapiens
TIEEHPASL

SEQ ID NO: 178227 - protein, 9 aa, Homo Sapiens
ISTPEEPGL

SEQ ID NO: 178228 - protein, 9 aa, Homo Sapiens
DEVLFGPGR

SEQ ID NO: 178229 - protein, 9 aa, Homo Sapiens
VPGFQYHPN

SEQ ID NO: 178230 - protein, 9 aa, Homo Sapiens
CQLMGVTKI

SEQ ID NO: 178231 - protein, 9 aa, Homo Sapiens
SVSSQHKQG

SEQ ID NO: 178232 - protein, 9 aa, Homo Sapiens
WRRRAIAAR

SEQ ID NO: 178233 - protein, 9 aa, Homo Sapiens
FVVTDAVRK

SEQ ID NO: 178234 - protein, 9 aa, Homo Sapiens
AAATFAYLL

SEQ ID NO: 178235 - protein, 9 aa, Homo Sapiens
VGFCGKLVS

SEQ ID NO: 178236 - protein, 9 aa, Homo Sapiens
PPKPWQSPW

SEQ ID NO: 178237 - protein, 9 aa, Homo Sapiens
ITTCKSPSN

SEQ ID NO: 178238 - protein, 9 aa, Homo Sapiens
FKIDSAIDL

SEQ ID NO: 178239 - protein, 9 aa, Homo Sapiens
MLIDGLKEL

SEQ ID NO: 178240 - protein, 9 aa, Homo Sapiens
TTERLLSWR

SEQ ID NO: 178241 - protein, 9 aa, Homo Sapiens
KCPLLLVYI

SEQ ID NO: 178242 - protein, 9 aa, Homo Sapiens
PNATYSICV

SEQ ID NO: 178243 - protein, 9 aa, Homo Sapiens
IGDHMKNGP

SEQ ID NO: 178244 - protein, 9 aa, Homo Sapiens
HAKVTILQK

SEQ ID NO: 178245 - protein, 9 aa, Homo Sapiens
ESGPPVPSK

SEQ ID NO: 178246 - protein, 9 aa, Homo Sapiens
WRACCPLPL

SEQ ID NO: 178247 - protein, 9 aa, Homo Sapiens
DASPPSACT

SEQ ID NO: 178248 - protein, 9 aa, Homo Sapiens
WWGRGCCLR

SEQ ID NO: 178249 - protein, 9 aa, Homo Sapiens
LEEEVLPII

SEQ ID NO: 178250 - protein, 9 aa, Homo Sapiens
YSSPKNHGQ

SEQ ID NO: 178251 - protein, 9 aa, Homo Sapiens
RGFPGYTGP

SEQ ID NO: 178252 - protein, 9 aa, Homo Sapiens
HFHLSKDLD

SEQ ID NO: 178253 - protein, 9 aa, Homo Sapiens
VCRAIFSLL

SEQ ID NO: 178254 - protein, 9 aa, Homo Sapiens
KERAWLSPT

SEQ ID NO: 178255 - protein, 9 aa, Homo Sapiens
GEQGPLEAE

SEQ ID NO: 178256 - protein, 9 aa, Homo Sapiens
NVGSPSARR

SEQ ID NO: 178257 - protein, 9 aa, Homo Sapiens
SSSSTSSLW

SEQ ID NO: 178258 - protein, 9 aa, Homo Sapiens
PEEHAHGAV

SEQ ID NO: 178259 - protein, 9 aa, Homo Sapiens
SRALGPVSL

SEQ ID NO: 178260 - protein, 9 aa, Homo Sapiens
SVAVKMDNS

SEQ ID NO: 178261 - protein, 9 aa, Homo Sapiens
EWKALRDMP

SEQ ID NO: 178262 - protein, 9 aa, Homo Sapiens
SLMIIPWRE

SEQ ID NO: 178263 - protein, 9 aa, Homo Sapiens
HRVITILIE

SEQ ID NO: 178264 - protein, 9 aa, Homo Sapiens
KMPESWGPA

SEQ ID NO: 178265 - protein, 9 aa, Homo Sapiens
RCTTNMVQE

SEQ ID NO: 178266 - protein, 9 aa, Homo Sapiens
VRCFFFNHG

SEQ ID NO: 178267 - protein, 9 aa, Homo Sapiens
STVWLSLIS

SEQ ID NO: 178268 - protein, 9 aa, Homo Sapiens
LDLEYLFPC

SEQ ID NO: 178269 - protein, 9 aa, Homo Sapiens
PVLICRFKE

SEQ ID NO: 178270 - protein, 9 aa, Homo Sapiens
NRGTFRCYS

SEQ ID NO: 178271 - protein, 9 aa, Homo Sapiens
LDKMTMSFW

SEQ ID NO: 178272 - protein, 9 aa, Homo Sapiens
NPRKLHSDL

SEQ ID NO: 178273 - protein, 9 aa, Homo Sapiens
VSGKPTESS

SEQ ID NO: 178274 - protein, 9 aa, Homo Sapiens
DKHLSRRRK

SEQ ID NO: 178275 - protein, 9 aa, Homo Sapiens
PGTTPPRAE

SEQ ID NO: 178276 - protein, 9 aa, Homo Sapiens
KKPIYADGY

SEQ ID NO: 178277 - protein, 9 aa, Homo Sapiens
PEGGPARGT

SEQ ID NO: 178278 - protein, 9 aa, Homo Sapiens
FQCCAVMCC

SEQ ID NO: 178279 - protein, 9 aa, Homo Sapiens
DTGCYTLKT

SEQ ID NO: 178280 - protein, 9 aa, Homo Sapiens
LFRIRGQKE

SEQ ID NO: 178281 - protein, 9 aa, Homo Sapiens
LYTMLIKCV

SEQ ID NO: 178282 - protein, 9 aa, Homo Sapiens
TSPSPWAAP

SEQ ID NO: 178283 - protein, 9 aa, Homo Sapiens
YYCLSVIFF

SEQ ID NO: 178284 - protein, 9 aa, Homo Sapiens
LAFPQPLPC

SEQ ID NO: 178285 - protein, 9 aa, Homo Sapiens
LPCNICKDV

SEQ ID NO: 178286 - protein, 9 aa, Homo Sapiens
TNEQVMGKF

SEQ ID NO: 178287 - protein, 9 aa, Homo Sapiens
ILICFLKME

SEQ ID NO: 178288 - protein, 9 aa, Homo Sapiens
YRFLDTSNQ

SEQ ID NO: 178289 - protein, 9 aa, Homo Sapiens
LSPTADYAV

SEQ ID NO: 178290 - protein, 9 aa, Homo Sapiens
KKCKKNVFN

SEQ ID NO: 178291 - protein, 9 aa, Homo Sapiens
MHFYFLNST

SEQ ID NO: 178292 - protein, 9 aa, Homo Sapiens
ARQEGVKKA

SEQ ID NO: 178293 - protein, 9 aa, Homo Sapiens
NFICAHPLG

SEQ ID NO: 178294 - protein, 9 aa, Homo Sapiens
TQLALCMQL

SEQ ID NO: 178295 - protein, 9 aa, Homo Sapiens
GRAFARALQ

SEQ ID NO: 178296 - protein, 9 aa, Homo Sapiens
ISALEDDLT

SEQ ID NO: 178297 - protein, 9 aa, Homo Sapiens
KQFHCPLCE

SEQ ID NO: 178298 - protein, 9 aa, Homo Sapiens
RTSSQPWRS

SEQ ID NO: 178299 - protein, 9 aa, Homo Sapiens
YGKKLVKIS

SEQ ID NO: 178300 - protein, 9 aa, Homo Sapiens
YSNGNIKKR

SEQ ID NO: 178301 - protein, 9 aa, Homo Sapiens
KHLFGIQVI

SEQ ID NO: 178302 - protein, 9 aa, Homo Sapiens
RKSWGRWCW

SEQ ID NO: 178303 - protein, 9 aa, Homo Sapiens
RGLDPSSWT

SEQ ID NO: 178304 - protein, 9 aa, Homo Sapiens
KTGRQRLFA

SEQ ID NO: 178305 - protein, 9 aa, Homo Sapiens
NLGWWQSPL

SEQ ID NO: 178306 - protein, 9 aa, Homo Sapiens
SPTTRSCGP

SEQ ID NO: 178307 - protein, 9 aa, Homo Sapiens
QGSGDNVDV

SEQ ID NO: 178308 - protein, 9 aa, Homo Sapiens
GDSIRNEKN

SEQ ID NO: 178309 - protein, 9 aa, Homo Sapiens
RAFPRVTPP

SEQ ID NO: 178310 - protein, 9 aa, Homo Sapiens
RARVEQARR

SEQ ID NO: 178311 - protein, 9 aa, Homo Sapiens
ILALYGGLS

SEQ ID NO: 178312 - protein, 9 aa, Homo Sapiens
TDRAIMVGV

SEQ ID NO: 178313 - protein, 9 aa, Homo Sapiens
RESKWVALQ

SEQ ID NO: 178314 - protein, 9 aa, Homo Sapiens
CRPNTCNLR

SEQ ID NO: 178315 - protein, 9 aa, Homo Sapiens
GIQEITRSR

SEQ ID NO: 178316 - protein, 9 aa, Homo Sapiens
KYEAFSDDP

SEQ ID NO: 178317 - protein, 9 aa, Homo Sapiens
GIWSEGVDG

SEQ ID NO: 178318 - protein, 9 aa, Homo Sapiens
QREHCFHHS

SEQ ID NO: 178319 - protein, 9 aa, Homo Sapiens
YYFLHHTCI

SEQ ID NO: 178320 - protein, 9 aa, Homo Sapiens
RRPATSSRR

SEQ ID NO: 178321 - protein, 9 aa, Homo Sapiens
PGHTCMPEN

SEQ ID NO: 178322 - protein, 9 aa, Homo Sapiens
RHIKLHTGG

SEQ ID NO: 178323 - protein, 9 aa, Homo Sapiens
GDSDSRRRG

SEQ ID NO: 178324 - protein, 9 aa, Homo Sapiens
CMMVQKERS

SEQ ID NO: 178325 - protein, 9 aa, Homo Sapiens
RLWLAALPQ

SEQ ID NO: 178326 - protein, 9 aa, Homo Sapiens
NRLKIQYQM

SEQ ID NO: 178327 - protein, 9 aa, Homo Sapiens
DCLQAFWDM

SEQ ID NO: 178328 - protein, 9 aa, Homo Sapiens
SQGLVPCVL

SEQ ID NO: 178329 - protein, 9 aa, Homo Sapiens
DQVGLFLTA

SEQ ID NO: 178330 - protein, 9 aa, Homo Sapiens
ALRDTMARQ

SEQ ID NO: 178331 - protein, 9 aa, Homo Sapiens
GRLWRPTAI

SEQ ID NO: 178332 - protein, 9 aa, Homo Sapiens
TVPRCSGRA

SEQ ID NO: 178333 - protein, 9 aa, Homo Sapiens
QQLWRGGKR

SEQ ID NO: 178334 - protein, 9 aa, Homo Sapiens
GVRTRGSPL

SEQ ID NO: 178335 - protein, 9 aa, Homo Sapiens
KLLCPGRQK

SEQ ID NO: 178336 - protein, 9 aa, Homo Sapiens
AGSPCAKAT

SEQ ID NO: 178337 - protein, 9 aa, Homo Sapiens
LESFNVPGL

SEQ ID NO: 178338 - protein, 9 aa, Homo Sapiens
ARRDNQFES

SEQ ID NO: 178339 - protein, 9 aa, Homo Sapiens
LLLQKHANV

SEQ ID NO: 178340 - protein, 9 aa, Homo Sapiens
SSSGLQGCV

SEQ ID NO: 178341 - protein, 9 aa, Homo Sapiens
GPKGVSVDC

SEQ ID NO: 178342 - protein, 9 aa, Homo Sapiens
RRCDQKLQR

SEQ ID NO: 178343 - protein, 9 aa, Homo Sapiens
LVYIMSTTG

SEQ ID NO: 178344 - protein, 9 aa, Homo Sapiens
MPKEQARIK

SEQ ID NO: 178345 - protein, 9 aa, Homo Sapiens
EGPIKPVIY

SEQ ID NO: 178346 - protein, 9 aa, Homo Sapiens
LYGGLSASL

SEQ ID NO: 178347 - protein, 9 aa, Homo Sapiens
LSVLGDQPK

SEQ ID NO: 178348 - protein, 9 aa, Homo Sapiens
QRALHTQPC

SEQ ID NO: 178349 - protein, 9 aa, Homo Sapiens
AEDLAGQLT

SEQ ID NO: 178350 - protein, 9 aa, Homo Sapiens
RWTFISSEK

SEQ ID NO: 178351 - protein, 9 aa, Homo Sapiens
FVFAAAKDT

SEQ ID NO: 178352 - protein, 9 aa, Homo Sapiens
SCFQGHHEL

SEQ ID NO: 178353 - protein, 9 aa, Homo Sapiens
PPTTLGPAM

SEQ ID NO: 178354 - protein, 9 aa, Homo Sapiens
RLWKHQHVG

SEQ ID NO: 178355 - protein, 9 aa, Homo Sapiens
SPVRVRMCN

SEQ ID NO: 178356 - protein, 9 aa, Homo Sapiens
VHITHHAHL

SEQ ID NO: 178357 - protein, 9 aa, Homo Sapiens
GQTSHKVLK

SEQ ID NO: 178358 - protein, 9 aa, Homo Sapiens
MCSQGDEDD

SEQ ID NO: 178359 - protein, 9 aa, Homo Sapiens
VPVVVLLIS

SEQ ID NO: 178360 - protein, 9 aa, Homo Sapiens
LYRKEGLSV

SEQ ID NO: 178361 - protein, 9 aa, Homo Sapiens
SMICWLRKR

SEQ ID NO: 178362 - protein, 9 aa, Homo Sapiens
RPTPASTLA

SEQ ID NO: 178363 - protein, 9 aa, Homo Sapiens
FKTKDCDYI

SEQ ID NO: 178364 - protein, 9 aa, Homo Sapiens
RIHKNFTEE

SEQ ID NO: 178365 - protein, 9 aa, Homo Sapiens
HHAHLQGHP

SEQ ID NO: 178366 - protein, 9 aa, Homo Sapiens
KTVLVTVSV

SEQ ID NO: 178367 - protein, 9 aa, Homo Sapiens
TSSSILDRF

SEQ ID NO: 178368 - protein, 9 aa, Homo Sapiens
YFHTRCWES

SEQ ID NO: 178369 - protein, 9 aa, Homo Sapiens
TFLQQEHQP

SEQ ID NO: 178370 - protein, 9 aa, Homo Sapiens
KKSADTMWD

SEQ ID NO: 178371 - protein, 9 aa, Homo Sapiens
NRASLPELP

SEQ ID NO: 178372 - protein, 9 aa, Homo Sapiens
KIKTQKSKG

SEQ ID NO: 178373 - protein, 9 aa, Homo Sapiens
VFPLGPHEE

SEQ ID NO: 178374 - protein, 9 aa, Homo Sapiens
PTSGTTRTS

SEQ ID NO: 178375 - protein, 9 aa, Homo Sapiens
VVQVGLHLG

SEQ ID NO: 178376 - protein, 9 aa, Homo Sapiens
ENLKLKPEN

SEQ ID NO: 178377 - protein, 9 aa, Homo Sapiens
SRIYLDELM

SEQ ID NO: 178378 - protein, 9 aa, Homo Sapiens
LCQCDKKRG

SEQ ID NO: 178379 - protein, 9 aa, Homo Sapiens
TPWFIHGLV

SEQ ID NO: 178380 - protein, 9 aa, Homo Sapiens
LGLHLLQIL

SEQ ID NO: 178381 - protein, 9 aa, Homo Sapiens
EADRYQRLR

SEQ ID NO: 178382 - protein, 9 aa, Homo Sapiens
FNVDEFEDM

SEQ ID NO: 178383 - protein, 9 aa, Homo Sapiens
YQLRLTDMN

SEQ ID NO: 178384 - protein, 9 aa, Homo Sapiens
FWKDCHLAL

SEQ ID NO: 178385 - protein, 9 aa, Homo Sapiens
IIFCRTKND

SEQ ID NO: 178386 - protein, 9 aa, Homo Sapiens
ERTIAGALI

SEQ ID NO: 178387 - protein, 9 aa, Homo Sapiens
LVQEVEGLE

SEQ ID NO: 178388 - protein, 9 aa, Homo Sapiens
MISLVMSYA

SEQ ID NO: 178389 - protein, 9 aa, Homo Sapiens
PQMISILAR

SEQ ID NO: 178390 - protein, 9 aa, Homo Sapiens
VLMKLLRIL

SEQ ID NO: 178391 - protein, 9 aa, Homo Sapiens
APPERRHSS

SEQ ID NO: 178392 - protein, 9 aa, Homo Sapiens
AAVPAPRLE

SEQ ID NO: 178393 - protein, 9 aa, Homo Sapiens
VIEAAKTAQ

SEQ ID NO: 178394 - protein, 9 aa, Homo Sapiens
GIHPAEDME

SEQ ID NO: 178395 - protein, 9 aa, Homo Sapiens
RECCSHCQN

SEQ ID NO: 178396 - protein, 9 aa, Homo Sapiens
HENAAPTGK

SEQ ID NO: 178397 - protein, 9 aa, Homo Sapiens
RPQIADEQS

SEQ ID NO: 178398 - protein, 9 aa, Homo Sapiens
EPEENLRLS

SEQ ID NO: 178399 - protein, 9 aa, Homo Sapiens
AAGLHDTCY

SEQ ID NO: 178400 - protein, 9 aa, Homo Sapiens
GPEEMRRLD

SEQ ID NO: 178401 - protein, 9 aa, Homo Sapiens
LHGNTAPSP

SEQ ID NO: 178402 - protein, 9 aa, Homo Sapiens
PLGSRTLKS

SEQ ID NO: 178403 - protein, 9 aa, Homo Sapiens
FSTRSSPTL

SEQ ID NO: 178404 - protein, 9 aa, Homo Sapiens
RDCKEVKEK

SEQ ID NO: 178405 - protein, 9 aa, Homo Sapiens
HEGVEMRAA

SEQ ID NO: 178406 - protein, 9 aa, Homo Sapiens
PSSPRPCGS

SEQ ID NO: 178407 - protein, 9 aa, Homo Sapiens
IGASSAQEF

SEQ ID NO: 178408 - protein, 9 aa, Homo Sapiens
NGCSPQLGP

SEQ ID NO: 178409 - protein, 9 aa, Homo Sapiens
LEADPIKHI

SEQ ID NO: 178410 - protein, 9 aa, Homo Sapiens
APPMGVDRW

SEQ ID NO: 178411 - protein, 9 aa, Homo Sapiens
KHRIIHLGA

SEQ ID NO: 178412 - protein, 9 aa, Homo Sapiens
IHMAKSYVL

SEQ ID NO: 178413 - protein, 9 aa, Homo Sapiens
SLLFSIRRW

SEQ ID NO: 178414 - protein, 9 aa, Homo Sapiens
LNCQKAMDE

SEQ ID NO: 178415 - protein, 9 aa, Homo Sapiens
AGCWTVRGS

SEQ ID NO: 178416 - protein, 9 aa, Homo Sapiens
KGVIYATIT

SEQ ID NO: 178417 - protein, 9 aa, Homo Sapiens
TFHLLLLCR

SEQ ID NO: 178418 - protein, 9 aa, Homo Sapiens
WKRFVVVTN

SEQ ID NO: 178419 - protein, 9 aa, Homo Sapiens
GNHCFKAYH

SEQ ID NO: 178420 - protein, 9 aa, Homo Sapiens
KNDVHQKQR

SEQ ID NO: 178421 - protein, 9 aa, Homo Sapiens
RRGRRPAGK

SEQ ID NO: 178422 - protein, 9 aa, Homo Sapiens
ILEGEHNTE

SEQ ID NO: 178423 - protein, 9 aa, Homo Sapiens
WKGPEHLAH

SEQ ID NO: 178424 - protein, 9 aa, Homo Sapiens
WRASVSVQF

SEQ ID NO: 178425 - protein, 9 aa, Homo Sapiens
AEHGGPLPG

SEQ ID NO: 178426 - protein, 9 aa, Homo Sapiens
LGPGASMTV

SEQ ID NO: 178427 - protein, 9 aa, Homo Sapiens
CLANWSNCS

SEQ ID NO: 178428 - protein, 9 aa, Homo Sapiens
WKDMIAHPR

SEQ ID NO: 178429 - protein, 9 aa, Homo Sapiens
ILRQEMLEP

SEQ ID NO: 178430 - protein, 9 aa, Homo Sapiens
SSTSRDSRS

SEQ ID NO: 178431 - protein, 9 aa, Homo Sapiens
NTDRSTVWL

SEQ ID NO: 178432 - protein, 9 aa, Homo Sapiens
CHLAHLSAA

SEQ ID NO: 178433 - protein, 9 aa, Homo Sapiens
FGSEVGFNI

SEQ ID NO: 178434 - protein, 9 aa, Homo Sapiens
GTVDTPPAC

SEQ ID NO: 178435 - protein, 9 aa, Homo Sapiens
TASTPASTN

SEQ ID NO: 178436 - protein, 9 aa, Homo Sapiens
GNKSIKDQL

SEQ ID NO: 178437 - protein, 9 aa, Homo Sapiens
STGGHTHTP

SEQ ID NO: 178438 - protein, 9 aa, Homo Sapiens
KRLKKRRRR

SEQ ID NO: 178439 - protein, 9 aa, Homo Sapiens
SLGRGLDPS

SEQ ID NO: 178440 - protein, 9 aa, Homo Sapiens
LQEVFQAER

SEQ ID NO: 178441 - protein, 9 aa, Homo Sapiens
SFLPPGAPS

SEQ ID NO: 178442 - protein, 9 aa, Homo Sapiens
SEGVDGTDI

SEQ ID NO: 178443 - protein, 9 aa, Homo Sapiens
QLNIYKNRL

SEQ ID NO: 178444 - protein, 9 aa, Homo Sapiens
TGWLERAYG

SEQ ID NO: 178445 - protein, 9 aa, Homo Sapiens
IFQILVTVK

SEQ ID NO: 178446 - protein, 9 aa, Homo Sapiens
AVPAPRLES

SEQ ID NO: 178447 - protein, 9 aa, Homo Sapiens
AQNGFNKKC

SEQ ID NO: 178448 - protein, 9 aa, Homo Sapiens
DADMPPLPQ

SEQ ID NO: 178449 - protein, 9 aa, Homo Sapiens
KGPEHLAHG

SEQ ID NO: 178450 - protein, 9 aa, Homo Sapiens
RPCGSPTTR

SEQ ID NO: 178451 - protein, 9 aa, Homo Sapiens
PRASACVPS

SEQ ID NO: 178452 - protein, 9 aa, Homo Sapiens
PGAPSIQQP

SEQ ID NO: 178453 - protein, 9 aa, Homo Sapiens
NASGRTTGI

SEQ ID NO: 178454 - protein, 9 aa, Homo Sapiens
DSDKKLPET

SEQ ID NO: 178455 - protein, 9 aa, Homo Sapiens
MGGEPLLSV

SEQ ID NO: 178456 - protein, 9 aa, Homo Sapiens
TFYNTPCRA

SEQ ID NO: 178457 - protein, 9 aa, Homo Sapiens
CGFSTRSSP

SEQ ID NO: 178458 - protein, 9 aa, Homo Sapiens
VNQLEDEGC

SEQ ID NO: 178459 - protein, 9 aa, Homo Sapiens
NFYDQIAVM

SEQ ID NO: 178460 - protein, 9 aa, Homo Sapiens
HFQHLAVRR

SEQ ID NO: 178461 - protein, 9 aa, Homo Sapiens
LTPEECHLN

SEQ ID NO: 178462 - protein, 9 aa, Homo Sapiens
HTPLDKLTQ

SEQ ID NO: 178463 - protein, 9 aa, Homo Sapiens
PIVHVPTSL

SEQ ID NO: 178464 - protein, 9 aa, Homo Sapiens
GKLCRKDLE

SEQ ID NO: 178465 - protein, 9 aa, Homo Sapiens
HELQKERIQ

SEQ ID NO: 178466 - protein, 9 aa, Homo Sapiens
RRPRAATPA

SEQ ID NO: 178467 - protein, 9 aa, Homo Sapiens
KDILADLMP

SEQ ID NO: 178468 - protein, 9 aa, Homo Sapiens
ERSFLDLMF

SEQ ID NO: 178469 - protein, 9 aa, Homo Sapiens
SGGGQDPGV

SEQ ID NO: 178470 - protein, 9 aa, Homo Sapiens
TRKASAASC

SEQ ID NO: 178471 - protein, 9 aa, Homo Sapiens
AQLVAVGGQ

SEQ ID NO: 178472 - protein, 9 aa, Homo Sapiens
YSQNHRRLL

SEQ ID NO: 178473 - protein, 9 aa, Homo Sapiens
RPAARTGSR

SEQ ID NO: 178474 - protein, 9 aa, Homo Sapiens
MPESWGPAP

SEQ ID NO: 178475 - protein, 9 aa, Homo Sapiens
IKQVALCKF

SEQ ID NO: 178476 - protein, 9 aa, Homo Sapiens
NCVVGAMQL

SEQ ID NO: 178477 - protein, 9 aa, Homo Sapiens
PSSWKSPLH

SEQ ID NO: 178478 - protein, 9 aa, Homo Sapiens
NDNPPLSRS

SEQ ID NO: 178479 - protein, 9 aa, Homo Sapiens
HRQGRGNLG

SEQ ID NO: 178480 - protein, 9 aa, Homo Sapiens
DPLEPVVTG

SEQ ID NO: 178481 - protein, 9 aa, Homo Sapiens
STPTGMLEF

SEQ ID NO: 178482 - protein, 9 aa, Homo Sapiens
QFQVLKQSQ

SEQ ID NO: 178483 - protein, 9 aa, Homo Sapiens
NQIIVNTVN

SEQ ID NO: 178484 - protein, 9 aa, Homo Sapiens
QQWHLFRTY

SEQ ID NO: 178485 - protein, 9 aa, Homo Sapiens
NVATCESKP

SEQ ID NO: 178486 - protein, 9 aa, Homo Sapiens
GRILLQRNL

SEQ ID NO: 178487 - protein, 9 aa, Homo Sapiens
TDVEPFFVT

SEQ ID NO: 178488 - protein, 9 aa, Homo Sapiens
YFLHHTCIQ

SEQ ID NO: 178489 - protein, 9 aa, Homo Sapiens
LSINAMNIK

SEQ ID NO: 178490 - protein, 9 aa, Homo Sapiens
HVPDAVWYD

SEQ ID NO: 178491 - protein, 9 aa, Homo Sapiens
GALLSQWDL

SEQ ID NO: 178492 - protein, 9 aa, Homo Sapiens
TFCVRCKCQ

SEQ ID NO: 178493 - protein, 9 aa, Homo Sapiens
TCSHFAQDL

SEQ ID NO: 178494 - protein, 9 aa, Homo Sapiens
RGTSPSQGI

SEQ ID NO: 178495 - protein, 9 aa, Homo Sapiens
GKVTEKQYY

SEQ ID NO: 178496 - protein, 9 aa, Homo Sapiens
KKDSQNCED

SEQ ID NO: 178497 - protein, 9 aa, Homo Sapiens
PQGRARCGV

SEQ ID NO: 178498 - protein, 9 aa, Homo Sapiens
PCQYFIGVL

SEQ ID NO: 178499 - protein, 9 aa, Homo Sapiens
LQSPVYFFL

SEQ ID NO: 178500 - protein, 9 aa, Homo Sapiens
RCDQKLQRC

SEQ ID NO: 178501 - protein, 9 aa, Homo Sapiens
YTGPKGNPG

SEQ ID NO: 178502 - protein, 9 aa, Homo Sapiens
KDSQNCEDA

SEQ ID NO: 178503 - protein, 9 aa, Homo Sapiens
LGQLPKEEL

SEQ ID NO: 178504 - protein, 9 aa, Homo Sapiens
RAVLAQAGR

SEQ ID NO: 178505 - protein, 9 aa, Homo Sapiens
TSAHPSRPC

SEQ ID NO: 178506 - protein, 9 aa, Homo Sapiens
LGVCGHLKP

SEQ ID NO: 178507 - protein, 9 aa, Homo Sapiens
CPFFYNRPI

SEQ ID NO: 178508 - protein, 9 aa, Homo Sapiens
HAPEECYPI

SEQ ID NO: 178509 - protein, 9 aa, Homo Sapiens
KQPAVGKQN

SEQ ID NO: 178510 - protein, 9 aa, Homo Sapiens
TWEVTPRSI

SEQ ID NO: 178511 - protein, 9 aa, Homo Sapiens
DRRPPRLSE

SEQ ID NO: 178512 - protein, 9 aa, Homo Sapiens
AVPSTPRPT

SEQ ID NO: 178513 - protein, 9 aa, Homo Sapiens
HTGGKPFKC

SEQ ID NO: 178514 - protein, 9 aa, Homo Sapiens
DVTYAFVIQ

SEQ ID NO: 178515 - protein, 9 aa, Homo Sapiens
GHHTILVSV

SEQ ID NO: 178516 - protein, 9 aa, Homo Sapiens
TPPRAEVSQ

SEQ ID NO: 178517 - protein, 9 aa, Homo Sapiens
NVEIAVGDK

SEQ ID NO: 178518 - protein, 9 aa, Homo Sapiens
LSPRKVPVV

SEQ ID NO: 178519 - protein, 9 aa, Homo Sapiens
ADRYQRLRD

SEQ ID NO: 178520 - protein, 9 aa, Homo Sapiens
LWPRWAQDE

SEQ ID NO: 178521 - protein, 9 aa, Homo Sapiens
VCRMCSQGD

SEQ ID NO: 178522 - protein, 9 aa, Homo Sapiens
LEFMMRQPN

SEQ ID NO: 178523 - protein, 9 aa, Homo Sapiens
EIRAEGNSH

SEQ ID NO: 178524 - protein, 9 aa, Homo Sapiens
PRWAQDEHP

SEQ ID NO: 178525 - protein, 9 aa, Homo Sapiens
TAQGHVNHG

SEQ ID NO: 178526 - protein, 9 aa, Homo Sapiens
ANRRDIRLV

SEQ ID NO: 178527 - protein, 9 aa, Homo Sapiens
DHIMKYKKS

SEQ ID NO: 178528 - protein, 9 aa, Homo Sapiens
TAASMKMNA

SEQ ID NO: 178529 - protein, 9 aa, Homo Sapiens
PLTVQSQAC

SEQ ID NO: 178530 - protein, 9 aa, Homo Sapiens
THQDSSQGN

SEQ ID NO: 178531 - protein, 9 aa, Homo Sapiens
DNHSGTLGM

SEQ ID NO: 178532 - protein, 9 aa, Homo Sapiens
IKPVIYSSP

SEQ ID NO: 178533 - protein, 9 aa, Homo Sapiens
PSLSRARVE

SEQ ID NO: 178534 - protein, 9 aa, Homo Sapiens
ALMTTVVIS

SEQ ID NO: 178535 - protein, 9 aa, Homo Sapiens
CPAAEPGLD

SEQ ID NO: 178536 - protein, 9 aa, Homo Sapiens
CLLLVLAGM

SEQ ID NO: 178537 - protein, 9 aa, Homo Sapiens
TQAKCSCLA

SEQ ID NO: 178538 - protein, 9 aa, Homo Sapiens
GAVFPLGPH

SEQ ID NO: 178539 - protein, 9 aa, Homo Sapiens
SVNSVSVEG

SEQ ID NO: 178540 - protein, 9 aa, Homo Sapiens
DTSTDEHLV

SEQ ID NO: 178541 - protein, 9 aa, Homo Sapiens
KDRYLLLCH

SEQ ID NO: 178542 - protein, 9 aa, Homo Sapiens
SPTLPQGRA

SEQ ID NO: 178543 - protein, 9 aa, Homo Sapiens
STQSGRCPA

SEQ ID NO: 178544 - protein, 9 aa, Homo Sapiens
HLSPPKQPQ

SEQ ID NO: 178545 - protein, 9 aa, Homo Sapiens
QLLCQNPEK

SEQ ID NO: 178546 - protein, 9 aa, Homo Sapiens
SSSPTWRVC

SEQ ID NO: 178547 - protein, 9 aa, Homo Sapiens
KTRMHQAIE

SEQ ID NO: 178548 - protein, 9 aa, Homo Sapiens
KLPETIGKR

SEQ ID NO: 178549 - protein, 9 aa, Homo Sapiens
ILVCCLPLG

SEQ ID NO: 178550 - protein, 9 aa, Homo Sapiens
DNSAGTFVL

SEQ ID NO: 178551 - protein, 9 aa, Homo Sapiens
ALLSQWDLK

SEQ ID NO: 178552 - protein, 9 aa, Homo Sapiens
GIDVLQGQV

SEQ ID NO: 178553 - protein, 9 aa, Homo Sapiens
PNMDFMDTF

SEQ ID NO: 178554 - protein, 9 aa, Homo Sapiens
ADLWGKRKG

SEQ ID NO: 178555 - protein, 9 aa, Homo Sapiens
QPAVGKQNG

SEQ ID NO: 178556 - protein, 9 aa, Homo Sapiens
LRSGFRQLC

SEQ ID NO: 178557 - protein, 9 aa, Homo Sapiens
SHYKCPLCD

SEQ ID NO: 178558 - protein, 9 aa, Homo Sapiens
HIRIGEAKR

SEQ ID NO: 178559 - protein, 9 aa, Homo Sapiens
KTGTPIGLS

SEQ ID NO: 178560 - protein, 9 aa, Homo Sapiens
PAEITLTRQ

SEQ ID NO: 178561 - protein, 9 aa, Homo Sapiens
ENTVPAASA

SEQ ID NO: 178562 - protein, 9 aa, Homo Sapiens
KQSQNYLWT

SEQ ID NO: 178563 - protein, 9 aa, Homo Sapiens
KQDALDVKK

SEQ ID NO: 178564 - protein, 9 aa, Homo Sapiens
GAVVIDVGI

SEQ ID NO: 178565 - protein, 9 aa, Homo Sapiens
LHFPDTSHS

SEQ ID NO: 178566 - protein, 9 aa, Homo Sapiens
RAMQRLQAR

SEQ ID NO: 178567 - protein, 9 aa, Homo Sapiens
AADLRAHRC

SEQ ID NO: 178568 - protein, 9 aa, Homo Sapiens
HINPAMTVA

SEQ ID NO: 178569 - protein, 9 aa, Homo Sapiens
ARVRRPSTD

SEQ ID NO: 178570 - protein, 9 aa, Homo Sapiens
KRYSTVCWR

SEQ ID NO: 178571 - protein, 9 aa, Homo Sapiens
AAVCTTAPP

SEQ ID NO: 178572 - protein, 9 aa, Homo Sapiens
EELFNILDL

SEQ ID NO: 178573 - protein, 9 aa, Homo Sapiens
RAAHIYPLP

SEQ ID NO: 178574 - protein, 9 aa, Homo Sapiens
LSSLPYSAY

SEQ ID NO: 178575 - protein, 9 aa, Homo Sapiens
CYEVIMTAY

SEQ ID NO: 178576 - protein, 9 aa, Homo Sapiens
GSRPCAGAR

SEQ ID NO: 178577 - protein, 9 aa, Homo Sapiens
DLTQTKAIK

SEQ ID NO: 178578 - protein, 9 aa, Homo Sapiens
EVNAMAVLW

SEQ ID NO: 178579 - protein, 9 aa, Homo Sapiens
LLLSHQQLG

SEQ ID NO: 178580 - protein, 9 aa, Homo Sapiens
GWHKFIQLL

SEQ ID NO: 178581 - protein, 9 aa, Homo Sapiens
LLKKCSLYG

SEQ ID NO: 178582 - protein, 9 aa, Homo Sapiens
SPTLTSSWK

SEQ ID NO: 178583 - protein, 9 aa, Homo Sapiens
GMLEFEGGE

SEQ ID NO: 178584 - protein, 9 aa, Homo Sapiens
KVTEKQYYS

SEQ ID NO: 178585 - protein, 9 aa, Homo Sapiens
TSTHRPASA

SEQ ID NO: 178586 - protein, 9 aa, Homo Sapiens
VDPNGQLDE

SEQ ID NO: 178587 - protein, 9 aa, Homo Sapiens
PVTHGGQFK

SEQ ID NO: 178588 - protein, 9 aa, Homo Sapiens
QTPELVLYT

SEQ ID NO: 178589 - protein, 9 aa, Homo Sapiens
LNIGRQFPQ

SEQ ID NO: 178590 - protein, 9 aa, Homo Sapiens
PPRAPASPG

SEQ ID NO: 178591 - protein, 9 aa, Homo Sapiens
HANVPFFQS

SEQ ID NO: 178592 - protein, 9 aa, Homo Sapiens
GTRVTNSSV

SEQ ID NO: 178593 - protein, 9 aa, Homo Sapiens
PEVEYDHHP

SEQ ID NO: 178594 - protein, 9 aa, Homo Sapiens
GGMQGADIQ

SEQ ID NO: 178595 - protein, 9 aa, Homo Sapiens
ERAQMLGGL

SEQ ID NO: 178596 - protein, 9 aa, Homo Sapiens
GEQIPGLLG

SEQ ID NO: 178597 - protein, 9 aa, Homo Sapiens
IDQVGLFLT

SEQ ID NO: 178598 - protein, 9 aa, Homo Sapiens
TGVADHGGR

SEQ ID NO: 178599 - protein, 9 aa, Homo Sapiens
IQILHWSYQ

SEQ ID NO: 178600 - protein, 9 aa, Homo Sapiens
FEDLFGQAL

SEQ ID NO: 178601 - protein, 9 aa, Homo Sapiens
AILQIPSTK

SEQ ID NO: 178602 - protein, 9 aa, Homo Sapiens
VLQGKAILW

SEQ ID NO: 178603 - protein, 9 aa, Homo Sapiens
SMEQFQVSV

SEQ ID NO: 178604 - protein, 9 aa, Homo Sapiens
PGPRKQDDS

SEQ ID NO: 178605 - protein, 9 aa, Homo Sapiens
CIYTYRILP

SEQ ID NO: 178606 - protein, 9 aa, Homo Sapiens
RLQYEKSLN

SEQ ID NO: 178607 - protein, 9 aa, Homo Sapiens
RGGTVKLAD

SEQ ID NO: 178608 - protein, 9 aa, Homo Sapiens
PSLGRGLDP

SEQ ID NO: 178609 - protein, 9 aa, Homo Sapiens
IDDDNPPCL

SEQ ID NO: 178610 - protein, 9 aa, Homo Sapiens
TGPKGNPGE

SEQ ID NO: 178611 - protein, 9 aa, Homo Sapiens
PLPLVTTPE

SEQ ID NO: 178612 - protein, 9 aa, Homo Sapiens
PGDNVEIAV

SEQ ID NO: 178613 - protein, 9 aa, Homo Sapiens
IFVMNVGSP

SEQ ID NO: 178614 - protein, 9 aa, Homo Sapiens
LGHRAELFA

SEQ ID NO: 178615 - protein, 9 aa, Homo Sapiens
KARGQALAQ

SEQ ID NO: 178616 - protein, 9 aa, Homo Sapiens
MRNHVSHYK

SEQ ID NO: 178617 - protein, 9 aa, Homo Sapiens
SGFSFFPAS

SEQ ID NO: 178618 - protein, 9 aa, Homo Sapiens
QLGGLITVR

SEQ ID NO: 178619 - protein, 9 aa, Homo Sapiens
DFAFDRKAL

SEQ ID NO: 178620 - protein, 9 aa, Homo Sapiens
SLVPNSSPC

SEQ ID NO: 178621 - protein, 9 aa, Homo Sapiens
YDQIAVMSG

SEQ ID NO: 178622 - protein, 9 aa, Homo Sapiens
SRPCRMRLY

SEQ ID NO: 178623 - protein, 9 aa, Homo Sapiens
IKRRSMICW

SEQ ID NO: 178624 - protein, 9 aa, Homo Sapiens
QNVLLMSPQ

SEQ ID NO: 178625 - protein, 9 aa, Homo Sapiens
HWKDMIAHP

SEQ ID NO: 178626 - protein, 9 aa, Homo Sapiens
MKCLTAVDC

SEQ ID NO: 178627 - protein, 9 aa, Homo Sapiens
QLGDYRKLT

SEQ ID NO: 178628 - protein, 9 aa, Homo Sapiens
EQHFPSPLP

SEQ ID NO: 178629 - protein, 9 aa, Homo Sapiens
APGLVLQLD

SEQ ID NO: 178630 - protein, 9 aa, Homo Sapiens
GLLALVTLR

SEQ ID NO: 178631 - protein, 9 aa, Homo Sapiens
RASVSFWTL

SEQ ID NO: 178632 - protein, 9 aa, Homo Sapiens
KDALERYLD

SEQ ID NO: 178633 - protein, 9 aa, Homo Sapiens
LDHVLAKVA

SEQ ID NO: 178634 - protein, 9 aa, Homo Sapiens
KNECDLTKA

SEQ ID NO: 178635 - protein, 9 aa, Homo Sapiens
STAGPPTTL

SEQ ID NO: 178636 - protein, 9 aa, Homo Sapiens
RGSGGGVGR

SEQ ID NO: 178637 - protein, 9 aa, Homo Sapiens
RLLSWRAAG

SEQ ID NO: 178638 - protein, 9 aa, Homo Sapiens
IITEYMSKG

SEQ ID NO: 178639 - protein, 9 aa, Homo Sapiens
YSSSPVVRR

SEQ ID NO: 178640 - protein, 9 aa, Homo Sapiens
KRSLGEQGP

SEQ ID NO: 178641 - protein, 9 aa, Homo Sapiens
KPITDQQLI

SEQ ID NO: 178642 - protein, 9 aa, Homo Sapiens
LSRIYLDEL

SEQ ID NO: 178643 - protein, 9 aa, Homo Sapiens
GRQRLFAQE

SEQ ID NO: 178644 - protein, 9 aa, Homo Sapiens
PTSPSSASC

SEQ ID NO: 178645 - protein, 9 aa, Homo Sapiens
SYWKEVLLH

SEQ ID NO: 178646 - protein, 9 aa, Homo Sapiens
RRLDSIIGP

SEQ ID NO: 178647 - protein, 9 aa, Homo Sapiens
EKLKGANPE

SEQ ID NO: 178648 - protein, 9 aa, Homo Sapiens
LQSLLSLYS

SEQ ID NO: 178649 - protein, 9 aa, Homo Sapiens
RAFARALQQ

SEQ ID NO: 178650 - protein, 9 aa, Homo Sapiens
AVGPRPGAP

SEQ ID NO: 178651 - protein, 9 aa, Homo Sapiens
ELGRGLPTN

SEQ ID NO: 178652 - protein, 9 aa, Homo Sapiens
LNIYKNRLL

SEQ ID NO: 178653 - protein, 9 aa, Homo Sapiens
LALKGFLFL

SEQ ID NO: 178654 - protein, 9 aa, Homo Sapiens
KTKGDSIRN

SEQ ID NO: 178655 - protein, 9 aa, Homo Sapiens
HGRKSLSGL

SEQ ID NO: 178656 - protein, 9 aa, Homo Sapiens
EALKKQREH

SEQ ID NO: 178657 - protein, 9 aa, Homo Sapiens
LRTARIEGP

SEQ ID NO: 178658 - protein, 9 aa, Homo Sapiens
CDGHTAQEN

SEQ ID NO: 178659 - protein, 9 aa, Homo Sapiens
RHAVLLAVL

SEQ ID NO: 178660 - protein, 9 aa, Homo Sapiens
MKVEGLNVC

SEQ ID NO: 178661 - protein, 9 aa, Homo Sapiens
KSPLHLLSH

SEQ ID NO: 178662 - protein, 9 aa, Homo Sapiens
LAAVQDGLR

SEQ ID NO: 178663 - protein, 9 aa, Homo Sapiens
ESQTRRGIK

SEQ ID NO: 178664 - protein, 9 aa, Homo Sapiens
NEKIGPRTG

SEQ ID NO: 178665 - protein, 9 aa, Homo Sapiens
GSGQRAHQV

SEQ ID NO: 178666 - protein, 9 aa, Homo Sapiens
KWHKYGCTN

SEQ ID NO: 178667 - protein, 9 aa, Homo Sapiens
QNWSSQKWT

SEQ ID NO: 178668 - protein, 9 aa, Homo Sapiens
GTSLNSSIR

SEQ ID NO: 178669 - protein, 9 aa, Homo Sapiens
VSQPYSFIE

SEQ ID NO: 178670 - protein, 9 aa, Homo Sapiens
TPTFRPSSI

SEQ ID NO: 178671 - protein, 9 aa, Homo Sapiens
LPGPLPGGL

SEQ ID NO: 178672 - protein, 9 aa, Homo Sapiens
SGGRGHPDG

SEQ ID NO: 178673 - protein, 9 aa, Homo Sapiens
LRKTKCRPT

SEQ ID NO: 178674 - protein, 9 aa, Homo Sapiens
LHDTCYSSD

SEQ ID NO: 178675 - protein, 9 aa, Homo Sapiens
LGSVLCTHH

SEQ ID NO: 178676 - protein, 9 aa, Homo Sapiens
IAVMSGVVQ

SEQ ID NO: 178677 - protein, 9 aa, Homo Sapiens
EHGGPLPGP

SEQ ID NO: 178678 - protein, 9 aa, Homo Sapiens
SFNSSLFRQ

SEQ ID NO: 178679 - protein, 9 aa, Homo Sapiens
NSPGNIQPN

SEQ ID NO: 178680 - protein, 9 aa, Homo Sapiens
NDSKHKLES

SEQ ID NO: 178681 - protein, 9 aa, Homo Sapiens
FHMRNHTFI

SEQ ID NO: 178682 - protein, 9 aa, Homo Sapiens
LQEHLVNSV

SEQ ID NO: 178683 - protein, 9 aa, Homo Sapiens
QELLGKKLL

SEQ ID NO: 178684 - protein, 9 aa, Homo Sapiens
LLHLISLSP

SEQ ID NO: 178685 - protein, 9 aa, Homo Sapiens
DGRNELAEV

SEQ ID NO: 178686 - protein, 9 aa, Homo Sapiens
LPREKSPPP

SEQ ID NO: 178687 - protein, 9 aa, Homo Sapiens
DICLKIKYW

SEQ ID NO: 178688 - protein, 9 aa, Homo Sapiens
AACVNYSEC

SEQ ID NO: 178689 - protein, 9 aa, Homo Sapiens
ALAEVLERG

SEQ ID NO: 178690 - protein, 9 aa, Homo Sapiens
IPAEQKTGT

SEQ ID NO: 178691 - protein, 9 aa, Homo Sapiens
GPLPGGLHR

SEQ ID NO: 178692 - protein, 9 aa, Homo Sapiens
PGRQKESER

SEQ ID NO: 178693 - protein, 9 aa, Homo Sapiens
ACWSCLEQA

SEQ ID NO: 178694 - protein, 9 aa, Homo Sapiens
LLLLQKHAN

SEQ ID NO: 178695 - protein, 9 aa, Homo Sapiens
YWIAVGGKE

SEQ ID NO: 178696 - protein, 9 aa, Homo Sapiens
LTYHENAAP

SEQ ID NO: 178697 - protein, 9 aa, Homo Sapiens
RPCHLIEQS

SEQ ID NO: 178698 - protein, 9 aa, Homo Sapiens
GMVGMLIDG

SEQ ID NO: 178699 - protein, 9 aa, Homo Sapiens
ALIVVHLIA

SEQ ID NO: 178700 - protein, 9 aa, Homo Sapiens
PKILTNVVT

SEQ ID NO: 178701 - protein, 9 aa, Homo Sapiens
GEKLHGDSG

SEQ ID NO: 178702 - protein, 9 aa, Homo Sapiens
EGAQRTLIE

SEQ ID NO: 178703 - protein, 9 aa, Homo Sapiens
KGRGEEQNH

SEQ ID NO: 178704 - protein, 9 aa, Homo Sapiens
KIQYQMHLR

SEQ ID NO: 178705 - protein, 9 aa, Homo Sapiens
EVDFVPIVG

SEQ ID NO: 178706 - protein, 9 aa, Homo Sapiens
YGRLWRPTA

SEQ ID NO: 178707 - protein, 9 aa, Homo Sapiens
VFVVTDAVR

SEQ ID NO: 178708 - protein, 9 aa, Homo Sapiens
QLHNKKEGN

SEQ ID NO: 178709 - protein, 9 aa, Homo Sapiens
WNCLSGFRQ

SEQ ID NO: 178710 - protein, 9 aa, Homo Sapiens
TVYYFARCQ

SEQ ID NO: 178711 - protein, 9 aa, Homo Sapiens
GQLQAWDSE

SEQ ID NO: 178712 - protein, 9 aa, Homo Sapiens
PPPPPTKKR

SEQ ID NO: 178713 - protein, 9 aa, Homo Sapiens
KVGAADAPL

SEQ ID NO: 178714 - protein, 9 aa, Homo Sapiens
IFGDPHSQI

SEQ ID NO: 178715 - protein, 9 aa, Homo Sapiens
LRPEPAKTR

SEQ ID NO: 178716 - protein, 9 aa, Homo Sapiens
KLGYNSGFF

SEQ ID NO: 178717 - protein, 9 aa, Homo Sapiens
HCWACTVSL

SEQ ID NO: 178718 - protein, 9 aa, Homo Sapiens
AMAVLWPSQ

SEQ ID NO: 178719 - protein, 9 aa, Homo Sapiens
YLQSVKKRC

SEQ ID NO: 178720 - protein, 9 aa, Homo Sapiens
GHIGVAILQ

SEQ ID NO: 178721 - protein, 9 aa, Homo Sapiens
LAIRLLTQC

SEQ ID NO: 178722 - protein, 9 aa, Homo Sapiens
FTHHISFHS

SEQ ID NO: 178723 - protein, 9 aa, Homo Sapiens
AQELKAPPE

SEQ ID NO: 178724 - protein, 9 aa, Homo Sapiens
LVLCATLIF

SEQ ID NO: 178725 - protein, 9 aa, Homo Sapiens
MTLKALVKT

SEQ ID NO: 178726 - protein, 9 aa, Homo Sapiens
AQENDDHPS

SEQ ID NO: 178727 - protein, 9 aa, Homo Sapiens
QKERIQEDY

SEQ ID NO: 178728 - protein, 9 aa, Homo Sapiens
LERKLGATS

SEQ ID NO: 178729 - protein, 9 aa, Homo Sapiens
PGLLGSPLL

SEQ ID NO: 178730 - protein, 9 aa, Homo Sapiens
VVAGHQEVT

SEQ ID NO: 178731 - protein, 9 aa, Homo Sapiens
TGVPLGEEH

SEQ ID NO: 178732 - protein, 9 aa, Homo Sapiens
EDWVLCLHS

SEQ ID NO: 178733 - protein, 9 aa, Homo Sapiens
LQNASQDLL

SEQ ID NO: 178734 - protein, 9 aa, Homo Sapiens
MEKKINNQI

SEQ ID NO: 178735 - protein, 9 aa, Homo Sapiens
TLSQEALYW

SEQ ID NO: 178736 - protein, 9 aa, Homo Sapiens
MTDEQKTSL

SEQ ID NO: 178737 - protein, 9 aa, Homo Sapiens
RRCDDPSKA

SEQ ID NO: 178738 - protein, 9 aa, Homo Sapiens
AAANFRRCC

SEQ ID NO: 178739 - protein, 9 aa, Homo Sapiens
IIGYVLLRS

SEQ ID NO: 178740 - protein, 9 aa, Homo Sapiens
KDSLSINAM

SEQ ID NO: 178741 - protein, 9 aa, Homo Sapiens
DIQGVSIQG

SEQ ID NO: 178742 - protein, 9 aa, Homo Sapiens
NKAFRDTFH

SEQ ID NO: 178743 - protein, 9 aa, Homo Sapiens
TPIGLSSSY

SEQ ID NO: 178744 - protein, 9 aa, Homo Sapiens
LPRKGRKGS

SEQ ID NO: 178745 - protein, 9 aa, Homo Sapiens
DEEDDDDEE

SEQ ID NO: 178746 - protein, 9 aa, Homo Sapiens
VKKDKGAFY

SEQ ID NO: 178747 - protein, 9 aa, Homo Sapiens
SQGILGSTG

SEQ ID NO: 178748 - protein, 9 aa, Homo Sapiens
PCTMLLPQG

SEQ ID NO: 178749 - protein, 9 aa, Homo Sapiens
CVVGAMQLY

SEQ ID NO: 178750 - protein, 9 aa, Homo Sapiens
CPSYHLKFC

SEQ ID NO: 178751 - protein, 9 aa, Homo Sapiens
DTTEQEQPR

SEQ ID NO: 178752 - protein, 9 aa, Homo Sapiens
IRASTKTWQ

SEQ ID NO: 178753 - protein, 9 aa, Homo Sapiens
LLSSAWPWP

SEQ ID NO: 178754 - protein, 9 aa, Homo Sapiens
GSPASGSSK

SEQ ID NO: 178755 - protein, 9 aa, Homo Sapiens
TPKKKEALF

SEQ ID NO: 178756 - protein, 9 aa, Homo Sapiens
QKLFLPNHT

SEQ ID NO: 178757 - protein, 9 aa, Homo Sapiens
ALQTGPGSC

SEQ ID NO: 178758 - protein, 9 aa, Homo Sapiens
AWTTRKPSS

SEQ ID NO: 178759 - protein, 9 aa, Homo Sapiens
GSASSLQTH

SEQ ID NO: 178760 - protein, 9 aa, Homo Sapiens
IIVNTVNQK

SEQ ID NO: 178761 - protein, 9 aa, Homo Sapiens
IKKKGISVS

SEQ ID NO: 178762 - protein, 9 aa, Homo Sapiens
ERQLPRCLL

SEQ ID NO: 178763 - protein, 9 aa, Homo Sapiens
VGGQMRAQR

SEQ ID NO: 178764 - protein, 9 aa, Homo Sapiens
PPANPQLLC

SEQ ID NO: 178765 - protein, 9 aa, Homo Sapiens
ALHTQPCAA

SEQ ID NO: 178766 - protein, 9 aa, Homo Sapiens
CEAFGWNIY

SEQ ID NO: 178767 - protein, 9 aa, Homo Sapiens
KPKNDVHQK

SEQ ID NO: 178768 - protein, 9 aa, Homo Sapiens
NEAQRISGK

SEQ ID NO: 178769 - protein, 9 aa, Homo Sapiens
PWARYITQS

SEQ ID NO: 178770 - protein, 9 aa, Homo Sapiens
PLPLPRPPM

SEQ ID NO: 178771 - protein, 9 aa, Homo Sapiens
YIKQVALCK

SEQ ID NO: 178772 - protein, 9 aa, Homo Sapiens
TYPKSLSQE

SEQ ID NO: 178773 - protein, 9 aa, Homo Sapiens
GIVQGSLQT

SEQ ID NO: 178774 - protein, 9 aa, Homo Sapiens
TQHLLTLLE

SEQ ID NO: 178775 - protein, 9 aa, Homo Sapiens
LLCPGRQKE

SEQ ID NO: 178776 - protein, 9 aa, Homo Sapiens
AKTRVSSLH

SEQ ID NO: 178777 - protein, 9 aa, Homo Sapiens
RRRRNLILR

SEQ ID NO: 178778 - protein, 9 aa, Homo Sapiens
LQQWHLFRT

SEQ ID NO: 178779 - protein, 9 aa, Homo Sapiens
HFTYSVTVD

SEQ ID NO: 178780 - protein, 9 aa, Homo Sapiens
TRVTNSSVW

SEQ ID NO: 178781 - protein, 9 aa, Homo Sapiens
TLTRQRDGE

SEQ ID NO: 178782 - protein, 9 aa, Homo Sapiens
WVALQIDES

SEQ ID NO: 178783 - protein, 9 aa, Homo Sapiens
HQGVWPCDI

SEQ ID NO: 178784 - protein, 9 aa, Homo Sapiens
EEQEGGWRR

SEQ ID NO: 178785 - protein, 9 aa, Homo Sapiens
MSCGIPESP

SEQ ID NO: 178786 - protein, 9 aa, Homo Sapiens
QAEHGGPLP

SEQ ID NO: 178787 - protein, 9 aa, Homo Sapiens
KHANVPFFQ

SEQ ID NO: 178788 - protein, 9 aa, Homo Sapiens
QTAAELQAF

SEQ ID NO: 178789 - protein, 9 aa, Homo Sapiens
VVNGLSTVG

SEQ ID NO: 178790 - protein, 9 aa, Homo Sapiens
VLGSHLGRR

SEQ ID NO: 178791 - protein, 9 aa, Homo Sapiens
NKGAPARMM

SEQ ID NO: 178792 - protein, 9 aa, Homo Sapiens
ENPNEVFCF

SEQ ID NO: 178793 - protein, 9 aa, Homo Sapiens
SQPRSLDSV

SEQ ID NO: 178794 - protein, 9 aa, Homo Sapiens
KRPASTAGP

SEQ ID NO: 178795 - protein, 9 aa, Homo Sapiens
LLGLQHLGQ

SEQ ID NO: 178796 - protein, 9 aa, Homo Sapiens
PKPWQSPWG

SEQ ID NO: 178797 - protein, 9 aa, Homo Sapiens
LQTGPGSCP

SEQ ID NO: 178798 - protein, 9 aa, Homo Sapiens
EQMAESCEV

SEQ ID NO: 178799 - protein, 9 aa, Homo Sapiens
HWLFVSVPS

SEQ ID NO: 178800 - protein, 9 aa, Homo Sapiens
SSRSMVASV

SEQ ID NO: 178801 - protein, 9 aa, Homo Sapiens
GSTRTTASL

SEQ ID NO: 178802 - protein, 9 aa, Homo Sapiens
NYLWTTNLQ

SEQ ID NO: 178803 - protein, 9 aa, Homo Sapiens
FLTANDNLK

SEQ ID NO: 178804 - protein, 9 aa, Homo Sapiens
PPSACTRPQ

SEQ ID NO: 178805 - protein, 9 aa, Homo Sapiens
PGRVMLSPC

SEQ ID NO: 178806 - protein, 9 aa, Homo Sapiens
SVDCNGHII

SEQ ID NO: 178807 - protein, 9 aa, Homo Sapiens
KLHSWKKSV

SEQ ID NO: 178808 - protein, 9 aa, Homo Sapiens
IDGRENCDG

SEQ ID NO: 178809 - protein, 9 aa, Homo Sapiens
SPRSNTIFP

SEQ ID NO: 178810 - protein, 9 aa, Homo Sapiens
GSRTLKSAR

SEQ ID NO: 178811 - protein, 9 aa, Homo Sapiens
QNHRRLLSL

SEQ ID NO: 178812 - protein, 9 aa, Homo Sapiens
ASGDGEEIA

SEQ ID NO: 178813 - protein, 9 aa, Homo Sapiens
PGNIQPNSA

SEQ ID NO: 178814 - protein, 9 aa, Homo Sapiens
PLPRPPMPR

SEQ ID NO: 178815 - protein, 9 aa, Homo Sapiens
CLTRAPQSG

SEQ ID NO: 178816 - protein, 9 aa, Homo Sapiens
TRSRKKDDP

SEQ ID NO: 178817 - protein, 9 aa, Homo Sapiens
KKEVWNVTR

SEQ ID NO: 178818 - protein, 9 aa, Homo Sapiens
SGSLFSLSI

SEQ ID NO: 178819 - protein, 9 aa, Homo Sapiens
QDALDVKKD

SEQ ID NO: 178820 - protein, 9 aa, Homo Sapiens
CIMVQSASP

SEQ ID NO: 178821 - protein, 9 aa, Homo Sapiens
SCEDGCAEG

SEQ ID NO: 178822 - protein, 9 aa, Homo Sapiens
AFGWNIYVV

SEQ ID NO: 178823 - protein, 9 aa, Homo Sapiens
QRAHGQGRS

SEQ ID NO: 178824 - protein, 9 aa, Homo Sapiens
GGQDPGVVR

SEQ ID NO: 178825 - protein, 9 aa, Homo Sapiens
STTGWLERA

SEQ ID NO: 178826 - protein, 9 aa, Homo Sapiens
EMTIIKQAP

SEQ ID NO: 178827 - protein, 9 aa, Homo Sapiens
TDVPILAGG

SEQ ID NO: 178828 - protein, 9 aa, Homo Sapiens
GPSSSPTWR

SEQ ID NO: 178829 - protein, 9 aa, Homo Sapiens
QDLLGETLA

SEQ ID NO: 178830 - protein, 9 aa, Homo Sapiens
EEAVSGSGG

SEQ ID NO: 178831 - protein, 9 aa, Homo Sapiens
GQQVHRLWL

SEQ ID NO: 178832 - protein, 9 aa, Homo Sapiens
PLIYVGVRA

SEQ ID NO: 178833 - protein, 9 aa, Homo Sapiens
QQYLDEAER

SEQ ID NO: 178834 - protein, 9 aa, Homo Sapiens
PTVWESRNK

SEQ ID NO: 178835 - protein, 9 aa, Homo Sapiens
VALQIDESS

SEQ ID NO: 178836 - protein, 9 aa, Homo Sapiens
SMCVGSSPS

SEQ ID NO: 178837 - protein, 9 aa, Homo Sapiens
AFLSEEKLC

SEQ ID NO: 178838 - protein, 9 aa, Homo Sapiens
VPRKLLNHG

SEQ ID NO: 178839 - protein, 9 aa, Homo Sapiens
SFQAMDSFL

SEQ ID NO: 178840 - protein, 9 aa, Homo Sapiens
KLCQETAIR

SEQ ID NO: 178841 - protein, 9 aa, Homo Sapiens
YKKAVELSP

SEQ ID NO: 178842 - protein, 9 aa, Homo Sapiens
QPYSFIEFD

SEQ ID NO: 178843 - protein, 9 aa, Homo Sapiens
DHGGRSDDE

SEQ ID NO: 178844 - protein, 9 aa, Homo Sapiens
AEKAELKKV

SEQ ID NO: 178845 - protein, 9 aa, Homo Sapiens
FFGMRVQEY

SEQ ID NO: 178846 - protein, 9 aa, Homo Sapiens
TSSLWSTPA

SEQ ID NO: 178847 - protein, 9 aa, Homo Sapiens
AAAPGLVLQ

SEQ ID NO: 178848 - protein, 9 aa, Homo Sapiens
LLSLRNLSS

SEQ ID NO: 178849 - protein, 9 aa, Homo Sapiens
PRPRVHVPW

SEQ ID NO: 178850 - protein, 9 aa, Homo Sapiens
QQSPGSSPT

SEQ ID NO: 178851 - protein, 9 aa, Homo Sapiens
VELSPCLPV

SEQ ID NO: 178852 - protein, 9 aa, Homo Sapiens
WTSRSVVPG

SEQ ID NO: 178853 - protein, 9 aa, Homo Sapiens
LNLTDTGCY

SEQ ID NO: 178854 - protein, 9 aa, Homo Sapiens
EIDTKRYST

SEQ ID NO: 178855 - protein, 9 aa, Homo Sapiens
PALLRKTKC

SEQ ID NO: 178856 - protein, 9 aa, Homo Sapiens
LQSAGLLGP

SEQ ID NO: 178857 - protein, 9 aa, Homo Sapiens
EVEYHTTTG

SEQ ID NO: 178858 - protein, 9 aa, Homo Sapiens
ICSARPEQV

SEQ ID NO: 178859 - protein, 9 aa, Homo Sapiens
GLPATSLCL

SEQ ID NO: 178860 - protein, 9 aa, Homo Sapiens
AIQAVLSLN

SEQ ID NO: 178861 - protein, 9 aa, Homo Sapiens
TSGEPWDTE

SEQ ID NO: 178862 - protein, 9 aa, Homo Sapiens
RHPRTVLSK

SEQ ID NO: 178863 - protein, 9 aa, Homo Sapiens
VLICRFKER

SEQ ID NO: 178864 - protein, 9 aa, Homo Sapiens
LGGLGVCGE

SEQ ID NO: 178865 - protein, 9 aa, Homo Sapiens
DMEGTEFEP

SEQ ID NO: 178866 - protein, 9 aa, Homo Sapiens
EQVPRARRC

SEQ ID NO: 178867 - protein, 9 aa, Homo Sapiens
PSRPCRMRL

SEQ ID NO: 178868 - protein, 9 aa, Homo Sapiens
QELKAPPER

SEQ ID NO: 178869 - protein, 9 aa, Homo Sapiens
MCKYPNRPS

SEQ ID NO: 178870 - protein, 9 aa, Homo Sapiens
QHKVDSECQ

SEQ ID NO: 178871 - protein, 9 aa, Homo Sapiens
VDELEVVPN

SEQ ID NO: 178872 - protein, 9 aa, Homo Sapiens
LAVNVCIRV

SEQ ID NO: 178873 - protein, 9 aa, Homo Sapiens
VSYGHIGVA

SEQ ID NO: 178874 - protein, 9 aa, Homo Sapiens
GARGRTGAV

SEQ ID NO: 178875 - protein, 9 aa, Homo Sapiens
GEPLLSVCP

SEQ ID NO: 178876 - protein, 9 aa, Homo Sapiens
FYPNNHERY

SEQ ID NO: 178877 - protein, 9 aa, Homo Sapiens
LQAIQKQLA

SEQ ID NO: 178878 - protein, 9 aa, Homo Sapiens
EASAVEQMA

SEQ ID NO: 178879 - protein, 9 aa, Homo Sapiens
SDKHFYSLV

SEQ ID NO: 178880 - protein, 9 aa, Homo Sapiens
DSIRSYGEK

SEQ ID NO: 178881 - protein, 9 aa, Homo Sapiens
QVTHTAAAP

SEQ ID NO: 178882 - protein, 9 aa, Homo Sapiens
KEWGKTEPV

SEQ ID NO: 178883 - protein, 9 aa, Homo Sapiens
PSQCPSMEE

SEQ ID NO: 178884 - protein, 9 aa, Homo Sapiens
DGDSLLAFG

SEQ ID NO: 178885 - protein, 9 aa, Homo Sapiens
EVWNVTRNR

SEQ ID NO: 178886 - protein, 9 aa, Homo Sapiens
TKKRGKSQG

SEQ ID NO: 178887 - protein, 9 aa, Homo Sapiens
AFPRVTPPP

SEQ ID NO: 178888 - protein, 9 aa, Homo Sapiens
GPTTDVEPF

SEQ ID NO: 178889 - protein, 9 aa, Homo Sapiens
KGPDFGSLR

SEQ ID NO: 178890 - protein, 9 aa, Homo Sapiens
RVKALKKAS

SEQ ID NO: 178891 - protein, 9 aa, Homo Sapiens
TLCLLSWCG

SEQ ID NO: 178892 - protein, 9 aa, Homo Sapiens
MHLRSFLLL

SEQ ID NO: 178893 - protein, 9 aa, Homo Sapiens
QAERLLLQE

SEQ ID NO: 178894 - protein, 9 aa, Homo Sapiens
LLNEIEKEK

SEQ ID NO: 178895 - protein, 9 aa, Homo Sapiens
AMTDEQKTS

SEQ ID NO: 178896 - protein, 9 aa, Homo Sapiens
TGTQSSPAP

SEQ ID NO: 178897 - protein, 9 aa, Homo Sapiens
NEDDECHAS

SEQ ID NO: 178898 - protein, 9 aa, Homo Sapiens
IPLDPAPPP

SEQ ID NO: 178899 - protein, 9 aa, Homo Sapiens
YNKKWKRFV

SEQ ID NO: 178900 - protein, 9 aa, Homo Sapiens
SPRQGCLPW

SEQ ID NO: 178901 - protein, 9 aa, Homo Sapiens
RIHTGKNPI

SEQ ID NO: 178902 - protein, 9 aa, Homo Sapiens
GALYEIGAS

SEQ ID NO: 178903 - protein, 9 aa, Homo Sapiens
LEEALHVFP

SEQ ID NO: 178904 - protein, 9 aa, Homo Sapiens
PIKHIRIGE

SEQ ID NO: 178905 - protein, 9 aa, Homo Sapiens
KHTPWEDPS

SEQ ID NO: 178906 - protein, 9 aa, Homo Sapiens
LAHQNSERQ

SEQ ID NO: 178907 - protein, 9 aa, Homo Sapiens
MTWGFDRIS

SEQ ID NO: 178908 - protein, 9 aa, Homo Sapiens
ERQRVLEEE

SEQ ID NO: 178909 - protein, 9 aa, Homo Sapiens
SENPQGHQI

SEQ ID NO: 178910 - protein, 9 aa, Homo Sapiens
HLLAQWAQL

SEQ ID NO: 178911 - protein, 9 aa, Homo Sapiens
LPEEGEGVS

SEQ ID NO: 178912 - protein, 9 aa, Homo Sapiens
SPRGLQHRQ

SEQ ID NO: 178913 - protein, 9 aa, Homo Sapiens
TAKKKAQLH

SEQ ID NO: 178914 - protein, 9 aa, Homo Sapiens
VDRLQPEPE

SEQ ID NO: 178915 - protein, 9 aa, Homo Sapiens
DDMKKLKTR

SEQ ID NO: 178916 - protein, 9 aa, Homo Sapiens
LNNMCAKKM

SEQ ID NO: 178917 - protein, 9 aa, Homo Sapiens
QALRDTMAR

SEQ ID NO: 178918 - protein, 9 aa, Homo Sapiens
VTSNICQPM

SEQ ID NO: 178919 - protein, 9 aa, Homo Sapiens
PARGTTSST

SEQ ID NO: 178920 - protein, 9 aa, Homo Sapiens
RKGRKGSVR

SEQ ID NO: 178921 - protein, 9 aa, Homo Sapiens
LLYSQNHRR

SEQ ID NO: 178922 - protein, 9 aa, Homo Sapiens
WWIMHDGGM

SEQ ID NO: 178923 - protein, 9 aa, Homo Sapiens
GCTNGRQMA

SEQ ID NO: 178924 - protein, 9 aa, Homo Sapiens
SFSARYGVQ

SEQ ID NO: 178925 - protein, 9 aa, Homo Sapiens
MIGQVDGLI

SEQ ID NO: 178926 - protein, 9 aa, Homo Sapiens
CRPTTSRRR

SEQ ID NO: 178927 - protein, 9 aa, Homo Sapiens
LENHKDIAQ

SEQ ID NO: 178928 - protein, 9 aa, Homo Sapiens
APHIGNTHL

SEQ ID NO: 178929 - protein, 9 aa, Homo Sapiens
NSAVCSADE

SEQ ID NO: 178930 - protein, 9 aa, Homo Sapiens
KRRHTEKNL

SEQ ID NO: 178931 - protein, 9 aa, Homo Sapiens
AVTAVLRVV

SEQ ID NO: 178932 - protein, 9 aa, Homo Sapiens
KLHGDSGIS

SEQ ID NO: 178933 - protein, 9 aa, Homo Sapiens
LQQEHQPFS

SEQ ID NO: 178934 - protein, 9 aa, Homo Sapiens
VPRLPRAGG

SEQ ID NO: 178935 - protein, 9 aa, Homo Sapiens
TARTPGPCV

SEQ ID NO: 178936 - protein, 9 aa, Homo Sapiens
LFSLSILSL

SEQ ID NO: 178937 - protein, 9 aa, Homo Sapiens
ASGTRKQPW

SEQ ID NO: 178938 - protein, 9 aa, Homo Sapiens
PTPASSPVS

SEQ ID NO: 178939 - protein, 9 aa, Homo Sapiens
ETKQPCQYF

SEQ ID NO: 178940 - protein, 9 aa, Homo Sapiens
NKATKQRHW

SEQ ID NO: 178941 - protein, 9 aa, Homo Sapiens
NGFFRDITD

SEQ ID NO: 178942 - protein, 9 aa, Homo Sapiens
GASCANLLI

SEQ ID NO: 178943 - protein, 9 aa, Homo Sapiens
WQCMVGNSY

SEQ ID NO: 178944 - protein, 9 aa, Homo Sapiens
GCAEGNGRP

SEQ ID NO: 178945 - protein, 9 aa, Homo Sapiens
SDGQPRWGQ

SEQ ID NO: 178946 - protein, 9 aa, Homo Sapiens
LFANRRDIR

SEQ ID NO: 178947 - protein, 9 aa, Homo Sapiens
EIEKEKEKL

SEQ ID NO: 178948 - protein, 9 aa, Homo Sapiens
DYRKLTPNC

SEQ ID NO: 178949 - protein, 9 aa, Homo Sapiens
APPRICPSL

SEQ ID NO: 178950 - protein, 9 aa, Homo Sapiens
LPFSTVRLL

SEQ ID NO: 178951 - protein, 9 aa, Homo Sapiens
MRQLQSSHY

SEQ ID NO: 178952 - protein, 9 aa, Homo Sapiens
GHQIFGSFL

SEQ ID NO: 178953 - protein, 9 aa, Homo Sapiens
IRKTVKRLW

SEQ ID NO: 178954 - protein, 9 aa, Homo Sapiens
KLLRILLQQ

SEQ ID NO: 178955 - protein, 9 aa, Homo Sapiens
MEILTLTPI

SEQ ID NO: 178956 - protein, 9 aa, Homo Sapiens
KCQYPVPGG

SEQ ID NO: 178957 - protein, 9 aa, Homo Sapiens
LPPSSSGKQ

SEQ ID NO: 178958 - protein, 9 aa, Homo Sapiens
KMMAEVVRW

SEQ ID NO: 178959 - protein, 9 aa, Homo Sapiens
ATSSRRPSG

SEQ ID NO: 178960 - protein, 9 aa, Homo Sapiens
LSPCLPVRP

SEQ ID NO: 178961 - protein, 9 aa, Homo Sapiens
GPCPPPQRT

SEQ ID NO: 178962 - protein, 9 aa, Homo Sapiens
TWTQFRNYP

SEQ ID NO: 178963 - protein, 9 aa, Homo Sapiens
PHQMKCLTA

SEQ ID NO: 178964 - protein, 9 aa, Homo Sapiens
TAWTTRKPS

SEQ ID NO: 178965 - protein, 9 aa, Homo Sapiens
NKSGFAEAS

SEQ ID NO: 178966 - protein, 9 aa, Homo Sapiens
LAVELHLLL

SEQ ID NO: 178967 - protein, 9 aa, Homo Sapiens
NEQVMGKFR

SEQ ID NO: 178968 - protein, 9 aa, Homo Sapiens
FPNHPSTAQ

SEQ ID NO: 178969 - protein, 9 aa, Homo Sapiens
VEGLNVCEP

SEQ ID NO: 178970 - protein, 9 aa, Homo Sapiens
IKQAPGHRR

SEQ ID NO: 178971 - protein, 9 aa, Homo Sapiens
FWPQMTCRP

SEQ ID NO: 178972 - protein, 9 aa, Homo Sapiens
FVVILGDFI

SEQ ID NO: 178973 - protein, 9 aa, Homo Sapiens
SAQELKAPP

SEQ ID NO: 178974 - protein, 9 aa, Homo Sapiens
EGGPARGTT

SEQ ID NO: 178975 - protein, 9 aa, Homo Sapiens
SAWPWPKIP

SEQ ID NO: 178976 - protein, 9 aa, Homo Sapiens
IYHNVEGPL

SEQ ID NO: 178977 - protein, 9 aa, Homo Sapiens
EKNPMGVLS

SEQ ID NO: 178978 - protein, 9 aa, Homo Sapiens
HPAEVLEEH

SEQ ID NO: 178979 - protein, 9 aa, Homo Sapiens
LQMYGKHTP

SEQ ID NO: 178980 - protein, 9 aa, Homo Sapiens
VLRQVRYWA

SEQ ID NO: 178981 - protein, 9 aa, Homo Sapiens
PCPFPFSLR

SEQ ID NO: 178982 - protein, 9 aa, Homo Sapiens
KRAEQLKKA

SEQ ID NO: 178983 - protein, 9 aa, Homo Sapiens
RLQSLLSLY

SEQ ID NO: 178984 - protein, 9 aa, Homo Sapiens
PLEAENGEV

SEQ ID NO: 178985 - protein, 9 aa, Homo Sapiens
MQHSCTHCW

SEQ ID NO: 178986 - protein, 9 aa, Homo Sapiens
RWCSNKKNV

SEQ ID NO: 178987 - protein, 9 aa, Homo Sapiens
VRCARRGRR

SEQ ID NO: 178988 - protein, 9 aa, Homo Sapiens
CLLSWCGRD

SEQ ID NO: 178989 - protein, 9 aa, Homo Sapiens
GESTDVHVC

SEQ ID NO: 178990 - protein, 9 aa, Homo Sapiens
ENTQHLLTL

SEQ ID NO: 178991 - protein, 9 aa, Homo Sapiens
VGKVVVTIL

SEQ ID NO: 178992 - protein, 9 aa, Homo Sapiens
KKGHSFEVG

SEQ ID NO: 178993 - protein, 9 aa, Homo Sapiens
DINLKIKTQ

SEQ ID NO: 178994 - protein, 9 aa, Homo Sapiens
VYTTQPGSS

SEQ ID NO: 178995 - protein, 9 aa, Homo Sapiens
IWKKLVIVG

SEQ ID NO: 178996 - protein, 9 aa, Homo Sapiens
GWWAPACTR

SEQ ID NO: 178997 - protein, 9 aa, Homo Sapiens
AGASCANLL

SEQ ID NO: 178998 - protein, 9 aa, Homo Sapiens
RRLDLEYLF

SEQ ID NO: 178999 - protein, 9 aa, Homo Sapiens
EAVSGSGGR

SEQ ID NO: 179000 - protein, 9 aa, Homo Sapiens
QNSERQLPR

SEQ ID NO: 179001 - protein, 9 aa, Homo Sapiens
PWPMHPDGM

SEQ ID NO: 179002 - protein, 9 aa, Homo Sapiens
VERTLTSVP

SEQ ID NO: 179003 - protein, 9 aa, Homo Sapiens
FPFSLRGNW

SEQ ID NO: 179004 - protein, 9 aa, Homo Sapiens
KVPQHAGKK

SEQ ID NO: 179005 - protein, 9 aa, Homo Sapiens
QKARGAALQ

SEQ ID NO: 179006 - protein, 9 aa, Homo Sapiens
LSEPQAIAV

SEQ ID NO: 179007 - protein, 9 aa, Homo Sapiens
AKVTILQKV

SEQ ID NO: 179008 - protein, 9 aa, Homo Sapiens
WESQVRQLA

SEQ ID NO: 179009 - protein, 9 aa, Homo Sapiens
LKNNSISKN

SEQ ID NO: 179010 - protein, 9 aa, Homo Sapiens
WMRPKKCPL

SEQ ID NO: 179011 - protein, 9 aa, Homo Sapiens
EQVMGKFRG

SEQ ID NO: 179012 - protein, 9 aa, Homo Sapiens
IVGIMFFER

SEQ ID NO: 179013 - protein, 9 aa, Homo Sapiens
PESPSISAQ

SEQ ID NO: 179014 - protein, 9 aa, Homo Sapiens
RRPSSMLPR

SEQ ID NO: 179015 - protein, 9 aa, Homo Sapiens
LPWARYITQ

SEQ ID NO: 179016 - protein, 9 aa, Homo Sapiens
ALDQAEQAE

SEQ ID NO: 179017 - protein, 9 aa, Homo Sapiens
DRSTVWLSL

SEQ ID NO: 179018 - protein, 9 aa, Homo Sapiens
SSSSRKSSV

SEQ ID NO: 179019 - protein, 9 aa, Homo Sapiens
TRSCGPSSS

SEQ ID NO: 179020 - protein, 9 aa, Homo Sapiens
FLCARQPRL

SEQ ID NO: 179021 - protein, 9 aa, Homo Sapiens
DQAEQAEAE

SEQ ID NO: 179022 - protein, 9 aa, Homo Sapiens
DEKFIQKFV

SEQ ID NO: 179023 - protein, 9 aa, Homo Sapiens
DAGPRTNGQ

SEQ ID NO: 179024 - protein, 9 aa, Homo Sapiens
RPGRPRWRD

SEQ ID NO: 179025 - protein, 9 aa, Homo Sapiens
TNYSLMVRC

SEQ ID NO: 179026 - protein, 9 aa, Homo Sapiens
EALHVFPWG

SEQ ID NO: 179027 - protein, 9 aa, Homo Sapiens
DCAHQVHLQ

SEQ ID NO: 179028 - protein, 9 aa, Homo Sapiens
ITRSRKKDD

SEQ ID NO: 179029 - protein, 9 aa, Homo Sapiens
GKLLLLHLI

SEQ ID NO: 179030 - protein, 9 aa, Homo Sapiens
FLLSLRNLS

SEQ ID NO: 179031 - protein, 9 aa, Homo Sapiens
EAPEAQMHG

SEQ ID NO: 179032 - protein, 9 aa, Homo Sapiens
QEAAKCEWI

SEQ ID NO: 179033 - protein, 9 aa, Homo Sapiens
VFAAAKDTI

SEQ ID NO: 179034 - protein, 9 aa, Homo Sapiens
QRSVVQQDL

SEQ ID NO: 179035 - protein, 9 aa, Homo Sapiens
LLTDPSLSR

SEQ ID NO: 179036 - protein, 9 aa, Homo Sapiens
CVIRHPRTV

SEQ ID NO: 179037 - protein, 9 aa, Homo Sapiens
AKPIFQMPQ

SEQ ID NO: 179038 - protein, 9 aa, Homo Sapiens
GTLPRKGRK

SEQ ID NO: 179039 - protein, 9 aa, Homo Sapiens
TKCRPTTSR

SEQ ID NO: 179040 - protein, 9 aa, Homo Sapiens
NSHFHLSKD

SEQ ID NO: 179041 - protein, 9 aa, Homo Sapiens
LTIGEKTEI

SEQ ID NO: 179042 - protein, 9 aa, Homo Sapiens
DIAHVLWPF

SEQ ID NO: 179043 - protein, 9 aa, Homo Sapiens
KKERAWLSP

SEQ ID NO: 179044 - protein, 9 aa, Homo Sapiens
PNLLYSQNH

SEQ ID NO: 179045 - protein, 9 aa, Homo Sapiens
HLLPQALCL

SEQ ID NO: 179046 - protein, 9 aa, Homo Sapiens
ATHKCILKP

SEQ ID NO: 179047 - protein, 9 aa, Homo Sapiens
ISPPSTNAK

SEQ ID NO: 179048 - protein, 9 aa, Homo Sapiens
IQVFHVRLR

SEQ ID NO: 179049 - protein, 9 aa, Homo Sapiens
GSDEMQKFM

SEQ ID NO: 179050 - protein, 9 aa, Homo Sapiens
CGRDASHCP

SEQ ID NO: 179051 - protein, 9 aa, Homo Sapiens
HAPRLSKKV

SEQ ID NO: 179052 - protein, 9 aa, Homo Sapiens
GQLDEDVEE

SEQ ID NO: 179053 - protein, 9 aa, Homo Sapiens
LHLLAVELH

SEQ ID NO: 179054 - protein, 9 aa, Homo Sapiens
LEPRDRRPP

SEQ ID NO: 179055 - protein, 9 aa, Homo Sapiens
RAHRCTHAG

SEQ ID NO: 179056 - protein, 9 aa, Homo Sapiens
KRKAMTKKR

SEQ ID NO: 179057 - protein, 9 aa, Homo Sapiens
THGGQFKFI

SEQ ID NO: 179058 - protein, 9 aa, Homo Sapiens
TPEEHAHGA

SEQ ID NO: 179059 - protein, 9 aa, Homo Sapiens
NCLSGFRQE

SEQ ID NO: 179060 - protein, 9 aa, Homo Sapiens
AHQGVWPCD

SEQ ID NO: 179061 - protein, 9 aa, Homo Sapiens
VLGSVLCTH

SEQ ID NO: 179062 - protein, 9 aa, Homo Sapiens
NAMNIKHFK

SEQ ID NO: 179063 - protein, 9 aa, Homo Sapiens
GEAVVVDVG

SEQ ID NO: 179064 - protein, 9 aa, Homo Sapiens
AMTVACLVG

SEQ ID NO: 179065 - protein, 9 aa, Homo Sapiens
EDNSGGGKK

SEQ ID NO: 179066 - protein, 9 aa, Homo Sapiens
DPHSQILIC

SEQ ID NO: 179067 - protein, 9 aa, Homo Sapiens
SSTSSLWST

SEQ ID NO: 179068 - protein, 9 aa, Homo Sapiens
NISEKKVTW

SEQ ID NO: 179069 - protein, 9 aa, Homo Sapiens
RASACVPSP

SEQ ID NO: 179070 - protein, 9 aa, Homo Sapiens
LGPETALVS

SEQ ID NO: 179071 - protein, 9 aa, Homo Sapiens
INLKIKTQK

SEQ ID NO: 179072 - protein, 9 aa, Homo Sapiens
AGRVAFKLC

SEQ ID NO: 179073 - protein, 9 aa, Homo Sapiens
RIVDIWILL

SEQ ID NO: 179074 - protein, 9 aa, Homo Sapiens
LETKQPCQY

SEQ ID NO: 179075 - protein, 9 aa, Homo Sapiens
TRMHQAIER

SEQ ID NO: 179076 - protein, 9 aa, Homo Sapiens
KETLLFYRV

SEQ ID NO: 179077 - protein, 9 aa, Homo Sapiens
NLSEPQAIA

SEQ ID NO: 179078 - protein, 9 aa, Homo Sapiens
VYLGGLGVC

SEQ ID NO: 179079 - protein, 9 aa, Homo Sapiens
LPAPVIQVK

SEQ ID NO: 179080 - protein, 9 aa, Homo Sapiens
QLQSPVYFF

SEQ ID NO: 179081 - protein, 9 aa, Homo Sapiens
QVMGKFRGG

SEQ ID NO: 179082 - protein, 9 aa, Homo Sapiens
CSILFWKDC

SEQ ID NO: 179083 - protein, 9 aa, Homo Sapiens
QKVRESKWV

SEQ ID NO: 179084 - protein, 9 aa, Homo Sapiens
SSPSSRDAT

SEQ ID NO: 179085 - protein, 9 aa, Homo Sapiens
CSWPRVRCA

SEQ ID NO: 179086 - protein, 9 aa, Homo Sapiens
RIPKVGLSS

SEQ ID NO: 179087 - protein, 9 aa, Homo Sapiens
SLEPPYLHQ

SEQ ID NO: 179088 - protein, 9 aa, Homo Sapiens
ALHTTENKL

SEQ ID NO: 179089 - protein, 9 aa, Homo Sapiens
VRLRQCRSQ

SEQ ID NO: 179090 - protein, 9 aa, Homo Sapiens
DKLLLPAHA

SEQ ID NO: 179091 - protein, 9 aa, Homo Sapiens
QTPQDSRQV

SEQ ID NO: 179092 - protein, 9 aa, Homo Sapiens
KPWQSPWGE

SEQ ID NO: 179093 - protein, 9 aa, Homo Sapiens
VDSECQACL

SEQ ID NO: 179094 - protein, 9 aa, Homo Sapiens
KAHENPFRG

SEQ ID NO: 179095 - protein, 9 aa, Homo Sapiens
KSGGNVKQT

SEQ ID NO: 179096 - protein, 9 aa, Homo Sapiens
DLCFFGMRV

SEQ ID NO: 179097 - protein, 9 aa, Homo Sapiens
GRRHGLGPI

SEQ ID NO: 179098 - protein, 9 aa, Homo Sapiens
RATGWPWQD

SEQ ID NO: 179099 - protein, 9 aa, Homo Sapiens
MAESCEVQE

SEQ ID NO: 179100 - protein, 9 aa, Homo Sapiens
KDLLSRIYL

SEQ ID NO: 179101 - protein, 9 aa, Homo Sapiens
LDLVSAEDL

SEQ ID NO: 179102 - protein, 9 aa, Homo Sapiens
TLFFHSQPT

SEQ ID NO: 179103 - protein, 9 aa, Homo Sapiens
IIFQILVTV

SEQ ID NO: 179104 - protein, 9 aa, Homo Sapiens
QSAGLLGPF

SEQ ID NO: 179105 - protein, 9 aa, Homo Sapiens
KAIKETGNV

SEQ ID NO: 179106 - protein, 9 aa, Homo Sapiens
VGSSSVVSQ

SEQ ID NO: 179107 - protein, 9 aa, Homo Sapiens
SRAASLLFS

SEQ ID NO: 179108 - protein, 9 aa, Homo Sapiens
ETRPQLDYE

SEQ ID NO: 179109 - protein, 9 aa, Homo Sapiens
TPKEGADTV

SEQ ID NO: 179110 - protein, 9 aa, Homo Sapiens
NPLEMTVWV

SEQ ID NO: 179111 - protein, 9 aa, Homo Sapiens
AQRTLIEAL

SEQ ID NO: 179112 - protein, 9 aa, Homo Sapiens
LSILSLENL

SEQ ID NO: 179113 - protein, 9 aa, Homo Sapiens
ATFAYLLVI

SEQ ID NO: 179114 - protein, 9 aa, Homo Sapiens
VSEWKEPRA

SEQ ID NO: 179115 - protein, 9 aa, Homo Sapiens
FIGNMITTV

SEQ ID NO: 179116 - protein, 9 aa, Homo Sapiens
VPLGEEHIL

SEQ ID NO: 179117 - protein, 9 aa, Homo Sapiens
YGGLSASLC

SEQ ID NO: 179118 - protein, 9 aa, Homo Sapiens
PGVVRGLGE

SEQ ID NO: 179119 - protein, 9 aa, Homo Sapiens
FNLGHLYEE

SEQ ID NO: 179120 - protein, 9 aa, Homo Sapiens
NHSPPTTRR

SEQ ID NO: 179121 - protein, 9 aa, Homo Sapiens
TTAPPTATW

SEQ ID NO: 179122 - protein, 9 aa, Homo Sapiens
LGDYRKLTP

SEQ ID NO: 179123 - protein, 9 aa, Homo Sapiens
SLSADIIQR

SEQ ID NO: 179124 - protein, 9 aa, Homo Sapiens
PHIGNTHLK

SEQ ID NO: 179125 - protein, 9 aa, Homo Sapiens
SVKKRCSLM

SEQ ID NO: 179126 - protein, 9 aa, Homo Sapiens
LALVTLRHH

SEQ ID NO: 179127 - protein, 9 aa, Homo Sapiens
WDNVCLTYC

SEQ ID NO: 179128 - protein, 9 aa, Homo Sapiens
PQDDTDSNR

SEQ ID NO: 179129 - protein, 9 aa, Homo Sapiens
SSSPSALPC

SEQ ID NO: 179130 - protein, 9 aa, Homo Sapiens
LRELGFSST

SEQ ID NO: 179131 - protein, 9 aa, Homo Sapiens
SLDDIAHVL

SEQ ID NO: 179132 - protein, 9 aa, Homo Sapiens
AAKCEWINS

SEQ ID NO: 179133 - protein, 9 aa, Homo Sapiens
GWWQSPLRK

SEQ ID NO: 179134 - protein, 9 aa, Homo Sapiens
PHRHCHPRS

SEQ ID NO: 179135 - protein, 9 aa, Homo Sapiens
PRARRCDQK

SEQ ID NO: 179136 - protein, 9 aa, Homo Sapiens
AEGGGHAVP

SEQ ID NO: 179137 - protein, 9 aa, Homo Sapiens
PASSPTCSW

SEQ ID NO: 179138 - protein, 9 aa, Homo Sapiens
LKFREQDAL

SEQ ID NO: 179139 - protein, 9 aa, Homo Sapiens
APQWPLSTF

SEQ ID NO: 179140 - protein, 9 aa, Homo Sapiens
SGSTSCGDS

SEQ ID NO: 179141 - protein, 9 aa, Homo Sapiens
TAEEKFIKR

SEQ ID NO: 179142 - protein, 9 aa, Homo Sapiens
NPLTQLEVA

SEQ ID NO: 179143 - protein, 9 aa, Homo Sapiens
FLASLMFFG

SEQ ID NO: 179144 - protein, 9 aa, Homo Sapiens
TSSDKLLVF

SEQ ID NO: 179145 - protein, 9 aa, Homo Sapiens
RKKRPQIAD

SEQ ID NO: 179146 - protein, 9 aa, Homo Sapiens
LQLLQTLRP

SEQ ID NO: 179147 - protein, 9 aa, Homo Sapiens
MFAGFLGCY

SEQ ID NO: 179148 - protein, 9 aa, Homo Sapiens
QAVREMLLR

SEQ ID NO: 179149 - protein, 9 aa, Homo Sapiens
MEGTEFEPE

SEQ ID NO: 179150 - protein, 9 aa, Homo Sapiens
RRRMMNMSK

SEQ ID NO: 179151 - protein, 9 aa, Homo Sapiens
TYNKKWKRF

SEQ ID NO: 179152 - protein, 9 aa, Homo Sapiens
SGESGRCVR

SEQ ID NO: 179153 - protein, 9 aa, Homo Sapiens
HRRQLRWKM

SEQ ID NO: 179154 - protein, 9 aa, Homo Sapiens
GRGQAHAVK

SEQ ID NO: 179155 - protein, 9 aa, Homo Sapiens
CYPILDGLK

SEQ ID NO: 179156 - protein, 9 aa, Homo Sapiens
QASAAAPAA

SEQ ID NO: 179157 - protein, 9 aa, Homo Sapiens
LDDQRLLLH

SEQ ID NO: 179158 - protein, 9 aa, Homo Sapiens
GPDQRLCKA

SEQ ID NO: 179159 - protein, 9 aa, Homo Sapiens
ALLHSPVPR

SEQ ID NO: 179160 - protein, 9 aa, Homo Sapiens
HFVPVLGFG

SEQ ID NO: 179161 - protein, 9 aa, Homo Sapiens
MKHLFGIQV

SEQ ID NO: 179162 - protein, 9 aa, Homo Sapiens
EGPAHPTVP

SEQ ID NO: 179163 - protein, 9 aa, Homo Sapiens
PRGPESRAL

SEQ ID NO: 179164 - protein, 9 aa, Homo Sapiens
AEEGIRKCQ

SEQ ID NO: 179165 - protein, 9 aa, Homo Sapiens
VKQTDAWLQ

SEQ ID NO: 179166 - protein, 9 aa, Homo Sapiens
AVGAVMMFA

SEQ ID NO: 179167 - protein, 9 aa, Homo Sapiens
TGDQKSGGN

SEQ ID NO: 179168 - protein, 9 aa, Homo Sapiens
QLHFAAESI

SEQ ID NO: 179169 - protein, 9 aa, Homo Sapiens
TSIFAGIVT

SEQ ID NO: 179170 - protein, 9 aa, Homo Sapiens
AIIFCRTKN

SEQ ID NO: 179171 - protein, 9 aa, Homo Sapiens
PPTQQPQTP

SEQ ID NO: 179172 - protein, 9 aa, Homo Sapiens
EEKLCQETA

SEQ ID NO: 179173 - protein, 9 aa, Homo Sapiens
SQRALLHSP

SEQ ID NO: 179174 - protein, 9 aa, Homo Sapiens
DQKLQRCFC

SEQ ID NO: 179175 - protein, 9 aa, Homo Sapiens
RCLLNIGRQ

SEQ ID NO: 179176 - protein, 9 aa, Homo Sapiens
KCLANWSNC

SEQ ID NO: 179177 - protein, 9 aa, Homo Sapiens
PRAGGHRPD

SEQ ID NO: 179178 - protein, 9 aa, Homo Sapiens
VTLVKTFAT

SEQ ID NO: 179179 - protein, 9 aa, Homo Sapiens
KSQALRDTM

SEQ ID NO: 179180 - protein, 9 aa, Homo Sapiens
ARGILSASW

SEQ ID NO: 179181 - protein, 9 aa, Homo Sapiens
AVLDHPAEV

SEQ ID NO: 179182 - protein, 9 aa, Homo Sapiens
FDKLLLPAH

SEQ ID NO: 179183 - protein, 9 aa, Homo Sapiens
ENPFRGKAL

SEQ ID NO: 179184 - protein, 9 aa, Homo Sapiens
LRKVRVPKR

SEQ ID NO: 179185 - protein, 9 aa, Homo Sapiens
ESGRCVRRS

SEQ ID NO: 179186 - protein, 9 aa, Homo Sapiens
WKSPLHLLS

SEQ ID NO: 179187 - protein, 9 aa, Homo Sapiens
PAPAAVPST

SEQ ID NO: 179188 - protein, 9 aa, Homo Sapiens
VLCATLIFF

SEQ ID NO: 179189 - protein, 9 aa, Homo Sapiens
PCPLPLQNS

SEQ ID NO: 179190 - protein, 9 aa, Homo Sapiens
KPSGEQIPG

SEQ ID NO: 179191 - protein, 9 aa, Homo Sapiens
GSVRATDRL

SEQ ID NO: 179192 - protein, 9 aa, Homo Sapiens
DTARGRPAA

SEQ ID NO: 179193 - protein, 9 aa, Homo Sapiens
LHLISLSPR

SEQ ID NO: 179194 - protein, 9 aa, Homo Sapiens
HRDSFEAPE

SEQ ID NO: 179195 - protein, 9 aa, Homo Sapiens
SSSVVSQTS

SEQ ID NO: 179196 - protein, 9 aa, Homo Sapiens
FVLFDEKHR

SEQ ID NO: 179197 - protein, 9 aa, Homo Sapiens
MRRLDLEYL

SEQ ID NO: 179198 - protein, 9 aa, Homo Sapiens
TDAWLQPEQ

SEQ ID NO: 179199 - protein, 9 aa, Homo Sapiens
AGPPTTLGP

SEQ ID NO: 179200 - protein, 9 aa, Homo Sapiens
ICQPMEILT

SEQ ID NO: 179201 - protein, 9 aa, Homo Sapiens
SARTASEQP

SEQ ID NO: 179202 - protein, 9 aa, Homo Sapiens
RAYGRLWRP

SEQ ID NO: 179203 - protein, 9 aa, Homo Sapiens
GRARCGVLW

SEQ ID NO: 179204 - protein, 9 aa, Homo Sapiens
LHTGGKPFK

SEQ ID NO: 179205 - protein, 9 aa, Homo Sapiens
KTQWETLFG

SEQ ID NO: 179206 - protein, 9 aa, Homo Sapiens
ADEQSKDRE

SEQ ID NO: 179207 - protein, 9 aa, Homo Sapiens
KEAADQGQG

SEQ ID NO: 179208 - protein, 9 aa, Homo Sapiens
KGATYTPRH

SEQ ID NO: 179209 - protein, 9 aa, Homo Sapiens
SDDMKKLKT

SEQ ID NO: 179210 - protein, 9 aa, Homo Sapiens
ENDDHPSLD

SEQ ID NO: 179211 - protein, 9 aa, Homo Sapiens
KAMDERQEA

SEQ ID NO: 179212 - protein, 9 aa, Homo Sapiens
RSCGPSSSP

SEQ ID NO: 179213 - protein, 9 aa, Homo Sapiens
VILLLLCQL

SEQ ID NO: 179214 - protein, 9 aa, Homo Sapiens
ILQKVAMDI

SEQ ID NO: 179215 - protein, 9 aa, Homo Sapiens
GCSPQLGPR

SEQ ID NO: 179216 - protein, 9 aa, Homo Sapiens
KFFLCLKKE

SEQ ID NO: 179217 - protein, 9 aa, Homo Sapiens
PKNHGQTSH

SEQ ID NO: 179218 - protein, 9 aa, Homo Sapiens
MTAKKKAQL

SEQ ID NO: 179219 - protein, 9 aa, Homo Sapiens
EINMLKKYY

SEQ ID NO: 179220 - protein, 9 aa, Homo Sapiens
RLPYFWDNV

SEQ ID NO: 179221 - protein, 9 aa, Homo Sapiens
SCWAPTTRP

SEQ ID NO: 179222 - protein, 9 aa, Homo Sapiens
GGREKKKAP

SEQ ID NO: 179223 - protein, 9 aa, Homo Sapiens
TEFLSLREL

SEQ ID NO: 179224 - protein, 9 aa, Homo Sapiens
KELGVNLLE

SEQ ID NO: 179225 - protein, 9 aa, Homo Sapiens
LNIITPPPH

SEQ ID NO: 179226 - protein, 9 aa, Homo Sapiens
GEFISFQAM

SEQ ID NO: 179227 - protein, 9 aa, Homo Sapiens
GIVTFSIYG

SEQ ID NO: 179228 - protein, 9 aa, Homo Sapiens
RIKKPIYAD

SEQ ID NO: 179229 - protein, 9 aa, Homo Sapiens
REITKLESR

SEQ ID NO: 179230 - protein, 9 aa, Homo Sapiens
RDTMARQLS

SEQ ID NO: 179231 - protein, 9 aa, Homo Sapiens
LATMGPIDL

SEQ ID NO: 179232 - protein, 9 aa, Homo Sapiens
TVTTARTPG

SEQ ID NO: 179233 - protein, 9 aa, Homo Sapiens
RSFLLLLLL

SEQ ID NO: 179234 - protein, 9 aa, Homo Sapiens
PIRQNPGIL

SEQ ID NO: 179235 - protein, 9 aa, Homo Sapiens
TAGPPTTLG

SEQ ID NO: 179236 - protein, 9 aa, Homo Sapiens
QHRYSTDSS

SEQ ID NO: 179237 - protein, 9 aa, Homo Sapiens
LSSPKGVPF

SEQ ID NO: 179238 - protein, 9 aa, Homo Sapiens
PFQALPREK

SEQ ID NO: 179239 - protein, 9 aa, Homo Sapiens
VLLAVLDHP

SEQ ID NO: 179240 - protein, 9 aa, Homo Sapiens
TIEHMGSGV

SEQ ID NO: 179241 - protein, 9 aa, Homo Sapiens
VTVSVLGSS

SEQ ID NO: 179242 - protein, 9 aa, Homo Sapiens
APYSTCYST

SEQ ID NO: 179243 - protein, 9 aa, Homo Sapiens
MPRPGPCPP

SEQ ID NO: 179244 - protein, 9 aa, Homo Sapiens
PSLDDIAHV

SEQ ID NO: 179245 - protein, 9 aa, Homo Sapiens
EAASVTGPD

SEQ ID NO: 179246 - protein, 9 aa, Homo Sapiens
ENMCPSVNL

SEQ ID NO: 179247 - protein, 9 aa, Homo Sapiens
AEQVITSFR

SEQ ID NO: 179248 - protein, 9 aa, Homo Sapiens
QENVLPDIF

SEQ ID NO: 179249 - protein, 9 aa, Homo Sapiens
VNLLEVLLI

SEQ ID NO: 179250 - protein, 9 aa, Homo Sapiens
PWATSLPRP

SEQ ID NO: 179251 - protein, 9 aa, Homo Sapiens
IIGQNGVLS

SEQ ID NO: 179252 - protein, 9 aa, Homo Sapiens
ETDHTTGGE

SEQ ID NO: 179253 - protein, 9 aa, Homo Sapiens
ELFNILDLL

SEQ ID NO: 179254 - protein, 9 aa, Homo Sapiens
NQRLLLLIK

SEQ ID NO: 179255 - protein, 9 aa, Homo Sapiens
LPQALCLLF

SEQ ID NO: 179256 - protein, 9 aa, Homo Sapiens
KHQKHHKHH

SEQ ID NO: 179257 - protein, 9 aa, Homo Sapiens
PEGEKLHGD

SEQ ID NO: 179258 - protein, 9 aa, Homo Sapiens
EGLGQLPKE

SEQ ID NO: 179259 - protein, 9 aa, Homo Sapiens
HLSNPLEMT

SEQ ID NO: 179260 - protein, 9 aa, Homo Sapiens
TPRDRLSFK

SEQ ID NO: 179261 - protein, 9 aa, Homo Sapiens
LAHLSAASP

SEQ ID NO: 179262 - protein, 9 aa, Homo Sapiens
SERQLPRCL

SEQ ID NO: 179263 - protein, 9 aa, Homo Sapiens
QARNHMNVN

SEQ ID NO: 179264 - protein, 9 aa, Homo Sapiens
EQQISPPST

SEQ ID NO: 179265 - protein, 9 aa, Homo Sapiens
LNEIEKEKE

SEQ ID NO: 179266 - protein, 9 aa, Homo Sapiens
STNLAYTTA

SEQ ID NO: 179267 - protein, 9 aa, Homo Sapiens
IMSSGDLLA

SEQ ID NO: 179268 - protein, 9 aa, Homo Sapiens
RNLSSLRPE

SEQ ID NO: 179269 - protein, 9 aa, Homo Sapiens
FPQPLPCVQ

SEQ ID NO: 179270 - protein, 9 aa, Homo Sapiens
MAHPNEEGM

SEQ ID NO: 179271 - protein, 9 aa, Homo Sapiens
STAWTTRKP

SEQ ID NO: 179272 - protein, 9 aa, Homo Sapiens
AGSVGAEGG

SEQ ID NO: 179273 - protein, 9 aa, Homo Sapiens
LLVRRMRRQ

SEQ ID NO: 179274 - protein, 9 aa, Homo Sapiens
TLVLPSLVP

SEQ ID NO: 179275 - protein, 9 aa, Homo Sapiens
KVSVIPPTT

SEQ ID NO: 179276 - protein, 9 aa, Homo Sapiens
KNIAFYPNN

SEQ ID NO: 179277 - protein, 9 aa, Homo Sapiens
TSLIIQMPE

SEQ ID NO: 179278 - protein, 9 aa, Homo Sapiens
WSSQKWTIF

SEQ ID NO: 179279 - protein, 9 aa, Homo Sapiens
AGQRRGVLQ

SEQ ID NO: 179280 - protein, 9 aa, Homo Sapiens
AGYASHFIV

SEQ ID NO: 179281 - protein, 9 aa, Homo Sapiens
TAWSPGEGS

SEQ ID NO: 179282 - protein, 9 aa, Homo Sapiens
GLNVCEPAS

SEQ ID NO: 179283 - protein, 9 aa, Homo Sapiens
AARWRRRAI

SEQ ID NO: 179284 - protein, 9 aa, Homo Sapiens
SKHKLESPA

SEQ ID NO: 179285 - protein, 9 aa, Homo Sapiens
ICYYNFICA

SEQ ID NO: 179286 - protein, 9 aa, Homo Sapiens
SLSTHSLEP

SEQ ID NO: 179287 - protein, 9 aa, Homo Sapiens
TESSAVAAT

SEQ ID NO: 179288 - protein, 9 aa, Homo Sapiens
HKQGNDGRV

SEQ ID NO: 179289 - protein, 9 aa, Homo Sapiens
SPMKSILRQ

SEQ ID NO: 179290 - protein, 9 aa, Homo Sapiens
PTILRPPGP

SEQ ID NO: 179291 - protein, 9 aa, Homo Sapiens
CWSPKGKQP

SEQ ID NO: 179292 - protein, 9 aa, Homo Sapiens
GRTFQDVTT

SEQ ID NO: 179293 - protein, 9 aa, Homo Sapiens
VCIYGKEID

SEQ ID NO: 179294 - protein, 9 aa, Homo Sapiens
EGKITFYIL

SEQ ID NO: 179295 - protein, 9 aa, Homo Sapiens
KNPIFVMNV

SEQ ID NO: 179296 - protein, 9 aa, Homo Sapiens
FFQLKTSLS

SEQ ID NO: 179297 - protein, 9 aa, Homo Sapiens
GPTILRPPG

SEQ ID NO: 179298 - protein, 9 aa, Homo Sapiens
AVLVKVIQV

SEQ ID NO: 179299 - protein, 9 aa, Homo Sapiens
HPWHQPSHH

SEQ ID NO: 179300 - protein, 9 aa, Homo Sapiens
NERTIAGAL

SEQ ID NO: 179301 - protein, 9 aa, Homo Sapiens
PIKDDLMLF

SEQ ID NO: 179302 - protein, 9 aa, Homo Sapiens
ARLPARALQ

SEQ ID NO: 179303 - protein, 9 aa, Homo Sapiens
PMTAKKKAQ

SEQ ID NO: 179304 - protein, 9 aa, Homo Sapiens
STRTTASLS

SEQ ID NO: 179305 - protein, 9 aa, Homo Sapiens
YWELLNSMK

SEQ ID NO: 179306 - protein, 9 aa, Homo Sapiens
LSGARGRTG

SEQ ID NO: 179307 - protein, 9 aa, Homo Sapiens
PPAVHITHH

SEQ ID NO: 179308 - protein, 9 aa, Homo Sapiens
EQVVEIITE

SEQ ID NO: 179309 - protein, 9 aa, Homo Sapiens
CDQWRIGSA

SEQ ID NO: 179310 - protein, 9 aa, Homo Sapiens
FAGFLGCYG

SEQ ID NO: 179311 - protein, 9 aa, Homo Sapiens
IMTVGFCGK

SEQ ID NO: 179312 - protein, 9 aa, Homo Sapiens
KEVNAMAVL

SEQ ID NO: 179313 - protein, 9 aa, Homo Sapiens
LDCKKIRAS

SEQ ID NO: 179314 - protein, 9 aa, Homo Sapiens
TEQVVEIIT

SEQ ID NO: 179315 - protein, 9 aa, Homo Sapiens
SCASGVTTS

SEQ ID NO: 179316 - protein, 9 aa, Homo Sapiens
GPLGGREKK

SEQ ID NO: 179317 - protein, 9 aa, Homo Sapiens
KSLPCNICK

SEQ ID NO: 179318 - protein, 9 aa, Homo Sapiens
EEDDTGMGD

SEQ ID NO: 179319 - protein, 9 aa, Homo Sapiens
PYPKDDNIQ

SEQ ID NO: 179320 - protein, 9 aa, Homo Sapiens
RIGAVKCKS

SEQ ID NO: 179321 - protein, 9 aa, Homo Sapiens
PSATSQTPG

SEQ ID NO: 179322 - protein, 9 aa, Homo Sapiens
KEDLLYLRT

SEQ ID NO: 179323 - protein, 9 aa, Homo Sapiens
HTILVSVHL

SEQ ID NO: 179324 - protein, 9 aa, Homo Sapiens
ILIEHTHRV

SEQ ID NO: 179325 - protein, 9 aa, Homo Sapiens
EAFKTKDCD

SEQ ID NO: 179326 - protein, 9 aa, Homo Sapiens
PAARTGSRP

SEQ ID NO: 179327 - protein, 9 aa, Homo Sapiens
SAEEGIRKC

SEQ ID NO: 179328 - protein, 9 aa, Homo Sapiens
GLGTPAPTG

SEQ ID NO: 179329 - protein, 9 aa, Homo Sapiens
LSIRLPYFW

SEQ ID NO: 179330 - protein, 9 aa, Homo Sapiens
RAPGPWEKM

SEQ ID NO: 179331 - protein, 9 aa, Homo Sapiens
QRSMAVCLT

SEQ ID NO: 179332 - protein, 9 aa, Homo Sapiens
DEMTIIKQA

SEQ ID NO: 179333 - protein, 9 aa, Homo Sapiens
QVALCKFHS

SEQ ID NO: 179334 - protein, 9 aa, Homo Sapiens
GCCLRIHCV

SEQ ID NO: 179335 - protein, 9 aa, Homo Sapiens
GCIEIMGGA

SEQ ID NO: 179336 - protein, 9 aa, Homo Sapiens
LCMMVQKER

SEQ ID NO: 179337 - protein, 9 aa, Homo Sapiens
CPHQASPHP

SEQ ID NO: 179338 - protein, 9 aa, Homo Sapiens
WLWDLFHIG

SEQ ID NO: 179339 - protein, 9 aa, Homo Sapiens
ASVSFWTLL

SEQ ID NO: 179340 - protein, 9 aa, Homo Sapiens
REFGLLLQL

SEQ ID NO: 179341 - protein, 9 aa, Homo Sapiens
LKTDRAIMV

SEQ ID NO: 179342 - protein, 9 aa, Homo Sapiens
LTYLSVANV

SEQ ID NO: 179343 - protein, 9 aa, Homo Sapiens
PKRRMVYHP

SEQ ID NO: 179344 - protein, 9 aa, Homo Sapiens
RGSQRAVRG

SEQ ID NO: 179345 - protein, 9 aa, Homo Sapiens
GEEGLGQLP

SEQ ID NO: 179346 - protein, 9 aa, Homo Sapiens
FLRRAGQAS

SEQ ID NO: 179347 - protein, 9 aa, Homo Sapiens
SWRAAGVRY

SEQ ID NO: 179348 - protein, 9 aa, Homo Sapiens
EQEEPRTVQ

SEQ ID NO: 179349 - protein, 9 aa, Homo Sapiens
EPPYLHQNS

SEQ ID NO: 179350 - protein, 9 aa, Homo Sapiens
SRPCAGARR

SEQ ID NO: 179351 - protein, 9 aa, Homo Sapiens
PLEPVVTGT

SEQ ID NO: 179352 - protein, 9 aa, Homo Sapiens
LVNSVDDVI

SEQ ID NO: 179353 - protein, 9 aa, Homo Sapiens
GRAPPPSSP

SEQ ID NO: 179354 - protein, 9 aa, Homo Sapiens
HRPDLEEAV

SEQ ID NO: 179355 - protein, 9 aa, Homo Sapiens
YWRASVSVQ

SEQ ID NO: 179356 - protein, 9 aa, Homo Sapiens
DDGDDEGGG

SEQ ID NO: 179357 - protein, 9 aa, Homo Sapiens
GPKPKNDVH

SEQ ID NO: 179358 - protein, 9 aa, Homo Sapiens
EHPASLTGA

SEQ ID NO: 179359 - protein, 9 aa, Homo Sapiens
DKTTMKELI

SEQ ID NO: 179360 - protein, 9 aa, Homo Sapiens
FGLREITKL

SEQ ID NO: 179361 - protein, 9 aa, Homo Sapiens
IAVSSLSAV

SEQ ID NO: 179362 - protein, 9 aa, Homo Sapiens
KKEWGKTEP

SEQ ID NO: 179363 - protein, 9 aa, Homo Sapiens
KLEPRDRRP

SEQ ID NO: 179364 - protein, 9 aa, Homo Sapiens
FAQLAEGGG

SEQ ID NO: 179365 - protein, 9 aa, Homo Sapiens
QSSENPQGH

SEQ ID NO: 179366 - protein, 9 aa, Homo Sapiens
CMEWYTMSA

SEQ ID NO: 179367 - protein, 9 aa, Homo Sapiens
LLLQEEQEG

SEQ ID NO: 179368 - protein, 9 aa, Homo Sapiens
LVTYFPSFQ

SEQ ID NO: 179369 - protein, 9 aa, Homo Sapiens
VDRWNALAL

SEQ ID NO: 179370 - protein, 9 aa, Homo Sapiens
SARYGVQTL

SEQ ID NO: 179371 - protein, 9 aa, Homo Sapiens
GLLGSPLLS

SEQ ID NO: 179372 - protein, 9 aa, Homo Sapiens
KYYYSWKKN

SEQ ID NO: 179373 - protein, 9 aa, Homo Sapiens
GNMITTVGK

SEQ ID NO: 179374 - protein, 9 aa, Homo Sapiens
AHQVHLQFP

SEQ ID NO: 179375 - protein, 9 aa, Homo Sapiens
RELGFSSTE

SEQ ID NO: 179376 - protein, 9 aa, Homo Sapiens
TFLLTKVGA

SEQ ID NO: 179377 - protein, 9 aa, Homo Sapiens
VKGIEEKSG

SEQ ID NO: 179378 - protein, 9 aa, Homo Sapiens
DLLRIMPSN

SEQ ID NO: 179379 - protein, 9 aa, Homo Sapiens
VKMSLLLSH

SEQ ID NO: 179380 - protein, 9 aa, Homo Sapiens
CAQRLHLLA

SEQ ID NO: 179381 - protein, 9 aa, Homo Sapiens
DQRDCKEVK

SEQ ID NO: 179382 - protein, 9 aa, Homo Sapiens
PLRGHSPRS

SEQ ID NO: 179383 - protein, 9 aa, Homo Sapiens
AKEAADQGQ

SEQ ID NO: 179384 - protein, 9 aa, Homo Sapiens
GKMAVMECD

SEQ ID NO: 179385 - protein, 9 aa, Homo Sapiens
LGGERDKAS

SEQ ID NO: 179386 - protein, 9 aa, Homo Sapiens
DDPYGARNE

SEQ ID NO: 179387 - protein, 9 aa, Homo Sapiens
YTTQPGSSF

SEQ ID NO: 179388 - protein, 9 aa, Homo Sapiens
LQFQVLKQS

SEQ ID NO: 179389 - protein, 9 aa, Homo Sapiens
GKHTPWEDP

SEQ ID NO: 179390 - protein, 9 aa, Homo Sapiens
NLCAGPSWK

SEQ ID NO: 179391 - protein, 9 aa, Homo Sapiens
GAEAASVTG

SEQ ID NO: 179392 - protein, 9 aa, Homo Sapiens
CCFDVLYCH

SEQ ID NO: 179393 - protein, 9 aa, Homo Sapiens
KEDVNKKRK

SEQ ID NO: 179394 - protein, 9 aa, Homo Sapiens
ALKKQREHC

SEQ ID NO: 179395 - protein, 9 aa, Homo Sapiens
ANWSNCSDL

SEQ ID NO: 179396 - protein, 9 aa, Homo Sapiens
TVLRMPMHT

SEQ ID NO: 179397 - protein, 9 aa, Homo Sapiens
RLRCIRRTQ

SEQ ID NO: 179398 - protein, 9 aa, Homo Sapiens
TATPTTCTT

SEQ ID NO: 179399 - protein, 9 aa, Homo Sapiens
RALQVMVSV

SEQ ID NO: 179400 - protein, 9 aa, Homo Sapiens
PILAGGNDD

SEQ ID NO: 179401 - protein, 9 aa, Homo Sapiens
EGEHNTEVK

SEQ ID NO: 179402 - protein, 9 aa, Homo Sapiens
DNLPPSSSG

SEQ ID NO: 179403 - protein, 9 aa, Homo Sapiens
LISVNSVSV

SEQ ID NO: 179404 - protein, 9 aa, Homo Sapiens
EGRILARGG

SEQ ID NO: 179405 - protein, 9 aa, Homo Sapiens
ATMGPIDLC

SEQ ID NO: 179406 - protein, 9 aa, Homo Sapiens
LQHGQQALA

SEQ ID NO: 179407 - protein, 9 aa, Homo Sapiens
VVEMWKKNE

SEQ ID NO: 179408 - protein, 9 aa, Homo Sapiens
GLIPLQPNM

SEQ ID NO: 179409 - protein, 9 aa, Homo Sapiens
NRIKKPIYA

SEQ ID NO: 179410 - protein, 9 aa, Homo Sapiens
RSRRAPGET

SEQ ID NO: 179411 - protein, 9 aa, Homo Sapiens
TTGTQSSPA

SEQ ID NO: 179412 - protein, 9 aa, Homo Sapiens
PLDKLTQQL

SEQ ID NO: 179413 - protein, 9 aa, Homo Sapiens
EHTHRVRVG

SEQ ID NO: 179414 - protein, 9 aa, Homo Sapiens
AAVTAVLRV

SEQ ID NO: 179415 - protein, 9 aa, Homo Sapiens
LDPSSWTTF

SEQ ID NO: 179416 - protein, 9 aa, Homo Sapiens
STHRPASAW

SEQ ID NO: 179417 - protein, 9 aa, Homo Sapiens
APMFTQPLQ

SEQ ID NO: 179418 - protein, 9 aa, Homo Sapiens
MDTGVVEGG

SEQ ID NO: 179419 - protein, 9 aa, Homo Sapiens
HSLRNLYFL

SEQ ID NO: 179420 - protein, 9 aa, Homo Sapiens
FITEYIQEK

SEQ ID NO: 179421 - protein, 9 aa, Homo Sapiens
IWSEGVDGT

SEQ ID NO: 179422 - protein, 9 aa, Homo Sapiens
CLSPTIPGP

SEQ ID NO: 179423 - protein, 9 aa, Homo Sapiens
GARPEGGPA

SEQ ID NO: 179424 - protein, 9 aa, Homo Sapiens
GLCVAYDLV

SEQ ID NO: 179425 - protein, 9 aa, Homo Sapiens
GPPTTLGPA

SEQ ID NO: 179426 - protein, 9 aa, Homo Sapiens
PANPQLLCQ

SEQ ID NO: 179427 - protein, 9 aa, Homo Sapiens
RALFYPARI

SEQ ID NO: 179428 - protein, 9 aa, Homo Sapiens
VAKKEDKHL

SEQ ID NO: 179429 - protein, 9 aa, Homo Sapiens
AIRWLWAPA

SEQ ID NO: 179430 - protein, 9 aa, Homo Sapiens
ALHRHAVLL

SEQ ID NO: 179431 - protein, 9 aa, Homo Sapiens
NSSPCPLPL

SEQ ID NO: 179432 - protein, 9 aa, Homo Sapiens
TTPTVPLNP

SEQ ID NO: 179433 - protein, 9 aa, Homo Sapiens
WLTRHRSAV

SEQ ID NO: 179434 - protein, 9 aa, Homo Sapiens
LRLWSWCGT

SEQ ID NO: 179435 - protein, 9 aa, Homo Sapiens
KHRGSGGGV

SEQ ID NO: 179436 - protein, 9 aa, Homo Sapiens
VVALVDIDC

SEQ ID NO: 179437 - protein, 9 aa, Homo Sapiens
FVVGGVPEE

SEQ ID NO: 179438 - protein, 9 aa, Homo Sapiens
GARGILSAS

SEQ ID NO: 179439 - protein, 9 aa, Homo Sapiens
IGVAILQIP

SEQ ID NO: 179440 - protein, 9 aa, Homo Sapiens
VLPIIPSAS

SEQ ID NO: 179441 - protein, 9 aa, Homo Sapiens
PESWSSQTA

SEQ ID NO: 179442 - protein, 9 aa, Homo Sapiens
HAQVASVKG

SEQ ID NO: 179443 - protein, 9 aa, Homo Sapiens
RTPPAPAAV

SEQ ID NO: 179444 - protein, 9 aa, Homo Sapiens
RYYGRTEFI

SEQ ID NO: 179445 - protein, 9 aa, Homo Sapiens
SGARGRTGA

SEQ ID NO: 179446 - protein, 9 aa, Homo Sapiens
FKFTFPTVW

SEQ ID NO: 179447 - protein, 9 aa, Homo Sapiens
PSASFFDIE

SEQ ID NO: 179448 - protein, 9 aa, Homo Sapiens
KLKGANPED

SEQ ID NO: 179449 - protein, 9 aa, Homo Sapiens
EWMTQRVLG

SEQ ID NO: 179450 - protein, 9 aa, Homo Sapiens
SICVMPLGP

SEQ ID NO: 179451 - protein, 9 aa, Homo Sapiens
DNVEIAVGD

SEQ ID NO: 179452 - protein, 9 aa, Homo Sapiens
VVRWCYDKQ

SEQ ID NO: 179453 - protein, 9 aa, Homo Sapiens
KAQQEFAGG

SEQ ID NO: 179454 - protein, 9 aa, Homo Sapiens
EAFGWNIYV

SEQ ID NO: 179455 - protein, 9 aa, Homo Sapiens
TGEFISFQA

SEQ ID NO: 179456 - protein, 9 aa, Homo Sapiens
LLPTQPSFE

SEQ ID NO: 179457 - protein, 9 aa, Homo Sapiens
TEASAVEQM

SEQ ID NO: 179458 - protein, 9 aa, Homo Sapiens
AIQNPQAPE

SEQ ID NO: 179459 - protein, 9 aa, Homo Sapiens
HIKLHTGGK

SEQ ID NO: 179460 - protein, 9 aa, Homo Sapiens
IMLKCRHMR

SEQ ID NO: 179461 - protein, 9 aa, Homo Sapiens
GIFHSSAQL

SEQ ID NO: 179462 - protein, 9 aa, Homo Sapiens
LGPDWLVKV

SEQ ID NO: 179463 - protein, 9 aa, Homo Sapiens
HVEMLYPVQ

SEQ ID NO: 179464 - protein, 9 aa, Homo Sapiens
ALESEMSTQ

SEQ ID NO: 179465 - protein, 9 aa, Homo Sapiens
SAASCASGV

SEQ ID NO: 179466 - protein, 9 aa, Homo Sapiens
FTSAHPSRP

SEQ ID NO: 179467 - protein, 9 aa, Homo Sapiens
VGRKETRPQ

SEQ ID NO: 179468 - protein, 9 aa, Homo Sapiens
FLEPPGARE

SEQ ID NO: 179469 - protein, 9 aa, Homo Sapiens
SKSNPFCVL

SEQ ID NO: 179470 - protein, 9 aa, Homo Sapiens
LTGALLSQW

SEQ ID NO: 179471 - protein, 9 aa, Homo Sapiens
EMLYPVQGQ

SEQ ID NO: 179472 - protein, 9 aa, Homo Sapiens
VQFVQLCQQ

SEQ ID NO: 179473 - protein, 9 aa, Homo Sapiens
KAYAALMDE

SEQ ID NO: 179474 - protein, 9 aa, Homo Sapiens
DEEDDTGMG

SEQ ID NO: 179475 - protein, 9 aa, Homo Sapiens
VSKKDSQNC

SEQ ID NO: 179476 - protein, 9 aa, Homo Sapiens
LLVYIMSTT

SEQ ID NO: 179477 - protein, 9 aa, Homo Sapiens
ALPWARYIT

SEQ ID NO: 179478 - protein, 9 aa, Homo Sapiens
VLLLPTQPS

SEQ ID NO: 179479 - protein, 9 aa, Homo Sapiens
IEAAKTAQF

SEQ ID NO: 179480 - protein, 9 aa, Homo Sapiens
TMSFWKRRN

SEQ ID NO: 179481 - protein, 9 aa, Homo Sapiens
DSNRASLPE

SEQ ID NO: 179482 - protein, 9 aa, Homo Sapiens
KQRRKRLPS

SEQ ID NO: 179483 - protein, 9 aa, Homo Sapiens
TRKQPWSVH

SEQ ID NO: 179484 - protein, 9 aa, Homo Sapiens
QLWAHGISS

SEQ ID NO: 179485 - protein, 9 aa, Homo Sapiens
MNVGSPSAR

SEQ ID NO: 179486 - protein, 9 aa, Homo Sapiens
GMASHLRRS

SEQ ID NO: 179487 - protein, 9 aa, Homo Sapiens
TCVQASDVD

SEQ ID NO: 179488 - protein, 9 aa, Homo Sapiens
TGKGLTLEL

SEQ ID NO: 179489 - protein, 9 aa, Homo Sapiens
RFNKSQQDA

SEQ ID NO: 179490 - protein, 9 aa, Homo Sapiens
VSVLGSSKR

SEQ ID NO: 179491 - protein, 9 aa, Homo Sapiens
CVERYSCYT

SEQ ID NO: 179492 - protein, 9 aa, Homo Sapiens
HAQLLVYEN

SEQ ID NO: 179493 - protein, 9 aa, Homo Sapiens
VAHTLCMMV

SEQ ID NO: 179494 - protein, 9 aa, Homo Sapiens
PHSQILICF

SEQ ID NO: 179495 - protein, 9 aa, Homo Sapiens
KEKEKLWYY

SEQ ID NO: 179496 - protein, 9 aa, Homo Sapiens
LEPVVTGTS

SEQ ID NO: 179497 - protein, 9 aa, Homo Sapiens
LISLSPRKV

SEQ ID NO: 179498 - protein, 9 aa, Homo Sapiens
AASCASGVT

SEQ ID NO: 179499 - protein, 9 aa, Homo Sapiens
SLRFRLPGL

SEQ ID NO: 179500 - protein, 9 aa, Homo Sapiens
VTTGTQSSP

SEQ ID NO: 179501 - protein, 9 aa, Homo Sapiens
NLLYSQNHR

SEQ ID NO: 179502 - protein, 9 aa, Homo Sapiens
VPTVSQPYS

SEQ ID NO: 179503 - protein, 9 aa, Homo Sapiens
PVVHEGVEM

SEQ ID NO: 179504 - protein, 9 aa, Homo Sapiens
ERTLTSVPG

SEQ ID NO: 179505 - protein, 9 aa, Homo Sapiens
DSQNCEDAQ

SEQ ID NO: 179506 - protein, 9 aa, Homo Sapiens
FLTAEEKIS

SEQ ID NO: 179507 - protein, 9 aa, Homo Sapiens
DRSPQAPLR

SEQ ID NO: 179508 - protein, 9 aa, Homo Sapiens
GAEAPWGRV

SEQ ID NO: 179509 - protein, 9 aa, Homo Sapiens
HPSTAQSHQ

SEQ ID NO: 179510 - protein, 9 aa, Homo Sapiens
WVQQAGSVG

SEQ ID NO: 179511 - protein, 9 aa, Homo Sapiens
FIGDHMKNG

SEQ ID NO: 179512 - protein, 9 aa, Homo Sapiens
PVPLLNVPQ

SEQ ID NO: 179513 - protein, 9 aa, Homo Sapiens
GVDRWNALA

SEQ ID NO: 179514 - protein, 9 aa, Homo Sapiens
SADIIQRTT

SEQ ID NO: 179515 - protein, 9 aa, Homo Sapiens
VTYFPSFQG

SEQ ID NO: 179516 - protein, 9 aa, Homo Sapiens
HQPDPDHPW

SEQ ID NO: 179517 - protein, 9 aa, Homo Sapiens
ILLLLCQLR

SEQ ID NO: 179518 - protein, 9 aa, Homo Sapiens
NSFQENVLP

SEQ ID NO: 179519 - protein, 9 aa, Homo Sapiens
PKGVSVDCN

SEQ ID NO: 179520 - protein, 9 aa, Homo Sapiens
RGHAAVGAV

SEQ ID NO: 179521 - protein, 9 aa, Homo Sapiens
QWAQLLLQL

SEQ ID NO: 179522 - protein, 9 aa, Homo Sapiens
KVLEDGGFF

SEQ ID NO: 179523 - protein, 9 aa, Homo Sapiens
NYFEPYLGC

SEQ ID NO: 179524 - protein, 9 aa, Homo Sapiens
GPDAQLEEK

SEQ ID NO: 179525 - protein, 9 aa, Homo Sapiens
LHVFPWGLL

SEQ ID NO: 179526 - protein, 9 aa, Homo Sapiens
EVVALCLSA

SEQ ID NO: 179527 - protein, 9 aa, Homo Sapiens
PSKEPSSPA

SEQ ID NO: 179528 - protein, 9 aa, Homo Sapiens
TEVKTHCGF

SEQ ID NO: 179529 - protein, 9 aa, Homo Sapiens
VQQAGSVGA

SEQ ID NO: 179530 - protein, 9 aa, Homo Sapiens
AVVIDVGIN

SEQ ID NO: 179531 - protein, 9 aa, Homo Sapiens
QRAHQVTHT

SEQ ID NO: 179532 - protein, 9 aa, Homo Sapiens
VADRRLSAR

SEQ ID NO: 179533 - protein, 9 aa, Homo Sapiens
NNHERYLEG

SEQ ID NO: 179534 - protein, 9 aa, Homo Sapiens
GQKMTSSDK

SEQ ID NO: 179535 - protein, 9 aa, Homo Sapiens
LLRSGFRQL

SEQ ID NO: 179536 - protein, 9 aa, Homo Sapiens
TWFLSPTLG

SEQ ID NO: 179537 - protein, 9 aa, Homo Sapiens
DSGKQFPNH

SEQ ID NO: 179538 - protein, 9 aa, Homo Sapiens
MCAKKMDWT

SEQ ID NO: 179539 - protein, 9 aa, Homo Sapiens
GGLDDRSPQ

SEQ ID NO: 179540 - protein, 9 aa, Homo Sapiens
QEEKWRRGD

SEQ ID NO: 179541 - protein, 9 aa, Homo Sapiens
QDDTDSNRA

SEQ ID NO: 179542 - protein, 9 aa, Homo Sapiens
AHVPVGHLP

SEQ ID NO: 179543 - protein, 9 aa, Homo Sapiens
TLYTMLIKC

SEQ ID NO: 179544 - protein, 9 aa, Homo Sapiens
KQFEERSAE

SEQ ID NO: 179545 - protein, 9 aa, Homo Sapiens
IEKNAGCLH

SEQ ID NO: 179546 - protein, 9 aa, Homo Sapiens
CRGASDSLS

SEQ ID NO: 179547 - protein, 9 aa, Homo Sapiens
GDAGPRTNG

SEQ ID NO: 179548 - protein, 9 aa, Homo Sapiens
STHSLEPPY

SEQ ID NO: 179549 - protein, 9 aa, Homo Sapiens
FLLIQFWDW

SEQ ID NO: 179550 - protein, 9 aa, Homo Sapiens
AIAVVMDVF

SEQ ID NO: 179551 - protein, 9 aa, Homo Sapiens
KDDLMLFQR

SEQ ID NO: 179552 - protein, 9 aa, Homo Sapiens
HFLLGDAAV

SEQ ID NO: 179553 - protein, 9 aa, Homo Sapiens
QRIHTGKNP

SEQ ID NO: 179554 - protein, 9 aa, Homo Sapiens
KATKKTKIQ

SEQ ID NO: 179555 - protein, 9 aa, Homo Sapiens
QDALEAVFR

SEQ ID NO: 179556 - protein, 9 aa, Homo Sapiens
QVIPELLGH

SEQ ID NO: 179557 - protein, 9 aa, Homo Sapiens
DGNNMGWSV

SEQ ID NO: 179558 - protein, 9 aa, Homo Sapiens
VKSASIIYQ

SEQ ID NO: 179559 - protein, 9 aa, Homo Sapiens
QCCAVMCCN

SEQ ID NO: 179560 - protein, 9 aa, Homo Sapiens
KALTEDIMS

SEQ ID NO: 179561 - protein, 9 aa, Homo Sapiens
SVSQTSPNP

SEQ ID NO: 179562 - protein, 9 aa, Homo Sapiens
LTWFLSPTL

SEQ ID NO: 179563 - protein, 9 aa, Homo Sapiens
EREEKIDRC

SEQ ID NO: 179564 - protein, 9 aa, Homo Sapiens
STLGSSPST

SEQ ID NO: 179565 - protein, 9 aa, Homo Sapiens
KMSLLLSHQ

SEQ ID NO: 179566 - protein, 9 aa, Homo Sapiens
ELGVNLLEV

SEQ ID NO: 179567 - protein, 9 aa, Homo Sapiens
MEKMKVEGL

SEQ ID NO: 179568 - protein, 9 aa, Homo Sapiens
LWSLLLLWA

SEQ ID NO: 179569 - protein, 9 aa, Homo Sapiens
QTHPREAIQ

SEQ ID NO: 179570 - protein, 9 aa, Homo Sapiens
DGYGTQREC

SEQ ID NO: 179571 - protein, 9 aa, Homo Sapiens
EMLLRQHEA

SEQ ID NO: 179572 - protein, 9 aa, Homo Sapiens
DITTCKSPS

SEQ ID NO: 179573 - protein, 9 aa, Homo Sapiens
KKAVELSPE

SEQ ID NO: 179574 - protein, 9 aa, Homo Sapiens
LRQLQSAGL

SEQ ID NO: 179575 - protein, 9 aa, Homo Sapiens
KLLNHGKKP

SEQ ID NO: 179576 - protein, 9 aa, Homo Sapiens
SSTLYWKAW

SEQ ID NO: 179577 - protein, 9 aa, Homo Sapiens
VGSPSARRQ

SEQ ID NO: 179578 - protein, 9 aa, Homo Sapiens
PLDHVLAKV

SEQ ID NO: 179579 - protein, 9 aa, Homo Sapiens
SVVSQTSLS

SEQ ID NO: 179580 - protein, 9 aa, Homo Sapiens
GQRYYGRTE

SEQ ID NO: 179581 - protein, 9 aa, Homo Sapiens
VDVGNPALG

SEQ ID NO: 179582 - protein, 9 aa, Homo Sapiens
NLCNDQCNQ

SEQ ID NO: 179583 - protein, 9 aa, Homo Sapiens
LHLGLHLLQ

SEQ ID NO: 179584 - protein, 9 aa, Homo Sapiens
LVKVTDLVS

SEQ ID NO: 179585 - protein, 9 aa, Homo Sapiens
KRKTANYER

SEQ ID NO: 179586 - protein, 9 aa, Homo Sapiens
DGHFVPVLG

SEQ ID NO: 179587 - protein, 9 aa, Homo Sapiens
SMKMNAKKA

SEQ ID NO: 179588 - protein, 9 aa, Homo Sapiens
PRPGPCPPP

SEQ ID NO: 179589 - protein, 9 aa, Homo Sapiens
QFHCPLCEK

SEQ ID NO: 179590 - protein, 9 aa, Homo Sapiens
AFKLCINKT

SEQ ID NO: 179591 - protein, 9 aa, Homo Sapiens
CRMCSQGDE

SEQ ID NO: 179592 - protein, 9 aa, Homo Sapiens
REKSPPPPL

SEQ ID NO: 179593 - protein, 9 aa, Homo Sapiens
PETALVSMS

SEQ ID NO: 179594 - protein, 9 aa, Homo Sapiens
TPPTTGLPA

SEQ ID NO: 179595 - protein, 9 aa, Homo Sapiens
KFMEDLKES

SEQ ID NO: 179596 - protein, 9 aa, Homo Sapiens
LKVLSFTHH

SEQ ID NO: 179597 - protein, 9 aa, Homo Sapiens
YKNRLLLTW

SEQ ID NO: 179598 - protein, 9 aa, Homo Sapiens
ANDNLKVSF

SEQ ID NO: 179599 - protein, 9 aa, Homo Sapiens
DHKSKPFRR

SEQ ID NO: 179600 - protein, 9 aa, Homo Sapiens
TNKATKQRH

SEQ ID NO: 179601 - protein, 9 aa, Homo Sapiens
KEEEHTPLD

SEQ ID NO: 179602 - protein, 9 aa, Homo Sapiens
VHEGVEMRA

SEQ ID NO: 179603 - protein, 9 aa, Homo Sapiens
ELGGGWICW

SEQ ID NO: 179604 - protein, 9 aa, Homo Sapiens
TSRRLKRFR

SEQ ID NO: 179605 - protein, 9 aa, Homo Sapiens
KHKLESPAL

SEQ ID NO: 179606 - protein, 9 aa, Homo Sapiens
PWQSPWGEH

SEQ ID NO: 179607 - protein, 9 aa, Homo Sapiens
LLCHAQLLV

SEQ ID NO: 179608 - protein, 9 aa, Homo Sapiens
RGQYGPQGG

SEQ ID NO: 179609 - protein, 9 aa, Homo Sapiens
QCPFFYNRP

SEQ ID NO: 179610 - protein, 9 aa, Homo Sapiens
KWRRGDPGP

SEQ ID NO: 179611 - protein, 9 aa, Homo Sapiens
HLRSFLLLL

SEQ ID NO: 179612 - protein, 9 aa, Homo Sapiens
GHRSDYSLS

SEQ ID NO: 179613 - protein, 9 aa, Homo Sapiens
VRRGFNWGL

SEQ ID NO: 179614 - protein, 9 aa, Homo Sapiens
HNTEVKEQT

SEQ ID NO: 179615 - protein, 9 aa, Homo Sapiens
PSDMTKKTF

SEQ ID NO: 179616 - protein, 9 aa, Homo Sapiens
TNHSPPTTR

SEQ ID NO: 179617 - protein, 9 aa, Homo Sapiens
VELAHQGVW

SEQ ID NO: 179618 - protein, 9 aa, Homo Sapiens
LPAEEEKWL

SEQ ID NO: 179619 - protein, 9 aa, Homo Sapiens
LLLCHAQLL

SEQ ID NO: 179620 - protein, 9 aa, Homo Sapiens
QFLDCAHQV

SEQ ID NO: 179621 - protein, 9 aa, Homo Sapiens
SLQCQSLAL

SEQ ID NO: 179622 - protein, 9 aa, Homo Sapiens
LSLVLCATL

SEQ ID NO: 179623 - protein, 9 aa, Homo Sapiens
LHNLAELPR

SEQ ID NO: 179624 - protein, 9 aa, Homo Sapiens
NWLKNAFVK

SEQ ID NO: 179625 - protein, 9 aa, Homo Sapiens
LKVAPGRVM

SEQ ID NO: 179626 - protein, 9 aa, Homo Sapiens
QLLQTLRPV

SEQ ID NO: 179627 - protein, 9 aa, Homo Sapiens
KREHGDPSR

SEQ ID NO: 179628 - protein, 9 aa, Homo Sapiens
LLHRVLQGK

SEQ ID NO: 179629 - protein, 9 aa, Homo Sapiens
PVQDLQLLA

SEQ ID NO: 179630 - protein, 9 aa, Homo Sapiens
AEVSQRALL

SEQ ID NO: 179631 - protein, 9 aa, Homo Sapiens
APGETSPTA

SEQ ID NO: 179632 - protein, 9 aa, Homo Sapiens
WRAAGVRYP

SEQ ID NO: 179633 - protein, 9 aa, Homo Sapiens
QRMLAMELR

SEQ ID NO: 179634 - protein, 9 aa, Homo Sapiens
AHSARQQPC

SEQ ID NO: 179635 - protein, 9 aa, Homo Sapiens
EVDPDEVLF

SEQ ID NO: 179636 - protein, 9 aa, Homo Sapiens
NPQLLCQNP

SEQ ID NO: 179637 - protein, 9 aa, Homo Sapiens
FMEDLKESI

SEQ ID NO: 179638 - protein, 9 aa, Homo Sapiens
SGLMVIELQ

SEQ ID NO: 179639 - protein, 9 aa, Homo Sapiens
PPTTRRSPL

SEQ ID NO: 179640 - protein, 9 aa, Homo Sapiens
PWPKIPLDP

SEQ ID NO: 179641 - protein, 9 aa, Homo Sapiens
FTYQHLSNP

SEQ ID NO: 179642 - protein, 9 aa, Homo Sapiens
HIDVWWIMH

SEQ ID NO: 179643 - protein, 9 aa, Homo Sapiens
AKALTEDIM

SEQ ID NO: 179644 - protein, 9 aa, Homo Sapiens
MPTVAMPPR

SEQ ID NO: 179645 - protein, 9 aa, Homo Sapiens
LALYGGLSA

SEQ ID NO: 179646 - protein, 9 aa, Homo Sapiens
QMYGKHTPW

SEQ ID NO: 179647 - protein, 9 aa, Homo Sapiens
LTRCTTNMV

SEQ ID NO: 179648 - protein, 9 aa, Homo Sapiens
RVCIYGKEI

SEQ ID NO: 179649 - protein, 9 aa, Homo Sapiens
EREGSRAFY

SEQ ID NO: 179650 - protein, 9 aa, Homo Sapiens
QGVTTERLL

SEQ ID NO: 179651 - protein, 9 aa, Homo Sapiens
PRICPSLSP

SEQ ID NO: 179652 - protein, 9 aa, Homo Sapiens
SQALRDTMA

SEQ ID NO: 179653 - protein, 9 aa, Homo Sapiens
VCGFSTRSS

SEQ ID NO: 179654 - protein, 9 aa, Homo Sapiens
RKRKCVLKS

SEQ ID NO: 179655 - protein, 9 aa, Homo Sapiens
KLGATSAQN

SEQ ID NO: 179656 - protein, 9 aa, Homo Sapiens
PKKDLEDGK

SEQ ID NO: 179657 - protein, 9 aa, Homo Sapiens
AAGAEAPWG

SEQ ID NO: 179658 - protein, 9 aa, Homo Sapiens
TTRTSLRSC

SEQ ID NO: 179659 - protein, 9 aa, Homo Sapiens
ILLQRNLLR

SEQ ID NO: 179660 - protein, 9 aa, Homo Sapiens
RLPRAGGHR

SEQ ID NO: 179661 - protein, 9 aa, Homo Sapiens
VKKAAEYLK

SEQ ID NO: 179662 - protein, 9 aa, Homo Sapiens
LLLLLARAS

SEQ ID NO: 179663 - protein, 9 aa, Homo Sapiens
LCQNPEKLA

SEQ ID NO: 179664 - protein, 9 aa, Homo Sapiens
IDVLQGQVA

SEQ ID NO: 179665 - protein, 9 aa, Homo Sapiens
PLLHNLAEL

SEQ ID NO: 179666 - protein, 9 aa, Homo Sapiens
CGDMIVVVN

SEQ ID NO: 179667 - protein, 9 aa, Homo Sapiens
QHLSNPLEM

SEQ ID NO: 179668 - protein, 9 aa, Homo Sapiens
PNLASSTLY

SEQ ID NO: 179669 - protein, 9 aa, Homo Sapiens
PRPTSPSPW

SEQ ID NO: 179670 - protein, 9 aa, Homo Sapiens
IDTKRYSTV

SEQ ID NO: 179671 - protein, 9 aa, Homo Sapiens
GRCVRRSRF

SEQ ID NO: 179672 - protein, 9 aa, Homo Sapiens
KWSHLATET

SEQ ID NO: 179673 - protein, 9 aa, Homo Sapiens
SSPSTPPTT

SEQ ID NO: 179674 - protein, 9 aa, Homo Sapiens
KAPPERRHS

SEQ ID NO: 179675 - protein, 9 aa, Homo Sapiens
KYGCTNGRQ

SEQ ID NO: 179676 - protein, 9 aa, Homo Sapiens
ELSPENTEL

SEQ ID NO: 179677 - protein, 9 aa, Homo Sapiens
GPESRALGP

SEQ ID NO: 179678 - protein, 9 aa, Homo Sapiens
GNIQPNSAP

SEQ ID NO: 179679 - protein, 9 aa, Homo Sapiens
KENNLCNDQ

SEQ ID NO: 179680 - protein, 9 aa, Homo Sapiens
LTVQSQACP

SEQ ID NO: 179681 - protein, 9 aa, Homo Sapiens
PESHHDQQR

SEQ ID NO: 179682 - protein, 9 aa, Homo Sapiens
RGLGTPAPT

SEQ ID NO: 179683 - protein, 9 aa, Homo Sapiens
LRRRASLEK

SEQ ID NO: 179684 - protein, 9 aa, Homo Sapiens
VGPPPCLSP

SEQ ID NO: 179685 - protein, 9 aa, Homo Sapiens
QHLLTLLET

SEQ ID NO: 179686 - protein, 9 aa, Homo Sapiens
SLLQSAKKR

SEQ ID NO: 179687 - protein, 9 aa, Homo Sapiens
CGIRTSLLV

SEQ ID NO: 179688 - protein, 9 aa, Homo Sapiens
DLMFGEGMT

SEQ ID NO: 179689 - protein, 9 aa, Homo Sapiens
DWHGIQEIT

SEQ ID NO: 179690 - protein, 9 aa, Homo Sapiens
LNSMKHLFG

SEQ ID NO: 179691 - protein, 9 aa, Homo Sapiens
LGLLNEDDE

SEQ ID NO: 179692 - protein, 9 aa, Homo Sapiens
SQNLLLRSG

SEQ ID NO: 179693 - protein, 9 aa, Homo Sapiens
AASPCHPVW

SEQ ID NO: 179694 - protein, 9 aa, Homo Sapiens
HHYPQRSVV

SEQ ID NO: 179695 - protein, 9 aa, Homo Sapiens
ENNLCNDQC

SEQ ID NO: 179696 - protein, 9 aa, Homo Sapiens
KERAWRLEA

SEQ ID NO: 179697 - protein, 9 aa, Homo Sapiens
TRPQLDYEV

SEQ ID NO: 179698 - protein, 9 aa, Homo Sapiens
MSSGRWWWS

SEQ ID NO: 179699 - protein, 9 aa, Homo Sapiens
TASEQPPSM

SEQ ID NO: 179700 - protein, 9 aa, Homo Sapiens
AVRGTSPSQ

SEQ ID NO: 179701 - protein, 9 aa, Homo Sapiens
TGGKMCWFR

SEQ ID NO: 179702 - protein, 9 aa, Homo Sapiens
IGKRLATTW

SEQ ID NO: 179703 - protein, 9 aa, Homo Sapiens
RLTDMNYSE

SEQ ID NO: 179704 - protein, 9 aa, Homo Sapiens
LGFGGPDAQ

SEQ ID NO: 179705 - protein, 9 aa, Homo Sapiens
PTLTSSWKK

SEQ ID NO: 179706 - protein, 9 aa, Homo Sapiens
LNKGAPARM

SEQ ID NO: 179707 - protein, 9 aa, Homo Sapiens
SIFIACWAP

SEQ ID NO: 179708 - protein, 9 aa, Homo Sapiens
RGDPGPPFP

SEQ ID NO: 179709 - protein, 9 aa, Homo Sapiens
DRVGQTIEH

SEQ ID NO: 179710 - protein, 9 aa, Homo Sapiens
AYTTAWSPG

SEQ ID NO: 179711 - protein, 9 aa, Homo Sapiens
LDNSVYMWS

SEQ ID NO: 179712 - protein, 9 aa, Homo Sapiens
GQFKFIVHA

SEQ ID NO: 179713 - protein, 9 aa, Homo Sapiens
TTGVGRTRA

SEQ ID NO: 179714 - protein, 9 aa, Homo Sapiens
VPAGLLALV

SEQ ID NO: 179715 - protein, 9 aa, Homo Sapiens
GQAHAVKTV

SEQ ID NO: 179716 - protein, 9 aa, Homo Sapiens
TGALLSQWD

SEQ ID NO: 179717 - protein, 9 aa, Homo Sapiens
ELLVNMGGT

SEQ ID NO: 179718 - protein, 9 aa, Homo Sapiens
PPQAAAAAI

SEQ ID NO: 179719 - protein, 9 aa, Homo Sapiens
AVFPLGPHE

SEQ ID NO: 179720 - protein, 9 aa, Homo Sapiens
RGAAGRQRA

SEQ ID NO: 179721 - protein, 9 aa, Homo Sapiens
DRSETPQLF

SEQ ID NO: 179722 - protein, 9 aa, Homo Sapiens
TYEEALKKQ

SEQ ID NO: 179723 - protein, 9 aa, Homo Sapiens
HTGKNPIFV

SEQ ID NO: 179724 - protein, 9 aa, Homo Sapiens
GVSVDCNGH

SEQ ID NO: 179725 - protein, 9 aa, Homo Sapiens
ASSLRSQHR

SEQ ID NO: 179726 - protein, 9 aa, Homo Sapiens
LESLKARGQ

SEQ ID NO: 179727 - protein, 9 aa, Homo Sapiens
SCPPSRAAS

SEQ ID NO: 179728 - protein, 9 aa, Homo Sapiens
MQNAAKEHH

SEQ ID NO: 179729 - protein, 9 aa, Homo Sapiens
SGGGKKPKM

SEQ ID NO: 179730 - protein, 9 aa, Homo Sapiens
PDPYPKDDN

SEQ ID NO: 179731 - protein, 9 aa, Homo Sapiens
QTDAWLQPE

SEQ ID NO: 179732 - protein, 9 aa, Homo Sapiens
WSLLLLWAW

SEQ ID NO: 179733 - protein, 9 aa, Homo Sapiens
KAMTKKRVN

SEQ ID NO: 179734 - protein, 9 aa, Homo Sapiens
MWKKNEEFK

SEQ ID NO: 179735 - protein, 9 aa, Homo Sapiens
PRWVQVPKG

SEQ ID NO: 179736 - protein, 9 aa, Homo Sapiens
RMQNAAKEH

SEQ ID NO: 179737 - protein, 9 aa, Homo Sapiens
VEYHTTTGT

SEQ ID NO: 179738 - protein, 9 aa, Homo Sapiens
QLQLEDWVL

SEQ ID NO: 179739 - protein, 9 aa, Homo Sapiens
LSSTHPVNT

SEQ ID NO: 179740 - protein, 9 aa, Homo Sapiens
QCRSQQIKT

SEQ ID NO: 179741 - protein, 9 aa, Homo Sapiens
PPPTSGTTR

SEQ ID NO: 179742 - protein, 9 aa, Homo Sapiens
HTTTKSMAA

SEQ ID NO: 179743 - protein, 9 aa, Homo Sapiens
GPSCSRGSQ

SEQ ID NO: 179744 - protein, 9 aa, Homo Sapiens
MRLEAVHAD

SEQ ID NO: 179745 - protein, 9 aa, Homo Sapiens
QATELGAAG

SEQ ID NO: 179746 - protein, 9 aa, Homo Sapiens
QHEGPPRLL

SEQ ID NO: 179747 - protein, 9 aa, Homo Sapiens
EMAHPNEEG

SEQ ID NO: 179748 - protein, 9 aa, Homo Sapiens
CKKNVFNPK

SEQ ID NO: 179749 - protein, 9 aa, Homo Sapiens
VSRAAARWR

SEQ ID NO: 179750 - protein, 9 aa, Homo Sapiens
LKHVVTEYQ

SEQ ID NO: 179751 - protein, 9 aa, Homo Sapiens
VDLCFFGMR

SEQ ID NO: 179752 - protein, 9 aa, Homo Sapiens
GGFTEAPKF

SEQ ID NO: 179753 - protein, 9 aa, Homo Sapiens
LSRARVEQA

SEQ ID NO: 179754 - protein, 9 aa, Homo Sapiens
ATTPRPGRL

SEQ ID NO: 179755 - protein, 9 aa, Homo Sapiens
KLPVPLLNV

SEQ ID NO: 179756 - protein, 9 aa, Homo Sapiens
HHDQQRDPI

SEQ ID NO: 179757 - protein, 9 aa, Homo Sapiens
KDCDYIDFL

SEQ ID NO: 179758 - protein, 9 aa, Homo Sapiens
SCTLSAEEG

SEQ ID NO: 179759 - protein, 9 aa, Homo Sapiens
CKEVKEKAQ

SEQ ID NO: 179760 - protein, 9 aa, Homo Sapiens
GTPPPLILW

SEQ ID NO: 179761 - protein, 9 aa, Homo Sapiens
FQAERLLLQ

SEQ ID NO: 179762 - protein, 9 aa, Homo Sapiens
DALPHIDGR

SEQ ID NO: 179763 - protein, 9 aa, Homo Sapiens
PWGRVLFEE

SEQ ID NO: 179764 - protein, 9 aa, Homo Sapiens
LVPNSSPCP

SEQ ID NO: 179765 - protein, 9 aa, Homo Sapiens
WRIGSASSL

SEQ ID NO: 179766 - protein, 9 aa, Homo Sapiens
GAAATFAYL

SEQ ID NO: 179767 - protein, 9 aa, Homo Sapiens
ENQIAVSSL

SEQ ID NO: 179768 - protein, 9 aa, Homo Sapiens
GLGLLAERA

SEQ ID NO: 179769 - protein, 9 aa, Homo Sapiens
WITPDPYPK

SEQ ID NO: 179770 - protein, 9 aa, Homo Sapiens
SSWTTFGVG

SEQ ID NO: 179771 - protein, 9 aa, Homo Sapiens
RFLRRAGQA

SEQ ID NO: 179772 - protein, 9 aa, Homo Sapiens
DPDHPWHQP

SEQ ID NO: 179773 - protein, 9 aa, Homo Sapiens
GASMTVTTA

SEQ ID NO: 179774 - protein, 9 aa, Homo Sapiens
TLTTQTLPS

SEQ ID NO: 179775 - protein, 9 aa, Homo Sapiens
RTKNDCDNL

SEQ ID NO: 179776 - protein, 9 aa, Homo Sapiens
HMGARAVAH

SEQ ID NO: 179777 - protein, 9 aa, Homo Sapiens
RMRQLQSSH

SEQ ID NO: 179778 - protein, 9 aa, Homo Sapiens
GPIKPVIYS

SEQ ID NO: 179779 - protein, 9 aa, Homo Sapiens
LCARQPRLR

SEQ ID NO: 179780 - protein, 9 aa, Homo Sapiens
RVLGSHLGR

SEQ ID NO: 179781 - protein, 9 aa, Homo Sapiens
PPMDDVHRT

SEQ ID NO: 179782 - protein, 9 aa, Homo Sapiens
VDDIIMENS

SEQ ID NO: 179783 - protein, 9 aa, Homo Sapiens
SFDMGGEPL

SEQ ID NO: 179784 - protein, 9 aa, Homo Sapiens
YERQPREPT

SEQ ID NO: 179785 - protein, 9 aa, Homo Sapiens
SVLNIHMAK

SEQ ID NO: 179786 - protein, 9 aa, Homo Sapiens
LAHQPVPCI

SEQ ID NO: 179787 - protein, 9 aa, Homo Sapiens
PTPASTLAR

SEQ ID NO: 179788 - protein, 9 aa, Homo Sapiens
EKLALKEDL

SEQ ID NO: 179789 - protein, 9 aa, Homo Sapiens
FLHHTCIQP

SEQ ID NO: 179790 - protein, 9 aa, Homo Sapiens
LLEKVSKKD

SEQ ID NO: 179791 - protein, 9 aa, Homo Sapiens
FICAHPLGN

SEQ ID NO: 179792 - protein, 9 aa, Homo Sapiens
DWVLCLHSR

SEQ ID NO: 179793 - protein, 9 aa, Homo Sapiens
GIGEVVALC

SEQ ID NO: 179794 - protein, 9 aa, Homo Sapiens
VQVGLHLGL

SEQ ID NO: 179795 - protein, 9 aa, Homo Sapiens
LPFLLSLRN

SEQ ID NO: 179796 - protein, 9 aa, Homo Sapiens
AGSSALGPL

SEQ ID NO: 179797 - protein, 9 aa, Homo Sapiens
AVWVQQAGS

SEQ ID NO: 179798 - protein, 9 aa, Homo Sapiens
FLQFLDCAH

SEQ ID NO: 179799 - protein, 9 aa, Homo Sapiens
PRTVQGGVL

SEQ ID NO: 179800 - protein, 9 aa, Homo Sapiens
RGLGLLAER

SEQ ID NO: 179801 - protein, 9 aa, Homo Sapiens
KLMHICTDQ

SEQ ID NO: 179802 - protein, 9 aa, Homo Sapiens
RLDSIIGPQ

SEQ ID NO: 179803 - protein, 9 aa, Homo Sapiens
EQIPGLLGS

SEQ ID NO: 179804 - protein, 9 aa, Homo Sapiens
MLAMELRSP

SEQ ID NO: 179805 - protein, 9 aa, Homo Sapiens
ENVETEKKT

SEQ ID NO: 179806 - protein, 9 aa, Homo Sapiens
GSMVRRAAN

SEQ ID NO: 179807 - protein, 9 aa, Homo Sapiens
EPSQPQCAV

SEQ ID NO: 179808 - protein, 9 aa, Homo Sapiens
INPAMTVAC

SEQ ID NO: 179809 - protein, 9 aa, Homo Sapiens
RKASAASCA

SEQ ID NO: 179810 - protein, 9 aa, Homo Sapiens
ANPEDVITG

SEQ ID NO: 179811 - protein, 9 aa, Homo Sapiens
PAKTRVSSL

SEQ ID NO: 179812 - protein, 9 aa, Homo Sapiens
VPCVLFVLK

SEQ ID NO: 179813 - protein, 9 aa, Homo Sapiens
ASLMFFGNQ

SEQ ID NO: 179814 - protein, 9 aa, Homo Sapiens
EDDECHASF

SEQ ID NO: 179815 - protein, 9 aa, Homo Sapiens
QRNLLRLQS

SEQ ID NO: 179816 - protein, 9 aa, Homo Sapiens
LGPHEEVLS

SEQ ID NO: 179817 - protein, 9 aa, Homo Sapiens
HQMKCLTAV

SEQ ID NO: 179818 - protein, 9 aa, Homo Sapiens
MPLIYVGVR

SEQ ID NO: 179819 - protein, 9 aa, Homo Sapiens
LGQSGAAVL

SEQ ID NO: 179820 - protein, 9 aa, Homo Sapiens
LKCGDMIVV

SEQ ID NO: 179821 - protein, 9 aa, Homo Sapiens
SLASSSSSP

SEQ ID NO: 179822 - protein, 9 aa, Homo Sapiens
HLVTYFPSF

SEQ ID NO: 179823 - protein, 9 aa, Homo Sapiens
PGAPPSRLS

SEQ ID NO: 179824 - protein, 9 aa, Homo Sapiens
CLPWRGCPL

SEQ ID NO: 179825 - protein, 9 aa, Homo Sapiens
ERVRVSTRA

SEQ ID NO: 179826 - protein, 9 aa, Homo Sapiens
PRVRCARRG

SEQ ID NO: 179827 - protein, 9 aa, Homo Sapiens
IVDIWILLQ

SEQ ID NO: 179828 - protein, 9 aa, Homo Sapiens
LIDHRWVLI

SEQ ID NO: 179829 - protein, 9 aa, Homo Sapiens
ALVNKSLLS

SEQ ID NO: 179830 - protein, 9 aa, Homo Sapiens
EKQQYLDEA

SEQ ID NO: 179831 - protein, 9 aa, Homo Sapiens
YIITEYMSK

SEQ ID NO: 179832 - protein, 9 aa, Homo Sapiens
GSAYLTIQV

SEQ ID NO: 179833 - protein, 9 aa, Homo Sapiens
YEIGASSAQ

SEQ ID NO: 179834 - protein, 9 aa, Homo Sapiens
DQWRIGSAS

SEQ ID NO: 179835 - protein, 9 aa, Homo Sapiens
KNCLVKNLD

SEQ ID NO: 179836 - protein, 9 aa, Homo Sapiens
RNLSEPQAI

SEQ ID NO: 179837 - protein, 9 aa, Homo Sapiens
GVQQVSECA

SEQ ID NO: 179838 - protein, 9 aa, Homo Sapiens
HADKWDKTT

SEQ ID NO: 179839 - protein, 9 aa, Homo Sapiens
LWRGGKRRG

SEQ ID NO: 179840 - protein, 9 aa, Homo Sapiens
LFHIGNSGK

SEQ ID NO: 179841 - protein, 9 aa, Homo Sapiens
EVGVWSIGC

SEQ ID NO: 179842 - protein, 9 aa, Homo Sapiens
HQQLGDYRK

SEQ ID NO: 179843 - protein, 9 aa, Homo Sapiens
AHHRRQLRW

SEQ ID NO: 179844 - protein, 9 aa, Homo Sapiens
DQSIDFKID

SEQ ID NO: 179845 - protein, 9 aa, Homo Sapiens
IYSSPKNHG

SEQ ID NO: 179846 - protein, 9 aa, Homo Sapiens
QSGSPASGS

SEQ ID NO: 179847 - protein, 9 aa, Homo Sapiens
EVTTRLLHS

SEQ ID NO: 179848 - protein, 9 aa, Homo Sapiens
TMLIKCVNK

SEQ ID NO: 179849 - protein, 9 aa, Homo Sapiens
SLPRHRRLA

SEQ ID NO: 179850 - protein, 9 aa, Homo Sapiens
ITDEIYQWM

SEQ ID NO: 179851 - protein, 9 aa, Homo Sapiens
GLPTNKIDA

SEQ ID NO: 179852 - protein, 9 aa, Homo Sapiens
LYEIGASSA

SEQ ID NO: 179853 - protein, 9 aa, Homo Sapiens
LFWKDCHLA

SEQ ID NO: 179854 - protein, 9 aa, Homo Sapiens
NHRRLLSLV

SEQ ID NO: 179855 - protein, 9 aa, Homo Sapiens
LEKATHKCI

SEQ ID NO: 179856 - protein, 9 aa, Homo Sapiens
PVRLLLGVC

SEQ ID NO: 179857 - protein, 9 aa, Homo Sapiens
IYTYRILPN

SEQ ID NO: 179858 - protein, 9 aa, Homo Sapiens
HHPRAERGQ

SEQ ID NO: 179859 - protein, 9 aa, Homo Sapiens
QIKTSHSLS

SEQ ID NO: 179860 - protein, 9 aa, Homo Sapiens
AQHEGLIRL

SEQ ID NO: 179861 - protein, 9 aa, Homo Sapiens
ATWAAAATA

SEQ ID NO: 179862 - protein, 9 aa, Homo Sapiens
VQVPKGVIY

SEQ ID NO: 179863 - protein, 9 aa, Homo Sapiens
GKEIDTKRY

SEQ ID NO: 179864 - protein, 9 aa, Homo Sapiens
QKAQQEFAG

SEQ ID NO: 179865 - protein, 9 aa, Homo Sapiens
TVLMKLLRI

SEQ ID NO: 179866 - protein, 9 aa, Homo Sapiens
ENKRKRKCV

SEQ ID NO: 179867 - protein, 9 aa, Homo Sapiens
EEERRLHQA

SEQ ID NO: 179868 - protein, 9 aa, Homo Sapiens
SRRPRAATP

SEQ ID NO: 179869 - protein, 9 aa, Homo Sapiens
CVRRSRFRN

SEQ ID NO: 179870 - protein, 9 aa, Homo Sapiens
KKEDKHLSR

SEQ ID NO: 179871 - protein, 9 aa, Homo Sapiens
VLSILVCCL

SEQ ID NO: 179872 - protein, 9 aa, Homo Sapiens
TCKSPSNTK

SEQ ID NO: 179873 - protein, 9 aa, Homo Sapiens
ARWRRRAIA

SEQ ID NO: 179874 - protein, 9 aa, Homo Sapiens
SSWTSRSVV

SEQ ID NO: 179875 - protein, 9 aa, Homo Sapiens
RPTSPSPWA

SEQ ID NO: 179876 - protein, 9 aa, Homo Sapiens
MDICLKIKY

SEQ ID NO: 179877 - protein, 9 aa, Homo Sapiens
QRALLHSPV

SEQ ID NO: 179878 - protein, 9 aa, Homo Sapiens
GVKGIEEKS

SEQ ID NO: 179879 - protein, 9 aa, Homo Sapiens
MTTQAPMFT

SEQ ID NO: 179880 - protein, 9 aa, Homo Sapiens
RPPRTATTP

SEQ ID NO: 179881 - protein, 9 aa, Homo Sapiens
TCSSMLSLI

SEQ ID NO: 179882 - protein, 9 aa, Homo Sapiens
DPVLLAIRL

SEQ ID NO: 179883 - protein, 9 aa, Homo Sapiens
AFAAGERAM

SEQ ID NO: 179884 - protein, 9 aa, Homo Sapiens
KEGHWDCGI

SEQ ID NO: 179885 - protein, 9 aa, Homo Sapiens
DLQLHTART

SEQ ID NO: 179886 - protein, 9 aa, Homo Sapiens
GGQMRAQRV

SEQ ID NO: 179887 - protein, 9 aa, Homo Sapiens
QLKKSADTM

SEQ ID NO: 179888 - protein, 9 aa, Homo Sapiens
NMCAKKMDW

SEQ ID NO: 179889 - protein, 9 aa, Homo Sapiens
REELLKKCS

SEQ ID NO: 179890 - protein, 9 aa, Homo Sapiens
KVPLEAFVF

SEQ ID NO: 179891 - protein, 9 aa, Homo Sapiens
TTDVEPFFV

SEQ ID NO: 179892 - protein, 9 aa, Homo Sapiens
PGPWEKMPE

SEQ ID NO: 179893 - protein, 9 aa, Homo Sapiens
DSIRNEKNP

SEQ ID NO: 179894 - protein, 9 aa, Homo Sapiens
EDGKVPQHA

SEQ ID NO: 179895 - protein, 9 aa, Homo Sapiens
YPQRSVVQQ

SEQ ID NO: 179896 - protein, 9 aa, Homo Sapiens
VTNHFWPQM

SEQ ID NO: 179897 - protein, 9 aa, Homo Sapiens
GQDSAIFNL

SEQ ID NO: 179898 - protein, 9 aa, Homo Sapiens
MTTVATDYD

SEQ ID NO: 179899 - protein, 9 aa, Homo Sapiens
RKLTQARNH

SEQ ID NO: 179900 - protein, 9 aa, Homo Sapiens
RKIIGYVLL

SEQ ID NO: 179901 - protein, 9 aa, Homo Sapiens
NKFRGFSVQ

SEQ ID NO: 179902 - protein, 9 aa, Homo Sapiens
MVDELEVVP

SEQ ID NO: 179903 - protein, 9 aa, Homo Sapiens
KDLLRIMPS

SEQ ID NO: 179904 - protein, 9 aa, Homo Sapiens
SSFGLSDEH

SEQ ID NO: 179905 - protein, 9 aa, Homo Sapiens
LLHSPVPRL

SEQ ID NO: 179906 - protein, 9 aa, Homo Sapiens
TLGLIFTPL

SEQ ID NO: 179907 - protein, 9 aa, Homo Sapiens
GRGLDPSSW

SEQ ID NO: 179908 - protein, 9 aa, Homo Sapiens
LWIIFQILV

SEQ ID NO: 179909 - protein, 9 aa, Homo Sapiens
EEEVLPIIP

SEQ ID NO: 179910 - protein, 9 aa, Homo Sapiens
RPFHFQHLA

SEQ ID NO: 179911 - protein, 9 aa, Homo Sapiens
YVKNTRATT

SEQ ID NO: 179912 - protein, 9 aa, Homo Sapiens
SVPGKKCGT

SEQ ID NO: 179913 - protein, 9 aa, Homo Sapiens
DLLYLRTSG

SEQ ID NO: 179914 - protein, 9 aa, Homo Sapiens
MESKQGTVL

SEQ ID NO: 179915 - protein, 9 aa, Homo Sapiens
IAHVLWPFG

SEQ ID NO: 179916 - protein, 9 aa, Homo Sapiens
FGQALGGER

SEQ ID NO: 179917 - protein, 9 aa, Homo Sapiens
NMDFMDTFE

SEQ ID NO: 179918 - protein, 9 aa, Homo Sapiens
IVLSILVCC

SEQ ID NO: 179919 - protein, 9 aa, Homo Sapiens
DPYGARNEN

SEQ ID NO: 179920 - protein, 9 aa, Homo Sapiens
RWGLQQAGL

SEQ ID NO: 179921 - protein, 9 aa, Homo Sapiens
ERGQCGEAD

SEQ ID NO: 179922 - protein, 9 aa, Homo Sapiens
KHWKDMIAH

SEQ ID NO: 179923 - protein, 9 aa, Homo Sapiens
LWAHGISSY

SEQ ID NO: 179924 - protein, 9 aa, Homo Sapiens
CCNKSGFAE

SEQ ID NO: 179925 - protein, 9 aa, Homo Sapiens
TFFFLHKEF

SEQ ID NO: 179926 - protein, 9 aa, Homo Sapiens
THKCILKPL

SEQ ID NO: 179927 - protein, 9 aa, Homo Sapiens
IPLQPNMDF

SEQ ID NO: 179928 - protein, 9 aa, Homo Sapiens
ATPTTCTTG

SEQ ID NO: 179929 - protein, 9 aa, Homo Sapiens
FFFFVYIWH

SEQ ID NO: 179930 - protein, 9 aa, Homo Sapiens
KKLFRIRGQ

SEQ ID NO: 179931 - protein, 9 aa, Homo Sapiens
GCENMCPSV

SEQ ID NO: 179932 - protein, 9 aa, Homo Sapiens
GTVLMKLLR

SEQ ID NO: 179933 - protein, 9 aa, Homo Sapiens
IALLGSLNP

SEQ ID NO: 179934 - protein, 9 aa, Homo Sapiens
WKLGTHYQI

SEQ ID NO: 179935 - protein, 9 aa, Homo Sapiens
RALKFREQD

SEQ ID NO: 179936 - protein, 9 aa, Homo Sapiens
DYCEVCQRG

SEQ ID NO: 179937 - protein, 9 aa, Homo Sapiens
EKVMAHVPD

SEQ ID NO: 179938 - protein, 9 aa, Homo Sapiens
AHIYPLPFF

SEQ ID NO: 179939 - protein, 9 aa, Homo Sapiens
SCCPARAAV

SEQ ID NO: 179940 - protein, 9 aa, Homo Sapiens
KPSRMCKYP

SEQ ID NO: 179941 - protein, 9 aa, Homo Sapiens
MLIKCVNKT

SEQ ID NO: 179942 - protein, 9 aa, Homo Sapiens
VGAEGGWGG

SEQ ID NO: 179943 - protein, 9 aa, Homo Sapiens
NRPCWEATH

SEQ ID NO: 179944 - protein, 9 aa, Homo Sapiens
STEQMEKFC

SEQ ID NO: 179945 - protein, 9 aa, Homo Sapiens
HQHTPYREN

SEQ ID NO: 179946 - protein, 9 aa, Homo Sapiens
KTDRAIMVG

SEQ ID NO: 179947 - protein, 9 aa, Homo Sapiens
LDLMFGEGM

SEQ ID NO: 179948 - protein, 9 aa, Homo Sapiens
VLYRNCIYT

SEQ ID NO: 179949 - protein, 9 aa, Homo Sapiens
LLSLYSVAV

SEQ ID NO: 179950 - protein, 9 aa, Homo Sapiens
HIYPLPFFL

SEQ ID NO: 179951 - protein, 9 aa, Homo Sapiens
ADSGLALKG

SEQ ID NO: 179952 - protein, 9 aa, Homo Sapiens
FPSLPKQPL

SEQ ID NO: 179953 - protein, 9 aa, Homo Sapiens
AFVFPMDED

SEQ ID NO: 179954 - protein, 9 aa, Homo Sapiens
RGFNWGLHF

SEQ ID NO: 179955 - protein, 9 aa, Homo Sapiens
PSSPPQAAA

SEQ ID NO: 179956 - protein, 9 aa, Homo Sapiens
VTEYQENKA

SEQ ID NO: 179957 - protein, 9 aa, Homo Sapiens
YPLPFFLNL

SEQ ID NO: 179958 - protein, 9 aa, Homo Sapiens
LGDKGLKKM

SEQ ID NO: 179959 - protein, 9 aa, Homo Sapiens
EITRSRKKD

SEQ ID NO: 179960 - protein, 9 aa, Homo Sapiens
HPLDVEEWG

SEQ ID NO: 179961 - protein, 9 aa, Homo Sapiens
EEHPASLTG

SEQ ID NO: 179962 - protein, 9 aa, Homo Sapiens
TNMVQEEQR

SEQ ID NO: 179963 - protein, 9 aa, Homo Sapiens
TDEIYQWMV

SEQ ID NO: 179964 - protein, 9 aa, Homo Sapiens
RIRGQKERR

SEQ ID NO: 179965 - protein, 9 aa, Homo Sapiens
LFFHSQPTQ

SEQ ID NO: 179966 - protein, 9 aa, Homo Sapiens
PPPPTKKRG

SEQ ID NO: 179967 - protein, 9 aa, Homo Sapiens
ILSMDNNCS

SEQ ID NO: 179968 - protein, 9 aa, Homo Sapiens
KRCEKPVLL

SEQ ID NO: 179969 - protein, 9 aa, Homo Sapiens
GKWHKYGCT

SEQ ID NO: 179970 - protein, 9 aa, Homo Sapiens
RRRRIPRRP

SEQ ID NO: 179971 - protein, 9 aa, Homo Sapiens
VAWAHGRRH

SEQ ID NO: 179972 - protein, 9 aa, Homo Sapiens
THRVRVGEA

SEQ ID NO: 179973 - protein, 9 aa, Homo Sapiens
SNDKEKIIR

SEQ ID NO: 179974 - protein, 9 aa, Homo Sapiens
MDNNCSLDL

SEQ ID NO: 179975 - protein, 9 aa, Homo Sapiens
RPASAWTSM

SEQ ID NO: 179976 - protein, 9 aa, Homo Sapiens
CGFLTDATK

SEQ ID NO: 179977 - protein, 9 aa, Homo Sapiens
RVVRIRAPI

SEQ ID NO: 179978 - protein, 9 aa, Homo Sapiens
VKTLVFCSD

SEQ ID NO: 179979 - protein, 9 aa, Homo Sapiens
DRHFAYGRS

SEQ ID NO: 179980 - protein, 9 aa, Homo Sapiens
QDLQSSENP

SEQ ID NO: 179981 - protein, 9 aa, Homo Sapiens
GGALAAPGA

SEQ ID NO: 179982 - protein, 9 aa, Homo Sapiens
REGEEGLGQ

SEQ ID NO: 179983 - protein, 9 aa, Homo Sapiens
HWDCGICLV

SEQ ID NO: 179984 - protein, 9 aa, Homo Sapiens
TPAPQKIST

SEQ ID NO: 179985 - protein, 9 aa, Homo Sapiens
SEKNEAQRI

SEQ ID NO: 179986 - protein, 9 aa, Homo Sapiens
GTAAFMEVW

SEQ ID NO: 179987 - protein, 9 aa, Homo Sapiens
SQTLLLWRW

SEQ ID NO: 179988 - protein, 9 aa, Homo Sapiens
NEPQRPPRS

SEQ ID NO: 179989 - protein, 9 aa, Homo Sapiens
NMFVCAQLP

SEQ ID NO: 179990 - protein, 9 aa, Homo Sapiens
RMCKYPNRP

SEQ ID NO: 179991 - protein, 9 aa, Homo Sapiens
MPTEELYGN

SEQ ID NO: 179992 - protein, 9 aa, Homo Sapiens
WAAGSPCAK

SEQ ID NO: 179993 - protein, 9 aa, Homo Sapiens
RLRRLNIKK

SEQ ID NO: 179994 - protein, 9 aa, Homo Sapiens
VDGTDINAV

SEQ ID NO: 179995 - protein, 9 aa, Homo Sapiens
GGLGVCGED

SEQ ID NO: 179996 - protein, 9 aa, Homo Sapiens
GSCGWWAPA

SEQ ID NO: 179997 - protein, 9 aa, Homo Sapiens
SCPRPSATS

SEQ ID NO: 179998 - protein, 9 aa, Homo Sapiens
ESLEHRMGG

SEQ ID NO: 179999 - protein, 9 aa, Homo Sapiens
APVQDLQLL

SEQ ID NO: 180000 - protein, 9 aa, Homo Sapiens
PVEGLTLYI

SEQ ID NO: 180001 - protein, 9 aa, Homo Sapiens
LILWPQAAP

SEQ ID NO: 180002 - protein, 9 aa, Homo Sapiens
EAPYSTCYS

SEQ ID NO: 180003 - protein, 9 aa, Homo Sapiens
NGNIKKRLF

SEQ ID NO: 180004 - protein, 9 aa, Homo Sapiens
GTQRECCSH

SEQ ID NO: 180005 - protein, 9 aa, Homo Sapiens
LQDSLQAIQ

SEQ ID NO: 180006 - protein, 9 aa, Homo Sapiens
AHHVIDGLH

SEQ ID NO: 180007 - protein, 9 aa, Homo Sapiens
SGPDQRLCK

SEQ ID NO: 180008 - protein, 9 aa, Homo Sapiens
AFQRMLAME

SEQ ID NO: 180009 - protein, 9 aa, Homo Sapiens
TLPWTLRKQ

SEQ ID NO: 180010 - protein, 9 aa, Homo Sapiens
GGKMCWFRT

SEQ ID NO: 180011 - protein, 9 aa, Homo Sapiens
FHVRLRQCR

SEQ ID NO: 180012 - protein, 9 aa, Homo Sapiens
RKALTRERI

SEQ ID NO: 180013 - protein, 9 aa, Homo Sapiens
TQQPQTPQD

SEQ ID NO: 180014 - protein, 9 aa, Homo Sapiens
RTDLQLHTA

SEQ ID NO: 180015 - protein, 9 aa, Homo Sapiens
LLQLVQLLA

SEQ ID NO: 180016 - protein, 9 aa, Homo Sapiens
VSGSMRQHE

SEQ ID NO: 180017 - protein, 9 aa, Homo Sapiens
VLFVLKEML

SEQ ID NO: 180018 - protein, 9 aa, Homo Sapiens
DNLPTSMHT

SEQ ID NO: 180019 - protein, 9 aa, Homo Sapiens
EGPAPPRIC

SEQ ID NO: 180020 - protein, 9 aa, Homo Sapiens
QTSHKVLKT

SEQ ID NO: 180021 - protein, 9 aa, Homo Sapiens
DLEEAVSGS

SEQ ID NO: 180022 - protein, 9 aa, Homo Sapiens
HCPLCEKRF

SEQ ID NO: 180023 - protein, 9 aa, Homo Sapiens
QRVLGSHLG

SEQ ID NO: 180024 - protein, 9 aa, Homo Sapiens
SLRSCRTSS

SEQ ID NO: 180025 - protein, 9 aa, Homo Sapiens
PRDRLSFKE

SEQ ID NO: 180026 - protein, 9 aa, Homo Sapiens
QRLHLLAVE

SEQ ID NO: 180027 - protein, 9 aa, Homo Sapiens
NARHRLSFA

SEQ ID NO: 180028 - protein, 9 aa, Homo Sapiens
KDLEDGKVP

SEQ ID NO: 180029 - protein, 9 aa, Homo Sapiens
MDERQEATV

SEQ ID NO: 180030 - protein, 9 aa, Homo Sapiens
LEICSARPE

SEQ ID NO: 180031 - protein, 9 aa, Homo Sapiens
EPLCNDNLP

SEQ ID NO: 180032 - protein, 9 aa, Homo Sapiens
VWPCDISRQ

SEQ ID NO: 180033 - protein, 9 aa, Homo Sapiens
EVDPNGQLD

SEQ ID NO: 180034 - protein, 9 aa, Homo Sapiens
GSRIVWMPR

SEQ ID NO: 180035 - protein, 9 aa, Homo Sapiens
LSLYSVAVW

SEQ ID NO: 180036 - protein, 9 aa, Homo Sapiens
RAGQASAAA

SEQ ID NO: 180037 - protein, 9 aa, Homo Sapiens
RALDMLLSA

SEQ ID NO: 180038 - protein, 9 aa, Homo Sapiens
KLLLLHLIS

SEQ ID NO: 180039 - protein, 9 aa, Homo Sapiens
RRRIPRRPH

SEQ ID NO: 180040 - protein, 9 aa, Homo Sapiens
EYDHHPRAE

SEQ ID NO: 180041 - protein, 9 aa, Homo Sapiens
IAICHHRGI

SEQ ID NO: 180042 - protein, 9 aa, Homo Sapiens
KFCLEQKVY

SEQ ID NO: 180043 - protein, 9 aa, Homo Sapiens
EKLQLTNSD

SEQ ID NO: 180044 - protein, 9 aa, Homo Sapiens
NRSSGNFSS

SEQ ID NO: 180045 - protein, 9 aa, Homo Sapiens
WLSLISPNN

SEQ ID NO: 180046 - protein, 9 aa, Homo Sapiens
FFLCLKKEV

SEQ ID NO: 180047 - protein, 9 aa, Homo Sapiens
SPASPPTQQ

SEQ ID NO: 180048 - protein, 9 aa, Homo Sapiens
TVRGSCGWW

SEQ ID NO: 180049 - protein, 9 aa, Homo Sapiens
WAACVNYSE

SEQ ID NO: 180050 - protein, 9 aa, Homo Sapiens
VPRARRCDQ

SEQ ID NO: 180051 - protein, 9 aa, Homo Sapiens
RVFDSGLMV

SEQ ID NO: 180052 - protein, 9 aa, Homo Sapiens
SKEERRCDD

SEQ ID NO: 180053 - protein, 9 aa, Homo Sapiens
EEAMDRSET

SEQ ID NO: 180054 - protein, 9 aa, Homo Sapiens
RLIIGQNGV

SEQ ID NO: 180055 - protein, 9 aa, Homo Sapiens
TTRKPSSPR

SEQ ID NO: 180056 - protein, 9 aa, Homo Sapiens
PSTFGSEVG

SEQ ID NO: 180057 - protein, 9 aa, Homo Sapiens
MWSASSGDI

SEQ ID NO: 180058 - protein, 9 aa, Homo Sapiens
LEDGGFFEE

SEQ ID NO: 180059 - protein, 9 aa, Homo Sapiens
PRRFLRRAG

SEQ ID NO: 180060 - protein, 9 aa, Homo Sapiens
RARSPASLS

SEQ ID NO: 180061 - protein, 9 aa, Homo Sapiens
HDALPHIDG

SEQ ID NO: 180062 - protein, 9 aa, Homo Sapiens
DELEVVPNI

SEQ ID NO: 180063 - protein, 9 aa, Homo Sapiens
ISILARLPA

SEQ ID NO: 180064 - protein, 9 aa, Homo Sapiens
HTAQENDDH

SEQ ID NO: 180065 - protein, 9 aa, Homo Sapiens
AQAIQNPQA

SEQ ID NO: 180066 - protein, 9 aa, Homo Sapiens
QSGRCPAAA

SEQ ID NO: 180067 - protein, 9 aa, Homo Sapiens
LNEWCPFVE

SEQ ID NO: 180068 - protein, 9 aa, Homo Sapiens
GSLRYGLAL

SEQ ID NO: 180069 - protein, 9 aa, Homo Sapiens
SLEKSAKKD

SEQ ID NO: 180070 - protein, 9 aa, Homo Sapiens
RGRWSCCPA

SEQ ID NO: 180071 - protein, 9 aa, Homo Sapiens
ELPPASPLK

SEQ ID NO: 180072 - protein, 9 aa, Homo Sapiens
RELRHAPRL

SEQ ID NO: 180073 - protein, 9 aa, Homo Sapiens
CVVNGPQTE

SEQ ID NO: 180074 - protein, 9 aa, Homo Sapiens
LAERAQMLG

SEQ ID NO: 180075 - protein, 9 aa, Homo Sapiens
GHRPDLEEA

SEQ ID NO: 180076 - protein, 9 aa, Homo Sapiens
LKGCAKEAA

SEQ ID NO: 180077 - protein, 9 aa, Homo Sapiens
TSSWKKTFT

SEQ ID NO: 180078 - protein, 9 aa, Homo Sapiens
GINFKDIQV

SEQ ID NO: 180079 - protein, 9 aa, Homo Sapiens
TTPRPGRLP

SEQ ID NO: 180080 - protein, 9 aa, Homo Sapiens
RPIRQNPGI

SEQ ID NO: 180081 - protein, 9 aa, Homo Sapiens
DVPRKLLNH

SEQ ID NO: 180082 - protein, 9 aa, Homo Sapiens
FLLLLLLHR

SEQ ID NO: 180083 - protein, 9 aa, Homo Sapiens
PLNPPPPLT

SEQ ID NO: 180084 - protein, 9 aa, Homo Sapiens
DKHFYSLVK

SEQ ID NO: 180085 - protein, 9 aa, Homo Sapiens
SPSARRQSS

SEQ ID NO: 180086 - protein, 9 aa, Homo Sapiens
VIKKKGISV

SEQ ID NO: 180087 - protein, 9 aa, Homo Sapiens
RTTSTLGSS

SEQ ID NO: 180088 - protein, 9 aa, Homo Sapiens
HPFLCVADF

SEQ ID NO: 180089 - protein, 9 aa, Homo Sapiens
KEGVVHFGH

SEQ ID NO: 180090 - protein, 9 aa, Homo Sapiens
APRRFLRRA

SEQ ID NO: 180091 - protein, 9 aa, Homo Sapiens
AVGGKEPTI

SEQ ID NO: 180092 - protein, 9 aa, Homo Sapiens
FWEGAKIQS

SEQ ID NO: 180093 - protein, 9 aa, Homo Sapiens
PLQHMCVAA

SEQ ID NO: 180094 - protein, 9 aa, Homo Sapiens
TVGFCGKLV

SEQ ID NO: 180095 - protein, 9 aa, Homo Sapiens
ECSGAIMAL

SEQ ID NO: 180096 - protein, 9 aa, Homo Sapiens
FMVEEHELQ

SEQ ID NO: 180097 - protein, 9 aa, Homo Sapiens
HLKKYRCYE

SEQ ID NO: 180098 - protein, 9 aa, Homo Sapiens
GYDEKLVQE

SEQ ID NO: 180099 - protein, 9 aa, Homo Sapiens
EDEEDDDDE

SEQ ID NO: 180100 - protein, 9 aa, Homo Sapiens
QLTNSDINL

SEQ ID NO: 180101 - protein, 9 aa, Homo Sapiens
QEDGMIMYI

SEQ ID NO: 180102 - protein, 9 aa, Homo Sapiens
TVGTPIADV

SEQ ID NO: 180103 - protein, 9 aa, Homo Sapiens
SDSRRRGAV

SEQ ID NO: 180104 - protein, 9 aa, Homo Sapiens
SSGATGTTP

SEQ ID NO: 180105 - protein, 9 aa, Homo Sapiens
WQTLTTQTL

SEQ ID NO: 180106 - protein, 9 aa, Homo Sapiens
IRKYVKNTR

SEQ ID NO: 180107 - protein, 9 aa, Homo Sapiens
AYLLVIMYG

SEQ ID NO: 180108 - protein, 9 aa, Homo Sapiens
PGLELVFAL

SEQ ID NO: 180109 - protein, 9 aa, Homo Sapiens
NFACSYPMD

SEQ ID NO: 180110 - protein, 9 aa, Homo Sapiens
LGGLGVVLG

SEQ ID NO: 180111 - protein, 9 aa, Homo Sapiens
RWESQVRQL

SEQ ID NO: 180112 - protein, 9 aa, Homo Sapiens
KKNISEKKV

SEQ ID NO: 180113 - protein, 9 aa, Homo Sapiens
SHGSLAHQN

SEQ ID NO: 180114 - protein, 9 aa, Homo Sapiens
RAGGHRPDL

SEQ ID NO: 180115 - protein, 9 aa, Homo Sapiens
NTEPSTAKP

SEQ ID NO: 180116 - protein, 9 aa, Homo Sapiens
FWTLLPTTG

SEQ ID NO: 180117 - protein, 9 aa, Homo Sapiens
GDLYGTIGS

SEQ ID NO: 180118 - protein, 9 aa, Homo Sapiens
NPVLYVFMG

SEQ ID NO: 180119 - protein, 9 aa, Homo Sapiens
NLSCRGASD

SEQ ID NO: 180120 - protein, 9 aa, Homo Sapiens
PEEPGLDKV

SEQ ID NO: 180121 - protein, 9 aa, Homo Sapiens
AELFVLLCR

SEQ ID NO: 180122 - protein, 9 aa, Homo Sapiens
MTFYNTPCR

SEQ ID NO: 180123 - protein, 9 aa, Homo Sapiens
WAPHIGNTH

SEQ ID NO: 180124 - protein, 9 aa, Homo Sapiens
RWAQDEHPQ

SEQ ID NO: 180125 - protein, 9 aa, Homo Sapiens
APRLESAFS

SEQ ID NO: 180126 - protein, 9 aa, Homo Sapiens
FHTRCWESC

SEQ ID NO: 180127 - protein, 9 aa, Homo Sapiens
IYADGYGTQ

SEQ ID NO: 180128 - protein, 9 aa, Homo Sapiens
SARRVDADM

SEQ ID NO: 180129 - protein, 9 aa, Homo Sapiens
SPEDGLSTE

SEQ ID NO: 180130 - protein, 9 aa, Homo Sapiens
ENPQGHQIF

SEQ ID NO: 180131 - protein, 9 aa, Homo Sapiens
IPGLLGSPL

SEQ ID NO: 180132 - protein, 9 aa, Homo Sapiens
KELQAVREM

SEQ ID NO: 180133 - protein, 9 aa, Homo Sapiens
QLEEKLMTV

SEQ ID NO: 180134 - protein, 9 aa, Homo Sapiens
QCPSMEEIV

SEQ ID NO: 180135 - protein, 9 aa, Homo Sapiens
RTIAGALIA

SEQ ID NO: 180136 - protein, 9 aa, Homo Sapiens
AATPAPRRF

SEQ ID NO: 180137 - protein, 9 aa, Homo Sapiens
HPRQPVAQW

SEQ ID NO: 180138 - protein, 9 aa, Homo Sapiens
LSVNQLEDE

SEQ ID NO: 180139 - protein, 9 aa, Homo Sapiens
GRDASHCPA

SEQ ID NO: 180140 - protein, 9 aa, Homo Sapiens
VLEVPWTHL

SEQ ID NO: 180141 - protein, 9 aa, Homo Sapiens
SLRNLYFLD

SEQ ID NO: 180142 - protein, 9 aa, Homo Sapiens
CRAIFSLLK

SEQ ID NO: 180143 - protein, 9 aa, Homo Sapiens
GQLPKEELQ

SEQ ID NO: 180144 - protein, 9 aa, Homo Sapiens
HGLVRESVL

SEQ ID NO: 180145 - protein, 9 aa, Homo Sapiens
TFGVGETRR

SEQ ID NO: 180146 - protein, 9 aa, Homo Sapiens
QSFANPAHH

SEQ ID NO: 180147 - protein, 9 aa, Homo Sapiens
PPVMLKVTR

SEQ ID NO: 180148 - protein, 9 aa, Homo Sapiens
VIQVKALIV

SEQ ID NO: 180149 - protein, 9 aa, Homo Sapiens
EDLFGQALG

SEQ ID NO: 180150 - protein, 9 aa, Homo Sapiens
RQTESQIIS

SEQ ID NO: 180151 - protein, 9 aa, Homo Sapiens
IKETGNVAT

SEQ ID NO: 180152 - protein, 9 aa, Homo Sapiens
DDDEEDDTG

SEQ ID NO: 180153 - protein, 9 aa, Homo Sapiens
LKKCSLYGK

SEQ ID NO: 180154 - protein, 9 aa, Homo Sapiens
KPIFQMPQN

SEQ ID NO: 180155 - protein, 9 aa, Homo Sapiens
LVAYKCKPS

SEQ ID NO: 180156 - protein, 9 aa, Homo Sapiens
PKKERAWLS

SEQ ID NO: 180157 - protein, 9 aa, Homo Sapiens
DTDSNRASL

SEQ ID NO: 180158 - protein, 9 aa, Homo Sapiens
SILVCCLPL

SEQ ID NO: 180159 - protein, 9 aa, Homo Sapiens
RGVQQVSEC

SEQ ID NO: 180160 - protein, 9 aa, Homo Sapiens
SSPVVHEGV

SEQ ID NO: 180161 - protein, 9 aa, Homo Sapiens
PTTCTTGVG

SEQ ID NO: 180162 - protein, 9 aa, Homo Sapiens
PLDVEEWGK

SEQ ID NO: 180163 - protein, 9 aa, Homo Sapiens
PNSAYGALT

SEQ ID NO: 180164 - protein, 9 aa, Homo Sapiens
RSFGTGTHA

SEQ ID NO: 180165 - protein, 9 aa, Homo Sapiens
PAAVPSTPR

SEQ ID NO: 180166 - protein, 9 aa, Homo Sapiens
ISDTSVAVK

SEQ ID NO: 180167 - protein, 9 aa, Homo Sapiens
ELKAPPERR

SEQ ID NO: 180168 - protein, 9 aa, Homo Sapiens
NPTEAELQV

SEQ ID NO: 180169 - protein, 9 aa, Homo Sapiens
QYYSNSFNT

SEQ ID NO: 180170 - protein, 9 aa, Homo Sapiens
KKNKFRGFS

SEQ ID NO: 180171 - protein, 9 aa, Homo Sapiens
TWMRPKKCP

SEQ ID NO: 180172 - protein, 9 aa, Homo Sapiens
PHVSPQMIS

SEQ ID NO: 180173 - protein, 9 aa, Homo Sapiens
NYLYICYER

SEQ ID NO: 180174 - protein, 9 aa, Homo Sapiens
AGKWKSIVT

SEQ ID NO: 180175 - protein, 9 aa, Homo Sapiens
QTGVLAHLE

SEQ ID NO: 180176 - protein, 9 aa, Homo Sapiens
KVFPSPPSP

SEQ ID NO: 180177 - protein, 9 aa, Homo Sapiens
TCMPENQRL

SEQ ID NO: 180178 - protein, 9 aa, Homo Sapiens
ISQVDRLQP

SEQ ID NO: 180179 - protein, 9 aa, Homo Sapiens
TVSGTQGKG

SEQ ID NO: 180180 - protein, 9 aa, Homo Sapiens
PGASMTVTT

SEQ ID NO: 180181 - protein, 9 aa, Homo Sapiens
PAVHITHHA

SEQ ID NO: 180182 - protein, 9 aa, Homo Sapiens
MCNHPPRKI

SEQ ID NO: 180183 - protein, 9 aa, Homo Sapiens
LLCQNPEKL

SEQ ID NO: 180184 - protein, 9 aa, Homo Sapiens
HTARTDWWC

SEQ ID NO: 180185 - protein, 9 aa, Homo Sapiens
YYGWQCMVG

SEQ ID NO: 180186 - protein, 9 aa, Homo Sapiens
TYYCLSVIF

SEQ ID NO: 180187 - protein, 9 aa, Homo Sapiens
GEGMTCSSC

SEQ ID NO: 180188 - protein, 9 aa, Homo Sapiens
PTADYAVGF

SEQ ID NO: 180189 - protein, 9 aa, Homo Sapiens
ACRMNCKKL

SEQ ID NO: 180190 - protein, 9 aa, Homo Sapiens
KELLPSDSA

SEQ ID NO: 180191 - protein, 9 aa, Homo Sapiens
KGLKKMTLK

SEQ ID NO: 180192 - protein, 9 aa, Homo Sapiens
KKRVNTAWK

SEQ ID NO: 180193 - protein, 9 aa, Homo Sapiens
VLSVGKPSV

SEQ ID NO: 180194 - protein, 9 aa, Homo Sapiens
LQPQHEGPP

SEQ ID NO: 180195 - protein, 9 aa, Homo Sapiens
VVRRGFNWG

SEQ ID NO: 180196 - protein, 9 aa, Homo Sapiens
IVGRADVLV

SEQ ID NO: 180197 - protein, 9 aa, Homo Sapiens
KTANYERQP

SEQ ID NO: 180198 - protein, 9 aa, Homo Sapiens
VWVQQAGSV

SEQ ID NO: 180199 - protein, 9 aa, Homo Sapiens
MLYPVQGQQ

SEQ ID NO: 180200 - protein, 9 aa, Homo Sapiens
IKRGEFSGD

SEQ ID NO: 180201 - protein, 9 aa, Homo Sapiens
KERGLFRGV

SEQ ID NO: 180202 - protein, 9 aa, Homo Sapiens
KPVIYSSPK

SEQ ID NO: 180203 - protein, 9 aa, Homo Sapiens
RFRASCEDG

SEQ ID NO: 180204 - protein, 9 aa, Homo Sapiens
VRVLAHHVI

SEQ ID NO: 180205 - protein, 9 aa, Homo Sapiens
CRTSSQPWR

SEQ ID NO: 180206 - protein, 9 aa, Homo Sapiens
GGINFKDIQ

SEQ ID NO: 180207 - protein, 9 aa, Homo Sapiens
INNQIIVNT

SEQ ID NO: 180208 - protein, 9 aa, Homo Sapiens
PKNIAFYPN

SEQ ID NO: 180209 - protein, 9 aa, Homo Sapiens
NKRQSYDIG

SEQ ID NO: 180210 - protein, 9 aa, Homo Sapiens
SSQTAAELQ

SEQ ID NO: 180211 - protein, 9 aa, Homo Sapiens
SKDPSQCPS

SEQ ID NO: 180212 - protein, 9 aa, Homo Sapiens
VSEEPIYII

SEQ ID NO: 180213 - protein, 9 aa, Homo Sapiens
PFHLEEWRT

SEQ ID NO: 180214 - protein, 9 aa, Homo Sapiens
KTSLKWQFL

SEQ ID NO: 180215 - protein, 9 aa, Homo Sapiens
SSLFRQEDD

SEQ ID NO: 180216 - protein, 9 aa, Homo Sapiens
EMRRTPTPA

SEQ ID NO: 180217 - protein, 9 aa, Homo Sapiens
DLSIFLSTR

SEQ ID NO: 180218 - protein, 9 aa, Homo Sapiens
PQSGSPASG

SEQ ID NO: 180219 - protein, 9 aa, Homo Sapiens
QPPTLPWTL

SEQ ID NO: 180220 - protein, 9 aa, Homo Sapiens
AAAKDTILQ

SEQ ID NO: 180221 - protein, 9 aa, Homo Sapiens
HPQSVVVGS

SEQ ID NO: 180222 - protein, 9 aa, Homo Sapiens
SGFFLEDEL

SEQ ID NO: 180223 - protein, 9 aa, Homo Sapiens
DFVPIVGFL

SEQ ID NO: 180224 - protein, 9 aa, Homo Sapiens
RRIHKNFTE

SEQ ID NO: 180225 - protein, 9 aa, Homo Sapiens
GQSGAAVLL

SEQ ID NO: 180226 - protein, 9 aa, Homo Sapiens
KYRALEMDF

SEQ ID NO: 180227 - protein, 9 aa, Homo Sapiens
ARPEGGPAR

SEQ ID NO: 180228 - protein, 9 aa, Homo Sapiens
GVSLRKELG

SEQ ID NO: 180229 - protein, 9 aa, Homo Sapiens
GVVEGGLNV

SEQ ID NO: 180230 - protein, 9 aa, Homo Sapiens
RRKNQKRKR

SEQ ID NO: 180231 - protein, 9 aa, Homo Sapiens
VEGGLNVTL

SEQ ID NO: 180232 - protein, 9 aa, Homo Sapiens
FIRFDVPEY

SEQ ID NO: 180233 - protein, 9 aa, Homo Sapiens
PRAERGQCG

SEQ ID NO: 180234 - protein, 9 aa, Homo Sapiens
SPADDNMDR

SEQ ID NO: 180235 - protein, 9 aa, Homo Sapiens
LQGELLVPC

SEQ ID NO: 180236 - protein, 9 aa, Homo Sapiens
QRLLLHHWA

SEQ ID NO: 180237 - protein, 9 aa, Homo Sapiens
GEVEASRLR

SEQ ID NO: 180238 - protein, 9 aa, Homo Sapiens
HHTCIQPHG

SEQ ID NO: 180239 - protein, 9 aa, Homo Sapiens
PEACGIRTS

SEQ ID NO: 180240 - protein, 9 aa, Homo Sapiens
PVPGQKGEK

SEQ ID NO: 180241 - protein, 9 aa, Homo Sapiens
EKMKVEGLN

SEQ ID NO: 180242 - protein, 9 aa, Homo Sapiens
TRCPAAEPG

SEQ ID NO: 180243 - protein, 9 aa, Homo Sapiens
ELKKVVQKS

SEQ ID NO: 180244 - protein, 9 aa, Homo Sapiens
SAPSDPLEP

SEQ ID NO: 180245 - protein, 9 aa, Homo Sapiens
ERSAEERHN

SEQ ID NO: 180246 - protein, 9 aa, Homo Sapiens
CSETDPCTG

SEQ ID NO: 180247 - protein, 9 aa, Homo Sapiens
CPLLLVYIM

SEQ ID NO: 180248 - protein, 9 aa, Homo Sapiens
RESVLTALL

SEQ ID NO: 180249 - protein, 9 aa, Homo Sapiens
WTQFRNYPR

SEQ ID NO: 180250 - protein, 9 aa, Homo Sapiens
SPIVHVPTS

SEQ ID NO: 180251 - protein, 9 aa, Homo Sapiens
WTLLPTTGV

SEQ ID NO: 180252 - protein, 9 aa, Homo Sapiens
PVAGDLTSL

SEQ ID NO: 180253 - protein, 9 aa, Homo Sapiens
LVRESVLTA

SEQ ID NO: 180254 - protein, 9 aa, Homo Sapiens
CCQYVTSYH

SEQ ID NO: 180255 - protein, 9 aa, Homo Sapiens
LPRPPMPRP

SEQ ID NO: 180256 - protein, 9 aa, Homo Sapiens
PIYLAKPIF

SEQ ID NO: 180257 - protein, 9 aa, Homo Sapiens
EKAHENPFR

SEQ ID NO: 180258 - protein, 9 aa, Homo Sapiens
GLLFCRVRY

SEQ ID NO: 180259 - protein, 9 aa, Homo Sapiens
FNDASPPSA

SEQ ID NO: 180260 - protein, 9 aa, Homo Sapiens
SRGPPAPRP

SEQ ID NO: 180261 - protein, 9 aa, Homo Sapiens
RHPTWRPFH

SEQ ID NO: 180262 - protein, 9 aa, Homo Sapiens
PCHPVWARR

SEQ ID NO: 180263 - protein, 9 aa, Homo Sapiens
VPPLLEGAP

SEQ ID NO: 180264 - protein, 9 aa, Homo Sapiens
VEEHELQKE

SEQ ID NO: 180265 - protein, 9 aa, Homo Sapiens
RIEGPAPPR

SEQ ID NO: 180266 - protein, 9 aa, Homo Sapiens
GKRACRMNC

SEQ ID NO: 180267 - protein, 9 aa, Homo Sapiens
CSGRAPPPS

SEQ ID NO: 180268 - protein, 9 aa, Homo Sapiens
LLQSAKKRA

SEQ ID NO: 180269 - protein, 9 aa, Homo Sapiens
TLYITSRDR

SEQ ID NO: 180270 - protein, 9 aa, Homo Sapiens
RPCAGARRG

SEQ ID NO: 180271 - protein, 9 aa, Homo Sapiens
RDVTSKSNP

SEQ ID NO: 180272 - protein, 9 aa, Homo Sapiens
RFGSMVRRA

SEQ ID NO: 180273 - protein, 9 aa, Homo Sapiens
LQGKAILWL

SEQ ID NO: 180274 - protein, 9 aa, Homo Sapiens
SSSNRLWME

SEQ ID NO: 180275 - protein, 9 aa, Homo Sapiens
WLSPTADYA

SEQ ID NO: 180276 - protein, 9 aa, Homo Sapiens
DDPSKALLT

SEQ ID NO: 180277 - protein, 9 aa, Homo Sapiens
CTLAPVLIC

SEQ ID NO: 180278 - protein, 9 aa, Homo Sapiens
MMRQPNSTA

SEQ ID NO: 180279 - protein, 9 aa, Homo Sapiens
PHCVPEGPA

SEQ ID NO: 180280 - protein, 9 aa, Homo Sapiens
LENLPCFPS

SEQ ID NO: 180281 - protein, 9 aa, Homo Sapiens
TELGAAGRH

SEQ ID NO: 180282 - protein, 9 aa, Homo Sapiens
FGDHHKDRH

SEQ ID NO: 180283 - protein, 9 aa, Homo Sapiens
PPSSSGKQY

SEQ ID NO: 180284 - protein, 9 aa, Homo Sapiens
AKLEPRDRR

SEQ ID NO: 180285 - protein, 9 aa, Homo Sapiens
VALFFGPGT

SEQ ID NO: 180286 - protein, 9 aa, Homo Sapiens
NHTLFLDSR

SEQ ID NO: 180287 - protein, 9 aa, Homo Sapiens
SVANVDLLN

SEQ ID NO: 180288 - protein, 9 aa, Homo Sapiens
FSWHDPHPW

SEQ ID NO: 180289 - protein, 9 aa, Homo Sapiens
HENPFRGKA

SEQ ID NO: 180290 - protein, 9 aa, Homo Sapiens
TEALEEANI

SEQ ID NO: 180291 - protein, 9 aa, Homo Sapiens
REMRAGGCC

SEQ ID NO: 180292 - protein, 9 aa, Homo Sapiens
QKDALERYL

SEQ ID NO: 180293 - protein, 9 aa, Homo Sapiens
NHTGEFISF

SEQ ID NO: 180294 - protein, 9 aa, Homo Sapiens
PATNYSLMV

SEQ ID NO: 180295 - protein, 9 aa, Homo Sapiens
PQCTFFFLH

SEQ ID NO: 180296 - protein, 9 aa, Homo Sapiens
GYTGPKGNP

SEQ ID NO: 180297 - protein, 9 aa, Homo Sapiens
LIDNSAGTF

SEQ ID NO: 180298 - protein, 9 aa, Homo Sapiens
TFVLLMLKV

SEQ ID NO: 180299 - protein, 9 aa, Homo Sapiens
PRCSGRAPP

SEQ ID NO: 180300 - protein, 9 aa, Homo Sapiens
LADLMPKEQ

SEQ ID NO: 180301 - protein, 9 aa, Homo Sapiens
SPRSSLISI

SEQ ID NO: 180302 - protein, 9 aa, Homo Sapiens
VCYWTIRVL

SEQ ID NO: 180303 - protein, 9 aa, Homo Sapiens
SGATGTTPS

SEQ ID NO: 180304 - protein, 9 aa, Homo Sapiens
SYSSTMTNN

SEQ ID NO: 180305 - protein, 9 aa, Homo Sapiens
KQEPIKDDL

SEQ ID NO: 180306 - protein, 9 aa, Homo Sapiens
EFGWKLVRG

SEQ ID NO: 180307 - protein, 9 aa, Homo Sapiens
KNNKSSSQQ

SEQ ID NO: 180308 - protein, 9 aa, Homo Sapiens
SPFPSTPLP

SEQ ID NO: 180309 - protein, 9 aa, Homo Sapiens
NILQIQGVT

SEQ ID NO: 180310 - protein, 9 aa, Homo Sapiens
VGVWSIGCI

SEQ ID NO: 180311 - protein, 9 aa, Homo Sapiens
VVLRRTPPA

SEQ ID NO: 180312 - protein, 9 aa, Homo Sapiens
IDPPQKRVD

SEQ ID NO: 180313 - protein, 9 aa, Homo Sapiens
HRLDKVFVV

SEQ ID NO: 180314 - protein, 9 aa, Homo Sapiens
ASSPGHPLG

SEQ ID NO: 180315 - protein, 9 aa, Homo Sapiens
LIEHTHRVR

SEQ ID NO: 180316 - protein, 9 aa, Homo Sapiens
LPFFLNLGR

SEQ ID NO: 180317 - protein, 9 aa, Homo Sapiens
VCLLFLLAF

SEQ ID NO: 180318 - protein, 9 aa, Homo Sapiens
GQRALHTQP

SEQ ID NO: 180319 - protein, 9 aa, Homo Sapiens
RENCDGHTA

SEQ ID NO: 180320 - protein, 9 aa, Homo Sapiens
AIFNLGHLY

SEQ ID NO: 180321 - protein, 9 aa, Homo Sapiens
SACTRPQST

SEQ ID NO: 180322 - protein, 9 aa, Homo Sapiens
HPRAERGQC

SEQ ID NO: 180323 - protein, 9 aa, Homo Sapiens
RVLGASHIH

SEQ ID NO: 180324 - protein, 9 aa, Homo Sapiens
CWEATHNCP

SEQ ID NO: 180325 - protein, 9 aa, Homo Sapiens
SDEHISLGQ

SEQ ID NO: 180326 - protein, 9 aa, Homo Sapiens
WTIRVLGAS

SEQ ID NO: 180327 - protein, 9 aa, Homo Sapiens
SYGHIGVAI

SEQ ID NO: 180328 - protein, 9 aa, Homo Sapiens
GVPEESKEL

SEQ ID NO: 180329 - protein, 9 aa, Homo Sapiens
VKCKSSENN

SEQ ID NO: 180330 - protein, 9 aa, Homo Sapiens
FSAEDLSIF

SEQ ID NO: 180331 - protein, 9 aa, Homo Sapiens
RARCGVLWL

SEQ ID NO: 180332 - protein, 9 aa, Homo Sapiens
TLSEIGHIL

SEQ ID NO: 180333 - protein, 9 aa, Homo Sapiens
DPGVVRGLG

SEQ ID NO: 180334 - protein, 9 aa, Homo Sapiens
GLPFPKILT

SEQ ID NO: 180335 - protein, 9 aa, Homo Sapiens
LLAQWAQLL

SEQ ID NO: 180336 - protein, 9 aa, Homo Sapiens
RRWRSSKER

SEQ ID NO: 180337 - protein, 9 aa, Homo Sapiens
PGAPSLGRG

SEQ ID NO: 180338 - protein, 9 aa, Homo Sapiens
GEPVLPRHP

SEQ ID NO: 180339 - protein, 9 aa, Homo Sapiens
QSVKKRCSL

SEQ ID NO: 180340 - protein, 9 aa, Homo Sapiens
HEQQVARTI

SEQ ID NO: 180341 - protein, 9 aa, Homo Sapiens
PDITTCKSP

SEQ ID NO: 180342 - protein, 9 aa, Homo Sapiens
GGGQDPGVV

SEQ ID NO: 180343 - protein, 9 aa, Homo Sapiens
ITTVGKVVV

SEQ ID NO: 180344 - protein, 9 aa, Homo Sapiens
VPRLRHGLC

SEQ ID NO: 180345 - protein, 9 aa, Homo Sapiens
TILVSVHLL

SEQ ID NO: 180346 - protein, 9 aa, Homo Sapiens
AMDRSETPQ

SEQ ID NO: 180347 - protein, 9 aa, Homo Sapiens
ALCLSASAR

SEQ ID NO: 180348 - protein, 9 aa, Homo Sapiens
AAPGLVLQL

SEQ ID NO: 180349 - protein, 9 aa, Homo Sapiens
HDPVLLAIR

SEQ ID NO: 180350 - protein, 9 aa, Homo Sapiens
NDYLRRRAS

SEQ ID NO: 180351 - protein, 9 aa, Homo Sapiens
AALQTGPGS

SEQ ID NO: 180352 - protein, 9 aa, Homo Sapiens
HKITMKEGW

SEQ ID NO: 180353 - protein, 9 aa, Homo Sapiens
NCLVKNLDA

SEQ ID NO: 180354 - protein, 9 aa, Homo Sapiens
APQSGSPAS

SEQ ID NO: 180355 - protein, 9 aa, Homo Sapiens
KKTQWETLF

SEQ ID NO: 180356 - protein, 9 aa, Homo Sapiens
LLLGGFLPP

SEQ ID NO: 180357 - protein, 9 aa, Homo Sapiens
LLRVVRIRA

SEQ ID NO: 180358 - protein, 9 aa, Homo Sapiens
MRMSSGRWW

SEQ ID NO: 180359 - protein, 9 aa, Homo Sapiens
DKVFVVTDA

SEQ ID NO: 180360 - protein, 9 aa, Homo Sapiens
AQLGDLYGT

SEQ ID NO: 180361 - protein, 9 aa, Homo Sapiens
SSRDHKSKP

SEQ ID NO: 180362 - protein, 9 aa, Homo Sapiens
QPCQYFIGV

SEQ ID NO: 180363 - protein, 9 aa, Homo Sapiens
FFGPGTFTY

SEQ ID NO: 180364 - protein, 9 aa, Homo Sapiens
EAVNMSMGL

SEQ ID NO: 180365 - protein, 9 aa, Homo Sapiens
YGRTEFIDE

SEQ ID NO: 180366 - protein, 9 aa, Homo Sapiens
STPAPQKIS

SEQ ID NO: 180367 - protein, 9 aa, Homo Sapiens
PSIQQPIPL

SEQ ID NO: 180368 - protein, 9 aa, Homo Sapiens
MRPKKCPLL

SEQ ID NO: 180369 - protein, 9 aa, Homo Sapiens
YITSRDRMT

SEQ ID NO: 180370 - protein, 9 aa, Homo Sapiens
WRDYKRLWA

SEQ ID NO: 180371 - protein, 9 aa, Homo Sapiens
CDAHSARQQ

SEQ ID NO: 180372 - protein, 9 aa, Homo Sapiens
YWMMQRSKM

SEQ ID NO: 180373 - protein, 9 aa, Homo Sapiens
KTCKKTETV

SEQ ID NO: 180374 - protein, 9 aa, Homo Sapiens
VLVKVIQVE

SEQ ID NO: 180375 - protein, 9 aa, Homo Sapiens
RGCCLRIHC

SEQ ID NO: 180376 - protein, 9 aa, Homo Sapiens
GEKGAEAAS

SEQ ID NO: 180377 - protein, 9 aa, Homo Sapiens
INKKCYGMA

SEQ ID NO: 180378 - protein, 9 aa, Homo Sapiens
LKDILADLM

SEQ ID NO: 180379 - protein, 9 aa, Homo Sapiens
PLLLLQKHA

SEQ ID NO: 180380 - protein, 9 aa, Homo Sapiens
HSQILICFL

SEQ ID NO: 180381 - protein, 9 aa, Homo Sapiens
TLKTKGRGE

SEQ ID NO: 180382 - protein, 9 aa, Homo Sapiens
GEIELKNNS

SEQ ID NO: 180383 - protein, 9 aa, Homo Sapiens
PPPLKVAPG

SEQ ID NO: 180384 - protein, 9 aa, Homo Sapiens
PPTTLNSID

SEQ ID NO: 180385 - protein, 9 aa, Homo Sapiens
VDGLISQLE

SEQ ID NO: 180386 - protein, 9 aa, Homo Sapiens
NRLWMEFVS

SEQ ID NO: 180387 - protein, 9 aa, Homo Sapiens
SFTRATSWM

SEQ ID NO: 180388 - protein, 9 aa, Homo Sapiens
LGALRTARI

SEQ ID NO: 180389 - protein, 9 aa, Homo Sapiens
VLQYGCCAF

SEQ ID NO: 180390 - protein, 9 aa, Homo Sapiens
LEKVSKKDS

SEQ ID NO: 180391 - protein, 9 aa, Homo Sapiens
RQHEQQVAR

SEQ ID NO: 180392 - protein, 9 aa, Homo Sapiens
SSPRPCGSP

SEQ ID NO: 180393 - protein, 9 aa, Homo Sapiens
DYAVGFNGC

SEQ ID NO: 180394 - protein, 9 aa, Homo Sapiens
KVMAHVPDA

SEQ ID NO: 180395 - protein, 9 aa, Homo Sapiens
VGRTRAGPR

SEQ ID NO: 180396 - protein, 9 aa, Homo Sapiens
PVIMLKCRH

SEQ ID NO: 180397 - protein, 9 aa, Homo Sapiens
QCGKVLEDG

SEQ ID NO: 180398 - protein, 9 aa, Homo Sapiens
EIRYMHFYF

SEQ ID NO: 180399 - protein, 9 aa, Homo Sapiens
RVHMGARAV

SEQ ID NO: 180400 - protein, 9 aa, Homo Sapiens
EEEEEEKKR

SEQ ID NO: 180401 - protein, 9 aa, Homo Sapiens
KFWNSNDKE

SEQ ID NO: 180402 - protein, 9 aa, Homo Sapiens
NPIFVMNVG

SEQ ID NO: 180403 - protein, 9 aa, Homo Sapiens
RRNLSCRGA

SEQ ID NO: 180404 - protein, 9 aa, Homo Sapiens
SGSPASGSS

SEQ ID NO: 180405 - protein, 9 aa, Homo Sapiens
LWAWRLHAR

SEQ ID NO: 180406 - protein, 9 aa, Homo Sapiens
HNLAELPRI

SEQ ID NO: 180407 - protein, 9 aa, Homo Sapiens
IQGVTTERL

SEQ ID NO: 180408 - protein, 9 aa, Homo Sapiens
SPLPDDSKV

SEQ ID NO: 180409 - protein, 9 aa, Homo Sapiens
WIMHDGGML

SEQ ID NO: 180410 - protein, 9 aa, Homo Sapiens
QVPKGVIYA

SEQ ID NO: 180411 - protein, 9 aa, Homo Sapiens
CGPVHLLPS

SEQ ID NO: 180412 - protein, 9 aa, Homo Sapiens
ATGWPWQDN

SEQ ID NO: 180413 - protein, 9 aa, Homo Sapiens
ATPAPRRFL

SEQ ID NO: 180414 - protein, 9 aa, Homo Sapiens
ITCSSMLSL

SEQ ID NO: 180415 - protein, 9 aa, Homo Sapiens
LSAASPCHP

SEQ ID NO: 180416 - protein, 9 aa, Homo Sapiens
LLVNMGGTG

SEQ ID NO: 180417 - protein, 9 aa, Homo Sapiens
LLSWCGRDA

SEQ ID NO: 180418 - protein, 9 aa, Homo Sapiens
MEKFCLEQK

SEQ ID NO: 180419 - protein, 9 aa, Homo Sapiens
LKTKGRGEE

SEQ ID NO: 180420 - protein, 9 aa, Homo Sapiens
AKLLLPVAG

SEQ ID NO: 180421 - protein, 9 aa, Homo Sapiens
HLGLHLLQI

SEQ ID NO: 180422 - protein, 9 aa, Homo Sapiens
KLLLPAHAS

SEQ ID NO: 180423 - protein, 9 aa, Homo Sapiens
LCQETAIRD

SEQ ID NO: 180424 - protein, 9 aa, Homo Sapiens
VRTRGSPLR

SEQ ID NO: 180425 - protein, 9 aa, Homo Sapiens
KEVLLHYLH

SEQ ID NO: 180426 - protein, 9 aa, Homo Sapiens
SADTMWDIQ

SEQ ID NO: 180427 - protein, 9 aa, Homo Sapiens
LAKPIFQMP

SEQ ID NO: 180428 - protein, 9 aa, Homo Sapiens
ALLQFQVLK

SEQ ID NO: 180429 - protein, 9 aa, Homo Sapiens
PQLTDPTAL

SEQ ID NO: 180430 - protein, 9 aa, Homo Sapiens
LGGLITVRC

SEQ ID NO: 180431 - protein, 9 aa, Homo Sapiens
VSALLHHWL

SEQ ID NO: 180432 - protein, 9 aa, Homo Sapiens
RTLTSVPGK

SEQ ID NO: 180433 - protein, 9 aa, Homo Sapiens
IDHRWVLIA

SEQ ID NO: 180434 - protein, 9 aa, Homo Sapiens
TTMKELIDK

SEQ ID NO: 180435 - protein, 9 aa, Homo Sapiens
KARGAALQT

SEQ ID NO: 180436 - protein, 9 aa, Homo Sapiens
CEKPVLLLP

SEQ ID NO: 180437 - protein, 9 aa, Homo Sapiens
VFHVRLRQC

SEQ ID NO: 180438 - protein, 9 aa, Homo Sapiens
LASSSSSPS

SEQ ID NO: 180439 - protein, 9 aa, Homo Sapiens
QDFGDAGPR

SEQ ID NO: 180440 - protein, 9 aa, Homo Sapiens
YPKDDNIQI

SEQ ID NO: 180441 - protein, 9 aa, Homo Sapiens
VGVKGIEEK

SEQ ID NO: 180442 - protein, 9 aa, Homo Sapiens
EGKTNTEPS

SEQ ID NO: 180443 - protein, 9 aa, Homo Sapiens
HWSYQVMRH

SEQ ID NO: 180444 - protein, 9 aa, Homo Sapiens
VHAVWVQQA

SEQ ID NO: 180445 - protein, 9 aa, Homo Sapiens
NILDLLTPF

SEQ ID NO: 180446 - protein, 9 aa, Homo Sapiens
LLLWAWRLH

SEQ ID NO: 180447 - protein, 9 aa, Homo Sapiens
QRLRDEVVR

SEQ ID NO: 180448 - protein, 9 aa, Homo Sapiens
SAGLLGPFS

SEQ ID NO: 180449 - protein, 9 aa, Homo Sapiens
FHFQHLAVR

SEQ ID NO: 180450 - protein, 9 aa, Homo Sapiens
VHLLEEALH

SEQ ID NO: 180451 - protein, 9 aa, Homo Sapiens
DTYNKKWKR

SEQ ID NO: 180452 - protein, 9 aa, Homo Sapiens
LRVKALKKA

SEQ ID NO: 180453 - protein, 9 aa, Homo Sapiens
EKKFHKTCK

SEQ ID NO: 180454 - protein, 9 aa, Homo Sapiens
TSPSSASCC

SEQ ID NO: 180455 - protein, 9 aa, Homo Sapiens
HRMGGPDTV

SEQ ID NO: 180456 - protein, 9 aa, Homo Sapiens
DLDCKKIRA

SEQ ID NO: 180457 - protein, 9 aa, Homo Sapiens
ANYERQPRE

SEQ ID NO: 180458 - protein, 9 aa, Homo Sapiens
YHTTTGTWA

SEQ ID NO: 180459 - protein, 9 aa, Homo Sapiens
TLTSSWKKT

SEQ ID NO: 180460 - protein, 9 aa, Homo Sapiens
VPVAEVVGV

SEQ ID NO: 180461 - protein, 9 aa, Homo Sapiens
DFAQNFTTN

SEQ ID NO: 180462 - protein, 9 aa, Homo Sapiens
RAQMLGGLG

SEQ ID NO: 180463 - protein, 9 aa, Homo Sapiens
LKCSEDLKN

SEQ ID NO: 180464 - protein, 9 aa, Homo Sapiens
EEWPKREHG

SEQ ID NO: 180465 - protein, 9 aa, Homo Sapiens
EHAHGAVTK

SEQ ID NO: 180466 - protein, 9 aa, Homo Sapiens
ERAWLSPTA

SEQ ID NO: 180467 - protein, 9 aa, Homo Sapiens
LISGKLLLL

SEQ ID NO: 180468 - protein, 9 aa, Homo Sapiens
HRPGTPPPL

SEQ ID NO: 180469 - protein, 9 aa, Homo Sapiens
EHRMGGPDT

SEQ ID NO: 180470 - protein, 9 aa, Homo Sapiens
CCAVMCCNV

SEQ ID NO: 180471 - protein, 9 aa, Homo Sapiens
RPSSIQQME

SEQ ID NO: 180472 - protein, 9 aa, Homo Sapiens
ENHKDIAQD

SEQ ID NO: 180473 - protein, 9 aa, Homo Sapiens
KALKKASSP

SEQ ID NO: 180474 - protein, 9 aa, Homo Sapiens
SIYYFVVGG

SEQ ID NO: 180475 - protein, 9 aa, Homo Sapiens
RRYRDTKGP

SEQ ID NO: 180476 - protein, 9 aa, Homo Sapiens
VNLNLCAGP

SEQ ID NO: 180477 - protein, 9 aa, Homo Sapiens
NECDLTKAT

SEQ ID NO: 180478 - protein, 9 aa, Homo Sapiens
SSAQEFGPT

SEQ ID NO: 180479 - protein, 9 aa, Homo Sapiens
LVTLFFHSQ

SEQ ID NO: 180480 - protein, 9 aa, Homo Sapiens
PPVPSKPRR

SEQ ID NO: 180481 - protein, 9 aa, Homo Sapiens
DGRENCDGH

SEQ ID NO: 180482 - protein, 9 aa, Homo Sapiens
QRGQYGPQG

SEQ ID NO: 180483 - protein, 9 aa, Homo Sapiens
NGVKKIVPK

SEQ ID NO: 180484 - protein, 9 aa, Homo Sapiens
AEVLEEHPQ

SEQ ID NO: 180485 - protein, 9 aa, Homo Sapiens
LLLTLPCTS

SEQ ID NO: 180486 - protein, 9 aa, Homo Sapiens
LLIDNSAGT

SEQ ID NO: 180487 - protein, 9 aa, Homo Sapiens
SAEERHNRL

SEQ ID NO: 180488 - protein, 9 aa, Homo Sapiens
PRTATTPRP

SEQ ID NO: 180489 - protein, 9 aa, Homo Sapiens
SSPPQAAAA

SEQ ID NO: 180490 - protein, 9 aa, Homo Sapiens
HIALLGSLN

SEQ ID NO: 180491 - protein, 9 aa, Homo Sapiens
QFWDWKIQK

SEQ ID NO: 180492 - protein, 9 aa, Homo Sapiens
LSVANVDLL

SEQ ID NO: 180493 - protein, 9 aa, Homo Sapiens
RIGSASSLQ

SEQ ID NO: 180494 - protein, 9 aa, Homo Sapiens
RLLTQCQSH

SEQ ID NO: 180495 - protein, 9 aa, Homo Sapiens
ESHHDQQRD

SEQ ID NO: 180496 - protein, 9 aa, Homo Sapiens
PDSSDMVPV

SEQ ID NO: 180497 - protein, 9 aa, Homo Sapiens
EKIDRCILD

SEQ ID NO: 180498 - protein, 9 aa, Homo Sapiens
VAVGGQMRA

SEQ ID NO: 180499 - protein, 9 aa, Homo Sapiens
TQAPMFTQP

SEQ ID NO: 180500 - protein, 9 aa, Homo Sapiens
PLHLLSHGS

SEQ ID NO: 180501 - protein, 9 aa, Homo Sapiens
ELLGHRAEL

SEQ ID NO: 180502 - protein, 9 aa, Homo Sapiens
LFPSTHLTP

SEQ ID NO: 180503 - protein, 9 aa, Homo Sapiens
PELQPQHEG

SEQ ID NO: 180504 - protein, 9 aa, Homo Sapiens
VSLQQWHLF

SEQ ID NO: 180505 - protein, 9 aa, Homo Sapiens
VAEDHVEML

SEQ ID NO: 180506 - protein, 9 aa, Homo Sapiens
DEEWPKREH

SEQ ID NO: 180507 - protein, 9 aa, Homo Sapiens
WEPEENLRL

SEQ ID NO: 180508 - protein, 9 aa, Homo Sapiens
NEIDPPQKR

SEQ ID NO: 180509 - protein, 9 aa, Homo Sapiens
KSWGRWCWW

SEQ ID NO: 180510 - protein, 9 aa, Homo Sapiens
KSKNNKSSS

SEQ ID NO: 180511 - protein, 9 aa, Homo Sapiens
LGSRTLKSA

SEQ ID NO: 180512 - protein, 9 aa, Homo Sapiens
GNLIQNRSP

SEQ ID NO: 180513 - protein, 9 aa, Homo Sapiens
PRPSATSQT

SEQ ID NO: 180514 - protein, 9 aa, Homo Sapiens
WESPKLHCH

SEQ ID NO: 180515 - protein, 9 aa, Homo Sapiens
QEGVKKAAE

SEQ ID NO: 180516 - protein, 9 aa, Homo Sapiens
GEPWDTERN

SEQ ID NO: 180517 - protein, 9 aa, Homo Sapiens
SSSSPSSAV

SEQ ID NO: 180518 - protein, 9 aa, Homo Sapiens
EPRTVQGGV

SEQ ID NO: 180519 - protein, 9 aa, Homo Sapiens
VVALCLSAS

SEQ ID NO: 180520 - protein, 9 aa, Homo Sapiens
SWAACVNYS

SEQ ID NO: 180521 - protein, 9 aa, Homo Sapiens
NVDVGNPAL

SEQ ID NO: 180522 - protein, 9 aa, Homo Sapiens
NIKKRLFHQ

SEQ ID NO: 180523 - protein, 9 aa, Homo Sapiens
QHFPSPLPD

SEQ ID NO: 180524 - protein, 9 aa, Homo Sapiens
ESWSSQTAA

SEQ ID NO: 180525 - protein, 9 aa, Homo Sapiens
GGKEPTIDE

SEQ ID NO: 180526 - protein, 9 aa, Homo Sapiens
WWHNSEEKK

SEQ ID NO: 180527 - protein, 9 aa, Homo Sapiens
EKFIQKFVL

SEQ ID NO: 180528 - protein, 9 aa, Homo Sapiens
GPTSPSSAS

SEQ ID NO: 180529 - protein, 9 aa, Homo Sapiens
VKTHCGFLT

SEQ ID NO: 180530 - protein, 9 aa, Homo Sapiens
EVARRRLEE

SEQ ID NO: 180531 - protein, 9 aa, Homo Sapiens
KNEAQRISG

SEQ ID NO: 180532 - protein, 9 aa, Homo Sapiens
EGNSHFTYS

SEQ ID NO: 180533 - protein, 9 aa, Homo Sapiens
SQEAVAICK

SEQ ID NO: 180534 - protein, 9 aa, Homo Sapiens
NGQLDEDVE

SEQ ID NO: 180535 - protein, 9 aa, Homo Sapiens
ELQAVREML

SEQ ID NO: 180536 - protein, 9 aa, Homo Sapiens
LAPPMGVDR

SEQ ID NO: 180537 - protein, 9 aa, Homo Sapiens
EKSLRMQNA

SEQ ID NO: 180538 - protein, 9 aa, Homo Sapiens
SVSVQFVQL

SEQ ID NO: 180539 - protein, 9 aa, Homo Sapiens
WFLSPTLGL

SEQ ID NO: 180540 - protein, 9 aa, Homo Sapiens
ICFRNALLL

SEQ ID NO: 180541 - protein, 9 aa, Homo Sapiens
QQEFAASRA

SEQ ID NO: 180542 - protein, 9 aa, Homo Sapiens
EENLRLSRI

SEQ ID NO: 180543 - protein, 9 aa, Homo Sapiens
QKSKGLNQR

SEQ ID NO: 180544 - protein, 9 aa, Homo Sapiens
WMPRMRQLQ

SEQ ID NO: 180545 - protein, 9 aa, Homo Sapiens
KGHSFEVGV

SEQ ID NO: 180546 - protein, 9 aa, Homo Sapiens
EGSRAFYRG

SEQ ID NO: 180547 - protein, 9 aa, Homo Sapiens
ALKAEHTNW

SEQ ID NO: 180548 - protein, 9 aa, Homo Sapiens
EDVNKKRKT

SEQ ID NO: 180549 - protein, 9 aa, Homo Sapiens
CGHLKPSGE

SEQ ID NO: 180550 - protein, 9 aa, Homo Sapiens
CGWWAPACT

SEQ ID NO: 180551 - protein, 9 aa, Homo Sapiens
KTVLRMPMH

SEQ ID NO: 180552 - protein, 9 aa, Homo Sapiens
VGAGRGQAH

SEQ ID NO: 180553 - protein, 9 aa, Homo Sapiens
EPGAAVPAP

SEQ ID NO: 180554 - protein, 9 aa, Homo Sapiens
NGFNKKCKK

SEQ ID NO: 180555 - protein, 9 aa, Homo Sapiens
PQGPSCSRG

SEQ ID NO: 180556 - protein, 9 aa, Homo Sapiens
SGYQALPWA

SEQ ID NO: 180557 - protein, 9 aa, Homo Sapiens
RQLQSSHYG

SEQ ID NO: 180558 - protein, 9 aa, Homo Sapiens
IFCRTKNDC

SEQ ID NO: 180559 - protein, 9 aa, Homo Sapiens
PMWQLASLV

SEQ ID NO: 180560 - protein, 9 aa, Homo Sapiens
DMPPLPQES

SEQ ID NO: 180561 - protein, 9 aa, Homo Sapiens
NGAVSGSVR

SEQ ID NO: 180562 - protein, 9 aa, Homo Sapiens
GKEKKVPPL

SEQ ID NO: 180563 - protein, 9 aa, Homo Sapiens
PTSLIIQMP

SEQ ID NO: 180564 - protein, 9 aa, Homo Sapiens
AGAATMKKP

SEQ ID NO: 180565 - protein, 9 aa, Homo Sapiens
PPRICPSLS

SEQ ID NO: 180566 - protein, 9 aa, Homo Sapiens
GFTKFNVDE

SEQ ID NO: 180567 - protein, 9 aa, Homo Sapiens
LQPNMDFMD

SEQ ID NO: 180568 - protein, 9 aa, Homo Sapiens
WARYITQSG

SEQ ID NO: 180569 - protein, 9 aa, Homo Sapiens
PCASLCARV

SEQ ID NO: 180570 - protein, 9 aa, Homo Sapiens
DSLLAFGIV

SEQ ID NO: 180571 - protein, 9 aa, Homo Sapiens
AGNSFQENV

SEQ ID NO: 180572 - protein, 9 aa, Homo Sapiens
SALLPRHPT

SEQ ID NO: 180573 - protein, 9 aa, Homo Sapiens
DGAGTIFTI

SEQ ID NO: 180574 - protein, 9 aa, Homo Sapiens
TSTLGSSPS

SEQ ID NO: 180575 - protein, 9 aa, Homo Sapiens
YQPPNLASS

SEQ ID NO: 180576 - protein, 9 aa, Homo Sapiens
GIGAGVSLR

SEQ ID NO: 180577 - protein, 9 aa, Homo Sapiens
AAAVSAKDI

SEQ ID NO: 180578 - protein, 9 aa, Homo Sapiens
TWKGPEHLA

SEQ ID NO: 180579 - protein, 9 aa, Homo Sapiens
RIRPRGRYI

SEQ ID NO: 180580 - protein, 9 aa, Homo Sapiens
KPTESSAVA

SEQ ID NO: 180581 - protein, 9 aa, Homo Sapiens
IFFQTGVLA

SEQ ID NO: 180582 - protein, 9 aa, Homo Sapiens
YHENAAPTG

SEQ ID NO: 180583 - protein, 9 aa, Homo Sapiens
RLKIQYQMH

SEQ ID NO: 180584 - protein, 9 aa, Homo Sapiens
QVEVLLLRV

SEQ ID NO: 180585 - protein, 9 aa, Homo Sapiens
EMENQIAVS

SEQ ID NO: 180586 - protein, 9 aa, Homo Sapiens
FPWGLLPEC

SEQ ID NO: 180587 - protein, 9 aa, Homo Sapiens
RGNWWRKSW

SEQ ID NO: 180588 - protein, 9 aa, Homo Sapiens
VHVCSSTRG

SEQ ID NO: 180589 - protein, 9 aa, Homo Sapiens
DTSVAVKMD

SEQ ID NO: 180590 - protein, 9 aa, Homo Sapiens
KMTSSDKLL

SEQ ID NO: 180591 - protein, 9 aa, Homo Sapiens
QNGVLSTPA

SEQ ID NO: 180592 - protein, 9 aa, Homo Sapiens
ILHSSCLHG

SEQ ID NO: 180593 - protein, 9 aa, Homo Sapiens
ERAWRLEAL

SEQ ID NO: 180594 - protein, 9 aa, Homo Sapiens
DAGVCVLRK

SEQ ID NO: 180595 - protein, 9 aa, Homo Sapiens
SGRAPPPSS

SEQ ID NO: 180596 - protein, 9 aa, Homo Sapiens
VGMRLEAVH

SEQ ID NO: 180597 - protein, 9 aa, Homo Sapiens
SGLQGCVQV

SEQ ID NO: 180598 - protein, 9 aa, Homo Sapiens
QIPGLLGSP

SEQ ID NO: 180599 - protein, 9 aa, Homo Sapiens
WLKGCAKEA

SEQ ID NO: 180600 - protein, 9 aa, Homo Sapiens
VYWKGWFGT

SEQ ID NO: 180601 - protein, 9 aa, Homo Sapiens
VDELERKLG

SEQ ID NO: 180602 - protein, 9 aa, Homo Sapiens
ASLEKENNL

SEQ ID NO: 180603 - protein, 9 aa, Homo Sapiens
LRHAPRLSK

SEQ ID NO: 180604 - protein, 9 aa, Homo Sapiens
VRGDIFRPP

SEQ ID NO: 180605 - protein, 9 aa, Homo Sapiens
HAVINYDTS

SEQ ID NO: 180606 - protein, 9 aa, Homo Sapiens
PGLHRLEIC

SEQ ID NO: 180607 - protein, 9 aa, Homo Sapiens
SYNRSSGNF

SEQ ID NO: 180608 - protein, 9 aa, Homo Sapiens
AQQNCVVGA

SEQ ID NO: 180609 - protein, 9 aa, Homo Sapiens
PTTRRSPLP

SEQ ID NO: 180610 - protein, 9 aa, Homo Sapiens
TAQSHQPDP

SEQ ID NO: 180611 - protein, 9 aa, Homo Sapiens
RSQQIKTSH

SEQ ID NO: 180612 - protein, 9 aa, Homo Sapiens
TSNICQPME

SEQ ID NO: 180613 - protein, 9 aa, Homo Sapiens
VPLEAFVFP

SEQ ID NO: 180614 - protein, 9 aa, Homo Sapiens
TRCTTNMVQ

SEQ ID NO: 180615 - protein, 9 aa, Homo Sapiens
CCLRIHCVA

SEQ ID NO: 180616 - protein, 9 aa, Homo Sapiens
IDRCILDRK

SEQ ID NO: 180617 - protein, 9 aa, Homo Sapiens
EVKTHCGFL

SEQ ID NO: 180618 - protein, 9 aa, Homo Sapiens
QLVAVGGQM

SEQ ID NO: 180619 - protein, 9 aa, Homo Sapiens
RSSVPWSAG

SEQ ID NO: 180620 - protein, 9 aa, Homo Sapiens
EKPVLLLPT

SEQ ID NO: 180621 - protein, 9 aa, Homo Sapiens
DGLRTHDLT

SEQ ID NO: 180622 - protein, 9 aa, Homo Sapiens
ATQLALCMQ

SEQ ID NO: 180623 - protein, 9 aa, Homo Sapiens
AVLSLNASG

SEQ ID NO: 180624 - protein, 9 aa, Homo Sapiens
QGAPQWPLS

SEQ ID NO: 180625 - protein, 9 aa, Homo Sapiens
HRYSTDSSS

SEQ ID NO: 180626 - protein, 9 aa, Homo Sapiens
VQGSLQTSS

SEQ ID NO: 180627 - protein, 9 aa, Homo Sapiens
RDTKGPFLI

SEQ ID NO: 180628 - protein, 9 aa, Homo Sapiens
RRLKRFRAS

SEQ ID NO: 180629 - protein, 9 aa, Homo Sapiens
RRVKSASII

SEQ ID NO: 180630 - protein, 9 aa, Homo Sapiens
QMEKFCLEQ

SEQ ID NO: 180631 - protein, 9 aa, Homo Sapiens
MQKFMEDLK

SEQ ID NO: 180632 - protein, 9 aa, Homo Sapiens
CSDKHFYSL

SEQ ID NO: 180633 - protein, 9 aa, Homo Sapiens
DLSRGHAAV

SEQ ID NO: 180634 - protein, 9 aa, Homo Sapiens
RKKRPEDFE

SEQ ID NO: 180635 - protein, 9 aa, Homo Sapiens
VPEGPAHPT

SEQ ID NO: 180636 - protein, 9 aa, Homo Sapiens
SRTLKSARS

SEQ ID NO: 180637 - protein, 9 aa, Homo Sapiens
SSCLHGNTA

SEQ ID NO: 180638 - protein, 9 aa, Homo Sapiens
VLSIFIACW

SEQ ID NO: 180639 - protein, 9 aa, Homo Sapiens
RLLLQEEQE

SEQ ID NO: 180640 - protein, 9 aa, Homo Sapiens
LLTGGKMCW

SEQ ID NO: 180641 - protein, 9 aa, Homo Sapiens
TATTPRPGR

SEQ ID NO: 180642 - protein, 9 aa, Homo Sapiens
DWKIQKTPW

SEQ ID NO: 180643 - protein, 9 aa, Homo Sapiens
LHDPVLLAI

SEQ ID NO: 180644 - protein, 9 aa, Homo Sapiens
AMPPGHTCM

SEQ ID NO: 180645 - protein, 9 aa, Homo Sapiens
VINYDTSTD

SEQ ID NO: 180646 - protein, 9 aa, Homo Sapiens
MNKLENHKD

SEQ ID NO: 180647 - protein, 9 aa, Homo Sapiens
NFLSKTVRA

SEQ ID NO: 180648 - protein, 9 aa, Homo Sapiens
SEDNSGGGK

SEQ ID NO: 180649 - protein, 9 aa, Homo Sapiens
NLSSRDHKS

SEQ ID NO: 180650 - protein, 9 aa, Homo Sapiens
GRGHPDGGG

SEQ ID NO: 180651 - protein, 9 aa, Homo Sapiens
PSEVVFWMT

SEQ ID NO: 180652 - protein, 9 aa, Homo Sapiens
FLRDQWNWL

SEQ ID NO: 180653 - protein, 9 aa, Homo Sapiens
LQSAKKRAS

SEQ ID NO: 180654 - protein, 9 aa, Homo Sapiens
IQQPIPLPS

SEQ ID NO: 180655 - protein, 9 aa, Homo Sapiens
GGVFSNPAV

SEQ ID NO: 180656 - protein, 9 aa, Homo Sapiens
PPTKKRGKS

SEQ ID NO: 180657 - protein, 9 aa, Homo Sapiens
KSPSNTKVP

SEQ ID NO: 180658 - protein, 9 aa, Homo Sapiens
CPARAAVCT

SEQ ID NO: 180659 - protein, 9 aa, Homo Sapiens
CGICLVRNE

SEQ ID NO: 180660 - protein, 9 aa, Homo Sapiens
AVKMDNSRD

SEQ ID NO: 180661 - protein, 9 aa, Homo Sapiens
LVNKSLLSL

SEQ ID NO: 180662 - protein, 9 aa, Homo Sapiens
ATMKKPSPS

SEQ ID NO: 180663 - protein, 9 aa, Homo Sapiens
HILVFSRTQ

SEQ ID NO: 180664 - protein, 9 aa, Homo Sapiens
LSVGKPSVG

SEQ ID NO: 180665 - protein, 9 aa, Homo Sapiens
KFVLFDEKH

SEQ ID NO: 180666 - protein, 9 aa, Homo Sapiens
VQGQQVHRL

SEQ ID NO: 180667 - protein, 9 aa, Homo Sapiens
TQRECCSHC

SEQ ID NO: 180668 - protein, 9 aa, Homo Sapiens
KLKTRMHQA

SEQ ID NO: 180669 - protein, 9 aa, Homo Sapiens
GGGSHLYYS

SEQ ID NO: 180670 - protein, 9 aa, Homo Sapiens
SNWIQKTAT

SEQ ID NO: 180671 - protein, 9 aa, Homo Sapiens
RVHVPWRTP

SEQ ID NO: 180672 - protein, 9 aa, Homo Sapiens
QLIKPSRMC

SEQ ID NO: 180673 - protein, 9 aa, Homo Sapiens
VFLQFLDCA

SEQ ID NO: 180674 - protein, 9 aa, Homo Sapiens
VFDSGLMVI

SEQ ID NO: 180675 - protein, 9 aa, Homo Sapiens
GHIREHDSY

SEQ ID NO: 180676 - protein, 9 aa, Homo Sapiens
QAELFVLLC

SEQ ID NO: 180677 - protein, 9 aa, Homo Sapiens
HMNVNSVGS

SEQ ID NO: 180678 - protein, 9 aa, Homo Sapiens
LLLLLHRVL

SEQ ID NO: 180679 - protein, 9 aa, Homo Sapiens
HLEKMEITH

SEQ ID NO: 180680 - protein, 9 aa, Homo Sapiens
RPDLEEAVS

SEQ ID NO: 180681 - protein, 9 aa, Homo Sapiens
AHENPFRGK

SEQ ID NO: 180682 - protein, 9 aa, Homo Sapiens
EAMDRSETP

SEQ ID NO: 180683 - protein, 9 aa, Homo Sapiens
LRKKLFRIR

SEQ ID NO: 180684 - protein, 9 aa, Homo Sapiens
RRGAAGRQR

SEQ ID NO: 180685 - protein, 9 aa, Homo Sapiens
MTNKATKQR

SEQ ID NO: 180686 - protein, 9 aa, Homo Sapiens
LLFSIRRWS

SEQ ID NO: 180687 - protein, 9 aa, Homo Sapiens
ECHLNKMQN

SEQ ID NO: 180688 - protein, 9 aa, Homo Sapiens
QGHQIFGSF

SEQ ID NO: 180689 - protein, 9 aa, Homo Sapiens
YLSSLPYSA

SEQ ID NO: 180690 - protein, 9 aa, Homo Sapiens
RAEPLIQDN

SEQ ID NO: 180691 - protein, 9 aa, Homo Sapiens
GQALAQLVA

SEQ ID NO: 180692 - protein, 9 aa, Homo Sapiens
IDQSIDFKI

SEQ ID NO: 180693 - protein, 9 aa, Homo Sapiens
GELGGGWIC

SEQ ID NO: 180694 - protein, 9 aa, Homo Sapiens
VPKRRMVYH

SEQ ID NO: 180695 - protein, 9 aa, Homo Sapiens
KDIVPGDNV

SEQ ID NO: 180696 - protein, 9 aa, Homo Sapiens
ASCEDGCAE

SEQ ID NO: 180697 - protein, 9 aa, Homo Sapiens
NYSEDLPQA

SEQ ID NO: 180698 - protein, 9 aa, Homo Sapiens
AGARRGRWS

SEQ ID NO: 180699 - protein, 9 aa, Homo Sapiens
SSIRAALRK

SEQ ID NO: 180700 - protein, 9 aa, Homo Sapiens
AAKDTILQL

SEQ ID NO: 180701 - protein, 9 aa, Homo Sapiens
ADVLVCLLF

SEQ ID NO: 180702 - protein, 9 aa, Homo Sapiens
WWRKSWGRW

SEQ ID NO: 180703 - protein, 9 aa, Homo Sapiens
SVQNLDGHI

SEQ ID NO: 180704 - protein, 9 aa, Homo Sapiens
CGMREMRAG

SEQ ID NO: 180705 - protein, 9 aa, Homo Sapiens
PVIQVKALI

SEQ ID NO: 180706 - protein, 9 aa, Homo Sapiens
QGPWPMHPD

SEQ ID NO: 180707 - protein, 9 aa, Homo Sapiens
WHDPHPWRS

SEQ ID NO: 180708 - protein, 9 aa, Homo Sapiens
IYLAKPIFQ

SEQ ID NO: 180709 - protein, 9 aa, Homo Sapiens
RLRVFDSGL

SEQ ID NO: 180710 - protein, 9 aa, Homo Sapiens
RQLQSAGLL

SEQ ID NO: 180711 - protein, 9 aa, Homo Sapiens
SAEKLMHIC

SEQ ID NO: 180712 - protein, 9 aa, Homo Sapiens
GLGQLPKEE

SEQ ID NO: 180713 - protein, 9 aa, Homo Sapiens
ERIEWSLSI

SEQ ID NO: 180714 - protein, 9 aa, Homo Sapiens
KGKEKKVPP

SEQ ID NO: 180715 - protein, 9 aa, Homo Sapiens
LPVVLWIIF

SEQ ID NO: 180716 - protein, 9 aa, Homo Sapiens
RNLRPLSLQ

SEQ ID NO: 180717 - protein, 9 aa, Homo Sapiens
QEITRSRKK

SEQ ID NO: 180718 - protein, 9 aa, Homo Sapiens
QYQMHLRSF

SEQ ID NO: 180719 - protein, 9 aa, Homo Sapiens
EQRNMPTEE

SEQ ID NO: 180720 - protein, 9 aa, Homo Sapiens
VKKIVPKKK

SEQ ID NO: 180721 - protein, 9 aa, Homo Sapiens
FLLTGGKMC

SEQ ID NO: 180722 - protein, 9 aa, Homo Sapiens
HRWVLIAAH

SEQ ID NO: 180723 - protein, 9 aa, Homo Sapiens
KKWKRFVVV

SEQ ID NO: 180724 - protein, 9 aa, Homo Sapiens
EDAQAIQNP

SEQ ID NO: 180725 - protein, 9 aa, Homo Sapiens
LGYCLLLVL

SEQ ID NO: 180726 - protein, 9 aa, Homo Sapiens
TGTHAKLPG

SEQ ID NO: 180727 - protein, 9 aa, Homo Sapiens
LLCPHSPKP

SEQ ID NO: 180728 - protein, 9 aa, Homo Sapiens
VSQTSPNPA

SEQ ID NO: 180729 - protein, 9 aa, Homo Sapiens
DGTLCSETD

SEQ ID NO: 180730 - protein, 9 aa, Homo Sapiens
TIFGDPHSQ

SEQ ID NO: 180731 - protein, 9 aa, Homo Sapiens
SRPALLRKT

SEQ ID NO: 180732 - protein, 9 aa, Homo Sapiens
GANPEDVIT

SEQ ID NO: 180733 - protein, 9 aa, Homo Sapiens
PEECHLNKM

SEQ ID NO: 180734 - protein, 9 aa, Homo Sapiens
ALVKTWTQF

SEQ ID NO: 180735 - protein, 9 aa, Homo Sapiens
FGSFLLISG

SEQ ID NO: 180736 - protein, 9 aa, Homo Sapiens
KKASSPGHP

SEQ ID NO: 180737 - protein, 9 aa, Homo Sapiens
KLADLWGKR

SEQ ID NO: 180738 - protein, 9 aa, Homo Sapiens
GQQALAEVL

SEQ ID NO: 180739 - protein, 9 aa, Homo Sapiens
LKTPHVSPQ

SEQ ID NO: 180740 - protein, 9 aa, Homo Sapiens
LPTNKIDAA

SEQ ID NO: 180741 - protein, 9 aa, Homo Sapiens
IRVIRTDTF

SEQ ID NO: 180742 - protein, 9 aa, Homo Sapiens
RTEFIDELE

SEQ ID NO: 180743 - protein, 9 aa, Homo Sapiens
DTLKTKGRG

SEQ ID NO: 180744 - protein, 9 aa, Homo Sapiens
GFCLHQFPR

SEQ ID NO: 180745 - protein, 9 aa, Homo Sapiens
TCISWMLLK

SEQ ID NO: 180746 - protein, 9 aa, Homo Sapiens
LDPTITCSS

SEQ ID NO: 180747 - protein, 9 aa, Homo Sapiens
RNLILRKPE

SEQ ID NO: 180748 - protein, 9 aa, Homo Sapiens
PCLPVRPGS

SEQ ID NO: 180749 - protein, 9 aa, Homo Sapiens
TVCWRGSTR

SEQ ID NO: 180750 - protein, 9 aa, Homo Sapiens
PQADVGFKF

SEQ ID NO: 180751 - protein, 9 aa, Homo Sapiens
ENGVKKIVP

SEQ ID NO: 180752 - protein, 9 aa, Homo Sapiens
TMKKPSPSK

SEQ ID NO: 180753 - protein, 9 aa, Homo Sapiens
QVGLHLGLH

SEQ ID NO: 180754 - protein, 9 aa, Homo Sapiens
ASAVSTAAS

SEQ ID NO: 180755 - protein, 9 aa, Homo Sapiens
DATVGMPLI

SEQ ID NO: 180756 - protein, 9 aa, Homo Sapiens
VSHLRPEPA

SEQ ID NO: 180757 - protein, 9 aa, Homo Sapiens
LHTARTDWW

SEQ ID NO: 180758 - protein, 9 aa, Homo Sapiens
GDGAGTIFT

SEQ ID NO: 180759 - protein, 9 aa, Homo Sapiens
TPLPLVTTP

SEQ ID NO: 180760 - protein, 9 aa, Homo Sapiens
QNPEKLALK

SEQ ID NO: 180761 - protein, 9 aa, Homo Sapiens
CTHHTNTLS

SEQ ID NO: 180762 - protein, 9 aa, Homo Sapiens
SCQEGCQLM

SEQ ID NO: 180763 - protein, 9 aa, Homo Sapiens
AEDMEGTEF

SEQ ID NO: 180764 - protein, 9 aa, Homo Sapiens
DLWGKRKGN

SEQ ID NO: 180765 - protein, 9 aa, Homo Sapiens
ARQQPCERQ

SEQ ID NO: 180766 - protein, 9 aa, Homo Sapiens
PPEAAFQRM

SEQ ID NO: 180767 - protein, 9 aa, Homo Sapiens
MPPLPQESP

SEQ ID NO: 180768 - protein, 9 aa, Homo Sapiens
HMRNHTFIV

SEQ ID NO: 180769 - protein, 9 aa, Homo Sapiens
IILKEVEYH

SEQ ID NO: 180770 - protein, 9 aa, Homo Sapiens
AKGEKPSSP

SEQ ID NO: 180771 - protein, 9 aa, Homo Sapiens
KALIVVHLI

SEQ ID NO: 180772 - protein, 9 aa, Homo Sapiens
LIQNRSPTP

SEQ ID NO: 180773 - protein, 9 aa, Homo Sapiens
SVLTALLQF

SEQ ID NO: 180774 - protein, 9 aa, Homo Sapiens
NETPKKKEA

SEQ ID NO: 180775 - protein, 9 aa, Homo Sapiens
NLNLCAGPS

SEQ ID NO: 180776 - protein, 9 aa, Homo Sapiens
HLAHLSAAS

SEQ ID NO: 180777 - protein, 9 aa, Homo Sapiens
DPAPPPLKV

SEQ ID NO: 180778 - protein, 9 aa, Homo Sapiens
LMEKKINNQ

SEQ ID NO: 180779 - protein, 9 aa, Homo Sapiens
ERTDLQLHT

SEQ ID NO: 180780 - protein, 9 aa, Homo Sapiens
REHKHRAKD

SEQ ID NO: 180781 - protein, 9 aa, Homo Sapiens
QDDTTEQEQ

SEQ ID NO: 180782 - protein, 9 aa, Homo Sapiens
RITFVLLML

SEQ ID NO: 180783 - protein, 9 aa, Homo Sapiens
VSFWTLLPT

SEQ ID NO: 180784 - protein, 9 aa, Homo Sapiens
DSAGHGHIC

SEQ ID NO: 180785 - protein, 9 aa, Homo Sapiens
GRTEFIDEL

SEQ ID NO: 180786 - protein, 9 aa, Homo Sapiens
LCQQGHIQA

SEQ ID NO: 180787 - protein, 9 aa, Homo Sapiens
HGGRSDDEV

SEQ ID NO: 180788 - protein, 9 aa, Homo Sapiens
PASTLARLE

SEQ ID NO: 180789 - protein, 9 aa, Homo Sapiens
KQYLFSRVL

SEQ ID NO: 180790 - protein, 9 aa, Homo Sapiens
KRLWAGSRI

SEQ ID NO: 180791 - protein, 9 aa, Homo Sapiens
EPAKTRVSS

SEQ ID NO: 180792 - protein, 9 aa, Homo Sapiens
VDESGPPVP

SEQ ID NO: 180793 - protein, 9 aa, Homo Sapiens
QPDPDHPWH

SEQ ID NO: 180794 - protein, 9 aa, Homo Sapiens
KMNKLENHK

SEQ ID NO: 180795 - protein, 9 aa, Homo Sapiens
VPWTHLTHY

SEQ ID NO: 180796 - protein, 9 aa, Homo Sapiens
PPTSGTTRT

SEQ ID NO: 180797 - protein, 9 aa, Homo Sapiens
RSTVWLSLI

SEQ ID NO: 180798 - protein, 9 aa, Homo Sapiens
LVCLLFLLA

SEQ ID NO: 180799 - protein, 9 aa, Homo Sapiens
CIRRTQNAE

SEQ ID NO: 180800 - protein, 9 aa, Homo Sapiens
YGLPFPKIL

SEQ ID NO: 180801 - protein, 9 aa, Homo Sapiens
WRGCPLRGH

SEQ ID NO: 180802 - protein, 9 aa, Homo Sapiens
GLQGCVQVT

SEQ ID NO: 180803 - protein, 9 aa, Homo Sapiens
TVYFHTRCW

SEQ ID NO: 180804 - protein, 9 aa, Homo Sapiens
APTPEEHAH

SEQ ID NO: 180805 - protein, 9 aa, Homo Sapiens
ALDVKKDKG

SEQ ID NO: 180806 - protein, 9 aa, Homo Sapiens
PSPTDHPGL

SEQ ID NO: 180807 - protein, 9 aa, Homo Sapiens
RTVLSKILT

SEQ ID NO: 180808 - protein, 9 aa, Homo Sapiens
GPPGTTPPR

SEQ ID NO: 180809 - protein, 9 aa, Homo Sapiens
AGKESRSRR

SEQ ID NO: 180810 - protein, 9 aa, Homo Sapiens
AAVSAKDIY

SEQ ID NO: 180811 - protein, 9 aa, Homo Sapiens
YSEDLPQAV

SEQ ID NO: 180812 - protein, 9 aa, Homo Sapiens
ALAQLVAVG

SEQ ID NO: 180813 - protein, 9 aa, Homo Sapiens
CYTLKTVTV

SEQ ID NO: 180814 - protein, 9 aa, Homo Sapiens
RVQRIPKVG

SEQ ID NO: 180815 - protein, 9 aa, Homo Sapiens
GMQGADIQG

SEQ ID NO: 180816 - protein, 9 aa, Homo Sapiens
KQMPPVMLK

SEQ ID NO: 180817 - protein, 9 aa, Homo Sapiens
QERQQYQRA

SEQ ID NO: 180818 - protein, 9 aa, Homo Sapiens
VADFRKIAS

SEQ ID NO: 180819 - protein, 9 aa, Homo Sapiens
GGNVKQTDA

SEQ ID NO: 180820 - protein, 9 aa, Homo Sapiens
LWSTPAPQK

SEQ ID NO: 180821 - protein, 9 aa, Homo Sapiens
AIQVFHVRL

SEQ ID NO: 180822 - protein, 9 aa, Homo Sapiens
FQVLKQSQN

SEQ ID NO: 180823 - protein, 9 aa, Homo Sapiens
LTANDNLKV

SEQ ID NO: 180824 - protein, 9 aa, Homo Sapiens
TGCYTLKTV

SEQ ID NO: 180825 - protein, 9 aa, Homo Sapiens
PGGPKGSKG

SEQ ID NO: 180826 - protein, 9 aa, Homo Sapiens
FWDNVCLTY

SEQ ID NO: 180827 - protein, 9 aa, Homo Sapiens
LLAIRLLTQ

SEQ ID NO: 180828 - protein, 9 aa, Homo Sapiens
RRRRRIPRR

SEQ ID NO: 180829 - protein, 9 aa, Homo Sapiens
AAPASPSRR

SEQ ID NO: 180830 - protein, 9 aa, Homo Sapiens
ALSSSPSAL

SEQ ID NO: 180831 - protein, 9 aa, Homo Sapiens
IHPAEDMEG

SEQ ID NO: 180832 - protein, 9 aa, Homo Sapiens
HMPVASSEA

SEQ ID NO: 180833 - protein, 9 aa, Homo Sapiens
PRSSLISIY

SEQ ID NO: 180834 - protein, 9 aa, Homo Sapiens
MGGTRKASA

SEQ ID NO: 180835 - protein, 9 aa, Homo Sapiens
KLVAYKCKP

SEQ ID NO: 180836 - protein, 9 aa, Homo Sapiens
QLNEWCPFV

SEQ ID NO: 180837 - protein, 9 aa, Homo Sapiens
QGHVNHGFV

SEQ ID NO: 180838 - protein, 9 aa, Homo Sapiens
PFFYNRPIT

SEQ ID NO: 180839 - protein, 9 aa, Homo Sapiens
QPSHHHPLT

SEQ ID NO: 180840 - protein, 9 aa, Homo Sapiens
PGETSPTAT

SEQ ID NO: 180841 - protein, 9 aa, Homo Sapiens
INVPENSHG

SEQ ID NO: 180842 - protein, 9 aa, Homo Sapiens
LDGNNMGWS

SEQ ID NO: 180843 - protein, 9 aa, Homo Sapiens
SWKASPCSR

SEQ ID NO: 180844 - protein, 9 aa, Homo Sapiens
YGCTNGRQM

SEQ ID NO: 180845 - protein, 9 aa, Homo Sapiens
LRLTDMNYS

SEQ ID NO: 180846 - protein, 9 aa, Homo Sapiens
SPQPLTQGP

SEQ ID NO: 180847 - protein, 9 aa, Homo Sapiens
TSCGDSDSR

SEQ ID NO: 180848 - protein, 9 aa, Homo Sapiens
NICQPMEIL

SEQ ID NO: 180849 - protein, 9 aa, Homo Sapiens
VEGLTLYIT

SEQ ID NO: 180850 - protein, 9 aa, Homo Sapiens
IILTSGKYR

SEQ ID NO: 180851 - protein, 9 aa, Homo Sapiens
QPQTPQDSR

SEQ ID NO: 180852 - protein, 9 aa, Homo Sapiens
GRLPPGPRP

SEQ ID NO: 180853 - protein, 9 aa, Homo Sapiens
FGLSDEHIS

SEQ ID NO: 180854 - protein, 9 aa, Homo Sapiens
YLRRRASLE

SEQ ID NO: 180855 - protein, 9 aa, Homo Sapiens
GRHRVITIL

SEQ ID NO: 180856 - protein, 9 aa, Homo Sapiens
VARRRLEEE

SEQ ID NO: 180857 - protein, 9 aa, Homo Sapiens
VPKGVIYAT

SEQ ID NO: 180858 - protein, 9 aa, Homo Sapiens
GPRTNGQEA

SEQ ID NO: 180859 - protein, 9 aa, Homo Sapiens
RWNTFNSIW

SEQ ID NO: 180860 - protein, 9 aa, Homo Sapiens
VPNSSPCPL

SEQ ID NO: 180861 - protein, 9 aa, Homo Sapiens
EKMPESWGP

SEQ ID NO: 180862 - protein, 9 aa, Homo Sapiens
NSSRSMVAS

SEQ ID NO: 180863 - protein, 9 aa, Homo Sapiens
FTFPTVWES

SEQ ID NO: 180864 - protein, 9 aa, Homo Sapiens
RRASLEKSA

SEQ ID NO: 180865 - protein, 9 aa, Homo Sapiens
QGPSCSRGS

SEQ ID NO: 180866 - protein, 9 aa, Homo Sapiens
KIMGVEEDD

SEQ ID NO: 180867 - protein, 9 aa, Homo Sapiens
PCPPPQRTV

SEQ ID NO: 180868 - protein, 9 aa, Homo Sapiens
LLRKTKCRP

SEQ ID NO: 180869 - protein, 9 aa, Homo Sapiens
KEPRAKNIS

SEQ ID NO: 180870 - protein, 9 aa, Homo Sapiens
AVEQMAESC

SEQ ID NO: 180871 - protein, 9 aa, Homo Sapiens
KGERWTFIS

SEQ ID NO: 180872 - protein, 9 aa, Homo Sapiens
SVWTLQRSM

SEQ ID NO: 180873 - protein, 9 aa, Homo Sapiens
IGQVDGLIS

SEQ ID NO: 180874 - protein, 9 aa, Homo Sapiens
SSVPWSAGC

SEQ ID NO: 180875 - protein, 9 aa, Homo Sapiens
LPWRGCPLR

SEQ ID NO: 180876 - protein, 9 aa, Homo Sapiens
NLILRKPEW

SEQ ID NO: 180877 - protein, 9 aa, Homo Sapiens
EMDFSLPPS

SEQ ID NO: 180878 - protein, 9 aa, Homo Sapiens
LLVTLFFHS

SEQ ID NO: 180879 - protein, 9 aa, Homo Sapiens
GNHSHKPPR

SEQ ID NO: 180880 - protein, 9 aa, Homo Sapiens
AVLLAVLDH

SEQ ID NO: 180881 - protein, 9 aa, Homo Sapiens
FNSIWDQNQ

SEQ ID NO: 180882 - protein, 9 aa, Homo Sapiens
FLEGMDICL

SEQ ID NO: 180883 - protein, 9 aa, Homo Sapiens
IFDKLLLPA

SEQ ID NO: 180884 - protein, 9 aa, Homo Sapiens
PSPFEGKTN

SEQ ID NO: 180885 - protein, 9 aa, Homo Sapiens
SVVQQDLQS

SEQ ID NO: 180886 - protein, 9 aa, Homo Sapiens
MHICTDQLG

SEQ ID NO: 180887 - protein, 9 aa, Homo Sapiens
AVRRKLHSW

SEQ ID NO: 180888 - protein, 9 aa, Homo Sapiens
RTGSRPCAG

SEQ ID NO: 180889 - protein, 9 aa, Homo Sapiens
GRVMVKATF

SEQ ID NO: 180890 - protein, 9 aa, Homo Sapiens
SMPFSLNSP

SEQ ID NO: 180891 - protein, 9 aa, Homo Sapiens
AELFAQLAE

SEQ ID NO: 180892 - protein, 9 aa, Homo Sapiens
AWGGAPLQE

SEQ ID NO: 180893 - protein, 9 aa, Homo Sapiens
LDGLLFCRV

SEQ ID NO: 180894 - protein, 9 aa, Homo Sapiens
VGSGQRAHQ

SEQ ID NO: 180895 - protein, 9 aa, Homo Sapiens
HCTMRGARG

SEQ ID NO: 180896 - protein, 9 aa, Homo Sapiens
MRGARGILS

SEQ ID NO: 180897 - protein, 9 aa, Homo Sapiens
EEHAHGAVT

SEQ ID NO: 180898 - protein, 9 aa, Homo Sapiens
KDRHFAYGR

SEQ ID NO: 180899 - protein, 9 aa, Homo Sapiens
ELSPCLPVR

SEQ ID NO: 180900 - protein, 9 aa, Homo Sapiens
GRQRAHGQG

SEQ ID NO: 180901 - protein, 9 aa, Homo Sapiens
RALQQEFAA

SEQ ID NO: 180902 - protein, 9 aa, Homo Sapiens
YRCYEVIMT

SEQ ID NO: 180903 - protein, 9 aa, Homo Sapiens
VLLESLKAR

SEQ ID NO: 180904 - protein, 9 aa, Homo Sapiens
KCYGMASHL

SEQ ID NO: 180905 - protein, 9 aa, Homo Sapiens
GAGRGQAHA

SEQ ID NO: 180906 - protein, 9 aa, Homo Sapiens
CPFVELVAG

SEQ ID NO: 180907 - protein, 9 aa, Homo Sapiens
GKKCGIIIL

SEQ ID NO: 180908 - protein, 9 aa, Homo Sapiens
TPQVNSPRS

SEQ ID NO: 180909 - protein, 9 aa, Homo Sapiens
ATVGTPIAD

SEQ ID NO: 180910 - protein, 9 aa, Homo Sapiens
FDSGLMVIE

SEQ ID NO: 180911 - protein, 9 aa, Homo Sapiens
KVEGLNVCE

SEQ ID NO: 180912 - protein, 9 aa, Homo Sapiens
TTAWSPGEG

SEQ ID NO: 180913 - protein, 9 aa, Homo Sapiens
LGHLSPPKQ

SEQ ID NO: 180914 - protein, 9 aa, Homo Sapiens
AVALFFGPG

SEQ ID NO: 180915 - protein, 9 aa, Homo Sapiens
GDKGLKKMT

SEQ ID NO: 180916 - protein, 9 aa, Homo Sapiens
LSYVAGITW

SEQ ID NO: 180917 - protein, 9 aa, Homo Sapiens
RGILSASWK

SEQ ID NO: 180918 - protein, 9 aa, Homo Sapiens
HDPHPWRSG

SEQ ID NO: 180919 - protein, 9 aa, Homo Sapiens
PDQRLCKAS

SEQ ID NO: 180920 - protein, 9 aa, Homo Sapiens
VPLQHMCVA

SEQ ID NO: 180921 - protein, 9 aa, Homo Sapiens
SPSSASCCY

SEQ ID NO: 180922 - protein, 9 aa, Homo Sapiens
IHAPEECYP

SEQ ID NO: 180923 - protein, 9 aa, Homo Sapiens
HAVLLAVLD

SEQ ID NO: 180924 - protein, 9 aa, Homo Sapiens
DCRINSAVC

SEQ ID NO: 180925 - protein, 9 aa, Homo Sapiens
AHPRQPVAQ

SEQ ID NO: 180926 - protein, 9 aa, Homo Sapiens
CVRCKCQWE

SEQ ID NO: 180927 - protein, 9 aa, Homo Sapiens
FTCISWMLL

SEQ ID NO: 180928 - protein, 9 aa, Homo Sapiens
LLRIMPSNA

SEQ ID NO: 180929 - protein, 9 aa, Homo Sapiens
LDRIVDIWI

SEQ ID NO: 180930 - protein, 9 aa, Homo Sapiens
VFPWGLLPE

SEQ ID NO: 180931 - protein, 9 aa, Homo Sapiens
SKLPVPLLN

SEQ ID NO: 180932 - protein, 9 aa, Homo Sapiens
TVIIVLSIF

SEQ ID NO: 180933 - protein, 9 aa, Homo Sapiens
RGQALAQLV

SEQ ID NO: 180934 - protein, 9 aa, Homo Sapiens
AGIVTFSIY

SEQ ID NO: 180935 - protein, 9 aa, Homo Sapiens
ASVKGKLAP

SEQ ID NO: 180936 - protein, 9 aa, Homo Sapiens
VDFVPIVGF

SEQ ID NO: 180937 - protein, 9 aa, Homo Sapiens
KPSSPRPCG

SEQ ID NO: 180938 - protein, 9 aa, Homo Sapiens
GGPDTVPHF

SEQ ID NO: 180939 - protein, 9 aa, Homo Sapiens
VPSTPRPTS

SEQ ID NO: 180940 - protein, 9 aa, Homo Sapiens
LANWQDAHH

SEQ ID NO: 180941 - protein, 9 aa, Homo Sapiens
VLPRHPSLI

SEQ ID NO: 180942 - protein, 9 aa, Homo Sapiens
RPEACGIRT

SEQ ID NO: 180943 - protein, 9 aa, Homo Sapiens
RDSFEAPED

SEQ ID NO: 180944 - protein, 9 aa, Homo Sapiens
MEITHHPPV

SEQ ID NO: 180945 - protein, 9 aa, Homo Sapiens
PRAKSIRAK

SEQ ID NO: 180946 - protein, 9 aa, Homo Sapiens
LVAVGGQMR

SEQ ID NO: 180947 - protein, 9 aa, Homo Sapiens
LLPPELPPA

SEQ ID NO: 180948 - protein, 9 aa, Homo Sapiens
PSDSGKQFP

SEQ ID NO: 180949 - protein, 9 aa, Homo Sapiens
MIVVVNGLS

SEQ ID NO: 180950 - protein, 9 aa, Homo Sapiens
ATSQTPGRG

SEQ ID NO: 180951 - protein, 9 aa, Homo Sapiens
REPTKMWHQ

SEQ ID NO: 180952 - protein, 9 aa, Homo Sapiens
SWKDKVAQH

SEQ ID NO: 180953 - protein, 9 aa, Homo Sapiens
LLNHGKKPF

SEQ ID NO: 180954 - protein, 9 aa, Homo Sapiens
LMSPQPLTQ

SEQ ID NO: 180955 - protein, 9 aa, Homo Sapiens
PNPLTQLEV

SEQ ID NO: 180956 - protein, 9 aa, Homo Sapiens
FANRRDIRL

SEQ ID NO: 180957 - protein, 9 aa, Homo Sapiens
VIQFGKSAT

SEQ ID NO: 180958 - protein, 9 aa, Homo Sapiens
QIVETEKLQ

SEQ ID NO: 180959 - protein, 9 aa, Homo Sapiens
LTPEWTHQD

SEQ ID NO: 180960 - protein, 9 aa, Homo Sapiens
KQTDAWLQP

SEQ ID NO: 180961 - protein, 9 aa, Homo Sapiens
SIQQPIPLP

SEQ ID NO: 180962 - protein, 9 aa, Homo Sapiens
RDPQQGQFI

SEQ ID NO: 180963 - protein, 9 aa, Homo Sapiens
NPEDVITGA

SEQ ID NO: 180964 - protein, 9 aa, Homo Sapiens
ALPREKSPP

SEQ ID NO: 180965 - protein, 9 aa, Homo Sapiens
FPDTSHSLR

SEQ ID NO: 180966 - protein, 9 aa, Homo Sapiens
PQQGQFIPS

SEQ ID NO: 180967 - protein, 9 aa, Homo Sapiens
QLLAREFGL

SEQ ID NO: 180968 - protein, 9 aa, Homo Sapiens
LQVMINEVD

SEQ ID NO: 180969 - protein, 9 aa, Homo Sapiens
QDPGVVRGL

SEQ ID NO: 180970 - protein, 9 aa, Homo Sapiens
DERQEATVL

SEQ ID NO: 180971 - protein, 9 aa, Homo Sapiens
TCVIIVLSI

SEQ ID NO: 180972 - protein, 9 aa, Homo Sapiens
EVFQAERLL

SEQ ID NO: 180973 - protein, 9 aa, Homo Sapiens
QAQLKTGRQ

SEQ ID NO: 180974 - protein, 9 aa, Homo Sapiens
VMINEVDAD

SEQ ID NO: 180975 - protein, 9 aa, Homo Sapiens
TKLESRLRY

SEQ ID NO: 180976 - protein, 9 aa, Homo Sapiens
FQSPGSMPF

SEQ ID NO: 180977 - protein, 9 aa, Homo Sapiens
DMIVVVNGL

SEQ ID NO: 180978 - protein, 9 aa, Homo Sapiens
ENVDVGNPA

SEQ ID NO: 180979 - protein, 9 aa, Homo Sapiens
RPPMPRPGP

SEQ ID NO: 180980 - protein, 9 aa, Homo Sapiens
EHSSSSTSS

SEQ ID NO: 180981 - protein, 9 aa, Homo Sapiens
VGSTRCPAA

SEQ ID NO: 180982 - protein, 9 aa, Homo Sapiens
TLTLSEIGH

SEQ ID NO: 180983 - protein, 9 aa, Homo Sapiens
PLPAEEEKW

SEQ ID NO: 180984 - protein, 9 aa, Homo Sapiens
NCDGHTAQE

SEQ ID NO: 180985 - protein, 9 aa, Homo Sapiens
GRADVLVCL

SEQ ID NO: 180986 - protein, 9 aa, Homo Sapiens
NHMNVNSVG

SEQ ID NO: 180987 - protein, 9 aa, Homo Sapiens
AVSGSGGRG

SEQ ID NO: 180988 - protein, 9 aa, Homo Sapiens
EFISFQAMD

SEQ ID NO: 180989 - protein, 9 aa, Homo Sapiens
EDLAGQLTD

SEQ ID NO: 180990 - protein, 9 aa, Homo Sapiens
TEAELQVMI

SEQ ID NO: 180991 - protein, 9 aa, Homo Sapiens
IVVVNGLST

SEQ ID NO: 180992 - protein, 9 aa, Homo Sapiens
TWGFDRISS

SEQ ID NO: 180993 - protein, 9 aa, Homo Sapiens
RSGFRQLCR

SEQ ID NO: 180994 - protein, 9 aa, Homo Sapiens
NTLTLSEIG

SEQ ID NO: 180995 - protein, 9 aa, Homo Sapiens
EVVFWMTSG

SEQ ID NO: 180996 - protein, 9 aa, Homo Sapiens
SPPTTRRSP

SEQ ID NO: 180997 - protein, 9 aa, Homo Sapiens
CQRGGEIIL

SEQ ID NO: 180998 - protein, 9 aa, Homo Sapiens
NRAPSSCWA

SEQ ID NO: 180999 - protein, 9 aa, Homo Sapiens
QPLTQGPRL

SEQ ID NO: 181000 - protein, 9 aa, Homo Sapiens
GENKRKRKC

SEQ ID NO: 181001 - protein, 9 aa, Homo Sapiens
QNRSPTPSE

SEQ ID NO: 181002 - protein, 9 aa, Homo Sapiens
TEKKTQWET

SEQ ID NO: 181003 - protein, 9 aa, Homo Sapiens
GYEQHFPSP

SEQ ID NO: 181004 - protein, 9 aa, Homo Sapiens
GFTEAPKFP

SEQ ID NO: 181005 - protein, 9 aa, Homo Sapiens
MPPGHTCMP

SEQ ID NO: 181006 - protein, 9 aa, Homo Sapiens
PPSRAASLL

SEQ ID NO: 181007 - protein, 9 aa, Homo Sapiens
DPMLTPEEC

SEQ ID NO: 181008 - protein, 9 aa, Homo Sapiens
TVKRLWKHQ

SEQ ID NO: 181009 - protein, 9 aa, Homo Sapiens
PWEKMPESW

SEQ ID NO: 181010 - protein, 9 aa, Homo Sapiens
GMISLVMSY

SEQ ID NO: 181011 - protein, 9 aa, Homo Sapiens
YQALPWARY

SEQ ID NO: 181012 - protein, 9 aa, Homo Sapiens
EGVVHFGHR

SEQ ID NO: 181013 - protein, 9 aa, Homo Sapiens
RVMVKATFC

SEQ ID NO: 181014 - protein, 9 aa, Homo Sapiens
FNGCSPQLG

SEQ ID NO: 181015 - protein, 9 aa, Homo Sapiens
VPSFLPPGA

SEQ ID NO: 181016 - protein, 9 aa, Homo Sapiens
HCFHHSTTK

SEQ ID NO: 181017 - protein, 9 aa, Homo Sapiens
AERGQCGEA

SEQ ID NO: 181018 - protein, 9 aa, Homo Sapiens
WFIHGLVRE

SEQ ID NO: 181019 - protein, 9 aa, Homo Sapiens
VLLHYLHNF

SEQ ID NO: 181020 - protein, 9 aa, Homo Sapiens
LLAVEGPTA

SEQ ID NO: 181021 - protein, 9 aa, Homo Sapiens
EACWSCLEQ

SEQ ID NO: 181022 - protein, 9 aa, Homo Sapiens
HTTTGTWAE

SEQ ID NO: 181023 - protein, 9 aa, Homo Sapiens
TTNEQVMGK

SEQ ID NO: 181024 - protein, 9 aa, Homo Sapiens
GIKKRRIHK

SEQ ID NO: 181025 - protein, 9 aa, Homo Sapiens
RGSPLRLTL

SEQ ID NO: 181026 - protein, 9 aa, Homo Sapiens
RAALRKMQD

SEQ ID NO: 181027 - protein, 9 aa, Homo Sapiens
TYLSVANVD

SEQ ID NO: 181028 - protein, 9 aa, Homo Sapiens
IMFFERAFD

SEQ ID NO: 181029 - protein, 9 aa, Homo Sapiens
KEKKVPPLL

SEQ ID NO: 181030 - protein, 9 aa, Homo Sapiens
AVINYDTST

SEQ ID NO: 181031 - protein, 9 aa, Homo Sapiens
NWQDAHHRR

SEQ ID NO: 181032 - protein, 9 aa, Homo Sapiens
LPAGLGGWH

SEQ ID NO: 181033 - protein, 9 aa, Homo Sapiens
DKAIKETGN

SEQ ID NO: 181034 - protein, 9 aa, Homo Sapiens
PARALQVMV

SEQ ID NO: 181035 - protein, 9 aa, Homo Sapiens
LCLLFQVIP

SEQ ID NO: 181036 - protein, 9 aa, Homo Sapiens
NGVTTGTQS

SEQ ID NO: 181037 - protein, 9 aa, Homo Sapiens
YATQLALCM

SEQ ID NO: 181038 - protein, 9 aa, Homo Sapiens
SAKPGAPPS

SEQ ID NO: 181039 - protein, 9 aa, Homo Sapiens
LPPGAPSIQ

SEQ ID NO: 181040 - protein, 9 aa, Homo Sapiens
GSPCAKATS

SEQ ID NO: 181041 - protein, 9 aa, Homo Sapiens
TEQEQPRRK

SEQ ID NO: 181042 - protein, 9 aa, Homo Sapiens
HTLFLDSRH

SEQ ID NO: 181043 - protein, 9 aa, Homo Sapiens
ESQIISELP

SEQ ID NO: 181044 - protein, 9 aa, Homo Sapiens
ASSSTSRDS

SEQ ID NO: 181045 - protein, 9 aa, Homo Sapiens
KFREQDALE

SEQ ID NO: 181046 - protein, 9 aa, Homo Sapiens
KKENGVKKI

SEQ ID NO: 181047 - protein, 9 aa, Homo Sapiens
ALVSMSPRA

SEQ ID NO: 181048 - protein, 9 aa, Homo Sapiens
VVRWKLGTH

SEQ ID NO: 181049 - protein, 9 aa, Homo Sapiens
LSRGHAAVG

SEQ ID NO: 181050 - protein, 9 aa, Homo Sapiens
LQHMCVAAS

SEQ ID NO: 181051 - protein, 9 aa, Homo Sapiens
ALHGRISAP

SEQ ID NO: 181052 - protein, 9 aa, Homo Sapiens
CEVCQRGGE

SEQ ID NO: 181053 - protein, 9 aa, Homo Sapiens
TGRSMEQFQ

SEQ ID NO: 181054 - protein, 9 aa, Homo Sapiens
LGDQPKAGP

SEQ ID NO: 181055 - protein, 9 aa, Homo Sapiens
TTQTASRGS

SEQ ID NO: 181056 - protein, 9 aa, Homo Sapiens
LELVFALRA

SEQ ID NO: 181057 - protein, 9 aa, Homo Sapiens
QKFLSRHLA

SEQ ID NO: 181058 - protein, 9 aa, Homo Sapiens
SVQFVQLCQ

SEQ ID NO: 181059 - protein, 9 aa, Homo Sapiens
DPQQGQFIP

SEQ ID NO: 181060 - protein, 9 aa, Homo Sapiens
MQRSKMSQT

SEQ ID NO: 181061 - protein, 9 aa, Homo Sapiens
EKGAEAASV

SEQ ID NO: 181062 - protein, 9 aa, Homo Sapiens
GNIKKRLFH

SEQ ID NO: 181063 - protein, 9 aa, Homo Sapiens
VLLLLLLAR

SEQ ID NO: 181064 - protein, 9 aa, Homo Sapiens
CCPARAAVC

SEQ ID NO: 181065 - protein, 9 aa, Homo Sapiens
APVIQVKAL

SEQ ID NO: 181066 - protein, 9 aa, Homo Sapiens
SASSLQTHP

SEQ ID NO: 181067 - protein, 9 aa, Homo Sapiens
FSVLNIHMA

SEQ ID NO: 181068 - protein, 9 aa, Homo Sapiens
DLNKGAPAR

SEQ ID NO: 181069 - protein, 9 aa, Homo Sapiens
AARWGLQQA

SEQ ID NO: 181070 - protein, 9 aa, Homo Sapiens
PHIALLGSL

SEQ ID NO: 181071 - protein, 9 aa, Homo Sapiens
PTQQPQTPQ

SEQ ID NO: 181072 - protein, 9 aa, Homo Sapiens
SRARVEQAR

SEQ ID NO: 181073 - protein, 9 aa, Homo Sapiens
LKQSQNYLW

SEQ ID NO: 181074 - protein, 9 aa, Homo Sapiens
LFRGVEDNP

SEQ ID NO: 181075 - protein, 9 aa, Homo Sapiens
TYHENAAPT

SEQ ID NO: 181076 - protein, 9 aa, Homo Sapiens
LLQEEQEGG

SEQ ID NO: 181077 - protein, 9 aa, Homo Sapiens
KAFRDTFHL

SEQ ID NO: 181078 - protein, 9 aa, Homo Sapiens
PMGVDRWNA

SEQ ID NO: 181079 - protein, 9 aa, Homo Sapiens
QMLGGLGVV

SEQ ID NO: 181080 - protein, 9 aa, Homo Sapiens
AHGAVTKPR

SEQ ID NO: 181081 - protein, 9 aa, Homo Sapiens
NFTYQHLSN

SEQ ID NO: 181082 - protein, 9 aa, Homo Sapiens
RMLAMELRS

SEQ ID NO: 181083 - protein, 9 aa, Homo Sapiens
TQTASRGSS

SEQ ID NO: 181084 - protein, 9 aa, Homo Sapiens
CWACTVSLS

SEQ ID NO: 181085 - protein, 9 aa, Homo Sapiens
STFGSEVGF

SEQ ID NO: 181086 - protein, 9 aa, Homo Sapiens
ATPLRASWL

SEQ ID NO: 181087 - protein, 9 aa, Homo Sapiens
ASSPTCSWP

SEQ ID NO: 181088 - protein, 9 aa, Homo Sapiens
SARGPVRLL

SEQ ID NO: 181089 - protein, 9 aa, Homo Sapiens
LAEAGKLCR

SEQ ID NO: 181090 - protein, 9 aa, Homo Sapiens
LYSQNHRRL

SEQ ID NO: 181091 - protein, 9 aa, Homo Sapiens
NEQKARGAA

SEQ ID NO: 181092 - protein, 9 aa, Homo Sapiens
HVCSSTRGA

SEQ ID NO: 181093 - protein, 9 aa, Homo Sapiens
RKKEWGKTE

SEQ ID NO: 181094 - protein, 9 aa, Homo Sapiens
GLKKMTLKA

SEQ ID NO: 181095 - protein, 9 aa, Homo Sapiens
LESPALKQV

SEQ ID NO: 181096 - protein, 9 aa, Homo Sapiens
AWLQPEQNP

SEQ ID NO: 181097 - protein, 9 aa, Homo Sapiens
PTKKRGKSQ

SEQ ID NO: 181098 - protein, 9 aa, Homo Sapiens
HMGSGVERM

SEQ ID NO: 181099 - protein, 9 aa, Homo Sapiens
MKEGWHKFI

SEQ ID NO: 181100 - protein, 9 aa, Homo Sapiens
LGRRSMGKR

SEQ ID NO: 181101 - protein, 9 aa, Homo Sapiens
AQLAEGGGH

SEQ ID NO: 181102 - protein, 9 aa, Homo Sapiens
TDMNYSEKI

SEQ ID NO: 181103 - protein, 9 aa, Homo Sapiens
KGIEEKSGI

SEQ ID NO: 181104 - protein, 9 aa, Homo Sapiens
PWSAGCWTV

SEQ ID NO: 181105 - protein, 9 aa, Homo Sapiens
IVGFLILEE

SEQ ID NO: 181106 - protein, 9 aa, Homo Sapiens
DARTHQHTP

SEQ ID NO: 181107 - protein, 9 aa, Homo Sapiens
EEPRTVQGG

SEQ ID NO: 181108 - protein, 9 aa, Homo Sapiens
WTFISSEKN

SEQ ID NO: 181109 - protein, 9 aa, Homo Sapiens
QKHHKHHKH

SEQ ID NO: 181110 - protein, 9 aa, Homo Sapiens
LEMDFSLPP

SEQ ID NO: 181111 - protein, 9 aa, Homo Sapiens
SCHRPFHLE

SEQ ID NO: 181112 - protein, 9 aa, Homo Sapiens
LLARASPTF

SEQ ID NO: 181113 - protein, 9 aa, Homo Sapiens
REYLAEIML

SEQ ID NO: 181114 - protein, 9 aa, Homo Sapiens
AWKTKKTSF

SEQ ID NO: 181115 - protein, 9 aa, Homo Sapiens
FGEGMTCSS

SEQ ID NO: 181116 - protein, 9 aa, Homo Sapiens
PKQPLLLLQ

SEQ ID NO: 181117 - protein, 9 aa, Homo Sapiens
VEQARRKSY

SEQ ID NO: 181118 - protein, 9 aa, Homo Sapiens
IPMKKEPEP

SEQ ID NO: 181119 - protein, 9 aa, Homo Sapiens
WMEKMKVEG

SEQ ID NO: 181120 - protein, 8 aa, Homo Sapiens
STKPDMIQ

SEQ ID NO: 181121 - protein, 9 aa, Homo Sapiens
SRAAARWRR

SEQ ID NO: 181122 - protein, 9 aa, Homo Sapiens
SLRNLSSLR

SEQ ID NO: 181123 - protein, 9 aa, Homo Sapiens
HRPASAWTS

SEQ ID NO: 181124 - protein, 9 aa, Homo Sapiens
NLDGSNRHV

SEQ ID NO: 181125 - protein, 9 aa, Homo Sapiens
TLIEALVAS

SEQ ID NO: 181126 - protein, 9 aa, Homo Sapiens
CPSVNLFSH

SEQ ID NO: 181127 - protein, 9 aa, Homo Sapiens
NSIWDQNQA

SEQ ID NO: 181128 - protein, 9 aa, Homo Sapiens
PCIMVQSAS

SEQ ID NO: 181129 - protein, 9 aa, Homo Sapiens
DLQKQLWAH

SEQ ID NO: 181130 - protein, 9 aa, Homo Sapiens
NDKEKIIRA

SEQ ID NO: 181131 - protein, 9 aa, Homo Sapiens
MVIHAPEEC

SEQ ID NO: 181132 - protein, 9 aa, Homo Sapiens
FLSKTVRAE

SEQ ID NO: 181133 - protein, 9 aa, Homo Sapiens
HYLFHMRNH

SEQ ID NO: 181134 - protein, 9 aa, Homo Sapiens
FGDAGPRTN

SEQ ID NO: 181135 - protein, 9 aa, Homo Sapiens
IFLSFAFLA

SEQ ID NO: 181136 - protein, 9 aa, Homo Sapiens
IIVLSIFIA

SEQ ID NO: 181137 - protein, 9 aa, Homo Sapiens
GHIQAEKAH

SEQ ID NO: 181138 - protein, 9 aa, Homo Sapiens
DKKRGASSS

SEQ ID NO: 181139 - protein, 9 aa, Homo Sapiens
LIQEACWSC

SEQ ID NO: 181140 - protein, 9 aa, Homo Sapiens
EKQFHCPLC

SEQ ID NO: 181141 - protein, 9 aa, Homo Sapiens
FGSLRYGLA

SEQ ID NO: 181142 - protein, 9 aa, Homo Sapiens
GAPSIQQPI

SEQ ID NO: 181143 - protein, 9 aa, Homo Sapiens
GRPRWRDYK

SEQ ID NO: 181144 - protein, 9 aa, Homo Sapiens
CSYPMDMKV

SEQ ID NO: 181145 - protein, 9 aa, Homo Sapiens
NSVDDVIKM

SEQ ID NO: 181146 - protein, 9 aa, Homo Sapiens
IVTAPGEGL

SEQ ID NO: 181147 - protein, 9 aa, Homo Sapiens
FFFLHKEFL

SEQ ID NO: 181148 - protein, 9 aa, Homo Sapiens
EFKNMLKTP

SEQ ID NO: 181149 - protein, 9 aa, Homo Sapiens
EPWDTERNL

SEQ ID NO: 181150 - protein, 9 aa, Homo Sapiens
AFARALQQE

SEQ ID NO: 181151 - protein, 9 aa, Homo Sapiens
SRVLRRGLE

SEQ ID NO: 181152 - protein, 9 aa, Homo Sapiens
YSAYYYPIY

SEQ ID NO: 181153 - protein, 9 aa, Homo Sapiens
GALRTARIE

SEQ ID NO: 181154 - protein, 9 aa, Homo Sapiens
PKEELQGSG

SEQ ID NO: 181155 - protein, 9 aa, Homo Sapiens
RPGRLPPGP

SEQ ID NO: 181156 - protein, 9 aa, Homo Sapiens
ATEVAQEEA

SEQ ID NO: 181157 - protein, 9 aa, Homo Sapiens
LLPSDSALH

SEQ ID NO: 181158 - protein, 9 aa, Homo Sapiens
IDGLHDVKH

SEQ ID NO: 181159 - protein, 9 aa, Homo Sapiens
VKLNDGHFV

SEQ ID NO: 181160 - protein, 9 aa, Homo Sapiens
GSMRQHEQQ

SEQ ID NO: 181161 - protein, 9 aa, Homo Sapiens
FGEPVLPRH

SEQ ID NO: 181162 - protein, 9 aa, Homo Sapiens
VEEDDDDDD

SEQ ID NO: 181163 - protein, 9 aa, Homo Sapiens
KDLDCKKIR

SEQ ID NO: 181164 - protein, 9 aa, Homo Sapiens
LHLLSHGSL

SEQ ID NO: 181165 - protein, 9 aa, Homo Sapiens
AGRKRGLGT

SEQ ID NO: 181166 - protein, 9 aa, Homo Sapiens
APRPASDGQ

SEQ ID NO: 181167 - protein, 9 aa, Homo Sapiens
SASCCYSTC

SEQ ID NO: 181168 - protein, 9 aa, Homo Sapiens
NLLRLQSLL

SEQ ID NO: 181169 - protein, 9 aa, Homo Sapiens
GPWEKMPES

SEQ ID NO: 181170 - protein, 9 aa, Homo Sapiens
TDKQDALDV

SEQ ID NO: 181171 - protein, 9 aa, Homo Sapiens
NHSGTLGMS

SEQ ID NO: 181172 - protein, 9 aa, Homo Sapiens
TGGKPFKCH

SEQ ID NO: 181173 - protein, 9 aa, Homo Sapiens
YPNNHERYL

SEQ ID NO: 181174 - protein, 9 aa, Homo Sapiens
RGASDSLSA

SEQ ID NO: 181175 - protein, 9 aa, Homo Sapiens
IEKDLLRIM

SEQ ID NO: 181176 - protein, 9 aa, Homo Sapiens
NSPQALKKF

SEQ ID NO: 181177 - protein, 9 aa, Homo Sapiens
YGMASHLRR

SEQ ID NO: 181178 - protein, 9 aa, Homo Sapiens
PVGRKETRP

SEQ ID NO: 181179 - protein, 9 aa, Homo Sapiens
VLEEHPQSV

SEQ ID NO: 181180 - protein, 9 aa, Homo Sapiens
FVELSPCLP

SEQ ID NO: 181181 - protein, 9 aa, Homo Sapiens
RDARTHQHT

SEQ ID NO: 181182 - protein, 9 aa, Homo Sapiens
RGVEDNPMV

SEQ ID NO: 181183 - protein, 9 aa, Homo Sapiens
TLRKQPQGP

SEQ ID NO: 181184 - protein, 9 aa, Homo Sapiens
QHGQQALAE

SEQ ID NO: 181185 - protein, 9 aa, Homo Sapiens
TQARNHMNV

SEQ ID NO: 181186 - protein, 9 aa, Homo Sapiens
VGKPSVGNQ

SEQ ID NO: 181187 - protein, 9 aa, Homo Sapiens
VNQKKAKIK

SEQ ID NO: 181188 - protein, 9 aa, Homo Sapiens
KKKGISVSR

SEQ ID NO: 181189 - protein, 9 aa, Homo Sapiens
HVPTSLIIQ

SEQ ID NO: 181190 - protein, 9 aa, Homo Sapiens
PSSASCCYS

SEQ ID NO: 181191 - protein, 9 aa, Homo Sapiens
GESQALMLP

SEQ ID NO: 181192 - protein, 9 aa, Homo Sapiens
PEAQMHGEL

SEQ ID NO: 181193 - protein, 9 aa, Homo Sapiens
GEVWRGKWQ

SEQ ID NO: 181194 - protein, 9 aa, Homo Sapiens
SGIYIKQVA

SEQ ID NO: 181195 - protein, 9 aa, Homo Sapiens
IGAVKCKSS

SEQ ID NO: 181196 - protein, 9 aa, Homo Sapiens
QRYYGRTEF

SEQ ID NO: 181197 - protein, 9 aa, Homo Sapiens
DRWGRQCDA

SEQ ID NO: 181198 - protein, 9 aa, Homo Sapiens
ERLKRGINH

SEQ ID NO: 181199 - protein, 9 aa, Homo Sapiens
RPVTHGGQF

SEQ ID NO: 181200 - protein, 9 aa, Homo Sapiens
PKDDNIQIG

SEQ ID NO: 181201 - protein, 9 aa, Homo Sapiens
ASCASGVTT

SEQ ID NO: 181202 - protein, 9 aa, Homo Sapiens
IRLVDAGGV

SEQ ID NO: 181203 - protein, 9 aa, Homo Sapiens
RQDYGKMAV

SEQ ID NO: 181204 - protein, 9 aa, Homo Sapiens
KTVIKKKGI

SEQ ID NO: 181205 - protein, 9 aa, Homo Sapiens
SSKERIEWS

SEQ ID NO: 181206 - protein, 9 aa, Homo Sapiens
SNVFQGMLR

SEQ ID NO: 181207 - protein, 9 aa, Homo Sapiens
EWCPFVELV

SEQ ID NO: 181208 - protein, 9 aa, Homo Sapiens
DFKIDSAID

SEQ ID NO: 181209 - protein, 9 aa, Homo Sapiens
SLFITEYIQ

SEQ ID NO: 181210 - protein, 9 aa, Homo Sapiens
KWLSAESGL

SEQ ID NO: 181211 - protein, 9 aa, Homo Sapiens
FGLLLQLLQ

SEQ ID NO: 181212 - protein, 9 aa, Homo Sapiens
DAWLQPEQN

SEQ ID NO: 181213 - protein, 9 aa, Homo Sapiens
DKENALDQA

SEQ ID NO: 181214 - protein, 9 aa, Homo Sapiens
PENEAAVTA

SEQ ID NO: 181215 - protein, 9 aa, Homo Sapiens
LTLSQEALY

SEQ ID NO: 181216 - protein, 9 aa, Homo Sapiens
TVSRAAARW

SEQ ID NO: 181217 - protein, 9 aa, Homo Sapiens
SILFWKDCH

SEQ ID NO: 181218 - protein, 9 aa, Homo Sapiens
VHVPWRTPR

SEQ ID NO: 181219 - protein, 9 aa, Homo Sapiens
LTYRFLDTS

SEQ ID NO: 181220 - protein, 9 aa, Homo Sapiens
SQVPRLRHG

SEQ ID NO: 181221 - protein, 9 aa, Homo Sapiens
KTSHSLSYW

SEQ ID NO: 181222 - protein, 9 aa, Homo Sapiens
VAHLLAQWA

SEQ ID NO: 181223 - protein, 9 aa, Homo Sapiens
DAVDNKKTH

SEQ ID NO: 181224 - protein, 9 aa, Homo Sapiens
THLKKYRCY

SEQ ID NO: 181225 - protein, 9 aa, Homo Sapiens
PWGEHSSSS

SEQ ID NO: 181226 - protein, 9 aa, Homo Sapiens
HISFHSAET

SEQ ID NO: 181227 - protein, 9 aa, Homo Sapiens
LTDPTALLS

SEQ ID NO: 181228 - protein, 9 aa, Homo Sapiens
EKNEAQRIS

SEQ ID NO: 181229 - protein, 9 aa, Homo Sapiens
KNISEKKVT

SEQ ID NO: 181230 - protein, 9 aa, Homo Sapiens
LRQEMLEPF

SEQ ID NO: 181231 - protein, 9 aa, Homo Sapiens
WAAAATARA

SEQ ID NO: 181232 - protein, 9 aa, Homo Sapiens
VALVDIDCF

SEQ ID NO: 181233 - protein, 9 aa, Homo Sapiens
HVSHYKCPL

SEQ ID NO: 181234 - protein, 9 aa, Homo Sapiens
PMDDVHRTW

SEQ ID NO: 181235 - protein, 9 aa, Homo Sapiens
LSAEEGIRK

SEQ ID NO: 181236 - protein, 9 aa, Homo Sapiens
LSEIGHILE

SEQ ID NO: 181237 - protein, 9 aa, Homo Sapiens
LRCIRRTQN

SEQ ID NO: 181238 - protein, 9 aa, Homo Sapiens
NTIFPNPEE

SEQ ID NO: 181239 - protein, 9 aa, Homo Sapiens
LSSDLSKSS

SEQ ID NO: 181240 - protein, 9 aa, Homo Sapiens
YFQCCAVMC

SEQ ID NO: 181241 - protein, 9 aa, Homo Sapiens
TEKQYYSNS

SEQ ID NO: 181242 - protein, 9 aa, Homo Sapiens
SEPQAIAVD

SEQ ID NO: 181243 - protein, 9 aa, Homo Sapiens
KSFSTCTDL

SEQ ID NO: 181244 - protein, 9 aa, Homo Sapiens
MAHVPDAVW

SEQ ID NO: 181245 - protein, 9 aa, Homo Sapiens
DIGIVAQVD

SEQ ID NO: 181246 - protein, 9 aa, Homo Sapiens
EEKWLSAES

SEQ ID NO: 181247 - protein, 9 aa, Homo Sapiens
PETIGKRLA

SEQ ID NO: 181248 - protein, 9 aa, Homo Sapiens
ADTMWDIQK

SEQ ID NO: 181249 - protein, 9 aa, Homo Sapiens
NKGERWTFI

SEQ ID NO: 181250 - protein, 9 aa, Homo Sapiens
QLALCMQLS

SEQ ID NO: 181251 - protein, 9 aa, Homo Sapiens
EKLMHICTD

SEQ ID NO: 181252 - protein, 9 aa, Homo Sapiens
LVEKKLSRR

SEQ ID NO: 181253 - protein, 9 aa, Homo Sapiens
TVNQKKAKI

SEQ ID NO: 181254 - protein, 9 aa, Homo Sapiens
SYGEKFYLF

SEQ ID NO: 181255 - protein, 9 aa, Homo Sapiens
CSMPPLLAT

SEQ ID NO: 181256 - protein, 9 aa, Homo Sapiens
WTTFGVGET

SEQ ID NO: 181257 - protein, 9 aa, Homo Sapiens
SLTNTMGGT

SEQ ID NO: 181258 - protein, 9 aa, Homo Sapiens
PSSRDATTR

SEQ ID NO: 181259 - protein, 9 aa, Homo Sapiens
GGGWICWRS

SEQ ID NO: 181260 - protein, 9 aa, Homo Sapiens
GVILSPSFP

SEQ ID NO: 181261 - protein, 9 aa, Homo Sapiens
AFGNAFLNM

SEQ ID NO: 181262 - protein, 9 aa, Homo Sapiens
TMRGARGIL

SEQ ID NO: 181263 - protein, 9 aa, Homo Sapiens
QRKEEEHTP

SEQ ID NO: 181264 - protein, 9 aa, Homo Sapiens
GSIYHNVEG

SEQ ID NO: 181265 - protein, 9 aa, Homo Sapiens
NDNLPTSMH

SEQ ID NO: 181266 - protein, 9 aa, Homo Sapiens
AAVLLESLK

SEQ ID NO: 181267 - protein, 9 aa, Homo Sapiens
RSMVASVSL

SEQ ID NO: 181268 - protein, 9 aa, Homo Sapiens
CDDPSKALL

SEQ ID NO: 181269 - protein, 9 aa, Homo Sapiens
ISWLEQEEP

SEQ ID NO: 181270 - protein, 9 aa, Homo Sapiens
KYWELLNSM

SEQ ID NO: 181271 - protein, 9 aa, Homo Sapiens
IIGSGVSCL

SEQ ID NO: 181272 - protein, 9 aa, Homo Sapiens
RNEIDPPQK

SEQ ID NO: 181273 - protein, 9 aa, Homo Sapiens
HFAYGRSDV

SEQ ID NO: 181274 - protein, 9 aa, Homo Sapiens
ISWMLLKAG

SEQ ID NO: 181275 - protein, 9 aa, Homo Sapiens
RLASLPTPL

SEQ ID NO: 181276 - protein, 9 aa, Homo Sapiens
RMMNMSKIS

SEQ ID NO: 181277 - protein, 9 aa, Homo Sapiens
AIMTVGFCG

SEQ ID NO: 181278 - protein, 9 aa, Homo Sapiens
RVQEYGSDC

SEQ ID NO: 181279 - protein, 9 aa, Homo Sapiens
CIQPHGQKM

SEQ ID NO: 181280 - protein, 9 aa, Homo Sapiens
CIYGKEIDT

SEQ ID NO: 181281 - protein, 9 aa, Homo Sapiens
AFWSEAPTS

SEQ ID NO: 181282 - protein, 9 aa, Homo Sapiens
IPKKERAWL

SEQ ID NO: 181283 - protein, 9 aa, Homo Sapiens
VSVDCNGHI

SEQ ID NO: 181284 - protein, 9 aa, Homo Sapiens
LLLPLLLEV

SEQ ID NO: 181285 - protein, 9 aa, Homo Sapiens
DFLEPPGAR

SEQ ID NO: 181286 - protein, 9 aa, Homo Sapiens
TDFGLCVAY

SEQ ID NO: 181287 - protein, 9 aa, Homo Sapiens
EERQRVLEE

SEQ ID NO: 181288 - protein, 9 aa, Homo Sapiens
QSAKKRASV

SEQ ID NO: 181289 - protein, 9 aa, Homo Sapiens
HGGPLPGPL

SEQ ID NO: 181290 - protein, 9 aa, Homo Sapiens
YMHFYFLNS

SEQ ID NO: 181291 - protein, 9 aa, Homo Sapiens
GDSGISVDS

SEQ ID NO: 181292 - protein, 9 aa, Homo Sapiens
MNDSKHKLE

SEQ ID NO: 181293 - protein, 9 aa, Homo Sapiens
NKLIFLEGM

SEQ ID NO: 181294 - protein, 9 aa, Homo Sapiens
HRAELFAQL

SEQ ID NO: 181295 - protein, 9 aa, Homo Sapiens
PLTQGPRLA

SEQ ID NO: 181296 - protein, 9 aa, Homo Sapiens
TFISSEKNE

SEQ ID NO: 181297 - protein, 9 aa, Homo Sapiens
SMPPLLATM

SEQ ID NO: 181298 - protein, 9 aa, Homo Sapiens
ESRSRRAPG

SEQ ID NO: 181299 - protein, 9 aa, Homo Sapiens
MTKKRVNTA

SEQ ID NO: 181300 - protein, 9 aa, Homo Sapiens
SGGNVKQTD

SEQ ID NO: 181301 - protein, 9 aa, Homo Sapiens
GPESPSISA

SEQ ID NO: 181302 - protein, 9 aa, Homo Sapiens
VAVKMDNSR

SEQ ID NO: 181303 - protein, 9 aa, Homo Sapiens
KAVELSPEN

SEQ ID NO: 181304 - protein, 9 aa, Homo Sapiens
THHAHLQGH

SEQ ID NO: 181305 - protein, 9 aa, Homo Sapiens
VVHEGVEMR

SEQ ID NO: 181306 - protein, 9 aa, Homo Sapiens
LDDRSPQAP

SEQ ID NO: 181307 - protein, 9 aa, Homo Sapiens
EQGPLEAEN

SEQ ID NO: 181308 - protein, 9 aa, Homo Sapiens
DPTITCSSM

SEQ ID NO: 181309 - protein, 9 aa, Homo Sapiens
PCHLIEQSS

SEQ ID NO: 181310 - protein, 9 aa, Homo Sapiens
PSQGILGST

SEQ ID NO: 181311 - protein, 9 aa, Homo Sapiens
IVNGKSYKI

SEQ ID NO: 181312 - protein, 9 aa, Homo Sapiens
RFVVVTNHF

SEQ ID NO: 181313 - protein, 9 aa, Homo Sapiens
IIVGIMFFE

SEQ ID NO: 181314 - protein, 9 aa, Homo Sapiens
HPKLQNASQ

SEQ ID NO: 181315 - protein, 9 aa, Homo Sapiens
NKKNVAVMD

SEQ ID NO: 181316 - protein, 9 aa, Homo Sapiens
LTLELAGTG

SEQ ID NO: 181317 - protein, 9 aa, Homo Sapiens
RVILYFYIK

SEQ ID NO: 181318 - protein, 9 aa, Homo Sapiens
KIQTSRRLK

SEQ ID NO: 181319 - protein, 9 aa, Homo Sapiens
QQEVVEMWK

SEQ ID NO: 181320 - protein, 9 aa, Homo Sapiens
SKWERQDYG

SEQ ID NO: 181321 - protein, 9 aa, Homo Sapiens
LNTHRYSSS

SEQ ID NO: 181322 - protein, 9 aa, Homo Sapiens
SSPSSAVAG

SEQ ID NO: 181323 - protein, 9 aa, Homo Sapiens
TVPAASAYP

SEQ ID NO: 181324 - protein, 9 aa, Homo Sapiens
DVKKDKGAF

SEQ ID NO: 181325 - protein, 9 aa, Homo Sapiens
KNNSISKNF

SEQ ID NO: 181326 - protein, 9 aa, Homo Sapiens
AQRVHMGAR

SEQ ID NO: 181327 - protein, 9 aa, Homo Sapiens
FWEIRYMHF

SEQ ID NO: 181328 - protein, 9 aa, Homo Sapiens
IEHTHRVRV

SEQ ID NO: 181329 - protein, 9 aa, Homo Sapiens
VNGPQTEEM

SEQ ID NO: 181330 - protein, 9 aa, Homo Sapiens
QEAVAICKG

SEQ ID NO: 181331 - protein, 9 aa, Homo Sapiens
QPIPLPSFV

SEQ ID NO: 181332 - protein, 9 aa, Homo Sapiens
KEGNLIQNR

SEQ ID NO: 181333 - protein, 9 aa, Homo Sapiens
VILYFYIKR

SEQ ID NO: 181334 - protein, 9 aa, Homo Sapiens
AVELHLLLP

SEQ ID NO: 181335 - protein, 9 aa, Homo Sapiens
EAPWGRVLF

SEQ ID NO: 181336 - protein, 9 aa, Homo Sapiens
VFWMTSGLI

SEQ ID NO: 181337 - protein, 9 aa, Homo Sapiens
SFFTSAHPS

SEQ ID NO: 181338 - protein, 9 aa, Homo Sapiens
ALPCAQPTV

SEQ ID NO: 181339 - protein, 9 aa, Homo Sapiens
YEEALKKQR

SEQ ID NO: 181340 - protein, 9 aa, Homo Sapiens
SSAQLADTS

SEQ ID NO: 181341 - protein, 9 aa, Homo Sapiens
PQAIAVDPL

SEQ ID NO: 181342 - protein, 9 aa, Homo Sapiens
LYITSRDRM

SEQ ID NO: 181343 - protein, 9 aa, Homo Sapiens
TRTTASLSA

SEQ ID NO: 181344 - protein, 9 aa, Homo Sapiens
LPRRPATSS

SEQ ID NO: 181345 - protein, 9 aa, Homo Sapiens
VREGEEGLG

SEQ ID NO: 181346 - protein, 9 aa, Homo Sapiens
GPPVPSKPR

SEQ ID NO: 181347 - protein, 9 aa, Homo Sapiens
ACTVSLSTA

SEQ ID NO: 181348 - protein, 9 aa, Homo Sapiens
SGKQFPNHP

SEQ ID NO: 181349 - protein, 9 aa, Homo Sapiens
SAIVNGKSY

SEQ ID NO: 181350 - protein, 9 aa, Homo Sapiens
SQVDRLQPE

SEQ ID NO: 181351 - protein, 9 aa, Homo Sapiens
VNMSMGLSL

SEQ ID NO: 181352 - protein, 9 aa, Homo Sapiens
PTEELYGNT

SEQ ID NO: 181353 - protein, 9 aa, Homo Sapiens
MTTVVISTC

SEQ ID NO: 181354 - protein, 9 aa, Homo Sapiens
LPEPASGDG

SEQ ID NO: 181355 - protein, 9 aa, Homo Sapiens
FFPASAVST

SEQ ID NO: 181356 - protein, 9 aa, Homo Sapiens
EPRDRRPPR

SEQ ID NO: 181357 - protein, 9 aa, Homo Sapiens
ALRAKLLLP

SEQ ID NO: 181358 - protein, 9 aa, Homo Sapiens
TMKEGWHKF

SEQ ID NO: 181359 - protein, 9 aa, Homo Sapiens
QEAKYEAFS

SEQ ID NO: 181360 - protein, 9 aa, Homo Sapiens
LLHYLHNFQ

SEQ ID NO: 181361 - protein, 9 aa, Homo Sapiens
KRFVVVTNH

SEQ ID NO: 181362 - protein, 9 aa, Homo Sapiens
PSALPCAQP

SEQ ID NO: 181363 - protein, 9 aa, Homo Sapiens
VPTSLIIQM

SEQ ID NO: 181364 - protein, 9 aa, Homo Sapiens
SVTSQPRSL

SEQ ID NO: 181365 - protein, 9 aa, Homo Sapiens
GGWHGFPGP

SEQ ID NO: 181366 - protein, 9 aa, Homo Sapiens
TSKSNPFCV

SEQ ID NO: 181367 - protein, 9 aa, Homo Sapiens
QDMMGHRSD

SEQ ID NO: 181368 - protein, 9 aa, Homo Sapiens
KNGPTRPPR

SEQ ID NO: 181369 - protein, 9 aa, Homo Sapiens
KYRQLSRLC

SEQ ID NO: 181370 - protein, 9 aa, Homo Sapiens
CKASDQPSG

SEQ ID NO: 181371 - protein, 9 aa, Homo Sapiens
RAPGETSPT

SEQ ID NO: 181372 - protein, 9 aa, Homo Sapiens
TLCSETDPC

SEQ ID NO: 181373 - protein, 9 aa, Homo Sapiens
AAFQRMLAM

SEQ ID NO: 181374 - protein, 9 aa, Homo Sapiens
EFANLDGSN

SEQ ID NO: 181375 - protein, 9 aa, Homo Sapiens
ISELPFTIA

SEQ ID NO: 181376 - protein, 9 aa, Homo Sapiens
SSPCPLPLQ

SEQ ID NO: 181377 - protein, 9 aa, Homo Sapiens
DLEDGKVPQ

SEQ ID NO: 181378 - protein, 9 aa, Homo Sapiens
PYCDYAGTQ

SEQ ID NO: 181379 - protein, 9 aa, Homo Sapiens
GAAGRQRAH

SEQ ID NO: 181380 - protein, 9 aa, Homo Sapiens
LKTILDKSS

SEQ ID NO: 181381 - protein, 9 aa, Homo Sapiens
FAFDRKALT

SEQ ID NO: 181382 - protein, 9 aa, Homo Sapiens
EQHNRPCWE

SEQ ID NO: 181383 - protein, 9 aa, Homo Sapiens
NHLNTHRYS

SEQ ID NO: 181384 - protein, 9 aa, Homo Sapiens
RDAMLENYR

SEQ ID NO: 181385 - protein, 9 aa, Homo Sapiens
FALTIIVGI

SEQ ID NO: 181386 - protein, 9 aa, Homo Sapiens
VWESRNKFS

SEQ ID NO: 181387 - protein, 9 aa, Homo Sapiens
LSARTASEQ

SEQ ID NO: 181388 - protein, 9 aa, Homo Sapiens
IAAHCSGSR

SEQ ID NO: 181389 - protein, 9 aa, Homo Sapiens
ILKEVEYHT

SEQ ID NO: 181390 - protein, 9 aa, Homo Sapiens
KCPYCDYAG

SEQ ID NO: 181391 - protein, 9 aa, Homo Sapiens
QQGHIQAEK

SEQ ID NO: 181392 - protein, 9 aa, Homo Sapiens
NMLKTPHVS

SEQ ID NO: 181393 - protein, 9 aa, Homo Sapiens
PCVTACPWA

SEQ ID NO: 181394 - protein, 9 aa, Homo Sapiens
QKTPRSCKR

SEQ ID NO: 181395 - protein, 9 aa, Homo Sapiens
EGLQMYGKH

SEQ ID NO: 181396 - protein, 9 aa, Homo Sapiens
PRTGGLVTA

SEQ ID NO: 181397 - protein, 9 aa, Homo Sapiens
DKEGMISLV

SEQ ID NO: 181398 - protein, 9 aa, Homo Sapiens
FFYYGWQCM

SEQ ID NO: 181399 - protein, 9 aa, Homo Sapiens
AFRDTFHLL

SEQ ID NO: 181400 - protein, 9 aa, Homo Sapiens
LLLPVAGDL

SEQ ID NO: 181401 - protein, 9 aa, Homo Sapiens
QAPIEKNAG

SEQ ID NO: 181402 - protein, 9 aa, Homo Sapiens
LEVVPNIPL

SEQ ID NO: 181403 - protein, 9 aa, Homo Sapiens
QQIKTSHSL

SEQ ID NO: 181404 - protein, 9 aa, Homo Sapiens
QGPRLASLP

SEQ ID NO: 181405 - protein, 9 aa, Homo Sapiens
MMNMSKISF

SEQ ID NO: 181406 - protein, 9 aa, Homo Sapiens
RSLGEQGPL

SEQ ID NO: 181407 - protein, 9 aa, Homo Sapiens
SNPLEMTVW

SEQ ID NO: 181408 - protein, 9 aa, Homo Sapiens
IYPLPFFLN

SEQ ID NO: 181409 - protein, 9 aa, Homo Sapiens
APPHCVPEG

SEQ ID NO: 181410 - protein, 9 aa, Homo Sapiens
EKENNLCND

SEQ ID NO: 181411 - protein, 9 aa, Homo Sapiens
STSKQMPPV

SEQ ID NO: 181412 - protein, 9 aa, Homo Sapiens
TSHSLSYWR

SEQ ID NO: 181413 - protein, 9 aa, Homo Sapiens
EEGPTTDVE

SEQ ID NO: 181414 - protein, 9 aa, Homo Sapiens
PSTNAKSYE

SEQ ID NO: 181415 - protein, 9 aa, Homo Sapiens
EICSARPEQ

SEQ ID NO: 181416 - protein, 9 aa, Homo Sapiens
RALTRCTTN

SEQ ID NO: 181417 - protein, 9 aa, Homo Sapiens
ALTRCTTNM

SEQ ID NO: 181418 - protein, 9 aa, Homo Sapiens
VRVPKRRMV

SEQ ID NO: 181419 - protein, 9 aa, Homo Sapiens
PALKTILDK

SEQ ID NO: 181420 - protein, 9 aa, Homo Sapiens
PKKCPLLLV

SEQ ID NO: 181421 - protein, 9 aa, Homo Sapiens
DDDGDDEGG

SEQ ID NO: 181422 - protein, 9 aa, Homo Sapiens
KQREHCFHH

SEQ ID NO: 181423 - protein, 9 aa, Homo Sapiens
VLEKATHKC

SEQ ID NO: 181424 - protein, 9 aa, Homo Sapiens
GHTHTPLPF

SEQ ID NO: 181425 - protein, 9 aa, Homo Sapiens
ENSKVVGVK

SEQ ID NO: 181426 - protein, 9 aa, Homo Sapiens
PPPELQPQH

SEQ ID NO: 181427 - protein, 9 aa, Homo Sapiens
RNRLKIQYQ

SEQ ID NO: 181428 - protein, 9 aa, Homo Sapiens
GGHTHTPLP

SEQ ID NO: 181429 - protein, 9 aa, Homo Sapiens
EGYWIAVGG

SEQ ID NO: 181430 - protein, 9 aa, Homo Sapiens
HLRPEPAKT

SEQ ID NO: 181431 - protein, 9 aa, Homo Sapiens
RFQDMMGHR

SEQ ID NO: 181432 - protein, 9 aa, Homo Sapiens
SFEVGVWSI

SEQ ID NO: 181433 - protein, 9 aa, Homo Sapiens
SESDLLNPR

SEQ ID NO: 181434 - protein, 9 aa, Homo Sapiens
DLKDNPLDH

SEQ ID NO: 181435 - protein, 9 aa, Homo Sapiens
VEGPTAKRT

SEQ ID NO: 181436 - protein, 9 aa, Homo Sapiens
WQSPWGEHS

SEQ ID NO: 181437 - protein, 9 aa, Homo Sapiens
YEQHFPSPL

SEQ ID NO: 181438 - protein, 9 aa, Homo Sapiens
LQPEPESIR

SEQ ID NO: 181439 - protein, 9 aa, Homo Sapiens
CWAAGSPCA

SEQ ID NO: 181440 - protein, 9 aa, Homo Sapiens
RMCSQGDED

SEQ ID NO: 181441 - protein, 9 aa, Homo Sapiens
SSCWAPTTR

SEQ ID NO: 181442 - protein, 9 aa, Homo Sapiens
THPCTMLLP

SEQ ID NO: 181443 - protein, 9 aa, Homo Sapiens
QRHAGNKSI

SEQ ID NO: 181444 - protein, 9 aa, Homo Sapiens
TDRSTVWLS

SEQ ID NO: 181445 - protein, 9 aa, Homo Sapiens
QENDDHPSL

SEQ ID NO: 181446 - protein, 9 aa, Homo Sapiens
WIIFQILVT

SEQ ID NO: 181447 - protein, 9 aa, Homo Sapiens
EGMTCSSCH

SEQ ID NO: 181448 - protein, 9 aa, Homo Sapiens
SWLEQEEPR

SEQ ID NO: 181449 - protein, 9 aa, Homo Sapiens
HGQKMTSSD

SEQ ID NO: 181450 - protein, 9 aa, Homo Sapiens
FRDKPITDQ

SEQ ID NO: 181451 - protein, 9 aa, Homo Sapiens
TDLQLHTAR

SEQ ID NO: 181452 - protein, 9 aa, Homo Sapiens
LAREFGLLL

SEQ ID NO: 181453 - protein, 9 aa, Homo Sapiens
SIRAKKPIK

SEQ ID NO: 181454 - protein, 9 aa, Homo Sapiens
ALTEDIMSS

SEQ ID NO: 181455 - protein, 9 aa, Homo Sapiens
ASRLRRLNI

SEQ ID NO: 181456 - protein, 9 aa, Homo Sapiens
SGAIMALCN

SEQ ID NO: 181457 - protein, 9 aa, Homo Sapiens
LRHGLCDQW

SEQ ID NO: 181458 - protein, 9 aa, Homo Sapiens
RRSMICWLR

SEQ ID NO: 181459 - protein, 9 aa, Homo Sapiens
MPPPANPQL

SEQ ID NO: 181460 - protein, 9 aa, Homo Sapiens
LHFFSGFSF

SEQ ID NO: 181461 - protein, 9 aa, Homo Sapiens
NKSIKDQLG

SEQ ID NO: 181462 - protein, 9 aa, Homo Sapiens
GSFSARYGV

SEQ ID NO: 181463 - protein, 9 aa, Homo Sapiens
PEWKALRDM

SEQ ID NO: 181464 - protein, 9 aa, Homo Sapiens
MAQENMCCN

SEQ ID NO: 181465 - protein, 9 aa, Homo Sapiens
RAVRGTSPS

SEQ ID NO: 181466 - protein, 9 aa, Homo Sapiens
PAHASCHVQ

SEQ ID NO: 181467 - protein, 9 aa, Homo Sapiens
RMPMHTIIP

SEQ ID NO: 181468 - protein, 9 aa, Homo Sapiens
VTAEMCCCC

SEQ ID NO: 181469 - protein, 9 aa, Homo Sapiens
LQTLRPVTH

SEQ ID NO: 181470 - protein, 9 aa, Homo Sapiens
PFRDKPITD

SEQ ID NO: 181471 - protein, 9 aa, Homo Sapiens
KFWTANRQC

SEQ ID NO: 181472 - protein, 9 aa, Homo Sapiens
LQKTPRSCK

SEQ ID NO: 181473 - protein, 9 aa, Homo Sapiens
WGFDRISSV

SEQ ID NO: 181474 - protein, 9 aa, Homo Sapiens
TAPPTATWA

SEQ ID NO: 181475 - protein, 9 aa, Homo Sapiens
SINAMNIKH

SEQ ID NO: 181476 - protein, 9 aa, Homo Sapiens
SGFRQESQT

SEQ ID NO: 181477 - protein, 9 aa, Homo Sapiens
CGDSDSRRR

SEQ ID NO: 181478 - protein, 9 aa, Homo Sapiens
VADSGLALK

SEQ ID NO: 181479 - protein, 9 aa, Homo Sapiens
VEQMAESCE

SEQ ID NO: 181480 - protein, 9 aa, Homo Sapiens
CFFGMRVQE

SEQ ID NO: 181481 - protein, 9 aa, Homo Sapiens
RLCNLSSRD

SEQ ID NO: 181482 - protein, 9 aa, Homo Sapiens
QKFVLFDEK

SEQ ID NO: 181483 - protein, 9 aa, Homo Sapiens
AVSPRGLQH

SEQ ID NO: 181484 - protein, 9 aa, Homo Sapiens
CPSMEEIVK

SEQ ID NO: 181485 - protein, 9 aa, Homo Sapiens
SVSARGPVR

SEQ ID NO: 181486 - protein, 9 aa, Homo Sapiens
VFRHWKKIL

SEQ ID NO: 181487 - protein, 9 aa, Homo Sapiens
LKLPETIGK

SEQ ID NO: 181488 - protein, 9 aa, Homo Sapiens
NEIEKEKEK

SEQ ID NO: 181489 - protein, 9 aa, Homo Sapiens
SHSLSYWRA

SEQ ID NO: 181490 - protein, 9 aa, Homo Sapiens
NPPLSRSQT

SEQ ID NO: 181491 - protein, 9 aa, Homo Sapiens
PPDSQETLV

SEQ ID NO: 181492 - protein, 9 aa, Homo Sapiens
RAPACSWKA

SEQ ID NO: 181493 - protein, 9 aa, Homo Sapiens
FQDVTTEIS

SEQ ID NO: 181494 - protein, 9 aa, Homo Sapiens
GPGGPKGSK

SEQ ID NO: 181495 - protein, 9 aa, Homo Sapiens
SLGALRTAR

SEQ ID NO: 181496 - protein, 9 aa, Homo Sapiens
EDKHLSRRR

SEQ ID NO: 181497 - protein, 9 aa, Homo Sapiens
LFVSVPSTG

SEQ ID NO: 181498 - protein, 9 aa, Homo Sapiens
PSISAQNSD

SEQ ID NO: 181499 - protein, 9 aa, Homo Sapiens
GGQAEHGGP

SEQ ID NO: 181500 - protein, 9 aa, Homo Sapiens
NFTTNNTSS

SEQ ID NO: 181501 - protein, 9 aa, Homo Sapiens
WKTKKTSFS

SEQ ID NO: 181502 - protein, 9 aa, Homo Sapiens
YHLKFCSCC

SEQ ID NO: 181503 - protein, 9 aa, Homo Sapiens
SALPCAQPT

SEQ ID NO: 181504 - protein, 9 aa, Homo Sapiens
VVPGFQYHP

SEQ ID NO: 181505 - protein, 9 aa, Homo Sapiens
NIRFVFAAA

SEQ ID NO: 181506 - protein, 9 aa, Homo Sapiens
VLPSLVPQN

SEQ ID NO: 181507 - protein, 9 aa, Homo Sapiens
LVKFWNSND

SEQ ID NO: 181508 - protein, 9 aa, Homo Sapiens
TGWPWQDNR

SEQ ID NO: 181509 - protein, 9 aa, Homo Sapiens
LQTSSSGLQ

SEQ ID NO: 181510 - protein, 9 aa, Homo Sapiens
TTSSTGNAS

SEQ ID NO: 181511 - protein, 9 aa, Homo Sapiens
LLPLLLEVV

SEQ ID NO: 181512 - protein, 9 aa, Homo Sapiens
ATYTPRHPR

SEQ ID NO: 181513 - protein, 9 aa, Homo Sapiens
CSRRPRAAT

SEQ ID NO: 181514 - protein, 9 aa, Homo Sapiens
RIYLDELMK

SEQ ID NO: 181515 - protein, 9 aa, Homo Sapiens
YHHMVFSSC

SEQ ID NO: 181516 - protein, 9 aa, Homo Sapiens
LHHWAKVVL

SEQ ID NO: 181517 - protein, 9 aa, Homo Sapiens
VSPRQTPEL

SEQ ID NO: 181518 - protein, 9 aa, Homo Sapiens
HDVKHFLLG

SEQ ID NO: 181519 - protein, 9 aa, Homo Sapiens
PPSRLSPPE

SEQ ID NO: 181520 - protein, 9 aa, Homo Sapiens
QVHRLWLAA

SEQ ID NO: 181521 - protein, 9 aa, Homo Sapiens
KLNLTDTGC

SEQ ID NO: 181522 - protein, 9 aa, Homo Sapiens
RPEPRFGSM

SEQ ID NO: 181523 - protein, 9 aa, Homo Sapiens
QPIYLAKPI

SEQ ID NO: 181524 - protein, 9 aa, Homo Sapiens
QLRLTDMNY

SEQ ID NO: 181525 - protein, 9 aa, Homo Sapiens
GGPLPGPLP

SEQ ID NO: 181526 - protein, 9 aa, Homo Sapiens
DLAKHQELL

SEQ ID NO: 181527 - protein, 9 aa, Homo Sapiens
PCAKATSPT

SEQ ID NO: 181528 - protein, 9 aa, Homo Sapiens
FGLCVAYDL

SEQ ID NO: 181529 - protein, 9 aa, Homo Sapiens
FCSDKHFYS

SEQ ID NO: 181530 - protein, 9 aa, Homo Sapiens
LYRNCIYTY

SEQ ID NO: 181531 - protein, 9 aa, Homo Sapiens
TPCRALFYP

SEQ ID NO: 181532 - protein, 9 aa, Homo Sapiens
KEGAVVIDV

SEQ ID NO: 181533 - protein, 9 aa, Homo Sapiens
WWWSARTVS

SEQ ID NO: 181534 - protein, 9 aa, Homo Sapiens
DLSVNQLED

SEQ ID NO: 181535 - protein, 9 aa, Homo Sapiens
FPKILTNVV

SEQ ID NO: 181536 - protein, 9 aa, Homo Sapiens
DLAVNVCIR

SEQ ID NO: 181537 - protein, 9 aa, Homo Sapiens
AGLGGWHGF

SEQ ID NO: 181538 - protein, 9 aa, Homo Sapiens
YGTQRECCS

SEQ ID NO: 181539 - protein, 9 aa, Homo Sapiens
LWDLFHIGN

SEQ ID NO: 181540 - protein, 9 aa, Homo Sapiens
RLDKVFVVT

SEQ ID NO: 181541 - protein, 9 aa, Homo Sapiens
LALSSSPSA

SEQ ID NO: 181542 - protein, 9 aa, Homo Sapiens
TWRVCIYGK

SEQ ID NO: 181543 - protein, 9 aa, Homo Sapiens
WTPQVNSPR

SEQ ID NO: 181544 - protein, 9 aa, Homo Sapiens
RAELFAQLA

SEQ ID NO: 181545 - protein, 9 aa, Homo Sapiens
ENFTVEAAN

SEQ ID NO: 181546 - protein, 9 aa, Homo Sapiens
GRSMEQFQV

SEQ ID NO: 181547 - protein, 9 aa, Homo Sapiens
KENALDQAE

SEQ ID NO: 181548 - protein, 9 aa, Homo Sapiens
SDINLKIKT

SEQ ID NO: 181549 - protein, 9 aa, Homo Sapiens
TRKVPEVTE

SEQ ID NO: 181550 - protein, 9 aa, Homo Sapiens
KKRLKKRRR

SEQ ID NO: 181551 - protein, 9 aa, Homo Sapiens
PWDTERNLR

SEQ ID NO: 181552 - protein, 9 aa, Homo Sapiens
DVTSKSNPF

SEQ ID NO: 181553 - protein, 9 aa, Homo Sapiens
FRGVEDNPM

SEQ ID NO: 181554 - protein, 9 aa, Homo Sapiens
FIQQCPFFY

SEQ ID NO: 181555 - protein, 9 aa, Homo Sapiens
FGTRVTNSS

SEQ ID NO: 181556 - protein, 9 aa, Homo Sapiens
TFLRDQWNW

SEQ ID NO: 181557 - protein, 9 aa, Homo Sapiens
ITSFRILAS

SEQ ID NO: 181558 - protein, 9 aa, Homo Sapiens
KHHKHHKHG

SEQ ID NO: 181559 - protein, 9 aa, Homo Sapiens
FEAQGQLQA

SEQ ID NO: 181560 - protein, 9 aa, Homo Sapiens
SGIHPAEDM

SEQ ID NO: 181561 - protein, 9 aa, Homo Sapiens
PDLQKQLWA

SEQ ID NO: 181562 - protein, 9 aa, Homo Sapiens
LCNDNLPTS

SEQ ID NO: 181563 - protein, 9 aa, Homo Sapiens
DHVEMLYPV

SEQ ID NO: 181564 - protein, 9 aa, Homo Sapiens
TQAELFVLL

SEQ ID NO: 181565 - protein, 9 aa, Homo Sapiens
SQPSNWIQK

SEQ ID NO: 181566 - protein, 9 aa, Homo Sapiens
PPQRTVPRC

SEQ ID NO: 181567 - protein, 9 aa, Homo Sapiens
TPRPRVHVP

SEQ ID NO: 181568 - protein, 9 aa, Homo Sapiens
IQSGTAYLL

SEQ ID NO: 181569 - protein, 9 aa, Homo Sapiens
PVKAKKTEE

SEQ ID NO: 181570 - protein, 9 aa, Homo Sapiens
KMESKQGTV

SEQ ID NO: 181571 - protein, 9 aa, Homo Sapiens
LARGGINFK

SEQ ID NO: 181572 - protein, 9 aa, Homo Sapiens
GTTSSTGNA

SEQ ID NO: 181573 - protein, 9 aa, Homo Sapiens
FDAHPRWES

SEQ ID NO: 181574 - protein, 9 aa, Homo Sapiens
WGGAPLQEE

SEQ ID NO: 181575 - protein, 9 aa, Homo Sapiens
ILEREGSRA

SEQ ID NO: 181576 - protein, 9 aa, Homo Sapiens
PALKQVSPA

SEQ ID NO: 181577 - protein, 9 aa, Homo Sapiens
KFIKRGEFS

SEQ ID NO: 181578 - protein, 9 aa, Homo Sapiens
PYSAYYYPI

SEQ ID NO: 181579 - protein, 9 aa, Homo Sapiens
VNLFSHGTR

SEQ ID NO: 181580 - protein, 9 aa, Homo Sapiens
VWVQSIVVE

SEQ ID NO: 181581 - protein, 9 aa, Homo Sapiens
EQLNIYKNR

SEQ ID NO: 181582 - protein, 9 aa, Homo Sapiens
GPARGTTSS

SEQ ID NO: 181583 - protein, 9 aa, Homo Sapiens
PGSSFTRAT

SEQ ID NO: 181584 - protein, 9 aa, Homo Sapiens
ASHFIVIAD

SEQ ID NO: 181585 - protein, 9 aa, Homo Sapiens
LEGEHNTEV

SEQ ID NO: 181586 - protein, 9 aa, Homo Sapiens
RDEVVRAQV

SEQ ID NO: 181587 - protein, 9 aa, Homo Sapiens
PTVKSLPCN

SEQ ID NO: 181588 - protein, 9 aa, Homo Sapiens
CQYPVPGGP

SEQ ID NO: 181589 - protein, 9 aa, Homo Sapiens
TQGPRLASL

SEQ ID NO: 181590 - protein, 9 aa, Homo Sapiens
EKAGAATMK

SEQ ID NO: 181591 - protein, 9 aa, Homo Sapiens
DDTDSNRAS

SEQ ID NO: 181592 - protein, 9 aa, Homo Sapiens
VEGVSHHAA

SEQ ID NO: 181593 - protein, 9 aa, Homo Sapiens
GVVLGQSGA

SEQ ID NO: 181594 - protein, 9 aa, Homo Sapiens
HLDGLLFCR

SEQ ID NO: 181595 - protein, 9 aa, Homo Sapiens
RIPRRPHRH

SEQ ID NO: 181596 - protein, 9 aa, Homo Sapiens
ILVKFWNSN

SEQ ID NO: 181597 - protein, 9 aa, Homo Sapiens
DGCAEGNGR

SEQ ID NO: 181598 - protein, 9 aa, Homo Sapiens
KLNDGHFVP

SEQ ID NO: 181599 - protein, 9 aa, Homo Sapiens
LQKERIQED

SEQ ID NO: 181600 - protein, 9 aa, Homo Sapiens
VGGKEPTID

SEQ ID NO: 181601 - protein, 9 aa, Homo Sapiens
ATIFGDPHS

SEQ ID NO: 181602 - protein, 9 aa, Homo Sapiens
PSTPLPLVT

SEQ ID NO: 181603 - protein, 9 aa, Homo Sapiens
LPKEELQGS

SEQ ID NO: 181604 - protein, 9 aa, Homo Sapiens
RTPGPCVTA

SEQ ID NO: 181605 - protein, 9 aa, Homo Sapiens
RSGPDQRLC

SEQ ID NO: 181606 - protein, 9 aa, Homo Sapiens
AHCIKKGRV

SEQ ID NO: 181607 - protein, 9 aa, Homo Sapiens
DFTFLRDQW

SEQ ID NO: 181608 - protein, 9 aa, Homo Sapiens
PLEAFVFPM

SEQ ID NO: 181609 - protein, 9 aa, Homo Sapiens
QTTVAKSNE

SEQ ID NO: 181610 - protein, 9 aa, Homo Sapiens
VSQRALLHS

SEQ ID NO: 181611 - protein, 9 aa, Homo Sapiens
LGMSLTSDA

SEQ ID NO: 181612 - protein, 9 aa, Homo Sapiens
GAALQTGPG

SEQ ID NO: 181613 - protein, 9 aa, Homo Sapiens
ILYFYIKRR

SEQ ID NO: 181614 - protein, 9 aa, Homo Sapiens
EHLAHGSPF

SEQ ID NO: 181615 - protein, 9 aa, Homo Sapiens
QQDLQSSEN

SEQ ID NO: 181616 - protein, 9 aa, Homo Sapiens
VGISAQQNC

SEQ ID NO: 181617 - protein, 9 aa, Homo Sapiens
LQTHPREAI

SEQ ID NO: 181618 - protein, 9 aa, Homo Sapiens
EWYTMSACP

SEQ ID NO: 181619 - protein, 9 aa, Homo Sapiens
EDIMSSGDL

SEQ ID NO: 181620 - protein, 9 aa, Homo Sapiens
PQAVIDDAF

SEQ ID NO: 181621 - protein, 9 aa, Homo Sapiens
EGPTTDVEP

SEQ ID NO: 181622 - protein, 9 aa, Homo Sapiens
EWPKREHGD

SEQ ID NO: 181623 - protein, 9 aa, Homo Sapiens
LDVKKDKGA

SEQ ID NO: 181624 - protein, 9 aa, Homo Sapiens
GHLPSSQNI

SEQ ID NO: 181625 - protein, 9 aa, Homo Sapiens
ETRALARSH

SEQ ID NO: 181626 - protein, 9 aa, Homo Sapiens
PDFGSLRYG

SEQ ID NO: 181627 - protein, 9 aa, Homo Sapiens
KHQELLGKK

SEQ ID NO: 181628 - protein, 9 aa, Homo Sapiens
EYGGFTEAP

SEQ ID NO: 181629 - protein, 9 aa, Homo Sapiens
IQRTTSTLG

SEQ ID NO: 181630 - protein, 9 aa, Homo Sapiens
PELVLYTLC

SEQ ID NO: 181631 - protein, 9 aa, Homo Sapiens
QRSKMSQTL

SEQ ID NO: 181632 - protein, 9 aa, Homo Sapiens
SFSVLNIHM

SEQ ID NO: 181633 - protein, 9 aa, Homo Sapiens
WLVCRAIFS

SEQ ID NO: 181634 - protein, 9 aa, Homo Sapiens
LPRPPRTAT

SEQ ID NO: 181635 - protein, 9 aa, Homo Sapiens
EVVPNIPLV

SEQ ID NO: 181636 - protein, 9 aa, Homo Sapiens
ALAAGLHDT

SEQ ID NO: 181637 - protein, 9 aa, Homo Sapiens
DKEPTEQVV

SEQ ID NO: 181638 - protein, 9 aa, Homo Sapiens
IPLPSFVEL

SEQ ID NO: 181639 - protein, 9 aa, Homo Sapiens
LQCQSLALP

SEQ ID NO: 181640 - protein, 9 aa, Homo Sapiens
KKTETVEEQ

SEQ ID NO: 181641 - protein, 9 aa, Homo Sapiens
LGSRLHSWC

SEQ ID NO: 181642 - protein, 9 aa, Homo Sapiens
RHAPRLSKK

SEQ ID NO: 181643 - protein, 9 aa, Homo Sapiens
KDCHLALLF

SEQ ID NO: 181644 - protein, 9 aa, Homo Sapiens
RWRDYKRLW

SEQ ID NO: 181645 - protein, 9 aa, Homo Sapiens
DTFNDASPP

SEQ ID NO: 181646 - protein, 9 aa, Homo Sapiens
GRRCLTRAP

SEQ ID NO: 181647 - protein, 9 aa, Homo Sapiens
WWAPACTRW

SEQ ID NO: 181648 - protein, 9 aa, Homo Sapiens
SVPWSAGCW

SEQ ID NO: 181649 - protein, 9 aa, Homo Sapiens
KCVLKSKTY

SEQ ID NO: 181650 - protein, 9 aa, Homo Sapiens
FQDMMGHRS

SEQ ID NO: 181651 - protein, 9 aa, Homo Sapiens
TQSGRCPAA

SEQ ID NO: 181652 - protein, 9 aa, Homo Sapiens
FGWKLVRGD

SEQ ID NO: 181653 - protein, 9 aa, Homo Sapiens
KALTRERIK

SEQ ID NO: 181654 - protein, 9 aa, Homo Sapiens
ALYWMMQRS

SEQ ID NO: 181655 - protein, 9 aa, Homo Sapiens
SAGTFVLEA

SEQ ID NO: 181656 - protein, 9 aa, Homo Sapiens
QAWDSEDFG

SEQ ID NO: 181657 - protein, 9 aa, Homo Sapiens
HCIKKGRVM

SEQ ID NO: 181658 - protein, 9 aa, Homo Sapiens
GSPTTRSCG

SEQ ID NO: 181659 - protein, 9 aa, Homo Sapiens
EEVKKEMAH

SEQ ID NO: 181660 - protein, 9 aa, Homo Sapiens
DYTEVKTHC

SEQ ID NO: 181661 - protein, 9 aa, Homo Sapiens
LAVLDHPAE

SEQ ID NO: 181662 - protein, 9 aa, Homo Sapiens
IRFDVPEYS

SEQ ID NO: 181663 - protein, 9 aa, Homo Sapiens
QTLTTQTLP

SEQ ID NO: 181664 - protein, 9 aa, Homo Sapiens
RRRGAAGRQ

SEQ ID NO: 181665 - protein, 9 aa, Homo Sapiens
LVKVIQVEG

SEQ ID NO: 181666 - protein, 9 aa, Homo Sapiens
CPPSRAASL

SEQ ID NO: 181667 - protein, 9 aa, Homo Sapiens
LASLMFFGN

SEQ ID NO: 181668 - protein, 9 aa, Homo Sapiens
LDAVETLGS

SEQ ID NO: 181669 - protein, 9 aa, Homo Sapiens
EGSIPIDQV

SEQ ID NO: 181670 - protein, 9 aa, Homo Sapiens
ASQDLLGET

SEQ ID NO: 181671 - protein, 9 aa, Homo Sapiens
SISKNFSPM

SEQ ID NO: 181672 - protein, 9 aa, Homo Sapiens
NEELFNILD

SEQ ID NO: 181673 - protein, 9 aa, Homo Sapiens
VDCLQAFWD

SEQ ID NO: 181674 - protein, 9 aa, Homo Sapiens
LFGIQVIQE

SEQ ID NO: 181675 - protein, 9 aa, Homo Sapiens
KFLSSTHPV

SEQ ID NO: 181676 - protein, 9 aa, Homo Sapiens
KFEEFQTTV

SEQ ID NO: 181677 - protein, 9 aa, Homo Sapiens
CSQGDEDDK

SEQ ID NO: 181678 - protein, 9 aa, Homo Sapiens
IEALVASYL

SEQ ID NO: 181679 - protein, 9 aa, Homo Sapiens
PEKLALKED

SEQ ID NO: 181680 - protein, 9 aa, Homo Sapiens
KPFRDKPIT

SEQ ID NO: 181681 - protein, 9 aa, Homo Sapiens
SNETPKKKE

SEQ ID NO: 181682 - protein, 9 aa, Homo Sapiens
PQRPPLQPV

SEQ ID NO: 181683 - protein, 9 aa, Homo Sapiens
RIIHLGAKQ

SEQ ID NO: 181684 - protein, 9 aa, Homo Sapiens
GVEEDDDDD

SEQ ID NO: 181685 - protein, 9 aa, Homo Sapiens
SWCGRDASH

SEQ ID NO: 181686 - protein, 9 aa, Homo Sapiens
LLLAVEGPT

SEQ ID NO: 181687 - protein, 9 aa, Homo Sapiens
VLSFTHHIS

SEQ ID NO: 181688 - protein, 9 aa, Homo Sapiens
PAHPTVPHG

SEQ ID NO: 181689 - protein, 9 aa, Homo Sapiens
KEKLADLWG

SEQ ID NO: 181690 - protein, 9 aa, Homo Sapiens
ATLIFFAIW

SEQ ID NO: 181691 - protein, 9 aa, Homo Sapiens
EKVSKKDSQ

SEQ ID NO: 181692 - protein, 9 aa, Homo Sapiens
LKPSGEQIP

SEQ ID NO: 181693 - protein, 9 aa, Homo Sapiens
QGCVQVTFS

SEQ ID NO: 181694 - protein, 9 aa, Homo Sapiens
ARGGINFKD

SEQ ID NO: 181695 - protein, 9 aa, Homo Sapiens
MSPQPLTQG

SEQ ID NO: 181696 - protein, 9 aa, Homo Sapiens
VRTLSGSWP

SEQ ID NO: 181697 - protein, 9 aa, Homo Sapiens
FPGYTGPKG

SEQ ID NO: 181698 - protein, 9 aa, Homo Sapiens
CPRPSATSQ

SEQ ID NO: 181699 - protein, 9 aa, Homo Sapiens
TLGMSLTSD

SEQ ID NO: 181700 - protein, 9 aa, Homo Sapiens
CEVLGSVLC

SEQ ID NO: 181701 - protein, 9 aa, Homo Sapiens
MCVGSSPSS

SEQ ID NO: 181702 - protein, 9 aa, Homo Sapiens
WAQLLLQLV

SEQ ID NO: 181703 - protein, 9 aa, Homo Sapiens
AGLHDTCYS

SEQ ID NO: 181704 - protein, 9 aa, Homo Sapiens
PSLPKQPLL

SEQ ID NO: 181705 - protein, 9 aa, Homo Sapiens
AASVTGPDG

SEQ ID NO: 181706 - protein, 9 aa, Homo Sapiens
EPRAKNISV

SEQ ID NO: 181707 - protein, 9 aa, Homo Sapiens
GQRRGVLQL

SEQ ID NO: 181708 - protein, 9 aa, Homo Sapiens
HGGQFKFIV

SEQ ID NO: 181709 - protein, 9 aa, Homo Sapiens
SGFRQLCRI

SEQ ID NO: 181710 - protein, 9 aa, Homo Sapiens
RDCSMPPLL

SEQ ID NO: 181711 - protein, 9 aa, Homo Sapiens
LWLPVVLWI

SEQ ID NO: 181712 - protein, 9 aa, Homo Sapiens
LKDLLSRIY

SEQ ID NO: 181713 - protein, 9 aa, Homo Sapiens
HCHPRSRPA

SEQ ID NO: 181714 - protein, 9 aa, Homo Sapiens
ERYLDPSMT

SEQ ID NO: 181715 - protein, 9 aa, Homo Sapiens
VGNQTSFAI

SEQ ID NO: 181716 - protein, 9 aa, Homo Sapiens
DTCYSSDEA

SEQ ID NO: 181717 - protein, 9 aa, Homo Sapiens
SLVEKKLSR

SEQ ID NO: 181718 - protein, 9 aa, Homo Sapiens
KRRSMICWL

SEQ ID NO: 181719 - protein, 9 aa, Homo Sapiens
FGWNIYVVD

SEQ ID NO: 181720 - protein, 9 aa, Homo Sapiens
DVQAVDKDL

SEQ ID NO: 181721 - protein, 9 aa, Homo Sapiens
ASLPTPLTL

SEQ ID NO: 181722 - protein, 9 aa, Homo Sapiens
ALEMDFSLP

SEQ ID NO: 181723 - protein, 9 aa, Homo Sapiens
PAATVSRAA

SEQ ID NO: 181724 - protein, 9 aa, Homo Sapiens
AQPTVSTGG

SEQ ID NO: 181725 - protein, 9 aa, Homo Sapiens
YQRLRDEVV

SEQ ID NO: 181726 - protein, 9 aa, Homo Sapiens
SHHDQQRDP

SEQ ID NO: 181727 - protein, 9 aa, Homo Sapiens
INEKIGPRT

SEQ ID NO: 181728 - protein, 9 aa, Homo Sapiens
PSSMLPRRP

SEQ ID NO: 181729 - protein, 9 aa, Homo Sapiens
STCYSTQVS

SEQ ID NO: 181730 - protein, 9 aa, Homo Sapiens
SDMTKKTFN

SEQ ID NO: 181731 - protein, 9 aa, Homo Sapiens
NIRPMWQLA

SEQ ID NO: 181732 - protein, 9 aa, Homo Sapiens
RAAWCGKVP

SEQ ID NO: 181733 - protein, 9 aa, Homo Sapiens
GSPRQGCLP

SEQ ID NO: 181734 - protein, 9 aa, Homo Sapiens
MYGKHTPWE

SEQ ID NO: 181735 - protein, 9 aa, Homo Sapiens
TDEQKTSLK

SEQ ID NO: 181736 - protein, 9 aa, Homo Sapiens
QVGLFLTAI

SEQ ID NO: 181737 - protein, 9 aa, Homo Sapiens
QQALAEVLE

SEQ ID NO: 181738 - protein, 9 aa, Homo Sapiens
QPRSLDSVV

SEQ ID NO: 181739 - protein, 9 aa, Homo Sapiens
CRVRVLAHH

SEQ ID NO: 181740 - protein, 9 aa, Homo Sapiens
TPIADVQAV

SEQ ID NO: 181741 - protein, 9 aa, Homo Sapiens
VPVLGFGTY

SEQ ID NO: 181742 - protein, 9 aa, Homo Sapiens
IAHPRQPVA

SEQ ID NO: 181743 - protein, 9 aa, Homo Sapiens
TTGVRTRGS

SEQ ID NO: 181744 - protein, 9 aa, Homo Sapiens
ALDNSVYMW

SEQ ID NO: 181745 - protein, 9 aa, Homo Sapiens
NASGTRKQP

SEQ ID NO: 181746 - protein, 9 aa, Homo Sapiens
SNRGVQQVS

SEQ ID NO: 181747 - protein, 9 aa, Homo Sapiens
SALEDDLTQ

SEQ ID NO: 181748 - protein, 9 aa, Homo Sapiens
FGTLPRKGR

SEQ ID NO: 181749 - protein, 9 aa, Homo Sapiens
RKKLFRIRG

SEQ ID NO: 181750 - protein, 9 aa, Homo Sapiens
LHSSCLHGN

SEQ ID NO: 181751 - protein, 9 aa, Homo Sapiens
RLHQAAFQK

SEQ ID NO: 181752 - protein, 9 aa, Homo Sapiens
VAQHEGLIR

SEQ ID NO: 181753 - protein, 9 aa, Homo Sapiens
ALKKFFLCL

SEQ ID NO: 181754 - protein, 9 aa, Homo Sapiens
AVSPRQTPE

SEQ ID NO: 181755 - protein, 9 aa, Homo Sapiens
AHASCHVQF

SEQ ID NO: 181756 - protein, 9 aa, Homo Sapiens
FVVDLAVNV

SEQ ID NO: 181757 - protein, 9 aa, Homo Sapiens
VNGKSYKIT

SEQ ID NO: 181758 - protein, 9 aa, Homo Sapiens
YSLMVRCAN

SEQ ID NO: 181759 - protein, 9 aa, Homo Sapiens
AEVREGEEG

SEQ ID NO: 181760 - protein, 9 aa, Homo Sapiens
GCSLGSRLH

SEQ ID NO: 181761 - protein, 9 aa, Homo Sapiens
RPHRHCHPR

SEQ ID NO: 181762 - protein, 9 aa, Homo Sapiens
VLYVFMGRN

SEQ ID NO: 181763 - protein, 9 aa, Homo Sapiens
CTVSLSTAW

SEQ ID NO: 181764 - protein, 9 aa, Homo Sapiens
AGPLREKVH

SEQ ID NO: 181765 - protein, 9 aa, Homo Sapiens
GRENCDGHT

SEQ ID NO: 181766 - protein, 9 aa, Homo Sapiens
TAPGEGLLA

SEQ ID NO: 181767 - protein, 9 aa, Homo Sapiens
VPGKKCGII

SEQ ID NO: 181768 - protein, 9 aa, Homo Sapiens
AHPSRPCRM

SEQ ID NO: 181769 - protein, 9 aa, Homo Sapiens
TLRPVTHGG

SEQ ID NO: 181770 - protein, 9 aa, Homo Sapiens
VFGIWSEGV

SEQ ID NO: 181771 - protein, 9 aa, Homo Sapiens
WKALRDMPQ

SEQ ID NO: 181772 - protein, 9 aa, Homo Sapiens
QDVTTEISP

SEQ ID NO: 181773 - protein, 9 aa, Homo Sapiens
CMVGNSYHH

SEQ ID NO: 181774 - protein, 9 aa, Homo Sapiens
LQVMVSVSQ

SEQ ID NO: 181775 - protein, 9 aa, Homo Sapiens
PKREHGDPS

SEQ ID NO: 181776 - protein, 9 aa, Homo Sapiens
DLRAHRCTH

SEQ ID NO: 181777 - protein, 9 aa, Homo Sapiens
NVDLLNRTW

SEQ ID NO: 181778 - protein, 9 aa, Homo Sapiens
RCEKPVLLL

SEQ ID NO: 181779 - protein, 9 aa, Homo Sapiens
VVLQYGCCA

SEQ ID NO: 181780 - protein, 9 aa, Homo Sapiens
EHNTEVKEQ

SEQ ID NO: 181781 - protein, 9 aa, Homo Sapiens
GLTLELAGT

SEQ ID NO: 181782 - protein, 9 aa, Homo Sapiens
LSPENTELL

SEQ ID NO: 181783 - protein, 9 aa, Homo Sapiens
AEEKISLPR

SEQ ID NO: 181784 - protein, 9 aa, Homo Sapiens
FHCPLCEKR

SEQ ID NO: 181785 - protein, 9 aa, Homo Sapiens
ASSAQEFGP

SEQ ID NO: 181786 - protein, 9 aa, Homo Sapiens
LGTPAPTGL

SEQ ID NO: 181787 - protein, 9 aa, Homo Sapiens
HTPWEDPSK

SEQ ID NO: 181788 - protein, 9 aa, Homo Sapiens
LGEWMTQRV

SEQ ID NO: 181789 - protein, 9 aa, Homo Sapiens
ARWGLQQAG

SEQ ID NO: 181790 - protein, 9 aa, Homo Sapiens
SLENLPCFP

SEQ ID NO: 181791 - protein, 9 aa, Homo Sapiens
SQSYSSTMT

SEQ ID NO: 181792 - protein, 9 aa, Homo Sapiens
SSDLSKSSD

SEQ ID NO: 181793 - protein, 9 aa, Homo Sapiens
AKPGAPPSR

SEQ ID NO: 181794 - protein, 9 aa, Homo Sapiens
RNCIYTYRI

SEQ ID NO: 181795 - protein, 9 aa, Homo Sapiens
KLHESQEGR

SEQ ID NO: 181796 - protein, 9 aa, Homo Sapiens
EEANILFDG

SEQ ID NO: 181797 - protein, 9 aa, Homo Sapiens
FFGNQSIIT

SEQ ID NO: 181798 - protein, 9 aa, Homo Sapiens
GRKSLSGLE

SEQ ID NO: 181799 - protein, 9 aa, Homo Sapiens
APASPGRRP

SEQ ID NO: 181800 - protein, 9 aa, Homo Sapiens
LNIHMAKSY

SEQ ID NO: 181801 - protein, 9 aa, Homo Sapiens
EDDPYGARN

SEQ ID NO: 181802 - protein, 9 aa, Homo Sapiens
IVLSIFIAC

SEQ ID NO: 181803 - protein, 9 aa, Homo Sapiens
SAVCSADES

SEQ ID NO: 181804 - protein, 9 aa, Homo Sapiens
DSAQLGPGA

SEQ ID NO: 181805 - protein, 9 aa, Homo Sapiens
VTLFFHSQP

SEQ ID NO: 181806 - protein, 9 aa, Homo Sapiens
SLLVTLFFH

SEQ ID NO: 181807 - protein, 9 aa, Homo Sapiens
PSSSPTWRV

SEQ ID NO: 181808 - protein, 9 aa, Homo Sapiens
AFRGSLLGC

SEQ ID NO: 181809 - protein, 9 aa, Homo Sapiens
ATPRDRLSF

SEQ ID NO: 181810 - protein, 9 aa, Homo Sapiens
WVQVPKGVI

SEQ ID NO: 181811 - protein, 9 aa, Homo Sapiens
LYRDAMLEN

SEQ ID NO: 181812 - protein, 9 aa, Homo Sapiens
KRRIHKNFT

SEQ ID NO: 181813 - protein, 9 aa, Homo Sapiens
PPTTGLPAT

SEQ ID NO: 181814 - protein, 9 aa, Homo Sapiens
QRRGVLQLL

SEQ ID NO: 181815 - protein, 9 aa, Homo Sapiens
ARVEQARRK

SEQ ID NO: 181816 - protein, 9 aa, Homo Sapiens
MEVWVQSIV

SEQ ID NO: 181817 - protein, 9 aa, Homo Sapiens
GSRGAAGQR

SEQ ID NO: 181818 - protein, 9 aa, Homo Sapiens
VADYYFLHH

SEQ ID NO: 181819 - protein, 9 aa, Homo Sapiens
GEEPRGAGG

SEQ ID NO: 181820 - protein, 9 aa, Homo Sapiens
RYLDPSMTE

SEQ ID NO: 181821 - protein, 9 aa, Homo Sapiens
CECRPKKRT

SEQ ID NO: 181822 - protein, 9 aa, Homo Sapiens
MREMRAGGC

SEQ ID NO: 181823 - protein, 9 aa, Homo Sapiens
SILARLPAR

SEQ ID NO: 181824 - protein, 9 aa, Homo Sapiens
WLRKRLCNL

SEQ ID NO: 181825 - protein, 9 aa, Homo Sapiens
KGRVMVKAT

SEQ ID NO: 181826 - protein, 9 aa, Homo Sapiens
IQKQLATIQ

SEQ ID NO: 181827 - protein, 9 aa, Homo Sapiens
DFIQRAVYK

SEQ ID NO: 181828 - protein, 9 aa, Homo Sapiens
TRRSPLPID

SEQ ID NO: 181829 - protein, 9 aa, Homo Sapiens
KRTFSSIRC

SEQ ID NO: 181830 - protein, 9 aa, Homo Sapiens
LLHHWAKVV

SEQ ID NO: 181831 - protein, 9 aa, Homo Sapiens
LAQLVAVGG

SEQ ID NO: 181832 - protein, 9 aa, Homo Sapiens
SATSQTPGR

SEQ ID NO: 181833 - protein, 9 aa, Homo Sapiens
QALCLLFQV

SEQ ID NO: 181834 - protein, 9 aa, Homo Sapiens
RGASSSTSR

SEQ ID NO: 181835 - protein, 9 aa, Homo Sapiens
EEEEKKRLK

SEQ ID NO: 181836 - protein, 9 aa, Homo Sapiens
VQTCGPVHL

SEQ ID NO: 181837 - protein, 9 aa, Homo Sapiens
QPEPESIRK

SEQ ID NO: 181838 - protein, 9 aa, Homo Sapiens
GIRLRCIRR

SEQ ID NO: 181839 - protein, 9 aa, Homo Sapiens
ADYAVGFNG

SEQ ID NO: 181840 - protein, 9 aa, Homo Sapiens
PDHPWHQPS

SEQ ID NO: 181841 - protein, 9 aa, Homo Sapiens
IALMTTVVI

SEQ ID NO: 181842 - protein, 9 aa, Homo Sapiens
ELLGKKLLS

SEQ ID NO: 181843 - protein, 9 aa, Homo Sapiens
IRRTQNAEL

SEQ ID NO: 181844 - protein, 9 aa, Homo Sapiens
YQYMNPAIV

SEQ ID NO: 181845 - protein, 9 aa, Homo Sapiens
SVIFFFFVY

SEQ ID NO: 181846 - protein, 9 aa, Homo Sapiens
EKIPTSHLV

SEQ ID NO: 181847 - protein, 9 aa, Homo Sapiens
EMWKKNEEF

SEQ ID NO: 181848 - protein, 9 aa, Homo Sapiens
LDVEEWGKL

SEQ ID NO: 181849 - protein, 9 aa, Homo Sapiens
PYLQSVKKR

SEQ ID NO: 181850 - protein, 9 aa, Homo Sapiens
CTRAVLAQA

SEQ ID NO: 181851 - protein, 9 aa, Homo Sapiens
SSSTSSLWS

SEQ ID NO: 181852 - protein, 9 aa, Homo Sapiens
PTALLSSAW

SEQ ID NO: 181853 - protein, 9 aa, Homo Sapiens
VVTDAVRKE

SEQ ID NO: 181854 - protein, 9 aa, Homo Sapiens
GKWQGEEVA

SEQ ID NO: 181855 - protein, 9 aa, Homo Sapiens
TWAGRGDSG

SEQ ID NO: 181856 - protein, 9 aa, Homo Sapiens
NVSGSMRQH

SEQ ID NO: 181857 - protein, 9 aa, Homo Sapiens
SYHHMVFSS

SEQ ID NO: 181858 - protein, 9 aa, Homo Sapiens
VDADMPPLP

SEQ ID NO: 181859 - protein, 9 aa, Homo Sapiens
SRRRKNQKR

SEQ ID NO: 181860 - protein, 9 aa, Homo Sapiens
PFHFQHLAV

SEQ ID NO: 181861 - protein, 9 aa, Homo Sapiens
CGIIILSAE

SEQ ID NO: 181862 - protein, 9 aa, Homo Sapiens
HVLWPFGFE

SEQ ID NO: 181863 - protein, 9 aa, Homo Sapiens
SGLALKGFL

SEQ ID NO: 181864 - protein, 9 aa, Homo Sapiens
GSQRAVRGT

SEQ ID NO: 181865 - protein, 9 aa, Homo Sapiens
WQSPLRKVR

SEQ ID NO: 181866 - protein, 9 aa, Homo Sapiens
APSLGRGLD

SEQ ID NO: 181867 - protein, 9 aa, Homo Sapiens
EDGCAEGNG

SEQ ID NO: 181868 - protein, 9 aa, Homo Sapiens
KHALPRTGG

SEQ ID NO: 181869 - protein, 9 aa, Homo Sapiens
NIQPNSAPS

SEQ ID NO: 181870 - protein, 9 aa, Homo Sapiens
STRSSPTLT

SEQ ID NO: 181871 - protein, 9 aa, Homo Sapiens
YSSSQVPRL

SEQ ID NO: 181872 - protein, 9 aa, Homo Sapiens
GVAILQIPS

SEQ ID NO: 181873 - protein, 9 aa, Homo Sapiens
QRLPLFYTI

SEQ ID NO: 181874 - protein, 9 aa, Homo Sapiens
SRGAAGQRR

SEQ ID NO: 181875 - protein, 9 aa, Homo Sapiens
QKMTSSDKL

SEQ ID NO: 181876 - protein, 9 aa, Homo Sapiens
STNRAPSSC

SEQ ID NO: 181877 - protein, 9 aa, Homo Sapiens
NGALFLLIQ

SEQ ID NO: 181878 - protein, 9 aa, Homo Sapiens
AVILLLLCQ

SEQ ID NO: 181879 - protein, 9 aa, Homo Sapiens
SQNCEDAQA

SEQ ID NO: 181880 - protein, 9 aa, Homo Sapiens
KKTHPCTML

SEQ ID NO: 181881 - protein, 9 aa, Homo Sapiens
QIEKDLLRI

SEQ ID NO: 181882 - protein, 9 aa, Homo Sapiens
DKGATYTPR

SEQ ID NO: 181883 - protein, 9 aa, Homo Sapiens
WLCWAAGSP

SEQ ID NO: 181884 - protein, 9 aa, Homo Sapiens
VTCVQASDV

SEQ ID NO: 181885 - protein, 9 aa, Homo Sapiens
CAQPTVSTG

SEQ ID NO: 181886 - protein, 9 aa, Homo Sapiens
STDVHVCSS

SEQ ID NO: 181887 - protein, 9 aa, Homo Sapiens
RQGCLPWRG

SEQ ID NO: 181888 - protein, 9 aa, Homo Sapiens
ENQSLNSDY

SEQ ID NO: 181889 - protein, 9 aa, Homo Sapiens
KKKEALFLQ

SEQ ID NO: 181890 - protein, 9 aa, Homo Sapiens
AQEFGPTSP

SEQ ID NO: 181891 - protein, 9 aa, Homo Sapiens
SIPIDQVGL

SEQ ID NO: 181892 - protein, 9 aa, Homo Sapiens
EDVPRKLLN

SEQ ID NO: 181893 - protein, 9 aa, Homo Sapiens
LTQARNHMN

SEQ ID NO: 181894 - protein, 9 aa, Homo Sapiens
HGDSGISVD

SEQ ID NO: 181895 - protein, 9 aa, Homo Sapiens
SQPQCAVCI

SEQ ID NO: 181896 - protein, 9 aa, Homo Sapiens
HHHPLTVQS

SEQ ID NO: 181897 - protein, 9 aa, Homo Sapiens
QYMNPAIVA

SEQ ID NO: 181898 - protein, 9 aa, Homo Sapiens
CASGVTTST

SEQ ID NO: 181899 - protein, 9 aa, Homo Sapiens
LKQVSPASP

SEQ ID NO: 181900 - protein, 9 aa, Homo Sapiens
LGDFIQRAV

SEQ ID NO: 181901 - protein, 9 aa, Homo Sapiens
QLEVARRRL

SEQ ID NO: 181902 - protein, 9 aa, Homo Sapiens
TVSVLGSSK

SEQ ID NO: 181903 - protein, 9 aa, Homo Sapiens
SLSTAWTTR

SEQ ID NO: 181904 - protein, 9 aa, Homo Sapiens
RALEMDFSL

SEQ ID NO: 181905 - protein, 9 aa, Homo Sapiens
CSWKASPCS

SEQ ID NO: 181906 - protein, 9 aa, Homo Sapiens
RAKSIRAKK

SEQ ID NO: 181907 - protein, 9 aa, Homo Sapiens
NSSLVEKKL

SEQ ID NO: 181908 - protein, 9 aa, Homo Sapiens
LHNKKEGNL

SEQ ID NO: 181909 - protein, 9 aa, Homo Sapiens
ITEYIQEKN

SEQ ID NO: 181910 - protein, 9 aa, Homo Sapiens
WSVRPSDMT

SEQ ID NO: 181911 - protein, 9 aa, Homo Sapiens
SAGCWTVRG

SEQ ID NO: 181912 - protein, 9 aa, Homo Sapiens
WVLIAAHCS

SEQ ID NO: 181913 - protein, 9 aa, Homo Sapiens
LSLQCQSLA

SEQ ID NO: 181914 - protein, 9 aa, Homo Sapiens
QLWRGGKRR

SEQ ID NO: 181915 - protein, 9 aa, Homo Sapiens
ARSPASLSF

SEQ ID NO: 181916 - protein, 9 aa, Homo Sapiens
LCMQLSSHC

SEQ ID NO: 181917 - protein, 9 aa, Homo Sapiens
CPRPRSCVV

SEQ ID NO: 181918 - protein, 9 aa, Homo Sapiens
LSIFIACWA

SEQ ID NO: 181919 - protein, 9 aa, Homo Sapiens
TSGAGGGSH

SEQ ID NO: 181920 - protein, 9 aa, Homo Sapiens
WHLFRTYKS

SEQ ID NO: 181921 - protein, 9 aa, Homo Sapiens
LEQRNMPTE

SEQ ID NO: 181922 - protein, 9 aa, Homo Sapiens
PPPCLSPTI

SEQ ID NO: 181923 - protein, 9 aa, Homo Sapiens
DGKGKEKKV

SEQ ID NO: 181924 - protein, 9 aa, Homo Sapiens
GYNSGFFLE

SEQ ID NO: 181925 - protein, 9 aa, Homo Sapiens
ALKGFLFLH

SEQ ID NO: 181926 - protein, 9 aa, Homo Sapiens
RPTAIRQTL

SEQ ID NO: 181927 - protein, 9 aa, Homo Sapiens
LQHLGQDHS

SEQ ID NO: 181928 - protein, 9 aa, Homo Sapiens
QKAMDERQE

SEQ ID NO: 181929 - protein, 9 aa, Homo Sapiens
PNIDGRSQE

SEQ ID NO: 181930 - protein, 9 aa, Homo Sapiens
LLAGWMRVQ

SEQ ID NO: 181931 - protein, 9 aa, Homo Sapiens
RTVPRCSGR

SEQ ID NO: 181932 - protein, 9 aa, Homo Sapiens
AVNLNLCAG

SEQ ID NO: 181933 - protein, 9 aa, Homo Sapiens
KSDDFLCAR

SEQ ID NO: 181934 - protein, 9 aa, Homo Sapiens
LLGDAAVLV

SEQ ID NO: 181935 - protein, 9 aa, Homo Sapiens
IFSNMFSSV

SEQ ID NO: 181936 - protein, 9 aa, Homo Sapiens
EAQGQLQAW

SEQ ID NO: 181937 - protein, 9 aa, Homo Sapiens
EKKPNIDGR

SEQ ID NO: 181938 - protein, 9 aa, Homo Sapiens
PEQGLAPPH

SEQ ID NO: 181939 - protein, 9 aa, Homo Sapiens
MAAIWKKLV

SEQ ID NO: 181940 - protein, 9 aa, Homo Sapiens
QAQMDTSPA

SEQ ID NO: 181941 - protein, 9 aa, Homo Sapiens
APWGRVLFE

SEQ ID NO: 181942 - protein, 9 aa, Homo Sapiens
FPQCLQSFA

SEQ ID NO: 181943 - protein, 9 aa, Homo Sapiens
NGLILRERG

SEQ ID NO: 181944 - protein, 9 aa, Homo Sapiens
KQQYLDEAE

SEQ ID NO: 181945 - protein, 9 aa, Homo Sapiens
ATARAPACS

SEQ ID NO: 181946 - protein, 9 aa, Homo Sapiens
KCSLYGKKL

SEQ ID NO: 181947 - protein, 9 aa, Homo Sapiens
RVITILIEH

SEQ ID NO: 181948 - protein, 9 aa, Homo Sapiens
GEKKAVEQR

SEQ ID NO: 181949 - protein, 9 aa, Homo Sapiens
AQLGPGASM

SEQ ID NO: 181950 - protein, 9 aa, Homo Sapiens
IATPLRASW

SEQ ID NO: 181951 - protein, 9 aa, Homo Sapiens
SPSFPGNYP

SEQ ID NO: 181952 - protein, 9 aa, Homo Sapiens
DRYQRLRDE

SEQ ID NO: 181953 - protein, 9 aa, Homo Sapiens
MNVNSVGSS

SEQ ID NO: 181954 - protein, 9 aa, Homo Sapiens
AQENMCCNK

SEQ ID NO: 181955 - protein, 9 aa, Homo Sapiens
ILDRFTGDF

SEQ ID NO: 181956 - protein, 9 aa, Homo Sapiens
SKDLDCKKI

SEQ ID NO: 181957 - protein, 9 aa, Homo Sapiens
EHTNWLKNA

SEQ ID NO: 181958 - protein, 9 aa, Homo Sapiens
KKRASVSFW

SEQ ID NO: 181959 - protein, 9 aa, Homo Sapiens
LQAVREMLL

SEQ ID NO: 181960 - protein, 9 aa, Homo Sapiens
KKCGIIILS

SEQ ID NO: 181961 - protein, 9 aa, Homo Sapiens
SLPYSAYYY

SEQ ID NO: 181962 - protein, 9 aa, Homo Sapiens
LQVLNLTYR

SEQ ID NO: 181963 - protein, 9 aa, Homo Sapiens
GVGRRCLTR

SEQ ID NO: 181964 - protein, 9 aa, Homo Sapiens
TTFGVGETR

SEQ ID NO: 181965 - protein, 9 aa, Homo Sapiens
PLNNMCAKK

SEQ ID NO: 181966 - protein, 9 aa, Homo Sapiens
PTESSAVAA

SEQ ID NO: 181967 - protein, 9 aa, Homo Sapiens
GKPSVGNQT

SEQ ID NO: 181968 - protein, 9 aa, Homo Sapiens
GCLPWRGCP

SEQ ID NO: 181969 - protein, 9 aa, Homo Sapiens
APTTRPLAP

SEQ ID NO: 181970 - protein, 9 aa, Homo Sapiens
VSARGPVRL

SEQ ID NO: 181971 - protein, 9 aa, Homo Sapiens
VSWPRASAC

SEQ ID NO: 181972 - protein, 9 aa, Homo Sapiens
HSHIKKKTH

SEQ ID NO: 181973 - protein, 9 aa, Homo Sapiens
ETGNVATCE

SEQ ID NO: 181974 - protein, 9 aa, Homo Sapiens
AGRIIPKPE

SEQ ID NO: 181975 - protein, 9 aa, Homo Sapiens
WTTRKPSSP

SEQ ID NO: 181976 - protein, 9 aa, Homo Sapiens
TLKALVKTW

SEQ ID NO: 181977 - protein, 9 aa, Homo Sapiens
TRKPSSPRP

SEQ ID NO: 181978 - protein, 9 aa, Homo Sapiens
LKALVKTWT

SEQ ID NO: 181979 - protein, 9 aa, Homo Sapiens
LRRTPPAPA

SEQ ID NO: 181980 - protein, 9 aa, Homo Sapiens
LSNPLEMTV

SEQ ID NO: 181981 - protein, 9 aa, Homo Sapiens
KVDESGPPV

SEQ ID NO: 181982 - protein, 9 aa, Homo Sapiens
LASSTLYWK

SEQ ID NO: 181983 - protein, 9 aa, Homo Sapiens
LHHTCIQPH

SEQ ID NO: 181984 - protein, 9 aa, Homo Sapiens
VCITDEIYQ

SEQ ID NO: 181985 - protein, 9 aa, Homo Sapiens
GYHPLDVEE

SEQ ID NO: 181986 - protein, 9 aa, Homo Sapiens
HISDTSVAV

SEQ ID NO: 181987 - protein, 9 aa, Homo Sapiens
HRLEICSAR

SEQ ID NO: 181988 - protein, 9 aa, Homo Sapiens
DKVYLGGLG

SEQ ID NO: 181989 - protein, 9 aa, Homo Sapiens
REGSRAFYR

SEQ ID NO: 181990 - protein, 9 aa, Homo Sapiens
QRAVRGTSP

SEQ ID NO: 181991 - protein, 9 aa, Homo Sapiens
AWAHGRRHG

SEQ ID NO: 181992 - protein, 9 aa, Homo Sapiens
PVVRRGFNW

SEQ ID NO: 181993 - protein, 9 aa, Homo Sapiens
EAFVFPMDE

SEQ ID NO: 181994 - protein, 9 aa, Homo Sapiens
MFTQPLQSV

SEQ ID NO: 181995 - protein, 9 aa, Homo Sapiens
CWESCQEVT

SEQ ID NO: 181996 - protein, 9 aa, Homo Sapiens
RDPIKCQYP

SEQ ID NO: 181997 - protein, 9 aa, Homo Sapiens
SPTADYAVG

SEQ ID NO: 181998 - protein, 9 aa, Homo Sapiens
ISQDFGDAG

SEQ ID NO: 181999 - protein, 9 aa, Homo Sapiens
GDMIVVVNG

SEQ ID NO: 182000 - protein, 9 aa, Homo Sapiens
MVGNSYHHM

SEQ ID NO: 182001 - protein, 9 aa, Homo Sapiens
DGTWLRLVD

SEQ ID NO: 182002 - protein, 9 aa, Homo Sapiens
FNKSQQDAF

SEQ ID NO: 182003 - protein, 9 aa, Homo Sapiens
PGRRPLKKW

SEQ ID NO: 182004 - protein, 9 aa, Homo Sapiens
QALPREKSP

SEQ ID NO: 182005 - protein, 9 aa, Homo Sapiens
TILRPPGPH

SEQ ID NO: 182006 - protein, 9 aa, Homo Sapiens
QTSLSIRKL

SEQ ID NO: 182007 - protein, 9 aa, Homo Sapiens
QSYSSTMTN

SEQ ID NO: 182008 - protein, 9 aa, Homo Sapiens
SKKDSQNCE

SEQ ID NO: 182009 - protein, 9 aa, Homo Sapiens
HTSLTFQRP

SEQ ID NO: 182010 - protein, 9 aa, Homo Sapiens
FGPGTFTYL

SEQ ID NO: 182011 - protein, 9 aa, Homo Sapiens
FANLDGSNR

SEQ ID NO: 182012 - protein, 9 aa, Homo Sapiens
SPFEGKTNT

SEQ ID NO: 182013 - protein, 9 aa, Homo Sapiens
NRQCASLDG

SEQ ID NO: 182014 - protein, 9 aa, Homo Sapiens
GMRMSSGRW

SEQ ID NO: 182015 - protein, 9 aa, Homo Sapiens
SGESTDVHV

SEQ ID NO: 182016 - protein, 9 aa, Homo Sapiens
RWKLGTHYQ

SEQ ID NO: 182017 - protein, 9 aa, Homo Sapiens
DSQPSNWIQ

SEQ ID NO: 182018 - protein, 9 aa, Homo Sapiens
TKDTRKSQE

SEQ ID NO: 182019 - protein, 9 aa, Homo Sapiens
STELLEAQA

SEQ ID NO: 182020 - protein, 9 aa, Homo Sapiens
IVHVPTSLI

SEQ ID NO: 182021 - protein, 9 aa, Homo Sapiens
SQQIKTSHS

SEQ ID NO: 182022 - protein, 9 aa, Homo Sapiens
EEEERRLHQ

SEQ ID NO: 182023 - protein, 9 aa, Homo Sapiens
RRKLHSWKK

SEQ ID NO: 182024 - protein, 9 aa, Homo Sapiens
PRSGLGVGL

SEQ ID NO: 182025 - protein, 9 aa, Homo Sapiens
GAQRTLIEA

SEQ ID NO: 182026 - protein, 9 aa, Homo Sapiens
VVGSGQRAH

SEQ ID NO: 182027 - protein, 9 aa, Homo Sapiens
APRLSKKVT

SEQ ID NO: 182028 - protein, 9 aa, Homo Sapiens
TVGMPLIYV

SEQ ID NO: 182029 - protein, 9 aa, Homo Sapiens
FKTHKKAGD

SEQ ID NO: 182030 - protein, 9 aa, Homo Sapiens
ALAAPGAPS

SEQ ID NO: 182031 - protein, 9 aa, Homo Sapiens
LVSAQRLQA

SEQ ID NO: 182032 - protein, 9 aa, Homo Sapiens
TSRDSRSFF

SEQ ID NO: 182033 - protein, 9 aa, Homo Sapiens
YAVGFNGCS

SEQ ID NO: 182034 - protein, 9 aa, Homo Sapiens
LLAFPQPLP

SEQ ID NO: 182035 - protein, 9 aa, Homo Sapiens
IRLLTQCQS

SEQ ID NO: 182036 - protein, 9 aa, Homo Sapiens
PMKKEPEPE

SEQ ID NO: 182037 - protein, 9 aa, Homo Sapiens
PVRVRMCNH

SEQ ID NO: 182038 - protein, 9 aa, Homo Sapiens
GLFRGVEDN

SEQ ID NO: 182039 - protein, 9 aa, Homo Sapiens
ELHAKVTIL

SEQ ID NO: 182040 - protein, 9 aa, Homo Sapiens
IAFYPNNHE

SEQ ID NO: 182041 - protein, 9 aa, Homo Sapiens
FRNALLLLP

SEQ ID NO: 182042 - protein, 9 aa, Homo Sapiens
VLLCRLADE

SEQ ID NO: 182043 - protein, 9 aa, Homo Sapiens
LKSARSSVP

SEQ ID NO: 182044 - protein, 9 aa, Homo Sapiens
FTRATSWMA

SEQ ID NO: 182045 - protein, 9 aa, Homo Sapiens
GDSLLAFGI

SEQ ID NO: 182046 - protein, 9 aa, Homo Sapiens
GPSTPTGML

SEQ ID NO: 182047 - protein, 9 aa, Homo Sapiens
ANPQLLCQN

SEQ ID NO: 182048 - protein, 9 aa, Homo Sapiens
IQKTPWFIH

SEQ ID NO: 182049 - protein, 9 aa, Homo Sapiens
PAPPRICPS

SEQ ID NO: 182050 - protein, 9 aa, Homo Sapiens
NPAGPLREK

SEQ ID NO: 182051 - protein, 9 aa, Homo Sapiens
LIDGKVTEK

SEQ ID NO: 182052 - protein, 9 aa, Homo Sapiens
GLVPCVLFV

SEQ ID NO: 182053 - protein, 9 aa, Homo Sapiens
TPASTLARL

SEQ ID NO: 182054 - protein, 9 aa, Homo Sapiens
RVQEKDNGF

SEQ ID NO: 182055 - protein, 9 aa, Homo Sapiens
QRIPKVGLS

SEQ ID NO: 182056 - protein, 9 aa, Homo Sapiens
RVEQARRKS

SEQ ID NO: 182057 - protein, 9 aa, Homo Sapiens
FREQDALEA

SEQ ID NO: 182058 - protein, 9 aa, Homo Sapiens
LEAQRKLHE

SEQ ID NO: 182059 - protein, 9 aa, Homo Sapiens
ALLCGMREM

SEQ ID NO: 182060 - protein, 9 aa, Homo Sapiens
LPFPKILTN

SEQ ID NO: 182061 - protein, 9 aa, Homo Sapiens
QGADIQGVS

SEQ ID NO: 182062 - protein, 9 aa, Homo Sapiens
IQQCPFFYN

SEQ ID NO: 182063 - protein, 9 aa, Homo Sapiens
HGNTAPSPS

SEQ ID NO: 182064 - protein, 9 aa, Homo Sapiens
KNAGCLHMT

SEQ ID NO: 182065 - protein, 9 aa, Homo Sapiens
VAASTHMGM

SEQ ID NO: 182066 - protein, 9 aa, Homo Sapiens
ICLKIKYWE

SEQ ID NO: 182067 - protein, 9 aa, Homo Sapiens
DLPQAVIDD

SEQ ID NO: 182068 - protein, 9 aa, Homo Sapiens
QILHWSYQV

SEQ ID NO: 182069 - protein, 9 aa, Homo Sapiens
VKFLHDPVL

SEQ ID NO: 182070 - protein, 9 aa, Homo Sapiens
APIEKNAGC

SEQ ID NO: 182071 - protein, 9 aa, Homo Sapiens
INMLKKYYH

SEQ ID NO: 182072 - protein, 9 aa, Homo Sapiens
GDGEEIAEA

SEQ ID NO: 182073 - protein, 9 aa, Homo Sapiens
TPPKPWQSP

SEQ ID NO: 182074 - protein, 9 aa, Homo Sapiens
AVAHLLAQW

SEQ ID NO: 182075 - protein, 9 aa, Homo Sapiens
QYVTSYHPK

SEQ ID NO: 182076 - protein, 9 aa, Homo Sapiens
PVPSFLPPG

SEQ ID NO: 182077 - protein, 9 aa, Homo Sapiens
SGRKSKNNK

SEQ ID NO: 182078 - protein, 9 aa, Homo Sapiens
SMEFAAICF

SEQ ID NO: 182079 - protein, 9 aa, Homo Sapiens
HSLSYWRAS

SEQ ID NO: 182080 - protein, 9 aa, Homo Sapiens
LLALSSSPS

SEQ ID NO: 182081 - protein, 9 aa, Homo Sapiens
IEEHPASLT

SEQ ID NO: 182082 - protein, 9 aa, Homo Sapiens
CGVLWLKGC

SEQ ID NO: 182083 - protein, 9 aa, Homo Sapiens
SQTRRGIKG

SEQ ID NO: 182084 - protein, 9 aa, Homo Sapiens
KRKRKCVLK

SEQ ID NO: 182085 - protein, 9 aa, Homo Sapiens
RSYGEKFYL

SEQ ID NO: 182086 - protein, 9 aa, Homo Sapiens
WHKYGCTNG

SEQ ID NO: 182087 - protein, 9 aa, Homo Sapiens
GRRVKSASI

SEQ ID NO: 182088 - protein, 9 aa, Homo Sapiens
MPPVMLKVT

SEQ ID NO: 182089 - protein, 9 aa, Homo Sapiens
ESKQGTVLM

SEQ ID NO: 182090 - protein, 9 aa, Homo Sapiens
NRRDIRLVD

SEQ ID NO: 182091 - protein, 9 aa, Homo Sapiens
ALKQVSPAS

SEQ ID NO: 182092 - protein, 9 aa, Homo Sapiens
DTFHLLLLC

SEQ ID NO: 182093 - protein, 9 aa, Homo Sapiens
SCDPPSSMG

SEQ ID NO: 182094 - protein, 9 aa, Homo Sapiens
KGIPMKKEP

SEQ ID NO: 182095 - protein, 9 aa, Homo Sapiens
DICYYNFIC

SEQ ID NO: 182096 - protein, 9 aa, Homo Sapiens
AAKTAQFGQ

SEQ ID NO: 182097 - protein, 9 aa, Homo Sapiens
RLWRPTAIR

SEQ ID NO: 182098 - protein, 9 aa, Homo Sapiens
HRSDYSLSE

SEQ ID NO: 182099 - protein, 9 aa, Homo Sapiens
HKVLKTDRA

SEQ ID NO: 182100 - protein, 9 aa, Homo Sapiens
FNVAHTLCM

SEQ ID NO: 182101 - protein, 9 aa, Homo Sapiens
LLQKHANVP

SEQ ID NO: 182102 - protein, 9 aa, Homo Sapiens
ICHHRGIRS

SEQ ID NO: 182103 - protein, 9 aa, Homo Sapiens
SAQEFGPTS

SEQ ID NO: 182104 - protein, 9 aa, Homo Sapiens
ELKHVVTEY

SEQ ID NO: 182105 - protein, 9 aa, Homo Sapiens
RPTTSRRRP

SEQ ID NO: 182106 - protein, 9 aa, Homo Sapiens
LPCFPSLPK

SEQ ID NO: 182107 - protein, 9 aa, Homo Sapiens
GETRRPYDS

SEQ ID NO: 182108 - protein, 9 aa, Homo Sapiens
EVAKKEDKH

SEQ ID NO: 182109 - protein, 9 aa, Homo Sapiens
ALTFPVPSF

SEQ ID NO: 182110 - protein, 9 aa, Homo Sapiens
AEGNSHFTY

SEQ ID NO: 182111 - protein, 9 aa, Homo Sapiens
CVADFRKIA

SEQ ID NO: 182112 - protein, 9 aa, Homo Sapiens
EQMEKFCLE

SEQ ID NO: 182113 - protein, 9 aa, Homo Sapiens
VLGYCLLLV

SEQ ID NO: 182114 - protein, 9 aa, Homo Sapiens
FLDLMFGEG

SEQ ID NO: 182115 - protein, 9 aa, Homo Sapiens
SSQVPRLRH

SEQ ID NO: 182116 - protein, 9 aa, Homo Sapiens
LRNLSSLRP

SEQ ID NO: 182117 - protein, 9 aa, Homo Sapiens
PLPGPLPGG

SEQ ID NO: 182118 - protein, 9 aa, Homo Sapiens
VRMCNHPPR

SEQ ID NO: 182119 - protein, 9 aa, Homo Sapiens
RDHICFVVD

SEQ ID NO: 182120 - protein, 9 aa, Homo Sapiens
QSPDLSPTL

SEQ ID NO: 182121 - protein, 9 aa, Homo Sapiens
WINSHFHLS

SEQ ID NO: 182122 - protein, 9 aa, Homo Sapiens
SIYHNVEGP

SEQ ID NO: 182123 - protein, 9 aa, Homo Sapiens
KDALHTTEN

SEQ ID NO: 182124 - protein, 9 aa, Homo Sapiens
VEALDSAGH

SEQ ID NO: 182125 - protein, 9 aa, Homo Sapiens
PELLGHRAE

SEQ ID NO: 182126 - protein, 9 aa, Homo Sapiens
WKHQHVGDF

SEQ ID NO: 182127 - protein, 9 aa, Homo Sapiens
PSSAVAGGA

SEQ ID NO: 182128 - protein, 9 aa, Homo Sapiens
EVLLHYLHN

SEQ ID NO: 182129 - protein, 9 aa, Homo Sapiens
LTQTKAIKD

SEQ ID NO: 182130 - protein, 9 aa, Homo Sapiens
DRLSFKELK

SEQ ID NO: 182131 - protein, 9 aa, Homo Sapiens
SILSLENLP

SEQ ID NO: 182132 - protein, 9 aa, Homo Sapiens
VGAADAPLR

SEQ ID NO: 182133 - protein, 9 aa, Homo Sapiens
TFPTVWESR

SEQ ID NO: 182134 - protein, 9 aa, Homo Sapiens
ADLRAHRCT

SEQ ID NO: 182135 - protein, 9 aa, Homo Sapiens
WPKIPLDPA

SEQ ID NO: 182136 - protein, 9 aa, Homo Sapiens
CMPENQRLE

SEQ ID NO: 182137 - protein, 9 aa, Homo Sapiens
ARRNLSCRG

SEQ ID NO: 182138 - protein, 9 aa, Homo Sapiens
SPTLGLIFT

SEQ ID NO: 182139 - protein, 9 aa, Homo Sapiens
YFFYYGWQC

SEQ ID NO: 182140 - protein, 9 aa, Homo Sapiens
KQFPNHPST

SEQ ID NO: 182141 - protein, 9 aa, Homo Sapiens
RVLQGKAIL

SEQ ID NO: 182142 - protein, 9 aa, Homo Sapiens
SLQTSSSGL

SEQ ID NO: 182143 - protein, 9 aa, Homo Sapiens
PEDSGRRVK

SEQ ID NO: 182144 - protein, 9 aa, Homo Sapiens
KRGLGTPAP

SEQ ID NO: 182145 - protein, 9 aa, Homo Sapiens
HLISLSPRK

SEQ ID NO: 182146 - protein, 9 aa, Homo Sapiens
MICWLRKRL

SEQ ID NO: 182147 - protein, 9 aa, Homo Sapiens
ISGKNRWLS

SEQ ID NO: 182148 - protein, 9 aa, Homo Sapiens
GTGTHAKLP

SEQ ID NO: 182149 - protein, 9 aa, Homo Sapiens
VCPRPRSCV

SEQ ID NO: 182150 - protein, 9 aa, Homo Sapiens
TTRLLHSPL

SEQ ID NO: 182151 - protein, 9 aa, Homo Sapiens
LKCRHMRGN

SEQ ID NO: 182152 - protein, 9 aa, Homo Sapiens
PLCQAMSCG

SEQ ID NO: 182153 - protein, 9 aa, Homo Sapiens
KKSVWTLQR

SEQ ID NO: 182154 - protein, 9 aa, Homo Sapiens
VSPQMISIL

SEQ ID NO: 182155 - protein, 9 aa, Homo Sapiens
YKCKPSSST

SEQ ID NO: 182156 - protein, 9 aa, Homo Sapiens
KNTRATTHN

SEQ ID NO: 182157 - protein, 9 aa, Homo Sapiens
LNGHHTILV

SEQ ID NO: 182158 - protein, 9 aa, Homo Sapiens
QQEHQPFSL

SEQ ID NO: 182159 - protein, 9 aa, Homo Sapiens
YKKHSYRLC

SEQ ID NO: 182160 - protein, 9 aa, Homo Sapiens
YPAIMTVGF

SEQ ID NO: 182161 - protein, 9 aa, Homo Sapiens
AMTKKRVNT

SEQ ID NO: 182162 - protein, 9 aa, Homo Sapiens
TGGHTHTPL

SEQ ID NO: 182163 - protein, 9 aa, Homo Sapiens
RKEEEHTPL

SEQ ID NO: 182164 - protein, 9 aa, Homo Sapiens
TGYDEKLVQ

SEQ ID NO: 182165 - protein, 9 aa, Homo Sapiens
IKCQYPVPG

SEQ ID NO: 182166 - protein, 9 aa, Homo Sapiens
ISLPTIGES

SEQ ID NO: 182167 - protein, 9 aa, Homo Sapiens
LFSIRRWST

SEQ ID NO: 182168 - protein, 9 aa, Homo Sapiens
ACPWATSLP

SEQ ID NO: 182169 - protein, 9 aa, Homo Sapiens
LTLSEIGHI

SEQ ID NO: 182170 - protein, 9 aa, Homo Sapiens
KCGIIILSA

SEQ ID NO: 182171 - protein, 9 aa, Homo Sapiens
VDIDCFFVQ

SEQ ID NO: 182172 - protein, 9 aa, Homo Sapiens
IKVFPSPPS

SEQ ID NO: 182173 - protein, 9 aa, Homo Sapiens
PSMCVGSSP

SEQ ID NO: 182174 - protein, 9 aa, Homo Sapiens
KKAAANFRR

SEQ ID NO: 182175 - protein, 9 aa, Homo Sapiens
ISGSLPFLL

SEQ ID NO: 182176 - protein, 9 aa, Homo Sapiens
SLAEAGKLC

SEQ ID NO: 182177 - protein, 9 aa, Homo Sapiens
EVTPRSIHE

SEQ ID NO: 182178 - protein, 9 aa, Homo Sapiens
STPEEPGLD

SEQ ID NO: 182179 - protein, 9 aa, Homo Sapiens
ILVTVKFLH

SEQ ID NO: 182180 - protein, 9 aa, Homo Sapiens
WSCCPARAA

SEQ ID NO: 182181 - protein, 9 aa, Homo Sapiens
IVWMPRMRQ

SEQ ID NO: 182182 - protein, 9 aa, Homo Sapiens
TTPPRAEVS

SEQ ID NO: 182183 - protein, 9 aa, Homo Sapiens
WRQQKEKLL

SEQ ID NO: 182184 - protein, 9 aa, Homo Sapiens
RPQSTCARR

SEQ ID NO: 182185 - protein, 9 aa, Homo Sapiens
ELIKKNKFR

SEQ ID NO: 182186 - protein, 9 aa, Homo Sapiens
FLSLRELGF

SEQ ID NO: 182187 - protein, 9 aa, Homo Sapiens
TEAPYSTCY

SEQ ID NO: 182188 - protein, 9 aa, Homo Sapiens
KEKLLCPGR

SEQ ID NO: 182189 - protein, 9 aa, Homo Sapiens
YDHHPRAER

SEQ ID NO: 182190 - protein, 9 aa, Homo Sapiens
SSGRWWWSA

SEQ ID NO: 182191 - protein, 9 aa, Homo Sapiens
WAGRGDSGL

SEQ ID NO: 182192 - protein, 9 aa, Homo Sapiens
CTTGVGRTR

SEQ ID NO: 182193 - protein, 9 aa, Homo Sapiens
ECHASFLRV

SEQ ID NO: 182194 - protein, 9 aa, Homo Sapiens
QFESPKRGR

SEQ ID NO: 182195 - protein, 9 aa, Homo Sapiens
PPEAVNMSM

SEQ ID NO: 182196 - protein, 9 aa, Homo Sapiens
QFIPSQPPT

SEQ ID NO: 182197 - protein, 9 aa, Homo Sapiens
VKKEMAHPN

SEQ ID NO: 182198 - protein, 9 aa, Homo Sapiens
FLPNHTLFL

SEQ ID NO: 182199 - protein, 9 aa, Homo Sapiens
VPCIMVQSA

SEQ ID NO: 182200 - protein, 9 aa, Homo Sapiens
KSLLSLRFR

SEQ ID NO: 182201 - protein, 9 aa, Homo Sapiens
KKYRCYEVI

SEQ ID NO: 182202 - protein, 9 aa, Homo Sapiens
SQNYLWTTN

SEQ ID NO: 182203 - protein, 9 aa, Homo Sapiens
DHVLAKVAG

SEQ ID NO: 182204 - protein, 9 aa, Homo Sapiens
AHQVTHTAA

SEQ ID NO: 182205 - protein, 9 aa, Homo Sapiens
YSTCYSTQV

SEQ ID NO: 182206 - protein, 9 aa, Homo Sapiens
KASAASCAS

SEQ ID NO: 182207 - protein, 9 aa, Homo Sapiens
HHKDRHFAY

SEQ ID NO: 182208 - protein, 9 aa, Homo Sapiens
VQLCQQGHI

SEQ ID NO: 182209 - protein, 9 aa, Homo Sapiens
LEVVQVGLH

SEQ ID NO: 182210 - protein, 9 aa, Homo Sapiens
NDGHFVPVL

SEQ ID NO: 182211 - protein, 9 aa, Homo Sapiens
LMFGEGMTC

SEQ ID NO: 182212 - protein, 9 aa, Homo Sapiens
PSRMCKYPN

SEQ ID NO: 182213 - protein, 9 aa, Homo Sapiens
VKKENGVKK

SEQ ID NO: 182214 - protein, 9 aa, Homo Sapiens
ANLLILSHH

SEQ ID NO: 182215 - protein, 9 aa, Homo Sapiens
APPDITTCK

SEQ ID NO: 182216 - protein, 9 aa, Homo Sapiens
DVWWIMHDG

SEQ ID NO: 182217 - protein, 9 aa, Homo Sapiens
PPLKVAPGR

SEQ ID NO: 182218 - protein, 9 aa, Homo Sapiens
LVECPSYHL

SEQ ID NO: 182219 - protein, 9 aa, Homo Sapiens
TFRPSSIQQ

SEQ ID NO: 182220 - protein, 9 aa, Homo Sapiens
EGLNVCEPA

SEQ ID NO: 182221 - protein, 9 aa, Homo Sapiens
TIFLSFAFL

SEQ ID NO: 182222 - protein, 9 aa, Homo Sapiens
SIRRWSTIS

SEQ ID NO: 182223 - protein, 9 aa, Homo Sapiens
VSRPEACGI

SEQ ID NO: 182224 - protein, 9 aa, Homo Sapiens
GLQMYGKHT

SEQ ID NO: 182225 - protein, 9 aa, Homo Sapiens
VAFKLCINK

SEQ ID NO: 182226 - protein, 9 aa, Homo Sapiens
TPLCQAMSC

SEQ ID NO: 182227 - protein, 9 aa, Homo Sapiens
QDSAIFNLG

SEQ ID NO: 182228 - protein, 9 aa, Homo Sapiens
LIDDDNPPC

SEQ ID NO: 182229 - protein, 9 aa, Homo Sapiens
YEQHNRPCW

SEQ ID NO: 182230 - protein, 9 aa, Homo Sapiens
LKKFFLCLK

SEQ ID NO: 182231 - protein, 9 aa, Homo Sapiens
NWSSQKWTI

SEQ ID NO: 182232 - protein, 9 aa, Homo Sapiens
VHQKQRRKR

SEQ ID NO: 182233 - protein, 9 aa, Homo Sapiens
PPKMPPPRS

SEQ ID NO: 182234 - protein, 9 aa, Homo Sapiens
GFPQPLLHN

SEQ ID NO: 182235 - protein, 9 aa, Homo Sapiens
RLPPGPRPP

SEQ ID NO: 182236 - protein, 9 aa, Homo Sapiens
PVLMALELS

SEQ ID NO: 182237 - protein, 9 aa, Homo Sapiens
VPRWVQVPK

SEQ ID NO: 182238 - protein, 9 aa, Homo Sapiens
MDDVHRTWP

SEQ ID NO: 182239 - protein, 9 aa, Homo Sapiens
GAAGRHRVI

SEQ ID NO: 182240 - protein, 9 aa, Homo Sapiens
SPQLGPRGP

SEQ ID NO: 182241 - protein, 9 aa, Homo Sapiens
QLGDLYGTI

SEQ ID NO: 182242 - protein, 9 aa, Homo Sapiens
PQIADEQSK

SEQ ID NO: 182243 - protein, 9 aa, Homo Sapiens
LGASSHTTT

SEQ ID NO: 182244 - protein, 9 aa, Homo Sapiens
VTSKSNPFC

SEQ ID NO: 182245 - protein, 9 aa, Homo Sapiens
TAKRTMRPT

SEQ ID NO: 182246 - protein, 9 aa, Homo Sapiens
TRGSPLRLT

SEQ ID NO: 182247 - protein, 9 aa, Homo Sapiens
TRAGRIIPK

SEQ ID NO: 182248 - protein, 9 aa, Homo Sapiens
VLAHHVIDG

SEQ ID NO: 182249 - protein, 9 aa, Homo Sapiens
RMGGPDTVP

SEQ ID NO: 182250 - protein, 9 aa, Homo Sapiens
SWLTRHRSA

SEQ ID NO: 182251 - protein, 9 aa, Homo Sapiens
LNSDYKRLV

SEQ ID NO: 182252 - protein, 9 aa, Homo Sapiens
VLRRTPPAP

SEQ ID NO: 182253 - protein, 9 aa, Homo Sapiens
SRWNTFNSI

SEQ ID NO: 182254 - protein, 9 aa, Homo Sapiens
KRDPQQGQF

SEQ ID NO: 182255 - protein, 9 aa, Homo Sapiens
EQKTGTPIG

SEQ ID NO: 182256 - protein, 9 aa, Homo Sapiens
LLQGELLVP

SEQ ID NO: 182257 - protein, 9 aa, Homo Sapiens
LQSPDLSPT

SEQ ID NO: 182258 - protein, 9 aa, Homo Sapiens
VLEAPVQDL

SEQ ID NO: 182259 - protein, 9 aa, Homo Sapiens
LLNSMKHLF

SEQ ID NO: 182260 - protein, 9 aa, Homo Sapiens
VSSQHKQGN

SEQ ID NO: 182261 - protein, 9 aa, Homo Sapiens
SNCSDLKQP

SEQ ID NO: 182262 - protein, 9 aa, Homo Sapiens
FVMNVGSPS

SEQ ID NO: 182263 - protein, 9 aa, Homo Sapiens
RVSTRAGRI

SEQ ID NO: 182264 - protein, 9 aa, Homo Sapiens
RLEAVHADR

SEQ ID NO: 182265 - protein, 9 aa, Homo Sapiens
IKTSHSLSY

SEQ ID NO: 182266 - protein, 9 aa, Homo Sapiens
GMTCSSCHR

SEQ ID NO: 182267 - protein, 9 aa, Homo Sapiens
AKKRASVSF

SEQ ID NO: 182268 - protein, 9 aa, Homo Sapiens
GFFLEDELD

SEQ ID NO: 182269 - protein, 9 aa, Homo Sapiens
AGGVFSNPA

SEQ ID NO: 182270 - protein, 9 aa, Homo Sapiens
APEECYPIL

SEQ ID NO: 182271 - protein, 9 aa, Homo Sapiens
ICFVVDLAV

SEQ ID NO: 182272 - protein, 9 aa, Homo Sapiens
LSSLRPENQ

SEQ ID NO: 182273 - protein, 9 aa, Homo Sapiens
SLEKENNLC

SEQ ID NO: 182274 - protein, 9 aa, Homo Sapiens
QMIGQVDGL

SEQ ID NO: 182275 - protein, 9 aa, Homo Sapiens
MGHRSDYSL

SEQ ID NO: 182276 - protein, 9 aa, Homo Sapiens
SFVELSPCL

SEQ ID NO: 182277 - protein, 9 aa, Homo Sapiens
LLHYLFHMR

SEQ ID NO: 182278 - protein, 9 aa, Homo Sapiens
MEPLCNDNL

SEQ ID NO: 182279 - protein, 9 aa, Homo Sapiens
ISVDNLPPS

SEQ ID NO: 182280 - protein, 9 aa, Homo Sapiens
FPSTPLPLV

SEQ ID NO: 182281 - protein, 9 aa, Homo Sapiens
KIGPRTGLR

SEQ ID NO: 182282 - protein, 9 aa, Homo Sapiens
EKWRRGDPG

SEQ ID NO: 182283 - protein, 9 aa, Homo Sapiens
TKQPCQYFI

SEQ ID NO: 182284 - protein, 9 aa, Homo Sapiens
FGKSATRTP

SEQ ID NO: 182285 - protein, 9 aa, Homo Sapiens
MMQRSKMSQ

SEQ ID NO: 182286 - protein, 9 aa, Homo Sapiens
CISGESGRC

SEQ ID NO: 182287 - protein, 9 aa, Homo Sapiens
SIRAALRKM

SEQ ID NO: 182288 - protein, 9 aa, Homo Sapiens
RRTPTPASS

SEQ ID NO: 182289 - protein, 9 aa, Homo Sapiens
STGCSLGSR

SEQ ID NO: 182290 - protein, 9 aa, Homo Sapiens
SSCHRPFHL

SEQ ID NO: 182291 - protein, 9 aa, Homo Sapiens
EKSPPPPLQ

SEQ ID NO: 182292 - protein, 9 aa, Homo Sapiens
EHGDPSRHF

SEQ ID NO: 182293 - protein, 9 aa, Homo Sapiens
GSSPTMQHS

SEQ ID NO: 182294 - protein, 9 aa, Homo Sapiens
LSKDLDCKK

SEQ ID NO: 182295 - protein, 9 aa, Homo Sapiens
INTDRSTVW

SEQ ID NO: 182296 - protein, 9 aa, Homo Sapiens
RPNATYSIC

SEQ ID NO: 182297 - protein, 9 aa, Homo Sapiens
GAWGGAPLQ

SEQ ID NO: 182298 - protein, 9 aa, Homo Sapiens
RILLQQLWR

SEQ ID NO: 182299 - protein, 9 aa, Homo Sapiens
VTAVLRVVA

SEQ ID NO: 182300 - protein, 9 aa, Homo Sapiens
SRRRPSSML

SEQ ID NO: 182301 - protein, 9 aa, Homo Sapiens
KVLKTDRAI

SEQ ID NO: 182302 - protein, 9 aa, Homo Sapiens
ACSYPMDMK

SEQ ID NO: 182303 - protein, 9 aa, Homo Sapiens
LIEALVASY

SEQ ID NO: 182304 - protein, 9 aa, Homo Sapiens
ARNHMNVNS

SEQ ID NO: 182305 - protein, 9 aa, Homo Sapiens
GPLREKVHP

SEQ ID NO: 182306 - protein, 9 aa, Homo Sapiens
QPPNLASST

SEQ ID NO: 182307 - protein, 9 aa, Homo Sapiens
NSEEKKFHK

SEQ ID NO: 182308 - protein, 9 aa, Homo Sapiens
RPASDGQPR

SEQ ID NO: 182309 - protein, 9 aa, Homo Sapiens
YCLLLVLAG

SEQ ID NO: 182310 - protein, 9 aa, Homo Sapiens
SHFIVIADF

SEQ ID NO: 182311 - protein, 9 aa, Homo Sapiens
LFLQEVFQA

SEQ ID NO: 182312 - protein, 9 aa, Homo Sapiens
SEVGFNIVK

SEQ ID NO: 182313 - protein, 9 aa, Homo Sapiens
VAGHQEVTT

SEQ ID NO: 182314 - protein, 9 aa, Homo Sapiens
PWRGCPLRG

SEQ ID NO: 182315 - protein, 9 aa, Homo Sapiens
NWIQKTATS

SEQ ID NO: 182316 - protein, 9 aa, Homo Sapiens
VADHGGRSD

SEQ ID NO: 182317 - protein, 9 aa, Homo Sapiens
DIIMENSKV

SEQ ID NO: 182318 - protein, 9 aa, Homo Sapiens
RPSCRITFV

SEQ ID NO: 182319 - protein, 9 aa, Homo Sapiens
PSRAASLLF

SEQ ID NO: 182320 - protein, 9 aa, Homo Sapiens
SHSLRNLYF

SEQ ID NO: 182321 - protein, 9 aa, Homo Sapiens
FSRVLRRGL

SEQ ID NO: 182322 - protein, 9 aa, Homo Sapiens
SSILDRFTG

SEQ ID NO: 182323 - protein, 9 aa, Homo Sapiens
KSATRTPES

SEQ ID NO: 182324 - protein, 9 aa, Homo Sapiens
NKTKGDSIR

SEQ ID NO: 182325 - protein, 9 aa, Homo Sapiens
GKYRALEMD

SEQ ID NO: 182326 - protein, 9 aa, Homo Sapiens
TSSTGNASG

SEQ ID NO: 182327 - protein, 9 aa, Homo Sapiens
SHFTYSVTV

SEQ ID NO: 182328 - protein, 9 aa, Homo Sapiens
QRTTSTLGS

SEQ ID NO: 182329 - protein, 9 aa, Homo Sapiens
VVSQTSLSI

SEQ ID NO: 182330 - protein, 9 aa, Homo Sapiens
VPQLTDPTA

SEQ ID NO: 182331 - protein, 9 aa, Homo Sapiens
LQYEKSLNQ

SEQ ID NO: 182332 - protein, 9 aa, Homo Sapiens
DELERKLGA

SEQ ID NO: 182333 - protein, 9 aa, Homo Sapiens
DRLQPEPES

SEQ ID NO: 182334 - protein, 9 aa, Homo Sapiens
KYVKNTRAT

SEQ ID NO: 182335 - protein, 9 aa, Homo Sapiens
SCSRGSQRA

SEQ ID NO: 182336 - protein, 9 aa, Homo Sapiens
IGIVAQVDQ

SEQ ID NO: 182337 - protein, 9 aa, Homo Sapiens
NMSMGLSLA

SEQ ID NO: 182338 - protein, 9 aa, Homo Sapiens
ENEQKARGA

SEQ ID NO: 182339 - protein, 9 aa, Homo Sapiens
MQRLQAREG

SEQ ID NO: 182340 - protein, 9 aa, Homo Sapiens
EEPRGAGGM

SEQ ID NO: 182341 - protein, 9 aa, Homo Sapiens
GHAVPVVKE

SEQ ID NO: 182342 - protein, 9 aa, Homo Sapiens
FLNMFVCAQ

SEQ ID NO: 182343 - protein, 9 aa, Homo Sapiens
GVPLGEEHI

SEQ ID NO: 182344 - protein, 9 aa, Homo Sapiens
QVLKQSQNY

SEQ ID NO: 182345 - protein, 9 aa, Homo Sapiens
GLHDTCYSS

SEQ ID NO: 182346 - protein, 9 aa, Homo Sapiens
RLENTQHLL

SEQ ID NO: 182347 - protein, 9 aa, Homo Sapiens
RSMGKRACR

SEQ ID NO: 182348 - protein, 9 aa, Homo Sapiens
VAMPPREIV

SEQ ID NO: 182349 - protein, 9 aa, Homo Sapiens
FKFIVHAVW

SEQ ID NO: 182350 - protein, 9 aa, Homo Sapiens
VIHAPEECY

SEQ ID NO: 182351 - protein, 9 aa, Homo Sapiens
KQPQGPSCS

SEQ ID NO: 182352 - protein, 9 aa, Homo Sapiens
PEDEGKITF

SEQ ID NO: 182353 - protein, 9 aa, Homo Sapiens
WPFGFEDDP

SEQ ID NO: 182354 - protein, 9 aa, Homo Sapiens
ESKWVALQI

SEQ ID NO: 182355 - protein, 9 aa, Homo Sapiens
TETVEEQLL

SEQ ID NO: 182356 - protein, 9 aa, Homo Sapiens
HPEVEYDHH

SEQ ID NO: 182357 - protein, 9 aa, Homo Sapiens
EEEKWLSAE

SEQ ID NO: 182358 - protein, 9 aa, Homo Sapiens
KPGAPPSRL

SEQ ID NO: 182359 - protein, 9 aa, Homo Sapiens
IRAEGNSHF

SEQ ID NO: 182360 - protein, 9 aa, Homo Sapiens
PRAKNISVA

SEQ ID NO: 182361 - protein, 9 aa, Homo Sapiens
LNPVLYVFM

SEQ ID NO: 182362 - protein, 9 aa, Homo Sapiens
HPASLTGAL

SEQ ID NO: 182363 - protein, 9 aa, Homo Sapiens
RVIRTDTFK

SEQ ID NO: 182364 - protein, 9 aa, Homo Sapiens
TCPRAVILL

SEQ ID NO: 182365 - protein, 9 aa, Homo Sapiens
MTVGFCGKL

SEQ ID NO: 182366 - protein, 9 aa, Homo Sapiens
MSTQSGRCP

SEQ ID NO: 182367 - protein, 9 aa, Homo Sapiens
TYQHLSNPL

SEQ ID NO: 182368 - protein, 9 aa, Homo Sapiens
TPQDSRQVL

SEQ ID NO: 182369 - protein, 9 aa, Homo Sapiens
PVHLLPSMC

SEQ ID NO: 182370 - protein, 9 aa, Homo Sapiens
VPAASAYPV

SEQ ID NO: 182371 - protein, 9 aa, Homo Sapiens
QQRLSLFPS

SEQ ID NO: 182372 - protein, 9 aa, Homo Sapiens
LQLEDWVLC

SEQ ID NO: 182373 - protein, 9 aa, Homo Sapiens
SVCGFSTRS

SEQ ID NO: 182374 - protein, 9 aa, Homo Sapiens
LEEAVSGSG

SEQ ID NO: 182375 - protein, 9 aa, Homo Sapiens
LLLRVVRIR

SEQ ID NO: 182376 - protein, 9 aa, Homo Sapiens
TASLSARTA

SEQ ID NO: 182377 - protein, 9 aa, Homo Sapiens
ACGKSFSTC

SEQ ID NO: 182378 - protein, 9 aa, Homo Sapiens
LQGQVAEDH

SEQ ID NO: 182379 - protein, 9 aa, Homo Sapiens
LSPPKQPQI

SEQ ID NO: 182380 - protein, 9 aa, Homo Sapiens
DQIAVMSGV

SEQ ID NO: 182381 - protein, 9 aa, Homo Sapiens
QPGSSFTRA

SEQ ID NO: 182382 - protein, 9 aa, Homo Sapiens
LSPSFPGNY

SEQ ID NO: 182383 - protein, 9 aa, Homo Sapiens
LIEQSSNSQ

SEQ ID NO: 182384 - protein, 9 aa, Homo Sapiens
QALAEVLER

SEQ ID NO: 182385 - protein, 9 aa, Homo Sapiens
PKPVAASTH

SEQ ID NO: 182386 - protein, 9 aa, Homo Sapiens
LEHRMGGPD

SEQ ID NO: 182387 - protein, 9 aa, Homo Sapiens
ALLPRHPTW

SEQ ID NO: 182388 - protein, 9 aa, Homo Sapiens
FFQTGVLAH

SEQ ID NO: 182389 - protein, 9 aa, Homo Sapiens
PAHHYPQRS

SEQ ID NO: 182390 - protein, 9 aa, Homo Sapiens
VDPDEVLFG

SEQ ID NO: 182391 - protein, 9 aa, Homo Sapiens
SFTHHISFH

SEQ ID NO: 182392 - protein, 9 aa, Homo Sapiens
KSVWTLQRS

SEQ ID NO: 182393 - protein, 9 aa, Homo Sapiens
TGSRPCAGA

SEQ ID NO: 182394 - protein, 9 aa, Homo Sapiens
MMSLGALRT

SEQ ID NO: 182395 - protein, 9 aa, Homo Sapiens
SPCSRRPRA

SEQ ID NO: 182396 - protein, 9 aa, Homo Sapiens
PTPRPRVHV

SEQ ID NO: 182397 - protein, 9 aa, Homo Sapiens
IGQNGVLST

SEQ ID NO: 182398 - protein, 9 aa, Homo Sapiens
LELCAQRLH

SEQ ID NO: 182399 - protein, 9 aa, Homo Sapiens
NTVPAASAY

SEQ ID NO: 182400 - protein, 9 aa, Homo Sapiens
PMPRPGPCP

SEQ ID NO: 182401 - protein, 9 aa, Homo Sapiens
ELQKERIQE

SEQ ID NO: 182402 - protein, 9 aa, Homo Sapiens
VQVTFSPGL

SEQ ID NO: 182403 - protein, 9 aa, Homo Sapiens
FPLGPHEEV

SEQ ID NO: 182404 - protein, 9 aa, Homo Sapiens
PCSRRPRAA

SEQ ID NO: 182405 - protein, 9 aa, Homo Sapiens
NSFTSIFAG

SEQ ID NO: 182406 - protein, 9 aa, Homo Sapiens
DVKHFLLGD

SEQ ID NO: 182407 - protein, 9 aa, Homo Sapiens
FYIKRRSMI

SEQ ID NO: 182408 - protein, 9 aa, Homo Sapiens
PHGASRGPP

SEQ ID NO: 182409 - protein, 9 aa, Homo Sapiens
LRSAREAIA

SEQ ID NO: 182410 - protein, 9 aa, Homo Sapiens
FDMGGEPLL

SEQ ID NO: 182411 - protein, 9 aa, Homo Sapiens
ERGLGLLAE

SEQ ID NO: 182412 - protein, 9 aa, Homo Sapiens
QGGGMQGAD

SEQ ID NO: 182413 - protein, 9 aa, Homo Sapiens
KRRMVYHPS

SEQ ID NO: 182414 - protein, 9 aa, Homo Sapiens
TWMKRRRRN

SEQ ID NO: 182415 - protein, 9 aa, Homo Sapiens
QLLARALLE

SEQ ID NO: 182416 - protein, 9 aa, Homo Sapiens
PDEVLFGPG

SEQ ID NO: 182417 - protein, 9 aa, Homo Sapiens
PSSSGKQYR

SEQ ID NO: 182418 - protein, 9 aa, Homo Sapiens
EEHTPLDKL

SEQ ID NO: 182419 - protein, 9 aa, Homo Sapiens
VRLLLGVCG

SEQ ID NO: 182420 - protein, 9 aa, Homo Sapiens
AAIRWLWAP

SEQ ID NO: 182421 - protein, 9 aa, Homo Sapiens
DGRSQEGKK

SEQ ID NO: 182422 - protein, 9 aa, Homo Sapiens
EEKIDRCIL

SEQ ID NO: 182423 - protein, 9 aa, Homo Sapiens
PVSWPRASA

SEQ ID NO: 182424 - protein, 9 aa, Homo Sapiens
AVDCLQAFW

SEQ ID NO: 182425 - protein, 9 aa, Homo Sapiens
TLVKTFATL

SEQ ID NO: 182426 - protein, 9 aa, Homo Sapiens
QRNMPTEEL

SEQ ID NO: 182427 - protein, 9 aa, Homo Sapiens
NNLCNDQCN

SEQ ID NO: 182428 - protein, 9 aa, Homo Sapiens
AQLADTSEA

SEQ ID NO: 182429 - protein, 9 aa, Homo Sapiens
SVSVEGVSH

SEQ ID NO: 182430 - protein, 9 aa, Homo Sapiens
SSVLRKHRI

SEQ ID NO: 182431 - protein, 9 aa, Homo Sapiens
KAILWLPVV

SEQ ID NO: 182432 - protein, 9 aa, Homo Sapiens
DYKRLWAGS

SEQ ID NO: 182433 - protein, 9 aa, Homo Sapiens
SPSSRDATT

SEQ ID NO: 182434 - protein, 9 aa, Homo Sapiens
SRKQRRPIR

SEQ ID NO: 182435 - protein, 9 aa, Homo Sapiens
KFIVHAVWV

SEQ ID NO: 182436 - protein, 9 aa, Homo Sapiens
MEENFTVEA

SEQ ID NO: 182437 - protein, 9 aa, Homo Sapiens
QRESCFQGH

SEQ ID NO: 182438 - protein, 9 aa, Homo Sapiens
SLGSRLHSW

SEQ ID NO: 182439 - protein, 9 aa, Homo Sapiens
LWAGSRIVW

SEQ ID NO: 182440 - protein, 9 aa, Homo Sapiens
SLMVRCANA

SEQ ID NO: 182441 - protein, 9 aa, Homo Sapiens
CWSKDPSQC

SEQ ID NO: 182442 - protein, 9 aa, Homo Sapiens
FGRPCHLIE

SEQ ID NO: 182443 - protein, 9 aa, Homo Sapiens
RGRPGRPRW

SEQ ID NO: 182444 - protein, 9 aa, Homo Sapiens
VKNTRATTH

SEQ ID NO: 182445 - protein, 9 aa, Homo Sapiens
RRRAIAART

SEQ ID NO: 182446 - protein, 9 aa, Homo Sapiens
SDSALHGRI

SEQ ID NO: 182447 - protein, 9 aa, Homo Sapiens
SNGVTTGTQ

SEQ ID NO: 182448 - protein, 9 aa, Homo Sapiens
MPFSLNSPN

SEQ ID NO: 182449 - protein, 9 aa, Homo Sapiens
LAGGNDDCR

SEQ ID NO: 182450 - protein, 9 aa, Homo Sapiens
ALPRTGGLV

SEQ ID NO: 182451 - protein, 9 aa, Homo Sapiens
QRECCSHCQ

SEQ ID NO: 182452 - protein, 9 aa, Homo Sapiens
PCHLAHLSA

SEQ ID NO: 182453 - protein, 9 aa, Homo Sapiens
LIKPSRMCK

SEQ ID NO: 182454 - protein, 9 aa, Homo Sapiens
SSTMTNNEG

SEQ ID NO: 182455 - protein, 9 aa, Homo Sapiens
RTASEQPPS

SEQ ID NO: 182456 - protein, 9 aa, Homo Sapiens
RRGRWSCCP

SEQ ID NO: 182457 - protein, 9 aa, Homo Sapiens
SVSFWTLLP

SEQ ID NO: 182458 - protein, 9 aa, Homo Sapiens
LKLKPENQV

SEQ ID NO: 182459 - protein, 9 aa, Homo Sapiens
HSPPTTRRS

SEQ ID NO: 182460 - protein, 9 aa, Homo Sapiens
HGPFPQQLV

SEQ ID NO: 182461 - protein, 9 aa, Homo Sapiens
TTRRSPLPI

SEQ ID NO: 182462 - protein, 9 aa, Homo Sapiens
AQRTLYRDA

SEQ ID NO: 182463 - protein, 9 aa, Homo Sapiens
RLEEKRAFE

SEQ ID NO: 182464 - protein, 9 aa, Homo Sapiens
SLTGALLSQ

SEQ ID NO: 182465 - protein, 9 aa, Homo Sapiens
EQKARGAAL

SEQ ID NO: 182466 - protein, 9 aa, Homo Sapiens
PASGDGEEI

SEQ ID NO: 182467 - protein, 9 aa, Homo Sapiens
SPCHPVWAR

SEQ ID NO: 182468 - protein, 9 aa, Homo Sapiens
LSDEHISLG

SEQ ID NO: 182469 - protein, 9 aa, Homo Sapiens
SMGKRACRM

SEQ ID NO: 182470 - protein, 9 aa, Homo Sapiens
PPSSPPQAA

SEQ ID NO: 182471 - protein, 9 aa, Homo Sapiens
CQAMSCGIP

SEQ ID NO: 182472 - protein, 9 aa, Homo Sapiens
LPPVSWPRA

SEQ ID NO: 182473 - protein, 9 aa, Homo Sapiens
FTSIFAGIV

SEQ ID NO: 182474 - protein, 9 aa, Homo Sapiens
ANFRRCCWY

SEQ ID NO: 182475 - protein, 9 aa, Homo Sapiens
VKTFATLNI

SEQ ID NO: 182476 - protein, 9 aa, Homo Sapiens
LGLQHLGQD

SEQ ID NO: 182477 - protein, 9 aa, Homo Sapiens
SFSTCTDLI

SEQ ID NO: 182478 - protein, 9 aa, Homo Sapiens
TCSWPRVRC

SEQ ID NO: 182479 - protein, 9 aa, Homo Sapiens
LCLKTPPKP

SEQ ID NO: 182480 - protein, 9 aa, Homo Sapiens
GVSCLAAAR

SEQ ID NO: 182481 - protein, 9 aa, Homo Sapiens
AHQNSERQL

SEQ ID NO: 182482 - protein, 9 aa, Homo Sapiens
SEIGHILET

SEQ ID NO: 182483 - protein, 9 aa, Homo Sapiens
VRAEPLIQD

SEQ ID NO: 182484 - protein, 9 aa, Homo Sapiens
QAHAVKTVY

SEQ ID NO: 182485 - protein, 9 aa, Homo Sapiens
ARARSPASL

SEQ ID NO: 182486 - protein, 9 aa, Homo Sapiens
PVAASTHMG

SEQ ID NO: 182487 - protein, 9 aa, Homo Sapiens
QRDPIKCQY

SEQ ID NO: 182488 - protein, 9 aa, Homo Sapiens
TSLPRPPRT

SEQ ID NO: 182489 - protein, 9 aa, Homo Sapiens
GMPLIYVGV

SEQ ID NO: 182490 - protein, 9 aa, Homo Sapiens
TMNDSKHKL

SEQ ID NO: 182491 - protein, 9 aa, Homo Sapiens
KTTMKELID

SEQ ID NO: 182492 - protein, 9 aa, Homo Sapiens
PLLNVPQLT

SEQ ID NO: 182493 - protein, 9 aa, Homo Sapiens
HFWPQMTCR

SEQ ID NO: 182494 - protein, 9 aa, Homo Sapiens
SLPRPPRTA

SEQ ID NO: 182495 - protein, 9 aa, Homo Sapiens
LIKCVNKTG

SEQ ID NO: 182496 - protein, 9 aa, Homo Sapiens
GNLLYYQYM

SEQ ID NO: 182497 - protein, 9 aa, Homo Sapiens
PVGHLPSSQ

SEQ ID NO: 182498 - protein, 9 aa, Homo Sapiens
SACPPENCS

SEQ ID NO: 182499 - protein, 9 aa, Homo Sapiens
HSCDPPSSM

SEQ ID NO: 182500 - protein, 9 aa, Homo Sapiens
EEKKFHKTC

SEQ ID NO: 182501 - protein, 9 aa, Homo Sapiens
GDQKSGGNV

SEQ ID NO: 182502 - protein, 9 aa, Homo Sapiens
CFWEGAKIQ

SEQ ID NO: 182503 - protein, 9 aa, Homo Sapiens
LLSHQQLGD

SEQ ID NO: 182504 - protein, 9 aa, Homo Sapiens
GSFLLISGK

SEQ ID NO: 182505 - protein, 9 aa, Homo Sapiens
VTAPGEGLL

SEQ ID NO: 182506 - protein, 9 aa, Homo Sapiens
LPSQNVCLH

SEQ ID NO: 182507 - protein, 9 aa, Homo Sapiens
VILGDFIQR

SEQ ID NO: 182508 - protein, 9 aa, Homo Sapiens
GGPARGTTS

SEQ ID NO: 182509 - protein, 9 aa, Homo Sapiens
PHSPKPVAA

SEQ ID NO: 182510 - protein, 9 aa, Homo Sapiens
GVDGTDINA

SEQ ID NO: 182511 - protein, 9 aa, Homo Sapiens
RLWSWCGTS

SEQ ID NO: 182512 - protein, 9 aa, Homo Sapiens
SPVYFFLSH

SEQ ID NO: 182513 - protein, 9 aa, Homo Sapiens
FNKKCKKNV

SEQ ID NO: 182514 - protein, 9 aa, Homo Sapiens
PLTLSQEAL

SEQ ID NO: 182515 - protein, 9 aa, Homo Sapiens
DVLPAPVIQ

SEQ ID NO: 182516 - protein, 9 aa, Homo Sapiens
SVLGSSKRP

SEQ ID NO: 182517 - protein, 9 aa, Homo Sapiens
PFSLRGNWW

SEQ ID NO: 182518 - protein, 9 aa, Homo Sapiens
VEMWKKNEE

SEQ ID NO: 182519 - protein, 9 aa, Homo Sapiens
VGHLPSSQN

SEQ ID NO: 182520 - protein, 9 aa, Homo Sapiens
PRNEIDPPQ

SEQ ID NO: 182521 - protein, 9 aa, Homo Sapiens
PAMEPLCND

SEQ ID NO: 182522 - protein, 9 aa, Homo Sapiens
LLDATVGMP

SEQ ID NO: 182523 - protein, 9 aa, Homo Sapiens
VIQVEGPIK

SEQ ID NO: 182524 - protein, 9 aa, Homo Sapiens
VREMLLRQH

SEQ ID NO: 182525 - protein, 9 aa, Homo Sapiens
VLTALLQFQ

SEQ ID NO: 182526 - protein, 9 aa, Homo Sapiens
SALGPLGSR

SEQ ID NO: 182527 - protein, 9 aa, Homo Sapiens
ELQVMINEV

SEQ ID NO: 182528 - protein, 9 aa, Homo Sapiens
FRASCEDGC

SEQ ID NO: 182529 - protein, 9 aa, Homo Sapiens
EAPVQDLQL

SEQ ID NO: 182530 - protein, 9 aa, Homo Sapiens
RTLYRDAML

SEQ ID NO: 182531 - protein, 9 aa, Homo Sapiens
SPPSACTRP

SEQ ID NO: 182532 - protein, 9 aa, Homo Sapiens
QEHLVNSVD

SEQ ID NO: 182533 - protein, 9 aa, Homo Sapiens
SVRATDRLM

SEQ ID NO: 182534 - protein, 9 aa, Homo Sapiens
TSLCLKTPP

SEQ ID NO: 182535 - protein, 9 aa, Homo Sapiens
VSGSVRATD

SEQ ID NO: 182536 - protein, 9 aa, Homo Sapiens
ARTGSRPCA

SEQ ID NO: 182537 - protein, 9 aa, Homo Sapiens
AQRLHLLAV

SEQ ID NO: 182538 - protein, 9 aa, Homo Sapiens
LLEEALHVF

SEQ ID NO: 182539 - protein, 9 aa, Homo Sapiens
GKWKSIVTA

SEQ ID NO: 182540 - protein, 9 aa, Homo Sapiens
KALVKTWTQ

SEQ ID NO: 182541 - protein, 9 aa, Homo Sapiens
EELQGSGDN

SEQ ID NO: 182542 - protein, 9 aa, Homo Sapiens
KMKVEGLNV

SEQ ID NO: 182543 - protein, 9 aa, Homo Sapiens
IDGLKELNL

SEQ ID NO: 182544 - protein, 9 aa, Homo Sapiens
CVPEGPAHP

SEQ ID NO: 182545 - protein, 9 aa, Homo Sapiens
MRAGGCCHA

SEQ ID NO: 182546 - protein, 9 aa, Homo Sapiens
GYVLLRSGL

SEQ ID NO: 182547 - protein, 9 aa, Homo Sapiens
TLPCTSWLC

SEQ ID NO: 182548 - protein, 9 aa, Homo Sapiens
LVTRGGTVK

SEQ ID NO: 182549 - protein, 9 aa, Homo Sapiens
PAEEEKWLS

SEQ ID NO: 182550 - protein, 9 aa, Homo Sapiens
SSKIPKKAL

SEQ ID NO: 182551 - protein, 9 aa, Homo Sapiens
AMQRLQARE

SEQ ID NO: 182552 - protein, 9 aa, Homo Sapiens
VAGYASHFI

SEQ ID NO: 182553 - protein, 9 aa, Homo Sapiens
HLLTLLETD

SEQ ID NO: 182554 - protein, 9 aa, Homo Sapiens
KGVPFSSKS

SEQ ID NO: 182555 - protein, 9 aa, Homo Sapiens
FQTTVAKSN

SEQ ID NO: 182556 - protein, 9 aa, Homo Sapiens
SCTHCWACT

SEQ ID NO: 182557 - protein, 9 aa, Homo Sapiens
GDVLEVPWT

SEQ ID NO: 182558 - protein, 9 aa, Homo Sapiens
RLRDEVVRA

SEQ ID NO: 182559 - protein, 9 aa, Homo Sapiens
TPEEPGLDK

SEQ ID NO: 182560 - protein, 9 aa, Homo Sapiens
SLDFAQNFT

SEQ ID NO: 182561 - protein, 9 aa, Homo Sapiens
SWPRASACV

SEQ ID NO: 182562 - protein, 9 aa, Homo Sapiens
LLTLPCTSW

SEQ ID NO: 182563 - protein, 9 aa, Homo Sapiens
FVQLCQQGH

SEQ ID NO: 182564 - protein, 9 aa, Homo Sapiens
VDNKKTHPC

SEQ ID NO: 182565 - protein, 9 aa, Homo Sapiens
PGYTGPKGN

SEQ ID NO: 182566 - protein, 9 aa, Homo Sapiens
KEVWNVTRN

SEQ ID NO: 182567 - protein, 9 aa, Homo Sapiens
RAQRVHMGA

SEQ ID NO: 182568 - protein, 9 aa, Homo Sapiens
EVEASRLRR

SEQ ID NO: 182569 - protein, 9 aa, Homo Sapiens
GSSPSSRDA

SEQ ID NO: 182570 - protein, 9 aa, Homo Sapiens
TSHLVTYFP

SEQ ID NO: 182571 - protein, 9 aa, Homo Sapiens
IDNYLYICY

SEQ ID NO: 182572 - protein, 9 aa, Homo Sapiens
SVVVGSGQR

SEQ ID NO: 182573 - protein, 9 aa, Homo Sapiens
PIKPVIYSS

SEQ ID NO: 182574 - protein, 9 aa, Homo Sapiens
DDQRLLLHH

SEQ ID NO: 182575 - protein, 9 aa, Homo Sapiens
HVPSASFFD

SEQ ID NO: 182576 - protein, 9 aa, Homo Sapiens
CKSSENNGT

SEQ ID NO: 182577 - protein, 9 aa, Homo Sapiens
TTVVISTCD

SEQ ID NO: 182578 - protein, 9 aa, Homo Sapiens
GFCGKLVSF

SEQ ID NO: 182579 - protein, 9 aa, Homo Sapiens
VPATNYSLM

SEQ ID NO: 182580 - protein, 9 aa, Homo Sapiens
FVLLCRLAD

SEQ ID NO: 182581 - protein, 9 aa, Homo Sapiens
VSVHLLEEA

SEQ ID NO: 182582 - protein, 9 aa, Homo Sapiens
QMAESCEVQ

SEQ ID NO: 182583 - protein, 9 aa, Homo Sapiens
WQGEEVAVK

SEQ ID NO: 182584 - protein, 9 aa, Homo Sapiens
AYLTIQVMG

SEQ ID NO: 182585 - protein, 9 aa, Homo Sapiens
IELKNNSIS

SEQ ID NO: 182586 - protein, 9 aa, Homo Sapiens
EYEPPCASL

SEQ ID NO: 182587 - protein, 9 aa, Homo Sapiens
IGNMITTVG

SEQ ID NO: 182588 - protein, 9 aa, Homo Sapiens
QQVSECAVR

SEQ ID NO: 182589 - protein, 9 aa, Homo Sapiens
STAQSHQPD

SEQ ID NO: 182590 - protein, 9 aa, Homo Sapiens
SFSAEDLSI

SEQ ID NO: 182591 - protein, 9 aa, Homo Sapiens
GQPRWGQRA

SEQ ID NO: 182592 - protein, 9 aa, Homo Sapiens
RKRGLGTPA

SEQ ID NO: 182593 - protein, 9 aa, Homo Sapiens
LLEAQRKLH

SEQ ID NO: 182594 - protein, 9 aa, Homo Sapiens
SNSPGNIQP

SEQ ID NO: 182595 - protein, 9 aa, Homo Sapiens
NMITTVGKV

SEQ ID NO: 182596 - protein, 9 aa, Homo Sapiens
RVLRRGLES

SEQ ID NO: 182597 - protein, 9 aa, Homo Sapiens
DPIKCQYPV

SEQ ID NO: 182598 - protein, 9 aa, Homo Sapiens
EGAEKVMAH

SEQ ID NO: 182599 - protein, 9 aa, Homo Sapiens
CQQGHIQAE

SEQ ID NO: 182600 - protein, 9 aa, Homo Sapiens
LGKKLLSEK

SEQ ID NO: 182601 - protein, 9 aa, Homo Sapiens
TAEEKISLP

SEQ ID NO: 182602 - protein, 9 aa, Homo Sapiens
KASSPGHPL

SEQ ID NO: 182603 - protein, 9 aa, Homo Sapiens
RKVPVVVLL

SEQ ID NO: 182604 - protein, 9 aa, Homo Sapiens
EKVPLEAFV

SEQ ID NO: 182605 - protein, 9 aa, Homo Sapiens
SPTATPTTC

SEQ ID NO: 182606 - protein, 9 aa, Homo Sapiens
CHHRGIRSL

SEQ ID NO: 182607 - protein, 9 aa, Homo Sapiens
SKLLDKMTM

SEQ ID NO: 182608 - protein, 9 aa, Homo Sapiens
GHSFEVGVW

SEQ ID NO: 182609 - protein, 9 aa, Homo Sapiens
RGARGILSA

SEQ ID NO: 182610 - protein, 9 aa, Homo Sapiens
IRWLWAPAS

SEQ ID NO: 182611 - protein, 9 aa, Homo Sapiens
VCGHLKPSG

SEQ ID NO: 182612 - protein, 9 aa, Homo Sapiens
SVIPPTTLN

SEQ ID NO: 182613 - protein, 9 aa, Homo Sapiens
YVTSYHPKR

SEQ ID NO: 182614 - protein, 9 aa, Homo Sapiens
THKKAGDFV

SEQ ID NO: 182615 - protein, 9 aa, Homo Sapiens
ALLELCAQR

SEQ ID NO: 182616 - protein, 9 aa, Homo Sapiens
GTSPSQGIL

SEQ ID NO: 182617 - protein, 9 aa, Homo Sapiens
WGRGCCLRI

SEQ ID NO: 182618 - protein, 9 aa, Homo Sapiens
RRAGQASAA

SEQ ID NO: 182619 - protein, 9 aa, Homo Sapiens
SEELDWRAV

SEQ ID NO: 182620 - protein, 9 aa, Homo Sapiens
AKKAAANFR

SEQ ID NO: 182621 - protein, 9 aa, Homo Sapiens
PKGKQPAVG

SEQ ID NO: 182622 - protein, 9 aa, Homo Sapiens
NLASSTLYW

SEQ ID NO: 182623 - protein, 9 aa, Homo Sapiens
EEQLNIYKN

SEQ ID NO: 182624 - protein, 9 aa, Homo Sapiens
KKRGKSQGG

SEQ ID NO: 182625 - protein, 9 aa, Homo Sapiens
IYKNRLLLT

SEQ ID NO: 182626 - protein, 9 aa, Homo Sapiens
CLKTPPKPW

SEQ ID NO: 182627 - protein, 9 aa, Homo Sapiens
LKAPPERRH

SEQ ID NO: 182628 - protein, 9 aa, Homo Sapiens
ALCKFHSVF

SEQ ID NO: 182629 - protein, 9 aa, Homo Sapiens
MSLTSDAPF

SEQ ID NO: 182630 - protein, 9 aa, Homo Sapiens
QIISELPFT

SEQ ID NO: 182631 - protein, 9 aa, Homo Sapiens
GGGMQGADI

SEQ ID NO: 182632 - protein, 9 aa, Homo Sapiens
PDAQLEEKL

SEQ ID NO: 182633 - protein, 9 aa, Homo Sapiens
WCWWGRGCC

SEQ ID NO: 182634 - protein, 9 aa, Homo Sapiens
RKSLSGLES

SEQ ID NO: 182635 - protein, 9 aa, Homo Sapiens
HRIIHLGAK

SEQ ID NO: 182636 - protein, 9 aa, Homo Sapiens
KFHKTCKKT

SEQ ID NO: 182637 - protein, 9 aa, Homo Sapiens
TTASLSART

SEQ ID NO: 182638 - protein, 9 aa, Homo Sapiens
PTVSQPYSF

SEQ ID NO: 182639 - protein, 9 aa, Homo Sapiens
NLQENGIRV

SEQ ID NO: 182640 - protein, 9 aa, Homo Sapiens
KLVRGDIFR

SEQ ID NO: 182641 - protein, 9 aa, Homo Sapiens
LLEVVQVGL

SEQ ID NO: 182642 - protein, 9 aa, Homo Sapiens
YVMPTVAMP

SEQ ID NO: 182643 - protein, 9 aa, Homo Sapiens
VEERQRVLE

SEQ ID NO: 182644 - protein, 9 aa, Homo Sapiens
PSYHLKFCS

SEQ ID NO: 182645 - protein, 9 aa, Homo Sapiens
HTPLPFSTV

SEQ ID NO: 182646 - protein, 9 aa, Homo Sapiens
GSYGPQRGQ

SEQ ID NO: 182647 - protein, 9 aa, Homo Sapiens
WAPACTRWK

SEQ ID NO: 182648 - protein, 9 aa, Homo Sapiens
RQCRSQQIK

SEQ ID NO: 182649 - protein, 9 aa, Homo Sapiens
SSWKKTFTR

SEQ ID NO: 182650 - protein, 9 aa, Homo Sapiens
LHSPVPRLP

SEQ ID NO: 182651 - protein, 9 aa, Homo Sapiens
WDLFHIGNS

SEQ ID NO: 182652 - protein, 9 aa, Homo Sapiens
FVIQRLPLF

SEQ ID NO: 182653 - protein, 9 aa, Homo Sapiens
MGKRACRMN

SEQ ID NO: 182654 - protein, 9 aa, Homo Sapiens
NPEKLALKE

SEQ ID NO: 182655 - protein, 9 aa, Homo Sapiens
LRSQHRYST

SEQ ID NO: 182656 - protein, 9 aa, Homo Sapiens
EGMISLVMS

SEQ ID NO: 182657 - protein, 9 aa, Homo Sapiens
HVRLRQCRS

SEQ ID NO: 182658 - protein, 9 aa, Homo Sapiens
VGFKFTFPT

SEQ ID NO: 182659 - protein, 9 aa, Homo Sapiens
WCGRDASHC

SEQ ID NO: 182660 - protein, 9 aa, Homo Sapiens
PWREHKHRA

SEQ ID NO: 182661 - protein, 9 aa, Homo Sapiens
LPLLLEVVQ

SEQ ID NO: 182662 - protein, 9 aa, Homo Sapiens
RDQWNWLDF

SEQ ID NO: 182663 - protein, 9 aa, Homo Sapiens
SPVGPPPCL

SEQ ID NO: 182664 - protein, 9 aa, Homo Sapiens
KRGASSSTS

SEQ ID NO: 182665 - protein, 9 aa, Homo Sapiens
RLTWEVTPR

SEQ ID NO: 182666 - protein, 9 aa, Homo Sapiens
ETGKGLTLE

SEQ ID NO: 182667 - protein, 9 aa, Homo Sapiens
DVGAGRGQA

SEQ ID NO: 182668 - protein, 9 aa, Homo Sapiens
EKEKCKKTL

SEQ ID NO: 182669 - protein, 9 aa, Homo Sapiens
KVPTVSQPY

SEQ ID NO: 182670 - protein, 9 aa, Homo Sapiens
PRTVLSKIL

SEQ ID NO: 182671 - protein, 9 aa, Homo Sapiens
MLGGLGVVL

SEQ ID NO: 182672 - protein, 9 aa, Homo Sapiens
VAVMDQESA

SEQ ID NO: 182673 - protein, 9 aa, Homo Sapiens
PPKQPQISG

SEQ ID NO: 182674 - protein, 9 aa, Homo Sapiens
QNPQAPEAP

SEQ ID NO: 182675 - protein, 9 aa, Homo Sapiens
APGHRRNPS

SEQ ID NO: 182676 - protein, 9 aa, Homo Sapiens
PEMENQIAV

SEQ ID NO: 182677 - protein, 9 aa, Homo Sapiens
SNRASLPEL

SEQ ID NO: 182678 - protein, 9 aa, Homo Sapiens
VLERGLGLL

SEQ ID NO: 182679 - protein, 9 aa, Homo Sapiens
TPAPRRFLR

SEQ ID NO: 182680 - protein, 9 aa, Homo Sapiens
REKKKAPSA

SEQ ID NO: 182681 - protein, 9 aa, Homo Sapiens
IGHILETRY

SEQ ID NO: 182682 - protein, 9 aa, Homo Sapiens
RLSARVRRP

SEQ ID NO: 182683 - protein, 9 aa, Homo Sapiens
SLNRSIEKR

SEQ ID NO: 182684 - protein, 9 aa, Homo Sapiens
TISCPRPSA

SEQ ID NO: 182685 - protein, 9 aa, Homo Sapiens
GTPIGLSSS

SEQ ID NO: 182686 - protein, 9 aa, Homo Sapiens
LGDAAVLVK

SEQ ID NO: 182687 - protein, 9 aa, Homo Sapiens
SSPTLTSSW

SEQ ID NO: 182688 - protein, 9 aa, Homo Sapiens
NNCSLDLDS

SEQ ID NO: 182689 - protein, 9 aa, Homo Sapiens
FHLSKDLDC

SEQ ID NO: 182690 - protein, 9 aa, Homo Sapiens
REKVHPMIL

SEQ ID NO: 182691 - protein, 9 aa, Homo Sapiens
RQRDGEDQT

SEQ ID NO: 182692 - protein, 9 aa, Homo Sapiens
QSPLRKVRV

SEQ ID NO: 182693 - protein, 9 aa, Homo Sapiens
MQGADIQGV

SEQ ID NO: 182694 - protein, 9 aa, Homo Sapiens
QKTSLKWQF

SEQ ID NO: 182695 - protein, 9 aa, Homo Sapiens
PLLLEVVQV

SEQ ID NO: 182696 - protein, 9 aa, Homo Sapiens
IRNEKNPNP

SEQ ID NO: 182697 - protein, 9 aa, Homo Sapiens
TWAAAATAR

SEQ ID NO: 182698 - protein, 9 aa, Homo Sapiens
QSKIFFQTG

SEQ ID NO: 182699 - protein, 9 aa, Homo Sapiens
HAVPVVKEL

SEQ ID NO: 182700 - protein, 9 aa, Homo Sapiens
IRVLGASHI

SEQ ID NO: 182701 - protein, 9 aa, Homo Sapiens
EHISLGQLS

SEQ ID NO: 182702 - protein, 9 aa, Homo Sapiens
PASAWTSMH

SEQ ID NO: 182703 - protein, 9 aa, Homo Sapiens
SLQAIQKQL

SEQ ID NO: 182704 - protein, 9 aa, Homo Sapiens
STRAGRIIP

SEQ ID NO: 182705 - protein, 9 aa, Homo Sapiens
ASPLKRDPQ

SEQ ID NO: 182706 - protein, 9 aa, Homo Sapiens
VPSKPRRGR

SEQ ID NO: 182707 - protein, 9 aa, Homo Sapiens
PPLILWPQA

SEQ ID NO: 182708 - protein, 9 aa, Homo Sapiens
WSEGVDGTD

SEQ ID NO: 182709 - protein, 9 aa, Homo Sapiens
SEDLKNAQT

SEQ ID NO: 182710 - protein, 9 aa, Homo Sapiens
VVDLAVNVC

SEQ ID NO: 182711 - protein, 9 aa, Homo Sapiens
EGCQLMGVT

SEQ ID NO: 182712 - protein, 9 aa, Homo Sapiens
LPRAGGHRP

SEQ ID NO: 182713 - protein, 9 aa, Homo Sapiens
DTAEQVITS

SEQ ID NO: 182714 - protein, 9 aa, Homo Sapiens
TDTGCYTLK

SEQ ID NO: 182715 - protein, 9 aa, Homo Sapiens
LTSSWKKTF

SEQ ID NO: 182716 - protein, 9 aa, Homo Sapiens
GPDFGSLRY

SEQ ID NO: 182717 - protein, 9 aa, Homo Sapiens
DCSMPPLLA

SEQ ID NO: 182718 - protein, 9 aa, Homo Sapiens
GWKLVRGDI

SEQ ID NO: 182719 - protein, 9 aa, Homo Sapiens
WKDKVAQHE

SEQ ID NO: 182720 - protein, 9 aa, Homo Sapiens
KKLVKISEI

SEQ ID NO: 182721 - protein, 9 aa, Homo Sapiens
GLHGLLALS

SEQ ID NO: 182722 - protein, 9 aa, Homo Sapiens
VPLLNVPQL

SEQ ID NO: 182723 - protein, 9 aa, Homo Sapiens
CPGRQKESE

SEQ ID NO: 182724 - protein, 9 aa, Homo Sapiens
GMRLEAVHA

SEQ ID NO: 182725 - protein, 9 aa, Homo Sapiens
KLFRIRGQK

SEQ ID NO: 182726 - protein, 9 aa, Homo Sapiens
RLCKASDQP

SEQ ID NO: 182727 - protein, 9 aa, Homo Sapiens
NEVFCFLVE

SEQ ID NO: 182728 - protein, 9 aa, Homo Sapiens
RLDLEYLFP

SEQ ID NO: 182729 - protein, 9 aa, Homo Sapiens
HKRRHTEKN

SEQ ID NO: 182730 - protein, 9 aa, Homo Sapiens
GKQPAVGKQ

SEQ ID NO: 182731 - protein, 9 aa, Homo Sapiens
MEKEKCKKT

SEQ ID NO: 182732 - protein, 9 aa, Homo Sapiens
CKCQWEEQH

SEQ ID NO: 182733 - protein, 9 aa, Homo Sapiens
QKQRRKRLP

SEQ ID NO: 182734 - protein, 9 aa, Homo Sapiens
RKTANYERQ

SEQ ID NO: 182735 - protein, 9 aa, Homo Sapiens
GLHLGLHLL

SEQ ID NO: 182736 - protein, 9 aa, Homo Sapiens
HLAVRRKLH

SEQ ID NO: 182737 - protein, 9 aa, Homo Sapiens
PPTLPWTLR

SEQ ID NO: 182738 - protein, 9 aa, Homo Sapiens
WPRWAQDEH

SEQ ID NO: 182739 - protein, 9 aa, Homo Sapiens
FFNSCLNPV

SEQ ID NO: 182740 - protein, 9 aa, Homo Sapiens
AQSHQPDPD

SEQ ID NO: 182741 - protein, 9 aa, Homo Sapiens
NYDTSTDEH

SEQ ID NO: 182742 - protein, 9 aa, Homo Sapiens
ILGNARHRL

SEQ ID NO: 182743 - protein, 9 aa, Homo Sapiens
PCLSPTIPG

SEQ ID NO: 182744 - protein, 9 aa, Homo Sapiens
SEDPVLMAL

SEQ ID NO: 182745 - protein, 9 aa, Homo Sapiens
SSAWPWPKI

SEQ ID NO: 182746 - protein, 9 aa, Homo Sapiens
CDYIDFLVT

SEQ ID NO: 182747 - protein, 9 aa, Homo Sapiens
HTCIQPHGQ

SEQ ID NO: 182748 - protein, 9 aa, Homo Sapiens
DHPWHQPSH

SEQ ID NO: 182749 - protein, 9 aa, Homo Sapiens
LVLPSLVPQ

SEQ ID NO: 182750 - protein, 9 aa, Homo Sapiens
QKKAKIKKK

SEQ ID NO: 182751 - protein, 9 aa, Homo Sapiens
GHIDVWWIM

SEQ ID NO: 182752 - protein, 9 aa, Homo Sapiens
GFNGCSPQL

SEQ ID NO: 182753 - protein, 9 aa, Homo Sapiens
ALQKTPRSC

SEQ ID NO: 182754 - protein, 9 aa, Homo Sapiens
MFFGNQSII

SEQ ID NO: 182755 - protein, 9 aa, Homo Sapiens
PATSLCLKT

SEQ ID NO: 182756 - protein, 9 aa, Homo Sapiens
LLNEDDECH

SEQ ID NO: 182757 - protein, 9 aa, Homo Sapiens
KKQREHCFH

SEQ ID NO: 182758 - protein, 9 aa, Homo Sapiens
KKSVSRPEA

SEQ ID NO: 182759 - protein, 9 aa, Homo Sapiens
KRPQIADEQ

SEQ ID NO: 182760 - protein, 9 aa, Homo Sapiens
LQEEQEGGW

SEQ ID NO: 182761 - protein, 9 aa, Homo Sapiens
VRYWAKGEK

SEQ ID NO: 182762 - protein, 9 aa, Homo Sapiens
AVTQAELFV

SEQ ID NO: 182763 - protein, 9 aa, Homo Sapiens
IEEKSGIGA

SEQ ID NO: 182764 - protein, 9 aa, Homo Sapiens
PDLEEAVSG

SEQ ID NO: 182765 - protein, 9 aa, Homo Sapiens
EDLKNAQTS

SEQ ID NO: 182766 - protein, 9 aa, Homo Sapiens
VAILQIPST

SEQ ID NO: 182767 - protein, 9 aa, Homo Sapiens
REHCFHHST

SEQ ID NO: 182768 - protein, 9 aa, Homo Sapiens
TLPQGRARC

SEQ ID NO: 182769 - protein, 9 aa, Homo Sapiens
KCRPTTSRR

SEQ ID NO: 182770 - protein, 9 aa, Homo Sapiens
CGKSFSTCT

SEQ ID NO: 182771 - protein, 9 aa, Homo Sapiens
SALHGRISA

SEQ ID NO: 182772 - protein, 9 aa, Homo Sapiens
EIDPPQKRV

SEQ ID NO: 182773 - protein, 9 aa, Homo Sapiens
VEGPIKPVI

SEQ ID NO: 182774 - protein, 9 aa, Homo Sapiens
RAWLSPTAD

SEQ ID NO: 182775 - protein, 9 aa, Homo Sapiens
NNSISKNFS

SEQ ID NO: 182776 - protein, 9 aa, Homo Sapiens
QWRIGSASS

SEQ ID NO: 182777 - protein, 9 aa, Homo Sapiens
KEELQGSGD

SEQ ID NO: 182778 - protein, 9 aa, Homo Sapiens
LAAGLHDTC

SEQ ID NO: 182779 - protein, 9 aa, Homo Sapiens
LFRTDPEAR

SEQ ID NO: 182780 - protein, 9 aa, Homo Sapiens
KKRKTANYE

SEQ ID NO: 182781 - protein, 9 aa, Homo Sapiens
AERAQMLGG

SEQ ID NO: 182782 - protein, 9 aa, Homo Sapiens
AICFRNALL

SEQ ID NO: 182783 - protein, 9 aa, Homo Sapiens
GHQEVTTRL

SEQ ID NO: 182784 - protein, 9 aa, Homo Sapiens
PPEWKALRD

SEQ ID NO: 182785 - protein, 9 aa, Homo Sapiens
EMEENFTVE

SEQ ID NO: 182786 - protein, 9 aa, Homo Sapiens
NVEGPLTGH

SEQ ID NO: 182787 - protein, 9 aa, Homo Sapiens
RRLTWEVTP

SEQ ID NO: 182788 - protein, 9 aa, Homo Sapiens
LSQAFRGSL

SEQ ID NO: 182789 - protein, 9 aa, Homo Sapiens
FLPPVSWPR

SEQ ID NO: 182790 - protein, 9 aa, Homo Sapiens
RCTHAGQTL

SEQ ID NO: 182791 - protein, 9 aa, Homo Sapiens
ENEAAVTAV

SEQ ID NO: 182792 - protein, 9 aa, Homo Sapiens
CHPVWARRQ

SEQ ID NO: 182793 - protein, 9 aa, Homo Sapiens
HHPPVWAAL

SEQ ID NO: 182794 - protein, 9 aa, Homo Sapiens
QLIQEACWS

SEQ ID NO: 182795 - protein, 9 aa, Homo Sapiens
TTNMVQEEQ

SEQ ID NO: 182796 - protein, 9 aa, Homo Sapiens
LRQCRSQQI

SEQ ID NO: 182797 - protein, 9 aa, Homo Sapiens
EGHWDCGIC

SEQ ID NO: 182798 - protein, 9 aa, Homo Sapiens
VVVTNHFWP

SEQ ID NO: 182799 - protein, 9 aa, Homo Sapiens
VFCFLVEEK

SEQ ID NO: 182800 - protein, 9 aa, Homo Sapiens
MSYNRSSGN

SEQ ID NO: 182801 - protein, 9 aa, Homo Sapiens
SKNNKSSSQ

SEQ ID NO: 182802 - protein, 9 aa, Homo Sapiens
LCPGRQKES

SEQ ID NO: 182803 - protein, 9 aa, Homo Sapiens
GKPFKCHLC

SEQ ID NO: 182804 - protein, 9 aa, Homo Sapiens
TLVFCSDKH

SEQ ID NO: 182805 - protein, 9 aa, Homo Sapiens
NLDGHIREH

SEQ ID NO: 182806 - protein, 9 aa, Homo Sapiens
LLAREFGLL

SEQ ID NO: 182807 - protein, 9 aa, Homo Sapiens
QILAHLLPQ

SEQ ID NO: 182808 - protein, 9 aa, Homo Sapiens
QTASTPAST

SEQ ID NO: 182809 - protein, 9 aa, Homo Sapiens
PLGEEHILV

SEQ ID NO: 182810 - protein, 9 aa, Homo Sapiens
SSSGKQYRL

SEQ ID NO: 182811 - protein, 9 aa, Homo Sapiens
DVPILAGGN

SEQ ID NO: 182812 - protein, 9 aa, Homo Sapiens
YRDTKGPFL

SEQ ID NO: 182813 - protein, 9 aa, Homo Sapiens
KLALKEDLL

SEQ ID NO: 182814 - protein, 9 aa, Homo Sapiens
EQGLAPPHC

SEQ ID NO: 182815 - protein, 9 aa, Homo Sapiens
NSYHHMVFS

SEQ ID NO: 182816 - protein, 9 aa, Homo Sapiens
LLGVCGHLK

SEQ ID NO: 182817 - protein, 9 aa, Homo Sapiens
PKIPLDPAP

SEQ ID NO: 182818 - protein, 9 aa, Homo Sapiens
KLVQEVEGL

SEQ ID NO: 182819 - protein, 9 aa, Homo Sapiens
LKAEHTNWL

SEQ ID NO: 182820 - protein, 9 aa, Homo Sapiens
DEQKTSLKW

SEQ ID NO: 182821 - protein, 9 aa, Homo Sapiens
SNRLWMEFV

SEQ ID NO: 182822 - protein, 9 aa, Homo Sapiens
GVADHGGRS

SEQ ID NO: 182823 - protein, 9 aa, Homo Sapiens
EKVHPMILA

SEQ ID NO: 182824 - protein, 9 aa, Homo Sapiens
NKSDDFLCA

SEQ ID NO: 182825 - protein, 9 aa, Homo Sapiens
NSVSVEGVS

SEQ ID NO: 182826 - protein, 9 aa, Homo Sapiens
TRQRDGEDQ

SEQ ID NO: 182827 - protein, 9 aa, Homo Sapiens
FSCQEGCQL

SEQ ID NO: 182828 - protein, 9 aa, Homo Sapiens
LSWCGRDAS

SEQ ID NO: 182829 - protein, 9 aa, Homo Sapiens
RAVNLNLCA

SEQ ID NO: 182830 - protein, 9 aa, Homo Sapiens
KKEPEPEPI

SEQ ID NO: 182831 - protein, 9 aa, Homo Sapiens
PEPAKTRVS

SEQ ID NO: 182832 - protein, 9 aa, Homo Sapiens
SRLRRLNIK

SEQ ID NO: 182833 - protein, 9 aa, Homo Sapiens
PRPPRTATT

SEQ ID NO: 182834 - protein, 9 aa, Homo Sapiens
SYHLKFCSC

SEQ ID NO: 182835 - protein, 9 aa, Homo Sapiens
RAEVSQRAL

SEQ ID NO: 182836 - protein, 9 aa, Homo Sapiens
FEPYLGCIE

SEQ ID NO: 182837 - protein, 9 aa, Homo Sapiens
VPSASFFDI

SEQ ID NO: 182838 - protein, 9 aa, Homo Sapiens
LHCHEINCG

SEQ ID NO: 182839 - protein, 9 aa, Homo Sapiens
EVPWTHLTH

SEQ ID NO: 182840 - protein, 9 aa, Homo Sapiens
GVIEEFWQQ

SEQ ID NO: 182841 - protein, 9 aa, Homo Sapiens
WLKNAFVKA

SEQ ID NO: 182842 - protein, 9 aa, Homo Sapiens
YTEVKTHCG

SEQ ID NO: 182843 - protein, 9 aa, Homo Sapiens
EKKRLKKRR

SEQ ID NO: 182844 - protein, 9 aa, Homo Sapiens
QASDVDSSD

SEQ ID NO: 182845 - protein, 9 aa, Homo Sapiens
GVADSGLAL

SEQ ID NO: 182846 - protein, 9 aa, Homo Sapiens
ILGDFIQRA

SEQ ID NO: 182847 - protein, 9 aa, Homo Sapiens
RATDRLMKE

SEQ ID NO: 182848 - protein, 9 aa, Homo Sapiens
QYEYEPPCA

SEQ ID NO: 182849 - protein, 9 aa, Homo Sapiens
DDRSPQAPL

SEQ ID NO: 182850 - protein, 9 aa, Homo Sapiens
MEDLKESIA

SEQ ID NO: 182851 - protein, 9 aa, Homo Sapiens
LLCQCDKKR

SEQ ID NO: 182852 - protein, 9 aa, Homo Sapiens
GGIKKRRIH

SEQ ID NO: 182853 - protein, 9 aa, Homo Sapiens
SGKYRQLSR

SEQ ID NO: 182854 - protein, 9 aa, Homo Sapiens
FFHSQPTQN

SEQ ID NO: 182855 - protein, 9 aa, Homo Sapiens
PGSPCSRRW

SEQ ID NO: 182856 - protein, 9 aa, Homo Sapiens
VYIMSTTGW

SEQ ID NO: 182857 - protein, 9 aa, Homo Sapiens
REAIAVVMD

SEQ ID NO: 182858 - protein, 9 aa, Homo Sapiens
LTDMNYSEK

SEQ ID NO: 182859 - protein, 9 aa, Homo Sapiens
SPTMQHSCT

SEQ ID NO: 182860 - protein, 9 aa, Homo Sapiens
IFFFFVYIW

SEQ ID NO: 182861 - protein, 9 aa, Homo Sapiens
DLVSAEDLA

SEQ ID NO: 182862 - protein, 9 aa, Homo Sapiens
SRRRTQTAS

SEQ ID NO: 182863 - protein, 9 aa, Homo Sapiens
KVYLGGLGV

SEQ ID NO: 182864 - protein, 9 aa, Homo Sapiens
CQQSPGSSP

SEQ ID NO: 182865 - protein, 9 aa, Homo Sapiens
GLLPECRVR

SEQ ID NO: 182866 - protein, 9 aa, Homo Sapiens
LWRQQKEKL

SEQ ID NO: 182867 - protein, 9 aa, Homo Sapiens
VLSYVAGIT

SEQ ID NO: 182868 - protein, 9 aa, Homo Sapiens
ACPPENCSG

SEQ ID NO: 182869 - protein, 9 aa, Homo Sapiens
AEAGKLCRK

SEQ ID NO: 182870 - protein, 9 aa, Homo Sapiens
NQCFRNIFS

SEQ ID NO: 182871 - protein, 9 aa, Homo Sapiens
NVSGELGGG

SEQ ID NO: 182872 - protein, 9 aa, Homo Sapiens
ILFWKDCHL

SEQ ID NO: 182873 - protein, 9 aa, Homo Sapiens
GSLVPNSSP

SEQ ID NO: 182874 - protein, 9 aa, Homo Sapiens
PGRGVPPRA

SEQ ID NO: 182875 - protein, 9 aa, Homo Sapiens
AGCLHMTCA

SEQ ID NO: 182876 - protein, 9 aa, Homo Sapiens
VLLWPRWAQ

SEQ ID NO: 182877 - protein, 9 aa, Homo Sapiens
KGANPEDVI

SEQ ID NO: 182878 - protein, 9 aa, Homo Sapiens
NGFFLRFIR

SEQ ID NO: 182879 - protein, 9 aa, Homo Sapiens
ETLVLPSLV

SEQ ID NO: 182880 - protein, 9 aa, Homo Sapiens
LQAWDSEDF

SEQ ID NO: 182881 - protein, 9 aa, Homo Sapiens
PTCSWPRVR

SEQ ID NO: 182882 - protein, 9 aa, Homo Sapiens
DLYGTIGSP

SEQ ID NO: 182883 - protein, 9 aa, Homo Sapiens
DAHPRWESQ

SEQ ID NO: 182884 - protein, 9 aa, Homo Sapiens
VAEVVGVAG

SEQ ID NO: 182885 - protein, 9 aa, Homo Sapiens
PCSRRWRSS

SEQ ID NO: 182886 - protein, 9 aa, Homo Sapiens
YCDYAGTQS

SEQ ID NO: 182887 - protein, 9 aa, Homo Sapiens
ASGSSKLPV

SEQ ID NO: 182888 - protein, 9 aa, Homo Sapiens
IRLRCIRRT

SEQ ID NO: 182889 - protein, 9 aa, Homo Sapiens
QTLRPVTHG

SEQ ID NO: 182890 - protein, 9 aa, Homo Sapiens
LLWQTLTTQ

SEQ ID NO: 182891 - protein, 9 aa, Homo Sapiens
CWRGSTRTT

SEQ ID NO: 182892 - protein, 9 aa, Homo Sapiens
IKKRLFHQK

SEQ ID NO: 182893 - protein, 9 aa, Homo Sapiens
RISGKNRWL

SEQ ID NO: 182894 - protein, 9 aa, Homo Sapiens
YTMLIKCVN

SEQ ID NO: 182895 - protein, 9 aa, Homo Sapiens
ARAPACSWK

SEQ ID NO: 182896 - protein, 9 aa, Homo Sapiens
GLALKGFLF

SEQ ID NO: 182897 - protein, 9 aa, Homo Sapiens
WSAGCWTVR

SEQ ID NO: 182898 - protein, 9 aa, Homo Sapiens
DGQPRWGQR

SEQ ID NO: 182899 - protein, 9 aa, Homo Sapiens
PPHQMKCLT

SEQ ID NO: 182900 - protein, 9 aa, Homo Sapiens
YKRLWAGSR

SEQ ID NO: 182901 - protein, 9 aa, Homo Sapiens
HQKHHKHHK

SEQ ID NO: 182902 - protein, 9 aa, Homo Sapiens
RGRPAARTG

SEQ ID NO: 182903 - protein, 9 aa, Homo Sapiens
RAHQVTHTA

SEQ ID NO: 182904 - protein, 9 aa, Homo Sapiens
VILSPSFPG

SEQ ID NO: 182905 - protein, 9 aa, Homo Sapiens
PRLRHGLCD

SEQ ID NO: 182906 - protein, 9 aa, Homo Sapiens
IVHAVWVQQ

SEQ ID NO: 182907 - protein, 9 aa, Homo Sapiens
KQRGRPGRP

SEQ ID NO: 182908 - protein, 9 aa, Homo Sapiens
QKLQRCFCT

SEQ ID NO: 182909 - protein, 9 aa, Homo Sapiens
ATKKTKIQT

SEQ ID NO: 182910 - protein, 9 aa, Homo Sapiens
SLVMSYALL

SEQ ID NO: 182911 - protein, 9 aa, Homo Sapiens
CRITFVLLM

SEQ ID NO: 182912 - protein, 9 aa, Homo Sapiens
IYIKQVALC

SEQ ID NO: 182913 - protein, 9 aa, Homo Sapiens
GKMCWFRTG

SEQ ID NO: 182914 - protein, 9 aa, Homo Sapiens
RTTASLSAR

SEQ ID NO: 182915 - protein, 9 aa, Homo Sapiens
CNDNLPTSM

SEQ ID NO: 182916 - protein, 9 aa, Homo Sapiens
AKPFRDKPI

SEQ ID NO: 182917 - protein, 9 aa, Homo Sapiens
YHNVEGPLT

SEQ ID NO: 182918 - protein, 9 aa, Homo Sapiens
MEGVILSPS

SEQ ID NO: 182919 - protein, 9 aa, Homo Sapiens
VVEIITEVP

SEQ ID NO: 182920 - protein, 9 aa, Homo Sapiens
LTNTMGGTR

SEQ ID NO: 182921 - protein, 9 aa, Homo Sapiens
LRDHICFVV

SEQ ID NO: 182922 - protein, 9 aa, Homo Sapiens
RSGLGVGLS

SEQ ID NO: 182923 - protein, 9 aa, Homo Sapiens
ARCQGFTSV

SEQ ID NO: 182924 - protein, 9 aa, Homo Sapiens
MDSSSFIRF

SEQ ID NO: 182925 - protein, 9 aa, Homo Sapiens
TARAPACSW

SEQ ID NO: 182926 - protein, 9 aa, Homo Sapiens
LTQLEVARR

SEQ ID NO: 182927 - protein, 9 aa, Homo Sapiens
LWLKGCAKE

SEQ ID NO: 182928 - protein, 9 aa, Homo Sapiens
GQVDGLISQ

SEQ ID NO: 182929 - protein, 9 aa, Homo Sapiens
SPGSMPFSL

SEQ ID NO: 182930 - protein, 9 aa, Homo Sapiens
GIRKCQGSS

SEQ ID NO: 182931 - protein, 9 aa, Homo Sapiens
DDDNPPCLL

SEQ ID NO: 182932 - protein, 9 aa, Homo Sapiens
RGPESRALG

SEQ ID NO: 182933 - protein, 9 aa, Homo Sapiens
QSQNYLWTT

SEQ ID NO: 182934 - protein, 9 aa, Homo Sapiens
CARRGRRPA

SEQ ID NO: 182935 - protein, 9 aa, Homo Sapiens
IDNSAGTFV

SEQ ID NO: 182936 - protein, 9 aa, Homo Sapiens
VSTAASMKM

SEQ ID NO: 182937 - protein, 9 aa, Homo Sapiens
EFGPTSPSS

SEQ ID NO: 182938 - protein, 9 aa, Homo Sapiens
ASVTGPDGV

SEQ ID NO: 182939 - protein, 9 aa, Homo Sapiens
PTVPLNPPP

SEQ ID NO: 182940 - protein, 9 aa, Homo Sapiens
VQASDVDSS

SEQ ID NO: 182941 - protein, 9 aa, Homo Sapiens
RRRASLEKS

SEQ ID NO: 182942 - protein, 9 aa, Homo Sapiens
CGKVPRKDL

SEQ ID NO: 182943 - protein, 9 aa, Homo Sapiens
DSQETLVLP

SEQ ID NO: 182944 - protein, 9 aa, Homo Sapiens
LVDLQVPRS

SEQ ID NO: 182945 - protein, 9 aa, Homo Sapiens
TTARTPGPC

SEQ ID NO: 182946 - protein, 9 aa, Homo Sapiens
NTMGGTRKA

SEQ ID NO: 182947 - protein, 9 aa, Homo Sapiens
ATSLCLKTP

SEQ ID NO: 182948 - protein, 9 aa, Homo Sapiens
LLRQLQSAG

SEQ ID NO: 182949 - protein, 9 aa, Homo Sapiens
VASVKGKLA

SEQ ID NO: 182950 - protein, 9 aa, Homo Sapiens
WQQERSFLD

SEQ ID NO: 182951 - protein, 9 aa, Homo Sapiens
FVELVAGQP

SEQ ID NO: 182952 - protein, 9 aa, Homo Sapiens
AELQVMINE

SEQ ID NO: 182953 - protein, 9 aa, Homo Sapiens
RQRAHGQGR

SEQ ID NO: 182954 - protein, 9 aa, Homo Sapiens
ASPHPEVEY

SEQ ID NO: 182955 - protein, 9 aa, Homo Sapiens
HGQQALAEV

SEQ ID NO: 182956 - protein, 9 aa, Homo Sapiens
EEKFIKRGE

SEQ ID NO: 182957 - protein, 9 aa, Homo Sapiens
LLLQLLQTL

SEQ ID NO: 182958 - protein, 9 aa, Homo Sapiens
PSFPGNYPS

SEQ ID NO: 182959 - protein, 9 aa, Homo Sapiens
FRPSSIQQM

SEQ ID NO: 182960 - protein, 9 aa, Homo Sapiens
AEAASVTGP

SEQ ID NO: 182961 - protein, 9 aa, Homo Sapiens
AMSCGIPES

SEQ ID NO: 182962 - protein, 9 aa, Homo Sapiens
HDSEELDWR

SEQ ID NO: 182963 - protein, 9 aa, Homo Sapiens
LTSGKYRQL

SEQ ID NO: 182964 - protein, 9 aa, Homo Sapiens
ILENTVPAA

SEQ ID NO: 182965 - protein, 9 aa, Homo Sapiens
GAAASPTTA

SEQ ID NO: 182966 - protein, 9 aa, Homo Sapiens
AEIMLESFN

SEQ ID NO: 182967 - protein, 9 aa, Homo Sapiens
GLSTELLEA

SEQ ID NO: 182968 - protein, 9 aa, Homo Sapiens
LHTQPCAAA

SEQ ID NO: 182969 - protein, 9 aa, Homo Sapiens
RYSTVCWRG

SEQ ID NO: 182970 - protein, 9 aa, Homo Sapiens
LSLNASGRT

SEQ ID NO: 182971 - protein, 9 aa, Homo Sapiens
FCFLVEEKI

SEQ ID NO: 182972 - protein, 9 aa, Homo Sapiens
RRLSARVRR

SEQ ID NO: 182973 - protein, 9 aa, Homo Sapiens
GKTEPVAGS

SEQ ID NO: 182974 - protein, 9 aa, Homo Sapiens
STRCPAAEP

SEQ ID NO: 182975 - protein, 9 aa, Homo Sapiens
QISGSLFSL

SEQ ID NO: 182976 - protein, 9 aa, Homo Sapiens
RCRLSSKGV

SEQ ID NO: 182977 - protein, 9 aa, Homo Sapiens
ILARGGINF

SEQ ID NO: 182978 - protein, 9 aa, Homo Sapiens
KCLTAVDCL

SEQ ID NO: 182979 - protein, 9 aa, Homo Sapiens
NCKKLIQKS

SEQ ID NO: 182980 - protein, 9 aa, Homo Sapiens
EAAKTAQFG

SEQ ID NO: 182981 - protein, 9 aa, Homo Sapiens
TKKRVNTAW

SEQ ID NO: 182982 - protein, 9 aa, Homo Sapiens
RHMPVASSE

SEQ ID NO: 182983 - protein, 9 aa, Homo Sapiens
IAKAYAALM

SEQ ID NO: 182984 - protein, 9 aa, Homo Sapiens
KKLKTRMHQ

SEQ ID NO: 182985 - protein, 9 aa, Homo Sapiens
ALKKASSPG

SEQ ID NO: 182986 - protein, 9 aa, Homo Sapiens
PPAPRPASD

SEQ ID NO: 182987 - protein, 9 aa, Homo Sapiens
GLLALSSSP

SEQ ID NO: 182988 - protein, 9 aa, Homo Sapiens
PEENLRLSR

SEQ ID NO: 182989 - protein, 9 aa, Homo Sapiens
SHFHLSKDL

SEQ ID NO: 182990 - protein, 9 aa, Homo Sapiens
NKRKRKCVL

SEQ ID NO: 182991 - protein, 9 aa, Homo Sapiens
EKHLMEKKI

SEQ ID NO: 182992 - protein, 9 aa, Homo Sapiens
TCKKTETVE

SEQ ID NO: 182993 - protein, 9 aa, Homo Sapiens
PRLSKKVTI

SEQ ID NO: 182994 - protein, 9 aa, Homo Sapiens
EALFLQEVF

SEQ ID NO: 182995 - protein, 9 aa, Homo Sapiens
PRALTRCTT

SEQ ID NO: 182996 - protein, 9 aa, Homo Sapiens
IKTQKSKGL

SEQ ID NO: 182997 - protein, 9 aa, Homo Sapiens
GGHAVPVVK

SEQ ID NO: 182998 - protein, 9 aa, Homo Sapiens
HIDGRENCD

SEQ ID NO: 182999 - protein, 9 aa, Homo Sapiens
HHRGIRSLR

SEQ ID NO: 183000 - protein, 9 aa, Homo Sapiens
FEVGVWSIG

SEQ ID NO: 183001 - protein, 9 aa, Homo Sapiens
FRGSLLGCV

SEQ ID NO: 183002 - protein, 9 aa, Homo Sapiens
TACPWATSL

SEQ ID NO: 183003 - protein, 9 aa, Homo Sapiens
GIDQSIDFK

SEQ ID NO: 183004 - protein, 9 aa, Homo Sapiens
AFTKVKMSL

SEQ ID NO: 183005 - protein, 9 aa, Homo Sapiens
RGSTRTTAS

SEQ ID NO: 183006 - protein, 9 aa, Homo Sapiens
CFSSPADDN

SEQ ID NO: 183007 - protein, 9 aa, Homo Sapiens
LLQTLRPVT

SEQ ID NO: 183008 - protein, 9 aa, Homo Sapiens
PQPLPCVQG

SEQ ID NO: 183009 - protein, 9 aa, Homo Sapiens
ISGKLLLLH

SEQ ID NO: 183010 - protein, 9 aa, Homo Sapiens
SPPQAAAAA

SEQ ID NO: 183011 - protein, 9 aa, Homo Sapiens
ALLHHWLFV

SEQ ID NO: 183012 - protein, 9 aa, Homo Sapiens
DDEEDDTGM

SEQ ID NO: 183013 - protein, 9 aa, Homo Sapiens
DEGKITFYI

SEQ ID NO: 183014 - protein, 9 aa, Homo Sapiens
AVSGSVRAT

SEQ ID NO: 183015 - protein, 9 aa, Homo Sapiens
LAKHQELLG

SEQ ID NO: 183016 - protein, 9 aa, Homo Sapiens
VVISTCDHG

SEQ ID NO: 183017 - protein, 9 aa, Homo Sapiens
GRRPAGKES

SEQ ID NO: 183018 - protein, 9 aa, Homo Sapiens
SHGRKSLSG

SEQ ID NO: 183019 - protein, 9 aa, Homo Sapiens
SPPEAAFQR

SEQ ID NO: 183020 - protein, 9 aa, Homo Sapiens
SSHTTTKSM

SEQ ID NO: 183021 - protein, 9 aa, Homo Sapiens
AAARWRRRA

SEQ ID NO: 183022 - protein, 9 aa, Homo Sapiens
LDSIIGPQL

SEQ ID NO: 183023 - protein, 9 aa, Homo Sapiens
GASRGPPAP

SEQ ID NO: 183024 - protein, 9 aa, Homo Sapiens
SPKGVPFSS

SEQ ID NO: 183025 - protein, 9 aa, Homo Sapiens
QAEKAHENP

SEQ ID NO: 183026 - protein, 9 aa, Homo Sapiens
VSKNGFFRD

SEQ ID NO: 183027 - protein, 9 aa, Homo Sapiens
GSHLGRRSM

SEQ ID NO: 183028 - protein, 9 aa, Homo Sapiens
LPKQPLLLL

SEQ ID NO: 183029 - protein, 9 aa, Homo Sapiens
KKYYHHRNI

SEQ ID NO: 183030 - protein, 9 aa, Homo Sapiens
GEADRWGRQ

SEQ ID NO: 183031 - protein, 9 aa, Homo Sapiens
SIRNEKNPN

SEQ ID NO: 183032 - protein, 9 aa, Homo Sapiens
QRTVPRCSG

SEQ ID NO: 183033 - protein, 9 aa, Homo Sapiens
CYWTIRVLG

SEQ ID NO: 183034 - protein, 9 aa, Homo Sapiens
NVAHTLCMM

SEQ ID NO: 183035 - protein, 9 aa, Homo Sapiens
AVCLTLCLL

SEQ ID NO: 183036 - protein, 9 aa, Homo Sapiens
HAVWVQQAG

SEQ ID NO: 183037 - protein, 9 aa, Homo Sapiens
GWPWQDNRT

SEQ ID NO: 183038 - protein, 9 aa, Homo Sapiens
QPLLHNLAE

SEQ ID NO: 183039 - protein, 9 aa, Homo Sapiens
SCRTSSQPW

SEQ ID NO: 183040 - protein, 9 aa, Homo Sapiens
LKIQYQMHL

SEQ ID NO: 183041 - protein, 9 aa, Homo Sapiens
SIFAGIVTF

SEQ ID NO: 183042 - protein, 9 aa, Homo Sapiens
PELPPASPL

SEQ ID NO: 183043 - protein, 9 aa, Homo Sapiens
WKQRGRPGR

SEQ ID NO: 183044 - protein, 9 aa, Homo Sapiens
GNPFLTAND

SEQ ID NO: 183045 - protein, 9 aa, Homo Sapiens
KKNVAVMDQ

SEQ ID NO: 183046 - protein, 9 aa, Homo Sapiens
EGNLIQNRS

SEQ ID NO: 183047 - protein, 9 aa, Homo Sapiens
SLNSSIRAA

SEQ ID NO: 183048 - protein, 9 aa, Homo Sapiens
HLPATPRDR

SEQ ID NO: 183049 - protein, 9 aa, Homo Sapiens
YLIAICHHR

SEQ ID NO: 183050 - protein, 9 aa, Homo Sapiens
PPMGVDRWN

SEQ ID NO: 183051 - protein, 9 aa, Homo Sapiens
DTVKIPKKE

SEQ ID NO: 183052 - protein, 9 aa, Homo Sapiens
FNSSLFRQE

SEQ ID NO: 183053 - protein, 9 aa, Homo Sapiens
YCKFLSSTH

SEQ ID NO: 183054 - protein, 9 aa, Homo Sapiens
NALDQAEQA

SEQ ID NO: 183055 - protein, 9 aa, Homo Sapiens
RSCRTSSQP

SEQ ID NO: 183056 - protein, 9 aa, Homo Sapiens
VELHLLLPL

SEQ ID NO: 183057 - protein, 9 aa, Homo Sapiens
TKATKKTKI

SEQ ID NO: 183058 - protein, 9 aa, Homo Sapiens
NPNEVFCFL

SEQ ID NO: 183059 - protein, 9 aa, Homo Sapiens
KQGTVLMKL

SEQ ID NO: 183060 - protein, 9 aa, Homo Sapiens
IPKVGLSSR

SEQ ID NO: 183061 - protein, 9 aa, Homo Sapiens
PREAIQVFH

SEQ ID NO: 183062 - protein, 9 aa, Homo Sapiens
GAVKCKSSE

SEQ ID NO: 183063 - protein, 9 aa, Homo Sapiens
RPEPAKTRV

SEQ ID NO: 183064 - protein, 9 aa, Homo Sapiens
HTFLLTKVG

SEQ ID NO: 183065 - protein, 9 aa, Homo Sapiens
KLFLPNHTL

SEQ ID NO: 183066 - protein, 9 aa, Homo Sapiens
IKLHTGGKP

SEQ ID NO: 183067 - protein, 9 aa, Homo Sapiens
LHLLLPLLL

SEQ ID NO: 183068 - protein, 9 aa, Homo Sapiens
EPESWSSQT

SEQ ID NO: 183069 - protein, 9 aa, Homo Sapiens
SIRSYGEKF

SEQ ID NO: 183070 - protein, 9 aa, Homo Sapiens
FIKRGEFSG

SEQ ID NO: 183071 - protein, 9 aa, Homo Sapiens
PVLYVFMGR

SEQ ID NO: 183072 - protein, 9 aa, Homo Sapiens
IEKEKEKLW

SEQ ID NO: 183073 - protein, 9 aa, Homo Sapiens
EGNPFLTAN

SEQ ID NO: 183074 - protein, 9 aa, Homo Sapiens
TTRPSDFCG

SEQ ID NO: 183075 - protein, 9 aa, Homo Sapiens
NMCCNKSGF

SEQ ID NO: 183076 - protein, 9 aa, Homo Sapiens
LEQEEPRTV

SEQ ID NO: 183077 - protein, 9 aa, Homo Sapiens
ANGSWAACV

SEQ ID NO: 183078 - protein, 9 aa, Homo Sapiens
ALATKDTRK

SEQ ID NO: 183079 - protein, 9 aa, Homo Sapiens
IKYWELLNS

SEQ ID NO: 183080 - protein, 9 aa, Homo Sapiens
NICKDVVTA

SEQ ID NO: 183081 - protein, 9 aa, Homo Sapiens
ARYITQSGD

SEQ ID NO: 183082 - protein, 9 aa, Homo Sapiens
LLTKVGAAD

SEQ ID NO: 183083 - protein, 9 aa, Homo Sapiens
QNCEDAQAI

SEQ ID NO: 183084 - protein, 9 aa, Homo Sapiens
PGRLPPGPR

SEQ ID NO: 183085 - protein, 9 aa, Homo Sapiens
SLKARGQAL

SEQ ID NO: 183086 - protein, 9 aa, Homo Sapiens
SRKSSVCSA

SEQ ID NO: 183087 - protein, 9 aa, Homo Sapiens
MKKEPEPEP

SEQ ID NO: 183088 - protein, 9 aa, Homo Sapiens
ILADLMPKE

SEQ ID NO: 183089 - protein, 9 aa, Homo Sapiens
LGVVLGQSG

SEQ ID NO: 183090 - protein, 9 aa, Homo Sapiens
VGTPIADVQ

SEQ ID NO: 183091 - protein, 9 aa, Homo Sapiens
SQEALYWMM

SEQ ID NO: 183092 - protein, 9 aa, Homo Sapiens
KEVKKENGV

SEQ ID NO: 183093 - protein, 9 aa, Homo Sapiens
VDLSVNQLE

SEQ ID NO: 183094 - protein, 9 aa, Homo Sapiens
HPRSRPALL

SEQ ID NO: 183095 - protein, 9 aa, Homo Sapiens
DEHISLGQL

SEQ ID NO: 183096 - protein, 9 aa, Homo Sapiens
TARARSPAS

SEQ ID NO: 183097 - protein, 9 aa, Homo Sapiens
SLMFFGNQS

SEQ ID NO: 183098 - protein, 9 aa, Homo Sapiens
RNLLRLQSL

SEQ ID NO: 183099 - protein, 9 aa, Homo Sapiens
KLIQKSHGR

SEQ ID NO: 183100 - protein, 9 aa, Homo Sapiens
VLAGMGLHY

SEQ ID NO: 183101 - protein, 9 aa, Homo Sapiens
SSPTCSWPR

SEQ ID NO: 183102 - protein, 9 aa, Homo Sapiens
KHRDSFEAP

SEQ ID NO: 183103 - protein, 9 aa, Homo Sapiens
DTKRYSTVC

SEQ ID NO: 183104 - protein, 9 aa, Homo Sapiens
ELCAQRLHL

SEQ ID NO: 183105 - protein, 9 aa, Homo Sapiens
FLCVADFRK

SEQ ID NO: 183106 - protein, 9 aa, Homo Sapiens
VSLRKELGV

SEQ ID NO: 183107 - protein, 9 aa, Homo Sapiens
LCFFGMRVQ

SEQ ID NO: 183108 - protein, 9 aa, Homo Sapiens
NLLYYQYMN

SEQ ID NO: 183109 - protein, 9 aa, Homo Sapiens
DACGKSFST

SEQ ID NO: 183110 - protein, 9 aa, Homo Sapiens
LRSALLPRH

SEQ ID NO: 183111 - protein, 9 aa, Homo Sapiens
RVLAHHVID

SEQ ID NO: 183112 - protein, 9 aa, Homo Sapiens
GRSLHLEKM

SEQ ID NO: 183113 - protein, 9 aa, Homo Sapiens
AEGNGRPSC

SEQ ID NO: 183114 - protein, 9 aa, Homo Sapiens
SAWTSMHQT

SEQ ID NO: 183115 - protein, 9 aa, Homo Sapiens
SQPYSFIEF

SEQ ID NO: 183116 - protein, 9 aa, Homo Sapiens
PSCRITFVL

SEQ ID NO: 183117 - protein, 9 aa, Homo Sapiens
DAFLPHVEC

SEQ ID NO: 183118 - protein, 9 aa, Homo Sapiens
VIIVLSILV

SEQ ID NO: 183119 - protein, 9 aa, Homo Sapiens
CANLLILSH

SEQ ID NO: 183120 - protein, 9 aa, Homo Sapiens
RHCVVNGPQ

SEQ ID NO: 183121 - protein, 9 aa, Homo Sapiens
IHGVSLQQW

SEQ ID NO: 183122 - protein, 9 aa, Homo Sapiens
LTTQTLPST

SEQ ID NO: 183123 - protein, 9 aa, Homo Sapiens
GSGAGASCA

SEQ ID NO: 183124 - protein, 9 aa, Homo Sapiens
TTEQEQPRR

SEQ ID NO: 183125 - protein, 9 aa, Homo Sapiens
ENQVLLGHL

SEQ ID NO: 183126 - protein, 9 aa, Homo Sapiens
NPAHHYPQR

SEQ ID NO: 183127 - protein, 9 aa, Homo Sapiens
RTTNEQVMG

SEQ ID NO: 183128 - protein, 9 aa, Homo Sapiens
GVLSVGKPS

SEQ ID NO: 183129 - protein, 9 aa, Homo Sapiens
NFTVEAANY

SEQ ID NO: 183130 - protein, 9 aa, Homo Sapiens
TTCSFNSSL

SEQ ID NO: 183131 - protein, 9 aa, Homo Sapiens
LEVLLIDNS

SEQ ID NO: 183132 - protein, 9 aa, Homo Sapiens
LQLTNSDIN

SEQ ID NO: 183133 - protein, 9 aa, Homo Sapiens
RQTPELVLY

SEQ ID NO: 183134 - protein, 9 aa, Homo Sapiens
NLAAAVSAK

SEQ ID NO: 183135 - protein, 9 aa, Homo Sapiens
NILVTRGGT

SEQ ID NO: 183136 - protein, 9 aa, Homo Sapiens
QNLDGHIRE

SEQ ID NO: 183137 - protein, 9 aa, Homo Sapiens
ADTVSGTQG

SEQ ID NO: 183138 - protein, 9 aa, Homo Sapiens
SIVTAPGEG

SEQ ID NO: 183139 - protein, 9 aa, Homo Sapiens
VGLHLGLHL

SEQ ID NO: 183140 - protein, 9 aa, Homo Sapiens
QENGIRVIR

SEQ ID NO: 183141 - protein, 9 aa, Homo Sapiens
MVRRAANVS

SEQ ID NO: 183142 - protein, 9 aa, Homo Sapiens
YICYERNDS

SEQ ID NO: 183143 - protein, 9 aa, Homo Sapiens
DKKLPETDI

SEQ ID NO: 183144 - protein, 9 aa, Homo Sapiens
VLKQSQNYL

SEQ ID NO: 183145 - protein, 9 aa, Homo Sapiens
LSMDNNCSL

SEQ ID NO: 183146 - protein, 9 aa, Homo Sapiens
LLRSALLPR

SEQ ID NO: 183147 - protein, 9 aa, Homo Sapiens
GRGEEQNHG

SEQ ID NO: 183148 - protein, 9 aa, Homo Sapiens
ELQPQHEGP

SEQ ID NO: 183149 - protein, 9 aa, Homo Sapiens
QVTFSPGLE

SEQ ID NO: 183150 - protein, 9 aa, Homo Sapiens
LHWSYQVMR

SEQ ID NO: 183151 - protein, 9 aa, Homo Sapiens
APAATVSRA

SEQ ID NO: 183152 - protein, 9 aa, Homo Sapiens
HSCTHCWAC

SEQ ID NO: 183153 - protein, 9 aa, Homo Sapiens
RADVLVCLL

SEQ ID NO: 183154 - protein, 9 aa, Homo Sapiens
IKKNKFRGF

SEQ ID NO: 183155 - protein, 9 aa, Homo Sapiens
FQRKFWTAN

SEQ ID NO: 183156 - protein, 9 aa, Homo Sapiens
GATGTTPSG

SEQ ID NO: 183157 - protein, 9 aa, Homo Sapiens
CWLRKRLCN

SEQ ID NO: 183158 - protein, 9 aa, Homo Sapiens
TARTDWWCE

SEQ ID NO: 183159 - protein, 9 aa, Homo Sapiens
CLRIHCVAK

SEQ ID NO: 183160 - protein, 9 aa, Homo Sapiens
DVLEVPWTH

SEQ ID NO: 183161 - protein, 9 aa, Homo Sapiens
RAPSSCWAP

SEQ ID NO: 183162 - protein, 9 aa, Homo Sapiens
TVSLSTAWT

SEQ ID NO: 183163 - protein, 9 aa, Homo Sapiens
NLPPSSSGK

SEQ ID NO: 183164 - protein, 9 aa, Homo Sapiens
CYTCDCDLT

SEQ ID NO: 183165 - protein, 9 aa, Homo Sapiens
ECCSHCQNK

SEQ ID NO: 183166 - protein, 9 aa, Homo Sapiens
NVTRNRLKI

SEQ ID NO: 183167 - protein, 9 aa, Homo Sapiens
SPVVRRGFN

SEQ ID NO: 183168 - protein, 9 aa, Homo Sapiens
ARRVDADMP

SEQ ID NO: 183169 - protein, 9 aa, Homo Sapiens
SQIISELPF

SEQ ID NO: 183170 - protein, 9 aa, Homo Sapiens
GGVPEESKE

SEQ ID NO: 183171 - protein, 9 aa, Homo Sapiens
FISSEKNEA

SEQ ID NO: 183172 - protein, 9 aa, Homo Sapiens
PAGLGGWHG

SEQ ID NO: 183173 - protein, 9 aa, Homo Sapiens
GTHAKLPGP

SEQ ID NO: 183174 - protein, 9 aa, Homo Sapiens
ARASPTFIS

SEQ ID NO: 183175 - protein, 9 aa, Homo Sapiens
KEIDTKRYS

SEQ ID NO: 183176 - protein, 9 aa, Homo Sapiens
EANILFDGV

SEQ ID NO: 183177 - protein, 9 aa, Homo Sapiens
RCWESCQEV

SEQ ID NO: 183178 - protein, 9 aa, Homo Sapiens
PASPLKRDP

SEQ ID NO: 183179 - protein, 9 aa, Homo Sapiens
LARLPARAL

SEQ ID NO: 183180 - protein, 9 aa, Homo Sapiens
GAVSGSVRA

SEQ ID NO: 183181 - protein, 9 aa, Homo Sapiens
STWKGPEHL

SEQ ID NO: 183182 - protein, 9 aa, Homo Sapiens
EAVHADRMR

SEQ ID NO: 183183 - protein, 9 aa, Homo Sapiens
EKKAVEQRD

SEQ ID NO: 183184 - protein, 9 aa, Homo Sapiens
VDNLPPSSS

SEQ ID NO: 183185 - protein, 9 aa, Homo Sapiens
PENSHGPFP

SEQ ID NO: 183186 - protein, 9 aa, Homo Sapiens
IGQSKIFFQ

SEQ ID NO: 183187 - protein, 9 aa, Homo Sapiens
HGSLAHQNS

SEQ ID NO: 183188 - protein, 9 aa, Homo Sapiens
AATVSRAAA

SEQ ID NO: 183189 - protein, 9 aa, Homo Sapiens
KFVVILGDF

SEQ ID NO: 183190 - protein, 9 aa, Homo Sapiens
HGASRGPPA

SEQ ID NO: 183191 - protein, 9 aa, Homo Sapiens
VSLGEWMTQ

SEQ ID NO: 183192 - protein, 9 aa, Homo Sapiens
LKMESKQGT

SEQ ID NO: 183193 - protein, 9 aa, Homo Sapiens
MIKEGAVVI

SEQ ID NO: 183194 - protein, 9 aa, Homo Sapiens
SGKPTESSA

SEQ ID NO: 183195 - protein, 9 aa, Homo Sapiens
HICTDQLGL

SEQ ID NO: 183196 - protein, 9 aa, Homo Sapiens
KLQNASQDL

SEQ ID NO: 183197 - protein, 9 aa, Homo Sapiens
QEENQSLNS

SEQ ID NO: 183198 - protein, 9 aa, Homo Sapiens
PPASPLKRD

SEQ ID NO: 183199 - protein, 9 aa, Homo Sapiens
ARSSVPWSA

SEQ ID NO: 183200 - protein, 9 aa, Homo Sapiens
PIPLPSFVE

SEQ ID NO: 183201 - protein, 9 aa, Homo Sapiens
VLRKHRIIH

SEQ ID NO: 183202 - protein, 9 aa, Homo Sapiens
LHTTENKLL

SEQ ID NO: 183203 - protein, 9 aa, Homo Sapiens
GSGGRGHPD

SEQ ID NO: 183204 - protein, 9 aa, Homo Sapiens
ALRTARIEG

SEQ ID NO: 183205 - protein, 9 aa, Homo Sapiens
TPPAPAAVP

SEQ ID NO: 183206 - protein, 9 aa, Homo Sapiens
APEAQMHGE

SEQ ID NO: 183207 - protein, 9 aa, Homo Sapiens
VYFHTRCWE

SEQ ID NO: 183208 - protein, 9 aa, Homo Sapiens
AEVVRWKLG

SEQ ID NO: 183209 - protein, 9 aa, Homo Sapiens
AVVVDVGAG

SEQ ID NO: 183210 - protein, 9 aa, Homo Sapiens
MIAHPRQPV

SEQ ID NO: 183211 - protein, 9 aa, Homo Sapiens
LLGSPLLSG

SEQ ID NO: 183212 - protein, 9 aa, Homo Sapiens
SFQENVLPD

SEQ ID NO: 183213 - protein, 9 aa, Homo Sapiens
LHGSAYLTI

SEQ ID NO: 183214 - protein, 9 aa, Homo Sapiens
EPASGDGEE

SEQ ID NO: 183215 - protein, 9 aa, Homo Sapiens
EINEKIGPR

SEQ ID NO: 183216 - protein, 9 aa, Homo Sapiens
ASLEKSAKK

SEQ ID NO: 183217 - protein, 9 aa, Homo Sapiens
SKGISKKEV

SEQ ID NO: 183218 - protein, 9 aa, Homo Sapiens
QQISPPSTN

SEQ ID NO: 183219 - protein, 9 aa, Homo Sapiens
LQLVQLLAR

SEQ ID NO: 183220 - protein, 9 aa, Homo Sapiens
DQRLLLHHW

SEQ ID NO: 183221 - protein, 9 aa, Homo Sapiens
SRDSRSFFT

SEQ ID NO: 183222 - protein, 9 aa, Homo Sapiens
SNPAGPLRE

SEQ ID NO: 183223 - protein, 9 aa, Homo Sapiens
LGDLYGTIG

SEQ ID NO: 183224 - protein, 9 aa, Homo Sapiens
DYIEFANLD

SEQ ID NO: 183225 - protein, 9 aa, Homo Sapiens
ASAWTSMHQ

SEQ ID NO: 183226 - protein, 9 aa, Homo Sapiens
DSALHGRIS

SEQ ID NO: 183227 - protein, 9 aa, Homo Sapiens
SYVCRMCSQ

SEQ ID NO: 183228 - protein, 9 aa, Homo Sapiens
PLTIGEKTE

SEQ ID NO: 183229 - protein, 9 aa, Homo Sapiens
LKKEVWNVT

SEQ ID NO: 183230 - protein, 9 aa, Homo Sapiens
KSILRQEML

SEQ ID NO: 183231 - protein, 9 aa, Homo Sapiens
LKKSADTMW

SEQ ID NO: 183232 - protein, 9 aa, Homo Sapiens
IRGQKERRN

SEQ ID NO: 183233 - protein, 9 aa, Homo Sapiens
WQGPCRHAG

SEQ ID NO: 183234 - protein, 9 aa, Homo Sapiens
CHLALLFKD

SEQ ID NO: 183235 - protein, 9 aa, Homo Sapiens
GPTRATGWP

SEQ ID NO: 183236 - protein, 9 aa, Homo Sapiens
GLQHRQGRG

SEQ ID NO: 183237 - protein, 9 aa, Homo Sapiens
HCQNKGERW

SEQ ID NO: 183238 - protein, 9 aa, Homo Sapiens
PKGVPFSSK

SEQ ID NO: 183239 - protein, 9 aa, Homo Sapiens
VIETDFGLC

SEQ ID NO: 183240 - protein, 9 aa, Homo Sapiens
MWQLASLVE

SEQ ID NO: 183241 - protein, 9 aa, Homo Sapiens
STCARRKVS

SEQ ID NO: 183242 - protein, 9 aa, Homo Sapiens
GALFLLIQF

SEQ ID NO: 183243 - protein, 9 aa, Homo Sapiens
VKATGRSME

SEQ ID NO: 183244 - protein, 9 aa, Homo Sapiens
QGILGSTGC

SEQ ID NO: 183245 - protein, 9 aa, Homo Sapiens
ARMMSLGAL

SEQ ID NO: 183246 - protein, 9 aa, Homo Sapiens
ESCFQGHHE

SEQ ID NO: 183247 - protein, 9 aa, Homo Sapiens
VERYSCYTC

SEQ ID NO: 183248 - protein, 9 aa, Homo Sapiens
GQMRAQRVH

SEQ ID NO: 183249 - protein, 9 aa, Homo Sapiens
EEGEGVSLG

SEQ ID NO: 183250 - protein, 9 aa, Homo Sapiens
HPSRPCRMR

SEQ ID NO: 183251 - protein, 9 aa, Homo Sapiens
RRLLSLVMN

SEQ ID NO: 183252 - protein, 9 aa, Homo Sapiens
IQAEKAHEN

SEQ ID NO: 183253 - protein, 9 aa, Homo Sapiens
HGAVTKPRY

SEQ ID NO: 183254 - protein, 9 aa, Homo Sapiens
THTAAAPGL

SEQ ID NO: 183255 - protein, 9 aa, Homo Sapiens
STATEVAQE

SEQ ID NO: 183256 - protein, 9 aa, Homo Sapiens
HLMEKKINN

SEQ ID NO: 183257 - protein, 9 aa, Homo Sapiens
VFALRAKLL

SEQ ID NO: 183258 - protein, 9 aa, Homo Sapiens
SPPTQQPQT

SEQ ID NO: 183259 - protein, 9 aa, Homo Sapiens
SSPVVRRGF

SEQ ID NO: 183260 - protein, 9 aa, Homo Sapiens
CTTAPPTAT

SEQ ID NO: 183261 - protein, 9 aa, Homo Sapiens
RLLWQTLTT

SEQ ID NO: 183262 - protein, 9 aa, Homo Sapiens
RLPSQNVCL

SEQ ID NO: 183263 - protein, 9 aa, Homo Sapiens
PAEQKTGTP

SEQ ID NO: 183264 - protein, 9 aa, Homo Sapiens
QMTCRPNTC

SEQ ID NO: 183265 - protein, 9 aa, Homo Sapiens
FWSEAPTSK

SEQ ID NO: 183266 - protein, 9 aa, Homo Sapiens
GAPARMMSL

SEQ ID NO: 183267 - protein, 9 aa, Homo Sapiens
SSLQTHPRE

SEQ ID NO: 183268 - protein, 9 aa, Homo Sapiens
RCVRRSRFR

SEQ ID NO: 183269 - protein, 9 aa, Homo Sapiens
RNEKNPNPI

SEQ ID NO: 183270 - protein, 9 aa, Homo Sapiens
VVVGSGQRA

SEQ ID NO: 183271 - protein, 9 aa, Homo Sapiens
TWLWDLFHI

SEQ ID NO: 183272 - protein, 9 aa, Homo Sapiens
WMEFVSDGS

SEQ ID NO: 183273 - protein, 9 aa, Homo Sapiens
LEGAQRTLI

SEQ ID NO: 183274 - protein, 9 aa, Homo Sapiens
LKKASSPGH

SEQ ID NO: 183275 - protein, 9 aa, Homo Sapiens
PTEQVVEII

SEQ ID NO: 183276 - protein, 9 aa, Homo Sapiens
ASRGSSSSV

SEQ ID NO: 183277 - protein, 9 aa, Homo Sapiens
KKEGHWDCG

SEQ ID NO: 183278 - protein, 9 aa, Homo Sapiens
LKTPPKPWQ

SEQ ID NO: 183279 - protein, 9 aa, Homo Sapiens
IMALCNLDH

SEQ ID NO: 183280 - protein, 9 aa, Homo Sapiens
KSWKDKVAQ

SEQ ID NO: 183281 - protein, 9 aa, Homo Sapiens
FARRDNQFE

SEQ ID NO: 183282 - protein, 9 aa, Homo Sapiens
MEFAAICFR

SEQ ID NO: 183283 - protein, 9 aa, Homo Sapiens
YSTVCWRGS

SEQ ID NO: 183284 - protein, 9 aa, Homo Sapiens
VLPEMENQI

SEQ ID NO: 183285 - protein, 9 aa, Homo Sapiens
TDHPGLHRL

SEQ ID NO: 183286 - protein, 9 aa, Homo Sapiens
CTHAGQTLY

SEQ ID NO: 183287 - protein, 9 aa, Homo Sapiens
NTRATTHNA

SEQ ID NO: 183288 - protein, 9 aa, Homo Sapiens
PQRSVVQQD

SEQ ID NO: 183289 - protein, 9 aa, Homo Sapiens
RVRVGEAVV

SEQ ID NO: 183290 - protein, 9 aa, Homo Sapiens
QVKALIVVH

SEQ ID NO: 183291 - protein, 9 aa, Homo Sapiens
HMKNGPTRP

SEQ ID NO: 183292 - protein, 9 aa, Homo Sapiens
DEMQKFMED

SEQ ID NO: 183293 - protein, 9 aa, Homo Sapiens
DHHKDRHFA

SEQ ID NO: 183294 - protein, 9 aa, Homo Sapiens
GRKSKNNKS

SEQ ID NO: 183295 - protein, 9 aa, Homo Sapiens
ADRWGRQCD

SEQ ID NO: 183296 - protein, 9 aa, Homo Sapiens
PPVSWPRAS

SEQ ID NO: 183297 - protein, 9 aa, Homo Sapiens
MSACPPENC

SEQ ID NO: 183298 - protein, 9 aa, Homo Sapiens
TVQSQACPH

SEQ ID NO: 183299 - protein, 9 aa, Homo Sapiens
WHGIQEITR

SEQ ID NO: 183300 - protein, 9 aa, Homo Sapiens
PSRLSPPEA

SEQ ID NO: 183301 - protein, 9 aa, Homo Sapiens
DRVVALVDI

SEQ ID NO: 183302 - protein, 9 aa, Homo Sapiens
LAAAVSAKD

SEQ ID NO: 183303 - protein, 9 aa, Homo Sapiens
PTAKRTMRP

SEQ ID NO: 183304 - protein, 9 aa, Homo Sapiens
MQHKVDSEC

SEQ ID NO: 183305 - protein, 9 aa, Homo Sapiens
GADTVSGTQ

SEQ ID NO: 183306 - protein, 9 aa, Homo Sapiens
RQSYDIGIV

SEQ ID NO: 183307 - protein, 9 aa, Homo Sapiens
RRAPGETSP

SEQ ID NO: 183308 - protein, 9 aa, Homo Sapiens
MCPSVNLFS

SEQ ID NO: 183309 - protein, 9 aa, Homo Sapiens
AALPQATEL

SEQ ID NO: 183310 - protein, 9 aa, Homo Sapiens
KTSDSQPSN

SEQ ID NO: 183311 - protein, 9 aa, Homo Sapiens
SRRRMMNMS

SEQ ID NO: 183312 - protein, 9 aa, Homo Sapiens
ALEDDLTQT

SEQ ID NO: 183313 - protein, 9 aa, Homo Sapiens
SSSPSSAVA

SEQ ID NO: 183314 - protein, 9 aa, Homo Sapiens
QEACWSCLE

SEQ ID NO: 183315 - protein, 9 aa, Homo Sapiens
VSWTETKKT

SEQ ID NO: 183316 - protein, 9 aa, Homo Sapiens
SIIGPQLTV

SEQ ID NO: 183317 - protein, 9 aa, Homo Sapiens
HLAHGSPFR

SEQ ID NO: 183318 - protein, 9 aa, Homo Sapiens
IFHSSAQLA

SEQ ID NO: 183319 - protein, 9 aa, Homo Sapiens
GASSHTTTK

SEQ ID NO: 183320 - protein, 9 aa, Homo Sapiens
SAFWSEAPT

SEQ ID NO: 183321 - protein, 9 aa, Homo Sapiens
GPLEAENGE

SEQ ID NO: 183322 - protein, 9 aa, Homo Sapiens
PGAWGGAPL

SEQ ID NO: 183323 - protein, 9 aa, Homo Sapiens
ALERYLDPS

SEQ ID NO: 183324 - protein, 9 aa, Homo Sapiens
PQTPQDSRQ

SEQ ID NO: 183325 - protein, 9 aa, Homo Sapiens
SGTLGMSLT

SEQ ID NO: 183326 - protein, 9 aa, Homo Sapiens
LPSQGAPQW

SEQ ID NO: 183327 - protein, 9 aa, Homo Sapiens
LLPVAGDLT

SEQ ID NO: 183328 - protein, 9 aa, Homo Sapiens
AANFRRCCW

SEQ ID NO: 183329 - protein, 9 aa, Homo Sapiens
RCSLMEQIP

SEQ ID NO: 183330 - protein, 9 aa, Homo Sapiens
AKYEAFSDD

SEQ ID NO: 183331 - protein, 9 aa, Homo Sapiens
GRGNLGWWQ

SEQ ID NO: 183332 - protein, 9 aa, Homo Sapiens
TVAPTTSAR

SEQ ID NO: 183333 - protein, 9 aa, Homo Sapiens
PSTPPTTGL

SEQ ID NO: 183334 - protein, 9 aa, Homo Sapiens
RSRRRMMNM

SEQ ID NO: 183335 - protein, 9 aa, Homo Sapiens
TFSCQEGCQ

SEQ ID NO: 183336 - protein, 9 aa, Homo Sapiens
MEPLNNMCA

SEQ ID NO: 183337 - protein, 9 aa, Homo Sapiens
KDKVAQHEG

SEQ ID NO: 183338 - protein, 9 aa, Homo Sapiens
VGIMFFERA

SEQ ID NO: 183339 - protein, 9 aa, Homo Sapiens
VTTRLLHSP

SEQ ID NO: 183340 - protein, 9 aa, Homo Sapiens
SSKNGALFL

SEQ ID NO: 183341 - protein, 9 aa, Homo Sapiens
EGMDICLKI

SEQ ID NO: 183342 - protein, 9 aa, Homo Sapiens
TPPPTSGTT

SEQ ID NO: 183343 - protein, 9 aa, Homo Sapiens
YLDPSMTEW

SEQ ID NO: 183344 - protein, 9 aa, Homo Sapiens
MGGQAEHGG

SEQ ID NO: 183345 - protein, 9 aa, Homo Sapiens
GPRDTARGR

SEQ ID NO: 183346 - protein, 9 aa, Homo Sapiens
NVPENSHGP

SEQ ID NO: 183347 - protein, 9 aa, Homo Sapiens
PYKCPYCDY

SEQ ID NO: 183348 - protein, 9 aa, Homo Sapiens
KEDKHLSRR

SEQ ID NO: 183349 - protein, 9 aa, Homo Sapiens
QRVHMGARA

SEQ ID NO: 183350 - protein, 9 aa, Homo Sapiens
AGHGHICGC

SEQ ID NO: 183351 - protein, 9 aa, Homo Sapiens
QHEQQVART

SEQ ID NO: 183352 - protein, 9 aa, Homo Sapiens
YLLVIMYGA

SEQ ID NO: 183353 - protein, 9 aa, Homo Sapiens
VHRTWPFPE

SEQ ID NO: 183354 - protein, 9 aa, Homo Sapiens
AVSAKDIYY

SEQ ID NO: 183355 - protein, 9 aa, Homo Sapiens
KVKMSLLLS

SEQ ID NO: 183356 - protein, 9 aa, Homo Sapiens
LLLLLLARA

SEQ ID NO: 183357 - protein, 9 aa, Homo Sapiens
TKNKEVNAM

SEQ ID NO: 183358 - protein, 9 aa, Homo Sapiens
QQGQFIPSQ

SEQ ID NO: 183359 - protein, 9 aa, Homo Sapiens
ANPAHHYPQ

SEQ ID NO: 183360 - protein, 9 aa, Homo Sapiens
LIKPKNECD

SEQ ID NO: 183361 - protein, 9 aa, Homo Sapiens
VNMGGTGLF

SEQ ID NO: 183362 - protein, 9 aa, Homo Sapiens
GSWPPLLRP

SEQ ID NO: 183363 - protein, 9 aa, Homo Sapiens
QDYCEVCQR

SEQ ID NO: 183364 - protein, 9 aa, Homo Sapiens
VLRMPMHTI

SEQ ID NO: 183365 - protein, 9 aa, Homo Sapiens
DLTSLGLHG

SEQ ID NO: 183366 - protein, 9 aa, Homo Sapiens
WSSQTAAEL

SEQ ID NO: 183367 - protein, 9 aa, Homo Sapiens
AYATQLALC

SEQ ID NO: 183368 - protein, 9 aa, Homo Sapiens
EPQAIAVDP

SEQ ID NO: 183369 - protein, 9 aa, Homo Sapiens
QVPRLRHGL

SEQ ID NO: 183370 - protein, 9 aa, Homo Sapiens
QPVPCIMVQ

SEQ ID NO: 183371 - protein, 9 aa, Homo Sapiens
EGLSVNMLV

SEQ ID NO: 183372 - protein, 9 aa, Homo Sapiens
SPRPCGSPT

SEQ ID NO: 183373 - protein, 9 aa, Homo Sapiens
QYLFSRVLR

SEQ ID NO: 183374 - protein, 9 aa, Homo Sapiens
GASSSTSRD

SEQ ID NO: 183375 - protein, 9 aa, Homo Sapiens
APACSWKAS

SEQ ID NO: 183376 - protein, 9 aa, Homo Sapiens
TQRVLGSHL

SEQ ID NO: 183377 - protein, 9 aa, Homo Sapiens
SMTVTTART

SEQ ID NO: 183378 - protein, 9 aa, Homo Sapiens
GLPAGLGGW

SEQ ID NO: 183379 - protein, 9 aa, Homo Sapiens
AEQQISPPS

SEQ ID NO: 183380 - protein, 9 aa, Homo Sapiens
DRYLLLCHA

SEQ ID NO: 183381 - protein, 9 aa, Homo Sapiens
LLHFFSGFS

SEQ ID NO: 183382 - protein, 9 aa, Homo Sapiens
VTLRHHKYG

SEQ ID NO: 183383 - protein, 9 aa, Homo Sapiens
AAFMEVWVQ

SEQ ID NO: 183384 - protein, 9 aa, Homo Sapiens
KTLVFCSDK

SEQ ID NO: 183385 - protein, 9 aa, Homo Sapiens
KRLWKHQHV

SEQ ID NO: 183386 - protein, 9 aa, Homo Sapiens
AEDHVEMLY

SEQ ID NO: 183387 - protein, 9 aa, Homo Sapiens
WPCDISRQL

SEQ ID NO: 183388 - protein, 9 aa, Homo Sapiens
NPCPFPFSL

SEQ ID NO: 183389 - protein, 9 aa, Homo Sapiens
QILVTVKFL

SEQ ID NO: 183390 - protein, 9 aa, Homo Sapiens
SARVRRPST

SEQ ID NO: 183391 - protein, 9 aa, Homo Sapiens
VDSSDFDRL

SEQ ID NO: 183392 - protein, 9 aa, Homo Sapiens
PMGVLSVGK

SEQ ID NO: 183393 - protein, 9 aa, Homo Sapiens
IDFKIDSAI

SEQ ID NO: 183394 - protein, 9 aa, Homo Sapiens
APRAKSIRA

SEQ ID NO: 183395 - protein, 9 aa, Homo Sapiens
FPTVWESRN

SEQ ID NO: 183396 - protein, 9 aa, Homo Sapiens
LPIIPSASE

SEQ ID NO: 183397 - protein, 9 aa, Homo Sapiens
CAVMCCNVP

SEQ ID NO: 183398 - protein, 9 aa, Homo Sapiens
RTATTPRPG

SEQ ID NO: 183399 - protein, 9 aa, Homo Sapiens
HSGTLGMSL

SEQ ID NO: 183400 - protein, 9 aa, Homo Sapiens
PSVNLFSHG

SEQ ID NO: 183401 - protein, 9 aa, Homo Sapiens
DFGSLRYGL

SEQ ID NO: 183402 - protein, 9 aa, Homo Sapiens
MSTTGWLER

SEQ ID NO: 183403 - protein, 9 aa, Homo Sapiens
VLNLTYRFL

SEQ ID NO: 183404 - protein, 9 aa, Homo Sapiens
DDLTQTKAI

SEQ ID NO: 183405 - protein, 9 aa, Homo Sapiens
HRGIRSLRD

SEQ ID NO: 183406 - protein, 9 aa, Homo Sapiens
MVEEHELQK

SEQ ID NO: 183407 - protein, 9 aa, Homo Sapiens
MLEFEGGEV

SEQ ID NO: 183408 - protein, 9 aa, Homo Sapiens
ASSPVVHEG

SEQ ID NO: 183409 - protein, 9 aa, Homo Sapiens
PYGARNENQ

SEQ ID NO: 183410 - protein, 9 aa, Homo Sapiens
SAQRLQAQM

SEQ ID NO: 183411 - protein, 9 aa, Homo Sapiens
LNDGHFVPV

SEQ ID NO: 183412 - protein, 9 aa, Homo Sapiens
VSLSTAWTT

SEQ ID NO: 183413 - protein, 9 aa, Homo Sapiens
LYPVQGQQV

SEQ ID NO: 183414 - protein, 9 aa, Homo Sapiens
GSSPSTPPT

SEQ ID NO: 183415 - protein, 9 aa, Homo Sapiens
HIQAEKAHE

SEQ ID NO: 183416 - protein, 9 aa, Homo Sapiens
CLLFQVIPE

SEQ ID NO: 183417 - protein, 9 aa, Homo Sapiens
LMTTVVIST

SEQ ID NO: 183418 - protein, 9 aa, Homo Sapiens
PAPVIQVKA

SEQ ID NO: 183419 - protein, 9 aa, Homo Sapiens
SSPTMQHSC

SEQ ID NO: 183420 - protein, 9 aa, Homo Sapiens
SRWQGPCRH

SEQ ID NO: 183421 - protein, 9 aa, Homo Sapiens
AQGQLQAWD

SEQ ID NO: 183422 - protein, 9 aa, Homo Sapiens
QQERQQYQR

SEQ ID NO: 183423 - protein, 9 aa, Homo Sapiens
QLTDPTALL

SEQ ID NO: 183424 - protein, 9 aa, Homo Sapiens
VKEKAQALM

SEQ ID NO: 183425 - protein, 9 aa, Homo Sapiens
GSSFTRATS

SEQ ID NO: 183426 - protein, 9 aa, Homo Sapiens
YSICVMPLG

SEQ ID NO: 183427 - protein, 9 aa, Homo Sapiens
RPLKKWPTP

SEQ ID NO: 183428 - protein, 9 aa, Homo Sapiens
IRFVFAAAK

SEQ ID NO: 183429 - protein, 9 aa, Homo Sapiens
PAEVLEEHP

SEQ ID NO: 183430 - protein, 9 aa, Homo Sapiens
KSLSQEAVA

SEQ ID NO: 183431 - protein, 9 aa, Homo Sapiens
PREPTKMWH

SEQ ID NO: 183432 - protein, 9 aa, Homo Sapiens
RDTFHLLLL

SEQ ID NO: 183433 - protein, 9 aa, Homo Sapiens
HPRTVLSKI

SEQ ID NO: 183434 - protein, 9 aa, Homo Sapiens
RKPSSPRPC

SEQ ID NO: 183435 - protein, 9 aa, Homo Sapiens
AFYPNNHER

SEQ ID NO: 183436 - protein, 9 aa, Homo Sapiens
PCNICKDVV

SEQ ID NO: 183437 - protein, 9 aa, Homo Sapiens
TFVLEAPVQ

SEQ ID NO: 183438 - protein, 9 aa, Homo Sapiens
YFVVGGVPE

SEQ ID NO: 183439 - protein, 9 aa, Homo Sapiens
KKEGNLIQN

SEQ ID NO: 183440 - protein, 9 aa, Homo Sapiens
FRISPRSNT

SEQ ID NO: 183441 - protein, 9 aa, Homo Sapiens
SMPVRHMPV

SEQ ID NO: 183442 - protein, 9 aa, Homo Sapiens
LLQILAHLL

SEQ ID NO: 183443 - protein, 9 aa, Homo Sapiens
PLPFFLNLG

SEQ ID NO: 183444 - protein, 9 aa, Homo Sapiens
SIFLSTRCV

SEQ ID NO: 183445 - protein, 9 aa, Homo Sapiens
HGELLEAPS

SEQ ID NO: 183446 - protein, 9 aa, Homo Sapiens
EHELQKERI

SEQ ID NO: 183447 - protein, 9 aa, Homo Sapiens
CVLYRNCIY

SEQ ID NO: 183448 - protein, 9 aa, Homo Sapiens
GVNLLEVLL

SEQ ID NO: 183449 - protein, 9 aa, Homo Sapiens
KCVNKTGRD

SEQ ID NO: 183450 - protein, 9 aa, Homo Sapiens
DEPVKAKKT

SEQ ID NO: 183451 - protein, 9 aa, Homo Sapiens
SLNASGRTT

SEQ ID NO: 183452 - protein, 9 aa, Homo Sapiens
DDIAHVLWP

SEQ ID NO: 183453 - protein, 9 aa, Homo Sapiens
VDLLNRTWS

SEQ ID NO: 183454 - protein, 9 aa, Homo Sapiens
RRDNQFESP

SEQ ID NO: 183455 - protein, 9 aa, Homo Sapiens
TDVHVCSST

SEQ ID NO: 183456 - protein, 9 aa, Homo Sapiens
SSQHKQGND

SEQ ID NO: 183457 - protein, 9 aa, Homo Sapiens
DAQAIQNPQ

SEQ ID NO: 183458 - protein, 9 aa, Homo Sapiens
PRLPRAGGH

SEQ ID NO: 183459 - protein, 9 aa, Homo Sapiens
LEGNPFLTA

SEQ ID NO: 183460 - protein, 9 aa, Homo Sapiens
KEENLKLKP

SEQ ID NO: 183461 - protein, 9 aa, Homo Sapiens
FKKENIRPM

SEQ ID NO: 183462 - protein, 9 aa, Homo Sapiens
RGPPAPRPA

SEQ ID NO: 183463 - protein, 9 aa, Homo Sapiens
KKEMAHPNE

SEQ ID NO: 183464 - protein, 9 aa, Homo Sapiens
KKMTLKALV

SEQ ID NO: 183465 - protein, 9 aa, Homo Sapiens
VVILGDFIQ

SEQ ID NO: 183466 - protein, 9 aa, Homo Sapiens
EPLNNMCAK

SEQ ID NO: 183467 - protein, 9 aa, Homo Sapiens
KSTATEVAQ

SEQ ID NO: 183468 - protein, 9 aa, Homo Sapiens
EQLQLEDWV

SEQ ID NO: 183469 - protein, 9 aa, Homo Sapiens
KCKKNVFNP

SEQ ID NO: 183470 - protein, 9 aa, Homo Sapiens
NLQDSLQAI

SEQ ID NO: 183471 - protein, 9 aa, Homo Sapiens
YIHAQVASV

SEQ ID NO: 183472 - protein, 9 aa, Homo Sapiens
QPREPTKMW

SEQ ID NO: 183473 - protein, 9 aa, Homo Sapiens
QWHLFRTYK

SEQ ID NO: 183474 - protein, 9 aa, Homo Sapiens
GQDHSDGIC

SEQ ID NO: 183475 - protein, 9 aa, Homo Sapiens
WTVRGSCGW

SEQ ID NO: 183476 - protein, 9 aa, Homo Sapiens
ACTRWKQRG

SEQ ID NO: 183477 - protein, 9 aa, Homo Sapiens
KFLHDPVLL

SEQ ID NO: 183478 - protein, 9 aa, Homo Sapiens
WNLYRKEGL

SEQ ID NO: 183479 - protein, 9 aa, Homo Sapiens
RKLGATSAQ

SEQ ID NO: 183480 - protein, 9 aa, Homo Sapiens
RWSTISCPR

SEQ ID NO: 183481 - protein, 9 aa, Homo Sapiens
LCNDQCNQF

SEQ ID NO: 183482 - protein, 9 aa, Homo Sapiens
QDHSDGICL

SEQ ID NO: 183483 - protein, 9 aa, Homo Sapiens
QIIVNTVNQ

SEQ ID NO: 183484 - protein, 9 aa, Homo Sapiens
VSVEGVSHH

SEQ ID NO: 183485 - protein, 9 aa, Homo Sapiens
SGAHINPAM

SEQ ID NO: 183486 - protein, 9 aa, Homo Sapiens
EMRAGGCCH

SEQ ID NO: 183487 - protein, 9 aa, Homo Sapiens
PPPLILWPQ

SEQ ID NO: 183488 - protein, 9 aa, Homo Sapiens
NELAEVREG

SEQ ID NO: 183489 - protein, 9 aa, Homo Sapiens
FGTGTHAKL

SEQ ID NO: 183490 - protein, 9 aa, Homo Sapiens
AHLLAQWAQ

SEQ ID NO: 183491 - protein, 9 aa, Homo Sapiens
GGKPFKCHL

SEQ ID NO: 183492 - protein, 9 aa, Homo Sapiens
GWICWRSRW

SEQ ID NO: 183493 - protein, 9 aa, Homo Sapiens
GEYVVRWCY

SEQ ID NO: 183494 - protein, 9 aa, Homo Sapiens
RLQPEPESI

SEQ ID NO: 183495 - protein, 9 aa, Homo Sapiens
VLPDIFTEL

SEQ ID NO: 183496 - protein, 9 aa, Homo Sapiens
GQFIPSQPP

SEQ ID NO: 183497 - protein, 9 aa, Homo Sapiens
EGVSLGEWM

SEQ ID NO: 183498 - protein, 9 aa, Homo Sapiens
GWNIYVVDG

SEQ ID NO: 183499 - protein, 9 aa, Homo Sapiens
PVPCIMVQS

SEQ ID NO: 183500 - protein, 9 aa, Homo Sapiens
RGPLGGREK

SEQ ID NO: 183501 - protein, 9 aa, Homo Sapiens
APLRLWSWC

SEQ ID NO: 183502 - protein, 9 aa, Homo Sapiens
DTMARQLSR

SEQ ID NO: 183503 - protein, 9 aa, Homo Sapiens
GSEVGFNIV

SEQ ID NO: 183504 - protein, 9 aa, Homo Sapiens
YDEEYGGFT

SEQ ID NO: 183505 - protein, 9 aa, Homo Sapiens
LPTPLTLSQ

SEQ ID NO: 183506 - protein, 9 aa, Homo Sapiens
HHISFHSAE

SEQ ID NO: 183507 - protein, 9 aa, Homo Sapiens
STPFTCISW

SEQ ID NO: 183508 - protein, 9 aa, Homo Sapiens
NGKSYKITS

SEQ ID NO: 183509 - protein, 9 aa, Homo Sapiens
AGGHRPDLE

SEQ ID NO: 183510 - protein, 9 aa, Homo Sapiens
LKGIPMKKE

SEQ ID NO: 183511 - protein, 9 aa, Homo Sapiens
TIGKRLATT

SEQ ID NO: 183512 - protein, 9 aa, Homo Sapiens
KRVNTAWKT

SEQ ID NO: 183513 - protein, 9 aa, Homo Sapiens
RSPQAPLRL

SEQ ID NO: 183514 - protein, 9 aa, Homo Sapiens
CFLVEEKIK

SEQ ID NO: 183515 - protein, 9 aa, Homo Sapiens
AAQKCHKKT

SEQ ID NO: 183516 - protein, 9 aa, Homo Sapiens
WKPSTFGSE

SEQ ID NO: 183517 - protein, 9 aa, Homo Sapiens
EAELQVMIN

SEQ ID NO: 183518 - protein, 9 aa, Homo Sapiens
VPGQKGEKK

SEQ ID NO: 183519 - protein, 9 aa, Homo Sapiens
QEEQEGGWR

SEQ ID NO: 183520 - protein, 9 aa, Homo Sapiens
CLEQKVYFK

SEQ ID NO: 183521 - protein, 9 aa, Homo Sapiens
TFWEIRYMH

SEQ ID NO: 183522 - protein, 9 aa, Homo Sapiens
SWRACCPLP

SEQ ID NO: 183523 - protein, 9 aa, Homo Sapiens
QQLGDYRKL

SEQ ID NO: 183524 - protein, 9 aa, Homo Sapiens
GQNGVLSTP

SEQ ID NO: 183525 - protein, 9 aa, Homo Sapiens
KQPCQYFIG

SEQ ID NO: 183526 - protein, 9 aa, Homo Sapiens
TNWLKNAFV

SEQ ID NO: 183527 - protein, 9 aa, Homo Sapiens
QWKFWNCLS

SEQ ID NO: 183528 - protein, 9 aa, Homo Sapiens
STGAAASPT

SEQ ID NO: 183529 - protein, 9 aa, Homo Sapiens
LLSGARGRT

SEQ ID NO: 183530 - protein, 9 aa, Homo Sapiens
KKFFLCLKK

SEQ ID NO: 183531 - protein, 9 aa, Homo Sapiens
IRYMHFYFL

SEQ ID NO: 183532 - protein, 9 aa, Homo Sapiens
QKQLATIQI

SEQ ID NO: 183533 - protein, 9 aa, Homo Sapiens
PASDGQPRW

SEQ ID NO: 183534 - protein, 9 aa, Homo Sapiens
SDPEDEGKI

SEQ ID NO: 183535 - protein, 9 aa, Homo Sapiens
NGHHTILVS

SEQ ID NO: 183536 - protein, 9 aa, Homo Sapiens
PHIDGRENC

SEQ ID NO: 183537 - protein, 9 aa, Homo Sapiens
NVDVLPAPV

SEQ ID NO: 183538 - protein, 9 aa, Homo Sapiens
DHTPHYSEQ

SEQ ID NO: 183539 - protein, 9 aa, Homo Sapiens
LPQATELGA

SEQ ID NO: 183540 - protein, 9 aa, Homo Sapiens
HFAAESIII

SEQ ID NO: 183541 - protein, 9 aa, Homo Sapiens
PQPLTQGPR

SEQ ID NO: 183542 - protein, 9 aa, Homo Sapiens
QTGPGSCPP

SEQ ID NO: 183543 - protein, 9 aa, Homo Sapiens
EDFEFGKIL

SEQ ID NO: 183544 - protein, 9 aa, Homo Sapiens
VEMLYPVQG

SEQ ID NO: 183545 - protein, 9 aa, Homo Sapiens
RYRDTKGPF

SEQ ID NO: 183546 - protein, 9 aa, Homo Sapiens
VDDVIKMID

SEQ ID NO: 183547 - protein, 9 aa, Homo Sapiens
YTMSACPPE

SEQ ID NO: 183548 - protein, 9 aa, Homo Sapiens
DPHPWRSGD

SEQ ID NO: 183549 - protein, 9 aa, Homo Sapiens
EGEEGLGQL

SEQ ID NO: 183550 - protein, 9 aa, Homo Sapiens
SSDMVPVAE

SEQ ID NO: 183551 - protein, 9 aa, Homo Sapiens
ALMDEESRK

SEQ ID NO: 183552 - protein, 9 aa, Homo Sapiens
EVKKENGVK

SEQ ID NO: 183553 - protein, 9 aa, Homo Sapiens
CPPPQRTVP

SEQ ID NO: 183554 - protein, 9 aa, Homo Sapiens
PSHHHPLTV

SEQ ID NO: 183555 - protein, 9 aa, Homo Sapiens
LVDIDCFFV

SEQ ID NO: 183556 - protein, 9 aa, Homo Sapiens
SCLAALDMT

SEQ ID NO: 183557 - protein, 9 aa, Homo Sapiens
HMVFSSCAK

SEQ ID NO: 183558 - protein, 9 aa, Homo Sapiens
VIDGLHDVK

SEQ ID NO: 183559 - protein, 9 aa, Homo Sapiens
VVDVGAGRG

SEQ ID NO: 183560 - protein, 9 aa, Homo Sapiens
YKNKLIFLE

SEQ ID NO: 183561 - protein, 9 aa, Homo Sapiens
CRPKKRTVL

SEQ ID NO: 183562 - protein, 9 aa, Homo Sapiens
MEFVSDGSI

SEQ ID NO: 183563 - protein, 9 aa, Homo Sapiens
EQPPSMCVG

SEQ ID NO: 183564 - protein, 9 aa, Homo Sapiens
YIMSTTGWL

SEQ ID NO: 183565 - protein, 9 aa, Homo Sapiens
LHRAAWCGK

SEQ ID NO: 183566 - protein, 9 aa, Homo Sapiens
VITSFRILA

SEQ ID NO: 183567 - protein, 9 aa, Homo Sapiens
CKPSSSTSG

SEQ ID NO: 183568 - protein, 9 aa, Homo Sapiens
KPVAASTHM

SEQ ID NO: 183569 - protein, 9 aa, Homo Sapiens
AGEQGPGGP

SEQ ID NO: 183570 - protein, 9 aa, Homo Sapiens
SVYVMPTVA

SEQ ID NO: 183571 - protein, 9 aa, Homo Sapiens
TGDSIRSYG

SEQ ID NO: 183572 - protein, 9 aa, Homo Sapiens
CSGAIMALC

SEQ ID NO: 183573 - protein, 9 aa, Homo Sapiens
PRSRPALLR

SEQ ID NO: 183574 - protein, 9 aa, Homo Sapiens
TKKTKIQTS

SEQ ID NO: 183575 - protein, 9 aa, Homo Sapiens
EVAQEEAKP

SEQ ID NO: 183576 - protein, 9 aa, Homo Sapiens
DLTKATKKT

SEQ ID NO: 183577 - protein, 9 aa, Homo Sapiens
PMEILTLTP

SEQ ID NO: 183578 - protein, 9 aa, Homo Sapiens
MIIPWREHK

SEQ ID NO: 183579 - protein, 9 aa, Homo Sapiens
TRAPQSGSP

SEQ ID NO: 183580 - protein, 9 aa, Homo Sapiens
SEDLPQAVI

SEQ ID NO: 183581 - protein, 9 aa, Homo Sapiens
NSAGTFVLE

SEQ ID NO: 183582 - protein, 9 aa, Homo Sapiens
TPHYSEQET

SEQ ID NO: 183583 - protein, 9 aa, Homo Sapiens
LRKRLCNLS

SEQ ID NO: 183584 - protein, 9 aa, Homo Sapiens
VTTSTHRPA

SEQ ID NO: 183585 - protein, 9 aa, Homo Sapiens
RIMPSNACF

SEQ ID NO: 183586 - protein, 9 aa, Homo Sapiens
PELKHVVTE

SEQ ID NO: 183587 - protein, 9 aa, Homo Sapiens
MKNGPTRPP

SEQ ID NO: 183588 - protein, 9 aa, Homo Sapiens
AKKEDKHLS

SEQ ID NO: 183589 - protein, 9 aa, Homo Sapiens
DPGPPFPPD

SEQ ID NO: 183590 - protein, 9 aa, Homo Sapiens
SPVPRLPRA

SEQ ID NO: 183591 - protein, 9 aa, Homo Sapiens
RKETRPQLD

SEQ ID NO: 183592 - protein, 9 aa, Homo Sapiens
FSFFPASAV

SEQ ID NO: 183593 - protein, 9 aa, Homo Sapiens
MENSKVVGV

SEQ ID NO: 183594 - protein, 9 aa, Homo Sapiens
VVCPRPRSC

SEQ ID NO: 183595 - protein, 9 aa, Homo Sapiens
LQKLFLPNH

SEQ ID NO: 183596 - protein, 9 aa, Homo Sapiens
ILLQQLWRG

SEQ ID NO: 183597 - protein, 9 aa, Homo Sapiens
VVVLLISGS

SEQ ID NO: 183598 - protein, 9 aa, Homo Sapiens
KNKEVNAMA

SEQ ID NO: 183599 - protein, 9 aa, Homo Sapiens
YHPLDVEEW

SEQ ID NO: 183600 - protein, 9 aa, Homo Sapiens
NHCFKAYHY

SEQ ID NO: 183601 - protein, 9 aa, Homo Sapiens
ENVLPDIFT

SEQ ID NO: 183602 - protein, 9 aa, Homo Sapiens
TGVVEGGLN

SEQ ID NO: 183603 - protein, 9 aa, Homo Sapiens
GWFGTRVTN

SEQ ID NO: 183604 - protein, 9 aa, Homo Sapiens
YNFICAHPL

SEQ ID NO: 183605 - protein, 9 aa, Homo Sapiens
LIKKNKFRG

SEQ ID NO: 183606 - protein, 9 aa, Homo Sapiens
HKDRHFAYG

SEQ ID NO: 183607 - protein, 9 aa, Homo Sapiens
SNPFCVLFT

SEQ ID NO: 183608 - protein, 9 aa, Homo Sapiens
AVLAQAGRA

SEQ ID NO: 183609 - protein, 9 aa, Homo Sapiens
IRPRGRYIS

SEQ ID NO: 183610 - protein, 9 aa, Homo Sapiens
GSLFSLSIL

SEQ ID NO: 183611 - protein, 9 aa, Homo Sapiens
HYETDHTTG

SEQ ID NO: 183612 - protein, 9 aa, Homo Sapiens
TLTPEWTHQ

SEQ ID NO: 183613 - protein, 9 aa, Homo Sapiens
PTEKQQYLD

SEQ ID NO: 183614 - protein, 9 aa, Homo Sapiens
HLLPSMCCE

SEQ ID NO: 183615 - protein, 9 aa, Homo Sapiens
SEEPIYIIT

SEQ ID NO: 183616 - protein, 9 aa, Homo Sapiens
HKKAGDFVP

SEQ ID NO: 183617 - protein, 9 aa, Homo Sapiens
VETEKLQLT

SEQ ID NO: 183618 - protein, 9 aa, Homo Sapiens
NKKTHPCTM

SEQ ID NO: 183619 - protein, 9 aa, Homo Sapiens
RHVPSASFF

SEQ ID NO: 183620 - protein, 9 aa, Homo Sapiens
GRQCDAHSA

SEQ ID NO: 183621 - protein, 9 aa, Homo Sapiens
SPRKVPVVV

SEQ ID NO: 183622 - protein, 9 aa, Homo Sapiens
NNQIIVNTV

SEQ ID NO: 183623 - protein, 9 aa, Homo Sapiens
WELLNSMKH

SEQ ID NO: 183624 - protein, 9 aa, Homo Sapiens
RYLLLCHAQ

SEQ ID NO: 183625 - protein, 9 aa, Homo Sapiens
GAIMALCNL

SEQ ID NO: 183626 - protein, 9 aa, Homo Sapiens
TVRCFFFNH

SEQ ID NO: 183627 - protein, 9 aa, Homo Sapiens
APGPWEKMP

SEQ ID NO: 183628 - protein, 9 aa, Homo Sapiens
LSYWRASVS

SEQ ID NO: 183629 - protein, 9 aa, Homo Sapiens
VGEAVVVDV

SEQ ID NO: 183630 - protein, 9 aa, Homo Sapiens
DEDEPTVAP

SEQ ID NO: 183631 - protein, 9 aa, Homo Sapiens
SQDLLGETL

SEQ ID NO: 183632 - protein, 9 aa, Homo Sapiens
CVNKTGRDA

SEQ ID NO: 183633 - protein, 9 aa, Homo Sapiens
KVRVPKRRM

SEQ ID NO: 183634 - protein, 9 aa, Homo Sapiens
PRLESAFSE

SEQ ID NO: 183635 - protein, 9 aa, Homo Sapiens
GQAEHGGPL

SEQ ID NO: 183636 - protein, 9 aa, Homo Sapiens
SPWGEHSSS

SEQ ID NO: 183637 - protein, 9 aa, Homo Sapiens
TPTVPLNPP

SEQ ID NO: 183638 - protein, 9 aa, Homo Sapiens
LDKSSEMGI

SEQ ID NO: 183639 - protein, 9 aa, Homo Sapiens
VTFSPGLEL

SEQ ID NO: 183640 - protein, 9 aa, Homo Sapiens
ASVSVQFVQ

SEQ ID NO: 183641 - protein, 9 aa, Homo Sapiens
AQMHGELLE

SEQ ID NO: 183642 - protein, 9 aa, Homo Sapiens
AGLLGPFSF

SEQ ID NO: 183643 - protein, 9 aa, Homo Sapiens
SSPAPSSGI

SEQ ID NO: 183644 - protein, 9 aa, Homo Sapiens
DMIAHPRQP

SEQ ID NO: 183645 - protein, 9 aa, Homo Sapiens
MLKCRHMRG

SEQ ID NO: 183646 - protein, 9 aa, Homo Sapiens
QGRARCGVL

SEQ ID NO: 183647 - protein, 9 aa, Homo Sapiens
GHVNHGFVV

SEQ ID NO: 183648 - protein, 9 aa, Homo Sapiens
LFSRVLRRG

SEQ ID NO: 183649 - protein, 9 aa, Homo Sapiens
VCLTLCLLS

SEQ ID NO: 183650 - protein, 9 aa, Homo Sapiens
DNGFFLRFI

SEQ ID NO: 183651 - protein, 9 aa, Homo Sapiens
WAPASSPTC

SEQ ID NO: 183652 - protein, 9 aa, Homo Sapiens
LNLCAGPSW

SEQ ID NO: 183653 - protein, 9 aa, Homo Sapiens
FGGPDAQLE

SEQ ID NO: 183654 - protein, 9 aa, Homo Sapiens
QPQCAVCIG

SEQ ID NO: 183655 - protein, 9 aa, Homo Sapiens
DGILALYGG

SEQ ID NO: 183656 - protein, 9 aa, Homo Sapiens
AAPAATVSR

SEQ ID NO: 183657 - protein, 9 aa, Homo Sapiens
SDGTWLRLV

SEQ ID NO: 183658 - protein, 9 aa, Homo Sapiens
KRVILYFYI

SEQ ID NO: 183659 - protein, 9 aa, Homo Sapiens
EFAAICFRN

SEQ ID NO: 183660 - protein, 9 aa, Homo Sapiens
HVLAKVAGD

SEQ ID NO: 183661 - protein, 9 aa, Homo Sapiens
MMTNKATKQ

SEQ ID NO: 183662 - protein, 9 aa, Homo Sapiens
PPEGEKLHG

SEQ ID NO: 183663 - protein, 9 aa, Homo Sapiens
TRRPYDSAQ

SEQ ID NO: 183664 - protein, 9 aa, Homo Sapiens
SYDIGIVAQ

SEQ ID NO: 183665 - protein, 9 aa, Homo Sapiens
GLDLVSAED

SEQ ID NO: 183666 - protein, 9 aa, Homo Sapiens
QVPRARRCD

SEQ ID NO: 183667 - protein, 9 aa, Homo Sapiens
STTPTVPLN

SEQ ID NO: 183668 - protein, 9 aa, Homo Sapiens
QSTCARRKV

SEQ ID NO: 183669 - protein, 9 aa, Homo Sapiens
AATARAPAC

SEQ ID NO: 183670 - protein, 9 aa, Homo Sapiens
KKAKIKKKT

SEQ ID NO: 183671 - protein, 9 aa, Homo Sapiens
QLTMNDSKH

SEQ ID NO: 183672 - protein, 9 aa, Homo Sapiens
DSKHKLESP

SEQ ID NO: 183673 - protein, 9 aa, Homo Sapiens
ILDLLTPFQ

SEQ ID NO: 183674 - protein, 9 aa, Homo Sapiens
PRSNTIFPN

SEQ ID NO: 183675 - protein, 9 aa, Homo Sapiens
EQDALEAVF

SEQ ID NO: 183676 - protein, 9 aa, Homo Sapiens
MTCRPNTCN

SEQ ID NO: 183677 - protein, 9 aa, Homo Sapiens
PRVTPPPTS

SEQ ID NO: 183678 - protein, 9 aa, Homo Sapiens
SDKKLPETD

SEQ ID NO: 183679 - protein, 9 aa, Homo Sapiens
GVSLQQWHL

SEQ ID NO: 183680 - protein, 9 aa, Homo Sapiens
NPFLTANDN

SEQ ID NO: 183681 - protein, 9 aa, Homo Sapiens
PTIGESQAL

SEQ ID NO: 183682 - protein, 9 aa, Homo Sapiens
FMILYFFYY

SEQ ID NO: 183683 - protein, 9 aa, Homo Sapiens
LYGKKLVKI

SEQ ID NO: 183684 - protein, 9 aa, Homo Sapiens
NYERQPREP

SEQ ID NO: 183685 - protein, 9 aa, Homo Sapiens
ARYGVQTLD

SEQ ID NO: 183686 - protein, 9 aa, Homo Sapiens
DNPLDHVLA

SEQ ID NO: 183687 - protein, 9 aa, Homo Sapiens
PRDRRPPRL

SEQ ID NO: 183688 - protein, 9 aa, Homo Sapiens
LYYQYMNPA

SEQ ID NO: 183689 - protein, 9 aa, Homo Sapiens
KVGLSSRMQ

SEQ ID NO: 183690 - protein, 9 aa, Homo Sapiens
SENVDVGNP

SEQ ID NO: 183691 - protein, 9 aa, Homo Sapiens
MSMGLSLAS

SEQ ID NO: 183692 - protein, 9 aa, Homo Sapiens
WMMQRSKMS

SEQ ID NO: 183693 - protein, 9 aa, Homo Sapiens
FSLSILSLE

SEQ ID NO: 183694 - protein, 9 aa, Homo Sapiens
QRLRHCVVN

SEQ ID NO: 183695 - protein, 9 aa, Homo Sapiens
VETEKKTQW

SEQ ID NO: 183696 - protein, 9 aa, Homo Sapiens
RSMEQFQVS

SEQ ID NO: 183697 - protein, 9 aa, Homo Sapiens
TWLRLVDLQ

SEQ ID NO: 183698 - protein, 9 aa, Homo Sapiens
MREMEENFT

SEQ ID NO: 183699 - protein, 9 aa, Homo Sapiens
FEERSAEER

SEQ ID NO: 183700 - protein, 9 aa, Homo Sapiens
KISLPRHRR

SEQ ID NO: 183701 - protein, 9 aa, Homo Sapiens
QIVGTMDSS

SEQ ID NO: 183702 - protein, 9 aa, Homo Sapiens
KTKDCDYID

SEQ ID NO: 183703 - protein, 9 aa, Homo Sapiens
FALRAKLLL

SEQ ID NO: 183704 - protein, 9 aa, Homo Sapiens
RVRVSTRAG

SEQ ID NO: 183705 - protein, 9 aa, Homo Sapiens
QESQTRRGI

SEQ ID NO: 183706 - protein, 9 aa, Homo Sapiens
LPLPRPPMP

SEQ ID NO: 183707 - protein, 9 aa, Homo Sapiens
NHPSTAQSH

SEQ ID NO: 183708 - protein, 9 aa, Homo Sapiens
RCLTRAPQS

SEQ ID NO: 183709 - protein, 9 aa, Homo Sapiens
LLSWRAAGV

SEQ ID NO: 183710 - protein, 9 aa, Homo Sapiens
VSQTSLSIR

SEQ ID NO: 183711 - protein, 9 aa, Homo Sapiens
WAWRLHARS

SEQ ID NO: 183712 - protein, 9 aa, Homo Sapiens
GTWLRLVDL

SEQ ID NO: 183713 - protein, 9 aa, Homo Sapiens
ARIEGPAPP

SEQ ID NO: 183714 - protein, 9 aa, Homo Sapiens
VYEINEKIG

SEQ ID NO: 183715 - protein, 9 aa, Homo Sapiens
SAQLADTSE

SEQ ID NO: 183716 - protein, 9 aa, Homo Sapiens
TTNHSPPTT

SEQ ID NO: 183717 - protein, 9 aa, Homo Sapiens
NSSIRAALR

SEQ ID NO: 183718 - protein, 9 aa, Homo Sapiens
PRPPMPRPG

SEQ ID NO: 183719 - protein, 9 aa, Homo Sapiens
KRKCVLKSK

SEQ ID NO: 183720 - protein, 9 aa, Homo Sapiens
ARTRSTPPA

SEQ ID NO: 183721 - protein, 9 aa, Homo Sapiens
ENALDQAEQ

SEQ ID NO: 183722 - protein, 9 aa, Homo Sapiens
RLLLHHWAK

SEQ ID NO: 183723 - protein, 9 aa, Homo Sapiens
QEPIKDDLM

SEQ ID NO: 183724 - protein, 9 aa, Homo Sapiens
DPSQCPSME

SEQ ID NO: 183725 - protein, 9 aa, Homo Sapiens
TCIQPHGQK

SEQ ID NO: 183726 - protein, 9 aa, Homo Sapiens
YYFVVGGVP

SEQ ID NO: 183727 - protein, 9 aa, Homo Sapiens
EDEPTVAPT

SEQ ID NO: 183728 - protein, 9 aa, Homo Sapiens
ATEFLSLRE

SEQ ID NO: 183729 - protein, 9 aa, Homo Sapiens
CRALFYPAR

SEQ ID NO: 183730 - protein, 9 aa, Homo Sapiens
QFVQLCQQG

SEQ ID NO: 183731 - protein, 9 aa, Homo Sapiens
WTETKKTIF

SEQ ID NO: 183732 - protein, 9 aa, Homo Sapiens
AFMEVWVQS

SEQ ID NO: 183733 - protein, 9 aa, Homo Sapiens
LNPCPFPFS

SEQ ID NO: 183734 - protein, 9 aa, Homo Sapiens
VTVKFLHDP

SEQ ID NO: 183735 - protein, 9 aa, Homo Sapiens
FSARYGVQT

SEQ ID NO: 183736 - protein, 9 aa, Homo Sapiens
LGEGSPRQG

SEQ ID NO: 183737 - protein, 9 aa, Homo Sapiens
PGKKCGIII

SEQ ID NO: 183738 - protein, 9 aa, Homo Sapiens
QVFHVRLRQ

SEQ ID NO: 183739 - protein, 9 aa, Homo Sapiens
HSFEVGVWS

SEQ ID NO: 183740 - protein, 9 aa, Homo Sapiens
TPRPTSPSP

SEQ ID NO: 183741 - protein, 9 aa, Homo Sapiens
ASCANLLIL

SEQ ID NO: 183742 - protein, 9 aa, Homo Sapiens
STPLPLVTT

SEQ ID NO: 183743 - protein, 9 aa, Homo Sapiens
RAGPRDTAR

SEQ ID NO: 183744 - protein, 9 aa, Homo Sapiens
HCVPEGPAH

SEQ ID NO: 183745 - protein, 9 aa, Homo Sapiens
TVGKVVVTI

SEQ ID NO: 183746 - protein, 9 aa, Homo Sapiens
PSQPPTLPW

SEQ ID NO: 183747 - protein, 9 aa, Homo Sapiens
ISLVMSYAL

SEQ ID NO: 183748 - protein, 9 aa, Homo Sapiens
GICLVRNEP

SEQ ID NO: 183749 - protein, 9 aa, Homo Sapiens
LREITKLES

SEQ ID NO: 183750 - protein, 9 aa, Homo Sapiens
WLRLVDLQV

SEQ ID NO: 183751 - protein, 9 aa, Homo Sapiens
HIREHDSYQ

SEQ ID NO: 183752 - protein, 9 aa, Homo Sapiens
LSAIVNGKS

SEQ ID NO: 183753 - protein, 9 aa, Homo Sapiens
RAAVCTTAP

SEQ ID NO: 183754 - protein, 9 aa, Homo Sapiens
RAGRIIPKP

SEQ ID NO: 183755 - protein, 9 aa, Homo Sapiens
PRQTPELVL

SEQ ID NO: 183756 - protein, 9 aa, Homo Sapiens
RCDDPSKAL

SEQ ID NO: 183757 - protein, 9 aa, Homo Sapiens
GPVIMLKCR

SEQ ID NO: 183758 - protein, 9 aa, Homo Sapiens
DYYFLHHTC

SEQ ID NO: 183759 - protein, 9 aa, Homo Sapiens
GVWSIGCIM

SEQ ID NO: 183760 - protein, 9 aa, Homo Sapiens
EPTKMWHQS

SEQ ID NO: 183761 - protein, 9 aa, Homo Sapiens
ILGSTGCSL

SEQ ID NO: 183762 - protein, 9 aa, Homo Sapiens
LRRAGQASA

SEQ ID NO: 183763 - protein, 9 aa, Homo Sapiens
LQKQLWAHG

SEQ ID NO: 183764 - protein, 9 aa, Homo Sapiens
LRRCPLSFG

SEQ ID NO: 183765 - protein, 9 aa, Homo Sapiens
HFPDTSHSL

SEQ ID NO: 183766 - protein, 9 aa, Homo Sapiens
LCNLDHLGS

SEQ ID NO: 183767 - protein, 9 aa, Homo Sapiens
MKCLANWSN

SEQ ID NO: 183768 - protein, 9 aa, Homo Sapiens
LFNLRDISN

SEQ ID NO: 183769 - protein, 9 aa, Homo Sapiens
QFKFIVHAV

SEQ ID NO: 183770 - protein, 9 aa, Homo Sapiens
TANYERQPR

SEQ ID NO: 183771 - protein, 9 aa, Homo Sapiens
LIFLEGMDI

SEQ ID NO: 183772 - protein, 9 aa, Homo Sapiens
SHGPFPQQL

SEQ ID NO: 183773 - protein, 9 aa, Homo Sapiens
QKGEKKAVE

SEQ ID NO: 183774 - protein, 9 aa, Homo Sapiens
LRVADYYFL

SEQ ID NO: 183775 - protein, 9 aa, Homo Sapiens
ALGGERDKA

SEQ ID NO: 183776 - protein, 9 aa, Homo Sapiens
EHCFHHSTT

SEQ ID NO: 183777 - protein, 9 aa, Homo Sapiens
RQSSLFITE

SEQ ID NO: 183778 - protein, 9 aa, Homo Sapiens
PVPGGPSDS

SEQ ID NO: 183779 - protein, 9 aa, Homo Sapiens
AAAIRWLWA

SEQ ID NO: 183780 - protein, 9 aa, Homo Sapiens
GKEPTIDET

SEQ ID NO: 183781 - protein, 9 aa, Homo Sapiens
SAQLGPGAS

SEQ ID NO: 183782 - protein, 9 aa, Homo Sapiens
SFLLLLLLH

SEQ ID NO: 183783 - protein, 9 aa, Homo Sapiens
QGHIQAEKA

SEQ ID NO: 183784 - protein, 9 aa, Homo Sapiens
SCKRVILYF

SEQ ID NO: 183785 - protein, 9 aa, Homo Sapiens
ERRLHQAAF

SEQ ID NO: 183786 - protein, 9 aa, Homo Sapiens
ETDSDLLAG

SEQ ID NO: 183787 - protein, 9 aa, Homo Sapiens
NTQHLLTLL

SEQ ID NO: 183788 - protein, 9 aa, Homo Sapiens
PVIYSSPKN

SEQ ID NO: 183789 - protein, 9 aa, Homo Sapiens
QALAQLVAV

SEQ ID NO: 183790 - protein, 9 aa, Homo Sapiens
ANVPFFQSP

SEQ ID NO: 183791 - protein, 9 aa, Homo Sapiens
LHAKVTILQ

SEQ ID NO: 183792 - protein, 9 aa, Homo Sapiens
RAPQSGSPA

SEQ ID NO: 183793 - protein, 9 aa, Homo Sapiens
FLKMESKQG

SEQ ID NO: 183794 - protein, 9 aa, Homo Sapiens
LEGMDICLK

SEQ ID NO: 183795 - protein, 9 aa, Homo Sapiens
CTRWKQRGR

SEQ ID NO: 183796 - protein, 9 aa, Homo Sapiens
QGGEEPRGA

SEQ ID NO: 183797 - protein, 9 aa, Homo Sapiens
ATYSICVMP

SEQ ID NO: 183798 - protein, 9 aa, Homo Sapiens
ASPEDGLST

SEQ ID NO: 183799 - protein, 9 aa, Homo Sapiens
GIMFFERAF

SEQ ID NO: 183800 - protein, 9 aa, Homo Sapiens
DALHTTENK

SEQ ID NO: 183801 - protein, 9 aa, Homo Sapiens
LLLGVCGHL

SEQ ID NO: 183802 - protein, 9 aa, Homo Sapiens
AAGSPCAKA

SEQ ID NO: 183803 - protein, 9 aa, Homo Sapiens
DQWNWLDFT

SEQ ID NO: 183804 - protein, 9 aa, Homo Sapiens
CWAPTTRPL

SEQ ID NO: 183805 - protein, 9 aa, Homo Sapiens
KLHRAAWCG

SEQ ID NO: 183806 - protein, 9 aa, Homo Sapiens
QTESQIISE

SEQ ID NO: 183807 - protein, 9 aa, Homo Sapiens
CRMNCKKLI

SEQ ID NO: 183808 - protein, 9 aa, Homo Sapiens
MFGTLPRKG

SEQ ID NO: 183809 - protein, 9 aa, Homo Sapiens
ATGTTPSGS

SEQ ID NO: 183810 - protein, 9 aa, Homo Sapiens
LIQKSHGRK

SEQ ID NO: 183811 - protein, 9 aa, Homo Sapiens
FQVIPELLG

SEQ ID NO: 183812 - protein, 9 aa, Homo Sapiens
PLRLWSWCG

SEQ ID NO: 183813 - protein, 9 aa, Homo Sapiens
HYLHNFQGK

SEQ ID NO: 183814 - protein, 9 aa, Homo Sapiens
AIKETGNVA

SEQ ID NO: 183815 - protein, 9 aa, Homo Sapiens
GYCKFLSST

SEQ ID NO: 183816 - protein, 9 aa, Homo Sapiens
DFVLSVLGD

SEQ ID NO: 183817 - protein, 9 aa, Homo Sapiens
NFPKKNYKV

SEQ ID NO: 183818 - protein, 9 aa, Homo Sapiens
HQIFGSFLL

SEQ ID NO: 183819 - protein, 9 aa, Homo Sapiens
HQEVTTRLL

SEQ ID NO: 183820 - protein, 9 aa, Homo Sapiens
RRTPPAPAA

SEQ ID NO: 183821 - protein, 9 aa, Homo Sapiens
LDWRAVNQQ

SEQ ID NO: 183822 - protein, 9 aa, Homo Sapiens
IVNTVNQKK

SEQ ID NO: 183823 - protein, 9 aa, Homo Sapiens
LARALLELC

SEQ ID NO: 183824 - protein, 9 aa, Homo Sapiens
LTGGKMCWF

SEQ ID NO: 183825 - protein, 9 aa, Homo Sapiens
ECPSYHLKF

SEQ ID NO: 183826 - protein, 9 aa, Homo Sapiens
KKVPTVSQP

SEQ ID NO: 183827 - protein, 9 aa, Homo Sapiens
VFSSCAKVG

SEQ ID NO: 183828 - protein, 9 aa, Homo Sapiens
KKCPLLLVY

SEQ ID NO: 183829 - protein, 9 aa, Homo Sapiens
LRGNWWRKS

SEQ ID NO: 183830 - protein, 9 aa, Homo Sapiens
EAQRKLHES

SEQ ID NO: 183831 - protein, 9 aa, Homo Sapiens
AKCEWINSH

SEQ ID NO: 183832 - protein, 9 aa, Homo Sapiens
SPSQGILGS

SEQ ID NO: 183833 - protein, 9 aa, Homo Sapiens
KNGFFRDIT

SEQ ID NO: 183834 - protein, 9 aa, Homo Sapiens
HNSEEKKFH

SEQ ID NO: 183835 - protein, 9 aa, Homo Sapiens
WKLVRGDIF

SEQ ID NO: 183836 - protein, 9 aa, Homo Sapiens
MGGPDTVPH

SEQ ID NO: 183837 - protein, 9 aa, Homo Sapiens
DMVPVAEVV

SEQ ID NO: 183838 - protein, 9 aa, Homo Sapiens
QDGLRTHDL

SEQ ID NO: 183839 - protein, 9 aa, Homo Sapiens
VLIAAHCSG

SEQ ID NO: 183840 - protein, 9 aa, Homo Sapiens
LTIIVGIMF

SEQ ID NO: 183841 - protein, 9 aa, Homo Sapiens
SRDATTRPS

SEQ ID NO: 183842 - protein, 9 aa, Homo Sapiens
CASLCARVQ

SEQ ID NO: 183843 - protein, 9 aa, Homo Sapiens
KVPPLLEGA

SEQ ID NO: 183844 - protein, 9 aa, Homo Sapiens
RLKRGINHA

SEQ ID NO: 183845 - protein, 9 aa, Homo Sapiens
KIPKKALWR

SEQ ID NO: 183846 - protein, 9 aa, Homo Sapiens
ITSRDRMTS

SEQ ID NO: 183847 - protein, 9 aa, Homo Sapiens
SKIFFQTGV

SEQ ID NO: 183848 - protein, 9 aa, Homo Sapiens
PESRALGPV

SEQ ID NO: 183849 - protein, 9 aa, Homo Sapiens
HAGNKSIKD

SEQ ID NO: 183850 - protein, 9 aa, Homo Sapiens
VLGQSGAAV

SEQ ID NO: 183851 - protein, 9 aa, Homo Sapiens
QNGFNKKCK

SEQ ID NO: 183852 - protein, 9 aa, Homo Sapiens
MLESFNVPG

SEQ ID NO: 183853 - protein, 9 aa, Homo Sapiens
HYSEQETEP

SEQ ID NO: 183854 - protein, 9 aa, Homo Sapiens
DEIYQWMVY

SEQ ID NO: 183855 - protein, 9 aa, Homo Sapiens
GCPLRGHSP

SEQ ID NO: 183856 - protein, 9 aa, Homo Sapiens
DKPITDQQL

SEQ ID NO: 183857 - protein, 9 aa, Homo Sapiens
LFGQALGGE

SEQ ID NO: 183858 - protein, 9 aa, Homo Sapiens
LAPPHCVPE

SEQ ID NO: 183859 - protein, 9 aa, Homo Sapiens
MFVCAQLPN

SEQ ID NO: 183860 - protein, 9 aa, Homo Sapiens
RIHCVAKDP

SEQ ID NO: 183861 - protein, 9 aa, Homo Sapiens
RQRVLEEER

SEQ ID NO: 183862 - protein, 9 aa, Homo Sapiens
LQENGIRVI

SEQ ID NO: 183863 - protein, 9 aa, Homo Sapiens
LSLFPSTHL

SEQ ID NO: 183864 - protein, 9 aa, Homo Sapiens
SPQMISILA

SEQ ID NO: 183865 - protein, 9 aa, Homo Sapiens
PQSVVVGSG

SEQ ID NO: 183866 - protein, 9 aa, Homo Sapiens
APVLICRFK

SEQ ID NO: 183867 - protein, 9 aa, Homo Sapiens
CHPRSRPAL

SEQ ID NO: 183868 - protein, 9 aa, Homo Sapiens
PLSSPKGVP

SEQ ID NO: 183869 - protein, 9 aa, Homo Sapiens
LEDDLTQTK

SEQ ID NO: 183870 - protein, 9 aa, Homo Sapiens
LPYFWDNVC

SEQ ID NO: 183871 - protein, 9 aa, Homo Sapiens
QHLAVRRKL

SEQ ID NO: 183872 - protein, 9 aa, Homo Sapiens
FARCQGFTS

SEQ ID NO: 183873 - protein, 9 aa, Homo Sapiens
LKKQREHCF

SEQ ID NO: 183874 - protein, 9 aa, Homo Sapiens
PCRALFYPA

SEQ ID NO: 183875 - protein, 9 aa, Homo Sapiens
PQWPLSTFS

SEQ ID NO: 183876 - protein, 9 aa, Homo Sapiens
IMVGVKGIE

SEQ ID NO: 183877 - protein, 9 aa, Homo Sapiens
HYPQRSVVQ

SEQ ID NO: 183878 - protein, 9 aa, Homo Sapiens
ENGIRVIRT

SEQ ID NO: 183879 - protein, 9 aa, Homo Sapiens
ASMTVTTAR

SEQ ID NO: 183880 - protein, 9 aa, Homo Sapiens
ISPRSNTIF

SEQ ID NO: 183881 - protein, 9 aa, Homo Sapiens
PSDPLEPVV

SEQ ID NO: 183882 - protein, 9 aa, Homo Sapiens
KNKFRGFSV

SEQ ID NO: 183883 - protein, 9 aa, Homo Sapiens
VHRLWLAAL

SEQ ID NO: 183884 - protein, 9 aa, Homo Sapiens
FQEAAKCEW

SEQ ID NO: 183885 - protein, 9 aa, Homo Sapiens
WLPVVLWII

SEQ ID NO: 183886 - protein, 9 aa, Homo Sapiens
EQKTSLKWQ

SEQ ID NO: 183887 - protein, 9 aa, Homo Sapiens
KEERRCDDP

SEQ ID NO: 183888 - protein, 9 aa, Homo Sapiens
IVETEKLQL

SEQ ID NO: 183889 - protein, 9 aa, Homo Sapiens
LLLLWAWRL

SEQ ID NO: 183890 - protein, 9 aa, Homo Sapiens
KSGIGAGVS

SEQ ID NO: 183891 - protein, 9 aa, Homo Sapiens
IDVWWIMHD

SEQ ID NO: 183892 - protein, 9 aa, Homo Sapiens
ELVFALRAK

SEQ ID NO: 183893 - protein, 9 aa, Homo Sapiens
IADVQAVDK

SEQ ID NO: 183894 - protein, 9 aa, Homo Sapiens
WAAPASPSR

SEQ ID NO: 183895 - protein, 9 aa, Homo Sapiens
RPSSMLPRR

SEQ ID NO: 183896 - protein, 9 aa, Homo Sapiens
AYGRLWRPT

SEQ ID NO: 183897 - protein, 9 aa, Homo Sapiens
RSSPTLTSS

SEQ ID NO: 183898 - protein, 9 aa, Homo Sapiens
EGVDGTDIN

SEQ ID NO: 183899 - protein, 9 aa, Homo Sapiens
PAKALTEDI

SEQ ID NO: 183900 - protein, 9 aa, Homo Sapiens
PEEGEGVSL

SEQ ID NO: 183901 - protein, 9 aa, Homo Sapiens
QKHANVPFF

SEQ ID NO: 183902 - protein, 9 aa, Homo Sapiens
KTWTQFRNY

SEQ ID NO: 183903 - protein, 9 aa, Homo Sapiens
EEEEEKKRL

SEQ ID NO: 183904 - protein, 9 aa, Homo Sapiens
DCFWEGAKI

SEQ ID NO: 183905 - protein, 9 aa, Homo Sapiens
AREFGLLLQ

SEQ ID NO: 183906 - protein, 9 aa, Homo Sapiens
SWGRWCWWG

SEQ ID NO: 183907 - protein, 9 aa, Homo Sapiens
NGVLSTPAV

SEQ ID NO: 183908 - protein, 9 aa, Homo Sapiens
LDLLTPFQS

SEQ ID NO: 183909 - protein, 9 aa, Homo Sapiens
HAAVGAVGA

SEQ ID NO: 183910 - protein, 9 aa, Homo Sapiens
FLSRHLAEY

SEQ ID NO: 183911 - protein, 9 aa, Homo Sapiens
PLQPNMDFM

SEQ ID NO: 183912 - protein, 9 aa, Homo Sapiens
RKQEPIKDD

SEQ ID NO: 183913 - protein, 9 aa, Homo Sapiens
QFHPFLCVA

SEQ ID NO: 183914 - protein, 9 aa, Homo Sapiens
WATSLPRPP

SEQ ID NO: 183915 - protein, 9 aa, Homo Sapiens
ASDVDSSDF

SEQ ID NO: 183916 - protein, 9 aa, Homo Sapiens
RQFPQCLQS

SEQ ID NO: 183917 - protein, 9 aa, Homo Sapiens
GAEKVMAHV

SEQ ID NO: 183918 - protein, 9 aa, Homo Sapiens
DQQRDPIKC

SEQ ID NO: 183919 - protein, 9 aa, Homo Sapiens
ALYEIGASS

SEQ ID NO: 183920 - protein, 9 aa, Homo Sapiens
IREHDSYQV

SEQ ID NO: 183921 - protein, 9 aa, Homo Sapiens
QERSFLDLM

SEQ ID NO: 183922 - protein, 9 aa, Homo Sapiens
LLGKKLLSE

SEQ ID NO: 183923 - protein, 9 aa, Homo Sapiens
RAEGNSHFT

SEQ ID NO: 183924 - protein, 9 aa, Homo Sapiens
GPRGPESRA

SEQ ID NO: 183925 - protein, 9 aa, Homo Sapiens
KEGIFHSSA

SEQ ID NO: 183926 - protein, 9 aa, Homo Sapiens
CSLMEQIPH

SEQ ID NO: 183927 - protein, 9 aa, Homo Sapiens
KGLTLELAG

SEQ ID NO: 183928 - protein, 9 aa, Homo Sapiens
GVEDNPMVV

SEQ ID NO: 183929 - protein, 9 aa, Homo Sapiens
SSSGATGTT

SEQ ID NO: 183930 - protein, 9 aa, Homo Sapiens
GYQPPNLAS

SEQ ID NO: 183931 - protein, 9 aa, Homo Sapiens
CFRNIFSNM

SEQ ID NO: 183932 - protein, 9 aa, Homo Sapiens
VPAPRLESA

SEQ ID NO: 183933 - protein, 9 aa, Homo Sapiens
AQLKTGRQR

SEQ ID NO: 183934 - protein, 9 aa, Homo Sapiens
WSHLATETR

SEQ ID NO: 183935 - protein, 9 aa, Homo Sapiens
RVQQMIGQV

SEQ ID NO: 183936 - protein, 9 aa, Homo Sapiens
FRNIFSNMF

SEQ ID NO: 183937 - protein, 9 aa, Homo Sapiens
LDCAHQVHL

SEQ ID NO: 183938 - protein, 9 aa, Homo Sapiens
MIPALKTIL

SEQ ID NO: 183939 - protein, 9 aa, Homo Sapiens
RLRHCVVNG

SEQ ID NO: 183940 - protein, 9 aa, Homo Sapiens
WGEHSSSST

SEQ ID NO: 183941 - protein, 9 aa, Homo Sapiens
NEWCPFVEL

SEQ ID NO: 183942 - protein, 9 aa, Homo Sapiens
REAIQVFHV

SEQ ID NO: 183943 - protein, 9 aa, Homo Sapiens
RDSRDMWDS

SEQ ID NO: 183944 - protein, 9 aa, Homo Sapiens
LKKRRRRRI

SEQ ID NO: 183945 - protein, 9 aa, Homo Sapiens
NKKEGNLIQ

SEQ ID NO: 183946 - protein, 9 aa, Homo Sapiens
RDTARGRPA

SEQ ID NO: 183947 - protein, 9 aa, Homo Sapiens
RESCFQGHH

SEQ ID NO: 183948 - protein, 9 aa, Homo Sapiens
SSRKSSVCS

SEQ ID NO: 183949 - protein, 9 aa, Homo Sapiens
FPSPLPDDS

SEQ ID NO: 183950 - protein, 9 aa, Homo Sapiens
IYVVDGRDV

SEQ ID NO: 183951 - protein, 9 aa, Homo Sapiens
EDFTFLRDQ

SEQ ID NO: 183952 - protein, 9 aa, Homo Sapiens
EHILVFSRT

SEQ ID NO: 183953 - protein, 9 aa, Homo Sapiens
CLTLCLLSW

SEQ ID NO: 183954 - protein, 9 aa, Homo Sapiens
LLISGSLPF

SEQ ID NO: 183955 - protein, 9 aa, Homo Sapiens
GQALGGERD

SEQ ID NO: 183956 - protein, 9 aa, Homo Sapiens
RWRRRAIAA

SEQ ID NO: 183957 - protein, 9 aa, Homo Sapiens
NIAFYPNNH

SEQ ID NO: 183958 - protein, 9 aa, Homo Sapiens
RYMHFYFLN

SEQ ID NO: 183959 - protein, 9 aa, Homo Sapiens
ARTHQHTPY

SEQ ID NO: 183960 - protein, 9 aa, Homo Sapiens
RNLSCRGAS

SEQ ID NO: 183961 - protein, 9 aa, Homo Sapiens
EVSQRALLH

SEQ ID NO: 183962 - protein, 9 aa, Homo Sapiens
VEYDHHPRA

SEQ ID NO: 183963 - protein, 9 aa, Homo Sapiens
DRRLSARVR

SEQ ID NO: 183964 - protein, 9 aa, Homo Sapiens
PSARRQSSL

SEQ ID NO: 183965 - protein, 9 aa, Homo Sapiens
HPRWESQVR

SEQ ID NO: 183966 - protein, 9 aa, Homo Sapiens
SGRRVKSAS

SEQ ID NO: 183967 - protein, 9 aa, Homo Sapiens
EEFWQQERS

SEQ ID NO: 183968 - protein, 9 aa, Homo Sapiens
FFSGFSFFP

SEQ ID NO: 183969 - protein, 9 aa, Homo Sapiens
LLWPRWAQD

SEQ ID NO: 183970 - protein, 9 aa, Homo Sapiens
ITPDPYPKD

SEQ ID NO: 183971 - protein, 9 aa, Homo Sapiens
RWCYDKQVN

SEQ ID NO: 183972 - protein, 9 aa, Homo Sapiens
RAPPPSSPP

SEQ ID NO: 183973 - protein, 9 aa, Homo Sapiens
HTSMYFQCC

SEQ ID NO: 183974 - protein, 9 aa, Homo Sapiens
SPLRLTLWP

SEQ ID NO: 183975 - protein, 9 aa, Homo Sapiens
DISNVFQGM

SEQ ID NO: 183976 - protein, 9 aa, Homo Sapiens
AAKEHHCQT

SEQ ID NO: 183977 - protein, 9 aa, Homo Sapiens
CDLTKATKK

SEQ ID NO: 183978 - protein, 9 aa, Homo Sapiens
STVCWRGST

SEQ ID NO: 183979 - protein, 9 aa, Homo Sapiens
VALDNSVYM

SEQ ID NO: 183980 - protein, 9 aa, Homo Sapiens
LEDGKVPQH

SEQ ID NO: 183981 - protein, 9 aa, Homo Sapiens
TRAVLAQAG

SEQ ID NO: 183982 - protein, 9 aa, Homo Sapiens
VRWKLGTHY

SEQ ID NO: 183983 - protein, 9 aa, Homo Sapiens
LLPTTGVRT

SEQ ID NO: 183984 - protein, 9 aa, Homo Sapiens
DCKEVKEKA

SEQ ID NO: 183985 - protein, 9 aa, Homo Sapiens
EAFTKVKMS

SEQ ID NO: 183986 - protein, 9 aa, Homo Sapiens
NGYCKFLSS

SEQ ID NO: 183987 - protein, 9 aa, Homo Sapiens
AAEPGLDAT

SEQ ID NO: 183988 - protein, 9 aa, Homo Sapiens
YDSAQLGPG

SEQ ID NO: 183989 - protein, 9 aa, Homo Sapiens
LAEIMLESF

SEQ ID NO: 183990 - protein, 9 aa, Homo Sapiens
CTHCWACTV

SEQ ID NO: 183991 - protein, 9 aa, Homo Sapiens
PVGPPPCLS

SEQ ID NO: 183992 - protein, 9 aa, Homo Sapiens
LTSLGLHGL

SEQ ID NO: 183993 - protein, 9 aa, Homo Sapiens
PGTFTYLTT

SEQ ID NO: 183994 - protein, 9 aa, Homo Sapiens
RPRVHVPWR

SEQ ID NO: 183995 - protein, 9 aa, Homo Sapiens
HLFGIQVIQ

SEQ ID NO: 183996 - protein, 9 aa, Homo Sapiens
CKKTETVEE

SEQ ID NO: 183997 - protein, 9 aa, Homo Sapiens
HIGNTHLKY

SEQ ID NO: 183998 - protein, 9 aa, Homo Sapiens
VLQLDGRNE

SEQ ID NO: 183999 - protein, 9 aa, Homo Sapiens
VNTVNQKKA

SEQ ID NO: 184000 - protein, 9 aa, Homo Sapiens
PTSPSPWAA

SEQ ID NO: 184001 - protein, 9 aa, Homo Sapiens
SLLSLRFRL

SEQ ID NO: 184002 - protein, 9 aa, Homo Sapiens
CQLCQQSPG

SEQ ID NO: 184003 - protein, 9 aa, Homo Sapiens
PEEMRRLDL

SEQ ID NO: 184004 - protein, 9 aa, Homo Sapiens
RGFSVQLVR

SEQ ID NO: 184005 - protein, 9 aa, Homo Sapiens
RALGPVSLH

SEQ ID NO: 184006 - protein, 9 aa, Homo Sapiens
LRLVDLQVP

SEQ ID NO: 184007 - protein, 9 aa, Homo Sapiens
RSVVPGFQY

SEQ ID NO: 184008 - protein, 9 aa, Homo Sapiens
LLGSLNPCP

SEQ ID NO: 184009 - protein, 9 aa, Homo Sapiens
VTACPWATS

SEQ ID NO: 184010 - protein, 9 aa, Homo Sapiens
SHTTTKSMA

SEQ ID NO: 184011 - protein, 9 aa, Homo Sapiens
ARGRPAART

SEQ ID NO: 184012 - protein, 9 aa, Homo Sapiens
YKKSVSRPE

SEQ ID NO: 184013 - protein, 9 aa, Homo Sapiens
GSPSARRQS

SEQ ID NO: 184014 - protein, 9 aa, Homo Sapiens
SLSARTASE

SEQ ID NO: 184015 - protein, 9 aa, Homo Sapiens
ILVTRGGTV

SEQ ID NO: 184016 - protein, 9 aa, Homo Sapiens
YLERHVPSA

SEQ ID NO: 184017 - protein, 9 aa, Homo Sapiens
RYWAKGEKP

SEQ ID NO: 184018 - protein, 9 aa, Homo Sapiens
GLMVIELQS

SEQ ID NO: 184019 - protein, 9 aa, Homo Sapiens
HLLAVELHL

SEQ ID NO: 184020 - protein, 9 aa, Homo Sapiens
ETVEEQLLC

SEQ ID NO: 184021 - protein, 9 aa, Homo Sapiens
TFNDASPPS

SEQ ID NO: 184022 - protein, 9 aa, Homo Sapiens
ATRTPESTQ

SEQ ID NO: 184023 - protein, 9 aa, Homo Sapiens
NHARALVRE

SEQ ID NO: 184024 - protein, 9 aa, Homo Sapiens
YAALMDEES

SEQ ID NO: 184025 - protein, 9 aa, Homo Sapiens
LLISGKLLL

SEQ ID NO: 184026 - protein, 9 aa, Homo Sapiens
GATSAQNIE

SEQ ID NO: 184027 - protein, 9 aa, Homo Sapiens
ALFLLIQFW

SEQ ID NO: 184028 - protein, 9 aa, Homo Sapiens
THRYSSSQV

SEQ ID NO: 184029 - protein, 9 aa, Homo Sapiens
KLCRKDLEI

SEQ ID NO: 184030 - protein, 9 aa, Homo Sapiens
FAYLLVIMY

SEQ ID NO: 184031 - protein, 9 aa, Homo Sapiens
TDPTALLSS

SEQ ID NO: 184032 - protein, 9 aa, Homo Sapiens
VKSLPCNIC

SEQ ID NO: 184033 - protein, 9 aa, Homo Sapiens
INDNPPLSR

SEQ ID NO: 184034 - protein, 9 aa, Homo Sapiens
WPWQDNRTR

SEQ ID NO: 184035 - protein, 9 aa, Homo Sapiens
TLQRSMAVC

SEQ ID NO: 184036 - protein, 9 aa, Homo Sapiens
VKALKKASS

SEQ ID NO: 184037 - protein, 9 aa, Homo Sapiens
TADYAVGFN

SEQ ID NO: 184038 - protein, 9 aa, Homo Sapiens
LPTTGVRTR

SEQ ID NO: 184039 - protein, 9 aa, Homo Sapiens
RREELLKKC

SEQ ID NO: 184040 - protein, 9 aa, Homo Sapiens
EWGKTEPVA

SEQ ID NO: 184041 - protein, 9 aa, Homo Sapiens
CRFKEREEN

SEQ ID NO: 184042 - protein, 9 aa, Homo Sapiens
TNQCFRNIF

SEQ ID NO: 184043 - protein, 9 aa, Homo Sapiens
RPRLLWQTL

SEQ ID NO: 184044 - protein, 9 aa, Homo Sapiens
KPKNECDLT

SEQ ID NO: 184045 - protein, 9 aa, Homo Sapiens
EPLGPETAL

SEQ ID NO: 184046 - protein, 9 aa, Homo Sapiens
IQNRSPTPS

SEQ ID NO: 184047 - protein, 9 aa, Homo Sapiens
PTDHPGLHR

SEQ ID NO: 184048 - protein, 9 aa, Homo Sapiens
SCGWWAPAC

SEQ ID NO: 184049 - protein, 9 aa, Homo Sapiens
PSGEQIPGL

SEQ ID NO: 184050 - protein, 9 aa, Homo Sapiens
RKLLNHGKK

SEQ ID NO: 184051 - protein, 9 aa, Homo Sapiens
MLSPCHLAH

SEQ ID NO: 184052 - protein, 9 aa, Homo Sapiens
LQLHNKKEG

SEQ ID NO: 184053 - protein, 9 aa, Homo Sapiens
APTTSARME

SEQ ID NO: 184054 - protein, 9 aa, Homo Sapiens
GSTSCGDSD

SEQ ID NO: 184055 - protein, 9 aa, Homo Sapiens
YRALEMDFS

SEQ ID NO: 184056 - protein, 9 aa, Homo Sapiens
LENTVPAAS

SEQ ID NO: 184057 - protein, 9 aa, Homo Sapiens
PSSSGATGT

SEQ ID NO: 184058 - protein, 9 aa, Homo Sapiens
QNFTTNNTS

SEQ ID NO: 184059 - protein, 9 aa, Homo Sapiens
ADRRLSARV

SEQ ID NO: 184060 - protein, 9 aa, Homo Sapiens
TFPVPSFLP

SEQ ID NO: 184061 - protein, 9 aa, Homo Sapiens
HRVLQGKAI

SEQ ID NO: 184062 - protein, 9 aa, Homo Sapiens
VRGTSPSQG

SEQ ID NO: 184063 - protein, 9 aa, Homo Sapiens
LCVAYDLVY

SEQ ID NO: 184064 - protein, 9 aa, Homo Sapiens
AVKCKSSEN

SEQ ID NO: 184065 - protein, 9 aa, Homo Sapiens
LGNARHRLS

SEQ ID NO: 184066 - protein, 9 aa, Homo Sapiens
MPRMRQLQS

SEQ ID NO: 184067 - protein, 9 aa, Homo Sapiens
VPENEAAVT

SEQ ID NO: 184068 - protein, 9 aa, Homo Sapiens
HTPYRENKN

SEQ ID NO: 184069 - protein, 9 aa, Homo Sapiens
PLPDDSKVP

SEQ ID NO: 184070 - protein, 9 aa, Homo Sapiens
PEQVPRARR

SEQ ID NO: 184071 - protein, 9 aa, Homo Sapiens
NPFCVLFTE

SEQ ID NO: 184072 - protein, 9 aa, Homo Sapiens
PRPASDGQP

SEQ ID NO: 184073 - protein, 9 aa, Homo Sapiens
VVFWMTSGL

SEQ ID NO: 184074 - protein, 9 aa, Homo Sapiens
DKWDKTTMK

SEQ ID NO: 184075 - protein, 9 aa, Homo Sapiens
RLVDLQVPR

SEQ ID NO: 184076 - protein, 9 aa, Homo Sapiens
FCRRLDSII

SEQ ID NO: 184077 - protein, 9 aa, Homo Sapiens
LGISTPEEP

SEQ ID NO: 184078 - protein, 9 aa, Homo Sapiens
RQEGVKKAA

SEQ ID NO: 184079 - protein, 9 aa, Homo Sapiens
EEDDDDDDG

SEQ ID NO: 184080 - protein, 9 aa, Homo Sapiens
SGQRAHQVT

SEQ ID NO: 184081 - protein, 9 aa, Homo Sapiens
VAGDLTSLG

SEQ ID NO: 184082 - protein, 9 aa, Homo Sapiens
PNSSPCPLP

SEQ ID NO: 184083 - protein, 9 aa, Homo Sapiens
PGRPRWRDY

SEQ ID NO: 184084 - protein, 9 aa, Homo Sapiens
QENMCCNKS

SEQ ID NO: 184085 - protein, 9 aa, Homo Sapiens
QKTPWFIHG

SEQ ID NO: 184086 - protein, 9 aa, Homo Sapiens
SQGGRILLQ

SEQ ID NO: 184087 - protein, 9 aa, Homo Sapiens
RRRNLILRK

SEQ ID NO: 184088 - protein, 9 aa, Homo Sapiens
SFANPAHHY

SEQ ID NO: 184089 - protein, 9 aa, Homo Sapiens
GAPSLGRGL

SEQ ID NO: 184090 - protein, 9 aa, Homo Sapiens
PTARARSPA

SEQ ID NO: 184091 - protein, 9 aa, Homo Sapiens
LSFTHHISF

SEQ ID NO: 184092 - protein, 9 aa, Homo Sapiens
KRACRMNCK

SEQ ID NO: 184093 - protein, 9 aa, Homo Sapiens
YWTIRVLGA

SEQ ID NO: 184094 - protein, 9 aa, Homo Sapiens
GASDSLSAR

SEQ ID NO: 184095 - protein, 9 aa, Homo Sapiens
PLDPAPPPL

SEQ ID NO: 184096 - protein, 9 aa, Homo Sapiens
HFIVIADFR

SEQ ID NO: 184097 - protein, 9 aa, Homo Sapiens
LTKATKKTK

SEQ ID NO: 184098 - protein, 9 aa, Homo Sapiens
HTPHYSEQE

SEQ ID NO: 184099 - protein, 9 aa, Homo Sapiens
SVSRPEACG

SEQ ID NO: 184100 - protein, 9 aa, Homo Sapiens
PAMTVACLV

SEQ ID NO: 184101 - protein, 9 aa, Homo Sapiens
GTIGSPVRL

SEQ ID NO: 184102 - protein, 9 aa, Homo Sapiens
LWPFGFEDD

SEQ ID NO: 184103 - protein, 9 aa, Homo Sapiens
LTWMRPKKC

SEQ ID NO: 184104 - protein, 9 aa, Homo Sapiens
PWAAPASPS

SEQ ID NO: 184105 - protein, 9 aa, Homo Sapiens
WTAVPLQHM

SEQ ID NO: 184106 - protein, 9 aa, Homo Sapiens
LHHWLFVSV

SEQ ID NO: 184107 - protein, 9 aa, Homo Sapiens
NLPCFPSLP

SEQ ID NO: 184108 - protein, 9 aa, Homo Sapiens
LINKKCYGM

SEQ ID NO: 184109 - protein, 9 aa, Homo Sapiens
SQTAAELQA

SEQ ID NO: 184110 - protein, 9 aa, Homo Sapiens
KDNGFFLRF

SEQ ID NO: 184111 - protein, 9 aa, Homo Sapiens
LVSKNGFFR

SEQ ID NO: 184112 - protein, 9 aa, Homo Sapiens
ATRKGPDFG

SEQ ID NO: 184113 - protein, 9 aa, Homo Sapiens
VGNPALGKS

SEQ ID NO: 184114 - protein, 9 aa, Homo Sapiens
GNSYHHMVF

SEQ ID NO: 184115 - protein, 9 aa, Homo Sapiens
AVGGQMRAQ

SEQ ID NO: 184116 - protein, 9 aa, Homo Sapiens
FWITPDPYP

SEQ ID NO: 184117 - protein, 9 aa, Homo Sapiens
PCRHAGSSA

SEQ ID NO: 184118 - protein, 9 aa, Homo Sapiens
SQTPGRGVP

SEQ ID NO: 184119 - protein, 9 aa, Homo Sapiens
TVLSKILTS

SEQ ID NO: 184120 - protein, 9 aa, Homo Sapiens
LSDPGPRKQ

SEQ ID NO: 184121 - protein, 9 aa, Homo Sapiens
MWDSREMRD

SEQ ID NO: 184122 - protein, 9 aa, Homo Sapiens
THTSLTFQR

SEQ ID NO: 184123 - protein, 9 aa, Homo Sapiens
KTILDKSSE

SEQ ID NO: 184124 - protein, 9 aa, Homo Sapiens
AQVASVKGK

SEQ ID NO: 184125 - protein, 9 aa, Homo Sapiens
HCHEINCGN

SEQ ID NO: 184126 - protein, 9 aa, Homo Sapiens
GSLQTSSSG

SEQ ID NO: 184127 - protein, 9 aa, Homo Sapiens
LLLLHLISL

SEQ ID NO: 184128 - protein, 9 aa, Homo Sapiens
LEKMEITHH

SEQ ID NO: 184129 - protein, 9 aa, Homo Sapiens
TELLEAQAE

SEQ ID NO: 184130 - protein, 9 aa, Homo Sapiens
AMLENYRNL

SEQ ID NO: 184131 - protein, 9 aa, Homo Sapiens
RPLSLQCQS

SEQ ID NO: 184132 - protein, 9 aa, Homo Sapiens
RAIFSLLKA

SEQ ID NO: 184133 - protein, 9 aa, Homo Sapiens
RNMPTEELY

SEQ ID NO: 184134 - protein, 9 aa, Homo Sapiens
RSDYSLSEV

SEQ ID NO: 184135 - protein, 9 aa, Homo Sapiens
GISTPEEPG

SEQ ID NO: 184136 - protein, 9 aa, Homo Sapiens
STSSLWSTP

SEQ ID NO: 184137 - protein, 9 aa, Homo Sapiens
TEQMEKFCL

SEQ ID NO: 184138 - protein, 9 aa, Homo Sapiens
EEKISLPRH

SEQ ID NO: 184139 - protein, 9 aa, Homo Sapiens
TTGLPATSL

SEQ ID NO: 184140 - protein, 9 aa, Homo Sapiens
KVLSFTHHI

SEQ ID NO: 184141 - protein, 9 aa, Homo Sapiens
ARALLELCA

SEQ ID NO: 184142 - protein, 9 aa, Homo Sapiens
ADLMPKEQA

SEQ ID NO: 184143 - protein, 9 aa, Homo Sapiens
CLVKNLDAV

SEQ ID NO: 184144 - protein, 9 aa, Homo Sapiens
SFLLISGKL

SEQ ID NO: 184145 - protein, 9 aa, Homo Sapiens
SAVEQMAES

SEQ ID NO: 184146 - protein, 9 aa, Homo Sapiens
TLARLERSS

SEQ ID NO: 184147 - protein, 9 aa, Homo Sapiens
DSFEAPEDK

SEQ ID NO: 184148 - protein, 9 aa, Homo Sapiens
PASTNRAPS

SEQ ID NO: 184149 - protein, 9 aa, Homo Sapiens
RRRPSSMLP

SEQ ID NO: 184150 - protein, 9 aa, Homo Sapiens
HISLGQLSS

SEQ ID NO: 184151 - protein, 9 aa, Homo Sapiens
ASTNRAPSS

SEQ ID NO: 184152 - protein, 9 aa, Homo Sapiens
GRRPLKKWP

SEQ ID NO: 184153 - protein, 9 aa, Homo Sapiens
LLNVPQLTD

SEQ ID NO: 184154 - protein, 9 aa, Homo Sapiens
LERGLGLLA

SEQ ID NO: 184155 - protein, 9 aa, Homo Sapiens
WAPTTRPLA

SEQ ID NO: 184156 - protein, 9 aa, Homo Sapiens
LLESLKARG

SEQ ID NO: 184157 - protein, 9 aa, Homo Sapiens
SIRLPYFWD

SEQ ID NO: 184158 - protein, 9 aa, Homo Sapiens
RKRLEEKRA

SEQ ID NO: 184159 - protein, 9 aa, Homo Sapiens
TRTSLRSCR

SEQ ID NO: 184160 - protein, 9 aa, Homo Sapiens
SSPSALPCA

SEQ ID NO: 184161 - protein, 9 aa, Homo Sapiens
TLAAVQDGL

SEQ ID NO: 184162 - protein, 9 aa, Homo Sapiens
GEWMTQRVL

SEQ ID NO: 184163 - protein, 9 aa, Homo Sapiens
MQQEVVEMW

SEQ ID NO: 184164 - protein, 9 aa, Homo Sapiens
GPVRLLLGV

SEQ ID NO: 184165 - protein, 9 aa, Homo Sapiens
VLLIDNSAG

SEQ ID NO: 184166 - protein, 9 aa, Homo Sapiens
LTLCLLSWC

SEQ ID NO: 184167 - protein, 9 aa, Homo Sapiens
MTNNEGLFS

SEQ ID NO: 184168 - protein, 9 aa, Homo Sapiens
ISFQAMDSF

SEQ ID NO: 184169 - protein, 9 aa, Homo Sapiens
RSMICWLRK

SEQ ID NO: 184170 - protein, 9 aa, Homo Sapiens
RIEWSLSIS

SEQ ID NO: 184171 - protein, 9 aa, Homo Sapiens
QMPPVMLKV

SEQ ID NO: 184172 - protein, 9 aa, Homo Sapiens
KTKKTSFSL

SEQ ID NO: 184173 - protein, 9 aa, Homo Sapiens
TSGKYRQLS

SEQ ID NO: 184174 - protein, 9 aa, Homo Sapiens
YLRTSGEPW

SEQ ID NO: 184175 - protein, 9 aa, Homo Sapiens
PLLATMGPI

SEQ ID NO: 184176 - protein, 9 aa, Homo Sapiens
PTEAELQVM

SEQ ID NO: 184177 - protein, 9 aa, Homo Sapiens
LAPVLICRF

SEQ ID NO: 184178 - protein, 9 aa, Homo Sapiens
RQESQTRRG

SEQ ID NO: 184179 - protein, 9 aa, Homo Sapiens
AGGNDDCRI

SEQ ID NO: 184180 - protein, 9 aa, Homo Sapiens
KSFGLDRIV

SEQ ID NO: 184181 - protein, 9 aa, Homo Sapiens
TEKLQLTNS

SEQ ID NO: 184182 - protein, 9 aa, Homo Sapiens
YGEKFYLFP

SEQ ID NO: 184183 - protein, 9 aa, Homo Sapiens
IMKYKKSVS

SEQ ID NO: 184184 - protein, 9 aa, Homo Sapiens
YYQYMNPAI

SEQ ID NO: 184185 - protein, 9 aa, Homo Sapiens
DIDCFFVQV

SEQ ID NO: 184186 - protein, 9 aa, Homo Sapiens
ILTSGKYRQ

SEQ ID NO: 184187 - protein, 9 aa, Homo Sapiens
RYQRLRDEV

SEQ ID NO: 184188 - protein, 9 aa, Homo Sapiens
AQRISGKNR

SEQ ID NO: 184189 - protein, 9 aa, Homo Sapiens
LICRFKERE

SEQ ID NO: 184190 - protein, 9 aa, Homo Sapiens
LLLLLLHRV

SEQ ID NO: 184191 - protein, 9 aa, Homo Sapiens
YGPQRGQYG

SEQ ID NO: 184192 - protein, 9 aa, Homo Sapiens
KEPTEQVVE

SEQ ID NO: 184193 - protein, 9 aa, Homo Sapiens
RLKKRRRRR

SEQ ID NO: 184194 - protein, 9 aa, Homo Sapiens
GAAGAEAPW

SEQ ID NO: 184195 - protein, 9 aa, Homo Sapiens
GDDEDFLEP

SEQ ID NO: 184196 - protein, 9 aa, Homo Sapiens
MPVRHMPVA

SEQ ID NO: 184197 - protein, 9 aa, Homo Sapiens
KKENIRPMW

SEQ ID NO: 184198 - protein, 9 aa, Homo Sapiens
EEEKKRLKK

SEQ ID NO: 184199 - protein, 9 aa, Homo Sapiens
LWAPASSPT

SEQ ID NO: 184200 - protein, 9 aa, Homo Sapiens
EGLGASSHT

SEQ ID NO: 184201 - protein, 9 aa, Homo Sapiens
PTVSTGGHT

SEQ ID NO: 184202 - protein, 9 aa, Homo Sapiens
SSSSSPSSA

SEQ ID NO: 184203 - protein, 9 aa, Homo Sapiens
KTEPVAGSP

SEQ ID NO: 184204 - protein, 9 aa, Homo Sapiens
PCTSWLCWA

SEQ ID NO: 184205 - protein, 9 aa, Homo Sapiens
CSVSSQHKQ

SEQ ID NO: 184206 - protein, 9 aa, Homo Sapiens
LKKYRCYEV

SEQ ID NO: 184207 - protein, 9 aa, Homo Sapiens
AHPTVPHGA

SEQ ID NO: 184208 - protein, 9 aa, Homo Sapiens
PWFIHGLVR

SEQ ID NO: 184209 - protein, 9 aa, Homo Sapiens
TDTAEQVIT

SEQ ID NO: 184210 - protein, 9 aa, Homo Sapiens
LPPELPPAS

SEQ ID NO: 184211 - protein, 9 aa, Homo Sapiens
MRVQEYGSD

SEQ ID NO: 184212 - protein, 9 aa, Homo Sapiens
QSGAAVLLE

SEQ ID NO: 184213 - protein, 9 aa, Homo Sapiens
KDNPLDHVL

SEQ ID NO: 184214 - protein, 9 aa, Homo Sapiens
SPGAWGGAP

SEQ ID NO: 184215 - protein, 9 aa, Homo Sapiens
GPTAKRTMR

SEQ ID NO: 184216 - protein, 9 aa, Homo Sapiens
TEKQQYLDE

SEQ ID NO: 184217 - protein, 9 aa, Homo Sapiens
HTRCWESCQ

SEQ ID NO: 184218 - protein, 9 aa, Homo Sapiens
INYDTSTDE

SEQ ID NO: 184219 - protein, 9 aa, Homo Sapiens
NTVNQKKAK

SEQ ID NO: 184220 - protein, 9 aa, Homo Sapiens
RSNTIFPNP

SEQ ID NO: 184221 - protein, 9 aa, Homo Sapiens
DFGLREITK

SEQ ID NO: 184222 - protein, 9 aa, Homo Sapiens
MLGPDWLVK

SEQ ID NO: 184223 - protein, 9 aa, Homo Sapiens
LPVPLLNVP

SEQ ID NO: 184224 - protein, 9 aa, Homo Sapiens
VIIVLSIFI

SEQ ID NO: 184225 - protein, 9 aa, Homo Sapiens
GLDRIVDIW

SEQ ID NO: 184226 - protein, 9 aa, Homo Sapiens
RQPREPTKM

SEQ ID NO: 184227 - protein, 9 aa, Homo Sapiens
KSQQDAFLP

SEQ ID NO: 184228 - protein, 9 aa, Homo Sapiens
KFNVDEFED

SEQ ID NO: 184229 - protein, 9 aa, Homo Sapiens
CQNPEKLAL

SEQ ID NO: 184230 - protein, 9 aa, Homo Sapiens
SFPGNYPSN

SEQ ID NO: 184231 - protein, 9 aa, Homo Sapiens
ESEMSTQSG

SEQ ID NO: 184232 - protein, 9 aa, Homo Sapiens
RRMMNMSKI

SEQ ID NO: 184233 - protein, 9 aa, Homo Sapiens
PPCASLCAR

SEQ ID NO: 184234 - protein, 9 aa, Homo Sapiens
SHCTMRGAR

SEQ ID NO: 184235 - protein, 9 aa, Homo Sapiens
SLGLHGLLA

SEQ ID NO: 184236 - protein, 9 aa, Homo Sapiens
QNASQDLLG

SEQ ID NO: 184237 - protein, 9 aa, Homo Sapiens
TARGRPAAR

SEQ ID NO: 184238 - protein, 9 aa, Homo Sapiens
SCANLLILS

SEQ ID NO: 184239 - protein, 9 aa, Homo Sapiens
TSWLCWAAG

SEQ ID NO: 184240 - protein, 9 aa, Homo Sapiens
CRINSAVCS

SEQ ID NO: 184241 - protein, 9 aa, Homo Sapiens
EKEKEKLWY

SEQ ID NO: 184242 - protein, 9 aa, Homo Sapiens
GLGVCGEDG

SEQ ID NO: 184243 - protein, 9 aa, Homo Sapiens
EKISLPRHR

SEQ ID NO: 184244 - protein, 9 aa, Homo Sapiens
GGPKGSKGE

SEQ ID NO: 184245 - protein, 9 aa, Homo Sapiens
CFLKMESKQ

SEQ ID NO: 184246 - protein, 9 aa, Homo Sapiens
IGSGVSCLA

SEQ ID NO: 184247 - protein, 9 aa, Homo Sapiens
LGLLAERAQ

SEQ ID NO: 184248 - protein, 9 aa, Homo Sapiens
ETLLFYRVP

SEQ ID NO: 184249 - protein, 9 aa, Homo Sapiens
DVLVCLLFL

SEQ ID NO: 184250 - protein, 9 aa, Homo Sapiens
PPRTATTPR

SEQ ID NO: 184251 - protein, 9 aa, Homo Sapiens
SQACPHQAS

SEQ ID NO: 184252 - protein, 9 aa, Homo Sapiens
CYSTQVSHI

SEQ ID NO: 184253 - protein, 9 aa, Homo Sapiens
LAEVLERGL

SEQ ID NO: 184254 - protein, 9 aa, Homo Sapiens
CHRPFHLEE

SEQ ID NO: 184255 - protein, 9 aa, Homo Sapiens
SHIKKKTHT

SEQ ID NO: 184256 - protein, 9 aa, Homo Sapiens
SLPKQPLLL

SEQ ID NO: 184257 - protein, 9 aa, Homo Sapiens
IYLDELMKK

SEQ ID NO: 184258 - protein, 9 aa, Homo Sapiens
TDALQKTPR

SEQ ID NO: 184259 - protein, 9 aa, Homo Sapiens
RGQAHAVKT

SEQ ID NO: 184260 - protein, 9 aa, Homo Sapiens
PQLQSPVYF

SEQ ID NO: 184261 - protein, 9 aa, Homo Sapiens
LASLPTPLT

SEQ ID NO: 184262 - protein, 9 aa, Homo Sapiens
PPAPAAVPS

SEQ ID NO: 184263 - protein, 9 aa, Homo Sapiens
SSFTRATSW

SEQ ID NO: 184264 - protein, 9 aa, Homo Sapiens
LAPGCALRR

SEQ ID NO: 184265 - protein, 9 aa, Homo Sapiens
QSHQPDPDH

SEQ ID NO: 184266 - protein, 9 aa, Homo Sapiens
PVLLAIRLL

SEQ ID NO: 184267 - protein, 9 aa, Homo Sapiens
KARGNSSLV

SEQ ID NO: 184268 - protein, 9 aa, Homo Sapiens
YFWDNVCLT

SEQ ID NO: 184269 - protein, 9 aa, Homo Sapiens
AISLPTIGE

SEQ ID NO: 184270 - protein, 9 aa, Homo Sapiens
MSGVVQTIF

SEQ ID NO: 184271 - protein, 9 aa, Homo Sapiens
CFPSLPKQP

SEQ ID NO: 184272 - protein, 9 aa, Homo Sapiens
SWTETKKTI

SEQ ID NO: 184273 - protein, 9 aa, Homo Sapiens
AHGRRHGLG

SEQ ID NO: 184274 - protein, 9 aa, Homo Sapiens
GWHGFPGPW

SEQ ID NO: 184275 - protein, 9 aa, Homo Sapiens
FHPFLCVAD

SEQ ID NO: 184276 - protein, 9 aa, Homo Sapiens
MENQIAVSS

SEQ ID NO: 184277 - protein, 9 aa, Homo Sapiens
TMSACPPEN

SEQ ID NO: 184278 - protein, 9 aa, Homo Sapiens
GGSHLYYSF

SEQ ID NO: 184279 - protein, 9 aa, Homo Sapiens
ELRHAPRLS

SEQ ID NO: 184280 - protein, 9 aa, Homo Sapiens
QLATIQILH

SEQ ID NO: 184281 - protein, 9 aa, Homo Sapiens
PCAGARRGR

SEQ ID NO: 184282 - protein, 9 aa, Homo Sapiens
FWNSNDKEK

SEQ ID NO: 184283 - protein, 9 aa, Homo Sapiens
SRSRRAPGE

SEQ ID NO: 184284 - protein, 9 aa, Homo Sapiens
TPDPYPKDD

SEQ ID NO: 184285 - protein, 9 aa, Homo Sapiens
EQDHYETDH

SEQ ID NO: 184286 - protein, 9 aa, Homo Sapiens
CTSWLCWAA

SEQ ID NO: 184287 - protein, 9 aa, Homo Sapiens
SKQGTVLMK

SEQ ID NO: 184288 - protein, 9 aa, Homo Sapiens
TSLKWQFLL

SEQ ID NO: 184289 - protein, 9 aa, Homo Sapiens
GGGHAVPVV

SEQ ID NO: 184290 - protein, 9 aa, Homo Sapiens
FQRMLAMEL

SEQ ID NO: 184291 - protein, 9 aa, Homo Sapiens
LSARVRRPS

SEQ ID NO: 184292 - protein, 9 aa, Homo Sapiens
SHLVTYFPS

SEQ ID NO: 184293 - protein, 9 aa, Homo Sapiens
LLGCVSTSL

SEQ ID NO: 184294 - protein, 9 aa, Homo Sapiens
KRPEDFEFG

SEQ ID NO: 184295 - protein, 9 aa, Homo Sapiens
VQNLDGHIR

SEQ ID NO: 184296 - protein, 9 aa, Homo Sapiens
EYLAEIMLE

SEQ ID NO: 184297 - protein, 9 aa, Homo Sapiens
KWERQDYGK

SEQ ID NO: 184298 - protein, 9 aa, Homo Sapiens
ENSHGPFPQ

SEQ ID NO: 184299 - protein, 9 aa, Homo Sapiens
VLPAPVIQV

SEQ ID NO: 184300 - protein, 9 aa, Homo Sapiens
GIIILSAEE

SEQ ID NO: 184301 - protein, 9 aa, Homo Sapiens
GGLGVVLGQ

SEQ ID NO: 184302 - protein, 9 aa, Homo Sapiens
ERRCDDPSK

SEQ ID NO: 184303 - protein, 9 aa, Homo Sapiens
GREKKKAPS

SEQ ID NO: 184304 - protein, 9 aa, Homo Sapiens
RIVWMPRMR

SEQ ID NO: 184305 - protein, 9 aa, Homo Sapiens
RCYEVIMTA

SEQ ID NO: 184306 - protein, 9 aa, Homo Sapiens
TEAPKFPTP

SEQ ID NO: 184307 - protein, 9 aa, Homo Sapiens
YLGCIEIMG

SEQ ID NO: 184308 - protein, 9 aa, Homo Sapiens
QPPSMCVGS

SEQ ID NO: 184309 - protein, 9 aa, Homo Sapiens
CGEADRWGR

SEQ ID NO: 184310 - protein, 9 aa, Homo Sapiens
SVYMWSASS

SEQ ID NO: 184311 - protein, 9 aa, Homo Sapiens
PQATELGAA

SEQ ID NO: 184312 - protein, 9 aa, Homo Sapiens
IRAALRKMQ

SEQ ID NO: 184313 - protein, 9 aa, Homo Sapiens
LRPVTHGGQ

SEQ ID NO: 184314 - protein, 9 aa, Homo Sapiens
GEVVALCLS

SEQ ID NO: 184315 - protein, 9 aa, Homo Sapiens
ADGYGTQRE

SEQ ID NO: 184316 - protein, 9 aa, Homo Sapiens
CQEGCQLMG

SEQ ID NO: 184317 - protein, 9 aa, Homo Sapiens
PPPHQMKCL

SEQ ID NO: 184318 - protein, 9 aa, Homo Sapiens
RHFAYGRSD

SEQ ID NO: 184319 - protein, 9 aa, Homo Sapiens
GLGVVLGQS

SEQ ID NO: 184320 - protein, 9 aa, Homo Sapiens
LREKVHPMI

SEQ ID NO: 184321 - protein, 9 aa, Homo Sapiens
QVEGPIKPV

SEQ ID NO: 184322 - protein, 9 aa, Homo Sapiens
KLIFLEGMD

SEQ ID NO: 184323 - protein, 9 aa, Homo Sapiens
WNVTRNRLK

SEQ ID NO: 184324 - protein, 9 aa, Homo Sapiens
SILDRFTGD

SEQ ID NO: 184325 - protein, 9 aa, Homo Sapiens
WEGAKIQSG

SEQ ID NO: 184326 - protein, 9 aa, Homo Sapiens
LPCTSWLCW

SEQ ID NO: 184327 - protein, 9 aa, Homo Sapiens
IIILSAEEL

SEQ ID NO: 184328 - protein, 9 aa, Homo Sapiens
SPWAAPASP

SEQ ID NO: 184329 - protein, 9 aa, Homo Sapiens
SMLPRRPAT

SEQ ID NO: 184330 - protein, 9 aa, Homo Sapiens
PTWRVCIYG

SEQ ID NO: 184331 - protein, 9 aa, Homo Sapiens
YPMDMKVSL

SEQ ID NO: 184332 - protein, 9 aa, Homo Sapiens
KERIEWSLS

SEQ ID NO: 184333 - protein, 9 aa, Homo Sapiens
AYGALTFPV

SEQ ID NO: 184334 - protein, 9 aa, Homo Sapiens
LLPRHPTWR

SEQ ID NO: 184335 - protein, 9 aa, Homo Sapiens
KEVKEKAQA

SEQ ID NO: 184336 - protein, 9 aa, Homo Sapiens
GSIPIDQVG

SEQ ID NO: 184337 - protein, 9 aa, Homo Sapiens
CLHQFPRSL

SEQ ID NO: 184338 - protein, 9 aa, Homo Sapiens
VTILQKVAM

SEQ ID NO: 184339 - protein, 9 aa, Homo Sapiens
PRKLLNHGK

SEQ ID NO: 184340 - protein, 9 aa, Homo Sapiens
GKSATRTPE

SEQ ID NO: 184341 - protein, 9 aa, Homo Sapiens
LGSSPSTPP

SEQ ID NO: 184342 - protein, 9 aa, Homo Sapiens
ASPSRRRTQ

SEQ ID NO: 184343 - protein, 9 aa, Homo Sapiens
TVKIPKKER

SEQ ID NO: 184344 - protein, 9 aa, Homo Sapiens
FHKTCKKTE

SEQ ID NO: 184345 - protein, 9 aa, Homo Sapiens
HKTCKKTET

SEQ ID NO: 184346 - protein, 9 aa, Homo Sapiens
LVLAGMGLH

SEQ ID NO: 184347 - protein, 9 aa, Homo Sapiens
ELHLLLPLL

SEQ ID NO: 184348 - protein, 9 aa, Homo Sapiens
GQRAHQVTH

SEQ ID NO: 184349 - protein, 9 aa, Homo Sapiens
SDLLNPRKL

SEQ ID NO: 184350 - protein, 9 aa, Homo Sapiens
SLWSTPAPQ

SEQ ID NO: 184351 - protein, 9 aa, Homo Sapiens
PMKSILRQE

SEQ ID NO: 184352 - protein, 9 aa, Homo Sapiens
RAERGQCGE

SEQ ID NO: 184353 - protein, 9 aa, Homo Sapiens
RFDVPEYSS

SEQ ID NO: 184354 - protein, 9 aa, Homo Sapiens
KIPLDPAPP

SEQ ID NO: 184355 - protein, 9 aa, Homo Sapiens
THSLEPPYL

SEQ ID NO: 184356 - protein, 9 aa, Homo Sapiens
KRRRRRIPR

SEQ ID NO: 184357 - protein, 9 aa, Homo Sapiens
LKPENQVLG

SEQ ID NO: 184358 - protein, 9 aa, Homo Sapiens
DPPQKRVDS

SEQ ID NO: 184359 - protein, 9 aa, Homo Sapiens
LPTIGESQA

SEQ ID NO: 184360 - protein, 9 aa, Homo Sapiens
SPQAPLRLW

SEQ ID NO: 184361 - protein, 9 aa, Homo Sapiens
MVFSSCAKV

SEQ ID NO: 184362 - protein, 9 aa, Homo Sapiens
AKDTYNKKW

SEQ ID NO: 184363 - protein, 9 aa, Homo Sapiens
HTGEKQFHC

SEQ ID NO: 184364 - protein, 9 aa, Homo Sapiens
CILDRKKQT

SEQ ID NO: 184365 - protein, 9 aa, Homo Sapiens
YNSGFFLED

SEQ ID NO: 184366 - protein, 9 aa, Homo Sapiens
SARIGAVKC

SEQ ID NO: 184367 - protein, 9 aa, Homo Sapiens
KLLDKMTMS

SEQ ID NO: 184368 - protein, 9 aa, Homo Sapiens
RASLEKSAK

SEQ ID NO: 184369 - protein, 9 aa, Homo Sapiens
CKKIRASTK

SEQ ID NO: 184370 - protein, 9 aa, Homo Sapiens
LNLTYRFLD

SEQ ID NO: 184371 - protein, 9 aa, Homo Sapiens
IFIACWAPL

SEQ ID NO: 184372 - protein, 9 aa, Homo Sapiens
ISAQNSDTP

SEQ ID NO: 184373 - protein, 9 aa, Homo Sapiens
FFLHKEFLL

SEQ ID NO: 184374 - protein, 9 aa, Homo Sapiens
AAATARAPA

SEQ ID NO: 184375 - protein, 9 aa, Homo Sapiens
GPGTFTYLT

SEQ ID NO: 184376 - protein, 9 aa, Homo Sapiens
YGTIGSPVR

SEQ ID NO: 184377 - protein, 9 aa, Homo Sapiens
SPTWRVCIY

SEQ ID NO: 184378 - protein, 9 aa, Homo Sapiens
ERQDYGKMA

SEQ ID NO: 184379 - protein, 9 aa, Homo Sapiens
KTKCRPTTS

SEQ ID NO: 184380 - protein, 9 aa, Homo Sapiens
CSADESLSA

SEQ ID NO: 184381 - protein, 9 aa, Homo Sapiens
QNCVVGAMQ

SEQ ID NO: 184382 - protein, 9 aa, Homo Sapiens
THPREAIQV

SEQ ID NO: 184383 - protein, 9 aa, Homo Sapiens
YYHHRNIAT

SEQ ID NO: 184384 - protein, 9 aa, Homo Sapiens
QIADEQSKD

SEQ ID NO: 184385 - protein, 9 aa, Homo Sapiens
QQVHRLWLA

SEQ ID NO: 184386 - protein, 9 aa, Homo Sapiens
EKATHKCIL

SEQ ID NO: 184387 - protein, 9 aa, Homo Sapiens
VMLSPCHLA

SEQ ID NO: 184388 - protein, 9 aa, Homo Sapiens
RAWRLEALR

SEQ ID NO: 184389 - protein, 9 aa, Homo Sapiens
SPCAKATSP

SEQ ID NO: 184390 - protein, 9 aa, Homo Sapiens
PRLASLPTP

SEQ ID NO: 184391 - protein, 9 aa, Homo Sapiens
FTVEAANYQ

SEQ ID NO: 184392 - protein, 9 aa, Homo Sapiens
RLLLLIKPK

SEQ ID NO: 184393 - protein, 9 aa, Homo Sapiens
SVHLLEEAL

SEQ ID NO: 184394 - protein, 9 aa, Homo Sapiens
QTASRGSSS

SEQ ID NO: 184395 - protein, 9 aa, Homo Sapiens
QMVDELEVV

SEQ ID NO: 184396 - protein, 9 aa, Homo Sapiens
TPYRENKNL

SEQ ID NO: 184397 - protein, 9 aa, Homo Sapiens
SPKGKQPAV

SEQ ID NO: 184398 - protein, 9 aa, Homo Sapiens
WRVCIYGKE

SEQ ID NO: 184399 - protein, 9 aa, Homo Sapiens
LTWEVTPRS

SEQ ID NO: 184400 - protein, 9 aa, Homo Sapiens
RLQAQMDTS

SEQ ID NO: 184401 - protein, 9 aa, Homo Sapiens
GFLPPVSWP

SEQ ID NO: 184402 - protein, 9 aa, Homo Sapiens
GARRGRWSC

SEQ ID NO: 184403 - protein, 9 aa, Homo Sapiens
KVFVVTDAV

SEQ ID NO: 184404 - protein, 9 aa, Homo Sapiens
ILDKSSEMG

SEQ ID NO: 184405 - protein, 9 aa, Homo Sapiens
VDVGAGRGQ

SEQ ID NO: 184406 - protein, 9 aa, Homo Sapiens
TALLQFQVL

SEQ ID NO: 184407 - protein, 9 aa, Homo Sapiens
AATMKKPSP

SEQ ID NO: 184408 - protein, 9 aa, Homo Sapiens
GDYRKLTPN

SEQ ID NO: 184409 - protein, 9 aa, Homo Sapiens
EFVSDGSIN

SEQ ID NO: 184410 - protein, 9 aa, Homo Sapiens
SPTCSWPRV

SEQ ID NO: 184411 - protein, 9 aa, Homo Sapiens
ESVLTALLQ

SEQ ID NO: 184412 - protein, 9 aa, Homo Sapiens
QKEKLLCPG

SEQ ID NO: 184413 - protein, 9 aa, Homo Sapiens
PASTAGPPT

SEQ ID NO: 184414 - protein, 9 aa, Homo Sapiens
SLKGIPMKK

SEQ ID NO: 184415 - protein, 9 aa, Homo Sapiens
DEEEDDDDD

SEQ ID NO: 184416 - protein, 9 aa, Homo Sapiens
PQSTCARRK

SEQ ID NO: 184417 - protein, 9 aa, Homo Sapiens
CFKAYHYLQ

SEQ ID NO: 184418 - protein, 9 aa, Homo Sapiens
LRDISNVFQ

SEQ ID NO: 184419 - protein, 9 aa, Homo Sapiens
RRQSSLFIT

SEQ ID NO: 184420 - protein, 9 aa, Homo Sapiens
QHLGQDHSD

SEQ ID NO: 184421 - protein, 9 aa, Homo Sapiens
PCGSPTTRS

SEQ ID NO: 184422 - protein, 9 aa, Homo Sapiens
EADRWGRQC

SEQ ID NO: 184423 - protein, 9 aa, Homo Sapiens
REVQIVGTM

SEQ ID NO: 184424 - protein, 9 aa, Homo Sapiens
LEPPGAREE

SEQ ID NO: 184425 - protein, 9 aa, Homo Sapiens
FGVGETRRP

SEQ ID NO: 184426 - protein, 9 aa, Homo Sapiens
EVYTTQPGS

SEQ ID NO: 184427 - protein, 9 aa, Homo Sapiens
TGTTPSGSE

SEQ ID NO: 184428 - protein, 9 aa, Homo Sapiens
EDLLYLRTS

SEQ ID NO: 184429 - protein, 9 aa, Homo Sapiens
GTTRTSLRS

SEQ ID NO: 184430 - protein, 9 aa, Homo Sapiens
RNIFSNMFS

SEQ ID NO: 184431 - protein, 9 aa, Homo Sapiens
GLTLYITSR

SEQ ID NO: 184432 - protein, 9 aa, Homo Sapiens
QGSLQTSSS

SEQ ID NO: 184433 - protein, 9 aa, Homo Sapiens
AGPRDTARG

SEQ ID NO: 184434 - protein, 9 aa, Homo Sapiens
EYLERHVPS

SEQ ID NO: 184435 - protein, 9 aa, Homo Sapiens
CNGHIIVVD

SEQ ID NO: 184436 - protein, 9 aa, Homo Sapiens
SWLCWAAGS

SEQ ID NO: 184437 - protein, 9 aa, Homo Sapiens
AFGIVQGSL

SEQ ID NO: 184438 - protein, 9 aa, Homo Sapiens
GVVRGLGEG

SEQ ID NO: 184439 - protein, 9 aa, Homo Sapiens
MDTWLVCRA

SEQ ID NO: 184440 - protein, 9 aa, Homo Sapiens
HIKKKTHTS

SEQ ID NO: 184441 - protein, 9 aa, Homo Sapiens
FWQQERSFL

SEQ ID NO: 184442 - protein, 9 aa, Homo Sapiens
SRMCKYPNR

SEQ ID NO: 184443 - protein, 9 aa, Homo Sapiens
GLLHYLFHM

SEQ ID NO: 184444 - protein, 9 aa, Homo Sapiens
VTPRSIHEG

SEQ ID NO: 184445 - protein, 9 aa, Homo Sapiens
QIAVMSGVV

SEQ ID NO: 184446 - protein, 9 aa, Homo Sapiens
NSKVVGVKS

SEQ ID NO: 184447 - protein, 9 aa, Homo Sapiens
KMTMSFWKR

SEQ ID NO: 184448 - protein, 9 aa, Homo Sapiens
PRAPASPGR

SEQ ID NO: 184449 - protein, 9 aa, Homo Sapiens
ICWRSRWQG

SEQ ID NO: 184450 - protein, 9 aa, Homo Sapiens
TTEISPEKA

SEQ ID NO: 184451 - protein, 9 aa, Homo Sapiens
SYPMDMKVS

SEQ ID NO: 184452 - protein, 9 aa, Homo Sapiens
THHPPVWAA

SEQ ID NO: 184453 - protein, 9 aa, Homo Sapiens
HQPVPCIMV

SEQ ID NO: 184454 - protein, 9 aa, Homo Sapiens
ALDSAGHGH

SEQ ID NO: 184455 - protein, 9 aa, Homo Sapiens
LCSETDPCT

SEQ ID NO: 184456 - protein, 9 aa, Homo Sapiens
WKSIVTAPG

SEQ ID NO: 184457 - protein, 9 aa, Homo Sapiens
VFPSPPSPT

SEQ ID NO: 184458 - protein, 9 aa, Homo Sapiens
VVCITDEIY

SEQ ID NO: 184459 - protein, 9 aa, Homo Sapiens
DSDSRRRGA

SEQ ID NO: 184460 - protein, 9 aa, Homo Sapiens
SSRDATTRP

SEQ ID NO: 184461 - protein, 9 aa, Homo Sapiens
SLHLEKMEI

SEQ ID NO: 184462 - protein, 9 aa, Homo Sapiens
RDIRLVDAG

SEQ ID NO: 184463 - protein, 9 aa, Homo Sapiens
QGPLEAENG

SEQ ID NO: 184464 - protein, 9 aa, Homo Sapiens
EKFIKRGEF

SEQ ID NO: 184465 - protein, 9 aa, Homo Sapiens
SNGNIKKRL

SEQ ID NO: 184466 - protein, 9 aa, Homo Sapiens
FHLEEWRTL

SEQ ID NO: 184467 - protein, 9 aa, Homo Sapiens
QEHQPFSLQ

SEQ ID NO: 184468 - protein, 9 aa, Homo Sapiens
GRPAARTGS

SEQ ID NO: 184469 - protein, 9 aa, Homo Sapiens
PKVGLSSRM

SEQ ID NO: 184470 - protein, 9 aa, Homo Sapiens
LSLRELGFS

SEQ ID NO: 184471 - protein, 9 aa, Homo Sapiens
WRAVNQQPI

SEQ ID NO: 184472 - protein, 9 aa, Homo Sapiens
NLKLKPENQ

SEQ ID NO: 184473 - protein, 9 aa, Homo Sapiens
PVLPRHPSL

SEQ ID NO: 184474 - protein, 9 aa, Homo Sapiens
IRKLTQARN

SEQ ID NO: 184475 - protein, 9 aa, Homo Sapiens
RASVSVQFV

SEQ ID NO: 184476 - protein, 9 aa, Homo Sapiens
SSSPGSPCS

SEQ ID NO: 184477 - protein, 9 aa, Homo Sapiens
ATKDTRKSQ

SEQ ID NO: 184478 - protein, 9 aa, Homo Sapiens
DKMTMSFWK

SEQ ID NO: 184479 - protein, 9 aa, Homo Sapiens
RKYVKNTRA

SEQ ID NO: 184480 - protein, 9 aa, Homo Sapiens
HRGSGGGVG

SEQ ID NO: 184481 - protein, 9 aa, Homo Sapiens
DNSVYMWSA

SEQ ID NO: 184482 - protein, 9 aa, Homo Sapiens
IEEFWQQER

SEQ ID NO: 184483 - protein, 9 aa, Homo Sapiens
EEWGKLHVA

SEQ ID NO: 184484 - protein, 9 aa, Homo Sapiens
KSHGRKSLS

SEQ ID NO: 184485 - protein, 9 aa, Homo Sapiens
GTPKEGADT

SEQ ID NO: 184486 - protein, 9 aa, Homo Sapiens
QDGSFSARY

SEQ ID NO: 184487 - protein, 9 aa, Homo Sapiens
SVNQLEDEG

SEQ ID NO: 184488 - protein, 9 aa, Homo Sapiens
FPRVTPPPT

SEQ ID NO: 184489 - protein, 9 aa, Homo Sapiens
RLRHGLCDQ

SEQ ID NO: 184490 - protein, 9 aa, Homo Sapiens
RTARIEGPA

SEQ ID NO: 184491 - protein, 9 aa, Homo Sapiens
KKIRASTKT

SEQ ID NO: 184492 - protein, 9 aa, Homo Sapiens
VLEEERKKR

SEQ ID NO: 184493 - protein, 9 aa, Homo Sapiens
QKQLWAHGI

SEQ ID NO: 184494 - protein, 9 aa, Homo Sapiens
AATFAYLLV

SEQ ID NO: 184495 - protein, 9 aa, Homo Sapiens
KFIQKFVLF

SEQ ID NO: 184496 - protein, 9 aa, Homo Sapiens
VPHGASRGP

SEQ ID NO: 184497 - protein, 9 aa, Homo Sapiens
LQSAEKLMH

SEQ ID NO: 184498 - protein, 9 aa, Homo Sapiens
RCILDRKKQ

SEQ ID NO: 184499 - protein, 9 aa, Homo Sapiens
EMLEPFLEN

SEQ ID NO: 184500 - protein, 9 aa, Homo Sapiens
VLAQAGRAL

SEQ ID NO: 184501 - protein, 9 aa, Homo Sapiens
SNICQPMEI

SEQ ID NO: 184502 - protein, 9 aa, Homo Sapiens
HKNFTEEEV

SEQ ID NO: 184503 - protein, 9 aa, Homo Sapiens
SPLHLLSHG

SEQ ID NO: 184504 - protein, 9 aa, Homo Sapiens
SSPKNHGQT

SEQ ID NO: 184505 - protein, 9 aa, Homo Sapiens
GRGVPPRAP

SEQ ID NO: 184506 - protein, 9 aa, Homo Sapiens
NSPRSSLIS

SEQ ID NO: 184507 - protein, 9 aa, Homo Sapiens
RWGQRALHT

SEQ ID NO: 184508 - protein, 9 aa, Homo Sapiens
KEPSSPAPS

SEQ ID NO: 184509 - protein, 9 aa, Homo Sapiens
LGGGWICWR

SEQ ID NO: 184510 - protein, 9 aa, Homo Sapiens
MEWYTMSAC

SEQ ID NO: 184511 - protein, 9 aa, Homo Sapiens
SLLLLWAWR

SEQ ID NO: 184512 - protein, 9 aa, Homo Sapiens
WGQRALHTQ

SEQ ID NO: 184513 - protein, 9 aa, Homo Sapiens
DHYETDHTT

SEQ ID NO: 184514 - protein, 9 aa, Homo Sapiens
EVFCFLVEE

SEQ ID NO: 184515 - protein, 9 aa, Homo Sapiens
KPLNTSSKN

SEQ ID NO: 184516 - protein, 9 aa, Homo Sapiens
EALYWMMQR

SEQ ID NO: 184517 - protein, 9 aa, Homo Sapiens
SSSRKSSVC

SEQ ID NO: 184518 - protein, 9 aa, Homo Sapiens
VPRSGLGVG

SEQ ID NO: 184519 - protein, 9 aa, Homo Sapiens
SSVVSQTSL

SEQ ID NO: 184520 - protein, 9 aa, Homo Sapiens
PKNECDLTK

SEQ ID NO: 184521 - protein, 9 aa, Homo Sapiens
AKDTILQLN

SEQ ID NO: 184522 - protein, 9 aa, Homo Sapiens
APAAVPSTP

SEQ ID NO: 184523 - protein, 9 aa, Homo Sapiens
AIWKKLVIV

SEQ ID NO: 184524 - protein, 9 aa, Homo Sapiens
HPREAIQVF

SEQ ID NO: 184525 - protein, 9 aa, Homo Sapiens
LSPTLPQGR

SEQ ID NO: 184526 - protein, 9 aa, Homo Sapiens
RSCKRVILY

SEQ ID NO: 184527 - protein, 9 aa, Homo Sapiens
SHLRPEPAK

SEQ ID NO: 184528 - protein, 9 aa, Homo Sapiens
FYEQHNRPC

SEQ ID NO: 184529 - protein, 9 aa, Homo Sapiens
GRKRGLGTP

SEQ ID NO: 184530 - protein, 9 aa, Homo Sapiens
AHLSAASPC

SEQ ID NO: 184531 - protein, 9 aa, Homo Sapiens
KSIVTAPGE

SEQ ID NO: 184532 - protein, 9 aa, Homo Sapiens
LCLKKEVWN

SEQ ID NO: 184533 - protein, 9 aa, Homo Sapiens
QCQSHCTMR

SEQ ID NO: 184534 - protein, 9 aa, Homo Sapiens
QTFCVRCKC

SEQ ID NO: 184535 - protein, 9 aa, Homo Sapiens
RAKNISVAS

SEQ ID NO: 184536 - protein, 9 aa, Homo Sapiens
LEMMTNKAT

SEQ ID NO: 184537 - protein, 9 aa, Homo Sapiens
RCYSYENNT

SEQ ID NO: 184538 - protein, 9 aa, Homo Sapiens
RRRLTWEVT

SEQ ID NO: 184539 - protein, 9 aa, Homo Sapiens
LIDGLKELN

SEQ ID NO: 184540 - protein, 9 aa, Homo Sapiens
RGEEQNHGV

SEQ ID NO: 184541 - protein, 9 aa, Homo Sapiens
NSERQLPRC

SEQ ID NO: 184542 - protein, 9 aa, Homo Sapiens
RHAGSSALG

SEQ ID NO: 184543 - protein, 9 aa, Homo Sapiens
PQISGSLFS

SEQ ID NO: 184544 - protein, 9 aa, Homo Sapiens
KVTILQKVA

SEQ ID NO: 184545 - protein, 9 aa, Homo Sapiens
RKVRVPKRR

SEQ ID NO: 184546 - protein, 9 aa, Homo Sapiens
SSPADDNMD

SEQ ID NO: 184547 - protein, 9 aa, Homo Sapiens
IFAGIVTFS

SEQ ID NO: 184548 - protein, 9 aa, Homo Sapiens
IQVMGELFI

SEQ ID NO: 184549 - protein, 9 aa, Homo Sapiens
HNRPCWEAT

SEQ ID NO: 184550 - protein, 9 aa, Homo Sapiens
LRDMPQMRM

SEQ ID NO: 184551 - protein, 9 aa, Homo Sapiens
MISILARLP

SEQ ID NO: 184552 - protein, 9 aa, Homo Sapiens
NRQTESQII

SEQ ID NO: 184553 - protein, 9 aa, Homo Sapiens
LPVAGDLTS

SEQ ID NO: 184554 - protein, 9 aa, Homo Sapiens
AKDIVPGDN

SEQ ID NO: 184555 - protein, 9 aa, Homo Sapiens
CLTAVDCLQ

SEQ ID NO: 184556 - protein, 9 aa, Homo Sapiens
RPRSCVVDQ

SEQ ID NO: 184557 - protein, 9 aa, Homo Sapiens
PRKQDDSGQ

SEQ ID NO: 184558 - protein, 9 aa, Homo Sapiens
AVIEAAKTA

SEQ ID NO: 184559 - protein, 9 aa, Homo Sapiens
MTSSDKLLV

SEQ ID NO: 184560 - protein, 9 aa, Homo Sapiens
PQALCLLFQ

SEQ ID NO: 184561 - protein, 9 aa, Homo Sapiens
EDFLEPPGA

SEQ ID NO: 184562 - protein, 9 aa, Homo Sapiens
NNLAAAVSA

SEQ ID NO: 184563 - protein, 9 aa, Homo Sapiens
PPMPPPANP

SEQ ID NO: 184564 - protein, 9 aa, Homo Sapiens
RQQYQRALD

SEQ ID NO: 184565 - protein, 9 aa, Homo Sapiens
DQDAGREDG

SEQ ID NO: 184566 - protein, 9 aa, Homo Sapiens
LMVIELQSH

SEQ ID NO: 184567 - protein, 9 aa, Homo Sapiens
VNSVSVEGV

SEQ ID NO: 184568 - protein, 9 aa, Homo Sapiens
CTNGRQMAN

SEQ ID NO: 184569 - protein, 9 aa, Homo Sapiens
LGPRGPESR

SEQ ID NO: 184570 - protein, 9 aa, Homo Sapiens
GMDICLKIK

SEQ ID NO: 184571 - protein, 9 aa, Homo Sapiens
SCLAAARQL

SEQ ID NO: 184572 - protein, 9 aa, Homo Sapiens
APSSCWAPT

SEQ ID NO: 184573 - protein, 9 aa, Homo Sapiens
DWLVKVTDL

SEQ ID NO: 184574 - protein, 9 aa, Homo Sapiens
LPNHTLFLD

SEQ ID NO: 184575 - protein, 9 aa, Homo Sapiens
QSYDIGIVA

SEQ ID NO: 184576 - protein, 9 aa, Homo Sapiens
KFRGFSVQL

SEQ ID NO: 184577 - protein, 9 aa, Homo Sapiens
KASPCSRRP

SEQ ID NO: 184578 - protein, 9 aa, Homo Sapiens
GEHSSSSTS

SEQ ID NO: 184579 - protein, 9 aa, Homo Sapiens
PQVNSPRSS

SEQ ID NO: 184580 - protein, 9 aa, Homo Sapiens
SYGPQRGQY

SEQ ID NO: 184581 - protein, 9 aa, Homo Sapiens
NAKKAAANF

SEQ ID NO: 184582 - protein, 9 aa, Homo Sapiens
CPRAVILLL

SEQ ID NO: 184583 - protein, 9 aa, Homo Sapiens
IQRLPLFYT

SEQ ID NO: 184584 - protein, 9 aa, Homo Sapiens
SKNGFFRDI

SEQ ID NO: 184585 - protein, 9 aa, Homo Sapiens
ESDLLNPRK

SEQ ID NO: 184586 - protein, 9 aa, Homo Sapiens
EMQKFMEDL

SEQ ID NO: 184587 - protein, 9 aa, Homo Sapiens
IKKKTHTSL

SEQ ID NO: 184588 - protein, 9 aa, Homo Sapiens
LQSFANPAH

SEQ ID NO: 184589 - protein, 9 aa, Homo Sapiens
INFACSYPM

SEQ ID NO: 184590 - protein, 9 aa, Homo Sapiens
SWPPLLRPL

SEQ ID NO: 184591 - protein, 9 aa, Homo Sapiens
SQHKQGNDG

SEQ ID NO: 184592 - protein, 9 aa, Homo Sapiens
VVPNIPLVP

SEQ ID NO: 184593 - protein, 9 aa, Homo Sapiens
GFEDDPYGA

SEQ ID NO: 184594 - protein, 9 aa, Homo Sapiens
SAKKRASVS

SEQ ID NO: 184595 - protein, 9 aa, Homo Sapiens
GEGSPRQGC

SEQ ID NO: 184596 - protein, 9 aa, Homo Sapiens
GLILRERGI

SEQ ID NO: 184597 - protein, 9 aa, Homo Sapiens
DHMKNGPTR

SEQ ID NO: 184598 - protein, 9 aa, Homo Sapiens
ESPALKQVS

SEQ ID NO: 184599 - protein, 9 aa, Homo Sapiens
GEKLKGANP

SEQ ID NO: 184600 - protein, 9 aa, Homo Sapiens
LSQEAVAIC

SEQ ID NO: 184601 - protein, 9 aa, Homo Sapiens
PLKRDPQQG

SEQ ID NO: 184602 - protein, 9 aa, Homo Sapiens
CCPLPLPRP

SEQ ID NO: 184603 - protein, 9 aa, Homo Sapiens
KRGEFSGDD

SEQ ID NO: 184604 - protein, 9 aa, Homo Sapiens
NKKRKTANY

SEQ ID NO: 184605 - protein, 9 aa, Homo Sapiens
SVDNLPPSS

SEQ ID NO: 184606 - protein, 9 aa, Homo Sapiens
HHWAKVVLT

SEQ ID NO: 184607 - protein, 9 aa, Homo Sapiens
TVAKSNELF

SEQ ID NO: 184608 - protein, 9 aa, Homo Sapiens
DRDCSMPPL

SEQ ID NO: 184609 - protein, 9 aa, Homo Sapiens
SRGHAAVGA

SEQ ID NO: 184610 - protein, 9 aa, Homo Sapiens
LRAHRCTHA

SEQ ID NO: 184611 - protein, 9 aa, Homo Sapiens
ALTIIVGIM

SEQ ID NO: 184612 - protein, 9 aa, Homo Sapiens
LFHMRNHTF

SEQ ID NO: 184613 - protein, 9 aa, Homo Sapiens
MWDIQKDLK

SEQ ID NO: 184614 - protein, 9 aa, Homo Sapiens
HSPKPVAAS

SEQ ID NO: 184615 - protein, 9 aa, Homo Sapiens
LLLEVVQVG

SEQ ID NO: 184616 - protein, 9 aa, Homo Sapiens
APSDPLEPV

SEQ ID NO: 184617 - protein, 9 aa, Homo Sapiens
FGDPHSQIL

SEQ ID NO: 184618 - protein, 9 aa, Homo Sapiens
NVETEKKTQ

SEQ ID NO: 184619 - protein, 9 aa, Homo Sapiens
RRRKNQKRK

SEQ ID NO: 184620 - protein, 9 aa, Homo Sapiens
RLPARALQV

SEQ ID NO: 184621 - protein, 9 aa, Homo Sapiens
EPLLSVCPM

SEQ ID NO: 184622 - protein, 9 aa, Homo Sapiens
FIHGLVRES

SEQ ID NO: 184623 - protein, 9 aa, Homo Sapiens
YFYIKRRSM

SEQ ID NO: 184624 - protein, 9 aa, Homo Sapiens
KSIKDQLGS

SEQ ID NO: 184625 - protein, 9 aa, Homo Sapiens
GSCPPSRAA

SEQ ID NO: 184626 - protein, 9 aa, Homo Sapiens
EEVDLSVNQ

SEQ ID NO: 184627 - protein, 9 aa, Homo Sapiens
LQRSMAVCL

SEQ ID NO: 184628 - protein, 9 aa, Homo Sapiens
KTFLQQEHQ

SEQ ID NO: 184629 - protein, 9 aa, Homo Sapiens
EKTEIQLTM

SEQ ID NO: 184630 - protein, 9 aa, Homo Sapiens
VGNKHRDSF

SEQ ID NO: 184631 - protein, 9 aa, Homo Sapiens
TPLTIGEKT

SEQ ID NO: 184632 - protein, 9 aa, Homo Sapiens
DPIKHIRIG
